United States Patent 7,888,497 (BIOINFORMATICALLY DETECTABLE GROUP OF NOVEL REGULATORY OLIGONUCLEOTIDES AND USES THEREOF) - sequence listing, part 124

SEQ ID NO: 5254443 - DNA, 14 bp, Homo sapiens
atgaggtgctggga

SEQ ID NO: 5254444 - DNA, 15 bp, Homo sapiens
atgaggtgctgggag

SEQ ID NO: 5254445 - DNA, 18 bp, Homo sapiens
atgaggtgctgggaggga

SEQ ID NO: 5254446 - DNA, 13 bp, Homo sapiens
atgaggtgggagg

SEQ ID NO: 5254447 - DNA, 14 bp, Homo sapiens
atgaggtgggaggt

SEQ ID NO: 5254448 - DNA, 14 bp, Homo sapiens
atgaggttatgaga

SEQ ID NO: 5254449 - DNA, 14 bp, Homo sapiens
atgaggttctctct

SEQ ID NO: 5254450 - DNA, 16 bp, Homo sapiens
atgaggttctgagacc

SEQ ID NO: 5254451 - DNA, 18 bp, Homo sapiens
atgaggttctgagaccag

SEQ ID NO: 5254452 - DNA, 15 bp, Homo sapiens
atgaggttttggaaa

SEQ ID NO: 5254453 - DNA, 21 bp, Homo sapiens
atgagtaaaaaaaaaaacaat

SEQ ID NO: 5254454 - DNA, 18 bp, Homo sapiens
atgagtaaactgaggccc

SEQ ID NO: 5254455 - DNA, 13 bp, Homo sapiens
atgagtaaataaa

SEQ ID NO: 5254456 - DNA, 14 bp, Homo sapiens
atgagtaaataaac

SEQ ID NO: 5254457 - DNA, 17 bp, Homo sapiens
atgagtaacatttgctg

SEQ ID NO: 5254458 - DNA, 17 bp, Homo sapiens
atgagtacaaatgcctt

SEQ ID NO: 5254459 - DNA, 14 bp, Homo sapiens
atgagtacctcaaa

SEQ ID NO: 5254460 - DNA, 14 bp, Homo sapiens
atcccaccagcccc

SEQ ID NO: 5254461 - DNA, 20 bp, Homo sapiens
atcccaccagccccggcctt

SEQ ID NO: 5254462 - DNA, 20 bp, Homo sapiens
atcccacccaacagctcaga

SEQ ID NO: 5254463 - DNA, 18 bp, Homo sapiens
atcccacccacatgtgac

SEQ ID NO: 5254464 - DNA, 20 bp, Homo sapiens
atcccaccccatcctccagg

SEQ ID NO: 5254465 - DNA, 19 bp, Homo sapiens
atcccaccgacccttcctg

SEQ ID NO: 5254466 - DNA, 17 bp, Homo sapiens
atcccacctccagccca

SEQ ID NO: 5254467 - DNA, 18 bp, Homo sapiens
atcccacctccagcccac

SEQ ID NO: 5254468 - DNA, 13 bp, Homo sapiens
atcccaccttccc

SEQ ID NO: 5254469 - DNA, 18 bp, Homo sapiens
atcccacgcactccatga

SEQ ID NO: 5254470 - DNA, 22 bp, Homo sapiens
atcccacgttgatgtctgaacg

SEQ ID NO: 5254471 - DNA, 20 bp, Homo sapiens
atcccactaatgcaaactgg

SEQ ID NO: 5254472 - DNA, 12 bp, Homo sapiens
atcccactccac

SEQ ID NO: 5254473 - DNA, 14 bp, Homo sapiens
atcccactggaaga

SEQ ID NO: 5254474 - DNA, 20 bp, Homo sapiens
atcccacttagcagggacag

SEQ ID NO: 5254475 - DNA, 23 bp, Homo sapiens
atcccacttagccgcaccctgca

SEQ ID NO: 5254476 - DNA, 18 bp, Homo sapiens
atcccacttcctttccta

SEQ ID NO: 5254477 - DNA, 13 bp, Homo sapiens
atcccagaaatta

SEQ ID NO: 5254478 - DNA, 14 bp, Homo sapiens
atcccagaccagcc

SEQ ID NO: 5254479 - DNA, 18 bp, Homo sapiens
atcccagaccagccaagg

SEQ ID NO: 5254480 - DNA, 15 bp, Homo sapiens
atcccagagaacaat

SEQ ID NO: 5254481 - DNA, 16 bp, Homo sapiens
atcccagagaacaatc

SEQ ID NO: 5254482 - DNA, 21 bp, Homo sapiens
atcccagagcttcccaggatc

SEQ ID NO: 5254483 - DNA, 19 bp, Homo sapiens
atcccagataatggagaat

SEQ ID NO: 5254484 - DNA, 14 bp, Homo sapiens
atcccagcacctgc

SEQ ID NO: 5254485 - DNA, 22 bp, Homo sapiens
atcccagcacctgccagggccc

SEQ ID NO: 5254486 - DNA, 11 bp, Homo sapiens
atcccagcact

SEQ ID NO: 5254487 - DNA, 13 bp, Homo sapiens
atcccagcacttt

SEQ ID NO: 5254488 - DNA, 21 bp, Homo sapiens
atcccagcactttgggaggcc

SEQ ID NO: 5254489 - DNA, 15 bp, Homo sapiens
atcccagcagcccaa

SEQ ID NO: 5254490 - DNA, 17 bp, Homo sapiens
atcccagcagcccaagc

SEQ ID NO: 5254491 - DNA, 16 bp, Homo sapiens
atcccagccccctgac

SEQ ID NO: 5254492 - DNA, 19 bp, Homo sapiens
atcccagccccctgaccac

SEQ ID NO: 5254493 - DNA, 24 bp, Homo sapiens
atcccagccggccaatggaaacct

SEQ ID NO: 5254494 - DNA, 13 bp, Homo sapiens
atcccagcctggg

SEQ ID NO: 5254495 - DNA, 21 bp, Homo sapiens
atcccagctacccaggaggct

SEQ ID NO: 5254496 - DNA, 23 bp, Homo sapiens
atcccagctactcaagaggctga

SEQ ID NO: 5254497 - DNA, 18 bp, Homo sapiens
atcccagctacttgggaa

SEQ ID NO: 5254498 - DNA, 19 bp, Homo sapiens
atcccagctcactgcagcc

SEQ ID NO: 5254499 - DNA, 20 bp, Homo sapiens
atcccagctgctgaggcgaa

SEQ ID NO: 5254500 - DNA, 22 bp, Homo sapiens
atcccagcttcggcatttgatc

SEQ ID NO: 5254501 - DNA, 14 bp, Homo sapiens
atcccagcttgccc

SEQ ID NO: 5254502 - DNA, 22 bp, Homo sapiens
atcccagcttggttccaggaat

SEQ ID NO: 5254503 - DNA, 21 bp, Homo sapiens
atcccagctttaaaaagaaaa

SEQ ID NO: 5254504 - DNA, 17 bp, Homo sapiens
atcccaggaaagaggca

SEQ ID NO: 5254505 - DNA, 22 bp, Homo sapiens
atcccaggacaccacacccagc

SEQ ID NO: 5254506 - DNA, 18 bp, Homo sapiens
atcccaggaggggcctct

SEQ ID NO: 5254507 - DNA, 17 bp, Homo sapiens
atcccaggatgtacaag

SEQ ID NO: 5254508 - DNA, 18 bp, Homo sapiens
atcccaggcccctggagg

SEQ ID NO: 5254509 - DNA, 17 bp, Homo sapiens
atcccagggctggctct

SEQ ID NO: 5254510 - DNA, 18 bp, Homo sapiens
atcccagggtacactctt

SEQ ID NO: 5254511 - DNA, 22 bp, Homo sapiens
atcccagggtcccacccccaac

SEQ ID NO: 5254512 - DNA, 16 bp, Homo sapiens
atcccagtcactcctc

SEQ ID NO: 5254513 - DNA, 12 bp, Homo sapiens
atcccagtgtcc

SEQ ID NO: 5254514 - DNA, 18 bp, Homo sapiens
atcccagttcatgttgct

SEQ ID NO: 5254515 - DNA, 17 bp, Homo sapiens
atcccagttcttcctgc

SEQ ID NO: 5254516 - DNA, 23 bp, Homo sapiens
atcccagtttaatattccaatac

SEQ ID NO: 5254517 - DNA, 11 bp, Homo sapiens
atcccagtttg

SEQ ID NO: 5254518 - DNA, 14 bp, Homo sapiens
atcccatactctca

SEQ ID NO: 5254519 - DNA, 24 bp, Homo sapiens
atcccatatgcctgggcagaagga

SEQ ID NO: 5254520 - DNA, 16 bp, Homo sapiens
atcccatccatcagct

SEQ ID NO: 5254521 - DNA, 11 bp, Homo sapiens
atcccatccca

SEQ ID NO: 5254522 - DNA, 15 bp, Homo sapiens
atcccatccctttct

SEQ ID NO: 5254523 - DNA, 21 bp, Homo sapiens
atcccatcgtctcggccttca

SEQ ID NO: 5254524 - DNA, 15 bp, Homo sapiens
atcccatctctacaa

SEQ ID NO: 5254525 - DNA, 14 bp, Homo sapiens
atcccatctctccc

SEQ ID NO: 5254526 - DNA, 15 bp, Homo sapiens
atcccatctgctaga

SEQ ID NO: 5254527 - DNA, 16 bp, Homo sapiens
atcccatgaacacact

SEQ ID NO: 5254528 - DNA, 18 bp, Homo sapiens
atcccatgagcctcagca

SEQ ID NO: 5254529 - DNA, 15 bp, Homo sapiens
atcccattccaggca

SEQ ID NO: 5254530 - DNA, 16 bp, Homo sapiens
atcccattctgcgtca

SEQ ID NO: 5254531 - DNA, 16 bp, Homo sapiens
atcccattctttataa

SEQ ID NO: 5254532 - DNA, 18 bp, Homo sapiens
atcccattgtatttaaaa

SEQ ID NO: 5254533 - DNA, 20 bp, Homo sapiens
atcccattgtatttaaaaca

SEQ ID NO: 5254534 - DNA, 21 bp, Homo sapiens
atcccattgtcttctgacctc

SEQ ID NO: 5254535 - DNA, 14 bp, Homo sapiens
atcccatttaaaaa

SEQ ID NO: 5254536 - DNA, 15 bp, Homo sapiens
atcccatttcccaaa

SEQ ID NO: 5254537 - DNA, 17 bp, Homo sapiens
atcccattttcatcctg

SEQ ID NO: 5254538 - DNA, 18 bp, Homo sapiens
atcccattttcatcctga

SEQ ID NO: 5254539 - DNA, 22 bp, Homo sapiens
atcccattttcatcctgagccc

SEQ ID NO: 5254540 - DNA, 17 bp, Homo sapiens
atccccaaaaaagcgaa

SEQ ID NO: 5254541 - DNA, 15 bp, Homo sapiens
atccccaaactcctt

SEQ ID NO: 5254542 - DNA, 17 bp, Homo sapiens
atccccaaactccttta

SEQ ID NO: 5254543 - DNA, 21 bp, Homo sapiens
atccccaaaggtcaaaaacaa

SEQ ID NO: 5254544 - DNA, 20 bp, Homo sapiens
atccccaacatgcactgatg

SEQ ID NO: 5254545 - DNA, 14 bp, Homo sapiens
atccccaaccccct

SEQ ID NO: 5254546 - DNA, 12 bp, Homo sapiens
atccccaactcc

SEQ ID NO: 5254547 - DNA, 21 bp, Homo sapiens
atccccaactccatggggttc

SEQ ID NO: 5254548 - DNA, 16 bp, Homo sapiens
atccccaactgctcca

SEQ ID NO: 5254549 - DNA, 16 bp, Homo sapiens
atccccaagcccacca

SEQ ID NO: 5254550 - DNA, 18 bp, Homo sapiens
atccccaagcctggcaag

SEQ ID NO: 5254551 - DNA, 13 bp, Homo sapiens
atccccaagctgg

SEQ ID NO: 5254552 - DNA, 14 bp, Homo sapiens
atccccaagtgtga

SEQ ID NO: 5254553 - DNA, 16 bp, Homo sapiens
atccccaccagctcgt

SEQ ID NO: 5254554 - DNA, 13 bp, Homo sapiens
atccccaccccac

SEQ ID NO: 5254555 - DNA, 15 bp, Homo sapiens
atccccaccccaccc

SEQ ID NO: 5254556 - DNA, 15 bp, Homo sapiens
atccccacctgtctt

SEQ ID NO: 5254557 - DNA, 19 bp, Homo sapiens
atccccaccttcacctcgg

SEQ ID NO: 5254558 - DNA, 17 bp, Homo sapiens
atccccacgacccctgc

SEQ ID NO: 5254559 - DNA, 20 bp, Homo sapiens
atccccacgccacagccctt

SEQ ID NO: 5254560 - DNA, 13 bp, Homo sapiens
atccccactcctc

SEQ ID NO: 5254561 - DNA, 15 bp, Homo sapiens
atccccactgtccta

SEQ ID NO: 5254562 - DNA, 20 bp, Homo sapiens
atccccagacttcatagaat

SEQ ID NO: 5254563 - DNA, 23 bp, Homo sapiens
atccccagagcccagctcttgct

SEQ ID NO: 5254564 - DNA, 12 bp, Homo sapiens
atccccagccag

SEQ ID NO: 5254565 - DNA, 11 bp, Homo sapiens
atccccagccc

SEQ ID NO: 5254566 - DNA, 23 bp, Homo sapiens
atccccagccccctggcccctcc

SEQ ID NO: 5254567 - DNA, 19 bp, Homo sapiens
atccccagcccctcctccc

SEQ ID NO: 5254568 - DNA, 22 bp, Homo sapiens
atccccagcccctcctccctca

SEQ ID NO: 5254569 - DNA, 22 bp, Homo sapiens
atccccagctggtggccctgtg

SEQ ID NO: 5254570 - DNA, 17 bp, Homo sapiens
atccccagctttctcct

SEQ ID NO: 5254571 - DNA, 14 bp, Homo sapiens
atccccaggccagg

SEQ ID NO: 5254572 - DNA, 15 bp, Homo sapiens
atccccaggccaggt

SEQ ID NO: 5254573 - DNA, 16 bp, Homo sapiens
atccccaggccaggtc

SEQ ID NO: 5254574 - DNA, 13 bp, Homo sapiens
atccccagggaca

SEQ ID NO: 5254575 - DNA, 22 bp, Homo sapiens
atccccagggggcatgaccaga

SEQ ID NO: 5254576 - DNA, 21 bp, Homo sapiens
atccccagtaaaattgccata

SEQ ID NO: 5254577 - DNA, 18 bp, Homo sapiens
atccccagtgccagctgg

SEQ ID NO: 5254578 - DNA, 13 bp, Homo sapiens
atccccagtgccc

SEQ ID NO: 5254579 - DNA, 22 bp, Homo sapiens
atccccagttttccatggtgta

SEQ ID NO: 5254580 - DNA, 16 bp, Homo sapiens
atccccatcggccctg

SEQ ID NO: 5254581 - DNA, 18 bp, Homo sapiens
atccccatctccctgcct

SEQ ID NO: 5254582 - DNA, 18 bp, Homo sapiens
atccccatggaacagccc

SEQ ID NO: 5254583 - DNA, 20 bp, Homo sapiens
atccccatggaacagccctg

SEQ ID NO: 5254584 - DNA, 18 bp, Homo sapiens
atcccccactgccacacc

SEQ ID NO: 5254585 - DNA, 20 bp, Homo sapiens
atcccccactgccacaccct

SEQ ID NO: 5254586 - DNA, 11 bp, Homo sapiens
atcccccaggg

SEQ ID NO: 5254587 - DNA, 20 bp, Homo sapiens
atccccccatcttgcttccc

SEQ ID NO: 5254588 - DNA, 15 bp, Homo sapiens
atcccccccagcctg

SEQ ID NO: 5254589 - DNA, 17 bp, Homo sapiens
atcccccccagcctggc

SEQ ID NO: 5254590 - DNA, 13 bp, Homo sapiens
atcccccctgctg

SEQ ID NO: 5254591 - DNA, 16 bp, Homo sapiens
atcccccgccccatcc

SEQ ID NO: 5254592 - DNA, 19 bp, Homo sapiens
atccccctcctctccctgt

SEQ ID NO: 5254593 - DNA, 12 bp, Homo sapiens
atccccctctca

SEQ ID NO: 5254594 - DNA, 23 bp, Homo sapiens
atccccctctcacgccacccccg

SEQ ID NO: 5254595 - DNA, 16 bp, Homo sapiens
atccccctctgtctgc

SEQ ID NO: 5254596 - DNA, 12 bp, Homo sapiens
atccccctgccc

SEQ ID NO: 5254597 - DNA, 12 bp, Homo sapiens
atccccctgtgg

SEQ ID NO: 5254598 - DNA, 12 bp, Homo sapiens
atcccccttaaa

SEQ ID NO: 5254599 - DNA, 14 bp, Homo sapiens
atcccccttgccac

SEQ ID NO: 5254600 - DNA, 14 bp, Homo sapiens
atccccgcctggcc

SEQ ID NO: 5254601 - DNA, 19 bp, Homo sapiens
atccccgcttccccttgcc

SEQ ID NO: 5254602 - DNA, 13 bp, Homo sapiens
atccccggctgct

SEQ ID NO: 5254603 - DNA, 22 bp, Homo sapiens
atccccgtctctgccctgggct

SEQ ID NO: 5254604 - DNA, 19 bp, Homo sapiens
atccccgtgctcacagtag

SEQ ID NO: 5254605 - DNA, 19 bp, Homo sapiens
atccccgttcctgacatca

SEQ ID NO: 5254606 - DNA, 23 bp, Homo sapiens
atcccctaactgatttccatcca

SEQ ID NO: 5254607 - DNA, 23 bp, Homo sapiens
atcccctcaacaccctgcttctc

SEQ ID NO: 5254608 - DNA, 20 bp, Homo sapiens
atcccctcagcctcttctct

SEQ ID NO: 5254609 - DNA, 13 bp, Homo sapiens
atcccctccccca

SEQ ID NO: 5254610 - DNA, 16 bp, Homo sapiens
atcccctccctgcctg

SEQ ID NO: 5254611 - DNA, 14 bp, Homo sapiens
atcccctccttggg

SEQ ID NO: 5254612 - DNA, 20 bp, Homo sapiens
atcccctcgtcctgtcccag

SEQ ID NO: 5254613 - DNA, 13 bp, Homo sapiens
atcccctgcctct

SEQ ID NO: 5254614 - DNA, 14 bp, Homo sapiens
atcccctgcctcta

SEQ ID NO: 5254615 - DNA, 19 bp, Homo sapiens
atcccctgctactccactg

SEQ ID NO: 5254616 - DNA, 15 bp, Homo sapiens
atcccctgtagagtg

SEQ ID NO: 5254617 - DNA, 19 bp, Homo sapiens
atcccctgtcccctggggc

SEQ ID NO: 5254618 - DNA, 13 bp, Homo sapiens
atccccttaccct

SEQ ID NO: 5254619 - DNA, 18 bp, Homo sapiens
atccccttcctaccaccc

SEQ ID NO: 5254620 - DNA, 15 bp, Homo sapiens
atccccttctcccct

SEQ ID NO: 5254621 - DNA, 20 bp, Homo sapiens
atccccttctcccctgcact

SEQ ID NO: 5254622 - DNA, 21 bp, Homo sapiens
atccccttctcccctgcactg

SEQ ID NO: 5254623 - DNA, 12 bp, Homo sapiens
atccccttgaac

SEQ ID NO: 5254624 - DNA, 16 bp, Homo sapiens
atccccttgaactctt

SEQ ID NO: 5254625 - DNA, 22 bp, Homo sapiens
atccccttgaggtctcagcccc

SEQ ID NO: 5254626 - DNA, 13 bp, Homo sapiens
atcccctttcctc

SEQ ID NO: 5254627 - DNA, 14 bp, Homo sapiens
atcccctttcctcc

SEQ ID NO: 5254628 - DNA, 15 bp, Homo sapiens
atcccctttcctccc

SEQ ID NO: 5254629 - DNA, 16 bp, Homo sapiens
atcccgatacctcagc

SEQ ID NO: 5254630 - DNA, 17 bp, Homo sapiens
atcccgatacctcagcc

SEQ ID NO: 5254631 - DNA, 22 bp, Homo sapiens
atcccgcagatggctggaatat

SEQ ID NO: 5254632 - DNA, 16 bp, Homo sapiens
atcccgccacctatct

SEQ ID NO: 5254633 - DNA, 17 bp, Homo sapiens
atcccgccttctccagg

SEQ ID NO: 5254634 - DNA, 13 bp, Homo sapiens
atcccgcttagcc

SEQ ID NO: 5254635 - DNA, 18 bp, Homo sapiens
atcccgcttagcctgcct

SEQ ID NO: 5254636 - DNA, 20 bp, Homo sapiens
atcccgcttagcctgcctca

SEQ ID NO: 5254637 - DNA, 23 bp, Homo sapiens
atcccgcttagcgctctggacag

SEQ ID NO: 5254638 - DNA, 24 bp, Homo sapiens
atcccgcttctgaagctgctgcag

SEQ ID NO: 5254639 - DNA, 18 bp, Homo sapiens
atgagtagcttatacaat

SEQ ID NO: 5254640 - DNA, 16 bp, Homo sapiens
atgagtatctgtggga

SEQ ID NO: 5254641 - DNA, 17 bp, Homo sapiens
atgagtatttggtccaa

SEQ ID NO: 5254642 - DNA, 17 bp, Homo sapiens
atgagtcaatgtgcagt

SEQ ID NO: 5254643 - DNA, 19 bp, Homo sapiens
atgagtcaatgtgcagtgt

SEQ ID NO: 5254644 - DNA, 20 bp, Homo sapiens
atgagtcagacatttggtat

SEQ ID NO: 5254645 - DNA, 22 bp, Homo sapiens
atgagtcagtgaagtctagaat

SEQ ID NO: 5254646 - DNA, 16 bp, Homo sapiens
atgagtccaaactgga

SEQ ID NO: 5254647 - DNA, 16 bp, Homo sapiens
atgagtcccagtggga

SEQ ID NO: 5254648 - DNA, 13 bp, Homo sapiens
atgagtcctgtta

SEQ ID NO: 5254649 - DNA, 19 bp, Homo sapiens
atgagtccttgatttcaaa

SEQ ID NO: 5254650 - DNA, 21 bp, Homo sapiens
atgagtccttgatttcaaagt

SEQ ID NO: 5254651 - DNA, 17 bp, Homo sapiens
atgagtctagtttcatt

SEQ ID NO: 5254652 - DNA, 16 bp, Homo sapiens
atgagtctccagatag

SEQ ID NO: 5254653 - DNA, 14 bp, Homo sapiens
atgagtctgtagga

SEQ ID NO: 5254654 - DNA, 14 bp, Homo sapiens
atgagtctgtttcc

SEQ ID NO: 5254655 - DNA, 17 bp, Homo sapiens
atgagtctgtttcccaa

SEQ ID NO: 5254656 - DNA, 17 bp, Homo sapiens
atgagtgaataaatgtc

SEQ ID NO: 5254657 - DNA, 22 bp, Homo sapiens
atgagtgattgacacacagcac

SEQ ID NO: 5254658 - DNA, 17 bp, Homo sapiens
atgagtgcgtgctcagt

SEQ ID NO: 5254659 - DNA, 20 bp, Homo sapiens
atgagtggccagcgccaggg

SEQ ID NO: 5254660 - DNA, 13 bp, Homo sapiens
atgagtgggaatc

SEQ ID NO: 5254661 - DNA, 22 bp, Homo sapiens
atgagtgggcttcggagtgaat

SEQ ID NO: 5254662 - DNA, 22 bp, Homo sapiens
atgagtgggttagctacctgct

SEQ ID NO: 5254663 - DNA, 16 bp, Homo sapiens
atgagtgtaacaagaa

SEQ ID NO: 5254664 - DNA, 17 bp, Homo sapiens
atgagtgtaacaagaaa

SEQ ID NO: 5254665 - DNA, 23 bp, Homo sapiens
atgagtgtaacaagaaaggagag

SEQ ID NO: 5254666 - DNA, 19 bp, Homo sapiens
atgagtgtcaactccagga

SEQ ID NO: 5254667 - DNA, 18 bp, Homo sapiens
atgagtgttgggagggga

SEQ ID NO: 5254668 - DNA, 12 bp, Homo sapiens
atgagttacctc

SEQ ID NO: 5254669 - DNA, 18 bp, Homo sapiens
atgagttacttagaatgc

SEQ ID NO: 5254670 - DNA, 16 bp, Homo sapiens
atgagttagaggagaa

SEQ ID NO: 5254671 - DNA, 14 bp, Homo sapiens
atgagttattatct

SEQ ID NO: 5254672 - DNA, 18 bp, Homo sapiens
atgagttcaaatactttt

SEQ ID NO: 5254673 - DNA, 16 bp, Homo sapiens
atgagttcacatgtgc

SEQ ID NO: 5254674 - DNA, 19 bp, Homo sapiens
atgagttccctaaacaaaa

SEQ ID NO: 5254675 - DNA, 22 bp, Homo sapiens
atgagttctgcacatacagatg

SEQ ID NO: 5254676 - DNA, 15 bp, Homo sapiens
atgagttgaaatgtt

SEQ ID NO: 5254677 - DNA, 20 bp, Homo sapiens
atgagttgctggaaaatcat

SEQ ID NO: 5254678 - DNA, 14 bp, Homo sapiens
atgagttggacttc

SEQ ID NO: 5254679 - DNA, 19 bp, Homo sapiens
atgagttgttttcagactc

SEQ ID NO: 5254680 - DNA, 20 bp, Homo sapiens
atgagttgttttcagactca

SEQ ID NO: 5254681 - DNA, 18 bp, Homo sapiens
atgagtttaaaaaaataa

SEQ ID NO: 5254682 - DNA, 19 bp, Homo sapiens
atgagtttaaaaaaataac

SEQ ID NO: 5254683 - DNA, 20 bp, Homo sapiens
atgagtttaaaaaaataaca

SEQ ID NO: 5254684 - DNA, 22 bp, Homo sapiens
atgagtttaaaaatcaactttt

SEQ ID NO: 5254685 - DNA, 22 bp, Homo sapiens
atgagtttcacagtgtgatttt

SEQ ID NO: 5254686 - DNA, 23 bp, Homo sapiens
atgagtttcactgtactgcatgt

SEQ ID NO: 5254687 - DNA, 19 bp, Homo sapiens
atgagtttctggggaaaaa

SEQ ID NO: 5254688 - DNA, 14 bp, Homo sapiens
atgagtttcttaga

SEQ ID NO: 5254689 - DNA, 14 bp, Homo sapiens
atgagtttgcttat

SEQ ID NO: 5254690 - DNA, 12 bp, Homo sapiens
atgagtttgtat

SEQ ID NO: 5254691 - DNA, 23 bp, Homo sapiens
atgagtttgtattattacaaata

SEQ ID NO: 5254692 - DNA, 14 bp, Homo sapiens
atgagttttaacaa

SEQ ID NO: 5254693 - DNA, 13 bp, Homo sapiens
atgagtttttccc

SEQ ID NO: 5254694 - DNA, 20 bp, Homo sapiens
atgagtttttgatagcttta

SEQ ID NO: 5254695 - DNA, 21 bp, Homo sapiens
atgagtttttgatagctttat

SEQ ID NO: 5254696 - DNA, 15 bp, Homo sapiens
atgataaaaaatttt

SEQ ID NO: 5254697 - DNA, 13 bp, Homo sapiens
atgataaaaggaa

SEQ ID NO: 5254698 - DNA, 19 bp, Homo sapiens
atgataaaaggagaataag

SEQ ID NO: 5254699 - DNA, 14 bp, Homo sapiens
atgataaaataaat

SEQ ID NO: 5254700 - DNA, 21 bp, Homo sapiens
atgataaaataaataatttta

SEQ ID NO: 5254701 - DNA, 13 bp, Homo sapiens
atgataaaataag

SEQ ID NO: 5254702 - DNA, 12 bp, Homo sapiens
atgataaaatag

SEQ ID NO: 5254703 - DNA, 15 bp, Homo sapiens
atgataaacattcat

SEQ ID NO: 5254704 - DNA, 21 bp, Homo sapiens
atgataaactcagatctgatc

SEQ ID NO: 5254705 - DNA, 15 bp, Homo sapiens
atgataaagactttt

SEQ ID NO: 5254706 - DNA, 20 bp, Homo sapiens
atgataaagatgtcaaatat

SEQ ID NO: 5254707 - DNA, 15 bp, Homo sapiens
atgataaaggaaata

SEQ ID NO: 5254708 - DNA, 13 bp, Homo sapiens
atgataaagttgt

SEQ ID NO: 5254709 - DNA, 16 bp, Homo sapiens
atgataaatttaaatg

SEQ ID NO: 5254710 - DNA, 17 bp, Homo sapiens
atgataaatttaaatga

SEQ ID NO: 5254711 - DNA, 14 bp, Homo sapiens
atgataacagaact

SEQ ID NO: 5254712 - DNA, 17 bp, Homo sapiens
atgataactatttacat

SEQ ID NO: 5254713 - DNA, 19 bp, Homo sapiens
atgataactgcatttggta

SEQ ID NO: 5254714 - DNA, 22 bp, Homo sapiens
atgataaggtttagaatgacag

SEQ ID NO: 5254715 - DNA, 20 bp, Homo sapiens
atgataagttcctttccttt

SEQ ID NO: 5254716 - DNA, 15 bp, Homo sapiens
atgataatagattct

SEQ ID NO: 5254717 - DNA, 13 bp, Homo sapiens
atgataatagctc

SEQ ID NO: 5254718 - DNA, 20 bp, Homo sapiens
atgataatagctcacagcac

SEQ ID NO: 5254719 - DNA, 18 bp, Homo sapiens
atgataatgataacttgt

SEQ ID NO: 5254720 - DNA, 15 bp, Homo sapiens
atgataattacaata

SEQ ID NO: 5254721 - DNA, 17 bp, Homo sapiens
atgataattatttacaa

SEQ ID NO: 5254722 - DNA, 17 bp, Homo sapiens
atgatacaatgaacact

SEQ ID NO: 5254723 - DNA, 17 bp, Homo sapiens
atgatacagtgttaaaa

SEQ ID NO: 5254724 - DNA, 22 bp, Homo sapiens
atgataccagcagcaactgaaa

SEQ ID NO: 5254725 - DNA, 18 bp, Homo sapiens
atgatactcatttcttat

SEQ ID NO: 5254726 - DNA, 18 bp, Homo sapiens
atgatactgattatgaaa

SEQ ID NO: 5254727 - DNA, 20 bp, Homo sapiens
atgatactgattatgaaatg

SEQ ID NO: 5254728 - DNA, 13 bp, Homo sapiens
atgatactgctgc

SEQ ID NO: 5254729 - DNA, 15 bp, Homo sapiens
atgatactgtctaag

SEQ ID NO: 5254730 - DNA, 23 bp, Homo sapiens
atgatactgtctctccagtgaaa

SEQ ID NO: 5254731 - DNA, 14 bp, Homo sapiens
atgatactgtttct

SEQ ID NO: 5254732 - DNA, 21 bp, Homo sapiens
atgatactgtttcttgcactg

SEQ ID NO: 5254733 - DNA, 19 bp, Homo sapiens
atgatacttattcaaaaaa

SEQ ID NO: 5254734 - DNA, 16 bp, Homo sapiens
atgatacttcgacact

SEQ ID NO: 5254735 - DNA, 15 bp, Homo sapiens
atgatacttggtcct

SEQ ID NO: 5254736 - DNA, 22 bp, Homo sapiens
atgatagaactgtactgttttc

SEQ ID NO: 5254737 - DNA, 18 bp, Homo sapiens
atgatagatttgacctcc

SEQ ID NO: 5254738 - DNA, 20 bp, Homo sapiens
atgatagatttgacctcctc

SEQ ID NO: 5254739 - DNA, 18 bp, Homo sapiens
atgatagcagacattgtt

SEQ ID NO: 5254740 - DNA, 22 bp, Homo sapiens
atgataggttaataaagatgat

SEQ ID NO: 5254741 - DNA, 16 bp, Homo sapiens
atgatagtgcaaggaa

SEQ ID NO: 5254742 - DNA, 13 bp, Homo sapiens
atgatagtgtgat

SEQ ID NO: 5254743 - DNA, 17 bp, Homo sapiens
atgatagtgtgattttt

SEQ ID NO: 5254744 - DNA, 12 bp, Homo sapiens
atgatagttaaa

SEQ ID NO: 5254745 - DNA, 19 bp, Homo sapiens
atgatagtttgtcctgtgt

SEQ ID NO: 5254746 - DNA, 21 bp, Homo sapiens
atgatagttttctagatgaca

SEQ ID NO: 5254747 - DNA, 23 bp, Homo sapiens
atgatagttttctagatgacata

SEQ ID NO: 5254748 - DNA, 16 bp, Homo sapiens
atgatataaggttttt

SEQ ID NO: 5254749 - DNA, 18 bp, Homo sapiens
atgatatacaatggttaa

SEQ ID NO: 5254750 - DNA, 14 bp, Homo sapiens
atgatatataaacc

SEQ ID NO: 5254751 - DNA, 21 bp, Homo sapiens
atgatatatatgtataatttc

SEQ ID NO: 5254752 - DNA, 13 bp, Homo sapiens
atgatatcattgt

SEQ ID NO: 5254753 - DNA, 19 bp, Homo sapiens
atgatatctatatatgtat

SEQ ID NO: 5254754 - DNA, 18 bp, Homo sapiens
atgatatctatattctaa

SEQ ID NO: 5254755 - DNA, 12 bp, Homo sapiens
atgatatgcatg

SEQ ID NO: 5254756 - DNA, 22 bp, Homo sapiens
atgatatgtaaacataattctt

SEQ ID NO: 5254757 - DNA, 13 bp, Homo sapiens
atgatatgtgctt

SEQ ID NO: 5254758 - DNA, 23 bp, Homo sapiens
atgatatgtgcttgtgtgtatgt

SEQ ID NO: 5254759 - DNA, 16 bp, Homo sapiens
atgatattaagaactg

SEQ ID NO: 5254760 - DNA, 19 bp, Homo sapiens
atgatattccatagtatat

SEQ ID NO: 5254761 - DNA, 20 bp, Homo sapiens
atgatattctcattatttca

SEQ ID NO: 5254762 - DNA, 16 bp, Homo sapiens
atgatattgacactgt

SEQ ID NO: 5254763 - DNA, 23 bp, Homo sapiens
atgatattgctgaagaatctact

SEQ ID NO: 5254764 - DNA, 24 bp, Homo sapiens
atgatattggaggaatacttctga

SEQ ID NO: 5254765 - DNA, 14 bp, Homo sapiens
atgatattgtttaa

SEQ ID NO: 5254766 - DNA, 19 bp, Homo sapiens
atgatattgtttaaaattc

SEQ ID NO: 5254767 - DNA, 22 bp, Homo sapiens
atgatattgtttaaaattcagt

SEQ ID NO: 5254768 - DNA, 17 bp, Homo sapiens
atgatattttaaaatct

SEQ ID NO: 5254769 - DNA, 12 bp, Homo sapiens
atgatattttat

SEQ ID NO: 5254770 - DNA, 20 bp, Homo sapiens
atgatatttttttaagtctt

SEQ ID NO: 5254771 - DNA, 16 bp, Homo sapiens
atgatcaaaacatgct

SEQ ID NO: 5254772 - DNA, 19 bp, Homo sapiens
atgatcaaaacctgtgcca

SEQ ID NO: 5254773 - DNA, 15 bp, Homo sapiens
atgatcaaaatgcat

SEQ ID NO: 5254774 - DNA, 20 bp, Homo sapiens
atgatcaaaatgcatacgta

SEQ ID NO: 5254775 - DNA, 17 bp, Homo sapiens
atgatcaaagttttgat

SEQ ID NO: 5254776 - DNA, 13 bp, Homo sapiens
atgatcaaatgtt

SEQ ID NO: 5254777 - DNA, 17 bp, Homo sapiens
atgatcaaatgtttaat

SEQ ID NO: 5254778 - DNA, 14 bp, Homo sapiens
atgatcaaattttg

SEQ ID NO: 5254779 - DNA, 13 bp, Homo sapiens
atgatcaagatat

SEQ ID NO: 5254780 - DNA, 15 bp, Homo sapiens
atgatcaaggaggga

SEQ ID NO: 5254781 - DNA, 16 bp, Homo sapiens
atgatcaaggagggag

SEQ ID NO: 5254782 - DNA, 15 bp, Homo sapiens
atgatcacagtgact

SEQ ID NO: 5254783 - DNA, 18 bp, Homo sapiens
atgatcacagtgacttta

SEQ ID NO: 5254784 - DNA, 19 bp, Homo sapiens
atgatcaccatgttagcct

SEQ ID NO: 5254785 - DNA, 14 bp, Homo sapiens
atgatcaccctgaa

SEQ ID NO: 5254786 - DNA, 23 bp, Homo sapiens
atgatcacggctcactgcagcct

SEQ ID NO: 5254787 - DNA, 15 bp, Homo sapiens
atgatcactgtgaaa

SEQ ID NO: 5254788 - DNA, 22 bp, Homo sapiens
atgatcagaactgggaaaacag

SEQ ID NO: 5254789 - DNA, 16 bp, Homo sapiens
atgatcagacttgatt

SEQ ID NO: 5254790 - DNA, 20 bp, Homo sapiens
atgatcagacttgatttaca

SEQ ID NO: 5254791 - DNA, 18 bp, Homo sapiens
atgatcagctgtttgtca

SEQ ID NO: 5254792 - DNA, 17 bp, Homo sapiens
atgatcaggtaactttc

SEQ ID NO: 5254793 - DNA, 22 bp, Homo sapiens
atgatcataaaagtgattcttt

SEQ ID NO: 5254794 - DNA, 21 bp, Homo sapiens
atgatcatctgaatcccgggc

SEQ ID NO: 5254795 - DNA, 15 bp, Homo sapiens
atgatcatgatgatg

SEQ ID NO: 5254796 - DNA, 16 bp, Homo sapiens
atgatcatgatgatga

SEQ ID NO: 5254797 - DNA, 14 bp, Homo sapiens
atgatcatgtaaat

SEQ ID NO: 5254798 - DNA, 19 bp, Homo sapiens
atgatcattgaaatacttt

SEQ ID NO: 5254799 - DNA, 21 bp, Homo sapiens
atgatcattgaaatacttttt

SEQ ID NO: 5254800 - DNA, 22 bp, Homo sapiens
atgatcatttgcccttaaggac

SEQ ID NO: 5254801 - DNA, 20 bp, Homo sapiens
atgatccacccacctcagcc

SEQ ID NO: 5254802 - DNA, 15 bp, Homo sapiens
atgatccagaacagt

SEQ ID NO: 5254803 - DNA, 21 bp, Homo sapiens
atgatccagaacagtggctcg

SEQ ID NO: 5254804 - DNA, 19 bp, Homo sapiens
atgatccagcagattattc

SEQ ID NO: 5254805 - DNA, 15 bp, Homo sapiens
atgatccatttgaac

SEQ ID NO: 5254806 - DNA, 22 bp, Homo sapiens
atgatccccgtctctgccctgg

SEQ ID NO: 5254807 - DNA, 23 bp, Homo sapiens
atgatccccgtctctgccctggg

SEQ ID NO: 5254808 - DNA, 13 bp, Homo sapiens
atgatccctgtgt

SEQ ID NO: 5254809 - DNA, 20 bp, Homo sapiens
atgatccctgtgttgtctct

SEQ ID NO: 5254810 - DNA, 19 bp, Homo sapiens
atgatcccttccccctgct

SEQ ID NO: 5254811 - DNA, 22 bp, Homo sapiens
atgatccggatttaatttgata

SEQ ID NO: 5254812 - DNA, 16 bp, Homo sapiens
atgatcctagtaattg

SEQ ID NO: 5254813 - DNA, 12 bp, Homo sapiens
atgatcctcagt

SEQ ID NO: 5254814 - DNA, 14 bp, Homo sapiens
atgatcctctattt

SEQ ID NO: 5254815 - DNA, 13 bp, Homo sapiens
atgatccttccta

SEQ ID NO: 5254816 - DNA, 16 bp, Homo sapiens
atgatccttcctactt

SEQ ID NO: 5254817 - DNA, 23 bp, Homo sapiens
atcccggagcgcacctgcttccc

SEQ ID NO: 5254818 - DNA, 15 bp, Homo sapiens
atcccggaggaaatc

SEQ ID NO: 5254819 - DNA, 21 bp, Homo sapiens
atcccggccggccctggcttg

SEQ ID NO: 5254820 - DNA, 18 bp, Homo sapiens
atcccggctgaccctgtg

SEQ ID NO: 5254821 - DNA, 13 bp, Homo sapiens
atcccgggcctca

SEQ ID NO: 5254822 - DNA, 19 bp, Homo sapiens
atcccgggcctcagtgccc

SEQ ID NO: 5254823 - DNA, 21 bp, Homo sapiens
atcccgtaagaccaccttccc

SEQ ID NO: 5254824 - DNA, 18 bp, Homo sapiens
atcccgtatcacagtgtt

SEQ ID NO: 5254825 - DNA, 13 bp, Homo sapiens
atcccgtcttcca

SEQ ID NO: 5254826 - DNA, 20 bp, Homo sapiens
atcccgtgcaaaacatgcta

SEQ ID NO: 5254827 - DNA, 14 bp, Homo sapiens
atcccgtgctttta

SEQ ID NO: 5254828 - DNA, 16 bp, Homo sapiens
atcccgttcagaaaac

SEQ ID NO: 5254829 - DNA, 23 bp, Homo sapiens
atcccgttcagaaaaccacttta

SEQ ID NO: 5254830 - DNA, 16 bp, Homo sapiens
atcccgtttccctcca

SEQ ID NO: 5254831 - DNA, 15 bp, Homo sapiens
atcccgttttcccca

SEQ ID NO: 5254832 - DNA, 18 bp, Homo sapiens
atcccgttttccccatga

SEQ ID NO: 5254833 - DNA, 16 bp, Homo sapiens
atccctaacaggctgt

SEQ ID NO: 5254834 - DNA, 17 bp, Homo sapiens
atccctaagaattccca

SEQ ID NO: 5254835 - DNA, 12 bp, Homo sapiens
atccctacatgt

SEQ ID NO: 5254836 - DNA, 21 bp, Homo sapiens
atccctaccccctaagagcca

SEQ ID NO: 5254837 - DNA, 22 bp, Homo sapiens
atccctaccccctaagagccat

SEQ ID NO: 5254838 - DNA, 22 bp, Homo sapiens
atccctagactttaggctttca

SEQ ID NO: 5254839 - DNA, 20 bp, Homo sapiens
atccctagtccccctgtttt

SEQ ID NO: 5254840 - DNA, 21 bp, Homo sapiens
atccctagtccccctgttttc

SEQ ID NO: 5254841 - DNA, 19 bp, Homo sapiens
atccctagtcttcaagcag

SEQ ID NO: 5254842 - DNA, 21 bp, Homo sapiens
atccctagtcttcaagcagat

SEQ ID NO: 5254843 - DNA, 19 bp, Homo sapiens
atccctatgctgcctaggc

SEQ ID NO: 5254844 - DNA, 20 bp, Homo sapiens
atccctattagatacacttc

SEQ ID NO: 5254845 - DNA, 19 bp, Homo sapiens
atccctcacccatcctaga

SEQ ID NO: 5254846 - DNA, 13 bp, Homo sapiens
atccctcacctgt

SEQ ID NO: 5254847 - DNA, 17 bp, Homo sapiens
atccctcacctgtagca

SEQ ID NO: 5254848 - DNA, 17 bp, Homo sapiens
atccctcaccttctgag

SEQ ID NO: 5254849 - DNA, 18 bp, Homo sapiens
atccctcaccttctgagt

SEQ ID NO: 5254850 - DNA, 14 bp, Homo sapiens
atccctcatcctca

SEQ ID NO: 5254851 - DNA, 14 bp, Homo sapiens
atccctcatcctga

SEQ ID NO: 5254852 - DNA, 22 bp, Homo sapiens
atccctcatctagtcttgacct

SEQ ID NO: 5254853 - DNA, 13 bp, Homo sapiens
atccctcatctgt

SEQ ID NO: 5254854 - DNA, 15 bp, Homo sapiens
atccctcatttcatt

SEQ ID NO: 5254855 - DNA, 17 bp, Homo sapiens
atccctccaccccagtc

SEQ ID NO: 5254856 - DNA, 18 bp, Homo sapiens
atccctccaccccagtcc

SEQ ID NO: 5254857 - DNA, 18 bp, Homo sapiens
atccctccaccttccgtt

SEQ ID NO: 5254858 - DNA, 19 bp, Homo sapiens
atccctccattcatccttc

SEQ ID NO: 5254859 - DNA, 17 bp, Homo sapiens
atccctcccccagcaga

SEQ ID NO: 5254860 - DNA, 11 bp, Homo sapiens
atccctccctc

SEQ ID NO: 5254861 - DNA, 13 bp, Homo sapiens
atccctccctcca

SEQ ID NO: 5254862 - DNA, 16 bp, Homo sapiens
atccctccctccacct

SEQ ID NO: 5254863 - DNA, 21 bp, Homo sapiens
atccctccctccacctccctg

SEQ ID NO: 5254864 - DNA, 17 bp, Homo sapiens
atccctcctgagctcgg

SEQ ID NO: 5254865 - DNA, 12 bp, Homo sapiens
atccctcctgtt

SEQ ID NO: 5254866 - DNA, 13 bp, Homo sapiens
atccctcctgttg

SEQ ID NO: 5254867 - DNA, 24 bp, Homo sapiens
atccctcgatatttttaaagatct

SEQ ID NO: 5254868 - DNA, 22 bp, Homo sapiens
atccctcggaagccgtctgact

SEQ ID NO: 5254869 - DNA, 12 bp, Homo sapiens
atccctctccac

SEQ ID NO: 5254870 - DNA, 12 bp, Homo sapiens
atccctctccat

SEQ ID NO: 5254871 - DNA, 15 bp, Homo sapiens
atccctctcctctgc

SEQ ID NO: 5254872 - DNA, 17 bp, Homo sapiens
atccctctcctctgccc

SEQ ID NO: 5254873 - DNA, 14 bp, Homo sapiens
atccctctctggat

SEQ ID NO: 5254874 - DNA, 16 bp, Homo sapiens
atccctctctggattg

SEQ ID NO: 5254875 - DNA, 11 bp, Homo sapiens
atccctctctt

SEQ ID NO: 5254876 - DNA, 13 bp, Homo sapiens
atccctctcttcc

SEQ ID NO: 5254877 - DNA, 16 bp, Homo sapiens
atccctctcttcccct

SEQ ID NO: 5254878 - DNA, 21 bp, Homo sapiens
atccctctcttccccttccct

SEQ ID NO: 5254879 - DNA, 23 bp, Homo sapiens
atccctctcttccccttccctta

SEQ ID NO: 5254880 - DNA, 21 bp, Homo sapiens
atccctctggcccacacagat

SEQ ID NO: 5254881 - DNA, 22 bp, Homo sapiens
atccctctgggggctctggcca

SEQ ID NO: 5254882 - DNA, 19 bp, Homo sapiens
atccctcttcctccaaagc

SEQ ID NO: 5254883 - DNA, 14 bp, Homo sapiens
atccctcttgtaag

SEQ ID NO: 5254884 - DNA, 20 bp, Homo sapiens
atccctgaacatagttttca

SEQ ID NO: 5254885 - DNA, 20 bp, Homo sapiens
atccctgaacccctggccag

SEQ ID NO: 5254886 - DNA, 22 bp, Homo sapiens
atccctgaagacgagcatcccc

SEQ ID NO: 5254887 - DNA, 22 bp, Homo sapiens
atccctgaaggccccgcccagg

SEQ ID NO: 5254888 - DNA, 20 bp, Homo sapiens
atccctgaatcccccttgcc

SEQ ID NO: 5254889 - DNA, 16 bp, Homo sapiens
atccctgaggctggac

SEQ ID NO: 5254890 - DNA, 19 bp, Homo sapiens
atccctgatcctaactgaa

SEQ ID NO: 5254891 - DNA, 12 bp, Homo sapiens
atccctgccaca

SEQ ID NO: 5254892 - DNA, 12 bp, Homo sapiens
atccctgccact

SEQ ID NO: 5254893 - DNA, 18 bp, Homo sapiens
atccctgccactgggctc

SEQ ID NO: 5254894 - DNA, 14 bp, Homo sapiens
atccctgccagctc

SEQ ID NO: 5254895 - DNA, 16 bp, Homo sapiens
atccctgcccagcctg

SEQ ID NO: 5254896 - DNA, 17 bp, Homo sapiens
atccctgcccagcctgt

SEQ ID NO: 5254897 - DNA, 17 bp, Homo sapiens
atccctgcctggaggct

SEQ ID NO: 5254898 - DNA, 23 bp, Homo sapiens
atccctgcctggaggctcctcta

SEQ ID NO: 5254899 - DNA, 15 bp, Homo sapiens
atccctgcctggtca

SEQ ID NO: 5254900 - DNA, 16 bp, Homo sapiens
atccctgcggcctcca

SEQ ID NO: 5254901 - DNA, 19 bp, Homo sapiens
atccctgcggcctccacac

SEQ ID NO: 5254902 - DNA, 12 bp, Homo sapiens
atccctgctcac

SEQ ID NO: 5254903 - DNA, 16 bp, Homo sapiens
atccctgctcactgca

SEQ ID NO: 5254904 - DNA, 15 bp, Homo sapiens
atccctgctctctga

SEQ ID NO: 5254905 - DNA, 16 bp, Homo sapiens
atccctgctctctgag

SEQ ID NO: 5254906 - DNA, 23 bp, Homo sapiens
atccctgctctctgagtttatct

SEQ ID NO: 5254907 - DNA, 14 bp, Homo sapiens
atccctgcttattt

SEQ ID NO: 5254908 - DNA, 17 bp, Homo sapiens
atccctgcttgcccgct

SEQ ID NO: 5254909 - DNA, 19 bp, Homo sapiens
atccctggacgcatgcagg

SEQ ID NO: 5254910 - DNA, 14 bp, Homo sapiens
atccctggagcagg

SEQ ID NO: 5254911 - DNA, 15 bp, Homo sapiens
atccctggccacctg

SEQ ID NO: 5254912 - DNA, 19 bp, Homo sapiens
atccctggccacctgccag

SEQ ID NO: 5254913 - DNA, 16 bp, Homo sapiens
atccctggccccctcc

SEQ ID NO: 5254914 - DNA, 19 bp, Homo sapiens
atccctggctgacctgctg

SEQ ID NO: 5254915 - DNA, 17 bp, Homo sapiens
atccctgggcccctcca

SEQ ID NO: 5254916 - DNA, 21 bp, Homo sapiens
atccctgggcccctccacgcc

SEQ ID NO: 5254917 - DNA, 15 bp, Homo sapiens
atccctgggcctgct

SEQ ID NO: 5254918 - DNA, 21 bp, Homo sapiens
atccctgggcctgctgctgag

SEQ ID NO: 5254919 - DNA, 20 bp, Homo sapiens
atccctgggccttgggctcc

SEQ ID NO: 5254920 - DNA, 21 bp, Homo sapiens
atccctggtcgtctatcccag

SEQ ID NO: 5254921 - DNA, 20 bp, Homo sapiens
atccctggtgaaagagtaaa

SEQ ID NO: 5254922 - DNA, 15 bp, Homo sapiens
atccctgtaaattgc

SEQ ID NO: 5254923 - DNA, 18 bp, Homo sapiens
atccctgtcttctttcca

SEQ ID NO: 5254924 - DNA, 18 bp, Homo sapiens
atccctgtgtccactgag

SEQ ID NO: 5254925 - DNA, 15 bp, Homo sapiens
atccctgtgttaatt

SEQ ID NO: 5254926 - DNA, 20 bp, Homo sapiens
atccctgtgttaatttaagt

SEQ ID NO: 5254927 - DNA, 16 bp, Homo sapiens
atccctgttcattgta

SEQ ID NO: 5254928 - DNA, 20 bp, Homo sapiens
atcccttaatatcctaaaca

SEQ ID NO: 5254929 - DNA, 20 bp, Homo sapiens
atcccttatccaaaatgctt

SEQ ID NO: 5254930 - DNA, 17 bp, Homo sapiens
atcccttattagttaca

SEQ ID NO: 5254931 - DNA, 15 bp, Homo sapiens
atcccttcaacccca

SEQ ID NO: 5254932 - DNA, 20 bp, Homo sapiens
atcccttcatacttgaacgt

SEQ ID NO: 5254933 - DNA, 14 bp, Homo sapiens
atcccttccacctg

SEQ ID NO: 5254934 - DNA, 20 bp, Homo sapiens
atcccttcccacatgcctgc

SEQ ID NO: 5254935 - DNA, 15 bp, Homo sapiens
atcccttccccctgc

SEQ ID NO: 5254936 - DNA, 23 bp, Homo sapiens
atcccttcctcctctcctggaaa

SEQ ID NO: 5254937 - DNA, 13 bp, Homo sapiens
atcccttcctgga

SEQ ID NO: 5254938 - DNA, 21 bp, Homo sapiens
atcccttccttttagcctagt

SEQ ID NO: 5254939 - DNA, 22 bp, Homo sapiens
atcccttgaccaggcctgggcc

SEQ ID NO: 5254940 - DNA, 21 bp, Homo sapiens
atcccttggggaagggtgggg

SEQ ID NO: 5254941 - DNA, 22 bp, Homo sapiens
atcccttgtacctatggctgcc

SEQ ID NO: 5254942 - DNA, 16 bp, Homo sapiens
atccctttcccttggt

SEQ ID NO: 5254943 - DNA, 15 bp, Homo sapiens
atccctttcctggtt

SEQ ID NO: 5254944 - DNA, 21 bp, Homo sapiens
atccctttctaagcaggaagg

SEQ ID NO: 5254945 - DNA, 22 bp, Homo sapiens
atccctttctaagcaggaaggt

SEQ ID NO: 5254946 - DNA, 19 bp, Homo sapiens
atccctttgcaacgctcac

SEQ ID NO: 5254947 - DNA, 23 bp, Homo sapiens
atccctttgtctgtcaatcacag

SEQ ID NO: 5254948 - DNA, 13 bp, Homo sapiens
atcccttttcctg

SEQ ID NO: 5254949 - DNA, 14 bp, Homo sapiens
atcccttttcctgt

SEQ ID NO: 5254950 - DNA, 17 bp, Homo sapiens
atcccttttcctgtcag

SEQ ID NO: 5254951 - DNA, 15 bp, Homo sapiens
atccctttttcaatg

SEQ ID NO: 5254952 - DNA, 17 bp, Homo sapiens
atccgactctaagctgt

SEQ ID NO: 5254953 - DNA, 18 bp, Homo sapiens
atccgactctaagctgtg

SEQ ID NO: 5254954 - DNA, 22 bp, Homo sapiens
atccgactctaagctgtgtgca

SEQ ID NO: 5254955 - DNA, 23 bp, Homo sapiens
atccgactctaagctgtgtgcag

SEQ ID NO: 5254956 - DNA, 15 bp, Homo sapiens
atccgactgcccctg

SEQ ID NO: 5254957 - DNA, 23 bp, Homo sapiens
atccgacttgaattttcccactg

SEQ ID NO: 5254958 - DNA, 14 bp, Homo sapiens
atccgagcccctgt

SEQ ID NO: 5254959 - DNA, 15 bp, Homo sapiens
atccgagcccctgtt

SEQ ID NO: 5254960 - DNA, 12 bp, Homo sapiens
atccgaggcagg

SEQ ID NO: 5254961 - DNA, 22 bp, Homo sapiens
atccgagtgtttgccaggctta

SEQ ID NO: 5254962 - DNA, 23 bp, Homo sapiens
atccgcaacccatgccctggacc

SEQ ID NO: 5254963 - DNA, 18 bp, Homo sapiens
atccgcaatgtggagcag

SEQ ID NO: 5254964 - DNA, 23 bp, Homo sapiens
atccgcaatgtggagcagcagcc

SEQ ID NO: 5254965 - DNA, 22 bp, Homo sapiens
atccgcagactgcttggccaga

SEQ ID NO: 5254966 - DNA, 14 bp, Homo sapiens
atccgcatgtgtct

SEQ ID NO: 5254967 - DNA, 15 bp, Homo sapiens
atccgcatgtgtctg

SEQ ID NO: 5254968 - DNA, 17 bp, Homo sapiens
atccgcatgtgtctgta

SEQ ID NO: 5254969 - DNA, 19 bp, Homo sapiens
atccgcatgtgtctgtatt

SEQ ID NO: 5254970 - DNA, 14 bp, Homo sapiens
atccgccaatatta

SEQ ID NO: 5254971 - DNA, 14 bp, Homo sapiens
atccgccagggccc

SEQ ID NO: 5254972 - DNA, 19 bp, Homo sapiens
atccgccagggcccacacc

SEQ ID NO: 5254973 - DNA, 17 bp, Homo sapiens
atccgccagtgtttctg

SEQ ID NO: 5254974 - DNA, 16 bp, Homo sapiens
atccgcccgcctcggc

SEQ ID NO: 5254975 - DNA, 18 bp, Homo sapiens
atccgcccgcctctgcct

SEQ ID NO: 5254976 - DNA, 15 bp, Homo sapiens
atccgccctgcagca

SEQ ID NO: 5254977 - DNA, 23 bp, Homo sapiens
atccgcctgcagaggacagagct

SEQ ID NO: 5254978 - DNA, 16 bp, Homo sapiens
atccgcctgcctctgc

SEQ ID NO: 5254979 - DNA, 17 bp, Homo sapiens
atccgcctgcctctgcc

SEQ ID NO: 5254980 - DNA, 13 bp, Homo sapiens
atccgcctggccc

SEQ ID NO: 5254981 - DNA, 14 bp, Homo sapiens
atccgcctggcccg

SEQ ID NO: 5254982 - DNA, 20 bp, Homo sapiens
atccgcggggaccctgccga

SEQ ID NO: 5254983 - DNA, 13 bp, Homo sapiens
atccgctctcttc

SEQ ID NO: 5254984 - DNA, 17 bp, Homo sapiens
atccgctctcttcctgc

SEQ ID NO: 5254985 - DNA, 14 bp, Homo sapiens
atccgctgccacca

SEQ ID NO: 5254986 - DNA, 22 bp, Homo sapiens
atccggaggagaagaaggaaat

SEQ ID NO: 5254987 - DNA, 16 bp, Homo sapiens
atccggctgctcctcc

SEQ ID NO: 5254988 - DNA, 22 bp, Homo sapiens
atccggctgctcctccagccct

SEQ ID NO: 5254989 - DNA, 17 bp, Homo sapiens
atccgggacgcttccag

SEQ ID NO: 5254990 - DNA, 16 bp, Homo sapiens
atccggtcagccaagt

SEQ ID NO: 5254991 - DNA, 21 bp, Homo sapiens
atccggtcccctgcctggaac

SEQ ID NO: 5254992 - DNA, 21 bp, Homo sapiens
atccggtggcctattccagga

SEQ ID NO: 5254993 - DNA, 20 bp, Homo sapiens
atccgtaccatcggtcagca

SEQ ID NO: 5254994 - DNA, 18 bp, Homo sapiens
atccgtagttattttgca

SEQ ID NO: 5254995 - DNA, 15 bp, Homo sapiens
atgatccttgtttta

SEQ ID NO: 5254996 - DNA, 16 bp, Homo sapiens
atgatccttgttttaa

SEQ ID NO: 5254997 - DNA, 19 bp, Homo sapiens
atgatccttgttttaagat

SEQ ID NO: 5254998 - DNA, 15 bp, Homo sapiens
atgatccttttttgt

SEQ ID NO: 5254999 - DNA, 18 bp, Homo sapiens
atgatccttttttgtcat

SEQ ID NO: 5255000 - DNA, 19 bp, Homo sapiens
atgatccttttttgtcatt

SEQ ID NO: 5255001 - DNA, 17 bp, Homo sapiens
atgatcgagccactgca

SEQ ID NO: 5255002 - DNA, 12 bp, Homo sapiens
atgatcgctgta

SEQ ID NO: 5255003 - DNA, 14 bp, Homo sapiens
atgatctaataaac

SEQ ID NO: 5255004 - DNA, 16 bp, Homo sapiens
atgatctaataaactt

SEQ ID NO: 5255005 - DNA, 19 bp, Homo sapiens
atgatctaataaactttat

SEQ ID NO: 5255006 - DNA, 23 bp, Homo sapiens
atgatctaccagcctccctattt

SEQ ID NO: 5255007 - DNA, 14 bp, Homo sapiens
atgatctactcaga

SEQ ID NO: 5255008 - DNA, 15 bp, Homo sapiens
atgatctaggaagac

SEQ ID NO: 5255009 - DNA, 15 bp, Homo sapiens
atgatctaggtttaa

SEQ ID NO: 5255010 - DNA, 17 bp, Homo sapiens
atgatctaggtttaact

SEQ ID NO: 5255011 - DNA, 22 bp, Homo sapiens
atgatctaggtttaactcagat

SEQ ID NO: 5255012 - DNA, 11 bp, Homo sapiens
atgatctattc

SEQ ID NO: 5255013 - DNA, 14 bp, Homo sapiens
atgatctccctgcc

SEQ ID NO: 5255014 - DNA, 15 bp, Homo sapiens
atgatctccctgccg

SEQ ID NO: 5255015 - DNA, 12 bp, Homo sapiens
atgatctcttct

SEQ ID NO: 5255016 - DNA, 14 bp, Homo sapiens
atgatctcttctgg

SEQ ID NO: 5255017 - DNA, 17 bp, Homo sapiens
atgatctcttctggtgt

SEQ ID NO: 5255018 - DNA, 22 bp, Homo sapiens
atgatctcttcttttggcttcc

SEQ ID NO: 5255019 - DNA, 20 bp, Homo sapiens
atgatctgactttaattgtg

SEQ ID NO: 5255020 - DNA, 17 bp, Homo sapiens
atgatctgcctctaaaa

SEQ ID NO: 5255021 - DNA, 17 bp, Homo sapiens
atgatctgtagtttttt

SEQ ID NO: 5255022 - DNA, 12 bp, Homo sapiens
atgatctgtcaa

SEQ ID NO: 5255023 - DNA, 15 bp, Homo sapiens
atgatctgtgccttt

SEQ ID NO: 5255024 - DNA, 23 bp, Homo sapiens
atgatctgtggagaatgtacaca

SEQ ID NO: 5255025 - DNA, 17 bp, Homo sapiens
atgatcttccaaatatt

SEQ ID NO: 5255026 - DNA, 19 bp, Homo sapiens
atgatcttccaaatattag

SEQ ID NO: 5255027 - DNA, 13 bp, Homo sapiens
atgatcttgatat

SEQ ID NO: 5255028 - DNA, 23 bp, Homo sapiens
atgatcttgttactgtgatattt

SEQ ID NO: 5255029 - DNA, 20 bp, Homo sapiens
atgatctttctttcctttct

SEQ ID NO: 5255030 - DNA, 19 bp, Homo sapiens
atgatctttgcagacaggc

SEQ ID NO: 5255031 - DNA, 21 bp, Homo sapiens
atgatctttgcagacaggcaa

SEQ ID NO: 5255032 - DNA, 20 bp, Homo sapiens
atgatgaaaacctacatatt

SEQ ID NO: 5255033 - DNA, 15 bp, Homo sapiens
atgatgaaactgtca

SEQ ID NO: 5255034 - DNA, 14 bp, Homo sapiens
atgatgaagaaatg

SEQ ID NO: 5255035 - DNA, 19 bp, Homo sapiens
atgatgaaggtaattaaag

SEQ ID NO: 5255036 - DNA, 12 bp, Homo sapiens
atgatgacaatc

SEQ ID NO: 5255037 - DNA, 16 bp, Homo sapiens
atgatgacaatcaaag

SEQ ID NO: 5255038 - DNA, 14 bp, Homo sapiens
atgatgacccacta

SEQ ID NO: 5255039 - DNA, 17 bp, Homo sapiens
atgatgacgacgacaac

SEQ ID NO: 5255040 - DNA, 19 bp, Homo sapiens
atgatgactcaagattttt

SEQ ID NO: 5255041 - DNA, 23 bp, Homo sapiens
atgatgactcaaggccaataata

SEQ ID NO: 5255042 - DNA, 18 bp, Homo sapiens
atgatgactcttcttatc

SEQ ID NO: 5255043 - DNA, 18 bp, Homo sapiens
atgatgacttgagccctg

SEQ ID NO: 5255044 - DNA, 19 bp, Homo sapiens
atgatgagaatttctaaaa

SEQ ID NO: 5255045 - DNA, 15 bp, Homo sapiens
atgatgagattcact

SEQ ID NO: 5255046 - DNA, 20 bp, Homo sapiens
atgatgatcaattatagttt

SEQ ID NO: 5255047 - DNA, 15 bp, Homo sapiens
atgatgatcctaggc

SEQ ID NO: 5255048 - DNA, 13 bp, Homo sapiens
atgatgatgatga

SEQ ID NO: 5255049 - DNA, 18 bp, Homo sapiens
atgatgatgggaattgtg

SEQ ID NO: 5255050 - DNA, 17 bp, Homo sapiens
atgatgattaaacacct

SEQ ID NO: 5255051 - DNA, 22 bp, Homo sapiens
atgatgattaaacacctgacac

SEQ ID NO: 5255052 - DNA, 16 bp, Homo sapiens
atgatgattgcttcca

SEQ ID NO: 5255053 - DNA, 19 bp, Homo sapiens
atgatgattttaacagttt

SEQ ID NO: 5255054 - DNA, 21 bp, Homo sapiens
atgatgcagctgttgagaaaa

SEQ ID NO: 5255055 - DNA, 22 bp, Homo sapiens
atgatgcagtctcctctttaaa

SEQ ID NO: 5255056 - DNA, 15 bp, Homo sapiens
atgatgcatacagtt

SEQ ID NO: 5255057 - DNA, 16 bp, Homo sapiens
atgatgcatacagttt

SEQ ID NO: 5255058 - DNA, 15 bp, Homo sapiens
atgatgcatggagga

SEQ ID NO: 5255059 - DNA, 17 bp, Homo sapiens
atgatgccaacctctgg

SEQ ID NO: 5255060 - DNA, 18 bp, Homo sapiens
atgatgccaacctctgga

SEQ ID NO: 5255061 - DNA, 10 bp, Homo sapiens
atgatgccac

SEQ ID NO: 5255062 - DNA, 22 bp, Homo sapiens
atgatgccacaccaagctgtgc

SEQ ID NO: 5255063 - DNA, 16 bp, Homo sapiens
atgatgccatgaggaa

SEQ ID NO: 5255064 - DNA, 23 bp, Homo sapiens
atgatgccctcccctcagcgcag

SEQ ID NO: 5255065 - DNA, 20 bp, Homo sapiens
atgatgccgctcttctgtca

SEQ ID NO: 5255066 - DNA, 15 bp, Homo sapiens
atgatgcctttataa

SEQ ID NO: 5255067 - DNA, 17 bp, Homo sapiens
atgatgctaagctgata

SEQ ID NO: 5255068 - DNA, 22 bp, Homo sapiens
atgatgctgccggcacagctgg

SEQ ID NO: 5255069 - DNA, 15 bp, Homo sapiens
atgatgctgtgacaa

SEQ ID NO: 5255070 - DNA, 22 bp, Homo sapiens
atgatgcttctataattttgcc

SEQ ID NO: 5255071 - DNA, 21 bp, Homo sapiens
atgatgcttttactgaacttt

SEQ ID NO: 5255072 - DNA, 18 bp, Homo sapiens
atgatgcttttatagctg

SEQ ID NO: 5255073 - DNA, 13 bp, Homo sapiens
atgatggaaaaat

SEQ ID NO: 5255074 - DNA, 15 bp, Homo sapiens
atgatggaatttcat

SEQ ID NO: 5255075 - DNA, 22 bp, Homo sapiens
atgatggacaaaggcctggcgt

SEQ ID NO: 5255076 - DNA, 15 bp, Homo sapiens
atgatggagacttca

SEQ ID NO: 5255077 - DNA, 17 bp, Homo sapiens
atgatggagcaactgaa

SEQ ID NO: 5255078 - DNA, 14 bp, Homo sapiens
atgatggagctgat

SEQ ID NO: 5255079 - DNA, 15 bp, Homo sapiens
atgatggatgccaat

SEQ ID NO: 5255080 - DNA, 14 bp, Homo sapiens
atgatggatggcag

SEQ ID NO: 5255081 - DNA, 15 bp, Homo sapiens
atgatggatggcaga

SEQ ID NO: 5255082 - DNA, 17 bp, Homo sapiens
atgatggatttaacagc

SEQ ID NO: 5255083 - DNA, 20 bp, Homo sapiens
atgatggatttaacagcatg

SEQ ID NO: 5255084 - DNA, 13 bp, Homo sapiens
atgatggcaacag

SEQ ID NO: 5255085 - DNA, 14 bp, Homo sapiens
atgatggcaacaga

SEQ ID NO: 5255086 - DNA, 19 bp, Homo sapiens
atgatggcaattttgtaac

SEQ ID NO: 5255087 - DNA, 16 bp, Homo sapiens
atgatggcagagccag

SEQ ID NO: 5255088 - DNA, 18 bp, Homo sapiens
atgatggcagagccaggc

SEQ ID NO: 5255089 - DNA, 21 bp, Homo sapiens
atgatggcagagccaggctgt

SEQ ID NO: 5255090 - DNA, 12 bp, Homo sapiens
atgatggcccat

SEQ ID NO: 5255091 - DNA, 20 bp, Homo sapiens
atgatggcccattctacttg

SEQ ID NO: 5255092 - DNA, 21 bp, Homo sapiens
atgatggcccattctacttgc

SEQ ID NO: 5255093 - DNA, 21 bp, Homo sapiens
atgatgggaaaatatttcctg

SEQ ID NO: 5255094 - DNA, 22 bp, Homo sapiens
atgatgggaatagggagacagg

SEQ ID NO: 5255095 - DNA, 18 bp, Homo sapiens
atgatgggctccccagga

SEQ ID NO: 5255096 - DNA, 17 bp, Homo sapiens
atgatgggcttctgttc

SEQ ID NO: 5255097 - DNA, 16 bp, Homo sapiens
atgatggggaaggagt

SEQ ID NO: 5255098 - DNA, 23 bp, Homo sapiens
atgatggggccctaattcagcca

SEQ ID NO: 5255099 - DNA, 19 bp, Homo sapiens
atgatggggtcagcaggcc

SEQ ID NO: 5255100 - DNA, 11 bp, Homo sapiens
atgatggtgag

SEQ ID NO: 5255101 - DNA, 15 bp, Homo sapiens
atgatggtgttaaag

SEQ ID NO: 5255102 - DNA, 14 bp, Homo sapiens
atgatggtttaata

SEQ ID NO: 5255103 - DNA, 20 bp, Homo sapiens
atgatggtttccaatttcat

SEQ ID NO: 5255104 - DNA, 17 bp, Homo sapiens
atgatggttttaaactt

SEQ ID NO: 5255105 - DNA, 19 bp, Homo sapiens
atgatgtaaaaaatattaa

SEQ ID NO: 5255106 - DNA, 21 bp, Homo sapiens
atgatgtaaaaatatgtatat

SEQ ID NO: 5255107 - DNA, 20 bp, Homo sapiens
atgatgtaagtttacctatg

SEQ ID NO: 5255108 - DNA, 13 bp, Homo sapiens
atgatgtatattt

SEQ ID NO: 5255109 - DNA, 23 bp, Homo sapiens
atgatgtatgttgaagcctttgt

SEQ ID NO: 5255110 - DNA, 19 bp, Homo sapiens
atgatgtccagggggagaa

SEQ ID NO: 5255111 - DNA, 17 bp, Homo sapiens
atgatgtcgttcatttt

SEQ ID NO: 5255112 - DNA, 19 bp, Homo sapiens
atgatgtctacagaaaatg

SEQ ID NO: 5255113 - DNA, 22 bp, Homo sapiens
atgatgtctacagaaaatgctg

SEQ ID NO: 5255114 - DNA, 15 bp, Homo sapiens
atgatgtctcttgta

SEQ ID NO: 5255115 - DNA, 14 bp, Homo sapiens
atgatgtgcctgct

SEQ ID NO: 5255116 - DNA, 18 bp, Homo sapiens
atgatgtgcctgcttcag

SEQ ID NO: 5255117 - DNA, 14 bp, Homo sapiens
atgatgtgcctggg

SEQ ID NO: 5255118 - DNA, 19 bp, Homo sapiens
atgatgtggagtggggcag

SEQ ID NO: 5255119 - DNA, 19 bp, Homo sapiens
atgatgtgggtcaaggaat

SEQ ID NO: 5255120 - DNA, 14 bp, Homo sapiens
atgatgtggttttt

SEQ ID NO: 5255121 - DNA, 14 bp, Homo sapiens
atgatgtgtatata

SEQ ID NO: 5255122 - DNA, 14 bp, Homo sapiens
atgatgtgtgaaac

SEQ ID NO: 5255123 - DNA, 14 bp, Homo sapiens
atgatgtgttgtga

SEQ ID NO: 5255124 - DNA, 11 bp, Homo sapiens
atgatgttaaa

SEQ ID NO: 5255125 - DNA, 21 bp, Homo sapiens
atgatgttaaaaaaataagaa

SEQ ID NO: 5255126 - DNA, 18 bp, Homo sapiens
atgatgttaatgggttat

SEQ ID NO: 5255127 - DNA, 21 bp, Homo sapiens
atgatgttaatgggttatctc

SEQ ID NO: 5255128 - DNA, 16 bp, Homo sapiens
atgatgttagtaactt

SEQ ID NO: 5255129 - DNA, 15 bp, Homo sapiens
atgatgttatcttaa

SEQ ID NO: 5255130 - DNA, 23 bp, Homo sapiens
atgatgttatcttaacactgaaa

SEQ ID NO: 5255131 - DNA, 17 bp, Homo sapiens
atgatgttattttgtac

SEQ ID NO: 5255132 - DNA, 13 bp, Homo sapiens
atgatgttctgaa

SEQ ID NO: 5255133 - DNA, 17 bp, Homo sapiens
atgatgttgtaaaatga

SEQ ID NO: 5255134 - DNA, 18 bp, Homo sapiens
atgatgtttcttttgcaa

SEQ ID NO: 5255135 - DNA, 16 bp, Homo sapiens
atgatgtttgcccaaa

SEQ ID NO: 5255136 - DNA, 19 bp, Homo sapiens
atgatgtttgcccaaaatt

SEQ ID NO: 5255137 - DNA, 14 bp, Homo sapiens
atgatgttttgcaa

SEQ ID NO: 5255138 - DNA, 15 bp, Homo sapiens
atgatgttttgcaaa

SEQ ID NO: 5255139 - DNA, 19 bp, Homo sapiens
atgatgtttttaaaatctt

SEQ ID NO: 5255140 - DNA, 20 bp, Homo sapiens
atgatgtttttaaaatctta

SEQ ID NO: 5255141 - DNA, 21 bp, Homo sapiens
atgatgtttttaaaatcttat

SEQ ID NO: 5255142 - DNA, 17 bp, Homo sapiens
atgattaaaaatatcaa

SEQ ID NO: 5255143 - DNA, 13 bp, Homo sapiens
atgattaaacacc

SEQ ID NO: 5255144 - DNA, 22 bp, Homo sapiens
atgattaaacacctgacacatc

SEQ ID NO: 5255145 - DNA, 22 bp, Homo sapiens
atgattaaactgggaaatgaga

SEQ ID NO: 5255146 - DNA, 20 bp, Homo sapiens
atgattaaccacttcagctg

SEQ ID NO: 5255147 - DNA, 23 bp, Homo sapiens
atgattaagggacatttctataa

SEQ ID NO: 5255148 - DNA, 14 bp, Homo sapiens
atgattaagtaatg

SEQ ID NO: 5255149 - DNA, 22 bp, Homo sapiens
atgattaagtgcttgaggccaa

SEQ ID NO: 5255150 - DNA, 12 bp, Homo sapiens
atgattaatcaa

SEQ ID NO: 5255151 - DNA, 13 bp, Homo sapiens
atgattaatcaaa

SEQ ID NO: 5255152 - DNA, 15 bp, Homo sapiens
atgattactggcctt

SEQ ID NO: 5255153 - DNA, 22 bp, Homo sapiens
atgattactggcctttttcatt

SEQ ID NO: 5255154 - DNA, 14 bp, Homo sapiens
atgattagacaatg

SEQ ID NO: 5255155 - DNA, 17 bp, Homo sapiens
atgattagacaatgtgg

SEQ ID NO: 5255156 - DNA, 19 bp, Homo sapiens
atgattagacaatgtggaa

SEQ ID NO: 5255157 - DNA, 20 bp, Homo sapiens
atgattagttaaaaaaagaa

SEQ ID NO: 5255158 - DNA, 18 bp, Homo sapiens
atgattagttatgtcttt

SEQ ID NO: 5255159 - DNA, 21 bp, Homo sapiens
atgattagttatgtcttttaa

SEQ ID NO: 5255160 - DNA, 14 bp, Homo sapiens
atgattataagaga

SEQ ID NO: 5255161 - DNA, 18 bp, Homo sapiens
atgattataagagagctt

SEQ ID NO: 5255162 - DNA, 20 bp, Homo sapiens
atgattataatgctatttta

SEQ ID NO: 5255163 - DNA, 16 bp, Homo sapiens
atgattatatgacaat

SEQ ID NO: 5255164 - DNA, 15 bp, Homo sapiens
atgattatattcaca

SEQ ID NO: 5255165 - DNA, 17 bp, Homo sapiens
atgattatattcacaga

SEQ ID NO: 5255166 - DNA, 18 bp, Homo sapiens
atgattattttcattaca

SEQ ID NO: 5255167 - DNA, 13 bp, Homo sapiens
atgattcaaaaag

SEQ ID NO: 5255168 - DNA, 21 bp, Homo sapiens
atgattcaaatatcaaaagga

SEQ ID NO: 5255169 - DNA, 21 bp, Homo sapiens
atgattcaaatgtctataaac

SEQ ID NO: 5255170 - DNA, 13 bp, Homo sapiens
atgattcaagcca

SEQ ID NO: 5255171 - DNA, 17 bp, Homo sapiens
atgattcaattaacata

SEQ ID NO: 5255172 - DNA, 20 bp, Homo sapiens
atgattcagggttatttgag

SEQ ID NO: 5255173 - DNA, 16 bp, Homo sapiens
atgattcatctttcag

SEQ ID NO: 5255174 - DNA, 16 bp, Homo sapiens
atccgtattgaatttg

SEQ ID NO: 5255175 - DNA, 19 bp, Homo sapiens
atccgtcccacatcagggc

SEQ ID NO: 5255176 - DNA, 12 bp, Homo sapiens
atccgtctcccc

SEQ ID NO: 5255177 - DNA, 13 bp, Homo sapiens
atccgtctctgtc

SEQ ID NO: 5255178 - DNA, 15 bp, Homo sapiens
atccgtctctgtccg

SEQ ID NO: 5255179 - DNA, 22 bp, Homo sapiens
atccgtctgtctgtcgcccttc

SEQ ID NO: 5255180 - DNA, 17 bp, Homo sapiens
atccgtgcctcttttta

SEQ ID NO: 5255181 - DNA, 20 bp, Homo sapiens
atccgtgtatttggctgggc

SEQ ID NO: 5255182 - DNA, 14 bp, Homo sapiens
atccgtttgaccaa

SEQ ID NO: 5255183 - DNA, 20 bp, Homo sapiens
atccgtttgcaagaaccaga

SEQ ID NO: 5255184 - DNA, 19 bp, Homo sapiens
atcctaaaacaaaagctca

SEQ ID NO: 5255185 - DNA, 16 bp, Homo sapiens
atcctaaactctctag

SEQ ID NO: 5255186 - DNA, 18 bp, Homo sapiens
atcctaaactctctagct

SEQ ID NO: 5255187 - DNA, 13 bp, Homo sapiens
atcctaaagaaca

SEQ ID NO: 5255188 - DNA, 18 bp, Homo sapiens
atcctaaatatgacagtg

SEQ ID NO: 5255189 - DNA, 18 bp, Homo sapiens
atcctaaatttaccctct

SEQ ID NO: 5255190 - DNA, 17 bp, Homo sapiens
atcctaaccctgggctc

SEQ ID NO: 5255191 - DNA, 18 bp, Homo sapiens
atcctaactgaagagaca

SEQ ID NO: 5255192 - DNA, 15 bp, Homo sapiens
atcctaagaaatatg

SEQ ID NO: 5255193 - DNA, 14 bp, Homo sapiens
atcctaagacacaa

SEQ ID NO: 5255194 - DNA, 15 bp, Homo sapiens
atcctaagacacaaa

SEQ ID NO: 5255195 - DNA, 21 bp, Homo sapiens
atcctaagatgtgttcttatt

SEQ ID NO: 5255196 - DNA, 18 bp, Homo sapiens
atcctaagcatctaagtt

SEQ ID NO: 5255197 - DNA, 21 bp, Homo sapiens
atcctaagggtcgaaagctct

SEQ ID NO: 5255198 - DNA, 20 bp, Homo sapiens
atcctaagtgggaagtgaag

SEQ ID NO: 5255199 - DNA, 23 bp, Homo sapiens
atcctaagtgggaagtgaagccc

SEQ ID NO: 5255200 - DNA, 14 bp, Homo sapiens
atcctaataaaaag

SEQ ID NO: 5255201 - DNA, 16 bp, Homo sapiens
atcctaataaaaaggt

SEQ ID NO: 5255202 - DNA, 17 bp, Homo sapiens
atcctaataaaaaggtg

SEQ ID NO: 5255203 - DNA, 18 bp, Homo sapiens
atcctaataaaaaggtga

SEQ ID NO: 5255204 - DNA, 17 bp, Homo sapiens
atcctaatagaaagaaa

SEQ ID NO: 5255205 - DNA, 12 bp, Homo sapiens
atcctaatgaat

SEQ ID NO: 5255206 - DNA, 19 bp, Homo sapiens
atcctaatgaatgcataaa

SEQ ID NO: 5255207 - DNA, 21 bp, Homo sapiens
atcctaatgacttctaaaaat

SEQ ID NO: 5255208 - DNA, 19 bp, Homo sapiens
atcctacaagacacagtga

SEQ ID NO: 5255209 - DNA, 22 bp, Homo sapiens
atcctacacacctaagggacat

SEQ ID NO: 5255210 - DNA, 15 bp, Homo sapiens
atcctacagtacaat

SEQ ID NO: 5255211 - DNA, 14 bp, Homo sapiens
atcctaccaaagta

SEQ ID NO: 5255212 - DNA, 15 bp, Homo sapiens
atcctaccaacctct

SEQ ID NO: 5255213 - DNA, 14 bp, Homo sapiens
atcctaccaatgca

SEQ ID NO: 5255214 - DNA, 15 bp, Homo sapiens
atcctaccaatgcat

SEQ ID NO: 5255215 - DNA, 16 bp, Homo sapiens
atcctacctgttttgt

SEQ ID NO: 5255216 - DNA, 22 bp, Homo sapiens
atcctaccttgcttttgcttct

SEQ ID NO: 5255217 - DNA, 22 bp, Homo sapiens
atcctaccttttgataaaatgt

SEQ ID NO: 5255218 - DNA, 18 bp, Homo sapiens
atcctacgctatgtagaa

SEQ ID NO: 5255219 - DNA, 19 bp, Homo sapiens
atcctacgctatgtagaat

SEQ ID NO: 5255220 - DNA, 14 bp, Homo sapiens
atcctacttctcca

SEQ ID NO: 5255221 - DNA, 19 bp, Homo sapiens
atcctagaaccaagcttca

SEQ ID NO: 5255222 - DNA, 20 bp, Homo sapiens
atcctagaaccaagcttcag

SEQ ID NO: 5255223 - DNA, 23 bp, Homo sapiens
atcctagaaccaagcttcagagc

SEQ ID NO: 5255224 - DNA, 14 bp, Homo sapiens
atcctagactgctc

SEQ ID NO: 5255225 - DNA, 14 bp, Homo sapiens
atcctagagaggct

SEQ ID NO: 5255226 - DNA, 16 bp, Homo sapiens
atcctagagattctta

SEQ ID NO: 5255227 - DNA, 15 bp, Homo sapiens
atcctagatcctaag

SEQ ID NO: 5255228 - DNA, 18 bp, Homo sapiens
atcctagattatatcaaa

SEQ ID NO: 5255229 - DNA, 20 bp, Homo sapiens
atcctagattatatcaaagt

SEQ ID NO: 5255230 - DNA, 13 bp, Homo sapiens
atcctagccccac

SEQ ID NO: 5255231 - DNA, 16 bp, Homo sapiens
atcctagccccaccca

SEQ ID NO: 5255232 - DNA, 20 bp, Homo sapiens
atcctagccccgagacacca

SEQ ID NO: 5255233 - DNA, 19 bp, Homo sapiens
atcctagccttatcctctg

SEQ ID NO: 5255234 - DNA, 20 bp, Homo sapiens
atcctagccttatcctctga

SEQ ID NO: 5255235 - DNA, 16 bp, Homo sapiens
atcctagcttcttcca

SEQ ID NO: 5255236 - DNA, 15 bp, Homo sapiens
atcctagctttttcc

SEQ ID NO: 5255237 - DNA, 14 bp, Homo sapiens
atcctaggaaccag

SEQ ID NO: 5255238 - DNA, 15 bp, Homo sapiens
atcctaggaaccagc

SEQ ID NO: 5255239 - DNA, 14 bp, Homo sapiens
atcctaggctgaca

SEQ ID NO: 5255240 - DNA, 21 bp, Homo sapiens
atcctaggcttaaatgcaata

SEQ ID NO: 5255241 - DNA, 20 bp, Homo sapiens
atcctagtcattcttcccta

SEQ ID NO: 5255242 - DNA, 22 bp, Homo sapiens
atcctagtctagcattctgcaa

SEQ ID NO: 5255243 - DNA, 23 bp, Homo sapiens
atcctagtctctatcattaaagt

SEQ ID NO: 5255244 - DNA, 15 bp, Homo sapiens
atcctagtcttcaca

SEQ ID NO: 5255245 - DNA, 21 bp, Homo sapiens
atcctagtcttcacaactttg

SEQ ID NO: 5255246 - DNA, 15 bp, Homo sapiens
atcctagtgggcact

SEQ ID NO: 5255247 - DNA, 14 bp, Homo sapiens
atcctagttccatt

SEQ ID NO: 5255248 - DNA, 17 bp, Homo sapiens
atcctagtttcctctcc

SEQ ID NO: 5255249 - DNA, 15 bp, Homo sapiens
atcctatatagaatg

SEQ ID NO: 5255250 - DNA, 18 bp, Homo sapiens
atcctatatagaatgctg

SEQ ID NO: 5255251 - DNA, 19 bp, Homo sapiens
atcctatatctgtttgtat

SEQ ID NO: 5255252 - DNA, 20 bp, Homo sapiens
atcctatcagcctgtctctt

SEQ ID NO: 5255253 - DNA, 17 bp, Homo sapiens
atcctatgcatggtttc

SEQ ID NO: 5255254 - DNA, 21 bp, Homo sapiens
atcctatgcatggtttcagca

SEQ ID NO: 5255255 - DNA, 22 bp, Homo sapiens
atcctatgcatggtttcagcac

SEQ ID NO: 5255256 - DNA, 23 bp, Homo sapiens
atcctatgcatggtttcagcact

SEQ ID NO: 5255257 - DNA, 12 bp, Homo sapiens
atcctatgctta

SEQ ID NO: 5255258 - DNA, 21 bp, Homo sapiens
atcctatggtttctccatcca

SEQ ID NO: 5255259 - DNA, 21 bp, Homo sapiens
atcctattacatagtttgaaa

SEQ ID NO: 5255260 - DNA, 17 bp, Homo sapiens
atcctattatgtgttca

SEQ ID NO: 5255261 - DNA, 21 bp, Homo sapiens
atcctattgaaccatgtttgt

SEQ ID NO: 5255262 - DNA, 22 bp, Homo sapiens
atcctatttcagtacttcagca

SEQ ID NO: 5255263 - DNA, 17 bp, Homo sapiens
atcctatttttaaacaa

SEQ ID NO: 5255264 - DNA, 21 bp, Homo sapiens
atcctcaaacactgcaggcat

SEQ ID NO: 5255265 - DNA, 18 bp, Homo sapiens
atcctcaaatcagtcttc

SEQ ID NO: 5255266 - DNA, 21 bp, Homo sapiens
atcctcaaatcagtcttcctt

SEQ ID NO: 5255267 - DNA, 14 bp, Homo sapiens
atcctcaacaacaa

SEQ ID NO: 5255268 - DNA, 12 bp, Homo sapiens
atcctcaatcca

SEQ ID NO: 5255269 - DNA, 15 bp, Homo sapiens
atcctcacacagatt

SEQ ID NO: 5255270 - DNA, 12 bp, Homo sapiens
atcctcacacta

SEQ ID NO: 5255271 - DNA, 14 bp, Homo sapiens
atcctcacaggagc

SEQ ID NO: 5255272 - DNA, 16 bp, Homo sapiens
atcctcacagtgaaca

SEQ ID NO: 5255273 - DNA, 16 bp, Homo sapiens
atcctcacatgtggca

SEQ ID NO: 5255274 - DNA, 22 bp, Homo sapiens
atcctcaccatccacagcaaga

SEQ ID NO: 5255275 - DNA, 23 bp, Homo sapiens
atcctcaccatccacagcaagat

SEQ ID NO: 5255276 - DNA, 14 bp, Homo sapiens
atcctcacccagat

SEQ ID NO: 5255277 - DNA, 23 bp, Homo sapiens
atcctcacccagatcaggaacca

SEQ ID NO: 5255278 - DNA, 18 bp, Homo sapiens
atcctcacgccttggcct

SEQ ID NO: 5255279 - DNA, 21 bp, Homo sapiens
atcctcactgagaaggcccca

SEQ ID NO: 5255280 - DNA, 16 bp, Homo sapiens
atcctcactgccctcc

SEQ ID NO: 5255281 - DNA, 15 bp, Homo sapiens
atcctcactgggtgg

SEQ ID NO: 5255282 - DNA, 20 bp, Homo sapiens
atcctcagaggctgagccct

SEQ ID NO: 5255283 - DNA, 15 bp, Homo sapiens
atcctcagccccagg

SEQ ID NO: 5255284 - DNA, 16 bp, Homo sapiens
atcctcagccccaggg

SEQ ID NO: 5255285 - DNA, 17 bp, Homo sapiens
atcctcagccccagggc

SEQ ID NO: 5255286 - DNA, 18 bp, Homo sapiens
atcctcagccccagggcc

SEQ ID NO: 5255287 - DNA, 21 bp, Homo sapiens
atcctcagccccagggccctg

SEQ ID NO: 5255288 - DNA, 16 bp, Homo sapiens
atcctcaggatttcat

SEQ ID NO: 5255289 - DNA, 11 bp, Homo sapiens
atcctcagtgc

SEQ ID NO: 5255290 - DNA, 20 bp, Homo sapiens
atcctcagtgcaaaatgtct

SEQ ID NO: 5255291 - DNA, 22 bp, Homo sapiens
atcctcagttcctgcagcagag

SEQ ID NO: 5255292 - DNA, 17 bp, Homo sapiens
atcctcatacccacccc

SEQ ID NO: 5255293 - DNA, 20 bp, Homo sapiens
atcctcatatggcccagtgt

SEQ ID NO: 5255294 - DNA, 21 bp, Homo sapiens
atcctcatatggcccagtgtc

SEQ ID NO: 5255295 - DNA, 14 bp, Homo sapiens
atcctcatcttgga

SEQ ID NO: 5255296 - DNA, 15 bp, Homo sapiens
atcctcattgcctcc

SEQ ID NO: 5255297 - DNA, 16 bp, Homo sapiens
atcctcattgcctcct

SEQ ID NO: 5255298 - DNA, 22 bp, Homo sapiens
atcctcatttgaggaagctctc

SEQ ID NO: 5255299 - DNA, 20 bp, Homo sapiens
atcctccaacgttaaaagac

SEQ ID NO: 5255300 - DNA, 23 bp, Homo sapiens
atcctccaacgttaaaagacagt

SEQ ID NO: 5255301 - DNA, 19 bp, Homo sapiens
atcctccaatgtctaattt

SEQ ID NO: 5255302 - DNA, 12 bp, Homo sapiens
atcctccacaga

SEQ ID NO: 5255303 - DNA, 18 bp, Homo sapiens
atcctccacatcctgtgt

SEQ ID NO: 5255304 - DNA, 21 bp, Homo sapiens
atcctccacatcctgtgtcag

SEQ ID NO: 5255305 - DNA, 17 bp, Homo sapiens
atcctccacttgttcag

SEQ ID NO: 5255306 - DNA, 13 bp, Homo sapiens
atcctccagccct

SEQ ID NO: 5255307 - DNA, 12 bp, Homo sapiens
atcctccagctt

SEQ ID NO: 5255308 - DNA, 23 bp, Homo sapiens
atcctccagcttctggtactctc

SEQ ID NO: 5255309 - DNA, 21 bp, Homo sapiens
atcctccagcttttgaacctt

SEQ ID NO: 5255310 - DNA, 12 bp, Homo sapiens
atcctccagggc

SEQ ID NO: 5255311 - DNA, 23 bp, Homo sapiens
atcctccagggggcctgcaggcc

SEQ ID NO: 5255312 - DNA, 23 bp, Homo sapiens
atcctccaggtgcacaagctcca

SEQ ID NO: 5255313 - DNA, 13 bp, Homo sapiens
atcctccaggttt

SEQ ID NO: 5255314 - DNA, 15 bp, Homo sapiens
atcctccaggttttt

SEQ ID NO: 5255315 - DNA, 17 bp, Homo sapiens
atcctccaggtttttca

SEQ ID NO: 5255316 - DNA, 21 bp, Homo sapiens
atcctccaggtttttcaatta

SEQ ID NO: 5255317 - DNA, 22 bp, Homo sapiens
atcctccaggtttttcaattaa

SEQ ID NO: 5255318 - DNA, 23 bp, Homo sapiens
atcctccaggtttttcaattaaa

SEQ ID NO: 5255319 - DNA, 19 bp, Homo sapiens
atcctccagtaccttgctt

SEQ ID NO: 5255320 - DNA, 23 bp, Homo sapiens
atcctcccaatctcaatacagcc

SEQ ID NO: 5255321 - DNA, 20 bp, Homo sapiens
atcctcccacttcagcctcc

SEQ ID NO: 5255322 - DNA, 13 bp, Homo sapiens
atcctcccagaaa

SEQ ID NO: 5255323 - DNA, 18 bp, Homo sapiens
atcctcccattgcccagt

SEQ ID NO: 5255324 - DNA, 22 bp, Homo sapiens
atcctccccaccagagctgcct

SEQ ID NO: 5255325 - DNA, 14 bp, Homo sapiens
atcctcccctctcc

SEQ ID NO: 5255326 - DNA, 17 bp, Homo sapiens
atcctcccgccccagcc

SEQ ID NO: 5255327 - DNA, 20 bp, Homo sapiens
atcctcccgccccagcctcc

SEQ ID NO: 5255328 - DNA, 21 bp, Homo sapiens
atcctcccgccccagcctcct

SEQ ID NO: 5255329 - DNA, 16 bp, Homo sapiens
atcctcccgcctcggc

SEQ ID NO: 5255330 - DNA, 22 bp, Homo sapiens
atcctccctacttccaagaaaa

SEQ ID NO: 5255331 - DNA, 14 bp, Homo sapiens
atcctccctgccca

SEQ ID NO: 5255332 - DNA, 12 bp, Homo sapiens
atcctccctgga

SEQ ID NO: 5255333 - DNA, 13 bp, Homo sapiens
atcctccctggag

SEQ ID NO: 5255334 - DNA, 16 bp, Homo sapiens
atcctccctggcagac

SEQ ID NO: 5255335 - DNA, 17 bp, Homo sapiens
atcctccctggcagaca

SEQ ID NO: 5255336 - DNA, 18 bp, Homo sapiens
atcctcccttcccaggag

SEQ ID NO: 5255337 - DNA, 12 bp, Homo sapiens
atcctcccttgc

SEQ ID NO: 5255338 - DNA, 17 bp, Homo sapiens
atcctcccttgccccag

SEQ ID NO: 5255339 - DNA, 20 bp, Homo sapiens
atcctcccttgccccaggcc

SEQ ID NO: 5255340 - DNA, 17 bp, Homo sapiens
atcctccgccctttttg

SEQ ID NO: 5255341 - DNA, 20 bp, Homo sapiens
atcctccgcggaggcccctg

SEQ ID NO: 5255342 - DNA, 14 bp, Homo sapiens
atcctcctcagatc

SEQ ID NO: 5255343 - DNA, 15 bp, Homo sapiens
atcctcctccagggt

SEQ ID NO: 5255344 - DNA, 14 bp, Homo sapiens
atcctcctcccacc

SEQ ID NO: 5255345 - DNA, 14 bp, Homo sapiens
atcctcctccccag

SEQ ID NO: 5255346 - DNA, 20 bp, Homo sapiens
atcctcctccccagctcttc

SEQ ID NO: 5255347 - DNA, 12 bp, Homo sapiens
atcctcctcctc

SEQ ID NO: 5255348 - DNA, 13 bp, Homo sapiens
atcctcctcctca

SEQ ID NO: 5255349 - DNA, 23 bp, Homo sapiens
atcctcctcctggactcccctcc

SEQ ID NO: 5255350 - DNA, 14 bp, Homo sapiens
atcctcctccttcc

SEQ ID NO: 5255351 - DNA, 13 bp, Homo sapiens
atcctcctctcca

SEQ ID NO: 5255352 - DNA, 11 bp, Homo sapiens
atgattccaaa

SEQ ID NO: 5255353 - DNA, 22 bp, Homo sapiens
atgattccaatctctgttctgt

SEQ ID NO: 5255354 - DNA, 15 bp, Homo sapiens
atgattccaggtggc

SEQ ID NO: 5255355 - DNA, 13 bp, Homo sapiens
atgattccctcct

SEQ ID NO: 5255356 - DNA, 19 bp, Homo sapiens
atgattcctggacatcacc

SEQ ID NO: 5255357 - DNA, 18 bp, Homo sapiens
atgattccttgagcattt

SEQ ID NO: 5255358 - DNA, 21 bp, Homo sapiens
atgattccttgagcattttat

SEQ ID NO: 5255359 - DNA, 18 bp, Homo sapiens
atgattctagtacataat

SEQ ID NO: 5255360 - DNA, 21 bp, Homo sapiens
atgattctagtacataattga

SEQ ID NO: 5255361 - DNA, 20 bp, Homo sapiens
atgattctatgtaatgtaaa

SEQ ID NO: 5255362 - DNA, 20 bp, Homo sapiens
atgattctcctgcctcagct

SEQ ID NO: 5255363 - DNA, 13 bp, Homo sapiens
atgattctctgag

SEQ ID NO: 5255364 - DNA, 13 bp, Homo sapiens
atgattctgaact

SEQ ID NO: 5255365 - DNA, 22 bp, Homo sapiens
atgattctgatgtactctaaat

SEQ ID NO: 5255366 - DNA, 15 bp, Homo sapiens
atgattctgctttta

SEQ ID NO: 5255367 - DNA, 23 bp, Homo sapiens
atgattctgcttttaccatgccc

SEQ ID NO: 5255368 - DNA, 19 bp, Homo sapiens
atgattcttactgttcttc

SEQ ID NO: 5255369 - DNA, 20 bp, Homo sapiens
atgattcttactgttcttcg

SEQ ID NO: 5255370 - DNA, 16 bp, Homo sapiens
atgattcttccagata

SEQ ID NO: 5255371 - DNA, 18 bp, Homo sapiens
atgattcttccagataat

SEQ ID NO: 5255372 - DNA, 14 bp, Homo sapiens
atgattcttctctt

SEQ ID NO: 5255373 - DNA, 19 bp, Homo sapiens
atgattcttctcttgtgat

SEQ ID NO: 5255374 - DNA, 21 bp, Homo sapiens
atgattcttgtgtcatcaagt

SEQ ID NO: 5255375 - DNA, 14 bp, Homo sapiens
atgattgagagcag

SEQ ID NO: 5255376 - DNA, 15 bp, Homo sapiens
atgattgagagcagc

SEQ ID NO: 5255377 - DNA, 21 bp, Homo sapiens
atgattgagagcagcctcttg

SEQ ID NO: 5255378 - DNA, 16 bp, Homo sapiens
atgattgcactaaata

SEQ ID NO: 5255379 - DNA, 21 bp, Homo sapiens
atgattgcagaattgtttaga

SEQ ID NO: 5255380 - DNA, 13 bp, Homo sapiens
atgattgctttta

SEQ ID NO: 5255381 - DNA, 19 bp, Homo sapiens
atgattggaatattacaat

SEQ ID NO: 5255382 - DNA, 14 bp, Homo sapiens
atgattggattatt

SEQ ID NO: 5255383 - DNA, 16 bp, Homo sapiens
atgattggattattca

SEQ ID NO: 5255384 - DNA, 22 bp, Homo sapiens
atgattggattattcatttaaa

SEQ ID NO: 5255385 - DNA, 15 bp, Homo sapiens
atgattggcttaaag

SEQ ID NO: 5255386 - DNA, 22 bp, Homo sapiens
atgattggtaggaaatagaatg

SEQ ID NO: 5255387 - DNA, 14 bp, Homo sapiens
atgattgtaacata

SEQ ID NO: 5255388 - DNA, 18 bp, Homo sapiens
atgattgtataatgtgat

SEQ ID NO: 5255389 - DNA, 20 bp, Homo sapiens
atgattgtataatgtgattt

SEQ ID NO: 5255390 - DNA, 15 bp, Homo sapiens
atgattgtatttgtg

SEQ ID NO: 5255391 - DNA, 12 bp, Homo sapiens
atgattgtttct

SEQ ID NO: 5255392 - DNA, 15 bp, Homo sapiens
atgattgtttgcaca

SEQ ID NO: 5255393 - DNA, 16 bp, Homo sapiens
atgatttaaaaacaac

SEQ ID NO: 5255394 - DNA, 13 bp, Homo sapiens
atgatttaaaaca

SEQ ID NO: 5255395 - DNA, 19 bp, Homo sapiens
atgatttaaagactacaat

SEQ ID NO: 5255396 - DNA, 24 bp, Homo sapiens
atgatttaaaggttgagtatgtga

SEQ ID NO: 5255397 - DNA, 13 bp, Homo sapiens
atgatttaacatt

SEQ ID NO: 5255398 - DNA, 21 bp, Homo sapiens
atgatttaagcattttactgt

SEQ ID NO: 5255399 - DNA, 15 bp, Homo sapiens
atgatttaagtatac

SEQ ID NO: 5255400 - DNA, 15 bp, Homo sapiens
atgatttaattctta

SEQ ID NO: 5255401 - DNA, 15 bp, Homo sapiens
atgatttactggaat

SEQ ID NO: 5255402 - DNA, 18 bp, Homo sapiens
atgatttagagtgctgtc

SEQ ID NO: 5255403 - DNA, 22 bp, Homo sapiens
atgatttagcaagcaactaatt

SEQ ID NO: 5255404 - DNA, 13 bp, Homo sapiens
atgatttagtgtt

SEQ ID NO: 5255405 - DNA, 15 bp, Homo sapiens
atgatttagtgttgt

SEQ ID NO: 5255406 - DNA, 13 bp, Homo sapiens
atgatttatagtt

SEQ ID NO: 5255407 - DNA, 15 bp, Homo sapiens
atgatttatatatgg

SEQ ID NO: 5255408 - DNA, 18 bp, Homo sapiens
atgatttatatatggcat

SEQ ID NO: 5255409 - DNA, 17 bp, Homo sapiens
atgatttcaatagcttt

SEQ ID NO: 5255410 - DNA, 20 bp, Homo sapiens
atgatttcaatgattgttta

SEQ ID NO: 5255411 - DNA, 13 bp, Homo sapiens
atgatttcacaaa

SEQ ID NO: 5255412 - DNA, 22 bp, Homo sapiens
atgatttcacaaatattaaaaa

SEQ ID NO: 5255413 - DNA, 18 bp, Homo sapiens
atgatttcactagaaaag

SEQ ID NO: 5255414 - DNA, 21 bp, Homo sapiens
atgatttcactagaaaagctg

SEQ ID NO: 5255415 - DNA, 16 bp, Homo sapiens
atgatttcagaaacaa

SEQ ID NO: 5255416 - DNA, 13 bp, Homo sapiens
atgatttcagaag

SEQ ID NO: 5255417 - DNA, 19 bp, Homo sapiens
atgatttcagctcactgca

SEQ ID NO: 5255418 - DNA, 21 bp, Homo sapiens
atgatttcagttctaggaaaa

SEQ ID NO: 5255419 - DNA, 19 bp, Homo sapiens
atgatttcatcttctggaa

SEQ ID NO: 5255420 - DNA, 20 bp, Homo sapiens
atgatttcatgctatctctg

SEQ ID NO: 5255421 - DNA, 13 bp, Homo sapiens
atgatttcatgta

SEQ ID NO: 5255422 - DNA, 23 bp, Homo sapiens
atgatttcccaaatgaaatactg

SEQ ID NO: 5255423 - DNA, 14 bp, Homo sapiens
atgatttcccccct

SEQ ID NO: 5255424 - DNA, 22 bp, Homo sapiens
atgatttccctccagagaaagc

SEQ ID NO: 5255425 - DNA, 23 bp, Homo sapiens
atgatttccctccagagaaagca

SEQ ID NO: 5255426 - DNA, 20 bp, Homo sapiens
atgatttccttcaatgtgca

SEQ ID NO: 5255427 - DNA, 15 bp, Homo sapiens
atgatttccttgaat

SEQ ID NO: 5255428 - DNA, 19 bp, Homo sapiens
atgatttccttgaatgtgg

SEQ ID NO: 5255429 - DNA, 21 bp, Homo sapiens
atgatttccttgaatgtggct

SEQ ID NO: 5255430 - DNA, 14 bp, Homo sapiens
atgatttcttctta

SEQ ID NO: 5255431 - DNA, 15 bp, Homo sapiens
atgatttgcaacttt

SEQ ID NO: 5255432 - DNA, 19 bp, Homo sapiens
atgatttgcaactttagaa

SEQ ID NO: 5255433 - DNA, 12 bp, Homo sapiens
atgatttgcaat

SEQ ID NO: 5255434 - DNA, 17 bp, Homo sapiens
atgatttgcatgtgtaa

SEQ ID NO: 5255435 - DNA, 19 bp, Homo sapiens
atgatttgggggaggcttt

SEQ ID NO: 5255436 - DNA, 21 bp, Homo sapiens
atgatttgtaaaggactattt

SEQ ID NO: 5255437 - DNA, 17 bp, Homo sapiens
atgatttgtcccagcct

SEQ ID NO: 5255438 - DNA, 17 bp, Homo sapiens
atgatttgttttgaatt

SEQ ID NO: 5255439 - DNA, 21 bp, Homo sapiens
atgatttgttttgaattttgt

SEQ ID NO: 5255440 - DNA, 19 bp, Homo sapiens
atgattttaacagttttac

SEQ ID NO: 5255441 - DNA, 17 bp, Homo sapiens
atgattttaattttata

SEQ ID NO: 5255442 - DNA, 16 bp, Homo sapiens
atgattttacagagaa

SEQ ID NO: 5255443 - DNA, 20 bp, Homo sapiens
atgattttacagagaatctg

SEQ ID NO: 5255444 - DNA, 21 bp, Homo sapiens
atgattttacttagcaatgtt

SEQ ID NO: 5255445 - DNA, 12 bp, Homo sapiens
atgattttatac

SEQ ID NO: 5255446 - DNA, 13 bp, Homo sapiens
atgattttataca

SEQ ID NO: 5255447 - DNA, 14 bp, Homo sapiens
atgattttatacat

SEQ ID NO: 5255448 - DNA, 19 bp, Homo sapiens
atgattttatacatagtca

SEQ ID NO: 5255449 - DNA, 13 bp, Homo sapiens
atgattttattac

SEQ ID NO: 5255450 - DNA, 15 bp, Homo sapiens
atgattttattacag

SEQ ID NO: 5255451 - DNA, 16 bp, Homo sapiens
atgattttatttgaca

SEQ ID NO: 5255452 - DNA, 20 bp, Homo sapiens
atgattttcataacttattg

SEQ ID NO: 5255453 - DNA, 22 bp, Homo sapiens
atgattttcataacttattgct

SEQ ID NO: 5255454 - DNA, 14 bp, Homo sapiens
atgattttctattt

SEQ ID NO: 5255455 - DNA, 18 bp, Homo sapiens
atgattttgatgcacaac

SEQ ID NO: 5255456 - DNA, 15 bp, Homo sapiens
atgattttgcttttc

SEQ ID NO: 5255457 - DNA, 14 bp, Homo sapiens
atgattttgtaatt

SEQ ID NO: 5255458 - DNA, 14 bp, Homo sapiens
atgatttttaaaga

SEQ ID NO: 5255459 - DNA, 12 bp, Homo sapiens
atgatttttaac

SEQ ID NO: 5255460 - DNA, 22 bp, Homo sapiens
atgatttttagatgagattgtt

SEQ ID NO: 5255461 - DNA, 14 bp, Homo sapiens
atgatttttcattg

SEQ ID NO: 5255462 - DNA, 16 bp, Homo sapiens
atgatttttgccctgc

SEQ ID NO: 5255463 - DNA, 15 bp, Homo sapiens
atgatttttgtcatc

SEQ ID NO: 5255464 - DNA, 19 bp, Homo sapiens
atgattttttaaaagaaat

SEQ ID NO: 5255465 - DNA, 22 bp, Homo sapiens
atgattttttaaaagaaattta

SEQ ID NO: 5255466 - DNA, 19 bp, Homo sapiens
atgattttttaaggagctg

SEQ ID NO: 5255467 - DNA, 15 bp, Homo sapiens
atgattttttgaaag

SEQ ID NO: 5255468 - DNA, 22 bp, Homo sapiens
atgcaaaaacatatgtctgtct

SEQ ID NO: 5255469 - DNA, 24 bp, Homo sapiens
atgcaaaaacatatgtctgtcttt

SEQ ID NO: 5255470 - DNA, 17 bp, Homo sapiens
atgcaaaaactctttga

SEQ ID NO: 5255471 - DNA, 23 bp, Homo sapiens
atgcaaaaactctttgagagggt

SEQ ID NO: 5255472 - DNA, 12 bp, Homo sapiens
atgcaaaaagaa

SEQ ID NO: 5255473 - DNA, 16 bp, Homo sapiens
atgcaaaaatgaattc

SEQ ID NO: 5255474 - DNA, 17 bp, Homo sapiens
atgcaaaaatgaattca

SEQ ID NO: 5255475 - DNA, 19 bp, Homo sapiens
atgcaaaaattagccgggc

SEQ ID NO: 5255476 - DNA, 12 bp, Homo sapiens
atgcaaaagaaa

SEQ ID NO: 5255477 - DNA, 17 bp, Homo sapiens
atgcaaaagaaagcaaa

SEQ ID NO: 5255478 - DNA, 18 bp, Homo sapiens
atgcaaaagaagtggcat

SEQ ID NO: 5255479 - DNA, 13 bp, Homo sapiens
atgcaaaagcaag

SEQ ID NO: 5255480 - DNA, 17 bp, Homo sapiens
atgcaaaagcagctaaa

SEQ ID NO: 5255481 - DNA, 14 bp, Homo sapiens
atgcaaaaggttta

SEQ ID NO: 5255482 - DNA, 19 bp, Homo sapiens
atgcaaaatagacatcttt

SEQ ID NO: 5255483 - DNA, 17 bp, Homo sapiens
atgcaaaatatgtttaa

SEQ ID NO: 5255484 - DNA, 11 bp, Homo sapiens
atgcaaaatgg

SEQ ID NO: 5255485 - DNA, 22 bp, Homo sapiens
atgcaaaattgttttcacttgt

SEQ ID NO: 5255486 - DNA, 13 bp, Homo sapiens
atgcaaaatttag

SEQ ID NO: 5255487 - DNA, 22 bp, Homo sapiens
atgcaaaatttagaagaaaagt

SEQ ID NO: 5255488 - DNA, 15 bp, Homo sapiens
atgcaaacaagaaac

SEQ ID NO: 5255489 - DNA, 16 bp, Homo sapiens
atgcaaacactgtgta

SEQ ID NO: 5255490 - DNA, 21 bp, Homo sapiens
atgcaaacaggttgttttcta

SEQ ID NO: 5255491 - DNA, 22 bp, Homo sapiens
atgcaaacaggttgttttctac

SEQ ID NO: 5255492 - DNA, 14 bp, Homo sapiens
atgcaaacagttct

SEQ ID NO: 5255493 - DNA, 20 bp, Homo sapiens
atgcaaacataacaaaatca

SEQ ID NO: 5255494 - DNA, 14 bp, Homo sapiens
atgcaaaccatagc

SEQ ID NO: 5255495 - DNA, 20 bp, Homo sapiens
atgcaaaccatcattgaaat

SEQ ID NO: 5255496 - DNA, 22 bp, Homo sapiens
atgcaaaccatcattgaaatct

SEQ ID NO: 5255497 - DNA, 22 bp, Homo sapiens
atgcaaacgttggagtttgggc

SEQ ID NO: 5255498 - DNA, 16 bp, Homo sapiens
atgcaaactctttggt

SEQ ID NO: 5255499 - DNA, 22 bp, Homo sapiens
atgcaaactgctttattttccc

SEQ ID NO: 5255500 - DNA, 13 bp, Homo sapiens
atgcaaagaactc

SEQ ID NO: 5255501 - DNA, 20 bp, Homo sapiens
atgcaaagatgaaggtctgt

SEQ ID NO: 5255502 - DNA, 17 bp, Homo sapiens
atgcaaagcacacctcg

SEQ ID NO: 5255503 - DNA, 12 bp, Homo sapiens
atgcaaagcact

SEQ ID NO: 5255504 - DNA, 14 bp, Homo sapiens
atgcaaagcactga

SEQ ID NO: 5255505 - DNA, 16 bp, Homo sapiens
atgcaaagtacaatgt

SEQ ID NO: 5255506 - DNA, 22 bp, Homo sapiens
atgcaaagttacatgaggggaa

SEQ ID NO: 5255507 - DNA, 21 bp, Homo sapiens
atgcaaagttctgtgtttaat

SEQ ID NO: 5255508 - DNA, 18 bp, Homo sapiens
atgcaaataaagcctgct

SEQ ID NO: 5255509 - DNA, 16 bp, Homo sapiens
atgcaaataacacaaa

SEQ ID NO: 5255510 - DNA, 21 bp, Homo sapiens
atgcaaatagtagacatttgt

SEQ ID NO: 5255511 - DNA, 23 bp, Homo sapiens
atgcaaatagtagacatttgtgt

SEQ ID NO: 5255512 - DNA, 18 bp, Homo sapiens
atgcaaatatttttttgt

SEQ ID NO: 5255513 - DNA, 18 bp, Homo sapiens
atgcaaatcagtctcaca

SEQ ID NO: 5255514 - DNA, 18 bp, Homo sapiens
atgcaaatcctatgtgat

SEQ ID NO: 5255515 - DNA, 11 bp, Homo sapiens
atgcaaatgaa

SEQ ID NO: 5255516 - DNA, 15 bp, Homo sapiens
atgcaaatgaatcat

SEQ ID NO: 5255517 - DNA, 19 bp, Homo sapiens
atgcaaatgaatcattgtt

SEQ ID NO: 5255518 - DNA, 18 bp, Homo sapiens
atgcaaatgagatttctt

SEQ ID NO: 5255519 - DNA, 19 bp, Homo sapiens
atgcaaatgagctctgaaa

SEQ ID NO: 5255520 - DNA, 15 bp, Homo sapiens
atgcaaattaaaaca

SEQ ID NO: 5255521 - DNA, 16 bp, Homo sapiens
atgcaaattaaaacat

SEQ ID NO: 5255522 - DNA, 19 bp, Homo sapiens
atgcaaattaaagggcaga

SEQ ID NO: 5255523 - DNA, 18 bp, Homo sapiens
atgcaaattgtgaaatag

SEQ ID NO: 5255524 - DNA, 19 bp, Homo sapiens
atgcaaatttctataaatt

SEQ ID NO: 5255525 - DNA, 14 bp, Homo sapiens
atgcaacaaatgaa

SEQ ID NO: 5255526 - DNA, 16 bp, Homo sapiens
atgcaacaaatgtggc

SEQ ID NO: 5255527 - DNA, 23 bp, Homo sapiens
atgcaacaaatgtggccaagcct

SEQ ID NO: 5255528 - DNA, 21 bp, Homo sapiens
atgcaacatacgggaagttta

SEQ ID NO: 5255529 - DNA, 23 bp, Homo sapiens
atgcaacatacgggaagtttatt

SEQ ID NO: 5255530 - DNA, 13 bp, Homo sapiens
atcctcctgagta

SEQ ID NO: 5255531 - DNA, 19 bp, Homo sapiens
atcctcctgagtagctggg

SEQ ID NO: 5255532 - DNA, 11 bp, Homo sapiens
atcctcctgca

SEQ ID NO: 5255533 - DNA, 11 bp, Homo sapiens
atcctcctgcc

SEQ ID NO: 5255534 - DNA, 13 bp, Homo sapiens
atcctcctgccca

SEQ ID NO: 5255535 - DNA, 19 bp, Homo sapiens
atcctcctgcccagctcct

SEQ ID NO: 5255536 - DNA, 22 bp, Homo sapiens
atcctcctgcccccaccccagg

SEQ ID NO: 5255537 - DNA, 14 bp, Homo sapiens
atcctcctgcctca

SEQ ID NO: 5255538 - DNA, 21 bp, Homo sapiens
atcctcctggacccagcaggg

SEQ ID NO: 5255539 - DNA, 18 bp, Homo sapiens
atcctcctgggattggct

SEQ ID NO: 5255540 - DNA, 12 bp, Homo sapiens
atcctcctgtct

SEQ ID NO: 5255541 - DNA, 16 bp, Homo sapiens
atcctcctgttctgaa

SEQ ID NO: 5255542 - DNA, 13 bp, Homo sapiens
atcctccttccag

SEQ ID NO: 5255543 - DNA, 16 bp, Homo sapiens
atcctccttccaggcc

SEQ ID NO: 5255544 - DNA, 22 bp, Homo sapiens
atcctccttccaggccccaggc

SEQ ID NO: 5255545 - DNA, 20 bp, Homo sapiens
atcctccttctcctgttcca

SEQ ID NO: 5255546 - DNA, 21 bp, Homo sapiens
atcctctattaattactgtgt

SEQ ID NO: 5255547 - DNA, 16 bp, Homo sapiens
atcctctatttcctga

SEQ ID NO: 5255548 - DNA, 16 bp, Homo sapiens
atcctctattttgtga

SEQ ID NO: 5255549 - DNA, 13 bp, Homo sapiens
atcctctcacctc

SEQ ID NO: 5255550 - DNA, 16 bp, Homo sapiens
atcctctcacctcagc

SEQ ID NO: 5255551 - DNA, 21 bp, Homo sapiens
atcctctccacagctgcctct

SEQ ID NO: 5255552 - DNA, 15 bp, Homo sapiens
atcctctccaccctc

SEQ ID NO: 5255553 - DNA, 11 bp, Homo sapiens
atcctctccag

SEQ ID NO: 5255554 - DNA, 20 bp, Homo sapiens
atcctctccccctcctccag

SEQ ID NO: 5255555 - DNA, 16 bp, Homo sapiens
atcctctctcccctct

SEQ ID NO: 5255556 - DNA, 13 bp, Homo sapiens
atcctctcttcct

SEQ ID NO: 5255557 - DNA, 13 bp, Homo sapiens
atcctctgactcc

SEQ ID NO: 5255558 - DNA, 12 bp, Homo sapiens
atcctctgcctc

SEQ ID NO: 5255559 - DNA, 14 bp, Homo sapiens
atcctctgcctcaa

SEQ ID NO: 5255560 - DNA, 14 bp, Homo sapiens
atcctctggacacg

SEQ ID NO: 5255561 - DNA, 13 bp, Homo sapiens
atcctctggcttg

SEQ ID NO: 5255562 - DNA, 18 bp, Homo sapiens
atcctctgggagcttctt

SEQ ID NO: 5255563 - DNA, 21 bp, Homo sapiens
atcctctggggttcatctagg

SEQ ID NO: 5255564 - DNA, 22 bp, Homo sapiens
atcctctgttaatgtggactgg

SEQ ID NO: 5255565 - DNA, 18 bp, Homo sapiens
atcctctgttttctctct

SEQ ID NO: 5255566 - DNA, 19 bp, Homo sapiens
atcctctgttttctctctg

SEQ ID NO: 5255567 - DNA, 17 bp, Homo sapiens
atcctcttctaactcat

SEQ ID NO: 5255568 - DNA, 21 bp, Homo sapiens
atcctcttctcaaagctggga

SEQ ID NO: 5255569 - DNA, 20 bp, Homo sapiens
atcctcttcttttagcagta

SEQ ID NO: 5255570 - DNA, 17 bp, Homo sapiens
atcctcttgctatataa

SEQ ID NO: 5255571 - DNA, 22 bp, Homo sapiens
atcctcttgctatataaataaa

SEQ ID NO: 5255572 - DNA, 15 bp, Homo sapiens
atcctcttgtatact

SEQ ID NO: 5255573 - DNA, 17 bp, Homo sapiens
atcctctttactctggg

SEQ ID NO: 5255574 - DNA, 15 bp, Homo sapiens
atcctctttagagtt

SEQ ID NO: 5255575 - DNA, 20 bp, Homo sapiens
atcctctttctcttttctag

SEQ ID NO: 5255576 - DNA, 17 bp, Homo sapiens
atcctctttgagtgaag

SEQ ID NO: 5255577 - DNA, 22 bp, Homo sapiens
atcctcttttgtattgtttcta

SEQ ID NO: 5255578 - DNA, 17 bp, Homo sapiens
atcctgaaacagtgttt

SEQ ID NO: 5255579 - DNA, 14 bp, Homo sapiens
atcctgaaagccag

SEQ ID NO: 5255580 - DNA, 15 bp, Homo sapiens
atcctgaacaagaaa

SEQ ID NO: 5255581 - DNA, 19 bp, Homo sapiens
atcctgaactttctccctc

SEQ ID NO: 5255582 - DNA, 16 bp, Homo sapiens
atcctgaagaaaccac

SEQ ID NO: 5255583 - DNA, 18 bp, Homo sapiens
atcctgaagaaaccacag

SEQ ID NO: 5255584 - DNA, 24 bp, Homo sapiens
atcctgaccagctgctccgaggac

SEQ ID NO: 5255585 - DNA, 16 bp, Homo sapiens
atcctgacctcctgga

SEQ ID NO: 5255586 - DNA, 23 bp, Homo sapiens
atcctgacctcctggactgtagg

SEQ ID NO: 5255587 - DNA, 18 bp, Homo sapiens
atcctgactaagcctttg

SEQ ID NO: 5255588 - DNA, 21 bp, Homo sapiens
atcctgactattatgttgtta

SEQ ID NO: 5255589 - DNA, 15 bp, Homo sapiens
atcctgactctgccc

SEQ ID NO: 5255590 - DNA, 20 bp, Homo sapiens
atcctgagaagtacctttgt

SEQ ID NO: 5255591 - DNA, 21 bp, Homo sapiens
atcctgagagacctgccctct

SEQ ID NO: 5255592 - DNA, 22 bp, Homo sapiens
atcctgagagacctgccctctc

SEQ ID NO: 5255593 - DNA, 15 bp, Homo sapiens
atcctgagcagtgta

SEQ ID NO: 5255594 - DNA, 11 bp, Homo sapiens
atcctgagcca

SEQ ID NO: 5255595 - DNA, 13 bp, Homo sapiens
atcctgagccaga

SEQ ID NO: 5255596 - DNA, 21 bp, Homo sapiens
atcctgagccagatttcactc

SEQ ID NO: 5255597 - DNA, 15 bp, Homo sapiens
atcctgagccaggga

SEQ ID NO: 5255598 - DNA, 23 bp, Homo sapiens
atcctgagccagggaacagcccc

SEQ ID NO: 5255599 - DNA, 11 bp, Homo sapiens
atcctgagccc

SEQ ID NO: 5255600 - DNA, 12 bp, Homo sapiens
atcctgagcccc

SEQ ID NO: 5255601 - DNA, 14 bp, Homo sapiens
atcctgagccccgc

SEQ ID NO: 5255602 - DNA, 20 bp, Homo sapiens
atcctgagccccgccctctt

SEQ ID NO: 5255603 - DNA, 22 bp, Homo sapiens
atcctgagccccgccctcttcc

SEQ ID NO: 5255604 - DNA, 21 bp, Homo sapiens
atcctgagctcaaatctctgt

SEQ ID NO: 5255605 - DNA, 20 bp, Homo sapiens
atcctgagcttttctcctca

SEQ ID NO: 5255606 - DNA, 20 bp, Homo sapiens
atcctgaggaccgccccaac

SEQ ID NO: 5255607 - DNA, 17 bp, Homo sapiens
atcctgaggccagtggc

SEQ ID NO: 5255608 - DNA, 18 bp, Homo sapiens
atcctgaggctccacttg

SEQ ID NO: 5255609 - DNA, 22 bp, Homo sapiens
atcctgaggggatatccctatg

SEQ ID NO: 5255610 - DNA, 13 bp, Homo sapiens
atcctgaggtgcc

SEQ ID NO: 5255611 - DNA, 16 bp, Homo sapiens
atcctgaggtgcctcc

SEQ ID NO: 5255612 - DNA, 19 bp, Homo sapiens
atcctgaggtgtaccagga

SEQ ID NO: 5255613 - DNA, 20 bp, Homo sapiens
atcctgataaacattaaaca

SEQ ID NO: 5255614 - DNA, 14 bp, Homo sapiens
atcctgatcaagca

SEQ ID NO: 5255615 - DNA, 19 bp, Homo sapiens
atcctgatgaggtttctac

SEQ ID NO: 5255616 - DNA, 18 bp, Homo sapiens
atcctgatggacctgccc

SEQ ID NO: 5255617 - DNA, 17 bp, Homo sapiens
atcctgattaaatgtct

SEQ ID NO: 5255618 - DNA, 18 bp, Homo sapiens
atcctgattattgaatgt

SEQ ID NO: 5255619 - DNA, 15 bp, Homo sapiens
atcctgattccaaat

SEQ ID NO: 5255620 - DNA, 18 bp, Homo sapiens
atcctgcaaaggcccttg

SEQ ID NO: 5255621 - DNA, 15 bp, Homo sapiens
atcctgcaaggtgaa

SEQ ID NO: 5255622 - DNA, 16 bp, Homo sapiens
atcctgcaaggtgaaa

SEQ ID NO: 5255623 - DNA, 16 bp, Homo sapiens
atcctgcaccccagca

SEQ ID NO: 5255624 - DNA, 16 bp, Homo sapiens
atcctgcagcctcctc

SEQ ID NO: 5255625 - DNA, 16 bp, Homo sapiens
atcctgcaggaaatat

SEQ ID NO: 5255626 - DNA, 22 bp, Homo sapiens
atcctgcaggaaatataaactt

SEQ ID NO: 5255627 - DNA, 19 bp, Homo sapiens
atcctgcaggaacgagcac

SEQ ID NO: 5255628 - DNA, 21 bp, Homo sapiens
atcctgcaggaacgagcactg

SEQ ID NO: 5255629 - DNA, 23 bp, Homo sapiens
atcctgcaggaacgagcactggc

SEQ ID NO: 5255630 - DNA, 17 bp, Homo sapiens
atcctgcagttgggcca

SEQ ID NO: 5255631 - DNA, 15 bp, Homo sapiens
atcctgcattttacg

SEQ ID NO: 5255632 - DNA, 22 bp, Homo sapiens
atcctgcattttacgtctttgg

SEQ ID NO: 5255633 - DNA, 18 bp, Homo sapiens
atcctgccaccctgtagc

SEQ ID NO: 5255634 - DNA, 13 bp, Homo sapiens
atcctgccagccc

SEQ ID NO: 5255635 - DNA, 22 bp, Homo sapiens
atcctgccagccccacacagct

SEQ ID NO: 5255636 - DNA, 22 bp, Homo sapiens
atcctgccaggagcagcctcca

SEQ ID NO: 5255637 - DNA, 14 bp, Homo sapiens
atcctgccatcctc

SEQ ID NO: 5255638 - DNA, 21 bp, Homo sapiens
atcctgcccagtgttgtttgt

SEQ ID NO: 5255639 - DNA, 22 bp, Homo sapiens
atcctgcccagtgttgtttgta

SEQ ID NO: 5255640 - DNA, 13 bp, Homo sapiens
atcctgcccctga

SEQ ID NO: 5255641 - DNA, 17 bp, Homo sapiens
atcctgcccgagggcag

SEQ ID NO: 5255642 - DNA, 19 bp, Homo sapiens
atcctgccctgcagcacgc

SEQ ID NO: 5255643 - DNA, 10 bp, Homo sapiens
atcctgcctg

SEQ ID NO: 5255644 - DNA, 20 bp, Homo sapiens
atcctgcctgggtgggacag

SEQ ID NO: 5255645 - DNA, 19 bp, Homo sapiens
atcctgccttagagccagg

SEQ ID NO: 5255646 - DNA, 21 bp, Homo sapiens
atcctgccttagagccaggca

SEQ ID NO: 5255647 - DNA, 17 bp, Homo sapiens
atcctgccttcatggaa

SEQ ID NO: 5255648 - DNA, 21 bp, Homo sapiens
atcctgccttttaccttcagt

SEQ ID NO: 5255649 - DNA, 22 bp, Homo sapiens
atcctgcggcaggactgcagag

SEQ ID NO: 5255650 - DNA, 23 bp, Homo sapiens
atcctgcggcaggactgcagagc

SEQ ID NO: 5255651 - DNA, 19 bp, Homo sapiens
atcctgctagcacctcccc

SEQ ID NO: 5255652 - DNA, 22 bp, Homo sapiens
atcctgctagcacctccccaga

SEQ ID NO: 5255653 - DNA, 16 bp, Homo sapiens
atcctgctcacatctg

SEQ ID NO: 5255654 - DNA, 22 bp, Homo sapiens
atcctgctcataacatctttga

SEQ ID NO: 5255655 - DNA, 13 bp, Homo sapiens
atcctgctccagc

SEQ ID NO: 5255656 - DNA, 16 bp, Homo sapiens
atcctgctccagcagc

SEQ ID NO: 5255657 - DNA, 22 bp, Homo sapiens
atcctgctcttccatttcttcc

SEQ ID NO: 5255658 - DNA, 18 bp, Homo sapiens
atcctgctgacctcactg

SEQ ID NO: 5255659 - DNA, 19 bp, Homo sapiens
atcctgctgcatgacctat

SEQ ID NO: 5255660 - DNA, 14 bp, Homo sapiens
atcctgctgccaga

SEQ ID NO: 5255661 - DNA, 20 bp, Homo sapiens
atcctgctgccagagaacca

SEQ ID NO: 5255662 - DNA, 14 bp, Homo sapiens
atcctgctgctgtg

SEQ ID NO: 5255663 - DNA, 15 bp, Homo sapiens
atcctgctggggctg

SEQ ID NO: 5255664 - DNA, 14 bp, Homo sapiens
atcctgctgttcta

SEQ ID NO: 5255665 - DNA, 14 bp, Homo sapiens
atcctgcttcctga

SEQ ID NO: 5255666 - DNA, 21 bp, Homo sapiens
atcctgcttcttcttccaaat

SEQ ID NO: 5255667 - DNA, 16 bp, Homo sapiens
atcctgctttccctcc

SEQ ID NO: 5255668 - DNA, 17 bp, Homo sapiens
atcctggaaccactgat

SEQ ID NO: 5255669 - DNA, 22 bp, Homo sapiens
atcctggaaggacacagtgatg

SEQ ID NO: 5255670 - DNA, 16 bp, Homo sapiens
atcctggactgagggg

SEQ ID NO: 5255671 - DNA, 23 bp, Homo sapiens
atcctggactgagggggcctgga

SEQ ID NO: 5255672 - DNA, 15 bp, Homo sapiens
atcctggagcccctg

SEQ ID NO: 5255673 - DNA, 16 bp, Homo sapiens
atcctggaggcccagt

SEQ ID NO: 5255674 - DNA, 20 bp, Homo sapiens
atcctggaggcccagttcac

SEQ ID NO: 5255675 - DNA, 21 bp, Homo sapiens
atcctggaggtcttttctagt

SEQ ID NO: 5255676 - DNA, 23 bp, Homo sapiens
atcctggagtctcactgtctgct

SEQ ID NO: 5255677 - DNA, 23 bp, Homo sapiens
atcctggatgatttcatcttctg

SEQ ID NO: 5255678 - DNA, 16 bp, Homo sapiens
atcctggattcactca

SEQ ID NO: 5255679 - DNA, 16 bp, Homo sapiens
atcctggcaagaaagc

SEQ ID NO: 5255680 - DNA, 19 bp, Homo sapiens
atcctggcacccggcccct

SEQ ID NO: 5255681 - DNA, 15 bp, Homo sapiens
atcctggcagcccag

SEQ ID NO: 5255682 - DNA, 17 bp, Homo sapiens
atcctggccaacatggt

SEQ ID NO: 5255683 - DNA, 11 bp, Homo sapiens
atcctggccca

SEQ ID NO: 5255684 - DNA, 18 bp, Homo sapiens
atcctggcccagggcatc

SEQ ID NO: 5255685 - DNA, 12 bp, Homo sapiens
atcctggcccat

SEQ ID NO: 5255686 - DNA, 13 bp, Homo sapiens
atcctggcccatc

SEQ ID NO: 5255687 - DNA, 11 bp, Homo sapiens
atcctggcccc

SEQ ID NO: 5255688 - DNA, 20 bp, Homo sapiens
atcctggcccctccagaccc

SEQ ID NO: 5255689 - DNA, 14 bp, Homo sapiens
atcctggccctctg

SEQ ID NO: 5255690 - DNA, 18 bp, Homo sapiens
atcctggcctccttttgc

SEQ ID NO: 5255691 - DNA, 12 bp, Homo sapiens
atcctggcctga

SEQ ID NO: 5255692 - DNA, 19 bp, Homo sapiens
atcctggctctgtggcttg

SEQ ID NO: 5255693 - DNA, 24 bp, Homo sapiens
atcctggctctttggagatcaagg

SEQ ID NO: 5255694 - DNA, 11 bp, Homo sapiens
atcctggctgg

SEQ ID NO: 5255695 - DNA, 15 bp, Homo sapiens
atcctggctggagaa

SEQ ID NO: 5255696 - DNA, 12 bp, Homo sapiens
atcctggctggc

SEQ ID NO: 5255697 - DNA, 12 bp, Homo sapiens
atcctgggacct

SEQ ID NO: 5255698 - DNA, 20 bp, Homo sapiens
atcctgggatccagtgtata

SEQ ID NO: 5255699 - DNA, 20 bp, Homo sapiens
atcctgggcatccccagccc

SEQ ID NO: 5255700 - DNA, 18 bp, Homo sapiens
atcctgggcatccttctt

SEQ ID NO: 5255701 - DNA, 20 bp, Homo sapiens
atcctgggcatgtccccagt

SEQ ID NO: 5255702 - DNA, 17 bp, Homo sapiens
atcctgggcccccagag

SEQ ID NO: 5255703 - DNA, 12 bp, Homo sapiens
atcctgggctgg

SEQ ID NO: 5255704 - DNA, 13 bp, Homo sapiens
atcctgggctggc

SEQ ID NO: 5255705 - DNA, 17 bp, Homo sapiens
atcctggggttgccctg

SEQ ID NO: 5255706 - DNA, 12 bp, Homo sapiens
atcctgggtgat

SEQ ID NO: 5255707 - DNA, 23 bp, Homo sapiens
atcctgggtggtctgcaggcagg

SEQ ID NO: 5255708 - DNA, 22 bp, Homo sapiens
atcctggtaagaggcaaagaat

SEQ ID NO: 5255709 - DNA, 15 bp, Homo sapiens
atgcaacctctgccc

SEQ ID NO: 5255710 - DNA, 18 bp, Homo sapiens
atgcaactccatgcctat

SEQ ID NO: 5255711 - DNA, 19 bp, Homo sapiens
atgcaacttgattcttgtg

SEQ ID NO: 5255712 - DNA, 13 bp, Homo sapiens
atgcaacttttaa

SEQ ID NO: 5255713 - DNA, 14 bp, Homo sapiens
atgcaacttttaat

SEQ ID NO: 5255714 - DNA, 20 bp, Homo sapiens
atgcaacttttaattactgt

SEQ ID NO: 5255715 - DNA, 14 bp, Homo sapiens
atgcaagaaggagg

SEQ ID NO: 5255716 - DNA, 20 bp, Homo sapiens
atgcaagaatttctggaaga

SEQ ID NO: 5255717 - DNA, 21 bp, Homo sapiens
atgcaagacttcactgcagcc

SEQ ID NO: 5255718 - DNA, 17 bp, Homo sapiens
atgcaagagaacatttt

SEQ ID NO: 5255719 - DNA, 18 bp, Homo sapiens
atgcaagagtgattgcag

SEQ ID NO: 5255720 - DNA, 17 bp, Homo sapiens
atgcaagattgttttca

SEQ ID NO: 5255721 - DNA, 22 bp, Homo sapiens
atgcaagcaaagtatcaaagaa

SEQ ID NO: 5255722 - DNA, 13 bp, Homo sapiens
atgcaagcacaaa

SEQ ID NO: 5255723 - DNA, 21 bp, Homo sapiens
atgcaagcagaggaccagggc

SEQ ID NO: 5255724 - DNA, 17 bp, Homo sapiens
atgcaagccccaacttt

SEQ ID NO: 5255725 - DNA, 23 bp, Homo sapiens
atgcaagctagtggcttcaaaat

SEQ ID NO: 5255726 - DNA, 14 bp, Homo sapiens
atgcaagctctgga

SEQ ID NO: 5255727 - DNA, 20 bp, Homo sapiens
atgcaagcttggtcaaactt

SEQ ID NO: 5255728 - DNA, 21 bp, Homo sapiens
atgcaagcttggtcaaacttt

SEQ ID NO: 5255729 - DNA, 15 bp, Homo sapiens
atgcaaggaccagga

SEQ ID NO: 5255730 - DNA, 17 bp, Homo sapiens
atgcaaggattacagaa

SEQ ID NO: 5255731 - DNA, 20 bp, Homo sapiens
atgcaaggattacagaaact

SEQ ID NO: 5255732 - DNA, 21 bp, Homo sapiens
atgcaaggcactgtactaggc

SEQ ID NO: 5255733 - DNA, 17 bp, Homo sapiens
atgcaaggggctgcatg

SEQ ID NO: 5255734 - DNA, 16 bp, Homo sapiens
atgcaagggtgctgtg

SEQ ID NO: 5255735 - DNA, 20 bp, Homo sapiens
atgcaaggtatttctccagt

SEQ ID NO: 5255736 - DNA, 23 bp, Homo sapiens
atgcaaggtgctggtgggtctga

SEQ ID NO: 5255737 - DNA, 22 bp, Homo sapiens
atgcaagtcactaaatttctca

SEQ ID NO: 5255738 - DNA, 20 bp, Homo sapiens
atgcaagtcgccaggcagga

SEQ ID NO: 5255739 - DNA, 13 bp, Homo sapiens
atgcaagtctgtg

SEQ ID NO: 5255740 - DNA, 14 bp, Homo sapiens
atgcaagtctgtga

SEQ ID NO: 5255741 - DNA, 15 bp, Homo sapiens
atgcaagtctgtgag

SEQ ID NO: 5255742 - DNA, 16 bp, Homo sapiens
atgcaagtctgtgagt

SEQ ID NO: 5255743 - DNA, 16 bp, Homo sapiens
atgcaagtgagaaaga

SEQ ID NO: 5255744 - DNA, 17 bp, Homo sapiens
atgcaagtgagaagctg

SEQ ID NO: 5255745 - DNA, 21 bp, Homo sapiens
atgcaagtgctgtttgggcag

SEQ ID NO: 5255746 - DNA, 18 bp, Homo sapiens
atgcaagtggagctgtct

SEQ ID NO: 5255747 - DNA, 23 bp, Homo sapiens
atgcaagtgtttgaagtctgctc

SEQ ID NO: 5255748 - DNA, 15 bp, Homo sapiens
atgcaagttatttta

SEQ ID NO: 5255749 - DNA, 20 bp, Homo sapiens
atgcaagttattttatttgc

SEQ ID NO: 5255750 - DNA, 16 bp, Homo sapiens
atgcaagttttttttc

SEQ ID NO: 5255751 - DNA, 18 bp, Homo sapiens
atgcaataaaattatttg

SEQ ID NO: 5255752 - DNA, 19 bp, Homo sapiens
atgcaataaaattatttgc

SEQ ID NO: 5255753 - DNA, 20 bp, Homo sapiens
atgcaataaaattatttgca

SEQ ID NO: 5255754 - DNA, 22 bp, Homo sapiens
atgcaataaaattatttgcagg

SEQ ID NO: 5255755 - DNA, 14 bp, Homo sapiens
atgcaataaaattt

SEQ ID NO: 5255756 - DNA, 16 bp, Homo sapiens
atgcaataaagagtaa

SEQ ID NO: 5255757 - DNA, 16 bp, Homo sapiens
atgcaataaataacag

SEQ ID NO: 5255758 - DNA, 17 bp, Homo sapiens
atgcaataaatattatt

SEQ ID NO: 5255759 - DNA, 18 bp, Homo sapiens
atgcaataactctgggag

SEQ ID NO: 5255760 - DNA, 15 bp, Homo sapiens
atgcaataatgtgca

SEQ ID NO: 5255761 - DNA, 22 bp, Homo sapiens
atgcaatactggtcaacttaag

SEQ ID NO: 5255762 - DNA, 22 bp, Homo sapiens
atgcaatagaagtgctcccctc

SEQ ID NO: 5255763 - DNA, 9 bp, Homo sapiens
atgcaatat

SEQ ID NO: 5255764 - DNA, 19 bp, Homo sapiens
atgcaatataaaaatgtga

SEQ ID NO: 5255765 - DNA, 21 bp, Homo sapiens
atgcaatataagcataaaaga

SEQ ID NO: 5255766 - DNA, 19 bp, Homo sapiens
atgcaatatatctaaattg

SEQ ID NO: 5255767 - DNA, 21 bp, Homo sapiens
atgcaatatatctaaattgaa

SEQ ID NO: 5255768 - DNA, 22 bp, Homo sapiens
atgcaatatatctaaattgaat

SEQ ID NO: 5255769 - DNA, 14 bp, Homo sapiens
atgcaatatgtatt

SEQ ID NO: 5255770 - DNA, 13 bp, Homo sapiens
atgcaatcaattt

SEQ ID NO: 5255771 - DNA, 16 bp, Homo sapiens
atgcaatccttacaaa

SEQ ID NO: 5255772 - DNA, 19 bp, Homo sapiens
atgcaatccttacaaatga

SEQ ID NO: 5255773 - DNA, 14 bp, Homo sapiens
atgcaatctctttt

SEQ ID NO: 5255774 - DNA, 18 bp, Homo sapiens
atgcaatgaaaaatactt

SEQ ID NO: 5255775 - DNA, 15 bp, Homo sapiens
atgcaatgaaaacaa

SEQ ID NO: 5255776 - DNA, 18 bp, Homo sapiens
atgcaatgaaaacaaaat

SEQ ID NO: 5255777 - DNA, 21 bp, Homo sapiens
atgcaatgaaacagatgataa

SEQ ID NO: 5255778 - DNA, 19 bp, Homo sapiens
atgcaatgacatcttcaaa

SEQ ID NO: 5255779 - DNA, 23 bp, Homo sapiens
atgcaatgagatagaagatgttt

SEQ ID NO: 5255780 - DNA, 14 bp, Homo sapiens
atgcaatgataaat

SEQ ID NO: 5255781 - DNA, 15 bp, Homo sapiens
atgcaatgataaata

SEQ ID NO: 5255782 - DNA, 17 bp, Homo sapiens
atgcaatgataaataaa

SEQ ID NO: 5255783 - DNA, 12 bp, Homo sapiens
atgcaatgcatc

SEQ ID NO: 5255784 - DNA, 23 bp, Homo sapiens
atgcaatgcttcattattcaaga

SEQ ID NO: 5255785 - DNA, 24 bp, Homo sapiens
atgcaatgtaagcatactttgtaa

SEQ ID NO: 5255786 - DNA, 22 bp, Homo sapiens
atgcaatgtcttaaataaaact

SEQ ID NO: 5255787 - DNA, 13 bp, Homo sapiens
atgcaatgtgcta

SEQ ID NO: 5255788 - DNA, 16 bp, Homo sapiens
atgcaatgtgctactg

SEQ ID NO: 5255789 - DNA, 17 bp, Homo sapiens
atgcaattagatagaaa

SEQ ID NO: 5255790 - DNA, 21 bp, Homo sapiens
atgcaattaggtttttcctta

SEQ ID NO: 5255791 - DNA, 21 bp, Homo sapiens
atgcaattcaatgcaatgaaa

SEQ ID NO: 5255792 - DNA, 16 bp, Homo sapiens
atgcaattcatcccag

SEQ ID NO: 5255793 - DNA, 19 bp, Homo sapiens
atgcaattgctcccatcag

SEQ ID NO: 5255794 - DNA, 14 bp, Homo sapiens
atgcaattgtacaa

SEQ ID NO: 5255795 - DNA, 17 bp, Homo sapiens
atgcaattgtacaaaaa

SEQ ID NO: 5255796 - DNA, 20 bp, Homo sapiens
atgcaattgtacaaaaaagt

SEQ ID NO: 5255797 - DNA, 18 bp, Homo sapiens
atgcaattgttgaaagct

SEQ ID NO: 5255798 - DNA, 20 bp, Homo sapiens
atgcaatttaatggatattt

SEQ ID NO: 5255799 - DNA, 19 bp, Homo sapiens
atgcaatttacttggaatt

SEQ ID NO: 5255800 - DNA, 14 bp, Homo sapiens
atgcaatttgaagt

SEQ ID NO: 5255801 - DNA, 17 bp, Homo sapiens
atgcaatttgattgact

SEQ ID NO: 5255802 - DNA, 20 bp, Homo sapiens
atgcaatttgttattctttt

SEQ ID NO: 5255803 - DNA, 15 bp, Homo sapiens
atgcaatttttaaac

SEQ ID NO: 5255804 - DNA, 20 bp, Homo sapiens
atgcaatttttaaactagta

SEQ ID NO: 5255805 - DNA, 15 bp, Homo sapiens
atgcacaaacagagg

SEQ ID NO: 5255806 - DNA, 18 bp, Homo sapiens
atgcacaaacagaggccg

SEQ ID NO: 5255807 - DNA, 15 bp, Homo sapiens
atgcacaaagtgtat

SEQ ID NO: 5255808 - DNA, 15 bp, Homo sapiens
atgcacaaattctgt

SEQ ID NO: 5255809 - DNA, 22 bp, Homo sapiens
atgcacaaattctgtctctgga

SEQ ID NO: 5255810 - DNA, 17 bp, Homo sapiens
atgcacaactctccaaa

SEQ ID NO: 5255811 - DNA, 15 bp, Homo sapiens
atgcacaagatgccc

SEQ ID NO: 5255812 - DNA, 23 bp, Homo sapiens
atgcacaagatgccccagggatg

SEQ ID NO: 5255813 - DNA, 15 bp, Homo sapiens
atgcacaatgtcttg

SEQ ID NO: 5255814 - DNA, 20 bp, Homo sapiens
atgcacacaaacacctccta

SEQ ID NO: 5255815 - DNA, 21 bp, Homo sapiens
atgcacacacacacgctttct

SEQ ID NO: 5255816 - DNA, 17 bp, Homo sapiens
atgcacacacacagaga

SEQ ID NO: 5255817 - DNA, 16 bp, Homo sapiens
atgcacacacatatat

SEQ ID NO: 5255818 - DNA, 13 bp, Homo sapiens
atgcacacagaga

SEQ ID NO: 5255819 - DNA, 15 bp, Homo sapiens
atgcacacagataca

SEQ ID NO: 5255820 - DNA, 15 bp, Homo sapiens
atgcacacagcggct

SEQ ID NO: 5255821 - DNA, 15 bp, Homo sapiens
atgcacacatttttt

SEQ ID NO: 5255822 - DNA, 23 bp, Homo sapiens
atgcacacattttttaaatgcac

SEQ ID NO: 5255823 - DNA, 20 bp, Homo sapiens
atgcacaccaaattgctgag

SEQ ID NO: 5255824 - DNA, 21 bp, Homo sapiens
atgcacaccaaattgctgaga

SEQ ID NO: 5255825 - DNA, 17 bp, Homo sapiens
atgcacacccattcaca

SEQ ID NO: 5255826 - DNA, 16 bp, Homo sapiens
atgcacacctccccct

SEQ ID NO: 5255827 - DNA, 15 bp, Homo sapiens
atgcacacggctggt

SEQ ID NO: 5255828 - DNA, 24 bp, Homo sapiens
atgcacacggctggtcactctgcc

SEQ ID NO: 5255829 - DNA, 21 bp, Homo sapiens
atgcacacgggaaagccttaa

SEQ ID NO: 5255830 - DNA, 21 bp, Homo sapiens
atgcacacgggcgagctttct

SEQ ID NO: 5255831 - DNA, 20 bp, Homo sapiens
atgcacactagcctctccag

SEQ ID NO: 5255832 - DNA, 11 bp, Homo sapiens
atgcacagaga

SEQ ID NO: 5255833 - DNA, 18 bp, Homo sapiens
atgcacagagaagctggg

SEQ ID NO: 5255834 - DNA, 13 bp, Homo sapiens
atgcacagagtcc

SEQ ID NO: 5255835 - DNA, 19 bp, Homo sapiens
atgcacagagttgttacat

SEQ ID NO: 5255836 - DNA, 22 bp, Homo sapiens
atgcacagagttgttacatttt

SEQ ID NO: 5255837 - DNA, 15 bp, Homo sapiens
atgcacagatatact

SEQ ID NO: 5255838 - DNA, 22 bp, Homo sapiens
atgcacagatatactttgtgga

SEQ ID NO: 5255839 - DNA, 11 bp, Homo sapiens
atgcacagatt

SEQ ID NO: 5255840 - DNA, 22 bp, Homo sapiens
atgcacagattaaacttcacct

SEQ ID NO: 5255841 - DNA, 21 bp, Homo sapiens
atgcacagctaacatggaagt

SEQ ID NO: 5255842 - DNA, 17 bp, Homo sapiens
atgcacagctgcttgtc

SEQ ID NO: 5255843 - DNA, 12 bp, Homo sapiens
atgcacagctgt

SEQ ID NO: 5255844 - DNA, 17 bp, Homo sapiens
atgcacagtaaaaatgg

SEQ ID NO: 5255845 - DNA, 22 bp, Homo sapiens
atgcacagtacaataatgtact

SEQ ID NO: 5255846 - DNA, 14 bp, Homo sapiens
atgcacagtatctg

SEQ ID NO: 5255847 - DNA, 17 bp, Homo sapiens
atgcacagtatctgctg

SEQ ID NO: 5255848 - DNA, 18 bp, Homo sapiens
atgcacagtatttgtaat

SEQ ID NO: 5255849 - DNA, 21 bp, Homo sapiens
atgcacagtatttgtaattaa

SEQ ID NO: 5255850 - DNA, 12 bp, Homo sapiens
atgcacagtgcc

SEQ ID NO: 5255851 - DNA, 14 bp, Homo sapiens
atgcacagtgcctg

SEQ ID NO: 5255852 - DNA, 15 bp, Homo sapiens
atgcacagtggaaag

SEQ ID NO: 5255853 - DNA, 19 bp, Homo sapiens
atgcacatatggactctgc

SEQ ID NO: 5255854 - DNA, 14 bp, Homo sapiens
atgcacatcctcat

SEQ ID NO: 5255855 - DNA, 22 bp, Homo sapiens
atgcacatcctcattcactaag

SEQ ID NO: 5255856 - DNA, 15 bp, Homo sapiens
atgcacatgcacgcc

SEQ ID NO: 5255857 - DNA, 22 bp, Homo sapiens
atgcacatgctgtctggccctg

SEQ ID NO: 5255858 - DNA, 18 bp, Homo sapiens
atgcacattcatcctcac

SEQ ID NO: 5255859 - DNA, 19 bp, Homo sapiens
atgcacattcatcctcaca

SEQ ID NO: 5255860 - DNA, 20 bp, Homo sapiens
atgcacattcatcctcacat

SEQ ID NO: 5255861 - DNA, 21 bp, Homo sapiens
atgcacattggaagctcccac

SEQ ID NO: 5255862 - DNA, 17 bp, Homo sapiens
atgcacatttatatata

SEQ ID NO: 5255863 - DNA, 22 bp, Homo sapiens
atgcacatttatatatatatgt

SEQ ID NO: 5255864 - DNA, 13 bp, Homo sapiens
atgcacatttcat

SEQ ID NO: 5255865 - DNA, 15 bp, Homo sapiens
atgcacatttctgga

SEQ ID NO: 5255866 - DNA, 16 bp, Homo sapiens
atgcacatttctggat

SEQ ID NO: 5255867 - DNA, 22 bp, Homo sapiens
atgcacatttgtgcataaattt

SEQ ID NO: 5255868 - DNA, 23 bp, Homo sapiens
atgcacatttgtgcataaatttc

SEQ ID NO: 5255869 - DNA, 17 bp, Homo sapiens
atgcaccaagtacagcc

SEQ ID NO: 5255870 - DNA, 19 bp, Homo sapiens
atgcaccaagtacagcctt

SEQ ID NO: 5255871 - DNA, 22 bp, Homo sapiens
atgcaccaagtacagccttcac

SEQ ID NO: 5255872 - DNA, 20 bp, Homo sapiens
atgcaccaatcagcaggatt

SEQ ID NO: 5255873 - DNA, 14 bp, Homo sapiens
atgcaccaccaagc

SEQ ID NO: 5255874 - DNA, 15 bp, Homo sapiens
atgcaccaccaagcc

SEQ ID NO: 5255875 - DNA, 23 bp, Homo sapiens
atgcaccacccatggagaggttt

SEQ ID NO: 5255876 - DNA, 17 bp, Homo sapiens
atgcacccatcagcact

SEQ ID NO: 5255877 - DNA, 22 bp, Homo sapiens
atgcacccatcagtgctctgta

SEQ ID NO: 5255878 - DNA, 22 bp, Homo sapiens
atgcacccctgagccagcaggg

SEQ ID NO: 5255879 - DNA, 15 bp, Homo sapiens
atgcacccctggaac

SEQ ID NO: 5255880 - DNA, 16 bp, Homo sapiens
atgcaccctccctcct

SEQ ID NO: 5255881 - DNA, 22 bp, Homo sapiens
atgcacctaaaatctaattaga

SEQ ID NO: 5255882 - DNA, 19 bp, Homo sapiens
atgcacctcccttccctcc

SEQ ID NO: 5255883 - DNA, 22 bp, Homo sapiens
atgcacctcccttccctccctg

SEQ ID NO: 5255884 - DNA, 20 bp, Homo sapiens
atgcacctgcaatcccagct

SEQ ID NO: 5255885 - DNA, 15 bp, Homo sapiens
atcctggtattgtaa

SEQ ID NO: 5255886 - DNA, 20 bp, Homo sapiens
atcctggtattgtaatatta

SEQ ID NO: 5255887 - DNA, 19 bp, Homo sapiens
atcctggttaccactcttt

SEQ ID NO: 5255888 - DNA, 23 bp, Homo sapiens
atcctggttagaagaaaattaat

SEQ ID NO: 5255889 - DNA, 23 bp, Homo sapiens
atcctggttcctaggggaatgag

SEQ ID NO: 5255890 - DNA, 14 bp, Homo sapiens
atcctggtttcata

SEQ ID NO: 5255891 - DNA, 15 bp, Homo sapiens
atcctggtttgtaat

SEQ ID NO: 5255892 - DNA, 15 bp, Homo sapiens
atcctgtaaaggtca

SEQ ID NO: 5255893 - DNA, 23 bp, Homo sapiens
atcctgtaaggtctgtaaatcag

SEQ ID NO: 5255894 - DNA, 16 bp, Homo sapiens
atcctgtaccaaatct

SEQ ID NO: 5255895 - DNA, 18 bp, Homo sapiens
atcctgtaccaaatctga

SEQ ID NO: 5255896 - DNA, 23 bp, Homo sapiens
atcctgtaccaaatctgacatat

SEQ ID NO: 5255897 - DNA, 20 bp, Homo sapiens
atcctgtaggaaggtactgt

SEQ ID NO: 5255898 - DNA, 22 bp, Homo sapiens
atcctgtaggaaggtactgtat

SEQ ID NO: 5255899 - DNA, 16 bp, Homo sapiens
atcctgtataagcact

SEQ ID NO: 5255900 - DNA, 21 bp, Homo sapiens
atcctgtatattatggtgtaa

SEQ ID NO: 5255901 - DNA, 23 bp, Homo sapiens
atcctgtatattatggtgtaatg

SEQ ID NO: 5255902 - DNA, 20 bp, Homo sapiens
atcctgtattcagacagatg

SEQ ID NO: 5255903 - DNA, 21 bp, Homo sapiens
atcctgtattcagacagatga

SEQ ID NO: 5255904 - DNA, 15 bp, Homo sapiens
atcctgtattcttgt

SEQ ID NO: 5255905 - DNA, 16 bp, Homo sapiens
atcctgtcaatgtttg

SEQ ID NO: 5255906 - DNA, 18 bp, Homo sapiens
atcctgtcaatgtttgct

SEQ ID NO: 5255907 - DNA, 22 bp, Homo sapiens
atcctgtcccatgggctctggc

SEQ ID NO: 5255908 - DNA, 17 bp, Homo sapiens
atcctgtcctcagcttc

SEQ ID NO: 5255909 - DNA, 18 bp, Homo sapiens
atcctgtcctcagcttct

SEQ ID NO: 5255910 - DNA, 21 bp, Homo sapiens
atcctgtcgattagactggac

SEQ ID NO: 5255911 - DNA, 14 bp, Homo sapiens
atcctgtctgaaaa

SEQ ID NO: 5255912 - DNA, 17 bp, Homo sapiens
atcctgtcttatttgtt

SEQ ID NO: 5255913 - DNA, 19 bp, Homo sapiens
atcctgtctttaaggaaaa

SEQ ID NO: 5255914 - DNA, 16 bp, Homo sapiens
atcctgtgacatgtaa

SEQ ID NO: 5255915 - DNA, 19 bp, Homo sapiens
atcctgtgacccctcccca

SEQ ID NO: 5255916 - DNA, 10 bp, Homo sapiens
atcctgtgca

SEQ ID NO: 5255917 - DNA, 15 bp, Homo sapiens
atcctgtgcaataga

SEQ ID NO: 5255918 - DNA, 20 bp, Homo sapiens
atcctgtgtcagaaaccctg

SEQ ID NO: 5255919 - DNA, 15 bp, Homo sapiens
atcctgtgtcccctg

SEQ ID NO: 5255920 - DNA, 16 bp, Homo sapiens
atcctgtgtggagagg

SEQ ID NO: 5255921 - DNA, 15 bp, Homo sapiens
atcctgtgtggggag

SEQ ID NO: 5255922 - DNA, 15 bp, Homo sapiens
atcctgtgtggttta

SEQ ID NO: 5255923 - DNA, 20 bp, Homo sapiens
atcctgtgtggtttagtgta

SEQ ID NO: 5255924 - DNA, 17 bp, Homo sapiens
atcctgtgtgtgtctag

SEQ ID NO: 5255925 - DNA, 19 bp, Homo sapiens
atcctgtgtgttaagctct

SEQ ID NO: 5255926 - DNA, 18 bp, Homo sapiens
atcctgtgtttctaggga

SEQ ID NO: 5255927 - DNA, 16 bp, Homo sapiens
atcctgttaaattttc

SEQ ID NO: 5255928 - DNA, 23 bp, Homo sapiens
atcctgttaagagataattctta

SEQ ID NO: 5255929 - DNA, 19 bp, Homo sapiens
atcctgttaggggaaaata

SEQ ID NO: 5255930 - DNA, 15 bp, Homo sapiens
atcctgttcttcccc

SEQ ID NO: 5255931 - DNA, 12 bp, Homo sapiens
atcctgttgaaa

SEQ ID NO: 5255932 - DNA, 18 bp, Homo sapiens
atcctgttgaaaagccat

SEQ ID NO: 5255933 - DNA, 22 bp, Homo sapiens
atcctgtttataatctgaagat

SEQ ID NO: 5255934 - DNA, 13 bp, Homo sapiens
atcctgtttgtat

SEQ ID NO: 5255935 - DNA, 18 bp, Homo sapiens
atcctgtttgtatgaaat

SEQ ID NO: 5255936 - DNA, 19 bp, Homo sapiens
atcctgtttgtatgaaatt

SEQ ID NO: 5255937 - DNA, 17 bp, Homo sapiens
atcctgtttgtattttt

SEQ ID NO: 5255938 - DNA, 19 bp, Homo sapiens
atcctgttttacagctgcc

SEQ ID NO: 5255939 - DNA, 22 bp, Homo sapiens
atcctgttttcatggacagctg

SEQ ID NO: 5255940 - DNA, 13 bp, Homo sapiens
atcctgttttctc

SEQ ID NO: 5255941 - DNA, 15 bp, Homo sapiens
atcctgtttttcctt

SEQ ID NO: 5255942 - DNA, 14 bp, Homo sapiens
atccttaaaagcat

SEQ ID NO: 5255943 - DNA, 15 bp, Homo sapiens
atccttaaatcttaa

SEQ ID NO: 5255944 - DNA, 20 bp, Homo sapiens
atccttaaatcttaatgttc

SEQ ID NO: 5255945 - DNA, 19 bp, Homo sapiens
atccttaaattattgctta

SEQ ID NO: 5255946 - DNA, 18 bp, Homo sapiens
atccttaagtatcagaaa

SEQ ID NO: 5255947 - DNA, 17 bp, Homo sapiens
atccttacaaatgattg

SEQ ID NO: 5255948 - DNA, 13 bp, Homo sapiens
atccttacaatgt

SEQ ID NO: 5255949 - DNA, 20 bp, Homo sapiens
atccttacaatgtgaataat

SEQ ID NO: 5255950 - DNA, 15 bp, Homo sapiens
atccttacactcccc

SEQ ID NO: 5255951 - DNA, 17 bp, Homo sapiens
atccttacttccagcaa

SEQ ID NO: 5255952 - DNA, 18 bp, Homo sapiens
atccttagagaagtttgt

SEQ ID NO: 5255953 - DNA, 18 bp, Homo sapiens
atccttagaggtcctctg

SEQ ID NO: 5255954 - DNA, 19 bp, Homo sapiens
atccttagaggtcctctgg

SEQ ID NO: 5255955 - DNA, 22 bp, Homo sapiens
atccttaggaaaatgcttctgt

SEQ ID NO: 5255956 - DNA, 15 bp, Homo sapiens
atccttatcagagct

SEQ ID NO: 5255957 - DNA, 23 bp, Homo sapiens
atccttcaaagtctcaatgaaat

SEQ ID NO: 5255958 - DNA, 15 bp, Homo sapiens
atccttcaactctgt

SEQ ID NO: 5255959 - DNA, 16 bp, Homo sapiens
atccttcaactctgtg

SEQ ID NO: 5255960 - DNA, 23 bp, Homo sapiens
atccttcaaggtggcagctgtta

SEQ ID NO: 5255961 - DNA, 17 bp, Homo sapiens
atccttcacaatttcaa

SEQ ID NO: 5255962 - DNA, 17 bp, Homo sapiens
atccttcaccagagccc

SEQ ID NO: 5255963 - DNA, 19 bp, Homo sapiens
atccttcatcttttaaaga

SEQ ID NO: 5255964 - DNA, 18 bp, Homo sapiens
atccttccaaaaaattaa

SEQ ID NO: 5255965 - DNA, 14 bp, Homo sapiens
atccttccaaagaa

SEQ ID NO: 5255966 - DNA, 20 bp, Homo sapiens
atccttccaaagaattctta

SEQ ID NO: 5255967 - DNA, 21 bp, Homo sapiens
atccttccagggctcttccag

SEQ ID NO: 5255968 - DNA, 17 bp, Homo sapiens
atccttccagtggctcg

SEQ ID NO: 5255969 - DNA, 22 bp, Homo sapiens
atccttccagtggctcgctccc

SEQ ID NO: 5255970 - DNA, 23 bp, Homo sapiens
atccttccatcttgtggggccag

SEQ ID NO: 5255971 - DNA, 15 bp, Homo sapiens
atccttccattccac

SEQ ID NO: 5255972 - DNA, 20 bp, Homo sapiens
atccttccattccacacaga

SEQ ID NO: 5255973 - DNA, 15 bp, Homo sapiens
atccttccattccat

SEQ ID NO: 5255974 - DNA, 16 bp, Homo sapiens
atccttccatttcttc

SEQ ID NO: 5255975 - DNA, 17 bp, Homo sapiens
atccttccatttcttct

SEQ ID NO: 5255976 - DNA, 18 bp, Homo sapiens
atccttccatttcttctg

SEQ ID NO: 5255977 - DNA, 22 bp, Homo sapiens
atccttcccaacgtactcctca

SEQ ID NO: 5255978 - DNA, 19 bp, Homo sapiens
atccttccccaacttccct

SEQ ID NO: 5255979 - DNA, 16 bp, Homo sapiens
atccttcccctctttt

SEQ ID NO: 5255980 - DNA, 18 bp, Homo sapiens
atccttcccgcagcacca

SEQ ID NO: 5255981 - DNA, 22 bp, Homo sapiens
atccttcccgcagcaccagcct

SEQ ID NO: 5255982 - DNA, 22 bp, Homo sapiens
atccttccctcatgcccgccag

SEQ ID NO: 5255983 - DNA, 15 bp, Homo sapiens
atccttccctgctct

SEQ ID NO: 5255984 - DNA, 19 bp, Homo sapiens
atccttccctgtctgccag

SEQ ID NO: 5255985 - DNA, 17 bp, Homo sapiens
atccttccctttggaga

SEQ ID NO: 5255986 - DNA, 21 bp, Homo sapiens
atccttccctttggagatgct

SEQ ID NO: 5255987 - DNA, 21 bp, Homo sapiens
atccttccgccaatctggccc

SEQ ID NO: 5255988 - DNA, 23 bp, Homo sapiens
atccttccgccaatctggccctt

SEQ ID NO: 5255989 - DNA, 17 bp, Homo sapiens
atccttcctataacttg

SEQ ID NO: 5255990 - DNA, 17 bp, Homo sapiens
atccttcctcacaccag

SEQ ID NO: 5255991 - DNA, 15 bp, Homo sapiens
atccttcctctcctt

SEQ ID NO: 5255992 - DNA, 16 bp, Homo sapiens
atccttcgtcctaaca

SEQ ID NO: 5255993 - DNA, 20 bp, Homo sapiens
atccttcgtgaacatcccct

SEQ ID NO: 5255994 - DNA, 22 bp, Homo sapiens
atccttctaagaggatacaaat

SEQ ID NO: 5255995 - DNA, 17 bp, Homo sapiens
atccttctcactgccat

SEQ ID NO: 5255996 - DNA, 20 bp, Homo sapiens
atccttctcactgccatgga

SEQ ID NO: 5255997 - DNA, 11 bp, Homo sapiens
atccttctccc

SEQ ID NO: 5255998 - DNA, 18 bp, Homo sapiens
atccttctctttcaatgt

SEQ ID NO: 5255999 - DNA, 19 bp, Homo sapiens
atccttctgagctccacct

SEQ ID NO: 5256000 - DNA, 20 bp, Homo sapiens
atccttctgagctccacctc

SEQ ID NO: 5256001 - DNA, 23 bp, Homo sapiens
atccttctgcaactgaaattaca

SEQ ID NO: 5256002 - DNA, 21 bp, Homo sapiens
atccttctggcagattcaaat

SEQ ID NO: 5256003 - DNA, 20 bp, Homo sapiens
atccttcttccactgtctca

SEQ ID NO: 5256004 - DNA, 19 bp, Homo sapiens
atccttcttggcttcctgg

SEQ ID NO: 5256005 - DNA, 12 bp, Homo sapiens
atccttgaagat

SEQ ID NO: 5256006 - DNA, 23 bp, Homo sapiens
atccttgaaggtatatctaggtt

SEQ ID NO: 5256007 - DNA, 13 bp, Homo sapiens
atccttgactgaa

SEQ ID NO: 5256008 - DNA, 16 bp, Homo sapiens
atccttgactggacct

SEQ ID NO: 5256009 - DNA, 17 bp, Homo sapiens
atccttgagattctgaa

SEQ ID NO: 5256010 - DNA, 19 bp, Homo sapiens
atccttgagcactcagtct

SEQ ID NO: 5256011 - DNA, 16 bp, Homo sapiens
atccttgagtcaaaaa

SEQ ID NO: 5256012 - DNA, 16 bp, Homo sapiens
atccttgattacttcc

SEQ ID NO: 5256013 - DNA, 17 bp, Homo sapiens
atccttgcagtttaaga

SEQ ID NO: 5256014 - DNA, 22 bp, Homo sapiens
atccttgccaatagtgtcatcc

SEQ ID NO: 5256015 - DNA, 23 bp, Homo sapiens
atccttgcccaggtgagggaagg

SEQ ID NO: 5256016 - DNA, 20 bp, Homo sapiens
atccttgcctgtctaaagcc

SEQ ID NO: 5256017 - DNA, 15 bp, Homo sapiens
atccttgctgcagct

SEQ ID NO: 5256018 - DNA, 19 bp, Homo sapiens
atccttgctgcagcttcta

SEQ ID NO: 5256019 - DNA, 13 bp, Homo sapiens
atccttggaaacc

SEQ ID NO: 5256020 - DNA, 24 bp, Homo sapiens
atccttggagagcagctggctctc

SEQ ID NO: 5256021 - DNA, 20 bp, Homo sapiens
atccttggagtcccaggggc

SEQ ID NO: 5256022 - DNA, 20 bp, Homo sapiens
atccttggctgaattaaaat

SEQ ID NO: 5256023 - DNA, 23 bp, Homo sapiens
atccttggctgaattaaaatggt

SEQ ID NO: 5256024 - DNA, 19 bp, Homo sapiens
atccttggctttcagagcc

SEQ ID NO: 5256025 - DNA, 21 bp, Homo sapiens
atccttggctttcagagccag

SEQ ID NO: 5256026 - DNA, 21 bp, Homo sapiens
atccttgggccataattatga

SEQ ID NO: 5256027 - DNA, 23 bp, Homo sapiens
atccttgggccataattatgaaa

SEQ ID NO: 5256028 - DNA, 18 bp, Homo sapiens
atccttgggggctcccag

SEQ ID NO: 5256029 - DNA, 15 bp, Homo sapiens
atccttggtctttgt

SEQ ID NO: 5256030 - DNA, 17 bp, Homo sapiens
atccttggtctttgtat

SEQ ID NO: 5256031 - DNA, 16 bp, Homo sapiens
atccttggtgctgtgt

SEQ ID NO: 5256032 - DNA, 17 bp, Homo sapiens
atccttggtgctgtgtg

SEQ ID NO: 5256033 - DNA, 22 bp, Homo sapiens
atccttggtgctgtgtgcccca

SEQ ID NO: 5256034 - DNA, 12 bp, Homo sapiens
atccttgtaata

SEQ ID NO: 5256035 - DNA, 12 bp, Homo sapiens
atccttgtcttt

SEQ ID NO: 5256036 - DNA, 21 bp, Homo sapiens
atccttgtcttttgagctatt

SEQ ID NO: 5256037 - DNA, 19 bp, Homo sapiens
atccttgtgttcagctctt

SEQ ID NO: 5256038 - DNA, 12 bp, Homo sapiens
atccttgtttca

SEQ ID NO: 5256039 - DNA, 13 bp, Homo sapiens
atccttgtttcaa

SEQ ID NO: 5256040 - DNA, 14 bp, Homo sapiens
atccttgtttcaaa

SEQ ID NO: 5256041 - DNA, 14 bp, Homo sapiens
atccttgtttcctt

SEQ ID NO: 5256042 - DNA, 15 bp, Homo sapiens
atccttgtttcctta

SEQ ID NO: 5256043 - DNA, 23 bp, Homo sapiens
atccttgttttgaaaacctaaaa

SEQ ID NO: 5256044 - DNA, 17 bp, Homo sapiens
atcctttaaatccttcc

SEQ ID NO: 5256045 - DNA, 18 bp, Homo sapiens
atcctttcacttctttcc

SEQ ID NO: 5256046 - DNA, 13 bp, Homo sapiens
atcctttcataaa

SEQ ID NO: 5256047 - DNA, 15 bp, Homo sapiens
atcctttcatcaatg

SEQ ID NO: 5256048 - DNA, 22 bp, Homo sapiens
atcctttcattaggcaaagtac

SEQ ID NO: 5256049 - DNA, 17 bp, Homo sapiens
atcctttccagcatgag

SEQ ID NO: 5256050 - DNA, 14 bp, Homo sapiens
atcctttccctctc

SEQ ID NO: 5256051 - DNA, 20 bp, Homo sapiens
atcctttccctctcccagtc

SEQ ID NO: 5256052 - DNA, 11 bp, Homo sapiens
atcctttcctc

SEQ ID NO: 5256053 - DNA, 19 bp, Homo sapiens
atcctttctgccccccagg

SEQ ID NO: 5256054 - DNA, 22 bp, Homo sapiens
atcctttctgccccccagggct

SEQ ID NO: 5256055 - DNA, 17 bp, Homo sapiens
atcctttctgcctctca

SEQ ID NO: 5256056 - DNA, 19 bp, Homo sapiens
atcctttgagaatgtgatt

SEQ ID NO: 5256057 - DNA, 17 bp, Homo sapiens
atcctttgcagggcagc

SEQ ID NO: 5256058 - DNA, 19 bp, Homo sapiens
atcctttgccccaaggctg

SEQ ID NO: 5256059 - DNA, 20 bp, Homo sapiens
atcctttgccccaaggctgc

SEQ ID NO: 5256060 - DNA, 17 bp, Homo sapiens
atcctttggtcctggtg

SEQ ID NO: 5256061 - DNA, 12 bp, Homo sapiens
atgcaccttgct

SEQ ID NO: 5256062 - DNA, 15 bp, Homo sapiens
atgcaccttgtgtct

SEQ ID NO: 5256063 - DNA, 14 bp, Homo sapiens
atgcacgaccttgg

SEQ ID NO: 5256064 - DNA, 23 bp, Homo sapiens
atgcacgcaccccgcccctgcat

SEQ ID NO: 5256065 - DNA, 13 bp, Homo sapiens
atgcacggcctcg

SEQ ID NO: 5256066 - DNA, 19 bp, Homo sapiens
atgcacggtgaggccgggc

SEQ ID NO: 5256067 - DNA, 22 bp, Homo sapiens
atgcacgtgtgcacacacacca

SEQ ID NO: 5256068 - DNA, 17 bp, Homo sapiens
atgcactaagacaagaa

SEQ ID NO: 5256069 - DNA, 20 bp, Homo sapiens
atgcactaagtctctttttt

SEQ ID NO: 5256070 - DNA, 22 bp, Homo sapiens
atgcactatatttgtatatatt

SEQ ID NO: 5256071 - DNA, 18 bp, Homo sapiens
atgcactcacccctagcc

SEQ ID NO: 5256072 - DNA, 13 bp, Homo sapiens
atgcactcagggt

SEQ ID NO: 5256073 - DNA, 17 bp, Homo sapiens
atgcactcctgccccgg

SEQ ID NO: 5256074 - DNA, 17 bp, Homo sapiens
atgcactcgctgtgatt

SEQ ID NO: 5256075 - DNA, 15 bp, Homo sapiens
atgcactctgggtct

SEQ ID NO: 5256076 - DNA, 16 bp, Homo sapiens
atgcactgaagagctc

SEQ ID NO: 5256077 - DNA, 17 bp, Homo sapiens
atgcactgaataaagca

SEQ ID NO: 5256078 - DNA, 17 bp, Homo sapiens
atgcactgacccttcca

SEQ ID NO: 5256079 - DNA, 23 bp, Homo sapiens
atgcactgacccttccagacata

SEQ ID NO: 5256080 - DNA, 11 bp, Homo sapiens
atgcactgagg

SEQ ID NO: 5256081 - DNA, 16 bp, Homo sapiens
atgcactgatgttgtg

SEQ ID NO: 5256082 - DNA, 17 bp, Homo sapiens
atgcactgctgtaactg

SEQ ID NO: 5256083 - DNA, 21 bp, Homo sapiens
atgcactgtattgctcctccc

SEQ ID NO: 5256084 - DNA, 18 bp, Homo sapiens
atgcactgtgaaggaccc

SEQ ID NO: 5256085 - DNA, 21 bp, Homo sapiens
atgcactgtggtttcagatgt

SEQ ID NO: 5256086 - DNA, 22 bp, Homo sapiens
atgcactgttccccctgtgcag

SEQ ID NO: 5256087 - DNA, 12 bp, Homo sapiens
atgcactgtttt

SEQ ID NO: 5256088 - DNA, 19 bp, Homo sapiens
atgcacttataattttcct

SEQ ID NO: 5256089 - DNA, 22 bp, Homo sapiens
atgcacttattttttaatgtga

SEQ ID NO: 5256090 - DNA, 18 bp, Homo sapiens
atgcacttgattcaggag

SEQ ID NO: 5256091 - DNA, 16 bp, Homo sapiens
atgcactttaaatgga

SEQ ID NO: 5256092 - DNA, 21 bp, Homo sapiens
atgcactttaattgaagaact

SEQ ID NO: 5256093 - DNA, 22 bp, Homo sapiens
atgcactttctatcctctgtaa

SEQ ID NO: 5256094 - DNA, 13 bp, Homo sapiens
atgcactttgctt

SEQ ID NO: 5256095 - DNA, 15 bp, Homo sapiens
atgcactttgcttta

SEQ ID NO: 5256096 - DNA, 22 bp, Homo sapiens
atgcactttgctttaatataaa

SEQ ID NO: 5256097 - DNA, 12 bp, Homo sapiens
atgcactttgtt

SEQ ID NO: 5256098 - DNA, 20 bp, Homo sapiens
atgcactttgttctggctct

SEQ ID NO: 5256099 - DNA, 23 bp, Homo sapiens
atgcactttgttctggctcttcc

SEQ ID NO: 5256100 - DNA, 18 bp, Homo sapiens
atgcacttttagaaatgc

SEQ ID NO: 5256101 - DNA, 20 bp, Homo sapiens
atgcacttttagaaatgcat

SEQ ID NO: 5256102 - DNA, 21 bp, Homo sapiens
atgcacttttatgaagttttt

SEQ ID NO: 5256103 - DNA, 22 bp, Homo sapiens
atgcactttttccttactgtgc

SEQ ID NO: 5256104 - DNA, 16 bp, Homo sapiens
atgcagaaaaagaaaa

SEQ ID NO: 5256105 - DNA, 16 bp, Homo sapiens
atgcagaaacttggat

SEQ ID NO: 5256106 - DNA, 15 bp, Homo sapiens
atgcagaacaaatga

SEQ ID NO: 5256107 - DNA, 18 bp, Homo sapiens
atgcagaacaaatgaaga

SEQ ID NO: 5256108 - DNA, 19 bp, Homo sapiens
atgcagaacacatttcaaa

SEQ ID NO: 5256109 - DNA, 19 bp, Homo sapiens
atgcagaaccacaaacaat

SEQ ID NO: 5256110 - DNA, 19 bp, Homo sapiens
atgcagaacgtatttagcc

SEQ ID NO: 5256111 - DNA, 17 bp, Homo sapiens
atgcagaagcagagatg

SEQ ID NO: 5256112 - DNA, 18 bp, Homo sapiens
atgcagaagcagagatga

SEQ ID NO: 5256113 - DNA, 18 bp, Homo sapiens
atgcagaagcatattttg

SEQ ID NO: 5256114 - DNA, 21 bp, Homo sapiens
atgcagaagcatattttgctg

SEQ ID NO: 5256115 - DNA, 23 bp, Homo sapiens
atgcagaagcatattttgctggt

SEQ ID NO: 5256116 - DNA, 15 bp, Homo sapiens
atgcagaagtattct

SEQ ID NO: 5256117 - DNA, 22 bp, Homo sapiens
atgcagaatacttgactcattt

SEQ ID NO: 5256118 - DNA, 17 bp, Homo sapiens
atgcagaatggcatttg

SEQ ID NO: 5256119 - DNA, 20 bp, Homo sapiens
atgcagacaaagccctgtcc

SEQ ID NO: 5256120 - DNA, 22 bp, Homo sapiens
atgcagacaacaccttcctcct

SEQ ID NO: 5256121 - DNA, 23 bp, Homo sapiens
atgcagacaacaccttcctcctg

SEQ ID NO: 5256122 - DNA, 13 bp, Homo sapiens
atgcagacacaca

SEQ ID NO: 5256123 - DNA, 21 bp, Homo sapiens
atgcagacagtctgttatgca

SEQ ID NO: 5256124 - DNA, 16 bp, Homo sapiens
atgcagacatctctgg

SEQ ID NO: 5256125 - DNA, 19 bp, Homo sapiens
atgcagacatttacatgtt

SEQ ID NO: 5256126 - DNA, 21 bp, Homo sapiens
atgcagacctcatgcccagct

SEQ ID NO: 5256127 - DNA, 18 bp, Homo sapiens
atgcagactcctcagatc

SEQ ID NO: 5256128 - DNA, 21 bp, Homo sapiens
atgcagactcctcagatctga

SEQ ID NO: 5256129 - DNA, 13 bp, Homo sapiens
atgcagagagcca

SEQ ID NO: 5256130 - DNA, 16 bp, Homo sapiens
atgcagagagccattt

SEQ ID NO: 5256131 - DNA, 20 bp, Homo sapiens
atgcagagagccattttgtg

SEQ ID NO: 5256132 - DNA, 21 bp, Homo sapiens
atgcagagagccattttgtga

SEQ ID NO: 5256133 - DNA, 23 bp, Homo sapiens
atgcagagagccattttgtgaat

SEQ ID NO: 5256134 - DNA, 18 bp, Homo sapiens
atgcagagcttgtggtgg

SEQ ID NO: 5256135 - DNA, 17 bp, Homo sapiens
atgcagaggaggagaaa

SEQ ID NO: 5256136 - DNA, 18 bp, Homo sapiens
atgcagaggaggtaagag

SEQ ID NO: 5256137 - DNA, 16 bp, Homo sapiens
atgcagaggcctgcag

SEQ ID NO: 5256138 - DNA, 17 bp, Homo sapiens
atgcagaggcctgcagg

SEQ ID NO: 5256139 - DNA, 21 bp, Homo sapiens
atgcagaggcctgcagggcct

SEQ ID NO: 5256140 - DNA, 22 bp, Homo sapiens
atgcagaggcctgcagggcctc

SEQ ID NO: 5256141 - DNA, 18 bp, Homo sapiens
atgcagaggtccacaaca

SEQ ID NO: 5256142 - DNA, 17 bp, Homo sapiens
atgcagaggtctccaaa

SEQ ID NO: 5256143 - DNA, 21 bp, Homo sapiens
atgcagaggtctccaaactga

SEQ ID NO: 5256144 - DNA, 23 bp, Homo sapiens
atgcagaggtctccaaactgatt

SEQ ID NO: 5256145 - DNA, 17 bp, Homo sapiens
atgcagagtcagcagaa

SEQ ID NO: 5256146 - DNA, 20 bp, Homo sapiens
atgcagagttcagggaagat

SEQ ID NO: 5256147 - DNA, 16 bp, Homo sapiens
atgcagagttgacatg

SEQ ID NO: 5256148 - DNA, 16 bp, Homo sapiens
atgcagataaaatatt

SEQ ID NO: 5256149 - DNA, 17 bp, Homo sapiens
atgcagatctagccagg

SEQ ID NO: 5256150 - DNA, 19 bp, Homo sapiens
atgcagatctagccaggcc

SEQ ID NO: 5256151 - DNA, 21 bp, Homo sapiens
atgcagatctagccaggcctc

SEQ ID NO: 5256152 - DNA, 15 bp, Homo sapiens
atgcagatgccagag

SEQ ID NO: 5256153 - DNA, 16 bp, Homo sapiens
atgcagatgccagagc

SEQ ID NO: 5256154 - DNA, 18 bp, Homo sapiens
atgcagattcctgggcct

SEQ ID NO: 5256155 - DNA, 21 bp, Homo sapiens
atgcagattcctgggcctgtc

SEQ ID NO: 5256156 - DNA, 22 bp, Homo sapiens
atgcagattcctgggcctgtcc

SEQ ID NO: 5256157 - DNA, 15 bp, Homo sapiens
atgcagcaaatatat

SEQ ID NO: 5256158 - DNA, 16 bp, Homo sapiens
atgcagcaaatatatg

SEQ ID NO: 5256159 - DNA, 21 bp, Homo sapiens
atgcagcaaggccctgctgcc

SEQ ID NO: 5256160 - DNA, 18 bp, Homo sapiens
atgcagcactgctgcctc

SEQ ID NO: 5256161 - DNA, 11 bp, Homo sapiens
atgcagcagct

SEQ ID NO: 5256162 - DNA, 13 bp, Homo sapiens
atgcagcagcttg

SEQ ID NO: 5256163 - DNA, 23 bp, Homo sapiens
atgcagcaggaaggaacaaagac

SEQ ID NO: 5256164 - DNA, 19 bp, Homo sapiens
atgcagcagggatgccctg

SEQ ID NO: 5256165 - DNA, 16 bp, Homo sapiens
atgcagcatacaaaaa

SEQ ID NO: 5256166 - DNA, 17 bp, Homo sapiens
atgcagcatctaagtaa

SEQ ID NO: 5256167 - DNA, 16 bp, Homo sapiens
atgcagcatttgataa

SEQ ID NO: 5256168 - DNA, 19 bp, Homo sapiens
atgcagcccaccaggagca

SEQ ID NO: 5256169 - DNA, 22 bp, Homo sapiens
atgcagcccatgcccacctgcc

SEQ ID NO: 5256170 - DNA, 23 bp, Homo sapiens
atgcagcccatgcccacctgccc

SEQ ID NO: 5256171 - DNA, 16 bp, Homo sapiens
atgcagcccatttctc

SEQ ID NO: 5256172 - DNA, 21 bp, Homo sapiens
atgcagcccatttctccagaa

SEQ ID NO: 5256173 - DNA, 16 bp, Homo sapiens
atgcagcccctgggcc

SEQ ID NO: 5256174 - DNA, 23 bp, Homo sapiens
atgcagcctaaagtacagcctgg

SEQ ID NO: 5256175 - DNA, 13 bp, Homo sapiens
atgcagcctcaca

SEQ ID NO: 5256176 - DNA, 18 bp, Homo sapiens
atgcagcctcacagtcct

SEQ ID NO: 5256177 - DNA, 19 bp, Homo sapiens
atgcagcctcttccccacc

SEQ ID NO: 5256178 - DNA, 23 bp, Homo sapiens
atgcagctcaactttctgttgga

SEQ ID NO: 5256179 - DNA, 13 bp, Homo sapiens
atgcagctcaaga

SEQ ID NO: 5256180 - DNA, 22 bp, Homo sapiens
atgcagctcttcaacatgacat

SEQ ID NO: 5256181 - DNA, 14 bp, Homo sapiens
atgcagctcttcct

SEQ ID NO: 5256182 - DNA, 16 bp, Homo sapiens
atgcagctgctcccca

SEQ ID NO: 5256183 - DNA, 13 bp, Homo sapiens
atgcagcttcagg

SEQ ID NO: 5256184 - DNA, 20 bp, Homo sapiens
atgcagcttcaggtgagcca

SEQ ID NO: 5256185 - DNA, 23 bp, Homo sapiens
atgcagcttgtccttgctcctgg

SEQ ID NO: 5256186 - DNA, 22 bp, Homo sapiens
atgcaggaagaccacatgcgct

SEQ ID NO: 5256187 - DNA, 21 bp, Homo sapiens
atgcaggaagaggcccactag

SEQ ID NO: 5256188 - DNA, 17 bp, Homo sapiens
atgcaggaaggaaaact

SEQ ID NO: 5256189 - DNA, 17 bp, Homo sapiens
atgcaggacaggaggcg

SEQ ID NO: 5256190 - DNA, 17 bp, Homo sapiens
atgcaggagagcttccc

SEQ ID NO: 5256191 - DNA, 22 bp, Homo sapiens
atgcaggagcttctgggagatt

SEQ ID NO: 5256192 - DNA, 22 bp, Homo sapiens
atgcaggaggtggagaaaattg

SEQ ID NO: 5256193 - DNA, 17 bp, Homo sapiens
atgcaggcaggtgtgaa

SEQ ID NO: 5256194 - DNA, 14 bp, Homo sapiens
atgcaggcatgctt

SEQ ID NO: 5256195 - DNA, 19 bp, Homo sapiens
atgcaggccccgccccctc

SEQ ID NO: 5256196 - DNA, 16 bp, Homo sapiens
atgcaggctcccctga

SEQ ID NO: 5256197 - DNA, 17 bp, Homo sapiens
atgcaggctcccctgag

SEQ ID NO: 5256198 - DNA, 23 bp, Homo sapiens
atgcagggaagagggcagtacct

SEQ ID NO: 5256199 - DNA, 12 bp, Homo sapiens
atgcagggaggc

SEQ ID NO: 5256200 - DNA, 15 bp, Homo sapiens
atgcagggagggagg

SEQ ID NO: 5256201 - DNA, 17 bp, Homo sapiens
atgcagggaggggaggc

SEQ ID NO: 5256202 - DNA, 19 bp, Homo sapiens
atgcagggaggggaggcag

SEQ ID NO: 5256203 - DNA, 22 bp, Homo sapiens
atgcaggggcaaacacctgctg

SEQ ID NO: 5256204 - DNA, 14 bp, Homo sapiens
atgcagggtattgc

SEQ ID NO: 5256205 - DNA, 15 bp, Homo sapiens
atgcaggtcagccca

SEQ ID NO: 5256206 - DNA, 14 bp, Homo sapiens
atgcaggtctccat

SEQ ID NO: 5256207 - DNA, 21 bp, Homo sapiens
atgcaggtctccatgaagaag

SEQ ID NO: 5256208 - DNA, 16 bp, Homo sapiens
atgcaggtgaactttt

SEQ ID NO: 5256209 - DNA, 17 bp, Homo sapiens
atgcaggtgtcctgagc

SEQ ID NO: 5256210 - DNA, 21 bp, Homo sapiens
atgcaggttggaaggggcctt

SEQ ID NO: 5256211 - DNA, 18 bp, Homo sapiens
atgcaggtttgaccagga

SEQ ID NO: 5256212 - DNA, 13 bp, Homo sapiens
atgcaggttttat

SEQ ID NO: 5256213 - DNA, 21 bp, Homo sapiens
atgcaggttttctaattgtac

SEQ ID NO: 5256214 - DNA, 17 bp, Homo sapiens
atgcagtacaggacata

SEQ ID NO: 5256215 - DNA, 20 bp, Homo sapiens
atgcagtacaggacatatat

SEQ ID NO: 5256216 - DNA, 21 bp, Homo sapiens
atgcagtacattctaaagaga

SEQ ID NO: 5256217 - DNA, 19 bp, Homo sapiens
atgcagtactaaaattaat

SEQ ID NO: 5256218 - DNA, 16 bp, Homo sapiens
atgcagtatctcttac

SEQ ID NO: 5256219 - DNA, 17 bp, Homo sapiens
atgcagtattgccacaa

SEQ ID NO: 5256220 - DNA, 20 bp, Homo sapiens
atgcagtattgccacaatgc

SEQ ID NO: 5256221 - DNA, 15 bp, Homo sapiens
atgcagtcatgagaa

SEQ ID NO: 5256222 - DNA, 19 bp, Homo sapiens
atgcagtccagaataagtg

SEQ ID NO: 5256223 - DNA, 11 bp, Homo sapiens
atgcagtcctg

SEQ ID NO: 5256224 - DNA, 19 bp, Homo sapiens
atgcagtcctgaggagagg

SEQ ID NO: 5256225 - DNA, 16 bp, Homo sapiens
atgcagtctcctcttt

SEQ ID NO: 5256226 - DNA, 18 bp, Homo sapiens
atgcagtctcctctttaa

SEQ ID NO: 5256227 - DNA, 21 bp, Homo sapiens
atgcagtctcctctttaaaac

SEQ ID NO: 5256228 - DNA, 22 bp, Homo sapiens
atgcagtctctttattttacta

SEQ ID NO: 5256229 - DNA, 20 bp, Homo sapiens
atgcagtcttaccaatgact

SEQ ID NO: 5256230 - DNA, 21 bp, Homo sapiens
atgcagtcttagatcatagtt

SEQ ID NO: 5256231 - DNA, 16 bp, Homo sapiens
atgcagtgaactattt

SEQ ID NO: 5256232 - DNA, 16 bp, Homo sapiens
atgcagtgaattgtga

SEQ ID NO: 5256233 - DNA, 19 bp, Homo sapiens
atgcagtgatatggcagaa

SEQ ID NO: 5256234 - DNA, 21 bp, Homo sapiens
atgcagtgatatggcagaaga

SEQ ID NO: 5256235 - DNA, 18 bp, Homo sapiens
atgcagtgcccctagctt

SEQ ID NO: 5256236 - DNA, 17 bp, Homo sapiens
atcctttgttctgagca

SEQ ID NO: 5256237 - DNA, 19 bp, Homo sapiens
atcctttgttttctgacta

SEQ ID NO: 5256238 - DNA, 19 bp, Homo sapiens
atccttttaaccattttaa

SEQ ID NO: 5256239 - DNA, 13 bp, Homo sapiens
atccttttatgtt

SEQ ID NO: 5256240 - DNA, 17 bp, Homo sapiens
atccttttatgttattt

SEQ ID NO: 5256241 - DNA, 23 bp, Homo sapiens
atccttttccagaaatacctgtc

SEQ ID NO: 5256242 - DNA, 19 bp, Homo sapiens
atccttttccatcccactc

SEQ ID NO: 5256243 - DNA, 21 bp, Homo sapiens
atccttttcctaattcacaca

SEQ ID NO: 5256244 - DNA, 12 bp, Homo sapiens
atccttttcctt

SEQ ID NO: 5256245 - DNA, 16 bp, Homo sapiens
atccttttctcctatc

SEQ ID NO: 5256246 - DNA, 18 bp, Homo sapiens
atccttttgataaattta

SEQ ID NO: 5256247 - DNA, 15 bp, Homo sapiens
atcctttttccatca

SEQ ID NO: 5256248 - DNA, 21 bp, Homo sapiens
atcctttttccatcattttac

SEQ ID NO: 5256249 - DNA, 18 bp, Homo sapiens
atcctttttctttataaa

SEQ ID NO: 5256250 - DNA, 13 bp, Homo sapiens
atccttttttaaa

SEQ ID NO: 5256251 - DNA, 16 bp, Homo sapiens
atccttttttaaaagt

SEQ ID NO: 5256252 - DNA, 22 bp, Homo sapiens
atccttttttaaaagtaaatgt

SEQ ID NO: 5256253 - DNA, 13 bp, Homo sapiens
atccttttttctc

SEQ ID NO: 5256254 - DNA, 17 bp, Homo sapiens
atccttttttctcttct

SEQ ID NO: 5256255 - DNA, 16 bp, Homo sapiens
atccttttttgtcatt

SEQ ID NO: 5256256 - DNA, 18 bp, Homo sapiens
atccttttttgtcatttt

SEQ ID NO: 5256257 - DNA, 17 bp, Homo sapiens
atcgaaaattcatttca

SEQ ID NO: 5256258 - DNA, 23 bp, Homo sapiens
atcgaaataacaatgttaaggaa

SEQ ID NO: 5256259 - DNA, 13 bp, Homo sapiens
atcgaacaaactg

SEQ ID NO: 5256260 - DNA, 13 bp, Homo sapiens
atcgaagtgttta

SEQ ID NO: 5256261 - DNA, 21 bp, Homo sapiens
atcgaatatagttctgtgtag

SEQ ID NO: 5256262 - DNA, 20 bp, Homo sapiens
atcgaatctactaattccac

SEQ ID NO: 5256263 - DNA, 17 bp, Homo sapiens
atcgacagacagccagg

SEQ ID NO: 5256264 - DNA, 17 bp, Homo sapiens
atcgagaactgccattg

SEQ ID NO: 5256265 - DNA, 19 bp, Homo sapiens
atcgagaccatcctggcta

SEQ ID NO: 5256266 - DNA, 14 bp, Homo sapiens
atcgagatggagct

SEQ ID NO: 5256267 - DNA, 15 bp, Homo sapiens
atcgaggctgtgtgt

SEQ ID NO: 5256268 - DNA, 21 bp, Homo sapiens
atcgagtgagacaaaatttta

SEQ ID NO: 5256269 - DNA, 21 bp, Homo sapiens
atcgagtgccgcatctcacag

SEQ ID NO: 5256270 - DNA, 19 bp, Homo sapiens
atcgagtgtagctgtgaaa

SEQ ID NO: 5256271 - DNA, 14 bp, Homo sapiens
atcgatataaattg

SEQ ID NO: 5256272 - DNA, 18 bp, Homo sapiens
atcgatataggcatttgg

SEQ ID NO: 5256273 - DNA, 15 bp, Homo sapiens
atcgatatgtatatc

SEQ ID NO: 5256274 - DNA, 18 bp, Homo sapiens
atcgatccccagcctggt

SEQ ID NO: 5256275 - DNA, 23 bp, Homo sapiens
atcgatgggggatgcttcatgtg

SEQ ID NO: 5256276 - DNA, 13 bp, Homo sapiens
atcgatgtgctca

SEQ ID NO: 5256277 - DNA, 15 bp, Homo sapiens
atcgattcccaagct

SEQ ID NO: 5256278 - DNA, 19 bp, Homo sapiens
atcgattcccaagctccct

SEQ ID NO: 5256279 - DNA, 20 bp, Homo sapiens
atcgatttagtaagtatgtt

SEQ ID NO: 5256280 - DNA, 18 bp, Homo sapiens
atcgatttgtattaatgt

SEQ ID NO: 5256281 - DNA, 14 bp, Homo sapiens
atcgcaaggcctgt

SEQ ID NO: 5256282 - DNA, 17 bp, Homo sapiens
atcgcaaggcctgtgct

SEQ ID NO: 5256283 - DNA, 17 bp, Homo sapiens
atcgcaagtcacagaaa

SEQ ID NO: 5256284 - DNA, 20 bp, Homo sapiens
atcgcagaccttttttagga

SEQ ID NO: 5256285 - DNA, 13 bp, Homo sapiens
atcgcagcttcct

SEQ ID NO: 5256286 - DNA, 22 bp, Homo sapiens
atcgcaggagtctctgccaccc

SEQ ID NO: 5256287 - DNA, 16 bp, Homo sapiens
atcgcatccgtcctgg

SEQ ID NO: 5256288 - DNA, 15 bp, Homo sapiens
atcgcatttcctaag

SEQ ID NO: 5256289 - DNA, 14 bp, Homo sapiens
atcgccaacttgtc

SEQ ID NO: 5256290 - DNA, 19 bp, Homo sapiens
atcgccagaggtgcttcac

SEQ ID NO: 5256291 - DNA, 14 bp, Homo sapiens
atcgccagcaaaac

SEQ ID NO: 5256292 - DNA, 21 bp, Homo sapiens
atcgccagctgatgactcaag

SEQ ID NO: 5256293 - DNA, 15 bp, Homo sapiens
atcgcccaggcctgg

SEQ ID NO: 5256294 - DNA, 17 bp, Homo sapiens
atcgcccaggctggagc

SEQ ID NO: 5256295 - DNA, 23 bp, Homo sapiens
atcgcccaggctggagctggccc

SEQ ID NO: 5256296 - DNA, 23 bp, Homo sapiens
atcgccccaactccaacctctcg

SEQ ID NO: 5256297 - DNA, 18 bp, Homo sapiens
atcgccctcctttccctt

SEQ ID NO: 5256298 - DNA, 13 bp, Homo sapiens
atcgccctgagct

SEQ ID NO: 5256299 - DNA, 19 bp, Homo sapiens
atcgccctgagctactgct

SEQ ID NO: 5256300 - DNA, 15 bp, Homo sapiens
atcgccttatgagaa

SEQ ID NO: 5256301 - DNA, 22 bp, Homo sapiens
atcgccttatgagaacatggtg

SEQ ID NO: 5256302 - DNA, 12 bp, Homo sapiens
atcgccttcccc

SEQ ID NO: 5256303 - DNA, 23 bp, Homo sapiens
atcgcgccactacactccagcct

SEQ ID NO: 5256304 - DNA, 22 bp, Homo sapiens
atcgcggcggagctggccccgc

SEQ ID NO: 5256305 - DNA, 21 bp, Homo sapiens
atcgctccaccttgcagctct

SEQ ID NO: 5256306 - DNA, 14 bp, Homo sapiens
atcgctctgagcat

SEQ ID NO: 5256307 - DNA, 20 bp, Homo sapiens
atcgctgcacatggcctgag

SEQ ID NO: 5256308 - DNA, 22 bp, Homo sapiens
atcgctgcacatggcctgagca

SEQ ID NO: 5256309 - DNA, 17 bp, Homo sapiens
atcgctgccttgccatg

SEQ ID NO: 5256310 - DNA, 14 bp, Homo sapiens
atcgctggcccctt

SEQ ID NO: 5256311 - DNA, 16 bp, Homo sapiens
atcgctgtattttgag

SEQ ID NO: 5256312 - DNA, 23 bp, Homo sapiens
atcgctgtccaagtgtttcttgt

SEQ ID NO: 5256313 - DNA, 12 bp, Homo sapiens
atcgctgtgcta

SEQ ID NO: 5256314 - DNA, 22 bp, Homo sapiens
atcgctgttctgggcatggcag

SEQ ID NO: 5256315 - DNA, 19 bp, Homo sapiens
atcgcttgaacctgggaag

SEQ ID NO: 5256316 - DNA, 15 bp, Homo sapiens
atcgcttgagcccag

SEQ ID NO: 5256317 - DNA, 19 bp, Homo sapiens
atcgcttgagcccaggagt

SEQ ID NO: 5256318 - DNA, 16 bp, Homo sapiens
atcgcttttaataaac

SEQ ID NO: 5256319 - DNA, 15 bp, Homo sapiens
atcggaaagctcttc

SEQ ID NO: 5256320 - DNA, 13 bp, Homo sapiens
atcggaacagctc

SEQ ID NO: 5256321 - DNA, 13 bp, Homo sapiens
atcggaagagagg

SEQ ID NO: 5256322 - DNA, 22 bp, Homo sapiens
atcggaagcagtgccttccata

SEQ ID NO: 5256323 - DNA, 19 bp, Homo sapiens
atcggacattctaatgcat

SEQ ID NO: 5256324 - DNA, 19 bp, Homo sapiens
atcggacctcagtttctgt

SEQ ID NO: 5256325 - DNA, 14 bp, Homo sapiens
atcggactctgccc

SEQ ID NO: 5256326 - DNA, 15 bp, Homo sapiens
atcggactgccaaat

SEQ ID NO: 5256327 - DNA, 20 bp, Homo sapiens
atcggagaacatgaatcaaa

SEQ ID NO: 5256328 - DNA, 16 bp, Homo sapiens
atcggagcgaagcaga

SEQ ID NO: 5256329 - DNA, 21 bp, Homo sapiens
atcggaggctgggcccctggg

SEQ ID NO: 5256330 - DNA, 22 bp, Homo sapiens
atcggaggctgggcccctggga

SEQ ID NO: 5256331 - DNA, 18 bp, Homo sapiens
atcggaggcttgtcagag

SEQ ID NO: 5256332 - DNA, 21 bp, Homo sapiens
atcggaggcttgtcagagctg

SEQ ID NO: 5256333 - DNA, 12 bp, Homo sapiens
atcggaggtggt

SEQ ID NO: 5256334 - DNA, 23 bp, Homo sapiens
atcggagttgacagtgaaacaaa

SEQ ID NO: 5256335 - DNA, 21 bp, Homo sapiens
atcggatctggggctctggga

SEQ ID NO: 5256336 - DNA, 23 bp, Homo sapiens
atcggcccacagctcccacccca

SEQ ID NO: 5256337 - DNA, 12 bp, Homo sapiens
atcggccctgtc

SEQ ID NO: 5256338 - DNA, 21 bp, Homo sapiens
atcggcctcctcttcaccccg

SEQ ID NO: 5256339 - DNA, 19 bp, Homo sapiens
atcggcttcctcaggggca

SEQ ID NO: 5256340 - DNA, 13 bp, Homo sapiens
atcgggaaagaag

SEQ ID NO: 5256341 - DNA, 16 bp, Homo sapiens
atcgggaaagaagaaa

SEQ ID NO: 5256342 - DNA, 15 bp, Homo sapiens
atcgggaacagtgtt

SEQ ID NO: 5256343 - DNA, 16 bp, Homo sapiens
atcgggaacagtgttt

SEQ ID NO: 5256344 - DNA, 21 bp, Homo sapiens
atcgggaacagtgtttcccat

SEQ ID NO: 5256345 - DNA, 12 bp, Homo sapiens
atcgggaaggat

SEQ ID NO: 5256346 - DNA, 18 bp, Homo sapiens
atcgggaaggatgggaaa

SEQ ID NO: 5256347 - DNA, 21 bp, Homo sapiens
atcgggagcagtgtcttccat

SEQ ID NO: 5256348 - DNA, 16 bp, Homo sapiens
atcggggagccgggag

SEQ ID NO: 5256349 - DNA, 17 bp, Homo sapiens
atcggggctaacagaga

SEQ ID NO: 5256350 - DNA, 14 bp, Homo sapiens
atcgggggtgagcg

SEQ ID NO: 5256351 - DNA, 14 bp, Homo sapiens
atcggggtggcaga

SEQ ID NO: 5256352 - DNA, 20 bp, Homo sapiens
atcgggtccagagaccacac

SEQ ID NO: 5256353 - DNA, 22 bp, Homo sapiens
atcgggtccagagaccacacca

SEQ ID NO: 5256354 - DNA, 22 bp, Homo sapiens
atcgggtgtaggtgaaaggcat

SEQ ID NO: 5256355 - DNA, 15 bp, Homo sapiens
atcggtcatgtgtgt

SEQ ID NO: 5256356 - DNA, 19 bp, Homo sapiens
atcggtcatgtgtgtattt

SEQ ID NO: 5256357 - DNA, 19 bp, Homo sapiens
atcggtgcagcggtggaag

SEQ ID NO: 5256358 - DNA, 21 bp, Homo sapiens
atcggtgctgtcagccctgct

SEQ ID NO: 5256359 - DNA, 15 bp, Homo sapiens
atcggtgtccattta

SEQ ID NO: 5256360 - DNA, 13 bp, Homo sapiens
atcgtaaaattaa

SEQ ID NO: 5256361 - DNA, 14 bp, Homo sapiens
atcgtaaagctgtt

SEQ ID NO: 5256362 - DNA, 17 bp, Homo sapiens
atcgtacctgtccctcc

SEQ ID NO: 5256363 - DNA, 19 bp, Homo sapiens
atcgtagaaaatttgcttt

SEQ ID NO: 5256364 - DNA, 13 bp, Homo sapiens
atcgtagacacag

SEQ ID NO: 5256365 - DNA, 18 bp, Homo sapiens
atcgtagacacagggatg

SEQ ID NO: 5256366 - DNA, 15 bp, Homo sapiens
atcgtaggcagccac

SEQ ID NO: 5256367 - DNA, 22 bp, Homo sapiens
atcgtataaggaaatccagccc

SEQ ID NO: 5256368 - DNA, 15 bp, Homo sapiens
atcgtatagctgtat

SEQ ID NO: 5256369 - DNA, 23 bp, Homo sapiens
atcgtatagctgtattgaatcat

SEQ ID NO: 5256370 - DNA, 18 bp, Homo sapiens
atcgtattaaaaaacaat

SEQ ID NO: 5256371 - DNA, 18 bp, Homo sapiens
atcgtattacataaaaca

SEQ ID NO: 5256372 - DNA, 22 bp, Homo sapiens
atcgtatttcttttttttaata

SEQ ID NO: 5256373 - DNA, 15 bp, Homo sapiens
atcgtcaaccacttt

SEQ ID NO: 5256374 - DNA, 14 bp, Homo sapiens
atcgtcactgctta

SEQ ID NO: 5256375 - DNA, 18 bp, Homo sapiens
atcgtcactgcttaactt

SEQ ID NO: 5256376 - DNA, 17 bp, Homo sapiens
atcgtcatgcacagtat

SEQ ID NO: 5256377 - DNA, 12 bp, Homo sapiens
atcgtccagccc

SEQ ID NO: 5256378 - DNA, 23 bp, Homo sapiens
atcgtccagggagcattttcctc

SEQ ID NO: 5256379 - DNA, 22 bp, Homo sapiens
atcgtccctatatcagggcctg

SEQ ID NO: 5256380 - DNA, 14 bp, Homo sapiens
atcgtcctgggact

SEQ ID NO: 5256381 - DNA, 16 bp, Homo sapiens
atcgtccttcctctca

SEQ ID NO: 5256382 - DNA, 14 bp, Homo sapiens
atcgtctaaacttt

SEQ ID NO: 5256383 - DNA, 17 bp, Homo sapiens
atcgtctcatgtaaaat

SEQ ID NO: 5256384 - DNA, 21 bp, Homo sapiens
atcgtctcatgtaaaataaga

SEQ ID NO: 5256385 - DNA, 19 bp, Homo sapiens
atcgtctctgccactcctg

SEQ ID NO: 5256386 - DNA, 18 bp, Homo sapiens
atcgtctttaaccccaaa

SEQ ID NO: 5256387 - DNA, 20 bp, Homo sapiens
atcgtgaaaccctgtctcta

SEQ ID NO: 5256388 - DNA, 23 bp, Homo sapiens
atcgtgaagaagcctgtaacact

SEQ ID NO: 5256389 - DNA, 16 bp, Homo sapiens
atcgtgacccttcagg

SEQ ID NO: 5256390 - DNA, 19 bp, Homo sapiens
atcgtgacccttcagggcc

SEQ ID NO: 5256391 - DNA, 20 bp, Homo sapiens
atcgtgacccttcagggcca

SEQ ID NO: 5256392 - DNA, 21 bp, Homo sapiens
atcgtgacccttcagggccag

SEQ ID NO: 5256393 - DNA, 22 bp, Homo sapiens
atcgtgacccttcagggccaga

SEQ ID NO: 5256394 - DNA, 17 bp, Homo sapiens
atcgtgacgctgaataa

SEQ ID NO: 5256395 - DNA, 18 bp, Homo sapiens
atcgtgacgctgaataaa

SEQ ID NO: 5256396 - DNA, 14 bp, Homo sapiens
atcgtgatattgaa

SEQ ID NO: 5256397 - DNA, 12 bp, Homo sapiens
atcgtgcatttg

SEQ ID NO: 5256398 - DNA, 14 bp, Homo sapiens
atcgtggagaaaca

SEQ ID NO: 5256399 - DNA, 19 bp, Homo sapiens
atcgtggagaaacaagaga

SEQ ID NO: 5256400 - DNA, 21 bp, Homo sapiens
atcgtggagaaacaagagacc

SEQ ID NO: 5256401 - DNA, 21 bp, Homo sapiens
atcgtgggtcactacagggag

SEQ ID NO: 5256402 - DNA, 21 bp, Homo sapiens
atcgtgtgccatggatctgat

SEQ ID NO: 5256403 - DNA, 22 bp, Homo sapiens
atcgtgtgccatggatctgatc

SEQ ID NO: 5256404 - DNA, 13 bp, Homo sapiens
atcgttactggca

SEQ ID NO: 5256405 - DNA, 15 bp, Homo sapiens
atcgttatcactgtg

SEQ ID NO: 5256406 - DNA, 12 bp, Homo sapiens
atcgttatctac

SEQ ID NO: 5256407 - DNA, 16 bp, Homo sapiens
atcgttatgtgtgtat

SEQ ID NO: 5256408 - DNA, 17 bp, Homo sapiens
atcgttattataaatgt

SEQ ID NO: 5256409 - DNA, 18 bp, Homo sapiens
atcgttattataaatgtt

SEQ ID NO: 5256410 - DNA, 15 bp, Homo sapiens
atcgttccccacccc

SEQ ID NO: 5256411 - DNA, 16 bp, Homo sapiens
atcgttctttctagct

SEQ ID NO: 5256412 - DNA, 21 bp, Homo sapiens
atcgttgagacatcaggaagg

SEQ ID NO: 5256413 - DNA, 20 bp, Homo sapiens
atcgttgcaaccactgcaat

SEQ ID NO: 5256414 - DNA, 15 bp, Homo sapiens
atgcagtgccctaga

SEQ ID NO: 5256415 - DNA, 16 bp, Homo sapiens
atgcagtgccctagaa

SEQ ID NO: 5256416 - DNA, 17 bp, Homo sapiens
atgcagtgctcgctgtt

SEQ ID NO: 5256417 - DNA, 23 bp, Homo sapiens
atgcagtgctcgctgttgctgaa

SEQ ID NO: 5256418 - DNA, 24 bp, Homo sapiens
atgcagtgctcgctgttgctgaat

SEQ ID NO: 5256419 - DNA, 16 bp, Homo sapiens
atgcagtgctgctttg

SEQ ID NO: 5256420 - DNA, 22 bp, Homo sapiens
atgcagtgtttccctctgtgtt

SEQ ID NO: 5256421 - DNA, 19 bp, Homo sapiens
atgcagttagctgaagaat

SEQ ID NO: 5256422 - DNA, 22 bp, Homo sapiens
atgcagttagctgaagaattga

SEQ ID NO: 5256423 - DNA, 15 bp, Homo sapiens
atgcagttattagaa

SEQ ID NO: 5256424 - DNA, 18 bp, Homo sapiens
atgcagttcattattttg

SEQ ID NO: 5256425 - DNA, 20 bp, Homo sapiens
atgcagttctcacgaaagta

SEQ ID NO: 5256426 - DNA, 18 bp, Homo sapiens
atgcagttgtctctgttt

SEQ ID NO: 5256427 - DNA, 18 bp, Homo sapiens
atgcagttgtggtgtgcc

SEQ ID NO: 5256428 - DNA, 16 bp, Homo sapiens
atgcagtttgaaattc

SEQ ID NO: 5256429 - DNA, 21 bp, Homo sapiens
atgcagtttgaaattctgaat

SEQ ID NO: 5256430 - DNA, 17 bp, Homo sapiens
atgcagtttttcagagt

SEQ ID NO: 5256431 - DNA, 22 bp, Homo sapiens
atgcagtttttcagagtggaat

SEQ ID NO: 5256432 - DNA, 13 bp, Homo sapiens
atgcataaacaac

SEQ ID NO: 5256433 - DNA, 18 bp, Homo sapiens
atgcataaacaacagtac

SEQ ID NO: 5256434 - DNA, 14 bp, Homo sapiens
atgcataaataaat

SEQ ID NO: 5256435 - DNA, 15 bp, Homo sapiens
atgcataaatatgca

SEQ ID NO: 5256436 - DNA, 16 bp, Homo sapiens
atgcataaatatgcag

SEQ ID NO: 5256437 - DNA, 12 bp, Homo sapiens
atgcataactga

SEQ ID NO: 5256438 - DNA, 22 bp, Homo sapiens
atgcataactgacaaatcaagt

SEQ ID NO: 5256439 - DNA, 15 bp, Homo sapiens
atgcataagcttttt

SEQ ID NO: 5256440 - DNA, 18 bp, Homo sapiens
atgcatacaaatctcact

SEQ ID NO: 5256441 - DNA, 15 bp, Homo sapiens
atgcatacaataaaa

SEQ ID NO: 5256442 - DNA, 17 bp, Homo sapiens
atgcatacaataaaaga

SEQ ID NO: 5256443 - DNA, 20 bp, Homo sapiens
atgcatacaataaaagagct

SEQ ID NO: 5256444 - DNA, 11 bp, Homo sapiens
atgcatacaca

SEQ ID NO: 5256445 - DNA, 12 bp, Homo sapiens
atgcatacacac

SEQ ID NO: 5256446 - DNA, 13 bp, Homo sapiens
atgcatacacaca

SEQ ID NO: 5256447 - DNA, 17 bp, Homo sapiens
atgcatacacacacaca

SEQ ID NO: 5256448 - DNA, 23 bp, Homo sapiens
atgcatacacacacacacacagc

SEQ ID NO: 5256449 - DNA, 18 bp, Homo sapiens
atgcatacagttttctag

SEQ ID NO: 5256450 - DNA, 20 bp, Homo sapiens
atgcataccacaagacattt

SEQ ID NO: 5256451 - DNA, 22 bp, Homo sapiens
atgcatacgtacattcctggac

SEQ ID NO: 5256452 - DNA, 14 bp, Homo sapiens
atgcatactgagat

SEQ ID NO: 5256453 - DNA, 21 bp, Homo sapiens
atgcatacttcaaaagtattt

SEQ ID NO: 5256454 - DNA, 13 bp, Homo sapiens
atgcatagagcaa

SEQ ID NO: 5256455 - DNA, 15 bp, Homo sapiens
atgcatagagcaatt

SEQ ID NO: 5256456 - DNA, 23 bp, Homo sapiens
atgcatagtcccagctacccagg

SEQ ID NO: 5256457 - DNA, 22 bp, Homo sapiens
atgcatagttcccatgttaaat

SEQ ID NO: 5256458 - DNA, 11 bp, Homo sapiens
atgcatatact

SEQ ID NO: 5256459 - DNA, 14 bp, Homo sapiens
atgcatatagacac

SEQ ID NO: 5256460 - DNA, 16 bp, Homo sapiens
atgcatatagacacac

SEQ ID NO: 5256461 - DNA, 15 bp, Homo sapiens
atgcatatatatgta

SEQ ID NO: 5256462 - DNA, 22 bp, Homo sapiens
atgcatatcattaaacaaataa

SEQ ID NO: 5256463 - DNA, 18 bp, Homo sapiens
atgcatatcctgagccat

SEQ ID NO: 5256464 - DNA, 17 bp, Homo sapiens
atgcatatcgctgggct

SEQ ID NO: 5256465 - DNA, 15 bp, Homo sapiens
atgcatatgatatat

SEQ ID NO: 5256466 - DNA, 20 bp, Homo sapiens
atgcatatgtcactagaatg

SEQ ID NO: 5256467 - DNA, 20 bp, Homo sapiens
atgcatattaaataataaag

SEQ ID NO: 5256468 - DNA, 24 bp, Homo sapiens
atgcatattattttatgttgcata

SEQ ID NO: 5256469 - DNA, 16 bp, Homo sapiens
atgcatattcaacaca

SEQ ID NO: 5256470 - DNA, 20 bp, Homo sapiens
atgcatattcaacacactgc

SEQ ID NO: 5256471 - DNA, 20 bp, Homo sapiens
atgcatatttataagagaag

SEQ ID NO: 5256472 - DNA, 17 bp, Homo sapiens
atgcatatttctatgtt

SEQ ID NO: 5256473 - DNA, 15 bp, Homo sapiens
atgcatatttttgca

SEQ ID NO: 5256474 - DNA, 19 bp, Homo sapiens
atgcatcaagaactattgt

SEQ ID NO: 5256475 - DNA, 19 bp, Homo sapiens
atgcatcacactcaaggac

SEQ ID NO: 5256476 - DNA, 16 bp, Homo sapiens
atgcatcagataacaa

SEQ ID NO: 5256477 - DNA, 18 bp, Homo sapiens
atgcatcgggaaagaaga

SEQ ID NO: 5256478 - DNA, 20 bp, Homo sapiens
atgcatcgggaaagaagaaa

SEQ ID NO: 5256479 - DNA, 23 bp, Homo sapiens
atgcatcgttttctttgctgtgc

SEQ ID NO: 5256480 - DNA, 17 bp, Homo sapiens
atgcatctccacctgct

SEQ ID NO: 5256481 - DNA, 16 bp, Homo sapiens
atgcatctctgcttag

SEQ ID NO: 5256482 - DNA, 17 bp, Homo sapiens
atgcatctctgcttagt

SEQ ID NO: 5256483 - DNA, 22 bp, Homo sapiens
atgcatctctgcttagttctat

SEQ ID NO: 5256484 - DNA, 21 bp, Homo sapiens
atgcatctgaaagttttgata

SEQ ID NO: 5256485 - DNA, 22 bp, Homo sapiens
atgcatctgaaagttttgatac

SEQ ID NO: 5256486 - DNA, 13 bp, Homo sapiens
atgcatctgagaa

SEQ ID NO: 5256487 - DNA, 15 bp, Homo sapiens
atgcatctggctact

SEQ ID NO: 5256488 - DNA, 20 bp, Homo sapiens
atgcatctggctcaccgggt

SEQ ID NO: 5256489 - DNA, 14 bp, Homo sapiens
atgcatcttactga

SEQ ID NO: 5256490 - DNA, 13 bp, Homo sapiens
atgcatctttgag

SEQ ID NO: 5256491 - DNA, 13 bp, Homo sapiens
atgcatctttgat

SEQ ID NO: 5256492 - DNA, 15 bp, Homo sapiens
atgcatctttgatgt

SEQ ID NO: 5256493 - DNA, 21 bp, Homo sapiens
atgcatctttgatgtgttgtt

SEQ ID NO: 5256494 - DNA, 13 bp, Homo sapiens
atgcatgaagcaa

SEQ ID NO: 5256495 - DNA, 20 bp, Homo sapiens
atgcatgaagtaatatgcac

SEQ ID NO: 5256496 - DNA, 16 bp, Homo sapiens
atgcatgacagcctct

SEQ ID NO: 5256497 - DNA, 21 bp, Homo sapiens
atgcatgacttccctccaccc

SEQ ID NO: 5256498 - DNA, 15 bp, Homo sapiens
atgcatgagaactaa

SEQ ID NO: 5256499 - DNA, 18 bp, Homo sapiens
atgcatgagaactaaata

SEQ ID NO: 5256500 - DNA, 14 bp, Homo sapiens
atgcatgataatga

SEQ ID NO: 5256501 - DNA, 22 bp, Homo sapiens
atgcatgatccagctgtgtgtt

SEQ ID NO: 5256502 - DNA, 24 bp, Homo sapiens
atgcatgatccagctgtgtgtttt

SEQ ID NO: 5256503 - DNA, 20 bp, Homo sapiens
atgcatgatgtaaaaaatac

SEQ ID NO: 5256504 - DNA, 13 bp, Homo sapiens
atgcatgatttta

SEQ ID NO: 5256505 - DNA, 19 bp, Homo sapiens
atgcatgattttatacata

SEQ ID NO: 5256506 - DNA, 13 bp, Homo sapiens
atgcatgcaaatg

SEQ ID NO: 5256507 - DNA, 18 bp, Homo sapiens
atgcatgcactcttttga

SEQ ID NO: 5256508 - DNA, 11 bp, Homo sapiens
atgcatgccag

SEQ ID NO: 5256509 - DNA, 14 bp, Homo sapiens
atgcatgccaggct

SEQ ID NO: 5256510 - DNA, 17 bp, Homo sapiens
atgcatgccaggctggg

SEQ ID NO: 5256511 - DNA, 19 bp, Homo sapiens
atgcatgccaggctgggca

SEQ ID NO: 5256512 - DNA, 15 bp, Homo sapiens
atgcatgctaaatta

SEQ ID NO: 5256513 - DNA, 17 bp, Homo sapiens
atgcatgcttcttctca

SEQ ID NO: 5256514 - DNA, 19 bp, Homo sapiens
atgcatgcttctttataaa

SEQ ID NO: 5256515 - DNA, 21 bp, Homo sapiens
atgcatgctttccatattttt

SEQ ID NO: 5256516 - DNA, 16 bp, Homo sapiens
atgcatggaaacatgg

SEQ ID NO: 5256517 - DNA, 23 bp, Homo sapiens
atgcatggaaacctgaaaaaaag

SEQ ID NO: 5256518 - DNA, 22 bp, Homo sapiens
atgcatggagtgtttgacgaag

SEQ ID NO: 5256519 - DNA, 14 bp, Homo sapiens
atgcatggcctccc

SEQ ID NO: 5256520 - DNA, 19 bp, Homo sapiens
atgcatggcctcccagcca

SEQ ID NO: 5256521 - DNA, 19 bp, Homo sapiens
atgcatgggaggaattcat

SEQ ID NO: 5256522 - DNA, 13 bp, Homo sapiens
atgcatgggatgt

SEQ ID NO: 5256523 - DNA, 22 bp, Homo sapiens
atgcatggggcgggtcctagct

SEQ ID NO: 5256524 - DNA, 23 bp, Homo sapiens
atgcatggtgcagttgacagcag

SEQ ID NO: 5256525 - DNA, 21 bp, Homo sapiens
atgcatggtgccccaggacca

SEQ ID NO: 5256526 - DNA, 19 bp, Homo sapiens
atgcatgtaatcaacatgg

SEQ ID NO: 5256527 - DNA, 13 bp, Homo sapiens
atgcatgtagcat

SEQ ID NO: 5256528 - DNA, 22 bp, Homo sapiens
atgcatgtagtagcctttcctg

SEQ ID NO: 5256529 - DNA, 16 bp, Homo sapiens
atgcatgtcctgtaaa

SEQ ID NO: 5256530 - DNA, 22 bp, Homo sapiens
atgcatgtctgccaaaatgcaa

SEQ ID NO: 5256531 - DNA, 19 bp, Homo sapiens
atgcatgtctgcctatgca

SEQ ID NO: 5256532 - DNA, 11 bp, Homo sapiens
atgcatgtctt

SEQ ID NO: 5256533 - DNA, 18 bp, Homo sapiens
atgcatgtcttttaaaat

SEQ ID NO: 5256534 - DNA, 14 bp, Homo sapiens
atgcatgtgaagaa

SEQ ID NO: 5256535 - DNA, 16 bp, Homo sapiens
atgcatgtgaagaaag

SEQ ID NO: 5256536 - DNA, 16 bp, Homo sapiens
atgcatgtgctgtctc

SEQ ID NO: 5256537 - DNA, 23 bp, Homo sapiens
atgcatgtggtttggttcctctc

SEQ ID NO: 5256538 - DNA, 13 bp, Homo sapiens
atgcatgttacta

SEQ ID NO: 5256539 - DNA, 20 bp, Homo sapiens
atgcatgttttatgtgcact

SEQ ID NO: 5256540 - DNA, 19 bp, Homo sapiens
atgcatgttttccagctcc

SEQ ID NO: 5256541 - DNA, 20 bp, Homo sapiens
atgcatgttttccagctcct

SEQ ID NO: 5256542 - DNA, 14 bp, Homo sapiens
atgcattaaaaaaa

SEQ ID NO: 5256543 - DNA, 20 bp, Homo sapiens
atgcattaaaagaaaataaa

SEQ ID NO: 5256544 - DNA, 19 bp, Homo sapiens
atgcattaataaaaatcaa

SEQ ID NO: 5256545 - DNA, 21 bp, Homo sapiens
atgcattataggatcatttgt

SEQ ID NO: 5256546 - DNA, 22 bp, Homo sapiens
atgcattataggatcatttgtt

SEQ ID NO: 5256547 - DNA, 20 bp, Homo sapiens
atgcattattttgtcataaa

SEQ ID NO: 5256548 - DNA, 17 bp, Homo sapiens
atgcattcaaaatataa

SEQ ID NO: 5256549 - DNA, 13 bp, Homo sapiens
atgcattcacaag

SEQ ID NO: 5256550 - DNA, 19 bp, Homo sapiens
atgcattcacatttagaaa

SEQ ID NO: 5256551 - DNA, 23 bp, Homo sapiens
atgcattcacatttagaaaagtg

SEQ ID NO: 5256552 - DNA, 19 bp, Homo sapiens
atgcattccctgaatctgt

SEQ ID NO: 5256553 - DNA, 21 bp, Homo sapiens
atgcattctaccactacattt

SEQ ID NO: 5256554 - DNA, 21 bp, Homo sapiens
atgcattctatcgttattata

SEQ ID NO: 5256555 - DNA, 22 bp, Homo sapiens
atgcattctgataggagggggc

SEQ ID NO: 5256556 - DNA, 17 bp, Homo sapiens
atgcattcttctctgtt

SEQ ID NO: 5256557 - DNA, 18 bp, Homo sapiens
atgcattctttcttctct

SEQ ID NO: 5256558 - DNA, 17 bp, Homo sapiens
atgcattgaaaaatttc

SEQ ID NO: 5256559 - DNA, 15 bp, Homo sapiens
atgcattgaaagaat

SEQ ID NO: 5256560 - DNA, 16 bp, Homo sapiens
atgcattgagctgcct

SEQ ID NO: 5256561 - DNA, 18 bp, Homo sapiens
atgcattgagctgcctcc

SEQ ID NO: 5256562 - DNA, 19 bp, Homo sapiens
atgcattgatattgtgaac

SEQ ID NO: 5256563 - DNA, 14 bp, Homo sapiens
atgcattgcctgta

SEQ ID NO: 5256564 - DNA, 21 bp, Homo sapiens
atgcattgctctggatctgtt

SEQ ID NO: 5256565 - DNA, 19 bp, Homo sapiens
atgcattggccctgacaaa

SEQ ID NO: 5256566 - DNA, 14 bp, Homo sapiens
atgcattggcctct

SEQ ID NO: 5256567 - DNA, 20 bp, Homo sapiens
atgcattgtgaattgcctgc

SEQ ID NO: 5256568 - DNA, 22 bp, Homo sapiens
atgcattgtgaattgcctgcca

SEQ ID NO: 5256569 - DNA, 16 bp, Homo sapiens
atgcattgttggctat

SEQ ID NO: 5256570 - DNA, 20 bp, Homo sapiens
atgcattgttggctatttga

SEQ ID NO: 5256571 - DNA, 17 bp, Homo sapiens
atgcattgttgtaaagt

SEQ ID NO: 5256572 - DNA, 20 bp, Homo sapiens
atgcattgttgtaaagtatt

SEQ ID NO: 5256573 - DNA, 17 bp, Homo sapiens
atgcatttaaaatacca

SEQ ID NO: 5256574 - DNA, 23 bp, Homo sapiens
atgcatttaagttgtaaacgtct

SEQ ID NO: 5256575 - DNA, 16 bp, Homo sapiens
atgcatttaataaaga

SEQ ID NO: 5256576 - DNA, 15 bp, Homo sapiens
atgcatttaattctg

SEQ ID NO: 5256577 - DNA, 23 bp, Homo sapiens
atgcatttagtggtggtagaaat

SEQ ID NO: 5256578 - DNA, 11 bp, Homo sapiens
atgcatttata

SEQ ID NO: 5256579 - DNA, 19 bp, Homo sapiens
atgcatttatcaataaaag

SEQ ID NO: 5256580 - DNA, 15 bp, Homo sapiens
atgcatttatgcatg

SEQ ID NO: 5256581 - DNA, 16 bp, Homo sapiens
atgcatttatgcatga

SEQ ID NO: 5256582 - DNA, 19 bp, Homo sapiens
atgcatttatgcatgagaa

SEQ ID NO: 5256583 - DNA, 15 bp, Homo sapiens
atgcatttcaaatgt

SEQ ID NO: 5256584 - DNA, 16 bp, Homo sapiens
atgcatttcaaatgtt

SEQ ID NO: 5256585 - DNA, 13 bp, Homo sapiens
atgcatttcaagc

SEQ ID NO: 5256586 - DNA, 12 bp, Homo sapiens
atgcatttcaat

SEQ ID NO: 5256587 - DNA, 15 bp, Homo sapiens
atgcatttccacact

SEQ ID NO: 5256588 - DNA, 20 bp, Homo sapiens
atgcatttccacactgtcag

SEQ ID NO: 5256589 - DNA, 21 bp, Homo sapiens
atgcatttccacactgtcaga

SEQ ID NO: 5256590 - DNA, 12 bp, Homo sapiens
atgcatttctgt

SEQ ID NO: 5256591 - DNA, 15 bp, Homo sapiens
atcgttgttattaaa

SEQ ID NO: 5256592 - DNA, 16 bp, Homo sapiens
atcgtttaatgtttat

SEQ ID NO: 5256593 - DNA, 20 bp, Homo sapiens
atcgtttattgcttaatccc

SEQ ID NO: 5256594 - DNA, 22 bp, Homo sapiens
atcgtttgcaaatgtcagtttc

SEQ ID NO: 5256595 - DNA, 18 bp, Homo sapiens
atcgttttcttaaagtgc

SEQ ID NO: 5256596 - DNA, 19 bp, Homo sapiens
atcgtttttgctgcagaga

SEQ ID NO: 5256597 - DNA, 16 bp, Homo sapiens
atctaaaaaatatctt

SEQ ID NO: 5256598 - DNA, 14 bp, Homo sapiens
atctaaaaatatac

SEQ ID NO: 5256599 - DNA, 23 bp, Homo sapiens
atctaaaaatatacatgtttatg

SEQ ID NO: 5256600 - DNA, 22 bp, Homo sapiens
atctaaaaattttgcatttcat

SEQ ID NO: 5256601 - DNA, 21 bp, Homo sapiens
atctaaaacaaaatctgaact

SEQ ID NO: 5256602 - DNA, 19 bp, Homo sapiens
atctaaaatgttttatgac

SEQ ID NO: 5256603 - DNA, 18 bp, Homo sapiens
atctaaaatttaaaatta

SEQ ID NO: 5256604 - DNA, 23 bp, Homo sapiens
atctaaacccagcaaaacagatt

SEQ ID NO: 5256605 - DNA, 21 bp, Homo sapiens
atctaaactttaatatgtatt

SEQ ID NO: 5256606 - DNA, 18 bp, Homo sapiens
atctaaaggatggaaaaa

SEQ ID NO: 5256607 - DNA, 14 bp, Homo sapiens
atctaaagttgctc

SEQ ID NO: 5256608 - DNA, 17 bp, Homo sapiens
atctaaataaaatgcta

SEQ ID NO: 5256609 - DNA, 17 bp, Homo sapiens
atctaaataatacagga

SEQ ID NO: 5256610 - DNA, 22 bp, Homo sapiens
atctaaatattgatttctgcct

SEQ ID NO: 5256611 - DNA, 15 bp, Homo sapiens
atctaaatctattta

SEQ ID NO: 5256612 - DNA, 22 bp, Homo sapiens
atctaaatctatttattaatat

SEQ ID NO: 5256613 - DNA, 13 bp, Homo sapiens
atctaaatgaatg

SEQ ID NO: 5256614 - DNA, 14 bp, Homo sapiens
atctaaatgatgag

SEQ ID NO: 5256615 - DNA, 17 bp, Homo sapiens
atctaaatggaaccact

SEQ ID NO: 5256616 - DNA, 18 bp, Homo sapiens
atctaaatggaaccactc

SEQ ID NO: 5256617 - DNA, 12 bp, Homo sapiens
atctaaattaaa

SEQ ID NO: 5256618 - DNA, 19 bp, Homo sapiens
atctaaattaacttctatt

SEQ ID NO: 5256619 - DNA, 20 bp, Homo sapiens
atctaaattacagtgcagtt

SEQ ID NO: 5256620 - DNA, 16 bp, Homo sapiens
atctaaattgaataat

SEQ ID NO: 5256621 - DNA, 21 bp, Homo sapiens
atctaaattgaataatggtac

SEQ ID NO: 5256622 - DNA, 17 bp, Homo sapiens
atctaaatttaattacc

SEQ ID NO: 5256623 - DNA, 17 bp, Homo sapiens
atctaaatttagaaatc

SEQ ID NO: 5256624 - DNA, 18 bp, Homo sapiens
atctaaatttcttttgct

SEQ ID NO: 5256625 - DNA, 12 bp, Homo sapiens
atctaacaaaat

SEQ ID NO: 5256626 - DNA, 15 bp, Homo sapiens
atctaacaaaataag

SEQ ID NO: 5256627 - DNA, 15 bp, Homo sapiens
atctaacaatggaag

SEQ ID NO: 5256628 - DNA, 16 bp, Homo sapiens
atctaacaatggaaga

SEQ ID NO: 5256629 - DNA, 14 bp, Homo sapiens
atctaacagacaag

SEQ ID NO: 5256630 - DNA, 15 bp, Homo sapiens
atctaacagtaacac

SEQ ID NO: 5256631 - DNA, 23 bp, Homo sapiens
atctaaccattaagtcatgtgtg

SEQ ID NO: 5256632 - DNA, 20 bp, Homo sapiens
atctaaccccttacccatct

SEQ ID NO: 5256633 - DNA, 15 bp, Homo sapiens
atctaaccctcccat

SEQ ID NO: 5256634 - DNA, 13 bp, Homo sapiens
atctaacctcatc

SEQ ID NO: 5256635 - DNA, 14 bp, Homo sapiens
atctaacctcatct

SEQ ID NO: 5256636 - DNA, 21 bp, Homo sapiens
atctaacgtgttccagtgtct

SEQ ID NO: 5256637 - DNA, 20 bp, Homo sapiens
atctaactgatgagtaaact

SEQ ID NO: 5256638 - DNA, 14 bp, Homo sapiens
atctaactgttgtt

SEQ ID NO: 5256639 - DNA, 14 bp, Homo sapiens
atctaactttgtaa

SEQ ID NO: 5256640 - DNA, 17 bp, Homo sapiens
atctaagaataataaaa

SEQ ID NO: 5256641 - DNA, 21 bp, Homo sapiens
atctaagcagcatttctgaag

SEQ ID NO: 5256642 - DNA, 16 bp, Homo sapiens
atctaagcagttgcaa

SEQ ID NO: 5256643 - DNA, 19 bp, Homo sapiens
atctaagcattccacactg

SEQ ID NO: 5256644 - DNA, 18 bp, Homo sapiens
atctaagcctttccataa

SEQ ID NO: 5256645 - DNA, 18 bp, Homo sapiens
atctaagctgtttgccaa

SEQ ID NO: 5256646 - DNA, 20 bp, Homo sapiens
atctaaggatgtcacagggc

SEQ ID NO: 5256647 - DNA, 19 bp, Homo sapiens
atctaagggaagatcactg

SEQ ID NO: 5256648 - DNA, 20 bp, Homo sapiens
atctaagggaagatcactgt

SEQ ID NO: 5256649 - DNA, 15 bp, Homo sapiens
atctaagtatatgtg

SEQ ID NO: 5256650 - DNA, 21 bp, Homo sapiens
atctaagtgcctcacattttt

SEQ ID NO: 5256651 - DNA, 12 bp, Homo sapiens
atctaataatga

SEQ ID NO: 5256652 - DNA, 14 bp, Homo sapiens
atctaatacaaaat

SEQ ID NO: 5256653 - DNA, 17 bp, Homo sapiens
atctaatacctctgtgt

SEQ ID NO: 5256654 - DNA, 18 bp, Homo sapiens
atctaatagagaactttt

SEQ ID NO: 5256655 - DNA, 21 bp, Homo sapiens
atctaatagcgggttactttc

SEQ ID NO: 5256656 - DNA, 15 bp, Homo sapiens
atctaatatatatga

SEQ ID NO: 5256657 - DNA, 19 bp, Homo sapiens
atctaatatatatgaataa

SEQ ID NO: 5256658 - DNA, 22 bp, Homo sapiens
atctaatatatatgaataaagt

SEQ ID NO: 5256659 - DNA, 13 bp, Homo sapiens
atctaatatgaag

SEQ ID NO: 5256660 - DNA, 23 bp, Homo sapiens
atctaatatggccacagtagtct

SEQ ID NO: 5256661 - DNA, 18 bp, Homo sapiens
atctaatatgtaacaagc

SEQ ID NO: 5256662 - DNA, 14 bp, Homo sapiens
atctaatctaaaag

SEQ ID NO: 5256663 - DNA, 18 bp, Homo sapiens
atctaatctcttattcta

SEQ ID NO: 5256664 - DNA, 23 bp, Homo sapiens
atctaatctgaactgaccttgaa

SEQ ID NO: 5256665 - DNA, 13 bp, Homo sapiens
atctaatgaaaaa

SEQ ID NO: 5256666 - DNA, 18 bp, Homo sapiens
atctaatgacattcaata

SEQ ID NO: 5256667 - DNA, 22 bp, Homo sapiens
atctaatgagttgctggaaaat

SEQ ID NO: 5256668 - DNA, 23 bp, Homo sapiens
atctaatgcttgtttatgatatt

SEQ ID NO: 5256669 - DNA, 16 bp, Homo sapiens
atctaatgtctcttcc

SEQ ID NO: 5256670 - DNA, 16 bp, Homo sapiens
atctaattaaatggca

SEQ ID NO: 5256671 - DNA, 17 bp, Homo sapiens
atctaattcagacagag

SEQ ID NO: 5256672 - DNA, 15 bp, Homo sapiens
atctaattctgattc

SEQ ID NO: 5256673 - DNA, 13 bp, Homo sapiens
atctaattcttta

SEQ ID NO: 5256674 - DNA, 12 bp, Homo sapiens
atctaatttata

SEQ ID NO: 5256675 - DNA, 14 bp, Homo sapiens
atctaatttataaa

SEQ ID NO: 5256676 - DNA, 14 bp, Homo sapiens
atctaatttataca

SEQ ID NO: 5256677 - DNA, 16 bp, Homo sapiens
atctaatttatacaaa

SEQ ID NO: 5256678 - DNA, 15 bp, Homo sapiens
atctaatttcattca

SEQ ID NO: 5256679 - DNA, 17 bp, Homo sapiens
atctaatttcattcaaa

SEQ ID NO: 5256680 - DNA, 14 bp, Homo sapiens
atctaattttacac

SEQ ID NO: 5256681 - DNA, 16 bp, Homo sapiens
atctaatttttattaa

SEQ ID NO: 5256682 - DNA, 14 bp, Homo sapiens
atctacaaactttt

SEQ ID NO: 5256683 - DNA, 17 bp, Homo sapiens
atctacaaacttttata

SEQ ID NO: 5256684 - DNA, 23 bp, Homo sapiens
atctacaaacttttataaatgtt

SEQ ID NO: 5256685 - DNA, 17 bp, Homo sapiens
atctacaagccaaaagt

SEQ ID NO: 5256686 - DNA, 15 bp, Homo sapiens
atctacaatacatat

SEQ ID NO: 5256687 - DNA, 17 bp, Homo sapiens
atctacaatacatatat

SEQ ID NO: 5256688 - DNA, 17 bp, Homo sapiens
atctacaatatatatta

SEQ ID NO: 5256689 - DNA, 19 bp, Homo sapiens
atctacaatctctttttgt

SEQ ID NO: 5256690 - DNA, 15 bp, Homo sapiens
atctacacagcctgg

SEQ ID NO: 5256691 - DNA, 17 bp, Homo sapiens
atctacacagcctggac

SEQ ID NO: 5256692 - DNA, 19 bp, Homo sapiens
atctacacagcctggactt

SEQ ID NO: 5256693 - DNA, 19 bp, Homo sapiens
atctacacatataaacaca

SEQ ID NO: 5256694 - DNA, 11 bp, Homo sapiens
atctacacatg

SEQ ID NO: 5256695 - DNA, 13 bp, Homo sapiens
atctacactgcct

SEQ ID NO: 5256696 - DNA, 18 bp, Homo sapiens
atctacactgccttacct

SEQ ID NO: 5256697 - DNA, 20 bp, Homo sapiens
atctacagaactacatattt

SEQ ID NO: 5256698 - DNA, 21 bp, Homo sapiens
atctacagatcctttttccat

SEQ ID NO: 5256699 - DNA, 22 bp, Homo sapiens
atctacagatcctttttccatc

SEQ ID NO: 5256700 - DNA, 19 bp, Homo sapiens
atctacagcttctattcat

SEQ ID NO: 5256701 - DNA, 16 bp, Homo sapiens
atctacagtaatgaaa

SEQ ID NO: 5256702 - DNA, 18 bp, Homo sapiens
atctacagtacttccaga

SEQ ID NO: 5256703 - DNA, 19 bp, Homo sapiens
atctacagtacttccagat

SEQ ID NO: 5256704 - DNA, 20 bp, Homo sapiens
atctacatcttttttcacaa

SEQ ID NO: 5256705 - DNA, 18 bp, Homo sapiens
atctacatgccatgccta

SEQ ID NO: 5256706 - DNA, 20 bp, Homo sapiens
atctacattataataaaatt

SEQ ID NO: 5256707 - DNA, 17 bp, Homo sapiens
atctacatttgtttgta

SEQ ID NO: 5256708 - DNA, 15 bp, Homo sapiens
atctaccaactttca

SEQ ID NO: 5256709 - DNA, 16 bp, Homo sapiens
atctaccaactttcaa

SEQ ID NO: 5256710 - DNA, 19 bp, Homo sapiens
atctaccaactttcaagaa

SEQ ID NO: 5256711 - DNA, 14 bp, Homo sapiens
atctaccccagact

SEQ ID NO: 5256712 - DNA, 20 bp, Homo sapiens
atctaccccagactagatgt

SEQ ID NO: 5256713 - DNA, 15 bp, Homo sapiens
atctacctagattta

SEQ ID NO: 5256714 - DNA, 18 bp, Homo sapiens
atctacctgcaacacaac

SEQ ID NO: 5256715 - DNA, 14 bp, Homo sapiens
atctacctgccctc

SEQ ID NO: 5256716 - DNA, 17 bp, Homo sapiens
atctacctgccctctct

SEQ ID NO: 5256717 - DNA, 14 bp, Homo sapiens
atctacctgttctg

SEQ ID NO: 5256718 - DNA, 20 bp, Homo sapiens
atctactaaaaatacaaaaa

SEQ ID NO: 5256719 - DNA, 21 bp, Homo sapiens
atctactaattgagccattta

SEQ ID NO: 5256720 - DNA, 15 bp, Homo sapiens
atctactacagagtg

SEQ ID NO: 5256721 - DNA, 13 bp, Homo sapiens
atctactcccaag

SEQ ID NO: 5256722 - DNA, 21 bp, Homo sapiens
atctactcttttgaagtgttt

SEQ ID NO: 5256723 - DNA, 14 bp, Homo sapiens
atctactgactata

SEQ ID NO: 5256724 - DNA, 16 bp, Homo sapiens
atctactgactgaaat

SEQ ID NO: 5256725 - DNA, 17 bp, Homo sapiens
atctactgactgaaatc

SEQ ID NO: 5256726 - DNA, 18 bp, Homo sapiens
atctactgactgaaatca

SEQ ID NO: 5256727 - DNA, 20 bp, Homo sapiens
atctactgactgaaatcagt

SEQ ID NO: 5256728 - DNA, 13 bp, Homo sapiens
atctactgagcca

SEQ ID NO: 5256729 - DNA, 12 bp, Homo sapiens
atctactgcatt

SEQ ID NO: 5256730 - DNA, 16 bp, Homo sapiens
atctacttagccagat

SEQ ID NO: 5256731 - DNA, 13 bp, Homo sapiens
atctacttccaaa

SEQ ID NO: 5256732 - DNA, 16 bp, Homo sapiens
atctactttaataaat

SEQ ID NO: 5256733 - DNA, 21 bp, Homo sapiens
atctactttaatttattttgt

SEQ ID NO: 5256734 - DNA, 19 bp, Homo sapiens
atctactttccctctggga

SEQ ID NO: 5256735 - DNA, 19 bp, Homo sapiens
atctacttttactcataag

SEQ ID NO: 5256736 - DNA, 19 bp, Homo sapiens
atctagaaaatgaaaagat

SEQ ID NO: 5256737 - DNA, 17 bp, Homo sapiens
atctagaaagctttgaa

SEQ ID NO: 5256738 - DNA, 18 bp, Homo sapiens
atctagaactatcatttt

SEQ ID NO: 5256739 - DNA, 19 bp, Homo sapiens
atctagaactatcattttt

SEQ ID NO: 5256740 - DNA, 12 bp, Homo sapiens
atctagaagaaa

SEQ ID NO: 5256741 - DNA, 14 bp, Homo sapiens
atctagaagaaatg

SEQ ID NO: 5256742 - DNA, 18 bp, Homo sapiens
atctagaagaaatgaaat

SEQ ID NO: 5256743 - DNA, 19 bp, Homo sapiens
atctagaagagtctattgt

SEQ ID NO: 5256744 - DNA, 23 bp, Homo sapiens
atctagaagatgtgtaaacaggt

SEQ ID NO: 5256745 - DNA, 14 bp, Homo sapiens
atctagaattttta

SEQ ID NO: 5256746 - DNA, 17 bp, Homo sapiens
atctagacaatatacaa

SEQ ID NO: 5256747 - DNA, 16 bp, Homo sapiens
atctagacaatttctt

SEQ ID NO: 5256748 - DNA, 14 bp, Homo sapiens
atctagagaacagt

SEQ ID NO: 5256749 - DNA, 17 bp, Homo sapiens
atctagagaacagtatt

SEQ ID NO: 5256750 - DNA, 16 bp, Homo sapiens
atctagagaataatca

SEQ ID NO: 5256751 - DNA, 16 bp, Homo sapiens
atctagagtttataca

SEQ ID NO: 5256752 - DNA, 23 bp, Homo sapiens
atctagagtttatacagtgtaca

SEQ ID NO: 5256753 - DNA, 14 bp, Homo sapiens
atctagatagctga

SEQ ID NO: 5256754 - DNA, 18 bp, Homo sapiens
atctagcaaatgttatgc

SEQ ID NO: 5256755 - DNA, 19 bp, Homo sapiens
atctagcaagaagattcta

SEQ ID NO: 5256756 - DNA, 15 bp, Homo sapiens
atctagcaatcacaa

SEQ ID NO: 5256757 - DNA, 22 bp, Homo sapiens
atctagcaatcacaacactggc

SEQ ID NO: 5256758 - DNA, 22 bp, Homo sapiens
atctagcactcctcaagacttt

SEQ ID NO: 5256759 - DNA, 11 bp, Homo sapiens
atctagcagct

SEQ ID NO: 5256760 - DNA, 17 bp, Homo sapiens
atctagcagctggccta

SEQ ID NO: 5256761 - DNA, 16 bp, Homo sapiens
atctagcagtaaaaga

SEQ ID NO: 5256762 - DNA, 18 bp, Homo sapiens
atctagcagtaaatactt

SEQ ID NO: 5256763 - DNA, 16 bp, Homo sapiens
atctagcatttatttc

SEQ ID NO: 5256764 - DNA, 22 bp, Homo sapiens
atctagccagagcccttcactg

SEQ ID NO: 5256765 - DNA, 18 bp, Homo sapiens
atctagccagaggctgga

SEQ ID NO: 5256766 - DNA, 15 bp, Homo sapiens
atctagccaggcctc

SEQ ID NO: 5256767 - DNA, 20 bp, Homo sapiens
atctagccaggcctcccgca

SEQ ID NO: 5256768 - DNA, 20 bp, Homo sapiens
atctagcctaaagtatacaa

SEQ ID NO: 5256769 - DNA, 20 bp, Homo sapiens
atctagcttcatgcctcagt

SEQ ID NO: 5256770 - DNA, 12 bp, Homo sapiens
atgcatttgaaa

SEQ ID NO: 5256771 - DNA, 18 bp, Homo sapiens
atgcatttgaaaattttg

SEQ ID NO: 5256772 - DNA, 17 bp, Homo sapiens
atgcatttgaggtcaag

SEQ ID NO: 5256773 - DNA, 23 bp, Homo sapiens
atgcatttgaggtcaagtaagaa

SEQ ID NO: 5256774 - DNA, 15 bp, Homo sapiens
atgcatttggaatta

SEQ ID NO: 5256775 - DNA, 15 bp, Homo sapiens
atgcattttcaagat

SEQ ID NO: 5256776 - DNA, 20 bp, Homo sapiens
atgcattttctacatgtatt

SEQ ID NO: 5256777 - DNA, 15 bp, Homo sapiens
atgcattttcttcac

SEQ ID NO: 5256778 - DNA, 16 bp, Homo sapiens
atgcattttcttcaca

SEQ ID NO: 5256779 - DNA, 18 bp, Homo sapiens
atgcattttcttcacagt

SEQ ID NO: 5256780 - DNA, 20 bp, Homo sapiens
atgcattttcttcacagtgc

SEQ ID NO: 5256781 - DNA, 16 bp, Homo sapiens
atgcattttcttgtat

SEQ ID NO: 5256782 - DNA, 15 bp, Homo sapiens
atgcattttgagtgt

SEQ ID NO: 5256783 - DNA, 20 bp, Homo sapiens
atgcattttgtgtacagtaa

SEQ ID NO: 5256784 - DNA, 16 bp, Homo sapiens
atgcatttttttagtt

SEQ ID NO: 5256785 - DNA, 20 bp, Homo sapiens
atgcatttttttagtttgtt

SEQ ID NO: 5256786 - DNA, 15 bp, Homo sapiens
atgccaaaaacaaaa

SEQ ID NO: 5256787 - DNA, 16 bp, Homo sapiens
atgccaaaaacaaaat

SEQ ID NO: 5256788 - DNA, 21 bp, Homo sapiens
atgccaaacagttgtaccact

SEQ ID NO: 5256789 - DNA, 20 bp, Homo sapiens
atgccaaagatcacttgttg

SEQ ID NO: 5256790 - DNA, 19 bp, Homo sapiens
atgccaaagatgtttgaaa

SEQ ID NO: 5256791 - DNA, 18 bp, Homo sapiens
atgccaaagcaaaagaag

SEQ ID NO: 5256792 - DNA, 16 bp, Homo sapiens
atgccaaagcagacat

SEQ ID NO: 5256793 - DNA, 22 bp, Homo sapiens
atgccaaagctagggtggccct

SEQ ID NO: 5256794 - DNA, 15 bp, Homo sapiens
atgccaaagctgctt

SEQ ID NO: 5256795 - DNA, 18 bp, Homo sapiens
atgccaaattaaaaaaga

SEQ ID NO: 5256796 - DNA, 22 bp, Homo sapiens
atgccaaattaaaaaagataaa

SEQ ID NO: 5256797 - DNA, 16 bp, Homo sapiens
atgccaacaagaatgc

SEQ ID NO: 5256798 - DNA, 14 bp, Homo sapiens
atgccaacacttaa

SEQ ID NO: 5256799 - DNA, 22 bp, Homo sapiens
atgccaacatacccttctttaa

SEQ ID NO: 5256800 - DNA, 22 bp, Homo sapiens
atgccaacttcccacacggcag

SEQ ID NO: 5256801 - DNA, 14 bp, Homo sapiens
atgccaacttgtcc

SEQ ID NO: 5256802 - DNA, 21 bp, Homo sapiens
atgccaagcactgtgctcagg

SEQ ID NO: 5256803 - DNA, 22 bp, Homo sapiens
atgccaaggaggtcccaggaag

SEQ ID NO: 5256804 - DNA, 19 bp, Homo sapiens
atgccaaggcctccctcag

SEQ ID NO: 5256805 - DNA, 14 bp, Homo sapiens
atgccaagttgttt

SEQ ID NO: 5256806 - DNA, 23 bp, Homo sapiens
atgccaagttgtttgagaaatta

SEQ ID NO: 5256807 - DNA, 17 bp, Homo sapiens
atgccaatattaaatct

SEQ ID NO: 5256808 - DNA, 17 bp, Homo sapiens
atgccaatgagtctgta

SEQ ID NO: 5256809 - DNA, 23 bp, Homo sapiens
atgccaatgtccaggtcacaggc

SEQ ID NO: 5256810 - DNA, 16 bp, Homo sapiens
atgccacaaggacttc

SEQ ID NO: 5256811 - DNA, 19 bp, Homo sapiens
atgccacaaggacttcctg

SEQ ID NO: 5256812 - DNA, 17 bp, Homo sapiens
atgccacaccaagctgt

SEQ ID NO: 5256813 - DNA, 21 bp, Homo sapiens
atgccacaccaagctgtgcca

SEQ ID NO: 5256814 - DNA, 16 bp, Homo sapiens
atgccacagacaactc

SEQ ID NO: 5256815 - DNA, 11 bp, Homo sapiens
atgccacagcc

SEQ ID NO: 5256816 - DNA, 12 bp, Homo sapiens
atgccacagcca

SEQ ID NO: 5256817 - DNA, 17 bp, Homo sapiens
atgccacagccaagccc

SEQ ID NO: 5256818 - DNA, 18 bp, Homo sapiens
atgccacagccccacagc

SEQ ID NO: 5256819 - DNA, 22 bp, Homo sapiens
atgccacagccccacagcaccc

SEQ ID NO: 5256820 - DNA, 15 bp, Homo sapiens
atgccacagccctgt

SEQ ID NO: 5256821 - DNA, 12 bp, Homo sapiens
atgccacattca

SEQ ID NO: 5256822 - DNA, 15 bp, Homo sapiens
atgccacattcaaaa

SEQ ID NO: 5256823 - DNA, 20 bp, Homo sapiens
atgccaccaacttacaaaaa

SEQ ID NO: 5256824 - DNA, 12 bp, Homo sapiens
atgccaccaccc

SEQ ID NO: 5256825 - DNA, 19 bp, Homo sapiens
atgccaccatccaataaaa

SEQ ID NO: 5256826 - DNA, 15 bp, Homo sapiens
atgccacccagcaac

SEQ ID NO: 5256827 - DNA, 21 bp, Homo sapiens
atgccacccccgctggaggat

SEQ ID NO: 5256828 - DNA, 15 bp, Homo sapiens
atgccaccctcacac

SEQ ID NO: 5256829 - DNA, 23 bp, Homo sapiens
atgccaccctcacacacacagct

SEQ ID NO: 5256830 - DNA, 23 bp, Homo sapiens
atgccaccggcctgtgggtctct

SEQ ID NO: 5256831 - DNA, 13 bp, Homo sapiens
atgccacctagac

SEQ ID NO: 5256832 - DNA, 14 bp, Homo sapiens
atgccacctgcagc

SEQ ID NO: 5256833 - DNA, 14 bp, Homo sapiens
atgccacctggcaa

SEQ ID NO: 5256834 - DNA, 20 bp, Homo sapiens
atgccacgcctggaagggcc

SEQ ID NO: 5256835 - DNA, 16 bp, Homo sapiens
atgccacggcagccac

SEQ ID NO: 5256836 - DNA, 17 bp, Homo sapiens
atgccacggcagccacc

SEQ ID NO: 5256837 - DNA, 18 bp, Homo sapiens
atgccacggcagccaccc

SEQ ID NO: 5256838 - DNA, 20 bp, Homo sapiens
atgccacggcagccaccctg

SEQ ID NO: 5256839 - DNA, 20 bp, Homo sapiens
atgccacgtggtcactgtgc

SEQ ID NO: 5256840 - DNA, 14 bp, Homo sapiens
atgccacgttccac

SEQ ID NO: 5256841 - DNA, 18 bp, Homo sapiens
atgccactaacttctaaa

SEQ ID NO: 5256842 - DNA, 20 bp, Homo sapiens
atgccactaacttctaaaga

SEQ ID NO: 5256843 - DNA, 16 bp, Homo sapiens
atgccactatgagctt

SEQ ID NO: 5256844 - DNA, 13 bp, Homo sapiens
atgccactcccta

SEQ ID NO: 5256845 - DNA, 14 bp, Homo sapiens
atgccactccctac

SEQ ID NO: 5256846 - DNA, 17 bp, Homo sapiens
atgccactcctccctcc

SEQ ID NO: 5256847 - DNA, 19 bp, Homo sapiens
atgccactgccaggcacct

SEQ ID NO: 5256848 - DNA, 21 bp, Homo sapiens
atgccactgccaggcacctgg

SEQ ID NO: 5256849 - DNA, 13 bp, Homo sapiens
atgccactgcctg

SEQ ID NO: 5256850 - DNA, 17 bp, Homo sapiens
atgccactgcctgcacc

SEQ ID NO: 5256851 - DNA, 18 bp, Homo sapiens
atgccactgcctgcacct

SEQ ID NO: 5256852 - DNA, 12 bp, Homo sapiens
atgccactggga

SEQ ID NO: 5256853 - DNA, 23 bp, Homo sapiens
atgccactgggacagctggctgg

SEQ ID NO: 5256854 - DNA, 22 bp, Homo sapiens
atgccagaaggaatcttctcat

SEQ ID NO: 5256855 - DNA, 20 bp, Homo sapiens
atgccagacttctaaaataa

SEQ ID NO: 5256856 - DNA, 20 bp, Homo sapiens
atgccagagcaaagggccag

SEQ ID NO: 5256857 - DNA, 13 bp, Homo sapiens
atgccagagccaa

SEQ ID NO: 5256858 - DNA, 14 bp, Homo sapiens
atgccagagccaac

SEQ ID NO: 5256859 - DNA, 19 bp, Homo sapiens
atgccagagccaacctgga

SEQ ID NO: 5256860 - DNA, 23 bp, Homo sapiens
atgccagagccaacctggacttc

SEQ ID NO: 5256861 - DNA, 11 bp, Homo sapiens
atgccagaggg

SEQ ID NO: 5256862 - DNA, 16 bp, Homo sapiens
atgccagagggccagc

SEQ ID NO: 5256863 - DNA, 20 bp, Homo sapiens
atgccagagggccagcaggc

SEQ ID NO: 5256864 - DNA, 19 bp, Homo sapiens
atgccagattctgcctctc

SEQ ID NO: 5256865 - DNA, 17 bp, Homo sapiens
atgccagccaagctctg

SEQ ID NO: 5256866 - DNA, 17 bp, Homo sapiens
atgccagcccctgcctg

SEQ ID NO: 5256867 - DNA, 18 bp, Homo sapiens
atgccagcccctgcctgg

SEQ ID NO: 5256868 - DNA, 20 bp, Homo sapiens
atgccagcccctgcctgggt

SEQ ID NO: 5256869 - DNA, 18 bp, Homo sapiens
atgccagctcagtcccat

SEQ ID NO: 5256870 - DNA, 21 bp, Homo sapiens
atgccagctccatgttctccc

SEQ ID NO: 5256871 - DNA, 12 bp, Homo sapiens
atgccagctgtg

SEQ ID NO: 5256872 - DNA, 15 bp, Homo sapiens
atgccagcttcctgt

SEQ ID NO: 5256873 - DNA, 13 bp, Homo sapiens
atgccagcttctc

SEQ ID NO: 5256874 - DNA, 15 bp, Homo sapiens
atgccagcttctctc

SEQ ID NO: 5256875 - DNA, 23 bp, Homo sapiens
atgccagcttctctctccagggt

SEQ ID NO: 5256876 - DNA, 19 bp, Homo sapiens
atgccagcttggacatcag

SEQ ID NO: 5256877 - DNA, 23 bp, Homo sapiens
atgccagcttggacatcagtgtt

SEQ ID NO: 5256878 - DNA, 23 bp, Homo sapiens
atgccaggaagcacgttcactag

SEQ ID NO: 5256879 - DNA, 18 bp, Homo sapiens
atgccaggacagctgcag

SEQ ID NO: 5256880 - DNA, 16 bp, Homo sapiens
atgccaggaccagtcc

SEQ ID NO: 5256881 - DNA, 15 bp, Homo sapiens
atgccaggacccgcc

SEQ ID NO: 5256882 - DNA, 19 bp, Homo sapiens
atgccaggacccgccagcc

SEQ ID NO: 5256883 - DNA, 22 bp, Homo sapiens
atgccaggacccgccagccccg

SEQ ID NO: 5256884 - DNA, 22 bp, Homo sapiens
atgccaggccagagggcagtgg

SEQ ID NO: 5256885 - DNA, 19 bp, Homo sapiens
atgccaggcggacaaagtt

SEQ ID NO: 5256886 - DNA, 19 bp, Homo sapiens
atgccaggctaatttttat

SEQ ID NO: 5256887 - DNA, 24 bp, Homo sapiens
atgccaggctgcgtccctccgagc

SEQ ID NO: 5256888 - DNA, 13 bp, Homo sapiens
atgccaggctgtg

SEQ ID NO: 5256889 - DNA, 14 bp, Homo sapiens
atgccaggctgtgc

SEQ ID NO: 5256890 - DNA, 14 bp, Homo sapiens
atgccagggcccag

SEQ ID NO: 5256891 - DNA, 23 bp, Homo sapiens
atgccaggttaggaaggcagcat

SEQ ID NO: 5256892 - DNA, 18 bp, Homo sapiens
atgccaggttctatttgg

SEQ ID NO: 5256893 - DNA, 19 bp, Homo sapiens
atgccaggttctatttgga

SEQ ID NO: 5256894 - DNA, 20 bp, Homo sapiens
atgccaggttctatttggaa

SEQ ID NO: 5256895 - DNA, 16 bp, Homo sapiens
atgccagtaactgtgc

SEQ ID NO: 5256896 - DNA, 20 bp, Homo sapiens
atgccagtaggctcaactag

SEQ ID NO: 5256897 - DNA, 13 bp, Homo sapiens
atgccagtatttt

SEQ ID NO: 5256898 - DNA, 20 bp, Homo sapiens
atgccagtatttttaaaggc

SEQ ID NO: 5256899 - DNA, 22 bp, Homo sapiens
atgccagtatttttaaaggcat

SEQ ID NO: 5256900 - DNA, 20 bp, Homo sapiens
atgccagtccagatgtgcct

SEQ ID NO: 5256901 - DNA, 13 bp, Homo sapiens
atgccagtctcat

SEQ ID NO: 5256902 - DNA, 15 bp, Homo sapiens
atgccagtgcatgcc

SEQ ID NO: 5256903 - DNA, 14 bp, Homo sapiens
atgccagtgcctta

SEQ ID NO: 5256904 - DNA, 14 bp, Homo sapiens
atgccagtgtgctg

SEQ ID NO: 5256905 - DNA, 21 bp, Homo sapiens
atgccagtttttaaaatgctg

SEQ ID NO: 5256906 - DNA, 18 bp, Homo sapiens
atgccataaaagccgccc

SEQ ID NO: 5256907 - DNA, 23 bp, Homo sapiens
atgccataaaattgcagtttcat

SEQ ID NO: 5256908 - DNA, 18 bp, Homo sapiens
atgccataaatacaagat

SEQ ID NO: 5256909 - DNA, 18 bp, Homo sapiens
atgccataagcaggagtt

SEQ ID NO: 5256910 - DNA, 12 bp, Homo sapiens
atgccataatac

SEQ ID NO: 5256911 - DNA, 17 bp, Homo sapiens
atgccataatacaaaag

SEQ ID NO: 5256912 - DNA, 14 bp, Homo sapiens
atgccatatttttg

SEQ ID NO: 5256913 - DNA, 16 bp, Homo sapiens
atgccatcagcccctg

SEQ ID NO: 5256914 - DNA, 17 bp, Homo sapiens
atgccatcagcccctgg

SEQ ID NO: 5256915 - DNA, 19 bp, Homo sapiens
atgccatcagcccctggga

SEQ ID NO: 5256916 - DNA, 16 bp, Homo sapiens
atgccatcatctcctg

SEQ ID NO: 5256917 - DNA, 15 bp, Homo sapiens
atgccatcatgccca

SEQ ID NO: 5256918 - DNA, 12 bp, Homo sapiens
atgccatcctca

SEQ ID NO: 5256919 - DNA, 22 bp, Homo sapiens
atgccatctccaccctgagcct

SEQ ID NO: 5256920 - DNA, 23 bp, Homo sapiens
atgccatctccaccctgagcctg

SEQ ID NO: 5256921 - DNA, 17 bp, Homo sapiens
atgccatctgtgggcac

SEQ ID NO: 5256922 - DNA, 18 bp, Homo sapiens
atgccatgaacaaattct

SEQ ID NO: 5256923 - DNA, 15 bp, Homo sapiens
atgccatgaatgagt

SEQ ID NO: 5256924 - DNA, 14 bp, Homo sapiens
atgccatgactgct

SEQ ID NO: 5256925 - DNA, 22 bp, Homo sapiens
atgccatggaatgactgaagac

SEQ ID NO: 5256926 - DNA, 14 bp, Homo sapiens
atgccatgtctgag

SEQ ID NO: 5256927 - DNA, 23 bp, Homo sapiens
atgccattgacaaggtgtttctc

SEQ ID NO: 5256928 - DNA, 20 bp, Homo sapiens
atgccatttagaatctagaa

SEQ ID NO: 5256929 - DNA, 23 bp, Homo sapiens
atgccatttagaatctagaaatg

SEQ ID NO: 5256930 - DNA, 13 bp, Homo sapiens
atgccatttcttc

SEQ ID NO: 5256931 - DNA, 12 bp, Homo sapiens
atgccatttgtc

SEQ ID NO: 5256932 - DNA, 20 bp, Homo sapiens
atgccatttgtcttttgtaa

SEQ ID NO: 5256933 - DNA, 15 bp, Homo sapiens
atgccatttgtttat

SEQ ID NO: 5256934 - DNA, 16 bp, Homo sapiens
atgccatttgtttatt

SEQ ID NO: 5256935 - DNA, 21 bp, Homo sapiens
atgccattttaaggaaaacta

SEQ ID NO: 5256936 - DNA, 13 bp, Homo sapiens
atgcccaaatata

SEQ ID NO: 5256937 - DNA, 16 bp, Homo sapiens
atgcccaccccctgcc

SEQ ID NO: 5256938 - DNA, 20 bp, Homo sapiens
atgcccaccccctgccctgc

SEQ ID NO: 5256939 - DNA, 13 bp, Homo sapiens
atgcccacccctg

SEQ ID NO: 5256940 - DNA, 22 bp, Homo sapiens
atgcccaccgaggagccccagc

SEQ ID NO: 5256941 - DNA, 21 bp, Homo sapiens
atgcccaccgcccctggacag

SEQ ID NO: 5256942 - DNA, 15 bp, Homo sapiens
atgcccacctgccca

SEQ ID NO: 5256943 - DNA, 16 bp, Homo sapiens
atgcccacctgcccat

SEQ ID NO: 5256944 - DNA, 20 bp, Homo sapiens
atgcccacctgcccatcaca

SEQ ID NO: 5256945 - DNA, 21 bp, Homo sapiens
atgcccactcccccaggagca

SEQ ID NO: 5256946 - DNA, 12 bp, Homo sapiens
atgcccactgct

SEQ ID NO: 5256947 - DNA, 11 bp, Homo sapiens
atgcccagaag

SEQ ID NO: 5256948 - DNA, 22 bp, Homo sapiens
atctagcttcatgcctcagttt

SEQ ID NO: 5256949 - DNA, 19 bp, Homo sapiens
atctaggaaaatattttga

SEQ ID NO: 5256950 - DNA, 14 bp, Homo sapiens
atctaggaaaatta

SEQ ID NO: 5256951 - DNA, 19 bp, Homo sapiens
atctaggattttaagggaa

SEQ ID NO: 5256952 - DNA, 19 bp, Homo sapiens
atctaggcatttcattatg

SEQ ID NO: 5256953 - DNA, 18 bp, Homo sapiens
atctaggccaccccaacc

SEQ ID NO: 5256954 - DNA, 23 bp, Homo sapiens
atctagggagccctgggccaggg

SEQ ID NO: 5256955 - DNA, 22 bp, Homo sapiens
atctaggtggagttgaaagagt

SEQ ID NO: 5256956 - DNA, 19 bp, Homo sapiens
atctaggtttaactcagat

SEQ ID NO: 5256957 - DNA, 14 bp, Homo sapiens
atctaggtttatga

SEQ ID NO: 5256958 - DNA, 22 bp, Homo sapiens
atctagtaagacgtaaggggaa

SEQ ID NO: 5256959 - DNA, 16 bp, Homo sapiens
atctagtaatatattt

SEQ ID NO: 5256960 - DNA, 20 bp, Homo sapiens
atctagtaggtctgcacaca

SEQ ID NO: 5256961 - DNA, 15 bp, Homo sapiens
atctagtagttgttc

SEQ ID NO: 5256962 - DNA, 15 bp, Homo sapiens
atctagtatgaaatt

SEQ ID NO: 5256963 - DNA, 17 bp, Homo sapiens
atctagtatgaaattat

SEQ ID NO: 5256964 - DNA, 16 bp, Homo sapiens
atctagtcacaaagac

SEQ ID NO: 5256965 - DNA, 13 bp, Homo sapiens
atctagtcagtat

SEQ ID NO: 5256966 - DNA, 18 bp, Homo sapiens
atctagtcttgacctctc

SEQ ID NO: 5256967 - DNA, 18 bp, Homo sapiens
atctagtgacacctcagt

SEQ ID NO: 5256968 - DNA, 22 bp, Homo sapiens
atctagtgacacctcagtcata

SEQ ID NO: 5256969 - DNA, 15 bp, Homo sapiens
atctagtgaccagat

SEQ ID NO: 5256970 - DNA, 14 bp, Homo sapiens
atctagtgcagctg

SEQ ID NO: 5256971 - DNA, 22 bp, Homo sapiens
atctagtgcagctgattttaac

SEQ ID NO: 5256972 - DNA, 13 bp, Homo sapiens
atctagtgccatt

SEQ ID NO: 5256973 - DNA, 20 bp, Homo sapiens
atctagtgccattatttcta

SEQ ID NO: 5256974 - DNA, 20 bp, Homo sapiens
atctagttcccctgtttatt

SEQ ID NO: 5256975 - DNA, 23 bp, Homo sapiens
atctagttcccctgtttattcat

SEQ ID NO: 5256976 - DNA, 19 bp, Homo sapiens
atctagttctcttctcctg

SEQ ID NO: 5256977 - DNA, 20 bp, Homo sapiens
atctagtttacagaaaaatc

SEQ ID NO: 5256978 - DNA, 11 bp, Homo sapiens
atctataaaat

SEQ ID NO: 5256979 - DNA, 14 bp, Homo sapiens
atctataaacactg

SEQ ID NO: 5256980 - DNA, 16 bp, Homo sapiens
atctataaagaagaac

SEQ ID NO: 5256981 - DNA, 21 bp, Homo sapiens
atctataaagcgatatacaga

SEQ ID NO: 5256982 - DNA, 15 bp, Homo sapiens
atctataacataaag

SEQ ID NO: 5256983 - DNA, 22 bp, Homo sapiens
atctataagtagtaaatcagaa

SEQ ID NO: 5256984 - DNA, 13 bp, Homo sapiens
atctatagaaagt

SEQ ID NO: 5256985 - DNA, 15 bp, Homo sapiens
atctatagcatttaa

SEQ ID NO: 5256986 - DNA, 19 bp, Homo sapiens
atctatagcatttaaagat

SEQ ID NO: 5256987 - DNA, 21 bp, Homo sapiens
atctatagtagtcaattagta

SEQ ID NO: 5256988 - DNA, 22 bp, Homo sapiens
atctatagtagtcaattagtac

SEQ ID NO: 5256989 - DNA, 22 bp, Homo sapiens
atctatagttatacatcttcat

SEQ ID NO: 5256990 - DNA, 21 bp, Homo sapiens
atctatagttcactgacacag

SEQ ID NO: 5256991 - DNA, 21 bp, Homo sapiens
atctatatacaaagccttggt

SEQ ID NO: 5256992 - DNA, 21 bp, Homo sapiens
atctatatagtacctttgctc

SEQ ID NO: 5256993 - DNA, 14 bp, Homo sapiens
atctatatataatt

SEQ ID NO: 5256994 - DNA, 20 bp, Homo sapiens
atctatatataattctgtac

SEQ ID NO: 5256995 - DNA, 14 bp, Homo sapiens
atctatatatacat

SEQ ID NO: 5256996 - DNA, 22 bp, Homo sapiens
atctatatatacgtatgtatat

SEQ ID NO: 5256997 - DNA, 16 bp, Homo sapiens
atctatatatgtgtat

SEQ ID NO: 5256998 - DNA, 14 bp, Homo sapiens
atctatatcatatt

SEQ ID NO: 5256999 - DNA, 19 bp, Homo sapiens
atctatatcatatttctgt

SEQ ID NO: 5257000 - DNA, 21 bp, Homo sapiens
atctatatctctaaactgctg

SEQ ID NO: 5257001 - DNA, 22 bp, Homo sapiens
atctatatgtctataagtatat

SEQ ID NO: 5257002 - DNA, 14 bp, Homo sapiens
atctatattaaatg

SEQ ID NO: 5257003 - DNA, 14 bp, Homo sapiens
atctatattctaaa

SEQ ID NO: 5257004 - DNA, 15 bp, Homo sapiens
atctatattctaaag

SEQ ID NO: 5257005 - DNA, 18 bp, Homo sapiens
atctatattttcagagct

SEQ ID NO: 5257006 - DNA, 14 bp, Homo sapiens
atctatatttttgt

SEQ ID NO: 5257007 - DNA, 22 bp, Homo sapiens
atctatcaatagtcaagaaaaa

SEQ ID NO: 5257008 - DNA, 14 bp, Homo sapiens
atctatcacctgtc

SEQ ID NO: 5257009 - DNA, 13 bp, Homo sapiens
atctatccctgcg

SEQ ID NO: 5257010 - DNA, 16 bp, Homo sapiens
atctatctaatcagat

SEQ ID NO: 5257011 - DNA, 19 bp, Homo sapiens
atctatctaatcagatctt

SEQ ID NO: 5257012 - DNA, 16 bp, Homo sapiens
atctatctacaaagaa

SEQ ID NO: 5257013 - DNA, 17 bp, Homo sapiens
atctatctatataatgt

SEQ ID NO: 5257014 - DNA, 19 bp, Homo sapiens
atctatctatatatacata

SEQ ID NO: 5257015 - DNA, 14 bp, Homo sapiens
atctatctatttga

SEQ ID NO: 5257016 - DNA, 16 bp, Homo sapiens
atctatctatttgagg

SEQ ID NO: 5257017 - DNA, 15 bp, Homo sapiens
atctatctctatata

SEQ ID NO: 5257018 - DNA, 20 bp, Homo sapiens
atctatctggtgatttctag

SEQ ID NO: 5257019 - DNA, 23 bp, Homo sapiens
atctatctggtgatttctagctc

SEQ ID NO: 5257020 - DNA, 17 bp, Homo sapiens
atctatctgtattttca

SEQ ID NO: 5257021 - DNA, 19 bp, Homo sapiens
atctatctgtattttcatt

SEQ ID NO: 5257022 - DNA, 22 bp, Homo sapiens
atctatcttttccacaaatatg

SEQ ID NO: 5257023 - DNA, 11 bp, Homo sapiens
atctatgaacc

SEQ ID NO: 5257024 - DNA, 14 bp, Homo sapiens
atctatgaacctga

SEQ ID NO: 5257025 - DNA, 18 bp, Homo sapiens
atctatgaagtatataat

SEQ ID NO: 5257026 - DNA, 14 bp, Homo sapiens
atctatgactgtgt

SEQ ID NO: 5257027 - DNA, 17 bp, Homo sapiens
atctatgagcaactcct

SEQ ID NO: 5257028 - DNA, 21 bp, Homo sapiens
atctatgagggtgtttcctct

SEQ ID NO: 5257029 - DNA, 15 bp, Homo sapiens
atctatgatatattt

SEQ ID NO: 5257030 - DNA, 21 bp, Homo sapiens
atctatgcaaagcactctctg

SEQ ID NO: 5257031 - DNA, 23 bp, Homo sapiens
atctatgcaaagcactctctgca

SEQ ID NO: 5257032 - DNA, 12 bp, Homo sapiens
atctatgcaatt

SEQ ID NO: 5257033 - DNA, 14 bp, Homo sapiens
atctatgcaatttt

SEQ ID NO: 5257034 - DNA, 17 bp, Homo sapiens
atctatgcaatttttaa

SEQ ID NO: 5257035 - DNA, 23 bp, Homo sapiens
atctatgcagcatggggttttta

SEQ ID NO: 5257036 - DNA, 13 bp, Homo sapiens
atctatgctggtg

SEQ ID NO: 5257037 - DNA, 15 bp, Homo sapiens
atctatggaaatgtg

SEQ ID NO: 5257038 - DNA, 17 bp, Homo sapiens
atctatggaaatgtgag

SEQ ID NO: 5257039 - DNA, 21 bp, Homo sapiens
atctatggaaatgtgagaaat

SEQ ID NO: 5257040 - DNA, 16 bp, Homo sapiens
atctatggagggcaga

SEQ ID NO: 5257041 - DNA, 21 bp, Homo sapiens
atctatggcagtccagccagc

SEQ ID NO: 5257042 - DNA, 20 bp, Homo sapiens
atctatggccctgcaaaaat

SEQ ID NO: 5257043 - DNA, 23 bp, Homo sapiens
atctatggccctgcaaaaatata

SEQ ID NO: 5257044 - DNA, 21 bp, Homo sapiens
atctatggcttatttctatga

SEQ ID NO: 5257045 - DNA, 20 bp, Homo sapiens
atctatggctttaaataaat

SEQ ID NO: 5257046 - DNA, 17 bp, Homo sapiens
atctatgggaagatact

SEQ ID NO: 5257047 - DNA, 17 bp, Homo sapiens
atctatggtcgggagac

SEQ ID NO: 5257048 - DNA, 23 bp, Homo sapiens
atctatggttctaaatattgctt

SEQ ID NO: 5257049 - DNA, 21 bp, Homo sapiens
atctatgtcgtgttttcaagg

SEQ ID NO: 5257050 - DNA, 13 bp, Homo sapiens
atctatgtgaata

SEQ ID NO: 5257051 - DNA, 12 bp, Homo sapiens
atctatgtgttt

SEQ ID NO: 5257052 - DNA, 21 bp, Homo sapiens
atctatgtgtttctgtaacaa

SEQ ID NO: 5257053 - DNA, 16 bp, Homo sapiens
atctatgtttcatctt

SEQ ID NO: 5257054 - DNA, 14 bp, Homo sapiens
atctatgttttacc

SEQ ID NO: 5257055 - DNA, 18 bp, Homo sapiens
atctattaatatatgtat

SEQ ID NO: 5257056 - DNA, 17 bp, Homo sapiens
atctattataaaaccat

SEQ ID NO: 5257057 - DNA, 14 bp, Homo sapiens
atctattatactgt

SEQ ID NO: 5257058 - DNA, 16 bp, Homo sapiens
atctattatactgtat

SEQ ID NO: 5257059 - DNA, 22 bp, Homo sapiens
atctattcctgtaaataagagt

SEQ ID NO: 5257060 - DNA, 23 bp, Homo sapiens
atctattcctgtaaataagagtt

SEQ ID NO: 5257061 - DNA, 13 bp, Homo sapiens
atctattctcaaa

SEQ ID NO: 5257062 - DNA, 13 bp, Homo sapiens
atctattctctgc

SEQ ID NO: 5257063 - DNA, 14 bp, Homo sapiens
atctattgcagata

SEQ ID NO: 5257064 - DNA, 21 bp, Homo sapiens
atctattgcttggacttaact

SEQ ID NO: 5257065 - DNA, 20 bp, Homo sapiens
atctattggctgatctatgc

SEQ ID NO: 5257066 - DNA, 17 bp, Homo sapiens
atctattgggttcatta

SEQ ID NO: 5257067 - DNA, 19 bp, Homo sapiens
atctattgtaagataaaaa

SEQ ID NO: 5257068 - DNA, 16 bp, Homo sapiens
atctattgtgttggct

SEQ ID NO: 5257069 - DNA, 19 bp, Homo sapiens
atctattgtttgttgcact

SEQ ID NO: 5257070 - DNA, 13 bp, Homo sapiens
atctatttaaaaa

SEQ ID NO: 5257071 - DNA, 14 bp, Homo sapiens
atctatttacataa

SEQ ID NO: 5257072 - DNA, 16 bp, Homo sapiens
atctatttattaagtt

SEQ ID NO: 5257073 - DNA, 15 bp, Homo sapiens
atctatttattaata

SEQ ID NO: 5257074 - DNA, 13 bp, Homo sapiens
atctatttattgg

SEQ ID NO: 5257075 - DNA, 17 bp, Homo sapiens
atctatttcacttattt

SEQ ID NO: 5257076 - DNA, 16 bp, Homo sapiens
atctatttcgagtgtt

SEQ ID NO: 5257077 - DNA, 15 bp, Homo sapiens
atctatttgtacaat

SEQ ID NO: 5257078 - DNA, 20 bp, Homo sapiens
atctatttgtatatatacat

SEQ ID NO: 5257079 - DNA, 21 bp, Homo sapiens
atctattttattttattgaat

SEQ ID NO: 5257080 - DNA, 13 bp, Homo sapiens
atctattttctat

SEQ ID NO: 5257081 - DNA, 14 bp, Homo sapiens
atctattttctatg

SEQ ID NO: 5257082 - DNA, 15 bp, Homo sapiens
atctattttctatgt

SEQ ID NO: 5257083 - DNA, 16 bp, Homo sapiens
atctattttctatgta

SEQ ID NO: 5257084 - DNA, 16 bp, Homo sapiens
atctattttgatgcag

SEQ ID NO: 5257085 - DNA, 18 bp, Homo sapiens
atctattttgatgcagca

SEQ ID NO: 5257086 - DNA, 14 bp, Homo sapiens
atctattttggatt

SEQ ID NO: 5257087 - DNA, 22 bp, Homo sapiens
atctattttggattgtatattg

SEQ ID NO: 5257088 - DNA, 20 bp, Homo sapiens
atctatttttaaaatcataa

SEQ ID NO: 5257089 - DNA, 12 bp, Homo sapiens
atctatttttgc

SEQ ID NO: 5257090 - DNA, 21 bp, Homo sapiens
atctatttttgcactggaata

SEQ ID NO: 5257091 - DNA, 23 bp, Homo sapiens
atctatttttgcactggaatatc

SEQ ID NO: 5257092 - DNA, 13 bp, Homo sapiens
atctatttttgga

SEQ ID NO: 5257093 - DNA, 19 bp, Homo sapiens
atctatttttggcagtctg

SEQ ID NO: 5257094 - DNA, 23 bp, Homo sapiens
atctcaaaaaaaaaaaagtgtct

SEQ ID NO: 5257095 - DNA, 14 bp, Homo sapiens
atctcaaaaaaaca

SEQ ID NO: 5257096 - DNA, 14 bp, Homo sapiens
atctcaaaacaaaa

SEQ ID NO: 5257097 - DNA, 15 bp, Homo sapiens
atctcaaaactgcac

SEQ ID NO: 5257098 - DNA, 20 bp, Homo sapiens
atctcaaaactgcactgtca

SEQ ID NO: 5257099 - DNA, 21 bp, Homo sapiens
atctcaaaagatctcctgtgc

SEQ ID NO: 5257100 - DNA, 17 bp, Homo sapiens
atctcaaacactgctta

SEQ ID NO: 5257101 - DNA, 14 bp, Homo sapiens
atctcaaataacta

SEQ ID NO: 5257102 - DNA, 21 bp, Homo sapiens
atctcaaataactaaaaggta

SEQ ID NO: 5257103 - DNA, 23 bp, Homo sapiens
atctcaaataactaaaaggtatg

SEQ ID NO: 5257104 - DNA, 20 bp, Homo sapiens
atctcaaataggctattaaa

SEQ ID NO: 5257105 - DNA, 14 bp, Homo sapiens
atctcaaatccact

SEQ ID NO: 5257106 - DNA, 17 bp, Homo sapiens
atctcaaatccactgac

SEQ ID NO: 5257107 - DNA, 18 bp, Homo sapiens
atctcaaatccactgaca

SEQ ID NO: 5257108 - DNA, 17 bp, Homo sapiens
atctcaaatgttttctg

SEQ ID NO: 5257109 - DNA, 19 bp, Homo sapiens
atctcaaattctcaaccta

SEQ ID NO: 5257110 - DNA, 17 bp, Homo sapiens
atctcaaattgtaatta

SEQ ID NO: 5257111 - DNA, 14 bp, Homo sapiens
atctcaaatttcta

SEQ ID NO: 5257112 - DNA, 15 bp, Homo sapiens
atctcaacaggcctc

SEQ ID NO: 5257113 - DNA, 22 bp, Homo sapiens
atctcaacaggcctcagggctc

SEQ ID NO: 5257114 - DNA, 19 bp, Homo sapiens
atctcaacctacctcgagt

SEQ ID NO: 5257115 - DNA, 13 bp, Homo sapiens
atctcaactataa

SEQ ID NO: 5257116 - DNA, 13 bp, Homo sapiens
atctcaactctgt

SEQ ID NO: 5257117 - DNA, 22 bp, Homo sapiens
atctcaactctgtttatttgat

SEQ ID NO: 5257118 - DNA, 15 bp, Homo sapiens
atctcaagatattca

SEQ ID NO: 5257119 - DNA, 22 bp, Homo sapiens
atctcaagatgggggcagggct

SEQ ID NO: 5257120 - DNA, 20 bp, Homo sapiens
atctcaagatgtttatctga

SEQ ID NO: 5257121 - DNA, 15 bp, Homo sapiens
atctcaagcaagttt

SEQ ID NO: 5257122 - DNA, 13 bp, Homo sapiens
atctcaagccagc

SEQ ID NO: 5257123 - DNA, 14 bp, Homo sapiens
atctcaagccagcc

SEQ ID NO: 5257124 - DNA, 16 bp, Homo sapiens
atctcaagtaaaacaa

SEQ ID NO: 5257125 - DNA, 20 bp, Homo sapiens
atctcaagtaaaacaaatga

SEQ ID NO: 5257126 - DNA, 22 bp, Homo sapiens
atgcccagacatcagcctcctt

SEQ ID NO: 5257127 - DNA, 14 bp, Homo sapiens
atgcccagagaccc

SEQ ID NO: 5257128 - DNA, 16 bp, Homo sapiens
atgcccagagacccag

SEQ ID NO: 5257129 - DNA, 23 bp, Homo sapiens
atgcccagagggcccaggcaggc

SEQ ID NO: 5257130 - DNA, 15 bp, Homo sapiens
atgcccagccagcca

SEQ ID NO: 5257131 - DNA, 16 bp, Homo sapiens
atgcccagccagccac

SEQ ID NO: 5257132 - DNA, 16 bp, Homo sapiens
atgcccagccccttct

SEQ ID NO: 5257133 - DNA, 21 bp, Homo sapiens
atgcccagctagtttttgtat

SEQ ID NO: 5257134 - DNA, 21 bp, Homo sapiens
atgcccagctgtgctgggagg

SEQ ID NO: 5257135 - DNA, 20 bp, Homo sapiens
atgcccagcttggagtgcca

SEQ ID NO: 5257136 - DNA, 23 bp, Homo sapiens
atgcccagcttggagtgccacgt

SEQ ID NO: 5257137 - DNA, 22 bp, Homo sapiens
atgcccaggaagtaattttctt

SEQ ID NO: 5257138 - DNA, 21 bp, Homo sapiens
atgcccagtaaaatttcagga

SEQ ID NO: 5257139 - DNA, 22 bp, Homo sapiens
atgcccagtaaaatttcaggat

SEQ ID NO: 5257140 - DNA, 13 bp, Homo sapiens
atgcccattcctg

SEQ ID NO: 5257141 - DNA, 17 bp, Homo sapiens
atgcccattcctgcctg

SEQ ID NO: 5257142 - DNA, 21 bp, Homo sapiens
atgcccatttgcctttaaaaa

SEQ ID NO: 5257143 - DNA, 12 bp, Homo sapiens
atgccccaagga

SEQ ID NO: 5257144 - DNA, 18 bp, Homo sapiens
atgccccacccacccctc

SEQ ID NO: 5257145 - DNA, 19 bp, Homo sapiens
atgccccacccacccctcc

SEQ ID NO: 5257146 - DNA, 13 bp, Homo sapiens
atgccccaccccc

SEQ ID NO: 5257147 - DNA, 19 bp, Homo sapiens
atgccccacccccctcctc

SEQ ID NO: 5257148 - DNA, 20 bp, Homo sapiens
atgccccacccccctcctcc

SEQ ID NO: 5257149 - DNA, 16 bp, Homo sapiens
atgccccactctgctg

SEQ ID NO: 5257150 - DNA, 18 bp, Homo sapiens
atgccccaggatcactct

SEQ ID NO: 5257151 - DNA, 14 bp, Homo sapiens
atgccccagtatta

SEQ ID NO: 5257152 - DNA, 20 bp, Homo sapiens
atgccccattccttgcgcct

SEQ ID NO: 5257153 - DNA, 15 bp, Homo sapiens
atgcccccaggcagc

SEQ ID NO: 5257154 - DNA, 17 bp, Homo sapiens
atgcccccattctccca

SEQ ID NO: 5257155 - DNA, 18 bp, Homo sapiens
atgcccccattctcccag

SEQ ID NO: 5257156 - DNA, 23 bp, Homo sapiens
atgcccccattctcccagtctct

SEQ ID NO: 5257157 - DNA, 15 bp, Homo sapiens
atgcccccgccacct

SEQ ID NO: 5257158 - DNA, 16 bp, Homo sapiens
atgcccccgccacctc

SEQ ID NO: 5257159 - DNA, 19 bp, Homo sapiens
atgcccccgccacctcccc

SEQ ID NO: 5257160 - DNA, 20 bp, Homo sapiens
atgcccccgccacctcccca

SEQ ID NO: 5257161 - DNA, 17 bp, Homo sapiens
atgccccctcagtgagg

SEQ ID NO: 5257162 - DNA, 13 bp, Homo sapiens
atgccccctcccc

SEQ ID NO: 5257163 - DNA, 16 bp, Homo sapiens
atgccccctcccctcc

SEQ ID NO: 5257164 - DNA, 17 bp, Homo sapiens
atgccccctcccctcct

SEQ ID NO: 5257165 - DNA, 18 bp, Homo sapiens
atgccccctcccctcctt

SEQ ID NO: 5257166 - DNA, 19 bp, Homo sapiens
atgccccctgtggatgctg

SEQ ID NO: 5257167 - DNA, 13 bp, Homo sapiens
atgcccccttcgc

SEQ ID NO: 5257168 - DNA, 21 bp, Homo sapiens
atgcccccttcgctcctcctc

SEQ ID NO: 5257169 - DNA, 19 bp, Homo sapiens
atgccccctttcagatgtc

SEQ ID NO: 5257170 - DNA, 23 bp, Homo sapiens
atgccccgccatggtcaccctca

SEQ ID NO: 5257171 - DNA, 21 bp, Homo sapiens
atgcccctagtaactgctgtc

SEQ ID NO: 5257172 - DNA, 17 bp, Homo sapiens
atgcccctcccccagct

SEQ ID NO: 5257173 - DNA, 19 bp, Homo sapiens
atgcccctcccccagctgc

SEQ ID NO: 5257174 - DNA, 23 bp, Homo sapiens
atgcccctgcagtttggccctgg

SEQ ID NO: 5257175 - DNA, 19 bp, Homo sapiens
atgcccctggccctgcctc

SEQ ID NO: 5257176 - DNA, 20 bp, Homo sapiens
atgcccctgtactccagcct

SEQ ID NO: 5257177 - DNA, 16 bp, Homo sapiens
atgccccttctcccct

SEQ ID NO: 5257178 - DNA, 19 bp, Homo sapiens
atgccccttggtcctggca

SEQ ID NO: 5257179 - DNA, 14 bp, Homo sapiens
atgcccctttctgg

SEQ ID NO: 5257180 - DNA, 18 bp, Homo sapiens
atgcccgctgtcccaggg

SEQ ID NO: 5257181 - DNA, 23 bp, Homo sapiens
atgcccgctgtcccaggggtctc

SEQ ID NO: 5257182 - DNA, 17 bp, Homo sapiens
atgcccggcgccgggca

SEQ ID NO: 5257183 - DNA, 22 bp, Homo sapiens
atgccctaagtgttgaagaaga

SEQ ID NO: 5257184 - DNA, 19 bp, Homo sapiens
atgccctataacccctgcc

SEQ ID NO: 5257185 - DNA, 22 bp, Homo sapiens
atgccctataacccctgcctgg

SEQ ID NO: 5257186 - DNA, 14 bp, Homo sapiens
atgccctcagggga

SEQ ID NO: 5257187 - DNA, 13 bp, Homo sapiens
atgccctccaatc

SEQ ID NO: 5257188 - DNA, 19 bp, Homo sapiens
atgccctcccaggaccctc

SEQ ID NO: 5257189 - DNA, 15 bp, Homo sapiens
atgccctcccctcag

SEQ ID NO: 5257190 - DNA, 20 bp, Homo sapiens
atgccctcccctcagcgcag

SEQ ID NO: 5257191 - DNA, 17 bp, Homo sapiens
atgccctcccttctccc

SEQ ID NO: 5257192 - DNA, 13 bp, Homo sapiens
atgccctcctctc

SEQ ID NO: 5257193 - DNA, 14 bp, Homo sapiens
atgccctcctctcc

SEQ ID NO: 5257194 - DNA, 15 bp, Homo sapiens
atgccctcctctccc

SEQ ID NO: 5257195 - DNA, 12 bp, Homo sapiens
atgccctcctgg

SEQ ID NO: 5257196 - DNA, 13 bp, Homo sapiens
atgccctcctggt

SEQ ID NO: 5257197 - DNA, 15 bp, Homo sapiens
atgccctcctggtga

SEQ ID NO: 5257198 - DNA, 21 bp, Homo sapiens
atgccctctctcgggagccct

SEQ ID NO: 5257199 - DNA, 24 bp, Homo sapiens
atgccctctctcgggagccctagc

SEQ ID NO: 5257200 - DNA, 16 bp, Homo sapiens
atgccctgcagagcaa

SEQ ID NO: 5257201 - DNA, 20 bp, Homo sapiens
atgccctgcagagcaataac

SEQ ID NO: 5257202 - DNA, 17 bp, Homo sapiens
atgccctgccaagcctg

SEQ ID NO: 5257203 - DNA, 11 bp, Homo sapiens
atgccctgccc

SEQ ID NO: 5257204 - DNA, 17 bp, Homo sapiens
atgccctgcccttcctc

SEQ ID NO: 5257205 - DNA, 19 bp, Homo sapiens
atgccctgcccttcctcag

SEQ ID NO: 5257206 - DNA, 20 bp, Homo sapiens
atgccctgcccttcctcagg

SEQ ID NO: 5257207 - DNA, 16 bp, Homo sapiens
atgccctgccttgctg

SEQ ID NO: 5257208 - DNA, 22 bp, Homo sapiens
atgccctgccttgtccctctca

SEQ ID NO: 5257209 - DNA, 15 bp, Homo sapiens
atgccctgcggctct

SEQ ID NO: 5257210 - DNA, 23 bp, Homo sapiens
atgccctgctctgaacacgaagc

SEQ ID NO: 5257211 - DNA, 18 bp, Homo sapiens
atgccctgggatgcctca

SEQ ID NO: 5257212 - DNA, 21 bp, Homo sapiens
atgccctgtccctagctcaca

SEQ ID NO: 5257213 - DNA, 13 bp, Homo sapiens
atgccctgtgcaa

SEQ ID NO: 5257214 - DNA, 18 bp, Homo sapiens
atgcccttcactttctcc

SEQ ID NO: 5257215 - DNA, 12 bp, Homo sapiens
atgcccttcccc

SEQ ID NO: 5257216 - DNA, 16 bp, Homo sapiens
atgcccttctgattcc

SEQ ID NO: 5257217 - DNA, 14 bp, Homo sapiens
atgcccttgctggg

SEQ ID NO: 5257218 - DNA, 22 bp, Homo sapiens
atgccctttcttgaattgcatt

SEQ ID NO: 5257219 - DNA, 19 bp, Homo sapiens
atgccgaacattaggaatt

SEQ ID NO: 5257220 - DNA, 22 bp, Homo sapiens
atgccgaatttggtacacatgt

SEQ ID NO: 5257221 - DNA, 18 bp, Homo sapiens
atgccgcagggagggctg

SEQ ID NO: 5257222 - DNA, 17 bp, Homo sapiens
atgccgccgtgtttcct

SEQ ID NO: 5257223 - DNA, 17 bp, Homo sapiens
atgccgcgatgggtcag

SEQ ID NO: 5257224 - DNA, 18 bp, Homo sapiens
atgccgcggtaggtaagg

SEQ ID NO: 5257225 - DNA, 16 bp, Homo sapiens
atgccgcgtccctgcc

SEQ ID NO: 5257226 - DNA, 19 bp, Homo sapiens
atgccgctcttctgtcatc

SEQ ID NO: 5257227 - DNA, 13 bp, Homo sapiens
atgccgctgtgtc

SEQ ID NO: 5257228 - DNA, 23 bp, Homo sapiens
atgccgctgtgtctatgaactag

SEQ ID NO: 5257229 - DNA, 21 bp, Homo sapiens
atgccggagccccaagactct

SEQ ID NO: 5257230 - DNA, 16 bp, Homo sapiens
atgccgggcgccagga

SEQ ID NO: 5257231 - DNA, 17 bp, Homo sapiens
atgccgggcgccaggac

SEQ ID NO: 5257232 - DNA, 18 bp, Homo sapiens
atgccgggcgccaggaca

SEQ ID NO: 5257233 - DNA, 19 bp, Homo sapiens
atgccgggcgccaggacag

SEQ ID NO: 5257234 - DNA, 21 bp, Homo sapiens
atgccgggcgccaggacagca

SEQ ID NO: 5257235 - DNA, 13 bp, Homo sapiens
atgccgggcgtgg

SEQ ID NO: 5257236 - DNA, 23 bp, Homo sapiens
atgccgggggagccaccagcccc

SEQ ID NO: 5257237 - DNA, 16 bp, Homo sapiens
atgccgtataaaagaa

SEQ ID NO: 5257238 - DNA, 23 bp, Homo sapiens
atgccgtataggatgtcagacaa

SEQ ID NO: 5257239 - DNA, 19 bp, Homo sapiens
atgccgtcctgcagtcctt

SEQ ID NO: 5257240 - DNA, 14 bp, Homo sapiens
atgccgtcctgctg

SEQ ID NO: 5257241 - DNA, 15 bp, Homo sapiens
atgccgtcctgctgg

SEQ ID NO: 5257242 - DNA, 19 bp, Homo sapiens
atgccgtcctgctggagtg

SEQ ID NO: 5257243 - DNA, 16 bp, Homo sapiens
atgccgtctcatattt

SEQ ID NO: 5257244 - DNA, 17 bp, Homo sapiens
atgccgtcttctgccct

SEQ ID NO: 5257245 - DNA, 19 bp, Homo sapiens
atgccgtgtagtttctggt

SEQ ID NO: 5257246 - DNA, 23 bp, Homo sapiens
atgccgtgtgtctcgtctcctga

SEQ ID NO: 5257247 - DNA, 13 bp, Homo sapiens
atgccgtttcctt

SEQ ID NO: 5257248 - DNA, 20 bp, Homo sapiens
atgcctaaaaattcccttcc

SEQ ID NO: 5257249 - DNA, 22 bp, Homo sapiens
atgcctaaaaattcccttcctg

SEQ ID NO: 5257250 - DNA, 15 bp, Homo sapiens
atgcctaagaagatg

SEQ ID NO: 5257251 - DNA, 21 bp, Homo sapiens
atgcctaagaagatgacttcc

SEQ ID NO: 5257252 - DNA, 20 bp, Homo sapiens
atgcctacaaccatccctgc

SEQ ID NO: 5257253 - DNA, 23 bp, Homo sapiens
atgcctacaaccatccctgccac

SEQ ID NO: 5257254 - DNA, 16 bp, Homo sapiens
atgcctacagataatt

SEQ ID NO: 5257255 - DNA, 17 bp, Homo sapiens
atgcctacagataattt

SEQ ID NO: 5257256 - DNA, 14 bp, Homo sapiens
atgcctacagctgt

SEQ ID NO: 5257257 - DNA, 15 bp, Homo sapiens
atgcctacattagtg

SEQ ID NO: 5257258 - DNA, 16 bp, Homo sapiens
atgcctaccttgtgag

SEQ ID NO: 5257259 - DNA, 18 bp, Homo sapiens
atgcctagactgtgtatg

SEQ ID NO: 5257260 - DNA, 23 bp, Homo sapiens
atgcctagacttcccaacagcct

SEQ ID NO: 5257261 - DNA, 16 bp, Homo sapiens
atgcctagagatattt

SEQ ID NO: 5257262 - DNA, 21 bp, Homo sapiens
atgcctagagatatttcaagc

SEQ ID NO: 5257263 - DNA, 23 bp, Homo sapiens
atgcctagcagagtgctggcact

SEQ ID NO: 5257264 - DNA, 19 bp, Homo sapiens
atgcctaggagatgttggg

SEQ ID NO: 5257265 - DNA, 23 bp, Homo sapiens
atgcctaggagatgttgggaaca

SEQ ID NO: 5257266 - DNA, 20 bp, Homo sapiens
atgcctaggccagctcctta

SEQ ID NO: 5257267 - DNA, 14 bp, Homo sapiens
atgcctatattatc

SEQ ID NO: 5257268 - DNA, 15 bp, Homo sapiens
atgcctatattatca

SEQ ID NO: 5257269 - DNA, 12 bp, Homo sapiens
atgcctattgta

SEQ ID NO: 5257270 - DNA, 19 bp, Homo sapiens
atgcctcaagaacaccttt

SEQ ID NO: 5257271 - DNA, 15 bp, Homo sapiens
atgcctcaatgtgac

SEQ ID NO: 5257272 - DNA, 16 bp, Homo sapiens
atgcctcaattcacat

SEQ ID NO: 5257273 - DNA, 23 bp, Homo sapiens
atgcctcaccacacccaggtctc

SEQ ID NO: 5257274 - DNA, 16 bp, Homo sapiens
atgcctcagaagtgca

SEQ ID NO: 5257275 - DNA, 23 bp, Homo sapiens
atgcctcagccacttgcctgtgc

SEQ ID NO: 5257276 - DNA, 18 bp, Homo sapiens
atgcctcagccagccctg

SEQ ID NO: 5257277 - DNA, 20 bp, Homo sapiens
atgcctcagccctgaccctg

SEQ ID NO: 5257278 - DNA, 24 bp, Homo sapiens
atgcctcagccctgaccctgtgga

SEQ ID NO: 5257279 - DNA, 21 bp, Homo sapiens
atgcctcagtagcatctcagt

SEQ ID NO: 5257280 - DNA, 14 bp, Homo sapiens
atgcctcagtgtat

SEQ ID NO: 5257281 - DNA, 15 bp, Homo sapiens
atgcctcagtttccc

SEQ ID NO: 5257282 - DNA, 18 bp, Homo sapiens
atgcctcatgccacacct

SEQ ID NO: 5257283 - DNA, 13 bp, Homo sapiens
atgcctccaccgc

SEQ ID NO: 5257284 - DNA, 14 bp, Homo sapiens
atgcctcccagcta

SEQ ID NO: 5257285 - DNA, 22 bp, Homo sapiens
atgcctccctatccctcacaca

SEQ ID NO: 5257286 - DNA, 14 bp, Homo sapiens
atgcctccctgagc

SEQ ID NO: 5257287 - DNA, 20 bp, Homo sapiens
atgcctccctgggccacctc

SEQ ID NO: 5257288 - DNA, 13 bp, Homo sapiens
atgcctcctcctg

SEQ ID NO: 5257289 - DNA, 18 bp, Homo sapiens
atgcctcctcctgccctc

SEQ ID NO: 5257290 - DNA, 20 bp, Homo sapiens
atgcctcctcctgccctccg

SEQ ID NO: 5257291 - DNA, 16 bp, Homo sapiens
atgcctccttcctctt

SEQ ID NO: 5257292 - DNA, 15 bp, Homo sapiens
atgcctcgctccctt

SEQ ID NO: 5257293 - DNA, 16 bp, Homo sapiens
atgcctctcccacgat

SEQ ID NO: 5257294 - DNA, 14 bp, Homo sapiens
atgcctctcccgca

SEQ ID NO: 5257295 - DNA, 20 bp, Homo sapiens
atgcctctcccgcaccaggc

SEQ ID NO: 5257296 - DNA, 23 bp, Homo sapiens
atgcctctcccgcaccaggccgg

SEQ ID NO: 5257297 - DNA, 17 bp, Homo sapiens
atgcctctctcaggcca

SEQ ID NO: 5257298 - DNA, 13 bp, Homo sapiens
atgcctctgaggc

SEQ ID NO: 5257299 - DNA, 18 bp, Homo sapiens
atgcctctgaggccagcc

SEQ ID NO: 5257300 - DNA, 22 bp, Homo sapiens
atgcctctgccaaaggatgtga

SEQ ID NO: 5257301 - DNA, 14 bp, Homo sapiens
atgcctctgtctag

SEQ ID NO: 5257302 - DNA, 17 bp, Homo sapiens
atgcctctgtctagcat

SEQ ID NO: 5257303 - DNA, 13 bp, Homo sapiens
atctcaagtatat

SEQ ID NO: 5257304 - DNA, 16 bp, Homo sapiens
atctcaatacagcctg

SEQ ID NO: 5257305 - DNA, 22 bp, Homo sapiens
atctcaatcttcggggtgtgat

SEQ ID NO: 5257306 - DNA, 14 bp, Homo sapiens
atctcaattcttcc

SEQ ID NO: 5257307 - DNA, 18 bp, Homo sapiens
atctcaattgaaagcttt

SEQ ID NO: 5257308 - DNA, 17 bp, Homo sapiens
atctcaattgtgctttg

SEQ ID NO: 5257309 - DNA, 17 bp, Homo sapiens
atctcaattttttcaaa

SEQ ID NO: 5257310 - DNA, 15 bp, Homo sapiens
atctcacacagctgg

SEQ ID NO: 5257311 - DNA, 16 bp, Homo sapiens
atctcacaggctgaga

SEQ ID NO: 5257312 - DNA, 17 bp, Homo sapiens
atctcacaggctgagaa

SEQ ID NO: 5257313 - DNA, 14 bp, Homo sapiens
atctcaccccatcc

SEQ ID NO: 5257314 - DNA, 16 bp, Homo sapiens
atctcaccccatccca

SEQ ID NO: 5257315 - DNA, 22 bp, Homo sapiens
atctcaccccatcccacaccct

SEQ ID NO: 5257316 - DNA, 15 bp, Homo sapiens
atctcacctcctgct

SEQ ID NO: 5257317 - DNA, 17 bp, Homo sapiens
atctcacctcctgctgg

SEQ ID NO: 5257318 - DNA, 18 bp, Homo sapiens
atctcacctctaggcctc

SEQ ID NO: 5257319 - DNA, 16 bp, Homo sapiens
atctcactctgccccc

SEQ ID NO: 5257320 - DNA, 18 bp, Homo sapiens
atctcacttaatacagat

SEQ ID NO: 5257321 - DNA, 19 bp, Homo sapiens
atctcacttaatacagatg

SEQ ID NO: 5257322 - DNA, 16 bp, Homo sapiens
atctcacttccagata

SEQ ID NO: 5257323 - DNA, 16 bp, Homo sapiens
atctcactttgtaaat

SEQ ID NO: 5257324 - DNA, 17 bp, Homo sapiens
atctcactttgtaaata

SEQ ID NO: 5257325 - DNA, 22 bp, Homo sapiens
atctcactttgtaaataaaaac

SEQ ID NO: 5257326 - DNA, 12 bp, Homo sapiens
atctcagaaagt

SEQ ID NO: 5257327 - DNA, 18 bp, Homo sapiens
atctcagaaagtaaatct

SEQ ID NO: 5257328 - DNA, 17 bp, Homo sapiens
atctcagaacagtctga

SEQ ID NO: 5257329 - DNA, 12 bp, Homo sapiens
atctcagaccct

SEQ ID NO: 5257330 - DNA, 15 bp, Homo sapiens
atctcagaccctgct

SEQ ID NO: 5257331 - DNA, 16 bp, Homo sapiens
atctcagaccctgctt

SEQ ID NO: 5257332 - DNA, 17 bp, Homo sapiens
atctcagacctttactg

SEQ ID NO: 5257333 - DNA, 23 bp, Homo sapiens
atctcagacctttactgatacta

SEQ ID NO: 5257334 - DNA, 14 bp, Homo sapiens
atctcagagacagg

SEQ ID NO: 5257335 - DNA, 19 bp, Homo sapiens
atctcagagacaggtggcc

SEQ ID NO: 5257336 - DNA, 20 bp, Homo sapiens
atctcagataaagtgaccag

SEQ ID NO: 5257337 - DNA, 14 bp, Homo sapiens
atctcagatatttg

SEQ ID NO: 5257338 - DNA, 20 bp, Homo sapiens
atctcagatgttaaaataaa

SEQ ID NO: 5257339 - DNA, 21 bp, Homo sapiens
atctcagatgttaaaataaat

SEQ ID NO: 5257340 - DNA, 16 bp, Homo sapiens
atctcagattctgtct

SEQ ID NO: 5257341 - DNA, 22 bp, Homo sapiens
atctcagattcttcactggtga

SEQ ID NO: 5257342 - DNA, 23 bp, Homo sapiens
atctcagcaaagctacaggactg

SEQ ID NO: 5257343 - DNA, 19 bp, Homo sapiens
atctcagcagccagctcct

SEQ ID NO: 5257344 - DNA, 21 bp, Homo sapiens
atctcagcagccagctcctgg

SEQ ID NO: 5257345 - DNA, 17 bp, Homo sapiens
atctcagcatcctggaa

SEQ ID NO: 5257346 - DNA, 19 bp, Homo sapiens
atctcagcatcctggaaat

SEQ ID NO: 5257347 - DNA, 14 bp, Homo sapiens
atctcagccatagg

SEQ ID NO: 5257348 - DNA, 11 bp, Homo sapiens
atctcagctca

SEQ ID NO: 5257349 - DNA, 13 bp, Homo sapiens
atctcagctcact

SEQ ID NO: 5257350 - DNA, 16 bp, Homo sapiens
atctcagctcactgca

SEQ ID NO: 5257351 - DNA, 23 bp, Homo sapiens
atctcagctttgagaagccttca

SEQ ID NO: 5257352 - DNA, 13 bp, Homo sapiens
atctcagcttttg

SEQ ID NO: 5257353 - DNA, 15 bp, Homo sapiens
atctcagcttttgat

SEQ ID NO: 5257354 - DNA, 19 bp, Homo sapiens
atctcaggaagtccagcca

SEQ ID NO: 5257355 - DNA, 22 bp, Homo sapiens
atctcaggaggggcagcgcatg

SEQ ID NO: 5257356 - DNA, 20 bp, Homo sapiens
atctcaggccacctgccccc

SEQ ID NO: 5257357 - DNA, 17 bp, Homo sapiens
atctcaggccagagcca

SEQ ID NO: 5257358 - DNA, 19 bp, Homo sapiens
atctcagggaactgaccct

SEQ ID NO: 5257359 - DNA, 22 bp, Homo sapiens
atctcagggagggaaggggatg

SEQ ID NO: 5257360 - DNA, 19 bp, Homo sapiens
atctcagggcacaatggct

SEQ ID NO: 5257361 - DNA, 13 bp, Homo sapiens
atctcagggcaga

SEQ ID NO: 5257362 - DNA, 16 bp, Homo sapiens
atctcagggcctggtc

SEQ ID NO: 5257363 - DNA, 20 bp, Homo sapiens
atctcaggggctgtttgagg

SEQ ID NO: 5257364 - DNA, 17 bp, Homo sapiens
atctcagggtccagacc

SEQ ID NO: 5257365 - DNA, 15 bp, Homo sapiens
atctcaggtctgaat

SEQ ID NO: 5257366 - DNA, 14 bp, Homo sapiens
atctcaggtgccac

SEQ ID NO: 5257367 - DNA, 20 bp, Homo sapiens
atctcaggtggcatttgcag

SEQ ID NO: 5257368 - DNA, 22 bp, Homo sapiens
atctcagtatgaattattcaat

SEQ ID NO: 5257369 - DNA, 16 bp, Homo sapiens
atctcagtcatgcata

SEQ ID NO: 5257370 - DNA, 20 bp, Homo sapiens
atctcagtcatgcataaata

SEQ ID NO: 5257371 - DNA, 14 bp, Homo sapiens
atctcagtcctcaa

SEQ ID NO: 5257372 - DNA, 15 bp, Homo sapiens
atctcagtgaagaat

SEQ ID NO: 5257373 - DNA, 15 bp, Homo sapiens
atctcagtgctttcc

SEQ ID NO: 5257374 - DNA, 17 bp, Homo sapiens
atctcagtggtgtgtga

SEQ ID NO: 5257375 - DNA, 16 bp, Homo sapiens
atctcagttgtttgct

SEQ ID NO: 5257376 - DNA, 19 bp, Homo sapiens
atctcagttgtttgcttct

SEQ ID NO: 5257377 - DNA, 17 bp, Homo sapiens
atctcataactcatttg

SEQ ID NO: 5257378 - DNA, 18 bp, Homo sapiens
atctcatacctctgacca

SEQ ID NO: 5257379 - DNA, 15 bp, Homo sapiens
atctcatagatgacc

SEQ ID NO: 5257380 - DNA, 19 bp, Homo sapiens
atctcataggttgccaata

SEQ ID NO: 5257381 - DNA, 22 bp, Homo sapiens
atctcatcagggtagcagcaga

SEQ ID NO: 5257382 - DNA, 17 bp, Homo sapiens
atctcatccccccaccc

SEQ ID NO: 5257383 - DNA, 16 bp, Homo sapiens
atctcatcctttcctc

SEQ ID NO: 5257384 - DNA, 23 bp, Homo sapiens
atctcatctgccggcccccagga

SEQ ID NO: 5257385 - DNA, 17 bp, Homo sapiens
atctcatgattccatgc

SEQ ID NO: 5257386 - DNA, 21 bp, Homo sapiens
atctcatggaaactggccagg

SEQ ID NO: 5257387 - DNA, 22 bp, Homo sapiens
atctcatggagaagcagaaata

SEQ ID NO: 5257388 - DNA, 20 bp, Homo sapiens
atctcatgtgtgctcacaat

SEQ ID NO: 5257389 - DNA, 19 bp, Homo sapiens
atctcattaattcaattaa

SEQ ID NO: 5257390 - DNA, 21 bp, Homo sapiens
atctcattacagctcattcgc

SEQ ID NO: 5257391 - DNA, 16 bp, Homo sapiens
atctcattagggcttt

SEQ ID NO: 5257392 - DNA, 15 bp, Homo sapiens
atctcattatttcaa

SEQ ID NO: 5257393 - DNA, 18 bp, Homo sapiens
atctcattatttcaaaat

SEQ ID NO: 5257394 - DNA, 13 bp, Homo sapiens
atctcatttaagg

SEQ ID NO: 5257395 - DNA, 18 bp, Homo sapiens
atctcatttaagggaaaa

SEQ ID NO: 5257396 - DNA, 20 bp, Homo sapiens
atctcatttaatttgttata

SEQ ID NO: 5257397 - DNA, 17 bp, Homo sapiens
atctcatttcaatttat

SEQ ID NO: 5257398 - DNA, 14 bp, Homo sapiens
atctcatttccaag

SEQ ID NO: 5257399 - DNA, 13 bp, Homo sapiens
atctccaaaataa

SEQ ID NO: 5257400 - DNA, 17 bp, Homo sapiens
atctccaaaataaaact

SEQ ID NO: 5257401 - DNA, 11 bp, Homo sapiens
atctccaactt

SEQ ID NO: 5257402 - DNA, 16 bp, Homo sapiens
atctccaactttattt

SEQ ID NO: 5257403 - DNA, 13 bp, Homo sapiens
atctccaagaatg

SEQ ID NO: 5257404 - DNA, 22 bp, Homo sapiens
atctccaagaatgctgaaacca

SEQ ID NO: 5257405 - DNA, 17 bp, Homo sapiens
atctccaagacctggtg

SEQ ID NO: 5257406 - DNA, 22 bp, Homo sapiens
atctccaagataagcctgagcc

SEQ ID NO: 5257407 - DNA, 23 bp, Homo sapiens
atctccaagcagcttagagttgg

SEQ ID NO: 5257408 - DNA, 18 bp, Homo sapiens
atctccaaggatcctctc

SEQ ID NO: 5257409 - DNA, 18 bp, Homo sapiens
atctccacaacctcttcc

SEQ ID NO: 5257410 - DNA, 19 bp, Homo sapiens
atctccacaacctcttccc

SEQ ID NO: 5257411 - DNA, 19 bp, Homo sapiens
atctccacaggagagactg

SEQ ID NO: 5257412 - DNA, 20 bp, Homo sapiens
atctccacaggagagactgg

SEQ ID NO: 5257413 - DNA, 22 bp, Homo sapiens
atctccaccagtcatttttcag

SEQ ID NO: 5257414 - DNA, 21 bp, Homo sapiens
atctccacccccagctgcttg

SEQ ID NO: 5257415 - DNA, 22 bp, Homo sapiens
atctccacccccagctgcttgt

SEQ ID NO: 5257416 - DNA, 21 bp, Homo sapiens
atctccaccctgagcctgacc

SEQ ID NO: 5257417 - DNA, 15 bp, Homo sapiens
atctccactccagat

SEQ ID NO: 5257418 - DNA, 17 bp, Homo sapiens
atctccagcatcctgct

SEQ ID NO: 5257419 - DNA, 19 bp, Homo sapiens
atctccagccaatttcaaa

SEQ ID NO: 5257420 - DNA, 11 bp, Homo sapiens
atctccaggcc

SEQ ID NO: 5257421 - DNA, 12 bp, Homo sapiens
atctccaggccc

SEQ ID NO: 5257422 - DNA, 14 bp, Homo sapiens
atctccagggagca

SEQ ID NO: 5257423 - DNA, 16 bp, Homo sapiens
atctccagggagcaag

SEQ ID NO: 5257424 - DNA, 19 bp, Homo sapiens
atctccagggagtcccctc

SEQ ID NO: 5257425 - DNA, 20 bp, Homo sapiens
atctccagggagtcccctcc

SEQ ID NO: 5257426 - DNA, 20 bp, Homo sapiens
atctccagggctgcccctgt

SEQ ID NO: 5257427 - DNA, 15 bp, Homo sapiens
atctccagtattctt

SEQ ID NO: 5257428 - DNA, 15 bp, Homo sapiens
atctccagtgtgcca

SEQ ID NO: 5257429 - DNA, 17 bp, Homo sapiens
atctccagtgtgccaga

SEQ ID NO: 5257430 - DNA, 22 bp, Homo sapiens
atctccatactgtttctttctt

SEQ ID NO: 5257431 - DNA, 20 bp, Homo sapiens
atctccatcatatgcctgac

SEQ ID NO: 5257432 - DNA, 18 bp, Homo sapiens
atctccatccttaactgt

SEQ ID NO: 5257433 - DNA, 21 bp, Homo sapiens
atctccatgctttgctctcaa

SEQ ID NO: 5257434 - DNA, 21 bp, Homo sapiens
atctccatggccctgtcccag

SEQ ID NO: 5257435 - DNA, 14 bp, Homo sapiens
atctccatggcttc

SEQ ID NO: 5257436 - DNA, 22 bp, Homo sapiens
atctccatggcttcctcctccc

SEQ ID NO: 5257437 - DNA, 20 bp, Homo sapiens
atctccatggggaggcctca

SEQ ID NO: 5257438 - DNA, 12 bp, Homo sapiens
atctccatttca

SEQ ID NO: 5257439 - DNA, 15 bp, Homo sapiens
atctccatttcacac

SEQ ID NO: 5257440 - DNA, 21 bp, Homo sapiens
atctccatttctgctcagatt

SEQ ID NO: 5257441 - DNA, 16 bp, Homo sapiens
atctcccaaggctgcc

SEQ ID NO: 5257442 - DNA, 17 bp, Homo sapiens
atctcccaaggctgcca

SEQ ID NO: 5257443 - DNA, 20 bp, Homo sapiens
atctcccaaggctgccagac

SEQ ID NO: 5257444 - DNA, 22 bp, Homo sapiens
atctcccaaggctgccagacat

SEQ ID NO: 5257445 - DNA, 19 bp, Homo sapiens
atctcccacctagcagcac

SEQ ID NO: 5257446 - DNA, 20 bp, Homo sapiens
atctcccacctagcagcacc

SEQ ID NO: 5257447 - DNA, 19 bp, Homo sapiens
atctcccagacttgtttcc

SEQ ID NO: 5257448 - DNA, 22 bp, Homo sapiens
atctcccagacttgtttcctgt

SEQ ID NO: 5257449 - DNA, 16 bp, Homo sapiens
atctcccaggccccag

SEQ ID NO: 5257450 - DNA, 22 bp, Homo sapiens
atctcccaggccccaggggaga

SEQ ID NO: 5257451 - DNA, 14 bp, Homo sapiens
atctcccagggctc

SEQ ID NO: 5257452 - DNA, 15 bp, Homo sapiens
atctcccagggctct

SEQ ID NO: 5257453 - DNA, 19 bp, Homo sapiens
atctcccagggctctctgg

SEQ ID NO: 5257454 - DNA, 14 bp, Homo sapiens
atctcccatgtgtg

SEQ ID NO: 5257455 - DNA, 18 bp, Homo sapiens
atctcccattttggaatt

SEQ ID NO: 5257456 - DNA, 19 bp, Homo sapiens
atctcccattttggaattt

SEQ ID NO: 5257457 - DNA, 14 bp, Homo sapiens
atctccccaggcct

SEQ ID NO: 5257458 - DNA, 15 bp, Homo sapiens
atctccccaggcctc

SEQ ID NO: 5257459 - DNA, 16 bp, Homo sapiens
atctccccaggcctcc

SEQ ID NO: 5257460 - DNA, 17 bp, Homo sapiens
atctccccaggcctcca

SEQ ID NO: 5257461 - DNA, 19 bp, Homo sapiens
atctccccaggcctccagc

SEQ ID NO: 5257462 - DNA, 21 bp, Homo sapiens
atctccccagtagagaaacat

SEQ ID NO: 5257463 - DNA, 15 bp, Homo sapiens
atctcccccaaccca

SEQ ID NO: 5257464 - DNA, 22 bp, Homo sapiens
atctcccccaacccacctctgg

SEQ ID NO: 5257465 - DNA, 16 bp, Homo sapiens
atctcccccactccac

SEQ ID NO: 5257466 - DNA, 17 bp, Homo sapiens
atctcccccactccact

SEQ ID NO: 5257467 - DNA, 18 bp, Homo sapiens
atctcccccactccacta

SEQ ID NO: 5257468 - DNA, 15 bp, Homo sapiens
atctcccccagcccc

SEQ ID NO: 5257469 - DNA, 21 bp, Homo sapiens
atctcccccagccccatcctc

SEQ ID NO: 5257470 - DNA, 19 bp, Homo sapiens
atctcccccatagcaccct

SEQ ID NO: 5257471 - DNA, 22 bp, Homo sapiens
atctcccccatcccccactgcc

SEQ ID NO: 5257472 - DNA, 21 bp, Homo sapiens
atctcccctagctcaccaggc

SEQ ID NO: 5257473 - DNA, 12 bp, Homo sapiens
atctcccctcaa

SEQ ID NO: 5257474 - DNA, 20 bp, Homo sapiens
atctcccctcagctcggctc

SEQ ID NO: 5257475 - DNA, 21 bp, Homo sapiens
atctccctcactgaaaccagg

SEQ ID NO: 5257476 - DNA, 23 bp, Homo sapiens
atctccctcccatttgcagacca

SEQ ID NO: 5257477 - DNA, 22 bp, Homo sapiens
atctccctcgaacccacactgc

SEQ ID NO: 5257478 - DNA, 23 bp, Homo sapiens
atctccctcgaacccacactgca

SEQ ID NO: 5257479 - DNA, 13 bp, Homo sapiens
atctccctgacct

SEQ ID NO: 5257480 - DNA, 13 bp, Homo sapiens
atgcctcttaaat

SEQ ID NO: 5257481 - DNA, 15 bp, Homo sapiens
atgcctcttctacct

SEQ ID NO: 5257482 - DNA, 21 bp, Homo sapiens
atgcctcttctacctcttcca

SEQ ID NO: 5257483 - DNA, 15 bp, Homo sapiens
atgcctgaacttgaa

SEQ ID NO: 5257484 - DNA, 18 bp, Homo sapiens
atgcctgacacaggggac

SEQ ID NO: 5257485 - DNA, 12 bp, Homo sapiens
atgcctgacccc

SEQ ID NO: 5257486 - DNA, 23 bp, Homo sapiens
atgcctgactaattttgtatttt

SEQ ID NO: 5257487 - DNA, 20 bp, Homo sapiens
atgcctgactaatttttgta

SEQ ID NO: 5257488 - DNA, 21 bp, Homo sapiens
atgcctgagagacatggcttt

SEQ ID NO: 5257489 - DNA, 16 bp, Homo sapiens
atgcctgagtgcctgg

SEQ ID NO: 5257490 - DNA, 19 bp, Homo sapiens
atgcctgagtgcctggcca

SEQ ID NO: 5257491 - DNA, 21 bp, Homo sapiens
atgcctgagttataaatattt

SEQ ID NO: 5257492 - DNA, 15 bp, Homo sapiens
atgcctgcactggga

SEQ ID NO: 5257493 - DNA, 12 bp, Homo sapiens
atgcctgcaggc

SEQ ID NO: 5257494 - DNA, 13 bp, Homo sapiens
atgcctgcaggca

SEQ ID NO: 5257495 - DNA, 19 bp, Homo sapiens
atgcctgcatgctgaaaca

SEQ ID NO: 5257496 - DNA, 20 bp, Homo sapiens
atgcctgcccattagagaag

SEQ ID NO: 5257497 - DNA, 21 bp, Homo sapiens
atgcctgcccattagagaagt

SEQ ID NO: 5257498 - DNA, 22 bp, Homo sapiens
atgcctgcccgcaccctggcct

SEQ ID NO: 5257499 - DNA, 17 bp, Homo sapiens
atgcctgcgcctgctgc

SEQ ID NO: 5257500 - DNA, 19 bp, Homo sapiens
atgcctgcgcctgctgcct

SEQ ID NO: 5257501 - DNA, 23 bp, Homo sapiens
atgcctgcgcctgctgcctgctg

SEQ ID NO: 5257502 - DNA, 14 bp, Homo sapiens
atgcctgctccctg

SEQ ID NO: 5257503 - DNA, 15 bp, Homo sapiens
atgcctgctccctgt

SEQ ID NO: 5257504 - DNA, 17 bp, Homo sapiens
atgcctgctccctgtct

SEQ ID NO: 5257505 - DNA, 21 bp, Homo sapiens
atgcctgctccctgtctgtgt

SEQ ID NO: 5257506 - DNA, 12 bp, Homo sapiens
atgcctgctgag

SEQ ID NO: 5257507 - DNA, 16 bp, Homo sapiens
atgcctgcttgataat

SEQ ID NO: 5257508 - DNA, 15 bp, Homo sapiens
atgcctggagacaga

SEQ ID NO: 5257509 - DNA, 21 bp, Homo sapiens
atgcctggatggggctgcacc

SEQ ID NO: 5257510 - DNA, 23 bp, Homo sapiens
atgcctggatggggctgcaccgg

SEQ ID NO: 5257511 - DNA, 21 bp, Homo sapiens
atgcctggcccccctccaggc

SEQ ID NO: 5257512 - DNA, 17 bp, Homo sapiens
atgcctggcccctcctc

SEQ ID NO: 5257513 - DNA, 23 bp, Homo sapiens
atgcctggcccttgccggggcct

SEQ ID NO: 5257514 - DNA, 15 bp, Homo sapiens
atgcctggcctgcca

SEQ ID NO: 5257515 - DNA, 13 bp, Homo sapiens
atgcctggcttcg

SEQ ID NO: 5257516 - DNA, 21 bp, Homo sapiens
atgcctgggaatcctgctgcc

SEQ ID NO: 5257517 - DNA, 17 bp, Homo sapiens
atgcctgggattgggaa

SEQ ID NO: 5257518 - DNA, 17 bp, Homo sapiens
atgcctgggcagaagga

SEQ ID NO: 5257519 - DNA, 21 bp, Homo sapiens
atgcctgggcccaggcccagc

SEQ ID NO: 5257520 - DNA, 18 bp, Homo sapiens
atgcctgggcctgatggt

SEQ ID NO: 5257521 - DNA, 15 bp, Homo sapiens
atgcctggggtggag

SEQ ID NO: 5257522 - DNA, 17 bp, Homo sapiens
atgcctggggtggaggc

SEQ ID NO: 5257523 - DNA, 18 bp, Homo sapiens
atgcctggtattttcaac

SEQ ID NO: 5257524 - DNA, 12 bp, Homo sapiens
atgcctggtggc

SEQ ID NO: 5257525 - DNA, 19 bp, Homo sapiens
atgcctgtaatcccagaac

SEQ ID NO: 5257526 - DNA, 22 bp, Homo sapiens
atgcctgtagctttcctggtcc

SEQ ID NO: 5257527 - DNA, 19 bp, Homo sapiens
atgcctgtatttccaacaa

SEQ ID NO: 5257528 - DNA, 16 bp, Homo sapiens
atgcctgtccagcctg

SEQ ID NO: 5257529 - DNA, 17 bp, Homo sapiens
atgcctgtcctgaaagc

SEQ ID NO: 5257530 - DNA, 16 bp, Homo sapiens
atgcctgtgaagcagt

SEQ ID NO: 5257531 - DNA, 12 bp, Homo sapiens
atgcctgtgcca

SEQ ID NO: 5257532 - DNA, 23 bp, Homo sapiens
atgcctgtggtgaagtgtggctg

SEQ ID NO: 5257533 - DNA, 13 bp, Homo sapiens
atgcctgttaatt

SEQ ID NO: 5257534 - DNA, 15 bp, Homo sapiens
atgcctgttaattta

SEQ ID NO: 5257535 - DNA, 21 bp, Homo sapiens
atgcctgttaatttataatgt

SEQ ID NO: 5257536 - DNA, 18 bp, Homo sapiens
atgcctgttgatctatgg

SEQ ID NO: 5257537 - DNA, 20 bp, Homo sapiens
atgcctgttgcaggcaaatg

SEQ ID NO: 5257538 - DNA, 18 bp, Homo sapiens
atgcctgttgtatttatg

SEQ ID NO: 5257539 - DNA, 13 bp, Homo sapiens
atgccttaaaatg

SEQ ID NO: 5257540 - DNA, 15 bp, Homo sapiens
atgccttaaaatgga

SEQ ID NO: 5257541 - DNA, 22 bp, Homo sapiens
atgccttaaaatggaattgaaa

SEQ ID NO: 5257542 - DNA, 15 bp, Homo sapiens
atgccttaagcagaa

SEQ ID NO: 5257543 - DNA, 17 bp, Homo sapiens
atgccttaatttagaaa

SEQ ID NO: 5257544 - DNA, 16 bp, Homo sapiens
atgccttactcttctt

SEQ ID NO: 5257545 - DNA, 15 bp, Homo sapiens
atgccttactttgta

SEQ ID NO: 5257546 - DNA, 22 bp, Homo sapiens
atgccttatatttgtccaacaa

SEQ ID NO: 5257547 - DNA, 16 bp, Homo sapiens
atgccttatctcttct

SEQ ID NO: 5257548 - DNA, 13 bp, Homo sapiens
atgccttattttt

SEQ ID NO: 5257549 - DNA, 13 bp, Homo sapiens
atgccttcaaata

SEQ ID NO: 5257550 - DNA, 22 bp, Homo sapiens
atgccttcaaatagtatagaaa

SEQ ID NO: 5257551 - DNA, 21 bp, Homo sapiens
atgccttcataaattatttct

SEQ ID NO: 5257552 - DNA, 19 bp, Homo sapiens
atgccttccgacaccactg

SEQ ID NO: 5257553 - DNA, 20 bp, Homo sapiens
atgccttccgacaccactgg

SEQ ID NO: 5257554 - DNA, 17 bp, Homo sapiens
atgccttcgggaaaatt

SEQ ID NO: 5257555 - DNA, 19 bp, Homo sapiens
atgccttcgggaaaattca

SEQ ID NO: 5257556 - DNA, 18 bp, Homo sapiens
atgccttctatacattag

SEQ ID NO: 5257557 - DNA, 15 bp, Homo sapiens
atgccttctgtattt

SEQ ID NO: 5257558 - DNA, 19 bp, Homo sapiens
atgccttctgttttccaaa

SEQ ID NO: 5257559 - DNA, 14 bp, Homo sapiens
atgccttcttattg

SEQ ID NO: 5257560 - DNA, 15 bp, Homo sapiens
atgccttgaataata

SEQ ID NO: 5257561 - DNA, 19 bp, Homo sapiens
atgccttgacaacagactg

SEQ ID NO: 5257562 - DNA, 18 bp, Homo sapiens
atgccttgataaatatat

SEQ ID NO: 5257563 - DNA, 20 bp, Homo sapiens
atgccttggaggaaatgtgc

SEQ ID NO: 5257564 - DNA, 22 bp, Homo sapiens
atgccttggaggaaatgtgctc

SEQ ID NO: 5257565 - DNA, 16 bp, Homo sapiens
atgccttggtgccggt

SEQ ID NO: 5257566 - DNA, 18 bp, Homo sapiens
atgccttggtgccggtca

SEQ ID NO: 5257567 - DNA, 14 bp, Homo sapiens
atgccttgtataaa

SEQ ID NO: 5257568 - DNA, 21 bp, Homo sapiens
atgccttgtataatattgaaa

SEQ ID NO: 5257569 - DNA, 16 bp, Homo sapiens
atgccttgtctgggga

SEQ ID NO: 5257570 - DNA, 18 bp, Homo sapiens
atgccttgtttcatattt

SEQ ID NO: 5257571 - DNA, 22 bp, Homo sapiens
atgcctttaaagtatgaatcta

SEQ ID NO: 5257572 - DNA, 20 bp, Homo sapiens
atgcctttaaatctgtgatg

SEQ ID NO: 5257573 - DNA, 21 bp, Homo sapiens
atgcctttaaatctgtgatga

SEQ ID NO: 5257574 - DNA, 17 bp, Homo sapiens
atgcctttatatactta

SEQ ID NO: 5257575 - DNA, 19 bp, Homo sapiens
atgcctttcatagtttatt

SEQ ID NO: 5257576 - DNA, 20 bp, Homo sapiens
atgcctttcatagtttatta

SEQ ID NO: 5257577 - DNA, 14 bp, Homo sapiens
atgcctttcatctt

SEQ ID NO: 5257578 - DNA, 17 bp, Homo sapiens
atgcctttcatcttgaa

SEQ ID NO: 5257579 - DNA, 12 bp, Homo sapiens
atgcctttctct

SEQ ID NO: 5257580 - DNA, 12 bp, Homo sapiens
atgcctttgaga

SEQ ID NO: 5257581 - DNA, 13 bp, Homo sapiens
atgcctttgctgt

SEQ ID NO: 5257582 - DNA, 14 bp, Homo sapiens
atgcctttgctgtt

SEQ ID NO: 5257583 - DNA, 17 bp, Homo sapiens
atgcctttgctgtttag

SEQ ID NO: 5257584 - DNA, 20 bp, Homo sapiens
atgccttttaccatgaattc

SEQ ID NO: 5257585 - DNA, 22 bp, Homo sapiens
atgccttttgaatacatttgta

SEQ ID NO: 5257586 - DNA, 23 bp, Homo sapiens
atgccttttgaatacatttgtat

SEQ ID NO: 5257587 - DNA, 13 bp, Homo sapiens
atgccttttgtag

SEQ ID NO: 5257588 - DNA, 17 bp, Homo sapiens
atgcctttttggttttg

SEQ ID NO: 5257589 - DNA, 16 bp, Homo sapiens
atgcctttttgtttac

SEQ ID NO: 5257590 - DNA, 16 bp, Homo sapiens
atgccttttttgtagt

SEQ ID NO: 5257591 - DNA, 19 bp, Homo sapiens
atgcctttttttctctgca

SEQ ID NO: 5257592 - DNA, 20 bp, Homo sapiens
atgcgaaaacttgaatctgt

SEQ ID NO: 5257593 - DNA, 14 bp, Homo sapiens
atgcgagactctga

SEQ ID NO: 5257594 - DNA, 15 bp, Homo sapiens
atgcgagactctgat

SEQ ID NO: 5257595 - DNA, 15 bp, Homo sapiens
atgcgagcttggcct

SEQ ID NO: 5257596 - DNA, 19 bp, Homo sapiens
atgcgaggctcggagcacc

SEQ ID NO: 5257597 - DNA, 21 bp, Homo sapiens
atgcgaggctcggagcaccct

SEQ ID NO: 5257598 - DNA, 19 bp, Homo sapiens
atgcgaggggccagcagag

SEQ ID NO: 5257599 - DNA, 19 bp, Homo sapiens
atgcgagtgctcatttcag

SEQ ID NO: 5257600 - DNA, 14 bp, Homo sapiens
atgcgatgtcatat

SEQ ID NO: 5257601 - DNA, 16 bp, Homo sapiens
atgcgatgtcatattt

SEQ ID NO: 5257602 - DNA, 14 bp, Homo sapiens
atgcgatttcttcc

SEQ ID NO: 5257603 - DNA, 19 bp, Homo sapiens
atgcgattttattactggc

SEQ ID NO: 5257604 - DNA, 17 bp, Homo sapiens
atgcgcaaaactgcctg

SEQ ID NO: 5257605 - DNA, 15 bp, Homo sapiens
atgcgcagatgaggg

SEQ ID NO: 5257606 - DNA, 22 bp, Homo sapiens
atgcgcagatgaggggccactg

SEQ ID NO: 5257607 - DNA, 23 bp, Homo sapiens
atgcgcagccccatctgtgcatt

SEQ ID NO: 5257608 - DNA, 14 bp, Homo sapiens
atgcgcagtgcctt

SEQ ID NO: 5257609 - DNA, 15 bp, Homo sapiens
atgcgcagttgctgt

SEQ ID NO: 5257610 - DNA, 16 bp, Homo sapiens
atgcgcattctaacct

SEQ ID NO: 5257611 - DNA, 18 bp, Homo sapiens
atgcgccaataaaccaat

SEQ ID NO: 5257612 - DNA, 13 bp, Homo sapiens
atgcgccccctcc

SEQ ID NO: 5257613 - DNA, 18 bp, Homo sapiens
atgcgccccctccgccct

SEQ ID NO: 5257614 - DNA, 21 bp, Homo sapiens
atgcgctcttcaccaggaaga

SEQ ID NO: 5257615 - DNA, 13 bp, Homo sapiens
atgcgctgctcaa

SEQ ID NO: 5257616 - DNA, 21 bp, Homo sapiens
atgcgctgctcaacctctctc

SEQ ID NO: 5257617 - DNA, 13 bp, Homo sapiens
atgcgcttcaaag

SEQ ID NO: 5257618 - DNA, 17 bp, Homo sapiens
atgcggatcctgctggg

SEQ ID NO: 5257619 - DNA, 18 bp, Homo sapiens
atgcggcaagaaggaatt

SEQ ID NO: 5257620 - DNA, 21 bp, Homo sapiens
atgcggcccactttcctgagc

SEQ ID NO: 5257621 - DNA, 23 bp, Homo sapiens
atgcggcccactttcctgagctg

SEQ ID NO: 5257622 - DNA, 14 bp, Homo sapiens
atgcggcccagccc

SEQ ID NO: 5257623 - DNA, 15 bp, Homo sapiens
atgcgggcattttga

SEQ ID NO: 5257624 - DNA, 15 bp, Homo sapiens
atgcgggctcgccca

SEQ ID NO: 5257625 - DNA, 19 bp, Homo sapiens
atgcgggctgggcagctgt

SEQ ID NO: 5257626 - DNA, 19 bp, Homo sapiens
atgcgggggagcaggcagt

SEQ ID NO: 5257627 - DNA, 14 bp, Homo sapiens
atgcggtagccagc

SEQ ID NO: 5257628 - DNA, 20 bp, Homo sapiens
atgcggtagccagcacacag

SEQ ID NO: 5257629 - DNA, 18 bp, Homo sapiens
atgcggtgggtgctgcca

SEQ ID NO: 5257630 - DNA, 21 bp, Homo sapiens
atgcggttataaaaaatggtt

SEQ ID NO: 5257631 - DNA, 19 bp, Homo sapiens
atgcggttgggaggcaggt

SEQ ID NO: 5257632 - DNA, 20 bp, Homo sapiens
atgcggtttccaaggtgcac

SEQ ID NO: 5257633 - DNA, 21 bp, Homo sapiens
atgcggtttccaaggtgcaca

SEQ ID NO: 5257634 - DNA, 16 bp, Homo sapiens
atgcgtaaacgacact

SEQ ID NO: 5257635 - DNA, 13 bp, Homo sapiens
atgcgtatatgtg

SEQ ID NO: 5257636 - DNA, 21 bp, Homo sapiens
atgcgtattataccaaaatgt

SEQ ID NO: 5257637 - DNA, 13 bp, Homo sapiens
atgcgtcccaaga

SEQ ID NO: 5257638 - DNA, 23 bp, Homo sapiens
atgcgtcttgtgaaattgtgtag

SEQ ID NO: 5257639 - DNA, 18 bp, Homo sapiens
atgcgtctttttcacaat

SEQ ID NO: 5257640 - DNA, 22 bp, Homo sapiens
atgcgtgcagttcctgctgcct

SEQ ID NO: 5257641 - DNA, 22 bp, Homo sapiens
atgcgtgcataccacttttgtt

SEQ ID NO: 5257642 - DNA, 21 bp, Homo sapiens
atgcgtgccgcctgctcctca

SEQ ID NO: 5257643 - DNA, 24 bp, Homo sapiens
atgcgtgccgcctgctcctcactg

SEQ ID NO: 5257644 - DNA, 22 bp, Homo sapiens
atgcgtggccacgggggcagtg

SEQ ID NO: 5257645 - DNA, 17 bp, Homo sapiens
atgcgtggctcccagca

SEQ ID NO: 5257646 - DNA, 14 bp, Homo sapiens
atgcgtgggaggca

SEQ ID NO: 5257647 - DNA, 15 bp, Homo sapiens
atgcgtgggaggcag

SEQ ID NO: 5257648 - DNA, 16 bp, Homo sapiens
atgcgtgggcagagga

SEQ ID NO: 5257649 - DNA, 14 bp, Homo sapiens
atgcgtgtgtttgg

SEQ ID NO: 5257650 - DNA, 22 bp, Homo sapiens
atgcgtgtgtttggtttcccat

SEQ ID NO: 5257651 - DNA, 16 bp, Homo sapiens
atgcgtgtttctgact

SEQ ID NO: 5257652 - DNA, 14 bp, Homo sapiens
atgctaaaattcta

SEQ ID NO: 5257653 - DNA, 20 bp, Homo sapiens
atgctaaactgtgaaaaatc

SEQ ID NO: 5257654 - DNA, 20 bp, Homo sapiens
atgctaaagatgatgatgtt

SEQ ID NO: 5257655 - DNA, 12 bp, Homo sapiens
atgctaaataac

SEQ ID NO: 5257656 - DNA, 13 bp, Homo sapiens
atgctaaataact

SEQ ID NO: 5257657 - DNA, 15 bp, Homo sapiens
atgctaaataactat

SEQ ID NO: 5257658 - DNA, 21 bp, Homo sapiens
atctccctgaccttctccagg

SEQ ID NO: 5257659 - DNA, 12 bp, Homo sapiens
atctccctgccg

SEQ ID NO: 5257660 - DNA, 15 bp, Homo sapiens
atctccctgccgcct

SEQ ID NO: 5257661 - DNA, 17 bp, Homo sapiens
atctccctgcctggccc

SEQ ID NO: 5257662 - DNA, 14 bp, Homo sapiens
atctccctgctttg

SEQ ID NO: 5257663 - DNA, 14 bp, Homo sapiens
atctccctggagaa

SEQ ID NO: 5257664 - DNA, 18 bp, Homo sapiens
atctccctggctcactgg

SEQ ID NO: 5257665 - DNA, 18 bp, Homo sapiens
atctccctggtgcttatg

SEQ ID NO: 5257666 - DNA, 23 bp, Homo sapiens
atctccctggtgcttatgctctt

SEQ ID NO: 5257667 - DNA, 19 bp, Homo sapiens
atctcccttagaagagagc

SEQ ID NO: 5257668 - DNA, 17 bp, Homo sapiens
atctcccttcagcaact

SEQ ID NO: 5257669 - DNA, 19 bp, Homo sapiens
atctcccttccacctcaca

SEQ ID NO: 5257670 - DNA, 19 bp, Homo sapiens
atctccgcatcgcatcctc

SEQ ID NO: 5257671 - DNA, 14 bp, Homo sapiens
atctccggctccca

SEQ ID NO: 5257672 - DNA, 16 bp, Homo sapiens
atctccggctcccagc

SEQ ID NO: 5257673 - DNA, 18 bp, Homo sapiens
atctccggctcccagcct

SEQ ID NO: 5257674 - DNA, 15 bp, Homo sapiens
atctccgtggctttg

SEQ ID NO: 5257675 - DNA, 21 bp, Homo sapiens
atctccgttccatctgggctt

SEQ ID NO: 5257676 - DNA, 14 bp, Homo sapiens
atctcctaacaaaa

SEQ ID NO: 5257677 - DNA, 15 bp, Homo sapiens
atctcctaacaaaag

SEQ ID NO: 5257678 - DNA, 21 bp, Homo sapiens
atctcctataatctgtcaaaa

SEQ ID NO: 5257679 - DNA, 14 bp, Homo sapiens
atctcctatctttt

SEQ ID NO: 5257680 - DNA, 18 bp, Homo sapiens
atctcctatttttttaaa

SEQ ID NO: 5257681 - DNA, 20 bp, Homo sapiens
atctcctcaccccagtgcct

SEQ ID NO: 5257682 - DNA, 18 bp, Homo sapiens
atctcctccaatgtcctg

SEQ ID NO: 5257683 - DNA, 19 bp, Homo sapiens
atctcctccaatgtcctga

SEQ ID NO: 5257684 - DNA, 12 bp, Homo sapiens
atctcctcccac

SEQ ID NO: 5257685 - DNA, 17 bp, Homo sapiens
atctcctcccatggcct

SEQ ID NO: 5257686 - DNA, 23 bp, Homo sapiens
atctcctcccttaccctcctctg

SEQ ID NO: 5257687 - DNA, 13 bp, Homo sapiens
atctcctctcccc

SEQ ID NO: 5257688 - DNA, 14 bp, Homo sapiens
atctcctctcccca

SEQ ID NO: 5257689 - DNA, 14 bp, Homo sapiens
atctcctctgctca

SEQ ID NO: 5257690 - DNA, 18 bp, Homo sapiens
atctcctctttgtgaaat

SEQ ID NO: 5257691 - DNA, 21 bp, Homo sapiens
atctcctgaccctcccactcc

SEQ ID NO: 5257692 - DNA, 16 bp, Homo sapiens
atctcctgacctcgtg

SEQ ID NO: 5257693 - DNA, 16 bp, Homo sapiens
atctcctgccagccca

SEQ ID NO: 5257694 - DNA, 19 bp, Homo sapiens
atctcctgccagcccagct

SEQ ID NO: 5257695 - DNA, 13 bp, Homo sapiens
atctcctgctcac

SEQ ID NO: 5257696 - DNA, 23 bp, Homo sapiens
atctcctgctcaccacctgcctc

SEQ ID NO: 5257697 - DNA, 12 bp, Homo sapiens
atctcctgctct

SEQ ID NO: 5257698 - DNA, 21 bp, Homo sapiens
atctcctggtagcatgacctt

SEQ ID NO: 5257699 - DNA, 22 bp, Homo sapiens
atctcctgtcctgggccaggga

SEQ ID NO: 5257700 - DNA, 18 bp, Homo sapiens
atctcctgtgcatgggtg

SEQ ID NO: 5257701 - DNA, 19 bp, Homo sapiens
atctccttacctctggaac

SEQ ID NO: 5257702 - DNA, 18 bp, Homo sapiens
atctccttactgtgtttc

SEQ ID NO: 5257703 - DNA, 16 bp, Homo sapiens
atctccttagaaaagc

SEQ ID NO: 5257704 - DNA, 16 bp, Homo sapiens
atctccttcagaagtt

SEQ ID NO: 5257705 - DNA, 13 bp, Homo sapiens
atctccttcccac

SEQ ID NO: 5257706 - DNA, 20 bp, Homo sapiens
atctccttcccacccctaca

SEQ ID NO: 5257707 - DNA, 13 bp, Homo sapiens
atctccttccccc

SEQ ID NO: 5257708 - DNA, 14 bp, Homo sapiens
atctccttccccca

SEQ ID NO: 5257709 - DNA, 20 bp, Homo sapiens
atctccttcccccagcccaa

SEQ ID NO: 5257710 - DNA, 16 bp, Homo sapiens
atctccttcccttctc

SEQ ID NO: 5257711 - DNA, 19 bp, Homo sapiens
atctccttgattacataat

SEQ ID NO: 5257712 - DNA, 17 bp, Homo sapiens
atctccttgtggcctat

SEQ ID NO: 5257713 - DNA, 15 bp, Homo sapiens
atctcctttgaagaa

SEQ ID NO: 5257714 - DNA, 19 bp, Homo sapiens
atctcctttgaagaaggca

SEQ ID NO: 5257715 - DNA, 18 bp, Homo sapiens
atctcctttgcagaatga

SEQ ID NO: 5257716 - DNA, 18 bp, Homo sapiens
atctcctttgtattctgt

SEQ ID NO: 5257717 - DNA, 17 bp, Homo sapiens
atctcgaagtcttccat

SEQ ID NO: 5257718 - DNA, 19 bp, Homo sapiens
atctcgaatttgaagagat

SEQ ID NO: 5257719 - DNA, 15 bp, Homo sapiens
atctcgactcccccc

SEQ ID NO: 5257720 - DNA, 22 bp, Homo sapiens
atctcgattaataacctgccag

SEQ ID NO: 5257721 - DNA, 20 bp, Homo sapiens
atctcgccacccctccttcc

SEQ ID NO: 5257722 - DNA, 14 bp, Homo sapiens
atctcgcctggaaa

SEQ ID NO: 5257723 - DNA, 20 bp, Homo sapiens
atctcgcctggaaacagagg

SEQ ID NO: 5257724 - DNA, 20 bp, Homo sapiens
atctcggcccgctgcagcct

SEQ ID NO: 5257725 - DNA, 14 bp, Homo sapiens
atctcggctcactg

SEQ ID NO: 5257726 - DNA, 16 bp, Homo sapiens
atctcggctcactgca

SEQ ID NO: 5257727 - DNA, 15 bp, Homo sapiens
atctcggctcagtgc

SEQ ID NO: 5257728 - DNA, 18 bp, Homo sapiens
atctcgggagtcctctag

SEQ ID NO: 5257729 - DNA, 15 bp, Homo sapiens
atctcgtaatagctt

SEQ ID NO: 5257730 - DNA, 19 bp, Homo sapiens
atctcgtaatagcttctgt

SEQ ID NO: 5257731 - DNA, 20 bp, Homo sapiens
atctcgtaatagcttctgtg

SEQ ID NO: 5257732 - DNA, 17 bp, Homo sapiens
atctcgtcaggctgcca

SEQ ID NO: 5257733 - DNA, 18 bp, Homo sapiens
atctcgtcaggctgccag

SEQ ID NO: 5257734 - DNA, 13 bp, Homo sapiens
atctcgttcccaa

SEQ ID NO: 5257735 - DNA, 16 bp, Homo sapiens
atctcgttgaggccaa

SEQ ID NO: 5257736 - DNA, 18 bp, Homo sapiens
atctcgtttagtgccaat

SEQ ID NO: 5257737 - DNA, 16 bp, Homo sapiens
atctctaaaattctag

SEQ ID NO: 5257738 - DNA, 20 bp, Homo sapiens
atctctaacagctcaggatc

SEQ ID NO: 5257739 - DNA, 15 bp, Homo sapiens
atctctaataaaaac

SEQ ID NO: 5257740 - DNA, 13 bp, Homo sapiens
atctctaatatgg

SEQ ID NO: 5257741 - DNA, 22 bp, Homo sapiens
atctctaatatggcaaaaatgg

SEQ ID NO: 5257742 - DNA, 17 bp, Homo sapiens
atctctaatgagctagt

SEQ ID NO: 5257743 - DNA, 21 bp, Homo sapiens
atctctaatgagctagtgtct

SEQ ID NO: 5257744 - DNA, 17 bp, Homo sapiens
atctctaattagtctat

SEQ ID NO: 5257745 - DNA, 23 bp, Homo sapiens
atctctaattggaagaaattcct

SEQ ID NO: 5257746 - DNA, 17 bp, Homo sapiens
atctctaccttctcccc

SEQ ID NO: 5257747 - DNA, 20 bp, Homo sapiens
atctctaccttctccccagc

SEQ ID NO: 5257748 - DNA, 20 bp, Homo sapiens
atctctacgactaatcacct

SEQ ID NO: 5257749 - DNA, 20 bp, Homo sapiens
atctctactaaaaatacaaa

SEQ ID NO: 5257750 - DNA, 13 bp, Homo sapiens
atctctatactgc

SEQ ID NO: 5257751 - DNA, 17 bp, Homo sapiens
atctctatataaaaaat

SEQ ID NO: 5257752 - DNA, 22 bp, Homo sapiens
atctctatcagaaatacaaaaa

SEQ ID NO: 5257753 - DNA, 21 bp, Homo sapiens
atctctatgccctgttaaatg

SEQ ID NO: 5257754 - DNA, 22 bp, Homo sapiens
atctctatgtggatctaaataa

SEQ ID NO: 5257755 - DNA, 14 bp, Homo sapiens
atctctatttaata

SEQ ID NO: 5257756 - DNA, 17 bp, Homo sapiens
atctctatttgagaagt

SEQ ID NO: 5257757 - DNA, 15 bp, Homo sapiens
atctctcaaaacttg

SEQ ID NO: 5257758 - DNA, 14 bp, Homo sapiens
atctctcaaaatgt

SEQ ID NO: 5257759 - DNA, 16 bp, Homo sapiens
atctctcaaaatgtgc

SEQ ID NO: 5257760 - DNA, 14 bp, Homo sapiens
atctctcaaactta

SEQ ID NO: 5257761 - DNA, 14 bp, Homo sapiens
atctctcaaatctg

SEQ ID NO: 5257762 - DNA, 17 bp, Homo sapiens
atctctcaagagtgctg

SEQ ID NO: 5257763 - DNA, 22 bp, Homo sapiens
atctctcaggagcacaggcagc

SEQ ID NO: 5257764 - DNA, 16 bp, Homo sapiens
atctctcatcctccag

SEQ ID NO: 5257765 - DNA, 21 bp, Homo sapiens
atctctcatcctccagtacct

SEQ ID NO: 5257766 - DNA, 17 bp, Homo sapiens
atctctccacctctagt

SEQ ID NO: 5257767 - DNA, 17 bp, Homo sapiens
atctctccaccttccaa

SEQ ID NO: 5257768 - DNA, 21 bp, Homo sapiens
atctctccactttcagctgtc

SEQ ID NO: 5257769 - DNA, 22 bp, Homo sapiens
atctctccagctaattcaggtc

SEQ ID NO: 5257770 - DNA, 15 bp, Homo sapiens
atctctcccacttcc

SEQ ID NO: 5257771 - DNA, 17 bp, Homo sapiens
atctctccccaatgctc

SEQ ID NO: 5257772 - DNA, 17 bp, Homo sapiens
atctctccccatatata

SEQ ID NO: 5257773 - DNA, 18 bp, Homo sapiens
atctctccccatatataa

SEQ ID NO: 5257774 - DNA, 20 bp, Homo sapiens
atctctccccatatataaat

SEQ ID NO: 5257775 - DNA, 19 bp, Homo sapiens
atctctcccttctttacct

SEQ ID NO: 5257776 - DNA, 13 bp, Homo sapiens
atctctcctgctc

SEQ ID NO: 5257777 - DNA, 14 bp, Homo sapiens
atctctcctggcct

SEQ ID NO: 5257778 - DNA, 19 bp, Homo sapiens
atctctcggttccacgtcc

SEQ ID NO: 5257779 - DNA, 17 bp, Homo sapiens
atctctctacctccacc

SEQ ID NO: 5257780 - DNA, 19 bp, Homo sapiens
atctctctactgctggact

SEQ ID NO: 5257781 - DNA, 17 bp, Homo sapiens
atctctctagctttgtc

SEQ ID NO: 5257782 - DNA, 13 bp, Homo sapiens
atctctctccctt

SEQ ID NO: 5257783 - DNA, 20 bp, Homo sapiens
atctctctctgtgtctttct

SEQ ID NO: 5257784 - DNA, 17 bp, Homo sapiens
atctctctctgttgtgt

SEQ ID NO: 5257785 - DNA, 21 bp, Homo sapiens
atctctctctgttgtgttcgt

SEQ ID NO: 5257786 - DNA, 15 bp, Homo sapiens
atctctctgcagctg

SEQ ID NO: 5257787 - DNA, 17 bp, Homo sapiens
atctctctgcagctgcc

SEQ ID NO: 5257788 - DNA, 14 bp, Homo sapiens
atctctctgcccaa

SEQ ID NO: 5257789 - DNA, 23 bp, Homo sapiens
atctctctgccctctccctgtgt

SEQ ID NO: 5257790 - DNA, 13 bp, Homo sapiens
atctctctggccc

SEQ ID NO: 5257791 - DNA, 13 bp, Homo sapiens
atctctctggctt

SEQ ID NO: 5257792 - DNA, 16 bp, Homo sapiens
atctctctggcttctg

SEQ ID NO: 5257793 - DNA, 13 bp, Homo sapiens
atctctctggggc

SEQ ID NO: 5257794 - DNA, 14 bp, Homo sapiens
atctctctgtcttt

SEQ ID NO: 5257795 - DNA, 11 bp, Homo sapiens
atctctcttcc

SEQ ID NO: 5257796 - DNA, 15 bp, Homo sapiens
atctctcttcttttc

SEQ ID NO: 5257797 - DNA, 22 bp, Homo sapiens
atctctcttgggccaagccagc

SEQ ID NO: 5257798 - DNA, 23 bp, Homo sapiens
atctctcttgggccaagccagct

SEQ ID NO: 5257799 - DNA, 17 bp, Homo sapiens
atctctcttgtcctctt

SEQ ID NO: 5257800 - DNA, 18 bp, Homo sapiens
atctctgaaaattctgga

SEQ ID NO: 5257801 - DNA, 22 bp, Homo sapiens
atctctgaactggtagaaaaac

SEQ ID NO: 5257802 - DNA, 16 bp, Homo sapiens
atctctgaacttcagc

SEQ ID NO: 5257803 - DNA, 19 bp, Homo sapiens
atctctgaagcatgtttca

SEQ ID NO: 5257804 - DNA, 20 bp, Homo sapiens
atctctgaagcatgtttcat

SEQ ID NO: 5257805 - DNA, 19 bp, Homo sapiens
atctctgaagccacaaata

SEQ ID NO: 5257806 - DNA, 16 bp, Homo sapiens
atctctgaatgcccca

SEQ ID NO: 5257807 - DNA, 17 bp, Homo sapiens
atctctgacctctgctg

SEQ ID NO: 5257808 - DNA, 18 bp, Homo sapiens
atctctgacctctgctga

SEQ ID NO: 5257809 - DNA, 20 bp, Homo sapiens
atctctgacctctgctgagt

SEQ ID NO: 5257810 - DNA, 22 bp, Homo sapiens
atctctgacctctgctgagtgc

SEQ ID NO: 5257811 - DNA, 14 bp, Homo sapiens
atctctgactaaaa

SEQ ID NO: 5257812 - DNA, 11 bp, Homo sapiens
atctctgagac

SEQ ID NO: 5257813 - DNA, 13 bp, Homo sapiens
atctctgagtgtc

SEQ ID NO: 5257814 - DNA, 19 bp, Homo sapiens
atctctgagtgtctctgcc

SEQ ID NO: 5257815 - DNA, 22 bp, Homo sapiens
atctctgagtgtctctgcctgg

SEQ ID NO: 5257816 - DNA, 13 bp, Homo sapiens
atctctgattaca

SEQ ID NO: 5257817 - DNA, 20 bp, Homo sapiens
atctctgccaacatgaggac

SEQ ID NO: 5257818 - DNA, 15 bp, Homo sapiens
atctctgccgtctct

SEQ ID NO: 5257819 - DNA, 15 bp, Homo sapiens
atctctgcctgacaa

SEQ ID NO: 5257820 - DNA, 21 bp, Homo sapiens
atctctgctccctgcaagctc

SEQ ID NO: 5257821 - DNA, 22 bp, Homo sapiens
atctctgctctctatgtatgta

SEQ ID NO: 5257822 - DNA, 14 bp, Homo sapiens
atctctgctgcttc

SEQ ID NO: 5257823 - DNA, 17 bp, Homo sapiens
atctctgctgcttctgg

SEQ ID NO: 5257824 - DNA, 21 bp, Homo sapiens
atctctgctgcttctgggcct

SEQ ID NO: 5257825 - DNA, 21 bp, Homo sapiens
atctctgctttgtttccttct

SEQ ID NO: 5257826 - DNA, 17 bp, Homo sapiens
atctctggaaaaataag

SEQ ID NO: 5257827 - DNA, 19 bp, Homo sapiens
atctctggaaggggcagcc

SEQ ID NO: 5257828 - DNA, 20 bp, Homo sapiens
atctctggaaggggcagccc

SEQ ID NO: 5257829 - DNA, 12 bp, Homo sapiens
atctctggagcc

SEQ ID NO: 5257830 - DNA, 21 bp, Homo sapiens
atctctgggggctgaggagca

SEQ ID NO: 5257831 - DNA, 22 bp, Homo sapiens
atctctggtgcctaaaaaccca

SEQ ID NO: 5257832 - DNA, 22 bp, Homo sapiens
atctctggttgacgggctgtcc

SEQ ID NO: 5257833 - DNA, 18 bp, Homo sapiens
atctctggttttcttgcc

SEQ ID NO: 5257834 - DNA, 19 bp, Homo sapiens
atctctgtaaaccacttgt

SEQ ID NO: 5257835 - DNA, 17 bp, Homo sapiens
atctctgtaaagctaaa

SEQ ID NO: 5257836 - DNA, 18 bp, Homo sapiens
atctctgtaaagctaaaa

SEQ ID NO: 5257837 - DNA, 16 bp, Homo sapiens
atgctaaataactata

SEQ ID NO: 5257838 - DNA, 13 bp, Homo sapiens
atgctaaatgtta

SEQ ID NO: 5257839 - DNA, 17 bp, Homo sapiens
atgctaacatctaaaaa

SEQ ID NO: 5257840 - DNA, 19 bp, Homo sapiens
atgctaacctctctgaact

SEQ ID NO: 5257841 - DNA, 21 bp, Homo sapiens
atgctaagaatgcattattga

SEQ ID NO: 5257842 - DNA, 16 bp, Homo sapiens
atgctaagaatttttt

SEQ ID NO: 5257843 - DNA, 18 bp, Homo sapiens
atgctaagccagttctta

SEQ ID NO: 5257844 - DNA, 13 bp, Homo sapiens
atgctaagctgat

SEQ ID NO: 5257845 - DNA, 14 bp, Homo sapiens
atgctaataaactg

SEQ ID NO: 5257846 - DNA, 15 bp, Homo sapiens
atgctaataaactgt

SEQ ID NO: 5257847 - DNA, 14 bp, Homo sapiens
atgctaatagaaaa

SEQ ID NO: 5257848 - DNA, 17 bp, Homo sapiens
atgctaatagaaaactg

SEQ ID NO: 5257849 - DNA, 18 bp, Homo sapiens
atgctaatagaaaactgt

SEQ ID NO: 5257850 - DNA, 19 bp, Homo sapiens
atgctaatattaaaagtca

SEQ ID NO: 5257851 - DNA, 17 bp, Homo sapiens
atgctaatcttgtgaaa

SEQ ID NO: 5257852 - DNA, 16 bp, Homo sapiens
atgctaattcaatgcc

SEQ ID NO: 5257853 - DNA, 12 bp, Homo sapiens
atgctaatttat

SEQ ID NO: 5257854 - DNA, 14 bp, Homo sapiens
atgctaattttatt

SEQ ID NO: 5257855 - DNA, 21 bp, Homo sapiens
atgctaatttttggagaaatg

SEQ ID NO: 5257856 - DNA, 18 bp, Homo sapiens
atgctacaaaatgtgtgc

SEQ ID NO: 5257857 - DNA, 16 bp, Homo sapiens
atgctacaatggaaac

SEQ ID NO: 5257858 - DNA, 17 bp, Homo sapiens
atgctacacactgcatg

SEQ ID NO: 5257859 - DNA, 21 bp, Homo sapiens
atgctacacatatgtgcttct

SEQ ID NO: 5257860 - DNA, 20 bp, Homo sapiens
atgctacagtactatgtaaa

SEQ ID NO: 5257861 - DNA, 12 bp, Homo sapiens
atgctacagtta

SEQ ID NO: 5257862 - DNA, 16 bp, Homo sapiens
atgctaccaccagctg

SEQ ID NO: 5257863 - DNA, 16 bp, Homo sapiens
atgctaccaggatgct

SEQ ID NO: 5257864 - DNA, 23 bp, Homo sapiens
atgctaccaggatgctaaagatg

SEQ ID NO: 5257865 - DNA, 16 bp, Homo sapiens
atgctacccagccatt

SEQ ID NO: 5257866 - DNA, 19 bp, Homo sapiens
atgctaccccactatgaca

SEQ ID NO: 5257867 - DNA, 20 bp, Homo sapiens
atgctacctctgatcaaagc

SEQ ID NO: 5257868 - DNA, 14 bp, Homo sapiens
atgctacgtgtgat

SEQ ID NO: 5257869 - DNA, 16 bp, Homo sapiens
atgctacgtgtgattt

SEQ ID NO: 5257870 - DNA, 22 bp, Homo sapiens
atgctacgtgtgatttttctgg

SEQ ID NO: 5257871 - DNA, 16 bp, Homo sapiens
atgctactcagtatat

SEQ ID NO: 5257872 - DNA, 18 bp, Homo sapiens
atgctactgaactgaaag

SEQ ID NO: 5257873 - DNA, 23 bp, Homo sapiens
atgctactgtctcactgaaacat

SEQ ID NO: 5257874 - DNA, 12 bp, Homo sapiens
atgctactttta

SEQ ID NO: 5257875 - DNA, 15 bp, Homo sapiens
atgctagaactccct

SEQ ID NO: 5257876 - DNA, 16 bp, Homo sapiens
atgctagaactccctt

SEQ ID NO: 5257877 - DNA, 20 bp, Homo sapiens
atgctagaactccctttcaa

SEQ ID NO: 5257878 - DNA, 21 bp, Homo sapiens
atgctagaactccctttcaac

SEQ ID NO: 5257879 - DNA, 14 bp, Homo sapiens
atgctagagcctct

SEQ ID NO: 5257880 - DNA, 19 bp, Homo sapiens
atgctagaggcttttatta

SEQ ID NO: 5257881 - DNA, 23 bp, Homo sapiens
atgctagaggcttttattagaaa

SEQ ID NO: 5257882 - DNA, 13 bp, Homo sapiens
atgctagccccag

SEQ ID NO: 5257883 - DNA, 16 bp, Homo sapiens
atgctagccccagaga

SEQ ID NO: 5257884 - DNA, 20 bp, Homo sapiens
atgctagcctcacgaaactg

SEQ ID NO: 5257885 - DNA, 13 bp, Homo sapiens
atgctaggttcta

SEQ ID NO: 5257886 - DNA, 14 bp, Homo sapiens
atgctaggttctac

SEQ ID NO: 5257887 - DNA, 13 bp, Homo sapiens
atgctataaattt

SEQ ID NO: 5257888 - DNA, 18 bp, Homo sapiens
atgctatcaaataactaa

SEQ ID NO: 5257889 - DNA, 22 bp, Homo sapiens
atgctatgagaccattcagaat

SEQ ID NO: 5257890 - DNA, 16 bp, Homo sapiens
atgctatgagttttct

SEQ ID NO: 5257891 - DNA, 20 bp, Homo sapiens
atgctatgagttttctcctt

SEQ ID NO: 5257892 - DNA, 18 bp, Homo sapiens
atgctatgctgaagacat

SEQ ID NO: 5257893 - DNA, 19 bp, Homo sapiens
atgctatggaaatacattt

SEQ ID NO: 5257894 - DNA, 20 bp, Homo sapiens
atgctatggaaatacattta

SEQ ID NO: 5257895 - DNA, 22 bp, Homo sapiens
atgctatggaacataaagttgt

SEQ ID NO: 5257896 - DNA, 13 bp, Homo sapiens
atgctatggactg

SEQ ID NO: 5257897 - DNA, 13 bp, Homo sapiens
atgctattaaagt

SEQ ID NO: 5257898 - DNA, 16 bp, Homo sapiens
atgctattaagaaggc

SEQ ID NO: 5257899 - DNA, 22 bp, Homo sapiens
atgctattatactgttatccat

SEQ ID NO: 5257900 - DNA, 23 bp, Homo sapiens
atgctattatactgttatccata

SEQ ID NO: 5257901 - DNA, 14 bp, Homo sapiens
atgctattgacaat

SEQ ID NO: 5257902 - DNA, 19 bp, Homo sapiens
atgctattgttgtgggctt

SEQ ID NO: 5257903 - DNA, 16 bp, Homo sapiens
atgctatttcagccaa

SEQ ID NO: 5257904 - DNA, 17 bp, Homo sapiens
atgctatttcagccaat

SEQ ID NO: 5257905 - DNA, 11 bp, Homo sapiens
atgctatttct

SEQ ID NO: 5257906 - DNA, 16 bp, Homo sapiens
atgctatttctggcct

SEQ ID NO: 5257907 - DNA, 14 bp, Homo sapiens
atgctatttggaca

SEQ ID NO: 5257908 - DNA, 11 bp, Homo sapiens
atgctatttta

SEQ ID NO: 5257909 - DNA, 19 bp, Homo sapiens
atgctattttaaaaaatat

SEQ ID NO: 5257910 - DNA, 11 bp, Homo sapiens
atgctattttt

SEQ ID NO: 5257911 - DNA, 13 bp, Homo sapiens
atgctcaaagaaa

SEQ ID NO: 5257912 - DNA, 14 bp, Homo sapiens
atgctcaaagaaat

SEQ ID NO: 5257913 - DNA, 15 bp, Homo sapiens
atgctcaaagaaatc

SEQ ID NO: 5257914 - DNA, 12 bp, Homo sapiens
atgctcaaatga

SEQ ID NO: 5257915 - DNA, 16 bp, Homo sapiens
atgctcaaatgaaaac

SEQ ID NO: 5257916 - DNA, 23 bp, Homo sapiens
atgctcaacccccctcccagaca

SEQ ID NO: 5257917 - DNA, 14 bp, Homo sapiens
atgctcaagaatgt

SEQ ID NO: 5257918 - DNA, 15 bp, Homo sapiens
atgctcaagtttttc

SEQ ID NO: 5257919 - DNA, 14 bp, Homo sapiens
atgctcaatgtgct

SEQ ID NO: 5257920 - DNA, 12 bp, Homo sapiens
atgctcacctct

SEQ ID NO: 5257921 - DNA, 16 bp, Homo sapiens
atgctcacgctcccaa

SEQ ID NO: 5257922 - DNA, 13 bp, Homo sapiens
atgctcactgctt

SEQ ID NO: 5257923 - DNA, 17 bp, Homo sapiens
atgctcactgcttctgc

SEQ ID NO: 5257924 - DNA, 14 bp, Homo sapiens
atgctcactttatt

SEQ ID NO: 5257925 - DNA, 15 bp, Homo sapiens
atgctcactttatta

SEQ ID NO: 5257926 - DNA, 14 bp, Homo sapiens
atgctcagaagcca

SEQ ID NO: 5257927 - DNA, 15 bp, Homo sapiens
atgctcagaagccag

SEQ ID NO: 5257928 - DNA, 17 bp, Homo sapiens
atgctcagaagccagtc

SEQ ID NO: 5257929 - DNA, 13 bp, Homo sapiens
atgctcagccctg

SEQ ID NO: 5257930 - DNA, 18 bp, Homo sapiens
atgctcagccttgctgct

SEQ ID NO: 5257931 - DNA, 13 bp, Homo sapiens
atgctcaggctac

SEQ ID NO: 5257932 - DNA, 21 bp, Homo sapiens
atgctcagggtcactgaacca

SEQ ID NO: 5257933 - DNA, 18 bp, Homo sapiens
atgctcaggtacagagaa

SEQ ID NO: 5257934 - DNA, 18 bp, Homo sapiens
atgctcaggtgctggggc

SEQ ID NO: 5257935 - DNA, 19 bp, Homo sapiens
atgctcaggtgctggggcc

SEQ ID NO: 5257936 - DNA, 14 bp, Homo sapiens
atgctcagtattga

SEQ ID NO: 5257937 - DNA, 19 bp, Homo sapiens
atgctcatggtccccatgg

SEQ ID NO: 5257938 - DNA, 16 bp, Homo sapiens
atgctcattgctttct

SEQ ID NO: 5257939 - DNA, 15 bp, Homo sapiens
atgctcattttctgg

SEQ ID NO: 5257940 - DNA, 15 bp, Homo sapiens
atgctccaagattct

SEQ ID NO: 5257941 - DNA, 16 bp, Homo sapiens
atgctccaagattcta

SEQ ID NO: 5257942 - DNA, 17 bp, Homo sapiens
atgctccaagattctag

SEQ ID NO: 5257943 - DNA, 22 bp, Homo sapiens
atgctccagattagagcctgta

SEQ ID NO: 5257944 - DNA, 22 bp, Homo sapiens
atgctccagcaacacagcctgg

SEQ ID NO: 5257945 - DNA, 12 bp, Homo sapiens
atgctccagcca

SEQ ID NO: 5257946 - DNA, 19 bp, Homo sapiens
atgctccagccaacccctg

SEQ ID NO: 5257947 - DNA, 13 bp, Homo sapiens
atgctccagtcaa

SEQ ID NO: 5257948 - DNA, 20 bp, Homo sapiens
atgctccatcccattcactt

SEQ ID NO: 5257949 - DNA, 22 bp, Homo sapiens
atgctcccaaatgcagcttcag

SEQ ID NO: 5257950 - DNA, 18 bp, Homo sapiens
atgctcccaactcccttc

SEQ ID NO: 5257951 - DNA, 11 bp, Homo sapiens
atgctcccagc

SEQ ID NO: 5257952 - DNA, 12 bp, Homo sapiens
atgctcccagct

SEQ ID NO: 5257953 - DNA, 18 bp, Homo sapiens
atgctcccagctgtgctg

SEQ ID NO: 5257954 - DNA, 22 bp, Homo sapiens
atgctcccagctgtgctgtgga

SEQ ID NO: 5257955 - DNA, 22 bp, Homo sapiens
atgctccccacagcgtccctgg

SEQ ID NO: 5257956 - DNA, 16 bp, Homo sapiens
atgctcccctgtgcca

SEQ ID NO: 5257957 - DNA, 13 bp, Homo sapiens
atgctccctcagc

SEQ ID NO: 5257958 - DNA, 22 bp, Homo sapiens
atgctccctcagcctcagagga

SEQ ID NO: 5257959 - DNA, 16 bp, Homo sapiens
atgctccctcccctgc

SEQ ID NO: 5257960 - DNA, 20 bp, Homo sapiens
atgctccctcccctgccctg

SEQ ID NO: 5257961 - DNA, 19 bp, Homo sapiens
atgctccgacagcgtctcc

SEQ ID NO: 5257962 - DNA, 16 bp, Homo sapiens
atgctccgtcatttga

SEQ ID NO: 5257963 - DNA, 20 bp, Homo sapiens
atgctcctcacctgtctagg

SEQ ID NO: 5257964 - DNA, 16 bp, Homo sapiens
atgctcctcactgccc

SEQ ID NO: 5257965 - DNA, 16 bp, Homo sapiens
atgctcctctgcctgt

SEQ ID NO: 5257966 - DNA, 17 bp, Homo sapiens
atgctccttgcctctgc

SEQ ID NO: 5257967 - DNA, 15 bp, Homo sapiens
atgctccttgggccc

SEQ ID NO: 5257968 - DNA, 22 bp, Homo sapiens
atgctcgccatcaaggtccagt

SEQ ID NO: 5257969 - DNA, 16 bp, Homo sapiens
atgctcgtgtgatttc

SEQ ID NO: 5257970 - DNA, 12 bp, Homo sapiens
atgctctaacaa

SEQ ID NO: 5257971 - DNA, 13 bp, Homo sapiens
atgctctaacaaa

SEQ ID NO: 5257972 - DNA, 16 bp, Homo sapiens
atgctctacttctttt

SEQ ID NO: 5257973 - DNA, 17 bp, Homo sapiens
atgctctatgtttgtat

SEQ ID NO: 5257974 - DNA, 16 bp, Homo sapiens
atgctctctatagagg

SEQ ID NO: 5257975 - DNA, 18 bp, Homo sapiens
atgctctctcaaattgtc

SEQ ID NO: 5257976 - DNA, 19 bp, Homo sapiens
atgctctctcaaattgtca

SEQ ID NO: 5257977 - DNA, 22 bp, Homo sapiens
atgctctctgaggcaaggccca

SEQ ID NO: 5257978 - DNA, 23 bp, Homo sapiens
atgctctctgcagccagcccagc

SEQ ID NO: 5257979 - DNA, 16 bp, Homo sapiens
atgctctgagaaattg

SEQ ID NO: 5257980 - DNA, 22 bp, Homo sapiens
atgctctgagaaattgaatgta

SEQ ID NO: 5257981 - DNA, 23 bp, Homo sapiens
atgctctgagaagaggagccctc

SEQ ID NO: 5257982 - DNA, 17 bp, Homo sapiens
atgctctgagtagcttt

SEQ ID NO: 5257983 - DNA, 12 bp, Homo sapiens
atgctctgatta

SEQ ID NO: 5257984 - DNA, 17 bp, Homo sapiens
atgctctgcaaaaggag

SEQ ID NO: 5257985 - DNA, 18 bp, Homo sapiens
atgctctgcatgttacat

SEQ ID NO: 5257986 - DNA, 14 bp, Homo sapiens
atgctctgctttta

SEQ ID NO: 5257987 - DNA, 20 bp, Homo sapiens
atgctctggcttgccccagg

SEQ ID NO: 5257988 - DNA, 12 bp, Homo sapiens
atgctctgtcca

SEQ ID NO: 5257989 - DNA, 15 bp, Homo sapiens
atgctctgtccagct

SEQ ID NO: 5257990 - DNA, 18 bp, Homo sapiens
atgctctgtcttcaatga

SEQ ID NO: 5257991 - DNA, 15 bp, Homo sapiens
atgctcttaaaatat

SEQ ID NO: 5257992 - DNA, 17 bp, Homo sapiens
atgctcttaaaatatct

SEQ ID NO: 5257993 - DNA, 20 bp, Homo sapiens
atgctcttaaaatatcttcc

SEQ ID NO: 5257994 - DNA, 15 bp, Homo sapiens
atgctcttaattgcc

SEQ ID NO: 5257995 - DNA, 17 bp, Homo sapiens
atgctcttatttcatca

SEQ ID NO: 5257996 - DNA, 13 bp, Homo sapiens
atgctcttctgtg

SEQ ID NO: 5257997 - DNA, 17 bp, Homo sapiens
atgctcttgaaatattc

SEQ ID NO: 5257998 - DNA, 21 bp, Homo sapiens
atgctcttgaccttgtagaga

SEQ ID NO: 5257999 - DNA, 13 bp, Homo sapiens
atgctctttcaat

SEQ ID NO: 5258000 - DNA, 17 bp, Homo sapiens
atgctctttcaatgcag

SEQ ID NO: 5258001 - DNA, 15 bp, Homo sapiens
atgctctttcaccct

SEQ ID NO: 5258002 - DNA, 14 bp, Homo sapiens
atgctctttccctt

SEQ ID NO: 5258003 - DNA, 15 bp, Homo sapiens
atgctctttcccttt

SEQ ID NO: 5258004 - DNA, 18 bp, Homo sapiens
atgctctttcccttttct

SEQ ID NO: 5258005 - DNA, 15 bp, Homo sapiens
atgctcttttttact

SEQ ID NO: 5258006 - DNA, 18 bp, Homo sapiens
atgctcttttttactcat

SEQ ID NO: 5258007 - DNA, 19 bp, Homo sapiens
atgctcttttttactcatt

SEQ ID NO: 5258008 - DNA, 23 bp, Homo sapiens
atgctgaaaatgtccttgtgatg

SEQ ID NO: 5258009 - DNA, 12 bp, Homo sapiens
atgctgaaacaa

SEQ ID NO: 5258010 - DNA, 17 bp, Homo sapiens
atgctgaaataaaatga

SEQ ID NO: 5258011 - DNA, 18 bp, Homo sapiens
atgctgaaataaactagg

SEQ ID NO: 5258012 - DNA, 23 bp, Homo sapiens
atgctgaacattgcatataactt

SEQ ID NO: 5258013 - DNA, 12 bp, Homo sapiens
atgctgaaggga

SEQ ID NO: 5258014 - DNA, 22 bp, Homo sapiens
atgctgaagtacagtcccagca

SEQ ID NO: 5258015 - DNA, 16 bp, Homo sapiens
atgctgaatatctgtt

SEQ ID NO: 5258016 - DNA, 18 bp, Homo sapiens
atgctgaatatctgttca

SEQ ID NO: 5258017 - DNA, 18 bp, Homo sapiens
atgctgaatgccccctgc

SEQ ID NO: 5258018 - DNA, 17 bp, Homo sapiens
atctctgtcacatccaa

SEQ ID NO: 5258019 - DNA, 21 bp, Homo sapiens
atctctgtcccattccctggg

SEQ ID NO: 5258020 - DNA, 20 bp, Homo sapiens
atctctgtctaccatctccc

SEQ ID NO: 5258021 - DNA, 14 bp, Homo sapiens
atctctgtctgggg

SEQ ID NO: 5258022 - DNA, 18 bp, Homo sapiens
atctctgtgccttcgtct

SEQ ID NO: 5258023 - DNA, 23 bp, Homo sapiens
atctctgtgtacccactcctcac

SEQ ID NO: 5258024 - DNA, 15 bp, Homo sapiens
atctctgtgtgcaca

SEQ ID NO: 5258025 - DNA, 20 bp, Homo sapiens
atctctgtgtgttttctttg

SEQ ID NO: 5258026 - DNA, 17 bp, Homo sapiens
atctctgttacaaaaga

SEQ ID NO: 5258027 - DNA, 12 bp, Homo sapiens
atctctgttact

SEQ ID NO: 5258028 - DNA, 19 bp, Homo sapiens
atctctgttatgtactgta

SEQ ID NO: 5258029 - DNA, 12 bp, Homo sapiens
atctctgttatt

SEQ ID NO: 5258030 - DNA, 22 bp, Homo sapiens
atctctgttctgtttggcactt

SEQ ID NO: 5258031 - DNA, 19 bp, Homo sapiens
atctctgttctttcatact

SEQ ID NO: 5258032 - DNA, 20 bp, Homo sapiens
atctctgttctttcatacta

SEQ ID NO: 5258033 - DNA, 16 bp, Homo sapiens
atctcttaaactctct

SEQ ID NO: 5258034 - DNA, 23 bp, Homo sapiens
atctcttaaattgggttcatgat

SEQ ID NO: 5258035 - DNA, 21 bp, Homo sapiens
atctcttaatattgagaatca

SEQ ID NO: 5258036 - DNA, 19 bp, Homo sapiens
atctcttagaagccatggg

SEQ ID NO: 5258037 - DNA, 15 bp, Homo sapiens
atctcttattctaat

SEQ ID NO: 5258038 - DNA, 16 bp, Homo sapiens
atctcttattttacaa

SEQ ID NO: 5258039 - DNA, 11 bp, Homo sapiens
atctcttcaat

SEQ ID NO: 5258040 - DNA, 13 bp, Homo sapiens
atctcttcaatca

SEQ ID NO: 5258041 - DNA, 18 bp, Homo sapiens
atctcttcactaccctga

SEQ ID NO: 5258042 - DNA, 12 bp, Homo sapiens
atctcttcagtc

SEQ ID NO: 5258043 - DNA, 15 bp, Homo sapiens
atctcttcattcaaa

SEQ ID NO: 5258044 - DNA, 14 bp, Homo sapiens
atctcttccccaga

SEQ ID NO: 5258045 - DNA, 16 bp, Homo sapiens
atctcttccccagaga

SEQ ID NO: 5258046 - DNA, 10 bp, Homo sapiens
atctcttcct

SEQ ID NO: 5258047 - DNA, 13 bp, Homo sapiens
atctcttccttca

SEQ ID NO: 5258048 - DNA, 13 bp, Homo sapiens
atctcttcctttc

SEQ ID NO: 5258049 - DNA, 14 bp, Homo sapiens
atctcttctaaatg

SEQ ID NO: 5258050 - DNA, 20 bp, Homo sapiens
atctcttctcactttccttt

SEQ ID NO: 5258051 - DNA, 13 bp, Homo sapiens
atctcttctgcaa

SEQ ID NO: 5258052 - DNA, 22 bp, Homo sapiens
atctcttcttaatgtacatagt

SEQ ID NO: 5258053 - DNA, 14 bp, Homo sapiens
atctcttgataaag

SEQ ID NO: 5258054 - DNA, 16 bp, Homo sapiens
atctcttgcccttcct

SEQ ID NO: 5258055 - DNA, 17 bp, Homo sapiens
atctcttgcttgtcatt

SEQ ID NO: 5258056 - DNA, 12 bp, Homo sapiens
atctcttgcttt

SEQ ID NO: 5258057 - DNA, 20 bp, Homo sapiens
atctcttgggagtcttgggt

SEQ ID NO: 5258058 - DNA, 17 bp, Homo sapiens
atctcttgtaccagccc

SEQ ID NO: 5258059 - DNA, 18 bp, Homo sapiens
atctcttgtcattctcat

SEQ ID NO: 5258060 - DNA, 22 bp, Homo sapiens
atctcttgtgcttttttgattt

SEQ ID NO: 5258061 - DNA, 16 bp, Homo sapiens
atctcttgtttaaatt

SEQ ID NO: 5258062 - DNA, 13 bp, Homo sapiens
atctctttagaga

SEQ ID NO: 5258063 - DNA, 20 bp, Homo sapiens
atctctttagatccaaaata

SEQ ID NO: 5258064 - DNA, 21 bp, Homo sapiens
atctctttagatccaaaataa

SEQ ID NO: 5258065 - DNA, 13 bp, Homo sapiens
atctctttcacat

SEQ ID NO: 5258066 - DNA, 17 bp, Homo sapiens
atctctttcacattgtt

SEQ ID NO: 5258067 - DNA, 15 bp, Homo sapiens
atctctttccatctt

SEQ ID NO: 5258068 - DNA, 12 bp, Homo sapiens
atctctttccct

SEQ ID NO: 5258069 - DNA, 19 bp, Homo sapiens
atctctttctcattagaga

SEQ ID NO: 5258070 - DNA, 23 bp, Homo sapiens
atctctttctttctctttctgtt

SEQ ID NO: 5258071 - DNA, 15 bp, Homo sapiens
atctctttgaatttt

SEQ ID NO: 5258072 - DNA, 21 bp, Homo sapiens
atctctttggaaaatagtttg

SEQ ID NO: 5258073 - DNA, 11 bp, Homo sapiens
atctctttgtc

SEQ ID NO: 5258074 - DNA, 14 bp, Homo sapiens
atctctttgtcctg

SEQ ID NO: 5258075 - DNA, 15 bp, Homo sapiens
atctctttgtcctga

SEQ ID NO: 5258076 - DNA, 16 bp, Homo sapiens
atctctttgtcctgaa

SEQ ID NO: 5258077 - DNA, 20 bp, Homo sapiens
atctcttttatatttgtagg

SEQ ID NO: 5258078 - DNA, 10 bp, Homo sapiens
atctcttttc

SEQ ID NO: 5258079 - DNA, 15 bp, Homo sapiens
atctcttttcccact

SEQ ID NO: 5258080 - DNA, 16 bp, Homo sapiens
atctcttttcccactc

SEQ ID NO: 5258081 - DNA, 18 bp, Homo sapiens
atctcttttcccactccc

SEQ ID NO: 5258082 - DNA, 22 bp, Homo sapiens
atctcttttctggtaattttgg

SEQ ID NO: 5258083 - DNA, 15 bp, Homo sapiens
atctctttttgtttg

SEQ ID NO: 5258084 - DNA, 17 bp, Homo sapiens
atctgaaaaatggccat

SEQ ID NO: 5258085 - DNA, 19 bp, Homo sapiens
atctgaaaaatggccatgt

SEQ ID NO: 5258086 - DNA, 13 bp, Homo sapiens
atctgaaaactgg

SEQ ID NO: 5258087 - DNA, 12 bp, Homo sapiens
atctgaaaagaa

SEQ ID NO: 5258088 - DNA, 17 bp, Homo sapiens
atctgaaaatacatttc

SEQ ID NO: 5258089 - DNA, 13 bp, Homo sapiens
atctgaaaatatt

SEQ ID NO: 5258090 - DNA, 12 bp, Homo sapiens
atctgaaaatgt

SEQ ID NO: 5258091 - DNA, 20 bp, Homo sapiens
atctgaaaatgtatgtgtaa

SEQ ID NO: 5258092 - DNA, 14 bp, Homo sapiens
atctgaaaatgtga

SEQ ID NO: 5258093 - DNA, 21 bp, Homo sapiens
atctgaaacccacagatgtct

SEQ ID NO: 5258094 - DNA, 19 bp, Homo sapiens
atctgaaaccctccttctg

SEQ ID NO: 5258095 - DNA, 15 bp, Homo sapiens
atctgaaaggccagc

SEQ ID NO: 5258096 - DNA, 17 bp, Homo sapiens
atctgaaaggccagcag

SEQ ID NO: 5258097 - DNA, 16 bp, Homo sapiens
atctgaaagtatattt

SEQ ID NO: 5258098 - DNA, 18 bp, Homo sapiens
atctgaaagttttgatac

SEQ ID NO: 5258099 - DNA, 17 bp, Homo sapiens
atctgaaataaggaatg

SEQ ID NO: 5258100 - DNA, 21 bp, Homo sapiens
atctgaaataggaaacaagtg

SEQ ID NO: 5258101 - DNA, 13 bp, Homo sapiens
atctgaaatgtta

SEQ ID NO: 5258102 - DNA, 18 bp, Homo sapiens
atctgaactctaagcaga

SEQ ID NO: 5258103 - DNA, 19 bp, Homo sapiens
atctgaactctaagcagaa

SEQ ID NO: 5258104 - DNA, 21 bp, Homo sapiens
atctgaactctaagcagaaga

SEQ ID NO: 5258105 - DNA, 14 bp, Homo sapiens
atctgaactctcaa

SEQ ID NO: 5258106 - DNA, 14 bp, Homo sapiens
atctgaactgctct

SEQ ID NO: 5258107 - DNA, 19 bp, Homo sapiens
atctgaactttgtttccag

SEQ ID NO: 5258108 - DNA, 14 bp, Homo sapiens
atctgaagagtgga

SEQ ID NO: 5258109 - DNA, 19 bp, Homo sapiens
atctgaagatatatttcac

SEQ ID NO: 5258110 - DNA, 13 bp, Homo sapiens
atctgaagattgt

SEQ ID NO: 5258111 - DNA, 15 bp, Homo sapiens
atctgaagattgttt

SEQ ID NO: 5258112 - DNA, 17 bp, Homo sapiens
atctgaagccttttcct

SEQ ID NO: 5258113 - DNA, 17 bp, Homo sapiens
atctgaagctagaggaa

SEQ ID NO: 5258114 - DNA, 17 bp, Homo sapiens
atctgaagctattgatg

SEQ ID NO: 5258115 - DNA, 18 bp, Homo sapiens
atctgaagctattgatgt

SEQ ID NO: 5258116 - DNA, 20 bp, Homo sapiens
atctgaagcttcactcactg

SEQ ID NO: 5258117 - DNA, 18 bp, Homo sapiens
atctgaaggaccccaggt

SEQ ID NO: 5258118 - DNA, 23 bp, Homo sapiens
atctgaaggagagagtcttttaa

SEQ ID NO: 5258119 - DNA, 15 bp, Homo sapiens
atctgaaggagattt

SEQ ID NO: 5258120 - DNA, 18 bp, Homo sapiens
atctgaaggggcaaattc

SEQ ID NO: 5258121 - DNA, 12 bp, Homo sapiens
atctgaagtagt

SEQ ID NO: 5258122 - DNA, 16 bp, Homo sapiens
atctgaagtcagatct

SEQ ID NO: 5258123 - DNA, 17 bp, Homo sapiens
atctgaagtcagatctg

SEQ ID NO: 5258124 - DNA, 22 bp, Homo sapiens
atctgaagtggttcagtctaga

SEQ ID NO: 5258125 - DNA, 22 bp, Homo sapiens
atctgaagtgtctaatgcatta

SEQ ID NO: 5258126 - DNA, 21 bp, Homo sapiens
atctgaataccccttctctgt

SEQ ID NO: 5258127 - DNA, 22 bp, Homo sapiens
atctgaataccccttctctgta

SEQ ID NO: 5258128 - DNA, 22 bp, Homo sapiens
atctgaatacctctttgaaaga

SEQ ID NO: 5258129 - DNA, 17 bp, Homo sapiens
atctgaatataggaagc

SEQ ID NO: 5258130 - DNA, 15 bp, Homo sapiens
atctgaatattagat

SEQ ID NO: 5258131 - DNA, 16 bp, Homo sapiens
atctgaatgaaaataa

SEQ ID NO: 5258132 - DNA, 18 bp, Homo sapiens
atctgaatgaaaataact

SEQ ID NO: 5258133 - DNA, 19 bp, Homo sapiens
atctgaatgaaaataactg

SEQ ID NO: 5258134 - DNA, 20 bp, Homo sapiens
atctgaatgaaaataactga

SEQ ID NO: 5258135 - DNA, 15 bp, Homo sapiens
atctgaatgtaattt

SEQ ID NO: 5258136 - DNA, 17 bp, Homo sapiens
atctgaatgtaatttgt

SEQ ID NO: 5258137 - DNA, 18 bp, Homo sapiens
atctgaatgtaatttgtg

SEQ ID NO: 5258138 - DNA, 15 bp, Homo sapiens
atctgaatttctaaa

SEQ ID NO: 5258139 - DNA, 11 bp, Homo sapiens
atctgaatttt

SEQ ID NO: 5258140 - DNA, 12 bp, Homo sapiens
atctgaattttt

SEQ ID NO: 5258141 - DNA, 14 bp, Homo sapiens
atctgaatttttaa

SEQ ID NO: 5258142 - DNA, 19 bp, Homo sapiens
atctgaatttttaaacaag

SEQ ID NO: 5258143 - DNA, 13 bp, Homo sapiens
atctgacaaaatg

SEQ ID NO: 5258144 - DNA, 20 bp, Homo sapiens
atctgacaaattcaaaagag

SEQ ID NO: 5258145 - DNA, 15 bp, Homo sapiens
atctgacaatataca

SEQ ID NO: 5258146 - DNA, 23 bp, Homo sapiens
atctgacagcaggccactagtga

SEQ ID NO: 5258147 - DNA, 20 bp, Homo sapiens
atctgacagtctcaaatttt

SEQ ID NO: 5258148 - DNA, 19 bp, Homo sapiens
atctgacagttactcttca

SEQ ID NO: 5258149 - DNA, 12 bp, Homo sapiens
atctgacatatt

SEQ ID NO: 5258150 - DNA, 17 bp, Homo sapiens
atctgacatatttcata

SEQ ID NO: 5258151 - DNA, 20 bp, Homo sapiens
atctgacatgattccttcct

SEQ ID NO: 5258152 - DNA, 16 bp, Homo sapiens
atctgaccacagacac

SEQ ID NO: 5258153 - DNA, 14 bp, Homo sapiens
atctgaccagcagc

SEQ ID NO: 5258154 - DNA, 19 bp, Homo sapiens
atctgaccatctgtgacta

SEQ ID NO: 5258155 - DNA, 19 bp, Homo sapiens
atctgacccactttgtaat

SEQ ID NO: 5258156 - DNA, 18 bp, Homo sapiens
atctgacccagtgccccc

SEQ ID NO: 5258157 - DNA, 14 bp, Homo sapiens
atctgactatgaca

SEQ ID NO: 5258158 - DNA, 18 bp, Homo sapiens
atctgactcacaagaaga

SEQ ID NO: 5258159 - DNA, 21 bp, Homo sapiens
atctgagaaactctacatgta

SEQ ID NO: 5258160 - DNA, 20 bp, Homo sapiens
atctgagaaagtactttctg

SEQ ID NO: 5258161 - DNA, 18 bp, Homo sapiens
atctgagaagtgtatata

SEQ ID NO: 5258162 - DNA, 19 bp, Homo sapiens
atctgagaagtgtatatag

SEQ ID NO: 5258163 - DNA, 13 bp, Homo sapiens
atctgagaatctt

SEQ ID NO: 5258164 - DNA, 14 bp, Homo sapiens
atctgagaatcttt

SEQ ID NO: 5258165 - DNA, 16 bp, Homo sapiens
atctgagaatctttat

SEQ ID NO: 5258166 - DNA, 20 bp, Homo sapiens
atctgagatctccctccagg

SEQ ID NO: 5258167 - DNA, 21 bp, Homo sapiens
atctgagattgtgtttgttca

SEQ ID NO: 5258168 - DNA, 17 bp, Homo sapiens
atctgagcaagagctgg

SEQ ID NO: 5258169 - DNA, 22 bp, Homo sapiens
atctgagcaagagctggcaaag

SEQ ID NO: 5258170 - DNA, 12 bp, Homo sapiens
atctgagcaagg

SEQ ID NO: 5258171 - DNA, 13 bp, Homo sapiens
atctgagcaataa

SEQ ID NO: 5258172 - DNA, 16 bp, Homo sapiens
atctgagcaataactt

SEQ ID NO: 5258173 - DNA, 22 bp, Homo sapiens
atctgagcgtttaaagtactga

SEQ ID NO: 5258174 - DNA, 19 bp, Homo sapiens
atctgagctgcagcctggc

SEQ ID NO: 5258175 - DNA, 22 bp, Homo sapiens
atctgagctgcagcctggctgg

SEQ ID NO: 5258176 - DNA, 22 bp, Homo sapiens
atctgaggaatcaacagggcag

SEQ ID NO: 5258177 - DNA, 16 bp, Homo sapiens
atctgaggaattctgt

SEQ ID NO: 5258178 - DNA, 20 bp, Homo sapiens
atctgaggaattctgtatag

SEQ ID NO: 5258179 - DNA, 18 bp, Homo sapiens
atctgaggacaaggaaat

SEQ ID NO: 5258180 - DNA, 18 bp, Homo sapiens
atctgagggaaatgtttt

SEQ ID NO: 5258181 - DNA, 22 bp, Homo sapiens
atctgagggaaatgttttgtaa

SEQ ID NO: 5258182 - DNA, 16 bp, Homo sapiens
atctgagggaggaggc

SEQ ID NO: 5258183 - DNA, 21 bp, Homo sapiens
atctgagggaggaggccacct

SEQ ID NO: 5258184 - DNA, 22 bp, Homo sapiens
atctgagggaggaggccacctc

SEQ ID NO: 5258185 - DNA, 21 bp, Homo sapiens
atctgagggcactctctgcca

SEQ ID NO: 5258186 - DNA, 23 bp, Homo sapiens
atctgagggcactctctgccagc

SEQ ID NO: 5258187 - DNA, 17 bp, Homo sapiens
atctgagggctgctccc

SEQ ID NO: 5258188 - DNA, 18 bp, Homo sapiens
atctgagggctgctcccc

SEQ ID NO: 5258189 - DNA, 16 bp, Homo sapiens
atctgagtaggtctgg

SEQ ID NO: 5258190 - DNA, 17 bp, Homo sapiens
atctgagtattgaatga

SEQ ID NO: 5258191 - DNA, 16 bp, Homo sapiens
atctgagtcagagcca

SEQ ID NO: 5258192 - DNA, 17 bp, Homo sapiens
atctgagtccagctccc

SEQ ID NO: 5258193 - DNA, 21 bp, Homo sapiens
atctgagtccagctcccccca

SEQ ID NO: 5258194 - DNA, 13 bp, Homo sapiens
atctgagtcctgg

SEQ ID NO: 5258195 - DNA, 23 bp, Homo sapiens
atctgagtgaattgtacctattt

SEQ ID NO: 5258196 - DNA, 13 bp, Homo sapiens
atctgagtgtgga

SEQ ID NO: 5258197 - DNA, 18 bp, Homo sapiens
atctgagttgccaagaca

SEQ ID NO: 5258198 - DNA, 18 bp, Homo sapiens
atgctgacataattctaa

SEQ ID NO: 5258199 - DNA, 15 bp, Homo sapiens
atgctgacatcattt

SEQ ID NO: 5258200 - DNA, 16 bp, Homo sapiens
atgctgacatcatttg

SEQ ID NO: 5258201 - DNA, 16 bp, Homo sapiens
atgctgacctcacctg

SEQ ID NO: 5258202 - DNA, 21 bp, Homo sapiens
atgctgacctcacctggtcct

SEQ ID NO: 5258203 - DNA, 21 bp, Homo sapiens
atgctgactgtactcctccca

SEQ ID NO: 5258204 - DNA, 18 bp, Homo sapiens
atgctgagacatccctca

SEQ ID NO: 5258205 - DNA, 20 bp, Homo sapiens
atgctgagacatccctcatc

SEQ ID NO: 5258206 - DNA, 21 bp, Homo sapiens
atgctgagacatccctcatct

SEQ ID NO: 5258207 - DNA, 17 bp, Homo sapiens
atgctgagagctgggct

SEQ ID NO: 5258208 - DNA, 21 bp, Homo sapiens
atgctgagattacaggtgtga

SEQ ID NO: 5258209 - DNA, 16 bp, Homo sapiens
atgctgagctgtgatg

SEQ ID NO: 5258210 - DNA, 20 bp, Homo sapiens
atgctgaggatataagcttt

SEQ ID NO: 5258211 - DNA, 14 bp, Homo sapiens
atgctgaggcccct

SEQ ID NO: 5258212 - DNA, 15 bp, Homo sapiens
atgctgaggcctcga

SEQ ID NO: 5258213 - DNA, 17 bp, Homo sapiens
atgctgagggtgtttct

SEQ ID NO: 5258214 - DNA, 14 bp, Homo sapiens
atgctgagtcatgc

SEQ ID NO: 5258215 - DNA, 24 bp, Homo sapiens
atgctgatcatcgccagaggtgct

SEQ ID NO: 5258216 - DNA, 15 bp, Homo sapiens
atgctgatgttcagt

SEQ ID NO: 5258217 - DNA, 16 bp, Homo sapiens
atgctgatgttcagtg

SEQ ID NO: 5258218 - DNA, 18 bp, Homo sapiens
atgctgatgttcagtgta

SEQ ID NO: 5258219 - DNA, 19 bp, Homo sapiens
atgctgatgttcagtgtaa

SEQ ID NO: 5258220 - DNA, 20 bp, Homo sapiens
atgctgatgttcagtgtaat

SEQ ID NO: 5258221 - DNA, 24 bp, Homo sapiens
atgctgatgttcagtgtaatttct

SEQ ID NO: 5258222 - DNA, 18 bp, Homo sapiens
atgctgattatttagagc

SEQ ID NO: 5258223 - DNA, 20 bp, Homo sapiens
atgctgattatttagagcca

SEQ ID NO: 5258224 - DNA, 17 bp, Homo sapiens
atgctgcaaaggagaag

SEQ ID NO: 5258225 - DNA, 18 bp, Homo sapiens
atgctgcaacaaaatgta

SEQ ID NO: 5258226 - DNA, 14 bp, Homo sapiens
atgctgcaactttt

SEQ ID NO: 5258227 - DNA, 21 bp, Homo sapiens
atgctgcaatacattaaaata

SEQ ID NO: 5258228 - DNA, 15 bp, Homo sapiens
atgctgcaggaaaag

SEQ ID NO: 5258229 - DNA, 23 bp, Homo sapiens
atgctgcattttaattttaacca

SEQ ID NO: 5258230 - DNA, 14 bp, Homo sapiens
atgctgccaatatc

SEQ ID NO: 5258231 - DNA, 21 bp, Homo sapiens
atgctgccaatatcctaataa

SEQ ID NO: 5258232 - DNA, 13 bp, Homo sapiens
atgctgccagtgt

SEQ ID NO: 5258233 - DNA, 20 bp, Homo sapiens
atgctgccatgcccaccatc

SEQ ID NO: 5258234 - DNA, 16 bp, Homo sapiens
atgctgccattcttga

SEQ ID NO: 5258235 - DNA, 19 bp, Homo sapiens
atgctgcccaccccctgct

SEQ ID NO: 5258236 - DNA, 22 bp, Homo sapiens
atgctgcccatgccaccgcttc

SEQ ID NO: 5258237 - DNA, 12 bp, Homo sapiens
atgctgcccctc

SEQ ID NO: 5258238 - DNA, 15 bp, Homo sapiens
atgctgcccctgcct

SEQ ID NO: 5258239 - DNA, 12 bp, Homo sapiens
atgctgccctgt

SEQ ID NO: 5258240 - DNA, 13 bp, Homo sapiens
atgctgccctgtg

SEQ ID NO: 5258241 - DNA, 18 bp, Homo sapiens
atgctgccggcacagctg

SEQ ID NO: 5258242 - DNA, 20 bp, Homo sapiens
atgctgccggcacagctggg

SEQ ID NO: 5258243 - DNA, 21 bp, Homo sapiens
atgctgccggcacagctggga

SEQ ID NO: 5258244 - DNA, 23 bp, Homo sapiens
atgctgcctagggttgcttgggc

SEQ ID NO: 5258245 - DNA, 23 bp, Homo sapiens
atgctgcctagtgctacagatgt

SEQ ID NO: 5258246 - DNA, 14 bp, Homo sapiens
atgctgcctcagga

SEQ ID NO: 5258247 - DNA, 22 bp, Homo sapiens
atgctgcctcaggacccatccc

SEQ ID NO: 5258248 - DNA, 23 bp, Homo sapiens
atgctgcctcaggacccatccct

SEQ ID NO: 5258249 - DNA, 15 bp, Homo sapiens
atgctgcctccagaa

SEQ ID NO: 5258250 - DNA, 11 bp, Homo sapiens
atgctgcctga

SEQ ID NO: 5258251 - DNA, 12 bp, Homo sapiens
atgctgcctgag

SEQ ID NO: 5258252 - DNA, 14 bp, Homo sapiens
atgctgcctgcctc

SEQ ID NO: 5258253 - DNA, 21 bp, Homo sapiens
atgctgcctgcctccggccct

SEQ ID NO: 5258254 - DNA, 22 bp, Homo sapiens
atgctgcctgcctccggccctg

SEQ ID NO: 5258255 - DNA, 23 bp, Homo sapiens
atgctgccttcccatgaatctgt

SEQ ID NO: 5258256 - DNA, 21 bp, Homo sapiens
atgctgcgcatgttttcttca

SEQ ID NO: 5258257 - DNA, 16 bp, Homo sapiens
atgctgcgcccttccc

SEQ ID NO: 5258258 - DNA, 20 bp, Homo sapiens
atgctgcgcttaccttccca

SEQ ID NO: 5258259 - DNA, 22 bp, Homo sapiens
atgctgctaaagggagaaatgc

SEQ ID NO: 5258260 - DNA, 17 bp, Homo sapiens
atgctgctatgaagact

SEQ ID NO: 5258261 - DNA, 16 bp, Homo sapiens
atgctgctccaccctc

SEQ ID NO: 5258262 - DNA, 23 bp, Homo sapiens
atgctgctcccctaaagccaggc

SEQ ID NO: 5258263 - DNA, 19 bp, Homo sapiens
atgctgctccgcccgctcc

SEQ ID NO: 5258264 - DNA, 22 bp, Homo sapiens
atgctgctctcagcctcccaca

SEQ ID NO: 5258265 - DNA, 21 bp, Homo sapiens
atgctgctctggtgcacgcct

SEQ ID NO: 5258266 - DNA, 14 bp, Homo sapiens
atgctgctgagcac

SEQ ID NO: 5258267 - DNA, 23 bp, Homo sapiens
atgctgctgcccctgcacagcag

SEQ ID NO: 5258268 - DNA, 14 bp, Homo sapiens
atgctgctggccaa

SEQ ID NO: 5258269 - DNA, 20 bp, Homo sapiens
atgctgctggcctccctccg

SEQ ID NO: 5258270 - DNA, 14 bp, Homo sapiens
atgctgctggggaa

SEQ ID NO: 5258271 - DNA, 15 bp, Homo sapiens
atgctgctgtgaatt

SEQ ID NO: 5258272 - DNA, 16 bp, Homo sapiens
atgctgctgtgaattt

SEQ ID NO: 5258273 - DNA, 19 bp, Homo sapiens
atgctgctgtgaatttttt

SEQ ID NO: 5258274 - DNA, 12 bp, Homo sapiens
atgctgcttcca

SEQ ID NO: 5258275 - DNA, 15 bp, Homo sapiens
atgctgcttccactc

SEQ ID NO: 5258276 - DNA, 16 bp, Homo sapiens
atgctgcttgtgacct

SEQ ID NO: 5258277 - DNA, 17 bp, Homo sapiens
atgctgcttgtgacctt

SEQ ID NO: 5258278 - DNA, 12 bp, Homo sapiens
atgctgctttaa

SEQ ID NO: 5258279 - DNA, 19 bp, Homo sapiens
atgctgctttaacagtgga

SEQ ID NO: 5258280 - DNA, 21 bp, Homo sapiens
atgctgctttaattgtgaatt

SEQ ID NO: 5258281 - DNA, 13 bp, Homo sapiens
atgctgctttccc

SEQ ID NO: 5258282 - DNA, 18 bp, Homo sapiens
atgctgctttcccctgtg

SEQ ID NO: 5258283 - DNA, 11 bp, Homo sapiens
atgctgctttg

SEQ ID NO: 5258284 - DNA, 19 bp, Homo sapiens
atgctgctttggggatatt

SEQ ID NO: 5258285 - DNA, 19 bp, Homo sapiens
atgctgctttggttaatct

SEQ ID NO: 5258286 - DNA, 15 bp, Homo sapiens
atgctgcttttatat

SEQ ID NO: 5258287 - DNA, 13 bp, Homo sapiens
atgctgctttttc

SEQ ID NO: 5258288 - DNA, 20 bp, Homo sapiens
atgctgctttttggcacagt

SEQ ID NO: 5258289 - DNA, 18 bp, Homo sapiens
atgctggaaataaaacag

SEQ ID NO: 5258290 - DNA, 23 bp, Homo sapiens
atgctggaacctgcaaaaaatac

SEQ ID NO: 5258291 - DNA, 22 bp, Homo sapiens
atgctggacattaacaagatca

SEQ ID NO: 5258292 - DNA, 16 bp, Homo sapiens
atgctggactggaggc

SEQ ID NO: 5258293 - DNA, 16 bp, Homo sapiens
atgctggagaaaaata

SEQ ID NO: 5258294 - DNA, 12 bp, Homo sapiens
atgctggagagg

SEQ ID NO: 5258295 - DNA, 11 bp, Homo sapiens
atgctggagcc

SEQ ID NO: 5258296 - DNA, 16 bp, Homo sapiens
atgctggagcctgtgt

SEQ ID NO: 5258297 - DNA, 22 bp, Homo sapiens
atgctggagcctgtgtaacagc

SEQ ID NO: 5258298 - DNA, 16 bp, Homo sapiens
atgctggaggccctcg

SEQ ID NO: 5258299 - DNA, 15 bp, Homo sapiens
atgctggagggaggc

SEQ ID NO: 5258300 - DNA, 17 bp, Homo sapiens
atgctggagtacccagc

SEQ ID NO: 5258301 - DNA, 22 bp, Homo sapiens
atgctggatgaccccatgctcc

SEQ ID NO: 5258302 - DNA, 19 bp, Homo sapiens
atgctggatgctccttcca

SEQ ID NO: 5258303 - DNA, 22 bp, Homo sapiens
atgctggatgtctgccaatttt

SEQ ID NO: 5258304 - DNA, 18 bp, Homo sapiens
atgctggcaaatccaggc

SEQ ID NO: 5258305 - DNA, 14 bp, Homo sapiens
atgctggccacaga

SEQ ID NO: 5258306 - DNA, 17 bp, Homo sapiens
atgctggccagcatttt

SEQ ID NO: 5258307 - DNA, 12 bp, Homo sapiens
atgctggcccag

SEQ ID NO: 5258308 - DNA, 15 bp, Homo sapiens
atgctggcccagggc

SEQ ID NO: 5258309 - DNA, 20 bp, Homo sapiens
atgctggcccagggcccaga

SEQ ID NO: 5258310 - DNA, 22 bp, Homo sapiens
atgctggcccagggcccagagc

SEQ ID NO: 5258311 - DNA, 11 bp, Homo sapiens
atgctggcctc

SEQ ID NO: 5258312 - DNA, 18 bp, Homo sapiens
atgctggcctgactggtt

SEQ ID NO: 5258313 - DNA, 18 bp, Homo sapiens
atgctggcctgtggcagg

SEQ ID NO: 5258314 - DNA, 20 bp, Homo sapiens
atgctggcctgtggcaggcc

SEQ ID NO: 5258315 - DNA, 20 bp, Homo sapiens
atgctggccttgccacactc

SEQ ID NO: 5258316 - DNA, 21 bp, Homo sapiens
atgctggctatagatgtcttt

SEQ ID NO: 5258317 - DNA, 18 bp, Homo sapiens
atgctggctcccagggcc

SEQ ID NO: 5258318 - DNA, 19 bp, Homo sapiens
atgctggctcccagggcca

SEQ ID NO: 5258319 - DNA, 22 bp, Homo sapiens
atgctggctgagctgaacacat

SEQ ID NO: 5258320 - DNA, 11 bp, Homo sapiens
atgctggctgg

SEQ ID NO: 5258321 - DNA, 12 bp, Homo sapiens
atgctggctggc

SEQ ID NO: 5258322 - DNA, 13 bp, Homo sapiens
atgctggctgggg

SEQ ID NO: 5258323 - DNA, 15 bp, Homo sapiens
atgctggctggggcc

SEQ ID NO: 5258324 - DNA, 10 bp, Homo sapiens
atgctgggac

SEQ ID NO: 5258325 - DNA, 22 bp, Homo sapiens
atgctgggcactgccagactga

SEQ ID NO: 5258326 - DNA, 18 bp, Homo sapiens
atgctgggcccctgctca

SEQ ID NO: 5258327 - DNA, 12 bp, Homo sapiens
atgctgggctgg

SEQ ID NO: 5258328 - DNA, 14 bp, Homo sapiens
atgctgggctgggc

SEQ ID NO: 5258329 - DNA, 16 bp, Homo sapiens
atgctgggctgggccc

SEQ ID NO: 5258330 - DNA, 18 bp, Homo sapiens
atgctgggctgggccctc

SEQ ID NO: 5258331 - DNA, 17 bp, Homo sapiens
atgctggggtacacagt

SEQ ID NO: 5258332 - DNA, 20 bp, Homo sapiens
atgctggggtacacagtgag

SEQ ID NO: 5258333 - DNA, 22 bp, Homo sapiens
atgctgggtctgaggcccctgc

SEQ ID NO: 5258334 - DNA, 21 bp, Homo sapiens
atgctgggttctggggctgag

SEQ ID NO: 5258335 - DNA, 22 bp, Homo sapiens
atgctgggttctggggctgaga

SEQ ID NO: 5258336 - DNA, 23 bp, Homo sapiens
atgctgggttggtgcacagtgat

SEQ ID NO: 5258337 - DNA, 21 bp, Homo sapiens
atgctggtagatgctgaggcc

SEQ ID NO: 5258338 - DNA, 17 bp, Homo sapiens
atgctggtagctagtga

SEQ ID NO: 5258339 - DNA, 18 bp, Homo sapiens
atgctggtggaaagatag

SEQ ID NO: 5258340 - DNA, 21 bp, Homo sapiens
atgctggtggaggaagggctg

SEQ ID NO: 5258341 - DNA, 23 bp, Homo sapiens
atgctggtggaggaagggctggg

SEQ ID NO: 5258342 - DNA, 13 bp, Homo sapiens
atgctgtaaatag

SEQ ID NO: 5258343 - DNA, 17 bp, Homo sapiens
atgctgtaaatatttca

SEQ ID NO: 5258344 - DNA, 22 bp, Homo sapiens
atgctgtaaatatttcataaat

SEQ ID NO: 5258345 - DNA, 16 bp, Homo sapiens
atgctgtacatacttt

SEQ ID NO: 5258346 - DNA, 23 bp, Homo sapiens
atgctgtacatctattttggatt

SEQ ID NO: 5258347 - DNA, 16 bp, Homo sapiens
atgctgtacccagttt

SEQ ID NO: 5258348 - DNA, 16 bp, Homo sapiens
atgctgtacctggctg

SEQ ID NO: 5258349 - DNA, 17 bp, Homo sapiens
atgctgtacctggctga

SEQ ID NO: 5258350 - DNA, 21 bp, Homo sapiens
atgctgtacttgtggttctct

SEQ ID NO: 5258351 - DNA, 16 bp, Homo sapiens
atgctgtagctgaaag

SEQ ID NO: 5258352 - DNA, 14 bp, Homo sapiens
atgctgtatatgtt

SEQ ID NO: 5258353 - DNA, 19 bp, Homo sapiens
atgctgtattcttctttgg

SEQ ID NO: 5258354 - DNA, 12 bp, Homo sapiens
atgctgtatttc

SEQ ID NO: 5258355 - DNA, 13 bp, Homo sapiens
atgctgtatttct

SEQ ID NO: 5258356 - DNA, 18 bp, Homo sapiens
atgctgtatttctttgta

SEQ ID NO: 5258357 - DNA, 21 bp, Homo sapiens
atgctgtatttctttgtagaa

SEQ ID NO: 5258358 - DNA, 14 bp, Homo sapiens
atgctgtatttgct

SEQ ID NO: 5258359 - DNA, 23 bp, Homo sapiens
atgctgtattttaaaagaatgat

SEQ ID NO: 5258360 - DNA, 20 bp, Homo sapiens
atgctgtcaactatgatatg

SEQ ID NO: 5258361 - DNA, 20 bp, Homo sapiens
atgctgtcaatattggtgta

SEQ ID NO: 5258362 - DNA, 19 bp, Homo sapiens
atgctgtcactggcagagc

SEQ ID NO: 5258363 - DNA, 20 bp, Homo sapiens
atgctgtcactggcagagca

SEQ ID NO: 5258364 - DNA, 20 bp, Homo sapiens
atgctgtcaggagatggaag

SEQ ID NO: 5258365 - DNA, 16 bp, Homo sapiens
atgctgtccctgcact

SEQ ID NO: 5258366 - DNA, 20 bp, Homo sapiens
atgctgtccctgtgggctca

SEQ ID NO: 5258367 - DNA, 21 bp, Homo sapiens
atgctgtccctgtgggctcac

SEQ ID NO: 5258368 - DNA, 19 bp, Homo sapiens
atgctgtcccttacgtgag

SEQ ID NO: 5258369 - DNA, 23 bp, Homo sapiens
atgctgtctacactaagagagaa

SEQ ID NO: 5258370 - DNA, 23 bp, Homo sapiens
atgctgtctccataatgccactg

SEQ ID NO: 5258371 - DNA, 18 bp, Homo sapiens
atgctgtctttcttgctc

SEQ ID NO: 5258372 - DNA, 21 bp, Homo sapiens
atgctgtgaattttacaaaaa

SEQ ID NO: 5258373 - DNA, 21 bp, Homo sapiens
atgctgtgagtctttggttct

SEQ ID NO: 5258374 - DNA, 14 bp, Homo sapiens
atgctgtgatacct

SEQ ID NO: 5258375 - DNA, 15 bp, Homo sapiens
atctgagttgtgcct

SEQ ID NO: 5258376 - DNA, 18 bp, Homo sapiens
atctgataaaattgtgat

SEQ ID NO: 5258377 - DNA, 17 bp, Homo sapiens
atctgataaagttgaga

SEQ ID NO: 5258378 - DNA, 22 bp, Homo sapiens
atctgataaagttgagagacag

SEQ ID NO: 5258379 - DNA, 22 bp, Homo sapiens
atctgataccaaagagacaggg

SEQ ID NO: 5258380 - DNA, 20 bp, Homo sapiens
atctgatatcagcactggat

SEQ ID NO: 5258381 - DNA, 21 bp, Homo sapiens
atctgatatcagcactggatt

SEQ ID NO: 5258382 - DNA, 22 bp, Homo sapiens
atctgatatcaggaaatatctg

SEQ ID NO: 5258383 - DNA, 14 bp, Homo sapiens
atctgatatgtatt

SEQ ID NO: 5258384 - DNA, 19 bp, Homo sapiens
atctgatattcaaacacac

SEQ ID NO: 5258385 - DNA, 20 bp, Homo sapiens
atctgatcaagagtccggat

SEQ ID NO: 5258386 - DNA, 17 bp, Homo sapiens
atctgatcacttcatgt

SEQ ID NO: 5258387 - DNA, 15 bp, Homo sapiens
atctgatctgtacca

SEQ ID NO: 5258388 - DNA, 17 bp, Homo sapiens
atctgatgatgttctga

SEQ ID NO: 5258389 - DNA, 18 bp, Homo sapiens
atctgatgcaagcaagaa

SEQ ID NO: 5258390 - DNA, 16 bp, Homo sapiens
atctgatgcatgcttt

SEQ ID NO: 5258391 - DNA, 24 bp, Homo sapiens
atctgatggctcctgcagcacttt

SEQ ID NO: 5258392 - DNA, 14 bp, Homo sapiens
atctgatgggcctg

SEQ ID NO: 5258393 - DNA, 17 bp, Homo sapiens
atctgatgggcctggct

SEQ ID NO: 5258394 - DNA, 20 bp, Homo sapiens
atctgatgggcctggctggg

SEQ ID NO: 5258395 - DNA, 23 bp, Homo sapiens
atctgatgggcctggctgggagt

SEQ ID NO: 5258396 - DNA, 13 bp, Homo sapiens
atctgatgtataa

SEQ ID NO: 5258397 - DNA, 21 bp, Homo sapiens
atctgatgtttgttttcgatg

SEQ ID NO: 5258398 - DNA, 13 bp, Homo sapiens
atctgattagaag

SEQ ID NO: 5258399 - DNA, 14 bp, Homo sapiens
atctgattccagca

SEQ ID NO: 5258400 - DNA, 14 bp, Homo sapiens
atctgattccttta

SEQ ID NO: 5258401 - DNA, 23 bp, Homo sapiens
atctgattgagtcagtgtttgct

SEQ ID NO: 5258402 - DNA, 18 bp, Homo sapiens
atctgattggacattttc

SEQ ID NO: 5258403 - DNA, 19 bp, Homo sapiens
atctgattggacattttct

SEQ ID NO: 5258404 - DNA, 11 bp, Homo sapiens
atctgatttaa

SEQ ID NO: 5258405 - DNA, 17 bp, Homo sapiens
atctgatttaatgtttt

SEQ ID NO: 5258406 - DNA, 19 bp, Homo sapiens
atctgatttaatgttttct

SEQ ID NO: 5258407 - DNA, 21 bp, Homo sapiens
atctgatttaatgttttctgc

SEQ ID NO: 5258408 - DNA, 12 bp, Homo sapiens
atctgatttact

SEQ ID NO: 5258409 - DNA, 21 bp, Homo sapiens
atctgatttactctttgggat

SEQ ID NO: 5258410 - DNA, 13 bp, Homo sapiens
atctgatttatac

SEQ ID NO: 5258411 - DNA, 14 bp, Homo sapiens
atctgatttcatta

SEQ ID NO: 5258412 - DNA, 22 bp, Homo sapiens
atctgatttcattacatttctg

SEQ ID NO: 5258413 - DNA, 14 bp, Homo sapiens
atctgatttctgaa

SEQ ID NO: 5258414 - DNA, 13 bp, Homo sapiens
atctgatttgcat

SEQ ID NO: 5258415 - DNA, 22 bp, Homo sapiens
atctgattttttattcaacaaa

SEQ ID NO: 5258416 - DNA, 11 bp, Homo sapiens
atctgcaaaag

SEQ ID NO: 5258417 - DNA, 19 bp, Homo sapiens
atctgcaaaatgtagaaat

SEQ ID NO: 5258418 - DNA, 21 bp, Homo sapiens
atctgcaaagcatgttttgca

SEQ ID NO: 5258419 - DNA, 22 bp, Homo sapiens
atctgcaaagcatgttttgcat

SEQ ID NO: 5258420 - DNA, 13 bp, Homo sapiens
atctgcaaatagt

SEQ ID NO: 5258421 - DNA, 18 bp, Homo sapiens
atctgcaaatagtttcaa

SEQ ID NO: 5258422 - DNA, 23 bp, Homo sapiens
atctgcaaatagtttcaaatgag

SEQ ID NO: 5258423 - DNA, 14 bp, Homo sapiens
atctgcaacaaaaa

SEQ ID NO: 5258424 - DNA, 19 bp, Homo sapiens
atctgcaaggattttttaa

SEQ ID NO: 5258425 - DNA, 18 bp, Homo sapiens
atctgcaatttctactac

SEQ ID NO: 5258426 - DNA, 18 bp, Homo sapiens
atctgcacacacctccga

SEQ ID NO: 5258427 - DNA, 20 bp, Homo sapiens
atctgcacactctcttctcc

SEQ ID NO: 5258428 - DNA, 18 bp, Homo sapiens
atctgcaccaccatgccc

SEQ ID NO: 5258429 - DNA, 17 bp, Homo sapiens
atctgcacccttctttt

SEQ ID NO: 5258430 - DNA, 22 bp, Homo sapiens
atctgcacctagaacctccctc

SEQ ID NO: 5258431 - DNA, 14 bp, Homo sapiens
atctgcactgggtg

SEQ ID NO: 5258432 - DNA, 17 bp, Homo sapiens
atctgcagaatgggcca

SEQ ID NO: 5258433 - DNA, 18 bp, Homo sapiens
atctgcagagcaatgact

SEQ ID NO: 5258434 - DNA, 14 bp, Homo sapiens
atctgcagcacatt

SEQ ID NO: 5258435 - DNA, 19 bp, Homo sapiens
atctgcagctctttcttct

SEQ ID NO: 5258436 - DNA, 14 bp, Homo sapiens
atctgcaggcagac

SEQ ID NO: 5258437 - DNA, 16 bp, Homo sapiens
atctgcaggctgcacc

SEQ ID NO: 5258438 - DNA, 12 bp, Homo sapiens
atctgcagggag

SEQ ID NO: 5258439 - DNA, 14 bp, Homo sapiens
atctgcagggagca

SEQ ID NO: 5258440 - DNA, 19 bp, Homo sapiens
atctgcagtacagtcttat

SEQ ID NO: 5258441 - DNA, 23 bp, Homo sapiens
atctgcagtgttctgtgaatagc

SEQ ID NO: 5258442 - DNA, 15 bp, Homo sapiens
atctgcagtttgtga

SEQ ID NO: 5258443 - DNA, 18 bp, Homo sapiens
atctgcagtttgtgaact

SEQ ID NO: 5258444 - DNA, 14 bp, Homo sapiens
atctgcatatttct

SEQ ID NO: 5258445 - DNA, 15 bp, Homo sapiens
atctgcatatttctg

SEQ ID NO: 5258446 - DNA, 16 bp, Homo sapiens
atctgcatcttaacat

SEQ ID NO: 5258447 - DNA, 22 bp, Homo sapiens
atctgcatgtaaaatcttcagc

SEQ ID NO: 5258448 - DNA, 11 bp, Homo sapiens
atctgcatgtg

SEQ ID NO: 5258449 - DNA, 12 bp, Homo sapiens
atctgcattatc

SEQ ID NO: 5258450 - DNA, 22 bp, Homo sapiens
atctgcattccccgctgcccaa

SEQ ID NO: 5258451 - DNA, 16 bp, Homo sapiens
atctgcattgcccagt

SEQ ID NO: 5258452 - DNA, 20 bp, Homo sapiens
atctgcattgcccagtcttt

SEQ ID NO: 5258453 - DNA, 18 bp, Homo sapiens
atctgcatttaccactgt

SEQ ID NO: 5258454 - DNA, 23 bp, Homo sapiens
atctgcattttcaccccaccctt

SEQ ID NO: 5258455 - DNA, 19 bp, Homo sapiens
atctgccaagagagatgta

SEQ ID NO: 5258456 - DNA, 16 bp, Homo sapiens
atctgccaagggccga

SEQ ID NO: 5258457 - DNA, 18 bp, Homo sapiens
atctgccaatgccatgac

SEQ ID NO: 5258458 - DNA, 15 bp, Homo sapiens
atctgccacaaaaac

SEQ ID NO: 5258459 - DNA, 15 bp, Homo sapiens
atctgccagaaaact

SEQ ID NO: 5258460 - DNA, 12 bp, Homo sapiens
atctgccagacc

SEQ ID NO: 5258461 - DNA, 16 bp, Homo sapiens
atctgccagacctgca

SEQ ID NO: 5258462 - DNA, 19 bp, Homo sapiens
atctgccagacctgcatgg

SEQ ID NO: 5258463 - DNA, 17 bp, Homo sapiens
atctgccagaccttaat

SEQ ID NO: 5258464 - DNA, 22 bp, Homo sapiens
atctgccattgggaccctccag

SEQ ID NO: 5258465 - DNA, 21 bp, Homo sapiens
atctgcccaactgtgtagcat

SEQ ID NO: 5258466 - DNA, 15 bp, Homo sapiens
atctgcccacctcag

SEQ ID NO: 5258467 - DNA, 23 bp, Homo sapiens
atctgcccacctcagcctcccaa

SEQ ID NO: 5258468 - DNA, 23 bp, Homo sapiens
atctgcccaggggtgccccctcc

SEQ ID NO: 5258469 - DNA, 16 bp, Homo sapiens
atctgcccctccctgc

SEQ ID NO: 5258470 - DNA, 17 bp, Homo sapiens
atctgcccgcctgccca

SEQ ID NO: 5258471 - DNA, 19 bp, Homo sapiens
atctgcccgcctgcccacc

SEQ ID NO: 5258472 - DNA, 20 bp, Homo sapiens
atctgcccgcctgcccacct

SEQ ID NO: 5258473 - DNA, 23 bp, Homo sapiens
atctgcccgcctgcccacctgcc

SEQ ID NO: 5258474 - DNA, 22 bp, Homo sapiens
atctgccgctttgtctgtccag

SEQ ID NO: 5258475 - DNA, 17 bp, Homo sapiens
atctgcctaaggacttc

SEQ ID NO: 5258476 - DNA, 18 bp, Homo sapiens
atctgcctaaggacttct

SEQ ID NO: 5258477 - DNA, 21 bp, Homo sapiens
atctgcctaaggacttcttta

SEQ ID NO: 5258478 - DNA, 14 bp, Homo sapiens
atctgcctgcagtg

SEQ ID NO: 5258479 - DNA, 15 bp, Homo sapiens
atctgcctgcgctct

SEQ ID NO: 5258480 - DNA, 14 bp, Homo sapiens
atctgcctggagcc

SEQ ID NO: 5258481 - DNA, 16 bp, Homo sapiens
atctgcctggaggcaa

SEQ ID NO: 5258482 - DNA, 15 bp, Homo sapiens
atctgcctggcctgg

SEQ ID NO: 5258483 - DNA, 11 bp, Homo sapiens
atctgcctggg

SEQ ID NO: 5258484 - DNA, 16 bp, Homo sapiens
atctgcctgggcctgt

SEQ ID NO: 5258485 - DNA, 23 bp, Homo sapiens
atctgcctgggcctgtgcagcag

SEQ ID NO: 5258486 - DNA, 14 bp, Homo sapiens
atctgcctgtaatt

SEQ ID NO: 5258487 - DNA, 15 bp, Homo sapiens
atctgcctgtggcct

SEQ ID NO: 5258488 - DNA, 19 bp, Homo sapiens
atctgccttaaaaccaaag

SEQ ID NO: 5258489 - DNA, 21 bp, Homo sapiens
atctgccttaaaaccaaagag

SEQ ID NO: 5258490 - DNA, 13 bp, Homo sapiens
atctgccttccag

SEQ ID NO: 5258491 - DNA, 15 bp, Homo sapiens
atctgccttgctgca

SEQ ID NO: 5258492 - DNA, 15 bp, Homo sapiens
atctgcgcagggtgg

SEQ ID NO: 5258493 - DNA, 15 bp, Homo sapiens
atctgcggggcttct

SEQ ID NO: 5258494 - DNA, 18 bp, Homo sapiens
atctgcgggggcagtgct

SEQ ID NO: 5258495 - DNA, 16 bp, Homo sapiens
atctgcgtgacaataa

SEQ ID NO: 5258496 - DNA, 16 bp, Homo sapiens
atctgctaagtaattt

SEQ ID NO: 5258497 - DNA, 20 bp, Homo sapiens
atctgctaagtaatttagaa

SEQ ID NO: 5258498 - DNA, 18 bp, Homo sapiens
atctgctaccaaaacagt

SEQ ID NO: 5258499 - DNA, 13 bp, Homo sapiens
atctgctagaaag

SEQ ID NO: 5258500 - DNA, 14 bp, Homo sapiens
atctgctagtgctg

SEQ ID NO: 5258501 - DNA, 20 bp, Homo sapiens
atctgctagtgctgtaatat

SEQ ID NO: 5258502 - DNA, 15 bp, Homo sapiens
atctgctcagcaggc

SEQ ID NO: 5258503 - DNA, 16 bp, Homo sapiens
atctgctcagccctgg

SEQ ID NO: 5258504 - DNA, 20 bp, Homo sapiens
atctgctcagccctggaggt

SEQ ID NO: 5258505 - DNA, 13 bp, Homo sapiens
atctgctcatctg

SEQ ID NO: 5258506 - DNA, 15 bp, Homo sapiens
atctgctcctcccat

SEQ ID NO: 5258507 - DNA, 23 bp, Homo sapiens
atctgctcgcctgagggaagagt

SEQ ID NO: 5258508 - DNA, 18 bp, Homo sapiens
atctgctctagattcata

SEQ ID NO: 5258509 - DNA, 21 bp, Homo sapiens
atctgctctagattcataaat

SEQ ID NO: 5258510 - DNA, 13 bp, Homo sapiens
atctgctctcctt

SEQ ID NO: 5258511 - DNA, 21 bp, Homo sapiens
atctgctctccttcctggagc

SEQ ID NO: 5258512 - DNA, 13 bp, Homo sapiens
atctgctctgaga

SEQ ID NO: 5258513 - DNA, 15 bp, Homo sapiens
atctgctctgtttta

SEQ ID NO: 5258514 - DNA, 20 bp, Homo sapiens
atctgctctgttttatacta

SEQ ID NO: 5258515 - DNA, 18 bp, Homo sapiens
atctgctgagctctgacc

SEQ ID NO: 5258516 - DNA, 13 bp, Homo sapiens
atctgctgcagtt

SEQ ID NO: 5258517 - DNA, 17 bp, Homo sapiens
atctgctgcatagctct

SEQ ID NO: 5258518 - DNA, 23 bp, Homo sapiens
atctgctgcatagctctatttta

SEQ ID NO: 5258519 - DNA, 15 bp, Homo sapiens
atctgctgcctctga

SEQ ID NO: 5258520 - DNA, 17 bp, Homo sapiens
atctgctgctgaaactg

SEQ ID NO: 5258521 - DNA, 18 bp, Homo sapiens
atctgctgctgaaactgt

SEQ ID NO: 5258522 - DNA, 13 bp, Homo sapiens
atctgctgggaac

SEQ ID NO: 5258523 - DNA, 17 bp, Homo sapiens
atctgctgtaataatat

SEQ ID NO: 5258524 - DNA, 12 bp, Homo sapiens
atctgctgtctt

SEQ ID NO: 5258525 - DNA, 13 bp, Homo sapiens
atctgctgtcttt

SEQ ID NO: 5258526 - DNA, 22 bp, Homo sapiens
atctgctgtgactgtggccctg

SEQ ID NO: 5258527 - DNA, 21 bp, Homo sapiens
atctgcttacaattccctgct

SEQ ID NO: 5258528 - DNA, 14 bp, Homo sapiens
atctgcttccctgg

SEQ ID NO: 5258529 - DNA, 21 bp, Homo sapiens
atctgcttccctggggcccca

SEQ ID NO: 5258530 - DNA, 13 bp, Homo sapiens
atctgcttctcca

SEQ ID NO: 5258531 - DNA, 19 bp, Homo sapiens
atctgcttcttagagaggc

SEQ ID NO: 5258532 - DNA, 13 bp, Homo sapiens
atctgctttagtt

SEQ ID NO: 5258533 - DNA, 20 bp, Homo sapiens
atctgctttagtttcacatt

SEQ ID NO: 5258534 - DNA, 14 bp, Homo sapiens
atctgctttattgc

SEQ ID NO: 5258535 - DNA, 17 bp, Homo sapiens
atctgctttcatccagc

SEQ ID NO: 5258536 - DNA, 17 bp, Homo sapiens
atctgctttctgttcat

SEQ ID NO: 5258537 - DNA, 15 bp, Homo sapiens
atctgctttgttaat

SEQ ID NO: 5258538 - DNA, 16 bp, Homo sapiens
atctgcttttattaaa

SEQ ID NO: 5258539 - DNA, 13 bp, Homo sapiens
atctggaaatctg

SEQ ID NO: 5258540 - DNA, 20 bp, Homo sapiens
atctggaacctcagcctggc

SEQ ID NO: 5258541 - DNA, 22 bp, Homo sapiens
atctggaacctcagcctggcca

SEQ ID NO: 5258542 - DNA, 18 bp, Homo sapiens
atctggaacgctctaggc

SEQ ID NO: 5258543 - DNA, 14 bp, Homo sapiens
atctggaagaaaaa

SEQ ID NO: 5258544 - DNA, 21 bp, Homo sapiens
atctggaagggcactatattt

SEQ ID NO: 5258545 - DNA, 17 bp, Homo sapiens
atctggaatattgtgat

SEQ ID NO: 5258546 - DNA, 15 bp, Homo sapiens
atctggaatctgagg

SEQ ID NO: 5258547 - DNA, 15 bp, Homo sapiens
atctggacacttctt

SEQ ID NO: 5258548 - DNA, 17 bp, Homo sapiens
atctggactcctctgtc

SEQ ID NO: 5258549 - DNA, 22 bp, Homo sapiens
atctggactcctctgtccaggc

SEQ ID NO: 5258550 - DNA, 20 bp, Homo sapiens
atctggagagctagaacctg

SEQ ID NO: 5258551 - DNA, 22 bp, Homo sapiens
atctggagagctagaacctgga

SEQ ID NO: 5258552 - DNA, 13 bp, Homo sapiens
atctggagtccct

SEQ ID NO: 5258553 - DNA, 22 bp, Homo sapiens
atctggagtccctcctccccca

SEQ ID NO: 5258554 - DNA, 19 bp, Homo sapiens
atgctgtgcaaacagtgta

SEQ ID NO: 5258555 - DNA, 14 bp, Homo sapiens
atgctgtgcccctg

SEQ ID NO: 5258556 - DNA, 18 bp, Homo sapiens
atgctgtgctaaatatca

SEQ ID NO: 5258557 - DNA, 14 bp, Homo sapiens
atgctgtgctacgt

SEQ ID NO: 5258558 - DNA, 18 bp, Homo sapiens
atgctgtgctccatattt

SEQ ID NO: 5258559 - DNA, 14 bp, Homo sapiens
atgctgtgctcttt

SEQ ID NO: 5258560 - DNA, 18 bp, Homo sapiens
atgctgtggttcactgca

SEQ ID NO: 5258561 - DNA, 17 bp, Homo sapiens
atgctgtgtaacagaac

SEQ ID NO: 5258562 - DNA, 23 bp, Homo sapiens
atgctgtgtacaacaatgctttg

SEQ ID NO: 5258563 - DNA, 14 bp, Homo sapiens
atgctgtgtgactc

SEQ ID NO: 5258564 - DNA, 14 bp, Homo sapiens
atgctgtgtgcaga

SEQ ID NO: 5258565 - DNA, 17 bp, Homo sapiens
atgctgtgtgcagagta

SEQ ID NO: 5258566 - DNA, 14 bp, Homo sapiens
atgctgtgtgccca

SEQ ID NO: 5258567 - DNA, 22 bp, Homo sapiens
atgctgtgtgcccaagtgggca

SEQ ID NO: 5258568 - DNA, 21 bp, Homo sapiens
atgctgttaatatttctaaaa

SEQ ID NO: 5258569 - DNA, 18 bp, Homo sapiens
atgctgttatgtccagaa

SEQ ID NO: 5258570 - DNA, 20 bp, Homo sapiens
atgctgttatgtccagaaat

SEQ ID NO: 5258571 - DNA, 14 bp, Homo sapiens
atgctgttcattga

SEQ ID NO: 5258572 - DNA, 16 bp, Homo sapiens
atgctgttctcaatca

SEQ ID NO: 5258573 - DNA, 13 bp, Homo sapiens
atgctgttctctt

SEQ ID NO: 5258574 - DNA, 19 bp, Homo sapiens
atgctgttctcttcttcat

SEQ ID NO: 5258575 - DNA, 15 bp, Homo sapiens
atgctgttctctttg

SEQ ID NO: 5258576 - DNA, 16 bp, Homo sapiens
atgctgttgattgcta

SEQ ID NO: 5258577 - DNA, 18 bp, Homo sapiens
atgctgttgattgctaaa

SEQ ID NO: 5258578 - DNA, 17 bp, Homo sapiens
atgctgttgcctcatct

SEQ ID NO: 5258579 - DNA, 17 bp, Homo sapiens
atgctgttgtgaagcta

SEQ ID NO: 5258580 - DNA, 17 bp, Homo sapiens
atgctgtttatgacaca

SEQ ID NO: 5258581 - DNA, 14 bp, Homo sapiens
atgctgtttcagag

SEQ ID NO: 5258582 - DNA, 20 bp, Homo sapiens
atgctgtttctaagaaaatg

SEQ ID NO: 5258583 - DNA, 11 bp, Homo sapiens
atgctgtttgt

SEQ ID NO: 5258584 - DNA, 16 bp, Homo sapiens
atgctgtttgtacaaa

SEQ ID NO: 5258585 - DNA, 18 bp, Homo sapiens
atgctgtttgtacaaact

SEQ ID NO: 5258586 - DNA, 15 bp, Homo sapiens
atgctgttttaataa

SEQ ID NO: 5258587 - DNA, 20 bp, Homo sapiens
atgctgttttaataattatg

SEQ ID NO: 5258588 - DNA, 18 bp, Homo sapiens
atgcttaaaaaataatac

SEQ ID NO: 5258589 - DNA, 16 bp, Homo sapiens
atgcttaaaataagca

SEQ ID NO: 5258590 - DNA, 13 bp, Homo sapiens
atgcttaaaatat

SEQ ID NO: 5258591 - DNA, 18 bp, Homo sapiens
atgcttaaaatatgtatg

SEQ ID NO: 5258592 - DNA, 22 bp, Homo sapiens
atgcttaaaatatgtatgtcta

SEQ ID NO: 5258593 - DNA, 20 bp, Homo sapiens
atgcttaaactaaataatga

SEQ ID NO: 5258594 - DNA, 20 bp, Homo sapiens
atgcttaaagaattcaaatt

SEQ ID NO: 5258595 - DNA, 14 bp, Homo sapiens
atgcttaaatttca

SEQ ID NO: 5258596 - DNA, 14 bp, Homo sapiens
atgcttaataaaag

SEQ ID NO: 5258597 - DNA, 20 bp, Homo sapiens
atgcttaataaaagaacatg

SEQ ID NO: 5258598 - DNA, 21 bp, Homo sapiens
atgcttaataaacatgtcaca

SEQ ID NO: 5258599 - DNA, 23 bp, Homo sapiens
atgcttaataataattgaagaat

SEQ ID NO: 5258600 - DNA, 23 bp, Homo sapiens
atgcttaattttaattggaggaa

SEQ ID NO: 5258601 - DNA, 15 bp, Homo sapiens
atgcttacaaaaaag

SEQ ID NO: 5258602 - DNA, 22 bp, Homo sapiens
atgcttacaggaaaacctgcag

SEQ ID NO: 5258603 - DNA, 14 bp, Homo sapiens
atgcttacagtgac

SEQ ID NO: 5258604 - DNA, 15 bp, Homo sapiens
atgcttacagtgact

SEQ ID NO: 5258605 - DNA, 19 bp, Homo sapiens
atgcttacggccatctctt

SEQ ID NO: 5258606 - DNA, 23 bp, Homo sapiens
atgcttacgtgatcctctcacct

SEQ ID NO: 5258607 - DNA, 13 bp, Homo sapiens
atgcttactattt

SEQ ID NO: 5258608 - DNA, 15 bp, Homo sapiens
atgcttactcttgct

SEQ ID NO: 5258609 - DNA, 13 bp, Homo sapiens
atgcttactgata

SEQ ID NO: 5258610 - DNA, 23 bp, Homo sapiens
atgcttactgatatattttacaa

SEQ ID NO: 5258611 - DNA, 14 bp, Homo sapiens
atgcttacttttta

SEQ ID NO: 5258612 - DNA, 20 bp, Homo sapiens
atgcttagaattctgagatc

SEQ ID NO: 5258613 - DNA, 13 bp, Homo sapiens
atgcttagagcat

SEQ ID NO: 5258614 - DNA, 17 bp, Homo sapiens
atgcttagatgttccag

SEQ ID NO: 5258615 - DNA, 23 bp, Homo sapiens
atgcttagcttatctttctttcc

SEQ ID NO: 5258616 - DNA, 23 bp, Homo sapiens
atgcttagtcactgcctgcagag

SEQ ID NO: 5258617 - DNA, 15 bp, Homo sapiens
atgcttagtccctca

SEQ ID NO: 5258618 - DNA, 20 bp, Homo sapiens
atgcttagtgtgaagttgat

SEQ ID NO: 5258619 - DNA, 13 bp, Homo sapiens
atgcttataacat

SEQ ID NO: 5258620 - DNA, 19 bp, Homo sapiens
atgcttatcatctaaagat

SEQ ID NO: 5258621 - DNA, 15 bp, Homo sapiens
atgcttatgacaatg

SEQ ID NO: 5258622 - DNA, 13 bp, Homo sapiens
atgcttatgttaa

SEQ ID NO: 5258623 - DNA, 17 bp, Homo sapiens
atgcttatgttaaactc

SEQ ID NO: 5258624 - DNA, 17 bp, Homo sapiens
atgcttattagcagctg

SEQ ID NO: 5258625 - DNA, 13 bp, Homo sapiens
atgcttattccat

SEQ ID NO: 5258626 - DNA, 22 bp, Homo sapiens
atgcttattccatgactgcttg

SEQ ID NO: 5258627 - DNA, 23 bp, Homo sapiens
atgcttattccatgactgcttgc

SEQ ID NO: 5258628 - DNA, 16 bp, Homo sapiens
atgcttattttaaaat

SEQ ID NO: 5258629 - DNA, 18 bp, Homo sapiens
atgcttcaaactaacaca

SEQ ID NO: 5258630 - DNA, 20 bp, Homo sapiens
atgcttcaaagtccacatta

SEQ ID NO: 5258631 - DNA, 16 bp, Homo sapiens
atgcttcaagtgttgc

SEQ ID NO: 5258632 - DNA, 16 bp, Homo sapiens
atgcttcagtggaaat

SEQ ID NO: 5258633 - DNA, 17 bp, Homo sapiens
atgcttcagttgtactt

SEQ ID NO: 5258634 - DNA, 13 bp, Homo sapiens
atgcttcatacag

SEQ ID NO: 5258635 - DNA, 15 bp, Homo sapiens
atgcttcatacaggg

SEQ ID NO: 5258636 - DNA, 19 bp, Homo sapiens
atgcttcatacagggatgg

SEQ ID NO: 5258637 - DNA, 19 bp, Homo sapiens
atgcttcatcattccctct

SEQ ID NO: 5258638 - DNA, 20 bp, Homo sapiens
atgcttcatcattccctctc

SEQ ID NO: 5258639 - DNA, 15 bp, Homo sapiens
atgcttcatgaattt

SEQ ID NO: 5258640 - DNA, 21 bp, Homo sapiens
atgcttcattcaatattgaca

SEQ ID NO: 5258641 - DNA, 21 bp, Homo sapiens
atgcttcatttgtatgtcaaa

SEQ ID NO: 5258642 - DNA, 20 bp, Homo sapiens
atgcttccaatcttgctttg

SEQ ID NO: 5258643 - DNA, 19 bp, Homo sapiens
atgcttccagggacaagct

SEQ ID NO: 5258644 - DNA, 19 bp, Homo sapiens
atgcttccattaacaaatg

SEQ ID NO: 5258645 - DNA, 22 bp, Homo sapiens
atgcttccattaacaaatgctc

SEQ ID NO: 5258646 - DNA, 15 bp, Homo sapiens
atgcttcccagaggg

SEQ ID NO: 5258647 - DNA, 18 bp, Homo sapiens
atgcttcccagagggagc

SEQ ID NO: 5258648 - DNA, 18 bp, Homo sapiens
atgcttccctgcagctga

SEQ ID NO: 5258649 - DNA, 20 bp, Homo sapiens
atgcttccctgcagctgacc

SEQ ID NO: 5258650 - DNA, 15 bp, Homo sapiens
atgcttcctagaagt

SEQ ID NO: 5258651 - DNA, 16 bp, Homo sapiens
atgcttcctagaagtt

SEQ ID NO: 5258652 - DNA, 21 bp, Homo sapiens
atgcttcctagaagttactga

SEQ ID NO: 5258653 - DNA, 21 bp, Homo sapiens
atgcttccttgcctgatgaca

SEQ ID NO: 5258654 - DNA, 19 bp, Homo sapiens
atgcttcctttctctcctg

SEQ ID NO: 5258655 - DNA, 20 bp, Homo sapiens
atgcttcctttctctcctgg

SEQ ID NO: 5258656 - DNA, 22 bp, Homo sapiens
atgcttcctttctctcctggct

SEQ ID NO: 5258657 - DNA, 23 bp, Homo sapiens
atgcttcctttctctcctggctc

SEQ ID NO: 5258658 - DNA, 21 bp, Homo sapiens
atgcttctaagtaaatacaat

SEQ ID NO: 5258659 - DNA, 17 bp, Homo sapiens
atgcttctactgtgaca

SEQ ID NO: 5258660 - DNA, 12 bp, Homo sapiens
atgcttctatca

SEQ ID NO: 5258661 - DNA, 15 bp, Homo sapiens
atgcttctatcagac

SEQ ID NO: 5258662 - DNA, 19 bp, Homo sapiens
atgcttctatcagactcag

SEQ ID NO: 5258663 - DNA, 22 bp, Homo sapiens
atgcttctctcatagtgtcata

SEQ ID NO: 5258664 - DNA, 20 bp, Homo sapiens
atgcttctgcctattgctga

SEQ ID NO: 5258665 - DNA, 13 bp, Homo sapiens
atgcttctgcctc

SEQ ID NO: 5258666 - DNA, 14 bp, Homo sapiens
atgcttctgctcac

SEQ ID NO: 5258667 - DNA, 15 bp, Homo sapiens
atgcttctgctcaca

SEQ ID NO: 5258668 - DNA, 19 bp, Homo sapiens
atgcttctgctcacattcc

SEQ ID NO: 5258669 - DNA, 22 bp, Homo sapiens
atgcttctgctcacattccctc

SEQ ID NO: 5258670 - DNA, 23 bp, Homo sapiens
atgcttctgctcacattccctct

SEQ ID NO: 5258671 - DNA, 11 bp, Homo sapiens
atgcttctgta

SEQ ID NO: 5258672 - DNA, 20 bp, Homo sapiens
atgcttcttcagagactcct

SEQ ID NO: 5258673 - DNA, 14 bp, Homo sapiens
atgcttcttctcaa

SEQ ID NO: 5258674 - DNA, 15 bp, Homo sapiens
atgcttcttctcaaa

SEQ ID NO: 5258675 - DNA, 14 bp, Homo sapiens
atgcttcttgcccc

SEQ ID NO: 5258676 - DNA, 15 bp, Homo sapiens
atgcttcttgcccct

SEQ ID NO: 5258677 - DNA, 21 bp, Homo sapiens
atgcttcttgccccttgggcc

SEQ ID NO: 5258678 - DNA, 12 bp, Homo sapiens
atgcttctttaa

SEQ ID NO: 5258679 - DNA, 14 bp, Homo sapiens
atgcttctttcaaa

SEQ ID NO: 5258680 - DNA, 23 bp, Homo sapiens
atgcttctttctactttgtttat

SEQ ID NO: 5258681 - DNA, 15 bp, Homo sapiens
atgcttgaaaaatgt

SEQ ID NO: 5258682 - DNA, 12 bp, Homo sapiens
atgcttgagcaa

SEQ ID NO: 5258683 - DNA, 18 bp, Homo sapiens
atgcttgatggtttatgt

SEQ ID NO: 5258684 - DNA, 19 bp, Homo sapiens
atgcttgcaaaaactacaa

SEQ ID NO: 5258685 - DNA, 17 bp, Homo sapiens
atgcttgcataagagct

SEQ ID NO: 5258686 - DNA, 18 bp, Homo sapiens
atgcttgcataagagctt

SEQ ID NO: 5258687 - DNA, 19 bp, Homo sapiens
atgcttgcatatatttcat

SEQ ID NO: 5258688 - DNA, 18 bp, Homo sapiens
atgcttgcatggagaatg

SEQ ID NO: 5258689 - DNA, 21 bp, Homo sapiens
atgcttgccatctgttcattt

SEQ ID NO: 5258690 - DNA, 16 bp, Homo sapiens
atgcttgcctagggcc

SEQ ID NO: 5258691 - DNA, 21 bp, Homo sapiens
atgcttgcctagggcctggtc

SEQ ID NO: 5258692 - DNA, 22 bp, Homo sapiens
atgcttgcggcaaaaggaaagc

SEQ ID NO: 5258693 - DNA, 15 bp, Homo sapiens
atgcttgcttgggga

SEQ ID NO: 5258694 - DNA, 20 bp, Homo sapiens
atgcttggaatatctgctgt

SEQ ID NO: 5258695 - DNA, 18 bp, Homo sapiens
atgcttggaatgggagag

SEQ ID NO: 5258696 - DNA, 19 bp, Homo sapiens
atgcttggagcaatcagaa

SEQ ID NO: 5258697 - DNA, 15 bp, Homo sapiens
atgcttggcttctca

SEQ ID NO: 5258698 - DNA, 23 bp, Homo sapiens
atgcttgggaagactcctagctg

SEQ ID NO: 5258699 - DNA, 22 bp, Homo sapiens
atgcttgggaccagaagtgttt

SEQ ID NO: 5258700 - DNA, 18 bp, Homo sapiens
atgcttgggccctgcatt

SEQ ID NO: 5258701 - DNA, 22 bp, Homo sapiens
atgcttgggctgacccagcatc

SEQ ID NO: 5258702 - DNA, 13 bp, Homo sapiens
atgcttggttttc

SEQ ID NO: 5258703 - DNA, 15 bp, Homo sapiens
atgcttggttttctt

SEQ ID NO: 5258704 - DNA, 17 bp, Homo sapiens
atgcttgtaacaagaaa

SEQ ID NO: 5258705 - DNA, 18 bp, Homo sapiens
atgcttgtaacaagaaaa

SEQ ID NO: 5258706 - DNA, 20 bp, Homo sapiens
atgcttgtaacaagaaaaca

SEQ ID NO: 5258707 - DNA, 22 bp, Homo sapiens
atgcttgtaatttaaacatttg

SEQ ID NO: 5258708 - DNA, 19 bp, Homo sapiens
atgcttgtgaaaatgtgtt

SEQ ID NO: 5258709 - DNA, 13 bp, Homo sapiens
atgcttgtgtata

SEQ ID NO: 5258710 - DNA, 13 bp, Homo sapiens
atgctttaaacat

SEQ ID NO: 5258711 - DNA, 15 bp, Homo sapiens
atgctttaattgtgt

SEQ ID NO: 5258712 - DNA, 20 bp, Homo sapiens
atgctttaccaaacagcaaa

SEQ ID NO: 5258713 - DNA, 18 bp, Homo sapiens
atgctttagaaaggtttt

SEQ ID NO: 5258714 - DNA, 14 bp, Homo sapiens
atgctttagcttat

SEQ ID NO: 5258715 - DNA, 18 bp, Homo sapiens
atgctttaggatgtacag

SEQ ID NO: 5258716 - DNA, 19 bp, Homo sapiens
atgctttattaatgttttc

SEQ ID NO: 5258717 - DNA, 23 bp, Homo sapiens
atgctttccatatttttttcctt

SEQ ID NO: 5258718 - DNA, 16 bp, Homo sapiens
atgctttccctgagga

SEQ ID NO: 5258719 - DNA, 18 bp, Homo sapiens
atgctttcctccctggca

SEQ ID NO: 5258720 - DNA, 13 bp, Homo sapiens
atgctttcctgtt

SEQ ID NO: 5258721 - DNA, 12 bp, Homo sapiens
atgctttccttc

SEQ ID NO: 5258722 - DNA, 22 bp, Homo sapiens
atgctttccttttcttccttct

SEQ ID NO: 5258723 - DNA, 13 bp, Homo sapiens
atgctttctcatg

SEQ ID NO: 5258724 - DNA, 14 bp, Homo sapiens
atgctttctcatgc

SEQ ID NO: 5258725 - DNA, 15 bp, Homo sapiens
atgctttctcctttt

SEQ ID NO: 5258726 - DNA, 20 bp, Homo sapiens
atgctttctctctagtagtt

SEQ ID NO: 5258727 - DNA, 17 bp, Homo sapiens
atgctttcttcatgttc

SEQ ID NO: 5258728 - DNA, 15 bp, Homo sapiens
atgctttgaaaatgt

SEQ ID NO: 5258729 - DNA, 17 bp, Homo sapiens
atgctttgaaaatgtat

SEQ ID NO: 5258730 - DNA, 17 bp, Homo sapiens
atgctttgaaaatgttt

SEQ ID NO: 5258731 - DNA, 19 bp, Homo sapiens
atgctttgaaattgaacct

SEQ ID NO: 5258732 - DNA, 22 bp, Homo sapiens
aaagatgcatctaccgctcttg

SEQ ID NO: 5258733 - DNA, 18 bp, Homo sapiens
aaagatgcattttgtgta

SEQ ID NO: 5258734 - DNA, 16 bp, Homo sapiens
aaagatgccatagcat

SEQ ID NO: 5258735 - DNA, 18 bp, Homo sapiens
aaagatgccatagcataa

SEQ ID NO: 5258736 - DNA, 16 bp, Homo sapiens
aaagatgcgtttgcct

SEQ ID NO: 5258737 - DNA, 19 bp, Homo sapiens
aaagatgcgtttgcctcct

SEQ ID NO: 5258738 - DNA, 18 bp, Homo sapiens
aaagatgctagaaaaatg

SEQ ID NO: 5258739 - DNA, 24 bp, Homo sapiens
aaagatgctcaggtacagagaagg

SEQ ID NO: 5258740 - DNA, 18 bp, Homo sapiens
aaagatgcttaaaaacct

SEQ ID NO: 5258741 - DNA, 14 bp, Homo sapiens
aaagatgcttctca

SEQ ID NO: 5258742 - DNA, 19 bp, Homo sapiens
aaagatgcttttaacagag

SEQ ID NO: 5258743 - DNA, 23 bp, Homo sapiens
aaagatggaaattctgaaaactg

SEQ ID NO: 5258744 - DNA, 21 bp, Homo sapiens
aaagatggagtttacaaagat

SEQ ID NO: 5258745 - DNA, 15 bp, Homo sapiens
aaagatggagtttct

SEQ ID NO: 5258746 - DNA, 19 bp, Homo sapiens
aaagatggagtttctaagg

SEQ ID NO: 5258747 - DNA, 13 bp, Homo sapiens
aaagatggataaa

SEQ ID NO: 5258748 - DNA, 18 bp, Homo sapiens
aaagatggatttgaaaat

SEQ ID NO: 5258749 - DNA, 21 bp, Homo sapiens
aaagatggatttgacacactc

SEQ ID NO: 5258750 - DNA, 18 bp, Homo sapiens
aaagatggctcagagggg

SEQ ID NO: 5258751 - DNA, 23 bp, Homo sapiens
aaagatggctgtgcctctgcctg

SEQ ID NO: 5258752 - DNA, 20 bp, Homo sapiens
aaagatggcttatgtcatca

SEQ ID NO: 5258753 - DNA, 18 bp, Homo sapiens
aaagatggcttttgtttc

SEQ ID NO: 5258754 - DNA, 17 bp, Homo sapiens
aaagatggggtctgtaa

SEQ ID NO: 5258755 - DNA, 23 bp, Homo sapiens
aaagatggggtctgtaaaatctt

SEQ ID NO: 5258756 - DNA, 20 bp, Homo sapiens
aaagatggtaaaccagatct

SEQ ID NO: 5258757 - DNA, 20 bp, Homo sapiens
aaagatggtatcatatattt

SEQ ID NO: 5258758 - DNA, 23 bp, Homo sapiens
aaagatgtaatgtagttctttgt

SEQ ID NO: 5258759 - DNA, 15 bp, Homo sapiens
aaagatgtactgaga

SEQ ID NO: 5258760 - DNA, 21 bp, Homo sapiens
aaagatgtcccacagggacca

SEQ ID NO: 5258761 - DNA, 16 bp, Homo sapiens
aaagatgttctggata

SEQ ID NO: 5258762 - DNA, 15 bp, Homo sapiens
aaagatgtttgaaaa

SEQ ID NO: 5258763 - DNA, 16 bp, Homo sapiens
aaagatgtttgaaaat

SEQ ID NO: 5258764 - DNA, 11 bp, Homo sapiens
aaagattaaac

SEQ ID NO: 5258765 - DNA, 14 bp, Homo sapiens
aaagattaaactgc

SEQ ID NO: 5258766 - DNA, 16 bp, Homo sapiens
aaagattaaatatatc

SEQ ID NO: 5258767 - DNA, 23 bp, Homo sapiens
aaagattaatgtgtattaaaaca

SEQ ID NO: 5258768 - DNA, 19 bp, Homo sapiens
aaagattacttagaggaaa

SEQ ID NO: 5258769 - DNA, 24 bp, Homo sapiens
aaagattataatatgtgccttaag

SEQ ID NO: 5258770 - DNA, 23 bp, Homo sapiens
aaagattatagctcccaaaagaa

SEQ ID NO: 5258771 - DNA, 23 bp, Homo sapiens
aaagattatgatgcatacagttt

SEQ ID NO: 5258772 - DNA, 15 bp, Homo sapiens
aaagattatgtattg

SEQ ID NO: 5258773 - DNA, 16 bp, Homo sapiens
aaagattatttaaatg

SEQ ID NO: 5258774 - DNA, 22 bp, Homo sapiens
aaagattcacctaagagattct

SEQ ID NO: 5258775 - DNA, 15 bp, Homo sapiens
aaagattccatgggt

SEQ ID NO: 5258776 - DNA, 18 bp, Homo sapiens
aaagattcccttgaaatt

SEQ ID NO: 5258777 - DNA, 14 bp, Homo sapiens
aaagattctactaa

SEQ ID NO: 5258778 - DNA, 15 bp, Homo sapiens
aaagattctactaac

SEQ ID NO: 5258779 - DNA, 20 bp, Homo sapiens
aaagattctatagttctaga

SEQ ID NO: 5258780 - DNA, 22 bp, Homo sapiens
aaagattctgaccttaaatgca

SEQ ID NO: 5258781 - DNA, 13 bp, Homo sapiens
aaagattctgtct

SEQ ID NO: 5258782 - DNA, 14 bp, Homo sapiens
aaagattcttctta

SEQ ID NO: 5258783 - DNA, 14 bp, Homo sapiens
aaagattctttaaa

SEQ ID NO: 5258784 - DNA, 18 bp, Homo sapiens
aaagattgaacttaaatg

SEQ ID NO: 5258785 - DNA, 15 bp, Homo sapiens
aaagattgagagaat

SEQ ID NO: 5258786 - DNA, 22 bp, Homo sapiens
aaagattgcaaagggacattga

SEQ ID NO: 5258787 - DNA, 23 bp, Homo sapiens
aaagattgcaaagggacattgaa

SEQ ID NO: 5258788 - DNA, 19 bp, Homo sapiens
aaagattgctgaaatttta

SEQ ID NO: 5258789 - DNA, 16 bp, Homo sapiens
aaagattggagctgaa

SEQ ID NO: 5258790 - DNA, 15 bp, Homo sapiens
aaagattgtaaacta

SEQ ID NO: 5258791 - DNA, 20 bp, Homo sapiens
aaagattgttaaattcaatg

SEQ ID NO: 5258792 - DNA, 21 bp, Homo sapiens
aaagattgttggcagtttcct

SEQ ID NO: 5258793 - DNA, 17 bp, Homo sapiens
aaagatttaagcacaaa

SEQ ID NO: 5258794 - DNA, 21 bp, Homo sapiens
aaagatttaatgttacagcat

SEQ ID NO: 5258795 - DNA, 16 bp, Homo sapiens
aaagatttatttagct

SEQ ID NO: 5258796 - DNA, 12 bp, Homo sapiens
aaagatttcata

SEQ ID NO: 5258797 - DNA, 18 bp, Homo sapiens
aaagatttcatatctaac

SEQ ID NO: 5258798 - DNA, 12 bp, Homo sapiens
aaagatttcttc

SEQ ID NO: 5258799 - DNA, 18 bp, Homo sapiens
aaagatttcttttcatta

SEQ ID NO: 5258800 - DNA, 18 bp, Homo sapiens
aaagatttggaaaattca

SEQ ID NO: 5258801 - DNA, 20 bp, Homo sapiens
aaagatttgtgaactggaag

SEQ ID NO: 5258802 - DNA, 12 bp, Homo sapiens
aaagatttgtta

SEQ ID NO: 5258803 - DNA, 17 bp, Homo sapiens
aaagatttgttactgta

SEQ ID NO: 5258804 - DNA, 19 bp, Homo sapiens
aaagatttgtttgtgttta

SEQ ID NO: 5258805 - DNA, 18 bp, Homo sapiens
aaagattttaatcaagtt

SEQ ID NO: 5258806 - DNA, 17 bp, Homo sapiens
aaagattttatgtgctt

SEQ ID NO: 5258807 - DNA, 22 bp, Homo sapiens
aaagattttatgtgcttgaaga

SEQ ID NO: 5258808 - DNA, 23 bp, Homo sapiens
aaagattttatgtgcttgaagat

SEQ ID NO: 5258809 - DNA, 12 bp, Homo sapiens
aaagattttatt

SEQ ID NO: 5258810 - DNA, 15 bp, Homo sapiens
aaagattttatttat

SEQ ID NO: 5258811 - DNA, 14 bp, Homo sapiens
aaagattttcagaa

SEQ ID NO: 5258812 - DNA, 14 bp, Homo sapiens
aaagattttgtgaa

SEQ ID NO: 5258813 - DNA, 16 bp, Homo sapiens
aaagattttgtgaaat

SEQ ID NO: 5258814 - DNA, 19 bp, Homo sapiens
aaagattttgtgaaatttc

SEQ ID NO: 5258815 - DNA, 20 bp, Homo sapiens
aaagatttttgttaagctca

SEQ ID NO: 5258816 - DNA, 19 bp, Homo sapiens
aaagattttttaataattt

SEQ ID NO: 5258817 - DNA, 23 bp, Homo sapiens
aaagattttttttttttctctca

SEQ ID NO: 5258818 - DNA, 17 bp, Homo sapiens
aaagcaaaaaataaaat

SEQ ID NO: 5258819 - DNA, 15 bp, Homo sapiens
aaagcaaaaagatgt

SEQ ID NO: 5258820 - DNA, 17 bp, Homo sapiens
aaagcaaaaagatgtat

SEQ ID NO: 5258821 - DNA, 16 bp, Homo sapiens
aaagcaaaaagtgatg

SEQ ID NO: 5258822 - DNA, 14 bp, Homo sapiens
aaagcaaaaatgct

SEQ ID NO: 5258823 - DNA, 13 bp, Homo sapiens
aaagcaaaacatt

SEQ ID NO: 5258824 - DNA, 13 bp, Homo sapiens
aaagcaaaagaag

SEQ ID NO: 5258825 - DNA, 14 bp, Homo sapiens
aaagcaaaagaagt

SEQ ID NO: 5258826 - DNA, 16 bp, Homo sapiens
aaagcaaaagcaaggg

SEQ ID NO: 5258827 - DNA, 13 bp, Homo sapiens
aaagcaaaaggca

SEQ ID NO: 5258828 - DNA, 14 bp, Homo sapiens
aaagcaaaataata

SEQ ID NO: 5258829 - DNA, 14 bp, Homo sapiens
aaagcaaaatagta

SEQ ID NO: 5258830 - DNA, 14 bp, Homo sapiens
aaagcaaaatattt

SEQ ID NO: 5258831 - DNA, 18 bp, Homo sapiens
aaagcaaaattgcaatct

SEQ ID NO: 5258832 - DNA, 14 bp, Homo sapiens
aaagcaaaattttt

SEQ ID NO: 5258833 - DNA, 18 bp, Homo sapiens
aaagcaaacatgtgcaga

SEQ ID NO: 5258834 - DNA, 18 bp, Homo sapiens
aaagcaaaccagcctcag

SEQ ID NO: 5258835 - DNA, 15 bp, Homo sapiens
aaagcaaagatgcat

SEQ ID NO: 5258836 - DNA, 15 bp, Homo sapiens
aaagcaaaggaagca

SEQ ID NO: 5258837 - DNA, 21 bp, Homo sapiens
aaagcaaaggagagtcctggg

SEQ ID NO: 5258838 - DNA, 12 bp, Homo sapiens
aaagcaaatact

SEQ ID NO: 5258839 - DNA, 21 bp, Homo sapiens
aaagcaaatatatttaggcca

SEQ ID NO: 5258840 - DNA, 17 bp, Homo sapiens
aaagcaaatcagacaca

SEQ ID NO: 5258841 - DNA, 18 bp, Homo sapiens
aaagcaaatctacagatc

SEQ ID NO: 5258842 - DNA, 13 bp, Homo sapiens
aaagcaaatgtct

SEQ ID NO: 5258843 - DNA, 16 bp, Homo sapiens
aaagcaaatgtgacct

SEQ ID NO: 5258844 - DNA, 23 bp, Homo sapiens
aaagcaacaaagattgagaagcc

SEQ ID NO: 5258845 - DNA, 22 bp, Homo sapiens
aaagcaacaaattaactagata

SEQ ID NO: 5258846 - DNA, 16 bp, Homo sapiens
aaagcaacagctggac

SEQ ID NO: 5258847 - DNA, 18 bp, Homo sapiens
aaagcaacatcagcttga

SEQ ID NO: 5258848 - DNA, 21 bp, Homo sapiens
aaagcaacccgctggagccca

SEQ ID NO: 5258849 - DNA, 20 bp, Homo sapiens
aaagcaacttcatcccagct

SEQ ID NO: 5258850 - DNA, 13 bp, Homo sapiens
aaagcaactttcc

SEQ ID NO: 5258851 - DNA, 15 bp, Homo sapiens
aaagcaagaaacagt

SEQ ID NO: 5258852 - DNA, 18 bp, Homo sapiens
aaagcaagaatcagagaa

SEQ ID NO: 5258853 - DNA, 16 bp, Homo sapiens
aaagcaagatctacta

SEQ ID NO: 5258854 - DNA, 20 bp, Homo sapiens
aaagcaagcattcagaagaa

SEQ ID NO: 5258855 - DNA, 13 bp, Homo sapiens
aaagcaagggcca

SEQ ID NO: 5258856 - DNA, 17 bp, Homo sapiens
aaagcaagggctccagc

SEQ ID NO: 5258857 - DNA, 22 bp, Homo sapiens
aaagcaagggctccagcatcca

SEQ ID NO: 5258858 - DNA, 11 bp, Homo sapiens
aaagcaagtgt

SEQ ID NO: 5258859 - DNA, 12 bp, Homo sapiens
aaagcaataaaa

SEQ ID NO: 5258860 - DNA, 15 bp, Homo sapiens
aaagcaataaatgaa

SEQ ID NO: 5258861 - DNA, 18 bp, Homo sapiens
aaagcaatacaactttac

SEQ ID NO: 5258862 - DNA, 20 bp, Homo sapiens
aaagcaatacaactttacca

SEQ ID NO: 5258863 - DNA, 12 bp, Homo sapiens
aaagcaatattg

SEQ ID NO: 5258864 - DNA, 14 bp, Homo sapiens
aaagcaatattgta

SEQ ID NO: 5258865 - DNA, 18 bp, Homo sapiens
aaagcaatattttggagt

SEQ ID NO: 5258866 - DNA, 20 bp, Homo sapiens
aaagcaatcaagcaccagga

SEQ ID NO: 5258867 - DNA, 13 bp, Homo sapiens
aaagcaatctgat

SEQ ID NO: 5258868 - DNA, 22 bp, Homo sapiens
aaagcaatctgattcagcatca

SEQ ID NO: 5258869 - DNA, 14 bp, Homo sapiens
aaagcaatctttta

SEQ ID NO: 5258870 - DNA, 23 bp, Homo sapiens
aaagcaatgctgatgaatcactg

SEQ ID NO: 5258871 - DNA, 16 bp, Homo sapiens
aaagcaattatattgt

SEQ ID NO: 5258872 - DNA, 16 bp, Homo sapiens
aaagcaattctgactg

SEQ ID NO: 5258873 - DNA, 17 bp, Homo sapiens
aaagcaattgccctgta

SEQ ID NO: 5258874 - DNA, 19 bp, Homo sapiens
aaagcaattgccctgtaac

SEQ ID NO: 5258875 - DNA, 12 bp, Homo sapiens
aaagcaattttc

SEQ ID NO: 5258876 - DNA, 19 bp, Homo sapiens
aaagcaattttccttgaag

SEQ ID NO: 5258877 - DNA, 20 bp, Homo sapiens
aaagcaattttccttgaagc

SEQ ID NO: 5258878 - DNA, 21 bp, Homo sapiens
aaagcaattttccttgaagcc

SEQ ID NO: 5258879 - DNA, 21 bp, Homo sapiens
aaagcacaaaatggattttag

SEQ ID NO: 5258880 - DNA, 17 bp, Homo sapiens
aaagcacaaaccctggg

SEQ ID NO: 5258881 - DNA, 16 bp, Homo sapiens
aaagcacaagaagcgt

SEQ ID NO: 5258882 - DNA, 13 bp, Homo sapiens
aaagcacaataac

SEQ ID NO: 5258883 - DNA, 21 bp, Homo sapiens
aaagcacagctctcactggcc

SEQ ID NO: 5258884 - DNA, 15 bp, Homo sapiens
aaagcacaggagaca

SEQ ID NO: 5258885 - DNA, 19 bp, Homo sapiens
aaagcacaggagacactgt

SEQ ID NO: 5258886 - DNA, 22 bp, Homo sapiens
aaagcacaggtgggcttcccag

SEQ ID NO: 5258887 - DNA, 21 bp, Homo sapiens
aaagcacagtgttaaatgaaa

SEQ ID NO: 5258888 - DNA, 13 bp, Homo sapiens
aaagcacatacat

SEQ ID NO: 5258889 - DNA, 15 bp, Homo sapiens
aaagcacatacatta

SEQ ID NO: 5258890 - DNA, 18 bp, Homo sapiens
aaagcacatacattaaaa

SEQ ID NO: 5258891 - DNA, 20 bp, Homo sapiens
aaagcacatacattaaaact

SEQ ID NO: 5258892 - DNA, 14 bp, Homo sapiens
aaagcacatgaata

SEQ ID NO: 5258893 - DNA, 18 bp, Homo sapiens
aaagcacatggttcaaat

SEQ ID NO: 5258894 - DNA, 20 bp, Homo sapiens
aaagcaccaaaataagaaaa

SEQ ID NO: 5258895 - DNA, 21 bp, Homo sapiens
aaagcaccaaaataagaaaag

SEQ ID NO: 5258896 - DNA, 22 bp, Homo sapiens
aaagcaccaaaataagaaaaga

SEQ ID NO: 5258897 - DNA, 18 bp, Homo sapiens
aaagcaccgcagcatgtg

SEQ ID NO: 5258898 - DNA, 22 bp, Homo sapiens
aaagcaccgcagcatgtgggga

SEQ ID NO: 5258899 - DNA, 12 bp, Homo sapiens
aaagcacctgcc

SEQ ID NO: 5258900 - DNA, 14 bp, Homo sapiens
aaagcacggactct

SEQ ID NO: 5258901 - DNA, 18 bp, Homo sapiens
aaagcactagagaatgca

SEQ ID NO: 5258902 - DNA, 14 bp, Homo sapiens
aaagcactatacag

SEQ ID NO: 5258903 - DNA, 16 bp, Homo sapiens
aaagcactatgaattt

SEQ ID NO: 5258904 - DNA, 16 bp, Homo sapiens
aaagcactctctgcag

SEQ ID NO: 5258905 - DNA, 14 bp, Homo sapiens
aaagcactgacctg

SEQ ID NO: 5258906 - DNA, 22 bp, Homo sapiens
aaagcactgacctgtcatgccc

SEQ ID NO: 5258907 - DNA, 21 bp, Homo sapiens
aaagcactggccttgcctcca

SEQ ID NO: 5258908 - DNA, 22 bp, Homo sapiens
aaagcactggccttgcctccag

SEQ ID NO: 5258909 - DNA, 23 bp, Homo sapiens
aaagcactggccttgcctccagg

SEQ ID NO: 5258910 - DNA, 21 bp, Homo sapiens
atgctttgaaattgaaccttt

SEQ ID NO: 5258911 - DNA, 14 bp, Homo sapiens
atgctttgaacttt

SEQ ID NO: 5258912 - DNA, 16 bp, Homo sapiens
atgctttgatcccttc

SEQ ID NO: 5258913 - DNA, 15 bp, Homo sapiens
atgctttgctttgtc

SEQ ID NO: 5258914 - DNA, 16 bp, Homo sapiens
atgctttgctttgtct

SEQ ID NO: 5258915 - DNA, 12 bp, Homo sapiens
atgctttggaaa

SEQ ID NO: 5258916 - DNA, 15 bp, Homo sapiens
atgctttggaaaaat

SEQ ID NO: 5258917 - DNA, 15 bp, Homo sapiens
atgctttgggaggcc

SEQ ID NO: 5258918 - DNA, 18 bp, Homo sapiens
atgctttgggaggccaag

SEQ ID NO: 5258919 - DNA, 20 bp, Homo sapiens
atgctttgggaggccaaggc

SEQ ID NO: 5258920 - DNA, 21 bp, Homo sapiens
atgctttgggaggccaaggca

SEQ ID NO: 5258921 - DNA, 15 bp, Homo sapiens
atgctttgtgaacaa

SEQ ID NO: 5258922 - DNA, 18 bp, Homo sapiens
atgctttgtgactattaa

SEQ ID NO: 5258923 - DNA, 22 bp, Homo sapiens
atgctttgtgtgattgaatctg

SEQ ID NO: 5258924 - DNA, 23 bp, Homo sapiens
atgctttgttttcccacacatat

SEQ ID NO: 5258925 - DNA, 21 bp, Homo sapiens
atgcttttactgaactttctt

SEQ ID NO: 5258926 - DNA, 22 bp, Homo sapiens
atgcttttatagctgcttggat

SEQ ID NO: 5258927 - DNA, 19 bp, Homo sapiens
atgcttttatattctaata

SEQ ID NO: 5258928 - DNA, 14 bp, Homo sapiens
atgcttttccaaac

SEQ ID NO: 5258929 - DNA, 13 bp, Homo sapiens
atgcttttctcat

SEQ ID NO: 5258930 - DNA, 13 bp, Homo sapiens
atgcttttgctgc

SEQ ID NO: 5258931 - DNA, 14 bp, Homo sapiens
atgcttttgctgct

SEQ ID NO: 5258932 - DNA, 15 bp, Homo sapiens
atgcttttgctgctg

SEQ ID NO: 5258933 - DNA, 18 bp, Homo sapiens
atgcttttgcttgcaatg

SEQ ID NO: 5258934 - DNA, 19 bp, Homo sapiens
atgctttttagaaagcatt

SEQ ID NO: 5258935 - DNA, 22 bp, Homo sapiens
atgctttttatcgctaaatgac

SEQ ID NO: 5258936 - DNA, 19 bp, Homo sapiens
atgctttttgagtttcatg

SEQ ID NO: 5258937 - DNA, 15 bp, Homo sapiens
atgcttttttgcaat

SEQ ID NO: 5258938 - DNA, 19 bp, Homo sapiens
atggaaaaaaaaaaaagag

SEQ ID NO: 5258939 - DNA, 21 bp, Homo sapiens
atggaaaaaaacataaaaagc

SEQ ID NO: 5258940 - DNA, 14 bp, Homo sapiens
atggaaaaaatgat

SEQ ID NO: 5258941 - DNA, 15 bp, Homo sapiens
atggaaaaacttgtg

SEQ ID NO: 5258942 - DNA, 13 bp, Homo sapiens
atggaaaaagaat

SEQ ID NO: 5258943 - DNA, 13 bp, Homo sapiens
atggaaaaataaa

SEQ ID NO: 5258944 - DNA, 16 bp, Homo sapiens
atggaaaaataacaac

SEQ ID NO: 5258945 - DNA, 22 bp, Homo sapiens
atggaaaaatgccatcaaatga

SEQ ID NO: 5258946 - DNA, 21 bp, Homo sapiens
atggaaaaatggttgatggaa

SEQ ID NO: 5258947 - DNA, 16 bp, Homo sapiens
atggaaaaattgacaa

SEQ ID NO: 5258948 - DNA, 23 bp, Homo sapiens
atggaaaacaaaccatctctagt

SEQ ID NO: 5258949 - DNA, 21 bp, Homo sapiens
atggaaaacgctctctactct

SEQ ID NO: 5258950 - DNA, 19 bp, Homo sapiens
atggaaaactgtgttgcca

SEQ ID NO: 5258951 - DNA, 13 bp, Homo sapiens
atggaaaagagag

SEQ ID NO: 5258952 - DNA, 17 bp, Homo sapiens
atggaaaagccttctta

SEQ ID NO: 5258953 - DNA, 21 bp, Homo sapiens
atggaaaagtcttcaagggct

SEQ ID NO: 5258954 - DNA, 13 bp, Homo sapiens
atggaaaatacca

SEQ ID NO: 5258955 - DNA, 22 bp, Homo sapiens
atggaaaatatacaagtaaatt

SEQ ID NO: 5258956 - DNA, 19 bp, Homo sapiens
atggaaaatgtcctgtggt

SEQ ID NO: 5258957 - DNA, 23 bp, Homo sapiens
atggaaaattaattctaaactta

SEQ ID NO: 5258958 - DNA, 22 bp, Homo sapiens
atggaaacaagatgaaattcca

SEQ ID NO: 5258959 - DNA, 13 bp, Homo sapiens
atggaaacaatgt

SEQ ID NO: 5258960 - DNA, 17 bp, Homo sapiens
atggaaacaatgtggag

SEQ ID NO: 5258961 - DNA, 16 bp, Homo sapiens
atggaaacactgattt

SEQ ID NO: 5258962 - DNA, 14 bp, Homo sapiens
atggaaacagaaga

SEQ ID NO: 5258963 - DNA, 14 bp, Homo sapiens
atggaaacagggca

SEQ ID NO: 5258964 - DNA, 17 bp, Homo sapiens
atggaaacagggcagtg

SEQ ID NO: 5258965 - DNA, 18 bp, Homo sapiens
atggaaacatcactgggg

SEQ ID NO: 5258966 - DNA, 21 bp, Homo sapiens
atggaaacccgagggttgatt

SEQ ID NO: 5258967 - DNA, 17 bp, Homo sapiens
atggaaacctcacgctg

SEQ ID NO: 5258968 - DNA, 13 bp, Homo sapiens
atggaaacggtga

SEQ ID NO: 5258969 - DNA, 16 bp, Homo sapiens
atggaaactgaaacta

SEQ ID NO: 5258970 - DNA, 13 bp, Homo sapiens
atggaaactgaat

SEQ ID NO: 5258971 - DNA, 16 bp, Homo sapiens
atggaaactgaatgct

SEQ ID NO: 5258972 - DNA, 15 bp, Homo sapiens
atggaaacttggaaa

SEQ ID NO: 5258973 - DNA, 11 bp, Homo sapiens
atggaaagaat

SEQ ID NO: 5258974 - DNA, 16 bp, Homo sapiens
atggaaagacaaactg

SEQ ID NO: 5258975 - DNA, 21 bp, Homo sapiens
atggaaagactgggacagccc

SEQ ID NO: 5258976 - DNA, 12 bp, Homo sapiens
atggaaagaggt

SEQ ID NO: 5258977 - DNA, 19 bp, Homo sapiens
atggaaaggagaggaaaga

SEQ ID NO: 5258978 - DNA, 19 bp, Homo sapiens
atggaaagggtcttccttc

SEQ ID NO: 5258979 - DNA, 11 bp, Homo sapiens
atggaaagttg

SEQ ID NO: 5258980 - DNA, 14 bp, Homo sapiens
atggaaagttgtat

SEQ ID NO: 5258981 - DNA, 20 bp, Homo sapiens
atggaaataaaaagtatgtt

SEQ ID NO: 5258982 - DNA, 20 bp, Homo sapiens
atggaaataacgggtggcat

SEQ ID NO: 5258983 - DNA, 23 bp, Homo sapiens
atggaaataacgggtggcattgg

SEQ ID NO: 5258984 - DNA, 12 bp, Homo sapiens
atggaaatacca

SEQ ID NO: 5258985 - DNA, 19 bp, Homo sapiens
atggaaatcagccaagttt

SEQ ID NO: 5258986 - DNA, 21 bp, Homo sapiens
atggaaatcttttacattttt

SEQ ID NO: 5258987 - DNA, 20 bp, Homo sapiens
atggaaatgggcagagcaga

SEQ ID NO: 5258988 - DNA, 15 bp, Homo sapiens
atggaaatgtgagaa

SEQ ID NO: 5258989 - DNA, 18 bp, Homo sapiens
atggaaatgtgagaaatg

SEQ ID NO: 5258990 - DNA, 16 bp, Homo sapiens
atggaaattagccaca

SEQ ID NO: 5258991 - DNA, 15 bp, Homo sapiens
atggaaatttaaagc

SEQ ID NO: 5258992 - DNA, 14 bp, Homo sapiens
atggaacaaagcat

SEQ ID NO: 5258993 - DNA, 15 bp, Homo sapiens
atggaacactctgag

SEQ ID NO: 5258994 - DNA, 19 bp, Homo sapiens
atggaacactggaacattc

SEQ ID NO: 5258995 - DNA, 14 bp, Homo sapiens
atggaacagtgtaa

SEQ ID NO: 5258996 - DNA, 15 bp, Homo sapiens
atggaacatatgcac

SEQ ID NO: 5258997 - DNA, 24 bp, Homo sapiens
atggaacattttctgtgtgtacat

SEQ ID NO: 5258998 - DNA, 16 bp, Homo sapiens
atggaaccaggcttgg

SEQ ID NO: 5258999 - DNA, 17 bp, Homo sapiens
atggaaccaggcttgga

SEQ ID NO: 5259000 - DNA, 17 bp, Homo sapiens
atggaaccgcaggaagc

SEQ ID NO: 5259001 - DNA, 13 bp, Homo sapiens
atggaacctcctt

SEQ ID NO: 5259002 - DNA, 21 bp, Homo sapiens
atggaaccttccctccaaatt

SEQ ID NO: 5259003 - DNA, 18 bp, Homo sapiens
atggaacgcgttgaaatt

SEQ ID NO: 5259004 - DNA, 23 bp, Homo sapiens
atggaacgcgttgaaattgtaat

SEQ ID NO: 5259005 - DNA, 13 bp, Homo sapiens
atggaactcccca

SEQ ID NO: 5259006 - DNA, 21 bp, Homo sapiens
atggaactctagggatagtca

SEQ ID NO: 5259007 - DNA, 14 bp, Homo sapiens
atggaactgacccc

SEQ ID NO: 5259008 - DNA, 15 bp, Homo sapiens
atggaactgtaataa

SEQ ID NO: 5259009 - DNA, 22 bp, Homo sapiens
atggaactgtgtatttatttaa

SEQ ID NO: 5259010 - DNA, 16 bp, Homo sapiens
atggaacttagccatt

SEQ ID NO: 5259011 - DNA, 16 bp, Homo sapiens
atggaagaaagaagca

SEQ ID NO: 5259012 - DNA, 12 bp, Homo sapiens
atggaagaaagt

SEQ ID NO: 5259013 - DNA, 18 bp, Homo sapiens
atggaagaagaaaggact

SEQ ID NO: 5259014 - DNA, 15 bp, Homo sapiens
atggaagaagtatat

SEQ ID NO: 5259015 - DNA, 14 bp, Homo sapiens
atggaagacaaata

SEQ ID NO: 5259016 - DNA, 16 bp, Homo sapiens
atggaagacaaataca

SEQ ID NO: 5259017 - DNA, 17 bp, Homo sapiens
atggaagacaaatacac

SEQ ID NO: 5259018 - DNA, 18 bp, Homo sapiens
atggaagacaaatacaca

SEQ ID NO: 5259019 - DNA, 16 bp, Homo sapiens
atggaagacagctctt

SEQ ID NO: 5259020 - DNA, 16 bp, Homo sapiens
atggaagacaggaaag

SEQ ID NO: 5259021 - DNA, 22 bp, Homo sapiens
atggaagacctaaggcagacag

SEQ ID NO: 5259022 - DNA, 12 bp, Homo sapiens
atggaagagaaa

SEQ ID NO: 5259023 - DNA, 18 bp, Homo sapiens
atggaagagaagagaaag

SEQ ID NO: 5259024 - DNA, 15 bp, Homo sapiens
atggaagagagaaag

SEQ ID NO: 5259025 - DNA, 18 bp, Homo sapiens
atggaagataattttatg

SEQ ID NO: 5259026 - DNA, 17 bp, Homo sapiens
atggaagattttaaatt

SEQ ID NO: 5259027 - DNA, 13 bp, Homo sapiens
atggaagcaaaga

SEQ ID NO: 5259028 - DNA, 15 bp, Homo sapiens
atggaagcacacaag

SEQ ID NO: 5259029 - DNA, 21 bp, Homo sapiens
atggaagcacacaagtggaga

SEQ ID NO: 5259030 - DNA, 20 bp, Homo sapiens
atggaagcggtggtcagaag

SEQ ID NO: 5259031 - DNA, 18 bp, Homo sapiens
atggaagcttactctctg

SEQ ID NO: 5259032 - DNA, 14 bp, Homo sapiens
atggaaggagagag

SEQ ID NO: 5259033 - DNA, 14 bp, Homo sapiens
atggaaggggcttc

SEQ ID NO: 5259034 - DNA, 17 bp, Homo sapiens
atggaaggggcttctgg

SEQ ID NO: 5259035 - DNA, 15 bp, Homo sapiens
atggaaggttagagg

SEQ ID NO: 5259036 - DNA, 22 bp, Homo sapiens
atggaaggttagaggtttgtca

SEQ ID NO: 5259037 - DNA, 23 bp, Homo sapiens
atggaaggttaggtttgtcaaca

SEQ ID NO: 5259038 - DNA, 17 bp, Homo sapiens
atggaaggtttgtatat

SEQ ID NO: 5259039 - DNA, 15 bp, Homo sapiens
atggaagtaaaggca

SEQ ID NO: 5259040 - DNA, 17 bp, Homo sapiens
atggaagtaattaaggt

SEQ ID NO: 5259041 - DNA, 20 bp, Homo sapiens
atggaagtaattaaggtaca

SEQ ID NO: 5259042 - DNA, 21 bp, Homo sapiens
atggaagtcacctttctgggc

SEQ ID NO: 5259043 - DNA, 20 bp, Homo sapiens
atggaagtgggccagtcctg

SEQ ID NO: 5259044 - DNA, 13 bp, Homo sapiens
atggaataaaagg

SEQ ID NO: 5259045 - DNA, 14 bp, Homo sapiens
atggaataaattat

SEQ ID NO: 5259046 - DNA, 20 bp, Homo sapiens
atggaataaattatggcatt

SEQ ID NO: 5259047 - DNA, 20 bp, Homo sapiens
atggaataacaactttcagt

SEQ ID NO: 5259048 - DNA, 22 bp, Homo sapiens
atggaataacaactttcagtgg

SEQ ID NO: 5259049 - DNA, 13 bp, Homo sapiens
atggaataactat

SEQ ID NO: 5259050 - DNA, 20 bp, Homo sapiens
atggaataactatctcactt

SEQ ID NO: 5259051 - DNA, 14 bp, Homo sapiens
atggaataagtgta

SEQ ID NO: 5259052 - DNA, 18 bp, Homo sapiens
atggaataagtgtacata

SEQ ID NO: 5259053 - DNA, 16 bp, Homo sapiens
atggaatacagtgtta

SEQ ID NO: 5259054 - DNA, 22 bp, Homo sapiens
atggaatacagtgttattttct

SEQ ID NO: 5259055 - DNA, 14 bp, Homo sapiens
atggaatagttctg

SEQ ID NO: 5259056 - DNA, 15 bp, Homo sapiens
atggaatatcagaag

SEQ ID NO: 5259057 - DNA, 16 bp, Homo sapiens
atggaatatcatctgt

SEQ ID NO: 5259058 - DNA, 20 bp, Homo sapiens
atggaatatcatctgtcatt

SEQ ID NO: 5259059 - DNA, 20 bp, Homo sapiens
atggaatatcatgaatgtga

SEQ ID NO: 5259060 - DNA, 14 bp, Homo sapiens
atggaatattcatt

SEQ ID NO: 5259061 - DNA, 21 bp, Homo sapiens
atggaatcccactgtatgatt

SEQ ID NO: 5259062 - DNA, 16 bp, Homo sapiens
atggaatcgaagtgtt

SEQ ID NO: 5259063 - DNA, 13 bp, Homo sapiens
atggaatcttctc

SEQ ID NO: 5259064 - DNA, 18 bp, Homo sapiens
atggaatcttctccagta

SEQ ID NO: 5259065 - DNA, 16 bp, Homo sapiens
atggaatcttgctgca

SEQ ID NO: 5259066 - DNA, 17 bp, Homo sapiens
atggaatgctgtgttaa

SEQ ID NO: 5259067 - DNA, 13 bp, Homo sapiens
atggaatgcttct

SEQ ID NO: 5259068 - DNA, 20 bp, Homo sapiens
atggaatgcttgaaaaatgt

SEQ ID NO: 5259069 - DNA, 16 bp, Homo sapiens
atggaatggttataaa

SEQ ID NO: 5259070 - DNA, 18 bp, Homo sapiens
atggaatggttataaaag

SEQ ID NO: 5259071 - DNA, 19 bp, Homo sapiens
atggaatggttataaaagt

SEQ ID NO: 5259072 - DNA, 20 bp, Homo sapiens
atggaatggttataaaagtg

SEQ ID NO: 5259073 - DNA, 15 bp, Homo sapiens
atggaatgtaaaata

SEQ ID NO: 5259074 - DNA, 16 bp, Homo sapiens
atggaatgtgccacct

SEQ ID NO: 5259075 - DNA, 16 bp, Homo sapiens
atggaattccctcctg

SEQ ID NO: 5259076 - DNA, 20 bp, Homo sapiens
atggaattcgtgttatgaat

SEQ ID NO: 5259077 - DNA, 22 bp, Homo sapiens
atggaattcgtgttatgaatct

SEQ ID NO: 5259078 - DNA, 23 bp, Homo sapiens
atggaattcgtgttatgaatctg

SEQ ID NO: 5259079 - DNA, 13 bp, Homo sapiens
atggaattgattt

SEQ ID NO: 5259080 - DNA, 18 bp, Homo sapiens
atggaattgatttgcatt

SEQ ID NO: 5259081 - DNA, 17 bp, Homo sapiens
atggaattgcttaccaa

SEQ ID NO: 5259082 - DNA, 21 bp, Homo sapiens
atggaattggtttaaactttt

SEQ ID NO: 5259083 - DNA, 18 bp, Homo sapiens
atggaatttaatttatgt

SEQ ID NO: 5259084 - DNA, 19 bp, Homo sapiens
atggaatttaatttatgtg

SEQ ID NO: 5259085 - DNA, 17 bp, Homo sapiens
atggaatttctcccagt

SEQ ID NO: 5259086 - DNA, 18 bp, Homo sapiens
atggaatttttgaatcta

SEQ ID NO: 5259087 - DNA, 19 bp, Homo sapiens
atggaattttttgaatatg

SEQ ID NO: 5259088 - DNA, 16 bp, Homo sapiens
atggacaaaattaata

SEQ ID NO: 5259089 - DNA, 17 bp, Homo sapiens
aaagcacttgaagaata

SEQ ID NO: 5259090 - DNA, 21 bp, Homo sapiens
aaagcacttggactcttgctc

SEQ ID NO: 5259091 - DNA, 15 bp, Homo sapiens
aaagcactttgcact

SEQ ID NO: 5259092 - DNA, 16 bp, Homo sapiens
aaagcactttgcactt

SEQ ID NO: 5259093 - DNA, 13 bp, Homo sapiens
aaagcacttttgt

SEQ ID NO: 5259094 - DNA, 17 bp, Homo sapiens
aaagcacttttgttatt

SEQ ID NO: 5259095 - DNA, 14 bp, Homo sapiens
aaagcactttttgg

SEQ ID NO: 5259096 - DNA, 13 bp, Homo sapiens
aaagcagaaaata

SEQ ID NO: 5259097 - DNA, 13 bp, Homo sapiens
aaagcagaaggag

SEQ ID NO: 5259098 - DNA, 18 bp, Homo sapiens
aaagcagaagtctggctt

SEQ ID NO: 5259099 - DNA, 14 bp, Homo sapiens
aaagcagaatttta

SEQ ID NO: 5259100 - DNA, 16 bp, Homo sapiens
aaagcagaattttaat

SEQ ID NO: 5259101 - DNA, 15 bp, Homo sapiens
aaagcagactatgca

SEQ ID NO: 5259102 - DNA, 14 bp, Homo sapiens
aaagcagagatttt

SEQ ID NO: 5259103 - DNA, 15 bp, Homo sapiens
aaagcagagattttc

SEQ ID NO: 5259104 - DNA, 17 bp, Homo sapiens
aaagcagagccaaggcc

SEQ ID NO: 5259105 - DNA, 20 bp, Homo sapiens
aaagcagaggcaacactgga

SEQ ID NO: 5259106 - DNA, 20 bp, Homo sapiens
aaagcagagtgaaattcaat

SEQ ID NO: 5259107 - DNA, 21 bp, Homo sapiens
aaagcagagtggactgcattt

SEQ ID NO: 5259108 - DNA, 22 bp, Homo sapiens
aaagcagatacctcaccctgct

SEQ ID NO: 5259109 - DNA, 20 bp, Homo sapiens
aaagcagatggacttgaaaa

SEQ ID NO: 5259110 - DNA, 21 bp, Homo sapiens
aaagcagattacctcttgccc

SEQ ID NO: 5259111 - DNA, 19 bp, Homo sapiens
aaagcagcacacattgtgt

SEQ ID NO: 5259112 - DNA, 22 bp, Homo sapiens
aaagcagcacatggtgttgtat

SEQ ID NO: 5259113 - DNA, 19 bp, Homo sapiens
aaagcagcagaggtgagaa

SEQ ID NO: 5259114 - DNA, 15 bp, Homo sapiens
aaagcagccacgagg

SEQ ID NO: 5259115 - DNA, 19 bp, Homo sapiens
aaagcagcctgattgaaaa

SEQ ID NO: 5259116 - DNA, 15 bp, Homo sapiens
aaagcagcgtttcta

SEQ ID NO: 5259117 - DNA, 18 bp, Homo sapiens
aaagcagcgtttctatga

SEQ ID NO: 5259118 - DNA, 23 bp, Homo sapiens
aaagcagctaaatgtaacttatt

SEQ ID NO: 5259119 - DNA, 18 bp, Homo sapiens
aaagcagctctcccctca

SEQ ID NO: 5259120 - DNA, 22 bp, Homo sapiens
aaagcaggatgaattttctgca

SEQ ID NO: 5259121 - DNA, 22 bp, Homo sapiens
aaagcaggcttgcccagtacat

SEQ ID NO: 5259122 - DNA, 18 bp, Homo sapiens
aaagcagggaatttctat

SEQ ID NO: 5259123 - DNA, 19 bp, Homo sapiens
aaagcagggcagcagggaa

SEQ ID NO: 5259124 - DNA, 19 bp, Homo sapiens
aaagcaggttcttgttggt

SEQ ID NO: 5259125 - DNA, 13 bp, Homo sapiens
aaagcagtaaaat

SEQ ID NO: 5259126 - DNA, 17 bp, Homo sapiens
aaagcagtaactgacaa

SEQ ID NO: 5259127 - DNA, 15 bp, Homo sapiens
aaagcagtatataat

SEQ ID NO: 5259128 - DNA, 22 bp, Homo sapiens
aaagcagtatataataacttta

SEQ ID NO: 5259129 - DNA, 23 bp, Homo sapiens
aaagcagtatataataactttat

SEQ ID NO: 5259130 - DNA, 16 bp, Homo sapiens
aaagcagtatttttct

SEQ ID NO: 5259131 - DNA, 18 bp, Homo sapiens
aaagcagtcacttttcct

SEQ ID NO: 5259132 - DNA, 22 bp, Homo sapiens
aaagcagtcagcggagaggacc

SEQ ID NO: 5259133 - DNA, 18 bp, Homo sapiens
aaagcagtcccattcata

SEQ ID NO: 5259134 - DNA, 22 bp, Homo sapiens
aaagcagtcccattcatattaa

SEQ ID NO: 5259135 - DNA, 23 bp, Homo sapiens
aaagcagtgtgtccttggggcac

SEQ ID NO: 5259136 - DNA, 11 bp, Homo sapiens
aaagcagtgtt

SEQ ID NO: 5259137 - DNA, 18 bp, Homo sapiens
aaagcagtgttttcacct

SEQ ID NO: 5259138 - DNA, 22 bp, Homo sapiens
aaagcagttcatgtctgaaaca

SEQ ID NO: 5259139 - DNA, 21 bp, Homo sapiens
aaagcagttcctgtcccacat

SEQ ID NO: 5259140 - DNA, 15 bp, Homo sapiens
aaagcagttgggagt

SEQ ID NO: 5259141 - DNA, 15 bp, Homo sapiens
aaagcagtttttgaa

SEQ ID NO: 5259142 - DNA, 13 bp, Homo sapiens
aaagcataaaatg

SEQ ID NO: 5259143 - DNA, 15 bp, Homo sapiens
aaagcataaaatgga

SEQ ID NO: 5259144 - DNA, 13 bp, Homo sapiens
aaagcataaagct

SEQ ID NO: 5259145 - DNA, 14 bp, Homo sapiens
aaagcatatataaa

SEQ ID NO: 5259146 - DNA, 18 bp, Homo sapiens
aaagcatcaaataataca

SEQ ID NO: 5259147 - DNA, 19 bp, Homo sapiens
aaagcatcaccactcattt

SEQ ID NO: 5259148 - DNA, 20 bp, Homo sapiens
aaagcatcaccactcatttt

SEQ ID NO: 5259149 - DNA, 13 bp, Homo sapiens
aaagcatccatgt

SEQ ID NO: 5259150 - DNA, 12 bp, Homo sapiens
aaagcatccctc

SEQ ID NO: 5259151 - DNA, 15 bp, Homo sapiens
aaagcatcctcctcc

SEQ ID NO: 5259152 - DNA, 20 bp, Homo sapiens
aaagcatctattcccaaaga

SEQ ID NO: 5259153 - DNA, 15 bp, Homo sapiens
aaagcatcttgcatt

SEQ ID NO: 5259154 - DNA, 13 bp, Homo sapiens
aaagcatgaaaca

SEQ ID NO: 5259155 - DNA, 16 bp, Homo sapiens
aaagcatgaatatttc

SEQ ID NO: 5259156 - DNA, 19 bp, Homo sapiens
aaagcatgaatatttctta

SEQ ID NO: 5259157 - DNA, 21 bp, Homo sapiens
aaagcatgatgggaaaatatt

SEQ ID NO: 5259158 - DNA, 23 bp, Homo sapiens
aaagcatgcatatcattaaacaa

SEQ ID NO: 5259159 - DNA, 17 bp, Homo sapiens
aaagcatgccaatttct

SEQ ID NO: 5259160 - DNA, 22 bp, Homo sapiens
aaagcatgctcagtattgagac

SEQ ID NO: 5259161 - DNA, 18 bp, Homo sapiens
aaagcatgggaaaaagag

SEQ ID NO: 5259162 - DNA, 21 bp, Homo sapiens
aaagcatgggaaaaagagact

SEQ ID NO: 5259163 - DNA, 22 bp, Homo sapiens
aaagcatgggaaaaagagactc

SEQ ID NO: 5259164 - DNA, 23 bp, Homo sapiens
aaagcatgggaaaaagagactct

SEQ ID NO: 5259165 - DNA, 13 bp, Homo sapiens
aaagcatgtacag

SEQ ID NO: 5259166 - DNA, 21 bp, Homo sapiens
aaagcatgtacagtgttctgt

SEQ ID NO: 5259167 - DNA, 18 bp, Homo sapiens
aaagcatgtctctgcttc

SEQ ID NO: 5259168 - DNA, 19 bp, Homo sapiens
aaagcatgtctctgcttcc

SEQ ID NO: 5259169 - DNA, 20 bp, Homo sapiens
aaagcatgtggtcttatagt

SEQ ID NO: 5259170 - DNA, 17 bp, Homo sapiens
aaagcatgttttgcatg

SEQ ID NO: 5259171 - DNA, 15 bp, Homo sapiens
aaagcattatttttt

SEQ ID NO: 5259172 - DNA, 22 bp, Homo sapiens
aaagcattcaatttattcaaga

SEQ ID NO: 5259173 - DNA, 18 bp, Homo sapiens
aaagcattccaacaaagg

SEQ ID NO: 5259174 - DNA, 15 bp, Homo sapiens
aaagcattctttaac

SEQ ID NO: 5259175 - DNA, 14 bp, Homo sapiens
aaagcattgctgtt

SEQ ID NO: 5259176 - DNA, 22 bp, Homo sapiens
aaagcattgcttttattttgaa

SEQ ID NO: 5259177 - DNA, 17 bp, Homo sapiens
aaagcattgtaaatgtg

SEQ ID NO: 5259178 - DNA, 18 bp, Homo sapiens
aaagcatttaggagaata

SEQ ID NO: 5259179 - DNA, 23 bp, Homo sapiens
aaagcatttaggagaatagcaga

SEQ ID NO: 5259180 - DNA, 14 bp, Homo sapiens
aaagcatttatcat

SEQ ID NO: 5259181 - DNA, 19 bp, Homo sapiens
aaagcatttcttttctctt

SEQ ID NO: 5259182 - DNA, 14 bp, Homo sapiens
aaagcatttgaatg

SEQ ID NO: 5259183 - DNA, 15 bp, Homo sapiens
aaagcatttgaatgc

SEQ ID NO: 5259184 - DNA, 20 bp, Homo sapiens
aaagcatttgagctgtggtt

SEQ ID NO: 5259185 - DNA, 16 bp, Homo sapiens
aaagcatttggtgcct

SEQ ID NO: 5259186 - DNA, 15 bp, Homo sapiens
aaagcatttgtacta

SEQ ID NO: 5259187 - DNA, 12 bp, Homo sapiens
aaagcattttca

SEQ ID NO: 5259188 - DNA, 18 bp, Homo sapiens
aaagcattttcagtcttg

SEQ ID NO: 5259189 - DNA, 21 bp, Homo sapiens
aaagcattttcagtcttgtag

SEQ ID NO: 5259190 - DNA, 16 bp, Homo sapiens
aaagcattttgctaag

SEQ ID NO: 5259191 - DNA, 11 bp, Homo sapiens
aaagccaaaaa

SEQ ID NO: 5259192 - DNA, 15 bp, Homo sapiens
aaagccaaacaaaac

SEQ ID NO: 5259193 - DNA, 17 bp, Homo sapiens
aaagccaaactctgcca

SEQ ID NO: 5259194 - DNA, 15 bp, Homo sapiens
aaagccaaaggtcta

SEQ ID NO: 5259195 - DNA, 16 bp, Homo sapiens
aaagccaaaggtctag

SEQ ID NO: 5259196 - DNA, 14 bp, Homo sapiens
aaagccaaatgtaa

SEQ ID NO: 5259197 - DNA, 12 bp, Homo sapiens
aaagccaaattt

SEQ ID NO: 5259198 - DNA, 17 bp, Homo sapiens
aaagccaaatttatatg

SEQ ID NO: 5259199 - DNA, 21 bp, Homo sapiens
aaagccaaccttcaaagaaac

SEQ ID NO: 5259200 - DNA, 23 bp, Homo sapiens
aaagccaaggagtcactgagacc

SEQ ID NO: 5259201 - DNA, 14 bp, Homo sapiens
aaagccaagggcaa

SEQ ID NO: 5259202 - DNA, 12 bp, Homo sapiens
aaagccacatct

SEQ ID NO: 5259203 - DNA, 18 bp, Homo sapiens
aaagccacatcttgctct

SEQ ID NO: 5259204 - DNA, 17 bp, Homo sapiens
aaagccacattatttct

SEQ ID NO: 5259205 - DNA, 18 bp, Homo sapiens
aaagccacattatttcta

SEQ ID NO: 5259206 - DNA, 21 bp, Homo sapiens
aaagccacattatttctagtc

SEQ ID NO: 5259207 - DNA, 13 bp, Homo sapiens
aaagccacatttt

SEQ ID NO: 5259208 - DNA, 17 bp, Homo sapiens
aaagccacctctccctc

SEQ ID NO: 5259209 - DNA, 18 bp, Homo sapiens
aaagccacctctgtcatt

SEQ ID NO: 5259210 - DNA, 15 bp, Homo sapiens
aaagccacctgctgc

SEQ ID NO: 5259211 - DNA, 16 bp, Homo sapiens
aaagccacctgctgcg

SEQ ID NO: 5259212 - DNA, 21 bp, Homo sapiens
aaagccacgccctccctgcta

SEQ ID NO: 5259213 - DNA, 22 bp, Homo sapiens
aaagccacgccctccctgctag

SEQ ID NO: 5259214 - DNA, 18 bp, Homo sapiens
aaagccacgttccttact

SEQ ID NO: 5259215 - DNA, 17 bp, Homo sapiens
aaagccactagactctt

SEQ ID NO: 5259216 - DNA, 19 bp, Homo sapiens
aaagccactggaaggagca

SEQ ID NO: 5259217 - DNA, 17 bp, Homo sapiens
aaagccagacaacttct

SEQ ID NO: 5259218 - DNA, 22 bp, Homo sapiens
aaagccagacaacttctgtttc

SEQ ID NO: 5259219 - DNA, 16 bp, Homo sapiens
aaagccagcaaagcct

SEQ ID NO: 5259220 - DNA, 16 bp, Homo sapiens
aaagccaggaacaggg

SEQ ID NO: 5259221 - DNA, 19 bp, Homo sapiens
aaagccaggaacagggacc

SEQ ID NO: 5259222 - DNA, 18 bp, Homo sapiens
aaagccaggagcagccct

SEQ ID NO: 5259223 - DNA, 14 bp, Homo sapiens
aaagccaggcctga

SEQ ID NO: 5259224 - DNA, 14 bp, Homo sapiens
aaagccaggctcag

SEQ ID NO: 5259225 - DNA, 16 bp, Homo sapiens
aaagccaggctcagga

SEQ ID NO: 5259226 - DNA, 19 bp, Homo sapiens
aaagccagggtctctccct

SEQ ID NO: 5259227 - DNA, 15 bp, Homo sapiens
aaagccaggtccctc

SEQ ID NO: 5259228 - DNA, 9 bp, Homo sapiens
aaagccagt

SEQ ID NO: 5259229 - DNA, 18 bp, Homo sapiens
aaagccagtcatcatctc

SEQ ID NO: 5259230 - DNA, 22 bp, Homo sapiens
aaagccagtcatcatctcttga

SEQ ID NO: 5259231 - DNA, 19 bp, Homo sapiens
aaagccagtgaaatgtgaa

SEQ ID NO: 5259232 - DNA, 19 bp, Homo sapiens
aaagccagtgactccagga

SEQ ID NO: 5259233 - DNA, 17 bp, Homo sapiens
aaagccataacttgaaa

SEQ ID NO: 5259234 - DNA, 18 bp, Homo sapiens
aaagccatatcaccagtc

SEQ ID NO: 5259235 - DNA, 15 bp, Homo sapiens
aaagccatatggaca

SEQ ID NO: 5259236 - DNA, 22 bp, Homo sapiens
aaagccatattctaaattcact

SEQ ID NO: 5259237 - DNA, 21 bp, Homo sapiens
aaagccatatttttttctgta

SEQ ID NO: 5259238 - DNA, 22 bp, Homo sapiens
aaagccatatttttttctgtaa

SEQ ID NO: 5259239 - DNA, 17 bp, Homo sapiens
aaagccatcatgccttg

SEQ ID NO: 5259240 - DNA, 16 bp, Homo sapiens
aaagccatcatgtaaa

SEQ ID NO: 5259241 - DNA, 13 bp, Homo sapiens
aaagccatgctgg

SEQ ID NO: 5259242 - DNA, 22 bp, Homo sapiens
aaagccatgtatttcagggacc

SEQ ID NO: 5259243 - DNA, 14 bp, Homo sapiens
aaagccatgtttaa

SEQ ID NO: 5259244 - DNA, 18 bp, Homo sapiens
aaagccatgtttattaca

SEQ ID NO: 5259245 - DNA, 13 bp, Homo sapiens
aaagccattcttt

SEQ ID NO: 5259246 - DNA, 18 bp, Homo sapiens
aaagccattgaccaccca

SEQ ID NO: 5259247 - DNA, 20 bp, Homo sapiens
aaagcccaaactcctttctt

SEQ ID NO: 5259248 - DNA, 21 bp, Homo sapiens
aaagcccaaactcctttctta

SEQ ID NO: 5259249 - DNA, 13 bp, Homo sapiens
aaagcccaacaca

SEQ ID NO: 5259250 - DNA, 15 bp, Homo sapiens
aaagcccaacctctt

SEQ ID NO: 5259251 - DNA, 22 bp, Homo sapiens
aaagcccaacctcttcctcctg

SEQ ID NO: 5259252 - DNA, 20 bp, Homo sapiens
aaagcccacaggcctgttcc

SEQ ID NO: 5259253 - DNA, 19 bp, Homo sapiens
aaagcccacctgggctggg

SEQ ID NO: 5259254 - DNA, 11 bp, Homo sapiens
aaagcccagac

SEQ ID NO: 5259255 - DNA, 13 bp, Homo sapiens
aaagcccagcatc

SEQ ID NO: 5259256 - DNA, 13 bp, Homo sapiens
aaagcccagcccg

SEQ ID NO: 5259257 - DNA, 14 bp, Homo sapiens
aaagcccagcccgg

SEQ ID NO: 5259258 - DNA, 12 bp, Homo sapiens
aaagcccaggag

SEQ ID NO: 5259259 - DNA, 13 bp, Homo sapiens
aaagcccaggagc

SEQ ID NO: 5259260 - DNA, 16 bp, Homo sapiens
aaagcccattcattcc

SEQ ID NO: 5259261 - DNA, 23 bp, Homo sapiens
aaagcccattttcaactgctttg

SEQ ID NO: 5259262 - DNA, 20 bp, Homo sapiens
aaagccccatgctggagcct

SEQ ID NO: 5259263 - DNA, 14 bp, Homo sapiens
aaagcccccagagc

SEQ ID NO: 5259264 - DNA, 17 bp, Homo sapiens
aaagcccccagttaata

SEQ ID NO: 5259265 - DNA, 14 bp, Homo sapiens
aaagccccccagct

SEQ ID NO: 5259266 - DNA, 22 bp, Homo sapiens
aaagccccccagctcccacacc

SEQ ID NO: 5259267 - DNA, 12 bp, Homo sapiens
aaagcccctgga

SEQ ID NO: 5259268 - DNA, 20 bp, Homo sapiens
atggacaaaattaatacatt

SEQ ID NO: 5259269 - DNA, 21 bp, Homo sapiens
atggacaacttatttaaaaat

SEQ ID NO: 5259270 - DNA, 23 bp, Homo sapiens
atggacaacttatttaaaaatat

SEQ ID NO: 5259271 - DNA, 16 bp, Homo sapiens
atggacacaaattttc

SEQ ID NO: 5259272 - DNA, 20 bp, Homo sapiens
atggacacccccagctgact

SEQ ID NO: 5259273 - DNA, 22 bp, Homo sapiens
atggacaccccttatccaggac

SEQ ID NO: 5259274 - DNA, 18 bp, Homo sapiens
atggacaccttgtgttta

SEQ ID NO: 5259275 - DNA, 14 bp, Homo sapiens
atggacacgagcca

SEQ ID NO: 5259276 - DNA, 20 bp, Homo sapiens
atggacacgagccacaagct

SEQ ID NO: 5259277 - DNA, 23 bp, Homo sapiens
atggacacgagccacaagctgca

SEQ ID NO: 5259278 - DNA, 22 bp, Homo sapiens
atggacacgctgcgcaaggcct

SEQ ID NO: 5259279 - DNA, 18 bp, Homo sapiens
atggacactaatgcagcc

SEQ ID NO: 5259280 - DNA, 17 bp, Homo sapiens
atggacactacacccag

SEQ ID NO: 5259281 - DNA, 19 bp, Homo sapiens
atggacactacacccagca

SEQ ID NO: 5259282 - DNA, 23 bp, Homo sapiens
atggacactgccaagagccgaca

SEQ ID NO: 5259283 - DNA, 14 bp, Homo sapiens
atggacactgtgac

SEQ ID NO: 5259284 - DNA, 15 bp, Homo sapiens
atggacactgtgaca

SEQ ID NO: 5259285 - DNA, 15 bp, Homo sapiens
atggacactttgaaa

SEQ ID NO: 5259286 - DNA, 22 bp, Homo sapiens
atggacactttgaaatgtgttt

SEQ ID NO: 5259287 - DNA, 12 bp, Homo sapiens
atggacagacac

SEQ ID NO: 5259288 - DNA, 13 bp, Homo sapiens
atggacagacacc

SEQ ID NO: 5259289 - DNA, 14 bp, Homo sapiens
atggacagacacct

SEQ ID NO: 5259290 - DNA, 13 bp, Homo sapiens
atggacagatgga

SEQ ID NO: 5259291 - DNA, 17 bp, Homo sapiens
atggacaggagaaacat

SEQ ID NO: 5259292 - DNA, 18 bp, Homo sapiens
atggacagggcatgccac

SEQ ID NO: 5259293 - DNA, 13 bp, Homo sapiens
atggacagggcca

SEQ ID NO: 5259294 - DNA, 23 bp, Homo sapiens
atggacagttcacaccctgcaag

SEQ ID NO: 5259295 - DNA, 13 bp, Homo sapiens
atggacagtttgt

SEQ ID NO: 5259296 - DNA, 15 bp, Homo sapiens
atggacatcctgtat

SEQ ID NO: 5259297 - DNA, 22 bp, Homo sapiens
atggacatcctgtataagcact

SEQ ID NO: 5259298 - DNA, 20 bp, Homo sapiens
atggacatcttgtcattttt

SEQ ID NO: 5259299 - DNA, 14 bp, Homo sapiens
atggacatggaaat

SEQ ID NO: 5259300 - DNA, 16 bp, Homo sapiens
atggacatgggcagca

SEQ ID NO: 5259301 - DNA, 18 bp, Homo sapiens
atggacatttagaagaaa

SEQ ID NO: 5259302 - DNA, 18 bp, Homo sapiens
atggaccaaagccacctg

SEQ ID NO: 5259303 - DNA, 21 bp, Homo sapiens
atggaccaaatgtgccatact

SEQ ID NO: 5259304 - DNA, 23 bp, Homo sapiens
atggaccaacctgctctgtcccc

SEQ ID NO: 5259305 - DNA, 15 bp, Homo sapiens
atggaccactgtttc

SEQ ID NO: 5259306 - DNA, 18 bp, Homo sapiens
atggaccactgtttcttg

SEQ ID NO: 5259307 - DNA, 21 bp, Homo sapiens
atggaccactgtttcttgctt

SEQ ID NO: 5259308 - DNA, 14 bp, Homo sapiens
atggaccagcatct

SEQ ID NO: 5259309 - DNA, 22 bp, Homo sapiens
atggaccagcccattggccgag

SEQ ID NO: 5259310 - DNA, 23 bp, Homo sapiens
atggaccatgctgtctggcacag

SEQ ID NO: 5259311 - DNA, 18 bp, Homo sapiens
atggacccaagataaaag

SEQ ID NO: 5259312 - DNA, 21 bp, Homo sapiens
atggacccaatatttaccaga

SEQ ID NO: 5259313 - DNA, 13 bp, Homo sapiens
atggacccaatgc

SEQ ID NO: 5259314 - DNA, 19 bp, Homo sapiens
atggacccactacccttct

SEQ ID NO: 5259315 - DNA, 15 bp, Homo sapiens
atggacccctcgccc

SEQ ID NO: 5259316 - DNA, 18 bp, Homo sapiens
atggaccctcgcagcagg

SEQ ID NO: 5259317 - DNA, 23 bp, Homo sapiens
atggaccctcgcagcaggtgcaa

SEQ ID NO: 5259318 - DNA, 20 bp, Homo sapiens
atggaccgaggttcccactc

SEQ ID NO: 5259319 - DNA, 20 bp, Homo sapiens
atggaccggagagtgggggt

SEQ ID NO: 5259320 - DNA, 18 bp, Homo sapiens
atggaccgggtgggcctg

SEQ ID NO: 5259321 - DNA, 19 bp, Homo sapiens
atggaccgggtgggcctgg

SEQ ID NO: 5259322 - DNA, 19 bp, Homo sapiens
atggacctatctgtaagag

SEQ ID NO: 5259323 - DNA, 14 bp, Homo sapiens
atggacctatgaca

SEQ ID NO: 5259324 - DNA, 14 bp, Homo sapiens
atggacctgcactt

SEQ ID NO: 5259325 - DNA, 19 bp, Homo sapiens
atggacctgcacttggcct

SEQ ID NO: 5259326 - DNA, 21 bp, Homo sapiens
atggacctgcacttggcctct

SEQ ID NO: 5259327 - DNA, 14 bp, Homo sapiens
atggacctgtcacg

SEQ ID NO: 5259328 - DNA, 17 bp, Homo sapiens
atggacgaacaggggcc

SEQ ID NO: 5259329 - DNA, 17 bp, Homo sapiens
atggacgaatatgaatg

SEQ ID NO: 5259330 - DNA, 15 bp, Homo sapiens
atggacgcaggccct

SEQ ID NO: 5259331 - DNA, 16 bp, Homo sapiens
atggacgcaggccctg

SEQ ID NO: 5259332 - DNA, 21 bp, Homo sapiens
atggacgcaggccctgtccag

SEQ ID NO: 5259333 - DNA, 21 bp, Homo sapiens
atggacgctgccgggagactg

SEQ ID NO: 5259334 - DNA, 21 bp, Homo sapiens
atggacggccccgtcagccac

SEQ ID NO: 5259335 - DNA, 15 bp, Homo sapiens
atggacggtgctcca

SEQ ID NO: 5259336 - DNA, 21 bp, Homo sapiens
atggacggtgctccaggcagg

SEQ ID NO: 5259337 - DNA, 20 bp, Homo sapiens
atggactaaatgatctctga

SEQ ID NO: 5259338 - DNA, 19 bp, Homo sapiens
atggactaattgacttgca

SEQ ID NO: 5259339 - DNA, 13 bp, Homo sapiens
atggactatctgt

SEQ ID NO: 5259340 - DNA, 16 bp, Homo sapiens
atggactattgcaata

SEQ ID NO: 5259341 - DNA, 15 bp, Homo sapiens
atggactcagccttg

SEQ ID NO: 5259342 - DNA, 16 bp, Homo sapiens
atggactcaggatcca

SEQ ID NO: 5259343 - DNA, 23 bp, Homo sapiens
atggactcaggatccagtgacat

SEQ ID NO: 5259344 - DNA, 21 bp, Homo sapiens
atggactccagcctgcctggc

SEQ ID NO: 5259345 - DNA, 22 bp, Homo sapiens
atggactccaggatcctcctgg

SEQ ID NO: 5259346 - DNA, 15 bp, Homo sapiens
atggactcctgacca

SEQ ID NO: 5259347 - DNA, 17 bp, Homo sapiens
atggactcgattttacc

SEQ ID NO: 5259348 - DNA, 14 bp, Homo sapiens
atggactctacact

SEQ ID NO: 5259349 - DNA, 18 bp, Homo sapiens
atggactctacactgtga

SEQ ID NO: 5259350 - DNA, 13 bp, Homo sapiens
atggactctgtcc

SEQ ID NO: 5259351 - DNA, 15 bp, Homo sapiens
atggactctgtcctg

SEQ ID NO: 5259352 - DNA, 18 bp, Homo sapiens
atggactcttctcggctc

SEQ ID NO: 5259353 - DNA, 23 bp, Homo sapiens
atggactcttctcggctcaggct

SEQ ID NO: 5259354 - DNA, 19 bp, Homo sapiens
atggactgactgtaacgat

SEQ ID NO: 5259355 - DNA, 13 bp, Homo sapiens
atggactgcacaa

SEQ ID NO: 5259356 - DNA, 14 bp, Homo sapiens
atggactgctcagg

SEQ ID NO: 5259357 - DNA, 14 bp, Homo sapiens
atggactggcccct

SEQ ID NO: 5259358 - DNA, 16 bp, Homo sapiens
atggactggcttggcc

SEQ ID NO: 5259359 - DNA, 16 bp, Homo sapiens
atggactgtgaatttc

SEQ ID NO: 5259360 - DNA, 17 bp, Homo sapiens
atggactgtggtgactt

SEQ ID NO: 5259361 - DNA, 22 bp, Homo sapiens
atggactgttacagactgaaag

SEQ ID NO: 5259362 - DNA, 17 bp, Homo sapiens
atggacttaaatgttaa

SEQ ID NO: 5259363 - DNA, 14 bp, Homo sapiens
atggacttcaaatt

SEQ ID NO: 5259364 - DNA, 19 bp, Homo sapiens
atggacttgtgattggctg

SEQ ID NO: 5259365 - DNA, 23 bp, Homo sapiens
atggacttgtgattggctgcagg

SEQ ID NO: 5259366 - DNA, 23 bp, Homo sapiens
atggacttttgggggttggatgg

SEQ ID NO: 5259367 - DNA, 17 bp, Homo sapiens
atggagaaacaggccca

SEQ ID NO: 5259368 - DNA, 19 bp, Homo sapiens
atggagaaagaagtggaga

SEQ ID NO: 5259369 - DNA, 12 bp, Homo sapiens
atggagaaagct

SEQ ID NO: 5259370 - DNA, 15 bp, Homo sapiens
atggagaaagctgac

SEQ ID NO: 5259371 - DNA, 23 bp, Homo sapiens
atggagaaatgaagcagaggaag

SEQ ID NO: 5259372 - DNA, 16 bp, Homo sapiens
atggagaacatgtttt

SEQ ID NO: 5259373 - DNA, 19 bp, Homo sapiens
atggagaaggaaaaggctg

SEQ ID NO: 5259374 - DNA, 20 bp, Homo sapiens
atggagaaggaaaaggctgg

SEQ ID NO: 5259375 - DNA, 13 bp, Homo sapiens
atggagaaggaag

SEQ ID NO: 5259376 - DNA, 16 bp, Homo sapiens
atggagaataaattat

SEQ ID NO: 5259377 - DNA, 20 bp, Homo sapiens
atggagaatcacttttctag

SEQ ID NO: 5259378 - DNA, 15 bp, Homo sapiens
atggagaatgccagc

SEQ ID NO: 5259379 - DNA, 17 bp, Homo sapiens
atggagaatgccagccc

SEQ ID NO: 5259380 - DNA, 16 bp, Homo sapiens
atggagaatggtgttc

SEQ ID NO: 5259381 - DNA, 18 bp, Homo sapiens
atggagacaccctctggg

SEQ ID NO: 5259382 - DNA, 11 bp, Homo sapiens
atggagacagc

SEQ ID NO: 5259383 - DNA, 13 bp, Homo sapiens
atggagacagcag

SEQ ID NO: 5259384 - DNA, 20 bp, Homo sapiens
atggagactccatgagaagc

SEQ ID NO: 5259385 - DNA, 16 bp, Homo sapiens
atggagactctgagag

SEQ ID NO: 5259386 - DNA, 13 bp, Homo sapiens
atggagagaaaac

SEQ ID NO: 5259387 - DNA, 14 bp, Homo sapiens
atggagagagggga

SEQ ID NO: 5259388 - DNA, 15 bp, Homo sapiens
atggagagaggggaa

SEQ ID NO: 5259389 - DNA, 23 bp, Homo sapiens
atggagagcagccagcacccacc

SEQ ID NO: 5259390 - DNA, 13 bp, Homo sapiens
atggagagccctg

SEQ ID NO: 5259391 - DNA, 16 bp, Homo sapiens
atggagagccctggga

SEQ ID NO: 5259392 - DNA, 15 bp, Homo sapiens
atggagaggaagaaa

SEQ ID NO: 5259393 - DNA, 13 bp, Homo sapiens
atggagaggcatg

SEQ ID NO: 5259394 - DNA, 22 bp, Homo sapiens
atggagaggcatgggggcccaa

SEQ ID NO: 5259395 - DNA, 16 bp, Homo sapiens
atggagaggcggcctc

SEQ ID NO: 5259396 - DNA, 20 bp, Homo sapiens
atggagaggcggcctcgtgc

SEQ ID NO: 5259397 - DNA, 11 bp, Homo sapiens
atggagaggct

SEQ ID NO: 5259398 - DNA, 14 bp, Homo sapiens
atggagaggctgag

SEQ ID NO: 5259399 - DNA, 14 bp, Homo sapiens
atggagaggcttcc

SEQ ID NO: 5259400 - DNA, 14 bp, Homo sapiens
atggagagggatgg

SEQ ID NO: 5259401 - DNA, 18 bp, Homo sapiens
atggagagggatggaaat

SEQ ID NO: 5259402 - DNA, 17 bp, Homo sapiens
atggagagggggtacaa

SEQ ID NO: 5259403 - DNA, 18 bp, Homo sapiens
atggagaggtttgtcaac

SEQ ID NO: 5259404 - DNA, 14 bp, Homo sapiens
atggagatgtaaaa

SEQ ID NO: 5259405 - DNA, 20 bp, Homo sapiens
atggagattaagatgccttg

SEQ ID NO: 5259406 - DNA, 19 bp, Homo sapiens
atggagattcagttttcat

SEQ ID NO: 5259407 - DNA, 21 bp, Homo sapiens
atggagcaaaacaaagctgat

SEQ ID NO: 5259408 - DNA, 14 bp, Homo sapiens
atggagcagccccc

SEQ ID NO: 5259409 - DNA, 11 bp, Homo sapiens
atggagccagc

SEQ ID NO: 5259410 - DNA, 20 bp, Homo sapiens
atggagcccagccccgccct

SEQ ID NO: 5259411 - DNA, 23 bp, Homo sapiens
atggagcccaggcgggagcggtg

SEQ ID NO: 5259412 - DNA, 13 bp, Homo sapiens
atggagccccacc

SEQ ID NO: 5259413 - DNA, 22 bp, Homo sapiens
atggagccccaccttgtctgct

SEQ ID NO: 5259414 - DNA, 16 bp, Homo sapiens
atggagccccagcccc

SEQ ID NO: 5259415 - DNA, 13 bp, Homo sapiens
atggagccccagg

SEQ ID NO: 5259416 - DNA, 23 bp, Homo sapiens
atggagcccccagatagagctgg

SEQ ID NO: 5259417 - DNA, 24 bp, Homo sapiens
atggagcccccagatagagctggg

SEQ ID NO: 5259418 - DNA, 17 bp, Homo sapiens
atggagccccctctgcc

SEQ ID NO: 5259419 - DNA, 14 bp, Homo sapiens
atggagcccctcca

SEQ ID NO: 5259420 - DNA, 10 bp, Homo sapiens
atggagccta

SEQ ID NO: 5259421 - DNA, 15 bp, Homo sapiens
atggagcctctgcag

SEQ ID NO: 5259422 - DNA, 18 bp, Homo sapiens
atggagcctgcacggtga

SEQ ID NO: 5259423 - DNA, 12 bp, Homo sapiens
atggagcctgga

SEQ ID NO: 5259424 - DNA, 23 bp, Homo sapiens
atggagcgcacctgccccctggt

SEQ ID NO: 5259425 - DNA, 14 bp, Homo sapiens
atggagctagagag

SEQ ID NO: 5259426 - DNA, 14 bp, Homo sapiens
atggagctcagaga

SEQ ID NO: 5259427 - DNA, 22 bp, Homo sapiens
atggagctcagagagggcaggc

SEQ ID NO: 5259428 - DNA, 14 bp, Homo sapiens
atggagctcatgtc

SEQ ID NO: 5259429 - DNA, 15 bp, Homo sapiens
atggagctcatgtca

SEQ ID NO: 5259430 - DNA, 14 bp, Homo sapiens
atggagctgggcta

SEQ ID NO: 5259431 - DNA, 23 bp, Homo sapiens
atggagctgtataactgtgcaga

SEQ ID NO: 5259432 - DNA, 14 bp, Homo sapiens
atggagctgtcacc

SEQ ID NO: 5259433 - DNA, 22 bp, Homo sapiens
atggagctgtcacctctcagct

SEQ ID NO: 5259434 - DNA, 14 bp, Homo sapiens
atggagctgtcatc

SEQ ID NO: 5259435 - DNA, 17 bp, Homo sapiens
atggagcttgtacatat

SEQ ID NO: 5259436 - DNA, 16 bp, Homo sapiens
atggagctttctgtat

SEQ ID NO: 5259437 - DNA, 16 bp, Homo sapiens
atggaggaaaaccaag

SEQ ID NO: 5259438 - DNA, 22 bp, Homo sapiens
atggaggaaatccggtcagcca

SEQ ID NO: 5259439 - DNA, 15 bp, Homo sapiens
atggaggaagaacaa

SEQ ID NO: 5259440 - DNA, 17 bp, Homo sapiens
atggaggactctcctct

SEQ ID NO: 5259441 - DNA, 11 bp, Homo sapiens
atggaggagaa

SEQ ID NO: 5259442 - DNA, 14 bp, Homo sapiens
atggaggagaaata

SEQ ID NO: 5259443 - DNA, 16 bp, Homo sapiens
atggaggagaaataaa

SEQ ID NO: 5259444 - DNA, 17 bp, Homo sapiens
atggaggagccaggccc

SEQ ID NO: 5259445 - DNA, 15 bp, Homo sapiens
atggaggaggaagac

SEQ ID NO: 5259446 - DNA, 15 bp, Homo sapiens
atggaggaggaggca

SEQ ID NO: 5259447 - DNA, 17 bp, Homo sapiens
atggaggatattctact

SEQ ID NO: 5259448 - DNA, 18 bp, Homo sapiens
atggaggattctttcccc

SEQ ID NO: 5259449 - DNA, 22 bp, Homo sapiens
atggaggattctttccccagag

SEQ ID NO: 5259450 - DNA, 14 bp, Homo sapiens
atggaggcagatgc

SEQ ID NO: 5259451 - DNA, 18 bp, Homo sapiens
atggaggcaggctccccc

SEQ ID NO: 5259452 - DNA, 15 bp, Homo sapiens
atggaggccaagcct

SEQ ID NO: 5259453 - DNA, 17 bp, Homo sapiens
atggaggccaagcctgc

SEQ ID NO: 5259454 - DNA, 14 bp, Homo sapiens
atggaggccagagt

SEQ ID NO: 5259455 - DNA, 16 bp, Homo sapiens
atggaggccctcctgt

SEQ ID NO: 5259456 - DNA, 16 bp, Homo sapiens
atggaggcctacctct

SEQ ID NO: 5259457 - DNA, 12 bp, Homo sapiens
atggaggcctgt

SEQ ID NO: 5259458 - DNA, 13 bp, Homo sapiens
atggaggcgcctt

SEQ ID NO: 5259459 - DNA, 14 bp, Homo sapiens
atggaggcttttca

SEQ ID NO: 5259460 - DNA, 15 bp, Homo sapiens
atggagggaagacct

SEQ ID NO: 5259461 - DNA, 18 bp, Homo sapiens
atggagggaagacctgaa

SEQ ID NO: 5259462 - DNA, 11 bp, Homo sapiens
atggagggcag

SEQ ID NO: 5259463 - DNA, 12 bp, Homo sapiens
atggagggcaga

SEQ ID NO: 5259464 - DNA, 24 bp, Homo sapiens
atggagggcagagtgggctgcctg

SEQ ID NO: 5259465 - DNA, 19 bp, Homo sapiens
atggagggcttggcccagc

SEQ ID NO: 5259466 - DNA, 14 bp, Homo sapiens
atggaggggaattc

SEQ ID NO: 5259467 - DNA, 14 bp, Homo sapiens
atggaggggcagag

SEQ ID NO: 5259468 - DNA, 16 bp, Homo sapiens
atggaggggggtgctg

SEQ ID NO: 5259469 - DNA, 20 bp, Homo sapiens
atggaggggtggtcctgact

SEQ ID NO: 5259470 - DNA, 11 bp, Homo sapiens
atggagggtcc

SEQ ID NO: 5259471 - DNA, 12 bp, Homo sapiens
atggaggtaggg

SEQ ID NO: 5259472 - DNA, 15 bp, Homo sapiens
atggaggtagggctg

SEQ ID NO: 5259473 - DNA, 20 bp, Homo sapiens
atggaggtagggctggctgg

SEQ ID NO: 5259474 - DNA, 16 bp, Homo sapiens
atggaggttctaaggc

SEQ ID NO: 5259475 - DNA, 22 bp, Homo sapiens
atggaggtttaccggttgttta

SEQ ID NO: 5259476 - DNA, 15 bp, Homo sapiens
atggagtacggctgg

SEQ ID NO: 5259477 - DNA, 18 bp, Homo sapiens
atggagtacggctggtgt

SEQ ID NO: 5259478 - DNA, 18 bp, Homo sapiens
atggagtagacccctggc

SEQ ID NO: 5259479 - DNA, 21 bp, Homo sapiens
atggagtagacccctggctgg

SEQ ID NO: 5259480 - DNA, 21 bp, Homo sapiens
atggagtagaggtactagaat

SEQ ID NO: 5259481 - DNA, 20 bp, Homo sapiens
atggagtagagtcaggagaa

SEQ ID NO: 5259482 - DNA, 14 bp, Homo sapiens
atggagtcatcttg

SEQ ID NO: 5259483 - DNA, 15 bp, Homo sapiens
atggagtctcactct

SEQ ID NO: 5259484 - DNA, 15 bp, Homo sapiens
atggagtctgcagtg

SEQ ID NO: 5259485 - DNA, 15 bp, Homo sapiens
atggagtcttgctct

SEQ ID NO: 5259486 - DNA, 15 bp, Homo sapiens
atggagtcttgtgaa

SEQ ID NO: 5259487 - DNA, 11 bp, Homo sapiens
atggagtgacg

SEQ ID NO: 5259488 - DNA, 17 bp, Homo sapiens
atggagtgagacccagg

SEQ ID NO: 5259489 - DNA, 19 bp, Homo sapiens
atggagtgagacccaggag

SEQ ID NO: 5259490 - DNA, 21 bp, Homo sapiens
atggagtgagacccaggagcc

SEQ ID NO: 5259491 - DNA, 16 bp, Homo sapiens
atggagtgagcagtag

SEQ ID NO: 5259492 - DNA, 19 bp, Homo sapiens
atggagtgagtcacctgct

SEQ ID NO: 5259493 - DNA, 19 bp, Homo sapiens
atggagtgcaccaaagaga

SEQ ID NO: 5259494 - DNA, 20 bp, Homo sapiens
atggagtgcaccaaagagaa

SEQ ID NO: 5259495 - DNA, 12 bp, Homo sapiens
atggagtgctgt

SEQ ID NO: 5259496 - DNA, 21 bp, Homo sapiens
atggagtgctgttttgttata

SEQ ID NO: 5259497 - DNA, 20 bp, Homo sapiens
atggagtgggagatcagcca

SEQ ID NO: 5259498 - DNA, 21 bp, Homo sapiens
atggagtgtcaccagctgcca

SEQ ID NO: 5259499 - DNA, 19 bp, Homo sapiens
atggagtgtgcagacagcc

SEQ ID NO: 5259500 - DNA, 23 bp, Homo sapiens
atggagtgtgcctctctctccca

SEQ ID NO: 5259501 - DNA, 13 bp, Homo sapiens
atggagtgtttga

SEQ ID NO: 5259502 - DNA, 16 bp, Homo sapiens
atggagtgtttgaaaa

SEQ ID NO: 5259503 - DNA, 15 bp, Homo sapiens
atggagttaaataaa

SEQ ID NO: 5259504 - DNA, 14 bp, Homo sapiens
atggagttatcagt

SEQ ID NO: 5259505 - DNA, 19 bp, Homo sapiens
atggataacctatatgatt

SEQ ID NO: 5259506 - DNA, 13 bp, Homo sapiens
atggatacataaa

SEQ ID NO: 5259507 - DNA, 14 bp, Homo sapiens
atggatacataaag

SEQ ID NO: 5259508 - DNA, 19 bp, Homo sapiens
atggatacatatttcagtt

SEQ ID NO: 5259509 - DNA, 19 bp, Homo sapiens
atggatacgtgttttgaat

SEQ ID NO: 5259510 - DNA, 16 bp, Homo sapiens
atggatacttcctggg

SEQ ID NO: 5259511 - DNA, 14 bp, Homo sapiens
atggatagattttc

SEQ ID NO: 5259512 - DNA, 18 bp, Homo sapiens
atggataggcacaggaaa

SEQ ID NO: 5259513 - DNA, 18 bp, Homo sapiens
atggatatagaaaatctt

SEQ ID NO: 5259514 - DNA, 14 bp, Homo sapiens
atggatatatttga

SEQ ID NO: 5259515 - DNA, 15 bp, Homo sapiens
atggatatgctgctt

SEQ ID NO: 5259516 - DNA, 22 bp, Homo sapiens
atggatatgtgtaaatgttatg

SEQ ID NO: 5259517 - DNA, 20 bp, Homo sapiens
atggatatgttgtattaact

SEQ ID NO: 5259518 - DNA, 23 bp, Homo sapiens
atggatatgttgtattaactggg

SEQ ID NO: 5259519 - DNA, 23 bp, Homo sapiens
atggatattagtcatagaagaac

SEQ ID NO: 5259520 - DNA, 20 bp, Homo sapiens
atggatcaaagaaattcaga

SEQ ID NO: 5259521 - DNA, 15 bp, Homo sapiens
atggatcacaagatg

SEQ ID NO: 5259522 - DNA, 16 bp, Homo sapiens
atggatcacaagatgg

SEQ ID NO: 5259523 - DNA, 16 bp, Homo sapiens
atggatcagagcattt

SEQ ID NO: 5259524 - DNA, 14 bp, Homo sapiens
atggatcagatctg

SEQ ID NO: 5259525 - DNA, 22 bp, Homo sapiens
atggatccactggctggacaaa

SEQ ID NO: 5259526 - DNA, 12 bp, Homo sapiens
atggatctgatc

SEQ ID NO: 5259527 - DNA, 16 bp, Homo sapiens
atggatcttttctaaa

SEQ ID NO: 5259528 - DNA, 20 bp, Homo sapiens
atggatcttttctaaatgtt

SEQ ID NO: 5259529 - DNA, 23 bp, Homo sapiens
atggatcttttctaaatgttatt

SEQ ID NO: 5259530 - DNA, 12 bp, Homo sapiens
atggatgaaacc

SEQ ID NO: 5259531 - DNA, 17 bp, Homo sapiens
atggatgacaaagaaaa

SEQ ID NO: 5259532 - DNA, 21 bp, Homo sapiens
atggatgattcagaaattgga

SEQ ID NO: 5259533 - DNA, 13 bp, Homo sapiens
atggatgcaaagt

SEQ ID NO: 5259534 - DNA, 22 bp, Homo sapiens
atggatgcaaagtacaatgtgt

SEQ ID NO: 5259535 - DNA, 16 bp, Homo sapiens
atggatgcatcacact

SEQ ID NO: 5259536 - DNA, 14 bp, Homo sapiens
atggatgcatttca

SEQ ID NO: 5259537 - DNA, 16 bp, Homo sapiens
atggatgcatttcaaa

SEQ ID NO: 5259538 - DNA, 19 bp, Homo sapiens
atggatgcccagaggactc

SEQ ID NO: 5259539 - DNA, 12 bp, Homo sapiens
atggatgctcat

SEQ ID NO: 5259540 - DNA, 18 bp, Homo sapiens
atggatggaaatatgttc

SEQ ID NO: 5259541 - DNA, 14 bp, Homo sapiens
atggatggacagaa

SEQ ID NO: 5259542 - DNA, 13 bp, Homo sapiens
atggatggcaccc

SEQ ID NO: 5259543 - DNA, 15 bp, Homo sapiens
atggatggcaccctg

SEQ ID NO: 5259544 - DNA, 19 bp, Homo sapiens
atggatggcaccctggaac

SEQ ID NO: 5259545 - DNA, 19 bp, Homo sapiens
atggatggctcaagtctgc

SEQ ID NO: 5259546 - DNA, 14 bp, Homo sapiens
atggatggcttcta

SEQ ID NO: 5259547 - DNA, 14 bp, Homo sapiens
atggatgtatttgt

SEQ ID NO: 5259548 - DNA, 12 bp, Homo sapiens
atggatgtgctt

SEQ ID NO: 5259549 - DNA, 16 bp, Homo sapiens
atggatgtttcttctt

SEQ ID NO: 5259550 - DNA, 12 bp, Homo sapiens
atggattaaaga

SEQ ID NO: 5259551 - DNA, 15 bp, Homo sapiens
atggattaaatggca

SEQ ID NO: 5259552 - DNA, 21 bp, Homo sapiens
atggattaaatggcacctgta

SEQ ID NO: 5259553 - DNA, 22 bp, Homo sapiens
atggattaaatggcacctgtat

SEQ ID NO: 5259554 - DNA, 21 bp, Homo sapiens
atggattaatagagttggagt

SEQ ID NO: 5259555 - DNA, 14 bp, Homo sapiens
atggattatgttga

SEQ ID NO: 5259556 - DNA, 23 bp, Homo sapiens
atggattcacccccctctgctgc

SEQ ID NO: 5259557 - DNA, 18 bp, Homo sapiens
atggattcattacagctt

SEQ ID NO: 5259558 - DNA, 21 bp, Homo sapiens
atggattccaaaccaggacac

SEQ ID NO: 5259559 - DNA, 15 bp, Homo sapiens
atggattctaaaatg

SEQ ID NO: 5259560 - DNA, 14 bp, Homo sapiens
atggattctcagat

SEQ ID NO: 5259561 - DNA, 20 bp, Homo sapiens
atggattgataattgcattc

SEQ ID NO: 5259562 - DNA, 17 bp, Homo sapiens
atggattgattcagtct

SEQ ID NO: 5259563 - DNA, 22 bp, Homo sapiens
atggattgattcagtcttctgg

SEQ ID NO: 5259564 - DNA, 14 bp, Homo sapiens
atggattgccacag

SEQ ID NO: 5259565 - DNA, 15 bp, Homo sapiens
atggattgccacagc

SEQ ID NO: 5259566 - DNA, 22 bp, Homo sapiens
atggattggattatttaataac

SEQ ID NO: 5259567 - DNA, 15 bp, Homo sapiens
atggattggtaagat

SEQ ID NO: 5259568 - DNA, 17 bp, Homo sapiens
atggattgtacatattt

SEQ ID NO: 5259569 - DNA, 22 bp, Homo sapiens
atggattgttaatttcagtcct

SEQ ID NO: 5259570 - DNA, 22 bp, Homo sapiens
atggatttattttttgtaactc

SEQ ID NO: 5259571 - DNA, 24 bp, Homo sapiens
atggatttattttttgtaactctt

SEQ ID NO: 5259572 - DNA, 18 bp, Homo sapiens
atggatttccagccaaag

SEQ ID NO: 5259573 - DNA, 23 bp, Homo sapiens
atggatttcgtttttcttggggt

SEQ ID NO: 5259574 - DNA, 18 bp, Homo sapiens
atggatttcttagagatt

SEQ ID NO: 5259575 - DNA, 16 bp, Homo sapiens
atggatttgacacact

SEQ ID NO: 5259576 - DNA, 17 bp, Homo sapiens
atggatttggttatgat

SEQ ID NO: 5259577 - DNA, 14 bp, Homo sapiens
atggattttagtca

SEQ ID NO: 5259578 - DNA, 20 bp, Homo sapiens
atggattttctattgttact

SEQ ID NO: 5259579 - DNA, 21 bp, Homo sapiens
atggattttctattgttactc

SEQ ID NO: 5259580 - DNA, 21 bp, Homo sapiens
atggattttggataaatcatt

SEQ ID NO: 5259581 - DNA, 15 bp, Homo sapiens
atggattttgggagt

SEQ ID NO: 5259582 - DNA, 21 bp, Homo sapiens
atggattttgggagtgactca

SEQ ID NO: 5259583 - DNA, 13 bp, Homo sapiens
atggatttttaaa

SEQ ID NO: 5259584 - DNA, 16 bp, Homo sapiens
atggatttttacaaga

SEQ ID NO: 5259585 - DNA, 19 bp, Homo sapiens
atggattttttttttcagg

SEQ ID NO: 5259586 - DNA, 18 bp, Homo sapiens
atggcaaaaaaaaaaaag

SEQ ID NO: 5259587 - DNA, 19 bp, Homo sapiens
atggcaaaaccagtagctt

SEQ ID NO: 5259588 - DNA, 16 bp, Homo sapiens
atggcaaatcaggggc

SEQ ID NO: 5259589 - DNA, 18 bp, Homo sapiens
atggcaaatcaggggcca

SEQ ID NO: 5259590 - DNA, 21 bp, Homo sapiens
atggcaaatcaggggccagag

SEQ ID NO: 5259591 - DNA, 17 bp, Homo sapiens
atggcaacaaacacatt

SEQ ID NO: 5259592 - DNA, 15 bp, Homo sapiens
atggcaacagatctg

SEQ ID NO: 5259593 - DNA, 16 bp, Homo sapiens
atggcaacagatctgg

SEQ ID NO: 5259594 - DNA, 18 bp, Homo sapiens
atggcaacattggacaga

SEQ ID NO: 5259595 - DNA, 23 bp, Homo sapiens
atggcaagaaagctggtaaacta

SEQ ID NO: 5259596 - DNA, 12 bp, Homo sapiens
atggcaaggaac

SEQ ID NO: 5259597 - DNA, 14 bp, Homo sapiens
atggcaagtgatat

SEQ ID NO: 5259598 - DNA, 14 bp, Homo sapiens
atggcaagtggggc

SEQ ID NO: 5259599 - DNA, 17 bp, Homo sapiens
atggcaatagcattgtt

SEQ ID NO: 5259600 - DNA, 14 bp, Homo sapiens
atggcaatatctac

SEQ ID NO: 5259601 - DNA, 22 bp, Homo sapiens
atggcaatcaaacattttctgg

SEQ ID NO: 5259602 - DNA, 15 bp, Homo sapiens
atggcaattctggaa

SEQ ID NO: 5259603 - DNA, 16 bp, Homo sapiens
atggcaattgcactca

SEQ ID NO: 5259604 - DNA, 21 bp, Homo sapiens
atggcacaaaaaatgaggaat

SEQ ID NO: 5259605 - DNA, 14 bp, Homo sapiens
atggcacaatgaat

SEQ ID NO: 5259606 - DNA, 17 bp, Homo sapiens
atggcacaatgaatgta

SEQ ID NO: 5259607 - DNA, 19 bp, Homo sapiens
atggcacatgtcattgccc

SEQ ID NO: 5259608 - DNA, 19 bp, Homo sapiens
atggcaccaaagccaccag

SEQ ID NO: 5259609 - DNA, 14 bp, Homo sapiens
atggcaccagcccc

SEQ ID NO: 5259610 - DNA, 19 bp, Homo sapiens
atggcaccagccccctgga

SEQ ID NO: 5259611 - DNA, 22 bp, Homo sapiens
atggcaccagccccctggatgg

SEQ ID NO: 5259612 - DNA, 13 bp, Homo sapiens
atggcaccctgga

SEQ ID NO: 5259613 - DNA, 14 bp, Homo sapiens
atggcaccctggaa

SEQ ID NO: 5259614 - DNA, 14 bp, Homo sapiens
atggcacctcaggc

SEQ ID NO: 5259615 - DNA, 20 bp, Homo sapiens
atggcacctctgcccttccc

SEQ ID NO: 5259616 - DNA, 17 bp, Homo sapiens
atggcaccttcattctc

SEQ ID NO: 5259617 - DNA, 15 bp, Homo sapiens
atggcactaaaccac

SEQ ID NO: 5259618 - DNA, 16 bp, Homo sapiens
atggcactatttttat

SEQ ID NO: 5259619 - DNA, 15 bp, Homo sapiens
atggcactccctcca

SEQ ID NO: 5259620 - DNA, 16 bp, Homo sapiens
atggcactccctccag

SEQ ID NO: 5259621 - DNA, 20 bp, Homo sapiens
atggcactccctccagcaca

SEQ ID NO: 5259622 - DNA, 21 bp, Homo sapiens
atggcactccctccagcacaa

SEQ ID NO: 5259623 - DNA, 21 bp, Homo sapiens
atggcactgaccggtgctttt

SEQ ID NO: 5259624 - DNA, 15 bp, Homo sapiens
atggcactgtccagg

SEQ ID NO: 5259625 - DNA, 16 bp, Homo sapiens
atggcacttgcatctg

SEQ ID NO: 5259626 - DNA, 12 bp, Homo sapiens
atggcagaaaga

SEQ ID NO: 5259627 - DNA, 16 bp, Homo sapiens
aaagccctcagatccc

SEQ ID NO: 5259628 - DNA, 20 bp, Homo sapiens
aaagccctcagatcccaggg

SEQ ID NO: 5259629 - DNA, 14 bp, Homo sapiens
aaagccctgcctct

SEQ ID NO: 5259630 - DNA, 22 bp, Homo sapiens
aaagccctgtcgggctttgtgt

SEQ ID NO: 5259631 - DNA, 23 bp, Homo sapiens
aaagcccttatgtttaatcagcg

SEQ ID NO: 5259632 - DNA, 21 bp, Homo sapiens
aaagcccttcaacttcagaag

SEQ ID NO: 5259633 - DNA, 22 bp, Homo sapiens
aaagcccttcaacttcagaagg

SEQ ID NO: 5259634 - DNA, 15 bp, Homo sapiens
aaagccgtgcctttc

SEQ ID NO: 5259635 - DNA, 14 bp, Homo sapiens
aaagcctaaaattg

SEQ ID NO: 5259636 - DNA, 16 bp, Homo sapiens
aaagcctaagaaaaag

SEQ ID NO: 5259637 - DNA, 17 bp, Homo sapiens
aaagcctaccctattct

SEQ ID NO: 5259638 - DNA, 20 bp, Homo sapiens
aaagcctagacaacctttct

SEQ ID NO: 5259639 - DNA, 18 bp, Homo sapiens
aaagcctattagatgttt

SEQ ID NO: 5259640 - DNA, 18 bp, Homo sapiens
aaagcctcagtgaaacag

SEQ ID NO: 5259641 - DNA, 16 bp, Homo sapiens
aaagcctccagcatct

SEQ ID NO: 5259642 - DNA, 17 bp, Homo sapiens
aaagcctccgctgggct

SEQ ID NO: 5259643 - DNA, 21 bp, Homo sapiens
aaagcctcctgccccctgcca

SEQ ID NO: 5259644 - DNA, 15 bp, Homo sapiens
aaagcctctcactaa

SEQ ID NO: 5259645 - DNA, 16 bp, Homo sapiens
aaagcctctgctgcca

SEQ ID NO: 5259646 - DNA, 22 bp, Homo sapiens
aaagcctctggccgtcacacgt

SEQ ID NO: 5259647 - DNA, 17 bp, Homo sapiens
aaagcctctgtgctgca

SEQ ID NO: 5259648 - DNA, 19 bp, Homo sapiens
aaagcctcttatttttcta

SEQ ID NO: 5259649 - DNA, 15 bp, Homo sapiens
aaagcctgaaaattc

SEQ ID NO: 5259650 - DNA, 14 bp, Homo sapiens
aaagcctgaagggc

SEQ ID NO: 5259651 - DNA, 19 bp, Homo sapiens
aaagcctgagtactccaca

SEQ ID NO: 5259652 - DNA, 12 bp, Homo sapiens
aaagcctgctca

SEQ ID NO: 5259653 - DNA, 14 bp, Homo sapiens
aaagcctgctctcc

SEQ ID NO: 5259654 - DNA, 11 bp, Homo sapiens
aaagcctggct

SEQ ID NO: 5259655 - DNA, 13 bp, Homo sapiens
aaagcctggcttc

SEQ ID NO: 5259656 - DNA, 20 bp, Homo sapiens
aaagcctgggcagaaatgtg

SEQ ID NO: 5259657 - DNA, 17 bp, Homo sapiens
aaagcctgggtgacatt

SEQ ID NO: 5259658 - DNA, 13 bp, Homo sapiens
aaagcctggtttt

SEQ ID NO: 5259659 - DNA, 17 bp, Homo sapiens
aaagcctgtaagcctgc

SEQ ID NO: 5259660 - DNA, 17 bp, Homo sapiens
aaagcctgtattctcaa

SEQ ID NO: 5259661 - DNA, 23 bp, Homo sapiens
aaagcctgtcccaggactcaccc

SEQ ID NO: 5259662 - DNA, 17 bp, Homo sapiens
aaagcctgtgttactga

SEQ ID NO: 5259663 - DNA, 13 bp, Homo sapiens
aaagcctgttccc

SEQ ID NO: 5259664 - DNA, 20 bp, Homo sapiens
aaagcctgttcccctcactg

SEQ ID NO: 5259665 - DNA, 23 bp, Homo sapiens
aaagccttacagttatcctgcaa

SEQ ID NO: 5259666 - DNA, 21 bp, Homo sapiens
aaagccttagggcaggaaaga

SEQ ID NO: 5259667 - DNA, 17 bp, Homo sapiens
aaagccttatcaagtgt

SEQ ID NO: 5259668 - DNA, 10 bp, Homo sapiens
aaagccttcc

SEQ ID NO: 5259669 - DNA, 16 bp, Homo sapiens
aaagccttctggatcc

SEQ ID NO: 5259670 - DNA, 11 bp, Homo sapiens
aaagccttctt

SEQ ID NO: 5259671 - DNA, 18 bp, Homo sapiens
aaagccttcttttggggg

SEQ ID NO: 5259672 - DNA, 14 bp, Homo sapiens
aaagccttgtgtat

SEQ ID NO: 5259673 - DNA, 22 bp, Homo sapiens
aaagccttgtgtatatttgtat

SEQ ID NO: 5259674 - DNA, 23 bp, Homo sapiens
aaagccttgtgtctacagagaac

SEQ ID NO: 5259675 - DNA, 17 bp, Homo sapiens
aaagccttgttttctct

SEQ ID NO: 5259676 - DNA, 10 bp, Homo sapiens
aaagccttta

SEQ ID NO: 5259677 - DNA, 12 bp, Homo sapiens
aaagcctttaaa

SEQ ID NO: 5259678 - DNA, 16 bp, Homo sapiens
aaagcctttaaattgt

SEQ ID NO: 5259679 - DNA, 23 bp, Homo sapiens
aaagcctttaaattgttcctctt

SEQ ID NO: 5259680 - DNA, 13 bp, Homo sapiens
aaagcctttcatt

SEQ ID NO: 5259681 - DNA, 18 bp, Homo sapiens
aaagcctttcattttgct

SEQ ID NO: 5259682 - DNA, 22 bp, Homo sapiens
aaagcctttcattttgctttaa

SEQ ID NO: 5259683 - DNA, 10 bp, Homo sapiens
aaagcctttt

SEQ ID NO: 5259684 - DNA, 21 bp, Homo sapiens
aaagccttttgctttatgctt

SEQ ID NO: 5259685 - DNA, 14 bp, Homo sapiens
aaagcgacagattc

SEQ ID NO: 5259686 - DNA, 23 bp, Homo sapiens
aaagcgacagattcataaagtaa

SEQ ID NO: 5259687 - DNA, 18 bp, Homo sapiens
aaagcgcccacccaggtc

SEQ ID NO: 5259688 - DNA, 20 bp, Homo sapiens
aaagcgctaagtaaaaatat

SEQ ID NO: 5259689 - DNA, 19 bp, Homo sapiens
aaagcggacatcagctggt

SEQ ID NO: 5259690 - DNA, 16 bp, Homo sapiens
aaagcggagaaacatg

SEQ ID NO: 5259691 - DNA, 14 bp, Homo sapiens
aaagcggctgcctc

SEQ ID NO: 5259692 - DNA, 15 bp, Homo sapiens
aaagcggctgcctcc

SEQ ID NO: 5259693 - DNA, 18 bp, Homo sapiens
aaagcgggttataatgaa

SEQ ID NO: 5259694 - DNA, 14 bp, Homo sapiens
aaagcgtcctctca

SEQ ID NO: 5259695 - DNA, 15 bp, Homo sapiens
aaagcgtctttaaga

SEQ ID NO: 5259696 - DNA, 18 bp, Homo sapiens
aaagcgtctttaagagac

SEQ ID NO: 5259697 - DNA, 21 bp, Homo sapiens
aaagcgtctttaagagactca

SEQ ID NO: 5259698 - DNA, 21 bp, Homo sapiens
aaagcgtgagcttaaaataca

SEQ ID NO: 5259699 - DNA, 23 bp, Homo sapiens
aaagcgtgagcttaaaatacaag

SEQ ID NO: 5259700 - DNA, 14 bp, Homo sapiens
aaagcgtttgcaca

SEQ ID NO: 5259701 - DNA, 15 bp, Homo sapiens
aaagctaaaaatatt

SEQ ID NO: 5259702 - DNA, 14 bp, Homo sapiens
aaagctaaaataaa

SEQ ID NO: 5259703 - DNA, 21 bp, Homo sapiens
aaagctaaaataaagaaatag

SEQ ID NO: 5259704 - DNA, 23 bp, Homo sapiens
aaagctaaaatgattttatctgt

SEQ ID NO: 5259705 - DNA, 13 bp, Homo sapiens
aaagctaaactga

SEQ ID NO: 5259706 - DNA, 14 bp, Homo sapiens
aaagctaaactgaa

SEQ ID NO: 5259707 - DNA, 15 bp, Homo sapiens
aaagctaaagtttgg

SEQ ID NO: 5259708 - DNA, 16 bp, Homo sapiens
aaagctaatactaata

SEQ ID NO: 5259709 - DNA, 16 bp, Homo sapiens
aaagctaatgtgcagg

SEQ ID NO: 5259710 - DNA, 20 bp, Homo sapiens
aaagctacctgtggtgatgt

SEQ ID NO: 5259711 - DNA, 13 bp, Homo sapiens
aaagctacctttt

SEQ ID NO: 5259712 - DNA, 17 bp, Homo sapiens
aaagctacgcagacaag

SEQ ID NO: 5259713 - DNA, 14 bp, Homo sapiens
aaagctactgaatt

SEQ ID NO: 5259714 - DNA, 13 bp, Homo sapiens
aaagctagaaatg

SEQ ID NO: 5259715 - DNA, 19 bp, Homo sapiens
aaagctagaacactgccaa

SEQ ID NO: 5259716 - DNA, 13 bp, Homo sapiens
aaagctagaattg

SEQ ID NO: 5259717 - DNA, 14 bp, Homo sapiens
aaagctagaattga

SEQ ID NO: 5259718 - DNA, 21 bp, Homo sapiens
aaagctagacaaaggcccaga

SEQ ID NO: 5259719 - DNA, 18 bp, Homo sapiens
aaagctagatatgcctta

SEQ ID NO: 5259720 - DNA, 14 bp, Homo sapiens
aaagctaggaaagg

SEQ ID NO: 5259721 - DNA, 17 bp, Homo sapiens
aaagctaggaaaggcag

SEQ ID NO: 5259722 - DNA, 22 bp, Homo sapiens
aaagctagtgtacctcctctca

SEQ ID NO: 5259723 - DNA, 17 bp, Homo sapiens
aaagctatataagacaa

SEQ ID NO: 5259724 - DNA, 19 bp, Homo sapiens
aaagctatatgttatggct

SEQ ID NO: 5259725 - DNA, 18 bp, Homo sapiens
aaagctatcttcatgtaa

SEQ ID NO: 5259726 - DNA, 19 bp, Homo sapiens
aaagctatgaatgttacta

SEQ ID NO: 5259727 - DNA, 20 bp, Homo sapiens
aaagctattacttggcaaat

SEQ ID NO: 5259728 - DNA, 15 bp, Homo sapiens
aaagctattagccag

SEQ ID NO: 5259729 - DNA, 19 bp, Homo sapiens
aaagctattagccaggatc

SEQ ID NO: 5259730 - DNA, 17 bp, Homo sapiens
aaagctattggagattt

SEQ ID NO: 5259731 - DNA, 14 bp, Homo sapiens
aaagctatttaagt

SEQ ID NO: 5259732 - DNA, 23 bp, Homo sapiens
aaagctcaaaggtttggaaggag

SEQ ID NO: 5259733 - DNA, 24 bp, Homo sapiens
aaagctcactgctgatcgtagaaa

SEQ ID NO: 5259734 - DNA, 18 bp, Homo sapiens
aaagctcaggaatcctac

SEQ ID NO: 5259735 - DNA, 21 bp, Homo sapiens
aaagctcatattttgtatata

SEQ ID NO: 5259736 - DNA, 16 bp, Homo sapiens
aaagctccatgtttag

SEQ ID NO: 5259737 - DNA, 20 bp, Homo sapiens
aaagctcctcgagggcaggg

SEQ ID NO: 5259738 - DNA, 16 bp, Homo sapiens
aaagctcctgtcctcc

SEQ ID NO: 5259739 - DNA, 19 bp, Homo sapiens
aaagctctagataaaactt

SEQ ID NO: 5259740 - DNA, 20 bp, Homo sapiens
aaagctctatggattatcca

SEQ ID NO: 5259741 - DNA, 18 bp, Homo sapiens
aaagctctctttggaatg

SEQ ID NO: 5259742 - DNA, 21 bp, Homo sapiens
aaagctctctttggaatgaac

SEQ ID NO: 5259743 - DNA, 13 bp, Homo sapiens
aaagctctgaaaa

SEQ ID NO: 5259744 - DNA, 13 bp, Homo sapiens
aaagctctgtggc

SEQ ID NO: 5259745 - DNA, 16 bp, Homo sapiens
aaagctcttcatttct

SEQ ID NO: 5259746 - DNA, 21 bp, Homo sapiens
aaagctcttcctaatcgctaa

SEQ ID NO: 5259747 - DNA, 15 bp, Homo sapiens
aaagctgaaaatgtg

SEQ ID NO: 5259748 - DNA, 15 bp, Homo sapiens
aaagctgaagaaaat

SEQ ID NO: 5259749 - DNA, 14 bp, Homo sapiens
aaagctgaatattt

SEQ ID NO: 5259750 - DNA, 18 bp, Homo sapiens
aaagctgaatccttccat

SEQ ID NO: 5259751 - DNA, 14 bp, Homo sapiens
aaagctgaatttat

SEQ ID NO: 5259752 - DNA, 15 bp, Homo sapiens
aaagctgacattgcc

SEQ ID NO: 5259753 - DNA, 19 bp, Homo sapiens
aaagctgacgaggctgggc

SEQ ID NO: 5259754 - DNA, 14 bp, Homo sapiens
aaagctgactgttt

SEQ ID NO: 5259755 - DNA, 18 bp, Homo sapiens
aaagctgacttggctggt

SEQ ID NO: 5259756 - DNA, 17 bp, Homo sapiens
aaagctgagaactcctg

SEQ ID NO: 5259757 - DNA, 18 bp, Homo sapiens
aaagctgagagaccctgg

SEQ ID NO: 5259758 - DNA, 22 bp, Homo sapiens
aaagctgagagaccctggcctc

SEQ ID NO: 5259759 - DNA, 13 bp, Homo sapiens
aaagctgagcctg

SEQ ID NO: 5259760 - DNA, 16 bp, Homo sapiens
aaagctgaggaacagg

SEQ ID NO: 5259761 - DNA, 22 bp, Homo sapiens
aaagctgatgaggctggtgacg

SEQ ID NO: 5259762 - DNA, 14 bp, Homo sapiens
aaagctgatttttt

SEQ ID NO: 5259763 - DNA, 18 bp, Homo sapiens
aaagctgcaaaaattata

SEQ ID NO: 5259764 - DNA, 16 bp, Homo sapiens
aaagctgcatgtgtag

SEQ ID NO: 5259765 - DNA, 13 bp, Homo sapiens
aaagctgccagcc

SEQ ID NO: 5259766 - DNA, 10 bp, Homo sapiens
aaagctgcct

SEQ ID NO: 5259767 - DNA, 16 bp, Homo sapiens
aaagctgcctgtagtt

SEQ ID NO: 5259768 - DNA, 22 bp, Homo sapiens
aaagctgcctgtgccatgccca

SEQ ID NO: 5259769 - DNA, 16 bp, Homo sapiens
aaagctgctaaatctc

SEQ ID NO: 5259770 - DNA, 18 bp, Homo sapiens
aaagctgctaaatctcct

SEQ ID NO: 5259771 - DNA, 22 bp, Homo sapiens
aaagctgctaaatctcctattt

SEQ ID NO: 5259772 - DNA, 18 bp, Homo sapiens
aaagctgctatccaatga

SEQ ID NO: 5259773 - DNA, 20 bp, Homo sapiens
aaagctgctatccaatgata

SEQ ID NO: 5259774 - DNA, 17 bp, Homo sapiens
aaagctgctgcacagct

SEQ ID NO: 5259775 - DNA, 15 bp, Homo sapiens
aaagctgctgggcca

SEQ ID NO: 5259776 - DNA, 17 bp, Homo sapiens
aaagctgctgggccagt

SEQ ID NO: 5259777 - DNA, 23 bp, Homo sapiens
aaagctgcttgactatcacatac

SEQ ID NO: 5259778 - DNA, 24 bp, Homo sapiens
aaagctgcttgactatcacataca

SEQ ID NO: 5259779 - DNA, 23 bp, Homo sapiens
aaagctgctttcttctctgcctc

SEQ ID NO: 5259780 - DNA, 21 bp, Homo sapiens
aaagctggacaagaagctgct

SEQ ID NO: 5259781 - DNA, 23 bp, Homo sapiens
aaagctggaggaaccattgtgct

SEQ ID NO: 5259782 - DNA, 11 bp, Homo sapiens
aaagctggccc

SEQ ID NO: 5259783 - DNA, 12 bp, Homo sapiens
aaagctggccct

SEQ ID NO: 5259784 - DNA, 20 bp, Homo sapiens
aaagctggtggcagagtcct

SEQ ID NO: 5259785 - DNA, 22 bp, Homo sapiens
aaagctggtgggtgaaagaaat

SEQ ID NO: 5259786 - DNA, 18 bp, Homo sapiens
aaagctggtttaatgttt

SEQ ID NO: 5259787 - DNA, 19 bp, Homo sapiens
aaagctgtaagaaaatgct

SEQ ID NO: 5259788 - DNA, 12 bp, Homo sapiens
aaagctgtgaaa

SEQ ID NO: 5259789 - DNA, 13 bp, Homo sapiens
aaagctgtgtctc

SEQ ID NO: 5259790 - DNA, 15 bp, Homo sapiens
aaagctgtgtctctg

SEQ ID NO: 5259791 - DNA, 16 bp, Homo sapiens
aaagctgtgtctctgt

SEQ ID NO: 5259792 - DNA, 19 bp, Homo sapiens
aaagctgtgtctctgtata

SEQ ID NO: 5259793 - DNA, 19 bp, Homo sapiens
aaagctgtgtctttaggga

SEQ ID NO: 5259794 - DNA, 18 bp, Homo sapiens
aaagctgttaaaatacat

SEQ ID NO: 5259795 - DNA, 17 bp, Homo sapiens
aaagctgttattcttgt

SEQ ID NO: 5259796 - DNA, 20 bp, Homo sapiens
aaagctgttattcttgttat

SEQ ID NO: 5259797 - DNA, 21 bp, Homo sapiens
aaagctgttattcttgttata

SEQ ID NO: 5259798 - DNA, 14 bp, Homo sapiens
aaagctgttccttg

SEQ ID NO: 5259799 - DNA, 17 bp, Homo sapiens
aaagctgttctgtcttc

SEQ ID NO: 5259800 - DNA, 16 bp, Homo sapiens
aaagctgttcttcctg

SEQ ID NO: 5259801 - DNA, 17 bp, Homo sapiens
aaagctgttcttgaaag

SEQ ID NO: 5259802 - DNA, 16 bp, Homo sapiens
aaagctgttgatggta

SEQ ID NO: 5259803 - DNA, 16 bp, Homo sapiens
aaagctgttggatttc

SEQ ID NO: 5259804 - DNA, 19 bp, Homo sapiens
aaagctgttggatttcagt

SEQ ID NO: 5259805 - DNA, 16 bp, Homo sapiens
aaagctgtttcatttg

SEQ ID NO: 5259806 - DNA, 15 bp, Homo sapiens
atggcagaaagatgg

SEQ ID NO: 5259807 - DNA, 13 bp, Homo sapiens
atggcagaagaca

SEQ ID NO: 5259808 - DNA, 22 bp, Homo sapiens
atggcagaagacaccagagcag

SEQ ID NO: 5259809 - DNA, 13 bp, Homo sapiens
atggcagaaggga

SEQ ID NO: 5259810 - DNA, 18 bp, Homo sapiens
atggcagagaagatgaaa

SEQ ID NO: 5259811 - DNA, 16 bp, Homo sapiens
atggcagagccaggct

SEQ ID NO: 5259812 - DNA, 13 bp, Homo sapiens
atggcagagccat

SEQ ID NO: 5259813 - DNA, 20 bp, Homo sapiens
atggcagagttgtaaatata

SEQ ID NO: 5259814 - DNA, 19 bp, Homo sapiens
atggcagagtttgtgtgtt

SEQ ID NO: 5259815 - DNA, 20 bp, Homo sapiens
atggcagagtttgtgtgttg

SEQ ID NO: 5259816 - DNA, 23 bp, Homo sapiens
atggcagagtttgtgtgttgtct

SEQ ID NO: 5259817 - DNA, 14 bp, Homo sapiens
atggcagatgtagg

SEQ ID NO: 5259818 - DNA, 19 bp, Homo sapiens
atggcagcaggcctgttgc

SEQ ID NO: 5259819 - DNA, 18 bp, Homo sapiens
atggcagcatgaattcca

SEQ ID NO: 5259820 - DNA, 22 bp, Homo sapiens
atggcagcatgcgatgtcatat

SEQ ID NO: 5259821 - DNA, 13 bp, Homo sapiens
atggcagcccggc

SEQ ID NO: 5259822 - DNA, 14 bp, Homo sapiens
atggcagcccggct

SEQ ID NO: 5259823 - DNA, 16 bp, Homo sapiens
atggcagcccggctgc

SEQ ID NO: 5259824 - DNA, 17 bp, Homo sapiens
atggcagcccggctgct

SEQ ID NO: 5259825 - DNA, 18 bp, Homo sapiens
atggcagcccggctgctg

SEQ ID NO: 5259826 - DNA, 24 bp, Homo sapiens
atggcagcccggctgctgcttgga

SEQ ID NO: 5259827 - DNA, 19 bp, Homo sapiens
atggcagcctactctcctt

SEQ ID NO: 5259828 - DNA, 21 bp, Homo sapiens
atggcagcctcagggcttcct

SEQ ID NO: 5259829 - DNA, 19 bp, Homo sapiens
atggcagctagactggagt

SEQ ID NO: 5259830 - DNA, 14 bp, Homo sapiens
atggcagctcctga

SEQ ID NO: 5259831 - DNA, 15 bp, Homo sapiens
atggcagctcctgac

SEQ ID NO: 5259832 - DNA, 16 bp, Homo sapiens
atggcagctgggccca

SEQ ID NO: 5259833 - DNA, 19 bp, Homo sapiens
atggcagctgggcccacag

SEQ ID NO: 5259834 - DNA, 20 bp, Homo sapiens
atggcagctgtttaaatgtt

SEQ ID NO: 5259835 - DNA, 22 bp, Homo sapiens
atggcagctgtttctcatgaag

SEQ ID NO: 5259836 - DNA, 18 bp, Homo sapiens
atggcagcttttaaaaga

SEQ ID NO: 5259837 - DNA, 20 bp, Homo sapiens
atggcaggacgtgggctggg

SEQ ID NO: 5259838 - DNA, 21 bp, Homo sapiens
atggcaggacgtgggctgggc

SEQ ID NO: 5259839 - DNA, 16 bp, Homo sapiens
atggcaggactcctgg

SEQ ID NO: 5259840 - DNA, 12 bp, Homo sapiens
atggcaggagct

SEQ ID NO: 5259841 - DNA, 19 bp, Homo sapiens
atggcaggagctactgaga

SEQ ID NO: 5259842 - DNA, 16 bp, Homo sapiens
atggcaggatggcctg

SEQ ID NO: 5259843 - DNA, 15 bp, Homo sapiens
atggcagggaagctt

SEQ ID NO: 5259844 - DNA, 19 bp, Homo sapiens
atggcagggggctgctgct

SEQ ID NO: 5259845 - DNA, 16 bp, Homo sapiens
atggcaggtgtcatat

SEQ ID NO: 5259846 - DNA, 16 bp, Homo sapiens
atggcaggttttacac

SEQ ID NO: 5259847 - DNA, 13 bp, Homo sapiens
atggcagtcctgg

SEQ ID NO: 5259848 - DNA, 14 bp, Homo sapiens
atggcagtcctgga

SEQ ID NO: 5259849 - DNA, 16 bp, Homo sapiens
atggcagtcctggagg

SEQ ID NO: 5259850 - DNA, 20 bp, Homo sapiens
atggcagtgactccccagcc

SEQ ID NO: 5259851 - DNA, 11 bp, Homo sapiens
atggcagtgag

SEQ ID NO: 5259852 - DNA, 16 bp, Homo sapiens
atggcagtgggaccaa

SEQ ID NO: 5259853 - DNA, 15 bp, Homo sapiens
atggcagttatattt

SEQ ID NO: 5259854 - DNA, 16 bp, Homo sapiens
atggcataacctgtct

SEQ ID NO: 5259855 - DNA, 21 bp, Homo sapiens
atggcatagccccggcccccc

SEQ ID NO: 5259856 - DNA, 16 bp, Homo sapiens
atggcatatggtccta

SEQ ID NO: 5259857 - DNA, 20 bp, Homo sapiens
atggcatatttttcacatat

SEQ ID NO: 5259858 - DNA, 17 bp, Homo sapiens
atggcatccaagagtgc

SEQ ID NO: 5259859 - DNA, 17 bp, Homo sapiens
atggcatccctttttca

SEQ ID NO: 5259860 - DNA, 23 bp, Homo sapiens
atggcatctagccagaggctgga

SEQ ID NO: 5259861 - DNA, 16 bp, Homo sapiens
atggcatcttcaatat

SEQ ID NO: 5259862 - DNA, 22 bp, Homo sapiens
atggcatgattagattgcaaag

SEQ ID NO: 5259863 - DNA, 21 bp, Homo sapiens
atggcatgcgccaccatgccc

SEQ ID NO: 5259864 - DNA, 13 bp, Homo sapiens
atggcatggagac

SEQ ID NO: 5259865 - DNA, 20 bp, Homo sapiens
atggcatggagactctgaga

SEQ ID NO: 5259866 - DNA, 21 bp, Homo sapiens
atggcatggagactctgagag

SEQ ID NO: 5259867 - DNA, 23 bp, Homo sapiens
atggcatggagtatagtgcaaat

SEQ ID NO: 5259868 - DNA, 23 bp, Homo sapiens
atggcatgttttgtcattgtttt

SEQ ID NO: 5259869 - DNA, 19 bp, Homo sapiens
atggcattgcactgcttat

SEQ ID NO: 5259870 - DNA, 13 bp, Homo sapiens
atggcatttctct

SEQ ID NO: 5259871 - DNA, 17 bp, Homo sapiens
atggcatttctctttaa

SEQ ID NO: 5259872 - DNA, 24 bp, Homo sapiens
atggcatttgctggttataacagc

SEQ ID NO: 5259873 - DNA, 20 bp, Homo sapiens
atggccaaaagtcagagtta

SEQ ID NO: 5259874 - DNA, 24 bp, Homo sapiens
atggccaaatgttcaatatgagtc

SEQ ID NO: 5259875 - DNA, 19 bp, Homo sapiens
atggccaaggctctctctg

SEQ ID NO: 5259876 - DNA, 23 bp, Homo sapiens
atggccaaggggccagctgcccc

SEQ ID NO: 5259877 - DNA, 14 bp, Homo sapiens
atggccaatagtca

SEQ ID NO: 5259878 - DNA, 20 bp, Homo sapiens
atggccaattcagtttcact

SEQ ID NO: 5259879 - DNA, 18 bp, Homo sapiens
atggccacaaagggacac

SEQ ID NO: 5259880 - DNA, 14 bp, Homo sapiens
atggccacaagttc

SEQ ID NO: 5259881 - DNA, 18 bp, Homo sapiens
atggccacactgtgacac

SEQ ID NO: 5259882 - DNA, 22 bp, Homo sapiens
atggccacactgtgacacacta

SEQ ID NO: 5259883 - DNA, 13 bp, Homo sapiens
atggccacagcca

SEQ ID NO: 5259884 - DNA, 18 bp, Homo sapiens
atggccacagccacctcc

SEQ ID NO: 5259885 - DNA, 19 bp, Homo sapiens
atggccacagccacctcca

SEQ ID NO: 5259886 - DNA, 22 bp, Homo sapiens
atggccacagtagtcttgatga

SEQ ID NO: 5259887 - DNA, 17 bp, Homo sapiens
atggccacatccaacat

SEQ ID NO: 5259888 - DNA, 23 bp, Homo sapiens
atggccacatcctcatggcccat

SEQ ID NO: 5259889 - DNA, 14 bp, Homo sapiens
atggccacatttaa

SEQ ID NO: 5259890 - DNA, 16 bp, Homo sapiens
atggccaccttttcag

SEQ ID NO: 5259891 - DNA, 22 bp, Homo sapiens
atggccagacgtggtggctcac

SEQ ID NO: 5259892 - DNA, 16 bp, Homo sapiens
atggccagactccctt

SEQ ID NO: 5259893 - DNA, 12 bp, Homo sapiens
atggccagagcc

SEQ ID NO: 5259894 - DNA, 13 bp, Homo sapiens
atggccagagcct

SEQ ID NO: 5259895 - DNA, 16 bp, Homo sapiens
atggccagagcctctg

SEQ ID NO: 5259896 - DNA, 17 bp, Homo sapiens
atggccagagcctctgg

SEQ ID NO: 5259897 - DNA, 11 bp, Homo sapiens
atggccagagg

SEQ ID NO: 5259898 - DNA, 14 bp, Homo sapiens
atggccagcccaga

SEQ ID NO: 5259899 - DNA, 12 bp, Homo sapiens
atggccagcccc

SEQ ID NO: 5259900 - DNA, 17 bp, Homo sapiens
atggccagccccttaga

SEQ ID NO: 5259901 - DNA, 20 bp, Homo sapiens
atggccagctggaggcaggg

SEQ ID NO: 5259902 - DNA, 15 bp, Homo sapiens
atggccaggggccag

SEQ ID NO: 5259903 - DNA, 16 bp, Homo sapiens
atggccaggggccagg

SEQ ID NO: 5259904 - DNA, 14 bp, Homo sapiens
atggccaggtacaa

SEQ ID NO: 5259905 - DNA, 15 bp, Homo sapiens
atggccagtgtctgt

SEQ ID NO: 5259906 - DNA, 17 bp, Homo sapiens
atggccagtgtctgtcc

SEQ ID NO: 5259907 - DNA, 23 bp, Homo sapiens
atggccagtttgaagcctgtgcc

SEQ ID NO: 5259908 - DNA, 21 bp, Homo sapiens
atggccatcttctttcttcca

SEQ ID NO: 5259909 - DNA, 10 bp, Homo sapiens
atggccatgc

SEQ ID NO: 5259910 - DNA, 15 bp, Homo sapiens
atggccatggtaccc

SEQ ID NO: 5259911 - DNA, 20 bp, Homo sapiens
atggccattgagctgtttcc

SEQ ID NO: 5259912 - DNA, 16 bp, Homo sapiens
atggcccaagggatgg

SEQ ID NO: 5259913 - DNA, 15 bp, Homo sapiens
atggcccagcaggca

SEQ ID NO: 5259914 - DNA, 15 bp, Homo sapiens
atggcccagccactg

SEQ ID NO: 5259915 - DNA, 17 bp, Homo sapiens
atggcccagccactgca

SEQ ID NO: 5259916 - DNA, 18 bp, Homo sapiens
atggcccagcctggagcc

SEQ ID NO: 5259917 - DNA, 19 bp, Homo sapiens
atggcccagcctggagccg

SEQ ID NO: 5259918 - DNA, 13 bp, Homo sapiens
atggcccaggcag

SEQ ID NO: 5259919 - DNA, 18 bp, Homo sapiens
atggcccaggcagcctca

SEQ ID NO: 5259920 - DNA, 14 bp, Homo sapiens
atggcccagtgtca

SEQ ID NO: 5259921 - DNA, 16 bp, Homo sapiens
atggcccatcaggggc

SEQ ID NO: 5259922 - DNA, 17 bp, Homo sapiens
atggcccattaagagtt

SEQ ID NO: 5259923 - DNA, 24 bp, Homo sapiens
atggcccattctacttgctctgga

SEQ ID NO: 5259924 - DNA, 16 bp, Homo sapiens
atggcccatttaatga

SEQ ID NO: 5259925 - DNA, 14 bp, Homo sapiens
atggccccagcaca

SEQ ID NO: 5259926 - DNA, 20 bp, Homo sapiens
atggccccagcacagcttga

SEQ ID NO: 5259927 - DNA, 17 bp, Homo sapiens
atggccccagctggctg

SEQ ID NO: 5259928 - DNA, 22 bp, Homo sapiens
atggccccaggcatctgcctct

SEQ ID NO: 5259929 - DNA, 18 bp, Homo sapiens
atggccccatctggatgt

SEQ ID NO: 5259930 - DNA, 18 bp, Homo sapiens
atggcccccaataaaggc

SEQ ID NO: 5259931 - DNA, 19 bp, Homo sapiens
atggcccccaataaaggca

SEQ ID NO: 5259932 - DNA, 21 bp, Homo sapiens
atggcccccaataaaggcagc

SEQ ID NO: 5259933 - DNA, 13 bp, Homo sapiens
atggcccccaggg

SEQ ID NO: 5259934 - DNA, 14 bp, Homo sapiens
atggcccccagggg

SEQ ID NO: 5259935 - DNA, 16 bp, Homo sapiens
atggcccccaggggca

SEQ ID NO: 5259936 - DNA, 22 bp, Homo sapiens
atggcccccaggggcaggactg

SEQ ID NO: 5259937 - DNA, 16 bp, Homo sapiens
atggccccccactccc

SEQ ID NO: 5259938 - DNA, 13 bp, Homo sapiens
atggcccctccac

SEQ ID NO: 5259939 - DNA, 15 bp, Homo sapiens
atggcccctccattt

SEQ ID NO: 5259940 - DNA, 18 bp, Homo sapiens
atggcccggatgctgctt

SEQ ID NO: 5259941 - DNA, 21 bp, Homo sapiens
atggcccggatgctgcttccg

SEQ ID NO: 5259942 - DNA, 20 bp, Homo sapiens
atggcccgggccttatccag

SEQ ID NO: 5259943 - DNA, 21 bp, Homo sapiens
atggccctcggaggtccagct

SEQ ID NO: 5259944 - DNA, 18 bp, Homo sapiens
atggccctgcaaaaatat

SEQ ID NO: 5259945 - DNA, 17 bp, Homo sapiens
atggccctgctgcccct

SEQ ID NO: 5259946 - DNA, 13 bp, Homo sapiens
atggccctgggcg

SEQ ID NO: 5259947 - DNA, 14 bp, Homo sapiens
atggccctgtagct

SEQ ID NO: 5259948 - DNA, 21 bp, Homo sapiens
atggccctgtagttaggcctg

SEQ ID NO: 5259949 - DNA, 21 bp, Homo sapiens
atggcccttcctcctccacca

SEQ ID NO: 5259950 - DNA, 23 bp, Homo sapiens
atggcccttcctggactggccct

SEQ ID NO: 5259951 - DNA, 20 bp, Homo sapiens
atggccgaagccccttggag

SEQ ID NO: 5259952 - DNA, 21 bp, Homo sapiens
atggccgatggggcccacatt

SEQ ID NO: 5259953 - DNA, 20 bp, Homo sapiens
atggccgcagggctgtgcac

SEQ ID NO: 5259954 - DNA, 18 bp, Homo sapiens
atggccgcttctagagcc

SEQ ID NO: 5259955 - DNA, 20 bp, Homo sapiens
atggccgcttctagagcctc

SEQ ID NO: 5259956 - DNA, 14 bp, Homo sapiens
atggccgggcaggg

SEQ ID NO: 5259957 - DNA, 16 bp, Homo sapiens
atggccgggccctctg

SEQ ID NO: 5259958 - DNA, 16 bp, Homo sapiens
atggccgggccctgct

SEQ ID NO: 5259959 - DNA, 17 bp, Homo sapiens
atggccgggctgctgct

SEQ ID NO: 5259960 - DNA, 22 bp, Homo sapiens
atggccgtgaatgggtgcccac

SEQ ID NO: 5259961 - DNA, 14 bp, Homo sapiens
atggccgtggatgc

SEQ ID NO: 5259962 - DNA, 18 bp, Homo sapiens
atggccgtgtagaagcat

SEQ ID NO: 5259963 - DNA, 15 bp, Homo sapiens
atggcctaaatttat

SEQ ID NO: 5259964 - DNA, 13 bp, Homo sapiens
atggcctcagctg

SEQ ID NO: 5259965 - DNA, 18 bp, Homo sapiens
atggcctcagctgcctca

SEQ ID NO: 5259966 - DNA, 14 bp, Homo sapiens
atggcctcccagcc

SEQ ID NO: 5259967 - DNA, 13 bp, Homo sapiens
atggcctcctccc

SEQ ID NO: 5259968 - DNA, 16 bp, Homo sapiens
atggcctctctccact

SEQ ID NO: 5259969 - DNA, 14 bp, Homo sapiens
atggcctctggcca

SEQ ID NO: 5259970 - DNA, 14 bp, Homo sapiens
atggcctctggggc

SEQ ID NO: 5259971 - DNA, 13 bp, Homo sapiens
atggcctcttgaa

SEQ ID NO: 5259972 - DNA, 16 bp, Homo sapiens
atggcctcttgaagag

SEQ ID NO: 5259973 - DNA, 23 bp, Homo sapiens
atggcctcttgaagagaaaaaag

SEQ ID NO: 5259974 - DNA, 20 bp, Homo sapiens
atggcctgacagctctgttt

SEQ ID NO: 5259975 - DNA, 17 bp, Homo sapiens
atggcctgagaagagag

SEQ ID NO: 5259976 - DNA, 15 bp, Homo sapiens
atggcctgagcatcc

SEQ ID NO: 5259977 - DNA, 22 bp, Homo sapiens
atggcctgcaaactgggaaccc

SEQ ID NO: 5259978 - DNA, 20 bp, Homo sapiens
atggcctgccttgaagccac

SEQ ID NO: 5259979 - DNA, 13 bp, Homo sapiens
atggcctggagca

SEQ ID NO: 5259980 - DNA, 17 bp, Homo sapiens
atggcctggagcaggcc

SEQ ID NO: 5259981 - DNA, 19 bp, Homo sapiens
atggcctggagcaggccca

SEQ ID NO: 5259982 - DNA, 16 bp, Homo sapiens
atggcctggctgcctg

SEQ ID NO: 5259983 - DNA, 17 bp, Homo sapiens
atggcctggctgcctgg

SEQ ID NO: 5259984 - DNA, 14 bp, Homo sapiens
atggcctgtcccta

SEQ ID NO: 5259985 - DNA, 22 bp, Homo sapiens
atggcctgtgctgggccagtgg

SEQ ID NO: 5259986 - DNA, 18 bp, Homo sapiens
atggccttaatttccttt

SEQ ID NO: 5259987 - DNA, 19 bp, Homo sapiens
atggccttaatttcctttt

SEQ ID NO: 5259988 - DNA, 23 bp, Homo sapiens
atggccttcccgccggaggccag

SEQ ID NO: 5259989 - DNA, 18 bp, Homo sapiens
atggccttccctccccac

SEQ ID NO: 5259990 - DNA, 12 bp, Homo sapiens
atggcctttcta

SEQ ID NO: 5259991 - DNA, 13 bp, Homo sapiens
atggcctttgctt

SEQ ID NO: 5259992 - DNA, 14 bp, Homo sapiens
atggcctttggacc

SEQ ID NO: 5259993 - DNA, 17 bp, Homo sapiens
atggcctttggacccag

SEQ ID NO: 5259994 - DNA, 23 bp, Homo sapiens
atggcctttggacccagggcctg

SEQ ID NO: 5259995 - DNA, 17 bp, Homo sapiens
atggcgaccaccaaagt

SEQ ID NO: 5259996 - DNA, 24 bp, Homo sapiens
atggcgaggcctctctcaggagca

SEQ ID NO: 5259997 - DNA, 21 bp, Homo sapiens
atggcgatggggactctgccg

SEQ ID NO: 5259998 - DNA, 21 bp, Homo sapiens
atggcgattcccattgaaaat

SEQ ID NO: 5259999 - DNA, 22 bp, Homo sapiens
atggcgattcccattgaaaatg

SEQ ID NO: 5260000 - DNA, 14 bp, Homo sapiens
atggcgcagtgcct

SEQ ID NO: 5260001 - DNA, 16 bp, Homo sapiens
atggcgcagtgcctct

SEQ ID NO: 5260002 - DNA, 20 bp, Homo sapiens
atggcgccaccagctctgcc

SEQ ID NO: 5260003 - DNA, 16 bp, Homo sapiens
atggcgccctgcctcc

SEQ ID NO: 5260004 - DNA, 22 bp, Homo sapiens
atggcgccctgcctcctggagg

SEQ ID NO: 5260005 - DNA, 23 bp, Homo sapiens
atggcgccctgcctcctggagga

SEQ ID NO: 5260006 - DNA, 21 bp, Homo sapiens
atggcgcctgctccctccaga

SEQ ID NO: 5260007 - DNA, 15 bp, Homo sapiens
atggcgcgggaggca

SEQ ID NO: 5260008 - DNA, 17 bp, Homo sapiens
atggcgcgggaggcacc

SEQ ID NO: 5260009 - DNA, 18 bp, Homo sapiens
atggcgcgggaggcacca

SEQ ID NO: 5260010 - DNA, 19 bp, Homo sapiens
atggcgctattgcactcca

SEQ ID NO: 5260011 - DNA, 22 bp, Homo sapiens
atggcggcccctcagcctgcct

SEQ ID NO: 5260012 - DNA, 17 bp, Homo sapiens
atggcggcctgcagtgg

SEQ ID NO: 5260013 - DNA, 13 bp, Homo sapiens
atggcgggactgg

SEQ ID NO: 5260014 - DNA, 13 bp, Homo sapiens
atggcgggcactg

SEQ ID NO: 5260015 - DNA, 22 bp, Homo sapiens
atggcgtaagtacagagaagcc

SEQ ID NO: 5260016 - DNA, 23 bp, Homo sapiens
atggcgtaagtacagagaagcca

SEQ ID NO: 5260017 - DNA, 17 bp, Homo sapiens
atggcgtaatgggcctg

SEQ ID NO: 5260018 - DNA, 21 bp, Homo sapiens
atggcgtaatgggcctgccca

SEQ ID NO: 5260019 - DNA, 20 bp, Homo sapiens
atggcgtagagggtgctgcc

SEQ ID NO: 5260020 - DNA, 15 bp, Homo sapiens
atggcgtcctgccct

SEQ ID NO: 5260021 - DNA, 14 bp, Homo sapiens
atggcgtctgctct

SEQ ID NO: 5260022 - DNA, 18 bp, Homo sapiens
atggcgtgtcccctgcct

SEQ ID NO: 5260023 - DNA, 18 bp, Homo sapiens
atggcgttttgtctgtgt

SEQ ID NO: 5260024 - DNA, 16 bp, Homo sapiens
atggctaataaactgt

SEQ ID NO: 5260025 - DNA, 22 bp, Homo sapiens
atggctaataaactgtattaaa

SEQ ID NO: 5260026 - DNA, 22 bp, Homo sapiens
atggctactttggtttctgtct

SEQ ID NO: 5260027 - DNA, 22 bp, Homo sapiens
atggctagaatatcctacttct

SEQ ID NO: 5260028 - DNA, 21 bp, Homo sapiens
atggctagtactgtattggct

SEQ ID NO: 5260029 - DNA, 14 bp, Homo sapiens
atggctataaatat

SEQ ID NO: 5260030 - DNA, 21 bp, Homo sapiens
atggctataaatatataaaaa

SEQ ID NO: 5260031 - DNA, 21 bp, Homo sapiens
atggctataggtgctacaaaa

SEQ ID NO: 5260032 - DNA, 23 bp, Homo sapiens
atggctataggtgctacaaaaac

SEQ ID NO: 5260033 - DNA, 15 bp, Homo sapiens
atggctatgaacaga

SEQ ID NO: 5260034 - DNA, 19 bp, Homo sapiens
atggctatgtttttaatgt

SEQ ID NO: 5260035 - DNA, 14 bp, Homo sapiens
atggctattaacaa

SEQ ID NO: 5260036 - DNA, 22 bp, Homo sapiens
atggctattaacaattaattgt

SEQ ID NO: 5260037 - DNA, 18 bp, Homo sapiens
atggctcaagtctgcaca

SEQ ID NO: 5260038 - DNA, 18 bp, Homo sapiens
atggctcactatgaatct

SEQ ID NO: 5260039 - DNA, 22 bp, Homo sapiens
atggctcactatggtgccaatg

SEQ ID NO: 5260040 - DNA, 16 bp, Homo sapiens
atggctcactgcagcc

SEQ ID NO: 5260041 - DNA, 19 bp, Homo sapiens
atggctcactgcagcctcg

SEQ ID NO: 5260042 - DNA, 13 bp, Homo sapiens
atggctcagaggg

SEQ ID NO: 5260043 - DNA, 15 bp, Homo sapiens
atggctcagaggggg

SEQ ID NO: 5260044 - DNA, 12 bp, Homo sapiens
atggctcaggca

SEQ ID NO: 5260045 - DNA, 20 bp, Homo sapiens
atggctcattgtagcacaat

SEQ ID NO: 5260046 - DNA, 13 bp, Homo sapiens
atggctccaacag

SEQ ID NO: 5260047 - DNA, 17 bp, Homo sapiens
atggctccagaaatgtc

SEQ ID NO: 5260048 - DNA, 13 bp, Homo sapiens
atggctccagtct

SEQ ID NO: 5260049 - DNA, 22 bp, Homo sapiens
atggctccagtctgctgccctc

SEQ ID NO: 5260050 - DNA, 17 bp, Homo sapiens
atggctcccacaggagt

SEQ ID NO: 5260051 - DNA, 14 bp, Homo sapiens
atggctcccctgag

SEQ ID NO: 5260052 - DNA, 15 bp, Homo sapiens
atggctcccctgagg

SEQ ID NO: 5260053 - DNA, 20 bp, Homo sapiens
atggctcccctgaggctggc

SEQ ID NO: 5260054 - DNA, 16 bp, Homo sapiens
atggctccctgggctg

SEQ ID NO: 5260055 - DNA, 21 bp, Homo sapiens
atggctccctgggctggcatg

SEQ ID NO: 5260056 - DNA, 23 bp, Homo sapiens
atggctccgaacaccctcgaagc

SEQ ID NO: 5260057 - DNA, 12 bp, Homo sapiens
atggctcctctc

SEQ ID NO: 5260058 - DNA, 14 bp, Homo sapiens
atggctcctgtctg

SEQ ID NO: 5260059 - DNA, 22 bp, Homo sapiens
atggctccttgggatgaagagg

SEQ ID NO: 5260060 - DNA, 13 bp, Homo sapiens
atggctctatttc

SEQ ID NO: 5260061 - DNA, 16 bp, Homo sapiens
atggctctatttcttc

SEQ ID NO: 5260062 - DNA, 23 bp, Homo sapiens
atggctctatttcttcttcacat

SEQ ID NO: 5260063 - DNA, 17 bp, Homo sapiens
atggctctgaactgcac

SEQ ID NO: 5260064 - DNA, 18 bp, Homo sapiens
atggctctgggctatatg

SEQ ID NO: 5260065 - DNA, 13 bp, Homo sapiens
atggctcttagaa

SEQ ID NO: 5260066 - DNA, 12 bp, Homo sapiens
atggctgaagaa

SEQ ID NO: 5260067 - DNA, 20 bp, Homo sapiens
atggctgaagaaacacagca

SEQ ID NO: 5260068 - DNA, 15 bp, Homo sapiens
atggctgaagctgga

SEQ ID NO: 5260069 - DNA, 18 bp, Homo sapiens
atggctgaagctggagca

SEQ ID NO: 5260070 - DNA, 19 bp, Homo sapiens
atggctgaagctggagcag

SEQ ID NO: 5260071 - DNA, 21 bp, Homo sapiens
atggctgaaggaaaccagtgc

SEQ ID NO: 5260072 - DNA, 17 bp, Homo sapiens
atggctgaagttggcca

SEQ ID NO: 5260073 - DNA, 20 bp, Homo sapiens
atggctgataattttaaatt

SEQ ID NO: 5260074 - DNA, 18 bp, Homo sapiens
atggctgcaagagcccag

SEQ ID NO: 5260075 - DNA, 23 bp, Homo sapiens
atggctgcccctgcgtggcctga

SEQ ID NO: 5260076 - DNA, 11 bp, Homo sapiens
atggctgcctg

SEQ ID NO: 5260077 - DNA, 19 bp, Homo sapiens
atggctgctgaagctgcct

SEQ ID NO: 5260078 - DNA, 22 bp, Homo sapiens
atggctgctgaagctgcctgct

SEQ ID NO: 5260079 - DNA, 23 bp, Homo sapiens
atggctgctgaagctgcctgctt

SEQ ID NO: 5260080 - DNA, 12 bp, Homo sapiens
atggctgctgct

SEQ ID NO: 5260081 - DNA, 12 bp, Homo sapiens
atggctgctttg

SEQ ID NO: 5260082 - DNA, 18 bp, Homo sapiens
atggctggaaggagccag

SEQ ID NO: 5260083 - DNA, 18 bp, Homo sapiens
atggctggagctagaatt

SEQ ID NO: 5260084 - DNA, 15 bp, Homo sapiens
atggctggccactgc

SEQ ID NO: 5260085 - DNA, 16 bp, Homo sapiens
atggctggccactgca

SEQ ID NO: 5260086 - DNA, 21 bp, Homo sapiens
atggctgggaactgcagacct

SEQ ID NO: 5260087 - DNA, 22 bp, Homo sapiens
atggctgggaactgcagacctg

SEQ ID NO: 5260088 - DNA, 17 bp, Homo sapiens
atggctggggccgctgg

SEQ ID NO: 5260089 - DNA, 21 bp, Homo sapiens
atggctggggccgctggggtc

SEQ ID NO: 5260090 - DNA, 17 bp, Homo sapiens
atggctgggggagggac

SEQ ID NO: 5260091 - DNA, 21 bp, Homo sapiens
atggctgggggagggactgct

SEQ ID NO: 5260092 - DNA, 20 bp, Homo sapiens
atggctgggtccttgggcct

SEQ ID NO: 5260093 - DNA, 21 bp, Homo sapiens
atggctgggtccttgggcctg

SEQ ID NO: 5260094 - DNA, 20 bp, Homo sapiens
atggctgtaaactataaact

SEQ ID NO: 5260095 - DNA, 12 bp, Homo sapiens
atggctgtattt

SEQ ID NO: 5260096 - DNA, 19 bp, Homo sapiens
atggctgtatttgctgttg

SEQ ID NO: 5260097 - DNA, 17 bp, Homo sapiens
atggctgtctgcacaga

SEQ ID NO: 5260098 - DNA, 18 bp, Homo sapiens
atggctgtgaaaattaca

SEQ ID NO: 5260099 - DNA, 13 bp, Homo sapiens
atggctgtgagga

SEQ ID NO: 5260100 - DNA, 16 bp, Homo sapiens
atggctgtgccccacc

SEQ ID NO: 5260101 - DNA, 17 bp, Homo sapiens
atggctgtgcctctgcc

SEQ ID NO: 5260102 - DNA, 18 bp, Homo sapiens
atggctgtgcctctgcct

SEQ ID NO: 5260103 - DNA, 19 bp, Homo sapiens
atggctgtgcctctgcctg

SEQ ID NO: 5260104 - DNA, 16 bp, Homo sapiens
atggctgtggagtgtg

SEQ ID NO: 5260105 - DNA, 21 bp, Homo sapiens
atggctgtggcatttccaaac

SEQ ID NO: 5260106 - DNA, 22 bp, Homo sapiens
atggctgtgttggtgtggccca

SEQ ID NO: 5260107 - DNA, 16 bp, Homo sapiens
atggcttaaaaatact

SEQ ID NO: 5260108 - DNA, 14 bp, Homo sapiens
atggcttaatgttt

SEQ ID NO: 5260109 - DNA, 21 bp, Homo sapiens
atggcttaatgtttattcctg

SEQ ID NO: 5260110 - DNA, 20 bp, Homo sapiens
atggcttacttacaaaagca

SEQ ID NO: 5260111 - DNA, 21 bp, Homo sapiens
atggcttataaatgtgtattc

SEQ ID NO: 5260112 - DNA, 14 bp, Homo sapiens
atggcttattgtgt

SEQ ID NO: 5260113 - DNA, 15 bp, Homo sapiens
atggcttattgtgtg

SEQ ID NO: 5260114 - DNA, 20 bp, Homo sapiens
atggcttattttttaaaata

SEQ ID NO: 5260115 - DNA, 22 bp, Homo sapiens
atggcttattttttaaaatatt

SEQ ID NO: 5260116 - DNA, 16 bp, Homo sapiens
atggcttccaaggtgg

SEQ ID NO: 5260117 - DNA, 21 bp, Homo sapiens
atggcttccaaggtggtctgc

SEQ ID NO: 5260118 - DNA, 12 bp, Homo sapiens
atggcttcctcc

SEQ ID NO: 5260119 - DNA, 15 bp, Homo sapiens
atggcttcctcctcc

SEQ ID NO: 5260120 - DNA, 20 bp, Homo sapiens
atggcttcggacaaaatatc

SEQ ID NO: 5260121 - DNA, 21 bp, Homo sapiens
atggcttcggagggccgcagg

SEQ ID NO: 5260122 - DNA, 15 bp, Homo sapiens
atggcttctctgttt

SEQ ID NO: 5260123 - DNA, 17 bp, Homo sapiens
atggcttgagcccagga

SEQ ID NO: 5260124 - DNA, 18 bp, Homo sapiens
atggcttgccacagctct

SEQ ID NO: 5260125 - DNA, 14 bp, Homo sapiens
atggcttggggagc

SEQ ID NO: 5260126 - DNA, 16 bp, Homo sapiens
atggcttggggagcag

SEQ ID NO: 5260127 - DNA, 18 bp, Homo sapiens
atggcttggggagcagag

SEQ ID NO: 5260128 - DNA, 19 bp, Homo sapiens
atggcttggggagcagagt

SEQ ID NO: 5260129 - DNA, 19 bp, Homo sapiens
atggcttgtagggtgaggc

SEQ ID NO: 5260130 - DNA, 14 bp, Homo sapiens
atggcttgtgaact

SEQ ID NO: 5260131 - DNA, 23 bp, Homo sapiens
atggcttgttcatcatccagatg

SEQ ID NO: 5260132 - DNA, 20 bp, Homo sapiens
atggctttatttgttttttt

SEQ ID NO: 5260133 - DNA, 22 bp, Homo sapiens
atggctttcaatacccttttaa

SEQ ID NO: 5260134 - DNA, 15 bp, Homo sapiens
atggctttcagaaaa

SEQ ID NO: 5260135 - DNA, 16 bp, Homo sapiens
atggctttcagaaaac

SEQ ID NO: 5260136 - DNA, 23 bp, Homo sapiens
atggctttcagaaaacgggaagc

SEQ ID NO: 5260137 - DNA, 20 bp, Homo sapiens
atggctttgtcttgaaaaaa

SEQ ID NO: 5260138 - DNA, 17 bp, Homo sapiens
atggctttgtgattcaa

SEQ ID NO: 5260139 - DNA, 17 bp, Homo sapiens
atggctttgtgctgctg

SEQ ID NO: 5260140 - DNA, 20 bp, Homo sapiens
atggctttgtgctgctgagt

SEQ ID NO: 5260141 - DNA, 14 bp, Homo sapiens
atggcttttcctgg

SEQ ID NO: 5260142 - DNA, 16 bp, Homo sapiens
atggcttttctcttgc

SEQ ID NO: 5260143 - DNA, 16 bp, Homo sapiens
atggcttttgtgcatt

SEQ ID NO: 5260144 - DNA, 17 bp, Homo sapiens
atggcttttgtgcatta

SEQ ID NO: 5260145 - DNA, 13 bp, Homo sapiens
atgggaaaaactg

SEQ ID NO: 5260146 - DNA, 13 bp, Homo sapiens
atgggaaaaagag

SEQ ID NO: 5260147 - DNA, 18 bp, Homo sapiens
atgggaaaaaggctggaa

SEQ ID NO: 5260148 - DNA, 21 bp, Homo sapiens
atgggaaaaatctaaaatgtg

SEQ ID NO: 5260149 - DNA, 18 bp, Homo sapiens
atgggaaacttccaagac

SEQ ID NO: 5260150 - DNA, 20 bp, Homo sapiens
atgggaaagagaaagagaca

SEQ ID NO: 5260151 - DNA, 14 bp, Homo sapiens
atgggaaagcattg

SEQ ID NO: 5260152 - DNA, 23 bp, Homo sapiens
atgggaaagccacctctccctca

SEQ ID NO: 5260153 - DNA, 21 bp, Homo sapiens
atgggaaagtattctgtactc

SEQ ID NO: 5260154 - DNA, 13 bp, Homo sapiens
atgggaaataaag

SEQ ID NO: 5260155 - DNA, 15 bp, Homo sapiens
atgggaaataaagaa

SEQ ID NO: 5260156 - DNA, 16 bp, Homo sapiens
atgggaaataaagaaa

SEQ ID NO: 5260157 - DNA, 17 bp, Homo sapiens
atgggaaataaagaaaa

SEQ ID NO: 5260158 - DNA, 19 bp, Homo sapiens
atgggaaataaagaaaatt

SEQ ID NO: 5260159 - DNA, 22 bp, Homo sapiens
atgggaaataaagaaaattctc

SEQ ID NO: 5260160 - DNA, 18 bp, Homo sapiens
atgggaaatagtctgatt

SEQ ID NO: 5260161 - DNA, 16 bp, Homo sapiens
aaagcttaaaactttg

SEQ ID NO: 5260162 - DNA, 19 bp, Homo sapiens
aaagcttaaaactttgaag

SEQ ID NO: 5260163 - DNA, 13 bp, Homo sapiens
aaagcttaaactg

SEQ ID NO: 5260164 - DNA, 15 bp, Homo sapiens
aaagcttaatatatt

SEQ ID NO: 5260165 - DNA, 23 bp, Homo sapiens
aaagcttacattttcctgagacc

SEQ ID NO: 5260166 - DNA, 15 bp, Homo sapiens
aaagcttactgtttt

SEQ ID NO: 5260167 - DNA, 15 bp, Homo sapiens
aaagcttagcaggag

SEQ ID NO: 5260168 - DNA, 15 bp, Homo sapiens
aaagcttaggtcaaa

SEQ ID NO: 5260169 - DNA, 23 bp, Homo sapiens
aaagcttatccataaaaaaaaat

SEQ ID NO: 5260170 - DNA, 18 bp, Homo sapiens
aaagcttattttgtaaga

SEQ ID NO: 5260171 - DNA, 22 bp, Homo sapiens
aaagcttcaaattatagaaaca

SEQ ID NO: 5260172 - DNA, 21 bp, Homo sapiens
aaagcttcagactcaagtacc

SEQ ID NO: 5260173 - DNA, 17 bp, Homo sapiens
aaagcttcagtgctgcc

SEQ ID NO: 5260174 - DNA, 13 bp, Homo sapiens
aaagcttccctcc

SEQ ID NO: 5260175 - DNA, 20 bp, Homo sapiens
aaagcttccctccctgctgt

SEQ ID NO: 5260176 - DNA, 17 bp, Homo sapiens
aaagcttctctctgagc

SEQ ID NO: 5260177 - DNA, 22 bp, Homo sapiens
aaagcttgaaaagattctgaaa

SEQ ID NO: 5260178 - DNA, 13 bp, Homo sapiens
aaagcttgtaaat

SEQ ID NO: 5260179 - DNA, 13 bp, Homo sapiens
aaagcttgtgaaa

SEQ ID NO: 5260180 - DNA, 14 bp, Homo sapiens
aaagcttgtgaaaa

SEQ ID NO: 5260181 - DNA, 15 bp, Homo sapiens
aaagcttgtgtatct

SEQ ID NO: 5260182 - DNA, 19 bp, Homo sapiens
aaagcttgtgtatcttgat

SEQ ID NO: 5260183 - DNA, 14 bp, Homo sapiens
aaagctttaaaaaa

SEQ ID NO: 5260184 - DNA, 23 bp, Homo sapiens
aaagctttagattgaaatttatg

SEQ ID NO: 5260185 - DNA, 18 bp, Homo sapiens
aaagctttatatgtaatt

SEQ ID NO: 5260186 - DNA, 14 bp, Homo sapiens
aaagctttatcttt

SEQ ID NO: 5260187 - DNA, 14 bp, Homo sapiens
aaagctttcctgcc

SEQ ID NO: 5260188 - DNA, 22 bp, Homo sapiens
aaagctttcctgccccaggcct

SEQ ID NO: 5260189 - DNA, 23 bp, Homo sapiens
aaagctttcctgccccaggcctg

SEQ ID NO: 5260190 - DNA, 15 bp, Homo sapiens
aaagctttcctggag

SEQ ID NO: 5260191 - DNA, 23 bp, Homo sapiens
aaagctttcctgtttccagggtc

SEQ ID NO: 5260192 - DNA, 20 bp, Homo sapiens
aaagctttctgacaagataa

SEQ ID NO: 5260193 - DNA, 18 bp, Homo sapiens
aaagctttcttttctaac

SEQ ID NO: 5260194 - DNA, 19 bp, Homo sapiens
aaagctttgaatactgtga

SEQ ID NO: 5260195 - DNA, 22 bp, Homo sapiens
aaagctttgctacaaatttatg

SEQ ID NO: 5260196 - DNA, 16 bp, Homo sapiens
aaagctttggacaagt

SEQ ID NO: 5260197 - DNA, 20 bp, Homo sapiens
aaagctttggctgagacctg

SEQ ID NO: 5260198 - DNA, 20 bp, Homo sapiens
aaagctttgtttgttcttgt

SEQ ID NO: 5260199 - DNA, 15 bp, Homo sapiens
aaagctttgttttgt

SEQ ID NO: 5260200 - DNA, 14 bp, Homo sapiens
aaagcttttaaaat

SEQ ID NO: 5260201 - DNA, 16 bp, Homo sapiens
aaagcttttgtaaaat

SEQ ID NO: 5260202 - DNA, 14 bp, Homo sapiens
aaaggaaaaaaaac

SEQ ID NO: 5260203 - DNA, 13 bp, Homo sapiens
aaaggaaaaacag

SEQ ID NO: 5260204 - DNA, 15 bp, Homo sapiens
aaaggaaaaagtatc

SEQ ID NO: 5260205 - DNA, 22 bp, Homo sapiens
aaaggaaaaagtatcatggaaa

SEQ ID NO: 5260206 - DNA, 14 bp, Homo sapiens
aaaggaaaaataac

SEQ ID NO: 5260207 - DNA, 15 bp, Homo sapiens
aaaggaaaaatattg

SEQ ID NO: 5260208 - DNA, 14 bp, Homo sapiens
aaaggaaaaatgta

SEQ ID NO: 5260209 - DNA, 18 bp, Homo sapiens
aaaggaaaaatgtagact

SEQ ID NO: 5260210 - DNA, 12 bp, Homo sapiens
aaaggaaaaatt

SEQ ID NO: 5260211 - DNA, 15 bp, Homo sapiens
aaaggaaaacaaaaa

SEQ ID NO: 5260212 - DNA, 22 bp, Homo sapiens
aaaggaaaacaattcaagctga

SEQ ID NO: 5260213 - DNA, 17 bp, Homo sapiens
aaaggaaaagattcctg

SEQ ID NO: 5260214 - DNA, 13 bp, Homo sapiens
aaaggaaaataat

SEQ ID NO: 5260215 - DNA, 15 bp, Homo sapiens
aaaggaaaataatgt

SEQ ID NO: 5260216 - DNA, 20 bp, Homo sapiens
aaaggaaacaagctttggct

SEQ ID NO: 5260217 - DNA, 14 bp, Homo sapiens
aaaggaaaccaagt

SEQ ID NO: 5260218 - DNA, 12 bp, Homo sapiens
aaaggaaacctt

SEQ ID NO: 5260219 - DNA, 16 bp, Homo sapiens
aaaggaaagaaaacat

SEQ ID NO: 5260220 - DNA, 12 bp, Homo sapiens
aaaggaaagaag

SEQ ID NO: 5260221 - DNA, 15 bp, Homo sapiens
aaaggaaagctgtgt

SEQ ID NO: 5260222 - DNA, 21 bp, Homo sapiens
aaaggaaagttctattatctg

SEQ ID NO: 5260223 - DNA, 16 bp, Homo sapiens
aaaggaaatatttttc

SEQ ID NO: 5260224 - DNA, 17 bp, Homo sapiens
aaaggaaatgtttgagt

SEQ ID NO: 5260225 - DNA, 23 bp, Homo sapiens
aaaggaacaaaaattacaaagaa

SEQ ID NO: 5260226 - DNA, 21 bp, Homo sapiens
aaaggaaccgcccagtgcagg

SEQ ID NO: 5260227 - DNA, 17 bp, Homo sapiens
aaaggaactaacttact

SEQ ID NO: 5260228 - DNA, 12 bp, Homo sapiens
aaaggaactaga

SEQ ID NO: 5260229 - DNA, 15 bp, Homo sapiens
aaaggaactgcagca

SEQ ID NO: 5260230 - DNA, 22 bp, Homo sapiens
aaaggaactgggtggtttggtt

SEQ ID NO: 5260231 - DNA, 13 bp, Homo sapiens
aaaggaagaaaaa

SEQ ID NO: 5260232 - DNA, 12 bp, Homo sapiens
aaaggaagacta

SEQ ID NO: 5260233 - DNA, 13 bp, Homo sapiens
aaaggaagactag

SEQ ID NO: 5260234 - DNA, 19 bp, Homo sapiens
aaaggaagagctaataaat

SEQ ID NO: 5260235 - DNA, 20 bp, Homo sapiens
aaaggaagcattgtaaaata

SEQ ID NO: 5260236 - DNA, 15 bp, Homo sapiens
aaaggaagccaaaga

SEQ ID NO: 5260237 - DNA, 12 bp, Homo sapiens
aaaggaaggaaa

SEQ ID NO: 5260238 - DNA, 13 bp, Homo sapiens
aaaggaaggaaaa

SEQ ID NO: 5260239 - DNA, 15 bp, Homo sapiens
aaaggaaggagagat

SEQ ID NO: 5260240 - DNA, 23 bp, Homo sapiens
aaaggaaggtagttcaagaaatg

SEQ ID NO: 5260241 - DNA, 20 bp, Homo sapiens
aaaggaaggttctggtgtga

SEQ ID NO: 5260242 - DNA, 14 bp, Homo sapiens
aaaggaagtctagg

SEQ ID NO: 5260243 - DNA, 21 bp, Homo sapiens
aaaggaagtggggacagattc

SEQ ID NO: 5260244 - DNA, 20 bp, Homo sapiens
aaaggaataacctttctgga

SEQ ID NO: 5260245 - DNA, 17 bp, Homo sapiens
aaaggaatcatttctat

SEQ ID NO: 5260246 - DNA, 21 bp, Homo sapiens
aaaggaatccactcccaggca

SEQ ID NO: 5260247 - DNA, 12 bp, Homo sapiens
aaaggaatgcaa

SEQ ID NO: 5260248 - DNA, 22 bp, Homo sapiens
aaaggaatgcaaagatgaaggt

SEQ ID NO: 5260249 - DNA, 18 bp, Homo sapiens
aaaggacaaataaaacat

SEQ ID NO: 5260250 - DNA, 16 bp, Homo sapiens
aaaggacaaataaagc

SEQ ID NO: 5260251 - DNA, 17 bp, Homo sapiens
aaaggacaaataaagca

SEQ ID NO: 5260252 - DNA, 15 bp, Homo sapiens
aaaggacaatttcaa

SEQ ID NO: 5260253 - DNA, 15 bp, Homo sapiens
aaaggacagagccag

SEQ ID NO: 5260254 - DNA, 17 bp, Homo sapiens
aaaggacagctttgata

SEQ ID NO: 5260255 - DNA, 15 bp, Homo sapiens
aaaggacaggaggag

SEQ ID NO: 5260256 - DNA, 17 bp, Homo sapiens
aaaggacatacatttaa

SEQ ID NO: 5260257 - DNA, 15 bp, Homo sapiens
aaaggacatcagcaa

SEQ ID NO: 5260258 - DNA, 18 bp, Homo sapiens
aaaggacatggcgtattt

SEQ ID NO: 5260259 - DNA, 15 bp, Homo sapiens
aaaggacccacccat

SEQ ID NO: 5260260 - DNA, 22 bp, Homo sapiens
aaaggaccctgtttctgtagaa

SEQ ID NO: 5260261 - DNA, 22 bp, Homo sapiens
aaaggacccttgagtaagtgaa

SEQ ID NO: 5260262 - DNA, 16 bp, Homo sapiens
aaaggaccgttttgta

SEQ ID NO: 5260263 - DNA, 21 bp, Homo sapiens
aaaggacgtaaaatttacagt

SEQ ID NO: 5260264 - DNA, 16 bp, Homo sapiens
aaaggactatttataa

SEQ ID NO: 5260265 - DNA, 14 bp, Homo sapiens
aaaggactctggaa

SEQ ID NO: 5260266 - DNA, 13 bp, Homo sapiens
aaaggactgacct

SEQ ID NO: 5260267 - DNA, 16 bp, Homo sapiens
aaaggactgacctgcc

SEQ ID NO: 5260268 - DNA, 23 bp, Homo sapiens
aaaggactggaaaaatgaactgt

SEQ ID NO: 5260269 - DNA, 20 bp, Homo sapiens
aaaggacttcaggaacaagt

SEQ ID NO: 5260270 - DNA, 14 bp, Homo sapiens
aaaggagaaaaaaa

SEQ ID NO: 5260271 - DNA, 20 bp, Homo sapiens
aaaggagaaaaaaaaccttg

SEQ ID NO: 5260272 - DNA, 19 bp, Homo sapiens
aaaggagaaattttggttt

SEQ ID NO: 5260273 - DNA, 17 bp, Homo sapiens
aaaggagacaaagcagg

SEQ ID NO: 5260274 - DNA, 19 bp, Homo sapiens
aaaggagactgtgtttggt

SEQ ID NO: 5260275 - DNA, 20 bp, Homo sapiens
aaaggagagaacgggcgtca

SEQ ID NO: 5260276 - DNA, 15 bp, Homo sapiens
aaaggagagcatcgg

SEQ ID NO: 5260277 - DNA, 20 bp, Homo sapiens
aaaggagaggttaaagcaaa

SEQ ID NO: 5260278 - DNA, 14 bp, Homo sapiens
aaaggagagtactt

SEQ ID NO: 5260279 - DNA, 16 bp, Homo sapiens
aaaggagcagctagct

SEQ ID NO: 5260280 - DNA, 20 bp, Homo sapiens
aaaggagcctaggccaggtg

SEQ ID NO: 5260281 - DNA, 11 bp, Homo sapiens
aaaggagcctg

SEQ ID NO: 5260282 - DNA, 19 bp, Homo sapiens
aaaggagccttttgctctc

SEQ ID NO: 5260283 - DNA, 21 bp, Homo sapiens
aaaggagccttttgctctctg

SEQ ID NO: 5260284 - DNA, 21 bp, Homo sapiens
aaaggagctttctcaatgtct

SEQ ID NO: 5260285 - DNA, 22 bp, Homo sapiens
aaaggagctttctcaatgtctt

SEQ ID NO: 5260286 - DNA, 15 bp, Homo sapiens
aaaggaggatagaaa

SEQ ID NO: 5260287 - DNA, 12 bp, Homo sapiens
aaaggagggaga

SEQ ID NO: 5260288 - DNA, 18 bp, Homo sapiens
aaaggaggggaaacaatg

SEQ ID NO: 5260289 - DNA, 16 bp, Homo sapiens
aaaggaggggtacatt

SEQ ID NO: 5260290 - DNA, 19 bp, Homo sapiens
aaaggagtgcatggccaca

SEQ ID NO: 5260291 - DNA, 21 bp, Homo sapiens
aaaggagtttatgttccatta

SEQ ID NO: 5260292 - DNA, 14 bp, Homo sapiens
aaaggataactctg

SEQ ID NO: 5260293 - DNA, 16 bp, Homo sapiens
aaaggatactgtaaca

SEQ ID NO: 5260294 - DNA, 18 bp, Homo sapiens
aaaggatagtatttttat

SEQ ID NO: 5260295 - DNA, 16 bp, Homo sapiens
aaaggatatttaagaa

SEQ ID NO: 5260296 - DNA, 13 bp, Homo sapiens
aaaggatcacaga

SEQ ID NO: 5260297 - DNA, 18 bp, Homo sapiens
aaaggatctgtgattggc

SEQ ID NO: 5260298 - DNA, 20 bp, Homo sapiens
aaaggatgaaagtctgagaa

SEQ ID NO: 5260299 - DNA, 13 bp, Homo sapiens
aaaggatgaagaa

SEQ ID NO: 5260300 - DNA, 17 bp, Homo sapiens
aaaggatgatggaaaaa

SEQ ID NO: 5260301 - DNA, 14 bp, Homo sapiens
aaaggatgcacaga

SEQ ID NO: 5260302 - DNA, 16 bp, Homo sapiens
aaaggatggaagaaag

SEQ ID NO: 5260303 - DNA, 19 bp, Homo sapiens
aaaggatggaagaaagaag

SEQ ID NO: 5260304 - DNA, 18 bp, Homo sapiens
aaaggatggcagcctcag

SEQ ID NO: 5260305 - DNA, 22 bp, Homo sapiens
aaaggatggcagcctcagggct

SEQ ID NO: 5260306 - DNA, 19 bp, Homo sapiens
aaaggatgtaaacagtgcc

SEQ ID NO: 5260307 - DNA, 17 bp, Homo sapiens
aaaggatgtataaattt

SEQ ID NO: 5260308 - DNA, 18 bp, Homo sapiens
aaaggatgtataaatttt

SEQ ID NO: 5260309 - DNA, 18 bp, Homo sapiens
aaaggatgttacaagttt

SEQ ID NO: 5260310 - DNA, 16 bp, Homo sapiens
aaaggattaggcaaaa

SEQ ID NO: 5260311 - DNA, 15 bp, Homo sapiens
aaaggattgattcag

SEQ ID NO: 5260312 - DNA, 17 bp, Homo sapiens
aaaggatttaagcaaag

SEQ ID NO: 5260313 - DNA, 14 bp, Homo sapiens
aaaggatttctaga

SEQ ID NO: 5260314 - DNA, 14 bp, Homo sapiens
aaaggatttgaaaa

SEQ ID NO: 5260315 - DNA, 22 bp, Homo sapiens
aaaggattttggaaaagaaaca

SEQ ID NO: 5260316 - DNA, 20 bp, Homo sapiens
aaaggattttggaaactcaa

SEQ ID NO: 5260317 - DNA, 22 bp, Homo sapiens
aaaggattttggaaactcaagg

SEQ ID NO: 5260318 - DNA, 16 bp, Homo sapiens
aaaggcaaaagactgg

SEQ ID NO: 5260319 - DNA, 20 bp, Homo sapiens
aaaggcaaataatggaaaaa

SEQ ID NO: 5260320 - DNA, 15 bp, Homo sapiens
aaaggcaaatattga

SEQ ID NO: 5260321 - DNA, 16 bp, Homo sapiens
aaaggcaaatgtgtac

SEQ ID NO: 5260322 - DNA, 18 bp, Homo sapiens
aaaggcaactcaaagatg

SEQ ID NO: 5260323 - DNA, 14 bp, Homo sapiens
aaaggcaagcttga

SEQ ID NO: 5260324 - DNA, 20 bp, Homo sapiens
aaaggcaagcttgaggccaa

SEQ ID NO: 5260325 - DNA, 13 bp, Homo sapiens
aaaggcaaggaaa

SEQ ID NO: 5260326 - DNA, 22 bp, Homo sapiens
aaaggcaagttaagagaaactt

SEQ ID NO: 5260327 - DNA, 23 bp, Homo sapiens
aaaggcaagttaagagaaacttt

SEQ ID NO: 5260328 - DNA, 18 bp, Homo sapiens
aaaggcaatggtttgtgt

SEQ ID NO: 5260329 - DNA, 13 bp, Homo sapiens
aaaggcacaaata

SEQ ID NO: 5260330 - DNA, 12 bp, Homo sapiens
aaaggcacagtg

SEQ ID NO: 5260331 - DNA, 17 bp, Homo sapiens
aaaggcaccatctaata

SEQ ID NO: 5260332 - DNA, 21 bp, Homo sapiens
aaaggcacccccgtcaagagt

SEQ ID NO: 5260333 - DNA, 19 bp, Homo sapiens
aaaggcagaagcaacccaa

SEQ ID NO: 5260334 - DNA, 18 bp, Homo sapiens
aaaggcagagaagttctc

SEQ ID NO: 5260335 - DNA, 10 bp, Homo sapiens
aaaggcagca

SEQ ID NO: 5260336 - DNA, 14 bp, Homo sapiens
aaaggcagcatttg

SEQ ID NO: 5260337 - DNA, 20 bp, Homo sapiens
aaaggcagccctcacctctg

SEQ ID NO: 5260338 - DNA, 22 bp, Homo sapiens
aaaggcagccctcacctctgag

SEQ ID NO: 5260339 - DNA, 15 bp, Homo sapiens
aaaggcagctgcctc

SEQ ID NO: 5260340 - DNA, 17 bp, Homo sapiens
aaaggcagctgcctctg

SEQ ID NO: 5260341 - DNA, 19 bp, Homo sapiens
atgggaaatagtctgattt

SEQ ID NO: 5260342 - DNA, 15 bp, Homo sapiens
atgggaaatgtcgat

SEQ ID NO: 5260343 - DNA, 18 bp, Homo sapiens
atgggaacaaattagagg

SEQ ID NO: 5260344 - DNA, 21 bp, Homo sapiens
atgggaacaaattagaggaga

SEQ ID NO: 5260345 - DNA, 17 bp, Homo sapiens
atgggaacaagtgtaca

SEQ ID NO: 5260346 - DNA, 19 bp, Homo sapiens
atgggaacaagtgtacaga

SEQ ID NO: 5260347 - DNA, 21 bp, Homo sapiens
atgggaacaagtgtacagaag

SEQ ID NO: 5260348 - DNA, 17 bp, Homo sapiens
atgggaacaattgaagt

SEQ ID NO: 5260349 - DNA, 11 bp, Homo sapiens
atgggaacatt

SEQ ID NO: 5260350 - DNA, 14 bp, Homo sapiens
atgggaacatttat

SEQ ID NO: 5260351 - DNA, 21 bp, Homo sapiens
atgggaacatttattttatga

SEQ ID NO: 5260352 - DNA, 21 bp, Homo sapiens
atgggaacgcagcctccagtt

SEQ ID NO: 5260353 - DNA, 16 bp, Homo sapiens
atgggaactgaattgt

SEQ ID NO: 5260354 - DNA, 16 bp, Homo sapiens
atgggaagaaaaagga

SEQ ID NO: 5260355 - DNA, 14 bp, Homo sapiens
atgggaagacatga

SEQ ID NO: 5260356 - DNA, 20 bp, Homo sapiens
atgggaagacgaggccctcg

SEQ ID NO: 5260357 - DNA, 21 bp, Homo sapiens
atgggaagatggtagcagata

SEQ ID NO: 5260358 - DNA, 13 bp, Homo sapiens
atgggaagcaata

SEQ ID NO: 5260359 - DNA, 12 bp, Homo sapiens
atgggaagcagg

SEQ ID NO: 5260360 - DNA, 18 bp, Homo sapiens
atgggaaggtgggcgggc

SEQ ID NO: 5260361 - DNA, 16 bp, Homo sapiens
atgggaagtcctggca

SEQ ID NO: 5260362 - DNA, 16 bp, Homo sapiens
atgggaataattgctt

SEQ ID NO: 5260363 - DNA, 18 bp, Homo sapiens
atgggaatagggagacag

SEQ ID NO: 5260364 - DNA, 18 bp, Homo sapiens
atgggaatcaagatttaa

SEQ ID NO: 5260365 - DNA, 13 bp, Homo sapiens
atgggaatgaagc

SEQ ID NO: 5260366 - DNA, 14 bp, Homo sapiens
atgggaatgaagct

SEQ ID NO: 5260367 - DNA, 23 bp, Homo sapiens
atgggaatgtctaacttaaatag

SEQ ID NO: 5260368 - DNA, 15 bp, Homo sapiens
atgggaatttggctt

SEQ ID NO: 5260369 - DNA, 13 bp, Homo sapiens
atgggacaagcag

SEQ ID NO: 5260370 - DNA, 18 bp, Homo sapiens
atgggacaagcagtccct

SEQ ID NO: 5260371 - DNA, 14 bp, Homo sapiens
atgggacagcaaca

SEQ ID NO: 5260372 - DNA, 21 bp, Homo sapiens
atgggacatttgctcatggaa

SEQ ID NO: 5260373 - DNA, 22 bp, Homo sapiens
atgggacatttgctcatggaat

SEQ ID NO: 5260374 - DNA, 11 bp, Homo sapiens
atgggaccagg

SEQ ID NO: 5260375 - DNA, 18 bp, Homo sapiens
atgggacccaagtctgaa

SEQ ID NO: 5260376 - DNA, 15 bp, Homo sapiens
atgggaccgtgcccc

SEQ ID NO: 5260377 - DNA, 21 bp, Homo sapiens
atgggaccgtgccccacctcc

SEQ ID NO: 5260378 - DNA, 15 bp, Homo sapiens
atgggacctataact

SEQ ID NO: 5260379 - DNA, 16 bp, Homo sapiens
atgggacctcctccct

SEQ ID NO: 5260380 - DNA, 13 bp, Homo sapiens
atgggacctggcc

SEQ ID NO: 5260381 - DNA, 15 bp, Homo sapiens
atgggactgatgtca

SEQ ID NO: 5260382 - DNA, 18 bp, Homo sapiens
atgggactgatgtcatct

SEQ ID NO: 5260383 - DNA, 19 bp, Homo sapiens
atgggactgattctgtggc

SEQ ID NO: 5260384 - DNA, 19 bp, Homo sapiens
atgggactggagtcagatg

SEQ ID NO: 5260385 - DNA, 20 bp, Homo sapiens
atgggactggagtcagatga

SEQ ID NO: 5260386 - DNA, 14 bp, Homo sapiens
atgggactgggagg

SEQ ID NO: 5260387 - DNA, 18 bp, Homo sapiens
atgggactgtgcctttgg

SEQ ID NO: 5260388 - DNA, 19 bp, Homo sapiens
atgggacttcttttcacat

SEQ ID NO: 5260389 - DNA, 23 bp, Homo sapiens
atgggacttcttttcacattctt

SEQ ID NO: 5260390 - DNA, 22 bp, Homo sapiens
atgggagaaatagtgtggaaat

SEQ ID NO: 5260391 - DNA, 17 bp, Homo sapiens
atgggagacccttgaca

SEQ ID NO: 5260392 - DNA, 18 bp, Homo sapiens
atgggagaggcaataaat

SEQ ID NO: 5260393 - DNA, 20 bp, Homo sapiens
atgggagaggttctgtgcaa

SEQ ID NO: 5260394 - DNA, 23 bp, Homo sapiens
atgggagagtagatggtgaaatt

SEQ ID NO: 5260395 - DNA, 16 bp, Homo sapiens
atgggagatggcagca

SEQ ID NO: 5260396 - DNA, 15 bp, Homo sapiens
atgggagatggtcag

SEQ ID NO: 5260397 - DNA, 18 bp, Homo sapiens
atgggagccagaattcac

SEQ ID NO: 5260398 - DNA, 15 bp, Homo sapiens
atgggagctcctctc

SEQ ID NO: 5260399 - DNA, 22 bp, Homo sapiens
atgggagctcctctcctggagg

SEQ ID NO: 5260400 - DNA, 24 bp, Homo sapiens
atgggagctcctctcctggaggat

SEQ ID NO: 5260401 - DNA, 14 bp, Homo sapiens
atgggaggaacaaa

SEQ ID NO: 5260402 - DNA, 15 bp, Homo sapiens
atgggaggagagcca

SEQ ID NO: 5260403 - DNA, 17 bp, Homo sapiens
atgggaggagagccact

SEQ ID NO: 5260404 - DNA, 20 bp, Homo sapiens
atgggaggagagccactggg

SEQ ID NO: 5260405 - DNA, 14 bp, Homo sapiens
atgggaggcagccg

SEQ ID NO: 5260406 - DNA, 15 bp, Homo sapiens
atgggaggccgggag

SEQ ID NO: 5260407 - DNA, 16 bp, Homo sapiens
atgggaggctcctggt

SEQ ID NO: 5260408 - DNA, 18 bp, Homo sapiens
atgggaggctcctggtgg

SEQ ID NO: 5260409 - DNA, 15 bp, Homo sapiens
atgggaggctggagt

SEQ ID NO: 5260410 - DNA, 14 bp, Homo sapiens
atgggagggggctc

SEQ ID NO: 5260411 - DNA, 16 bp, Homo sapiens
atgggagggggctcca

SEQ ID NO: 5260412 - DNA, 19 bp, Homo sapiens
atgggaggtatgggctggg

SEQ ID NO: 5260413 - DNA, 18 bp, Homo sapiens
atgggagtaagagcaaat

SEQ ID NO: 5260414 - DNA, 18 bp, Homo sapiens
atgggagtaagttcttca

SEQ ID NO: 5260415 - DNA, 16 bp, Homo sapiens
atgggataaatgccat

SEQ ID NO: 5260416 - DNA, 15 bp, Homo sapiens
atgggatcatgaaag

SEQ ID NO: 5260417 - DNA, 14 bp, Homo sapiens
atgggatcattatt

SEQ ID NO: 5260418 - DNA, 19 bp, Homo sapiens
atgggatccaattttaata

SEQ ID NO: 5260419 - DNA, 20 bp, Homo sapiens
atgggatccaattttaatat

SEQ ID NO: 5260420 - DNA, 15 bp, Homo sapiens
atgggatcctggagt

SEQ ID NO: 5260421 - DNA, 14 bp, Homo sapiens
atgggatgagaaaa

SEQ ID NO: 5260422 - DNA, 16 bp, Homo sapiens
atgggatgattgaaga

SEQ ID NO: 5260423 - DNA, 17 bp, Homo sapiens
atgggatgattgaagaa

SEQ ID NO: 5260424 - DNA, 21 bp, Homo sapiens
atgggatggtcggatctcaca

SEQ ID NO: 5260425 - DNA, 18 bp, Homo sapiens
atgggatggtggagggcc

SEQ ID NO: 5260426 - DNA, 15 bp, Homo sapiens
atgggattagaaaca

SEQ ID NO: 5260427 - DNA, 19 bp, Homo sapiens
atgggattgaaggggcttc

SEQ ID NO: 5260428 - DNA, 23 bp, Homo sapiens
atgggattgaaggggcttctaat

SEQ ID NO: 5260429 - DNA, 16 bp, Homo sapiens
atgggattgtgttaaa

SEQ ID NO: 5260430 - DNA, 22 bp, Homo sapiens
atgggattttctagtttcctgc

SEQ ID NO: 5260431 - DNA, 23 bp, Homo sapiens
atgggatttttcttttgaggcat

SEQ ID NO: 5260432 - DNA, 16 bp, Homo sapiens
atgggcaaaccctggt

SEQ ID NO: 5260433 - DNA, 19 bp, Homo sapiens
atgggcaaaccctggtgct

SEQ ID NO: 5260434 - DNA, 15 bp, Homo sapiens
atgggcaaagcttgt

SEQ ID NO: 5260435 - DNA, 21 bp, Homo sapiens
atgggcaacccccagcctgct

SEQ ID NO: 5260436 - DNA, 21 bp, Homo sapiens
atgggcaactcgtgacagcct

SEQ ID NO: 5260437 - DNA, 17 bp, Homo sapiens
atgggcaaggggccagg

SEQ ID NO: 5260438 - DNA, 18 bp, Homo sapiens
atgggcaaggggccagga

SEQ ID NO: 5260439 - DNA, 19 bp, Homo sapiens
atgggcaaggggccaggaa

SEQ ID NO: 5260440 - DNA, 20 bp, Homo sapiens
atgggcaattccagaaatct

SEQ ID NO: 5260441 - DNA, 18 bp, Homo sapiens
atgggcacatgaggaggg

SEQ ID NO: 5260442 - DNA, 20 bp, Homo sapiens
atgggcacatgaggagggtg

SEQ ID NO: 5260443 - DNA, 22 bp, Homo sapiens
atgggcacatgaggagggtgcc

SEQ ID NO: 5260444 - DNA, 22 bp, Homo sapiens
atgggcactgctgggtggccca

SEQ ID NO: 5260445 - DNA, 15 bp, Homo sapiens
atgggcactggaaaa

SEQ ID NO: 5260446 - DNA, 14 bp, Homo sapiens
atgggcagagcaga

SEQ ID NO: 5260447 - DNA, 16 bp, Homo sapiens
atgggcagaggatgag

SEQ ID NO: 5260448 - DNA, 18 bp, Homo sapiens
atgggcagatcttttctt

SEQ ID NO: 5260449 - DNA, 13 bp, Homo sapiens
atgggcagcccaa

SEQ ID NO: 5260450 - DNA, 16 bp, Homo sapiens
atgggcagcccaacag

SEQ ID NO: 5260451 - DNA, 21 bp, Homo sapiens
atgggcagctccatcctcttg

SEQ ID NO: 5260452 - DNA, 10 bp, Homo sapiens
atgggcaggt

SEQ ID NO: 5260453 - DNA, 20 bp, Homo sapiens
atgggcaggtggcctctgct

SEQ ID NO: 5260454 - DNA, 22 bp, Homo sapiens
atgggcaggtggcctctgctgg

SEQ ID NO: 5260455 - DNA, 17 bp, Homo sapiens
atgggcagtgcctcctg

SEQ ID NO: 5260456 - DNA, 14 bp, Homo sapiens
atgggcagttacat

SEQ ID NO: 5260457 - DNA, 19 bp, Homo sapiens
atgggcagttacatgcata

SEQ ID NO: 5260458 - DNA, 20 bp, Homo sapiens
atgggcagttctcccaggga

SEQ ID NO: 5260459 - DNA, 13 bp, Homo sapiens
atgggcatttatt

SEQ ID NO: 5260460 - DNA, 16 bp, Homo sapiens
atgggcatttatttta

SEQ ID NO: 5260461 - DNA, 19 bp, Homo sapiens
atgggcatttattttataa

SEQ ID NO: 5260462 - DNA, 14 bp, Homo sapiens
atgggcatttctaa

SEQ ID NO: 5260463 - DNA, 16 bp, Homo sapiens
atgggcatttctaaaa

SEQ ID NO: 5260464 - DNA, 20 bp, Homo sapiens
atgggcattttacaagaagt

SEQ ID NO: 5260465 - DNA, 17 bp, Homo sapiens
atgggccaattaaaata

SEQ ID NO: 5260466 - DNA, 17 bp, Homo sapiens
atgggccacccaccagg

SEQ ID NO: 5260467 - DNA, 16 bp, Homo sapiens
atgggccactgaaatc

SEQ ID NO: 5260468 - DNA, 14 bp, Homo sapiens
atgggccagagttg

SEQ ID NO: 5260469 - DNA, 12 bp, Homo sapiens
atgggccagccc

SEQ ID NO: 5260470 - DNA, 13 bp, Homo sapiens
atgggccagccta

SEQ ID NO: 5260471 - DNA, 14 bp, Homo sapiens
atgggcccctggca

SEQ ID NO: 5260472 - DNA, 17 bp, Homo sapiens
atgggcccgctgcctct

SEQ ID NO: 5260473 - DNA, 21 bp, Homo sapiens
atgggccctcagcgtctcccc

SEQ ID NO: 5260474 - DNA, 12 bp, Homo sapiens
atgggccctgca

SEQ ID NO: 5260475 - DNA, 21 bp, Homo sapiens
atgggccggcccccttcctgg

SEQ ID NO: 5260476 - DNA, 21 bp, Homo sapiens
atgggccgtcccctctcccct

SEQ ID NO: 5260477 - DNA, 20 bp, Homo sapiens
atgggcctcatgaataaatg

SEQ ID NO: 5260478 - DNA, 18 bp, Homo sapiens
atgggcctcctgtgtgtg

SEQ ID NO: 5260479 - DNA, 11 bp, Homo sapiens
atgggcctctc

SEQ ID NO: 5260480 - DNA, 17 bp, Homo sapiens
atgggcctgaactcgga

SEQ ID NO: 5260481 - DNA, 14 bp, Homo sapiens
atgggcctgcccaa

SEQ ID NO: 5260482 - DNA, 22 bp, Homo sapiens
atgggcctgccgggctgagggc

SEQ ID NO: 5260483 - DNA, 12 bp, Homo sapiens
atgggcctgcct

SEQ ID NO: 5260484 - DNA, 18 bp, Homo sapiens
atgggcctgcctgcctcc

SEQ ID NO: 5260485 - DNA, 20 bp, Homo sapiens
atgggcctggccacctctct

SEQ ID NO: 5260486 - DNA, 11 bp, Homo sapiens
atgggcctggg

SEQ ID NO: 5260487 - DNA, 12 bp, Homo sapiens
atgggcctgggc

SEQ ID NO: 5260488 - DNA, 13 bp, Homo sapiens
atgggcctgggcc

SEQ ID NO: 5260489 - DNA, 16 bp, Homo sapiens
atgggcctgtggggac

SEQ ID NO: 5260490 - DNA, 22 bp, Homo sapiens
atgggccttgctttgggctttg

SEQ ID NO: 5260491 - DNA, 18 bp, Homo sapiens
atgggcctttgagcctga

SEQ ID NO: 5260492 - DNA, 20 bp, Homo sapiens
atgggcctttgagcctgatg

SEQ ID NO: 5260493 - DNA, 14 bp, Homo sapiens
atgggccttttctt

SEQ ID NO: 5260494 - DNA, 13 bp, Homo sapiens
atgggcgaccagg

SEQ ID NO: 5260495 - DNA, 13 bp, Homo sapiens
atgggcgagtccc

SEQ ID NO: 5260496 - DNA, 22 bp, Homo sapiens
atgggcggaagtacttccctca

SEQ ID NO: 5260497 - DNA, 18 bp, Homo sapiens
atgggcgtacgctggtgc

SEQ ID NO: 5260498 - DNA, 17 bp, Homo sapiens
atgggctaatgaagatc

SEQ ID NO: 5260499 - DNA, 15 bp, Homo sapiens
atgggctaggcctcc

SEQ ID NO: 5260500 - DNA, 21 bp, Homo sapiens
atgggctatcagggaggaaga

SEQ ID NO: 5260501 - DNA, 13 bp, Homo sapiens
atgggctcagggc

SEQ ID NO: 5260502 - DNA, 14 bp, Homo sapiens
atgggctcagggcc

SEQ ID NO: 5260503 - DNA, 15 bp, Homo sapiens
atgggctcagggcca

SEQ ID NO: 5260504 - DNA, 21 bp, Homo sapiens
atgggctcgccgtgtctcagc

SEQ ID NO: 5260505 - DNA, 21 bp, Homo sapiens
atgggctgcaaaatgaagaca

SEQ ID NO: 5260506 - DNA, 19 bp, Homo sapiens
atgggctgcagcagaggca

SEQ ID NO: 5260507 - DNA, 18 bp, Homo sapiens
atgggctggggcaggggc

SEQ ID NO: 5260508 - DNA, 23 bp, Homo sapiens
atgggctgggggccagggctgga

SEQ ID NO: 5260509 - DNA, 20 bp, Homo sapiens
atgggctgggggctatgtat

SEQ ID NO: 5260510 - DNA, 20 bp, Homo sapiens
atgggctgggttctacccag

SEQ ID NO: 5260511 - DNA, 23 bp, Homo sapiens
atgggctgggttctacccaggtg

SEQ ID NO: 5260512 - DNA, 19 bp, Homo sapiens
atgggctgttctgtttcct

SEQ ID NO: 5260513 - DNA, 23 bp, Homo sapiens
atgggctgttctgtttcctgtgt

SEQ ID NO: 5260514 - DNA, 20 bp, Homo sapiens
atgggcttcctgatgatgat

SEQ ID NO: 5260515 - DNA, 15 bp, Homo sapiens
atgggcttctgttct

SEQ ID NO: 5260516 - DNA, 18 bp, Homo sapiens
atgggcttggacttcctg

SEQ ID NO: 5260517 - DNA, 19 bp, Homo sapiens
atgggcttggacttcctgg

SEQ ID NO: 5260518 - DNA, 18 bp, Homo sapiens
atgggcttgttttcttgc

SEQ ID NO: 5260519 - DNA, 15 bp, Homo sapiens
atgggctttctcagt

SEQ ID NO: 5260520 - DNA, 19 bp, Homo sapiens
aaaggcagctgtgtctgag

SEQ ID NO: 5260521 - DNA, 21 bp, Homo sapiens
aaaggcagctgtgtctgagcc

SEQ ID NO: 5260522 - DNA, 14 bp, Homo sapiens
aaaggcagctgttg

SEQ ID NO: 5260523 - DNA, 21 bp, Homo sapiens
aaaggcaggcctatttcatca

SEQ ID NO: 5260524 - DNA, 13 bp, Homo sapiens
aaaggcagggccc

SEQ ID NO: 5260525 - DNA, 17 bp, Homo sapiens
aaaggcaggtttcattt

SEQ ID NO: 5260526 - DNA, 16 bp, Homo sapiens
aaaggcagttttctaa

SEQ ID NO: 5260527 - DNA, 15 bp, Homo sapiens
aaaggcatattgctt

SEQ ID NO: 5260528 - DNA, 17 bp, Homo sapiens
aaaggcatattgctttt

SEQ ID NO: 5260529 - DNA, 19 bp, Homo sapiens
aaaggcatcccagcctggg

SEQ ID NO: 5260530 - DNA, 15 bp, Homo sapiens
aaaggcatgctggag

SEQ ID NO: 5260531 - DNA, 15 bp, Homo sapiens
aaaggcatgtacaaa

SEQ ID NO: 5260532 - DNA, 15 bp, Homo sapiens
aaaggcattagagtc

SEQ ID NO: 5260533 - DNA, 15 bp, Homo sapiens
aaaggccaaacctct

SEQ ID NO: 5260534 - DNA, 18 bp, Homo sapiens
aaaggccaaactgctgga

SEQ ID NO: 5260535 - DNA, 15 bp, Homo sapiens
aaaggccaaagataa

SEQ ID NO: 5260536 - DNA, 14 bp, Homo sapiens
aaaggccaacagca

SEQ ID NO: 5260537 - DNA, 17 bp, Homo sapiens
aaaggccaatataccta

SEQ ID NO: 5260538 - DNA, 18 bp, Homo sapiens
aaaggccagctggcagca

SEQ ID NO: 5260539 - DNA, 19 bp, Homo sapiens
aaaggccatggagagctgg

SEQ ID NO: 5260540 - DNA, 13 bp, Homo sapiens
aaaggcccagccc

SEQ ID NO: 5260541 - DNA, 14 bp, Homo sapiens
aaaggcccagcccc

SEQ ID NO: 5260542 - DNA, 17 bp, Homo sapiens
aaaggcccagcccctag

SEQ ID NO: 5260543 - DNA, 14 bp, Homo sapiens
aaaggcccatgccc

SEQ ID NO: 5260544 - DNA, 12 bp, Homo sapiens
aaaggcccccta

SEQ ID NO: 5260545 - DNA, 20 bp, Homo sapiens
aaaggcccggaagcgccagg

SEQ ID NO: 5260546 - DNA, 17 bp, Homo sapiens
aaaggccgtcatttcat

SEQ ID NO: 5260547 - DNA, 15 bp, Homo sapiens
aaaggccgtgtgttt

SEQ ID NO: 5260548 - DNA, 16 bp, Homo sapiens
aaaggcctcctccccc

SEQ ID NO: 5260549 - DNA, 14 bp, Homo sapiens
aaaggcctcttcct

SEQ ID NO: 5260550 - DNA, 13 bp, Homo sapiens
aaaggcctcttgt

SEQ ID NO: 5260551 - DNA, 10 bp, Homo sapiens
aaaggcctgg

SEQ ID NO: 5260552 - DNA, 20 bp, Homo sapiens
aaaggcctggaaccagggag

SEQ ID NO: 5260553 - DNA, 13 bp, Homo sapiens
aaaggcctggcgt

SEQ ID NO: 5260554 - DNA, 23 bp, Homo sapiens
aaaggcctgtgatccaggaaaga

SEQ ID NO: 5260555 - DNA, 20 bp, Homo sapiens
aaaggcctgtggggagccga

SEQ ID NO: 5260556 - DNA, 12 bp, Homo sapiens
aaaggcctttgg

SEQ ID NO: 5260557 - DNA, 14 bp, Homo sapiens
aaaggcctttggga

SEQ ID NO: 5260558 - DNA, 22 bp, Homo sapiens
aaaggcgcccccgccccaggct

SEQ ID NO: 5260559 - DNA, 19 bp, Homo sapiens
aaaggctaagaatagtggg

SEQ ID NO: 5260560 - DNA, 17 bp, Homo sapiens
aaaggctaccttattgt

SEQ ID NO: 5260561 - DNA, 19 bp, Homo sapiens
aaaggctcagtctcaggag

SEQ ID NO: 5260562 - DNA, 19 bp, Homo sapiens
aaaggctcatttaaaacag

SEQ ID NO: 5260563 - DNA, 15 bp, Homo sapiens
aaaggctccaggagc

SEQ ID NO: 5260564 - DNA, 16 bp, Homo sapiens
aaaggctccaggagca

SEQ ID NO: 5260565 - DNA, 21 bp, Homo sapiens
aaaggctccaggagcagccac

SEQ ID NO: 5260566 - DNA, 16 bp, Homo sapiens
aaaggctcctgagaca

SEQ ID NO: 5260567 - DNA, 16 bp, Homo sapiens
aaaggctcgattttgt

SEQ ID NO: 5260568 - DNA, 17 bp, Homo sapiens
aaaggctcgattttgta

SEQ ID NO: 5260569 - DNA, 13 bp, Homo sapiens
aaaggctctgtgc

SEQ ID NO: 5260570 - DNA, 16 bp, Homo sapiens
aaaggctgacattcac

SEQ ID NO: 5260571 - DNA, 23 bp, Homo sapiens
aaaggctggctgaaaatcactat

SEQ ID NO: 5260572 - DNA, 17 bp, Homo sapiens
aaaggctgtagaaggaa

SEQ ID NO: 5260573 - DNA, 20 bp, Homo sapiens
aaaggctgtattcagcaagg

SEQ ID NO: 5260574 - DNA, 15 bp, Homo sapiens
aaaggctgtgctgcc

SEQ ID NO: 5260575 - DNA, 23 bp, Homo sapiens
aaaggctgtgctgccctgaagaa

SEQ ID NO: 5260576 - DNA, 13 bp, Homo sapiens
aaaggctgtggta

SEQ ID NO: 5260577 - DNA, 15 bp, Homo sapiens
aaaggctgttaaata

SEQ ID NO: 5260578 - DNA, 19 bp, Homo sapiens
aaaggctgttaaatacagg

SEQ ID NO: 5260579 - DNA, 14 bp, Homo sapiens
aaaggcttataaaa

SEQ ID NO: 5260580 - DNA, 12 bp, Homo sapiens
aaagggaaaaaa

SEQ ID NO: 5260581 - DNA, 14 bp, Homo sapiens
aaagggaaaaaaga

SEQ ID NO: 5260582 - DNA, 14 bp, Homo sapiens
aaagggaaactatt

SEQ ID NO: 5260583 - DNA, 15 bp, Homo sapiens
aaagggaaactggga

SEQ ID NO: 5260584 - DNA, 13 bp, Homo sapiens
aaagggaacacaa

SEQ ID NO: 5260585 - DNA, 14 bp, Homo sapiens
aaagggaacatgca

SEQ ID NO: 5260586 - DNA, 14 bp, Homo sapiens
aaagggaactagat

SEQ ID NO: 5260587 - DNA, 16 bp, Homo sapiens
aaagggaactgaacat

SEQ ID NO: 5260588 - DNA, 14 bp, Homo sapiens
aaagggaagaaact

SEQ ID NO: 5260589 - DNA, 15 bp, Homo sapiens
aaagggaagccctga

SEQ ID NO: 5260590 - DNA, 14 bp, Homo sapiens
aaagggaagcctga

SEQ ID NO: 5260591 - DNA, 18 bp, Homo sapiens
aaagggaaggctgctgtg

SEQ ID NO: 5260592 - DNA, 18 bp, Homo sapiens
aaagggaagtgaggccca

SEQ ID NO: 5260593 - DNA, 19 bp, Homo sapiens
aaagggaagtgaggcccaa

SEQ ID NO: 5260594 - DNA, 18 bp, Homo sapiens
aaagggaagttgtgcctt

SEQ ID NO: 5260595 - DNA, 15 bp, Homo sapiens
aaagggaatcatttt

SEQ ID NO: 5260596 - DNA, 21 bp, Homo sapiens
aaagggaatgactttgaagta

SEQ ID NO: 5260597 - DNA, 18 bp, Homo sapiens
aaagggaatgggtctgca

SEQ ID NO: 5260598 - DNA, 18 bp, Homo sapiens
aaagggacacccctacac

SEQ ID NO: 5260599 - DNA, 13 bp, Homo sapiens
aaagggacactgg

SEQ ID NO: 5260600 - DNA, 14 bp, Homo sapiens
aaagggacagcatg

SEQ ID NO: 5260601 - DNA, 12 bp, Homo sapiens
aaagggacatga

SEQ ID NO: 5260602 - DNA, 17 bp, Homo sapiens
aaagggacccacctgct

SEQ ID NO: 5260603 - DNA, 22 bp, Homo sapiens
aaagggacttggaagctccgct

SEQ ID NO: 5260604 - DNA, 17 bp, Homo sapiens
aaagggagaaagaaaac

SEQ ID NO: 5260605 - DNA, 18 bp, Homo sapiens
aaagggagaaagaaaact

SEQ ID NO: 5260606 - DNA, 19 bp, Homo sapiens
aaagggagaaagaaaactg

SEQ ID NO: 5260607 - DNA, 15 bp, Homo sapiens
aaagggagaaggaag

SEQ ID NO: 5260608 - DNA, 13 bp, Homo sapiens
aaagggagcccct

SEQ ID NO: 5260609 - DNA, 20 bp, Homo sapiens
aaagggagcccctcctctga

SEQ ID NO: 5260610 - DNA, 19 bp, Homo sapiens
aaagggagggctctgaggc

SEQ ID NO: 5260611 - DNA, 15 bp, Homo sapiens
aaagggagtttaaaa

SEQ ID NO: 5260612 - DNA, 14 bp, Homo sapiens
aaagggagtttttg

SEQ ID NO: 5260613 - DNA, 20 bp, Homo sapiens
aaagggatcatcatgcagct

SEQ ID NO: 5260614 - DNA, 19 bp, Homo sapiens
aaagggattacccaagcaa

SEQ ID NO: 5260615 - DNA, 21 bp, Homo sapiens
aaagggattgaggagttgcct

SEQ ID NO: 5260616 - DNA, 16 bp, Homo sapiens
aaagggcactcccaac

SEQ ID NO: 5260617 - DNA, 20 bp, Homo sapiens
aaagggcacttaatttgtaa

SEQ ID NO: 5260618 - DNA, 12 bp, Homo sapiens
aaagggcagagg

SEQ ID NO: 5260619 - DNA, 12 bp, Homo sapiens
aaagggcagcca

SEQ ID NO: 5260620 - DNA, 20 bp, Homo sapiens
aaagggcagccaggggctgc

SEQ ID NO: 5260621 - DNA, 17 bp, Homo sapiens
aaagggcagccctcctt

SEQ ID NO: 5260622 - DNA, 15 bp, Homo sapiens
aaagggcagggccca

SEQ ID NO: 5260623 - DNA, 15 bp, Homo sapiens
aaagggcagtaaagt

SEQ ID NO: 5260624 - DNA, 15 bp, Homo sapiens
aaagggcagttttga

SEQ ID NO: 5260625 - DNA, 21 bp, Homo sapiens
aaagggcatgggtcgggagag

SEQ ID NO: 5260626 - DNA, 12 bp, Homo sapiens
aaagggccaggt

SEQ ID NO: 5260627 - DNA, 23 bp, Homo sapiens
aaagggcccacagtgacttttgc

SEQ ID NO: 5260628 - DNA, 20 bp, Homo sapiens
aaagggcccagagagggtgg

SEQ ID NO: 5260629 - DNA, 23 bp, Homo sapiens
aaagggccccatgagggtgtttt

SEQ ID NO: 5260630 - DNA, 17 bp, Homo sapiens
aaagggccctccttcct

SEQ ID NO: 5260631 - DNA, 19 bp, Homo sapiens
aaagggccctccttcctaa

SEQ ID NO: 5260632 - DNA, 15 bp, Homo sapiens
aaagggcctggccag

SEQ ID NO: 5260633 - DNA, 20 bp, Homo sapiens
aaagggcgcaaagggcatgg

SEQ ID NO: 5260634 - DNA, 16 bp, Homo sapiens
aaagggcggaagagtt

SEQ ID NO: 5260635 - DNA, 22 bp, Homo sapiens
aaagggctaaacatgtgaggcc

SEQ ID NO: 5260636 - DNA, 16 bp, Homo sapiens
aaagggctctttagcc

SEQ ID NO: 5260637 - DNA, 14 bp, Homo sapiens
aaagggctggctgc

SEQ ID NO: 5260638 - DNA, 20 bp, Homo sapiens
aaagggcttgaggtgaattt

SEQ ID NO: 5260639 - DNA, 17 bp, Homo sapiens
aaaggggacaaggaagg

SEQ ID NO: 5260640 - DNA, 14 bp, Homo sapiens
aaaggggagagcct

SEQ ID NO: 5260641 - DNA, 16 bp, Homo sapiens
aaaggggagagcctgc

SEQ ID NO: 5260642 - DNA, 13 bp, Homo sapiens
aaaggggaggaga

SEQ ID NO: 5260643 - DNA, 13 bp, Homo sapiens
aaaggggctgctg

SEQ ID NO: 5260644 - DNA, 14 bp, Homo sapiens
aaaggggctgctgg

SEQ ID NO: 5260645 - DNA, 15 bp, Homo sapiens
aaaggggctgctggg

SEQ ID NO: 5260646 - DNA, 19 bp, Homo sapiens
aaaggggctgctggggcat

SEQ ID NO: 5260647 - DNA, 14 bp, Homo sapiens
aaagggggcctggg

SEQ ID NO: 5260648 - DNA, 14 bp, Homo sapiens
aaaggggggtggga

SEQ ID NO: 5260649 - DNA, 20 bp, Homo sapiens
aaaggggggtgggaggggaa

SEQ ID NO: 5260650 - DNA, 16 bp, Homo sapiens
aaagggggtcccagtg

SEQ ID NO: 5260651 - DNA, 16 bp, Homo sapiens
aaaggggtgattgaaa

SEQ ID NO: 5260652 - DNA, 19 bp, Homo sapiens
aaaggggtgattgaaagaa

SEQ ID NO: 5260653 - DNA, 22 bp, Homo sapiens
aaaggggttggggtgacagtca

SEQ ID NO: 5260654 - DNA, 15 bp, Homo sapiens
aaagggtaaattata

SEQ ID NO: 5260655 - DNA, 23 bp, Homo sapiens
aaagggtagcctggcttttctgg

SEQ ID NO: 5260656 - DNA, 11 bp, Homo sapiens
aaagggtcagg

SEQ ID NO: 5260657 - DNA, 23 bp, Homo sapiens
aaagggtcaggttagggctcctg

SEQ ID NO: 5260658 - DNA, 23 bp, Homo sapiens
aaagggtctgataaacacagagg

SEQ ID NO: 5260659 - DNA, 21 bp, Homo sapiens
aaagggtgaagctatttatct

SEQ ID NO: 5260660 - DNA, 18 bp, Homo sapiens
aaagggtgtaggggccac

SEQ ID NO: 5260661 - DNA, 14 bp, Homo sapiens
aaagggtgtatagt

SEQ ID NO: 5260662 - DNA, 18 bp, Homo sapiens
aaagggtgtatagtgttc

SEQ ID NO: 5260663 - DNA, 22 bp, Homo sapiens
aaagggttaatcatatttgaaa

SEQ ID NO: 5260664 - DNA, 23 bp, Homo sapiens
aaagggttgaaaatgtgtttgct

SEQ ID NO: 5260665 - DNA, 15 bp, Homo sapiens
aaaggtaaaacaaaa

SEQ ID NO: 5260666 - DNA, 14 bp, Homo sapiens
aaaggtaaatcaga

SEQ ID NO: 5260667 - DNA, 23 bp, Homo sapiens
aaaggtaaatggttaaattttac

SEQ ID NO: 5260668 - DNA, 15 bp, Homo sapiens
aaaggtaactaactg

SEQ ID NO: 5260669 - DNA, 17 bp, Homo sapiens
aaaggtaactaactgct

SEQ ID NO: 5260670 - DNA, 16 bp, Homo sapiens
aaaggtaatgtgtgga

SEQ ID NO: 5260671 - DNA, 23 bp, Homo sapiens
aaaggtacactggtatttatatt

SEQ ID NO: 5260672 - DNA, 14 bp, Homo sapiens
aaaggtacttcaaa

SEQ ID NO: 5260673 - DNA, 16 bp, Homo sapiens
aaaggtactttgcagg

SEQ ID NO: 5260674 - DNA, 15 bp, Homo sapiens
aaaggtagactttta

SEQ ID NO: 5260675 - DNA, 16 bp, Homo sapiens
aaaggtagagatgtgt

SEQ ID NO: 5260676 - DNA, 17 bp, Homo sapiens
aaaggtagagatgtgtg

SEQ ID NO: 5260677 - DNA, 14 bp, Homo sapiens
aaaggtaggtcaga

SEQ ID NO: 5260678 - DNA, 16 bp, Homo sapiens
aaaggtaggttttaaa

SEQ ID NO: 5260679 - DNA, 13 bp, Homo sapiens
aaaggtataaata

SEQ ID NO: 5260680 - DNA, 14 bp, Homo sapiens
aaaggtataatttt

SEQ ID NO: 5260681 - DNA, 14 bp, Homo sapiens
aaaggtatgaaaat

SEQ ID NO: 5260682 - DNA, 22 bp, Homo sapiens
aaaggtatgtagttacagaatt

SEQ ID NO: 5260683 - DNA, 12 bp, Homo sapiens
aaaggtatttgg

SEQ ID NO: 5260684 - DNA, 20 bp, Homo sapiens
aaaggtattttaatcaccaa

SEQ ID NO: 5260685 - DNA, 18 bp, Homo sapiens
aaaggtattttgaatacc

SEQ ID NO: 5260686 - DNA, 16 bp, Homo sapiens
aaaggtcaaaaacaaa

SEQ ID NO: 5260687 - DNA, 14 bp, Homo sapiens
aaaggtcaataagg

SEQ ID NO: 5260688 - DNA, 16 bp, Homo sapiens
aaaggtcatattggaa

SEQ ID NO: 5260689 - DNA, 16 bp, Homo sapiens
aaaggtcatccaaaga

SEQ ID NO: 5260690 - DNA, 18 bp, Homo sapiens
aaaggtcattgtggctat

SEQ ID NO: 5260691 - DNA, 13 bp, Homo sapiens
aaaggtcctgtaa

SEQ ID NO: 5260692 - DNA, 19 bp, Homo sapiens
aaaggtccttgcctcctgg

SEQ ID NO: 5260693 - DNA, 21 bp, Homo sapiens
aaaggtcgcagcagtagcttt

SEQ ID NO: 5260694 - DNA, 19 bp, Homo sapiens
aaaggtctaagcaagtgag

SEQ ID NO: 5260695 - DNA, 13 bp, Homo sapiens
aaaggtctatgca

SEQ ID NO: 5260696 - DNA, 16 bp, Homo sapiens
aaaggtgaaacacaca

SEQ ID NO: 5260697 - DNA, 15 bp, Homo sapiens
aaaggtgaaggaata

SEQ ID NO: 5260698 - DNA, 24 bp, Homo sapiens
aaaggtgaaggaatatatggcaga

SEQ ID NO: 5260699 - DNA, 16 bp, Homo sapiens
aaaggtgacccttctg

SEQ ID NO: 5260700 - DNA, 20 bp, Homo sapiens
aaaggtgacttcctctggtg

SEQ ID NO: 5260701 - DNA, 13 bp, Homo sapiens
aaaggtgataaaa

SEQ ID NO: 5260702 - DNA, 20 bp, Homo sapiens
atggggaaaaaaatcatcta

SEQ ID NO: 5260703 - DNA, 16 bp, Homo sapiens
atggggaactccccca

SEQ ID NO: 5260704 - DNA, 19 bp, Homo sapiens
atggggaatccgtgtgtgt

SEQ ID NO: 5260705 - DNA, 22 bp, Homo sapiens
atggggaatctaagagagctgc

SEQ ID NO: 5260706 - DNA, 14 bp, Homo sapiens
atggggaccagcag

SEQ ID NO: 5260707 - DNA, 23 bp, Homo sapiens
atggggaccctccaaaggaaggg

SEQ ID NO: 5260708 - DNA, 13 bp, Homo sapiens
atggggacgcaga

SEQ ID NO: 5260709 - DNA, 20 bp, Homo sapiens
atggggactctccaggcacc

SEQ ID NO: 5260710 - DNA, 15 bp, Homo sapiens
atggggactctgccg

SEQ ID NO: 5260711 - DNA, 16 bp, Homo sapiens
atggggagaaagggag

SEQ ID NO: 5260712 - DNA, 20 bp, Homo sapiens
atggggagatcggggccaga

SEQ ID NO: 5260713 - DNA, 19 bp, Homo sapiens
atggggagctctggaggtg

SEQ ID NO: 5260714 - DNA, 12 bp, Homo sapiens
atggggagctgg

SEQ ID NO: 5260715 - DNA, 13 bp, Homo sapiens
atggggagctggc

SEQ ID NO: 5260716 - DNA, 17 bp, Homo sapiens
atggggaggaagagaga

SEQ ID NO: 5260717 - DNA, 17 bp, Homo sapiens
atggggaggacaaaatg

SEQ ID NO: 5260718 - DNA, 14 bp, Homo sapiens
atggggaggcagca

SEQ ID NO: 5260719 - DNA, 16 bp, Homo sapiens
atggggaggcagcaga

SEQ ID NO: 5260720 - DNA, 14 bp, Homo sapiens
atggggaggccgct

SEQ ID NO: 5260721 - DNA, 19 bp, Homo sapiens
atggggaggttgtggggcc

SEQ ID NO: 5260722 - DNA, 23 bp, Homo sapiens
atggggagtattatggaaatcca

SEQ ID NO: 5260723 - DNA, 12 bp, Homo sapiens
atggggagtgag

SEQ ID NO: 5260724 - DNA, 17 bp, Homo sapiens
atggggatcacagagac

SEQ ID NO: 5260725 - DNA, 15 bp, Homo sapiens
atggggattaattag

SEQ ID NO: 5260726 - DNA, 13 bp, Homo sapiens
atggggcaagcca

SEQ ID NO: 5260727 - DNA, 19 bp, Homo sapiens
atggggcaagccagggccc

SEQ ID NO: 5260728 - DNA, 20 bp, Homo sapiens
atggggcaagccagggccca

SEQ ID NO: 5260729 - DNA, 22 bp, Homo sapiens
atggggcaagccagggcccaga

SEQ ID NO: 5260730 - DNA, 23 bp, Homo sapiens
atggggcaagccagggcccagag

SEQ ID NO: 5260731 - DNA, 14 bp, Homo sapiens
atggggcagaagag

SEQ ID NO: 5260732 - DNA, 20 bp, Homo sapiens
atggggcagaagagaaagga

SEQ ID NO: 5260733 - DNA, 14 bp, Homo sapiens
atggggcagaggct

SEQ ID NO: 5260734 - DNA, 23 bp, Homo sapiens
atggggcaggccacctggctctc

SEQ ID NO: 5260735 - DNA, 21 bp, Homo sapiens
atggggcatcctctttttcca

SEQ ID NO: 5260736 - DNA, 17 bp, Homo sapiens
atggggccacagccaga

SEQ ID NO: 5260737 - DNA, 21 bp, Homo sapiens
atggggccagatccagcctgg

SEQ ID NO: 5260738 - DNA, 13 bp, Homo sapiens
atggggccaggaa

SEQ ID NO: 5260739 - DNA, 14 bp, Homo sapiens
atggggccctgcct

SEQ ID NO: 5260740 - DNA, 17 bp, Homo sapiens
atggggcctccctcctt

SEQ ID NO: 5260741 - DNA, 14 bp, Homo sapiens
atggggcctctgtt

SEQ ID NO: 5260742 - DNA, 15 bp, Homo sapiens
atggggcctgggctg

SEQ ID NO: 5260743 - DNA, 15 bp, Homo sapiens
atggggcgctggaca

SEQ ID NO: 5260744 - DNA, 17 bp, Homo sapiens
atggggcggcctgcaga

SEQ ID NO: 5260745 - DNA, 18 bp, Homo sapiens
atggggcggcctgcagac

SEQ ID NO: 5260746 - DNA, 12 bp, Homo sapiens
atggggcggggc

SEQ ID NO: 5260747 - DNA, 14 bp, Homo sapiens
atggggctcccagc

SEQ ID NO: 5260748 - DNA, 22 bp, Homo sapiens
atgggggaaagcacaggtgggc

SEQ ID NO: 5260749 - DNA, 18 bp, Homo sapiens
atgggggaaggcgctggg

SEQ ID NO: 5260750 - DNA, 16 bp, Homo sapiens
atgggggaccccttcc

SEQ ID NO: 5260751 - DNA, 19 bp, Homo sapiens
atgggggaccccttcccac

SEQ ID NO: 5260752 - DNA, 12 bp, Homo sapiens
atgggggagagg

SEQ ID NO: 5260753 - DNA, 19 bp, Homo sapiens
atgggggagattgaacttt

SEQ ID NO: 5260754 - DNA, 21 bp, Homo sapiens
atgggggagtctgaagcagat

SEQ ID NO: 5260755 - DNA, 16 bp, Homo sapiens
atgggggatgggccag

SEQ ID NO: 5260756 - DNA, 18 bp, Homo sapiens
atgggggcaggaaagcca

SEQ ID NO: 5260757 - DNA, 23 bp, Homo sapiens
atgggggcaggaaagccacatct

SEQ ID NO: 5260758 - DNA, 14 bp, Homo sapiens
atgggggcagggct

SEQ ID NO: 5260759 - DNA, 23 bp, Homo sapiens
atgggggcagtctccccttcctg

SEQ ID NO: 5260760 - DNA, 23 bp, Homo sapiens
atgggggcatctcttccccagag

SEQ ID NO: 5260761 - DNA, 13 bp, Homo sapiens
atgggggcctctc

SEQ ID NO: 5260762 - DNA, 21 bp, Homo sapiens
atgggggcggctggaaagagg

SEQ ID NO: 5260763 - DNA, 22 bp, Homo sapiens
atgggggctccagacattgtat

SEQ ID NO: 5260764 - DNA, 14 bp, Homo sapiens
atgggggctgccag

SEQ ID NO: 5260765 - DNA, 12 bp, Homo sapiens
atgggggctttc

SEQ ID NO: 5260766 - DNA, 22 bp, Homo sapiens
atgggggctttcggggagggcg

SEQ ID NO: 5260767 - DNA, 14 bp, Homo sapiens
atggggggagaagt

SEQ ID NO: 5260768 - DNA, 21 bp, Homo sapiens
atggggggagcaccctgaggg

SEQ ID NO: 5260769 - DNA, 16 bp, Homo sapiens
atggggggccaacacc

SEQ ID NO: 5260770 - DNA, 22 bp, Homo sapiens
atggggggccaacaccagggat

SEQ ID NO: 5260771 - DNA, 21 bp, Homo sapiens
atggggggcgggccagggtgg

SEQ ID NO: 5260772 - DNA, 15 bp, Homo sapiens
atggggggtatattt

SEQ ID NO: 5260773 - DNA, 16 bp, Homo sapiens
atgggggtagcagctg

SEQ ID NO: 5260774 - DNA, 22 bp, Homo sapiens
atgggggtgcaggcagccttga

SEQ ID NO: 5260775 - DNA, 14 bp, Homo sapiens
atggggtagaaaca

SEQ ID NO: 5260776 - DNA, 22 bp, Homo sapiens
atggggtagggtgagaagggca

SEQ ID NO: 5260777 - DNA, 14 bp, Homo sapiens
atggggtcagcccc

SEQ ID NO: 5260778 - DNA, 21 bp, Homo sapiens
atggggtcagccccaagggct

SEQ ID NO: 5260779 - DNA, 20 bp, Homo sapiens
atggggtccatccccttccc

SEQ ID NO: 5260780 - DNA, 16 bp, Homo sapiens
atggggtcggctcctg

SEQ ID NO: 5260781 - DNA, 19 bp, Homo sapiens
atggggtcggctcctgatg

SEQ ID NO: 5260782 - DNA, 19 bp, Homo sapiens
atggggtctctcacagaca

SEQ ID NO: 5260783 - DNA, 18 bp, Homo sapiens
atggggtctgtaaaatct

SEQ ID NO: 5260784 - DNA, 11 bp, Homo sapiens
atggggtgaga

SEQ ID NO: 5260785 - DNA, 21 bp, Homo sapiens
atggggtgatgctgggctggc

SEQ ID NO: 5260786 - DNA, 10 bp, Homo sapiens
atggggtggg

SEQ ID NO: 5260787 - DNA, 20 bp, Homo sapiens
atggggtgggagccacaggg

SEQ ID NO: 5260788 - DNA, 19 bp, Homo sapiens
atggggtgggcagggctgg

SEQ ID NO: 5260789 - DNA, 21 bp, Homo sapiens
atggggtgggcagggctggga

SEQ ID NO: 5260790 - DNA, 15 bp, Homo sapiens
atggggtgggcctct

SEQ ID NO: 5260791 - DNA, 16 bp, Homo sapiens
atggggtgggcctctg

SEQ ID NO: 5260792 - DNA, 18 bp, Homo sapiens
atggggtgggcctctggt

SEQ ID NO: 5260793 - DNA, 13 bp, Homo sapiens
atggggtgggggg

SEQ ID NO: 5260794 - DNA, 23 bp, Homo sapiens
atggggtggggttggggcaaagc

SEQ ID NO: 5260795 - DNA, 21 bp, Homo sapiens
atggggttggctgggcccaga

SEQ ID NO: 5260796 - DNA, 16 bp, Homo sapiens
atggggttgggctctg

SEQ ID NO: 5260797 - DNA, 13 bp, Homo sapiens
atgggtaaataaa

SEQ ID NO: 5260798 - DNA, 23 bp, Homo sapiens
atgggtaaataaatgctgctttg

SEQ ID NO: 5260799 - DNA, 18 bp, Homo sapiens
atgggtaacctagacttc

SEQ ID NO: 5260800 - DNA, 18 bp, Homo sapiens
atgggtaatataaagtgt

SEQ ID NO: 5260801 - DNA, 15 bp, Homo sapiens
atgggtaattcaaga

SEQ ID NO: 5260802 - DNA, 15 bp, Homo sapiens
atgggtactccagca

SEQ ID NO: 5260803 - DNA, 17 bp, Homo sapiens
atgggtagagaaacact

SEQ ID NO: 5260804 - DNA, 23 bp, Homo sapiens
atgggtagcttctgacctcagca

SEQ ID NO: 5260805 - DNA, 20 bp, Homo sapiens
atgggtatattgataaattt

SEQ ID NO: 5260806 - DNA, 21 bp, Homo sapiens
atgggtatattgataaatttt

SEQ ID NO: 5260807 - DNA, 22 bp, Homo sapiens
atgggtattaaacttgtcagaa

SEQ ID NO: 5260808 - DNA, 22 bp, Homo sapiens
atgggtcacacctgacaaatgg

SEQ ID NO: 5260809 - DNA, 14 bp, Homo sapiens
atgggtcagagcta

SEQ ID NO: 5260810 - DNA, 13 bp, Homo sapiens
atgggtcagggtg

SEQ ID NO: 5260811 - DNA, 18 bp, Homo sapiens
atgggtcagggtgtgagg

SEQ ID NO: 5260812 - DNA, 21 bp, Homo sapiens
atgggtcagggtgtgaggcca

SEQ ID NO: 5260813 - DNA, 22 bp, Homo sapiens
atgggtccagaagaccccactt

SEQ ID NO: 5260814 - DNA, 15 bp, Homo sapiens
atgggtccagggcct

SEQ ID NO: 5260815 - DNA, 21 bp, Homo sapiens
atgggtcccgggttagcctgg

SEQ ID NO: 5260816 - DNA, 21 bp, Homo sapiens
atgggtcccttccccctgctc

SEQ ID NO: 5260817 - DNA, 17 bp, Homo sapiens
atgggtcccttgaagga

SEQ ID NO: 5260818 - DNA, 21 bp, Homo sapiens
atgggtcctagcccttccctg

SEQ ID NO: 5260819 - DNA, 22 bp, Homo sapiens
atgggtcgcccatgagagcgca

SEQ ID NO: 5260820 - DNA, 16 bp, Homo sapiens
atgggtctgatattaa

SEQ ID NO: 5260821 - DNA, 19 bp, Homo sapiens
atgggtctgatattaatca

SEQ ID NO: 5260822 - DNA, 14 bp, Homo sapiens
atgggtctggcctg

SEQ ID NO: 5260823 - DNA, 17 bp, Homo sapiens
atgggtctggctgagct

SEQ ID NO: 5260824 - DNA, 21 bp, Homo sapiens
atgggtcttttataggaaaaa

SEQ ID NO: 5260825 - DNA, 17 bp, Homo sapiens
atgggtgaaggctggca

SEQ ID NO: 5260826 - DNA, 22 bp, Homo sapiens
atgggtgaagggagagccagct

SEQ ID NO: 5260827 - DNA, 15 bp, Homo sapiens
atgggtgatatcctg

SEQ ID NO: 5260828 - DNA, 21 bp, Homo sapiens
atgggtgattatgaaatgcca

SEQ ID NO: 5260829 - DNA, 19 bp, Homo sapiens
atgggtgcagtttgagggg

SEQ ID NO: 5260830 - DNA, 20 bp, Homo sapiens
atgggtgcagtttgaggggc

SEQ ID NO: 5260831 - DNA, 22 bp, Homo sapiens
atgggtgccctttcctggcagt

SEQ ID NO: 5260832 - DNA, 12 bp, Homo sapiens
atgggtgctggc

SEQ ID NO: 5260833 - DNA, 20 bp, Homo sapiens
atgggtgcttggaggaagga

SEQ ID NO: 5260834 - DNA, 17 bp, Homo sapiens
atgggtggaaagtgctc

SEQ ID NO: 5260835 - DNA, 22 bp, Homo sapiens
atgggtggctttcaaggctggg

SEQ ID NO: 5260836 - DNA, 22 bp, Homo sapiens
atgggtgggacatggaaaagaa

SEQ ID NO: 5260837 - DNA, 22 bp, Homo sapiens
atgggtgggggctcctggtggc

SEQ ID NO: 5260838 - DNA, 23 bp, Homo sapiens
atgggtgggggctcctggtggcc

SEQ ID NO: 5260839 - DNA, 20 bp, Homo sapiens
atgggtgtgcccttggggta

SEQ ID NO: 5260840 - DNA, 19 bp, Homo sapiens
atgggtgtgggagtgaggg

SEQ ID NO: 5260841 - DNA, 12 bp, Homo sapiens
atgggtgtgtgt

SEQ ID NO: 5260842 - DNA, 21 bp, Homo sapiens
atgggtgttgtatggggaggc

SEQ ID NO: 5260843 - DNA, 23 bp, Homo sapiens
atgggttatctcaaattttaagt

SEQ ID NO: 5260844 - DNA, 15 bp, Homo sapiens
atgggttcttagagc

SEQ ID NO: 5260845 - DNA, 16 bp, Homo sapiens
atgggttggtgcttct

SEQ ID NO: 5260846 - DNA, 19 bp, Homo sapiens
atgggtttcttccagcaga

SEQ ID NO: 5260847 - DNA, 22 bp, Homo sapiens
atgggttttatgagatggatca

SEQ ID NO: 5260848 - DNA, 15 bp, Homo sapiens
atggtaaaaactagt

SEQ ID NO: 5260849 - DNA, 15 bp, Homo sapiens
atggtaaaattttgt

SEQ ID NO: 5260850 - DNA, 16 bp, Homo sapiens
atggtaaataactgtg

SEQ ID NO: 5260851 - DNA, 22 bp, Homo sapiens
atggtaacactttgctttctga

SEQ ID NO: 5260852 - DNA, 22 bp, Homo sapiens
atggtaaccgagccagcagctg

SEQ ID NO: 5260853 - DNA, 13 bp, Homo sapiens
atggtaacttttg

SEQ ID NO: 5260854 - DNA, 13 bp, Homo sapiens
atggtaagagaaa

SEQ ID NO: 5260855 - DNA, 17 bp, Homo sapiens
atggtaagagtcacaat

SEQ ID NO: 5260856 - DNA, 20 bp, Homo sapiens
atggtaatctttacctgtat

SEQ ID NO: 5260857 - DNA, 20 bp, Homo sapiens
atggtaattcttattctttc

SEQ ID NO: 5260858 - DNA, 20 bp, Homo sapiens
atggtaatttagtgtatatg

SEQ ID NO: 5260859 - DNA, 22 bp, Homo sapiens
atggtaatttagtgtatatgtg

SEQ ID NO: 5260860 - DNA, 23 bp, Homo sapiens
atggtaatttctactttgataaa

SEQ ID NO: 5260861 - DNA, 16 bp, Homo sapiens
atggtacactgcatct

SEQ ID NO: 5260862 - DNA, 17 bp, Homo sapiens
atggtacagcttctgga

SEQ ID NO: 5260863 - DNA, 19 bp, Homo sapiens
atggtacagcttctggagc

SEQ ID NO: 5260864 - DNA, 22 bp, Homo sapiens
atggtacagcttctggagcaga

SEQ ID NO: 5260865 - DNA, 18 bp, Homo sapiens
atggtacatgtcttccat

SEQ ID NO: 5260866 - DNA, 16 bp, Homo sapiens
atggtacatttttcaa

SEQ ID NO: 5260867 - DNA, 15 bp, Homo sapiens
atggtaccagataaa

SEQ ID NO: 5260868 - DNA, 15 bp, Homo sapiens
atggtacccccttct

SEQ ID NO: 5260869 - DNA, 20 bp, Homo sapiens
atggtacctatttggtgcta

SEQ ID NO: 5260870 - DNA, 19 bp, Homo sapiens
atggtactagggggaagtg

SEQ ID NO: 5260871 - DNA, 21 bp, Homo sapiens
atggtactcccaaactgacaa

SEQ ID NO: 5260872 - DNA, 14 bp, Homo sapiens
atggtactgctgag

SEQ ID NO: 5260873 - DNA, 20 bp, Homo sapiens
atggtacttaaacatttttg

SEQ ID NO: 5260874 - DNA, 16 bp, Homo sapiens
atggtacttcctctgt

SEQ ID NO: 5260875 - DNA, 19 bp, Homo sapiens
atggtacttcctctgtgaa

SEQ ID NO: 5260876 - DNA, 18 bp, Homo sapiens
atggtagaaactttggaa

SEQ ID NO: 5260877 - DNA, 21 bp, Homo sapiens
atggtagacaatttgccttag

SEQ ID NO: 5260878 - DNA, 17 bp, Homo sapiens
atctggataggagcctg

SEQ ID NO: 5260879 - DNA, 18 bp, Homo sapiens
atctggataggagcctgc

SEQ ID NO: 5260880 - DNA, 21 bp, Homo sapiens
atctggataggagcctgctgg

SEQ ID NO: 5260881 - DNA, 11 bp, Homo sapiens
atctggatata

SEQ ID NO: 5260882 - DNA, 18 bp, Homo sapiens
atctggatatatttaaaa

SEQ ID NO: 5260883 - DNA, 15 bp, Homo sapiens
atctggatatcaagg

SEQ ID NO: 5260884 - DNA, 23 bp, Homo sapiens
atctggatatcaaggtggaaatg

SEQ ID NO: 5260885 - DNA, 17 bp, Homo sapiens
atctggatgccttcccc

SEQ ID NO: 5260886 - DNA, 14 bp, Homo sapiens
atctggatgtaaat

SEQ ID NO: 5260887 - DNA, 15 bp, Homo sapiens
atctggatgtaaatc

SEQ ID NO: 5260888 - DNA, 21 bp, Homo sapiens
atctggcactactcagttatt

SEQ ID NO: 5260889 - DNA, 12 bp, Homo sapiens
atctggcagggt

SEQ ID NO: 5260890 - DNA, 21 bp, Homo sapiens
atctggccacactgggctcac

SEQ ID NO: 5260891 - DNA, 16 bp, Homo sapiens
atctggcccaagctgg

SEQ ID NO: 5260892 - DNA, 20 bp, Homo sapiens
atctggcccaagtgaagcat

SEQ ID NO: 5260893 - DNA, 13 bp, Homo sapiens
atctggcccaggc

SEQ ID NO: 5260894 - DNA, 22 bp, Homo sapiens
atctggcccaggctggccccca

SEQ ID NO: 5260895 - DNA, 20 bp, Homo sapiens
atctggccctcgacactcac

SEQ ID NO: 5260896 - DNA, 11 bp, Homo sapiens
atctggccctg

SEQ ID NO: 5260897 - DNA, 15 bp, Homo sapiens
atctggccctgctgc

SEQ ID NO: 5260898 - DNA, 17 bp, Homo sapiens
atctggccctgctgccc

SEQ ID NO: 5260899 - DNA, 19 bp, Homo sapiens
atctggcccttacacactc

SEQ ID NO: 5260900 - DNA, 20 bp, Homo sapiens
atctggcccttacacactca

SEQ ID NO: 5260901 - DNA, 21 bp, Homo sapiens
atctggcccttacacactcag

SEQ ID NO: 5260902 - DNA, 17 bp, Homo sapiens
atctggcctaaaatctt

SEQ ID NO: 5260903 - DNA, 20 bp, Homo sapiens
atctggcctaaaatcttgga

SEQ ID NO: 5260904 - DNA, 22 bp, Homo sapiens
atctggcctaaaatcttggaag

SEQ ID NO: 5260905 - DNA, 23 bp, Homo sapiens
atctggcctaaaatcttggaagt

SEQ ID NO: 5260906 - DNA, 20 bp, Homo sapiens
atctggcctatgaccctgtg

SEQ ID NO: 5260907 - DNA, 21 bp, Homo sapiens
atctggcctatgaccctgtgc

SEQ ID NO: 5260908 - DNA, 16 bp, Homo sapiens
atctggcctggccagt

SEQ ID NO: 5260909 - DNA, 16 bp, Homo sapiens
atctggcctggcctgg

SEQ ID NO: 5260910 - DNA, 22 bp, Homo sapiens
atctggcctggcctggccctgc

SEQ ID NO: 5260911 - DNA, 23 bp, Homo sapiens
atctggcctggcctggccctgcc

SEQ ID NO: 5260912 - DNA, 16 bp, Homo sapiens
atctggctcctcctgg

SEQ ID NO: 5260913 - DNA, 17 bp, Homo sapiens
atctggctcctgtttcc

SEQ ID NO: 5260914 - DNA, 21 bp, Homo sapiens
atctggctcctttacaaaaga

SEQ ID NO: 5260915 - DNA, 18 bp, Homo sapiens
atctggctgcacaggctg

SEQ ID NO: 5260916 - DNA, 19 bp, Homo sapiens
atctggctgtctagaatgt

SEQ ID NO: 5260917 - DNA, 13 bp, Homo sapiens
atctggctgttta

SEQ ID NO: 5260918 - DNA, 20 bp, Homo sapiens
atctggctgtttagcagaac

SEQ ID NO: 5260919 - DNA, 23 bp, Homo sapiens
atctggcttagtgccacccacct

SEQ ID NO: 5260920 - DNA, 22 bp, Homo sapiens
atctggcttattttaatgtgat

SEQ ID NO: 5260921 - DNA, 15 bp, Homo sapiens
atctggcttccctgg

SEQ ID NO: 5260922 - DNA, 19 bp, Homo sapiens
atctggcttccctggaagc

SEQ ID NO: 5260923 - DNA, 22 bp, Homo sapiens
atctggcttctggccaggaagc

SEQ ID NO: 5260924 - DNA, 18 bp, Homo sapiens
atctggctttttctgcca

SEQ ID NO: 5260925 - DNA, 21 bp, Homo sapiens
atctggctttttctgccactg

SEQ ID NO: 5260926 - DNA, 11 bp, Homo sapiens
atctgggaaag

SEQ ID NO: 5260927 - DNA, 20 bp, Homo sapiens
atctgggaactcccaagaac

SEQ ID NO: 5260928 - DNA, 17 bp, Homo sapiens
atctgggactgtgcctg

SEQ ID NO: 5260929 - DNA, 18 bp, Homo sapiens
atctgggagtcccctttt

SEQ ID NO: 5260930 - DNA, 15 bp, Homo sapiens
atctgggcactgaag

SEQ ID NO: 5260931 - DNA, 18 bp, Homo sapiens
atctgggcattttcctcc

SEQ ID NO: 5260932 - DNA, 22 bp, Homo sapiens
atctgggcattttcctcctctg

SEQ ID NO: 5260933 - DNA, 23 bp, Homo sapiens
atctgggcattttcctcctctgc

SEQ ID NO: 5260934 - DNA, 11 bp, Homo sapiens
atctgggccac

SEQ ID NO: 5260935 - DNA, 17 bp, Homo sapiens
atctgggccagaatttc

SEQ ID NO: 5260936 - DNA, 15 bp, Homo sapiens
atctgggctggcaga

SEQ ID NO: 5260937 - DNA, 10 bp, Homo sapiens
atctgggctt

SEQ ID NO: 5260938 - DNA, 13 bp, Homo sapiens
atctgggcttcct

SEQ ID NO: 5260939 - DNA, 20 bp, Homo sapiens
atctgggcttcctggagcag

SEQ ID NO: 5260940 - DNA, 14 bp, Homo sapiens
atctggggaaggac

SEQ ID NO: 5260941 - DNA, 20 bp, Homo sapiens
atctggggagagcggctgga

SEQ ID NO: 5260942 - DNA, 17 bp, Homo sapiens
atctggggagctcctgg

SEQ ID NO: 5260943 - DNA, 16 bp, Homo sapiens
atctggggatggagaa

SEQ ID NO: 5260944 - DNA, 23 bp, Homo sapiens
atctggggatggagaatgccagc

SEQ ID NO: 5260945 - DNA, 22 bp, Homo sapiens
atctggggcagcaccctataaa

SEQ ID NO: 5260946 - DNA, 16 bp, Homo sapiens
atctggggctctggga

SEQ ID NO: 5260947 - DNA, 16 bp, Homo sapiens
atctgggggagtggaa

SEQ ID NO: 5260948 - DNA, 18 bp, Homo sapiens
atctgggggagtggaata

SEQ ID NO: 5260949 - DNA, 18 bp, Homo sapiens
atctgggggcctcttctg

SEQ ID NO: 5260950 - DNA, 14 bp, Homo sapiens
atctggggggtggg

SEQ ID NO: 5260951 - DNA, 18 bp, Homo sapiens
atctggggggtggggagg

SEQ ID NO: 5260952 - DNA, 23 bp, Homo sapiens
atctggggtgggagtaacagggc

SEQ ID NO: 5260953 - DNA, 19 bp, Homo sapiens
atctgggtaagaagaaagc

SEQ ID NO: 5260954 - DNA, 22 bp, Homo sapiens
atctgggtctactcaaacactt

SEQ ID NO: 5260955 - DNA, 19 bp, Homo sapiens
atctgggtggtaactgcca

SEQ ID NO: 5260956 - DNA, 14 bp, Homo sapiens
atctgggtggtctg

SEQ ID NO: 5260957 - DNA, 17 bp, Homo sapiens
atctgggttcactgcaa

SEQ ID NO: 5260958 - DNA, 18 bp, Homo sapiens
atctgggttttgcctctg

SEQ ID NO: 5260959 - DNA, 23 bp, Homo sapiens
atctggtagaagggaaagcccat

SEQ ID NO: 5260960 - DNA, 20 bp, Homo sapiens
atctggtagggggaaaatgt

SEQ ID NO: 5260961 - DNA, 23 bp, Homo sapiens
atctggtatggtgctaatatttt

SEQ ID NO: 5260962 - DNA, 18 bp, Homo sapiens
atctggtattaaatgcca

SEQ ID NO: 5260963 - DNA, 19 bp, Homo sapiens
atctggtcttgttagaaaa

SEQ ID NO: 5260964 - DNA, 20 bp, Homo sapiens
atctggtcttgtttccagga

SEQ ID NO: 5260965 - DNA, 22 bp, Homo sapiens
atctggtcttgtttccaggagc

SEQ ID NO: 5260966 - DNA, 13 bp, Homo sapiens
atctggtcttttt

SEQ ID NO: 5260967 - DNA, 10 bp, Homo sapiens
atctggtgac

SEQ ID NO: 5260968 - DNA, 13 bp, Homo sapiens
atctggtgcctcc

SEQ ID NO: 5260969 - DNA, 16 bp, Homo sapiens
atctggtgcctcctca

SEQ ID NO: 5260970 - DNA, 12 bp, Homo sapiens
atctggtgcctt

SEQ ID NO: 5260971 - DNA, 13 bp, Homo sapiens
atctggtgcgtgt

SEQ ID NO: 5260972 - DNA, 19 bp, Homo sapiens
atctggtgttcttgctaac

SEQ ID NO: 5260973 - DNA, 12 bp, Homo sapiens
atctggttacag

SEQ ID NO: 5260974 - DNA, 17 bp, Homo sapiens
atctggttaggatggca

SEQ ID NO: 5260975 - DNA, 22 bp, Homo sapiens
atctggtttgactccgctggag

SEQ ID NO: 5260976 - DNA, 14 bp, Homo sapiens
atctggttttgcta

SEQ ID NO: 5260977 - DNA, 14 bp, Homo sapiens
atctgtaaaaaaga

SEQ ID NO: 5260978 - DNA, 23 bp, Homo sapiens
atctgtaaaaattgttataatta

SEQ ID NO: 5260979 - DNA, 16 bp, Homo sapiens
atctgtaaaaccaggc

SEQ ID NO: 5260980 - DNA, 14 bp, Homo sapiens
atctgtaaactgtg

SEQ ID NO: 5260981 - DNA, 22 bp, Homo sapiens
atctgtaaactgtgtattccaa

SEQ ID NO: 5260982 - DNA, 15 bp, Homo sapiens
atctgtaaagaaaac

SEQ ID NO: 5260983 - DNA, 13 bp, Homo sapiens
atctgtaaagata

SEQ ID NO: 5260984 - DNA, 14 bp, Homo sapiens
atctgtaaagccag

SEQ ID NO: 5260985 - DNA, 16 bp, Homo sapiens
atctgtaaatttaact

SEQ ID NO: 5260986 - DNA, 17 bp, Homo sapiens
atctgtaaatttaactg

SEQ ID NO: 5260987 - DNA, 23 bp, Homo sapiens
atctgtaacccttgaatttctag

SEQ ID NO: 5260988 - DNA, 20 bp, Homo sapiens
atctgtaagagcttgctcca

SEQ ID NO: 5260989 - DNA, 21 bp, Homo sapiens
atctgtaagagcttgctccag

SEQ ID NO: 5260990 - DNA, 16 bp, Homo sapiens
atctgtaagctctttg

SEQ ID NO: 5260991 - DNA, 18 bp, Homo sapiens
atctgtaaggaactggaa

SEQ ID NO: 5260992 - DNA, 17 bp, Homo sapiens
atctgtaatgatactga

SEQ ID NO: 5260993 - DNA, 18 bp, Homo sapiens
atctgtaatggtactgac

SEQ ID NO: 5260994 - DNA, 23 bp, Homo sapiens
atctgtacaaaggggaaagaaca

SEQ ID NO: 5260995 - DNA, 15 bp, Homo sapiens
atctgtacaatgaac

SEQ ID NO: 5260996 - DNA, 21 bp, Homo sapiens
atctgtacatactttttcaag

SEQ ID NO: 5260997 - DNA, 17 bp, Homo sapiens
atctgtacatgttcttg

SEQ ID NO: 5260998 - DNA, 16 bp, Homo sapiens
atctgtacctctgcct

SEQ ID NO: 5260999 - DNA, 16 bp, Homo sapiens
atctgtactgaaagca

SEQ ID NO: 5261000 - DNA, 12 bp, Homo sapiens
atctgtactgta

SEQ ID NO: 5261001 - DNA, 14 bp, Homo sapiens
atctgtactgtaat

SEQ ID NO: 5261002 - DNA, 15 bp, Homo sapiens
atctgtactgtaatt

SEQ ID NO: 5261003 - DNA, 17 bp, Homo sapiens
atctgtacttcttcgat

SEQ ID NO: 5261004 - DNA, 23 bp, Homo sapiens
atctgtacttggtccaactgcaa

SEQ ID NO: 5261005 - DNA, 13 bp, Homo sapiens
atctgtactttgt

SEQ ID NO: 5261006 - DNA, 15 bp, Homo sapiens
atctgtactttgtgt

SEQ ID NO: 5261007 - DNA, 21 bp, Homo sapiens
atctgtactttgtgtttagct

SEQ ID NO: 5261008 - DNA, 16 bp, Homo sapiens
atctgtacttttttca

SEQ ID NO: 5261009 - DNA, 17 bp, Homo sapiens
atctgtacttttttcaa

SEQ ID NO: 5261010 - DNA, 18 bp, Homo sapiens
atctgtacttttttcaaa

SEQ ID NO: 5261011 - DNA, 22 bp, Homo sapiens
atctgtagatactagctatcta

SEQ ID NO: 5261012 - DNA, 21 bp, Homo sapiens
atctgtagctataatgagcat

SEQ ID NO: 5261013 - DNA, 14 bp, Homo sapiens
atctgtagggctgg

SEQ ID NO: 5261014 - DNA, 19 bp, Homo sapiens
atctgtagtgatggagttc

SEQ ID NO: 5261015 - DNA, 18 bp, Homo sapiens
atctgtataaaaatgtaa

SEQ ID NO: 5261016 - DNA, 19 bp, Homo sapiens
atctgtataaaaatgtaaa

SEQ ID NO: 5261017 - DNA, 14 bp, Homo sapiens
atctgtataaataa

SEQ ID NO: 5261018 - DNA, 15 bp, Homo sapiens
atctgtataaataag

SEQ ID NO: 5261019 - DNA, 16 bp, Homo sapiens
atctgtataaataaga

SEQ ID NO: 5261020 - DNA, 14 bp, Homo sapiens
atctgtataaatgt

SEQ ID NO: 5261021 - DNA, 15 bp, Homo sapiens
atctgtataaatgtc

SEQ ID NO: 5261022 - DNA, 21 bp, Homo sapiens
atctgtataaatgtctattat

SEQ ID NO: 5261023 - DNA, 17 bp, Homo sapiens
atctgtataagctgtaa

SEQ ID NO: 5261024 - DNA, 20 bp, Homo sapiens
atctgtataagctgtaatat

SEQ ID NO: 5261025 - DNA, 21 bp, Homo sapiens
atctgtataagtaagaaaata

SEQ ID NO: 5261026 - DNA, 23 bp, Homo sapiens
atctgtataagtaagaaaatatt

SEQ ID NO: 5261027 - DNA, 21 bp, Homo sapiens
atctgtataatactttgtata

SEQ ID NO: 5261028 - DNA, 24 bp, Homo sapiens
atctgtataatactttgtatacaa

SEQ ID NO: 5261029 - DNA, 22 bp, Homo sapiens
atctgtatataaaatattttca

SEQ ID NO: 5261030 - DNA, 20 bp, Homo sapiens
atctgtatatacaataacat

SEQ ID NO: 5261031 - DNA, 15 bp, Homo sapiens
atctgtatatcagct

SEQ ID NO: 5261032 - DNA, 16 bp, Homo sapiens
atctgtatatcagctc

SEQ ID NO: 5261033 - DNA, 21 bp, Homo sapiens
atctgtatatcagctctaaag

SEQ ID NO: 5261034 - DNA, 23 bp, Homo sapiens
atctgtatctttgacaattctgg

SEQ ID NO: 5261035 - DNA, 17 bp, Homo sapiens
atctgtatcttttctct

SEQ ID NO: 5261036 - DNA, 13 bp, Homo sapiens
atctgtatgcctc

SEQ ID NO: 5261037 - DNA, 18 bp, Homo sapiens
atctgtatgggtcattct

SEQ ID NO: 5261038 - DNA, 16 bp, Homo sapiens
atctgtattcttgctt

SEQ ID NO: 5261039 - DNA, 18 bp, Homo sapiens
atctgtatttattatttg

SEQ ID NO: 5261040 - DNA, 17 bp, Homo sapiens
atctgtcaaaacactgt

SEQ ID NO: 5261041 - DNA, 21 bp, Homo sapiens
atctgtcaagagtagttatat

SEQ ID NO: 5261042 - DNA, 10 bp, Homo sapiens
atctgtcaca

SEQ ID NO: 5261043 - DNA, 20 bp, Homo sapiens
atctgtcacaataaatggcc

SEQ ID NO: 5261044 - DNA, 17 bp, Homo sapiens
atctgtcacaccagcca

SEQ ID NO: 5261045 - DNA, 18 bp, Homo sapiens
atctgtcacttgcattcc

SEQ ID NO: 5261046 - DNA, 15 bp, Homo sapiens
atctgtcagcttccc

SEQ ID NO: 5261047 - DNA, 13 bp, Homo sapiens
atctgtcagtgtt

SEQ ID NO: 5261048 - DNA, 21 bp, Homo sapiens
atctgtcatccatatttgcta

SEQ ID NO: 5261049 - DNA, 16 bp, Homo sapiens
atctgtcatctctctg

SEQ ID NO: 5261050 - DNA, 19 bp, Homo sapiens
atctgtcatctctctgggg

SEQ ID NO: 5261051 - DNA, 17 bp, Homo sapiens
atctgtcattatattct

SEQ ID NO: 5261052 - DNA, 22 bp, Homo sapiens
atctgtcatttgagcagggctc

SEQ ID NO: 5261053 - DNA, 18 bp, Homo sapiens
atctgtccaaaggaggct

SEQ ID NO: 5261054 - DNA, 20 bp, Homo sapiens
atctgtccacatccccagag

SEQ ID NO: 5261055 - DNA, 15 bp, Homo sapiens
atggtagactgtgac

SEQ ID NO: 5261056 - DNA, 21 bp, Homo sapiens
atggtagattcgctgtcccct

SEQ ID NO: 5261057 - DNA, 19 bp, Homo sapiens
atggtagccagatgataaa

SEQ ID NO: 5261058 - DNA, 20 bp, Homo sapiens
atggtagccagttgaattta

SEQ ID NO: 5261059 - DNA, 18 bp, Homo sapiens
atggtagctctgaaggga

SEQ ID NO: 5261060 - DNA, 23 bp, Homo sapiens
atggtagctctgaagggagggga

SEQ ID NO: 5261061 - DNA, 18 bp, Homo sapiens
atggtaggcatttcctat

SEQ ID NO: 5261062 - DNA, 18 bp, Homo sapiens
atggtaggggagggcagg

SEQ ID NO: 5261063 - DNA, 18 bp, Homo sapiens
atggtagggtataatgtg

SEQ ID NO: 5261064 - DNA, 22 bp, Homo sapiens
atggtagggtataatgtgtctg

SEQ ID NO: 5261065 - DNA, 19 bp, Homo sapiens
atggtagtctaaccaaatg

SEQ ID NO: 5261066 - DNA, 17 bp, Homo sapiens
atggtagtggcaaagag

SEQ ID NO: 5261067 - DNA, 13 bp, Homo sapiens
atggtagtttaaa

SEQ ID NO: 5261068 - DNA, 13 bp, Homo sapiens
atggtagtttctg

SEQ ID NO: 5261069 - DNA, 22 bp, Homo sapiens
atggtagttttacagtgtttct

SEQ ID NO: 5261070 - DNA, 21 bp, Homo sapiens
atggtataaaaggttgccaaa

SEQ ID NO: 5261071 - DNA, 19 bp, Homo sapiens
atggtataatggttgactg

SEQ ID NO: 5261072 - DNA, 12 bp, Homo sapiens
atggtatatata

SEQ ID NO: 5261073 - DNA, 14 bp, Homo sapiens
atggtatatataca

SEQ ID NO: 5261074 - DNA, 16 bp, Homo sapiens
atggtatatatacata

SEQ ID NO: 5261075 - DNA, 21 bp, Homo sapiens
atggtatatttggtactgtat

SEQ ID NO: 5261076 - DNA, 18 bp, Homo sapiens
atggtatcaaaattacat

SEQ ID NO: 5261077 - DNA, 17 bp, Homo sapiens
atggtatcatgtatctc

SEQ ID NO: 5261078 - DNA, 14 bp, Homo sapiens
atggtatccagaat

SEQ ID NO: 5261079 - DNA, 18 bp, Homo sapiens
atggtatgatcaataaag

SEQ ID NO: 5261080 - DNA, 18 bp, Homo sapiens
atggtatgcacaattcca

SEQ ID NO: 5261081 - DNA, 15 bp, Homo sapiens
atggtatgcagcata

SEQ ID NO: 5261082 - DNA, 19 bp, Homo sapiens
atggtatgcagcatacaaa

SEQ ID NO: 5261083 - DNA, 16 bp, Homo sapiens
atggtatgctggccag

SEQ ID NO: 5261084 - DNA, 18 bp, Homo sapiens
atggtatgtaactcttaa

SEQ ID NO: 5261085 - DNA, 17 bp, Homo sapiens
atggtattaatcttgtg

SEQ ID NO: 5261086 - DNA, 18 bp, Homo sapiens
atggtattaatcttgtgt

SEQ ID NO: 5261087 - DNA, 16 bp, Homo sapiens
atggtattgaaggaat

SEQ ID NO: 5261088 - DNA, 17 bp, Homo sapiens
atggtattgtattgtaa

SEQ ID NO: 5261089 - DNA, 16 bp, Homo sapiens
atggtatttctttctc

SEQ ID NO: 5261090 - DNA, 20 bp, Homo sapiens
atggtattttcgtgcatttg

SEQ ID NO: 5261091 - DNA, 23 bp, Homo sapiens
atggtattttcgtgcatttgtga

SEQ ID NO: 5261092 - DNA, 18 bp, Homo sapiens
atggtattttttgtgaat

SEQ ID NO: 5261093 - DNA, 22 bp, Homo sapiens
atggtattttttgtgaatggtt

SEQ ID NO: 5261094 - DNA, 20 bp, Homo sapiens
atggtcaacacttaagggtt

SEQ ID NO: 5261095 - DNA, 20 bp, Homo sapiens
atggtcaagttcccaactga

SEQ ID NO: 5261096 - DNA, 16 bp, Homo sapiens
atggtcacacactgat

SEQ ID NO: 5261097 - DNA, 14 bp, Homo sapiens
atggtcacagaccc

SEQ ID NO: 5261098 - DNA, 15 bp, Homo sapiens
atggtcacagacccc

SEQ ID NO: 5261099 - DNA, 16 bp, Homo sapiens
atggtcacagacccct

SEQ ID NO: 5261100 - DNA, 24 bp, Homo sapiens
atggtcacagtcctatgtacagag

SEQ ID NO: 5261101 - DNA, 19 bp, Homo sapiens
atggtcaccaaatcagctg

SEQ ID NO: 5261102 - DNA, 23 bp, Homo sapiens
atggtcacgaggtccagacccac

SEQ ID NO: 5261103 - DNA, 23 bp, Homo sapiens
atggtcagaatttccctctgata

SEQ ID NO: 5261104 - DNA, 16 bp, Homo sapiens
atggtcagacacaaac

SEQ ID NO: 5261105 - DNA, 15 bp, Homo sapiens
atggtcagctcacac

SEQ ID NO: 5261106 - DNA, 13 bp, Homo sapiens
atggtcagctccc

SEQ ID NO: 5261107 - DNA, 18 bp, Homo sapiens
atggtcagtgtgcaaaga

SEQ ID NO: 5261108 - DNA, 13 bp, Homo sapiens
atggtcatataca

SEQ ID NO: 5261109 - DNA, 14 bp, Homo sapiens
atggtcatattatt

SEQ ID NO: 5261110 - DNA, 19 bp, Homo sapiens
atggtccaattagtttcct

SEQ ID NO: 5261111 - DNA, 16 bp, Homo sapiens
atggtccaggagaagg

SEQ ID NO: 5261112 - DNA, 21 bp, Homo sapiens
atggtccagtgtcattttgat

SEQ ID NO: 5261113 - DNA, 19 bp, Homo sapiens
atggtccatttcatgtgat

SEQ ID NO: 5261114 - DNA, 22 bp, Homo sapiens
atggtccatttcatgtgatcta

SEQ ID NO: 5261115 - DNA, 19 bp, Homo sapiens
atggtcccacatccctggg

SEQ ID NO: 5261116 - DNA, 11 bp, Homo sapiens
atggtcccagg

SEQ ID NO: 5261117 - DNA, 18 bp, Homo sapiens
atggtcccaggaagcagg

SEQ ID NO: 5261118 - DNA, 13 bp, Homo sapiens
atggtcccatcca

SEQ ID NO: 5261119 - DNA, 14 bp, Homo sapiens
atggtcccatccag

SEQ ID NO: 5261120 - DNA, 19 bp, Homo sapiens
atggtccgctttcctggag

SEQ ID NO: 5261121 - DNA, 20 bp, Homo sapiens
atggtccgctttcctggagc

SEQ ID NO: 5261122 - DNA, 20 bp, Homo sapiens
atggtccgtgcccaggccct

SEQ ID NO: 5261123 - DNA, 21 bp, Homo sapiens
atggtccgtgctaaggacttg

SEQ ID NO: 5261124 - DNA, 20 bp, Homo sapiens
atggtcctaaaagcaaaata

SEQ ID NO: 5261125 - DNA, 18 bp, Homo sapiens
atggtcctgcagaaagct

SEQ ID NO: 5261126 - DNA, 17 bp, Homo sapiens
atggtcctggggctctg

SEQ ID NO: 5261127 - DNA, 22 bp, Homo sapiens
atggtcctgtctgtccttctga

SEQ ID NO: 5261128 - DNA, 12 bp, Homo sapiens
atggtcctgtgc

SEQ ID NO: 5261129 - DNA, 13 bp, Homo sapiens
atggtcctgtgcc

SEQ ID NO: 5261130 - DNA, 17 bp, Homo sapiens
atggtcctgtgccccga

SEQ ID NO: 5261131 - DNA, 18 bp, Homo sapiens
atggtcctgttatgtcat

SEQ ID NO: 5261132 - DNA, 17 bp, Homo sapiens
atggtcctttctggaag

SEQ ID NO: 5261133 - DNA, 14 bp, Homo sapiens
atggtcgcccagga

SEQ ID NO: 5261134 - DNA, 16 bp, Homo sapiens
atggtcgcccaggaga

SEQ ID NO: 5261135 - DNA, 15 bp, Homo sapiens
atggtcggatctcac

SEQ ID NO: 5261136 - DNA, 16 bp, Homo sapiens
atggtcggatctcaca

SEQ ID NO: 5261137 - DNA, 14 bp, Homo sapiens
atggtctaatgttt

SEQ ID NO: 5261138 - DNA, 15 bp, Homo sapiens
atggtctagaaatgc

SEQ ID NO: 5261139 - DNA, 18 bp, Homo sapiens
atggtctcatctcctttg

SEQ ID NO: 5261140 - DNA, 19 bp, Homo sapiens
atggtctccatatcagctc

SEQ ID NO: 5261141 - DNA, 22 bp, Homo sapiens
atggtctcctctgattatcagg

SEQ ID NO: 5261142 - DNA, 21 bp, Homo sapiens
atggtctctcgggccccccac

SEQ ID NO: 5261143 - DNA, 23 bp, Homo sapiens
atggtctgagtggggcttcctgg

SEQ ID NO: 5261144 - DNA, 19 bp, Homo sapiens
atggtctggatctcctgac

SEQ ID NO: 5261145 - DNA, 20 bp, Homo sapiens
atggtctggcaatattctgt

SEQ ID NO: 5261146 - DNA, 13 bp, Homo sapiens
atggtctggtcta

SEQ ID NO: 5261147 - DNA, 15 bp, Homo sapiens
atggtcttcagcctc

SEQ ID NO: 5261148 - DNA, 17 bp, Homo sapiens
atggtcttcagcctctt

SEQ ID NO: 5261149 - DNA, 16 bp, Homo sapiens
atggtcttgagccagt

SEQ ID NO: 5261150 - DNA, 16 bp, Homo sapiens
atggtcttgatcctcc

SEQ ID NO: 5261151 - DNA, 19 bp, Homo sapiens
atggtcttgatctcctgag

SEQ ID NO: 5261152 - DNA, 13 bp, Homo sapiens
atggtctttgctc

SEQ ID NO: 5261153 - DNA, 18 bp, Homo sapiens
atggtctttgggcaggga

SEQ ID NO: 5261154 - DNA, 21 bp, Homo sapiens
atggtgaaaccccgtctctac

SEQ ID NO: 5261155 - DNA, 17 bp, Homo sapiens
atggtgaaaccctgtct

SEQ ID NO: 5261156 - DNA, 17 bp, Homo sapiens
atggtgaaatttattag

SEQ ID NO: 5261157 - DNA, 15 bp, Homo sapiens
atggtgaacatttta

SEQ ID NO: 5261158 - DNA, 20 bp, Homo sapiens
atggtgaactgaagcagagt

SEQ ID NO: 5261159 - DNA, 14 bp, Homo sapiens
atggtgaagtaaca

SEQ ID NO: 5261160 - DNA, 22 bp, Homo sapiens
atggtgaagtcacattagtgtg

SEQ ID NO: 5261161 - DNA, 13 bp, Homo sapiens
atggtgacacaca

SEQ ID NO: 5261162 - DNA, 17 bp, Homo sapiens
atggtgacacacagcag

SEQ ID NO: 5261163 - DNA, 17 bp, Homo sapiens
atggtgaccaccccctg

SEQ ID NO: 5261164 - DNA, 14 bp, Homo sapiens
atggtgacctctcc

SEQ ID NO: 5261165 - DNA, 15 bp, Homo sapiens
atggtgacttttgaa

SEQ ID NO: 5261166 - DNA, 19 bp, Homo sapiens
atggtgagaattaaaataa

SEQ ID NO: 5261167 - DNA, 19 bp, Homo sapiens
atggtgagcgctgtgagat

SEQ ID NO: 5261168 - DNA, 22 bp, Homo sapiens
atggtgaggaagccccaagcca

SEQ ID NO: 5261169 - DNA, 20 bp, Homo sapiens
atggtgaggcttaacaatgt

SEQ ID NO: 5261170 - DNA, 18 bp, Homo sapiens
atggtgagggctgagagg

SEQ ID NO: 5261171 - DNA, 18 bp, Homo sapiens
atggtgagtgatttttat

SEQ ID NO: 5261172 - DNA, 18 bp, Homo sapiens
atggtgatactccaaggt

SEQ ID NO: 5261173 - DNA, 15 bp, Homo sapiens
atggtgatggagagg

SEQ ID NO: 5261174 - DNA, 20 bp, Homo sapiens
atggtgatggagagggatgg

SEQ ID NO: 5261175 - DNA, 13 bp, Homo sapiens
atggtgatttctt

SEQ ID NO: 5261176 - DNA, 15 bp, Homo sapiens
atggtgatttcttgc

SEQ ID NO: 5261177 - DNA, 16 bp, Homo sapiens
atggtgcaatgaatta

SEQ ID NO: 5261178 - DNA, 13 bp, Homo sapiens
atggtgcaatgac

SEQ ID NO: 5261179 - DNA, 16 bp, Homo sapiens
atggtgcaatgacctt

SEQ ID NO: 5261180 - DNA, 22 bp, Homo sapiens
atggtgcaatttgtctttggaa

SEQ ID NO: 5261181 - DNA, 19 bp, Homo sapiens
atggtgcagagaagctgga

SEQ ID NO: 5261182 - DNA, 22 bp, Homo sapiens
atggtgcagagaagctggactt

SEQ ID NO: 5261183 - DNA, 11 bp, Homo sapiens
atggtgcagtg

SEQ ID NO: 5261184 - DNA, 13 bp, Homo sapiens
atggtgcagtgaa

SEQ ID NO: 5261185 - DNA, 18 bp, Homo sapiens
atggtgcattgtatagat

SEQ ID NO: 5261186 - DNA, 16 bp, Homo sapiens
atggtgccccaggacc

SEQ ID NO: 5261187 - DNA, 17 bp, Homo sapiens
atggtgccccaggacca

SEQ ID NO: 5261188 - DNA, 19 bp, Homo sapiens
atggtgccccaggaccagc

SEQ ID NO: 5261189 - DNA, 16 bp, Homo sapiens
atggtgccccctgggg

SEQ ID NO: 5261190 - DNA, 13 bp, Homo sapiens
atggtgcccttgg

SEQ ID NO: 5261191 - DNA, 9 bp, Homo sapiens
atggtgcct

SEQ ID NO: 5261192 - DNA, 16 bp, Homo sapiens
atggtgcctagtattg

SEQ ID NO: 5261193 - DNA, 21 bp, Homo sapiens
atggtgcctagtattgacaaa

SEQ ID NO: 5261194 - DNA, 20 bp, Homo sapiens
atggtgcctatatctgagag

SEQ ID NO: 5261195 - DNA, 14 bp, Homo sapiens
atggtgcctctgga

SEQ ID NO: 5261196 - DNA, 16 bp, Homo sapiens
atggtgcctgagaggc

SEQ ID NO: 5261197 - DNA, 17 bp, Homo sapiens
atggtgcctgagaggca

SEQ ID NO: 5261198 - DNA, 20 bp, Homo sapiens
atggtgcctgagaggcaggc

SEQ ID NO: 5261199 - DNA, 14 bp, Homo sapiens
atggtgccttcatt

SEQ ID NO: 5261200 - DNA, 10 bp, Homo sapiens
atggtgctaa

SEQ ID NO: 5261201 - DNA, 17 bp, Homo sapiens
atggtgctaatgtgtct

SEQ ID NO: 5261202 - DNA, 22 bp, Homo sapiens
atggtgctaatgtgtctgtgga

SEQ ID NO: 5261203 - DNA, 15 bp, Homo sapiens
atggtgctcaccatg

SEQ ID NO: 5261204 - DNA, 12 bp, Homo sapiens
atggtgctgaga

SEQ ID NO: 5261205 - DNA, 13 bp, Homo sapiens
atggtgctgagaa

SEQ ID NO: 5261206 - DNA, 16 bp, Homo sapiens
atggtgctgggtcctt

SEQ ID NO: 5261207 - DNA, 23 bp, Homo sapiens
atggtgcttattaagaccaaaga

SEQ ID NO: 5261208 - DNA, 13 bp, Homo sapiens
atggtggaagagg

SEQ ID NO: 5261209 - DNA, 22 bp, Homo sapiens
atggtggaagaggttctcagca

SEQ ID NO: 5261210 - DNA, 20 bp, Homo sapiens
atggtggaggattgctgcca

SEQ ID NO: 5261211 - DNA, 13 bp, Homo sapiens
atggtggagggca

SEQ ID NO: 5261212 - DNA, 16 bp, Homo sapiens
atggtggagggcactt

SEQ ID NO: 5261213 - DNA, 19 bp, Homo sapiens
atggtggagggcacttcag

SEQ ID NO: 5261214 - DNA, 20 bp, Homo sapiens
atggtggagggcacttcagg

SEQ ID NO: 5261215 - DNA, 13 bp, Homo sapiens
atggtggagggcc

SEQ ID NO: 5261216 - DNA, 14 bp, Homo sapiens
atggtggagggcca

SEQ ID NO: 5261217 - DNA, 19 bp, Homo sapiens
atggtggatgatccccacg

SEQ ID NO: 5261218 - DNA, 22 bp, Homo sapiens
atggtggatgatccccacgcca

SEQ ID NO: 5261219 - DNA, 21 bp, Homo sapiens
atggtggcacacgcctgtagt

SEQ ID NO: 5261220 - DNA, 15 bp, Homo sapiens
atggtggcacaggca

SEQ ID NO: 5261221 - DNA, 13 bp, Homo sapiens
atggtggcacatt

SEQ ID NO: 5261222 - DNA, 16 bp, Homo sapiens
atggtggcacattcct

SEQ ID NO: 5261223 - DNA, 22 bp, Homo sapiens
atggtggcacattcctttgggt

SEQ ID NO: 5261224 - DNA, 17 bp, Homo sapiens
atggtggcatgtgcctg

SEQ ID NO: 5261225 - DNA, 17 bp, Homo sapiens
atggtggccctggggaa

SEQ ID NO: 5261226 - DNA, 14 bp, Homo sapiens
atggtggcctcaag

SEQ ID NO: 5261227 - DNA, 16 bp, Homo sapiens
atggtggcgcgcacct

SEQ ID NO: 5261228 - DNA, 23 bp, Homo sapiens
atggtggcgctttctcctgtgcc

SEQ ID NO: 5261229 - DNA, 17 bp, Homo sapiens
atggtggctcatgcctg

SEQ ID NO: 5261230 - DNA, 12 bp, Homo sapiens
atggtggctggg

SEQ ID NO: 5261231 - DNA, 17 bp, Homo sapiens
atggtggctgggttgga

SEQ ID NO: 5261232 - DNA, 12 bp, Homo sapiens
atggtggctgtg

SEQ ID NO: 5261233 - DNA, 22 bp, Homo sapiens
atggtggcttcagctccagccc

SEQ ID NO: 5261234 - DNA, 22 bp, Homo sapiens
atctgtccacatccccagagcc

SEQ ID NO: 5261235 - DNA, 23 bp, Homo sapiens
atctgtccacatccccagagccc

SEQ ID NO: 5261236 - DNA, 13 bp, Homo sapiens
atctgtccatcct

SEQ ID NO: 5261237 - DNA, 16 bp, Homo sapiens
atctgtccatcctcct

SEQ ID NO: 5261238 - DNA, 17 bp, Homo sapiens
atctgtccatggccttt

SEQ ID NO: 5261239 - DNA, 18 bp, Homo sapiens
atctgtccccctttagat

SEQ ID NO: 5261240 - DNA, 16 bp, Homo sapiens
atctgtcccctctccc

SEQ ID NO: 5261241 - DNA, 18 bp, Homo sapiens
atctgtcccctctcccct

SEQ ID NO: 5261242 - DNA, 16 bp, Homo sapiens
atctgtccgtggaaaa

SEQ ID NO: 5261243 - DNA, 19 bp, Homo sapiens
atctgtccgtggaaaattt

SEQ ID NO: 5261244 - DNA, 15 bp, Homo sapiens
atctgtcctcaccct

SEQ ID NO: 5261245 - DNA, 18 bp, Homo sapiens
atctgtcctcagccttgc

SEQ ID NO: 5261246 - DNA, 12 bp, Homo sapiens
atctgtcctctg

SEQ ID NO: 5261247 - DNA, 17 bp, Homo sapiens
atctgtcctctgtagta

SEQ ID NO: 5261248 - DNA, 23 bp, Homo sapiens
atctgtcctgtggcatgcaaaag

SEQ ID NO: 5261249 - DNA, 18 bp, Homo sapiens
atctgtcgcatttcatca

SEQ ID NO: 5261250 - DNA, 17 bp, Homo sapiens
atctgtctaaagataga

SEQ ID NO: 5261251 - DNA, 13 bp, Homo sapiens
atctgtctacttt

SEQ ID NO: 5261252 - DNA, 18 bp, Homo sapiens
atctgtctactttctctt

SEQ ID NO: 5261253 - DNA, 12 bp, Homo sapiens
atctgtctagaa

SEQ ID NO: 5261254 - DNA, 18 bp, Homo sapiens
atctgtctcccagttatg

SEQ ID NO: 5261255 - DNA, 13 bp, Homo sapiens
atctgtctgagcc

SEQ ID NO: 5261256 - DNA, 14 bp, Homo sapiens
atctgtctgagccc

SEQ ID NO: 5261257 - DNA, 18 bp, Homo sapiens
atctgtctgagccctgcc

SEQ ID NO: 5261258 - DNA, 12 bp, Homo sapiens
atctgtctgatt

SEQ ID NO: 5261259 - DNA, 15 bp, Homo sapiens
atctgtctgattcta

SEQ ID NO: 5261260 - DNA, 19 bp, Homo sapiens
atctgtctgccaacctaaa

SEQ ID NO: 5261261 - DNA, 11 bp, Homo sapiens
atctgtctgct

SEQ ID NO: 5261262 - DNA, 13 bp, Homo sapiens
atctgtctgtcct

SEQ ID NO: 5261263 - DNA, 13 bp, Homo sapiens
atctgtctgtctg

SEQ ID NO: 5261264 - DNA, 15 bp, Homo sapiens
atctgtctgtctgtg

SEQ ID NO: 5261265 - DNA, 15 bp, Homo sapiens
atctgtctgtgcaca

SEQ ID NO: 5261266 - DNA, 19 bp, Homo sapiens
atctgtctgtggcaaaagt

SEQ ID NO: 5261267 - DNA, 21 bp, Homo sapiens
atctgtcttgactttttaaaa

SEQ ID NO: 5261268 - DNA, 16 bp, Homo sapiens
atctgtcttgccagcc

SEQ ID NO: 5261269 - DNA, 18 bp, Homo sapiens
atctgtcttgccagccag

SEQ ID NO: 5261270 - DNA, 23 bp, Homo sapiens
atctgtcttgccagccagaagcc

SEQ ID NO: 5261271 - DNA, 16 bp, Homo sapiens
atctgtcttgtaatat

SEQ ID NO: 5261272 - DNA, 11 bp, Homo sapiens
atctgtcttta

SEQ ID NO: 5261273 - DNA, 14 bp, Homo sapiens
atctgtctttatga

SEQ ID NO: 5261274 - DNA, 21 bp, Homo sapiens
atctgtcttttatttaacaaa

SEQ ID NO: 5261275 - DNA, 12 bp, Homo sapiens
atctgtgaaata

SEQ ID NO: 5261276 - DNA, 17 bp, Homo sapiens
atctgtgaaatatcatc

SEQ ID NO: 5261277 - DNA, 21 bp, Homo sapiens
atctgtgaaatgctggcattt

SEQ ID NO: 5261278 - DNA, 20 bp, Homo sapiens
atctgtgaagaaagaggtta

SEQ ID NO: 5261279 - DNA, 12 bp, Homo sapiens
atctgtgaataa

SEQ ID NO: 5261280 - DNA, 13 bp, Homo sapiens
atctgtgaataag

SEQ ID NO: 5261281 - DNA, 19 bp, Homo sapiens
atctgtgaatcctttgtac

SEQ ID NO: 5261282 - DNA, 16 bp, Homo sapiens
atctgtgaattcagat

SEQ ID NO: 5261283 - DNA, 23 bp, Homo sapiens
atctgtgacctgtcagaataaaa

SEQ ID NO: 5261284 - DNA, 13 bp, Homo sapiens
atctgtgactata

SEQ ID NO: 5261285 - DNA, 15 bp, Homo sapiens
atctgtgactataaa

SEQ ID NO: 5261286 - DNA, 14 bp, Homo sapiens
atctgtgagaagtt

SEQ ID NO: 5261287 - DNA, 23 bp, Homo sapiens
atctgtgagtgaaagttgccatt

SEQ ID NO: 5261288 - DNA, 13 bp, Homo sapiens
atctgtgattaaa

SEQ ID NO: 5261289 - DNA, 14 bp, Homo sapiens
atctgtgattggct

SEQ ID NO: 5261290 - DNA, 15 bp, Homo sapiens
atctgtgattggctg

SEQ ID NO: 5261291 - DNA, 16 bp, Homo sapiens
atctgtgatttcttct

SEQ ID NO: 5261292 - DNA, 17 bp, Homo sapiens
atctgtgatttcttctc

SEQ ID NO: 5261293 - DNA, 15 bp, Homo sapiens
atctgtgcaaacagt

SEQ ID NO: 5261294 - DNA, 14 bp, Homo sapiens
atctgtgcaataaa

SEQ ID NO: 5261295 - DNA, 15 bp, Homo sapiens
atctgtgcaataaaa

SEQ ID NO: 5261296 - DNA, 18 bp, Homo sapiens
atctgtgcaatggaatat

SEQ ID NO: 5261297 - DNA, 15 bp, Homo sapiens
atctgtgcacactaa

SEQ ID NO: 5261298 - DNA, 16 bp, Homo sapiens
atctgtgcacactaag

SEQ ID NO: 5261299 - DNA, 20 bp, Homo sapiens
atctgtgcacactaagaaat

SEQ ID NO: 5261300 - DNA, 17 bp, Homo sapiens
atctgtgcagggctggt

SEQ ID NO: 5261301 - DNA, 18 bp, Homo sapiens
atctgtgcagggtattaa

SEQ ID NO: 5261302 - DNA, 18 bp, Homo sapiens
atctgtgccatagaacaa

SEQ ID NO: 5261303 - DNA, 15 bp, Homo sapiens
atctgtgcctgggat

SEQ ID NO: 5261304 - DNA, 16 bp, Homo sapiens
atctgtgcctgggatc

SEQ ID NO: 5261305 - DNA, 20 bp, Homo sapiens
atctgtgcctgtctgtccaa

SEQ ID NO: 5261306 - DNA, 23 bp, Homo sapiens
atctgtgcgcgtggcgtggcccg

SEQ ID NO: 5261307 - DNA, 18 bp, Homo sapiens
atctgtgcgtgaaacaca

SEQ ID NO: 5261308 - DNA, 19 bp, Homo sapiens
atctgtgcgtgaaacacac

SEQ ID NO: 5261309 - DNA, 19 bp, Homo sapiens
atctgtgctcaggactcag

SEQ ID NO: 5261310 - DNA, 15 bp, Homo sapiens
atctgtgctggccat

SEQ ID NO: 5261311 - DNA, 16 bp, Homo sapiens
atctgtgctggccatg

SEQ ID NO: 5261312 - DNA, 21 bp, Homo sapiens
atctgtgctgtttcaaagttc

SEQ ID NO: 5261313 - DNA, 16 bp, Homo sapiens
atctgtgctttccagc

SEQ ID NO: 5261314 - DNA, 18 bp, Homo sapiens
atctgtgctttccagctc

SEQ ID NO: 5261315 - DNA, 19 bp, Homo sapiens
atctgtgctttccagctca

SEQ ID NO: 5261316 - DNA, 16 bp, Homo sapiens
atctgtggaaagctag

SEQ ID NO: 5261317 - DNA, 16 bp, Homo sapiens
atctgtggagaatgta

SEQ ID NO: 5261318 - DNA, 17 bp, Homo sapiens
atctgtggagctgccac

SEQ ID NO: 5261319 - DNA, 19 bp, Homo sapiens
atctgtggagctgccacag

SEQ ID NO: 5261320 - DNA, 18 bp, Homo sapiens
atctgtggagttcctgct

SEQ ID NO: 5261321 - DNA, 14 bp, Homo sapiens
atctgtggcctggg

SEQ ID NO: 5261322 - DNA, 22 bp, Homo sapiens
atctgtgtaacctccacagtag

SEQ ID NO: 5261323 - DNA, 16 bp, Homo sapiens
atctgtgtacaatttt

SEQ ID NO: 5261324 - DNA, 13 bp, Homo sapiens
atctgtgtcctgg

SEQ ID NO: 5261325 - DNA, 14 bp, Homo sapiens
atctgtgtctctgg

SEQ ID NO: 5261326 - DNA, 18 bp, Homo sapiens
atctgtgtgcatatttgt

SEQ ID NO: 5261327 - DNA, 14 bp, Homo sapiens
atctgtgtgcccta

SEQ ID NO: 5261328 - DNA, 20 bp, Homo sapiens
atctgtgtgccctagggctc

SEQ ID NO: 5261329 - DNA, 22 bp, Homo sapiens
atctgtgtgccctagggctcag

SEQ ID NO: 5261330 - DNA, 23 bp, Homo sapiens
atctgtgtgccctagggctcaga

SEQ ID NO: 5261331 - DNA, 19 bp, Homo sapiens
atctgtgtgtgtcccccta

SEQ ID NO: 5261332 - DNA, 19 bp, Homo sapiens
atctgtgtgtgtgtgcgtg

SEQ ID NO: 5261333 - DNA, 18 bp, Homo sapiens
atctgtgtttttgaaata

SEQ ID NO: 5261334 - DNA, 21 bp, Homo sapiens
atctgtgtttttgaaatatta

SEQ ID NO: 5261335 - DNA, 18 bp, Homo sapiens
atctgttaaccaaataaa

SEQ ID NO: 5261336 - DNA, 14 bp, Homo sapiens
atctgttactccaa

SEQ ID NO: 5261337 - DNA, 16 bp, Homo sapiens
atctgttactccaaaa

SEQ ID NO: 5261338 - DNA, 19 bp, Homo sapiens
atctgttagatgctactaa

SEQ ID NO: 5261339 - DNA, 23 bp, Homo sapiens
atctgttagatgctactaagaaa

SEQ ID NO: 5261340 - DNA, 14 bp, Homo sapiens
atctgttagcagag

SEQ ID NO: 5261341 - DNA, 17 bp, Homo sapiens
atctgttagcagagtct

SEQ ID NO: 5261342 - DNA, 20 bp, Homo sapiens
atctgttagcattattgcca

SEQ ID NO: 5261343 - DNA, 15 bp, Homo sapiens
atctgttagggcctt

SEQ ID NO: 5261344 - DNA, 17 bp, Homo sapiens
atctgttagggccttgg

SEQ ID NO: 5261345 - DNA, 19 bp, Homo sapiens
atctgttcaacctcagtat

SEQ ID NO: 5261346 - DNA, 18 bp, Homo sapiens
atctgttcccctgtcctg

SEQ ID NO: 5261347 - DNA, 19 bp, Homo sapiens
atctgttcccctgtcctgt

SEQ ID NO: 5261348 - DNA, 17 bp, Homo sapiens
atctgttcccttcctct

SEQ ID NO: 5261349 - DNA, 18 bp, Homo sapiens
atctgttcccttcctctg

SEQ ID NO: 5261350 - DNA, 22 bp, Homo sapiens
atctgttcccttcctctgtgcc

SEQ ID NO: 5261351 - DNA, 17 bp, Homo sapiens
atctgttctactcttaa

SEQ ID NO: 5261352 - DNA, 20 bp, Homo sapiens
atctgttctatgcttcctcg

SEQ ID NO: 5261353 - DNA, 17 bp, Homo sapiens
atctgttctatggacca

SEQ ID NO: 5261354 - DNA, 14 bp, Homo sapiens
atctgttgaaatgc

SEQ ID NO: 5261355 - DNA, 20 bp, Homo sapiens
atctgttgacaaatgacaga

SEQ ID NO: 5261356 - DNA, 21 bp, Homo sapiens
atctgttgagtacattgaaga

SEQ ID NO: 5261357 - DNA, 19 bp, Homo sapiens
atctgttgcaagcccctct

SEQ ID NO: 5261358 - DNA, 18 bp, Homo sapiens
atctgttgggaaccagag

SEQ ID NO: 5261359 - DNA, 19 bp, Homo sapiens
atctgttgtaatatcagtt

SEQ ID NO: 5261360 - DNA, 22 bp, Homo sapiens
atctgttgtaatatcagttaca

SEQ ID NO: 5261361 - DNA, 22 bp, Homo sapiens
atctgttgtgcatgctcaaatg

SEQ ID NO: 5261362 - DNA, 15 bp, Homo sapiens
atctgttgttccaaa

SEQ ID NO: 5261363 - DNA, 14 bp, Homo sapiens
atctgttgttctgt

SEQ ID NO: 5261364 - DNA, 14 bp, Homo sapiens
atctgttgtttgaa

SEQ ID NO: 5261365 - DNA, 17 bp, Homo sapiens
atctgtttaaagcatat

SEQ ID NO: 5261366 - DNA, 21 bp, Homo sapiens
atctgtttacactctttgcca

SEQ ID NO: 5261367 - DNA, 12 bp, Homo sapiens
atctgtttacag

SEQ ID NO: 5261368 - DNA, 13 bp, Homo sapiens
atctgtttattct

SEQ ID NO: 5261369 - DNA, 22 bp, Homo sapiens
atctgtttcaaactgaatttgt

SEQ ID NO: 5261370 - DNA, 22 bp, Homo sapiens
atctgtttcaggtttccattct

SEQ ID NO: 5261371 - DNA, 14 bp, Homo sapiens
atctgtttcctgtt

SEQ ID NO: 5261372 - DNA, 16 bp, Homo sapiens
atctgtttcctgttct

SEQ ID NO: 5261373 - DNA, 17 bp, Homo sapiens
atctgtttcctgttctc

SEQ ID NO: 5261374 - DNA, 12 bp, Homo sapiens
atctgtttctct

SEQ ID NO: 5261375 - DNA, 16 bp, Homo sapiens
atctgtttctctgctg

SEQ ID NO: 5261376 - DNA, 19 bp, Homo sapiens
atctgtttctctgctgtca

SEQ ID NO: 5261377 - DNA, 15 bp, Homo sapiens
atctgtttgagaaag

SEQ ID NO: 5261378 - DNA, 15 bp, Homo sapiens
atctgtttgcttcta

SEQ ID NO: 5261379 - DNA, 17 bp, Homo sapiens
atctgtttgcttctaaa

SEQ ID NO: 5261380 - DNA, 14 bp, Homo sapiens
atctgtttgttact

SEQ ID NO: 5261381 - DNA, 22 bp, Homo sapiens
atctgttttaaatttatttcaa

SEQ ID NO: 5261382 - DNA, 14 bp, Homo sapiens
atctgttttactgc

SEQ ID NO: 5261383 - DNA, 18 bp, Homo sapiens
atctgttttactgctttt

SEQ ID NO: 5261384 - DNA, 15 bp, Homo sapiens
atctgttttctggaa

SEQ ID NO: 5261385 - DNA, 17 bp, Homo sapiens
atctgttttctggaagt

SEQ ID NO: 5261386 - DNA, 18 bp, Homo sapiens
atctgttttgaaggcaaa

SEQ ID NO: 5261387 - DNA, 16 bp, Homo sapiens
atctgttttggatgtt

SEQ ID NO: 5261388 - DNA, 17 bp, Homo sapiens
atctgttttgtatatga

SEQ ID NO: 5261389 - DNA, 18 bp, Homo sapiens
atctgttttgtatatgat

SEQ ID NO: 5261390 - DNA, 20 bp, Homo sapiens
atctgttttgtatatgatct

SEQ ID NO: 5261391 - DNA, 22 bp, Homo sapiens
atctgttttgtatatgatctaa

SEQ ID NO: 5261392 - DNA, 19 bp, Homo sapiens
atctgtttttaaaaatcat

SEQ ID NO: 5261393 - DNA, 14 bp, Homo sapiens
atctgtttttctca

SEQ ID NO: 5261394 - DNA, 22 bp, Homo sapiens
atctgtttttgtttatttcatt

SEQ ID NO: 5261395 - DNA, 19 bp, Homo sapiens
atcttaaacaatgtataaa

SEQ ID NO: 5261396 - DNA, 16 bp, Homo sapiens
atcttaaacaatttgt

SEQ ID NO: 5261397 - DNA, 20 bp, Homo sapiens
atcttaaacataataaatca

SEQ ID NO: 5261398 - DNA, 12 bp, Homo sapiens
atcttaaactaa

SEQ ID NO: 5261399 - DNA, 18 bp, Homo sapiens
atcttaaagaaacagctt

SEQ ID NO: 5261400 - DNA, 20 bp, Homo sapiens
atcttaaagaaacagctttc

SEQ ID NO: 5261401 - DNA, 22 bp, Homo sapiens
atcttaaagaaacagctttcaa

SEQ ID NO: 5261402 - DNA, 17 bp, Homo sapiens
atcttaaagatcgtgta

SEQ ID NO: 5261403 - DNA, 13 bp, Homo sapiens
atcttaaaggaca

SEQ ID NO: 5261404 - DNA, 17 bp, Homo sapiens
atcttaaaggacataaa

SEQ ID NO: 5261405 - DNA, 22 bp, Homo sapiens
atcttaaaggacataaaattta

SEQ ID NO: 5261406 - DNA, 17 bp, Homo sapiens
atcttaaatatgaattc

SEQ ID NO: 5261407 - DNA, 15 bp, Homo sapiens
atcttaaatcagaat

SEQ ID NO: 5261408 - DNA, 20 bp, Homo sapiens
atcttaaatcagaataaatt

SEQ ID NO: 5261409 - DNA, 13 bp, Homo sapiens
atcttaaatctgt

SEQ ID NO: 5261410 - DNA, 16 bp, Homo sapiens
atcttaaatctgtgaa

SEQ ID NO: 5261411 - DNA, 15 bp, Homo sapiens
atcttaaatttctaa

SEQ ID NO: 5261412 - DNA, 13 bp, Homo sapiens
atcttaacactga

SEQ ID NO: 5261413 - DNA, 12 bp, Homo sapiens
atcttaactctt

SEQ ID NO: 5261414 - DNA, 22 bp, Homo sapiens
atggtggcttcttttctttgta

SEQ ID NO: 5261415 - DNA, 23 bp, Homo sapiens
atggtggcttcttttctttgtat

SEQ ID NO: 5261416 - DNA, 16 bp, Homo sapiens
atggtgggaaccctcc

SEQ ID NO: 5261417 - DNA, 17 bp, Homo sapiens
atggtgggaaccctccc

SEQ ID NO: 5261418 - DNA, 21 bp, Homo sapiens
atggtgggagagactgtgagg

SEQ ID NO: 5261419 - DNA, 19 bp, Homo sapiens
atggtgggctccagagtag

SEQ ID NO: 5261420 - DNA, 17 bp, Homo sapiens
atggtgggcttcagggc

SEQ ID NO: 5261421 - DNA, 18 bp, Homo sapiens
atggtggggcccccagca

SEQ ID NO: 5261422 - DNA, 20 bp, Homo sapiens
atggtggggcccccagcacc

SEQ ID NO: 5261423 - DNA, 22 bp, Homo sapiens
atggtggggcccccagcaccct

SEQ ID NO: 5261424 - DNA, 20 bp, Homo sapiens
atggtggggtaccagccact

SEQ ID NO: 5261425 - DNA, 16 bp, Homo sapiens
atggtggggtctcctc

SEQ ID NO: 5261426 - DNA, 16 bp, Homo sapiens
atggtggtcttctcca

SEQ ID NO: 5261427 - DNA, 16 bp, Homo sapiens
atggtggttattttaa

SEQ ID NO: 5261428 - DNA, 14 bp, Homo sapiens
atggtggtttcaga

SEQ ID NO: 5261429 - DNA, 19 bp, Homo sapiens
atggtggtttcagaaaggg

SEQ ID NO: 5261430 - DNA, 14 bp, Homo sapiens
atggtggtttgtca

SEQ ID NO: 5261431 - DNA, 12 bp, Homo sapiens
atggtgtaataa

SEQ ID NO: 5261432 - DNA, 12 bp, Homo sapiens
atggtgtaatgc

SEQ ID NO: 5261433 - DNA, 17 bp, Homo sapiens
atggtgtaatgcacaat

SEQ ID NO: 5261434 - DNA, 22 bp, Homo sapiens
atggtgtaatgcacaatttaga

SEQ ID NO: 5261435 - DNA, 18 bp, Homo sapiens
atggtgtacataatgtat

SEQ ID NO: 5261436 - DNA, 18 bp, Homo sapiens
atggtgtagaacactaat

SEQ ID NO: 5261437 - DNA, 21 bp, Homo sapiens
atggtgtcataactagagcac

SEQ ID NO: 5261438 - DNA, 22 bp, Homo sapiens
atggtgtcataactagagcacg

SEQ ID NO: 5261439 - DNA, 18 bp, Homo sapiens
atggtgtcattctgcctg

SEQ ID NO: 5261440 - DNA, 12 bp, Homo sapiens
atggtgtcccgg

SEQ ID NO: 5261441 - DNA, 21 bp, Homo sapiens
atggtgtcccggtaccttcca

SEQ ID NO: 5261442 - DNA, 14 bp, Homo sapiens
atggtgtcctgagg

SEQ ID NO: 5261443 - DNA, 20 bp, Homo sapiens
atggtgtcctgaggcctcca

SEQ ID NO: 5261444 - DNA, 16 bp, Homo sapiens
atggtgtcctgcatgt

SEQ ID NO: 5261445 - DNA, 18 bp, Homo sapiens
atggtgtcctgcatgtat

SEQ ID NO: 5261446 - DNA, 15 bp, Homo sapiens
atggtgtccttccct

SEQ ID NO: 5261447 - DNA, 14 bp, Homo sapiens
atggtgtctttcaa

SEQ ID NO: 5261448 - DNA, 17 bp, Homo sapiens
atggtgtgccttccaga

SEQ ID NO: 5261449 - DNA, 13 bp, Homo sapiens
atggtgtggccat

SEQ ID NO: 5261450 - DNA, 14 bp, Homo sapiens
atggtgtggccatc

SEQ ID NO: 5261451 - DNA, 18 bp, Homo sapiens
atggtgtgggtgtcctgc

SEQ ID NO: 5261452 - DNA, 16 bp, Homo sapiens
atggtgtgtgtctctg

SEQ ID NO: 5261453 - DNA, 12 bp, Homo sapiens
atggtgtgttca

SEQ ID NO: 5261454 - DNA, 15 bp, Homo sapiens
atggtgtgttctgca

SEQ ID NO: 5261455 - DNA, 16 bp, Homo sapiens
atggtgtgtttcccta

SEQ ID NO: 5261456 - DNA, 18 bp, Homo sapiens
atggtgttaaagctgtac

SEQ ID NO: 5261457 - DNA, 13 bp, Homo sapiens
atggtgttccatt

SEQ ID NO: 5261458 - DNA, 15 bp, Homo sapiens
atggtgttctcctgc

SEQ ID NO: 5261459 - DNA, 16 bp, Homo sapiens
atggtgttggaggggc

SEQ ID NO: 5261460 - DNA, 21 bp, Homo sapiens
atggtgttggaggggcaggcc

SEQ ID NO: 5261461 - DNA, 17 bp, Homo sapiens
atggtgttttcattccc

SEQ ID NO: 5261462 - DNA, 14 bp, Homo sapiens
atggttaaaaaggc

SEQ ID NO: 5261463 - DNA, 16 bp, Homo sapiens
atggttaataaaactg

SEQ ID NO: 5261464 - DNA, 19 bp, Homo sapiens
atggttaataaaactgcac

SEQ ID NO: 5261465 - DNA, 21 bp, Homo sapiens
atggttaataaaactgcacag

SEQ ID NO: 5261466 - DNA, 17 bp, Homo sapiens
atggttaatactattaa

SEQ ID NO: 5261467 - DNA, 23 bp, Homo sapiens
atggttaatttttcctgcatgtt

SEQ ID NO: 5261468 - DNA, 15 bp, Homo sapiens
atggttacactgtta

SEQ ID NO: 5261469 - DNA, 23 bp, Homo sapiens
atggttacactgttagaacacta

SEQ ID NO: 5261470 - DNA, 17 bp, Homo sapiens
atggttaccatgtcttt

SEQ ID NO: 5261471 - DNA, 21 bp, Homo sapiens
atggttacctctgcataaata

SEQ ID NO: 5261472 - DNA, 13 bp, Homo sapiens
atggttagctgtc

SEQ ID NO: 5261473 - DNA, 12 bp, Homo sapiens
atggttagtgtg

SEQ ID NO: 5261474 - DNA, 14 bp, Homo sapiens
atggttataaaagt

SEQ ID NO: 5261475 - DNA, 14 bp, Homo sapiens
atggttatgaaaga

SEQ ID NO: 5261476 - DNA, 14 bp, Homo sapiens
atggttcaaagata

SEQ ID NO: 5261477 - DNA, 17 bp, Homo sapiens
atggttcaaagatacaa

SEQ ID NO: 5261478 - DNA, 16 bp, Homo sapiens
atggttcaagattgtt

SEQ ID NO: 5261479 - DNA, 20 bp, Homo sapiens
atggttccatgcctgagggt

SEQ ID NO: 5261480 - DNA, 16 bp, Homo sapiens
atggttcccaataaaa

SEQ ID NO: 5261481 - DNA, 18 bp, Homo sapiens
atggttcccaataaaagt

SEQ ID NO: 5261482 - DNA, 14 bp, Homo sapiens
atggttccccagga

SEQ ID NO: 5261483 - DNA, 20 bp, Homo sapiens
atggttcccctgttcactct

SEQ ID NO: 5261484 - DNA, 21 bp, Homo sapiens
atggttcccttgatgaagaag

SEQ ID NO: 5261485 - DNA, 20 bp, Homo sapiens
atggttccgacttgtccctc

SEQ ID NO: 5261486 - DNA, 22 bp, Homo sapiens
atggttccgctaatctcttcta

SEQ ID NO: 5261487 - DNA, 19 bp, Homo sapiens
atggttccttccctgggaa

SEQ ID NO: 5261488 - DNA, 15 bp, Homo sapiens
atggttctagaagga

SEQ ID NO: 5261489 - DNA, 12 bp, Homo sapiens
atggttctcaat

SEQ ID NO: 5261490 - DNA, 16 bp, Homo sapiens
atggttctcaggcctg

SEQ ID NO: 5261491 - DNA, 13 bp, Homo sapiens
atggttctgcctc

SEQ ID NO: 5261492 - DNA, 13 bp, Homo sapiens
atggttctgtgcc

SEQ ID NO: 5261493 - DNA, 15 bp, Homo sapiens
atggttgaatgaata

SEQ ID NO: 5261494 - DNA, 19 bp, Homo sapiens
atggttgagaaatgaataa

SEQ ID NO: 5261495 - DNA, 14 bp, Homo sapiens
atggttgatggaaa

SEQ ID NO: 5261496 - DNA, 19 bp, Homo sapiens
atggttgatggaaaataaa

SEQ ID NO: 5261497 - DNA, 13 bp, Homo sapiens
atggttgcagata

SEQ ID NO: 5261498 - DNA, 14 bp, Homo sapiens
atggttgccacccc

SEQ ID NO: 5261499 - DNA, 15 bp, Homo sapiens
atggttgccacccca

SEQ ID NO: 5261500 - DNA, 23 bp, Homo sapiens
atggttgccaccccaacccaata

SEQ ID NO: 5261501 - DNA, 17 bp, Homo sapiens
atggttgccaggacgaa

SEQ ID NO: 5261502 - DNA, 23 bp, Homo sapiens
atggttgccaggacgaattgaga

SEQ ID NO: 5261503 - DNA, 15 bp, Homo sapiens
atggttgccttaaag

SEQ ID NO: 5261504 - DNA, 17 bp, Homo sapiens
atggttgccttaaagaa

SEQ ID NO: 5261505 - DNA, 16 bp, Homo sapiens
atggttggagagccct

SEQ ID NO: 5261506 - DNA, 17 bp, Homo sapiens
atggttggagagccctg

SEQ ID NO: 5261507 - DNA, 19 bp, Homo sapiens
atggttggagagccctgga

SEQ ID NO: 5261508 - DNA, 22 bp, Homo sapiens
atggttgggacaatggcaatag

SEQ ID NO: 5261509 - DNA, 13 bp, Homo sapiens
atggttgggacca

SEQ ID NO: 5261510 - DNA, 23 bp, Homo sapiens
atggttgggaccaggccaatccc

SEQ ID NO: 5261511 - DNA, 23 bp, Homo sapiens
atggttggttagtgcatgtcaca

SEQ ID NO: 5261512 - DNA, 21 bp, Homo sapiens
atggttggttttatttgtcag

SEQ ID NO: 5261513 - DNA, 22 bp, Homo sapiens
atggttgtaacatatgtattcc

SEQ ID NO: 5261514 - DNA, 13 bp, Homo sapiens
atggttgtacata

SEQ ID NO: 5261515 - DNA, 12 bp, Homo sapiens
atggttgtagca

SEQ ID NO: 5261516 - DNA, 15 bp, Homo sapiens
atggttgtatacaca

SEQ ID NO: 5261517 - DNA, 21 bp, Homo sapiens
atggttgtattagatgttctc

SEQ ID NO: 5261518 - DNA, 22 bp, Homo sapiens
atggttgtcacctctctctgag

SEQ ID NO: 5261519 - DNA, 20 bp, Homo sapiens
atggttgtgaaatgtaacat

SEQ ID NO: 5261520 - DNA, 23 bp, Homo sapiens
atggtttacatgaacacagctgc

SEQ ID NO: 5261521 - DNA, 12 bp, Homo sapiens
atggtttactgc

SEQ ID NO: 5261522 - DNA, 14 bp, Homo sapiens
atggtttactgctg

SEQ ID NO: 5261523 - DNA, 17 bp, Homo sapiens
atggtttactgctgtca

SEQ ID NO: 5261524 - DNA, 19 bp, Homo sapiens
atggtttactgctgtcatt

SEQ ID NO: 5261525 - DNA, 22 bp, Homo sapiens
atggtttaggccttgccagttt

SEQ ID NO: 5261526 - DNA, 19 bp, Homo sapiens
atggtttatgcatgtatat

SEQ ID NO: 5261527 - DNA, 22 bp, Homo sapiens
atggtttattcccaagtatgcc

SEQ ID NO: 5261528 - DNA, 13 bp, Homo sapiens
atggtttcaaaga

SEQ ID NO: 5261529 - DNA, 13 bp, Homo sapiens
atggtttcagcac

SEQ ID NO: 5261530 - DNA, 22 bp, Homo sapiens
atggtttcagcactagccaaac

SEQ ID NO: 5261531 - DNA, 22 bp, Homo sapiens
atggtttcctccatttgagaaa

SEQ ID NO: 5261532 - DNA, 13 bp, Homo sapiens
atggtttcctctg

SEQ ID NO: 5261533 - DNA, 15 bp, Homo sapiens
atggtttcctctgga

SEQ ID NO: 5261534 - DNA, 15 bp, Homo sapiens
atggtttctgaaaat

SEQ ID NO: 5261535 - DNA, 20 bp, Homo sapiens
atggtttctgaaaatgttta

SEQ ID NO: 5261536 - DNA, 18 bp, Homo sapiens
atggtttctgtctgaatt

SEQ ID NO: 5261537 - DNA, 14 bp, Homo sapiens
atggtttgaaattt

SEQ ID NO: 5261538 - DNA, 15 bp, Homo sapiens
atggtttgatatgta

SEQ ID NO: 5261539 - DNA, 16 bp, Homo sapiens
atggtttgcaaggaag

SEQ ID NO: 5261540 - DNA, 20 bp, Homo sapiens
atggtttggaaaataacttt

SEQ ID NO: 5261541 - DNA, 12 bp, Homo sapiens
atggtttggttt

SEQ ID NO: 5261542 - DNA, 15 bp, Homo sapiens
atggttttaaacttt

SEQ ID NO: 5261543 - DNA, 13 bp, Homo sapiens
atggttttaagaa

SEQ ID NO: 5261544 - DNA, 15 bp, Homo sapiens
atggttttcaaaata

SEQ ID NO: 5261545 - DNA, 20 bp, Homo sapiens
atggttttctccaagagcta

SEQ ID NO: 5261546 - DNA, 21 bp, Homo sapiens
atggttttctccaagagctac

SEQ ID NO: 5261547 - DNA, 13 bp, Homo sapiens
atggttttggctc

SEQ ID NO: 5261548 - DNA, 19 bp, Homo sapiens
atggttttggctctcccac

SEQ ID NO: 5261549 - DNA, 21 bp, Homo sapiens
atggttttggctctcccaccc

SEQ ID NO: 5261550 - DNA, 19 bp, Homo sapiens
atggttttgtgccatctgt

SEQ ID NO: 5261551 - DNA, 18 bp, Homo sapiens
atggttttgttttcaatg

SEQ ID NO: 5261552 - DNA, 16 bp, Homo sapiens
atggtttttaaatttt

SEQ ID NO: 5261553 - DNA, 21 bp, Homo sapiens
atggtttttataatattcata

SEQ ID NO: 5261554 - DNA, 20 bp, Homo sapiens
atggtttttatttctcgggt

SEQ ID NO: 5261555 - DNA, 17 bp, Homo sapiens
atggtttttgagatatt

SEQ ID NO: 5261556 - DNA, 11 bp, Homo sapiens
atgtaaaaaac

SEQ ID NO: 5261557 - DNA, 13 bp, Homo sapiens
atgtaaaaaagaa

SEQ ID NO: 5261558 - DNA, 16 bp, Homo sapiens
atgtaaaaaatattaa

SEQ ID NO: 5261559 - DNA, 16 bp, Homo sapiens
atgtaaaaaatgtaaa

SEQ ID NO: 5261560 - DNA, 18 bp, Homo sapiens
atgtaaaaaccctgctaa

SEQ ID NO: 5261561 - DNA, 18 bp, Homo sapiens
atgtaaaaagacaaaaac

SEQ ID NO: 5261562 - DNA, 14 bp, Homo sapiens
atgtaaaaataacc

SEQ ID NO: 5261563 - DNA, 14 bp, Homo sapiens
atgtaaaaatatgt

SEQ ID NO: 5261564 - DNA, 13 bp, Homo sapiens
atgtaaaacagaa

SEQ ID NO: 5261565 - DNA, 15 bp, Homo sapiens
atgtaaaacagaata

SEQ ID NO: 5261566 - DNA, 20 bp, Homo sapiens
atgtaaaacatttattttga

SEQ ID NO: 5261567 - DNA, 21 bp, Homo sapiens
atgtaaaacatttattttgac

SEQ ID NO: 5261568 - DNA, 20 bp, Homo sapiens
atgtaaaaccctttaaatgt

SEQ ID NO: 5261569 - DNA, 19 bp, Homo sapiens
atgtaaaactccattcata

SEQ ID NO: 5261570 - DNA, 16 bp, Homo sapiens
atgtaaaactcgcttt

SEQ ID NO: 5261571 - DNA, 14 bp, Homo sapiens
atgtaaaagaaaat

SEQ ID NO: 5261572 - DNA, 19 bp, Homo sapiens
atgtaaaagaacttactga

SEQ ID NO: 5261573 - DNA, 22 bp, Homo sapiens
atgtaaaagaacttactgatta

SEQ ID NO: 5261574 - DNA, 13 bp, Homo sapiens
atgtaaaagccta

SEQ ID NO: 5261575 - DNA, 15 bp, Homo sapiens
atgtaaaataagtat

SEQ ID NO: 5261576 - DNA, 14 bp, Homo sapiens
atgtaaaatattgt

SEQ ID NO: 5261577 - DNA, 16 bp, Homo sapiens
atgtaaaatcaataaa

SEQ ID NO: 5261578 - DNA, 17 bp, Homo sapiens
atgtaaaatcctacagt

SEQ ID NO: 5261579 - DNA, 19 bp, Homo sapiens
atgtaaaatcctacagtga

SEQ ID NO: 5261580 - DNA, 20 bp, Homo sapiens
atgtaaaatcctacagtgaa

SEQ ID NO: 5261581 - DNA, 21 bp, Homo sapiens
atgtaaaatcctacagtgaaa

SEQ ID NO: 5261582 - DNA, 16 bp, Homo sapiens
atgtaaaatcttcagc

SEQ ID NO: 5261583 - DNA, 17 bp, Homo sapiens
atgtaaaatcttcagct

SEQ ID NO: 5261584 - DNA, 19 bp, Homo sapiens
atgtaaaatcttcagctgg

SEQ ID NO: 5261585 - DNA, 16 bp, Homo sapiens
atgtaaaatcttgata

SEQ ID NO: 5261586 - DNA, 19 bp, Homo sapiens
atgtaaaatcttgatagct

SEQ ID NO: 5261587 - DNA, 14 bp, Homo sapiens
atgtaaaatcttgt

SEQ ID NO: 5261588 - DNA, 20 bp, Homo sapiens
atgtaaaatcttgtcatgtg

SEQ ID NO: 5261589 - DNA, 16 bp, Homo sapiens
atgtaaaatgaattga

SEQ ID NO: 5261590 - DNA, 18 bp, Homo sapiens
atgtaaaatgcagtccag

SEQ ID NO: 5261591 - DNA, 23 bp, Homo sapiens
atgtaaaatgcagtccagaataa

SEQ ID NO: 5261592 - DNA, 19 bp, Homo sapiens
atgtaaaatggagaccaat

SEQ ID NO: 5261593 - DNA, 14 bp, Homo sapiens
atcttaactctttg

SEQ ID NO: 5261594 - DNA, 23 bp, Homo sapiens
atcttaactctttgcctttgcca

SEQ ID NO: 5261595 - DNA, 18 bp, Homo sapiens
atcttaagagcttgatct

SEQ ID NO: 5261596 - DNA, 23 bp, Homo sapiens
atcttaagaggatggatgaatct

SEQ ID NO: 5261597 - DNA, 21 bp, Homo sapiens
atcttaagagtgctaaatttt

SEQ ID NO: 5261598 - DNA, 17 bp, Homo sapiens
atcttaagataatattt

SEQ ID NO: 5261599 - DNA, 19 bp, Homo sapiens
atcttaagataatatttaa

SEQ ID NO: 5261600 - DNA, 22 bp, Homo sapiens
atcttaagataatatttaaaat

SEQ ID NO: 5261601 - DNA, 23 bp, Homo sapiens
atcttaagattccattttggaaa

SEQ ID NO: 5261602 - DNA, 19 bp, Homo sapiens
atcttaagcagtaatctgt

SEQ ID NO: 5261603 - DNA, 21 bp, Homo sapiens
atcttaagcatgtcaattcat

SEQ ID NO: 5261604 - DNA, 14 bp, Homo sapiens
atcttaaggtctaa

SEQ ID NO: 5261605 - DNA, 21 bp, Homo sapiens
atcttaagttctatgaagagt

SEQ ID NO: 5261606 - DNA, 15 bp, Homo sapiens
atcttaatactgtta

SEQ ID NO: 5261607 - DNA, 18 bp, Homo sapiens
atcttaatactgttattc

SEQ ID NO: 5261608 - DNA, 21 bp, Homo sapiens
atcttaatactgttattcttt

SEQ ID NO: 5261609 - DNA, 15 bp, Homo sapiens
atcttaatacttgaa

SEQ ID NO: 5261610 - DNA, 13 bp, Homo sapiens
atcttaatataaa

SEQ ID NO: 5261611 - DNA, 14 bp, Homo sapiens
atcttaatataaat

SEQ ID NO: 5261612 - DNA, 13 bp, Homo sapiens
atcttaatatata

SEQ ID NO: 5261613 - DNA, 18 bp, Homo sapiens
atcttaatatatacattt

SEQ ID NO: 5261614 - DNA, 19 bp, Homo sapiens
atcttaatcgatgaatgta

SEQ ID NO: 5261615 - DNA, 20 bp, Homo sapiens
atcttaatcgatgaatgtaa

SEQ ID NO: 5261616 - DNA, 14 bp, Homo sapiens
atcttaatctttat

SEQ ID NO: 5261617 - DNA, 20 bp, Homo sapiens
atcttaatgtatcaaactgt

SEQ ID NO: 5261618 - DNA, 12 bp, Homo sapiens
atcttaatgttc

SEQ ID NO: 5261619 - DNA, 14 bp, Homo sapiens
atcttaatgttcct

SEQ ID NO: 5261620 - DNA, 19 bp, Homo sapiens
atcttaattctttgttctg

SEQ ID NO: 5261621 - DNA, 22 bp, Homo sapiens
atcttaattctttgttctgttt

SEQ ID NO: 5261622 - DNA, 13 bp, Homo sapiens
atcttaattgcaa

SEQ ID NO: 5261623 - DNA, 12 bp, Homo sapiens
atcttaattttg

SEQ ID NO: 5261624 - DNA, 13 bp, Homo sapiens
atcttacaaaatc

SEQ ID NO: 5261625 - DNA, 14 bp, Homo sapiens
atcttacaaaatcc

SEQ ID NO: 5261626 - DNA, 21 bp, Homo sapiens
atcttacaaaatcctggaaga

SEQ ID NO: 5261627 - DNA, 14 bp, Homo sapiens
atcttacaaagtgt

SEQ ID NO: 5261628 - DNA, 14 bp, Homo sapiens
atcttacaagttta

SEQ ID NO: 5261629 - DNA, 15 bp, Homo sapiens
atcttacaatattga

SEQ ID NO: 5261630 - DNA, 17 bp, Homo sapiens
atcttacaatattgatt

SEQ ID NO: 5261631 - DNA, 15 bp, Homo sapiens
atcttacacgaagaa

SEQ ID NO: 5261632 - DNA, 20 bp, Homo sapiens
atcttacacgaagaaataga

SEQ ID NO: 5261633 - DNA, 15 bp, Homo sapiens
atcttacagaaaata

SEQ ID NO: 5261634 - DNA, 19 bp, Homo sapiens
atcttacagccagaggaac

SEQ ID NO: 5261635 - DNA, 13 bp, Homo sapiens
atcttacagctgg

SEQ ID NO: 5261636 - DNA, 15 bp, Homo sapiens
atcttacatctgcag

SEQ ID NO: 5261637 - DNA, 23 bp, Homo sapiens
atcttacccttcaatgttaaatc

SEQ ID NO: 5261638 - DNA, 16 bp, Homo sapiens
atcttacctgtaaagt

SEQ ID NO: 5261639 - DNA, 14 bp, Homo sapiens
atcttactctactg

SEQ ID NO: 5261640 - DNA, 15 bp, Homo sapiens
atcttactgaaggta

SEQ ID NO: 5261641 - DNA, 19 bp, Homo sapiens
atcttacttgcaaaatgga

SEQ ID NO: 5261642 - DNA, 20 bp, Homo sapiens
atcttacttgcaaaatggag

SEQ ID NO: 5261643 - DNA, 14 bp, Homo sapiens
atcttactttgtaa

SEQ ID NO: 5261644 - DNA, 20 bp, Homo sapiens
atcttactttgtaaattctg

SEQ ID NO: 5261645 - DNA, 21 bp, Homo sapiens
atcttactttgtaaattctga

SEQ ID NO: 5261646 - DNA, 18 bp, Homo sapiens
atcttagaacagatggct

SEQ ID NO: 5261647 - DNA, 21 bp, Homo sapiens
atcttagagacaaaccttaaa

SEQ ID NO: 5261648 - DNA, 15 bp, Homo sapiens
atcttagagtttaca

SEQ ID NO: 5261649 - DNA, 16 bp, Homo sapiens
atcttagagtttacag

SEQ ID NO: 5261650 - DNA, 17 bp, Homo sapiens
atcttagagtttacagt

SEQ ID NO: 5261651 - DNA, 18 bp, Homo sapiens
atcttagataacttcttg

SEQ ID NO: 5261652 - DNA, 18 bp, Homo sapiens
atcttagatgtttcacac

SEQ ID NO: 5261653 - DNA, 22 bp, Homo sapiens
atcttagattctctgtgtctaa

SEQ ID NO: 5261654 - DNA, 23 bp, Homo sapiens
atcttagattctctgtgtctaag

SEQ ID NO: 5261655 - DNA, 16 bp, Homo sapiens
atcttagctgccaagt

SEQ ID NO: 5261656 - DNA, 14 bp, Homo sapiens
atcttagcttttaa

SEQ ID NO: 5261657 - DNA, 16 bp, Homo sapiens
atcttaggatttacca

SEQ ID NO: 5261658 - DNA, 18 bp, Homo sapiens
atcttaggcactttttaa

SEQ ID NO: 5261659 - DNA, 21 bp, Homo sapiens
atcttaggtagtcatgctgtg

SEQ ID NO: 5261660 - DNA, 16 bp, Homo sapiens
atcttagtatttgcat

SEQ ID NO: 5261661 - DNA, 13 bp, Homo sapiens
atcttagtgtatg

SEQ ID NO: 5261662 - DNA, 13 bp, Homo sapiens
atcttagtgttca

SEQ ID NO: 5261663 - DNA, 14 bp, Homo sapiens
atcttagtttggat

SEQ ID NO: 5261664 - DNA, 24 bp, Homo sapiens
atcttataaagtggaagtatgtat

SEQ ID NO: 5261665 - DNA, 16 bp, Homo sapiens
atcttataactgtttt

SEQ ID NO: 5261666 - DNA, 16 bp, Homo sapiens
atcttataattgttct

SEQ ID NO: 5261667 - DNA, 16 bp, Homo sapiens
atcttatactgtacaa

SEQ ID NO: 5261668 - DNA, 19 bp, Homo sapiens
atcttatactgtacaataa

SEQ ID NO: 5261669 - DNA, 18 bp, Homo sapiens
atcttatagcactttgaa

SEQ ID NO: 5261670 - DNA, 15 bp, Homo sapiens
atcttatagttctag

SEQ ID NO: 5261671 - DNA, 20 bp, Homo sapiens
atcttatcatggtctcagtc

SEQ ID NO: 5261672 - DNA, 13 bp, Homo sapiens
atcttatctactg

SEQ ID NO: 5261673 - DNA, 14 bp, Homo sapiens
atcttatctactga

SEQ ID NO: 5261674 - DNA, 23 bp, Homo sapiens
atcttatctactgactgaaatca

SEQ ID NO: 5261675 - DNA, 14 bp, Homo sapiens
atcttatctcagat

SEQ ID NO: 5261676 - DNA, 18 bp, Homo sapiens
atcttatctcagatattt

SEQ ID NO: 5261677 - DNA, 13 bp, Homo sapiens
atcttatcttttg

SEQ ID NO: 5261678 - DNA, 20 bp, Homo sapiens
atcttatgaaaaccaaattt

SEQ ID NO: 5261679 - DNA, 23 bp, Homo sapiens
atcttatgagtataatgaacact

SEQ ID NO: 5261680 - DNA, 18 bp, Homo sapiens
atcttatggtggaagagg

SEQ ID NO: 5261681 - DNA, 13 bp, Homo sapiens
atcttatgttgat

SEQ ID NO: 5261682 - DNA, 18 bp, Homo sapiens
atcttattaaagtttcaa

SEQ ID NO: 5261683 - DNA, 19 bp, Homo sapiens
atcttattaaagtttcaaa

SEQ ID NO: 5261684 - DNA, 23 bp, Homo sapiens
atcttattaaagtttcaaaaatc

SEQ ID NO: 5261685 - DNA, 13 bp, Homo sapiens
atcttattcacat

SEQ ID NO: 5261686 - DNA, 13 bp, Homo sapiens
atcttattcattt

SEQ ID NO: 5261687 - DNA, 18 bp, Homo sapiens
atcttattcattttctct

SEQ ID NO: 5261688 - DNA, 20 bp, Homo sapiens
atcttattcccaattaaaag

SEQ ID NO: 5261689 - DNA, 19 bp, Homo sapiens
atcttattccgagcattcc

SEQ ID NO: 5261690 - DNA, 23 bp, Homo sapiens
atcttattccgagcattccagta

SEQ ID NO: 5261691 - DNA, 12 bp, Homo sapiens
atcttattgctt

SEQ ID NO: 5261692 - DNA, 16 bp, Homo sapiens
atcttattgtttaatc

SEQ ID NO: 5261693 - DNA, 14 bp, Homo sapiens
atcttatttatata

SEQ ID NO: 5261694 - DNA, 16 bp, Homo sapiens
atcttattttcatgta

SEQ ID NO: 5261695 - DNA, 21 bp, Homo sapiens
atcttattttctcaatctcct

SEQ ID NO: 5261696 - DNA, 17 bp, Homo sapiens
atcttattttgtgaact

SEQ ID NO: 5261697 - DNA, 14 bp, Homo sapiens
atcttatttttcct

SEQ ID NO: 5261698 - DNA, 16 bp, Homo sapiens
atcttatttttcctgt

SEQ ID NO: 5261699 - DNA, 19 bp, Homo sapiens
atcttatttttctaaacgt

SEQ ID NO: 5261700 - DNA, 16 bp, Homo sapiens
atcttcaaactttcac

SEQ ID NO: 5261701 - DNA, 19 bp, Homo sapiens
atcttcaaactttcacttt

SEQ ID NO: 5261702 - DNA, 18 bp, Homo sapiens
atcttcaaagccttctcc

SEQ ID NO: 5261703 - DNA, 13 bp, Homo sapiens
atcttcaacaaat

SEQ ID NO: 5261704 - DNA, 12 bp, Homo sapiens
atcttcaaggtg

SEQ ID NO: 5261705 - DNA, 15 bp, Homo sapiens
atcttcaaggtgtaa

SEQ ID NO: 5261706 - DNA, 15 bp, Homo sapiens
atcttcaatggcttt

SEQ ID NO: 5261707 - DNA, 14 bp, Homo sapiens
atcttcaatttgga

SEQ ID NO: 5261708 - DNA, 11 bp, Homo sapiens
atcttcacaag

SEQ ID NO: 5261709 - DNA, 18 bp, Homo sapiens
atcttcaccctcatcctt

SEQ ID NO: 5261710 - DNA, 21 bp, Homo sapiens
atcttcaccctgtaatggttg

SEQ ID NO: 5261711 - DNA, 13 bp, Homo sapiens
atcttcacctcag

SEQ ID NO: 5261712 - DNA, 16 bp, Homo sapiens
atcttcacctcagagt

SEQ ID NO: 5261713 - DNA, 17 bp, Homo sapiens
atcttcacgcctgggtg

SEQ ID NO: 5261714 - DNA, 17 bp, Homo sapiens
atcttcactgccaagca

SEQ ID NO: 5261715 - DNA, 21 bp, Homo sapiens
atcttcactgtatatgtaaat

SEQ ID NO: 5261716 - DNA, 22 bp, Homo sapiens
atcttcactgtcttactcaaga

SEQ ID NO: 5261717 - DNA, 13 bp, Homo sapiens
atcttcacttcta

SEQ ID NO: 5261718 - DNA, 15 bp, Homo sapiens
atcttcactttctta

SEQ ID NO: 5261719 - DNA, 16 bp, Homo sapiens
atcttcagaaggctag

SEQ ID NO: 5261720 - DNA, 18 bp, Homo sapiens
atcttcagaggtgctaaa

SEQ ID NO: 5261721 - DNA, 23 bp, Homo sapiens
atcttcagatttaagttaaataa

SEQ ID NO: 5261722 - DNA, 19 bp, Homo sapiens
atcttcagcatagaaggaa

SEQ ID NO: 5261723 - DNA, 14 bp, Homo sapiens
atcttcagcccagg

SEQ ID NO: 5261724 - DNA, 23 bp, Homo sapiens
atcttcagcccaggcttttgcta

SEQ ID NO: 5261725 - DNA, 13 bp, Homo sapiens
atcttcagctccc

SEQ ID NO: 5261726 - DNA, 21 bp, Homo sapiens
atcttcagctgaacacaagca

SEQ ID NO: 5261727 - DNA, 20 bp, Homo sapiens
atcttcagctggtggatggt

SEQ ID NO: 5261728 - DNA, 13 bp, Homo sapiens
atcttcagcttct

SEQ ID NO: 5261729 - DNA, 15 bp, Homo sapiens
atcttcagcttcttc

SEQ ID NO: 5261730 - DNA, 15 bp, Homo sapiens
atcttcagtttaatg

SEQ ID NO: 5261731 - DNA, 15 bp, Homo sapiens
atcttcagtttctga

SEQ ID NO: 5261732 - DNA, 12 bp, Homo sapiens
atcttcatataa

SEQ ID NO: 5261733 - DNA, 14 bp, Homo sapiens
atcttcatataaac

SEQ ID NO: 5261734 - DNA, 18 bp, Homo sapiens
atcttcatcccaacagcc

SEQ ID NO: 5261735 - DNA, 23 bp, Homo sapiens
atcttcatctgagagaggctaaa

SEQ ID NO: 5261736 - DNA, 14 bp, Homo sapiens
atcttccaaatatt

SEQ ID NO: 5261737 - DNA, 13 bp, Homo sapiens
atcttccacctgt

SEQ ID NO: 5261738 - DNA, 15 bp, Homo sapiens
atcttccactggaac

SEQ ID NO: 5261739 - DNA, 20 bp, Homo sapiens
atcttccagaagctgtactt

SEQ ID NO: 5261740 - DNA, 18 bp, Homo sapiens
atcttccagaagtgtgat

SEQ ID NO: 5261741 - DNA, 22 bp, Homo sapiens
atcttccatatccgggtgctca

SEQ ID NO: 5261742 - DNA, 17 bp, Homo sapiens
atcttccatatgctctt

SEQ ID NO: 5261743 - DNA, 18 bp, Homo sapiens
atcttccatatttggaag

SEQ ID NO: 5261744 - DNA, 14 bp, Homo sapiens
atcttcccacagga

SEQ ID NO: 5261745 - DNA, 13 bp, Homo sapiens
atcttcccacgtg

SEQ ID NO: 5261746 - DNA, 18 bp, Homo sapiens
atcttcccataataaagc

SEQ ID NO: 5261747 - DNA, 20 bp, Homo sapiens
atcttcccataataaagcaa

SEQ ID NO: 5261748 - DNA, 17 bp, Homo sapiens
atcttccccaagggcca

SEQ ID NO: 5261749 - DNA, 21 bp, Homo sapiens
atcttccccagccctccccac

SEQ ID NO: 5261750 - DNA, 17 bp, Homo sapiens
atcttcccgcctcagcc

SEQ ID NO: 5261751 - DNA, 20 bp, Homo sapiens
atcttccctacccttcctgc

SEQ ID NO: 5261752 - DNA, 15 bp, Homo sapiens
atcttccctgcccct

SEQ ID NO: 5261753 - DNA, 19 bp, Homo sapiens
atcttccctgcccctgtgc

SEQ ID NO: 5261754 - DNA, 23 bp, Homo sapiens
atcttcctaataaggtgtggtct

SEQ ID NO: 5261755 - DNA, 15 bp, Homo sapiens
atcttcctctgctaa

SEQ ID NO: 5261756 - DNA, 18 bp, Homo sapiens
atcttcctctgctaaatt

SEQ ID NO: 5261757 - DNA, 20 bp, Homo sapiens
atcttcctctgctaaattga

SEQ ID NO: 5261758 - DNA, 13 bp, Homo sapiens
atcttcctctgga

SEQ ID NO: 5261759 - DNA, 15 bp, Homo sapiens
atcttcctggcacaa

SEQ ID NO: 5261760 - DNA, 18 bp, Homo sapiens
atcttcctggtcgaaagt

SEQ ID NO: 5261761 - DNA, 11 bp, Homo sapiens
atcttccttcc

SEQ ID NO: 5261762 - DNA, 17 bp, Homo sapiens
atcttccttgtgaggat

SEQ ID NO: 5261763 - DNA, 13 bp, Homo sapiens
atcttcctttctt

SEQ ID NO: 5261764 - DNA, 16 bp, Homo sapiens
atcttcgtaacttcat

SEQ ID NO: 5261765 - DNA, 15 bp, Homo sapiens
atcttcgttagtaat

SEQ ID NO: 5261766 - DNA, 17 bp, Homo sapiens
atcttctacatgcaatt

SEQ ID NO: 5261767 - DNA, 15 bp, Homo sapiens
atcttctagccacag

SEQ ID NO: 5261768 - DNA, 23 bp, Homo sapiens
atcttctatataattcctgtttt

SEQ ID NO: 5261769 - DNA, 23 bp, Homo sapiens
atcttctatttttatcatgaatt

SEQ ID NO: 5261770 - DNA, 20 bp, Homo sapiens
atcttctcaaccttatcaag

SEQ ID NO: 5261771 - DNA, 15 bp, Homo sapiens
atcttctcaagttct

SEQ ID NO: 5261772 - DNA, 19 bp, Homo sapiens
atcttctcaagttctaaga

SEQ ID NO: 5261773 - DNA, 12 bp, Homo sapiens
atgtaaaattca

SEQ ID NO: 5261774 - DNA, 14 bp, Homo sapiens
atgtaaaattcata

SEQ ID NO: 5261775 - DNA, 20 bp, Homo sapiens
atgtaaaattgaaaatatgt

SEQ ID NO: 5261776 - DNA, 19 bp, Homo sapiens
atgtaaaattttgcctaat

SEQ ID NO: 5261777 - DNA, 21 bp, Homo sapiens
atgtaaacaaaaaagcttttg

SEQ ID NO: 5261778 - DNA, 21 bp, Homo sapiens
atgtaaacaaaccacagcagg

SEQ ID NO: 5261779 - DNA, 15 bp, Homo sapiens
atgtaaacaaatctt

SEQ ID NO: 5261780 - DNA, 18 bp, Homo sapiens
atgtaaacaatgtaaagt

SEQ ID NO: 5261781 - DNA, 15 bp, Homo sapiens
atgtaaacagtgcct

SEQ ID NO: 5261782 - DNA, 20 bp, Homo sapiens
atgtaaacagtgcctgctga

SEQ ID NO: 5261783 - DNA, 17 bp, Homo sapiens
atgtaaacagtgtcttc

SEQ ID NO: 5261784 - DNA, 23 bp, Homo sapiens
atgtaaacataattcttgtatat

SEQ ID NO: 5261785 - DNA, 15 bp, Homo sapiens
atgtaaacatcataa

SEQ ID NO: 5261786 - DNA, 16 bp, Homo sapiens
atgtaaaccattcgaa

SEQ ID NO: 5261787 - DNA, 20 bp, Homo sapiens
atgtaaactctcttctcttt

SEQ ID NO: 5261788 - DNA, 17 bp, Homo sapiens
atgtaaactcttcacct

SEQ ID NO: 5261789 - DNA, 11 bp, Homo sapiens
atgtaaactgc

SEQ ID NO: 5261790 - DNA, 12 bp, Homo sapiens
atgtaaacttta

SEQ ID NO: 5261791 - DNA, 22 bp, Homo sapiens
atgtaaactttaacttccactt

SEQ ID NO: 5261792 - DNA, 14 bp, Homo sapiens
atgtaaagaaatgt

SEQ ID NO: 5261793 - DNA, 16 bp, Homo sapiens
atgtaaagaaatgtct

SEQ ID NO: 5261794 - DNA, 17 bp, Homo sapiens
atgtaaagaacttaaat

SEQ ID NO: 5261795 - DNA, 14 bp, Homo sapiens
atgtaaagatattt

SEQ ID NO: 5261796 - DNA, 17 bp, Homo sapiens
atgtaaagatcaataaa

SEQ ID NO: 5261797 - DNA, 13 bp, Homo sapiens
atgtaaagattgt

SEQ ID NO: 5261798 - DNA, 14 bp, Homo sapiens
atgtaaagccatgc

SEQ ID NO: 5261799 - DNA, 20 bp, Homo sapiens
atgtaaagcgggaaggacat

SEQ ID NO: 5261800 - DNA, 21 bp, Homo sapiens
atgtaaagcgggaaggacatt

SEQ ID NO: 5261801 - DNA, 15 bp, Homo sapiens
atgtaaagctgttaa

SEQ ID NO: 5261802 - DNA, 19 bp, Homo sapiens
atgtaaaggggcagcagtg

SEQ ID NO: 5261803 - DNA, 16 bp, Homo sapiens
atgtaaagtaagacat

SEQ ID NO: 5261804 - DNA, 16 bp, Homo sapiens
atgtaaagtatgtttt

SEQ ID NO: 5261805 - DNA, 14 bp, Homo sapiens
atgtaaataaaaca

SEQ ID NO: 5261806 - DNA, 23 bp, Homo sapiens
atgtaaataaaacatcactatca

SEQ ID NO: 5261807 - DNA, 18 bp, Homo sapiens
atgtaaataaaattgagt

SEQ ID NO: 5261808 - DNA, 17 bp, Homo sapiens
atgtaaataaactattt

SEQ ID NO: 5261809 - DNA, 21 bp, Homo sapiens
atgtaaataaccccattcttt

SEQ ID NO: 5261810 - DNA, 22 bp, Homo sapiens
atgtaaataaccccattctttg

SEQ ID NO: 5261811 - DNA, 16 bp, Homo sapiens
atgtaaataatctgtg

SEQ ID NO: 5261812 - DNA, 19 bp, Homo sapiens
atgtaaatactcatgaatg

SEQ ID NO: 5261813 - DNA, 22 bp, Homo sapiens
atgtaaatactcatgaatgaaa

SEQ ID NO: 5261814 - DNA, 19 bp, Homo sapiens
atgtaaatactttccatgt

SEQ ID NO: 5261815 - DNA, 17 bp, Homo sapiens
atgtaaatagtgcagaa

SEQ ID NO: 5261816 - DNA, 14 bp, Homo sapiens
atgtaaatatacag

SEQ ID NO: 5261817 - DNA, 15 bp, Homo sapiens
atgtaaatattgctg

SEQ ID NO: 5261818 - DNA, 19 bp, Homo sapiens
atgtaaatattttaaagaa

SEQ ID NO: 5261819 - DNA, 21 bp, Homo sapiens
atgtaaatcacttcattgttt

SEQ ID NO: 5261820 - DNA, 20 bp, Homo sapiens
atgtaaatcccattattcaa

SEQ ID NO: 5261821 - DNA, 23 bp, Homo sapiens
atgtaaatcccattattcaaagt

SEQ ID NO: 5261822 - DNA, 20 bp, Homo sapiens
atgtaaatcgggaaggatgg

SEQ ID NO: 5261823 - DNA, 12 bp, Homo sapiens
atgtaaatgaag

SEQ ID NO: 5261824 - DNA, 15 bp, Homo sapiens
atgtaaatgtaaact

SEQ ID NO: 5261825 - DNA, 18 bp, Homo sapiens
atgtaaatgtctcactga

SEQ ID NO: 5261826 - DNA, 23 bp, Homo sapiens
atgtaaatgtctcactgagcact

SEQ ID NO: 5261827 - DNA, 13 bp, Homo sapiens
atgtaaatgtgca

SEQ ID NO: 5261828 - DNA, 14 bp, Homo sapiens
atgtaaatgtgcat

SEQ ID NO: 5261829 - DNA, 17 bp, Homo sapiens
atgtaaattaaatgaag

SEQ ID NO: 5261830 - DNA, 19 bp, Homo sapiens
atgtaaattaaatgaagat

SEQ ID NO: 5261831 - DNA, 21 bp, Homo sapiens
atgtaaattaaattagttcag

SEQ ID NO: 5261832 - DNA, 20 bp, Homo sapiens
atgtaaattaccagtaaagt

SEQ ID NO: 5261833 - DNA, 23 bp, Homo sapiens
atgtaaattaccagtaaagtgta

SEQ ID NO: 5261834 - DNA, 17 bp, Homo sapiens
atgtaaattagtttgac

SEQ ID NO: 5261835 - DNA, 18 bp, Homo sapiens
atgtaaattagtttgaca

SEQ ID NO: 5261836 - DNA, 19 bp, Homo sapiens
atgtaaattagtttgacac

SEQ ID NO: 5261837 - DNA, 22 bp, Homo sapiens
atgtaaattagtttgacactgc

SEQ ID NO: 5261838 - DNA, 14 bp, Homo sapiens
atgtaaattatgta

SEQ ID NO: 5261839 - DNA, 18 bp, Homo sapiens
atgtaaattattgtaaac

SEQ ID NO: 5261840 - DNA, 17 bp, Homo sapiens
atgtaaattgactgtac

SEQ ID NO: 5261841 - DNA, 18 bp, Homo sapiens
atgtaaattgactgtact

SEQ ID NO: 5261842 - DNA, 12 bp, Homo sapiens
atgtaaatttgt

SEQ ID NO: 5261843 - DNA, 17 bp, Homo sapiens
atgtaaatttgtactat

SEQ ID NO: 5261844 - DNA, 18 bp, Homo sapiens
atgtaaattttaatgtta

SEQ ID NO: 5261845 - DNA, 15 bp, Homo sapiens
atgtaacaacaatta

SEQ ID NO: 5261846 - DNA, 17 bp, Homo sapiens
atgtaacaacaattatt

SEQ ID NO: 5261847 - DNA, 12 bp, Homo sapiens
atgtaacactgg

SEQ ID NO: 5261848 - DNA, 16 bp, Homo sapiens
atgtaacagtctgatc

SEQ ID NO: 5261849 - DNA, 16 bp, Homo sapiens
atgtaacatcataatt

SEQ ID NO: 5261850 - DNA, 16 bp, Homo sapiens
atgtaacatccagaag

SEQ ID NO: 5261851 - DNA, 15 bp, Homo sapiens
atgtaacatgaagca

SEQ ID NO: 5261852 - DNA, 19 bp, Homo sapiens
atgtaacatgatgttaact

SEQ ID NO: 5261853 - DNA, 12 bp, Homo sapiens
atgtaacattgg

SEQ ID NO: 5261854 - DNA, 13 bp, Homo sapiens
atgtaaccaagct

SEQ ID NO: 5261855 - DNA, 22 bp, Homo sapiens
atgtaacccaaatgtccaatat

SEQ ID NO: 5261856 - DNA, 12 bp, Homo sapiens
atgtaactatgt

SEQ ID NO: 5261857 - DNA, 21 bp, Homo sapiens
atgtaactccagatagagaaa

SEQ ID NO: 5261858 - DNA, 17 bp, Homo sapiens
atgtaactctccagcca

SEQ ID NO: 5261859 - DNA, 17 bp, Homo sapiens
atgtaactgaagcataa

SEQ ID NO: 5261860 - DNA, 18 bp, Homo sapiens
atgtaactgaagcataaa

SEQ ID NO: 5261861 - DNA, 14 bp, Homo sapiens
atgtaactgagaat

SEQ ID NO: 5261862 - DNA, 17 bp, Homo sapiens
atgtaactgagaatttg

SEQ ID NO: 5261863 - DNA, 20 bp, Homo sapiens
atgtaactgcattgagaact

SEQ ID NO: 5261864 - DNA, 14 bp, Homo sapiens
atgtaactgctgaa

SEQ ID NO: 5261865 - DNA, 18 bp, Homo sapiens
atgtaactgttaccattg

SEQ ID NO: 5261866 - DNA, 23 bp, Homo sapiens
atgtaactgttaccattggaaat

SEQ ID NO: 5261867 - DNA, 15 bp, Homo sapiens
atgtaacttattatt

SEQ ID NO: 5261868 - DNA, 15 bp, Homo sapiens
atgtaacttcctctt

SEQ ID NO: 5261869 - DNA, 17 bp, Homo sapiens
atgtaacttttcttaca

SEQ ID NO: 5261870 - DNA, 17 bp, Homo sapiens
atgtaacttttgtaaga

SEQ ID NO: 5261871 - DNA, 20 bp, Homo sapiens
atgtaacttttttattttaa

SEQ ID NO: 5261872 - DNA, 21 bp, Homo sapiens
atgtaacttttttattttaag

SEQ ID NO: 5261873 - DNA, 15 bp, Homo sapiens
atgtaagaaaatgtt

SEQ ID NO: 5261874 - DNA, 16 bp, Homo sapiens
atgtaagaacacattt

SEQ ID NO: 5261875 - DNA, 12 bp, Homo sapiens
atgtaagaagaa

SEQ ID NO: 5261876 - DNA, 13 bp, Homo sapiens
atgtaagaagaaa

SEQ ID NO: 5261877 - DNA, 15 bp, Homo sapiens
atgtaagaagaaact

SEQ ID NO: 5261878 - DNA, 16 bp, Homo sapiens
atgtaagaagaaactg

SEQ ID NO: 5261879 - DNA, 19 bp, Homo sapiens
atgtaagagctttacaaaa

SEQ ID NO: 5261880 - DNA, 20 bp, Homo sapiens
atgtaagagctttacaaaaa

SEQ ID NO: 5261881 - DNA, 22 bp, Homo sapiens
atgtaagagctttacaaaaaga

SEQ ID NO: 5261882 - DNA, 15 bp, Homo sapiens
atgtaagattataga

SEQ ID NO: 5261883 - DNA, 17 bp, Homo sapiens
atgtaagattatagatt

SEQ ID NO: 5261884 - DNA, 22 bp, Homo sapiens
atgtaagcaaaggctctgaaat

SEQ ID NO: 5261885 - DNA, 15 bp, Homo sapiens
atgtaagcatacttt

SEQ ID NO: 5261886 - DNA, 17 bp, Homo sapiens
atgtaagctctactgag

SEQ ID NO: 5261887 - DNA, 16 bp, Homo sapiens
atgtaagctgaaaata

SEQ ID NO: 5261888 - DNA, 12 bp, Homo sapiens
atgtaaggactg

SEQ ID NO: 5261889 - DNA, 21 bp, Homo sapiens
atgtaaggaggtttgtataag

SEQ ID NO: 5261890 - DNA, 14 bp, Homo sapiens
atgtaaggcactgt

SEQ ID NO: 5261891 - DNA, 20 bp, Homo sapiens
atgtaagggaaactgccagc

SEQ ID NO: 5261892 - DNA, 17 bp, Homo sapiens
atgtaagggctttaaat

SEQ ID NO: 5261893 - DNA, 18 bp, Homo sapiens
atgtaagggctttaaata

SEQ ID NO: 5261894 - DNA, 20 bp, Homo sapiens
atgtaagggctttaaataaa

SEQ ID NO: 5261895 - DNA, 19 bp, Homo sapiens
atgtaagggtctgttgtaa

SEQ ID NO: 5261896 - DNA, 22 bp, Homo sapiens
atgtaaggtatatcattctaaa

SEQ ID NO: 5261897 - DNA, 19 bp, Homo sapiens
atgtaaggtcacatttagt

SEQ ID NO: 5261898 - DNA, 16 bp, Homo sapiens
atgtaagtaaacggtc

SEQ ID NO: 5261899 - DNA, 22 bp, Homo sapiens
atgtaagtaattgcatttctgc

SEQ ID NO: 5261900 - DNA, 17 bp, Homo sapiens
atgtaagtgtggttttg

SEQ ID NO: 5261901 - DNA, 16 bp, Homo sapiens
atgtaagttgagaaaa

SEQ ID NO: 5261902 - DNA, 12 bp, Homo sapiens
atgtaagtttaa

SEQ ID NO: 5261903 - DNA, 15 bp, Homo sapiens
atgtaagtttctaag

SEQ ID NO: 5261904 - DNA, 17 bp, Homo sapiens
atgtaagtttctaagaa

SEQ ID NO: 5261905 - DNA, 19 bp, Homo sapiens
atgtaagtttctaagaatt

SEQ ID NO: 5261906 - DNA, 16 bp, Homo sapiens
atgtaagtttgcatat

SEQ ID NO: 5261907 - DNA, 17 bp, Homo sapiens
atgtaagtttgcatatc

SEQ ID NO: 5261908 - DNA, 18 bp, Homo sapiens
atgtaagtttgtgtaaat

SEQ ID NO: 5261909 - DNA, 15 bp, Homo sapiens
atgtaataaacttta

SEQ ID NO: 5261910 - DNA, 16 bp, Homo sapiens
atgtaataaactttaa

SEQ ID NO: 5261911 - DNA, 12 bp, Homo sapiens
atgtaataaagt

SEQ ID NO: 5261912 - DNA, 13 bp, Homo sapiens
atgtaataaagtg

SEQ ID NO: 5261913 - DNA, 16 bp, Homo sapiens
atgtaataaagtgaac

SEQ ID NO: 5261914 - DNA, 17 bp, Homo sapiens
atgtaataaagtgaact

SEQ ID NO: 5261915 - DNA, 15 bp, Homo sapiens
atgtaataaatctga

SEQ ID NO: 5261916 - DNA, 14 bp, Homo sapiens
atgtaataaattca

SEQ ID NO: 5261917 - DNA, 13 bp, Homo sapiens
atgtaataatcat

SEQ ID NO: 5261918 - DNA, 17 bp, Homo sapiens
atgtaataatcatttta

SEQ ID NO: 5261919 - DNA, 21 bp, Homo sapiens
atgtaatacatatagcagctc

SEQ ID NO: 5261920 - DNA, 12 bp, Homo sapiens
atgtaatactga

SEQ ID NO: 5261921 - DNA, 18 bp, Homo sapiens
atgtaatactgaaccact

SEQ ID NO: 5261922 - DNA, 14 bp, Homo sapiens
atgtaatactggaa

SEQ ID NO: 5261923 - DNA, 15 bp, Homo sapiens
atgtaatactggaat

SEQ ID NO: 5261924 - DNA, 22 bp, Homo sapiens
atgtaatactggaataatttgt

SEQ ID NO: 5261925 - DNA, 22 bp, Homo sapiens
atgtaatacttaaataaacatg

SEQ ID NO: 5261926 - DNA, 20 bp, Homo sapiens
atgtaatagtcttgcagaaa

SEQ ID NO: 5261927 - DNA, 14 bp, Homo sapiens
atgtaatataaatt

SEQ ID NO: 5261928 - DNA, 20 bp, Homo sapiens
atgtaatataaatttaagca

SEQ ID NO: 5261929 - DNA, 21 bp, Homo sapiens
atgtaatataatgtattttct

SEQ ID NO: 5261930 - DNA, 21 bp, Homo sapiens
atgtaatatatacatattcaa

SEQ ID NO: 5261931 - DNA, 12 bp, Homo sapiens
atgtaatatatt

SEQ ID NO: 5261932 - DNA, 15 bp, Homo sapiens
atgtaatatattgta

SEQ ID NO: 5261933 - DNA, 16 bp, Homo sapiens
atgtaatatattgtac

SEQ ID NO: 5261934 - DNA, 15 bp, Homo sapiens
atgtaatatatttca

SEQ ID NO: 5261935 - DNA, 22 bp, Homo sapiens
atgtaatatatttcagacattt

SEQ ID NO: 5261936 - DNA, 16 bp, Homo sapiens
atgtaatcatttatct

SEQ ID NO: 5261937 - DNA, 17 bp, Homo sapiens
atgtaatcccagctact

SEQ ID NO: 5261938 - DNA, 22 bp, Homo sapiens
atgtaatcggcttgaattttga

SEQ ID NO: 5261939 - DNA, 19 bp, Homo sapiens
atgtaatctctctgcagct

SEQ ID NO: 5261940 - DNA, 22 bp, Homo sapiens
atgtaatctctctgcagctgcc

SEQ ID NO: 5261941 - DNA, 19 bp, Homo sapiens
atgtaatcttgaattgtaa

SEQ ID NO: 5261942 - DNA, 22 bp, Homo sapiens
atgtaatgaagtaaagccatta

SEQ ID NO: 5261943 - DNA, 22 bp, Homo sapiens
atgtaatgatgctgaggatata

SEQ ID NO: 5261944 - DNA, 18 bp, Homo sapiens
atgtaatgcgattttatt

SEQ ID NO: 5261945 - DNA, 19 bp, Homo sapiens
atgtaatgcttccaatctt

SEQ ID NO: 5261946 - DNA, 22 bp, Homo sapiens
atgtaatggactatgcacactt

SEQ ID NO: 5261947 - DNA, 16 bp, Homo sapiens
atgtaatggcagttat

SEQ ID NO: 5261948 - DNA, 17 bp, Homo sapiens
atgtaatggcagttata

SEQ ID NO: 5261949 - DNA, 21 bp, Homo sapiens
atgtaatgtaaaccagaaaaa

SEQ ID NO: 5261950 - DNA, 22 bp, Homo sapiens
atgtaatgtaaaccagaaaaaa

SEQ ID NO: 5261951 - DNA, 14 bp, Homo sapiens
atgtaatgtaaata

SEQ ID NO: 5261952 - DNA, 20 bp, Homo sapiens
atcttctcaagttctaagat

SEQ ID NO: 5261953 - DNA, 23 bp, Homo sapiens
atcttctcaagttctaagattct

SEQ ID NO: 5261954 - DNA, 24 bp, Homo sapiens
atcttctcagaaggcaaatgactt

SEQ ID NO: 5261955 - DNA, 12 bp, Homo sapiens
atcttctcagct

SEQ ID NO: 5261956 - DNA, 16 bp, Homo sapiens
atcttctcagctccca

SEQ ID NO: 5261957 - DNA, 14 bp, Homo sapiens
atcttctcatcttt

SEQ ID NO: 5261958 - DNA, 23 bp, Homo sapiens
atcttctcattcccatgtggaac

SEQ ID NO: 5261959 - DNA, 18 bp, Homo sapiens
atcttctccccacagcct

SEQ ID NO: 5261960 - DNA, 23 bp, Homo sapiens
atcttctcccccacggtatccta

SEQ ID NO: 5261961 - DNA, 17 bp, Homo sapiens
atcttctccccgaggct

SEQ ID NO: 5261962 - DNA, 18 bp, Homo sapiens
atcttctctatattttta

SEQ ID NO: 5261963 - DNA, 19 bp, Homo sapiens
atcttctctatatttttat

SEQ ID NO: 5261964 - DNA, 14 bp, Homo sapiens
atcttctctggcga

SEQ ID NO: 5261965 - DNA, 17 bp, Homo sapiens
atcttctctttgacaat

SEQ ID NO: 5261966 - DNA, 19 bp, Homo sapiens
atcttctgaaatgaaacaa

SEQ ID NO: 5261967 - DNA, 22 bp, Homo sapiens
atcttctgaacttggcgctgcc

SEQ ID NO: 5261968 - DNA, 17 bp, Homo sapiens
atcttctgcaattgctt

SEQ ID NO: 5261969 - DNA, 13 bp, Homo sapiens
atcttctgcagac

SEQ ID NO: 5261970 - DNA, 11 bp, Homo sapiens
atcttctggag

SEQ ID NO: 5261971 - DNA, 15 bp, Homo sapiens
atcttctggagaagc

SEQ ID NO: 5261972 - DNA, 20 bp, Homo sapiens
atcttctggagtctccagtg

SEQ ID NO: 5261973 - DNA, 11 bp, Homo sapiens
atcttctggat

SEQ ID NO: 5261974 - DNA, 20 bp, Homo sapiens
atcttctgggtagtcccctg

SEQ ID NO: 5261975 - DNA, 18 bp, Homo sapiens
atcttctggtgcatgttc

SEQ ID NO: 5261976 - DNA, 19 bp, Homo sapiens
atcttctgtttttctcaaa

SEQ ID NO: 5261977 - DNA, 21 bp, Homo sapiens
atcttctgtttttctcaaata

SEQ ID NO: 5261978 - DNA, 23 bp, Homo sapiens
atcttctgtttttctcaaataaa

SEQ ID NO: 5261979 - DNA, 20 bp, Homo sapiens
atcttcttaaaccaggaaaa

SEQ ID NO: 5261980 - DNA, 19 bp, Homo sapiens
atcttcttaacagtttagt

SEQ ID NO: 5261981 - DNA, 16 bp, Homo sapiens
atcttcttactaagct

SEQ ID NO: 5261982 - DNA, 17 bp, Homo sapiens
atcttcttatgcaattt

SEQ ID NO: 5261983 - DNA, 13 bp, Homo sapiens
atcttcttcaaat

SEQ ID NO: 5261984 - DNA, 14 bp, Homo sapiens
atcttcttgcatct

SEQ ID NO: 5261985 - DNA, 14 bp, Homo sapiens
atcttctttcctca

SEQ ID NO: 5261986 - DNA, 16 bp, Homo sapiens
atcttctttcttccac

SEQ ID NO: 5261987 - DNA, 21 bp, Homo sapiens
atcttctttggaaataaaaga

SEQ ID NO: 5261988 - DNA, 22 bp, Homo sapiens
atcttctttggacttctgaaga

SEQ ID NO: 5261989 - DNA, 17 bp, Homo sapiens
atcttgaaaagaatcta

SEQ ID NO: 5261990 - DNA, 16 bp, Homo sapiens
atcttgaaaatgccac

SEQ ID NO: 5261991 - DNA, 17 bp, Homo sapiens
atcttgaaaatgccacc

SEQ ID NO: 5261992 - DNA, 22 bp, Homo sapiens
atcttgaaattaagaaggcaaa

SEQ ID NO: 5261993 - DNA, 14 bp, Homo sapiens
atcttgaagaatat

SEQ ID NO: 5261994 - DNA, 15 bp, Homo sapiens
atcttgaagaatatt

SEQ ID NO: 5261995 - DNA, 17 bp, Homo sapiens
atcttgaagaatattgt

SEQ ID NO: 5261996 - DNA, 17 bp, Homo sapiens
atcttgaaggaaaaatt

SEQ ID NO: 5261997 - DNA, 18 bp, Homo sapiens
atcttgaaggaaaaattc

SEQ ID NO: 5261998 - DNA, 15 bp, Homo sapiens
atcttgaagggccca

SEQ ID NO: 5261999 - DNA, 18 bp, Homo sapiens
atcttgaagtcattgtcc

SEQ ID NO: 5262000 - DNA, 18 bp, Homo sapiens
atcttgaatactctgccc

SEQ ID NO: 5262001 - DNA, 23 bp, Homo sapiens
atcttgaatagcttatgtacaaa

SEQ ID NO: 5262002 - DNA, 21 bp, Homo sapiens
atcttgaatgtggtctcagga

SEQ ID NO: 5262003 - DNA, 14 bp, Homo sapiens
atcttgaatgtttg

SEQ ID NO: 5262004 - DNA, 16 bp, Homo sapiens
atcttgaatttcatgc

SEQ ID NO: 5262005 - DNA, 17 bp, Homo sapiens
atcttgacaggcgccgc

SEQ ID NO: 5262006 - DNA, 21 bp, Homo sapiens
atcttgaccaacagaaacctt

SEQ ID NO: 5262007 - DNA, 21 bp, Homo sapiens
atcttgaccaagcaggaagct

SEQ ID NO: 5262008 - DNA, 22 bp, Homo sapiens
atcttgaccaagcaggaagctc

SEQ ID NO: 5262009 - DNA, 16 bp, Homo sapiens
atcttgaccatactaa

SEQ ID NO: 5262010 - DNA, 20 bp, Homo sapiens
atcttgactaggtattgtct

SEQ ID NO: 5262011 - DNA, 15 bp, Homo sapiens
atcttgactttctga

SEQ ID NO: 5262012 - DNA, 15 bp, Homo sapiens
atcttgagagagaaa

SEQ ID NO: 5262013 - DNA, 15 bp, Homo sapiens
atcttgagagctgct

SEQ ID NO: 5262014 - DNA, 17 bp, Homo sapiens
atcttgagcaaggcaag

SEQ ID NO: 5262015 - DNA, 17 bp, Homo sapiens
atcttgaggaataaatg

SEQ ID NO: 5262016 - DNA, 21 bp, Homo sapiens
atcttgatacattcaaatttg

SEQ ID NO: 5262017 - DNA, 21 bp, Homo sapiens
atcttgataccacctatatag

SEQ ID NO: 5262018 - DNA, 16 bp, Homo sapiens
atcttgatctgctcag

SEQ ID NO: 5262019 - DNA, 17 bp, Homo sapiens
atcttgatctttgagcc

SEQ ID NO: 5262020 - DNA, 17 bp, Homo sapiens
atcttgatgtctttgtt

SEQ ID NO: 5262021 - DNA, 16 bp, Homo sapiens
atcttgatgtttagaa

SEQ ID NO: 5262022 - DNA, 16 bp, Homo sapiens
atcttgattaatgtac

SEQ ID NO: 5262023 - DNA, 22 bp, Homo sapiens
atcttgattaatgtacttttta

SEQ ID NO: 5262024 - DNA, 24 bp, Homo sapiens
atcttgcaccccaaagctttcctg

SEQ ID NO: 5262025 - DNA, 18 bp, Homo sapiens
atcttgcagcatttacta

SEQ ID NO: 5262026 - DNA, 20 bp, Homo sapiens
atcttgcagcatttactatg

SEQ ID NO: 5262027 - DNA, 21 bp, Homo sapiens
atcttgcagtatcggcactgt

SEQ ID NO: 5262028 - DNA, 17 bp, Homo sapiens
atcttgcatctacctgc

SEQ ID NO: 5262029 - DNA, 16 bp, Homo sapiens
atcttgcattcatttt

SEQ ID NO: 5262030 - DNA, 12 bp, Homo sapiens
atcttgccacat

SEQ ID NO: 5262031 - DNA, 17 bp, Homo sapiens
atcttgccacatttctg

SEQ ID NO: 5262032 - DNA, 19 bp, Homo sapiens
atcttgccacatttctgat

SEQ ID NO: 5262033 - DNA, 12 bp, Homo sapiens
atcttgccagcc

SEQ ID NO: 5262034 - DNA, 19 bp, Homo sapiens
atcttgccagcctcaggct

SEQ ID NO: 5262035 - DNA, 15 bp, Homo sapiens
atcttgcccttaata

SEQ ID NO: 5262036 - DNA, 18 bp, Homo sapiens
atcttgcctacttttctt

SEQ ID NO: 5262037 - DNA, 21 bp, Homo sapiens
atcttgcctccaggtgcagag

SEQ ID NO: 5262038 - DNA, 19 bp, Homo sapiens
atcttgcctctttcctcct

SEQ ID NO: 5262039 - DNA, 16 bp, Homo sapiens
atcttgcctgtctggc

SEQ ID NO: 5262040 - DNA, 23 bp, Homo sapiens
atcttgcgaatccaagctccctg

SEQ ID NO: 5262041 - DNA, 16 bp, Homo sapiens
atcttgctaccagtat

SEQ ID NO: 5262042 - DNA, 23 bp, Homo sapiens
atcttgctaccagtatttagaag

SEQ ID NO: 5262043 - DNA, 17 bp, Homo sapiens
atcttgctactaccgtt

SEQ ID NO: 5262044 - DNA, 22 bp, Homo sapiens
atcttgctctgtaatctcgttt

SEQ ID NO: 5262045 - DNA, 22 bp, Homo sapiens
atcttgctgcaggccctccctc

SEQ ID NO: 5262046 - DNA, 23 bp, Homo sapiens
atcttgctgcaggccctccctct

SEQ ID NO: 5262047 - DNA, 21 bp, Homo sapiens
atcttgctggagaagcatcca

SEQ ID NO: 5262048 - DNA, 15 bp, Homo sapiens
atcttgcttcattgt

SEQ ID NO: 5262049 - DNA, 23 bp, Homo sapiens
atcttgcttcattgttacatgta

SEQ ID NO: 5262050 - DNA, 15 bp, Homo sapiens
atcttgcttccaaga

SEQ ID NO: 5262051 - DNA, 12 bp, Homo sapiens
atcttgcttgaa

SEQ ID NO: 5262052 - DNA, 12 bp, Homo sapiens
atcttgctttct

SEQ ID NO: 5262053 - DNA, 15 bp, Homo sapiens
atcttgctttggagg

SEQ ID NO: 5262054 - DNA, 23 bp, Homo sapiens
atcttgctttttttcaccaatat

SEQ ID NO: 5262055 - DNA, 12 bp, Homo sapiens
atcttggaaatc

SEQ ID NO: 5262056 - DNA, 14 bp, Homo sapiens
atcttggaaatcat

SEQ ID NO: 5262057 - DNA, 15 bp, Homo sapiens
atcttggaatcatgc

SEQ ID NO: 5262058 - DNA, 18 bp, Homo sapiens
atcttggacgcactgttt

SEQ ID NO: 5262059 - DNA, 19 bp, Homo sapiens
atcttggactgacatttag

SEQ ID NO: 5262060 - DNA, 16 bp, Homo sapiens
atcttggagacaatta

SEQ ID NO: 5262061 - DNA, 19 bp, Homo sapiens
atcttggagacaattacaa

SEQ ID NO: 5262062 - DNA, 21 bp, Homo sapiens
atcttggagacaattacaaga

SEQ ID NO: 5262063 - DNA, 15 bp, Homo sapiens
atcttggagagctgg

SEQ ID NO: 5262064 - DNA, 14 bp, Homo sapiens
atcttggagctgct

SEQ ID NO: 5262065 - DNA, 16 bp, Homo sapiens
atcttggagctgcttg

SEQ ID NO: 5262066 - DNA, 13 bp, Homo sapiens
atcttggatgaga

SEQ ID NO: 5262067 - DNA, 19 bp, Homo sapiens
atcttggatggtgacattg

SEQ ID NO: 5262068 - DNA, 18 bp, Homo sapiens
atcttggcaggtaggaat

SEQ ID NO: 5262069 - DNA, 18 bp, Homo sapiens
atcttggccctcctcagc

SEQ ID NO: 5262070 - DNA, 21 bp, Homo sapiens
atcttggccctcctcagctcc

SEQ ID NO: 5262071 - DNA, 23 bp, Homo sapiens
atcttggccctcctcagctccct

SEQ ID NO: 5262072 - DNA, 17 bp, Homo sapiens
atcttggccttactgta

SEQ ID NO: 5262073 - DNA, 21 bp, Homo sapiens
atcttggctatgtaattcttg

SEQ ID NO: 5262074 - DNA, 22 bp, Homo sapiens
atcttggctatgtaattcttgt

SEQ ID NO: 5262075 - DNA, 17 bp, Homo sapiens
atcttggctgggtgcgg

SEQ ID NO: 5262076 - DNA, 22 bp, Homo sapiens
atcttggctgtttcaaaaaaat

SEQ ID NO: 5262077 - DNA, 13 bp, Homo sapiens
atcttggcttctt

SEQ ID NO: 5262078 - DNA, 16 bp, Homo sapiens
atcttggcttcttaaa

SEQ ID NO: 5262079 - DNA, 20 bp, Homo sapiens
atcttggcttcttaaaaact

SEQ ID NO: 5262080 - DNA, 21 bp, Homo sapiens
atcttggcttcttaaaaactg

SEQ ID NO: 5262081 - DNA, 23 bp, Homo sapiens
atcttggcttcttaaaaactgtg

SEQ ID NO: 5262082 - DNA, 17 bp, Homo sapiens
atcttggggacatctct

SEQ ID NO: 5262083 - DNA, 16 bp, Homo sapiens
atcttgggggggtggc

SEQ ID NO: 5262084 - DNA, 20 bp, Homo sapiens
atcttgggggggtggccgct

SEQ ID NO: 5262085 - DNA, 15 bp, Homo sapiens
atcttgggggtcacc

SEQ ID NO: 5262086 - DNA, 23 bp, Homo sapiens
atcttgggggtcacccatggcct

SEQ ID NO: 5262087 - DNA, 23 bp, Homo sapiens
atcttgggtgggtgaaggcctgg

SEQ ID NO: 5262088 - DNA, 23 bp, Homo sapiens
atcttggtaaatttccccaacag

SEQ ID NO: 5262089 - DNA, 20 bp, Homo sapiens
atcttggtcctgtcaccctg

SEQ ID NO: 5262090 - DNA, 18 bp, Homo sapiens
atcttggtgtgttaagag

SEQ ID NO: 5262091 - DNA, 20 bp, Homo sapiens
atcttggttgatgccaaaaa

SEQ ID NO: 5262092 - DNA, 23 bp, Homo sapiens
atcttggtttggtacagttcata

SEQ ID NO: 5262093 - DNA, 21 bp, Homo sapiens
atcttggtttgtcagtttatc

SEQ ID NO: 5262094 - DNA, 15 bp, Homo sapiens
atcttgtcatgtgta

SEQ ID NO: 5262095 - DNA, 17 bp, Homo sapiens
atcttgtcatgtgtata

SEQ ID NO: 5262096 - DNA, 19 bp, Homo sapiens
atcttgtcatgtgtataaa

SEQ ID NO: 5262097 - DNA, 20 bp, Homo sapiens
atcttgtccaagttgtttca

SEQ ID NO: 5262098 - DNA, 14 bp, Homo sapiens
atcttgtccacagt

SEQ ID NO: 5262099 - DNA, 15 bp, Homo sapiens
atcttgtctcactag

SEQ ID NO: 5262100 - DNA, 14 bp, Homo sapiens
atcttgtctctggg

SEQ ID NO: 5262101 - DNA, 11 bp, Homo sapiens
atcttgtgaaa

SEQ ID NO: 5262102 - DNA, 16 bp, Homo sapiens
atcttgtgagtggata

SEQ ID NO: 5262103 - DNA, 18 bp, Homo sapiens
atcttgtgctagaatact

SEQ ID NO: 5262104 - DNA, 17 bp, Homo sapiens
atcttgtgctatgaaac

SEQ ID NO: 5262105 - DNA, 19 bp, Homo sapiens
atcttgtgctatgaaacaa

SEQ ID NO: 5262106 - DNA, 20 bp, Homo sapiens
atcttgtgctatgaaacaat

SEQ ID NO: 5262107 - DNA, 22 bp, Homo sapiens
atcttgtggctttgcaaccatt

SEQ ID NO: 5262108 - DNA, 17 bp, Homo sapiens
atcttgtggggccagga

SEQ ID NO: 5262109 - DNA, 16 bp, Homo sapiens
atcttgttaatgcatt

SEQ ID NO: 5262110 - DNA, 18 bp, Homo sapiens
atcttgttaatgtcattg

SEQ ID NO: 5262111 - DNA, 20 bp, Homo sapiens
atcttgttaatgtcattgct

SEQ ID NO: 5262112 - DNA, 18 bp, Homo sapiens
atcttgttagagagcttt

SEQ ID NO: 5262113 - DNA, 19 bp, Homo sapiens
atcttgttattaatgtttc

SEQ ID NO: 5262114 - DNA, 22 bp, Homo sapiens
atcttgttattattgttaataa

SEQ ID NO: 5262115 - DNA, 14 bp, Homo sapiens
atcttgttcaatga

SEQ ID NO: 5262116 - DNA, 20 bp, Homo sapiens
atcttgttggtacctttcta

SEQ ID NO: 5262117 - DNA, 14 bp, Homo sapiens
atcttgtttacaat

SEQ ID NO: 5262118 - DNA, 21 bp, Homo sapiens
atcttgtttacaataaagaat

SEQ ID NO: 5262119 - DNA, 14 bp, Homo sapiens
atcttgtttatagc

SEQ ID NO: 5262120 - DNA, 15 bp, Homo sapiens
atcttgtttcatttg

SEQ ID NO: 5262121 - DNA, 19 bp, Homo sapiens
atcttgttttaagcaaatg

SEQ ID NO: 5262122 - DNA, 20 bp, Homo sapiens
atcttgttttgtttgcttcc

SEQ ID NO: 5262123 - DNA, 22 bp, Homo sapiens
atcttgttttgtttgcttccat

SEQ ID NO: 5262124 - DNA, 23 bp, Homo sapiens
atcttgtttttccactactgcta

SEQ ID NO: 5262125 - DNA, 21 bp, Homo sapiens
atctttaaaaaaaaatcttgt

SEQ ID NO: 5262126 - DNA, 18 bp, Homo sapiens
atctttaaaaagcagtcc

SEQ ID NO: 5262127 - DNA, 12 bp, Homo sapiens
atctttaaaata

SEQ ID NO: 5262128 - DNA, 17 bp, Homo sapiens
atgtaatgtaaatacat

SEQ ID NO: 5262129 - DNA, 13 bp, Homo sapiens
atgtaatgtcaga

SEQ ID NO: 5262130 - DNA, 14 bp, Homo sapiens
atgtaatgtccctt

SEQ ID NO: 5262131 - DNA, 20 bp, Homo sapiens
atgtaatgtttttatttcaa

SEQ ID NO: 5262132 - DNA, 22 bp, Homo sapiens
atgtaatgtttttatttcaatt

SEQ ID NO: 5262133 - DNA, 16 bp, Homo sapiens
atgtaattagctctgg

SEQ ID NO: 5262134 - DNA, 18 bp, Homo sapiens
atgtaattagctctgggg

SEQ ID NO: 5262135 - DNA, 21 bp, Homo sapiens
atgtaattagctctggggggc

SEQ ID NO: 5262136 - DNA, 22 bp, Homo sapiens
atgtaattatctagtagttgta

SEQ ID NO: 5262137 - DNA, 17 bp, Homo sapiens
atgtaattatgttctaa

SEQ ID NO: 5262138 - DNA, 12 bp, Homo sapiens
atgtaattggaa

SEQ ID NO: 5262139 - DNA, 13 bp, Homo sapiens
atgtaattggaat

SEQ ID NO: 5262140 - DNA, 14 bp, Homo sapiens
atgtaattggaatc

SEQ ID NO: 5262141 - DNA, 19 bp, Homo sapiens
atgtaattgtaattttgaa

SEQ ID NO: 5262142 - DNA, 11 bp, Homo sapiens
atgtaattgtt

SEQ ID NO: 5262143 - DNA, 13 bp, Homo sapiens
atgtaatttaaat

SEQ ID NO: 5262144 - DNA, 16 bp, Homo sapiens
atgtaatttaaatgaa

SEQ ID NO: 5262145 - DNA, 17 bp, Homo sapiens
atgtaatttaaatgaaa

SEQ ID NO: 5262146 - DNA, 21 bp, Homo sapiens
atgtaatttaatgcctgccca

SEQ ID NO: 5262147 - DNA, 21 bp, Homo sapiens
atgtaatttagggtactaaat

SEQ ID NO: 5262148 - DNA, 13 bp, Homo sapiens
atgtaatttatgc

SEQ ID NO: 5262149 - DNA, 19 bp, Homo sapiens
atgtaatttcaaaatacat

SEQ ID NO: 5262150 - DNA, 20 bp, Homo sapiens
atgtaatttcaaaatacatt

SEQ ID NO: 5262151 - DNA, 21 bp, Homo sapiens
atgtaatttcaggaggaatac

SEQ ID NO: 5262152 - DNA, 18 bp, Homo sapiens
atgtaatttctttaaatg

SEQ ID NO: 5262153 - DNA, 22 bp, Homo sapiens
atgtaatttctttaaatgtgta

SEQ ID NO: 5262154 - DNA, 13 bp, Homo sapiens
atgtaatttgcat

SEQ ID NO: 5262155 - DNA, 14 bp, Homo sapiens
atgtaatttgcatt

SEQ ID NO: 5262156 - DNA, 18 bp, Homo sapiens
atgtaatttgcattactc

SEQ ID NO: 5262157 - DNA, 19 bp, Homo sapiens
atgtaatttgtacaggggc

SEQ ID NO: 5262158 - DNA, 22 bp, Homo sapiens
atgtaatttgtacaggggccat

SEQ ID NO: 5262159 - DNA, 21 bp, Homo sapiens
atgtaatttgtgtaataaagt

SEQ ID NO: 5262160 - DNA, 20 bp, Homo sapiens
atgtaattttattttaaaat

SEQ ID NO: 5262161 - DNA, 22 bp, Homo sapiens
atgtaattttgtgtaagaaata

SEQ ID NO: 5262162 - DNA, 18 bp, Homo sapiens
atgtaatttttaaagcaa

SEQ ID NO: 5262163 - DNA, 20 bp, Homo sapiens
atgtaatttttaaagcaaat

SEQ ID NO: 5262164 - DNA, 21 bp, Homo sapiens
atgtaatttttaaagcaaata

SEQ ID NO: 5262165 - DNA, 18 bp, Homo sapiens
atgtacaaaaacacaaat

SEQ ID NO: 5262166 - DNA, 19 bp, Homo sapiens
atgtacaaaaacacaaata

SEQ ID NO: 5262167 - DNA, 21 bp, Homo sapiens
atgtacaaaatcgattggctt

SEQ ID NO: 5262168 - DNA, 13 bp, Homo sapiens
atgtacaaacatg

SEQ ID NO: 5262169 - DNA, 14 bp, Homo sapiens
atgtacaaacatgt

SEQ ID NO: 5262170 - DNA, 11 bp, Homo sapiens
atgtacaaact

SEQ ID NO: 5262171 - DNA, 19 bp, Homo sapiens
atgtacaaataatattgcc

SEQ ID NO: 5262172 - DNA, 20 bp, Homo sapiens
atgtacaaataatattgcct

SEQ ID NO: 5262173 - DNA, 14 bp, Homo sapiens
atgtacaaccctga

SEQ ID NO: 5262174 - DNA, 16 bp, Homo sapiens
atgtacaaccctgacc

SEQ ID NO: 5262175 - DNA, 16 bp, Homo sapiens
atgtacaaggtatgta

SEQ ID NO: 5262176 - DNA, 19 bp, Homo sapiens
atgtacaaggtatgtacag

SEQ ID NO: 5262177 - DNA, 14 bp, Homo sapiens
atgtacaatacaat

SEQ ID NO: 5262178 - DNA, 17 bp, Homo sapiens
atgtacaatacaatgta

SEQ ID NO: 5262179 - DNA, 20 bp, Homo sapiens
atgtacaatacaatgtacaa

SEQ ID NO: 5262180 - DNA, 21 bp, Homo sapiens
atgtacaatacaatgtacaat

SEQ ID NO: 5262181 - DNA, 18 bp, Homo sapiens
atgtacactggatatgtt

SEQ ID NO: 5262182 - DNA, 19 bp, Homo sapiens
atgtacagaacacaaatgt

SEQ ID NO: 5262183 - DNA, 23 bp, Homo sapiens
atgtacagaacacaaatgtctag

SEQ ID NO: 5262184 - DNA, 21 bp, Homo sapiens
atgtacagagaactaacacta

SEQ ID NO: 5262185 - DNA, 13 bp, Homo sapiens
atgtacagagtgg

SEQ ID NO: 5262186 - DNA, 15 bp, Homo sapiens
atgtacagattcttt

SEQ ID NO: 5262187 - DNA, 21 bp, Homo sapiens
atgtacagattttatttgtaa

SEQ ID NO: 5262188 - DNA, 17 bp, Homo sapiens
atgtacagctggtgctt

SEQ ID NO: 5262189 - DNA, 14 bp, Homo sapiens
atgtacaggatgct

SEQ ID NO: 5262190 - DNA, 17 bp, Homo sapiens
atgtacaggatgctttg

SEQ ID NO: 5262191 - DNA, 19 bp, Homo sapiens
atgtacaggctgagacaca

SEQ ID NO: 5262192 - DNA, 20 bp, Homo sapiens
atgtacaggctgagacacag

SEQ ID NO: 5262193 - DNA, 13 bp, Homo sapiens
atgtacagtattt

SEQ ID NO: 5262194 - DNA, 21 bp, Homo sapiens
atgtacagtctcaattttgta

SEQ ID NO: 5262195 - DNA, 13 bp, Homo sapiens
atgtacagtctgt

SEQ ID NO: 5262196 - DNA, 17 bp, Homo sapiens
atgtacagtgttctgtt

SEQ ID NO: 5262197 - DNA, 23 bp, Homo sapiens
atgtacagttcataaatttgttg

SEQ ID NO: 5262198 - DNA, 17 bp, Homo sapiens
atgtacagtttattgat

SEQ ID NO: 5262199 - DNA, 19 bp, Homo sapiens
atgtacataaactgtcact

SEQ ID NO: 5262200 - DNA, 14 bp, Homo sapiens
atgtacataactcc

SEQ ID NO: 5262201 - DNA, 15 bp, Homo sapiens
atgtacatacatata

SEQ ID NO: 5262202 - DNA, 22 bp, Homo sapiens
atgtacatagttatttttctct

SEQ ID NO: 5262203 - DNA, 12 bp, Homo sapiens
atgtacatctct

SEQ ID NO: 5262204 - DNA, 15 bp, Homo sapiens
atgtacatgggccgc

SEQ ID NO: 5262205 - DNA, 19 bp, Homo sapiens
atgtacatgttcctttgta

SEQ ID NO: 5262206 - DNA, 17 bp, Homo sapiens
atgtacattacagatta

SEQ ID NO: 5262207 - DNA, 14 bp, Homo sapiens
atgtacatttaata

SEQ ID NO: 5262208 - DNA, 16 bp, Homo sapiens
atgtacatttaataat

SEQ ID NO: 5262209 - DNA, 17 bp, Homo sapiens
atgtacatttctcaggc

SEQ ID NO: 5262210 - DNA, 16 bp, Homo sapiens
atgtaccagtgtactg

SEQ ID NO: 5262211 - DNA, 18 bp, Homo sapiens
atgtaccatgaaacaaag

SEQ ID NO: 5262212 - DNA, 18 bp, Homo sapiens
atgtaccatgaatattta

SEQ ID NO: 5262213 - DNA, 15 bp, Homo sapiens
atgtaccatgtacat

SEQ ID NO: 5262214 - DNA, 21 bp, Homo sapiens
atgtaccatgtacatgaagaa

SEQ ID NO: 5262215 - DNA, 18 bp, Homo sapiens
atgtaccatttgcatggc

SEQ ID NO: 5262216 - DNA, 14 bp, Homo sapiens
atgtacctatgtga

SEQ ID NO: 5262217 - DNA, 22 bp, Homo sapiens
atgtacctatgtgagtttcaga

SEQ ID NO: 5262218 - DNA, 18 bp, Homo sapiens
atgtacctattccttcag

SEQ ID NO: 5262219 - DNA, 21 bp, Homo sapiens
atgtacctcagatctctctct

SEQ ID NO: 5262220 - DNA, 22 bp, Homo sapiens
atgtacctcccctgccttgctg

SEQ ID NO: 5262221 - DNA, 20 bp, Homo sapiens
atgtacctctagctgttctt

SEQ ID NO: 5262222 - DNA, 21 bp, Homo sapiens
atgtacctctattagtttcaa

SEQ ID NO: 5262223 - DNA, 17 bp, Homo sapiens
atgtaccttttgataga

SEQ ID NO: 5262224 - DNA, 15 bp, Homo sapiens
atgtacgctgcgtgc

SEQ ID NO: 5262225 - DNA, 18 bp, Homo sapiens
atgtacgtccagcctgcc

SEQ ID NO: 5262226 - DNA, 20 bp, Homo sapiens
atgtactagtgttctgtttg

SEQ ID NO: 5262227 - DNA, 14 bp, Homo sapiens
atgtactataacat

SEQ ID NO: 5262228 - DNA, 19 bp, Homo sapiens
atgtactataatgtgatga

SEQ ID NO: 5262229 - DNA, 15 bp, Homo sapiens
atgtactatgtctga

SEQ ID NO: 5262230 - DNA, 22 bp, Homo sapiens
atgtactctactgatatctaaa

SEQ ID NO: 5262231 - DNA, 20 bp, Homo sapiens
atgtactcttccgatgtttg

SEQ ID NO: 5262232 - DNA, 17 bp, Homo sapiens
atgtactgagacaaaaa

SEQ ID NO: 5262233 - DNA, 17 bp, Homo sapiens
atgtactgatttcagta

SEQ ID NO: 5262234 - DNA, 18 bp, Homo sapiens
atgtactgatttcagtaa

SEQ ID NO: 5262235 - DNA, 15 bp, Homo sapiens
atgtactgcattatt

SEQ ID NO: 5262236 - DNA, 20 bp, Homo sapiens
atgtactgcattatttgaga

SEQ ID NO: 5262237 - DNA, 15 bp, Homo sapiens
atgtactggagagtg

SEQ ID NO: 5262238 - DNA, 16 bp, Homo sapiens
atgtactggtaattgt

SEQ ID NO: 5262239 - DNA, 21 bp, Homo sapiens
atgtactggtaattgtacaat

SEQ ID NO: 5262240 - DNA, 20 bp, Homo sapiens
atgtactgtaaacagttctg

SEQ ID NO: 5262241 - DNA, 13 bp, Homo sapiens
atgtactgtacat

SEQ ID NO: 5262242 - DNA, 14 bp, Homo sapiens
atgtactgtacata

SEQ ID NO: 5262243 - DNA, 17 bp, Homo sapiens
atgtactgtacataaat

SEQ ID NO: 5262244 - DNA, 12 bp, Homo sapiens
atgtactgtact

SEQ ID NO: 5262245 - DNA, 12 bp, Homo sapiens
atgtactgtatt

SEQ ID NO: 5262246 - DNA, 18 bp, Homo sapiens
atgtactgttgaaaaaga

SEQ ID NO: 5262247 - DNA, 15 bp, Homo sapiens
atgtactgtttgctg

SEQ ID NO: 5262248 - DNA, 12 bp, Homo sapiens
atgtacttaaat

SEQ ID NO: 5262249 - DNA, 20 bp, Homo sapiens
atgtacttagctgtactata

SEQ ID NO: 5262250 - DNA, 21 bp, Homo sapiens
atgtacttagctgtactataa

SEQ ID NO: 5262251 - DNA, 13 bp, Homo sapiens
atgtacttccagt

SEQ ID NO: 5262252 - DNA, 14 bp, Homo sapiens
atgtacttctctgt

SEQ ID NO: 5262253 - DNA, 15 bp, Homo sapiens
atgtacttctttatt

SEQ ID NO: 5262254 - DNA, 19 bp, Homo sapiens
atgtacttgaaggatggat

SEQ ID NO: 5262255 - DNA, 14 bp, Homo sapiens
atgtacttgatact

SEQ ID NO: 5262256 - DNA, 17 bp, Homo sapiens
atgtacttgatactgaa

SEQ ID NO: 5262257 - DNA, 21 bp, Homo sapiens
atgtacttgatactgaatgca

SEQ ID NO: 5262258 - DNA, 19 bp, Homo sapiens
atgtacttgtcaaagaagg

SEQ ID NO: 5262259 - DNA, 19 bp, Homo sapiens
atgtacttgtttctctgtt

SEQ ID NO: 5262260 - DNA, 20 bp, Homo sapiens
atgtacttgtttgaatattt

SEQ ID NO: 5262261 - DNA, 15 bp, Homo sapiens
atgtacttgtttgct

SEQ ID NO: 5262262 - DNA, 16 bp, Homo sapiens
atgtacttttccattt

SEQ ID NO: 5262263 - DNA, 18 bp, Homo sapiens
atgtactttttaaatcat

SEQ ID NO: 5262264 - DNA, 17 bp, Homo sapiens
atgtactttttattgca

SEQ ID NO: 5262265 - DNA, 19 bp, Homo sapiens
atgtactttttattgcatg

SEQ ID NO: 5262266 - DNA, 18 bp, Homo sapiens
atgtagaaaagagacttc

SEQ ID NO: 5262267 - DNA, 15 bp, Homo sapiens
atgtagaaacattta

SEQ ID NO: 5262268 - DNA, 17 bp, Homo sapiens
atgtagaaactgaggcc

SEQ ID NO: 5262269 - DNA, 20 bp, Homo sapiens
atgtagaaactgaggcccag

SEQ ID NO: 5262270 - DNA, 12 bp, Homo sapiens
atgtagaaattc

SEQ ID NO: 5262271 - DNA, 14 bp, Homo sapiens
atgtagaaattcta

SEQ ID NO: 5262272 - DNA, 19 bp, Homo sapiens
atgtagaaattcttcatga

SEQ ID NO: 5262273 - DNA, 15 bp, Homo sapiens
atgtagaactcagca

SEQ ID NO: 5262274 - DNA, 20 bp, Homo sapiens
atgtagaactcagcagttga

SEQ ID NO: 5262275 - DNA, 14 bp, Homo sapiens
atgtagaactgttc

SEQ ID NO: 5262276 - DNA, 16 bp, Homo sapiens
atgtagaactgttcat

SEQ ID NO: 5262277 - DNA, 21 bp, Homo sapiens
atgtagaacttgaactaacat

SEQ ID NO: 5262278 - DNA, 15 bp, Homo sapiens
atgtagaagaaagca

SEQ ID NO: 5262279 - DNA, 21 bp, Homo sapiens
atgtagaagagggagaaggag

SEQ ID NO: 5262280 - DNA, 16 bp, Homo sapiens
atgtagaataaatgaa

SEQ ID NO: 5262281 - DNA, 19 bp, Homo sapiens
atgtagaatgtaatatact

SEQ ID NO: 5262282 - DNA, 13 bp, Homo sapiens
atgtagaattgct

SEQ ID NO: 5262283 - DNA, 20 bp, Homo sapiens
atgtagacagttgggttttt

SEQ ID NO: 5262284 - DNA, 16 bp, Homo sapiens
atgtagacataaagaa

SEQ ID NO: 5262285 - DNA, 22 bp, Homo sapiens
atgtagacataaagaagaaact

SEQ ID NO: 5262286 - DNA, 22 bp, Homo sapiens
atgtagacattatcttttggct

SEQ ID NO: 5262287 - DNA, 12 bp, Homo sapiens
atgtagacattg

SEQ ID NO: 5262288 - DNA, 17 bp, Homo sapiens
atgtagacattgtaaat

SEQ ID NO: 5262289 - DNA, 20 bp, Homo sapiens
atgtagacattgtaaataaa

SEQ ID NO: 5262290 - DNA, 21 bp, Homo sapiens
atgtagacattgtaaataaat

SEQ ID NO: 5262291 - DNA, 18 bp, Homo sapiens
atgtagacggaacagtgt

SEQ ID NO: 5262292 - DNA, 17 bp, Homo sapiens
atgtagactatatacat

SEQ ID NO: 5262293 - DNA, 23 bp, Homo sapiens
atgtagactatatacatgtgtgt

SEQ ID NO: 5262294 - DNA, 15 bp, Homo sapiens
atgtagagaaaagca

SEQ ID NO: 5262295 - DNA, 20 bp, Homo sapiens
atgtagagcacaatggaatt

SEQ ID NO: 5262296 - DNA, 19 bp, Homo sapiens
atgtagaggagaaactgga

SEQ ID NO: 5262297 - DNA, 18 bp, Homo sapiens
atgtagaggctttatgtt

SEQ ID NO: 5262298 - DNA, 22 bp, Homo sapiens
atgtagatattgtgaagtacat

SEQ ID NO: 5262299 - DNA, 21 bp, Homo sapiens
atgtagatattgttttctgta

SEQ ID NO: 5262300 - DNA, 22 bp, Homo sapiens
atgtagatattgttttctgtaa

SEQ ID NO: 5262301 - DNA, 21 bp, Homo sapiens
atgtagatatttggcttaaat

SEQ ID NO: 5262302 - DNA, 18 bp, Homo sapiens
atgtagatgtatgcacac

SEQ ID NO: 5262303 - DNA, 19 bp, Homo sapiens
atgtagatgtatgcacaca

SEQ ID NO: 5262304 - DNA, 19 bp, Homo sapiens
atgtagattaaggtgatgt

SEQ ID NO: 5262305 - DNA, 22 bp, Homo sapiens
atgtagattaaggtgatgtgat

SEQ ID NO: 5262306 - DNA, 14 bp, Homo sapiens
atctttaaaccaat

SEQ ID NO: 5262307 - DNA, 15 bp, Homo sapiens
atctttaaatataat

SEQ ID NO: 5262308 - DNA, 19 bp, Homo sapiens
atctttaaatgatgtacag

SEQ ID NO: 5262309 - DNA, 21 bp, Homo sapiens
atctttaacaattgtcttaaa

SEQ ID NO: 5262310 - DNA, 23 bp, Homo sapiens
atctttaacatagtcctgttact

SEQ ID NO: 5262311 - DNA, 14 bp, Homo sapiens
atctttaagaaaaa

SEQ ID NO: 5262312 - DNA, 14 bp, Homo sapiens
atctttaagtattg

SEQ ID NO: 5262313 - DNA, 18 bp, Homo sapiens
atctttaattaaaacctg

SEQ ID NO: 5262314 - DNA, 15 bp, Homo sapiens
atctttaattcctta

SEQ ID NO: 5262315 - DNA, 17 bp, Homo sapiens
atctttaattgtatctc

SEQ ID NO: 5262316 - DNA, 16 bp, Homo sapiens
atctttaattttacat

SEQ ID NO: 5262317 - DNA, 21 bp, Homo sapiens
atctttaattttacatttcct

SEQ ID NO: 5262318 - DNA, 21 bp, Homo sapiens
atctttacaaaactacatgag

SEQ ID NO: 5262319 - DNA, 17 bp, Homo sapiens
atctttacctgtataca

SEQ ID NO: 5262320 - DNA, 17 bp, Homo sapiens
atctttacgtactgtaa

SEQ ID NO: 5262321 - DNA, 20 bp, Homo sapiens
atctttacgtactgtaactg

SEQ ID NO: 5262322 - DNA, 16 bp, Homo sapiens
atctttactggaaatg

SEQ ID NO: 5262323 - DNA, 16 bp, Homo sapiens
atctttagaaaaggca

SEQ ID NO: 5262324 - DNA, 13 bp, Homo sapiens
atctttagcagtt

SEQ ID NO: 5262325 - DNA, 17 bp, Homo sapiens
atctttagcagtttcct

SEQ ID NO: 5262326 - DNA, 20 bp, Homo sapiens
atctttagcagtttcctcag

SEQ ID NO: 5262327 - DNA, 15 bp, Homo sapiens
atctttaggccaggc

SEQ ID NO: 5262328 - DNA, 19 bp, Homo sapiens
atctttatacagattttct

SEQ ID NO: 5262329 - DNA, 21 bp, Homo sapiens
atctttatacttaaacagctt

SEQ ID NO: 5262330 - DNA, 22 bp, Homo sapiens
atctttatacttaaacagcttt

SEQ ID NO: 5262331 - DNA, 20 bp, Homo sapiens
atctttatatttcaataaat

SEQ ID NO: 5262332 - DNA, 14 bp, Homo sapiens
atctttatcataaa

SEQ ID NO: 5262333 - DNA, 22 bp, Homo sapiens
atctttatcatcggagttgaca

SEQ ID NO: 5262334 - DNA, 16 bp, Homo sapiens
atctttatcattaaac

SEQ ID NO: 5262335 - DNA, 19 bp, Homo sapiens
atctttatcctaaaaatct

SEQ ID NO: 5262336 - DNA, 17 bp, Homo sapiens
atctttatgcaaaaaca

SEQ ID NO: 5262337 - DNA, 19 bp, Homo sapiens
atctttattaaaacaaaag

SEQ ID NO: 5262338 - DNA, 21 bp, Homo sapiens
atctttattaaaacaaaaggg

SEQ ID NO: 5262339 - DNA, 15 bp, Homo sapiens
atctttattaacctc

SEQ ID NO: 5262340 - DNA, 19 bp, Homo sapiens
atctttattaacctcagca

SEQ ID NO: 5262341 - DNA, 18 bp, Homo sapiens
atctttattaagtagatg

SEQ ID NO: 5262342 - DNA, 13 bp, Homo sapiens
atctttattaatc

SEQ ID NO: 5262343 - DNA, 14 bp, Homo sapiens
atctttattaatca

SEQ ID NO: 5262344 - DNA, 19 bp, Homo sapiens
atctttattcaaactttta

SEQ ID NO: 5262345 - DNA, 22 bp, Homo sapiens
atctttattcaaacttttatta

SEQ ID NO: 5262346 - DNA, 17 bp, Homo sapiens
atctttattgagaaaga

SEQ ID NO: 5262347 - DNA, 14 bp, Homo sapiens
atctttattttatt

SEQ ID NO: 5262348 - DNA, 17 bp, Homo sapiens
atctttcaaaccagctt

SEQ ID NO: 5262349 - DNA, 15 bp, Homo sapiens
atctttcaatatcat

SEQ ID NO: 5262350 - DNA, 14 bp, Homo sapiens
atctttcaccaagt

SEQ ID NO: 5262351 - DNA, 15 bp, Homo sapiens
atctttcacctttct

SEQ ID NO: 5262352 - DNA, 15 bp, Homo sapiens
atctttcacttgaaa

SEQ ID NO: 5262353 - DNA, 17 bp, Homo sapiens
atctttcacttgaaaga

SEQ ID NO: 5262354 - DNA, 13 bp, Homo sapiens
atctttcagaaat

SEQ ID NO: 5262355 - DNA, 13 bp, Homo sapiens
atctttcagaata

SEQ ID NO: 5262356 - DNA, 18 bp, Homo sapiens
atctttcagcctgcttct

SEQ ID NO: 5262357 - DNA, 12 bp, Homo sapiens
atctttcaggaa

SEQ ID NO: 5262358 - DNA, 14 bp, Homo sapiens
atctttcaggaaat

SEQ ID NO: 5262359 - DNA, 22 bp, Homo sapiens
atctttcaggaaatttttgcat

SEQ ID NO: 5262360 - DNA, 21 bp, Homo sapiens
atctttcagttattaaatgat

SEQ ID NO: 5262361 - DNA, 14 bp, Homo sapiens
atctttcatacata

SEQ ID NO: 5262362 - DNA, 22 bp, Homo sapiens
atctttcatacatatatatatt

SEQ ID NO: 5262363 - DNA, 16 bp, Homo sapiens
atctttcatagttctg

SEQ ID NO: 5262364 - DNA, 20 bp, Homo sapiens
atctttcatagttctgttaa

SEQ ID NO: 5262365 - DNA, 17 bp, Homo sapiens
atctttcatgtcttgtc

SEQ ID NO: 5262366 - DNA, 20 bp, Homo sapiens
atctttcattaaaggcttct

SEQ ID NO: 5262367 - DNA, 17 bp, Homo sapiens
atctttccatatccata

SEQ ID NO: 5262368 - DNA, 19 bp, Homo sapiens
atctttccctccttggtga

SEQ ID NO: 5262369 - DNA, 17 bp, Homo sapiens
atctttccctcttcggt

SEQ ID NO: 5262370 - DNA, 22 bp, Homo sapiens
atctttcctccaaactcctgcc

SEQ ID NO: 5262371 - DNA, 16 bp, Homo sapiens
atctttccttgtctct

SEQ ID NO: 5262372 - DNA, 19 bp, Homo sapiens
atctttcctttgctctgga

SEQ ID NO: 5262373 - DNA, 16 bp, Homo sapiens
atctttcgcacagcag

SEQ ID NO: 5262374 - DNA, 21 bp, Homo sapiens
atctttcgttggttgtttctc

SEQ ID NO: 5262375 - DNA, 12 bp, Homo sapiens
atctttctagag

SEQ ID NO: 5262376 - DNA, 18 bp, Homo sapiens
atctttctatagccaact

SEQ ID NO: 5262377 - DNA, 21 bp, Homo sapiens
atctttctatgctgcttttat

SEQ ID NO: 5262378 - DNA, 23 bp, Homo sapiens
atctttctccctcaactgaaggg

SEQ ID NO: 5262379 - DNA, 13 bp, Homo sapiens
atctttctcctgg

SEQ ID NO: 5262380 - DNA, 22 bp, Homo sapiens
atctttctccttgaatatcttt

SEQ ID NO: 5262381 - DNA, 12 bp, Homo sapiens
atctttctctta

SEQ ID NO: 5262382 - DNA, 20 bp, Homo sapiens
atctttctcttacctgttat

SEQ ID NO: 5262383 - DNA, 15 bp, Homo sapiens
atctttctcttccct

SEQ ID NO: 5262384 - DNA, 13 bp, Homo sapiens
atctttctgcaga

SEQ ID NO: 5262385 - DNA, 11 bp, Homo sapiens
atctttctgga

SEQ ID NO: 5262386 - DNA, 19 bp, Homo sapiens
atctttcttctattttatt

SEQ ID NO: 5262387 - DNA, 17 bp, Homo sapiens
atctttctttacctgag

SEQ ID NO: 5262388 - DNA, 21 bp, Homo sapiens
atctttctttacctgagacca

SEQ ID NO: 5262389 - DNA, 23 bp, Homo sapiens
atctttctttccaaaacatttct

SEQ ID NO: 5262390 - DNA, 16 bp, Homo sapiens
atctttctttctctaa

SEQ ID NO: 5262391 - DNA, 17 bp, Homo sapiens
atctttctttcttagaa

SEQ ID NO: 5262392 - DNA, 19 bp, Homo sapiens
atctttgaaaactcataca

SEQ ID NO: 5262393 - DNA, 21 bp, Homo sapiens
atctttgaaaggttagagaat

SEQ ID NO: 5262394 - DNA, 17 bp, Homo sapiens
atctttgaaattatgta

SEQ ID NO: 5262395 - DNA, 15 bp, Homo sapiens
atctttgactgaagc

SEQ ID NO: 5262396 - DNA, 20 bp, Homo sapiens
atctttgagaatattataaa

SEQ ID NO: 5262397 - DNA, 13 bp, Homo sapiens
atctttgagccca

SEQ ID NO: 5262398 - DNA, 14 bp, Homo sapiens
atctttgagcccat

SEQ ID NO: 5262399 - DNA, 15 bp, Homo sapiens
atctttgaggtgagg

SEQ ID NO: 5262400 - DNA, 12 bp, Homo sapiens
atctttgagtgt

SEQ ID NO: 5262401 - DNA, 17 bp, Homo sapiens
atctttgcagacaggca

SEQ ID NO: 5262402 - DNA, 18 bp, Homo sapiens
atctttgcagacaggcaa

SEQ ID NO: 5262403 - DNA, 16 bp, Homo sapiens
atctttgcatcataga

SEQ ID NO: 5262404 - DNA, 22 bp, Homo sapiens
atctttgcatcatagaacagaa

SEQ ID NO: 5262405 - DNA, 23 bp, Homo sapiens
atctttgcatcatagaacagaaa

SEQ ID NO: 5262406 - DNA, 19 bp, Homo sapiens
atctttgccaagtaagagt

SEQ ID NO: 5262407 - DNA, 15 bp, Homo sapiens
atctttgccaccctc

SEQ ID NO: 5262408 - DNA, 20 bp, Homo sapiens
atctttgccttgggctgctc

SEQ ID NO: 5262409 - DNA, 10 bp, Homo sapiens
atctttgctg

SEQ ID NO: 5262410 - DNA, 16 bp, Homo sapiens
atctttgcttccttgc

SEQ ID NO: 5262411 - DNA, 15 bp, Homo sapiens
atctttgtaaattat

SEQ ID NO: 5262412 - DNA, 20 bp, Homo sapiens
atctttgtagcctaaagacc

SEQ ID NO: 5262413 - DNA, 14 bp, Homo sapiens
atctttgtataaat

SEQ ID NO: 5262414 - DNA, 23 bp, Homo sapiens
atctttgtataaataaatatttt

SEQ ID NO: 5262415 - DNA, 17 bp, Homo sapiens
atctttgtattcttcat

SEQ ID NO: 5262416 - DNA, 20 bp, Homo sapiens
atctttgtattcttcatgaa

SEQ ID NO: 5262417 - DNA, 18 bp, Homo sapiens
atctttgtgaacattctg

SEQ ID NO: 5262418 - DNA, 17 bp, Homo sapiens
atctttgtgataattta

SEQ ID NO: 5262419 - DNA, 15 bp, Homo sapiens
atctttgtggccaag

SEQ ID NO: 5262420 - DNA, 19 bp, Homo sapiens
atctttgtggccaaggagc

SEQ ID NO: 5262421 - DNA, 21 bp, Homo sapiens
atctttgtggtttagtttatt

SEQ ID NO: 5262422 - DNA, 13 bp, Homo sapiens
atctttgttaaaa

SEQ ID NO: 5262423 - DNA, 15 bp, Homo sapiens
atctttgttaaaata

SEQ ID NO: 5262424 - DNA, 17 bp, Homo sapiens
atctttgttacttcctt

SEQ ID NO: 5262425 - DNA, 14 bp, Homo sapiens
atcttttaaagaaa

SEQ ID NO: 5262426 - DNA, 20 bp, Homo sapiens
atcttttaaagtgttacttt

SEQ ID NO: 5262427 - DNA, 13 bp, Homo sapiens
atcttttaactgc

SEQ ID NO: 5262428 - DNA, 18 bp, Homo sapiens
atcttttaatcatgagcc

SEQ ID NO: 5262429 - DNA, 20 bp, Homo sapiens
atcttttaatcatgagcctg

SEQ ID NO: 5262430 - DNA, 21 bp, Homo sapiens
atcttttaatcatgagcctgt

SEQ ID NO: 5262431 - DNA, 15 bp, Homo sapiens
atcttttaattacag

SEQ ID NO: 5262432 - DNA, 21 bp, Homo sapiens
atcttttaattgtttccagga

SEQ ID NO: 5262433 - DNA, 15 bp, Homo sapiens
atcttttactgtgga

SEQ ID NO: 5262434 - DNA, 22 bp, Homo sapiens
atcttttactgtggaggtggct

SEQ ID NO: 5262435 - DNA, 16 bp, Homo sapiens
atcttttataatgatt

SEQ ID NO: 5262436 - DNA, 13 bp, Homo sapiens
atcttttatacaa

SEQ ID NO: 5262437 - DNA, 19 bp, Homo sapiens
atcttttatagacgctctt

SEQ ID NO: 5262438 - DNA, 14 bp, Homo sapiens
atcttttatttaag

SEQ ID NO: 5262439 - DNA, 18 bp, Homo sapiens
atcttttattttcctgtc

SEQ ID NO: 5262440 - DNA, 18 bp, Homo sapiens
atcttttattttggaact

SEQ ID NO: 5262441 - DNA, 20 bp, Homo sapiens
atcttttattttggaactat

SEQ ID NO: 5262442 - DNA, 22 bp, Homo sapiens
atcttttcaaaggtacttggat

SEQ ID NO: 5262443 - DNA, 13 bp, Homo sapiens
atcttttcacaaa

SEQ ID NO: 5262444 - DNA, 14 bp, Homo sapiens
atcttttcacaaat

SEQ ID NO: 5262445 - DNA, 22 bp, Homo sapiens
atcttttcataaagggttgaaa

SEQ ID NO: 5262446 - DNA, 14 bp, Homo sapiens
atcttttcatacat

SEQ ID NO: 5262447 - DNA, 22 bp, Homo sapiens
atcttttcattgaacagcaaag

SEQ ID NO: 5262448 - DNA, 22 bp, Homo sapiens
atcttttcatttaggtgaggaa

SEQ ID NO: 5262449 - DNA, 16 bp, Homo sapiens
atcttttcatttatca

SEQ ID NO: 5262450 - DNA, 16 bp, Homo sapiens
atcttttccatcctga

SEQ ID NO: 5262451 - DNA, 12 bp, Homo sapiens
atcttttcctga

SEQ ID NO: 5262452 - DNA, 22 bp, Homo sapiens
atcttttctaatcacagtgttg

SEQ ID NO: 5262453 - DNA, 13 bp, Homo sapiens
atcttttctacag

SEQ ID NO: 5262454 - DNA, 14 bp, Homo sapiens
atcttttctacagc

SEQ ID NO: 5262455 - DNA, 22 bp, Homo sapiens
atcttttctagagacacattgg

SEQ ID NO: 5262456 - DNA, 16 bp, Homo sapiens
atcttttctgaatctt

SEQ ID NO: 5262457 - DNA, 14 bp, Homo sapiens
atcttttcttgcct

SEQ ID NO: 5262458 - DNA, 13 bp, Homo sapiens
atcttttctttag

SEQ ID NO: 5262459 - DNA, 20 bp, Homo sapiens
atcttttctttagagaactg

SEQ ID NO: 5262460 - DNA, 17 bp, Homo sapiens
atcttttgaagctttct

SEQ ID NO: 5262461 - DNA, 22 bp, Homo sapiens
atcttttgaagggagaagacac

SEQ ID NO: 5262462 - DNA, 23 bp, Homo sapiens
atcttttgaagggagaagacact

SEQ ID NO: 5262463 - DNA, 23 bp, Homo sapiens
atcttttgatatgcatatttgtt

SEQ ID NO: 5262464 - DNA, 17 bp, Homo sapiens
atcttttgtaagacatt

SEQ ID NO: 5262465 - DNA, 18 bp, Homo sapiens
atcttttgtatatctaag

SEQ ID NO: 5262466 - DNA, 23 bp, Homo sapiens
atcttttgtgagatgtaattgtt

SEQ ID NO: 5262467 - DNA, 17 bp, Homo sapiens
atcttttgtgcctagat

SEQ ID NO: 5262468 - DNA, 22 bp, Homo sapiens
atcttttgttactcttgggaca

SEQ ID NO: 5262469 - DNA, 22 bp, Homo sapiens
atcttttgtttccttttttccc

SEQ ID NO: 5262470 - DNA, 18 bp, Homo sapiens
atctttttaaaaactctt

SEQ ID NO: 5262471 - DNA, 17 bp, Homo sapiens
atctttttaaaaatgat

SEQ ID NO: 5262472 - DNA, 15 bp, Homo sapiens
atctttttaaagctt

SEQ ID NO: 5262473 - DNA, 14 bp, Homo sapiens
atctttttacagtt

SEQ ID NO: 5262474 - DNA, 15 bp, Homo sapiens
atctttttacagttg

SEQ ID NO: 5262475 - DNA, 19 bp, Homo sapiens
atctttttacctttcatac

SEQ ID NO: 5262476 - DNA, 16 bp, Homo sapiens
atctttttatattctt

SEQ ID NO: 5262477 - DNA, 14 bp, Homo sapiens
atctttttatcatg

SEQ ID NO: 5262478 - DNA, 15 bp, Homo sapiens
atctttttatcatga

SEQ ID NO: 5262479 - DNA, 16 bp, Homo sapiens
atctttttatgcaaaa

SEQ ID NO: 5262480 - DNA, 18 bp, Homo sapiens
atctttttattgatgtgc

SEQ ID NO: 5262481 - DNA, 22 bp, Homo sapiens
atctttttattgatgtgcaaaa

SEQ ID NO: 5262482 - DNA, 23 bp, Homo sapiens
atctttttctagagttatcttct

SEQ ID NO: 5262483 - DNA, 20 bp, Homo sapiens
atctttttgaccctcattct

SEQ ID NO: 5262484 - DNA, 17 bp, Homo sapiens
atgtagcaaaacgcatg

SEQ ID NO: 5262485 - DNA, 20 bp, Homo sapiens
atgtagcaaaacgcatggag

SEQ ID NO: 5262486 - DNA, 13 bp, Homo sapiens
atgtagcacttac

SEQ ID NO: 5262487 - DNA, 21 bp, Homo sapiens
atgtagcacttacgtaaaaca

SEQ ID NO: 5262488 - DNA, 22 bp, Homo sapiens
atgtagcacttacgtaaaacat

SEQ ID NO: 5262489 - DNA, 15 bp, Homo sapiens
atgtagcagaataat

SEQ ID NO: 5262490 - DNA, 12 bp, Homo sapiens
atgtagcagcag

SEQ ID NO: 5262491 - DNA, 18 bp, Homo sapiens
atgtagcagcagcctact

SEQ ID NO: 5262492 - DNA, 15 bp, Homo sapiens
atgtagcatataaat

SEQ ID NO: 5262493 - DNA, 17 bp, Homo sapiens
atgtagcattaaatata

SEQ ID NO: 5262494 - DNA, 20 bp, Homo sapiens
atgtagcattaaatataaaa

SEQ ID NO: 5262495 - DNA, 18 bp, Homo sapiens
atgtagcattatgcaatt

SEQ ID NO: 5262496 - DNA, 17 bp, Homo sapiens
atgtagccagcagaact

SEQ ID NO: 5262497 - DNA, 14 bp, Homo sapiens
atgtagccagccca

SEQ ID NO: 5262498 - DNA, 16 bp, Homo sapiens
atgtagccagctgtgc

SEQ ID NO: 5262499 - DNA, 19 bp, Homo sapiens
atgtagccagttaaggaaa

SEQ ID NO: 5262500 - DNA, 23 bp, Homo sapiens
atgtagccatgaccttacatttc

SEQ ID NO: 5262501 - DNA, 16 bp, Homo sapiens
atgtagccatgggacc

SEQ ID NO: 5262502 - DNA, 18 bp, Homo sapiens
atgtagccccagtcagaa

SEQ ID NO: 5262503 - DNA, 23 bp, Homo sapiens
atgtagcccggggtggtccaatg

SEQ ID NO: 5262504 - DNA, 22 bp, Homo sapiens
atgtagccctctccaaatcaag

SEQ ID NO: 5262505 - DNA, 19 bp, Homo sapiens
atgtagccttagagcatct

SEQ ID NO: 5262506 - DNA, 22 bp, Homo sapiens
atgtagcctttactgtttgata

SEQ ID NO: 5262507 - DNA, 22 bp, Homo sapiens
atgtagctctttgtcagggagt

SEQ ID NO: 5262508 - DNA, 20 bp, Homo sapiens
atgtagctgtcgtacattga

SEQ ID NO: 5262509 - DNA, 19 bp, Homo sapiens
atgtagcttcagtcattaa

SEQ ID NO: 5262510 - DNA, 16 bp, Homo sapiens
atgtagcttccacctc

SEQ ID NO: 5262511 - DNA, 18 bp, Homo sapiens
atgtagcttccacctcat

SEQ ID NO: 5262512 - DNA, 21 bp, Homo sapiens
atgtagcttccacctcatgga

SEQ ID NO: 5262513 - DNA, 15 bp, Homo sapiens
atgtagcttcttctg

SEQ ID NO: 5262514 - DNA, 20 bp, Homo sapiens
atgtagcttcttctgaaaga

SEQ ID NO: 5262515 - DNA, 15 bp, Homo sapiens
atgtagcttgacaat

SEQ ID NO: 5262516 - DNA, 18 bp, Homo sapiens
atgtagcttttcaccttt

SEQ ID NO: 5262517 - DNA, 16 bp, Homo sapiens
atgtagcttttgggga

SEQ ID NO: 5262518 - DNA, 18 bp, Homo sapiens
atgtaggaaaattttctt

SEQ ID NO: 5262519 - DNA, 14 bp, Homo sapiens
atgtaggaagtagg

SEQ ID NO: 5262520 - DNA, 23 bp, Homo sapiens
atgtaggagctgccttggctcag

SEQ ID NO: 5262521 - DNA, 13 bp, Homo sapiens
atgtaggagctgg

SEQ ID NO: 5262522 - DNA, 12 bp, Homo sapiens
atgtaggaggga

SEQ ID NO: 5262523 - DNA, 21 bp, Homo sapiens
atgtaggctaagaaagaaatg

SEQ ID NO: 5262524 - DNA, 20 bp, Homo sapiens
atgtagggcaagaggatgaa

SEQ ID NO: 5262525 - DNA, 22 bp, Homo sapiens
atgtaggggaagagatgtttac

SEQ ID NO: 5262526 - DNA, 18 bp, Homo sapiens
atgtaggtaagactgtag

SEQ ID NO: 5262527 - DNA, 12 bp, Homo sapiens
atgtaggtcctc

SEQ ID NO: 5262528 - DNA, 15 bp, Homo sapiens
atgtaggtgagcctg

SEQ ID NO: 5262529 - DNA, 16 bp, Homo sapiens
atgtaggtgagcctgg

SEQ ID NO: 5262530 - DNA, 20 bp, Homo sapiens
atgtaggtgagcctgggcag

SEQ ID NO: 5262531 - DNA, 21 bp, Homo sapiens
atgtaggtgtctgcacccagg

SEQ ID NO: 5262532 - DNA, 13 bp, Homo sapiens
atgtagtaacact

SEQ ID NO: 5262533 - DNA, 20 bp, Homo sapiens
atgtagtaacactaatatat

SEQ ID NO: 5262534 - DNA, 22 bp, Homo sapiens
atgtagtaagcgtgattcactt

SEQ ID NO: 5262535 - DNA, 18 bp, Homo sapiens
atgtagtaattgacatgt

SEQ ID NO: 5262536 - DNA, 18 bp, Homo sapiens
atgtagtagcctttcctg

SEQ ID NO: 5262537 - DNA, 14 bp, Homo sapiens
atgtagtagtactt

SEQ ID NO: 5262538 - DNA, 16 bp, Homo sapiens
atgtagtataaagaaa

SEQ ID NO: 5262539 - DNA, 16 bp, Homo sapiens
atgtagtatgatgtaa

SEQ ID NO: 5262540 - DNA, 17 bp, Homo sapiens
atgtagtatgatgtaat

SEQ ID NO: 5262541 - DNA, 20 bp, Homo sapiens
atgtagtatgctatgattaa

SEQ ID NO: 5262542 - DNA, 19 bp, Homo sapiens
atgtagtattaaaagttgc

SEQ ID NO: 5262543 - DNA, 12 bp, Homo sapiens
atgtagtatttt

SEQ ID NO: 5262544 - DNA, 21 bp, Homo sapiens
atgtagtcagaattagctgct

SEQ ID NO: 5262545 - DNA, 15 bp, Homo sapiens
atgtagtcagttgca

SEQ ID NO: 5262546 - DNA, 16 bp, Homo sapiens
atgtagtgagtgtaga

SEQ ID NO: 5262547 - DNA, 12 bp, Homo sapiens
atgtagtgcagt

SEQ ID NO: 5262548 - DNA, 21 bp, Homo sapiens
atgtagtgcatttttaaactt

SEQ ID NO: 5262549 - DNA, 18 bp, Homo sapiens
atgtagtgccgctcttgg

SEQ ID NO: 5262550 - DNA, 17 bp, Homo sapiens
atgtagtgctctcagtc

SEQ ID NO: 5262551 - DNA, 22 bp, Homo sapiens
atgtagtgtgggaggctcctgt

SEQ ID NO: 5262552 - DNA, 18 bp, Homo sapiens
atgtagttctgccaggca

SEQ ID NO: 5262553 - DNA, 21 bp, Homo sapiens
atgtagttctttgttcctgct

SEQ ID NO: 5262554 - DNA, 22 bp, Homo sapiens
atgtagttctttgttcctgctt

SEQ ID NO: 5262555 - DNA, 20 bp, Homo sapiens
atgtagtttgaggaaatttg

SEQ ID NO: 5262556 - DNA, 16 bp, Homo sapiens
atgtagttttcttttt

SEQ ID NO: 5262557 - DNA, 13 bp, Homo sapiens
atgtataaaatgt

SEQ ID NO: 5262558 - DNA, 18 bp, Homo sapiens
atgtataaaatgtaacac

SEQ ID NO: 5262559 - DNA, 21 bp, Homo sapiens
atgtataaactttagagtaga

SEQ ID NO: 5262560 - DNA, 19 bp, Homo sapiens
atgtataaagattgtactt

SEQ ID NO: 5262561 - DNA, 17 bp, Homo sapiens
atgtataaagtgattga

SEQ ID NO: 5262562 - DNA, 14 bp, Homo sapiens
atgtataaatatac

SEQ ID NO: 5262563 - DNA, 14 bp, Homo sapiens
atgtataaattttt

SEQ ID NO: 5262564 - DNA, 23 bp, Homo sapiens
atgtataactaggagctttgact

SEQ ID NO: 5262565 - DNA, 20 bp, Homo sapiens
atgtataactttaacttctg

SEQ ID NO: 5262566 - DNA, 13 bp, Homo sapiens
atgtataatatat

SEQ ID NO: 5262567 - DNA, 23 bp, Homo sapiens
atgtataatatttttaattaaat

SEQ ID NO: 5262568 - DNA, 15 bp, Homo sapiens
atgtataatgtaatg

SEQ ID NO: 5262569 - DNA, 15 bp, Homo sapiens
atgtatacaatgcac

SEQ ID NO: 5262570 - DNA, 17 bp, Homo sapiens
atgtatacaatgcactt

SEQ ID NO: 5262571 - DNA, 19 bp, Homo sapiens
atgtatacacaaatatata

SEQ ID NO: 5262572 - DNA, 14 bp, Homo sapiens
atgtatacacacac

SEQ ID NO: 5262573 - DNA, 20 bp, Homo sapiens
atgtatacacacatatacat

SEQ ID NO: 5262574 - DNA, 19 bp, Homo sapiens
atgtatacaccaagtggta

SEQ ID NO: 5262575 - DNA, 16 bp, Homo sapiens
atgtatacgcacgcac

SEQ ID NO: 5262576 - DNA, 18 bp, Homo sapiens
atgtatacttaatactga

SEQ ID NO: 5262577 - DNA, 19 bp, Homo sapiens
atgtatacttatcttgctc

SEQ ID NO: 5262578 - DNA, 14 bp, Homo sapiens
atgtatacttgaaa

SEQ ID NO: 5262579 - DNA, 22 bp, Homo sapiens
atgtatagaaaataaaataaat

SEQ ID NO: 5262580 - DNA, 12 bp, Homo sapiens
atgtatagcttt

SEQ ID NO: 5262581 - DNA, 19 bp, Homo sapiens
atgtatagtgagtgtggct

SEQ ID NO: 5262582 - DNA, 14 bp, Homo sapiens
atgtatagtgtcta

SEQ ID NO: 5262583 - DNA, 16 bp, Homo sapiens
atgtatagttttgaat

SEQ ID NO: 5262584 - DNA, 14 bp, Homo sapiens
atgtatataaaaat

SEQ ID NO: 5262585 - DNA, 17 bp, Homo sapiens
atgtatataaaatgtgc

SEQ ID NO: 5262586 - DNA, 17 bp, Homo sapiens
atgtatataaacatgct

SEQ ID NO: 5262587 - DNA, 19 bp, Homo sapiens
atgtatataaactgggatg

SEQ ID NO: 5262588 - DNA, 15 bp, Homo sapiens
atgtatataagtact

SEQ ID NO: 5262589 - DNA, 13 bp, Homo sapiens
atgtatatacaca

SEQ ID NO: 5262590 - DNA, 16 bp, Homo sapiens
atgtatatacacatat

SEQ ID NO: 5262591 - DNA, 17 bp, Homo sapiens
atgtatatatattctca

SEQ ID NO: 5262592 - DNA, 16 bp, Homo sapiens
atgtatatatctatta

SEQ ID NO: 5262593 - DNA, 20 bp, Homo sapiens
atgtatatatctattattca

SEQ ID NO: 5262594 - DNA, 13 bp, Homo sapiens
atgtatatatgta

SEQ ID NO: 5262595 - DNA, 12 bp, Homo sapiens
atgtatatattt

SEQ ID NO: 5262596 - DNA, 14 bp, Homo sapiens
atgtatatatttag

SEQ ID NO: 5262597 - DNA, 16 bp, Homo sapiens
atgtatatatttatta

SEQ ID NO: 5262598 - DNA, 22 bp, Homo sapiens
atgtatatattttttaaaaatc

SEQ ID NO: 5262599 - DNA, 15 bp, Homo sapiens
atgtatatcagggtt

SEQ ID NO: 5262600 - DNA, 20 bp, Homo sapiens
atgtatatctgtaatatata

SEQ ID NO: 5262601 - DNA, 14 bp, Homo sapiens
atgtatatcttcta

SEQ ID NO: 5262602 - DNA, 15 bp, Homo sapiens
atgtatatctttgca

SEQ ID NO: 5262603 - DNA, 19 bp, Homo sapiens
atgtatatctttgcactga

SEQ ID NO: 5262604 - DNA, 22 bp, Homo sapiens
atgtatatgctactgtgttaca

SEQ ID NO: 5262605 - DNA, 13 bp, Homo sapiens
atgtatatgtata

SEQ ID NO: 5262606 - DNA, 17 bp, Homo sapiens
atgtatatgtatatcta

SEQ ID NO: 5262607 - DNA, 18 bp, Homo sapiens
atgtatatgttatttttg

SEQ ID NO: 5262608 - DNA, 16 bp, Homo sapiens
atgtatatgtttatat

SEQ ID NO: 5262609 - DNA, 16 bp, Homo sapiens
atgtatattaaaaaag

SEQ ID NO: 5262610 - DNA, 21 bp, Homo sapiens
atgtatattaaaaaagagaca

SEQ ID NO: 5262611 - DNA, 22 bp, Homo sapiens
atgtatattaaaaaagagacat

SEQ ID NO: 5262612 - DNA, 13 bp, Homo sapiens
atgtatatttgca

SEQ ID NO: 5262613 - DNA, 15 bp, Homo sapiens
atgtatatttgctgc

SEQ ID NO: 5262614 - DNA, 20 bp, Homo sapiens
atgtatatttgctgcaaaga

SEQ ID NO: 5262615 - DNA, 17 bp, Homo sapiens
atgtatattttatatga

SEQ ID NO: 5262616 - DNA, 21 bp, Homo sapiens
atgtatatttttgctaggagc

SEQ ID NO: 5262617 - DNA, 18 bp, Homo sapiens
atgtatatttttttaatt

SEQ ID NO: 5262618 - DNA, 20 bp, Homo sapiens
atgtatatttttttaattta

SEQ ID NO: 5262619 - DNA, 21 bp, Homo sapiens
atgtatatttttttaatttaa

SEQ ID NO: 5262620 - DNA, 20 bp, Homo sapiens
atgtatcagccagccttccc

SEQ ID NO: 5262621 - DNA, 13 bp, Homo sapiens
atgtatcaggaaa

SEQ ID NO: 5262622 - DNA, 21 bp, Homo sapiens
atgtatcaggaaatatatatg

SEQ ID NO: 5262623 - DNA, 17 bp, Homo sapiens
atgtatcagtgtccttt

SEQ ID NO: 5262624 - DNA, 20 bp, Homo sapiens
atgtatcagtgtcctttcca

SEQ ID NO: 5262625 - DNA, 17 bp, Homo sapiens
atgtatcatagaaatgt

SEQ ID NO: 5262626 - DNA, 12 bp, Homo sapiens
atgtatcatctg

SEQ ID NO: 5262627 - DNA, 14 bp, Homo sapiens
atgtatccagagga

SEQ ID NO: 5262628 - DNA, 15 bp, Homo sapiens
atgtatccagaggaa

SEQ ID NO: 5262629 - DNA, 21 bp, Homo sapiens
atgtatcccttctcacagcac

SEQ ID NO: 5262630 - DNA, 22 bp, Homo sapiens
atgtatcctgataaacattaaa

SEQ ID NO: 5262631 - DNA, 14 bp, Homo sapiens
atgtatcgcatatt

SEQ ID NO: 5262632 - DNA, 13 bp, Homo sapiens
atgtatcgctcct

SEQ ID NO: 5262633 - DNA, 17 bp, Homo sapiens
atgtatcgctcctattg

SEQ ID NO: 5262634 - DNA, 19 bp, Homo sapiens
atgtatcgggaagatttct

SEQ ID NO: 5262635 - DNA, 20 bp, Homo sapiens
atgtatctaatttcattcaa

SEQ ID NO: 5262636 - DNA, 17 bp, Homo sapiens
atgtatctacaatacat

SEQ ID NO: 5262637 - DNA, 15 bp, Homo sapiens
atgtatctacctcac

SEQ ID NO: 5262638 - DNA, 16 bp, Homo sapiens
atgtatctatttgtac

SEQ ID NO: 5262639 - DNA, 21 bp, Homo sapiens
atgtatctatttgtacaattt

SEQ ID NO: 5262640 - DNA, 14 bp, Homo sapiens
atgtatctgcatat

SEQ ID NO: 5262641 - DNA, 17 bp, Homo sapiens
atgtatctggttaatga

SEQ ID NO: 5262642 - DNA, 14 bp, Homo sapiens
atgtatctgtctac

SEQ ID NO: 5262643 - DNA, 23 bp, Homo sapiens
atgtatctgtctactttctcttg

SEQ ID NO: 5262644 - DNA, 19 bp, Homo sapiens
atgtatcttatagtcactc

SEQ ID NO: 5262645 - DNA, 13 bp, Homo sapiens
atgtatcttattt

SEQ ID NO: 5262646 - DNA, 19 bp, Homo sapiens
atgtatcttatttatatat

SEQ ID NO: 5262647 - DNA, 15 bp, Homo sapiens
atgtatctttactgg

SEQ ID NO: 5262648 - DNA, 20 bp, Homo sapiens
atgtatctttactggaaatg

SEQ ID NO: 5262649 - DNA, 13 bp, Homo sapiens
atgtatgaaggct

SEQ ID NO: 5262650 - DNA, 18 bp, Homo sapiens
atgtatgaatacagcagc

SEQ ID NO: 5262651 - DNA, 14 bp, Homo sapiens
atgtatgaattttg

SEQ ID NO: 5262652 - DNA, 16 bp, Homo sapiens
atgtatgaattttgta

SEQ ID NO: 5262653 - DNA, 18 bp, Homo sapiens
atgtatgaattttgtaag

SEQ ID NO: 5262654 - DNA, 15 bp, Homo sapiens
atgtatgagacagaa

SEQ ID NO: 5262655 - DNA, 19 bp, Homo sapiens
atgtatgaggaatttctgt

SEQ ID NO: 5262656 - DNA, 12 bp, Homo sapiens
atgtatgataaa

SEQ ID NO: 5262657 - DNA, 15 bp, Homo sapiens
atgtatgatctctct

SEQ ID NO: 5262658 - DNA, 15 bp, Homo sapiens
atgtatgcacacaca

SEQ ID NO: 5262659 - DNA, 14 bp, Homo sapiens
atgtatgcagctat

SEQ ID NO: 5262660 - DNA, 13 bp, Homo sapiens
atgtatgcataat

SEQ ID NO: 5262661 - DNA, 23 bp, Homo sapiens
atgtatgcctgcaatatgggaac

SEQ ID NO: 5262662 - DNA, 16 bp, Homo sapiens
atgtatgcttcataca

SEQ ID NO: 5262663 - DNA, 23 bp, Homo sapiens
atctttttgaccctcattcttta

SEQ ID NO: 5262664 - DNA, 15 bp, Homo sapiens
atctttttgtgtgca

SEQ ID NO: 5262665 - DNA, 16 bp, Homo sapiens
atctttttgtttttct

SEQ ID NO: 5262666 - DNA, 19 bp, Homo sapiens
atcttttttagcataaaat

SEQ ID NO: 5262667 - DNA, 23 bp, Homo sapiens
atcttttttagcataaaattttc

SEQ ID NO: 5262668 - DNA, 23 bp, Homo sapiens
atcttttttcctagtttttctaa

SEQ ID NO: 5262669 - DNA, 13 bp, Homo sapiens
atcttttttcctt

SEQ ID NO: 5262670 - DNA, 22 bp, Homo sapiens
atcttttttctaaacctgtgcc

SEQ ID NO: 5262671 - DNA, 16 bp, Homo sapiens
atctttttttaagtgt

SEQ ID NO: 5262672 - DNA, 17 bp, Homo sapiens
atcttttttttatataa

SEQ ID NO: 5262673 - DNA, 20 bp, Homo sapiens
atcttttttttatataaata

SEQ ID NO: 5262674 - DNA, 16 bp, Homo sapiens
atcttttttttttccc

SEQ ID NO: 5262675 - DNA, 15 bp, Homo sapiens
atgaaaaaaaaaggg

SEQ ID NO: 5262676 - DNA, 21 bp, Homo sapiens
atgaaaaaaggacaatttcaa

SEQ ID NO: 5262677 - DNA, 17 bp, Homo sapiens
atgaaaaaatatatatc

SEQ ID NO: 5262678 - DNA, 16 bp, Homo sapiens
atgaaaaaatgtatat

SEQ ID NO: 5262679 - DNA, 13 bp, Homo sapiens
atgaaaaacaacc

SEQ ID NO: 5262680 - DNA, 22 bp, Homo sapiens
atgaaaaacatcccaaacttta

SEQ ID NO: 5262681 - DNA, 23 bp, Homo sapiens
atgaaaaacatcccaaactttaa

SEQ ID NO: 5262682 - DNA, 15 bp, Homo sapiens
atgaaaaagaagaat

SEQ ID NO: 5262683 - DNA, 16 bp, Homo sapiens
atgaaaaagaagaatc

SEQ ID NO: 5262684 - DNA, 17 bp, Homo sapiens
atgaaaaagaagaatct

SEQ ID NO: 5262685 - DNA, 11 bp, Homo sapiens
atgaaaaagat

SEQ ID NO: 5262686 - DNA, 12 bp, Homo sapiens
atgaaaaagatt

SEQ ID NO: 5262687 - DNA, 23 bp, Homo sapiens
atgaaaaagattatttgtgcatt

SEQ ID NO: 5262688 - DNA, 14 bp, Homo sapiens
atgaaaaagcatgt

SEQ ID NO: 5262689 - DNA, 17 bp, Homo sapiens
atgaaaaagctgcttct

SEQ ID NO: 5262690 - DNA, 13 bp, Homo sapiens
atgaaaaatagca

SEQ ID NO: 5262691 - DNA, 14 bp, Homo sapiens
atgaaaaatctgaa

SEQ ID NO: 5262692 - DNA, 15 bp, Homo sapiens
atgaaaaatgaaaga

SEQ ID NO: 5262693 - DNA, 19 bp, Homo sapiens
atgaaaaatttaagcattg

SEQ ID NO: 5262694 - DNA, 22 bp, Homo sapiens
atgaaaaatttaagcattgttt

SEQ ID NO: 5262695 - DNA, 21 bp, Homo sapiens
atgaaaacaaaattccattac

SEQ ID NO: 5262696 - DNA, 11 bp, Homo sapiens
atgaaaacacc

SEQ ID NO: 5262697 - DNA, 11 bp, Homo sapiens
atgaaaacact

SEQ ID NO: 5262698 - DNA, 15 bp, Homo sapiens
atgaaaacagaatgt

SEQ ID NO: 5262699 - DNA, 20 bp, Homo sapiens
atgaaaacatggaacagtgt

SEQ ID NO: 5262700 - DNA, 18 bp, Homo sapiens
atgaaaacatgtactaca

SEQ ID NO: 5262701 - DNA, 11 bp, Homo sapiens
atgaaaacatt

SEQ ID NO: 5262702 - DNA, 18 bp, Homo sapiens
atgaaaacattcagagga

SEQ ID NO: 5262703 - DNA, 22 bp, Homo sapiens
atgaaaaccctcgatgttcatg

SEQ ID NO: 5262704 - DNA, 14 bp, Homo sapiens
atgaaaacctgcat

SEQ ID NO: 5262705 - DNA, 20 bp, Homo sapiens
atgaaaacgttttattgtgt

SEQ ID NO: 5262706 - DNA, 15 bp, Homo sapiens
atgaaaacttttgta

SEQ ID NO: 5262707 - DNA, 19 bp, Homo sapiens
atgaaaacttttgtaaatt

SEQ ID NO: 5262708 - DNA, 13 bp, Homo sapiens
atgaaaagacaag

SEQ ID NO: 5262709 - DNA, 16 bp, Homo sapiens
atgaaaagagaattac

SEQ ID NO: 5262710 - DNA, 13 bp, Homo sapiens
atgaaaagattta

SEQ ID NO: 5262711 - DNA, 11 bp, Homo sapiens
atgaaaagcaa

SEQ ID NO: 5262712 - DNA, 12 bp, Homo sapiens
atgaaaagcaac

SEQ ID NO: 5262713 - DNA, 13 bp, Homo sapiens
atgaaaagccata

SEQ ID NO: 5262714 - DNA, 12 bp, Homo sapiens
atgaaaagctac

SEQ ID NO: 5262715 - DNA, 23 bp, Homo sapiens
atgaaaagctttgtttgttcttg

SEQ ID NO: 5262716 - DNA, 21 bp, Homo sapiens
atgaaaaggatattatctacc

SEQ ID NO: 5262717 - DNA, 13 bp, Homo sapiens
atgaaaagttatt

SEQ ID NO: 5262718 - DNA, 22 bp, Homo sapiens
atgaaaagttatttatgctata

SEQ ID NO: 5262719 - DNA, 15 bp, Homo sapiens
atgaaaataaaataa

SEQ ID NO: 5262720 - DNA, 14 bp, Homo sapiens
atgaaaataaagaa

SEQ ID NO: 5262721 - DNA, 18 bp, Homo sapiens
atgaaaataactgaacca

SEQ ID NO: 5262722 - DNA, 21 bp, Homo sapiens
atgaaaataactgaaccaaat

SEQ ID NO: 5262723 - DNA, 17 bp, Homo sapiens
atgaaaataatctctga

SEQ ID NO: 5262724 - DNA, 13 bp, Homo sapiens
atgaaaatacaac

SEQ ID NO: 5262725 - DNA, 18 bp, Homo sapiens
atgaaaataccataggaa

SEQ ID NO: 5262726 - DNA, 22 bp, Homo sapiens
atgaaaatatagacattctcac

SEQ ID NO: 5262727 - DNA, 23 bp, Homo sapiens
atgaaaatattctgattggtctg

SEQ ID NO: 5262728 - DNA, 16 bp, Homo sapiens
atgaaaatatttaaag

SEQ ID NO: 5262729 - DNA, 18 bp, Homo sapiens
atgaaaatattttttaca

SEQ ID NO: 5262730 - DNA, 21 bp, Homo sapiens
atgaaaatcagcaacttctag

SEQ ID NO: 5262731 - DNA, 22 bp, Homo sapiens
atgaaaatcagttatattcttt

SEQ ID NO: 5262732 - DNA, 15 bp, Homo sapiens
atgaaaatcctacca

SEQ ID NO: 5262733 - DNA, 19 bp, Homo sapiens
atgaaaatcctaccaacct

SEQ ID NO: 5262734 - DNA, 18 bp, Homo sapiens
atgaaaatcctatatctg

SEQ ID NO: 5262735 - DNA, 23 bp, Homo sapiens
atgaaaatcctatatctgtttgt

SEQ ID NO: 5262736 - DNA, 20 bp, Homo sapiens
atgaaaatccttttaaccat

SEQ ID NO: 5262737 - DNA, 15 bp, Homo sapiens
atgaaaatgagccct

SEQ ID NO: 5262738 - DNA, 20 bp, Homo sapiens
atgaaaatgagccctggctc

SEQ ID NO: 5262739 - DNA, 18 bp, Homo sapiens
atgaaaatgagttgtgaa

SEQ ID NO: 5262740 - DNA, 23 bp, Homo sapiens
atgaaaatggctgaagaaacaca

SEQ ID NO: 5262741 - DNA, 21 bp, Homo sapiens
atgaaaatgtattcctttaaa

SEQ ID NO: 5262742 - DNA, 14 bp, Homo sapiens
atgaaaatgtccat

SEQ ID NO: 5262743 - DNA, 14 bp, Homo sapiens
atgaaaatgtcttg

SEQ ID NO: 5262744 - DNA, 15 bp, Homo sapiens
atgaaaatgtcttgt

SEQ ID NO: 5262745 - DNA, 14 bp, Homo sapiens
atgaaaattaagat

SEQ ID NO: 5262746 - DNA, 22 bp, Homo sapiens
atgaaaatttcacttgaaatta

SEQ ID NO: 5262747 - DNA, 13 bp, Homo sapiens
atgaaacaaacta

SEQ ID NO: 5262748 - DNA, 16 bp, Homo sapiens
atgaaacaaataatca

SEQ ID NO: 5262749 - DNA, 15 bp, Homo sapiens
atgaaacaaatatac

SEQ ID NO: 5262750 - DNA, 16 bp, Homo sapiens
atgaaacaaatatact

SEQ ID NO: 5262751 - DNA, 21 bp, Homo sapiens
atgaaacaaatatactcattt

SEQ ID NO: 5262752 - DNA, 15 bp, Homo sapiens
atgaaacaatcttcc

SEQ ID NO: 5262753 - DNA, 17 bp, Homo sapiens
atgaaacaatcttccaa

SEQ ID NO: 5262754 - DNA, 20 bp, Homo sapiens
atgaaacaatcttccaaaga

SEQ ID NO: 5262755 - DNA, 12 bp, Homo sapiens
atgaaacacagc

SEQ ID NO: 5262756 - DNA, 16 bp, Homo sapiens
atgaaacaccttctct

SEQ ID NO: 5262757 - DNA, 13 bp, Homo sapiens
atgaaacagaaac

SEQ ID NO: 5262758 - DNA, 15 bp, Homo sapiens
atgaaacagatgata

SEQ ID NO: 5262759 - DNA, 21 bp, Homo sapiens
atgaaacagatgataaatatt

SEQ ID NO: 5262760 - DNA, 13 bp, Homo sapiens
atgaaacagcagc

SEQ ID NO: 5262761 - DNA, 13 bp, Homo sapiens
atgaaacatatca

SEQ ID NO: 5262762 - DNA, 22 bp, Homo sapiens
atgaaacatcctatgaaatact

SEQ ID NO: 5262763 - DNA, 23 bp, Homo sapiens
atgaaacatcctatgaaatactt

SEQ ID NO: 5262764 - DNA, 21 bp, Homo sapiens
atgaaaccaactgttgacata

SEQ ID NO: 5262765 - DNA, 17 bp, Homo sapiens
atgaaaccgcattttgg

SEQ ID NO: 5262766 - DNA, 16 bp, Homo sapiens
atgaaaccgtccctga

SEQ ID NO: 5262767 - DNA, 14 bp, Homo sapiens
atgaaaccttcctc

SEQ ID NO: 5262768 - DNA, 19 bp, Homo sapiens
atgaaactaaagcaataga

SEQ ID NO: 5262769 - DNA, 21 bp, Homo sapiens
atgaaactaaagcaatagaaa

SEQ ID NO: 5262770 - DNA, 22 bp, Homo sapiens
atgaaactaaagcaatagaaac

SEQ ID NO: 5262771 - DNA, 23 bp, Homo sapiens
atgaaactaaagcaatagaaaca

SEQ ID NO: 5262772 - DNA, 18 bp, Homo sapiens
atgaaactcctgattttg

SEQ ID NO: 5262773 - DNA, 11 bp, Homo sapiens
atgaaactggt

SEQ ID NO: 5262774 - DNA, 19 bp, Homo sapiens
atgaaactggttcctacat

SEQ ID NO: 5262775 - DNA, 22 bp, Homo sapiens
atgaaactgtcataatggtgaa

SEQ ID NO: 5262776 - DNA, 20 bp, Homo sapiens
atgaaactgtgtattatttg

SEQ ID NO: 5262777 - DNA, 15 bp, Homo sapiens
atgaaacttaagaat

SEQ ID NO: 5262778 - DNA, 13 bp, Homo sapiens
atgaaacttctca

SEQ ID NO: 5262779 - DNA, 12 bp, Homo sapiens
atgaaacttgaa

SEQ ID NO: 5262780 - DNA, 19 bp, Homo sapiens
atgaaacttgtttcactga

SEQ ID NO: 5262781 - DNA, 14 bp, Homo sapiens
atgaaagaatatat

SEQ ID NO: 5262782 - DNA, 15 bp, Homo sapiens
atgaaagaatatcta

SEQ ID NO: 5262783 - DNA, 12 bp, Homo sapiens
atgaaagacaaa

SEQ ID NO: 5262784 - DNA, 12 bp, Homo sapiens
atgaaagactgt

SEQ ID NO: 5262785 - DNA, 19 bp, Homo sapiens
atgaaagagaaaatatata

SEQ ID NO: 5262786 - DNA, 21 bp, Homo sapiens
atgaaagagaaaatatatatt

SEQ ID NO: 5262787 - DNA, 12 bp, Homo sapiens
atgaaagattca

SEQ ID NO: 5262788 - DNA, 16 bp, Homo sapiens
atgaaagattccacag

SEQ ID NO: 5262789 - DNA, 23 bp, Homo sapiens
atgaaagatttttactaatatat

SEQ ID NO: 5262790 - DNA, 15 bp, Homo sapiens
atgaaagcaacaact

SEQ ID NO: 5262791 - DNA, 19 bp, Homo sapiens
atgaaagcaacaactttgt

SEQ ID NO: 5262792 - DNA, 23 bp, Homo sapiens
atgaaagcagcacacattgtgtt

SEQ ID NO: 5262793 - DNA, 17 bp, Homo sapiens
atgaaagcagtgaagca

SEQ ID NO: 5262794 - DNA, 19 bp, Homo sapiens
atgaaagcatggctaatag

SEQ ID NO: 5262795 - DNA, 18 bp, Homo sapiens
atgaaagcatgtggcatg

SEQ ID NO: 5262796 - DNA, 12 bp, Homo sapiens
atgaaagcattc

SEQ ID NO: 5262797 - DNA, 21 bp, Homo sapiens
atgaaagctgattactgtcaa

SEQ ID NO: 5262798 - DNA, 23 bp, Homo sapiens
atgaaagctgattactgtcaata

SEQ ID NO: 5262799 - DNA, 13 bp, Homo sapiens
atgaaagctgttt

SEQ ID NO: 5262800 - DNA, 15 bp, Homo sapiens
atgaaaggagagcat

SEQ ID NO: 5262801 - DNA, 17 bp, Homo sapiens
atgaaaggattctctaa

SEQ ID NO: 5262802 - DNA, 16 bp, Homo sapiens
atgaaaggcttttaaa

SEQ ID NO: 5262803 - DNA, 13 bp, Homo sapiens
atgaaagggaaac

SEQ ID NO: 5262804 - DNA, 15 bp, Homo sapiens
atgaaagggcccaga

SEQ ID NO: 5262805 - DNA, 18 bp, Homo sapiens
atgaaagggcccagagag

SEQ ID NO: 5262806 - DNA, 15 bp, Homo sapiens
atgaaaggtatgtag

SEQ ID NO: 5262807 - DNA, 13 bp, Homo sapiens
atgaaaggtgcca

SEQ ID NO: 5262808 - DNA, 22 bp, Homo sapiens
atgaaaggtgccatggaagagg

SEQ ID NO: 5262809 - DNA, 15 bp, Homo sapiens
atgaaagtagctgta

SEQ ID NO: 5262810 - DNA, 19 bp, Homo sapiens
atgaaagtcaaatttactt

SEQ ID NO: 5262811 - DNA, 20 bp, Homo sapiens
atgaaagtcaaatttacttt

SEQ ID NO: 5262812 - DNA, 19 bp, Homo sapiens
atgaaagtcaagtctacct

SEQ ID NO: 5262813 - DNA, 20 bp, Homo sapiens
atgaaagtctagaaataaaa

SEQ ID NO: 5262814 - DNA, 16 bp, Homo sapiens
atgaaagtgagacttt

SEQ ID NO: 5262815 - DNA, 23 bp, Homo sapiens
atgaaataaaaaaaaaaggatga

SEQ ID NO: 5262816 - DNA, 14 bp, Homo sapiens
atgaaataaaatta

SEQ ID NO: 5262817 - DNA, 24 bp, Homo sapiens
atgaaataaattctgacttatgaa

SEQ ID NO: 5262818 - DNA, 22 bp, Homo sapiens
atgaaataactccttcttgtag

SEQ ID NO: 5262819 - DNA, 20 bp, Homo sapiens
atgaaatacacaagtaaaca

SEQ ID NO: 5262820 - DNA, 23 bp, Homo sapiens
atgaaatactgagatgctgggct

SEQ ID NO: 5262821 - DNA, 20 bp, Homo sapiens
atgaaatagttattttaata

SEQ ID NO: 5262822 - DNA, 19 bp, Homo sapiens
atgaaatataaactgtgag

SEQ ID NO: 5262823 - DNA, 21 bp, Homo sapiens
atgaaatataaactgtgagat

SEQ ID NO: 5262824 - DNA, 21 bp, Homo sapiens
atgaaatataaattatctgaa

SEQ ID NO: 5262825 - DNA, 22 bp, Homo sapiens
atgaaatataaattatctgaat

SEQ ID NO: 5262826 - DNA, 23 bp, Homo sapiens
atgaaatatatattgtaaagaag

SEQ ID NO: 5262827 - DNA, 15 bp, Homo sapiens
atgaaatatatgtga

SEQ ID NO: 5262828 - DNA, 22 bp, Homo sapiens
atgaaatatattttctcttttt

SEQ ID NO: 5262829 - DNA, 13 bp, Homo sapiens
atgaaatatcaga

SEQ ID NO: 5262830 - DNA, 15 bp, Homo sapiens
atgaaatatctgtat

SEQ ID NO: 5262831 - DNA, 15 bp, Homo sapiens
atgaaatatgcatct

SEQ ID NO: 5262832 - DNA, 20 bp, Homo sapiens
atgaaatattatgttaaaac

SEQ ID NO: 5262833 - DNA, 17 bp, Homo sapiens
atgaaatattgctgtat

SEQ ID NO: 5262834 - DNA, 22 bp, Homo sapiens
atgaaatatttgcttatttata

SEQ ID NO: 5262835 - DNA, 15 bp, Homo sapiens
atgaaatattttgaa

SEQ ID NO: 5262836 - DNA, 16 bp, Homo sapiens
atgaaatattttgaat

SEQ ID NO: 5262837 - DNA, 21 bp, Homo sapiens
atgaaatccgtgaagtcacat

SEQ ID NO: 5262838 - DNA, 13 bp, Homo sapiens
atgaaatctattt

SEQ ID NO: 5262839 - DNA, 14 bp, Homo sapiens
atgaaatctatttt

SEQ ID NO: 5262840 - DNA, 17 bp, Homo sapiens
atgaaatctattttcag

SEQ ID NO: 5262841 - DNA, 16 bp, Homo sapiens
atgaaatctgtttgtt

SEQ ID NO: 5262842 - DNA, 20 bp, Homo sapiens
atgtatgcttcatacaggga

SEQ ID NO: 5262843 - DNA, 15 bp, Homo sapiens
atgtatgctttgaat

SEQ ID NO: 5262844 - DNA, 19 bp, Homo sapiens
atgtatggaaacacatact

SEQ ID NO: 5262845 - DNA, 18 bp, Homo sapiens
atgtatggaatacagtgt

SEQ ID NO: 5262846 - DNA, 21 bp, Homo sapiens
atgtatggaatacagtgttat

SEQ ID NO: 5262847 - DNA, 16 bp, Homo sapiens
atgtatggatatattt

SEQ ID NO: 5262848 - DNA, 13 bp, Homo sapiens
atgtatggcatgt

SEQ ID NO: 5262849 - DNA, 21 bp, Homo sapiens
atgtatgggtagggtaaatca

SEQ ID NO: 5262850 - DNA, 12 bp, Homo sapiens
atgtatggtgca

SEQ ID NO: 5262851 - DNA, 12 bp, Homo sapiens
atgtatgtaaaa

SEQ ID NO: 5262852 - DNA, 13 bp, Homo sapiens
atgtatgtaaaaa

SEQ ID NO: 5262853 - DNA, 13 bp, Homo sapiens
atgtatgtaaagt

SEQ ID NO: 5262854 - DNA, 15 bp, Homo sapiens
atgtatgtacaatac

SEQ ID NO: 5262855 - DNA, 17 bp, Homo sapiens
atgtatgtatcatcagt

SEQ ID NO: 5262856 - DNA, 21 bp, Homo sapiens
atgtatgtatgagacagaaac

SEQ ID NO: 5262857 - DNA, 16 bp, Homo sapiens
atgtatgtatgtatta

SEQ ID NO: 5262858 - DNA, 15 bp, Homo sapiens
atgtatgtcagtgct

SEQ ID NO: 5262859 - DNA, 17 bp, Homo sapiens
atgtatgtccattcact

SEQ ID NO: 5262860 - DNA, 18 bp, Homo sapiens
atgtatgtctgcaggtgt

SEQ ID NO: 5262861 - DNA, 18 bp, Homo sapiens
atgtatgtgccaattttg

SEQ ID NO: 5262862 - DNA, 17 bp, Homo sapiens
atgtatgtggatacagt

SEQ ID NO: 5262863 - DNA, 21 bp, Homo sapiens
atgtatgtggatacagtcatt

SEQ ID NO: 5262864 - DNA, 19 bp, Homo sapiens
atgtatgtggtatgtatat

SEQ ID NO: 5262865 - DNA, 11 bp, Homo sapiens
atgtatgtgta

SEQ ID NO: 5262866 - DNA, 16 bp, Homo sapiens
atgtatgtgtaagtat

SEQ ID NO: 5262867 - DNA, 15 bp, Homo sapiens
atgtatgtgtagtgt

SEQ ID NO: 5262868 - DNA, 19 bp, Homo sapiens
atgtatgtgtatatgttta

SEQ ID NO: 5262869 - DNA, 12 bp, Homo sapiens
atgtatgtgtca

SEQ ID NO: 5262870 - DNA, 13 bp, Homo sapiens
atgtatgtgtgaa

SEQ ID NO: 5262871 - DNA, 18 bp, Homo sapiens
atgtatgtgtgagtgtat

SEQ ID NO: 5262872 - DNA, 20 bp, Homo sapiens
atgtatgtgtgagtgtatgt

SEQ ID NO: 5262873 - DNA, 21 bp, Homo sapiens
atgtatgtgtgagtgtatgta

SEQ ID NO: 5262874 - DNA, 22 bp, Homo sapiens
atgtatgtgtgagtgtatgtat

SEQ ID NO: 5262875 - DNA, 21 bp, Homo sapiens
atgtatgtgtgtctattttgt

SEQ ID NO: 5262876 - DNA, 14 bp, Homo sapiens
atgtatgtgtgtgg

SEQ ID NO: 5262877 - DNA, 15 bp, Homo sapiens
atgtatgtgtttaga

SEQ ID NO: 5262878 - DNA, 13 bp, Homo sapiens
atgtatgttaatt

SEQ ID NO: 5262879 - DNA, 13 bp, Homo sapiens
atgtatgttacca

SEQ ID NO: 5262880 - DNA, 17 bp, Homo sapiens
atgtatgttgcatgaat

SEQ ID NO: 5262881 - DNA, 12 bp, Homo sapiens
atgtatgtttac

SEQ ID NO: 5262882 - DNA, 17 bp, Homo sapiens
atgtatgtttacactgt

SEQ ID NO: 5262883 - DNA, 19 bp, Homo sapiens
atgtatgtttacactgtca

SEQ ID NO: 5262884 - DNA, 20 bp, Homo sapiens
atgtatgtttacactgtcaa

SEQ ID NO: 5262885 - DNA, 19 bp, Homo sapiens
atgtatgtttggctctgct

SEQ ID NO: 5262886 - DNA, 19 bp, Homo sapiens
atgtattaaaatatcccaa

SEQ ID NO: 5262887 - DNA, 21 bp, Homo sapiens
atgtattaaacttttcattac

SEQ ID NO: 5262888 - DNA, 21 bp, Homo sapiens
atgtattaaattacatttgta

SEQ ID NO: 5262889 - DNA, 23 bp, Homo sapiens
atgtattaacactactcaaagca

SEQ ID NO: 5262890 - DNA, 23 bp, Homo sapiens
atgtattaacctacctgtgaatc

SEQ ID NO: 5262891 - DNA, 15 bp, Homo sapiens
atgtattaactgaaa

SEQ ID NO: 5262892 - DNA, 18 bp, Homo sapiens
atgtattaagccaaacat

SEQ ID NO: 5262893 - DNA, 22 bp, Homo sapiens
atgtattaagccaaacatgagt

SEQ ID NO: 5262894 - DNA, 19 bp, Homo sapiens
atgtattaatatctccata

SEQ ID NO: 5262895 - DNA, 16 bp, Homo sapiens
atgtattaatctgttt

SEQ ID NO: 5262896 - DNA, 16 bp, Homo sapiens
atgtattaatgtatgt

SEQ ID NO: 5262897 - DNA, 17 bp, Homo sapiens
atgtattagaagatttt

SEQ ID NO: 5262898 - DNA, 18 bp, Homo sapiens
atgtattagccagtcatt

SEQ ID NO: 5262899 - DNA, 18 bp, Homo sapiens
atgtattagctcactgaa

SEQ ID NO: 5262900 - DNA, 18 bp, Homo sapiens
atgtattagtatggttca

SEQ ID NO: 5262901 - DNA, 12 bp, Homo sapiens
atgtattagtga

SEQ ID NO: 5262902 - DNA, 13 bp, Homo sapiens
atgtattatcaca

SEQ ID NO: 5262903 - DNA, 14 bp, Homo sapiens
atgtattatcacat

SEQ ID NO: 5262904 - DNA, 17 bp, Homo sapiens
atgtattatcacatcaa

SEQ ID NO: 5262905 - DNA, 21 bp, Homo sapiens
atgtattatcacatcaagcat

SEQ ID NO: 5262906 - DNA, 15 bp, Homo sapiens
atgtattatgctgtt

SEQ ID NO: 5262907 - DNA, 14 bp, Homo sapiens
atgtattatggtga

SEQ ID NO: 5262908 - DNA, 12 bp, Homo sapiens
atgtattatgtc

SEQ ID NO: 5262909 - DNA, 13 bp, Homo sapiens
atgtattattctg

SEQ ID NO: 5262910 - DNA, 17 bp, Homo sapiens
atgtattatttataatt

SEQ ID NO: 5262911 - DNA, 17 bp, Homo sapiens
atgtattattttctata

SEQ ID NO: 5262912 - DNA, 16 bp, Homo sapiens
atgtattcccttgtat

SEQ ID NO: 5262913 - DNA, 18 bp, Homo sapiens
atgtattcccttgtattt

SEQ ID NO: 5262914 - DNA, 19 bp, Homo sapiens
atgtattcctatgacaaaa

SEQ ID NO: 5262915 - DNA, 18 bp, Homo sapiens
atgtattcctttaaaata

SEQ ID NO: 5262916 - DNA, 20 bp, Homo sapiens
atgtattcctttaaaatatt

SEQ ID NO: 5262917 - DNA, 20 bp, Homo sapiens
atgtattctagctaatgtaa

SEQ ID NO: 5262918 - DNA, 15 bp, Homo sapiens
atgtattctcttcta

SEQ ID NO: 5262919 - DNA, 18 bp, Homo sapiens
atgtattctgtaaaagaa

SEQ ID NO: 5262920 - DNA, 13 bp, Homo sapiens
atgtattctgtat

SEQ ID NO: 5262921 - DNA, 14 bp, Homo sapiens
atgtattgagatat

SEQ ID NO: 5262922 - DNA, 14 bp, Homo sapiens
atgtattgattaca

SEQ ID NO: 5262923 - DNA, 16 bp, Homo sapiens
atgtattgcacattgt

SEQ ID NO: 5262924 - DNA, 17 bp, Homo sapiens
atgtattgcacattgta

SEQ ID NO: 5262925 - DNA, 16 bp, Homo sapiens
atgtattggcatttat

SEQ ID NO: 5262926 - DNA, 11 bp, Homo sapiens
atgtattgtaa

SEQ ID NO: 5262927 - DNA, 19 bp, Homo sapiens
atgtattgtaaacatgtgt

SEQ ID NO: 5262928 - DNA, 21 bp, Homo sapiens
atgtattgtaaacatgtgttt

SEQ ID NO: 5262929 - DNA, 13 bp, Homo sapiens
atgtattgtacct

SEQ ID NO: 5262930 - DNA, 16 bp, Homo sapiens
atgtatttaactcaga

SEQ ID NO: 5262931 - DNA, 12 bp, Homo sapiens
atgtatttaaga

SEQ ID NO: 5262932 - DNA, 21 bp, Homo sapiens
atgtatttaagatgtacattt

SEQ ID NO: 5262933 - DNA, 21 bp, Homo sapiens
atgtatttaccaaaaattttg

SEQ ID NO: 5262934 - DNA, 19 bp, Homo sapiens
atgtatttagctacagctt

SEQ ID NO: 5262935 - DNA, 13 bp, Homo sapiens
atgtatttataat

SEQ ID NO: 5262936 - DNA, 14 bp, Homo sapiens
atgtatttataatt

SEQ ID NO: 5262937 - DNA, 20 bp, Homo sapiens
atgtatttataatttaaatg

SEQ ID NO: 5262938 - DNA, 23 bp, Homo sapiens
atgtatttataatttaaatgata

SEQ ID NO: 5262939 - DNA, 16 bp, Homo sapiens
atgtatttatgtgtat

SEQ ID NO: 5262940 - DNA, 22 bp, Homo sapiens
atgtatttattcctctgtccta

SEQ ID NO: 5262941 - DNA, 18 bp, Homo sapiens
atgtatttatttaaaaga

SEQ ID NO: 5262942 - DNA, 14 bp, Homo sapiens
atgtatttcctgaa

SEQ ID NO: 5262943 - DNA, 22 bp, Homo sapiens
atgtatttctttagaacaacat

SEQ ID NO: 5262944 - DNA, 14 bp, Homo sapiens
atgtatttgcaagg

SEQ ID NO: 5262945 - DNA, 10 bp, Homo sapiens
atgtatttgt

SEQ ID NO: 5262946 - DNA, 19 bp, Homo sapiens
atgtatttgtagtgttatt

SEQ ID NO: 5262947 - DNA, 21 bp, Homo sapiens
atgtatttgtagtgttattgc

SEQ ID NO: 5262948 - DNA, 20 bp, Homo sapiens
atgtatttgttatatataat

SEQ ID NO: 5262949 - DNA, 21 bp, Homo sapiens
atgtatttgttatatataata

SEQ ID NO: 5262950 - DNA, 18 bp, Homo sapiens
atgtatttgttcatgttt

SEQ ID NO: 5262951 - DNA, 19 bp, Homo sapiens
atgtatttgttcatgtttg

SEQ ID NO: 5262952 - DNA, 16 bp, Homo sapiens
atgtattttaataaca

SEQ ID NO: 5262953 - DNA, 23 bp, Homo sapiens
atgtattttaataacatatctaa

SEQ ID NO: 5262954 - DNA, 12 bp, Homo sapiens
atgtattttatg

SEQ ID NO: 5262955 - DNA, 14 bp, Homo sapiens
atgtattttatgta

SEQ ID NO: 5262956 - DNA, 15 bp, Homo sapiens
atgtattttatgtat

SEQ ID NO: 5262957 - DNA, 18 bp, Homo sapiens
atgtattttatgttatat

SEQ ID NO: 5262958 - DNA, 14 bp, Homo sapiens
atgtattttattgt

SEQ ID NO: 5262959 - DNA, 21 bp, Homo sapiens
atgtattttcaataaagaaaa

SEQ ID NO: 5262960 - DNA, 15 bp, Homo sapiens
atgtattttcatagt

SEQ ID NO: 5262961 - DNA, 13 bp, Homo sapiens
atgtattttccaa

SEQ ID NO: 5262962 - DNA, 13 bp, Homo sapiens
atgtattttccta

SEQ ID NO: 5262963 - DNA, 12 bp, Homo sapiens
atgtattttgaa

SEQ ID NO: 5262964 - DNA, 14 bp, Homo sapiens
atgtattttgaaaa

SEQ ID NO: 5262965 - DNA, 19 bp, Homo sapiens
atgtattttgaaaacactt

SEQ ID NO: 5262966 - DNA, 15 bp, Homo sapiens
atgtattttggaaga

SEQ ID NO: 5262967 - DNA, 19 bp, Homo sapiens
atgtattttggaagacata

SEQ ID NO: 5262968 - DNA, 22 bp, Homo sapiens
atgtattttggaagacatatat

SEQ ID NO: 5262969 - DNA, 16 bp, Homo sapiens
atgtattttgtaaact

SEQ ID NO: 5262970 - DNA, 12 bp, Homo sapiens
atgtattttgtg

SEQ ID NO: 5262971 - DNA, 14 bp, Homo sapiens
atgtattttgtgag

SEQ ID NO: 5262972 - DNA, 16 bp, Homo sapiens
atgtattttgtgagtt

SEQ ID NO: 5262973 - DNA, 19 bp, Homo sapiens
atgtattttgtgagtttgt

SEQ ID NO: 5262974 - DNA, 15 bp, Homo sapiens
atgtatttttctaca

SEQ ID NO: 5262975 - DNA, 16 bp, Homo sapiens
atgtatttttctacat

SEQ ID NO: 5262976 - DNA, 23 bp, Homo sapiens
atgtatttttctacattattgct

SEQ ID NO: 5262977 - DNA, 20 bp, Homo sapiens
atgtatttttgatgtatata

SEQ ID NO: 5262978 - DNA, 17 bp, Homo sapiens
atgtatttttgtcaatt

SEQ ID NO: 5262979 - DNA, 13 bp, Homo sapiens
atgtcaaaaatat

SEQ ID NO: 5262980 - DNA, 14 bp, Homo sapiens
atgtcaaaaatatt

SEQ ID NO: 5262981 - DNA, 16 bp, Homo sapiens
atgtcaaaaatatttt

SEQ ID NO: 5262982 - DNA, 20 bp, Homo sapiens
atgtcaaaagtagaactttg

SEQ ID NO: 5262983 - DNA, 22 bp, Homo sapiens
atgtcaaaagtagaactttgta

SEQ ID NO: 5262984 - DNA, 13 bp, Homo sapiens
atgtcaaaatcat

SEQ ID NO: 5262985 - DNA, 15 bp, Homo sapiens
atgtcaaacagtgcc

SEQ ID NO: 5262986 - DNA, 16 bp, Homo sapiens
atgtcaaacagtgcca

SEQ ID NO: 5262987 - DNA, 19 bp, Homo sapiens
atgtcaaacagtgccaaat

SEQ ID NO: 5262988 - DNA, 20 bp, Homo sapiens
atgtcaaacagtgccaaatg

SEQ ID NO: 5262989 - DNA, 17 bp, Homo sapiens
atgtcaaagctgcatgt

SEQ ID NO: 5262990 - DNA, 22 bp, Homo sapiens
atgtcaaaggtcgggacagctg

SEQ ID NO: 5262991 - DNA, 19 bp, Homo sapiens
atgtcaaagtgaaagacat

SEQ ID NO: 5262992 - DNA, 23 bp, Homo sapiens
atgtcaaagtgaaagacatttca

SEQ ID NO: 5262993 - DNA, 17 bp, Homo sapiens
atgtcaaataaagcaaa

SEQ ID NO: 5262994 - DNA, 19 bp, Homo sapiens
atgtcaaatatctcagagg

SEQ ID NO: 5262995 - DNA, 19 bp, Homo sapiens
atgtcaaatatttagatgt

SEQ ID NO: 5262996 - DNA, 20 bp, Homo sapiens
atgtcaaatggagctgaatt

SEQ ID NO: 5262997 - DNA, 14 bp, Homo sapiens
atgtcaaatgtgaa

SEQ ID NO: 5262998 - DNA, 12 bp, Homo sapiens
atgtcaaattga

SEQ ID NO: 5262999 - DNA, 15 bp, Homo sapiens
atgtcaaattgtcag

SEQ ID NO: 5263000 - DNA, 13 bp, Homo sapiens
atgtcaacaccag

SEQ ID NO: 5263001 - DNA, 23 bp, Homo sapiens
atgtcaaccaggtccagatgtgc

SEQ ID NO: 5263002 - DNA, 19 bp, Homo sapiens
atgtcaaccttgtgtgagt

SEQ ID NO: 5263003 - DNA, 21 bp, Homo sapiens
atgtcaactgtgtctctgaat

SEQ ID NO: 5263004 - DNA, 17 bp, Homo sapiens
atgtcaacttctggctc

SEQ ID NO: 5263005 - DNA, 18 bp, Homo sapiens
atgtcaacttctggctcc

SEQ ID NO: 5263006 - DNA, 19 bp, Homo sapiens
atgtcaacttctggctcct

SEQ ID NO: 5263007 - DNA, 16 bp, Homo sapiens
atgtcaactttatgca

SEQ ID NO: 5263008 - DNA, 20 bp, Homo sapiens
atgtcaacttttgactaaga

SEQ ID NO: 5263009 - DNA, 22 bp, Homo sapiens
atgtcaacttttgactaagaat

SEQ ID NO: 5263010 - DNA, 15 bp, Homo sapiens
atgtcaagattcagc

SEQ ID NO: 5263011 - DNA, 18 bp, Homo sapiens
atgtcaagattcagctag

SEQ ID NO: 5263012 - DNA, 18 bp, Homo sapiens
atgtcaaggactcctgtc

SEQ ID NO: 5263013 - DNA, 22 bp, Homo sapiens
atgtcaagggttcaagattgtt

SEQ ID NO: 5263014 - DNA, 23 bp, Homo sapiens
atgtcaataaacaacagctgaag

SEQ ID NO: 5263015 - DNA, 16 bp, Homo sapiens
atgtcaataacagtat

SEQ ID NO: 5263016 - DNA, 19 bp, Homo sapiens
atgtcaatcaagatgggtg

SEQ ID NO: 5263017 - DNA, 19 bp, Homo sapiens
atgtcaatcttaagaggat

SEQ ID NO: 5263018 - DNA, 23 bp, Homo sapiens
atgtcaatgaccattcaattagt

SEQ ID NO: 5263019 - DNA, 21 bp, Homo sapiens
atgtcaatgctatggactgca

SEQ ID NO: 5263020 - DNA, 20 bp, Homo sapiens
atgtcaattgatatttctgt

SEQ ID NO: 5263021 - DNA, 16 bp, Homo sapiens
atgtcaatttctgtgt

SEQ ID NO: 5263022 - DNA, 15 bp, Homo sapiens
atgtcacaacatggt

SEQ ID NO: 5263023 - DNA, 14 bp, Homo sapiens
atgtcacaacctct

SEQ ID NO: 5263024 - DNA, 22 bp, Homo sapiens
atgtcacaacctctctgatctt

SEQ ID NO: 5263025 - DNA, 17 bp, Homo sapiens
atgtcacaataaaacaa

SEQ ID NO: 5263026 - DNA, 13 bp, Homo sapiens
atgtcacaggcag

SEQ ID NO: 5263027 - DNA, 15 bp, Homo sapiens
atgtcacaggcaggt

SEQ ID NO: 5263028 - DNA, 12 bp, Homo sapiens
atgtcacagggc

SEQ ID NO: 5263029 - DNA, 23 bp, Homo sapiens
atgtcacagtccaaccagaaaca

SEQ ID NO: 5263030 - DNA, 17 bp, Homo sapiens
atgtcacagtttgttca

SEQ ID NO: 5263031 - DNA, 18 bp, Homo sapiens
atgtcacagtttgttcag

SEQ ID NO: 5263032 - DNA, 19 bp, Homo sapiens
atgtcaccaccttcccagc

SEQ ID NO: 5263033 - DNA, 21 bp, Homo sapiens
atgtcaccataatgaacaatt

SEQ ID NO: 5263034 - DNA, 20 bp, Homo sapiens
atgtcaccggatcctgggtg

SEQ ID NO: 5263035 - DNA, 17 bp, Homo sapiens
atgtcacctcagctgat

SEQ ID NO: 5263036 - DNA, 18 bp, Homo sapiens
atgtcacgaacttgaaag

SEQ ID NO: 5263037 - DNA, 18 bp, Homo sapiens
atgtcacgtcttgaaaag

SEQ ID NO: 5263038 - DNA, 22 bp, Homo sapiens
atgtcactaaagcaggcctttt

SEQ ID NO: 5263039 - DNA, 15 bp, Homo sapiens
atgtcactatatctt

SEQ ID NO: 5263040 - DNA, 15 bp, Homo sapiens
atgtcactcagaaag

SEQ ID NO: 5263041 - DNA, 19 bp, Homo sapiens
atgtcactctggtcccttt

SEQ ID NO: 5263042 - DNA, 15 bp, Homo sapiens
atgtcactgaagtga

SEQ ID NO: 5263043 - DNA, 20 bp, Homo sapiens
atgtcactgaagtgattgaa

SEQ ID NO: 5263044 - DNA, 16 bp, Homo sapiens
atgtcactgttataaa

SEQ ID NO: 5263045 - DNA, 18 bp, Homo sapiens
atgtcactgttataaatt

SEQ ID NO: 5263046 - DNA, 23 bp, Homo sapiens
atgtcactgttataaattttgta

SEQ ID NO: 5263047 - DNA, 17 bp, Homo sapiens
atgtcagaaaaaatatg

SEQ ID NO: 5263048 - DNA, 16 bp, Homo sapiens
atgtcagaaacaatga

SEQ ID NO: 5263049 - DNA, 13 bp, Homo sapiens
atgtcagaaactc

SEQ ID NO: 5263050 - DNA, 19 bp, Homo sapiens
atgtcagacaataccactg

SEQ ID NO: 5263051 - DNA, 13 bp, Homo sapiens
atgtcagacacag

SEQ ID NO: 5263052 - DNA, 21 bp, Homo sapiens
atgtcagacacagattggcca

SEQ ID NO: 5263053 - DNA, 21 bp, Homo sapiens
atgtcagacatgaaaactatt

SEQ ID NO: 5263054 - DNA, 22 bp, Homo sapiens
atgtcagactttgctgcatttt

SEQ ID NO: 5263055 - DNA, 18 bp, Homo sapiens
atgtcagagctgttataa

SEQ ID NO: 5263056 - DNA, 22 bp, Homo sapiens
atgtcagaggaccccagggtgg

SEQ ID NO: 5263057 - DNA, 22 bp, Homo sapiens
atgtcagataagtgtaaataga

SEQ ID NO: 5263058 - DNA, 23 bp, Homo sapiens
atgtcagataagtgtaaatagaa

SEQ ID NO: 5263059 - DNA, 16 bp, Homo sapiens
atgtcagatacaatgt

SEQ ID NO: 5263060 - DNA, 21 bp, Homo sapiens
atgtcagatgcgtgcccagct

SEQ ID NO: 5263061 - DNA, 15 bp, Homo sapiens
atgtcagatttctgg

SEQ ID NO: 5263062 - DNA, 23 bp, Homo sapiens
atgtcagcaaaaagcaaaatcat

SEQ ID NO: 5263063 - DNA, 12 bp, Homo sapiens
atgtcagcaatt

SEQ ID NO: 5263064 - DNA, 19 bp, Homo sapiens
atgtcagcagacacacatg

SEQ ID NO: 5263065 - DNA, 15 bp, Homo sapiens
atgtcagcagctctg

SEQ ID NO: 5263066 - DNA, 20 bp, Homo sapiens
atgtcagcagttgctggtaa

SEQ ID NO: 5263067 - DNA, 22 bp, Homo sapiens
atgtcagcagttgctggtaaaa

SEQ ID NO: 5263068 - DNA, 17 bp, Homo sapiens
atgtcagccactgtgat

SEQ ID NO: 5263069 - DNA, 21 bp, Homo sapiens
atgtcagcctcatgccccagg

SEQ ID NO: 5263070 - DNA, 17 bp, Homo sapiens
atgtcagcctttgttaa

SEQ ID NO: 5263071 - DNA, 16 bp, Homo sapiens
atgtcagctgctgttg

SEQ ID NO: 5263072 - DNA, 13 bp, Homo sapiens
atgtcagcttccc

SEQ ID NO: 5263073 - DNA, 14 bp, Homo sapiens
atgtcagcttccca

SEQ ID NO: 5263074 - DNA, 17 bp, Homo sapiens
atgtcagcttcccagcc

SEQ ID NO: 5263075 - DNA, 22 bp, Homo sapiens
atgtcaggaatttaagaatttg

SEQ ID NO: 5263076 - DNA, 20 bp, Homo sapiens
atgtcagggtacctggggcc

SEQ ID NO: 5263077 - DNA, 17 bp, Homo sapiens
atgtcagtaccttcaaa

SEQ ID NO: 5263078 - DNA, 17 bp, Homo sapiens
atgtcagtagtgcctgt

SEQ ID NO: 5263079 - DNA, 21 bp, Homo sapiens
atgtcagtagtgcctgtgatc

SEQ ID NO: 5263080 - DNA, 23 bp, Homo sapiens
atgtcagtagtgctaatgcattt

SEQ ID NO: 5263081 - DNA, 13 bp, Homo sapiens
atgtcagtatttc

SEQ ID NO: 5263082 - DNA, 16 bp, Homo sapiens
atgtcagtatttcaac

SEQ ID NO: 5263083 - DNA, 18 bp, Homo sapiens
atgtcagtatttcaactg

SEQ ID NO: 5263084 - DNA, 21 bp, Homo sapiens
atgtcagtatttcaactgctg

SEQ ID NO: 5263085 - DNA, 22 bp, Homo sapiens
atgtcagtatttcaactgctgt

SEQ ID NO: 5263086 - DNA, 22 bp, Homo sapiens
atgtcagtctacaggcctttca

SEQ ID NO: 5263087 - DNA, 21 bp, Homo sapiens
atgtcagtctgcttagaaata

SEQ ID NO: 5263088 - DNA, 22 bp, Homo sapiens
atgtcagtctgcttagaaataa

SEQ ID NO: 5263089 - DNA, 14 bp, Homo sapiens
atgtcagtctgtcc

SEQ ID NO: 5263090 - DNA, 23 bp, Homo sapiens
atgtcagtgctataaatgccaga

SEQ ID NO: 5263091 - DNA, 13 bp, Homo sapiens
atgtcagtgtgac

SEQ ID NO: 5263092 - DNA, 13 bp, Homo sapiens
atgtcagtgttca

SEQ ID NO: 5263093 - DNA, 22 bp, Homo sapiens
atgtcagttataataacctggt

SEQ ID NO: 5263094 - DNA, 14 bp, Homo sapiens
atgtcagttctgat

SEQ ID NO: 5263095 - DNA, 16 bp, Homo sapiens
atgtcagttgttattt

SEQ ID NO: 5263096 - DNA, 15 bp, Homo sapiens
atgtcataaagaaga

SEQ ID NO: 5263097 - DNA, 17 bp, Homo sapiens
atgtcataaatgtcaca

SEQ ID NO: 5263098 - DNA, 12 bp, Homo sapiens
atgtcataaatt

SEQ ID NO: 5263099 - DNA, 17 bp, Homo sapiens
atgtcatacagagaagt

SEQ ID NO: 5263100 - DNA, 18 bp, Homo sapiens
atgtcatacagagaagtc

SEQ ID NO: 5263101 - DNA, 21 bp, Homo sapiens
atgtcatactctgtgtaatct

SEQ ID NO: 5263102 - DNA, 22 bp, Homo sapiens
atgtcatagaggctatcctgga

SEQ ID NO: 5263103 - DNA, 19 bp, Homo sapiens
atgtcatagccaaagccag

SEQ ID NO: 5263104 - DNA, 19 bp, Homo sapiens
atgtcatagtcttgaaatg

SEQ ID NO: 5263105 - DNA, 21 bp, Homo sapiens
atgtcatattggcagttggag

SEQ ID NO: 5263106 - DNA, 21 bp, Homo sapiens
atgtcatattttcctttatgt

SEQ ID NO: 5263107 - DNA, 16 bp, Homo sapiens
atgtcatattttgcca

SEQ ID NO: 5263108 - DNA, 22 bp, Homo sapiens
atgtcatcaaatattaccaaaa

SEQ ID NO: 5263109 - DNA, 22 bp, Homo sapiens
atgtcatccccttgtgtcagag

SEQ ID NO: 5263110 - DNA, 20 bp, Homo sapiens
atgtcatctaaccattaagt

SEQ ID NO: 5263111 - DNA, 12 bp, Homo sapiens
atgtcatcttga

SEQ ID NO: 5263112 - DNA, 14 bp, Homo sapiens
atgtcatcttgagc

SEQ ID NO: 5263113 - DNA, 15 bp, Homo sapiens
atgtcatcttgagct

SEQ ID NO: 5263114 - DNA, 14 bp, Homo sapiens
atgtcatgattgcc

SEQ ID NO: 5263115 - DNA, 22 bp, Homo sapiens
atgtcatgcctcactttcttct

SEQ ID NO: 5263116 - DNA, 23 bp, Homo sapiens
atgtcatgcctcactttcttcta

SEQ ID NO: 5263117 - DNA, 13 bp, Homo sapiens
atgtcatgctgcc

SEQ ID NO: 5263118 - DNA, 14 bp, Homo sapiens
atgtcatgctgcct

SEQ ID NO: 5263119 - DNA, 16 bp, Homo sapiens
atgtcatgctgcctta

SEQ ID NO: 5263120 - DNA, 17 bp, Homo sapiens
atgtcatggatcgtgtt

SEQ ID NO: 5263121 - DNA, 21 bp, Homo sapiens
atgtcatggccttgaaacagt

SEQ ID NO: 5263122 - DNA, 16 bp, Homo sapiens
atgtcatgtctgcttg

SEQ ID NO: 5263123 - DNA, 17 bp, Homo sapiens
atgtcatgtctgcttgt

SEQ ID NO: 5263124 - DNA, 14 bp, Homo sapiens
atgtcatgtgccac

SEQ ID NO: 5263125 - DNA, 20 bp, Homo sapiens
atgtcattaaaataaataaa

SEQ ID NO: 5263126 - DNA, 16 bp, Homo sapiens
atgtcattaaacatga

SEQ ID NO: 5263127 - DNA, 15 bp, Homo sapiens
atgtcattaatgtgt

SEQ ID NO: 5263128 - DNA, 17 bp, Homo sapiens
atgtcattaatgtgttg

SEQ ID NO: 5263129 - DNA, 16 bp, Homo sapiens
atgtcattatgacatt

SEQ ID NO: 5263130 - DNA, 16 bp, Homo sapiens
atgtcattatgtagaa

SEQ ID NO: 5263131 - DNA, 15 bp, Homo sapiens
atgtcattatttatt

SEQ ID NO: 5263132 - DNA, 19 bp, Homo sapiens
atgtcattatttattgtta

SEQ ID NO: 5263133 - DNA, 13 bp, Homo sapiens
atgtcattgctaa

SEQ ID NO: 5263134 - DNA, 15 bp, Homo sapiens
atgtcattgctaaaa

SEQ ID NO: 5263135 - DNA, 13 bp, Homo sapiens
atgtcattgtgtt

SEQ ID NO: 5263136 - DNA, 13 bp, Homo sapiens
atgtcatttcata

SEQ ID NO: 5263137 - DNA, 16 bp, Homo sapiens
atgtcatttcatacaa

SEQ ID NO: 5263138 - DNA, 12 bp, Homo sapiens
atgtcatttcta

SEQ ID NO: 5263139 - DNA, 14 bp, Homo sapiens
atgtcatttctact

SEQ ID NO: 5263140 - DNA, 20 bp, Homo sapiens
atgtcatttctactttgact

SEQ ID NO: 5263141 - DNA, 12 bp, Homo sapiens
atgtcatttctc

SEQ ID NO: 5263142 - DNA, 14 bp, Homo sapiens
atgtcatttgcaca

SEQ ID NO: 5263143 - DNA, 18 bp, Homo sapiens
atgtcatttgcacacaaa

SEQ ID NO: 5263144 - DNA, 16 bp, Homo sapiens
atgtcatttgctaatg

SEQ ID NO: 5263145 - DNA, 19 bp, Homo sapiens
atgtcattttcagatcctt

SEQ ID NO: 5263146 - DNA, 19 bp, Homo sapiens
atgtcatttttaatgtatc

SEQ ID NO: 5263147 - DNA, 20 bp, Homo sapiens
atgtcatttttaatgtatct

SEQ ID NO: 5263148 - DNA, 22 bp, Homo sapiens
atgtcatttttaatgtatctat

SEQ ID NO: 5263149 - DNA, 13 bp, Homo sapiens
atgtccaaaatgt

SEQ ID NO: 5263150 - DNA, 15 bp, Homo sapiens
atgtccaaaatttat

SEQ ID NO: 5263151 - DNA, 22 bp, Homo sapiens
atgtccaaacccactcatgact

SEQ ID NO: 5263152 - DNA, 18 bp, Homo sapiens
atgtccaaacccatcttc

SEQ ID NO: 5263153 - DNA, 21 bp, Homo sapiens
atgtccaaacttaacagatca

SEQ ID NO: 5263154 - DNA, 22 bp, Homo sapiens
atgtccaaatactctgaaatgc

SEQ ID NO: 5263155 - DNA, 16 bp, Homo sapiens
atgtccaagaagccca

SEQ ID NO: 5263156 - DNA, 18 bp, Homo sapiens
atgtccaagaagcccagg

SEQ ID NO: 5263157 - DNA, 18 bp, Homo sapiens
atgtccaccacttcaggg

SEQ ID NO: 5263158 - DNA, 22 bp, Homo sapiens
atgtccacctgtgagaaaggaa

SEQ ID NO: 5263159 - DNA, 16 bp, Homo sapiens
atgtccacgtgtgtgt

SEQ ID NO: 5263160 - DNA, 17 bp, Homo sapiens
atgtccacgtgtgtgtg

SEQ ID NO: 5263161 - DNA, 16 bp, Homo sapiens
atgtccactggttctt

SEQ ID NO: 5263162 - DNA, 17 bp, Homo sapiens
atgtccactggttcttc

SEQ ID NO: 5263163 - DNA, 17 bp, Homo sapiens
atgtccactgtgtatag

SEQ ID NO: 5263164 - DNA, 16 bp, Homo sapiens
atgtccacttaaaata

SEQ ID NO: 5263165 - DNA, 18 bp, Homo sapiens
atgtccacttaaaataca

SEQ ID NO: 5263166 - DNA, 19 bp, Homo sapiens
atgtccacttaaaatacat

SEQ ID NO: 5263167 - DNA, 14 bp, Homo sapiens
atgtccagagctgg

SEQ ID NO: 5263168 - DNA, 18 bp, Homo sapiens
atgtccagagggactgga

SEQ ID NO: 5263169 - DNA, 15 bp, Homo sapiens
atgtccagggggaga

SEQ ID NO: 5263170 - DNA, 19 bp, Homo sapiens
atgtccagtaagatcactg

SEQ ID NO: 5263171 - DNA, 21 bp, Homo sapiens
atgtccagtaagatcactgtt

SEQ ID NO: 5263172 - DNA, 16 bp, Homo sapiens
atgtccagtcatcctg

SEQ ID NO: 5263173 - DNA, 11 bp, Homo sapiens
atgtccagtga

SEQ ID NO: 5263174 - DNA, 17 bp, Homo sapiens
atgtccagtgagcagtg

SEQ ID NO: 5263175 - DNA, 13 bp, Homo sapiens
atgtccatacact

SEQ ID NO: 5263176 - DNA, 20 bp, Homo sapiens
atgtccatagccataattcc

SEQ ID NO: 5263177 - DNA, 21 bp, Homo sapiens
atgtccatagccataattcca

SEQ ID NO: 5263178 - DNA, 18 bp, Homo sapiens
atgtccatcccttttcct

SEQ ID NO: 5263179 - DNA, 18 bp, Homo sapiens
atgtcccacagggaccac

SEQ ID NO: 5263180 - DNA, 20 bp, Homo sapiens
atgtcccacagggaccacat

SEQ ID NO: 5263181 - DNA, 22 bp, Homo sapiens
atgtcccacagggaccacatcc

SEQ ID NO: 5263182 - DNA, 15 bp, Homo sapiens
atgtcccacccaccc

SEQ ID NO: 5263183 - DNA, 17 bp, Homo sapiens
atgtcccaccctcccta

SEQ ID NO: 5263184 - DNA, 14 bp, Homo sapiens
atgtcccagaaatg

SEQ ID NO: 5263185 - DNA, 16 bp, Homo sapiens
atgtcccatctgctcc

SEQ ID NO: 5263186 - DNA, 20 bp, Homo sapiens
atgtcccatctgctcctccc

SEQ ID NO: 5263187 - DNA, 18 bp, Homo sapiens
atgtccccaaacctgcaa

SEQ ID NO: 5263188 - DNA, 19 bp, Homo sapiens
atgtccccaaacctgcaag

SEQ ID NO: 5263189 - DNA, 14 bp, Homo sapiens
atgtccccactccc

SEQ ID NO: 5263190 - DNA, 17 bp, Homo sapiens
atgtccccactcccgaa

SEQ ID NO: 5263191 - DNA, 18 bp, Homo sapiens
atgtccccataagacaaa

SEQ ID NO: 5263192 - DNA, 14 bp, Homo sapiens
atgtcccccacctc

SEQ ID NO: 5263193 - DNA, 22 bp, Homo sapiens
atgtcccccaggggcccaggct

SEQ ID NO: 5263194 - DNA, 19 bp, Homo sapiens
atgtcccctcaaactcatt

SEQ ID NO: 5263195 - DNA, 22 bp, Homo sapiens
atgtcccctcaaactcattgca

SEQ ID NO: 5263196 - DNA, 14 bp, Homo sapiens
atgtcccctcccag

SEQ ID NO: 5263197 - DNA, 22 bp, Homo sapiens
atgtccccttcctgttcttcct

SEQ ID NO: 5263198 - DNA, 21 bp, Homo sapiens
atgtccctacacccctcccct

SEQ ID NO: 5263199 - DNA, 16 bp, Homo sapiens
atgaaatgaacacaaa

SEQ ID NO: 5263200 - DNA, 20 bp, Homo sapiens
atgaaatgataaagactttt

SEQ ID NO: 5263201 - DNA, 18 bp, Homo sapiens
atgaaatgccaagactct

SEQ ID NO: 5263202 - DNA, 21 bp, Homo sapiens
atgaaatgccagacttctaaa

SEQ ID NO: 5263203 - DNA, 21 bp, Homo sapiens
atgaaatgccctcctaaatgt

SEQ ID NO: 5263204 - DNA, 22 bp, Homo sapiens
atgaaatgccctcctaaatgtc

SEQ ID NO: 5263205 - DNA, 13 bp, Homo sapiens
atgaaatgtatgt

SEQ ID NO: 5263206 - DNA, 12 bp, Homo sapiens
atgaaatgtgaa

SEQ ID NO: 5263207 - DNA, 13 bp, Homo sapiens
atgaaatgtgaat

SEQ ID NO: 5263208 - DNA, 18 bp, Homo sapiens
atgaaatgtgaattttta

SEQ ID NO: 5263209 - DNA, 22 bp, Homo sapiens
atgaaatgtgaatttttattgt

SEQ ID NO: 5263210 - DNA, 23 bp, Homo sapiens
atgaaatgtgttttgtctttttt

SEQ ID NO: 5263211 - DNA, 12 bp, Homo sapiens
atgaaatgtttt

SEQ ID NO: 5263212 - DNA, 14 bp, Homo sapiens
atgaaattaataaa

SEQ ID NO: 5263213 - DNA, 21 bp, Homo sapiens
atgaaattataagtagatttg

SEQ ID NO: 5263214 - DNA, 13 bp, Homo sapiens
atgaaattccatt

SEQ ID NO: 5263215 - DNA, 15 bp, Homo sapiens
atgaaattcctcctt

SEQ ID NO: 5263216 - DNA, 16 bp, Homo sapiens
atgaaattcttcctaa

SEQ ID NO: 5263217 - DNA, 24 bp, Homo sapiens
atgaaattgacaagctaggaaaga

SEQ ID NO: 5263218 - DNA, 19 bp, Homo sapiens
atgaaattgagaagggaaa

SEQ ID NO: 5263219 - DNA, 11 bp, Homo sapiens
atgaaattgcc

SEQ ID NO: 5263220 - DNA, 12 bp, Homo sapiens
atgaaattgcca

SEQ ID NO: 5263221 - DNA, 20 bp, Homo sapiens
atgaaattgtctagcagagc

SEQ ID NO: 5263222 - DNA, 18 bp, Homo sapiens
atgaaatttaaacattaa

SEQ ID NO: 5263223 - DNA, 21 bp, Homo sapiens
atgaaatttaaacattaaaaa

SEQ ID NO: 5263224 - DNA, 14 bp, Homo sapiens
atgaaattttacca

SEQ ID NO: 5263225 - DNA, 21 bp, Homo sapiens
atgaaattttaccaagttata

SEQ ID NO: 5263226 - DNA, 21 bp, Homo sapiens
atgaaattttctagactttct

SEQ ID NO: 5263227 - DNA, 14 bp, Homo sapiens
atgaaatttttgta

SEQ ID NO: 5263228 - DNA, 15 bp, Homo sapiens
atgaaattttttagt

SEQ ID NO: 5263229 - DNA, 19 bp, Homo sapiens
atgaacaaaattatttgta

SEQ ID NO: 5263230 - DNA, 10 bp, Homo sapiens
atgaacaaag

SEQ ID NO: 5263231 - DNA, 17 bp, Homo sapiens
atgaacaaattctttag

SEQ ID NO: 5263232 - DNA, 19 bp, Homo sapiens
atgaacaaattctttagta

SEQ ID NO: 5263233 - DNA, 21 bp, Homo sapiens
atgaacaaattctttagtact

SEQ ID NO: 5263234 - DNA, 13 bp, Homo sapiens
atgaacaacagta

SEQ ID NO: 5263235 - DNA, 21 bp, Homo sapiens
atgaacaacagtagtttctca

SEQ ID NO: 5263236 - DNA, 14 bp, Homo sapiens
atgaacaagagaag

SEQ ID NO: 5263237 - DNA, 21 bp, Homo sapiens
atgaacaagttttaatgtata

SEQ ID NO: 5263238 - DNA, 13 bp, Homo sapiens
atgaacaatgtat

SEQ ID NO: 5263239 - DNA, 18 bp, Homo sapiens
atgaacaatgtatacaat

SEQ ID NO: 5263240 - DNA, 13 bp, Homo sapiens
atgaacaattgct

SEQ ID NO: 5263241 - DNA, 13 bp, Homo sapiens
atgaacacaaatt

SEQ ID NO: 5263242 - DNA, 14 bp, Homo sapiens
atgaacacaaatta

SEQ ID NO: 5263243 - DNA, 22 bp, Homo sapiens
atgaacacacatggatgcacac

SEQ ID NO: 5263244 - DNA, 13 bp, Homo sapiens
atgaacacagctc

SEQ ID NO: 5263245 - DNA, 20 bp, Homo sapiens
atgaacacagctctttaaca

SEQ ID NO: 5263246 - DNA, 20 bp, Homo sapiens
atgaacacagctgctgaaga

SEQ ID NO: 5263247 - DNA, 16 bp, Homo sapiens
atgaacacatggcaga

SEQ ID NO: 5263248 - DNA, 13 bp, Homo sapiens
atgaacactggct

SEQ ID NO: 5263249 - DNA, 16 bp, Homo sapiens
atgaacacttaataaa

SEQ ID NO: 5263250 - DNA, 16 bp, Homo sapiens
atgaacagaaactaca

SEQ ID NO: 5263251 - DNA, 19 bp, Homo sapiens
atgaacagaaactacattt

SEQ ID NO: 5263252 - DNA, 13 bp, Homo sapiens
atgaacagaattt

SEQ ID NO: 5263253 - DNA, 14 bp, Homo sapiens
atgaacagctctga

SEQ ID NO: 5263254 - DNA, 20 bp, Homo sapiens
atgaacagctctgagatcct

SEQ ID NO: 5263255 - DNA, 13 bp, Homo sapiens
atgaacagctgtg

SEQ ID NO: 5263256 - DNA, 21 bp, Homo sapiens
atgaacagctgtgtctgccaa

SEQ ID NO: 5263257 - DNA, 16 bp, Homo sapiens
atgaacagggcccagg

SEQ ID NO: 5263258 - DNA, 22 bp, Homo sapiens
atgaacagggcccaggcctgga

SEQ ID NO: 5263259 - DNA, 23 bp, Homo sapiens
atgaacagttctcccttcaactg

SEQ ID NO: 5263260 - DNA, 13 bp, Homo sapiens
atgaacataatga

SEQ ID NO: 5263261 - DNA, 16 bp, Homo sapiens
atgaacataatgaaca

SEQ ID NO: 5263262 - DNA, 16 bp, Homo sapiens
atgaacatacaaatgc

SEQ ID NO: 5263263 - DNA, 14 bp, Homo sapiens
atgaacatattcat

SEQ ID NO: 5263264 - DNA, 15 bp, Homo sapiens
atgaacatattcatg

SEQ ID NO: 5263265 - DNA, 16 bp, Homo sapiens
atgaacatggtcagaa

SEQ ID NO: 5263266 - DNA, 12 bp, Homo sapiens
atgaacattgta

SEQ ID NO: 5263267 - DNA, 14 bp, Homo sapiens
atgaacattgtact

SEQ ID NO: 5263268 - DNA, 15 bp, Homo sapiens
atgaacattgtactg

SEQ ID NO: 5263269 - DNA, 21 bp, Homo sapiens
atgaacattttatttttgaaa

SEQ ID NO: 5263270 - DNA, 21 bp, Homo sapiens
atgaacccaaaaagagaccca

SEQ ID NO: 5263271 - DNA, 14 bp, Homo sapiens
atgaacccctggct

SEQ ID NO: 5263272 - DNA, 18 bp, Homo sapiens
atgaaccctcctcctttt

SEQ ID NO: 5263273 - DNA, 15 bp, Homo sapiens
atgaaccctgcccca

SEQ ID NO: 5263274 - DNA, 15 bp, Homo sapiens
atgaaccctgccctg

SEQ ID NO: 5263275 - DNA, 16 bp, Homo sapiens
atgaaccgtttacagt

SEQ ID NO: 5263276 - DNA, 16 bp, Homo sapiens
atgaacctattttcat

SEQ ID NO: 5263277 - DNA, 20 bp, Homo sapiens
atgaacctattttcatttgt

SEQ ID NO: 5263278 - DNA, 23 bp, Homo sapiens
atgaacctattttcatttgtaca

SEQ ID NO: 5263279 - DNA, 15 bp, Homo sapiens
atgaacctgaaaagg

SEQ ID NO: 5263280 - DNA, 24 bp, Homo sapiens
atgaaccttctggcctcccacaga

SEQ ID NO: 5263281 - DNA, 20 bp, Homo sapiens
atgaaccttgctatcaagaa

SEQ ID NO: 5263282 - DNA, 21 bp, Homo sapiens
atgaacgcacaacatgcacat

SEQ ID NO: 5263283 - DNA, 15 bp, Homo sapiens
atgaacggccttgct

SEQ ID NO: 5263284 - DNA, 19 bp, Homo sapiens
atgaactaaaaagagactg

SEQ ID NO: 5263285 - DNA, 16 bp, Homo sapiens
atgaactaactgccat

SEQ ID NO: 5263286 - DNA, 18 bp, Homo sapiens
atgaactaactgccatgt

SEQ ID NO: 5263287 - DNA, 13 bp, Homo sapiens
atgaactagccat

SEQ ID NO: 5263288 - DNA, 22 bp, Homo sapiens
atgaactagccatgactagggt

SEQ ID NO: 5263289 - DNA, 12 bp, Homo sapiens
atgaactagtga

SEQ ID NO: 5263290 - DNA, 16 bp, Homo sapiens
atgaactcaatgcatg

SEQ ID NO: 5263291 - DNA, 12 bp, Homo sapiens
atgaactctgaa

SEQ ID NO: 5263292 - DNA, 20 bp, Homo sapiens
atgaactcttagaaatgaag

SEQ ID NO: 5263293 - DNA, 12 bp, Homo sapiens
atgaactctttc

SEQ ID NO: 5263294 - DNA, 17 bp, Homo sapiens
atgaactctttccccag

SEQ ID NO: 5263295 - DNA, 20 bp, Homo sapiens
atgaactgaagtttcacatg

SEQ ID NO: 5263296 - DNA, 19 bp, Homo sapiens
atgaactgcatcaagactt

SEQ ID NO: 5263297 - DNA, 16 bp, Homo sapiens
atgaactgtactactc

SEQ ID NO: 5263298 - DNA, 20 bp, Homo sapiens
atgaactgtccgtgaatggt

SEQ ID NO: 5263299 - DNA, 15 bp, Homo sapiens
atgaactgtgacagg

SEQ ID NO: 5263300 - DNA, 13 bp, Homo sapiens
atgaactgtggaa

SEQ ID NO: 5263301 - DNA, 16 bp, Homo sapiens
atgaactgtggaattt

SEQ ID NO: 5263302 - DNA, 20 bp, Homo sapiens
atgaactgtggaatttattg

SEQ ID NO: 5263303 - DNA, 16 bp, Homo sapiens
atgaacttaacatgct

SEQ ID NO: 5263304 - DNA, 20 bp, Homo sapiens
atgaacttagattttacatg

SEQ ID NO: 5263305 - DNA, 22 bp, Homo sapiens
atgaacttagattttacatgaa

SEQ ID NO: 5263306 - DNA, 18 bp, Homo sapiens
atgaacttattctgtaga

SEQ ID NO: 5263307 - DNA, 16 bp, Homo sapiens
atgaacttgaggacac

SEQ ID NO: 5263308 - DNA, 13 bp, Homo sapiens
atgaacttgtctt

SEQ ID NO: 5263309 - DNA, 12 bp, Homo sapiens
atgaactttaaa

SEQ ID NO: 5263310 - DNA, 19 bp, Homo sapiens
atgaacttttacagaatgc

SEQ ID NO: 5263311 - DNA, 19 bp, Homo sapiens
atgaactttttaacaaatg

SEQ ID NO: 5263312 - DNA, 17 bp, Homo sapiens
atgaagaaaaaatacat

SEQ ID NO: 5263313 - DNA, 19 bp, Homo sapiens
atgaagaaaaaatacattt

SEQ ID NO: 5263314 - DNA, 20 bp, Homo sapiens
atgaagaaaaaatacatttt

SEQ ID NO: 5263315 - DNA, 17 bp, Homo sapiens
atgaagaaaaagtacaa

SEQ ID NO: 5263316 - DNA, 14 bp, Homo sapiens
atgaagaaaatact

SEQ ID NO: 5263317 - DNA, 17 bp, Homo sapiens
atgaagaaaatacttaa

SEQ ID NO: 5263318 - DNA, 22 bp, Homo sapiens
atgaagaaaatacttaaatgtt

SEQ ID NO: 5263319 - DNA, 15 bp, Homo sapiens
atgaagaaagagact

SEQ ID NO: 5263320 - DNA, 23 bp, Homo sapiens
atgaagaaagggaggcccagccg

SEQ ID NO: 5263321 - DNA, 15 bp, Homo sapiens
atgaagaactgagga

SEQ ID NO: 5263322 - DNA, 14 bp, Homo sapiens
atgaagaagccttt

SEQ ID NO: 5263323 - DNA, 22 bp, Homo sapiens
atgaagaaggagcagaataaat

SEQ ID NO: 5263324 - DNA, 17 bp, Homo sapiens
atgaagaagggggtggg

SEQ ID NO: 5263325 - DNA, 16 bp, Homo sapiens
atgaagaatagaaaca

SEQ ID NO: 5263326 - DNA, 18 bp, Homo sapiens
atgaagaatagaaacaag

SEQ ID NO: 5263327 - DNA, 19 bp, Homo sapiens
atgaagaatataccatttc

SEQ ID NO: 5263328 - DNA, 16 bp, Homo sapiens
atgaagaatttaaaga

SEQ ID NO: 5263329 - DNA, 13 bp, Homo sapiens
atgaagacaatga

SEQ ID NO: 5263330 - DNA, 15 bp, Homo sapiens
atgaagacagaaggc

SEQ ID NO: 5263331 - DNA, 13 bp, Homo sapiens
atgaagaccaaag

SEQ ID NO: 5263332 - DNA, 17 bp, Homo sapiens
atgaagaccaaatgata

SEQ ID NO: 5263333 - DNA, 13 bp, Homo sapiens
atgaagacctaaa

SEQ ID NO: 5263334 - DNA, 16 bp, Homo sapiens
atgaagacctaaatga

SEQ ID NO: 5263335 - DNA, 21 bp, Homo sapiens
atgaagacctttttctgcact

SEQ ID NO: 5263336 - DNA, 18 bp, Homo sapiens
atgaagactacttttaga

SEQ ID NO: 5263337 - DNA, 19 bp, Homo sapiens
atgaagactcgcaatttca

SEQ ID NO: 5263338 - DNA, 13 bp, Homo sapiens
atgaagagaaaaa

SEQ ID NO: 5263339 - DNA, 19 bp, Homo sapiens
atgaagagaaaaaaaggaa

SEQ ID NO: 5263340 - DNA, 15 bp, Homo sapiens
atgaagagaagcaat

SEQ ID NO: 5263341 - DNA, 20 bp, Homo sapiens
atgaagagatttttcatgat

SEQ ID NO: 5263342 - DNA, 13 bp, Homo sapiens
atgaagagcaaaa

SEQ ID NO: 5263343 - DNA, 15 bp, Homo sapiens
atgaagagcaaaaat

SEQ ID NO: 5263344 - DNA, 16 bp, Homo sapiens
atgaagagctgtcttc

SEQ ID NO: 5263345 - DNA, 19 bp, Homo sapiens
atgaagagctgtcttcccc

SEQ ID NO: 5263346 - DNA, 16 bp, Homo sapiens
atgaagagctgttgat

SEQ ID NO: 5263347 - DNA, 18 bp, Homo sapiens
atgaagagcttgctttga

SEQ ID NO: 5263348 - DNA, 16 bp, Homo sapiens
atgaagagtattaatg

SEQ ID NO: 5263349 - DNA, 18 bp, Homo sapiens
atgaagagtgagagggca

SEQ ID NO: 5263350 - DNA, 19 bp, Homo sapiens
atgaagagtgagagggcat

SEQ ID NO: 5263351 - DNA, 17 bp, Homo sapiens
atgaagagttgtttata

SEQ ID NO: 5263352 - DNA, 22 bp, Homo sapiens
atgaagagtttttttctgttta

SEQ ID NO: 5263353 - DNA, 12 bp, Homo sapiens
atgaagataaat

SEQ ID NO: 5263354 - DNA, 14 bp, Homo sapiens
atgaagatacacat

SEQ ID NO: 5263355 - DNA, 18 bp, Homo sapiens
atgaagataccatcagca

SEQ ID NO: 5263356 - DNA, 15 bp, Homo sapiens
atgaagatactgaaa

SEQ ID NO: 5263357 - DNA, 17 bp, Homo sapiens
atgaagatactgaaata

SEQ ID NO: 5263358 - DNA, 23 bp, Homo sapiens
atgaagatcggctttcatgtaat

SEQ ID NO: 5263359 - DNA, 14 bp, Homo sapiens
atgaagatctttgt

SEQ ID NO: 5263360 - DNA, 16 bp, Homo sapiens
atgaagatgaagagct

SEQ ID NO: 5263361 - DNA, 18 bp, Homo sapiens
atgaagatgcattttaaa

SEQ ID NO: 5263362 - DNA, 12 bp, Homo sapiens
atgaagattatt

SEQ ID NO: 5263363 - DNA, 17 bp, Homo sapiens
atgaagattcagcagtg

SEQ ID NO: 5263364 - DNA, 17 bp, Homo sapiens
atgaagattcatgttta

SEQ ID NO: 5263365 - DNA, 16 bp, Homo sapiens
atgaagatttggtttt

SEQ ID NO: 5263366 - DNA, 17 bp, Homo sapiens
atgaagatttggttttt

SEQ ID NO: 5263367 - DNA, 14 bp, Homo sapiens
atgaagcaaacaca

SEQ ID NO: 5263368 - DNA, 17 bp, Homo sapiens
atgaagcaaacacacag

SEQ ID NO: 5263369 - DNA, 13 bp, Homo sapiens
atgaagcaagctg

SEQ ID NO: 5263370 - DNA, 19 bp, Homo sapiens
atgaagcaagctgtgttac

SEQ ID NO: 5263371 - DNA, 13 bp, Homo sapiens
atgaagcaaggaa

SEQ ID NO: 5263372 - DNA, 19 bp, Homo sapiens
atgaagcagaggaaggaaa

SEQ ID NO: 5263373 - DNA, 22 bp, Homo sapiens
atgaagcagaggaaggaaacat

SEQ ID NO: 5263374 - DNA, 13 bp, Homo sapiens
atgaagcaggagg

SEQ ID NO: 5263375 - DNA, 15 bp, Homo sapiens
atgaagcaggaggcc

SEQ ID NO: 5263376 - DNA, 20 bp, Homo sapiens
atgaagcataatttgtttaa

SEQ ID NO: 5263377 - DNA, 23 bp, Homo sapiens
atgaagccacagcccaggcctcc

SEQ ID NO: 5263378 - DNA, 12 bp, Homo sapiens
atgaagccagct

SEQ ID NO: 5263379 - DNA, 20 bp, Homo sapiens
atgaagccctaagtaaatct

SEQ ID NO: 5263380 - DNA, 24 bp, Homo sapiens
atgtccctaccgagtctcttctcc

SEQ ID NO: 5263381 - DNA, 18 bp, Homo sapiens
atgtccctattctgccat

SEQ ID NO: 5263382 - DNA, 13 bp, Homo sapiens
atgtccctattta

SEQ ID NO: 5263383 - DNA, 13 bp, Homo sapiens
atgtccctccaac

SEQ ID NO: 5263384 - DNA, 18 bp, Homo sapiens
atgtccctctcttggcta

SEQ ID NO: 5263385 - DNA, 15 bp, Homo sapiens
atgtccctgggccag

SEQ ID NO: 5263386 - DNA, 21 bp, Homo sapiens
atgtccctgggccagggtctg

SEQ ID NO: 5263387 - DNA, 18 bp, Homo sapiens
atgtcccttgatgcacag

SEQ ID NO: 5263388 - DNA, 14 bp, Homo sapiens
atgtcccttgctgt

SEQ ID NO: 5263389 - DNA, 20 bp, Homo sapiens
atgtcccttttcctaagtca

SEQ ID NO: 5263390 - DNA, 21 bp, Homo sapiens
atgtccgatggtatctgggta

SEQ ID NO: 5263391 - DNA, 21 bp, Homo sapiens
atgtccgttccaggagcacac

SEQ ID NO: 5263392 - DNA, 20 bp, Homo sapiens
atgtcctaaagaagacattt

SEQ ID NO: 5263393 - DNA, 16 bp, Homo sapiens
atgtcctaaggacaca

SEQ ID NO: 5263394 - DNA, 18 bp, Homo sapiens
atgtcctaaggacacact

SEQ ID NO: 5263395 - DNA, 21 bp, Homo sapiens
atgtcctaaggacacactaat

SEQ ID NO: 5263396 - DNA, 16 bp, Homo sapiens
atgtcctaggctctgg

SEQ ID NO: 5263397 - DNA, 19 bp, Homo sapiens
atgtcctatattggctaaa

SEQ ID NO: 5263398 - DNA, 16 bp, Homo sapiens
atgtcctattactgat

SEQ ID NO: 5263399 - DNA, 23 bp, Homo sapiens
atgtcctattactgatgtgtgca

SEQ ID NO: 5263400 - DNA, 17 bp, Homo sapiens
atgtcctcaaagaagtg

SEQ ID NO: 5263401 - DNA, 22 bp, Homo sapiens
atgtcctccaacaataaagagc

SEQ ID NO: 5263402 - DNA, 20 bp, Homo sapiens
atgtcctccaccacaagagc

SEQ ID NO: 5263403 - DNA, 22 bp, Homo sapiens
atgtcctccagaagcctctggc

SEQ ID NO: 5263404 - DNA, 23 bp, Homo sapiens
atgtcctccagaagcctctggct

SEQ ID NO: 5263405 - DNA, 16 bp, Homo sapiens
atgtcctcctctgtga

SEQ ID NO: 5263406 - DNA, 17 bp, Homo sapiens
atgtcctcctctgtgaa

SEQ ID NO: 5263407 - DNA, 18 bp, Homo sapiens
atgtcctcctctgtgaaa

SEQ ID NO: 5263408 - DNA, 20 bp, Homo sapiens
atgtcctcggtttcccattt

SEQ ID NO: 5263409 - DNA, 23 bp, Homo sapiens
atgtcctgaggctctctaagaaa

SEQ ID NO: 5263410 - DNA, 21 bp, Homo sapiens
atgtcctgcctattatctgtc

SEQ ID NO: 5263411 - DNA, 22 bp, Homo sapiens
atgtcctgcctattatctgtca

SEQ ID NO: 5263412 - DNA, 13 bp, Homo sapiens
atgtcctgccttt

SEQ ID NO: 5263413 - DNA, 15 bp, Homo sapiens
atgtcctgcctttta

SEQ ID NO: 5263414 - DNA, 17 bp, Homo sapiens
atgtcctgctggcttcc

SEQ ID NO: 5263415 - DNA, 19 bp, Homo sapiens
atgtcctggaagtgtgtgt

SEQ ID NO: 5263416 - DNA, 15 bp, Homo sapiens
atgtcctgtcctggt

SEQ ID NO: 5263417 - DNA, 11 bp, Homo sapiens
atgtcctgtgt

SEQ ID NO: 5263418 - DNA, 13 bp, Homo sapiens
atgtcctgtgtca

SEQ ID NO: 5263419 - DNA, 19 bp, Homo sapiens
atgtccttgggttgctggt

SEQ ID NO: 5263420 - DNA, 21 bp, Homo sapiens
atgtccttgtaatattccctt

SEQ ID NO: 5263421 - DNA, 23 bp, Homo sapiens
atgtccttgtgatgtgcacgtaa

SEQ ID NO: 5263422 - DNA, 19 bp, Homo sapiens
atgtcctttccctggagtc

SEQ ID NO: 5263423 - DNA, 14 bp, Homo sapiens
atgtcgatcaagag

SEQ ID NO: 5263424 - DNA, 20 bp, Homo sapiens
atgtcgatcaagagaatcaa

SEQ ID NO: 5263425 - DNA, 14 bp, Homo sapiens
atgtcgattaaaat

SEQ ID NO: 5263426 - DNA, 12 bp, Homo sapiens
atgtcgcacaat

SEQ ID NO: 5263427 - DNA, 13 bp, Homo sapiens
atgtcgcacaatg

SEQ ID NO: 5263428 - DNA, 14 bp, Homo sapiens
atgtcgccaaaaat

SEQ ID NO: 5263429 - DNA, 18 bp, Homo sapiens
atgtcgccaaaaatacag

SEQ ID NO: 5263430 - DNA, 14 bp, Homo sapiens
atgtcgcctctgca

SEQ ID NO: 5263431 - DNA, 14 bp, Homo sapiens
atgtcgctgtaaat

SEQ ID NO: 5263432 - DNA, 19 bp, Homo sapiens
atgtcggagtagaaattgt

SEQ ID NO: 5263433 - DNA, 20 bp, Homo sapiens
atgtcggcacgtcccatgtg

SEQ ID NO: 5263434 - DNA, 22 bp, Homo sapiens
atgtcggggttggggtgggagg

SEQ ID NO: 5263435 - DNA, 16 bp, Homo sapiens
atgtcgtaggtaaact

SEQ ID NO: 5263436 - DNA, 22 bp, Homo sapiens
atgtcgtgaccaactagacatt

SEQ ID NO: 5263437 - DNA, 18 bp, Homo sapiens
atgtcgtggactccagct

SEQ ID NO: 5263438 - DNA, 18 bp, Homo sapiens
atgtcgtgttttcaagga

SEQ ID NO: 5263439 - DNA, 13 bp, Homo sapiens
atgtctaaaattg

SEQ ID NO: 5263440 - DNA, 19 bp, Homo sapiens
atgtctaacttaaatagct

SEQ ID NO: 5263441 - DNA, 18 bp, Homo sapiens
atgtctaagaactctttg

SEQ ID NO: 5263442 - DNA, 17 bp, Homo sapiens
atgtctaatgtatttta

SEQ ID NO: 5263443 - DNA, 21 bp, Homo sapiens
atgtctaatgtattttattgt

SEQ ID NO: 5263444 - DNA, 14 bp, Homo sapiens
atgtctacagaaaa

SEQ ID NO: 5263445 - DNA, 18 bp, Homo sapiens
atgtctacagaaaatgct

SEQ ID NO: 5263446 - DNA, 16 bp, Homo sapiens
atgtctacctggcaga

SEQ ID NO: 5263447 - DNA, 15 bp, Homo sapiens
atgtctactttttaa

SEQ ID NO: 5263448 - DNA, 15 bp, Homo sapiens
atgtctagaaagtaa

SEQ ID NO: 5263449 - DNA, 23 bp, Homo sapiens
atgtctagaccaggacctccctc

SEQ ID NO: 5263450 - DNA, 16 bp, Homo sapiens
atgtctagagcctctt

SEQ ID NO: 5263451 - DNA, 19 bp, Homo sapiens
atgtctagagcctcttggg

SEQ ID NO: 5263452 - DNA, 15 bp, Homo sapiens
atgtctagataacat

SEQ ID NO: 5263453 - DNA, 19 bp, Homo sapiens
atgtctagattttgaaaaa

SEQ ID NO: 5263454 - DNA, 12 bp, Homo sapiens
atgtctatgtgt

SEQ ID NO: 5263455 - DNA, 15 bp, Homo sapiens
atgtctatgtgtata

SEQ ID NO: 5263456 - DNA, 16 bp, Homo sapiens
atgtctatgtgtatat

SEQ ID NO: 5263457 - DNA, 17 bp, Homo sapiens
atgtctattaaggtgat

SEQ ID NO: 5263458 - DNA, 14 bp, Homo sapiens
atgtctattattat

SEQ ID NO: 5263459 - DNA, 17 bp, Homo sapiens
atgtctattccattccc

SEQ ID NO: 5263460 - DNA, 12 bp, Homo sapiens
atgtctatttaa

SEQ ID NO: 5263461 - DNA, 19 bp, Homo sapiens
atgtctatttgcacaagat

SEQ ID NO: 5263462 - DNA, 21 bp, Homo sapiens
atgtctattttcttgaggaaa

SEQ ID NO: 5263463 - DNA, 13 bp, Homo sapiens
atgtctatttttg

SEQ ID NO: 5263464 - DNA, 20 bp, Homo sapiens
atgtctcaaggcagttaatt

SEQ ID NO: 5263465 - DNA, 15 bp, Homo sapiens
atgtctcaagtgcaa

SEQ ID NO: 5263466 - DNA, 14 bp, Homo sapiens
atgtctcactgagc

SEQ ID NO: 5263467 - DNA, 19 bp, Homo sapiens
atgtctcactgagcactgt

SEQ ID NO: 5263468 - DNA, 20 bp, Homo sapiens
atgtctcactgagcactgtt

SEQ ID NO: 5263469 - DNA, 14 bp, Homo sapiens
atgtctcactgttc

SEQ ID NO: 5263470 - DNA, 17 bp, Homo sapiens
atgtctcactgttctgc

SEQ ID NO: 5263471 - DNA, 18 bp, Homo sapiens
atgtctcactgttctgca

SEQ ID NO: 5263472 - DNA, 20 bp, Homo sapiens
atgtctcactttactttcaa

SEQ ID NO: 5263473 - DNA, 21 bp, Homo sapiens
atgtctcactttactttcaag

SEQ ID NO: 5263474 - DNA, 17 bp, Homo sapiens
atgtctcaggtccctgc

SEQ ID NO: 5263475 - DNA, 20 bp, Homo sapiens
atgtctcatgatgtaaaaaa

SEQ ID NO: 5263476 - DNA, 16 bp, Homo sapiens
atgtctcatgtaattt

SEQ ID NO: 5263477 - DNA, 13 bp, Homo sapiens
atgtctcatgttt

SEQ ID NO: 5263478 - DNA, 12 bp, Homo sapiens
atgtctccatac

SEQ ID NO: 5263479 - DNA, 12 bp, Homo sapiens
atgtctccattg

SEQ ID NO: 5263480 - DNA, 18 bp, Homo sapiens
atgtctcctcaacccaca

SEQ ID NO: 5263481 - DNA, 14 bp, Homo sapiens
atgtctcctcaagc

SEQ ID NO: 5263482 - DNA, 18 bp, Homo sapiens
atgtctcctcaagcctgt

SEQ ID NO: 5263483 - DNA, 19 bp, Homo sapiens
atgtctcctcaagcctgtg

SEQ ID NO: 5263484 - DNA, 17 bp, Homo sapiens
atgtctcctgcatagct

SEQ ID NO: 5263485 - DNA, 16 bp, Homo sapiens
atgtctcctttgctct

SEQ ID NO: 5263486 - DNA, 18 bp, Homo sapiens
atgtctcctttgctcttg

SEQ ID NO: 5263487 - DNA, 20 bp, Homo sapiens
atgtctcctttgctcttgcc

SEQ ID NO: 5263488 - DNA, 16 bp, Homo sapiens
atgtctcgctagtgat

SEQ ID NO: 5263489 - DNA, 19 bp, Homo sapiens
atgtctcgtggtaggactg

SEQ ID NO: 5263490 - DNA, 17 bp, Homo sapiens
atgtctctaaactgcgg

SEQ ID NO: 5263491 - DNA, 21 bp, Homo sapiens
atgtctctcagaattcttcag

SEQ ID NO: 5263492 - DNA, 11 bp, Homo sapiens
atgtctctgcc

SEQ ID NO: 5263493 - DNA, 21 bp, Homo sapiens
atgtctctgtgagactcgaga

SEQ ID NO: 5263494 - DNA, 13 bp, Homo sapiens
atgtctctgtgtg

SEQ ID NO: 5263495 - DNA, 16 bp, Homo sapiens
atgtctcttcctggta

SEQ ID NO: 5263496 - DNA, 16 bp, Homo sapiens
atgtctcttctaacat

SEQ ID NO: 5263497 - DNA, 17 bp, Homo sapiens
atgtctcttctgagcta

SEQ ID NO: 5263498 - DNA, 23 bp, Homo sapiens
atgtctctttaatgtcacaggca

SEQ ID NO: 5263499 - DNA, 23 bp, Homo sapiens
atgtctgaaaaatgcctgctgct

SEQ ID NO: 5263500 - DNA, 13 bp, Homo sapiens
atgtctgaaacag

SEQ ID NO: 5263501 - DNA, 17 bp, Homo sapiens
atgtctgaactttggga

SEQ ID NO: 5263502 - DNA, 16 bp, Homo sapiens
atgtctgaagtacaaa

SEQ ID NO: 5263503 - DNA, 21 bp, Homo sapiens
atgtctgaagtacaaacatga

SEQ ID NO: 5263504 - DNA, 22 bp, Homo sapiens
atgtctgaagtacaaacatgaa

SEQ ID NO: 5263505 - DNA, 16 bp, Homo sapiens
atgtctgacacattaa

SEQ ID NO: 5263506 - DNA, 21 bp, Homo sapiens
atgtctgagagaccatctcct

SEQ ID NO: 5263507 - DNA, 20 bp, Homo sapiens
atgtctgagcggcgcagagc

SEQ ID NO: 5263508 - DNA, 13 bp, Homo sapiens
atgtctgcaaagt

SEQ ID NO: 5263509 - DNA, 22 bp, Homo sapiens
atgtctgcacctccgcttgcca

SEQ ID NO: 5263510 - DNA, 11 bp, Homo sapiens
atgtctgcagc

SEQ ID NO: 5263511 - DNA, 23 bp, Homo sapiens
atgtctgcagctcaagggctggc

SEQ ID NO: 5263512 - DNA, 18 bp, Homo sapiens
atgtctgcaggtgtctga

SEQ ID NO: 5263513 - DNA, 18 bp, Homo sapiens
atgtctgccaaaatgcaa

SEQ ID NO: 5263514 - DNA, 16 bp, Homo sapiens
atgtctgccaattttt

SEQ ID NO: 5263515 - DNA, 21 bp, Homo sapiens
atgtctgccaatttttgcctt

SEQ ID NO: 5263516 - DNA, 23 bp, Homo sapiens
atgtctgccaatttttgccttca

SEQ ID NO: 5263517 - DNA, 20 bp, Homo sapiens
atgtctgcctatgcactgaa

SEQ ID NO: 5263518 - DNA, 15 bp, Homo sapiens
atgtctgcctggagt

SEQ ID NO: 5263519 - DNA, 13 bp, Homo sapiens
atgtctgccttac

SEQ ID NO: 5263520 - DNA, 21 bp, Homo sapiens
atgtctgccttcgaccacagc

SEQ ID NO: 5263521 - DNA, 19 bp, Homo sapiens
atgtctgctcctttcccct

SEQ ID NO: 5263522 - DNA, 18 bp, Homo sapiens
atgtctgctggtatttct

SEQ ID NO: 5263523 - DNA, 20 bp, Homo sapiens
atgtctgctggtatttctaa

SEQ ID NO: 5263524 - DNA, 12 bp, Homo sapiens
atgtctgcttct

SEQ ID NO: 5263525 - DNA, 22 bp, Homo sapiens
atgtctggagaataattctttg

SEQ ID NO: 5263526 - DNA, 23 bp, Homo sapiens
atgtctggagaccaccagggcat

SEQ ID NO: 5263527 - DNA, 12 bp, Homo sapiens
atgtctggcaga

SEQ ID NO: 5263528 - DNA, 13 bp, Homo sapiens
atgtctggcagat

SEQ ID NO: 5263529 - DNA, 23 bp, Homo sapiens
atgtctggctcaaagcagcagga

SEQ ID NO: 5263530 - DNA, 16 bp, Homo sapiens
atgtctggggacaggc

SEQ ID NO: 5263531 - DNA, 15 bp, Homo sapiens
atgtctggtaaatag

SEQ ID NO: 5263532 - DNA, 17 bp, Homo sapiens
atgtctggtgtttgtca

SEQ ID NO: 5263533 - DNA, 20 bp, Homo sapiens
atgtctggtgtttgtcatgg

SEQ ID NO: 5263534 - DNA, 23 bp, Homo sapiens
atgtctggttctcaattccaaca

SEQ ID NO: 5263535 - DNA, 19 bp, Homo sapiens
atgtctgtagctcctcaac

SEQ ID NO: 5263536 - DNA, 11 bp, Homo sapiens
atgtctgtagt

SEQ ID NO: 5263537 - DNA, 18 bp, Homo sapiens
atgtctgtatactcctgt

SEQ ID NO: 5263538 - DNA, 22 bp, Homo sapiens
atgtctgtatactcctgtcacc

SEQ ID NO: 5263539 - DNA, 16 bp, Homo sapiens
atgtctgtatccccag

SEQ ID NO: 5263540 - DNA, 17 bp, Homo sapiens
atgtctgtatccccagt

SEQ ID NO: 5263541 - DNA, 13 bp, Homo sapiens
atgtctgtatcta

SEQ ID NO: 5263542 - DNA, 20 bp, Homo sapiens
atgtctgtccctaaacatag

SEQ ID NO: 5263543 - DNA, 16 bp, Homo sapiens
atgtctgtcctcagag

SEQ ID NO: 5263544 - DNA, 16 bp, Homo sapiens
atgtctgtctacagga

SEQ ID NO: 5263545 - DNA, 18 bp, Homo sapiens
atgtctgtctttgcaaag

SEQ ID NO: 5263546 - DNA, 13 bp, Homo sapiens
atgtctgtgagta

SEQ ID NO: 5263547 - DNA, 11 bp, Homo sapiens
atgtctgtgct

SEQ ID NO: 5263548 - DNA, 13 bp, Homo sapiens
atgtctgtgctgt

SEQ ID NO: 5263549 - DNA, 16 bp, Homo sapiens
atgtctgtggccttgt

SEQ ID NO: 5263550 - DNA, 14 bp, Homo sapiens
atgtctgtgtatac

SEQ ID NO: 5263551 - DNA, 15 bp, Homo sapiens
atgtctgtgtataca

SEQ ID NO: 5263552 - DNA, 19 bp, Homo sapiens
atgtctgtgtatacatatg

SEQ ID NO: 5263553 - DNA, 21 bp, Homo sapiens
atgtctgtgtatacatatgta

SEQ ID NO: 5263554 - DNA, 22 bp, Homo sapiens
atgtctgtgtatacatatgtat

SEQ ID NO: 5263555 - DNA, 23 bp, Homo sapiens
atgtctgtgtatacatatgtatg

SEQ ID NO: 5263556 - DNA, 15 bp, Homo sapiens
atgtctgtgtatgta

SEQ ID NO: 5263557 - DNA, 24 bp, Homo sapiens
atgtctgtgtgtgtgtgtgtatgt

SEQ ID NO: 5263558 - DNA, 11 bp, Homo sapiens
atgaagccttt

SEQ ID NO: 5263559 - DNA, 19 bp, Homo sapiens
atgaagcctttggtgaatt

SEQ ID NO: 5263560 - DNA, 14 bp, Homo sapiens
atgaagccttttga

SEQ ID NO: 5263561 - DNA, 16 bp, Homo sapiens
atgaagccttttgaaa

SEQ ID NO: 5263562 - DNA, 17 bp, Homo sapiens
atgaagccttttgaaag

SEQ ID NO: 5263563 - DNA, 16 bp, Homo sapiens
atgaagctaatgtgaa

SEQ ID NO: 5263564 - DNA, 21 bp, Homo sapiens
atgaagctaatgtgaatgtga

SEQ ID NO: 5263565 - DNA, 15 bp, Homo sapiens
atgaagctacctcaa

SEQ ID NO: 5263566 - DNA, 14 bp, Homo sapiens
atgaagctcagttt

SEQ ID NO: 5263567 - DNA, 14 bp, Homo sapiens
atgaagctgacaat

SEQ ID NO: 5263568 - DNA, 17 bp, Homo sapiens
atgaagctgagcttttg

SEQ ID NO: 5263569 - DNA, 19 bp, Homo sapiens
atgaagctgaggctgctgc

SEQ ID NO: 5263570 - DNA, 14 bp, Homo sapiens
atgaagctgccatc

SEQ ID NO: 5263571 - DNA, 21 bp, Homo sapiens
atgaagctgccatccttgctg

SEQ ID NO: 5263572 - DNA, 19 bp, Homo sapiens
atgaagctggaagcactgc

SEQ ID NO: 5263573 - DNA, 21 bp, Homo sapiens
atgaagctggaagcactgctg

SEQ ID NO: 5263574 - DNA, 22 bp, Homo sapiens
atgaagctggaagcactgctgt

SEQ ID NO: 5263575 - DNA, 15 bp, Homo sapiens
atgaagcttgtgtat

SEQ ID NO: 5263576 - DNA, 19 bp, Homo sapiens
atgaagcttgtgtatccat

SEQ ID NO: 5263577 - DNA, 16 bp, Homo sapiens
atgaagctttggccct

SEQ ID NO: 5263578 - DNA, 19 bp, Homo sapiens
atgaagcttttatgtgaaa

SEQ ID NO: 5263579 - DNA, 22 bp, Homo sapiens
atgaaggaatcattccagtgct

SEQ ID NO: 5263580 - DNA, 22 bp, Homo sapiens
atgaaggaatttgattgctttg

SEQ ID NO: 5263581 - DNA, 21 bp, Homo sapiens
atgaaggagaggcaacatcca

SEQ ID NO: 5263582 - DNA, 17 bp, Homo sapiens
atgaaggatcaaaaaat

SEQ ID NO: 5263583 - DNA, 14 bp, Homo sapiens
atgaaggatgaagt

SEQ ID NO: 5263584 - DNA, 21 bp, Homo sapiens
atgaaggcaaaaactgtactg

SEQ ID NO: 5263585 - DNA, 17 bp, Homo sapiens
atgaaggcacctgcccc

SEQ ID NO: 5263586 - DNA, 20 bp, Homo sapiens
atgaaggcatatttccaata

SEQ ID NO: 5263587 - DNA, 17 bp, Homo sapiens
atgaaggcgtgcaaggg

SEQ ID NO: 5263588 - DNA, 23 bp, Homo sapiens
atgaaggcgtgcaaggggctcag

SEQ ID NO: 5263589 - DNA, 19 bp, Homo sapiens
atgaaggctgaatcaaaga

SEQ ID NO: 5263590 - DNA, 18 bp, Homo sapiens
atgaaggctggaaggcag

SEQ ID NO: 5263591 - DNA, 21 bp, Homo sapiens
atgaaggctggaaggcagcag

SEQ ID NO: 5263592 - DNA, 16 bp, Homo sapiens
atgaaggctgtatcta

SEQ ID NO: 5263593 - DNA, 15 bp, Homo sapiens
atgaaggcttgtcag

SEQ ID NO: 5263594 - DNA, 16 bp, Homo sapiens
atgaagggaaaattag

SEQ ID NO: 5263595 - DNA, 20 bp, Homo sapiens
atgaagggacagctgctggg

SEQ ID NO: 5263596 - DNA, 22 bp, Homo sapiens
atgaagggccagcatatatact

SEQ ID NO: 5263597 - DNA, 15 bp, Homo sapiens
atgaagggcccgaga

SEQ ID NO: 5263598 - DNA, 21 bp, Homo sapiens
atgaagggccttgagcatctg

SEQ ID NO: 5263599 - DNA, 18 bp, Homo sapiens
atgaaggtcctagcttta

SEQ ID NO: 5263600 - DNA, 18 bp, Homo sapiens
atgaaggtgtcatacaga

SEQ ID NO: 5263601 - DNA, 20 bp, Homo sapiens
atgaaggtgtgctacagaaa

SEQ ID NO: 5263602 - DNA, 16 bp, Homo sapiens
atgaaggttaggattt

SEQ ID NO: 5263603 - DNA, 19 bp, Homo sapiens
atgaaggtttctgaaaatt

SEQ ID NO: 5263604 - DNA, 17 bp, Homo sapiens
atgaaggtttgagagca

SEQ ID NO: 5263605 - DNA, 18 bp, Homo sapiens
atgaaggtttttgtaaag

SEQ ID NO: 5263606 - DNA, 21 bp, Homo sapiens
atgaaggtttttgtaaagatt

SEQ ID NO: 5263607 - DNA, 21 bp, Homo sapiens
atgaagtaaagaactgcacat

SEQ ID NO: 5263608 - DNA, 15 bp, Homo sapiens
atgaagtaaattatg

SEQ ID NO: 5263609 - DNA, 19 bp, Homo sapiens
atgaagtaacttgtcttaa

SEQ ID NO: 5263610 - DNA, 21 bp, Homo sapiens
atgaagtaacttgtcttaaat

SEQ ID NO: 5263611 - DNA, 23 bp, Homo sapiens
atgaagtaatatgcacacatttt

SEQ ID NO: 5263612 - DNA, 13 bp, Homo sapiens
atgaagtactcat

SEQ ID NO: 5263613 - DNA, 21 bp, Homo sapiens
atgaagtactcatacatgtta

SEQ ID NO: 5263614 - DNA, 14 bp, Homo sapiens
atgaagtactttta

SEQ ID NO: 5263615 - DNA, 15 bp, Homo sapiens
atgaagtacttttaa

SEQ ID NO: 5263616 - DNA, 16 bp, Homo sapiens
atgaagtataaatctg

SEQ ID NO: 5263617 - DNA, 18 bp, Homo sapiens
atgaagtattaaaatgca

SEQ ID NO: 5263618 - DNA, 22 bp, Homo sapiens
atgaagtattaaaatgcatatt

SEQ ID NO: 5263619 - DNA, 22 bp, Homo sapiens
atgaagtattatctgtaaaaat

SEQ ID NO: 5263620 - DNA, 23 bp, Homo sapiens
atgaagtccaagcatttagatgt

SEQ ID NO: 5263621 - DNA, 14 bp, Homo sapiens
atgaagtctctgaa

SEQ ID NO: 5263622 - DNA, 23 bp, Homo sapiens
atgaagtcttaaggacaaagtgc

SEQ ID NO: 5263623 - DNA, 15 bp, Homo sapiens
atgaagtgcacagga

SEQ ID NO: 5263624 - DNA, 16 bp, Homo sapiens
atgaagtgcgtgaatg

SEQ ID NO: 5263625 - DNA, 18 bp, Homo sapiens
atgaagtgcgtgaatgta

SEQ ID NO: 5263626 - DNA, 19 bp, Homo sapiens
atgaagtgtgtttccttca

SEQ ID NO: 5263627 - DNA, 18 bp, Homo sapiens
atgaagtgttagatagaa

SEQ ID NO: 5263628 - DNA, 14 bp, Homo sapiens
atgaagtgtttcct

SEQ ID NO: 5263629 - DNA, 14 bp, Homo sapiens
atgaagttgaaaat

SEQ ID NO: 5263630 - DNA, 16 bp, Homo sapiens
atgaagttgaaaatca

SEQ ID NO: 5263631 - DNA, 18 bp, Homo sapiens
atgaagttgattcatatt

SEQ ID NO: 5263632 - DNA, 16 bp, Homo sapiens
atgaagttgctgttta

SEQ ID NO: 5263633 - DNA, 17 bp, Homo sapiens
atgaagttgctgtttat

SEQ ID NO: 5263634 - DNA, 18 bp, Homo sapiens
atgaagttgctgtttatt

SEQ ID NO: 5263635 - DNA, 16 bp, Homo sapiens
atgaagtttattttct

SEQ ID NO: 5263636 - DNA, 18 bp, Homo sapiens
atgaagtttgaacttcat

SEQ ID NO: 5263637 - DNA, 15 bp, Homo sapiens
atgaagtttgaatgt

SEQ ID NO: 5263638 - DNA, 20 bp, Homo sapiens
atgaagtttgaatgttaaat

SEQ ID NO: 5263639 - DNA, 21 bp, Homo sapiens
atgaagtttttaaaaataaag

SEQ ID NO: 5263640 - DNA, 13 bp, Homo sapiens
atgaataaaacaa

SEQ ID NO: 5263641 - DNA, 16 bp, Homo sapiens
atgaataaaacactca

SEQ ID NO: 5263642 - DNA, 17 bp, Homo sapiens
atgaataaaacactcat

SEQ ID NO: 5263643 - DNA, 14 bp, Homo sapiens
atgaataaaataat

SEQ ID NO: 5263644 - DNA, 15 bp, Homo sapiens
atgaataaaatgttt

SEQ ID NO: 5263645 - DNA, 14 bp, Homo sapiens
atgaataaaattag

SEQ ID NO: 5263646 - DNA, 18 bp, Homo sapiens
atgaataaactgaatatt

SEQ ID NO: 5263647 - DNA, 17 bp, Homo sapiens
atgaataaagacaccta

SEQ ID NO: 5263648 - DNA, 18 bp, Homo sapiens
atgaataaagcctttgta

SEQ ID NO: 5263649 - DNA, 13 bp, Homo sapiens
atgaataaaggtt

SEQ ID NO: 5263650 - DNA, 18 bp, Homo sapiens
atgaataaagtgcaaaca

SEQ ID NO: 5263651 - DNA, 19 bp, Homo sapiens
atgaataacatttaaattc

SEQ ID NO: 5263652 - DNA, 15 bp, Homo sapiens
atgaataagcacttg

SEQ ID NO: 5263653 - DNA, 20 bp, Homo sapiens
atgaataagtgtaagtaaat

SEQ ID NO: 5263654 - DNA, 16 bp, Homo sapiens
atgaataatgaaaata

SEQ ID NO: 5263655 - DNA, 18 bp, Homo sapiens
atgaataatgcctttgta

SEQ ID NO: 5263656 - DNA, 15 bp, Homo sapiens
atgaataattatgtt

SEQ ID NO: 5263657 - DNA, 21 bp, Homo sapiens
atgaataattatgtttacctc

SEQ ID NO: 5263658 - DNA, 13 bp, Homo sapiens
atgaataatttca

SEQ ID NO: 5263659 - DNA, 14 bp, Homo sapiens
atgaataatttcac

SEQ ID NO: 5263660 - DNA, 15 bp, Homo sapiens
atgaataatttccca

SEQ ID NO: 5263661 - DNA, 20 bp, Homo sapiens
atgaatacaaacaatggaaa

SEQ ID NO: 5263662 - DNA, 14 bp, Homo sapiens
atgaatacaaattt

SEQ ID NO: 5263663 - DNA, 15 bp, Homo sapiens
atgaatacaaatttt

SEQ ID NO: 5263664 - DNA, 21 bp, Homo sapiens
atgaatacagggcatgcattt

SEQ ID NO: 5263665 - DNA, 14 bp, Homo sapiens
atgaatacatttcc

SEQ ID NO: 5263666 - DNA, 24 bp, Homo sapiens
atgaataccttagtgcagttattt

SEQ ID NO: 5263667 - DNA, 15 bp, Homo sapiens
atgaatacctttgtt

SEQ ID NO: 5263668 - DNA, 20 bp, Homo sapiens
atgaatacgtaaactgcgta

SEQ ID NO: 5263669 - DNA, 12 bp, Homo sapiens
atgaatactttg

SEQ ID NO: 5263670 - DNA, 16 bp, Homo sapiens
atgaatagaagaaaga

SEQ ID NO: 5263671 - DNA, 12 bp, Homo sapiens
atgaatagacat

SEQ ID NO: 5263672 - DNA, 20 bp, Homo sapiens
atgaatagatgtgatcactg

SEQ ID NO: 5263673 - DNA, 12 bp, Homo sapiens
atgaatagcttg

SEQ ID NO: 5263674 - DNA, 22 bp, Homo sapiens
atgaatatatggcatttgcaga

SEQ ID NO: 5263675 - DNA, 14 bp, Homo sapiens
atgaatatcaagaa

SEQ ID NO: 5263676 - DNA, 18 bp, Homo sapiens
atgaatatcatacaaatc

SEQ ID NO: 5263677 - DNA, 17 bp, Homo sapiens
atgaatatctattaata

SEQ ID NO: 5263678 - DNA, 20 bp, Homo sapiens
atgaatatctattaatatat

SEQ ID NO: 5263679 - DNA, 21 bp, Homo sapiens
atgaatatctattaatatatg

SEQ ID NO: 5263680 - DNA, 13 bp, Homo sapiens
atgaatatctgct

SEQ ID NO: 5263681 - DNA, 14 bp, Homo sapiens
atgaatatgatgac

SEQ ID NO: 5263682 - DNA, 12 bp, Homo sapiens
atgaatattaca

SEQ ID NO: 5263683 - DNA, 14 bp, Homo sapiens
atgaatattacatg

SEQ ID NO: 5263684 - DNA, 21 bp, Homo sapiens
atgaatatttagtgttcataa

SEQ ID NO: 5263685 - DNA, 18 bp, Homo sapiens
atgaatatttataacagc

SEQ ID NO: 5263686 - DNA, 17 bp, Homo sapiens
atgaatatttcaaaata

SEQ ID NO: 5263687 - DNA, 19 bp, Homo sapiens
atgaatatttcaaaataaa

SEQ ID NO: 5263688 - DNA, 20 bp, Homo sapiens
atgaatatttcattttgaga

SEQ ID NO: 5263689 - DNA, 14 bp, Homo sapiens
atgaatatttctta

SEQ ID NO: 5263690 - DNA, 23 bp, Homo sapiens
atgaatattttatattaaaatat

SEQ ID NO: 5263691 - DNA, 22 bp, Homo sapiens
atgaatattttcaagtttttca

SEQ ID NO: 5263692 - DNA, 12 bp, Homo sapiens
atgaatattttg

SEQ ID NO: 5263693 - DNA, 14 bp, Homo sapiens
atgaatcaaagaca

SEQ ID NO: 5263694 - DNA, 14 bp, Homo sapiens
atgaatcaatgaaa

SEQ ID NO: 5263695 - DNA, 19 bp, Homo sapiens
atgaatcaatgaaaaatgt

SEQ ID NO: 5263696 - DNA, 21 bp, Homo sapiens
atgaatcactgtgctcagcca

SEQ ID NO: 5263697 - DNA, 22 bp, Homo sapiens
atgaatcactgtgctcagccac

SEQ ID NO: 5263698 - DNA, 21 bp, Homo sapiens
atgaatcactgttgctttgaa

SEQ ID NO: 5263699 - DNA, 18 bp, Homo sapiens
atgaatcactgtttttag

SEQ ID NO: 5263700 - DNA, 23 bp, Homo sapiens
atgaatcactgtttttagacacc

SEQ ID NO: 5263701 - DNA, 20 bp, Homo sapiens
atgaatcagttttggaatct

SEQ ID NO: 5263702 - DNA, 21 bp, Homo sapiens
atgaatcagttttggaatcta

SEQ ID NO: 5263703 - DNA, 13 bp, Homo sapiens
atgaatccaaatg

SEQ ID NO: 5263704 - DNA, 15 bp, Homo sapiens
atgaatccaaatgtg

SEQ ID NO: 5263705 - DNA, 16 bp, Homo sapiens
atgaatccaaatgtga

SEQ ID NO: 5263706 - DNA, 20 bp, Homo sapiens
atgaatccatcgatttgtat

SEQ ID NO: 5263707 - DNA, 22 bp, Homo sapiens
atgaatcgcagacgcaagaggt

SEQ ID NO: 5263708 - DNA, 21 bp, Homo sapiens
atgaatcgggctaaggtccct

SEQ ID NO: 5263709 - DNA, 13 bp, Homo sapiens
atgaatctacatt

SEQ ID NO: 5263710 - DNA, 17 bp, Homo sapiens
atgaatctacatttgtt

SEQ ID NO: 5263711 - DNA, 22 bp, Homo sapiens
atgaatctacatttgtttgtat

SEQ ID NO: 5263712 - DNA, 14 bp, Homo sapiens
atgaatctatgcca

SEQ ID NO: 5263713 - DNA, 21 bp, Homo sapiens
atgaatctcgttcccaaagaa

SEQ ID NO: 5263714 - DNA, 17 bp, Homo sapiens
atgaatctgatttttat

SEQ ID NO: 5263715 - DNA, 18 bp, Homo sapiens
atgaatctgctcacttta

SEQ ID NO: 5263716 - DNA, 22 bp, Homo sapiens
atgaatctgtgctggccatgga

SEQ ID NO: 5263717 - DNA, 12 bp, Homo sapiens
atgaatctttca

SEQ ID NO: 5263718 - DNA, 17 bp, Homo sapiens
atgaatctttcatacat

SEQ ID NO: 5263719 - DNA, 21 bp, Homo sapiens
atgaatctttcatacatatat

SEQ ID NO: 5263720 - DNA, 23 bp, Homo sapiens
atgaatctttgtttcaggttcag

SEQ ID NO: 5263721 - DNA, 17 bp, Homo sapiens
atgaatgaaacattttg

SEQ ID NO: 5263722 - DNA, 12 bp, Homo sapiens
atgaatgaaata

SEQ ID NO: 5263723 - DNA, 16 bp, Homo sapiens
atgaatgaaatataaa

SEQ ID NO: 5263724 - DNA, 15 bp, Homo sapiens
atgaatgaataacta

SEQ ID NO: 5263725 - DNA, 17 bp, Homo sapiens
atgaatgaatggcttgg

SEQ ID NO: 5263726 - DNA, 14 bp, Homo sapiens
atgaatgagaatgt

SEQ ID NO: 5263727 - DNA, 21 bp, Homo sapiens
atgaatgagtgggctgtagtt

SEQ ID NO: 5263728 - DNA, 13 bp, Homo sapiens
atgaatgatatct

SEQ ID NO: 5263729 - DNA, 17 bp, Homo sapiens
atgaatgatatctttga

SEQ ID NO: 5263730 - DNA, 23 bp, Homo sapiens
atgaatgatgatggtatagtatg

SEQ ID NO: 5263731 - DNA, 19 bp, Homo sapiens
atgaatgattaaattatga

SEQ ID NO: 5263732 - DNA, 20 bp, Homo sapiens
atgaatgattaaattatgaa

SEQ ID NO: 5263733 - DNA, 17 bp, Homo sapiens
atgaatgatttgcatat

SEQ ID NO: 5263734 - DNA, 18 bp, Homo sapiens
atgaatgcaaaattgttt

SEQ ID NO: 5263735 - DNA, 20 bp, Homo sapiens
atgaatgcagcactgctgcc

SEQ ID NO: 5263736 - DNA, 14 bp, Homo sapiens
atgtctgttctaca

SEQ ID NO: 5263737 - DNA, 13 bp, Homo sapiens
atgtctgttgaaa

SEQ ID NO: 5263738 - DNA, 14 bp, Homo sapiens
atgtctgtttaaga

SEQ ID NO: 5263739 - DNA, 16 bp, Homo sapiens
atgtctgtttaagaaa

SEQ ID NO: 5263740 - DNA, 19 bp, Homo sapiens
atgtctgtttaagaaaagt

SEQ ID NO: 5263741 - DNA, 23 bp, Homo sapiens
atgtctgtttattaactactgaa

SEQ ID NO: 5263742 - DNA, 21 bp, Homo sapiens
atgtctgttttccaaagataa

SEQ ID NO: 5263743 - DNA, 18 bp, Homo sapiens
atgtctgtttttgtatct

SEQ ID NO: 5263744 - DNA, 20 bp, Homo sapiens
atgtctgtttttgtatcttt

SEQ ID NO: 5263745 - DNA, 22 bp, Homo sapiens
atgtctgtttttgtatctttat

SEQ ID NO: 5263746 - DNA, 23 bp, Homo sapiens
atgtcttaaaacctgcttttcaa

SEQ ID NO: 5263747 - DNA, 22 bp, Homo sapiens
atgtcttaaataaaactattta

SEQ ID NO: 5263748 - DNA, 15 bp, Homo sapiens
atgtcttaaatgctc

SEQ ID NO: 5263749 - DNA, 20 bp, Homo sapiens
atgtcttaaatgctcataaa

SEQ ID NO: 5263750 - DNA, 18 bp, Homo sapiens
atgtcttaacctcaggga

SEQ ID NO: 5263751 - DNA, 18 bp, Homo sapiens
atgtcttaacgaataaag

SEQ ID NO: 5263752 - DNA, 19 bp, Homo sapiens
atgtcttaacgaataaagg

SEQ ID NO: 5263753 - DNA, 20 bp, Homo sapiens
atgtcttaacgaataaaggt

SEQ ID NO: 5263754 - DNA, 17 bp, Homo sapiens
atgtcttaactgtcacc

SEQ ID NO: 5263755 - DNA, 12 bp, Homo sapiens
atgtcttaatga

SEQ ID NO: 5263756 - DNA, 18 bp, Homo sapiens
atgtcttaatgaagtttg

SEQ ID NO: 5263757 - DNA, 17 bp, Homo sapiens
atgtcttaatttttgaa

SEQ ID NO: 5263758 - DNA, 21 bp, Homo sapiens
atgtcttactactttaaatcc

SEQ ID NO: 5263759 - DNA, 13 bp, Homo sapiens
atgtcttagtgac

SEQ ID NO: 5263760 - DNA, 12 bp, Homo sapiens
atgtcttatttt

SEQ ID NO: 5263761 - DNA, 20 bp, Homo sapiens
atgtcttattttattatttc

SEQ ID NO: 5263762 - DNA, 20 bp, Homo sapiens
atgtcttcaaggcttcagtc

SEQ ID NO: 5263763 - DNA, 15 bp, Homo sapiens
atgtcttcagtggaa

SEQ ID NO: 5263764 - DNA, 22 bp, Homo sapiens
atgtcttcatacctacatgtat

SEQ ID NO: 5263765 - DNA, 20 bp, Homo sapiens
atgtcttcatcacttcttcc

SEQ ID NO: 5263766 - DNA, 23 bp, Homo sapiens
atgtcttcatcacttcttccact

SEQ ID NO: 5263767 - DNA, 18 bp, Homo sapiens
atgtcttccatgtatctt

SEQ ID NO: 5263768 - DNA, 12 bp, Homo sapiens
atgtcttccctg

SEQ ID NO: 5263769 - DNA, 13 bp, Homo sapiens
atgtcttccctgg

SEQ ID NO: 5263770 - DNA, 16 bp, Homo sapiens
atgtcttccctgggct

SEQ ID NO: 5263771 - DNA, 17 bp, Homo sapiens
atgtcttcgtacagttc

SEQ ID NO: 5263772 - DNA, 14 bp, Homo sapiens
atgtcttctgcctg

SEQ ID NO: 5263773 - DNA, 15 bp, Homo sapiens
atgtcttctgcctgt

SEQ ID NO: 5263774 - DNA, 17 bp, Homo sapiens
atgtcttctgcctgtta

SEQ ID NO: 5263775 - DNA, 19 bp, Homo sapiens
atgtcttctgcctgttata

SEQ ID NO: 5263776 - DNA, 23 bp, Homo sapiens
atgtcttctgctgttcttcactt

SEQ ID NO: 5263777 - DNA, 16 bp, Homo sapiens
atgtcttctggtgtca

SEQ ID NO: 5263778 - DNA, 14 bp, Homo sapiens
atgtcttcttgaaa

SEQ ID NO: 5263779 - DNA, 17 bp, Homo sapiens
atgtcttgagatgtatt

SEQ ID NO: 5263780 - DNA, 22 bp, Homo sapiens
atgtcttgagatgtattatgca

SEQ ID NO: 5263781 - DNA, 20 bp, Homo sapiens
atgtcttggaacattggaat

SEQ ID NO: 5263782 - DNA, 13 bp, Homo sapiens
atgtcttggacac

SEQ ID NO: 5263783 - DNA, 19 bp, Homo sapiens
atgtcttggccactatgga

SEQ ID NO: 5263784 - DNA, 17 bp, Homo sapiens
atgtcttgtacatgtgt

SEQ ID NO: 5263785 - DNA, 16 bp, Homo sapiens
atgtcttgtatttaaa

SEQ ID NO: 5263786 - DNA, 23 bp, Homo sapiens
atgtcttgtatttaaaaacattt

SEQ ID NO: 5263787 - DNA, 13 bp, Homo sapiens
atgtcttgtcata

SEQ ID NO: 5263788 - DNA, 10 bp, Homo sapiens
atgtcttgtg

SEQ ID NO: 5263789 - DNA, 15 bp, Homo sapiens
atgtcttgtgcataa

SEQ ID NO: 5263790 - DNA, 14 bp, Homo sapiens
atgtcttgtgtatt

SEQ ID NO: 5263791 - DNA, 13 bp, Homo sapiens
atgtcttgttaat

SEQ ID NO: 5263792 - DNA, 21 bp, Homo sapiens
atgtcttgttaatattctttc

SEQ ID NO: 5263793 - DNA, 21 bp, Homo sapiens
atgtctttattagtaacatca

SEQ ID NO: 5263794 - DNA, 16 bp, Homo sapiens
atgtctttcatgtaaa

SEQ ID NO: 5263795 - DNA, 20 bp, Homo sapiens
atgtctttccacttctctgg

SEQ ID NO: 5263796 - DNA, 18 bp, Homo sapiens
atgtctttctccaaagtt

SEQ ID NO: 5263797 - DNA, 17 bp, Homo sapiens
atgtctttctcctctgg

SEQ ID NO: 5263798 - DNA, 14 bp, Homo sapiens
atgtctttcttgta

SEQ ID NO: 5263799 - DNA, 13 bp, Homo sapiens
atgtctttggaaa

SEQ ID NO: 5263800 - DNA, 22 bp, Homo sapiens
atgtctttggcttcagaattgt

SEQ ID NO: 5263801 - DNA, 12 bp, Homo sapiens
atgtctttgtaa

SEQ ID NO: 5263802 - DNA, 21 bp, Homo sapiens
atgtctttgtaagtcagtgtt

SEQ ID NO: 5263803 - DNA, 14 bp, Homo sapiens
atgtcttttaaaat

SEQ ID NO: 5263804 - DNA, 20 bp, Homo sapiens
atgtcttttatatttgtatc

SEQ ID NO: 5263805 - DNA, 22 bp, Homo sapiens
atgtcttttatatttgtatcga

SEQ ID NO: 5263806 - DNA, 16 bp, Homo sapiens
atgtcttttcccattt

SEQ ID NO: 5263807 - DNA, 21 bp, Homo sapiens
atgtcttttcccatttatcta

SEQ ID NO: 5263808 - DNA, 16 bp, Homo sapiens
atgtctttttaagctt

SEQ ID NO: 5263809 - DNA, 23 bp, Homo sapiens
atgtctttttaagcttatttaat

SEQ ID NO: 5263810 - DNA, 17 bp, Homo sapiens
atgtcttttttttaatg

SEQ ID NO: 5263811 - DNA, 18 bp, Homo sapiens
atgtcttttttttaatgt

SEQ ID NO: 5263812 - DNA, 12 bp, Homo sapiens
atgtgaaaaaaa

SEQ ID NO: 5263813 - DNA, 19 bp, Homo sapiens
atgtgaaaaaaaaaagtaa

SEQ ID NO: 5263814 - DNA, 15 bp, Homo sapiens
atgtgaaaaaaatga

SEQ ID NO: 5263815 - DNA, 16 bp, Homo sapiens
atgtgaaaaaaattat

SEQ ID NO: 5263816 - DNA, 11 bp, Homo sapiens
atgtgaaaaac

SEQ ID NO: 5263817 - DNA, 21 bp, Homo sapiens
atgtgaaaaagcctaagaaaa

SEQ ID NO: 5263818 - DNA, 13 bp, Homo sapiens
atgtgaaaaatta

SEQ ID NO: 5263819 - DNA, 18 bp, Homo sapiens
atgtgaaaagtaaaacag

SEQ ID NO: 5263820 - DNA, 19 bp, Homo sapiens
atgtgaaaataaagcagaa

SEQ ID NO: 5263821 - DNA, 22 bp, Homo sapiens
atgtgaaaataaagcagaagca

SEQ ID NO: 5263822 - DNA, 16 bp, Homo sapiens
atgtgaaaatcaaata

SEQ ID NO: 5263823 - DNA, 15 bp, Homo sapiens
atgtgaaaatgcttt

SEQ ID NO: 5263824 - DNA, 19 bp, Homo sapiens
atgtgaaaatgctttgaaa

SEQ ID NO: 5263825 - DNA, 19 bp, Homo sapiens
atgtgaaacacatgccagt

SEQ ID NO: 5263826 - DNA, 13 bp, Homo sapiens
atgtgaaacactt

SEQ ID NO: 5263827 - DNA, 22 bp, Homo sapiens
atgtgaaacactttgcctcctg

SEQ ID NO: 5263828 - DNA, 18 bp, Homo sapiens
atgtgaaaccttttttaa

SEQ ID NO: 5263829 - DNA, 20 bp, Homo sapiens
atgtgaaaccttttttaaga

SEQ ID NO: 5263830 - DNA, 23 bp, Homo sapiens
atgtgaaaccttttttaagattt

SEQ ID NO: 5263831 - DNA, 18 bp, Homo sapiens
atgtgaaactcatctcat

SEQ ID NO: 5263832 - DNA, 21 bp, Homo sapiens
atgtgaaagattatttaaatg

SEQ ID NO: 5263833 - DNA, 14 bp, Homo sapiens
atgtgaaagtgtaa

SEQ ID NO: 5263834 - DNA, 19 bp, Homo sapiens
atgtgaaataaagagttct

SEQ ID NO: 5263835 - DNA, 14 bp, Homo sapiens
atgtgaaatcattc

SEQ ID NO: 5263836 - DNA, 13 bp, Homo sapiens
atgtgaaatctca

SEQ ID NO: 5263837 - DNA, 11 bp, Homo sapiens
atgtgaaattt

SEQ ID NO: 5263838 - DNA, 16 bp, Homo sapiens
atgtgaaatttaaata

SEQ ID NO: 5263839 - DNA, 18 bp, Homo sapiens
atgtgaaatttaaataat

SEQ ID NO: 5263840 - DNA, 20 bp, Homo sapiens
atgtgaaatttacatcattt

SEQ ID NO: 5263841 - DNA, 13 bp, Homo sapiens
atgtgaaattttt

SEQ ID NO: 5263842 - DNA, 23 bp, Homo sapiens
atgtgaacaaatcaaattgctta

SEQ ID NO: 5263843 - DNA, 16 bp, Homo sapiens
atgtgaacaactgttt

SEQ ID NO: 5263844 - DNA, 16 bp, Homo sapiens
atgtgaacagcataag

SEQ ID NO: 5263845 - DNA, 19 bp, Homo sapiens
atgtgaacagcataagttt

SEQ ID NO: 5263846 - DNA, 21 bp, Homo sapiens
atgtgaacagttgtgtttgaa

SEQ ID NO: 5263847 - DNA, 14 bp, Homo sapiens
atgtgaacattcct

SEQ ID NO: 5263848 - DNA, 15 bp, Homo sapiens
atgtgaacattccta

SEQ ID NO: 5263849 - DNA, 13 bp, Homo sapiens
atgtgaacttgta

SEQ ID NO: 5263850 - DNA, 17 bp, Homo sapiens
atgtgaacttgtagctg

SEQ ID NO: 5263851 - DNA, 20 bp, Homo sapiens
atgtgaactttctcagcata

SEQ ID NO: 5263852 - DNA, 14 bp, Homo sapiens
atgtgaagaaaaag

SEQ ID NO: 5263853 - DNA, 17 bp, Homo sapiens
atgtgaagaaaaagacc

SEQ ID NO: 5263854 - DNA, 12 bp, Homo sapiens
atgtgaagaaat

SEQ ID NO: 5263855 - DNA, 17 bp, Homo sapiens
atgtgaagaaataagta

SEQ ID NO: 5263856 - DNA, 15 bp, Homo sapiens
atgtgaagacatttt

SEQ ID NO: 5263857 - DNA, 20 bp, Homo sapiens
atgtgaagacattttttgct

SEQ ID NO: 5263858 - DNA, 21 bp, Homo sapiens
atgtgaagacattttttgcta

SEQ ID NO: 5263859 - DNA, 22 bp, Homo sapiens
atgtgaagaggtctgattggct

SEQ ID NO: 5263860 - DNA, 18 bp, Homo sapiens
atgtgaagataatttgca

SEQ ID NO: 5263861 - DNA, 21 bp, Homo sapiens
atgtgaagatgcattgtagtt

SEQ ID NO: 5263862 - DNA, 14 bp, Homo sapiens
atgtgaagcatgct

SEQ ID NO: 5263863 - DNA, 17 bp, Homo sapiens
atgtgaagcatgctttg

SEQ ID NO: 5263864 - DNA, 21 bp, Homo sapiens
atgtgaagcatgctttgctgc

SEQ ID NO: 5263865 - DNA, 21 bp, Homo sapiens
atgtgaagccaattcagacag

SEQ ID NO: 5263866 - DNA, 22 bp, Homo sapiens
atgtgaagccaattcagacagg

SEQ ID NO: 5263867 - DNA, 23 bp, Homo sapiens
atgtgaagcctggagctttcctg

SEQ ID NO: 5263868 - DNA, 13 bp, Homo sapiens
atgtgaagccttc

SEQ ID NO: 5263869 - DNA, 23 bp, Homo sapiens
atgtgaagctatttgatatgcac

SEQ ID NO: 5263870 - DNA, 21 bp, Homo sapiens
atgtgaagctcacactgatgg

SEQ ID NO: 5263871 - DNA, 20 bp, Homo sapiens
atgtgaaggaccttcactct

SEQ ID NO: 5263872 - DNA, 23 bp, Homo sapiens
atgtgaagggaaggaagaggaag

SEQ ID NO: 5263873 - DNA, 16 bp, Homo sapiens
atgtgaagggtggggt

SEQ ID NO: 5263874 - DNA, 14 bp, Homo sapiens
atgtgaagtgttaa

SEQ ID NO: 5263875 - DNA, 19 bp, Homo sapiens
atgtgaagttcatcttgca

SEQ ID NO: 5263876 - DNA, 23 bp, Homo sapiens
atgtgaagttcatcttgcagcat

SEQ ID NO: 5263877 - DNA, 19 bp, Homo sapiens
atgtgaataatggcactga

SEQ ID NO: 5263878 - DNA, 12 bp, Homo sapiens
atgtgaatcaga

SEQ ID NO: 5263879 - DNA, 15 bp, Homo sapiens
atgtgaatcagaccc

SEQ ID NO: 5263880 - DNA, 21 bp, Homo sapiens
atgtgaatcagaccctacccc

SEQ ID NO: 5263881 - DNA, 23 bp, Homo sapiens
atgtgaatcgcaaggcctgtgct

SEQ ID NO: 5263882 - DNA, 20 bp, Homo sapiens
atgtgaatcgcagctgtggg

SEQ ID NO: 5263883 - DNA, 22 bp, Homo sapiens
atgtgaatctatgctggtgaaa

SEQ ID NO: 5263884 - DNA, 20 bp, Homo sapiens
atgtgaatgatctctctgaa

SEQ ID NO: 5263885 - DNA, 11 bp, Homo sapiens
atgtgaatgtg

SEQ ID NO: 5263886 - DNA, 13 bp, Homo sapiens
atgtgaattacta

SEQ ID NO: 5263887 - DNA, 17 bp, Homo sapiens
atgtgaattactaactt

SEQ ID NO: 5263888 - DNA, 18 bp, Homo sapiens
atgtgaattactaacttc

SEQ ID NO: 5263889 - DNA, 20 bp, Homo sapiens
atgtgaattactaacttcta

SEQ ID NO: 5263890 - DNA, 16 bp, Homo sapiens
atgtgaattctgtgaa

SEQ ID NO: 5263891 - DNA, 18 bp, Homo sapiens
atgtgaattctgtgaaga

SEQ ID NO: 5263892 - DNA, 20 bp, Homo sapiens
atgtgaattctgtgaagaat

SEQ ID NO: 5263893 - DNA, 14 bp, Homo sapiens
atgtgaatttcaac

SEQ ID NO: 5263894 - DNA, 14 bp, Homo sapiens
atgtgaatttgagt

SEQ ID NO: 5263895 - DNA, 12 bp, Homo sapiens
atgtgaattttt

SEQ ID NO: 5263896 - DNA, 13 bp, Homo sapiens
atgtgaattttta

SEQ ID NO: 5263897 - DNA, 14 bp, Homo sapiens
atgtgaatttttaa

SEQ ID NO: 5263898 - DNA, 18 bp, Homo sapiens
atgtgaatttttatttct

SEQ ID NO: 5263899 - DNA, 15 bp, Homo sapiens
atgtgaatttttgcc

SEQ ID NO: 5263900 - DNA, 20 bp, Homo sapiens
atgtgacaacctttgtgtaa

SEQ ID NO: 5263901 - DNA, 11 bp, Homo sapiens
atgtgacacat

SEQ ID NO: 5263902 - DNA, 12 bp, Homo sapiens
atgtgacagaca

SEQ ID NO: 5263903 - DNA, 16 bp, Homo sapiens
atgtgacatgttgctc

SEQ ID NO: 5263904 - DNA, 15 bp, Homo sapiens
atgtgacattaacaa

SEQ ID NO: 5263905 - DNA, 21 bp, Homo sapiens
atgtgacattccatgacgaca

SEQ ID NO: 5263906 - DNA, 15 bp, Homo sapiens
atgtgacattcctga

SEQ ID NO: 5263907 - DNA, 18 bp, Homo sapiens
atgtgacattcttaaaaa

SEQ ID NO: 5263908 - DNA, 23 bp, Homo sapiens
atgtgacattcttaaaaaaagaa

SEQ ID NO: 5263909 - DNA, 11 bp, Homo sapiens
atgtgacattt

SEQ ID NO: 5263910 - DNA, 13 bp, Homo sapiens
atgtgacatttac

SEQ ID NO: 5263911 - DNA, 19 bp, Homo sapiens
atgtgacatttatatattg

SEQ ID NO: 5263912 - DNA, 14 bp, Homo sapiens
atgtgacatttctc

SEQ ID NO: 5263913 - DNA, 18 bp, Homo sapiens
atgtgacatttgtcattt

SEQ ID NO: 5263914 - DNA, 19 bp, Homo sapiens
atgtgacatttgtcatttt

SEQ ID NO: 5263915 - DNA, 21 bp, Homo sapiens
atgaatgcagcactgctgcct

SEQ ID NO: 5263916 - DNA, 14 bp, Homo sapiens
atgaatgcagtata

SEQ ID NO: 5263917 - DNA, 18 bp, Homo sapiens
atgaatgcagtataaaat

SEQ ID NO: 5263918 - DNA, 19 bp, Homo sapiens
atgaatgcagtataaaatg

SEQ ID NO: 5263919 - DNA, 13 bp, Homo sapiens
atgaatgcccagt

SEQ ID NO: 5263920 - DNA, 13 bp, Homo sapiens
atgaatgccttcc

SEQ ID NO: 5263921 - DNA, 20 bp, Homo sapiens
atgaatgcctttcaaacatt

SEQ ID NO: 5263922 - DNA, 12 bp, Homo sapiens
atgaatgcttaa

SEQ ID NO: 5263923 - DNA, 21 bp, Homo sapiens
atgaatgcttaaagaattcaa

SEQ ID NO: 5263924 - DNA, 16 bp, Homo sapiens
atgaatgcttttagtg

SEQ ID NO: 5263925 - DNA, 20 bp, Homo sapiens
atgaatgggatattttgaaa

SEQ ID NO: 5263926 - DNA, 18 bp, Homo sapiens
atgaatggtctggcaata

SEQ ID NO: 5263927 - DNA, 18 bp, Homo sapiens
atgaatggttctttatca

SEQ ID NO: 5263928 - DNA, 13 bp, Homo sapiens
atgaatgtaaatt

SEQ ID NO: 5263929 - DNA, 15 bp, Homo sapiens
atgaatgtaaatttg

SEQ ID NO: 5263930 - DNA, 19 bp, Homo sapiens
atgaatgtactatgtctga

SEQ ID NO: 5263931 - DNA, 13 bp, Homo sapiens
atgaatgtatcag

SEQ ID NO: 5263932 - DNA, 15 bp, Homo sapiens
atgaatgtatttatt

SEQ ID NO: 5263933 - DNA, 16 bp, Homo sapiens
atgaatgtgaagcctt

SEQ ID NO: 5263934 - DNA, 17 bp, Homo sapiens
atgaatgtgaagccttc

SEQ ID NO: 5263935 - DNA, 12 bp, Homo sapiens
atgaatgtgctg

SEQ ID NO: 5263936 - DNA, 19 bp, Homo sapiens
atgaatgtgctgaagcaaa

SEQ ID NO: 5263937 - DNA, 12 bp, Homo sapiens
atgaatgtgtaa

SEQ ID NO: 5263938 - DNA, 18 bp, Homo sapiens
atgaatgtgttgatttga

SEQ ID NO: 5263939 - DNA, 22 bp, Homo sapiens
atgaatgttcatatagccaggg

SEQ ID NO: 5263940 - DNA, 14 bp, Homo sapiens
atgaattaaataaa

SEQ ID NO: 5263941 - DNA, 16 bp, Homo sapiens
atgaattaagaaagat

SEQ ID NO: 5263942 - DNA, 21 bp, Homo sapiens
atgaattaagggccagaaaaa

SEQ ID NO: 5263943 - DNA, 15 bp, Homo sapiens
atgaattaagttttt

SEQ ID NO: 5263944 - DNA, 16 bp, Homo sapiens
atgaattacatttgta

SEQ ID NO: 5263945 - DNA, 17 bp, Homo sapiens
atgaattacatttgtat

SEQ ID NO: 5263946 - DNA, 20 bp, Homo sapiens
atgaattagaagaaaatgga

SEQ ID NO: 5263947 - DNA, 14 bp, Homo sapiens
atgaattagccaaa

SEQ ID NO: 5263948 - DNA, 19 bp, Homo sapiens
atgaattataacagttata

SEQ ID NO: 5263949 - DNA, 19 bp, Homo sapiens
atgaattataactagacat

SEQ ID NO: 5263950 - DNA, 23 bp, Homo sapiens
atgaattatcctatttcagtact

SEQ ID NO: 5263951 - DNA, 18 bp, Homo sapiens
atgaattatcttggatga

SEQ ID NO: 5263952 - DNA, 15 bp, Homo sapiens
atgaattattacagt

SEQ ID NO: 5263953 - DNA, 17 bp, Homo sapiens
atgaattattacagtgt

SEQ ID NO: 5263954 - DNA, 15 bp, Homo sapiens
atgaattattttgat

SEQ ID NO: 5263955 - DNA, 15 bp, Homo sapiens
atgaattcacaaaca

SEQ ID NO: 5263956 - DNA, 19 bp, Homo sapiens
atgaattcacaaacaaatg

SEQ ID NO: 5263957 - DNA, 21 bp, Homo sapiens
atgaattccactccttccaga

SEQ ID NO: 5263958 - DNA, 17 bp, Homo sapiens
atgaattcctatatacc

SEQ ID NO: 5263959 - DNA, 23 bp, Homo sapiens
atgaattcgatgcgtattctgtg

SEQ ID NO: 5263960 - DNA, 12 bp, Homo sapiens
atgaattcttta

SEQ ID NO: 5263961 - DNA, 17 bp, Homo sapiens
atgaattgaatgctcta

SEQ ID NO: 5263962 - DNA, 17 bp, Homo sapiens
atgaattgataaaagag

SEQ ID NO: 5263963 - DNA, 22 bp, Homo sapiens
atgaattgcctttgataattct

SEQ ID NO: 5263964 - DNA, 15 bp, Homo sapiens
atgaattgctgtcta

SEQ ID NO: 5263965 - DNA, 23 bp, Homo sapiens
atgaattggaactgcaatgaaag

SEQ ID NO: 5263966 - DNA, 15 bp, Homo sapiens
atgaattgggaacat

SEQ ID NO: 5263967 - DNA, 14 bp, Homo sapiens
atgaatttaaatat

SEQ ID NO: 5263968 - DNA, 16 bp, Homo sapiens
atgaatttaaggcaaa

SEQ ID NO: 5263969 - DNA, 13 bp, Homo sapiens
atgaatttaccat

SEQ ID NO: 5263970 - DNA, 20 bp, Homo sapiens
atgaatttaccatcaaacaa

SEQ ID NO: 5263971 - DNA, 15 bp, Homo sapiens
atgaatttatcattt

SEQ ID NO: 5263972 - DNA, 14 bp, Homo sapiens
atgaatttatctga

SEQ ID NO: 5263973 - DNA, 17 bp, Homo sapiens
atgaatttcatgtgaat

SEQ ID NO: 5263974 - DNA, 18 bp, Homo sapiens
atgaatttcttctaatta

SEQ ID NO: 5263975 - DNA, 13 bp, Homo sapiens
atgaatttgctaa

SEQ ID NO: 5263976 - DNA, 15 bp, Homo sapiens
atgaatttggagact

SEQ ID NO: 5263977 - DNA, 20 bp, Homo sapiens
atgaatttggagactctgtg

SEQ ID NO: 5263978 - DNA, 19 bp, Homo sapiens
atgaatttggtctgcctct

SEQ ID NO: 5263979 - DNA, 21 bp, Homo sapiens
atgaatttgtccatttaaaaa

SEQ ID NO: 5263980 - DNA, 16 bp, Homo sapiens
atgaattttaaaagca

SEQ ID NO: 5263981 - DNA, 21 bp, Homo sapiens
atgaattttaaaagcatatat

SEQ ID NO: 5263982 - DNA, 17 bp, Homo sapiens
atgaattttaaaatctg

SEQ ID NO: 5263983 - DNA, 16 bp, Homo sapiens
atgaattttaagggtt

SEQ ID NO: 5263984 - DNA, 17 bp, Homo sapiens
atgaattttagcttttg

SEQ ID NO: 5263985 - DNA, 18 bp, Homo sapiens
atgaattttagcttttgt

SEQ ID NO: 5263986 - DNA, 21 bp, Homo sapiens
atgaattttatcagccatgtt

SEQ ID NO: 5263987 - DNA, 13 bp, Homo sapiens
atgaattttatgt

SEQ ID NO: 5263988 - DNA, 21 bp, Homo sapiens
atgaattttccacgcagttct

SEQ ID NO: 5263989 - DNA, 14 bp, Homo sapiens
atgaattttctgca

SEQ ID NO: 5263990 - DNA, 13 bp, Homo sapiens
atgaattttgtaa

SEQ ID NO: 5263991 - DNA, 14 bp, Homo sapiens
atgaattttgtaag

SEQ ID NO: 5263992 - DNA, 17 bp, Homo sapiens
atgaattttgtaagtat

SEQ ID NO: 5263993 - DNA, 22 bp, Homo sapiens
atgaattttgtaagtataagaa

SEQ ID NO: 5263994 - DNA, 20 bp, Homo sapiens
atgaatttttatgatttctt

SEQ ID NO: 5263995 - DNA, 15 bp, Homo sapiens
atgacaaaaattcaa

SEQ ID NO: 5263996 - DNA, 23 bp, Homo sapiens
atgacaaaaattcaactcagact

SEQ ID NO: 5263997 - DNA, 12 bp, Homo sapiens
atgacaaaagat

SEQ ID NO: 5263998 - DNA, 22 bp, Homo sapiens
atgacaaacatcattgtttaga

SEQ ID NO: 5263999 - DNA, 13 bp, Homo sapiens
atgacaaacccag

SEQ ID NO: 5264000 - DNA, 14 bp, Homo sapiens
atgacaaagaaaat

SEQ ID NO: 5264001 - DNA, 20 bp, Homo sapiens
atgacaaagcagattcagaa

SEQ ID NO: 5264002 - DNA, 13 bp, Homo sapiens
atgacaaagccat

SEQ ID NO: 5264003 - DNA, 17 bp, Homo sapiens
atgacaaagccattctt

SEQ ID NO: 5264004 - DNA, 19 bp, Homo sapiens
atgacaaagccattctttt

SEQ ID NO: 5264005 - DNA, 14 bp, Homo sapiens
atgacaaagtgttg

SEQ ID NO: 5264006 - DNA, 20 bp, Homo sapiens
atgacaaatgaaagagaaaa

SEQ ID NO: 5264007 - DNA, 14 bp, Homo sapiens
atgacaaattatat

SEQ ID NO: 5264008 - DNA, 17 bp, Homo sapiens
atgacaaattggggctg

SEQ ID NO: 5264009 - DNA, 18 bp, Homo sapiens
atgacaacttctaattgc

SEQ ID NO: 5264010 - DNA, 20 bp, Homo sapiens
atgacaacttctaattgcca

SEQ ID NO: 5264011 - DNA, 19 bp, Homo sapiens
atgacaacttttaaagaaa

SEQ ID NO: 5264012 - DNA, 13 bp, Homo sapiens
atgacaagatggt

SEQ ID NO: 5264013 - DNA, 12 bp, Homo sapiens
atgacaagatgt

SEQ ID NO: 5264014 - DNA, 16 bp, Homo sapiens
atgacaagccccaggc

SEQ ID NO: 5264015 - DNA, 20 bp, Homo sapiens
atgacaagccccaggcaggc

SEQ ID NO: 5264016 - DNA, 19 bp, Homo sapiens
atgacaagctgtatcactg

SEQ ID NO: 5264017 - DNA, 20 bp, Homo sapiens
atgacaagctgtatcactgc

SEQ ID NO: 5264018 - DNA, 15 bp, Homo sapiens
atgacaataaagctt

SEQ ID NO: 5264019 - DNA, 23 bp, Homo sapiens
atgacaataaattttatctcagt

SEQ ID NO: 5264020 - DNA, 18 bp, Homo sapiens
atgacaatcatgtgtgtt

SEQ ID NO: 5264021 - DNA, 15 bp, Homo sapiens
atgacaattgtgaac

SEQ ID NO: 5264022 - DNA, 16 bp, Homo sapiens
atgacaattgtgaaca

SEQ ID NO: 5264023 - DNA, 19 bp, Homo sapiens
atgacaattgtgaacatga

SEQ ID NO: 5264024 - DNA, 20 bp, Homo sapiens
atgacaattgtgaacatgat

SEQ ID NO: 5264025 - DNA, 17 bp, Homo sapiens
atgacaatttcaaaatg

SEQ ID NO: 5264026 - DNA, 19 bp, Homo sapiens
atgacaatttcaaaatgca

SEQ ID NO: 5264027 - DNA, 14 bp, Homo sapiens
atgacaatttttgc

SEQ ID NO: 5264028 - DNA, 17 bp, Homo sapiens
atgacacagcttgtgaa

SEQ ID NO: 5264029 - DNA, 17 bp, Homo sapiens
atgacacagttatcaaa

SEQ ID NO: 5264030 - DNA, 16 bp, Homo sapiens
atgacacataaatctg

SEQ ID NO: 5264031 - DNA, 14 bp, Homo sapiens
atgacacatgcaag

SEQ ID NO: 5264032 - DNA, 22 bp, Homo sapiens
atgacacatgcaaggtcatttt

SEQ ID NO: 5264033 - DNA, 17 bp, Homo sapiens
atgacacatttggcagt

SEQ ID NO: 5264034 - DNA, 15 bp, Homo sapiens
atgacacatttgttg

SEQ ID NO: 5264035 - DNA, 17 bp, Homo sapiens
atgacacatttgttgca

SEQ ID NO: 5264036 - DNA, 20 bp, Homo sapiens
atgacacccaccctgtgcca

SEQ ID NO: 5264037 - DNA, 15 bp, Homo sapiens
atgacacccagacct

SEQ ID NO: 5264038 - DNA, 17 bp, Homo sapiens
atgacacccatgccaga

SEQ ID NO: 5264039 - DNA, 20 bp, Homo sapiens
atgacacccatgccagagag

SEQ ID NO: 5264040 - DNA, 21 bp, Homo sapiens
atgacacccctggcctgactc

SEQ ID NO: 5264041 - DNA, 22 bp, Homo sapiens
atgacacccgtgagcgcctgtg

SEQ ID NO: 5264042 - DNA, 18 bp, Homo sapiens
atgacacgaatattgctg

SEQ ID NO: 5264043 - DNA, 20 bp, Homo sapiens
atgacacgaatattgctgat

SEQ ID NO: 5264044 - DNA, 23 bp, Homo sapiens
atgacacggtaggccaagctgaa

SEQ ID NO: 5264045 - DNA, 21 bp, Homo sapiens
atgacactagaaaacttgact

SEQ ID NO: 5264046 - DNA, 15 bp, Homo sapiens
atgacactcctagac

SEQ ID NO: 5264047 - DNA, 15 bp, Homo sapiens
atgacactgtttcct

SEQ ID NO: 5264048 - DNA, 15 bp, Homo sapiens
atgacacttgtacaa

SEQ ID NO: 5264049 - DNA, 16 bp, Homo sapiens
atgacacttgtacaat

SEQ ID NO: 5264050 - DNA, 22 bp, Homo sapiens
atgacacttgtccccaaatccg

SEQ ID NO: 5264051 - DNA, 12 bp, Homo sapiens
atgacagaatat

SEQ ID NO: 5264052 - DNA, 15 bp, Homo sapiens
atgacagaatataca

SEQ ID NO: 5264053 - DNA, 19 bp, Homo sapiens
atgacagaatatacacatt

SEQ ID NO: 5264054 - DNA, 19 bp, Homo sapiens
atgacagaatttgtgaata

SEQ ID NO: 5264055 - DNA, 13 bp, Homo sapiens
atgacagagccag

SEQ ID NO: 5264056 - DNA, 23 bp, Homo sapiens
atgacagaggaggatgtaaggcc

SEQ ID NO: 5264057 - DNA, 20 bp, Homo sapiens
atgacagaggtttgaaggag

SEQ ID NO: 5264058 - DNA, 22 bp, Homo sapiens
atgacagaggtttgaaggagaa

SEQ ID NO: 5264059 - DNA, 23 bp, Homo sapiens
atgacagaggtttgaaggagaat

SEQ ID NO: 5264060 - DNA, 22 bp, Homo sapiens
atgacagataaatccttaacat

SEQ ID NO: 5264061 - DNA, 16 bp, Homo sapiens
atgacagataacctaa

SEQ ID NO: 5264062 - DNA, 21 bp, Homo sapiens
atgacagatatatttaagcct

SEQ ID NO: 5264063 - DNA, 15 bp, Homo sapiens
atgacagatgaagaa

SEQ ID NO: 5264064 - DNA, 19 bp, Homo sapiens
atgacagatggtgaagtaa

SEQ ID NO: 5264065 - DNA, 14 bp, Homo sapiens
atgacagattctga

SEQ ID NO: 5264066 - DNA, 18 bp, Homo sapiens
atgacagcctctatccta

SEQ ID NO: 5264067 - DNA, 15 bp, Homo sapiens
atgacagcctgcagc

SEQ ID NO: 5264068 - DNA, 12 bp, Homo sapiens
atgacagccttg

SEQ ID NO: 5264069 - DNA, 15 bp, Homo sapiens
atgacagccttgcaa

SEQ ID NO: 5264070 - DNA, 19 bp, Homo sapiens
atgacagccttgcaaccca

SEQ ID NO: 5264071 - DNA, 16 bp, Homo sapiens
atgacaggctctcctg

SEQ ID NO: 5264072 - DNA, 12 bp, Homo sapiens
atgacagggcag

SEQ ID NO: 5264073 - DNA, 16 bp, Homo sapiens
atgacagggcagagca

SEQ ID NO: 5264074 - DNA, 16 bp, Homo sapiens
atgacaggtaaattaa

SEQ ID NO: 5264075 - DNA, 15 bp, Homo sapiens
atgacaggtgtgagc

SEQ ID NO: 5264076 - DNA, 16 bp, Homo sapiens
atgacaggtgtgagcc

SEQ ID NO: 5264077 - DNA, 17 bp, Homo sapiens
atgacaggtgtgagcca

SEQ ID NO: 5264078 - DNA, 14 bp, Homo sapiens
atgacagtaatatt

SEQ ID NO: 5264079 - DNA, 12 bp, Homo sapiens
atgacagtaatt

SEQ ID NO: 5264080 - DNA, 15 bp, Homo sapiens
atgacagtcaaaaga

SEQ ID NO: 5264081 - DNA, 20 bp, Homo sapiens
atgacagtccgtcaaaacag

SEQ ID NO: 5264082 - DNA, 21 bp, Homo sapiens
atgacagtccgtcaaaacaga

SEQ ID NO: 5264083 - DNA, 20 bp, Homo sapiens
atgacagtgaagcagcactg

SEQ ID NO: 5264084 - DNA, 15 bp, Homo sapiens
atgacagtgcttgca

SEQ ID NO: 5264085 - DNA, 23 bp, Homo sapiens
atgacagtgcttgcatcctattt

SEQ ID NO: 5264086 - DNA, 20 bp, Homo sapiens
atgacataacagtgcagggc

SEQ ID NO: 5264087 - DNA, 22 bp, Homo sapiens
atgacataataaagtattttct

SEQ ID NO: 5264088 - DNA, 14 bp, Homo sapiens
atgacatagcagtt

SEQ ID NO: 5264089 - DNA, 16 bp, Homo sapiens
atgacataggccaagg

SEQ ID NO: 5264090 - DNA, 17 bp, Homo sapiens
atgacataggccaaggc

SEQ ID NO: 5264091 - DNA, 17 bp, Homo sapiens
atgacatatcacatgtc

SEQ ID NO: 5264092 - DNA, 13 bp, Homo sapiens
atgacatattttt

SEQ ID NO: 5264093 - DNA, 14 bp, Homo sapiens
atgacatcacttgt

SEQ ID NO: 5264094 - DNA, 17 bp, Homo sapiens
atgacatccacatgcac

SEQ ID NO: 5264095 - DNA, 20 bp, Homo sapiens
atgtgaccaaaaaaaagcat

SEQ ID NO: 5264096 - DNA, 16 bp, Homo sapiens
atgtgaccataatgta

SEQ ID NO: 5264097 - DNA, 18 bp, Homo sapiens
atgtgaccatgtgaatct

SEQ ID NO: 5264098 - DNA, 16 bp, Homo sapiens
atgtgaccattctgcc

SEQ ID NO: 5264099 - DNA, 17 bp, Homo sapiens
atgtgaccattctgcct

SEQ ID NO: 5264100 - DNA, 19 bp, Homo sapiens
atgtgaccattctgcctct

SEQ ID NO: 5264101 - DNA, 20 bp, Homo sapiens
atgtgacctggggcagataa

SEQ ID NO: 5264102 - DNA, 20 bp, Homo sapiens
atgtgacctttaattcaggt

SEQ ID NO: 5264103 - DNA, 18 bp, Homo sapiens
atgtgactaaaaatgcat

SEQ ID NO: 5264104 - DNA, 17 bp, Homo sapiens
atgtgactaccgtgcca

SEQ ID NO: 5264105 - DNA, 20 bp, Homo sapiens
atgtgactaccgtgccagca

SEQ ID NO: 5264106 - DNA, 14 bp, Homo sapiens
atgtgactcctgaa

SEQ ID NO: 5264107 - DNA, 13 bp, Homo sapiens
atgtgactctgaa

SEQ ID NO: 5264108 - DNA, 22 bp, Homo sapiens
atgtgactctggcttggcctat

SEQ ID NO: 5264109 - DNA, 12 bp, Homo sapiens
atgtgactcttt

SEQ ID NO: 5264110 - DNA, 17 bp, Homo sapiens
atgtgactgcatcatat

SEQ ID NO: 5264111 - DNA, 18 bp, Homo sapiens
atgtgactgcatcatata

SEQ ID NO: 5264112 - DNA, 19 bp, Homo sapiens
atgtgactgcatcatatat

SEQ ID NO: 5264113 - DNA, 19 bp, Homo sapiens
atgtgactgttgagggcct

SEQ ID NO: 5264114 - DNA, 18 bp, Homo sapiens
atgtgacttcatgctata

SEQ ID NO: 5264115 - DNA, 23 bp, Homo sapiens
atgtgacttgcatcgtggagaca

SEQ ID NO: 5264116 - DNA, 17 bp, Homo sapiens
atgtgacttggccgggc

SEQ ID NO: 5264117 - DNA, 16 bp, Homo sapiens
atgtgagaaagcagat

SEQ ID NO: 5264118 - DNA, 12 bp, Homo sapiens
atgtgagaaatg

SEQ ID NO: 5264119 - DNA, 16 bp, Homo sapiens
atgtgagacagcaagt

SEQ ID NO: 5264120 - DNA, 15 bp, Homo sapiens
atgtgagagaaagtg

SEQ ID NO: 5264121 - DNA, 22 bp, Homo sapiens
atgtgagatagttttcatttta

SEQ ID NO: 5264122 - DNA, 22 bp, Homo sapiens
atgtgagcactatctttcagga

SEQ ID NO: 5264123 - DNA, 21 bp, Homo sapiens
atgtgagccaccgctgccagc

SEQ ID NO: 5264124 - DNA, 22 bp, Homo sapiens
atgtgagccaccgctgccagca

SEQ ID NO: 5264125 - DNA, 17 bp, Homo sapiens
atgtgagccgcctcgga

SEQ ID NO: 5264126 - DNA, 17 bp, Homo sapiens
atgtgagccttgtgcat

SEQ ID NO: 5264127 - DNA, 15 bp, Homo sapiens
atgtgagctcttcct

SEQ ID NO: 5264128 - DNA, 19 bp, Homo sapiens
atgtgagctgctgccatga

SEQ ID NO: 5264129 - DNA, 14 bp, Homo sapiens
atgtgaggaggaaa

SEQ ID NO: 5264130 - DNA, 17 bp, Homo sapiens
atgtgaggaggaaaagg

SEQ ID NO: 5264131 - DNA, 12 bp, Homo sapiens
atgtgaggatgt

SEQ ID NO: 5264132 - DNA, 22 bp, Homo sapiens
atgtgaggggtagtgggatggt

SEQ ID NO: 5264133 - DNA, 19 bp, Homo sapiens
atgtgaggggtccctagca

SEQ ID NO: 5264134 - DNA, 15 bp, Homo sapiens
atgtgagggtttgta

SEQ ID NO: 5264135 - DNA, 14 bp, Homo sapiens
atgtgagtatttct

SEQ ID NO: 5264136 - DNA, 18 bp, Homo sapiens
atgtgagtatttctgttc

SEQ ID NO: 5264137 - DNA, 22 bp, Homo sapiens
atgtgagtatttctgttccttt

SEQ ID NO: 5264138 - DNA, 18 bp, Homo sapiens
atgtgagtcattatgtag

SEQ ID NO: 5264139 - DNA, 15 bp, Homo sapiens
atgtgagtccctgtg

SEQ ID NO: 5264140 - DNA, 14 bp, Homo sapiens
atgtgagtctggga

SEQ ID NO: 5264141 - DNA, 15 bp, Homo sapiens
atgtgagtctgggat

SEQ ID NO: 5264142 - DNA, 20 bp, Homo sapiens
atgtgagtgacgatgatgta

SEQ ID NO: 5264143 - DNA, 16 bp, Homo sapiens
atgtgagtggttgaat

SEQ ID NO: 5264144 - DNA, 17 bp, Homo sapiens
atgtgagtttcagaaat

SEQ ID NO: 5264145 - DNA, 19 bp, Homo sapiens
atgtgagtttcagaaattc

SEQ ID NO: 5264146 - DNA, 21 bp, Homo sapiens
atgtgagtttggtctggactg

SEQ ID NO: 5264147 - DNA, 23 bp, Homo sapiens
atgtgagtttggtctggactgac

SEQ ID NO: 5264148 - DNA, 18 bp, Homo sapiens
atgtgataaggaaatcaa

SEQ ID NO: 5264149 - DNA, 21 bp, Homo sapiens
atgtgataatatattgctaaa

SEQ ID NO: 5264150 - DNA, 13 bp, Homo sapiens
atgtgataattgt

SEQ ID NO: 5264151 - DNA, 21 bp, Homo sapiens
atgtgatacccatagcttcca

SEQ ID NO: 5264152 - DNA, 19 bp, Homo sapiens
atgtgatatataagtgtac

SEQ ID NO: 5264153 - DNA, 23 bp, Homo sapiens
atgtgatatataagtgtacatat

SEQ ID NO: 5264154 - DNA, 15 bp, Homo sapiens
atgtgatattctaag

SEQ ID NO: 5264155 - DNA, 13 bp, Homo sapiens
atgtgatattctg

SEQ ID NO: 5264156 - DNA, 19 bp, Homo sapiens
atgtgatattctgttgctt

SEQ ID NO: 5264157 - DNA, 16 bp, Homo sapiens
atgtgatcactgagac

SEQ ID NO: 5264158 - DNA, 23 bp, Homo sapiens
atgtgatcagctttcaaagcatt

SEQ ID NO: 5264159 - DNA, 16 bp, Homo sapiens
atgtgatcaggcccca

SEQ ID NO: 5264160 - DNA, 19 bp, Homo sapiens
atgtgatcaggccccaccc

SEQ ID NO: 5264161 - DNA, 19 bp, Homo sapiens
atgtgatcatagctcactg

SEQ ID NO: 5264162 - DNA, 14 bp, Homo sapiens
atgtgatcatatga

SEQ ID NO: 5264163 - DNA, 15 bp, Homo sapiens
atgtgatcatctttg

SEQ ID NO: 5264164 - DNA, 17 bp, Homo sapiens
atgtgatcatctttgct

SEQ ID NO: 5264165 - DNA, 18 bp, Homo sapiens
atgtgatcatctttgctg

SEQ ID NO: 5264166 - DNA, 19 bp, Homo sapiens
atgtgatcatgtgtggaag

SEQ ID NO: 5264167 - DNA, 20 bp, Homo sapiens
atgtgatcatgtgtggaagt

SEQ ID NO: 5264168 - DNA, 18 bp, Homo sapiens
atgtgatcctaaaattgt

SEQ ID NO: 5264169 - DNA, 16 bp, Homo sapiens
atgtgatccttttatg

SEQ ID NO: 5264170 - DNA, 21 bp, Homo sapiens
atgtgatccttttatgttatt

SEQ ID NO: 5264171 - DNA, 18 bp, Homo sapiens
atgtgatctattactctg

SEQ ID NO: 5264172 - DNA, 16 bp, Homo sapiens
atgtgatctcattgtt

SEQ ID NO: 5264173 - DNA, 22 bp, Homo sapiens
atgtgatctgggcattttcctc

SEQ ID NO: 5264174 - DNA, 17 bp, Homo sapiens
atgtgatctgtcttgta

SEQ ID NO: 5264175 - DNA, 18 bp, Homo sapiens
atgtgatctgtcttgtaa

SEQ ID NO: 5264176 - DNA, 17 bp, Homo sapiens
atgtgatgaatactgta

SEQ ID NO: 5264177 - DNA, 14 bp, Homo sapiens
atgtgatgatgtaa

SEQ ID NO: 5264178 - DNA, 21 bp, Homo sapiens
atgtgatgatgtaattgacgg

SEQ ID NO: 5264179 - DNA, 14 bp, Homo sapiens
atgtgatggactgg

SEQ ID NO: 5264180 - DNA, 18 bp, Homo sapiens
atgtgatgttaactatta

SEQ ID NO: 5264181 - DNA, 14 bp, Homo sapiens
atgtgatgttctaa

SEQ ID NO: 5264182 - DNA, 20 bp, Homo sapiens
atgtgatgttctaaggctct

SEQ ID NO: 5264183 - DNA, 15 bp, Homo sapiens
atgtgattaatgttt

SEQ ID NO: 5264184 - DNA, 15 bp, Homo sapiens
atgtgattacaaggc

SEQ ID NO: 5264185 - DNA, 16 bp, Homo sapiens
atgtgattatcattta

SEQ ID NO: 5264186 - DNA, 17 bp, Homo sapiens
atgtgattctggaagca

SEQ ID NO: 5264187 - DNA, 19 bp, Homo sapiens
atgtgattctggaagcaaa

SEQ ID NO: 5264188 - DNA, 16 bp, Homo sapiens
atgtgattcttctaaa

SEQ ID NO: 5264189 - DNA, 20 bp, Homo sapiens
atgtgattgcctcaataaag

SEQ ID NO: 5264190 - DNA, 21 bp, Homo sapiens
atgtgattgttccataataaa

SEQ ID NO: 5264191 - DNA, 18 bp, Homo sapiens
atgtgatttaatagtgtt

SEQ ID NO: 5264192 - DNA, 16 bp, Homo sapiens
atgtgatttatgcatt

SEQ ID NO: 5264193 - DNA, 20 bp, Homo sapiens
atgtgatttatttatttcta

SEQ ID NO: 5264194 - DNA, 14 bp, Homo sapiens
atgtgattttaact

SEQ ID NO: 5264195 - DNA, 19 bp, Homo sapiens
atgtgattttaactctgtc

SEQ ID NO: 5264196 - DNA, 19 bp, Homo sapiens
atgtgattttcaaatatgt

SEQ ID NO: 5264197 - DNA, 11 bp, Homo sapiens
atgtgattttt

SEQ ID NO: 5264198 - DNA, 17 bp, Homo sapiens
atgtgcaaaaaaagaaa

SEQ ID NO: 5264199 - DNA, 23 bp, Homo sapiens
atgtgcaaaaatttttggattga

SEQ ID NO: 5264200 - DNA, 21 bp, Homo sapiens
atgtgcaaacccactcagaga

SEQ ID NO: 5264201 - DNA, 18 bp, Homo sapiens
atgtgcaaacgctgtatt

SEQ ID NO: 5264202 - DNA, 14 bp, Homo sapiens
atgtgcaaatgcaa

SEQ ID NO: 5264203 - DNA, 14 bp, Homo sapiens
atgtgcaaattttg

SEQ ID NO: 5264204 - DNA, 19 bp, Homo sapiens
atgtgcaaattttgcattt

SEQ ID NO: 5264205 - DNA, 21 bp, Homo sapiens
atgtgcaacctgtggctcagg

SEQ ID NO: 5264206 - DNA, 15 bp, Homo sapiens
atgtgcaactcttgt

SEQ ID NO: 5264207 - DNA, 16 bp, Homo sapiens
atgtgcaactcttgta

SEQ ID NO: 5264208 - DNA, 20 bp, Homo sapiens
atgtgcaagcgacgacagat

SEQ ID NO: 5264209 - DNA, 21 bp, Homo sapiens
atgtgcaaggtgataggaaaa

SEQ ID NO: 5264210 - DNA, 16 bp, Homo sapiens
atgtgcaagtgtatgc

SEQ ID NO: 5264211 - DNA, 14 bp, Homo sapiens
atgtgcaataattt

SEQ ID NO: 5264212 - DNA, 18 bp, Homo sapiens
atgtgcaatttgtaaata

SEQ ID NO: 5264213 - DNA, 22 bp, Homo sapiens
atgtgcacatatcaagaagtca

SEQ ID NO: 5264214 - DNA, 23 bp, Homo sapiens
atgtgcacatgcacgtgtgtgca

SEQ ID NO: 5264215 - DNA, 17 bp, Homo sapiens
atgtgcacatgtgtctg

SEQ ID NO: 5264216 - DNA, 18 bp, Homo sapiens
atgtgcacatgtgtctgt

SEQ ID NO: 5264217 - DNA, 20 bp, Homo sapiens
atgtgcacatgtgtctgtgt

SEQ ID NO: 5264218 - DNA, 15 bp, Homo sapiens
atgtgcacggcagct

SEQ ID NO: 5264219 - DNA, 19 bp, Homo sapiens
atgtgcactgcattagaaa

SEQ ID NO: 5264220 - DNA, 22 bp, Homo sapiens
atgtgcactgcctgcatgagct

SEQ ID NO: 5264221 - DNA, 21 bp, Homo sapiens
atgtgcagactgattggcctg

SEQ ID NO: 5264222 - DNA, 21 bp, Homo sapiens
atgtgcagcagattggaagga

SEQ ID NO: 5264223 - DNA, 13 bp, Homo sapiens
atgtgcagcattt

SEQ ID NO: 5264224 - DNA, 17 bp, Homo sapiens
atgtgcagcatttcact

SEQ ID NO: 5264225 - DNA, 19 bp, Homo sapiens
atgtgcagcgacccttggt

SEQ ID NO: 5264226 - DNA, 21 bp, Homo sapiens
atgtgcagggatattgcctta

SEQ ID NO: 5264227 - DNA, 14 bp, Homo sapiens
atgtgcagtatttt

SEQ ID NO: 5264228 - DNA, 16 bp, Homo sapiens
atgtgcagtgtcttgt

SEQ ID NO: 5264229 - DNA, 20 bp, Homo sapiens
atgtgcagtgtcttgtaaca

SEQ ID NO: 5264230 - DNA, 13 bp, Homo sapiens
atgtgcagtgtgg

SEQ ID NO: 5264231 - DNA, 14 bp, Homo sapiens
atgtgcagtttgga

SEQ ID NO: 5264232 - DNA, 15 bp, Homo sapiens
atgtgcagtttggaa

SEQ ID NO: 5264233 - DNA, 11 bp, Homo sapiens
atgtgcatata

SEQ ID NO: 5264234 - DNA, 12 bp, Homo sapiens
atgtgcatataa

SEQ ID NO: 5264235 - DNA, 18 bp, Homo sapiens
atgtgcatgcataccaca

SEQ ID NO: 5264236 - DNA, 19 bp, Homo sapiens
atgtgcattcttttaaaag

SEQ ID NO: 5264237 - DNA, 16 bp, Homo sapiens
atgtgcattgaatact

SEQ ID NO: 5264238 - DNA, 22 bp, Homo sapiens
atgtgcatttcacctgtgacaa

SEQ ID NO: 5264239 - DNA, 20 bp, Homo sapiens
atgtgcatttttgtgaaatg

SEQ ID NO: 5264240 - DNA, 21 bp, Homo sapiens
atgtgcatttttgtgaaatga

SEQ ID NO: 5264241 - DNA, 17 bp, Homo sapiens
atgtgccaaaactagta

SEQ ID NO: 5264242 - DNA, 15 bp, Homo sapiens
atgtgccaaagcttt

SEQ ID NO: 5264243 - DNA, 13 bp, Homo sapiens
atgtgccaaggtg

SEQ ID NO: 5264244 - DNA, 14 bp, Homo sapiens
atgtgccaattttg

SEQ ID NO: 5264245 - DNA, 12 bp, Homo sapiens
atgtgccacaga

SEQ ID NO: 5264246 - DNA, 15 bp, Homo sapiens
atgtgccacagaggc

SEQ ID NO: 5264247 - DNA, 21 bp, Homo sapiens
atgtgccacagaggccccacc

SEQ ID NO: 5264248 - DNA, 20 bp, Homo sapiens
atgtgccacctgtccggccc

SEQ ID NO: 5264249 - DNA, 23 bp, Homo sapiens
atgtgccacctgtccggcccagt

SEQ ID NO: 5264250 - DNA, 21 bp, Homo sapiens
atgtgccagggcaatgatgaa

SEQ ID NO: 5264251 - DNA, 21 bp, Homo sapiens
atgtgccaggtttttggtctg

SEQ ID NO: 5264252 - DNA, 22 bp, Homo sapiens
atgtgccaggtttttggtctga

SEQ ID NO: 5264253 - DNA, 19 bp, Homo sapiens
atgtgccatgtataatttt

SEQ ID NO: 5264254 - DNA, 14 bp, Homo sapiens
atgtgcccacaggg

SEQ ID NO: 5264255 - DNA, 18 bp, Homo sapiens
atgtgcccagtcatgaca

SEQ ID NO: 5264256 - DNA, 12 bp, Homo sapiens
atgtgcccccag

SEQ ID NO: 5264257 - DNA, 14 bp, Homo sapiens
atgtgcccccagac

SEQ ID NO: 5264258 - DNA, 14 bp, Homo sapiens
atgtgcccctggcc

SEQ ID NO: 5264259 - DNA, 16 bp, Homo sapiens
atgtgcccctggccca

SEQ ID NO: 5264260 - DNA, 22 bp, Homo sapiens
atgtgccccttcgcagctgaag

SEQ ID NO: 5264261 - DNA, 13 bp, Homo sapiens
atgtgccctcctg

SEQ ID NO: 5264262 - DNA, 16 bp, Homo sapiens
atgtgccctcctgagg

SEQ ID NO: 5264263 - DNA, 18 bp, Homo sapiens
atgtgccctcctgaggga

SEQ ID NO: 5264264 - DNA, 22 bp, Homo sapiens
atgtgccctcctgagggaggac

SEQ ID NO: 5264265 - DNA, 13 bp, Homo sapiens
atgtgccctgcct

SEQ ID NO: 5264266 - DNA, 17 bp, Homo sapiens
atgtgccgaatgtgcag

SEQ ID NO: 5264267 - DNA, 21 bp, Homo sapiens
atgtgccgtgttattgtatta

SEQ ID NO: 5264268 - DNA, 19 bp, Homo sapiens
atgtgcctattgctagagc

SEQ ID NO: 5264269 - DNA, 20 bp, Homo sapiens
atgtgcctattgctagagct

SEQ ID NO: 5264270 - DNA, 15 bp, Homo sapiens
atgtgcctcattaag

SEQ ID NO: 5264271 - DNA, 15 bp, Homo sapiens
atgtgcctgcaccag

SEQ ID NO: 5264272 - DNA, 10 bp, Homo sapiens
atgtgcctgg

SEQ ID NO: 5264273 - DNA, 22 bp, Homo sapiens
atgacatccacatgcacatgta

SEQ ID NO: 5264274 - DNA, 23 bp, Homo sapiens
atgacatcctagaggtagagaaa

SEQ ID NO: 5264275 - DNA, 15 bp, Homo sapiens
atgacatctttttaa

SEQ ID NO: 5264276 - DNA, 15 bp, Homo sapiens
atgacatgaatttta

SEQ ID NO: 5264277 - DNA, 22 bp, Homo sapiens
atgacatgaattttagcttttg

SEQ ID NO: 5264278 - DNA, 15 bp, Homo sapiens
atgacatgcactgac

SEQ ID NO: 5264279 - DNA, 23 bp, Homo sapiens
atgacatgcactgacccttccag

SEQ ID NO: 5264280 - DNA, 17 bp, Homo sapiens
atgacatgccaccctct

SEQ ID NO: 5264281 - DNA, 20 bp, Homo sapiens
atgacatgccaccctctcca

SEQ ID NO: 5264282 - DNA, 20 bp, Homo sapiens
atgacatggaggcactgaag

SEQ ID NO: 5264283 - DNA, 17 bp, Homo sapiens
atgacattaaatgcaat

SEQ ID NO: 5264284 - DNA, 21 bp, Homo sapiens
atgacattaaatgcaataatt

SEQ ID NO: 5264285 - DNA, 18 bp, Homo sapiens
atgacattatatttgagt

SEQ ID NO: 5264286 - DNA, 13 bp, Homo sapiens
atgacattattaa

SEQ ID NO: 5264287 - DNA, 17 bp, Homo sapiens
atgacattattaaagtt

SEQ ID NO: 5264288 - DNA, 18 bp, Homo sapiens
atgacattcatgcctggc

SEQ ID NO: 5264289 - DNA, 16 bp, Homo sapiens
atgacattgactattt

SEQ ID NO: 5264290 - DNA, 14 bp, Homo sapiens
atgacattgctaag

SEQ ID NO: 5264291 - DNA, 20 bp, Homo sapiens
atgacattgctaagatgctc

SEQ ID NO: 5264292 - DNA, 23 bp, Homo sapiens
atgacattgctaagatgctctat

SEQ ID NO: 5264293 - DNA, 22 bp, Homo sapiens
atgacatttaaatgtaacttat

SEQ ID NO: 5264294 - DNA, 20 bp, Homo sapiens
atgacatttcgttttttaca

SEQ ID NO: 5264295 - DNA, 15 bp, Homo sapiens
atgacatttctcaaa

SEQ ID NO: 5264296 - DNA, 15 bp, Homo sapiens
atgacatttcttaaa

SEQ ID NO: 5264297 - DNA, 18 bp, Homo sapiens
atgacatttcttaaaact

SEQ ID NO: 5264298 - DNA, 19 bp, Homo sapiens
atgacatttcttaaaactt

SEQ ID NO: 5264299 - DNA, 20 bp, Homo sapiens
atgacatttcttaaaacttt

SEQ ID NO: 5264300 - DNA, 21 bp, Homo sapiens
atgacatttctttgtgctttg

SEQ ID NO: 5264301 - DNA, 21 bp, Homo sapiens
atgacatttgtcctgcagagc

SEQ ID NO: 5264302 - DNA, 14 bp, Homo sapiens
atgacattttgcca

SEQ ID NO: 5264303 - DNA, 21 bp, Homo sapiens
atgaccaaagtcccttcctgc

SEQ ID NO: 5264304 - DNA, 15 bp, Homo sapiens
atgaccaaagtcctt

SEQ ID NO: 5264305 - DNA, 13 bp, Homo sapiens
atgaccaatttta

SEQ ID NO: 5264306 - DNA, 17 bp, Homo sapiens
atgaccaattttaactt

SEQ ID NO: 5264307 - DNA, 14 bp, Homo sapiens
atgaccacacctgc

SEQ ID NO: 5264308 - DNA, 15 bp, Homo sapiens
atgaccacactccag

SEQ ID NO: 5264309 - DNA, 23 bp, Homo sapiens
atgaccacataagaaggcaattt

SEQ ID NO: 5264310 - DNA, 23 bp, Homo sapiens
atgaccacccctctcgcctcatt

SEQ ID NO: 5264311 - DNA, 16 bp, Homo sapiens
atgaccacgcacctcc

SEQ ID NO: 5264312 - DNA, 17 bp, Homo sapiens
atgaccacgcacctcca

SEQ ID NO: 5264313 - DNA, 19 bp, Homo sapiens
atgaccacgggcctcagtt

SEQ ID NO: 5264314 - DNA, 23 bp, Homo sapiens
atgaccacgggcctcagtttccc

SEQ ID NO: 5264315 - DNA, 14 bp, Homo sapiens
atgaccagaagcct

SEQ ID NO: 5264316 - DNA, 20 bp, Homo sapiens
atgaccagaagggaaacagt

SEQ ID NO: 5264317 - DNA, 18 bp, Homo sapiens
atgaccagatgcgtccca

SEQ ID NO: 5264318 - DNA, 12 bp, Homo sapiens
atgaccaggcca

SEQ ID NO: 5264319 - DNA, 15 bp, Homo sapiens
atgaccaggccacca

SEQ ID NO: 5264320 - DNA, 17 bp, Homo sapiens
atgaccaggccaccatc

SEQ ID NO: 5264321 - DNA, 19 bp, Homo sapiens
atgaccaggccaccatctg

SEQ ID NO: 5264322 - DNA, 18 bp, Homo sapiens
atgaccagggatgctggg

SEQ ID NO: 5264323 - DNA, 20 bp, Homo sapiens
atgaccagggatgctgggct

SEQ ID NO: 5264324 - DNA, 21 bp, Homo sapiens
atgaccagggatgctgggctg

SEQ ID NO: 5264325 - DNA, 22 bp, Homo sapiens
atgaccagggatgctgggctgg

SEQ ID NO: 5264326 - DNA, 19 bp, Homo sapiens
atgaccagtaattgtgaaa

SEQ ID NO: 5264327 - DNA, 20 bp, Homo sapiens
atgaccatgttatattgctt

SEQ ID NO: 5264328 - DNA, 19 bp, Homo sapiens
atgaccattgaaaaaggaa

SEQ ID NO: 5264329 - DNA, 20 bp, Homo sapiens
atgaccattgaaaaaggaaa

SEQ ID NO: 5264330 - DNA, 21 bp, Homo sapiens
atgaccattgaaaaaggaaaa

SEQ ID NO: 5264331 - DNA, 19 bp, Homo sapiens
atgaccattgagtccctgc

SEQ ID NO: 5264332 - DNA, 16 bp, Homo sapiens
atgacccaaagaccaa

SEQ ID NO: 5264333 - DNA, 19 bp, Homo sapiens
atgacccacactgccagaa

SEQ ID NO: 5264334 - DNA, 17 bp, Homo sapiens
atgacccacccctgtgc

SEQ ID NO: 5264335 - DNA, 19 bp, Homo sapiens
atgacccacccctgtgctc

SEQ ID NO: 5264336 - DNA, 15 bp, Homo sapiens
atgacccactaaaga

SEQ ID NO: 5264337 - DNA, 19 bp, Homo sapiens
atgacccagatatggaaac

SEQ ID NO: 5264338 - DNA, 14 bp, Homo sapiens
atgacccaggctgg

SEQ ID NO: 5264339 - DNA, 15 bp, Homo sapiens
atgacccaggctggg

SEQ ID NO: 5264340 - DNA, 22 bp, Homo sapiens
atgacccaggctgggcaaggag

SEQ ID NO: 5264341 - DNA, 12 bp, Homo sapiens
atgacccagtgg

SEQ ID NO: 5264342 - DNA, 19 bp, Homo sapiens
atgacccccaggtattgtc

SEQ ID NO: 5264343 - DNA, 19 bp, Homo sapiens
atgacccctcgtccacccc

SEQ ID NO: 5264344 - DNA, 20 bp, Homo sapiens
atgacccctcgtccaccccc

SEQ ID NO: 5264345 - DNA, 15 bp, Homo sapiens
atgacccctggccac

SEQ ID NO: 5264346 - DNA, 16 bp, Homo sapiens
atgacccctggccaca

SEQ ID NO: 5264347 - DNA, 21 bp, Homo sapiens
atgacccctggccacagcctt

SEQ ID NO: 5264348 - DNA, 20 bp, Homo sapiens
atgacccctgtaaggggcca

SEQ ID NO: 5264349 - DNA, 22 bp, Homo sapiens
atgacccggatgaactcaatgc

SEQ ID NO: 5264350 - DNA, 19 bp, Homo sapiens
atgacccggggcagctggc

SEQ ID NO: 5264351 - DNA, 22 bp, Homo sapiens
atgaccctctgtccccaggcct

SEQ ID NO: 5264352 - DNA, 20 bp, Homo sapiens
atgaccctgcctctcccagg

SEQ ID NO: 5264353 - DNA, 23 bp, Homo sapiens
atgaccctgcgaaggggccctgg

SEQ ID NO: 5264354 - DNA, 16 bp, Homo sapiens
atgaccctgtgcctgt

SEQ ID NO: 5264355 - DNA, 18 bp, Homo sapiens
atgaccgagccctggaga

SEQ ID NO: 5264356 - DNA, 20 bp, Homo sapiens
atgaccgagccctggagagc

SEQ ID NO: 5264357 - DNA, 16 bp, Homo sapiens
atgaccgctctccctt

SEQ ID NO: 5264358 - DNA, 15 bp, Homo sapiens
atgaccgtgtacaat

SEQ ID NO: 5264359 - DNA, 23 bp, Homo sapiens
atgacctaaatccattttctaaa

SEQ ID NO: 5264360 - DNA, 20 bp, Homo sapiens
atgacctacagtgctgtgta

SEQ ID NO: 5264361 - DNA, 19 bp, Homo sapiens
atgacctaccaggacagaa

SEQ ID NO: 5264362 - DNA, 15 bp, Homo sapiens
atgacctatcaaaaa

SEQ ID NO: 5264363 - DNA, 15 bp, Homo sapiens
atgacctcagcaaat

SEQ ID NO: 5264364 - DNA, 20 bp, Homo sapiens
atgacctcagcaaatcctct

SEQ ID NO: 5264365 - DNA, 22 bp, Homo sapiens
atgacctcagcaaatcctcttc

SEQ ID NO: 5264366 - DNA, 13 bp, Homo sapiens
atgacctccagaa

SEQ ID NO: 5264367 - DNA, 16 bp, Homo sapiens
atgacctccagaagtc

SEQ ID NO: 5264368 - DNA, 12 bp, Homo sapiens
atgacctccagc

SEQ ID NO: 5264369 - DNA, 14 bp, Homo sapiens
atgacctcccctcc

SEQ ID NO: 5264370 - DNA, 13 bp, Homo sapiens
atgacctcgttcc

SEQ ID NO: 5264371 - DNA, 15 bp, Homo sapiens
atgacctgaggaaag

SEQ ID NO: 5264372 - DNA, 20 bp, Homo sapiens
atgacctgcagtcagggccc

SEQ ID NO: 5264373 - DNA, 20 bp, Homo sapiens
atgacctgggtggggtcagg

SEQ ID NO: 5264374 - DNA, 19 bp, Homo sapiens
atgacctgtgaccagcact

SEQ ID NO: 5264375 - DNA, 21 bp, Homo sapiens
atgaccttaaggaaaagtaag

SEQ ID NO: 5264376 - DNA, 16 bp, Homo sapiens
atgaccttacatttcc

SEQ ID NO: 5264377 - DNA, 21 bp, Homo sapiens
atgaccttatccttcctctcc

SEQ ID NO: 5264378 - DNA, 20 bp, Homo sapiens
atgaccttgagttaacagga

SEQ ID NO: 5264379 - DNA, 17 bp, Homo sapiens
atgaccttggggtacaa

SEQ ID NO: 5264380 - DNA, 19 bp, Homo sapiens
atgaccttgtaatgtaact

SEQ ID NO: 5264381 - DNA, 13 bp, Homo sapiens
atgacctttcaat

SEQ ID NO: 5264382 - DNA, 21 bp, Homo sapiens
atgaccttttggcctttgtaa

SEQ ID NO: 5264383 - DNA, 19 bp, Homo sapiens
atgacgacgacaacgatga

SEQ ID NO: 5264384 - DNA, 23 bp, Homo sapiens
atgacgagacctcagatgtgttg

SEQ ID NO: 5264385 - DNA, 20 bp, Homo sapiens
atgacgccagataaaatgtt

SEQ ID NO: 5264386 - DNA, 23 bp, Homo sapiens
atgacgccagataaaatgttcag

SEQ ID NO: 5264387 - DNA, 14 bp, Homo sapiens
atgacgcctctgga

SEQ ID NO: 5264388 - DNA, 16 bp, Homo sapiens
atgacggaagaacata

SEQ ID NO: 5264389 - DNA, 14 bp, Homo sapiens
atgacggccaggct

SEQ ID NO: 5264390 - DNA, 20 bp, Homo sapiens
atgacggccaggctccctga

SEQ ID NO: 5264391 - DNA, 14 bp, Homo sapiens
atgacggcctgcct

SEQ ID NO: 5264392 - DNA, 15 bp, Homo sapiens
atgacggcctgcctg

SEQ ID NO: 5264393 - DNA, 19 bp, Homo sapiens
atgacgggatgctctttaa

SEQ ID NO: 5264394 - DNA, 18 bp, Homo sapiens
atgacggtaagtgttctc

SEQ ID NO: 5264395 - DNA, 19 bp, Homo sapiens
atgacggtaagtgttctca

SEQ ID NO: 5264396 - DNA, 22 bp, Homo sapiens
atgacggtaagtgttctcatga

SEQ ID NO: 5264397 - DNA, 22 bp, Homo sapiens
atgacggtgttaattttgctaa

SEQ ID NO: 5264398 - DNA, 17 bp, Homo sapiens
atgacgtgaatgtgtat

SEQ ID NO: 5264399 - DNA, 13 bp, Homo sapiens
atgacgtgcacaa

SEQ ID NO: 5264400 - DNA, 17 bp, Homo sapiens
atgacgtggtaaaatgt

SEQ ID NO: 5264401 - DNA, 21 bp, Homo sapiens
atgactaaagacctgctgtaa

SEQ ID NO: 5264402 - DNA, 22 bp, Homo sapiens
atgactaaagacctgctgtaat

SEQ ID NO: 5264403 - DNA, 19 bp, Homo sapiens
atgactaaagagagaatgt

SEQ ID NO: 5264404 - DNA, 23 bp, Homo sapiens
atgactaaagagagaatgtagat

SEQ ID NO: 5264405 - DNA, 14 bp, Homo sapiens
atgactaagccaag

SEQ ID NO: 5264406 - DNA, 13 bp, Homo sapiens
atgactaatgctt

SEQ ID NO: 5264407 - DNA, 14 bp, Homo sapiens
atgactaatgcttt

SEQ ID NO: 5264408 - DNA, 15 bp, Homo sapiens
atgactaatgctttt

SEQ ID NO: 5264409 - DNA, 23 bp, Homo sapiens
atgactaattagggtacatttat

SEQ ID NO: 5264410 - DNA, 20 bp, Homo sapiens
atgactacatttagcccctc

SEQ ID NO: 5264411 - DNA, 13 bp, Homo sapiens
atgactacatttt

SEQ ID NO: 5264412 - DNA, 14 bp, Homo sapiens
atgactacattttg

SEQ ID NO: 5264413 - DNA, 21 bp, Homo sapiens
atgactactaacaaatgtaaa

SEQ ID NO: 5264414 - DNA, 24 bp, Homo sapiens
atgactactacacactgctcattt

SEQ ID NO: 5264415 - DNA, 20 bp, Homo sapiens
atgactagagacgcaccttg

SEQ ID NO: 5264416 - DNA, 19 bp, Homo sapiens
atgactagcaaacaaaaat

SEQ ID NO: 5264417 - DNA, 15 bp, Homo sapiens
atgactagtcacctg

SEQ ID NO: 5264418 - DNA, 18 bp, Homo sapiens
atgactagtcacctgggg

SEQ ID NO: 5264419 - DNA, 18 bp, Homo sapiens
atgactagtgcctagaaa

SEQ ID NO: 5264420 - DNA, 14 bp, Homo sapiens
atgactataaacat

SEQ ID NO: 5264421 - DNA, 17 bp, Homo sapiens
atgactatataatttat

SEQ ID NO: 5264422 - DNA, 22 bp, Homo sapiens
atgactatataatttatttcca

SEQ ID NO: 5264423 - DNA, 16 bp, Homo sapiens
atgactattgtaatgc

SEQ ID NO: 5264424 - DNA, 18 bp, Homo sapiens
atgactattgtaatgcca

SEQ ID NO: 5264425 - DNA, 15 bp, Homo sapiens
atgactcaaagatga

SEQ ID NO: 5264426 - DNA, 15 bp, Homo sapiens
atgactcaagattcc

SEQ ID NO: 5264427 - DNA, 19 bp, Homo sapiens
atgactcaagattcccagg

SEQ ID NO: 5264428 - DNA, 22 bp, Homo sapiens
atgactcaagattcccaggagt

SEQ ID NO: 5264429 - DNA, 22 bp, Homo sapiens
atgactcagcagaacaccgcgt

SEQ ID NO: 5264430 - DNA, 16 bp, Homo sapiens
atgactcatcaatttt

SEQ ID NO: 5264431 - DNA, 22 bp, Homo sapiens
atgactccactgtttttctcta

SEQ ID NO: 5264432 - DNA, 22 bp, Homo sapiens
atgactcccttaaaatagaaat

SEQ ID NO: 5264433 - DNA, 14 bp, Homo sapiens
atgactcctttctc

SEQ ID NO: 5264434 - DNA, 16 bp, Homo sapiens
atgactcgggggtggg

SEQ ID NO: 5264435 - DNA, 13 bp, Homo sapiens
atgactctctcca

SEQ ID NO: 5264436 - DNA, 12 bp, Homo sapiens
atgactctgaga

SEQ ID NO: 5264437 - DNA, 13 bp, Homo sapiens
atgactctgagaa

SEQ ID NO: 5264438 - DNA, 21 bp, Homo sapiens
atgactcttcttatcacactt

SEQ ID NO: 5264439 - DNA, 22 bp, Homo sapiens
atgactcttcttatcacacttg

SEQ ID NO: 5264440 - DNA, 18 bp, Homo sapiens
atgactcttggagcctct

SEQ ID NO: 5264441 - DNA, 23 bp, Homo sapiens
atgactctttctgaaggaagaga

SEQ ID NO: 5264442 - DNA, 12 bp, Homo sapiens
atgactgaagac

SEQ ID NO: 5264443 - DNA, 20 bp, Homo sapiens
atgactgaagacaggcacaa

SEQ ID NO: 5264444 - DNA, 22 bp, Homo sapiens
atgactgaagacaggcacaaaa

SEQ ID NO: 5264445 - DNA, 23 bp, Homo sapiens
atgactgaagacaggcacaaaat

SEQ ID NO: 5264446 - DNA, 21 bp, Homo sapiens
atgactgacccaaaatgtgaa

SEQ ID NO: 5264447 - DNA, 16 bp, Homo sapiens
atgactgcatttgtgt

SEQ ID NO: 5264448 - DNA, 11 bp, Homo sapiens
atgtgcctgga

SEQ ID NO: 5264449 - DNA, 20 bp, Homo sapiens
atgtgcctgtaatctttttc

SEQ ID NO: 5264450 - DNA, 22 bp, Homo sapiens
atgtgcctgtaatctttttctc

SEQ ID NO: 5264451 - DNA, 23 bp, Homo sapiens
atgtgcctgtattcccagctact

SEQ ID NO: 5264452 - DNA, 15 bp, Homo sapiens
atgtgcctgtgggag

SEQ ID NO: 5264453 - DNA, 23 bp, Homo sapiens
atgtgccttaagttttagtcttt

SEQ ID NO: 5264454 - DNA, 23 bp, Homo sapiens
atgtgccttctagaatacatatt

SEQ ID NO: 5264455 - DNA, 16 bp, Homo sapiens
atgtgccttgtccagg

SEQ ID NO: 5264456 - DNA, 10 bp, Homo sapiens
atgtgccttt

SEQ ID NO: 5264457 - DNA, 13 bp, Homo sapiens
atgtgcctttctt

SEQ ID NO: 5264458 - DNA, 21 bp, Homo sapiens
atgtgcctttctttgcctctg

SEQ ID NO: 5264459 - DNA, 22 bp, Homo sapiens
atgtgcctttctttgcctctgc

SEQ ID NO: 5264460 - DNA, 16 bp, Homo sapiens
atgtgcgaagcaagaa

SEQ ID NO: 5264461 - DNA, 22 bp, Homo sapiens
atgtgcgaagcaagaagaattg

SEQ ID NO: 5264462 - DNA, 14 bp, Homo sapiens
atgtgcggctgaac

SEQ ID NO: 5264463 - DNA, 17 bp, Homo sapiens
atgtgcgtgctgtctgt

SEQ ID NO: 5264464 - DNA, 15 bp, Homo sapiens
atgtgcgtggaagtg

SEQ ID NO: 5264465 - DNA, 21 bp, Homo sapiens
atgtgcgtggaagtgttcctg

SEQ ID NO: 5264466 - DNA, 23 bp, Homo sapiens
atgtgcgtggaagtgttcctgtc

SEQ ID NO: 5264467 - DNA, 15 bp, Homo sapiens
atgtgctacaggggc

SEQ ID NO: 5264468 - DNA, 19 bp, Homo sapiens
atgtgctacaggggccaga

SEQ ID NO: 5264469 - DNA, 19 bp, Homo sapiens
atgtgctagagttaaaagt

SEQ ID NO: 5264470 - DNA, 20 bp, Homo sapiens
atgtgctagtaattggaaag

SEQ ID NO: 5264471 - DNA, 16 bp, Homo sapiens
atgtgctatacacaca

SEQ ID NO: 5264472 - DNA, 17 bp, Homo sapiens
atgtgctatacacacac

SEQ ID NO: 5264473 - DNA, 21 bp, Homo sapiens
atgtgctatagacattagaga

SEQ ID NO: 5264474 - DNA, 16 bp, Homo sapiens
atgtgctatcacatgt

SEQ ID NO: 5264475 - DNA, 21 bp, Homo sapiens
atgtgctatcacatgtgaaaa

SEQ ID NO: 5264476 - DNA, 21 bp, Homo sapiens
atgtgctatgcaaaatagaca

SEQ ID NO: 5264477 - DNA, 18 bp, Homo sapiens
atgtgctattgaactgag

SEQ ID NO: 5264478 - DNA, 20 bp, Homo sapiens
atgtgctcaaattactaatg

SEQ ID NO: 5264479 - DNA, 21 bp, Homo sapiens
atgtgctcaaattactaatga

SEQ ID NO: 5264480 - DNA, 12 bp, Homo sapiens
atgtgctcagaa

SEQ ID NO: 5264481 - DNA, 18 bp, Homo sapiens
atgtgctcagccaaattt

SEQ ID NO: 5264482 - DNA, 20 bp, Homo sapiens
atgtgctcagccccagacct

SEQ ID NO: 5264483 - DNA, 16 bp, Homo sapiens
atgtgctcccaccagg

SEQ ID NO: 5264484 - DNA, 17 bp, Homo sapiens
atgtgctcccaccaggc

SEQ ID NO: 5264485 - DNA, 18 bp, Homo sapiens
atgtgctcccaccaggca

SEQ ID NO: 5264486 - DNA, 13 bp, Homo sapiens
atgtgctctatgt

SEQ ID NO: 5264487 - DNA, 17 bp, Homo sapiens
atgtgctgaagcaaagt

SEQ ID NO: 5264488 - DNA, 12 bp, Homo sapiens
atgtgctgatca

SEQ ID NO: 5264489 - DNA, 12 bp, Homo sapiens
atgtgctgctgg

SEQ ID NO: 5264490 - DNA, 13 bp, Homo sapiens
atgtgctggaggg

SEQ ID NO: 5264491 - DNA, 21 bp, Homo sapiens
atgtgctggaggggtggccca

SEQ ID NO: 5264492 - DNA, 22 bp, Homo sapiens
atgtgctggaggggtggcccag

SEQ ID NO: 5264493 - DNA, 21 bp, Homo sapiens
atgtgctgggaaatgcagaaa

SEQ ID NO: 5264494 - DNA, 18 bp, Homo sapiens
atgtgctgggtgcctccc

SEQ ID NO: 5264495 - DNA, 19 bp, Homo sapiens
atgtgctgggtgcctccca

SEQ ID NO: 5264496 - DNA, 22 bp, Homo sapiens
atgtgctggtgaacactgtgac

SEQ ID NO: 5264497 - DNA, 14 bp, Homo sapiens
atgtgctgtgtaaa

SEQ ID NO: 5264498 - DNA, 19 bp, Homo sapiens
atgtgctgtgtgacattgg

SEQ ID NO: 5264499 - DNA, 19 bp, Homo sapiens
atgtgctgtgtgagtgagc

SEQ ID NO: 5264500 - DNA, 20 bp, Homo sapiens
atgtgctgttgattctttca

SEQ ID NO: 5264501 - DNA, 13 bp, Homo sapiens
atgtgctgttttc

SEQ ID NO: 5264502 - DNA, 16 bp, Homo sapiens
atgtgcttaacaggga

SEQ ID NO: 5264503 - DNA, 16 bp, Homo sapiens
atgtgcttcattgttt

SEQ ID NO: 5264504 - DNA, 14 bp, Homo sapiens
atgtgcttctcagt

SEQ ID NO: 5264505 - DNA, 14 bp, Homo sapiens
atgtgcttgaagat

SEQ ID NO: 5264506 - DNA, 15 bp, Homo sapiens
atgtgcttgtgccta

SEQ ID NO: 5264507 - DNA, 23 bp, Homo sapiens
atgtgcttgtgcctacctggccg

SEQ ID NO: 5264508 - DNA, 16 bp, Homo sapiens
atgtgcttgtgtgtat

SEQ ID NO: 5264509 - DNA, 14 bp, Homo sapiens
atgtgctttgattc

SEQ ID NO: 5264510 - DNA, 13 bp, Homo sapiens
atgtgctttgctg

SEQ ID NO: 5264511 - DNA, 16 bp, Homo sapiens
atgtgctttgtagctt

SEQ ID NO: 5264512 - DNA, 20 bp, Homo sapiens
atgtgcttttccatctaaaa

SEQ ID NO: 5264513 - DNA, 13 bp, Homo sapiens
atgtgcttttctc

SEQ ID NO: 5264514 - DNA, 16 bp, Homo sapiens
atgtgcttttctccaa

SEQ ID NO: 5264515 - DNA, 23 bp, Homo sapiens
atgtggaaaagccaagaggctgc

SEQ ID NO: 5264516 - DNA, 17 bp, Homo sapiens
atgtggaaagtgaattt

SEQ ID NO: 5264517 - DNA, 18 bp, Homo sapiens
atgtggaactgctgccac

SEQ ID NO: 5264518 - DNA, 19 bp, Homo sapiens
atgtggaactgctgccact

SEQ ID NO: 5264519 - DNA, 14 bp, Homo sapiens
atgtggaagcaggt

SEQ ID NO: 5264520 - DNA, 19 bp, Homo sapiens
atgtggaagtatacctggc

SEQ ID NO: 5264521 - DNA, 21 bp, Homo sapiens
atgtggaagtatacctggctt

SEQ ID NO: 5264522 - DNA, 15 bp, Homo sapiens
atgtggaagtgtggg

SEQ ID NO: 5264523 - DNA, 15 bp, Homo sapiens
atgtggaatataaag

SEQ ID NO: 5264524 - DNA, 17 bp, Homo sapiens
atgtggaatgcatccaa

SEQ ID NO: 5264525 - DNA, 14 bp, Homo sapiens
atgtggacatgcac

SEQ ID NO: 5264526 - DNA, 15 bp, Homo sapiens
atgtggacatgcacc

SEQ ID NO: 5264527 - DNA, 19 bp, Homo sapiens
atgtggaccatattttgta

SEQ ID NO: 5264528 - DNA, 18 bp, Homo sapiens
atgtggaccttagaatac

SEQ ID NO: 5264529 - DNA, 13 bp, Homo sapiens
atgtggactgtgc

SEQ ID NO: 5264530 - DNA, 16 bp, Homo sapiens
atgtggacttaggaag

SEQ ID NO: 5264531 - DNA, 23 bp, Homo sapiens
atgtggagcacaaaagcctctca

SEQ ID NO: 5264532 - DNA, 13 bp, Homo sapiens
atgtggagccagg

SEQ ID NO: 5264533 - DNA, 14 bp, Homo sapiens
atgtggagccaggc

SEQ ID NO: 5264534 - DNA, 15 bp, Homo sapiens
atgtggagccaggcg

SEQ ID NO: 5264535 - DNA, 16 bp, Homo sapiens
atgtggagccaggcgt

SEQ ID NO: 5264536 - DNA, 22 bp, Homo sapiens
atgtggaggaagagccacctgc

SEQ ID NO: 5264537 - DNA, 22 bp, Homo sapiens
atgtggagggtggcgccctgcg

SEQ ID NO: 5264538 - DNA, 20 bp, Homo sapiens
atgtggagttcatcttgaat

SEQ ID NO: 5264539 - DNA, 16 bp, Homo sapiens
atgtggataaaactgt

SEQ ID NO: 5264540 - DNA, 18 bp, Homo sapiens
atgtggataaaactgtgt

SEQ ID NO: 5264541 - DNA, 19 bp, Homo sapiens
atgtggataaaactgtgta

SEQ ID NO: 5264542 - DNA, 23 bp, Homo sapiens
atgtggattagctagaatgcaca

SEQ ID NO: 5264543 - DNA, 22 bp, Homo sapiens
atgtggatttcctattttaaaa

SEQ ID NO: 5264544 - DNA, 19 bp, Homo sapiens
atgtggcaaagctcaccat

SEQ ID NO: 5264545 - DNA, 17 bp, Homo sapiens
atgtggcaaagtgctgt

SEQ ID NO: 5264546 - DNA, 20 bp, Homo sapiens
atgtggcaaagtgctgtacc

SEQ ID NO: 5264547 - DNA, 12 bp, Homo sapiens
atgtggcagctg

SEQ ID NO: 5264548 - DNA, 16 bp, Homo sapiens
atgtggcaggggcagt

SEQ ID NO: 5264549 - DNA, 23 bp, Homo sapiens
atgtggcaggggcagtggcctgg

SEQ ID NO: 5264550 - DNA, 13 bp, Homo sapiens
atgtggcaggggt

SEQ ID NO: 5264551 - DNA, 22 bp, Homo sapiens
atgtggccaagggctccagggc

SEQ ID NO: 5264552 - DNA, 19 bp, Homo sapiens
atgtggccacaactgctgt

SEQ ID NO: 5264553 - DNA, 17 bp, Homo sapiens
atgtggccacttatttc

SEQ ID NO: 5264554 - DNA, 17 bp, Homo sapiens
atgtggccccaggtgcc

SEQ ID NO: 5264555 - DNA, 15 bp, Homo sapiens
atgtggccctggcct

SEQ ID NO: 5264556 - DNA, 17 bp, Homo sapiens
atgtggccgaggacttt

SEQ ID NO: 5264557 - DNA, 18 bp, Homo sapiens
atgtggccgaggactttg

SEQ ID NO: 5264558 - DNA, 19 bp, Homo sapiens
atgtggcctaaaaatgcaa

SEQ ID NO: 5264559 - DNA, 16 bp, Homo sapiens
atgtggcctccatgtg

SEQ ID NO: 5264560 - DNA, 15 bp, Homo sapiens
atgtggcctgcccag

SEQ ID NO: 5264561 - DNA, 16 bp, Homo sapiens
atgtggcctgcccagc

SEQ ID NO: 5264562 - DNA, 20 bp, Homo sapiens
atgtggcctgcccagcctca

SEQ ID NO: 5264563 - DNA, 23 bp, Homo sapiens
atgtggctcagtgccttcctctc

SEQ ID NO: 5264564 - DNA, 13 bp, Homo sapiens
atgtggctggaag

SEQ ID NO: 5264565 - DNA, 15 bp, Homo sapiens
atgtggctgtaaaac

SEQ ID NO: 5264566 - DNA, 22 bp, Homo sapiens
atgtggctgtatcttgtttttc

SEQ ID NO: 5264567 - DNA, 24 bp, Homo sapiens
atgtggcttctctgtctctgtgga

SEQ ID NO: 5264568 - DNA, 21 bp, Homo sapiens
atgtggcttgagaaatatgga

SEQ ID NO: 5264569 - DNA, 18 bp, Homo sapiens
atgtggcttggtttggtc

SEQ ID NO: 5264570 - DNA, 13 bp, Homo sapiens
atgtggcttttat

SEQ ID NO: 5264571 - DNA, 21 bp, Homo sapiens
atgtggcttttatttcagtgc

SEQ ID NO: 5264572 - DNA, 22 bp, Homo sapiens
atgtggcttttttaaaaaagca

SEQ ID NO: 5264573 - DNA, 17 bp, Homo sapiens
atgtgggaatctcccag

SEQ ID NO: 5264574 - DNA, 23 bp, Homo sapiens
atgtgggagctgaaccacagaaa

SEQ ID NO: 5264575 - DNA, 19 bp, Homo sapiens
atgtgggatattgaatgtt

SEQ ID NO: 5264576 - DNA, 19 bp, Homo sapiens
atgtgggatgagtttttaa

SEQ ID NO: 5264577 - DNA, 20 bp, Homo sapiens
atgtgggattatgggtcaca

SEQ ID NO: 5264578 - DNA, 22 bp, Homo sapiens
atgtgggattatgggtcacagg

SEQ ID NO: 5264579 - DNA, 18 bp, Homo sapiens
atgtgggcagtgatgtca

SEQ ID NO: 5264580 - DNA, 16 bp, Homo sapiens
atgtgggcgcccaccc

SEQ ID NO: 5264581 - DNA, 16 bp, Homo sapiens
atgtgggcgtttgtaa

SEQ ID NO: 5264582 - DNA, 16 bp, Homo sapiens
atgtggggacagggct

SEQ ID NO: 5264583 - DNA, 17 bp, Homo sapiens
atgtggggctgagctgg

SEQ ID NO: 5264584 - DNA, 14 bp, Homo sapiens
atgtgggggaaggc

SEQ ID NO: 5264585 - DNA, 19 bp, Homo sapiens
atgtgggggcttcatctct

SEQ ID NO: 5264586 - DNA, 17 bp, Homo sapiens
atgtgggggtctgtgtg

SEQ ID NO: 5264587 - DNA, 21 bp, Homo sapiens
atgtgggtaagaggagcagag

SEQ ID NO: 5264588 - DNA, 23 bp, Homo sapiens
atgtgggtcttatgcttccatta

SEQ ID NO: 5264589 - DNA, 17 bp, Homo sapiens
atgtgggtcttccaggg

SEQ ID NO: 5264590 - DNA, 21 bp, Homo sapiens
atgtgggtctttttctcttct

SEQ ID NO: 5264591 - DNA, 15 bp, Homo sapiens
atgtgggtgaccagg

SEQ ID NO: 5264592 - DNA, 17 bp, Homo sapiens
atgtgggtggagaaggg

SEQ ID NO: 5264593 - DNA, 21 bp, Homo sapiens
atgtgggtggagaagggaggg

SEQ ID NO: 5264594 - DNA, 23 bp, Homo sapiens
atgtgggtggagaagggagggtg

SEQ ID NO: 5264595 - DNA, 21 bp, Homo sapiens
atgtgggttatcatggaagaa

SEQ ID NO: 5264596 - DNA, 14 bp, Homo sapiens
atgtgggttgtgat

SEQ ID NO: 5264597 - DNA, 15 bp, Homo sapiens
atgtgggttgtgata

SEQ ID NO: 5264598 - DNA, 18 bp, Homo sapiens
atgtgggttgtgatattg

SEQ ID NO: 5264599 - DNA, 15 bp, Homo sapiens
atgtggtacaggggc

SEQ ID NO: 5264600 - DNA, 21 bp, Homo sapiens
atgtggtagtacccagggcca

SEQ ID NO: 5264601 - DNA, 22 bp, Homo sapiens
atgtggtcacagctgtatagct

SEQ ID NO: 5264602 - DNA, 19 bp, Homo sapiens
atgtggtccatctctgaaa

SEQ ID NO: 5264603 - DNA, 13 bp, Homo sapiens
atgtggtctcagg

SEQ ID NO: 5264604 - DNA, 14 bp, Homo sapiens
atgtggtctcagga

SEQ ID NO: 5264605 - DNA, 15 bp, Homo sapiens
atgtggtctcaggat

SEQ ID NO: 5264606 - DNA, 20 bp, Homo sapiens
atgtggtgaaaagcaggttg

SEQ ID NO: 5264607 - DNA, 17 bp, Homo sapiens
atgtggtgaatatgcaa

SEQ ID NO: 5264608 - DNA, 19 bp, Homo sapiens
atgtggtgacacctccccc

SEQ ID NO: 5264609 - DNA, 20 bp, Homo sapiens
atgtggtgacacctccccct

SEQ ID NO: 5264610 - DNA, 20 bp, Homo sapiens
atgtggtggcaataaatgtc

SEQ ID NO: 5264611 - DNA, 18 bp, Homo sapiens
atgtggtggcacaggccc

SEQ ID NO: 5264612 - DNA, 16 bp, Homo sapiens
atgtggtggtttctat

SEQ ID NO: 5264613 - DNA, 21 bp, Homo sapiens
atgtggttacacagtgtgaat

SEQ ID NO: 5264614 - DNA, 20 bp, Homo sapiens
atgtggttacttcctactgt

SEQ ID NO: 5264615 - DNA, 18 bp, Homo sapiens
atgtggttatttctctga

SEQ ID NO: 5264616 - DNA, 21 bp, Homo sapiens
atgtggtttggttcctctctg

SEQ ID NO: 5264617 - DNA, 17 bp, Homo sapiens
atgtggttttcttaagg

SEQ ID NO: 5264618 - DNA, 21 bp, Homo sapiens
atgtgtaaagatctacatgaa

SEQ ID NO: 5264619 - DNA, 22 bp, Homo sapiens
atgtgtaaagatctacatgaat

SEQ ID NO: 5264620 - DNA, 19 bp, Homo sapiens
atgtgtaaatgtggacaca

SEQ ID NO: 5264621 - DNA, 15 bp, Homo sapiens
atgtgtaaatgttat

SEQ ID NO: 5264622 - DNA, 14 bp, Homo sapiens
atgtgtaacagagt

SEQ ID NO: 5264623 - DNA, 20 bp, Homo sapiens
atgtgtaactttattggtct

SEQ ID NO: 5264624 - DNA, 14 bp, Homo sapiens
atgtgtaacttttt

SEQ ID NO: 5264625 - DNA, 20 bp, Homo sapiens
atgactgcatttgtgtgtgt

SEQ ID NO: 5264626 - DNA, 13 bp, Homo sapiens
atgactgcatttt

SEQ ID NO: 5264627 - DNA, 19 bp, Homo sapiens
atgactgccccttgcttct

SEQ ID NO: 5264628 - DNA, 11 bp, Homo sapiens
atgactgcctt

SEQ ID NO: 5264629 - DNA, 12 bp, Homo sapiens
atgactgccttg

SEQ ID NO: 5264630 - DNA, 14 bp, Homo sapiens
atgactgctcaggc

SEQ ID NO: 5264631 - DNA, 16 bp, Homo sapiens
atgactgctcaggcct

SEQ ID NO: 5264632 - DNA, 21 bp, Homo sapiens
atgactgctccccagccctgg

SEQ ID NO: 5264633 - DNA, 17 bp, Homo sapiens
atgactgcttgccctaa

SEQ ID NO: 5264634 - DNA, 14 bp, Homo sapiens
atgactggaaacaa

SEQ ID NO: 5264635 - DNA, 12 bp, Homo sapiens
atgactggaatt

SEQ ID NO: 5264636 - DNA, 15 bp, Homo sapiens
atgactggctcctga

SEQ ID NO: 5264637 - DNA, 15 bp, Homo sapiens
atgactggctgtctg

SEQ ID NO: 5264638 - DNA, 20 bp, Homo sapiens
atgactggctgtctgcctgt

SEQ ID NO: 5264639 - DNA, 10 bp, Homo sapiens
atgactgggc

SEQ ID NO: 5264640 - DNA, 20 bp, Homo sapiens
atgactggtgagagaagaaa

SEQ ID NO: 5264641 - DNA, 15 bp, Homo sapiens
atgactggtgcgttc

SEQ ID NO: 5264642 - DNA, 15 bp, Homo sapiens
atgactggttgttca

SEQ ID NO: 5264643 - DNA, 13 bp, Homo sapiens
atgactgtagaat

SEQ ID NO: 5264644 - DNA, 13 bp, Homo sapiens
atgactgtttctt

SEQ ID NO: 5264645 - DNA, 18 bp, Homo sapiens
atgactgtttcttttgta

SEQ ID NO: 5264646 - DNA, 19 bp, Homo sapiens
atgactgtttcttttgtaa

SEQ ID NO: 5264647 - DNA, 19 bp, Homo sapiens
atgactgtttttcggacag

SEQ ID NO: 5264648 - DNA, 22 bp, Homo sapiens
atgacttaattttagaaagaaa

SEQ ID NO: 5264649 - DNA, 15 bp, Homo sapiens
atgacttagaaactg

SEQ ID NO: 5264650 - DNA, 23 bp, Homo sapiens
atgacttagcgtcaagacatttg

SEQ ID NO: 5264651 - DNA, 16 bp, Homo sapiens
atgacttattatgcat

SEQ ID NO: 5264652 - DNA, 19 bp, Homo sapiens
atgacttattatgcataaa

SEQ ID NO: 5264653 - DNA, 22 bp, Homo sapiens
atgacttatttctgctctggaa

SEQ ID NO: 5264654 - DNA, 20 bp, Homo sapiens
atgacttcagagtacatcca

SEQ ID NO: 5264655 - DNA, 13 bp, Homo sapiens
atgacttcagtga

SEQ ID NO: 5264656 - DNA, 23 bp, Homo sapiens
atgacttcagtgaaattttcagg

SEQ ID NO: 5264657 - DNA, 18 bp, Homo sapiens
atgacttcatttctgatg

SEQ ID NO: 5264658 - DNA, 21 bp, Homo sapiens
atgacttcatttctgatgtga

SEQ ID NO: 5264659 - DNA, 19 bp, Homo sapiens
atgacttccccaatatctt

SEQ ID NO: 5264660 - DNA, 22 bp, Homo sapiens
atgacttccccaatatcttgct

SEQ ID NO: 5264661 - DNA, 20 bp, Homo sapiens
atgacttccttatttctgaa

SEQ ID NO: 5264662 - DNA, 22 bp, Homo sapiens
atgacttccttatttctgaaca

SEQ ID NO: 5264663 - DNA, 12 bp, Homo sapiens
atgacttctcca

SEQ ID NO: 5264664 - DNA, 12 bp, Homo sapiens
atgacttctgct

SEQ ID NO: 5264665 - DNA, 12 bp, Homo sapiens
atgacttcttgt

SEQ ID NO: 5264666 - DNA, 20 bp, Homo sapiens
atgacttctttactaacact

SEQ ID NO: 5264667 - DNA, 13 bp, Homo sapiens
atgacttgagatg

SEQ ID NO: 5264668 - DNA, 22 bp, Homo sapiens
atgacttgaggcacaaatcact

SEQ ID NO: 5264669 - DNA, 15 bp, Homo sapiens
atgacttgccattaa

SEQ ID NO: 5264670 - DNA, 12 bp, Homo sapiens
atgacttgctca

SEQ ID NO: 5264671 - DNA, 18 bp, Homo sapiens
atgacttgggcaccccca

SEQ ID NO: 5264672 - DNA, 21 bp, Homo sapiens
atgacttgggcacccccagcc

SEQ ID NO: 5264673 - DNA, 18 bp, Homo sapiens
atgacttgggtttaacaa

SEQ ID NO: 5264674 - DNA, 20 bp, Homo sapiens
atgacttgtagcatattctt

SEQ ID NO: 5264675 - DNA, 12 bp, Homo sapiens
atgactttagaa

SEQ ID NO: 5264676 - DNA, 13 bp, Homo sapiens
atgactttattgc

SEQ ID NO: 5264677 - DNA, 18 bp, Homo sapiens
atgactttcagattgtat

SEQ ID NO: 5264678 - DNA, 21 bp, Homo sapiens
atgactttcagattgtatctg

SEQ ID NO: 5264679 - DNA, 23 bp, Homo sapiens
atgactttcagattgtatctgaa

SEQ ID NO: 5264680 - DNA, 15 bp, Homo sapiens
atgactttccttagg

SEQ ID NO: 5264681 - DNA, 12 bp, Homo sapiens
atgactttgaac

SEQ ID NO: 5264682 - DNA, 13 bp, Homo sapiens
atgactttgaact

SEQ ID NO: 5264683 - DNA, 13 bp, Homo sapiens
atgactttgcaga

SEQ ID NO: 5264684 - DNA, 12 bp, Homo sapiens
atgactttggac

SEQ ID NO: 5264685 - DNA, 21 bp, Homo sapiens
atgacttttaaaatttgtaga

SEQ ID NO: 5264686 - DNA, 17 bp, Homo sapiens
atgacttttctggaaga

SEQ ID NO: 5264687 - DNA, 20 bp, Homo sapiens
atgacttttctggaagacat

SEQ ID NO: 5264688 - DNA, 15 bp, Homo sapiens
atgactttttataaa

SEQ ID NO: 5264689 - DNA, 14 bp, Homo sapiens
atgactttttgaaa

SEQ ID NO: 5264690 - DNA, 14 bp, Homo sapiens
atgagaaaaaaaca

SEQ ID NO: 5264691 - DNA, 14 bp, Homo sapiens
atgagaaaaaacta

SEQ ID NO: 5264692 - DNA, 15 bp, Homo sapiens
atgagaaaaataaat

SEQ ID NO: 5264693 - DNA, 20 bp, Homo sapiens
atgagaaaaataaatggaaa

SEQ ID NO: 5264694 - DNA, 23 bp, Homo sapiens
atgagaaaatggctttaatcaat

SEQ ID NO: 5264695 - DNA, 17 bp, Homo sapiens
atgagaaaatgtcttta

SEQ ID NO: 5264696 - DNA, 17 bp, Homo sapiens
atgagaaacagctcagc

SEQ ID NO: 5264697 - DNA, 22 bp, Homo sapiens
atgagaaaggttgaagcaccaa

SEQ ID NO: 5264698 - DNA, 15 bp, Homo sapiens
atgagaaatacaaaa

SEQ ID NO: 5264699 - DNA, 22 bp, Homo sapiens
atgagaaatacaaaaatactca

SEQ ID NO: 5264700 - DNA, 18 bp, Homo sapiens
atgagaaatacagaagaa

SEQ ID NO: 5264701 - DNA, 19 bp, Homo sapiens
atgagaaatataaaaataa

SEQ ID NO: 5264702 - DNA, 12 bp, Homo sapiens
atgagaaatcat

SEQ ID NO: 5264703 - DNA, 14 bp, Homo sapiens
atgagaaatcatgc

SEQ ID NO: 5264704 - DNA, 14 bp, Homo sapiens
atgagaaatcatgt

SEQ ID NO: 5264705 - DNA, 16 bp, Homo sapiens
atgagaaatgtaatgc

SEQ ID NO: 5264706 - DNA, 12 bp, Homo sapiens
atgagaaatgtg

SEQ ID NO: 5264707 - DNA, 18 bp, Homo sapiens
atgagaaattgtgccaaa

SEQ ID NO: 5264708 - DNA, 13 bp, Homo sapiens
atgagaacaaaca

SEQ ID NO: 5264709 - DNA, 16 bp, Homo sapiens
atgagaacaaagctgt

SEQ ID NO: 5264710 - DNA, 17 bp, Homo sapiens
atgagaacaaagctgtt

SEQ ID NO: 5264711 - DNA, 18 bp, Homo sapiens
atgagaacaaagctgtta

SEQ ID NO: 5264712 - DNA, 22 bp, Homo sapiens
atgagaacaaagctgttaaact

SEQ ID NO: 5264713 - DNA, 21 bp, Homo sapiens
atgagaacaagtcacagctgc

SEQ ID NO: 5264714 - DNA, 23 bp, Homo sapiens
atgagaacagactggcctgagga

SEQ ID NO: 5264715 - DNA, 18 bp, Homo sapiens
atgagaacagataaagat

SEQ ID NO: 5264716 - DNA, 16 bp, Homo sapiens
atgagaactggttctt

SEQ ID NO: 5264717 - DNA, 18 bp, Homo sapiens
atgagaactggttcttgc

SEQ ID NO: 5264718 - DNA, 15 bp, Homo sapiens
atgagaagaaaaatg

SEQ ID NO: 5264719 - DNA, 16 bp, Homo sapiens
atgagaaggaacttcc

SEQ ID NO: 5264720 - DNA, 15 bp, Homo sapiens
atgagaagtactttg

SEQ ID NO: 5264721 - DNA, 17 bp, Homo sapiens
atgagaagttaagcagc

SEQ ID NO: 5264722 - DNA, 18 bp, Homo sapiens
atgagaagttaagcagcc

SEQ ID NO: 5264723 - DNA, 21 bp, Homo sapiens
atgagaagttaagcagccttt

SEQ ID NO: 5264724 - DNA, 13 bp, Homo sapiens
atgagaatagaaa

SEQ ID NO: 5264725 - DNA, 24 bp, Homo sapiens
atgagaatagaaacgtaaactatg

SEQ ID NO: 5264726 - DNA, 23 bp, Homo sapiens
atgagaatctacccccagatcca

SEQ ID NO: 5264727 - DNA, 16 bp, Homo sapiens
atgagaatctgtgcag

SEQ ID NO: 5264728 - DNA, 19 bp, Homo sapiens
atgagaatctgtgcagtca

SEQ ID NO: 5264729 - DNA, 16 bp, Homo sapiens
atgagaatgacagcct

SEQ ID NO: 5264730 - DNA, 19 bp, Homo sapiens
atgagaatgaccctgtcaa

SEQ ID NO: 5264731 - DNA, 15 bp, Homo sapiens
atgagaatgtcattt

SEQ ID NO: 5264732 - DNA, 14 bp, Homo sapiens
atgagaatgtgacc

SEQ ID NO: 5264733 - DNA, 19 bp, Homo sapiens
atgagaattcagctgcccc

SEQ ID NO: 5264734 - DNA, 15 bp, Homo sapiens
atgagacaacacaca

SEQ ID NO: 5264735 - DNA, 14 bp, Homo sapiens
atgagacacaggat

SEQ ID NO: 5264736 - DNA, 17 bp, Homo sapiens
atgagacacatacaaaa

SEQ ID NO: 5264737 - DNA, 23 bp, Homo sapiens
atgagacagggttttttcatttt

SEQ ID NO: 5264738 - DNA, 14 bp, Homo sapiens
atgagaccccttta

SEQ ID NO: 5264739 - DNA, 20 bp, Homo sapiens
atgagacccctttaaactgt

SEQ ID NO: 5264740 - DNA, 15 bp, Homo sapiens
atgagacctccccca

SEQ ID NO: 5264741 - DNA, 17 bp, Homo sapiens
atgagacctcccccagg

SEQ ID NO: 5264742 - DNA, 18 bp, Homo sapiens
atgagacctcccccaggg

SEQ ID NO: 5264743 - DNA, 19 bp, Homo sapiens
atgagacctcccccaggga

SEQ ID NO: 5264744 - DNA, 20 bp, Homo sapiens
atgagacctcccccagggag

SEQ ID NO: 5264745 - DNA, 22 bp, Homo sapiens
atgagactatgtaaaaataacc

SEQ ID NO: 5264746 - DNA, 17 bp, Homo sapiens
atgagactctagggtcc

SEQ ID NO: 5264747 - DNA, 21 bp, Homo sapiens
atgagactgatccctggccac

SEQ ID NO: 5264748 - DNA, 23 bp, Homo sapiens
atgagactgatccctggccactg

SEQ ID NO: 5264749 - DNA, 21 bp, Homo sapiens
atgagactgccctgcccaggt

SEQ ID NO: 5264750 - DNA, 22 bp, Homo sapiens
atgagacttatggagtgtgcct

SEQ ID NO: 5264751 - DNA, 15 bp, Homo sapiens
atgagactttctgct

SEQ ID NO: 5264752 - DNA, 16 bp, Homo sapiens
atgagactttttcagt

SEQ ID NO: 5264753 - DNA, 18 bp, Homo sapiens
atgagactttttcagtgg

SEQ ID NO: 5264754 - DNA, 12 bp, Homo sapiens
atgagagaatgg

SEQ ID NO: 5264755 - DNA, 17 bp, Homo sapiens
atgagagaatgtggaaa

SEQ ID NO: 5264756 - DNA, 18 bp, Homo sapiens
atgagagaatgtggaaat

SEQ ID NO: 5264757 - DNA, 14 bp, Homo sapiens
atgagagacacact

SEQ ID NO: 5264758 - DNA, 13 bp, Homo sapiens
atgagagagaaaa

SEQ ID NO: 5264759 - DNA, 10 bp, Homo sapiens
atgagagagt

SEQ ID NO: 5264760 - DNA, 15 bp, Homo sapiens
atgagagcaaatgca

SEQ ID NO: 5264761 - DNA, 21 bp, Homo sapiens
atgagagcaaatgcaaaaata

SEQ ID NO: 5264762 - DNA, 22 bp, Homo sapiens
atgagagcaaatgcaaaaataa

SEQ ID NO: 5264763 - DNA, 16 bp, Homo sapiens
atgagagcataattta

SEQ ID NO: 5264764 - DNA, 13 bp, Homo sapiens
atgagagcccaga

SEQ ID NO: 5264765 - DNA, 13 bp, Homo sapiens
atgagagcccctt

SEQ ID NO: 5264766 - DNA, 15 bp, Homo sapiens
atgagaggaaaagaa

SEQ ID NO: 5264767 - DNA, 19 bp, Homo sapiens
atgagagggcagtgtttcc

SEQ ID NO: 5264768 - DNA, 20 bp, Homo sapiens
atgagaggggagagctgaac

SEQ ID NO: 5264769 - DNA, 17 bp, Homo sapiens
atgagaggttgaggaaa

SEQ ID NO: 5264770 - DNA, 19 bp, Homo sapiens
atgagaggttgaggaaaag

SEQ ID NO: 5264771 - DNA, 13 bp, Homo sapiens
atgagagtcactt

SEQ ID NO: 5264772 - DNA, 19 bp, Homo sapiens
atgagagtggcttaaaaac

SEQ ID NO: 5264773 - DNA, 18 bp, Homo sapiens
atgagagttttggatgca

SEQ ID NO: 5264774 - DNA, 17 bp, Homo sapiens
atgagataatatgagat

SEQ ID NO: 5264775 - DNA, 15 bp, Homo sapiens
atgagatactttgca

SEQ ID NO: 5264776 - DNA, 23 bp, Homo sapiens
atgagatatatctttatacttaa

SEQ ID NO: 5264777 - DNA, 15 bp, Homo sapiens
atgagatatgcaata

SEQ ID NO: 5264778 - DNA, 17 bp, Homo sapiens
atgagatatttgtattt

SEQ ID NO: 5264779 - DNA, 13 bp, Homo sapiens
atgagatcactga

SEQ ID NO: 5264780 - DNA, 17 bp, Homo sapiens
atgagatcactgaactt

SEQ ID NO: 5264781 - DNA, 17 bp, Homo sapiens
atgagatctgaatgtgg

SEQ ID NO: 5264782 - DNA, 23 bp, Homo sapiens
atgagatgatacatccaaagcag

SEQ ID NO: 5264783 - DNA, 14 bp, Homo sapiens
atgagatgatttaa

SEQ ID NO: 5264784 - DNA, 18 bp, Homo sapiens
atgagatgatttaattct

SEQ ID NO: 5264785 - DNA, 20 bp, Homo sapiens
atgagatgatttaattctta

SEQ ID NO: 5264786 - DNA, 21 bp, Homo sapiens
atgagatgatttaattcttac

SEQ ID NO: 5264787 - DNA, 18 bp, Homo sapiens
atgagatgcctgaagcca

SEQ ID NO: 5264788 - DNA, 19 bp, Homo sapiens
atgagatgcgttgttacag

SEQ ID NO: 5264789 - DNA, 21 bp, Homo sapiens
atgagatgtatgcccaaagac

SEQ ID NO: 5264790 - DNA, 22 bp, Homo sapiens
atgagatgtgtggactgtggca

SEQ ID NO: 5264791 - DNA, 14 bp, Homo sapiens
atgagattcagtga

SEQ ID NO: 5264792 - DNA, 20 bp, Homo sapiens
atgagattggtcattaaata

SEQ ID NO: 5264793 - DNA, 20 bp, Homo sapiens
atgagattggttttcctgtg

SEQ ID NO: 5264794 - DNA, 17 bp, Homo sapiens
atgagattgtacatttt

SEQ ID NO: 5264795 - DNA, 22 bp, Homo sapiens
atgagattgttttatcatgaca

SEQ ID NO: 5264796 - DNA, 16 bp, Homo sapiens
atgagatttctttgaa

SEQ ID NO: 5264797 - DNA, 22 bp, Homo sapiens
atgagcaaccacatttagaaat

SEQ ID NO: 5264798 - DNA, 14 bp, Homo sapiens
atgagcaaggacat

SEQ ID NO: 5264799 - DNA, 15 bp, Homo sapiens
atgagcaaggacatt

SEQ ID NO: 5264800 - DNA, 18 bp, Homo sapiens
atgagcaaggacattgcc

SEQ ID NO: 5264801 - DNA, 20 bp, Homo sapiens
atgagcaaggacattgcccc

SEQ ID NO: 5264802 - DNA, 21 bp, Homo sapiens
atgagcaaggacattgcccca

SEQ ID NO: 5264803 - DNA, 17 bp, Homo sapiens
atgagcaatatctgcta

SEQ ID NO: 5264804 - DNA, 17 bp, Homo sapiens
atgtgtaataaatatgt

SEQ ID NO: 5264805 - DNA, 22 bp, Homo sapiens
atgtgtaataaatatgtttcac

SEQ ID NO: 5264806 - DNA, 22 bp, Homo sapiens
atgtgtaataatgtaacatgat

SEQ ID NO: 5264807 - DNA, 22 bp, Homo sapiens
atgtgtaatcaataaacgattt

SEQ ID NO: 5264808 - DNA, 12 bp, Homo sapiens
atgtgtaatgat

SEQ ID NO: 5264809 - DNA, 20 bp, Homo sapiens
atgtgtaattgttttggaat

SEQ ID NO: 5264810 - DNA, 19 bp, Homo sapiens
atgtgtaatttttctgtat

SEQ ID NO: 5264811 - DNA, 18 bp, Homo sapiens
atgtgtacaatgtacaca

SEQ ID NO: 5264812 - DNA, 22 bp, Homo sapiens
atgtgtacacaaaggatttgat

SEQ ID NO: 5264813 - DNA, 16 bp, Homo sapiens
atgtgtacagaaacaa

SEQ ID NO: 5264814 - DNA, 23 bp, Homo sapiens
atgtgtacagtgaattgtctttt

SEQ ID NO: 5264815 - DNA, 14 bp, Homo sapiens
atgtgtacatatat

SEQ ID NO: 5264816 - DNA, 17 bp, Homo sapiens
atgtgtacatatatgta

SEQ ID NO: 5264817 - DNA, 19 bp, Homo sapiens
atgtgtacatcccatgtaa

SEQ ID NO: 5264818 - DNA, 14 bp, Homo sapiens
atgtgtacatggca

SEQ ID NO: 5264819 - DNA, 18 bp, Homo sapiens
atgtgtacattctgccta

SEQ ID NO: 5264820 - DNA, 19 bp, Homo sapiens
atgtgtacttattacagtc

SEQ ID NO: 5264821 - DNA, 15 bp, Homo sapiens
atgtgtagagcccct

SEQ ID NO: 5264822 - DNA, 20 bp, Homo sapiens
atgtgtagagcccctactgt

SEQ ID NO: 5264823 - DNA, 14 bp, Homo sapiens
atgtgtagcctatg

SEQ ID NO: 5264824 - DNA, 14 bp, Homo sapiens
atgtgtagcctgtg

SEQ ID NO: 5264825 - DNA, 15 bp, Homo sapiens
atgtgtagccttctc

SEQ ID NO: 5264826 - DNA, 16 bp, Homo sapiens
atgtgtagttcatgta

SEQ ID NO: 5264827 - DNA, 23 bp, Homo sapiens
atgtgtagttgtctctcttcaga

SEQ ID NO: 5264828 - DNA, 15 bp, Homo sapiens
atgtgtataaactgc

SEQ ID NO: 5264829 - DNA, 14 bp, Homo sapiens
atgtgtataagaat

SEQ ID NO: 5264830 - DNA, 22 bp, Homo sapiens
atgtgtatacacttaaacttgc

SEQ ID NO: 5264831 - DNA, 15 bp, Homo sapiens
atgtgtatacagaaa

SEQ ID NO: 5264832 - DNA, 17 bp, Homo sapiens
atgtgtatacagaaaat

SEQ ID NO: 5264833 - DNA, 15 bp, Homo sapiens
atgtgtatacataca

SEQ ID NO: 5264834 - DNA, 16 bp, Homo sapiens
atgtgtatatatacat

SEQ ID NO: 5264835 - DNA, 23 bp, Homo sapiens
atgtgtatatatacatacacttg

SEQ ID NO: 5264836 - DNA, 23 bp, Homo sapiens
atgtgtatatatgtgtgccctgg

SEQ ID NO: 5264837 - DNA, 13 bp, Homo sapiens
atgtgtatatatt

SEQ ID NO: 5264838 - DNA, 23 bp, Homo sapiens
atgtgtatatattatatatacat

SEQ ID NO: 5264839 - DNA, 22 bp, Homo sapiens
atgtgtatctatttatatatca

SEQ ID NO: 5264840 - DNA, 22 bp, Homo sapiens
atgtgtatggtatcatgtatct

SEQ ID NO: 5264841 - DNA, 20 bp, Homo sapiens
atgtgtatgtacgtttgtat

SEQ ID NO: 5264842 - DNA, 21 bp, Homo sapiens
atgtgtatgtctggtaaatag

SEQ ID NO: 5264843 - DNA, 11 bp, Homo sapiens
atgtgtatgtg

SEQ ID NO: 5264844 - DNA, 17 bp, Homo sapiens
atgtgtatgtgtgtgag

SEQ ID NO: 5264845 - DNA, 23 bp, Homo sapiens
atgtgtattaaaacacattatgt

SEQ ID NO: 5264846 - DNA, 18 bp, Homo sapiens
atgtgtattacaaatatt

SEQ ID NO: 5264847 - DNA, 14 bp, Homo sapiens
atgtgtatttctta

SEQ ID NO: 5264848 - DNA, 16 bp, Homo sapiens
atgtgtatttcttata

SEQ ID NO: 5264849 - DNA, 16 bp, Homo sapiens
atgtgtatttgtatgt

SEQ ID NO: 5264850 - DNA, 21 bp, Homo sapiens
atgtgtatttgtatgtactgt

SEQ ID NO: 5264851 - DNA, 17 bp, Homo sapiens
atgtgtattttattaca

SEQ ID NO: 5264852 - DNA, 22 bp, Homo sapiens
atgtgtcaaattataagagaca

SEQ ID NO: 5264853 - DNA, 21 bp, Homo sapiens
atgtgtcactactcacagtct

SEQ ID NO: 5264854 - DNA, 19 bp, Homo sapiens
atgtgtcactgcatggctt

SEQ ID NO: 5264855 - DNA, 18 bp, Homo sapiens
atgtgtcagaataggaaa

SEQ ID NO: 5264856 - DNA, 17 bp, Homo sapiens
atgtgtcagagtgttgt

SEQ ID NO: 5264857 - DNA, 19 bp, Homo sapiens
atgtgtcagctgtagaaag

SEQ ID NO: 5264858 - DNA, 21 bp, Homo sapiens
atgtgtcagctgtagaaaggt

SEQ ID NO: 5264859 - DNA, 22 bp, Homo sapiens
atgtgtcagtggggctctctga

SEQ ID NO: 5264860 - DNA, 17 bp, Homo sapiens
atgtgtcatgatttcaa

SEQ ID NO: 5264861 - DNA, 18 bp, Homo sapiens
atgtgtcatgatttcaat

SEQ ID NO: 5264862 - DNA, 20 bp, Homo sapiens
atgtgtcattggaagccatc

SEQ ID NO: 5264863 - DNA, 16 bp, Homo sapiens
atgtgtccaagacaca

SEQ ID NO: 5264864 - DNA, 17 bp, Homo sapiens
atgtgtccatgtgaaat

SEQ ID NO: 5264865 - DNA, 21 bp, Homo sapiens
atgtgtccatgtgaaatttac

SEQ ID NO: 5264866 - DNA, 11 bp, Homo sapiens
atgtgtcccag

SEQ ID NO: 5264867 - DNA, 16 bp, Homo sapiens
atgtgtcccagaagat

SEQ ID NO: 5264868 - DNA, 18 bp, Homo sapiens
atgtgtcccccccaggcc

SEQ ID NO: 5264869 - DNA, 23 bp, Homo sapiens
atgtgtcccccccaggccttgtc

SEQ ID NO: 5264870 - DNA, 19 bp, Homo sapiens
atgtgtcccccctgtggtc

SEQ ID NO: 5264871 - DNA, 22 bp, Homo sapiens
atgtgtcccccctgtggtctgt

SEQ ID NO: 5264872 - DNA, 22 bp, Homo sapiens
atgtgtcccttccaagctgtgt

SEQ ID NO: 5264873 - DNA, 22 bp, Homo sapiens
atgtgtcctatctatcttccaa

SEQ ID NO: 5264874 - DNA, 15 bp, Homo sapiens
atgtgtcctcctgct

SEQ ID NO: 5264875 - DNA, 23 bp, Homo sapiens
atgtgtcctcctgctctgcttcc

SEQ ID NO: 5264876 - DNA, 14 bp, Homo sapiens
atgtgtctcacatc

SEQ ID NO: 5264877 - DNA, 17 bp, Homo sapiens
atgtgtctcccagaact

SEQ ID NO: 5264878 - DNA, 15 bp, Homo sapiens
atgtgtctctgcttt

SEQ ID NO: 5264879 - DNA, 21 bp, Homo sapiens
atgtgtctgtattcatacagc

SEQ ID NO: 5264880 - DNA, 16 bp, Homo sapiens
atgtgtctgtatttca

SEQ ID NO: 5264881 - DNA, 14 bp, Homo sapiens
atgtgtctgtggac

SEQ ID NO: 5264882 - DNA, 20 bp, Homo sapiens
atgtgtctgtgttgcttcaa

SEQ ID NO: 5264883 - DNA, 16 bp, Homo sapiens
atgtgtcttgtattat

SEQ ID NO: 5264884 - DNA, 20 bp, Homo sapiens
atgtgtctttatcagtgatg

SEQ ID NO: 5264885 - DNA, 15 bp, Homo sapiens
atgtgtgaaacaatg

SEQ ID NO: 5264886 - DNA, 20 bp, Homo sapiens
atgtgtgaagtgagaactcc

SEQ ID NO: 5264887 - DNA, 17 bp, Homo sapiens
atgtgtgacaagtgtgt

SEQ ID NO: 5264888 - DNA, 12 bp, Homo sapiens
atgtgtgacttt

SEQ ID NO: 5264889 - DNA, 15 bp, Homo sapiens
atgtgtgactttcag

SEQ ID NO: 5264890 - DNA, 16 bp, Homo sapiens
atgtgtgagaaaaact

SEQ ID NO: 5264891 - DNA, 21 bp, Homo sapiens
atgtgtgagataacttccttc

SEQ ID NO: 5264892 - DNA, 17 bp, Homo sapiens
atgtgtgagcatcctgc

SEQ ID NO: 5264893 - DNA, 20 bp, Homo sapiens
atgtgtgagcatcctgcaag

SEQ ID NO: 5264894 - DNA, 19 bp, Homo sapiens
atgtgtgaggagctgctgg

SEQ ID NO: 5264895 - DNA, 16 bp, Homo sapiens
atgtgtgagtgcatgt

SEQ ID NO: 5264896 - DNA, 23 bp, Homo sapiens
atgtgtgagtgtatgtatacaca

SEQ ID NO: 5264897 - DNA, 21 bp, Homo sapiens
atgtgtgattcaatgcctctg

SEQ ID NO: 5264898 - DNA, 22 bp, Homo sapiens
atgtgtgcaacagggtatggac

SEQ ID NO: 5264899 - DNA, 14 bp, Homo sapiens
atgtgtgcaggagc

SEQ ID NO: 5264900 - DNA, 21 bp, Homo sapiens
atgtgtgcaggagcctccctg

SEQ ID NO: 5264901 - DNA, 13 bp, Homo sapiens
atgtgtgcatcat

SEQ ID NO: 5264902 - DNA, 15 bp, Homo sapiens
atgtgtgcatgtgtg

SEQ ID NO: 5264903 - DNA, 20 bp, Homo sapiens
atgtgtgccatagagtttaa

SEQ ID NO: 5264904 - DNA, 22 bp, Homo sapiens
atgtgtgccatagagtttaaca

SEQ ID NO: 5264905 - DNA, 13 bp, Homo sapiens
atgtgtgcccaga

SEQ ID NO: 5264906 - DNA, 12 bp, Homo sapiens
atgtgtgcctgt

SEQ ID NO: 5264907 - DNA, 15 bp, Homo sapiens
atgtgtgcctgtggc

SEQ ID NO: 5264908 - DNA, 16 bp, Homo sapiens
atgtgtgcctgtggca

SEQ ID NO: 5264909 - DNA, 23 bp, Homo sapiens
atgtgtgcctgtggcagaaaaga

SEQ ID NO: 5264910 - DNA, 15 bp, Homo sapiens
atgtgtgccttgttc

SEQ ID NO: 5264911 - DNA, 19 bp, Homo sapiens
atgtgtgcgagtgtgtgca

SEQ ID NO: 5264912 - DNA, 17 bp, Homo sapiens
atgtgtgctcacaatgt

SEQ ID NO: 5264913 - DNA, 20 bp, Homo sapiens
atgtgtgggatcattgcatt

SEQ ID NO: 5264914 - DNA, 16 bp, Homo sapiens
atgtgtggtgctaact

SEQ ID NO: 5264915 - DNA, 20 bp, Homo sapiens
atgtgtggtgctaactgtat

SEQ ID NO: 5264916 - DNA, 19 bp, Homo sapiens
atgtgtggtttataatctg

SEQ ID NO: 5264917 - DNA, 12 bp, Homo sapiens
atgtgtggtttc

SEQ ID NO: 5264918 - DNA, 16 bp, Homo sapiens
atgtgtggtttcagtt

SEQ ID NO: 5264919 - DNA, 15 bp, Homo sapiens
atgtgtgtaaaaaag

SEQ ID NO: 5264920 - DNA, 18 bp, Homo sapiens
atgtgtgtaaaaaagtgt

SEQ ID NO: 5264921 - DNA, 19 bp, Homo sapiens
atgtgtgtaaaaaagtgtt

SEQ ID NO: 5264922 - DNA, 19 bp, Homo sapiens
atgtgtgtagacaaatatt

SEQ ID NO: 5264923 - DNA, 16 bp, Homo sapiens
atgtgtgtagactgta

SEQ ID NO: 5264924 - DNA, 10 bp, Homo sapiens
atgtgtgtat

SEQ ID NO: 5264925 - DNA, 18 bp, Homo sapiens
atgtgtgtattttttcat

SEQ ID NO: 5264926 - DNA, 13 bp, Homo sapiens
atgtgtgtcagcc

SEQ ID NO: 5264927 - DNA, 23 bp, Homo sapiens
atgtgtgtcagcccatgtcaatc

SEQ ID NO: 5264928 - DNA, 22 bp, Homo sapiens
atgtgtgtccacgactgtctcc

SEQ ID NO: 5264929 - DNA, 23 bp, Homo sapiens
atgtgtgtccacgactgtctcca

SEQ ID NO: 5264930 - DNA, 13 bp, Homo sapiens
atgtgtgtctcac

SEQ ID NO: 5264931 - DNA, 18 bp, Homo sapiens
atgtgtgtgatgtgacat

SEQ ID NO: 5264932 - DNA, 19 bp, Homo sapiens
atgtgtgtgcaagtgtgtg

SEQ ID NO: 5264933 - DNA, 11 bp, Homo sapiens
atgtgtgtggt

SEQ ID NO: 5264934 - DNA, 17 bp, Homo sapiens
atgtgtgtggtgtgtgt

SEQ ID NO: 5264935 - DNA, 19 bp, Homo sapiens
atgtgtgtggtgtgtgtgc

SEQ ID NO: 5264936 - DNA, 15 bp, Homo sapiens
atgtgtgtgtatgct

SEQ ID NO: 5264937 - DNA, 16 bp, Homo sapiens
atgtgtgtgtatgcta

SEQ ID NO: 5264938 - DNA, 21 bp, Homo sapiens
atgtgtgtgtatgtttgcaca

SEQ ID NO: 5264939 - DNA, 15 bp, Homo sapiens
atgtgtgtgtgggtg

SEQ ID NO: 5264940 - DNA, 17 bp, Homo sapiens
atgtgtgtgtgggtgtg

SEQ ID NO: 5264941 - DNA, 20 bp, Homo sapiens
atgtgtgtgtgggtgtgtgc

SEQ ID NO: 5264942 - DNA, 18 bp, Homo sapiens
atgtgtgtgtgtggcagg

SEQ ID NO: 5264943 - DNA, 21 bp, Homo sapiens
atgtgtgtgtgtgtatgtgta

SEQ ID NO: 5264944 - DNA, 18 bp, Homo sapiens
atgtgtgtgtgttgtgtg

SEQ ID NO: 5264945 - DNA, 18 bp, Homo sapiens
atgtgtgttcctgctttt

SEQ ID NO: 5264946 - DNA, 23 bp, Homo sapiens
atgtgtgttgtcagcctgtgctg

SEQ ID NO: 5264947 - DNA, 16 bp, Homo sapiens
atgtgtgttgtttcca

SEQ ID NO: 5264948 - DNA, 18 bp, Homo sapiens
atgtgtgttgtttccata

SEQ ID NO: 5264949 - DNA, 17 bp, Homo sapiens
atgtgtgtttaaataaa

SEQ ID NO: 5264950 - DNA, 15 bp, Homo sapiens
atgtgtgttttaaaa

SEQ ID NO: 5264951 - DNA, 16 bp, Homo sapiens
atgtgtgttttgctaa

SEQ ID NO: 5264952 - DNA, 23 bp, Homo sapiens
atgtgtgttttgctaaaggaaaa

SEQ ID NO: 5264953 - DNA, 20 bp, Homo sapiens
atgtgttaaacatgctaaat

SEQ ID NO: 5264954 - DNA, 13 bp, Homo sapiens
atgtgttaatctt

SEQ ID NO: 5264955 - DNA, 14 bp, Homo sapiens
atgtgttaatctta

SEQ ID NO: 5264956 - DNA, 21 bp, Homo sapiens
atgtgttagcactgatagtcc

SEQ ID NO: 5264957 - DNA, 12 bp, Homo sapiens
atgtgttatcta

SEQ ID NO: 5264958 - DNA, 18 bp, Homo sapiens
atgtgttatctacctcaa

SEQ ID NO: 5264959 - DNA, 14 bp, Homo sapiens
atgtgttatgaaca

SEQ ID NO: 5264960 - DNA, 17 bp, Homo sapiens
atgtgttcattcaagct

SEQ ID NO: 5264961 - DNA, 18 bp, Homo sapiens
atgtgttcattcaagcta

SEQ ID NO: 5264962 - DNA, 22 bp, Homo sapiens
atgtgttccaaatttgctttac

SEQ ID NO: 5264963 - DNA, 18 bp, Homo sapiens
atgtgttcctccattttc

SEQ ID NO: 5264964 - DNA, 14 bp, Homo sapiens
atgtgttcctcctg

SEQ ID NO: 5264965 - DNA, 17 bp, Homo sapiens
atgtgttcctcctgctg

SEQ ID NO: 5264966 - DNA, 13 bp, Homo sapiens
atgtgttctaagc

SEQ ID NO: 5264967 - DNA, 21 bp, Homo sapiens
atgtgttcttcgtaactttat

SEQ ID NO: 5264968 - DNA, 14 bp, Homo sapiens
atgtgttctttgta

SEQ ID NO: 5264969 - DNA, 23 bp, Homo sapiens
atgtgttgagcgtattcttgaaa

SEQ ID NO: 5264970 - DNA, 20 bp, Homo sapiens
atgtgttgataattttttaa

SEQ ID NO: 5264971 - DNA, 23 bp, Homo sapiens
atgtgttgcaaattattctagtc

SEQ ID NO: 5264972 - DNA, 19 bp, Homo sapiens
atgtgttgcagctgtcacc

SEQ ID NO: 5264973 - DNA, 13 bp, Homo sapiens
atgtgttgccact

SEQ ID NO: 5264974 - DNA, 15 bp, Homo sapiens
atgtgttgctctcca

SEQ ID NO: 5264975 - DNA, 16 bp, Homo sapiens
atgtgttggacaaatg

SEQ ID NO: 5264976 - DNA, 20 bp, Homo sapiens
atgtgttggacaaatgtgaa

SEQ ID NO: 5264977 - DNA, 20 bp, Homo sapiens
atgtgttggggagacatcaa

SEQ ID NO: 5264978 - DNA, 21 bp, Homo sapiens
atgtgttgtaaaaatgtcttt

SEQ ID NO: 5264979 - DNA, 13 bp, Homo sapiens
atgtgttgtgata

SEQ ID NO: 5264980 - DNA, 20 bp, Homo sapiens
atgtgtttaaaacatgcacg

SEQ ID NO: 5264981 - DNA, 19 bp, Homo sapiens
atgagcacatctctctgcc

SEQ ID NO: 5264982 - DNA, 20 bp, Homo sapiens
atgagcacatctctctgccc

SEQ ID NO: 5264983 - DNA, 15 bp, Homo sapiens
atgagcacctttctg

SEQ ID NO: 5264984 - DNA, 20 bp, Homo sapiens
atgagcacctttctggcttt

SEQ ID NO: 5264985 - DNA, 20 bp, Homo sapiens
atgagcactcctgattttta

SEQ ID NO: 5264986 - DNA, 18 bp, Homo sapiens
atgagcagagggaggaag

SEQ ID NO: 5264987 - DNA, 21 bp, Homo sapiens
atgagcagatgagagtttctg

SEQ ID NO: 5264988 - DNA, 16 bp, Homo sapiens
atgagcagcccctccc

SEQ ID NO: 5264989 - DNA, 17 bp, Homo sapiens
atgagcaggagcttggg

SEQ ID NO: 5264990 - DNA, 13 bp, Homo sapiens
atgagcagtcaca

SEQ ID NO: 5264991 - DNA, 14 bp, Homo sapiens
atgagcagtcacac

SEQ ID NO: 5264992 - DNA, 16 bp, Homo sapiens
atgagcagtcacactg

SEQ ID NO: 5264993 - DNA, 15 bp, Homo sapiens
atgagcagtccagag

SEQ ID NO: 5264994 - DNA, 16 bp, Homo sapiens
atgagcagttagaaat

SEQ ID NO: 5264995 - DNA, 19 bp, Homo sapiens
atgagcagttagaaataca

SEQ ID NO: 5264996 - DNA, 15 bp, Homo sapiens
atgagcatcaggcca

SEQ ID NO: 5264997 - DNA, 20 bp, Homo sapiens
atgagcatcaggccaggccc

SEQ ID NO: 5264998 - DNA, 22 bp, Homo sapiens
atgagcatcaggccaggccctc

SEQ ID NO: 5264999 - DNA, 18 bp, Homo sapiens
atgagcatcctgagcccc

SEQ ID NO: 5265000 - DNA, 20 bp, Homo sapiens
atgagcatcctgagccccgc

SEQ ID NO: 5265001 - DNA, 20 bp, Homo sapiens
atgagcatctcaaatgtttt

SEQ ID NO: 5265002 - DNA, 18 bp, Homo sapiens
atgagcatgctccctcat

SEQ ID NO: 5265003 - DNA, 18 bp, Homo sapiens
atgagcatggagctggcc

SEQ ID NO: 5265004 - DNA, 21 bp, Homo sapiens
atgagcatgtttagactttaa

SEQ ID NO: 5265005 - DNA, 19 bp, Homo sapiens
atgagccaaaatgactttg

SEQ ID NO: 5265006 - DNA, 20 bp, Homo sapiens
atgagccaaaatgactttga

SEQ ID NO: 5265007 - DNA, 17 bp, Homo sapiens
atgagccaaaccagcag

SEQ ID NO: 5265008 - DNA, 17 bp, Homo sapiens
atgagccactgagcctg

SEQ ID NO: 5265009 - DNA, 19 bp, Homo sapiens
atgagccactgagcctggc

SEQ ID NO: 5265010 - DNA, 18 bp, Homo sapiens
atgagccactgcacctga

SEQ ID NO: 5265011 - DNA, 11 bp, Homo sapiens
atgagccagac

SEQ ID NO: 5265012 - DNA, 13 bp, Homo sapiens
atgagccagctct

SEQ ID NO: 5265013 - DNA, 16 bp, Homo sapiens
atgagccatcactaga

SEQ ID NO: 5265014 - DNA, 18 bp, Homo sapiens
atgagccatcactagaag

SEQ ID NO: 5265015 - DNA, 22 bp, Homo sapiens
atgagccatcactagaagaaaa

SEQ ID NO: 5265016 - DNA, 19 bp, Homo sapiens
atgagccatgatttcccac

SEQ ID NO: 5265017 - DNA, 21 bp, Homo sapiens
atgagcccaacactcacttaa

SEQ ID NO: 5265018 - DNA, 17 bp, Homo sapiens
atgagcccagagaacag

SEQ ID NO: 5265019 - DNA, 18 bp, Homo sapiens
atgagcccagagaacagc

SEQ ID NO: 5265020 - DNA, 14 bp, Homo sapiens
atgagccctggctc

SEQ ID NO: 5265021 - DNA, 16 bp, Homo sapiens
atgagccgcccaaggc

SEQ ID NO: 5265022 - DNA, 15 bp, Homo sapiens
atgagcctcagcatc

SEQ ID NO: 5265023 - DNA, 16 bp, Homo sapiens
atgagcctcagcatcc

SEQ ID NO: 5265024 - DNA, 18 bp, Homo sapiens
atgagcctcagcatcctg

SEQ ID NO: 5265025 - DNA, 21 bp, Homo sapiens
atgagcctcagcatcctggca

SEQ ID NO: 5265026 - DNA, 12 bp, Homo sapiens
atgagcctctcc

SEQ ID NO: 5265027 - DNA, 15 bp, Homo sapiens
atgagcctctccttg

SEQ ID NO: 5265028 - DNA, 10 bp, Homo sapiens
atgagcctgc

SEQ ID NO: 5265029 - DNA, 12 bp, Homo sapiens
atgagcctgctg

SEQ ID NO: 5265030 - DNA, 14 bp, Homo sapiens
atgagcctgctgga

SEQ ID NO: 5265031 - DNA, 11 bp, Homo sapiens
atgagcctggc

SEQ ID NO: 5265032 - DNA, 23 bp, Homo sapiens
atgagcctgtaatcctcagctga

SEQ ID NO: 5265033 - DNA, 15 bp, Homo sapiens
atgagcctgtttatt

SEQ ID NO: 5265034 - DNA, 17 bp, Homo sapiens
atgagcctgtttattgc

SEQ ID NO: 5265035 - DNA, 22 bp, Homo sapiens
atgagccttgcagatatctgca

SEQ ID NO: 5265036 - DNA, 18 bp, Homo sapiens
atgagcctttgtgctttt

SEQ ID NO: 5265037 - DNA, 19 bp, Homo sapiens
atgagcgaaattgtcttta

SEQ ID NO: 5265038 - DNA, 15 bp, Homo sapiens
atgagcgccacctct

SEQ ID NO: 5265039 - DNA, 16 bp, Homo sapiens
atgagcgctactcttg

SEQ ID NO: 5265040 - DNA, 19 bp, Homo sapiens
atgagcgctactcttggat

SEQ ID NO: 5265041 - DNA, 17 bp, Homo sapiens
atgagcgtcactgccca

SEQ ID NO: 5265042 - DNA, 19 bp, Homo sapiens
atgagcgttaacacagtaa

SEQ ID NO: 5265043 - DNA, 17 bp, Homo sapiens
atgagctacaacaaaag

SEQ ID NO: 5265044 - DNA, 21 bp, Homo sapiens
atgagctacaacaaaaggact

SEQ ID NO: 5265045 - DNA, 23 bp, Homo sapiens
atgagctacttcttattcacttt

SEQ ID NO: 5265046 - DNA, 17 bp, Homo sapiens
atgagctatcctttcaa

SEQ ID NO: 5265047 - DNA, 16 bp, Homo sapiens
atgagctattaaaact

SEQ ID NO: 5265048 - DNA, 17 bp, Homo sapiens
atgagctattaaaactc

SEQ ID NO: 5265049 - DNA, 22 bp, Homo sapiens
atgagctcccacaagcctgagg

SEQ ID NO: 5265050 - DNA, 13 bp, Homo sapiens
atgagctccctcg

SEQ ID NO: 5265051 - DNA, 21 bp, Homo sapiens
atgagctcctgatcagaggca

SEQ ID NO: 5265052 - DNA, 19 bp, Homo sapiens
atgagctcctgctcattgt

SEQ ID NO: 5265053 - DNA, 20 bp, Homo sapiens
atgagctcggggtccaccag

SEQ ID NO: 5265054 - DNA, 18 bp, Homo sapiens
atgagctctacccagggc

SEQ ID NO: 5265055 - DNA, 19 bp, Homo sapiens
atgagctctacccagggcc

SEQ ID NO: 5265056 - DNA, 17 bp, Homo sapiens
atgagctctgaaatctt

SEQ ID NO: 5265057 - DNA, 19 bp, Homo sapiens
atgagctctgaacaaacac

SEQ ID NO: 5265058 - DNA, 20 bp, Homo sapiens
atgagctctgaacaaacact

SEQ ID NO: 5265059 - DNA, 13 bp, Homo sapiens
atgagctgagggg

SEQ ID NO: 5265060 - DNA, 17 bp, Homo sapiens
atgagctgccagaatca

SEQ ID NO: 5265061 - DNA, 23 bp, Homo sapiens
atgagctgccagaatcaggtttc

SEQ ID NO: 5265062 - DNA, 22 bp, Homo sapiens
atgagctgctcattacagttct

SEQ ID NO: 5265063 - DNA, 13 bp, Homo sapiens
atgagctggaagg

SEQ ID NO: 5265064 - DNA, 13 bp, Homo sapiens
atgagctggagct

SEQ ID NO: 5265065 - DNA, 19 bp, Homo sapiens
atgagctggcaaccagcca

SEQ ID NO: 5265066 - DNA, 18 bp, Homo sapiens
atgagctgggccctgggt

SEQ ID NO: 5265067 - DNA, 14 bp, Homo sapiens
atgagctgtatctg

SEQ ID NO: 5265068 - DNA, 18 bp, Homo sapiens
atgagctgtatctgtaat

SEQ ID NO: 5265069 - DNA, 15 bp, Homo sapiens
atgagctgtgagaag

SEQ ID NO: 5265070 - DNA, 23 bp, Homo sapiens
atgagcttaagaaatttgtggaa

SEQ ID NO: 5265071 - DNA, 19 bp, Homo sapiens
atgagcttcaatataagaa

SEQ ID NO: 5265072 - DNA, 22 bp, Homo sapiens
atgagctttatgtaataatgtg

SEQ ID NO: 5265073 - DNA, 12 bp, Homo sapiens
atgagctttctg

SEQ ID NO: 5265074 - DNA, 14 bp, Homo sapiens
atgagctttctgaa

SEQ ID NO: 5265075 - DNA, 17 bp, Homo sapiens
atgagctttctgaacag

SEQ ID NO: 5265076 - DNA, 13 bp, Homo sapiens
atgagctttcttt

SEQ ID NO: 5265077 - DNA, 23 bp, Homo sapiens
atgaggaaaaaatggtataaaag

SEQ ID NO: 5265078 - DNA, 15 bp, Homo sapiens
atgaggaaaattctt

SEQ ID NO: 5265079 - DNA, 19 bp, Homo sapiens
atgaggaaaattcttaaaa

SEQ ID NO: 5265080 - DNA, 16 bp, Homo sapiens
atgaggaaacaggcct

SEQ ID NO: 5265081 - DNA, 23 bp, Homo sapiens
atgaggaaactactgaactagca

SEQ ID NO: 5265082 - DNA, 22 bp, Homo sapiens
atgaggaaacttggacatttat

SEQ ID NO: 5265083 - DNA, 13 bp, Homo sapiens
atgaggaaagaca

SEQ ID NO: 5265084 - DNA, 17 bp, Homo sapiens
atgaggaaagacacaga

SEQ ID NO: 5265085 - DNA, 22 bp, Homo sapiens
atgaggaaatgccacaaattgt

SEQ ID NO: 5265086 - DNA, 13 bp, Homo sapiens
atgaggaaatgtg

SEQ ID NO: 5265087 - DNA, 21 bp, Homo sapiens
atgaggaacaatcacaaaagc

SEQ ID NO: 5265088 - DNA, 11 bp, Homo sapiens
atgaggaagaa

SEQ ID NO: 5265089 - DNA, 14 bp, Homo sapiens
atgaggaatccaaa

SEQ ID NO: 5265090 - DNA, 21 bp, Homo sapiens
atgaggaatccaaaagacaaa

SEQ ID NO: 5265091 - DNA, 17 bp, Homo sapiens
atgaggaattaaagaca

SEQ ID NO: 5265092 - DNA, 17 bp, Homo sapiens
atgaggacagaaggact

SEQ ID NO: 5265093 - DNA, 17 bp, Homo sapiens
atgaggaccagggtgga

SEQ ID NO: 5265094 - DNA, 19 bp, Homo sapiens
atgaggactctattcttta

SEQ ID NO: 5265095 - DNA, 17 bp, Homo sapiens
atgaggagagaaaatat

SEQ ID NO: 5265096 - DNA, 13 bp, Homo sapiens
atgaggagcctct

SEQ ID NO: 5265097 - DNA, 14 bp, Homo sapiens
atgaggagcgtgga

SEQ ID NO: 5265098 - DNA, 16 bp, Homo sapiens
atgaggagcgtggact

SEQ ID NO: 5265099 - DNA, 14 bp, Homo sapiens
atgaggaggaagga

SEQ ID NO: 5265100 - DNA, 12 bp, Homo sapiens
atgaggagggga

SEQ ID NO: 5265101 - DNA, 13 bp, Homo sapiens
atgaggaggggag

SEQ ID NO: 5265102 - DNA, 14 bp, Homo sapiens
atgaggaggggagg

SEQ ID NO: 5265103 - DNA, 17 bp, Homo sapiens
atgaggaggggagggta

SEQ ID NO: 5265104 - DNA, 21 bp, Homo sapiens
atgaggaggggcccccctgcc

SEQ ID NO: 5265105 - DNA, 18 bp, Homo sapiens
atgaggagtgaacatttg

SEQ ID NO: 5265106 - DNA, 20 bp, Homo sapiens
atgaggataacttccttgcc

SEQ ID NO: 5265107 - DNA, 17 bp, Homo sapiens
atgaggatccagggcag

SEQ ID NO: 5265108 - DNA, 20 bp, Homo sapiens
atgaggatgcagagtcagca

SEQ ID NO: 5265109 - DNA, 17 bp, Homo sapiens
atgaggatgtatgtgta

SEQ ID NO: 5265110 - DNA, 18 bp, Homo sapiens
atgaggatgtatgtgtat

SEQ ID NO: 5265111 - DNA, 15 bp, Homo sapiens
atgaggcaaaaatgt

SEQ ID NO: 5265112 - DNA, 20 bp, Homo sapiens
atgaggcaacctgattgtaa

SEQ ID NO: 5265113 - DNA, 20 bp, Homo sapiens
atgaggcacgcctgccttct

SEQ ID NO: 5265114 - DNA, 14 bp, Homo sapiens
atgaggcacttctg

SEQ ID NO: 5265115 - DNA, 14 bp, Homo sapiens
atgaggcatttgtt

SEQ ID NO: 5265116 - DNA, 23 bp, Homo sapiens
atgaggccactgctgcttctcca

SEQ ID NO: 5265117 - DNA, 21 bp, Homo sapiens
atgaggccatggactctgtcc

SEQ ID NO: 5265118 - DNA, 20 bp, Homo sapiens
atgaggccctccacacctgc

SEQ ID NO: 5265119 - DNA, 15 bp, Homo sapiens
atgaggcctcttgga

SEQ ID NO: 5265120 - DNA, 21 bp, Homo sapiens
atgaggcctcttggacctctg

SEQ ID NO: 5265121 - DNA, 22 bp, Homo sapiens
atgaggcggagctccaggatgg

SEQ ID NO: 5265122 - DNA, 13 bp, Homo sapiens
atgaggctcagag

SEQ ID NO: 5265123 - DNA, 18 bp, Homo sapiens
atgaggctcagagaggta

SEQ ID NO: 5265124 - DNA, 22 bp, Homo sapiens
atgaggctgctttccaaagcca

SEQ ID NO: 5265125 - DNA, 15 bp, Homo sapiens
atgaggctggtgacg

SEQ ID NO: 5265126 - DNA, 11 bp, Homo sapiens
atgaggcttct

SEQ ID NO: 5265127 - DNA, 15 bp, Homo sapiens
atgaggcttcttcct

SEQ ID NO: 5265128 - DNA, 16 bp, Homo sapiens
atgaggcttcttcctg

SEQ ID NO: 5265129 - DNA, 22 bp, Homo sapiens
atgaggcttcttcctggatggg

SEQ ID NO: 5265130 - DNA, 23 bp, Homo sapiens
atgagggaaatctgtaaagccag

SEQ ID NO: 5265131 - DNA, 16 bp, Homo sapiens
atgagggagatgccat

SEQ ID NO: 5265132 - DNA, 16 bp, Homo sapiens
atgagggatgggcctg

SEQ ID NO: 5265133 - DNA, 18 bp, Homo sapiens
atgagggatgggcctggc

SEQ ID NO: 5265134 - DNA, 14 bp, Homo sapiens
atgagggcagcagc

SEQ ID NO: 5265135 - DNA, 15 bp, Homo sapiens
atgagggcagcagcc

SEQ ID NO: 5265136 - DNA, 23 bp, Homo sapiens
atgagggcagcagccagccctgc

SEQ ID NO: 5265137 - DNA, 18 bp, Homo sapiens
atgagggcgtgaaacaca

SEQ ID NO: 5265138 - DNA, 21 bp, Homo sapiens
atgagggctggctgccgtttt

SEQ ID NO: 5265139 - DNA, 19 bp, Homo sapiens
atgaggggaaaaaaacagt

SEQ ID NO: 5265140 - DNA, 16 bp, Homo sapiens
atgaggggaagccatt

SEQ ID NO: 5265141 - DNA, 12 bp, Homo sapiens
atgaggggagag

SEQ ID NO: 5265142 - DNA, 14 bp, Homo sapiens
atgaggggagagga

SEQ ID NO: 5265143 - DNA, 13 bp, Homo sapiens
atgaggggagggg

SEQ ID NO: 5265144 - DNA, 19 bp, Homo sapiens
atgaggggatatttaggcc

SEQ ID NO: 5265145 - DNA, 15 bp, Homo sapiens
atgaggggccactga

SEQ ID NO: 5265146 - DNA, 15 bp, Homo sapiens
atgaggggcccgagc

SEQ ID NO: 5265147 - DNA, 20 bp, Homo sapiens
atgagggggaattcctggaa

SEQ ID NO: 5265148 - DNA, 20 bp, Homo sapiens
atgaggggttcctcccctcc

SEQ ID NO: 5265149 - DNA, 16 bp, Homo sapiens
atgagggtctcactgc

SEQ ID NO: 5265150 - DNA, 14 bp, Homo sapiens
atgagggtgactgt

SEQ ID NO: 5265151 - DNA, 21 bp, Homo sapiens
atgagggtgtcggctgtgagg

SEQ ID NO: 5265152 - DNA, 20 bp, Homo sapiens
atgagggtgtttcctctaaa

SEQ ID NO: 5265153 - DNA, 16 bp, Homo sapiens
atgagggtgttttttt

SEQ ID NO: 5265154 - DNA, 19 bp, Homo sapiens
atgagggtttgagagagca

SEQ ID NO: 5265155 - DNA, 20 bp, Homo sapiens
atgaggtaaaagagccaagt

SEQ ID NO: 5265156 - DNA, 15 bp, Homo sapiens
atgaggtactgagag

SEQ ID NO: 5265157 - DNA, 15 bp, Homo sapiens
atgaggtagctgaca

SEQ ID NO: 5265158 - DNA, 16 bp, Homo sapiens
atgaggtatcttcttt

SEQ ID NO: 5265159 - DNA, 16 bp, Homo sapiens
atgaggtcaagaaatg

SEQ ID NO: 5265160 - DNA, 15 bp, Homo sapiens
atgtgtttaattttg

SEQ ID NO: 5265161 - DNA, 11 bp, Homo sapiens
atgtgtttaga

SEQ ID NO: 5265162 - DNA, 13 bp, Homo sapiens
atgtgtttagaat

SEQ ID NO: 5265163 - DNA, 18 bp, Homo sapiens
atgtgtttattcatccag

SEQ ID NO: 5265164 - DNA, 21 bp, Homo sapiens
atgtgtttattcatccagcag

SEQ ID NO: 5265165 - DNA, 17 bp, Homo sapiens
atgtgtttcacagtttg

SEQ ID NO: 5265166 - DNA, 21 bp, Homo sapiens
atgtgtttcacagtttgaaat

SEQ ID NO: 5265167 - DNA, 23 bp, Homo sapiens
atgtgtttcacagtttgaaataa

SEQ ID NO: 5265168 - DNA, 20 bp, Homo sapiens
atgtgtttcataacaaacca

SEQ ID NO: 5265169 - DNA, 19 bp, Homo sapiens
atgtgtttctgacacaaga

SEQ ID NO: 5265170 - DNA, 20 bp, Homo sapiens
atgtgtttctgtaacaaatt

SEQ ID NO: 5265171 - DNA, 13 bp, Homo sapiens
atgtgtttgctgc

SEQ ID NO: 5265172 - DNA, 16 bp, Homo sapiens
atgtgtttgctgcctt

SEQ ID NO: 5265173 - DNA, 23 bp, Homo sapiens
atgtgtttggatacatctgctgt

SEQ ID NO: 5265174 - DNA, 22 bp, Homo sapiens
atgtgtttggtttataatttga

SEQ ID NO: 5265175 - DNA, 15 bp, Homo sapiens
atgtgttttaataaa

SEQ ID NO: 5265176 - DNA, 16 bp, Homo sapiens
atgtgttttcagtctt

SEQ ID NO: 5265177 - DNA, 14 bp, Homo sapiens
atgtgttttctgta

SEQ ID NO: 5265178 - DNA, 15 bp, Homo sapiens
atgtgttttctgtag

SEQ ID NO: 5265179 - DNA, 22 bp, Homo sapiens
atgtgttttgcacgtcttgcta

SEQ ID NO: 5265180 - DNA, 17 bp, Homo sapiens
atgtgttttgcttttat

SEQ ID NO: 5265181 - DNA, 15 bp, Homo sapiens
atgtgtttttcagtt

SEQ ID NO: 5265182 - DNA, 20 bp, Homo sapiens
atgtgtttttctatatagtt

SEQ ID NO: 5265183 - DNA, 17 bp, Homo sapiens
atgtgtttttctccagt

SEQ ID NO: 5265184 - DNA, 19 bp, Homo sapiens
atgttaaaaaaataagaag

SEQ ID NO: 5265185 - DNA, 22 bp, Homo sapiens
atgttaaaaaaataagaagaat

SEQ ID NO: 5265186 - DNA, 16 bp, Homo sapiens
atgttaaaaatagcag

SEQ ID NO: 5265187 - DNA, 17 bp, Homo sapiens
atgttaaaaatagcagt

SEQ ID NO: 5265188 - DNA, 19 bp, Homo sapiens
atgttaaaacataaacaca

SEQ ID NO: 5265189 - DNA, 13 bp, Homo sapiens
atgttaaaataat

SEQ ID NO: 5265190 - DNA, 18 bp, Homo sapiens
atgttaaaataattatat

SEQ ID NO: 5265191 - DNA, 17 bp, Homo sapiens
atgttaaaatgtacttt

SEQ ID NO: 5265192 - DNA, 15 bp, Homo sapiens
atgttaaaatgtgtt

SEQ ID NO: 5265193 - DNA, 13 bp, Homo sapiens
atgttaaaccatg

SEQ ID NO: 5265194 - DNA, 20 bp, Homo sapiens
atgttaaaccatgggataaa

SEQ ID NO: 5265195 - DNA, 17 bp, Homo sapiens
atgttaaacgtcacagc

SEQ ID NO: 5265196 - DNA, 18 bp, Homo sapiens
atgttaaacgtcacagca

SEQ ID NO: 5265197 - DNA, 24 bp, Homo sapiens
atgttaaactagcatatctgcctt

SEQ ID NO: 5265198 - DNA, 17 bp, Homo sapiens
atgttaaagagaatgag

SEQ ID NO: 5265199 - DNA, 22 bp, Homo sapiens
atgttaaagagaatgagtcctt

SEQ ID NO: 5265200 - DNA, 13 bp, Homo sapiens
atgttaaagatgt

SEQ ID NO: 5265201 - DNA, 16 bp, Homo sapiens
atgttaaataaattgt

SEQ ID NO: 5265202 - DNA, 20 bp, Homo sapiens
atgttaaataaattgtatat

SEQ ID NO: 5265203 - DNA, 13 bp, Homo sapiens
atgttaaatactg

SEQ ID NO: 5265204 - DNA, 15 bp, Homo sapiens
atgttaaatactgtg

SEQ ID NO: 5265205 - DNA, 18 bp, Homo sapiens
atgttaaatgccttggtt

SEQ ID NO: 5265206 - DNA, 16 bp, Homo sapiens
atgttaaatttgtaag

SEQ ID NO: 5265207 - DNA, 20 bp, Homo sapiens
atgttaaatttgtaagtttc

SEQ ID NO: 5265208 - DNA, 14 bp, Homo sapiens
atgttaacaacttg

SEQ ID NO: 5265209 - DNA, 15 bp, Homo sapiens
atgttaacacatttt

SEQ ID NO: 5265210 - DNA, 15 bp, Homo sapiens
atgttaacatgcgca

SEQ ID NO: 5265211 - DNA, 19 bp, Homo sapiens
atgttaacatgcgcatttt

SEQ ID NO: 5265212 - DNA, 18 bp, Homo sapiens
atgttaaccaaggaaata

SEQ ID NO: 5265213 - DNA, 18 bp, Homo sapiens
atgttaacctaggcagtg

SEQ ID NO: 5265214 - DNA, 14 bp, Homo sapiens
atgttaactgccaa

SEQ ID NO: 5265215 - DNA, 22 bp, Homo sapiens
atgttaacttggttctcagact

SEQ ID NO: 5265216 - DNA, 12 bp, Homo sapiens
atgttaagaaag

SEQ ID NO: 5265217 - DNA, 18 bp, Homo sapiens
atgttaagaaatgggttt

SEQ ID NO: 5265218 - DNA, 14 bp, Homo sapiens
atgttaagaataac

SEQ ID NO: 5265219 - DNA, 23 bp, Homo sapiens
atgttaagaatgaagttctgcta

SEQ ID NO: 5265220 - DNA, 18 bp, Homo sapiens
atgttaagataacttact

SEQ ID NO: 5265221 - DNA, 20 bp, Homo sapiens
atgttaagataacttactgt

SEQ ID NO: 5265222 - DNA, 16 bp, Homo sapiens
atgttaagcatggatt

SEQ ID NO: 5265223 - DNA, 16 bp, Homo sapiens
atgttaagcatttatt

SEQ ID NO: 5265224 - DNA, 21 bp, Homo sapiens
atgttaagccctggcaggcag

SEQ ID NO: 5265225 - DNA, 17 bp, Homo sapiens
atgttaaggaaactctt

SEQ ID NO: 5265226 - DNA, 20 bp, Homo sapiens
atgttaagggaagaattcca

SEQ ID NO: 5265227 - DNA, 19 bp, Homo sapiens
atgttaataaactgcaaat

SEQ ID NO: 5265228 - DNA, 14 bp, Homo sapiens
atgttaatacatca

SEQ ID NO: 5265229 - DNA, 22 bp, Homo sapiens
atgttaatattttacttttaca

SEQ ID NO: 5265230 - DNA, 18 bp, Homo sapiens
atgttaatattttatgtg

SEQ ID NO: 5265231 - DNA, 20 bp, Homo sapiens
atgttaatattttatgtgta

SEQ ID NO: 5265232 - DNA, 14 bp, Homo sapiens
atgttaatcaaaca

SEQ ID NO: 5265233 - DNA, 21 bp, Homo sapiens
atgttaattaaactgaagaag

SEQ ID NO: 5265234 - DNA, 19 bp, Homo sapiens
atgttaattaaagtaaaat

SEQ ID NO: 5265235 - DNA, 22 bp, Homo sapiens
atgttaattaaagtaaaattat

SEQ ID NO: 5265236 - DNA, 16 bp, Homo sapiens
atgttaattatgcagt

SEQ ID NO: 5265237 - DNA, 21 bp, Homo sapiens
atgttaattatgcagtgtttc

SEQ ID NO: 5265238 - DNA, 22 bp, Homo sapiens
atgttaattatgcagtgtttcc

SEQ ID NO: 5265239 - DNA, 18 bp, Homo sapiens
atgttaatttactttctg

SEQ ID NO: 5265240 - DNA, 17 bp, Homo sapiens
atgttaatttatttagt

SEQ ID NO: 5265241 - DNA, 19 bp, Homo sapiens
atgttaatttattttgctc

SEQ ID NO: 5265242 - DNA, 22 bp, Homo sapiens
atgttaattttttggtacaaaa

SEQ ID NO: 5265243 - DNA, 15 bp, Homo sapiens
atgttacaagtttgc

SEQ ID NO: 5265244 - DNA, 17 bp, Homo sapiens
atgttacaagtttgcta

SEQ ID NO: 5265245 - DNA, 23 bp, Homo sapiens
atgttacaagtttgctaaaagaa

SEQ ID NO: 5265246 - DNA, 13 bp, Homo sapiens
atgttacacatta

SEQ ID NO: 5265247 - DNA, 21 bp, Homo sapiens
atgttacacattaaacaggat

SEQ ID NO: 5265248 - DNA, 22 bp, Homo sapiens
atgttacagcatctactctttg

SEQ ID NO: 5265249 - DNA, 20 bp, Homo sapiens
atgttacataagataaatgt

SEQ ID NO: 5265250 - DNA, 16 bp, Homo sapiens
atgttacatgtagaaa

SEQ ID NO: 5265251 - DNA, 21 bp, Homo sapiens
atgttacatgtagaaaaatac

SEQ ID NO: 5265252 - DNA, 15 bp, Homo sapiens
atgttacattaggaa

SEQ ID NO: 5265253 - DNA, 23 bp, Homo sapiens
atgttaccaaagcaatatttccc

SEQ ID NO: 5265254 - DNA, 13 bp, Homo sapiens
atgttaccagact

SEQ ID NO: 5265255 - DNA, 16 bp, Homo sapiens
atgttaccatcttact

SEQ ID NO: 5265256 - DNA, 14 bp, Homo sapiens
atgttacccattca

SEQ ID NO: 5265257 - DNA, 21 bp, Homo sapiens
atgttacgtgaagaaataaat

SEQ ID NO: 5265258 - DNA, 23 bp, Homo sapiens
atgttactaaatggtgttacatt

SEQ ID NO: 5265259 - DNA, 22 bp, Homo sapiens
atgttactaaattacgtatgca

SEQ ID NO: 5265260 - DNA, 20 bp, Homo sapiens
atgttactaaattttctaat

SEQ ID NO: 5265261 - DNA, 17 bp, Homo sapiens
atgttactacatgcact

SEQ ID NO: 5265262 - DNA, 18 bp, Homo sapiens
atgttactgatcatgcat

SEQ ID NO: 5265263 - DNA, 21 bp, Homo sapiens
atgttactgatcatgcattgt

SEQ ID NO: 5265264 - DNA, 15 bp, Homo sapiens
atgttactgccaaaa

SEQ ID NO: 5265265 - DNA, 14 bp, Homo sapiens
atgttactgcctta

SEQ ID NO: 5265266 - DNA, 16 bp, Homo sapiens
atgttactgcttcatt

SEQ ID NO: 5265267 - DNA, 17 bp, Homo sapiens
atgttagaagtccaggc

SEQ ID NO: 5265268 - DNA, 17 bp, Homo sapiens
atgttagaattgatttc

SEQ ID NO: 5265269 - DNA, 18 bp, Homo sapiens
atgttagaattgatttcc

SEQ ID NO: 5265270 - DNA, 24 bp, Homo sapiens
atgttagacttgtgtgcatggaag

SEQ ID NO: 5265271 - DNA, 20 bp, Homo sapiens
atgttagattaggtgtaaga

SEQ ID NO: 5265272 - DNA, 15 bp, Homo sapiens
atgttagcattaaag

SEQ ID NO: 5265273 - DNA, 20 bp, Homo sapiens
atgttagcattaaagttcta

SEQ ID NO: 5265274 - DNA, 19 bp, Homo sapiens
atgttagggtataagttgc

SEQ ID NO: 5265275 - DNA, 22 bp, Homo sapiens
atgttagggtataagttgctgt

SEQ ID NO: 5265276 - DNA, 14 bp, Homo sapiens
atgttagtaacttt

SEQ ID NO: 5265277 - DNA, 16 bp, Homo sapiens
atgttagtaatacctc

SEQ ID NO: 5265278 - DNA, 17 bp, Homo sapiens
atgttagtaatggcaga

SEQ ID NO: 5265279 - DNA, 22 bp, Homo sapiens
atgttagtaatggcagagcagt

SEQ ID NO: 5265280 - DNA, 14 bp, Homo sapiens
atgttagtatttta

SEQ ID NO: 5265281 - DNA, 22 bp, Homo sapiens
atgttagtggcatatttgcttc

SEQ ID NO: 5265282 - DNA, 11 bp, Homo sapiens
atgttagttct

SEQ ID NO: 5265283 - DNA, 21 bp, Homo sapiens
atgttagttctagctctattt

SEQ ID NO: 5265284 - DNA, 16 bp, Homo sapiens
atgttataacttatga

SEQ ID NO: 5265285 - DNA, 15 bp, Homo sapiens
atgttatacaaggca

SEQ ID NO: 5265286 - DNA, 17 bp, Homo sapiens
atgttatacaaggcaag

SEQ ID NO: 5265287 - DNA, 15 bp, Homo sapiens
atgttatacatccta

SEQ ID NO: 5265288 - DNA, 17 bp, Homo sapiens
atgttatacatcctatt

SEQ ID NO: 5265289 - DNA, 18 bp, Homo sapiens
atgttatacatcctattt

SEQ ID NO: 5265290 - DNA, 14 bp, Homo sapiens
atgttatagaactt

SEQ ID NO: 5265291 - DNA, 15 bp, Homo sapiens
atgttatagaacttc

SEQ ID NO: 5265292 - DNA, 15 bp, Homo sapiens
atgttatatataaat

SEQ ID NO: 5265293 - DNA, 18 bp, Homo sapiens
atgttatatataaatata

SEQ ID NO: 5265294 - DNA, 17 bp, Homo sapiens
atgttatattaaagaaa

SEQ ID NO: 5265295 - DNA, 14 bp, Homo sapiens
atgttatattgctt

SEQ ID NO: 5265296 - DNA, 13 bp, Homo sapiens
atgttatatttaa

SEQ ID NO: 5265297 - DNA, 23 bp, Homo sapiens
atgttatcacctaagcacttcta

SEQ ID NO: 5265298 - DNA, 14 bp, Homo sapiens
atgttatcagtatt

SEQ ID NO: 5265299 - DNA, 22 bp, Homo sapiens
atgttatcggattactgaattg

SEQ ID NO: 5265300 - DNA, 19 bp, Homo sapiens
atgttatcggctctattct

SEQ ID NO: 5265301 - DNA, 21 bp, Homo sapiens
atgttatcttatactgtacaa

SEQ ID NO: 5265302 - DNA, 16 bp, Homo sapiens
atgttatcttctcaag

SEQ ID NO: 5265303 - DNA, 22 bp, Homo sapiens
atgttatcttctcaagttctaa

SEQ ID NO: 5265304 - DNA, 14 bp, Homo sapiens
atgttatgaacagc

SEQ ID NO: 5265305 - DNA, 22 bp, Homo sapiens
atgttatgaacagctgtgtctg

SEQ ID NO: 5265306 - DNA, 13 bp, Homo sapiens
atgttatgataaa

SEQ ID NO: 5265307 - DNA, 22 bp, Homo sapiens
atgttatgataaaaaattttgt

SEQ ID NO: 5265308 - DNA, 23 bp, Homo sapiens
atgttatgataaaaaattttgta

SEQ ID NO: 5265309 - DNA, 20 bp, Homo sapiens
atgttatgatttgtaacatt

SEQ ID NO: 5265310 - DNA, 20 bp, Homo sapiens
atgttatgcagtgaactatt

SEQ ID NO: 5265311 - DNA, 17 bp, Homo sapiens
atgttatgccagctcca

SEQ ID NO: 5265312 - DNA, 21 bp, Homo sapiens
atgttatggcttattgtgtga

SEQ ID NO: 5265313 - DNA, 19 bp, Homo sapiens
atgttatgggatgtaaaca

SEQ ID NO: 5265314 - DNA, 14 bp, Homo sapiens
atgttatgtgacta

SEQ ID NO: 5265315 - DNA, 13 bp, Homo sapiens
atgttatgtttaa

SEQ ID NO: 5265316 - DNA, 19 bp, Homo sapiens
atgttatgtttaataagct

SEQ ID NO: 5265317 - DNA, 16 bp, Homo sapiens
atgttattaaacaggt

SEQ ID NO: 5265318 - DNA, 13 bp, Homo sapiens
atgttattactgt

SEQ ID NO: 5265319 - DNA, 21 bp, Homo sapiens
atgttattactgttttgggcc

SEQ ID NO: 5265320 - DNA, 13 bp, Homo sapiens
atgttattatctg

SEQ ID NO: 5265321 - DNA, 13 bp, Homo sapiens
atgttattatgct

SEQ ID NO: 5265322 - DNA, 14 bp, Homo sapiens
atgttattatgcta

SEQ ID NO: 5265323 - DNA, 14 bp, Homo sapiens
atgttattctagta

SEQ ID NO: 5265324 - DNA, 14 bp, Homo sapiens
atgttattgaaaaa

SEQ ID NO: 5265325 - DNA, 22 bp, Homo sapiens
atgttattgaaaaaaattggca

SEQ ID NO: 5265326 - DNA, 15 bp, Homo sapiens
atgttattgcataat

SEQ ID NO: 5265327 - DNA, 21 bp, Homo sapiens
atgttattgcctaatcactcc

SEQ ID NO: 5265328 - DNA, 15 bp, Homo sapiens
atgttattggaattt

SEQ ID NO: 5265329 - DNA, 13 bp, Homo sapiens
atgttattgtgta

SEQ ID NO: 5265330 - DNA, 14 bp, Homo sapiens
atgttattgtgtat

SEQ ID NO: 5265331 - DNA, 18 bp, Homo sapiens
atgttatttatatattgg

SEQ ID NO: 5265332 - DNA, 15 bp, Homo sapiens
atgttatttctgcaa

SEQ ID NO: 5265333 - DNA, 15 bp, Homo sapiens
atgttatttgtaata

SEQ ID NO: 5265334 - DNA, 17 bp, Homo sapiens
atgttattttccttctg

SEQ ID NO: 5265335 - DNA, 12 bp, Homo sapiens
atgttattttgt

SEQ ID NO: 5265336 - DNA, 17 bp, Homo sapiens
atgttattttttaatta

SEQ ID NO: 5265337 - DNA, 15 bp, Homo sapiens
atgttcaaaagaagt

SEQ ID NO: 5265338 - DNA, 16 bp, Homo sapiens
atgaggtcagagcctg

SEQ ID NO: 5265339 - DNA, 15 bp, Homo sapiens
atgaggtcccaggca

SEQ ID NO: 5265340 - DNA, 13 bp, Homo sapiens
atgaggtcctcag

SEQ ID NO: 5265341 - DNA, 17 bp, Homo sapiens
atgaggtcctcaggtca

SEQ ID NO: 5265342 - DNA, 18 bp, Homo sapiens
atgaggtcctcaggtcag

SEQ ID NO: 5265343 - DNA, 21 bp, Homo sapiens
atgaggtctcgaccctgtccc

SEQ ID NO: 5265344 - DNA, 14 bp, Homo sapiens
atgaggtctgaaat

SEQ ID NO: 5265345 - DNA, 15 bp, Homo sapiens
atgaggtcttcccgc

SEQ ID NO: 5265346 - DNA, 16 bp, Homo sapiens
atgaggtgccacccag

SEQ ID NO: 5265347 - DNA, 16 bp, Homo sapiens
atgaggtgctgggagg

SEQ ID NO: 5265348 - DNA, 13 bp, Homo sapiens
atgaggtgggggt

SEQ ID NO: 5265349 - DNA, 16 bp, Homo sapiens
atgaggttatgagaaa

SEQ ID NO: 5265350 - DNA, 22 bp, Homo sapiens
atgaggttctgagaccagtgta

SEQ ID NO: 5265351 - DNA, 17 bp, Homo sapiens
atgagtaaaaactagaa

SEQ ID NO: 5265352 - DNA, 20 bp, Homo sapiens
atgagtaaactgtttctcag

SEQ ID NO: 5265353 - DNA, 17 bp, Homo sapiens
atgagtaaataaactct

SEQ ID NO: 5265354 - DNA, 21 bp, Homo sapiens
atgagtaaataaactcttcaa

SEQ ID NO: 5265355 - DNA, 15 bp, Homo sapiens
atgagtaaatgaata

SEQ ID NO: 5265356 - DNA, 16 bp, Homo sapiens
atgagtaacatttgct

SEQ ID NO: 5265357 - DNA, 24 bp, Homo sapiens
atgagtagatactctcagcaccaa

SEQ ID NO: 5265358 - DNA, 19 bp, Homo sapiens
atgagtataatgaacactc

SEQ ID NO: 5265359 - DNA, 14 bp, Homo sapiens
atgagtatacaata

SEQ ID NO: 5265360 - DNA, 18 bp, Homo sapiens
atgagtatacaatatata

SEQ ID NO: 5265361 - DNA, 15 bp, Homo sapiens
atgagtatatgtaac

SEQ ID NO: 5265362 - DNA, 19 bp, Homo sapiens
atgagtatatgtaacagtt

SEQ ID NO: 5265363 - DNA, 23 bp, Homo sapiens
atgagtatatgtaacagtttaaa

SEQ ID NO: 5265364 - DNA, 19 bp, Homo sapiens
atgagtattagttccctgt

SEQ ID NO: 5265365 - DNA, 21 bp, Homo sapiens
atgagtattataggactttct

SEQ ID NO: 5265366 - DNA, 14 bp, Homo sapiens
atgagtcaaaacaa

SEQ ID NO: 5265367 - DNA, 17 bp, Homo sapiens
atgagtcaatcagcctt

SEQ ID NO: 5265368 - DNA, 19 bp, Homo sapiens
atgagtcaatcagccttta

SEQ ID NO: 5265369 - DNA, 15 bp, Homo sapiens
atgagtcacaaaata

SEQ ID NO: 5265370 - DNA, 21 bp, Homo sapiens
atgagtcatttgtttaaacaa

SEQ ID NO: 5265371 - DNA, 19 bp, Homo sapiens
atgagtccaaactggaatg

SEQ ID NO: 5265372 - DNA, 13 bp, Homo sapiens
atgagtcctattc

SEQ ID NO: 5265373 - DNA, 21 bp, Homo sapiens
atgagtctacctgagcattca

SEQ ID NO: 5265374 - DNA, 12 bp, Homo sapiens
atgagtctagat

SEQ ID NO: 5265375 - DNA, 17 bp, Homo sapiens
atgagtctagatgttta

SEQ ID NO: 5265376 - DNA, 22 bp, Homo sapiens
atgagtctcaataaactgaatt

SEQ ID NO: 5265377 - DNA, 14 bp, Homo sapiens
atgagtctcactag

SEQ ID NO: 5265378 - DNA, 22 bp, Homo sapiens
atgagtctccagatagatgtcg

SEQ ID NO: 5265379 - DNA, 17 bp, Homo sapiens
atgagtctgcataaact

SEQ ID NO: 5265380 - DNA, 20 bp, Homo sapiens
atgagtctgcataaacttca

SEQ ID NO: 5265381 - DNA, 18 bp, Homo sapiens
atgagtctgttgtgtgtc

SEQ ID NO: 5265382 - DNA, 15 bp, Homo sapiens
atgagtgaataaatg

SEQ ID NO: 5265383 - DNA, 16 bp, Homo sapiens
atgagtgaataaatgt

SEQ ID NO: 5265384 - DNA, 23 bp, Homo sapiens
atgagtgattgacacacagcact

SEQ ID NO: 5265385 - DNA, 14 bp, Homo sapiens
atgagtgcacctgc

SEQ ID NO: 5265386 - DNA, 20 bp, Homo sapiens
atgagtgcgcagatctgtgc

SEQ ID NO: 5265387 - DNA, 19 bp, Homo sapiens
atgagtgcgtggtgcgagt

SEQ ID NO: 5265388 - DNA, 22 bp, Homo sapiens
atgagtgcgtggtgcgagtgcg

SEQ ID NO: 5265389 - DNA, 20 bp, Homo sapiens
atgagtgctaagagcctctg

SEQ ID NO: 5265390 - DNA, 23 bp, Homo sapiens
atgagtgcttcagaatgtgattt

SEQ ID NO: 5265391 - DNA, 13 bp, Homo sapiens
atgagtggaaata

SEQ ID NO: 5265392 - DNA, 16 bp, Homo sapiens
atgagtggaaatacac

SEQ ID NO: 5265393 - DNA, 18 bp, Homo sapiens
atgagtggatggatggac

SEQ ID NO: 5265394 - DNA, 13 bp, Homo sapiens
atgagtggccagc

SEQ ID NO: 5265395 - DNA, 19 bp, Homo sapiens
atgagtggccagcgccagg

SEQ ID NO: 5265396 - DNA, 22 bp, Homo sapiens
atgagtggccagcgccagggcc

SEQ ID NO: 5265397 - DNA, 17 bp, Homo sapiens
atgagtggctttaatga

SEQ ID NO: 5265398 - DNA, 20 bp, Homo sapiens
atgagtgtaacaagaaagga

SEQ ID NO: 5265399 - DNA, 21 bp, Homo sapiens
atgagtgtaacaagaaaggag

SEQ ID NO: 5265400 - DNA, 22 bp, Homo sapiens
atgagtgtaacaagaaaggaga

SEQ ID NO: 5265401 - DNA, 13 bp, Homo sapiens
atgagtgtctgga

SEQ ID NO: 5265402 - DNA, 19 bp, Homo sapiens
atgagtgtctggagcgctt

SEQ ID NO: 5265403 - DNA, 22 bp, Homo sapiens
atgagtgtctgtgagaggcagc

SEQ ID NO: 5265404 - DNA, 23 bp, Homo sapiens
atgagtgtgatccagtttttcat

SEQ ID NO: 5265405 - DNA, 19 bp, Homo sapiens
atgagttaaataaaacatt

SEQ ID NO: 5265406 - DNA, 22 bp, Homo sapiens
atgagttaactgtgaaatacca

SEQ ID NO: 5265407 - DNA, 17 bp, Homo sapiens
atgagttaattgtttta

SEQ ID NO: 5265408 - DNA, 23 bp, Homo sapiens
atgagttagaataataaatattt

SEQ ID NO: 5265409 - DNA, 20 bp, Homo sapiens
atgagttattatctatggaa

SEQ ID NO: 5265410 - DNA, 16 bp, Homo sapiens
atgagttattcataaa

SEQ ID NO: 5265411 - DNA, 20 bp, Homo sapiens
atgagttattggattagacc

SEQ ID NO: 5265412 - DNA, 21 bp, Homo sapiens
atgagttcacatgtgccctgc

SEQ ID NO: 5265413 - DNA, 18 bp, Homo sapiens
atgagttccagaaagtaa

SEQ ID NO: 5265414 - DNA, 20 bp, Homo sapiens
atgagttctgcacatacaga

SEQ ID NO: 5265415 - DNA, 13 bp, Homo sapiens
atgagttgcagtt

SEQ ID NO: 5265416 - DNA, 23 bp, Homo sapiens
atgagttgcagtttttataatag

SEQ ID NO: 5265417 - DNA, 21 bp, Homo sapiens
atgagttgcatttgtaaaaat

SEQ ID NO: 5265418 - DNA, 17 bp, Homo sapiens
atgagttggacttcagt

SEQ ID NO: 5265419 - DNA, 20 bp, Homo sapiens
atgagttgtcagctttgact

SEQ ID NO: 5265420 - DNA, 20 bp, Homo sapiens
atgagttgtgatgaatcaat

SEQ ID NO: 5265421 - DNA, 22 bp, Homo sapiens
atgagttgttttcagactcaga

SEQ ID NO: 5265422 - DNA, 13 bp, Homo sapiens
atgagtttcacag

SEQ ID NO: 5265423 - DNA, 13 bp, Homo sapiens
atgagtttcactg

SEQ ID NO: 5265424 - DNA, 16 bp, Homo sapiens
atgagtttcactgtac

SEQ ID NO: 5265425 - DNA, 18 bp, Homo sapiens
atgagtttcactgtactg

SEQ ID NO: 5265426 - DNA, 15 bp, Homo sapiens
atgagtttcatagct

SEQ ID NO: 5265427 - DNA, 20 bp, Homo sapiens
atgagtttcatagctaagaa

SEQ ID NO: 5265428 - DNA, 20 bp, Homo sapiens
atgagtttccagctaagcct

SEQ ID NO: 5265429 - DNA, 13 bp, Homo sapiens
atgagtttctggg

SEQ ID NO: 5265430 - DNA, 19 bp, Homo sapiens
atgagttttgggaagttaa

SEQ ID NO: 5265431 - DNA, 15 bp, Homo sapiens
atgagtttttaaatg

SEQ ID NO: 5265432 - DNA, 12 bp, Homo sapiens
atgagtttttat

SEQ ID NO: 5265433 - DNA, 17 bp, Homo sapiens
atgataaaaagaaatgt

SEQ ID NO: 5265434 - DNA, 18 bp, Homo sapiens
atgataaaaggaagtaga

SEQ ID NO: 5265435 - DNA, 17 bp, Homo sapiens
atgataaaataagtaac

SEQ ID NO: 5265436 - DNA, 15 bp, Homo sapiens
atgataaactcagat

SEQ ID NO: 5265437 - DNA, 20 bp, Homo sapiens
atgataaactcagatctgat

SEQ ID NO: 5265438 - DNA, 22 bp, Homo sapiens
atgataaactcagatctgatca

SEQ ID NO: 5265439 - DNA, 13 bp, Homo sapiens
atgataaagactt

SEQ ID NO: 5265440 - DNA, 14 bp, Homo sapiens
atgataaagacttt

SEQ ID NO: 5265441 - DNA, 17 bp, Homo sapiens
atgataaagagacagtg

SEQ ID NO: 5265442 - DNA, 14 bp, Homo sapiens
atgataaagatgtc

SEQ ID NO: 5265443 - DNA, 18 bp, Homo sapiens
atgataaagatgtcaaat

SEQ ID NO: 5265444 - DNA, 18 bp, Homo sapiens
atgataaatatttatgct

SEQ ID NO: 5265445 - DNA, 20 bp, Homo sapiens
atgataacaccagtgggaat

SEQ ID NO: 5265446 - DNA, 20 bp, Homo sapiens
atgataactactgacgaaag

SEQ ID NO: 5265447 - DNA, 13 bp, Homo sapiens
atgataagacatt

SEQ ID NO: 5265448 - DNA, 15 bp, Homo sapiens
atgataagacatttt

SEQ ID NO: 5265449 - DNA, 17 bp, Homo sapiens
atgataagattgaaatt

SEQ ID NO: 5265450 - DNA, 18 bp, Homo sapiens
atgataagccgaggaggc

SEQ ID NO: 5265451 - DNA, 13 bp, Homo sapiens
atgataaggttta

SEQ ID NO: 5265452 - DNA, 16 bp, Homo sapiens
atgataaggtttagaa

SEQ ID NO: 5265453 - DNA, 13 bp, Homo sapiens
atgataataataa

SEQ ID NO: 5265454 - DNA, 15 bp, Homo sapiens
atgataataggtcat

SEQ ID NO: 5265455 - DNA, 16 bp, Homo sapiens
atgataataggtcata

SEQ ID NO: 5265456 - DNA, 18 bp, Homo sapiens
atgataatcatcaggttt

SEQ ID NO: 5265457 - DNA, 15 bp, Homo sapiens
atgatacagtcagga

SEQ ID NO: 5265458 - DNA, 16 bp, Homo sapiens
atgatacagtgttaaa

SEQ ID NO: 5265459 - DNA, 22 bp, Homo sapiens
atgatacagtgttttttaggaa

SEQ ID NO: 5265460 - DNA, 13 bp, Homo sapiens
atgatacattttt

SEQ ID NO: 5265461 - DNA, 17 bp, Homo sapiens
atgataccacctttact

SEQ ID NO: 5265462 - DNA, 20 bp, Homo sapiens
atgataccagcagcaactga

SEQ ID NO: 5265463 - DNA, 21 bp, Homo sapiens
atgataccagcagcaactgaa

SEQ ID NO: 5265464 - DNA, 23 bp, Homo sapiens
atgataccagcagcaactgaaaa

SEQ ID NO: 5265465 - DNA, 16 bp, Homo sapiens
atgatacccaacagtt

SEQ ID NO: 5265466 - DNA, 23 bp, Homo sapiens
atgatacgcttaaggtggaaagt

SEQ ID NO: 5265467 - DNA, 19 bp, Homo sapiens
atgatactaataaactaat

SEQ ID NO: 5265468 - DNA, 21 bp, Homo sapiens
atgatactatcatactactga

SEQ ID NO: 5265469 - DNA, 17 bp, Homo sapiens
atgatactgattatgaa

SEQ ID NO: 5265470 - DNA, 22 bp, Homo sapiens
atgatactgtctaagaataatg

SEQ ID NO: 5265471 - DNA, 14 bp, Homo sapiens
atgatactgtctct

SEQ ID NO: 5265472 - DNA, 17 bp, Homo sapiens
atgatactgtctctcca

SEQ ID NO: 5265473 - DNA, 12 bp, Homo sapiens
atgatactgtgt

SEQ ID NO: 5265474 - DNA, 22 bp, Homo sapiens
atgatacttacaagtttctagc

SEQ ID NO: 5265475 - DNA, 20 bp, Homo sapiens
atgatagaaagaataaaatg

SEQ ID NO: 5265476 - DNA, 17 bp, Homo sapiens
atgatagatttgacctc

SEQ ID NO: 5265477 - DNA, 14 bp, Homo sapiens
atgatagcccagaa

SEQ ID NO: 5265478 - DNA, 17 bp, Homo sapiens
atgataggttaataaag

SEQ ID NO: 5265479 - DNA, 19 bp, Homo sapiens
atgatagtaataggataca

SEQ ID NO: 5265480 - DNA, 15 bp, Homo sapiens
atgatagtccaattt

SEQ ID NO: 5265481 - DNA, 14 bp, Homo sapiens
atgatagtgtgatt

SEQ ID NO: 5265482 - DNA, 16 bp, Homo sapiens
atgatagtgtgatttt

SEQ ID NO: 5265483 - DNA, 19 bp, Homo sapiens
atgatataggaaaatacat

SEQ ID NO: 5265484 - DNA, 22 bp, Homo sapiens
atgatataggaaaatacattgt

SEQ ID NO: 5265485 - DNA, 23 bp, Homo sapiens
atgatatataaaccttaaatgaa

SEQ ID NO: 5265486 - DNA, 18 bp, Homo sapiens
atgatatatttatatcat

SEQ ID NO: 5265487 - DNA, 14 bp, Homo sapiens
atgatatccctgat

SEQ ID NO: 5265488 - DNA, 19 bp, Homo sapiens
atgatatctatattctaaa

SEQ ID NO: 5265489 - DNA, 23 bp, Homo sapiens
atgatatctatattctaaagagc

SEQ ID NO: 5265490 - DNA, 15 bp, Homo sapiens
atgatatgtctttaa

SEQ ID NO: 5265491 - DNA, 21 bp, Homo sapiens
atgatatgtgcttgtgtgtat

SEQ ID NO: 5265492 - DNA, 20 bp, Homo sapiens
atgatattcaatcttaacaa

SEQ ID NO: 5265493 - DNA, 14 bp, Homo sapiens
atgatattccatag

SEQ ID NO: 5265494 - DNA, 22 bp, Homo sapiens
atgatattccccatttcctgta

SEQ ID NO: 5265495 - DNA, 18 bp, Homo sapiens
atgatattgtatgtacct

SEQ ID NO: 5265496 - DNA, 18 bp, Homo sapiens
atgatattgtttaaaatt

SEQ ID NO: 5265497 - DNA, 12 bp, Homo sapiens
atgatatttctt

SEQ ID NO: 5265498 - DNA, 18 bp, Homo sapiens
atgatcaaaaactgcctt

SEQ ID NO: 5265499 - DNA, 15 bp, Homo sapiens
atgatcaaagttttg

SEQ ID NO: 5265500 - DNA, 19 bp, Homo sapiens
atgatcaaatgtttaatca

SEQ ID NO: 5265501 - DNA, 23 bp, Homo sapiens
atgatcaaggagtgaagtaattg

SEQ ID NO: 5265502 - DNA, 13 bp, Homo sapiens
atgatcaataaag

SEQ ID NO: 5265503 - DNA, 20 bp, Homo sapiens
atgatcaattatagtttctg

SEQ ID NO: 5265504 - DNA, 19 bp, Homo sapiens
atgatcacaactgagatca

SEQ ID NO: 5265505 - DNA, 15 bp, Homo sapiens
atgatcacatctaaa

SEQ ID NO: 5265506 - DNA, 18 bp, Homo sapiens
atgatcacatctaaagct

SEQ ID NO: 5265507 - DNA, 19 bp, Homo sapiens
atgatcacatctaaagctt

SEQ ID NO: 5265508 - DNA, 14 bp, Homo sapiens
atgatcacatggaa

SEQ ID NO: 5265509 - DNA, 18 bp, Homo sapiens
atgatcaccgactgaaaa

SEQ ID NO: 5265510 - DNA, 22 bp, Homo sapiens
atgatcactaatactaattcat

SEQ ID NO: 5265511 - DNA, 22 bp, Homo sapiens
atgatcagaagaacatgatttt

SEQ ID NO: 5265512 - DNA, 16 bp, Homo sapiens
atgatcagacatacag

SEQ ID NO: 5265513 - DNA, 18 bp, Homo sapiens
atgatcagacatacagct

SEQ ID NO: 5265514 - DNA, 21 bp, Homo sapiens
atgatcagcatctgtgatggg

SEQ ID NO: 5265515 - DNA, 18 bp, Homo sapiens
atgttcaaagactgtgaa

SEQ ID NO: 5265516 - DNA, 18 bp, Homo sapiens
atgttcaaagccacatta

SEQ ID NO: 5265517 - DNA, 21 bp, Homo sapiens
atgttcaacttaatgaagaaa

SEQ ID NO: 5265518 - DNA, 19 bp, Homo sapiens
atgttcaagtattgttaat

SEQ ID NO: 5265519 - DNA, 23 bp, Homo sapiens
atgttcaatagaacatgcaagaa

SEQ ID NO: 5265520 - DNA, 16 bp, Homo sapiens
atgttcaatatttgta

SEQ ID NO: 5265521 - DNA, 12 bp, Homo sapiens
atgttcaattat

SEQ ID NO: 5265522 - DNA, 14 bp, Homo sapiens
atgttcacattttt

SEQ ID NO: 5265523 - DNA, 21 bp, Homo sapiens
atgttcacttcgaaattctga

SEQ ID NO: 5265524 - DNA, 14 bp, Homo sapiens
atgttcacttttga

SEQ ID NO: 5265525 - DNA, 20 bp, Homo sapiens
atgttcacttttgacaaagg

SEQ ID NO: 5265526 - DNA, 22 bp, Homo sapiens
atgttcacttttgacaaaggca

SEQ ID NO: 5265527 - DNA, 19 bp, Homo sapiens
atgttcagaaaagaagtga

SEQ ID NO: 5265528 - DNA, 22 bp, Homo sapiens
atgttcagaaatgtaaatgtta

SEQ ID NO: 5265529 - DNA, 23 bp, Homo sapiens
atgttcagaacttcatctgccac

SEQ ID NO: 5265530 - DNA, 20 bp, Homo sapiens
atgttcagaattttggaaaa

SEQ ID NO: 5265531 - DNA, 21 bp, Homo sapiens
atgttcagacatttatgtgtt

SEQ ID NO: 5265532 - DNA, 16 bp, Homo sapiens
atgttcagagtggctc

SEQ ID NO: 5265533 - DNA, 22 bp, Homo sapiens
atgttcagagtggctcactggc

SEQ ID NO: 5265534 - DNA, 19 bp, Homo sapiens
atgttcagcactgtccctt

SEQ ID NO: 5265535 - DNA, 18 bp, Homo sapiens
atgttcagcttataatga

SEQ ID NO: 5265536 - DNA, 19 bp, Homo sapiens
atgttcagtcacatgtgct

SEQ ID NO: 5265537 - DNA, 19 bp, Homo sapiens
atgttcatcaatgaatgaa

SEQ ID NO: 5265538 - DNA, 15 bp, Homo sapiens
atgttcatgatagaa

SEQ ID NO: 5265539 - DNA, 16 bp, Homo sapiens
atgttcatgatagaaa

SEQ ID NO: 5265540 - DNA, 19 bp, Homo sapiens
atgttcatgatagaaagaa

SEQ ID NO: 5265541 - DNA, 20 bp, Homo sapiens
atgttcatgatagaaagaat

SEQ ID NO: 5265542 - DNA, 17 bp, Homo sapiens
atgttcatgatttcaag

SEQ ID NO: 5265543 - DNA, 13 bp, Homo sapiens
atgttcattataa

SEQ ID NO: 5265544 - DNA, 20 bp, Homo sapiens
atgttcattataatctcaaa

SEQ ID NO: 5265545 - DNA, 22 bp, Homo sapiens
atgttcattgtaatgttactga

SEQ ID NO: 5265546 - DNA, 15 bp, Homo sapiens
atgttcattgtagat

SEQ ID NO: 5265547 - DNA, 23 bp, Homo sapiens
atgttcattgtagattttgttat

SEQ ID NO: 5265548 - DNA, 18 bp, Homo sapiens
atgttcatttgtttgttt

SEQ ID NO: 5265549 - DNA, 11 bp, Homo sapiens
atgttcatttt

SEQ ID NO: 5265550 - DNA, 12 bp, Homo sapiens
atgttcattttt

SEQ ID NO: 5265551 - DNA, 21 bp, Homo sapiens
atgttcatttttaaagcctgg

SEQ ID NO: 5265552 - DNA, 20 bp, Homo sapiens
atgttccaaaccctcctggg

SEQ ID NO: 5265553 - DNA, 16 bp, Homo sapiens
atgttccaataaacag

SEQ ID NO: 5265554 - DNA, 15 bp, Homo sapiens
atgttccactaaccc

SEQ ID NO: 5265555 - DNA, 15 bp, Homo sapiens
atgttccagcttcta

SEQ ID NO: 5265556 - DNA, 15 bp, Homo sapiens
atgttccatgcctgg

SEQ ID NO: 5265557 - DNA, 16 bp, Homo sapiens
atgttccatgcctggc

SEQ ID NO: 5265558 - DNA, 19 bp, Homo sapiens
atgttccatgcctggccct

SEQ ID NO: 5265559 - DNA, 13 bp, Homo sapiens
atgttcccagctc

SEQ ID NO: 5265560 - DNA, 15 bp, Homo sapiens
atgttcccagctcag

SEQ ID NO: 5265561 - DNA, 17 bp, Homo sapiens
atgttccccagttcagt

SEQ ID NO: 5265562 - DNA, 11 bp, Homo sapiens
atgttccctct

SEQ ID NO: 5265563 - DNA, 19 bp, Homo sapiens
atgttccctcttgtccctt

SEQ ID NO: 5265564 - DNA, 13 bp, Homo sapiens
atgttccctgcac

SEQ ID NO: 5265565 - DNA, 14 bp, Homo sapiens
atgttcccttctcc

SEQ ID NO: 5265566 - DNA, 15 bp, Homo sapiens
atgttcccttgacca

SEQ ID NO: 5265567 - DNA, 23 bp, Homo sapiens
atgttcccttgaccattggctgc

SEQ ID NO: 5265568 - DNA, 15 bp, Homo sapiens
atgttccctttaaaa

SEQ ID NO: 5265569 - DNA, 22 bp, Homo sapiens
atgttccggcgtttatttctgc

SEQ ID NO: 5265570 - DNA, 19 bp, Homo sapiens
atgttcctaacaaaatgag

SEQ ID NO: 5265571 - DNA, 20 bp, Homo sapiens
atgttcctaaggtcatttct

SEQ ID NO: 5265572 - DNA, 17 bp, Homo sapiens
atgttcctagtgaaaga

SEQ ID NO: 5265573 - DNA, 21 bp, Homo sapiens
atgttcctcaaagcttggatt

SEQ ID NO: 5265574 - DNA, 16 bp, Homo sapiens
atgttcctgctaataa

SEQ ID NO: 5265575 - DNA, 23 bp, Homo sapiens
atgttcctgctaataatttgcca

SEQ ID NO: 5265576 - DNA, 12 bp, Homo sapiens
atgttcctgctg

SEQ ID NO: 5265577 - DNA, 14 bp, Homo sapiens
atgttcctgctgta

SEQ ID NO: 5265578 - DNA, 18 bp, Homo sapiens
atgttcctgctgtatttc

SEQ ID NO: 5265579 - DNA, 11 bp, Homo sapiens
atgttccttcc

SEQ ID NO: 5265580 - DNA, 15 bp, Homo sapiens
atgttcctttgtaat

SEQ ID NO: 5265581 - DNA, 14 bp, Homo sapiens
atgttccttttgaa

SEQ ID NO: 5265582 - DNA, 13 bp, Homo sapiens
atgttcctttttt

SEQ ID NO: 5265583 - DNA, 18 bp, Homo sapiens
atgttccttttttgtata

SEQ ID NO: 5265584 - DNA, 23 bp, Homo sapiens
atgttcggtttttttcctgtttc

SEQ ID NO: 5265585 - DNA, 18 bp, Homo sapiens
atgttctaaaattattat

SEQ ID NO: 5265586 - DNA, 15 bp, Homo sapiens
atgttctaaattcta

SEQ ID NO: 5265587 - DNA, 16 bp, Homo sapiens
atgttctaaattctat

SEQ ID NO: 5265588 - DNA, 22 bp, Homo sapiens
atgttctaaattctataaaaac

SEQ ID NO: 5265589 - DNA, 17 bp, Homo sapiens
atgttctaacagcatct

SEQ ID NO: 5265590 - DNA, 13 bp, Homo sapiens
atgttctaaggct

SEQ ID NO: 5265591 - DNA, 22 bp, Homo sapiens
atgttctaaggctctgagagtc

SEQ ID NO: 5265592 - DNA, 18 bp, Homo sapiens
atgttctaagtctttcca

SEQ ID NO: 5265593 - DNA, 19 bp, Homo sapiens
atgttctaagtctttccat

SEQ ID NO: 5265594 - DNA, 20 bp, Homo sapiens
atgttctaagtttctaagat

SEQ ID NO: 5265595 - DNA, 23 bp, Homo sapiens
atgttctaagtttctaagattct

SEQ ID NO: 5265596 - DNA, 16 bp, Homo sapiens
atgttctaatactttg

SEQ ID NO: 5265597 - DNA, 23 bp, Homo sapiens
atgttctaggatagttgatgcat

SEQ ID NO: 5265598 - DNA, 18 bp, Homo sapiens
atgttctatataattttt

SEQ ID NO: 5265599 - DNA, 19 bp, Homo sapiens
atgttctatataatttttc

SEQ ID NO: 5265600 - DNA, 18 bp, Homo sapiens
atgttctattaatcacct

SEQ ID NO: 5265601 - DNA, 17 bp, Homo sapiens
atgttctcagaatcagg

SEQ ID NO: 5265602 - DNA, 17 bp, Homo sapiens
atgttctcatgaactac

SEQ ID NO: 5265603 - DNA, 20 bp, Homo sapiens
atgttctccagtcattatgt

SEQ ID NO: 5265604 - DNA, 15 bp, Homo sapiens
atgttctccatccca

SEQ ID NO: 5265605 - DNA, 18 bp, Homo sapiens
atgttctctatcatttaa

SEQ ID NO: 5265606 - DNA, 12 bp, Homo sapiens
atgttctctgaa

SEQ ID NO: 5265607 - DNA, 15 bp, Homo sapiens
atgttctcttcccag

SEQ ID NO: 5265608 - DNA, 18 bp, Homo sapiens
atgttctcttcccaggcc

SEQ ID NO: 5265609 - DNA, 20 bp, Homo sapiens
atgttctcttcccaggcctt

SEQ ID NO: 5265610 - DNA, 16 bp, Homo sapiens
atgttctgaataattt

SEQ ID NO: 5265611 - DNA, 14 bp, Homo sapiens
atgttctgacatta

SEQ ID NO: 5265612 - DNA, 15 bp, Homo sapiens
atgttctgacattaa

SEQ ID NO: 5265613 - DNA, 17 bp, Homo sapiens
atgttctgcaagaatta

SEQ ID NO: 5265614 - DNA, 20 bp, Homo sapiens
atgttctgcaagaattaaaa

SEQ ID NO: 5265615 - DNA, 22 bp, Homo sapiens
atgttctgcaagaattaaaact

SEQ ID NO: 5265616 - DNA, 16 bp, Homo sapiens
atgttctgcccccagc

SEQ ID NO: 5265617 - DNA, 20 bp, Homo sapiens
atgttctgcccccagcccaa

SEQ ID NO: 5265618 - DNA, 12 bp, Homo sapiens
atgttctgcctc

SEQ ID NO: 5265619 - DNA, 15 bp, Homo sapiens
atgttctgggacaca

SEQ ID NO: 5265620 - DNA, 22 bp, Homo sapiens
atgttctgggtgatggaaactg

SEQ ID NO: 5265621 - DNA, 22 bp, Homo sapiens
atgttctggtatgcattcttta

SEQ ID NO: 5265622 - DNA, 18 bp, Homo sapiens
atgttctgtcacgtgaaa

SEQ ID NO: 5265623 - DNA, 13 bp, Homo sapiens
atgttctgtccct

SEQ ID NO: 5265624 - DNA, 14 bp, Homo sapiens
atgttctgtccctt

SEQ ID NO: 5265625 - DNA, 23 bp, Homo sapiens
atgttctgtcttcccaaacccag

SEQ ID NO: 5265626 - DNA, 16 bp, Homo sapiens
atgttctgtgactgaa

SEQ ID NO: 5265627 - DNA, 18 bp, Homo sapiens
atgttctgtgatacagaa

SEQ ID NO: 5265628 - DNA, 23 bp, Homo sapiens
atgttctgtgtcacgtgaccctg

SEQ ID NO: 5265629 - DNA, 20 bp, Homo sapiens
atgttcttagtggatgttct

SEQ ID NO: 5265630 - DNA, 18 bp, Homo sapiens
atgttcttatagaataaa

SEQ ID NO: 5265631 - DNA, 20 bp, Homo sapiens
atgttcttatagaataaaag

SEQ ID NO: 5265632 - DNA, 20 bp, Homo sapiens
atgttcttatgcaaaatgga

SEQ ID NO: 5265633 - DNA, 19 bp, Homo sapiens
atgttcttccagcttcaat

SEQ ID NO: 5265634 - DNA, 14 bp, Homo sapiens
atgttcttccagtt

SEQ ID NO: 5265635 - DNA, 18 bp, Homo sapiens
atgttcttgagcagctga

SEQ ID NO: 5265636 - DNA, 19 bp, Homo sapiens
atgttcttgcagtcatcag

SEQ ID NO: 5265637 - DNA, 17 bp, Homo sapiens
atgttcttggaacatgg

SEQ ID NO: 5265638 - DNA, 19 bp, Homo sapiens
atgttcttggtgtttgact

SEQ ID NO: 5265639 - DNA, 22 bp, Homo sapiens
atgttctttagatggtggcaca

SEQ ID NO: 5265640 - DNA, 11 bp, Homo sapiens
atgttctttat

SEQ ID NO: 5265641 - DNA, 16 bp, Homo sapiens
atgttctttatataca

SEQ ID NO: 5265642 - DNA, 20 bp, Homo sapiens
atgttctttcacccatccta

SEQ ID NO: 5265643 - DNA, 23 bp, Homo sapiens
atgttctttccatgaatcattgt

SEQ ID NO: 5265644 - DNA, 22 bp, Homo sapiens
atgttctttcctttcatcctca

SEQ ID NO: 5265645 - DNA, 23 bp, Homo sapiens
atgttctttcctttcatcctcag

SEQ ID NO: 5265646 - DNA, 11 bp, Homo sapiens
atgttctttct

SEQ ID NO: 5265647 - DNA, 13 bp, Homo sapiens
atgttctttggaa

SEQ ID NO: 5265648 - DNA, 18 bp, Homo sapiens
atgttcttttctatttat

SEQ ID NO: 5265649 - DNA, 19 bp, Homo sapiens
atgttgaaaagtcaaactg

SEQ ID NO: 5265650 - DNA, 23 bp, Homo sapiens
atgttgaaactgcttgagcatca

SEQ ID NO: 5265651 - DNA, 18 bp, Homo sapiens
atgttgaaagatcaaaag

SEQ ID NO: 5265652 - DNA, 12 bp, Homo sapiens
atgttgaacttt

SEQ ID NO: 5265653 - DNA, 14 bp, Homo sapiens
atgttgaacttttt

SEQ ID NO: 5265654 - DNA, 16 bp, Homo sapiens
atgttgaagaaaaaag

SEQ ID NO: 5265655 - DNA, 15 bp, Homo sapiens
atgttgaagcctttg

SEQ ID NO: 5265656 - DNA, 16 bp, Homo sapiens
atgttgaagcctttgt

SEQ ID NO: 5265657 - DNA, 22 bp, Homo sapiens
atgttgaatgtatctagtggtc

SEQ ID NO: 5265658 - DNA, 14 bp, Homo sapiens
atgttgaattcttt

SEQ ID NO: 5265659 - DNA, 21 bp, Homo sapiens
atgttgacatcactggcatgg

SEQ ID NO: 5265660 - DNA, 13 bp, Homo sapiens
atgttgacatttg

SEQ ID NO: 5265661 - DNA, 14 bp, Homo sapiens
atgttgacatttgt

SEQ ID NO: 5265662 - DNA, 18 bp, Homo sapiens
atgttgagccaggcctgg

SEQ ID NO: 5265663 - DNA, 13 bp, Homo sapiens
atgttgaggtgga

SEQ ID NO: 5265664 - DNA, 23 bp, Homo sapiens
atgttgataaaccaaaaacattt

SEQ ID NO: 5265665 - DNA, 17 bp, Homo sapiens
atgttgataatagtaat

SEQ ID NO: 5265666 - DNA, 17 bp, Homo sapiens
atgttgataatttcagg

SEQ ID NO: 5265667 - DNA, 19 bp, Homo sapiens
atgttgatcagcaaattta

SEQ ID NO: 5265668 - DNA, 16 bp, Homo sapiens
atgttgatcgatgtta

SEQ ID NO: 5265669 - DNA, 14 bp, Homo sapiens
atgttgatctgcat

SEQ ID NO: 5265670 - DNA, 12 bp, Homo sapiens
atgttgatgaaa

SEQ ID NO: 5265671 - DNA, 22 bp, Homo sapiens
atgttgatgactcgaaactgac

SEQ ID NO: 5265672 - DNA, 15 bp, Homo sapiens
atgttgatttctagt

SEQ ID NO: 5265673 - DNA, 23 bp, Homo sapiens
atgttgatttttactgtgtttta

SEQ ID NO: 5265674 - DNA, 12 bp, Homo sapiens
atgttgcaaagg

SEQ ID NO: 5265675 - DNA, 21 bp, Homo sapiens
atgttgcacacccactcagct

SEQ ID NO: 5265676 - DNA, 22 bp, Homo sapiens
atgttgcacacccactcagctc

SEQ ID NO: 5265677 - DNA, 20 bp, Homo sapiens
atgttgcacatcattcattc

SEQ ID NO: 5265678 - DNA, 17 bp, Homo sapiens
atgttgcatagaataaa

SEQ ID NO: 5265679 - DNA, 18 bp, Homo sapiens
atgttgcatagaataaaa

SEQ ID NO: 5265680 - DNA, 17 bp, Homo sapiens
atgttgcatgaatccat

SEQ ID NO: 5265681 - DNA, 18 bp, Homo sapiens
atgttgccatgaggcctt

SEQ ID NO: 5265682 - DNA, 16 bp, Homo sapiens
atgttgccatgtgttt

SEQ ID NO: 5265683 - DNA, 18 bp, Homo sapiens
atgttgccatgtgtttta

SEQ ID NO: 5265684 - DNA, 13 bp, Homo sapiens
atgttgcccaagc

SEQ ID NO: 5265685 - DNA, 12 bp, Homo sapiens
atgttgcccagg

SEQ ID NO: 5265686 - DNA, 15 bp, Homo sapiens
atgttgcccaggcag

SEQ ID NO: 5265687 - DNA, 15 bp, Homo sapiens
atgttgcccaggttg

SEQ ID NO: 5265688 - DNA, 20 bp, Homo sapiens
atgttgccctgttgctgcct

SEQ ID NO: 5265689 - DNA, 19 bp, Homo sapiens
atgttgctagttttttgct

SEQ ID NO: 5265690 - DNA, 19 bp, Homo sapiens
atgttgctataagaaaagt

SEQ ID NO: 5265691 - DNA, 15 bp, Homo sapiens
atgttgctatagtga

SEQ ID NO: 5265692 - DNA, 19 bp, Homo sapiens
atgttgctatagtgacatg

SEQ ID NO: 5265693 - DNA, 16 bp, Homo sapiens
atgatcagggatccaa

SEQ ID NO: 5265694 - DNA, 13 bp, Homo sapiens
atgatcagtgttg

SEQ ID NO: 5265695 - DNA, 15 bp, Homo sapiens
atgatcagttttttt

SEQ ID NO: 5265696 - DNA, 22 bp, Homo sapiens
atgatcatctgtaatctgaggg

SEQ ID NO: 5265697 - DNA, 21 bp, Homo sapiens
atgatcatgtaaatgattatc

SEQ ID NO: 5265698 - DNA, 22 bp, Homo sapiens
atgatcatgtaaatgattatct

SEQ ID NO: 5265699 - DNA, 18 bp, Homo sapiens
atgatcattgaaatactt

SEQ ID NO: 5265700 - DNA, 21 bp, Homo sapiens
atgatccaactaatgccttac

SEQ ID NO: 5265701 - DNA, 22 bp, Homo sapiens
atgatccacccacctcagcctc

SEQ ID NO: 5265702 - DNA, 12 bp, Homo sapiens
atgatccagaac

SEQ ID NO: 5265703 - DNA, 16 bp, Homo sapiens
atgatccagaacagtg

SEQ ID NO: 5265704 - DNA, 14 bp, Homo sapiens
atgatccagagcag

SEQ ID NO: 5265705 - DNA, 10 bp, Homo sapiens
atgatccagc

SEQ ID NO: 5265706 - DNA, 15 bp, Homo sapiens
atgatccagggattg

SEQ ID NO: 5265707 - DNA, 24 bp, Homo sapiens
atgatccatttgaacagttggctg

SEQ ID NO: 5265708 - DNA, 19 bp, Homo sapiens
atgatccccgtctctgccc

SEQ ID NO: 5265709 - DNA, 20 bp, Homo sapiens
atgatccctgaacatagttt

SEQ ID NO: 5265710 - DNA, 23 bp, Homo sapiens
atgatccctgaacatagttttca

SEQ ID NO: 5265711 - DNA, 18 bp, Homo sapiens
atgatccctgtgttgtct

SEQ ID NO: 5265712 - DNA, 14 bp, Homo sapiens
atgatcccttcccc

SEQ ID NO: 5265713 - DNA, 15 bp, Homo sapiens
atgatcccttccccc

SEQ ID NO: 5265714 - DNA, 22 bp, Homo sapiens
atgatcccttccccctgctgat

SEQ ID NO: 5265715 - DNA, 15 bp, Homo sapiens
atgatcctaatgaat

SEQ ID NO: 5265716 - DNA, 13 bp, Homo sapiens
atgatcctcaagg

SEQ ID NO: 5265717 - DNA, 13 bp, Homo sapiens
atgatcctcagtg

SEQ ID NO: 5265718 - DNA, 14 bp, Homo sapiens
atgatcctcagtgc

SEQ ID NO: 5265719 - DNA, 13 bp, Homo sapiens
atgatcctcccac

SEQ ID NO: 5265720 - DNA, 11 bp, Homo sapiens
atgatcctgaa

SEQ ID NO: 5265721 - DNA, 22 bp, Homo sapiens
atgatcctggaaattgcagtaa

SEQ ID NO: 5265722 - DNA, 20 bp, Homo sapiens
atgatcctgtattcagacag

SEQ ID NO: 5265723 - DNA, 16 bp, Homo sapiens
atgatccttgcacaga

SEQ ID NO: 5265724 - DNA, 22 bp, Homo sapiens
atgatcgaaaaaataattattt

SEQ ID NO: 5265725 - DNA, 20 bp, Homo sapiens
atgatcgttctgggtcagct

SEQ ID NO: 5265726 - DNA, 23 bp, Homo sapiens
atgatctaagaaatcatgtgcat

SEQ ID NO: 5265727 - DNA, 19 bp, Homo sapiens
atgatctaagaagctacag

SEQ ID NO: 5265728 - DNA, 18 bp, Homo sapiens
atgatctactcagaaatt

SEQ ID NO: 5265729 - DNA, 16 bp, Homo sapiens
atgatctactcatttg

SEQ ID NO: 5265730 - DNA, 16 bp, Homo sapiens
atgatctaggtttaac

SEQ ID NO: 5265731 - DNA, 21 bp, Homo sapiens
atgatctaggtttaactcaga

SEQ ID NO: 5265732 - DNA, 12 bp, Homo sapiens
atgatctattgc

SEQ ID NO: 5265733 - DNA, 13 bp, Homo sapiens
atgatctatttgt

SEQ ID NO: 5265734 - DNA, 14 bp, Homo sapiens
atgatctatttgta

SEQ ID NO: 5265735 - DNA, 12 bp, Homo sapiens
atgatctcagga

SEQ ID NO: 5265736 - DNA, 19 bp, Homo sapiens
atgatctcggatgaccaaa

SEQ ID NO: 5265737 - DNA, 22 bp, Homo sapiens
atgatctcggatgaccaaacca

SEQ ID NO: 5265738 - DNA, 23 bp, Homo sapiens
atgatctcggatgaccaaaccag

SEQ ID NO: 5265739 - DNA, 15 bp, Homo sapiens
atgatctctctagct

SEQ ID NO: 5265740 - DNA, 17 bp, Homo sapiens
atgatctctctagcttt

SEQ ID NO: 5265741 - DNA, 18 bp, Homo sapiens
atgatctctctagctttg

SEQ ID NO: 5265742 - DNA, 14 bp, Homo sapiens
atgatctctctgaa

SEQ ID NO: 5265743 - DNA, 14 bp, Homo sapiens
atgatctctgatga

SEQ ID NO: 5265744 - DNA, 14 bp, Homo sapiens
atgatctgaaaaat

SEQ ID NO: 5265745 - DNA, 22 bp, Homo sapiens
atgatctgactttaattgtgtg

SEQ ID NO: 5265746 - DNA, 21 bp, Homo sapiens
atgatctgagtcccaggagct

SEQ ID NO: 5265747 - DNA, 17 bp, Homo sapiens
atgatctgcaggggtct

SEQ ID NO: 5265748 - DNA, 19 bp, Homo sapiens
atgatctgtgcctttttta

SEQ ID NO: 5265749 - DNA, 13 bp, Homo sapiens
atgatctgtggag

SEQ ID NO: 5265750 - DNA, 17 bp, Homo sapiens
atgatcttacacgaaga

SEQ ID NO: 5265751 - DNA, 14 bp, Homo sapiens
atgatcttctttat

SEQ ID NO: 5265752 - DNA, 22 bp, Homo sapiens
atgatcttgagatttcttttaa

SEQ ID NO: 5265753 - DNA, 23 bp, Homo sapiens
atgatcttgagtataagaaatgc

SEQ ID NO: 5265754 - DNA, 17 bp, Homo sapiens
atgatcttgttaatgca

SEQ ID NO: 5265755 - DNA, 20 bp, Homo sapiens
atgatcttgttactgtgata

SEQ ID NO: 5265756 - DNA, 15 bp, Homo sapiens
atgatcttttcaagt

SEQ ID NO: 5265757 - DNA, 17 bp, Homo sapiens
atgatgaaaataataaa

SEQ ID NO: 5265758 - DNA, 23 bp, Homo sapiens
atgatgaaatgaggtcagagcct

SEQ ID NO: 5265759 - DNA, 17 bp, Homo sapiens
atgatgacaaaaaatgt

SEQ ID NO: 5265760 - DNA, 11 bp, Homo sapiens
atgatgacaat

SEQ ID NO: 5265761 - DNA, 14 bp, Homo sapiens
atgatgaccaagaa

SEQ ID NO: 5265762 - DNA, 15 bp, Homo sapiens
atgatgaccaagaat

SEQ ID NO: 5265763 - DNA, 14 bp, Homo sapiens
atgatgacttgagc

SEQ ID NO: 5265764 - DNA, 13 bp, Homo sapiens
atgatgagggaag

SEQ ID NO: 5265765 - DNA, 18 bp, Homo sapiens
atgatgatacagtgttaa

SEQ ID NO: 5265766 - DNA, 22 bp, Homo sapiens
atgatgatacagtgttaaaaga

SEQ ID NO: 5265767 - DNA, 22 bp, Homo sapiens
atgatgatccggatttaatttg

SEQ ID NO: 5265768 - DNA, 21 bp, Homo sapiens
atgatgattccttgagcattt

SEQ ID NO: 5265769 - DNA, 14 bp, Homo sapiens
atgatgattgaact

SEQ ID NO: 5265770 - DNA, 19 bp, Homo sapiens
atgatgcaaccaaaaggga

SEQ ID NO: 5265771 - DNA, 11 bp, Homo sapiens
atgatgcacat

SEQ ID NO: 5265772 - DNA, 16 bp, Homo sapiens
atgatgcacatttcat

SEQ ID NO: 5265773 - DNA, 19 bp, Homo sapiens
atgatgcagctgttgagaa

SEQ ID NO: 5265774 - DNA, 15 bp, Homo sapiens
atgatgcagtctcct

SEQ ID NO: 5265775 - DNA, 21 bp, Homo sapiens
atgatgcagtctcctctttaa

SEQ ID NO: 5265776 - DNA, 20 bp, Homo sapiens
atgatgcatggagtgtttga

SEQ ID NO: 5265777 - DNA, 13 bp, Homo sapiens
atgatgccaaaat

SEQ ID NO: 5265778 - DNA, 18 bp, Homo sapiens
atgatgccacaccaagct

SEQ ID NO: 5265779 - DNA, 24 bp, Homo sapiens
atgatgccacaccaagctgtgcca

SEQ ID NO: 5265780 - DNA, 17 bp, Homo sapiens
atgatgccatgaggaac

SEQ ID NO: 5265781 - DNA, 24 bp, Homo sapiens
atgatgccctcccctcagcgcagg

SEQ ID NO: 5265782 - DNA, 16 bp, Homo sapiens
atgatgccctgctcca

SEQ ID NO: 5265783 - DNA, 19 bp, Homo sapiens
atgatgcgcttcaaagtgg

SEQ ID NO: 5265784 - DNA, 17 bp, Homo sapiens
atgatgctaagagtcct

SEQ ID NO: 5265785 - DNA, 16 bp, Homo sapiens
atgatgctatttgcaa

SEQ ID NO: 5265786 - DNA, 13 bp, Homo sapiens
atgatgctcagtt

SEQ ID NO: 5265787 - DNA, 14 bp, Homo sapiens
atgatgctcagttt

SEQ ID NO: 5265788 - DNA, 16 bp, Homo sapiens
atgatgctctttccca

SEQ ID NO: 5265789 - DNA, 14 bp, Homo sapiens
atgatgctgagccc

SEQ ID NO: 5265790 - DNA, 23 bp, Homo sapiens
atgatgctgccggcacagctggg

SEQ ID NO: 5265791 - DNA, 15 bp, Homo sapiens
atgatgctttggaag

SEQ ID NO: 5265792 - DNA, 19 bp, Homo sapiens
atgatggaaacgcacttac

SEQ ID NO: 5265793 - DNA, 15 bp, Homo sapiens
atgatggaaattagc

SEQ ID NO: 5265794 - DNA, 19 bp, Homo sapiens
atgatggaacagtgaaagt

SEQ ID NO: 5265795 - DNA, 22 bp, Homo sapiens
atgatggaagggccttctccac

SEQ ID NO: 5265796 - DNA, 20 bp, Homo sapiens
atgatggacaaaggcctggc

SEQ ID NO: 5265797 - DNA, 15 bp, Homo sapiens
atgatggagtcaggt

SEQ ID NO: 5265798 - DNA, 17 bp, Homo sapiens
atgatggatgagaaaaa

SEQ ID NO: 5265799 - DNA, 17 bp, Homo sapiens
atgatggatggcagact

SEQ ID NO: 5265800 - DNA, 18 bp, Homo sapiens
atgatggatggcagactc

SEQ ID NO: 5265801 - DNA, 15 bp, Homo sapiens
atgatggcagagcca

SEQ ID NO: 5265802 - DNA, 19 bp, Homo sapiens
atgatggcaggtcctctgt

SEQ ID NO: 5265803 - DNA, 24 bp, Homo sapiens
atgatggcaggtcctctgttgcaa

SEQ ID NO: 5265804 - DNA, 16 bp, Homo sapiens
atgatggccatttcta

SEQ ID NO: 5265805 - DNA, 17 bp, Homo sapiens
atgatgggaaaatattt

SEQ ID NO: 5265806 - DNA, 14 bp, Homo sapiens
atgatgggaaagtg

SEQ ID NO: 5265807 - DNA, 16 bp, Homo sapiens
atgatgggaaagtgga

SEQ ID NO: 5265808 - DNA, 16 bp, Homo sapiens
atgatgggccgagcca

SEQ ID NO: 5265809 - DNA, 13 bp, Homo sapiens
atgatgggcttct

SEQ ID NO: 5265810 - DNA, 18 bp, Homo sapiens
atgatgggcttttgttct

SEQ ID NO: 5265811 - DNA, 17 bp, Homo sapiens
atgatggggaaggagta

SEQ ID NO: 5265812 - DNA, 14 bp, Homo sapiens
atgatgggggaaaa

SEQ ID NO: 5265813 - DNA, 18 bp, Homo sapiens
atgatggggtcagcaggc

SEQ ID NO: 5265814 - DNA, 21 bp, Homo sapiens
atgatggggtcagcaggccca

SEQ ID NO: 5265815 - DNA, 21 bp, Homo sapiens
atgatggggtgggagactttc

SEQ ID NO: 5265816 - DNA, 16 bp, Homo sapiens
atgatggtcacttaaa

SEQ ID NO: 5265817 - DNA, 16 bp, Homo sapiens
atgatggtgctgacct

SEQ ID NO: 5265818 - DNA, 16 bp, Homo sapiens
atgatggtgttggtga

SEQ ID NO: 5265819 - DNA, 20 bp, Homo sapiens
atgatggtgttggtgaaaat

SEQ ID NO: 5265820 - DNA, 21 bp, Homo sapiens
atgatggtgttggtgaaaata

SEQ ID NO: 5265821 - DNA, 18 bp, Homo sapiens
atgatgtaaaaaatacaa

SEQ ID NO: 5265822 - DNA, 14 bp, Homo sapiens
atgatgtacagatt

SEQ ID NO: 5265823 - DNA, 18 bp, Homo sapiens
atgatgtacagattcttt

SEQ ID NO: 5265824 - DNA, 21 bp, Homo sapiens
atgatgtagtgcctctttcat

SEQ ID NO: 5265825 - DNA, 18 bp, Homo sapiens
atgatgtatactgccact

SEQ ID NO: 5265826 - DNA, 17 bp, Homo sapiens
atgatgtatataaaatg

SEQ ID NO: 5265827 - DNA, 16 bp, Homo sapiens
atgatgtatatccata

SEQ ID NO: 5265828 - DNA, 15 bp, Homo sapiens
atgatgtatttttgt

SEQ ID NO: 5265829 - DNA, 18 bp, Homo sapiens
atgatgtccaacaaggaa

SEQ ID NO: 5265830 - DNA, 14 bp, Homo sapiens
atgatgtccagaag

SEQ ID NO: 5265831 - DNA, 15 bp, Homo sapiens
atgatgtccagaaga

SEQ ID NO: 5265832 - DNA, 23 bp, Homo sapiens
atgatgtccagaagaatattcag

SEQ ID NO: 5265833 - DNA, 14 bp, Homo sapiens
atgatgtccttgga

SEQ ID NO: 5265834 - DNA, 21 bp, Homo sapiens
atgatgtctacagaaaatgct

SEQ ID NO: 5265835 - DNA, 19 bp, Homo sapiens
atgatgtctttttattaaa

SEQ ID NO: 5265836 - DNA, 17 bp, Homo sapiens
atgatgtgaaacacttt

SEQ ID NO: 5265837 - DNA, 20 bp, Homo sapiens
atgatgtgaaacactttgcc

SEQ ID NO: 5265838 - DNA, 20 bp, Homo sapiens
atgatgtgaaagataaatga

SEQ ID NO: 5265839 - DNA, 23 bp, Homo sapiens
atgatgtgaaagataaatgatga

SEQ ID NO: 5265840 - DNA, 20 bp, Homo sapiens
atgatgtgatggaacacaca

SEQ ID NO: 5265841 - DNA, 13 bp, Homo sapiens
atgatgtgcttaa

SEQ ID NO: 5265842 - DNA, 19 bp, Homo sapiens
atgatgtggacatatgtat

SEQ ID NO: 5265843 - DNA, 17 bp, Homo sapiens
atgatgtggagaaagga

SEQ ID NO: 5265844 - DNA, 17 bp, Homo sapiens
atgatgtgggtgtcctg

SEQ ID NO: 5265845 - DNA, 23 bp, Homo sapiens
atgatgtggtgcctgaggtctgt

SEQ ID NO: 5265846 - DNA, 15 bp, Homo sapiens
atgatgtgtgaaacc

SEQ ID NO: 5265847 - DNA, 16 bp, Homo sapiens
atgatgtgtgaaacct

SEQ ID NO: 5265848 - DNA, 21 bp, Homo sapiens
atgatgtgtgaaacctgacac

SEQ ID NO: 5265849 - DNA, 13 bp, Homo sapiens
atgatgtgtgagt

SEQ ID NO: 5265850 - DNA, 9 bp, Homo sapiens
atgatgtta

SEQ ID NO: 5265851 - DNA, 18 bp, Homo sapiens
atgatgttaaatgccttg

SEQ ID NO: 5265852 - DNA, 20 bp, Homo sapiens
atgatgttaaatgtaatata

SEQ ID NO: 5265853 - DNA, 17 bp, Homo sapiens
atgatgttagaagaaga

SEQ ID NO: 5265854 - DNA, 17 bp, Homo sapiens
atgatgttagttttcct

SEQ ID NO: 5265855 - DNA, 19 bp, Homo sapiens
atgatgttagttttcctta

SEQ ID NO: 5265856 - DNA, 17 bp, Homo sapiens
atgatgttatagaatta

SEQ ID NO: 5265857 - DNA, 22 bp, Homo sapiens
atgatgttattttgtacgtgtt

SEQ ID NO: 5265858 - DNA, 12 bp, Homo sapiens
atgatgttctga

SEQ ID NO: 5265859 - DNA, 17 bp, Homo sapiens
atgatgttgaatatttg

SEQ ID NO: 5265860 - DNA, 14 bp, Homo sapiens
atgatgttgataat

SEQ ID NO: 5265861 - DNA, 18 bp, Homo sapiens
atgatgtttccctctcct

SEQ ID NO: 5265862 - DNA, 14 bp, Homo sapiens
atgatgtttgccca

SEQ ID NO: 5265863 - DNA, 22 bp, Homo sapiens
atgatgttttaaaaaaatttga

SEQ ID NO: 5265864 - DNA, 15 bp, Homo sapiens
atgatgttttcaggt

SEQ ID NO: 5265865 - DNA, 14 bp, Homo sapiens
atgatgttttgata

SEQ ID NO: 5265866 - DNA, 13 bp, Homo sapiens
atgatgtttttaa

SEQ ID NO: 5265867 - DNA, 17 bp, Homo sapiens
atgattaaaaagaataa

SEQ ID NO: 5265868 - DNA, 15 bp, Homo sapiens
atgattaaacacctg

SEQ ID NO: 5265869 - DNA, 16 bp, Homo sapiens
atgattaaacacctga

SEQ ID NO: 5265870 - DNA, 20 bp, Homo sapiens
atgattaaaggcagcatttg

SEQ ID NO: 5265871 - DNA, 17 bp, Homo sapiens
atgattaaataagattc

SEQ ID NO: 5265872 - DNA, 12 bp, Homo sapiens
atgttgctattg

SEQ ID NO: 5265873 - DNA, 15 bp, Homo sapiens
atgttgctattgtaa

SEQ ID NO: 5265874 - DNA, 18 bp, Homo sapiens
atgttgctattgtaaggt

SEQ ID NO: 5265875 - DNA, 14 bp, Homo sapiens
atgttgctctttca

SEQ ID NO: 5265876 - DNA, 17 bp, Homo sapiens
atgttgctctttcacct

SEQ ID NO: 5265877 - DNA, 20 bp, Homo sapiens
atgttgctgaaaaatgggca

SEQ ID NO: 5265878 - DNA, 13 bp, Homo sapiens
atgttgctgaaac

SEQ ID NO: 5265879 - DNA, 16 bp, Homo sapiens
atgttgctgaatttgt

SEQ ID NO: 5265880 - DNA, 20 bp, Homo sapiens
atgttgctgaggagtgagga

SEQ ID NO: 5265881 - DNA, 18 bp, Homo sapiens
atgttgctgatggcccct

SEQ ID NO: 5265882 - DNA, 23 bp, Homo sapiens
atgttgctgatggcccctccagc

SEQ ID NO: 5265883 - DNA, 19 bp, Homo sapiens
atgttgctggactgtcata

SEQ ID NO: 5265884 - DNA, 19 bp, Homo sapiens
atgttgctgttattatatt

SEQ ID NO: 5265885 - DNA, 14 bp, Homo sapiens
atgttgcttctcag

SEQ ID NO: 5265886 - DNA, 19 bp, Homo sapiens
atgttgcttttgaaaagtt

SEQ ID NO: 5265887 - DNA, 22 bp, Homo sapiens
atgttggaaaacatatgaaata

SEQ ID NO: 5265888 - DNA, 21 bp, Homo sapiens
atgttggaactctgtgcaggt

SEQ ID NO: 5265889 - DNA, 17 bp, Homo sapiens
atgttggacagacactg

SEQ ID NO: 5265890 - DNA, 20 bp, Homo sapiens
atgttggacagacactgttg

SEQ ID NO: 5265891 - DNA, 16 bp, Homo sapiens
atgttggagcagcagg

SEQ ID NO: 5265892 - DNA, 17 bp, Homo sapiens
atgttggataaggaatt

SEQ ID NO: 5265893 - DNA, 21 bp, Homo sapiens
atgttggatttataaatgcta

SEQ ID NO: 5265894 - DNA, 21 bp, Homo sapiens
atgttggcagatgcagctctt

SEQ ID NO: 5265895 - DNA, 22 bp, Homo sapiens
atgttggcattaacaataaagc

SEQ ID NO: 5265896 - DNA, 16 bp, Homo sapiens
atgttggccaggctgc

SEQ ID NO: 5265897 - DNA, 21 bp, Homo sapiens
atgttggccaggctgctctca

SEQ ID NO: 5265898 - DNA, 21 bp, Homo sapiens
atgttggccaggctggtctaa

SEQ ID NO: 5265899 - DNA, 20 bp, Homo sapiens
atgttggccaggctgttctc

SEQ ID NO: 5265900 - DNA, 20 bp, Homo sapiens
atgttggctgcgtactccac

SEQ ID NO: 5265901 - DNA, 13 bp, Homo sapiens
atgttgggaaaaa

SEQ ID NO: 5265902 - DNA, 15 bp, Homo sapiens
atgttgggaaaaact

SEQ ID NO: 5265903 - DNA, 21 bp, Homo sapiens
atgttgggaaaaactggcttt

SEQ ID NO: 5265904 - DNA, 23 bp, Homo sapiens
atgttgggaggatacagaggaga

SEQ ID NO: 5265905 - DNA, 18 bp, Homo sapiens
atgttgggatttatatct

SEQ ID NO: 5265906 - DNA, 19 bp, Homo sapiens
atgttgggatttatatcta

SEQ ID NO: 5265907 - DNA, 19 bp, Homo sapiens
atgttggggggccccacgg

SEQ ID NO: 5265908 - DNA, 21 bp, Homo sapiens
atgttgggggggaccctgcct

SEQ ID NO: 5265909 - DNA, 23 bp, Homo sapiens
atgttggggtaaaagtgttgctg

SEQ ID NO: 5265910 - DNA, 17 bp, Homo sapiens
atgttgggtttgagaca

SEQ ID NO: 5265911 - DNA, 18 bp, Homo sapiens
atgttggttgcactttgt

SEQ ID NO: 5265912 - DNA, 19 bp, Homo sapiens
atgttggtttaattaataa

SEQ ID NO: 5265913 - DNA, 18 bp, Homo sapiens
atgttggtttactttcaa

SEQ ID NO: 5265914 - DNA, 12 bp, Homo sapiens
atgttggtttat

SEQ ID NO: 5265915 - DNA, 14 bp, Homo sapiens
atgttggtttcagt

SEQ ID NO: 5265916 - DNA, 18 bp, Homo sapiens
atgttggtttcagtggct

SEQ ID NO: 5265917 - DNA, 22 bp, Homo sapiens
atgttggttttttagtgcaatt

SEQ ID NO: 5265918 - DNA, 16 bp, Homo sapiens
atgttgtaaaatgaat

SEQ ID NO: 5265919 - DNA, 18 bp, Homo sapiens
atgttgtaaaatgaattt

SEQ ID NO: 5265920 - DNA, 20 bp, Homo sapiens
atgttgtaaaatgaatttgt

SEQ ID NO: 5265921 - DNA, 16 bp, Homo sapiens
atgttgtaatattttg

SEQ ID NO: 5265922 - DNA, 11 bp, Homo sapiens
atgttgtacaa

SEQ ID NO: 5265923 - DNA, 15 bp, Homo sapiens
atgttgtacaatgta

SEQ ID NO: 5265924 - DNA, 21 bp, Homo sapiens
atgttgtacttgaaaatgcta

SEQ ID NO: 5265925 - DNA, 23 bp, Homo sapiens
atgttgtacttgaaaatgctata

SEQ ID NO: 5265926 - DNA, 12 bp, Homo sapiens
atgttgtagtgt

SEQ ID NO: 5265927 - DNA, 14 bp, Homo sapiens
atgttgtattaact

SEQ ID NO: 5265928 - DNA, 11 bp, Homo sapiens
atgttgtattg

SEQ ID NO: 5265929 - DNA, 22 bp, Homo sapiens
atgttgtattgatttttaagaa

SEQ ID NO: 5265930 - DNA, 14 bp, Homo sapiens
atgttgtcaaagag

SEQ ID NO: 5265931 - DNA, 22 bp, Homo sapiens
atgttgtcaggtcgttcttatc

SEQ ID NO: 5265932 - DNA, 11 bp, Homo sapiens
atgttgtcata

SEQ ID NO: 5265933 - DNA, 22 bp, Homo sapiens
atgttgtcataacatttaaaga

SEQ ID NO: 5265934 - DNA, 16 bp, Homo sapiens
atgttgtcctgtgtca

SEQ ID NO: 5265935 - DNA, 23 bp, Homo sapiens
atgttgtcctgtgtcatctgtca

SEQ ID NO: 5265936 - DNA, 17 bp, Homo sapiens
atgttgtctaagaaatt

SEQ ID NO: 5265937 - DNA, 22 bp, Homo sapiens
atgttgtctaagaaattgaata

SEQ ID NO: 5265938 - DNA, 18 bp, Homo sapiens
atgttgtcttataaacaa

SEQ ID NO: 5265939 - DNA, 14 bp, Homo sapiens
atgttgtgaagatg

SEQ ID NO: 5265940 - DNA, 19 bp, Homo sapiens
atgttgtgatgtacacatt

SEQ ID NO: 5265941 - DNA, 15 bp, Homo sapiens
atgttgtgatgtatt

SEQ ID NO: 5265942 - DNA, 18 bp, Homo sapiens
atgttgtgcctccctggt

SEQ ID NO: 5265943 - DNA, 13 bp, Homo sapiens
atgttgtggaata

SEQ ID NO: 5265944 - DNA, 21 bp, Homo sapiens
atgttgtggaatatggcaata

SEQ ID NO: 5265945 - DNA, 18 bp, Homo sapiens
atgttgtgtgttgcactc

SEQ ID NO: 5265946 - DNA, 16 bp, Homo sapiens
atgttgtgttctaata

SEQ ID NO: 5265947 - DNA, 17 bp, Homo sapiens
atgttgtgttgttatca

SEQ ID NO: 5265948 - DNA, 22 bp, Homo sapiens
atgttgtgtttctgttcacctt

SEQ ID NO: 5265949 - DNA, 20 bp, Homo sapiens
atgttgtgtttggatttgta

SEQ ID NO: 5265950 - DNA, 20 bp, Homo sapiens
atgttgtgtttggttcaatt

SEQ ID NO: 5265951 - DNA, 17 bp, Homo sapiens
atgttgttaaaattatg

SEQ ID NO: 5265952 - DNA, 14 bp, Homo sapiens
atgttgttaaatgc

SEQ ID NO: 5265953 - DNA, 18 bp, Homo sapiens
atgttgttaaatgctatg

SEQ ID NO: 5265954 - DNA, 23 bp, Homo sapiens
atgttgttagagaaaaatgcttt

SEQ ID NO: 5265955 - DNA, 16 bp, Homo sapiens
atgttgttatgctatt

SEQ ID NO: 5265956 - DNA, 15 bp, Homo sapiens
atgttgttatttaaa

SEQ ID NO: 5265957 - DNA, 15 bp, Homo sapiens
atgttgttcaaatgc

SEQ ID NO: 5265958 - DNA, 23 bp, Homo sapiens
atgttgttcccacacacaaacca

SEQ ID NO: 5265959 - DNA, 14 bp, Homo sapiens
atgttgttgaaagg

SEQ ID NO: 5265960 - DNA, 20 bp, Homo sapiens
atgttgtttataataaaaat

SEQ ID NO: 5265961 - DNA, 16 bp, Homo sapiens
atgttgttttttcata

SEQ ID NO: 5265962 - DNA, 21 bp, Homo sapiens
atgtttaaaaaagtttaaaat

SEQ ID NO: 5265963 - DNA, 19 bp, Homo sapiens
atgtttaaaaagtttctaa

SEQ ID NO: 5265964 - DNA, 12 bp, Homo sapiens
atgtttaaaaca

SEQ ID NO: 5265965 - DNA, 22 bp, Homo sapiens
atgtttaaaacaccttctatag

SEQ ID NO: 5265966 - DNA, 14 bp, Homo sapiens
atgtttaaaacatc

SEQ ID NO: 5265967 - DNA, 20 bp, Homo sapiens
atgtttaaaagaaatatatt

SEQ ID NO: 5265968 - DNA, 12 bp, Homo sapiens
atgtttaaaata

SEQ ID NO: 5265969 - DNA, 23 bp, Homo sapiens
atgtttaaaatggcatttagcac

SEQ ID NO: 5265970 - DNA, 20 bp, Homo sapiens
atgtttaaactttgtgcctt

SEQ ID NO: 5265971 - DNA, 18 bp, Homo sapiens
atgtttaaagtaattgtt

SEQ ID NO: 5265972 - DNA, 14 bp, Homo sapiens
atgtttaaataaat

SEQ ID NO: 5265973 - DNA, 14 bp, Homo sapiens
atgtttaaattgta

SEQ ID NO: 5265974 - DNA, 17 bp, Homo sapiens
atgtttaaattgtaaat

SEQ ID NO: 5265975 - DNA, 22 bp, Homo sapiens
atgtttaacaaatctaatctct

SEQ ID NO: 5265976 - DNA, 15 bp, Homo sapiens
atgtttaagatatat

SEQ ID NO: 5265977 - DNA, 21 bp, Homo sapiens
atgtttaagcagaattggaaa

SEQ ID NO: 5265978 - DNA, 20 bp, Homo sapiens
atgtttaagtattaacttac

SEQ ID NO: 5265979 - DNA, 18 bp, Homo sapiens
atgtttaataaagcttta

SEQ ID NO: 5265980 - DNA, 16 bp, Homo sapiens
atgtttaatagaaaat

SEQ ID NO: 5265981 - DNA, 20 bp, Homo sapiens
atgtttaatatctgactgaa

SEQ ID NO: 5265982 - DNA, 22 bp, Homo sapiens
atgtttaatcaagagagacaaa

SEQ ID NO: 5265983 - DNA, 16 bp, Homo sapiens
atgtttaatcatataa

SEQ ID NO: 5265984 - DNA, 17 bp, Homo sapiens
atgtttaatctgttatg

SEQ ID NO: 5265985 - DNA, 13 bp, Homo sapiens
atgtttaatgtga

SEQ ID NO: 5265986 - DNA, 18 bp, Homo sapiens
atgtttaatgtgaactct

SEQ ID NO: 5265987 - DNA, 14 bp, Homo sapiens
atgtttaattgtga

SEQ ID NO: 5265988 - DNA, 18 bp, Homo sapiens
atgtttaattgtgatatt

SEQ ID NO: 5265989 - DNA, 17 bp, Homo sapiens
atgtttacagaggacag

SEQ ID NO: 5265990 - DNA, 22 bp, Homo sapiens
atgtttacaggtggacacacaa

SEQ ID NO: 5265991 - DNA, 18 bp, Homo sapiens
atgtttacaggtttgaat

SEQ ID NO: 5265992 - DNA, 19 bp, Homo sapiens
atgtttacaggtttgaatt

SEQ ID NO: 5265993 - DNA, 14 bp, Homo sapiens
atgtttacattttc

SEQ ID NO: 5265994 - DNA, 19 bp, Homo sapiens
atgtttacattttctttca

SEQ ID NO: 5265995 - DNA, 17 bp, Homo sapiens
atgtttactcattgccc

SEQ ID NO: 5265996 - DNA, 11 bp, Homo sapiens
atgtttactgt

SEQ ID NO: 5265997 - DNA, 13 bp, Homo sapiens
atgtttactgtaa

SEQ ID NO: 5265998 - DNA, 23 bp, Homo sapiens
atgtttactgtatcaatttctaa

SEQ ID NO: 5265999 - DNA, 18 bp, Homo sapiens
atgtttactttattagag

SEQ ID NO: 5266000 - DNA, 23 bp, Homo sapiens
atgtttagaaaagtattcgttac

SEQ ID NO: 5266001 - DNA, 19 bp, Homo sapiens
atgtttagaaataaatgaa

SEQ ID NO: 5266002 - DNA, 18 bp, Homo sapiens
atgtttagactttaacat

SEQ ID NO: 5266003 - DNA, 21 bp, Homo sapiens
atgtttagcagaaataggcag

SEQ ID NO: 5266004 - DNA, 15 bp, Homo sapiens
atgtttaggaaattt

SEQ ID NO: 5266005 - DNA, 16 bp, Homo sapiens
atgtttagtagaaacg

SEQ ID NO: 5266006 - DNA, 21 bp, Homo sapiens
atgtttagtagctgataaaga

SEQ ID NO: 5266007 - DNA, 11 bp, Homo sapiens
atgtttataaa

SEQ ID NO: 5266008 - DNA, 20 bp, Homo sapiens
atgtttataaatcttatgct

SEQ ID NO: 5266009 - DNA, 19 bp, Homo sapiens
atgtttataactattcagt

SEQ ID NO: 5266010 - DNA, 16 bp, Homo sapiens
atgtttatacaataat

SEQ ID NO: 5266011 - DNA, 14 bp, Homo sapiens
atgtttatacacac

SEQ ID NO: 5266012 - DNA, 17 bp, Homo sapiens
atgtttatacacacagg

SEQ ID NO: 5266013 - DNA, 15 bp, Homo sapiens
atgtttatacagagt

SEQ ID NO: 5266014 - DNA, 17 bp, Homo sapiens
atgtttatacagagtaa

SEQ ID NO: 5266015 - DNA, 13 bp, Homo sapiens
atgtttatactgt

SEQ ID NO: 5266016 - DNA, 15 bp, Homo sapiens
atgtttatagcattc

SEQ ID NO: 5266017 - DNA, 16 bp, Homo sapiens
atgtttatataaatgc

SEQ ID NO: 5266018 - DNA, 14 bp, Homo sapiens
atgtttatatactg

SEQ ID NO: 5266019 - DNA, 13 bp, Homo sapiens
atgtttatattgt

SEQ ID NO: 5266020 - DNA, 14 bp, Homo sapiens
atgtttatattgtt

SEQ ID NO: 5266021 - DNA, 22 bp, Homo sapiens
atgtttatatttattatataag

SEQ ID NO: 5266022 - DNA, 16 bp, Homo sapiens
atgtttatctgacaca

SEQ ID NO: 5266023 - DNA, 19 bp, Homo sapiens
atgtttatgaaaataaata

SEQ ID NO: 5266024 - DNA, 15 bp, Homo sapiens
atgtttatgagccag

SEQ ID NO: 5266025 - DNA, 18 bp, Homo sapiens
atgtttatgcaaggaagg

SEQ ID NO: 5266026 - DNA, 18 bp, Homo sapiens
atgtttatgccacagaat

SEQ ID NO: 5266027 - DNA, 17 bp, Homo sapiens
atgtttatggaaatatt

SEQ ID NO: 5266028 - DNA, 13 bp, Homo sapiens
atgtttatgtaaa

SEQ ID NO: 5266029 - DNA, 21 bp, Homo sapiens
atgtttatgtaaacaaatctt

SEQ ID NO: 5266030 - DNA, 15 bp, Homo sapiens
atgtttatgtactgt

SEQ ID NO: 5266031 - DNA, 14 bp, Homo sapiens
atgtttatgttctt

SEQ ID NO: 5266032 - DNA, 17 bp, Homo sapiens
atgtttattaaatgctt

SEQ ID NO: 5266033 - DNA, 19 bp, Homo sapiens
atgtttattaaatgcttca

SEQ ID NO: 5266034 - DNA, 21 bp, Homo sapiens
atgtttattaagaatcattgt

SEQ ID NO: 5266035 - DNA, 16 bp, Homo sapiens
atgtttattacaattt

SEQ ID NO: 5266036 - DNA, 22 bp, Homo sapiens
atgtttattacagtataattaa

SEQ ID NO: 5266037 - DNA, 14 bp, Homo sapiens
atgtttattcaaaa

SEQ ID NO: 5266038 - DNA, 14 bp, Homo sapiens
atgtttattcctga

SEQ ID NO: 5266039 - DNA, 18 bp, Homo sapiens
atgtttattccttctgta

SEQ ID NO: 5266040 - DNA, 21 bp, Homo sapiens
atgtttattggtatattttct

SEQ ID NO: 5266041 - DNA, 17 bp, Homo sapiens
atgtttatttactaatt

SEQ ID NO: 5266042 - DNA, 17 bp, Homo sapiens
atgtttatttagaaact

SEQ ID NO: 5266043 - DNA, 19 bp, Homo sapiens
atgtttatttagctctgaa

SEQ ID NO: 5266044 - DNA, 21 bp, Homo sapiens
atgtttatttattctgcattt

SEQ ID NO: 5266045 - DNA, 17 bp, Homo sapiens
atgtttatttttgctct

SEQ ID NO: 5266046 - DNA, 21 bp, Homo sapiens
atgtttcaaacatatataaca

SEQ ID NO: 5266047 - DNA, 12 bp, Homo sapiens
atgtttcaaact

SEQ ID NO: 5266048 - DNA, 14 bp, Homo sapiens
atgtttcaaacttt

SEQ ID NO: 5266049 - DNA, 22 bp, Homo sapiens
atgtttcactatgattttctat

SEQ ID NO: 5266050 - DNA, 19 bp, Homo sapiens
atgattaaataagattcta

SEQ ID NO: 5266051 - DNA, 11 bp, Homo sapiens
atgattaaatt

SEQ ID NO: 5266052 - DNA, 18 bp, Homo sapiens
atgattaaattatgaagc

SEQ ID NO: 5266053 - DNA, 23 bp, Homo sapiens
atgattaaattttagtacatttt

SEQ ID NO: 5266054 - DNA, 23 bp, Homo sapiens
atgattaaccccttctttcatgt

SEQ ID NO: 5266055 - DNA, 20 bp, Homo sapiens
atgattaagggacatttcta

SEQ ID NO: 5266056 - DNA, 18 bp, Homo sapiens
atgattaagtaatgataa

SEQ ID NO: 5266057 - DNA, 15 bp, Homo sapiens
atgattaatacctga

SEQ ID NO: 5266058 - DNA, 15 bp, Homo sapiens
atgattaatcaaagg

SEQ ID NO: 5266059 - DNA, 23 bp, Homo sapiens
atgattaatcagctgttgcaggc

SEQ ID NO: 5266060 - DNA, 14 bp, Homo sapiens
atgattaatgcatt

SEQ ID NO: 5266061 - DNA, 17 bp, Homo sapiens
atgattaatgtgtattt

SEQ ID NO: 5266062 - DNA, 15 bp, Homo sapiens
atgattactcctcca

SEQ ID NO: 5266063 - DNA, 22 bp, Homo sapiens
atgattagaaattacctgtgga

SEQ ID NO: 5266064 - DNA, 13 bp, Homo sapiens
atgattagacaat

SEQ ID NO: 5266065 - DNA, 14 bp, Homo sapiens
atgattagcaagtt

SEQ ID NO: 5266066 - DNA, 23 bp, Homo sapiens
atgattagcagaagaaaggaaca

SEQ ID NO: 5266067 - DNA, 19 bp, Homo sapiens
atgattagcataaagcact

SEQ ID NO: 5266068 - DNA, 22 bp, Homo sapiens
atgattaggcccgccaaacttc

SEQ ID NO: 5266069 - DNA, 15 bp, Homo sapiens
atgattagtaaagaa

SEQ ID NO: 5266070 - DNA, 12 bp, Homo sapiens
atgattatacaa

SEQ ID NO: 5266071 - DNA, 22 bp, Homo sapiens
atgattatgaattacatttgta

SEQ ID NO: 5266072 - DNA, 17 bp, Homo sapiens
atgattatgccactgct

SEQ ID NO: 5266073 - DNA, 14 bp, Homo sapiens
atgattattcaaga

SEQ ID NO: 5266074 - DNA, 13 bp, Homo sapiens
atgattatttgta

SEQ ID NO: 5266075 - DNA, 17 bp, Homo sapiens
atgattatttgtattta

SEQ ID NO: 5266076 - DNA, 15 bp, Homo sapiens
atgattattttcatt

SEQ ID NO: 5266077 - DNA, 20 bp, Homo sapiens
atgattatttttttctgtaa

SEQ ID NO: 5266078 - DNA, 17 bp, Homo sapiens
atgattcaaatgtttta

SEQ ID NO: 5266079 - DNA, 14 bp, Homo sapiens
atgattcaacctga

SEQ ID NO: 5266080 - DNA, 15 bp, Homo sapiens
atgattcaagccatt

SEQ ID NO: 5266081 - DNA, 12 bp, Homo sapiens
atgattcaatgt

SEQ ID NO: 5266082 - DNA, 13 bp, Homo sapiens
atgattcaatgtg

SEQ ID NO: 5266083 - DNA, 15 bp, Homo sapiens
atgattcaatgtgaa

SEQ ID NO: 5266084 - DNA, 22 bp, Homo sapiens
atgattcaatgtgaattttaaa

SEQ ID NO: 5266085 - DNA, 22 bp, Homo sapiens
atgattcacaactaggacctca

SEQ ID NO: 5266086 - DNA, 14 bp, Homo sapiens
atgattcagaaatt

SEQ ID NO: 5266087 - DNA, 17 bp, Homo sapiens
atgattcagaaattgga

SEQ ID NO: 5266088 - DNA, 14 bp, Homo sapiens
atgattcaggtgca

SEQ ID NO: 5266089 - DNA, 22 bp, Homo sapiens
atgattcaggtgcagaggaagt

SEQ ID NO: 5266090 - DNA, 14 bp, Homo sapiens
atgattcataacaa

SEQ ID NO: 5266091 - DNA, 15 bp, Homo sapiens
atgattcataacaat

SEQ ID NO: 5266092 - DNA, 17 bp, Homo sapiens
atgattcatctttcaga

SEQ ID NO: 5266093 - DNA, 15 bp, Homo sapiens
atgattcatgttata

SEQ ID NO: 5266094 - DNA, 21 bp, Homo sapiens
atgattccaagggcccagagg

SEQ ID NO: 5266095 - DNA, 14 bp, Homo sapiens
atgattccatgccc

SEQ ID NO: 5266096 - DNA, 12 bp, Homo sapiens
atgattcccagc

SEQ ID NO: 5266097 - DNA, 15 bp, Homo sapiens
atgattccctcctcg

SEQ ID NO: 5266098 - DNA, 22 bp, Homo sapiens
atgattctagtacataattgat

SEQ ID NO: 5266099 - DNA, 23 bp, Homo sapiens
atgattctagtacataattgatt

SEQ ID NO: 5266100 - DNA, 15 bp, Homo sapiens
atgattctatgtaat

SEQ ID NO: 5266101 - DNA, 22 bp, Homo sapiens
atgattctatttatatgtacat

SEQ ID NO: 5266102 - DNA, 23 bp, Homo sapiens
atgattctatttatatgtacatg

SEQ ID NO: 5266103 - DNA, 13 bp, Homo sapiens
atgattctcctct

SEQ ID NO: 5266104 - DNA, 17 bp, Homo sapiens
atgattctcctctccca

SEQ ID NO: 5266105 - DNA, 13 bp, Homo sapiens
atgattctctgtg

SEQ ID NO: 5266106 - DNA, 21 bp, Homo sapiens
atgattctgaagcttatgttt

SEQ ID NO: 5266107 - DNA, 23 bp, Homo sapiens
atgattctgaagcttatgtttct

SEQ ID NO: 5266108 - DNA, 14 bp, Homo sapiens
atgattcttaacac

SEQ ID NO: 5266109 - DNA, 18 bp, Homo sapiens
atgattcttactgttctt

SEQ ID NO: 5266110 - DNA, 15 bp, Homo sapiens
atgattcttctcttg

SEQ ID NO: 5266111 - DNA, 18 bp, Homo sapiens
atgattcttctcttgtga

SEQ ID NO: 5266112 - DNA, 20 bp, Homo sapiens
atgattcttctcttgtgatt

SEQ ID NO: 5266113 - DNA, 20 bp, Homo sapiens
atgattctttgttacaggca

SEQ ID NO: 5266114 - DNA, 12 bp, Homo sapiens
atgattgaaaat

SEQ ID NO: 5266115 - DNA, 13 bp, Homo sapiens
atgattgaagaaa

SEQ ID NO: 5266116 - DNA, 19 bp, Homo sapiens
atgattgcactaaataaac

SEQ ID NO: 5266117 - DNA, 23 bp, Homo sapiens
atgattgcactaaataaactact

SEQ ID NO: 5266118 - DNA, 15 bp, Homo sapiens
atgattgccaacagt

SEQ ID NO: 5266119 - DNA, 17 bp, Homo sapiens
atgattgccaacagtgg

SEQ ID NO: 5266120 - DNA, 14 bp, Homo sapiens
atgattgcttttaa

SEQ ID NO: 5266121 - DNA, 21 bp, Homo sapiens
atgattggattattcatttaa

SEQ ID NO: 5266122 - DNA, 21 bp, Homo sapiens
atgattggttaaaatgtgatt

SEQ ID NO: 5266123 - DNA, 13 bp, Homo sapiens
atgattggttcag

SEQ ID NO: 5266124 - DNA, 15 bp, Homo sapiens
atgattgtaaaatag

SEQ ID NO: 5266125 - DNA, 15 bp, Homo sapiens
atgattgtactttga

SEQ ID NO: 5266126 - DNA, 16 bp, Homo sapiens
atgattgtactttgaa

SEQ ID NO: 5266127 - DNA, 17 bp, Homo sapiens
atgattgtactttgaat

SEQ ID NO: 5266128 - DNA, 13 bp, Homo sapiens
atgattgtataag

SEQ ID NO: 5266129 - DNA, 15 bp, Homo sapiens
atgattgtataagca

SEQ ID NO: 5266130 - DNA, 18 bp, Homo sapiens
atgattgtataagcatgc

SEQ ID NO: 5266131 - DNA, 21 bp, Homo sapiens
atgattgtataatgtgatttt

SEQ ID NO: 5266132 - DNA, 12 bp, Homo sapiens
atgattgtctaa

SEQ ID NO: 5266133 - DNA, 14 bp, Homo sapiens
atgattgtctaacc

SEQ ID NO: 5266134 - DNA, 22 bp, Homo sapiens
atgattgtctaaccaattgtga

SEQ ID NO: 5266135 - DNA, 13 bp, Homo sapiens
atgattgttcata

SEQ ID NO: 5266136 - DNA, 19 bp, Homo sapiens
atgattgttcttttgtttc

SEQ ID NO: 5266137 - DNA, 18 bp, Homo sapiens
atgattgtttcttcttca

SEQ ID NO: 5266138 - DNA, 17 bp, Homo sapiens
atgattgtttgcacaga

SEQ ID NO: 5266139 - DNA, 14 bp, Homo sapiens
atgattgttttaga

SEQ ID NO: 5266140 - DNA, 22 bp, Homo sapiens
atgatttaaaaaataaatataa

SEQ ID NO: 5266141 - DNA, 23 bp, Homo sapiens
atgatttaaaaaataaatataat

SEQ ID NO: 5266142 - DNA, 14 bp, Homo sapiens
atgatttaaaacat

SEQ ID NO: 5266143 - DNA, 16 bp, Homo sapiens
atgatttaaaagggaa

SEQ ID NO: 5266144 - DNA, 14 bp, Homo sapiens
atgatttaaagact

SEQ ID NO: 5266145 - DNA, 12 bp, Homo sapiens
atgatttaacat

SEQ ID NO: 5266146 - DNA, 13 bp, Homo sapiens
atgatttaataaa

SEQ ID NO: 5266147 - DNA, 14 bp, Homo sapiens
atgatttaataaaa

SEQ ID NO: 5266148 - DNA, 19 bp, Homo sapiens
atgatttaataaaataatt

SEQ ID NO: 5266149 - DNA, 15 bp, Homo sapiens
atgatttagcaagca

SEQ ID NO: 5266150 - DNA, 17 bp, Homo sapiens
atgatttagcaagcaac

SEQ ID NO: 5266151 - DNA, 17 bp, Homo sapiens
atgatttagcaagttct

SEQ ID NO: 5266152 - DNA, 14 bp, Homo sapiens
atgatttatagttt

SEQ ID NO: 5266153 - DNA, 15 bp, Homo sapiens
atgatttcacaaata

SEQ ID NO: 5266154 - DNA, 13 bp, Homo sapiens
atgatttcacagt

SEQ ID NO: 5266155 - DNA, 14 bp, Homo sapiens
atgatttcagaaac

SEQ ID NO: 5266156 - DNA, 14 bp, Homo sapiens
atgatttcagtagc

SEQ ID NO: 5266157 - DNA, 21 bp, Homo sapiens
atgatttcagtcatagcaagc

SEQ ID NO: 5266158 - DNA, 20 bp, Homo sapiens
atgatttcagttctaggaaa

SEQ ID NO: 5266159 - DNA, 13 bp, Homo sapiens
atgatttcatatt

SEQ ID NO: 5266160 - DNA, 14 bp, Homo sapiens
atgatttcatattg

SEQ ID NO: 5266161 - DNA, 21 bp, Homo sapiens
atgatttcatcttctggaata

SEQ ID NO: 5266162 - DNA, 13 bp, Homo sapiens
atgatttcatgat

SEQ ID NO: 5266163 - DNA, 19 bp, Homo sapiens
atgatttcatgattagaca

SEQ ID NO: 5266164 - DNA, 14 bp, Homo sapiens
atgatttcatgtac

SEQ ID NO: 5266165 - DNA, 16 bp, Homo sapiens
atgatttcatgtactg

SEQ ID NO: 5266166 - DNA, 12 bp, Homo sapiens
atgatttcccaa

SEQ ID NO: 5266167 - DNA, 23 bp, Homo sapiens
atgatttcccactcagggctggg

SEQ ID NO: 5266168 - DNA, 19 bp, Homo sapiens
atgatttccctccagagaa

SEQ ID NO: 5266169 - DNA, 21 bp, Homo sapiens
atgatttccctccagagaaag

SEQ ID NO: 5266170 - DNA, 24 bp, Homo sapiens
atgatttccctccagagaaagcac

SEQ ID NO: 5266171 - DNA, 12 bp, Homo sapiens
atgatttcctct

SEQ ID NO: 5266172 - DNA, 16 bp, Homo sapiens
atgatttccttgaatg

SEQ ID NO: 5266173 - DNA, 17 bp, Homo sapiens
atgatttcgtgactgta

SEQ ID NO: 5266174 - DNA, 12 bp, Homo sapiens
atgatttctatg

SEQ ID NO: 5266175 - DNA, 18 bp, Homo sapiens
atgatttctccagaaatt

SEQ ID NO: 5266176 - DNA, 20 bp, Homo sapiens
atgatttctccagaaattta

SEQ ID NO: 5266177 - DNA, 13 bp, Homo sapiens
atgatttctgtga

SEQ ID NO: 5266178 - DNA, 16 bp, Homo sapiens
atgatttcttgctttg

SEQ ID NO: 5266179 - DNA, 20 bp, Homo sapiens
atgatttcttgtgatgtatt

SEQ ID NO: 5266180 - DNA, 22 bp, Homo sapiens
atgatttgcaactttagaaaga

SEQ ID NO: 5266181 - DNA, 13 bp, Homo sapiens
atgatttgcatgt

SEQ ID NO: 5266182 - DNA, 20 bp, Homo sapiens
atgatttgcattttttaaat

SEQ ID NO: 5266183 - DNA, 15 bp, Homo sapiens
atgatttggccaggc

SEQ ID NO: 5266184 - DNA, 11 bp, Homo sapiens
atgatttgtac

SEQ ID NO: 5266185 - DNA, 16 bp, Homo sapiens
atgatttgtacttgga

SEQ ID NO: 5266186 - DNA, 17 bp, Homo sapiens
atgatttgtagtggaaa

SEQ ID NO: 5266187 - DNA, 22 bp, Homo sapiens
atgatttgtgtccatttcaagt

SEQ ID NO: 5266188 - DNA, 15 bp, Homo sapiens
atgatttgttccttt

SEQ ID NO: 5266189 - DNA, 18 bp, Homo sapiens
atgatttgttcctttctg

SEQ ID NO: 5266190 - DNA, 14 bp, Homo sapiens
atgatttgttttga

SEQ ID NO: 5266191 - DNA, 21 bp, Homo sapiens
atgattttaagtttctctgca

SEQ ID NO: 5266192 - DNA, 22 bp, Homo sapiens
atgattttacaagtataacagt

SEQ ID NO: 5266193 - DNA, 13 bp, Homo sapiens
atgattttacaga

SEQ ID NO: 5266194 - DNA, 17 bp, Homo sapiens
atgattttatacatagt

SEQ ID NO: 5266195 - DNA, 18 bp, Homo sapiens
atgattttatacatagtc

SEQ ID NO: 5266196 - DNA, 14 bp, Homo sapiens
atgattttattaca

SEQ ID NO: 5266197 - DNA, 22 bp, Homo sapiens
atgattttattacagaaatgtt

SEQ ID NO: 5266198 - DNA, 18 bp, Homo sapiens
atgattttatttgacaaa

SEQ ID NO: 5266199 - DNA, 23 bp, Homo sapiens
atgattttatttgacaaaatttg

SEQ ID NO: 5266200 - DNA, 15 bp, Homo sapiens
atgattttcataact

SEQ ID NO: 5266201 - DNA, 22 bp, Homo sapiens
atgattttcatttcatgaaaat

SEQ ID NO: 5266202 - DNA, 23 bp, Homo sapiens
atgattttctatttttcttctaa

SEQ ID NO: 5266203 - DNA, 15 bp, Homo sapiens
atgattttcttttgt

SEQ ID NO: 5266204 - DNA, 18 bp, Homo sapiens
atgattttgcaaaatgag

SEQ ID NO: 5266205 - DNA, 14 bp, Homo sapiens
atgattttgctgac

SEQ ID NO: 5266206 - DNA, 14 bp, Homo sapiens
atgatttttagact

SEQ ID NO: 5266207 - DNA, 11 bp, Homo sapiens
atgatttttgc

SEQ ID NO: 5266208 - DNA, 15 bp, Homo sapiens
atgatttttgccctg

SEQ ID NO: 5266209 - DNA, 17 bp, Homo sapiens
atgatttttgccctgcg

SEQ ID NO: 5266210 - DNA, 16 bp, Homo sapiens
atgatttttggtattt

SEQ ID NO: 5266211 - DNA, 20 bp, Homo sapiens
atgatttttggtatttatgt

SEQ ID NO: 5266212 - DNA, 22 bp, Homo sapiens
atgatttttggtatttatgtaa

SEQ ID NO: 5266213 - DNA, 18 bp, Homo sapiens
atgatttttgtgtatcca

SEQ ID NO: 5266214 - DNA, 20 bp, Homo sapiens
atgattttttacaaattatg

SEQ ID NO: 5266215 - DNA, 15 bp, Homo sapiens
atgatttttttttcc

SEQ ID NO: 5266216 - DNA, 17 bp, Homo sapiens
atgatttttttttccaa

SEQ ID NO: 5266217 - DNA, 15 bp, Homo sapiens
atgcaaaaaagaaac

SEQ ID NO: 5266218 - DNA, 14 bp, Homo sapiens
atgcaaaaaatctt

SEQ ID NO: 5266219 - DNA, 18 bp, Homo sapiens
atgcaaaaaatcttccaa

SEQ ID NO: 5266220 - DNA, 14 bp, Homo sapiens
atgcaaaaacatat

SEQ ID NO: 5266221 - DNA, 23 bp, Homo sapiens
atgcaaaaacatatgtctgtctt

SEQ ID NO: 5266222 - DNA, 19 bp, Homo sapiens
atgcaaaaataaccaagtc

SEQ ID NO: 5266223 - DNA, 13 bp, Homo sapiens
atgcaaaaatgaa

SEQ ID NO: 5266224 - DNA, 14 bp, Homo sapiens
atgcaaaaatgaat

SEQ ID NO: 5266225 - DNA, 18 bp, Homo sapiens
atgcaaaaatgacccaag

SEQ ID NO: 5266226 - DNA, 23 bp, Homo sapiens
atgcaaaaccttgtgaactgact

SEQ ID NO: 5266227 - DNA, 23 bp, Homo sapiens
atgcaaaaggttcactaaagcag

SEQ ID NO: 5266228 - DNA, 14 bp, Homo sapiens
atgcaaaagtgggg

SEQ ID NO: 5266229 - DNA, 15 bp, Homo sapiens
atgcaaaagttctca

SEQ ID NO: 5266230 - DNA, 21 bp, Homo sapiens
atgcaaaagttctgacttgac

SEQ ID NO: 5266231 - DNA, 16 bp, Homo sapiens
atgtttcactcctgct

SEQ ID NO: 5266232 - DNA, 13 bp, Homo sapiens
atgtttcacttaa

SEQ ID NO: 5266233 - DNA, 18 bp, Homo sapiens
atgtttcatacagctatt

SEQ ID NO: 5266234 - DNA, 20 bp, Homo sapiens
atgtttcatacagctattaa

SEQ ID NO: 5266235 - DNA, 12 bp, Homo sapiens
atgtttcatatt

SEQ ID NO: 5266236 - DNA, 21 bp, Homo sapiens
atgtttcattatgcactttta

SEQ ID NO: 5266237 - DNA, 18 bp, Homo sapiens
atgtttccaccaaatgaa

SEQ ID NO: 5266238 - DNA, 18 bp, Homo sapiens
atgtttccagaaaatata

SEQ ID NO: 5266239 - DNA, 20 bp, Homo sapiens
atgtttccagaaaatataaa

SEQ ID NO: 5266240 - DNA, 15 bp, Homo sapiens
atgtttccagacttc

SEQ ID NO: 5266241 - DNA, 13 bp, Homo sapiens
atgtttccagctg

SEQ ID NO: 5266242 - DNA, 16 bp, Homo sapiens
atgtttccagctgcca

SEQ ID NO: 5266243 - DNA, 21 bp, Homo sapiens
atgtttccatagctactatat

SEQ ID NO: 5266244 - DNA, 14 bp, Homo sapiens
atgtttcccccact

SEQ ID NO: 5266245 - DNA, 22 bp, Homo sapiens
atgtttcccgctccaagagaat

SEQ ID NO: 5266246 - DNA, 17 bp, Homo sapiens
atgtttcctgtggaaat

SEQ ID NO: 5266247 - DNA, 14 bp, Homo sapiens
atgtttccttccct

SEQ ID NO: 5266248 - DNA, 12 bp, Homo sapiens
atgtttccttgt

SEQ ID NO: 5266249 - DNA, 19 bp, Homo sapiens
atgtttctatatgtaactt

SEQ ID NO: 5266250 - DNA, 13 bp, Homo sapiens
atgtttctatctg

SEQ ID NO: 5266251 - DNA, 17 bp, Homo sapiens
atgtttctatttccata

SEQ ID NO: 5266252 - DNA, 11 bp, Homo sapiens
atgtttctcac

SEQ ID NO: 5266253 - DNA, 13 bp, Homo sapiens
atgtttctcacat

SEQ ID NO: 5266254 - DNA, 18 bp, Homo sapiens
atgtttctcacattgctg

SEQ ID NO: 5266255 - DNA, 12 bp, Homo sapiens
atgtttctctgg

SEQ ID NO: 5266256 - DNA, 17 bp, Homo sapiens
atgtttctctggcccca

SEQ ID NO: 5266257 - DNA, 23 bp, Homo sapiens
atgtttctctttgattatttgca

SEQ ID NO: 5266258 - DNA, 24 bp, Homo sapiens
atgtttctctttgattatttgcat

SEQ ID NO: 5266259 - DNA, 23 bp, Homo sapiens
atgtttctgcagtagtctctgtg

SEQ ID NO: 5266260 - DNA, 20 bp, Homo sapiens
atgtttctgcagtattctgt

SEQ ID NO: 5266261 - DNA, 21 bp, Homo sapiens
atgtttctggacattctcttt

SEQ ID NO: 5266262 - DNA, 21 bp, Homo sapiens
atgtttctgggtcctgaagaa

SEQ ID NO: 5266263 - DNA, 13 bp, Homo sapiens
atgtttctgtgaa

SEQ ID NO: 5266264 - DNA, 13 bp, Homo sapiens
atgtttcttcatt

SEQ ID NO: 5266265 - DNA, 20 bp, Homo sapiens
atgtttcttctttcttttaa

SEQ ID NO: 5266266 - DNA, 21 bp, Homo sapiens
atgtttcttgccttttgttaa

SEQ ID NO: 5266267 - DNA, 13 bp, Homo sapiens
atgtttctttgat

SEQ ID NO: 5266268 - DNA, 20 bp, Homo sapiens
atgtttcttttcccttaaat

SEQ ID NO: 5266269 - DNA, 11 bp, Homo sapiens
atgtttgaaaa

SEQ ID NO: 5266270 - DNA, 17 bp, Homo sapiens
atgtttgaaaacaaaaa

SEQ ID NO: 5266271 - DNA, 18 bp, Homo sapiens
atgtttgaaaatgctctt

SEQ ID NO: 5266272 - DNA, 19 bp, Homo sapiens
atgtttgaagagttccaag

SEQ ID NO: 5266273 - DNA, 21 bp, Homo sapiens
atgtttgaatatggacaagag

SEQ ID NO: 5266274 - DNA, 18 bp, Homo sapiens
atgtttgaatttttctct

SEQ ID NO: 5266275 - DNA, 20 bp, Homo sapiens
atgtttgaatttttctcttc

SEQ ID NO: 5266276 - DNA, 13 bp, Homo sapiens
atgtttgacttta

SEQ ID NO: 5266277 - DNA, 16 bp, Homo sapiens
atgtttgatcacacag

SEQ ID NO: 5266278 - DNA, 12 bp, Homo sapiens
atgtttgattta

SEQ ID NO: 5266279 - DNA, 17 bp, Homo sapiens
atgtttgcacctttcta

SEQ ID NO: 5266280 - DNA, 16 bp, Homo sapiens
atgtttgcacttgtga

SEQ ID NO: 5266281 - DNA, 13 bp, Homo sapiens
atgtttgcagtgt

SEQ ID NO: 5266282 - DNA, 14 bp, Homo sapiens
atgtttgcatataa

SEQ ID NO: 5266283 - DNA, 16 bp, Homo sapiens
atgtttgccaaataaa

SEQ ID NO: 5266284 - DNA, 13 bp, Homo sapiens
atgtttgcccaaa

SEQ ID NO: 5266285 - DNA, 21 bp, Homo sapiens
atgtttgccctgttcaaagta

SEQ ID NO: 5266286 - DNA, 16 bp, Homo sapiens
atgtttgcctcataat

SEQ ID NO: 5266287 - DNA, 18 bp, Homo sapiens
atgtttgcctcataatag

SEQ ID NO: 5266288 - DNA, 14 bp, Homo sapiens
atgtttgcctctgc

SEQ ID NO: 5266289 - DNA, 18 bp, Homo sapiens
atgtttgcctctgcctct

SEQ ID NO: 5266290 - DNA, 17 bp, Homo sapiens
atgtttgcgaatggctt

SEQ ID NO: 5266291 - DNA, 22 bp, Homo sapiens
atgtttgctcagaacacattct

SEQ ID NO: 5266292 - DNA, 14 bp, Homo sapiens
atgtttgctcctgt

SEQ ID NO: 5266293 - DNA, 23 bp, Homo sapiens
atgtttgctcttgtttttattaa

SEQ ID NO: 5266294 - DNA, 20 bp, Homo sapiens
atgtttgctgaacattggag

SEQ ID NO: 5266295 - DNA, 22 bp, Homo sapiens
atgtttggaaaaaactctgaag

SEQ ID NO: 5266296 - DNA, 18 bp, Homo sapiens
atgtttggaatttaagaa

SEQ ID NO: 5266297 - DNA, 22 bp, Homo sapiens
atgtttggacaccctgtcagac

SEQ ID NO: 5266298 - DNA, 16 bp, Homo sapiens
atgtttggcaagaaat

SEQ ID NO: 5266299 - DNA, 13 bp, Homo sapiens
atgtttggctgaa

SEQ ID NO: 5266300 - DNA, 18 bp, Homo sapiens
atgtttgggcagaaggga

SEQ ID NO: 5266301 - DNA, 23 bp, Homo sapiens
atgtttgggcagaagggagaagg

SEQ ID NO: 5266302 - DNA, 23 bp, Homo sapiens
atgtttggggatcgatgtgctca

SEQ ID NO: 5266303 - DNA, 18 bp, Homo sapiens
atgtttgggggaaaaaaa

SEQ ID NO: 5266304 - DNA, 19 bp, Homo sapiens
atgtttgggtgggttaagt

SEQ ID NO: 5266305 - DNA, 20 bp, Homo sapiens
atgtttggttttccaaaaga

SEQ ID NO: 5266306 - DNA, 23 bp, Homo sapiens
atgtttggttttccaaaagaaca

SEQ ID NO: 5266307 - DNA, 24 bp, Homo sapiens
atgtttgtaactttttacattaca

SEQ ID NO: 5266308 - DNA, 13 bp, Homo sapiens
atgtttgtacttt

SEQ ID NO: 5266309 - DNA, 13 bp, Homo sapiens
atgtttgtcagta

SEQ ID NO: 5266310 - DNA, 21 bp, Homo sapiens
atgtttgtctcagttggaaat

SEQ ID NO: 5266311 - DNA, 14 bp, Homo sapiens
atgtttgtgcatgt

SEQ ID NO: 5266312 - DNA, 17 bp, Homo sapiens
atgtttgtgcatgtata

SEQ ID NO: 5266313 - DNA, 19 bp, Homo sapiens
atgtttgtgccttaaaagg

SEQ ID NO: 5266314 - DNA, 13 bp, Homo sapiens
atgtttgtggcct

SEQ ID NO: 5266315 - DNA, 15 bp, Homo sapiens
atgtttgtggcctca

SEQ ID NO: 5266316 - DNA, 16 bp, Homo sapiens
atgtttgtggcctcag

SEQ ID NO: 5266317 - DNA, 19 bp, Homo sapiens
atgtttgtggttttgggaa

SEQ ID NO: 5266318 - DNA, 16 bp, Homo sapiens
atgtttgtgtctgtgg

SEQ ID NO: 5266319 - DNA, 17 bp, Homo sapiens
atgtttgtgtctgtggt

SEQ ID NO: 5266320 - DNA, 17 bp, Homo sapiens
atgtttgtgtgatttcc

SEQ ID NO: 5266321 - DNA, 18 bp, Homo sapiens
atgtttgtgtgatttcct

SEQ ID NO: 5266322 - DNA, 17 bp, Homo sapiens
atgtttgttaaaaataa

SEQ ID NO: 5266323 - DNA, 23 bp, Homo sapiens
atgtttgttatttacactggtct

SEQ ID NO: 5266324 - DNA, 22 bp, Homo sapiens
atgtttgtttatatcactgtct

SEQ ID NO: 5266325 - DNA, 18 bp, Homo sapiens
atgtttgtttcagtgcca

SEQ ID NO: 5266326 - DNA, 22 bp, Homo sapiens
atgtttgttttcaaaatacttc

SEQ ID NO: 5266327 - DNA, 19 bp, Homo sapiens
atgttttaaaaaaatttga

SEQ ID NO: 5266328 - DNA, 15 bp, Homo sapiens
atgttttaaaatcta

SEQ ID NO: 5266329 - DNA, 21 bp, Homo sapiens
atgttttaaaatctataacat

SEQ ID NO: 5266330 - DNA, 19 bp, Homo sapiens
atgttttaaagaagtccat

SEQ ID NO: 5266331 - DNA, 20 bp, Homo sapiens
atgttttaaatatagaattt

SEQ ID NO: 5266332 - DNA, 14 bp, Homo sapiens
atgttttaaatgta

SEQ ID NO: 5266333 - DNA, 16 bp, Homo sapiens
atgttttaacaaaaac

SEQ ID NO: 5266334 - DNA, 13 bp, Homo sapiens
atgttttaactta

SEQ ID NO: 5266335 - DNA, 16 bp, Homo sapiens
atgttttaattccatg

SEQ ID NO: 5266336 - DNA, 18 bp, Homo sapiens
atgttttacaatggctgg

SEQ ID NO: 5266337 - DNA, 18 bp, Homo sapiens
atgttttacgcaaggaag

SEQ ID NO: 5266338 - DNA, 20 bp, Homo sapiens
atgttttacgcaaggaagga

SEQ ID NO: 5266339 - DNA, 18 bp, Homo sapiens
atgttttacgtgcaaaca

SEQ ID NO: 5266340 - DNA, 23 bp, Homo sapiens
atgttttagacaaatactcatgt

SEQ ID NO: 5266341 - DNA, 21 bp, Homo sapiens
atgttttagagataaatattt

SEQ ID NO: 5266342 - DNA, 12 bp, Homo sapiens
atgttttagcat

SEQ ID NO: 5266343 - DNA, 17 bp, Homo sapiens
atgttttagcatttgta

SEQ ID NO: 5266344 - DNA, 20 bp, Homo sapiens
atgttttattatttctatta

SEQ ID NO: 5266345 - DNA, 16 bp, Homo sapiens
atgttttatttaaatg

SEQ ID NO: 5266346 - DNA, 15 bp, Homo sapiens
atgttttatttatca

SEQ ID NO: 5266347 - DNA, 15 bp, Homo sapiens
atgttttatttatga

SEQ ID NO: 5266348 - DNA, 12 bp, Homo sapiens
atgttttcaaat

SEQ ID NO: 5266349 - DNA, 18 bp, Homo sapiens
atgttttcaaatgttctc

SEQ ID NO: 5266350 - DNA, 16 bp, Homo sapiens
atgttttcaagttgca

SEQ ID NO: 5266351 - DNA, 17 bp, Homo sapiens
atgttttcaggctagat

SEQ ID NO: 5266352 - DNA, 21 bp, Homo sapiens
atgttttcaggctagatgtat

SEQ ID NO: 5266353 - DNA, 15 bp, Homo sapiens
atgttttcattatgt

SEQ ID NO: 5266354 - DNA, 19 bp, Homo sapiens
atgttttcattatgttcat

SEQ ID NO: 5266355 - DNA, 20 bp, Homo sapiens
atgttttccattgtttgaaa

SEQ ID NO: 5266356 - DNA, 17 bp, Homo sapiens
atgttttccttgccaaa

SEQ ID NO: 5266357 - DNA, 18 bp, Homo sapiens
atgttttccttttattca

SEQ ID NO: 5266358 - DNA, 18 bp, Homo sapiens
atgttttcgaaaatcaaa

SEQ ID NO: 5266359 - DNA, 22 bp, Homo sapiens
atgttttcgaaaatcaaatggt

SEQ ID NO: 5266360 - DNA, 17 bp, Homo sapiens
atgttttcgcaaatgtt

SEQ ID NO: 5266361 - DNA, 20 bp, Homo sapiens
atgttttctgaaaatataac

SEQ ID NO: 5266362 - DNA, 21 bp, Homo sapiens
atgttttctgaaaatataacc

SEQ ID NO: 5266363 - DNA, 11 bp, Homo sapiens
atgttttctgg

SEQ ID NO: 5266364 - DNA, 12 bp, Homo sapiens
atgttttctttc

SEQ ID NO: 5266365 - DNA, 15 bp, Homo sapiens
atgttttctttctca

SEQ ID NO: 5266366 - DNA, 16 bp, Homo sapiens
atgttttgaaagacag

SEQ ID NO: 5266367 - DNA, 14 bp, Homo sapiens
atgttttgaatgat

SEQ ID NO: 5266368 - DNA, 18 bp, Homo sapiens
atgttttgaatgtggata

SEQ ID NO: 5266369 - DNA, 12 bp, Homo sapiens
atgttttgacat

SEQ ID NO: 5266370 - DNA, 13 bp, Homo sapiens
atgttttgagaaa

SEQ ID NO: 5266371 - DNA, 20 bp, Homo sapiens
atgttttgataaagtagtaa

SEQ ID NO: 5266372 - DNA, 22 bp, Homo sapiens
atgttttgataaagtagtaaaa

SEQ ID NO: 5266373 - DNA, 23 bp, Homo sapiens
atgttttgatatttatttcctgc

SEQ ID NO: 5266374 - DNA, 15 bp, Homo sapiens
atgttttgatcaaat

SEQ ID NO: 5266375 - DNA, 14 bp, Homo sapiens
atgttttgatgcca

SEQ ID NO: 5266376 - DNA, 13 bp, Homo sapiens
atgttttgcaaag

SEQ ID NO: 5266377 - DNA, 12 bp, Homo sapiens
atgttttgctaa

SEQ ID NO: 5266378 - DNA, 14 bp, Homo sapiens
atgttttgctaatg

SEQ ID NO: 5266379 - DNA, 19 bp, Homo sapiens
atgttttggagagagcaat

SEQ ID NO: 5266380 - DNA, 18 bp, Homo sapiens
atgttttgggaaacactg

SEQ ID NO: 5266381 - DNA, 15 bp, Homo sapiens
atgttttggtatctg

SEQ ID NO: 5266382 - DNA, 23 bp, Homo sapiens
atgttttggtatctgttctttaa

SEQ ID NO: 5266383 - DNA, 15 bp, Homo sapiens
atgttttgtaaacat

SEQ ID NO: 5266384 - DNA, 16 bp, Homo sapiens
atgttttgtaaacatt

SEQ ID NO: 5266385 - DNA, 15 bp, Homo sapiens
atgttttgtaaactt

SEQ ID NO: 5266386 - DNA, 16 bp, Homo sapiens
atgttttgtaaacttt

SEQ ID NO: 5266387 - DNA, 17 bp, Homo sapiens
atgttttgtaaactttg

SEQ ID NO: 5266388 - DNA, 21 bp, Homo sapiens
atgttttgtaaactttgaaat

SEQ ID NO: 5266389 - DNA, 15 bp, Homo sapiens
atgttttgtataaaa

SEQ ID NO: 5266390 - DNA, 17 bp, Homo sapiens
atgttttgtataaaatc

SEQ ID NO: 5266391 - DNA, 20 bp, Homo sapiens
atgttttgtatatacagtta

SEQ ID NO: 5266392 - DNA, 23 bp, Homo sapiens
atgttttgtatatacagttattt

SEQ ID NO: 5266393 - DNA, 23 bp, Homo sapiens
atgttttgtcccatttccttgga

SEQ ID NO: 5266394 - DNA, 14 bp, Homo sapiens
atgttttgtgacta

SEQ ID NO: 5266395 - DNA, 23 bp, Homo sapiens
atgttttgtgcatttgtaaatgc

SEQ ID NO: 5266396 - DNA, 14 bp, Homo sapiens
atgttttgttcaaa

SEQ ID NO: 5266397 - DNA, 22 bp, Homo sapiens
atgttttgttttgtgtttttcc

SEQ ID NO: 5266398 - DNA, 12 bp, Homo sapiens
atgtttttaaaa

SEQ ID NO: 5266399 - DNA, 18 bp, Homo sapiens
atgtttttaaaagtttca

SEQ ID NO: 5266400 - DNA, 14 bp, Homo sapiens
atgtttttaaaatc

SEQ ID NO: 5266401 - DNA, 13 bp, Homo sapiens
atgtttttaatat

SEQ ID NO: 5266402 - DNA, 12 bp, Homo sapiens
atgtttttaatg

SEQ ID NO: 5266403 - DNA, 16 bp, Homo sapiens
atgtttttaatggcat

SEQ ID NO: 5266404 - DNA, 16 bp, Homo sapiens
atgtttttaatgtata

SEQ ID NO: 5266405 - DNA, 19 bp, Homo sapiens
atgtttttaatgtatagta

SEQ ID NO: 5266406 - DNA, 15 bp, Homo sapiens
atgtttttacattat

SEQ ID NO: 5266407 - DNA, 12 bp, Homo sapiens
atgtttttactg

SEQ ID NO: 5266408 - DNA, 22 bp, Homo sapiens
atgtttttagaggggcaaaaat

SEQ ID NO: 5266409 - DNA, 18 bp, Homo sapiens
atgtttttagttctgact

SEQ ID NO: 5266410 - DNA, 17 bp, Homo sapiens
atgcaaaatagacatct

SEQ ID NO: 5266411 - DNA, 23 bp, Homo sapiens
atgcaaaatcaggaaaggctgta

SEQ ID NO: 5266412 - DNA, 12 bp, Homo sapiens
atgcaaaatgga

SEQ ID NO: 5266413 - DNA, 12 bp, Homo sapiens
atgcaaaattag

SEQ ID NO: 5266414 - DNA, 12 bp, Homo sapiens
atgcaaaattgt

SEQ ID NO: 5266415 - DNA, 17 bp, Homo sapiens
atgcaaaattgttttca

SEQ ID NO: 5266416 - DNA, 23 bp, Homo sapiens
atgcaaaattgttttcacttgta

SEQ ID NO: 5266417 - DNA, 14 bp, Homo sapiens
atgcaaaatttaga

SEQ ID NO: 5266418 - DNA, 13 bp, Homo sapiens
atgcaaacactgt

SEQ ID NO: 5266419 - DNA, 17 bp, Homo sapiens
atgcaaacattggaaga

SEQ ID NO: 5266420 - DNA, 16 bp, Homo sapiens
atgcaaaccatcattg

SEQ ID NO: 5266421 - DNA, 19 bp, Homo sapiens
atgcaaaccatcattgaaa

SEQ ID NO: 5266422 - DNA, 15 bp, Homo sapiens
atgcaaactgcttta

SEQ ID NO: 5266423 - DNA, 15 bp, Homo sapiens
atgcaaagaggcaag

SEQ ID NO: 5266424 - DNA, 17 bp, Homo sapiens
atgcaaagcactctctg

SEQ ID NO: 5266425 - DNA, 13 bp, Homo sapiens
atgcaaagcactg

SEQ ID NO: 5266426 - DNA, 15 bp, Homo sapiens
atgcaaagcactgac

SEQ ID NO: 5266427 - DNA, 14 bp, Homo sapiens
atgcaaaggctggg

SEQ ID NO: 5266428 - DNA, 15 bp, Homo sapiens
atgcaaaggctggga

SEQ ID NO: 5266429 - DNA, 18 bp, Homo sapiens
atgcaaagtacaatgtgt

SEQ ID NO: 5266430 - DNA, 22 bp, Homo sapiens
atgcaaagtaccaactgagcca

SEQ ID NO: 5266431 - DNA, 13 bp, Homo sapiens
atgcaaagtataa

SEQ ID NO: 5266432 - DNA, 10 bp, Homo sapiens
atgcaaatac

SEQ ID NO: 5266433 - DNA, 11 bp, Homo sapiens
atgcaaataca

SEQ ID NO: 5266434 - DNA, 23 bp, Homo sapiens
atgcaaatagattcagagaaatt

SEQ ID NO: 5266435 - DNA, 16 bp, Homo sapiens
atgcaaatagcaaaac

SEQ ID NO: 5266436 - DNA, 18 bp, Homo sapiens
atgcaaatcaattactgg

SEQ ID NO: 5266437 - DNA, 21 bp, Homo sapiens
atgcaaatctgccaagagaga

SEQ ID NO: 5266438 - DNA, 22 bp, Homo sapiens
atgcaaatctggcttagtaaat

SEQ ID NO: 5266439 - DNA, 18 bp, Homo sapiens
atgcaaatgagttcagga

SEQ ID NO: 5266440 - DNA, 14 bp, Homo sapiens
atgcaaatgtcttc

SEQ ID NO: 5266441 - DNA, 20 bp, Homo sapiens
atgcaaatgttttgaaatga

SEQ ID NO: 5266442 - DNA, 12 bp, Homo sapiens
atgcaacaaaaa

SEQ ID NO: 5266443 - DNA, 20 bp, Homo sapiens
atgcaacaaaatatttaatt

SEQ ID NO: 5266444 - DNA, 19 bp, Homo sapiens
atgcaacaaatatttatat

SEQ ID NO: 5266445 - DNA, 21 bp, Homo sapiens
atgcaacaaatgaattttcca

SEQ ID NO: 5266446 - DNA, 14 bp, Homo sapiens
atgcaacaacatgt

SEQ ID NO: 5266447 - DNA, 22 bp, Homo sapiens
atgcaacagaaaagccttttaa

SEQ ID NO: 5266448 - DNA, 14 bp, Homo sapiens
atgcaacagaagtg

SEQ ID NO: 5266449 - DNA, 19 bp, Homo sapiens
atgcaacatgtgtacttaa

SEQ ID NO: 5266450 - DNA, 17 bp, Homo sapiens
atgcaaccaaaagggaa

SEQ ID NO: 5266451 - DNA, 18 bp, Homo sapiens
atgcaaccaaaagggaaa

SEQ ID NO: 5266452 - DNA, 18 bp, Homo sapiens
atgcaaccaagtcacacg

SEQ ID NO: 5266453 - DNA, 21 bp, Homo sapiens
atgcaaccaagtcacacgctt

SEQ ID NO: 5266454 - DNA, 20 bp, Homo sapiens
atgcaaccagaattgtcctc

SEQ ID NO: 5266455 - DNA, 17 bp, Homo sapiens
atgcaaccagataaaga

SEQ ID NO: 5266456 - DNA, 19 bp, Homo sapiens
atgcaacctgtgcaaaata

SEQ ID NO: 5266457 - DNA, 15 bp, Homo sapiens
atgcaacgcaggagg

SEQ ID NO: 5266458 - DNA, 20 bp, Homo sapiens
atgcaactaattcaataaaa

SEQ ID NO: 5266459 - DNA, 15 bp, Homo sapiens
atgcaactccatgcc

SEQ ID NO: 5266460 - DNA, 17 bp, Homo sapiens
atgcaactccatgccta

SEQ ID NO: 5266461 - DNA, 20 bp, Homo sapiens
atgcaactctaactctgaga

SEQ ID NO: 5266462 - DNA, 21 bp, Homo sapiens
atgcaactctaactctgagag

SEQ ID NO: 5266463 - DNA, 22 bp, Homo sapiens
atgcaagaagaatataaataaa

SEQ ID NO: 5266464 - DNA, 22 bp, Homo sapiens
atgcaagacttcactgcagcct

SEQ ID NO: 5266465 - DNA, 17 bp, Homo sapiens
atgcaagagaaggagat

SEQ ID NO: 5266466 - DNA, 18 bp, Homo sapiens
atgcaagagtggactgaa

SEQ ID NO: 5266467 - DNA, 15 bp, Homo sapiens
atgcaagagtttctt

SEQ ID NO: 5266468 - DNA, 15 bp, Homo sapiens
atgcaagatacagga

SEQ ID NO: 5266469 - DNA, 23 bp, Homo sapiens
atgcaagatagtttatctaactt

SEQ ID NO: 5266470 - DNA, 14 bp, Homo sapiens
atgcaagcagagga

SEQ ID NO: 5266471 - DNA, 15 bp, Homo sapiens
atgcaagcagctttt

SEQ ID NO: 5266472 - DNA, 16 bp, Homo sapiens
atgcaagcagcttttt

SEQ ID NO: 5266473 - DNA, 23 bp, Homo sapiens
atgcaagcagtttcaataaagtt

SEQ ID NO: 5266474 - DNA, 13 bp, Homo sapiens
atgcaagccagct

SEQ ID NO: 5266475 - DNA, 22 bp, Homo sapiens
atgcaagccagcttcctgtgca

SEQ ID NO: 5266476 - DNA, 18 bp, Homo sapiens
atgcaagccccaactttc

SEQ ID NO: 5266477 - DNA, 17 bp, Homo sapiens
atgcaagcttggtcaaa

SEQ ID NO: 5266478 - DNA, 19 bp, Homo sapiens
atgcaagcttggtcaaact

SEQ ID NO: 5266479 - DNA, 18 bp, Homo sapiens
atgcaaggaaggaaagaa

SEQ ID NO: 5266480 - DNA, 22 bp, Homo sapiens
atgcaaggaccaggactccctc

SEQ ID NO: 5266481 - DNA, 18 bp, Homo sapiens
atgcaaggattacagaaa

SEQ ID NO: 5266482 - DNA, 21 bp, Homo sapiens
atgcaaggattacagaaactg

SEQ ID NO: 5266483 - DNA, 22 bp, Homo sapiens
atgcaaggattacagaaactga

SEQ ID NO: 5266484 - DNA, 13 bp, Homo sapiens
atgcaagggactg

SEQ ID NO: 5266485 - DNA, 15 bp, Homo sapiens
atgcaagtaaaaaaa

SEQ ID NO: 5266486 - DNA, 16 bp, Homo sapiens
atgcaagtattctcat

SEQ ID NO: 5266487 - DNA, 23 bp, Homo sapiens
atgcaagtcactaaatttctcag

SEQ ID NO: 5266488 - DNA, 18 bp, Homo sapiens
atgcaagtcaggaatcat

SEQ ID NO: 5266489 - DNA, 17 bp, Homo sapiens
atgcaagtctgtgagtg

SEQ ID NO: 5266490 - DNA, 22 bp, Homo sapiens
atgcaagtgggagatgaaaacc

SEQ ID NO: 5266491 - DNA, 18 bp, Homo sapiens
atgcaagtgtttctgttc

SEQ ID NO: 5266492 - DNA, 21 bp, Homo sapiens
atgcaagttattttatttgct

SEQ ID NO: 5266493 - DNA, 23 bp, Homo sapiens
atgcaataaaatttaaaaaataa

SEQ ID NO: 5266494 - DNA, 18 bp, Homo sapiens
atgcaataaagagtaaat

SEQ ID NO: 5266495 - DNA, 22 bp, Homo sapiens
atgcaataaagagtaaatatac

SEQ ID NO: 5266496 - DNA, 23 bp, Homo sapiens
atgcaataaagagtaaatatact

SEQ ID NO: 5266497 - DNA, 12 bp, Homo sapiens
atgcaataaata

SEQ ID NO: 5266498 - DNA, 13 bp, Homo sapiens
atgcaataaataa

SEQ ID NO: 5266499 - DNA, 13 bp, Homo sapiens
atgcaataaatat

SEQ ID NO: 5266500 - DNA, 16 bp, Homo sapiens
atgcaataaatattat

SEQ ID NO: 5266501 - DNA, 19 bp, Homo sapiens
atgcaataatccaccccca

SEQ ID NO: 5266502 - DNA, 12 bp, Homo sapiens
atgcaataattt

SEQ ID NO: 5266503 - DNA, 14 bp, Homo sapiens
atgcaataatttta

SEQ ID NO: 5266504 - DNA, 23 bp, Homo sapiens
atgcaatagaagtgctcccctct

SEQ ID NO: 5266505 - DNA, 20 bp, Homo sapiens
atgcaatatatctaaattga

SEQ ID NO: 5266506 - DNA, 13 bp, Homo sapiens
atgcaatatgtat

SEQ ID NO: 5266507 - DNA, 22 bp, Homo sapiens
atgcaatatgtttatcaactca

SEQ ID NO: 5266508 - DNA, 22 bp, Homo sapiens
atgcaatattggatgaaaagag

SEQ ID NO: 5266509 - DNA, 21 bp, Homo sapiens
atgcaatcaaaaatatgtgtt

SEQ ID NO: 5266510 - DNA, 16 bp, Homo sapiens
atgcaatcagacaagt

SEQ ID NO: 5266511 - DNA, 19 bp, Homo sapiens
atgcaatcctacttctata

SEQ ID NO: 5266512 - DNA, 15 bp, Homo sapiens
atgcaatccttacaa

SEQ ID NO: 5266513 - DNA, 21 bp, Homo sapiens
atgcaatccttacaaatgatt

SEQ ID NO: 5266514 - DNA, 13 bp, Homo sapiens
atgcaatctcttt

SEQ ID NO: 5266515 - DNA, 16 bp, Homo sapiens
atgcaatgaaaacaaa

SEQ ID NO: 5266516 - DNA, 15 bp, Homo sapiens
atgcaatgaaacaga

SEQ ID NO: 5266517 - DNA, 13 bp, Homo sapiens
atgcaatgcatct

SEQ ID NO: 5266518 - DNA, 17 bp, Homo sapiens
atgcaatgcatctgaaa

SEQ ID NO: 5266519 - DNA, 22 bp, Homo sapiens
atgcaatgcatctgaaagtttt

SEQ ID NO: 5266520 - DNA, 18 bp, Homo sapiens
atgcaatgtatagtgtct

SEQ ID NO: 5266521 - DNA, 22 bp, Homo sapiens
atgcaatgtatggcttttctct

SEQ ID NO: 5266522 - DNA, 16 bp, Homo sapiens
atgcaatgtcttaaat

SEQ ID NO: 5266523 - DNA, 23 bp, Homo sapiens
atgcaatgtcttaaataaaacta

SEQ ID NO: 5266524 - DNA, 14 bp, Homo sapiens
atgcaatgtgaagc

SEQ ID NO: 5266525 - DNA, 13 bp, Homo sapiens
atgcaattaaaac

SEQ ID NO: 5266526 - DNA, 20 bp, Homo sapiens
atgcaattggggaagaaaaa

SEQ ID NO: 5266527 - DNA, 22 bp, Homo sapiens
atgcaattggggaagaaaaaat

SEQ ID NO: 5266528 - DNA, 21 bp, Homo sapiens
atgcaattgttgaaagctttg

SEQ ID NO: 5266529 - DNA, 17 bp, Homo sapiens
atgcaatttacttggaa

SEQ ID NO: 5266530 - DNA, 21 bp, Homo sapiens
atgcaatttgataatcagttt

SEQ ID NO: 5266531 - DNA, 17 bp, Homo sapiens
atgcaatttttaaacta

SEQ ID NO: 5266532 - DNA, 21 bp, Homo sapiens
atgcaatttttaaactagtaa

SEQ ID NO: 5266533 - DNA, 17 bp, Homo sapiens
atgcaatttttctttct

SEQ ID NO: 5266534 - DNA, 23 bp, Homo sapiens
atgcacaaattctgtctctggat

SEQ ID NO: 5266535 - DNA, 16 bp, Homo sapiens
atgcacaagaatggat

SEQ ID NO: 5266536 - DNA, 14 bp, Homo sapiens
atgcacaagatgcc

SEQ ID NO: 5266537 - DNA, 21 bp, Homo sapiens
atgcacaatgtagataagtgt

SEQ ID NO: 5266538 - DNA, 16 bp, Homo sapiens
atgcacaatgtcttgg

SEQ ID NO: 5266539 - DNA, 12 bp, Homo sapiens
atgcacaattta

SEQ ID NO: 5266540 - DNA, 17 bp, Homo sapiens
atgcacaatttagaaaa

SEQ ID NO: 5266541 - DNA, 19 bp, Homo sapiens
atgcacaatttagaaaaca

SEQ ID NO: 5266542 - DNA, 20 bp, Homo sapiens
atgcacaatttagaaaacat

SEQ ID NO: 5266543 - DNA, 15 bp, Homo sapiens
atgcacacaaaacaa

SEQ ID NO: 5266544 - DNA, 19 bp, Homo sapiens
atgcacacaaacacctcct

SEQ ID NO: 5266545 - DNA, 22 bp, Homo sapiens
atgcacacaaacacctcctagc

SEQ ID NO: 5266546 - DNA, 10 bp, Homo sapiens
atgcacacac

SEQ ID NO: 5266547 - DNA, 16 bp, Homo sapiens
atgcacacacacacac

SEQ ID NO: 5266548 - DNA, 15 bp, Homo sapiens
atgcacacacatata

SEQ ID NO: 5266549 - DNA, 21 bp, Homo sapiens
atgcacacagcggctgcctcc

SEQ ID NO: 5266550 - DNA, 21 bp, Homo sapiens
atgcacacagtgctttccgtg

SEQ ID NO: 5266551 - DNA, 13 bp, Homo sapiens
atgcacacatttt

SEQ ID NO: 5266552 - DNA, 22 bp, Homo sapiens
atgcacacattttttaaatgca

SEQ ID NO: 5266553 - DNA, 13 bp, Homo sapiens
atgcacaccaaat

SEQ ID NO: 5266554 - DNA, 18 bp, Homo sapiens
atgcacaccaaattgctg

SEQ ID NO: 5266555 - DNA, 21 bp, Homo sapiens
atgcacacgcacatagagata

SEQ ID NO: 5266556 - DNA, 22 bp, Homo sapiens
atgcacacggctggtcactctg

SEQ ID NO: 5266557 - DNA, 22 bp, Homo sapiens
atgcacactagcctctccagga

SEQ ID NO: 5266558 - DNA, 13 bp, Homo sapiens
atgcacactgttg

SEQ ID NO: 5266559 - DNA, 19 bp, Homo sapiens
atgcacactgttggaatgt

SEQ ID NO: 5266560 - DNA, 14 bp, Homo sapiens
atgcacacttctga

SEQ ID NO: 5266561 - DNA, 16 bp, Homo sapiens
atgcacagagaagctg

SEQ ID NO: 5266562 - DNA, 13 bp, Homo sapiens
atgcacagagata

SEQ ID NO: 5266563 - DNA, 19 bp, Homo sapiens
atgcacagagatatgcaca

SEQ ID NO: 5266564 - DNA, 19 bp, Homo sapiens
atgcacagagcccaatgca

SEQ ID NO: 5266565 - DNA, 16 bp, Homo sapiens
atgcacagagttgtta

SEQ ID NO: 5266566 - DNA, 17 bp, Homo sapiens
atgcacagagttgttac

SEQ ID NO: 5266567 - DNA, 12 bp, Homo sapiens
atgcacagccta

SEQ ID NO: 5266568 - DNA, 14 bp, Homo sapiens
atgcacagctaaca

SEQ ID NO: 5266569 - DNA, 13 bp, Homo sapiens
atgcacagctgct

SEQ ID NO: 5266570 - DNA, 14 bp, Homo sapiens
atgcacagctgctt

SEQ ID NO: 5266571 - DNA, 16 bp, Homo sapiens
atgcacagctgcttgt

SEQ ID NO: 5266572 - DNA, 20 bp, Homo sapiens
atgcacagtacaataatgta

SEQ ID NO: 5266573 - DNA, 18 bp, Homo sapiens
atgcacagtatctgctgt

SEQ ID NO: 5266574 - DNA, 19 bp, Homo sapiens
atgcacagtatctgctgtt

SEQ ID NO: 5266575 - DNA, 15 bp, Homo sapiens
atgcacagtatttgt

SEQ ID NO: 5266576 - DNA, 13 bp, Homo sapiens
atgcacagtgcct

SEQ ID NO: 5266577 - DNA, 12 bp, Homo sapiens
atgcacagttct

SEQ ID NO: 5266578 - DNA, 21 bp, Homo sapiens
atgcacagttctatttgctat

SEQ ID NO: 5266579 - DNA, 15 bp, Homo sapiens
atgcacagtttgcaa

SEQ ID NO: 5266580 - DNA, 17 bp, Homo sapiens
atgcacatccattccca

SEQ ID NO: 5266581 - DNA, 18 bp, Homo sapiens
atgcacatcctcattcac

SEQ ID NO: 5266582 - DNA, 17 bp, Homo sapiens
atgcacatgaacttaga

SEQ ID NO: 5266583 - DNA, 23 bp, Homo sapiens
atgcacatgctgtctggccctgg

SEQ ID NO: 5266584 - DNA, 15 bp, Homo sapiens
atgcacatgtattct

SEQ ID NO: 5266585 - DNA, 23 bp, Homo sapiens
atgcacattcatcctcacatgtg

SEQ ID NO: 5266586 - DNA, 18 bp, Homo sapiens
atgcacatttcaaaacaa

SEQ ID NO: 5266587 - DNA, 17 bp, Homo sapiens
atgcacatttctggatt

SEQ ID NO: 5266588 - DNA, 22 bp, Homo sapiens
atgtttttagttctgactttga

SEQ ID NO: 5266589 - DNA, 21 bp, Homo sapiens
atgtttttataaaaataaata

SEQ ID NO: 5266590 - DNA, 12 bp, Homo sapiens
atgtttttatac

SEQ ID NO: 5266591 - DNA, 15 bp, Homo sapiens
atgtttttatacaaa

SEQ ID NO: 5266592 - DNA, 16 bp, Homo sapiens
atgtttttatatgtct

SEQ ID NO: 5266593 - DNA, 22 bp, Homo sapiens
atgtttttatttcaattgttta

SEQ ID NO: 5266594 - DNA, 22 bp, Homo sapiens
atgtttttcagttcaaagtcat

SEQ ID NO: 5266595 - DNA, 16 bp, Homo sapiens
atgtttttctaaagga

SEQ ID NO: 5266596 - DNA, 21 bp, Homo sapiens
atgtttttctcaaaaagctgc

SEQ ID NO: 5266597 - DNA, 18 bp, Homo sapiens
atgtttttcttctccctc

SEQ ID NO: 5266598 - DNA, 21 bp, Homo sapiens
atgtttttgaaggcagaaagc

SEQ ID NO: 5266599 - DNA, 19 bp, Homo sapiens
atgttttttagatcaaata

SEQ ID NO: 5266600 - DNA, 16 bp, Homo sapiens
atgttttttattatgc

SEQ ID NO: 5266601 - DNA, 20 bp, Homo sapiens
atgttttttccttttcacat

SEQ ID NO: 5266602 - DNA, 16 bp, Homo sapiens
atgttttttctgcaat

SEQ ID NO: 5266603 - DNA, 21 bp, Homo sapiens
atgttttttctgcaatgactg

SEQ ID NO: 5266604 - DNA, 17 bp, Homo sapiens
atgttttttgaagttct

SEQ ID NO: 5266605 - DNA, 16 bp, Homo sapiens
atgttttttgtaagat

SEQ ID NO: 5266606 - DNA, 17 bp, Homo sapiens
attaaaaaaaaaaacta

SEQ ID NO: 5266607 - DNA, 21 bp, Homo sapiens
attaaaaaaaaatactctttc

SEQ ID NO: 5266608 - DNA, 15 bp, Homo sapiens
attaaaaaaaaattg

SEQ ID NO: 5266609 - DNA, 13 bp, Homo sapiens
attaaaaaaacac

SEQ ID NO: 5266610 - DNA, 14 bp, Homo sapiens
attaaaaaaacaca

SEQ ID NO: 5266611 - DNA, 13 bp, Homo sapiens
attaaaaaaataa

SEQ ID NO: 5266612 - DNA, 16 bp, Homo sapiens
attaaaaaaatgtggt

SEQ ID NO: 5266613 - DNA, 22 bp, Homo sapiens
attaaaaaacagcttgttctag

SEQ ID NO: 5266614 - DNA, 16 bp, Homo sapiens
attaaaaaagagacat

SEQ ID NO: 5266615 - DNA, 13 bp, Homo sapiens
attaaaaacatga

SEQ ID NO: 5266616 - DNA, 17 bp, Homo sapiens
attaaaaacatgaccac

SEQ ID NO: 5266617 - DNA, 12 bp, Homo sapiens
attaaaaaccac

SEQ ID NO: 5266618 - DNA, 13 bp, Homo sapiens
attaaaaactgag

SEQ ID NO: 5266619 - DNA, 15 bp, Homo sapiens
attaaaaactgctta

SEQ ID NO: 5266620 - DNA, 19 bp, Homo sapiens
attaaaaagaataaacaca

SEQ ID NO: 5266621 - DNA, 19 bp, Homo sapiens
attaaaaagccttacagtt

SEQ ID NO: 5266622 - DNA, 22 bp, Homo sapiens
attaaaaagggagaaagaaaac

SEQ ID NO: 5266623 - DNA, 19 bp, Homo sapiens
attaaaaaggtttacagaa

SEQ ID NO: 5266624 - DNA, 13 bp, Homo sapiens
attaaaaagtctt

SEQ ID NO: 5266625 - DNA, 15 bp, Homo sapiens
attaaaaagtctttt

SEQ ID NO: 5266626 - DNA, 18 bp, Homo sapiens
attaaaaagtcttttaaa

SEQ ID NO: 5266627 - DNA, 13 bp, Homo sapiens
attaaaaagttaa

SEQ ID NO: 5266628 - DNA, 21 bp, Homo sapiens
attaaaaataccttctatgta

SEQ ID NO: 5266629 - DNA, 13 bp, Homo sapiens
attaaaaatataa

SEQ ID NO: 5266630 - DNA, 15 bp, Homo sapiens
attaaaaatataaaa

SEQ ID NO: 5266631 - DNA, 18 bp, Homo sapiens
attaaaaatataaacaat

SEQ ID NO: 5266632 - DNA, 23 bp, Homo sapiens
attaaaaatctcaaatttctaaa

SEQ ID NO: 5266633 - DNA, 22 bp, Homo sapiens
attaaaaatgaccactctttta

SEQ ID NO: 5266634 - DNA, 20 bp, Homo sapiens
attaaaaatgagatttctta

SEQ ID NO: 5266635 - DNA, 14 bp, Homo sapiens
attaaaaatgcttt

SEQ ID NO: 5266636 - DNA, 18 bp, Homo sapiens
attaaaaatggtaaaatt

SEQ ID NO: 5266637 - DNA, 23 bp, Homo sapiens
attaaaaatggtaaaattgcatg

SEQ ID NO: 5266638 - DNA, 14 bp, Homo sapiens
attaaaaatgttct

SEQ ID NO: 5266639 - DNA, 18 bp, Homo sapiens
attaaaaatgttctcaaa

SEQ ID NO: 5266640 - DNA, 13 bp, Homo sapiens
attaaaaattata

SEQ ID NO: 5266641 - DNA, 15 bp, Homo sapiens
attaaaaattataga

SEQ ID NO: 5266642 - DNA, 22 bp, Homo sapiens
attaaaacaaaagggtgtatag

SEQ ID NO: 5266643 - DNA, 21 bp, Homo sapiens
attaaaacaagagaccacttc

SEQ ID NO: 5266644 - DNA, 12 bp, Homo sapiens
attaaaacaata

SEQ ID NO: 5266645 - DNA, 23 bp, Homo sapiens
attaaaacacattatgtatctta

SEQ ID NO: 5266646 - DNA, 19 bp, Homo sapiens
attaaaacatatttcattt

SEQ ID NO: 5266647 - DNA, 14 bp, Homo sapiens
attaaaacattgga

SEQ ID NO: 5266648 - DNA, 21 bp, Homo sapiens
attaaaacctgggattatata

SEQ ID NO: 5266649 - DNA, 16 bp, Homo sapiens
attaaaaccttaagag

SEQ ID NO: 5266650 - DNA, 16 bp, Homo sapiens
attaaaacgggaatca

SEQ ID NO: 5266651 - DNA, 20 bp, Homo sapiens
attaaaactaggtaatgttt

SEQ ID NO: 5266652 - DNA, 18 bp, Homo sapiens
attaaaactgaagtctga

SEQ ID NO: 5266653 - DNA, 12 bp, Homo sapiens
attaaaactgag

SEQ ID NO: 5266654 - DNA, 14 bp, Homo sapiens
attaaaactgagtc

SEQ ID NO: 5266655 - DNA, 12 bp, Homo sapiens
attaaaactgct

SEQ ID NO: 5266656 - DNA, 16 bp, Homo sapiens
attaaaactgcttttt

SEQ ID NO: 5266657 - DNA, 21 bp, Homo sapiens
attaaaacttcttaaatatct

SEQ ID NO: 5266658 - DNA, 13 bp, Homo sapiens
attaaaacttggg

SEQ ID NO: 5266659 - DNA, 16 bp, Homo sapiens
attaaaactttgtaga

SEQ ID NO: 5266660 - DNA, 20 bp, Homo sapiens
attaaaactttgtagacatt

SEQ ID NO: 5266661 - DNA, 23 bp, Homo sapiens
attaaaactttgtagacattttg

SEQ ID NO: 5266662 - DNA, 14 bp, Homo sapiens
attaaaagaatatc

SEQ ID NO: 5266663 - DNA, 16 bp, Homo sapiens
attaaaagaatatctg

SEQ ID NO: 5266664 - DNA, 15 bp, Homo sapiens
attaaaagaatattt

SEQ ID NO: 5266665 - DNA, 14 bp, Homo sapiens
attaaaagaatgag

SEQ ID NO: 5266666 - DNA, 22 bp, Homo sapiens
attaaaagaatgagtgaagtat

SEQ ID NO: 5266667 - DNA, 16 bp, Homo sapiens
attaaaagacaaatat

SEQ ID NO: 5266668 - DNA, 19 bp, Homo sapiens
attaaaagacaaatatgta

SEQ ID NO: 5266669 - DNA, 12 bp, Homo sapiens
attaaaagactc

SEQ ID NO: 5266670 - DNA, 16 bp, Homo sapiens
attaaaagcaaatcat

SEQ ID NO: 5266671 - DNA, 22 bp, Homo sapiens
attaaaagggattacccaagca

SEQ ID NO: 5266672 - DNA, 14 bp, Homo sapiens
attaaaagttcata

SEQ ID NO: 5266673 - DNA, 13 bp, Homo sapiens
attaaaataaaac

SEQ ID NO: 5266674 - DNA, 15 bp, Homo sapiens
attaaaataaaacaa

SEQ ID NO: 5266675 - DNA, 18 bp, Homo sapiens
attaaaataaaacaagcc

SEQ ID NO: 5266676 - DNA, 19 bp, Homo sapiens
attaaaataaaacaagcct

SEQ ID NO: 5266677 - DNA, 20 bp, Homo sapiens
attaaaataaaacaagcctt

SEQ ID NO: 5266678 - DNA, 17 bp, Homo sapiens
attaaaataaaccaaat

SEQ ID NO: 5266679 - DNA, 20 bp, Homo sapiens
attaaaataactaagcaagt

SEQ ID NO: 5266680 - DNA, 14 bp, Homo sapiens
attaaaataactat

SEQ ID NO: 5266681 - DNA, 21 bp, Homo sapiens
attaaaatacagctgcactga

SEQ ID NO: 5266682 - DNA, 19 bp, Homo sapiens
attaaaatactatgcagta

SEQ ID NO: 5266683 - DNA, 15 bp, Homo sapiens
attaaaatagcatac

SEQ ID NO: 5266684 - DNA, 18 bp, Homo sapiens
attaaaatataatctcta

SEQ ID NO: 5266685 - DNA, 15 bp, Homo sapiens
attaaaatatatgtt

SEQ ID NO: 5266686 - DNA, 14 bp, Homo sapiens
attaaaatatgaag

SEQ ID NO: 5266687 - DNA, 18 bp, Homo sapiens
attaaaatatgcactaag

SEQ ID NO: 5266688 - DNA, 20 bp, Homo sapiens
attaaaatatgcactaagtc

SEQ ID NO: 5266689 - DNA, 12 bp, Homo sapiens
attaaaatatta

SEQ ID NO: 5266690 - DNA, 18 bp, Homo sapiens
attaaaatattatttgat

SEQ ID NO: 5266691 - DNA, 19 bp, Homo sapiens
attaaaatattttcttaat

SEQ ID NO: 5266692 - DNA, 16 bp, Homo sapiens
attaaaatattttgga

SEQ ID NO: 5266693 - DNA, 18 bp, Homo sapiens
attaaaatctacagaact

SEQ ID NO: 5266694 - DNA, 16 bp, Homo sapiens
attaaaatctggaaat

SEQ ID NO: 5266695 - DNA, 21 bp, Homo sapiens
attaaaatctggcaaagttat

SEQ ID NO: 5266696 - DNA, 15 bp, Homo sapiens
attaaaatcttgaaa

SEQ ID NO: 5266697 - DNA, 23 bp, Homo sapiens
attaaaatcttgaaagcgaaata

SEQ ID NO: 5266698 - DNA, 15 bp, Homo sapiens
attaaaatctttctt

SEQ ID NO: 5266699 - DNA, 13 bp, Homo sapiens
attaaaatgaata

SEQ ID NO: 5266700 - DNA, 21 bp, Homo sapiens
attaaaatgacaaacatgata

SEQ ID NO: 5266701 - DNA, 14 bp, Homo sapiens
attaaaatgcttcc

SEQ ID NO: 5266702 - DNA, 22 bp, Homo sapiens
attaaaatggatttaatccatt

SEQ ID NO: 5266703 - DNA, 18 bp, Homo sapiens
attaaaatgtaggaagaa

SEQ ID NO: 5266704 - DNA, 22 bp, Homo sapiens
attaaaatgtaggaagaaaaat

SEQ ID NO: 5266705 - DNA, 23 bp, Homo sapiens
attaaaatgtatgcatgttgtct

SEQ ID NO: 5266706 - DNA, 22 bp, Homo sapiens
attaaaatgtcggatttatctt

SEQ ID NO: 5266707 - DNA, 13 bp, Homo sapiens
attaaaattaaat

SEQ ID NO: 5266708 - DNA, 12 bp, Homo sapiens
attaaaattaag

SEQ ID NO: 5266709 - DNA, 16 bp, Homo sapiens
attaaaattaaggtct

SEQ ID NO: 5266710 - DNA, 21 bp, Homo sapiens
attaaaattacagatgtgaaa

SEQ ID NO: 5266711 - DNA, 22 bp, Homo sapiens
attaaaattacagatgtgaaaa

SEQ ID NO: 5266712 - DNA, 13 bp, Homo sapiens
attaaaattagtg

SEQ ID NO: 5266713 - DNA, 19 bp, Homo sapiens
attaaaattgccattttat

SEQ ID NO: 5266714 - DNA, 14 bp, Homo sapiens
attaaaattgtgca

SEQ ID NO: 5266715 - DNA, 15 bp, Homo sapiens
attaaaatttaacat

SEQ ID NO: 5266716 - DNA, 17 bp, Homo sapiens
attaaaatttaacatct

SEQ ID NO: 5266717 - DNA, 15 bp, Homo sapiens
attaaaatttattct

SEQ ID NO: 5266718 - DNA, 13 bp, Homo sapiens
attaaaattttcc

SEQ ID NO: 5266719 - DNA, 21 bp, Homo sapiens
attaaaattttcctttatgat

SEQ ID NO: 5266720 - DNA, 13 bp, Homo sapiens
attaaaatttttt

SEQ ID NO: 5266721 - DNA, 19 bp, Homo sapiens
attaaacaatttattttat

SEQ ID NO: 5266722 - DNA, 20 bp, Homo sapiens
attaaacaatttattttatt

SEQ ID NO: 5266723 - DNA, 21 bp, Homo sapiens
attaaacagaaggtaatagga

SEQ ID NO: 5266724 - DNA, 19 bp, Homo sapiens
attaaacagatgatgagaa

SEQ ID NO: 5266725 - DNA, 18 bp, Homo sapiens
attaaacagatttttaca

SEQ ID NO: 5266726 - DNA, 13 bp, Homo sapiens
attaaacagcaaa

SEQ ID NO: 5266727 - DNA, 22 bp, Homo sapiens
attaaacaggtggttcttttta

SEQ ID NO: 5266728 - DNA, 15 bp, Homo sapiens
attaaacataaaaca

SEQ ID NO: 5266729 - DNA, 23 bp, Homo sapiens
attaaacatgactccatagacct

SEQ ID NO: 5266730 - DNA, 14 bp, Homo sapiens
attaaacattttca

SEQ ID NO: 5266731 - DNA, 17 bp, Homo sapiens
attaaaccaagcagctt

SEQ ID NO: 5266732 - DNA, 21 bp, Homo sapiens
attaaaccaatgaagaagaca

SEQ ID NO: 5266733 - DNA, 17 bp, Homo sapiens
attaaaccatctccctg

SEQ ID NO: 5266734 - DNA, 12 bp, Homo sapiens
attaaacctgga

SEQ ID NO: 5266735 - DNA, 16 bp, Homo sapiens
attaaacctgtctcca

SEQ ID NO: 5266736 - DNA, 17 bp, Homo sapiens
attaaacctttccattt

SEQ ID NO: 5266737 - DNA, 15 bp, Homo sapiens
attaaacggattatt

SEQ ID NO: 5266738 - DNA, 16 bp, Homo sapiens
attaaacggattattt

SEQ ID NO: 5266739 - DNA, 22 bp, Homo sapiens
attaaacggattattttttcag

SEQ ID NO: 5266740 - DNA, 16 bp, Homo sapiens
attaaacgtaaatgtt

SEQ ID NO: 5266741 - DNA, 17 bp, Homo sapiens
attaaacgtaaatgttt

SEQ ID NO: 5266742 - DNA, 20 bp, Homo sapiens
attaaacgtatgcatgtgaa

SEQ ID NO: 5266743 - DNA, 19 bp, Homo sapiens
attaaacgtgtaaattgca

SEQ ID NO: 5266744 - DNA, 16 bp, Homo sapiens
attaaactaaaataca

SEQ ID NO: 5266745 - DNA, 19 bp, Homo sapiens
attaaactgaatagttcag

SEQ ID NO: 5266746 - DNA, 15 bp, Homo sapiens
attaaactgatgggt

SEQ ID NO: 5266747 - DNA, 19 bp, Homo sapiens
attaaactgcgaagtcaag

SEQ ID NO: 5266748 - DNA, 18 bp, Homo sapiens
attaaactgtaaatcata

SEQ ID NO: 5266749 - DNA, 17 bp, Homo sapiens
attaaacttaaaacttt

SEQ ID NO: 5266750 - DNA, 12 bp, Homo sapiens
attaaacttcac

SEQ ID NO: 5266751 - DNA, 13 bp, Homo sapiens
attaaacttcagc

SEQ ID NO: 5266752 - DNA, 16 bp, Homo sapiens
attaaacttctactga

SEQ ID NO: 5266753 - DNA, 16 bp, Homo sapiens
attaaacttcttttct

SEQ ID NO: 5266754 - DNA, 13 bp, Homo sapiens
attaaacttgaag

SEQ ID NO: 5266755 - DNA, 16 bp, Homo sapiens
attaaagaaaaaaatg

SEQ ID NO: 5266756 - DNA, 17 bp, Homo sapiens
attaaagaaaaaaatgt

SEQ ID NO: 5266757 - DNA, 15 bp, Homo sapiens
attaaagaaaaactt

SEQ ID NO: 5266758 - DNA, 13 bp, Homo sapiens
attaaagaaaata

SEQ ID NO: 5266759 - DNA, 20 bp, Homo sapiens
attaaagaaaattgccaaaa

SEQ ID NO: 5266760 - DNA, 16 bp, Homo sapiens
attaaagaaataattt

SEQ ID NO: 5266761 - DNA, 19 bp, Homo sapiens
attaaagaaataattttat

SEQ ID NO: 5266762 - DNA, 15 bp, Homo sapiens
attaaagaaatgaaa

SEQ ID NO: 5266763 - DNA, 16 bp, Homo sapiens
attaaagaagacctga

SEQ ID NO: 5266764 - DNA, 22 bp, Homo sapiens
attaaagaagacctgagaatgt

SEQ ID NO: 5266765 - DNA, 13 bp, Homo sapiens
attaaagaatgct

SEQ ID NO: 5266766 - DNA, 21 bp, Homo sapiens
attaaagaatttaaaaaagtt

SEQ ID NO: 5266767 - DNA, 13 bp, Homo sapiens
attaaagacattt

SEQ ID NO: 5266768 - DNA, 13 bp, Homo sapiens
atgcacatttgtg

SEQ ID NO: 5266769 - DNA, 21 bp, Homo sapiens
atgcacatttgtgcataaatt

SEQ ID NO: 5266770 - DNA, 15 bp, Homo sapiens
atgcacattttgtac

SEQ ID NO: 5266771 - DNA, 18 bp, Homo sapiens
atgcacattttgtacatt

SEQ ID NO: 5266772 - DNA, 20 bp, Homo sapiens
atgcacattttgtacattgt

SEQ ID NO: 5266773 - DNA, 11 bp, Homo sapiens
atgcaccaaac

SEQ ID NO: 5266774 - DNA, 19 bp, Homo sapiens
atgcaccaaataggatcat

SEQ ID NO: 5266775 - DNA, 18 bp, Homo sapiens
atgcaccaagtacagcct

SEQ ID NO: 5266776 - DNA, 20 bp, Homo sapiens
atgcaccaagtacagccttc

SEQ ID NO: 5266777 - DNA, 21 bp, Homo sapiens
atgcaccaagtacagccttca

SEQ ID NO: 5266778 - DNA, 13 bp, Homo sapiens
atgcaccagccct

SEQ ID NO: 5266779 - DNA, 16 bp, Homo sapiens
atgcaccatggagacg

SEQ ID NO: 5266780 - DNA, 12 bp, Homo sapiens
atgcacccctgg

SEQ ID NO: 5266781 - DNA, 19 bp, Homo sapiens
atgcacccgcatgtacaaa

SEQ ID NO: 5266782 - DNA, 23 bp, Homo sapiens
atgcacccgcatgtacaaaaaca

SEQ ID NO: 5266783 - DNA, 18 bp, Homo sapiens
atgcacctaaagaaaaac

SEQ ID NO: 5266784 - DNA, 15 bp, Homo sapiens
atgcacctcagggcc

SEQ ID NO: 5266785 - DNA, 20 bp, Homo sapiens
atgcacctcttgttactccc

SEQ ID NO: 5266786 - DNA, 20 bp, Homo sapiens
atgcaccttatatttctgtg

SEQ ID NO: 5266787 - DNA, 19 bp, Homo sapiens
atgcaccttccagcccggg

SEQ ID NO: 5266788 - DNA, 16 bp, Homo sapiens
atgcaccttgtgtctg

SEQ ID NO: 5266789 - DNA, 21 bp, Homo sapiens
atgcaccttgtgtctgtacac

SEQ ID NO: 5266790 - DNA, 17 bp, Homo sapiens
atgcacgcacacatcag

SEQ ID NO: 5266791 - DNA, 17 bp, Homo sapiens
atgcacgcaccccgccc

SEQ ID NO: 5266792 - DNA, 15 bp, Homo sapiens
atgcacggcctcgcg

SEQ ID NO: 5266793 - DNA, 18 bp, Homo sapiens
atgcacggcctcgcgtct

SEQ ID NO: 5266794 - DNA, 18 bp, Homo sapiens
atgcacggcggcagggtg

SEQ ID NO: 5266795 - DNA, 17 bp, Homo sapiens
atgcacggtttctgttc

SEQ ID NO: 5266796 - DNA, 19 bp, Homo sapiens
atgcacggtttctgttctg

SEQ ID NO: 5266797 - DNA, 20 bp, Homo sapiens
atgcacggtttctgttctgc

SEQ ID NO: 5266798 - DNA, 14 bp, Homo sapiens
atgcacgttaacag

SEQ ID NO: 5266799 - DNA, 13 bp, Homo sapiens
atgcactaagaca

SEQ ID NO: 5266800 - DNA, 20 bp, Homo sapiens
atgcactacacttttgatgt

SEQ ID NO: 5266801 - DNA, 16 bp, Homo sapiens
atgcactactgaaatt

SEQ ID NO: 5266802 - DNA, 15 bp, Homo sapiens
atgcactatatgttt

SEQ ID NO: 5266803 - DNA, 20 bp, Homo sapiens
atgcactatatgtttacaca

SEQ ID NO: 5266804 - DNA, 21 bp, Homo sapiens
atgcactatatttgtatatat

SEQ ID NO: 5266805 - DNA, 21 bp, Homo sapiens
atgcactcacccctagccctg

SEQ ID NO: 5266806 - DNA, 22 bp, Homo sapiens
atgcactcacccctagccctgg

SEQ ID NO: 5266807 - DNA, 23 bp, Homo sapiens
atgcactcacccctagccctggt

SEQ ID NO: 5266808 - DNA, 12 bp, Homo sapiens
atgcactcctgc

SEQ ID NO: 5266809 - DNA, 15 bp, Homo sapiens
atgcactcctgcccc

SEQ ID NO: 5266810 - DNA, 21 bp, Homo sapiens
atgcactcctgccccggccca

SEQ ID NO: 5266811 - DNA, 18 bp, Homo sapiens
atgcactcgcactgcaaa

SEQ ID NO: 5266812 - DNA, 19 bp, Homo sapiens
atgcactcgcactgcaaat

SEQ ID NO: 5266813 - DNA, 17 bp, Homo sapiens
atgcactcttttgagca

SEQ ID NO: 5266814 - DNA, 17 bp, Homo sapiens
atgcactgaagagctct

SEQ ID NO: 5266815 - DNA, 23 bp, Homo sapiens
atgcactgacctgctccgccagg

SEQ ID NO: 5266816 - DNA, 12 bp, Homo sapiens
atgcactgcctg

SEQ ID NO: 5266817 - DNA, 12 bp, Homo sapiens
atgcactggcca

SEQ ID NO: 5266818 - DNA, 13 bp, Homo sapiens
atgcactggccac

SEQ ID NO: 5266819 - DNA, 14 bp, Homo sapiens
atgcactggccacc

SEQ ID NO: 5266820 - DNA, 23 bp, Homo sapiens
atgcactggcctgttctgtagga

SEQ ID NO: 5266821 - DNA, 24 bp, Homo sapiens
atgcactggcctgttctgtaggag

SEQ ID NO: 5266822 - DNA, 19 bp, Homo sapiens
atgcactggggtaccacat

SEQ ID NO: 5266823 - DNA, 20 bp, Homo sapiens
atgcactggggtaccacatg

SEQ ID NO: 5266824 - DNA, 13 bp, Homo sapiens
atgcactgtaaat

SEQ ID NO: 5266825 - DNA, 14 bp, Homo sapiens
atgcactgtaaata

SEQ ID NO: 5266826 - DNA, 16 bp, Homo sapiens
atgcactgtaaatatc

SEQ ID NO: 5266827 - DNA, 19 bp, Homo sapiens
atgcactgtaaatatccct

SEQ ID NO: 5266828 - DNA, 21 bp, Homo sapiens
atgcactgtaaatatccctcc

SEQ ID NO: 5266829 - DNA, 12 bp, Homo sapiens
atgcactgtaat

SEQ ID NO: 5266830 - DNA, 21 bp, Homo sapiens
atgcactgtaatatgtacaca

SEQ ID NO: 5266831 - DNA, 18 bp, Homo sapiens
atgcactgtggtttcaga

SEQ ID NO: 5266832 - DNA, 20 bp, Homo sapiens
atgcactgtggtttcagatg

SEQ ID NO: 5266833 - DNA, 22 bp, Homo sapiens
atgcactgtggtttcagatgtg

SEQ ID NO: 5266834 - DNA, 23 bp, Homo sapiens
atgcactgtggtttcagatgtgc

SEQ ID NO: 5266835 - DNA, 21 bp, Homo sapiens
atgcacttcaaataattaaat

SEQ ID NO: 5266836 - DNA, 20 bp, Homo sapiens
atgcacttcaaattcaaata

SEQ ID NO: 5266837 - DNA, 13 bp, Homo sapiens
atgcacttctatt

SEQ ID NO: 5266838 - DNA, 22 bp, Homo sapiens
atgcactttaaatggaataatt

SEQ ID NO: 5266839 - DNA, 17 bp, Homo sapiens
atgcactttccctagaa

SEQ ID NO: 5266840 - DNA, 19 bp, Homo sapiens
atgcactttgctttaatat

SEQ ID NO: 5266841 - DNA, 20 bp, Homo sapiens
atgcactttgctttaatata

SEQ ID NO: 5266842 - DNA, 17 bp, Homo sapiens
atgcactttgttctggc

SEQ ID NO: 5266843 - DNA, 21 bp, Homo sapiens
atgcactttgttctggctctt

SEQ ID NO: 5266844 - DNA, 21 bp, Homo sapiens
atgcacttttagaaatgcata

SEQ ID NO: 5266845 - DNA, 22 bp, Homo sapiens
atgcacttttagaaatgcatat

SEQ ID NO: 5266846 - DNA, 15 bp, Homo sapiens
atgcacttttatgaa

SEQ ID NO: 5266847 - DNA, 20 bp, Homo sapiens
atgcactttttccttactgt

SEQ ID NO: 5266848 - DNA, 13 bp, Homo sapiens
atgcagaaaaaga

SEQ ID NO: 5266849 - DNA, 14 bp, Homo sapiens
atgcagaaaaagaa

SEQ ID NO: 5266850 - DNA, 19 bp, Homo sapiens
atgcagaaaacagggtctg

SEQ ID NO: 5266851 - DNA, 22 bp, Homo sapiens
atgcagaaaacagggtctggga

SEQ ID NO: 5266852 - DNA, 24 bp, Homo sapiens
atgcagaaaaggaagatgttctgt

SEQ ID NO: 5266853 - DNA, 18 bp, Homo sapiens
atgcagaaacttggatgt

SEQ ID NO: 5266854 - DNA, 11 bp, Homo sapiens
atgcagaaata

SEQ ID NO: 5266855 - DNA, 18 bp, Homo sapiens
atgcagaaatagacaaaa

SEQ ID NO: 5266856 - DNA, 19 bp, Homo sapiens
atgcagaaatcacgttgct

SEQ ID NO: 5266857 - DNA, 17 bp, Homo sapiens
atgcagaacgtatttag

SEQ ID NO: 5266858 - DNA, 22 bp, Homo sapiens
atgcagaacgtatttagccatt

SEQ ID NO: 5266859 - DNA, 20 bp, Homo sapiens
atgcagaagcatattttgct

SEQ ID NO: 5266860 - DNA, 14 bp, Homo sapiens
atgcagaagtattc

SEQ ID NO: 5266861 - DNA, 18 bp, Homo sapiens
atgcagaataatcctgtt

SEQ ID NO: 5266862 - DNA, 20 bp, Homo sapiens
atgcagaataatcctgtttt

SEQ ID NO: 5266863 - DNA, 14 bp, Homo sapiens
atgcagaatacttt

SEQ ID NO: 5266864 - DNA, 12 bp, Homo sapiens
atgcagaatgtt

SEQ ID NO: 5266865 - DNA, 15 bp, Homo sapiens
atgcagaatttgatt

SEQ ID NO: 5266866 - DNA, 22 bp, Homo sapiens
atgcagacaaagccctgtcctt

SEQ ID NO: 5266867 - DNA, 19 bp, Homo sapiens
atgcagacaacaccttcct

SEQ ID NO: 5266868 - DNA, 21 bp, Homo sapiens
atgcagacaacaccttcctcc

SEQ ID NO: 5266869 - DNA, 14 bp, Homo sapiens
atgcagacacacaa

SEQ ID NO: 5266870 - DNA, 17 bp, Homo sapiens
atgcagacatctctgga

SEQ ID NO: 5266871 - DNA, 22 bp, Homo sapiens
atgcagacatctctggagccag

SEQ ID NO: 5266872 - DNA, 18 bp, Homo sapiens
atgcagacatttacatgt

SEQ ID NO: 5266873 - DNA, 19 bp, Homo sapiens
atgcagacctcatgcccag

SEQ ID NO: 5266874 - DNA, 19 bp, Homo sapiens
atgcagactgttagctttt

SEQ ID NO: 5266875 - DNA, 10 bp, Homo sapiens
atgcagagat

SEQ ID NO: 5266876 - DNA, 22 bp, Homo sapiens
atgcagagatgtgcccccaccc

SEQ ID NO: 5266877 - DNA, 21 bp, Homo sapiens
atgcagagcgccgtgagttct

SEQ ID NO: 5266878 - DNA, 15 bp, Homo sapiens
atgcagagcttgtgg

SEQ ID NO: 5266879 - DNA, 21 bp, Homo sapiens
atgcagaggaggtgagagtgg

SEQ ID NO: 5266880 - DNA, 15 bp, Homo sapiens
atgcagaggcctggg

SEQ ID NO: 5266881 - DNA, 20 bp, Homo sapiens
atgcagagtaagtattatgc

SEQ ID NO: 5266882 - DNA, 15 bp, Homo sapiens
atgcagagtatttct

SEQ ID NO: 5266883 - DNA, 17 bp, Homo sapiens
atgcagatagaatcaat

SEQ ID NO: 5266884 - DNA, 20 bp, Homo sapiens
atgcagatctagccaggcct

SEQ ID NO: 5266885 - DNA, 12 bp, Homo sapiens
atgcagatgcca

SEQ ID NO: 5266886 - DNA, 17 bp, Homo sapiens
atgcagattacactgat

SEQ ID NO: 5266887 - DNA, 16 bp, Homo sapiens
atgcagattcctgggc

SEQ ID NO: 5266888 - DNA, 17 bp, Homo sapiens
atgcagattcctgggcc

SEQ ID NO: 5266889 - DNA, 22 bp, Homo sapiens
atgcagattttgcccttgacaa

SEQ ID NO: 5266890 - DNA, 18 bp, Homo sapiens
atgcagcaacacccaagt

SEQ ID NO: 5266891 - DNA, 19 bp, Homo sapiens
atgcagcaaggccctgctg

SEQ ID NO: 5266892 - DNA, 15 bp, Homo sapiens
atgcagcacttcaga

SEQ ID NO: 5266893 - DNA, 22 bp, Homo sapiens
atgcagcaggaaggaacaaaga

SEQ ID NO: 5266894 - DNA, 20 bp, Homo sapiens
atgcagcagggatgccctgg

SEQ ID NO: 5266895 - DNA, 15 bp, Homo sapiens
atgcagcatacaaaa

SEQ ID NO: 5266896 - DNA, 12 bp, Homo sapiens
atgcagcatttg

SEQ ID NO: 5266897 - DNA, 15 bp, Homo sapiens
atgcagcatttgata

SEQ ID NO: 5266898 - DNA, 18 bp, Homo sapiens
atgcagccacttaggaca

SEQ ID NO: 5266899 - DNA, 16 bp, Homo sapiens
atgcagccatatatgg

SEQ ID NO: 5266900 - DNA, 11 bp, Homo sapiens
atgcagcccac

SEQ ID NO: 5266901 - DNA, 17 bp, Homo sapiens
atgcagcccaccaggag

SEQ ID NO: 5266902 - DNA, 23 bp, Homo sapiens
atgcagcccaccaggagcacctg

SEQ ID NO: 5266903 - DNA, 11 bp, Homo sapiens
atgcagcccat

SEQ ID NO: 5266904 - DNA, 21 bp, Homo sapiens
atgcagcccctgggcccttgt

SEQ ID NO: 5266905 - DNA, 18 bp, Homo sapiens
atgcagccgccttccttg

SEQ ID NO: 5266906 - DNA, 19 bp, Homo sapiens
atgcagccgccttccttga

SEQ ID NO: 5266907 - DNA, 16 bp, Homo sapiens
atgcagccgtgatcaa

SEQ ID NO: 5266908 - DNA, 21 bp, Homo sapiens
atgcagccgtgatcaagggaa

SEQ ID NO: 5266909 - DNA, 14 bp, Homo sapiens
atgcagcctcacag

SEQ ID NO: 5266910 - DNA, 17 bp, Homo sapiens
atgcagcctcacagtcc

SEQ ID NO: 5266911 - DNA, 18 bp, Homo sapiens
atgcagccttggggcatt

SEQ ID NO: 5266912 - DNA, 18 bp, Homo sapiens
atgcagcgaattcagaaa

SEQ ID NO: 5266913 - DNA, 20 bp, Homo sapiens
atgcagcgccgtgtcctctc

SEQ ID NO: 5266914 - DNA, 16 bp, Homo sapiens
atgcagcggcgtgagg

SEQ ID NO: 5266915 - DNA, 13 bp, Homo sapiens
atgcagcgtgaag

SEQ ID NO: 5266916 - DNA, 21 bp, Homo sapiens
atgcagctactggaatggtgt

SEQ ID NO: 5266917 - DNA, 14 bp, Homo sapiens
atgcagctatctgg

SEQ ID NO: 5266918 - DNA, 20 bp, Homo sapiens
atgcagctcttcaacatgac

SEQ ID NO: 5266919 - DNA, 21 bp, Homo sapiens
atgcagctcttcaacatgaca

SEQ ID NO: 5266920 - DNA, 16 bp, Homo sapiens
atgcagctcttcctgg

SEQ ID NO: 5266921 - DNA, 17 bp, Homo sapiens
atgcagctgaggtctgt

SEQ ID NO: 5266922 - DNA, 11 bp, Homo sapiens
atgcagctgcc

SEQ ID NO: 5266923 - DNA, 17 bp, Homo sapiens
atgcagctgcctggggc

SEQ ID NO: 5266924 - DNA, 18 bp, Homo sapiens
atgcagctgcctggggcc

SEQ ID NO: 5266925 - DNA, 19 bp, Homo sapiens
atgcagctgcctggggccc

SEQ ID NO: 5266926 - DNA, 15 bp, Homo sapiens
atgcagctgttgaga

SEQ ID NO: 5266927 - DNA, 16 bp, Homo sapiens
atgcagctgttgagaa

SEQ ID NO: 5266928 - DNA, 18 bp, Homo sapiens
atgcagctgttgagaaaa

SEQ ID NO: 5266929 - DNA, 22 bp, Homo sapiens
atgcagctgttgagaaaacgaa

SEQ ID NO: 5266930 - DNA, 17 bp, Homo sapiens
atgcagcttcaggtgag

SEQ ID NO: 5266931 - DNA, 14 bp, Homo sapiens
atgcagcttcatca

SEQ ID NO: 5266932 - DNA, 22 bp, Homo sapiens
atgcagcttcatcaatttttat

SEQ ID NO: 5266933 - DNA, 16 bp, Homo sapiens
atgcagcttgtccttg

SEQ ID NO: 5266934 - DNA, 15 bp, Homo sapiens
atgcagctttgcaaa

SEQ ID NO: 5266935 - DNA, 18 bp, Homo sapiens
atgcaggaagaggcccac

SEQ ID NO: 5266936 - DNA, 14 bp, Homo sapiens
atgcaggaaggaaa

SEQ ID NO: 5266937 - DNA, 18 bp, Homo sapiens
atgcaggaaggaaaacta

SEQ ID NO: 5266938 - DNA, 14 bp, Homo sapiens
atgcaggagagctt

SEQ ID NO: 5266939 - DNA, 19 bp, Homo sapiens
atgcaggaggctcaggtga

SEQ ID NO: 5266940 - DNA, 16 bp, Homo sapiens
atgcaggaggtggaga

SEQ ID NO: 5266941 - DNA, 19 bp, Homo sapiens
atgcaggaggtggagaaaa

SEQ ID NO: 5266942 - DNA, 19 bp, Homo sapiens
atgcaggatttgttctctg

SEQ ID NO: 5266943 - DNA, 22 bp, Homo sapiens
atgcaggcacttattgtaaatt

SEQ ID NO: 5266944 - DNA, 17 bp, Homo sapiens
atgcaggcagcctgcag

SEQ ID NO: 5266945 - DNA, 14 bp, Homo sapiens
attaaagacattta

SEQ ID NO: 5266946 - DNA, 17 bp, Homo sapiens
attaaagacatttaaaa

SEQ ID NO: 5266947 - DNA, 15 bp, Homo sapiens
attaaagactccagt

SEQ ID NO: 5266948 - DNA, 14 bp, Homo sapiens
attaaagatgtgtt

SEQ ID NO: 5266949 - DNA, 21 bp, Homo sapiens
attaaagattgctttatccag

SEQ ID NO: 5266950 - DNA, 14 bp, Homo sapiens
attaaagcagcaaa

SEQ ID NO: 5266951 - DNA, 23 bp, Homo sapiens
attaaagcagtcacttttcctgt

SEQ ID NO: 5266952 - DNA, 12 bp, Homo sapiens
attaaagccatg

SEQ ID NO: 5266953 - DNA, 15 bp, Homo sapiens
attaaagccttaagc

SEQ ID NO: 5266954 - DNA, 18 bp, Homo sapiens
attaaagctaaagtatct

SEQ ID NO: 5266955 - DNA, 12 bp, Homo sapiens
attaaaggaagg

SEQ ID NO: 5266956 - DNA, 13 bp, Homo sapiens
attaaaggaagga

SEQ ID NO: 5266957 - DNA, 16 bp, Homo sapiens
attaaaggaaggaaaa

SEQ ID NO: 5266958 - DNA, 16 bp, Homo sapiens
attaaaggcagcattt

SEQ ID NO: 5266959 - DNA, 20 bp, Homo sapiens
attaaaggcttctctctcac

SEQ ID NO: 5266960 - DNA, 23 bp, Homo sapiens
attaaaggtattccttgttcttc

SEQ ID NO: 5266961 - DNA, 18 bp, Homo sapiens
attaaaggttaaattgct

SEQ ID NO: 5266962 - DNA, 17 bp, Homo sapiens
attaaaggttcctttgt

SEQ ID NO: 5266963 - DNA, 11 bp, Homo sapiens
attaaagtatg

SEQ ID NO: 5266964 - DNA, 16 bp, Homo sapiens
attaaagtcagaagtt

SEQ ID NO: 5266965 - DNA, 14 bp, Homo sapiens
attaaagtctgaat

SEQ ID NO: 5266966 - DNA, 12 bp, Homo sapiens
attaaagtgact

SEQ ID NO: 5266967 - DNA, 13 bp, Homo sapiens
attaaagtgactt

SEQ ID NO: 5266968 - DNA, 14 bp, Homo sapiens
attaaagtgacttt

SEQ ID NO: 5266969 - DNA, 15 bp, Homo sapiens
attaaagtgccttca

SEQ ID NO: 5266970 - DNA, 21 bp, Homo sapiens
attaaagtgccttcagccaag

SEQ ID NO: 5266971 - DNA, 17 bp, Homo sapiens
attaaagtgctaaggtt

SEQ ID NO: 5266972 - DNA, 19 bp, Homo sapiens
attaaagtgctaaggttct

SEQ ID NO: 5266973 - DNA, 20 bp, Homo sapiens
attaaagtgctaaggttcta

SEQ ID NO: 5266974 - DNA, 23 bp, Homo sapiens
attaaagtgctgtttagatttat

SEQ ID NO: 5266975 - DNA, 15 bp, Homo sapiens
attaaagtgtccatt

SEQ ID NO: 5266976 - DNA, 23 bp, Homo sapiens
attaaagtgtccattgacatgta

SEQ ID NO: 5266977 - DNA, 12 bp, Homo sapiens
attaaagtgtta

SEQ ID NO: 5266978 - DNA, 13 bp, Homo sapiens
attaaagtttcaa

SEQ ID NO: 5266979 - DNA, 21 bp, Homo sapiens
attaaagtttcattagtcata

SEQ ID NO: 5266980 - DNA, 16 bp, Homo sapiens
attaaagtttgcttgt

SEQ ID NO: 5266981 - DNA, 17 bp, Homo sapiens
attaaagttttcaaatt

SEQ ID NO: 5266982 - DNA, 14 bp, Homo sapiens
attaaataaaatca

SEQ ID NO: 5266983 - DNA, 22 bp, Homo sapiens
attaaataaaatttttatgtaa

SEQ ID NO: 5266984 - DNA, 15 bp, Homo sapiens
attaaataaactgtt

SEQ ID NO: 5266985 - DNA, 14 bp, Homo sapiens
attaaataaataaa

SEQ ID NO: 5266986 - DNA, 16 bp, Homo sapiens
attaaataaatatttt

SEQ ID NO: 5266987 - DNA, 19 bp, Homo sapiens
attaaataaatattttaca

SEQ ID NO: 5266988 - DNA, 16 bp, Homo sapiens
attaaataaatgaata

SEQ ID NO: 5266989 - DNA, 16 bp, Homo sapiens
attaaataagattcta

SEQ ID NO: 5266990 - DNA, 16 bp, Homo sapiens
attaaataataaagta

SEQ ID NO: 5266991 - DNA, 14 bp, Homo sapiens
attaaataatgtac

SEQ ID NO: 5266992 - DNA, 19 bp, Homo sapiens
attaaataattttacatgt

SEQ ID NO: 5266993 - DNA, 12 bp, Homo sapiens
attaaatacaga

SEQ ID NO: 5266994 - DNA, 11 bp, Homo sapiens
attaaatagct

SEQ ID NO: 5266995 - DNA, 11 bp, Homo sapiens
attaaatagtg

SEQ ID NO: 5266996 - DNA, 20 bp, Homo sapiens
attaaatagtgtgatgtttg

SEQ ID NO: 5266997 - DNA, 15 bp, Homo sapiens
attaaatataaaata

SEQ ID NO: 5266998 - DNA, 18 bp, Homo sapiens
attaaatataaaatacat

SEQ ID NO: 5266999 - DNA, 16 bp, Homo sapiens
attaaatataaagcaa

SEQ ID NO: 5267000 - DNA, 15 bp, Homo sapiens
attaaatataatatg

SEQ ID NO: 5267001 - DNA, 15 bp, Homo sapiens
attaaatatatcttt

SEQ ID NO: 5267002 - DNA, 18 bp, Homo sapiens
attaaatatatctttgta

SEQ ID NO: 5267003 - DNA, 17 bp, Homo sapiens
attaaatatatgtatgt

SEQ ID NO: 5267004 - DNA, 21 bp, Homo sapiens
attaaatatatgtatgtaaaa

SEQ ID NO: 5267005 - DNA, 14 bp, Homo sapiens
attaaatatttaac

SEQ ID NO: 5267006 - DNA, 13 bp, Homo sapiens
attaaatatttat

SEQ ID NO: 5267007 - DNA, 13 bp, Homo sapiens
attaaatatttct

SEQ ID NO: 5267008 - DNA, 22 bp, Homo sapiens
attaaatatttcttaagtataa

SEQ ID NO: 5267009 - DNA, 15 bp, Homo sapiens
attaaatcatactcc

SEQ ID NO: 5267010 - DNA, 17 bp, Homo sapiens
attaaatcctccagctt

SEQ ID NO: 5267011 - DNA, 19 bp, Homo sapiens
attaaatcctccagctttt

SEQ ID NO: 5267012 - DNA, 21 bp, Homo sapiens
attaaatcgtttaatgtttat

SEQ ID NO: 5267013 - DNA, 19 bp, Homo sapiens
attaaatctagacattctt

SEQ ID NO: 5267014 - DNA, 20 bp, Homo sapiens
attaaatctccagcttacta

SEQ ID NO: 5267015 - DNA, 21 bp, Homo sapiens
attaaatcttaaacaatgtat

SEQ ID NO: 5267016 - DNA, 22 bp, Homo sapiens
attaaatcttaaacaatgtata

SEQ ID NO: 5267017 - DNA, 20 bp, Homo sapiens
attaaatgaaagaatatcta

SEQ ID NO: 5267018 - DNA, 13 bp, Homo sapiens
attaaatgaaata

SEQ ID NO: 5267019 - DNA, 13 bp, Homo sapiens
attaaatgaatat

SEQ ID NO: 5267020 - DNA, 14 bp, Homo sapiens
attaaatgaatata

SEQ ID NO: 5267021 - DNA, 15 bp, Homo sapiens
attaaatgacactca

SEQ ID NO: 5267022 - DNA, 13 bp, Homo sapiens
attaaatgactct

SEQ ID NO: 5267023 - DNA, 21 bp, Homo sapiens
attaaatgactcttccctcaa

SEQ ID NO: 5267024 - DNA, 12 bp, Homo sapiens
attaaatgcaaa

SEQ ID NO: 5267025 - DNA, 14 bp, Homo sapiens
attaaatgccactt

SEQ ID NO: 5267026 - DNA, 19 bp, Homo sapiens
attaaatgccactttttca

SEQ ID NO: 5267027 - DNA, 15 bp, Homo sapiens
attaaatgcccagcc

SEQ ID NO: 5267028 - DNA, 19 bp, Homo sapiens
attaaatgcccagcccctt

SEQ ID NO: 5267029 - DNA, 18 bp, Homo sapiens
attaaatggtgatttctt

SEQ ID NO: 5267030 - DNA, 14 bp, Homo sapiens
attaaatgtagctt

SEQ ID NO: 5267031 - DNA, 14 bp, Homo sapiens
attaaatgtattta

SEQ ID NO: 5267032 - DNA, 16 bp, Homo sapiens
attaaatgttgcacat

SEQ ID NO: 5267033 - DNA, 13 bp, Homo sapiens
attaaatgttgct

SEQ ID NO: 5267034 - DNA, 15 bp, Homo sapiens
attaaatgtttcaaa

SEQ ID NO: 5267035 - DNA, 18 bp, Homo sapiens
attaaatgtttcaaaata

SEQ ID NO: 5267036 - DNA, 11 bp, Homo sapiens
attaaattaca

SEQ ID NO: 5267037 - DNA, 15 bp, Homo sapiens
attaaattacagctt

SEQ ID NO: 5267038 - DNA, 20 bp, Homo sapiens
attaaattacagcttttatg

SEQ ID NO: 5267039 - DNA, 22 bp, Homo sapiens
attaaattacagcttttatgga

SEQ ID NO: 5267040 - DNA, 14 bp, Homo sapiens
attaaattacattt

SEQ ID NO: 5267041 - DNA, 18 bp, Homo sapiens
attaaattaggaataaat

SEQ ID NO: 5267042 - DNA, 18 bp, Homo sapiens
attaaattatcattgttt

SEQ ID NO: 5267043 - DNA, 12 bp, Homo sapiens
attaaattatga

SEQ ID NO: 5267044 - DNA, 17 bp, Homo sapiens
attaaattcacaaactt

SEQ ID NO: 5267045 - DNA, 22 bp, Homo sapiens
attaaattccttccatgataga

SEQ ID NO: 5267046 - DNA, 21 bp, Homo sapiens
attaaattctctctaacataa

SEQ ID NO: 5267047 - DNA, 13 bp, Homo sapiens
attaaattcttgc

SEQ ID NO: 5267048 - DNA, 18 bp, Homo sapiens
attaaattgcctttgtaa

SEQ ID NO: 5267049 - DNA, 17 bp, Homo sapiens
attaaattggaaagcag

SEQ ID NO: 5267050 - DNA, 23 bp, Homo sapiens
attaaattgggcttcaatcactg

SEQ ID NO: 5267051 - DNA, 15 bp, Homo sapiens
attaaattgtaaaac

SEQ ID NO: 5267052 - DNA, 12 bp, Homo sapiens
attaaattgtgt

SEQ ID NO: 5267053 - DNA, 17 bp, Homo sapiens
attaaatttcacaatat

SEQ ID NO: 5267054 - DNA, 15 bp, Homo sapiens
attaaatttctggat

SEQ ID NO: 5267055 - DNA, 16 bp, Homo sapiens
attaaattttaatgta

SEQ ID NO: 5267056 - DNA, 12 bp, Homo sapiens
attaaattttag

SEQ ID NO: 5267057 - DNA, 19 bp, Homo sapiens
attaaattttttgttgaca

SEQ ID NO: 5267058 - DNA, 20 bp, Homo sapiens
attaaatttttttgtatgaa

SEQ ID NO: 5267059 - DNA, 21 bp, Homo sapiens
attaaatttttttgtatgaaa

SEQ ID NO: 5267060 - DNA, 22 bp, Homo sapiens
attaaatttttttgtatgaaaa

SEQ ID NO: 5267061 - DNA, 18 bp, Homo sapiens
attaacaaaagattctgt

SEQ ID NO: 5267062 - DNA, 14 bp, Homo sapiens
attaacaaacagga

SEQ ID NO: 5267063 - DNA, 18 bp, Homo sapiens
attaacaaagttactggc

SEQ ID NO: 5267064 - DNA, 13 bp, Homo sapiens
attaacaaataaa

SEQ ID NO: 5267065 - DNA, 12 bp, Homo sapiens
attaacaaatat

SEQ ID NO: 5267066 - DNA, 20 bp, Homo sapiens
attaacaaatatgctaattt

SEQ ID NO: 5267067 - DNA, 21 bp, Homo sapiens
attaacaaatatgctaatttg

SEQ ID NO: 5267068 - DNA, 14 bp, Homo sapiens
attaacaaatgctc

SEQ ID NO: 5267069 - DNA, 14 bp, Homo sapiens
attaacaaattcag

SEQ ID NO: 5267070 - DNA, 17 bp, Homo sapiens
attaacaaattgcattt

SEQ ID NO: 5267071 - DNA, 15 bp, Homo sapiens
attaacaaatttctt

SEQ ID NO: 5267072 - DNA, 20 bp, Homo sapiens
attaacaacccataggcact

SEQ ID NO: 5267073 - DNA, 19 bp, Homo sapiens
attaacaactgtgaatatg

SEQ ID NO: 5267074 - DNA, 20 bp, Homo sapiens
attaacaatttaacagagaa

SEQ ID NO: 5267075 - DNA, 13 bp, Homo sapiens
attaacacaaagg

SEQ ID NO: 5267076 - DNA, 17 bp, Homo sapiens
attaacacactgaaccg

SEQ ID NO: 5267077 - DNA, 17 bp, Homo sapiens
attaacacagtgtttca

SEQ ID NO: 5267078 - DNA, 18 bp, Homo sapiens
attaacactaattatcac

SEQ ID NO: 5267079 - DNA, 24 bp, Homo sapiens
attaacactaattatcacgtctga

SEQ ID NO: 5267080 - DNA, 18 bp, Homo sapiens
attaacactcatttccaa

SEQ ID NO: 5267081 - DNA, 18 bp, Homo sapiens
attaacagaaatgtttct

SEQ ID NO: 5267082 - DNA, 16 bp, Homo sapiens
attaacaggtctttga

SEQ ID NO: 5267083 - DNA, 19 bp, Homo sapiens
attaacaggtctttgaaat

SEQ ID NO: 5267084 - DNA, 14 bp, Homo sapiens
attaacagttttcc

SEQ ID NO: 5267085 - DNA, 18 bp, Homo sapiens
attaacagttttccatga

SEQ ID NO: 5267086 - DNA, 19 bp, Homo sapiens
attaacagttttccatgaa

SEQ ID NO: 5267087 - DNA, 18 bp, Homo sapiens
attaacataggtgaaagt

SEQ ID NO: 5267088 - DNA, 14 bp, Homo sapiens
attaacatcaaaca

SEQ ID NO: 5267089 - DNA, 12 bp, Homo sapiens
attaacatgatg

SEQ ID NO: 5267090 - DNA, 16 bp, Homo sapiens
attaacatgatgtact

SEQ ID NO: 5267091 - DNA, 21 bp, Homo sapiens
attaaccaaattaacctttca

SEQ ID NO: 5267092 - DNA, 22 bp, Homo sapiens
attaaccaaccttgtttaatag

SEQ ID NO: 5267093 - DNA, 15 bp, Homo sapiens
attaaccaaggtaga

SEQ ID NO: 5267094 - DNA, 17 bp, Homo sapiens
attaacccaaagaagct

SEQ ID NO: 5267095 - DNA, 21 bp, Homo sapiens
attaacccactagctcttgtt

SEQ ID NO: 5267096 - DNA, 19 bp, Homo sapiens
attaacccccaaattcaaa

SEQ ID NO: 5267097 - DNA, 20 bp, Homo sapiens
attaaccctctgagtttttg

SEQ ID NO: 5267098 - DNA, 19 bp, Homo sapiens
attaaccgagacactttat

SEQ ID NO: 5267099 - DNA, 15 bp, Homo sapiens
attaacctacctgtg

SEQ ID NO: 5267100 - DNA, 13 bp, Homo sapiens
attaacctagaga

SEQ ID NO: 5267101 - DNA, 17 bp, Homo sapiens
attaacctctcacagtt

SEQ ID NO: 5267102 - DNA, 16 bp, Homo sapiens
attaacctgcatgcag

SEQ ID NO: 5267103 - DNA, 18 bp, Homo sapiens
attaaccttttcaaatta

SEQ ID NO: 5267104 - DNA, 22 bp, Homo sapiens
attaaccttttttgtcttattg

SEQ ID NO: 5267105 - DNA, 14 bp, Homo sapiens
attaacggtgctaa

SEQ ID NO: 5267106 - DNA, 15 bp, Homo sapiens
attaacggtgctaaa

SEQ ID NO: 5267107 - DNA, 15 bp, Homo sapiens
attaactaaagaaga

SEQ ID NO: 5267108 - DNA, 17 bp, Homo sapiens
attaactaatctattgg

SEQ ID NO: 5267109 - DNA, 14 bp, Homo sapiens
attaactacattta

SEQ ID NO: 5267110 - DNA, 21 bp, Homo sapiens
attaactacatttatgagtaa

SEQ ID NO: 5267111 - DNA, 22 bp, Homo sapiens
attaactactgtagaactgatt

SEQ ID NO: 5267112 - DNA, 20 bp, Homo sapiens
attaactagatacagaataa

SEQ ID NO: 5267113 - DNA, 17 bp, Homo sapiens
attaactagtttatcat

SEQ ID NO: 5267114 - DNA, 16 bp, Homo sapiens
attaactatcatcagt

SEQ ID NO: 5267115 - DNA, 14 bp, Homo sapiens
attaactatcttct

SEQ ID NO: 5267116 - DNA, 19 bp, Homo sapiens
attaactatttttttcaaa

SEQ ID NO: 5267117 - DNA, 20 bp, Homo sapiens
attaactatttttttcaaag

SEQ ID NO: 5267118 - DNA, 16 bp, Homo sapiens
attaactcaggcattt

SEQ ID NO: 5267119 - DNA, 12 bp, Homo sapiens
attaactcatta

SEQ ID NO: 5267120 - DNA, 17 bp, Homo sapiens
attaactcattagactg

SEQ ID NO: 5267121 - DNA, 13 bp, Homo sapiens
attaactccctcc

SEQ ID NO: 5267122 - DNA, 23 bp, Homo sapiens
attaactccctccaccagcctgc

SEQ ID NO: 5267123 - DNA, 13 bp, Homo sapiens
attaactctaact

SEQ ID NO: 5267124 - DNA, 15 bp, Homo sapiens
attaactctgcatag

SEQ ID NO: 5267125 - DNA, 19 bp, Homo sapiens
attaactgaattctgaact

SEQ ID NO: 5267126 - DNA, 20 bp, Homo sapiens
attaactgacgaagaagcaa

SEQ ID NO: 5267127 - DNA, 15 bp, Homo sapiens
atgcaggccccgccc

SEQ ID NO: 5267128 - DNA, 12 bp, Homo sapiens
atgcaggccctt

SEQ ID NO: 5267129 - DNA, 22 bp, Homo sapiens
atgcaggccctttgaagcctca

SEQ ID NO: 5267130 - DNA, 20 bp, Homo sapiens
atgcaggccttaactttccc

SEQ ID NO: 5267131 - DNA, 11 bp, Homo sapiens
atgcaggctgt

SEQ ID NO: 5267132 - DNA, 18 bp, Homo sapiens
atgcagggaagagggcag

SEQ ID NO: 5267133 - DNA, 13 bp, Homo sapiens
atgcagggaggcc

SEQ ID NO: 5267134 - DNA, 14 bp, Homo sapiens
atgcagggaggcca

SEQ ID NO: 5267135 - DNA, 18 bp, Homo sapiens
atgcagggattgctgcca

SEQ ID NO: 5267136 - DNA, 15 bp, Homo sapiens
atgcagggcagtcat

SEQ ID NO: 5267137 - DNA, 18 bp, Homo sapiens
atgcagggcccccacagg

SEQ ID NO: 5267138 - DNA, 13 bp, Homo sapiens
atgcagggctgca

SEQ ID NO: 5267139 - DNA, 17 bp, Homo sapiens
atgcaggggcaaacacc

SEQ ID NO: 5267140 - DNA, 20 bp, Homo sapiens
atgcaggggcaaacacctgc

SEQ ID NO: 5267141 - DNA, 16 bp, Homo sapiens
atgcagggggctcctg

SEQ ID NO: 5267142 - DNA, 12 bp, Homo sapiens
atgcaggtcagc

SEQ ID NO: 5267143 - DNA, 16 bp, Homo sapiens
atgcaggtcagcccat

SEQ ID NO: 5267144 - DNA, 24 bp, Homo sapiens
atgcaggtcagcccatggaggcag

SEQ ID NO: 5267145 - DNA, 21 bp, Homo sapiens
atgcaggtcgctactggcata

SEQ ID NO: 5267146 - DNA, 19 bp, Homo sapiens
atgcaggtgatgccattac

SEQ ID NO: 5267147 - DNA, 23 bp, Homo sapiens
atgcaggttcaggtcccctttca

SEQ ID NO: 5267148 - DNA, 21 bp, Homo sapiens
atgcaggtttgaccaggaaag

SEQ ID NO: 5267149 - DNA, 13 bp, Homo sapiens
atgcaggttttct

SEQ ID NO: 5267150 - DNA, 15 bp, Homo sapiens
atgcagtaacattct

SEQ ID NO: 5267151 - DNA, 22 bp, Homo sapiens
atgcagtaacattctacttgct

SEQ ID NO: 5267152 - DNA, 17 bp, Homo sapiens
atgcagtagccagcacg

SEQ ID NO: 5267153 - DNA, 23 bp, Homo sapiens
atgcagtattgagtgttctagtt

SEQ ID NO: 5267154 - DNA, 23 bp, Homo sapiens
atgcagtcacttattgtccaggt

SEQ ID NO: 5267155 - DNA, 17 bp, Homo sapiens
atgcagtcagtgtttct

SEQ ID NO: 5267156 - DNA, 16 bp, Homo sapiens
atgcagtcatgagaat

SEQ ID NO: 5267157 - DNA, 20 bp, Homo sapiens
atgcagtcatgagaattaca

SEQ ID NO: 5267158 - DNA, 21 bp, Homo sapiens
atgcagtccagaataagtgct

SEQ ID NO: 5267159 - DNA, 22 bp, Homo sapiens
atgcagtccagaataagtgctg

SEQ ID NO: 5267160 - DNA, 14 bp, Homo sapiens
atgcagtccagtga

SEQ ID NO: 5267161 - DNA, 17 bp, Homo sapiens
atgcagtctcctcttta

SEQ ID NO: 5267162 - DNA, 23 bp, Homo sapiens
atgcagtctcctctttaaaacaa

SEQ ID NO: 5267163 - DNA, 20 bp, Homo sapiens
atgcagtctgtccaggctcg

SEQ ID NO: 5267164 - DNA, 22 bp, Homo sapiens
atgcagtcttaccaatgacttt

SEQ ID NO: 5267165 - DNA, 15 bp, Homo sapiens
atgcagtgaactatt

SEQ ID NO: 5267166 - DNA, 17 bp, Homo sapiens
atgcagtgaccgcttcc

SEQ ID NO: 5267167 - DNA, 22 bp, Homo sapiens
atgcagtgatatggcagaagac

SEQ ID NO: 5267168 - DNA, 23 bp, Homo sapiens
atgcagtgatatggcagaagaca

SEQ ID NO: 5267169 - DNA, 17 bp, Homo sapiens
atgcagtgcctttcccc

SEQ ID NO: 5267170 - DNA, 19 bp, Homo sapiens
atgcagtgctcgctgttgc

SEQ ID NO: 5267171 - DNA, 14 bp, Homo sapiens
atgcagtgctcttt

SEQ ID NO: 5267172 - DNA, 14 bp, Homo sapiens
atgcagtgctgctt

SEQ ID NO: 5267173 - DNA, 13 bp, Homo sapiens
atgcagtgcttcc

SEQ ID NO: 5267174 - DNA, 23 bp, Homo sapiens
atgcagtgggtggggctgtacac

SEQ ID NO: 5267175 - DNA, 19 bp, Homo sapiens
atgcagtgtagattttata

SEQ ID NO: 5267176 - DNA, 23 bp, Homo sapiens
atgcagtgtagattttatagtgt

SEQ ID NO: 5267177 - DNA, 15 bp, Homo sapiens
atgcagttatatatt

SEQ ID NO: 5267178 - DNA, 20 bp, Homo sapiens
atgcagttattagaacttag

SEQ ID NO: 5267179 - DNA, 19 bp, Homo sapiens
atgcagttcattattttgt

SEQ ID NO: 5267180 - DNA, 14 bp, Homo sapiens
atgcagttcctggc

SEQ ID NO: 5267181 - DNA, 23 bp, Homo sapiens
atgcagttctcacgaaagtattt

SEQ ID NO: 5267182 - DNA, 17 bp, Homo sapiens
atgcagttctgaagaag

SEQ ID NO: 5267183 - DNA, 18 bp, Homo sapiens
atgcagttctgaagaaga

SEQ ID NO: 5267184 - DNA, 16 bp, Homo sapiens
atgcagttgtctctgt

SEQ ID NO: 5267185 - DNA, 11 bp, Homo sapiens
atgcagtttga

SEQ ID NO: 5267186 - DNA, 19 bp, Homo sapiens
atgcagtttgaaattctga

SEQ ID NO: 5267187 - DNA, 22 bp, Homo sapiens
atgcagtttgaaattctgaatt

SEQ ID NO: 5267188 - DNA, 22 bp, Homo sapiens
atgcataaaagggtcaaacctg

SEQ ID NO: 5267189 - DNA, 15 bp, Homo sapiens
atgcataaagtcagt

SEQ ID NO: 5267190 - DNA, 19 bp, Homo sapiens
atgcataaatgcataattt

SEQ ID NO: 5267191 - DNA, 14 bp, Homo sapiens
atgcataacacact

SEQ ID NO: 5267192 - DNA, 14 bp, Homo sapiens
atgcataagaaatg

SEQ ID NO: 5267193 - DNA, 15 bp, Homo sapiens
atgcataattcacat

SEQ ID NO: 5267194 - DNA, 13 bp, Homo sapiens
atgcataatttat

SEQ ID NO: 5267195 - DNA, 15 bp, Homo sapiens
atgcataatttatgg

SEQ ID NO: 5267196 - DNA, 22 bp, Homo sapiens
atgcatacaataaaagagcttt

SEQ ID NO: 5267197 - DNA, 22 bp, Homo sapiens
atgcatacacacacacacacag

SEQ ID NO: 5267198 - DNA, 17 bp, Homo sapiens
atgcatacactctcaaa

SEQ ID NO: 5267199 - DNA, 17 bp, Homo sapiens
atgcataccacaagaca

SEQ ID NO: 5267200 - DNA, 18 bp, Homo sapiens
atgcatactgagatagct

SEQ ID NO: 5267201 - DNA, 14 bp, Homo sapiens
atgcatactgttga

SEQ ID NO: 5267202 - DNA, 15 bp, Homo sapiens
atgcatacttcaaaa

SEQ ID NO: 5267203 - DNA, 17 bp, Homo sapiens
atgcatacttcaaaagt

SEQ ID NO: 5267204 - DNA, 20 bp, Homo sapiens
atgcatacttcaaaagtatt

SEQ ID NO: 5267205 - DNA, 13 bp, Homo sapiens
atgcatagacaag

SEQ ID NO: 5267206 - DNA, 21 bp, Homo sapiens
atgcatagagcaattaaactg

SEQ ID NO: 5267207 - DNA, 16 bp, Homo sapiens
atgcatagagccctgg

SEQ ID NO: 5267208 - DNA, 17 bp, Homo sapiens
atgcatagagccctggc

SEQ ID NO: 5267209 - DNA, 19 bp, Homo sapiens
atgcatagagccctggcca

SEQ ID NO: 5267210 - DNA, 16 bp, Homo sapiens
atgcataggattccaa

SEQ ID NO: 5267211 - DNA, 17 bp, Homo sapiens
atgcatagtgctaagaa

SEQ ID NO: 5267212 - DNA, 15 bp, Homo sapiens
atgcatataatgaat

SEQ ID NO: 5267213 - DNA, 18 bp, Homo sapiens
atgcatataatgaataaa

SEQ ID NO: 5267214 - DNA, 21 bp, Homo sapiens
atgcatataatgaataaatca

SEQ ID NO: 5267215 - DNA, 13 bp, Homo sapiens
atgcatatagaca

SEQ ID NO: 5267216 - DNA, 17 bp, Homo sapiens
atgcatatagacacaca

SEQ ID NO: 5267217 - DNA, 16 bp, Homo sapiens
atgcatatatatatgt

SEQ ID NO: 5267218 - DNA, 20 bp, Homo sapiens
atgcatatatatatgtgtgt

SEQ ID NO: 5267219 - DNA, 13 bp, Homo sapiens
atgcatatctgtt

SEQ ID NO: 5267220 - DNA, 14 bp, Homo sapiens
atgcatatgatata

SEQ ID NO: 5267221 - DNA, 19 bp, Homo sapiens
atgcatatgatatatagtt

SEQ ID NO: 5267222 - DNA, 15 bp, Homo sapiens
atgcatatgtagata

SEQ ID NO: 5267223 - DNA, 18 bp, Homo sapiens
atgcatatgtcactagaa

SEQ ID NO: 5267224 - DNA, 22 bp, Homo sapiens
atgcatatgtcactagaatgga

SEQ ID NO: 5267225 - DNA, 21 bp, Homo sapiens
atgcatattaaagaaagtcat

SEQ ID NO: 5267226 - DNA, 16 bp, Homo sapiens
atgcatattaaataat

SEQ ID NO: 5267227 - DNA, 17 bp, Homo sapiens
atgcatattcaatgtat

SEQ ID NO: 5267228 - DNA, 13 bp, Homo sapiens
atgcatattgtat

SEQ ID NO: 5267229 - DNA, 15 bp, Homo sapiens
atgcatattgtatta

SEQ ID NO: 5267230 - DNA, 16 bp, Homo sapiens
atgcatattgtattac

SEQ ID NO: 5267231 - DNA, 16 bp, Homo sapiens
atgcatatttataaga

SEQ ID NO: 5267232 - DNA, 19 bp, Homo sapiens
atgcatatttataagagaa

SEQ ID NO: 5267233 - DNA, 15 bp, Homo sapiens
atgcatatttataga

SEQ ID NO: 5267234 - DNA, 16 bp, Homo sapiens
atgcatatttgtttat

SEQ ID NO: 5267235 - DNA, 16 bp, Homo sapiens
atgcatatttttgcac

SEQ ID NO: 5267236 - DNA, 17 bp, Homo sapiens
atgcatcaagaactatt

SEQ ID NO: 5267237 - DNA, 15 bp, Homo sapiens
atgcatcaatcctgt

SEQ ID NO: 5267238 - DNA, 16 bp, Homo sapiens
atgcatcaatcctgtg

SEQ ID NO: 5267239 - DNA, 18 bp, Homo sapiens
atgcatcagaaagggagg

SEQ ID NO: 5267240 - DNA, 16 bp, Homo sapiens
atgcatcatcagccta

SEQ ID NO: 5267241 - DNA, 18 bp, Homo sapiens
atgcatcattcttgttaa

SEQ ID NO: 5267242 - DNA, 17 bp, Homo sapiens
atgcatcatttcaggag

SEQ ID NO: 5267243 - DNA, 20 bp, Homo sapiens
atgcatccatttactgacac

SEQ ID NO: 5267244 - DNA, 19 bp, Homo sapiens
atgcatcctttgcactgtc

SEQ ID NO: 5267245 - DNA, 16 bp, Homo sapiens
atgcatcgggaaagaa

SEQ ID NO: 5267246 - DNA, 22 bp, Homo sapiens
atgcatcgggaaagaagaaact

SEQ ID NO: 5267247 - DNA, 14 bp, Homo sapiens
atgcatctagatta

SEQ ID NO: 5267248 - DNA, 22 bp, Homo sapiens
atgcatctcactggatgcaaag

SEQ ID NO: 5267249 - DNA, 14 bp, Homo sapiens
atgcatctccacct

SEQ ID NO: 5267250 - DNA, 13 bp, Homo sapiens
atgcatctctgct

SEQ ID NO: 5267251 - DNA, 15 bp, Homo sapiens
atgcatctgtcctca

SEQ ID NO: 5267252 - DNA, 19 bp, Homo sapiens
atgcatctgtggcctgggg

SEQ ID NO: 5267253 - DNA, 20 bp, Homo sapiens
atgcatctgtttattctata

SEQ ID NO: 5267254 - DNA, 16 bp, Homo sapiens
atgcatcttactgaag

SEQ ID NO: 5267255 - DNA, 20 bp, Homo sapiens
atgcatctttaattccttat

SEQ ID NO: 5267256 - DNA, 12 bp, Homo sapiens
atgcatctttga

SEQ ID NO: 5267257 - DNA, 18 bp, Homo sapiens
atgcatctttgagaatat

SEQ ID NO: 5267258 - DNA, 16 bp, Homo sapiens
atgcatctttgatgtg

SEQ ID NO: 5267259 - DNA, 22 bp, Homo sapiens
atgcatgaaatgaatgtctgag

SEQ ID NO: 5267260 - DNA, 12 bp, Homo sapiens
atgcatgaacaa

SEQ ID NO: 5267261 - DNA, 13 bp, Homo sapiens
atgcatgaacaag

SEQ ID NO: 5267262 - DNA, 21 bp, Homo sapiens
atgcatgaacaagttttaatg

SEQ ID NO: 5267263 - DNA, 23 bp, Homo sapiens
atgcatgaagtaatatgcacaca

SEQ ID NO: 5267264 - DNA, 16 bp, Homo sapiens
atgcatgagaactaaa

SEQ ID NO: 5267265 - DNA, 17 bp, Homo sapiens
atgcatgagaactaaat

SEQ ID NO: 5267266 - DNA, 17 bp, Homo sapiens
atgcatgagctattgct

SEQ ID NO: 5267267 - DNA, 14 bp, Homo sapiens
atgcatgagctccc

SEQ ID NO: 5267268 - DNA, 20 bp, Homo sapiens
atgcatgatattgtatgtac

SEQ ID NO: 5267269 - DNA, 21 bp, Homo sapiens
atgcatgatattgtatgtacc

SEQ ID NO: 5267270 - DNA, 22 bp, Homo sapiens
atgcatgatattgtatgtacct

SEQ ID NO: 5267271 - DNA, 14 bp, Homo sapiens
atgcatgatgactc

SEQ ID NO: 5267272 - DNA, 21 bp, Homo sapiens
atgcatgatgccctcccctca

SEQ ID NO: 5267273 - DNA, 13 bp, Homo sapiens
atgcatgatgggt

SEQ ID NO: 5267274 - DNA, 14 bp, Homo sapiens
atgcatgattttat

SEQ ID NO: 5267275 - DNA, 15 bp, Homo sapiens
atgcatgattttata

SEQ ID NO: 5267276 - DNA, 17 bp, Homo sapiens
atgcatgattttataca

SEQ ID NO: 5267277 - DNA, 20 bp, Homo sapiens
atgcatgattttatacatag

SEQ ID NO: 5267278 - DNA, 22 bp, Homo sapiens
atgcatgattttatacatagtc

SEQ ID NO: 5267279 - DNA, 17 bp, Homo sapiens
atgcatgcactgttccc

SEQ ID NO: 5267280 - DNA, 22 bp, Homo sapiens
atgcatgccctctctgagtctg

SEQ ID NO: 5267281 - DNA, 21 bp, Homo sapiens
atgcatgcccttcctttctat

SEQ ID NO: 5267282 - DNA, 16 bp, Homo sapiens
atgcatgcgcaggctc

SEQ ID NO: 5267283 - DNA, 17 bp, Homo sapiens
atgcatgcgcaggctca

SEQ ID NO: 5267284 - DNA, 16 bp, Homo sapiens
atgcatgctttggaaa

SEQ ID NO: 5267285 - DNA, 12 bp, Homo sapiens
atgcatggaaat

SEQ ID NO: 5267286 - DNA, 20 bp, Homo sapiens
atgcatggaggactctcctc

SEQ ID NO: 5267287 - DNA, 13 bp, Homo sapiens
atgcatggcctcc

SEQ ID NO: 5267288 - DNA, 17 bp, Homo sapiens
atgcatggcctcccagc

SEQ ID NO: 5267289 - DNA, 19 bp, Homo sapiens
atgcatggtgcagttgaca

SEQ ID NO: 5267290 - DNA, 16 bp, Homo sapiens
atgcatggtgccccag

SEQ ID NO: 5267291 - DNA, 22 bp, Homo sapiens
atgcatggtgccccaggaccag

SEQ ID NO: 5267292 - DNA, 17 bp, Homo sapiens
atgcatggtttcagcac

SEQ ID NO: 5267293 - DNA, 18 bp, Homo sapiens
atgcatggtttcagcact

SEQ ID NO: 5267294 - DNA, 20 bp, Homo sapiens
atgcatggtttcagcactag

SEQ ID NO: 5267295 - DNA, 21 bp, Homo sapiens
atgcatgtaaggtcttcttgt

SEQ ID NO: 5267296 - DNA, 17 bp, Homo sapiens
atgcatgtactttatat

SEQ ID NO: 5267297 - DNA, 14 bp, Homo sapiens
atgcatgtagcata

SEQ ID NO: 5267298 - DNA, 15 bp, Homo sapiens
atgcatgtagcatat

SEQ ID NO: 5267299 - DNA, 16 bp, Homo sapiens
atgcatgtagcatata

SEQ ID NO: 5267300 - DNA, 16 bp, Homo sapiens
atgcatgtcaaacatg

SEQ ID NO: 5267301 - DNA, 22 bp, Homo sapiens
atgcatgtcaaacatgagatgt

SEQ ID NO: 5267302 - DNA, 17 bp, Homo sapiens
atgcatgtcctgtaaag

SEQ ID NO: 5267303 - DNA, 23 bp, Homo sapiens
atgcatgtctgccaaaatgcaac

SEQ ID NO: 5267304 - DNA, 12 bp, Homo sapiens
atgcatgtctta

SEQ ID NO: 5267305 - DNA, 19 bp, Homo sapiens
attaactgctccaaattta

SEQ ID NO: 5267306 - DNA, 17 bp, Homo sapiens
attaactgcttcctata

SEQ ID NO: 5267307 - DNA, 18 bp, Homo sapiens
attaactgggtaatgaaa

SEQ ID NO: 5267308 - DNA, 22 bp, Homo sapiens
attaactgggtaatgaaacaaa

SEQ ID NO: 5267309 - DNA, 23 bp, Homo sapiens
attaactgggtacccaaaacaca

SEQ ID NO: 5267310 - DNA, 21 bp, Homo sapiens
attaactggtagttcattgta

SEQ ID NO: 5267311 - DNA, 17 bp, Homo sapiens
attaacttaaaagattc

SEQ ID NO: 5267312 - DNA, 16 bp, Homo sapiens
attaacttaactgaag

SEQ ID NO: 5267313 - DNA, 14 bp, Homo sapiens
attaacttaataat

SEQ ID NO: 5267314 - DNA, 19 bp, Homo sapiens
attaacttaataatcaaga

SEQ ID NO: 5267315 - DNA, 20 bp, Homo sapiens
attaacttctattttcaagt

SEQ ID NO: 5267316 - DNA, 13 bp, Homo sapiens
attaactttaatg

SEQ ID NO: 5267317 - DNA, 20 bp, Homo sapiens
attaacttttataaacttta

SEQ ID NO: 5267318 - DNA, 22 bp, Homo sapiens
attaagaaaaacaataaagata

SEQ ID NO: 5267319 - DNA, 14 bp, Homo sapiens
attaagaaaactat

SEQ ID NO: 5267320 - DNA, 16 bp, Homo sapiens
attaagaaaactatta

SEQ ID NO: 5267321 - DNA, 19 bp, Homo sapiens
attaagaaaactattaaga

SEQ ID NO: 5267322 - DNA, 15 bp, Homo sapiens
attaagaaaatattc

SEQ ID NO: 5267323 - DNA, 13 bp, Homo sapiens
attaagaaaatca

SEQ ID NO: 5267324 - DNA, 17 bp, Homo sapiens
attaagaaacaatttaa

SEQ ID NO: 5267325 - DNA, 11 bp, Homo sapiens
attaagaaacc

SEQ ID NO: 5267326 - DNA, 12 bp, Homo sapiens
attaagaaacct

SEQ ID NO: 5267327 - DNA, 22 bp, Homo sapiens
attaagaaagattaaatatatc

SEQ ID NO: 5267328 - DNA, 20 bp, Homo sapiens
attaagaacacttttaataa

SEQ ID NO: 5267329 - DNA, 14 bp, Homo sapiens
attaagaactgaat

SEQ ID NO: 5267330 - DNA, 19 bp, Homo sapiens
attaagaagagcagagctg

SEQ ID NO: 5267331 - DNA, 22 bp, Homo sapiens
attaagaaggcaaaaatgtaaa

SEQ ID NO: 5267332 - DNA, 14 bp, Homo sapiens
attaagaaggcact

SEQ ID NO: 5267333 - DNA, 14 bp, Homo sapiens
attaagaatgatct

SEQ ID NO: 5267334 - DNA, 12 bp, Homo sapiens
attaagaatgtt

SEQ ID NO: 5267335 - DNA, 21 bp, Homo sapiens
attaagaatgttggtttactt

SEQ ID NO: 5267336 - DNA, 23 bp, Homo sapiens
attaagaatgttggtttactttc

SEQ ID NO: 5267337 - DNA, 19 bp, Homo sapiens
attaagacaaaaagccttg

SEQ ID NO: 5267338 - DNA, 20 bp, Homo sapiens
attaagacaaaaagccttga

SEQ ID NO: 5267339 - DNA, 22 bp, Homo sapiens
attaagacaaaaagccttgaag

SEQ ID NO: 5267340 - DNA, 14 bp, Homo sapiens
attaagacagtgta

SEQ ID NO: 5267341 - DNA, 16 bp, Homo sapiens
attaagacagtgtaca

SEQ ID NO: 5267342 - DNA, 17 bp, Homo sapiens
attaagaccaaagactt

SEQ ID NO: 5267343 - DNA, 16 bp, Homo sapiens
attaagagaacaaaga

SEQ ID NO: 5267344 - DNA, 15 bp, Homo sapiens
attaagagatacatt

SEQ ID NO: 5267345 - DNA, 16 bp, Homo sapiens
attaagagatacattc

SEQ ID NO: 5267346 - DNA, 16 bp, Homo sapiens
attaagagcaaacttt

SEQ ID NO: 5267347 - DNA, 18 bp, Homo sapiens
attaagagcaaactttag

SEQ ID NO: 5267348 - DNA, 18 bp, Homo sapiens
attaagagctattttaga

SEQ ID NO: 5267349 - DNA, 23 bp, Homo sapiens
attaagagctattttagaaagct

SEQ ID NO: 5267350 - DNA, 17 bp, Homo sapiens
attaagaggcagaaaat

SEQ ID NO: 5267351 - DNA, 18 bp, Homo sapiens
attaagaggtaagactta

SEQ ID NO: 5267352 - DNA, 17 bp, Homo sapiens
attaagagtgaatgtgt

SEQ ID NO: 5267353 - DNA, 14 bp, Homo sapiens
attaagatacactc

SEQ ID NO: 5267354 - DNA, 16 bp, Homo sapiens
attaagatacactcct

SEQ ID NO: 5267355 - DNA, 16 bp, Homo sapiens
attaagatcctaaact

SEQ ID NO: 5267356 - DNA, 16 bp, Homo sapiens
attaagatgccttgaa

SEQ ID NO: 5267357 - DNA, 17 bp, Homo sapiens
attaagatgccttgaat

SEQ ID NO: 5267358 - DNA, 19 bp, Homo sapiens
attaagatgccttgaattg

SEQ ID NO: 5267359 - DNA, 15 bp, Homo sapiens
attaagatggattct

SEQ ID NO: 5267360 - DNA, 23 bp, Homo sapiens
attaagatggattctcagatatt

SEQ ID NO: 5267361 - DNA, 24 bp, Homo sapiens
attaagatggattctcagatattt

SEQ ID NO: 5267362 - DNA, 14 bp, Homo sapiens
attaagattattgt

SEQ ID NO: 5267363 - DNA, 21 bp, Homo sapiens
attaagattctctgcccagcc

SEQ ID NO: 5267364 - DNA, 17 bp, Homo sapiens
attaagattgaggcctg

SEQ ID NO: 5267365 - DNA, 20 bp, Homo sapiens
attaagattgaggcctgccc

SEQ ID NO: 5267366 - DNA, 16 bp, Homo sapiens
attaagattggaaatg

SEQ ID NO: 5267367 - DNA, 11 bp, Homo sapiens
attaagatttc

SEQ ID NO: 5267368 - DNA, 17 bp, Homo sapiens
attaagcaaatgttaaa

SEQ ID NO: 5267369 - DNA, 21 bp, Homo sapiens
attaagcaaccttaaagcaat

SEQ ID NO: 5267370 - DNA, 19 bp, Homo sapiens
attaagcacacacatctgg

SEQ ID NO: 5267371 - DNA, 23 bp, Homo sapiens
attaagcacattattgtagagaa

SEQ ID NO: 5267372 - DNA, 12 bp, Homo sapiens
attaagcagaaa

SEQ ID NO: 5267373 - DNA, 15 bp, Homo sapiens
attaagcagaaacag

SEQ ID NO: 5267374 - DNA, 18 bp, Homo sapiens
attaagcagaaacagcat

SEQ ID NO: 5267375 - DNA, 13 bp, Homo sapiens
attaagcagcttg

SEQ ID NO: 5267376 - DNA, 15 bp, Homo sapiens
attaagcagtaaaaa

SEQ ID NO: 5267377 - DNA, 19 bp, Homo sapiens
attaagcagtaaaaactgt

SEQ ID NO: 5267378 - DNA, 21 bp, Homo sapiens
attaagcatatatttttatat

SEQ ID NO: 5267379 - DNA, 14 bp, Homo sapiens
attaagcatcacaa

SEQ ID NO: 5267380 - DNA, 17 bp, Homo sapiens
attaagcatcagaaact

SEQ ID NO: 5267381 - DNA, 21 bp, Homo sapiens
attaagcattttgaaacaaag

SEQ ID NO: 5267382 - DNA, 15 bp, Homo sapiens
attaagccaaacatg

SEQ ID NO: 5267383 - DNA, 15 bp, Homo sapiens
attaagcccttattt

SEQ ID NO: 5267384 - DNA, 23 bp, Homo sapiens
attaagctccagtgctttatcca

SEQ ID NO: 5267385 - DNA, 16 bp, Homo sapiens
attaagctccttcagt

SEQ ID NO: 5267386 - DNA, 22 bp, Homo sapiens
attaagctccttcagtttgaag

SEQ ID NO: 5267387 - DNA, 13 bp, Homo sapiens
attaagctgtgca

SEQ ID NO: 5267388 - DNA, 20 bp, Homo sapiens
attaagctgtttgaaggaaa

SEQ ID NO: 5267389 - DNA, 12 bp, Homo sapiens
attaaggaacat

SEQ ID NO: 5267390 - DNA, 15 bp, Homo sapiens
attaaggactacaga

SEQ ID NO: 5267391 - DNA, 18 bp, Homo sapiens
attaaggatgtagctttt

SEQ ID NO: 5267392 - DNA, 17 bp, Homo sapiens
attaaggattttatgct

SEQ ID NO: 5267393 - DNA, 16 bp, Homo sapiens
attaaggcaactgaac

SEQ ID NO: 5267394 - DNA, 15 bp, Homo sapiens
attaaggcagtatga

SEQ ID NO: 5267395 - DNA, 16 bp, Homo sapiens
attaagggacatgtat

SEQ ID NO: 5267396 - DNA, 17 bp, Homo sapiens
attaagggacatttcta

SEQ ID NO: 5267397 - DNA, 15 bp, Homo sapiens
attaaggggaagaat

SEQ ID NO: 5267398 - DNA, 18 bp, Homo sapiens
attaaggggaagaatgaa

SEQ ID NO: 5267399 - DNA, 19 bp, Homo sapiens
attaaggggaagaatgaaa

SEQ ID NO: 5267400 - DNA, 16 bp, Homo sapiens
attaagggtaggatgt

SEQ ID NO: 5267401 - DNA, 22 bp, Homo sapiens
attaagggtaggatgttgcttc

SEQ ID NO: 5267402 - DNA, 22 bp, Homo sapiens
attaagggttaccccaccctgc

SEQ ID NO: 5267403 - DNA, 15 bp, Homo sapiens
attaaggtacatcat

SEQ ID NO: 5267404 - DNA, 17 bp, Homo sapiens
attaaggtagttattca

SEQ ID NO: 5267405 - DNA, 16 bp, Homo sapiens
attaaggtctctcttt

SEQ ID NO: 5267406 - DNA, 19 bp, Homo sapiens
attaaggtctctctttgga

SEQ ID NO: 5267407 - DNA, 15 bp, Homo sapiens
attaaggtgtttgaa

SEQ ID NO: 5267408 - DNA, 18 bp, Homo sapiens
attaaggtgtttgaaaat

SEQ ID NO: 5267409 - DNA, 14 bp, Homo sapiens
attaagtaaaaaat

SEQ ID NO: 5267410 - DNA, 19 bp, Homo sapiens
attaagtaacttatttatg

SEQ ID NO: 5267411 - DNA, 22 bp, Homo sapiens
attaagtaatctttttacagtt

SEQ ID NO: 5267412 - DNA, 21 bp, Homo sapiens
attaagtaatgataactggaa

SEQ ID NO: 5267413 - DNA, 23 bp, Homo sapiens
attaagtaatgataactggaaac

SEQ ID NO: 5267414 - DNA, 14 bp, Homo sapiens
attaagtactatgt

SEQ ID NO: 5267415 - DNA, 13 bp, Homo sapiens
attaagtcatgtg

SEQ ID NO: 5267416 - DNA, 18 bp, Homo sapiens
attaagtcatgtgtgaac

SEQ ID NO: 5267417 - DNA, 17 bp, Homo sapiens
attaagtcattttgtaa

SEQ ID NO: 5267418 - DNA, 18 bp, Homo sapiens
attaagtcattttgtaat

SEQ ID NO: 5267419 - DNA, 14 bp, Homo sapiens
attaagtctcagta

SEQ ID NO: 5267420 - DNA, 21 bp, Homo sapiens
attaagtctgggatgtagaac

SEQ ID NO: 5267421 - DNA, 24 bp, Homo sapiens
attaagtctgtgagattcattcat

SEQ ID NO: 5267422 - DNA, 18 bp, Homo sapiens
attaagtgaaattttaaa

SEQ ID NO: 5267423 - DNA, 22 bp, Homo sapiens
attaagtgactgaccatgcact

SEQ ID NO: 5267424 - DNA, 20 bp, Homo sapiens
attaagtgcagcttgacatt

SEQ ID NO: 5267425 - DNA, 23 bp, Homo sapiens
attaagtgcagcttgacattatg

SEQ ID NO: 5267426 - DNA, 18 bp, Homo sapiens
attaagtggctttttaac

SEQ ID NO: 5267427 - DNA, 16 bp, Homo sapiens
attaagtggttacttt

SEQ ID NO: 5267428 - DNA, 19 bp, Homo sapiens
attaagtgtgtataaaaca

SEQ ID NO: 5267429 - DNA, 13 bp, Homo sapiens
attaagttacaat

SEQ ID NO: 5267430 - DNA, 22 bp, Homo sapiens
attaagttacaattacatctct

SEQ ID NO: 5267431 - DNA, 18 bp, Homo sapiens
attaagttataccagcaa

SEQ ID NO: 5267432 - DNA, 19 bp, Homo sapiens
attaagttctcaatgtgaa

SEQ ID NO: 5267433 - DNA, 12 bp, Homo sapiens
attaagttgaaa

SEQ ID NO: 5267434 - DNA, 14 bp, Homo sapiens
attaagttgaaaaa

SEQ ID NO: 5267435 - DNA, 19 bp, Homo sapiens
attaagttgttaataaaag

SEQ ID NO: 5267436 - DNA, 17 bp, Homo sapiens
attaagttgttgaaagt

SEQ ID NO: 5267437 - DNA, 13 bp, Homo sapiens
attaataaaactg

SEQ ID NO: 5267438 - DNA, 15 bp, Homo sapiens
attaataaaactgtg

SEQ ID NO: 5267439 - DNA, 13 bp, Homo sapiens
attaataaaatac

SEQ ID NO: 5267440 - DNA, 13 bp, Homo sapiens
attaataaagaaa

SEQ ID NO: 5267441 - DNA, 16 bp, Homo sapiens
attaataaagaaaaag

SEQ ID NO: 5267442 - DNA, 13 bp, Homo sapiens
attaataaatgtc

SEQ ID NO: 5267443 - DNA, 16 bp, Homo sapiens
attaataacagaaata

SEQ ID NO: 5267444 - DNA, 19 bp, Homo sapiens
attaataacagaaatacat

SEQ ID NO: 5267445 - DNA, 18 bp, Homo sapiens
attaataactttctctgt

SEQ ID NO: 5267446 - DNA, 21 bp, Homo sapiens
attaataactttctctgtgaa

SEQ ID NO: 5267447 - DNA, 15 bp, Homo sapiens
attaataagattttt

SEQ ID NO: 5267448 - DNA, 17 bp, Homo sapiens
attaataagtgaagaat

SEQ ID NO: 5267449 - DNA, 19 bp, Homo sapiens
attaataagtgaagaatac

SEQ ID NO: 5267450 - DNA, 16 bp, Homo sapiens
attaataatagctaat

SEQ ID NO: 5267451 - DNA, 18 bp, Homo sapiens
attaataatatgtactaa

SEQ ID NO: 5267452 - DNA, 15 bp, Homo sapiens
attaataatatttat

SEQ ID NO: 5267453 - DNA, 16 bp, Homo sapiens
attaataatcttatta

SEQ ID NO: 5267454 - DNA, 13 bp, Homo sapiens
attaatacaatat

SEQ ID NO: 5267455 - DNA, 14 bp, Homo sapiens
attaatacataagt

SEQ ID NO: 5267456 - DNA, 16 bp, Homo sapiens
attaataccaaatatt

SEQ ID NO: 5267457 - DNA, 18 bp, Homo sapiens
attaataccaaatatttt

SEQ ID NO: 5267458 - DNA, 19 bp, Homo sapiens
attaatacctgacctcaca

SEQ ID NO: 5267459 - DNA, 13 bp, Homo sapiens
attaatactaaaa

SEQ ID NO: 5267460 - DNA, 16 bp, Homo sapiens
attaatactacccata

SEQ ID NO: 5267461 - DNA, 21 bp, Homo sapiens
attaatactctatttttacat

SEQ ID NO: 5267462 - DNA, 13 bp, Homo sapiens
attaatagctttt

SEQ ID NO: 5267463 - DNA, 18 bp, Homo sapiens
attaatagcttttattgt

SEQ ID NO: 5267464 - DNA, 19 bp, Homo sapiens
attaatagcttttattgta

SEQ ID NO: 5267465 - DNA, 21 bp, Homo sapiens
attaataggaaagatttaatg

SEQ ID NO: 5267466 - DNA, 23 bp, Homo sapiens
attaatagtaggattattcctag

SEQ ID NO: 5267467 - DNA, 16 bp, Homo sapiens
attaatataaaaacat

SEQ ID NO: 5267468 - DNA, 17 bp, Homo sapiens
attaatataagtttctt

SEQ ID NO: 5267469 - DNA, 16 bp, Homo sapiens
attaatatatgtatta

SEQ ID NO: 5267470 - DNA, 13 bp, Homo sapiens
attaatatattaa

SEQ ID NO: 5267471 - DNA, 16 bp, Homo sapiens
attaatatatttaata

SEQ ID NO: 5267472 - DNA, 15 bp, Homo sapiens
attaatatcacagca

SEQ ID NO: 5267473 - DNA, 20 bp, Homo sapiens
attaatatccctacatgtat

SEQ ID NO: 5267474 - DNA, 12 bp, Homo sapiens
attaatatgaaa

SEQ ID NO: 5267475 - DNA, 20 bp, Homo sapiens
attaatatggggatgcagca

SEQ ID NO: 5267476 - DNA, 13 bp, Homo sapiens
attaatatgtact

SEQ ID NO: 5267477 - DNA, 20 bp, Homo sapiens
attaatatgtacttttccat

SEQ ID NO: 5267478 - DNA, 22 bp, Homo sapiens
attaatatgtacttttccattt

SEQ ID NO: 5267479 - DNA, 18 bp, Homo sapiens
attaatatgtgggaatta

SEQ ID NO: 5267480 - DNA, 18 bp, Homo sapiens
attaatatgttcattaaa

SEQ ID NO: 5267481 - DNA, 22 bp, Homo sapiens
attaatatgttcattaaatttt

SEQ ID NO: 5267482 - DNA, 20 bp, Homo sapiens
attaatattaactacagaaa

SEQ ID NO: 5267483 - DNA, 23 bp, Homo sapiens
attaatattcagggtaaatagga

SEQ ID NO: 5267484 - DNA, 18 bp, Homo sapiens
atgcatgtcttaaatgct

SEQ ID NO: 5267485 - DNA, 13 bp, Homo sapiens
atgcatgtgctgt

SEQ ID NO: 5267486 - DNA, 22 bp, Homo sapiens
atgcatgttgaccatgtctatg

SEQ ID NO: 5267487 - DNA, 13 bp, Homo sapiens
atgcattaaaaaa

SEQ ID NO: 5267488 - DNA, 14 bp, Homo sapiens
atgcattaaacctg

SEQ ID NO: 5267489 - DNA, 17 bp, Homo sapiens
atgcattaaacctgtct

SEQ ID NO: 5267490 - DNA, 21 bp, Homo sapiens
atgcattacctgggaatttat

SEQ ID NO: 5267491 - DNA, 19 bp, Homo sapiens
atgcattagattatcaaaa

SEQ ID NO: 5267492 - DNA, 13 bp, Homo sapiens
atgcattagggaa

SEQ ID NO: 5267493 - DNA, 23 bp, Homo sapiens
atgcattattgacgaactggcta

SEQ ID NO: 5267494 - DNA, 14 bp, Homo sapiens
atgcattcactcag

SEQ ID NO: 5267495 - DNA, 13 bp, Homo sapiens
atgcattcagatc

SEQ ID NO: 5267496 - DNA, 17 bp, Homo sapiens
atgcattccagaacaaa

SEQ ID NO: 5267497 - DNA, 21 bp, Homo sapiens
atgcattccagaacaaattgt

SEQ ID NO: 5267498 - DNA, 15 bp, Homo sapiens
atgcattctatcgtt

SEQ ID NO: 5267499 - DNA, 23 bp, Homo sapiens
atgcattctatcgttattataaa

SEQ ID NO: 5267500 - DNA, 13 bp, Homo sapiens
atgcattctgata

SEQ ID NO: 5267501 - DNA, 20 bp, Homo sapiens
atgcattctttatagtgaag

SEQ ID NO: 5267502 - DNA, 12 bp, Homo sapiens
atgcattctttt

SEQ ID NO: 5267503 - DNA, 16 bp, Homo sapiens
atgcattgaaagaatt

SEQ ID NO: 5267504 - DNA, 17 bp, Homo sapiens
atgcattgactatttct

SEQ ID NO: 5267505 - DNA, 14 bp, Homo sapiens
atgcattgagctgc

SEQ ID NO: 5267506 - DNA, 20 bp, Homo sapiens
atgcattgagctgcctccag

SEQ ID NO: 5267507 - DNA, 21 bp, Homo sapiens
atgcattgagctgcctccagc

SEQ ID NO: 5267508 - DNA, 18 bp, Homo sapiens
atgcattgatattgtgaa

SEQ ID NO: 5267509 - DNA, 15 bp, Homo sapiens
atgcattgctctgga

SEQ ID NO: 5267510 - DNA, 14 bp, Homo sapiens
atgcattgtagttt

SEQ ID NO: 5267511 - DNA, 14 bp, Homo sapiens
atgcattgtcctct

SEQ ID NO: 5267512 - DNA, 16 bp, Homo sapiens
atgcattgtctgcaat

SEQ ID NO: 5267513 - DNA, 18 bp, Homo sapiens
atgcattgtcttgtggag

SEQ ID NO: 5267514 - DNA, 21 bp, Homo sapiens
atgcattgtgaattgcctgcc

SEQ ID NO: 5267515 - DNA, 12 bp, Homo sapiens
atgcattgttgg

SEQ ID NO: 5267516 - DNA, 21 bp, Homo sapiens
atgcattgttggctatttgaa

SEQ ID NO: 5267517 - DNA, 15 bp, Homo sapiens
atgcattgttgtaaa

SEQ ID NO: 5267518 - DNA, 21 bp, Homo sapiens
atgcattgttgtaaagtattt

SEQ ID NO: 5267519 - DNA, 12 bp, Homo sapiens
atgcatttaaaa

SEQ ID NO: 5267520 - DNA, 15 bp, Homo sapiens
atgcatttaaaatac

SEQ ID NO: 5267521 - DNA, 16 bp, Homo sapiens
atgcatttaaaatacc

SEQ ID NO: 5267522 - DNA, 20 bp, Homo sapiens
atgcatttaaaataccactg

SEQ ID NO: 5267523 - DNA, 20 bp, Homo sapiens
atgcatttaagttgtaaacg

SEQ ID NO: 5267524 - DNA, 14 bp, Homo sapiens
atgcatttaataaa

SEQ ID NO: 5267525 - DNA, 15 bp, Homo sapiens
atgcatttaataaag

SEQ ID NO: 5267526 - DNA, 17 bp, Homo sapiens
atgcatttaataaagat

SEQ ID NO: 5267527 - DNA, 19 bp, Homo sapiens
atgcatttatagatcattt

SEQ ID NO: 5267528 - DNA, 18 bp, Homo sapiens
atgcatttatcaataaaa

SEQ ID NO: 5267529 - DNA, 12 bp, Homo sapiens
atgcatttatgc

SEQ ID NO: 5267530 - DNA, 20 bp, Homo sapiens
atgcatttatgcatgagaac

SEQ ID NO: 5267531 - DNA, 17 bp, Homo sapiens
atgcatttcaaatgtta

SEQ ID NO: 5267532 - DNA, 13 bp, Homo sapiens
atgcatttcattc

SEQ ID NO: 5267533 - DNA, 13 bp, Homo sapiens
atgcatttccaca

SEQ ID NO: 5267534 - DNA, 12 bp, Homo sapiens
atgcatttgact

SEQ ID NO: 5267535 - DNA, 14 bp, Homo sapiens
atgcatttgcattt

SEQ ID NO: 5267536 - DNA, 13 bp, Homo sapiens
atgcatttggaac

SEQ ID NO: 5267537 - DNA, 21 bp, Homo sapiens
atgcatttggaaccaaagtct

SEQ ID NO: 5267538 - DNA, 15 bp, Homo sapiens
atgcatttgggtcca

SEQ ID NO: 5267539 - DNA, 19 bp, Homo sapiens
atgcatttgggtccaggag

SEQ ID NO: 5267540 - DNA, 22 bp, Homo sapiens
atgcattttaaagttaaacatt

SEQ ID NO: 5267541 - DNA, 18 bp, Homo sapiens
atgcattttaaatgtcta

SEQ ID NO: 5267542 - DNA, 21 bp, Homo sapiens
atgcattttaaatgtctataa

SEQ ID NO: 5267543 - DNA, 15 bp, Homo sapiens
atgcattttatcaga

SEQ ID NO: 5267544 - DNA, 19 bp, Homo sapiens
atgcattttatcagacaat

SEQ ID NO: 5267545 - DNA, 15 bp, Homo sapiens
atgcattttcttcag

SEQ ID NO: 5267546 - DNA, 12 bp, Homo sapiens
atgcattttgca

SEQ ID NO: 5267547 - DNA, 18 bp, Homo sapiens
atgcattttgcagcagtg

SEQ ID NO: 5267548 - DNA, 16 bp, Homo sapiens
atgcatttttaagaat

SEQ ID NO: 5267549 - DNA, 18 bp, Homo sapiens
atgccaaaaaaaaataca

SEQ ID NO: 5267550 - DNA, 18 bp, Homo sapiens
atgccaaaaaaagacagg

SEQ ID NO: 5267551 - DNA, 14 bp, Homo sapiens
atgccaaacagttg

SEQ ID NO: 5267552 - DNA, 17 bp, Homo sapiens
atgccaaacagttgtac

SEQ ID NO: 5267553 - DNA, 18 bp, Homo sapiens
atgccaaagatcacttgt

SEQ ID NO: 5267554 - DNA, 14 bp, Homo sapiens
atgccaaagatgtt

SEQ ID NO: 5267555 - DNA, 23 bp, Homo sapiens
atgccaaagatgtttgaaaatgc

SEQ ID NO: 5267556 - DNA, 12 bp, Homo sapiens
atgccaaagcag

SEQ ID NO: 5267557 - DNA, 20 bp, Homo sapiens
atgccaaagccattctcccc

SEQ ID NO: 5267558 - DNA, 12 bp, Homo sapiens
atgccaaagctg

SEQ ID NO: 5267559 - DNA, 17 bp, Homo sapiens
atgccaaagctgctttc

SEQ ID NO: 5267560 - DNA, 12 bp, Homo sapiens
atgccaaaggaa

SEQ ID NO: 5267561 - DNA, 20 bp, Homo sapiens
atgccaaatgttaactgcca

SEQ ID NO: 5267562 - DNA, 21 bp, Homo sapiens
atgccaaatgttaactgccaa

SEQ ID NO: 5267563 - DNA, 13 bp, Homo sapiens
atgccaacaagaa

SEQ ID NO: 5267564 - DNA, 15 bp, Homo sapiens
atgccaacaagaatg

SEQ ID NO: 5267565 - DNA, 19 bp, Homo sapiens
atgccaacaagaatgcatt

SEQ ID NO: 5267566 - DNA, 21 bp, Homo sapiens
atgccaacaagaatgcattga

SEQ ID NO: 5267567 - DNA, 15 bp, Homo sapiens
atgccaacaccttct

SEQ ID NO: 5267568 - DNA, 20 bp, Homo sapiens
atgccaacacttaatcattt

SEQ ID NO: 5267569 - DNA, 21 bp, Homo sapiens
atgccaacatacccttcttta

SEQ ID NO: 5267570 - DNA, 16 bp, Homo sapiens
atgccaactcgggagc

SEQ ID NO: 5267571 - DNA, 18 bp, Homo sapiens
atgccaactcgggagcat

SEQ ID NO: 5267572 - DNA, 16 bp, Homo sapiens
atgccaactgttggaa

SEQ ID NO: 5267573 - DNA, 16 bp, Homo sapiens
atgccaacttcccaca

SEQ ID NO: 5267574 - DNA, 22 bp, Homo sapiens
atgccaagaaaagggctgacat

SEQ ID NO: 5267575 - DNA, 22 bp, Homo sapiens
atgccaaggaccttttgctgcc

SEQ ID NO: 5267576 - DNA, 21 bp, Homo sapiens
atgccaagggggtgactggaa

SEQ ID NO: 5267577 - DNA, 16 bp, Homo sapiens
atgccaagttgtttga

SEQ ID NO: 5267578 - DNA, 23 bp, Homo sapiens
atgccaatactagtcaccccaag

SEQ ID NO: 5267579 - DNA, 13 bp, Homo sapiens
atgccaatgacat

SEQ ID NO: 5267580 - DNA, 21 bp, Homo sapiens
atgccaattacggtgtacagt

SEQ ID NO: 5267581 - DNA, 14 bp, Homo sapiens
atgccaatttcctc

SEQ ID NO: 5267582 - DNA, 17 bp, Homo sapiens
atgccaatttcctctcc

SEQ ID NO: 5267583 - DNA, 14 bp, Homo sapiens
atgccacacacctt

SEQ ID NO: 5267584 - DNA, 16 bp, Homo sapiens
atgccacacatcaccc

SEQ ID NO: 5267585 - DNA, 15 bp, Homo sapiens
atgccacaccaagct

SEQ ID NO: 5267586 - DNA, 22 bp, Homo sapiens
atgccacaccaagctgtgccac

SEQ ID NO: 5267587 - DNA, 23 bp, Homo sapiens
atgccacaccaagctgtgccacc

SEQ ID NO: 5267588 - DNA, 15 bp, Homo sapiens
atgccacacctggcc

SEQ ID NO: 5267589 - DNA, 17 bp, Homo sapiens
atgccacacctggcctt

SEQ ID NO: 5267590 - DNA, 13 bp, Homo sapiens
atgccacagccaa

SEQ ID NO: 5267591 - DNA, 15 bp, Homo sapiens
atgccacagccaagc

SEQ ID NO: 5267592 - DNA, 12 bp, Homo sapiens
atgccacagccc

SEQ ID NO: 5267593 - DNA, 15 bp, Homo sapiens
atgccacagccccac

SEQ ID NO: 5267594 - DNA, 18 bp, Homo sapiens
atgccacatcaaaccttt

SEQ ID NO: 5267595 - DNA, 15 bp, Homo sapiens
atgccaccaaaggag

SEQ ID NO: 5267596 - DNA, 14 bp, Homo sapiens
atgccaccatccaa

SEQ ID NO: 5267597 - DNA, 20 bp, Homo sapiens
atgccacccagcaacacaga

SEQ ID NO: 5267598 - DNA, 14 bp, Homo sapiens
atgccaccctcaca

SEQ ID NO: 5267599 - DNA, 14 bp, Homo sapiens
atgccaccctctcc

SEQ ID NO: 5267600 - DNA, 15 bp, Homo sapiens
atgccaccctctcca

SEQ ID NO: 5267601 - DNA, 16 bp, Homo sapiens
atgccaccctctccat

SEQ ID NO: 5267602 - DNA, 19 bp, Homo sapiens
atgccaccctgttttcagc

SEQ ID NO: 5267603 - DNA, 21 bp, Homo sapiens
atgccacctagactctccctg

SEQ ID NO: 5267604 - DNA, 15 bp, Homo sapiens
atgccacctgcagcg

SEQ ID NO: 5267605 - DNA, 17 bp, Homo sapiens
atgccacgcctggaagg

SEQ ID NO: 5267606 - DNA, 15 bp, Homo sapiens
atgccacggcagcca

SEQ ID NO: 5267607 - DNA, 23 bp, Homo sapiens
atgccacggcagccaccctgcca

SEQ ID NO: 5267608 - DNA, 13 bp, Homo sapiens
atgccacgtgcca

SEQ ID NO: 5267609 - DNA, 21 bp, Homo sapiens
atgccacgttccacagttgcc

SEQ ID NO: 5267610 - DNA, 15 bp, Homo sapiens
atgccactaaattga

SEQ ID NO: 5267611 - DNA, 15 bp, Homo sapiens
atgccactaggccct

SEQ ID NO: 5267612 - DNA, 18 bp, Homo sapiens
atgccactaggccctggt

SEQ ID NO: 5267613 - DNA, 16 bp, Homo sapiens
atgccactcctccctc

SEQ ID NO: 5267614 - DNA, 13 bp, Homo sapiens
atgccactgccag

SEQ ID NO: 5267615 - DNA, 16 bp, Homo sapiens
atgccactgccaggca

SEQ ID NO: 5267616 - DNA, 17 bp, Homo sapiens
atgccactgccaggcac

SEQ ID NO: 5267617 - DNA, 23 bp, Homo sapiens
atgccactgccaggcacctggcc

SEQ ID NO: 5267618 - DNA, 15 bp, Homo sapiens
atgccactgccttcg

SEQ ID NO: 5267619 - DNA, 21 bp, Homo sapiens
atgccactgctttccagcctg

SEQ ID NO: 5267620 - DNA, 15 bp, Homo sapiens
atgccactgggacag

SEQ ID NO: 5267621 - DNA, 18 bp, Homo sapiens
atgccactgggacagctg

SEQ ID NO: 5267622 - DNA, 18 bp, Homo sapiens
atgccacttctaagaaaa

SEQ ID NO: 5267623 - DNA, 14 bp, Homo sapiens
atgccagaaacagt

SEQ ID NO: 5267624 - DNA, 17 bp, Homo sapiens
atgccagaaacagttcc

SEQ ID NO: 5267625 - DNA, 19 bp, Homo sapiens
atgccagacttctaaaata

SEQ ID NO: 5267626 - DNA, 22 bp, Homo sapiens
atgccagagacggaagcctttt

SEQ ID NO: 5267627 - DNA, 17 bp, Homo sapiens
atgccagagccaacctg

SEQ ID NO: 5267628 - DNA, 18 bp, Homo sapiens
atgccagagccaacctgg

SEQ ID NO: 5267629 - DNA, 21 bp, Homo sapiens
atgccagagccaacctggact

SEQ ID NO: 5267630 - DNA, 22 bp, Homo sapiens
atgccagagccaacctggactt

SEQ ID NO: 5267631 - DNA, 13 bp, Homo sapiens
atgccagagcctg

SEQ ID NO: 5267632 - DNA, 14 bp, Homo sapiens
atgccagagggcca

SEQ ID NO: 5267633 - DNA, 15 bp, Homo sapiens
atgccagagggccag

SEQ ID NO: 5267634 - DNA, 18 bp, Homo sapiens
atgccagagggccagcag

SEQ ID NO: 5267635 - DNA, 22 bp, Homo sapiens
atgccagagggccagcaggctc

SEQ ID NO: 5267636 - DNA, 21 bp, Homo sapiens
atgccagattctgcctctctg

SEQ ID NO: 5267637 - DNA, 11 bp, Homo sapiens
atgccagccca

SEQ ID NO: 5267638 - DNA, 12 bp, Homo sapiens
atgccagcccaa

SEQ ID NO: 5267639 - DNA, 13 bp, Homo sapiens
atgccagcccaaa

SEQ ID NO: 5267640 - DNA, 15 bp, Homo sapiens
atgccagcccttcag

SEQ ID NO: 5267641 - DNA, 16 bp, Homo sapiens
atgccagctacttcct

SEQ ID NO: 5267642 - DNA, 19 bp, Homo sapiens
atgccagctcagtcccatc

SEQ ID NO: 5267643 - DNA, 15 bp, Homo sapiens
atgccagctgtgtcc

SEQ ID NO: 5267644 - DNA, 22 bp, Homo sapiens
atgccagcttcctgtgggccag

SEQ ID NO: 5267645 - DNA, 17 bp, Homo sapiens
atgccaggacagctgca

SEQ ID NO: 5267646 - DNA, 15 bp, Homo sapiens
atgccaggatttctc

SEQ ID NO: 5267647 - DNA, 20 bp, Homo sapiens
atgccaggctgcgtccctcc

SEQ ID NO: 5267648 - DNA, 12 bp, Homo sapiens
atgccaggctgt

SEQ ID NO: 5267649 - DNA, 18 bp, Homo sapiens
atgccagggccgaccaga

SEQ ID NO: 5267650 - DNA, 21 bp, Homo sapiens
atgccagggccgaccagagga

SEQ ID NO: 5267651 - DNA, 13 bp, Homo sapiens
atgccaggggcct

SEQ ID NO: 5267652 - DNA, 21 bp, Homo sapiens
atgccaggttaggaaggcagc

SEQ ID NO: 5267653 - DNA, 23 bp, Homo sapiens
atgccagtaacgcgtcttcctga

SEQ ID NO: 5267654 - DNA, 14 bp, Homo sapiens
atgccagtattttt

SEQ ID NO: 5267655 - DNA, 12 bp, Homo sapiens
atgccagtctca

SEQ ID NO: 5267656 - DNA, 16 bp, Homo sapiens
atgccagtctcattgt

SEQ ID NO: 5267657 - DNA, 16 bp, Homo sapiens
atgccagtgactgctg

SEQ ID NO: 5267658 - DNA, 18 bp, Homo sapiens
atgccagtgactgctgcg

SEQ ID NO: 5267659 - DNA, 20 bp, Homo sapiens
atgccagtgactgctgcgct

SEQ ID NO: 5267660 - DNA, 22 bp, Homo sapiens
atgccagtgactgctgcgctgt

SEQ ID NO: 5267661 - DNA, 15 bp, Homo sapiens
atgccagtgccttat

SEQ ID NO: 5267662 - DNA, 19 bp, Homo sapiens
atgccataaaagccgccca

SEQ ID NO: 5267663 - DNA, 16 bp, Homo sapiens
atgccataaatacaag

SEQ ID NO: 5267664 - DNA, 11 bp, Homo sapiens
atgccataata

SEQ ID NO: 5267665 - DNA, 20 bp, Homo sapiens
attaatattcccattttatt

SEQ ID NO: 5267666 - DNA, 12 bp, Homo sapiens
attaatattcct

SEQ ID NO: 5267667 - DNA, 18 bp, Homo sapiens
attaatattgtattgctg

SEQ ID NO: 5267668 - DNA, 22 bp, Homo sapiens
attaatatttaccaaagtagga

SEQ ID NO: 5267669 - DNA, 17 bp, Homo sapiens
attaatatttatgtgtt

SEQ ID NO: 5267670 - DNA, 13 bp, Homo sapiens
attaatatttgca

SEQ ID NO: 5267671 - DNA, 20 bp, Homo sapiens
attaatatttgcacatggga

SEQ ID NO: 5267672 - DNA, 23 bp, Homo sapiens
attaatatttgtgaaagaagaca

SEQ ID NO: 5267673 - DNA, 16 bp, Homo sapiens
attaatcaaaattgtc

SEQ ID NO: 5267674 - DNA, 13 bp, Homo sapiens
attaatcaagaga

SEQ ID NO: 5267675 - DNA, 16 bp, Homo sapiens
attaatcaagagaaac

SEQ ID NO: 5267676 - DNA, 22 bp, Homo sapiens
attaatcaagagaaacttcaaa

SEQ ID NO: 5267677 - DNA, 22 bp, Homo sapiens
attaatcaagtacctatattga

SEQ ID NO: 5267678 - DNA, 16 bp, Homo sapiens
attaatcaccaaagta

SEQ ID NO: 5267679 - DNA, 22 bp, Homo sapiens
attaatcaccctaccaacttta

SEQ ID NO: 5267680 - DNA, 16 bp, Homo sapiens
attaatcaccttcttt

SEQ ID NO: 5267681 - DNA, 23 bp, Homo sapiens
attaatcacggcttttggtgaat

SEQ ID NO: 5267682 - DNA, 13 bp, Homo sapiens
attaatcactgtg

SEQ ID NO: 5267683 - DNA, 18 bp, Homo sapiens
attaatcactgtgtatat

SEQ ID NO: 5267684 - DNA, 21 bp, Homo sapiens
attaatcactgtgtatatttg

SEQ ID NO: 5267685 - DNA, 23 bp, Homo sapiens
attaatcactgtgtatatttgat

SEQ ID NO: 5267686 - DNA, 23 bp, Homo sapiens
attaatcagccccagagtgcttt

SEQ ID NO: 5267687 - DNA, 17 bp, Homo sapiens
attaatcagctgttgca

SEQ ID NO: 5267688 - DNA, 18 bp, Homo sapiens
attaatcagctgttgcag

SEQ ID NO: 5267689 - DNA, 16 bp, Homo sapiens
attaatcatacaaact

SEQ ID NO: 5267690 - DNA, 20 bp, Homo sapiens
attaatcatacaaactctca

SEQ ID NO: 5267691 - DNA, 14 bp, Homo sapiens
attaatccagaata

SEQ ID NO: 5267692 - DNA, 18 bp, Homo sapiens
attaatccattttaacaa

SEQ ID NO: 5267693 - DNA, 23 bp, Homo sapiens
attaatcctgtttttagtgctga

SEQ ID NO: 5267694 - DNA, 14 bp, Homo sapiens
attaatctaaaaaa

SEQ ID NO: 5267695 - DNA, 20 bp, Homo sapiens
attaatctaccttgcagtgt

SEQ ID NO: 5267696 - DNA, 17 bp, Homo sapiens
attaatctagaaaatga

SEQ ID NO: 5267697 - DNA, 20 bp, Homo sapiens
attaatctctaaaattctag

SEQ ID NO: 5267698 - DNA, 16 bp, Homo sapiens
attaatcttagtgtat

SEQ ID NO: 5267699 - DNA, 20 bp, Homo sapiens
attaatcttagtgtatgatt

SEQ ID NO: 5267700 - DNA, 17 bp, Homo sapiens
attaatcttattgttta

SEQ ID NO: 5267701 - DNA, 21 bp, Homo sapiens
attaatcttgcttcattgtta

SEQ ID NO: 5267702 - DNA, 17 bp, Homo sapiens
attaatcttgtgtagtc

SEQ ID NO: 5267703 - DNA, 18 bp, Homo sapiens
attaatctttctttacct

SEQ ID NO: 5267704 - DNA, 13 bp, Homo sapiens
attaatcttttaa

SEQ ID NO: 5267705 - DNA, 20 bp, Homo sapiens
attaatcttttaaaaatgat

SEQ ID NO: 5267706 - DNA, 12 bp, Homo sapiens
attaatgaaata

SEQ ID NO: 5267707 - DNA, 14 bp, Homo sapiens
attaatgaaatacc

SEQ ID NO: 5267708 - DNA, 15 bp, Homo sapiens
attaatgaaatatct

SEQ ID NO: 5267709 - DNA, 13 bp, Homo sapiens
attaatgaagaaa

SEQ ID NO: 5267710 - DNA, 15 bp, Homo sapiens
attaatgaagctttt

SEQ ID NO: 5267711 - DNA, 20 bp, Homo sapiens
attaatgactttatgtatta

SEQ ID NO: 5267712 - DNA, 22 bp, Homo sapiens
attaatgagaagagttttctca

SEQ ID NO: 5267713 - DNA, 17 bp, Homo sapiens
attaatgaggtctttaa

SEQ ID NO: 5267714 - DNA, 14 bp, Homo sapiens
attaatgataaact

SEQ ID NO: 5267715 - DNA, 20 bp, Homo sapiens
attaatgatgaggatctgaa

SEQ ID NO: 5267716 - DNA, 21 bp, Homo sapiens
attaatgattaaagactgtga

SEQ ID NO: 5267717 - DNA, 14 bp, Homo sapiens
attaatgattctga

SEQ ID NO: 5267718 - DNA, 21 bp, Homo sapiens
attaatgattctgaagcttat

SEQ ID NO: 5267719 - DNA, 18 bp, Homo sapiens
attaatgcctctcccgca

SEQ ID NO: 5267720 - DNA, 19 bp, Homo sapiens
attaatgcctctcccgcac

SEQ ID NO: 5267721 - DNA, 17 bp, Homo sapiens
attaatgcctgcttttt

SEQ ID NO: 5267722 - DNA, 16 bp, Homo sapiens
attaatgcctttaaag

SEQ ID NO: 5267723 - DNA, 21 bp, Homo sapiens
attaatgcctttaaagtatga

SEQ ID NO: 5267724 - DNA, 19 bp, Homo sapiens
attaatgcgatttcttcct

SEQ ID NO: 5267725 - DNA, 23 bp, Homo sapiens
attaatgctaagggcaggcccaa

SEQ ID NO: 5267726 - DNA, 16 bp, Homo sapiens
attaatgcttagtgaa

SEQ ID NO: 5267727 - DNA, 13 bp, Homo sapiens
attaatgctttgg

SEQ ID NO: 5267728 - DNA, 12 bp, Homo sapiens
attaatggaaaa

SEQ ID NO: 5267729 - DNA, 19 bp, Homo sapiens
attaatggaaaactgttaa

SEQ ID NO: 5267730 - DNA, 17 bp, Homo sapiens
attaatggcatgtaata

SEQ ID NO: 5267731 - DNA, 15 bp, Homo sapiens
attaatggtctaaaa

SEQ ID NO: 5267732 - DNA, 15 bp, Homo sapiens
attaatgtaataaag

SEQ ID NO: 5267733 - DNA, 16 bp, Homo sapiens
attaatgtaataaagt

SEQ ID NO: 5267734 - DNA, 21 bp, Homo sapiens
attaatgtactttttattgca

SEQ ID NO: 5267735 - DNA, 22 bp, Homo sapiens
attaatgtactttttattgcat

SEQ ID NO: 5267736 - DNA, 15 bp, Homo sapiens
attaatgtagataaa

SEQ ID NO: 5267737 - DNA, 13 bp, Homo sapiens
attaatgtatgta

SEQ ID NO: 5267738 - DNA, 16 bp, Homo sapiens
attaatgtctcacttt

SEQ ID NO: 5267739 - DNA, 20 bp, Homo sapiens
attaatgtgatcctaaaatt

SEQ ID NO: 5267740 - DNA, 16 bp, Homo sapiens
attaatgtgtaaaatt

SEQ ID NO: 5267741 - DNA, 14 bp, Homo sapiens
attaatgttgaaaa

SEQ ID NO: 5267742 - DNA, 14 bp, Homo sapiens
attaatgttgatga

SEQ ID NO: 5267743 - DNA, 14 bp, Homo sapiens
attaatgttgattt

SEQ ID NO: 5267744 - DNA, 17 bp, Homo sapiens
attaatgttgatttcta

SEQ ID NO: 5267745 - DNA, 19 bp, Homo sapiens
attaatgtttatttagctc

SEQ ID NO: 5267746 - DNA, 15 bp, Homo sapiens
attaatgtttcttaa

SEQ ID NO: 5267747 - DNA, 16 bp, Homo sapiens
attaatgttttgtaca

SEQ ID NO: 5267748 - DNA, 18 bp, Homo sapiens
attaatgttttgtacaat

SEQ ID NO: 5267749 - DNA, 16 bp, Homo sapiens
attaattaaagaaaat

SEQ ID NO: 5267750 - DNA, 16 bp, Homo sapiens
attaattaacatcaaa

SEQ ID NO: 5267751 - DNA, 14 bp, Homo sapiens
attaattaagtatc

SEQ ID NO: 5267752 - DNA, 15 bp, Homo sapiens
attaattaatggctt

SEQ ID NO: 5267753 - DNA, 13 bp, Homo sapiens
attaattaattaa

SEQ ID NO: 5267754 - DNA, 14 bp, Homo sapiens
attaattaattaaa

SEQ ID NO: 5267755 - DNA, 18 bp, Homo sapiens
attaattacatacagatt

SEQ ID NO: 5267756 - DNA, 19 bp, Homo sapiens
attaattagatcaacactt

SEQ ID NO: 5267757 - DNA, 15 bp, Homo sapiens
attaattagattttc

SEQ ID NO: 5267758 - DNA, 13 bp, Homo sapiens
attaattaggaat

SEQ ID NO: 5267759 - DNA, 23 bp, Homo sapiens
attaattagttgattgctgttga

SEQ ID NO: 5267760 - DNA, 13 bp, Homo sapiens
attaattagttta

SEQ ID NO: 5267761 - DNA, 15 bp, Homo sapiens
attaattataaaatg

SEQ ID NO: 5267762 - DNA, 14 bp, Homo sapiens
attaattataataa

SEQ ID NO: 5267763 - DNA, 23 bp, Homo sapiens
attaattataataaaggtcacat

SEQ ID NO: 5267764 - DNA, 16 bp, Homo sapiens
attaattatatgtata

SEQ ID NO: 5267765 - DNA, 13 bp, Homo sapiens
attaattatgtgt

SEQ ID NO: 5267766 - DNA, 14 bp, Homo sapiens
attaattattgaaa

SEQ ID NO: 5267767 - DNA, 16 bp, Homo sapiens
attaattattttccaa

SEQ ID NO: 5267768 - DNA, 14 bp, Homo sapiens
attaattcaattaa

SEQ ID NO: 5267769 - DNA, 11 bp, Homo sapiens
attaattcatt

SEQ ID NO: 5267770 - DNA, 12 bp, Homo sapiens
attaattcatta

SEQ ID NO: 5267771 - DNA, 18 bp, Homo sapiens
attaattcctgtttgtct

SEQ ID NO: 5267772 - DNA, 14 bp, Homo sapiens
attaattctactaa

SEQ ID NO: 5267773 - DNA, 13 bp, Homo sapiens
attaattctcttg

SEQ ID NO: 5267774 - DNA, 14 bp, Homo sapiens
attaattctctttc

SEQ ID NO: 5267775 - DNA, 12 bp, Homo sapiens
attaattcttca

SEQ ID NO: 5267776 - DNA, 16 bp, Homo sapiens
attaattcttcacctg

SEQ ID NO: 5267777 - DNA, 17 bp, Homo sapiens
attaattcttcacctgt

SEQ ID NO: 5267778 - DNA, 12 bp, Homo sapiens
attaattcttta

SEQ ID NO: 5267779 - DNA, 17 bp, Homo sapiens
attaattctttatcaca

SEQ ID NO: 5267780 - DNA, 17 bp, Homo sapiens
attaattgcctgttaaa

SEQ ID NO: 5267781 - DNA, 16 bp, Homo sapiens
attaattggcagcaga

SEQ ID NO: 5267782 - DNA, 20 bp, Homo sapiens
attaattggcagcagatttt

SEQ ID NO: 5267783 - DNA, 20 bp, Homo sapiens
attaattgtaatctgaataa

SEQ ID NO: 5267784 - DNA, 20 bp, Homo sapiens
attaattgtcctgtgtctat

SEQ ID NO: 5267785 - DNA, 23 bp, Homo sapiens
attaattgtcctgtgtctatgta

SEQ ID NO: 5267786 - DNA, 12 bp, Homo sapiens
attaattgtctt

SEQ ID NO: 5267787 - DNA, 11 bp, Homo sapiens
attaattgtgt

SEQ ID NO: 5267788 - DNA, 20 bp, Homo sapiens
attaattgtgtgaacttgga

SEQ ID NO: 5267789 - DNA, 15 bp, Homo sapiens
attaatttaattact

SEQ ID NO: 5267790 - DNA, 16 bp, Homo sapiens
attaatttagaatggt

SEQ ID NO: 5267791 - DNA, 15 bp, Homo sapiens
attaatttatatttg

SEQ ID NO: 5267792 - DNA, 19 bp, Homo sapiens
attaatttatatttgtctc

SEQ ID NO: 5267793 - DNA, 15 bp, Homo sapiens
attaatttatcagat

SEQ ID NO: 5267794 - DNA, 16 bp, Homo sapiens
attaatttatgcagaa

SEQ ID NO: 5267795 - DNA, 13 bp, Homo sapiens
attaatttatggt

SEQ ID NO: 5267796 - DNA, 18 bp, Homo sapiens
attaatttctctcaattt

SEQ ID NO: 5267797 - DNA, 14 bp, Homo sapiens
attaatttctgata

SEQ ID NO: 5267798 - DNA, 15 bp, Homo sapiens
attaatttctgataa

SEQ ID NO: 5267799 - DNA, 20 bp, Homo sapiens
attaatttctgccatttcat

SEQ ID NO: 5267800 - DNA, 13 bp, Homo sapiens
attaatttgaaac

SEQ ID NO: 5267801 - DNA, 22 bp, Homo sapiens
attaatttgagaattattcctt

SEQ ID NO: 5267802 - DNA, 18 bp, Homo sapiens
attaatttgattaacaaa

SEQ ID NO: 5267803 - DNA, 15 bp, Homo sapiens
attaatttgcatctg

SEQ ID NO: 5267804 - DNA, 21 bp, Homo sapiens
attaatttgcatctgaaatag

SEQ ID NO: 5267805 - DNA, 16 bp, Homo sapiens
attaatttgtgaattt

SEQ ID NO: 5267806 - DNA, 16 bp, Homo sapiens
attaatttgtgtagat

SEQ ID NO: 5267807 - DNA, 19 bp, Homo sapiens
attaatttgtttttcttat

SEQ ID NO: 5267808 - DNA, 13 bp, Homo sapiens
attaattttactc

SEQ ID NO: 5267809 - DNA, 18 bp, Homo sapiens
attaattttagtttttca

SEQ ID NO: 5267810 - DNA, 20 bp, Homo sapiens
attaattttcaggatttttg

SEQ ID NO: 5267811 - DNA, 16 bp, Homo sapiens
attaattttctatgtg

SEQ ID NO: 5267812 - DNA, 16 bp, Homo sapiens
attaattttctcttta

SEQ ID NO: 5267813 - DNA, 21 bp, Homo sapiens
attaattttctctttaggaga

SEQ ID NO: 5267814 - DNA, 14 bp, Homo sapiens
attaattttgtgca

SEQ ID NO: 5267815 - DNA, 17 bp, Homo sapiens
attaattttgtgcattc

SEQ ID NO: 5267816 - DNA, 18 bp, Homo sapiens
attaattttgtgcattct

SEQ ID NO: 5267817 - DNA, 15 bp, Homo sapiens
attaatttttaattg

SEQ ID NO: 5267818 - DNA, 18 bp, Homo sapiens
attaatttttcaatttct

SEQ ID NO: 5267819 - DNA, 22 bp, Homo sapiens
attaatttttcaatttctcctt

SEQ ID NO: 5267820 - DNA, 21 bp, Homo sapiens
attaatttttttattgtttaa

SEQ ID NO: 5267821 - DNA, 13 bp, Homo sapiens
attacaaaaacaa

SEQ ID NO: 5267822 - DNA, 15 bp, Homo sapiens
attacaaaaggctcg

SEQ ID NO: 5267823 - DNA, 12 bp, Homo sapiens
attacaaacaag

SEQ ID NO: 5267824 - DNA, 20 bp, Homo sapiens
attacaaaggaatctaatta

SEQ ID NO: 5267825 - DNA, 24 bp, Homo sapiens
attacaaagttaaaattgttatca

SEQ ID NO: 5267826 - DNA, 21 bp, Homo sapiens
attacaaagttcactgtttat

SEQ ID NO: 5267827 - DNA, 16 bp, Homo sapiens
attacaaatcagaagt

SEQ ID NO: 5267828 - DNA, 21 bp, Homo sapiens
attacaaatcagaagtcatct

SEQ ID NO: 5267829 - DNA, 21 bp, Homo sapiens
attacaaatggtgaatggatt

SEQ ID NO: 5267830 - DNA, 13 bp, Homo sapiens
attacaaatggtt

SEQ ID NO: 5267831 - DNA, 21 bp, Homo sapiens
attacaaatgtggctgtaaaa

SEQ ID NO: 5267832 - DNA, 19 bp, Homo sapiens
attacaaattaagggttaa

SEQ ID NO: 5267833 - DNA, 13 bp, Homo sapiens
attacaaattgct

SEQ ID NO: 5267834 - DNA, 22 bp, Homo sapiens
attacaaattgcttactttgga

SEQ ID NO: 5267835 - DNA, 20 bp, Homo sapiens
attacaaccggttatcagtt

SEQ ID NO: 5267836 - DNA, 15 bp, Homo sapiens
attacaacggagtca

SEQ ID NO: 5267837 - DNA, 17 bp, Homo sapiens
attacaacggagtcaaa

SEQ ID NO: 5267838 - DNA, 18 bp, Homo sapiens
attacaactgaccaagtt

SEQ ID NO: 5267839 - DNA, 14 bp, Homo sapiens
attacaagataaaa

SEQ ID NO: 5267840 - DNA, 17 bp, Homo sapiens
attacaagtaatgtaaa

SEQ ID NO: 5267841 - DNA, 19 bp, Homo sapiens
attacaagtatttttaatt

SEQ ID NO: 5267842 - DNA, 14 bp, Homo sapiens
attacaagtggctc

SEQ ID NO: 5267843 - DNA, 18 bp, Homo sapiens
attacaagtggctcccca

SEQ ID NO: 5267844 - DNA, 20 bp, Homo sapiens
attacaagtttcagtaatag

SEQ ID NO: 5267845 - DNA, 22 bp, Homo sapiens
atgccatagaaatgtaggtcct

SEQ ID NO: 5267846 - DNA, 13 bp, Homo sapiens
atgccatcagccc

SEQ ID NO: 5267847 - DNA, 13 bp, Homo sapiens
atgccatcctctt

SEQ ID NO: 5267848 - DNA, 15 bp, Homo sapiens
atgccatcctctttc

SEQ ID NO: 5267849 - DNA, 23 bp, Homo sapiens
atgccatcctctttctcttttct

SEQ ID NO: 5267850 - DNA, 19 bp, Homo sapiens
atgccatctaccggcgtcc

SEQ ID NO: 5267851 - DNA, 14 bp, Homo sapiens
atgccatgaacaaa

SEQ ID NO: 5267852 - DNA, 16 bp, Homo sapiens
atgccatgaacaaatt

SEQ ID NO: 5267853 - DNA, 23 bp, Homo sapiens
atgccatgaacaaattctttagt

SEQ ID NO: 5267854 - DNA, 16 bp, Homo sapiens
atgccatgactgctca

SEQ ID NO: 5267855 - DNA, 17 bp, Homo sapiens
atgccatgactgctcag

SEQ ID NO: 5267856 - DNA, 21 bp, Homo sapiens
atgccatgaggaacaaggcaa

SEQ ID NO: 5267857 - DNA, 17 bp, Homo sapiens
atgccatgatatcactt

SEQ ID NO: 5267858 - DNA, 14 bp, Homo sapiens
atgccatgatgcct

SEQ ID NO: 5267859 - DNA, 14 bp, Homo sapiens
atgccatgcccagg

SEQ ID NO: 5267860 - DNA, 17 bp, Homo sapiens
atgccatggacagaaga

SEQ ID NO: 5267861 - DNA, 13 bp, Homo sapiens
atgccatgtctga

SEQ ID NO: 5267862 - DNA, 16 bp, Homo sapiens
atgccattacagaacc

SEQ ID NO: 5267863 - DNA, 17 bp, Homo sapiens
atgccattccatatata

SEQ ID NO: 5267864 - DNA, 22 bp, Homo sapiens
atgccattccatatatatctga

SEQ ID NO: 5267865 - DNA, 17 bp, Homo sapiens
atgccattggaacctgt

SEQ ID NO: 5267866 - DNA, 17 bp, Homo sapiens
atgccatttcttctctc

SEQ ID NO: 5267867 - DNA, 22 bp, Homo sapiens
atgccatttcttctctctgttc

SEQ ID NO: 5267868 - DNA, 23 bp, Homo sapiens
atgccatttcttctctctgttcc

SEQ ID NO: 5267869 - DNA, 16 bp, Homo sapiens
atgccatttgtactga

SEQ ID NO: 5267870 - DNA, 15 bp, Homo sapiens
atgccatttgtcttt

SEQ ID NO: 5267871 - DNA, 17 bp, Homo sapiens
atgccattttatttctt

SEQ ID NO: 5267872 - DNA, 24 bp, Homo sapiens
atgccattttgtacatgtatgaaa

SEQ ID NO: 5267873 - DNA, 22 bp, Homo sapiens
atgccatttttagtttaaaatc

SEQ ID NO: 5267874 - DNA, 22 bp, Homo sapiens
atgcccaaatataacatgaaag

SEQ ID NO: 5267875 - DNA, 17 bp, Homo sapiens
atgcccaagccctgaga

SEQ ID NO: 5267876 - DNA, 12 bp, Homo sapiens
atgcccaaggga

SEQ ID NO: 5267877 - DNA, 14 bp, Homo sapiens
atgcccaatatatt

SEQ ID NO: 5267878 - DNA, 16 bp, Homo sapiens
atgcccaatatattct

SEQ ID NO: 5267879 - DNA, 16 bp, Homo sapiens
atgcccaatccaggcc

SEQ ID NO: 5267880 - DNA, 22 bp, Homo sapiens
atgcccacaacttgtcacccaa

SEQ ID NO: 5267881 - DNA, 12 bp, Homo sapiens
atgcccaccccc

SEQ ID NO: 5267882 - DNA, 16 bp, Homo sapiens
atgcccacgcccctcc

SEQ ID NO: 5267883 - DNA, 16 bp, Homo sapiens
atgcccactcccccag

SEQ ID NO: 5267884 - DNA, 17 bp, Homo sapiens
atgcccactcccccagg

SEQ ID NO: 5267885 - DNA, 18 bp, Homo sapiens
atgcccactcccccagga

SEQ ID NO: 5267886 - DNA, 20 bp, Homo sapiens
atgcccactgctggtgccag

SEQ ID NO: 5267887 - DNA, 10 bp, Homo sapiens
atgcccagag

SEQ ID NO: 5267888 - DNA, 17 bp, Homo sapiens
atgcccagagacccagc

SEQ ID NO: 5267889 - DNA, 19 bp, Homo sapiens
atgcccagcacaattcatt

SEQ ID NO: 5267890 - DNA, 22 bp, Homo sapiens
atgcccagcaggggaggtgagg

SEQ ID NO: 5267891 - DNA, 12 bp, Homo sapiens
atgcccagccag

SEQ ID NO: 5267892 - DNA, 17 bp, Homo sapiens
atgcccagccagccacc

SEQ ID NO: 5267893 - DNA, 22 bp, Homo sapiens
atgcccagccagccacccctgc

SEQ ID NO: 5267894 - DNA, 23 bp, Homo sapiens
atgcccagccagccacccctgcc

SEQ ID NO: 5267895 - DNA, 13 bp, Homo sapiens
atgcccagcccct

SEQ ID NO: 5267896 - DNA, 15 bp, Homo sapiens
atgcccagccccttc

SEQ ID NO: 5267897 - DNA, 17 bp, Homo sapiens
atgcccagcctccaact

SEQ ID NO: 5267898 - DNA, 15 bp, Homo sapiens
atgcccagcgtttga

SEQ ID NO: 5267899 - DNA, 12 bp, Homo sapiens
atgcccagctct

SEQ ID NO: 5267900 - DNA, 16 bp, Homo sapiens
atgcccagctctctga

SEQ ID NO: 5267901 - DNA, 18 bp, Homo sapiens
atgcccagctctctgacg

SEQ ID NO: 5267902 - DNA, 17 bp, Homo sapiens
atgcccagctgtgctgg

SEQ ID NO: 5267903 - DNA, 21 bp, Homo sapiens
atgcccagcttggagtgccac

SEQ ID NO: 5267904 - DNA, 21 bp, Homo sapiens
atgcccaggaagtaattttct

SEQ ID NO: 5267905 - DNA, 11 bp, Homo sapiens
atgcccaggac

SEQ ID NO: 5267906 - DNA, 21 bp, Homo sapiens
atgcccagggccactctgcct

SEQ ID NO: 5267907 - DNA, 13 bp, Homo sapiens
atgcccaggtacc

SEQ ID NO: 5267908 - DNA, 18 bp, Homo sapiens
atgcccaggtaccaccct

SEQ ID NO: 5267909 - DNA, 15 bp, Homo sapiens
atgcccagtgagact

SEQ ID NO: 5267910 - DNA, 17 bp, Homo sapiens
atgcccagtttctgcct

SEQ ID NO: 5267911 - DNA, 18 bp, Homo sapiens
atgcccagtttctgcctc

SEQ ID NO: 5267912 - DNA, 19 bp, Homo sapiens
atgcccagtttctgcctct

SEQ ID NO: 5267913 - DNA, 19 bp, Homo sapiens
atgcccatcccagtgtcct

SEQ ID NO: 5267914 - DNA, 18 bp, Homo sapiens
atgcccattcctgcctgg

SEQ ID NO: 5267915 - DNA, 21 bp, Homo sapiens
atgcccattcctgcctggtcc

SEQ ID NO: 5267916 - DNA, 13 bp, Homo sapiens
atgccccaaagtt

SEQ ID NO: 5267917 - DNA, 14 bp, Homo sapiens
atgccccaaggaca

SEQ ID NO: 5267918 - DNA, 23 bp, Homo sapiens
atgccccacccacccctcctggg

SEQ ID NO: 5267919 - DNA, 17 bp, Homo sapiens
atgccccacccccctcc

SEQ ID NO: 5267920 - DNA, 17 bp, Homo sapiens
atgccccactctgctga

SEQ ID NO: 5267921 - DNA, 20 bp, Homo sapiens
atgccccactctgctgaggc

SEQ ID NO: 5267922 - DNA, 22 bp, Homo sapiens
atgccccactctgctgaggcca

SEQ ID NO: 5267923 - DNA, 15 bp, Homo sapiens
atgccccagctctgg

SEQ ID NO: 5267924 - DNA, 12 bp, Homo sapiens
atgccccaggat

SEQ ID NO: 5267925 - DNA, 20 bp, Homo sapiens
atgccccaggatcactctct

SEQ ID NO: 5267926 - DNA, 21 bp, Homo sapiens
atgccccaggatcactctctg

SEQ ID NO: 5267927 - DNA, 16 bp, Homo sapiens
atgcccccagctggcc

SEQ ID NO: 5267928 - DNA, 16 bp, Homo sapiens
atgcccccaggcagcc

SEQ ID NO: 5267929 - DNA, 13 bp, Homo sapiens
atgcccccctcaa

SEQ ID NO: 5267930 - DNA, 22 bp, Homo sapiens
atgcccccctcaaacctcctct

SEQ ID NO: 5267931 - DNA, 23 bp, Homo sapiens
atgcccccgacccccgcagaggc

SEQ ID NO: 5267932 - DNA, 20 bp, Homo sapiens
atgccccctcccctccttta

SEQ ID NO: 5267933 - DNA, 17 bp, Homo sapiens
atgccccctcgtgccag

SEQ ID NO: 5267934 - DNA, 18 bp, Homo sapiens
atgccccctcgtgccagt

SEQ ID NO: 5267935 - DNA, 15 bp, Homo sapiens
atgccccctgtggat

SEQ ID NO: 5267936 - DNA, 16 bp, Homo sapiens
atgcccccttcgctcc

SEQ ID NO: 5267937 - DNA, 21 bp, Homo sapiens
atgccccctttcagatgtctt

SEQ ID NO: 5267938 - DNA, 17 bp, Homo sapiens
atgccccgagcccaggc

SEQ ID NO: 5267939 - DNA, 24 bp, Homo sapiens
atgccccgccatggtcaccctcag

SEQ ID NO: 5267940 - DNA, 16 bp, Homo sapiens
atgccccggccacctc

SEQ ID NO: 5267941 - DNA, 20 bp, Homo sapiens
atgccccggccacctctgcg

SEQ ID NO: 5267942 - DNA, 13 bp, Homo sapiens
atgcccctcccca

SEQ ID NO: 5267943 - DNA, 14 bp, Homo sapiens
atgcccctccccca

SEQ ID NO: 5267944 - DNA, 20 bp, Homo sapiens
atgcccctcccccagctgcg

SEQ ID NO: 5267945 - DNA, 15 bp, Homo sapiens
atgcccctcccctcc

SEQ ID NO: 5267946 - DNA, 15 bp, Homo sapiens
atgcccctgaattta

SEQ ID NO: 5267947 - DNA, 21 bp, Homo sapiens
atgcccctgcagtttggccct

SEQ ID NO: 5267948 - DNA, 22 bp, Homo sapiens
atgcccctgcagtttggccctg

SEQ ID NO: 5267949 - DNA, 13 bp, Homo sapiens
atgcccctggccc

SEQ ID NO: 5267950 - DNA, 14 bp, Homo sapiens
atgcccctggccct

SEQ ID NO: 5267951 - DNA, 20 bp, Homo sapiens
atgcccctggccctgcctca

SEQ ID NO: 5267952 - DNA, 23 bp, Homo sapiens
atgcccctggccctgcctcactg

SEQ ID NO: 5267953 - DNA, 19 bp, Homo sapiens
atgccccttctccccttcc

SEQ ID NO: 5267954 - DNA, 22 bp, Homo sapiens
atgccccttcttgggccccaga

SEQ ID NO: 5267955 - DNA, 23 bp, Homo sapiens
atgccccttcttgggccccagac

SEQ ID NO: 5267956 - DNA, 20 bp, Homo sapiens
atgccccttggtcctggcag

SEQ ID NO: 5267957 - DNA, 20 bp, Homo sapiens
atgcccgagtccgcccatcc

SEQ ID NO: 5267958 - DNA, 23 bp, Homo sapiens
atgcccgagtccgcccatccctg

SEQ ID NO: 5267959 - DNA, 19 bp, Homo sapiens
atgcccgcacagtaatgta

SEQ ID NO: 5267960 - DNA, 19 bp, Homo sapiens
atgcccgcccggggagttt

SEQ ID NO: 5267961 - DNA, 14 bp, Homo sapiens
atgcccgctgtccc

SEQ ID NO: 5267962 - DNA, 20 bp, Homo sapiens
atgcccggctaatttttgta

SEQ ID NO: 5267963 - DNA, 16 bp, Homo sapiens
atgcccgttgtctagg

SEQ ID NO: 5267964 - DNA, 16 bp, Homo sapiens
atgccctacctgcctg

SEQ ID NO: 5267965 - DNA, 20 bp, Homo sapiens
atgccctacctgcctgttct

SEQ ID NO: 5267966 - DNA, 20 bp, Homo sapiens
atgccctactctcttatgca

SEQ ID NO: 5267967 - DNA, 16 bp, Homo sapiens
atgccctcaagtaaaa

SEQ ID NO: 5267968 - DNA, 16 bp, Homo sapiens
atgccctcaggcttgg

SEQ ID NO: 5267969 - DNA, 17 bp, Homo sapiens
atgccctcaggcttggg

SEQ ID NO: 5267970 - DNA, 16 bp, Homo sapiens
atgccctccctgctgc

SEQ ID NO: 5267971 - DNA, 21 bp, Homo sapiens
atgccctccctgctgccaggc

SEQ ID NO: 5267972 - DNA, 19 bp, Homo sapiens
atgccctcccttctccctg

SEQ ID NO: 5267973 - DNA, 20 bp, Homo sapiens
atgccctcccttctccctgg

SEQ ID NO: 5267974 - DNA, 17 bp, Homo sapiens
atgccctcctaaatgtc

SEQ ID NO: 5267975 - DNA, 19 bp, Homo sapiens
atgccctcctaaatgtcag

SEQ ID NO: 5267976 - DNA, 20 bp, Homo sapiens
atgccctcttctccttgcct

SEQ ID NO: 5267977 - DNA, 15 bp, Homo sapiens
atgccctgcagagca

SEQ ID NO: 5267978 - DNA, 21 bp, Homo sapiens
atgccctgccaagcctggagc

SEQ ID NO: 5267979 - DNA, 14 bp, Homo sapiens
atgccctgccttgc

SEQ ID NO: 5267980 - DNA, 17 bp, Homo sapiens
atgccctgcggctctgg

SEQ ID NO: 5267981 - DNA, 21 bp, Homo sapiens
atgccctgcggctctggaaag

SEQ ID NO: 5267982 - DNA, 14 bp, Homo sapiens
atgccctgctccag

SEQ ID NO: 5267983 - DNA, 14 bp, Homo sapiens
atgccctgctggcc

SEQ ID NO: 5267984 - DNA, 16 bp, Homo sapiens
atgccctgctggcctg

SEQ ID NO: 5267985 - DNA, 18 bp, Homo sapiens
atgccctggaccagccgc

SEQ ID NO: 5267986 - DNA, 14 bp, Homo sapiens
atgccctggaggtg

SEQ ID NO: 5267987 - DNA, 15 bp, Homo sapiens
atgccctggaggtgg

SEQ ID NO: 5267988 - DNA, 16 bp, Homo sapiens
atgccctggaggtggc

SEQ ID NO: 5267989 - DNA, 23 bp, Homo sapiens
atgccctgtgcaacctcttggcc

SEQ ID NO: 5267990 - DNA, 17 bp, Homo sapiens
atgcccttcactttctc

SEQ ID NO: 5267991 - DNA, 21 bp, Homo sapiens
atgcccttcactttctcctgg

SEQ ID NO: 5267992 - DNA, 23 bp, Homo sapiens
atgcccttccccctttctctgcc

SEQ ID NO: 5267993 - DNA, 15 bp, Homo sapiens
atgcccttcttccat

SEQ ID NO: 5267994 - DNA, 15 bp, Homo sapiens
atgcccttgctgggc

SEQ ID NO: 5267995 - DNA, 19 bp, Homo sapiens
atgcccttgctgggcctgg

SEQ ID NO: 5267996 - DNA, 20 bp, Homo sapiens
atgccgaacattaggaattg

SEQ ID NO: 5267997 - DNA, 22 bp, Homo sapiens
atgccgaacctatacccattct

SEQ ID NO: 5267998 - DNA, 21 bp, Homo sapiens
atgccgaatttggtacacatg

SEQ ID NO: 5267999 - DNA, 23 bp, Homo sapiens
atgccgagacctcaagccctgag

SEQ ID NO: 5268000 - DNA, 15 bp, Homo sapiens
atgccgcagggaggg

SEQ ID NO: 5268001 - DNA, 15 bp, Homo sapiens
atgccgcctgtcaat

SEQ ID NO: 5268002 - DNA, 18 bp, Homo sapiens
atgccgcgatgggtcagg

SEQ ID NO: 5268003 - DNA, 22 bp, Homo sapiens
atgccgcgggcggccaggcaac

SEQ ID NO: 5268004 - DNA, 18 bp, Homo sapiens
atgccgcgtccctgcccc

SEQ ID NO: 5268005 - DNA, 22 bp, Homo sapiens
atgccgctcttctgtcatcccg

SEQ ID NO: 5268006 - DNA, 22 bp, Homo sapiens
atgccgctgcatccgtgagcag

SEQ ID NO: 5268007 - DNA, 14 bp, Homo sapiens
atgccgctgtctct

SEQ ID NO: 5268008 - DNA, 18 bp, Homo sapiens
atgccgctgtctctgagg

SEQ ID NO: 5268009 - DNA, 14 bp, Homo sapiens
atgccgctgtgtcc

SEQ ID NO: 5268010 - DNA, 16 bp, Homo sapiens
atgccgctgtgtcccc

SEQ ID NO: 5268011 - DNA, 15 bp, Homo sapiens
atgccggatgtgctt

SEQ ID NO: 5268012 - DNA, 20 bp, Homo sapiens
atgccgggcgccaggacagc

SEQ ID NO: 5268013 - DNA, 18 bp, Homo sapiens
atgccgggcgtggtggca

SEQ ID NO: 5268014 - DNA, 19 bp, Homo sapiens
atgccgggggagccaccag

SEQ ID NO: 5268015 - DNA, 18 bp, Homo sapiens
atgccggtacacagccag

SEQ ID NO: 5268016 - DNA, 20 bp, Homo sapiens
atgccggtgagaataagaga

SEQ ID NO: 5268017 - DNA, 16 bp, Homo sapiens
atgccgtcttctgccc

SEQ ID NO: 5268018 - DNA, 20 bp, Homo sapiens
atgccgtcttctgccctaac

SEQ ID NO: 5268019 - DNA, 18 bp, Homo sapiens
atgccgtgtagtttctgg

SEQ ID NO: 5268020 - DNA, 22 bp, Homo sapiens
atgccgtgtgtctcgtctcctg

SEQ ID NO: 5268021 - DNA, 16 bp, Homo sapiens
atgccgttctgcaccc

SEQ ID NO: 5268022 - DNA, 15 bp, Homo sapiens
attacaataaatcct

SEQ ID NO: 5268023 - DNA, 22 bp, Homo sapiens
attacaatacaaaggttccatt

SEQ ID NO: 5268024 - DNA, 14 bp, Homo sapiens
attacaatatttgt

SEQ ID NO: 5268025 - DNA, 12 bp, Homo sapiens
attacaatggaa

SEQ ID NO: 5268026 - DNA, 17 bp, Homo sapiens
attacaatggaaacaat

SEQ ID NO: 5268027 - DNA, 14 bp, Homo sapiens
attacaatggccag

SEQ ID NO: 5268028 - DNA, 14 bp, Homo sapiens
attacaatgtatct

SEQ ID NO: 5268029 - DNA, 17 bp, Homo sapiens
attacaatgtatcttta

SEQ ID NO: 5268030 - DNA, 16 bp, Homo sapiens
attacaatttctttaa

SEQ ID NO: 5268031 - DNA, 16 bp, Homo sapiens
attacaatttgtatta

SEQ ID NO: 5268032 - DNA, 13 bp, Homo sapiens
attacaattttat

SEQ ID NO: 5268033 - DNA, 18 bp, Homo sapiens
attacaattttatctgtt

SEQ ID NO: 5268034 - DNA, 22 bp, Homo sapiens
attacaatttttaataaattga

SEQ ID NO: 5268035 - DNA, 13 bp, Homo sapiens
attacacaaaaca

SEQ ID NO: 5268036 - DNA, 17 bp, Homo sapiens
attacacaaaacaaatg

SEQ ID NO: 5268037 - DNA, 15 bp, Homo sapiens
attacacaagtttaa

SEQ ID NO: 5268038 - DNA, 18 bp, Homo sapiens
attacacaataaagcagt

SEQ ID NO: 5268039 - DNA, 20 bp, Homo sapiens
attacacacgtgtgatgtat

SEQ ID NO: 5268040 - DNA, 12 bp, Homo sapiens
attacacagtca

SEQ ID NO: 5268041 - DNA, 18 bp, Homo sapiens
attacacatttcactgtg

SEQ ID NO: 5268042 - DNA, 15 bp, Homo sapiens
attacacatttgtac

SEQ ID NO: 5268043 - DNA, 12 bp, Homo sapiens
attacaccacag

SEQ ID NO: 5268044 - DNA, 21 bp, Homo sapiens
attacaccaccggccccctcc

SEQ ID NO: 5268045 - DNA, 21 bp, Homo sapiens
attacaccagcctcgtcttca

SEQ ID NO: 5268046 - DNA, 21 bp, Homo sapiens
attacactacaagtttataag

SEQ ID NO: 5268047 - DNA, 12 bp, Homo sapiens
attacactccag

SEQ ID NO: 5268048 - DNA, 19 bp, Homo sapiens
attacactgtatttgtatc

SEQ ID NO: 5268049 - DNA, 20 bp, Homo sapiens
attacactgtgccttttccc

SEQ ID NO: 5268050 - DNA, 19 bp, Homo sapiens
attacacttggtaattgta

SEQ ID NO: 5268051 - DNA, 17 bp, Homo sapiens
attacactttattcttt

SEQ ID NO: 5268052 - DNA, 14 bp, Homo sapiens
attacagaaaattt

SEQ ID NO: 5268053 - DNA, 17 bp, Homo sapiens
attacagaaaatttgca

SEQ ID NO: 5268054 - DNA, 13 bp, Homo sapiens
attacagaaactg

SEQ ID NO: 5268055 - DNA, 16 bp, Homo sapiens
attacagaaactgatg

SEQ ID NO: 5268056 - DNA, 18 bp, Homo sapiens
attacagaaactgatgcc

SEQ ID NO: 5268057 - DNA, 15 bp, Homo sapiens
attacagaagaagct

SEQ ID NO: 5268058 - DNA, 21 bp, Homo sapiens
attacagaagagtttcttaac

SEQ ID NO: 5268059 - DNA, 12 bp, Homo sapiens
attacagaatat

SEQ ID NO: 5268060 - DNA, 19 bp, Homo sapiens
attacagaccatggatatg

SEQ ID NO: 5268061 - DNA, 16 bp, Homo sapiens
attacagactctgatt

SEQ ID NO: 5268062 - DNA, 17 bp, Homo sapiens
attacagagaggagaaa

SEQ ID NO: 5268063 - DNA, 21 bp, Homo sapiens
attacagagatataaatgaag

SEQ ID NO: 5268064 - DNA, 15 bp, Homo sapiens
attacagaggaagtt

SEQ ID NO: 5268065 - DNA, 17 bp, Homo sapiens
attacagaggaagttat

SEQ ID NO: 5268066 - DNA, 23 bp, Homo sapiens
attacagagggtaggaatgggta

SEQ ID NO: 5268067 - DNA, 22 bp, Homo sapiens
attacagataaaatgtaaactg

SEQ ID NO: 5268068 - DNA, 15 bp, Homo sapiens
attacagatcatata

SEQ ID NO: 5268069 - DNA, 13 bp, Homo sapiens
attacagatgtga

SEQ ID NO: 5268070 - DNA, 13 bp, Homo sapiens
attacagccaggt

SEQ ID NO: 5268071 - DNA, 17 bp, Homo sapiens
attacaggaagtactgg

SEQ ID NO: 5268072 - DNA, 16 bp, Homo sapiens
attacaggaatgaaga

SEQ ID NO: 5268073 - DNA, 17 bp, Homo sapiens
attacaggaatgaagaa

SEQ ID NO: 5268074 - DNA, 18 bp, Homo sapiens
attacaggaatgaagaac

SEQ ID NO: 5268075 - DNA, 20 bp, Homo sapiens
attacaggaatgaagaactg

SEQ ID NO: 5268076 - DNA, 20 bp, Homo sapiens
attacaggcacctaccacca

SEQ ID NO: 5268077 - DNA, 20 bp, Homo sapiens
attacaggccttttgactct

SEQ ID NO: 5268078 - DNA, 21 bp, Homo sapiens
attacaggcgtgagccactgc

SEQ ID NO: 5268079 - DNA, 15 bp, Homo sapiens
attacaggcttgagc

SEQ ID NO: 5268080 - DNA, 19 bp, Homo sapiens
attacagggaagaaatcaa

SEQ ID NO: 5268081 - DNA, 15 bp, Homo sapiens
attacagggcacagg

SEQ ID NO: 5268082 - DNA, 16 bp, Homo sapiens
attacagggcacaggc

SEQ ID NO: 5268083 - DNA, 18 bp, Homo sapiens
attacaggggcttgaaca

SEQ ID NO: 5268084 - DNA, 22 bp, Homo sapiens
attacaggtgggatatgctaga

SEQ ID NO: 5268085 - DNA, 16 bp, Homo sapiens
attacaggtgtgagcc

SEQ ID NO: 5268086 - DNA, 20 bp, Homo sapiens
attacaggtgtgagccacag

SEQ ID NO: 5268087 - DNA, 15 bp, Homo sapiens
attacaggtgtgtgc

SEQ ID NO: 5268088 - DNA, 21 bp, Homo sapiens
attacaggtgtgtgccatcat

SEQ ID NO: 5268089 - DNA, 22 bp, Homo sapiens
attacagtatccaatgtctttt

SEQ ID NO: 5268090 - DNA, 20 bp, Homo sapiens
attacagtatggcaatatct

SEQ ID NO: 5268091 - DNA, 18 bp, Homo sapiens
attacagtccaaaatact

SEQ ID NO: 5268092 - DNA, 23 bp, Homo sapiens
attacagtctcactcagaactgt

SEQ ID NO: 5268093 - DNA, 15 bp, Homo sapiens
attacagtgcagttt

SEQ ID NO: 5268094 - DNA, 19 bp, Homo sapiens
attacagtgcctaaaataa

SEQ ID NO: 5268095 - DNA, 21 bp, Homo sapiens
attacagtggggaatgaagat

SEQ ID NO: 5268096 - DNA, 14 bp, Homo sapiens
attacagtgtttat

SEQ ID NO: 5268097 - DNA, 22 bp, Homo sapiens
attacagtgtttatcctttcat

SEQ ID NO: 5268098 - DNA, 15 bp, Homo sapiens
attacagttctttcc

SEQ ID NO: 5268099 - DNA, 16 bp, Homo sapiens
attacagttctttcct

SEQ ID NO: 5268100 - DNA, 19 bp, Homo sapiens
attacagttctttcctctt

SEQ ID NO: 5268101 - DNA, 19 bp, Homo sapiens
attacagttgcatttttat

SEQ ID NO: 5268102 - DNA, 22 bp, Homo sapiens
attacataaataaattaaataa

SEQ ID NO: 5268103 - DNA, 14 bp, Homo sapiens
attacataactgat

SEQ ID NO: 5268104 - DNA, 20 bp, Homo sapiens
attacataactgatctattt

SEQ ID NO: 5268105 - DNA, 17 bp, Homo sapiens
attacataatcaaagct

SEQ ID NO: 5268106 - DNA, 21 bp, Homo sapiens
attacataatctgtacaatga

SEQ ID NO: 5268107 - DNA, 13 bp, Homo sapiens
attacatacagat

SEQ ID NO: 5268108 - DNA, 14 bp, Homo sapiens
attacatacagatt

SEQ ID NO: 5268109 - DNA, 23 bp, Homo sapiens
attacatattgcaggagacattt

SEQ ID NO: 5268110 - DNA, 15 bp, Homo sapiens
attacatatttgact

SEQ ID NO: 5268111 - DNA, 21 bp, Homo sapiens
attacatatttgactctttca

SEQ ID NO: 5268112 - DNA, 23 bp, Homo sapiens
attacatatttgactctttcaaa

SEQ ID NO: 5268113 - DNA, 17 bp, Homo sapiens
attacatcatcctcctt

SEQ ID NO: 5268114 - DNA, 22 bp, Homo sapiens
attacatccgtaggacaagttt

SEQ ID NO: 5268115 - DNA, 16 bp, Homo sapiens
attacatctttcacat

SEQ ID NO: 5268116 - DNA, 14 bp, Homo sapiens
attacatgactgtt

SEQ ID NO: 5268117 - DNA, 14 bp, Homo sapiens
attacatgatttaa

SEQ ID NO: 5268118 - DNA, 12 bp, Homo sapiens
attacatgcatg

SEQ ID NO: 5268119 - DNA, 17 bp, Homo sapiens
attacatgcatgagcac

SEQ ID NO: 5268120 - DNA, 18 bp, Homo sapiens
attacatgtaaagctgtt

SEQ ID NO: 5268121 - DNA, 13 bp, Homo sapiens
attacatgtaaat

SEQ ID NO: 5268122 - DNA, 16 bp, Homo sapiens
attacatgtaatttga

SEQ ID NO: 5268123 - DNA, 17 bp, Homo sapiens
attacatgtttaaattg

SEQ ID NO: 5268124 - DNA, 20 bp, Homo sapiens
attacatgtttaaattgtaa

SEQ ID NO: 5268125 - DNA, 22 bp, Homo sapiens
attacatgtttaaattgtaaat

SEQ ID NO: 5268126 - DNA, 13 bp, Homo sapiens
attacattaaaat

SEQ ID NO: 5268127 - DNA, 17 bp, Homo sapiens
attacattaaaatggac

SEQ ID NO: 5268128 - DNA, 14 bp, Homo sapiens
attacattagttaa

SEQ ID NO: 5268129 - DNA, 13 bp, Homo sapiens
attacattatgcc

SEQ ID NO: 5268130 - DNA, 23 bp, Homo sapiens
attacattcctaactagaattag

SEQ ID NO: 5268131 - DNA, 17 bp, Homo sapiens
attacattccttgataa

SEQ ID NO: 5268132 - DNA, 21 bp, Homo sapiens
attacattccttgataatgtt

SEQ ID NO: 5268133 - DNA, 22 bp, Homo sapiens
attacattccttgataatgttg

SEQ ID NO: 5268134 - DNA, 19 bp, Homo sapiens
attacattgctttttcttg

SEQ ID NO: 5268135 - DNA, 22 bp, Homo sapiens
attacattggcacaatgtatac

SEQ ID NO: 5268136 - DNA, 15 bp, Homo sapiens
attacatttatacat

SEQ ID NO: 5268137 - DNA, 18 bp, Homo sapiens
attacatttatttatcca

SEQ ID NO: 5268138 - DNA, 22 bp, Homo sapiens
attacatttccaaatgaatgac

SEQ ID NO: 5268139 - DNA, 17 bp, Homo sapiens
attacatttgtataaaa

SEQ ID NO: 5268140 - DNA, 22 bp, Homo sapiens
attacattttactgattaacaa

SEQ ID NO: 5268141 - DNA, 23 bp, Homo sapiens
attacattttattaagctttttg

SEQ ID NO: 5268142 - DNA, 18 bp, Homo sapiens
attaccaaaaatcttggg

SEQ ID NO: 5268143 - DNA, 18 bp, Homo sapiens
attaccaaattacatgaa

SEQ ID NO: 5268144 - DNA, 16 bp, Homo sapiens
attaccaacctgttac

SEQ ID NO: 5268145 - DNA, 12 bp, Homo sapiens
attaccactgaa

SEQ ID NO: 5268146 - DNA, 14 bp, Homo sapiens
attaccactgaaga

SEQ ID NO: 5268147 - DNA, 18 bp, Homo sapiens
attaccactgaagataga

SEQ ID NO: 5268148 - DNA, 16 bp, Homo sapiens
attaccagacaaaaaa

SEQ ID NO: 5268149 - DNA, 20 bp, Homo sapiens
attaccagacggttcaccag

SEQ ID NO: 5268150 - DNA, 23 bp, Homo sapiens
attaccagacggttcaccagcct

SEQ ID NO: 5268151 - DNA, 17 bp, Homo sapiens
attaccagatagttata

SEQ ID NO: 5268152 - DNA, 13 bp, Homo sapiens
attaccaggtttc

SEQ ID NO: 5268153 - DNA, 19 bp, Homo sapiens
attaccaggtttcattttg

SEQ ID NO: 5268154 - DNA, 16 bp, Homo sapiens
attaccagtctgatta

SEQ ID NO: 5268155 - DNA, 19 bp, Homo sapiens
attaccatagagtaatgat

SEQ ID NO: 5268156 - DNA, 14 bp, Homo sapiens
attaccatcttaat

SEQ ID NO: 5268157 - DNA, 18 bp, Homo sapiens
attaccatcttaatcttt

SEQ ID NO: 5268158 - DNA, 15 bp, Homo sapiens
attaccatggagaca

SEQ ID NO: 5268159 - DNA, 12 bp, Homo sapiens
attaccatgtaa

SEQ ID NO: 5268160 - DNA, 13 bp, Homo sapiens
attaccatgtaaa

SEQ ID NO: 5268161 - DNA, 19 bp, Homo sapiens
attaccatgtaaataatct

SEQ ID NO: 5268162 - DNA, 22 bp, Homo sapiens
attaccattaattacatacaga

SEQ ID NO: 5268163 - DNA, 14 bp, Homo sapiens
attaccatttgtta

SEQ ID NO: 5268164 - DNA, 12 bp, Homo sapiens
attacccacccg

SEQ ID NO: 5268165 - DNA, 16 bp, Homo sapiens
attacccacccgacct

SEQ ID NO: 5268166 - DNA, 22 bp, Homo sapiens
attacccacccgacctggctgc

SEQ ID NO: 5268167 - DNA, 19 bp, Homo sapiens
attacccagctaaataatc

SEQ ID NO: 5268168 - DNA, 23 bp, Homo sapiens
attacccagtgccgaggacatgc

SEQ ID NO: 5268169 - DNA, 14 bp, Homo sapiens
attacccataaaca

SEQ ID NO: 5268170 - DNA, 14 bp, Homo sapiens
attacccccagtcc

SEQ ID NO: 5268171 - DNA, 22 bp, Homo sapiens
attaccccctcattgtttatta

SEQ ID NO: 5268172 - DNA, 20 bp, Homo sapiens
attaccccctccttcagaca

SEQ ID NO: 5268173 - DNA, 23 bp, Homo sapiens
attacccctatacctgagcctca

SEQ ID NO: 5268174 - DNA, 16 bp, Homo sapiens
attacccttcctcatc

SEQ ID NO: 5268175 - DNA, 16 bp, Homo sapiens
attacccttctttcca

SEQ ID NO: 5268176 - DNA, 19 bp, Homo sapiens
attaccgataaatgaacat

SEQ ID NO: 5268177 - DNA, 20 bp, Homo sapiens
attaccgcgttgtaaaatat

SEQ ID NO: 5268178 - DNA, 20 bp, Homo sapiens
attaccgtcacactcttcag

SEQ ID NO: 5268179 - DNA, 21 bp, Homo sapiens
attaccgttatgtctttggaa

SEQ ID NO: 5268180 - DNA, 15 bp, Homo sapiens
attacctaatgaaag

SEQ ID NO: 5268181 - DNA, 15 bp, Homo sapiens
attacctagaaatct

SEQ ID NO: 5268182 - DNA, 16 bp, Homo sapiens
attacctagaaatcta

SEQ ID NO: 5268183 - DNA, 13 bp, Homo sapiens
attacctcctgag

SEQ ID NO: 5268184 - DNA, 22 bp, Homo sapiens
attacctctcagggccgagagg

SEQ ID NO: 5268185 - DNA, 12 bp, Homo sapiens
attacctgaaag

SEQ ID NO: 5268186 - DNA, 16 bp, Homo sapiens
attacctgaaagccct

SEQ ID NO: 5268187 - DNA, 18 bp, Homo sapiens
attacctgccaattgcta

SEQ ID NO: 5268188 - DNA, 20 bp, Homo sapiens
attacctggtgagtaactta

SEQ ID NO: 5268189 - DNA, 23 bp, Homo sapiens
attacctggtgagtaacttagaa

SEQ ID NO: 5268190 - DNA, 14 bp, Homo sapiens
attacctgtagctt

SEQ ID NO: 5268191 - DNA, 16 bp, Homo sapiens
attacctgtagctttg

SEQ ID NO: 5268192 - DNA, 17 bp, Homo sapiens
attacctgtataatgga

SEQ ID NO: 5268193 - DNA, 13 bp, Homo sapiens
attaccttactgt

SEQ ID NO: 5268194 - DNA, 19 bp, Homo sapiens
attacctttaattttaatg

SEQ ID NO: 5268195 - DNA, 17 bp, Homo sapiens
attacgaagttcaagat

SEQ ID NO: 5268196 - DNA, 17 bp, Homo sapiens
attacgataaggaagaa

SEQ ID NO: 5268197 - DNA, 20 bp, Homo sapiens
attacgataaggaagaaaca

SEQ ID NO: 5268198 - DNA, 23 bp, Homo sapiens
attacgcaggtatttagaagcag

SEQ ID NO: 5268199 - DNA, 19 bp, Homo sapiens
attacggtgtacagtttaa

SEQ ID NO: 5268200 - DNA, 23 bp, Homo sapiens
atgcctaaaaattcccttcctgt

SEQ ID NO: 5268201 - DNA, 15 bp, Homo sapiens
atgcctaaagcccat

SEQ ID NO: 5268202 - DNA, 22 bp, Homo sapiens
atgcctaaagcccattgctgca

SEQ ID NO: 5268203 - DNA, 20 bp, Homo sapiens
atgcctaagaagatgacttc

SEQ ID NO: 5268204 - DNA, 21 bp, Homo sapiens
atgcctaatatttaggcaaga

SEQ ID NO: 5268205 - DNA, 13 bp, Homo sapiens
atgcctacagata

SEQ ID NO: 5268206 - DNA, 18 bp, Homo sapiens
atgcctacagccctcact

SEQ ID NO: 5268207 - DNA, 17 bp, Homo sapiens
atgcctaccaatattta

SEQ ID NO: 5268208 - DNA, 15 bp, Homo sapiens
atgcctaccttgtga

SEQ ID NO: 5268209 - DNA, 19 bp, Homo sapiens
atgcctacttttggcctca

SEQ ID NO: 5268210 - DNA, 20 bp, Homo sapiens
atgcctacttttggcctcat

SEQ ID NO: 5268211 - DNA, 16 bp, Homo sapiens
atgcctagactgtgta

SEQ ID NO: 5268212 - DNA, 15 bp, Homo sapiens
atgcctagagatatt

SEQ ID NO: 5268213 - DNA, 17 bp, Homo sapiens
atgcctagagatatttc

SEQ ID NO: 5268214 - DNA, 18 bp, Homo sapiens
atgcctagagatatttca

SEQ ID NO: 5268215 - DNA, 22 bp, Homo sapiens
atgcctagagatatttcaagct

SEQ ID NO: 5268216 - DNA, 18 bp, Homo sapiens
atgcctagcagagaactg

SEQ ID NO: 5268217 - DNA, 21 bp, Homo sapiens
atgcctagcagagtgctggca

SEQ ID NO: 5268218 - DNA, 14 bp, Homo sapiens
atgcctaggccagc

SEQ ID NO: 5268219 - DNA, 16 bp, Homo sapiens
atgcctaggccagctc

SEQ ID NO: 5268220 - DNA, 18 bp, Homo sapiens
atgcctaggtcccttccc

SEQ ID NO: 5268221 - DNA, 13 bp, Homo sapiens
atgcctatattta

SEQ ID NO: 5268222 - DNA, 17 bp, Homo sapiens
atgcctatgggccagag

SEQ ID NO: 5268223 - DNA, 21 bp, Homo sapiens
atgcctatggtggatccaaac

SEQ ID NO: 5268224 - DNA, 13 bp, Homo sapiens
atgcctatgtttt

SEQ ID NO: 5268225 - DNA, 15 bp, Homo sapiens
atgcctcacaaatgc

SEQ ID NO: 5268226 - DNA, 21 bp, Homo sapiens
atgcctcacaaatgctgtggt

SEQ ID NO: 5268227 - DNA, 16 bp, Homo sapiens
atgcctcacgagattt

SEQ ID NO: 5268228 - DNA, 16 bp, Homo sapiens
atgcctcactaatttt

SEQ ID NO: 5268229 - DNA, 21 bp, Homo sapiens
atgcctcagccagccctggag

SEQ ID NO: 5268230 - DNA, 23 bp, Homo sapiens
atgcctcagccagccctggaggc

SEQ ID NO: 5268231 - DNA, 21 bp, Homo sapiens
atgcctcagcccaggtcagct

SEQ ID NO: 5268232 - DNA, 17 bp, Homo sapiens
atgcctcagtttcccca

SEQ ID NO: 5268233 - DNA, 22 bp, Homo sapiens
atgcctcataaattaatgattc

SEQ ID NO: 5268234 - DNA, 16 bp, Homo sapiens
atgcctcatcctccca

SEQ ID NO: 5268235 - DNA, 20 bp, Homo sapiens
atgcctccaaaaattcacat

SEQ ID NO: 5268236 - DNA, 20 bp, Homo sapiens
atgcctccaccccccagaac

SEQ ID NO: 5268237 - DNA, 12 bp, Homo sapiens
atgcctccaccg

SEQ ID NO: 5268238 - DNA, 13 bp, Homo sapiens
atgcctccccaag

SEQ ID NO: 5268239 - DNA, 14 bp, Homo sapiens
atgcctccccaaga

SEQ ID NO: 5268240 - DNA, 20 bp, Homo sapiens
atgcctccccctagccattt

SEQ ID NO: 5268241 - DNA, 23 bp, Homo sapiens
atgcctcccggctttgcagggag

SEQ ID NO: 5268242 - DNA, 11 bp, Homo sapiens
atgcctccctg

SEQ ID NO: 5268243 - DNA, 18 bp, Homo sapiens
atgcctccctgaccctgc

SEQ ID NO: 5268244 - DNA, 22 bp, Homo sapiens
atgcctccctgaccctgcagag

SEQ ID NO: 5268245 - DNA, 21 bp, Homo sapiens
atgcctccctgggccacctcc

SEQ ID NO: 5268246 - DNA, 22 bp, Homo sapiens
atgcctccgaaggggctctgag

SEQ ID NO: 5268247 - DNA, 13 bp, Homo sapiens
atgcctcctcagg

SEQ ID NO: 5268248 - DNA, 14 bp, Homo sapiens
atgcctcctcctgc

SEQ ID NO: 5268249 - DNA, 15 bp, Homo sapiens
atgcctcctcctgcc

SEQ ID NO: 5268250 - DNA, 23 bp, Homo sapiens
atgcctcctctgtcctcattctt

SEQ ID NO: 5268251 - DNA, 14 bp, Homo sapiens
atgcctcctgtggg

SEQ ID NO: 5268252 - DNA, 15 bp, Homo sapiens
atgcctccttggcca

SEQ ID NO: 5268253 - DNA, 22 bp, Homo sapiens
atgcctcgctcagtcagtgcac

SEQ ID NO: 5268254 - DNA, 16 bp, Homo sapiens
atgcctcgctcccttc

SEQ ID NO: 5268255 - DNA, 20 bp, Homo sapiens
atgcctctccccagagcatt

SEQ ID NO: 5268256 - DNA, 15 bp, Homo sapiens
atgcctctctcaggc

SEQ ID NO: 5268257 - DNA, 19 bp, Homo sapiens
atgcctctctcaggccaaa

SEQ ID NO: 5268258 - DNA, 21 bp, Homo sapiens
atgcctctgacagtccacagg

SEQ ID NO: 5268259 - DNA, 12 bp, Homo sapiens
atgcctctgagc

SEQ ID NO: 5268260 - DNA, 22 bp, Homo sapiens
atgcctctgatatgggactgag

SEQ ID NO: 5268261 - DNA, 18 bp, Homo sapiens
atgcctctgccaaaggat

SEQ ID NO: 5268262 - DNA, 16 bp, Homo sapiens
atgcctcttaggactg

SEQ ID NO: 5268263 - DNA, 22 bp, Homo sapiens
atgcctgaccaacaggcccagc

SEQ ID NO: 5268264 - DNA, 19 bp, Homo sapiens
atgcctgaccccttgctcc

SEQ ID NO: 5268265 - DNA, 18 bp, Homo sapiens
atgcctgactaattttgt

SEQ ID NO: 5268266 - DNA, 19 bp, Homo sapiens
atgcctgactaatttttgt

SEQ ID NO: 5268267 - DNA, 21 bp, Homo sapiens
atgcctgagaatgcctaggcc

SEQ ID NO: 5268268 - DNA, 15 bp, Homo sapiens
atgcctgagccccct

SEQ ID NO: 5268269 - DNA, 17 bp, Homo sapiens
atgcctgagccccctga

SEQ ID NO: 5268270 - DNA, 15 bp, Homo sapiens
atgcctgagggtgga

SEQ ID NO: 5268271 - DNA, 17 bp, Homo sapiens
atgcctgagggtggaga

SEQ ID NO: 5268272 - DNA, 16 bp, Homo sapiens
atgcctgagttataaa

SEQ ID NO: 5268273 - DNA, 20 bp, Homo sapiens
atgcctgagttataaatatt

SEQ ID NO: 5268274 - DNA, 21 bp, Homo sapiens
atgcctgattgccaagctcag

SEQ ID NO: 5268275 - DNA, 16 bp, Homo sapiens
atgcctgattttaaaa

SEQ ID NO: 5268276 - DNA, 13 bp, Homo sapiens
atgcctgcactgg

SEQ ID NO: 5268277 - DNA, 23 bp, Homo sapiens
atgcctgcactgggaaggaaaca

SEQ ID NO: 5268278 - DNA, 17 bp, Homo sapiens
atgcctgcaggcatgga

SEQ ID NO: 5268279 - DNA, 14 bp, Homo sapiens
atgcctgcatgctg

SEQ ID NO: 5268280 - DNA, 12 bp, Homo sapiens
atgcctgcccat

SEQ ID NO: 5268281 - DNA, 19 bp, Homo sapiens
atgcctgccccaaacaaat

SEQ ID NO: 5268282 - DNA, 15 bp, Homo sapiens
atgcctgcctgaaca

SEQ ID NO: 5268283 - DNA, 18 bp, Homo sapiens
atgcctgcgcctgctgcc

SEQ ID NO: 5268284 - DNA, 18 bp, Homo sapiens
atgcctgctccctgtctg

SEQ ID NO: 5268285 - DNA, 22 bp, Homo sapiens
atgcctgctccctgtctgtgtc

SEQ ID NO: 5268286 - DNA, 12 bp, Homo sapiens
atgcctgctctt

SEQ ID NO: 5268287 - DNA, 12 bp, Homo sapiens
atgcctgctgct

SEQ ID NO: 5268288 - DNA, 16 bp, Homo sapiens
atgcctgctgctgcca

SEQ ID NO: 5268289 - DNA, 23 bp, Homo sapiens
atgcctgctttttggaaagtcag

SEQ ID NO: 5268290 - DNA, 11 bp, Homo sapiens
atgcctggagg

SEQ ID NO: 5268291 - DNA, 15 bp, Homo sapiens
atgcctggagggtaa

SEQ ID NO: 5268292 - DNA, 15 bp, Homo sapiens
atgcctggcccaggt

SEQ ID NO: 5268293 - DNA, 12 bp, Homo sapiens
atgcctggcccc

SEQ ID NO: 5268294 - DNA, 13 bp, Homo sapiens
atgcctggccccc

SEQ ID NO: 5268295 - DNA, 22 bp, Homo sapiens
atgcctggcccccctccaggca

SEQ ID NO: 5268296 - DNA, 13 bp, Homo sapiens
atgcctggcccct

SEQ ID NO: 5268297 - DNA, 22 bp, Homo sapiens
atgcctggcccctcctcctaga

SEQ ID NO: 5268298 - DNA, 12 bp, Homo sapiens
atgcctggccct

SEQ ID NO: 5268299 - DNA, 13 bp, Homo sapiens
atgcctggccctt

SEQ ID NO: 5268300 - DNA, 19 bp, Homo sapiens
atgcctgggaatcctgctg

SEQ ID NO: 5268301 - DNA, 20 bp, Homo sapiens
atgcctgggaatcctgctgc

SEQ ID NO: 5268302 - DNA, 22 bp, Homo sapiens
atgcctggtaagtggctttttg

SEQ ID NO: 5268303 - DNA, 15 bp, Homo sapiens
atgcctggtcccaag

SEQ ID NO: 5268304 - DNA, 17 bp, Homo sapiens
atgcctggtgagcaggg

SEQ ID NO: 5268305 - DNA, 17 bp, Homo sapiens
atgcctggtgagcatta

SEQ ID NO: 5268306 - DNA, 11 bp, Homo sapiens
atgcctggtgg

SEQ ID NO: 5268307 - DNA, 15 bp, Homo sapiens
atgcctggtggcagc

SEQ ID NO: 5268308 - DNA, 16 bp, Homo sapiens
atgcctgtaaagtctg

SEQ ID NO: 5268309 - DNA, 20 bp, Homo sapiens
atgcctgtaatcccagaact

SEQ ID NO: 5268310 - DNA, 21 bp, Homo sapiens
atgcctgtactcgcttgtgca

SEQ ID NO: 5268311 - DNA, 24 bp, Homo sapiens
atgcctgtagctttcctggtccct

SEQ ID NO: 5268312 - DNA, 12 bp, Homo sapiens
atgcctgtattt

SEQ ID NO: 5268313 - DNA, 16 bp, Homo sapiens
atgcctgtatttccaa

SEQ ID NO: 5268314 - DNA, 17 bp, Homo sapiens
atgcctgtatttccaac

SEQ ID NO: 5268315 - DNA, 21 bp, Homo sapiens
atgcctgtcagtttcatggag

SEQ ID NO: 5268316 - DNA, 17 bp, Homo sapiens
atgcctgtccagcctgg

SEQ ID NO: 5268317 - DNA, 15 bp, Homo sapiens
atgcctgtcctgaaa

SEQ ID NO: 5268318 - DNA, 16 bp, Homo sapiens
atgcctgtcctgaaag

SEQ ID NO: 5268319 - DNA, 16 bp, Homo sapiens
atgcctgtctctagct

SEQ ID NO: 5268320 - DNA, 13 bp, Homo sapiens
atgcctgtctctg

SEQ ID NO: 5268321 - DNA, 22 bp, Homo sapiens
atgcctgtctctgttcagatgt

SEQ ID NO: 5268322 - DNA, 22 bp, Homo sapiens
atgcctgtggaagagtgtgtgt

SEQ ID NO: 5268323 - DNA, 12 bp, Homo sapiens
atgcctgtggct

SEQ ID NO: 5268324 - DNA, 15 bp, Homo sapiens
atgcctgtggctgcg

SEQ ID NO: 5268325 - DNA, 21 bp, Homo sapiens
atgcctgtggtgaagtgtggc

SEQ ID NO: 5268326 - DNA, 22 bp, Homo sapiens
atgcctgttaatttataatgta

SEQ ID NO: 5268327 - DNA, 12 bp, Homo sapiens
atgcctgttgat

SEQ ID NO: 5268328 - DNA, 16 bp, Homo sapiens
atgcctgttgcaggca

SEQ ID NO: 5268329 - DNA, 21 bp, Homo sapiens
atgcctgttgcaggcaaatgt

SEQ ID NO: 5268330 - DNA, 19 bp, Homo sapiens
atgcctgttttgagaccag

SEQ ID NO: 5268331 - DNA, 19 bp, Homo sapiens
atgccttaaaatggaattg

SEQ ID NO: 5268332 - DNA, 13 bp, Homo sapiens
atgccttaagcag

SEQ ID NO: 5268333 - DNA, 16 bp, Homo sapiens
atgccttaagcagaac

SEQ ID NO: 5268334 - DNA, 17 bp, Homo sapiens
atgccttaagcagaaca

SEQ ID NO: 5268335 - DNA, 21 bp, Homo sapiens
atgccttaagcagaacaaatg

SEQ ID NO: 5268336 - DNA, 13 bp, Homo sapiens
atgccttaattta

SEQ ID NO: 5268337 - DNA, 20 bp, Homo sapiens
atgccttaatttagaaactg

SEQ ID NO: 5268338 - DNA, 21 bp, Homo sapiens
atgccttaatttagaaactga

SEQ ID NO: 5268339 - DNA, 22 bp, Homo sapiens
atgccttaatttagaaactgaa

SEQ ID NO: 5268340 - DNA, 18 bp, Homo sapiens
atgccttactcttcttga

SEQ ID NO: 5268341 - DNA, 15 bp, Homo sapiens
atgccttatgtaatt

SEQ ID NO: 5268342 - DNA, 19 bp, Homo sapiens
atgccttatttttgaattc

SEQ ID NO: 5268343 - DNA, 23 bp, Homo sapiens
atgccttatttttgaattcttta

SEQ ID NO: 5268344 - DNA, 20 bp, Homo sapiens
atgccttcaaatagtataga

SEQ ID NO: 5268345 - DNA, 22 bp, Homo sapiens
atgccttcataaattatttcta

SEQ ID NO: 5268346 - DNA, 11 bp, Homo sapiens
atgccttccac

SEQ ID NO: 5268347 - DNA, 14 bp, Homo sapiens
atgccttcctgtct

SEQ ID NO: 5268348 - DNA, 13 bp, Homo sapiens
atgccttctgtat

SEQ ID NO: 5268349 - DNA, 15 bp, Homo sapiens
atgccttctgtggcc

SEQ ID NO: 5268350 - DNA, 23 bp, Homo sapiens
atgccttctgttttccaaaggag

SEQ ID NO: 5268351 - DNA, 13 bp, Homo sapiens
atgccttgaactg

SEQ ID NO: 5268352 - DNA, 16 bp, Homo sapiens
atgccttgaactgttg

SEQ ID NO: 5268353 - DNA, 17 bp, Homo sapiens
atgccttgataaatata

SEQ ID NO: 5268354 - DNA, 21 bp, Homo sapiens
atgccttgattagacctaatt

SEQ ID NO: 5268355 - DNA, 14 bp, Homo sapiens
atgccttgcttgta

SEQ ID NO: 5268356 - DNA, 18 bp, Homo sapiens
atgccttggaggaaatgt

SEQ ID NO: 5268357 - DNA, 20 bp, Homo sapiens
atgccttggggaggacaaaa

SEQ ID NO: 5268358 - DNA, 12 bp, Homo sapiens
atgccttgtata

SEQ ID NO: 5268359 - DNA, 13 bp, Homo sapiens
atgccttgtataa

SEQ ID NO: 5268360 - DNA, 19 bp, Homo sapiens
atgccttgtgctgttaata

SEQ ID NO: 5268361 - DNA, 14 bp, Homo sapiens
atgcctttatactt

SEQ ID NO: 5268362 - DNA, 22 bp, Homo sapiens
atgcctttctagcaattgcttc

SEQ ID NO: 5268363 - DNA, 16 bp, Homo sapiens
atgcctttctctccta

SEQ ID NO: 5268364 - DNA, 13 bp, Homo sapiens
atgcctttgagac

SEQ ID NO: 5268365 - DNA, 21 bp, Homo sapiens
atgcctttgagacagtttctt

SEQ ID NO: 5268366 - DNA, 12 bp, Homo sapiens
atgcctttgtaa

SEQ ID NO: 5268367 - DNA, 21 bp, Homo sapiens
atgcctttgtactttagggaa

SEQ ID NO: 5268368 - DNA, 14 bp, Homo sapiens
atgccttttatttc

SEQ ID NO: 5268369 - DNA, 24 bp, Homo sapiens
atgccttttcaaatgcagcaatcc

SEQ ID NO: 5268370 - DNA, 21 bp, Homo sapiens
atgccttttcccaaaatgttg

SEQ ID NO: 5268371 - DNA, 20 bp, Homo sapiens
atgccttttcccaactccag

SEQ ID NO: 5268372 - DNA, 17 bp, Homo sapiens
atgccttttgaatacat

SEQ ID NO: 5268373 - DNA, 13 bp, Homo sapiens
atgccttttgggt

SEQ ID NO: 5268374 - DNA, 19 bp, Homo sapiens
atgccttttgtagctgtca

SEQ ID NO: 5268375 - DNA, 22 bp, Homo sapiens
atgcctttttagatgtattttt

SEQ ID NO: 5268376 - DNA, 15 bp, Homo sapiens
atgcctttttttaag

SEQ ID NO: 5268377 - DNA, 18 bp, Homo sapiens
atgcgaaaacttgaatct

SEQ ID NO: 5268378 - DNA, 19 bp, Homo sapiens
atgcgaaccacccaaaaca

SEQ ID NO: 5268379 - DNA, 18 bp, Homo sapiens
attacgtactaaggatac

SEQ ID NO: 5268380 - DNA, 14 bp, Homo sapiens
attacgtatgcaag

SEQ ID NO: 5268381 - DNA, 13 bp, Homo sapiens
attacgtgagcca

SEQ ID NO: 5268382 - DNA, 14 bp, Homo sapiens
attacgtgagccag

SEQ ID NO: 5268383 - DNA, 20 bp, Homo sapiens
attacgtgggtgccctctcc

SEQ ID NO: 5268384 - DNA, 14 bp, Homo sapiens
attacgtgtatgtt

SEQ ID NO: 5268385 - DNA, 18 bp, Homo sapiens
attacgtgtatgtttctt

SEQ ID NO: 5268386 - DNA, 22 bp, Homo sapiens
attacgttcttacaagcttaaa

SEQ ID NO: 5268387 - DNA, 15 bp, Homo sapiens
attacgtttgttatt

SEQ ID NO: 5268388 - DNA, 13 bp, Homo sapiens
attactaaattgt

SEQ ID NO: 5268389 - DNA, 22 bp, Homo sapiens
attactaaggcaggtgggcaga

SEQ ID NO: 5268390 - DNA, 15 bp, Homo sapiens
attactacaaaattt

SEQ ID NO: 5268391 - DNA, 14 bp, Homo sapiens
attactactccttt

SEQ ID NO: 5268392 - DNA, 12 bp, Homo sapiens
attactactgta

SEQ ID NO: 5268393 - DNA, 13 bp, Homo sapiens
attactactgtac

SEQ ID NO: 5268394 - DNA, 14 bp, Homo sapiens
attactagagttgg

SEQ ID NO: 5268395 - DNA, 16 bp, Homo sapiens
attactatctgttgaa

SEQ ID NO: 5268396 - DNA, 21 bp, Homo sapiens
attactattccctttgacttc

SEQ ID NO: 5268397 - DNA, 13 bp, Homo sapiens
attactcaggttt

SEQ ID NO: 5268398 - DNA, 14 bp, Homo sapiens
attactccaaaaag

SEQ ID NO: 5268399 - DNA, 20 bp, Homo sapiens
attactccaaaaagacaagt

SEQ ID NO: 5268400 - DNA, 18 bp, Homo sapiens
attactccaaggtttata

SEQ ID NO: 5268401 - DNA, 14 bp, Homo sapiens
attactcccaggat

SEQ ID NO: 5268402 - DNA, 18 bp, Homo sapiens
attactcccattttgcag

SEQ ID NO: 5268403 - DNA, 16 bp, Homo sapiens
attactcctatttttg

SEQ ID NO: 5268404 - DNA, 21 bp, Homo sapiens
attactcctatttttgtaaac

SEQ ID NO: 5268405 - DNA, 14 bp, Homo sapiens
attactccttcctt

SEQ ID NO: 5268406 - DNA, 15 bp, Homo sapiens
attactccttccttc

SEQ ID NO: 5268407 - DNA, 22 bp, Homo sapiens
attactcgatcaaaaccttcct

SEQ ID NO: 5268408 - DNA, 18 bp, Homo sapiens
attactctagtttattct

SEQ ID NO: 5268409 - DNA, 17 bp, Homo sapiens
attactctcacccataa

SEQ ID NO: 5268410 - DNA, 22 bp, Homo sapiens
attactctcacccataaacagt

SEQ ID NO: 5268411 - DNA, 23 bp, Homo sapiens
attactctcacccataaacagta

SEQ ID NO: 5268412 - DNA, 11 bp, Homo sapiens
attactctgca

SEQ ID NO: 5268413 - DNA, 15 bp, Homo sapiens
attactctgcactat

SEQ ID NO: 5268414 - DNA, 20 bp, Homo sapiens
attactctgcactatagcca

SEQ ID NO: 5268415 - DNA, 23 bp, Homo sapiens
attactctggtggattgttctag

SEQ ID NO: 5268416 - DNA, 13 bp, Homo sapiens
attactcttgtaa

SEQ ID NO: 5268417 - DNA, 21 bp, Homo sapiens
attactcttgtaagattttga

SEQ ID NO: 5268418 - DNA, 20 bp, Homo sapiens
attactctttgctttgtagt

SEQ ID NO: 5268419 - DNA, 14 bp, Homo sapiens
attactctttttca

SEQ ID NO: 5268420 - DNA, 19 bp, Homo sapiens
attactctttttcaataaa

SEQ ID NO: 5268421 - DNA, 21 bp, Homo sapiens
attactctttttcaataaatt

SEQ ID NO: 5268422 - DNA, 15 bp, Homo sapiens
attactgaattgtat

SEQ ID NO: 5268423 - DNA, 14 bp, Homo sapiens
attactgaccgtat

SEQ ID NO: 5268424 - DNA, 18 bp, Homo sapiens
attactgaggaaagggag

SEQ ID NO: 5268425 - DNA, 21 bp, Homo sapiens
attactgaggggattctctac

SEQ ID NO: 5268426 - DNA, 16 bp, Homo sapiens
attactgatatcagag

SEQ ID NO: 5268427 - DNA, 23 bp, Homo sapiens
attactgatccccaatatgttga

SEQ ID NO: 5268428 - DNA, 20 bp, Homo sapiens
attactgatttagaagcaaa

SEQ ID NO: 5268429 - DNA, 15 bp, Homo sapiens
attactgcaatcact

SEQ ID NO: 5268430 - DNA, 17 bp, Homo sapiens
attactgcaatcactgt

SEQ ID NO: 5268431 - DNA, 21 bp, Homo sapiens
attactgcaatcactgtgcta

SEQ ID NO: 5268432 - DNA, 20 bp, Homo sapiens
attactgccattcacttcat

SEQ ID NO: 5268433 - DNA, 14 bp, Homo sapiens
attactgccttgaa

SEQ ID NO: 5268434 - DNA, 15 bp, Homo sapiens
attactgccttgaaa

SEQ ID NO: 5268435 - DNA, 16 bp, Homo sapiens
attactgcctttggaa

SEQ ID NO: 5268436 - DNA, 24 bp, Homo sapiens
attactgcctttggaagaaacagg

SEQ ID NO: 5268437 - DNA, 16 bp, Homo sapiens
attactgctaagtatt

SEQ ID NO: 5268438 - DNA, 19 bp, Homo sapiens
attactgctaagtatttcc

SEQ ID NO: 5268439 - DNA, 15 bp, Homo sapiens
attactgcttcattt

SEQ ID NO: 5268440 - DNA, 18 bp, Homo sapiens
attactgctttaatcaga

SEQ ID NO: 5268441 - DNA, 20 bp, Homo sapiens
attactgctttaatcagaaa

SEQ ID NO: 5268442 - DNA, 21 bp, Homo sapiens
attactggcctttttcattta

SEQ ID NO: 5268443 - DNA, 17 bp, Homo sapiens
attactggcgtggatta

SEQ ID NO: 5268444 - DNA, 13 bp, Homo sapiens
attactgggcctt

SEQ ID NO: 5268445 - DNA, 14 bp, Homo sapiens
attactgggcctta

SEQ ID NO: 5268446 - DNA, 14 bp, Homo sapiens
attactgggtatat

SEQ ID NO: 5268447 - DNA, 15 bp, Homo sapiens
attactggtccaaaa

SEQ ID NO: 5268448 - DNA, 14 bp, Homo sapiens
attactgtatgtat

SEQ ID NO: 5268449 - DNA, 17 bp, Homo sapiens
attactgtatgtataaa

SEQ ID NO: 5268450 - DNA, 13 bp, Homo sapiens
attactgtcaata

SEQ ID NO: 5268451 - DNA, 12 bp, Homo sapiens
attactgtcccc

SEQ ID NO: 5268452 - DNA, 13 bp, Homo sapiens
attactgtcttta

SEQ ID NO: 5268453 - DNA, 20 bp, Homo sapiens
attactgtctttattcttat

SEQ ID NO: 5268454 - DNA, 12 bp, Homo sapiens
attactgtgatt

SEQ ID NO: 5268455 - DNA, 13 bp, Homo sapiens
attactgtgattt

SEQ ID NO: 5268456 - DNA, 14 bp, Homo sapiens
attactgttgcatt

SEQ ID NO: 5268457 - DNA, 16 bp, Homo sapiens
attactgtttatttct

SEQ ID NO: 5268458 - DNA, 13 bp, Homo sapiens
attactgtttgga

SEQ ID NO: 5268459 - DNA, 13 bp, Homo sapiens
attactgtttgtc

SEQ ID NO: 5268460 - DNA, 23 bp, Homo sapiens
attactgtttgtcttctccccag

SEQ ID NO: 5268461 - DNA, 18 bp, Homo sapiens
attactgttttatgttga

SEQ ID NO: 5268462 - DNA, 19 bp, Homo sapiens
attactgttttatgttgat

SEQ ID NO: 5268463 - DNA, 18 bp, Homo sapiens
attactgtttttgctatt

SEQ ID NO: 5268464 - DNA, 14 bp, Homo sapiens
attacttaaggcag

SEQ ID NO: 5268465 - DNA, 13 bp, Homo sapiens
attacttaatgtg

SEQ ID NO: 5268466 - DNA, 13 bp, Homo sapiens
attacttactgtt

SEQ ID NO: 5268467 - DNA, 21 bp, Homo sapiens
attacttactgttaaaactgt

SEQ ID NO: 5268468 - DNA, 23 bp, Homo sapiens
attacttactgttaaaactgtac

SEQ ID NO: 5268469 - DNA, 22 bp, Homo sapiens
attacttatccctgcccatttc

SEQ ID NO: 5268470 - DNA, 13 bp, Homo sapiens
attacttatttaa

SEQ ID NO: 5268471 - DNA, 15 bp, Homo sapiens
attacttatttttga

SEQ ID NO: 5268472 - DNA, 22 bp, Homo sapiens
attacttcactatacaaacaaa

SEQ ID NO: 5268473 - DNA, 14 bp, Homo sapiens
attacttcagggct

SEQ ID NO: 5268474 - DNA, 15 bp, Homo sapiens
attacttccatgaat

SEQ ID NO: 5268475 - DNA, 16 bp, Homo sapiens
attacttccatgaatt

SEQ ID NO: 5268476 - DNA, 19 bp, Homo sapiens
attacttctagtcagtcat

SEQ ID NO: 5268477 - DNA, 13 bp, Homo sapiens
attacttctgcta

SEQ ID NO: 5268478 - DNA, 16 bp, Homo sapiens
attacttctgtttggg

SEQ ID NO: 5268479 - DNA, 13 bp, Homo sapiens
attacttgaactt

SEQ ID NO: 5268480 - DNA, 14 bp, Homo sapiens
attacttgaacttt

SEQ ID NO: 5268481 - DNA, 18 bp, Homo sapiens
attacttgaactttccaa

SEQ ID NO: 5268482 - DNA, 14 bp, Homo sapiens
attacttgaatgta

SEQ ID NO: 5268483 - DNA, 19 bp, Homo sapiens
attacttgattaagatttt

SEQ ID NO: 5268484 - DNA, 12 bp, Homo sapiens
attacttgcaca

SEQ ID NO: 5268485 - DNA, 13 bp, Homo sapiens
attacttgcacaa

SEQ ID NO: 5268486 - DNA, 18 bp, Homo sapiens
attacttgcacaagcttg

SEQ ID NO: 5268487 - DNA, 15 bp, Homo sapiens
attacttgccagggg

SEQ ID NO: 5268488 - DNA, 21 bp, Homo sapiens
attacttgcctatctgacttc

SEQ ID NO: 5268489 - DNA, 23 bp, Homo sapiens
attacttgctttcaattgacaaa

SEQ ID NO: 5268490 - DNA, 14 bp, Homo sapiens
attacttggctttt

SEQ ID NO: 5268491 - DNA, 16 bp, Homo sapiens
attacttgtaaatata

SEQ ID NO: 5268492 - DNA, 19 bp, Homo sapiens
attacttgtaattatgaaa

SEQ ID NO: 5268493 - DNA, 23 bp, Homo sapiens
attacttgtaattatgaaaagaa

SEQ ID NO: 5268494 - DNA, 18 bp, Homo sapiens
attacttgtgcacttagt

SEQ ID NO: 5268495 - DNA, 15 bp, Homo sapiens
attactttaaattat

SEQ ID NO: 5268496 - DNA, 16 bp, Homo sapiens
attactttaacatgcc

SEQ ID NO: 5268497 - DNA, 12 bp, Homo sapiens
attactttacca

SEQ ID NO: 5268498 - DNA, 13 bp, Homo sapiens
attactttatagc

SEQ ID NO: 5268499 - DNA, 15 bp, Homo sapiens
attactttatcactt

SEQ ID NO: 5268500 - DNA, 16 bp, Homo sapiens
attactttatcacttt

SEQ ID NO: 5268501 - DNA, 15 bp, Homo sapiens
attactttcagaatg

SEQ ID NO: 5268502 - DNA, 12 bp, Homo sapiens
attactttcctc

SEQ ID NO: 5268503 - DNA, 15 bp, Homo sapiens
attactttctctgta

SEQ ID NO: 5268504 - DNA, 20 bp, Homo sapiens
attactttgaacattaatgt

SEQ ID NO: 5268505 - DNA, 23 bp, Homo sapiens
attactttggggctaatttaaca

SEQ ID NO: 5268506 - DNA, 14 bp, Homo sapiens
attactttgtgaat

SEQ ID NO: 5268507 - DNA, 14 bp, Homo sapiens
attacttttcatct

SEQ ID NO: 5268508 - DNA, 14 bp, Homo sapiens
attacttttgctgt

SEQ ID NO: 5268509 - DNA, 18 bp, Homo sapiens
attacttttgtaaatatt

SEQ ID NO: 5268510 - DNA, 23 bp, Homo sapiens
attacttttgtaaatattcttgt

SEQ ID NO: 5268511 - DNA, 14 bp, Homo sapiens
attacttttttcca

SEQ ID NO: 5268512 - DNA, 15 bp, Homo sapiens
attagaaaaaaacaa

SEQ ID NO: 5268513 - DNA, 21 bp, Homo sapiens
attagaaaaatatatgcttac

SEQ ID NO: 5268514 - DNA, 15 bp, Homo sapiens
attagaaaatattct

SEQ ID NO: 5268515 - DNA, 13 bp, Homo sapiens
attagaaaattag

SEQ ID NO: 5268516 - DNA, 16 bp, Homo sapiens
attagaaaattttgta

SEQ ID NO: 5268517 - DNA, 18 bp, Homo sapiens
attagaaacaaacaaaac

SEQ ID NO: 5268518 - DNA, 19 bp, Homo sapiens
attagaaacaaacaaaact

SEQ ID NO: 5268519 - DNA, 15 bp, Homo sapiens
attagaaaccatgaa

SEQ ID NO: 5268520 - DNA, 20 bp, Homo sapiens
attagaaagactttctaaat

SEQ ID NO: 5268521 - DNA, 22 bp, Homo sapiens
attagaaatagacagtatattt

SEQ ID NO: 5268522 - DNA, 15 bp, Homo sapiens
attagaaattagctg

SEQ ID NO: 5268523 - DNA, 20 bp, Homo sapiens
attagaaattagctgtgtga

SEQ ID NO: 5268524 - DNA, 13 bp, Homo sapiens
attagaaatttaa

SEQ ID NO: 5268525 - DNA, 19 bp, Homo sapiens
attagaaatttaatttctt

SEQ ID NO: 5268526 - DNA, 13 bp, Homo sapiens
attagaacattta

SEQ ID NO: 5268527 - DNA, 11 bp, Homo sapiens
attagaagaaa

SEQ ID NO: 5268528 - DNA, 20 bp, Homo sapiens
attagaagaaaacatatatt

SEQ ID NO: 5268529 - DNA, 21 bp, Homo sapiens
attagaagaaaataatttata

SEQ ID NO: 5268530 - DNA, 15 bp, Homo sapiens
attagaagacaacag

SEQ ID NO: 5268531 - DNA, 20 bp, Homo sapiens
attagaagccaagacagtgg

SEQ ID NO: 5268532 - DNA, 15 bp, Homo sapiens
attagaagtctttca

SEQ ID NO: 5268533 - DNA, 13 bp, Homo sapiens
attagaagtgttt

SEQ ID NO: 5268534 - DNA, 22 bp, Homo sapiens
attagaatagtgttctgcaaaa

SEQ ID NO: 5268535 - DNA, 21 bp, Homo sapiens
attagaatataatatttgaag

SEQ ID NO: 5268536 - DNA, 20 bp, Homo sapiens
attagaatcaaacattttga

SEQ ID NO: 5268537 - DNA, 21 bp, Homo sapiens
attagaatcaaacattttgaa

SEQ ID NO: 5268538 - DNA, 14 bp, Homo sapiens
attagaatccaatt

SEQ ID NO: 5268539 - DNA, 20 bp, Homo sapiens
attagaatgaatttatcttt

SEQ ID NO: 5268540 - DNA, 12 bp, Homo sapiens
attagaatgccg

SEQ ID NO: 5268541 - DNA, 14 bp, Homo sapiens
attagaatggagga

SEQ ID NO: 5268542 - DNA, 15 bp, Homo sapiens
attagaatgtgattt

SEQ ID NO: 5268543 - DNA, 15 bp, Homo sapiens
attagaattaccatt

SEQ ID NO: 5268544 - DNA, 19 bp, Homo sapiens
attagaattaccatttgtt

SEQ ID NO: 5268545 - DNA, 21 bp, Homo sapiens
attagaattaccatttgttaa

SEQ ID NO: 5268546 - DNA, 21 bp, Homo sapiens
attagaattagtgccagaatt

SEQ ID NO: 5268547 - DNA, 13 bp, Homo sapiens
attagaattattt

SEQ ID NO: 5268548 - DNA, 12 bp, Homo sapiens
attagaattctg

SEQ ID NO: 5268549 - DNA, 19 bp, Homo sapiens
attagacaatgtggaatta

SEQ ID NO: 5268550 - DNA, 22 bp, Homo sapiens
attagacaatgtggaattacat

SEQ ID NO: 5268551 - DNA, 13 bp, Homo sapiens
attagacacacat

SEQ ID NO: 5268552 - DNA, 17 bp, Homo sapiens
attagacaggttaaata

SEQ ID NO: 5268553 - DNA, 22 bp, Homo sapiens
attagacagtaagagtttacaa

SEQ ID NO: 5268554 - DNA, 18 bp, Homo sapiens
attagacctttatttttc

SEQ ID NO: 5268555 - DNA, 13 bp, Homo sapiens
attagactcctcc

SEQ ID NO: 5268556 - DNA, 15 bp, Homo sapiens
attagactgaattta

SEQ ID NO: 5268557 - DNA, 18 bp, Homo sapiens
attagactgaatttaact

SEQ ID NO: 5268558 - DNA, 15 bp, Homo sapiens
attagactggaactt

SEQ ID NO: 5268559 - DNA, 22 bp, Homo sapiens
attagactggaacttgaactga

SEQ ID NO: 5268560 - DNA, 16 bp, Homo sapiens
atgcgagactctgatg

SEQ ID NO: 5268561 - DNA, 18 bp, Homo sapiens
atgcgagactctgatgga

SEQ ID NO: 5268562 - DNA, 18 bp, Homo sapiens
atgcgagcttggccttgg

SEQ ID NO: 5268563 - DNA, 13 bp, Homo sapiens
atgcgaggaccac

SEQ ID NO: 5268564 - DNA, 22 bp, Homo sapiens
atgcgaggctcggagcaccctt

SEQ ID NO: 5268565 - DNA, 15 bp, Homo sapiens
atgcgaggggccagc

SEQ ID NO: 5268566 - DNA, 22 bp, Homo sapiens
atgcgattatctacccacgtcc

SEQ ID NO: 5268567 - DNA, 15 bp, Homo sapiens
atgcgcaatgtggca

SEQ ID NO: 5268568 - DNA, 20 bp, Homo sapiens
atgcgcacagagggaagcca

SEQ ID NO: 5268569 - DNA, 15 bp, Homo sapiens
atgcgcagaggccag

SEQ ID NO: 5268570 - DNA, 13 bp, Homo sapiens
atgcgcaggctgg

SEQ ID NO: 5268571 - DNA, 18 bp, Homo sapiens
atgcgcaggctggccctg

SEQ ID NO: 5268572 - DNA, 21 bp, Homo sapiens
atgcgcattctaacctggagg

SEQ ID NO: 5268573 - DNA, 16 bp, Homo sapiens
atgcgccaccatgccc

SEQ ID NO: 5268574 - DNA, 22 bp, Homo sapiens
atgcgccccctccgccctgcca

SEQ ID NO: 5268575 - DNA, 20 bp, Homo sapiens
atgcgccctggtatgtgcct

SEQ ID NO: 5268576 - DNA, 17 bp, Homo sapiens
atgcgccttcgtgcctg

SEQ ID NO: 5268577 - DNA, 18 bp, Homo sapiens
atgcgcgcgctctctctc

SEQ ID NO: 5268578 - DNA, 15 bp, Homo sapiens
atgcgcgctgtgggc

SEQ ID NO: 5268579 - DNA, 21 bp, Homo sapiens
atgcgcggaggagctagcctg

SEQ ID NO: 5268580 - DNA, 14 bp, Homo sapiens
atgcgctgtggcca

SEQ ID NO: 5268581 - DNA, 17 bp, Homo sapiens
atgcggaggaaagcaag

SEQ ID NO: 5268582 - DNA, 16 bp, Homo sapiens
atgcggatcctgctgg

SEQ ID NO: 5268583 - DNA, 12 bp, Homo sapiens
atgcggccaaga

SEQ ID NO: 5268584 - DNA, 13 bp, Homo sapiens
atgcggcccagcc

SEQ ID NO: 5268585 - DNA, 14 bp, Homo sapiens
atgcggcccagcca

SEQ ID NO: 5268586 - DNA, 22 bp, Homo sapiens
atgcggcccagccatgggccct

SEQ ID NO: 5268587 - DNA, 18 bp, Homo sapiens
atgcggcccagcccggct

SEQ ID NO: 5268588 - DNA, 19 bp, Homo sapiens
atgcggccgcattccctga

SEQ ID NO: 5268589 - DNA, 13 bp, Homo sapiens
atgcggccggcct

SEQ ID NO: 5268590 - DNA, 16 bp, Homo sapiens
atgcggccggcctggg

SEQ ID NO: 5268591 - DNA, 19 bp, Homo sapiens
atgcggctttctctgcctc

SEQ ID NO: 5268592 - DNA, 22 bp, Homo sapiens
atgcggctttctctgcctctgg

SEQ ID NO: 5268593 - DNA, 17 bp, Homo sapiens
atgcgggcattttgaat

SEQ ID NO: 5268594 - DNA, 16 bp, Homo sapiens
atgcgggccagtgctc

SEQ ID NO: 5268595 - DNA, 17 bp, Homo sapiens
atgcgggctgggcagct

SEQ ID NO: 5268596 - DNA, 14 bp, Homo sapiens
atgcggggacaggc

SEQ ID NO: 5268597 - DNA, 21 bp, Homo sapiens
atgcggtagccagcacacagg

SEQ ID NO: 5268598 - DNA, 21 bp, Homo sapiens
atgcggtgtttggttttttgt

SEQ ID NO: 5268599 - DNA, 16 bp, Homo sapiens
atgcggttgggaggca

SEQ ID NO: 5268600 - DNA, 17 bp, Homo sapiens
atgcggttgggaggcag

SEQ ID NO: 5268601 - DNA, 19 bp, Homo sapiens
atgcggtttccaaggtgca

SEQ ID NO: 5268602 - DNA, 17 bp, Homo sapiens
atgcgtaatttaatggg

SEQ ID NO: 5268603 - DNA, 21 bp, Homo sapiens
atgcgtacgtttcctgagaag

SEQ ID NO: 5268604 - DNA, 13 bp, Homo sapiens
atgcgtattctgt

SEQ ID NO: 5268605 - DNA, 14 bp, Homo sapiens
atgcgtattctgtg

SEQ ID NO: 5268606 - DNA, 17 bp, Homo sapiens
atgcgtattctgtggcc

SEQ ID NO: 5268607 - DNA, 19 bp, Homo sapiens
atgcgtcccaagatgttga

SEQ ID NO: 5268608 - DNA, 17 bp, Homo sapiens
atgcgtcccaagcagcc

SEQ ID NO: 5268609 - DNA, 22 bp, Homo sapiens
atgcgtcttgtgaaattgtgta

SEQ ID NO: 5268610 - DNA, 22 bp, Homo sapiens
atgcgtgagatgggtgtacaaa

SEQ ID NO: 5268611 - DNA, 20 bp, Homo sapiens
atgcgtgcataccacttttg

SEQ ID NO: 5268612 - DNA, 19 bp, Homo sapiens
atgcgtgcccttttcatat

SEQ ID NO: 5268613 - DNA, 18 bp, Homo sapiens
atgcgtgctgagaggcga

SEQ ID NO: 5268614 - DNA, 14 bp, Homo sapiens
atgcgtgggcagag

SEQ ID NO: 5268615 - DNA, 12 bp, Homo sapiens
atgcgtgtgtgt

SEQ ID NO: 5268616 - DNA, 16 bp, Homo sapiens
atgcgtgtgtgtgtgt

SEQ ID NO: 5268617 - DNA, 15 bp, Homo sapiens
atgcgttcactccaa

SEQ ID NO: 5268618 - DNA, 14 bp, Homo sapiens
atgcgtttcatgta

SEQ ID NO: 5268619 - DNA, 16 bp, Homo sapiens
atgcgtttgcctcctg

SEQ ID NO: 5268620 - DNA, 17 bp, Homo sapiens
atgcgtttgcctcctgg

SEQ ID NO: 5268621 - DNA, 15 bp, Homo sapiens
atgctaaaattctat

SEQ ID NO: 5268622 - DNA, 14 bp, Homo sapiens
atgctaaaattctt

SEQ ID NO: 5268623 - DNA, 12 bp, Homo sapiens
atgctaaacctt

SEQ ID NO: 5268624 - DNA, 14 bp, Homo sapiens
atgctaaaccttag

SEQ ID NO: 5268625 - DNA, 20 bp, Homo sapiens
atgctaaaccttagtactga

SEQ ID NO: 5268626 - DNA, 22 bp, Homo sapiens
atgctaaaccttagtactgagt

SEQ ID NO: 5268627 - DNA, 23 bp, Homo sapiens
atgctaaaccttagtactgagtt

SEQ ID NO: 5268628 - DNA, 17 bp, Homo sapiens
atgctaaacctttgagt

SEQ ID NO: 5268629 - DNA, 16 bp, Homo sapiens
atgctaaactgtgaaa

SEQ ID NO: 5268630 - DNA, 22 bp, Homo sapiens
atgctaaagaaaaagtcatcca

SEQ ID NO: 5268631 - DNA, 23 bp, Homo sapiens
atgctaaagaaaaagtcatccaa

SEQ ID NO: 5268632 - DNA, 14 bp, Homo sapiens
atgctaaataacta

SEQ ID NO: 5268633 - DNA, 13 bp, Homo sapiens
atgctaaatgcaa

SEQ ID NO: 5268634 - DNA, 19 bp, Homo sapiens
atgctaaatgcaaacactg

SEQ ID NO: 5268635 - DNA, 15 bp, Homo sapiens
atgctaaatgtgtaa

SEQ ID NO: 5268636 - DNA, 12 bp, Homo sapiens
atgctaaatgtt

SEQ ID NO: 5268637 - DNA, 15 bp, Homo sapiens
atgctaacaaactga

SEQ ID NO: 5268638 - DNA, 19 bp, Homo sapiens
atgctaacaaactgaaaaa

SEQ ID NO: 5268639 - DNA, 14 bp, Homo sapiens
atgctaacatctaa

SEQ ID NO: 5268640 - DNA, 18 bp, Homo sapiens
atgctaagaaagcaaata

SEQ ID NO: 5268641 - DNA, 13 bp, Homo sapiens
atgctaagaaatg

SEQ ID NO: 5268642 - DNA, 17 bp, Homo sapiens
atgctaagagaagtaga

SEQ ID NO: 5268643 - DNA, 17 bp, Homo sapiens
atgctaagtccatcacc

SEQ ID NO: 5268644 - DNA, 13 bp, Homo sapiens
atgctaataaact

SEQ ID NO: 5268645 - DNA, 21 bp, Homo sapiens
atgctaatataagtttctttg

SEQ ID NO: 5268646 - DNA, 17 bp, Homo sapiens
atgctaatcttgtccct

SEQ ID NO: 5268647 - DNA, 18 bp, Homo sapiens
atgctaatgaggtgcaca

SEQ ID NO: 5268648 - DNA, 14 bp, Homo sapiens
atgctaatggaatt

SEQ ID NO: 5268649 - DNA, 15 bp, Homo sapiens
atgctaatgtaatca

SEQ ID NO: 5268650 - DNA, 23 bp, Homo sapiens
atgctaatgtaatcatttatctt

SEQ ID NO: 5268651 - DNA, 21 bp, Homo sapiens
atgctaattctcagaaaggca

SEQ ID NO: 5268652 - DNA, 18 bp, Homo sapiens
atgctaatttaaagagac

SEQ ID NO: 5268653 - DNA, 20 bp, Homo sapiens
atgctaatttttggagaaat

SEQ ID NO: 5268654 - DNA, 16 bp, Homo sapiens
atgctacaaaatgtgt

SEQ ID NO: 5268655 - DNA, 17 bp, Homo sapiens
atgctacaattttaaga

SEQ ID NO: 5268656 - DNA, 15 bp, Homo sapiens
atgctacagtaataa

SEQ ID NO: 5268657 - DNA, 17 bp, Homo sapiens
atgctacagtaataaat

SEQ ID NO: 5268658 - DNA, 21 bp, Homo sapiens
atgctacagtactatgtaaat

SEQ ID NO: 5268659 - DNA, 16 bp, Homo sapiens
atgctacattaatgtt

SEQ ID NO: 5268660 - DNA, 14 bp, Homo sapiens
atgctaccaccagc

SEQ ID NO: 5268661 - DNA, 15 bp, Homo sapiens
atgctacgtgtgatt

SEQ ID NO: 5268662 - DNA, 21 bp, Homo sapiens
atgctactacaaaaaagttgt

SEQ ID NO: 5268663 - DNA, 16 bp, Homo sapiens
atgctactgtcagtgt

SEQ ID NO: 5268664 - DNA, 21 bp, Homo sapiens
atgctactgtcagtgtcctca

SEQ ID NO: 5268665 - DNA, 20 bp, Homo sapiens
atgctactgtctcactgaaa

SEQ ID NO: 5268666 - DNA, 18 bp, Homo sapiens
atgctacttcccactgta

SEQ ID NO: 5268667 - DNA, 19 bp, Homo sapiens
atgctagaaaaatgttctt

SEQ ID NO: 5268668 - DNA, 14 bp, Homo sapiens
atgctagaaaaggc

SEQ ID NO: 5268669 - DNA, 22 bp, Homo sapiens
atgctagaactccctttcaaca

SEQ ID NO: 5268670 - DNA, 16 bp, Homo sapiens
atgctagaagaaaaca

SEQ ID NO: 5268671 - DNA, 22 bp, Homo sapiens
atgctagcacaatattcctatg

SEQ ID NO: 5268672 - DNA, 14 bp, Homo sapiens
atgctagccccaga

SEQ ID NO: 5268673 - DNA, 17 bp, Homo sapiens
atgctagccccagagat

SEQ ID NO: 5268674 - DNA, 22 bp, Homo sapiens
atgctagcctcacgaaactgga

SEQ ID NO: 5268675 - DNA, 18 bp, Homo sapiens
atgctagcgcgttgcctg

SEQ ID NO: 5268676 - DNA, 19 bp, Homo sapiens
atgctagcgcgttgcctgt

SEQ ID NO: 5268677 - DNA, 15 bp, Homo sapiens
atgctaggtctcgga

SEQ ID NO: 5268678 - DNA, 13 bp, Homo sapiens
atgctagtgttgt

SEQ ID NO: 5268679 - DNA, 19 bp, Homo sapiens
atgctagtgttgtatttct

SEQ ID NO: 5268680 - DNA, 14 bp, Homo sapiens
atgctagttcttac

SEQ ID NO: 5268681 - DNA, 20 bp, Homo sapiens
atgctataaattttttgaaa

SEQ ID NO: 5268682 - DNA, 22 bp, Homo sapiens
atgctataaattttttgaaaca

SEQ ID NO: 5268683 - DNA, 22 bp, Homo sapiens
atgctatactgtgtcatggtga

SEQ ID NO: 5268684 - DNA, 22 bp, Homo sapiens
atgctatcaaataactaaggaa

SEQ ID NO: 5268685 - DNA, 18 bp, Homo sapiens
atgctatcagaaacagta

SEQ ID NO: 5268686 - DNA, 18 bp, Homo sapiens
atgctatctcgctagcca

SEQ ID NO: 5268687 - DNA, 15 bp, Homo sapiens
atgctatgcaaaaaa

SEQ ID NO: 5268688 - DNA, 22 bp, Homo sapiens
atgctatggaaatacatttaga

SEQ ID NO: 5268689 - DNA, 18 bp, Homo sapiens
atgctatgttctgtcttc

SEQ ID NO: 5268690 - DNA, 13 bp, Homo sapiens
atgctattaagaa

SEQ ID NO: 5268691 - DNA, 15 bp, Homo sapiens
atgctattaagaagg

SEQ ID NO: 5268692 - DNA, 19 bp, Homo sapiens
atgctattatactgttatc

SEQ ID NO: 5268693 - DNA, 21 bp, Homo sapiens
atgctattatactgttatcca

SEQ ID NO: 5268694 - DNA, 21 bp, Homo sapiens
atgctattatcccttcttata

SEQ ID NO: 5268695 - DNA, 18 bp, Homo sapiens
atgctattgacaataaaa

SEQ ID NO: 5268696 - DNA, 23 bp, Homo sapiens
atgctattgacaataaaatatta

SEQ ID NO: 5268697 - DNA, 22 bp, Homo sapiens
atgctatttcagccaatctgga

SEQ ID NO: 5268698 - DNA, 13 bp, Homo sapiens
atgctatttctac

SEQ ID NO: 5268699 - DNA, 15 bp, Homo sapiens
atgctatttctacct

SEQ ID NO: 5268700 - DNA, 13 bp, Homo sapiens
atgctatttctat

SEQ ID NO: 5268701 - DNA, 18 bp, Homo sapiens
atgctatttctggcctca

SEQ ID NO: 5268702 - DNA, 22 bp, Homo sapiens
atgctatttttgtttttagaat

SEQ ID NO: 5268703 - DNA, 19 bp, Homo sapiens
atgctcaaagatgtaatgt

SEQ ID NO: 5268704 - DNA, 16 bp, Homo sapiens
atgctcaaccactgtg

SEQ ID NO: 5268705 - DNA, 17 bp, Homo sapiens
atgctcaacccccctcc

SEQ ID NO: 5268706 - DNA, 22 bp, Homo sapiens
atgctcaacccccctcccagac

SEQ ID NO: 5268707 - DNA, 16 bp, Homo sapiens
atgctcaagtttttca

SEQ ID NO: 5268708 - DNA, 19 bp, Homo sapiens
atgctcaatcatgtgccag

SEQ ID NO: 5268709 - DNA, 13 bp, Homo sapiens
atgctcaatgtgc

SEQ ID NO: 5268710 - DNA, 21 bp, Homo sapiens
atgctcaatgtgctgttgatt

SEQ ID NO: 5268711 - DNA, 23 bp, Homo sapiens
atgctcacctcttctttaccaga

SEQ ID NO: 5268712 - DNA, 15 bp, Homo sapiens
atgctcactgcttct

SEQ ID NO: 5268713 - DNA, 16 bp, Homo sapiens
atgctcactgcttctg

SEQ ID NO: 5268714 - DNA, 13 bp, Homo sapiens
atgctcactttat

SEQ ID NO: 5268715 - DNA, 18 bp, Homo sapiens
atgctcacttttgtgaaa

SEQ ID NO: 5268716 - DNA, 20 bp, Homo sapiens
atgctcagaagccagtctgc

SEQ ID NO: 5268717 - DNA, 21 bp, Homo sapiens
atgctcagaagccagtctgcg

SEQ ID NO: 5268718 - DNA, 12 bp, Homo sapiens
atgctcagacca

SEQ ID NO: 5268719 - DNA, 19 bp, Homo sapiens
atgctcagccttgctgctc

SEQ ID NO: 5268720 - DNA, 21 bp, Homo sapiens
atgctcaggggccctggagca

SEQ ID NO: 5268721 - DNA, 19 bp, Homo sapiens
atgctcagggtcactgaac

SEQ ID NO: 5268722 - DNA, 19 bp, Homo sapiens
atgctcaggtacagagaag

SEQ ID NO: 5268723 - DNA, 22 bp, Homo sapiens
atgctcaggtacagagaaggaa

SEQ ID NO: 5268724 - DNA, 17 bp, Homo sapiens
atgctcagtacctgtgt

SEQ ID NO: 5268725 - DNA, 13 bp, Homo sapiens
atgctcagtattg

SEQ ID NO: 5268726 - DNA, 18 bp, Homo sapiens
atgctcagtattgagaca

SEQ ID NO: 5268727 - DNA, 23 bp, Homo sapiens
atgctcagtgccttttggtttca

SEQ ID NO: 5268728 - DNA, 14 bp, Homo sapiens
atgctcagttgcta

SEQ ID NO: 5268729 - DNA, 23 bp, Homo sapiens
atgctcagtttaaggtacactgt

SEQ ID NO: 5268730 - DNA, 21 bp, Homo sapiens
atgctcataaagatgttaaat

SEQ ID NO: 5268731 - DNA, 21 bp, Homo sapiens
atgctcataacggatcagaaa

SEQ ID NO: 5268732 - DNA, 14 bp, Homo sapiens
atgctcatctgctg

SEQ ID NO: 5268733 - DNA, 12 bp, Homo sapiens
atgctcatgtat

SEQ ID NO: 5268734 - DNA, 22 bp, Homo sapiens
atgctcatgtccctgtccccag

SEQ ID NO: 5268735 - DNA, 16 bp, Homo sapiens
atgctcattttctggt

SEQ ID NO: 5268736 - DNA, 17 bp, Homo sapiens
atgctcattttctttag

SEQ ID NO: 5268737 - DNA, 21 bp, Homo sapiens
atgctccagcaacacagcctg

SEQ ID NO: 5268738 - DNA, 14 bp, Homo sapiens
attagactggacag

SEQ ID NO: 5268739 - DNA, 15 bp, Homo sapiens
attagactggacagc

SEQ ID NO: 5268740 - DNA, 22 bp, Homo sapiens
attagactgtaggaagagtagc

SEQ ID NO: 5268741 - DNA, 14 bp, Homo sapiens
attagactgtgatt

SEQ ID NO: 5268742 - DNA, 18 bp, Homo sapiens
attagactgtgattcaga

SEQ ID NO: 5268743 - DNA, 22 bp, Homo sapiens
attagacttatagtcctcctgg

SEQ ID NO: 5268744 - DNA, 15 bp, Homo sapiens
attagacttctgttt

SEQ ID NO: 5268745 - DNA, 16 bp, Homo sapiens
attagagaaaacctta

SEQ ID NO: 5268746 - DNA, 20 bp, Homo sapiens
attagagaaaaccttaaaag

SEQ ID NO: 5268747 - DNA, 15 bp, Homo sapiens
attagagaacatcct

SEQ ID NO: 5268748 - DNA, 16 bp, Homo sapiens
attagagaactggagg

SEQ ID NO: 5268749 - DNA, 13 bp, Homo sapiens
attagagaagaga

SEQ ID NO: 5268750 - DNA, 15 bp, Homo sapiens
attagagaagccttt

SEQ ID NO: 5268751 - DNA, 11 bp, Homo sapiens
attagagaagt

SEQ ID NO: 5268752 - DNA, 21 bp, Homo sapiens
attagagagcatctgcaacaa

SEQ ID NO: 5268753 - DNA, 15 bp, Homo sapiens
attagagagtgttga

SEQ ID NO: 5268754 - DNA, 12 bp, Homo sapiens
attagagatatt

SEQ ID NO: 5268755 - DNA, 22 bp, Homo sapiens
attagagattgacttcagaaac

SEQ ID NO: 5268756 - DNA, 18 bp, Homo sapiens
attagagcaagaacattc

SEQ ID NO: 5268757 - DNA, 18 bp, Homo sapiens
attagagcacagcttctt

SEQ ID NO: 5268758 - DNA, 20 bp, Homo sapiens
attagagcacagcttcttct

SEQ ID NO: 5268759 - DNA, 13 bp, Homo sapiens
attagagcctgta

SEQ ID NO: 5268760 - DNA, 22 bp, Homo sapiens
attagagctcgaaataaaggcg

SEQ ID NO: 5268761 - DNA, 21 bp, Homo sapiens
attagagggaggagaatgagc

SEQ ID NO: 5268762 - DNA, 22 bp, Homo sapiens
attagagggaggtgtttaaaga

SEQ ID NO: 5268763 - DNA, 12 bp, Homo sapiens
attagagggcct

SEQ ID NO: 5268764 - DNA, 19 bp, Homo sapiens
attagagggccttgcttct

SEQ ID NO: 5268765 - DNA, 21 bp, Homo sapiens
attagagggccttgcttctct

SEQ ID NO: 5268766 - DNA, 20 bp, Homo sapiens
attagaggtttgtcaacaca

SEQ ID NO: 5268767 - DNA, 19 bp, Homo sapiens
attagagtatttcccttcc

SEQ ID NO: 5268768 - DNA, 19 bp, Homo sapiens
attagagtgcaaaagtgag

SEQ ID NO: 5268769 - DNA, 21 bp, Homo sapiens
attagagtgcccttaaaataa

SEQ ID NO: 5268770 - DNA, 17 bp, Homo sapiens
attagagtgtctttcca

SEQ ID NO: 5268771 - DNA, 19 bp, Homo sapiens
attagagttgtgatacaga

SEQ ID NO: 5268772 - DNA, 18 bp, Homo sapiens
attagataaattactata

SEQ ID NO: 5268773 - DNA, 22 bp, Homo sapiens
attagatattaggggggaaagt

SEQ ID NO: 5268774 - DNA, 23 bp, Homo sapiens
attagatcacatcttaaattcat

SEQ ID NO: 5268775 - DNA, 18 bp, Homo sapiens
attagatccattaattta

SEQ ID NO: 5268776 - DNA, 19 bp, Homo sapiens
attagatcccatatttact

SEQ ID NO: 5268777 - DNA, 20 bp, Homo sapiens
attagatcccatatttactt

SEQ ID NO: 5268778 - DNA, 23 bp, Homo sapiens
attagatgaattatcctatttca

SEQ ID NO: 5268779 - DNA, 20 bp, Homo sapiens
attagatgctctgagaaatt

SEQ ID NO: 5268780 - DNA, 21 bp, Homo sapiens
attagatgctctgagaaattg

SEQ ID NO: 5268781 - DNA, 22 bp, Homo sapiens
attagatggcttattttttaaa

SEQ ID NO: 5268782 - DNA, 14 bp, Homo sapiens
attagatgtgattt

SEQ ID NO: 5268783 - DNA, 21 bp, Homo sapiens
attagatgtgatttaatagtg

SEQ ID NO: 5268784 - DNA, 14 bp, Homo sapiens
attagatgtgccaa

SEQ ID NO: 5268785 - DNA, 17 bp, Homo sapiens
attagatgtgccaataa

SEQ ID NO: 5268786 - DNA, 21 bp, Homo sapiens
attagatgtgccaataaccaa

SEQ ID NO: 5268787 - DNA, 21 bp, Homo sapiens
attagatgttactgtgtgaag

SEQ ID NO: 5268788 - DNA, 14 bp, Homo sapiens
attagatgttctct

SEQ ID NO: 5268789 - DNA, 16 bp, Homo sapiens
attagatgttctctat

SEQ ID NO: 5268790 - DNA, 23 bp, Homo sapiens
attagatgttctctatcatttaa

SEQ ID NO: 5268791 - DNA, 13 bp, Homo sapiens
attagattagaaa

SEQ ID NO: 5268792 - DNA, 21 bp, Homo sapiens
attagattatattgagacaaa

SEQ ID NO: 5268793 - DNA, 16 bp, Homo sapiens
attagattatttctgt

SEQ ID NO: 5268794 - DNA, 22 bp, Homo sapiens
attagattcatctatggagggc

SEQ ID NO: 5268795 - DNA, 19 bp, Homo sapiens
attagatttaaaataaaca

SEQ ID NO: 5268796 - DNA, 15 bp, Homo sapiens
attagatttctgaat

SEQ ID NO: 5268797 - DNA, 14 bp, Homo sapiens
attagatttgtgca

SEQ ID NO: 5268798 - DNA, 16 bp, Homo sapiens
attagattttcttgca

SEQ ID NO: 5268799 - DNA, 14 bp, Homo sapiens
attagcaaaaaaag

SEQ ID NO: 5268800 - DNA, 18 bp, Homo sapiens
attagcaaaaaaagttgt

SEQ ID NO: 5268801 - DNA, 17 bp, Homo sapiens
attagcaactgtgctac

SEQ ID NO: 5268802 - DNA, 16 bp, Homo sapiens
attagcaaggctgggt

SEQ ID NO: 5268803 - DNA, 18 bp, Homo sapiens
attagcaaggtcatttct

SEQ ID NO: 5268804 - DNA, 19 bp, Homo sapiens
attagcaaggtcatttctt

SEQ ID NO: 5268805 - DNA, 21 bp, Homo sapiens
attagcaaggtcatttcttca

SEQ ID NO: 5268806 - DNA, 22 bp, Homo sapiens
attagcaattgactgtcactgt

SEQ ID NO: 5268807 - DNA, 15 bp, Homo sapiens
attagcacagatttt

SEQ ID NO: 5268808 - DNA, 17 bp, Homo sapiens
attagcacagattttaa

SEQ ID NO: 5268809 - DNA, 18 bp, Homo sapiens
attagcacagattttaat

SEQ ID NO: 5268810 - DNA, 13 bp, Homo sapiens
attagcagaatgg

SEQ ID NO: 5268811 - DNA, 16 bp, Homo sapiens
attagcagaatggaga

SEQ ID NO: 5268812 - DNA, 16 bp, Homo sapiens
attagcagctatgtaa

SEQ ID NO: 5268813 - DNA, 18 bp, Homo sapiens
attagcagtccctccaca

SEQ ID NO: 5268814 - DNA, 16 bp, Homo sapiens
attagcagttgctcac

SEQ ID NO: 5268815 - DNA, 20 bp, Homo sapiens
attagcagttgctcacatgt

SEQ ID NO: 5268816 - DNA, 17 bp, Homo sapiens
attagcagtttgctttg

SEQ ID NO: 5268817 - DNA, 17 bp, Homo sapiens
attagcataaagcacta

SEQ ID NO: 5268818 - DNA, 18 bp, Homo sapiens
attagcatgagctttcca

SEQ ID NO: 5268819 - DNA, 13 bp, Homo sapiens
attagcatgcaag

SEQ ID NO: 5268820 - DNA, 23 bp, Homo sapiens
attagcatgcaagcttggtcaaa

SEQ ID NO: 5268821 - DNA, 17 bp, Homo sapiens
attagcattctggcagt

SEQ ID NO: 5268822 - DNA, 22 bp, Homo sapiens
attagcatttgttttagcatta

SEQ ID NO: 5268823 - DNA, 17 bp, Homo sapiens
attagccaaaacactta

SEQ ID NO: 5268824 - DNA, 14 bp, Homo sapiens
attagccaaagagg

SEQ ID NO: 5268825 - DNA, 17 bp, Homo sapiens
attagccacaaaattgg

SEQ ID NO: 5268826 - DNA, 15 bp, Homo sapiens
attagccaggatcat

SEQ ID NO: 5268827 - DNA, 22 bp, Homo sapiens
attagccaggatcatggtgtaa

SEQ ID NO: 5268828 - DNA, 14 bp, Homo sapiens
attagccagtaatc

SEQ ID NO: 5268829 - DNA, 16 bp, Homo sapiens
attagccagtaatcct

SEQ ID NO: 5268830 - DNA, 21 bp, Homo sapiens
attagccgggcatgatggtgc

SEQ ID NO: 5268831 - DNA, 16 bp, Homo sapiens
attagcctgagtagaa

SEQ ID NO: 5268832 - DNA, 21 bp, Homo sapiens
attagcggctcctcgccccca

SEQ ID NO: 5268833 - DNA, 18 bp, Homo sapiens
attagctaaaaatatata

SEQ ID NO: 5268834 - DNA, 22 bp, Homo sapiens
attagctacttttcagaattga

SEQ ID NO: 5268835 - DNA, 17 bp, Homo sapiens
attagctagaatgcaca

SEQ ID NO: 5268836 - DNA, 20 bp, Homo sapiens
attagctagactaggagacc

SEQ ID NO: 5268837 - DNA, 19 bp, Homo sapiens
attagctcacttggtgata

SEQ ID NO: 5268838 - DNA, 12 bp, Homo sapiens
attagctctgga

SEQ ID NO: 5268839 - DNA, 18 bp, Homo sapiens
attagctctggggggcag

SEQ ID NO: 5268840 - DNA, 12 bp, Homo sapiens
attagctgggca

SEQ ID NO: 5268841 - DNA, 13 bp, Homo sapiens
attagcttatgtt

SEQ ID NO: 5268842 - DNA, 22 bp, Homo sapiens
attagcttatgttaactgacaa

SEQ ID NO: 5268843 - DNA, 13 bp, Homo sapiens
attagcttggcat

SEQ ID NO: 5268844 - DNA, 20 bp, Homo sapiens
attagctttattatggcttg

SEQ ID NO: 5268845 - DNA, 21 bp, Homo sapiens
attagctttattatggcttgt

SEQ ID NO: 5268846 - DNA, 14 bp, Homo sapiens
attagctttctcct

SEQ ID NO: 5268847 - DNA, 14 bp, Homo sapiens
attagctttgtgtt

SEQ ID NO: 5268848 - DNA, 20 bp, Homo sapiens
attaggaaaagatattttta

SEQ ID NO: 5268849 - DNA, 13 bp, Homo sapiens
attaggaaaataa

SEQ ID NO: 5268850 - DNA, 23 bp, Homo sapiens
attaggaaggccatggggcagcc

SEQ ID NO: 5268851 - DNA, 21 bp, Homo sapiens
attaggaagtgtaacagctga

SEQ ID NO: 5268852 - DNA, 16 bp, Homo sapiens
attaggaataaataaa

SEQ ID NO: 5268853 - DNA, 11 bp, Homo sapiens
attaggaatta

SEQ ID NO: 5268854 - DNA, 23 bp, Homo sapiens
attaggacaatcagtcccctccc

SEQ ID NO: 5268855 - DNA, 21 bp, Homo sapiens
attaggactaaggaactaaaa

SEQ ID NO: 5268856 - DNA, 15 bp, Homo sapiens
attaggactgtataa

SEQ ID NO: 5268857 - DNA, 21 bp, Homo sapiens
attaggaggctcaacaataaa

SEQ ID NO: 5268858 - DNA, 15 bp, Homo sapiens
attaggagtaacttt

SEQ ID NO: 5268859 - DNA, 17 bp, Homo sapiens
attaggagtaactttca

SEQ ID NO: 5268860 - DNA, 15 bp, Homo sapiens
attaggagtgctgat

SEQ ID NO: 5268861 - DNA, 15 bp, Homo sapiens
attaggataactaaa

SEQ ID NO: 5268862 - DNA, 21 bp, Homo sapiens
attaggataactaaaattctg

SEQ ID NO: 5268863 - DNA, 23 bp, Homo sapiens
attaggatctatgcaatttttaa

SEQ ID NO: 5268864 - DNA, 21 bp, Homo sapiens
attaggatctgcaaacaatga

SEQ ID NO: 5268865 - DNA, 19 bp, Homo sapiens
attaggatttgccccttcc

SEQ ID NO: 5268866 - DNA, 11 bp, Homo sapiens
attaggcaaag

SEQ ID NO: 5268867 - DNA, 19 bp, Homo sapiens
attaggcaaagtacaaaat

SEQ ID NO: 5268868 - DNA, 14 bp, Homo sapiens
attaggcagactct

SEQ ID NO: 5268869 - DNA, 21 bp, Homo sapiens
attaggcagactctttatgct

SEQ ID NO: 5268870 - DNA, 18 bp, Homo sapiens
attaggccagcaacgctt

SEQ ID NO: 5268871 - DNA, 12 bp, Homo sapiens
attaggcctgga

SEQ ID NO: 5268872 - DNA, 13 bp, Homo sapiens
attaggcctggag

SEQ ID NO: 5268873 - DNA, 22 bp, Homo sapiens
attaggcctggagttgggctgg

SEQ ID NO: 5268874 - DNA, 21 bp, Homo sapiens
attaggctgtgtcaccattgt

SEQ ID NO: 5268875 - DNA, 12 bp, Homo sapiens
attaggctgttg

SEQ ID NO: 5268876 - DNA, 16 bp, Homo sapiens
attaggctgttttctt

SEQ ID NO: 5268877 - DNA, 23 bp, Homo sapiens
attagggaaaatggatatagaaa

SEQ ID NO: 5268878 - DNA, 20 bp, Homo sapiens
attagggagaaaattcaatt

SEQ ID NO: 5268879 - DNA, 13 bp, Homo sapiens
attagggagctct

SEQ ID NO: 5268880 - DNA, 19 bp, Homo sapiens
attagggcatttgagaaat

SEQ ID NO: 5268881 - DNA, 15 bp, Homo sapiens
attagggccctgtgt

SEQ ID NO: 5268882 - DNA, 17 bp, Homo sapiens
attagggctctaatttc

SEQ ID NO: 5268883 - DNA, 17 bp, Homo sapiens
attaggggatggggagg

SEQ ID NO: 5268884 - DNA, 17 bp, Homo sapiens
attaggggattcttctt

SEQ ID NO: 5268885 - DNA, 16 bp, Homo sapiens
attagggtagtaatta

SEQ ID NO: 5268886 - DNA, 20 bp, Homo sapiens
attaggtactatctgtgaag

SEQ ID NO: 5268887 - DNA, 18 bp, Homo sapiens
attaggtagactttgctt

SEQ ID NO: 5268888 - DNA, 16 bp, Homo sapiens
attaggtagcacagca

SEQ ID NO: 5268889 - DNA, 19 bp, Homo sapiens
attaggtccacttcaatgt

SEQ ID NO: 5268890 - DNA, 24 bp, Homo sapiens
attaggtctgcattttctcaggca

SEQ ID NO: 5268891 - DNA, 14 bp, Homo sapiens
attaggtcttgctg

SEQ ID NO: 5268892 - DNA, 15 bp, Homo sapiens
attaggtggaaattt

SEQ ID NO: 5268893 - DNA, 14 bp, Homo sapiens
attaggtgtaagac

SEQ ID NO: 5268894 - DNA, 19 bp, Homo sapiens
attaggttaactatgtaca

SEQ ID NO: 5268895 - DNA, 21 bp, Homo sapiens
attaggttatgctatttggac

SEQ ID NO: 5268896 - DNA, 21 bp, Homo sapiens
attaggttatggtttaatgtt

SEQ ID NO: 5268897 - DNA, 17 bp, Homo sapiens
attaggttgaaacatat

SEQ ID NO: 5268898 - DNA, 14 bp, Homo sapiens
attaggttgtgaat

SEQ ID NO: 5268899 - DNA, 19 bp, Homo sapiens
attaggtttcagcagagct

SEQ ID NO: 5268900 - DNA, 19 bp, Homo sapiens
attaggtttctttgaagaa

SEQ ID NO: 5268901 - DNA, 14 bp, Homo sapiens
attagtaaatatgt

SEQ ID NO: 5268902 - DNA, 16 bp, Homo sapiens
attagtaaatgcttat

SEQ ID NO: 5268903 - DNA, 12 bp, Homo sapiens
attagtaacatc

SEQ ID NO: 5268904 - DNA, 18 bp, Homo sapiens
attagtaagctagcaaat

SEQ ID NO: 5268905 - DNA, 15 bp, Homo sapiens
attagtaattgtcaa

SEQ ID NO: 5268906 - DNA, 22 bp, Homo sapiens
attagtaccatagtaccattta

SEQ ID NO: 5268907 - DNA, 19 bp, Homo sapiens
attagtactgctcttgttt

SEQ ID NO: 5268908 - DNA, 21 bp, Homo sapiens
attagtactttatagaagaat

SEQ ID NO: 5268909 - DNA, 12 bp, Homo sapiens
attagtagaaaa

SEQ ID NO: 5268910 - DNA, 14 bp, Homo sapiens
attagtagaaagtg

SEQ ID NO: 5268911 - DNA, 17 bp, Homo sapiens
attagtagttaccacag

SEQ ID NO: 5268912 - DNA, 19 bp, Homo sapiens
attagtataatatttctta

SEQ ID NO: 5268913 - DNA, 22 bp, Homo sapiens
attagtatgtctgtttttgtat

SEQ ID NO: 5268914 - DNA, 15 bp, Homo sapiens
attagtattcaggca

SEQ ID NO: 5268915 - DNA, 17 bp, Homo sapiens
attagtattcaggcact

SEQ ID NO: 5268916 - DNA, 13 bp, Homo sapiens
atgctccagcact

SEQ ID NO: 5268917 - DNA, 15 bp, Homo sapiens
atgctccagcactca

SEQ ID NO: 5268918 - DNA, 20 bp, Homo sapiens
atgctccagcactcaataaa

SEQ ID NO: 5268919 - DNA, 20 bp, Homo sapiens
atgctccagccaacccctgt

SEQ ID NO: 5268920 - DNA, 22 bp, Homo sapiens
atgctccaggatctttgactga

SEQ ID NO: 5268921 - DNA, 13 bp, Homo sapiens
atgctccagggca

SEQ ID NO: 5268922 - DNA, 13 bp, Homo sapiens
atgctccagggtc

SEQ ID NO: 5268923 - DNA, 24 bp, Homo sapiens
atgctccagtcaacaaactatttc

SEQ ID NO: 5268924 - DNA, 21 bp, Homo sapiens
atgctcccaactcccttctgc

SEQ ID NO: 5268925 - DNA, 14 bp, Homo sapiens
atgctccccacagc

SEQ ID NO: 5268926 - DNA, 15 bp, Homo sapiens
atgctcccccatcct

SEQ ID NO: 5268927 - DNA, 17 bp, Homo sapiens
atgctcccctgtgccag

SEQ ID NO: 5268928 - DNA, 19 bp, Homo sapiens
atgctccctcagcctcaga

SEQ ID NO: 5268929 - DNA, 20 bp, Homo sapiens
atgctccgaggactggactg

SEQ ID NO: 5268930 - DNA, 22 bp, Homo sapiens
atgctcctagtttgacctcaca

SEQ ID NO: 5268931 - DNA, 13 bp, Homo sapiens
atgctcctcacct

SEQ ID NO: 5268932 - DNA, 13 bp, Homo sapiens
atgctcctctgcc

SEQ ID NO: 5268933 - DNA, 15 bp, Homo sapiens
atgctcctctgcctg

SEQ ID NO: 5268934 - DNA, 19 bp, Homo sapiens
atgctcctctgcctgtgcc

SEQ ID NO: 5268935 - DNA, 21 bp, Homo sapiens
atgctcctctgcctgtgcccg

SEQ ID NO: 5268936 - DNA, 16 bp, Homo sapiens
atgctcctcttcccca

SEQ ID NO: 5268937 - DNA, 19 bp, Homo sapiens
atgctcctcttccccagac

SEQ ID NO: 5268938 - DNA, 23 bp, Homo sapiens
atgctcctcttccccagacgcct

SEQ ID NO: 5268939 - DNA, 14 bp, Homo sapiens
atgctcctggccca

SEQ ID NO: 5268940 - DNA, 18 bp, Homo sapiens
atgctccttgagaggaga

SEQ ID NO: 5268941 - DNA, 16 bp, Homo sapiens
atgctccttgggccct

SEQ ID NO: 5268942 - DNA, 13 bp, Homo sapiens
atgctcggctttt

SEQ ID NO: 5268943 - DNA, 17 bp, Homo sapiens
atgctcgtgtgatttcc

SEQ ID NO: 5268944 - DNA, 21 bp, Homo sapiens
atgctcgtgtgatttcctaca

SEQ ID NO: 5268945 - DNA, 18 bp, Homo sapiens
atgctctaactggacatg

SEQ ID NO: 5268946 - DNA, 15 bp, Homo sapiens
atgctctacttcttt

SEQ ID NO: 5268947 - DNA, 21 bp, Homo sapiens
atgctctatcttgctctgtaa

SEQ ID NO: 5268948 - DNA, 12 bp, Homo sapiens
atgctctatttt

SEQ ID NO: 5268949 - DNA, 20 bp, Homo sapiens
atgctctcaggctgagggag

SEQ ID NO: 5268950 - DNA, 17 bp, Homo sapiens
atgctctctcaaattgt

SEQ ID NO: 5268951 - DNA, 13 bp, Homo sapiens
atgctctctcacc

SEQ ID NO: 5268952 - DNA, 18 bp, Homo sapiens
atgctctctcttcttatt

SEQ ID NO: 5268953 - DNA, 19 bp, Homo sapiens
atgctctctgcagccagcc

SEQ ID NO: 5268954 - DNA, 21 bp, Homo sapiens
atgctctctgcagccagccca

SEQ ID NO: 5268955 - DNA, 21 bp, Homo sapiens
atgctctctttcttttctctg

SEQ ID NO: 5268956 - DNA, 22 bp, Homo sapiens
atgctctgaaaggatgtagaaa

SEQ ID NO: 5268957 - DNA, 18 bp, Homo sapiens
atgctctgatgcagtgcc

SEQ ID NO: 5268958 - DNA, 23 bp, Homo sapiens
atgctctgatgcagtgccctaga

SEQ ID NO: 5268959 - DNA, 12 bp, Homo sapiens
atgctctgcagc

SEQ ID NO: 5268960 - DNA, 15 bp, Homo sapiens
atgctctgcatgtta

SEQ ID NO: 5268961 - DNA, 12 bp, Homo sapiens
atgctctggaag

SEQ ID NO: 5268962 - DNA, 16 bp, Homo sapiens
atgctctggaagcctg

SEQ ID NO: 5268963 - DNA, 21 bp, Homo sapiens
atgctctggcttgccccagga

SEQ ID NO: 5268964 - DNA, 22 bp, Homo sapiens
atgctctggcttgccccaggac

SEQ ID NO: 5268965 - DNA, 13 bp, Homo sapiens
atgctctgtgcca

SEQ ID NO: 5268966 - DNA, 14 bp, Homo sapiens
atgctctgtgccag

SEQ ID NO: 5268967 - DNA, 18 bp, Homo sapiens
atgctcttaaaatatctt

SEQ ID NO: 5268968 - DNA, 16 bp, Homo sapiens
atgctcttaaaggcag

SEQ ID NO: 5268969 - DNA, 16 bp, Homo sapiens
atgctcttaattgcca

SEQ ID NO: 5268970 - DNA, 19 bp, Homo sapiens
atgctcttaattgccacct

SEQ ID NO: 5268971 - DNA, 18 bp, Homo sapiens
atgctcttatttcatcat

SEQ ID NO: 5268972 - DNA, 19 bp, Homo sapiens
atgctcttatttcatcatt

SEQ ID NO: 5268973 - DNA, 21 bp, Homo sapiens
atgctcttgaaatattcagaa

SEQ ID NO: 5268974 - DNA, 15 bp, Homo sapiens
atgctctttaaataa

SEQ ID NO: 5268975 - DNA, 16 bp, Homo sapiens
atgctctttaaataat

SEQ ID NO: 5268976 - DNA, 20 bp, Homo sapiens
atgctctttaaataataaag

SEQ ID NO: 5268977 - DNA, 17 bp, Homo sapiens
atgctctttcaccctgc

SEQ ID NO: 5268978 - DNA, 12 bp, Homo sapiens
atgctctttccc

SEQ ID NO: 5268979 - DNA, 13 bp, Homo sapiens
atgctctttccca

SEQ ID NO: 5268980 - DNA, 22 bp, Homo sapiens
atgctctttcccacccagcctg

SEQ ID NO: 5268981 - DNA, 14 bp, Homo sapiens
atgctctttcccag

SEQ ID NO: 5268982 - DNA, 20 bp, Homo sapiens
atgctctttcccttttctgt

SEQ ID NO: 5268983 - DNA, 16 bp, Homo sapiens
atgctcttttgcacaa

SEQ ID NO: 5268984 - DNA, 17 bp, Homo sapiens
atgctcttttgcacaag

SEQ ID NO: 5268985 - DNA, 16 bp, Homo sapiens
atgctcttttgtttgg

SEQ ID NO: 5268986 - DNA, 20 bp, Homo sapiens
atgctcttttttactcattg

SEQ ID NO: 5268987 - DNA, 22 bp, Homo sapiens
atgctcttttttactcattgaa

SEQ ID NO: 5268988 - DNA, 24 bp, Homo sapiens
atgctcttttttactcattgaaat

SEQ ID NO: 5268989 - DNA, 15 bp, Homo sapiens
atgctctttttttaa

SEQ ID NO: 5268990 - DNA, 12 bp, Homo sapiens
atgctgaaaatg

SEQ ID NO: 5268991 - DNA, 22 bp, Homo sapiens
atgctgaaaattgcctttctgt

SEQ ID NO: 5268992 - DNA, 16 bp, Homo sapiens
atgctgaaacaggaga

SEQ ID NO: 5268993 - DNA, 18 bp, Homo sapiens
atgctgaaacaggagaga

SEQ ID NO: 5268994 - DNA, 14 bp, Homo sapiens
atgctgaaaccaag

SEQ ID NO: 5268995 - DNA, 15 bp, Homo sapiens
atgctgaagacattc

SEQ ID NO: 5268996 - DNA, 19 bp, Homo sapiens
atgctgaagccaaagccaa

SEQ ID NO: 5268997 - DNA, 17 bp, Homo sapiens
atgctgaagtacagtcc

SEQ ID NO: 5268998 - DNA, 21 bp, Homo sapiens
atgctgaagtacagtcccagc

SEQ ID NO: 5268999 - DNA, 15 bp, Homo sapiens
atgctgaatccacct

SEQ ID NO: 5269000 - DNA, 17 bp, Homo sapiens
atgctgaatccacctcg

SEQ ID NO: 5269001 - DNA, 21 bp, Homo sapiens
atgctgaatccacctcggagc

SEQ ID NO: 5269002 - DNA, 14 bp, Homo sapiens
atgctgaatgaatc

SEQ ID NO: 5269003 - DNA, 15 bp, Homo sapiens
atgctgaattatttt

SEQ ID NO: 5269004 - DNA, 16 bp, Homo sapiens
atgctgaattgaacat

SEQ ID NO: 5269005 - DNA, 17 bp, Homo sapiens
atgctgacaaaaatatt

SEQ ID NO: 5269006 - DNA, 13 bp, Homo sapiens
atgctgacagctc

SEQ ID NO: 5269007 - DNA, 14 bp, Homo sapiens
atgctgacccagga

SEQ ID NO: 5269008 - DNA, 16 bp, Homo sapiens
atgctgacccatgggc

SEQ ID NO: 5269009 - DNA, 17 bp, Homo sapiens
atgctgacccatgggca

SEQ ID NO: 5269010 - DNA, 22 bp, Homo sapiens
atgctgacctcacctggtcctc

SEQ ID NO: 5269011 - DNA, 22 bp, Homo sapiens
atgctgaccttcacccagagct

SEQ ID NO: 5269012 - DNA, 17 bp, Homo sapiens
atgctgacttcacttat

SEQ ID NO: 5269013 - DNA, 22 bp, Homo sapiens
atgctgagccagccatctttgg

SEQ ID NO: 5269014 - DNA, 14 bp, Homo sapiens
atgctgagctgaag

SEQ ID NO: 5269015 - DNA, 16 bp, Homo sapiens
atgctgagctgaagaa

SEQ ID NO: 5269016 - DNA, 17 bp, Homo sapiens
atgctgagctgaagaaa

SEQ ID NO: 5269017 - DNA, 14 bp, Homo sapiens
atgctgagctgtga

SEQ ID NO: 5269018 - DNA, 15 bp, Homo sapiens
atgctgagctgtgat

SEQ ID NO: 5269019 - DNA, 18 bp, Homo sapiens
atgctgaggccacccact

SEQ ID NO: 5269020 - DNA, 19 bp, Homo sapiens
atgctgaggccacccactg

SEQ ID NO: 5269021 - DNA, 20 bp, Homo sapiens
atgctgagggtgtttcttcc

SEQ ID NO: 5269022 - DNA, 23 bp, Homo sapiens
atgctgaggttttgaataaaaag

SEQ ID NO: 5269023 - DNA, 22 bp, Homo sapiens
atgctgagtatgttaagctctt

SEQ ID NO: 5269024 - DNA, 14 bp, Homo sapiens
atgctgagtctccc

SEQ ID NO: 5269025 - DNA, 16 bp, Homo sapiens
atgctgatatttactg

SEQ ID NO: 5269026 - DNA, 12 bp, Homo sapiens
atgctgatcatc

SEQ ID NO: 5269027 - DNA, 17 bp, Homo sapiens
atgctgatcttttaaaa

SEQ ID NO: 5269028 - DNA, 18 bp, Homo sapiens
atgctgatcttttaaaat

SEQ ID NO: 5269029 - DNA, 17 bp, Homo sapiens
atgctgatgaatcactg

SEQ ID NO: 5269030 - DNA, 15 bp, Homo sapiens
atgctgatgatcaaa

SEQ ID NO: 5269031 - DNA, 13 bp, Homo sapiens
atgctgatggagc

SEQ ID NO: 5269032 - DNA, 12 bp, Homo sapiens
atgctgatgttc

SEQ ID NO: 5269033 - DNA, 17 bp, Homo sapiens
atgctgatgttcagtgt

SEQ ID NO: 5269034 - DNA, 15 bp, Homo sapiens
atgctgcaacaaaat

SEQ ID NO: 5269035 - DNA, 20 bp, Homo sapiens
atgctgcaacaaaatgtaga

SEQ ID NO: 5269036 - DNA, 21 bp, Homo sapiens
atgctgcacaccagttactgt

SEQ ID NO: 5269037 - DNA, 20 bp, Homo sapiens
atgctgcagatttgggctgg

SEQ ID NO: 5269038 - DNA, 14 bp, Homo sapiens
atgctgcagcagag

SEQ ID NO: 5269039 - DNA, 15 bp, Homo sapiens
atgctgcaggatgga

SEQ ID NO: 5269040 - DNA, 12 bp, Homo sapiens
atgctgcagtgg

SEQ ID NO: 5269041 - DNA, 18 bp, Homo sapiens
atgctgccaatatcctaa

SEQ ID NO: 5269042 - DNA, 19 bp, Homo sapiens
atgctgccaatatcctaat

SEQ ID NO: 5269043 - DNA, 23 bp, Homo sapiens
atgctgccaatatcctaataaaa

SEQ ID NO: 5269044 - DNA, 15 bp, Homo sapiens
atgctgccatgccca

SEQ ID NO: 5269045 - DNA, 19 bp, Homo sapiens
atgctgccatgcccaccat

SEQ ID NO: 5269046 - DNA, 14 bp, Homo sapiens
atgctgcccacccc

SEQ ID NO: 5269047 - DNA, 21 bp, Homo sapiens
atgctgcccagggtcagtgta

SEQ ID NO: 5269048 - DNA, 21 bp, Homo sapiens
atgctgccccgttccctgtca

SEQ ID NO: 5269049 - DNA, 11 bp, Homo sapiens
atgctgccctg

SEQ ID NO: 5269050 - DNA, 15 bp, Homo sapiens
atgctgccctgtgag

SEQ ID NO: 5269051 - DNA, 13 bp, Homo sapiens
atgctgcctgagt

SEQ ID NO: 5269052 - DNA, 15 bp, Homo sapiens
atgctgcctgccatg

SEQ ID NO: 5269053 - DNA, 16 bp, Homo sapiens
atgctgcctgccatgt

SEQ ID NO: 5269054 - DNA, 17 bp, Homo sapiens
atgctgcctgccatgtg

SEQ ID NO: 5269055 - DNA, 15 bp, Homo sapiens
atgctgcctgcctcc

SEQ ID NO: 5269056 - DNA, 23 bp, Homo sapiens
atgctgcctgcctccggccctgc

SEQ ID NO: 5269057 - DNA, 15 bp, Homo sapiens
atgctgcctgcctgt

SEQ ID NO: 5269058 - DNA, 18 bp, Homo sapiens
atgctgcctgcctgtctg

SEQ ID NO: 5269059 - DNA, 23 bp, Homo sapiens
atgctgcctggcacagaccaggc

SEQ ID NO: 5269060 - DNA, 21 bp, Homo sapiens
atgctgcctgtatttgagaga

SEQ ID NO: 5269061 - DNA, 23 bp, Homo sapiens
atgctgcctgtatttgagagact

SEQ ID NO: 5269062 - DNA, 22 bp, Homo sapiens
atgctgccttcagggagacagg

SEQ ID NO: 5269063 - DNA, 18 bp, Homo sapiens
atgctgcgcccttcccca

SEQ ID NO: 5269064 - DNA, 19 bp, Homo sapiens
atgctgcgcccttccccag

SEQ ID NO: 5269065 - DNA, 13 bp, Homo sapiens
atgctgctactta

SEQ ID NO: 5269066 - DNA, 21 bp, Homo sapiens
atgctgctacttaattccttt

SEQ ID NO: 5269067 - DNA, 15 bp, Homo sapiens
atgctgctagatctt

SEQ ID NO: 5269068 - DNA, 20 bp, Homo sapiens
atgctgctatatccactgtc

SEQ ID NO: 5269069 - DNA, 14 bp, Homo sapiens
atgctgctcatcca

SEQ ID NO: 5269070 - DNA, 18 bp, Homo sapiens
atgctgctcccctaaagc

SEQ ID NO: 5269071 - DNA, 21 bp, Homo sapiens
atgctgctcccctaaagccag

SEQ ID NO: 5269072 - DNA, 15 bp, Homo sapiens
atgctgctgcccctg

SEQ ID NO: 5269073 - DNA, 21 bp, Homo sapiens
atgctgctgcccctgcacagc

SEQ ID NO: 5269074 - DNA, 13 bp, Homo sapiens
atgctgctggcca

SEQ ID NO: 5269075 - DNA, 16 bp, Homo sapiens
atgctgctggggaaga

SEQ ID NO: 5269076 - DNA, 19 bp, Homo sapiens
atgctgctggggaagacag

SEQ ID NO: 5269077 - DNA, 21 bp, Homo sapiens
atgctgctggggaagacagtg

SEQ ID NO: 5269078 - DNA, 11 bp, Homo sapiens
atgctgctgtg

SEQ ID NO: 5269079 - DNA, 12 bp, Homo sapiens
atgctgctgtga

SEQ ID NO: 5269080 - DNA, 22 bp, Homo sapiens
atgctgctgttgaagctttgaa

SEQ ID NO: 5269081 - DNA, 17 bp, Homo sapiens
atgctgcttctcctccc

SEQ ID NO: 5269082 - DNA, 15 bp, Homo sapiens
atgctgctttaacag

SEQ ID NO: 5269083 - DNA, 23 bp, Homo sapiens
atgctgctttaacagtggagctg

SEQ ID NO: 5269084 - DNA, 20 bp, Homo sapiens
atgctgctttcccctgtggg

SEQ ID NO: 5269085 - DNA, 14 bp, Homo sapiens
atgctgctttctgc

SEQ ID NO: 5269086 - DNA, 12 bp, Homo sapiens
atgctgctttgc

SEQ ID NO: 5269087 - DNA, 15 bp, Homo sapiens
atgctgctttgcaca

SEQ ID NO: 5269088 - DNA, 12 bp, Homo sapiens
atgctgctttgg

SEQ ID NO: 5269089 - DNA, 16 bp, Homo sapiens
atgctgcttttatatc

SEQ ID NO: 5269090 - DNA, 13 bp, Homo sapiens
atgctgcttttgg

SEQ ID NO: 5269091 - DNA, 13 bp, Homo sapiens
atgctggaaataa

SEQ ID NO: 5269092 - DNA, 21 bp, Homo sapiens
atgctggaaataaaacagctg

SEQ ID NO: 5269093 - DNA, 18 bp, Homo sapiens
atgctggaacctgcaaaa

SEQ ID NO: 5269094 - DNA, 22 bp, Homo sapiens
atgctggacggcattcctgctt

SEQ ID NO: 5269095 - DNA, 20 bp, Homo sapiens
attagtattcaggcactgag

SEQ ID NO: 5269096 - DNA, 14 bp, Homo sapiens
attagtattgttgt

SEQ ID NO: 5269097 - DNA, 18 bp, Homo sapiens
attagtatttatttaatg

SEQ ID NO: 5269098 - DNA, 20 bp, Homo sapiens
attagtcactgctgctactg

SEQ ID NO: 5269099 - DNA, 13 bp, Homo sapiens
attagtcatagaa

SEQ ID NO: 5269100 - DNA, 23 bp, Homo sapiens
attagtccaaatgtgatcaactg

SEQ ID NO: 5269101 - DNA, 19 bp, Homo sapiens
attagtcctcacagcctag

SEQ ID NO: 5269102 - DNA, 18 bp, Homo sapiens
attagtcgggcatgagtc

SEQ ID NO: 5269103 - DNA, 22 bp, Homo sapiens
attagtcgttatatttgacttg

SEQ ID NO: 5269104 - DNA, 21 bp, Homo sapiens
attagtctatcaaatgaaact

SEQ ID NO: 5269105 - DNA, 20 bp, Homo sapiens
attagtctattattttagag

SEQ ID NO: 5269106 - DNA, 13 bp, Homo sapiens
attagtctgaaac

SEQ ID NO: 5269107 - DNA, 15 bp, Homo sapiens
attagtctgaaactg

SEQ ID NO: 5269108 - DNA, 19 bp, Homo sapiens
attagtctttttctttttt

SEQ ID NO: 5269109 - DNA, 22 bp, Homo sapiens
attagtgaaccaaaaatagaaa

SEQ ID NO: 5269110 - DNA, 17 bp, Homo sapiens
attagtgaactaagtta

SEQ ID NO: 5269111 - DNA, 15 bp, Homo sapiens
attagtgagatttgt

SEQ ID NO: 5269112 - DNA, 15 bp, Homo sapiens
attagtgatatagtg

SEQ ID NO: 5269113 - DNA, 23 bp, Homo sapiens
attagtgatgtccttaaaatgtg

SEQ ID NO: 5269114 - DNA, 22 bp, Homo sapiens
attagtgattccatcaaagaga

SEQ ID NO: 5269115 - DNA, 16 bp, Homo sapiens
attagtgattctgatt

SEQ ID NO: 5269116 - DNA, 17 bp, Homo sapiens
attagtgattctgattt

SEQ ID NO: 5269117 - DNA, 18 bp, Homo sapiens
attagtgccacttaatgt

SEQ ID NO: 5269118 - DNA, 21 bp, Homo sapiens
attagtgccacttaatgtatg

SEQ ID NO: 5269119 - DNA, 19 bp, Homo sapiens
attagtgccagaattttag

SEQ ID NO: 5269120 - DNA, 13 bp, Homo sapiens
attagtgctaagt

SEQ ID NO: 5269121 - DNA, 18 bp, Homo sapiens
attagtgctaagtgtgaa

SEQ ID NO: 5269122 - DNA, 20 bp, Homo sapiens
attagtgctaagtgtgaact

SEQ ID NO: 5269123 - DNA, 17 bp, Homo sapiens
attagtgtagtgttaaa

SEQ ID NO: 5269124 - DNA, 19 bp, Homo sapiens
attagtgtccccccttgaa

SEQ ID NO: 5269125 - DNA, 22 bp, Homo sapiens
attagtgtgttgtctctttcct

SEQ ID NO: 5269126 - DNA, 21 bp, Homo sapiens
attagtgttatatgaacatac

SEQ ID NO: 5269127 - DNA, 20 bp, Homo sapiens
attagtgttttcattctggt

SEQ ID NO: 5269128 - DNA, 22 bp, Homo sapiens
attagttacttgctataaatag

SEQ ID NO: 5269129 - DNA, 14 bp, Homo sapiens
attagttatgtctt

SEQ ID NO: 5269130 - DNA, 19 bp, Homo sapiens
attagttccccaaatacaa

SEQ ID NO: 5269131 - DNA, 20 bp, Homo sapiens
attagttccccaaatacaaa

SEQ ID NO: 5269132 - DNA, 22 bp, Homo sapiens
attagttgaaaggcctcaagaa

SEQ ID NO: 5269133 - DNA, 17 bp, Homo sapiens
attagttgccaatatgc

SEQ ID NO: 5269134 - DNA, 16 bp, Homo sapiens
attagttgcctgactt

SEQ ID NO: 5269135 - DNA, 20 bp, Homo sapiens
attagttggagctagaaaat

SEQ ID NO: 5269136 - DNA, 18 bp, Homo sapiens
attagttggcagagaaaa

SEQ ID NO: 5269137 - DNA, 20 bp, Homo sapiens
attagttggcagagaaaatg

SEQ ID NO: 5269138 - DNA, 17 bp, Homo sapiens
attagttggtttgtgtg

SEQ ID NO: 5269139 - DNA, 13 bp, Homo sapiens
attagtttaaaat

SEQ ID NO: 5269140 - DNA, 15 bp, Homo sapiens
attagtttaaaatgc

SEQ ID NO: 5269141 - DNA, 17 bp, Homo sapiens
attagtttcctttttaa

SEQ ID NO: 5269142 - DNA, 14 bp, Homo sapiens
attagtttgacact

SEQ ID NO: 5269143 - DNA, 15 bp, Homo sapiens
attagtttgacactg

SEQ ID NO: 5269144 - DNA, 16 bp, Homo sapiens
attagtttgacactgc

SEQ ID NO: 5269145 - DNA, 17 bp, Homo sapiens
attagtttgacactgct

SEQ ID NO: 5269146 - DNA, 22 bp, Homo sapiens
attagtttgatttaatatctga

SEQ ID NO: 5269147 - DNA, 15 bp, Homo sapiens
attagtttgcacttc

SEQ ID NO: 5269148 - DNA, 17 bp, Homo sapiens
attagttttaaaatact

SEQ ID NO: 5269149 - DNA, 20 bp, Homo sapiens
attagttttaaaatactata

SEQ ID NO: 5269150 - DNA, 19 bp, Homo sapiens
attagttttaatctcttaa

SEQ ID NO: 5269151 - DNA, 20 bp, Homo sapiens
attagttttagaggcattgt

SEQ ID NO: 5269152 - DNA, 14 bp, Homo sapiens
attagttttctgta

SEQ ID NO: 5269153 - DNA, 15 bp, Homo sapiens
attagttttctttgt

SEQ ID NO: 5269154 - DNA, 20 bp, Homo sapiens
attagttttctttgtaaagg

SEQ ID NO: 5269155 - DNA, 18 bp, Homo sapiens
attagttttgcataattt

SEQ ID NO: 5269156 - DNA, 19 bp, Homo sapiens
attataaaaaatgtaacat

SEQ ID NO: 5269157 - DNA, 19 bp, Homo sapiens
attataaaaaattaactta

SEQ ID NO: 5269158 - DNA, 22 bp, Homo sapiens
attataaaaaattaacttagtt

SEQ ID NO: 5269159 - DNA, 16 bp, Homo sapiens
attataaaaacactta

SEQ ID NO: 5269160 - DNA, 13 bp, Homo sapiens
attataaaaatat

SEQ ID NO: 5269161 - DNA, 15 bp, Homo sapiens
attataaaaatatca

SEQ ID NO: 5269162 - DNA, 15 bp, Homo sapiens
attataaaaattaca

SEQ ID NO: 5269163 - DNA, 20 bp, Homo sapiens
attataaaagctcagatgac

SEQ ID NO: 5269164 - DNA, 13 bp, Homo sapiens
attataaaatgct

SEQ ID NO: 5269165 - DNA, 14 bp, Homo sapiens
attataaaatgctc

SEQ ID NO: 5269166 - DNA, 15 bp, Homo sapiens
attataaaattattt

SEQ ID NO: 5269167 - DNA, 16 bp, Homo sapiens
attataaaattatttt

SEQ ID NO: 5269168 - DNA, 12 bp, Homo sapiens
attataaaattg

SEQ ID NO: 5269169 - DNA, 13 bp, Homo sapiens
attataaaatttt

SEQ ID NO: 5269170 - DNA, 22 bp, Homo sapiens
attataaacaagaatgaaggtt

SEQ ID NO: 5269171 - DNA, 17 bp, Homo sapiens
attataaacagaaaatc

SEQ ID NO: 5269172 - DNA, 13 bp, Homo sapiens
attataaacgctt

SEQ ID NO: 5269173 - DNA, 14 bp, Homo sapiens
attataaactataa

SEQ ID NO: 5269174 - DNA, 20 bp, Homo sapiens
attataaactataaacttaa

SEQ ID NO: 5269175 - DNA, 21 bp, Homo sapiens
attataaactataaacttaag

SEQ ID NO: 5269176 - DNA, 17 bp, Homo sapiens
attataaactcattttg

SEQ ID NO: 5269177 - DNA, 13 bp, Homo sapiens
attataaagtttt

SEQ ID NO: 5269178 - DNA, 16 bp, Homo sapiens
attataaataaatgcc

SEQ ID NO: 5269179 - DNA, 18 bp, Homo sapiens
attataaataaatgccaa

SEQ ID NO: 5269180 - DNA, 17 bp, Homo sapiens
attataaatatatataa

SEQ ID NO: 5269181 - DNA, 17 bp, Homo sapiens
attataaatatcattgt

SEQ ID NO: 5269182 - DNA, 14 bp, Homo sapiens
attataaatgaaat

SEQ ID NO: 5269183 - DNA, 15 bp, Homo sapiens
attataaatgtgttt

SEQ ID NO: 5269184 - DNA, 19 bp, Homo sapiens
attataaatgttagttcta

SEQ ID NO: 5269185 - DNA, 20 bp, Homo sapiens
attataaatgttagttctag

SEQ ID NO: 5269186 - DNA, 15 bp, Homo sapiens
attataaatgtttca

SEQ ID NO: 5269187 - DNA, 14 bp, Homo sapiens
attataaatgtttg

SEQ ID NO: 5269188 - DNA, 18 bp, Homo sapiens
attataaatgtttggaaa

SEQ ID NO: 5269189 - DNA, 20 bp, Homo sapiens
attataacaactatttactt

SEQ ID NO: 5269190 - DNA, 17 bp, Homo sapiens
attataacagcaaggaa

SEQ ID NO: 5269191 - DNA, 15 bp, Homo sapiens
attataacagttata

SEQ ID NO: 5269192 - DNA, 14 bp, Homo sapiens
attataacataaaa

SEQ ID NO: 5269193 - DNA, 17 bp, Homo sapiens
attataactattacagt

SEQ ID NO: 5269194 - DNA, 16 bp, Homo sapiens
attataactcatttgt

SEQ ID NO: 5269195 - DNA, 15 bp, Homo sapiens
attataacttaaaaa

SEQ ID NO: 5269196 - DNA, 13 bp, Homo sapiens
attataacttatt

SEQ ID NO: 5269197 - DNA, 17 bp, Homo sapiens
attataacttattagca

SEQ ID NO: 5269198 - DNA, 14 bp, Homo sapiens
attataagaagagg

SEQ ID NO: 5269199 - DNA, 13 bp, Homo sapiens
attataagacaat

SEQ ID NO: 5269200 - DNA, 20 bp, Homo sapiens
attataagagagcttattgt

SEQ ID NO: 5269201 - DNA, 20 bp, Homo sapiens
attataagaggctgataatt

SEQ ID NO: 5269202 - DNA, 22 bp, Homo sapiens
attataagccctgcataatgtt

SEQ ID NO: 5269203 - DNA, 19 bp, Homo sapiens
attataagctatgtcacta

SEQ ID NO: 5269204 - DNA, 12 bp, Homo sapiens
attataaggact

SEQ ID NO: 5269205 - DNA, 14 bp, Homo sapiens
attataaggactgc

SEQ ID NO: 5269206 - DNA, 15 bp, Homo sapiens
attataaggactgca

SEQ ID NO: 5269207 - DNA, 17 bp, Homo sapiens
attataaggactgcatg

SEQ ID NO: 5269208 - DNA, 22 bp, Homo sapiens
attataagggagagctgagcca

SEQ ID NO: 5269209 - DNA, 16 bp, Homo sapiens
attataagggccctgc

SEQ ID NO: 5269210 - DNA, 15 bp, Homo sapiens
attataagtcacaaa

SEQ ID NO: 5269211 - DNA, 20 bp, Homo sapiens
attataagttctattttact

SEQ ID NO: 5269212 - DNA, 16 bp, Homo sapiens
attataataaaatttc

SEQ ID NO: 5269213 - DNA, 19 bp, Homo sapiens
attataataaatatataca

SEQ ID NO: 5269214 - DNA, 15 bp, Homo sapiens
attataataagcaaa

SEQ ID NO: 5269215 - DNA, 16 bp, Homo sapiens
attataataatgttct

SEQ ID NO: 5269216 - DNA, 19 bp, Homo sapiens
attataatactaaaactca

SEQ ID NO: 5269217 - DNA, 21 bp, Homo sapiens
attataataggaacaatcttt

SEQ ID NO: 5269218 - DNA, 21 bp, Homo sapiens
attataatatgtgccttaagt

SEQ ID NO: 5269219 - DNA, 22 bp, Homo sapiens
attataatatgtgccttaagtt

SEQ ID NO: 5269220 - DNA, 18 bp, Homo sapiens
attataatcaccagggcc

SEQ ID NO: 5269221 - DNA, 18 bp, Homo sapiens
attataatctcaaaggag

SEQ ID NO: 5269222 - DNA, 19 bp, Homo sapiens
attataatctcatttcaat

SEQ ID NO: 5269223 - DNA, 16 bp, Homo sapiens
attataatctccaact

SEQ ID NO: 5269224 - DNA, 13 bp, Homo sapiens
attataatgaatt

SEQ ID NO: 5269225 - DNA, 14 bp, Homo sapiens
attataatgaattt

SEQ ID NO: 5269226 - DNA, 15 bp, Homo sapiens
attataatgcatcta

SEQ ID NO: 5269227 - DNA, 20 bp, Homo sapiens
attataatgccagaatataa

SEQ ID NO: 5269228 - DNA, 23 bp, Homo sapiens
attataatgccagaatataatgt

SEQ ID NO: 5269229 - DNA, 21 bp, Homo sapiens
attataatgtattcatatttg

SEQ ID NO: 5269230 - DNA, 12 bp, Homo sapiens
attataattcag

SEQ ID NO: 5269231 - DNA, 16 bp, Homo sapiens
attataattggaagtg

SEQ ID NO: 5269232 - DNA, 15 bp, Homo sapiens
attataattgtatca

SEQ ID NO: 5269233 - DNA, 13 bp, Homo sapiens
attataattgtca

SEQ ID NO: 5269234 - DNA, 20 bp, Homo sapiens
attataattgtcatgacttt

SEQ ID NO: 5269235 - DNA, 12 bp, Homo sapiens
attataattgtt

SEQ ID NO: 5269236 - DNA, 15 bp, Homo sapiens
attataatttaatgc

SEQ ID NO: 5269237 - DNA, 14 bp, Homo sapiens
attataatttgggt

SEQ ID NO: 5269238 - DNA, 17 bp, Homo sapiens
attatacaaaagagcat

SEQ ID NO: 5269239 - DNA, 18 bp, Homo sapiens
attatacaaaagagcatg

SEQ ID NO: 5269240 - DNA, 22 bp, Homo sapiens
attatacaaaagagcatggatg

SEQ ID NO: 5269241 - DNA, 19 bp, Homo sapiens
attatacaaattaaaaaga

SEQ ID NO: 5269242 - DNA, 14 bp, Homo sapiens
attatacaatgata

SEQ ID NO: 5269243 - DNA, 22 bp, Homo sapiens
attatacagacctaatatcatt

SEQ ID NO: 5269244 - DNA, 23 bp, Homo sapiens
attatacagacctaatatcattt

SEQ ID NO: 5269245 - DNA, 15 bp, Homo sapiens
attatacagtaagtt

SEQ ID NO: 5269246 - DNA, 20 bp, Homo sapiens
attatacatgtgatacattt

SEQ ID NO: 5269247 - DNA, 16 bp, Homo sapiens
attataccaaaatgtt

SEQ ID NO: 5269248 - DNA, 15 bp, Homo sapiens
attataccaagagta

SEQ ID NO: 5269249 - DNA, 16 bp, Homo sapiens
attataccagcaaaga

SEQ ID NO: 5269250 - DNA, 20 bp, Homo sapiens
attataccatgtgtgctaat

SEQ ID NO: 5269251 - DNA, 22 bp, Homo sapiens
attataccccatgatacctatt

SEQ ID NO: 5269252 - DNA, 21 bp, Homo sapiens
attataccgcagagtatttga

SEQ ID NO: 5269253 - DNA, 14 bp, Homo sapiens
attatacgctggca

SEQ ID NO: 5269254 - DNA, 15 bp, Homo sapiens
attatactaagaaaa

SEQ ID NO: 5269255 - DNA, 19 bp, Homo sapiens
attatactaagaaaagata

SEQ ID NO: 5269256 - DNA, 20 bp, Homo sapiens
attatactctctgaaatata

SEQ ID NO: 5269257 - DNA, 15 bp, Homo sapiens
attatactgaagcta

SEQ ID NO: 5269258 - DNA, 15 bp, Homo sapiens
attatactgtagatt

SEQ ID NO: 5269259 - DNA, 19 bp, Homo sapiens
attatactgtagatttcag

SEQ ID NO: 5269260 - DNA, 23 bp, Homo sapiens
attatactgtagctgatgaaact

SEQ ID NO: 5269261 - DNA, 17 bp, Homo sapiens
attatactgttatccat

SEQ ID NO: 5269262 - DNA, 14 bp, Homo sapiens
attatacttacttc

SEQ ID NO: 5269263 - DNA, 15 bp, Homo sapiens
attatacttctttat

SEQ ID NO: 5269264 - DNA, 18 bp, Homo sapiens
attatacttctttattca

SEQ ID NO: 5269265 - DNA, 17 bp, Homo sapiens
attatacttgtaattat

SEQ ID NO: 5269266 - DNA, 20 bp, Homo sapiens
attatacttgtaattatgga

SEQ ID NO: 5269267 - DNA, 12 bp, Homo sapiens
attatactttat

SEQ ID NO: 5269268 - DNA, 18 bp, Homo sapiens
attatactttatatctgt

SEQ ID NO: 5269269 - DNA, 14 bp, Homo sapiens
attatagaaattct

SEQ ID NO: 5269270 - DNA, 16 bp, Homo sapiens
attatagaaattctga

SEQ ID NO: 5269271 - DNA, 17 bp, Homo sapiens
attatagaaattctgaa

SEQ ID NO: 5269272 - DNA, 19 bp, Homo sapiens
attatagaaggctgtctta

SEQ ID NO: 5269273 - DNA, 16 bp, Homo sapiens
attatagacaaaagaa

SEQ ID NO: 5269274 - DNA, 20 bp, Homo sapiens
atgctggactggaggcccct

SEQ ID NO: 5269275 - DNA, 23 bp, Homo sapiens
atgctggagaaaaatatctgtaa

SEQ ID NO: 5269276 - DNA, 17 bp, Homo sapiens
atgctggagaagagagg

SEQ ID NO: 5269277 - DNA, 23 bp, Homo sapiens
atgctggagaagagaggagagga

SEQ ID NO: 5269278 - DNA, 13 bp, Homo sapiens
atgctggagaggt

SEQ ID NO: 5269279 - DNA, 14 bp, Homo sapiens
atgctggagaggtt

SEQ ID NO: 5269280 - DNA, 15 bp, Homo sapiens
atgctggagaggtta

SEQ ID NO: 5269281 - DNA, 14 bp, Homo sapiens
atgctggaggcaga

SEQ ID NO: 5269282 - DNA, 19 bp, Homo sapiens
atgctggagtacccagcct

SEQ ID NO: 5269283 - DNA, 22 bp, Homo sapiens
atgctggatgagcaactcctgt

SEQ ID NO: 5269284 - DNA, 17 bp, Homo sapiens
atgctggatgtctgcca

SEQ ID NO: 5269285 - DNA, 13 bp, Homo sapiens
atgctggcaaagg

SEQ ID NO: 5269286 - DNA, 17 bp, Homo sapiens
atgctggcaaatccagg

SEQ ID NO: 5269287 - DNA, 23 bp, Homo sapiens
atgctggcatttgcacctacctc

SEQ ID NO: 5269288 - DNA, 12 bp, Homo sapiens
atgctggccagc

SEQ ID NO: 5269289 - DNA, 14 bp, Homo sapiens
atgctggccagcac

SEQ ID NO: 5269290 - DNA, 17 bp, Homo sapiens
atgctggccagcaccct

SEQ ID NO: 5269291 - DNA, 18 bp, Homo sapiens
atgctggccagcaccctc

SEQ ID NO: 5269292 - DNA, 21 bp, Homo sapiens
atgctggccagcaccctctcc

SEQ ID NO: 5269293 - DNA, 15 bp, Homo sapiens
atgctggccagcctg

SEQ ID NO: 5269294 - DNA, 22 bp, Homo sapiens
atgctggccagcctggggcctg

SEQ ID NO: 5269295 - DNA, 13 bp, Homo sapiens
atgctggcccagg

SEQ ID NO: 5269296 - DNA, 16 bp, Homo sapiens
atgctggcccagggcc

SEQ ID NO: 5269297 - DNA, 21 bp, Homo sapiens
atgctggcccagggcccagag

SEQ ID NO: 5269298 - DNA, 12 bp, Homo sapiens
atgctggcccca

SEQ ID NO: 5269299 - DNA, 20 bp, Homo sapiens
atgctggccgaagatttcat

SEQ ID NO: 5269300 - DNA, 22 bp, Homo sapiens
atgctggcctcccaataaagct

SEQ ID NO: 5269301 - DNA, 23 bp, Homo sapiens
atgctggcctcccaataaagctg

SEQ ID NO: 5269302 - DNA, 22 bp, Homo sapiens
atgctggcctcttggcacctgc

SEQ ID NO: 5269303 - DNA, 22 bp, Homo sapiens
atgctggcctgtggcaggccta

SEQ ID NO: 5269304 - DNA, 19 bp, Homo sapiens
atgctggctgaagaggacc

SEQ ID NO: 5269305 - DNA, 23 bp, Homo sapiens
atgctggctggccttgtggtcca

SEQ ID NO: 5269306 - DNA, 18 bp, Homo sapiens
atgctggctgttggctgg

SEQ ID NO: 5269307 - DNA, 16 bp, Homo sapiens
atgctgggactcagcc

SEQ ID NO: 5269308 - DNA, 13 bp, Homo sapiens
atgctgggcccct

SEQ ID NO: 5269309 - DNA, 12 bp, Homo sapiens
atgctgggccct

SEQ ID NO: 5269310 - DNA, 15 bp, Homo sapiens
atgctgggccctctt

SEQ ID NO: 5269311 - DNA, 11 bp, Homo sapiens
atgctgggctc

SEQ ID NO: 5269312 - DNA, 13 bp, Homo sapiens
atgctgggctcac

SEQ ID NO: 5269313 - DNA, 15 bp, Homo sapiens
atgctgggctcccgt

SEQ ID NO: 5269314 - DNA, 19 bp, Homo sapiens
atgctgggctctgttcttg

SEQ ID NO: 5269315 - DNA, 21 bp, Homo sapiens
atgctgggctggctccctctt

SEQ ID NO: 5269316 - DNA, 13 bp, Homo sapiens
atgctgggctggg

SEQ ID NO: 5269317 - DNA, 17 bp, Homo sapiens
atgctgggctgggccct

SEQ ID NO: 5269318 - DNA, 22 bp, Homo sapiens
atgctggggcaagtccctgact

SEQ ID NO: 5269319 - DNA, 16 bp, Homo sapiens
atgctggggtacacag

SEQ ID NO: 5269320 - DNA, 19 bp, Homo sapiens
atgctggggtcatataaaa

SEQ ID NO: 5269321 - DNA, 22 bp, Homo sapiens
atgctgggtatgctctgtgaca

SEQ ID NO: 5269322 - DNA, 21 bp, Homo sapiens
atgctgggtccatatcacaca

SEQ ID NO: 5269323 - DNA, 14 bp, Homo sapiens
atgctgggtctgag

SEQ ID NO: 5269324 - DNA, 19 bp, Homo sapiens
atgctgggtctgaggcccc

SEQ ID NO: 5269325 - DNA, 14 bp, Homo sapiens
atgctgggttctgg

SEQ ID NO: 5269326 - DNA, 17 bp, Homo sapiens
atgctggtagatgctga

SEQ ID NO: 5269327 - DNA, 23 bp, Homo sapiens
atgctggtcaagccccctttgat

SEQ ID NO: 5269328 - DNA, 19 bp, Homo sapiens
atgctggtcatcctgggca

SEQ ID NO: 5269329 - DNA, 20 bp, Homo sapiens
atgctggtcatcctgggcat

SEQ ID NO: 5269330 - DNA, 23 bp, Homo sapiens
atgctggtgaaatgctgttggta

SEQ ID NO: 5269331 - DNA, 14 bp, Homo sapiens
atgctggtggctgg

SEQ ID NO: 5269332 - DNA, 16 bp, Homo sapiens
atgctggtggctggtg

SEQ ID NO: 5269333 - DNA, 18 bp, Homo sapiens
atgctggtggctggtgag

SEQ ID NO: 5269334 - DNA, 14 bp, Homo sapiens
atgctgtaaatatt

SEQ ID NO: 5269335 - DNA, 19 bp, Homo sapiens
atgctgtaaatatttcata

SEQ ID NO: 5269336 - DNA, 20 bp, Homo sapiens
atgctgtaacttaaaatagg

SEQ ID NO: 5269337 - DNA, 15 bp, Homo sapiens
atgctgtacatactt

SEQ ID NO: 5269338 - DNA, 12 bp, Homo sapiens
atgctgtacatc

SEQ ID NO: 5269339 - DNA, 16 bp, Homo sapiens
atgctgtacatctatt

SEQ ID NO: 5269340 - DNA, 13 bp, Homo sapiens
atgctgtacccag

SEQ ID NO: 5269341 - DNA, 20 bp, Homo sapiens
atgctgtagacatctgtcct

SEQ ID NO: 5269342 - DNA, 19 bp, Homo sapiens
atgctgtatgtcattaaag

SEQ ID NO: 5269343 - DNA, 14 bp, Homo sapiens
atgctgtattttaa

SEQ ID NO: 5269344 - DNA, 22 bp, Homo sapiens
atgctgtcactggcagagcaca

SEQ ID NO: 5269345 - DNA, 15 bp, Homo sapiens
atgctgtccctgtgg

SEQ ID NO: 5269346 - DNA, 23 bp, Homo sapiens
atgctgtcccttacgtgagtcct

SEQ ID NO: 5269347 - DNA, 17 bp, Homo sapiens
atgctgtccgtgcttgc

SEQ ID NO: 5269348 - DNA, 22 bp, Homo sapiens
atgctgtctacactaagagaga

SEQ ID NO: 5269349 - DNA, 22 bp, Homo sapiens
atgctgtctccataatgccact

SEQ ID NO: 5269350 - DNA, 16 bp, Homo sapiens
atgctgtctggcacag

SEQ ID NO: 5269351 - DNA, 16 bp, Homo sapiens
atgctgtctggccctg

SEQ ID NO: 5269352 - DNA, 17 bp, Homo sapiens
atgctgtctggccctgg

SEQ ID NO: 5269353 - DNA, 13 bp, Homo sapiens
atgctgtctttgt

SEQ ID NO: 5269354 - DNA, 11 bp, Homo sapiens
atgctgtgaca

SEQ ID NO: 5269355 - DNA, 12 bp, Homo sapiens
atgctgtgcaaa

SEQ ID NO: 5269356 - DNA, 17 bp, Homo sapiens
atgctgtgcaaacagtg

SEQ ID NO: 5269357 - DNA, 19 bp, Homo sapiens
atgctgtgccctaaagtgt

SEQ ID NO: 5269358 - DNA, 14 bp, Homo sapiens
atgctgtgcctggc

SEQ ID NO: 5269359 - DNA, 18 bp, Homo sapiens
atgctgtgcgcccagggc

SEQ ID NO: 5269360 - DNA, 15 bp, Homo sapiens
atgctgtgctacgtg

SEQ ID NO: 5269361 - DNA, 21 bp, Homo sapiens
atgctgtgctacgtgtgaaat

SEQ ID NO: 5269362 - DNA, 18 bp, Homo sapiens
atgctgtgctctttgaag

SEQ ID NO: 5269363 - DNA, 15 bp, Homo sapiens
atgctgtgtgcccaa

SEQ ID NO: 5269364 - DNA, 19 bp, Homo sapiens
atgctgttatgtccagaaa

SEQ ID NO: 5269365 - DNA, 23 bp, Homo sapiens
atgctgttcatgaaagattcaat

SEQ ID NO: 5269366 - DNA, 19 bp, Homo sapiens
atgctgttctcaatcattg

SEQ ID NO: 5269367 - DNA, 22 bp, Homo sapiens
atgctgttctcaatcattgtca

SEQ ID NO: 5269368 - DNA, 21 bp, Homo sapiens
atgctgttgattgctaaatgt

SEQ ID NO: 5269369 - DNA, 23 bp, Homo sapiens
atgctgttgattgctaaatgtaa

SEQ ID NO: 5269370 - DNA, 21 bp, Homo sapiens
atgctgttgcatttagaactt

SEQ ID NO: 5269371 - DNA, 15 bp, Homo sapiens
atgctgttgcctcat

SEQ ID NO: 5269372 - DNA, 13 bp, Homo sapiens
atgctgttgctgc

SEQ ID NO: 5269373 - DNA, 15 bp, Homo sapiens
atgctgttggcctca

SEQ ID NO: 5269374 - DNA, 22 bp, Homo sapiens
atgctgttggcctcaagcaagg

SEQ ID NO: 5269375 - DNA, 22 bp, Homo sapiens
atgctgttgtaaacaacgtgta

SEQ ID NO: 5269376 - DNA, 16 bp, Homo sapiens
atgctgttgtgaagct

SEQ ID NO: 5269377 - DNA, 13 bp, Homo sapiens
atgctgtttctaa

SEQ ID NO: 5269378 - DNA, 15 bp, Homo sapiens
atgctgtttctaaga

SEQ ID NO: 5269379 - DNA, 21 bp, Homo sapiens
atgcttaaaaaaaaaaaattt

SEQ ID NO: 5269380 - DNA, 17 bp, Homo sapiens
atgcttaaaataagcag

SEQ ID NO: 5269381 - DNA, 16 bp, Homo sapiens
atgcttaaaatatgta

SEQ ID NO: 5269382 - DNA, 15 bp, Homo sapiens
atgcttaaactaaat

SEQ ID NO: 5269383 - DNA, 17 bp, Homo sapiens
atgcttaaactaaataa

SEQ ID NO: 5269384 - DNA, 21 bp, Homo sapiens
atgcttaaagaattcaaattt

SEQ ID NO: 5269385 - DNA, 16 bp, Homo sapiens
atgcttaaagcaaggc

SEQ ID NO: 5269386 - DNA, 16 bp, Homo sapiens
atgcttaaatttcaga

SEQ ID NO: 5269387 - DNA, 12 bp, Homo sapiens
atgcttaagatt

SEQ ID NO: 5269388 - DNA, 23 bp, Homo sapiens
atgcttaagcatccgtgtatttg

SEQ ID NO: 5269389 - DNA, 15 bp, Homo sapiens
atgcttaataaaaga

SEQ ID NO: 5269390 - DNA, 14 bp, Homo sapiens
atgcttaataaaca

SEQ ID NO: 5269391 - DNA, 13 bp, Homo sapiens
atgcttaatttct

SEQ ID NO: 5269392 - DNA, 15 bp, Homo sapiens
atgcttaatttctaa

SEQ ID NO: 5269393 - DNA, 18 bp, Homo sapiens
atgcttacatctggaatc

SEQ ID NO: 5269394 - DNA, 15 bp, Homo sapiens
atgcttagagcatgt

SEQ ID NO: 5269395 - DNA, 22 bp, Homo sapiens
atgcttagaggggtgaaaatta

SEQ ID NO: 5269396 - DNA, 16 bp, Homo sapiens
atgcttagcttatctt

SEQ ID NO: 5269397 - DNA, 21 bp, Homo sapiens
atgcttagcttatctttcttt

SEQ ID NO: 5269398 - DNA, 16 bp, Homo sapiens
atgcttaggtgaaggc

SEQ ID NO: 5269399 - DNA, 17 bp, Homo sapiens
atgcttaggtgaaggca

SEQ ID NO: 5269400 - DNA, 14 bp, Homo sapiens
atgcttataacatt

SEQ ID NO: 5269401 - DNA, 16 bp, Homo sapiens
atgcttataagcaaca

SEQ ID NO: 5269402 - DNA, 17 bp, Homo sapiens
atgcttatgcttgtgta

SEQ ID NO: 5269403 - DNA, 18 bp, Homo sapiens
atgcttatgcttgtgtat

SEQ ID NO: 5269404 - DNA, 21 bp, Homo sapiens
atgcttattgatgaggtttat

SEQ ID NO: 5269405 - DNA, 21 bp, Homo sapiens
atgcttattttaaaattttat

SEQ ID NO: 5269406 - DNA, 13 bp, Homo sapiens
atgcttcaagttt

SEQ ID NO: 5269407 - DNA, 18 bp, Homo sapiens
atgcttcacatagcatgt

SEQ ID NO: 5269408 - DNA, 18 bp, Homo sapiens
atgcttcagttgtacttc

SEQ ID NO: 5269409 - DNA, 11 bp, Homo sapiens
atgcttcatac

SEQ ID NO: 5269410 - DNA, 12 bp, Homo sapiens
atgcttcataca

SEQ ID NO: 5269411 - DNA, 22 bp, Homo sapiens
atgcttcatgaaaatcctacca

SEQ ID NO: 5269412 - DNA, 13 bp, Homo sapiens
atgcttcattatt

SEQ ID NO: 5269413 - DNA, 14 bp, Homo sapiens
atgcttcattgaaa

SEQ ID NO: 5269414 - DNA, 18 bp, Homo sapiens
atgcttccaatcttgctt

SEQ ID NO: 5269415 - DNA, 23 bp, Homo sapiens
atgcttccactaccaaaagacat

SEQ ID NO: 5269416 - DNA, 24 bp, Homo sapiens
atgcttccactaccaaaagacatt

SEQ ID NO: 5269417 - DNA, 12 bp, Homo sapiens
atgcttccagaa

SEQ ID NO: 5269418 - DNA, 13 bp, Homo sapiens
atgcttccagaaa

SEQ ID NO: 5269419 - DNA, 14 bp, Homo sapiens
atgcttccagaaac

SEQ ID NO: 5269420 - DNA, 22 bp, Homo sapiens
atgcttccagaaacacccacag

SEQ ID NO: 5269421 - DNA, 22 bp, Homo sapiens
atgcttccatatttttaaattt

SEQ ID NO: 5269422 - DNA, 12 bp, Homo sapiens
atgcttcccaga

SEQ ID NO: 5269423 - DNA, 13 bp, Homo sapiens
atgcttcccagag

SEQ ID NO: 5269424 - DNA, 20 bp, Homo sapiens
atgcttcccagagggagcag

SEQ ID NO: 5269425 - DNA, 16 bp, Homo sapiens
atgcttccctttcctg

SEQ ID NO: 5269426 - DNA, 15 bp, Homo sapiens
atgcttcctgacaat

SEQ ID NO: 5269427 - DNA, 16 bp, Homo sapiens
atgcttcctgacaatc

SEQ ID NO: 5269428 - DNA, 20 bp, Homo sapiens
atgcttcctgacaatcaact

SEQ ID NO: 5269429 - DNA, 14 bp, Homo sapiens
atgcttcctttctc

SEQ ID NO: 5269430 - DNA, 15 bp, Homo sapiens
atgcttcctttctct

SEQ ID NO: 5269431 - DNA, 17 bp, Homo sapiens
atgcttcctttctctcc

SEQ ID NO: 5269432 - DNA, 20 bp, Homo sapiens
atgcttctaagtaaatacaa

SEQ ID NO: 5269433 - DNA, 23 bp, Homo sapiens
atgcttctaagtaaatacaattt

SEQ ID NO: 5269434 - DNA, 16 bp, Homo sapiens
atgcttctcatcttgt

SEQ ID NO: 5269435 - DNA, 22 bp, Homo sapiens
atgcttctcatcttgtgaaatg

SEQ ID NO: 5269436 - DNA, 14 bp, Homo sapiens
atgcttctctcctt

SEQ ID NO: 5269437 - DNA, 17 bp, Homo sapiens
atgcttctctccttgcc

SEQ ID NO: 5269438 - DNA, 14 bp, Homo sapiens
atgcttctctttag

SEQ ID NO: 5269439 - DNA, 17 bp, Homo sapiens
atgcttctgacttcata

SEQ ID NO: 5269440 - DNA, 13 bp, Homo sapiens
atgcttctgattt

SEQ ID NO: 5269441 - DNA, 14 bp, Homo sapiens
atgcttctgcatca

SEQ ID NO: 5269442 - DNA, 21 bp, Homo sapiens
atgcttctgcctattgctgat

SEQ ID NO: 5269443 - DNA, 13 bp, Homo sapiens
atgcttctgctca

SEQ ID NO: 5269444 - DNA, 13 bp, Homo sapiens
atgcttctgtagc

SEQ ID NO: 5269445 - DNA, 15 bp, Homo sapiens
atgcttcttctcagg

SEQ ID NO: 5269446 - DNA, 12 bp, Homo sapiens
atgcttcttgcc

SEQ ID NO: 5269447 - DNA, 14 bp, Homo sapiens
atgcttctttaaaa

SEQ ID NO: 5269448 - DNA, 20 bp, Homo sapiens
atgcttcttttagtcagaaa

SEQ ID NO: 5269449 - DNA, 22 bp, Homo sapiens
atgcttcttttagtcagaaatg

SEQ ID NO: 5269450 - DNA, 17 bp, Homo sapiens
atgcttgaatggagctg

SEQ ID NO: 5269451 - DNA, 17 bp, Homo sapiens
atgcttgatataataat

SEQ ID NO: 5269452 - DNA, 13 bp, Homo sapiens
atgcttgatgtta

SEQ ID NO: 5269453 - DNA, 22 bp, Homo sapiens
atgcttgattgttttggtctca

SEQ ID NO: 5269454 - DNA, 21 bp, Homo sapiens
attatagacaaaagaataaga

SEQ ID NO: 5269455 - DNA, 18 bp, Homo sapiens
attatagatatataaata

SEQ ID NO: 5269456 - DNA, 21 bp, Homo sapiens
attatagatgggaatgaagct

SEQ ID NO: 5269457 - DNA, 13 bp, Homo sapiens
attatagattcta

SEQ ID NO: 5269458 - DNA, 17 bp, Homo sapiens
attatagattctaaaga

SEQ ID NO: 5269459 - DNA, 16 bp, Homo sapiens
attatagcaaccattt

SEQ ID NO: 5269460 - DNA, 19 bp, Homo sapiens
attatagcaactaatgttt

SEQ ID NO: 5269461 - DNA, 17 bp, Homo sapiens
attatagcaatgtgatt

SEQ ID NO: 5269462 - DNA, 20 bp, Homo sapiens
attatagcaatgtgattttg

SEQ ID NO: 5269463 - DNA, 21 bp, Homo sapiens
attatagcgcctgtataagta

SEQ ID NO: 5269464 - DNA, 20 bp, Homo sapiens
attatagctcctattaaatt

SEQ ID NO: 5269465 - DNA, 15 bp, Homo sapiens
attatagctctaatg

SEQ ID NO: 5269466 - DNA, 16 bp, Homo sapiens
attatagctctaatgt

SEQ ID NO: 5269467 - DNA, 17 bp, Homo sapiens
attatagctctaatgtt

SEQ ID NO: 5269468 - DNA, 18 bp, Homo sapiens
attatagctctaatgttt

SEQ ID NO: 5269469 - DNA, 17 bp, Homo sapiens
attataggatcatttgt

SEQ ID NO: 5269470 - DNA, 19 bp, Homo sapiens
attataggtaatcaatgaa

SEQ ID NO: 5269471 - DNA, 16 bp, Homo sapiens
attatagtactgcttt

SEQ ID NO: 5269472 - DNA, 20 bp, Homo sapiens
attatagtatgatttttaca

SEQ ID NO: 5269473 - DNA, 22 bp, Homo sapiens
attatagtcaatataccatgac

SEQ ID NO: 5269474 - DNA, 15 bp, Homo sapiens
attatagtgtagaaa

SEQ ID NO: 5269475 - DNA, 16 bp, Homo sapiens
attatagtttctgagg

SEQ ID NO: 5269476 - DNA, 14 bp, Homo sapiens
attatataaatata

SEQ ID NO: 5269477 - DNA, 16 bp, Homo sapiens
attatataaatatata

SEQ ID NO: 5269478 - DNA, 20 bp, Homo sapiens
attatataacccactgctga

SEQ ID NO: 5269479 - DNA, 17 bp, Homo sapiens
attatataactgtattt

SEQ ID NO: 5269480 - DNA, 20 bp, Homo sapiens
attatataagtattctaaat

SEQ ID NO: 5269481 - DNA, 12 bp, Homo sapiens
attatatagcaa

SEQ ID NO: 5269482 - DNA, 17 bp, Homo sapiens
attatatagcaaagata

SEQ ID NO: 5269483 - DNA, 18 bp, Homo sapiens
attatatagcaaagatat

SEQ ID NO: 5269484 - DNA, 20 bp, Homo sapiens
attatatagcaaagatatat

SEQ ID NO: 5269485 - DNA, 23 bp, Homo sapiens
attatatagcaaagatatatatt

SEQ ID NO: 5269486 - DNA, 23 bp, Homo sapiens
attatataggttgtgcaaattaa

SEQ ID NO: 5269487 - DNA, 22 bp, Homo sapiens
attatatagtataccatacatt

SEQ ID NO: 5269488 - DNA, 14 bp, Homo sapiens
attatatatacatt

SEQ ID NO: 5269489 - DNA, 13 bp, Homo sapiens
attatatatagaa

SEQ ID NO: 5269490 - DNA, 18 bp, Homo sapiens
attatatatcataaagta

SEQ ID NO: 5269491 - DNA, 23 bp, Homo sapiens
attatatattgcaaggtgtgatg

SEQ ID NO: 5269492 - DNA, 12 bp, Homo sapiens
attatatattta

SEQ ID NO: 5269493 - DNA, 16 bp, Homo sapiens
attatatatttacaga

SEQ ID NO: 5269494 - DNA, 15 bp, Homo sapiens
attatatatttatag

SEQ ID NO: 5269495 - DNA, 20 bp, Homo sapiens
attatatatttttctgagat

SEQ ID NO: 5269496 - DNA, 19 bp, Homo sapiens
attatatcattttgtggat

SEQ ID NO: 5269497 - DNA, 15 bp, Homo sapiens
attatatctaattta

SEQ ID NO: 5269498 - DNA, 19 bp, Homo sapiens
attatatgaagcagaatga

SEQ ID NO: 5269499 - DNA, 13 bp, Homo sapiens
attatatgaagtt

SEQ ID NO: 5269500 - DNA, 13 bp, Homo sapiens
attatatgatatg

SEQ ID NO: 5269501 - DNA, 18 bp, Homo sapiens
attatatgatatgcatgt

SEQ ID NO: 5269502 - DNA, 17 bp, Homo sapiens
attatatggaaatatat

SEQ ID NO: 5269503 - DNA, 18 bp, Homo sapiens
attatatggcaggagcta

SEQ ID NO: 5269504 - DNA, 18 bp, Homo sapiens
attatatgttcagattat

SEQ ID NO: 5269505 - DNA, 14 bp, Homo sapiens
attatattaaaata

SEQ ID NO: 5269506 - DNA, 15 bp, Homo sapiens
attatattaaacata

SEQ ID NO: 5269507 - DNA, 13 bp, Homo sapiens
attatattataat

SEQ ID NO: 5269508 - DNA, 15 bp, Homo sapiens
attatattcaatgca

SEQ ID NO: 5269509 - DNA, 16 bp, Homo sapiens
attatattcaatgcat

SEQ ID NO: 5269510 - DNA, 19 bp, Homo sapiens
attatattcacagactgat

SEQ ID NO: 5269511 - DNA, 20 bp, Homo sapiens
attatattcctcttgcattt

SEQ ID NO: 5269512 - DNA, 13 bp, Homo sapiens
attatattctgtt

SEQ ID NO: 5269513 - DNA, 14 bp, Homo sapiens
attatattctgttt

SEQ ID NO: 5269514 - DNA, 16 bp, Homo sapiens
attatattctgtttat

SEQ ID NO: 5269515 - DNA, 20 bp, Homo sapiens
attatattggtccagaagtt

SEQ ID NO: 5269516 - DNA, 22 bp, Homo sapiens
attatattggtgcgtttttaca

SEQ ID NO: 5269517 - DNA, 18 bp, Homo sapiens
attatattgttaatcaat

SEQ ID NO: 5269518 - DNA, 20 bp, Homo sapiens
attatatttgaattgacagg

SEQ ID NO: 5269519 - DNA, 17 bp, Homo sapiens
attatatttgagtttct

SEQ ID NO: 5269520 - DNA, 15 bp, Homo sapiens
attatatttgcatta

SEQ ID NO: 5269521 - DNA, 16 bp, Homo sapiens
attatatttggatgca

SEQ ID NO: 5269522 - DNA, 21 bp, Homo sapiens
attatattttgagtagaactc

SEQ ID NO: 5269523 - DNA, 21 bp, Homo sapiens
attatattttgttgctttctt

SEQ ID NO: 5269524 - DNA, 16 bp, Homo sapiens
attatcaaaaaacaga

SEQ ID NO: 5269525 - DNA, 13 bp, Homo sapiens
attatcaaagcat

SEQ ID NO: 5269526 - DNA, 13 bp, Homo sapiens
attatcaagctaa

SEQ ID NO: 5269527 - DNA, 14 bp, Homo sapiens
attatcaagctaat

SEQ ID NO: 5269528 - DNA, 15 bp, Homo sapiens
attatcaagctaata

SEQ ID NO: 5269529 - DNA, 16 bp, Homo sapiens
attatcaagctaataa

SEQ ID NO: 5269530 - DNA, 23 bp, Homo sapiens
attatcaagctaataaaatatca

SEQ ID NO: 5269531 - DNA, 23 bp, Homo sapiens
attatcacattaatctcaaagag

SEQ ID NO: 5269532 - DNA, 15 bp, Homo sapiens
attatcactgaaaaa

SEQ ID NO: 5269533 - DNA, 15 bp, Homo sapiens
attatcagcaaagaa

SEQ ID NO: 5269534 - DNA, 20 bp, Homo sapiens
attatcaggcaaatttgcat

SEQ ID NO: 5269535 - DNA, 22 bp, Homo sapiens
attatcagttaaaatcacattt

SEQ ID NO: 5269536 - DNA, 13 bp, Homo sapiens
attatcatatatg

SEQ ID NO: 5269537 - DNA, 16 bp, Homo sapiens
attatcatgggaaaag

SEQ ID NO: 5269538 - DNA, 20 bp, Homo sapiens
attatcatggtatttgacca

SEQ ID NO: 5269539 - DNA, 16 bp, Homo sapiens
attatcatgtctattt

SEQ ID NO: 5269540 - DNA, 12 bp, Homo sapiens
attatcattgct

SEQ ID NO: 5269541 - DNA, 13 bp, Homo sapiens
attatcattgttt

SEQ ID NO: 5269542 - DNA, 16 bp, Homo sapiens
attatcattgtttgtc

SEQ ID NO: 5269543 - DNA, 22 bp, Homo sapiens
attatcatttatttttaaaata

SEQ ID NO: 5269544 - DNA, 23 bp, Homo sapiens
attatcattttagaagactctac

SEQ ID NO: 5269545 - DNA, 17 bp, Homo sapiens
attatccatattgagtc

SEQ ID NO: 5269546 - DNA, 19 bp, Homo sapiens
attatccattacgtgcatt

SEQ ID NO: 5269547 - DNA, 21 bp, Homo sapiens
attatccctgctggctttctt

SEQ ID NO: 5269548 - DNA, 17 bp, Homo sapiens
attatcccttcttatac

SEQ ID NO: 5269549 - DNA, 21 bp, Homo sapiens
attatcctagattatatcaaa

SEQ ID NO: 5269550 - DNA, 20 bp, Homo sapiens
attatcctcctgttctgaaa

SEQ ID NO: 5269551 - DNA, 14 bp, Homo sapiens
attatcctctttgt

SEQ ID NO: 5269552 - DNA, 15 bp, Homo sapiens
attatcctctttgta

SEQ ID NO: 5269553 - DNA, 15 bp, Homo sapiens
attatcctgtgtgat

SEQ ID NO: 5269554 - DNA, 17 bp, Homo sapiens
attatcctgtgtgatta

SEQ ID NO: 5269555 - DNA, 14 bp, Homo sapiens
attatcctgtgtgt

SEQ ID NO: 5269556 - DNA, 17 bp, Homo sapiens
attatcctgttactgaa

SEQ ID NO: 5269557 - DNA, 22 bp, Homo sapiens
attatccttcacaatttcaatg

SEQ ID NO: 5269558 - DNA, 16 bp, Homo sapiens
attatccttgctatga

SEQ ID NO: 5269559 - DNA, 14 bp, Homo sapiens
attatcctttattt

SEQ ID NO: 5269560 - DNA, 20 bp, Homo sapiens
attatcctttattttattga

SEQ ID NO: 5269561 - DNA, 19 bp, Homo sapiens
attatccttttatctcaca

SEQ ID NO: 5269562 - DNA, 23 bp, Homo sapiens
attatcgctttatgtttttggtt

SEQ ID NO: 5269563 - DNA, 17 bp, Homo sapiens
attatcggaagcagtgc

SEQ ID NO: 5269564 - DNA, 21 bp, Homo sapiens
attatcggaagcagtgccttc

SEQ ID NO: 5269565 - DNA, 18 bp, Homo sapiens
attatcgggaacagtgtt

SEQ ID NO: 5269566 - DNA, 19 bp, Homo sapiens
attatcgggaacagtgttt

SEQ ID NO: 5269567 - DNA, 16 bp, Homo sapiens
attatcgggagcagtg

SEQ ID NO: 5269568 - DNA, 17 bp, Homo sapiens
attatcgggagcagtgt

SEQ ID NO: 5269569 - DNA, 21 bp, Homo sapiens
attatcgggagcagtgtcttc

SEQ ID NO: 5269570 - DNA, 13 bp, Homo sapiens
attatctaattta

SEQ ID NO: 5269571 - DNA, 23 bp, Homo sapiens
attatctacctgttctgtagctt

SEQ ID NO: 5269572 - DNA, 22 bp, Homo sapiens
attatctatacatatctttatt

SEQ ID NO: 5269573 - DNA, 22 bp, Homo sapiens
attatctatagctaagtacaca

SEQ ID NO: 5269574 - DNA, 15 bp, Homo sapiens
attatctatgcagca

SEQ ID NO: 5269575 - DNA, 17 bp, Homo sapiens
attatctatgcagcatg

SEQ ID NO: 5269576 - DNA, 21 bp, Homo sapiens
attatctatggaaatgtgaga

SEQ ID NO: 5269577 - DNA, 13 bp, Homo sapiens
attatctcaagta

SEQ ID NO: 5269578 - DNA, 18 bp, Homo sapiens
attatctcaagtaaaaca

SEQ ID NO: 5269579 - DNA, 19 bp, Homo sapiens
attatctcaagtaaaacaa

SEQ ID NO: 5269580 - DNA, 20 bp, Homo sapiens
attatctcaagtaaaacaaa

SEQ ID NO: 5269581 - DNA, 23 bp, Homo sapiens
attatctcaagtaaaacaaatga

SEQ ID NO: 5269582 - DNA, 17 bp, Homo sapiens
attatctcactttgtaa

SEQ ID NO: 5269583 - DNA, 12 bp, Homo sapiens
attatctccctt

SEQ ID NO: 5269584 - DNA, 13 bp, Homo sapiens
attatctctttct

SEQ ID NO: 5269585 - DNA, 19 bp, Homo sapiens
attatctctttgatctact

SEQ ID NO: 5269586 - DNA, 20 bp, Homo sapiens
attatctctttgatctactt

SEQ ID NO: 5269587 - DNA, 13 bp, Homo sapiens
attatctgaatat

SEQ ID NO: 5269588 - DNA, 18 bp, Homo sapiens
attatctgaatattagat

SEQ ID NO: 5269589 - DNA, 12 bp, Homo sapiens
attatctgctgt

SEQ ID NO: 5269590 - DNA, 13 bp, Homo sapiens
attatctgggttt

SEQ ID NO: 5269591 - DNA, 17 bp, Homo sapiens
attatctgtaaaaattg

SEQ ID NO: 5269592 - DNA, 13 bp, Homo sapiens
attatctgttcta

SEQ ID NO: 5269593 - DNA, 19 bp, Homo sapiens
attatcttaaacccacata

SEQ ID NO: 5269594 - DNA, 15 bp, Homo sapiens
attatcttatgaaaa

SEQ ID NO: 5269595 - DNA, 16 bp, Homo sapiens
attatcttcagcccag

SEQ ID NO: 5269596 - DNA, 16 bp, Homo sapiens
attatcttgatacatt

SEQ ID NO: 5269597 - DNA, 20 bp, Homo sapiens
attatcttgatacattcaaa

SEQ ID NO: 5269598 - DNA, 22 bp, Homo sapiens
attatcttgggatagttcccaa

SEQ ID NO: 5269599 - DNA, 18 bp, Homo sapiens
attatcttgttcaggaaa

SEQ ID NO: 5269600 - DNA, 19 bp, Homo sapiens
attatctttagttgaattc

SEQ ID NO: 5269601 - DNA, 18 bp, Homo sapiens
attatctttgtaattatt

SEQ ID NO: 5269602 - DNA, 15 bp, Homo sapiens
attatcttttcaaag

SEQ ID NO: 5269603 - DNA, 23 bp, Homo sapiens
attatcttttcatacattttcta

SEQ ID NO: 5269604 - DNA, 16 bp, Homo sapiens
attatgaaaaaatgtt

SEQ ID NO: 5269605 - DNA, 18 bp, Homo sapiens
attatgaaaaaatgttca

SEQ ID NO: 5269606 - DNA, 19 bp, Homo sapiens
attatgaaaaaatgttcaa

SEQ ID NO: 5269607 - DNA, 22 bp, Homo sapiens
attatgaaaaaatgttcaaatt

SEQ ID NO: 5269608 - DNA, 14 bp, Homo sapiens
attatgaaaaacat

SEQ ID NO: 5269609 - DNA, 17 bp, Homo sapiens
attatgaaaattaagat

SEQ ID NO: 5269610 - DNA, 21 bp, Homo sapiens
attatgaaaattaagattatt

SEQ ID NO: 5269611 - DNA, 20 bp, Homo sapiens
attatgaaagcaacaaagaa

SEQ ID NO: 5269612 - DNA, 22 bp, Homo sapiens
attatgaaagcaacaaagaaat

SEQ ID NO: 5269613 - DNA, 23 bp, Homo sapiens
attatgaaagcaacaaagaaatc

SEQ ID NO: 5269614 - DNA, 12 bp, Homo sapiens
attatgaaatgc

SEQ ID NO: 5269615 - DNA, 14 bp, Homo sapiens
attatgaaatttca

SEQ ID NO: 5269616 - DNA, 23 bp, Homo sapiens
attatgaagaatacccaggaaga

SEQ ID NO: 5269617 - DNA, 13 bp, Homo sapiens
attatgaagaatt

SEQ ID NO: 5269618 - DNA, 22 bp, Homo sapiens
attatgaagatgtttttagagg

SEQ ID NO: 5269619 - DNA, 17 bp, Homo sapiens
attatgaaggaatttga

SEQ ID NO: 5269620 - DNA, 22 bp, Homo sapiens
attatgaaggaatttgattgct

SEQ ID NO: 5269621 - DNA, 18 bp, Homo sapiens
attatgaaggacctgaaa

SEQ ID NO: 5269622 - DNA, 13 bp, Homo sapiens
attatgaataaaa

SEQ ID NO: 5269623 - DNA, 20 bp, Homo sapiens
attatgaatgtgaagccttc

SEQ ID NO: 5269624 - DNA, 14 bp, Homo sapiens
attatgaattacat

SEQ ID NO: 5269625 - DNA, 18 bp, Homo sapiens
attatgaattacatttgt

SEQ ID NO: 5269626 - DNA, 21 bp, Homo sapiens
attatgacaaatgaaagagaa

SEQ ID NO: 5269627 - DNA, 14 bp, Homo sapiens
attatgacagttat

SEQ ID NO: 5269628 - DNA, 15 bp, Homo sapiens
attatgacagttata

SEQ ID NO: 5269629 - DNA, 17 bp, Homo sapiens
attatgacagttatact

SEQ ID NO: 5269630 - DNA, 19 bp, Homo sapiens
attatgacagttatactgt

SEQ ID NO: 5269631 - DNA, 15 bp, Homo sapiens
attatgactaaagta

SEQ ID NO: 5269632 - DNA, 12 bp, Homo sapiens
atgcttgattta

SEQ ID NO: 5269633 - DNA, 16 bp, Homo sapiens
atgcttgcatggagaa

SEQ ID NO: 5269634 - DNA, 19 bp, Homo sapiens
atgcttgcatggagaatgg

SEQ ID NO: 5269635 - DNA, 23 bp, Homo sapiens
atgcttgcctagggcctggtcca

SEQ ID NO: 5269636 - DNA, 18 bp, Homo sapiens
atgcttgcggcaaaagga

SEQ ID NO: 5269637 - DNA, 20 bp, Homo sapiens
atgcttgcggcaaaaggaaa

SEQ ID NO: 5269638 - DNA, 17 bp, Homo sapiens
atgcttggagcaatcag

SEQ ID NO: 5269639 - DNA, 15 bp, Homo sapiens
atgcttgggccctgc

SEQ ID NO: 5269640 - DNA, 12 bp, Homo sapiens
atgcttggtttt

SEQ ID NO: 5269641 - DNA, 12 bp, Homo sapiens
atgcttgtaatt

SEQ ID NO: 5269642 - DNA, 13 bp, Homo sapiens
atgcttgtacata

SEQ ID NO: 5269643 - DNA, 15 bp, Homo sapiens
atgcttgtacataat

SEQ ID NO: 5269644 - DNA, 16 bp, Homo sapiens
atgcttgtacataatg

SEQ ID NO: 5269645 - DNA, 21 bp, Homo sapiens
atgcttgtgtatatgtataaa

SEQ ID NO: 5269646 - DNA, 13 bp, Homo sapiens
atgcttgtgttat

SEQ ID NO: 5269647 - DNA, 15 bp, Homo sapiens
atgcttgtgtttctt

SEQ ID NO: 5269648 - DNA, 22 bp, Homo sapiens
atgcttgtttatgatatttctt

SEQ ID NO: 5269649 - DNA, 12 bp, Homo sapiens
atgctttaaata

SEQ ID NO: 5269650 - DNA, 13 bp, Homo sapiens
atgctttaaatag

SEQ ID NO: 5269651 - DNA, 19 bp, Homo sapiens
atgctttaaatagtttact

SEQ ID NO: 5269652 - DNA, 20 bp, Homo sapiens
atgctttaacttcagagtga

SEQ ID NO: 5269653 - DNA, 19 bp, Homo sapiens
atgctttaccaaacagcaa

SEQ ID NO: 5269654 - DNA, 21 bp, Homo sapiens
atgctttaggatgtacagtta

SEQ ID NO: 5269655 - DNA, 22 bp, Homo sapiens
atgctttattaatgttttcaaa

SEQ ID NO: 5269656 - DNA, 14 bp, Homo sapiens
atgctttatttgta

SEQ ID NO: 5269657 - DNA, 16 bp, Homo sapiens
atgctttatttgtaaa

SEQ ID NO: 5269658 - DNA, 15 bp, Homo sapiens
atgctttccaaaacc

SEQ ID NO: 5269659 - DNA, 15 bp, Homo sapiens
atgctttccaaacct

SEQ ID NO: 5269660 - DNA, 16 bp, Homo sapiens
atgctttccatatttt

SEQ ID NO: 5269661 - DNA, 22 bp, Homo sapiens
atgctttccatatttttttcct

SEQ ID NO: 5269662 - DNA, 22 bp, Homo sapiens
atgctttcctaaagtctctgct

SEQ ID NO: 5269663 - DNA, 14 bp, Homo sapiens
atgctttccttctt

SEQ ID NO: 5269664 - DNA, 16 bp, Homo sapiens
atgctttctcatgcat

SEQ ID NO: 5269665 - DNA, 20 bp, Homo sapiens
atgctttctcatgcatagac

SEQ ID NO: 5269666 - DNA, 13 bp, Homo sapiens
atgctttctcctt

SEQ ID NO: 5269667 - DNA, 22 bp, Homo sapiens
atgctttctgaagctttaccag

SEQ ID NO: 5269668 - DNA, 13 bp, Homo sapiens
atgctttcttcat

SEQ ID NO: 5269669 - DNA, 16 bp, Homo sapiens
atgctttcttcatgtt

SEQ ID NO: 5269670 - DNA, 22 bp, Homo sapiens
atgctttgaaaaatcacttgat

SEQ ID NO: 5269671 - DNA, 16 bp, Homo sapiens
atgctttgaaaatgtt

SEQ ID NO: 5269672 - DNA, 18 bp, Homo sapiens
atgctttgaaaatgtttt

SEQ ID NO: 5269673 - DNA, 15 bp, Homo sapiens
atgctttgaacttta

SEQ ID NO: 5269674 - DNA, 17 bp, Homo sapiens
atgctttgaactttagt

SEQ ID NO: 5269675 - DNA, 21 bp, Homo sapiens
atgctttgaagtacaattgtg

SEQ ID NO: 5269676 - DNA, 22 bp, Homo sapiens
atgctttgagaccagaagaaaa

SEQ ID NO: 5269677 - DNA, 17 bp, Homo sapiens
atgctttgattgttcat

SEQ ID NO: 5269678 - DNA, 16 bp, Homo sapiens
atgctttgcccaggct

SEQ ID NO: 5269679 - DNA, 21 bp, Homo sapiens
atgctttgctctcaaggcttg

SEQ ID NO: 5269680 - DNA, 18 bp, Homo sapiens
atgctttgctttgtctgg

SEQ ID NO: 5269681 - DNA, 22 bp, Homo sapiens
atgctttggaaaaatgggtctt

SEQ ID NO: 5269682 - DNA, 19 bp, Homo sapiens
atgctttgggaggccaagg

SEQ ID NO: 5269683 - DNA, 16 bp, Homo sapiens
atgctttgtgtgattg

SEQ ID NO: 5269684 - DNA, 17 bp, Homo sapiens
atgcttttaaaaatcta

SEQ ID NO: 5269685 - DNA, 22 bp, Homo sapiens
atgcttttaatgaatttaaggc

SEQ ID NO: 5269686 - DNA, 15 bp, Homo sapiens
atgcttttactaagc

SEQ ID NO: 5269687 - DNA, 17 bp, Homo sapiens
atgcttttactgaactt

SEQ ID NO: 5269688 - DNA, 15 bp, Homo sapiens
atgcttttatattct

SEQ ID NO: 5269689 - DNA, 22 bp, Homo sapiens
atgcttttatatttttttaaaa

SEQ ID NO: 5269690 - DNA, 15 bp, Homo sapiens
atgcttttattcaag

SEQ ID NO: 5269691 - DNA, 22 bp, Homo sapiens
atgcttttcactttctgtctag

SEQ ID NO: 5269692 - DNA, 14 bp, Homo sapiens
atgcttttctcaaa

SEQ ID NO: 5269693 - DNA, 18 bp, Homo sapiens
atgcttttctcatggtat

SEQ ID NO: 5269694 - DNA, 20 bp, Homo sapiens
atgcttttctgtctctgcct

SEQ ID NO: 5269695 - DNA, 16 bp, Homo sapiens
atgcttttgctgctgc

SEQ ID NO: 5269696 - DNA, 22 bp, Homo sapiens
atgcttttggaagttaaaattt

SEQ ID NO: 5269697 - DNA, 14 bp, Homo sapiens
atgctttttagaaa

SEQ ID NO: 5269698 - DNA, 19 bp, Homo sapiens
atgctttttatttctgcat

SEQ ID NO: 5269699 - DNA, 23 bp, Homo sapiens
atgctttttatttctgcatatgt

SEQ ID NO: 5269700 - DNA, 11 bp, Homo sapiens
atggaaaaaaa

SEQ ID NO: 5269701 - DNA, 23 bp, Homo sapiens
atggaaaaaaaaaaaagaggaaa

SEQ ID NO: 5269702 - DNA, 16 bp, Homo sapiens
atggaaaaaaaaaaca

SEQ ID NO: 5269703 - DNA, 20 bp, Homo sapiens
atggaaaaaaaaaacaaaaa

SEQ ID NO: 5269704 - DNA, 21 bp, Homo sapiens
atggaaaaaaaaaacaaaaaa

SEQ ID NO: 5269705 - DNA, 19 bp, Homo sapiens
atggaaaaaaacataaaaa

SEQ ID NO: 5269706 - DNA, 19 bp, Homo sapiens
atggaaaaaaataaacttt

SEQ ID NO: 5269707 - DNA, 12 bp, Homo sapiens
atggaaaaataa

SEQ ID NO: 5269708 - DNA, 16 bp, Homo sapiens
atggaaaaatactgcc

SEQ ID NO: 5269709 - DNA, 16 bp, Homo sapiens
atggaaaaatggttga

SEQ ID NO: 5269710 - DNA, 17 bp, Homo sapiens
atggaaaaattgacaaa

SEQ ID NO: 5269711 - DNA, 20 bp, Homo sapiens
atggaaaaattgacaaaaaa

SEQ ID NO: 5269712 - DNA, 21 bp, Homo sapiens
atggaaaacaaaccatctcta

SEQ ID NO: 5269713 - DNA, 22 bp, Homo sapiens
atggaaaacagagtatttctgg

SEQ ID NO: 5269714 - DNA, 17 bp, Homo sapiens
atggaaaacatttacat

SEQ ID NO: 5269715 - DNA, 17 bp, Homo sapiens
atggaaaacctggggga

SEQ ID NO: 5269716 - DNA, 19 bp, Homo sapiens
atggaaaacgctctctact

SEQ ID NO: 5269717 - DNA, 16 bp, Homo sapiens
atggaaaacttagttt

SEQ ID NO: 5269718 - DNA, 17 bp, Homo sapiens
atggaaaacttagtttg

SEQ ID NO: 5269719 - DNA, 13 bp, Homo sapiens
atggaaaagccca

SEQ ID NO: 5269720 - DNA, 12 bp, Homo sapiens
atggaaaaggaa

SEQ ID NO: 5269721 - DNA, 18 bp, Homo sapiens
atggaaaagtgtccttct

SEQ ID NO: 5269722 - DNA, 14 bp, Homo sapiens
atggaaaataaaca

SEQ ID NO: 5269723 - DNA, 16 bp, Homo sapiens
atggaaaataaattat

SEQ ID NO: 5269724 - DNA, 19 bp, Homo sapiens
atggaaaatatacaagtaa

SEQ ID NO: 5269725 - DNA, 17 bp, Homo sapiens
atggaaaatcagctgct

SEQ ID NO: 5269726 - DNA, 17 bp, Homo sapiens
atggaaaatcagtgaca

SEQ ID NO: 5269727 - DNA, 21 bp, Homo sapiens
atggaaaatcagtgacatctg

SEQ ID NO: 5269728 - DNA, 21 bp, Homo sapiens
atggaaaattaattctaaact

SEQ ID NO: 5269729 - DNA, 21 bp, Homo sapiens
atggaaaattttctccttggt

SEQ ID NO: 5269730 - DNA, 15 bp, Homo sapiens
atggaaacaaagtgg

SEQ ID NO: 5269731 - DNA, 16 bp, Homo sapiens
atggaaacaatgtgga

SEQ ID NO: 5269732 - DNA, 15 bp, Homo sapiens
atggaaacacatact

SEQ ID NO: 5269733 - DNA, 16 bp, Homo sapiens
atggaaacattacagt

SEQ ID NO: 5269734 - DNA, 22 bp, Homo sapiens
atggaaacattttatactgtac

SEQ ID NO: 5269735 - DNA, 22 bp, Homo sapiens
atggaaacccataggcccacac

SEQ ID NO: 5269736 - DNA, 13 bp, Homo sapiens
atggaaacctcac

SEQ ID NO: 5269737 - DNA, 16 bp, Homo sapiens
atggaaacctgaaaaa

SEQ ID NO: 5269738 - DNA, 23 bp, Homo sapiens
atggaaacctgaaaaaaagttta

SEQ ID NO: 5269739 - DNA, 16 bp, Homo sapiens
atggaaacgcacttac

SEQ ID NO: 5269740 - DNA, 21 bp, Homo sapiens
atggaaacgcacttacaagtg

SEQ ID NO: 5269741 - DNA, 13 bp, Homo sapiens
atggaaactgcca

SEQ ID NO: 5269742 - DNA, 14 bp, Homo sapiens
atggaaactgccaa

SEQ ID NO: 5269743 - DNA, 15 bp, Homo sapiens
atggaaactggactc

SEQ ID NO: 5269744 - DNA, 15 bp, Homo sapiens
atggaaactggccag

SEQ ID NO: 5269745 - DNA, 20 bp, Homo sapiens
atggaaactgttgccagaga

SEQ ID NO: 5269746 - DNA, 18 bp, Homo sapiens
atggaaagaaaagaatgt

SEQ ID NO: 5269747 - DNA, 22 bp, Homo sapiens
atggaaagaaaagaatgtacat

SEQ ID NO: 5269748 - DNA, 13 bp, Homo sapiens
atggaaagaagga

SEQ ID NO: 5269749 - DNA, 17 bp, Homo sapiens
atggaaagaatctaata

SEQ ID NO: 5269750 - DNA, 19 bp, Homo sapiens
atggaaagaggtgaaaatg

SEQ ID NO: 5269751 - DNA, 17 bp, Homo sapiens
atggaaagatggggagc

SEQ ID NO: 5269752 - DNA, 16 bp, Homo sapiens
atggaaagcagcagct

SEQ ID NO: 5269753 - DNA, 19 bp, Homo sapiens
atggaaagcttcagtgctg

SEQ ID NO: 5269754 - DNA, 14 bp, Homo sapiens
atggaaaggaagaa

SEQ ID NO: 5269755 - DNA, 15 bp, Homo sapiens
atggaaagggtgtgg

SEQ ID NO: 5269756 - DNA, 21 bp, Homo sapiens
atggaaagggtgtggcttgga

SEQ ID NO: 5269757 - DNA, 18 bp, Homo sapiens
atggaaaggtcctgtggg

SEQ ID NO: 5269758 - DNA, 16 bp, Homo sapiens
atggaaagtttgtagc

SEQ ID NO: 5269759 - DNA, 17 bp, Homo sapiens
atggaaataacgggtgg

SEQ ID NO: 5269760 - DNA, 14 bp, Homo sapiens
atggaaatacattt

SEQ ID NO: 5269761 - DNA, 15 bp, Homo sapiens
atggaaatacattta

SEQ ID NO: 5269762 - DNA, 18 bp, Homo sapiens
atggaaatacatttagaa

SEQ ID NO: 5269763 - DNA, 21 bp, Homo sapiens
atggaaataccaggaccagtt

SEQ ID NO: 5269764 - DNA, 17 bp, Homo sapiens
atggaaatatgttctaa

SEQ ID NO: 5269765 - DNA, 22 bp, Homo sapiens
atggaaatattatgcaaattcc

SEQ ID NO: 5269766 - DNA, 18 bp, Homo sapiens
atggaaatgcaaactggg

SEQ ID NO: 5269767 - DNA, 12 bp, Homo sapiens
atggaaatgtaa

SEQ ID NO: 5269768 - DNA, 17 bp, Homo sapiens
atggaaatgtgagaaat

SEQ ID NO: 5269769 - DNA, 13 bp, Homo sapiens
atggaaattagcc

SEQ ID NO: 5269770 - DNA, 15 bp, Homo sapiens
atggaaattctgaaa

SEQ ID NO: 5269771 - DNA, 16 bp, Homo sapiens
atggaaattttgctat

SEQ ID NO: 5269772 - DNA, 15 bp, Homo sapiens
atggaacaaagcatg

SEQ ID NO: 5269773 - DNA, 11 bp, Homo sapiens
atggaacactc

SEQ ID NO: 5269774 - DNA, 14 bp, Homo sapiens
atggaacactctga

SEQ ID NO: 5269775 - DNA, 18 bp, Homo sapiens
atggaacactctgagact

SEQ ID NO: 5269776 - DNA, 15 bp, Homo sapiens
atggaacagtaatta

SEQ ID NO: 5269777 - DNA, 20 bp, Homo sapiens
atggaacataaagttgtatt

SEQ ID NO: 5269778 - DNA, 21 bp, Homo sapiens
atggaacataaagttgtattg

SEQ ID NO: 5269779 - DNA, 15 bp, Homo sapiens
atggaacatgcccac

SEQ ID NO: 5269780 - DNA, 23 bp, Homo sapiens
atggaacccttttggcccccgag

SEQ ID NO: 5269781 - DNA, 16 bp, Homo sapiens
atggaaccgcaggaag

SEQ ID NO: 5269782 - DNA, 19 bp, Homo sapiens
atggaaccgcaggaagctg

SEQ ID NO: 5269783 - DNA, 21 bp, Homo sapiens
atggaacctgacgtagctgca

SEQ ID NO: 5269784 - DNA, 15 bp, Homo sapiens
atggaaccttccctc

SEQ ID NO: 5269785 - DNA, 18 bp, Homo sapiens
atggaaccttccctccaa

SEQ ID NO: 5269786 - DNA, 19 bp, Homo sapiens
atggaaccttccctccaaa

SEQ ID NO: 5269787 - DNA, 15 bp, Homo sapiens
atggaacgcgttgaa

SEQ ID NO: 5269788 - DNA, 16 bp, Homo sapiens
atggaacgcgttgaaa

SEQ ID NO: 5269789 - DNA, 24 bp, Homo sapiens
atggaacgggcatgggcctctctg

SEQ ID NO: 5269790 - DNA, 16 bp, Homo sapiens
atggaactactgtact

SEQ ID NO: 5269791 - DNA, 17 bp, Homo sapiens
atggaactactgtactt

SEQ ID NO: 5269792 - DNA, 18 bp, Homo sapiens
atggaactactgtacttt

SEQ ID NO: 5269793 - DNA, 23 bp, Homo sapiens
atggaactactgtactttgccat

SEQ ID NO: 5269794 - DNA, 16 bp, Homo sapiens
atggaactccccaggg

SEQ ID NO: 5269795 - DNA, 18 bp, Homo sapiens
atggaactccccagggcc

SEQ ID NO: 5269796 - DNA, 19 bp, Homo sapiens
atggaactccccagggcct

SEQ ID NO: 5269797 - DNA, 16 bp, Homo sapiens
atggaactcgcccccc

SEQ ID NO: 5269798 - DNA, 17 bp, Homo sapiens
atggaactcgctcagaa

SEQ ID NO: 5269799 - DNA, 15 bp, Homo sapiens
atggaactctttttt

SEQ ID NO: 5269800 - DNA, 14 bp, Homo sapiens
atggaacttagact

SEQ ID NO: 5269801 - DNA, 19 bp, Homo sapiens
atggaacttagactcctct

SEQ ID NO: 5269802 - DNA, 12 bp, Homo sapiens
atggaagaaaga

SEQ ID NO: 5269803 - DNA, 15 bp, Homo sapiens
atggaagaaagaagc

SEQ ID NO: 5269804 - DNA, 17 bp, Homo sapiens
atggaagaaagaagcat

SEQ ID NO: 5269805 - DNA, 17 bp, Homo sapiens
atggaagaagaaaggac

SEQ ID NO: 5269806 - DNA, 15 bp, Homo sapiens
atggaagacaaatac

SEQ ID NO: 5269807 - DNA, 13 bp, Homo sapiens
atggaagacacat

SEQ ID NO: 5269808 - DNA, 15 bp, Homo sapiens
atggaagacagctct

SEQ ID NO: 5269809 - DNA, 18 bp, Homo sapiens
atggaagacagctcttat

SEQ ID NO: 5269810 - DNA, 15 bp, Homo sapiens
atggaagacaggaaa

SEQ ID NO: 5269811 - DNA, 20 bp, Homo sapiens
attatgagctatcctttcaa

SEQ ID NO: 5269812 - DNA, 21 bp, Homo sapiens
attatgagctatcctttcaaa

SEQ ID NO: 5269813 - DNA, 16 bp, Homo sapiens
attatgagctttcttt

SEQ ID NO: 5269814 - DNA, 18 bp, Homo sapiens
attatgaggctattaaaa

SEQ ID NO: 5269815 - DNA, 17 bp, Homo sapiens
attatgatcctctattt

SEQ ID NO: 5269816 - DNA, 13 bp, Homo sapiens
attatgatctaat

SEQ ID NO: 5269817 - DNA, 21 bp, Homo sapiens
attatgatctaataaacttta

SEQ ID NO: 5269818 - DNA, 17 bp, Homo sapiens
attatgatgcatacagt

SEQ ID NO: 5269819 - DNA, 21 bp, Homo sapiens
attatgatgtgggtcaaggaa

SEQ ID NO: 5269820 - DNA, 20 bp, Homo sapiens
attatgatgttttgcaaagg

SEQ ID NO: 5269821 - DNA, 15 bp, Homo sapiens
attatgattagcttt

SEQ ID NO: 5269822 - DNA, 12 bp, Homo sapiens
attatgattagt

SEQ ID NO: 5269823 - DNA, 15 bp, Homo sapiens
attatgcaaaagcag

SEQ ID NO: 5269824 - DNA, 16 bp, Homo sapiens
attatgcacgtgtctg

SEQ ID NO: 5269825 - DNA, 17 bp, Homo sapiens
attatgcactggccacc

SEQ ID NO: 5269826 - DNA, 23 bp, Homo sapiens
attatgcacttttagaaatgcat

SEQ ID NO: 5269827 - DNA, 21 bp, Homo sapiens
attatgcaggggcaaacacct

SEQ ID NO: 5269828 - DNA, 12 bp, Homo sapiens
attatgcataaa

SEQ ID NO: 5269829 - DNA, 15 bp, Homo sapiens
attatgcataactga

SEQ ID NO: 5269830 - DNA, 16 bp, Homo sapiens
attatgcattatatca

SEQ ID NO: 5269831 - DNA, 16 bp, Homo sapiens
attatgcattcttata

SEQ ID NO: 5269832 - DNA, 16 bp, Homo sapiens
attatgcccatgaaca

SEQ ID NO: 5269833 - DNA, 18 bp, Homo sapiens
attatgccttgagaatga

SEQ ID NO: 5269834 - DNA, 19 bp, Homo sapiens
attatgccttttaaaaata

SEQ ID NO: 5269835 - DNA, 20 bp, Homo sapiens
attatgcggaaaggtatttg

SEQ ID NO: 5269836 - DNA, 13 bp, Homo sapiens
attatgctaagaa

SEQ ID NO: 5269837 - DNA, 18 bp, Homo sapiens
attatggaaaaaaaatat

SEQ ID NO: 5269838 - DNA, 20 bp, Homo sapiens
attatggaaaaataaaactg

SEQ ID NO: 5269839 - DNA, 14 bp, Homo sapiens
attatggaaacaga

SEQ ID NO: 5269840 - DNA, 16 bp, Homo sapiens
attatggaagatttta

SEQ ID NO: 5269841 - DNA, 14 bp, Homo sapiens
attatggaatatca

SEQ ID NO: 5269842 - DNA, 18 bp, Homo sapiens
attatggaatatcatctg

SEQ ID NO: 5269843 - DNA, 22 bp, Homo sapiens
attatggaatatcatctgtcat

SEQ ID NO: 5269844 - DNA, 22 bp, Homo sapiens
attatggagtcatttttacaat

SEQ ID NO: 5269845 - DNA, 18 bp, Homo sapiens
attatggcttgtgaactg

SEQ ID NO: 5269846 - DNA, 16 bp, Homo sapiens
attatgggaacaagtg

SEQ ID NO: 5269847 - DNA, 17 bp, Homo sapiens
attatgggaatcaagat

SEQ ID NO: 5269848 - DNA, 15 bp, Homo sapiens
attatgggtcacagg

SEQ ID NO: 5269849 - DNA, 16 bp, Homo sapiens
attatgggtcctgcaa

SEQ ID NO: 5269850 - DNA, 23 bp, Homo sapiens
attatgggttaggcattaatgtt

SEQ ID NO: 5269851 - DNA, 21 bp, Homo sapiens
attatggtctggggtaaaatt

SEQ ID NO: 5269852 - DNA, 14 bp, Homo sapiens
attatggtgaaatt

SEQ ID NO: 5269853 - DNA, 18 bp, Homo sapiens
attatggtgatactccaa

SEQ ID NO: 5269854 - DNA, 20 bp, Homo sapiens
attatggtgtaatgcacaat

SEQ ID NO: 5269855 - DNA, 22 bp, Homo sapiens
attatggtgtaatgcacaattt

SEQ ID NO: 5269856 - DNA, 15 bp, Homo sapiens
attatgtaaataact

SEQ ID NO: 5269857 - DNA, 17 bp, Homo sapiens
attatgtaaataactct

SEQ ID NO: 5269858 - DNA, 13 bp, Homo sapiens
attatgtaaatcc

SEQ ID NO: 5269859 - DNA, 22 bp, Homo sapiens
attatgtaaatcccattattca

SEQ ID NO: 5269860 - DNA, 12 bp, Homo sapiens
attatgtaacac

SEQ ID NO: 5269861 - DNA, 20 bp, Homo sapiens
attatgtaatatattgtaca

SEQ ID NO: 5269862 - DNA, 14 bp, Homo sapiens
attatgtaatgcaa

SEQ ID NO: 5269863 - DNA, 15 bp, Homo sapiens
attatgtaccatgaa

SEQ ID NO: 5269864 - DNA, 20 bp, Homo sapiens
attatgtaccatgaatattt

SEQ ID NO: 5269865 - DNA, 14 bp, Homo sapiens
attatgtagaaata

SEQ ID NO: 5269866 - DNA, 14 bp, Homo sapiens
attatgtagctctt

SEQ ID NO: 5269867 - DNA, 15 bp, Homo sapiens
attatgtataaaatg

SEQ ID NO: 5269868 - DNA, 16 bp, Homo sapiens
attatgtataaaatgt

SEQ ID NO: 5269869 - DNA, 14 bp, Homo sapiens
attatgtataacaa

SEQ ID NO: 5269870 - DNA, 15 bp, Homo sapiens
attatgtataacaag

SEQ ID NO: 5269871 - DNA, 21 bp, Homo sapiens
attatgtatagaaaataaaat

SEQ ID NO: 5269872 - DNA, 14 bp, Homo sapiens
attatgtatggata

SEQ ID NO: 5269873 - DNA, 16 bp, Homo sapiens
attatgtatgtttaca

SEQ ID NO: 5269874 - DNA, 17 bp, Homo sapiens
attatgtatgtttacat

SEQ ID NO: 5269875 - DNA, 18 bp, Homo sapiens
attatgtattaacttgta

SEQ ID NO: 5269876 - DNA, 19 bp, Homo sapiens
attatgtattaacttgtag

SEQ ID NO: 5269877 - DNA, 16 bp, Homo sapiens
attatgtcaaatggat

SEQ ID NO: 5269878 - DNA, 15 bp, Homo sapiens
attatgtccattatt

SEQ ID NO: 5269879 - DNA, 23 bp, Homo sapiens
attatgtcttttatatttgtatc

SEQ ID NO: 5269880 - DNA, 15 bp, Homo sapiens
attatgtgaagaatt

SEQ ID NO: 5269881 - DNA, 13 bp, Homo sapiens
attatgtgacatt

SEQ ID NO: 5269882 - DNA, 19 bp, Homo sapiens
attatgtgacattttacat

SEQ ID NO: 5269883 - DNA, 13 bp, Homo sapiens
attatgtgacttg

SEQ ID NO: 5269884 - DNA, 15 bp, Homo sapiens
attatgtgcaaaggt

SEQ ID NO: 5269885 - DNA, 21 bp, Homo sapiens
attatgtgccagatttatgca

SEQ ID NO: 5269886 - DNA, 20 bp, Homo sapiens
attatgtgcctaattttcta

SEQ ID NO: 5269887 - DNA, 14 bp, Homo sapiens
attatgtggtttta

SEQ ID NO: 5269888 - DNA, 19 bp, Homo sapiens
attatgtgtagttataaac

SEQ ID NO: 5269889 - DNA, 15 bp, Homo sapiens
attatgtgtgtttta

SEQ ID NO: 5269890 - DNA, 21 bp, Homo sapiens
attatgtgtgttttaaaatga

SEQ ID NO: 5269891 - DNA, 14 bp, Homo sapiens
attatgttactgta

SEQ ID NO: 5269892 - DNA, 18 bp, Homo sapiens
attatgttagtttaaaag

SEQ ID NO: 5269893 - DNA, 15 bp, Homo sapiens
attatgttatgaaaa

SEQ ID NO: 5269894 - DNA, 16 bp, Homo sapiens
attatgttatgaaaac

SEQ ID NO: 5269895 - DNA, 14 bp, Homo sapiens
attatgttattgaa

SEQ ID NO: 5269896 - DNA, 18 bp, Homo sapiens
attatgttattgaaaaaa

SEQ ID NO: 5269897 - DNA, 21 bp, Homo sapiens
attatgttattggaattttct

SEQ ID NO: 5269898 - DNA, 15 bp, Homo sapiens
attatgttcaatgaa

SEQ ID NO: 5269899 - DNA, 20 bp, Homo sapiens
attatgttcatgtaagaagc

SEQ ID NO: 5269900 - DNA, 13 bp, Homo sapiens
attatgttccaag

SEQ ID NO: 5269901 - DNA, 21 bp, Homo sapiens
attatgttcctgctgtatttc

SEQ ID NO: 5269902 - DNA, 20 bp, Homo sapiens
attatgttgttagagaaaaa

SEQ ID NO: 5269903 - DNA, 14 bp, Homo sapiens
attatgtttaagat

SEQ ID NO: 5269904 - DNA, 16 bp, Homo sapiens
attatgtttatataaa

SEQ ID NO: 5269905 - DNA, 16 bp, Homo sapiens
attatgtttattacaa

SEQ ID NO: 5269906 - DNA, 15 bp, Homo sapiens
attatgtttatttca

SEQ ID NO: 5269907 - DNA, 20 bp, Homo sapiens
attatgtttatttcatgtgg

SEQ ID NO: 5269908 - DNA, 21 bp, Homo sapiens
attatgttttatttaaatgct

SEQ ID NO: 5269909 - DNA, 12 bp, Homo sapiens
attatgttttca

SEQ ID NO: 5269910 - DNA, 16 bp, Homo sapiens
attatgtttttattaa

SEQ ID NO: 5269911 - DNA, 18 bp, Homo sapiens
attatgtttttattaaga

SEQ ID NO: 5269912 - DNA, 23 bp, Homo sapiens
attatgtttttattaagattatt

SEQ ID NO: 5269913 - DNA, 20 bp, Homo sapiens
attatgttttttaaaatatt

SEQ ID NO: 5269914 - DNA, 17 bp, Homo sapiens
attattaaaaattatag

SEQ ID NO: 5269915 - DNA, 20 bp, Homo sapiens
attattaaagtctaaacaaa

SEQ ID NO: 5269916 - DNA, 15 bp, Homo sapiens
attattaaagttttc

SEQ ID NO: 5269917 - DNA, 18 bp, Homo sapiens
attattaaatcagaatct

SEQ ID NO: 5269918 - DNA, 22 bp, Homo sapiens
attattaaatcagttttgtgta

SEQ ID NO: 5269919 - DNA, 20 bp, Homo sapiens
attattaaatcgtttaatgt

SEQ ID NO: 5269920 - DNA, 15 bp, Homo sapiens
attattaacactaat

SEQ ID NO: 5269921 - DNA, 19 bp, Homo sapiens
attattaactacatttatg

SEQ ID NO: 5269922 - DNA, 14 bp, Homo sapiens
attattaagtaact

SEQ ID NO: 5269923 - DNA, 18 bp, Homo sapiens
attattaagtaacttatt

SEQ ID NO: 5269924 - DNA, 13 bp, Homo sapiens
attattaataaat

SEQ ID NO: 5269925 - DNA, 12 bp, Homo sapiens
attattaatcat

SEQ ID NO: 5269926 - DNA, 15 bp, Homo sapiens
attattaatcattcc

SEQ ID NO: 5269927 - DNA, 18 bp, Homo sapiens
attattaatcctcttgag

SEQ ID NO: 5269928 - DNA, 14 bp, Homo sapiens
attattaatgaaaa

SEQ ID NO: 5269929 - DNA, 14 bp, Homo sapiens
attattaatgaatg

SEQ ID NO: 5269930 - DNA, 15 bp, Homo sapiens
attattaatgaatgc

SEQ ID NO: 5269931 - DNA, 20 bp, Homo sapiens
attattaattgtcctgtgtc

SEQ ID NO: 5269932 - DNA, 13 bp, Homo sapiens
attattaatttat

SEQ ID NO: 5269933 - DNA, 16 bp, Homo sapiens
attattaatttatgca

SEQ ID NO: 5269934 - DNA, 15 bp, Homo sapiens
attattacagtgttt

SEQ ID NO: 5269935 - DNA, 13 bp, Homo sapiens
attattactgttt

SEQ ID NO: 5269936 - DNA, 16 bp, Homo sapiens
attattacttctgttt

SEQ ID NO: 5269937 - DNA, 13 bp, Homo sapiens
attattacttgta

SEQ ID NO: 5269938 - DNA, 23 bp, Homo sapiens
attattacttgtaaatataaaga

SEQ ID NO: 5269939 - DNA, 13 bp, Homo sapiens
attattactttaa

SEQ ID NO: 5269940 - DNA, 12 bp, Homo sapiens
attattactttt

SEQ ID NO: 5269941 - DNA, 14 bp, Homo sapiens
attattacttttgc

SEQ ID NO: 5269942 - DNA, 15 bp, Homo sapiens
attattacttttgct

SEQ ID NO: 5269943 - DNA, 14 bp, Homo sapiens
attattacttttta

SEQ ID NO: 5269944 - DNA, 14 bp, Homo sapiens
attattagaacatt

SEQ ID NO: 5269945 - DNA, 22 bp, Homo sapiens
attattagactctctagtttta

SEQ ID NO: 5269946 - DNA, 13 bp, Homo sapiens
attattagattct

SEQ ID NO: 5269947 - DNA, 22 bp, Homo sapiens
attattagattgccaatactca

SEQ ID NO: 5269948 - DNA, 15 bp, Homo sapiens
attattataaaaggg

SEQ ID NO: 5269949 - DNA, 17 bp, Homo sapiens
attattataaactataa

SEQ ID NO: 5269950 - DNA, 20 bp, Homo sapiens
attattataagcattgaaat

SEQ ID NO: 5269951 - DNA, 14 bp, Homo sapiens
attattatacttca

SEQ ID NO: 5269952 - DNA, 13 bp, Homo sapiens
attattatagcaa

SEQ ID NO: 5269953 - DNA, 13 bp, Homo sapiens
attattatattgt

SEQ ID NO: 5269954 - DNA, 14 bp, Homo sapiens
attattatgtaaat

SEQ ID NO: 5269955 - DNA, 15 bp, Homo sapiens
attattatgttctta

SEQ ID NO: 5269956 - DNA, 14 bp, Homo sapiens
attattattcagaa

SEQ ID NO: 5269957 - DNA, 15 bp, Homo sapiens
attattattcttcat

SEQ ID NO: 5269958 - DNA, 22 bp, Homo sapiens
attattatttatttgattaggt

SEQ ID NO: 5269959 - DNA, 16 bp, Homo sapiens
attattatttctgttc

SEQ ID NO: 5269960 - DNA, 15 bp, Homo sapiens
attattatttgcagt

SEQ ID NO: 5269961 - DNA, 20 bp, Homo sapiens
attattattttaaaatatat

SEQ ID NO: 5269962 - DNA, 17 bp, Homo sapiens
attattcaaagttgcct

SEQ ID NO: 5269963 - DNA, 24 bp, Homo sapiens
attattcaaagttgcctaaatcca

SEQ ID NO: 5269964 - DNA, 12 bp, Homo sapiens
attattcaagaa

SEQ ID NO: 5269965 - DNA, 21 bp, Homo sapiens
attattcaagaaagatatcta

SEQ ID NO: 5269966 - DNA, 21 bp, Homo sapiens
attattcaccatgtaaaacaa

SEQ ID NO: 5269967 - DNA, 19 bp, Homo sapiens
attattcactgatttgaca

SEQ ID NO: 5269968 - DNA, 20 bp, Homo sapiens
attattcagaattatacaga

SEQ ID NO: 5269969 - DNA, 14 bp, Homo sapiens
attattcagtgtca

SEQ ID NO: 5269970 - DNA, 15 bp, Homo sapiens
attattcagttaaga

SEQ ID NO: 5269971 - DNA, 16 bp, Homo sapiens
attattcataatgtga

SEQ ID NO: 5269972 - DNA, 18 bp, Homo sapiens
attattcataatgtgaga

SEQ ID NO: 5269973 - DNA, 19 bp, Homo sapiens
attattcataatgtgagat

SEQ ID NO: 5269974 - DNA, 16 bp, Homo sapiens
attattcatagctgta

SEQ ID NO: 5269975 - DNA, 15 bp, Homo sapiens
attattcatatgctt

SEQ ID NO: 5269976 - DNA, 20 bp, Homo sapiens
attattcatatgcttcccag

SEQ ID NO: 5269977 - DNA, 15 bp, Homo sapiens
attattcatttaaaa

SEQ ID NO: 5269978 - DNA, 16 bp, Homo sapiens
attattcatttaaaat

SEQ ID NO: 5269979 - DNA, 18 bp, Homo sapiens
attattccgtattacatt

SEQ ID NO: 5269980 - DNA, 19 bp, Homo sapiens
attattccgtattacattt

SEQ ID NO: 5269981 - DNA, 16 bp, Homo sapiens
attattcctcaaaaaa

SEQ ID NO: 5269982 - DNA, 19 bp, Homo sapiens
attattcctcagattgctg

SEQ ID NO: 5269983 - DNA, 20 bp, Homo sapiens
attattcctcagattgctga

SEQ ID NO: 5269984 - DNA, 12 bp, Homo sapiens
attattctagtc

SEQ ID NO: 5269985 - DNA, 18 bp, Homo sapiens
attattctagtcaactgc

SEQ ID NO: 5269986 - DNA, 13 bp, Homo sapiens
attattctatgta

SEQ ID NO: 5269987 - DNA, 12 bp, Homo sapiens
attattctcatt

SEQ ID NO: 5269988 - DNA, 17 bp, Homo sapiens
attattctcatttagtg

SEQ ID NO: 5269989 - DNA, 19 bp, Homo sapiens
attattctcatttagtgcc

SEQ ID NO: 5269990 - DNA, 13 bp, Homo sapiens
attattctccact

SEQ ID NO: 5269991 - DNA, 21 bp, Homo sapiens
attattctccactttttctta

SEQ ID NO: 5269992 - DNA, 19 bp, Homo sapiens
atggaagacctaaggcaga

SEQ ID NO: 5269993 - DNA, 23 bp, Homo sapiens
atggaagacctaaggcagacagg

SEQ ID NO: 5269994 - DNA, 14 bp, Homo sapiens
atggaagagaaatc

SEQ ID NO: 5269995 - DNA, 15 bp, Homo sapiens
atggaagagaaatct

SEQ ID NO: 5269996 - DNA, 14 bp, Homo sapiens
atggaagagagaaa

SEQ ID NO: 5269997 - DNA, 13 bp, Homo sapiens
atggaagagtcat

SEQ ID NO: 5269998 - DNA, 19 bp, Homo sapiens
atggaagataattttatgt

SEQ ID NO: 5269999 - DNA, 19 bp, Homo sapiens
atggaagatggtccgtgcc

SEQ ID NO: 5270000 - DNA, 17 bp, Homo sapiens
atggaagcaaagacaaa

SEQ ID NO: 5270001 - DNA, 20 bp, Homo sapiens
atggaagcaaagacaaaaga

SEQ ID NO: 5270002 - DNA, 22 bp, Homo sapiens
atggaagcaaagacaaaagaaa

SEQ ID NO: 5270003 - DNA, 17 bp, Homo sapiens
atggaagcaaagtgctg

SEQ ID NO: 5270004 - DNA, 23 bp, Homo sapiens
atggaagcctccacctgcagccc

SEQ ID NO: 5270005 - DNA, 12 bp, Homo sapiens
atggaaggagag

SEQ ID NO: 5270006 - DNA, 15 bp, Homo sapiens
atggaaggagagagg

SEQ ID NO: 5270007 - DNA, 16 bp, Homo sapiens
atggaagggtttgtgg

SEQ ID NO: 5270008 - DNA, 16 bp, Homo sapiens
atggaaggtgccagaa

SEQ ID NO: 5270009 - DNA, 20 bp, Homo sapiens
atggaaggttaggtttgtca

SEQ ID NO: 5270010 - DNA, 21 bp, Homo sapiens
atggaagtaaaggcattccac

SEQ ID NO: 5270011 - DNA, 18 bp, Homo sapiens
atggaagtatttgagaga

SEQ ID NO: 5270012 - DNA, 22 bp, Homo sapiens
atggaagtcacctttctgggct

SEQ ID NO: 5270013 - DNA, 14 bp, Homo sapiens
atggaagtgggcca

SEQ ID NO: 5270014 - DNA, 15 bp, Homo sapiens
atggaagtgggccag

SEQ ID NO: 5270015 - DNA, 10 bp, Homo sapiens
atggaagtgt

SEQ ID NO: 5270016 - DNA, 15 bp, Homo sapiens
atggaagttttccta

SEQ ID NO: 5270017 - DNA, 14 bp, Homo sapiens
atggaataacatgt

SEQ ID NO: 5270018 - DNA, 18 bp, Homo sapiens
atggaataactatctcac

SEQ ID NO: 5270019 - DNA, 16 bp, Homo sapiens
atggaataactctgtg

SEQ ID NO: 5270020 - DNA, 16 bp, Homo sapiens
atggaataagtgtaca

SEQ ID NO: 5270021 - DNA, 16 bp, Homo sapiens
atggaataattagctt

SEQ ID NO: 5270022 - DNA, 20 bp, Homo sapiens
atggaatagaaaagatgaga

SEQ ID NO: 5270023 - DNA, 14 bp, Homo sapiens
atggaatatatcag

SEQ ID NO: 5270024 - DNA, 14 bp, Homo sapiens
atggaatatcagaa

SEQ ID NO: 5270025 - DNA, 18 bp, Homo sapiens
atggaatatcatgaatgt

SEQ ID NO: 5270026 - DNA, 19 bp, Homo sapiens
atggaatatcatgaatgtg

SEQ ID NO: 5270027 - DNA, 18 bp, Homo sapiens
atggaatcacagccaata

SEQ ID NO: 5270028 - DNA, 19 bp, Homo sapiens
atggaatcgaagtgtttat

SEQ ID NO: 5270029 - DNA, 15 bp, Homo sapiens
atggaatctacatgt

SEQ ID NO: 5270030 - DNA, 15 bp, Homo sapiens
atggaatgactgaag

SEQ ID NO: 5270031 - DNA, 21 bp, Homo sapiens
atggaatgatgggtcagttgt

SEQ ID NO: 5270032 - DNA, 21 bp, Homo sapiens
atggaatgattggttaaaatg

SEQ ID NO: 5270033 - DNA, 15 bp, Homo sapiens
atggaatgcttgaaa

SEQ ID NO: 5270034 - DNA, 15 bp, Homo sapiens
atggaatggaaaagc

SEQ ID NO: 5270035 - DNA, 18 bp, Homo sapiens
atggaatgtcagtgttca

SEQ ID NO: 5270036 - DNA, 17 bp, Homo sapiens
atggaatgtgccacctg

SEQ ID NO: 5270037 - DNA, 21 bp, Homo sapiens
atggaatgtgcccctggccca

SEQ ID NO: 5270038 - DNA, 18 bp, Homo sapiens
atggaattaaatgtggga

SEQ ID NO: 5270039 - DNA, 16 bp, Homo sapiens
atggaattactccaaa

SEQ ID NO: 5270040 - DNA, 15 bp, Homo sapiens
atggaattatgtata

SEQ ID NO: 5270041 - DNA, 20 bp, Homo sapiens
atggaattattttgaatgtc

SEQ ID NO: 5270042 - DNA, 23 bp, Homo sapiens
atggaattattttgaatgtcaca

SEQ ID NO: 5270043 - DNA, 15 bp, Homo sapiens
atggaattcttcctc

SEQ ID NO: 5270044 - DNA, 15 bp, Homo sapiens
atggaattgatttgc

SEQ ID NO: 5270045 - DNA, 17 bp, Homo sapiens
atggaattgatttgcat

SEQ ID NO: 5270046 - DNA, 15 bp, Homo sapiens
atggaattggacata

SEQ ID NO: 5270047 - DNA, 21 bp, Homo sapiens
atggaatttaatgctgaatat

SEQ ID NO: 5270048 - DNA, 17 bp, Homo sapiens
atggaatttaatttatg

SEQ ID NO: 5270049 - DNA, 21 bp, Homo sapiens
atggaatttgtaagtttatgt

SEQ ID NO: 5270050 - DNA, 17 bp, Homo sapiens
atggaattttgcaaaga

SEQ ID NO: 5270051 - DNA, 15 bp, Homo sapiens
atggaatttttttgt

SEQ ID NO: 5270052 - DNA, 17 bp, Homo sapiens
atggaatttttttgtac

SEQ ID NO: 5270053 - DNA, 18 bp, Homo sapiens
atggacaaaattaataca

SEQ ID NO: 5270054 - DNA, 16 bp, Homo sapiens
atggacaaagaaaacg

SEQ ID NO: 5270055 - DNA, 15 bp, Homo sapiens
atggacaacttattt

SEQ ID NO: 5270056 - DNA, 17 bp, Homo sapiens
atggacaacttatttaa

SEQ ID NO: 5270057 - DNA, 23 bp, Homo sapiens
atggacaagcagtgtctgtcagc

SEQ ID NO: 5270058 - DNA, 18 bp, Homo sapiens
atggacaatttaccacag

SEQ ID NO: 5270059 - DNA, 20 bp, Homo sapiens
atggacacaaattttcaagt

SEQ ID NO: 5270060 - DNA, 22 bp, Homo sapiens
atggacacagacccacacatgt

SEQ ID NO: 5270061 - DNA, 15 bp, Homo sapiens
atggacacccccagc

SEQ ID NO: 5270062 - DNA, 16 bp, Homo sapiens
atggacacccccagct

SEQ ID NO: 5270063 - DNA, 23 bp, Homo sapiens
atggacaccccttatccaggact

SEQ ID NO: 5270064 - DNA, 22 bp, Homo sapiens
atggacactacacccagcaata

SEQ ID NO: 5270065 - DNA, 13 bp, Homo sapiens
atggacactccag

SEQ ID NO: 5270066 - DNA, 17 bp, Homo sapiens
atggacactccagtgcc

SEQ ID NO: 5270067 - DNA, 14 bp, Homo sapiens
atggacacttttca

SEQ ID NO: 5270068 - DNA, 16 bp, Homo sapiens
atggacacttttcacc

SEQ ID NO: 5270069 - DNA, 13 bp, Homo sapiens
atggacagaattt

SEQ ID NO: 5270070 - DNA, 11 bp, Homo sapiens
atggacagaca

SEQ ID NO: 5270071 - DNA, 15 bp, Homo sapiens
atggacagacacctc

SEQ ID NO: 5270072 - DNA, 17 bp, Homo sapiens
atggacagacacctccc

SEQ ID NO: 5270073 - DNA, 19 bp, Homo sapiens
atggacagacacctccccc

SEQ ID NO: 5270074 - DNA, 13 bp, Homo sapiens
atggacagacaga

SEQ ID NO: 5270075 - DNA, 12 bp, Homo sapiens
atggacagatgg

SEQ ID NO: 5270076 - DNA, 18 bp, Homo sapiens
atggacagatggaccaaa

SEQ ID NO: 5270077 - DNA, 14 bp, Homo sapiens
atggacagattaat

SEQ ID NO: 5270078 - DNA, 14 bp, Homo sapiens
atggacaggctggc

SEQ ID NO: 5270079 - DNA, 18 bp, Homo sapiens
atggacagggccagggtt

SEQ ID NO: 5270080 - DNA, 21 bp, Homo sapiens
atggacagtgggcatcagcag

SEQ ID NO: 5270081 - DNA, 22 bp, Homo sapiens
atggacagttcacaccctgcaa

SEQ ID NO: 5270082 - DNA, 19 bp, Homo sapiens
atggacagtttgtttcctg

SEQ ID NO: 5270083 - DNA, 23 bp, Homo sapiens
atggacatcctgtataagcactg

SEQ ID NO: 5270084 - DNA, 18 bp, Homo sapiens
atggacatcgatatgaaa

SEQ ID NO: 5270085 - DNA, 12 bp, Homo sapiens
atggacatcttg

SEQ ID NO: 5270086 - DNA, 17 bp, Homo sapiens
atggacatttagaagaa

SEQ ID NO: 5270087 - DNA, 13 bp, Homo sapiens
atggacattttgg

SEQ ID NO: 5270088 - DNA, 13 bp, Homo sapiens
atggaccaaagcc

SEQ ID NO: 5270089 - DNA, 14 bp, Homo sapiens
atggaccaaagcca

SEQ ID NO: 5270090 - DNA, 22 bp, Homo sapiens
atggaccaaagccacctgctgc

SEQ ID NO: 5270091 - DNA, 17 bp, Homo sapiens
atggaccaaatgtaaaa

SEQ ID NO: 5270092 - DNA, 18 bp, Homo sapiens
atggaccacagtgactta

SEQ ID NO: 5270093 - DNA, 22 bp, Homo sapiens
atggaccacgaatattctttct

SEQ ID NO: 5270094 - DNA, 12 bp, Homo sapiens
atggaccacttt

SEQ ID NO: 5270095 - DNA, 18 bp, Homo sapiens
atggacccaatgcacaca

SEQ ID NO: 5270096 - DNA, 22 bp, Homo sapiens
atggacccacgaacgctcttag

SEQ ID NO: 5270097 - DNA, 21 bp, Homo sapiens
atggacccactacccttctcc

SEQ ID NO: 5270098 - DNA, 22 bp, Homo sapiens
atggacccactacccttctcct

SEQ ID NO: 5270099 - DNA, 13 bp, Homo sapiens
atggacccctccc

SEQ ID NO: 5270100 - DNA, 19 bp, Homo sapiens
atggacccctcccttgctc

SEQ ID NO: 5270101 - DNA, 14 bp, Homo sapiens
atggaccctcgcag

SEQ ID NO: 5270102 - DNA, 13 bp, Homo sapiens
atggaccggagag

SEQ ID NO: 5270103 - DNA, 12 bp, Homo sapiens
atggacctaaca

SEQ ID NO: 5270104 - DNA, 13 bp, Homo sapiens
atggacctaacat

SEQ ID NO: 5270105 - DNA, 18 bp, Homo sapiens
atggacctcagcaagctg

SEQ ID NO: 5270106 - DNA, 21 bp, Homo sapiens
atggacctcagcaagctgccc

SEQ ID NO: 5270107 - DNA, 19 bp, Homo sapiens
atggacctccaggctccag

SEQ ID NO: 5270108 - DNA, 21 bp, Homo sapiens
atggacctctcagcagaaaca

SEQ ID NO: 5270109 - DNA, 13 bp, Homo sapiens
atggacctgcact

SEQ ID NO: 5270110 - DNA, 18 bp, Homo sapiens
atggacctggtgcccctg

SEQ ID NO: 5270111 - DNA, 15 bp, Homo sapiens
atggaccttctagaa

SEQ ID NO: 5270112 - DNA, 19 bp, Homo sapiens
atggacgaatatgaatgtc

SEQ ID NO: 5270113 - DNA, 13 bp, Homo sapiens
atggacgcaggcc

SEQ ID NO: 5270114 - DNA, 15 bp, Homo sapiens
atggacgcctggctc

SEQ ID NO: 5270115 - DNA, 16 bp, Homo sapiens
atggacgcctggctcc

SEQ ID NO: 5270116 - DNA, 18 bp, Homo sapiens
atggacgctgccgggaga

SEQ ID NO: 5270117 - DNA, 20 bp, Homo sapiens
atggacgtgttatgactcca

SEQ ID NO: 5270118 - DNA, 19 bp, Homo sapiens
atggactaacttgtctttg

SEQ ID NO: 5270119 - DNA, 20 bp, Homo sapiens
atggactaagtgggagaaat

SEQ ID NO: 5270120 - DNA, 17 bp, Homo sapiens
atggactatctgtctgg

SEQ ID NO: 5270121 - DNA, 20 bp, Homo sapiens
atggactatctgtctggtgg

SEQ ID NO: 5270122 - DNA, 21 bp, Homo sapiens
atggactatctgtctggtggc

SEQ ID NO: 5270123 - DNA, 18 bp, Homo sapiens
atggactcagaaactcca

SEQ ID NO: 5270124 - DNA, 17 bp, Homo sapiens
atggactcagccttgca

SEQ ID NO: 5270125 - DNA, 19 bp, Homo sapiens
atggactcagctctgtctg

SEQ ID NO: 5270126 - DNA, 19 bp, Homo sapiens
atggactcaggatccagtg

SEQ ID NO: 5270127 - DNA, 21 bp, Homo sapiens
atggactcaggatccagtgac

SEQ ID NO: 5270128 - DNA, 23 bp, Homo sapiens
atggactcatggcttagaaatct

SEQ ID NO: 5270129 - DNA, 18 bp, Homo sapiens
atggactctgaaaaacat

SEQ ID NO: 5270130 - DNA, 18 bp, Homo sapiens
atggactctgggtttcat

SEQ ID NO: 5270131 - DNA, 13 bp, Homo sapiens
atggactcttctc

SEQ ID NO: 5270132 - DNA, 16 bp, Homo sapiens
atggactcttctcggc

SEQ ID NO: 5270133 - DNA, 21 bp, Homo sapiens
atggactcttctcggctcagg

SEQ ID NO: 5270134 - DNA, 16 bp, Homo sapiens
atggactgatgctttt

SEQ ID NO: 5270135 - DNA, 21 bp, Homo sapiens
atggactgggaggagggggag

SEQ ID NO: 5270136 - DNA, 17 bp, Homo sapiens
atggactggtttgagat

SEQ ID NO: 5270137 - DNA, 19 bp, Homo sapiens
atggactgtacaataagtt

SEQ ID NO: 5270138 - DNA, 17 bp, Homo sapiens
atggactgtgaatttca

SEQ ID NO: 5270139 - DNA, 23 bp, Homo sapiens
atggacttaattatgctaacaaa

SEQ ID NO: 5270140 - DNA, 18 bp, Homo sapiens
atggacttatttcttcaa

SEQ ID NO: 5270141 - DNA, 20 bp, Homo sapiens
atggacttatttcttcaaat

SEQ ID NO: 5270142 - DNA, 17 bp, Homo sapiens
atggacttgcttcttgt

SEQ ID NO: 5270143 - DNA, 17 bp, Homo sapiens
atggacttgtatatttg

SEQ ID NO: 5270144 - DNA, 21 bp, Homo sapiens
atggacttgtgattggctgca

SEQ ID NO: 5270145 - DNA, 11 bp, Homo sapiens
atggactttgt

SEQ ID NO: 5270146 - DNA, 12 bp, Homo sapiens
atggactttgtt

SEQ ID NO: 5270147 - DNA, 20 bp, Homo sapiens
atggacttttgggggttgga

SEQ ID NO: 5270148 - DNA, 21 bp, Homo sapiens
atggacttttgttcatgggag

SEQ ID NO: 5270149 - DNA, 17 bp, Homo sapiens
atggagaaaatgaatgg

SEQ ID NO: 5270150 - DNA, 18 bp, Homo sapiens
atggagaaaatgaatgga

SEQ ID NO: 5270151 - DNA, 16 bp, Homo sapiens
atggagaaacaggccc

SEQ ID NO: 5270152 - DNA, 18 bp, Homo sapiens
atggagaaacaggcccag

SEQ ID NO: 5270153 - DNA, 20 bp, Homo sapiens
atggagaaacaggcccagag

SEQ ID NO: 5270154 - DNA, 20 bp, Homo sapiens
atggagaaacatcctaagtg

SEQ ID NO: 5270155 - DNA, 14 bp, Homo sapiens
atggagaaaccctg

SEQ ID NO: 5270156 - DNA, 14 bp, Homo sapiens
atggagaaagaagt

SEQ ID NO: 5270157 - DNA, 14 bp, Homo sapiens
atggagaaagctga

SEQ ID NO: 5270158 - DNA, 22 bp, Homo sapiens
atggagaaagtaagtctttttt

SEQ ID NO: 5270159 - DNA, 22 bp, Homo sapiens
atggagaaatgaagcagaggaa

SEQ ID NO: 5270160 - DNA, 22 bp, Homo sapiens
atggagaagaaaggccatcaga

SEQ ID NO: 5270161 - DNA, 22 bp, Homo sapiens
atggagaagcagaaatacatat

SEQ ID NO: 5270162 - DNA, 16 bp, Homo sapiens
atggagaagctgcagg

SEQ ID NO: 5270163 - DNA, 15 bp, Homo sapiens
atggagaaggaaggc

SEQ ID NO: 5270164 - DNA, 20 bp, Homo sapiens
atggagaatacagaaacatt

SEQ ID NO: 5270165 - DNA, 12 bp, Homo sapiens
atggagaatggg

SEQ ID NO: 5270166 - DNA, 21 bp, Homo sapiens
atggagaatggtgttccattg

SEQ ID NO: 5270167 - DNA, 17 bp, Homo sapiens
atggagaattgctgaag

SEQ ID NO: 5270168 - DNA, 17 bp, Homo sapiens
atggagacaccctctgg

SEQ ID NO: 5270169 - DNA, 19 bp, Homo sapiens
atggagacaccctctgggg

SEQ ID NO: 5270170 - DNA, 20 bp, Homo sapiens
atggagacgtggtgggactc

SEQ ID NO: 5270171 - DNA, 14 bp, Homo sapiens
attattctctttta

SEQ ID NO: 5270172 - DNA, 12 bp, Homo sapiens
attattcttcag

SEQ ID NO: 5270173 - DNA, 15 bp, Homo sapiens
attattcttcttaca

SEQ ID NO: 5270174 - DNA, 13 bp, Homo sapiens
attattcttgtag

SEQ ID NO: 5270175 - DNA, 20 bp, Homo sapiens
attattctttctcctttttt

SEQ ID NO: 5270176 - DNA, 14 bp, Homo sapiens
attattctttgaaa

SEQ ID NO: 5270177 - DNA, 15 bp, Homo sapiens
attattctttgaaaa

SEQ ID NO: 5270178 - DNA, 12 bp, Homo sapiens
attattgacact

SEQ ID NO: 5270179 - DNA, 15 bp, Homo sapiens
attattgacactgaa

SEQ ID NO: 5270180 - DNA, 16 bp, Homo sapiens
attattgacactgaac

SEQ ID NO: 5270181 - DNA, 20 bp, Homo sapiens
attattgagttccagttgaa

SEQ ID NO: 5270182 - DNA, 15 bp, Homo sapiens
attattgatagtact

SEQ ID NO: 5270183 - DNA, 17 bp, Homo sapiens
attattgatagtactct

SEQ ID NO: 5270184 - DNA, 15 bp, Homo sapiens
attattgatatatat

SEQ ID NO: 5270185 - DNA, 12 bp, Homo sapiens
attattgatgat

SEQ ID NO: 5270186 - DNA, 16 bp, Homo sapiens
attattgcactagaga

SEQ ID NO: 5270187 - DNA, 20 bp, Homo sapiens
attattgcactagagaaaat

SEQ ID NO: 5270188 - DNA, 22 bp, Homo sapiens
attattgcactagagaaaataa

SEQ ID NO: 5270189 - DNA, 23 bp, Homo sapiens
attattgctatatttgctaatac

SEQ ID NO: 5270190 - DNA, 13 bp, Homo sapiens
attattgctgttg

SEQ ID NO: 5270191 - DNA, 20 bp, Homo sapiens
attattggaatataattgtt

SEQ ID NO: 5270192 - DNA, 17 bp, Homo sapiens
attattggacttccatt

SEQ ID NO: 5270193 - DNA, 17 bp, Homo sapiens
attattggcttgcactt

SEQ ID NO: 5270194 - DNA, 18 bp, Homo sapiens
attattgggcttaatata

SEQ ID NO: 5270195 - DNA, 17 bp, Homo sapiens
attattggtatatttgt

SEQ ID NO: 5270196 - DNA, 15 bp, Homo sapiens
attattgtaaacttt

SEQ ID NO: 5270197 - DNA, 14 bp, Homo sapiens
attattgtaaagtt

SEQ ID NO: 5270198 - DNA, 12 bp, Homo sapiens
attattgtaagt

SEQ ID NO: 5270199 - DNA, 15 bp, Homo sapiens
attattgtaagttgt

SEQ ID NO: 5270200 - DNA, 18 bp, Homo sapiens
attattgtaagttgtaca

SEQ ID NO: 5270201 - DNA, 20 bp, Homo sapiens
attattgtaagttgtacaaa

SEQ ID NO: 5270202 - DNA, 16 bp, Homo sapiens
attattgtagagaaaa

SEQ ID NO: 5270203 - DNA, 22 bp, Homo sapiens
attattgtcctttgattccaaa

SEQ ID NO: 5270204 - DNA, 17 bp, Homo sapiens
attattgtgacttcact

SEQ ID NO: 5270205 - DNA, 19 bp, Homo sapiens
attattgtgacttcactgt

SEQ ID NO: 5270206 - DNA, 21 bp, Homo sapiens
attattgtgacttcactgtat

SEQ ID NO: 5270207 - DNA, 23 bp, Homo sapiens
attattgtgtgttatttaaatga

SEQ ID NO: 5270208 - DNA, 22 bp, Homo sapiens
attatttaaaccgctaaaagaa

SEQ ID NO: 5270209 - DNA, 19 bp, Homo sapiens
attatttaaactcgctcct

SEQ ID NO: 5270210 - DNA, 11 bp, Homo sapiens
attatttaaag

SEQ ID NO: 5270211 - DNA, 16 bp, Homo sapiens
attatttaaatgcttt

SEQ ID NO: 5270212 - DNA, 13 bp, Homo sapiens
attatttaactct

SEQ ID NO: 5270213 - DNA, 21 bp, Homo sapiens
attatttaactcttaactgaa

SEQ ID NO: 5270214 - DNA, 13 bp, Homo sapiens
attatttaataaa

SEQ ID NO: 5270215 - DNA, 14 bp, Homo sapiens
attatttaataaca

SEQ ID NO: 5270216 - DNA, 22 bp, Homo sapiens
attatttaataacattacctta

SEQ ID NO: 5270217 - DNA, 12 bp, Homo sapiens
attatttaatgt

SEQ ID NO: 5270218 - DNA, 14 bp, Homo sapiens
attatttacaatgc

SEQ ID NO: 5270219 - DNA, 21 bp, Homo sapiens
attatttacaatgcagaattt

SEQ ID NO: 5270220 - DNA, 14 bp, Homo sapiens
attatttagtaaaa

SEQ ID NO: 5270221 - DNA, 15 bp, Homo sapiens
attatttagtaaaat

SEQ ID NO: 5270222 - DNA, 15 bp, Homo sapiens
attatttagtcaatt

SEQ ID NO: 5270223 - DNA, 14 bp, Homo sapiens
attatttatgacct

SEQ ID NO: 5270224 - DNA, 15 bp, Homo sapiens
attatttatgacctg

SEQ ID NO: 5270225 - DNA, 12 bp, Homo sapiens
attatttatgta

SEQ ID NO: 5270226 - DNA, 16 bp, Homo sapiens
attatttatgtatggt

SEQ ID NO: 5270227 - DNA, 14 bp, Homo sapiens
attatttatgtatt

SEQ ID NO: 5270228 - DNA, 15 bp, Homo sapiens
attatttatgtattg

SEQ ID NO: 5270229 - DNA, 23 bp, Homo sapiens
attatttattacttgtgcactta

SEQ ID NO: 5270230 - DNA, 13 bp, Homo sapiens
attatttattatt

SEQ ID NO: 5270231 - DNA, 21 bp, Homo sapiens
attatttattgtattaggaaa

SEQ ID NO: 5270232 - DNA, 14 bp, Homo sapiens
attatttattgtta

SEQ ID NO: 5270233 - DNA, 20 bp, Homo sapiens
attatttatttctggtaact

SEQ ID NO: 5270234 - DNA, 21 bp, Homo sapiens
attatttcaaccgcttgccat

SEQ ID NO: 5270235 - DNA, 22 bp, Homo sapiens
attatttcaaccgcttgccata

SEQ ID NO: 5270236 - DNA, 21 bp, Homo sapiens
attatttcactttagatgctg

SEQ ID NO: 5270237 - DNA, 20 bp, Homo sapiens
attatttcagattcctcagt

SEQ ID NO: 5270238 - DNA, 12 bp, Homo sapiens
attatttcagtg

SEQ ID NO: 5270239 - DNA, 13 bp, Homo sapiens
attatttcagtgt

SEQ ID NO: 5270240 - DNA, 19 bp, Homo sapiens
attatttcatatactataa

SEQ ID NO: 5270241 - DNA, 22 bp, Homo sapiens
attatttcatatactataattg

SEQ ID NO: 5270242 - DNA, 12 bp, Homo sapiens
attatttctaaa

SEQ ID NO: 5270243 - DNA, 19 bp, Homo sapiens
attatttctaatccttttc

SEQ ID NO: 5270244 - DNA, 16 bp, Homo sapiens
attatttctaggaaga

SEQ ID NO: 5270245 - DNA, 22 bp, Homo sapiens
attatttctgtcacagtaaaaa

SEQ ID NO: 5270246 - DNA, 13 bp, Homo sapiens
attatttcttctc

SEQ ID NO: 5270247 - DNA, 15 bp, Homo sapiens
attatttcttctctt

SEQ ID NO: 5270248 - DNA, 23 bp, Homo sapiens
attatttgaaaacatataaagca

SEQ ID NO: 5270249 - DNA, 16 bp, Homo sapiens
attatttgaatgacta

SEQ ID NO: 5270250 - DNA, 15 bp, Homo sapiens
attatttgattattt

SEQ ID NO: 5270251 - DNA, 19 bp, Homo sapiens
attatttgattatttaaga

SEQ ID NO: 5270252 - DNA, 22 bp, Homo sapiens
attatttgattatttaagacta

SEQ ID NO: 5270253 - DNA, 15 bp, Homo sapiens
attatttgcagctgc

SEQ ID NO: 5270254 - DNA, 11 bp, Homo sapiens
attatttgcat

SEQ ID NO: 5270255 - DNA, 14 bp, Homo sapiens
attatttgcatgtt

SEQ ID NO: 5270256 - DNA, 21 bp, Homo sapiens
attatttgcatgttatgttta

SEQ ID NO: 5270257 - DNA, 19 bp, Homo sapiens
attatttgccttctgaaat

SEQ ID NO: 5270258 - DNA, 12 bp, Homo sapiens
attatttgctat

SEQ ID NO: 5270259 - DNA, 12 bp, Homo sapiens
attatttgcttt

SEQ ID NO: 5270260 - DNA, 23 bp, Homo sapiens
attatttggagcctgccaagagg

SEQ ID NO: 5270261 - DNA, 11 bp, Homo sapiens
attatttggca

SEQ ID NO: 5270262 - DNA, 23 bp, Homo sapiens
attatttggcagtttggtatttg

SEQ ID NO: 5270263 - DNA, 21 bp, Homo sapiens
attatttgggggaactggaca

SEQ ID NO: 5270264 - DNA, 12 bp, Homo sapiens
attatttgtgca

SEQ ID NO: 5270265 - DNA, 13 bp, Homo sapiens
attatttgtgcat

SEQ ID NO: 5270266 - DNA, 22 bp, Homo sapiens
attatttgttatttgtacagtt

SEQ ID NO: 5270267 - DNA, 14 bp, Homo sapiens
attattttaaaaat

SEQ ID NO: 5270268 - DNA, 13 bp, Homo sapiens
attattttaaaag

SEQ ID NO: 5270269 - DNA, 14 bp, Homo sapiens
attattttaaaaga

SEQ ID NO: 5270270 - DNA, 17 bp, Homo sapiens
attattttaaaatatat

SEQ ID NO: 5270271 - DNA, 17 bp, Homo sapiens
attattttaaaatattt

SEQ ID NO: 5270272 - DNA, 15 bp, Homo sapiens
attattttaaacaaa

SEQ ID NO: 5270273 - DNA, 18 bp, Homo sapiens
attattttaaattataag

SEQ ID NO: 5270274 - DNA, 20 bp, Homo sapiens
attattttaaattataagga

SEQ ID NO: 5270275 - DNA, 16 bp, Homo sapiens
attattttaaatttct

SEQ ID NO: 5270276 - DNA, 17 bp, Homo sapiens
attattttaaatttctt

SEQ ID NO: 5270277 - DNA, 13 bp, Homo sapiens
attattttaacaa

SEQ ID NO: 5270278 - DNA, 17 bp, Homo sapiens
attattttaatatttat

SEQ ID NO: 5270279 - DNA, 16 bp, Homo sapiens
attattttaatatttt

SEQ ID NO: 5270280 - DNA, 18 bp, Homo sapiens
attattttaatattttgt

SEQ ID NO: 5270281 - DNA, 18 bp, Homo sapiens
attattttaattaggtta

SEQ ID NO: 5270282 - DNA, 19 bp, Homo sapiens
attattttaattttttctc

SEQ ID NO: 5270283 - DNA, 13 bp, Homo sapiens
attattttacagt

SEQ ID NO: 5270284 - DNA, 14 bp, Homo sapiens
attattttacagtc

SEQ ID NO: 5270285 - DNA, 19 bp, Homo sapiens
attattttagcttcagttg

SEQ ID NO: 5270286 - DNA, 20 bp, Homo sapiens
attattttagcttcagttgt

SEQ ID NO: 5270287 - DNA, 20 bp, Homo sapiens
attattttagtctgtcatcc

SEQ ID NO: 5270288 - DNA, 16 bp, Homo sapiens
attattttagtgtgta

SEQ ID NO: 5270289 - DNA, 20 bp, Homo sapiens
attattttagtgtgtaaaat

SEQ ID NO: 5270290 - DNA, 22 bp, Homo sapiens
attattttagtgtgtaaaatta

SEQ ID NO: 5270291 - DNA, 13 bp, Homo sapiens
attattttatatc

SEQ ID NO: 5270292 - DNA, 16 bp, Homo sapiens
attattttatgttgca

SEQ ID NO: 5270293 - DNA, 21 bp, Homo sapiens
attattttattatgaaacttg

SEQ ID NO: 5270294 - DNA, 16 bp, Homo sapiens
attattttattgtgta

SEQ ID NO: 5270295 - DNA, 17 bp, Homo sapiens
attattttcaaaggaaa

SEQ ID NO: 5270296 - DNA, 14 bp, Homo sapiens
attattttcattac

SEQ ID NO: 5270297 - DNA, 20 bp, Homo sapiens
attattttcccatttgctgt

SEQ ID NO: 5270298 - DNA, 10 bp, Homo sapiens
attattttct

SEQ ID NO: 5270299 - DNA, 16 bp, Homo sapiens
attattttctatagct

SEQ ID NO: 5270300 - DNA, 18 bp, Homo sapiens
attattttctatatttgg

SEQ ID NO: 5270301 - DNA, 12 bp, Homo sapiens
attattttctcc

SEQ ID NO: 5270302 - DNA, 19 bp, Homo sapiens
attattttctccaaataaa

SEQ ID NO: 5270303 - DNA, 14 bp, Homo sapiens
attattttctgtca

SEQ ID NO: 5270304 - DNA, 15 bp, Homo sapiens
attattttctgtcag

SEQ ID NO: 5270305 - DNA, 16 bp, Homo sapiens
attattttgaaacttt

SEQ ID NO: 5270306 - DNA, 23 bp, Homo sapiens
attattttgaggtagaggaaaat

SEQ ID NO: 5270307 - DNA, 12 bp, Homo sapiens
attattttgatg

SEQ ID NO: 5270308 - DNA, 12 bp, Homo sapiens
attattttgggg

SEQ ID NO: 5270309 - DNA, 22 bp, Homo sapiens
attattttggggtctcttttgt

SEQ ID NO: 5270310 - DNA, 19 bp, Homo sapiens
attattttggtacttttat

SEQ ID NO: 5270311 - DNA, 22 bp, Homo sapiens
attattttgtggttctatttta

SEQ ID NO: 5270312 - DNA, 16 bp, Homo sapiens
attattttgttcatac

SEQ ID NO: 5270313 - DNA, 19 bp, Homo sapiens
attattttgttcatacata

SEQ ID NO: 5270314 - DNA, 18 bp, Homo sapiens
attattttgttgtgattt

SEQ ID NO: 5270315 - DNA, 11 bp, Homo sapiens
attatttttca

SEQ ID NO: 5270316 - DNA, 20 bp, Homo sapiens
attatttttcaagtaataaa

SEQ ID NO: 5270317 - DNA, 13 bp, Homo sapiens
attatttttctcc

SEQ ID NO: 5270318 - DNA, 15 bp, Homo sapiens
attatttttctctct

SEQ ID NO: 5270319 - DNA, 20 bp, Homo sapiens
attatttttcttttaaagat

SEQ ID NO: 5270320 - DNA, 14 bp, Homo sapiens
attatttttgtgtt

SEQ ID NO: 5270321 - DNA, 20 bp, Homo sapiens
attatttttgtgtttctaaa

SEQ ID NO: 5270322 - DNA, 14 bp, Homo sapiens
attattttttatga

SEQ ID NO: 5270323 - DNA, 13 bp, Homo sapiens
attattttttcag

SEQ ID NO: 5270324 - DNA, 16 bp, Homo sapiens
attattttttcagacc

SEQ ID NO: 5270325 - DNA, 17 bp, Homo sapiens
attattttttcagaccg

SEQ ID NO: 5270326 - DNA, 21 bp, Homo sapiens
attattttttcagaccgaaaa

SEQ ID NO: 5270327 - DNA, 14 bp, Homo sapiens
attattttttgcat

SEQ ID NO: 5270328 - DNA, 19 bp, Homo sapiens
attatttttttaaaatttt

SEQ ID NO: 5270329 - DNA, 21 bp, Homo sapiens
attatttttttaaaattttgt

SEQ ID NO: 5270330 - DNA, 22 bp, Homo sapiens
attatttttttaaaattttgta

SEQ ID NO: 5270331 - DNA, 17 bp, Homo sapiens
attatttttttaaactt

SEQ ID NO: 5270332 - DNA, 16 bp, Homo sapiens
attcaaaaacaggttt

SEQ ID NO: 5270333 - DNA, 19 bp, Homo sapiens
attcaaaaacatggccaca

SEQ ID NO: 5270334 - DNA, 22 bp, Homo sapiens
attcaaaaagacagcagacaaa

SEQ ID NO: 5270335 - DNA, 12 bp, Homo sapiens
attcaaaaagtc

SEQ ID NO: 5270336 - DNA, 20 bp, Homo sapiens
attcaaaaataaattagaaa

SEQ ID NO: 5270337 - DNA, 18 bp, Homo sapiens
attcaaaaattatatttt

SEQ ID NO: 5270338 - DNA, 16 bp, Homo sapiens
attcaaaaattatcta

SEQ ID NO: 5270339 - DNA, 23 bp, Homo sapiens
attcaaaaattatctatagctaa

SEQ ID NO: 5270340 - DNA, 15 bp, Homo sapiens
attcaaaaatttcac

SEQ ID NO: 5270341 - DNA, 14 bp, Homo sapiens
attcaaaagattaa

SEQ ID NO: 5270342 - DNA, 21 bp, Homo sapiens
attcaaaagctctctttggaa

SEQ ID NO: 5270343 - DNA, 23 bp, Homo sapiens
attcaaaagctctctttggaatg

SEQ ID NO: 5270344 - DNA, 18 bp, Homo sapiens
attcaaaatagggtatat

SEQ ID NO: 5270345 - DNA, 23 bp, Homo sapiens
attcaaaatagttctatttctat

SEQ ID NO: 5270346 - DNA, 14 bp, Homo sapiens
attcaaaatattta

SEQ ID NO: 5270347 - DNA, 16 bp, Homo sapiens
attcaaaatgatgtat

SEQ ID NO: 5270348 - DNA, 14 bp, Homo sapiens
attcaaaatgtcca

SEQ ID NO: 5270349 - DNA, 22 bp, Homo sapiens
attcaaacaattcaatcaaagc

SEQ ID NO: 5270350 - DNA, 20 bp, Homo sapiens
attcaaacagtctcaggaaa

SEQ ID NO: 5270351 - DNA, 22 bp, Homo sapiens
attcaaacagtctcaggaaatc

SEQ ID NO: 5270352 - DNA, 12 bp, Homo sapiens
atggagactctg

SEQ ID NO: 5270353 - DNA, 15 bp, Homo sapiens
atggagactctgaga

SEQ ID NO: 5270354 - DNA, 23 bp, Homo sapiens
atggagacttcaggttgttctgt

SEQ ID NO: 5270355 - DNA, 16 bp, Homo sapiens
atggagagaattaaaa

SEQ ID NO: 5270356 - DNA, 21 bp, Homo sapiens
atggagagagactcaaagaga

SEQ ID NO: 5270357 - DNA, 13 bp, Homo sapiens
atggagagagggg

SEQ ID NO: 5270358 - DNA, 20 bp, Homo sapiens
atggagagctagaacccggc

SEQ ID NO: 5270359 - DNA, 14 bp, Homo sapiens
atggagaggagaac

SEQ ID NO: 5270360 - DNA, 17 bp, Homo sapiens
atggagaggcttcccta

SEQ ID NO: 5270361 - DNA, 14 bp, Homo sapiens
atggagagtggcat

SEQ ID NO: 5270362 - DNA, 14 bp, Homo sapiens
atggagatctgaag

SEQ ID NO: 5270363 - DNA, 14 bp, Homo sapiens
atggagattaagat

SEQ ID NO: 5270364 - DNA, 17 bp, Homo sapiens
atggagattaagatgcc

SEQ ID NO: 5270365 - DNA, 20 bp, Homo sapiens
atggagattcagttttcatt

SEQ ID NO: 5270366 - DNA, 20 bp, Homo sapiens
atggagattgacctggatgg

SEQ ID NO: 5270367 - DNA, 21 bp, Homo sapiens
atggagcaaacctagccccca

SEQ ID NO: 5270368 - DNA, 13 bp, Homo sapiens
atggagcaagaga

SEQ ID NO: 5270369 - DNA, 16 bp, Homo sapiens
atggagcaagtgagca

SEQ ID NO: 5270370 - DNA, 18 bp, Homo sapiens
atggagcaagtgagcact

SEQ ID NO: 5270371 - DNA, 20 bp, Homo sapiens
atggagcacgaggccttcag

SEQ ID NO: 5270372 - DNA, 13 bp, Homo sapiens
atggagcagcccc

SEQ ID NO: 5270373 - DNA, 18 bp, Homo sapiens
atggagccagctccctct

SEQ ID NO: 5270374 - DNA, 14 bp, Homo sapiens
atggagccccacct

SEQ ID NO: 5270375 - DNA, 22 bp, Homo sapiens
atggagcccccagatagagctg

SEQ ID NO: 5270376 - DNA, 15 bp, Homo sapiens
atggagcctcttctg

SEQ ID NO: 5270377 - DNA, 22 bp, Homo sapiens
atggagcctgcacggtgaatgg

SEQ ID NO: 5270378 - DNA, 20 bp, Homo sapiens
atggagcctggcacaggact

SEQ ID NO: 5270379 - DNA, 23 bp, Homo sapiens
atggagcctggcacaggactgat

SEQ ID NO: 5270380 - DNA, 17 bp, Homo sapiens
atggagcgcacctgccc

SEQ ID NO: 5270381 - DNA, 18 bp, Homo sapiens
atggagctattttaaacc

SEQ ID NO: 5270382 - DNA, 24 bp, Homo sapiens
atggagctcacactccagtggcag

SEQ ID NO: 5270383 - DNA, 17 bp, Homo sapiens
atggagctcatgtcagc

SEQ ID NO: 5270384 - DNA, 21 bp, Homo sapiens
atggagctcatgtcagccgtg

SEQ ID NO: 5270385 - DNA, 11 bp, Homo sapiens
atggagctgag

SEQ ID NO: 5270386 - DNA, 17 bp, Homo sapiens
atggagctgtcacctct

SEQ ID NO: 5270387 - DNA, 23 bp, Homo sapiens
atggagctgtcacctctcagctg

SEQ ID NO: 5270388 - DNA, 13 bp, Homo sapiens
atggagctgtcat

SEQ ID NO: 5270389 - DNA, 16 bp, Homo sapiens
atggagcttgtacata

SEQ ID NO: 5270390 - DNA, 15 bp, Homo sapiens
atggagctttctgta

SEQ ID NO: 5270391 - DNA, 12 bp, Homo sapiens
atggaggaaaaa

SEQ ID NO: 5270392 - DNA, 18 bp, Homo sapiens
atggaggaagaactgaaa

SEQ ID NO: 5270393 - DNA, 20 bp, Homo sapiens
atggaggaagaactgaaagg

SEQ ID NO: 5270394 - DNA, 13 bp, Homo sapiens
atggaggaatatg

SEQ ID NO: 5270395 - DNA, 18 bp, Homo sapiens
atggaggaattgggacct

SEQ ID NO: 5270396 - DNA, 22 bp, Homo sapiens
atggaggaccacgtctatttca

SEQ ID NO: 5270397 - DNA, 17 bp, Homo sapiens
atggaggactccaggca

SEQ ID NO: 5270398 - DNA, 21 bp, Homo sapiens
atggaggactccaggcagcag

SEQ ID NO: 5270399 - DNA, 16 bp, Homo sapiens
atggaggactctcctc

SEQ ID NO: 5270400 - DNA, 12 bp, Homo sapiens
atggaggagaaa

SEQ ID NO: 5270401 - DNA, 13 bp, Homo sapiens
atggaggagaaat

SEQ ID NO: 5270402 - DNA, 15 bp, Homo sapiens
atggaggagaagaat

SEQ ID NO: 5270403 - DNA, 17 bp, Homo sapiens
atggaggagaagaattt

SEQ ID NO: 5270404 - DNA, 14 bp, Homo sapiens
atggaggagccagg

SEQ ID NO: 5270405 - DNA, 22 bp, Homo sapiens
atggaggagccaggccccaccc

SEQ ID NO: 5270406 - DNA, 20 bp, Homo sapiens
atggaggattctttccccag

SEQ ID NO: 5270407 - DNA, 21 bp, Homo sapiens
atggaggattctttccccaga

SEQ ID NO: 5270408 - DNA, 12 bp, Homo sapiens
atggaggcacac

SEQ ID NO: 5270409 - DNA, 19 bp, Homo sapiens
atggaggcacacagctgca

SEQ ID NO: 5270410 - DNA, 12 bp, Homo sapiens
atggaggcaggc

SEQ ID NO: 5270411 - DNA, 19 bp, Homo sapiens
atggaggcaggctccccct

SEQ ID NO: 5270412 - DNA, 22 bp, Homo sapiens
atggaggccagagtctcccagt

SEQ ID NO: 5270413 - DNA, 20 bp, Homo sapiens
atggaggccctcctgtgctg

SEQ ID NO: 5270414 - DNA, 18 bp, Homo sapiens
atggaggcgccttcctgg

SEQ ID NO: 5270415 - DNA, 14 bp, Homo sapiens
atggaggctgcagc

SEQ ID NO: 5270416 - DNA, 16 bp, Homo sapiens
atggagggaataatac

SEQ ID NO: 5270417 - DNA, 21 bp, Homo sapiens
atggagggattattcttccag

SEQ ID NO: 5270418 - DNA, 18 bp, Homo sapiens
atggagggcttggcccag

SEQ ID NO: 5270419 - DNA, 22 bp, Homo sapiens
atggaggggagaggggtcacac

SEQ ID NO: 5270420 - DNA, 18 bp, Homo sapiens
atggagggggctggggtc

SEQ ID NO: 5270421 - DNA, 22 bp, Homo sapiens
atggagggggctggggtcacag

SEQ ID NO: 5270422 - DNA, 19 bp, Homo sapiens
atggagggtatactgaggg

SEQ ID NO: 5270423 - DNA, 23 bp, Homo sapiens
atggagggtatactgaggggtct

SEQ ID NO: 5270424 - DNA, 12 bp, Homo sapiens
atggagggtggg

SEQ ID NO: 5270425 - DNA, 22 bp, Homo sapiens
atggagggtggggccgggtgaa

SEQ ID NO: 5270426 - DNA, 21 bp, Homo sapiens
atggaggtagggctggctgga

SEQ ID NO: 5270427 - DNA, 21 bp, Homo sapiens
atggaggtcccagccctgggg

SEQ ID NO: 5270428 - DNA, 18 bp, Homo sapiens
atggaggtgatgaaaacc

SEQ ID NO: 5270429 - DNA, 17 bp, Homo sapiens
atggagtaatggtcacg

SEQ ID NO: 5270430 - DNA, 12 bp, Homo sapiens
atggagtacatg

SEQ ID NO: 5270431 - DNA, 22 bp, Homo sapiens
atggagtagacccctggctggt

SEQ ID NO: 5270432 - DNA, 21 bp, Homo sapiens
atggagtaggtaccatttgtg

SEQ ID NO: 5270433 - DNA, 13 bp, Homo sapiens
atggagtcatctt

SEQ ID NO: 5270434 - DNA, 21 bp, Homo sapiens
atggagtccagacctgggccc

SEQ ID NO: 5270435 - DNA, 22 bp, Homo sapiens
atggagtccagacctgggccct

SEQ ID NO: 5270436 - DNA, 20 bp, Homo sapiens
atggagtccagggaagagaa

SEQ ID NO: 5270437 - DNA, 21 bp, Homo sapiens
atggagtcttgctctgtcacc

SEQ ID NO: 5270438 - DNA, 20 bp, Homo sapiens
atggagtcttttctgttatt

SEQ ID NO: 5270439 - DNA, 18 bp, Homo sapiens
atggagtgcaccaaagag

SEQ ID NO: 5270440 - DNA, 19 bp, Homo sapiens
atggagtgctgttttgtta

SEQ ID NO: 5270441 - DNA, 17 bp, Homo sapiens
atggagtggcagcccag

SEQ ID NO: 5270442 - DNA, 16 bp, Homo sapiens
atggagtgtacaagta

SEQ ID NO: 5270443 - DNA, 12 bp, Homo sapiens
atggagtgtgca

SEQ ID NO: 5270444 - DNA, 18 bp, Homo sapiens
atggagtgtgcagacagc

SEQ ID NO: 5270445 - DNA, 19 bp, Homo sapiens
atggagtgtgcgtgtgtgc

SEQ ID NO: 5270446 - DNA, 15 bp, Homo sapiens
atggagtgtttgaaa

SEQ ID NO: 5270447 - DNA, 20 bp, Homo sapiens
atggagtgtttgaaaactga

SEQ ID NO: 5270448 - DNA, 12 bp, Homo sapiens
atggagttaaat

SEQ ID NO: 5270449 - DNA, 19 bp, Homo sapiens
atggagttaacatcatgaa

SEQ ID NO: 5270450 - DNA, 15 bp, Homo sapiens
atggagtttctctct

SEQ ID NO: 5270451 - DNA, 16 bp, Homo sapiens
atggagtttctctctt

SEQ ID NO: 5270452 - DNA, 18 bp, Homo sapiens
atggataaatattggttg

SEQ ID NO: 5270453 - DNA, 14 bp, Homo sapiens
atggataaatcagt

SEQ ID NO: 5270454 - DNA, 14 bp, Homo sapiens
atggataatctgag

SEQ ID NO: 5270455 - DNA, 16 bp, Homo sapiens
atggataatctgagca

SEQ ID NO: 5270456 - DNA, 18 bp, Homo sapiens
atggataatctgagcagg

SEQ ID NO: 5270457 - DNA, 14 bp, Homo sapiens
atggataatcttcg

SEQ ID NO: 5270458 - DNA, 21 bp, Homo sapiens
atggataatgccggtgagaat

SEQ ID NO: 5270459 - DNA, 14 bp, Homo sapiens
atggatagaaaaaa

SEQ ID NO: 5270460 - DNA, 21 bp, Homo sapiens
atggatagaaaaaaactaaag

SEQ ID NO: 5270461 - DNA, 14 bp, Homo sapiens
atggatagattgtt

SEQ ID NO: 5270462 - DNA, 17 bp, Homo sapiens
atggataggcacaggaa

SEQ ID NO: 5270463 - DNA, 22 bp, Homo sapiens
atggatatagttttacttttaa

SEQ ID NO: 5270464 - DNA, 19 bp, Homo sapiens
atggatatatttgaaatag

SEQ ID NO: 5270465 - DNA, 13 bp, Homo sapiens
atggatatgctgc

SEQ ID NO: 5270466 - DNA, 14 bp, Homo sapiens
atggatatgctgct

SEQ ID NO: 5270467 - DNA, 23 bp, Homo sapiens
atggatatgtgtaaatgttatga

SEQ ID NO: 5270468 - DNA, 21 bp, Homo sapiens
atggatatgttgtattaactg

SEQ ID NO: 5270469 - DNA, 22 bp, Homo sapiens
atggatatgttgtattaactgg

SEQ ID NO: 5270470 - DNA, 18 bp, Homo sapiens
atggatattattagaaat

SEQ ID NO: 5270471 - DNA, 13 bp, Homo sapiens
atggatatttctc

SEQ ID NO: 5270472 - DNA, 15 bp, Homo sapiens
atggatcaatacaca

SEQ ID NO: 5270473 - DNA, 13 bp, Homo sapiens
atggatcagagga

SEQ ID NO: 5270474 - DNA, 19 bp, Homo sapiens
atggatcagaggagtaaat

SEQ ID NO: 5270475 - DNA, 18 bp, Homo sapiens
atggatcatgtccccctt

SEQ ID NO: 5270476 - DNA, 18 bp, Homo sapiens
atggatcccaattcattt

SEQ ID NO: 5270477 - DNA, 17 bp, Homo sapiens
atggatccccagtgaaa

SEQ ID NO: 5270478 - DNA, 13 bp, Homo sapiens
atggatcgtgttg

SEQ ID NO: 5270479 - DNA, 19 bp, Homo sapiens
atggatctgatctgtacca

SEQ ID NO: 5270480 - DNA, 14 bp, Homo sapiens
atggatctgctcca

SEQ ID NO: 5270481 - DNA, 18 bp, Homo sapiens
atggatctgctccatgca

SEQ ID NO: 5270482 - DNA, 13 bp, Homo sapiens
atggatcttgctg

SEQ ID NO: 5270483 - DNA, 21 bp, Homo sapiens
atggatgaatctcccactcca

SEQ ID NO: 5270484 - DNA, 17 bp, Homo sapiens
atggatgaattatgata

SEQ ID NO: 5270485 - DNA, 15 bp, Homo sapiens
atggatgacaaagaa

SEQ ID NO: 5270486 - DNA, 17 bp, Homo sapiens
atggatgagtcagacac

SEQ ID NO: 5270487 - DNA, 15 bp, Homo sapiens
atggatgattaaatt

SEQ ID NO: 5270488 - DNA, 14 bp, Homo sapiens
atggatgcagaaat

SEQ ID NO: 5270489 - DNA, 16 bp, Homo sapiens
atggatgcagaaatga

SEQ ID NO: 5270490 - DNA, 12 bp, Homo sapiens
atggatgcattt

SEQ ID NO: 5270491 - DNA, 17 bp, Homo sapiens
atggatgcatttcaaat

SEQ ID NO: 5270492 - DNA, 19 bp, Homo sapiens
atggatgcatttcaaatgt

SEQ ID NO: 5270493 - DNA, 23 bp, Homo sapiens
atggatgccaatattaaatctgc

SEQ ID NO: 5270494 - DNA, 14 bp, Homo sapiens
atggatgctgggga

SEQ ID NO: 5270495 - DNA, 21 bp, Homo sapiens
atggatggaaaacgctctcta

SEQ ID NO: 5270496 - DNA, 20 bp, Homo sapiens
atggatggaaatatgttcta

SEQ ID NO: 5270497 - DNA, 24 bp, Homo sapiens
atggatggaaatatgttctaacag

SEQ ID NO: 5270498 - DNA, 13 bp, Homo sapiens
atggatggacaga

SEQ ID NO: 5270499 - DNA, 17 bp, Homo sapiens
atggatggacagaatga

SEQ ID NO: 5270500 - DNA, 22 bp, Homo sapiens
atggatggagcccagttggaaa

SEQ ID NO: 5270501 - DNA, 17 bp, Homo sapiens
atggatggcaccctgga

SEQ ID NO: 5270502 - DNA, 21 bp, Homo sapiens
atggatggggcccaggggctt

SEQ ID NO: 5270503 - DNA, 13 bp, Homo sapiens
atggatgtaatat

SEQ ID NO: 5270504 - DNA, 12 bp, Homo sapiens
atggatgtagat

SEQ ID NO: 5270505 - DNA, 16 bp, Homo sapiens
atggatgtagatacag

SEQ ID NO: 5270506 - DNA, 15 bp, Homo sapiens
atggatgtttcttct

SEQ ID NO: 5270507 - DNA, 22 bp, Homo sapiens
atggatgttttagccattgttg

SEQ ID NO: 5270508 - DNA, 17 bp, Homo sapiens
atggattaaaaactgct

SEQ ID NO: 5270509 - DNA, 18 bp, Homo sapiens
atggattataatcagaat

SEQ ID NO: 5270510 - DNA, 21 bp, Homo sapiens
atggattatgttgacattttc

SEQ ID NO: 5270511 - DNA, 22 bp, Homo sapiens
atggattatgttgacattttct

SEQ ID NO: 5270512 - DNA, 20 bp, Homo sapiens
atggattcacccccctctgc

SEQ ID NO: 5270513 - DNA, 16 bp, Homo sapiens
atggattcacttctat

SEQ ID NO: 5270514 - DNA, 16 bp, Homo sapiens
atggattcagtttcta

SEQ ID NO: 5270515 - DNA, 15 bp, Homo sapiens
atggattccaaacca

SEQ ID NO: 5270516 - DNA, 16 bp, Homo sapiens
atggattccaaagcat

SEQ ID NO: 5270517 - DNA, 17 bp, Homo sapiens
atggattccaaagcatt

SEQ ID NO: 5270518 - DNA, 21 bp, Homo sapiens
atggattcccccccctttcct

SEQ ID NO: 5270519 - DNA, 14 bp, Homo sapiens
atggattctaaaat

SEQ ID NO: 5270520 - DNA, 19 bp, Homo sapiens
atggattctcagatattta

SEQ ID NO: 5270521 - DNA, 22 bp, Homo sapiens
atggattctcagatatttatat

SEQ ID NO: 5270522 - DNA, 20 bp, Homo sapiens
atggattggattatttaata

SEQ ID NO: 5270523 - DNA, 18 bp, Homo sapiens
atggattggcctccaggg

SEQ ID NO: 5270524 - DNA, 23 bp, Homo sapiens
atggattgggtatcaaaatgaat

SEQ ID NO: 5270525 - DNA, 18 bp, Homo sapiens
atggattgtacatatttt

SEQ ID NO: 5270526 - DNA, 17 bp, Homo sapiens
atggatttctttgaaaa

SEQ ID NO: 5270527 - DNA, 15 bp, Homo sapiens
atggatttgaagcaa

SEQ ID NO: 5270528 - DNA, 21 bp, Homo sapiens
atggatttgcctgtgccaccc

SEQ ID NO: 5270529 - DNA, 22 bp, Homo sapiens
atggatttggcactagccaaag

SEQ ID NO: 5270530 - DNA, 18 bp, Homo sapiens
attcaaaccaaagctgcc

SEQ ID NO: 5270531 - DNA, 22 bp, Homo sapiens
attcaaaccaatttcttccttc

SEQ ID NO: 5270532 - DNA, 18 bp, Homo sapiens
attcaaaccatttaattc

SEQ ID NO: 5270533 - DNA, 19 bp, Homo sapiens
attcaaaccatttaattca

SEQ ID NO: 5270534 - DNA, 15 bp, Homo sapiens
attcaaactgctcca

SEQ ID NO: 5270535 - DNA, 16 bp, Homo sapiens
attcaaactgctccaa

SEQ ID NO: 5270536 - DNA, 17 bp, Homo sapiens
attcaaagaaaacccta

SEQ ID NO: 5270537 - DNA, 14 bp, Homo sapiens
attcaaagaaatat

SEQ ID NO: 5270538 - DNA, 14 bp, Homo sapiens
attcaaagaatcac

SEQ ID NO: 5270539 - DNA, 14 bp, Homo sapiens
attcaaagagaaaa

SEQ ID NO: 5270540 - DNA, 19 bp, Homo sapiens
attcaaagcaccaaaataa

SEQ ID NO: 5270541 - DNA, 14 bp, Homo sapiens
attcaaagcagctg

SEQ ID NO: 5270542 - DNA, 12 bp, Homo sapiens
attcaaagcatg

SEQ ID NO: 5270543 - DNA, 18 bp, Homo sapiens
attcaaagcttgtgaaaa

SEQ ID NO: 5270544 - DNA, 16 bp, Homo sapiens
attcaaaggtatccaa

SEQ ID NO: 5270545 - DNA, 17 bp, Homo sapiens
attcaaaggttctaggt

SEQ ID NO: 5270546 - DNA, 18 bp, Homo sapiens
attcaaaggttctaggtt

SEQ ID NO: 5270547 - DNA, 21 bp, Homo sapiens
attcaaagtagttttatttta

SEQ ID NO: 5270548 - DNA, 14 bp, Homo sapiens
attcaaatcagtga

SEQ ID NO: 5270549 - DNA, 18 bp, Homo sapiens
attcaaatcagtgatcta

SEQ ID NO: 5270550 - DNA, 21 bp, Homo sapiens
attcaaatcgtttatttcaca

SEQ ID NO: 5270551 - DNA, 18 bp, Homo sapiens
attcaaatgcatgatatt

SEQ ID NO: 5270552 - DNA, 22 bp, Homo sapiens
attcaaatgcatgatattgtat

SEQ ID NO: 5270553 - DNA, 14 bp, Homo sapiens
attcaaatgtcagt

SEQ ID NO: 5270554 - DNA, 16 bp, Homo sapiens
attcaaatgtctataa

SEQ ID NO: 5270555 - DNA, 21 bp, Homo sapiens
attcaaattctttttttatta

SEQ ID NO: 5270556 - DNA, 22 bp, Homo sapiens
attcaaattctttttttattat

SEQ ID NO: 5270557 - DNA, 21 bp, Homo sapiens
attcaaatttatttccaatgt

SEQ ID NO: 5270558 - DNA, 14 bp, Homo sapiens
attcaaatttgatg

SEQ ID NO: 5270559 - DNA, 23 bp, Homo sapiens
attcaaatttgtaataaaactat

SEQ ID NO: 5270560 - DNA, 15 bp, Homo sapiens
attcaaatttgtaca

SEQ ID NO: 5270561 - DNA, 22 bp, Homo sapiens
attcaaatttgtacaggactgt

SEQ ID NO: 5270562 - DNA, 13 bp, Homo sapiens
attcaacaaacat

SEQ ID NO: 5270563 - DNA, 12 bp, Homo sapiens
attcaacaaagt

SEQ ID NO: 5270564 - DNA, 15 bp, Homo sapiens
attcaacaaagtatt

SEQ ID NO: 5270565 - DNA, 15 bp, Homo sapiens
attcaacaatttcaa

SEQ ID NO: 5270566 - DNA, 21 bp, Homo sapiens
attcaacacactgccttatta

SEQ ID NO: 5270567 - DNA, 19 bp, Homo sapiens
attcaacacattacttgca

SEQ ID NO: 5270568 - DNA, 16 bp, Homo sapiens
attcaacacattttta

SEQ ID NO: 5270569 - DNA, 15 bp, Homo sapiens
attcaacacttattt

SEQ ID NO: 5270570 - DNA, 22 bp, Homo sapiens
attcaacagcaagtgtgaatac

SEQ ID NO: 5270571 - DNA, 18 bp, Homo sapiens
attcaacaggttttcctg

SEQ ID NO: 5270572 - DNA, 16 bp, Homo sapiens
attcaacatcaaaact

SEQ ID NO: 5270573 - DNA, 20 bp, Homo sapiens
attcaacatcaaaacttaag

SEQ ID NO: 5270574 - DNA, 16 bp, Homo sapiens
attcaaccctggagag

SEQ ID NO: 5270575 - DNA, 14 bp, Homo sapiens
attcaactaaaaaa

SEQ ID NO: 5270576 - DNA, 19 bp, Homo sapiens
attcaactaatacatggtt

SEQ ID NO: 5270577 - DNA, 17 bp, Homo sapiens
attcaactggaaattaa

SEQ ID NO: 5270578 - DNA, 21 bp, Homo sapiens
attcaactggaaattaaaaaa

SEQ ID NO: 5270579 - DNA, 14 bp, Homo sapiens
attcaactttgtaa

SEQ ID NO: 5270580 - DNA, 14 bp, Homo sapiens
attcaacttttcta

SEQ ID NO: 5270581 - DNA, 22 bp, Homo sapiens
attcaagaaaacaacttcaata

SEQ ID NO: 5270582 - DNA, 15 bp, Homo sapiens
attcaagaaacagaa

SEQ ID NO: 5270583 - DNA, 22 bp, Homo sapiens
attcaagaaagccagtcttaac

SEQ ID NO: 5270584 - DNA, 15 bp, Homo sapiens
attcaagaagtattt

SEQ ID NO: 5270585 - DNA, 17 bp, Homo sapiens
attcaagaagtattttt

SEQ ID NO: 5270586 - DNA, 21 bp, Homo sapiens
attcaagaatgccagtagaaa

SEQ ID NO: 5270587 - DNA, 19 bp, Homo sapiens
attcaagacaagagctgtt

SEQ ID NO: 5270588 - DNA, 17 bp, Homo sapiens
attcaagagtgggggga

SEQ ID NO: 5270589 - DNA, 21 bp, Homo sapiens
attcaagccattccaaagttc

SEQ ID NO: 5270590 - DNA, 16 bp, Homo sapiens
attcaagcctctaaac

SEQ ID NO: 5270591 - DNA, 11 bp, Homo sapiens
attcaagctga

SEQ ID NO: 5270592 - DNA, 18 bp, Homo sapiens
attcaaggagaatatgat

SEQ ID NO: 5270593 - DNA, 12 bp, Homo sapiens
attcaaggctta

SEQ ID NO: 5270594 - DNA, 20 bp, Homo sapiens
attcaaggctttaaaagtca

SEQ ID NO: 5270595 - DNA, 17 bp, Homo sapiens
attcaaggtaaaattct

SEQ ID NO: 5270596 - DNA, 18 bp, Homo sapiens
attcaaggtaaaattcta

SEQ ID NO: 5270597 - DNA, 19 bp, Homo sapiens
attcaaggtaaaattctaa

SEQ ID NO: 5270598 - DNA, 20 bp, Homo sapiens
attcaaggtaaaattctaaa

SEQ ID NO: 5270599 - DNA, 21 bp, Homo sapiens
attcaaggtaaaattctaaat

SEQ ID NO: 5270600 - DNA, 15 bp, Homo sapiens
attcaagtaacactt

SEQ ID NO: 5270601 - DNA, 20 bp, Homo sapiens
attcaagtattgagaacctg

SEQ ID NO: 5270602 - DNA, 14 bp, Homo sapiens
attcaagtgcctct

SEQ ID NO: 5270603 - DNA, 19 bp, Homo sapiens
attcaataaaatgcactga

SEQ ID NO: 5270604 - DNA, 13 bp, Homo sapiens
attcaataaagct

SEQ ID NO: 5270605 - DNA, 13 bp, Homo sapiens
attcaataaagta

SEQ ID NO: 5270606 - DNA, 13 bp, Homo sapiens
attcaataaattg

SEQ ID NO: 5270607 - DNA, 19 bp, Homo sapiens
attcaataccgctcagtat

SEQ ID NO: 5270608 - DNA, 17 bp, Homo sapiens
attcaatagtaatataa

SEQ ID NO: 5270609 - DNA, 16 bp, Homo sapiens
attcaatatcctttgc

SEQ ID NO: 5270610 - DNA, 19 bp, Homo sapiens
attcaatatggttacgttg

SEQ ID NO: 5270611 - DNA, 16 bp, Homo sapiens
attcaatcaaagctac

SEQ ID NO: 5270612 - DNA, 19 bp, Homo sapiens
attcaatcatttattcatt

SEQ ID NO: 5270613 - DNA, 16 bp, Homo sapiens
attcaatctgtaaact

SEQ ID NO: 5270614 - DNA, 17 bp, Homo sapiens
attcaatctgtaaactg

SEQ ID NO: 5270615 - DNA, 21 bp, Homo sapiens
attcaatgcaatgaaaacaaa

SEQ ID NO: 5270616 - DNA, 15 bp, Homo sapiens
attcaatgcatttaa

SEQ ID NO: 5270617 - DNA, 17 bp, Homo sapiens
attcaatgcttgatgtt

SEQ ID NO: 5270618 - DNA, 20 bp, Homo sapiens
attcaatgggtaaataaatg

SEQ ID NO: 5270619 - DNA, 22 bp, Homo sapiens
attcaatgggtaaataaatgct

SEQ ID NO: 5270620 - DNA, 17 bp, Homo sapiens
attcaatgtgaatttta

SEQ ID NO: 5270621 - DNA, 23 bp, Homo sapiens
attcaatgtttatgcaaggaagg

SEQ ID NO: 5270622 - DNA, 17 bp, Homo sapiens
attcaattaacatatat

SEQ ID NO: 5270623 - DNA, 21 bp, Homo sapiens
attcaattacggactctggat

SEQ ID NO: 5270624 - DNA, 14 bp, Homo sapiens
attcaattcctctg

SEQ ID NO: 5270625 - DNA, 21 bp, Homo sapiens
attcaattgtaaattgaatca

SEQ ID NO: 5270626 - DNA, 21 bp, Homo sapiens
attcaatttaagtatatttgt

SEQ ID NO: 5270627 - DNA, 13 bp, Homo sapiens
attcaatttctca

SEQ ID NO: 5270628 - DNA, 22 bp, Homo sapiens
attcaatttgctatttacaaat

SEQ ID NO: 5270629 - DNA, 17 bp, Homo sapiens
attcacaaaaaaagtaa

SEQ ID NO: 5270630 - DNA, 12 bp, Homo sapiens
attcacaaaaat

SEQ ID NO: 5270631 - DNA, 14 bp, Homo sapiens
attcacaaacaaat

SEQ ID NO: 5270632 - DNA, 21 bp, Homo sapiens
attcacaaacaaatggctgta

SEQ ID NO: 5270633 - DNA, 22 bp, Homo sapiens
attcacaaacttttatactctt

SEQ ID NO: 5270634 - DNA, 16 bp, Homo sapiens
attcacaagctgcctc

SEQ ID NO: 5270635 - DNA, 19 bp, Homo sapiens
attcacaagttaagattct

SEQ ID NO: 5270636 - DNA, 21 bp, Homo sapiens
attcacaagttaagattcttg

SEQ ID NO: 5270637 - DNA, 16 bp, Homo sapiens
attcacaataaaagct

SEQ ID NO: 5270638 - DNA, 22 bp, Homo sapiens
attcacaatgaaatgctctcct

SEQ ID NO: 5270639 - DNA, 18 bp, Homo sapiens
attcacaatggaaacttt

SEQ ID NO: 5270640 - DNA, 14 bp, Homo sapiens
attcacaattattc

SEQ ID NO: 5270641 - DNA, 12 bp, Homo sapiens
attcacacacac

SEQ ID NO: 5270642 - DNA, 15 bp, Homo sapiens
attcacacacacaca

SEQ ID NO: 5270643 - DNA, 15 bp, Homo sapiens
attcacacacagcct

SEQ ID NO: 5270644 - DNA, 21 bp, Homo sapiens
attcacacacagcctggcctc

SEQ ID NO: 5270645 - DNA, 22 bp, Homo sapiens
attcacacacccctcaaaaaaa

SEQ ID NO: 5270646 - DNA, 14 bp, Homo sapiens
attcacaccccacc

SEQ ID NO: 5270647 - DNA, 15 bp, Homo sapiens
attcacaccccacct

SEQ ID NO: 5270648 - DNA, 11 bp, Homo sapiens
attcacactgt

SEQ ID NO: 5270649 - DNA, 16 bp, Homo sapiens
attcacactgttccag

SEQ ID NO: 5270650 - DNA, 16 bp, Homo sapiens
attcacacttgaacca

SEQ ID NO: 5270651 - DNA, 12 bp, Homo sapiens
attcacagccca

SEQ ID NO: 5270652 - DNA, 13 bp, Homo sapiens
attcacagcctcc

SEQ ID NO: 5270653 - DNA, 22 bp, Homo sapiens
attcacagcctccgcggactgg

SEQ ID NO: 5270654 - DNA, 18 bp, Homo sapiens
attcacagctccttgtga

SEQ ID NO: 5270655 - DNA, 22 bp, Homo sapiens
attcacagtggtcccatttata

SEQ ID NO: 5270656 - DNA, 24 bp, Homo sapiens
attcacagtggtcccatttatatc

SEQ ID NO: 5270657 - DNA, 23 bp, Homo sapiens
attcacatcactgattgggtgcc

SEQ ID NO: 5270658 - DNA, 22 bp, Homo sapiens
attcacatccaatgcatagttt

SEQ ID NO: 5270659 - DNA, 18 bp, Homo sapiens
attcacatcgcagattct

SEQ ID NO: 5270660 - DNA, 15 bp, Homo sapiens
attcacatctcattt

SEQ ID NO: 5270661 - DNA, 19 bp, Homo sapiens
attcacatgttttcaaatg

SEQ ID NO: 5270662 - DNA, 13 bp, Homo sapiens
attcacattgtat

SEQ ID NO: 5270663 - DNA, 20 bp, Homo sapiens
attcacattgtattcagagt

SEQ ID NO: 5270664 - DNA, 13 bp, Homo sapiens
attcacatttgat

SEQ ID NO: 5270665 - DNA, 21 bp, Homo sapiens
attcacatttgatgtacatgt

SEQ ID NO: 5270666 - DNA, 15 bp, Homo sapiens
attcacattttaaca

SEQ ID NO: 5270667 - DNA, 16 bp, Homo sapiens
attcaccagtacattc

SEQ ID NO: 5270668 - DNA, 15 bp, Homo sapiens
attcaccagtgttcc

SEQ ID NO: 5270669 - DNA, 18 bp, Homo sapiens
attcaccatgtaaaacaa

SEQ ID NO: 5270670 - DNA, 19 bp, Homo sapiens
attcaccatgtaaaacaaa

SEQ ID NO: 5270671 - DNA, 22 bp, Homo sapiens
attcaccatgtaaaacaaaaaa

SEQ ID NO: 5270672 - DNA, 16 bp, Homo sapiens
attcacccccaaacag

SEQ ID NO: 5270673 - DNA, 20 bp, Homo sapiens
attcacccccctctgctgcc

SEQ ID NO: 5270674 - DNA, 11 bp, Homo sapiens
attcacccctc

SEQ ID NO: 5270675 - DNA, 23 bp, Homo sapiens
attcacccctcccacctctttct

SEQ ID NO: 5270676 - DNA, 16 bp, Homo sapiens
attcacccctgccccg

SEQ ID NO: 5270677 - DNA, 16 bp, Homo sapiens
attcaccctgggcagt

SEQ ID NO: 5270678 - DNA, 18 bp, Homo sapiens
attcacctaagagattct

SEQ ID NO: 5270679 - DNA, 21 bp, Homo sapiens
attcacctaagagattctgat

SEQ ID NO: 5270680 - DNA, 22 bp, Homo sapiens
attcacctaagagattctgatt

SEQ ID NO: 5270681 - DNA, 17 bp, Homo sapiens
attcacctcagcctgga

SEQ ID NO: 5270682 - DNA, 19 bp, Homo sapiens
attcacctcctaaaacaac

SEQ ID NO: 5270683 - DNA, 21 bp, Homo sapiens
attcacctcctaaaacaacag

SEQ ID NO: 5270684 - DNA, 23 bp, Homo sapiens
attcacctctctcactgactatt

SEQ ID NO: 5270685 - DNA, 14 bp, Homo sapiens
attcacctcttcct

SEQ ID NO: 5270686 - DNA, 18 bp, Homo sapiens
attcacctcttcctctgg

SEQ ID NO: 5270687 - DNA, 24 bp, Homo sapiens
attcacctcttcctctggttcctt

SEQ ID NO: 5270688 - DNA, 15 bp, Homo sapiens
attcacctgccctgt

SEQ ID NO: 5270689 - DNA, 13 bp, Homo sapiens
attcacctgtaaa

SEQ ID NO: 5270690 - DNA, 15 bp, Homo sapiens
attcacctgtaaaac

SEQ ID NO: 5270691 - DNA, 16 bp, Homo sapiens
attcacctgtaaaact

SEQ ID NO: 5270692 - DNA, 17 bp, Homo sapiens
attcacctgtaaaactt

SEQ ID NO: 5270693 - DNA, 18 bp, Homo sapiens
attcacctgtaaaacttt

SEQ ID NO: 5270694 - DNA, 17 bp, Homo sapiens
attcacctttcttttgt

SEQ ID NO: 5270695 - DNA, 15 bp, Homo sapiens
attcacctttttaat

SEQ ID NO: 5270696 - DNA, 18 bp, Homo sapiens
attcacctttttaataaa

SEQ ID NO: 5270697 - DNA, 20 bp, Homo sapiens
attcacgtgctttgtgttca

SEQ ID NO: 5270698 - DNA, 14 bp, Homo sapiens
attcactaagccat

SEQ ID NO: 5270699 - DNA, 14 bp, Homo sapiens
attcactattagag

SEQ ID NO: 5270700 - DNA, 20 bp, Homo sapiens
attcactattggctgggagt

SEQ ID NO: 5270701 - DNA, 16 bp, Homo sapiens
attcactcaagcactg

SEQ ID NO: 5270702 - DNA, 14 bp, Homo sapiens
attcactcagaaga

SEQ ID NO: 5270703 - DNA, 21 bp, Homo sapiens
attcactcatacatctggccg

SEQ ID NO: 5270704 - DNA, 14 bp, Homo sapiens
attcactccagtca

SEQ ID NO: 5270705 - DNA, 15 bp, Homo sapiens
attcactccagtcaa

SEQ ID NO: 5270706 - DNA, 16 bp, Homo sapiens
attcactccagtcaac

SEQ ID NO: 5270707 - DNA, 12 bp, Homo sapiens
attcactcccac

SEQ ID NO: 5270708 - DNA, 21 bp, Homo sapiens
attcactcccacacccaagaa

SEQ ID NO: 5270709 - DNA, 14 bp, Homo sapiens
atggatttgttaca

SEQ ID NO: 5270710 - DNA, 17 bp, Homo sapiens
atggatttgttacagcc

SEQ ID NO: 5270711 - DNA, 20 bp, Homo sapiens
atggattttagtcaaatatt

SEQ ID NO: 5270712 - DNA, 18 bp, Homo sapiens
atggattttggcagggcg

SEQ ID NO: 5270713 - DNA, 21 bp, Homo sapiens
atggatttttacaagatccat

SEQ ID NO: 5270714 - DNA, 16 bp, Homo sapiens
atggatttttctttaa

SEQ ID NO: 5270715 - DNA, 20 bp, Homo sapiens
atggatttttctttaactgc

SEQ ID NO: 5270716 - DNA, 18 bp, Homo sapiens
atggattttttttttcag

SEQ ID NO: 5270717 - DNA, 14 bp, Homo sapiens
atggcaaaaaaaaa

SEQ ID NO: 5270718 - DNA, 21 bp, Homo sapiens
atggcaaagcggttgcttctg

SEQ ID NO: 5270719 - DNA, 18 bp, Homo sapiens
atggcaaaggaaggtgga

SEQ ID NO: 5270720 - DNA, 20 bp, Homo sapiens
atggcaaatcaggggccaga

SEQ ID NO: 5270721 - DNA, 19 bp, Homo sapiens
atggcaacaaactgcacat

SEQ ID NO: 5270722 - DNA, 19 bp, Homo sapiens
atggcaacattggacagaa

SEQ ID NO: 5270723 - DNA, 22 bp, Homo sapiens
atggcaacattggacagaaaat

SEQ ID NO: 5270724 - DNA, 18 bp, Homo sapiens
atggcaaccattataacc

SEQ ID NO: 5270725 - DNA, 20 bp, Homo sapiens
atggcaacgttcatgttcat

SEQ ID NO: 5270726 - DNA, 18 bp, Homo sapiens
atggcaaggcagccctgt

SEQ ID NO: 5270727 - DNA, 23 bp, Homo sapiens
atggcaagggggtgtcatctgag

SEQ ID NO: 5270728 - DNA, 22 bp, Homo sapiens
atggcaagtctagagtctcaga

SEQ ID NO: 5270729 - DNA, 20 bp, Homo sapiens
atggcaagttgcatcagaaa

SEQ ID NO: 5270730 - DNA, 22 bp, Homo sapiens
atggcaagttgccattttgtaa

SEQ ID NO: 5270731 - DNA, 23 bp, Homo sapiens
atggcaagttttgatatgagtat

SEQ ID NO: 5270732 - DNA, 23 bp, Homo sapiens
atggcaatgaaaattttaagaag

SEQ ID NO: 5270733 - DNA, 16 bp, Homo sapiens
atggcaatgttttgct

SEQ ID NO: 5270734 - DNA, 23 bp, Homo sapiens
atggcaattctttgacctcaacc

SEQ ID NO: 5270735 - DNA, 21 bp, Homo sapiens
atggcaattggcatcattctc

SEQ ID NO: 5270736 - DNA, 16 bp, Homo sapiens
atggcaattttgtaac

SEQ ID NO: 5270737 - DNA, 19 bp, Homo sapiens
atggcacagggcatgaaat

SEQ ID NO: 5270738 - DNA, 20 bp, Homo sapiens
atggcaccagccccctggat

SEQ ID NO: 5270739 - DNA, 22 bp, Homo sapiens
atggcacccacacagaggacct

SEQ ID NO: 5270740 - DNA, 13 bp, Homo sapiens
atggcacccagtg

SEQ ID NO: 5270741 - DNA, 20 bp, Homo sapiens
atggcaccctgcaccaggcc

SEQ ID NO: 5270742 - DNA, 22 bp, Homo sapiens
atggcaccctggaaccgggaag

SEQ ID NO: 5270743 - DNA, 15 bp, Homo sapiens
atggcacctatttct

SEQ ID NO: 5270744 - DNA, 17 bp, Homo sapiens
atggcacctcaggctga

SEQ ID NO: 5270745 - DNA, 18 bp, Homo sapiens
atggcacctcaggctgag

SEQ ID NO: 5270746 - DNA, 17 bp, Homo sapiens
atggcacctgtggccag

SEQ ID NO: 5270747 - DNA, 17 bp, Homo sapiens
atggcaccttcagactt

SEQ ID NO: 5270748 - DNA, 19 bp, Homo sapiens
atggcaccttcattctccg

SEQ ID NO: 5270749 - DNA, 21 bp, Homo sapiens
atggcaccttcattctccgtt

SEQ ID NO: 5270750 - DNA, 24 bp, Homo sapiens
atggcactaaaccacttctctgct

SEQ ID NO: 5270751 - DNA, 18 bp, Homo sapiens
atggcactccctccagca

SEQ ID NO: 5270752 - DNA, 13 bp, Homo sapiens
atggcactgaccg

SEQ ID NO: 5270753 - DNA, 13 bp, Homo sapiens
atggcactgtcca

SEQ ID NO: 5270754 - DNA, 14 bp, Homo sapiens
atggcactgtccag

SEQ ID NO: 5270755 - DNA, 16 bp, Homo sapiens
atggcactgtccaggg

SEQ ID NO: 5270756 - DNA, 17 bp, Homo sapiens
atggcactgtccagggc

SEQ ID NO: 5270757 - DNA, 22 bp, Homo sapiens
atggcacttgatgtgtagacat

SEQ ID NO: 5270758 - DNA, 17 bp, Homo sapiens
atggcacttgcatctgt

SEQ ID NO: 5270759 - DNA, 18 bp, Homo sapiens
atggcacttgggggactg

SEQ ID NO: 5270760 - DNA, 16 bp, Homo sapiens
atggcactttagtgat

SEQ ID NO: 5270761 - DNA, 13 bp, Homo sapiens
atggcagaaaagt

SEQ ID NO: 5270762 - DNA, 16 bp, Homo sapiens
atggcagaaagatgga

SEQ ID NO: 5270763 - DNA, 21 bp, Homo sapiens
atggcagaaagatggagaggc

SEQ ID NO: 5270764 - DNA, 22 bp, Homo sapiens
atggcagaaagatggagaggca

SEQ ID NO: 5270765 - DNA, 20 bp, Homo sapiens
atggcagaaagggggcatct

SEQ ID NO: 5270766 - DNA, 19 bp, Homo sapiens
atggcagaacgatgcctgc

SEQ ID NO: 5270767 - DNA, 13 bp, Homo sapiens
atggcagaaggca

SEQ ID NO: 5270768 - DNA, 20 bp, Homo sapiens
atggcagaaggcaaacccat

SEQ ID NO: 5270769 - DNA, 12 bp, Homo sapiens
atggcagaaggg

SEQ ID NO: 5270770 - DNA, 16 bp, Homo sapiens
atggcagacagtcaag

SEQ ID NO: 5270771 - DNA, 12 bp, Homo sapiens
atggcagagcag

SEQ ID NO: 5270772 - DNA, 13 bp, Homo sapiens
atggcagagccag

SEQ ID NO: 5270773 - DNA, 22 bp, Homo sapiens
atggcagagccaggctgttgga

SEQ ID NO: 5270774 - DNA, 15 bp, Homo sapiens
atggcagaggagctt

SEQ ID NO: 5270775 - DNA, 15 bp, Homo sapiens
atggcagagttgtaa

SEQ ID NO: 5270776 - DNA, 16 bp, Homo sapiens
atggcagatgcacatg

SEQ ID NO: 5270777 - DNA, 19 bp, Homo sapiens
atggcagatgtaggaggga

SEQ ID NO: 5270778 - DNA, 20 bp, Homo sapiens
atggcagatgtaggagggac

SEQ ID NO: 5270779 - DNA, 12 bp, Homo sapiens
atggcagcagcc

SEQ ID NO: 5270780 - DNA, 19 bp, Homo sapiens
atggcagcagccagggacc

SEQ ID NO: 5270781 - DNA, 21 bp, Homo sapiens
atggcagcagccagggacccc

SEQ ID NO: 5270782 - DNA, 13 bp, Homo sapiens
atggcagcagggg

SEQ ID NO: 5270783 - DNA, 15 bp, Homo sapiens
atggcagcagtgaag

SEQ ID NO: 5270784 - DNA, 20 bp, Homo sapiens
atggcagcagttccatgaag

SEQ ID NO: 5270785 - DNA, 21 bp, Homo sapiens
atggcagcatgcaaacttgga

SEQ ID NO: 5270786 - DNA, 19 bp, Homo sapiens
atggcagcccggctgctgc

SEQ ID NO: 5270787 - DNA, 12 bp, Homo sapiens
atggcagcctca

SEQ ID NO: 5270788 - DNA, 13 bp, Homo sapiens
atggcagcctcag

SEQ ID NO: 5270789 - DNA, 18 bp, Homo sapiens
atggcagcctcagggctt

SEQ ID NO: 5270790 - DNA, 12 bp, Homo sapiens
atggcagctcct

SEQ ID NO: 5270791 - DNA, 17 bp, Homo sapiens
atggcagctcctgacct

SEQ ID NO: 5270792 - DNA, 12 bp, Homo sapiens
atggcagctgga

SEQ ID NO: 5270793 - DNA, 14 bp, Homo sapiens
atggcagctgggcc

SEQ ID NO: 5270794 - DNA, 21 bp, Homo sapiens
atggcagctgggcccacagcc

SEQ ID NO: 5270795 - DNA, 16 bp, Homo sapiens
atggcaggacagctcc

SEQ ID NO: 5270796 - DNA, 17 bp, Homo sapiens
atggcaggacagctcct

SEQ ID NO: 5270797 - DNA, 16 bp, Homo sapiens
atggcaggagaatcag

SEQ ID NO: 5270798 - DNA, 17 bp, Homo sapiens
atggcaggatggcctgg

SEQ ID NO: 5270799 - DNA, 22 bp, Homo sapiens
atggcaggatggcctggccagg

SEQ ID NO: 5270800 - DNA, 12 bp, Homo sapiens
atggcagggcct

SEQ ID NO: 5270801 - DNA, 16 bp, Homo sapiens
atggcagggctgagga

SEQ ID NO: 5270802 - DNA, 19 bp, Homo sapiens
atggcaggggaagccttgc

SEQ ID NO: 5270803 - DNA, 20 bp, Homo sapiens
atggcagggggctgctgctg

SEQ ID NO: 5270804 - DNA, 22 bp, Homo sapiens
atggcagggggctgctgctggg

SEQ ID NO: 5270805 - DNA, 19 bp, Homo sapiens
atggcaggtgatgtcctgt

SEQ ID NO: 5270806 - DNA, 15 bp, Homo sapiens
atggcaggtgtcata

SEQ ID NO: 5270807 - DNA, 15 bp, Homo sapiens
atggcagtcctggag

SEQ ID NO: 5270808 - DNA, 17 bp, Homo sapiens
atggcagtcctggaggc

SEQ ID NO: 5270809 - DNA, 17 bp, Homo sapiens
atggcagtctagggtga

SEQ ID NO: 5270810 - DNA, 18 bp, Homo sapiens
atggcagtgactccccag

SEQ ID NO: 5270811 - DNA, 15 bp, Homo sapiens
atggcagtgggagac

SEQ ID NO: 5270812 - DNA, 20 bp, Homo sapiens
atggcagtgtggggagggca

SEQ ID NO: 5270813 - DNA, 17 bp, Homo sapiens
atggcataacctgtctc

SEQ ID NO: 5270814 - DNA, 20 bp, Homo sapiens
atggcatattgataataaaa

SEQ ID NO: 5270815 - DNA, 21 bp, Homo sapiens
atggcatattgataataaaat

SEQ ID NO: 5270816 - DNA, 22 bp, Homo sapiens
atggcatatttttcacatatct

SEQ ID NO: 5270817 - DNA, 23 bp, Homo sapiens
atggcatatttttcacatatcta

SEQ ID NO: 5270818 - DNA, 13 bp, Homo sapiens
atggcatcagcac

SEQ ID NO: 5270819 - DNA, 23 bp, Homo sapiens
atggcatcatccattctctctgc

SEQ ID NO: 5270820 - DNA, 22 bp, Homo sapiens
atggcatccctttttcataaat

SEQ ID NO: 5270821 - DNA, 16 bp, Homo sapiens
atggcatcctccagcc

SEQ ID NO: 5270822 - DNA, 18 bp, Homo sapiens
atggcatctagccagagg

SEQ ID NO: 5270823 - DNA, 22 bp, Homo sapiens
atggcatctagccagaggctgg

SEQ ID NO: 5270824 - DNA, 20 bp, Homo sapiens
atggcatctcattgaggaca

SEQ ID NO: 5270825 - DNA, 17 bp, Homo sapiens
atggcatcttcaatatg

SEQ ID NO: 5270826 - DNA, 20 bp, Homo sapiens
atggcatcttcgtcttcact

SEQ ID NO: 5270827 - DNA, 17 bp, Homo sapiens
atggcatgagaaataca

SEQ ID NO: 5270828 - DNA, 19 bp, Homo sapiens
atggcatgagaaatacaaa

SEQ ID NO: 5270829 - DNA, 15 bp, Homo sapiens
atggcatgatttata

SEQ ID NO: 5270830 - DNA, 23 bp, Homo sapiens
atggcatgatttatatatggcat

SEQ ID NO: 5270831 - DNA, 16 bp, Homo sapiens
atggcatggagactct

SEQ ID NO: 5270832 - DNA, 16 bp, Homo sapiens
atggcatggcaggagt

SEQ ID NO: 5270833 - DNA, 14 bp, Homo sapiens
atggcatgtgaaaa

SEQ ID NO: 5270834 - DNA, 13 bp, Homo sapiens
atggcattactct

SEQ ID NO: 5270835 - DNA, 14 bp, Homo sapiens
atggcattactctg

SEQ ID NO: 5270836 - DNA, 15 bp, Homo sapiens
atggcattactctgc

SEQ ID NO: 5270837 - DNA, 17 bp, Homo sapiens
atggcattactctgcac

SEQ ID NO: 5270838 - DNA, 16 bp, Homo sapiens
atggcatttagcacag

SEQ ID NO: 5270839 - DNA, 20 bp, Homo sapiens
atggcatttagcacagtatt

SEQ ID NO: 5270840 - DNA, 22 bp, Homo sapiens
atggcatttagtaccttcaaat

SEQ ID NO: 5270841 - DNA, 23 bp, Homo sapiens
atggcatttctctttaaactatg

SEQ ID NO: 5270842 - DNA, 13 bp, Homo sapiens
atggcatttgcag

SEQ ID NO: 5270843 - DNA, 17 bp, Homo sapiens
atggcatttgcagattt

SEQ ID NO: 5270844 - DNA, 19 bp, Homo sapiens
atggcatttggtctcaggc

SEQ ID NO: 5270845 - DNA, 20 bp, Homo sapiens
atggcatttggtctcaggca

SEQ ID NO: 5270846 - DNA, 21 bp, Homo sapiens
atggcatttggtctcaggcag

SEQ ID NO: 5270847 - DNA, 16 bp, Homo sapiens
atggcatttttttaaa

SEQ ID NO: 5270848 - DNA, 18 bp, Homo sapiens
atggcatttttttagtaa

SEQ ID NO: 5270849 - DNA, 14 bp, Homo sapiens
atggccaaaatacc

SEQ ID NO: 5270850 - DNA, 20 bp, Homo sapiens
atggccaaagcaaaggagag

SEQ ID NO: 5270851 - DNA, 23 bp, Homo sapiens
atggccaaagcaaaggagagtcc

SEQ ID NO: 5270852 - DNA, 16 bp, Homo sapiens
atggccaagaaagaaa

SEQ ID NO: 5270853 - DNA, 13 bp, Homo sapiens
atggccaagagca

SEQ ID NO: 5270854 - DNA, 18 bp, Homo sapiens
atggccaaggctctctct

SEQ ID NO: 5270855 - DNA, 15 bp, Homo sapiens
atggccaaggggcca

SEQ ID NO: 5270856 - DNA, 16 bp, Homo sapiens
atggccaagtgtacat

SEQ ID NO: 5270857 - DNA, 17 bp, Homo sapiens
atggccaagtgtacatt

SEQ ID NO: 5270858 - DNA, 13 bp, Homo sapiens
atggccacaaacc

SEQ ID NO: 5270859 - DNA, 14 bp, Homo sapiens
atggccacaaacct

SEQ ID NO: 5270860 - DNA, 17 bp, Homo sapiens
atggccacaaacctgcc

SEQ ID NO: 5270861 - DNA, 12 bp, Homo sapiens
atggccacactg

SEQ ID NO: 5270862 - DNA, 21 bp, Homo sapiens
atggccacactgtgacacact

SEQ ID NO: 5270863 - DNA, 23 bp, Homo sapiens
atggccacactgtgacacactac

SEQ ID NO: 5270864 - DNA, 18 bp, Homo sapiens
atggccaccccgtgccac

SEQ ID NO: 5270865 - DNA, 20 bp, Homo sapiens
atggccaccccgtgccaccc

SEQ ID NO: 5270866 - DNA, 17 bp, Homo sapiens
atggccaccttttcagc

SEQ ID NO: 5270867 - DNA, 19 bp, Homo sapiens
atggccagagcctctggcc

SEQ ID NO: 5270868 - DNA, 13 bp, Homo sapiens
atggccagaggaa

SEQ ID NO: 5270869 - DNA, 16 bp, Homo sapiens
atggccagcccagatg

SEQ ID NO: 5270870 - DNA, 22 bp, Homo sapiens
atggccagcccagatggctccc

SEQ ID NO: 5270871 - DNA, 21 bp, Homo sapiens
atggccagccccttagacaga

SEQ ID NO: 5270872 - DNA, 21 bp, Homo sapiens
atggccaggaagtagcacagg

SEQ ID NO: 5270873 - DNA, 14 bp, Homo sapiens
atggccaggccagg

SEQ ID NO: 5270874 - DNA, 15 bp, Homo sapiens
atggccaggccaggg

SEQ ID NO: 5270875 - DNA, 20 bp, Homo sapiens
atggccaggtggttgtctta

SEQ ID NO: 5270876 - DNA, 15 bp, Homo sapiens
atggccagtgctgct

SEQ ID NO: 5270877 - DNA, 16 bp, Homo sapiens
atggccagtgctgctt

SEQ ID NO: 5270878 - DNA, 18 bp, Homo sapiens
atggccagtgctgcttct

SEQ ID NO: 5270879 - DNA, 21 bp, Homo sapiens
atggccagtttgaagcctgtg

SEQ ID NO: 5270880 - DNA, 19 bp, Homo sapiens
atggccatagaggcccagg

SEQ ID NO: 5270881 - DNA, 21 bp, Homo sapiens
atggccatagaggcccaggca

SEQ ID NO: 5270882 - DNA, 16 bp, Homo sapiens
atggccataggagagg

SEQ ID NO: 5270883 - DNA, 20 bp, Homo sapiens
atggccatcttctttcttcc

SEQ ID NO: 5270884 - DNA, 17 bp, Homo sapiens
atggccatgcaggaggt

SEQ ID NO: 5270885 - DNA, 20 bp, Homo sapiens
atggccatgcaggaggtgga

SEQ ID NO: 5270886 - DNA, 18 bp, Homo sapiens
attcactctcccagaggc

SEQ ID NO: 5270887 - DNA, 15 bp, Homo sapiens
attcactcttccaga

SEQ ID NO: 5270888 - DNA, 19 bp, Homo sapiens
attcactcttccagaatcc

SEQ ID NO: 5270889 - DNA, 14 bp, Homo sapiens
attcactcttcctg

SEQ ID NO: 5270890 - DNA, 12 bp, Homo sapiens
attcactgattt

SEQ ID NO: 5270891 - DNA, 16 bp, Homo sapiens
attcactgcacaagat

SEQ ID NO: 5270892 - DNA, 13 bp, Homo sapiens
attcactggcctg

SEQ ID NO: 5270893 - DNA, 15 bp, Homo sapiens
attcactggcctggc

SEQ ID NO: 5270894 - DNA, 16 bp, Homo sapiens
attcactggttttaca

SEQ ID NO: 5270895 - DNA, 17 bp, Homo sapiens
attcactgtatagtaat

SEQ ID NO: 5270896 - DNA, 13 bp, Homo sapiens
attcactgtgctt

SEQ ID NO: 5270897 - DNA, 17 bp, Homo sapiens
attcactgtttcactga

SEQ ID NO: 5270898 - DNA, 17 bp, Homo sapiens
attcacttaagtttttc

SEQ ID NO: 5270899 - DNA, 20 bp, Homo sapiens
attcacttctgaattggcca

SEQ ID NO: 5270900 - DNA, 14 bp, Homo sapiens
attcactttcattt

SEQ ID NO: 5270901 - DNA, 15 bp, Homo sapiens
attcacttttattgt

SEQ ID NO: 5270902 - DNA, 18 bp, Homo sapiens
attcacttttattgtata

SEQ ID NO: 5270903 - DNA, 14 bp, Homo sapiens
attcacttttgtta

SEQ ID NO: 5270904 - DNA, 20 bp, Homo sapiens
attcagaaaacataatataa

SEQ ID NO: 5270905 - DNA, 13 bp, Homo sapiens
attcagaaaactt

SEQ ID NO: 5270906 - DNA, 22 bp, Homo sapiens
attcagaaaatgttctgtttgc

SEQ ID NO: 5270907 - DNA, 16 bp, Homo sapiens
attcagaaagcttcaa

SEQ ID NO: 5270908 - DNA, 23 bp, Homo sapiens
attcagaaatatccctcatttca

SEQ ID NO: 5270909 - DNA, 13 bp, Homo sapiens
attcagaaattaa

SEQ ID NO: 5270910 - DNA, 15 bp, Homo sapiens
attcagaaattaaaa

SEQ ID NO: 5270911 - DNA, 16 bp, Homo sapiens
attcagaaattaaaat

SEQ ID NO: 5270912 - DNA, 19 bp, Homo sapiens
attcagaaattaaaatatt

SEQ ID NO: 5270913 - DNA, 21 bp, Homo sapiens
attcagaaattaaaatattat

SEQ ID NO: 5270914 - DNA, 22 bp, Homo sapiens
attcagaaattaaaatattatt

SEQ ID NO: 5270915 - DNA, 14 bp, Homo sapiens
attcagaaattgga

SEQ ID NO: 5270916 - DNA, 19 bp, Homo sapiens
attcagaacaccaagactt

SEQ ID NO: 5270917 - DNA, 17 bp, Homo sapiens
attcagaacatcctcca

SEQ ID NO: 5270918 - DNA, 20 bp, Homo sapiens
attcagaactaaatttttca

SEQ ID NO: 5270919 - DNA, 19 bp, Homo sapiens
attcagaactatttaaaat

SEQ ID NO: 5270920 - DNA, 20 bp, Homo sapiens
attcagaactatttaaaata

SEQ ID NO: 5270921 - DNA, 15 bp, Homo sapiens
attcagaacttgtaa

SEQ ID NO: 5270922 - DNA, 14 bp, Homo sapiens
attcagaagaaaaa

SEQ ID NO: 5270923 - DNA, 17 bp, Homo sapiens
attcagaagaaaaagaa

SEQ ID NO: 5270924 - DNA, 24 bp, Homo sapiens
attcagaaggatcttcatctgact

SEQ ID NO: 5270925 - DNA, 15 bp, Homo sapiens
attcagaatattcat

SEQ ID NO: 5270926 - DNA, 23 bp, Homo sapiens
attcagaatcaaacctttttata

SEQ ID NO: 5270927 - DNA, 17 bp, Homo sapiens
attcagacaaaatggat

SEQ ID NO: 5270928 - DNA, 14 bp, Homo sapiens
attcagacaacatt

SEQ ID NO: 5270929 - DNA, 15 bp, Homo sapiens
attcagacaacatta

SEQ ID NO: 5270930 - DNA, 23 bp, Homo sapiens
attcagacaacattatgatctaa

SEQ ID NO: 5270931 - DNA, 13 bp, Homo sapiens
attcagacaagca

SEQ ID NO: 5270932 - DNA, 11 bp, Homo sapiens
attcagacagc

SEQ ID NO: 5270933 - DNA, 18 bp, Homo sapiens
attcagacagctgcctgg

SEQ ID NO: 5270934 - DNA, 11 bp, Homo sapiens
attcagacatc

SEQ ID NO: 5270935 - DNA, 19 bp, Homo sapiens
attcagactttcacaccat

SEQ ID NO: 5270936 - DNA, 13 bp, Homo sapiens
attcagagaaatt

SEQ ID NO: 5270937 - DNA, 20 bp, Homo sapiens
attcagagactgcccttctc

SEQ ID NO: 5270938 - DNA, 17 bp, Homo sapiens
attcagagatgtaccat

SEQ ID NO: 5270939 - DNA, 21 bp, Homo sapiens
attcagaggaaaaacagagga

SEQ ID NO: 5270940 - DNA, 12 bp, Homo sapiens
attcagaggaag

SEQ ID NO: 5270941 - DNA, 15 bp, Homo sapiens
attcagaggcagtga

SEQ ID NO: 5270942 - DNA, 14 bp, Homo sapiens
attcagaggtcact

SEQ ID NO: 5270943 - DNA, 22 bp, Homo sapiens
attcagaggttttgttaggtta

SEQ ID NO: 5270944 - DNA, 13 bp, Homo sapiens
attcagagtcctt

SEQ ID NO: 5270945 - DNA, 15 bp, Homo sapiens
attcagataatggta

SEQ ID NO: 5270946 - DNA, 16 bp, Homo sapiens
attcagatataagatt

SEQ ID NO: 5270947 - DNA, 16 bp, Homo sapiens
attcagatcactgaat

SEQ ID NO: 5270948 - DNA, 23 bp, Homo sapiens
attcagatcactgaatttataaa

SEQ ID NO: 5270949 - DNA, 19 bp, Homo sapiens
attcagattaggacacagt

SEQ ID NO: 5270950 - DNA, 19 bp, Homo sapiens
attcagattgacaaggtag

SEQ ID NO: 5270951 - DNA, 16 bp, Homo sapiens
attcagattgtttaaa

SEQ ID NO: 5270952 - DNA, 19 bp, Homo sapiens
attcagatttctctttgaa

SEQ ID NO: 5270953 - DNA, 14 bp, Homo sapiens
attcagcaaaccat

SEQ ID NO: 5270954 - DNA, 17 bp, Homo sapiens
attcagcaaatgccttt

SEQ ID NO: 5270955 - DNA, 23 bp, Homo sapiens
attcagcaaggcgctaacttgct

SEQ ID NO: 5270956 - DNA, 18 bp, Homo sapiens
attcagcacaccccaagg

SEQ ID NO: 5270957 - DNA, 20 bp, Homo sapiens
attcagcacactgtgaaaat

SEQ ID NO: 5270958 - DNA, 17 bp, Homo sapiens
attcagcactgatttca

SEQ ID NO: 5270959 - DNA, 21 bp, Homo sapiens
attcagcactgatttcacaac

SEQ ID NO: 5270960 - DNA, 19 bp, Homo sapiens
attcagcagaatgactctg

SEQ ID NO: 5270961 - DNA, 23 bp, Homo sapiens
attcagcagactttctctgtgta

SEQ ID NO: 5270962 - DNA, 19 bp, Homo sapiens
attcagcatgtccaacatg

SEQ ID NO: 5270963 - DNA, 21 bp, Homo sapiens
attcagcatttgttctttgcc

SEQ ID NO: 5270964 - DNA, 16 bp, Homo sapiens
attcagccaacatgtg

SEQ ID NO: 5270965 - DNA, 14 bp, Homo sapiens
attcagccagctta

SEQ ID NO: 5270966 - DNA, 19 bp, Homo sapiens
attcagccagcttaaaccc

SEQ ID NO: 5270967 - DNA, 20 bp, Homo sapiens
attcagccccgggagtggcg

SEQ ID NO: 5270968 - DNA, 14 bp, Homo sapiens
attcagcctggctt

SEQ ID NO: 5270969 - DNA, 14 bp, Homo sapiens
attcagcctgtttg

SEQ ID NO: 5270970 - DNA, 18 bp, Homo sapiens
attcagccttatccaggt

SEQ ID NO: 5270971 - DNA, 17 bp, Homo sapiens
attcagccttctttttc

SEQ ID NO: 5270972 - DNA, 17 bp, Homo sapiens
attcagcggaatattga

SEQ ID NO: 5270973 - DNA, 17 bp, Homo sapiens
attcagcggcagtgtgt

SEQ ID NO: 5270974 - DNA, 11 bp, Homo sapiens
attcagctctg

SEQ ID NO: 5270975 - DNA, 13 bp, Homo sapiens
attcagctctgat

SEQ ID NO: 5270976 - DNA, 21 bp, Homo sapiens
attcagctctgatctgaggct

SEQ ID NO: 5270977 - DNA, 14 bp, Homo sapiens
attcagctctgcaa

SEQ ID NO: 5270978 - DNA, 18 bp, Homo sapiens
attcagctctgcaagaat

SEQ ID NO: 5270979 - DNA, 15 bp, Homo sapiens
attcagctctggaga

SEQ ID NO: 5270980 - DNA, 13 bp, Homo sapiens
attcagctgcccc

SEQ ID NO: 5270981 - DNA, 15 bp, Homo sapiens
attcagcttcctgct

SEQ ID NO: 5270982 - DNA, 23 bp, Homo sapiens
attcagcttctataagtgtgacc

SEQ ID NO: 5270983 - DNA, 20 bp, Homo sapiens
attcaggaaaaggcctgggg

SEQ ID NO: 5270984 - DNA, 13 bp, Homo sapiens
attcaggaaatgt

SEQ ID NO: 5270985 - DNA, 19 bp, Homo sapiens
attcaggaacctggaccaa

SEQ ID NO: 5270986 - DNA, 16 bp, Homo sapiens
attcaggaagatgaaa

SEQ ID NO: 5270987 - DNA, 22 bp, Homo sapiens
attcaggaagcagctttcccca

SEQ ID NO: 5270988 - DNA, 13 bp, Homo sapiens
attcaggaagctc

SEQ ID NO: 5270989 - DNA, 17 bp, Homo sapiens
attcaggaagctcaggg

SEQ ID NO: 5270990 - DNA, 20 bp, Homo sapiens
attcaggaatatctgttccc

SEQ ID NO: 5270991 - DNA, 11 bp, Homo sapiens
attcaggactc

SEQ ID NO: 5270992 - DNA, 21 bp, Homo sapiens
attcaggacttaacggctcca

SEQ ID NO: 5270993 - DNA, 22 bp, Homo sapiens
attcaggagagtagaacagata

SEQ ID NO: 5270994 - DNA, 15 bp, Homo sapiens
attcaggcactgaga

SEQ ID NO: 5270995 - DNA, 15 bp, Homo sapiens
attcaggcagcactg

SEQ ID NO: 5270996 - DNA, 14 bp, Homo sapiens
attcaggcagcagt

SEQ ID NO: 5270997 - DNA, 17 bp, Homo sapiens
attcaggcagcagtgtc

SEQ ID NO: 5270998 - DNA, 15 bp, Homo sapiens
attcaggccagccca

SEQ ID NO: 5270999 - DNA, 19 bp, Homo sapiens
attcaggccagcccagcca

SEQ ID NO: 5271000 - DNA, 20 bp, Homo sapiens
attcaggccagcccagccag

SEQ ID NO: 5271001 - DNA, 14 bp, Homo sapiens
attcaggcctctga

SEQ ID NO: 5271002 - DNA, 19 bp, Homo sapiens
attcaggcctctgaggagc

SEQ ID NO: 5271003 - DNA, 14 bp, Homo sapiens
attcagggaaggag

SEQ ID NO: 5271004 - DNA, 23 bp, Homo sapiens
attcagggaaggaggagcctgtc

SEQ ID NO: 5271005 - DNA, 18 bp, Homo sapiens
attcagggagaatgttgt

SEQ ID NO: 5271006 - DNA, 16 bp, Homo sapiens
attcagggcccctgaa

SEQ ID NO: 5271007 - DNA, 20 bp, Homo sapiens
attcagggcccctgaagtga

SEQ ID NO: 5271008 - DNA, 19 bp, Homo sapiens
attcaggggaagggcaggc

SEQ ID NO: 5271009 - DNA, 12 bp, Homo sapiens
attcaggggctg

SEQ ID NO: 5271010 - DNA, 14 bp, Homo sapiens
attcaggggctttg

SEQ ID NO: 5271011 - DNA, 15 bp, Homo sapiens
attcaggggctttgg

SEQ ID NO: 5271012 - DNA, 23 bp, Homo sapiens
attcaggggctttgggcccaaga

SEQ ID NO: 5271013 - DNA, 14 bp, Homo sapiens
attcaggtacagaa

SEQ ID NO: 5271014 - DNA, 13 bp, Homo sapiens
attcaggtatgtt

SEQ ID NO: 5271015 - DNA, 22 bp, Homo sapiens
attcaggtgctagaagcctact

SEQ ID NO: 5271016 - DNA, 21 bp, Homo sapiens
attcaggtggccagaagagct

SEQ ID NO: 5271017 - DNA, 14 bp, Homo sapiens
attcaggtttttcc

SEQ ID NO: 5271018 - DNA, 16 bp, Homo sapiens
attcaggttttttagt

SEQ ID NO: 5271019 - DNA, 16 bp, Homo sapiens
attcagtaaacaaatt

SEQ ID NO: 5271020 - DNA, 15 bp, Homo sapiens
attcagtaagttctg

SEQ ID NO: 5271021 - DNA, 19 bp, Homo sapiens
attcagtaagttctgtggt

SEQ ID NO: 5271022 - DNA, 15 bp, Homo sapiens
attcagtaataactc

SEQ ID NO: 5271023 - DNA, 19 bp, Homo sapiens
attcagtaataactctacc

SEQ ID NO: 5271024 - DNA, 21 bp, Homo sapiens
attcagtacaacccataatca

SEQ ID NO: 5271025 - DNA, 16 bp, Homo sapiens
attcagtatgttttac

SEQ ID NO: 5271026 - DNA, 22 bp, Homo sapiens
attcagtatttattgagcatct

SEQ ID NO: 5271027 - DNA, 23 bp, Homo sapiens
attcagtccgcctggccggctcc

SEQ ID NO: 5271028 - DNA, 18 bp, Homo sapiens
attcagtcctaagaaaga

SEQ ID NO: 5271029 - DNA, 17 bp, Homo sapiens
attcagtcctgggcaaa

SEQ ID NO: 5271030 - DNA, 16 bp, Homo sapiens
attcagtctatgctgt

SEQ ID NO: 5271031 - DNA, 18 bp, Homo sapiens
attcagtctatgctgtgt

SEQ ID NO: 5271032 - DNA, 21 bp, Homo sapiens
attcagtctatgctgtgtgca

SEQ ID NO: 5271033 - DNA, 13 bp, Homo sapiens
attcagtctgcag

SEQ ID NO: 5271034 - DNA, 15 bp, Homo sapiens
attcagtctgctctc

SEQ ID NO: 5271035 - DNA, 19 bp, Homo sapiens
attcagtctgctctccctt

SEQ ID NO: 5271036 - DNA, 12 bp, Homo sapiens
attcagtcttgc

SEQ ID NO: 5271037 - DNA, 20 bp, Homo sapiens
attcagtcttttctctgaaa

SEQ ID NO: 5271038 - DNA, 15 bp, Homo sapiens
attcagtgaatttgt

SEQ ID NO: 5271039 - DNA, 16 bp, Homo sapiens
attcagtgaatttgtc

SEQ ID NO: 5271040 - DNA, 10 bp, Homo sapiens
attcagtgac

SEQ ID NO: 5271041 - DNA, 11 bp, Homo sapiens
attcagtgaca

SEQ ID NO: 5271042 - DNA, 12 bp, Homo sapiens
attcagtgacat

SEQ ID NO: 5271043 - DNA, 17 bp, Homo sapiens
attcagtgacttctggc

SEQ ID NO: 5271044 - DNA, 19 bp, Homo sapiens
attcagtgacttctggctt

SEQ ID NO: 5271045 - DNA, 15 bp, Homo sapiens
attcagtgagggtct

SEQ ID NO: 5271046 - DNA, 17 bp, Homo sapiens
attcagtgcagcatata

SEQ ID NO: 5271047 - DNA, 16 bp, Homo sapiens
attcagtgccttcaac

SEQ ID NO: 5271048 - DNA, 19 bp, Homo sapiens
attcagtgcttcttaaaga

SEQ ID NO: 5271049 - DNA, 22 bp, Homo sapiens
attcagtgggaattgcagcata

SEQ ID NO: 5271050 - DNA, 18 bp, Homo sapiens
attcagtggtgaaatctt

SEQ ID NO: 5271051 - DNA, 19 bp, Homo sapiens
attcagtggtgaaatcttg

SEQ ID NO: 5271052 - DNA, 20 bp, Homo sapiens
attcagtggtgaaatcttgt

SEQ ID NO: 5271053 - DNA, 22 bp, Homo sapiens
attcagtggtgaaatcttgttt

SEQ ID NO: 5271054 - DNA, 18 bp, Homo sapiens
attcagtgtatttcagtt

SEQ ID NO: 5271055 - DNA, 20 bp, Homo sapiens
attcagttaagaaaaaaata

SEQ ID NO: 5271056 - DNA, 15 bp, Homo sapiens
attcagttagcagac

SEQ ID NO: 5271057 - DNA, 16 bp, Homo sapiens
attcagttatcactac

SEQ ID NO: 5271058 - DNA, 14 bp, Homo sapiens
attcagttccaata

SEQ ID NO: 5271059 - DNA, 20 bp, Homo sapiens
attcagttccaatacttcat

SEQ ID NO: 5271060 - DNA, 21 bp, Homo sapiens
attcagttccaatacttcatt

SEQ ID NO: 5271061 - DNA, 16 bp, Homo sapiens
attcagttcccagaat

SEQ ID NO: 5271062 - DNA, 19 bp, Homo sapiens
attcagttcccagaatcaa

SEQ ID NO: 5271063 - DNA, 13 bp, Homo sapiens
attcagttctagg

SEQ ID NO: 5271064 - DNA, 22 bp, Homo sapiens
attcagtttaagagttttcctt

SEQ ID NO: 5271065 - DNA, 20 bp, Homo sapiens
attcagtttctaaaattgag

SEQ ID NO: 5271066 - DNA, 12 bp, Homo sapiens
atggccatgccc

SEQ ID NO: 5271067 - DNA, 14 bp, Homo sapiens
atggccatgcccta

SEQ ID NO: 5271068 - DNA, 16 bp, Homo sapiens
atggccatgccctaga

SEQ ID NO: 5271069 - DNA, 13 bp, Homo sapiens
atggccatgctca

SEQ ID NO: 5271070 - DNA, 12 bp, Homo sapiens
atggccatggaa

SEQ ID NO: 5271071 - DNA, 22 bp, Homo sapiens
atggccatggagtgtacaagta

SEQ ID NO: 5271072 - DNA, 14 bp, Homo sapiens
atggccattttaaa

SEQ ID NO: 5271073 - DNA, 19 bp, Homo sapiens
atggcccaaaatgaccaac

SEQ ID NO: 5271074 - DNA, 11 bp, Homo sapiens
atggcccaagg

SEQ ID NO: 5271075 - DNA, 19 bp, Homo sapiens
atggcccagcagcttggct

SEQ ID NO: 5271076 - DNA, 19 bp, Homo sapiens
atggcccagccactgcagc

SEQ ID NO: 5271077 - DNA, 20 bp, Homo sapiens
atggcccagccactgcagca

SEQ ID NO: 5271078 - DNA, 17 bp, Homo sapiens
atggcccagcctggagc

SEQ ID NO: 5271079 - DNA, 15 bp, Homo sapiens
atggcccaggcagcc

SEQ ID NO: 5271080 - DNA, 15 bp, Homo sapiens
atggcccattctact

SEQ ID NO: 5271081 - DNA, 17 bp, Homo sapiens
atggcccattctacttg

SEQ ID NO: 5271082 - DNA, 19 bp, Homo sapiens
atggcccattctacttgct

SEQ ID NO: 5271083 - DNA, 23 bp, Homo sapiens
atggcccattctacttgctctgg

SEQ ID NO: 5271084 - DNA, 15 bp, Homo sapiens
atggccccagcacag

SEQ ID NO: 5271085 - DNA, 18 bp, Homo sapiens
atggccccagcacagctt

SEQ ID NO: 5271086 - DNA, 13 bp, Homo sapiens
atggccccagggt

SEQ ID NO: 5271087 - DNA, 14 bp, Homo sapiens
atggccccagggtt

SEQ ID NO: 5271088 - DNA, 13 bp, Homo sapiens
atggcccccaata

SEQ ID NO: 5271089 - DNA, 15 bp, Homo sapiens
atggcccccaataaa

SEQ ID NO: 5271090 - DNA, 22 bp, Homo sapiens
atggcccccaataaaggcagct

SEQ ID NO: 5271091 - DNA, 23 bp, Homo sapiens
atggcccccaataaaggcagctg

SEQ ID NO: 5271092 - DNA, 15 bp, Homo sapiens
atggccccccactcc

SEQ ID NO: 5271093 - DNA, 15 bp, Homo sapiens
atggcccctccactg

SEQ ID NO: 5271094 - DNA, 14 bp, Homo sapiens
atggcccctccagc

SEQ ID NO: 5271095 - DNA, 15 bp, Homo sapiens
atggcccctccagca

SEQ ID NO: 5271096 - DNA, 17 bp, Homo sapiens
atggcccctccaggaac

SEQ ID NO: 5271097 - DNA, 17 bp, Homo sapiens
atggcccctccttgcaa

SEQ ID NO: 5271098 - DNA, 22 bp, Homo sapiens
atggcccctccttgcaaccagg

SEQ ID NO: 5271099 - DNA, 18 bp, Homo sapiens
atggcccctctgacctgc

SEQ ID NO: 5271100 - DNA, 21 bp, Homo sapiens
atggcccgaagcgtgcggggc

SEQ ID NO: 5271101 - DNA, 17 bp, Homo sapiens
atggcccgacatttctt

SEQ ID NO: 5271102 - DNA, 19 bp, Homo sapiens
atggcccggatgctgcttc

SEQ ID NO: 5271103 - DNA, 19 bp, Homo sapiens
atggcccggcccctcctga

SEQ ID NO: 5271104 - DNA, 20 bp, Homo sapiens
atggcccggcccctcctgac

SEQ ID NO: 5271105 - DNA, 22 bp, Homo sapiens
atggcccggcccctcctgactc

SEQ ID NO: 5271106 - DNA, 19 bp, Homo sapiens
atggccctagaactgtgcc

SEQ ID NO: 5271107 - DNA, 14 bp, Homo sapiens
atggccctcattca

SEQ ID NO: 5271108 - DNA, 13 bp, Homo sapiens
atggccctctggt

SEQ ID NO: 5271109 - DNA, 13 bp, Homo sapiens
atggccctgctgc

SEQ ID NO: 5271110 - DNA, 14 bp, Homo sapiens
atggcccttcctgg

SEQ ID NO: 5271111 - DNA, 17 bp, Homo sapiens
atggccgcttctagagc

SEQ ID NO: 5271112 - DNA, 18 bp, Homo sapiens
atggccggagaggaccgg

SEQ ID NO: 5271113 - DNA, 18 bp, Homo sapiens
atggccgggctgctgctg

SEQ ID NO: 5271114 - DNA, 18 bp, Homo sapiens
atggccgtgaatgggtgc

SEQ ID NO: 5271115 - DNA, 16 bp, Homo sapiens
atggccgtggatggcc

SEQ ID NO: 5271116 - DNA, 21 bp, Homo sapiens
atggccgtgtagaagcatggt

SEQ ID NO: 5271117 - DNA, 18 bp, Homo sapiens
atggccgttgcctctctg

SEQ ID NO: 5271118 - DNA, 18 bp, Homo sapiens
atggcctatgcacatatg

SEQ ID NO: 5271119 - DNA, 21 bp, Homo sapiens
atggcctcaagatcaatgaaa

SEQ ID NO: 5271120 - DNA, 14 bp, Homo sapiens
atggcctcagccct

SEQ ID NO: 5271121 - DNA, 19 bp, Homo sapiens
atggcctcagctgcctcac

SEQ ID NO: 5271122 - DNA, 13 bp, Homo sapiens
atggcctcatgtg

SEQ ID NO: 5271123 - DNA, 15 bp, Homo sapiens
atggcctcccagcca

SEQ ID NO: 5271124 - DNA, 20 bp, Homo sapiens
atggcctcgcctccccaccc

SEQ ID NO: 5271125 - DNA, 21 bp, Homo sapiens
atggcctcgcctccccaccct

SEQ ID NO: 5271126 - DNA, 15 bp, Homo sapiens
atggcctctctccac

SEQ ID NO: 5271127 - DNA, 20 bp, Homo sapiens
atggcctctggggcaggacc

SEQ ID NO: 5271128 - DNA, 22 bp, Homo sapiens
atggcctcttactaatgtaaaa

SEQ ID NO: 5271129 - DNA, 15 bp, Homo sapiens
atggcctcttgaaga

SEQ ID NO: 5271130 - DNA, 16 bp, Homo sapiens
atggcctgacagctct

SEQ ID NO: 5271131 - DNA, 17 bp, Homo sapiens
atggcctgacagctctg

SEQ ID NO: 5271132 - DNA, 17 bp, Homo sapiens
atggcctgcaaactggg

SEQ ID NO: 5271133 - DNA, 18 bp, Homo sapiens
atggcctgcaaactggga

SEQ ID NO: 5271134 - DNA, 19 bp, Homo sapiens
atggcctgcagccacatgg

SEQ ID NO: 5271135 - DNA, 21 bp, Homo sapiens
atggcctgcagccacatggga

SEQ ID NO: 5271136 - DNA, 19 bp, Homo sapiens
atggcctgccttgaagcca

SEQ ID NO: 5271137 - DNA, 15 bp, Homo sapiens
atggcctggagcagg

SEQ ID NO: 5271138 - DNA, 14 bp, Homo sapiens
atggcctggaggga

SEQ ID NO: 5271139 - DNA, 20 bp, Homo sapiens
atggcctggctgcctggtgg

SEQ ID NO: 5271140 - DNA, 16 bp, Homo sapiens
atggcctgggggatgt

SEQ ID NO: 5271141 - DNA, 19 bp, Homo sapiens
atggcctgtgctgggccag

SEQ ID NO: 5271142 - DNA, 17 bp, Homo sapiens
atggccttaatatacta

SEQ ID NO: 5271143 - DNA, 17 bp, Homo sapiens
atggccttaatttcctt

SEQ ID NO: 5271144 - DNA, 16 bp, Homo sapiens
atggccttacactgaa

SEQ ID NO: 5271145 - DNA, 14 bp, Homo sapiens
atggccttcatatc

SEQ ID NO: 5271146 - DNA, 14 bp, Homo sapiens
atggccttccctcc

SEQ ID NO: 5271147 - DNA, 20 bp, Homo sapiens
atggccttgaaacagttcca

SEQ ID NO: 5271148 - DNA, 14 bp, Homo sapiens
atggccttgaagtg

SEQ ID NO: 5271149 - DNA, 18 bp, Homo sapiens
atggccttgaagtgtttt

SEQ ID NO: 5271150 - DNA, 19 bp, Homo sapiens
atggccttgcagcactcac

SEQ ID NO: 5271151 - DNA, 13 bp, Homo sapiens
atggcctttcctt

SEQ ID NO: 5271152 - DNA, 14 bp, Homo sapiens
atggcctttccttc

SEQ ID NO: 5271153 - DNA, 22 bp, Homo sapiens
atggccttttgctacgtgcctc

SEQ ID NO: 5271154 - DNA, 18 bp, Homo sapiens
atggcgatggggactctg

SEQ ID NO: 5271155 - DNA, 18 bp, Homo sapiens
atggcgattccctctcac

SEQ ID NO: 5271156 - DNA, 20 bp, Homo sapiens
atggcgattccctctcaccc

SEQ ID NO: 5271157 - DNA, 20 bp, Homo sapiens
atggcgcacccggcagcccc

SEQ ID NO: 5271158 - DNA, 22 bp, Homo sapiens
atggcgcacccggcagcccccc

SEQ ID NO: 5271159 - DNA, 18 bp, Homo sapiens
atggcgcagtgcctctgg

SEQ ID NO: 5271160 - DNA, 19 bp, Homo sapiens
atggcgcagtgcctctggt

SEQ ID NO: 5271161 - DNA, 13 bp, Homo sapiens
atggcgccctgcc

SEQ ID NO: 5271162 - DNA, 20 bp, Homo sapiens
atggcgccctgcctcctgga

SEQ ID NO: 5271163 - DNA, 23 bp, Homo sapiens
atggcgcgggaggcaccagctct

SEQ ID NO: 5271164 - DNA, 23 bp, Homo sapiens
atggcgctaggggacttggggat

SEQ ID NO: 5271165 - DNA, 14 bp, Homo sapiens
atggcgggcactgg

SEQ ID NO: 5271166 - DNA, 15 bp, Homo sapiens
atggcgggtgggggt

SEQ ID NO: 5271167 - DNA, 20 bp, Homo sapiens
atggcgggtgggggtggaat

SEQ ID NO: 5271168 - DNA, 20 bp, Homo sapiens
atggcggtgatcagcagaga

SEQ ID NO: 5271169 - DNA, 15 bp, Homo sapiens
atggcggtggagggg

SEQ ID NO: 5271170 - DNA, 18 bp, Homo sapiens
atggcgtaagtacagaga

SEQ ID NO: 5271171 - DNA, 18 bp, Homo sapiens
atggcgtaatgggcctgc

SEQ ID NO: 5271172 - DNA, 21 bp, Homo sapiens
atggcgtagagggtgctgccc

SEQ ID NO: 5271173 - DNA, 19 bp, Homo sapiens
atggcgtctgctctggtgg

SEQ ID NO: 5271174 - DNA, 15 bp, Homo sapiens
atggcgtgtcccctg

SEQ ID NO: 5271175 - DNA, 23 bp, Homo sapiens
atggcgttttgtctgtgttgctg

SEQ ID NO: 5271176 - DNA, 17 bp, Homo sapiens
atggcgtttttctcgtc

SEQ ID NO: 5271177 - DNA, 19 bp, Homo sapiens
atggctaagcaaaatgtga

SEQ ID NO: 5271178 - DNA, 21 bp, Homo sapiens
atggctaagcttaaaaaaaac

SEQ ID NO: 5271179 - DNA, 17 bp, Homo sapiens
atggctaaggcaccagc

SEQ ID NO: 5271180 - DNA, 18 bp, Homo sapiens
atggctaaggcaccagcc

SEQ ID NO: 5271181 - DNA, 18 bp, Homo sapiens
atggctaataaactgtat

SEQ ID NO: 5271182 - DNA, 20 bp, Homo sapiens
atggctaataaactgtatta

SEQ ID NO: 5271183 - DNA, 18 bp, Homo sapiens
atggctaatgtactgcat

SEQ ID NO: 5271184 - DNA, 13 bp, Homo sapiens
atggctacctcag

SEQ ID NO: 5271185 - DNA, 17 bp, Homo sapiens
atggctacttgctttga

SEQ ID NO: 5271186 - DNA, 15 bp, Homo sapiens
atggctagcctttct

SEQ ID NO: 5271187 - DNA, 21 bp, Homo sapiens
atggctaggaaagggaagcct

SEQ ID NO: 5271188 - DNA, 23 bp, Homo sapiens
atggctaggaaagggaagcctga

SEQ ID NO: 5271189 - DNA, 23 bp, Homo sapiens
atggctagtactgtattggctct

SEQ ID NO: 5271190 - DNA, 21 bp, Homo sapiens
atggctataaacaattacatg

SEQ ID NO: 5271191 - DNA, 16 bp, Homo sapiens
atggctataaatatat

SEQ ID NO: 5271192 - DNA, 14 bp, Homo sapiens
atggctatatggca

SEQ ID NO: 5271193 - DNA, 17 bp, Homo sapiens
atggctatcaaaagaaa

SEQ ID NO: 5271194 - DNA, 21 bp, Homo sapiens
atggctatcatcaaaagtgta

SEQ ID NO: 5271195 - DNA, 22 bp, Homo sapiens
atggctatctatacctgccttt

SEQ ID NO: 5271196 - DNA, 14 bp, Homo sapiens
atggctatgcttaa

SEQ ID NO: 5271197 - DNA, 15 bp, Homo sapiens
atggctattataatg

SEQ ID NO: 5271198 - DNA, 17 bp, Homo sapiens
atggctatttttgaagc

SEQ ID NO: 5271199 - DNA, 19 bp, Homo sapiens
atggctatttttgaagcaa

SEQ ID NO: 5271200 - DNA, 14 bp, Homo sapiens
atggctcaagtaga

SEQ ID NO: 5271201 - DNA, 15 bp, Homo sapiens
atggctcaagtagaa

SEQ ID NO: 5271202 - DNA, 16 bp, Homo sapiens
atggctcaagtagaaa

SEQ ID NO: 5271203 - DNA, 16 bp, Homo sapiens
atggctcactatgaat

SEQ ID NO: 5271204 - DNA, 20 bp, Homo sapiens
atggctcactatgaatctat

SEQ ID NO: 5271205 - DNA, 19 bp, Homo sapiens
atggctcaggcaagcccct

SEQ ID NO: 5271206 - DNA, 14 bp, Homo sapiens
atggctcatcagat

SEQ ID NO: 5271207 - DNA, 15 bp, Homo sapiens
atggctccagaaatg

SEQ ID NO: 5271208 - DNA, 19 bp, Homo sapiens
atggctcccctgaggctgg

SEQ ID NO: 5271209 - DNA, 13 bp, Homo sapiens
atggctcctctca

SEQ ID NO: 5271210 - DNA, 15 bp, Homo sapiens
atggctcctgtctgg

SEQ ID NO: 5271211 - DNA, 23 bp, Homo sapiens
atggctccttgggatgaagaggg

SEQ ID NO: 5271212 - DNA, 17 bp, Homo sapiens
atggctcgtgggctctg

SEQ ID NO: 5271213 - DNA, 22 bp, Homo sapiens
atggctcgtgggctctggctcc

SEQ ID NO: 5271214 - DNA, 19 bp, Homo sapiens
atggctctaacattactgc

SEQ ID NO: 5271215 - DNA, 22 bp, Homo sapiens
atggctctatttcttcttcaca

SEQ ID NO: 5271216 - DNA, 18 bp, Homo sapiens
atggctctcaagtgaaag

SEQ ID NO: 5271217 - DNA, 15 bp, Homo sapiens
atggctctgttatgc

SEQ ID NO: 5271218 - DNA, 23 bp, Homo sapiens
atggctcttgcaacatctcccct

SEQ ID NO: 5271219 - DNA, 13 bp, Homo sapiens
atggctgaagaaa

SEQ ID NO: 5271220 - DNA, 16 bp, Homo sapiens
atggctgaagaaacac

SEQ ID NO: 5271221 - DNA, 19 bp, Homo sapiens
atggctgaagaaacacagc

SEQ ID NO: 5271222 - DNA, 23 bp, Homo sapiens
atggctgaagctggagcagcgga

SEQ ID NO: 5271223 - DNA, 23 bp, Homo sapiens
atggctgaagtgcatgggtcagg

SEQ ID NO: 5271224 - DNA, 18 bp, Homo sapiens
atggctgactttgctctt

SEQ ID NO: 5271225 - DNA, 18 bp, Homo sapiens
atggctgatttatttcta

SEQ ID NO: 5271226 - DNA, 22 bp, Homo sapiens
atggctgcacgtaggttcccca

SEQ ID NO: 5271227 - DNA, 15 bp, Homo sapiens
atggctgcagtcctc

SEQ ID NO: 5271228 - DNA, 17 bp, Homo sapiens
atggctgcatagtattc

SEQ ID NO: 5271229 - DNA, 21 bp, Homo sapiens
atggctgcatcaaatgcatgc

SEQ ID NO: 5271230 - DNA, 22 bp, Homo sapiens
atggctgcatcaaatgcatgcg

SEQ ID NO: 5271231 - DNA, 23 bp, Homo sapiens
atggctgccaatgggagctcatg

SEQ ID NO: 5271232 - DNA, 12 bp, Homo sapiens
atggctgcccag

SEQ ID NO: 5271233 - DNA, 16 bp, Homo sapiens
atggctgcccaggaga

SEQ ID NO: 5271234 - DNA, 13 bp, Homo sapiens
atggctgcctgca

SEQ ID NO: 5271235 - DNA, 22 bp, Homo sapiens
atggctgctagattttaattta

SEQ ID NO: 5271236 - DNA, 16 bp, Homo sapiens
atggctgctgcctgct

SEQ ID NO: 5271237 - DNA, 18 bp, Homo sapiens
atggctgctgcctgctca

SEQ ID NO: 5271238 - DNA, 15 bp, Homo sapiens
atggctgctgctcac

SEQ ID NO: 5271239 - DNA, 16 bp, Homo sapiens
atggctgctgctcacc

SEQ ID NO: 5271240 - DNA, 11 bp, Homo sapiens
atggctgctgg

SEQ ID NO: 5271241 - DNA, 22 bp, Homo sapiens
atggctgctggaggggacgctg

SEQ ID NO: 5271242 - DNA, 19 bp, Homo sapiens
atggctgcttgattttgta

SEQ ID NO: 5271243 - DNA, 22 bp, Homo sapiens
atggctgctttgacaaggcaga

SEQ ID NO: 5271244 - DNA, 15 bp, Homo sapiens
attcagtttttgtat

SEQ ID NO: 5271245 - DNA, 16 bp, Homo sapiens
attcagtttttgtatc

SEQ ID NO: 5271246 - DNA, 18 bp, Homo sapiens
attcagtttttgtatctt

SEQ ID NO: 5271247 - DNA, 12 bp, Homo sapiens
attcataaatct

SEQ ID NO: 5271248 - DNA, 14 bp, Homo sapiens
attcataacaatgt

SEQ ID NO: 5271249 - DNA, 18 bp, Homo sapiens
attcataacaatgtatgt

SEQ ID NO: 5271250 - DNA, 12 bp, Homo sapiens
attcataaccat

SEQ ID NO: 5271251 - DNA, 11 bp, Homo sapiens
attcataataa

SEQ ID NO: 5271252 - DNA, 14 bp, Homo sapiens
attcataataaact

SEQ ID NO: 5271253 - DNA, 22 bp, Homo sapiens
attcataatgaattataacagt

SEQ ID NO: 5271254 - DNA, 13 bp, Homo sapiens
attcataatgtga

SEQ ID NO: 5271255 - DNA, 20 bp, Homo sapiens
attcataattaaaatttatc

SEQ ID NO: 5271256 - DNA, 13 bp, Homo sapiens
attcatacaacaa

SEQ ID NO: 5271257 - DNA, 17 bp, Homo sapiens
attcatacaacaaagag

SEQ ID NO: 5271258 - DNA, 18 bp, Homo sapiens
attcataccttctgatga

SEQ ID NO: 5271259 - DNA, 14 bp, Homo sapiens
attcatactctgtt

SEQ ID NO: 5271260 - DNA, 13 bp, Homo sapiens
attcatactgaca

SEQ ID NO: 5271261 - DNA, 16 bp, Homo sapiens
attcatactgtagaaa

SEQ ID NO: 5271262 - DNA, 14 bp, Homo sapiens
attcatactttcca

SEQ ID NO: 5271263 - DNA, 13 bp, Homo sapiens
attcatagaataa

SEQ ID NO: 5271264 - DNA, 17 bp, Homo sapiens
attcatagtaaaatacc

SEQ ID NO: 5271265 - DNA, 16 bp, Homo sapiens
attcatagtaacttct

SEQ ID NO: 5271266 - DNA, 19 bp, Homo sapiens
attcatagtaacttcttat

SEQ ID NO: 5271267 - DNA, 20 bp, Homo sapiens
attcatagtctttggagaaa

SEQ ID NO: 5271268 - DNA, 16 bp, Homo sapiens
attcatataaaagttg

SEQ ID NO: 5271269 - DNA, 23 bp, Homo sapiens
attcatatattttatgaatcaga

SEQ ID NO: 5271270 - DNA, 21 bp, Homo sapiens
attcatatctaaatagtattt

SEQ ID NO: 5271271 - DNA, 13 bp, Homo sapiens
attcatatgcttc

SEQ ID NO: 5271272 - DNA, 15 bp, Homo sapiens
attcatattcctgcc

SEQ ID NO: 5271273 - DNA, 16 bp, Homo sapiens
attcatattcttcata

SEQ ID NO: 5271274 - DNA, 14 bp, Homo sapiens
attcatattctttt

SEQ ID NO: 5271275 - DNA, 15 bp, Homo sapiens
attcatattggaaaa

SEQ ID NO: 5271276 - DNA, 20 bp, Homo sapiens
attcatatttacttcttata

SEQ ID NO: 5271277 - DNA, 17 bp, Homo sapiens
attcatatttgtacttt

SEQ ID NO: 5271278 - DNA, 23 bp, Homo sapiens
attcatatttgtactttctgtta

SEQ ID NO: 5271279 - DNA, 19 bp, Homo sapiens
attcatcaaataaaccttg

SEQ ID NO: 5271280 - DNA, 14 bp, Homo sapiens
attcatcagcagga

SEQ ID NO: 5271281 - DNA, 13 bp, Homo sapiens
attcatcatatga

SEQ ID NO: 5271282 - DNA, 16 bp, Homo sapiens
attcatccagcagtgt

SEQ ID NO: 5271283 - DNA, 18 bp, Homo sapiens
attcatccaggactgaga

SEQ ID NO: 5271284 - DNA, 19 bp, Homo sapiens
attcatccaggactgagat

SEQ ID NO: 5271285 - DNA, 21 bp, Homo sapiens
attcatccaggactgagatgc

SEQ ID NO: 5271286 - DNA, 19 bp, Homo sapiens
attcatccagttgcaataa

SEQ ID NO: 5271287 - DNA, 22 bp, Homo sapiens
attcatccagttgcaataaaat

SEQ ID NO: 5271288 - DNA, 19 bp, Homo sapiens
attcatccatccgttcatt

SEQ ID NO: 5271289 - DNA, 20 bp, Homo sapiens
attcatccatccgttcattc

SEQ ID NO: 5271290 - DNA, 17 bp, Homo sapiens
attcatcctcacatgtg

SEQ ID NO: 5271291 - DNA, 19 bp, Homo sapiens
attcatcctgggatgtaaa

SEQ ID NO: 5271292 - DNA, 20 bp, Homo sapiens
attcatcctgggatgtaaac

SEQ ID NO: 5271293 - DNA, 20 bp, Homo sapiens
attcatctagttaagtcgct

SEQ ID NO: 5271294 - DNA, 16 bp, Homo sapiens
attcatctatttcgag

SEQ ID NO: 5271295 - DNA, 19 bp, Homo sapiens
attcatctctcaaacttag

SEQ ID NO: 5271296 - DNA, 22 bp, Homo sapiens
attcatctctctttaatataaa

SEQ ID NO: 5271297 - DNA, 13 bp, Homo sapiens
attcatctctggt

SEQ ID NO: 5271298 - DNA, 15 bp, Homo sapiens
attcatctgggctgg

SEQ ID NO: 5271299 - DNA, 18 bp, Homo sapiens
attcatctgtctatattt

SEQ ID NO: 5271300 - DNA, 17 bp, Homo sapiens
attcatctgtgaatctg

SEQ ID NO: 5271301 - DNA, 13 bp, Homo sapiens
attcatctttcag

SEQ ID NO: 5271302 - DNA, 17 bp, Homo sapiens
attcatctttcagaaat

SEQ ID NO: 5271303 - DNA, 19 bp, Homo sapiens
attcatctttcagaaataa

SEQ ID NO: 5271304 - DNA, 21 bp, Homo sapiens
attcatcttttaatcatgagc

SEQ ID NO: 5271305 - DNA, 15 bp, Homo sapiens
attcatcttttgtat

SEQ ID NO: 5271306 - DNA, 17 bp, Homo sapiens
attcatgaacttcgcat

SEQ ID NO: 5271307 - DNA, 13 bp, Homo sapiens
attcatgaagagt

SEQ ID NO: 5271308 - DNA, 21 bp, Homo sapiens
attcatgaagagttgtttata

SEQ ID NO: 5271309 - DNA, 20 bp, Homo sapiens
attcatgaagcttacttttt

SEQ ID NO: 5271310 - DNA, 22 bp, Homo sapiens
attcatgagattggtcattaaa

SEQ ID NO: 5271311 - DNA, 16 bp, Homo sapiens
attcatgaggagggtg

SEQ ID NO: 5271312 - DNA, 18 bp, Homo sapiens
attcatgatgctagttct

SEQ ID NO: 5271313 - DNA, 21 bp, Homo sapiens
attcatgccaaagcaaaagaa

SEQ ID NO: 5271314 - DNA, 15 bp, Homo sapiens
attcatgccatctgt

SEQ ID NO: 5271315 - DNA, 15 bp, Homo sapiens
attcatgcctcaagt

SEQ ID NO: 5271316 - DNA, 17 bp, Homo sapiens
attcatgcctttcatag

SEQ ID NO: 5271317 - DNA, 19 bp, Homo sapiens
attcatgctgcctgccatg

SEQ ID NO: 5271318 - DNA, 18 bp, Homo sapiens
attcatgcttgccatctg

SEQ ID NO: 5271319 - DNA, 19 bp, Homo sapiens
attcatgctttctcctttt

SEQ ID NO: 5271320 - DNA, 20 bp, Homo sapiens
attcatggatatttgtcaac

SEQ ID NO: 5271321 - DNA, 12 bp, Homo sapiens
attcatggctac

SEQ ID NO: 5271322 - DNA, 19 bp, Homo sapiens
attcatggctacctcagaa

SEQ ID NO: 5271323 - DNA, 17 bp, Homo sapiens
attcatggcttatgctt

SEQ ID NO: 5271324 - DNA, 15 bp, Homo sapiens
attcatggctttgta

SEQ ID NO: 5271325 - DNA, 13 bp, Homo sapiens
attcatgggtgtc

SEQ ID NO: 5271326 - DNA, 17 bp, Homo sapiens
attcatggttcaagtat

SEQ ID NO: 5271327 - DNA, 12 bp, Homo sapiens
attcatgtaaac

SEQ ID NO: 5271328 - DNA, 16 bp, Homo sapiens
attcatgtaacactgt

SEQ ID NO: 5271329 - DNA, 15 bp, Homo sapiens
attcatgtaactctc

SEQ ID NO: 5271330 - DNA, 12 bp, Homo sapiens
attcatgtaata

SEQ ID NO: 5271331 - DNA, 13 bp, Homo sapiens
attcatgtaataa

SEQ ID NO: 5271332 - DNA, 17 bp, Homo sapiens
attcatgtaataaatct

SEQ ID NO: 5271333 - DNA, 19 bp, Homo sapiens
attcatgtaataaatctga

SEQ ID NO: 5271334 - DNA, 15 bp, Homo sapiens
attcatgtattttgt

SEQ ID NO: 5271335 - DNA, 17 bp, Homo sapiens
attcatgtattttgttt

SEQ ID NO: 5271336 - DNA, 17 bp, Homo sapiens
attcatgtgtacagaaa

SEQ ID NO: 5271337 - DNA, 22 bp, Homo sapiens
attcatgttatatttaatgcat

SEQ ID NO: 5271338 - DNA, 15 bp, Homo sapiens
attcatgttcatcaa

SEQ ID NO: 5271339 - DNA, 18 bp, Homo sapiens
attcatgttcatgtgatt

SEQ ID NO: 5271340 - DNA, 20 bp, Homo sapiens
attcatgttcatgtgattaa

SEQ ID NO: 5271341 - DNA, 21 bp, Homo sapiens
attcatgtttaacgtttctca

SEQ ID NO: 5271342 - DNA, 13 bp, Homo sapiens
attcatgttttga

SEQ ID NO: 5271343 - DNA, 18 bp, Homo sapiens
attcattaaaaacatttt

SEQ ID NO: 5271344 - DNA, 15 bp, Homo sapiens
attcattaaagaaaa

SEQ ID NO: 5271345 - DNA, 16 bp, Homo sapiens
attcattaaatgtttg

SEQ ID NO: 5271346 - DNA, 16 bp, Homo sapiens
attcattaagcttttt

SEQ ID NO: 5271347 - DNA, 21 bp, Homo sapiens
attcattaagtaatcttttta

SEQ ID NO: 5271348 - DNA, 13 bp, Homo sapiens
attcattaatata

SEQ ID NO: 5271349 - DNA, 13 bp, Homo sapiens
attcattaattag

SEQ ID NO: 5271350 - DNA, 14 bp, Homo sapiens
attcattacagctt

SEQ ID NO: 5271351 - DNA, 15 bp, Homo sapiens
attcattacatcctc

SEQ ID NO: 5271352 - DNA, 14 bp, Homo sapiens
attcattagttttg

SEQ ID NO: 5271353 - DNA, 15 bp, Homo sapiens
attcattataatttg

SEQ ID NO: 5271354 - DNA, 14 bp, Homo sapiens
attcattatgtcaa

SEQ ID NO: 5271355 - DNA, 13 bp, Homo sapiens
attcattattcct

SEQ ID NO: 5271356 - DNA, 23 bp, Homo sapiens
attcattattcctcagattgctg

SEQ ID NO: 5271357 - DNA, 15 bp, Homo sapiens
attcattatttgtca

SEQ ID NO: 5271358 - DNA, 20 bp, Homo sapiens
attcattatttttccacttt

SEQ ID NO: 5271359 - DNA, 20 bp, Homo sapiens
attcattcacaatggattat

SEQ ID NO: 5271360 - DNA, 13 bp, Homo sapiens
attcattcagtga

SEQ ID NO: 5271361 - DNA, 17 bp, Homo sapiens
attcattcatcctctta

SEQ ID NO: 5271362 - DNA, 22 bp, Homo sapiens
attcattcctgatggaattgtt

SEQ ID NO: 5271363 - DNA, 22 bp, Homo sapiens
attcattctcataattcctaca

SEQ ID NO: 5271364 - DNA, 18 bp, Homo sapiens
attcattctgcattgcta

SEQ ID NO: 5271365 - DNA, 15 bp, Homo sapiens
attcattctggaggg

SEQ ID NO: 5271366 - DNA, 19 bp, Homo sapiens
attcattctggtctctcta

SEQ ID NO: 5271367 - DNA, 18 bp, Homo sapiens
attcattctgtgatcatt

SEQ ID NO: 5271368 - DNA, 19 bp, Homo sapiens
attcattcttaatttatgt

SEQ ID NO: 5271369 - DNA, 21 bp, Homo sapiens
attcattcttaatttatgtaa

SEQ ID NO: 5271370 - DNA, 16 bp, Homo sapiens
attcattctttataaa

SEQ ID NO: 5271371 - DNA, 17 bp, Homo sapiens
attcattgtctcagtga

SEQ ID NO: 5271372 - DNA, 22 bp, Homo sapiens
attcattgtggttatttttata

SEQ ID NO: 5271373 - DNA, 16 bp, Homo sapiens
attcattgttaaaaaa

SEQ ID NO: 5271374 - DNA, 20 bp, Homo sapiens
attcattgttaaaaaacaac

SEQ ID NO: 5271375 - DNA, 23 bp, Homo sapiens
attcattgttttgcaaaagtgta

SEQ ID NO: 5271376 - DNA, 16 bp, Homo sapiens
attcatttaagaacaa

SEQ ID NO: 5271377 - DNA, 22 bp, Homo sapiens
attcatttaagaacaagagacc

SEQ ID NO: 5271378 - DNA, 22 bp, Homo sapiens
attcatttcatagccaaacagg

SEQ ID NO: 5271379 - DNA, 23 bp, Homo sapiens
attcatttcatagccaaacagga

SEQ ID NO: 5271380 - DNA, 14 bp, Homo sapiens
attcatttcatcta

SEQ ID NO: 5271381 - DNA, 14 bp, Homo sapiens
attcatttcatggt

SEQ ID NO: 5271382 - DNA, 12 bp, Homo sapiens
attcatttcctg

SEQ ID NO: 5271383 - DNA, 13 bp, Homo sapiens
attcatttcctgc

SEQ ID NO: 5271384 - DNA, 14 bp, Homo sapiens
attcatttcctgcc

SEQ ID NO: 5271385 - DNA, 11 bp, Homo sapiens
attcatttcta

SEQ ID NO: 5271386 - DNA, 19 bp, Homo sapiens
attcatttctagactcaaa

SEQ ID NO: 5271387 - DNA, 12 bp, Homo sapiens
attcatttgtat

SEQ ID NO: 5271388 - DNA, 18 bp, Homo sapiens
attcatttgtggcaatta

SEQ ID NO: 5271389 - DNA, 21 bp, Homo sapiens
attcattttaacatctgagaa

SEQ ID NO: 5271390 - DNA, 14 bp, Homo sapiens
attcattttatatt

SEQ ID NO: 5271391 - DNA, 10 bp, Homo sapiens
attcattttc

SEQ ID NO: 5271392 - DNA, 16 bp, Homo sapiens
attcattttcattgtt

SEQ ID NO: 5271393 - DNA, 22 bp, Homo sapiens
attcattttcctgttcagtgag

SEQ ID NO: 5271394 - DNA, 14 bp, Homo sapiens
attcattttctaga

SEQ ID NO: 5271395 - DNA, 16 bp, Homo sapiens
attcattttctcttta

SEQ ID NO: 5271396 - DNA, 15 bp, Homo sapiens
attcattttctgaca

SEQ ID NO: 5271397 - DNA, 18 bp, Homo sapiens
attcattttctgacatgc

SEQ ID NO: 5271398 - DNA, 20 bp, Homo sapiens
attcattttctgacatgcat

SEQ ID NO: 5271399 - DNA, 14 bp, Homo sapiens
attcattttgcaac

SEQ ID NO: 5271400 - DNA, 17 bp, Homo sapiens
attcattttgcaacttg

SEQ ID NO: 5271401 - DNA, 23 bp, Homo sapiens
attcattttgtggcaaaatattc

SEQ ID NO: 5271402 - DNA, 13 bp, Homo sapiens
attcatttttaag

SEQ ID NO: 5271403 - DNA, 13 bp, Homo sapiens
attcatttttaat

SEQ ID NO: 5271404 - DNA, 16 bp, Homo sapiens
attcatttttaccttg

SEQ ID NO: 5271405 - DNA, 22 bp, Homo sapiens
attcatttttgaaactgcattt

SEQ ID NO: 5271406 - DNA, 17 bp, Homo sapiens
attccaaaaagcacata

SEQ ID NO: 5271407 - DNA, 22 bp, Homo sapiens
attccaaaatacaatgttatca

SEQ ID NO: 5271408 - DNA, 12 bp, Homo sapiens
attccaaaatat

SEQ ID NO: 5271409 - DNA, 21 bp, Homo sapiens
attccaaaccaaattttaatt

SEQ ID NO: 5271410 - DNA, 20 bp, Homo sapiens
attccaaagagtagaattgc

SEQ ID NO: 5271411 - DNA, 23 bp, Homo sapiens
attccaaagctttattaccagtg

SEQ ID NO: 5271412 - DNA, 16 bp, Homo sapiens
attccaaagtctctaa

SEQ ID NO: 5271413 - DNA, 15 bp, Homo sapiens
attccaaagttctta

SEQ ID NO: 5271414 - DNA, 23 bp, Homo sapiens
attccaaataaaacttgagccca

SEQ ID NO: 5271415 - DNA, 18 bp, Homo sapiens
attccaaatagcccacac

SEQ ID NO: 5271416 - DNA, 15 bp, Homo sapiens
attccaacaaagggt

SEQ ID NO: 5271417 - DNA, 16 bp, Homo sapiens
attccaacacctgcca

SEQ ID NO: 5271418 - DNA, 17 bp, Homo sapiens
attccaacagtttaatg

SEQ ID NO: 5271419 - DNA, 20 bp, Homo sapiens
attccaactgggcatttcaa

SEQ ID NO: 5271420 - DNA, 22 bp, Homo sapiens
attccaactgggcatttcaatc

SEQ ID NO: 5271421 - DNA, 14 bp, Homo sapiens
attccaacttgaag

SEQ ID NO: 5271422 - DNA, 16 bp, Homo sapiens
attccaacttgaagga

SEQ ID NO: 5271423 - DNA, 15 bp, Homo sapiens
attccaactttcagg

SEQ ID NO: 5271424 - DNA, 19 bp, Homo sapiens
atggctggaacactgtact

SEQ ID NO: 5271425 - DNA, 23 bp, Homo sapiens
atggctggcaggcagttctagaa

SEQ ID NO: 5271426 - DNA, 23 bp, Homo sapiens
atggctggccactgcacagagct

SEQ ID NO: 5271427 - DNA, 18 bp, Homo sapiens
atggctggcctggtaagg

SEQ ID NO: 5271428 - DNA, 20 bp, Homo sapiens
atggctgggagggggccctt

SEQ ID NO: 5271429 - DNA, 16 bp, Homo sapiens
atggctggggccgctg

SEQ ID NO: 5271430 - DNA, 22 bp, Homo sapiens
atggctggggggtctcagcatg

SEQ ID NO: 5271431 - DNA, 15 bp, Homo sapiens
atggctgggtccttg

SEQ ID NO: 5271432 - DNA, 17 bp, Homo sapiens
atggctgtaaactataa

SEQ ID NO: 5271433 - DNA, 18 bp, Homo sapiens
atggctgtaaactataaa

SEQ ID NO: 5271434 - DNA, 16 bp, Homo sapiens
atggctgtatttgctg

SEQ ID NO: 5271435 - DNA, 19 bp, Homo sapiens
atggctgtatttttagaga

SEQ ID NO: 5271436 - DNA, 13 bp, Homo sapiens
atggctgtctgca

SEQ ID NO: 5271437 - DNA, 18 bp, Homo sapiens
atggctgtctgcacagag

SEQ ID NO: 5271438 - DNA, 19 bp, Homo sapiens
atggctgtgaaaattacac

SEQ ID NO: 5271439 - DNA, 13 bp, Homo sapiens
atggctgtgcccc

SEQ ID NO: 5271440 - DNA, 17 bp, Homo sapiens
atggctgtgccccacct

SEQ ID NO: 5271441 - DNA, 21 bp, Homo sapiens
atggctgtgccccacctgttg

SEQ ID NO: 5271442 - DNA, 20 bp, Homo sapiens
atggctgtgcctctgcctgt

SEQ ID NO: 5271443 - DNA, 19 bp, Homo sapiens
atggctgttatctgtcttt

SEQ ID NO: 5271444 - DNA, 22 bp, Homo sapiens
atggctgttgaggttctcattt

SEQ ID NO: 5271445 - DNA, 16 bp, Homo sapiens
atggcttaatgtttat

SEQ ID NO: 5271446 - DNA, 16 bp, Homo sapiens
atggcttataaatgtg

SEQ ID NO: 5271447 - DNA, 17 bp, Homo sapiens
atggcttataaatgtgt

SEQ ID NO: 5271448 - DNA, 19 bp, Homo sapiens
atggcttatccagctggtg

SEQ ID NO: 5271449 - DNA, 14 bp, Homo sapiens
atggcttatttcta

SEQ ID NO: 5271450 - DNA, 15 bp, Homo sapiens
atggcttatttctat

SEQ ID NO: 5271451 - DNA, 21 bp, Homo sapiens
atggcttatttctatgacaaa

SEQ ID NO: 5271452 - DNA, 21 bp, Homo sapiens
atggcttccctctttcatctc

SEQ ID NO: 5271453 - DNA, 17 bp, Homo sapiens
atggcttcctcctccct

SEQ ID NO: 5271454 - DNA, 23 bp, Homo sapiens
atggcttcctggcaatagtcaaa

SEQ ID NO: 5271455 - DNA, 18 bp, Homo sapiens
atggcttcggagggccgc

SEQ ID NO: 5271456 - DNA, 13 bp, Homo sapiens
atggcttctcctt

SEQ ID NO: 5271457 - DNA, 15 bp, Homo sapiens
atggcttgacatgtg

SEQ ID NO: 5271458 - DNA, 16 bp, Homo sapiens
atggcttgacatgtgc

SEQ ID NO: 5271459 - DNA, 16 bp, Homo sapiens
atggcttgagcccagg

SEQ ID NO: 5271460 - DNA, 21 bp, Homo sapiens
atggcttggggggctccaggg

SEQ ID NO: 5271461 - DNA, 15 bp, Homo sapiens
atggctttaaataaa

SEQ ID NO: 5271462 - DNA, 23 bp, Homo sapiens
atggctttatttgttttttttgt

SEQ ID NO: 5271463 - DNA, 18 bp, Homo sapiens
atggctttatttttttga

SEQ ID NO: 5271464 - DNA, 13 bp, Homo sapiens
atggctttcaaag

SEQ ID NO: 5271465 - DNA, 21 bp, Homo sapiens
atggctttcactttctctttt

SEQ ID NO: 5271466 - DNA, 20 bp, Homo sapiens
atggctttcatcctgtgtcc

SEQ ID NO: 5271467 - DNA, 18 bp, Homo sapiens
atggctttgataattgtt

SEQ ID NO: 5271468 - DNA, 16 bp, Homo sapiens
atggctttgctttgtg

SEQ ID NO: 5271469 - DNA, 19 bp, Homo sapiens
atggctttgctttgtgtaa

SEQ ID NO: 5271470 - DNA, 16 bp, Homo sapiens
atggctttgtcttgaa

SEQ ID NO: 5271471 - DNA, 19 bp, Homo sapiens
atggctttgtcttgaaaaa

SEQ ID NO: 5271472 - DNA, 16 bp, Homo sapiens
atggctttgtgctgct

SEQ ID NO: 5271473 - DNA, 21 bp, Homo sapiens
atggcttttcttacccagatt

SEQ ID NO: 5271474 - DNA, 23 bp, Homo sapiens
atggctttttctttttttgcata

SEQ ID NO: 5271475 - DNA, 22 bp, Homo sapiens
atggctttttttgcctaccatt

SEQ ID NO: 5271476 - DNA, 24 bp, Homo sapiens
atggctttttttgcctaccatttc

SEQ ID NO: 5271477 - DNA, 22 bp, Homo sapiens
atgggaaaaaaacaaacaaaaa

SEQ ID NO: 5271478 - DNA, 17 bp, Homo sapiens
atgggaaaaactgcagt

SEQ ID NO: 5271479 - DNA, 16 bp, Homo sapiens
atgggaaaaagagact

SEQ ID NO: 5271480 - DNA, 20 bp, Homo sapiens
atgggaaaaatgttggaatg

SEQ ID NO: 5271481 - DNA, 17 bp, Homo sapiens
atgggaaaatatttcct

SEQ ID NO: 5271482 - DNA, 18 bp, Homo sapiens
atgggaaaatatttcctg

SEQ ID NO: 5271483 - DNA, 20 bp, Homo sapiens
atgggaaacgtatgtgtgca

SEQ ID NO: 5271484 - DNA, 16 bp, Homo sapiens
atgggaaactgctttt

SEQ ID NO: 5271485 - DNA, 20 bp, Homo sapiens
atgggaaagcattgtaaatg

SEQ ID NO: 5271486 - DNA, 21 bp, Homo sapiens
atgggaaagcggcgccacaga

SEQ ID NO: 5271487 - DNA, 23 bp, Homo sapiens
atgggaaaggaggcatgcctctg

SEQ ID NO: 5271488 - DNA, 18 bp, Homo sapiens
atgggaaagtattctctt

SEQ ID NO: 5271489 - DNA, 22 bp, Homo sapiens
atgggaaagtattctcttttca

SEQ ID NO: 5271490 - DNA, 18 bp, Homo sapiens
atgggaaatagcggccct

SEQ ID NO: 5271491 - DNA, 21 bp, Homo sapiens
atgggaaatagcggccctgga

SEQ ID NO: 5271492 - DNA, 20 bp, Homo sapiens
atgggaaatgcctaagaaga

SEQ ID NO: 5271493 - DNA, 23 bp, Homo sapiens
atgggaaatgtcgattttcaata

SEQ ID NO: 5271494 - DNA, 15 bp, Homo sapiens
atgggaacaagtgta

SEQ ID NO: 5271495 - DNA, 22 bp, Homo sapiens
atgggaacaagtgtacagaaga

SEQ ID NO: 5271496 - DNA, 13 bp, Homo sapiens
atgggaacattta

SEQ ID NO: 5271497 - DNA, 23 bp, Homo sapiens
atgggaactgatgtagaaggcag

SEQ ID NO: 5271498 - DNA, 17 bp, Homo sapiens
atgggaagacgaggccc

SEQ ID NO: 5271499 - DNA, 19 bp, Homo sapiens
atgggaagacgaggccctc

SEQ ID NO: 5271500 - DNA, 19 bp, Homo sapiens
atgggaagatgtctcagag

SEQ ID NO: 5271501 - DNA, 19 bp, Homo sapiens
atgggaagcagctcaaggg

SEQ ID NO: 5271502 - DNA, 17 bp, Homo sapiens
atgggaagcctgtgtat

SEQ ID NO: 5271503 - DNA, 19 bp, Homo sapiens
atgggaaggagggaggtat

SEQ ID NO: 5271504 - DNA, 15 bp, Homo sapiens
atgggaaggagggga

SEQ ID NO: 5271505 - DNA, 18 bp, Homo sapiens
atgggaaggggaggaccc

SEQ ID NO: 5271506 - DNA, 14 bp, Homo sapiens
atgggaagtcctgg

SEQ ID NO: 5271507 - DNA, 16 bp, Homo sapiens
atgggaatcaggcatg

SEQ ID NO: 5271508 - DNA, 22 bp, Homo sapiens
atgggaatcatggcctcttgaa

SEQ ID NO: 5271509 - DNA, 14 bp, Homo sapiens
atgggaatcattcc

SEQ ID NO: 5271510 - DNA, 15 bp, Homo sapiens
atgggaatgaagctt

SEQ ID NO: 5271511 - DNA, 15 bp, Homo sapiens
atgggaattgcgctc

SEQ ID NO: 5271512 - DNA, 18 bp, Homo sapiens
atgggaattgcgctcagg

SEQ ID NO: 5271513 - DNA, 17 bp, Homo sapiens
atgggaattggaatcaa

SEQ ID NO: 5271514 - DNA, 22 bp, Homo sapiens
atgggacaaagttccaaaatgc

SEQ ID NO: 5271515 - DNA, 19 bp, Homo sapiens
atgggacaaattgcacaga

SEQ ID NO: 5271516 - DNA, 15 bp, Homo sapiens
atgggacagggagga

SEQ ID NO: 5271517 - DNA, 18 bp, Homo sapiens
atgggacagggaggccac

SEQ ID NO: 5271518 - DNA, 22 bp, Homo sapiens
atgggacatcaaatttgccacc

SEQ ID NO: 5271519 - DNA, 20 bp, Homo sapiens
atgggacatttgctcatgga

SEQ ID NO: 5271520 - DNA, 12 bp, Homo sapiens
atgggaccacaa

SEQ ID NO: 5271521 - DNA, 13 bp, Homo sapiens
atgggaccaggga

SEQ ID NO: 5271522 - DNA, 20 bp, Homo sapiens
atgggaccgtgccccacctc

SEQ ID NO: 5271523 - DNA, 15 bp, Homo sapiens
atgggacctcctccc

SEQ ID NO: 5271524 - DNA, 12 bp, Homo sapiens
atgggactgatg

SEQ ID NO: 5271525 - DNA, 17 bp, Homo sapiens
atgggactgatgtcatc

SEQ ID NO: 5271526 - DNA, 21 bp, Homo sapiens
atgggactgatgtcatcttga

SEQ ID NO: 5271527 - DNA, 15 bp, Homo sapiens
atgggactggcctct

SEQ ID NO: 5271528 - DNA, 13 bp, Homo sapiens
atgggactgggag

SEQ ID NO: 5271529 - DNA, 19 bp, Homo sapiens
atgggagaagtgggggcag

SEQ ID NO: 5271530 - DNA, 13 bp, Homo sapiens
atgggagaatcag

SEQ ID NO: 5271531 - DNA, 17 bp, Homo sapiens
atgggagaatcagcaga

SEQ ID NO: 5271532 - DNA, 18 bp, Homo sapiens
atgggagacccttgacac

SEQ ID NO: 5271533 - DNA, 16 bp, Homo sapiens
atgggagacctgttgg

SEQ ID NO: 5271534 - DNA, 20 bp, Homo sapiens
atgggagactctttgaaatg

SEQ ID NO: 5271535 - DNA, 19 bp, Homo sapiens
atgggagagaagagaatgc

SEQ ID NO: 5271536 - DNA, 18 bp, Homo sapiens
atgggagagcaacaagta

SEQ ID NO: 5271537 - DNA, 19 bp, Homo sapiens
atgggagagtgtcaaccag

SEQ ID NO: 5271538 - DNA, 23 bp, Homo sapiens
atgggagagtgtcaaccagacag

SEQ ID NO: 5271539 - DNA, 23 bp, Homo sapiens
atgggagcaaatatctaaataat

SEQ ID NO: 5271540 - DNA, 20 bp, Homo sapiens
atgggagcagtccatgcatg

SEQ ID NO: 5271541 - DNA, 22 bp, Homo sapiens
atgggagcagtccatgcatgac

SEQ ID NO: 5271542 - DNA, 11 bp, Homo sapiens
atgggagccag

SEQ ID NO: 5271543 - DNA, 12 bp, Homo sapiens
atgggagccaga

SEQ ID NO: 5271544 - DNA, 17 bp, Homo sapiens
atgggagccagctgctt

SEQ ID NO: 5271545 - DNA, 19 bp, Homo sapiens
atgggagccagctgctttt

SEQ ID NO: 5271546 - DNA, 20 bp, Homo sapiens
atgggagccagctgcttttt

SEQ ID NO: 5271547 - DNA, 15 bp, Homo sapiens
atgggagccgggcaa

SEQ ID NO: 5271548 - DNA, 17 bp, Homo sapiens
atgggagccgggtctgc

SEQ ID NO: 5271549 - DNA, 15 bp, Homo sapiens
atgggagcctgaggc

SEQ ID NO: 5271550 - DNA, 23 bp, Homo sapiens
atgggagctgaggccacactcag

SEQ ID NO: 5271551 - DNA, 21 bp, Homo sapiens
atgggagctgtcaagcatgta

SEQ ID NO: 5271552 - DNA, 22 bp, Homo sapiens
atgggagctgtcaagcatgtat

SEQ ID NO: 5271553 - DNA, 18 bp, Homo sapiens
atgggaggaaaagcccag

SEQ ID NO: 5271554 - DNA, 14 bp, Homo sapiens
atgggaggaagacg

SEQ ID NO: 5271555 - DNA, 17 bp, Homo sapiens
atgggaggaagacgatt

SEQ ID NO: 5271556 - DNA, 14 bp, Homo sapiens
atgggaggaattca

SEQ ID NO: 5271557 - DNA, 21 bp, Homo sapiens
atgggaggagagccactgggc

SEQ ID NO: 5271558 - DNA, 12 bp, Homo sapiens
atgggaggcttg

SEQ ID NO: 5271559 - DNA, 13 bp, Homo sapiens
atgggagggatca

SEQ ID NO: 5271560 - DNA, 16 bp, Homo sapiens
atgggagggatcagcc

SEQ ID NO: 5271561 - DNA, 17 bp, Homo sapiens
atgggaggggaaatggg

SEQ ID NO: 5271562 - DNA, 17 bp, Homo sapiens
atgggagggggctccat

SEQ ID NO: 5271563 - DNA, 20 bp, Homo sapiens
atgggaggtggaagcagagg

SEQ ID NO: 5271564 - DNA, 23 bp, Homo sapiens
atgggaggtggccaggcctgcca

SEQ ID NO: 5271565 - DNA, 23 bp, Homo sapiens
atgggagtaggctccagacagga

SEQ ID NO: 5271566 - DNA, 16 bp, Homo sapiens
atgggagtcagggagc

SEQ ID NO: 5271567 - DNA, 21 bp, Homo sapiens
atgggagtcagggagccctgg

SEQ ID NO: 5271568 - DNA, 16 bp, Homo sapiens
atgggagtgagacaga

SEQ ID NO: 5271569 - DNA, 14 bp, Homo sapiens
atgggagtgggcac

SEQ ID NO: 5271570 - DNA, 16 bp, Homo sapiens
atgggagtgggcacct

SEQ ID NO: 5271571 - DNA, 19 bp, Homo sapiens
atgggagtgggcacctcag

SEQ ID NO: 5271572 - DNA, 15 bp, Homo sapiens
atgggataaatgcca

SEQ ID NO: 5271573 - DNA, 20 bp, Homo sapiens
atgggataaatgccatcaat

SEQ ID NO: 5271574 - DNA, 21 bp, Homo sapiens
atgggatatgtggtgtatatc

SEQ ID NO: 5271575 - DNA, 15 bp, Homo sapiens
atgggatcattattt

SEQ ID NO: 5271576 - DNA, 19 bp, Homo sapiens
atgggatcattatttcatg

SEQ ID NO: 5271577 - DNA, 17 bp, Homo sapiens
atgggatccaattttaa

SEQ ID NO: 5271578 - DNA, 19 bp, Homo sapiens
atgggatcccaggccaggg

SEQ ID NO: 5271579 - DNA, 14 bp, Homo sapiens
atgggatcctctcc

SEQ ID NO: 5271580 - DNA, 19 bp, Homo sapiens
atgggatctatttttgcac

SEQ ID NO: 5271581 - DNA, 17 bp, Homo sapiens
atgggatctgtaaggaa

SEQ ID NO: 5271582 - DNA, 13 bp, Homo sapiens
atgggatctttct

SEQ ID NO: 5271583 - DNA, 20 bp, Homo sapiens
atgggatctttctgggagct

SEQ ID NO: 5271584 - DNA, 19 bp, Homo sapiens
atgggatgattgaagaaac

SEQ ID NO: 5271585 - DNA, 17 bp, Homo sapiens
atgggattagaaacaaa

SEQ ID NO: 5271586 - DNA, 23 bp, Homo sapiens
atgggattagattcatctatgga

SEQ ID NO: 5271587 - DNA, 23 bp, Homo sapiens
atgggattcagtgcttcttaaag

SEQ ID NO: 5271588 - DNA, 14 bp, Homo sapiens
atgggattctggac

SEQ ID NO: 5271589 - DNA, 21 bp, Homo sapiens
atgggattttcaattatactg

SEQ ID NO: 5271590 - DNA, 17 bp, Homo sapiens
atgggcaaaactgaatt

SEQ ID NO: 5271591 - DNA, 22 bp, Homo sapiens
atgggcaactcgtgacagcctc

SEQ ID NO: 5271592 - DNA, 24 bp, Homo sapiens
atgggcaactcgtgacagcctctg

SEQ ID NO: 5271593 - DNA, 14 bp, Homo sapiens
atgggcaaggggcc

SEQ ID NO: 5271594 - DNA, 23 bp, Homo sapiens
atgggcaaggggccaggaagggg

SEQ ID NO: 5271595 - DNA, 18 bp, Homo sapiens
atgggcactgctgggtgg

SEQ ID NO: 5271596 - DNA, 23 bp, Homo sapiens
atgggcactgctgggtggcccat

SEQ ID NO: 5271597 - DNA, 14 bp, Homo sapiens
atgggcagagccca

SEQ ID NO: 5271598 - DNA, 15 bp, Homo sapiens
atgggcagaggatga

SEQ ID NO: 5271599 - DNA, 17 bp, Homo sapiens
atgggcagaggatgagg

SEQ ID NO: 5271600 - DNA, 22 bp, Homo sapiens
attccaagaatagcatctgtac

SEQ ID NO: 5271601 - DNA, 22 bp, Homo sapiens
attccaagacatgtctgttcta

SEQ ID NO: 5271602 - DNA, 21 bp, Homo sapiens
attccaagattaaaagttcat

SEQ ID NO: 5271603 - DNA, 16 bp, Homo sapiens
attccaaggaaaattg

SEQ ID NO: 5271604 - DNA, 18 bp, Homo sapiens
attccaagtgtatttaaa

SEQ ID NO: 5271605 - DNA, 14 bp, Homo sapiens
attccaatacatta

SEQ ID NO: 5271606 - DNA, 18 bp, Homo sapiens
attccaatatgatgactc

SEQ ID NO: 5271607 - DNA, 22 bp, Homo sapiens
attccaatatttataattaaag

SEQ ID NO: 5271608 - DNA, 23 bp, Homo sapiens
attccaatatttataattaaaga

SEQ ID NO: 5271609 - DNA, 15 bp, Homo sapiens
attccaatatttctg

SEQ ID NO: 5271610 - DNA, 14 bp, Homo sapiens
attccaattaaatt

SEQ ID NO: 5271611 - DNA, 13 bp, Homo sapiens
attccaattctaa

SEQ ID NO: 5271612 - DNA, 14 bp, Homo sapiens
attccaatttcaaa

SEQ ID NO: 5271613 - DNA, 18 bp, Homo sapiens
attccaatttcaaaatgt

SEQ ID NO: 5271614 - DNA, 20 bp, Homo sapiens
attccacactgcagggagga

SEQ ID NO: 5271615 - DNA, 17 bp, Homo sapiens
attccacagatatcttt

SEQ ID NO: 5271616 - DNA, 14 bp, Homo sapiens
attccacaggatca

SEQ ID NO: 5271617 - DNA, 23 bp, Homo sapiens
attccacaggtcatcagatgcct

SEQ ID NO: 5271618 - DNA, 18 bp, Homo sapiens
attccacagtctctggga

SEQ ID NO: 5271619 - DNA, 22 bp, Homo sapiens
attccaccacaggaatgtatca

SEQ ID NO: 5271620 - DNA, 21 bp, Homo sapiens
attccaccagggccagagcag

SEQ ID NO: 5271621 - DNA, 15 bp, Homo sapiens
attccaccattcaca

SEQ ID NO: 5271622 - DNA, 19 bp, Homo sapiens
attccaccttaaattaaac

SEQ ID NO: 5271623 - DNA, 18 bp, Homo sapiens
attccactacacctggct

SEQ ID NO: 5271624 - DNA, 19 bp, Homo sapiens
attccactacacctggctg

SEQ ID NO: 5271625 - DNA, 20 bp, Homo sapiens
attccactatttgcagaggc

SEQ ID NO: 5271626 - DNA, 16 bp, Homo sapiens
attccactccactcag

SEQ ID NO: 5271627 - DNA, 13 bp, Homo sapiens
attccactgaaac

SEQ ID NO: 5271628 - DNA, 19 bp, Homo sapiens
attccactgaaacctctgt

SEQ ID NO: 5271629 - DNA, 20 bp, Homo sapiens
attccactgaaatagagtga

SEQ ID NO: 5271630 - DNA, 21 bp, Homo sapiens
attccactgaaatagagtgaa

SEQ ID NO: 5271631 - DNA, 12 bp, Homo sapiens
attccacttcct

SEQ ID NO: 5271632 - DNA, 18 bp, Homo sapiens
attccagaacaaattgtt

SEQ ID NO: 5271633 - DNA, 21 bp, Homo sapiens
attccagaacgccctgtgtcc

SEQ ID NO: 5271634 - DNA, 23 bp, Homo sapiens
attccagaagaagagaagctgct

SEQ ID NO: 5271635 - DNA, 12 bp, Homo sapiens
attccagaatat

SEQ ID NO: 5271636 - DNA, 16 bp, Homo sapiens
attccagaatatctgg

SEQ ID NO: 5271637 - DNA, 18 bp, Homo sapiens
attccagaatatctggga

SEQ ID NO: 5271638 - DNA, 13 bp, Homo sapiens
attccagaatctt

SEQ ID NO: 5271639 - DNA, 22 bp, Homo sapiens
attccagaatcttgactttctg

SEQ ID NO: 5271640 - DNA, 23 bp, Homo sapiens
attccagacagtcacaaatttct

SEQ ID NO: 5271641 - DNA, 17 bp, Homo sapiens
attccagacctgaagaa

SEQ ID NO: 5271642 - DNA, 15 bp, Homo sapiens
attccagacgacctt

SEQ ID NO: 5271643 - DNA, 23 bp, Homo sapiens
attccagactgcttccaattttc

SEQ ID NO: 5271644 - DNA, 13 bp, Homo sapiens
attccagacttca

SEQ ID NO: 5271645 - DNA, 16 bp, Homo sapiens
attccagagaaaatca

SEQ ID NO: 5271646 - DNA, 18 bp, Homo sapiens
attccagagagtggctcc

SEQ ID NO: 5271647 - DNA, 19 bp, Homo sapiens
attccagagcgtgtagtga

SEQ ID NO: 5271648 - DNA, 18 bp, Homo sapiens
attccagaggactctgct

SEQ ID NO: 5271649 - DNA, 19 bp, Homo sapiens
attccagaggactctgctt

SEQ ID NO: 5271650 - DNA, 15 bp, Homo sapiens
attccagagtgctga

SEQ ID NO: 5271651 - DNA, 22 bp, Homo sapiens
attccagagttaaaatgtttac

SEQ ID NO: 5271652 - DNA, 14 bp, Homo sapiens
attccagatcccag

SEQ ID NO: 5271653 - DNA, 19 bp, Homo sapiens
attccagatctttcagaaa

SEQ ID NO: 5271654 - DNA, 22 bp, Homo sapiens
attccagatgagtcagtctctt

SEQ ID NO: 5271655 - DNA, 16 bp, Homo sapiens
attccagcaataagaa

SEQ ID NO: 5271656 - DNA, 17 bp, Homo sapiens
attccagcaataagaaa

SEQ ID NO: 5271657 - DNA, 18 bp, Homo sapiens
attccagcaataagaaat

SEQ ID NO: 5271658 - DNA, 19 bp, Homo sapiens
attccagcaataagaaatg

SEQ ID NO: 5271659 - DNA, 21 bp, Homo sapiens
attccagcaataagaaatgaa

SEQ ID NO: 5271660 - DNA, 17 bp, Homo sapiens
attccagcagtgaatgc

SEQ ID NO: 5271661 - DNA, 18 bp, Homo sapiens
attccagcagttgttcca

SEQ ID NO: 5271662 - DNA, 22 bp, Homo sapiens
attccagcatttgccattcctg

SEQ ID NO: 5271663 - DNA, 16 bp, Homo sapiens
attccagccaggccca

SEQ ID NO: 5271664 - DNA, 17 bp, Homo sapiens
attccagccaggcccag

SEQ ID NO: 5271665 - DNA, 19 bp, Homo sapiens
attccagccaggcccaggc

SEQ ID NO: 5271666 - DNA, 20 bp, Homo sapiens
attccagccaggcccaggcc

SEQ ID NO: 5271667 - DNA, 17 bp, Homo sapiens
attccagccagggtgac

SEQ ID NO: 5271668 - DNA, 17 bp, Homo sapiens
attccagccatcacctt

SEQ ID NO: 5271669 - DNA, 14 bp, Homo sapiens
attccagcccctct

SEQ ID NO: 5271670 - DNA, 16 bp, Homo sapiens
attccagctcattcat

SEQ ID NO: 5271671 - DNA, 19 bp, Homo sapiens
attccagctcattcatttt

SEQ ID NO: 5271672 - DNA, 21 bp, Homo sapiens
attccagctcattcattttat

SEQ ID NO: 5271673 - DNA, 15 bp, Homo sapiens
attccagctcctccg

SEQ ID NO: 5271674 - DNA, 18 bp, Homo sapiens
attccagctctgcccccg

SEQ ID NO: 5271675 - DNA, 23 bp, Homo sapiens
attccagctgtcactctgtgcct

SEQ ID NO: 5271676 - DNA, 21 bp, Homo sapiens
attccaggatggtttggaaac

SEQ ID NO: 5271677 - DNA, 12 bp, Homo sapiens
attccaggctga

SEQ ID NO: 5271678 - DNA, 23 bp, Homo sapiens
attccaggctgagccatgaggag

SEQ ID NO: 5271679 - DNA, 16 bp, Homo sapiens
attccagtaacttttt

SEQ ID NO: 5271680 - DNA, 15 bp, Homo sapiens
attccagtacagtat

SEQ ID NO: 5271681 - DNA, 23 bp, Homo sapiens
attccagtacagtattcttttaa

SEQ ID NO: 5271682 - DNA, 22 bp, Homo sapiens
attccagtcaaatctgggctca

SEQ ID NO: 5271683 - DNA, 20 bp, Homo sapiens
attccagtcaggctctctgg

SEQ ID NO: 5271684 - DNA, 20 bp, Homo sapiens
attccagtgcagtagtgcca

SEQ ID NO: 5271685 - DNA, 20 bp, Homo sapiens
attccagtgctagaaaattt

SEQ ID NO: 5271686 - DNA, 17 bp, Homo sapiens
attccagtggaccctgg

SEQ ID NO: 5271687 - DNA, 18 bp, Homo sapiens
attccagtgtattttctg

SEQ ID NO: 5271688 - DNA, 17 bp, Homo sapiens
attccagttgcaattca

SEQ ID NO: 5271689 - DNA, 15 bp, Homo sapiens
attccagtttgttta

SEQ ID NO: 5271690 - DNA, 23 bp, Homo sapiens
attccagtttgtttattacttat

SEQ ID NO: 5271691 - DNA, 14 bp, Homo sapiens
attccataatacat

SEQ ID NO: 5271692 - DNA, 16 bp, Homo sapiens
attccatacttctctc

SEQ ID NO: 5271693 - DNA, 14 bp, Homo sapiens
attccatagtatat

SEQ ID NO: 5271694 - DNA, 18 bp, Homo sapiens
attccatagtatattaaa

SEQ ID NO: 5271695 - DNA, 22 bp, Homo sapiens
attccatagtatattaaaaatg

SEQ ID NO: 5271696 - DNA, 17 bp, Homo sapiens
attccatagtggaccac

SEQ ID NO: 5271697 - DNA, 23 bp, Homo sapiens
attccatagtggaccacttggaa

SEQ ID NO: 5271698 - DNA, 21 bp, Homo sapiens
attccatatcttgcgaatcca

SEQ ID NO: 5271699 - DNA, 19 bp, Homo sapiens
attccatattagaaaactt

SEQ ID NO: 5271700 - DNA, 16 bp, Homo sapiens
attccatattcatgta

SEQ ID NO: 5271701 - DNA, 13 bp, Homo sapiens
attccatatttat

SEQ ID NO: 5271702 - DNA, 19 bp, Homo sapiens
attccatcacagccagccc

SEQ ID NO: 5271703 - DNA, 23 bp, Homo sapiens
attccatcacagccagcccagct

SEQ ID NO: 5271704 - DNA, 22 bp, Homo sapiens
attccatcacatcacatttaaa

SEQ ID NO: 5271705 - DNA, 14 bp, Homo sapiens
attccatcaggcag

SEQ ID NO: 5271706 - DNA, 21 bp, Homo sapiens
attccatccctaagaattccc

SEQ ID NO: 5271707 - DNA, 16 bp, Homo sapiens
attccatcctgtgtcc

SEQ ID NO: 5271708 - DNA, 21 bp, Homo sapiens
attccatctatataaatcgca

SEQ ID NO: 5271709 - DNA, 13 bp, Homo sapiens
attccatcttgta

SEQ ID NO: 5271710 - DNA, 12 bp, Homo sapiens
attccatgaatc

SEQ ID NO: 5271711 - DNA, 16 bp, Homo sapiens
attccatgaatgtatc

SEQ ID NO: 5271712 - DNA, 18 bp, Homo sapiens
attccatgaatgtatcag

SEQ ID NO: 5271713 - DNA, 13 bp, Homo sapiens
attccatgattaa

SEQ ID NO: 5271714 - DNA, 13 bp, Homo sapiens
attccatgatttt

SEQ ID NO: 5271715 - DNA, 14 bp, Homo sapiens
attccatgatttta

SEQ ID NO: 5271716 - DNA, 15 bp, Homo sapiens
attccatgattttac

SEQ ID NO: 5271717 - DNA, 20 bp, Homo sapiens
attccatgattttacagaga

SEQ ID NO: 5271718 - DNA, 21 bp, Homo sapiens
attccatgattttacagagaa

SEQ ID NO: 5271719 - DNA, 22 bp, Homo sapiens
attccatgcactctctctctgt

SEQ ID NO: 5271720 - DNA, 17 bp, Homo sapiens
attccatgcccgagtcc

SEQ ID NO: 5271721 - DNA, 22 bp, Homo sapiens
attccatgctaagcaagctaac

SEQ ID NO: 5271722 - DNA, 19 bp, Homo sapiens
attccatggaaataaaaag

SEQ ID NO: 5271723 - DNA, 17 bp, Homo sapiens
attccatgggatgttaa

SEQ ID NO: 5271724 - DNA, 19 bp, Homo sapiens
attccatgtccatatgcat

SEQ ID NO: 5271725 - DNA, 15 bp, Homo sapiens
attccatgtgcccag

SEQ ID NO: 5271726 - DNA, 16 bp, Homo sapiens
attccatgtgcccagt

SEQ ID NO: 5271727 - DNA, 19 bp, Homo sapiens
attccatgttttaaaatta

SEQ ID NO: 5271728 - DNA, 15 bp, Homo sapiens
attccattatcttat

SEQ ID NO: 5271729 - DNA, 20 bp, Homo sapiens
attccattatcttatgaata

SEQ ID NO: 5271730 - DNA, 16 bp, Homo sapiens
attccattctggattt

SEQ ID NO: 5271731 - DNA, 19 bp, Homo sapiens
attccattgcctagctctt

SEQ ID NO: 5271732 - DNA, 20 bp, Homo sapiens
attccattgcctagctcttt

SEQ ID NO: 5271733 - DNA, 16 bp, Homo sapiens
attccattggtccaag

SEQ ID NO: 5271734 - DNA, 23 bp, Homo sapiens
attccattggtccaagattccgg

SEQ ID NO: 5271735 - DNA, 18 bp, Homo sapiens
attccatttaaaaaacaa

SEQ ID NO: 5271736 - DNA, 17 bp, Homo sapiens
attccatttatctttct

SEQ ID NO: 5271737 - DNA, 20 bp, Homo sapiens
attccatttctctccaacat

SEQ ID NO: 5271738 - DNA, 13 bp, Homo sapiens
attccatttctgg

SEQ ID NO: 5271739 - DNA, 22 bp, Homo sapiens
attccatttcttaacagtctcc

SEQ ID NO: 5271740 - DNA, 23 bp, Homo sapiens
attccatttgttgagccccagtc

SEQ ID NO: 5271741 - DNA, 17 bp, Homo sapiens
attccattttatacaag

SEQ ID NO: 5271742 - DNA, 18 bp, Homo sapiens
attccattttgtgtctgt

SEQ ID NO: 5271743 - DNA, 21 bp, Homo sapiens
attccatttttactaaagcag

SEQ ID NO: 5271744 - DNA, 23 bp, Homo sapiens
attccatttttactaaagcagtg

SEQ ID NO: 5271745 - DNA, 17 bp, Homo sapiens
attcccaaatcctagac

SEQ ID NO: 5271746 - DNA, 17 bp, Homo sapiens
attcccaaatctcaaaa

SEQ ID NO: 5271747 - DNA, 14 bp, Homo sapiens
attcccaacatttc

SEQ ID NO: 5271748 - DNA, 18 bp, Homo sapiens
attcccaacatttcttaa

SEQ ID NO: 5271749 - DNA, 20 bp, Homo sapiens
attcccaacgtgcaaagcca

SEQ ID NO: 5271750 - DNA, 21 bp, Homo sapiens
attcccaacgtgcaaagccaa

SEQ ID NO: 5271751 - DNA, 17 bp, Homo sapiens
attcccaactagacatt

SEQ ID NO: 5271752 - DNA, 16 bp, Homo sapiens
attcccaactgctctg

SEQ ID NO: 5271753 - DNA, 17 bp, Homo sapiens
attcccaactgctctgc

SEQ ID NO: 5271754 - DNA, 18 bp, Homo sapiens
attcccaactgctctgcc

SEQ ID NO: 5271755 - DNA, 19 bp, Homo sapiens
attcccaactgctctgccc

SEQ ID NO: 5271756 - DNA, 15 bp, Homo sapiens
attcccaagaaatgc

SEQ ID NO: 5271757 - DNA, 22 bp, Homo sapiens
attcccaagagtggtggcagct

SEQ ID NO: 5271758 - DNA, 22 bp, Homo sapiens
attcccaagctctagtgggaag

SEQ ID NO: 5271759 - DNA, 22 bp, Homo sapiens
attcccacccaattcaaaacat

SEQ ID NO: 5271760 - DNA, 20 bp, Homo sapiens
attcccactaagctttctcc

SEQ ID NO: 5271761 - DNA, 22 bp, Homo sapiens
attcccactaagctttctcctt

SEQ ID NO: 5271762 - DNA, 16 bp, Homo sapiens
attcccactcaccagc

SEQ ID NO: 5271763 - DNA, 23 bp, Homo sapiens
attcccactcaccagccctagct

SEQ ID NO: 5271764 - DNA, 12 bp, Homo sapiens
attcccactgca

SEQ ID NO: 5271765 - DNA, 16 bp, Homo sapiens
attcccagactctgcc

SEQ ID NO: 5271766 - DNA, 17 bp, Homo sapiens
attcccagactctgcct

SEQ ID NO: 5271767 - DNA, 19 bp, Homo sapiens
attcccagagacaggaaaa

SEQ ID NO: 5271768 - DNA, 12 bp, Homo sapiens
attcccagagag

SEQ ID NO: 5271769 - DNA, 15 bp, Homo sapiens
attcccagaggtggg

SEQ ID NO: 5271770 - DNA, 15 bp, Homo sapiens
attcccagagtcaga

SEQ ID NO: 5271771 - DNA, 18 bp, Homo sapiens
attcccagatttgaagac

SEQ ID NO: 5271772 - DNA, 12 bp, Homo sapiens
attcccagccca

SEQ ID NO: 5271773 - DNA, 12 bp, Homo sapiens
attcccagcctg

SEQ ID NO: 5271774 - DNA, 12 bp, Homo sapiens
attcccagctct

SEQ ID NO: 5271775 - DNA, 12 bp, Homo sapiens
attcccaggagt

SEQ ID NO: 5271776 - DNA, 14 bp, Homo sapiens
atgggcagggaagg

SEQ ID NO: 5271777 - DNA, 21 bp, Homo sapiens
atgggcaggtggcctctgctg

SEQ ID NO: 5271778 - DNA, 20 bp, Homo sapiens
atgggcagtcattttgcaga

SEQ ID NO: 5271779 - DNA, 11 bp, Homo sapiens
atgggcagtgc

SEQ ID NO: 5271780 - DNA, 16 bp, Homo sapiens
atgggcagtgcctcct

SEQ ID NO: 5271781 - DNA, 18 bp, Homo sapiens
atgggcagtgcctcctgg

SEQ ID NO: 5271782 - DNA, 17 bp, Homo sapiens
atgggcagttctcccag

SEQ ID NO: 5271783 - DNA, 16 bp, Homo sapiens
atgggcatcttttgta

SEQ ID NO: 5271784 - DNA, 14 bp, Homo sapiens
atgggcatgaatgg

SEQ ID NO: 5271785 - DNA, 22 bp, Homo sapiens
atgggcatggggtgggcctctg

SEQ ID NO: 5271786 - DNA, 23 bp, Homo sapiens
atgggcatggggtgggcctctgg

SEQ ID NO: 5271787 - DNA, 14 bp, Homo sapiens
atgggcattgcagc

SEQ ID NO: 5271788 - DNA, 17 bp, Homo sapiens
atgggcattgcagcctt

SEQ ID NO: 5271789 - DNA, 14 bp, Homo sapiens
atgggcattgggct

SEQ ID NO: 5271790 - DNA, 15 bp, Homo sapiens
atgggcattgggctg

SEQ ID NO: 5271791 - DNA, 23 bp, Homo sapiens
atgggcatttctaaaatgttaaa

SEQ ID NO: 5271792 - DNA, 16 bp, Homo sapiens
atgggccaagccaggg

SEQ ID NO: 5271793 - DNA, 23 bp, Homo sapiens
atgggccaagccagggttccaga

SEQ ID NO: 5271794 - DNA, 20 bp, Homo sapiens
atgggccaattaaaatatat

SEQ ID NO: 5271795 - DNA, 22 bp, Homo sapiens
atgggccaattaaaatatatat

SEQ ID NO: 5271796 - DNA, 15 bp, Homo sapiens
atgggccacacaagt

SEQ ID NO: 5271797 - DNA, 17 bp, Homo sapiens
atgggccaccgccttgc

SEQ ID NO: 5271798 - DNA, 12 bp, Homo sapiens
atgggccaccgg

SEQ ID NO: 5271799 - DNA, 18 bp, Homo sapiens
atgggccacggctgagcc

SEQ ID NO: 5271800 - DNA, 22 bp, Homo sapiens
atgggccagcccctccatctgt

SEQ ID NO: 5271801 - DNA, 14 bp, Homo sapiens
atgggccagcctag

SEQ ID NO: 5271802 - DNA, 14 bp, Homo sapiens
atgggcccaggcct

SEQ ID NO: 5271803 - DNA, 18 bp, Homo sapiens
atgggccccgccttcctg

SEQ ID NO: 5271804 - DNA, 16 bp, Homo sapiens
atgggcccctggcact

SEQ ID NO: 5271805 - DNA, 14 bp, Homo sapiens
atgggcccctggcc

SEQ ID NO: 5271806 - DNA, 20 bp, Homo sapiens
atgggcccgcctcggcctcc

SEQ ID NO: 5271807 - DNA, 19 bp, Homo sapiens
atgggccctatgtctcagg

SEQ ID NO: 5271808 - DNA, 14 bp, Homo sapiens
atgggccctcagcg

SEQ ID NO: 5271809 - DNA, 15 bp, Homo sapiens
atgggcctcagcccc

SEQ ID NO: 5271810 - DNA, 17 bp, Homo sapiens
atgggcctcctgtgtgt

SEQ ID NO: 5271811 - DNA, 14 bp, Homo sapiens
atgggcctctctgg

SEQ ID NO: 5271812 - DNA, 15 bp, Homo sapiens
atgggcctctctggg

SEQ ID NO: 5271813 - DNA, 14 bp, Homo sapiens
atgggcctgaactc

SEQ ID NO: 5271814 - DNA, 21 bp, Homo sapiens
atgggcctgcccaatgctttg

SEQ ID NO: 5271815 - DNA, 18 bp, Homo sapiens
atgggcctgccgggctga

SEQ ID NO: 5271816 - DNA, 19 bp, Homo sapiens
atgggcctgcctgcctcca

SEQ ID NO: 5271817 - DNA, 19 bp, Homo sapiens
atgggcctgcttcctgtct

SEQ ID NO: 5271818 - DNA, 13 bp, Homo sapiens
atgggcctggcat

SEQ ID NO: 5271819 - DNA, 15 bp, Homo sapiens
atgggcctgggcctg

SEQ ID NO: 5271820 - DNA, 16 bp, Homo sapiens
atgggcctgggcctgc

SEQ ID NO: 5271821 - DNA, 20 bp, Homo sapiens
atgggcctttaagaacctta

SEQ ID NO: 5271822 - DNA, 17 bp, Homo sapiens
atgggcctttgagcctg

SEQ ID NO: 5271823 - DNA, 21 bp, Homo sapiens
atgggccttttcttgaataaa

SEQ ID NO: 5271824 - DNA, 16 bp, Homo sapiens
atgggcgcaggcccag

SEQ ID NO: 5271825 - DNA, 17 bp, Homo sapiens
atgggcgcaggcccagt

SEQ ID NO: 5271826 - DNA, 21 bp, Homo sapiens
atgggcgcccccccctcccca

SEQ ID NO: 5271827 - DNA, 23 bp, Homo sapiens
atgggcggaagtacttccctcag

SEQ ID NO: 5271828 - DNA, 17 bp, Homo sapiens
atgggctagagggtgcc

SEQ ID NO: 5271829 - DNA, 21 bp, Homo sapiens
atgggctagtgtgagtggcag

SEQ ID NO: 5271830 - DNA, 20 bp, Homo sapiens
atgggctatcagggaggaag

SEQ ID NO: 5271831 - DNA, 15 bp, Homo sapiens
atgggctcaggatct

SEQ ID NO: 5271832 - DNA, 12 bp, Homo sapiens
atgggctcaggg

SEQ ID NO: 5271833 - DNA, 20 bp, Homo sapiens
atgggctcccaccctcccct

SEQ ID NO: 5271834 - DNA, 16 bp, Homo sapiens
atgggctcctgcccct

SEQ ID NO: 5271835 - DNA, 23 bp, Homo sapiens
atgggctcgccgtgtctcagcct

SEQ ID NO: 5271836 - DNA, 19 bp, Homo sapiens
atgggctctacctctcttt

SEQ ID NO: 5271837 - DNA, 21 bp, Homo sapiens
atgggctctgacagaaagcag

SEQ ID NO: 5271838 - DNA, 15 bp, Homo sapiens
atgggctctggcccc

SEQ ID NO: 5271839 - DNA, 14 bp, Homo sapiens
atgggctcttccaa

SEQ ID NO: 5271840 - DNA, 17 bp, Homo sapiens
atgggctgagctagcct

SEQ ID NO: 5271841 - DNA, 17 bp, Homo sapiens
atgggctgcaaaatgaa

SEQ ID NO: 5271842 - DNA, 20 bp, Homo sapiens
atgggctggggcaggggcct

SEQ ID NO: 5271843 - DNA, 13 bp, Homo sapiens
atgggctgggggc

SEQ ID NO: 5271844 - DNA, 23 bp, Homo sapiens
atgggctgtgtcctaaggcccat

SEQ ID NO: 5271845 - DNA, 15 bp, Homo sapiens
atgggcttcactgta

SEQ ID NO: 5271846 - DNA, 19 bp, Homo sapiens
atgggcttctgttctctgc

SEQ ID NO: 5271847 - DNA, 20 bp, Homo sapiens
atgggcttctgttctctgct

SEQ ID NO: 5271848 - DNA, 22 bp, Homo sapiens
atgggcttctgttctctgctga

SEQ ID NO: 5271849 - DNA, 22 bp, Homo sapiens
atgggctttctctttggtttct

SEQ ID NO: 5271850 - DNA, 20 bp, Homo sapiens
atgggctttgtacgttcctt

SEQ ID NO: 5271851 - DNA, 18 bp, Homo sapiens
atgggcttttacctgtgc

SEQ ID NO: 5271852 - DNA, 20 bp, Homo sapiens
atgggcttttacctgtgcac

SEQ ID NO: 5271853 - DNA, 20 bp, Homo sapiens
atggggaaaaaaaaactact

SEQ ID NO: 5271854 - DNA, 15 bp, Homo sapiens
atggggaaaaaaatc

SEQ ID NO: 5271855 - DNA, 23 bp, Homo sapiens
atggggaaaccctggagccatcc

SEQ ID NO: 5271856 - DNA, 19 bp, Homo sapiens
atggggaaactgagggcag

SEQ ID NO: 5271857 - DNA, 18 bp, Homo sapiens
atggggaaagcagaactg

SEQ ID NO: 5271858 - DNA, 23 bp, Homo sapiens
atggggaaagcagaactgaagcc

SEQ ID NO: 5271859 - DNA, 20 bp, Homo sapiens
atggggaactcccccagagg

SEQ ID NO: 5271860 - DNA, 16 bp, Homo sapiens
atggggaaggaggctg

SEQ ID NO: 5271861 - DNA, 23 bp, Homo sapiens
atggggaaggagtacaaaacaat

SEQ ID NO: 5271862 - DNA, 21 bp, Homo sapiens
atggggaaggcagaggctggc

SEQ ID NO: 5271863 - DNA, 17 bp, Homo sapiens
atggggaatacaagttc

SEQ ID NO: 5271864 - DNA, 17 bp, Homo sapiens
atggggactctccaggc

SEQ ID NO: 5271865 - DNA, 19 bp, Homo sapiens
atggggactctccaggcac

SEQ ID NO: 5271866 - DNA, 13 bp, Homo sapiens
atggggagaaagg

SEQ ID NO: 5271867 - DNA, 18 bp, Homo sapiens
atggggagaaagggagcg

SEQ ID NO: 5271868 - DNA, 22 bp, Homo sapiens
atggggagacagttgagagcgg

SEQ ID NO: 5271869 - DNA, 13 bp, Homo sapiens
atggggagaggca

SEQ ID NO: 5271870 - DNA, 15 bp, Homo sapiens
atggggaggcagcag

SEQ ID NO: 5271871 - DNA, 11 bp, Homo sapiens
atggggaggga

SEQ ID NO: 5271872 - DNA, 16 bp, Homo sapiens
atggggagggagggag

SEQ ID NO: 5271873 - DNA, 21 bp, Homo sapiens
atggggaggtggcactaggga

SEQ ID NO: 5271874 - DNA, 24 bp, Homo sapiens
atggggagtcggttagtcattgat

SEQ ID NO: 5271875 - DNA, 23 bp, Homo sapiens
atggggagtgagtgatcactggt

SEQ ID NO: 5271876 - DNA, 22 bp, Homo sapiens
atggggataaaatgactactta

SEQ ID NO: 5271877 - DNA, 20 bp, Homo sapiens
atggggatagatgtgtggac

SEQ ID NO: 5271878 - DNA, 20 bp, Homo sapiens
atggggatagtctgggtcag

SEQ ID NO: 5271879 - DNA, 22 bp, Homo sapiens
atggggatctggggggtgggga

SEQ ID NO: 5271880 - DNA, 13 bp, Homo sapiens
atggggatgcttc

SEQ ID NO: 5271881 - DNA, 17 bp, Homo sapiens
atggggatgggaggggg

SEQ ID NO: 5271882 - DNA, 21 bp, Homo sapiens
atggggcaagacagaaaagtg

SEQ ID NO: 5271883 - DNA, 14 bp, Homo sapiens
atggggcaagccag

SEQ ID NO: 5271884 - DNA, 16 bp, Homo sapiens
atggggcacggctctg

SEQ ID NO: 5271885 - DNA, 14 bp, Homo sapiens
atggggcagaaatc

SEQ ID NO: 5271886 - DNA, 15 bp, Homo sapiens
atggggcagaagaga

SEQ ID NO: 5271887 - DNA, 20 bp, Homo sapiens
atggggcagagcttctcctg

SEQ ID NO: 5271888 - DNA, 15 bp, Homo sapiens
atggggcaggccacc

SEQ ID NO: 5271889 - DNA, 23 bp, Homo sapiens
atggggcattaatattcttttgt

SEQ ID NO: 5271890 - DNA, 12 bp, Homo sapiens
atggggccacag

SEQ ID NO: 5271891 - DNA, 13 bp, Homo sapiens
atggggccagatc

SEQ ID NO: 5271892 - DNA, 15 bp, Homo sapiens
atggggccagatcca

SEQ ID NO: 5271893 - DNA, 15 bp, Homo sapiens
atggggccaggaaag

SEQ ID NO: 5271894 - DNA, 20 bp, Homo sapiens
atggggccctaattcagcca

SEQ ID NO: 5271895 - DNA, 15 bp, Homo sapiens
atggggccctcccag

SEQ ID NO: 5271896 - DNA, 17 bp, Homo sapiens
atggggccctcccagaa

SEQ ID NO: 5271897 - DNA, 20 bp, Homo sapiens
atggggccctgcctcctttg

SEQ ID NO: 5271898 - DNA, 22 bp, Homo sapiens
atggggccctgtccaggtagaa

SEQ ID NO: 5271899 - DNA, 18 bp, Homo sapiens
atggggcctccctccttg

SEQ ID NO: 5271900 - DNA, 14 bp, Homo sapiens
atggggcctgggct

SEQ ID NO: 5271901 - DNA, 21 bp, Homo sapiens
atggggcctttggtaagggaa

SEQ ID NO: 5271902 - DNA, 17 bp, Homo sapiens
atggggctcccgcccgt

SEQ ID NO: 5271903 - DNA, 19 bp, Homo sapiens
atggggctgaacggggaga

SEQ ID NO: 5271904 - DNA, 12 bp, Homo sapiens
atggggctgcac

SEQ ID NO: 5271905 - DNA, 24 bp, Homo sapiens
atggggctgcaccggctggcctgg

SEQ ID NO: 5271906 - DNA, 20 bp, Homo sapiens
atggggctgcgggacagagg

SEQ ID NO: 5271907 - DNA, 19 bp, Homo sapiens
atggggctggcatgttttc

SEQ ID NO: 5271908 - DNA, 20 bp, Homo sapiens
atggggcttgccctgggtca

SEQ ID NO: 5271909 - DNA, 17 bp, Homo sapiens
atggggctttcctgatg

SEQ ID NO: 5271910 - DNA, 13 bp, Homo sapiens
atggggcttttaa

SEQ ID NO: 5271911 - DNA, 19 bp, Homo sapiens
atgggggaaaattattttg

SEQ ID NO: 5271912 - DNA, 21 bp, Homo sapiens
atgggggaactcagatccagg

SEQ ID NO: 5271913 - DNA, 22 bp, Homo sapiens
atgggggaaggcgctgggtgcc

SEQ ID NO: 5271914 - DNA, 22 bp, Homo sapiens
atgggggacaggatttggccac

SEQ ID NO: 5271915 - DNA, 17 bp, Homo sapiens
atgggggaccccttccc

SEQ ID NO: 5271916 - DNA, 21 bp, Homo sapiens
atgggggacgagggccaggca

SEQ ID NO: 5271917 - DNA, 13 bp, Homo sapiens
atgggggactgag

SEQ ID NO: 5271918 - DNA, 18 bp, Homo sapiens
atgggggagattgaactt

SEQ ID NO: 5271919 - DNA, 14 bp, Homo sapiens
atgggggaggccca

SEQ ID NO: 5271920 - DNA, 13 bp, Homo sapiens
atgggggaggctc

SEQ ID NO: 5271921 - DNA, 14 bp, Homo sapiens
atgggggaggctct

SEQ ID NO: 5271922 - DNA, 15 bp, Homo sapiens
atgggggaggctctg

SEQ ID NO: 5271923 - DNA, 18 bp, Homo sapiens
atgggggagggggcagaa

SEQ ID NO: 5271924 - DNA, 19 bp, Homo sapiens
atgggggagtctgaagcag

SEQ ID NO: 5271925 - DNA, 14 bp, Homo sapiens
atgggggatgcttc

SEQ ID NO: 5271926 - DNA, 16 bp, Homo sapiens
atgggggatgcttcat

SEQ ID NO: 5271927 - DNA, 18 bp, Homo sapiens
atgggggatgggccaggg

SEQ ID NO: 5271928 - DNA, 15 bp, Homo sapiens
atgggggatttcaaa

SEQ ID NO: 5271929 - DNA, 16 bp, Homo sapiens
atgggggcacttgagt

SEQ ID NO: 5271930 - DNA, 19 bp, Homo sapiens
atgggggccaggctgagcc

SEQ ID NO: 5271931 - DNA, 16 bp, Homo sapiens
atgggggcctcagggc

SEQ ID NO: 5271932 - DNA, 14 bp, Homo sapiens
atgggggctcctgg

SEQ ID NO: 5271933 - DNA, 19 bp, Homo sapiens
atgggggctcctggcagtg

SEQ ID NO: 5271934 - DNA, 16 bp, Homo sapiens
atgggggcttcttcct

SEQ ID NO: 5271935 - DNA, 17 bp, Homo sapiens
atgggggcttcttcctc

SEQ ID NO: 5271936 - DNA, 18 bp, Homo sapiens
atgggggcttcttcctca

SEQ ID NO: 5271937 - DNA, 12 bp, Homo sapiens
atggggggagaa

SEQ ID NO: 5271938 - DNA, 22 bp, Homo sapiens
atggggggagcaccctgagggc

SEQ ID NO: 5271939 - DNA, 22 bp, Homo sapiens
atggggggagtgagctctctca

SEQ ID NO: 5271940 - DNA, 15 bp, Homo sapiens
atggggggatttttt

SEQ ID NO: 5271941 - DNA, 23 bp, Homo sapiens
atggggggatttttttgttcttg

SEQ ID NO: 5271942 - DNA, 18 bp, Homo sapiens
atggggggcgggccaggg

SEQ ID NO: 5271943 - DNA, 17 bp, Homo sapiens
atgggggtgaccccacg

SEQ ID NO: 5271944 - DNA, 15 bp, Homo sapiens
atgggggtgcatttg

SEQ ID NO: 5271945 - DNA, 11 bp, Homo sapiens
atgggggtggc

SEQ ID NO: 5271946 - DNA, 17 bp, Homo sapiens
atgggggtgtattggaa

SEQ ID NO: 5271947 - DNA, 22 bp, Homo sapiens
atggggtagaaacattgtaaat

SEQ ID NO: 5271948 - DNA, 19 bp, Homo sapiens
atggggtagggtgagaagg

SEQ ID NO: 5271949 - DNA, 15 bp, Homo sapiens
atggggtcagcaggc

SEQ ID NO: 5271950 - DNA, 23 bp, Homo sapiens
atggggtcagcaggcccaggaga

SEQ ID NO: 5271951 - DNA, 15 bp, Homo sapiens
atggggtcagcccca

SEQ ID NO: 5271952 - DNA, 16 bp, Homo sapiens
atggggtccagagagc

SEQ ID NO: 5271953 - DNA, 16 bp, Homo sapiens
atggggtcctggccat

SEQ ID NO: 5271954 - DNA, 20 bp, Homo sapiens
attcccaggagttctgctca

SEQ ID NO: 5271955 - DNA, 14 bp, Homo sapiens
attcccaggccagg

SEQ ID NO: 5271956 - DNA, 18 bp, Homo sapiens
attcccaggccaggctcc

SEQ ID NO: 5271957 - DNA, 19 bp, Homo sapiens
attcccaggccagggctgg

SEQ ID NO: 5271958 - DNA, 22 bp, Homo sapiens
attcccagggaagtgctctgat

SEQ ID NO: 5271959 - DNA, 18 bp, Homo sapiens
attcccagggaccttgga

SEQ ID NO: 5271960 - DNA, 19 bp, Homo sapiens
attcccaggtaggccaagg

SEQ ID NO: 5271961 - DNA, 23 bp, Homo sapiens
attcccaggtaggccaaggtgtc

SEQ ID NO: 5271962 - DNA, 15 bp, Homo sapiens
attcccatctgcttt

SEQ ID NO: 5271963 - DNA, 21 bp, Homo sapiens
attcccatgaatatcaagaat

SEQ ID NO: 5271964 - DNA, 18 bp, Homo sapiens
attcccatggtggcctca

SEQ ID NO: 5271965 - DNA, 15 bp, Homo sapiens
attcccatgtggaac

SEQ ID NO: 5271966 - DNA, 14 bp, Homo sapiens
attcccattgaaaa

SEQ ID NO: 5271967 - DNA, 15 bp, Homo sapiens
attcccattgtgaca

SEQ ID NO: 5271968 - DNA, 23 bp, Homo sapiens
attcccattttgcaaaatttcca

SEQ ID NO: 5271969 - DNA, 18 bp, Homo sapiens
attccccactcagccttt

SEQ ID NO: 5271970 - DNA, 19 bp, Homo sapiens
attccccaggaggccagcc

SEQ ID NO: 5271971 - DNA, 21 bp, Homo sapiens
attccccaggtggctgaccca

SEQ ID NO: 5271972 - DNA, 17 bp, Homo sapiens
attccccagtgactcca

SEQ ID NO: 5271973 - DNA, 13 bp, Homo sapiens
attccccatcaac

SEQ ID NO: 5271974 - DNA, 16 bp, Homo sapiens
attccccatctcaggc

SEQ ID NO: 5271975 - DNA, 18 bp, Homo sapiens
attccccatctcaggcca

SEQ ID NO: 5271976 - DNA, 14 bp, Homo sapiens
attccccattcttc

SEQ ID NO: 5271977 - DNA, 15 bp, Homo sapiens
attccccattcttcc

SEQ ID NO: 5271978 - DNA, 17 bp, Homo sapiens
attccccattgcctcct

SEQ ID NO: 5271979 - DNA, 14 bp, Homo sapiens
attcccccaaactt

SEQ ID NO: 5271980 - DNA, 16 bp, Homo sapiens
attcccccaaactttt

SEQ ID NO: 5271981 - DNA, 14 bp, Homo sapiens
attcccccatcttc

SEQ ID NO: 5271982 - DNA, 17 bp, Homo sapiens
attccccccatctccat

SEQ ID NO: 5271983 - DNA, 23 bp, Homo sapiens
attccccccattttgcctctgtc

SEQ ID NO: 5271984 - DNA, 22 bp, Homo sapiens
attcccccctacttgagataat

SEQ ID NO: 5271985 - DNA, 23 bp, Homo sapiens
attccccctggccaccacccccc

SEQ ID NO: 5271986 - DNA, 16 bp, Homo sapiens
attcccccttaaactt

SEQ ID NO: 5271987 - DNA, 20 bp, Homo sapiens
attcccccttaaacttccaa

SEQ ID NO: 5271988 - DNA, 14 bp, Homo sapiens
attccccggagctg

SEQ ID NO: 5271989 - DNA, 21 bp, Homo sapiens
attcccctatctctagaattt

SEQ ID NO: 5271990 - DNA, 20 bp, Homo sapiens
attcccctccccactcctct

SEQ ID NO: 5271991 - DNA, 22 bp, Homo sapiens
attcccctctgctgctgtccct

SEQ ID NO: 5271992 - DNA, 16 bp, Homo sapiens
attcccctctggaggg

SEQ ID NO: 5271993 - DNA, 18 bp, Homo sapiens
attccccttcccttattt

SEQ ID NO: 5271994 - DNA, 14 bp, Homo sapiens
attccccttcctgt

SEQ ID NO: 5271995 - DNA, 21 bp, Homo sapiens
attcccctttgcactgtaatg

SEQ ID NO: 5271996 - DNA, 23 bp, Homo sapiens
attcccgttttgtcactttttct

SEQ ID NO: 5271997 - DNA, 17 bp, Homo sapiens
attccctacaattcaca

SEQ ID NO: 5271998 - DNA, 21 bp, Homo sapiens
attccctagaaacttccaaat

SEQ ID NO: 5271999 - DNA, 14 bp, Homo sapiens
attccctatcaaaa

SEQ ID NO: 5272000 - DNA, 19 bp, Homo sapiens
attccctatcaaaacatat

SEQ ID NO: 5272001 - DNA, 21 bp, Homo sapiens
attccctatcttttagtttta

SEQ ID NO: 5272002 - DNA, 17 bp, Homo sapiens
attccctcatttaaacc

SEQ ID NO: 5272003 - DNA, 21 bp, Homo sapiens
attccctccacccacttgcct

SEQ ID NO: 5272004 - DNA, 16 bp, Homo sapiens
attccctccccctcct

SEQ ID NO: 5272005 - DNA, 18 bp, Homo sapiens
attccctcgtctttccca

SEQ ID NO: 5272006 - DNA, 16 bp, Homo sapiens
attccctctcatctca

SEQ ID NO: 5272007 - DNA, 23 bp, Homo sapiens
attccctctcccacccaaggaga

SEQ ID NO: 5272008 - DNA, 14 bp, Homo sapiens
attccctctcccag

SEQ ID NO: 5272009 - DNA, 16 bp, Homo sapiens
attccctctcccaggc

SEQ ID NO: 5272010 - DNA, 17 bp, Homo sapiens
attccctctcctgccca

SEQ ID NO: 5272011 - DNA, 15 bp, Homo sapiens
attccctctctctga

SEQ ID NO: 5272012 - DNA, 20 bp, Homo sapiens
attccctctctctgactctc

SEQ ID NO: 5272013 - DNA, 23 bp, Homo sapiens
attccctctgataagctgttctg

SEQ ID NO: 5272014 - DNA, 16 bp, Homo sapiens
attccctgaaaaacta

SEQ ID NO: 5272015 - DNA, 21 bp, Homo sapiens
attccctgaattgtttgatat

SEQ ID NO: 5272016 - DNA, 21 bp, Homo sapiens
attccctgcacacacatgcat

SEQ ID NO: 5272017 - DNA, 20 bp, Homo sapiens
attccctgcccaaaccctta

SEQ ID NO: 5272018 - DNA, 22 bp, Homo sapiens
attccctgctaaatgccatgtt

SEQ ID NO: 5272019 - DNA, 12 bp, Homo sapiens
attccctggcct

SEQ ID NO: 5272020 - DNA, 20 bp, Homo sapiens
attccctggcctggctctcc

SEQ ID NO: 5272021 - DNA, 14 bp, Homo sapiens
attccctgggatct

SEQ ID NO: 5272022 - DNA, 19 bp, Homo sapiens
attcccttatcttttactt

SEQ ID NO: 5272023 - DNA, 22 bp, Homo sapiens
attcccttatcttttacttttt

SEQ ID NO: 5272024 - DNA, 16 bp, Homo sapiens
attcccttcatctgga

SEQ ID NO: 5272025 - DNA, 19 bp, Homo sapiens
attcccttcatctggaacc

SEQ ID NO: 5272026 - DNA, 19 bp, Homo sapiens
attcccttcctgccagccc

SEQ ID NO: 5272027 - DNA, 16 bp, Homo sapiens
attcccttcctgttcc

SEQ ID NO: 5272028 - DNA, 23 bp, Homo sapiens
attcccttcctgttccctcctgg

SEQ ID NO: 5272029 - DNA, 17 bp, Homo sapiens
attcccttctctcagcc

SEQ ID NO: 5272030 - DNA, 22 bp, Homo sapiens
attcccttctctcagcctccac

SEQ ID NO: 5272031 - DNA, 22 bp, Homo sapiens
attcccttctgatcttggaaag

SEQ ID NO: 5272032 - DNA, 18 bp, Homo sapiens
attcccttgaattgtgta

SEQ ID NO: 5272033 - DNA, 12 bp, Homo sapiens
attcccttgtat

SEQ ID NO: 5272034 - DNA, 19 bp, Homo sapiens
attcccttgttattcaaca

SEQ ID NO: 5272035 - DNA, 20 bp, Homo sapiens
attccctttgacttcagctg

SEQ ID NO: 5272036 - DNA, 23 bp, Homo sapiens
attcccttttaaagaatttttgc

SEQ ID NO: 5272037 - DNA, 13 bp, Homo sapiens
attcccttttaat

SEQ ID NO: 5272038 - DNA, 18 bp, Homo sapiens
attcccttttaggtgagg

SEQ ID NO: 5272039 - DNA, 19 bp, Homo sapiens
attcccttttatttccaaa

SEQ ID NO: 5272040 - DNA, 13 bp, Homo sapiens
attccgagcattc

SEQ ID NO: 5272041 - DNA, 17 bp, Homo sapiens
attccgagcattccagt

SEQ ID NO: 5272042 - DNA, 18 bp, Homo sapiens
attccgagcattccagta

SEQ ID NO: 5272043 - DNA, 19 bp, Homo sapiens
attccgattagacctttat

SEQ ID NO: 5272044 - DNA, 14 bp, Homo sapiens
attccgcatcccta

SEQ ID NO: 5272045 - DNA, 22 bp, Homo sapiens
attccggaaactagtgtacatt

SEQ ID NO: 5272046 - DNA, 23 bp, Homo sapiens
attccggaaactagtgtacattt

SEQ ID NO: 5272047 - DNA, 15 bp, Homo sapiens
attccggactggcag

SEQ ID NO: 5272048 - DNA, 22 bp, Homo sapiens
attccggaggctaaataaagtc

SEQ ID NO: 5272049 - DNA, 13 bp, Homo sapiens
attccggatccta

SEQ ID NO: 5272050 - DNA, 15 bp, Homo sapiens
attccggatcctaag

SEQ ID NO: 5272051 - DNA, 23 bp, Homo sapiens
attccggccacatcattctgtgt

SEQ ID NO: 5272052 - DNA, 23 bp, Homo sapiens
attccgtagccagctgctcccca

SEQ ID NO: 5272053 - DNA, 14 bp, Homo sapiens
attccgtatttaaa

SEQ ID NO: 5272054 - DNA, 23 bp, Homo sapiens
attccgttaggaataacactgca

SEQ ID NO: 5272055 - DNA, 18 bp, Homo sapiens
attccgttgtctgtggat

SEQ ID NO: 5272056 - DNA, 18 bp, Homo sapiens
attcctaaaactctgcca

SEQ ID NO: 5272057 - DNA, 14 bp, Homo sapiens
attcctaaaattat

SEQ ID NO: 5272058 - DNA, 15 bp, Homo sapiens
attcctaaactatct

SEQ ID NO: 5272059 - DNA, 17 bp, Homo sapiens
attcctaaactatcttt

SEQ ID NO: 5272060 - DNA, 19 bp, Homo sapiens
attcctaaatattttcaag

SEQ ID NO: 5272061 - DNA, 20 bp, Homo sapiens
attcctaacacagcatgtgt

SEQ ID NO: 5272062 - DNA, 18 bp, Homo sapiens
attcctaactagaattag

SEQ ID NO: 5272063 - DNA, 20 bp, Homo sapiens
attcctaactagaattagta

SEQ ID NO: 5272064 - DNA, 18 bp, Homo sapiens
attcctaacttttcaatg

SEQ ID NO: 5272065 - DNA, 21 bp, Homo sapiens
attcctaagagtggaggagga

SEQ ID NO: 5272066 - DNA, 20 bp, Homo sapiens
attcctaagcagtgcttgta

SEQ ID NO: 5272067 - DNA, 15 bp, Homo sapiens
attcctaaggcccag

SEQ ID NO: 5272068 - DNA, 18 bp, Homo sapiens
attcctaaggcccagctg

SEQ ID NO: 5272069 - DNA, 16 bp, Homo sapiens
attcctaattcctgta

SEQ ID NO: 5272070 - DNA, 20 bp, Homo sapiens
attcctaattctatgattaa

SEQ ID NO: 5272071 - DNA, 14 bp, Homo sapiens
attcctacaactta

SEQ ID NO: 5272072 - DNA, 21 bp, Homo sapiens
attcctacaacttaatggaaa

SEQ ID NO: 5272073 - DNA, 18 bp, Homo sapiens
attcctacaatatatatt

SEQ ID NO: 5272074 - DNA, 15 bp, Homo sapiens
attcctacagcacta

SEQ ID NO: 5272075 - DNA, 15 bp, Homo sapiens
attcctacccctctt

SEQ ID NO: 5272076 - DNA, 17 bp, Homo sapiens
attcctacccctcttcc

SEQ ID NO: 5272077 - DNA, 18 bp, Homo sapiens
attcctacccctcttcca

SEQ ID NO: 5272078 - DNA, 22 bp, Homo sapiens
attcctactccctcttccaaat

SEQ ID NO: 5272079 - DNA, 15 bp, Homo sapiens
attcctacttaaaca

SEQ ID NO: 5272080 - DNA, 21 bp, Homo sapiens
attcctagaattaaaccagat

SEQ ID NO: 5272081 - DNA, 18 bp, Homo sapiens
attcctagagagcagaaa

SEQ ID NO: 5272082 - DNA, 21 bp, Homo sapiens
attcctagataaaaagatggc

SEQ ID NO: 5272083 - DNA, 15 bp, Homo sapiens
attcctagctgtaaa

SEQ ID NO: 5272084 - DNA, 23 bp, Homo sapiens
attcctaggcaactattaataat

SEQ ID NO: 5272085 - DNA, 23 bp, Homo sapiens
attcctagttccccgtgaacttc

SEQ ID NO: 5272086 - DNA, 16 bp, Homo sapiens
attcctagttggtgag

SEQ ID NO: 5272087 - DNA, 17 bp, Homo sapiens
attcctatatagtttat

SEQ ID NO: 5272088 - DNA, 23 bp, Homo sapiens
attcctatcttattgttcgttta

SEQ ID NO: 5272089 - DNA, 22 bp, Homo sapiens
attcctatgaagttggcacatt

SEQ ID NO: 5272090 - DNA, 20 bp, Homo sapiens
attcctatgctgcaatacat

SEQ ID NO: 5272091 - DNA, 22 bp, Homo sapiens
attcctattaatgtctcacttt

SEQ ID NO: 5272092 - DNA, 14 bp, Homo sapiens
attcctattgtgat

SEQ ID NO: 5272093 - DNA, 17 bp, Homo sapiens
attcctattgtgatttg

SEQ ID NO: 5272094 - DNA, 18 bp, Homo sapiens
attcctattgtgatttga

SEQ ID NO: 5272095 - DNA, 19 bp, Homo sapiens
attcctattgtgatttgac

SEQ ID NO: 5272096 - DNA, 21 bp, Homo sapiens
attcctattgtgatttgactg

SEQ ID NO: 5272097 - DNA, 17 bp, Homo sapiens
attcctcaacgtattgt

SEQ ID NO: 5272098 - DNA, 23 bp, Homo sapiens
attcctcacctaccctcaaagta

SEQ ID NO: 5272099 - DNA, 16 bp, Homo sapiens
attcctcagattgctg

SEQ ID NO: 5272100 - DNA, 17 bp, Homo sapiens
attcctcagattgctga

SEQ ID NO: 5272101 - DNA, 16 bp, Homo sapiens
attcctcagctgccaa

SEQ ID NO: 5272102 - DNA, 17 bp, Homo sapiens
attcctcaggaaggaca

SEQ ID NO: 5272103 - DNA, 18 bp, Homo sapiens
attcctcaggaaggacat

SEQ ID NO: 5272104 - DNA, 13 bp, Homo sapiens
attcctcatttgt

SEQ ID NO: 5272105 - DNA, 18 bp, Homo sapiens
attcctcatttgttcatt

SEQ ID NO: 5272106 - DNA, 23 bp, Homo sapiens
attcctcatttgttcattaaacg

SEQ ID NO: 5272107 - DNA, 15 bp, Homo sapiens
attcctccagagaca

SEQ ID NO: 5272108 - DNA, 16 bp, Homo sapiens
attcctccagagacac

SEQ ID NO: 5272109 - DNA, 18 bp, Homo sapiens
attcctccagccctggtg

SEQ ID NO: 5272110 - DNA, 13 bp, Homo sapiens
attcctccagcct

SEQ ID NO: 5272111 - DNA, 15 bp, Homo sapiens
attcctccagcctcc

SEQ ID NO: 5272112 - DNA, 12 bp, Homo sapiens
attcctccagct

SEQ ID NO: 5272113 - DNA, 17 bp, Homo sapiens
attcctccagctgggat

SEQ ID NO: 5272114 - DNA, 11 bp, Homo sapiens
attcctccagg

SEQ ID NO: 5272115 - DNA, 21 bp, Homo sapiens
attcctcccaggaggtgcttg

SEQ ID NO: 5272116 - DNA, 11 bp, Homo sapiens
attcctcccca

SEQ ID NO: 5272117 - DNA, 16 bp, Homo sapiens
attcctccccaccctg

SEQ ID NO: 5272118 - DNA, 22 bp, Homo sapiens
attcctccccaccctgtcccag

SEQ ID NO: 5272119 - DNA, 14 bp, Homo sapiens
attcctcccctgga

SEQ ID NO: 5272120 - DNA, 16 bp, Homo sapiens
attcctcctataggga

SEQ ID NO: 5272121 - DNA, 20 bp, Homo sapiens
attcctcctgctcatattgt

SEQ ID NO: 5272122 - DNA, 12 bp, Homo sapiens
attcctcctgtc

SEQ ID NO: 5272123 - DNA, 21 bp, Homo sapiens
attcctccttccccccatctc

SEQ ID NO: 5272124 - DNA, 14 bp, Homo sapiens
attcctctaaaact

SEQ ID NO: 5272125 - DNA, 13 bp, Homo sapiens
attcctctaagat

SEQ ID NO: 5272126 - DNA, 19 bp, Homo sapiens
attcctctaagatcttgcc

SEQ ID NO: 5272127 - DNA, 20 bp, Homo sapiens
attcctctcaaattcagctc

SEQ ID NO: 5272128 - DNA, 21 bp, Homo sapiens
attcctctcaaattcagctct

SEQ ID NO: 5272129 - DNA, 22 bp, Homo sapiens
attcctctcaaattcagctctg

SEQ ID NO: 5272130 - DNA, 16 bp, Homo sapiens
atggggtctgtaaata

SEQ ID NO: 5272131 - DNA, 16 bp, Homo sapiens
atggggtctgtgactg

SEQ ID NO: 5272132 - DNA, 19 bp, Homo sapiens
atggggtctgtgactggat

SEQ ID NO: 5272133 - DNA, 11 bp, Homo sapiens
atggggtgggg

SEQ ID NO: 5272134 - DNA, 13 bp, Homo sapiens
atggggttcctgc

SEQ ID NO: 5272135 - DNA, 15 bp, Homo sapiens
atggggttcctgctg

SEQ ID NO: 5272136 - DNA, 13 bp, Homo sapiens
atggggttctgga

SEQ ID NO: 5272137 - DNA, 18 bp, Homo sapiens
atggggttggctgggccc

SEQ ID NO: 5272138 - DNA, 13 bp, Homo sapiens
atggggttgggct

SEQ ID NO: 5272139 - DNA, 14 bp, Homo sapiens
atggggttgggctc

SEQ ID NO: 5272140 - DNA, 18 bp, Homo sapiens
atggggttgggctctgcg

SEQ ID NO: 5272141 - DNA, 14 bp, Homo sapiens
atgggtaaataaat

SEQ ID NO: 5272142 - DNA, 17 bp, Homo sapiens
atgggtaaataaatgct

SEQ ID NO: 5272143 - DNA, 22 bp, Homo sapiens
atgggtaaataaatgctgcttt

SEQ ID NO: 5272144 - DNA, 16 bp, Homo sapiens
atgggtaagggaggga

SEQ ID NO: 5272145 - DNA, 18 bp, Homo sapiens
atgggtaagggagggaag

SEQ ID NO: 5272146 - DNA, 18 bp, Homo sapiens
atgggtaaggttctaata

SEQ ID NO: 5272147 - DNA, 20 bp, Homo sapiens
atgggtactccagcaggtag

SEQ ID NO: 5272148 - DNA, 19 bp, Homo sapiens
atgggtactgtctcggcag

SEQ ID NO: 5272149 - DNA, 22 bp, Homo sapiens
atgggtactgtctcggcagagg

SEQ ID NO: 5272150 - DNA, 23 bp, Homo sapiens
atgggtagggctctgacaaagct

SEQ ID NO: 5272151 - DNA, 16 bp, Homo sapiens
atgggtatcaaacagc

SEQ ID NO: 5272152 - DNA, 20 bp, Homo sapiens
atgggtatgtgttgccaaag

SEQ ID NO: 5272153 - DNA, 14 bp, Homo sapiens
atgggtattaaact

SEQ ID NO: 5272154 - DNA, 15 bp, Homo sapiens
atgggtattaaactt

SEQ ID NO: 5272155 - DNA, 19 bp, Homo sapiens
atgggtatttttataacaa

SEQ ID NO: 5272156 - DNA, 20 bp, Homo sapiens
atgggtcaacctttgtgtgg

SEQ ID NO: 5272157 - DNA, 21 bp, Homo sapiens
atgggtcacacctgacaaatg

SEQ ID NO: 5272158 - DNA, 12 bp, Homo sapiens
atgggtcacagg

SEQ ID NO: 5272159 - DNA, 13 bp, Homo sapiens
atgggtcacagga

SEQ ID NO: 5272160 - DNA, 13 bp, Homo sapiens
atgggtcagagct

SEQ ID NO: 5272161 - DNA, 16 bp, Homo sapiens
atgggtccaagagaca

SEQ ID NO: 5272162 - DNA, 22 bp, Homo sapiens
atgggtcccgggttagcctggt

SEQ ID NO: 5272163 - DNA, 20 bp, Homo sapiens
atgggtcccttgaaggaaga

SEQ ID NO: 5272164 - DNA, 21 bp, Homo sapiens
atgggtcccttgaaggaagag

SEQ ID NO: 5272165 - DNA, 22 bp, Homo sapiens
atgggtcccttgaaggaagagg

SEQ ID NO: 5272166 - DNA, 14 bp, Homo sapiens
atgggtcctgctgc

SEQ ID NO: 5272167 - DNA, 15 bp, Homo sapiens
atgggtcgcccatga

SEQ ID NO: 5272168 - DNA, 18 bp, Homo sapiens
atgggtcgggagagggga

SEQ ID NO: 5272169 - DNA, 20 bp, Homo sapiens
atgggtcgggagaggggacg

SEQ ID NO: 5272170 - DNA, 12 bp, Homo sapiens
atgggtctggct

SEQ ID NO: 5272171 - DNA, 22 bp, Homo sapiens
atgggtctggctagagggccca

SEQ ID NO: 5272172 - DNA, 19 bp, Homo sapiens
atgggtctggctgagctga

SEQ ID NO: 5272173 - DNA, 10 bp, Homo sapiens
atgggtctta

SEQ ID NO: 5272174 - DNA, 16 bp, Homo sapiens
atgggtgaaaccacat

SEQ ID NO: 5272175 - DNA, 14 bp, Homo sapiens
atgggtgaaggctg

SEQ ID NO: 5272176 - DNA, 18 bp, Homo sapiens
atgggtgaaggctggcat

SEQ ID NO: 5272177 - DNA, 13 bp, Homo sapiens
atgggtgattatg

SEQ ID NO: 5272178 - DNA, 17 bp, Homo sapiens
atgggtgattatgaaat

SEQ ID NO: 5272179 - DNA, 16 bp, Homo sapiens
atgggtgcaaggaaaa

SEQ ID NO: 5272180 - DNA, 19 bp, Homo sapiens
atgggtgcccgtatccaga

SEQ ID NO: 5272181 - DNA, 20 bp, Homo sapiens
atgggtgcccgtatccagag

SEQ ID NO: 5272182 - DNA, 21 bp, Homo sapiens
atgggtgcccgtatccagagt

SEQ ID NO: 5272183 - DNA, 17 bp, Homo sapiens
atgggtgctgaactctc

SEQ ID NO: 5272184 - DNA, 21 bp, Homo sapiens
atgggtgcttggaggaaggaa

SEQ ID NO: 5272185 - DNA, 18 bp, Homo sapiens
atgggtggaattagagtg

SEQ ID NO: 5272186 - DNA, 16 bp, Homo sapiens
atgggtggacacggat

SEQ ID NO: 5272187 - DNA, 16 bp, Homo sapiens
atgggtggacctgtgt

SEQ ID NO: 5272188 - DNA, 17 bp, Homo sapiens
atgggtggctttcaagg

SEQ ID NO: 5272189 - DNA, 23 bp, Homo sapiens
atgggtggctttcaaggctgggg

SEQ ID NO: 5272190 - DNA, 18 bp, Homo sapiens
atgggtgggaataaaatt

SEQ ID NO: 5272191 - DNA, 18 bp, Homo sapiens
atgggtgggggctcctgg

SEQ ID NO: 5272192 - DNA, 20 bp, Homo sapiens
atgggtgggggctcctggtg

SEQ ID NO: 5272193 - DNA, 20 bp, Homo sapiens
atgggtgtatataattttat

SEQ ID NO: 5272194 - DNA, 21 bp, Homo sapiens
atgggtgtatgaatggtctag

SEQ ID NO: 5272195 - DNA, 20 bp, Homo sapiens
atgggtgtcccctggtgccc

SEQ ID NO: 5272196 - DNA, 13 bp, Homo sapiens
atgggtgtgccct

SEQ ID NO: 5272197 - DNA, 18 bp, Homo sapiens
atgggtgtggatggcagt

SEQ ID NO: 5272198 - DNA, 22 bp, Homo sapiens
atgggttataatcagggaaact

SEQ ID NO: 5272199 - DNA, 22 bp, Homo sapiens
atgggttatctcaaattttaag

SEQ ID NO: 5272200 - DNA, 14 bp, Homo sapiens
atgggttcttagct

SEQ ID NO: 5272201 - DNA, 14 bp, Homo sapiens
atgggttttgctta

SEQ ID NO: 5272202 - DNA, 22 bp, Homo sapiens
atgggtttttccctgtacagta

SEQ ID NO: 5272203 - DNA, 16 bp, Homo sapiens
atggtaaaaaatttat

SEQ ID NO: 5272204 - DNA, 18 bp, Homo sapiens
atggtaaaaaatttataa

SEQ ID NO: 5272205 - DNA, 16 bp, Homo sapiens
atggtaaaataaaatg

SEQ ID NO: 5272206 - DNA, 13 bp, Homo sapiens
atggtaaaattgc

SEQ ID NO: 5272207 - DNA, 14 bp, Homo sapiens
atggtaaaattgca

SEQ ID NO: 5272208 - DNA, 14 bp, Homo sapiens
atggtaaataactg

SEQ ID NO: 5272209 - DNA, 20 bp, Homo sapiens
atggtaactgctttctgttc

SEQ ID NO: 5272210 - DNA, 16 bp, Homo sapiens
atggtaagacctctga

SEQ ID NO: 5272211 - DNA, 17 bp, Homo sapiens
atggtaagacctctgag

SEQ ID NO: 5272212 - DNA, 22 bp, Homo sapiens
atggtaagactgtaattaagta

SEQ ID NO: 5272213 - DNA, 16 bp, Homo sapiens
atggtaagagaaaaga

SEQ ID NO: 5272214 - DNA, 19 bp, Homo sapiens
atggtaagtacttgagtaa

SEQ ID NO: 5272215 - DNA, 20 bp, Homo sapiens
atggtaatcagttttgtata

SEQ ID NO: 5272216 - DNA, 17 bp, Homo sapiens
atggtaatctacagctc

SEQ ID NO: 5272217 - DNA, 18 bp, Homo sapiens
atggtaatcttttctgag

SEQ ID NO: 5272218 - DNA, 19 bp, Homo sapiens
atggtaatgacagatgcaa

SEQ ID NO: 5272219 - DNA, 14 bp, Homo sapiens
atggtacaaccttt

SEQ ID NO: 5272220 - DNA, 22 bp, Homo sapiens
atggtacaacctttattctttt

SEQ ID NO: 5272221 - DNA, 18 bp, Homo sapiens
atggtacagcttctggag

SEQ ID NO: 5272222 - DNA, 19 bp, Homo sapiens
atggtacatttatcactga

SEQ ID NO: 5272223 - DNA, 12 bp, Homo sapiens
atggtacatttt

SEQ ID NO: 5272224 - DNA, 16 bp, Homo sapiens
atggtaccagatgcag

SEQ ID NO: 5272225 - DNA, 15 bp, Homo sapiens
atggtaccagccctg

SEQ ID NO: 5272226 - DNA, 20 bp, Homo sapiens
atggtaccagccctggggct

SEQ ID NO: 5272227 - DNA, 16 bp, Homo sapiens
atggtactaaggagaa

SEQ ID NO: 5272228 - DNA, 18 bp, Homo sapiens
atggtactcccaaactga

SEQ ID NO: 5272229 - DNA, 20 bp, Homo sapiens
atggtactcccaaactgaca

SEQ ID NO: 5272230 - DNA, 21 bp, Homo sapiens
atggtactgactttgcttgct

SEQ ID NO: 5272231 - DNA, 18 bp, Homo sapiens
atggtagaaattttatct

SEQ ID NO: 5272232 - DNA, 21 bp, Homo sapiens
atggtagaagatgaatcagta

SEQ ID NO: 5272233 - DNA, 14 bp, Homo sapiens
atggtagagagagt

SEQ ID NO: 5272234 - DNA, 17 bp, Homo sapiens
atggtagagagagttgc

SEQ ID NO: 5272235 - DNA, 23 bp, Homo sapiens
atggtagattcgctgtcccctca

SEQ ID NO: 5272236 - DNA, 15 bp, Homo sapiens
atggtagattctgtt

SEQ ID NO: 5272237 - DNA, 13 bp, Homo sapiens
atggtagcatttt

SEQ ID NO: 5272238 - DNA, 15 bp, Homo sapiens
atggtagctctgaag

SEQ ID NO: 5272239 - DNA, 17 bp, Homo sapiens
atggtagctctgaaggg

SEQ ID NO: 5272240 - DNA, 17 bp, Homo sapiens
atggtaggaagggatgt

SEQ ID NO: 5272241 - DNA, 13 bp, Homo sapiens
atggtaggggagg

SEQ ID NO: 5272242 - DNA, 16 bp, Homo sapiens
atggtaggggagggca

SEQ ID NO: 5272243 - DNA, 16 bp, Homo sapiens
atggtagtctaaccaa

SEQ ID NO: 5272244 - DNA, 19 bp, Homo sapiens
atggtagtttaaaacatca

SEQ ID NO: 5272245 - DNA, 23 bp, Homo sapiens
atggtagtttctgtggttggctg

SEQ ID NO: 5272246 - DNA, 14 bp, Homo sapiens
atggtagttttttc

SEQ ID NO: 5272247 - DNA, 19 bp, Homo sapiens
atggtagttttttcatctt

SEQ ID NO: 5272248 - DNA, 19 bp, Homo sapiens
atggtataaaaggttgcca

SEQ ID NO: 5272249 - DNA, 13 bp, Homo sapiens
atggtataaacag

SEQ ID NO: 5272250 - DNA, 19 bp, Homo sapiens
atggtatagcaaatgtttt

SEQ ID NO: 5272251 - DNA, 17 bp, Homo sapiens
atggtatatatacatat

SEQ ID NO: 5272252 - DNA, 13 bp, Homo sapiens
atggtatatattt

SEQ ID NO: 5272253 - DNA, 13 bp, Homo sapiens
atggtatctcttt

SEQ ID NO: 5272254 - DNA, 14 bp, Homo sapiens
atggtatgagctga

SEQ ID NO: 5272255 - DNA, 17 bp, Homo sapiens
atggtatgatcaataaa

SEQ ID NO: 5272256 - DNA, 21 bp, Homo sapiens
atggtatgattctattatata

SEQ ID NO: 5272257 - DNA, 18 bp, Homo sapiens
atggtatgtacaagttga

SEQ ID NO: 5272258 - DNA, 17 bp, Homo sapiens
atggtatgtgggtgacc

SEQ ID NO: 5272259 - DNA, 21 bp, Homo sapiens
atggtattaatcttgtgtagt

SEQ ID NO: 5272260 - DNA, 14 bp, Homo sapiens
atggtattacaaaa

SEQ ID NO: 5272261 - DNA, 22 bp, Homo sapiens
atggtattgtattgtaaaccat

SEQ ID NO: 5272262 - DNA, 15 bp, Homo sapiens
atggtatttgagaca

SEQ ID NO: 5272263 - DNA, 17 bp, Homo sapiens
atggtatttgctgtatt

SEQ ID NO: 5272264 - DNA, 12 bp, Homo sapiens
atggtattttcg

SEQ ID NO: 5272265 - DNA, 21 bp, Homo sapiens
atggtattttcgtgcatttgt

SEQ ID NO: 5272266 - DNA, 17 bp, Homo sapiens
atggtattttttgtgaa

SEQ ID NO: 5272267 - DNA, 18 bp, Homo sapiens
atggtcaagcctcttatg

SEQ ID NO: 5272268 - DNA, 17 bp, Homo sapiens
atggtcacacaccagca

SEQ ID NO: 5272269 - DNA, 14 bp, Homo sapiens
atggtcacacactg

SEQ ID NO: 5272270 - DNA, 18 bp, Homo sapiens
atggtcacacactgatgc

SEQ ID NO: 5272271 - DNA, 20 bp, Homo sapiens
atggtcacagacccctgggg

SEQ ID NO: 5272272 - DNA, 21 bp, Homo sapiens
atggtcacagtcctatgtaca

SEQ ID NO: 5272273 - DNA, 18 bp, Homo sapiens
atggtcacccccactctg

SEQ ID NO: 5272274 - DNA, 20 bp, Homo sapiens
atggtcacgtttggtgcttc

SEQ ID NO: 5272275 - DNA, 21 bp, Homo sapiens
atggtcacgtttggtgcttct

SEQ ID NO: 5272276 - DNA, 22 bp, Homo sapiens
atggtcacttaaaatgtgcagt

SEQ ID NO: 5272277 - DNA, 22 bp, Homo sapiens
atggtcagaatttccctctgat

SEQ ID NO: 5272278 - DNA, 16 bp, Homo sapiens
atggtcagcgttgcat

SEQ ID NO: 5272279 - DNA, 18 bp, Homo sapiens
atggtcagcgttgcatgt

SEQ ID NO: 5272280 - DNA, 16 bp, Homo sapiens
atggtcagctcacacc

SEQ ID NO: 5272281 - DNA, 20 bp, Homo sapiens
atggtcagctcccttctctg

SEQ ID NO: 5272282 - DNA, 22 bp, Homo sapiens
atggtcaggaagtttgcagata

SEQ ID NO: 5272283 - DNA, 15 bp, Homo sapiens
atggtcaggcccagt

SEQ ID NO: 5272284 - DNA, 17 bp, Homo sapiens
atggtcagttgaggaat

SEQ ID NO: 5272285 - DNA, 19 bp, Homo sapiens
atggtcatatacatattgt

SEQ ID NO: 5272286 - DNA, 17 bp, Homo sapiens
atggtcattgcagttta

SEQ ID NO: 5272287 - DNA, 13 bp, Homo sapiens
atggtccaggaga

SEQ ID NO: 5272288 - DNA, 18 bp, Homo sapiens
atggtccatttgttcctg

SEQ ID NO: 5272289 - DNA, 19 bp, Homo sapiens
atggtccatttgttcctgc

SEQ ID NO: 5272290 - DNA, 17 bp, Homo sapiens
atggtcccacatccctg

SEQ ID NO: 5272291 - DNA, 20 bp, Homo sapiens
atggtcccacatccctgggc

SEQ ID NO: 5272292 - DNA, 23 bp, Homo sapiens
atggtcccacatccctgggcctg

SEQ ID NO: 5272293 - DNA, 19 bp, Homo sapiens
atggtcccacttccccatc

SEQ ID NO: 5272294 - DNA, 17 bp, Homo sapiens
atggtcccaggaagcag

SEQ ID NO: 5272295 - DNA, 17 bp, Homo sapiens
atggtcccatccaggca

SEQ ID NO: 5272296 - DNA, 13 bp, Homo sapiens
atggtccccatgg

SEQ ID NO: 5272297 - DNA, 17 bp, Homo sapiens
atggtccgtgcccaggc

SEQ ID NO: 5272298 - DNA, 23 bp, Homo sapiens
atggtcctcacaagcctcttctg

SEQ ID NO: 5272299 - DNA, 23 bp, Homo sapiens
atggtcctcatggtgcatataaa

SEQ ID NO: 5272300 - DNA, 23 bp, Homo sapiens
atggtcgagaaagaggcaccagg

SEQ ID NO: 5272301 - DNA, 15 bp, Homo sapiens
atggtcggaaaacat

SEQ ID NO: 5272302 - DNA, 17 bp, Homo sapiens
atggtcggatctcacag

SEQ ID NO: 5272303 - DNA, 22 bp, Homo sapiens
atggtcggatctcacaggctga

SEQ ID NO: 5272304 - DNA, 21 bp, Homo sapiens
atggtctaaaacagctatttc

SEQ ID NO: 5272305 - DNA, 16 bp, Homo sapiens
atggtctaatgtttaa

SEQ ID NO: 5272306 - DNA, 14 bp, Homo sapiens
atggtctcagaaac

SEQ ID NO: 5272307 - DNA, 18 bp, Homo sapiens
atggtctcagaaaccaaa

SEQ ID NO: 5272308 - DNA, 18 bp, Homo sapiens
attcctctcaccccactc

SEQ ID NO: 5272309 - DNA, 20 bp, Homo sapiens
attcctctcaccccactcct

SEQ ID NO: 5272310 - DNA, 18 bp, Homo sapiens
attcctctccaggccaga

SEQ ID NO: 5272311 - DNA, 17 bp, Homo sapiens
attcctctcctagccct

SEQ ID NO: 5272312 - DNA, 20 bp, Homo sapiens
attcctctcctagccctcct

SEQ ID NO: 5272313 - DNA, 13 bp, Homo sapiens
attcctctctcag

SEQ ID NO: 5272314 - DNA, 23 bp, Homo sapiens
attcctctgataatatattttca

SEQ ID NO: 5272315 - DNA, 13 bp, Homo sapiens
attcctctgccag

SEQ ID NO: 5272316 - DNA, 12 bp, Homo sapiens
attcctctggga

SEQ ID NO: 5272317 - DNA, 13 bp, Homo sapiens
attcctctgggaa

SEQ ID NO: 5272318 - DNA, 14 bp, Homo sapiens
attcctcttcattg

SEQ ID NO: 5272319 - DNA, 23 bp, Homo sapiens
attcctcttggcaagatgtttct

SEQ ID NO: 5272320 - DNA, 12 bp, Homo sapiens
attcctctttaa

SEQ ID NO: 5272321 - DNA, 13 bp, Homo sapiens
attcctctttaac

SEQ ID NO: 5272322 - DNA, 19 bp, Homo sapiens
attcctgaagaaccagtcc

SEQ ID NO: 5272323 - DNA, 14 bp, Homo sapiens
attcctgaagccag

SEQ ID NO: 5272324 - DNA, 16 bp, Homo sapiens
attcctgaagccagat

SEQ ID NO: 5272325 - DNA, 17 bp, Homo sapiens
attcctgaatgaaatat

SEQ ID NO: 5272326 - DNA, 15 bp, Homo sapiens
attcctgacccaggc

SEQ ID NO: 5272327 - DNA, 17 bp, Homo sapiens
attcctgacccaggccg

SEQ ID NO: 5272328 - DNA, 21 bp, Homo sapiens
attcctgacccaggccgcagc

SEQ ID NO: 5272329 - DNA, 12 bp, Homo sapiens
attcctgaccct

SEQ ID NO: 5272330 - DNA, 16 bp, Homo sapiens
attcctgaccctcact

SEQ ID NO: 5272331 - DNA, 18 bp, Homo sapiens
attcctgaccctcacttt

SEQ ID NO: 5272332 - DNA, 22 bp, Homo sapiens
attcctgacgagataagcagtt

SEQ ID NO: 5272333 - DNA, 23 bp, Homo sapiens
attcctgagattctgggaaaggt

SEQ ID NO: 5272334 - DNA, 20 bp, Homo sapiens
attcctgagatttcctcctg

SEQ ID NO: 5272335 - DNA, 17 bp, Homo sapiens
attcctgagctggcctg

SEQ ID NO: 5272336 - DNA, 18 bp, Homo sapiens
attcctgagctggcctgt

SEQ ID NO: 5272337 - DNA, 23 bp, Homo sapiens
attcctgatatgatttaaaacat

SEQ ID NO: 5272338 - DNA, 19 bp, Homo sapiens
attcctgatcccatggcca

SEQ ID NO: 5272339 - DNA, 19 bp, Homo sapiens
attcctgcagcctggaggc

SEQ ID NO: 5272340 - DNA, 13 bp, Homo sapiens
attcctgcatttg

SEQ ID NO: 5272341 - DNA, 20 bp, Homo sapiens
attcctgccccagatggctt

SEQ ID NO: 5272342 - DNA, 18 bp, Homo sapiens
attcctgcctggtccagt

SEQ ID NO: 5272343 - DNA, 15 bp, Homo sapiens
attcctgcctgtctc

SEQ ID NO: 5272344 - DNA, 12 bp, Homo sapiens
attcctgccttt

SEQ ID NO: 5272345 - DNA, 20 bp, Homo sapiens
attcctgcctttaagccaaa

SEQ ID NO: 5272346 - DNA, 19 bp, Homo sapiens
attcctgctatgacagctg

SEQ ID NO: 5272347 - DNA, 22 bp, Homo sapiens
attcctgctatgacagctggct

SEQ ID NO: 5272348 - DNA, 13 bp, Homo sapiens
attcctgctgcct

SEQ ID NO: 5272349 - DNA, 18 bp, Homo sapiens
attcctggaacctggacc

SEQ ID NO: 5272350 - DNA, 19 bp, Homo sapiens
attcctggaacctggaccc

SEQ ID NO: 5272351 - DNA, 20 bp, Homo sapiens
attcctggacatcaccagtc

SEQ ID NO: 5272352 - DNA, 17 bp, Homo sapiens
attcctggccccgggct

SEQ ID NO: 5272353 - DNA, 22 bp, Homo sapiens
attcctggctctaccctgtctg

SEQ ID NO: 5272354 - DNA, 10 bp, Homo sapiens
attcctgggc

SEQ ID NO: 5272355 - DNA, 13 bp, Homo sapiens
attcctgggcctg

SEQ ID NO: 5272356 - DNA, 16 bp, Homo sapiens
attcctggtattattt

SEQ ID NO: 5272357 - DNA, 23 bp, Homo sapiens
attcctgtaacttttaatcccta

SEQ ID NO: 5272358 - DNA, 21 bp, Homo sapiens
attcctgtactgtgtctcatg

SEQ ID NO: 5272359 - DNA, 15 bp, Homo sapiens
attcctgtcaacaag

SEQ ID NO: 5272360 - DNA, 17 bp, Homo sapiens
attcctgtcagagcttt

SEQ ID NO: 5272361 - DNA, 17 bp, Homo sapiens
attcctgtccctttgtt

SEQ ID NO: 5272362 - DNA, 15 bp, Homo sapiens
attcctgtccttcac

SEQ ID NO: 5272363 - DNA, 22 bp, Homo sapiens
attcctgtggatgtaaagtgat

SEQ ID NO: 5272364 - DNA, 14 bp, Homo sapiens
attcctgttctctt

SEQ ID NO: 5272365 - DNA, 19 bp, Homo sapiens
attcctgttgatgggaaaa

SEQ ID NO: 5272366 - DNA, 21 bp, Homo sapiens
attcctgttgatgggaaaagc

SEQ ID NO: 5272367 - DNA, 16 bp, Homo sapiens
attcctgttgctctgt

SEQ ID NO: 5272368 - DNA, 16 bp, Homo sapiens
attccttaaacctgaa

SEQ ID NO: 5272369 - DNA, 16 bp, Homo sapiens
attccttaaataaact

SEQ ID NO: 5272370 - DNA, 16 bp, Homo sapiens
attccttaaatgaact

SEQ ID NO: 5272371 - DNA, 19 bp, Homo sapiens
attccttaaatgaactact

SEQ ID NO: 5272372 - DNA, 17 bp, Homo sapiens
attccttaccccagctg

SEQ ID NO: 5272373 - DNA, 18 bp, Homo sapiens
attccttacttgcactgt

SEQ ID NO: 5272374 - DNA, 22 bp, Homo sapiens
attccttagactcttttccttc

SEQ ID NO: 5272375 - DNA, 16 bp, Homo sapiens
attccttagcagctca

SEQ ID NO: 5272376 - DNA, 23 bp, Homo sapiens
attccttagcttagacctcagcc

SEQ ID NO: 5272377 - DNA, 13 bp, Homo sapiens
attccttcaaata

SEQ ID NO: 5272378 - DNA, 19 bp, Homo sapiens
attccttcaaataaagaaa

SEQ ID NO: 5272379 - DNA, 15 bp, Homo sapiens
attccttcagcactt

SEQ ID NO: 5272380 - DNA, 14 bp, Homo sapiens
attccttcagggtg

SEQ ID NO: 5272381 - DNA, 15 bp, Homo sapiens
attccttcccactca

SEQ ID NO: 5272382 - DNA, 18 bp, Homo sapiens
attccttcccactcatgt

SEQ ID NO: 5272383 - DNA, 12 bp, Homo sapiens
attccttcctgt

SEQ ID NO: 5272384 - DNA, 14 bp, Homo sapiens
attccttcctgttc

SEQ ID NO: 5272385 - DNA, 18 bp, Homo sapiens
attccttcctgttctgaa

SEQ ID NO: 5272386 - DNA, 19 bp, Homo sapiens
attccttcgaaaggccttc

SEQ ID NO: 5272387 - DNA, 14 bp, Homo sapiens
attccttctggcct

SEQ ID NO: 5272388 - DNA, 13 bp, Homo sapiens
attccttctgtag

SEQ ID NO: 5272389 - DNA, 15 bp, Homo sapiens
attccttcttcccca

SEQ ID NO: 5272390 - DNA, 15 bp, Homo sapiens
attccttcttctagt

SEQ ID NO: 5272391 - DNA, 13 bp, Homo sapiens
attccttcttgct

SEQ ID NO: 5272392 - DNA, 23 bp, Homo sapiens
attccttcttgctcagtccctct

SEQ ID NO: 5272393 - DNA, 16 bp, Homo sapiens
attccttctttcacag

SEQ ID NO: 5272394 - DNA, 15 bp, Homo sapiens
attccttctttgata

SEQ ID NO: 5272395 - DNA, 15 bp, Homo sapiens
attccttgccccaca

SEQ ID NO: 5272396 - DNA, 18 bp, Homo sapiens
attccttgcgcctcagcc

SEQ ID NO: 5272397 - DNA, 19 bp, Homo sapiens
attccttgcgcctcagccc

SEQ ID NO: 5272398 - DNA, 21 bp, Homo sapiens
attccttgcgcctcagccctc

SEQ ID NO: 5272399 - DNA, 21 bp, Homo sapiens
attccttggcatgccttccag

SEQ ID NO: 5272400 - DNA, 13 bp, Homo sapiens
attccttggccca

SEQ ID NO: 5272401 - DNA, 14 bp, Homo sapiens
attccttggcccag

SEQ ID NO: 5272402 - DNA, 20 bp, Homo sapiens
attccttgtgttttgtcctg

SEQ ID NO: 5272403 - DNA, 16 bp, Homo sapiens
attcctttacaactaa

SEQ ID NO: 5272404 - DNA, 21 bp, Homo sapiens
attcctttacaactaaataac

SEQ ID NO: 5272405 - DNA, 22 bp, Homo sapiens
attcctttacaactaaataaca

SEQ ID NO: 5272406 - DNA, 15 bp, Homo sapiens
attcctttcagcaat

SEQ ID NO: 5272407 - DNA, 12 bp, Homo sapiens
attcctttccct

SEQ ID NO: 5272408 - DNA, 19 bp, Homo sapiens
attcctttcccttcctctt

SEQ ID NO: 5272409 - DNA, 15 bp, Homo sapiens
attcctttcccttta

SEQ ID NO: 5272410 - DNA, 13 bp, Homo sapiens
attcctttccttt

SEQ ID NO: 5272411 - DNA, 22 bp, Homo sapiens
attcctttccttttttgagatt

SEQ ID NO: 5272412 - DNA, 23 bp, Homo sapiens
attcctttccttttttgagattt

SEQ ID NO: 5272413 - DNA, 18 bp, Homo sapiens
attcctttgaagaggaaa

SEQ ID NO: 5272414 - DNA, 17 bp, Homo sapiens
attcctttggccactgt

SEQ ID NO: 5272415 - DNA, 19 bp, Homo sapiens
attcctttggccactgtat

SEQ ID NO: 5272416 - DNA, 23 bp, Homo sapiens
attcctttgtcttcaaactgtga

SEQ ID NO: 5272417 - DNA, 18 bp, Homo sapiens
attcctttgtgtttctat

SEQ ID NO: 5272418 - DNA, 22 bp, Homo sapiens
attcctttgttacttctctaat

SEQ ID NO: 5272419 - DNA, 11 bp, Homo sapiens
attccttttaa

SEQ ID NO: 5272420 - DNA, 18 bp, Homo sapiens
attccttttaaagaagct

SEQ ID NO: 5272421 - DNA, 15 bp, Homo sapiens
attccttttcttgtt

SEQ ID NO: 5272422 - DNA, 18 bp, Homo sapiens
attccttttgtcaattgc

SEQ ID NO: 5272423 - DNA, 16 bp, Homo sapiens
attcctttttaacttt

SEQ ID NO: 5272424 - DNA, 16 bp, Homo sapiens
attcctttttatttat

SEQ ID NO: 5272425 - DNA, 20 bp, Homo sapiens
attcctttttatttatatgt

SEQ ID NO: 5272426 - DNA, 21 bp, Homo sapiens
attcctttttatttatatgta

SEQ ID NO: 5272427 - DNA, 14 bp, Homo sapiens
attcctttttctat

SEQ ID NO: 5272428 - DNA, 14 bp, Homo sapiens
attcgaatctctgc

SEQ ID NO: 5272429 - DNA, 16 bp, Homo sapiens
attcgaatctctgccc

SEQ ID NO: 5272430 - DNA, 16 bp, Homo sapiens
attcgaatgaaaagac

SEQ ID NO: 5272431 - DNA, 22 bp, Homo sapiens
attcgaatggggtagaaacatt

SEQ ID NO: 5272432 - DNA, 18 bp, Homo sapiens
attcgacctgatttacag

SEQ ID NO: 5272433 - DNA, 13 bp, Homo sapiens
attcgagcaaaca

SEQ ID NO: 5272434 - DNA, 18 bp, Homo sapiens
attcgagcaaacaacttt

SEQ ID NO: 5272435 - DNA, 16 bp, Homo sapiens
attcgatgccccccta

SEQ ID NO: 5272436 - DNA, 18 bp, Homo sapiens
attcgcatgtttaatgtg

SEQ ID NO: 5272437 - DNA, 23 bp, Homo sapiens
attcgcccacccgagtacctcca

SEQ ID NO: 5272438 - DNA, 16 bp, Homo sapiens
attcgcctttgtcttg

SEQ ID NO: 5272439 - DNA, 20 bp, Homo sapiens
attcgctgaattgcccgttt

SEQ ID NO: 5272440 - DNA, 17 bp, Homo sapiens
attcgctggggaagggg

SEQ ID NO: 5272441 - DNA, 19 bp, Homo sapiens
attcgctgtcccctcagcg

SEQ ID NO: 5272442 - DNA, 16 bp, Homo sapiens
attcgggccacagggc

SEQ ID NO: 5272443 - DNA, 17 bp, Homo sapiens
attcgggccccacctgc

SEQ ID NO: 5272444 - DNA, 18 bp, Homo sapiens
attcggggctgacctttc

SEQ ID NO: 5272445 - DNA, 18 bp, Homo sapiens
attcggggtgatcctgtt

SEQ ID NO: 5272446 - DNA, 21 bp, Homo sapiens
attcggtatccccccatcttg

SEQ ID NO: 5272447 - DNA, 18 bp, Homo sapiens
attcggtgatgactcttg

SEQ ID NO: 5272448 - DNA, 21 bp, Homo sapiens
attcggtgtgcaccagggttg

SEQ ID NO: 5272449 - DNA, 17 bp, Homo sapiens
attcggtgtgctgccaa

SEQ ID NO: 5272450 - DNA, 13 bp, Homo sapiens
attcgtaagttct

SEQ ID NO: 5272451 - DNA, 24 bp, Homo sapiens
attcgtaatcatccccatcctcca

SEQ ID NO: 5272452 - DNA, 23 bp, Homo sapiens
attcgtacataatactgaaccac

SEQ ID NO: 5272453 - DNA, 15 bp, Homo sapiens
attcgtagccatctc

SEQ ID NO: 5272454 - DNA, 17 bp, Homo sapiens
attcgtgaatagtcttt

SEQ ID NO: 5272455 - DNA, 21 bp, Homo sapiens
attcgtgcagcatatgaggat

SEQ ID NO: 5272456 - DNA, 18 bp, Homo sapiens
attcgtggcatgttttga

SEQ ID NO: 5272457 - DNA, 19 bp, Homo sapiens
attcgtgggcctgctgctc

SEQ ID NO: 5272458 - DNA, 23 bp, Homo sapiens
attcgtggtgatcaattaaatgt

SEQ ID NO: 5272459 - DNA, 17 bp, Homo sapiens
attcgtggttgatttca

SEQ ID NO: 5272460 - DNA, 17 bp, Homo sapiens
attcgtgttatgaatct

SEQ ID NO: 5272461 - DNA, 23 bp, Homo sapiens
attcgtgttatgaatctgtgctg

SEQ ID NO: 5272462 - DNA, 17 bp, Homo sapiens
attcgttatctaatagg

SEQ ID NO: 5272463 - DNA, 16 bp, Homo sapiens
attcgtttgctagaat

SEQ ID NO: 5272464 - DNA, 18 bp, Homo sapiens
attcgttttttacctgtt

SEQ ID NO: 5272465 - DNA, 22 bp, Homo sapiens
attctaaaacacaacaagaaac

SEQ ID NO: 5272466 - DNA, 16 bp, Homo sapiens
attctaaaacattctt

SEQ ID NO: 5272467 - DNA, 18 bp, Homo sapiens
attctaaaacattcttta

SEQ ID NO: 5272468 - DNA, 15 bp, Homo sapiens
attctaaaatgcctt

SEQ ID NO: 5272469 - DNA, 22 bp, Homo sapiens
attctaaaatgtctcaagtgca

SEQ ID NO: 5272470 - DNA, 20 bp, Homo sapiens
attctaaaatgtgatgttct

SEQ ID NO: 5272471 - DNA, 22 bp, Homo sapiens
attctaaaatgtgatgttctaa

SEQ ID NO: 5272472 - DNA, 21 bp, Homo sapiens
attctaaacagatgtccctga

SEQ ID NO: 5272473 - DNA, 12 bp, Homo sapiens
attctaaactta

SEQ ID NO: 5272474 - DNA, 14 bp, Homo sapiens
attctaaatattga

SEQ ID NO: 5272475 - DNA, 17 bp, Homo sapiens
attctaaatcactttaa

SEQ ID NO: 5272476 - DNA, 16 bp, Homo sapiens
attctaaattacaaag

SEQ ID NO: 5272477 - DNA, 13 bp, Homo sapiens
attctaaattatg

SEQ ID NO: 5272478 - DNA, 14 bp, Homo sapiens
attctaaattttat

SEQ ID NO: 5272479 - DNA, 16 bp, Homo sapiens
attctaacaaaaagca

SEQ ID NO: 5272480 - DNA, 19 bp, Homo sapiens
attctaacattaaatcaca

SEQ ID NO: 5272481 - DNA, 20 bp, Homo sapiens
attctaacgcaaaaatagct

SEQ ID NO: 5272482 - DNA, 18 bp, Homo sapiens
attctaacggtctgttct

SEQ ID NO: 5272483 - DNA, 23 bp, Homo sapiens
attctaacttattaaatttatca

SEQ ID NO: 5272484 - DNA, 23 bp, Homo sapiens
attctaagaaatatctgtgaaat

SEQ ID NO: 5272485 - DNA, 24 bp, Homo sapiens
attctaagaaatatctgtgaaata

SEQ ID NO: 5272486 - DNA, 23 bp, Homo sapiens
atggtctcatctcctttgctagt

SEQ ID NO: 5272487 - DNA, 15 bp, Homo sapiens
atggtctccacctgt

SEQ ID NO: 5272488 - DNA, 19 bp, Homo sapiens
atggtctccacctgtgctt

SEQ ID NO: 5272489 - DNA, 22 bp, Homo sapiens
atggtctcgatatcctgatctc

SEQ ID NO: 5272490 - DNA, 19 bp, Homo sapiens
atggtctctcgggcccccc

SEQ ID NO: 5272491 - DNA, 23 bp, Homo sapiens
atggtctctcgggccccccacac

SEQ ID NO: 5272492 - DNA, 15 bp, Homo sapiens
atggtctctctccct

SEQ ID NO: 5272493 - DNA, 16 bp, Homo sapiens
atggtctctctccctc

SEQ ID NO: 5272494 - DNA, 17 bp, Homo sapiens
atggtctctctccctct

SEQ ID NO: 5272495 - DNA, 22 bp, Homo sapiens
atggtctgaagaaggaaggcct

SEQ ID NO: 5272496 - DNA, 16 bp, Homo sapiens
atggtctgccctctgc

SEQ ID NO: 5272497 - DNA, 18 bp, Homo sapiens
atggtctggggtaaaatt

SEQ ID NO: 5272498 - DNA, 18 bp, Homo sapiens
atggtcttatatttacaa

SEQ ID NO: 5272499 - DNA, 22 bp, Homo sapiens
atggtcttgatcctccaatgtc

SEQ ID NO: 5272500 - DNA, 18 bp, Homo sapiens
atggtcttgatctcctga

SEQ ID NO: 5272501 - DNA, 20 bp, Homo sapiens
atggtcttgatctcctgagc

SEQ ID NO: 5272502 - DNA, 17 bp, Homo sapiens
atggtctttgctccaga

SEQ ID NO: 5272503 - DNA, 16 bp, Homo sapiens
atggtgaaaacgtctt

SEQ ID NO: 5272504 - DNA, 16 bp, Homo sapiens
atggtgaaaatgtact

SEQ ID NO: 5272505 - DNA, 18 bp, Homo sapiens
atggtgaaatctgctctg

SEQ ID NO: 5272506 - DNA, 20 bp, Homo sapiens
atggtgaactgtgagtacta

SEQ ID NO: 5272507 - DNA, 12 bp, Homo sapiens
atggtgaagaca

SEQ ID NO: 5272508 - DNA, 16 bp, Homo sapiens
atggtgaatattacat

SEQ ID NO: 5272509 - DNA, 16 bp, Homo sapiens
atggtgacacacagca

SEQ ID NO: 5272510 - DNA, 15 bp, Homo sapiens
atggtgacagctgca

SEQ ID NO: 5272511 - DNA, 23 bp, Homo sapiens
atggtgaccaccccctgttccct

SEQ ID NO: 5272512 - DNA, 18 bp, Homo sapiens
atggtgacctctccggcc

SEQ ID NO: 5272513 - DNA, 21 bp, Homo sapiens
atggtgacctctccggcctgg

SEQ ID NO: 5272514 - DNA, 17 bp, Homo sapiens
atggtgactcctgaaac

SEQ ID NO: 5272515 - DNA, 17 bp, Homo sapiens
atggtgactgatttcaa

SEQ ID NO: 5272516 - DNA, 23 bp, Homo sapiens
atggtgacttcctcgcctctccc

SEQ ID NO: 5272517 - DNA, 14 bp, Homo sapiens
atggtgacttttga

SEQ ID NO: 5272518 - DNA, 14 bp, Homo sapiens
atggtgagaattaa

SEQ ID NO: 5272519 - DNA, 12 bp, Homo sapiens
atggtgagaccc

SEQ ID NO: 5272520 - DNA, 21 bp, Homo sapiens
atggtgagagaagcctgtgcc

SEQ ID NO: 5272521 - DNA, 18 bp, Homo sapiens
atggtgagatgcagctgg

SEQ ID NO: 5272522 - DNA, 19 bp, Homo sapiens
atggtgagatgcagctgga

SEQ ID NO: 5272523 - DNA, 14 bp, Homo sapiens
atggtgagctggga

SEQ ID NO: 5272524 - DNA, 16 bp, Homo sapiens
atggtgagctgggaag

SEQ ID NO: 5272525 - DNA, 20 bp, Homo sapiens
atggtgagggatacccatcc

SEQ ID NO: 5272526 - DNA, 14 bp, Homo sapiens
atggtgagggctga

SEQ ID NO: 5272527 - DNA, 17 bp, Homo sapiens
atggtgatcctctattt

SEQ ID NO: 5272528 - DNA, 19 bp, Homo sapiens
atggtgatcctctattttg

SEQ ID NO: 5272529 - DNA, 21 bp, Homo sapiens
atggtgatcctctattttgtg

SEQ ID NO: 5272530 - DNA, 16 bp, Homo sapiens
atggtgatgaaatgta

SEQ ID NO: 5272531 - DNA, 14 bp, Homo sapiens
atggtgatgcaagt

SEQ ID NO: 5272532 - DNA, 20 bp, Homo sapiens
atggtgatgcagtcttagat

SEQ ID NO: 5272533 - DNA, 23 bp, Homo sapiens
atggtgatttcttgctaagctcc

SEQ ID NO: 5272534 - DNA, 12 bp, Homo sapiens
atggtgatttta

SEQ ID NO: 5272535 - DNA, 14 bp, Homo sapiens
atggtgattttaaa

SEQ ID NO: 5272536 - DNA, 17 bp, Homo sapiens
atggtgattttaaatgt

SEQ ID NO: 5272537 - DNA, 21 bp, Homo sapiens
atggtgcaaaaaaaaacttaa

SEQ ID NO: 5272538 - DNA, 12 bp, Homo sapiens
atggtgcaatga

SEQ ID NO: 5272539 - DNA, 15 bp, Homo sapiens
atggtgcaatgacct

SEQ ID NO: 5272540 - DNA, 16 bp, Homo sapiens
atggtgcaatttgtct

SEQ ID NO: 5272541 - DNA, 18 bp, Homo sapiens
atggtgcaatttgtcttt

SEQ ID NO: 5272542 - DNA, 20 bp, Homo sapiens
atggtgcagttgacagcagg

SEQ ID NO: 5272543 - DNA, 15 bp, Homo sapiens
atggtgcattgtata

SEQ ID NO: 5272544 - DNA, 18 bp, Homo sapiens
atggtgccccaggaccag

SEQ ID NO: 5272545 - DNA, 20 bp, Homo sapiens
atggtgccccaggaccagct

SEQ ID NO: 5272546 - DNA, 21 bp, Homo sapiens
atggtgccccaggaccagctc

SEQ ID NO: 5272547 - DNA, 13 bp, Homo sapiens
atggtgccccctg

SEQ ID NO: 5272548 - DNA, 13 bp, Homo sapiens
atggtgcccctag

SEQ ID NO: 5272549 - DNA, 11 bp, Homo sapiens
atggtgcctga

SEQ ID NO: 5272550 - DNA, 18 bp, Homo sapiens
atggtgcctgagaggcag

SEQ ID NO: 5272551 - DNA, 23 bp, Homo sapiens
atggtgcctgagaggcaggcata

SEQ ID NO: 5272552 - DNA, 22 bp, Homo sapiens
atggtgcctgattcggctgtct

SEQ ID NO: 5272553 - DNA, 16 bp, Homo sapiens
atggtgccttcatttg

SEQ ID NO: 5272554 - DNA, 16 bp, Homo sapiens
atggtgctaatgtgtc

SEQ ID NO: 5272555 - DNA, 20 bp, Homo sapiens
atggtgctacgcctgcatgt

SEQ ID NO: 5272556 - DNA, 16 bp, Homo sapiens
atggtgctcatttcat

SEQ ID NO: 5272557 - DNA, 20 bp, Homo sapiens
atggtgctgcacccctggtg

SEQ ID NO: 5272558 - DNA, 21 bp, Homo sapiens
atggtgctgcagatttgatat

SEQ ID NO: 5272559 - DNA, 15 bp, Homo sapiens
atggtgctgcattga

SEQ ID NO: 5272560 - DNA, 13 bp, Homo sapiens
atggtgctgggag

SEQ ID NO: 5272561 - DNA, 20 bp, Homo sapiens
atggtgctgggtaataaaat

SEQ ID NO: 5272562 - DNA, 16 bp, Homo sapiens
atggtgcttaagttcc

SEQ ID NO: 5272563 - DNA, 13 bp, Homo sapiens
atggtgcttatta

SEQ ID NO: 5272564 - DNA, 22 bp, Homo sapiens
atggtgcttattaagaccaaag

SEQ ID NO: 5272565 - DNA, 23 bp, Homo sapiens
atggtgcttggagggggaagaga

SEQ ID NO: 5272566 - DNA, 23 bp, Homo sapiens
atggtggaagggggtgtgcgtgc

SEQ ID NO: 5272567 - DNA, 15 bp, Homo sapiens
atggtggactaagca

SEQ ID NO: 5272568 - DNA, 18 bp, Homo sapiens
atggtggactacaaaata

SEQ ID NO: 5272569 - DNA, 21 bp, Homo sapiens
atggtggaggattgctgccag

SEQ ID NO: 5272570 - DNA, 23 bp, Homo sapiens
atggtggaggattgctgccagag

SEQ ID NO: 5272571 - DNA, 23 bp, Homo sapiens
atggtggagggcacttcaggtcc

SEQ ID NO: 5272572 - DNA, 18 bp, Homo sapiens
atggtggagtgagagcct

SEQ ID NO: 5272573 - DNA, 18 bp, Homo sapiens
atggtggcacacgcctgt

SEQ ID NO: 5272574 - DNA, 15 bp, Homo sapiens
atggtggcaggaaaa

SEQ ID NO: 5272575 - DNA, 19 bp, Homo sapiens
atggtggcatgcacctgca

SEQ ID NO: 5272576 - DNA, 14 bp, Homo sapiens
atggtggccctgaa

SEQ ID NO: 5272577 - DNA, 17 bp, Homo sapiens
atggtggctgtgtctct

SEQ ID NO: 5272578 - DNA, 15 bp, Homo sapiens
atggtggcttcagct

SEQ ID NO: 5272579 - DNA, 19 bp, Homo sapiens
atggtgggattacaggtgt

SEQ ID NO: 5272580 - DNA, 19 bp, Homo sapiens
atggtgggcttgtggtggc

SEQ ID NO: 5272581 - DNA, 23 bp, Homo sapiens
atggtggggtctcctcaggacca

SEQ ID NO: 5272582 - DNA, 21 bp, Homo sapiens
atggtggtgcatgtctgcaaa

SEQ ID NO: 5272583 - DNA, 24 bp, Homo sapiens
atggtggttgggacccagtggcag

SEQ ID NO: 5272584 - DNA, 20 bp, Homo sapiens
atggtgtaataagacataac

SEQ ID NO: 5272585 - DNA, 22 bp, Homo sapiens
atggtgtaataagacataacgt

SEQ ID NO: 5272586 - DNA, 13 bp, Homo sapiens
atggtgtaatgca

SEQ ID NO: 5272587 - DNA, 13 bp, Homo sapiens
atggtgtacataa

SEQ ID NO: 5272588 - DNA, 16 bp, Homo sapiens
atggtgtagaacacta

SEQ ID NO: 5272589 - DNA, 19 bp, Homo sapiens
atggtgtagaacactaatt

SEQ ID NO: 5272590 - DNA, 22 bp, Homo sapiens
atggtgtagaacactaattcat

SEQ ID NO: 5272591 - DNA, 17 bp, Homo sapiens
atggtgtagctgtcctc

SEQ ID NO: 5272592 - DNA, 14 bp, Homo sapiens
atggtgtatgtggt

SEQ ID NO: 5272593 - DNA, 17 bp, Homo sapiens
atggtgtccttccctgc

SEQ ID NO: 5272594 - DNA, 13 bp, Homo sapiens
atggtgtctccca

SEQ ID NO: 5272595 - DNA, 18 bp, Homo sapiens
atggtgtgaaagtcagat

SEQ ID NO: 5272596 - DNA, 22 bp, Homo sapiens
atggtgtgaaagtcagatgccc

SEQ ID NO: 5272597 - DNA, 16 bp, Homo sapiens
atggtgtgaactaagt

SEQ ID NO: 5272598 - DNA, 20 bp, Homo sapiens
atggtgtgaactaagttatt

SEQ ID NO: 5272599 - DNA, 18 bp, Homo sapiens
atggtgtgcttatgtttt

SEQ ID NO: 5272600 - DNA, 20 bp, Homo sapiens
atggtgtgggtgtcctgcct

SEQ ID NO: 5272601 - DNA, 17 bp, Homo sapiens
atggtgtggtgaatgtg

SEQ ID NO: 5272602 - DNA, 18 bp, Homo sapiens
atggtgtggtgaatgtgt

SEQ ID NO: 5272603 - DNA, 16 bp, Homo sapiens
atggtgtgtggtgcta

SEQ ID NO: 5272604 - DNA, 17 bp, Homo sapiens
atggtgtgtgtctctga

SEQ ID NO: 5272605 - DNA, 18 bp, Homo sapiens
atggtgtgtgtctctgac

SEQ ID NO: 5272606 - DNA, 15 bp, Homo sapiens
atggtgtgtttgtaa

SEQ ID NO: 5272607 - DNA, 14 bp, Homo sapiens
atggtgttacatat

SEQ ID NO: 5272608 - DNA, 18 bp, Homo sapiens
atggtgttactgcagttg

SEQ ID NO: 5272609 - DNA, 23 bp, Homo sapiens
atggtgttgatacgtgtgtgaag

SEQ ID NO: 5272610 - DNA, 20 bp, Homo sapiens
atggtgttgccctgagtgga

SEQ ID NO: 5272611 - DNA, 17 bp, Homo sapiens
atggtgttggaggggca

SEQ ID NO: 5272612 - DNA, 13 bp, Homo sapiens
atggtgttggctt

SEQ ID NO: 5272613 - DNA, 16 bp, Homo sapiens
atggtgttgtatactt

SEQ ID NO: 5272614 - DNA, 16 bp, Homo sapiens
atggtgtttctccctc

SEQ ID NO: 5272615 - DNA, 21 bp, Homo sapiens
atggtgttttcttatgcagga

SEQ ID NO: 5272616 - DNA, 18 bp, Homo sapiens
atggtgtttttcttgtaa

SEQ ID NO: 5272617 - DNA, 22 bp, Homo sapiens
atggtgtttttcttgtaaatgt

SEQ ID NO: 5272618 - DNA, 15 bp, Homo sapiens
atggttacaatcatt

SEQ ID NO: 5272619 - DNA, 19 bp, Homo sapiens
atggttacaatcattgctg

SEQ ID NO: 5272620 - DNA, 20 bp, Homo sapiens
atggttacaatcattgctga

SEQ ID NO: 5272621 - DNA, 13 bp, Homo sapiens
atggttacactgt

SEQ ID NO: 5272622 - DNA, 16 bp, Homo sapiens
atggttacactgttag

SEQ ID NO: 5272623 - DNA, 20 bp, Homo sapiens
atggttaccatgggtgtgga

SEQ ID NO: 5272624 - DNA, 17 bp, Homo sapiens
atggttagaaccagcag

SEQ ID NO: 5272625 - DNA, 18 bp, Homo sapiens
atggttagaaccagcaga

SEQ ID NO: 5272626 - DNA, 22 bp, Homo sapiens
atggttagtgtggaggggagat

SEQ ID NO: 5272627 - DNA, 15 bp, Homo sapiens
atggttcaagattgt

SEQ ID NO: 5272628 - DNA, 13 bp, Homo sapiens
atggttcaagtat

SEQ ID NO: 5272629 - DNA, 20 bp, Homo sapiens
atggttcaagtcttctgtta

SEQ ID NO: 5272630 - DNA, 23 bp, Homo sapiens
atggttcaccatgcagtgggccc

SEQ ID NO: 5272631 - DNA, 20 bp, Homo sapiens
atggttcagaattaaacttt

SEQ ID NO: 5272632 - DNA, 21 bp, Homo sapiens
atggttcagaattaaactttt

SEQ ID NO: 5272633 - DNA, 16 bp, Homo sapiens
atggttccaatgaaat

SEQ ID NO: 5272634 - DNA, 17 bp, Homo sapiens
atggttccatgcctgag

SEQ ID NO: 5272635 - DNA, 19 bp, Homo sapiens
atggttcccaataaaagtg

SEQ ID NO: 5272636 - DNA, 13 bp, Homo sapiens
atggttccttccc

SEQ ID NO: 5272637 - DNA, 16 bp, Homo sapiens
atggttcgttctgttt

SEQ ID NO: 5272638 - DNA, 18 bp, Homo sapiens
atggttcgttctgtttac

SEQ ID NO: 5272639 - DNA, 14 bp, Homo sapiens
atggttctcaattt

SEQ ID NO: 5272640 - DNA, 16 bp, Homo sapiens
atggttctcaatttat

SEQ ID NO: 5272641 - DNA, 22 bp, Homo sapiens
atggttctcagatcttgacagt

SEQ ID NO: 5272642 - DNA, 13 bp, Homo sapiens
atggttctgtgac

SEQ ID NO: 5272643 - DNA, 23 bp, Homo sapiens
atggttctttatcatttctcttc

SEQ ID NO: 5272644 - DNA, 19 bp, Homo sapiens
atggttgaccaaggtgctt

SEQ ID NO: 5272645 - DNA, 15 bp, Homo sapiens
atggttgagttacat

SEQ ID NO: 5272646 - DNA, 18 bp, Homo sapiens
atggttgatggaaaataa

SEQ ID NO: 5272647 - DNA, 17 bp, Homo sapiens
atggttgattcccagca

SEQ ID NO: 5272648 - DNA, 15 bp, Homo sapiens
atggttgcaaagtgt

SEQ ID NO: 5272649 - DNA, 22 bp, Homo sapiens
atggttgcaaagtgttgtctta

SEQ ID NO: 5272650 - DNA, 13 bp, Homo sapiens
atggttgccaccc

SEQ ID NO: 5272651 - DNA, 17 bp, Homo sapiens
atggttgccaccccaac

SEQ ID NO: 5272652 - DNA, 20 bp, Homo sapiens
atggttgccaccccaaccca

SEQ ID NO: 5272653 - DNA, 18 bp, Homo sapiens
atggttgccttaaagaaa

SEQ ID NO: 5272654 - DNA, 15 bp, Homo sapiens
atggttgctttgagc

SEQ ID NO: 5272655 - DNA, 20 bp, Homo sapiens
atggttggagagccctggat

SEQ ID NO: 5272656 - DNA, 20 bp, Homo sapiens
atggttgggaccaggccaat

SEQ ID NO: 5272657 - DNA, 17 bp, Homo sapiens
atggttgtagcatttaa

SEQ ID NO: 5272658 - DNA, 13 bp, Homo sapiens
atggttgtattag

SEQ ID NO: 5272659 - DNA, 14 bp, Homo sapiens
atggttgtattaga

SEQ ID NO: 5272660 - DNA, 19 bp, Homo sapiens
atggttgtcacctctctct

SEQ ID NO: 5272661 - DNA, 12 bp, Homo sapiens
atggttgtgaaa

SEQ ID NO: 5272662 - DNA, 17 bp, Homo sapiens
atggttgtgaaatgtaa

SEQ ID NO: 5272663 - DNA, 18 bp, Homo sapiens
attctaagactaatgctc

SEQ ID NO: 5272664 - DNA, 12 bp, Homo sapiens
attctaagactt

SEQ ID NO: 5272665 - DNA, 20 bp, Homo sapiens
attctaagacttactctaag

SEQ ID NO: 5272666 - DNA, 22 bp, Homo sapiens
attctaagacttactctaagat

SEQ ID NO: 5272667 - DNA, 23 bp, Homo sapiens
attctaagattgtacatatggaa

SEQ ID NO: 5272668 - DNA, 18 bp, Homo sapiens
attctaagttatttactt

SEQ ID NO: 5272669 - DNA, 18 bp, Homo sapiens
attctaataaatatacta

SEQ ID NO: 5272670 - DNA, 20 bp, Homo sapiens
attctaataaatatactatg

SEQ ID NO: 5272671 - DNA, 19 bp, Homo sapiens
attctaataagctagttga

SEQ ID NO: 5272672 - DNA, 20 bp, Homo sapiens
attctaataagctagttgaa

SEQ ID NO: 5272673 - DNA, 14 bp, Homo sapiens
attctaataatgca

SEQ ID NO: 5272674 - DNA, 11 bp, Homo sapiens
attctaatgca

SEQ ID NO: 5272675 - DNA, 16 bp, Homo sapiens
attctaatgcatattt

SEQ ID NO: 5272676 - DNA, 14 bp, Homo sapiens
attctaatggtaac

SEQ ID NO: 5272677 - DNA, 17 bp, Homo sapiens
attctaatggtaacttt

SEQ ID NO: 5272678 - DNA, 19 bp, Homo sapiens
attctaatggtaacttttg

SEQ ID NO: 5272679 - DNA, 20 bp, Homo sapiens
attctaatggtaacttttgt

SEQ ID NO: 5272680 - DNA, 21 bp, Homo sapiens
attctaatggtaacttttgta

SEQ ID NO: 5272681 - DNA, 13 bp, Homo sapiens
attctaatgtctt

SEQ ID NO: 5272682 - DNA, 14 bp, Homo sapiens
attctaattacaaa

SEQ ID NO: 5272683 - DNA, 17 bp, Homo sapiens
attctaattcttcatta

SEQ ID NO: 5272684 - DNA, 18 bp, Homo sapiens
attctaattcttcattat

SEQ ID NO: 5272685 - DNA, 15 bp, Homo sapiens
attctaattttatat

SEQ ID NO: 5272686 - DNA, 22 bp, Homo sapiens
attctacaaaaaaccaggatgc

SEQ ID NO: 5272687 - DNA, 15 bp, Homo sapiens
attctacacatatat

SEQ ID NO: 5272688 - DNA, 24 bp, Homo sapiens
attctacacatatatgtatatgta

SEQ ID NO: 5272689 - DNA, 23 bp, Homo sapiens
attctacacatgtaaaatatgta

SEQ ID NO: 5272690 - DNA, 13 bp, Homo sapiens
attctacacctgg

SEQ ID NO: 5272691 - DNA, 16 bp, Homo sapiens
attctacagctaggac

SEQ ID NO: 5272692 - DNA, 19 bp, Homo sapiens
attctacagctaggactta

SEQ ID NO: 5272693 - DNA, 14 bp, Homo sapiens
attctacagttgtg

SEQ ID NO: 5272694 - DNA, 22 bp, Homo sapiens
attctacagtttcttactgttt

SEQ ID NO: 5272695 - DNA, 16 bp, Homo sapiens
attctacataatggaa

SEQ ID NO: 5272696 - DNA, 16 bp, Homo sapiens
attctaccaaattttt

SEQ ID NO: 5272697 - DNA, 20 bp, Homo sapiens
attctaccaaccccagataa

SEQ ID NO: 5272698 - DNA, 14 bp, Homo sapiens
attctaccaagctg

SEQ ID NO: 5272699 - DNA, 19 bp, Homo sapiens
attctaccaagctgtcaca

SEQ ID NO: 5272700 - DNA, 23 bp, Homo sapiens
attctaccctgttgcaaaggaaa

SEQ ID NO: 5272701 - DNA, 14 bp, Homo sapiens
attctacctttgta

SEQ ID NO: 5272702 - DNA, 11 bp, Homo sapiens
attctactaac

SEQ ID NO: 5272703 - DNA, 14 bp, Homo sapiens
attctactaagtta

SEQ ID NO: 5272704 - DNA, 23 bp, Homo sapiens
attctactaagttattttatgac

SEQ ID NO: 5272705 - DNA, 14 bp, Homo sapiens
attctactcttgtc

SEQ ID NO: 5272706 - DNA, 20 bp, Homo sapiens
attctactggaaaaaaatac

SEQ ID NO: 5272707 - DNA, 16 bp, Homo sapiens
attctacttgctctgg

SEQ ID NO: 5272708 - DNA, 22 bp, Homo sapiens
attctacttgctctggacctgc

SEQ ID NO: 5272709 - DNA, 22 bp, Homo sapiens
attctacttgcttattacattt

SEQ ID NO: 5272710 - DNA, 17 bp, Homo sapiens
attctactttaagcact

SEQ ID NO: 5272711 - DNA, 13 bp, Homo sapiens
attctactttgag

SEQ ID NO: 5272712 - DNA, 16 bp, Homo sapiens
attctactttgagtgc

SEQ ID NO: 5272713 - DNA, 17 bp, Homo sapiens
attctagatcagagagc

SEQ ID NO: 5272714 - DNA, 16 bp, Homo sapiens
attctagattaccatg

SEQ ID NO: 5272715 - DNA, 20 bp, Homo sapiens
attctagcacatcatggcag

SEQ ID NO: 5272716 - DNA, 21 bp, Homo sapiens
attctagctgtatgatttgtt

SEQ ID NO: 5272717 - DNA, 23 bp, Homo sapiens
attctaggaaatcagaagtagtt

SEQ ID NO: 5272718 - DNA, 16 bp, Homo sapiens
attctaggacctgtgt

SEQ ID NO: 5272719 - DNA, 13 bp, Homo sapiens
attctaggcatcc

SEQ ID NO: 5272720 - DNA, 16 bp, Homo sapiens
attctaggcatcccag

SEQ ID NO: 5272721 - DNA, 18 bp, Homo sapiens
attctaggcctcctggcc

SEQ ID NO: 5272722 - DNA, 19 bp, Homo sapiens
attctaggcctcctggccc

SEQ ID NO: 5272723 - DNA, 21 bp, Homo sapiens
attctagggtttcttaaatat

SEQ ID NO: 5272724 - DNA, 21 bp, Homo sapiens
attctaggtggaggttgtgca

SEQ ID NO: 5272725 - DNA, 15 bp, Homo sapiens
attctagtacataat

SEQ ID NO: 5272726 - DNA, 22 bp, Homo sapiens
attctagtacataattgattaa

SEQ ID NO: 5272727 - DNA, 14 bp, Homo sapiens
attctagtatttta

SEQ ID NO: 5272728 - DNA, 21 bp, Homo sapiens
attctagtctctgatttgcaa

SEQ ID NO: 5272729 - DNA, 12 bp, Homo sapiens
attctagtgctg

SEQ ID NO: 5272730 - DNA, 17 bp, Homo sapiens
attctagttttgtcaaa

SEQ ID NO: 5272731 - DNA, 13 bp, Homo sapiens
attctataaaact

SEQ ID NO: 5272732 - DNA, 14 bp, Homo sapiens
attctataaaactc

SEQ ID NO: 5272733 - DNA, 22 bp, Homo sapiens
attctataactcgaggagctca

SEQ ID NO: 5272734 - DNA, 15 bp, Homo sapiens
attctataagagaca

SEQ ID NO: 5272735 - DNA, 18 bp, Homo sapiens
attctataagctatttat

SEQ ID NO: 5272736 - DNA, 12 bp, Homo sapiens
attctataattt

SEQ ID NO: 5272737 - DNA, 15 bp, Homo sapiens
attctatagttctag

SEQ ID NO: 5272738 - DNA, 17 bp, Homo sapiens
attctatagttctagac

SEQ ID NO: 5272739 - DNA, 13 bp, Homo sapiens
attctatatgaat

SEQ ID NO: 5272740 - DNA, 15 bp, Homo sapiens
attctatatgaattt

SEQ ID NO: 5272741 - DNA, 16 bp, Homo sapiens
attctatatgaattta

SEQ ID NO: 5272742 - DNA, 19 bp, Homo sapiens
attctatatgaatttaaat

SEQ ID NO: 5272743 - DNA, 17 bp, Homo sapiens
attctatatgatcctga

SEQ ID NO: 5272744 - DNA, 18 bp, Homo sapiens
attctatatgatcctgaa

SEQ ID NO: 5272745 - DNA, 21 bp, Homo sapiens
attctatatgatcctgaaaaa

SEQ ID NO: 5272746 - DNA, 17 bp, Homo sapiens
attctatatttcatatt

SEQ ID NO: 5272747 - DNA, 17 bp, Homo sapiens
attctatccatctcctg

SEQ ID NO: 5272748 - DNA, 20 bp, Homo sapiens
attctatccccaatcagctc

SEQ ID NO: 5272749 - DNA, 22 bp, Homo sapiens
attctatccccaatcagctcct

SEQ ID NO: 5272750 - DNA, 20 bp, Homo sapiens
attctatcctgtgaggcttt

SEQ ID NO: 5272751 - DNA, 18 bp, Homo sapiens
attctatcgttattataa

SEQ ID NO: 5272752 - DNA, 23 bp, Homo sapiens
attctatcgttattataaatgtt

SEQ ID NO: 5272753 - DNA, 15 bp, Homo sapiens
attctatgagaacaa

SEQ ID NO: 5272754 - DNA, 22 bp, Homo sapiens
attctatgattaaactgggaaa

SEQ ID NO: 5272755 - DNA, 20 bp, Homo sapiens
attctatgcctgtatttcca

SEQ ID NO: 5272756 - DNA, 19 bp, Homo sapiens
attctatggaatagttctg

SEQ ID NO: 5272757 - DNA, 21 bp, Homo sapiens
attctatggccattactaaca

SEQ ID NO: 5272758 - DNA, 12 bp, Homo sapiens
attctatgtaac

SEQ ID NO: 5272759 - DNA, 14 bp, Homo sapiens
attctatgtaactt

SEQ ID NO: 5272760 - DNA, 15 bp, Homo sapiens
attctatgtaacttg

SEQ ID NO: 5272761 - DNA, 16 bp, Homo sapiens
attctatgtaacttgt

SEQ ID NO: 5272762 - DNA, 17 bp, Homo sapiens
attctatgtaatgtaaa

SEQ ID NO: 5272763 - DNA, 20 bp, Homo sapiens
attctatgtaatgtaaacca

SEQ ID NO: 5272764 - DNA, 13 bp, Homo sapiens
attctatgtatgt

SEQ ID NO: 5272765 - DNA, 21 bp, Homo sapiens
attctatgtatgttaatttat

SEQ ID NO: 5272766 - DNA, 13 bp, Homo sapiens
attctatgttaaa

SEQ ID NO: 5272767 - DNA, 19 bp, Homo sapiens
attctatgttaaatactgt

SEQ ID NO: 5272768 - DNA, 24 bp, Homo sapiens
attctatgttaaatactgtgcaga

SEQ ID NO: 5272769 - DNA, 15 bp, Homo sapiens
attctatgttaatat

SEQ ID NO: 5272770 - DNA, 20 bp, Homo sapiens
attctatgttaatattttat

SEQ ID NO: 5272771 - DNA, 16 bp, Homo sapiens
attctatgttggcatt

SEQ ID NO: 5272772 - DNA, 22 bp, Homo sapiens
attctattaaaggaaactttga

SEQ ID NO: 5272773 - DNA, 14 bp, Homo sapiens
attctattaacttt

SEQ ID NO: 5272774 - DNA, 20 bp, Homo sapiens
attctattacattttcagtg

SEQ ID NO: 5272775 - DNA, 15 bp, Homo sapiens
attctattatatatt

SEQ ID NO: 5272776 - DNA, 14 bp, Homo sapiens
attctattctccag

SEQ ID NO: 5272777 - DNA, 15 bp, Homo sapiens
attctattctccaga

SEQ ID NO: 5272778 - DNA, 16 bp, Homo sapiens
attctattctccagac

SEQ ID NO: 5272779 - DNA, 19 bp, Homo sapiens
attctattgactttcttaa

SEQ ID NO: 5272780 - DNA, 13 bp, Homo sapiens
attctattgcctt

SEQ ID NO: 5272781 - DNA, 18 bp, Homo sapiens
attctattgccttctttg

SEQ ID NO: 5272782 - DNA, 21 bp, Homo sapiens
attctattgccttctttgaag

SEQ ID NO: 5272783 - DNA, 17 bp, Homo sapiens
attctattgtattattt

SEQ ID NO: 5272784 - DNA, 20 bp, Homo sapiens
attctattgtgcctatgata

SEQ ID NO: 5272785 - DNA, 14 bp, Homo sapiens
attctattgtttac

SEQ ID NO: 5272786 - DNA, 12 bp, Homo sapiens
attctatttctc

SEQ ID NO: 5272787 - DNA, 13 bp, Homo sapiens
attctatttctct

SEQ ID NO: 5272788 - DNA, 12 bp, Homo sapiens
attctatttgaa

SEQ ID NO: 5272789 - DNA, 15 bp, Homo sapiens
attctatttgctggg

SEQ ID NO: 5272790 - DNA, 18 bp, Homo sapiens
attctatttgctgggctt

SEQ ID NO: 5272791 - DNA, 19 bp, Homo sapiens
attctatttgtcttctcct

SEQ ID NO: 5272792 - DNA, 14 bp, Homo sapiens
attctatttgtgta

SEQ ID NO: 5272793 - DNA, 18 bp, Homo sapiens
attctattttagaataaa

SEQ ID NO: 5272794 - DNA, 21 bp, Homo sapiens
attctattttcattttctgca

SEQ ID NO: 5272795 - DNA, 19 bp, Homo sapiens
attctatttttgtccttgc

SEQ ID NO: 5272796 - DNA, 13 bp, Homo sapiens
attctcaaagcag

SEQ ID NO: 5272797 - DNA, 22 bp, Homo sapiens
attctcaagacctgagtatttt

SEQ ID NO: 5272798 - DNA, 19 bp, Homo sapiens
attctcaagccgcatccca

SEQ ID NO: 5272799 - DNA, 13 bp, Homo sapiens
attctcacaatag

SEQ ID NO: 5272800 - DNA, 21 bp, Homo sapiens
attctcaccaatcgctcccca

SEQ ID NO: 5272801 - DNA, 15 bp, Homo sapiens
attctcaccagctgt

SEQ ID NO: 5272802 - DNA, 17 bp, Homo sapiens
attctcaccattcctgt

SEQ ID NO: 5272803 - DNA, 18 bp, Homo sapiens
attctcaccctgtgaaac

SEQ ID NO: 5272804 - DNA, 21 bp, Homo sapiens
attctcacctaaaccctctgt

SEQ ID NO: 5272805 - DNA, 22 bp, Homo sapiens
attctcacctaaaccctctgtg

SEQ ID NO: 5272806 - DNA, 14 bp, Homo sapiens
attctcactccacc

SEQ ID NO: 5272807 - DNA, 17 bp, Homo sapiens
attctcactccaccacc

SEQ ID NO: 5272808 - DNA, 22 bp, Homo sapiens
attctcagaattcggtgtgctg

SEQ ID NO: 5272809 - DNA, 20 bp, Homo sapiens
attctcagcccctagcagag

SEQ ID NO: 5272810 - DNA, 13 bp, Homo sapiens
attctcaggcacc

SEQ ID NO: 5272811 - DNA, 16 bp, Homo sapiens
attctcagggtctctg

SEQ ID NO: 5272812 - DNA, 22 bp, Homo sapiens
attctcaggtaggaagcaacag

SEQ ID NO: 5272813 - DNA, 17 bp, Homo sapiens
attctcagtaactttta

SEQ ID NO: 5272814 - DNA, 13 bp, Homo sapiens
attctcagttttt

SEQ ID NO: 5272815 - DNA, 21 bp, Homo sapiens
attctcataagtagcattcat

SEQ ID NO: 5272816 - DNA, 15 bp, Homo sapiens
attctcataatcctt

SEQ ID NO: 5272817 - DNA, 18 bp, Homo sapiens
attctcataattcctaca

SEQ ID NO: 5272818 - DNA, 13 bp, Homo sapiens
attctcatctgca

SEQ ID NO: 5272819 - DNA, 21 bp, Homo sapiens
attctcatctgcacccttctt

SEQ ID NO: 5272820 - DNA, 23 bp, Homo sapiens
attctcatgcactgcaaatactt

SEQ ID NO: 5272821 - DNA, 20 bp, Homo sapiens
attctcatgcctcagcctct

SEQ ID NO: 5272822 - DNA, 12 bp, Homo sapiens
attctcatgtga

SEQ ID NO: 5272823 - DNA, 18 bp, Homo sapiens
attctcattgcagaataa

SEQ ID NO: 5272824 - DNA, 21 bp, Homo sapiens
attctcattggggttgcaaca

SEQ ID NO: 5272825 - DNA, 15 bp, Homo sapiens
attctccaaatgatt

SEQ ID NO: 5272826 - DNA, 15 bp, Homo sapiens
attctccaacagctg

SEQ ID NO: 5272827 - DNA, 13 bp, Homo sapiens
attctccacagca

SEQ ID NO: 5272828 - DNA, 19 bp, Homo sapiens
attctccacctgccaggga

SEQ ID NO: 5272829 - DNA, 16 bp, Homo sapiens
attctccagacatgga

SEQ ID NO: 5272830 - DNA, 20 bp, Homo sapiens
attctccagaccaaagcaat

SEQ ID NO: 5272831 - DNA, 15 bp, Homo sapiens
attctccagttgatt

SEQ ID NO: 5272832 - DNA, 16 bp, Homo sapiens
attctcccagctctag

SEQ ID NO: 5272833 - DNA, 20 bp, Homo sapiens
attctcccaggtaccagctg

SEQ ID NO: 5272834 - DNA, 22 bp, Homo sapiens
attctcccaggtaccagctgcg

SEQ ID NO: 5272835 - DNA, 16 bp, Homo sapiens
attctcccagtctctg

SEQ ID NO: 5272836 - DNA, 18 bp, Homo sapiens
attctccccctgttcaca

SEQ ID NO: 5272837 - DNA, 20 bp, Homo sapiens
attctccccctgttcacatc

SEQ ID NO: 5272838 - DNA, 14 bp, Homo sapiens
attctcccctccct

SEQ ID NO: 5272839 - DNA, 18 bp, Homo sapiens
attctcccgcctcagcct

SEQ ID NO: 5272840 - DNA, 18 bp, Homo sapiens
attctcccgggactctgc

SEQ ID NO: 5272841 - DNA, 14 bp, Homo sapiens
attctccctaaagt

SEQ ID NO: 5272842 - DNA, 12 bp, Homo sapiens
atggttgtgtat

SEQ ID NO: 5272843 - DNA, 21 bp, Homo sapiens
atggtttacatccttcactgc

SEQ ID NO: 5272844 - DNA, 18 bp, Homo sapiens
atggtttagataaaggaa

SEQ ID NO: 5272845 - DNA, 21 bp, Homo sapiens
atggtttatagccctgtgaag

SEQ ID NO: 5272846 - DNA, 22 bp, Homo sapiens
atggtttattttgtattgtggt

SEQ ID NO: 5272847 - DNA, 15 bp, Homo sapiens
atggtttcagcacta

SEQ ID NO: 5272848 - DNA, 14 bp, Homo sapiens
atggtttcctctgg

SEQ ID NO: 5272849 - DNA, 15 bp, Homo sapiens
atggtttcttgcaag

SEQ ID NO: 5272850 - DNA, 13 bp, Homo sapiens
atggtttgaaatt

SEQ ID NO: 5272851 - DNA, 21 bp, Homo sapiens
atggtttgaatataaacacta

SEQ ID NO: 5272852 - DNA, 12 bp, Homo sapiens
atggtttggaaa

SEQ ID NO: 5272853 - DNA, 14 bp, Homo sapiens
atggtttggagctg

SEQ ID NO: 5272854 - DNA, 15 bp, Homo sapiens
atggtttggagctga

SEQ ID NO: 5272855 - DNA, 16 bp, Homo sapiens
atggtttggtttttct

SEQ ID NO: 5272856 - DNA, 15 bp, Homo sapiens
atggtttgtcctgat

SEQ ID NO: 5272857 - DNA, 22 bp, Homo sapiens
atggtttgttgttctgcctgga

SEQ ID NO: 5272858 - DNA, 17 bp, Homo sapiens
atggttttacagtgaat

SEQ ID NO: 5272859 - DNA, 22 bp, Homo sapiens
atggttttataactatataaat

SEQ ID NO: 5272860 - DNA, 13 bp, Homo sapiens
atggttttatttc

SEQ ID NO: 5272861 - DNA, 14 bp, Homo sapiens
atggttttctccaa

SEQ ID NO: 5272862 - DNA, 23 bp, Homo sapiens
atggttttggctctcccaccccg

SEQ ID NO: 5272863 - DNA, 21 bp, Homo sapiens
atggtttttaaattttgtaat

SEQ ID NO: 5272864 - DNA, 14 bp, Homo sapiens
atggtttttataat

SEQ ID NO: 5272865 - DNA, 23 bp, Homo sapiens
atggtttttgcaagatttaacac

SEQ ID NO: 5272866 - DNA, 16 bp, Homo sapiens
atggtttttgctctac

SEQ ID NO: 5272867 - DNA, 14 bp, Homo sapiens
atgtaaaaaacaaa

SEQ ID NO: 5272868 - DNA, 15 bp, Homo sapiens
atgtaaaaaacaaaa

SEQ ID NO: 5272869 - DNA, 18 bp, Homo sapiens
atgtaaaaaacaaaaaca

SEQ ID NO: 5272870 - DNA, 11 bp, Homo sapiens
atgtaaaaaag

SEQ ID NO: 5272871 - DNA, 14 bp, Homo sapiens
atgtaaaaaataca

SEQ ID NO: 5272872 - DNA, 21 bp, Homo sapiens
atgtaaaaaatattaaagata

SEQ ID NO: 5272873 - DNA, 19 bp, Homo sapiens
atgtaaaaatacactaatg

SEQ ID NO: 5272874 - DNA, 23 bp, Homo sapiens
atgtaaaaatacactaatgagta

SEQ ID NO: 5272875 - DNA, 20 bp, Homo sapiens
atgtaaaaatatatatgtat

SEQ ID NO: 5272876 - DNA, 14 bp, Homo sapiens
atgtaaaaatgaag

SEQ ID NO: 5272877 - DNA, 18 bp, Homo sapiens
atgtaaaaatgaaggaat

SEQ ID NO: 5272878 - DNA, 13 bp, Homo sapiens
atgtaaaaatgtt

SEQ ID NO: 5272879 - DNA, 12 bp, Homo sapiens
atgtaaaacaaa

SEQ ID NO: 5272880 - DNA, 13 bp, Homo sapiens
atgtaaaacaaaa

SEQ ID NO: 5272881 - DNA, 20 bp, Homo sapiens
atgtaaaacaaaaaacaata

SEQ ID NO: 5272882 - DNA, 15 bp, Homo sapiens
atgtaaaacaggaaa

SEQ ID NO: 5272883 - DNA, 15 bp, Homo sapiens
atgtaaaactcgctt

SEQ ID NO: 5272884 - DNA, 23 bp, Homo sapiens
atgtaaaagaacttactgattat

SEQ ID NO: 5272885 - DNA, 12 bp, Homo sapiens
atgtaaaagaca

SEQ ID NO: 5272886 - DNA, 13 bp, Homo sapiens
atgtaaaagacac

SEQ ID NO: 5272887 - DNA, 16 bp, Homo sapiens
atgtaaaagacactgg

SEQ ID NO: 5272888 - DNA, 21 bp, Homo sapiens
atgtaaaagacactggtgtat

SEQ ID NO: 5272889 - DNA, 22 bp, Homo sapiens
atgtaaaagacttttttcccaa

SEQ ID NO: 5272890 - DNA, 21 bp, Homo sapiens
atgtaaaagagtcatctggta

SEQ ID NO: 5272891 - DNA, 20 bp, Homo sapiens
atgtaaaaggattattacta

SEQ ID NO: 5272892 - DNA, 18 bp, Homo sapiens
atgtaaaaggccaaacct

SEQ ID NO: 5272893 - DNA, 22 bp, Homo sapiens
atgtaaaataaaggctctgtgc

SEQ ID NO: 5272894 - DNA, 17 bp, Homo sapiens
atgtaaaatatgtaaaa

SEQ ID NO: 5272895 - DNA, 14 bp, Homo sapiens
atgtaaaatattta

SEQ ID NO: 5272896 - DNA, 16 bp, Homo sapiens
atgtaaaatatttata

SEQ ID NO: 5272897 - DNA, 14 bp, Homo sapiens
atgtaaaatcaata

SEQ ID NO: 5272898 - DNA, 12 bp, Homo sapiens
atgtaaaatctt

SEQ ID NO: 5272899 - DNA, 13 bp, Homo sapiens
atgtaaaatcttc

SEQ ID NO: 5272900 - DNA, 15 bp, Homo sapiens
atgtaaaatcttcag

SEQ ID NO: 5272901 - DNA, 20 bp, Homo sapiens
atgtaaaatcttcagctggt

SEQ ID NO: 5272902 - DNA, 23 bp, Homo sapiens
atgtaaaatcttcagctggtgga

SEQ ID NO: 5272903 - DNA, 24 bp, Homo sapiens
atgtaaaatcttcagctggtggat

SEQ ID NO: 5272904 - DNA, 13 bp, Homo sapiens
atgtaaaatcttg

SEQ ID NO: 5272905 - DNA, 15 bp, Homo sapiens
atgtaaaatcttgat

SEQ ID NO: 5272906 - DNA, 22 bp, Homo sapiens
atgtaaaatcttgatagctaaa

SEQ ID NO: 5272907 - DNA, 15 bp, Homo sapiens
atgtaaaatcttgtc

SEQ ID NO: 5272908 - DNA, 16 bp, Homo sapiens
atgtaaaatcttgtca

SEQ ID NO: 5272909 - DNA, 13 bp, Homo sapiens
atgtaaaatgatt

SEQ ID NO: 5272910 - DNA, 12 bp, Homo sapiens
atgtaaaatgca

SEQ ID NO: 5272911 - DNA, 13 bp, Homo sapiens
atgtaaaatgcag

SEQ ID NO: 5272912 - DNA, 17 bp, Homo sapiens
atgtaaaatgttgaata

SEQ ID NO: 5272913 - DNA, 18 bp, Homo sapiens
atgtaaacaaaatttagt

SEQ ID NO: 5272914 - DNA, 22 bp, Homo sapiens
atgtaaacaaatctttccatat

SEQ ID NO: 5272915 - DNA, 19 bp, Homo sapiens
atgtaaacattcatatttg

SEQ ID NO: 5272916 - DNA, 12 bp, Homo sapiens
atgtaaacattt

SEQ ID NO: 5272917 - DNA, 18 bp, Homo sapiens
atgtaaaccagaaaaaat

SEQ ID NO: 5272918 - DNA, 19 bp, Homo sapiens
atgtaaaccagaaaaaata

SEQ ID NO: 5272919 - DNA, 13 bp, Homo sapiens
atgtaaactcggg

SEQ ID NO: 5272920 - DNA, 15 bp, Homo sapiens
atgtaaactctcttc

SEQ ID NO: 5272921 - DNA, 13 bp, Homo sapiens
atgtaaactgcca

SEQ ID NO: 5272922 - DNA, 14 bp, Homo sapiens
atgtaaactgtgca

SEQ ID NO: 5272923 - DNA, 20 bp, Homo sapiens
atgtaaactgtttctttaaa

SEQ ID NO: 5272924 - DNA, 22 bp, Homo sapiens
atgtaaactgtttctttaaaat

SEQ ID NO: 5272925 - DNA, 18 bp, Homo sapiens
atgtaaactttaacttcc

SEQ ID NO: 5272926 - DNA, 15 bp, Homo sapiens
atgtaaactttgtca

SEQ ID NO: 5272927 - DNA, 21 bp, Homo sapiens
atgtaaactttgtcatggttt

SEQ ID NO: 5272928 - DNA, 19 bp, Homo sapiens
atgtaaagaacataaataa

SEQ ID NO: 5272929 - DNA, 20 bp, Homo sapiens
atgtaaagaacttaaattat

SEQ ID NO: 5272930 - DNA, 13 bp, Homo sapiens
atgtaaagacaaa

SEQ ID NO: 5272931 - DNA, 13 bp, Homo sapiens
atgtaaagccatg

SEQ ID NO: 5272932 - DNA, 16 bp, Homo sapiens
atgtaaagctgttaaa

SEQ ID NO: 5272933 - DNA, 20 bp, Homo sapiens
atgtaaagctgttaaaatac

SEQ ID NO: 5272934 - DNA, 22 bp, Homo sapiens
atgtaaagctgttaaaatacat

SEQ ID NO: 5272935 - DNA, 20 bp, Homo sapiens
atgtaaaggagtcaaaacta

SEQ ID NO: 5272936 - DNA, 21 bp, Homo sapiens
atgtaaaggtatattgtgaac

SEQ ID NO: 5272937 - DNA, 13 bp, Homo sapiens
atgtaaagtatgt

SEQ ID NO: 5272938 - DNA, 18 bp, Homo sapiens
atgtaaagtatgttttta

SEQ ID NO: 5272939 - DNA, 20 bp, Homo sapiens
atgtaaagtatgtttttaca

SEQ ID NO: 5272940 - DNA, 17 bp, Homo sapiens
atgtaaagtctagaaaa

SEQ ID NO: 5272941 - DNA, 13 bp, Homo sapiens
atgtaaagttaaa

SEQ ID NO: 5272942 - DNA, 15 bp, Homo sapiens
atgtaaagttatgta

SEQ ID NO: 5272943 - DNA, 23 bp, Homo sapiens
atgtaaagttatgtatttaaagt

SEQ ID NO: 5272944 - DNA, 15 bp, Homo sapiens
atgtaaataactcta

SEQ ID NO: 5272945 - DNA, 13 bp, Homo sapiens
atgtaaataattc

SEQ ID NO: 5272946 - DNA, 16 bp, Homo sapiens
atgtaaataattcttt

SEQ ID NO: 5272947 - DNA, 20 bp, Homo sapiens
atgtaaataccaagagcaat

SEQ ID NO: 5272948 - DNA, 20 bp, Homo sapiens
atgtaaatactcatgaatga

SEQ ID NO: 5272949 - DNA, 17 bp, Homo sapiens
atgtaaatactttccat

SEQ ID NO: 5272950 - DNA, 14 bp, Homo sapiens
atgtaaatagattt

SEQ ID NO: 5272951 - DNA, 20 bp, Homo sapiens
atgtaaatagctaagatata

SEQ ID NO: 5272952 - DNA, 12 bp, Homo sapiens
atgtaaatattc

SEQ ID NO: 5272953 - DNA, 15 bp, Homo sapiens
atgtaaatattctat

SEQ ID NO: 5272954 - DNA, 23 bp, Homo sapiens
atgtaaatattgttctgctgtct

SEQ ID NO: 5272955 - DNA, 20 bp, Homo sapiens
atgtaaatcacttcattgtt

SEQ ID NO: 5272956 - DNA, 14 bp, Homo sapiens
atgtaaatcccatt

SEQ ID NO: 5272957 - DNA, 21 bp, Homo sapiens
atgtaaatgattttatgtttt

SEQ ID NO: 5272958 - DNA, 15 bp, Homo sapiens
atgtaaatgctcaaa

SEQ ID NO: 5272959 - DNA, 19 bp, Homo sapiens
atgtaaatgtctcactgag

SEQ ID NO: 5272960 - DNA, 14 bp, Homo sapiens
atgtaaattaagtg

SEQ ID NO: 5272961 - DNA, 15 bp, Homo sapiens
atgtaaattaagtgt

SEQ ID NO: 5272962 - DNA, 17 bp, Homo sapiens
atgtaaattaagtgtgt

SEQ ID NO: 5272963 - DNA, 23 bp, Homo sapiens
atgtaaattatcaggcaaatttg

SEQ ID NO: 5272964 - DNA, 15 bp, Homo sapiens
atgtaaatttgtact

SEQ ID NO: 5272965 - DNA, 20 bp, Homo sapiens
atgtaaattttgtatgaaaa

SEQ ID NO: 5272966 - DNA, 19 bp, Homo sapiens
atgtaaatttttcttttct

SEQ ID NO: 5272967 - DNA, 23 bp, Homo sapiens
atgtaaattttttacgtagctat

SEQ ID NO: 5272968 - DNA, 21 bp, Homo sapiens
atgtaacaaccagagatgact

SEQ ID NO: 5272969 - DNA, 16 bp, Homo sapiens
atgtaacacataaaca

SEQ ID NO: 5272970 - DNA, 20 bp, Homo sapiens
atgtaacaggtaaccacaat

SEQ ID NO: 5272971 - DNA, 18 bp, Homo sapiens
atgtaacagttggtgatt

SEQ ID NO: 5272972 - DNA, 22 bp, Homo sapiens
atgtaacagttggtgattttag

SEQ ID NO: 5272973 - DNA, 14 bp, Homo sapiens
atgtaacagttgtg

SEQ ID NO: 5272974 - DNA, 11 bp, Homo sapiens
atgtaacatca

SEQ ID NO: 5272975 - DNA, 21 bp, Homo sapiens
atgtaacatcataattacatt

SEQ ID NO: 5272976 - DNA, 12 bp, Homo sapiens
atgtaacatgat

SEQ ID NO: 5272977 - DNA, 13 bp, Homo sapiens
atgtaacatgttt

SEQ ID NO: 5272978 - DNA, 13 bp, Homo sapiens
atgtaacattaat

SEQ ID NO: 5272979 - DNA, 14 bp, Homo sapiens
atgtaactagaatt

SEQ ID NO: 5272980 - DNA, 16 bp, Homo sapiens
atgtaactccagatag

SEQ ID NO: 5272981 - DNA, 20 bp, Homo sapiens
atgtaactccagatagagaa

SEQ ID NO: 5272982 - DNA, 22 bp, Homo sapiens
atgtaactccagatagagaaat

SEQ ID NO: 5272983 - DNA, 16 bp, Homo sapiens
atgtaactgagaattt

SEQ ID NO: 5272984 - DNA, 23 bp, Homo sapiens
atgtaactgcattgagaactgca

SEQ ID NO: 5272985 - DNA, 18 bp, Homo sapiens
atgtaactgcctagaaac

SEQ ID NO: 5272986 - DNA, 15 bp, Homo sapiens
atgtaactgctcttg

SEQ ID NO: 5272987 - DNA, 21 bp, Homo sapiens
atgtaactgttaccattggaa

SEQ ID NO: 5272988 - DNA, 14 bp, Homo sapiens
atgtaacttattcc

SEQ ID NO: 5272989 - DNA, 12 bp, Homo sapiens
atgtaacttcag

SEQ ID NO: 5272990 - DNA, 21 bp, Homo sapiens
atgtaacttcagatgtttcca

SEQ ID NO: 5272991 - DNA, 12 bp, Homo sapiens
atgtaacttgaa

SEQ ID NO: 5272992 - DNA, 13 bp, Homo sapiens
atgtaacttgttg

SEQ ID NO: 5272993 - DNA, 15 bp, Homo sapiens
atgtaacttgttgca

SEQ ID NO: 5272994 - DNA, 19 bp, Homo sapiens
atgtaacttgttgcagact

SEQ ID NO: 5272995 - DNA, 23 bp, Homo sapiens
atgtaacttttcttacagcacat

SEQ ID NO: 5272996 - DNA, 14 bp, Homo sapiens
atgtaacttttgta

SEQ ID NO: 5272997 - DNA, 16 bp, Homo sapiens
atgtaacttttgtaag

SEQ ID NO: 5272998 - DNA, 21 bp, Homo sapiens
atgtaagaaaacaaaatctaa

SEQ ID NO: 5272999 - DNA, 22 bp, Homo sapiens
atgtaagaaaacaaaatctaaa

SEQ ID NO: 5273000 - DNA, 16 bp, Homo sapiens
atgtaagaaaatgtta

SEQ ID NO: 5273001 - DNA, 17 bp, Homo sapiens
atgtaagaacacatttt

SEQ ID NO: 5273002 - DNA, 13 bp, Homo sapiens
atgtaagaatcat

SEQ ID NO: 5273003 - DNA, 21 bp, Homo sapiens
atgtaagagctttacaaaaag

SEQ ID NO: 5273004 - DNA, 19 bp, Homo sapiens
atgtaagattatagattct

SEQ ID NO: 5273005 - DNA, 22 bp, Homo sapiens
atgtaagattatagattctaaa

SEQ ID NO: 5273006 - DNA, 12 bp, Homo sapiens
atgtaagcaaag

SEQ ID NO: 5273007 - DNA, 17 bp, Homo sapiens
atgtaagctgaaaatat

SEQ ID NO: 5273008 - DNA, 14 bp, Homo sapiens
atgtaagctgttta

SEQ ID NO: 5273009 - DNA, 20 bp, Homo sapiens
atgtaaggaatgcttggaat

SEQ ID NO: 5273010 - DNA, 15 bp, Homo sapiens
atgtaaggaattgaa

SEQ ID NO: 5273011 - DNA, 14 bp, Homo sapiens
atgtaaggatgagg

SEQ ID NO: 5273012 - DNA, 17 bp, Homo sapiens
atgtaaggattctggaa

SEQ ID NO: 5273013 - DNA, 12 bp, Homo sapiens
atgtaaggcact

SEQ ID NO: 5273014 - DNA, 21 bp, Homo sapiens
atgtaagggaaactgccagca

SEQ ID NO: 5273015 - DNA, 14 bp, Homo sapiens
atgtaagggcttta

SEQ ID NO: 5273016 - DNA, 15 bp, Homo sapiens
atgtaagggctttaa

SEQ ID NO: 5273017 - DNA, 17 bp, Homo sapiens
atgtaagggtctttggt

SEQ ID NO: 5273018 - DNA, 23 bp, Homo sapiens
atgtaaggttttttttgtacgca

SEQ ID NO: 5273019 - DNA, 17 bp, Homo sapiens
atgtaagtaaatgtctg

SEQ ID NO: 5273020 - DNA, 16 bp, Homo sapiens
atgtaagtattaagaa

SEQ ID NO: 5273021 - DNA, 16 bp, Homo sapiens
atgtaagtgtggtttt

SEQ ID NO: 5273022 - DNA, 18 bp, Homo sapiens
attctccctccatggcag

SEQ ID NO: 5273023 - DNA, 15 bp, Homo sapiens
attctccctgacctt

SEQ ID NO: 5273024 - DNA, 23 bp, Homo sapiens
attctccgttgtcattgacttca

SEQ ID NO: 5273025 - DNA, 21 bp, Homo sapiens
attctcctatcacctgtcttg

SEQ ID NO: 5273026 - DNA, 16 bp, Homo sapiens
attctcctcagtggct

SEQ ID NO: 5273027 - DNA, 20 bp, Homo sapiens
attctcctcagtggcttctc

SEQ ID NO: 5273028 - DNA, 16 bp, Homo sapiens
attctcctcctcctcc

SEQ ID NO: 5273029 - DNA, 14 bp, Homo sapiens
attctcctctccca

SEQ ID NO: 5273030 - DNA, 12 bp, Homo sapiens
attctcctgcca

SEQ ID NO: 5273031 - DNA, 15 bp, Homo sapiens
attctcctgcctcag

SEQ ID NO: 5273032 - DNA, 23 bp, Homo sapiens
attctcctgcctcagcctcccat

SEQ ID NO: 5273033 - DNA, 15 bp, Homo sapiens
attctcctggatgct

SEQ ID NO: 5273034 - DNA, 23 bp, Homo sapiens
attctcctgtctcagcctcctga

SEQ ID NO: 5273035 - DNA, 22 bp, Homo sapiens
attctccttcagccctcacccc

SEQ ID NO: 5273036 - DNA, 19 bp, Homo sapiens
attctccttgtgttactaa

SEQ ID NO: 5273037 - DNA, 16 bp, Homo sapiens
attctcgccccttccc

SEQ ID NO: 5273038 - DNA, 17 bp, Homo sapiens
attctcgggaaattatt

SEQ ID NO: 5273039 - DNA, 18 bp, Homo sapiens
attctctaaactggcatc

SEQ ID NO: 5273040 - DNA, 16 bp, Homo sapiens
attctctaagcctggc

SEQ ID NO: 5273041 - DNA, 16 bp, Homo sapiens
attctctaataaaatt

SEQ ID NO: 5273042 - DNA, 23 bp, Homo sapiens
attctctagtttgattaaattct

SEQ ID NO: 5273043 - DNA, 16 bp, Homo sapiens
attctctatgtacaga

SEQ ID NO: 5273044 - DNA, 12 bp, Homo sapiens
attctctattgg

SEQ ID NO: 5273045 - DNA, 17 bp, Homo sapiens
attctctatttattggg

SEQ ID NO: 5273046 - DNA, 14 bp, Homo sapiens
attctctattttac

SEQ ID NO: 5273047 - DNA, 16 bp, Homo sapiens
attctctattttactt

SEQ ID NO: 5273048 - DNA, 19 bp, Homo sapiens
attctctcaagacttctcc

SEQ ID NO: 5273049 - DNA, 20 bp, Homo sapiens
attctctcatagaacattga

SEQ ID NO: 5273050 - DNA, 14 bp, Homo sapiens
attctctccaaaaa

SEQ ID NO: 5273051 - DNA, 17 bp, Homo sapiens
attctctcccatcctgg

SEQ ID NO: 5273052 - DNA, 22 bp, Homo sapiens
attctctcctaatgatgacttg

SEQ ID NO: 5273053 - DNA, 18 bp, Homo sapiens
attctctcctcagactgc

SEQ ID NO: 5273054 - DNA, 19 bp, Homo sapiens
attctctcctcagactgct

SEQ ID NO: 5273055 - DNA, 22 bp, Homo sapiens
attctctcctcagactgctcaa

SEQ ID NO: 5273056 - DNA, 16 bp, Homo sapiens
attctctcctgtacct

SEQ ID NO: 5273057 - DNA, 14 bp, Homo sapiens
attctctccttccc

SEQ ID NO: 5273058 - DNA, 15 bp, Homo sapiens
attctctctatgcaa

SEQ ID NO: 5273059 - DNA, 12 bp, Homo sapiens
attctctctcct

SEQ ID NO: 5273060 - DNA, 14 bp, Homo sapiens
attctctctctaag

SEQ ID NO: 5273061 - DNA, 23 bp, Homo sapiens
attctctctctttacctttgccc

SEQ ID NO: 5273062 - DNA, 15 bp, Homo sapiens
attctctctgctcag

SEQ ID NO: 5273063 - DNA, 11 bp, Homo sapiens
attctctctta

SEQ ID NO: 5273064 - DNA, 18 bp, Homo sapiens
attctctgagctgtgcag

SEQ ID NO: 5273065 - DNA, 11 bp, Homo sapiens
attctctgagt

SEQ ID NO: 5273066 - DNA, 16 bp, Homo sapiens
attctctgattttgag

SEQ ID NO: 5273067 - DNA, 14 bp, Homo sapiens
attctctgcagccc

SEQ ID NO: 5273068 - DNA, 14 bp, Homo sapiens
attctctgcccagc

SEQ ID NO: 5273069 - DNA, 16 bp, Homo sapiens
attctctgcccgggcc

SEQ ID NO: 5273070 - DNA, 17 bp, Homo sapiens
attctctgcgagcaaca

SEQ ID NO: 5273071 - DNA, 19 bp, Homo sapiens
attctctggctgtaaggct

SEQ ID NO: 5273072 - DNA, 22 bp, Homo sapiens
attctctggctgtaaggctcta

SEQ ID NO: 5273073 - DNA, 17 bp, Homo sapiens
attctctgtacatatta

SEQ ID NO: 5273074 - DNA, 21 bp, Homo sapiens
attctctgtccagggcttcag

SEQ ID NO: 5273075 - DNA, 13 bp, Homo sapiens
attctctgtctca

SEQ ID NO: 5273076 - DNA, 19 bp, Homo sapiens
attctctgtctcatccatc

SEQ ID NO: 5273077 - DNA, 18 bp, Homo sapiens
attctctgtgtctaagat

SEQ ID NO: 5273078 - DNA, 20 bp, Homo sapiens
attctctgtgtctaagattc

SEQ ID NO: 5273079 - DNA, 22 bp, Homo sapiens
attctctgtgtctaagattcta

SEQ ID NO: 5273080 - DNA, 17 bp, Homo sapiens
attctctgtttgctttt

SEQ ID NO: 5273081 - DNA, 18 bp, Homo sapiens
attctctgtttgcttttg

SEQ ID NO: 5273082 - DNA, 18 bp, Homo sapiens
attctcttaaaatgacaa

SEQ ID NO: 5273083 - DNA, 15 bp, Homo sapiens
attctcttaaatttg

SEQ ID NO: 5273084 - DNA, 22 bp, Homo sapiens
attctcttaatcactactgtat

SEQ ID NO: 5273085 - DNA, 13 bp, Homo sapiens
attctcttagaca

SEQ ID NO: 5273086 - DNA, 12 bp, Homo sapiens
attctcttcgct

SEQ ID NO: 5273087 - DNA, 15 bp, Homo sapiens
attctcttcttgcta

SEQ ID NO: 5273088 - DNA, 19 bp, Homo sapiens
attctcttgaaggtgctgc

SEQ ID NO: 5273089 - DNA, 22 bp, Homo sapiens
attctcttgaaggtgctgccac

SEQ ID NO: 5273090 - DNA, 20 bp, Homo sapiens
attctcttgtataagatcct

SEQ ID NO: 5273091 - DNA, 16 bp, Homo sapiens
attctcttgtctggct

SEQ ID NO: 5273092 - DNA, 16 bp, Homo sapiens
attctctttgataaca

SEQ ID NO: 5273093 - DNA, 20 bp, Homo sapiens
attctctttggtgtacaaaa

SEQ ID NO: 5273094 - DNA, 19 bp, Homo sapiens
attctcttttatctgttta

SEQ ID NO: 5273095 - DNA, 18 bp, Homo sapiens
attctcttttcaaacaca

SEQ ID NO: 5273096 - DNA, 13 bp, Homo sapiens
attctgaaaggaa

SEQ ID NO: 5273097 - DNA, 18 bp, Homo sapiens
attctgaaaggaaataca

SEQ ID NO: 5273098 - DNA, 19 bp, Homo sapiens
attctgaaaggaaatacac

SEQ ID NO: 5273099 - DNA, 14 bp, Homo sapiens
attctgaaatactt

SEQ ID NO: 5273100 - DNA, 16 bp, Homo sapiens
attctgaaatactttt

SEQ ID NO: 5273101 - DNA, 11 bp, Homo sapiens
attctgaacca

SEQ ID NO: 5273102 - DNA, 14 bp, Homo sapiens
attctgaaccagaa

SEQ ID NO: 5273103 - DNA, 20 bp, Homo sapiens
attctgaaccctccaaagga

SEQ ID NO: 5273104 - DNA, 15 bp, Homo sapiens
attctgaagcaacat

SEQ ID NO: 5273105 - DNA, 19 bp, Homo sapiens
attctgaagcaacatttta

SEQ ID NO: 5273106 - DNA, 20 bp, Homo sapiens
attctgaagcttatgtttct

SEQ ID NO: 5273107 - DNA, 22 bp, Homo sapiens
attctgaagcttatgtttctta

SEQ ID NO: 5273108 - DNA, 14 bp, Homo sapiens
attctgaagtatga

SEQ ID NO: 5273109 - DNA, 22 bp, Homo sapiens
attctgaagtttcctatgacta

SEQ ID NO: 5273110 - DNA, 21 bp, Homo sapiens
attctgaatcaagcacactgt

SEQ ID NO: 5273111 - DNA, 19 bp, Homo sapiens
attctgaatgcttctaagt

SEQ ID NO: 5273112 - DNA, 22 bp, Homo sapiens
attctgaatgcttctaagtaaa

SEQ ID NO: 5273113 - DNA, 17 bp, Homo sapiens
attctgaattgtccttt

SEQ ID NO: 5273114 - DNA, 22 bp, Homo sapiens
attctgaatttgcaaagtactg

SEQ ID NO: 5273115 - DNA, 23 bp, Homo sapiens
attctgaatttgcaaagtactgt

SEQ ID NO: 5273116 - DNA, 17 bp, Homo sapiens
attctgaattttggtaa

SEQ ID NO: 5273117 - DNA, 18 bp, Homo sapiens
attctgacacatatcatt

SEQ ID NO: 5273118 - DNA, 17 bp, Homo sapiens
attctgacataaaattc

SEQ ID NO: 5273119 - DNA, 15 bp, Homo sapiens
attctgacatttata

SEQ ID NO: 5273120 - DNA, 18 bp, Homo sapiens
attctgaccgttaaaaaa

SEQ ID NO: 5273121 - DNA, 20 bp, Homo sapiens
attctgaccgttaaaaaatt

SEQ ID NO: 5273122 - DNA, 18 bp, Homo sapiens
attctgaccttaaatgca

SEQ ID NO: 5273123 - DNA, 18 bp, Homo sapiens
attctgactcggtttctc

SEQ ID NO: 5273124 - DNA, 16 bp, Homo sapiens
attctgacttacttaa

SEQ ID NO: 5273125 - DNA, 16 bp, Homo sapiens
attctgacttatgaat

SEQ ID NO: 5273126 - DNA, 13 bp, Homo sapiens
attctgagagctg

SEQ ID NO: 5273127 - DNA, 22 bp, Homo sapiens
attctgagcacgggcaaagaaa

SEQ ID NO: 5273128 - DNA, 15 bp, Homo sapiens
attctgagcagtgcc

SEQ ID NO: 5273129 - DNA, 19 bp, Homo sapiens
attctgagcatactcaaca

SEQ ID NO: 5273130 - DNA, 14 bp, Homo sapiens
attctgagccttga

SEQ ID NO: 5273131 - DNA, 15 bp, Homo sapiens
attctgaggccctgc

SEQ ID NO: 5273132 - DNA, 20 bp, Homo sapiens
attctgagggaatttaacca

SEQ ID NO: 5273133 - DNA, 16 bp, Homo sapiens
attctgaggtaagtgt

SEQ ID NO: 5273134 - DNA, 18 bp, Homo sapiens
attctgaggtaagtgtat

SEQ ID NO: 5273135 - DNA, 17 bp, Homo sapiens
attctgagtgaaaattt

SEQ ID NO: 5273136 - DNA, 22 bp, Homo sapiens
attctgagttttgtgtttgttg

SEQ ID NO: 5273137 - DNA, 16 bp, Homo sapiens
attctgataatgctca

SEQ ID NO: 5273138 - DNA, 13 bp, Homo sapiens
attctgatacatt

SEQ ID NO: 5273139 - DNA, 17 bp, Homo sapiens
attctgataggaggggg

SEQ ID NO: 5273140 - DNA, 15 bp, Homo sapiens
attctgatcctcagc

SEQ ID NO: 5273141 - DNA, 18 bp, Homo sapiens
attctgatgttactgaga

SEQ ID NO: 5273142 - DNA, 19 bp, Homo sapiens
attctgatgtttctgtgaa

SEQ ID NO: 5273143 - DNA, 20 bp, Homo sapiens
attctgatgtttctgtgaaa

SEQ ID NO: 5273144 - DNA, 18 bp, Homo sapiens
attctgattagagatata

SEQ ID NO: 5273145 - DNA, 15 bp, Homo sapiens
attctgattattaca

SEQ ID NO: 5273146 - DNA, 20 bp, Homo sapiens
attctgattcgaatgacact

SEQ ID NO: 5273147 - DNA, 12 bp, Homo sapiens
attctgattctt

SEQ ID NO: 5273148 - DNA, 14 bp, Homo sapiens
attctgattgctat

SEQ ID NO: 5273149 - DNA, 12 bp, Homo sapiens
attctgatttca

SEQ ID NO: 5273150 - DNA, 16 bp, Homo sapiens
attctgatttcagttt

SEQ ID NO: 5273151 - DNA, 14 bp, Homo sapiens
attctgatttcttt

SEQ ID NO: 5273152 - DNA, 17 bp, Homo sapiens
attctgcaacagcctgt

SEQ ID NO: 5273153 - DNA, 15 bp, Homo sapiens
attctgcaagcaatc

SEQ ID NO: 5273154 - DNA, 19 bp, Homo sapiens
attctgcaagcacatctgc

SEQ ID NO: 5273155 - DNA, 14 bp, Homo sapiens
attctgcaagtata

SEQ ID NO: 5273156 - DNA, 23 bp, Homo sapiens
attctgcaagtttctgtttcaaa

SEQ ID NO: 5273157 - DNA, 15 bp, Homo sapiens
attctgcaccttgcc

SEQ ID NO: 5273158 - DNA, 16 bp, Homo sapiens
attctgcaccttgcca

SEQ ID NO: 5273159 - DNA, 23 bp, Homo sapiens
attctgcacgctgcccaggggct

SEQ ID NO: 5273160 - DNA, 14 bp, Homo sapiens
attctgcagaaaaa

SEQ ID NO: 5273161 - DNA, 19 bp, Homo sapiens
attctgcagaaaaaaaaga

SEQ ID NO: 5273162 - DNA, 22 bp, Homo sapiens
attctgcagaactcctccaaag

SEQ ID NO: 5273163 - DNA, 13 bp, Homo sapiens
attctgcagcatg

SEQ ID NO: 5273164 - DNA, 15 bp, Homo sapiens
attctgcagcatgac

SEQ ID NO: 5273165 - DNA, 17 bp, Homo sapiens
attctgcagtaaatctt

SEQ ID NO: 5273166 - DNA, 16 bp, Homo sapiens
attctgcatgagctga

SEQ ID NO: 5273167 - DNA, 15 bp, Homo sapiens
attctgcatgtacta

SEQ ID NO: 5273168 - DNA, 15 bp, Homo sapiens
attctgcattaataa

SEQ ID NO: 5273169 - DNA, 16 bp, Homo sapiens
attctgcattgagaag

SEQ ID NO: 5273170 - DNA, 20 bp, Homo sapiens
attctgcattgagaaggaac

SEQ ID NO: 5273171 - DNA, 22 bp, Homo sapiens
attctgcattgctagataaaag

SEQ ID NO: 5273172 - DNA, 12 bp, Homo sapiens
attctgccaaag

SEQ ID NO: 5273173 - DNA, 23 bp, Homo sapiens
attctgccaggcccccaagcctg

SEQ ID NO: 5273174 - DNA, 22 bp, Homo sapiens
attctgccataacagattatgt

SEQ ID NO: 5273175 - DNA, 17 bp, Homo sapiens
attctgccctccttaat

SEQ ID NO: 5273176 - DNA, 22 bp, Homo sapiens
attctgccgtgtgccctcgggc

SEQ ID NO: 5273177 - DNA, 15 bp, Homo sapiens
attctgcctaataaa

SEQ ID NO: 5273178 - DNA, 22 bp, Homo sapiens
attctgcctacgttctctttaa

SEQ ID NO: 5273179 - DNA, 16 bp, Homo sapiens
attctgcctatgtaaa

SEQ ID NO: 5273180 - DNA, 20 bp, Homo sapiens
attctgcctcagcctcctga

SEQ ID NO: 5273181 - DNA, 22 bp, Homo sapiens
attctgcctcagcctcctgagt

SEQ ID NO: 5273182 - DNA, 15 bp, Homo sapiens
attctgcctctcctc

SEQ ID NO: 5273183 - DNA, 21 bp, Homo sapiens
attctgcctctctggaaagag

SEQ ID NO: 5273184 - DNA, 13 bp, Homo sapiens
attctgcctgccc

SEQ ID NO: 5273185 - DNA, 16 bp, Homo sapiens
attctgcctgcccagg

SEQ ID NO: 5273186 - DNA, 19 bp, Homo sapiens
attctgcctgcccaggccc

SEQ ID NO: 5273187 - DNA, 22 bp, Homo sapiens
attctgcctgcctcctccctcc

SEQ ID NO: 5273188 - DNA, 15 bp, Homo sapiens
attctgcctgctcca

SEQ ID NO: 5273189 - DNA, 11 bp, Homo sapiens
attctgccttg

SEQ ID NO: 5273190 - DNA, 16 bp, Homo sapiens
attctgcctttgccag

SEQ ID NO: 5273191 - DNA, 15 bp, Homo sapiens
attctgcctttgccg

SEQ ID NO: 5273192 - DNA, 12 bp, Homo sapiens
attctgctaaga

SEQ ID NO: 5273193 - DNA, 15 bp, Homo sapiens
attctgctacctcac

SEQ ID NO: 5273194 - DNA, 19 bp, Homo sapiens
attctgctcacatatctgt

SEQ ID NO: 5273195 - DNA, 20 bp, Homo sapiens
attctgctcacatatctgtc

SEQ ID NO: 5273196 - DNA, 20 bp, Homo sapiens
attctgctcctgaaaaatga

SEQ ID NO: 5273197 - DNA, 19 bp, Homo sapiens
attctgctctaaataaaga

SEQ ID NO: 5273198 - DNA, 15 bp, Homo sapiens
attctgctctgccca

SEQ ID NO: 5273199 - DNA, 14 bp, Homo sapiens
attctgctgtctca

SEQ ID NO: 5273200 - DNA, 22 bp, Homo sapiens
attctgcttaaagttgtaacaa

SEQ ID NO: 5273201 - DNA, 13 bp, Homo sapiens
atgtaagtgttaa

SEQ ID NO: 5273202 - DNA, 19 bp, Homo sapiens
atgtaataaaaagcctctt

SEQ ID NO: 5273203 - DNA, 14 bp, Homo sapiens
atgtaataaacagg

SEQ ID NO: 5273204 - DNA, 11 bp, Homo sapiens
atgtaataaag

SEQ ID NO: 5273205 - DNA, 14 bp, Homo sapiens
atgtaataaagtga

SEQ ID NO: 5273206 - DNA, 22 bp, Homo sapiens
atgtaataaagtgaactttgtt

SEQ ID NO: 5273207 - DNA, 12 bp, Homo sapiens
atgtaataaatc

SEQ ID NO: 5273208 - DNA, 13 bp, Homo sapiens
atgtaataaatct

SEQ ID NO: 5273209 - DNA, 17 bp, Homo sapiens
atgtaataaattcaaaa

SEQ ID NO: 5273210 - DNA, 20 bp, Homo sapiens
atgtaataagcacttgcctg

SEQ ID NO: 5273211 - DNA, 20 bp, Homo sapiens
atgtaataataatgaatgtc

SEQ ID NO: 5273212 - DNA, 23 bp, Homo sapiens
atgtaataataatgaatgtcatg

SEQ ID NO: 5273213 - DNA, 19 bp, Homo sapiens
atgtaataatcattttaga

SEQ ID NO: 5273214 - DNA, 14 bp, Homo sapiens
atgtaataatgtga

SEQ ID NO: 5273215 - DNA, 20 bp, Homo sapiens
atgtaatacaccaaatagct

SEQ ID NO: 5273216 - DNA, 13 bp, Homo sapiens
atgtaatactgaa

SEQ ID NO: 5273217 - DNA, 13 bp, Homo sapiens
atgtaatactgta

SEQ ID NO: 5273218 - DNA, 21 bp, Homo sapiens
atgtaatacttcttgtgtgta

SEQ ID NO: 5273219 - DNA, 22 bp, Homo sapiens
atgtaatagtcttgcagaaaat

SEQ ID NO: 5273220 - DNA, 14 bp, Homo sapiens
atgtaatagtttat

SEQ ID NO: 5273221 - DNA, 15 bp, Homo sapiens
atgtaatataatgta

SEQ ID NO: 5273222 - DNA, 19 bp, Homo sapiens
atgtaatatagggtttgtt

SEQ ID NO: 5273223 - DNA, 14 bp, Homo sapiens
atgtaatatattgt

SEQ ID NO: 5273224 - DNA, 23 bp, Homo sapiens
atgtaatatattgtacaaatgta

SEQ ID NO: 5273225 - DNA, 21 bp, Homo sapiens
atgtaatatatttcagacatt

SEQ ID NO: 5273226 - DNA, 14 bp, Homo sapiens
atgtaatattaaat

SEQ ID NO: 5273227 - DNA, 16 bp, Homo sapiens
atgtaatattaaattc

SEQ ID NO: 5273228 - DNA, 18 bp, Homo sapiens
atgtaatcaaacttctag

SEQ ID NO: 5273229 - DNA, 20 bp, Homo sapiens
atgtaatcaaacttctaggt

SEQ ID NO: 5273230 - DNA, 17 bp, Homo sapiens
atgtaatcatttatctt

SEQ ID NO: 5273231 - DNA, 19 bp, Homo sapiens
atgtaatcatttatcttat

SEQ ID NO: 5273232 - DNA, 22 bp, Homo sapiens
atgtaatctgattttcaaaaat

SEQ ID NO: 5273233 - DNA, 17 bp, Homo sapiens
atgtaatgacagagagt

SEQ ID NO: 5273234 - DNA, 14 bp, Homo sapiens
atgtaatgatcttg

SEQ ID NO: 5273235 - DNA, 16 bp, Homo sapiens
atgtaatgatcttgga

SEQ ID NO: 5273236 - DNA, 13 bp, Homo sapiens
atgtaatgtaaac

SEQ ID NO: 5273237 - DNA, 18 bp, Homo sapiens
atgtaatgtagttctttg

SEQ ID NO: 5273238 - DNA, 20 bp, Homo sapiens
atgtaatgtgtggtggcctc

SEQ ID NO: 5273239 - DNA, 21 bp, Homo sapiens
atgtaatgtgtggtggcctca

SEQ ID NO: 5273240 - DNA, 12 bp, Homo sapiens
atgtaatgtttt

SEQ ID NO: 5273241 - DNA, 19 bp, Homo sapiens
atgtaatgtttttatttca

SEQ ID NO: 5273242 - DNA, 21 bp, Homo sapiens
atgtaatgtttttatttcaat

SEQ ID NO: 5273243 - DNA, 15 bp, Homo sapiens
atgtaattaagtact

SEQ ID NO: 5273244 - DNA, 16 bp, Homo sapiens
atgtaattacattaaa

SEQ ID NO: 5273245 - DNA, 14 bp, Homo sapiens
atgtaattagctct

SEQ ID NO: 5273246 - DNA, 17 bp, Homo sapiens
atgtaattagctctggg

SEQ ID NO: 5273247 - DNA, 17 bp, Homo sapiens
atgtaattatttatgta

SEQ ID NO: 5273248 - DNA, 23 bp, Homo sapiens
atgtaattatttatgtatggtgc

SEQ ID NO: 5273249 - DNA, 16 bp, Homo sapiens
atgtaattcaggactc

SEQ ID NO: 5273250 - DNA, 15 bp, Homo sapiens
atgtaattggaatct

SEQ ID NO: 5273251 - DNA, 17 bp, Homo sapiens
atgtaattgtaattttg

SEQ ID NO: 5273252 - DNA, 15 bp, Homo sapiens
atgtaatttaaatga

SEQ ID NO: 5273253 - DNA, 14 bp, Homo sapiens
atgtaatttagaaa

SEQ ID NO: 5273254 - DNA, 16 bp, Homo sapiens
atgtaatttagaaact

SEQ ID NO: 5273255 - DNA, 19 bp, Homo sapiens
atgtaatttagtctaacac

SEQ ID NO: 5273256 - DNA, 14 bp, Homo sapiens
atgtaatttatgca

SEQ ID NO: 5273257 - DNA, 13 bp, Homo sapiens
atgtaatttcaaa

SEQ ID NO: 5273258 - DNA, 21 bp, Homo sapiens
atgtaatttcaaaatacattt

SEQ ID NO: 5273259 - DNA, 19 bp, Homo sapiens
atgtaatttcagttctaaa

SEQ ID NO: 5273260 - DNA, 16 bp, Homo sapiens
atgtaatttctttaaa

SEQ ID NO: 5273261 - DNA, 23 bp, Homo sapiens
atgtaatttctttaaatgtgtat

SEQ ID NO: 5273262 - DNA, 17 bp, Homo sapiens
atgtaatttgcattact

SEQ ID NO: 5273263 - DNA, 14 bp, Homo sapiens
atgtaatttgtaca

SEQ ID NO: 5273264 - DNA, 17 bp, Homo sapiens
atgtaatttgtgtaata

SEQ ID NO: 5273265 - DNA, 18 bp, Homo sapiens
atgtaattttgaactgtt

SEQ ID NO: 5273266 - DNA, 17 bp, Homo sapiens
atgtaattttgtgtaag

SEQ ID NO: 5273267 - DNA, 15 bp, Homo sapiens
atgtacaaaaacaca

SEQ ID NO: 5273268 - DNA, 14 bp, Homo sapiens
atgtacaaaaatta

SEQ ID NO: 5273269 - DNA, 18 bp, Homo sapiens
atgtacaaaaattatgca

SEQ ID NO: 5273270 - DNA, 20 bp, Homo sapiens
atgtacaaaaattatgcaat

SEQ ID NO: 5273271 - DNA, 13 bp, Homo sapiens
atgtacaaaactt

SEQ ID NO: 5273272 - DNA, 15 bp, Homo sapiens
atgtacaaagatact

SEQ ID NO: 5273273 - DNA, 13 bp, Homo sapiens
atgtacaaccctg

SEQ ID NO: 5273274 - DNA, 15 bp, Homo sapiens
atgtacaaccctgac

SEQ ID NO: 5273275 - DNA, 17 bp, Homo sapiens
atgtacaaggtatgtac

SEQ ID NO: 5273276 - DNA, 16 bp, Homo sapiens
atgtacaagttgagta

SEQ ID NO: 5273277 - DNA, 16 bp, Homo sapiens
atgtacaagttttgta

SEQ ID NO: 5273278 - DNA, 21 bp, Homo sapiens
atgtacaagttttgtataaat

SEQ ID NO: 5273279 - DNA, 22 bp, Homo sapiens
atgtacaagttttgtataaata

SEQ ID NO: 5273280 - DNA, 13 bp, Homo sapiens
atgtacaatacaa

SEQ ID NO: 5273281 - DNA, 14 bp, Homo sapiens
atgtacaatatttt

SEQ ID NO: 5273282 - DNA, 19 bp, Homo sapiens
atgtacaatattttaagca

SEQ ID NO: 5273283 - DNA, 23 bp, Homo sapiens
atgtacaattgtgggcataaact

SEQ ID NO: 5273284 - DNA, 22 bp, Homo sapiens
atgtacacacacagatgcacac

SEQ ID NO: 5273285 - DNA, 18 bp, Homo sapiens
atgtacaccacatgctat

SEQ ID NO: 5273286 - DNA, 18 bp, Homo sapiens
atgtacagaaaatagctt

SEQ ID NO: 5273287 - DNA, 19 bp, Homo sapiens
atgtacagaaaatagcttt

SEQ ID NO: 5273288 - DNA, 19 bp, Homo sapiens
atgtacagacatatttaac

SEQ ID NO: 5273289 - DNA, 23 bp, Homo sapiens
atgtacagagaactaacactatt

SEQ ID NO: 5273290 - DNA, 12 bp, Homo sapiens
atgtacagatga

SEQ ID NO: 5273291 - DNA, 18 bp, Homo sapiens
atgtacagattctttcag

SEQ ID NO: 5273292 - DNA, 22 bp, Homo sapiens
atgtacagattttatttgtaat

SEQ ID NO: 5273293 - DNA, 13 bp, Homo sapiens
atgtacagcatgc

SEQ ID NO: 5273294 - DNA, 21 bp, Homo sapiens
atgtacagcattaaaatttta

SEQ ID NO: 5273295 - DNA, 20 bp, Homo sapiens
atgtacaggatgctttggtt

SEQ ID NO: 5273296 - DNA, 18 bp, Homo sapiens
atgtacagtctcaatttt

SEQ ID NO: 5273297 - DNA, 15 bp, Homo sapiens
atgtacagtctgtca

SEQ ID NO: 5273298 - DNA, 17 bp, Homo sapiens
atgtacagtctgtcatg

SEQ ID NO: 5273299 - DNA, 20 bp, Homo sapiens
atgtacagtgttctgtttaa

SEQ ID NO: 5273300 - DNA, 16 bp, Homo sapiens
atgtacagttgaaata

SEQ ID NO: 5273301 - DNA, 20 bp, Homo sapiens
atgtacagtttattgatatt

SEQ ID NO: 5273302 - DNA, 19 bp, Homo sapiens
atgtacatactgaaaaata

SEQ ID NO: 5273303 - DNA, 17 bp, Homo sapiens
atgtacatagaccctct

SEQ ID NO: 5273304 - DNA, 19 bp, Homo sapiens
atgtacatagtaaagtatt

SEQ ID NO: 5273305 - DNA, 15 bp, Homo sapiens
atgtacatagtgcta

SEQ ID NO: 5273306 - DNA, 17 bp, Homo sapiens
atgtacatagtgctaac

SEQ ID NO: 5273307 - DNA, 16 bp, Homo sapiens
atgtacatatggaaat

SEQ ID NO: 5273308 - DNA, 12 bp, Homo sapiens
atgtacatcttt

SEQ ID NO: 5273309 - DNA, 15 bp, Homo sapiens
atgtacatgaagcaa

SEQ ID NO: 5273310 - DNA, 13 bp, Homo sapiens
atgtacatgtatt

SEQ ID NO: 5273311 - DNA, 17 bp, Homo sapiens
atgtacatgtattaaat

SEQ ID NO: 5273312 - DNA, 13 bp, Homo sapiens
atgtacatgtgta

SEQ ID NO: 5273313 - DNA, 21 bp, Homo sapiens
atgtacatgttcctttgtaat

SEQ ID NO: 5273314 - DNA, 18 bp, Homo sapiens
atgtacattaaataccag

SEQ ID NO: 5273315 - DNA, 12 bp, Homo sapiens
atgtacattaca

SEQ ID NO: 5273316 - DNA, 22 bp, Homo sapiens
atgtacattggtctttctacat

SEQ ID NO: 5273317 - DNA, 19 bp, Homo sapiens
atgtacattgtacccaata

SEQ ID NO: 5273318 - DNA, 16 bp, Homo sapiens
atgtacatttattcat

SEQ ID NO: 5273319 - DNA, 19 bp, Homo sapiens
atgtacatttctgaaatga

SEQ ID NO: 5273320 - DNA, 17 bp, Homo sapiens
atgtacatttgaaaata

SEQ ID NO: 5273321 - DNA, 16 bp, Homo sapiens
atgtacatttgtcttt

SEQ ID NO: 5273322 - DNA, 20 bp, Homo sapiens
atgtaccaagtaaccatttc

SEQ ID NO: 5273323 - DNA, 18 bp, Homo sapiens
atgtaccagtgtactgct

SEQ ID NO: 5273324 - DNA, 22 bp, Homo sapiens
atgtaccagtgtactgctttca

SEQ ID NO: 5273325 - DNA, 17 bp, Homo sapiens
atgtaccatgttaaaga

SEQ ID NO: 5273326 - DNA, 15 bp, Homo sapiens
atgtaccatttgcat

SEQ ID NO: 5273327 - DNA, 14 bp, Homo sapiens
atgtacccagccta

SEQ ID NO: 5273328 - DNA, 16 bp, Homo sapiens
atgtaccccctttccc

SEQ ID NO: 5273329 - DNA, 19 bp, Homo sapiens
atgtaccccctttcccttc

SEQ ID NO: 5273330 - DNA, 23 bp, Homo sapiens
atgtaccctccccttttatgcac

SEQ ID NO: 5273331 - DNA, 16 bp, Homo sapiens
atgtaccgtaggcttt

SEQ ID NO: 5273332 - DNA, 22 bp, Homo sapiens
atgtacctaatccaaatatcat

SEQ ID NO: 5273333 - DNA, 21 bp, Homo sapiens
atgtacctatagaaatagaac

SEQ ID NO: 5273334 - DNA, 14 bp, Homo sapiens
atgtacctattcct

SEQ ID NO: 5273335 - DNA, 19 bp, Homo sapiens
atgtacctattccttcaga

SEQ ID NO: 5273336 - DNA, 14 bp, Homo sapiens
atgtacctcccctg

SEQ ID NO: 5273337 - DNA, 15 bp, Homo sapiens
atgtacctgagcata

SEQ ID NO: 5273338 - DNA, 21 bp, Homo sapiens
atgtaccttatttaaaagatt

SEQ ID NO: 5273339 - DNA, 15 bp, Homo sapiens
atgtaccttgaccat

SEQ ID NO: 5273340 - DNA, 16 bp, Homo sapiens
atgtacgataggtaga

SEQ ID NO: 5273341 - DNA, 20 bp, Homo sapiens
atgtacgataggtagaattg

SEQ ID NO: 5273342 - DNA, 18 bp, Homo sapiens
atgtacggattttcagtt

SEQ ID NO: 5273343 - DNA, 19 bp, Homo sapiens
atgtactacatttgcatgc

SEQ ID NO: 5273344 - DNA, 15 bp, Homo sapiens
atgtactagtactgt

SEQ ID NO: 5273345 - DNA, 18 bp, Homo sapiens
atgtactagtactgtgta

SEQ ID NO: 5273346 - DNA, 22 bp, Homo sapiens
atgtactagtactgtgtactgt

SEQ ID NO: 5273347 - DNA, 22 bp, Homo sapiens
atgtactagtgttctgtttgtt

SEQ ID NO: 5273348 - DNA, 21 bp, Homo sapiens
atgtactagttttagttttct

SEQ ID NO: 5273349 - DNA, 22 bp, Homo sapiens
atgtactcacatataacatgca

SEQ ID NO: 5273350 - DNA, 20 bp, Homo sapiens
atgtactcctctttacactg

SEQ ID NO: 5273351 - DNA, 19 bp, Homo sapiens
atgtactctacgccaaagt

SEQ ID NO: 5273352 - DNA, 20 bp, Homo sapiens
atgtactctacgccaaagtg

SEQ ID NO: 5273353 - DNA, 16 bp, Homo sapiens
atgtactctactgata

SEQ ID NO: 5273354 - DNA, 16 bp, Homo sapiens
atgtactgaattcttt

SEQ ID NO: 5273355 - DNA, 14 bp, Homo sapiens
atgtactgagacaa

SEQ ID NO: 5273356 - DNA, 18 bp, Homo sapiens
atgtactgagacaaaaag

SEQ ID NO: 5273357 - DNA, 23 bp, Homo sapiens
atgtactgagaggaggggtaaat

SEQ ID NO: 5273358 - DNA, 18 bp, Homo sapiens
atgtactgcaaagtcgcc

SEQ ID NO: 5273359 - DNA, 13 bp, Homo sapiens
atgtactgcatta

SEQ ID NO: 5273360 - DNA, 13 bp, Homo sapiens
atgtactgtaaac

SEQ ID NO: 5273361 - DNA, 15 bp, Homo sapiens
atgtactgtaaacag

SEQ ID NO: 5273362 - DNA, 18 bp, Homo sapiens
atgtactgtaaacagttc

SEQ ID NO: 5273363 - DNA, 19 bp, Homo sapiens
atgtactgtacataaattc

SEQ ID NO: 5273364 - DNA, 17 bp, Homo sapiens
atgtactgtactaattc

SEQ ID NO: 5273365 - DNA, 18 bp, Homo sapiens
atgtactgtactaattct

SEQ ID NO: 5273366 - DNA, 20 bp, Homo sapiens
atgtactgtactaattctta

SEQ ID NO: 5273367 - DNA, 19 bp, Homo sapiens
atgtactgtagtttttctt

SEQ ID NO: 5273368 - DNA, 13 bp, Homo sapiens
atgtactgtattg

SEQ ID NO: 5273369 - DNA, 17 bp, Homo sapiens
atgtactgttattgaaa

SEQ ID NO: 5273370 - DNA, 18 bp, Homo sapiens
atgtacttaagagtggca

SEQ ID NO: 5273371 - DNA, 19 bp, Homo sapiens
atgtacttagctgtactat

SEQ ID NO: 5273372 - DNA, 12 bp, Homo sapiens
atgtacttccct

SEQ ID NO: 5273373 - DNA, 19 bp, Homo sapiens
atgtacttccctcttgaaa

SEQ ID NO: 5273374 - DNA, 20 bp, Homo sapiens
atgtacttcctgtgtactct

SEQ ID NO: 5273375 - DNA, 16 bp, Homo sapiens
atgtacttgaaggatg

SEQ ID NO: 5273376 - DNA, 17 bp, Homo sapiens
atgtacttgaaggatgg

SEQ ID NO: 5273377 - DNA, 17 bp, Homo sapiens
atgtacttgtttgaata

SEQ ID NO: 5273378 - DNA, 23 bp, Homo sapiens
atgtacttgtttgaatatttgtt

SEQ ID NO: 5273379 - DNA, 17 bp, Homo sapiens
atgtacttgtttgctat

SEQ ID NO: 5273380 - DNA, 20 bp, Homo sapiens
attctgcttctagtattttt

SEQ ID NO: 5273381 - DNA, 17 bp, Homo sapiens
attctgcttgagaatat

SEQ ID NO: 5273382 - DNA, 12 bp, Homo sapiens
attctggaaatg

SEQ ID NO: 5273383 - DNA, 20 bp, Homo sapiens
attctggaactgtggctttg

SEQ ID NO: 5273384 - DNA, 22 bp, Homo sapiens
attctggacaggatgtgtttgc

SEQ ID NO: 5273385 - DNA, 23 bp, Homo sapiens
attctggagacagaaccagcaga

SEQ ID NO: 5273386 - DNA, 15 bp, Homo sapiens
attctggaggaagaa

SEQ ID NO: 5273387 - DNA, 18 bp, Homo sapiens
attctggaggaagaagac

SEQ ID NO: 5273388 - DNA, 16 bp, Homo sapiens
attctggatctgaccc

SEQ ID NO: 5273389 - DNA, 19 bp, Homo sapiens
attctggatctgaccctcc

SEQ ID NO: 5273390 - DNA, 23 bp, Homo sapiens
attctggatctgaccctcccagt

SEQ ID NO: 5273391 - DNA, 17 bp, Homo sapiens
attctggatggccgggc

SEQ ID NO: 5273392 - DNA, 22 bp, Homo sapiens
attctggattataaaaatgaat

SEQ ID NO: 5273393 - DNA, 19 bp, Homo sapiens
attctggattcacagacca

SEQ ID NO: 5273394 - DNA, 21 bp, Homo sapiens
attctggattttgtcaagcag

SEQ ID NO: 5273395 - DNA, 18 bp, Homo sapiens
attctggcactttaatga

SEQ ID NO: 5273396 - DNA, 21 bp, Homo sapiens
attctggcactttaatgataa

SEQ ID NO: 5273397 - DNA, 14 bp, Homo sapiens
attctggccagact

SEQ ID NO: 5273398 - DNA, 17 bp, Homo sapiens
attctggcctagtccct

SEQ ID NO: 5273399 - DNA, 22 bp, Homo sapiens
attctggcggagatgggtcctg

SEQ ID NO: 5273400 - DNA, 13 bp, Homo sapiens
attctggctccac

SEQ ID NO: 5273401 - DNA, 22 bp, Homo sapiens
attctggctgcaagggccagag

SEQ ID NO: 5273402 - DNA, 18 bp, Homo sapiens
attctgggaaaggtgctc

SEQ ID NO: 5273403 - DNA, 22 bp, Homo sapiens
attctgggaaaggtgctcaaag

SEQ ID NO: 5273404 - DNA, 23 bp, Homo sapiens
attctgggaaaggtgctcaaaga

SEQ ID NO: 5273405 - DNA, 21 bp, Homo sapiens
attctgggaagcttgagcctc

SEQ ID NO: 5273406 - DNA, 19 bp, Homo sapiens
attctgggaatcatgtcca

SEQ ID NO: 5273407 - DNA, 21 bp, Homo sapiens
attctgggaatcatgtccatc

SEQ ID NO: 5273408 - DNA, 16 bp, Homo sapiens
attctgggaatgtata

SEQ ID NO: 5273409 - DNA, 17 bp, Homo sapiens
attctgggaatgtatag

SEQ ID NO: 5273410 - DNA, 21 bp, Homo sapiens
attctgggaggcaagaaaagg

SEQ ID NO: 5273411 - DNA, 22 bp, Homo sapiens
attctgggaggcaagaaaagga

SEQ ID NO: 5273412 - DNA, 18 bp, Homo sapiens
attctgggaggcttcagt

SEQ ID NO: 5273413 - DNA, 22 bp, Homo sapiens
attctgggatggaccctcgcag

SEQ ID NO: 5273414 - DNA, 16 bp, Homo sapiens
attctgggcaaataga

SEQ ID NO: 5273415 - DNA, 24 bp, Homo sapiens
attctgggcaccacaaaatataca

SEQ ID NO: 5273416 - DNA, 22 bp, Homo sapiens
attctggggaaacaacatttat

SEQ ID NO: 5273417 - DNA, 16 bp, Homo sapiens
attctgggggctgcag

SEQ ID NO: 5273418 - DNA, 17 bp, Homo sapiens
attctgggggctgcagt

SEQ ID NO: 5273419 - DNA, 16 bp, Homo sapiens
attctgggtattctat

SEQ ID NO: 5273420 - DNA, 18 bp, Homo sapiens
attctgggtgtgttctta

SEQ ID NO: 5273421 - DNA, 21 bp, Homo sapiens
attctgggtttgcccagtcct

SEQ ID NO: 5273422 - DNA, 23 bp, Homo sapiens
attctggtagggatatggcagga

SEQ ID NO: 5273423 - DNA, 16 bp, Homo sapiens
attctggtatacattg

SEQ ID NO: 5273424 - DNA, 17 bp, Homo sapiens
attctggtcacattcca

SEQ ID NO: 5273425 - DNA, 15 bp, Homo sapiens
attctggtctctcta

SEQ ID NO: 5273426 - DNA, 18 bp, Homo sapiens
attctggtgaccagactt

SEQ ID NO: 5273427 - DNA, 19 bp, Homo sapiens
attctggtgaccagacttt

SEQ ID NO: 5273428 - DNA, 23 bp, Homo sapiens
attctggtgaccagacttttgct

SEQ ID NO: 5273429 - DNA, 19 bp, Homo sapiens
attctggttccctgctgcg

SEQ ID NO: 5273430 - DNA, 21 bp, Homo sapiens
attctggttccctgctgcgct

SEQ ID NO: 5273431 - DNA, 12 bp, Homo sapiens
attctgtaaatg

SEQ ID NO: 5273432 - DNA, 15 bp, Homo sapiens
attctgtacattttt

SEQ ID NO: 5273433 - DNA, 17 bp, Homo sapiens
attctgtagattctgtg

SEQ ID NO: 5273434 - DNA, 17 bp, Homo sapiens
attctgtagttgcagct

SEQ ID NO: 5273435 - DNA, 11 bp, Homo sapiens
attctgtatag

SEQ ID NO: 5273436 - DNA, 15 bp, Homo sapiens
attctgtatccttaa

SEQ ID NO: 5273437 - DNA, 16 bp, Homo sapiens
attctgtcactcaaga

SEQ ID NO: 5273438 - DNA, 17 bp, Homo sapiens
attctgtcccccacgtg

SEQ ID NO: 5273439 - DNA, 18 bp, Homo sapiens
attctgtccctgtccctg

SEQ ID NO: 5273440 - DNA, 19 bp, Homo sapiens
attctgtcgccttagcatg

SEQ ID NO: 5273441 - DNA, 21 bp, Homo sapiens
attctgtcgccttagcatgtt

SEQ ID NO: 5273442 - DNA, 15 bp, Homo sapiens
attctgtcttgttca

SEQ ID NO: 5273443 - DNA, 23 bp, Homo sapiens
attctgtcttgttcattttgagt

SEQ ID NO: 5273444 - DNA, 14 bp, Homo sapiens
attctgtctttcaa

SEQ ID NO: 5273445 - DNA, 22 bp, Homo sapiens
attctgtgacatgctaattatt

SEQ ID NO: 5273446 - DNA, 11 bp, Homo sapiens
attctgtgacc

SEQ ID NO: 5273447 - DNA, 20 bp, Homo sapiens
attctgtgatcttttaaagt

SEQ ID NO: 5273448 - DNA, 16 bp, Homo sapiens
attctgtgcaggctgc

SEQ ID NO: 5273449 - DNA, 20 bp, Homo sapiens
attctgtgcctccaggacca

SEQ ID NO: 5273450 - DNA, 21 bp, Homo sapiens
attctgtgcctccaggaccag

SEQ ID NO: 5273451 - DNA, 16 bp, Homo sapiens
attctgtggattctat

SEQ ID NO: 5273452 - DNA, 17 bp, Homo sapiens
attctgtggattctata

SEQ ID NO: 5273453 - DNA, 18 bp, Homo sapiens
attctgtggattctatat

SEQ ID NO: 5273454 - DNA, 17 bp, Homo sapiens
attctgtgtattaacat

SEQ ID NO: 5273455 - DNA, 10 bp, Homo sapiens
attctgtgtc

SEQ ID NO: 5273456 - DNA, 20 bp, Homo sapiens
attctgtgtgtgactctggg

SEQ ID NO: 5273457 - DNA, 11 bp, Homo sapiens
attctgtgtta

SEQ ID NO: 5273458 - DNA, 22 bp, Homo sapiens
attctgtgttgaacacaattga

SEQ ID NO: 5273459 - DNA, 17 bp, Homo sapiens
attctgtgttttatcta

SEQ ID NO: 5273460 - DNA, 14 bp, Homo sapiens
attctgtgttttca

SEQ ID NO: 5273461 - DNA, 22 bp, Homo sapiens
attctgtgttttcagactgcct

SEQ ID NO: 5273462 - DNA, 19 bp, Homo sapiens
attctgttaaaaaaataaa

SEQ ID NO: 5273463 - DNA, 19 bp, Homo sapiens
attctgttaaaatcaggat

SEQ ID NO: 5273464 - DNA, 20 bp, Homo sapiens
attctgttaaaatctattct

SEQ ID NO: 5273465 - DNA, 18 bp, Homo sapiens
attctgttactttgctat

SEQ ID NO: 5273466 - DNA, 19 bp, Homo sapiens
attctgttagctgctcact

SEQ ID NO: 5273467 - DNA, 22 bp, Homo sapiens
attctgttagctgctcacttaa

SEQ ID NO: 5273468 - DNA, 13 bp, Homo sapiens
attctgttatatg

SEQ ID NO: 5273469 - DNA, 15 bp, Homo sapiens
attctgttatctcag

SEQ ID NO: 5273470 - DNA, 19 bp, Homo sapiens
attctgttctgcaactcca

SEQ ID NO: 5273471 - DNA, 20 bp, Homo sapiens
attctgttgcccaggctggc

SEQ ID NO: 5273472 - DNA, 22 bp, Homo sapiens
attctgttgcccaggctggcct

SEQ ID NO: 5273473 - DNA, 23 bp, Homo sapiens
attctgttgcccaggctggcctg

SEQ ID NO: 5273474 - DNA, 15 bp, Homo sapiens
attctgttgctttac

SEQ ID NO: 5273475 - DNA, 13 bp, Homo sapiens
attctgttggaag

SEQ ID NO: 5273476 - DNA, 14 bp, Homo sapiens
attctgttggccag

SEQ ID NO: 5273477 - DNA, 21 bp, Homo sapiens
attctgttggccagtgtgaca

SEQ ID NO: 5273478 - DNA, 21 bp, Homo sapiens
attctgttgggcaacaattgt

SEQ ID NO: 5273479 - DNA, 14 bp, Homo sapiens
attctgttgtgttc

SEQ ID NO: 5273480 - DNA, 22 bp, Homo sapiens
attctgttgttcagtcctctgc

SEQ ID NO: 5273481 - DNA, 14 bp, Homo sapiens
attctgttgttcca

SEQ ID NO: 5273482 - DNA, 20 bp, Homo sapiens
attctgttgttccattttat

SEQ ID NO: 5273483 - DNA, 21 bp, Homo sapiens
attctgtttattcttccagaa

SEQ ID NO: 5273484 - DNA, 15 bp, Homo sapiens
attctgtttcctctt

SEQ ID NO: 5273485 - DNA, 17 bp, Homo sapiens
attctgttttcccccag

SEQ ID NO: 5273486 - DNA, 17 bp, Homo sapiens
attctgttttgtaaatg

SEQ ID NO: 5273487 - DNA, 22 bp, Homo sapiens
attctgttttgttaatataccc

SEQ ID NO: 5273488 - DNA, 15 bp, Homo sapiens
attcttaaaaaaaga

SEQ ID NO: 5273489 - DNA, 13 bp, Homo sapiens
attcttaaaacta

SEQ ID NO: 5273490 - DNA, 18 bp, Homo sapiens
attcttaaaactataaca

SEQ ID NO: 5273491 - DNA, 19 bp, Homo sapiens
attcttaaaactataacat

SEQ ID NO: 5273492 - DNA, 23 bp, Homo sapiens
attcttaaaactttctaaatgca

SEQ ID NO: 5273493 - DNA, 23 bp, Homo sapiens
attcttaaaaggcccatagcagc

SEQ ID NO: 5273494 - DNA, 22 bp, Homo sapiens
attcttaaaatgcaatatttgt

SEQ ID NO: 5273495 - DNA, 15 bp, Homo sapiens
attcttaaagttgaa

SEQ ID NO: 5273496 - DNA, 20 bp, Homo sapiens
attcttaaagttgaatttat

SEQ ID NO: 5273497 - DNA, 16 bp, Homo sapiens
attcttaacaaactct

SEQ ID NO: 5273498 - DNA, 17 bp, Homo sapiens
attcttaacaagatatt

SEQ ID NO: 5273499 - DNA, 15 bp, Homo sapiens
attcttaaccatgga

SEQ ID NO: 5273500 - DNA, 21 bp, Homo sapiens
attcttaacttattacctcag

SEQ ID NO: 5273501 - DNA, 21 bp, Homo sapiens
attcttaagacttgcatttaa

SEQ ID NO: 5273502 - DNA, 13 bp, Homo sapiens
attcttaagcact

SEQ ID NO: 5273503 - DNA, 22 bp, Homo sapiens
attcttaagggaacttccacat

SEQ ID NO: 5273504 - DNA, 15 bp, Homo sapiens
attcttaatttatgt

SEQ ID NO: 5273505 - DNA, 16 bp, Homo sapiens
attcttacaaacatgt

SEQ ID NO: 5273506 - DNA, 21 bp, Homo sapiens
attcttacaaacatgtggtta

SEQ ID NO: 5273507 - DNA, 18 bp, Homo sapiens
attcttacaattgcactg

SEQ ID NO: 5273508 - DNA, 19 bp, Homo sapiens
attcttacaattgcactgc

SEQ ID NO: 5273509 - DNA, 19 bp, Homo sapiens
attcttacactgcctgtat

SEQ ID NO: 5273510 - DNA, 20 bp, Homo sapiens
attcttacactgcctgtata

SEQ ID NO: 5273511 - DNA, 22 bp, Homo sapiens
attcttacactgcctgtatact

SEQ ID NO: 5273512 - DNA, 15 bp, Homo sapiens
attcttacatgtttt

SEQ ID NO: 5273513 - DNA, 18 bp, Homo sapiens
attcttaccgaaatgaaa

SEQ ID NO: 5273514 - DNA, 18 bp, Homo sapiens
attcttaccgagaaaagg

SEQ ID NO: 5273515 - DNA, 18 bp, Homo sapiens
attcttacctcatttgca

SEQ ID NO: 5273516 - DNA, 21 bp, Homo sapiens
attcttactcggcatcctcca

SEQ ID NO: 5273517 - DNA, 20 bp, Homo sapiens
attcttactgttaaccaaat

SEQ ID NO: 5273518 - DNA, 17 bp, Homo sapiens
attcttactgttctgaa

SEQ ID NO: 5273519 - DNA, 23 bp, Homo sapiens
attcttagatacactaaaaatct

SEQ ID NO: 5273520 - DNA, 14 bp, Homo sapiens
attcttagcaaaaa

SEQ ID NO: 5273521 - DNA, 16 bp, Homo sapiens
attcttagcaaaaaat

SEQ ID NO: 5273522 - DNA, 17 bp, Homo sapiens
attcttagcctgtggca

SEQ ID NO: 5273523 - DNA, 13 bp, Homo sapiens
attcttaggcaga

SEQ ID NO: 5273524 - DNA, 17 bp, Homo sapiens
attcttaggctttcagt

SEQ ID NO: 5273525 - DNA, 16 bp, Homo sapiens
attcttataaatatga

SEQ ID NO: 5273526 - DNA, 17 bp, Homo sapiens
attcttataacattgta

SEQ ID NO: 5273527 - DNA, 18 bp, Homo sapiens
attcttataacattgtat

SEQ ID NO: 5273528 - DNA, 17 bp, Homo sapiens
attcttatattttatca

SEQ ID NO: 5273529 - DNA, 19 bp, Homo sapiens
attcttatattttatcaag

SEQ ID NO: 5273530 - DNA, 22 bp, Homo sapiens
attcttatgtagcaggaaataa

SEQ ID NO: 5273531 - DNA, 14 bp, Homo sapiens
attcttatgttatc

SEQ ID NO: 5273532 - DNA, 17 bp, Homo sapiens
attcttatgttgaatat

SEQ ID NO: 5273533 - DNA, 14 bp, Homo sapiens
attcttattaattc

SEQ ID NO: 5273534 - DNA, 13 bp, Homo sapiens
attcttattacta

SEQ ID NO: 5273535 - DNA, 21 bp, Homo sapiens
attcttattccatattagaaa

SEQ ID NO: 5273536 - DNA, 21 bp, Homo sapiens
attcttattgacaattgtgta

SEQ ID NO: 5273537 - DNA, 13 bp, Homo sapiens
attcttatttaat

SEQ ID NO: 5273538 - DNA, 13 bp, Homo sapiens
attcttatttccc

SEQ ID NO: 5273539 - DNA, 23 bp, Homo sapiens
attcttatttcccctttccaatt

SEQ ID NO: 5273540 - DNA, 15 bp, Homo sapiens
attcttattttgtgg

SEQ ID NO: 5273541 - DNA, 16 bp, Homo sapiens
attcttatttttccta

SEQ ID NO: 5273542 - DNA, 18 bp, Homo sapiens
attcttcaagatcccatt

SEQ ID NO: 5273543 - DNA, 17 bp, Homo sapiens
attcttcacctgttatg

SEQ ID NO: 5273544 - DNA, 16 bp, Homo sapiens
attcttcacctttgta

SEQ ID NO: 5273545 - DNA, 17 bp, Homo sapiens
attcttcacctttgtaa

SEQ ID NO: 5273546 - DNA, 17 bp, Homo sapiens
attcttcacgcagagat

SEQ ID NO: 5273547 - DNA, 22 bp, Homo sapiens
attcttcaggcttcctgcaatt

SEQ ID NO: 5273548 - DNA, 17 bp, Homo sapiens
attcttcagtgtctctg

SEQ ID NO: 5273549 - DNA, 19 bp, Homo sapiens
attcttcagtttttcactt

SEQ ID NO: 5273550 - DNA, 21 bp, Homo sapiens
attcttccaagctgagagtct

SEQ ID NO: 5273551 - DNA, 16 bp, Homo sapiens
attcttccagaatgct

SEQ ID NO: 5273552 - DNA, 17 bp, Homo sapiens
attcttccatcatcact

SEQ ID NO: 5273553 - DNA, 22 bp, Homo sapiens
attcttccatcatcactgtaaa

SEQ ID NO: 5273554 - DNA, 14 bp, Homo sapiens
attcttccatctga

SEQ ID NO: 5273555 - DNA, 22 bp, Homo sapiens
attcttcccattctccatttgt

SEQ ID NO: 5273556 - DNA, 13 bp, Homo sapiens
atgtactttatat

SEQ ID NO: 5273557 - DNA, 20 bp, Homo sapiens
atgtactttatattttctat

SEQ ID NO: 5273558 - DNA, 20 bp, Homo sapiens
atgtacttttattttacaca

SEQ ID NO: 5273559 - DNA, 22 bp, Homo sapiens
atgtacttttattttacacaga

SEQ ID NO: 5273560 - DNA, 20 bp, Homo sapiens
atgtactttttattgcatgg

SEQ ID NO: 5273561 - DNA, 21 bp, Homo sapiens
atgtactttttattgcatggt

SEQ ID NO: 5273562 - DNA, 21 bp, Homo sapiens
atgtagaaaagagacttctct

SEQ ID NO: 5273563 - DNA, 14 bp, Homo sapiens
atgtagaaaatttg

SEQ ID NO: 5273564 - DNA, 16 bp, Homo sapiens
atgtagaaacatttag

SEQ ID NO: 5273565 - DNA, 12 bp, Homo sapiens
atgtagaaactg

SEQ ID NO: 5273566 - DNA, 13 bp, Homo sapiens
atgtagaaactta

SEQ ID NO: 5273567 - DNA, 17 bp, Homo sapiens
atgtagaaagatacact

SEQ ID NO: 5273568 - DNA, 22 bp, Homo sapiens
atgtagaaagatacactgactt

SEQ ID NO: 5273569 - DNA, 23 bp, Homo sapiens
atgtagaaatattataaatccaa

SEQ ID NO: 5273570 - DNA, 20 bp, Homo sapiens
atgtagaaatgtttcataca

SEQ ID NO: 5273571 - DNA, 14 bp, Homo sapiens
atgtagaaattctt

SEQ ID NO: 5273572 - DNA, 22 bp, Homo sapiens
atgtagaacaagaaatctttct

SEQ ID NO: 5273573 - DNA, 17 bp, Homo sapiens
atgtagaactgttcatt

SEQ ID NO: 5273574 - DNA, 23 bp, Homo sapiens
atgtagaacttcaagaagtaaga

SEQ ID NO: 5273575 - DNA, 18 bp, Homo sapiens
atgtagaagaaagcaaaa

SEQ ID NO: 5273576 - DNA, 20 bp, Homo sapiens
atgtagaagaaagcaaaaaa

SEQ ID NO: 5273577 - DNA, 12 bp, Homo sapiens
atgtagaagagg

SEQ ID NO: 5273578 - DNA, 16 bp, Homo sapiens
atgtagaagagggaga

SEQ ID NO: 5273579 - DNA, 19 bp, Homo sapiens
atgtagaagagggagaagg

SEQ ID NO: 5273580 - DNA, 20 bp, Homo sapiens
atgtagaagagggagaagga

SEQ ID NO: 5273581 - DNA, 18 bp, Homo sapiens
atgtagaataaatgaaga

SEQ ID NO: 5273582 - DNA, 11 bp, Homo sapiens
atgtagaatga

SEQ ID NO: 5273583 - DNA, 16 bp, Homo sapiens
atgtagacaaaactta

SEQ ID NO: 5273584 - DNA, 23 bp, Homo sapiens
atgtagacaaaacttataatttc

SEQ ID NO: 5273585 - DNA, 17 bp, Homo sapiens
atgtagacagactttgt

SEQ ID NO: 5273586 - DNA, 18 bp, Homo sapiens
atgtagacagatatttca

SEQ ID NO: 5273587 - DNA, 20 bp, Homo sapiens
atgtagactatatacatgtg

SEQ ID NO: 5273588 - DNA, 21 bp, Homo sapiens
atgtagactatatacatgtgt

SEQ ID NO: 5273589 - DNA, 13 bp, Homo sapiens
atgtagactctga

SEQ ID NO: 5273590 - DNA, 19 bp, Homo sapiens
atgtagagagaacaggtgg

SEQ ID NO: 5273591 - DNA, 12 bp, Homo sapiens
atgtagaggaga

SEQ ID NO: 5273592 - DNA, 18 bp, Homo sapiens
atgtagataaactcagaa

SEQ ID NO: 5273593 - DNA, 16 bp, Homo sapiens
atgtagataaagcact

SEQ ID NO: 5273594 - DNA, 22 bp, Homo sapiens
atgtagatacagatccgcatgt

SEQ ID NO: 5273595 - DNA, 14 bp, Homo sapiens
atgtagatataaat

SEQ ID NO: 5273596 - DNA, 23 bp, Homo sapiens
atgtagatattgtgaagtacata

SEQ ID NO: 5273597 - DNA, 13 bp, Homo sapiens
atgtagatatttg

SEQ ID NO: 5273598 - DNA, 16 bp, Homo sapiens
atgtagatatttgaaa

SEQ ID NO: 5273599 - DNA, 18 bp, Homo sapiens
atgtagatgggcattttt

SEQ ID NO: 5273600 - DNA, 17 bp, Homo sapiens
atgtagatgtatgcaca

SEQ ID NO: 5273601 - DNA, 22 bp, Homo sapiens
atgtagatgtatgcacacacat

SEQ ID NO: 5273602 - DNA, 17 bp, Homo sapiens
atgtagatgtgcatttt

SEQ ID NO: 5273603 - DNA, 20 bp, Homo sapiens
atgtagatttgtacaggagt

SEQ ID NO: 5273604 - DNA, 21 bp, Homo sapiens
atgtagcaatcagattttcct

SEQ ID NO: 5273605 - DNA, 16 bp, Homo sapiens
atgtagcacataaact

SEQ ID NO: 5273606 - DNA, 20 bp, Homo sapiens
atgtagcactactacagaaa

SEQ ID NO: 5273607 - DNA, 19 bp, Homo sapiens
atgtagcagcagcctactg

SEQ ID NO: 5273608 - DNA, 21 bp, Homo sapiens
atgtagcagcagcctactgag

SEQ ID NO: 5273609 - DNA, 14 bp, Homo sapiens
atgtagcatataaa

SEQ ID NO: 5273610 - DNA, 16 bp, Homo sapiens
atgtagcattaaatat

SEQ ID NO: 5273611 - DNA, 18 bp, Homo sapiens
atgtagcattaaatataa

SEQ ID NO: 5273612 - DNA, 22 bp, Homo sapiens
atgtagcattaaatataaaata

SEQ ID NO: 5273613 - DNA, 14 bp, Homo sapiens
atgtagcattgttc

SEQ ID NO: 5273614 - DNA, 19 bp, Homo sapiens
atgtagccagcagaactga

SEQ ID NO: 5273615 - DNA, 23 bp, Homo sapiens
atgtagccccctggcctctgtgc

SEQ ID NO: 5273616 - DNA, 16 bp, Homo sapiens
atgtagcccggccagg

SEQ ID NO: 5273617 - DNA, 17 bp, Homo sapiens
atgtagcccggccaggg

SEQ ID NO: 5273618 - DNA, 16 bp, Homo sapiens
atgtagcctttactgt

SEQ ID NO: 5273619 - DNA, 15 bp, Homo sapiens
atgtagcgacagcat

SEQ ID NO: 5273620 - DNA, 17 bp, Homo sapiens
atgtagcgacagcattt

SEQ ID NO: 5273621 - DNA, 13 bp, Homo sapiens
atgtagcgtgttt

SEQ ID NO: 5273622 - DNA, 22 bp, Homo sapiens
atgtagcgtgtttacatgtgta

SEQ ID NO: 5273623 - DNA, 17 bp, Homo sapiens
atgtagctaaacattgt

SEQ ID NO: 5273624 - DNA, 22 bp, Homo sapiens
atgtagctctgcatctcctgtc

SEQ ID NO: 5273625 - DNA, 15 bp, Homo sapiens
atgtagctgaaaata

SEQ ID NO: 5273626 - DNA, 19 bp, Homo sapiens
atgtagctgaaacaaaaat

SEQ ID NO: 5273627 - DNA, 14 bp, Homo sapiens
atgtagctggtttc

SEQ ID NO: 5273628 - DNA, 15 bp, Homo sapiens
atgtagctggtttcc

SEQ ID NO: 5273629 - DNA, 20 bp, Homo sapiens
atgtagcttcagtcattaaa

SEQ ID NO: 5273630 - DNA, 11 bp, Homo sapiens
atgtagcttcc

SEQ ID NO: 5273631 - DNA, 17 bp, Homo sapiens
atgtagcttccacctca

SEQ ID NO: 5273632 - DNA, 19 bp, Homo sapiens
atgtagcttttatgtgata

SEQ ID NO: 5273633 - DNA, 12 bp, Homo sapiens
atgtagcttttg

SEQ ID NO: 5273634 - DNA, 16 bp, Homo sapiens
atgtaggactgtatag

SEQ ID NO: 5273635 - DNA, 22 bp, Homo sapiens
atgtaggatgacaggctctcct

SEQ ID NO: 5273636 - DNA, 17 bp, Homo sapiens
atgtaggcacttttatt

SEQ ID NO: 5273637 - DNA, 22 bp, Homo sapiens
atgtaggctggctttcagagta

SEQ ID NO: 5273638 - DNA, 14 bp, Homo sapiens
atgtagggcaagag

SEQ ID NO: 5273639 - DNA, 19 bp, Homo sapiens
atgtagggcagaatagctg

SEQ ID NO: 5273640 - DNA, 22 bp, Homo sapiens
atgtagggcagaatagctgata

SEQ ID NO: 5273641 - DNA, 19 bp, Homo sapiens
atgtaggggaagagatgtt

SEQ ID NO: 5273642 - DNA, 20 bp, Homo sapiens
atgtaggggaagagatgttt

SEQ ID NO: 5273643 - DNA, 23 bp, Homo sapiens
atgtaggggaagagatgtttaca

SEQ ID NO: 5273644 - DNA, 23 bp, Homo sapiens
atgtaggggttaacttggtcaga

SEQ ID NO: 5273645 - DNA, 18 bp, Homo sapiens
atgtagggtaaggtgcct

SEQ ID NO: 5273646 - DNA, 14 bp, Homo sapiens
atgtaggtaaattc

SEQ ID NO: 5273647 - DNA, 20 bp, Homo sapiens
atgtaggtaagactgtagat

SEQ ID NO: 5273648 - DNA, 17 bp, Homo sapiens
atgtaggtatgaataag

SEQ ID NO: 5273649 - DNA, 21 bp, Homo sapiens
atgtaggtcctcagaaagtgt

SEQ ID NO: 5273650 - DNA, 12 bp, Homo sapiens
atgtagtaacac

SEQ ID NO: 5273651 - DNA, 14 bp, Homo sapiens
atgtagtaacacta

SEQ ID NO: 5273652 - DNA, 16 bp, Homo sapiens
atgtagtaacactaat

SEQ ID NO: 5273653 - DNA, 17 bp, Homo sapiens
atgtagtaacactaata

SEQ ID NO: 5273654 - DNA, 22 bp, Homo sapiens
atgtagtaacactaatatattt

SEQ ID NO: 5273655 - DNA, 16 bp, Homo sapiens
atgtagtaattgacat

SEQ ID NO: 5273656 - DNA, 19 bp, Homo sapiens
atgtagtataaagaaaagt

SEQ ID NO: 5273657 - DNA, 21 bp, Homo sapiens
atgtagtatcaaatattagat

SEQ ID NO: 5273658 - DNA, 19 bp, Homo sapiens
atgtagtatctatatgact

SEQ ID NO: 5273659 - DNA, 23 bp, Homo sapiens
atgtagtatggcctgacagctct

SEQ ID NO: 5273660 - DNA, 16 bp, Homo sapiens
atgtagtatggtatat

SEQ ID NO: 5273661 - DNA, 18 bp, Homo sapiens
atgtagtatggtatatgc

SEQ ID NO: 5273662 - DNA, 18 bp, Homo sapiens
atgtagtattcaatgatt

SEQ ID NO: 5273663 - DNA, 22 bp, Homo sapiens
atgtagtattttttgtataatt

SEQ ID NO: 5273664 - DNA, 19 bp, Homo sapiens
atgtagtcagactgacact

SEQ ID NO: 5273665 - DNA, 14 bp, Homo sapiens
atgtagtcataata

SEQ ID NO: 5273666 - DNA, 15 bp, Homo sapiens
atgtagtcataataa

SEQ ID NO: 5273667 - DNA, 13 bp, Homo sapiens
atgtagtctgtag

SEQ ID NO: 5273668 - DNA, 16 bp, Homo sapiens
atgtagtgcctctttc

SEQ ID NO: 5273669 - DNA, 17 bp, Homo sapiens
atgtagtggttttagga

SEQ ID NO: 5273670 - DNA, 17 bp, Homo sapiens
atgtagttctgctccag

SEQ ID NO: 5273671 - DNA, 18 bp, Homo sapiens
atgtagttgatgtatcca

SEQ ID NO: 5273672 - DNA, 15 bp, Homo sapiens
atgtagtttgaggaa

SEQ ID NO: 5273673 - DNA, 23 bp, Homo sapiens
atgtagtttgaggaaatttgcag

SEQ ID NO: 5273674 - DNA, 17 bp, Homo sapiens
atgtagttttaacagaa

SEQ ID NO: 5273675 - DNA, 19 bp, Homo sapiens
atgtagttttcttttttaa

SEQ ID NO: 5273676 - DNA, 15 bp, Homo sapiens
atgtagttttgtata

SEQ ID NO: 5273677 - DNA, 22 bp, Homo sapiens
atgtagttttgtgatgcatttt

SEQ ID NO: 5273678 - DNA, 20 bp, Homo sapiens
atgtagtttttatatgttgt

SEQ ID NO: 5273679 - DNA, 21 bp, Homo sapiens
atgtagtttttatatgttgta

SEQ ID NO: 5273680 - DNA, 22 bp, Homo sapiens
atgtataaaacttgataaatgg

SEQ ID NO: 5273681 - DNA, 14 bp, Homo sapiens
atgtataaaataca

SEQ ID NO: 5273682 - DNA, 20 bp, Homo sapiens
atgtataaaatacatagtga

SEQ ID NO: 5273683 - DNA, 22 bp, Homo sapiens
atgtataaaatgtaacactgat

SEQ ID NO: 5273684 - DNA, 13 bp, Homo sapiens
atgtataaagatt

SEQ ID NO: 5273685 - DNA, 19 bp, Homo sapiens
atgtataaagtgattgact

SEQ ID NO: 5273686 - DNA, 16 bp, Homo sapiens
atgtataaatatacag

SEQ ID NO: 5273687 - DNA, 14 bp, Homo sapiens
atgtataaattaat

SEQ ID NO: 5273688 - DNA, 16 bp, Homo sapiens
atgtataaattattca

SEQ ID NO: 5273689 - DNA, 23 bp, Homo sapiens
atgtataacaagccaaacattct

SEQ ID NO: 5273690 - DNA, 23 bp, Homo sapiens
atgtataaccaagtgtgctcttt

SEQ ID NO: 5273691 - DNA, 14 bp, Homo sapiens
atgtataatatttt

SEQ ID NO: 5273692 - DNA, 18 bp, Homo sapiens
atgtataatgacttttaa

SEQ ID NO: 5273693 - DNA, 19 bp, Homo sapiens
atgtataattaacttaact

SEQ ID NO: 5273694 - DNA, 20 bp, Homo sapiens
atgtatacaatgcactttta

SEQ ID NO: 5273695 - DNA, 18 bp, Homo sapiens
atgtatacacaaatatat

SEQ ID NO: 5273696 - DNA, 13 bp, Homo sapiens
atgtatacacaca

SEQ ID NO: 5273697 - DNA, 15 bp, Homo sapiens
atgtatacacacaca

SEQ ID NO: 5273698 - DNA, 15 bp, Homo sapiens
atgtatacacacata

SEQ ID NO: 5273699 - DNA, 23 bp, Homo sapiens
atgtatacatcttatagatgcaa

SEQ ID NO: 5273700 - DNA, 15 bp, Homo sapiens
atgtatactgccact

SEQ ID NO: 5273701 - DNA, 22 bp, Homo sapiens
atgtatacttaaaaataaagta

SEQ ID NO: 5273702 - DNA, 15 bp, Homo sapiens
atgtatacttatctt

SEQ ID NO: 5273703 - DNA, 18 bp, Homo sapiens
atgtatacttatcttgct

SEQ ID NO: 5273704 - DNA, 13 bp, Homo sapiens
atgtatacttgaa

SEQ ID NO: 5273705 - DNA, 19 bp, Homo sapiens
atgtatagaaaataaaata

SEQ ID NO: 5273706 - DNA, 13 bp, Homo sapiens
atgtatagcttta

SEQ ID NO: 5273707 - DNA, 19 bp, Homo sapiens
atgtatagctttaacattt

SEQ ID NO: 5273708 - DNA, 12 bp, Homo sapiens
atgtatagtaaa

SEQ ID NO: 5273709 - DNA, 17 bp, Homo sapiens
atgtatagtatttgaaa

SEQ ID NO: 5273710 - DNA, 18 bp, Homo sapiens
atgtatagtatttgaaaa

SEQ ID NO: 5273711 - DNA, 20 bp, Homo sapiens
atgtatagtatttgaaaaca

SEQ ID NO: 5273712 - DNA, 16 bp, Homo sapiens
atgtatagttttccct

SEQ ID NO: 5273713 - DNA, 13 bp, Homo sapiens
atgtatataaaaa

SEQ ID NO: 5273714 - DNA, 13 bp, Homo sapiens
atgtatataaaat

SEQ ID NO: 5273715 - DNA, 16 bp, Homo sapiens
atgtatataaaatgtg

SEQ ID NO: 5273716 - DNA, 18 bp, Homo sapiens
atgtatataaactgggat

SEQ ID NO: 5273717 - DNA, 21 bp, Homo sapiens
atgtatataatcatgctcatg

SEQ ID NO: 5273718 - DNA, 15 bp, Homo sapiens
atgtatatacacata

SEQ ID NO: 5273719 - DNA, 18 bp, Homo sapiens
atgtatatacacatatac

SEQ ID NO: 5273720 - DNA, 16 bp, Homo sapiens
atgtatatacacatcc

SEQ ID NO: 5273721 - DNA, 16 bp, Homo sapiens
atgtatatacatttat

SEQ ID NO: 5273722 - DNA, 21 bp, Homo sapiens
atgtatatactatacaacaat

SEQ ID NO: 5273723 - DNA, 19 bp, Homo sapiens
atgtatatatatatatgca

SEQ ID NO: 5273724 - DNA, 19 bp, Homo sapiens
atgtatatatatgtatgta

SEQ ID NO: 5273725 - DNA, 13 bp, Homo sapiens
atgtatatatatt

SEQ ID NO: 5273726 - DNA, 15 bp, Homo sapiens
atgtatatatattct

SEQ ID NO: 5273727 - DNA, 14 bp, Homo sapiens
atgtatatatgtat

SEQ ID NO: 5273728 - DNA, 17 bp, Homo sapiens
atgtatatatttagtgc

SEQ ID NO: 5273729 - DNA, 19 bp, Homo sapiens
atgtatatcattctacaga

SEQ ID NO: 5273730 - DNA, 21 bp, Homo sapiens
atgtatatcattctacagaat

SEQ ID NO: 5273731 - DNA, 20 bp, Homo sapiens
atgtatatccatataacaat

SEQ ID NO: 5273732 - DNA, 18 bp, Homo sapiens
atgtatatctgtgtaaga

SEQ ID NO: 5273733 - DNA, 21 bp, Homo sapiens
attcttccctatctttgccac

SEQ ID NO: 5273734 - DNA, 12 bp, Homo sapiens
attcttcctagt

SEQ ID NO: 5273735 - DNA, 19 bp, Homo sapiens
attcttcctagttttctcc

SEQ ID NO: 5273736 - DNA, 13 bp, Homo sapiens
attcttcctccct

SEQ ID NO: 5273737 - DNA, 14 bp, Homo sapiens
attcttcctcctct

SEQ ID NO: 5273738 - DNA, 15 bp, Homo sapiens
attcttcctcctctg

SEQ ID NO: 5273739 - DNA, 13 bp, Homo sapiens
attcttcctctcc

SEQ ID NO: 5273740 - DNA, 16 bp, Homo sapiens
attcttcctctccttc

SEQ ID NO: 5273741 - DNA, 21 bp, Homo sapiens
attcttcctctccttcccaca

SEQ ID NO: 5273742 - DNA, 23 bp, Homo sapiens
attcttccttccctccttttaaa

SEQ ID NO: 5273743 - DNA, 20 bp, Homo sapiens
attcttccttgagctaagca

SEQ ID NO: 5273744 - DNA, 15 bp, Homo sapiens
attcttccttgccac

SEQ ID NO: 5273745 - DNA, 21 bp, Homo sapiens
attcttccttttattaaaacc

SEQ ID NO: 5273746 - DNA, 18 bp, Homo sapiens
attcttcgcataaagaag

SEQ ID NO: 5273747 - DNA, 21 bp, Homo sapiens
attcttcgcataaagaagaag

SEQ ID NO: 5273748 - DNA, 21 bp, Homo sapiens
attcttcggaggaggtggaca

SEQ ID NO: 5273749 - DNA, 21 bp, Homo sapiens
attcttcggtctgaattttag

SEQ ID NO: 5273750 - DNA, 20 bp, Homo sapiens
attcttctaaaactactgcc

SEQ ID NO: 5273751 - DNA, 21 bp, Homo sapiens
attcttctaaaactactgcct

SEQ ID NO: 5273752 - DNA, 22 bp, Homo sapiens
attcttctaaagcactggtttc

SEQ ID NO: 5273753 - DNA, 15 bp, Homo sapiens
attcttctcctttgt

SEQ ID NO: 5273754 - DNA, 15 bp, Homo sapiens
attcttctctagctg

SEQ ID NO: 5273755 - DNA, 22 bp, Homo sapiens
attcttctcttgctttatacta

SEQ ID NO: 5273756 - DNA, 13 bp, Homo sapiens
attcttctcttgt

SEQ ID NO: 5273757 - DNA, 17 bp, Homo sapiens
attcttctgagcactgt

SEQ ID NO: 5273758 - DNA, 13 bp, Homo sapiens
attcttctgcaac

SEQ ID NO: 5273759 - DNA, 12 bp, Homo sapiens
attcttctgcct

SEQ ID NO: 5273760 - DNA, 14 bp, Homo sapiens
attcttctgcctca

SEQ ID NO: 5273761 - DNA, 11 bp, Homo sapiens
attcttctgct

SEQ ID NO: 5273762 - DNA, 20 bp, Homo sapiens
attcttctgcttcagcctcc

SEQ ID NO: 5273763 - DNA, 22 bp, Homo sapiens
attcttctggtgctactccatg

SEQ ID NO: 5273764 - DNA, 16 bp, Homo sapiens
attcttctgtatttct

SEQ ID NO: 5273765 - DNA, 17 bp, Homo sapiens
attcttctgtatttcta

SEQ ID NO: 5273766 - DNA, 22 bp, Homo sapiens
attcttctgtcaagcttactac

SEQ ID NO: 5273767 - DNA, 15 bp, Homo sapiens
attcttctgtgttta

SEQ ID NO: 5273768 - DNA, 19 bp, Homo sapiens
attcttctgtgtttataaa

SEQ ID NO: 5273769 - DNA, 16 bp, Homo sapiens
attcttctgttctctg

SEQ ID NO: 5273770 - DNA, 10 bp, Homo sapiens
attcttctta

SEQ ID NO: 5273771 - DNA, 13 bp, Homo sapiens
attcttcttgcta

SEQ ID NO: 5273772 - DNA, 14 bp, Homo sapiens
attcttctttgata

SEQ ID NO: 5273773 - DNA, 14 bp, Homo sapiens
attcttcttttctt

SEQ ID NO: 5273774 - DNA, 15 bp, Homo sapiens
attcttcttttgtgt

SEQ ID NO: 5273775 - DNA, 19 bp, Homo sapiens
attcttcttttttgtaaaa

SEQ ID NO: 5273776 - DNA, 11 bp, Homo sapiens
attcttgaaag

SEQ ID NO: 5273777 - DNA, 15 bp, Homo sapiens
attcttgaaggaaaa

SEQ ID NO: 5273778 - DNA, 19 bp, Homo sapiens
attcttgagaagtaactgt

SEQ ID NO: 5273779 - DNA, 16 bp, Homo sapiens
attcttgagacccaaa

SEQ ID NO: 5273780 - DNA, 17 bp, Homo sapiens
attcttgatcagtagtt

SEQ ID NO: 5273781 - DNA, 19 bp, Homo sapiens
attcttgatcagtagtttg

SEQ ID NO: 5273782 - DNA, 21 bp, Homo sapiens
attcttgatcagtagtttgca

SEQ ID NO: 5273783 - DNA, 19 bp, Homo sapiens
attcttgatgtaaaatctt

SEQ ID NO: 5273784 - DNA, 15 bp, Homo sapiens
attcttgattcctgg

SEQ ID NO: 5273785 - DNA, 17 bp, Homo sapiens
attcttgattcctggct

SEQ ID NO: 5273786 - DNA, 22 bp, Homo sapiens
attcttgatttatttgcttctt

SEQ ID NO: 5273787 - DNA, 16 bp, Homo sapiens
attcttgcactgtatc

SEQ ID NO: 5273788 - DNA, 17 bp, Homo sapiens
attcttgcactgtatcc

SEQ ID NO: 5273789 - DNA, 20 bp, Homo sapiens
attcttgcactgtatccaag

SEQ ID NO: 5273790 - DNA, 22 bp, Homo sapiens
attcttgccttgaggctctgca

SEQ ID NO: 5273791 - DNA, 21 bp, Homo sapiens
attcttgctgttaaaaataat

SEQ ID NO: 5273792 - DNA, 14 bp, Homo sapiens
attcttgcttgtgt

SEQ ID NO: 5273793 - DNA, 20 bp, Homo sapiens
attcttgctttcacaaatat

SEQ ID NO: 5273794 - DNA, 17 bp, Homo sapiens
attcttggaccatgcca

SEQ ID NO: 5273795 - DNA, 20 bp, Homo sapiens
attcttggaccatgccagat

SEQ ID NO: 5273796 - DNA, 14 bp, Homo sapiens
attcttggagaact

SEQ ID NO: 5273797 - DNA, 16 bp, Homo sapiens
attcttggagaacttt

SEQ ID NO: 5273798 - DNA, 13 bp, Homo sapiens
attcttgggagga

SEQ ID NO: 5273799 - DNA, 16 bp, Homo sapiens
attcttggttcttatt

SEQ ID NO: 5273800 - DNA, 17 bp, Homo sapiens
attcttggttgaggaaa

SEQ ID NO: 5273801 - DNA, 17 bp, Homo sapiens
attcttggttggctggc

SEQ ID NO: 5273802 - DNA, 20 bp, Homo sapiens
attcttggttggctggcctt

SEQ ID NO: 5273803 - DNA, 19 bp, Homo sapiens
attcttgtaaatctttttg

SEQ ID NO: 5273804 - DNA, 21 bp, Homo sapiens
attcttgtaaatctttttgct

SEQ ID NO: 5273805 - DNA, 18 bp, Homo sapiens
attcttgtaaggctttga

SEQ ID NO: 5273806 - DNA, 19 bp, Homo sapiens
attcttgtatttctagcat

SEQ ID NO: 5273807 - DNA, 17 bp, Homo sapiens
attcttgtgaatatgta

SEQ ID NO: 5273808 - DNA, 19 bp, Homo sapiens
attcttgtgattgactttt

SEQ ID NO: 5273809 - DNA, 18 bp, Homo sapiens
attcttgtgcttttcctg

SEQ ID NO: 5273810 - DNA, 21 bp, Homo sapiens
attcttgtgtcatcaagtagt

SEQ ID NO: 5273811 - DNA, 17 bp, Homo sapiens
attcttgttagaatctg

SEQ ID NO: 5273812 - DNA, 20 bp, Homo sapiens
attcttgttgctgtacaaaa

SEQ ID NO: 5273813 - DNA, 22 bp, Homo sapiens
attcttgttgctgtacaaaagc

SEQ ID NO: 5273814 - DNA, 22 bp, Homo sapiens
attcttgttggtagcatgtact

SEQ ID NO: 5273815 - DNA, 19 bp, Homo sapiens
attcttgtttgaattcctc

SEQ ID NO: 5273816 - DNA, 21 bp, Homo sapiens
attcttgtttgaattcctcct

SEQ ID NO: 5273817 - DNA, 16 bp, Homo sapiens
attcttgttttacatt

SEQ ID NO: 5273818 - DNA, 15 bp, Homo sapiens
attcttgttttgctt

SEQ ID NO: 5273819 - DNA, 16 bp, Homo sapiens
attcttgttttgcttc

SEQ ID NO: 5273820 - DNA, 14 bp, Homo sapiens
attctttaaactac

SEQ ID NO: 5273821 - DNA, 17 bp, Homo sapiens
attctttaaactactga

SEQ ID NO: 5273822 - DNA, 14 bp, Homo sapiens
attctttaaggaga

SEQ ID NO: 5273823 - DNA, 15 bp, Homo sapiens
attctttaatgattc

SEQ ID NO: 5273824 - DNA, 21 bp, Homo sapiens
attctttaattgttgctttta

SEQ ID NO: 5273825 - DNA, 19 bp, Homo sapiens
attctttacaaaatgaatg

SEQ ID NO: 5273826 - DNA, 15 bp, Homo sapiens
attctttagagaaga

SEQ ID NO: 5273827 - DNA, 21 bp, Homo sapiens
attctttagcttacctgggca

SEQ ID NO: 5273828 - DNA, 20 bp, Homo sapiens
attctttagtactcaatgtt

SEQ ID NO: 5273829 - DNA, 22 bp, Homo sapiens
attctttagtactcaatgtttc

SEQ ID NO: 5273830 - DNA, 16 bp, Homo sapiens
attctttataaaatgt

SEQ ID NO: 5273831 - DNA, 16 bp, Homo sapiens
attctttatagtgaag

SEQ ID NO: 5273832 - DNA, 15 bp, Homo sapiens
attctttatatctga

SEQ ID NO: 5273833 - DNA, 23 bp, Homo sapiens
attctttattatttttctctctc

SEQ ID NO: 5273834 - DNA, 19 bp, Homo sapiens
attctttcaataacgaagt

SEQ ID NO: 5273835 - DNA, 13 bp, Homo sapiens
attctttcaatac

SEQ ID NO: 5273836 - DNA, 22 bp, Homo sapiens
attctttcaatccacagtattg

SEQ ID NO: 5273837 - DNA, 23 bp, Homo sapiens
attctttcaatccacagtattgt

SEQ ID NO: 5273838 - DNA, 20 bp, Homo sapiens
attctttcaattctgtaggt

SEQ ID NO: 5273839 - DNA, 17 bp, Homo sapiens
attctttcagttctttg

SEQ ID NO: 5273840 - DNA, 15 bp, Homo sapiens
attctttccatgaca

SEQ ID NO: 5273841 - DNA, 14 bp, Homo sapiens
attctttccatgca

SEQ ID NO: 5273842 - DNA, 18 bp, Homo sapiens
attctttccatgcagtta

SEQ ID NO: 5273843 - DNA, 16 bp, Homo sapiens
attctttccattatga

SEQ ID NO: 5273844 - DNA, 19 bp, Homo sapiens
attctttccatttgcattt

SEQ ID NO: 5273845 - DNA, 21 bp, Homo sapiens
attctttcccaattcacatct

SEQ ID NO: 5273846 - DNA, 15 bp, Homo sapiens
attctttcccagtga

SEQ ID NO: 5273847 - DNA, 20 bp, Homo sapiens
attctttcccctcagagctc

SEQ ID NO: 5273848 - DNA, 12 bp, Homo sapiens
attctttcctaa

SEQ ID NO: 5273849 - DNA, 11 bp, Homo sapiens
attctttcctg

SEQ ID NO: 5273850 - DNA, 13 bp, Homo sapiens
attctttcctgag

SEQ ID NO: 5273851 - DNA, 17 bp, Homo sapiens
attctttcctgaggctg

SEQ ID NO: 5273852 - DNA, 21 bp, Homo sapiens
attctttccttctctgaaagt

SEQ ID NO: 5273853 - DNA, 19 bp, Homo sapiens
attctttctattttcacaa

SEQ ID NO: 5273854 - DNA, 11 bp, Homo sapiens
attctttctca

SEQ ID NO: 5273855 - DNA, 15 bp, Homo sapiens
attctttctgataac

SEQ ID NO: 5273856 - DNA, 22 bp, Homo sapiens
attctttctgcctttaattttc

SEQ ID NO: 5273857 - DNA, 15 bp, Homo sapiens
attctttctgtattg

SEQ ID NO: 5273858 - DNA, 13 bp, Homo sapiens
attctttctgtct

SEQ ID NO: 5273859 - DNA, 16 bp, Homo sapiens
attctttctgtctccc

SEQ ID NO: 5273860 - DNA, 20 bp, Homo sapiens
attctttctgtctcccttct

SEQ ID NO: 5273861 - DNA, 16 bp, Homo sapiens
attctttctgttgaaa

SEQ ID NO: 5273862 - DNA, 19 bp, Homo sapiens
attctttcttcctccagtc

SEQ ID NO: 5273863 - DNA, 21 bp, Homo sapiens
attctttctttttccttcata

SEQ ID NO: 5273864 - DNA, 16 bp, Homo sapiens
attctttgatgttaac

SEQ ID NO: 5273865 - DNA, 21 bp, Homo sapiens
attctttgatgttaacacatt

SEQ ID NO: 5273866 - DNA, 11 bp, Homo sapiens
attctttgcta

SEQ ID NO: 5273867 - DNA, 23 bp, Homo sapiens
attctttgcttgaacacagtatt

SEQ ID NO: 5273868 - DNA, 13 bp, Homo sapiens
attctttgtacca

SEQ ID NO: 5273869 - DNA, 22 bp, Homo sapiens
attctttgtaccatctgtcttg

SEQ ID NO: 5273870 - DNA, 16 bp, Homo sapiens
attctttgttctgttt

SEQ ID NO: 5273871 - DNA, 16 bp, Homo sapiens
attctttgtttatgca

SEQ ID NO: 5273872 - DNA, 16 bp, Homo sapiens
attcttttaaaattca

SEQ ID NO: 5273873 - DNA, 20 bp, Homo sapiens
attcttttaaaattcaaaag

SEQ ID NO: 5273874 - DNA, 13 bp, Homo sapiens
attcttttaaatg

SEQ ID NO: 5273875 - DNA, 14 bp, Homo sapiens
attcttttaaatgg

SEQ ID NO: 5273876 - DNA, 15 bp, Homo sapiens
attcttttaaatggg

SEQ ID NO: 5273877 - DNA, 16 bp, Homo sapiens
attcttttaaatgggt

SEQ ID NO: 5273878 - DNA, 18 bp, Homo sapiens
attcttttaaattagaaa

SEQ ID NO: 5273879 - DNA, 23 bp, Homo sapiens
attcttttaaattagaaaatatt

SEQ ID NO: 5273880 - DNA, 18 bp, Homo sapiens
attcttttaggacaatta

SEQ ID NO: 5273881 - DNA, 19 bp, Homo sapiens
attcttttatataactaca

SEQ ID NO: 5273882 - DNA, 12 bp, Homo sapiens
attcttttatga

SEQ ID NO: 5273883 - DNA, 19 bp, Homo sapiens
attcttttattaatggcat

SEQ ID NO: 5273884 - DNA, 15 bp, Homo sapiens
attcttttcaaaatt

SEQ ID NO: 5273885 - DNA, 19 bp, Homo sapiens
attcttttcaaaattgttg

SEQ ID NO: 5273886 - DNA, 13 bp, Homo sapiens
attcttttcaatt

SEQ ID NO: 5273887 - DNA, 18 bp, Homo sapiens
attcttttcagcttgttt

SEQ ID NO: 5273888 - DNA, 19 bp, Homo sapiens
attcttttccaaaataaaa

SEQ ID NO: 5273889 - DNA, 14 bp, Homo sapiens
attcttttccagaa

SEQ ID NO: 5273890 - DNA, 20 bp, Homo sapiens
attcttttccagaaagaaaa

SEQ ID NO: 5273891 - DNA, 13 bp, Homo sapiens
attcttttctata

SEQ ID NO: 5273892 - DNA, 23 bp, Homo sapiens
attcttttctataatgtgcctgg

SEQ ID NO: 5273893 - DNA, 18 bp, Homo sapiens
attcttttctgaagttgt

SEQ ID NO: 5273894 - DNA, 13 bp, Homo sapiens
attcttttgctgt

SEQ ID NO: 5273895 - DNA, 23 bp, Homo sapiens
attcttttggctttgaaacttgc

SEQ ID NO: 5273896 - DNA, 23 bp, Homo sapiens
attcttttgttattaaaaaaaca

SEQ ID NO: 5273897 - DNA, 14 bp, Homo sapiens
attcttttgtttcc

SEQ ID NO: 5273898 - DNA, 16 bp, Homo sapiens
attcttttgtttccat

SEQ ID NO: 5273899 - DNA, 18 bp, Homo sapiens
attcttttgtttccatgg

SEQ ID NO: 5273900 - DNA, 15 bp, Homo sapiens
attctttttctgatt

SEQ ID NO: 5273901 - DNA, 14 bp, Homo sapiens
attctttttgctct

SEQ ID NO: 5273902 - DNA, 22 bp, Homo sapiens
attctttttgctctaaaatatt

SEQ ID NO: 5273903 - DNA, 19 bp, Homo sapiens
attcttttttaaattttct

SEQ ID NO: 5273904 - DNA, 21 bp, Homo sapiens
attcttttttcttccccctcc

SEQ ID NO: 5273905 - DNA, 15 bp, Homo sapiens
attctttttttccta

SEQ ID NO: 5273906 - DNA, 15 bp, Homo sapiens
attctttttttctgt

SEQ ID NO: 5273907 - DNA, 18 bp, Homo sapiens
attctttttttctgtcag

SEQ ID NO: 5273908 - DNA, 20 bp, Homo sapiens
attctttttttctgtcagta

SEQ ID NO: 5273909 - DNA, 14 bp, Homo sapiens
attgaaaaaaaaaa

SEQ ID NO: 5273910 - DNA, 15 bp, Homo sapiens
attgaaaaaaatata

SEQ ID NO: 5273911 - DNA, 14 bp, Homo sapiens
attgaaaaaaattg

SEQ ID NO: 5273912 - DNA, 20 bp, Homo sapiens
atgtatatcttctacatgca

SEQ ID NO: 5273913 - DNA, 22 bp, Homo sapiens
atgtatatgaacttaacatgct

SEQ ID NO: 5273914 - DNA, 16 bp, Homo sapiens
atgtatatgtatatat

SEQ ID NO: 5273915 - DNA, 18 bp, Homo sapiens
atgtatatgtatatctat

SEQ ID NO: 5273916 - DNA, 22 bp, Homo sapiens
atgtatatttttaaagaatgtt

SEQ ID NO: 5273917 - DNA, 19 bp, Homo sapiens
atgtatatttttgctagga

SEQ ID NO: 5273918 - DNA, 14 bp, Homo sapiens
atgtatcacattga

SEQ ID NO: 5273919 - DNA, 15 bp, Homo sapiens
atgtatcagctctct

SEQ ID NO: 5273920 - DNA, 20 bp, Homo sapiens
atgtatcatttttgtgcaca

SEQ ID NO: 5273921 - DNA, 17 bp, Homo sapiens
atgtatccagtacattt

SEQ ID NO: 5273922 - DNA, 17 bp, Homo sapiens
atgtatcccattggcta

SEQ ID NO: 5273923 - DNA, 20 bp, Homo sapiens
atgtatctaaatgaaaagag

SEQ ID NO: 5273924 - DNA, 21 bp, Homo sapiens
atgtatctaaatgaaaagaga

SEQ ID NO: 5273925 - DNA, 14 bp, Homo sapiens
atgtatctaagaat

SEQ ID NO: 5273926 - DNA, 16 bp, Homo sapiens
atgtatctaagaataa

SEQ ID NO: 5273927 - DNA, 18 bp, Homo sapiens
atgtatctaatttcattc

SEQ ID NO: 5273928 - DNA, 14 bp, Homo sapiens
atgtatctagtggt

SEQ ID NO: 5273929 - DNA, 20 bp, Homo sapiens
atgtatctagtgtgtcctgt

SEQ ID NO: 5273930 - DNA, 15 bp, Homo sapiens
atgtatctctctgtg

SEQ ID NO: 5273931 - DNA, 14 bp, Homo sapiens
atgtatctgaatat

SEQ ID NO: 5273932 - DNA, 15 bp, Homo sapiens
atgtatctgaatatc

SEQ ID NO: 5273933 - DNA, 14 bp, Homo sapiens
atgtatctgtgaag

SEQ ID NO: 5273934 - DNA, 14 bp, Homo sapiens
atgtatctgttttg

SEQ ID NO: 5273935 - DNA, 12 bp, Homo sapiens
atgtatcttaaa

SEQ ID NO: 5273936 - DNA, 13 bp, Homo sapiens
atgtatcttaaag

SEQ ID NO: 5273937 - DNA, 17 bp, Homo sapiens
atgtatcttatttatat

SEQ ID NO: 5273938 - DNA, 20 bp, Homo sapiens
atgtatcttatttatatatg

SEQ ID NO: 5273939 - DNA, 17 bp, Homo sapiens
atgtatctttattaaaa

SEQ ID NO: 5273940 - DNA, 21 bp, Homo sapiens
atgtatgaaggaatcattcca

SEQ ID NO: 5273941 - DNA, 23 bp, Homo sapiens
atgtatgaaggaatcattccagt

SEQ ID NO: 5273942 - DNA, 23 bp, Homo sapiens
atgtatgaatacagcagcaagaa

SEQ ID NO: 5273943 - DNA, 14 bp, Homo sapiens
atgtatgagacaga

SEQ ID NO: 5273944 - DNA, 16 bp, Homo sapiens
atgtatgatctctcta

SEQ ID NO: 5273945 - DNA, 17 bp, Homo sapiens
atgtatgcataataatc

SEQ ID NO: 5273946 - DNA, 19 bp, Homo sapiens
atgtatgctgtttgtacaa

SEQ ID NO: 5273947 - DNA, 15 bp, Homo sapiens
atgtatgcttcatac

SEQ ID NO: 5273948 - DNA, 17 bp, Homo sapiens
atgtatgcttcatacag

SEQ ID NO: 5273949 - DNA, 18 bp, Homo sapiens
atgtatgctttgaatgca

SEQ ID NO: 5273950 - DNA, 15 bp, Homo sapiens
atgtatgctttttac

SEQ ID NO: 5273951 - DNA, 20 bp, Homo sapiens
atgtatggaatacagtgtta

SEQ ID NO: 5273952 - DNA, 22 bp, Homo sapiens
atgtatggaatcccactgtatg

SEQ ID NO: 5273953 - DNA, 15 bp, Homo sapiens
atgtatggatatatt

SEQ ID NO: 5273954 - DNA, 18 bp, Homo sapiens
atgtatggatatatttga

SEQ ID NO: 5273955 - DNA, 19 bp, Homo sapiens
atgtatggatttccagttt

SEQ ID NO: 5273956 - DNA, 19 bp, Homo sapiens
atgtatggcttttctcttg

SEQ ID NO: 5273957 - DNA, 22 bp, Homo sapiens
atgtatgtaaataggtttctaa

SEQ ID NO: 5273958 - DNA, 19 bp, Homo sapiens
atgtatgtacctgagcata

SEQ ID NO: 5273959 - DNA, 22 bp, Homo sapiens
atgtatgtgaaagtgtaaaata

SEQ ID NO: 5273960 - DNA, 18 bp, Homo sapiens
atgtatgtgcacatgtgt

SEQ ID NO: 5273961 - DNA, 19 bp, Homo sapiens
atgtatgtgcacatgtgtc

SEQ ID NO: 5273962 - DNA, 15 bp, Homo sapiens
atgtatgtgcactgt

SEQ ID NO: 5273963 - DNA, 14 bp, Homo sapiens
atgtatgtgcattt

SEQ ID NO: 5273964 - DNA, 21 bp, Homo sapiens
atgtatgtggtatgtatattt

SEQ ID NO: 5273965 - DNA, 12 bp, Homo sapiens
atgtatgtgtaa

SEQ ID NO: 5273966 - DNA, 22 bp, Homo sapiens
atgtatgtgtagtgtgtttgtg

SEQ ID NO: 5273967 - DNA, 12 bp, Homo sapiens
atgtatgtgtat

SEQ ID NO: 5273968 - DNA, 16 bp, Homo sapiens
atgtatgtgtatatgt

SEQ ID NO: 5273969 - DNA, 17 bp, Homo sapiens
atgtatgtgtatatgtt

SEQ ID NO: 5273970 - DNA, 14 bp, Homo sapiens
atgtatgtgtttag

SEQ ID NO: 5273971 - DNA, 18 bp, Homo sapiens
atgtatgtgtttagaatt

SEQ ID NO: 5273972 - DNA, 21 bp, Homo sapiens
atgtatgtgtttagaattgaa

SEQ ID NO: 5273973 - DNA, 12 bp, Homo sapiens
atgtatgttacc

SEQ ID NO: 5273974 - DNA, 14 bp, Homo sapiens
atgtatgttaccaa

SEQ ID NO: 5273975 - DNA, 15 bp, Homo sapiens
atgtatgttatttga

SEQ ID NO: 5273976 - DNA, 15 bp, Homo sapiens
atgtatgttgcatga

SEQ ID NO: 5273977 - DNA, 21 bp, Homo sapiens
atgtatgtttacactgtcaaa

SEQ ID NO: 5273978 - DNA, 16 bp, Homo sapiens
atgtatgtttacatat

SEQ ID NO: 5273979 - DNA, 18 bp, Homo sapiens
atgtatgtttacatatca

SEQ ID NO: 5273980 - DNA, 14 bp, Homo sapiens
atgtatgtttctct

SEQ ID NO: 5273981 - DNA, 20 bp, Homo sapiens
atgtatgttttggtatctgt

SEQ ID NO: 5273982 - DNA, 15 bp, Homo sapiens
atgtattaaactttt

SEQ ID NO: 5273983 - DNA, 14 bp, Homo sapiens
atgtattaactgaa

SEQ ID NO: 5273984 - DNA, 20 bp, Homo sapiens
atgtattaagccaaacatga

SEQ ID NO: 5273985 - DNA, 21 bp, Homo sapiens
atgtattaagcccacagtata

SEQ ID NO: 5273986 - DNA, 23 bp, Homo sapiens
atgtattaagcccacagtatatt

SEQ ID NO: 5273987 - DNA, 16 bp, Homo sapiens
atgtattaatattcat

SEQ ID NO: 5273988 - DNA, 17 bp, Homo sapiens
atgtattaatattcatt

SEQ ID NO: 5273989 - DNA, 14 bp, Homo sapiens
atgtattaatgtat

SEQ ID NO: 5273990 - DNA, 18 bp, Homo sapiens
atgtattacatgactgtt

SEQ ID NO: 5273991 - DNA, 19 bp, Homo sapiens
atgtattacatgactgttt

SEQ ID NO: 5273992 - DNA, 16 bp, Homo sapiens
atgtattaccagcccc

SEQ ID NO: 5273993 - DNA, 17 bp, Homo sapiens
atgtattaccagccccc

SEQ ID NO: 5273994 - DNA, 18 bp, Homo sapiens
atgtattacttttctgca

SEQ ID NO: 5273995 - DNA, 18 bp, Homo sapiens
atgtattagtagagcaac

SEQ ID NO: 5273996 - DNA, 16 bp, Homo sapiens
atgtattagtgatatt

SEQ ID NO: 5273997 - DNA, 19 bp, Homo sapiens
atgtattagtgatatttct

SEQ ID NO: 5273998 - DNA, 22 bp, Homo sapiens
atgtattagtgatatttctcta

SEQ ID NO: 5273999 - DNA, 23 bp, Homo sapiens
atgtattagtgatatttctctag

SEQ ID NO: 5274000 - DNA, 23 bp, Homo sapiens
atgtattatcctgtgtgtgtcta

SEQ ID NO: 5274001 - DNA, 12 bp, Homo sapiens
atgtattatgaa

SEQ ID NO: 5274002 - DNA, 15 bp, Homo sapiens
atgtattatgagcca

SEQ ID NO: 5274003 - DNA, 17 bp, Homo sapiens
atgtattatgcaaagta

SEQ ID NO: 5274004 - DNA, 19 bp, Homo sapiens
atgtattattattaaagaa

SEQ ID NO: 5274005 - DNA, 14 bp, Homo sapiens
atgtattattctgc

SEQ ID NO: 5274006 - DNA, 17 bp, Homo sapiens
atgtattatttaaatgt

SEQ ID NO: 5274007 - DNA, 18 bp, Homo sapiens
atgtattattttctatag

SEQ ID NO: 5274008 - DNA, 20 bp, Homo sapiens
atgtattcaagcaaacatca

SEQ ID NO: 5274009 - DNA, 21 bp, Homo sapiens
atgtattcaagcaaacatcaa

SEQ ID NO: 5274010 - DNA, 21 bp, Homo sapiens
atgtattcatatttgtacttt

SEQ ID NO: 5274011 - DNA, 15 bp, Homo sapiens
atgtattcatccaga

SEQ ID NO: 5274012 - DNA, 21 bp, Homo sapiens
atgtattcatccagagttctt

SEQ ID NO: 5274013 - DNA, 21 bp, Homo sapiens
atgtattcccttgtattttgt

SEQ ID NO: 5274014 - DNA, 13 bp, Homo sapiens
atgtattcctatg

SEQ ID NO: 5274015 - DNA, 17 bp, Homo sapiens
atgtattcctatgacaa

SEQ ID NO: 5274016 - DNA, 14 bp, Homo sapiens
atgtattcctgaaa

SEQ ID NO: 5274017 - DNA, 15 bp, Homo sapiens
atgtattcctttaaa

SEQ ID NO: 5274018 - DNA, 17 bp, Homo sapiens
atgtattcctttaaaat

SEQ ID NO: 5274019 - DNA, 22 bp, Homo sapiens
atgtattctttctgcctttaat

SEQ ID NO: 5274020 - DNA, 12 bp, Homo sapiens
atgtattctttt

SEQ ID NO: 5274021 - DNA, 19 bp, Homo sapiens
atgtattcttttatataac

SEQ ID NO: 5274022 - DNA, 21 bp, Homo sapiens
atgtattcttttatataacta

SEQ ID NO: 5274023 - DNA, 14 bp, Homo sapiens
atgtattgattcaa

SEQ ID NO: 5274024 - DNA, 22 bp, Homo sapiens
atgtattgcacattgtaaaaag

SEQ ID NO: 5274025 - DNA, 21 bp, Homo sapiens
atgtattgcagtgcggctcac

SEQ ID NO: 5274026 - DNA, 17 bp, Homo sapiens
atgtattggcatttatt

SEQ ID NO: 5274027 - DNA, 16 bp, Homo sapiens
atgtattggcctggag

SEQ ID NO: 5274028 - DNA, 19 bp, Homo sapiens
atgtattgtaaacagaagg

SEQ ID NO: 5274029 - DNA, 17 bp, Homo sapiens
atgtattgtaatctttc

SEQ ID NO: 5274030 - DNA, 17 bp, Homo sapiens
atgtattgtgcaatgtg

SEQ ID NO: 5274031 - DNA, 20 bp, Homo sapiens
atgtattgtgcaatgtgtat

SEQ ID NO: 5274032 - DNA, 16 bp, Homo sapiens
atgtatttaaagaaca

SEQ ID NO: 5274033 - DNA, 17 bp, Homo sapiens
atgtatttataaatata

SEQ ID NO: 5274034 - DNA, 17 bp, Homo sapiens
atgtatttataatttaa

SEQ ID NO: 5274035 - DNA, 14 bp, Homo sapiens
atgtatttatattt

SEQ ID NO: 5274036 - DNA, 13 bp, Homo sapiens
atgtatttatgta

SEQ ID NO: 5274037 - DNA, 23 bp, Homo sapiens
atgtatttattgtcattactgcc

SEQ ID NO: 5274038 - DNA, 15 bp, Homo sapiens
atgtatttcagggac

SEQ ID NO: 5274039 - DNA, 18 bp, Homo sapiens
atgtatttcattgctgtg

SEQ ID NO: 5274040 - DNA, 20 bp, Homo sapiens
atgtatttcattgctgtgtc

SEQ ID NO: 5274041 - DNA, 22 bp, Homo sapiens
atgtatttctccatcctgcaga

SEQ ID NO: 5274042 - DNA, 13 bp, Homo sapiens
atgtatttcttta

SEQ ID NO: 5274043 - DNA, 16 bp, Homo sapiens
atgtatttgatgtctt

SEQ ID NO: 5274044 - DNA, 12 bp, Homo sapiens
atgtatttgatt

SEQ ID NO: 5274045 - DNA, 12 bp, Homo sapiens
atgtatttgcaa

SEQ ID NO: 5274046 - DNA, 22 bp, Homo sapiens
atgtatttgcaaggctgattta

SEQ ID NO: 5274047 - DNA, 15 bp, Homo sapiens
atgtatttgctgaca

SEQ ID NO: 5274048 - DNA, 16 bp, Homo sapiens
atgtatttgtagccag

SEQ ID NO: 5274049 - DNA, 13 bp, Homo sapiens
atgtatttgtagt

SEQ ID NO: 5274050 - DNA, 14 bp, Homo sapiens
atgtatttgttata

SEQ ID NO: 5274051 - DNA, 17 bp, Homo sapiens
atgtatttgttatatat

SEQ ID NO: 5274052 - DNA, 19 bp, Homo sapiens
atgtatttgttatatataa

SEQ ID NO: 5274053 - DNA, 14 bp, Homo sapiens
atgtatttgttcat

SEQ ID NO: 5274054 - DNA, 14 bp, Homo sapiens
atgtattttaaaat

SEQ ID NO: 5274055 - DNA, 15 bp, Homo sapiens
atgtattttaaaata

SEQ ID NO: 5274056 - DNA, 23 bp, Homo sapiens
atgtattttacacaaatgtgatt

SEQ ID NO: 5274057 - DNA, 13 bp, Homo sapiens
atgtattttatga

SEQ ID NO: 5274058 - DNA, 14 bp, Homo sapiens
atgtattttatgat

SEQ ID NO: 5274059 - DNA, 17 bp, Homo sapiens
atgtattttatgtatgt

SEQ ID NO: 5274060 - DNA, 20 bp, Homo sapiens
atgtattttatgtatgttta

SEQ ID NO: 5274061 - DNA, 14 bp, Homo sapiens
atgtattttatgtt

SEQ ID NO: 5274062 - DNA, 16 bp, Homo sapiens
atgtattttatgttat

SEQ ID NO: 5274063 - DNA, 20 bp, Homo sapiens
atgtattttattattttctt

SEQ ID NO: 5274064 - DNA, 16 bp, Homo sapiens
atgtattttattgtaa

SEQ ID NO: 5274065 - DNA, 13 bp, Homo sapiens
atgtattttcata

SEQ ID NO: 5274066 - DNA, 20 bp, Homo sapiens
atgtattttccaagtaaaat

SEQ ID NO: 5274067 - DNA, 12 bp, Homo sapiens
atgtattttcct

SEQ ID NO: 5274068 - DNA, 18 bp, Homo sapiens
atgtattttcctaatgtg

SEQ ID NO: 5274069 - DNA, 23 bp, Homo sapiens
atgtattttcttcacctctgcta

SEQ ID NO: 5274070 - DNA, 21 bp, Homo sapiens
atgtattttctttttattttg

SEQ ID NO: 5274071 - DNA, 13 bp, Homo sapiens
atgtattttgaaa

SEQ ID NO: 5274072 - DNA, 23 bp, Homo sapiens
atgtattttgaagaatatttaag

SEQ ID NO: 5274073 - DNA, 13 bp, Homo sapiens
atgtattttgtga

SEQ ID NO: 5274074 - DNA, 16 bp, Homo sapiens
atgtattttgtgaata

SEQ ID NO: 5274075 - DNA, 15 bp, Homo sapiens
atgtattttgtgagt

SEQ ID NO: 5274076 - DNA, 23 bp, Homo sapiens
atgtattttgtgagtttgtttct

SEQ ID NO: 5274077 - DNA, 19 bp, Homo sapiens
atgtatttttctacattat

SEQ ID NO: 5274078 - DNA, 14 bp, Homo sapiens
atgtatttttctat

SEQ ID NO: 5274079 - DNA, 15 bp, Homo sapiens
atgtatttttcttgc

SEQ ID NO: 5274080 - DNA, 19 bp, Homo sapiens
atgtatttttgatgtatat

SEQ ID NO: 5274081 - DNA, 18 bp, Homo sapiens
atgtattttttgaatcta

SEQ ID NO: 5274082 - DNA, 21 bp, Homo sapiens
atgtattttttgaatctatga

SEQ ID NO: 5274083 - DNA, 23 bp, Homo sapiens
atgtcaaaaatatttaggaattt

SEQ ID NO: 5274084 - DNA, 17 bp, Homo sapiens
atgtcaaaagtagaact

SEQ ID NO: 5274085 - DNA, 18 bp, Homo sapiens
atgtcaaagatatgttaa

SEQ ID NO: 5274086 - DNA, 20 bp, Homo sapiens
atgtcaaagctgcatgtgta

SEQ ID NO: 5274087 - DNA, 20 bp, Homo sapiens
atgtcaaaggtcgggacagc

SEQ ID NO: 5274088 - DNA, 15 bp, Homo sapiens
atgtcaaagtgtaac

SEQ ID NO: 5274089 - DNA, 15 bp, Homo sapiens
atgtcaaatggatgt

SEQ ID NO: 5274090 - DNA, 24 bp, Homo sapiens
atgtcaacagccataataataatt

SEQ ID NO: 5274091 - DNA, 19 bp, Homo sapiens
attgaaaaaaattggcatt

SEQ ID NO: 5274092 - DNA, 22 bp, Homo sapiens
attgaaaaaatagagcctgagg

SEQ ID NO: 5274093 - DNA, 14 bp, Homo sapiens
attgaaaaaatatt

SEQ ID NO: 5274094 - DNA, 13 bp, Homo sapiens
attgaaaaacaat

SEQ ID NO: 5274095 - DNA, 15 bp, Homo sapiens
attgaaaaacaattt

SEQ ID NO: 5274096 - DNA, 22 bp, Homo sapiens
attgaaaaacaattttctgtaa

SEQ ID NO: 5274097 - DNA, 17 bp, Homo sapiens
attgaaaaactctttat

SEQ ID NO: 5274098 - DNA, 16 bp, Homo sapiens
attgaaaaataaaaac

SEQ ID NO: 5274099 - DNA, 17 bp, Homo sapiens
attgaaaaataaaaacc

SEQ ID NO: 5274100 - DNA, 15 bp, Homo sapiens
attgaaaaatcacca

SEQ ID NO: 5274101 - DNA, 14 bp, Homo sapiens
attgaaaaatcagt

SEQ ID NO: 5274102 - DNA, 21 bp, Homo sapiens
attgaaaaattatcagttata

SEQ ID NO: 5274103 - DNA, 21 bp, Homo sapiens
attgaaaacaaagacattctt

SEQ ID NO: 5274104 - DNA, 15 bp, Homo sapiens
attgaaaacagatat

SEQ ID NO: 5274105 - DNA, 14 bp, Homo sapiens
attgaaaacttcaa

SEQ ID NO: 5274106 - DNA, 11 bp, Homo sapiens
attgaaaagaa

SEQ ID NO: 5274107 - DNA, 23 bp, Homo sapiens
attgaaaagacgctaataaaaat

SEQ ID NO: 5274108 - DNA, 17 bp, Homo sapiens
attgaaaagcacagagg

SEQ ID NO: 5274109 - DNA, 16 bp, Homo sapiens
attgaaaaggaacttg

SEQ ID NO: 5274110 - DNA, 14 bp, Homo sapiens
attgaaaaggaaga

SEQ ID NO: 5274111 - DNA, 15 bp, Homo sapiens
attgaaaagtgtcct

SEQ ID NO: 5274112 - DNA, 16 bp, Homo sapiens
attgaaaagtgtcctc

SEQ ID NO: 5274113 - DNA, 16 bp, Homo sapiens
attgaaaagtgttctg

SEQ ID NO: 5274114 - DNA, 21 bp, Homo sapiens
attgaaaagttatttcccttt

SEQ ID NO: 5274115 - DNA, 16 bp, Homo sapiens
attgaaaagtttttgt

SEQ ID NO: 5274116 - DNA, 15 bp, Homo sapiens
attgaaaatatattt

SEQ ID NO: 5274117 - DNA, 14 bp, Homo sapiens
attgaaaatgaatg

SEQ ID NO: 5274118 - DNA, 13 bp, Homo sapiens
attgaaaatgcat

SEQ ID NO: 5274119 - DNA, 14 bp, Homo sapiens
attgaaaatggctt

SEQ ID NO: 5274120 - DNA, 16 bp, Homo sapiens
attgaaaatgtaagta

SEQ ID NO: 5274121 - DNA, 20 bp, Homo sapiens
attgaaaatgtcactgttat

SEQ ID NO: 5274122 - DNA, 22 bp, Homo sapiens
attgaaaatgtccaggaaagtg

SEQ ID NO: 5274123 - DNA, 20 bp, Homo sapiens
attgaaaattattaatcaga

SEQ ID NO: 5274124 - DNA, 17 bp, Homo sapiens
attgaaacaacattatt

SEQ ID NO: 5274125 - DNA, 18 bp, Homo sapiens
attgaaactacactaaat

SEQ ID NO: 5274126 - DNA, 20 bp, Homo sapiens
attgaaactagttattttat

SEQ ID NO: 5274127 - DNA, 13 bp, Homo sapiens
attgaaactgtat

SEQ ID NO: 5274128 - DNA, 20 bp, Homo sapiens
attgaaagaatgtaaagcaa

SEQ ID NO: 5274129 - DNA, 18 bp, Homo sapiens
attgaaagagaaccagtt

SEQ ID NO: 5274130 - DNA, 15 bp, Homo sapiens
attgaaagagaattt

SEQ ID NO: 5274131 - DNA, 16 bp, Homo sapiens
attgaaagagaatttg

SEQ ID NO: 5274132 - DNA, 21 bp, Homo sapiens
attgaaagcactatgaatttg

SEQ ID NO: 5274133 - DNA, 13 bp, Homo sapiens
attgaaagccaac

SEQ ID NO: 5274134 - DNA, 23 bp, Homo sapiens
attgaaaggacctcttctgaagc

SEQ ID NO: 5274135 - DNA, 18 bp, Homo sapiens
attgaaaggcattctctg

SEQ ID NO: 5274136 - DNA, 17 bp, Homo sapiens
attgaaagggacaagta

SEQ ID NO: 5274137 - DNA, 20 bp, Homo sapiens
attgaaaggggacacctgta

SEQ ID NO: 5274138 - DNA, 17 bp, Homo sapiens
attgaaagtattcagaa

SEQ ID NO: 5274139 - DNA, 18 bp, Homo sapiens
attgaaagtattcagaaa

SEQ ID NO: 5274140 - DNA, 23 bp, Homo sapiens
attgaaagtattcagaaattaaa

SEQ ID NO: 5274141 - DNA, 16 bp, Homo sapiens
attgaaagttctggaa

SEQ ID NO: 5274142 - DNA, 15 bp, Homo sapiens
attgaaagttgcttt

SEQ ID NO: 5274143 - DNA, 22 bp, Homo sapiens
attgaaataaataaaaatgcat

SEQ ID NO: 5274144 - DNA, 14 bp, Homo sapiens
attgaaatactttt

SEQ ID NO: 5274145 - DNA, 20 bp, Homo sapiens
attgaaatataatgcaaacc

SEQ ID NO: 5274146 - DNA, 11 bp, Homo sapiens
attgaaatatc

SEQ ID NO: 5274147 - DNA, 13 bp, Homo sapiens
attgaaatattag

SEQ ID NO: 5274148 - DNA, 14 bp, Homo sapiens
attgaaatcagcat

SEQ ID NO: 5274149 - DNA, 18 bp, Homo sapiens
attgaaatctttttgctt

SEQ ID NO: 5274150 - DNA, 22 bp, Homo sapiens
attgaaatgctgtatttttaca

SEQ ID NO: 5274151 - DNA, 13 bp, Homo sapiens
attgaaatgtata

SEQ ID NO: 5274152 - DNA, 12 bp, Homo sapiens
attgaaatgtca

SEQ ID NO: 5274153 - DNA, 15 bp, Homo sapiens
attgaaattccagtt

SEQ ID NO: 5274154 - DNA, 21 bp, Homo sapiens
attgaaattccagttgcaatt

SEQ ID NO: 5274155 - DNA, 19 bp, Homo sapiens
attgaaatttttaaatcat

SEQ ID NO: 5274156 - DNA, 14 bp, Homo sapiens
attgaacacaaact

SEQ ID NO: 5274157 - DNA, 16 bp, Homo sapiens
attgaacacaaactgt

SEQ ID NO: 5274158 - DNA, 19 bp, Homo sapiens
attgaacacaaactgtaaa

SEQ ID NO: 5274159 - DNA, 15 bp, Homo sapiens
attgaacacaggcaa

SEQ ID NO: 5274160 - DNA, 16 bp, Homo sapiens
attgaacactgcaccc

SEQ ID NO: 5274161 - DNA, 15 bp, Homo sapiens
attgaacatgcaatt

SEQ ID NO: 5274162 - DNA, 16 bp, Homo sapiens
attgaacattctagaa

SEQ ID NO: 5274163 - DNA, 18 bp, Homo sapiens
attgaaccagctcatctc

SEQ ID NO: 5274164 - DNA, 15 bp, Homo sapiens
attgaacccaggagg

SEQ ID NO: 5274165 - DNA, 21 bp, Homo sapiens
attgaaccgtcaatgtgaaat

SEQ ID NO: 5274166 - DNA, 22 bp, Homo sapiens
attgaaccgtcaatgtgaaata

SEQ ID NO: 5274167 - DNA, 21 bp, Homo sapiens
attgaactacagcttgagaac

SEQ ID NO: 5274168 - DNA, 15 bp, Homo sapiens
attgaactctgagag

SEQ ID NO: 5274169 - DNA, 15 bp, Homo sapiens
attgaactctttgaa

SEQ ID NO: 5274170 - DNA, 14 bp, Homo sapiens
attgaactgagcca

SEQ ID NO: 5274171 - DNA, 15 bp, Homo sapiens
attgaactgagccaa

SEQ ID NO: 5274172 - DNA, 19 bp, Homo sapiens
attgaacttaaataaatgt

SEQ ID NO: 5274173 - DNA, 22 bp, Homo sapiens
attgaacttactgtagcctcag

SEQ ID NO: 5274174 - DNA, 14 bp, Homo sapiens
attgaacttccagg

SEQ ID NO: 5274175 - DNA, 14 bp, Homo sapiens
attgaacttttgta

SEQ ID NO: 5274176 - DNA, 16 bp, Homo sapiens
attgaacttttgtact

SEQ ID NO: 5274177 - DNA, 23 bp, Homo sapiens
attgaacttttgtactgaatttt

SEQ ID NO: 5274178 - DNA, 18 bp, Homo sapiens
attgaagaactgcacttt

SEQ ID NO: 5274179 - DNA, 12 bp, Homo sapiens
attgaagaatct

SEQ ID NO: 5274180 - DNA, 13 bp, Homo sapiens
attgaagaatctg

SEQ ID NO: 5274181 - DNA, 19 bp, Homo sapiens
attgaagaatctgcccctg

SEQ ID NO: 5274182 - DNA, 18 bp, Homo sapiens
attgaagagagagctgag

SEQ ID NO: 5274183 - DNA, 21 bp, Homo sapiens
attgaagagagatatatctga

SEQ ID NO: 5274184 - DNA, 14 bp, Homo sapiens
attgaagatgctgc

SEQ ID NO: 5274185 - DNA, 13 bp, Homo sapiens
attgaagatgtcc

SEQ ID NO: 5274186 - DNA, 22 bp, Homo sapiens
attgaagccgactctggccctg

SEQ ID NO: 5274187 - DNA, 17 bp, Homo sapiens
attgaagctaaaacact

SEQ ID NO: 5274188 - DNA, 22 bp, Homo sapiens
attgaagctttactttagaatt

SEQ ID NO: 5274189 - DNA, 13 bp, Homo sapiens
attgaaggaaaga

SEQ ID NO: 5274190 - DNA, 16 bp, Homo sapiens
attgaaggagaaaatg

SEQ ID NO: 5274191 - DNA, 21 bp, Homo sapiens
attgaaggttgtatgtaaatc

SEQ ID NO: 5274192 - DNA, 17 bp, Homo sapiens
attgaaggtttttgata

SEQ ID NO: 5274193 - DNA, 18 bp, Homo sapiens
attgaaggtttttgatag

SEQ ID NO: 5274194 - DNA, 18 bp, Homo sapiens
attgaagtaagttcatca

SEQ ID NO: 5274195 - DNA, 16 bp, Homo sapiens
attgaagtatattctt

SEQ ID NO: 5274196 - DNA, 14 bp, Homo sapiens
attgaagtcatcat

SEQ ID NO: 5274197 - DNA, 21 bp, Homo sapiens
attgaagtcttcttatctaaa

SEQ ID NO: 5274198 - DNA, 15 bp, Homo sapiens
attgaagtgtcttct

SEQ ID NO: 5274199 - DNA, 16 bp, Homo sapiens
attgaagtgtcttctg

SEQ ID NO: 5274200 - DNA, 19 bp, Homo sapiens
attgaagtgttctgagctg

SEQ ID NO: 5274201 - DNA, 22 bp, Homo sapiens
attgaagtgtttaaaagagcca

SEQ ID NO: 5274202 - DNA, 14 bp, Homo sapiens
attgaagttaactg

SEQ ID NO: 5274203 - DNA, 20 bp, Homo sapiens
attgaagtttattattttca

SEQ ID NO: 5274204 - DNA, 21 bp, Homo sapiens
attgaagtttattattttcaa

SEQ ID NO: 5274205 - DNA, 22 bp, Homo sapiens
attgaataaaaaatagacatgt

SEQ ID NO: 5274206 - DNA, 22 bp, Homo sapiens
attgaataagtggcatactttt

SEQ ID NO: 5274207 - DNA, 22 bp, Homo sapiens
attgaataatggtaccagataa

SEQ ID NO: 5274208 - DNA, 22 bp, Homo sapiens
attgaatagtggaacattttca

SEQ ID NO: 5274209 - DNA, 13 bp, Homo sapiens
attgaatatatca

SEQ ID NO: 5274210 - DNA, 22 bp, Homo sapiens
attgaatatatcagaatctgtg

SEQ ID NO: 5274211 - DNA, 13 bp, Homo sapiens
attgaatatcagt

SEQ ID NO: 5274212 - DNA, 23 bp, Homo sapiens
attgaatattgtgttccttttta

SEQ ID NO: 5274213 - DNA, 13 bp, Homo sapiens
attgaatcagtat

SEQ ID NO: 5274214 - DNA, 20 bp, Homo sapiens
attgaatcagtataaacaaa

SEQ ID NO: 5274215 - DNA, 13 bp, Homo sapiens
attgaatcatgta

SEQ ID NO: 5274216 - DNA, 21 bp, Homo sapiens
attgaatcatgtaggatcttg

SEQ ID NO: 5274217 - DNA, 16 bp, Homo sapiens
attgaatctacaaaag

SEQ ID NO: 5274218 - DNA, 14 bp, Homo sapiens
attgaatctattta

SEQ ID NO: 5274219 - DNA, 14 bp, Homo sapiens
attgaatctgattg

SEQ ID NO: 5274220 - DNA, 23 bp, Homo sapiens
attgaatctgattggacattttc

SEQ ID NO: 5274221 - DNA, 23 bp, Homo sapiens
attgaatgccttatttttgaatt

SEQ ID NO: 5274222 - DNA, 15 bp, Homo sapiens
attgaatgcgcttta

SEQ ID NO: 5274223 - DNA, 23 bp, Homo sapiens
attgaatgtaccttatttaaaag

SEQ ID NO: 5274224 - DNA, 12 bp, Homo sapiens
attgaatgtgaa

SEQ ID NO: 5274225 - DNA, 13 bp, Homo sapiens
attgaatgtgaaa

SEQ ID NO: 5274226 - DNA, 14 bp, Homo sapiens
attgaatgtgaaac

SEQ ID NO: 5274227 - DNA, 22 bp, Homo sapiens
attgaatgtggctgaagttgaa

SEQ ID NO: 5274228 - DNA, 20 bp, Homo sapiens
attgaatgtgtgatgtgaac

SEQ ID NO: 5274229 - DNA, 21 bp, Homo sapiens
attgaatgttatatcatcaat

SEQ ID NO: 5274230 - DNA, 14 bp, Homo sapiens
attgaatgtttaaa

SEQ ID NO: 5274231 - DNA, 14 bp, Homo sapiens
attgaattagaaaa

SEQ ID NO: 5274232 - DNA, 13 bp, Homo sapiens
attgaattatctt

SEQ ID NO: 5274233 - DNA, 15 bp, Homo sapiens
attgaattattttgt

SEQ ID NO: 5274234 - DNA, 20 bp, Homo sapiens
attgaattattttgttactg

SEQ ID NO: 5274235 - DNA, 21 bp, Homo sapiens
attgaattattttgttactgt

SEQ ID NO: 5274236 - DNA, 15 bp, Homo sapiens
attgaattcattata

SEQ ID NO: 5274237 - DNA, 23 bp, Homo sapiens
attgaattcttggttgaggaaac

SEQ ID NO: 5274238 - DNA, 13 bp, Homo sapiens
attgaattggaaa

SEQ ID NO: 5274239 - DNA, 17 bp, Homo sapiens
attgaattggaaagact

SEQ ID NO: 5274240 - DNA, 13 bp, Homo sapiens
attgaatttaaca

SEQ ID NO: 5274241 - DNA, 23 bp, Homo sapiens
attgaatttgcacggtttgtgag

SEQ ID NO: 5274242 - DNA, 13 bp, Homo sapiens
attgaatttgtta

SEQ ID NO: 5274243 - DNA, 15 bp, Homo sapiens
attgaatttgttaga

SEQ ID NO: 5274244 - DNA, 12 bp, Homo sapiens
attgacaaaaaa

SEQ ID NO: 5274245 - DNA, 14 bp, Homo sapiens
attgacaaaatgtt

SEQ ID NO: 5274246 - DNA, 17 bp, Homo sapiens
attgacaaaatgttatt

SEQ ID NO: 5274247 - DNA, 19 bp, Homo sapiens
attgacaaaatgttatttc

SEQ ID NO: 5274248 - DNA, 22 bp, Homo sapiens
attgacaaaatgttatttccct

SEQ ID NO: 5274249 - DNA, 17 bp, Homo sapiens
attgacaaatctgtgta

SEQ ID NO: 5274250 - DNA, 20 bp, Homo sapiens
attgacaaatctgtgtatat

SEQ ID NO: 5274251 - DNA, 22 bp, Homo sapiens
attgacaaatctgtgtatatta

SEQ ID NO: 5274252 - DNA, 13 bp, Homo sapiens
attgacaacattt

SEQ ID NO: 5274253 - DNA, 20 bp, Homo sapiens
attgacaacattttattacc

SEQ ID NO: 5274254 - DNA, 19 bp, Homo sapiens
attgacaaccgagaaggtt

SEQ ID NO: 5274255 - DNA, 20 bp, Homo sapiens
attgacaactgaagagacac

SEQ ID NO: 5274256 - DNA, 17 bp, Homo sapiens
attgacaagtgtctttt

SEQ ID NO: 5274257 - DNA, 13 bp, Homo sapiens
attgacaataaaa

SEQ ID NO: 5274258 - DNA, 18 bp, Homo sapiens
attgacaataatttcagg

SEQ ID NO: 5274259 - DNA, 16 bp, Homo sapiens
attgacaatgacaaaa

SEQ ID NO: 5274260 - DNA, 15 bp, Homo sapiens
attgacacacagcac

SEQ ID NO: 5274261 - DNA, 19 bp, Homo sapiens
attgacacatccgcctttt

SEQ ID NO: 5274262 - DNA, 16 bp, Homo sapiens
attgacactgaactta

SEQ ID NO: 5274263 - DNA, 18 bp, Homo sapiens
attgacactgtccctctt

SEQ ID NO: 5274264 - DNA, 20 bp, Homo sapiens
attgacacttaaaaatggtt

SEQ ID NO: 5274265 - DNA, 23 bp, Homo sapiens
attgacagaaccctttgggagca

SEQ ID NO: 5274266 - DNA, 16 bp, Homo sapiens
attgacagattgaatt

SEQ ID NO: 5274267 - DNA, 13 bp, Homo sapiens
attgacagctttg

SEQ ID NO: 5274268 - DNA, 15 bp, Homo sapiens
attgacagctttgct

SEQ ID NO: 5274269 - DNA, 18 bp, Homo sapiens
attgacagctttgctgct

SEQ ID NO: 5274270 - DNA, 13 bp, Homo sapiens
atgtcaacagtat

SEQ ID NO: 5274271 - DNA, 23 bp, Homo sapiens
atgtcaacctttgtaagaaaacc

SEQ ID NO: 5274272 - DNA, 24 bp, Homo sapiens
atgtcaacctttgtaagaaaacca

SEQ ID NO: 5274273 - DNA, 15 bp, Homo sapiens
atgtcaagaaaagga

SEQ ID NO: 5274274 - DNA, 19 bp, Homo sapiens
atgtcaagaaattctgctg

SEQ ID NO: 5274275 - DNA, 20 bp, Homo sapiens
atgtcaagaaattctgctgt

SEQ ID NO: 5274276 - DNA, 21 bp, Homo sapiens
atgtcaagaaattctgctgtt

SEQ ID NO: 5274277 - DNA, 14 bp, Homo sapiens
atgtcaagcaatgg

SEQ ID NO: 5274278 - DNA, 18 bp, Homo sapiens
atgtcaagctggccgtgg

SEQ ID NO: 5274279 - DNA, 19 bp, Homo sapiens
atgtcaaggaaaggatgca

SEQ ID NO: 5274280 - DNA, 22 bp, Homo sapiens
atgtcaaggaagacttttggta

SEQ ID NO: 5274281 - DNA, 16 bp, Homo sapiens
atgtcaaggactcctg

SEQ ID NO: 5274282 - DNA, 17 bp, Homo sapiens
atgtcaaggtgctgttg

SEQ ID NO: 5274283 - DNA, 18 bp, Homo sapiens
atgtcaagtggcagctca

SEQ ID NO: 5274284 - DNA, 16 bp, Homo sapiens
atgtcaatatttgagc

SEQ ID NO: 5274285 - DNA, 16 bp, Homo sapiens
atgtcaatcagcctag

SEQ ID NO: 5274286 - DNA, 21 bp, Homo sapiens
atgtcaatcagcctagttgat

SEQ ID NO: 5274287 - DNA, 23 bp, Homo sapiens
atgtcaatcatatttaaagggaa

SEQ ID NO: 5274288 - DNA, 14 bp, Homo sapiens
atgtcaatcttaag

SEQ ID NO: 5274289 - DNA, 22 bp, Homo sapiens
atgtcaatgccaggatttctca

SEQ ID NO: 5274290 - DNA, 14 bp, Homo sapiens
atgtcaattcatga

SEQ ID NO: 5274291 - DNA, 13 bp, Homo sapiens
atgtcaattgata

SEQ ID NO: 5274292 - DNA, 18 bp, Homo sapiens
atgtcaatttgtatatca

SEQ ID NO: 5274293 - DNA, 20 bp, Homo sapiens
atgtcacaatcctgtccctc

SEQ ID NO: 5274294 - DNA, 17 bp, Homo sapiens
atgtcacacttgtttct

SEQ ID NO: 5274295 - DNA, 17 bp, Homo sapiens
atgtcacaggcaggtcc

SEQ ID NO: 5274296 - DNA, 19 bp, Homo sapiens
atgtcacagtttgttcagt

SEQ ID NO: 5274297 - DNA, 17 bp, Homo sapiens
atgtcacataatgaatg

SEQ ID NO: 5274298 - DNA, 21 bp, Homo sapiens
atgtcacatcctaatagaaag

SEQ ID NO: 5274299 - DNA, 19 bp, Homo sapiens
atgtcacatttgaattctt

SEQ ID NO: 5274300 - DNA, 16 bp, Homo sapiens
atgtcaccacaacaaa

SEQ ID NO: 5274301 - DNA, 15 bp, Homo sapiens
atgtcaccaccttcc

SEQ ID NO: 5274302 - DNA, 16 bp, Homo sapiens
atgtcaccaccttccc

SEQ ID NO: 5274303 - DNA, 20 bp, Homo sapiens
atgtcaccaccttcccagct

SEQ ID NO: 5274304 - DNA, 15 bp, Homo sapiens
atgtcaccagtcctg

SEQ ID NO: 5274305 - DNA, 22 bp, Homo sapiens
atgtcaccggtcagtgcctttt

SEQ ID NO: 5274306 - DNA, 23 bp, Homo sapiens
atgtcaccgtggaccttcctgcc

SEQ ID NO: 5274307 - DNA, 12 bp, Homo sapiens
atgtcacctcag

SEQ ID NO: 5274308 - DNA, 15 bp, Homo sapiens
atgtcacctcagctg

SEQ ID NO: 5274309 - DNA, 19 bp, Homo sapiens
atgtcacgaacttgaaagt

SEQ ID NO: 5274310 - DNA, 14 bp, Homo sapiens
atgtcactagaatg

SEQ ID NO: 5274311 - DNA, 14 bp, Homo sapiens
atgtcactcccaga

SEQ ID NO: 5274312 - DNA, 14 bp, Homo sapiens
atgtcactgtggtc

SEQ ID NO: 5274313 - DNA, 17 bp, Homo sapiens
atgtcactgttataaat

SEQ ID NO: 5274314 - DNA, 22 bp, Homo sapiens
atgtcactgtttttattccttc

SEQ ID NO: 5274315 - DNA, 15 bp, Homo sapiens
atgtcacttctggat

SEQ ID NO: 5274316 - DNA, 18 bp, Homo sapiens
atgtcacttctggatata

SEQ ID NO: 5274317 - DNA, 23 bp, Homo sapiens
atgtcagaaaaacaataagagcg

SEQ ID NO: 5274318 - DNA, 20 bp, Homo sapiens
atgtcagaaaataacagatg

SEQ ID NO: 5274319 - DNA, 16 bp, Homo sapiens
atgtcagaacagagtg

SEQ ID NO: 5274320 - DNA, 18 bp, Homo sapiens
atgtcagaaggagacaga

SEQ ID NO: 5274321 - DNA, 14 bp, Homo sapiens
atgtcagaattaaa

SEQ ID NO: 5274322 - DNA, 20 bp, Homo sapiens
atgtcagacacagattggcc

SEQ ID NO: 5274323 - DNA, 23 bp, Homo sapiens
atgtcagacatccatgtttgtaa

SEQ ID NO: 5274324 - DNA, 14 bp, Homo sapiens
atgtcagactttgc

SEQ ID NO: 5274325 - DNA, 21 bp, Homo sapiens
atgtcagactttgctgcattt

SEQ ID NO: 5274326 - DNA, 21 bp, Homo sapiens
atgtcagaggaccccagggtg

SEQ ID NO: 5274327 - DNA, 17 bp, Homo sapiens
atgtcagataagtgtaa

SEQ ID NO: 5274328 - DNA, 20 bp, Homo sapiens
atgtcagataagtgtaaata

SEQ ID NO: 5274329 - DNA, 14 bp, Homo sapiens
atgtcagattcctt

SEQ ID NO: 5274330 - DNA, 18 bp, Homo sapiens
atgtcagattcctttccc

SEQ ID NO: 5274331 - DNA, 14 bp, Homo sapiens
atgtcagatttctg

SEQ ID NO: 5274332 - DNA, 13 bp, Homo sapiens
atgtcagcaaaaa

SEQ ID NO: 5274333 - DNA, 14 bp, Homo sapiens
atgtcagcagacac

SEQ ID NO: 5274334 - DNA, 16 bp, Homo sapiens
atgtcagccactgtga

SEQ ID NO: 5274335 - DNA, 16 bp, Homo sapiens
atgtcagcctttgtta

SEQ ID NO: 5274336 - DNA, 18 bp, Homo sapiens
atgtcagctgctgttgaa

SEQ ID NO: 5274337 - DNA, 23 bp, Homo sapiens
atgtcagctgctgttgaactttt

SEQ ID NO: 5274338 - DNA, 18 bp, Homo sapiens
atgtcagcttcccagcca

SEQ ID NO: 5274339 - DNA, 21 bp, Homo sapiens
atgtcagcttcccagccatgc

SEQ ID NO: 5274340 - DNA, 15 bp, Homo sapiens
atgtcaggaacagaa

SEQ ID NO: 5274341 - DNA, 18 bp, Homo sapiens
atgtcaggaatttaagaa

SEQ ID NO: 5274342 - DNA, 16 bp, Homo sapiens
atgtcaggcctgtgtg

SEQ ID NO: 5274343 - DNA, 23 bp, Homo sapiens
atgtcaggggcggggagggtgac

SEQ ID NO: 5274344 - DNA, 19 bp, Homo sapiens
atgtcagtatttcaactgc

SEQ ID NO: 5274345 - DNA, 24 bp, Homo sapiens
atgtcagtatttcagtgtagttaa

SEQ ID NO: 5274346 - DNA, 14 bp, Homo sapiens
atgtcagtctacag

SEQ ID NO: 5274347 - DNA, 18 bp, Homo sapiens
atgtcagtctgcttagaa

SEQ ID NO: 5274348 - DNA, 20 bp, Homo sapiens
atgtcagtctgcttagaaat

SEQ ID NO: 5274349 - DNA, 15 bp, Homo sapiens
atgtcagtctgtcca

SEQ ID NO: 5274350 - DNA, 24 bp, Homo sapiens
atgtcagtgctataaatgccagag

SEQ ID NO: 5274351 - DNA, 18 bp, Homo sapiens
atgtcagtggtttctact

SEQ ID NO: 5274352 - DNA, 21 bp, Homo sapiens
atgtcagtgtgactgatctct

SEQ ID NO: 5274353 - DNA, 18 bp, Homo sapiens
atgtcagttcataatata

SEQ ID NO: 5274354 - DNA, 19 bp, Homo sapiens
atgtcagttcataatatat

SEQ ID NO: 5274355 - DNA, 21 bp, Homo sapiens
atgtcagttggccctttaata

SEQ ID NO: 5274356 - DNA, 14 bp, Homo sapiens
atgtcataaagtga

SEQ ID NO: 5274357 - DNA, 23 bp, Homo sapiens
atgtcataaagtgagaaaactgt

SEQ ID NO: 5274358 - DNA, 13 bp, Homo sapiens
atgtcataaatgt

SEQ ID NO: 5274359 - DNA, 14 bp, Homo sapiens
atgtcataaatgtc

SEQ ID NO: 5274360 - DNA, 19 bp, Homo sapiens
atgtcataaatgtcacaat

SEQ ID NO: 5274361 - DNA, 19 bp, Homo sapiens
atgtcataataaagttgtt

SEQ ID NO: 5274362 - DNA, 12 bp, Homo sapiens
atgtcatagcca

SEQ ID NO: 5274363 - DNA, 17 bp, Homo sapiens
atgtcatagccaaagcc

SEQ ID NO: 5274364 - DNA, 18 bp, Homo sapiens
atgtcatagtcttgaaat

SEQ ID NO: 5274365 - DNA, 13 bp, Homo sapiens
atgtcatatcatt

SEQ ID NO: 5274366 - DNA, 15 bp, Homo sapiens
atgtcatatcttctt

SEQ ID NO: 5274367 - DNA, 21 bp, Homo sapiens
atgtcatcagagctcctctgt

SEQ ID NO: 5274368 - DNA, 9 bp, Homo sapiens
atgtcatcc

SEQ ID NO: 5274369 - DNA, 22 bp, Homo sapiens
atgtcatgaggaaactactgaa

SEQ ID NO: 5274370 - DNA, 15 bp, Homo sapiens
atgtcatgctgcctt

SEQ ID NO: 5274371 - DNA, 18 bp, Homo sapiens
atgtcatggccttgaaac

SEQ ID NO: 5274372 - DNA, 19 bp, Homo sapiens
atgtcatggccttgaaaca

SEQ ID NO: 5274373 - DNA, 21 bp, Homo sapiens
atgtcatgtaggttgtctaaa

SEQ ID NO: 5274374 - DNA, 14 bp, Homo sapiens
atgtcatgtctgct

SEQ ID NO: 5274375 - DNA, 18 bp, Homo sapiens
atgtcatgtctgcttgtc

SEQ ID NO: 5274376 - DNA, 17 bp, Homo sapiens
atgtcattaaaataaat

SEQ ID NO: 5274377 - DNA, 15 bp, Homo sapiens
atgtcattaatatat

SEQ ID NO: 5274378 - DNA, 18 bp, Homo sapiens
atgtcattacatagaaca

SEQ ID NO: 5274379 - DNA, 18 bp, Homo sapiens
atgtcattatgacatttc

SEQ ID NO: 5274380 - DNA, 13 bp, Homo sapiens
atgtcattattta

SEQ ID NO: 5274381 - DNA, 21 bp, Homo sapiens
atgtcattatttattgttaaa

SEQ ID NO: 5274382 - DNA, 16 bp, Homo sapiens
atgtcattatttgata

SEQ ID NO: 5274383 - DNA, 22 bp, Homo sapiens
atgtcattatttgataacattt

SEQ ID NO: 5274384 - DNA, 18 bp, Homo sapiens
atgtcattgagtaatata

SEQ ID NO: 5274385 - DNA, 19 bp, Homo sapiens
atgtcattgcccacttctg

SEQ ID NO: 5274386 - DNA, 14 bp, Homo sapiens
atgtcattgctaaa

SEQ ID NO: 5274387 - DNA, 13 bp, Homo sapiens
atgtcattgtcta

SEQ ID NO: 5274388 - DNA, 17 bp, Homo sapiens
atgtcatttcagaagtt

SEQ ID NO: 5274389 - DNA, 17 bp, Homo sapiens
atgtcatttcatacaaa

SEQ ID NO: 5274390 - DNA, 14 bp, Homo sapiens
atgtcatttgagca

SEQ ID NO: 5274391 - DNA, 15 bp, Homo sapiens
atgtcatttgcacac

SEQ ID NO: 5274392 - DNA, 14 bp, Homo sapiens
atgtcatttgctaa

SEQ ID NO: 5274393 - DNA, 19 bp, Homo sapiens
atgtcatttgctaatgaat

SEQ ID NO: 5274394 - DNA, 16 bp, Homo sapiens
atgtcattttcagatc

SEQ ID NO: 5274395 - DNA, 21 bp, Homo sapiens
atgtcattttgtttataatat

SEQ ID NO: 5274396 - DNA, 16 bp, Homo sapiens
atgtccaaacccactc

SEQ ID NO: 5274397 - DNA, 16 bp, Homo sapiens
atgtccaaagaggctg

SEQ ID NO: 5274398 - DNA, 18 bp, Homo sapiens
atgtccaaagaggctgcc

SEQ ID NO: 5274399 - DNA, 21 bp, Homo sapiens
atgtccaaagaggctgcccct

SEQ ID NO: 5274400 - DNA, 22 bp, Homo sapiens
atgtccaaagaggctgcccctc

SEQ ID NO: 5274401 - DNA, 16 bp, Homo sapiens
atgtccaacccgtctg

SEQ ID NO: 5274402 - DNA, 17 bp, Homo sapiens
atgtccaagttcttcac

SEQ ID NO: 5274403 - DNA, 21 bp, Homo sapiens
atgtccaccatgaacttgata

SEQ ID NO: 5274404 - DNA, 19 bp, Homo sapiens
atgtccacctgtgagaaag

SEQ ID NO: 5274405 - DNA, 14 bp, Homo sapiens
atgtccactgtgta

SEQ ID NO: 5274406 - DNA, 17 bp, Homo sapiens
atgtccagaagagtcaa

SEQ ID NO: 5274407 - DNA, 20 bp, Homo sapiens
atgtccagagctggccaggc

SEQ ID NO: 5274408 - DNA, 16 bp, Homo sapiens
atgtccagcaccttgt

SEQ ID NO: 5274409 - DNA, 19 bp, Homo sapiens
atgtccagccacccccagg

SEQ ID NO: 5274410 - DNA, 22 bp, Homo sapiens
atgtccagctagccaactcctc

SEQ ID NO: 5274411 - DNA, 19 bp, Homo sapiens
atgtccagtcatcctgccc

SEQ ID NO: 5274412 - DNA, 20 bp, Homo sapiens
atgtccagtgagcagtgttg

SEQ ID NO: 5274413 - DNA, 16 bp, Homo sapiens
atgtcccaaataaatt

SEQ ID NO: 5274414 - DNA, 17 bp, Homo sapiens
atgtcccacagggacca

SEQ ID NO: 5274415 - DNA, 14 bp, Homo sapiens
atgtcccacccacc

SEQ ID NO: 5274416 - DNA, 20 bp, Homo sapiens
atgtcccagtttcccactct

SEQ ID NO: 5274417 - DNA, 16 bp, Homo sapiens
atgtcccattgataat

SEQ ID NO: 5274418 - DNA, 17 bp, Homo sapiens
atgtcccattgataatt

SEQ ID NO: 5274419 - DNA, 16 bp, Homo sapiens
atgtccccaaacctgc

SEQ ID NO: 5274420 - DNA, 16 bp, Homo sapiens
atgtccccactggcat

SEQ ID NO: 5274421 - DNA, 21 bp, Homo sapiens
atgtccccattctataaattc

SEQ ID NO: 5274422 - DNA, 17 bp, Homo sapiens
atgtcccccacctcttt

SEQ ID NO: 5274423 - DNA, 21 bp, Homo sapiens
atgtcccccacctcttttcct

SEQ ID NO: 5274424 - DNA, 15 bp, Homo sapiens
atgtcccccaggggc

SEQ ID NO: 5274425 - DNA, 13 bp, Homo sapiens
atgtcccctgcgg

SEQ ID NO: 5274426 - DNA, 15 bp, Homo sapiens
atgtcccctgtccca

SEQ ID NO: 5274427 - DNA, 14 bp, Homo sapiens
atgtccccttcctg

SEQ ID NO: 5274428 - DNA, 19 bp, Homo sapiens
atgtccctatttatgattt

SEQ ID NO: 5274429 - DNA, 12 bp, Homo sapiens
atgtccctccag

SEQ ID NO: 5274430 - DNA, 16 bp, Homo sapiens
atgtccctctcttggc

SEQ ID NO: 5274431 - DNA, 23 bp, Homo sapiens
atgtccctctcttggctattgac

SEQ ID NO: 5274432 - DNA, 16 bp, Homo sapiens
atgtccctgggccagg

SEQ ID NO: 5274433 - DNA, 18 bp, Homo sapiens
atgtccctgggccagggt

SEQ ID NO: 5274434 - DNA, 21 bp, Homo sapiens
atgtccctgtccccaggccca

SEQ ID NO: 5274435 - DNA, 21 bp, Homo sapiens
atgtccctgtcccctcctcgc

SEQ ID NO: 5274436 - DNA, 14 bp, Homo sapiens
atgtcccttctcat

SEQ ID NO: 5274437 - DNA, 16 bp, Homo sapiens
atgtccctttcttctc

SEQ ID NO: 5274438 - DNA, 16 bp, Homo sapiens
atgtccctttcttggc

SEQ ID NO: 5274439 - DNA, 15 bp, Homo sapiens
atgtccgttccagga

SEQ ID NO: 5274440 - DNA, 19 bp, Homo sapiens
atgtccgttccaggagcac

SEQ ID NO: 5274441 - DNA, 20 bp, Homo sapiens
atgtcctaaggacacactaa

SEQ ID NO: 5274442 - DNA, 22 bp, Homo sapiens
atgtcctaggggccgagggaaa

SEQ ID NO: 5274443 - DNA, 14 bp, Homo sapiens
atgtcctatccctg

SEQ ID NO: 5274444 - DNA, 20 bp, Homo sapiens
atgtcctatgtatatcttct

SEQ ID NO: 5274445 - DNA, 15 bp, Homo sapiens
atgtcctcaccacat

SEQ ID NO: 5274446 - DNA, 17 bp, Homo sapiens
atgtcctcaccacatgc

SEQ ID NO: 5274447 - DNA, 23 bp, Homo sapiens
atgtcctccaacaataaagagct

SEQ ID NO: 5274448 - DNA, 17 bp, Homo sapiens
attgacaggcgaaagaa

SEQ ID NO: 5274449 - DNA, 17 bp, Homo sapiens
attgacagttgaacaga

SEQ ID NO: 5274450 - DNA, 21 bp, Homo sapiens
attgacataggtcataaagca

SEQ ID NO: 5274451 - DNA, 17 bp, Homo sapiens
attgacatcagcatcac

SEQ ID NO: 5274452 - DNA, 18 bp, Homo sapiens
attgacattctctattgt

SEQ ID NO: 5274453 - DNA, 18 bp, Homo sapiens
attgacattgaaatctag

SEQ ID NO: 5274454 - DNA, 22 bp, Homo sapiens
attgacattgaaatctaggaaa

SEQ ID NO: 5274455 - DNA, 15 bp, Homo sapiens
attgaccaagaactg

SEQ ID NO: 5274456 - DNA, 17 bp, Homo sapiens
attgaccaagaactgca

SEQ ID NO: 5274457 - DNA, 18 bp, Homo sapiens
attgaccaagaactgcat

SEQ ID NO: 5274458 - DNA, 17 bp, Homo sapiens
attgaccaccagttaac

SEQ ID NO: 5274459 - DNA, 16 bp, Homo sapiens
attgaccatgtgatta

SEQ ID NO: 5274460 - DNA, 13 bp, Homo sapiens
attgaccattttt

SEQ ID NO: 5274461 - DNA, 22 bp, Homo sapiens
attgacccacaaagtttcagaa

SEQ ID NO: 5274462 - DNA, 16 bp, Homo sapiens
attgacctcaaaagaa

SEQ ID NO: 5274463 - DNA, 23 bp, Homo sapiens
attgacctcaaaagaaaatgtgt

SEQ ID NO: 5274464 - DNA, 15 bp, Homo sapiens
attgacctcatcatt

SEQ ID NO: 5274465 - DNA, 23 bp, Homo sapiens
attgacctcatcattaataagtg

SEQ ID NO: 5274466 - DNA, 13 bp, Homo sapiens
attgacctctcag

SEQ ID NO: 5274467 - DNA, 16 bp, Homo sapiens
attgacctctcagggc

SEQ ID NO: 5274468 - DNA, 17 bp, Homo sapiens
attgacctgaggccctt

SEQ ID NO: 5274469 - DNA, 17 bp, Homo sapiens
attgacctgctccgctg

SEQ ID NO: 5274470 - DNA, 14 bp, Homo sapiens
attgacctggatgg

SEQ ID NO: 5274471 - DNA, 22 bp, Homo sapiens
attgaccttgaccattaataaa

SEQ ID NO: 5274472 - DNA, 20 bp, Homo sapiens
attgacgattccttctctga

SEQ ID NO: 5274473 - DNA, 18 bp, Homo sapiens
attgactatcaaactgaa

SEQ ID NO: 5274474 - DNA, 23 bp, Homo sapiens
attgactatggagtcttgtgaaa

SEQ ID NO: 5274475 - DNA, 21 bp, Homo sapiens
attgactatttatacaaatgg

SEQ ID NO: 5274476 - DNA, 22 bp, Homo sapiens
attgactattttcgttcattac

SEQ ID NO: 5274477 - DNA, 14 bp, Homo sapiens
attgactcaaacca

SEQ ID NO: 5274478 - DNA, 23 bp, Homo sapiens
attgactcgatttaaactccagc

SEQ ID NO: 5274479 - DNA, 13 bp, Homo sapiens
attgactctcaca

SEQ ID NO: 5274480 - DNA, 14 bp, Homo sapiens
attgactctgggtc

SEQ ID NO: 5274481 - DNA, 19 bp, Homo sapiens
attgactcttatttataga

SEQ ID NO: 5274482 - DNA, 16 bp, Homo sapiens
attgactcttgagttg

SEQ ID NO: 5274483 - DNA, 18 bp, Homo sapiens
attgactctttctattgt

SEQ ID NO: 5274484 - DNA, 16 bp, Homo sapiens
attgactgaactgcac

SEQ ID NO: 5274485 - DNA, 15 bp, Homo sapiens
attgactgaagcaca

SEQ ID NO: 5274486 - DNA, 14 bp, Homo sapiens
attgactgcagttg

SEQ ID NO: 5274487 - DNA, 18 bp, Homo sapiens
attgactgcctatgccaa

SEQ ID NO: 5274488 - DNA, 23 bp, Homo sapiens
attgactgggcaacactgcagga

SEQ ID NO: 5274489 - DNA, 20 bp, Homo sapiens
attgactgggtctccttaat

SEQ ID NO: 5274490 - DNA, 19 bp, Homo sapiens
attgacttagatattaaaa

SEQ ID NO: 5274491 - DNA, 12 bp, Homo sapiens
attgacttcatt

SEQ ID NO: 5274492 - DNA, 13 bp, Homo sapiens
attgacttcattt

SEQ ID NO: 5274493 - DNA, 17 bp, Homo sapiens
attgacttcattttata

SEQ ID NO: 5274494 - DNA, 18 bp, Homo sapiens
attgacttcattttatat

SEQ ID NO: 5274495 - DNA, 20 bp, Homo sapiens
attgacttcattttatattt

SEQ ID NO: 5274496 - DNA, 13 bp, Homo sapiens
attgacttcctcc

SEQ ID NO: 5274497 - DNA, 14 bp, Homo sapiens
attgacttcctcca

SEQ ID NO: 5274498 - DNA, 15 bp, Homo sapiens
attgactttcagtaa

SEQ ID NO: 5274499 - DNA, 15 bp, Homo sapiens
attgagaaactgaat

SEQ ID NO: 5274500 - DNA, 13 bp, Homo sapiens
attgagaaatgtg

SEQ ID NO: 5274501 - DNA, 18 bp, Homo sapiens
attgagaactgcatatgt

SEQ ID NO: 5274502 - DNA, 11 bp, Homo sapiens
attgagaagcc

SEQ ID NO: 5274503 - DNA, 19 bp, Homo sapiens
attgagaagcgtatgtttt

SEQ ID NO: 5274504 - DNA, 14 bp, Homo sapiens
attgagaaggagag

SEQ ID NO: 5274505 - DNA, 17 bp, Homo sapiens
attgagaaggagctccc

SEQ ID NO: 5274506 - DNA, 14 bp, Homo sapiens
attgagaagttcat

SEQ ID NO: 5274507 - DNA, 16 bp, Homo sapiens
attgagaataattatt

SEQ ID NO: 5274508 - DNA, 18 bp, Homo sapiens
attgagaatagaaatttg

SEQ ID NO: 5274509 - DNA, 17 bp, Homo sapiens
attgagaattttaaatt

SEQ ID NO: 5274510 - DNA, 16 bp, Homo sapiens
attgagacaaaaatta

SEQ ID NO: 5274511 - DNA, 20 bp, Homo sapiens
attgagacaaaaattatcta

SEQ ID NO: 5274512 - DNA, 17 bp, Homo sapiens
attgagacactgtcaag

SEQ ID NO: 5274513 - DNA, 21 bp, Homo sapiens
attgagaccgtgaagatactt

SEQ ID NO: 5274514 - DNA, 22 bp, Homo sapiens
attgagaccgtgaagatacttt

SEQ ID NO: 5274515 - DNA, 18 bp, Homo sapiens
attgagacctacaggctg

SEQ ID NO: 5274516 - DNA, 13 bp, Homo sapiens
attgagactgaaa

SEQ ID NO: 5274517 - DNA, 19 bp, Homo sapiens
attgagactgaaagaaact

SEQ ID NO: 5274518 - DNA, 17 bp, Homo sapiens
attgagactttcttcta

SEQ ID NO: 5274519 - DNA, 17 bp, Homo sapiens
attgagagagatgtgta

SEQ ID NO: 5274520 - DNA, 20 bp, Homo sapiens
attgagagttttgtcttgaa

SEQ ID NO: 5274521 - DNA, 19 bp, Homo sapiens
attgagataatatctgtga

SEQ ID NO: 5274522 - DNA, 16 bp, Homo sapiens
attgagatactttttc

SEQ ID NO: 5274523 - DNA, 22 bp, Homo sapiens
attgagatcagcattcaaaata

SEQ ID NO: 5274524 - DNA, 22 bp, Homo sapiens
attgagatgtaattcagattag

SEQ ID NO: 5274525 - DNA, 19 bp, Homo sapiens
attgagattagagggaggt

SEQ ID NO: 5274526 - DNA, 22 bp, Homo sapiens
attgagattcacatgctggctc

SEQ ID NO: 5274527 - DNA, 23 bp, Homo sapiens
attgagcaaataaacttacagat

SEQ ID NO: 5274528 - DNA, 19 bp, Homo sapiens
attgagcacctgcaggcgt

SEQ ID NO: 5274529 - DNA, 21 bp, Homo sapiens
attgagcagaattcattcata

SEQ ID NO: 5274530 - DNA, 18 bp, Homo sapiens
attgagccattttttaaa

SEQ ID NO: 5274531 - DNA, 15 bp, Homo sapiens
attgagcctaaaaat

SEQ ID NO: 5274532 - DNA, 21 bp, Homo sapiens
attgagcctaaaaataaagca

SEQ ID NO: 5274533 - DNA, 20 bp, Homo sapiens
attgagccttacgacacttt

SEQ ID NO: 5274534 - DNA, 22 bp, Homo sapiens
attgagccttgcatgtacttga

SEQ ID NO: 5274535 - DNA, 23 bp, Homo sapiens
attgagctagttaaggcaaatca

SEQ ID NO: 5274536 - DNA, 14 bp, Homo sapiens
attgagcttacaat

SEQ ID NO: 5274537 - DNA, 20 bp, Homo sapiens
attgaggaaaaactgacaga

SEQ ID NO: 5274538 - DNA, 15 bp, Homo sapiens
attgaggaaaaatat

SEQ ID NO: 5274539 - DNA, 22 bp, Homo sapiens
attgaggaaaattaatatcaca

SEQ ID NO: 5274540 - DNA, 16 bp, Homo sapiens
attgaggaaggaaatc

SEQ ID NO: 5274541 - DNA, 14 bp, Homo sapiens
attgaggagctgca

SEQ ID NO: 5274542 - DNA, 18 bp, Homo sapiens
attgaggagctgcactga

SEQ ID NO: 5274543 - DNA, 19 bp, Homo sapiens
attgaggataaattgccat

SEQ ID NO: 5274544 - DNA, 23 bp, Homo sapiens
attgaggataaattgccataata

SEQ ID NO: 5274545 - DNA, 21 bp, Homo sapiens
attgaggcctgccctcaggga

SEQ ID NO: 5274546 - DNA, 14 bp, Homo sapiens
attgaggctttgtg

SEQ ID NO: 5274547 - DNA, 22 bp, Homo sapiens
attgagggccagtgatgatgtt

SEQ ID NO: 5274548 - DNA, 17 bp, Homo sapiens
attgaggggaggtggcc

SEQ ID NO: 5274549 - DNA, 19 bp, Homo sapiens
attgaggggaggtggccag

SEQ ID NO: 5274550 - DNA, 17 bp, Homo sapiens
attgaggggattaatat

SEQ ID NO: 5274551 - DNA, 19 bp, Homo sapiens
attgaggggccctggccag

SEQ ID NO: 5274552 - DNA, 16 bp, Homo sapiens
attgagggtcattctt

SEQ ID NO: 5274553 - DNA, 23 bp, Homo sapiens
attgaggtgtatggagagaaaac

SEQ ID NO: 5274554 - DNA, 18 bp, Homo sapiens
attgaggtgtttgaaata

SEQ ID NO: 5274555 - DNA, 17 bp, Homo sapiens
attgagtaagatttacc

SEQ ID NO: 5274556 - DNA, 17 bp, Homo sapiens
attgagtaatgggattt

SEQ ID NO: 5274557 - DNA, 20 bp, Homo sapiens
attgagtaatggtgtagaac

SEQ ID NO: 5274558 - DNA, 16 bp, Homo sapiens
attgagtattgtttaa

SEQ ID NO: 5274559 - DNA, 22 bp, Homo sapiens
attgagtcattttatatatgaa

SEQ ID NO: 5274560 - DNA, 19 bp, Homo sapiens
attgagtctgaagcactct

SEQ ID NO: 5274561 - DNA, 21 bp, Homo sapiens
attgagtctgtccagataagt

SEQ ID NO: 5274562 - DNA, 22 bp, Homo sapiens
attgagttattaactgtatttt

SEQ ID NO: 5274563 - DNA, 18 bp, Homo sapiens
attgagttcatcatgagc

SEQ ID NO: 5274564 - DNA, 14 bp, Homo sapiens
attgagttctgaag

SEQ ID NO: 5274565 - DNA, 22 bp, Homo sapiens
attgagttggttacctattgct

SEQ ID NO: 5274566 - DNA, 15 bp, Homo sapiens
attgagttgtaaaga

SEQ ID NO: 5274567 - DNA, 16 bp, Homo sapiens
attgagtttcagaata

SEQ ID NO: 5274568 - DNA, 14 bp, Homo sapiens
attgagtttgtagg

SEQ ID NO: 5274569 - DNA, 22 bp, Homo sapiens
attgataagagggcacacactg

SEQ ID NO: 5274570 - DNA, 23 bp, Homo sapiens
attgataagagggcacacactgt

SEQ ID NO: 5274571 - DNA, 16 bp, Homo sapiens
attgataagatggttt

SEQ ID NO: 5274572 - DNA, 12 bp, Homo sapiens
attgataagttc

SEQ ID NO: 5274573 - DNA, 12 bp, Homo sapiens
attgataataaa

SEQ ID NO: 5274574 - DNA, 14 bp, Homo sapiens
attgataataaaat

SEQ ID NO: 5274575 - DNA, 13 bp, Homo sapiens
attgataataaac

SEQ ID NO: 5274576 - DNA, 15 bp, Homo sapiens
attgataatcttcag

SEQ ID NO: 5274577 - DNA, 18 bp, Homo sapiens
attgataatgctttcaca

SEQ ID NO: 5274578 - DNA, 18 bp, Homo sapiens
attgataattcaacattt

SEQ ID NO: 5274579 - DNA, 16 bp, Homo sapiens
attgatacaaagtaca

SEQ ID NO: 5274580 - DNA, 14 bp, Homo sapiens
attgatacaatatt

SEQ ID NO: 5274581 - DNA, 15 bp, Homo sapiens
attgatactctttct

SEQ ID NO: 5274582 - DNA, 21 bp, Homo sapiens
attgatactctttctaatgct

SEQ ID NO: 5274583 - DNA, 13 bp, Homo sapiens
attgatacttcag

SEQ ID NO: 5274584 - DNA, 22 bp, Homo sapiens
attgatagcaggtgtaataaga

SEQ ID NO: 5274585 - DNA, 22 bp, Homo sapiens
attgatagggagttttaaagaa

SEQ ID NO: 5274586 - DNA, 19 bp, Homo sapiens
attgatataaataaaacat

SEQ ID NO: 5274587 - DNA, 19 bp, Homo sapiens
attgatattgtgaacattt

SEQ ID NO: 5274588 - DNA, 12 bp, Homo sapiens
attgatatttct

SEQ ID NO: 5274589 - DNA, 18 bp, Homo sapiens
attgatatttgtgcattt

SEQ ID NO: 5274590 - DNA, 22 bp, Homo sapiens
attgatatttgtgcattttcta

SEQ ID NO: 5274591 - DNA, 15 bp, Homo sapiens
attgatcaaaatcaa

SEQ ID NO: 5274592 - DNA, 17 bp, Homo sapiens
attgatcaaaatcaaaa

SEQ ID NO: 5274593 - DNA, 21 bp, Homo sapiens
attgatcacagatgtgcccag

SEQ ID NO: 5274594 - DNA, 23 bp, Homo sapiens
attgatcactttgttaaaaatat

SEQ ID NO: 5274595 - DNA, 15 bp, Homo sapiens
attgatcattcataa

SEQ ID NO: 5274596 - DNA, 21 bp, Homo sapiens
attgatcattttccccccact

SEQ ID NO: 5274597 - DNA, 16 bp, Homo sapiens
attgatcatttttata

SEQ ID NO: 5274598 - DNA, 16 bp, Homo sapiens
attgatccagaaagaa

SEQ ID NO: 5274599 - DNA, 18 bp, Homo sapiens
attgatccagaaagaaaa

SEQ ID NO: 5274600 - DNA, 19 bp, Homo sapiens
attgatccagaaagaaaac

SEQ ID NO: 5274601 - DNA, 21 bp, Homo sapiens
attgatccttaaccaataatg

SEQ ID NO: 5274602 - DNA, 17 bp, Homo sapiens
attgatctaaggcatgc

SEQ ID NO: 5274603 - DNA, 19 bp, Homo sapiens
attgatctgccaaatcgtt

SEQ ID NO: 5274604 - DNA, 23 bp, Homo sapiens
attgatctgttttacaggaaaca

SEQ ID NO: 5274605 - DNA, 14 bp, Homo sapiens
attgatctgttttg

SEQ ID NO: 5274606 - DNA, 15 bp, Homo sapiens
attgatctgttttgg

SEQ ID NO: 5274607 - DNA, 20 bp, Homo sapiens
attgatctgttttggatgtt

SEQ ID NO: 5274608 - DNA, 13 bp, Homo sapiens
attgatcttaaac

SEQ ID NO: 5274609 - DNA, 17 bp, Homo sapiens
attgatcttttcagtgt

SEQ ID NO: 5274610 - DNA, 18 bp, Homo sapiens
attgatctttttatcatg

SEQ ID NO: 5274611 - DNA, 13 bp, Homo sapiens
attgatctttttt

SEQ ID NO: 5274612 - DNA, 16 bp, Homo sapiens
attgatcttttttaat

SEQ ID NO: 5274613 - DNA, 21 bp, Homo sapiens
attgatgaaaagatttaagca

SEQ ID NO: 5274614 - DNA, 22 bp, Homo sapiens
attgatgaaaagatttaagcac

SEQ ID NO: 5274615 - DNA, 14 bp, Homo sapiens
attgatgaaatcat

SEQ ID NO: 5274616 - DNA, 18 bp, Homo sapiens
attgatgaagatgtttat

SEQ ID NO: 5274617 - DNA, 23 bp, Homo sapiens
attgatgataacacttaaaattg

SEQ ID NO: 5274618 - DNA, 21 bp, Homo sapiens
attgatgataatacccacatt

SEQ ID NO: 5274619 - DNA, 17 bp, Homo sapiens
attgatgattttgtaat

SEQ ID NO: 5274620 - DNA, 13 bp, Homo sapiens
attgatgcaatat

SEQ ID NO: 5274621 - DNA, 18 bp, Homo sapiens
attgatgggatttggtca

SEQ ID NO: 5274622 - DNA, 13 bp, Homo sapiens
attgatggggaag

SEQ ID NO: 5274623 - DNA, 12 bp, Homo sapiens
attgatgtacag

SEQ ID NO: 5274624 - DNA, 14 bp, Homo sapiens
attgatgtatatgt

SEQ ID NO: 5274625 - DNA, 22 bp, Homo sapiens
atgtcctccaccacaagagctc

SEQ ID NO: 5274626 - DNA, 18 bp, Homo sapiens
atgtcctccagaagcctc

SEQ ID NO: 5274627 - DNA, 19 bp, Homo sapiens
atgtcctccagaagcctct

SEQ ID NO: 5274628 - DNA, 20 bp, Homo sapiens
atgtcctgactttgccccct

SEQ ID NO: 5274629 - DNA, 21 bp, Homo sapiens
atgtcctgactttgccccctt

SEQ ID NO: 5274630 - DNA, 13 bp, Homo sapiens
atgtcctgtaaac

SEQ ID NO: 5274631 - DNA, 13 bp, Homo sapiens
atgtcctgtcctg

SEQ ID NO: 5274632 - DNA, 18 bp, Homo sapiens
atgtcctgtcctggtcct

SEQ ID NO: 5274633 - DNA, 18 bp, Homo sapiens
atgtcctgtgtcagttta

SEQ ID NO: 5274634 - DNA, 21 bp, Homo sapiens
atgtcctgtgtcagtttatgt

SEQ ID NO: 5274635 - DNA, 17 bp, Homo sapiens
atgtccttaaaatgtgg

SEQ ID NO: 5274636 - DNA, 13 bp, Homo sapiens
atgtccttattct

SEQ ID NO: 5274637 - DNA, 14 bp, Homo sapiens
atgtccttattctt

SEQ ID NO: 5274638 - DNA, 18 bp, Homo sapiens
atgtccttggactccatc

SEQ ID NO: 5274639 - DNA, 17 bp, Homo sapiens
atgtcctttccatctgt

SEQ ID NO: 5274640 - DNA, 15 bp, Homo sapiens
atgtcctttccctgg

SEQ ID NO: 5274641 - DNA, 18 bp, Homo sapiens
atgtcctttccctggagt

SEQ ID NO: 5274642 - DNA, 14 bp, Homo sapiens
atgtcctttctcag

SEQ ID NO: 5274643 - DNA, 14 bp, Homo sapiens
atgtcgagagctgg

SEQ ID NO: 5274644 - DNA, 19 bp, Homo sapiens
atgtcgaggctagaggcat

SEQ ID NO: 5274645 - DNA, 19 bp, Homo sapiens
atgtcgatcaagagaatca

SEQ ID NO: 5274646 - DNA, 15 bp, Homo sapiens
atgtcgatgcacagt

SEQ ID NO: 5274647 - DNA, 16 bp, Homo sapiens
atgtcgattttcaata

SEQ ID NO: 5274648 - DNA, 15 bp, Homo sapiens
atgtcgctgggtcct

SEQ ID NO: 5274649 - DNA, 18 bp, Homo sapiens
atgtcgcttttgggcctc

SEQ ID NO: 5274650 - DNA, 21 bp, Homo sapiens
atgtcggcacgtcccatgtgc

SEQ ID NO: 5274651 - DNA, 15 bp, Homo sapiens
atgtcggggcccctg

SEQ ID NO: 5274652 - DNA, 14 bp, Homo sapiens
atgtcggggttggg

SEQ ID NO: 5274653 - DNA, 21 bp, Homo sapiens
atgtcggggttggggtgggag

SEQ ID NO: 5274654 - DNA, 17 bp, Homo sapiens
atgtcgtagaattcctt

SEQ ID NO: 5274655 - DNA, 22 bp, Homo sapiens
atgtcgtagttactctcaggca

SEQ ID NO: 5274656 - DNA, 16 bp, Homo sapiens
atgtcgtggactccag

SEQ ID NO: 5274657 - DNA, 23 bp, Homo sapiens
atgtcgtgttttcaaggaagaaa

SEQ ID NO: 5274658 - DNA, 18 bp, Homo sapiens
atgtctaaaagattcttt

SEQ ID NO: 5274659 - DNA, 21 bp, Homo sapiens
atgtctaaaagattctttaaa

SEQ ID NO: 5274660 - DNA, 11 bp, Homo sapiens
atgtctaaaga

SEQ ID NO: 5274661 - DNA, 17 bp, Homo sapiens
atgtctaaatgctgaaa

SEQ ID NO: 5274662 - DNA, 17 bp, Homo sapiens
atgtctaacaggacttg

SEQ ID NO: 5274663 - DNA, 23 bp, Homo sapiens
atgtctaacttaaatagctttga

SEQ ID NO: 5274664 - DNA, 18 bp, Homo sapiens
atgtctaatgtattttat

SEQ ID NO: 5274665 - DNA, 19 bp, Homo sapiens
atgtctaatgtattttatt

SEQ ID NO: 5274666 - DNA, 13 bp, Homo sapiens
atgtctaattttc

SEQ ID NO: 5274667 - DNA, 17 bp, Homo sapiens
atgtctaattttctttc

SEQ ID NO: 5274668 - DNA, 14 bp, Homo sapiens
atgtctacaaaagc

SEQ ID NO: 5274669 - DNA, 16 bp, Homo sapiens
atgtctacagaaaatg

SEQ ID NO: 5274670 - DNA, 22 bp, Homo sapiens
atgtctactttttaatttttaa

SEQ ID NO: 5274671 - DNA, 16 bp, Homo sapiens
atgtctagagaacact

SEQ ID NO: 5274672 - DNA, 19 bp, Homo sapiens
atgtctagataacattcat

SEQ ID NO: 5274673 - DNA, 23 bp, Homo sapiens
atgtctagcacatgttgatttcc

SEQ ID NO: 5274674 - DNA, 16 bp, Homo sapiens
atgtctaggataattt

SEQ ID NO: 5274675 - DNA, 17 bp, Homo sapiens
atgtctaggataatttt

SEQ ID NO: 5274676 - DNA, 16 bp, Homo sapiens
atgtctataaatggtg

SEQ ID NO: 5274677 - DNA, 17 bp, Homo sapiens
atgtctataaatggtgt

SEQ ID NO: 5274678 - DNA, 15 bp, Homo sapiens
atgtctatagagaaa

SEQ ID NO: 5274679 - DNA, 20 bp, Homo sapiens
atgtctatcaactttaatca

SEQ ID NO: 5274680 - DNA, 12 bp, Homo sapiens
atgtctatgaca

SEQ ID NO: 5274681 - DNA, 15 bp, Homo sapiens
atgtctatgatagat

SEQ ID NO: 5274682 - DNA, 14 bp, Homo sapiens
atgtctatgtgtat

SEQ ID NO: 5274683 - DNA, 19 bp, Homo sapiens
atgtctatgtgtatatatt

SEQ ID NO: 5274684 - DNA, 20 bp, Homo sapiens
atgtctatgtgtatatatta

SEQ ID NO: 5274685 - DNA, 14 bp, Homo sapiens
atgtctattccatt

SEQ ID NO: 5274686 - DNA, 18 bp, Homo sapiens
atgtctattccattccct

SEQ ID NO: 5274687 - DNA, 19 bp, Homo sapiens
atgtctattccattccctt

SEQ ID NO: 5274688 - DNA, 15 bp, Homo sapiens
atgtctatttaagcc

SEQ ID NO: 5274689 - DNA, 16 bp, Homo sapiens
atgtctatttccaaga

SEQ ID NO: 5274690 - DNA, 23 bp, Homo sapiens
atgtctcaaaaatccttatgcat

SEQ ID NO: 5274691 - DNA, 15 bp, Homo sapiens
atgtctcactgagca

SEQ ID NO: 5274692 - DNA, 18 bp, Homo sapiens
atgtctcactgagcactg

SEQ ID NO: 5274693 - DNA, 13 bp, Homo sapiens
atgtctcactgtt

SEQ ID NO: 5274694 - DNA, 16 bp, Homo sapiens
atgtctcactgttctg

SEQ ID NO: 5274695 - DNA, 19 bp, Homo sapiens
atgtctcactgttctgcaa

SEQ ID NO: 5274696 - DNA, 20 bp, Homo sapiens
atgtctcactgttctgcaaa

SEQ ID NO: 5274697 - DNA, 21 bp, Homo sapiens
atgtctcactgttctgcaaag

SEQ ID NO: 5274698 - DNA, 17 bp, Homo sapiens
atgtctcactttacttt

SEQ ID NO: 5274699 - DNA, 18 bp, Homo sapiens
atgtctcagagccttcca

SEQ ID NO: 5274700 - DNA, 14 bp, Homo sapiens
atgtctcatgtaat

SEQ ID NO: 5274701 - DNA, 17 bp, Homo sapiens
atgtctcatgtaatttg

SEQ ID NO: 5274702 - DNA, 15 bp, Homo sapiens
atgtctcatgtttta

SEQ ID NO: 5274703 - DNA, 12 bp, Homo sapiens
atgtctcccaca

SEQ ID NO: 5274704 - DNA, 13 bp, Homo sapiens
atgtctcccacac

SEQ ID NO: 5274705 - DNA, 15 bp, Homo sapiens
atgtctcctaagcac

SEQ ID NO: 5274706 - DNA, 13 bp, Homo sapiens
atgtctcctcccc

SEQ ID NO: 5274707 - DNA, 21 bp, Homo sapiens
atgtctcctctatggaaggag

SEQ ID NO: 5274708 - DNA, 15 bp, Homo sapiens
atgtctcctttgctc

SEQ ID NO: 5274709 - DNA, 19 bp, Homo sapiens
atgtctcctttgctcttgc

SEQ ID NO: 5274710 - DNA, 15 bp, Homo sapiens
atgtctcgtggtagg

SEQ ID NO: 5274711 - DNA, 15 bp, Homo sapiens
atgtctctaaagcac

SEQ ID NO: 5274712 - DNA, 16 bp, Homo sapiens
atgtctctcagaattc

SEQ ID NO: 5274713 - DNA, 19 bp, Homo sapiens
atgtctctgacaaagtgtg

SEQ ID NO: 5274714 - DNA, 17 bp, Homo sapiens
atgtctctgagcattag

SEQ ID NO: 5274715 - DNA, 16 bp, Homo sapiens
atgtctctgctcctac

SEQ ID NO: 5274716 - DNA, 14 bp, Homo sapiens
atgtctctgcttcc

SEQ ID NO: 5274717 - DNA, 12 bp, Homo sapiens
atgtctctgggg

SEQ ID NO: 5274718 - DNA, 23 bp, Homo sapiens
atgtctctgtgagactcgagaac

SEQ ID NO: 5274719 - DNA, 20 bp, Homo sapiens
atgtctcttcctctgttcta

SEQ ID NO: 5274720 - DNA, 14 bp, Homo sapiens
atgtctcttggaaa

SEQ ID NO: 5274721 - DNA, 19 bp, Homo sapiens
atgtctcttggaaatgtta

SEQ ID NO: 5274722 - DNA, 23 bp, Homo sapiens
atgtctcttggaaatgttaagaa

SEQ ID NO: 5274723 - DNA, 16 bp, Homo sapiens
atgtctcttgtagaag

SEQ ID NO: 5274724 - DNA, 14 bp, Homo sapiens
atgtctctttgcca

SEQ ID NO: 5274725 - DNA, 20 bp, Homo sapiens
atgtctgaaaagggactgtg

SEQ ID NO: 5274726 - DNA, 17 bp, Homo sapiens
atgtctgaaacagagaa

SEQ ID NO: 5274727 - DNA, 17 bp, Homo sapiens
atgtctgaactctccag

SEQ ID NO: 5274728 - DNA, 14 bp, Homo sapiens
atgtctgaactttg

SEQ ID NO: 5274729 - DNA, 23 bp, Homo sapiens
atgtctgaagtacaaacatgaaa

SEQ ID NO: 5274730 - DNA, 19 bp, Homo sapiens
atgtctgacctgcaaaaat

SEQ ID NO: 5274731 - DNA, 19 bp, Homo sapiens
atgtctgagatacgtctgt

SEQ ID NO: 5274732 - DNA, 21 bp, Homo sapiens
atgtctgagcggcgcagagcc

SEQ ID NO: 5274733 - DNA, 20 bp, Homo sapiens
atgtctgcaaaggagggcct

SEQ ID NO: 5274734 - DNA, 14 bp, Homo sapiens
atgtctgcacctcc

SEQ ID NO: 5274735 - DNA, 15 bp, Homo sapiens
atgtctgcagccctg

SEQ ID NO: 5274736 - DNA, 19 bp, Homo sapiens
atgtctgcagccctgagaa

SEQ ID NO: 5274737 - DNA, 16 bp, Homo sapiens
atgtctgcagctcaag

SEQ ID NO: 5274738 - DNA, 13 bp, Homo sapiens
atgtctgccaatt

SEQ ID NO: 5274739 - DNA, 16 bp, Homo sapiens
atgtctgccacagaga

SEQ ID NO: 5274740 - DNA, 15 bp, Homo sapiens
atgtctgccatgttg

SEQ ID NO: 5274741 - DNA, 13 bp, Homo sapiens
atgtctgcctgga

SEQ ID NO: 5274742 - DNA, 17 bp, Homo sapiens
atgtctgcctggagtgc

SEQ ID NO: 5274743 - DNA, 13 bp, Homo sapiens
atgtctgccttcg

SEQ ID NO: 5274744 - DNA, 13 bp, Homo sapiens
atgtctgctgagt

SEQ ID NO: 5274745 - DNA, 11 bp, Homo sapiens
atgtctgctgg

SEQ ID NO: 5274746 - DNA, 19 bp, Homo sapiens
atgtctgctggtatttcta

SEQ ID NO: 5274747 - DNA, 20 bp, Homo sapiens
atgtctgcttctgtccagga

SEQ ID NO: 5274748 - DNA, 16 bp, Homo sapiens
atgtctgcttgtcaaa

SEQ ID NO: 5274749 - DNA, 18 bp, Homo sapiens
atgtctgcttgtcaaaag

SEQ ID NO: 5274750 - DNA, 13 bp, Homo sapiens
atgtctggagacc

SEQ ID NO: 5274751 - DNA, 14 bp, Homo sapiens
atgtctggagacca

SEQ ID NO: 5274752 - DNA, 14 bp, Homo sapiens
atgtctggagtggt

SEQ ID NO: 5274753 - DNA, 14 bp, Homo sapiens
atgtctggcagatg

SEQ ID NO: 5274754 - DNA, 22 bp, Homo sapiens
atgtctggctcaaagcagcagg

SEQ ID NO: 5274755 - DNA, 15 bp, Homo sapiens
atgtctggctgaagc

SEQ ID NO: 5274756 - DNA, 19 bp, Homo sapiens
atgtctgggaaagcagagt

SEQ ID NO: 5274757 - DNA, 13 bp, Homo sapiens
atgtctggggaca

SEQ ID NO: 5274758 - DNA, 19 bp, Homo sapiens
atgtctggtgtttgtcatg

SEQ ID NO: 5274759 - DNA, 13 bp, Homo sapiens
atgtctggttctc

SEQ ID NO: 5274760 - DNA, 14 bp, Homo sapiens
atgtctggttctca

SEQ ID NO: 5274761 - DNA, 17 bp, Homo sapiens
atgtctgtatactcctg

SEQ ID NO: 5274762 - DNA, 19 bp, Homo sapiens
atgtctgtatccccagtgc

SEQ ID NO: 5274763 - DNA, 13 bp, Homo sapiens
atgtctgtcagaa

SEQ ID NO: 5274764 - DNA, 18 bp, Homo sapiens
atgtctgtcagaagacac

SEQ ID NO: 5274765 - DNA, 20 bp, Homo sapiens
atgtctgtcagaagacacta

SEQ ID NO: 5274766 - DNA, 15 bp, Homo sapiens
atgtctgtctttgca

SEQ ID NO: 5274767 - DNA, 17 bp, Homo sapiens
atgtctgtctttgcaaa

SEQ ID NO: 5274768 - DNA, 11 bp, Homo sapiens
atgtctgtgat

SEQ ID NO: 5274769 - DNA, 12 bp, Homo sapiens
atgtctgtgcta

SEQ ID NO: 5274770 - DNA, 20 bp, Homo sapiens
atgtctgtgctagggaaact

SEQ ID NO: 5274771 - DNA, 13 bp, Homo sapiens
atgtctgtgtata

SEQ ID NO: 5274772 - DNA, 16 bp, Homo sapiens
atgtctgtgtatacat

SEQ ID NO: 5274773 - DNA, 17 bp, Homo sapiens
atgtctgtgtatacata

SEQ ID NO: 5274774 - DNA, 13 bp, Homo sapiens
atgtctgttacca

SEQ ID NO: 5274775 - DNA, 20 bp, Homo sapiens
atgtctgttaccatgtcact

SEQ ID NO: 5274776 - DNA, 23 bp, Homo sapiens
atgtctgttaccatgtcactgtg

SEQ ID NO: 5274777 - DNA, 13 bp, Homo sapiens
atgtctgttccag

SEQ ID NO: 5274778 - DNA, 13 bp, Homo sapiens
atgtctgttcttc

SEQ ID NO: 5274779 - DNA, 16 bp, Homo sapiens
atgtctgtttttgtat

SEQ ID NO: 5274780 - DNA, 17 bp, Homo sapiens
atgtcttaaataaaact

SEQ ID NO: 5274781 - DNA, 13 bp, Homo sapiens
atgtcttaatgaa

SEQ ID NO: 5274782 - DNA, 21 bp, Homo sapiens
atgtcttaatgaagtttgaat

SEQ ID NO: 5274783 - DNA, 23 bp, Homo sapiens
atgtcttaatgaagtttgaatgt

SEQ ID NO: 5274784 - DNA, 17 bp, Homo sapiens
atgtcttactactttaa

SEQ ID NO: 5274785 - DNA, 22 bp, Homo sapiens
atgtcttactactttaaatcct

SEQ ID NO: 5274786 - DNA, 15 bp, Homo sapiens
atgtcttataagaaa

SEQ ID NO: 5274787 - DNA, 11 bp, Homo sapiens
atgtcttattt

SEQ ID NO: 5274788 - DNA, 14 bp, Homo sapiens
atgtcttattttat

SEQ ID NO: 5274789 - DNA, 21 bp, Homo sapiens
atgtcttattttattatttct

SEQ ID NO: 5274790 - DNA, 15 bp, Homo sapiens
atgtcttatttttag

SEQ ID NO: 5274791 - DNA, 17 bp, Homo sapiens
atgtcttcaaggcttca

SEQ ID NO: 5274792 - DNA, 23 bp, Homo sapiens
atgtcttcagtggaacacaaatg

SEQ ID NO: 5274793 - DNA, 15 bp, Homo sapiens
atgtcttcataaagt

SEQ ID NO: 5274794 - DNA, 23 bp, Homo sapiens
atgtcttcattggctatataaaa

SEQ ID NO: 5274795 - DNA, 17 bp, Homo sapiens
atgtcttcatttcattg

SEQ ID NO: 5274796 - DNA, 21 bp, Homo sapiens
atgtcttcattttttaatgtg

SEQ ID NO: 5274797 - DNA, 22 bp, Homo sapiens
atgtcttccatgtatcttttga

SEQ ID NO: 5274798 - DNA, 20 bp, Homo sapiens
atgtcttcgtacagttcttc

SEQ ID NO: 5274799 - DNA, 22 bp, Homo sapiens
atgtcttcgtacagttcttcgg

SEQ ID NO: 5274800 - DNA, 15 bp, Homo sapiens
atgtcttctagctgc

SEQ ID NO: 5274801 - DNA, 12 bp, Homo sapiens
atgtcttctgcc

SEQ ID NO: 5274802 - DNA, 20 bp, Homo sapiens
atgtcttctgtattcactta

SEQ ID NO: 5274803 - DNA, 14 bp, Homo sapiens
atgtcttgagatgt

SEQ ID NO: 5274804 - DNA, 16 bp, Homo sapiens
atgtcttgagatgtat

SEQ ID NO: 5274805 - DNA, 16 bp, Homo sapiens
atgtcttgagctctat

SEQ ID NO: 5274806 - DNA, 20 bp, Homo sapiens
attgatgtgattatttttct

SEQ ID NO: 5274807 - DNA, 17 bp, Homo sapiens
attgatgtgcaaaaatt

SEQ ID NO: 5274808 - DNA, 18 bp, Homo sapiens
attgatgtgcaaaaattt

SEQ ID NO: 5274809 - DNA, 20 bp, Homo sapiens
attgatgtgcaaaaattttt

SEQ ID NO: 5274810 - DNA, 16 bp, Homo sapiens
attgatgttaacaaga

SEQ ID NO: 5274811 - DNA, 13 bp, Homo sapiens
attgatgtttaca

SEQ ID NO: 5274812 - DNA, 16 bp, Homo sapiens
attgatgtttccagaa

SEQ ID NO: 5274813 - DNA, 18 bp, Homo sapiens
attgatgtttccagaaaa

SEQ ID NO: 5274814 - DNA, 21 bp, Homo sapiens
attgatgtttccagaaaatat

SEQ ID NO: 5274815 - DNA, 23 bp, Homo sapiens
attgatgtttccagaaaatataa

SEQ ID NO: 5274816 - DNA, 13 bp, Homo sapiens
attgatgttttca

SEQ ID NO: 5274817 - DNA, 16 bp, Homo sapiens
attgattaaaatctct

SEQ ID NO: 5274818 - DNA, 22 bp, Homo sapiens
attgattaaaatctcttgatta

SEQ ID NO: 5274819 - DNA, 15 bp, Homo sapiens
attgattaaattgca

SEQ ID NO: 5274820 - DNA, 19 bp, Homo sapiens
attgattaaggctttcttt

SEQ ID NO: 5274821 - DNA, 19 bp, Homo sapiens
attgattacaaataaacag

SEQ ID NO: 5274822 - DNA, 20 bp, Homo sapiens
attgattacaaataaacagt

SEQ ID NO: 5274823 - DNA, 15 bp, Homo sapiens
attgattacaattga

SEQ ID NO: 5274824 - DNA, 16 bp, Homo sapiens
attgattatataagca

SEQ ID NO: 5274825 - DNA, 18 bp, Homo sapiens
attgattatttgttttac

SEQ ID NO: 5274826 - DNA, 14 bp, Homo sapiens
attgattcaaatgt

SEQ ID NO: 5274827 - DNA, 20 bp, Homo sapiens
attgattcagtcttctggat

SEQ ID NO: 5274828 - DNA, 13 bp, Homo sapiens
attgattcctttt

SEQ ID NO: 5274829 - DNA, 22 bp, Homo sapiens
attgattccttttttcaaaatc

SEQ ID NO: 5274830 - DNA, 14 bp, Homo sapiens
attgattgaattaa

SEQ ID NO: 5274831 - DNA, 14 bp, Homo sapiens
attgattgaatttt

SEQ ID NO: 5274832 - DNA, 18 bp, Homo sapiens
attgattggataaatgct

SEQ ID NO: 5274833 - DNA, 20 bp, Homo sapiens
attgattgggaaaacatttg

SEQ ID NO: 5274834 - DNA, 21 bp, Homo sapiens
attgattgggaaaacatttgc

SEQ ID NO: 5274835 - DNA, 15 bp, Homo sapiens
attgattgtatatag

SEQ ID NO: 5274836 - DNA, 13 bp, Homo sapiens
attgattgtattg

SEQ ID NO: 5274837 - DNA, 13 bp, Homo sapiens
attgatttaaaag

SEQ ID NO: 5274838 - DNA, 15 bp, Homo sapiens
attgatttaaaagtg

SEQ ID NO: 5274839 - DNA, 17 bp, Homo sapiens
attgatttaaaagtgta

SEQ ID NO: 5274840 - DNA, 21 bp, Homo sapiens
attgatttaagctttcctgtt

SEQ ID NO: 5274841 - DNA, 18 bp, Homo sapiens
attgatttacctttggaa

SEQ ID NO: 5274842 - DNA, 20 bp, Homo sapiens
attgatttacctttggaatt

SEQ ID NO: 5274843 - DNA, 13 bp, Homo sapiens
attgatttcaaga

SEQ ID NO: 5274844 - DNA, 16 bp, Homo sapiens
attgatttcaagacct

SEQ ID NO: 5274845 - DNA, 22 bp, Homo sapiens
attgatttctacgttatgaaaa

SEQ ID NO: 5274846 - DNA, 15 bp, Homo sapiens
attgatttctgcctt

SEQ ID NO: 5274847 - DNA, 21 bp, Homo sapiens
attgatttctgccttccttgc

SEQ ID NO: 5274848 - DNA, 16 bp, Homo sapiens
attgatttgaagaaca

SEQ ID NO: 5274849 - DNA, 15 bp, Homo sapiens
attgatttgaagtgg

SEQ ID NO: 5274850 - DNA, 12 bp, Homo sapiens
attgatttgacc

SEQ ID NO: 5274851 - DNA, 14 bp, Homo sapiens
attgatttgattgg

SEQ ID NO: 5274852 - DNA, 13 bp, Homo sapiens
attgatttgcatt

SEQ ID NO: 5274853 - DNA, 16 bp, Homo sapiens
attgatttgcattgaa

SEQ ID NO: 5274854 - DNA, 20 bp, Homo sapiens
attgatttgtcccagaattt

SEQ ID NO: 5274855 - DNA, 19 bp, Homo sapiens
attgattttaaaatgtaca

SEQ ID NO: 5274856 - DNA, 17 bp, Homo sapiens
attgattttaaatataa

SEQ ID NO: 5274857 - DNA, 22 bp, Homo sapiens
attgattttaaatataagtaat

SEQ ID NO: 5274858 - DNA, 12 bp, Homo sapiens
attgattttgaa

SEQ ID NO: 5274859 - DNA, 13 bp, Homo sapiens
attgatttttaaa

SEQ ID NO: 5274860 - DNA, 19 bp, Homo sapiens
attgatttttaaagtttaa

SEQ ID NO: 5274861 - DNA, 23 bp, Homo sapiens
attgatttttaaagtttaaatac

SEQ ID NO: 5274862 - DNA, 18 bp, Homo sapiens
attgatttttctcttcat

SEQ ID NO: 5274863 - DNA, 15 bp, Homo sapiens
attgatttttcttct

SEQ ID NO: 5274864 - DNA, 22 bp, Homo sapiens
attgatttttcttcttttactt

SEQ ID NO: 5274865 - DNA, 17 bp, Homo sapiens
attgattttttttctct

SEQ ID NO: 5274866 - DNA, 21 bp, Homo sapiens
attgcaaaactagacaaaagt

SEQ ID NO: 5274867 - DNA, 22 bp, Homo sapiens
attgcaaaactagacaaaagtt

SEQ ID NO: 5274868 - DNA, 20 bp, Homo sapiens
attgcaaaaggttaagccat

SEQ ID NO: 5274869 - DNA, 21 bp, Homo sapiens
attgcaaaaggttaagccata

SEQ ID NO: 5274870 - DNA, 14 bp, Homo sapiens
attgcaaaatacat

SEQ ID NO: 5274871 - DNA, 18 bp, Homo sapiens
attgcaaaatacatgaag

SEQ ID NO: 5274872 - DNA, 19 bp, Homo sapiens
attgcaaaatacatgaagc

SEQ ID NO: 5274873 - DNA, 14 bp, Homo sapiens
attgcaaaatagaa

SEQ ID NO: 5274874 - DNA, 23 bp, Homo sapiens
attgcaaaatagaagaagaggaa

SEQ ID NO: 5274875 - DNA, 15 bp, Homo sapiens
attgcaaaatagcat

SEQ ID NO: 5274876 - DNA, 23 bp, Homo sapiens
attgcaaaatgcgtatttgcatt

SEQ ID NO: 5274877 - DNA, 20 bp, Homo sapiens
attgcaaacaactgaaatgt

SEQ ID NO: 5274878 - DNA, 21 bp, Homo sapiens
attgcaaagaaaattctcaag

SEQ ID NO: 5274879 - DNA, 19 bp, Homo sapiens
attgcaaagggacattgaa

SEQ ID NO: 5274880 - DNA, 10 bp, Homo sapiens
attgcaaagt

SEQ ID NO: 5274881 - DNA, 12 bp, Homo sapiens
attgcaaatatt

SEQ ID NO: 5274882 - DNA, 19 bp, Homo sapiens
attgcaaatcttgaaatta

SEQ ID NO: 5274883 - DNA, 16 bp, Homo sapiens
attgcaacccagggca

SEQ ID NO: 5274884 - DNA, 21 bp, Homo sapiens
attgcaacctccaccttctgg

SEQ ID NO: 5274885 - DNA, 23 bp, Homo sapiens
attgcaagaagctttatttctag

SEQ ID NO: 5274886 - DNA, 22 bp, Homo sapiens
attgcaagtgaaataatattga

SEQ ID NO: 5274887 - DNA, 16 bp, Homo sapiens
attgcaatatctgaag

SEQ ID NO: 5274888 - DNA, 13 bp, Homo sapiens
attgcaattaaac

SEQ ID NO: 5274889 - DNA, 13 bp, Homo sapiens
attgcacaatata

SEQ ID NO: 5274890 - DNA, 19 bp, Homo sapiens
attgcacaatatattttta

SEQ ID NO: 5274891 - DNA, 11 bp, Homo sapiens
attgcacaatt

SEQ ID NO: 5274892 - DNA, 19 bp, Homo sapiens
attgcacacacagtctgtt

SEQ ID NO: 5274893 - DNA, 22 bp, Homo sapiens
attgcacagagcacacttattt

SEQ ID NO: 5274894 - DNA, 20 bp, Homo sapiens
attgcacagtaggatgtgga

SEQ ID NO: 5274895 - DNA, 15 bp, Homo sapiens
attgcacatctaaca

SEQ ID NO: 5274896 - DNA, 18 bp, Homo sapiens
attgcacatgtcttaatg

SEQ ID NO: 5274897 - DNA, 23 bp, Homo sapiens
attgcaccactgcactccagcct

SEQ ID NO: 5274898 - DNA, 18 bp, Homo sapiens
attgcaccagaaatgttt

SEQ ID NO: 5274899 - DNA, 23 bp, Homo sapiens
attgcaccatactccttgcttcc

SEQ ID NO: 5274900 - DNA, 19 bp, Homo sapiens
attgcaccattttcaattt

SEQ ID NO: 5274901 - DNA, 19 bp, Homo sapiens
attgcacctatctcagcca

SEQ ID NO: 5274902 - DNA, 20 bp, Homo sapiens
attgcacctatctcagccat

SEQ ID NO: 5274903 - DNA, 15 bp, Homo sapiens
attgcacctgcaggc

SEQ ID NO: 5274904 - DNA, 17 bp, Homo sapiens
attgcacgtgcctgtgg

SEQ ID NO: 5274905 - DNA, 23 bp, Homo sapiens
attgcacgtgcctgtgggcctgg

SEQ ID NO: 5274906 - DNA, 19 bp, Homo sapiens
attgcacgtggcctcttga

SEQ ID NO: 5274907 - DNA, 10 bp, Homo sapiens
attgcactaa

SEQ ID NO: 5274908 - DNA, 14 bp, Homo sapiens
attgcactaaaagt

SEQ ID NO: 5274909 - DNA, 11 bp, Homo sapiens
attgcactagg

SEQ ID NO: 5274910 - DNA, 13 bp, Homo sapiens
attgcactatgaa

SEQ ID NO: 5274911 - DNA, 15 bp, Homo sapiens
attgcactccagcct

SEQ ID NO: 5274912 - DNA, 20 bp, Homo sapiens
attgcactccagcctgggtg

SEQ ID NO: 5274913 - DNA, 19 bp, Homo sapiens
attgcactctagcctggca

SEQ ID NO: 5274914 - DNA, 23 bp, Homo sapiens
attgcactgaagtttttgaaata

SEQ ID NO: 5274915 - DNA, 15 bp, Homo sapiens
attgcactgctgttc

SEQ ID NO: 5274916 - DNA, 16 bp, Homo sapiens
attgcactgttctgat

SEQ ID NO: 5274917 - DNA, 21 bp, Homo sapiens
attgcacttcggataattttc

SEQ ID NO: 5274918 - DNA, 22 bp, Homo sapiens
attgcacttcggataattttca

SEQ ID NO: 5274919 - DNA, 23 bp, Homo sapiens
attgcacttcggataattttcat

SEQ ID NO: 5274920 - DNA, 22 bp, Homo sapiens
attgcacttgattaagcttttg

SEQ ID NO: 5274921 - DNA, 20 bp, Homo sapiens
attgcactttcctttcaata

SEQ ID NO: 5274922 - DNA, 16 bp, Homo sapiens
attgcactttttaagt

SEQ ID NO: 5274923 - DNA, 16 bp, Homo sapiens
attgcagaaaggagag

SEQ ID NO: 5274924 - DNA, 17 bp, Homo sapiens
attgcagaaaggagaga

SEQ ID NO: 5274925 - DNA, 21 bp, Homo sapiens
attgcagaacatgagtgctga

SEQ ID NO: 5274926 - DNA, 20 bp, Homo sapiens
attgcagaactaaactcatt

SEQ ID NO: 5274927 - DNA, 19 bp, Homo sapiens
attgcagaagaaactcctg

SEQ ID NO: 5274928 - DNA, 13 bp, Homo sapiens
attgcagaattgt

SEQ ID NO: 5274929 - DNA, 16 bp, Homo sapiens
attgcagaattgttta

SEQ ID NO: 5274930 - DNA, 20 bp, Homo sapiens
attgcagaattgtttagatt

SEQ ID NO: 5274931 - DNA, 14 bp, Homo sapiens
attgcagacctgtc

SEQ ID NO: 5274932 - DNA, 17 bp, Homo sapiens
attgcagacctgtcacc

SEQ ID NO: 5274933 - DNA, 17 bp, Homo sapiens
attgcagactgttctta

SEQ ID NO: 5274934 - DNA, 16 bp, Homo sapiens
attgcagatatgggac

SEQ ID NO: 5274935 - DNA, 16 bp, Homo sapiens
attgcagatatttgat

SEQ ID NO: 5274936 - DNA, 17 bp, Homo sapiens
attgcagatatttgatg

SEQ ID NO: 5274937 - DNA, 23 bp, Homo sapiens
attgcagatcccagcccaccctg

SEQ ID NO: 5274938 - DNA, 16 bp, Homo sapiens
attgcagattgaatat

SEQ ID NO: 5274939 - DNA, 16 bp, Homo sapiens
attgcagcagataact

SEQ ID NO: 5274940 - DNA, 19 bp, Homo sapiens
attgcagcctaagaagaag

SEQ ID NO: 5274941 - DNA, 23 bp, Homo sapiens
attgcagcctaagaagaaggcca

SEQ ID NO: 5274942 - DNA, 20 bp, Homo sapiens
attgcagctcactgctgctg

SEQ ID NO: 5274943 - DNA, 17 bp, Homo sapiens
attgcaggaccttgggc

SEQ ID NO: 5274944 - DNA, 18 bp, Homo sapiens
attgcaggtgcctggctt

SEQ ID NO: 5274945 - DNA, 23 bp, Homo sapiens
attgcagtctaaaacttcaaaaa

SEQ ID NO: 5274946 - DNA, 21 bp, Homo sapiens
attgcagtgcggctcacatca

SEQ ID NO: 5274947 - DNA, 14 bp, Homo sapiens
attgcagttagccc

SEQ ID NO: 5274948 - DNA, 17 bp, Homo sapiens
attgcagttagccccag

SEQ ID NO: 5274949 - DNA, 20 bp, Homo sapiens
attgcagttcaaatcctcac

SEQ ID NO: 5274950 - DNA, 18 bp, Homo sapiens
attgcagttcatactgaa

SEQ ID NO: 5274951 - DNA, 19 bp, Homo sapiens
attgcagttctgattcatt

SEQ ID NO: 5274952 - DNA, 13 bp, Homo sapiens
attgcagtttaca

SEQ ID NO: 5274953 - DNA, 17 bp, Homo sapiens
attgcagtttacagtat

SEQ ID NO: 5274954 - DNA, 21 bp, Homo sapiens
attgcagtttacagtatttct

SEQ ID NO: 5274955 - DNA, 14 bp, Homo sapiens
attgcagtttatat

SEQ ID NO: 5274956 - DNA, 16 bp, Homo sapiens
attgcagtttcatgta

SEQ ID NO: 5274957 - DNA, 17 bp, Homo sapiens
attgcagtttcatgtat

SEQ ID NO: 5274958 - DNA, 15 bp, Homo sapiens
attgcataaagcata

SEQ ID NO: 5274959 - DNA, 15 bp, Homo sapiens
attgcatactttgta

SEQ ID NO: 5274960 - DNA, 16 bp, Homo sapiens
attgcatataacttat

SEQ ID NO: 5274961 - DNA, 22 bp, Homo sapiens
attgcatataacttatattgta

SEQ ID NO: 5274962 - DNA, 17 bp, Homo sapiens
attgcatatagatttag

SEQ ID NO: 5274963 - DNA, 14 bp, Homo sapiens
attgcatcagttca

SEQ ID NO: 5274964 - DNA, 13 bp, Homo sapiens
attgcatcatgaa

SEQ ID NO: 5274965 - DNA, 15 bp, Homo sapiens
attgcatcatttaca

SEQ ID NO: 5274966 - DNA, 13 bp, Homo sapiens
attgcatccacta

SEQ ID NO: 5274967 - DNA, 15 bp, Homo sapiens
attgcatctcccaga

SEQ ID NO: 5274968 - DNA, 23 bp, Homo sapiens
attgcatctcccagataatgtga

SEQ ID NO: 5274969 - DNA, 20 bp, Homo sapiens
attgcatctgggtagctgta

SEQ ID NO: 5274970 - DNA, 14 bp, Homo sapiens
attgcatctgtata

SEQ ID NO: 5274971 - DNA, 18 bp, Homo sapiens
attgcatgaaaatagcta

SEQ ID NO: 5274972 - DNA, 20 bp, Homo sapiens
attgcatgaattcacaaaca

SEQ ID NO: 5274973 - DNA, 19 bp, Homo sapiens
attgcatgtattgtaaaca

SEQ ID NO: 5274974 - DNA, 13 bp, Homo sapiens
attgcatgtgact

SEQ ID NO: 5274975 - DNA, 15 bp, Homo sapiens
attgcatgtgactct

SEQ ID NO: 5274976 - DNA, 18 bp, Homo sapiens
attgcatgtgactctgaa

SEQ ID NO: 5274977 - DNA, 23 bp, Homo sapiens
attgcattaaatataatatgcac

SEQ ID NO: 5274978 - DNA, 23 bp, Homo sapiens
attgcattctattgccttctttg

SEQ ID NO: 5274979 - DNA, 11 bp, Homo sapiens
attgcattgac

SEQ ID NO: 5274980 - DNA, 15 bp, Homo sapiens
attgcattgactttc

SEQ ID NO: 5274981 - DNA, 21 bp, Homo sapiens
attgcatttccagaaatctgc

SEQ ID NO: 5274982 - DNA, 21 bp, Homo sapiens
attgcattttttaaaacaaga

SEQ ID NO: 5274983 - DNA, 16 bp, Homo sapiens
attgccaaaacccagc

SEQ ID NO: 5274984 - DNA, 23 bp, Homo sapiens
atgtcttgatgcatgcactgttc

SEQ ID NO: 5274985 - DNA, 20 bp, Homo sapiens
atgtcttggacactgtacaa

SEQ ID NO: 5274986 - DNA, 23 bp, Homo sapiens
atgtcttggtacttgctgctatt

SEQ ID NO: 5274987 - DNA, 14 bp, Homo sapiens
atgtcttgtacatg

SEQ ID NO: 5274988 - DNA, 20 bp, Homo sapiens
atgtcttgtatttaaaaaca

SEQ ID NO: 5274989 - DNA, 17 bp, Homo sapiens
atgtcttgtcatacaaa

SEQ ID NO: 5274990 - DNA, 22 bp, Homo sapiens
atgtcttgtcatacaaatttat

SEQ ID NO: 5274991 - DNA, 15 bp, Homo sapiens
atgtcttgtgtattt

SEQ ID NO: 5274992 - DNA, 21 bp, Homo sapiens
atgtcttgtgtatttctctgt

SEQ ID NO: 5274993 - DNA, 20 bp, Homo sapiens
atgtcttgttaatattcttt

SEQ ID NO: 5274994 - DNA, 15 bp, Homo sapiens
atgtcttgttcttga

SEQ ID NO: 5274995 - DNA, 13 bp, Homo sapiens
atgtctttaaaat

SEQ ID NO: 5274996 - DNA, 23 bp, Homo sapiens
atgtctttactggacctgaaatt

SEQ ID NO: 5274997 - DNA, 18 bp, Homo sapiens
atgtctttccaaattatt

SEQ ID NO: 5274998 - DNA, 21 bp, Homo sapiens
atgtctttggtcctcttgcca

SEQ ID NO: 5274999 - DNA, 13 bp, Homo sapiens
atgtcttttaaaa

SEQ ID NO: 5275000 - DNA, 22 bp, Homo sapiens
atgtcttttaataaaaaggaaa

SEQ ID NO: 5275001 - DNA, 23 bp, Homo sapiens
atgtcttttaataaaaaggaaat

SEQ ID NO: 5275002 - DNA, 14 bp, Homo sapiens
atgtcttttatagt

SEQ ID NO: 5275003 - DNA, 19 bp, Homo sapiens
atgtcttttatagtggaaa

SEQ ID NO: 5275004 - DNA, 20 bp, Homo sapiens
atgtcttttatagtggaaaa

SEQ ID NO: 5275005 - DNA, 21 bp, Homo sapiens
atgtcttttatagtggaaaaa

SEQ ID NO: 5275006 - DNA, 16 bp, Homo sapiens
atgtcttttatatttg

SEQ ID NO: 5275007 - DNA, 17 bp, Homo sapiens
atgtcttttatatttgt

SEQ ID NO: 5275008 - DNA, 21 bp, Homo sapiens
atgtcttttatatttgtatcg

SEQ ID NO: 5275009 - DNA, 18 bp, Homo sapiens
atgtcttttcaaaaggat

SEQ ID NO: 5275010 - DNA, 17 bp, Homo sapiens
atgtcttttcccattta

SEQ ID NO: 5275011 - DNA, 14 bp, Homo sapiens
atgtcttttcttgc

SEQ ID NO: 5275012 - DNA, 15 bp, Homo sapiens
atgtcttttcttggc

SEQ ID NO: 5275013 - DNA, 18 bp, Homo sapiens
atgtctttttaagcttat

SEQ ID NO: 5275014 - DNA, 15 bp, Homo sapiens
atgtctttttattaa

SEQ ID NO: 5275015 - DNA, 21 bp, Homo sapiens
atgtcttttttcaaactttat

SEQ ID NO: 5275016 - DNA, 19 bp, Homo sapiens
atgtcttttttttaatgtg

SEQ ID NO: 5275017 - DNA, 22 bp, Homo sapiens
atgtgaaaaaaaaaagtaatta

SEQ ID NO: 5275018 - DNA, 17 bp, Homo sapiens
atgtgaaaaaaattatt

SEQ ID NO: 5275019 - DNA, 22 bp, Homo sapiens
atgtgaaaaagcctaagaaaaa

SEQ ID NO: 5275020 - DNA, 15 bp, Homo sapiens
atgtgaaaaaggaat

SEQ ID NO: 5275021 - DNA, 13 bp, Homo sapiens
atgtgaaaaatct

SEQ ID NO: 5275022 - DNA, 14 bp, Homo sapiens
atgtgaaaaatctg

SEQ ID NO: 5275023 - DNA, 15 bp, Homo sapiens
atgtgaaaaattaac

SEQ ID NO: 5275024 - DNA, 17 bp, Homo sapiens
atgtgaaaaattaactt

SEQ ID NO: 5275025 - DNA, 19 bp, Homo sapiens
atgtgaaaaattaactttt

SEQ ID NO: 5275026 - DNA, 22 bp, Homo sapiens
atgtgaaaagcacagctgtata

SEQ ID NO: 5275027 - DNA, 13 bp, Homo sapiens
atgtgaaaagtat

SEQ ID NO: 5275028 - DNA, 18 bp, Homo sapiens
atgtgaaaataaagcaga

SEQ ID NO: 5275029 - DNA, 13 bp, Homo sapiens
atgtgaaaatata

SEQ ID NO: 5275030 - DNA, 18 bp, Homo sapiens
atgtgaaaatatacttga

SEQ ID NO: 5275031 - DNA, 18 bp, Homo sapiens
atgtgaaaatcaaataca

SEQ ID NO: 5275032 - DNA, 13 bp, Homo sapiens
atgtgaaaatcat

SEQ ID NO: 5275033 - DNA, 12 bp, Homo sapiens
atgtgaaaatga

SEQ ID NO: 5275034 - DNA, 21 bp, Homo sapiens
atgtgaaaatggtccaggaga

SEQ ID NO: 5275035 - DNA, 22 bp, Homo sapiens
atgtgaaaatggtccaggagaa

SEQ ID NO: 5275036 - DNA, 22 bp, Homo sapiens
atgtgaaacatccgttttcatt

SEQ ID NO: 5275037 - DNA, 17 bp, Homo sapiens
atgtgaaacatcttctc

SEQ ID NO: 5275038 - DNA, 22 bp, Homo sapiens
atgtgaaaccttttttaagatt

SEQ ID NO: 5275039 - DNA, 18 bp, Homo sapiens
atgtgaaagatgcatgtt

SEQ ID NO: 5275040 - DNA, 14 bp, Homo sapiens
atgtgaaagattat

SEQ ID NO: 5275041 - DNA, 12 bp, Homo sapiens
atgtgaaagcac

SEQ ID NO: 5275042 - DNA, 18 bp, Homo sapiens
atgtgaaaggaacatttt

SEQ ID NO: 5275043 - DNA, 18 bp, Homo sapiens
atgtgaaatcattcattt

SEQ ID NO: 5275044 - DNA, 10 bp, Homo sapiens
atgtgaaatt

SEQ ID NO: 5275045 - DNA, 14 bp, Homo sapiens
atgtgaaattcatt

SEQ ID NO: 5275046 - DNA, 19 bp, Homo sapiens
atgtgaaattcatttgtgg

SEQ ID NO: 5275047 - DNA, 23 bp, Homo sapiens
atgtgaaatttacatcatttctt

SEQ ID NO: 5275048 - DNA, 21 bp, Homo sapiens
atgtgaacaaatcaaattgct

SEQ ID NO: 5275049 - DNA, 22 bp, Homo sapiens
atgtgaacaaatcaaattgctt

SEQ ID NO: 5275050 - DNA, 12 bp, Homo sapiens
atgtgaaccatt

SEQ ID NO: 5275051 - DNA, 17 bp, Homo sapiens
atgtgaacgtccttcct

SEQ ID NO: 5275052 - DNA, 19 bp, Homo sapiens
atgtgaactagctggaatt

SEQ ID NO: 5275053 - DNA, 18 bp, Homo sapiens
atgtgaactctcccctcc

SEQ ID NO: 5275054 - DNA, 19 bp, Homo sapiens
atgtgaactctcccctccc

SEQ ID NO: 5275055 - DNA, 12 bp, Homo sapiens
atgtgaacttgt

SEQ ID NO: 5275056 - DNA, 23 bp, Homo sapiens
atgtgaacttgtagctgtaaaac

SEQ ID NO: 5275057 - DNA, 22 bp, Homo sapiens
atgtgaactttctcagcatata

SEQ ID NO: 5275058 - DNA, 11 bp, Homo sapiens
atgtgaagaaa

SEQ ID NO: 5275059 - DNA, 11 bp, Homo sapiens
atgtgaagaat

SEQ ID NO: 5275060 - DNA, 16 bp, Homo sapiens
atgtgaagaatttaga

SEQ ID NO: 5275061 - DNA, 22 bp, Homo sapiens
atgtgaagacacctgcagcctt

SEQ ID NO: 5275062 - DNA, 18 bp, Homo sapiens
atgtgaagagaattatta

SEQ ID NO: 5275063 - DNA, 23 bp, Homo sapiens
atgtgaagaggtctgattggctg

SEQ ID NO: 5275064 - DNA, 19 bp, Homo sapiens
atgtgaagataatttgcat

SEQ ID NO: 5275065 - DNA, 20 bp, Homo sapiens
atgtgaagcatgctttgctg

SEQ ID NO: 5275066 - DNA, 22 bp, Homo sapiens
atgtgaagcatgctttgctgct

SEQ ID NO: 5275067 - DNA, 17 bp, Homo sapiens
atgtgaagccttcccct

SEQ ID NO: 5275068 - DNA, 17 bp, Homo sapiens
atgtgaagctcacactg

SEQ ID NO: 5275069 - DNA, 21 bp, Homo sapiens
atgtgaagctgaaccccctcc

SEQ ID NO: 5275070 - DNA, 18 bp, Homo sapiens
atgtgaaggacatgagac

SEQ ID NO: 5275071 - DNA, 19 bp, Homo sapiens
atgtgaaggacatgagact

SEQ ID NO: 5275072 - DNA, 14 bp, Homo sapiens
atgtgaagggtggg

SEQ ID NO: 5275073 - DNA, 18 bp, Homo sapiens
atgtgaaggtgtttcaaa

SEQ ID NO: 5275074 - DNA, 21 bp, Homo sapiens
atgtgaagtcaccagtggcct

SEQ ID NO: 5275075 - DNA, 16 bp, Homo sapiens
atgtgaagtgttaata

SEQ ID NO: 5275076 - DNA, 18 bp, Homo sapiens
atgtgaagttcatcttgc

SEQ ID NO: 5275077 - DNA, 19 bp, Homo sapiens
atgtgaataggttatatgc

SEQ ID NO: 5275078 - DNA, 19 bp, Homo sapiens
atgtgaatatggacagtta

SEQ ID NO: 5275079 - DNA, 16 bp, Homo sapiens
atgtgaatcagaccct

SEQ ID NO: 5275080 - DNA, 18 bp, Homo sapiens
atgtgaatgaatacacag

SEQ ID NO: 5275081 - DNA, 14 bp, Homo sapiens
atgtgaatgtggca

SEQ ID NO: 5275082 - DNA, 22 bp, Homo sapiens
atgtgaattactaacttctaaa

SEQ ID NO: 5275083 - DNA, 20 bp, Homo sapiens
atgtgaattattgacactga

SEQ ID NO: 5275084 - DNA, 19 bp, Homo sapiens
atgtgaattctgtgaagaa

SEQ ID NO: 5275085 - DNA, 18 bp, Homo sapiens
atgtgaattgcctgcaga

SEQ ID NO: 5275086 - DNA, 23 bp, Homo sapiens
atgtgaattgttagtttctgagt

SEQ ID NO: 5275087 - DNA, 10 bp, Homo sapiens
atgtgaattt

SEQ ID NO: 5275088 - DNA, 18 bp, Homo sapiens
atgtgaatttcaactttt

SEQ ID NO: 5275089 - DNA, 16 bp, Homo sapiens
atgtgaatttttaagc

SEQ ID NO: 5275090 - DNA, 18 bp, Homo sapiens
atgtgaatttttaagctg

SEQ ID NO: 5275091 - DNA, 21 bp, Homo sapiens
atgtgaatttttaagctgcaa

SEQ ID NO: 5275092 - DNA, 13 bp, Homo sapiens
atgtgacaaaatt

SEQ ID NO: 5275093 - DNA, 13 bp, Homo sapiens
atgtgacaacatt

SEQ ID NO: 5275094 - DNA, 19 bp, Homo sapiens
atgtgacaacctttgtgta

SEQ ID NO: 5275095 - DNA, 14 bp, Homo sapiens
atgtgacacccaca

SEQ ID NO: 5275096 - DNA, 18 bp, Homo sapiens
atgtgacacctaactctt

SEQ ID NO: 5275097 - DNA, 16 bp, Homo sapiens
atgtgacaggtaaact

SEQ ID NO: 5275098 - DNA, 22 bp, Homo sapiens
atgtgacatgcccaaggccacg

SEQ ID NO: 5275099 - DNA, 19 bp, Homo sapiens
atgtgacatgcgggctggg

SEQ ID NO: 5275100 - DNA, 19 bp, Homo sapiens
atgtgacattccatgacga

SEQ ID NO: 5275101 - DNA, 22 bp, Homo sapiens
atgtgacattccatgacgacat

SEQ ID NO: 5275102 - DNA, 14 bp, Homo sapiens
atgtgacatttgtc

SEQ ID NO: 5275103 - DNA, 22 bp, Homo sapiens
atgtgacatttgtcattttcat

SEQ ID NO: 5275104 - DNA, 16 bp, Homo sapiens
atgtgacattttacat

SEQ ID NO: 5275105 - DNA, 18 bp, Homo sapiens
atgtgaccacatacgtgt

SEQ ID NO: 5275106 - DNA, 13 bp, Homo sapiens
atgtgaccatgtg

SEQ ID NO: 5275107 - DNA, 17 bp, Homo sapiens
atgtgaccatgtgaatc

SEQ ID NO: 5275108 - DNA, 19 bp, Homo sapiens
atgtgaccatgtgaatctg

SEQ ID NO: 5275109 - DNA, 18 bp, Homo sapiens
atgtgaccattctgcctc

SEQ ID NO: 5275110 - DNA, 20 bp, Homo sapiens
atgtgacccagatcctcaca

SEQ ID NO: 5275111 - DNA, 14 bp, Homo sapiens
atgtgactaaagga

SEQ ID NO: 5275112 - DNA, 22 bp, Homo sapiens
atgtgactaaaggaaaaaactt

SEQ ID NO: 5275113 - DNA, 21 bp, Homo sapiens
atgtgactagcgcctggcctt

SEQ ID NO: 5275114 - DNA, 21 bp, Homo sapiens
atgtgactccatatcccggga

SEQ ID NO: 5275115 - DNA, 15 bp, Homo sapiens
atgtgactctggctt

SEQ ID NO: 5275116 - DNA, 19 bp, Homo sapiens
atgtgactggttcagaaat

SEQ ID NO: 5275117 - DNA, 17 bp, Homo sapiens
atgtgacttgcaataaa

SEQ ID NO: 5275118 - DNA, 16 bp, Homo sapiens
atgtgacttgcgctta

SEQ ID NO: 5275119 - DNA, 20 bp, Homo sapiens
atgtgacttggattcaattt

SEQ ID NO: 5275120 - DNA, 13 bp, Homo sapiens
atgtgactttgaa

SEQ ID NO: 5275121 - DNA, 20 bp, Homo sapiens
atgtgacttttatatgcttt

SEQ ID NO: 5275122 - DNA, 15 bp, Homo sapiens
atgtgacttttctga

SEQ ID NO: 5275123 - DNA, 16 bp, Homo sapiens
atgtgacttttctgat

SEQ ID NO: 5275124 - DNA, 17 bp, Homo sapiens
atgtgacttttctgatt

SEQ ID NO: 5275125 - DNA, 20 bp, Homo sapiens
atgtgacttttctgattaat

SEQ ID NO: 5275126 - DNA, 18 bp, Homo sapiens
atgtgactttttttggta

SEQ ID NO: 5275127 - DNA, 21 bp, Homo sapiens
atgtgactttttttggtataa

SEQ ID NO: 5275128 - DNA, 19 bp, Homo sapiens
atgtgagaaagctaaaatg

SEQ ID NO: 5275129 - DNA, 12 bp, Homo sapiens
atgtgagaaatc

SEQ ID NO: 5275130 - DNA, 15 bp, Homo sapiens
atgtgagaaatgtct

SEQ ID NO: 5275131 - DNA, 19 bp, Homo sapiens
atgtgagaacattaggccc

SEQ ID NO: 5275132 - DNA, 15 bp, Homo sapiens
atgtgagaacttttc

SEQ ID NO: 5275133 - DNA, 14 bp, Homo sapiens
atgtgagacagcaa

SEQ ID NO: 5275134 - DNA, 17 bp, Homo sapiens
atgtgagacagcaagtt

SEQ ID NO: 5275135 - DNA, 17 bp, Homo sapiens
atgtgagaggtttgact

SEQ ID NO: 5275136 - DNA, 19 bp, Homo sapiens
atgtgagatagttttcatt

SEQ ID NO: 5275137 - DNA, 18 bp, Homo sapiens
atgtgagatggttcccaa

SEQ ID NO: 5275138 - DNA, 17 bp, Homo sapiens
atgtgagatttccttat

SEQ ID NO: 5275139 - DNA, 16 bp, Homo sapiens
atgtgagcactatctt

SEQ ID NO: 5275140 - DNA, 11 bp, Homo sapiens
atgtgagcaga

SEQ ID NO: 5275141 - DNA, 21 bp, Homo sapiens
atgtgagcagaagactattta

SEQ ID NO: 5275142 - DNA, 19 bp, Homo sapiens
atgtgagccaccgctgcca

SEQ ID NO: 5275143 - DNA, 21 bp, Homo sapiens
atgtgagccaccgtgcctggc

SEQ ID NO: 5275144 - DNA, 11 bp, Homo sapiens
atgtgagcccc

SEQ ID NO: 5275145 - DNA, 15 bp, Homo sapiens
atgtgagccccaggg

SEQ ID NO: 5275146 - DNA, 16 bp, Homo sapiens
atgtgagccccagggg

SEQ ID NO: 5275147 - DNA, 22 bp, Homo sapiens
atgtgagccgcctcggagtgtg

SEQ ID NO: 5275148 - DNA, 23 bp, Homo sapiens
atgtgagctaggagaagggctga

SEQ ID NO: 5275149 - DNA, 19 bp, Homo sapiens
atgtgagctataatgtttc

SEQ ID NO: 5275150 - DNA, 15 bp, Homo sapiens
atgtgagctgctgcc

SEQ ID NO: 5275151 - DNA, 23 bp, Homo sapiens
atgtgagctgctgccatgaactg

SEQ ID NO: 5275152 - DNA, 21 bp, Homo sapiens
atgtgagctgtaaaaatgtta

SEQ ID NO: 5275153 - DNA, 20 bp, Homo sapiens
atgtgaggaactcacatact

SEQ ID NO: 5275154 - DNA, 22 bp, Homo sapiens
atgtgaggaactcacatactga

SEQ ID NO: 5275155 - DNA, 20 bp, Homo sapiens
atgtgagggcaccaccaaga

SEQ ID NO: 5275156 - DNA, 17 bp, Homo sapiens
atgtgaggggaatctgg

SEQ ID NO: 5275157 - DNA, 18 bp, Homo sapiens
atgtgaggggaatctgga

SEQ ID NO: 5275158 - DNA, 16 bp, Homo sapiens
atgtgagtatttctgt

SEQ ID NO: 5275159 - DNA, 20 bp, Homo sapiens
atgtgagtcattatgtagct

SEQ ID NO: 5275160 - DNA, 21 bp, Homo sapiens
atgtgagtcccagagcccgct

SEQ ID NO: 5275161 - DNA, 17 bp, Homo sapiens
attgccaaaacccagct

SEQ ID NO: 5275162 - DNA, 18 bp, Homo sapiens
attgccaaaacccagctg

SEQ ID NO: 5275163 - DNA, 19 bp, Homo sapiens
attgccaaacattaatgtt

SEQ ID NO: 5275164 - DNA, 22 bp, Homo sapiens
attgccaaacattaatgttgat

SEQ ID NO: 5275165 - DNA, 14 bp, Homo sapiens
attgccaaatatta

SEQ ID NO: 5275166 - DNA, 14 bp, Homo sapiens
attgccaaattgac

SEQ ID NO: 5275167 - DNA, 15 bp, Homo sapiens
attgccaaattgaca

SEQ ID NO: 5275168 - DNA, 16 bp, Homo sapiens
attgccaacagtggct

SEQ ID NO: 5275169 - DNA, 17 bp, Homo sapiens
attgccaaggcatcccc

SEQ ID NO: 5275170 - DNA, 15 bp, Homo sapiens
attgccaagtcagat

SEQ ID NO: 5275171 - DNA, 21 bp, Homo sapiens
attgccacaatgcctctccca

SEQ ID NO: 5275172 - DNA, 22 bp, Homo sapiens
attgccacataattcattaaaa

SEQ ID NO: 5275173 - DNA, 14 bp, Homo sapiens
attgccaccaggag

SEQ ID NO: 5275174 - DNA, 21 bp, Homo sapiens
attgccaccaggagaaccact

SEQ ID NO: 5275175 - DNA, 22 bp, Homo sapiens
attgccacctctaacagcacca

SEQ ID NO: 5275176 - DNA, 14 bp, Homo sapiens
attgccagcaaata

SEQ ID NO: 5275177 - DNA, 16 bp, Homo sapiens
attgccaggaatgttt

SEQ ID NO: 5275178 - DNA, 18 bp, Homo sapiens
attgccaggaatgtttca

SEQ ID NO: 5275179 - DNA, 21 bp, Homo sapiens
attgccaggagatggccccaa

SEQ ID NO: 5275180 - DNA, 20 bp, Homo sapiens
attgccagtatataagctgt

SEQ ID NO: 5275181 - DNA, 14 bp, Homo sapiens
attgccagtgacat

SEQ ID NO: 5275182 - DNA, 14 bp, Homo sapiens
attgccagtgtctt

SEQ ID NO: 5275183 - DNA, 12 bp, Homo sapiens
attgccataata

SEQ ID NO: 5275184 - DNA, 13 bp, Homo sapiens
attgccataatat

SEQ ID NO: 5275185 - DNA, 19 bp, Homo sapiens
attgccatattgcacatgt

SEQ ID NO: 5275186 - DNA, 17 bp, Homo sapiens
attgccattatagcgcc

SEQ ID NO: 5275187 - DNA, 18 bp, Homo sapiens
attgccattccctgcctg

SEQ ID NO: 5275188 - DNA, 15 bp, Homo sapiens
attgccatttcttcc

SEQ ID NO: 5275189 - DNA, 19 bp, Homo sapiens
attgccatttcttcccaag

SEQ ID NO: 5275190 - DNA, 21 bp, Homo sapiens
attgcccacacctgcctctga

SEQ ID NO: 5275191 - DNA, 19 bp, Homo sapiens
attgcccacttctgtgtag

SEQ ID NO: 5275192 - DNA, 16 bp, Homo sapiens
attgcccaggctggtc

SEQ ID NO: 5275193 - DNA, 23 bp, Homo sapiens
attgcccagtgagccctgctctt

SEQ ID NO: 5275194 - DNA, 19 bp, Homo sapiens
attgcccatgatataactt

SEQ ID NO: 5275195 - DNA, 13 bp, Homo sapiens
attgccccaagat

SEQ ID NO: 5275196 - DNA, 19 bp, Homo sapiens
attgccccagagccccact

SEQ ID NO: 5275197 - DNA, 22 bp, Homo sapiens
attgccccatccagacctggct

SEQ ID NO: 5275198 - DNA, 18 bp, Homo sapiens
attgccccatctagacta

SEQ ID NO: 5275199 - DNA, 13 bp, Homo sapiens
attgcccccacct

SEQ ID NO: 5275200 - DNA, 15 bp, Homo sapiens
attgcccccagggca

SEQ ID NO: 5275201 - DNA, 22 bp, Homo sapiens
attgcccccagggcacttcaca

SEQ ID NO: 5275202 - DNA, 13 bp, Homo sapiens
attgcccctggct

SEQ ID NO: 5275203 - DNA, 22 bp, Homo sapiens
attgcccctggctttgcctctt

SEQ ID NO: 5275204 - DNA, 20 bp, Homo sapiens
attgcccgcgctcaggaggt

SEQ ID NO: 5275205 - DNA, 16 bp, Homo sapiens
attgccctaattaaaa

SEQ ID NO: 5275206 - DNA, 17 bp, Homo sapiens
attgccctatgctgtgc

SEQ ID NO: 5275207 - DNA, 13 bp, Homo sapiens
attgccctgaggg

SEQ ID NO: 5275208 - DNA, 16 bp, Homo sapiens
attgccctgaggggcc

SEQ ID NO: 5275209 - DNA, 23 bp, Homo sapiens
attgccgaagtccagctttctgc

SEQ ID NO: 5275210 - DNA, 21 bp, Homo sapiens
attgcctagaaatatctttct

SEQ ID NO: 5275211 - DNA, 22 bp, Homo sapiens
attgcctagaaatatctttctc

SEQ ID NO: 5275212 - DNA, 15 bp, Homo sapiens
attgcctataatact

SEQ ID NO: 5275213 - DNA, 16 bp, Homo sapiens
attgcctcaaaattgt

SEQ ID NO: 5275214 - DNA, 13 bp, Homo sapiens
attgcctcaataa

SEQ ID NO: 5275215 - DNA, 20 bp, Homo sapiens
attgcctcaataaagctcgt

SEQ ID NO: 5275216 - DNA, 15 bp, Homo sapiens
attgcctcacttcag

SEQ ID NO: 5275217 - DNA, 22 bp, Homo sapiens
attgcctcatttcttcctctgc

SEQ ID NO: 5275218 - DNA, 22 bp, Homo sapiens
attgcctccacctctccttgga

SEQ ID NO: 5275219 - DNA, 16 bp, Homo sapiens
attgcctcccaggcaa

SEQ ID NO: 5275220 - DNA, 19 bp, Homo sapiens
attgcctcccttcctccgc

SEQ ID NO: 5275221 - DNA, 20 bp, Homo sapiens
attgcctcccttcctccgct

SEQ ID NO: 5275222 - DNA, 20 bp, Homo sapiens
attgcctcctgttctgccca

SEQ ID NO: 5275223 - DNA, 21 bp, Homo sapiens
attgcctcctgttctgcccac

SEQ ID NO: 5275224 - DNA, 19 bp, Homo sapiens
attgcctcggctggctccc

SEQ ID NO: 5275225 - DNA, 14 bp, Homo sapiens
attgcctctgagag

SEQ ID NO: 5275226 - DNA, 20 bp, Homo sapiens
attgcctgaaacccatttac

SEQ ID NO: 5275227 - DNA, 18 bp, Homo sapiens
attgcctgactaaaatgt

SEQ ID NO: 5275228 - DNA, 16 bp, Homo sapiens
attgcctgcagagaga

SEQ ID NO: 5275229 - DNA, 19 bp, Homo sapiens
attgcctgccatggctgtg

SEQ ID NO: 5275230 - DNA, 22 bp, Homo sapiens
attgcctgcggtcaaggccagc

SEQ ID NO: 5275231 - DNA, 18 bp, Homo sapiens
attgcctggactgaccac

SEQ ID NO: 5275232 - DNA, 19 bp, Homo sapiens
attgcctggactgaccaca

SEQ ID NO: 5275233 - DNA, 17 bp, Homo sapiens
attgcctgggcagtgcc

SEQ ID NO: 5275234 - DNA, 16 bp, Homo sapiens
attgcctgttcataaa

SEQ ID NO: 5275235 - DNA, 15 bp, Homo sapiens
attgcctgttctgct

SEQ ID NO: 5275236 - DNA, 16 bp, Homo sapiens
attgcctgttctgctt

SEQ ID NO: 5275237 - DNA, 21 bp, Homo sapiens
attgcctgtttctgatttgct

SEQ ID NO: 5275238 - DNA, 18 bp, Homo sapiens
attgccttaactggagcc

SEQ ID NO: 5275239 - DNA, 23 bp, Homo sapiens
attgccttatattggatcaggaa

SEQ ID NO: 5275240 - DNA, 22 bp, Homo sapiens
attgccttatttgtctgtaaaa

SEQ ID NO: 5275241 - DNA, 15 bp, Homo sapiens
attgccttcagccct

SEQ ID NO: 5275242 - DNA, 14 bp, Homo sapiens
attgccttcctcgt

SEQ ID NO: 5275243 - DNA, 16 bp, Homo sapiens
attgccttcctcgtgc

SEQ ID NO: 5275244 - DNA, 22 bp, Homo sapiens
attgccttcctcgtgcagagct

SEQ ID NO: 5275245 - DNA, 15 bp, Homo sapiens
attgccttctcacca

SEQ ID NO: 5275246 - DNA, 19 bp, Homo sapiens
attgccttctcaccagctg

SEQ ID NO: 5275247 - DNA, 20 bp, Homo sapiens
attgccttctcaccagctgc

SEQ ID NO: 5275248 - DNA, 19 bp, Homo sapiens
attgccttctttgaagaag

SEQ ID NO: 5275249 - DNA, 12 bp, Homo sapiens
attgcctttaaa

SEQ ID NO: 5275250 - DNA, 16 bp, Homo sapiens
attgcctttaatattt

SEQ ID NO: 5275251 - DNA, 21 bp, Homo sapiens
attgcctttagaaactgagtc

SEQ ID NO: 5275252 - DNA, 23 bp, Homo sapiens
attgcctttagtgatcacagcag

SEQ ID NO: 5275253 - DNA, 14 bp, Homo sapiens
attgcctttccagg

SEQ ID NO: 5275254 - DNA, 22 bp, Homo sapiens
attgcctttccagggttattta

SEQ ID NO: 5275255 - DNA, 22 bp, Homo sapiens
attgcctttgaatgttaatttt

SEQ ID NO: 5275256 - DNA, 12 bp, Homo sapiens
attgcctttgta

SEQ ID NO: 5275257 - DNA, 18 bp, Homo sapiens
attgcctttgtaatatga

SEQ ID NO: 5275258 - DNA, 16 bp, Homo sapiens
attgcctttgtagtta

SEQ ID NO: 5275259 - DNA, 19 bp, Homo sapiens
attgcctttttataacttt

SEQ ID NO: 5275260 - DNA, 23 bp, Homo sapiens
attgccttttttctgtataaatg

SEQ ID NO: 5275261 - DNA, 16 bp, Homo sapiens
attgcgagaattttca

SEQ ID NO: 5275262 - DNA, 17 bp, Homo sapiens
attgcgagagatgtgtg

SEQ ID NO: 5275263 - DNA, 18 bp, Homo sapiens
attgcgagagatgtgtgt

SEQ ID NO: 5275264 - DNA, 19 bp, Homo sapiens
attgcgagagatgtgtgtt

SEQ ID NO: 5275265 - DNA, 20 bp, Homo sapiens
attgcgagagatgtgtgttg

SEQ ID NO: 5275266 - DNA, 19 bp, Homo sapiens
attgcgccactgcactcca

SEQ ID NO: 5275267 - DNA, 21 bp, Homo sapiens
attgcgcctgagatacaaggc

SEQ ID NO: 5275268 - DNA, 18 bp, Homo sapiens
attgcgcctttgtattat

SEQ ID NO: 5275269 - DNA, 22 bp, Homo sapiens
attgcgtagctctcaaatgtgt

SEQ ID NO: 5275270 - DNA, 19 bp, Homo sapiens
attgcgtgaccctatgacc

SEQ ID NO: 5275271 - DNA, 17 bp, Homo sapiens
attgcgttggtctctgc

SEQ ID NO: 5275272 - DNA, 20 bp, Homo sapiens
attgcgtttgaccttttatg

SEQ ID NO: 5275273 - DNA, 21 bp, Homo sapiens
attgcgtttgaccttttatgt

SEQ ID NO: 5275274 - DNA, 11 bp, Homo sapiens
attgctaaaag

SEQ ID NO: 5275275 - DNA, 16 bp, Homo sapiens
attgctaaaagtgcat

SEQ ID NO: 5275276 - DNA, 13 bp, Homo sapiens
attgctaaatgta

SEQ ID NO: 5275277 - DNA, 16 bp, Homo sapiens
attgctaaatgtaaca

SEQ ID NO: 5275278 - DNA, 15 bp, Homo sapiens
attgctaattctgag

SEQ ID NO: 5275279 - DNA, 13 bp, Homo sapiens
attgctaattgtg

SEQ ID NO: 5275280 - DNA, 14 bp, Homo sapiens
attgctaattgtgt

SEQ ID NO: 5275281 - DNA, 18 bp, Homo sapiens
attgctaatttaaaggag

SEQ ID NO: 5275282 - DNA, 23 bp, Homo sapiens
attgctaccacagacttgcactg

SEQ ID NO: 5275283 - DNA, 21 bp, Homo sapiens
attgctactacttacctacca

SEQ ID NO: 5275284 - DNA, 22 bp, Homo sapiens
attgctactagaaataaataac

SEQ ID NO: 5275285 - DNA, 18 bp, Homo sapiens
attgctactataatcaaa

SEQ ID NO: 5275286 - DNA, 19 bp, Homo sapiens
attgctactataatcaaat

SEQ ID NO: 5275287 - DNA, 21 bp, Homo sapiens
attgctactgatgctgtcatg

SEQ ID NO: 5275288 - DNA, 19 bp, Homo sapiens
attgctacttcctgcctgg

SEQ ID NO: 5275289 - DNA, 18 bp, Homo sapiens
attgctagacgtctcact

SEQ ID NO: 5275290 - DNA, 14 bp, Homo sapiens
attgctagagctcc

SEQ ID NO: 5275291 - DNA, 16 bp, Homo sapiens
attgctagagctcctc

SEQ ID NO: 5275292 - DNA, 18 bp, Homo sapiens
attgctagagctcctccc

SEQ ID NO: 5275293 - DNA, 16 bp, Homo sapiens
attgctagataaaagc

SEQ ID NO: 5275294 - DNA, 16 bp, Homo sapiens
attgctagcgagccgc

SEQ ID NO: 5275295 - DNA, 15 bp, Homo sapiens
attgctaggagctcc

SEQ ID NO: 5275296 - DNA, 16 bp, Homo sapiens
attgctaggtaaagag

SEQ ID NO: 5275297 - DNA, 21 bp, Homo sapiens
attgctatctattgataattt

SEQ ID NO: 5275298 - DNA, 20 bp, Homo sapiens
attgctatgttactattttc

SEQ ID NO: 5275299 - DNA, 19 bp, Homo sapiens
attgctattactagtacta

SEQ ID NO: 5275300 - DNA, 19 bp, Homo sapiens
attgctattgtttatagga

SEQ ID NO: 5275301 - DNA, 14 bp, Homo sapiens
attgctatttatat

SEQ ID NO: 5275302 - DNA, 17 bp, Homo sapiens
attgctatttatattca

SEQ ID NO: 5275303 - DNA, 17 bp, Homo sapiens
attgctcacagttatta

SEQ ID NO: 5275304 - DNA, 21 bp, Homo sapiens
attgctcacagttattacata

SEQ ID NO: 5275305 - DNA, 15 bp, Homo sapiens
attgctcataatgac

SEQ ID NO: 5275306 - DNA, 13 bp, Homo sapiens
attgctccagagc

SEQ ID NO: 5275307 - DNA, 18 bp, Homo sapiens
attgctccagatctggaa

SEQ ID NO: 5275308 - DNA, 15 bp, Homo sapiens
attgctcccagtgcc

SEQ ID NO: 5275309 - DNA, 16 bp, Homo sapiens
attgctcccagtgcca

SEQ ID NO: 5275310 - DNA, 19 bp, Homo sapiens
attgctccctaagactgtg

SEQ ID NO: 5275311 - DNA, 13 bp, Homo sapiens
attgctcctaact

SEQ ID NO: 5275312 - DNA, 21 bp, Homo sapiens
attgctcctcccacttctcaa

SEQ ID NO: 5275313 - DNA, 20 bp, Homo sapiens
attgctcctgctcagatctt

SEQ ID NO: 5275314 - DNA, 12 bp, Homo sapiens
attgctccttga

SEQ ID NO: 5275315 - DNA, 19 bp, Homo sapiens
attgctctatgtctgcctt

SEQ ID NO: 5275316 - DNA, 19 bp, Homo sapiens
attgctctggaagcctgct

SEQ ID NO: 5275317 - DNA, 12 bp, Homo sapiens
attgctctggag

SEQ ID NO: 5275318 - DNA, 17 bp, Homo sapiens
attgctctggagcagcc

SEQ ID NO: 5275319 - DNA, 14 bp, Homo sapiens
attgctctgttccc

SEQ ID NO: 5275320 - DNA, 22 bp, Homo sapiens
attgctctgttcccagtagtta

SEQ ID NO: 5275321 - DNA, 21 bp, Homo sapiens
attgctcttaaaaatcttggt

SEQ ID NO: 5275322 - DNA, 12 bp, Homo sapiens
attgctgaaact

SEQ ID NO: 5275323 - DNA, 15 bp, Homo sapiens
attgctgaactctta

SEQ ID NO: 5275324 - DNA, 14 bp, Homo sapiens
attgctgacagagc

SEQ ID NO: 5275325 - DNA, 17 bp, Homo sapiens
attgctgagaagcaaac

SEQ ID NO: 5275326 - DNA, 21 bp, Homo sapiens
attgctgagatgtttagtagc

SEQ ID NO: 5275327 - DNA, 23 bp, Homo sapiens
attgctgagcctctgctccccag

SEQ ID NO: 5275328 - DNA, 12 bp, Homo sapiens
attgctgaggca

SEQ ID NO: 5275329 - DNA, 15 bp, Homo sapiens
attgctgatggtgca

SEQ ID NO: 5275330 - DNA, 15 bp, Homo sapiens
attgctgattttaat

SEQ ID NO: 5275331 - DNA, 13 bp, Homo sapiens
attgctgcatatt

SEQ ID NO: 5275332 - DNA, 14 bp, Homo sapiens
attgctgcatattt

SEQ ID NO: 5275333 - DNA, 13 bp, Homo sapiens
attgctgcatttt

SEQ ID NO: 5275334 - DNA, 19 bp, Homo sapiens
attgctgcattttaagcat

SEQ ID NO: 5275335 - DNA, 11 bp, Homo sapiens
attgctgccaa

SEQ ID NO: 5275336 - DNA, 14 bp, Homo sapiens
attgctgccaaaac

SEQ ID NO: 5275337 - DNA, 20 bp, Homo sapiens
attgctgccaaaaccacatg

SEQ ID NO: 5275338 - DNA, 21 bp, Homo sapiens
attgctgccaaaaccacatgg

SEQ ID NO: 5275339 - DNA, 19 bp, Homo sapiens
atgtgagtccctgtgatgg

SEQ ID NO: 5275340 - DNA, 23 bp, Homo sapiens
atgtgagtcctgttgaagacttc

SEQ ID NO: 5275341 - DNA, 21 bp, Homo sapiens
atgtgagtgaaagtacttcag

SEQ ID NO: 5275342 - DNA, 22 bp, Homo sapiens
atgtgagtgccttttgcagaag

SEQ ID NO: 5275343 - DNA, 22 bp, Homo sapiens
atgtgagtgtgtatgtcagtgg

SEQ ID NO: 5275344 - DNA, 20 bp, Homo sapiens
atgtgagtttggtctggact

SEQ ID NO: 5275345 - DNA, 22 bp, Homo sapiens
atgtgatacattaggaagctga

SEQ ID NO: 5275346 - DNA, 22 bp, Homo sapiens
atgtgatacattttttaagctt

SEQ ID NO: 5275347 - DNA, 19 bp, Homo sapiens
atgtgatataaacagcttc

SEQ ID NO: 5275348 - DNA, 16 bp, Homo sapiens
atgtgatatataagtg

SEQ ID NO: 5275349 - DNA, 21 bp, Homo sapiens
atgtgatatataagtgtacat

SEQ ID NO: 5275350 - DNA, 22 bp, Homo sapiens
atgtgatatataagtgtacata

SEQ ID NO: 5275351 - DNA, 16 bp, Homo sapiens
atgtgatatgtgtaat

SEQ ID NO: 5275352 - DNA, 18 bp, Homo sapiens
atgtgatatgtgtaatat

SEQ ID NO: 5275353 - DNA, 22 bp, Homo sapiens
atgtgatatgtgtaatatcatt

SEQ ID NO: 5275354 - DNA, 13 bp, Homo sapiens
atgtgatatgttt

SEQ ID NO: 5275355 - DNA, 14 bp, Homo sapiens
atgtgatattctaa

SEQ ID NO: 5275356 - DNA, 18 bp, Homo sapiens
atgtgatattctaagact

SEQ ID NO: 5275357 - DNA, 20 bp, Homo sapiens
atgtgatattctgttgcttt

SEQ ID NO: 5275358 - DNA, 22 bp, Homo sapiens
atgtgatattctgttgctttac

SEQ ID NO: 5275359 - DNA, 16 bp, Homo sapiens
atgtgatattttcaca

SEQ ID NO: 5275360 - DNA, 13 bp, Homo sapiens
atgtgatcactga

SEQ ID NO: 5275361 - DNA, 20 bp, Homo sapiens
atgtgatcaggccccacccc

SEQ ID NO: 5275362 - DNA, 20 bp, Homo sapiens
atgtgatcctaaaattgttt

SEQ ID NO: 5275363 - DNA, 23 bp, Homo sapiens
atgtgatccttttatgttattta

SEQ ID NO: 5275364 - DNA, 21 bp, Homo sapiens
atgtgatctatgtttcatctt

SEQ ID NO: 5275365 - DNA, 21 bp, Homo sapiens
atgtgatctattactctgaca

SEQ ID NO: 5275366 - DNA, 23 bp, Homo sapiens
atgtgatctgggcattttcctcc

SEQ ID NO: 5275367 - DNA, 20 bp, Homo sapiens
atgtgatctgtcttgtaata

SEQ ID NO: 5275368 - DNA, 19 bp, Homo sapiens
atgtgatgaaactttgaaa

SEQ ID NO: 5275369 - DNA, 19 bp, Homo sapiens
atgtgatgaatactgtatt

SEQ ID NO: 5275370 - DNA, 15 bp, Homo sapiens
atgtgatgagaggaa

SEQ ID NO: 5275371 - DNA, 12 bp, Homo sapiens
atgtgatgccaa

SEQ ID NO: 5275372 - DNA, 19 bp, Homo sapiens
atgtgatgcttataataaa

SEQ ID NO: 5275373 - DNA, 18 bp, Homo sapiens
atgtgatggaacacacac

SEQ ID NO: 5275374 - DNA, 19 bp, Homo sapiens
atgtgatggaacacacaca

SEQ ID NO: 5275375 - DNA, 18 bp, Homo sapiens
atgtgatggacactccag

SEQ ID NO: 5275376 - DNA, 17 bp, Homo sapiens
atgtgatggactgggga

SEQ ID NO: 5275377 - DNA, 22 bp, Homo sapiens
atgtgatggactggggagcaca

SEQ ID NO: 5275378 - DNA, 18 bp, Homo sapiens
atgtgatggatggcacaa

SEQ ID NO: 5275379 - DNA, 20 bp, Homo sapiens
atgtgatggatggcacaatg

SEQ ID NO: 5275380 - DNA, 21 bp, Homo sapiens
atgtgatggatggcacaatga

SEQ ID NO: 5275381 - DNA, 20 bp, Homo sapiens
atgtgatggtcaggatctca

SEQ ID NO: 5275382 - DNA, 14 bp, Homo sapiens
atgtgatggttggt

SEQ ID NO: 5275383 - DNA, 17 bp, Homo sapiens
atgtgatgttaactatt

SEQ ID NO: 5275384 - DNA, 21 bp, Homo sapiens
atgtgatgttctaaggctctg

SEQ ID NO: 5275385 - DNA, 23 bp, Homo sapiens
atgtgattaacatctacaatcag

SEQ ID NO: 5275386 - DNA, 16 bp, Homo sapiens
atgtgattaactctta

SEQ ID NO: 5275387 - DNA, 19 bp, Homo sapiens
atgtgattaactcttagaa

SEQ ID NO: 5275388 - DNA, 11 bp, Homo sapiens
atgtgattaat

SEQ ID NO: 5275389 - DNA, 18 bp, Homo sapiens
atgtgattaatgttttca

SEQ ID NO: 5275390 - DNA, 21 bp, Homo sapiens
atgtgattaatgttttcatta

SEQ ID NO: 5275391 - DNA, 20 bp, Homo sapiens
atgtgattatttttctttta

SEQ ID NO: 5275392 - DNA, 22 bp, Homo sapiens
atgtgattcactgccttcctct

SEQ ID NO: 5275393 - DNA, 20 bp, Homo sapiens
atgtgattcctttgaagagg

SEQ ID NO: 5275394 - DNA, 15 bp, Homo sapiens
atgtgattccttttg

SEQ ID NO: 5275395 - DNA, 16 bp, Homo sapiens
atgtgattccttttga

SEQ ID NO: 5275396 - DNA, 15 bp, Homo sapiens
atgtgattctaatgt

SEQ ID NO: 5275397 - DNA, 20 bp, Homo sapiens
atgtgattcttctaaagcac

SEQ ID NO: 5275398 - DNA, 14 bp, Homo sapiens
atgtgattgtggaa

SEQ ID NO: 5275399 - DNA, 16 bp, Homo sapiens
atgtgatttaatagtg

SEQ ID NO: 5275400 - DNA, 21 bp, Homo sapiens
atgtgatttaatagtgttaat

SEQ ID NO: 5275401 - DNA, 18 bp, Homo sapiens
atgtgattttaactctgt

SEQ ID NO: 5275402 - DNA, 14 bp, Homo sapiens
atgtgattttcaaa

SEQ ID NO: 5275403 - DNA, 18 bp, Homo sapiens
atgtgattttcaaatatg

SEQ ID NO: 5275404 - DNA, 21 bp, Homo sapiens
atgtgattttcctttgtagct

SEQ ID NO: 5275405 - DNA, 14 bp, Homo sapiens
atgtgatttttctg

SEQ ID NO: 5275406 - DNA, 14 bp, Homo sapiens
atgtgcaaaacagc

SEQ ID NO: 5275407 - DNA, 21 bp, Homo sapiens
atgtgcaaaaccttttactgg

SEQ ID NO: 5275408 - DNA, 16 bp, Homo sapiens
atgtgcaaagcagtat

SEQ ID NO: 5275409 - DNA, 13 bp, Homo sapiens
atgtgcaaagtga

SEQ ID NO: 5275410 - DNA, 19 bp, Homo sapiens
atgtgcaaggattgtacac

SEQ ID NO: 5275411 - DNA, 20 bp, Homo sapiens
atgtgcaagttgtactgtat

SEQ ID NO: 5275412 - DNA, 23 bp, Homo sapiens
atgtgcaagttgtactgtatgca

SEQ ID NO: 5275413 - DNA, 19 bp, Homo sapiens
atgtgcaataatttgtaca

SEQ ID NO: 5275414 - DNA, 15 bp, Homo sapiens
atgtgcaatagaaat

SEQ ID NO: 5275415 - DNA, 12 bp, Homo sapiens
atgtgcaatttg

SEQ ID NO: 5275416 - DNA, 15 bp, Homo sapiens
atgtgcacagcccct

SEQ ID NO: 5275417 - DNA, 16 bp, Homo sapiens
atgtgcacatgtgtct

SEQ ID NO: 5275418 - DNA, 22 bp, Homo sapiens
atgtgcacccatgggctctgac

SEQ ID NO: 5275419 - DNA, 20 bp, Homo sapiens
atgtgcacccggcctggatg

SEQ ID NO: 5275420 - DNA, 16 bp, Homo sapiens
atgtgcactgcctgca

SEQ ID NO: 5275421 - DNA, 15 bp, Homo sapiens
atgtgcactgtcact

SEQ ID NO: 5275422 - DNA, 18 bp, Homo sapiens
atgtgcactgtcactttg

SEQ ID NO: 5275423 - DNA, 22 bp, Homo sapiens
atgtgcactgtcactttgctct

SEQ ID NO: 5275424 - DNA, 23 bp, Homo sapiens
atgtgcagaaaatatttaatatc

SEQ ID NO: 5275425 - DNA, 20 bp, Homo sapiens
atgtgcagacactcaagagc

SEQ ID NO: 5275426 - DNA, 23 bp, Homo sapiens
atgtgcagacactcaagagccct

SEQ ID NO: 5275427 - DNA, 15 bp, Homo sapiens
atgtgcagatatcca

SEQ ID NO: 5275428 - DNA, 20 bp, Homo sapiens
atgtgcagatatccaaacaa

SEQ ID NO: 5275429 - DNA, 13 bp, Homo sapiens
atgtgcagcagat

SEQ ID NO: 5275430 - DNA, 20 bp, Homo sapiens
atgtgcagcagattggaagg

SEQ ID NO: 5275431 - DNA, 18 bp, Homo sapiens
atgtgcagcgacccttgg

SEQ ID NO: 5275432 - DNA, 20 bp, Homo sapiens
atgtgcagcgacccttggtg

SEQ ID NO: 5275433 - DNA, 17 bp, Homo sapiens
atgtgcaggaagaaaag

SEQ ID NO: 5275434 - DNA, 19 bp, Homo sapiens
atgtgcaggaagaaaagcc

SEQ ID NO: 5275435 - DNA, 12 bp, Homo sapiens
atgtgcagggat

SEQ ID NO: 5275436 - DNA, 22 bp, Homo sapiens
atgtgcagggatattgccttat

SEQ ID NO: 5275437 - DNA, 21 bp, Homo sapiens
atgtgcagggtgggctggtga

SEQ ID NO: 5275438 - DNA, 15 bp, Homo sapiens
atgtgcagtgtcttg

SEQ ID NO: 5275439 - DNA, 14 bp, Homo sapiens
atgtgcataatgga

SEQ ID NO: 5275440 - DNA, 15 bp, Homo sapiens
atgtgcatagataca

SEQ ID NO: 5275441 - DNA, 18 bp, Homo sapiens
atgtgcatagtttcttta

SEQ ID NO: 5275442 - DNA, 13 bp, Homo sapiens
atgtgcatataaa

SEQ ID NO: 5275443 - DNA, 14 bp, Homo sapiens
atgtgcatatatct

SEQ ID NO: 5275444 - DNA, 16 bp, Homo sapiens
atgtgcatctggccta

SEQ ID NO: 5275445 - DNA, 23 bp, Homo sapiens
atgtgcatctggcctatgaccct

SEQ ID NO: 5275446 - DNA, 14 bp, Homo sapiens
atgtgcatctggtg

SEQ ID NO: 5275447 - DNA, 22 bp, Homo sapiens
atgtgcatggaaatgtcctcca

SEQ ID NO: 5275448 - DNA, 17 bp, Homo sapiens
atgtgcattctccagcc

SEQ ID NO: 5275449 - DNA, 19 bp, Homo sapiens
atgtgcatttaattagaaa

SEQ ID NO: 5275450 - DNA, 11 bp, Homo sapiens
atgtgcatttc

SEQ ID NO: 5275451 - DNA, 17 bp, Homo sapiens
atgtgcatttcacctgt

SEQ ID NO: 5275452 - DNA, 23 bp, Homo sapiens
atgtgcatttcacctgtgacaaa

SEQ ID NO: 5275453 - DNA, 22 bp, Homo sapiens
atgtgccaagattctactcttg

SEQ ID NO: 5275454 - DNA, 23 bp, Homo sapiens
atgtgccaataaccaagtttatt

SEQ ID NO: 5275455 - DNA, 17 bp, Homo sapiens
atgtgccaatcaatagc

SEQ ID NO: 5275456 - DNA, 20 bp, Homo sapiens
atgtgccaattttgtcacag

SEQ ID NO: 5275457 - DNA, 17 bp, Homo sapiens
atgtgccacagaggccc

SEQ ID NO: 5275458 - DNA, 15 bp, Homo sapiens
atgtgccacattttc

SEQ ID NO: 5275459 - DNA, 15 bp, Homo sapiens
atgtgccaccaacat

SEQ ID NO: 5275460 - DNA, 22 bp, Homo sapiens
atgtgccaccaacataaaacaa

SEQ ID NO: 5275461 - DNA, 14 bp, Homo sapiens
atgtgccaggcttg

SEQ ID NO: 5275462 - DNA, 16 bp, Homo sapiens
atgtgccaggcttgcc

SEQ ID NO: 5275463 - DNA, 17 bp, Homo sapiens
atgtgccagttcctgta

SEQ ID NO: 5275464 - DNA, 13 bp, Homo sapiens
atgtgccatgtat

SEQ ID NO: 5275465 - DNA, 22 bp, Homo sapiens
atgtgccattttaaaaaaaaag

SEQ ID NO: 5275466 - DNA, 21 bp, Homo sapiens
atgtgccattttaataaaatg

SEQ ID NO: 5275467 - DNA, 15 bp, Homo sapiens
atgtgcccacaggga

SEQ ID NO: 5275468 - DNA, 16 bp, Homo sapiens
atgtgcccagagtagc

SEQ ID NO: 5275469 - DNA, 16 bp, Homo sapiens
atgtgcccagtcatga

SEQ ID NO: 5275470 - DNA, 14 bp, Homo sapiens
atgtgcccccaccc

SEQ ID NO: 5275471 - DNA, 17 bp, Homo sapiens
atgtgcccctgccaagg

SEQ ID NO: 5275472 - DNA, 13 bp, Homo sapiens
atgtgcccctggc

SEQ ID NO: 5275473 - DNA, 20 bp, Homo sapiens
atgtgcccctggcccatctc

SEQ ID NO: 5275474 - DNA, 14 bp, Homo sapiens
atgtgccccttccc

SEQ ID NO: 5275475 - DNA, 12 bp, Homo sapiens
atgtgccctgcc

SEQ ID NO: 5275476 - DNA, 14 bp, Homo sapiens
atgtgccctgcctt

SEQ ID NO: 5275477 - DNA, 15 bp, Homo sapiens
atgtgcctaattttc

SEQ ID NO: 5275478 - DNA, 16 bp, Homo sapiens
atgtgcctaattttct

SEQ ID NO: 5275479 - DNA, 23 bp, Homo sapiens
atgtgcctattgctagagctcct

SEQ ID NO: 5275480 - DNA, 20 bp, Homo sapiens
atgtgcctccaagcggccct

SEQ ID NO: 5275481 - DNA, 17 bp, Homo sapiens
atgtgcctgcgttctga

SEQ ID NO: 5275482 - DNA, 14 bp, Homo sapiens
atgtgcctgggtgg

SEQ ID NO: 5275483 - DNA, 21 bp, Homo sapiens
atgtgccttatgttgaaaaaa

SEQ ID NO: 5275484 - DNA, 19 bp, Homo sapiens
atgtgccttgtccaggaac

SEQ ID NO: 5275485 - DNA, 18 bp, Homo sapiens
atgtgcctttctttgcct

SEQ ID NO: 5275486 - DNA, 14 bp, Homo sapiens
atgtgccttttctg

SEQ ID NO: 5275487 - DNA, 23 bp, Homo sapiens
atgtgcgaagcaagaagaattga

SEQ ID NO: 5275488 - DNA, 14 bp, Homo sapiens
atgtgcgtggaagt

SEQ ID NO: 5275489 - DNA, 17 bp, Homo sapiens
atgtgcgtggaagtgtt

SEQ ID NO: 5275490 - DNA, 20 bp, Homo sapiens
atgtgcgtggaagtgttcct

SEQ ID NO: 5275491 - DNA, 15 bp, Homo sapiens
atgtgcgtgtgtgca

SEQ ID NO: 5275492 - DNA, 22 bp, Homo sapiens
atgtgctaataagtttgaaata

SEQ ID NO: 5275493 - DNA, 21 bp, Homo sapiens
atgtgctacaggggccagaag

SEQ ID NO: 5275494 - DNA, 19 bp, Homo sapiens
atgtgctagaacaatggga

SEQ ID NO: 5275495 - DNA, 21 bp, Homo sapiens
atgtgctagagttaaaagtta

SEQ ID NO: 5275496 - DNA, 15 bp, Homo sapiens
atgtgctatacacac

SEQ ID NO: 5275497 - DNA, 19 bp, Homo sapiens
atgtgctatactgcatact

SEQ ID NO: 5275498 - DNA, 13 bp, Homo sapiens
atgtgctatgcaa

SEQ ID NO: 5275499 - DNA, 15 bp, Homo sapiens
atgtgctatgcaaaa

SEQ ID NO: 5275500 - DNA, 20 bp, Homo sapiens
atgtgctatgcaaaatagac

SEQ ID NO: 5275501 - DNA, 13 bp, Homo sapiens
atgtgctattaat

SEQ ID NO: 5275502 - DNA, 17 bp, Homo sapiens
atgtgctattaatattt

SEQ ID NO: 5275503 - DNA, 17 bp, Homo sapiens
atgtgctattgaactga

SEQ ID NO: 5275504 - DNA, 21 bp, Homo sapiens
atgtgctattgaactgagcca

SEQ ID NO: 5275505 - DNA, 14 bp, Homo sapiens
atgtgctcagaaga

SEQ ID NO: 5275506 - DNA, 19 bp, Homo sapiens
atgtgctcagaagaggaaa

SEQ ID NO: 5275507 - DNA, 17 bp, Homo sapiens
atgtgctcagccccaga

SEQ ID NO: 5275508 - DNA, 16 bp, Homo sapiens
atgtgctcatcagaaa

SEQ ID NO: 5275509 - DNA, 15 bp, Homo sapiens
atgtgctcccaccag

SEQ ID NO: 5275510 - DNA, 20 bp, Homo sapiens
atgtgctcccaccaggcagc

SEQ ID NO: 5275511 - DNA, 16 bp, Homo sapiens
atgtgctctgtaacat

SEQ ID NO: 5275512 - DNA, 15 bp, Homo sapiens
atgtgctgaacattg

SEQ ID NO: 5275513 - DNA, 16 bp, Homo sapiens
atgtgctgaacattgt

SEQ ID NO: 5275514 - DNA, 13 bp, Homo sapiens
atgtgctgccctg

SEQ ID NO: 5275515 - DNA, 21 bp, Homo sapiens
atgtgctgcggtcactcaggc

SEQ ID NO: 5275516 - DNA, 22 bp, Homo sapiens
attgctgccaaaaccacatggg

SEQ ID NO: 5275517 - DNA, 23 bp, Homo sapiens
attgctgccaaggtggagggaag

SEQ ID NO: 5275518 - DNA, 14 bp, Homo sapiens
attgctgccacttt

SEQ ID NO: 5275519 - DNA, 15 bp, Homo sapiens
attgctgccaggatt

SEQ ID NO: 5275520 - DNA, 20 bp, Homo sapiens
attgctgccccatcagtgct

SEQ ID NO: 5275521 - DNA, 20 bp, Homo sapiens
attgctgcccgtttgtacat

SEQ ID NO: 5275522 - DNA, 22 bp, Homo sapiens
attgctgcctttgtccccacac

SEQ ID NO: 5275523 - DNA, 21 bp, Homo sapiens
attgctgctccttagctgcca

SEQ ID NO: 5275524 - DNA, 15 bp, Homo sapiens
attgctgctctctga

SEQ ID NO: 5275525 - DNA, 20 bp, Homo sapiens
attgctggaacccaggaggt

SEQ ID NO: 5275526 - DNA, 17 bp, Homo sapiens
attgctggatgcatttt

SEQ ID NO: 5275527 - DNA, 14 bp, Homo sapiens
attgctggctgccc

SEQ ID NO: 5275528 - DNA, 20 bp, Homo sapiens
attgctggggccaggcccca

SEQ ID NO: 5275529 - DNA, 22 bp, Homo sapiens
attgctggtagagacccccagg

SEQ ID NO: 5275530 - DNA, 15 bp, Homo sapiens
attgctggtcttgta

SEQ ID NO: 5275531 - DNA, 22 bp, Homo sapiens
attgctggttctatttaatgga

SEQ ID NO: 5275532 - DNA, 18 bp, Homo sapiens
attgctgtaaataaaaat

SEQ ID NO: 5275533 - DNA, 21 bp, Homo sapiens
attgctgtaaataaaaatagc

SEQ ID NO: 5275534 - DNA, 22 bp, Homo sapiens
attgctgtaggatctaaggctg

SEQ ID NO: 5275535 - DNA, 22 bp, Homo sapiens
attgctgtccttgaatgccata

SEQ ID NO: 5275536 - DNA, 16 bp, Homo sapiens
attgctgtctagcctt

SEQ ID NO: 5275537 - DNA, 21 bp, Homo sapiens
attgctgtctagccttagtca

SEQ ID NO: 5275538 - DNA, 23 bp, Homo sapiens
attgctgtctgaaaaagtgtttt

SEQ ID NO: 5275539 - DNA, 17 bp, Homo sapiens
attgctgtctgcagcct

SEQ ID NO: 5275540 - DNA, 16 bp, Homo sapiens
attgctgtctggtgag

SEQ ID NO: 5275541 - DNA, 22 bp, Homo sapiens
attgctgtctggtgaggtggcc

SEQ ID NO: 5275542 - DNA, 17 bp, Homo sapiens
attgctgtcttgcccca

SEQ ID NO: 5275543 - DNA, 19 bp, Homo sapiens
attgctgtcttgccccagt

SEQ ID NO: 5275544 - DNA, 11 bp, Homo sapiens
attgctgtgcc

SEQ ID NO: 5275545 - DNA, 18 bp, Homo sapiens
attgctgtgctttatgga

SEQ ID NO: 5275546 - DNA, 12 bp, Homo sapiens
attgctgtgtat

SEQ ID NO: 5275547 - DNA, 21 bp, Homo sapiens
attgctgtgtccaactccagt

SEQ ID NO: 5275548 - DNA, 21 bp, Homo sapiens
attgctgtgtctcctctcaga

SEQ ID NO: 5275549 - DNA, 22 bp, Homo sapiens
attgctgtgtcttcattttcat

SEQ ID NO: 5275550 - DNA, 23 bp, Homo sapiens
attgctgttatgtctgtttaaga

SEQ ID NO: 5275551 - DNA, 15 bp, Homo sapiens
attgctgttgaaagc

SEQ ID NO: 5275552 - DNA, 21 bp, Homo sapiens
attgctgttgaaagcaaaaat

SEQ ID NO: 5275553 - DNA, 23 bp, Homo sapiens
attgctgttgaaagcaaaaatgc

SEQ ID NO: 5275554 - DNA, 13 bp, Homo sapiens
attgctgttgaga

SEQ ID NO: 5275555 - DNA, 12 bp, Homo sapiens
attgctgttgct

SEQ ID NO: 5275556 - DNA, 15 bp, Homo sapiens
attgctgttgtccaa

SEQ ID NO: 5275557 - DNA, 19 bp, Homo sapiens
attgctgttgtccaactat

SEQ ID NO: 5275558 - DNA, 17 bp, Homo sapiens
attgctgttgttgcagg

SEQ ID NO: 5275559 - DNA, 20 bp, Homo sapiens
attgctgtttggtttgttta

SEQ ID NO: 5275560 - DNA, 21 bp, Homo sapiens
attgcttacaagcctaagaat

SEQ ID NO: 5275561 - DNA, 15 bp, Homo sapiens
attgcttagtaaaat

SEQ ID NO: 5275562 - DNA, 22 bp, Homo sapiens
attgcttagtaaaatttatttc

SEQ ID NO: 5275563 - DNA, 17 bp, Homo sapiens
attgcttagtgaaaata

SEQ ID NO: 5275564 - DNA, 17 bp, Homo sapiens
attgcttatgtctctac

SEQ ID NO: 5275565 - DNA, 19 bp, Homo sapiens
attgcttattttattatga

SEQ ID NO: 5275566 - DNA, 17 bp, Homo sapiens
attgcttcaattaaaat

SEQ ID NO: 5275567 - DNA, 13 bp, Homo sapiens
attgcttcaattt

SEQ ID NO: 5275568 - DNA, 16 bp, Homo sapiens
attgcttcaatttcaa

SEQ ID NO: 5275569 - DNA, 13 bp, Homo sapiens
attgcttcatgtt

SEQ ID NO: 5275570 - DNA, 19 bp, Homo sapiens
attgcttcattaaaacaag

SEQ ID NO: 5275571 - DNA, 18 bp, Homo sapiens
attgcttccacccacacg

SEQ ID NO: 5275572 - DNA, 16 bp, Homo sapiens
attgcttcctcctccc

SEQ ID NO: 5275573 - DNA, 23 bp, Homo sapiens
attgcttctaaaacaataaagat

SEQ ID NO: 5275574 - DNA, 13 bp, Homo sapiens
attgcttctgtag

SEQ ID NO: 5275575 - DNA, 10 bp, Homo sapiens
attgcttctt

SEQ ID NO: 5275576 - DNA, 16 bp, Homo sapiens
attgcttgaaagaaaa

SEQ ID NO: 5275577 - DNA, 17 bp, Homo sapiens
attgcttgaacccagga

SEQ ID NO: 5275578 - DNA, 13 bp, Homo sapiens
attgcttgagcat

SEQ ID NO: 5275579 - DNA, 16 bp, Homo sapiens
attgcttgagctcagg

SEQ ID NO: 5275580 - DNA, 15 bp, Homo sapiens
attgcttgatacttt

SEQ ID NO: 5275581 - DNA, 15 bp, Homo sapiens
attgctttatccagc

SEQ ID NO: 5275582 - DNA, 11 bp, Homo sapiens
attgctttctg

SEQ ID NO: 5275583 - DNA, 16 bp, Homo sapiens
attgctttctgaaatt

SEQ ID NO: 5275584 - DNA, 18 bp, Homo sapiens
attgctttctgctcttta

SEQ ID NO: 5275585 - DNA, 15 bp, Homo sapiens
attgctttgaaacta

SEQ ID NO: 5275586 - DNA, 21 bp, Homo sapiens
attgctttgaagcagttgtgt

SEQ ID NO: 5275587 - DNA, 20 bp, Homo sapiens
attgctttgccaaaatacca

SEQ ID NO: 5275588 - DNA, 13 bp, Homo sapiens
attgctttgctgc

SEQ ID NO: 5275589 - DNA, 14 bp, Homo sapiens
attgctttgctgca

SEQ ID NO: 5275590 - DNA, 18 bp, Homo sapiens
attgctttggtcatatga

SEQ ID NO: 5275591 - DNA, 21 bp, Homo sapiens
attgctttgtattgtatatta

SEQ ID NO: 5275592 - DNA, 19 bp, Homo sapiens
attgctttgtgcctttggg

SEQ ID NO: 5275593 - DNA, 15 bp, Homo sapiens
attgcttttaaaact

SEQ ID NO: 5275594 - DNA, 16 bp, Homo sapiens
attgcttttaaaacta

SEQ ID NO: 5275595 - DNA, 21 bp, Homo sapiens
attgcttttaaaattttaagc

SEQ ID NO: 5275596 - DNA, 19 bp, Homo sapiens
attgcttttattttgaaaa

SEQ ID NO: 5275597 - DNA, 11 bp, Homo sapiens
attgcttttgt

SEQ ID NO: 5275598 - DNA, 14 bp, Homo sapiens
attgcttttgtgca

SEQ ID NO: 5275599 - DNA, 19 bp, Homo sapiens
attgcttttgttgtgactt

SEQ ID NO: 5275600 - DNA, 15 bp, Homo sapiens
attgctttttctaat

SEQ ID NO: 5275601 - DNA, 15 bp, Homo sapiens
attgcttttttgtat

SEQ ID NO: 5275602 - DNA, 12 bp, Homo sapiens
attggaaatgta

SEQ ID NO: 5275603 - DNA, 22 bp, Homo sapiens
attggaaatgtcatctaaccat

SEQ ID NO: 5275604 - DNA, 14 bp, Homo sapiens
attggaaatttcac

SEQ ID NO: 5275605 - DNA, 15 bp, Homo sapiens
attggaacagtgaat

SEQ ID NO: 5275606 - DNA, 23 bp, Homo sapiens
attggaactctactcaacccatt

SEQ ID NO: 5275607 - DNA, 15 bp, Homo sapiens
attggaactggaggc

SEQ ID NO: 5275608 - DNA, 14 bp, Homo sapiens
attggaagaaattc

SEQ ID NO: 5275609 - DNA, 16 bp, Homo sapiens
attggaagacttgggt

SEQ ID NO: 5275610 - DNA, 24 bp, Homo sapiens
attggaagagcagcacctcctcag

SEQ ID NO: 5275611 - DNA, 17 bp, Homo sapiens
attggaagagtgacctg

SEQ ID NO: 5275612 - DNA, 19 bp, Homo sapiens
attggaagcaggttaaatg

SEQ ID NO: 5275613 - DNA, 22 bp, Homo sapiens
attggaagcaggttaaatgttt

SEQ ID NO: 5275614 - DNA, 16 bp, Homo sapiens
attggaagcctgagca

SEQ ID NO: 5275615 - DNA, 23 bp, Homo sapiens
attggaagctgattcccagagca

SEQ ID NO: 5275616 - DNA, 19 bp, Homo sapiens
attggaagctgctgaggcc

SEQ ID NO: 5275617 - DNA, 21 bp, Homo sapiens
attggaagctttgagttgact

SEQ ID NO: 5275618 - DNA, 17 bp, Homo sapiens
attggaaggagacacag

SEQ ID NO: 5275619 - DNA, 18 bp, Homo sapiens
attggaaggagacacaga

SEQ ID NO: 5275620 - DNA, 15 bp, Homo sapiens
attggaaggagaggg

SEQ ID NO: 5275621 - DNA, 19 bp, Homo sapiens
attggaatagcagcctcac

SEQ ID NO: 5275622 - DNA, 17 bp, Homo sapiens
attggaatcttcacctc

SEQ ID NO: 5275623 - DNA, 17 bp, Homo sapiens
attggaatgcactcaga

SEQ ID NO: 5275624 - DNA, 22 bp, Homo sapiens
attggaatggaactactgtact

SEQ ID NO: 5275625 - DNA, 18 bp, Homo sapiens
attggaatgttctcagat

SEQ ID NO: 5275626 - DNA, 14 bp, Homo sapiens
attggaattaacct

SEQ ID NO: 5275627 - DNA, 14 bp, Homo sapiens
attggaatttctgg

SEQ ID NO: 5275628 - DNA, 13 bp, Homo sapiens
attggaattttct

SEQ ID NO: 5275629 - DNA, 14 bp, Homo sapiens
attggaattttctt

SEQ ID NO: 5275630 - DNA, 19 bp, Homo sapiens
attggaatttttttttcct

SEQ ID NO: 5275631 - DNA, 17 bp, Homo sapiens
attggacagaaaatgca

SEQ ID NO: 5275632 - DNA, 18 bp, Homo sapiens
attggacagaaaatgcaa

SEQ ID NO: 5275633 - DNA, 19 bp, Homo sapiens
attggacagatttcagtaa

SEQ ID NO: 5275634 - DNA, 13 bp, Homo sapiens
attggacagttgt

SEQ ID NO: 5275635 - DNA, 21 bp, Homo sapiens
attggacagttgtctagagat

SEQ ID NO: 5275636 - DNA, 22 bp, Homo sapiens
attggacatagatattttcaca

SEQ ID NO: 5275637 - DNA, 16 bp, Homo sapiens
attggacatggtctcc

SEQ ID NO: 5275638 - DNA, 19 bp, Homo sapiens
attggacattaagcatcac

SEQ ID NO: 5275639 - DNA, 13 bp, Homo sapiens
attggaccaggcc

SEQ ID NO: 5275640 - DNA, 16 bp, Homo sapiens
attggacctgcccaca

SEQ ID NO: 5275641 - DNA, 15 bp, Homo sapiens
attggacctggccca

SEQ ID NO: 5275642 - DNA, 13 bp, Homo sapiens
attggactccagg

SEQ ID NO: 5275643 - DNA, 14 bp, Homo sapiens
attggactccaggc

SEQ ID NO: 5275644 - DNA, 21 bp, Homo sapiens
attggactccaggcctgacca

SEQ ID NO: 5275645 - DNA, 17 bp, Homo sapiens
attggacttccatttgg

SEQ ID NO: 5275646 - DNA, 16 bp, Homo sapiens
attggagaaaagcact

SEQ ID NO: 5275647 - DNA, 22 bp, Homo sapiens
attggagaaaagcacttaaagt

SEQ ID NO: 5275648 - DNA, 14 bp, Homo sapiens
attggagaatactt

SEQ ID NO: 5275649 - DNA, 23 bp, Homo sapiens
attggagaatactttgcttcata

SEQ ID NO: 5275650 - DNA, 19 bp, Homo sapiens
attggagagaaaaaattaa

SEQ ID NO: 5275651 - DNA, 21 bp, Homo sapiens
attggagagggctctgtgctg

SEQ ID NO: 5275652 - DNA, 18 bp, Homo sapiens
attggagagtaaaaactg

SEQ ID NO: 5275653 - DNA, 21 bp, Homo sapiens
attggagattactaactgtgg

SEQ ID NO: 5275654 - DNA, 17 bp, Homo sapiens
attggagctcgtgggac

SEQ ID NO: 5275655 - DNA, 12 bp, Homo sapiens
attggagctgac

SEQ ID NO: 5275656 - DNA, 22 bp, Homo sapiens
attggagctgactgttcttggt

SEQ ID NO: 5275657 - DNA, 20 bp, Homo sapiens
attggaggatgggggtcctg

SEQ ID NO: 5275658 - DNA, 16 bp, Homo sapiens
attggagggaaatctt

SEQ ID NO: 5275659 - DNA, 13 bp, Homo sapiens
attggagggaaga

SEQ ID NO: 5275660 - DNA, 22 bp, Homo sapiens
attggagggtaaatgatgtggt

SEQ ID NO: 5275661 - DNA, 14 bp, Homo sapiens
attggagtgcagct

SEQ ID NO: 5275662 - DNA, 18 bp, Homo sapiens
attggagtttcaaatccc

SEQ ID NO: 5275663 - DNA, 13 bp, Homo sapiens
attggatacagca

SEQ ID NO: 5275664 - DNA, 15 bp, Homo sapiens
attggatacagcagt

SEQ ID NO: 5275665 - DNA, 21 bp, Homo sapiens
attggatatttgatatttggt

SEQ ID NO: 5275666 - DNA, 22 bp, Homo sapiens
attggatattttttactttaga

SEQ ID NO: 5275667 - DNA, 17 bp, Homo sapiens
attggatgcatttctat

SEQ ID NO: 5275668 - DNA, 16 bp, Homo sapiens
attggattatttaata

SEQ ID NO: 5275669 - DNA, 18 bp, Homo sapiens
attggattatttaataac

SEQ ID NO: 5275670 - DNA, 20 bp, Homo sapiens
attggattgcgcctttgtat

SEQ ID NO: 5275671 - DNA, 15 bp, Homo sapiens
attggatttcctaat

SEQ ID NO: 5275672 - DNA, 22 bp, Homo sapiens
attggatttcctaatactgtca

SEQ ID NO: 5275673 - DNA, 23 bp, Homo sapiens
attggatttcctaatactgtcat

SEQ ID NO: 5275674 - DNA, 14 bp, Homo sapiens
attggatttgtcca

SEQ ID NO: 5275675 - DNA, 22 bp, Homo sapiens
attggatttgtccaaacaggtg

SEQ ID NO: 5275676 - DNA, 13 bp, Homo sapiens
attggcaaaacta

SEQ ID NO: 5275677 - DNA, 23 bp, Homo sapiens
attggcaaaattacagttcacac

SEQ ID NO: 5275678 - DNA, 19 bp, Homo sapiens
attggcaaagtttaaatgt

SEQ ID NO: 5275679 - DNA, 22 bp, Homo sapiens
attggcaaagtttaaatgtatt

SEQ ID NO: 5275680 - DNA, 16 bp, Homo sapiens
attggcaagtcacgtt

SEQ ID NO: 5275681 - DNA, 21 bp, Homo sapiens
attggcacatgccacctggca

SEQ ID NO: 5275682 - DNA, 15 bp, Homo sapiens
attggcaccatgtgc

SEQ ID NO: 5275683 - DNA, 13 bp, Homo sapiens
attggcagatgag

SEQ ID NO: 5275684 - DNA, 16 bp, Homo sapiens
attggcagcacagcta

SEQ ID NO: 5275685 - DNA, 12 bp, Homo sapiens
attggcagcaga

SEQ ID NO: 5275686 - DNA, 19 bp, Homo sapiens
attggcagcaggtgctgct

SEQ ID NO: 5275687 - DNA, 17 bp, Homo sapiens
attggcagcttcaaaac

SEQ ID NO: 5275688 - DNA, 16 bp, Homo sapiens
attggcaggaggcagg

SEQ ID NO: 5275689 - DNA, 17 bp, Homo sapiens
attggcaggtgtgggct

SEQ ID NO: 5275690 - DNA, 20 bp, Homo sapiens
attggcaggtgtgggctccc

SEQ ID NO: 5275691 - DNA, 17 bp, Homo sapiens
attggcagttcctggca

SEQ ID NO: 5275692 - DNA, 20 bp, Homo sapiens
attggcagttggaggacaca

SEQ ID NO: 5275693 - DNA, 15 bp, Homo sapiens
attggcataaaacaa

SEQ ID NO: 5275694 - DNA, 13 bp, Homo sapiens
atgtgctgctttg

SEQ ID NO: 5275695 - DNA, 16 bp, Homo sapiens
atgtgctgctttgata

SEQ ID NO: 5275696 - DNA, 19 bp, Homo sapiens
atgtgctgctttgatatat

SEQ ID NO: 5275697 - DNA, 15 bp, Homo sapiens
atgtgctgtaattta

SEQ ID NO: 5275698 - DNA, 19 bp, Homo sapiens
atgtgctgtctccatgctg

SEQ ID NO: 5275699 - DNA, 20 bp, Homo sapiens
atgtgctgtctccatgctgg

SEQ ID NO: 5275700 - DNA, 11 bp, Homo sapiens
atgtgctgtgt

SEQ ID NO: 5275701 - DNA, 15 bp, Homo sapiens
atgtgctgtgtaaag

SEQ ID NO: 5275702 - DNA, 16 bp, Homo sapiens
atgtgctgtgtaaagt

SEQ ID NO: 5275703 - DNA, 20 bp, Homo sapiens
atgtgctgtgtaaagttagt

SEQ ID NO: 5275704 - DNA, 21 bp, Homo sapiens
atgtgctgttagaatatgttg

SEQ ID NO: 5275705 - DNA, 17 bp, Homo sapiens
atgtgcttcatctgtgg

SEQ ID NO: 5275706 - DNA, 15 bp, Homo sapiens
atgtgcttcattgtt

SEQ ID NO: 5275707 - DNA, 21 bp, Homo sapiens
atgtgcttccctaggctgagc

SEQ ID NO: 5275708 - DNA, 22 bp, Homo sapiens
atgtgcttccctaggctgagct

SEQ ID NO: 5275709 - DNA, 21 bp, Homo sapiens
atgtgcttccgagattcagac

SEQ ID NO: 5275710 - DNA, 23 bp, Homo sapiens
atgtgcttctcagttgcagaaaa

SEQ ID NO: 5275711 - DNA, 22 bp, Homo sapiens
atgtgcttgaagattcaggctt

SEQ ID NO: 5275712 - DNA, 19 bp, Homo sapiens
atgtgcttgtgcctacctg

SEQ ID NO: 5275713 - DNA, 20 bp, Homo sapiens
atgtgcttgtgcctacctgg

SEQ ID NO: 5275714 - DNA, 22 bp, Homo sapiens
atgtgcttgtgcctacctggcc

SEQ ID NO: 5275715 - DNA, 21 bp, Homo sapiens
atgtgcttgtgtgtatgtcta

SEQ ID NO: 5275716 - DNA, 23 bp, Homo sapiens
atgtgcttgtgtgtatgtctatg

SEQ ID NO: 5275717 - DNA, 17 bp, Homo sapiens
atgtgctttatttgcaa

SEQ ID NO: 5275718 - DNA, 13 bp, Homo sapiens
atgtgctttgtag

SEQ ID NO: 5275719 - DNA, 22 bp, Homo sapiens
atgtgctttgtagcttaaaaaa

SEQ ID NO: 5275720 - DNA, 18 bp, Homo sapiens
atgtgctttgtggcttct

SEQ ID NO: 5275721 - DNA, 21 bp, Homo sapiens
atgtgcttttccatctaaaat

SEQ ID NO: 5275722 - DNA, 15 bp, Homo sapiens
atgtgcttttctcca

SEQ ID NO: 5275723 - DNA, 14 bp, Homo sapiens
atgtggaaatatac

SEQ ID NO: 5275724 - DNA, 23 bp, Homo sapiens
atgtggaactgctgccactgagg

SEQ ID NO: 5275725 - DNA, 14 bp, Homo sapiens
atgtggaagagcat

SEQ ID NO: 5275726 - DNA, 12 bp, Homo sapiens
atgtggaagtat

SEQ ID NO: 5275727 - DNA, 13 bp, Homo sapiens
atgtggaagtgtg

SEQ ID NO: 5275728 - DNA, 16 bp, Homo sapiens
atgtggaagtgtgggt

SEQ ID NO: 5275729 - DNA, 15 bp, Homo sapiens
atgtggaattacata

SEQ ID NO: 5275730 - DNA, 17 bp, Homo sapiens
atgtggaattacataac

SEQ ID NO: 5275731 - DNA, 13 bp, Homo sapiens
atgtggacatgca

SEQ ID NO: 5275732 - DNA, 22 bp, Homo sapiens
atgtggacgtcacgctccctga

SEQ ID NO: 5275733 - DNA, 15 bp, Homo sapiens
atgtggactaaatat

SEQ ID NO: 5275734 - DNA, 19 bp, Homo sapiens
atgtggacttttttgtaca

SEQ ID NO: 5275735 - DNA, 19 bp, Homo sapiens
atgtggagaacattcaatc

SEQ ID NO: 5275736 - DNA, 15 bp, Homo sapiens
atgtggagaagagtg

SEQ ID NO: 5275737 - DNA, 23 bp, Homo sapiens
atgtggagactgatggccaggca

SEQ ID NO: 5275738 - DNA, 19 bp, Homo sapiens
atgtggaggaagagccacc

SEQ ID NO: 5275739 - DNA, 20 bp, Homo sapiens
atgtggaggaagagccacct

SEQ ID NO: 5275740 - DNA, 23 bp, Homo sapiens
atgtggaggaagagccacctgca

SEQ ID NO: 5275741 - DNA, 20 bp, Homo sapiens
atgtggagggtggcgccctg

SEQ ID NO: 5275742 - DNA, 19 bp, Homo sapiens
atgtggagtctccctctga

SEQ ID NO: 5275743 - DNA, 14 bp, Homo sapiens
atgtggagtggaca

SEQ ID NO: 5275744 - DNA, 16 bp, Homo sapiens
atgtggagtggggcag

SEQ ID NO: 5275745 - DNA, 23 bp, Homo sapiens
atgtggataaaactgtgtaaacc

SEQ ID NO: 5275746 - DNA, 18 bp, Homo sapiens
atgtggatacagtcatta

SEQ ID NO: 5275747 - DNA, 14 bp, Homo sapiens
atgtggatgctctt

SEQ ID NO: 5275748 - DNA, 22 bp, Homo sapiens
atgtggattagctagaatgcac

SEQ ID NO: 5275749 - DNA, 15 bp, Homo sapiens
atgtggatttcctat

SEQ ID NO: 5275750 - DNA, 17 bp, Homo sapiens
atgtggattttttccta

SEQ ID NO: 5275751 - DNA, 20 bp, Homo sapiens
atgtggcaaactgaagctgc

SEQ ID NO: 5275752 - DNA, 18 bp, Homo sapiens
atgtggcaaggaaaaaca

SEQ ID NO: 5275753 - DNA, 23 bp, Homo sapiens
atgtggcaataaaggagaagaga

SEQ ID NO: 5275754 - DNA, 13 bp, Homo sapiens
atgtggcactgct

SEQ ID NO: 5275755 - DNA, 15 bp, Homo sapiens
atgtggcagatctac

SEQ ID NO: 5275756 - DNA, 23 bp, Homo sapiens
atgtggcagcaggcatggcttcc

SEQ ID NO: 5275757 - DNA, 13 bp, Homo sapiens
atgtggcagctgg

SEQ ID NO: 5275758 - DNA, 24 bp, Homo sapiens
atgtggcagctggggagcagctga

SEQ ID NO: 5275759 - DNA, 15 bp, Homo sapiens
atgtggcaggggcag

SEQ ID NO: 5275760 - DNA, 17 bp, Homo sapiens
atgtggcaggggcagtg

SEQ ID NO: 5275761 - DNA, 19 bp, Homo sapiens
atgtggcaggggcagtggc

SEQ ID NO: 5275762 - DNA, 22 bp, Homo sapiens
atgtggcattggggggccgggc

SEQ ID NO: 5275763 - DNA, 17 bp, Homo sapiens
atgtggccaagcctatc

SEQ ID NO: 5275764 - DNA, 14 bp, Homo sapiens
atgtggccctggcc

SEQ ID NO: 5275765 - DNA, 19 bp, Homo sapiens
atgtggccctggcctgctg

SEQ ID NO: 5275766 - DNA, 16 bp, Homo sapiens
atgtggccgaggactt

SEQ ID NO: 5275767 - DNA, 18 bp, Homo sapiens
atgtggcctaatattgaa

SEQ ID NO: 5275768 - DNA, 17 bp, Homo sapiens
atgtggctccccctgaa

SEQ ID NO: 5275769 - DNA, 11 bp, Homo sapiens
atgtggctgaa

SEQ ID NO: 5275770 - DNA, 14 bp, Homo sapiens
atgtggctgaagac

SEQ ID NO: 5275771 - DNA, 17 bp, Homo sapiens
atgtggctgcagcagcg

SEQ ID NO: 5275772 - DNA, 13 bp, Homo sapiens
atgtggctgcccc

SEQ ID NO: 5275773 - DNA, 20 bp, Homo sapiens
atgtggctggaagatcctgc

SEQ ID NO: 5275774 - DNA, 17 bp, Homo sapiens
atgtggcttctctgtct

SEQ ID NO: 5275775 - DNA, 19 bp, Homo sapiens
atgtgggaaaaaagaaatc

SEQ ID NO: 5275776 - DNA, 15 bp, Homo sapiens
atgtgggaagaaaca

SEQ ID NO: 5275777 - DNA, 19 bp, Homo sapiens
atgtgggagctgaaccaca

SEQ ID NO: 5275778 - DNA, 11 bp, Homo sapiens
atgtgggatgg

SEQ ID NO: 5275779 - DNA, 13 bp, Homo sapiens
atgtgggcactgg

SEQ ID NO: 5275780 - DNA, 18 bp, Homo sapiens
atgtgggcactggcccag

SEQ ID NO: 5275781 - DNA, 17 bp, Homo sapiens
atgtgggcgtttgtaaa

SEQ ID NO: 5275782 - DNA, 22 bp, Homo sapiens
atgtgggctcagatcctgggca

SEQ ID NO: 5275783 - DNA, 16 bp, Homo sapiens
atgtgggctgaaggat

SEQ ID NO: 5275784 - DNA, 19 bp, Homo sapiens
atgtggggatgtttgtgct

SEQ ID NO: 5275785 - DNA, 16 bp, Homo sapiens
atgtggggccaggtca

SEQ ID NO: 5275786 - DNA, 13 bp, Homo sapiens
atgtggggctgag

SEQ ID NO: 5275787 - DNA, 18 bp, Homo sapiens
atgtggggctgagctggg

SEQ ID NO: 5275788 - DNA, 16 bp, Homo sapiens
atgtgggggcttcatc

SEQ ID NO: 5275789 - DNA, 18 bp, Homo sapiens
atgtgggggtctgtgtgt

SEQ ID NO: 5275790 - DNA, 21 bp, Homo sapiens
atgtggggtccccatcatccc

SEQ ID NO: 5275791 - DNA, 19 bp, Homo sapiens
atgtgggtaagaggagcag

SEQ ID NO: 5275792 - DNA, 20 bp, Homo sapiens
atgtgggtcttatgcttcca

SEQ ID NO: 5275793 - DNA, 15 bp, Homo sapiens
atgtgggtcttccag

SEQ ID NO: 5275794 - DNA, 16 bp, Homo sapiens
atgtgggtgtcctgca

SEQ ID NO: 5275795 - DNA, 20 bp, Homo sapiens
atgtgggttatacacatgga

SEQ ID NO: 5275796 - DNA, 16 bp, Homo sapiens
atgtgggttccacaga

SEQ ID NO: 5275797 - DNA, 19 bp, Homo sapiens
atgtggtattggtgctttg

SEQ ID NO: 5275798 - DNA, 16 bp, Homo sapiens
atgtggtcacagctgt

SEQ ID NO: 5275799 - DNA, 17 bp, Homo sapiens
atgtggtcacagctgta

SEQ ID NO: 5275800 - DNA, 20 bp, Homo sapiens
atgtggtccatctctgaaaa

SEQ ID NO: 5275801 - DNA, 21 bp, Homo sapiens
atgtggtccatctctgaaaac

SEQ ID NO: 5275802 - DNA, 22 bp, Homo sapiens
atgtggtccatctctgaaaaca

SEQ ID NO: 5275803 - DNA, 18 bp, Homo sapiens
atgtggtcttatgatttt

SEQ ID NO: 5275804 - DNA, 19 bp, Homo sapiens
atgtggtcttatgatttta

SEQ ID NO: 5275805 - DNA, 16 bp, Homo sapiens
atgtggtgaaaagcag

SEQ ID NO: 5275806 - DNA, 18 bp, Homo sapiens
atgtggtgaggcaggctt

SEQ ID NO: 5275807 - DNA, 13 bp, Homo sapiens
atgtggtgatgat

SEQ ID NO: 5275808 - DNA, 17 bp, Homo sapiens
atgtggtgtggggcgtg

SEQ ID NO: 5275809 - DNA, 21 bp, Homo sapiens
atgtggttaattttgcatatc

SEQ ID NO: 5275810 - DNA, 15 bp, Homo sapiens
atgtggttacacact

SEQ ID NO: 5275811 - DNA, 23 bp, Homo sapiens
atgtggttaccgagtatctgtaa

SEQ ID NO: 5275812 - DNA, 23 bp, Homo sapiens
atgtggttacttcctactgtagg

SEQ ID NO: 5275813 - DNA, 23 bp, Homo sapiens
atgtggttcagtgccttcctctc

SEQ ID NO: 5275814 - DNA, 16 bp, Homo sapiens
atgtggttgaagagca

SEQ ID NO: 5275815 - DNA, 20 bp, Homo sapiens
atgtggttgcaaggccgctg

SEQ ID NO: 5275816 - DNA, 21 bp, Homo sapiens
atgtggtttgtacatatcaaa

SEQ ID NO: 5275817 - DNA, 17 bp, Homo sapiens
atgtggtttttaatttt

SEQ ID NO: 5275818 - DNA, 16 bp, Homo sapiens
atgtggtttttgatgc

SEQ ID NO: 5275819 - DNA, 13 bp, Homo sapiens
atgtgtaaaattg

SEQ ID NO: 5275820 - DNA, 14 bp, Homo sapiens
atgtgtaaaattgg

SEQ ID NO: 5275821 - DNA, 22 bp, Homo sapiens
atgtgtaaaattggattattac

SEQ ID NO: 5275822 - DNA, 15 bp, Homo sapiens
atgtgtaaagattta

SEQ ID NO: 5275823 - DNA, 11 bp, Homo sapiens
atgtgtaaatg

SEQ ID NO: 5275824 - DNA, 13 bp, Homo sapiens
atgtgtaaatgga

SEQ ID NO: 5275825 - DNA, 16 bp, Homo sapiens
atgtgtaaatgttatg

SEQ ID NO: 5275826 - DNA, 19 bp, Homo sapiens
atgtgtaaatgttatgact

SEQ ID NO: 5275827 - DNA, 16 bp, Homo sapiens
atgtgtaacagagttg

SEQ ID NO: 5275828 - DNA, 12 bp, Homo sapiens
atgtgtaacagg

SEQ ID NO: 5275829 - DNA, 22 bp, Homo sapiens
atgtgtaacaggatacaggtga

SEQ ID NO: 5275830 - DNA, 22 bp, Homo sapiens
atgtgtaagaacaatgccaggg

SEQ ID NO: 5275831 - DNA, 16 bp, Homo sapiens
atgtgtaagcattgta

SEQ ID NO: 5275832 - DNA, 20 bp, Homo sapiens
atgtgtaaggatgagcagca

SEQ ID NO: 5275833 - DNA, 13 bp, Homo sapiens
atgtgtaataaat

SEQ ID NO: 5275834 - DNA, 15 bp, Homo sapiens
atgtgtaataatgta

SEQ ID NO: 5275835 - DNA, 20 bp, Homo sapiens
atgtgtaatattccagtttt

SEQ ID NO: 5275836 - DNA, 16 bp, Homo sapiens
atgtgtaatcaataaa

SEQ ID NO: 5275837 - DNA, 20 bp, Homo sapiens
atgtgtaatcaataaacgat

SEQ ID NO: 5275838 - DNA, 11 bp, Homo sapiens
atgtgtaatga

SEQ ID NO: 5275839 - DNA, 12 bp, Homo sapiens
atgtgtaatttt

SEQ ID NO: 5275840 - DNA, 15 bp, Homo sapiens
atgtgtaatttttct

SEQ ID NO: 5275841 - DNA, 22 bp, Homo sapiens
atgtgtaatttttctgtataga

SEQ ID NO: 5275842 - DNA, 22 bp, Homo sapiens
atgtgtacaaaagtttcatcct

SEQ ID NO: 5275843 - DNA, 20 bp, Homo sapiens
atgtgtacaatgtacacact

SEQ ID NO: 5275844 - DNA, 10 bp, Homo sapiens
atgtgtacac

SEQ ID NO: 5275845 - DNA, 16 bp, Homo sapiens
atgtgtacacatatga

SEQ ID NO: 5275846 - DNA, 16 bp, Homo sapiens
atgtgtacatatatgt

SEQ ID NO: 5275847 - DNA, 21 bp, Homo sapiens
atgtgtacatcccatgtaaca

SEQ ID NO: 5275848 - DNA, 22 bp, Homo sapiens
atgtgtacatgtagttgaattt

SEQ ID NO: 5275849 - DNA, 16 bp, Homo sapiens
atgtgtacgtgtgtgt

SEQ ID NO: 5275850 - DNA, 12 bp, Homo sapiens
atgtgtactggt

SEQ ID NO: 5275851 - DNA, 12 bp, Homo sapiens
atgtgtagatat

SEQ ID NO: 5275852 - DNA, 17 bp, Homo sapiens
atgtgtagattgcgtgg

SEQ ID NO: 5275853 - DNA, 15 bp, Homo sapiens
atgtgtagcctatgt

SEQ ID NO: 5275854 - DNA, 16 bp, Homo sapiens
atgtgtagcctgtgca

SEQ ID NO: 5275855 - DNA, 23 bp, Homo sapiens
atgtgtagcctgtgcatgtatgt

SEQ ID NO: 5275856 - DNA, 17 bp, Homo sapiens
atgtgtaggatgtatgc

SEQ ID NO: 5275857 - DNA, 22 bp, Homo sapiens
atgtgtaggcagtttagtgcat

SEQ ID NO: 5275858 - DNA, 20 bp, Homo sapiens
atgtgtagggaaagttaaaa

SEQ ID NO: 5275859 - DNA, 19 bp, Homo sapiens
atgtgtaggtgaacagtca

SEQ ID NO: 5275860 - DNA, 20 bp, Homo sapiens
atgtgtagttataaaccaat

SEQ ID NO: 5275861 - DNA, 19 bp, Homo sapiens
atgtgtagttcatgtaaat

SEQ ID NO: 5275862 - DNA, 22 bp, Homo sapiens
atgtgtagttgtctctcttcag

SEQ ID NO: 5275863 - DNA, 23 bp, Homo sapiens
atgtgtataaaaataaaaaagat

SEQ ID NO: 5275864 - DNA, 15 bp, Homo sapiens
atgtgtataaacaag

SEQ ID NO: 5275865 - DNA, 21 bp, Homo sapiens
atgtgtataattttaaagtaa

SEQ ID NO: 5275866 - DNA, 22 bp, Homo sapiens
atgtgtataattttaaagtaat

SEQ ID NO: 5275867 - DNA, 23 bp, Homo sapiens
atgtgtatacacttaaacttgca

SEQ ID NO: 5275868 - DNA, 17 bp, Homo sapiens
atgtgtatatatacata

SEQ ID NO: 5275869 - DNA, 22 bp, Homo sapiens
atgtgtatatatatgtgaggat

SEQ ID NO: 5275870 - DNA, 15 bp, Homo sapiens
atgtgtatatatgtc

SEQ ID NO: 5275871 - DNA, 22 bp, Homo sapiens
attggcatagaaaaaagtagca

SEQ ID NO: 5275872 - DNA, 22 bp, Homo sapiens
attggcatggaaatttaaagca

SEQ ID NO: 5275873 - DNA, 23 bp, Homo sapiens
attggcatggaaatttaaagcag

SEQ ID NO: 5275874 - DNA, 18 bp, Homo sapiens
attggcatggatttctgt

SEQ ID NO: 5275875 - DNA, 22 bp, Homo sapiens
attggcatggttgttgcatata

SEQ ID NO: 5275876 - DNA, 14 bp, Homo sapiens
attggcatgtgtat

SEQ ID NO: 5275877 - DNA, 17 bp, Homo sapiens
attggcatgtgtatgtt

SEQ ID NO: 5275878 - DNA, 18 bp, Homo sapiens
attggcattctttgcaat

SEQ ID NO: 5275879 - DNA, 12 bp, Homo sapiens
attggccaatta

SEQ ID NO: 5275880 - DNA, 22 bp, Homo sapiens
attggccacctgtagccatctg

SEQ ID NO: 5275881 - DNA, 22 bp, Homo sapiens
attggccactggatcctgctgc

SEQ ID NO: 5275882 - DNA, 22 bp, Homo sapiens
attggccattctattgtggcaa

SEQ ID NO: 5275883 - DNA, 16 bp, Homo sapiens
attggcccaacactgt

SEQ ID NO: 5275884 - DNA, 20 bp, Homo sapiens
attggcccaagtcattgttt

SEQ ID NO: 5275885 - DNA, 17 bp, Homo sapiens
attggccctgcccctcc

SEQ ID NO: 5275886 - DNA, 13 bp, Homo sapiens
attggcctccagg

SEQ ID NO: 5275887 - DNA, 15 bp, Homo sapiens
attggcctcccaaaa

SEQ ID NO: 5275888 - DNA, 12 bp, Homo sapiens
attggcctctgt

SEQ ID NO: 5275889 - DNA, 14 bp, Homo sapiens
attggcctctgtat

SEQ ID NO: 5275890 - DNA, 18 bp, Homo sapiens
attggcctgaacagatgt

SEQ ID NO: 5275891 - DNA, 19 bp, Homo sapiens
attggcctgaacagatgta

SEQ ID NO: 5275892 - DNA, 23 bp, Homo sapiens
attggcctgaacagatgtaaatc

SEQ ID NO: 5275893 - DNA, 18 bp, Homo sapiens
attggcctggcctccagc

SEQ ID NO: 5275894 - DNA, 19 bp, Homo sapiens
attggcctggcctccagct

SEQ ID NO: 5275895 - DNA, 21 bp, Homo sapiens
attggcctggcctccagctcc

SEQ ID NO: 5275896 - DNA, 22 bp, Homo sapiens
attggcctgtagagttgctgag

SEQ ID NO: 5275897 - DNA, 18 bp, Homo sapiens
attggccttaactggccc

SEQ ID NO: 5275898 - DNA, 19 bp, Homo sapiens
attggccttaactggccct

SEQ ID NO: 5275899 - DNA, 20 bp, Homo sapiens
attggccttaactggccctc

SEQ ID NO: 5275900 - DNA, 21 bp, Homo sapiens
attggccttaactggccctcg

SEQ ID NO: 5275901 - DNA, 17 bp, Homo sapiens
attggctaaaagacatg

SEQ ID NO: 5275902 - DNA, 20 bp, Homo sapiens
attggctaaaagacatgcat

SEQ ID NO: 5275903 - DNA, 16 bp, Homo sapiens
attggctactatggca

SEQ ID NO: 5275904 - DNA, 19 bp, Homo sapiens
attggctagaggttcaaag

SEQ ID NO: 5275905 - DNA, 17 bp, Homo sapiens
attggctatataaaatg

SEQ ID NO: 5275906 - DNA, 20 bp, Homo sapiens
attggctatataaaatgtgg

SEQ ID NO: 5275907 - DNA, 17 bp, Homo sapiens
attggctatttaaaact

SEQ ID NO: 5275908 - DNA, 19 bp, Homo sapiens
attggctatttaaagacaa

SEQ ID NO: 5275909 - DNA, 16 bp, Homo sapiens
attggctcacactgag

SEQ ID NO: 5275910 - DNA, 21 bp, Homo sapiens
attggctccatatcatttgag

SEQ ID NO: 5275911 - DNA, 12 bp, Homo sapiens
attggctcccaa

SEQ ID NO: 5275912 - DNA, 15 bp, Homo sapiens
attggctcctttccc

SEQ ID NO: 5275913 - DNA, 16 bp, Homo sapiens
attggctcctttccca

SEQ ID NO: 5275914 - DNA, 22 bp, Homo sapiens
attggctgaactcatgagaagt

SEQ ID NO: 5275915 - DNA, 22 bp, Homo sapiens
attggctgccaagagtccaagc

SEQ ID NO: 5275916 - DNA, 15 bp, Homo sapiens
attggctgctttgcc

SEQ ID NO: 5275917 - DNA, 23 bp, Homo sapiens
attggctgggcaaaagaatgttt

SEQ ID NO: 5275918 - DNA, 21 bp, Homo sapiens
attggcttaaagtgaaggaaa

SEQ ID NO: 5275919 - DNA, 18 bp, Homo sapiens
attggcttactgaaagac

SEQ ID NO: 5275920 - DNA, 19 bp, Homo sapiens
attggcttattttttaaaa

SEQ ID NO: 5275921 - DNA, 22 bp, Homo sapiens
attggcttccagattttaaatt

SEQ ID NO: 5275922 - DNA, 17 bp, Homo sapiens
attggcttgataaacat

SEQ ID NO: 5275923 - DNA, 16 bp, Homo sapiens
attggcttgtagaatt

SEQ ID NO: 5275924 - DNA, 17 bp, Homo sapiens
attggcttgtagaattg

SEQ ID NO: 5275925 - DNA, 14 bp, Homo sapiens
attggcttgtctca

SEQ ID NO: 5275926 - DNA, 17 bp, Homo sapiens
attggctttatcctctt

SEQ ID NO: 5275927 - DNA, 18 bp, Homo sapiens
attggctttctctccttg

SEQ ID NO: 5275928 - DNA, 14 bp, Homo sapiens
attggctttgtgct

SEQ ID NO: 5275929 - DNA, 13 bp, Homo sapiens
attggcttttctg

SEQ ID NO: 5275930 - DNA, 16 bp, Homo sapiens
attggcttttctgatc

SEQ ID NO: 5275931 - DNA, 16 bp, Homo sapiens
attgggaactgaaatc

SEQ ID NO: 5275932 - DNA, 17 bp, Homo sapiens
attgggaagctggggga

SEQ ID NO: 5275933 - DNA, 18 bp, Homo sapiens
attgggaagctgggggaa

SEQ ID NO: 5275934 - DNA, 15 bp, Homo sapiens
attgggaatgcaata

SEQ ID NO: 5275935 - DNA, 22 bp, Homo sapiens
attgggacacacatcaaaaacc

SEQ ID NO: 5275936 - DNA, 17 bp, Homo sapiens
attgggactagtttata

SEQ ID NO: 5275937 - DNA, 17 bp, Homo sapiens
attgggactggggctga

SEQ ID NO: 5275938 - DNA, 12 bp, Homo sapiens
attgggagaaag

SEQ ID NO: 5275939 - DNA, 18 bp, Homo sapiens
attgggagaagtggaaat

SEQ ID NO: 5275940 - DNA, 12 bp, Homo sapiens
attgggagaggt

SEQ ID NO: 5275941 - DNA, 19 bp, Homo sapiens
attgggagcaatctggaaa

SEQ ID NO: 5275942 - DNA, 21 bp, Homo sapiens
attgggagcttgggaatggat

SEQ ID NO: 5275943 - DNA, 20 bp, Homo sapiens
attgggagtccaggcacagg

SEQ ID NO: 5275944 - DNA, 18 bp, Homo sapiens
attgggatatcattttaa

SEQ ID NO: 5275945 - DNA, 15 bp, Homo sapiens
attgggatctgtctt

SEQ ID NO: 5275946 - DNA, 17 bp, Homo sapiens
attgggcacatcatttc

SEQ ID NO: 5275947 - DNA, 19 bp, Homo sapiens
attgggcacatcatttcaa

SEQ ID NO: 5275948 - DNA, 23 bp, Homo sapiens
attgggcacatcatttcaagaag

SEQ ID NO: 5275949 - DNA, 20 bp, Homo sapiens
attgggcagaatcctgggcc

SEQ ID NO: 5275950 - DNA, 21 bp, Homo sapiens
attgggcagaatcctgggccc

SEQ ID NO: 5275951 - DNA, 19 bp, Homo sapiens
attgggcagcgcccttcct

SEQ ID NO: 5275952 - DNA, 16 bp, Homo sapiens
attgggccagcttttc

SEQ ID NO: 5275953 - DNA, 19 bp, Homo sapiens
attgggcccttagaatgtg

SEQ ID NO: 5275954 - DNA, 19 bp, Homo sapiens
attgggccttttggatatg

SEQ ID NO: 5275955 - DNA, 22 bp, Homo sapiens
attgggcggggcttctcttggg

SEQ ID NO: 5275956 - DNA, 12 bp, Homo sapiens
attgggctggct

SEQ ID NO: 5275957 - DNA, 15 bp, Homo sapiens
attgggcttaatata

SEQ ID NO: 5275958 - DNA, 16 bp, Homo sapiens
attgggcttcaatcac

SEQ ID NO: 5275959 - DNA, 18 bp, Homo sapiens
attgggcttcaatcactg

SEQ ID NO: 5275960 - DNA, 15 bp, Homo sapiens
attgggcttcttcgt

SEQ ID NO: 5275961 - DNA, 19 bp, Homo sapiens
attggggaagactgtggct

SEQ ID NO: 5275962 - DNA, 22 bp, Homo sapiens
attggggaagagagcctgcagg

SEQ ID NO: 5275963 - DNA, 23 bp, Homo sapiens
attggggaagagagcctgcagga

SEQ ID NO: 5275964 - DNA, 12 bp, Homo sapiens
attggggaggag

SEQ ID NO: 5275965 - DNA, 23 bp, Homo sapiens
attggggagggagaaagggtagt

SEQ ID NO: 5275966 - DNA, 14 bp, Homo sapiens
attggggattctta

SEQ ID NO: 5275967 - DNA, 22 bp, Homo sapiens
attggggattcttaaagttgaa

SEQ ID NO: 5275968 - DNA, 21 bp, Homo sapiens
attggggctcccagccaggcc

SEQ ID NO: 5275969 - DNA, 19 bp, Homo sapiens
attgggggagtcatggtca

SEQ ID NO: 5275970 - DNA, 21 bp, Homo sapiens
attgggggatgtgaagaaata

SEQ ID NO: 5275971 - DNA, 13 bp, Homo sapiens
attggggtagttg

SEQ ID NO: 5275972 - DNA, 17 bp, Homo sapiens
attggggttgcaacaat

SEQ ID NO: 5275973 - DNA, 20 bp, Homo sapiens
attggggttggttggggtgg

SEQ ID NO: 5275974 - DNA, 18 bp, Homo sapiens
attggggtttctggttgg

SEQ ID NO: 5275975 - DNA, 21 bp, Homo sapiens
attgggtatcaagacatagca

SEQ ID NO: 5275976 - DNA, 18 bp, Homo sapiens
attgggtcatagaaattc

SEQ ID NO: 5275977 - DNA, 10 bp, Homo sapiens
attgggtccc

SEQ ID NO: 5275978 - DNA, 16 bp, Homo sapiens
attgggtctattccag

SEQ ID NO: 5275979 - DNA, 17 bp, Homo sapiens
attgggtctattccagc

SEQ ID NO: 5275980 - DNA, 22 bp, Homo sapiens
attgggtgaatatggtggaaaa

SEQ ID NO: 5275981 - DNA, 23 bp, Homo sapiens
attgggtgaatatggtggaaaat

SEQ ID NO: 5275982 - DNA, 21 bp, Homo sapiens
attgggtggggggcttcatac

SEQ ID NO: 5275983 - DNA, 18 bp, Homo sapiens
attgggtgggtaaattca

SEQ ID NO: 5275984 - DNA, 13 bp, Homo sapiens
attgggtgtagat

SEQ ID NO: 5275985 - DNA, 17 bp, Homo sapiens
attgggttatgaatatt

SEQ ID NO: 5275986 - DNA, 19 bp, Homo sapiens
attgggtttggggccatgg

SEQ ID NO: 5275987 - DNA, 19 bp, Homo sapiens
attgggtttttggacttct

SEQ ID NO: 5275988 - DNA, 18 bp, Homo sapiens
attggtaaagaatggaag

SEQ ID NO: 5275989 - DNA, 23 bp, Homo sapiens
attggtaaattctggtatacatt

SEQ ID NO: 5275990 - DNA, 15 bp, Homo sapiens
attggtaacatcctt

SEQ ID NO: 5275991 - DNA, 21 bp, Homo sapiens
attggtaactaggatatgtat

SEQ ID NO: 5275992 - DNA, 20 bp, Homo sapiens
attggtaaggcctctggact

SEQ ID NO: 5275993 - DNA, 22 bp, Homo sapiens
attggtaattacctggagaaga

SEQ ID NO: 5275994 - DNA, 15 bp, Homo sapiens
attggtaccttgcac

SEQ ID NO: 5275995 - DNA, 18 bp, Homo sapiens
attggtaccttgcacaca

SEQ ID NO: 5275996 - DNA, 22 bp, Homo sapiens
attggtacttacccttctacaa

SEQ ID NO: 5275997 - DNA, 14 bp, Homo sapiens
attggtagaggaag

SEQ ID NO: 5275998 - DNA, 19 bp, Homo sapiens
attggtaggatttatatct

SEQ ID NO: 5275999 - DNA, 17 bp, Homo sapiens
attggtagtgtgggaat

SEQ ID NO: 5276000 - DNA, 17 bp, Homo sapiens
attggtatcaagaaagt

SEQ ID NO: 5276001 - DNA, 16 bp, Homo sapiens
attggtattaaagaat

SEQ ID NO: 5276002 - DNA, 18 bp, Homo sapiens
attggtattcactaatct

SEQ ID NO: 5276003 - DNA, 14 bp, Homo sapiens
attggtcattaaat

SEQ ID NO: 5276004 - DNA, 15 bp, Homo sapiens
attggtcattaaata

SEQ ID NO: 5276005 - DNA, 23 bp, Homo sapiens
attggtctctatctcctgaatct

SEQ ID NO: 5276006 - DNA, 18 bp, Homo sapiens
attggtgataagtggaaa

SEQ ID NO: 5276007 - DNA, 17 bp, Homo sapiens
attggtgctatttaaca

SEQ ID NO: 5276008 - DNA, 22 bp, Homo sapiens
attggtgcttcagccctggccc

SEQ ID NO: 5276009 - DNA, 15 bp, Homo sapiens
attggtgggaagcaa

SEQ ID NO: 5276010 - DNA, 23 bp, Homo sapiens
attggtgggtggtgtatttgaga

SEQ ID NO: 5276011 - DNA, 16 bp, Homo sapiens
attggtgtactgtgtt

SEQ ID NO: 5276012 - DNA, 14 bp, Homo sapiens
attggtgtatatta

SEQ ID NO: 5276013 - DNA, 23 bp, Homo sapiens
attggtgttcgtttccatcatgt

SEQ ID NO: 5276014 - DNA, 13 bp, Homo sapiens
attggtgttgcca

SEQ ID NO: 5276015 - DNA, 16 bp, Homo sapiens
attggtgttgccagtt

SEQ ID NO: 5276016 - DNA, 21 bp, Homo sapiens
attggtgttgccagttgtcct

SEQ ID NO: 5276017 - DNA, 13 bp, Homo sapiens
attggtgttgccc

SEQ ID NO: 5276018 - DNA, 15 bp, Homo sapiens
attggttaatcactt

SEQ ID NO: 5276019 - DNA, 21 bp, Homo sapiens
attggttaatgaaaaatctga

SEQ ID NO: 5276020 - DNA, 16 bp, Homo sapiens
attggttacaaatttt

SEQ ID NO: 5276021 - DNA, 14 bp, Homo sapiens
attggttagtattt

SEQ ID NO: 5276022 - DNA, 22 bp, Homo sapiens
attggttctcctaaaacatgaa

SEQ ID NO: 5276023 - DNA, 21 bp, Homo sapiens
attggttcttcccctcatagt

SEQ ID NO: 5276024 - DNA, 23 bp, Homo sapiens
attggttggaagctaccagagct

SEQ ID NO: 5276025 - DNA, 19 bp, Homo sapiens
attggttggacactgtggt

SEQ ID NO: 5276026 - DNA, 19 bp, Homo sapiens
attggttggtgtgaagaaa

SEQ ID NO: 5276027 - DNA, 15 bp, Homo sapiens
attggttgtatataa

SEQ ID NO: 5276028 - DNA, 17 bp, Homo sapiens
attggtttaaaagtcac

SEQ ID NO: 5276029 - DNA, 17 bp, Homo sapiens
attggtttaaagaaagt

SEQ ID NO: 5276030 - DNA, 18 bp, Homo sapiens
attggtttctcttctccc

SEQ ID NO: 5276031 - DNA, 17 bp, Homo sapiens
attggtttctgtttgaa

SEQ ID NO: 5276032 - DNA, 19 bp, Homo sapiens
attggttttgaaatgtttc

SEQ ID NO: 5276033 - DNA, 23 bp, Homo sapiens
attggttttggggaaatgtggag

SEQ ID NO: 5276034 - DNA, 15 bp, Homo sapiens
attggtttttttgta

SEQ ID NO: 5276035 - DNA, 17 bp, Homo sapiens
attgtaaaaaaaaatgc

SEQ ID NO: 5276036 - DNA, 14 bp, Homo sapiens
attgtaaaaaattc

SEQ ID NO: 5276037 - DNA, 17 bp, Homo sapiens
attgtaaaaaattcaca

SEQ ID NO: 5276038 - DNA, 18 bp, Homo sapiens
attgtaaaaaattcacat

SEQ ID NO: 5276039 - DNA, 19 bp, Homo sapiens
attgtaaaaaattcacata

SEQ ID NO: 5276040 - DNA, 14 bp, Homo sapiens
attgtaaaaataat

SEQ ID NO: 5276041 - DNA, 13 bp, Homo sapiens
attgtaaaacatt

SEQ ID NO: 5276042 - DNA, 18 bp, Homo sapiens
attgtaaaacattcacac

SEQ ID NO: 5276043 - DNA, 23 bp, Homo sapiens
attgtaaaagcattttgtaataa

SEQ ID NO: 5276044 - DNA, 17 bp, Homo sapiens
attgtaaaataattctg

SEQ ID NO: 5276045 - DNA, 21 bp, Homo sapiens
attgtaaaatagcttgtatag

SEQ ID NO: 5276046 - DNA, 17 bp, Homo sapiens
attgtaaacaaactctt

SEQ ID NO: 5276047 - DNA, 14 bp, Homo sapiens
atgtgtatatatta

SEQ ID NO: 5276048 - DNA, 21 bp, Homo sapiens
atgtgtatatgtttatacaca

SEQ ID NO: 5276049 - DNA, 16 bp, Homo sapiens
atgtgtatatttgtag

SEQ ID NO: 5276050 - DNA, 21 bp, Homo sapiens
atgtgtatatttttgtatgtc

SEQ ID NO: 5276051 - DNA, 17 bp, Homo sapiens
atgtgtatctatttata

SEQ ID NO: 5276052 - DNA, 13 bp, Homo sapiens
atgtgtatgagaa

SEQ ID NO: 5276053 - DNA, 20 bp, Homo sapiens
atgtgtatgcacagtaaaaa

SEQ ID NO: 5276054 - DNA, 13 bp, Homo sapiens
atgtgtatgtact

SEQ ID NO: 5276055 - DNA, 14 bp, Homo sapiens
atgtgtatgtgtct

SEQ ID NO: 5276056 - DNA, 18 bp, Homo sapiens
atgtgtatgtgtggtttc

SEQ ID NO: 5276057 - DNA, 15 bp, Homo sapiens
atgtgtatgtgtgtg

SEQ ID NO: 5276058 - DNA, 16 bp, Homo sapiens
atgtgtatgtgtgtga

SEQ ID NO: 5276059 - DNA, 14 bp, Homo sapiens
atgtgtatgtgttt

SEQ ID NO: 5276060 - DNA, 14 bp, Homo sapiens
atgtgtatttatac

SEQ ID NO: 5276061 - DNA, 20 bp, Homo sapiens
atgtgtatttccagtgcaat

SEQ ID NO: 5276062 - DNA, 22 bp, Homo sapiens
atgtgtatttcttaagaattca

SEQ ID NO: 5276063 - DNA, 18 bp, Homo sapiens
atgtgtatttgtatgtac

SEQ ID NO: 5276064 - DNA, 20 bp, Homo sapiens
atgtgtatttttcaaggcat

SEQ ID NO: 5276065 - DNA, 21 bp, Homo sapiens
atgtgtatttttcaaggcatt

SEQ ID NO: 5276066 - DNA, 15 bp, Homo sapiens
atgtgtcaaaataaa

SEQ ID NO: 5276067 - DNA, 14 bp, Homo sapiens
atgtgtcaaagaga

SEQ ID NO: 5276068 - DNA, 16 bp, Homo sapiens
atgtgtcaaattataa

SEQ ID NO: 5276069 - DNA, 14 bp, Homo sapiens
atgtgtcaactgag

SEQ ID NO: 5276070 - DNA, 20 bp, Homo sapiens
atgtgtcaactgagagtcat

SEQ ID NO: 5276071 - DNA, 20 bp, Homo sapiens
atgtgtcaatgtaaagccaa

SEQ ID NO: 5276072 - DNA, 14 bp, Homo sapiens
atgtgtcacttgtg

SEQ ID NO: 5276073 - DNA, 19 bp, Homo sapiens
atgtgtcagaataggaaaa

SEQ ID NO: 5276074 - DNA, 15 bp, Homo sapiens
atgtgtcagcatgca

SEQ ID NO: 5276075 - DNA, 15 bp, Homo sapiens
atgtgtcatgatttc

SEQ ID NO: 5276076 - DNA, 19 bp, Homo sapiens
atgtgtcatgtaatactga

SEQ ID NO: 5276077 - DNA, 21 bp, Homo sapiens
atgtgtcatttccggctgctg

SEQ ID NO: 5276078 - DNA, 16 bp, Homo sapiens
atgtgtccatgtgaaa

SEQ ID NO: 5276079 - DNA, 15 bp, Homo sapiens
atgtgtccatttcct

SEQ ID NO: 5276080 - DNA, 14 bp, Homo sapiens
atgtgtcccagaag

SEQ ID NO: 5276081 - DNA, 18 bp, Homo sapiens
atgtgtcccagtgaacag

SEQ ID NO: 5276082 - DNA, 19 bp, Homo sapiens
atgtgtcccctcactctgt

SEQ ID NO: 5276083 - DNA, 22 bp, Homo sapiens
atgtgtcccctcactctgtcag

SEQ ID NO: 5276084 - DNA, 24 bp, Homo sapiens
atgtgtcccctcactctgtcagcc

SEQ ID NO: 5276085 - DNA, 17 bp, Homo sapiens
atgtgtccctggcgctg

SEQ ID NO: 5276086 - DNA, 18 bp, Homo sapiens
atgtgtccctggcgctgt

SEQ ID NO: 5276087 - DNA, 14 bp, Homo sapiens
atgtgtcctgacac

SEQ ID NO: 5276088 - DNA, 17 bp, Homo sapiens
atgtgtcctgacactgc

SEQ ID NO: 5276089 - DNA, 22 bp, Homo sapiens
atgtgtcgcctctcactctggc

SEQ ID NO: 5276090 - DNA, 19 bp, Homo sapiens
atgtgtctagcaaagccac

SEQ ID NO: 5276091 - DNA, 20 bp, Homo sapiens
atgtgtctcaggctcaagtt

SEQ ID NO: 5276092 - DNA, 22 bp, Homo sapiens
atgtgtctcaggctcaagtttt

SEQ ID NO: 5276093 - DNA, 14 bp, Homo sapiens
atgtgtctcccaga

SEQ ID NO: 5276094 - DNA, 15 bp, Homo sapiens
atgtgtctcccaggt

SEQ ID NO: 5276095 - DNA, 19 bp, Homo sapiens
atgtgtctctgctttcctt

SEQ ID NO: 5276096 - DNA, 15 bp, Homo sapiens
atgtgtctggaagaa

SEQ ID NO: 5276097 - DNA, 13 bp, Homo sapiens
atgtgtctgggag

SEQ ID NO: 5276098 - DNA, 20 bp, Homo sapiens
atgtgtctgggagagcctgg

SEQ ID NO: 5276099 - DNA, 17 bp, Homo sapiens
atgtgtctgtattcata

SEQ ID NO: 5276100 - DNA, 22 bp, Homo sapiens
atgtgtctgtattcatacagca

SEQ ID NO: 5276101 - DNA, 19 bp, Homo sapiens
atgtgtctgtgttgcttca

SEQ ID NO: 5276102 - DNA, 21 bp, Homo sapiens
atgtgtctttagatagccctg

SEQ ID NO: 5276103 - DNA, 12 bp, Homo sapiens
atgtgtctttat

SEQ ID NO: 5276104 - DNA, 14 bp, Homo sapiens
atgtgtgaaacaat

SEQ ID NO: 5276105 - DNA, 18 bp, Homo sapiens
atgtgtgaaggtcttgcc

SEQ ID NO: 5276106 - DNA, 18 bp, Homo sapiens
atgtgtgaattctgcaac

SEQ ID NO: 5276107 - DNA, 14 bp, Homo sapiens
atgtgtgactttca

SEQ ID NO: 5276108 - DNA, 15 bp, Homo sapiens
atgtgtgaggagctg

SEQ ID NO: 5276109 - DNA, 13 bp, Homo sapiens
atgtgtgagtgta

SEQ ID NO: 5276110 - DNA, 14 bp, Homo sapiens
atgtgtgagtgtat

SEQ ID NO: 5276111 - DNA, 16 bp, Homo sapiens
atgtgtgagtgtatgt

SEQ ID NO: 5276112 - DNA, 19 bp, Homo sapiens
atgtgtgagtgtatgtata

SEQ ID NO: 5276113 - DNA, 16 bp, Homo sapiens
atgtgtgagtgtgtgc

SEQ ID NO: 5276114 - DNA, 14 bp, Homo sapiens
atgtgtgcagagca

SEQ ID NO: 5276115 - DNA, 20 bp, Homo sapiens
atgtgtgcagagcagacagg

SEQ ID NO: 5276116 - DNA, 22 bp, Homo sapiens
atgtgtgcagagcagacaggct

SEQ ID NO: 5276117 - DNA, 23 bp, Homo sapiens
atgtgtgcagagcagacaggcta

SEQ ID NO: 5276118 - DNA, 12 bp, Homo sapiens
atgtgtgcatgt

SEQ ID NO: 5276119 - DNA, 13 bp, Homo sapiens
atgtgtgcatgtg

SEQ ID NO: 5276120 - DNA, 16 bp, Homo sapiens
atgtgtgcatgtgtgt

SEQ ID NO: 5276121 - DNA, 15 bp, Homo sapiens
atgtgtgccaaggct

SEQ ID NO: 5276122 - DNA, 20 bp, Homo sapiens
atgtgtgccagatgccctgt

SEQ ID NO: 5276123 - DNA, 13 bp, Homo sapiens
atgtgtgcccagc

SEQ ID NO: 5276124 - DNA, 13 bp, Homo sapiens
atgtgtgccctgg

SEQ ID NO: 5276125 - DNA, 18 bp, Homo sapiens
atgtgtgccctggactgt

SEQ ID NO: 5276126 - DNA, 23 bp, Homo sapiens
atgtgtgcctcctagagtgcagg

SEQ ID NO: 5276127 - DNA, 18 bp, Homo sapiens
atgtgtgcctggccgcag

SEQ ID NO: 5276128 - DNA, 15 bp, Homo sapiens
atgtgtgcgagtgtg

SEQ ID NO: 5276129 - DNA, 18 bp, Homo sapiens
atgtgtgcgagtgtgtgc

SEQ ID NO: 5276130 - DNA, 17 bp, Homo sapiens
atgtgtgctcttcttct

SEQ ID NO: 5276131 - DNA, 23 bp, Homo sapiens
atgtgtggagtgtgctgaacaca

SEQ ID NO: 5276132 - DNA, 18 bp, Homo sapiens
atgtgtggatgtgtaaat

SEQ ID NO: 5276133 - DNA, 16 bp, Homo sapiens
atgtgtggctcattct

SEQ ID NO: 5276134 - DNA, 19 bp, Homo sapiens
atgtgtggctgtgggtgtg

SEQ ID NO: 5276135 - DNA, 13 bp, Homo sapiens
atgtgtgggaaag

SEQ ID NO: 5276136 - DNA, 16 bp, Homo sapiens
atgtgtgggaaaggga

SEQ ID NO: 5276137 - DNA, 15 bp, Homo sapiens
atgtgtggggcatgg

SEQ ID NO: 5276138 - DNA, 23 bp, Homo sapiens
atgtgtgggtgaatgtgtgttca

SEQ ID NO: 5276139 - DNA, 16 bp, Homo sapiens
atgtgtgggtgctgat

SEQ ID NO: 5276140 - DNA, 20 bp, Homo sapiens
atgtgtgggtgtgtgttaca

SEQ ID NO: 5276141 - DNA, 19 bp, Homo sapiens
atgtgtggtggcctcagct

SEQ ID NO: 5276142 - DNA, 13 bp, Homo sapiens
atgtgtggtggtg

SEQ ID NO: 5276143 - DNA, 17 bp, Homo sapiens
atgtgtgtaagtgtgtg

SEQ ID NO: 5276144 - DNA, 18 bp, Homo sapiens
atgtgtgtagactgtaac

SEQ ID NO: 5276145 - DNA, 14 bp, Homo sapiens
atgtgtgtaggtta

SEQ ID NO: 5276146 - DNA, 21 bp, Homo sapiens
atgtgtgtataagtgcacaca

SEQ ID NO: 5276147 - DNA, 18 bp, Homo sapiens
atgtgtgtatatatgtgt

SEQ ID NO: 5276148 - DNA, 16 bp, Homo sapiens
atgtgtgtatatggac

SEQ ID NO: 5276149 - DNA, 17 bp, Homo sapiens
atgtgtgtatatgtatg

SEQ ID NO: 5276150 - DNA, 20 bp, Homo sapiens
atgtgtgtatgggtgtgtgt

SEQ ID NO: 5276151 - DNA, 14 bp, Homo sapiens
atgtgtgtatgtgt

SEQ ID NO: 5276152 - DNA, 16 bp, Homo sapiens
atgtgtgtatgtgtat

SEQ ID NO: 5276153 - DNA, 16 bp, Homo sapiens
atgtgtgtatgtgtgt

SEQ ID NO: 5276154 - DNA, 17 bp, Homo sapiens
atgtgtgtattttttca

SEQ ID NO: 5276155 - DNA, 21 bp, Homo sapiens
atgtgtgtccacgactgtctc

SEQ ID NO: 5276156 - DNA, 15 bp, Homo sapiens
atgtgtgtctatttt

SEQ ID NO: 5276157 - DNA, 10 bp, Homo sapiens
atgtgtgtga

SEQ ID NO: 5276158 - DNA, 11 bp, Homo sapiens
atgtgtgtgca

SEQ ID NO: 5276159 - DNA, 13 bp, Homo sapiens
atgtgtgtgcatg

SEQ ID NO: 5276160 - DNA, 10 bp, Homo sapiens
atgtgtgtgt

SEQ ID NO: 5276161 - DNA, 12 bp, Homo sapiens
atgtgtgtgtat

SEQ ID NO: 5276162 - DNA, 21 bp, Homo sapiens
atgtgtgtgtatgctactaca

SEQ ID NO: 5276163 - DNA, 15 bp, Homo sapiens
atgtgtgtgtatgtt

SEQ ID NO: 5276164 - DNA, 12 bp, Homo sapiens
atgtgtgtgtct

SEQ ID NO: 5276165 - DNA, 15 bp, Homo sapiens
atgtgtgtgtctcta

SEQ ID NO: 5276166 - DNA, 12 bp, Homo sapiens
atgtgtgtgtgc

SEQ ID NO: 5276167 - DNA, 14 bp, Homo sapiens
atgtgtgtgtgggt

SEQ ID NO: 5276168 - DNA, 12 bp, Homo sapiens
atgtgtgtgtgt

SEQ ID NO: 5276169 - DNA, 16 bp, Homo sapiens
atgtgtgtgtgtgtat

SEQ ID NO: 5276170 - DNA, 18 bp, Homo sapiens
atgtgtgttgatactgtt

SEQ ID NO: 5276171 - DNA, 19 bp, Homo sapiens
atgtgtgttgatactgttg

SEQ ID NO: 5276172 - DNA, 20 bp, Homo sapiens
atgtgtgttgatactgttgc

SEQ ID NO: 5276173 - DNA, 23 bp, Homo sapiens
atgtgtgttgatactgttgcacg

SEQ ID NO: 5276174 - DNA, 23 bp, Homo sapiens
atgtgtgttttaaaatgagaaat

SEQ ID NO: 5276175 - DNA, 14 bp, Homo sapiens
atgtgtgttttttc

SEQ ID NO: 5276176 - DNA, 20 bp, Homo sapiens
atgtgttaatcttaatgtat

SEQ ID NO: 5276177 - DNA, 15 bp, Homo sapiens
atgtgttacattatt

SEQ ID NO: 5276178 - DNA, 22 bp, Homo sapiens
atgtgttatagtaggattaatt

SEQ ID NO: 5276179 - DNA, 14 bp, Homo sapiens
atgtgttatctacc

SEQ ID NO: 5276180 - DNA, 17 bp, Homo sapiens
atgtgttatctacctca

SEQ ID NO: 5276181 - DNA, 13 bp, Homo sapiens
atgtgttatgaga

SEQ ID NO: 5276182 - DNA, 21 bp, Homo sapiens
atgtgttcattcaagctattt

SEQ ID NO: 5276183 - DNA, 21 bp, Homo sapiens
atgtgttccaaatttgcttta

SEQ ID NO: 5276184 - DNA, 22 bp, Homo sapiens
atgtgttccctttgtctttcaa

SEQ ID NO: 5276185 - DNA, 23 bp, Homo sapiens
atgtgttcctccattttcttatc

SEQ ID NO: 5276186 - DNA, 15 bp, Homo sapiens
atgtgttcctcctgc

SEQ ID NO: 5276187 - DNA, 23 bp, Homo sapiens
atgtgttctaagcaatgcaaatg

SEQ ID NO: 5276188 - DNA, 14 bp, Homo sapiens
atgtgttctattca

SEQ ID NO: 5276189 - DNA, 21 bp, Homo sapiens
atgtgttcttttctcctttac

SEQ ID NO: 5276190 - DNA, 19 bp, Homo sapiens
atgtgttgaccggctgccg

SEQ ID NO: 5276191 - DNA, 14 bp, Homo sapiens
atgtgttgcaaatt

SEQ ID NO: 5276192 - DNA, 19 bp, Homo sapiens
atgtgttgcaaattattct

SEQ ID NO: 5276193 - DNA, 18 bp, Homo sapiens
atgtgttgcataaacaat

SEQ ID NO: 5276194 - DNA, 18 bp, Homo sapiens
atgtgttgccaaaaccaa

SEQ ID NO: 5276195 - DNA, 19 bp, Homo sapiens
atgtgttgccactttccaa

SEQ ID NO: 5276196 - DNA, 22 bp, Homo sapiens
atgtgttgctctccattctttt

SEQ ID NO: 5276197 - DNA, 13 bp, Homo sapiens
atgtgttggaaac

SEQ ID NO: 5276198 - DNA, 16 bp, Homo sapiens
atgtgttggaaactgt

SEQ ID NO: 5276199 - DNA, 20 bp, Homo sapiens
atgtgttgtgtttgtagtct

SEQ ID NO: 5276200 - DNA, 12 bp, Homo sapiens
atgtgtttacat

SEQ ID NO: 5276201 - DNA, 22 bp, Homo sapiens
atgtgtttacatttactgaaat

SEQ ID NO: 5276202 - DNA, 17 bp, Homo sapiens
atgtgtttactttatgt

SEQ ID NO: 5276203 - DNA, 12 bp, Homo sapiens
atgtgtttagaa

SEQ ID NO: 5276204 - DNA, 14 bp, Homo sapiens
atgtgtttagaatt

SEQ ID NO: 5276205 - DNA, 20 bp, Homo sapiens
atgtgtttataattgttata

SEQ ID NO: 5276206 - DNA, 18 bp, Homo sapiens
atgtgtttatgtgagctg

SEQ ID NO: 5276207 - DNA, 19 bp, Homo sapiens
atgtgtttattcatccagc

SEQ ID NO: 5276208 - DNA, 14 bp, Homo sapiens
atgtgtttcaaact

SEQ ID NO: 5276209 - DNA, 18 bp, Homo sapiens
atgtgtttcacagtttga

SEQ ID NO: 5276210 - DNA, 20 bp, Homo sapiens
atgtgtttcacagtttgaaa

SEQ ID NO: 5276211 - DNA, 22 bp, Homo sapiens
atgtgtttcacagtttgaaata

SEQ ID NO: 5276212 - DNA, 17 bp, Homo sapiens
atgtgtttccttttcag

SEQ ID NO: 5276213 - DNA, 20 bp, Homo sapiens
atgtgtttccttttcaggag

SEQ ID NO: 5276214 - DNA, 22 bp, Homo sapiens
atgtgtttccttttcaggagat

SEQ ID NO: 5276215 - DNA, 15 bp, Homo sapiens
atgtgtttctgtaac

SEQ ID NO: 5276216 - DNA, 20 bp, Homo sapiens
atgtgtttgagcatcactta

SEQ ID NO: 5276217 - DNA, 12 bp, Homo sapiens
atgtgtttgctt

SEQ ID NO: 5276218 - DNA, 17 bp, Homo sapiens
atgtgtttgctttctga

SEQ ID NO: 5276219 - DNA, 16 bp, Homo sapiens
atgtgtttgtgtgtgt

SEQ ID NO: 5276220 - DNA, 19 bp, Homo sapiens
atgtgttttaataaacgtt

SEQ ID NO: 5276221 - DNA, 14 bp, Homo sapiens
atgtgttttagagt

SEQ ID NO: 5276222 - DNA, 15 bp, Homo sapiens
atgtgttttagatgg

SEQ ID NO: 5276223 - DNA, 19 bp, Homo sapiens
atgtgttttcatcatttca

SEQ ID NO: 5276224 - DNA, 14 bp, Homo sapiens
atgtgttttctgaa

SEQ ID NO: 5276225 - DNA, 18 bp, Homo sapiens
atgtgttttctgtagact

SEQ ID NO: 5276226 - DNA, 15 bp, Homo sapiens
atgtgttttgcacgt

SEQ ID NO: 5276227 - DNA, 16 bp, Homo sapiens
attgtaaactaaagtg

SEQ ID NO: 5276228 - DNA, 22 bp, Homo sapiens
attgtaaactaaagtgtgcttt

SEQ ID NO: 5276229 - DNA, 23 bp, Homo sapiens
attgtaaactaaagtgtgcttta

SEQ ID NO: 5276230 - DNA, 15 bp, Homo sapiens
attgtaaactttttc

SEQ ID NO: 5276231 - DNA, 18 bp, Homo sapiens
attgtaaaggtaggtgca

SEQ ID NO: 5276232 - DNA, 16 bp, Homo sapiens
attgtaaaggtgatga

SEQ ID NO: 5276233 - DNA, 19 bp, Homo sapiens
attgtaaaggtgatgaatt

SEQ ID NO: 5276234 - DNA, 20 bp, Homo sapiens
attgtaaaggtgatgaattt

SEQ ID NO: 5276235 - DNA, 17 bp, Homo sapiens
attgtaaagtaaatgaa

SEQ ID NO: 5276236 - DNA, 14 bp, Homo sapiens
attgtaaagtatgt

SEQ ID NO: 5276237 - DNA, 19 bp, Homo sapiens
attgtaaataaattttgtg

SEQ ID NO: 5276238 - DNA, 23 bp, Homo sapiens
attgtaaatacaagttctattta

SEQ ID NO: 5276239 - DNA, 17 bp, Homo sapiens
attgtaaatattttgat

SEQ ID NO: 5276240 - DNA, 13 bp, Homo sapiens
attgtaaatcact

SEQ ID NO: 5276241 - DNA, 18 bp, Homo sapiens
attgtaaatctgaagaaa

SEQ ID NO: 5276242 - DNA, 14 bp, Homo sapiens
attgtaaatgtgga

SEQ ID NO: 5276243 - DNA, 21 bp, Homo sapiens
attgtaaatgtttaatatctg

SEQ ID NO: 5276244 - DNA, 15 bp, Homo sapiens
attgtaaattatatt

SEQ ID NO: 5276245 - DNA, 17 bp, Homo sapiens
attgtaaattgaatcag

SEQ ID NO: 5276246 - DNA, 20 bp, Homo sapiens
attgtaaattttagagcata

SEQ ID NO: 5276247 - DNA, 15 bp, Homo sapiens
attgtaacagacatt

SEQ ID NO: 5276248 - DNA, 13 bp, Homo sapiens
attgtaacatatt

SEQ ID NO: 5276249 - DNA, 18 bp, Homo sapiens
attgtaaccctgtctgga

SEQ ID NO: 5276250 - DNA, 12 bp, Homo sapiens
attgtaacctgc

SEQ ID NO: 5276251 - DNA, 15 bp, Homo sapiens
attgtaacgttgctg

SEQ ID NO: 5276252 - DNA, 17 bp, Homo sapiens
attgtaacgttgctgtg

SEQ ID NO: 5276253 - DNA, 13 bp, Homo sapiens
attgtaactatta

SEQ ID NO: 5276254 - DNA, 15 bp, Homo sapiens
attgtaactattaac

SEQ ID NO: 5276255 - DNA, 19 bp, Homo sapiens
attgtaactattaaccttt

SEQ ID NO: 5276256 - DNA, 20 bp, Homo sapiens
attgtaactattaacctttt

SEQ ID NO: 5276257 - DNA, 10 bp, Homo sapiens
attgtaactc

SEQ ID NO: 5276258 - DNA, 18 bp, Homo sapiens
attgtaactcacatgcct

SEQ ID NO: 5276259 - DNA, 14 bp, Homo sapiens
attgtaagaaatac

SEQ ID NO: 5276260 - DNA, 14 bp, Homo sapiens
attgtaagataaaa

SEQ ID NO: 5276261 - DNA, 16 bp, Homo sapiens
attgtaagccagagtc

SEQ ID NO: 5276262 - DNA, 17 bp, Homo sapiens
attgtaagccagagtca

SEQ ID NO: 5276263 - DNA, 15 bp, Homo sapiens
attgtaaggaatgat

SEQ ID NO: 5276264 - DNA, 16 bp, Homo sapiens
attgtaaggaatgatt

SEQ ID NO: 5276265 - DNA, 17 bp, Homo sapiens
attgtaaggtattgcaa

SEQ ID NO: 5276266 - DNA, 18 bp, Homo sapiens
attgtaaggtctttgtaa

SEQ ID NO: 5276267 - DNA, 18 bp, Homo sapiens
attgtaagtcccatgaat

SEQ ID NO: 5276268 - DNA, 23 bp, Homo sapiens
attgtaagtgaaattaagcattt

SEQ ID NO: 5276269 - DNA, 16 bp, Homo sapiens
attgtaagtggaaaat

SEQ ID NO: 5276270 - DNA, 18 bp, Homo sapiens
attgtaagttgtacaaat

SEQ ID NO: 5276271 - DNA, 22 bp, Homo sapiens
attgtaatatagaaaaaaacat

SEQ ID NO: 5276272 - DNA, 19 bp, Homo sapiens
attgtaatattaaaaagaa

SEQ ID NO: 5276273 - DNA, 14 bp, Homo sapiens
attgtaatcataaa

SEQ ID NO: 5276274 - DNA, 19 bp, Homo sapiens
attgtaatcgtgtgccatg

SEQ ID NO: 5276275 - DNA, 15 bp, Homo sapiens
attgtaatctatgtt

SEQ ID NO: 5276276 - DNA, 13 bp, Homo sapiens
attgtaatctttc

SEQ ID NO: 5276277 - DNA, 15 bp, Homo sapiens
attgtaatgtaataa

SEQ ID NO: 5276278 - DNA, 12 bp, Homo sapiens
attgtaatgttg

SEQ ID NO: 5276279 - DNA, 20 bp, Homo sapiens
attgtaatgttgtgaataat

SEQ ID NO: 5276280 - DNA, 13 bp, Homo sapiens
attgtaattatat

SEQ ID NO: 5276281 - DNA, 16 bp, Homo sapiens
attgtaattatatctg

SEQ ID NO: 5276282 - DNA, 16 bp, Homo sapiens
attgtaattatgtaaa

SEQ ID NO: 5276283 - DNA, 23 bp, Homo sapiens
attgtaattttgttcctgtttat

SEQ ID NO: 5276284 - DNA, 21 bp, Homo sapiens
attgtacaaaattaagcaaat

SEQ ID NO: 5276285 - DNA, 22 bp, Homo sapiens
attgtacaaaattaagcaaatg

SEQ ID NO: 5276286 - DNA, 17 bp, Homo sapiens
attgtacaaagtattaa

SEQ ID NO: 5276287 - DNA, 19 bp, Homo sapiens
attgtacaaagtattaagc

SEQ ID NO: 5276288 - DNA, 19 bp, Homo sapiens
attgtacaaggtatttaca

SEQ ID NO: 5276289 - DNA, 13 bp, Homo sapiens
attgtacaataaa

SEQ ID NO: 5276290 - DNA, 15 bp, Homo sapiens
attgtacaataaatt

SEQ ID NO: 5276291 - DNA, 19 bp, Homo sapiens
attgtacacaccttatatt

SEQ ID NO: 5276292 - DNA, 22 bp, Homo sapiens
attgtacactaacatatttaga

SEQ ID NO: 5276293 - DNA, 14 bp, Homo sapiens
attgtacacttttt

SEQ ID NO: 5276294 - DNA, 20 bp, Homo sapiens
attgtacagaatcattgctt

SEQ ID NO: 5276295 - DNA, 13 bp, Homo sapiens
attgtacagtttt

SEQ ID NO: 5276296 - DNA, 21 bp, Homo sapiens
attgtacagtttttattgctt

SEQ ID NO: 5276297 - DNA, 15 bp, Homo sapiens
attgtacataaaatt

SEQ ID NO: 5276298 - DNA, 13 bp, Homo sapiens
attgtacatattt

SEQ ID NO: 5276299 - DNA, 15 bp, Homo sapiens
attgtacatatttgt

SEQ ID NO: 5276300 - DNA, 15 bp, Homo sapiens
attgtaccaaagctg

SEQ ID NO: 5276301 - DNA, 16 bp, Homo sapiens
attgtaccaaagctgt

SEQ ID NO: 5276302 - DNA, 17 bp, Homo sapiens
attgtaccaaagctgtt

SEQ ID NO: 5276303 - DNA, 16 bp, Homo sapiens
attgtaccatcatttt

SEQ ID NO: 5276304 - DNA, 17 bp, Homo sapiens
attgtacctaagtaaat

SEQ ID NO: 5276305 - DNA, 14 bp, Homo sapiens
attgtacctatttc

SEQ ID NO: 5276306 - DNA, 18 bp, Homo sapiens
attgtacctatttctgat

SEQ ID NO: 5276307 - DNA, 22 bp, Homo sapiens
attgtacctatttctgatgatg

SEQ ID NO: 5276308 - DNA, 16 bp, Homo sapiens
attgtaccttttaaca

SEQ ID NO: 5276309 - DNA, 17 bp, Homo sapiens
attgtaccttttaacac

SEQ ID NO: 5276310 - DNA, 17 bp, Homo sapiens
attgtacgaagagtatt

SEQ ID NO: 5276311 - DNA, 19 bp, Homo sapiens
attgtacgtttaaagtgta

SEQ ID NO: 5276312 - DNA, 22 bp, Homo sapiens
attgtactaaagccaaacatat

SEQ ID NO: 5276313 - DNA, 17 bp, Homo sapiens
attgtactaatctgaga

SEQ ID NO: 5276314 - DNA, 14 bp, Homo sapiens
attgtactcaatgg

SEQ ID NO: 5276315 - DNA, 14 bp, Homo sapiens
attgtactccagcc

SEQ ID NO: 5276316 - DNA, 18 bp, Homo sapiens
attgtactccagcctggg

SEQ ID NO: 5276317 - DNA, 14 bp, Homo sapiens
attgtactctgctt

SEQ ID NO: 5276318 - DNA, 16 bp, Homo sapiens
attgtactctgcttta

SEQ ID NO: 5276319 - DNA, 23 bp, Homo sapiens
attgtactgtgtttttaaatttt

SEQ ID NO: 5276320 - DNA, 21 bp, Homo sapiens
attgtactgttcatacagttt

SEQ ID NO: 5276321 - DNA, 16 bp, Homo sapiens
attgtacttggagtaa

SEQ ID NO: 5276322 - DNA, 16 bp, Homo sapiens
attgtactttgaaaac

SEQ ID NO: 5276323 - DNA, 15 bp, Homo sapiens
attgtactttgtgct

SEQ ID NO: 5276324 - DNA, 20 bp, Homo sapiens
attgtacttttggcatgaaa

SEQ ID NO: 5276325 - DNA, 21 bp, Homo sapiens
attgtagaaagctaatacaaa

SEQ ID NO: 5276326 - DNA, 13 bp, Homo sapiens
attgtagaacata

SEQ ID NO: 5276327 - DNA, 17 bp, Homo sapiens
attgtagaacttgttgc

SEQ ID NO: 5276328 - DNA, 19 bp, Homo sapiens
attgtagaattgtatatag

SEQ ID NO: 5276329 - DNA, 13 bp, Homo sapiens
attgtagacatgc

SEQ ID NO: 5276330 - DNA, 22 bp, Homo sapiens
attgtagagaaaaaaaaatatg

SEQ ID NO: 5276331 - DNA, 16 bp, Homo sapiens
attgtagagcacattt

SEQ ID NO: 5276332 - DNA, 18 bp, Homo sapiens
attgtagagcacatttag

SEQ ID NO: 5276333 - DNA, 19 bp, Homo sapiens
attgtagataacactgact

SEQ ID NO: 5276334 - DNA, 15 bp, Homo sapiens
attgtagatggaaat

SEQ ID NO: 5276335 - DNA, 16 bp, Homo sapiens
attgtagattttgtta

SEQ ID NO: 5276336 - DNA, 18 bp, Homo sapiens
attgtagcagttacagct

SEQ ID NO: 5276337 - DNA, 17 bp, Homo sapiens
attgtagcccagttggt

SEQ ID NO: 5276338 - DNA, 19 bp, Homo sapiens
attgtagggttattagtcc

SEQ ID NO: 5276339 - DNA, 21 bp, Homo sapiens
attgtaggtcaatgaaatatt

SEQ ID NO: 5276340 - DNA, 15 bp, Homo sapiens
attgtaggtgcaagc

SEQ ID NO: 5276341 - DNA, 16 bp, Homo sapiens
attgtagtcctgtaat

SEQ ID NO: 5276342 - DNA, 23 bp, Homo sapiens
attgtagtttgaaagttgtacat

SEQ ID NO: 5276343 - DNA, 18 bp, Homo sapiens
attgtagtttgaatattt

SEQ ID NO: 5276344 - DNA, 21 bp, Homo sapiens
attgtataaaaagtttcacag

SEQ ID NO: 5276345 - DNA, 15 bp, Homo sapiens
attgtataaaaatag

SEQ ID NO: 5276346 - DNA, 17 bp, Homo sapiens
attgtataaaaatagaa

SEQ ID NO: 5276347 - DNA, 20 bp, Homo sapiens
attgtataaaacagtgtttc

SEQ ID NO: 5276348 - DNA, 13 bp, Homo sapiens
attgtataacagg

SEQ ID NO: 5276349 - DNA, 22 bp, Homo sapiens
attgtataagattagaatgaaa

SEQ ID NO: 5276350 - DNA, 12 bp, Homo sapiens
attgtataagca

SEQ ID NO: 5276351 - DNA, 17 bp, Homo sapiens
attgtataagcatgctt

SEQ ID NO: 5276352 - DNA, 19 bp, Homo sapiens
attgtataagcatgctttc

SEQ ID NO: 5276353 - DNA, 17 bp, Homo sapiens
attgtataagtcaagca

SEQ ID NO: 5276354 - DNA, 19 bp, Homo sapiens
attgtataccaatgtgttt

SEQ ID NO: 5276355 - DNA, 22 bp, Homo sapiens
attgtatagagatatgcagaag

SEQ ID NO: 5276356 - DNA, 16 bp, Homo sapiens
attgtataggccatct

SEQ ID NO: 5276357 - DNA, 18 bp, Homo sapiens
attgtataggccatctgt

SEQ ID NO: 5276358 - DNA, 19 bp, Homo sapiens
attgtataggccatctgta

SEQ ID NO: 5276359 - DNA, 15 bp, Homo sapiens
attgtatatatatgt

SEQ ID NO: 5276360 - DNA, 20 bp, Homo sapiens
attgtatatatatgtgaact

SEQ ID NO: 5276361 - DNA, 20 bp, Homo sapiens
attgtatatatattcatata

SEQ ID NO: 5276362 - DNA, 18 bp, Homo sapiens
attgtatattacaatgat

SEQ ID NO: 5276363 - DNA, 19 bp, Homo sapiens
attgtatattacaatgatc

SEQ ID NO: 5276364 - DNA, 15 bp, Homo sapiens
attgtatattcactt

SEQ ID NO: 5276365 - DNA, 20 bp, Homo sapiens
attgtatattgattatagca

SEQ ID NO: 5276366 - DNA, 13 bp, Homo sapiens
attgtatattgta

SEQ ID NO: 5276367 - DNA, 17 bp, Homo sapiens
attgtatattgtaattt

SEQ ID NO: 5276368 - DNA, 16 bp, Homo sapiens
attgtatcaatttgtt

SEQ ID NO: 5276369 - DNA, 15 bp, Homo sapiens
attgtatcagaggcc

SEQ ID NO: 5276370 - DNA, 19 bp, Homo sapiens
attgtatcagaggcctata

SEQ ID NO: 5276371 - DNA, 24 bp, Homo sapiens
attgtatcgtatagctgtattgaa

SEQ ID NO: 5276372 - DNA, 21 bp, Homo sapiens
attgtatctacattaaaatga

SEQ ID NO: 5276373 - DNA, 15 bp, Homo sapiens
attgtatctagtgca

SEQ ID NO: 5276374 - DNA, 16 bp, Homo sapiens
attgtatctagtgcag

SEQ ID NO: 5276375 - DNA, 21 bp, Homo sapiens
attgtatctagtgcagctgat

SEQ ID NO: 5276376 - DNA, 17 bp, Homo sapiens
attgtatgaaaatcctt

SEQ ID NO: 5276377 - DNA, 22 bp, Homo sapiens
attgtatgaaaatccttttaac

SEQ ID NO: 5276378 - DNA, 12 bp, Homo sapiens
attgtatgatgt

SEQ ID NO: 5276379 - DNA, 15 bp, Homo sapiens
attgtatgatgtgtt

SEQ ID NO: 5276380 - DNA, 16 bp, Homo sapiens
attgtattactttaat

SEQ ID NO: 5276381 - DNA, 16 bp, Homo sapiens
attgtattaggaaaat

SEQ ID NO: 5276382 - DNA, 21 bp, Homo sapiens
attgtattatagtactgcttt

SEQ ID NO: 5276383 - DNA, 16 bp, Homo sapiens
attgtattatcatata

SEQ ID NO: 5276384 - DNA, 19 bp, Homo sapiens
attgtattatcatatatgc

SEQ ID NO: 5276385 - DNA, 20 bp, Homo sapiens
attgtattatcatatatgct

SEQ ID NO: 5276386 - DNA, 15 bp, Homo sapiens
attgtattatttgga

SEQ ID NO: 5276387 - DNA, 16 bp, Homo sapiens
attgtattcagataat

SEQ ID NO: 5276388 - DNA, 13 bp, Homo sapiens
attgtattcctca

SEQ ID NO: 5276389 - DNA, 14 bp, Homo sapiens
attgtattgctgct

SEQ ID NO: 5276390 - DNA, 16 bp, Homo sapiens
attgtattgctgctgt

SEQ ID NO: 5276391 - DNA, 12 bp, Homo sapiens
attgtattgtct

SEQ ID NO: 5276392 - DNA, 20 bp, Homo sapiens
attgtattgtctgacacatg

SEQ ID NO: 5276393 - DNA, 17 bp, Homo sapiens
attgtatttatgtatgt

SEQ ID NO: 5276394 - DNA, 14 bp, Homo sapiens
attgtatttattca

SEQ ID NO: 5276395 - DNA, 20 bp, Homo sapiens
attgtatttattcaataaag

SEQ ID NO: 5276396 - DNA, 19 bp, Homo sapiens
attgtattttactttgtgc

SEQ ID NO: 5276397 - DNA, 20 bp, Homo sapiens
attgtattttactttgtgca

SEQ ID NO: 5276398 - DNA, 16 bp, Homo sapiens
attgtcaaagtggtga

SEQ ID NO: 5276399 - DNA, 14 bp, Homo sapiens
attgtcaaatacag

SEQ ID NO: 5276400 - DNA, 19 bp, Homo sapiens
attgtcaacacaaactggc

SEQ ID NO: 5276401 - DNA, 14 bp, Homo sapiens
attgtcaagctagc

SEQ ID NO: 5276402 - DNA, 19 bp, Homo sapiens
attgtcaatgctggagaaa

SEQ ID NO: 5276403 - DNA, 16 bp, Homo sapiens
attgtcacatcaagca

SEQ ID NO: 5276404 - DNA, 23 bp, Homo sapiens
attgtcacatctatccacactgt

SEQ ID NO: 5276405 - DNA, 17 bp, Homo sapiens
attgtcaccgcaggtgc

SEQ ID NO: 5276406 - DNA, 16 bp, Homo sapiens
atgtgttttgcacgtc

SEQ ID NO: 5276407 - DNA, 14 bp, Homo sapiens
atgtgttttgcttt

SEQ ID NO: 5276408 - DNA, 18 bp, Homo sapiens
atgtgttttgtttattaa

SEQ ID NO: 5276409 - DNA, 20 bp, Homo sapiens
atgtgttttgtttattaaat

SEQ ID NO: 5276410 - DNA, 18 bp, Homo sapiens
atgtgttttgttttggac

SEQ ID NO: 5276411 - DNA, 19 bp, Homo sapiens
atgtgtttttctatatagt

SEQ ID NO: 5276412 - DNA, 15 bp, Homo sapiens
atgtgtttttctcca

SEQ ID NO: 5276413 - DNA, 16 bp, Homo sapiens
atgtgtttttctccag

SEQ ID NO: 5276414 - DNA, 19 bp, Homo sapiens
atgtgttttttgcaacata

SEQ ID NO: 5276415 - DNA, 21 bp, Homo sapiens
atgtgttttttgcaacatatg

SEQ ID NO: 5276416 - DNA, 20 bp, Homo sapiens
atgttaaaacataaacacat

SEQ ID NO: 5276417 - DNA, 13 bp, Homo sapiens
atgttaaaagaag

SEQ ID NO: 5276418 - DNA, 18 bp, Homo sapiens
atgttaaaataaatggtt

SEQ ID NO: 5276419 - DNA, 17 bp, Homo sapiens
atgttaaaatagtcata

SEQ ID NO: 5276420 - DNA, 21 bp, Homo sapiens
atgttaaaatattgatttcta

SEQ ID NO: 5276421 - DNA, 12 bp, Homo sapiens
atgttaaaatgt

SEQ ID NO: 5276422 - DNA, 13 bp, Homo sapiens
atgttaaaatgta

SEQ ID NO: 5276423 - DNA, 16 bp, Homo sapiens
atgttaaaatgtgttg

SEQ ID NO: 5276424 - DNA, 16 bp, Homo sapiens
atgttaaacaccattt

SEQ ID NO: 5276425 - DNA, 12 bp, Homo sapiens
atgttaaaccat

SEQ ID NO: 5276426 - DNA, 19 bp, Homo sapiens
atgttaaacgtcacagcag

SEQ ID NO: 5276427 - DNA, 15 bp, Homo sapiens
atgttaaactagcat

SEQ ID NO: 5276428 - DNA, 19 bp, Homo sapiens
atgttaaactagcatatct

SEQ ID NO: 5276429 - DNA, 21 bp, Homo sapiens
atgttaaactagcatatctgc

SEQ ID NO: 5276430 - DNA, 13 bp, Homo sapiens
atgttaaactctt

SEQ ID NO: 5276431 - DNA, 14 bp, Homo sapiens
atgttaaactcttt

SEQ ID NO: 5276432 - DNA, 23 bp, Homo sapiens
atgttaaacttataacccacttt

SEQ ID NO: 5276433 - DNA, 12 bp, Homo sapiens
atgttaaagagg

SEQ ID NO: 5276434 - DNA, 15 bp, Homo sapiens
atgttaaagatgtag

SEQ ID NO: 5276435 - DNA, 13 bp, Homo sapiens
atgttaaagcatt

SEQ ID NO: 5276436 - DNA, 13 bp, Homo sapiens
atgttaaagttta

SEQ ID NO: 5276437 - DNA, 14 bp, Homo sapiens
atgttaaagtttaa

SEQ ID NO: 5276438 - DNA, 13 bp, Homo sapiens
atgttaaataaat

SEQ ID NO: 5276439 - DNA, 19 bp, Homo sapiens
atgttaaataaattgtata

SEQ ID NO: 5276440 - DNA, 12 bp, Homo sapiens
atgttaaatact

SEQ ID NO: 5276441 - DNA, 21 bp, Homo sapiens
atgttaaatactgtgcagaat

SEQ ID NO: 5276442 - DNA, 20 bp, Homo sapiens
atgttaaatcccattcataa

SEQ ID NO: 5276443 - DNA, 15 bp, Homo sapiens
atgttaaatgccttg

SEQ ID NO: 5276444 - DNA, 19 bp, Homo sapiens
atgttaaatgccttggttt

SEQ ID NO: 5276445 - DNA, 13 bp, Homo sapiens
atgttaaatggaa

SEQ ID NO: 5276446 - DNA, 15 bp, Homo sapiens
atgttaaatggaatt

SEQ ID NO: 5276447 - DNA, 17 bp, Homo sapiens
atgttaaatttgtaagt

SEQ ID NO: 5276448 - DNA, 18 bp, Homo sapiens
atgttaaatttgtaagtt

SEQ ID NO: 5276449 - DNA, 21 bp, Homo sapiens
atgttaacaatgcctattgta

SEQ ID NO: 5276450 - DNA, 20 bp, Homo sapiens
atgttaacacattttgtata

SEQ ID NO: 5276451 - DNA, 22 bp, Homo sapiens
atgttaacacattttgtataat

SEQ ID NO: 5276452 - DNA, 23 bp, Homo sapiens
atgttaacacattttgtataatt

SEQ ID NO: 5276453 - DNA, 17 bp, Homo sapiens
atgttaacaggtatttt

SEQ ID NO: 5276454 - DNA, 16 bp, Homo sapiens
atgttaacagtatttt

SEQ ID NO: 5276455 - DNA, 18 bp, Homo sapiens
atgttaaccgtttcagga

SEQ ID NO: 5276456 - DNA, 23 bp, Homo sapiens
atgttaacctaggcagtgggagg

SEQ ID NO: 5276457 - DNA, 18 bp, Homo sapiens
atgttaacctcagtgtca

SEQ ID NO: 5276458 - DNA, 21 bp, Homo sapiens
atgttaacctcagtgtcattt

SEQ ID NO: 5276459 - DNA, 23 bp, Homo sapiens
atgttaactgacaagctccattt

SEQ ID NO: 5276460 - DNA, 14 bp, Homo sapiens
atgttaactttcaa

SEQ ID NO: 5276461 - DNA, 21 bp, Homo sapiens
atgttaagaatgaagttctgc

SEQ ID NO: 5276462 - DNA, 18 bp, Homo sapiens
atgttaagacttgacagt

SEQ ID NO: 5276463 - DNA, 20 bp, Homo sapiens
atgttaagacttgacagtgg

SEQ ID NO: 5276464 - DNA, 12 bp, Homo sapiens
atgttaagcaga

SEQ ID NO: 5276465 - DNA, 13 bp, Homo sapiens
atgttaagcagat

SEQ ID NO: 5276466 - DNA, 23 bp, Homo sapiens
atgttaaggaaactcttatctca

SEQ ID NO: 5276467 - DNA, 23 bp, Homo sapiens
atgttaagttacttcactttaat

SEQ ID NO: 5276468 - DNA, 14 bp, Homo sapiens
atgttaataaaggt

SEQ ID NO: 5276469 - DNA, 13 bp, Homo sapiens
atgttaatacatc

SEQ ID NO: 5276470 - DNA, 16 bp, Homo sapiens
atgttaatcacattcc

SEQ ID NO: 5276471 - DNA, 18 bp, Homo sapiens
atgttaatcctagctgtg

SEQ ID NO: 5276472 - DNA, 20 bp, Homo sapiens
atgttaatggatttcagaag

SEQ ID NO: 5276473 - DNA, 15 bp, Homo sapiens
atgttaattaaactg

SEQ ID NO: 5276474 - DNA, 22 bp, Homo sapiens
atgttaattcagcactgatttc

SEQ ID NO: 5276475 - DNA, 16 bp, Homo sapiens
atgttaatttatttag

SEQ ID NO: 5276476 - DNA, 17 bp, Homo sapiens
atgttaatttattttgc

SEQ ID NO: 5276477 - DNA, 13 bp, Homo sapiens
atgttaatttcat

SEQ ID NO: 5276478 - DNA, 20 bp, Homo sapiens
atgttaatttgtgtgttttt

SEQ ID NO: 5276479 - DNA, 14 bp, Homo sapiens
atgttacaaaaaaa

SEQ ID NO: 5276480 - DNA, 19 bp, Homo sapiens
atgttacaaaaataaacta

SEQ ID NO: 5276481 - DNA, 16 bp, Homo sapiens
atgttacaagtttgct

SEQ ID NO: 5276482 - DNA, 20 bp, Homo sapiens
atgttacaagtttgctaaaa

SEQ ID NO: 5276483 - DNA, 20 bp, Homo sapiens
atgttacagaatctaactgg

SEQ ID NO: 5276484 - DNA, 17 bp, Homo sapiens
atgttacatcacagtgt

SEQ ID NO: 5276485 - DNA, 20 bp, Homo sapiens
atgttacatctgttttaaat

SEQ ID NO: 5276486 - DNA, 14 bp, Homo sapiens
atgttacattatta

SEQ ID NO: 5276487 - DNA, 20 bp, Homo sapiens
atgttaccaaagcaatattt

SEQ ID NO: 5276488 - DNA, 17 bp, Homo sapiens
atgttaccagacttcaa

SEQ ID NO: 5276489 - DNA, 19 bp, Homo sapiens
atgttaccagacttcaaga

SEQ ID NO: 5276490 - DNA, 20 bp, Homo sapiens
atgttaccagacttcaagat

SEQ ID NO: 5276491 - DNA, 21 bp, Homo sapiens
atgttaccatcttacttgagc

SEQ ID NO: 5276492 - DNA, 15 bp, Homo sapiens
atgttacccagcctg

SEQ ID NO: 5276493 - DNA, 21 bp, Homo sapiens
atgttacctcctataaactta

SEQ ID NO: 5276494 - DNA, 14 bp, Homo sapiens
atgttacctctgaa

SEQ ID NO: 5276495 - DNA, 14 bp, Homo sapiens
atgttaccttcaca

SEQ ID NO: 5276496 - DNA, 17 bp, Homo sapiens
atgttacgtgaagaaat

SEQ ID NO: 5276497 - DNA, 23 bp, Homo sapiens
atgttactcagtgttagagaaat

SEQ ID NO: 5276498 - DNA, 13 bp, Homo sapiens
atgttactgatca

SEQ ID NO: 5276499 - DNA, 19 bp, Homo sapiens
atgttactgatcatgcatt

SEQ ID NO: 5276500 - DNA, 13 bp, Homo sapiens
atgttactgccaa

SEQ ID NO: 5276501 - DNA, 14 bp, Homo sapiens
atgttactgcttca

SEQ ID NO: 5276502 - DNA, 14 bp, Homo sapiens
atgttacttctgat

SEQ ID NO: 5276503 - DNA, 16 bp, Homo sapiens
atgttacttgagaagt

SEQ ID NO: 5276504 - DNA, 17 bp, Homo sapiens
atgttacttgagaagtg

SEQ ID NO: 5276505 - DNA, 15 bp, Homo sapiens
atgttagaagaagag

SEQ ID NO: 5276506 - DNA, 14 bp, Homo sapiens
atgttagaataatt

SEQ ID NO: 5276507 - DNA, 16 bp, Homo sapiens
atgttagaatcaaata

SEQ ID NO: 5276508 - DNA, 18 bp, Homo sapiens
atgttagaatcaaatact

SEQ ID NO: 5276509 - DNA, 15 bp, Homo sapiens
atgttagagactttt

SEQ ID NO: 5276510 - DNA, 12 bp, Homo sapiens
atgttagagcac

SEQ ID NO: 5276511 - DNA, 16 bp, Homo sapiens
atgttagaggttttaa

SEQ ID NO: 5276512 - DNA, 21 bp, Homo sapiens
atgttagaggttttaaagtga

SEQ ID NO: 5276513 - DNA, 13 bp, Homo sapiens
atgttagagtcat

SEQ ID NO: 5276514 - DNA, 19 bp, Homo sapiens
atgttagagtcatttctga

SEQ ID NO: 5276515 - DNA, 19 bp, Homo sapiens
atgttagatacacaaaata

SEQ ID NO: 5276516 - DNA, 15 bp, Homo sapiens
atgttagatattgct

SEQ ID NO: 5276517 - DNA, 18 bp, Homo sapiens
atgttagatattgctact

SEQ ID NO: 5276518 - DNA, 20 bp, Homo sapiens
atgttagccgggatggtctt

SEQ ID NO: 5276519 - DNA, 17 bp, Homo sapiens
atgttagcctgcaaaca

SEQ ID NO: 5276520 - DNA, 20 bp, Homo sapiens
atgttagctccaaagcattt

SEQ ID NO: 5276521 - DNA, 19 bp, Homo sapiens
atgttaggaaaatttcaca

SEQ ID NO: 5276522 - DNA, 16 bp, Homo sapiens
atgttaggagaactac

SEQ ID NO: 5276523 - DNA, 19 bp, Homo sapiens
atgttaggggtatttaatg

SEQ ID NO: 5276524 - DNA, 17 bp, Homo sapiens
atgttagggtataagtt

SEQ ID NO: 5276525 - DNA, 16 bp, Homo sapiens
atgttagggtgctctg

SEQ ID NO: 5276526 - DNA, 16 bp, Homo sapiens
atgttagtaaaggaac

SEQ ID NO: 5276527 - DNA, 20 bp, Homo sapiens
atgttagtaatacctctaat

SEQ ID NO: 5276528 - DNA, 17 bp, Homo sapiens
atgttagtattttaatc

SEQ ID NO: 5276529 - DNA, 18 bp, Homo sapiens
atgttagtattttaatcc

SEQ ID NO: 5276530 - DNA, 21 bp, Homo sapiens
atgttagtattttaatcctgt

SEQ ID NO: 5276531 - DNA, 16 bp, Homo sapiens
atgttagtcattgtta

SEQ ID NO: 5276532 - DNA, 22 bp, Homo sapiens
atgttagttaccttatagttac

SEQ ID NO: 5276533 - DNA, 15 bp, Homo sapiens
atgttagtttcttgg

SEQ ID NO: 5276534 - DNA, 20 bp, Homo sapiens
atgttatacaaggcaagcat

SEQ ID NO: 5276535 - DNA, 15 bp, Homo sapiens
atgttatagtgaatt

SEQ ID NO: 5276536 - DNA, 14 bp, Homo sapiens
atgttatatataaa

SEQ ID NO: 5276537 - DNA, 19 bp, Homo sapiens
atgttatatataaatatat

SEQ ID NO: 5276538 - DNA, 22 bp, Homo sapiens
atgttatatataaatatattat

SEQ ID NO: 5276539 - DNA, 18 bp, Homo sapiens
atgttatatcatatgtat

SEQ ID NO: 5276540 - DNA, 21 bp, Homo sapiens
atgttatatgttgttcttaca

SEQ ID NO: 5276541 - DNA, 15 bp, Homo sapiens
atgttatattaaaga

SEQ ID NO: 5276542 - DNA, 13 bp, Homo sapiens
atgttatattgct

SEQ ID NO: 5276543 - DNA, 15 bp, Homo sapiens
atgttatattgcttc

SEQ ID NO: 5276544 - DNA, 18 bp, Homo sapiens
atgttatcaaccaactgc

SEQ ID NO: 5276545 - DNA, 20 bp, Homo sapiens
atgttatcaaccaactgcac

SEQ ID NO: 5276546 - DNA, 16 bp, Homo sapiens
atgttatcattcttat

SEQ ID NO: 5276547 - DNA, 19 bp, Homo sapiens
atgttatcttaacactgaa

SEQ ID NO: 5276548 - DNA, 21 bp, Homo sapiens
atgttatcttctcaagttcta

SEQ ID NO: 5276549 - DNA, 23 bp, Homo sapiens
atgttatcttggtgtgttaagag

SEQ ID NO: 5276550 - DNA, 17 bp, Homo sapiens
atgttatgaacagctgt

SEQ ID NO: 5276551 - DNA, 14 bp, Homo sapiens
atgttatgaacatg

SEQ ID NO: 5276552 - DNA, 24 bp, Homo sapiens
atgttatgactatgtaaactactt

SEQ ID NO: 5276553 - DNA, 15 bp, Homo sapiens
atgttatgcagtgaa

SEQ ID NO: 5276554 - DNA, 16 bp, Homo sapiens
atgttatgcagtgaac

SEQ ID NO: 5276555 - DNA, 13 bp, Homo sapiens
atgttatgctggt

SEQ ID NO: 5276556 - DNA, 20 bp, Homo sapiens
atgttatgggatgtaaacaa

SEQ ID NO: 5276557 - DNA, 12 bp, Homo sapiens
atgttatgtata

SEQ ID NO: 5276558 - DNA, 16 bp, Homo sapiens
atgttatgtatatggt

SEQ ID NO: 5276559 - DNA, 16 bp, Homo sapiens
atgttatgtttaataa

SEQ ID NO: 5276560 - DNA, 13 bp, Homo sapiens
atgttatgtttct

SEQ ID NO: 5276561 - DNA, 14 bp, Homo sapiens
atgttattaaacag

SEQ ID NO: 5276562 - DNA, 19 bp, Homo sapiens
atgttattactgaggaaag

SEQ ID NO: 5276563 - DNA, 16 bp, Homo sapiens
atgttattatgctaat

SEQ ID NO: 5276564 - DNA, 23 bp, Homo sapiens
atgttattattactctacactga

SEQ ID NO: 5276565 - DNA, 15 bp, Homo sapiens
atgttattctctcac

SEQ ID NO: 5276566 - DNA, 12 bp, Homo sapiens
atgttattggaa

SEQ ID NO: 5276567 - DNA, 23 bp, Homo sapiens
atgttattggaattttctttcat

SEQ ID NO: 5276568 - DNA, 14 bp, Homo sapiens
atgttattgttttc

SEQ ID NO: 5276569 - DNA, 18 bp, Homo sapiens
atgttatttaagaatgac

SEQ ID NO: 5276570 - DNA, 12 bp, Homo sapiens
atgttatttccc

SEQ ID NO: 5276571 - DNA, 14 bp, Homo sapiens
atgttatttctctg

SEQ ID NO: 5276572 - DNA, 20 bp, Homo sapiens
atgttatttgttattttcag

SEQ ID NO: 5276573 - DNA, 13 bp, Homo sapiens
atgttattttcag

SEQ ID NO: 5276574 - DNA, 15 bp, Homo sapiens
atgttattttcagtg

SEQ ID NO: 5276575 - DNA, 16 bp, Homo sapiens
atgttattttcagtgc

SEQ ID NO: 5276576 - DNA, 21 bp, Homo sapiens
atgttattttcagtgctttgc

SEQ ID NO: 5276577 - DNA, 19 bp, Homo sapiens
atgttattttcttctaagt

SEQ ID NO: 5276578 - DNA, 16 bp, Homo sapiens
atgttattttgtacgt

SEQ ID NO: 5276579 - DNA, 20 bp, Homo sapiens
atgttattttgtacgtgtta

SEQ ID NO: 5276580 - DNA, 16 bp, Homo sapiens
atgttatttttgtatt

SEQ ID NO: 5276581 - DNA, 22 bp, Homo sapiens
atgttatttttgtatttttaaa

SEQ ID NO: 5276582 - DNA, 12 bp, Homo sapiens
atgttcaaagac

SEQ ID NO: 5276583 - DNA, 17 bp, Homo sapiens
atgttcaaagccacatt

SEQ ID NO: 5276584 - DNA, 14 bp, Homo sapiens
atgttcaaagtcaa

SEQ ID NO: 5276585 - DNA, 14 bp, Homo sapiens
atgttcaactggag

SEQ ID NO: 5276586 - DNA, 16 bp, Homo sapiens
attgtcacctgcttct

SEQ ID NO: 5276587 - DNA, 17 bp, Homo sapiens
attgtcacctgcttctc

SEQ ID NO: 5276588 - DNA, 19 bp, Homo sapiens
attgtcacctgcttctctg

SEQ ID NO: 5276589 - DNA, 20 bp, Homo sapiens
attgtcagaaatattcttat

SEQ ID NO: 5276590 - DNA, 13 bp, Homo sapiens
attgtcagaatgt

SEQ ID NO: 5276591 - DNA, 16 bp, Homo sapiens
attgtcagacacttat

SEQ ID NO: 5276592 - DNA, 14 bp, Homo sapiens
attgtcagatattt

SEQ ID NO: 5276593 - DNA, 15 bp, Homo sapiens
attgtcagccacctc

SEQ ID NO: 5276594 - DNA, 16 bp, Homo sapiens
attgtcagccttgcta

SEQ ID NO: 5276595 - DNA, 19 bp, Homo sapiens
attgtcagttttgttcact

SEQ ID NO: 5276596 - DNA, 21 bp, Homo sapiens
attgtcatatcagcacatatt

SEQ ID NO: 5276597 - DNA, 23 bp, Homo sapiens
attgtcatctttttctagagtta

SEQ ID NO: 5276598 - DNA, 15 bp, Homo sapiens
attgtcatgtttatt

SEQ ID NO: 5276599 - DNA, 15 bp, Homo sapiens
attgtcattactgcc

SEQ ID NO: 5276600 - DNA, 14 bp, Homo sapiens
attgtcattagtga

SEQ ID NO: 5276601 - DNA, 16 bp, Homo sapiens
attgtcattattttgg

SEQ ID NO: 5276602 - DNA, 15 bp, Homo sapiens
attgtcattcctgta

SEQ ID NO: 5276603 - DNA, 13 bp, Homo sapiens
attgtccaaagtt

SEQ ID NO: 5276604 - DNA, 17 bp, Homo sapiens
attgtccacaaatgtcc

SEQ ID NO: 5276605 - DNA, 21 bp, Homo sapiens
attgtccatatcagacctctg

SEQ ID NO: 5276606 - DNA, 14 bp, Homo sapiens
attgtccatgccta

SEQ ID NO: 5276607 - DNA, 23 bp, Homo sapiens
attgtccatgcctacagataatt

SEQ ID NO: 5276608 - DNA, 15 bp, Homo sapiens
attgtccccatgcaa

SEQ ID NO: 5276609 - DNA, 17 bp, Homo sapiens
attgtccccgacccttg

SEQ ID NO: 5276610 - DNA, 12 bp, Homo sapiens
attgtccctctg

SEQ ID NO: 5276611 - DNA, 18 bp, Homo sapiens
attgtccctggcttcctt

SEQ ID NO: 5276612 - DNA, 20 bp, Homo sapiens
attgtcctattagtgttata

SEQ ID NO: 5276613 - DNA, 21 bp, Homo sapiens
attgtcctattagtgttatat

SEQ ID NO: 5276614 - DNA, 13 bp, Homo sapiens
attgtcctccttt

SEQ ID NO: 5276615 - DNA, 12 bp, Homo sapiens
attgtcctgtga

SEQ ID NO: 5276616 - DNA, 17 bp, Homo sapiens
attgtcctgtttcttca

SEQ ID NO: 5276617 - DNA, 16 bp, Homo sapiens
attgtccttcagagct

SEQ ID NO: 5276618 - DNA, 21 bp, Homo sapiens
attgtccttgaagcttgtatc

SEQ ID NO: 5276619 - DNA, 16 bp, Homo sapiens
attgtccttttctccc

SEQ ID NO: 5276620 - DNA, 19 bp, Homo sapiens
attgtcgctatgtgacttg

SEQ ID NO: 5276621 - DNA, 20 bp, Homo sapiens
attgtctaaagttactactg

SEQ ID NO: 5276622 - DNA, 22 bp, Homo sapiens
attgtctaaagttactactgat

SEQ ID NO: 5276623 - DNA, 15 bp, Homo sapiens
attgtctaataaata

SEQ ID NO: 5276624 - DNA, 13 bp, Homo sapiens
attgtctagtgaa

SEQ ID NO: 5276625 - DNA, 13 bp, Homo sapiens
attgtctatttat

SEQ ID NO: 5276626 - DNA, 18 bp, Homo sapiens
attgtctattttatatct

SEQ ID NO: 5276627 - DNA, 21 bp, Homo sapiens
attgtctcaacgcctccccct

SEQ ID NO: 5276628 - DNA, 14 bp, Homo sapiens
attgtctcagtgaa

SEQ ID NO: 5276629 - DNA, 10 bp, Homo sapiens
attgtctccc

SEQ ID NO: 5276630 - DNA, 15 bp, Homo sapiens
attgtctcccttcca

SEQ ID NO: 5276631 - DNA, 18 bp, Homo sapiens
attgtctcctatatattt

SEQ ID NO: 5276632 - DNA, 18 bp, Homo sapiens
attgtctctaaattgtgg

SEQ ID NO: 5276633 - DNA, 23 bp, Homo sapiens
attgtctgaaaagtgaagacaga

SEQ ID NO: 5276634 - DNA, 21 bp, Homo sapiens
attgtctgaaattttctagaa

SEQ ID NO: 5276635 - DNA, 16 bp, Homo sapiens
attgtctgaacttgca

SEQ ID NO: 5276636 - DNA, 20 bp, Homo sapiens
attgtctgacacatgctctc

SEQ ID NO: 5276637 - DNA, 13 bp, Homo sapiens
attgtctgattga

SEQ ID NO: 5276638 - DNA, 12 bp, Homo sapiens
attgtctgctgc

SEQ ID NO: 5276639 - DNA, 15 bp, Homo sapiens
attgtctgctgcctc

SEQ ID NO: 5276640 - DNA, 14 bp, Homo sapiens
attgtctgtaaatc

SEQ ID NO: 5276641 - DNA, 21 bp, Homo sapiens
attgtctgtctacatttctgc

SEQ ID NO: 5276642 - DNA, 19 bp, Homo sapiens
attgtctgtctgctcttat

SEQ ID NO: 5276643 - DNA, 15 bp, Homo sapiens
attgtctgtgaagtg

SEQ ID NO: 5276644 - DNA, 14 bp, Homo sapiens
attgtcttaatgga

SEQ ID NO: 5276645 - DNA, 15 bp, Homo sapiens
attgtcttaatggat

SEQ ID NO: 5276646 - DNA, 17 bp, Homo sapiens
attgtcttaatggatga

SEQ ID NO: 5276647 - DNA, 21 bp, Homo sapiens
attgtcttccaaccccagctg

SEQ ID NO: 5276648 - DNA, 23 bp, Homo sapiens
attgtcttcggaaaccttggtgt

SEQ ID NO: 5276649 - DNA, 16 bp, Homo sapiens
attgtcttgatgtttt

SEQ ID NO: 5276650 - DNA, 20 bp, Homo sapiens
attgtcttgcaacttcagtt

SEQ ID NO: 5276651 - DNA, 20 bp, Homo sapiens
attgtcttgttatgtacaaa

SEQ ID NO: 5276652 - DNA, 23 bp, Homo sapiens
attgtcttgttatgtacaaacta

SEQ ID NO: 5276653 - DNA, 21 bp, Homo sapiens
attgtctttaatataataaaa

SEQ ID NO: 5276654 - DNA, 20 bp, Homo sapiens
attgtctttatatgaacata

SEQ ID NO: 5276655 - DNA, 23 bp, Homo sapiens
attgtctttcattttgcctgagt

SEQ ID NO: 5276656 - DNA, 15 bp, Homo sapiens
attgtctttttgtat

SEQ ID NO: 5276657 - DNA, 17 bp, Homo sapiens
attgtcttttttttcct

SEQ ID NO: 5276658 - DNA, 15 bp, Homo sapiens
attgtgaaaatgaat

SEQ ID NO: 5276659 - DNA, 11 bp, Homo sapiens
attgtgaaata

SEQ ID NO: 5276660 - DNA, 14 bp, Homo sapiens
attgtgaaatttgt

SEQ ID NO: 5276661 - DNA, 19 bp, Homo sapiens
attgtgaacatacacattt

SEQ ID NO: 5276662 - DNA, 17 bp, Homo sapiens
attgtgaactcattgct

SEQ ID NO: 5276663 - DNA, 20 bp, Homo sapiens
attgtgaagctaatgaccaa

SEQ ID NO: 5276664 - DNA, 14 bp, Homo sapiens
attgtgaaggattt

SEQ ID NO: 5276665 - DNA, 13 bp, Homo sapiens
attgtgaatattt

SEQ ID NO: 5276666 - DNA, 17 bp, Homo sapiens
attgtgaatatttggaa

SEQ ID NO: 5276667 - DNA, 19 bp, Homo sapiens
attgtgaattgataataaa

SEQ ID NO: 5276668 - DNA, 23 bp, Homo sapiens
attgtgacaatagggctaaatgt

SEQ ID NO: 5276669 - DNA, 11 bp, Homo sapiens
attgtgacagc

SEQ ID NO: 5276670 - DNA, 17 bp, Homo sapiens
attgtgaccaagttata

SEQ ID NO: 5276671 - DNA, 18 bp, Homo sapiens
attgtgaccaatacattt

SEQ ID NO: 5276672 - DNA, 19 bp, Homo sapiens
attgtgaccaatacatttg

SEQ ID NO: 5276673 - DNA, 21 bp, Homo sapiens
attgtgaccaatacatttgta

SEQ ID NO: 5276674 - DNA, 21 bp, Homo sapiens
attgtgaccacaggctggtgt

SEQ ID NO: 5276675 - DNA, 16 bp, Homo sapiens
attgtgaccactgaat

SEQ ID NO: 5276676 - DNA, 17 bp, Homo sapiens
attgtgaccactgaatt

SEQ ID NO: 5276677 - DNA, 21 bp, Homo sapiens
attgtgaccactgaattcact

SEQ ID NO: 5276678 - DNA, 23 bp, Homo sapiens
attgtgaccactgaattcactcc

SEQ ID NO: 5276679 - DNA, 20 bp, Homo sapiens
attgtgactgtgtttgcatt

SEQ ID NO: 5276680 - DNA, 16 bp, Homo sapiens
attgtgacttcactgt

SEQ ID NO: 5276681 - DNA, 23 bp, Homo sapiens
attgtgacttcactgtatataaa

SEQ ID NO: 5276682 - DNA, 16 bp, Homo sapiens
attgtgacttggagat

SEQ ID NO: 5276683 - DNA, 20 bp, Homo sapiens
attgtgagaattactgtttg

SEQ ID NO: 5276684 - DNA, 16 bp, Homo sapiens
attgtgagatgatttg

SEQ ID NO: 5276685 - DNA, 20 bp, Homo sapiens
attgtgagatgatttgtact

SEQ ID NO: 5276686 - DNA, 22 bp, Homo sapiens
attgtgatatttgacagacatc

SEQ ID NO: 5276687 - DNA, 21 bp, Homo sapiens
attgtgatggttcgttctgtt

SEQ ID NO: 5276688 - DNA, 15 bp, Homo sapiens
attgtgatgtgtcct

SEQ ID NO: 5276689 - DNA, 23 bp, Homo sapiens
attgtgattacgtgtatgtttct

SEQ ID NO: 5276690 - DNA, 23 bp, Homo sapiens
attgtgattagacagaacaccta

SEQ ID NO: 5276691 - DNA, 14 bp, Homo sapiens
attgtgatttcccg

SEQ ID NO: 5276692 - DNA, 16 bp, Homo sapiens
attgtgatttgactgt

SEQ ID NO: 5276693 - DNA, 18 bp, Homo sapiens
attgtgatttgactgttt

SEQ ID NO: 5276694 - DNA, 23 bp, Homo sapiens
attgtgatttgactgtttttacc

SEQ ID NO: 5276695 - DNA, 17 bp, Homo sapiens
attgtgcaatgtgtata

SEQ ID NO: 5276696 - DNA, 21 bp, Homo sapiens
attgtgcacaagtctttccag

SEQ ID NO: 5276697 - DNA, 22 bp, Homo sapiens
attgtgcacaagtctttccaga

SEQ ID NO: 5276698 - DNA, 16 bp, Homo sapiens
attgtgcataatgctt

SEQ ID NO: 5276699 - DNA, 22 bp, Homo sapiens
attgtgcataatgctttggaaa

SEQ ID NO: 5276700 - DNA, 22 bp, Homo sapiens
attgtgcatgcaaaccaggagc

SEQ ID NO: 5276701 - DNA, 18 bp, Homo sapiens
attgtgcattaaaattaa

SEQ ID NO: 5276702 - DNA, 12 bp, Homo sapiens
attgtgccaagc

SEQ ID NO: 5276703 - DNA, 19 bp, Homo sapiens
attgtgccaatatgtattg

SEQ ID NO: 5276704 - DNA, 21 bp, Homo sapiens
attgtgccatgtcaaacaaat

SEQ ID NO: 5276705 - DNA, 22 bp, Homo sapiens
attgtgccatgtcaaacaaata

SEQ ID NO: 5276706 - DNA, 12 bp, Homo sapiens
attgtgcccact

SEQ ID NO: 5276707 - DNA, 19 bp, Homo sapiens
attgtgcctatgataaatt

SEQ ID NO: 5276708 - DNA, 23 bp, Homo sapiens
attgtgcgctaaacttttctgat

SEQ ID NO: 5276709 - DNA, 15 bp, Homo sapiens
attgtgctcagagac

SEQ ID NO: 5276710 - DNA, 22 bp, Homo sapiens
attgtgctccaaatgtctactg

SEQ ID NO: 5276711 - DNA, 23 bp, Homo sapiens
attgtgctccaaatgtctactga

SEQ ID NO: 5276712 - DNA, 12 bp, Homo sapiens
attgtgctgcca

SEQ ID NO: 5276713 - DNA, 22 bp, Homo sapiens
attgtgctggtcatacatttgt

SEQ ID NO: 5276714 - DNA, 14 bp, Homo sapiens
attgtgcttaataa

SEQ ID NO: 5276715 - DNA, 12 bp, Homo sapiens
attgtgcttctc

SEQ ID NO: 5276716 - DNA, 19 bp, Homo sapiens
attgtgcttctccccagaa

SEQ ID NO: 5276717 - DNA, 20 bp, Homo sapiens
attgtgcttctccccagaat

SEQ ID NO: 5276718 - DNA, 18 bp, Homo sapiens
attgtgctttggttaata

SEQ ID NO: 5276719 - DNA, 14 bp, Homo sapiens
attgtgctttgtat

SEQ ID NO: 5276720 - DNA, 15 bp, Homo sapiens
attgtggaaaaccag

SEQ ID NO: 5276721 - DNA, 16 bp, Homo sapiens
attgtggaaaaccagg

SEQ ID NO: 5276722 - DNA, 14 bp, Homo sapiens
attgtggaatgttg

SEQ ID NO: 5276723 - DNA, 17 bp, Homo sapiens
attgtggaatgttggat

SEQ ID NO: 5276724 - DNA, 14 bp, Homo sapiens
attgtggatgaaga

SEQ ID NO: 5276725 - DNA, 17 bp, Homo sapiens
attgtggattaatgtca

SEQ ID NO: 5276726 - DNA, 20 bp, Homo sapiens
attgtggcatcagataatgc

SEQ ID NO: 5276727 - DNA, 19 bp, Homo sapiens
attgtggctcctatctgtg

SEQ ID NO: 5276728 - DNA, 20 bp, Homo sapiens
attgtggctcctatctgtgt

SEQ ID NO: 5276729 - DNA, 17 bp, Homo sapiens
attgtggctgttcactc

SEQ ID NO: 5276730 - DNA, 13 bp, Homo sapiens
attgtggctttat

SEQ ID NO: 5276731 - DNA, 21 bp, Homo sapiens
attgtgggacttattacaatt

SEQ ID NO: 5276732 - DNA, 16 bp, Homo sapiens
attgtggggtgcagct

SEQ ID NO: 5276733 - DNA, 22 bp, Homo sapiens
attgtggtaggccttttaacat

SEQ ID NO: 5276734 - DNA, 15 bp, Homo sapiens
attgtggtggtgcta

SEQ ID NO: 5276735 - DNA, 14 bp, Homo sapiens
attgtggtgtctta

SEQ ID NO: 5276736 - DNA, 21 bp, Homo sapiens
attgtggtttatatatttaaa

SEQ ID NO: 5276737 - DNA, 18 bp, Homo sapiens
attgtgtaaaaaatggaa

SEQ ID NO: 5276738 - DNA, 23 bp, Homo sapiens
attgtgtaacaattttaatgcta

SEQ ID NO: 5276739 - DNA, 16 bp, Homo sapiens
attgtgtaactgttct

SEQ ID NO: 5276740 - DNA, 12 bp, Homo sapiens
attgtgtaagaa

SEQ ID NO: 5276741 - DNA, 17 bp, Homo sapiens
attgtgtaagaatcact

SEQ ID NO: 5276742 - DNA, 22 bp, Homo sapiens
attgtgtacaaagtagagaagt

SEQ ID NO: 5276743 - DNA, 14 bp, Homo sapiens
attgtgtacacttt

SEQ ID NO: 5276744 - DNA, 15 bp, Homo sapiens
attgtgtacatagag

SEQ ID NO: 5276745 - DNA, 14 bp, Homo sapiens
attgtgtagacgat

SEQ ID NO: 5276746 - DNA, 18 bp, Homo sapiens
attgtgtagcaattgaca

SEQ ID NO: 5276747 - DNA, 18 bp, Homo sapiens
attgtgtagcctttttgt

SEQ ID NO: 5276748 - DNA, 22 bp, Homo sapiens
attgtgtagcctttttgtataa

SEQ ID NO: 5276749 - DNA, 15 bp, Homo sapiens
attgtgtatatatct

SEQ ID NO: 5276750 - DNA, 17 bp, Homo sapiens
attgtgtatatatctta

SEQ ID NO: 5276751 - DNA, 16 bp, Homo sapiens
attgtgtatcagtttc

SEQ ID NO: 5276752 - DNA, 18 bp, Homo sapiens
attgtgtatcagtttcca

SEQ ID NO: 5276753 - DNA, 21 bp, Homo sapiens
attgtgtatctgtgcttctaa

SEQ ID NO: 5276754 - DNA, 21 bp, Homo sapiens
attgtgtatttaaaaaaaaga

SEQ ID NO: 5276755 - DNA, 12 bp, Homo sapiens
attgtgtatttt

SEQ ID NO: 5276756 - DNA, 20 bp, Homo sapiens
attgtgtcagaaacatgaaa

SEQ ID NO: 5276757 - DNA, 17 bp, Homo sapiens
attgtgtcatattaaac

SEQ ID NO: 5276758 - DNA, 18 bp, Homo sapiens
attgtgtctcttggtcct

SEQ ID NO: 5276759 - DNA, 14 bp, Homo sapiens
attgtgtctgcagg

SEQ ID NO: 5276760 - DNA, 18 bp, Homo sapiens
attgtgtcttaatctctc

SEQ ID NO: 5276761 - DNA, 13 bp, Homo sapiens
attgtgtcttttg

SEQ ID NO: 5276762 - DNA, 16 bp, Homo sapiens
attgtgtcttttgcat

SEQ ID NO: 5276763 - DNA, 18 bp, Homo sapiens
attgtgtcttttgcatga

SEQ ID NO: 5276764 - DNA, 22 bp, Homo sapiens
atgttcaactggagacactatt

SEQ ID NO: 5276765 - DNA, 18 bp, Homo sapiens
atgttcaacttaatgaag

SEQ ID NO: 5276766 - DNA, 20 bp, Homo sapiens
atgttcaagtattgttaatg

SEQ ID NO: 5276767 - DNA, 17 bp, Homo sapiens
atgttcacgcaacttga

SEQ ID NO: 5276768 - DNA, 15 bp, Homo sapiens
atgttcactgtgagt

SEQ ID NO: 5276769 - DNA, 14 bp, Homo sapiens
atgttcacttcgaa

SEQ ID NO: 5276770 - DNA, 12 bp, Homo sapiens
atgttcacttta

SEQ ID NO: 5276771 - DNA, 17 bp, Homo sapiens
atgttcactttaaagca

SEQ ID NO: 5276772 - DNA, 16 bp, Homo sapiens
atgttcagaacttcat

SEQ ID NO: 5276773 - DNA, 21 bp, Homo sapiens
atgttcagaacttcatctgcc

SEQ ID NO: 5276774 - DNA, 22 bp, Homo sapiens
atgttcagaacttcatctgcca

SEQ ID NO: 5276775 - DNA, 19 bp, Homo sapiens
atgttcagacatttatgtg

SEQ ID NO: 5276776 - DNA, 23 bp, Homo sapiens
atgttcagagtggctcactggct

SEQ ID NO: 5276777 - DNA, 20 bp, Homo sapiens
atgttcagattgctttgatt

SEQ ID NO: 5276778 - DNA, 15 bp, Homo sapiens
atgttcagatttcta

SEQ ID NO: 5276779 - DNA, 18 bp, Homo sapiens
atgttcaggagagtaaaa

SEQ ID NO: 5276780 - DNA, 23 bp, Homo sapiens
atgttcaggagagtaaaaattca

SEQ ID NO: 5276781 - DNA, 13 bp, Homo sapiens
atgttcagggatg

SEQ ID NO: 5276782 - DNA, 14 bp, Homo sapiens
atgttcagggatgc

SEQ ID NO: 5276783 - DNA, 14 bp, Homo sapiens
atgttcagttcaaa

SEQ ID NO: 5276784 - DNA, 18 bp, Homo sapiens
atgttcataaaaaataac

SEQ ID NO: 5276785 - DNA, 18 bp, Homo sapiens
atgttcatatagccaggg

SEQ ID NO: 5276786 - DNA, 17 bp, Homo sapiens
atgttcatatgtacttg

SEQ ID NO: 5276787 - DNA, 16 bp, Homo sapiens
atgttcatcaattccc

SEQ ID NO: 5276788 - DNA, 21 bp, Homo sapiens
atgttcatcatcctaagctat

SEQ ID NO: 5276789 - DNA, 14 bp, Homo sapiens
atgttcatgatttc

SEQ ID NO: 5276790 - DNA, 13 bp, Homo sapiens
atgttcatggaac

SEQ ID NO: 5276791 - DNA, 14 bp, Homo sapiens
atgttcatggaatt

SEQ ID NO: 5276792 - DNA, 13 bp, Homo sapiens
atgttcatgtgat

SEQ ID NO: 5276793 - DNA, 15 bp, Homo sapiens
atgttcattaaattt

SEQ ID NO: 5276794 - DNA, 20 bp, Homo sapiens
atgttcattaaattttctat

SEQ ID NO: 5276795 - DNA, 15 bp, Homo sapiens
atgttcattataatc

SEQ ID NO: 5276796 - DNA, 21 bp, Homo sapiens
atgttcattataatctcaaag

SEQ ID NO: 5276797 - DNA, 14 bp, Homo sapiens
atgttcattgtaat

SEQ ID NO: 5276798 - DNA, 23 bp, Homo sapiens
atgttcattgtaatgttactgat

SEQ ID NO: 5276799 - DNA, 11 bp, Homo sapiens
atgttcattta

SEQ ID NO: 5276800 - DNA, 20 bp, Homo sapiens
atgttcattttctctgtatg

SEQ ID NO: 5276801 - DNA, 16 bp, Homo sapiens
atgttcattttgaaaa

SEQ ID NO: 5276802 - DNA, 16 bp, Homo sapiens
atgttccacctgccac

SEQ ID NO: 5276803 - DNA, 17 bp, Homo sapiens
atgttccagacattctc

SEQ ID NO: 5276804 - DNA, 18 bp, Homo sapiens
atgttccatcctgtacaa

SEQ ID NO: 5276805 - DNA, 15 bp, Homo sapiens
atgttccattaaacg

SEQ ID NO: 5276806 - DNA, 16 bp, Homo sapiens
atgttcccaaaacaat

SEQ ID NO: 5276807 - DNA, 13 bp, Homo sapiens
atgttcccagaac

SEQ ID NO: 5276808 - DNA, 12 bp, Homo sapiens
atgttccctgca

SEQ ID NO: 5276809 - DNA, 18 bp, Homo sapiens
atgttccctgcaccctgg

SEQ ID NO: 5276810 - DNA, 16 bp, Homo sapiens
atgttcccttgaccat

SEQ ID NO: 5276811 - DNA, 20 bp, Homo sapiens
atgttccgaattgagcacaa

SEQ ID NO: 5276812 - DNA, 22 bp, Homo sapiens
atgttccgttcatctgaggagt

SEQ ID NO: 5276813 - DNA, 18 bp, Homo sapiens
atgttcctaacaaaatga

SEQ ID NO: 5276814 - DNA, 11 bp, Homo sapiens
atgttcctaag

SEQ ID NO: 5276815 - DNA, 21 bp, Homo sapiens
atgttcctaaggtcatttctt

SEQ ID NO: 5276816 - DNA, 16 bp, Homo sapiens
atgttcctcaaagctt

SEQ ID NO: 5276817 - DNA, 17 bp, Homo sapiens
atgttcctcaaagcttg

SEQ ID NO: 5276818 - DNA, 23 bp, Homo sapiens
atgttcctgaattctatttgctg

SEQ ID NO: 5276819 - DNA, 17 bp, Homo sapiens
atgttcctgctgtattt

SEQ ID NO: 5276820 - DNA, 22 bp, Homo sapiens
atgttcctgctgtatttcctgc

SEQ ID NO: 5276821 - DNA, 22 bp, Homo sapiens
atgttcctggacaccacccaga

SEQ ID NO: 5276822 - DNA, 14 bp, Homo sapiens
atgttccttaccaa

SEQ ID NO: 5276823 - DNA, 18 bp, Homo sapiens
atgttcctttgtaattga

SEQ ID NO: 5276824 - DNA, 17 bp, Homo sapiens
atgttccttttgaaatt

SEQ ID NO: 5276825 - DNA, 17 bp, Homo sapiens
atgttccttttttgtat

SEQ ID NO: 5276826 - DNA, 23 bp, Homo sapiens
atgttccttttttgtatattaca

SEQ ID NO: 5276827 - DNA, 23 bp, Homo sapiens
atgttctaaaatgtcaaggcagt

SEQ ID NO: 5276828 - DNA, 18 bp, Homo sapiens
atgttctaaatatccctt

SEQ ID NO: 5276829 - DNA, 17 bp, Homo sapiens
atgttctaacagatcag

SEQ ID NO: 5276830 - DNA, 22 bp, Homo sapiens
atgttctaacagatcagaacat

SEQ ID NO: 5276831 - DNA, 23 bp, Homo sapiens
atgttctaacagcatctgcctct

SEQ ID NO: 5276832 - DNA, 17 bp, Homo sapiens
atgttctaagaagtgaa

SEQ ID NO: 5276833 - DNA, 14 bp, Homo sapiens
atgttctaaggctc

SEQ ID NO: 5276834 - DNA, 16 bp, Homo sapiens
atgttctaagtttcta

SEQ ID NO: 5276835 - DNA, 19 bp, Homo sapiens
atgttctaatactttgttt

SEQ ID NO: 5276836 - DNA, 15 bp, Homo sapiens
atgttctatatgcat

SEQ ID NO: 5276837 - DNA, 17 bp, Homo sapiens
atgttctatattcttta

SEQ ID NO: 5276838 - DNA, 20 bp, Homo sapiens
atgttctatggttatgaaag

SEQ ID NO: 5276839 - DNA, 11 bp, Homo sapiens
atgttctatta

SEQ ID NO: 5276840 - DNA, 20 bp, Homo sapiens
atgttctatttaacaactgg

SEQ ID NO: 5276841 - DNA, 22 bp, Homo sapiens
atgttctatttcagtgccaata

SEQ ID NO: 5276842 - DNA, 21 bp, Homo sapiens
atgttctcatgaactacccca

SEQ ID NO: 5276843 - DNA, 19 bp, Homo sapiens
atgttctcatgtttgtgca

SEQ ID NO: 5276844 - DNA, 19 bp, Homo sapiens
atgttctctatcatttaat

SEQ ID NO: 5276845 - DNA, 21 bp, Homo sapiens
atgttctctatcatttaataa

SEQ ID NO: 5276846 - DNA, 16 bp, Homo sapiens
atgttctctcttctcc

SEQ ID NO: 5276847 - DNA, 13 bp, Homo sapiens
atgttctctgagg

SEQ ID NO: 5276848 - DNA, 17 bp, Homo sapiens
atgttctctgaggacac

SEQ ID NO: 5276849 - DNA, 19 bp, Homo sapiens
atgttctgacagcatttca

SEQ ID NO: 5276850 - DNA, 18 bp, Homo sapiens
atgttctgacattaacag

SEQ ID NO: 5276851 - DNA, 20 bp, Homo sapiens
atgttctgacattaacagtt

SEQ ID NO: 5276852 - DNA, 21 bp, Homo sapiens
atgttctgcaagaattaaaac

SEQ ID NO: 5276853 - DNA, 23 bp, Homo sapiens
atgttctgcaagaattaaaactg

SEQ ID NO: 5276854 - DNA, 21 bp, Homo sapiens
atgttctgcctctccctgggt

SEQ ID NO: 5276855 - DNA, 11 bp, Homo sapiens
atgttctggga

SEQ ID NO: 5276856 - DNA, 12 bp, Homo sapiens
atgttctgggac

SEQ ID NO: 5276857 - DNA, 13 bp, Homo sapiens
atgttctgggaca

SEQ ID NO: 5276858 - DNA, 18 bp, Homo sapiens
atgttctggtatgcattc

SEQ ID NO: 5276859 - DNA, 19 bp, Homo sapiens
atgttctggtggtttgatt

SEQ ID NO: 5276860 - DNA, 20 bp, Homo sapiens
atgttctgtcccttgccccc

SEQ ID NO: 5276861 - DNA, 21 bp, Homo sapiens
atgttctgtgtgccctgaaaa

SEQ ID NO: 5276862 - DNA, 20 bp, Homo sapiens
atgttctgttgtaaagagtg

SEQ ID NO: 5276863 - DNA, 16 bp, Homo sapiens
atgttctgtttgctgt

SEQ ID NO: 5276864 - DNA, 17 bp, Homo sapiens
atgttctgtttgctgtg

SEQ ID NO: 5276865 - DNA, 14 bp, Homo sapiens
atgttcttaattct

SEQ ID NO: 5276866 - DNA, 18 bp, Homo sapiens
atgttcttagcaataaat

SEQ ID NO: 5276867 - DNA, 16 bp, Homo sapiens
atgttcttatagaata

SEQ ID NO: 5276868 - DNA, 21 bp, Homo sapiens
atgttcttatgcaaaatggaa

SEQ ID NO: 5276869 - DNA, 11 bp, Homo sapiens
atgttcttcca

SEQ ID NO: 5276870 - DNA, 12 bp, Homo sapiens
atgttcttgggt

SEQ ID NO: 5276871 - DNA, 18 bp, Homo sapiens
atgttcttgggtggttcc

SEQ ID NO: 5276872 - DNA, 21 bp, Homo sapiens
atgttcttgggtggttcctaa

SEQ ID NO: 5276873 - DNA, 15 bp, Homo sapiens
atgttcttggtgttt

SEQ ID NO: 5276874 - DNA, 22 bp, Homo sapiens
atgttcttggttcccattgtga

SEQ ID NO: 5276875 - DNA, 22 bp, Homo sapiens
atgttcttgtcataaaatgcat

SEQ ID NO: 5276876 - DNA, 13 bp, Homo sapiens
atgttctttatat

SEQ ID NO: 5276877 - DNA, 22 bp, Homo sapiens
atgttctttatatacaataatg

SEQ ID NO: 5276878 - DNA, 11 bp, Homo sapiens
atgttctttca

SEQ ID NO: 5276879 - DNA, 15 bp, Homo sapiens
atgttctttccatga

SEQ ID NO: 5276880 - DNA, 19 bp, Homo sapiens
atgttctttggaaagtaca

SEQ ID NO: 5276881 - DNA, 14 bp, Homo sapiens
atgttcttttctat

SEQ ID NO: 5276882 - DNA, 16 bp, Homo sapiens
atgttcttttctattt

SEQ ID NO: 5276883 - DNA, 16 bp, Homo sapiens
atgttgaaaagtaatt

SEQ ID NO: 5276884 - DNA, 15 bp, Homo sapiens
atgttgaaaatactt

SEQ ID NO: 5276885 - DNA, 12 bp, Homo sapiens
atgttgaaagat

SEQ ID NO: 5276886 - DNA, 15 bp, Homo sapiens
atgttgaacaaaata

SEQ ID NO: 5276887 - DNA, 16 bp, Homo sapiens
atgttgaagtcaaatt

SEQ ID NO: 5276888 - DNA, 19 bp, Homo sapiens
atgttgaatactttttaca

SEQ ID NO: 5276889 - DNA, 12 bp, Homo sapiens
atgttgaatatt

SEQ ID NO: 5276890 - DNA, 14 bp, Homo sapiens
atgttgaatgttaa

SEQ ID NO: 5276891 - DNA, 19 bp, Homo sapiens
atgttgacataccttttat

SEQ ID NO: 5276892 - DNA, 15 bp, Homo sapiens
atgttgacatgggac

SEQ ID NO: 5276893 - DNA, 20 bp, Homo sapiens
atgttgaccaggctggtctc

SEQ ID NO: 5276894 - DNA, 15 bp, Homo sapiens
atgttgaccattcca

SEQ ID NO: 5276895 - DNA, 20 bp, Homo sapiens
atgttgactgacttatggca

SEQ ID NO: 5276896 - DNA, 12 bp, Homo sapiens
atgttgacttta

SEQ ID NO: 5276897 - DNA, 15 bp, Homo sapiens
atgttgagaggttct

SEQ ID NO: 5276898 - DNA, 20 bp, Homo sapiens
atgttgagggaacagacagg

SEQ ID NO: 5276899 - DNA, 17 bp, Homo sapiens
atgttgagggcaagcca

SEQ ID NO: 5276900 - DNA, 21 bp, Homo sapiens
atgttgagtgttcattttagt

SEQ ID NO: 5276901 - DNA, 12 bp, Homo sapiens
atgttgataaac

SEQ ID NO: 5276902 - DNA, 22 bp, Homo sapiens
atgttgataaaccaaaaacatt

SEQ ID NO: 5276903 - DNA, 13 bp, Homo sapiens
atgttgataaaga

SEQ ID NO: 5276904 - DNA, 15 bp, Homo sapiens
atgttgatcagcaaa

SEQ ID NO: 5276905 - DNA, 18 bp, Homo sapiens
atgttgatcatgtacttt

SEQ ID NO: 5276906 - DNA, 20 bp, Homo sapiens
atgttgatccatccagcttg

SEQ ID NO: 5276907 - DNA, 23 bp, Homo sapiens
atgttgatccatccagcttgcca

SEQ ID NO: 5276908 - DNA, 14 bp, Homo sapiens
atgttgatcgatgt

SEQ ID NO: 5276909 - DNA, 17 bp, Homo sapiens
atgttgatctgcatatt

SEQ ID NO: 5276910 - DNA, 20 bp, Homo sapiens
atgttgatctgcatatttct

SEQ ID NO: 5276911 - DNA, 23 bp, Homo sapiens
atgttgatctgcatatttctgta

SEQ ID NO: 5276912 - DNA, 15 bp, Homo sapiens
atgttgatgaaattc

SEQ ID NO: 5276913 - DNA, 21 bp, Homo sapiens
atgttgatgcaatccttacaa

SEQ ID NO: 5276914 - DNA, 15 bp, Homo sapiens
atgttgatttagtct

SEQ ID NO: 5276915 - DNA, 15 bp, Homo sapiens
atgttgatttatgag

SEQ ID NO: 5276916 - DNA, 20 bp, Homo sapiens
atgttgatttttactgtgtt

SEQ ID NO: 5276917 - DNA, 21 bp, Homo sapiens
atgttgatttttactgtgttt

SEQ ID NO: 5276918 - DNA, 22 bp, Homo sapiens
atgttgcaatgtgaaaaatctg

SEQ ID NO: 5276919 - DNA, 14 bp, Homo sapiens
atgttgcacatcat

SEQ ID NO: 5276920 - DNA, 14 bp, Homo sapiens
atgttgcactgaaa

SEQ ID NO: 5276921 - DNA, 17 bp, Homo sapiens
atgttgcactgtttgca

SEQ ID NO: 5276922 - DNA, 16 bp, Homo sapiens
atgttgcatgcctatg

SEQ ID NO: 5276923 - DNA, 19 bp, Homo sapiens
atgttgcattaattgtgct

SEQ ID NO: 5276924 - DNA, 22 bp, Homo sapiens
atgttgccaaaatggtggcctg

SEQ ID NO: 5276925 - DNA, 22 bp, Homo sapiens
atgttgccacctgttaaaatgt

SEQ ID NO: 5276926 - DNA, 17 bp, Homo sapiens
atgttgccatgaggcct

SEQ ID NO: 5276927 - DNA, 21 bp, Homo sapiens
atgttgccatgaggcctttcc

SEQ ID NO: 5276928 - DNA, 12 bp, Homo sapiens
atgttgcccaag

SEQ ID NO: 5276929 - DNA, 12 bp, Homo sapiens
atgttgcccaga

SEQ ID NO: 5276930 - DNA, 17 bp, Homo sapiens
atgttgcccaggcaggt

SEQ ID NO: 5276931 - DNA, 14 bp, Homo sapiens
atgttgcccaggct

SEQ ID NO: 5276932 - DNA, 18 bp, Homo sapiens
atgttgctatagtgacat

SEQ ID NO: 5276933 - DNA, 23 bp, Homo sapiens
atgttgctctgggagacttactg

SEQ ID NO: 5276934 - DNA, 16 bp, Homo sapiens
atgttgctctttcacc

SEQ ID NO: 5276935 - DNA, 17 bp, Homo sapiens
atgttgctgaatttgta

SEQ ID NO: 5276936 - DNA, 14 bp, Homo sapiens
atgttgctgacttt

SEQ ID NO: 5276937 - DNA, 15 bp, Homo sapiens
atgttgctggatcag

SEQ ID NO: 5276938 - DNA, 20 bp, Homo sapiens
atgttgctgtgcacggtgga

SEQ ID NO: 5276939 - DNA, 11 bp, Homo sapiens
atgttgcttct

SEQ ID NO: 5276940 - DNA, 17 bp, Homo sapiens
atgttgcttctgaatca

SEQ ID NO: 5276941 - DNA, 14 bp, Homo sapiens
atgttgctttgaaa

SEQ ID NO: 5276942 - DNA, 17 bp, Homo sapiens
atgttgcttttgaaaag

SEQ ID NO: 5276943 - DNA, 15 bp, Homo sapiens
attgtgtgagcttct

SEQ ID NO: 5276944 - DNA, 13 bp, Homo sapiens
attgtgtgatgtt

SEQ ID NO: 5276945 - DNA, 18 bp, Homo sapiens
attgtgtgcgctgcctgg

SEQ ID NO: 5276946 - DNA, 21 bp, Homo sapiens
attgtgtgcgctgcctggcca

SEQ ID NO: 5276947 - DNA, 19 bp, Homo sapiens
attgtgtgtgcagacttca

SEQ ID NO: 5276948 - DNA, 14 bp, Homo sapiens
attgtgttcctttt

SEQ ID NO: 5276949 - DNA, 15 bp, Homo sapiens
attgtgttcttaaaa

SEQ ID NO: 5276950 - DNA, 19 bp, Homo sapiens
attgtgttgaagaagggtt

SEQ ID NO: 5276951 - DNA, 13 bp, Homo sapiens
attgtgttgacat

SEQ ID NO: 5276952 - DNA, 19 bp, Homo sapiens
attgtgttgactttataaa

SEQ ID NO: 5276953 - DNA, 20 bp, Homo sapiens
attgtgttgccttagcactt

SEQ ID NO: 5276954 - DNA, 21 bp, Homo sapiens
attgtgttgccttagcacttc

SEQ ID NO: 5276955 - DNA, 17 bp, Homo sapiens
attgtgttgtcttcagc

SEQ ID NO: 5276956 - DNA, 14 bp, Homo sapiens
attgtgttgtgaat

SEQ ID NO: 5276957 - DNA, 17 bp, Homo sapiens
attgtgttgtgaatgtt

SEQ ID NO: 5276958 - DNA, 12 bp, Homo sapiens
attgtgtttaca

SEQ ID NO: 5276959 - DNA, 15 bp, Homo sapiens
attgtgtttacattt

SEQ ID NO: 5276960 - DNA, 13 bp, Homo sapiens
attgtgtttgtca

SEQ ID NO: 5276961 - DNA, 16 bp, Homo sapiens
attgtgtttgtcatta

SEQ ID NO: 5276962 - DNA, 19 bp, Homo sapiens
attgtgtttgtcattagcc

SEQ ID NO: 5276963 - DNA, 22 bp, Homo sapiens
attgtgtttgtcattagcctga

SEQ ID NO: 5276964 - DNA, 17 bp, Homo sapiens
attgtgtttgttcataa

SEQ ID NO: 5276965 - DNA, 15 bp, Homo sapiens
attgttaaattcaat

SEQ ID NO: 5276966 - DNA, 17 bp, Homo sapiens
attgttaactcttgtct

SEQ ID NO: 5276967 - DNA, 14 bp, Homo sapiens
attgttaatacaag

SEQ ID NO: 5276968 - DNA, 17 bp, Homo sapiens
attgttaatctctgtta

SEQ ID NO: 5276969 - DNA, 22 bp, Homo sapiens
attgttaatgcctataactttt

SEQ ID NO: 5276970 - DNA, 14 bp, Homo sapiens
attgttaatttcag

SEQ ID NO: 5276971 - DNA, 15 bp, Homo sapiens
attgttaatttcagt

SEQ ID NO: 5276972 - DNA, 15 bp, Homo sapiens
attgttacaaggaca

SEQ ID NO: 5276973 - DNA, 14 bp, Homo sapiens
attgttacaagtgt

SEQ ID NO: 5276974 - DNA, 20 bp, Homo sapiens
attgttacaagtgttcttag

SEQ ID NO: 5276975 - DNA, 15 bp, Homo sapiens
attgttacagaagct

SEQ ID NO: 5276976 - DNA, 19 bp, Homo sapiens
attgttacaggtgtactat

SEQ ID NO: 5276977 - DNA, 17 bp, Homo sapiens
attgttacatgtaatat

SEQ ID NO: 5276978 - DNA, 21 bp, Homo sapiens
attgttacattatgtggaaaa

SEQ ID NO: 5276979 - DNA, 16 bp, Homo sapiens
attgttacccatttga

SEQ ID NO: 5276980 - DNA, 19 bp, Homo sapiens
attgttacgtagcctaagg

SEQ ID NO: 5276981 - DNA, 20 bp, Homo sapiens
attgttagaaaatgacttat

SEQ ID NO: 5276982 - DNA, 21 bp, Homo sapiens
attgttagaaaatgacttatt

SEQ ID NO: 5276983 - DNA, 20 bp, Homo sapiens
attgttagagagtataactt

SEQ ID NO: 5276984 - DNA, 14 bp, Homo sapiens
attgttagatggca

SEQ ID NO: 5276985 - DNA, 18 bp, Homo sapiens
attgttagcttccttaag

SEQ ID NO: 5276986 - DNA, 19 bp, Homo sapiens
attgttaggaaatgtcatc

SEQ ID NO: 5276987 - DNA, 18 bp, Homo sapiens
attgttagggtcagccat

SEQ ID NO: 5276988 - DNA, 12 bp, Homo sapiens
attgttagttta

SEQ ID NO: 5276989 - DNA, 17 bp, Homo sapiens
attgttagttttaagcc

SEQ ID NO: 5276990 - DNA, 18 bp, Homo sapiens
attgttatacctttttga

SEQ ID NO: 5276991 - DNA, 17 bp, Homo sapiens
attgttatgatctactc

SEQ ID NO: 5276992 - DNA, 14 bp, Homo sapiens
attgttatttaata

SEQ ID NO: 5276993 - DNA, 22 bp, Homo sapiens
attgttatttaatagctgtgat

SEQ ID NO: 5276994 - DNA, 13 bp, Homo sapiens
attgttatttata

SEQ ID NO: 5276995 - DNA, 17 bp, Homo sapiens
attgttcaaaaagatat

SEQ ID NO: 5276996 - DNA, 21 bp, Homo sapiens
attgttcaaactttctgcctt

SEQ ID NO: 5276997 - DNA, 20 bp, Homo sapiens
attgttcacacaaagcctgt

SEQ ID NO: 5276998 - DNA, 23 bp, Homo sapiens
attgttcagaaaagcacctcttg

SEQ ID NO: 5276999 - DNA, 18 bp, Homo sapiens
attgttcataatacataa

SEQ ID NO: 5277000 - DNA, 18 bp, Homo sapiens
attgttcattttgagctg

SEQ ID NO: 5277001 - DNA, 20 bp, Homo sapiens
attgttccaagacattgtca

SEQ ID NO: 5277002 - DNA, 22 bp, Homo sapiens
attgttccaagacattgtcaat

SEQ ID NO: 5277003 - DNA, 24 bp, Homo sapiens
attgttccagcagttttcaagtca

SEQ ID NO: 5277004 - DNA, 22 bp, Homo sapiens
attgttccaggcatccatcttg

SEQ ID NO: 5277005 - DNA, 16 bp, Homo sapiens
attgttcccagtgaca

SEQ ID NO: 5277006 - DNA, 17 bp, Homo sapiens
attgttcctaagttctt

SEQ ID NO: 5277007 - DNA, 20 bp, Homo sapiens
attgttcctaagttcttaga

SEQ ID NO: 5277008 - DNA, 23 bp, Homo sapiens
attgttcctaagttcttagatat

SEQ ID NO: 5277009 - DNA, 15 bp, Homo sapiens
attgttcctccccag

SEQ ID NO: 5277010 - DNA, 15 bp, Homo sapiens
attgttcctctttgt

SEQ ID NO: 5277011 - DNA, 15 bp, Homo sapiens
attgttccttgcttt

SEQ ID NO: 5277012 - DNA, 20 bp, Homo sapiens
attgttccttggagaaatga

SEQ ID NO: 5277013 - DNA, 21 bp, Homo sapiens
attgttccttggagaaatgaa

SEQ ID NO: 5277014 - DNA, 22 bp, Homo sapiens
attgttcgtttcatcaggctct

SEQ ID NO: 5277015 - DNA, 17 bp, Homo sapiens
attgttctaatgcaaca

SEQ ID NO: 5277016 - DNA, 17 bp, Homo sapiens
attgttctagtactgta

SEQ ID NO: 5277017 - DNA, 17 bp, Homo sapiens
attgttctcctcgtcca

SEQ ID NO: 5277018 - DNA, 10 bp, Homo sapiens
attgttctgg

SEQ ID NO: 5277019 - DNA, 18 bp, Homo sapiens
attgttctgggtgatttc

SEQ ID NO: 5277020 - DNA, 12 bp, Homo sapiens
attgttcttccc

SEQ ID NO: 5277021 - DNA, 20 bp, Homo sapiens
attgttcttgtaaaactgtg

SEQ ID NO: 5277022 - DNA, 21 bp, Homo sapiens
attgttcttgtaaaactgtga

SEQ ID NO: 5277023 - DNA, 18 bp, Homo sapiens
attgttctttgccagaga

SEQ ID NO: 5277024 - DNA, 13 bp, Homo sapiens
attgttcttttgt

SEQ ID NO: 5277025 - DNA, 16 bp, Homo sapiens
attgttgaaattttgc

SEQ ID NO: 5277026 - DNA, 13 bp, Homo sapiens
attgttgaataaa

SEQ ID NO: 5277027 - DNA, 14 bp, Homo sapiens
attgttgaatgtat

SEQ ID NO: 5277028 - DNA, 18 bp, Homo sapiens
attgttgataggaactgt

SEQ ID NO: 5277029 - DNA, 20 bp, Homo sapiens
attgttgcataggttagata

SEQ ID NO: 5277030 - DNA, 21 bp, Homo sapiens
attgttgcatcccccttagaa

SEQ ID NO: 5277031 - DNA, 16 bp, Homo sapiens
attgttgctccctgtg

SEQ ID NO: 5277032 - DNA, 16 bp, Homo sapiens
attgttgctgaaaact

SEQ ID NO: 5277033 - DNA, 18 bp, Homo sapiens
attgttggcacatcctat

SEQ ID NO: 5277034 - DNA, 17 bp, Homo sapiens
attgttggctatttgaa

SEQ ID NO: 5277035 - DNA, 16 bp, Homo sapiens
attgttgggaaaggaa

SEQ ID NO: 5277036 - DNA, 18 bp, Homo sapiens
attgttggtgttaattga

SEQ ID NO: 5277037 - DNA, 16 bp, Homo sapiens
attgttgtaaactgtt

SEQ ID NO: 5277038 - DNA, 21 bp, Homo sapiens
attgttgtacacagaaataca

SEQ ID NO: 5277039 - DNA, 22 bp, Homo sapiens
attgttgtccggtttactttaa

SEQ ID NO: 5277040 - DNA, 15 bp, Homo sapiens
attgttgtgcttaga

SEQ ID NO: 5277041 - DNA, 15 bp, Homo sapiens
attgttgtgggcttt

SEQ ID NO: 5277042 - DNA, 14 bp, Homo sapiens
attgttgttctgtt

SEQ ID NO: 5277043 - DNA, 18 bp, Homo sapiens
attgttgttctgttaact

SEQ ID NO: 5277044 - DNA, 21 bp, Homo sapiens
attgttgttctgttaactgaa

SEQ ID NO: 5277045 - DNA, 14 bp, Homo sapiens
attgttgtttcttt

SEQ ID NO: 5277046 - DNA, 16 bp, Homo sapiens
attgttgtttctttct

SEQ ID NO: 5277047 - DNA, 19 bp, Homo sapiens
attgttgtttctttctagt

SEQ ID NO: 5277048 - DNA, 17 bp, Homo sapiens
attgttgtttgtatgta

SEQ ID NO: 5277049 - DNA, 21 bp, Homo sapiens
attgttgtttgtatgtataat

SEQ ID NO: 5277050 - DNA, 20 bp, Homo sapiens
attgttgttttaacctcccc

SEQ ID NO: 5277051 - DNA, 15 bp, Homo sapiens
attgtttaaaaatac

SEQ ID NO: 5277052 - DNA, 20 bp, Homo sapiens
attgtttaaaaatacacatg

SEQ ID NO: 5277053 - DNA, 19 bp, Homo sapiens
attgtttaaaatcatttct

SEQ ID NO: 5277054 - DNA, 15 bp, Homo sapiens
attgtttaaaatgta

SEQ ID NO: 5277055 - DNA, 18 bp, Homo sapiens
attgtttaaaattcagtt

SEQ ID NO: 5277056 - DNA, 14 bp, Homo sapiens
attgtttaaagatg

SEQ ID NO: 5277057 - DNA, 15 bp, Homo sapiens
attgtttaaatgcct

SEQ ID NO: 5277058 - DNA, 14 bp, Homo sapiens
attgtttaatgcaa

SEQ ID NO: 5277059 - DNA, 14 bp, Homo sapiens
attgtttacaggat

SEQ ID NO: 5277060 - DNA, 23 bp, Homo sapiens
attgtttatacacaactttgcaa

SEQ ID NO: 5277061 - DNA, 21 bp, Homo sapiens
attgtttatctagatgtaaat

SEQ ID NO: 5277062 - DNA, 13 bp, Homo sapiens
attgtttatgtaa

SEQ ID NO: 5277063 - DNA, 21 bp, Homo sapiens
attgtttatgtgttatgaaca

SEQ ID NO: 5277064 - DNA, 23 bp, Homo sapiens
attgtttatgtgttatgaacatc

SEQ ID NO: 5277065 - DNA, 15 bp, Homo sapiens
attgtttatttatca

SEQ ID NO: 5277066 - DNA, 18 bp, Homo sapiens
attgtttatttatcagtg

SEQ ID NO: 5277067 - DNA, 19 bp, Homo sapiens
attgtttcaaaataaaaac

SEQ ID NO: 5277068 - DNA, 22 bp, Homo sapiens
attgtttcaattgcatctccca

SEQ ID NO: 5277069 - DNA, 12 bp, Homo sapiens
attgtttccaaa

SEQ ID NO: 5277070 - DNA, 23 bp, Homo sapiens
attgtttccaaagtgcatgtcac

SEQ ID NO: 5277071 - DNA, 13 bp, Homo sapiens
attgtttccaact

SEQ ID NO: 5277072 - DNA, 18 bp, Homo sapiens
attgtttccaacttgtct

SEQ ID NO: 5277073 - DNA, 22 bp, Homo sapiens
attgtttccaacttgtctggga

SEQ ID NO: 5277074 - DNA, 14 bp, Homo sapiens
attgtttcttgaca

SEQ ID NO: 5277075 - DNA, 19 bp, Homo sapiens
attgtttgaaacaaagaag

SEQ ID NO: 5277076 - DNA, 20 bp, Homo sapiens
attgtttgaaacaaagaagg

SEQ ID NO: 5277077 - DNA, 19 bp, Homo sapiens
attgtttgatgaataaaat

SEQ ID NO: 5277078 - DNA, 15 bp, Homo sapiens
attgtttgcttattg

SEQ ID NO: 5277079 - DNA, 16 bp, Homo sapiens
attgtttgcttattgt

SEQ ID NO: 5277080 - DNA, 17 bp, Homo sapiens
attgtttggacctgcat

SEQ ID NO: 5277081 - DNA, 21 bp, Homo sapiens
attgtttgggatcctattgaa

SEQ ID NO: 5277082 - DNA, 21 bp, Homo sapiens
attgtttggggaagttcaagt

SEQ ID NO: 5277083 - DNA, 16 bp, Homo sapiens
attgtttgtctttaac

SEQ ID NO: 5277084 - DNA, 21 bp, Homo sapiens
attgtttgtctttaactgtca

SEQ ID NO: 5277085 - DNA, 13 bp, Homo sapiens
attgtttgtttta

SEQ ID NO: 5277086 - DNA, 17 bp, Homo sapiens
attgttttaacacagta

SEQ ID NO: 5277087 - DNA, 13 bp, Homo sapiens
attgttttacaat

SEQ ID NO: 5277088 - DNA, 17 bp, Homo sapiens
attgttttacaatagtt

SEQ ID NO: 5277089 - DNA, 19 bp, Homo sapiens
attgttttacctgttctga

SEQ ID NO: 5277090 - DNA, 15 bp, Homo sapiens
attgttttagagact

SEQ ID NO: 5277091 - DNA, 15 bp, Homo sapiens
attgttttataaatg

SEQ ID NO: 5277092 - DNA, 19 bp, Homo sapiens
attgttttatctgaatttt

SEQ ID NO: 5277093 - DNA, 20 bp, Homo sapiens
attgttttatggtgtgttcc

SEQ ID NO: 5277094 - DNA, 17 bp, Homo sapiens
attgttttcacttgtat

SEQ ID NO: 5277095 - DNA, 19 bp, Homo sapiens
attgttttcacttgtattg

SEQ ID NO: 5277096 - DNA, 18 bp, Homo sapiens
attgttttccagaagcct

SEQ ID NO: 5277097 - DNA, 20 bp, Homo sapiens
attgttttccagaagcctcc

SEQ ID NO: 5277098 - DNA, 15 bp, Homo sapiens
attgttttctattta

SEQ ID NO: 5277099 - DNA, 21 bp, Homo sapiens
attgttttctatttatgcctt

SEQ ID NO: 5277100 - DNA, 20 bp, Homo sapiens
attgttttctgtaaataacc

SEQ ID NO: 5277101 - DNA, 14 bp, Homo sapiens
attgttttgaatat

SEQ ID NO: 5277102 - DNA, 22 bp, Homo sapiens
attgttttgaatattactccta

SEQ ID NO: 5277103 - DNA, 20 bp, Homo sapiens
attgttttgcaaaagtgtat

SEQ ID NO: 5277104 - DNA, 20 bp, Homo sapiens
attgtttttaatttgaatca

SEQ ID NO: 5277105 - DNA, 23 bp, Homo sapiens
attgtttttagaaatttattctt

SEQ ID NO: 5277106 - DNA, 16 bp, Homo sapiens
attgtttttataaaaa

SEQ ID NO: 5277107 - DNA, 20 bp, Homo sapiens
attgtttttataaaaacatt

SEQ ID NO: 5277108 - DNA, 22 bp, Homo sapiens
attgtttttataaaaacattga

SEQ ID NO: 5277109 - DNA, 17 bp, Homo sapiens
attgtttttatatatta

SEQ ID NO: 5277110 - DNA, 14 bp, Homo sapiens
attgtttttcaaag

SEQ ID NO: 5277111 - DNA, 22 bp, Homo sapiens
attgtttttccctaatcttccg

SEQ ID NO: 5277112 - DNA, 15 bp, Homo sapiens
attgtttttctttct

SEQ ID NO: 5277113 - DNA, 23 bp, Homo sapiens
attgtttttgaatttaaataaag

SEQ ID NO: 5277114 - DNA, 13 bp, Homo sapiens
attgtttttgtat

SEQ ID NO: 5277115 - DNA, 16 bp, Homo sapiens
attgtttttgtatatt

SEQ ID NO: 5277116 - DNA, 16 bp, Homo sapiens
attgtttttgtattta

SEQ ID NO: 5277117 - DNA, 14 bp, Homo sapiens
attgttttttaaag

SEQ ID NO: 5277118 - DNA, 22 bp, Homo sapiens
attgttttttcctaaggaaact

SEQ ID NO: 5277119 - DNA, 18 bp, Homo sapiens
attgttttttctttaaag

SEQ ID NO: 5277120 - DNA, 19 bp, Homo sapiens
atttaaaaaaaaaagagga

SEQ ID NO: 5277121 - DNA, 17 bp, Homo sapiens
atgttggaagagaaagc

SEQ ID NO: 5277122 - DNA, 21 bp, Homo sapiens
atgttggaattttaagtcttt

SEQ ID NO: 5277123 - DNA, 19 bp, Homo sapiens
atgttggacacctttaggt

SEQ ID NO: 5277124 - DNA, 22 bp, Homo sapiens
atgttggacacctttaggttct

SEQ ID NO: 5277125 - DNA, 23 bp, Homo sapiens
atgttggacacctttaggttctt

SEQ ID NO: 5277126 - DNA, 22 bp, Homo sapiens
atgttggacagacactgttgca

SEQ ID NO: 5277127 - DNA, 19 bp, Homo sapiens
atgttggagcagcaggcct

SEQ ID NO: 5277128 - DNA, 23 bp, Homo sapiens
atgttggagcagcaggcctctgg

SEQ ID NO: 5277129 - DNA, 21 bp, Homo sapiens
atgttggatgatgaaacattc

SEQ ID NO: 5277130 - DNA, 16 bp, Homo sapiens
atgttggatttataaa

SEQ ID NO: 5277131 - DNA, 18 bp, Homo sapiens
atgttggatttataaatg

SEQ ID NO: 5277132 - DNA, 20 bp, Homo sapiens
atgttggatttataaatgct

SEQ ID NO: 5277133 - DNA, 14 bp, Homo sapiens
atgttggccaggct

SEQ ID NO: 5277134 - DNA, 16 bp, Homo sapiens
atgttggccaggctgg

SEQ ID NO: 5277135 - DNA, 14 bp, Homo sapiens
atgttggcctgtca

SEQ ID NO: 5277136 - DNA, 22 bp, Homo sapiens
atgttggcttggggcaacagat

SEQ ID NO: 5277137 - DNA, 12 bp, Homo sapiens
atgttgggaaag

SEQ ID NO: 5277138 - DNA, 14 bp, Homo sapiens
atgttgggatttat

SEQ ID NO: 5277139 - DNA, 23 bp, Homo sapiens
atgttgggatttatatctatagt

SEQ ID NO: 5277140 - DNA, 22 bp, Homo sapiens
atgttgggggggaccctgcctc

SEQ ID NO: 5277141 - DNA, 19 bp, Homo sapiens
atgttggggtttttttaag

SEQ ID NO: 5277142 - DNA, 20 bp, Homo sapiens
atgttgggttgttacagagt

SEQ ID NO: 5277143 - DNA, 15 bp, Homo sapiens
atgttggtatttatc

SEQ ID NO: 5277144 - DNA, 17 bp, Homo sapiens
atgttggtatttatcta

SEQ ID NO: 5277145 - DNA, 21 bp, Homo sapiens
atgttggtatttatctattgt

SEQ ID NO: 5277146 - DNA, 12 bp, Homo sapiens
atgttggtcagg

SEQ ID NO: 5277147 - DNA, 20 bp, Homo sapiens
atgttggtgcaattaactct

SEQ ID NO: 5277148 - DNA, 23 bp, Homo sapiens
atgttggtgtggagttttcatga

SEQ ID NO: 5277149 - DNA, 20 bp, Homo sapiens
atgttggttgcactttgtag

SEQ ID NO: 5277150 - DNA, 21 bp, Homo sapiens
atgttggtttaattaataata

SEQ ID NO: 5277151 - DNA, 17 bp, Homo sapiens
atgttggtttactttca

SEQ ID NO: 5277152 - DNA, 19 bp, Homo sapiens
atgttggtttactttcaaa

SEQ ID NO: 5277153 - DNA, 15 bp, Homo sapiens
atgttgtaatgctgc

SEQ ID NO: 5277154 - DNA, 20 bp, Homo sapiens
atgttgtaattttacttttt

SEQ ID NO: 5277155 - DNA, 20 bp, Homo sapiens
atgttgtacatactgccgaa

SEQ ID NO: 5277156 - DNA, 16 bp, Homo sapiens
atgttgtacttgaaaa

SEQ ID NO: 5277157 - DNA, 15 bp, Homo sapiens
atgttgtagatacaa

SEQ ID NO: 5277158 - DNA, 22 bp, Homo sapiens
atgttgtagatacaatcagctg

SEQ ID NO: 5277159 - DNA, 13 bp, Homo sapiens
atgttgtattaac

SEQ ID NO: 5277160 - DNA, 19 bp, Homo sapiens
atgttgtattaactgggta

SEQ ID NO: 5277161 - DNA, 20 bp, Homo sapiens
atgttgtatttatggaagaa

SEQ ID NO: 5277162 - DNA, 12 bp, Homo sapiens
atgttgtcataa

SEQ ID NO: 5277163 - DNA, 15 bp, Homo sapiens
atgttgtcattatgt

SEQ ID NO: 5277164 - DNA, 22 bp, Homo sapiens
atgttgtccaacaataaacagg

SEQ ID NO: 5277165 - DNA, 17 bp, Homo sapiens
atgttgtcctgtgtcat

SEQ ID NO: 5277166 - DNA, 13 bp, Homo sapiens
atgttgtctaaga

SEQ ID NO: 5277167 - DNA, 16 bp, Homo sapiens
atgttgtctaagaaat

SEQ ID NO: 5277168 - DNA, 17 bp, Homo sapiens
atgttgtgaataattac

SEQ ID NO: 5277169 - DNA, 12 bp, Homo sapiens
atgttgtggaat

SEQ ID NO: 5277170 - DNA, 16 bp, Homo sapiens
atgttgtggtttgttg

SEQ ID NO: 5277171 - DNA, 18 bp, Homo sapiens
atgttgtgtgggttcaaa

SEQ ID NO: 5277172 - DNA, 19 bp, Homo sapiens
atgttgtgttggtatttac

SEQ ID NO: 5277173 - DNA, 20 bp, Homo sapiens
atgttgtgttggtatttact

SEQ ID NO: 5277174 - DNA, 22 bp, Homo sapiens
atgttgtgttggtatttactgc

SEQ ID NO: 5277175 - DNA, 15 bp, Homo sapiens
atgttgtgtttttaa

SEQ ID NO: 5277176 - DNA, 16 bp, Homo sapiens
atgttgttaaatgcta

SEQ ID NO: 5277177 - DNA, 21 bp, Homo sapiens
atgttgttaaatgctatggaa

SEQ ID NO: 5277178 - DNA, 17 bp, Homo sapiens
atgttgttatgctatta

SEQ ID NO: 5277179 - DNA, 12 bp, Homo sapiens
atgttgttattt

SEQ ID NO: 5277180 - DNA, 20 bp, Homo sapiens
atgttgttcaaatgcatttt

SEQ ID NO: 5277181 - DNA, 20 bp, Homo sapiens
atgttgttcattattggagg

SEQ ID NO: 5277182 - DNA, 13 bp, Homo sapiens
atgttgttcctgg

SEQ ID NO: 5277183 - DNA, 19 bp, Homo sapiens
atgttgttcgatcgtttca

SEQ ID NO: 5277184 - DNA, 17 bp, Homo sapiens
atgttgttgaactaata

SEQ ID NO: 5277185 - DNA, 16 bp, Homo sapiens
atgttgttgtctattt

SEQ ID NO: 5277186 - DNA, 18 bp, Homo sapiens
atgttgttgtctatttgt

SEQ ID NO: 5277187 - DNA, 21 bp, Homo sapiens
atgttgttgtgtgtatatgta

SEQ ID NO: 5277188 - DNA, 15 bp, Homo sapiens
atgttgtttaacata

SEQ ID NO: 5277189 - DNA, 17 bp, Homo sapiens
atgttgtttataataaa

SEQ ID NO: 5277190 - DNA, 22 bp, Homo sapiens
atgttgtttataataaaaatat

SEQ ID NO: 5277191 - DNA, 15 bp, Homo sapiens
atgttgttttgtaca

SEQ ID NO: 5277192 - DNA, 17 bp, Homo sapiens
atgttgttttgtacaga

SEQ ID NO: 5277193 - DNA, 20 bp, Homo sapiens
atgtttaaaaaaacattatt

SEQ ID NO: 5277194 - DNA, 16 bp, Homo sapiens
atgtttaaaaaagttt

SEQ ID NO: 5277195 - DNA, 17 bp, Homo sapiens
atgtttaaaaaagttta

SEQ ID NO: 5277196 - DNA, 21 bp, Homo sapiens
atgtttaaaaacattccccaa

SEQ ID NO: 5277197 - DNA, 14 bp, Homo sapiens
atgtttaaaacacc

SEQ ID NO: 5277198 - DNA, 21 bp, Homo sapiens
atgtttaaaacaccttctata

SEQ ID NO: 5277199 - DNA, 15 bp, Homo sapiens
atgtttaaaagaaat

SEQ ID NO: 5277200 - DNA, 16 bp, Homo sapiens
atgtttaaaagaaata

SEQ ID NO: 5277201 - DNA, 19 bp, Homo sapiens
atgtttaaaagaaatatat

SEQ ID NO: 5277202 - DNA, 19 bp, Homo sapiens
atgtttaaaagcaaaactg

SEQ ID NO: 5277203 - DNA, 20 bp, Homo sapiens
atgtttaaaatttcttagaa

SEQ ID NO: 5277204 - DNA, 14 bp, Homo sapiens
atgtttaaacattt

SEQ ID NO: 5277205 - DNA, 22 bp, Homo sapiens
atgtttaaactttgtgcctttg

SEQ ID NO: 5277206 - DNA, 18 bp, Homo sapiens
atgtttaaatagcctaaa

SEQ ID NO: 5277207 - DNA, 17 bp, Homo sapiens
atgtttaaatataaatg

SEQ ID NO: 5277208 - DNA, 13 bp, Homo sapiens
atgtttaaatcat

SEQ ID NO: 5277209 - DNA, 14 bp, Homo sapiens
atgtttaaatcatg

SEQ ID NO: 5277210 - DNA, 15 bp, Homo sapiens
atgtttaaatcatgt

SEQ ID NO: 5277211 - DNA, 18 bp, Homo sapiens
atgtttaaatcatgtatg

SEQ ID NO: 5277212 - DNA, 19 bp, Homo sapiens
atgtttaaatcatgtatgt

SEQ ID NO: 5277213 - DNA, 15 bp, Homo sapiens
atgtttaaattgtaa

SEQ ID NO: 5277214 - DNA, 17 bp, Homo sapiens
atgtttaacatcattgc

SEQ ID NO: 5277215 - DNA, 12 bp, Homo sapiens
atgtttaagatt

SEQ ID NO: 5277216 - DNA, 14 bp, Homo sapiens
atgtttaagattta

SEQ ID NO: 5277217 - DNA, 21 bp, Homo sapiens
atgtttaagatttaatttgcc

SEQ ID NO: 5277218 - DNA, 20 bp, Homo sapiens
atgtttaagcagaattggaa

SEQ ID NO: 5277219 - DNA, 22 bp, Homo sapiens
atgtttaagcagaattggaaaa

SEQ ID NO: 5277220 - DNA, 16 bp, Homo sapiens
atgtttaagccaaaat

SEQ ID NO: 5277221 - DNA, 14 bp, Homo sapiens
atgtttaagtgctt

SEQ ID NO: 5277222 - DNA, 15 bp, Homo sapiens
atgtttaataaagct

SEQ ID NO: 5277223 - DNA, 19 bp, Homo sapiens
atgtttaataaagctttat

SEQ ID NO: 5277224 - DNA, 16 bp, Homo sapiens
atgtttaataatatgt

SEQ ID NO: 5277225 - DNA, 17 bp, Homo sapiens
atgtttaataatatgta

SEQ ID NO: 5277226 - DNA, 18 bp, Homo sapiens
atgtttaataatatgtac

SEQ ID NO: 5277227 - DNA, 19 bp, Homo sapiens
atgtttaataatatgtaca

SEQ ID NO: 5277228 - DNA, 21 bp, Homo sapiens
atgtttaataatatgtacaaa

SEQ ID NO: 5277229 - DNA, 17 bp, Homo sapiens
atgtttaatatctgact

SEQ ID NO: 5277230 - DNA, 15 bp, Homo sapiens
atgtttaatgaagtc

SEQ ID NO: 5277231 - DNA, 21 bp, Homo sapiens
atgtttaatgaagtcactatt

SEQ ID NO: 5277232 - DNA, 22 bp, Homo sapiens
atgtttaatgaagtcactattt

SEQ ID NO: 5277233 - DNA, 15 bp, Homo sapiens
atgtttaatgtgaac

SEQ ID NO: 5277234 - DNA, 16 bp, Homo sapiens
atgtttaatgtgaact

SEQ ID NO: 5277235 - DNA, 14 bp, Homo sapiens
atgtttacacaatt

SEQ ID NO: 5277236 - DNA, 18 bp, Homo sapiens
atgtttacactctttgta

SEQ ID NO: 5277237 - DNA, 21 bp, Homo sapiens
atgtttacactctttgtaaga

SEQ ID NO: 5277238 - DNA, 21 bp, Homo sapiens
atgtttacaggaacccagcca

SEQ ID NO: 5277239 - DNA, 21 bp, Homo sapiens
atgtttacagggagcctcctg

SEQ ID NO: 5277240 - DNA, 19 bp, Homo sapiens
atgtttacagtgtctgtgt

SEQ ID NO: 5277241 - DNA, 12 bp, Homo sapiens
atgtttacattt

SEQ ID NO: 5277242 - DNA, 18 bp, Homo sapiens
atgtttacattttctttc

SEQ ID NO: 5277243 - DNA, 14 bp, Homo sapiens
atgtttacattttg

SEQ ID NO: 5277244 - DNA, 19 bp, Homo sapiens
atgtttacctcactggtgc

SEQ ID NO: 5277245 - DNA, 15 bp, Homo sapiens
atgtttacctggtgc

SEQ ID NO: 5277246 - DNA, 15 bp, Homo sapiens
atgtttaccttttaa

SEQ ID NO: 5277247 - DNA, 18 bp, Homo sapiens
atgtttaccttttaatta

SEQ ID NO: 5277248 - DNA, 14 bp, Homo sapiens
atgtttactgtaaa

SEQ ID NO: 5277249 - DNA, 15 bp, Homo sapiens
atgtttactgtaaat

SEQ ID NO: 5277250 - DNA, 13 bp, Homo sapiens
atgtttactgtat

SEQ ID NO: 5277251 - DNA, 14 bp, Homo sapiens
atgtttactgtatc

SEQ ID NO: 5277252 - DNA, 22 bp, Homo sapiens
atgtttactgtatcaatttcta

SEQ ID NO: 5277253 - DNA, 20 bp, Homo sapiens
atgtttagaaataaatgaaa

SEQ ID NO: 5277254 - DNA, 21 bp, Homo sapiens
atgtttagatagggctgggca

SEQ ID NO: 5277255 - DNA, 16 bp, Homo sapiens
atgtttagattccagg

SEQ ID NO: 5277256 - DNA, 17 bp, Homo sapiens
atgtttagtaatcatat

SEQ ID NO: 5277257 - DNA, 16 bp, Homo sapiens
atgtttagtagctgat

SEQ ID NO: 5277258 - DNA, 19 bp, Homo sapiens
atgtttagtagctgataaa

SEQ ID NO: 5277259 - DNA, 20 bp, Homo sapiens
atgtttagtgtgctgctgtt

SEQ ID NO: 5277260 - DNA, 17 bp, Homo sapiens
atgtttataactctagg

SEQ ID NO: 5277261 - DNA, 18 bp, Homo sapiens
atgtttatacaataattt

SEQ ID NO: 5277262 - DNA, 15 bp, Homo sapiens
atgtttatacacaca

SEQ ID NO: 5277263 - DNA, 20 bp, Homo sapiens
atgtttatacagagtaatta

SEQ ID NO: 5277264 - DNA, 13 bp, Homo sapiens
atgtttatataaa

SEQ ID NO: 5277265 - DNA, 16 bp, Homo sapiens
atgtttatatcaaatg

SEQ ID NO: 5277266 - DNA, 23 bp, Homo sapiens
atgtttatatctgcaaaaaacct

SEQ ID NO: 5277267 - DNA, 18 bp, Homo sapiens
atgtttatattgttttta

SEQ ID NO: 5277268 - DNA, 13 bp, Homo sapiens
atgtttatgaaaa

SEQ ID NO: 5277269 - DNA, 15 bp, Homo sapiens
atgtttatgaaaata

SEQ ID NO: 5277270 - DNA, 18 bp, Homo sapiens
atgtttatgaaaataaat

SEQ ID NO: 5277271 - DNA, 14 bp, Homo sapiens
atgtttatgaaggg

SEQ ID NO: 5277272 - DNA, 20 bp, Homo sapiens
atgtttatgagccagacaaa

SEQ ID NO: 5277273 - DNA, 21 bp, Homo sapiens
atgtttatgagccagacaaat

SEQ ID NO: 5277274 - DNA, 20 bp, Homo sapiens
atgtttatgcaaggaaggaa

SEQ ID NO: 5277275 - DNA, 15 bp, Homo sapiens
atgtttattacaatt

SEQ ID NO: 5277276 - DNA, 15 bp, Homo sapiens
atgtttattacagta

SEQ ID NO: 5277277 - DNA, 16 bp, Homo sapiens
atgtttattacagtat

SEQ ID NO: 5277278 - DNA, 18 bp, Homo sapiens
atgtttattacagtataa

SEQ ID NO: 5277279 - DNA, 23 bp, Homo sapiens
atgtttattacagtataattaac

SEQ ID NO: 5277280 - DNA, 17 bp, Homo sapiens
atgtttattcaaaatat

SEQ ID NO: 5277281 - DNA, 15 bp, Homo sapiens
atgtttattctagtt

SEQ ID NO: 5277282 - DNA, 23 bp, Homo sapiens
atgtttattctagttaaggaaat

SEQ ID NO: 5277283 - DNA, 18 bp, Homo sapiens
atgtttattcttctagag

SEQ ID NO: 5277284 - DNA, 22 bp, Homo sapiens
atgtttattgttttttaaagaa

SEQ ID NO: 5277285 - DNA, 21 bp, Homo sapiens
atgtttatttatttccagtgg

SEQ ID NO: 5277286 - DNA, 22 bp, Homo sapiens
atgtttatttcatgtggtgaat

SEQ ID NO: 5277287 - DNA, 18 bp, Homo sapiens
atgtttcaaaatagacaa

SEQ ID NO: 5277288 - DNA, 22 bp, Homo sapiens
atgtttcaaaatagacaagttt

SEQ ID NO: 5277289 - DNA, 15 bp, Homo sapiens
atgtttcaagaggag

SEQ ID NO: 5277290 - DNA, 12 bp, Homo sapiens
atgtttcacaac

SEQ ID NO: 5277291 - DNA, 14 bp, Homo sapiens
atgtttcacaacag

SEQ ID NO: 5277292 - DNA, 18 bp, Homo sapiens
atgtttcacaacaggcat

SEQ ID NO: 5277293 - DNA, 17 bp, Homo sapiens
atgtttcacaaggtctt

SEQ ID NO: 5277294 - DNA, 16 bp, Homo sapiens
atgtttcacacaaaca

SEQ ID NO: 5277295 - DNA, 21 bp, Homo sapiens
atgtttcacaccggaaggttt

SEQ ID NO: 5277296 - DNA, 18 bp, Homo sapiens
atgtttcactatgatttt

SEQ ID NO: 5277297 - DNA, 23 bp, Homo sapiens
atgtttcactcctgcttctctca

SEQ ID NO: 5277298 - DNA, 17 bp, Homo sapiens
atttaaaaaaaaacata

SEQ ID NO: 5277299 - DNA, 17 bp, Homo sapiens
atttaaaaaaaaacctg

SEQ ID NO: 5277300 - DNA, 18 bp, Homo sapiens
atttaaaaaaaagaaact

SEQ ID NO: 5277301 - DNA, 20 bp, Homo sapiens
atttaaaaaaaagaaacttt

SEQ ID NO: 5277302 - DNA, 22 bp, Homo sapiens
atttaaaaaaaagaaacttttc

SEQ ID NO: 5277303 - DNA, 13 bp, Homo sapiens
atttaaaaaacta

SEQ ID NO: 5277304 - DNA, 17 bp, Homo sapiens
atttaaaaaactaaaaa

SEQ ID NO: 5277305 - DNA, 13 bp, Homo sapiens
atttaaaaaataa

SEQ ID NO: 5277306 - DNA, 17 bp, Homo sapiens
atttaaaaaataaaaaa

SEQ ID NO: 5277307 - DNA, 20 bp, Homo sapiens
atttaaaaaataaaaaaata

SEQ ID NO: 5277308 - DNA, 22 bp, Homo sapiens
atttaaaaaataaaaaaataca

SEQ ID NO: 5277309 - DNA, 17 bp, Homo sapiens
atttaaaaaataaataa

SEQ ID NO: 5277310 - DNA, 13 bp, Homo sapiens
atttaaaaaatta

SEQ ID NO: 5277311 - DNA, 18 bp, Homo sapiens
atttaaaaaattaaaaat

SEQ ID NO: 5277312 - DNA, 20 bp, Homo sapiens
atttaaaaaattaaaaatga

SEQ ID NO: 5277313 - DNA, 17 bp, Homo sapiens
atttaaaaaattatgga

SEQ ID NO: 5277314 - DNA, 20 bp, Homo sapiens
atttaaaaacaaaaggcaat

SEQ ID NO: 5277315 - DNA, 22 bp, Homo sapiens
atttaaaaacaaccaacagaaa

SEQ ID NO: 5277316 - DNA, 18 bp, Homo sapiens
atttaaaaacttaaatat

SEQ ID NO: 5277317 - DNA, 21 bp, Homo sapiens
atttaaaaagaaacagaaatg

SEQ ID NO: 5277318 - DNA, 13 bp, Homo sapiens
atttaaaaagcaa

SEQ ID NO: 5277319 - DNA, 21 bp, Homo sapiens
atttaaaaaggtttaaaacta

SEQ ID NO: 5277320 - DNA, 19 bp, Homo sapiens
atttaaaaataagtcaaca

SEQ ID NO: 5277321 - DNA, 22 bp, Homo sapiens
atttaaaaataagtcaacagta

SEQ ID NO: 5277322 - DNA, 16 bp, Homo sapiens
atttaaaaatagaaac

SEQ ID NO: 5277323 - DNA, 15 bp, Homo sapiens
atttaaaaatatatt

SEQ ID NO: 5277324 - DNA, 14 bp, Homo sapiens
atttaaaaatattt

SEQ ID NO: 5277325 - DNA, 18 bp, Homo sapiens
atttaaaaatatttcaga

SEQ ID NO: 5277326 - DNA, 19 bp, Homo sapiens
atttaaaaatatttcagat

SEQ ID NO: 5277327 - DNA, 18 bp, Homo sapiens
atttaaaaatatttttgg

SEQ ID NO: 5277328 - DNA, 14 bp, Homo sapiens
atttaaaaatcttt

SEQ ID NO: 5277329 - DNA, 20 bp, Homo sapiens
atttaaaaatctttcagaat

SEQ ID NO: 5277330 - DNA, 21 bp, Homo sapiens
atttaaaaatgagtgtgaagg

SEQ ID NO: 5277331 - DNA, 19 bp, Homo sapiens
atttaaaaatgcatgataa

SEQ ID NO: 5277332 - DNA, 21 bp, Homo sapiens
atttaaaaatgcatgataatg

SEQ ID NO: 5277333 - DNA, 12 bp, Homo sapiens
atttaaaaatgt

SEQ ID NO: 5277334 - DNA, 16 bp, Homo sapiens
atttaaaaatgtcttg

SEQ ID NO: 5277335 - DNA, 20 bp, Homo sapiens
atttaaaaattaaagcagca

SEQ ID NO: 5277336 - DNA, 13 bp, Homo sapiens
atttaaaaattgt

SEQ ID NO: 5277337 - DNA, 18 bp, Homo sapiens
atttaaaacaacttgttt

SEQ ID NO: 5277338 - DNA, 22 bp, Homo sapiens
atttaaaacaagctgatagtgt

SEQ ID NO: 5277339 - DNA, 20 bp, Homo sapiens
atttaaaacaatccttacta

SEQ ID NO: 5277340 - DNA, 17 bp, Homo sapiens
atttaaaacagacactg

SEQ ID NO: 5277341 - DNA, 13 bp, Homo sapiens
atttaaaacatgt

SEQ ID NO: 5277342 - DNA, 14 bp, Homo sapiens
atttaaaacatgta

SEQ ID NO: 5277343 - DNA, 13 bp, Homo sapiens
atttaaaacatta

SEQ ID NO: 5277344 - DNA, 14 bp, Homo sapiens
atttaaaacatttc

SEQ ID NO: 5277345 - DNA, 15 bp, Homo sapiens
atttaaaacatttca

SEQ ID NO: 5277346 - DNA, 18 bp, Homo sapiens
atttaaaacatttcatgt

SEQ ID NO: 5277347 - DNA, 21 bp, Homo sapiens
atttaaaactgggtcatcatt

SEQ ID NO: 5277348 - DNA, 19 bp, Homo sapiens
atttaaaacttttgtttaa

SEQ ID NO: 5277349 - DNA, 18 bp, Homo sapiens
atttaaaagattcatttt

SEQ ID NO: 5277350 - DNA, 14 bp, Homo sapiens
atttaaaagatttt

SEQ ID NO: 5277351 - DNA, 23 bp, Homo sapiens
atttaaaataaagaggagtgtta

SEQ ID NO: 5277352 - DNA, 11 bp, Homo sapiens
atttaaaatag

SEQ ID NO: 5277353 - DNA, 15 bp, Homo sapiens
atttaaaatagcaaa

SEQ ID NO: 5277354 - DNA, 20 bp, Homo sapiens
atttaaaatagcaaaagaag

SEQ ID NO: 5277355 - DNA, 22 bp, Homo sapiens
atttaaaatagcaaaagaagaa

SEQ ID NO: 5277356 - DNA, 21 bp, Homo sapiens
atttaaaatagttttctaaat

SEQ ID NO: 5277357 - DNA, 21 bp, Homo sapiens
atttaaaatcattcaatatct

SEQ ID NO: 5277358 - DNA, 13 bp, Homo sapiens
atttaaaatgatt

SEQ ID NO: 5277359 - DNA, 20 bp, Homo sapiens
atttaaaatgctcaatttca

SEQ ID NO: 5277360 - DNA, 14 bp, Homo sapiens
atttaaaatgtagt

SEQ ID NO: 5277361 - DNA, 18 bp, Homo sapiens
atttaaaatgtgtgccat

SEQ ID NO: 5277362 - DNA, 14 bp, Homo sapiens
atttaaaattaaat

SEQ ID NO: 5277363 - DNA, 19 bp, Homo sapiens
atttaaaattaagtagaac

SEQ ID NO: 5277364 - DNA, 12 bp, Homo sapiens
atttaaaattca

SEQ ID NO: 5277365 - DNA, 14 bp, Homo sapiens
atttaaaattccat

SEQ ID NO: 5277366 - DNA, 19 bp, Homo sapiens
atttaaaattccattatct

SEQ ID NO: 5277367 - DNA, 11 bp, Homo sapiens
atttaaaattg

SEQ ID NO: 5277368 - DNA, 20 bp, Homo sapiens
atttaaaattgtgatgtgtc

SEQ ID NO: 5277369 - DNA, 15 bp, Homo sapiens
atttaaacaaacaaa

SEQ ID NO: 5277370 - DNA, 14 bp, Homo sapiens
atttaaacaaatgt

SEQ ID NO: 5277371 - DNA, 19 bp, Homo sapiens
atttaaacaaatgtgtaat

SEQ ID NO: 5277372 - DNA, 20 bp, Homo sapiens
atttaaacagcagtgttccc

SEQ ID NO: 5277373 - DNA, 16 bp, Homo sapiens
atttaaacatgcagaa

SEQ ID NO: 5277374 - DNA, 13 bp, Homo sapiens
atttaaaccagca

SEQ ID NO: 5277375 - DNA, 14 bp, Homo sapiens
atttaaaccagcag

SEQ ID NO: 5277376 - DNA, 16 bp, Homo sapiens
atttaaaccagcagaa

SEQ ID NO: 5277377 - DNA, 18 bp, Homo sapiens
atttaaaccagcagaaaa

SEQ ID NO: 5277378 - DNA, 21 bp, Homo sapiens
atttaaaccagcagaaaagtg

SEQ ID NO: 5277379 - DNA, 14 bp, Homo sapiens
atttaaacccattt

SEQ ID NO: 5277380 - DNA, 18 bp, Homo sapiens
atttaaaccgctaaaaga

SEQ ID NO: 5277381 - DNA, 20 bp, Homo sapiens
atttaaaccgctaaaagaaa

SEQ ID NO: 5277382 - DNA, 23 bp, Homo sapiens
atttaaaccgctaaaagaaactt

SEQ ID NO: 5277383 - DNA, 12 bp, Homo sapiens
atttaaactata

SEQ ID NO: 5277384 - DNA, 22 bp, Homo sapiens
atttaaactattcagaggaaaa

SEQ ID NO: 5277385 - DNA, 18 bp, Homo sapiens
atttaaactccagcattt

SEQ ID NO: 5277386 - DNA, 15 bp, Homo sapiens
atttaaactctgaat

SEQ ID NO: 5277387 - DNA, 13 bp, Homo sapiens
atttaaactctgc

SEQ ID NO: 5277388 - DNA, 15 bp, Homo sapiens
atttaaactctgcca

SEQ ID NO: 5277389 - DNA, 19 bp, Homo sapiens
atttaaactctgccagaaa

SEQ ID NO: 5277390 - DNA, 23 bp, Homo sapiens
atttaaactgcaatgccagtcct

SEQ ID NO: 5277391 - DNA, 12 bp, Homo sapiens
atttaaactttt

SEQ ID NO: 5277392 - DNA, 18 bp, Homo sapiens
atttaaagaaaaaaatgt

SEQ ID NO: 5277393 - DNA, 19 bp, Homo sapiens
atttaaagaaaaaaatgtc

SEQ ID NO: 5277394 - DNA, 23 bp, Homo sapiens
atttaaagaaatatgtattctgt

SEQ ID NO: 5277395 - DNA, 13 bp, Homo sapiens
atttaaagatatt

SEQ ID NO: 5277396 - DNA, 16 bp, Homo sapiens
atttaaagatctttta

SEQ ID NO: 5277397 - DNA, 12 bp, Homo sapiens
atttaaagcaca

SEQ ID NO: 5277398 - DNA, 21 bp, Homo sapiens
atttaaagcattgctgttatg

SEQ ID NO: 5277399 - DNA, 15 bp, Homo sapiens
atttaaagctaaatt

SEQ ID NO: 5277400 - DNA, 17 bp, Homo sapiens
atttaaagctaaatttt

SEQ ID NO: 5277401 - DNA, 21 bp, Homo sapiens
atttaaaggaaagttctatta

SEQ ID NO: 5277402 - DNA, 18 bp, Homo sapiens
atttaaaggcagacagtt

SEQ ID NO: 5277403 - DNA, 20 bp, Homo sapiens
atttaaaggccctatctgtt

SEQ ID NO: 5277404 - DNA, 21 bp, Homo sapiens
atttaaaggccctatctgttt

SEQ ID NO: 5277405 - DNA, 13 bp, Homo sapiens
atttaaagggaat

SEQ ID NO: 5277406 - DNA, 19 bp, Homo sapiens
atttaaagggaatgacttt

SEQ ID NO: 5277407 - DNA, 14 bp, Homo sapiens
atttaaagtatttt

SEQ ID NO: 5277408 - DNA, 20 bp, Homo sapiens
atttaaagtgccttatcaaa

SEQ ID NO: 5277409 - DNA, 21 bp, Homo sapiens
atttaaagtgccttatcaaat

SEQ ID NO: 5277410 - DNA, 22 bp, Homo sapiens
atttaaagtgccttatcaaata

SEQ ID NO: 5277411 - DNA, 23 bp, Homo sapiens
atttaaagttgtatcttgacaca

SEQ ID NO: 5277412 - DNA, 14 bp, Homo sapiens
atttaaagttgttt

SEQ ID NO: 5277413 - DNA, 21 bp, Homo sapiens
atttaaataaaactttccaaa

SEQ ID NO: 5277414 - DNA, 19 bp, Homo sapiens
atttaaatagataaccaat

SEQ ID NO: 5277415 - DNA, 19 bp, Homo sapiens
atttaaatataattctgta

SEQ ID NO: 5277416 - DNA, 16 bp, Homo sapiens
atttaaatatctgtta

SEQ ID NO: 5277417 - DNA, 22 bp, Homo sapiens
atttaaatattaccctccaagt

SEQ ID NO: 5277418 - DNA, 20 bp, Homo sapiens
atttaaatcagactagagaa

SEQ ID NO: 5277419 - DNA, 21 bp, Homo sapiens
atttaaatcattttaacttct

SEQ ID NO: 5277420 - DNA, 13 bp, Homo sapiens
atttaaatctgtt

SEQ ID NO: 5277421 - DNA, 15 bp, Homo sapiens
atttaaatgaaagga

SEQ ID NO: 5277422 - DNA, 17 bp, Homo sapiens
atttaaatgatatttag

SEQ ID NO: 5277423 - DNA, 13 bp, Homo sapiens
atttaaatgattt

SEQ ID NO: 5277424 - DNA, 23 bp, Homo sapiens
atttaaatgcatgtcttaaatgc

SEQ ID NO: 5277425 - DNA, 22 bp, Homo sapiens
atttaaatgcttttaaatctgc

SEQ ID NO: 5277426 - DNA, 18 bp, Homo sapiens
atttaaatgtacttatat

SEQ ID NO: 5277427 - DNA, 17 bp, Homo sapiens
atttaaatgtctaatgt

SEQ ID NO: 5277428 - DNA, 22 bp, Homo sapiens
atttaaatgttgaaatcttaaa

SEQ ID NO: 5277429 - DNA, 14 bp, Homo sapiens
atttaaatgtttaa

SEQ ID NO: 5277430 - DNA, 16 bp, Homo sapiens
atttaaatgtttacta

SEQ ID NO: 5277431 - DNA, 21 bp, Homo sapiens
atttaaattacaattttatct

SEQ ID NO: 5277432 - DNA, 12 bp, Homo sapiens
atttaaattata

SEQ ID NO: 5277433 - DNA, 14 bp, Homo sapiens
atttaaattccaca

SEQ ID NO: 5277434 - DNA, 14 bp, Homo sapiens
atttaaattctttt

SEQ ID NO: 5277435 - DNA, 17 bp, Homo sapiens
atttaaatttaaagata

SEQ ID NO: 5277436 - DNA, 18 bp, Homo sapiens
atttaaatttaaagatat

SEQ ID NO: 5277437 - DNA, 18 bp, Homo sapiens
atttaaatttagtgctca

SEQ ID NO: 5277438 - DNA, 12 bp, Homo sapiens
atttaaatttga

SEQ ID NO: 5277439 - DNA, 22 bp, Homo sapiens
atttaaatttgatttccatctt

SEQ ID NO: 5277440 - DNA, 16 bp, Homo sapiens
atttaaattttcacct

SEQ ID NO: 5277441 - DNA, 17 bp, Homo sapiens
atttaaatttttttcct

SEQ ID NO: 5277442 - DNA, 18 bp, Homo sapiens
atttaacaaaaaatgtaa

SEQ ID NO: 5277443 - DNA, 19 bp, Homo sapiens
atttaacaaaaaatgtaat

SEQ ID NO: 5277444 - DNA, 15 bp, Homo sapiens
atttaacaaactaaa

SEQ ID NO: 5277445 - DNA, 21 bp, Homo sapiens
atttaacaaatacattcataa

SEQ ID NO: 5277446 - DNA, 13 bp, Homo sapiens
atttaacaatgac

SEQ ID NO: 5277447 - DNA, 21 bp, Homo sapiens
atttaacaatgacaagatgtt

SEQ ID NO: 5277448 - DNA, 15 bp, Homo sapiens
atttaacactaaaaa

SEQ ID NO: 5277449 - DNA, 20 bp, Homo sapiens
atttaacactgagtgaaata

SEQ ID NO: 5277450 - DNA, 14 bp, Homo sapiens
atttaacagaaatt

SEQ ID NO: 5277451 - DNA, 14 bp, Homo sapiens
atttaacagaagtt

SEQ ID NO: 5277452 - DNA, 16 bp, Homo sapiens
atttaacagaagttgt

SEQ ID NO: 5277453 - DNA, 22 bp, Homo sapiens
atttaacagataaagaaactga

SEQ ID NO: 5277454 - DNA, 18 bp, Homo sapiens
atttaacagcatgacaaa

SEQ ID NO: 5277455 - DNA, 21 bp, Homo sapiens
atttaacagctgaattatcta

SEQ ID NO: 5277456 - DNA, 22 bp, Homo sapiens
atttaacagctgaattatctat

SEQ ID NO: 5277457 - DNA, 22 bp, Homo sapiens
atttaacatcactacaaaaaga

SEQ ID NO: 5277458 - DNA, 12 bp, Homo sapiens
atttaacatctg

SEQ ID NO: 5277459 - DNA, 22 bp, Homo sapiens
atttaacatgcaacccgaaggt

SEQ ID NO: 5277460 - DNA, 15 bp, Homo sapiens
atttaacattattta

SEQ ID NO: 5277461 - DNA, 16 bp, Homo sapiens
atttaacattcttggt

SEQ ID NO: 5277462 - DNA, 13 bp, Homo sapiens
atttaacattgtt

SEQ ID NO: 5277463 - DNA, 14 bp, Homo sapiens
atttaacattgttt

SEQ ID NO: 5277464 - DNA, 14 bp, Homo sapiens
atttaacattttac

SEQ ID NO: 5277465 - DNA, 15 bp, Homo sapiens
atttaacattttaca

SEQ ID NO: 5277466 - DNA, 17 bp, Homo sapiens
atttaacattttacagt

SEQ ID NO: 5277467 - DNA, 18 bp, Homo sapiens
atttaacccattattcct

SEQ ID NO: 5277468 - DNA, 19 bp, Homo sapiens
atttaacccatttgtctct

SEQ ID NO: 5277469 - DNA, 20 bp, Homo sapiens
atttaacccccctgtacaca

SEQ ID NO: 5277470 - DNA, 18 bp, Homo sapiens
atttaacctgttatttct

SEQ ID NO: 5277471 - DNA, 19 bp, Homo sapiens
atttaacctgttatttcta

SEQ ID NO: 5277472 - DNA, 12 bp, Homo sapiens
atttaactaatt

SEQ ID NO: 5277473 - DNA, 21 bp, Homo sapiens
atttaactaatttaaaccagc

SEQ ID NO: 5277474 - DNA, 19 bp, Homo sapiens
atttaactacccttaatta

SEQ ID NO: 5277475 - DNA, 18 bp, Homo sapiens
atttaactactaagaata

SEQ ID NO: 5277476 - DNA, 17 bp, Homo sapiens
atgtttcagctgcagtt

SEQ ID NO: 5277477 - DNA, 23 bp, Homo sapiens
atgtttcagtgaagatgctgtaa

SEQ ID NO: 5277478 - DNA, 15 bp, Homo sapiens
atgtttcatgaagaa

SEQ ID NO: 5277479 - DNA, 13 bp, Homo sapiens
atgtttccaacct

SEQ ID NO: 5277480 - DNA, 15 bp, Homo sapiens
atgtttccaagatgt

SEQ ID NO: 5277481 - DNA, 12 bp, Homo sapiens
atgtttccactg

SEQ ID NO: 5277482 - DNA, 13 bp, Homo sapiens
atgtttccagaaa

SEQ ID NO: 5277483 - DNA, 14 bp, Homo sapiens
atgtttccagaaaa

SEQ ID NO: 5277484 - DNA, 15 bp, Homo sapiens
atgtttccagaaaat

SEQ ID NO: 5277485 - DNA, 19 bp, Homo sapiens
atgtttccagaaaatataa

SEQ ID NO: 5277486 - DNA, 21 bp, Homo sapiens
atgtttccagaaaatataaat

SEQ ID NO: 5277487 - DNA, 13 bp, Homo sapiens
atgtttccagcag

SEQ ID NO: 5277488 - DNA, 15 bp, Homo sapiens
atgtttccagcattc

SEQ ID NO: 5277489 - DNA, 15 bp, Homo sapiens
atgtttccagctgcc

SEQ ID NO: 5277490 - DNA, 19 bp, Homo sapiens
atgtttccatcttcagttt

SEQ ID NO: 5277491 - DNA, 22 bp, Homo sapiens
atgtttccatggttaccatggg

SEQ ID NO: 5277492 - DNA, 16 bp, Homo sapiens
atgtttccccatctct

SEQ ID NO: 5277493 - DNA, 17 bp, Homo sapiens
atgtttccccatctctg

SEQ ID NO: 5277494 - DNA, 19 bp, Homo sapiens
atgtttccccatctctgtc

SEQ ID NO: 5277495 - DNA, 21 bp, Homo sapiens
atgtttccccatctctgtctg

SEQ ID NO: 5277496 - DNA, 15 bp, Homo sapiens
atgtttccctctcct

SEQ ID NO: 5277497 - DNA, 18 bp, Homo sapiens
atgtttccctctccttcc

SEQ ID NO: 5277498 - DNA, 22 bp, Homo sapiens
atgtttccgaggcactgtttta

SEQ ID NO: 5277499 - DNA, 13 bp, Homo sapiens
atgtttcctggaa

SEQ ID NO: 5277500 - DNA, 14 bp, Homo sapiens
atgtttcctggaag

SEQ ID NO: 5277501 - DNA, 15 bp, Homo sapiens
atgtttcctggaagc

SEQ ID NO: 5277502 - DNA, 12 bp, Homo sapiens
atgtttccttaa

SEQ ID NO: 5277503 - DNA, 15 bp, Homo sapiens
atgtttccttccctc

SEQ ID NO: 5277504 - DNA, 20 bp, Homo sapiens
atgtttcgtgaagtatactg

SEQ ID NO: 5277505 - DNA, 23 bp, Homo sapiens
atgtttcgtgaagtatactgtat

SEQ ID NO: 5277506 - DNA, 13 bp, Homo sapiens
atgtttctaaggt

SEQ ID NO: 5277507 - DNA, 14 bp, Homo sapiens
atgtttctatatgt

SEQ ID NO: 5277508 - DNA, 15 bp, Homo sapiens
atgtttctatatgta

SEQ ID NO: 5277509 - DNA, 17 bp, Homo sapiens
atgtttctcattttaaa

SEQ ID NO: 5277510 - DNA, 23 bp, Homo sapiens
atgtttctcattttaaacaactt

SEQ ID NO: 5277511 - DNA, 17 bp, Homo sapiens
atgtttctgatttctga

SEQ ID NO: 5277512 - DNA, 22 bp, Homo sapiens
atgtttctgcagtagtctctgt

SEQ ID NO: 5277513 - DNA, 15 bp, Homo sapiens
atgtttctgcatagc

SEQ ID NO: 5277514 - DNA, 20 bp, Homo sapiens
atgtttctgcatagcgaaat

SEQ ID NO: 5277515 - DNA, 16 bp, Homo sapiens
atgtttctggacattc

SEQ ID NO: 5277516 - DNA, 18 bp, Homo sapiens
atgtttctggacattctc

SEQ ID NO: 5277517 - DNA, 22 bp, Homo sapiens
atgtttctggacattctctttg

SEQ ID NO: 5277518 - DNA, 12 bp, Homo sapiens
atgtttctggat

SEQ ID NO: 5277519 - DNA, 18 bp, Homo sapiens
atgtttcttaaatgggct

SEQ ID NO: 5277520 - DNA, 14 bp, Homo sapiens
atgtttcttagccc

SEQ ID NO: 5277521 - DNA, 20 bp, Homo sapiens
atgtttcttcatttctctgc

SEQ ID NO: 5277522 - DNA, 22 bp, Homo sapiens
atgtttcttctaggttctaaaa

SEQ ID NO: 5277523 - DNA, 19 bp, Homo sapiens
atgtttcttgccttttgtt

SEQ ID NO: 5277524 - DNA, 21 bp, Homo sapiens
atgtttctttgatcatgaata

SEQ ID NO: 5277525 - DNA, 21 bp, Homo sapiens
atgtttcttttgtatgtaaat

SEQ ID NO: 5277526 - DNA, 16 bp, Homo sapiens
atgtttcttttgtttg

SEQ ID NO: 5277527 - DNA, 21 bp, Homo sapiens
atgtttcttttgtttggtaaa

SEQ ID NO: 5277528 - DNA, 13 bp, Homo sapiens
atgtttctttttc

SEQ ID NO: 5277529 - DNA, 12 bp, Homo sapiens
atgtttgaaatg

SEQ ID NO: 5277530 - DNA, 11 bp, Homo sapiens
atgtttgaata

SEQ ID NO: 5277531 - DNA, 17 bp, Homo sapiens
atgtttgaatatggaca

SEQ ID NO: 5277532 - DNA, 23 bp, Homo sapiens
atgtttgagcagtggcctacaaa

SEQ ID NO: 5277533 - DNA, 18 bp, Homo sapiens
atgtttgaggagcatgtt

SEQ ID NO: 5277534 - DNA, 21 bp, Homo sapiens
atgtttgatagattttctgct

SEQ ID NO: 5277535 - DNA, 12 bp, Homo sapiens
atgtttgatgtc

SEQ ID NO: 5277536 - DNA, 15 bp, Homo sapiens
atgtttgatttagta

SEQ ID NO: 5277537 - DNA, 21 bp, Homo sapiens
atgtttgcacctttctagttg

SEQ ID NO: 5277538 - DNA, 22 bp, Homo sapiens
atgtttgcacctttctagttga

SEQ ID NO: 5277539 - DNA, 13 bp, Homo sapiens
atgtttgcatata

SEQ ID NO: 5277540 - DNA, 16 bp, Homo sapiens
atgtttgcattaaatg

SEQ ID NO: 5277541 - DNA, 17 bp, Homo sapiens
atgtttgccatttgctg

SEQ ID NO: 5277542 - DNA, 22 bp, Homo sapiens
atgtttgccctgttcaaagtac

SEQ ID NO: 5277543 - DNA, 16 bp, Homo sapiens
atgtttgctcagaaca

SEQ ID NO: 5277544 - DNA, 14 bp, Homo sapiens
atgtttggaaaata

SEQ ID NO: 5277545 - DNA, 22 bp, Homo sapiens
atgtttggaaaccacagtcagt

SEQ ID NO: 5277546 - DNA, 13 bp, Homo sapiens
atgtttggaattt

SEQ ID NO: 5277547 - DNA, 14 bp, Homo sapiens
atgtttggatggtt

SEQ ID NO: 5277548 - DNA, 17 bp, Homo sapiens
atgtttggattctctta

SEQ ID NO: 5277549 - DNA, 16 bp, Homo sapiens
atgtttggcatgtaaa

SEQ ID NO: 5277550 - DNA, 19 bp, Homo sapiens
atgtttggctctgctttta

SEQ ID NO: 5277551 - DNA, 23 bp, Homo sapiens
atgtttgggagactgctgagtca

SEQ ID NO: 5277552 - DNA, 20 bp, Homo sapiens
atgtttgggggaaaaaaaag

SEQ ID NO: 5277553 - DNA, 15 bp, Homo sapiens
atgtttgtaactttt

SEQ ID NO: 5277554 - DNA, 22 bp, Homo sapiens
atgtttgtactagttgatgaag

SEQ ID NO: 5277555 - DNA, 22 bp, Homo sapiens
atgtttgtacttttgtgttact

SEQ ID NO: 5277556 - DNA, 23 bp, Homo sapiens
atgtttgtcctgaacacttttgt

SEQ ID NO: 5277557 - DNA, 14 bp, Homo sapiens
atgtttgtctcact

SEQ ID NO: 5277558 - DNA, 20 bp, Homo sapiens
atgtttgtctcagttggaaa

SEQ ID NO: 5277559 - DNA, 21 bp, Homo sapiens
atgtttgtgatattaaatttc

SEQ ID NO: 5277560 - DNA, 19 bp, Homo sapiens
atgtttgtgcagtaacttg

SEQ ID NO: 5277561 - DNA, 22 bp, Homo sapiens
atgtttgtgcagtaacttggga

SEQ ID NO: 5277562 - DNA, 13 bp, Homo sapiens
atgtttgtgcctt

SEQ ID NO: 5277563 - DNA, 15 bp, Homo sapiens
atgtttgtgctctgt

SEQ ID NO: 5277564 - DNA, 14 bp, Homo sapiens
atgtttgtgctgca

SEQ ID NO: 5277565 - DNA, 18 bp, Homo sapiens
atgtttgtggcctcagaa

SEQ ID NO: 5277566 - DNA, 18 bp, Homo sapiens
atgtttgtgggtatttct

SEQ ID NO: 5277567 - DNA, 15 bp, Homo sapiens
atgtttgtgtctgtg

SEQ ID NO: 5277568 - DNA, 15 bp, Homo sapiens
atgtttgtgtgattt

SEQ ID NO: 5277569 - DNA, 14 bp, Homo sapiens
atgtttgttaaaaa

SEQ ID NO: 5277570 - DNA, 16 bp, Homo sapiens
atgtttgtttcagtgc

SEQ ID NO: 5277571 - DNA, 20 bp, Homo sapiens
atgtttgttttcaaaatact

SEQ ID NO: 5277572 - DNA, 15 bp, Homo sapiens
atgttttaaaataat

SEQ ID NO: 5277573 - DNA, 14 bp, Homo sapiens
atgttttaaacaca

SEQ ID NO: 5277574 - DNA, 21 bp, Homo sapiens
atgttttaaacatagaaagtt

SEQ ID NO: 5277575 - DNA, 12 bp, Homo sapiens
atgttttaaaga

SEQ ID NO: 5277576 - DNA, 13 bp, Homo sapiens
atgttttaaagaa

SEQ ID NO: 5277577 - DNA, 22 bp, Homo sapiens
atgttttaaagaatatgacttt

SEQ ID NO: 5277578 - DNA, 18 bp, Homo sapiens
atgttttaaagttaaaac

SEQ ID NO: 5277579 - DNA, 15 bp, Homo sapiens
atgttttaaatgtac

SEQ ID NO: 5277580 - DNA, 10 bp, Homo sapiens
atgttttaac

SEQ ID NO: 5277581 - DNA, 13 bp, Homo sapiens
atgttttaacaaa

SEQ ID NO: 5277582 - DNA, 22 bp, Homo sapiens
atgttttaacttatttatatga

SEQ ID NO: 5277583 - DNA, 23 bp, Homo sapiens
atgttttaacttatttatatgaa

SEQ ID NO: 5277584 - DNA, 14 bp, Homo sapiens
atgttttaattcca

SEQ ID NO: 5277585 - DNA, 15 bp, Homo sapiens
atgttttaattccat

SEQ ID NO: 5277586 - DNA, 17 bp, Homo sapiens
atgttttaattccatga

SEQ ID NO: 5277587 - DNA, 18 bp, Homo sapiens
atgttttaattccatgaa

SEQ ID NO: 5277588 - DNA, 23 bp, Homo sapiens
atgttttacaaagaaacaaaata

SEQ ID NO: 5277589 - DNA, 12 bp, Homo sapiens
atgttttacaac

SEQ ID NO: 5277590 - DNA, 14 bp, Homo sapiens
atgttttacactgt

SEQ ID NO: 5277591 - DNA, 17 bp, Homo sapiens
atgttttacgtgcaaac

SEQ ID NO: 5277592 - DNA, 19 bp, Homo sapiens
atgttttagacaaatactc

SEQ ID NO: 5277593 - DNA, 22 bp, Homo sapiens
atgttttagacaaatactcatg

SEQ ID NO: 5277594 - DNA, 11 bp, Homo sapiens
atgttttagag

SEQ ID NO: 5277595 - DNA, 12 bp, Homo sapiens
atgttttagaga

SEQ ID NO: 5277596 - DNA, 20 bp, Homo sapiens
atgttttagagataaatatt

SEQ ID NO: 5277597 - DNA, 14 bp, Homo sapiens
atgttttagagtta

SEQ ID NO: 5277598 - DNA, 13 bp, Homo sapiens
atgttttagcatt

SEQ ID NO: 5277599 - DNA, 24 bp, Homo sapiens
atgttttagcatttgtataaagaa

SEQ ID NO: 5277600 - DNA, 15 bp, Homo sapiens
atgttttagcatttt

SEQ ID NO: 5277601 - DNA, 22 bp, Homo sapiens
atgttttagggacccccaacct

SEQ ID NO: 5277602 - DNA, 23 bp, Homo sapiens
atgttttagggagtggttcctgt

SEQ ID NO: 5277603 - DNA, 16 bp, Homo sapiens
atgttttataagttca

SEQ ID NO: 5277604 - DNA, 17 bp, Homo sapiens
atgttttatatagcaag

SEQ ID NO: 5277605 - DNA, 16 bp, Homo sapiens
atgttttatatgatta

SEQ ID NO: 5277606 - DNA, 13 bp, Homo sapiens
atgttttatcctt

SEQ ID NO: 5277607 - DNA, 14 bp, Homo sapiens
atgttttatttatc

SEQ ID NO: 5277608 - DNA, 19 bp, Homo sapiens
atgttttatttatgaagtt

SEQ ID NO: 5277609 - DNA, 22 bp, Homo sapiens
atgttttcaaaaggtattatac

SEQ ID NO: 5277610 - DNA, 15 bp, Homo sapiens
atgttttcaaatgtt

SEQ ID NO: 5277611 - DNA, 15 bp, Homo sapiens
atgttttcaggtgtc

SEQ ID NO: 5277612 - DNA, 17 bp, Homo sapiens
atgttttcattatgttc

SEQ ID NO: 5277613 - DNA, 12 bp, Homo sapiens
atgttttcattg

SEQ ID NO: 5277614 - DNA, 17 bp, Homo sapiens
atgttttcattgggaaa

SEQ ID NO: 5277615 - DNA, 21 bp, Homo sapiens
atgttttccaatattttaata

SEQ ID NO: 5277616 - DNA, 17 bp, Homo sapiens
atgttttccacataaat

SEQ ID NO: 5277617 - DNA, 21 bp, Homo sapiens
atgttttccacataaatttta

SEQ ID NO: 5277618 - DNA, 23 bp, Homo sapiens
atgttttccacataaattttaat

SEQ ID NO: 5277619 - DNA, 18 bp, Homo sapiens
atgttttccagctcctca

SEQ ID NO: 5277620 - DNA, 23 bp, Homo sapiens
atgttttcgaaaatcaaatggta

SEQ ID NO: 5277621 - DNA, 14 bp, Homo sapiens
atgttttctgcaga

SEQ ID NO: 5277622 - DNA, 20 bp, Homo sapiens
atgttttctgcagaaaaaaa

SEQ ID NO: 5277623 - DNA, 18 bp, Homo sapiens
atgttttctgctgtttaa

SEQ ID NO: 5277624 - DNA, 17 bp, Homo sapiens
atgttttctgctttaaa

SEQ ID NO: 5277625 - DNA, 14 bp, Homo sapiens
atgttttcttcaac

SEQ ID NO: 5277626 - DNA, 18 bp, Homo sapiens
atgttttctttgcaaagt

SEQ ID NO: 5277627 - DNA, 18 bp, Homo sapiens
atgttttctttgctttaa

SEQ ID NO: 5277628 - DNA, 16 bp, Homo sapiens
atgttttctttgtttc

SEQ ID NO: 5277629 - DNA, 13 bp, Homo sapiens
atgttttgacaca

SEQ ID NO: 5277630 - DNA, 16 bp, Homo sapiens
atgttttgacattttt

SEQ ID NO: 5277631 - DNA, 15 bp, Homo sapiens
atgttttgagaaaaa

SEQ ID NO: 5277632 - DNA, 21 bp, Homo sapiens
atgttttgataaagtagtaaa

SEQ ID NO: 5277633 - DNA, 22 bp, Homo sapiens
atgttttgcaaaggaaaataat

SEQ ID NO: 5277634 - DNA, 13 bp, Homo sapiens
atgttttgctaat

SEQ ID NO: 5277635 - DNA, 14 bp, Homo sapiens
atgttttggaattc

SEQ ID NO: 5277636 - DNA, 23 bp, Homo sapiens
atgttttggccaatgcacctaaa

SEQ ID NO: 5277637 - DNA, 22 bp, Homo sapiens
atgttttggtagattaaatata

SEQ ID NO: 5277638 - DNA, 17 bp, Homo sapiens
atgttttggtatctgtt

SEQ ID NO: 5277639 - DNA, 23 bp, Homo sapiens
atgttttggtccacttttccagt

SEQ ID NO: 5277640 - DNA, 22 bp, Homo sapiens
atgttttggtctgaaaagctgt

SEQ ID NO: 5277641 - DNA, 11 bp, Homo sapiens
atgttttggtg

SEQ ID NO: 5277642 - DNA, 17 bp, Homo sapiens
atgttttgtaaacattt

SEQ ID NO: 5277643 - DNA, 18 bp, Homo sapiens
atgttttgtaaactttga

SEQ ID NO: 5277644 - DNA, 20 bp, Homo sapiens
atgttttgtaaactttgaaa

SEQ ID NO: 5277645 - DNA, 19 bp, Homo sapiens
atgttttgtacaattacta

SEQ ID NO: 5277646 - DNA, 20 bp, Homo sapiens
atgttttgtataaaatctga

SEQ ID NO: 5277647 - DNA, 15 bp, Homo sapiens
atgttttgtatacaa

SEQ ID NO: 5277648 - DNA, 16 bp, Homo sapiens
atgttttgtatacaaa

SEQ ID NO: 5277649 - DNA, 23 bp, Homo sapiens
atgttttgtattatttcaccagc

SEQ ID NO: 5277650 - DNA, 21 bp, Homo sapiens
atgttttgtcccatttccttg

SEQ ID NO: 5277651 - DNA, 16 bp, Homo sapiens
atgttttgtgcatttg

SEQ ID NO: 5277652 - DNA, 18 bp, Homo sapiens
atgttttgtgggaacaga

SEQ ID NO: 5277653 - DNA, 20 bp, Homo sapiens
atgttttgtttctgaaaatt

SEQ ID NO: 5277654 - DNA, 21 bp, Homo sapiens
atgttttgtttctgaaaattc

SEQ ID NO: 5277655 - DNA, 12 bp, Homo sapiens
atttaactccat

SEQ ID NO: 5277656 - DNA, 12 bp, Homo sapiens
atttaactcttt

SEQ ID NO: 5277657 - DNA, 18 bp, Homo sapiens
atttaactgaactgtgaa

SEQ ID NO: 5277658 - DNA, 15 bp, Homo sapiens
atttaactgcatata

SEQ ID NO: 5277659 - DNA, 18 bp, Homo sapiens
atttaactgcatatagat

SEQ ID NO: 5277660 - DNA, 21 bp, Homo sapiens
atttaactgcctaaaatgttc

SEQ ID NO: 5277661 - DNA, 20 bp, Homo sapiens
atttaactgggaaccccttc

SEQ ID NO: 5277662 - DNA, 21 bp, Homo sapiens
atttaactggtgcactttgta

SEQ ID NO: 5277663 - DNA, 15 bp, Homo sapiens
atttaacttacattt

SEQ ID NO: 5277664 - DNA, 16 bp, Homo sapiens
atttaacttacatttg

SEQ ID NO: 5277665 - DNA, 13 bp, Homo sapiens
atttaacttgagc

SEQ ID NO: 5277666 - DNA, 19 bp, Homo sapiens
atttaacttgagctttaaa

SEQ ID NO: 5277667 - DNA, 20 bp, Homo sapiens
atttaacttgagggtaataa

SEQ ID NO: 5277668 - DNA, 23 bp, Homo sapiens
atttaacttgagggtaataaact

SEQ ID NO: 5277669 - DNA, 13 bp, Homo sapiens
atttaactttata

SEQ ID NO: 5277670 - DNA, 16 bp, Homo sapiens
atttaactttgcaaaa

SEQ ID NO: 5277671 - DNA, 16 bp, Homo sapiens
atttaacttttaaaga

SEQ ID NO: 5277672 - DNA, 17 bp, Homo sapiens
atttaacttttagtaaa

SEQ ID NO: 5277673 - DNA, 21 bp, Homo sapiens
atttaacttttagtaaagtca

SEQ ID NO: 5277674 - DNA, 23 bp, Homo sapiens
atttaacttttcttttggacttt

SEQ ID NO: 5277675 - DNA, 12 bp, Homo sapiens
atttaacttttt

SEQ ID NO: 5277676 - DNA, 22 bp, Homo sapiens
atttaagaaaaacaaaatgtta

SEQ ID NO: 5277677 - DNA, 16 bp, Homo sapiens
atttaagaaaagcact

SEQ ID NO: 5277678 - DNA, 18 bp, Homo sapiens
atttaagaaaagcacttt

SEQ ID NO: 5277679 - DNA, 14 bp, Homo sapiens
atttaagaagaatg

SEQ ID NO: 5277680 - DNA, 20 bp, Homo sapiens
atttaagacaagttcaacaa

SEQ ID NO: 5277681 - DNA, 15 bp, Homo sapiens
atttaagacactgaa

SEQ ID NO: 5277682 - DNA, 16 bp, Homo sapiens
atttaagacactgaaa

SEQ ID NO: 5277683 - DNA, 12 bp, Homo sapiens
atttaagacata

SEQ ID NO: 5277684 - DNA, 21 bp, Homo sapiens
atttaagacataaacaaagac

SEQ ID NO: 5277685 - DNA, 12 bp, Homo sapiens
atttaagactga

SEQ ID NO: 5277686 - DNA, 23 bp, Homo sapiens
atttaagagaagacctagctatg

SEQ ID NO: 5277687 - DNA, 19 bp, Homo sapiens
atttaagagatacttgatg

SEQ ID NO: 5277688 - DNA, 15 bp, Homo sapiens
atttaagataattat

SEQ ID NO: 5277689 - DNA, 16 bp, Homo sapiens
atttaagatacaaata

SEQ ID NO: 5277690 - DNA, 15 bp, Homo sapiens
atttaagatagtttt

SEQ ID NO: 5277691 - DNA, 13 bp, Homo sapiens
atttaagatatat

SEQ ID NO: 5277692 - DNA, 15 bp, Homo sapiens
atttaagatatgtaa

SEQ ID NO: 5277693 - DNA, 22 bp, Homo sapiens
atttaagatgtacatttaataa

SEQ ID NO: 5277694 - DNA, 13 bp, Homo sapiens
atttaagatgtga

SEQ ID NO: 5277695 - DNA, 21 bp, Homo sapiens
atttaagcaaaggctccctcg

SEQ ID NO: 5277696 - DNA, 16 bp, Homo sapiens
atttaagcaaatactt

SEQ ID NO: 5277697 - DNA, 22 bp, Homo sapiens
atttaagcaaatacttagcaaa

SEQ ID NO: 5277698 - DNA, 15 bp, Homo sapiens
atttaagcacaaact

SEQ ID NO: 5277699 - DNA, 21 bp, Homo sapiens
atttaagcataatctgaaaac

SEQ ID NO: 5277700 - DNA, 13 bp, Homo sapiens
atttaagcattgt

SEQ ID NO: 5277701 - DNA, 15 bp, Homo sapiens
atttaagcattgttt

SEQ ID NO: 5277702 - DNA, 15 bp, Homo sapiens
atttaagcattttac

SEQ ID NO: 5277703 - DNA, 10 bp, Homo sapiens
atttaagccc

SEQ ID NO: 5277704 - DNA, 15 bp, Homo sapiens
atttaagcctaaaga

SEQ ID NO: 5277705 - DNA, 22 bp, Homo sapiens
atttaagcctaaagattttgat

SEQ ID NO: 5277706 - DNA, 17 bp, Homo sapiens
atttaagcctcatattt

SEQ ID NO: 5277707 - DNA, 21 bp, Homo sapiens
atttaagcctcatatttaaag

SEQ ID NO: 5277708 - DNA, 18 bp, Homo sapiens
atttaagccttacaaagg

SEQ ID NO: 5277709 - DNA, 20 bp, Homo sapiens
atttaagccttacaaaggga

SEQ ID NO: 5277710 - DNA, 22 bp, Homo sapiens
atttaagccttataaaccaatc

SEQ ID NO: 5277711 - DNA, 17 bp, Homo sapiens
atttaagccttgacaca

SEQ ID NO: 5277712 - DNA, 22 bp, Homo sapiens
atttaagccttgacacactgtg

SEQ ID NO: 5277713 - DNA, 22 bp, Homo sapiens
atttaagctgtaaattacataa

SEQ ID NO: 5277714 - DNA, 22 bp, Homo sapiens
atttaagctttaaatgacagta

SEQ ID NO: 5277715 - DNA, 18 bp, Homo sapiens
atttaaggaatcaaatct

SEQ ID NO: 5277716 - DNA, 20 bp, Homo sapiens
atttaaggaatcaaatctta

SEQ ID NO: 5277717 - DNA, 14 bp, Homo sapiens
atttaaggatggat

SEQ ID NO: 5277718 - DNA, 18 bp, Homo sapiens
atttaaggatggatggca

SEQ ID NO: 5277719 - DNA, 21 bp, Homo sapiens
atttaaggatggatggcaccc

SEQ ID NO: 5277720 - DNA, 12 bp, Homo sapiens
atttaaggcaaa

SEQ ID NO: 5277721 - DNA, 15 bp, Homo sapiens
atttaagggaaaaat

SEQ ID NO: 5277722 - DNA, 20 bp, Homo sapiens
atttaaggtctgtttgctgt

SEQ ID NO: 5277723 - DNA, 15 bp, Homo sapiens
atttaagtactatct

SEQ ID NO: 5277724 - DNA, 16 bp, Homo sapiens
atttaagtactatctt

SEQ ID NO: 5277725 - DNA, 17 bp, Homo sapiens
atttaagtactatcttt

SEQ ID NO: 5277726 - DNA, 21 bp, Homo sapiens
atttaagtactatctttgtct

SEQ ID NO: 5277727 - DNA, 18 bp, Homo sapiens
atttaagtagaaaagttg

SEQ ID NO: 5277728 - DNA, 14 bp, Homo sapiens
atttaagtatatag

SEQ ID NO: 5277729 - DNA, 15 bp, Homo sapiens
atttaagtatcttgt

SEQ ID NO: 5277730 - DNA, 14 bp, Homo sapiens
atttaagtgaagga

SEQ ID NO: 5277731 - DNA, 14 bp, Homo sapiens
atttaagtgacaca

SEQ ID NO: 5277732 - DNA, 18 bp, Homo sapiens
atttaagtgacacagaca

SEQ ID NO: 5277733 - DNA, 19 bp, Homo sapiens
atttaagtgcgtgtgtaga

SEQ ID NO: 5277734 - DNA, 18 bp, Homo sapiens
atttaagtggactgtatt

SEQ ID NO: 5277735 - DNA, 21 bp, Homo sapiens
atttaagtggactgtatttcg

SEQ ID NO: 5277736 - DNA, 20 bp, Homo sapiens
atttaagtggggcaaaacct

SEQ ID NO: 5277737 - DNA, 18 bp, Homo sapiens
atttaagttatcaacttt

SEQ ID NO: 5277738 - DNA, 15 bp, Homo sapiens
atttaagttcctgct

SEQ ID NO: 5277739 - DNA, 22 bp, Homo sapiens
atttaagttcctgctgcctggg

SEQ ID NO: 5277740 - DNA, 19 bp, Homo sapiens
atttaagttgtaaacgtct

SEQ ID NO: 5277741 - DNA, 21 bp, Homo sapiens
atttaagtttgtagtttttgc

SEQ ID NO: 5277742 - DNA, 21 bp, Homo sapiens
atttaagtttgttgctgtcaa

SEQ ID NO: 5277743 - DNA, 16 bp, Homo sapiens
atttaataaaaaaaca

SEQ ID NO: 5277744 - DNA, 17 bp, Homo sapiens
atttaataaaaaggaat

SEQ ID NO: 5277745 - DNA, 14 bp, Homo sapiens
atttaataaaactg

SEQ ID NO: 5277746 - DNA, 19 bp, Homo sapiens
atttaataaaataattcta

SEQ ID NO: 5277747 - DNA, 14 bp, Homo sapiens
atttaataaagaaa

SEQ ID NO: 5277748 - DNA, 18 bp, Homo sapiens
atttaataaagaaatatt

SEQ ID NO: 5277749 - DNA, 16 bp, Homo sapiens
atttaataaatgtgcc

SEQ ID NO: 5277750 - DNA, 16 bp, Homo sapiens
atttaataacaattgt

SEQ ID NO: 5277751 - DNA, 15 bp, Homo sapiens
atttaataacattac

SEQ ID NO: 5277752 - DNA, 17 bp, Homo sapiens
atttaataacattacct

SEQ ID NO: 5277753 - DNA, 23 bp, Homo sapiens
atttaataacattaccttactgt

SEQ ID NO: 5277754 - DNA, 21 bp, Homo sapiens
atttaataactttgctggaaa

SEQ ID NO: 5277755 - DNA, 13 bp, Homo sapiens
atttaataatatc

SEQ ID NO: 5277756 - DNA, 15 bp, Homo sapiens
atttaataatgcttt

SEQ ID NO: 5277757 - DNA, 13 bp, Homo sapiens
atttaatacagca

SEQ ID NO: 5277758 - DNA, 15 bp, Homo sapiens
atttaatacagcagt

SEQ ID NO: 5277759 - DNA, 23 bp, Homo sapiens
atttaataccaccaacaaatata

SEQ ID NO: 5277760 - DNA, 22 bp, Homo sapiens
atttaatagataaagtgcctat

SEQ ID NO: 5277761 - DNA, 15 bp, Homo sapiens
atttaatagtgttaa

SEQ ID NO: 5277762 - DNA, 18 bp, Homo sapiens
atttaatagtgttaatca

SEQ ID NO: 5277763 - DNA, 22 bp, Homo sapiens
atttaatagtgttaatcaattt

SEQ ID NO: 5277764 - DNA, 23 bp, Homo sapiens
atttaatataaagttttatatat

SEQ ID NO: 5277765 - DNA, 12 bp, Homo sapiens
atttaatatcaa

SEQ ID NO: 5277766 - DNA, 18 bp, Homo sapiens
atttaatatgcatctttg

SEQ ID NO: 5277767 - DNA, 14 bp, Homo sapiens
atttaatattacag

SEQ ID NO: 5277768 - DNA, 16 bp, Homo sapiens
atttaatattacagat

SEQ ID NO: 5277769 - DNA, 17 bp, Homo sapiens
atttaatatttctgtgg

SEQ ID NO: 5277770 - DNA, 15 bp, Homo sapiens
atttaatattttgca

SEQ ID NO: 5277771 - DNA, 16 bp, Homo sapiens
atttaatatttttcaa

SEQ ID NO: 5277772 - DNA, 18 bp, Homo sapiens
atttaatatttttcaaaa

SEQ ID NO: 5277773 - DNA, 21 bp, Homo sapiens
atttaatcacagtcatcttta

SEQ ID NO: 5277774 - DNA, 17 bp, Homo sapiens
atttaatccagatctgg

SEQ ID NO: 5277775 - DNA, 16 bp, Homo sapiens
atttaatccattttta

SEQ ID NO: 5277776 - DNA, 18 bp, Homo sapiens
atttaatccttctttgta

SEQ ID NO: 5277777 - DNA, 18 bp, Homo sapiens
atttaatcttttttatgt

SEQ ID NO: 5277778 - DNA, 21 bp, Homo sapiens
atttaatgaaagactgtacaa

SEQ ID NO: 5277779 - DNA, 13 bp, Homo sapiens
atttaatgacttt

SEQ ID NO: 5277780 - DNA, 22 bp, Homo sapiens
atttaatgataagtaaatgcta

SEQ ID NO: 5277781 - DNA, 16 bp, Homo sapiens
atttaatgatgtgtca

SEQ ID NO: 5277782 - DNA, 17 bp, Homo sapiens
atttaatgcattaaacc

SEQ ID NO: 5277783 - DNA, 20 bp, Homo sapiens
atttaatgcattaaacctgt

SEQ ID NO: 5277784 - DNA, 15 bp, Homo sapiens
atttaatgcctgccc

SEQ ID NO: 5277785 - DNA, 16 bp, Homo sapiens
atttaatgcctgccca

SEQ ID NO: 5277786 - DNA, 13 bp, Homo sapiens
atttaatgctgcc

SEQ ID NO: 5277787 - DNA, 20 bp, Homo sapiens
atttaatgcttaaaaatgta

SEQ ID NO: 5277788 - DNA, 22 bp, Homo sapiens
atttaatggaagtgtatttatt

SEQ ID NO: 5277789 - DNA, 19 bp, Homo sapiens
atttaatggactgtgaatt

SEQ ID NO: 5277790 - DNA, 22 bp, Homo sapiens
atttaatggcagctagtgcctt

SEQ ID NO: 5277791 - DNA, 20 bp, Homo sapiens
atttaatggtttttatttct

SEQ ID NO: 5277792 - DNA, 14 bp, Homo sapiens
atttaatgtagcca

SEQ ID NO: 5277793 - DNA, 16 bp, Homo sapiens
atttaatgtagccatg

SEQ ID NO: 5277794 - DNA, 13 bp, Homo sapiens
atttaatgtatta

SEQ ID NO: 5277795 - DNA, 19 bp, Homo sapiens
atttaatgtattaatctgt

SEQ ID NO: 5277796 - DNA, 22 bp, Homo sapiens
atttaatgtcgaggctctattt

SEQ ID NO: 5277797 - DNA, 14 bp, Homo sapiens
atttaatgtgagtt

SEQ ID NO: 5277798 - DNA, 15 bp, Homo sapiens
atttaatgtgagttt

SEQ ID NO: 5277799 - DNA, 16 bp, Homo sapiens
atttaatgtgagtttg

SEQ ID NO: 5277800 - DNA, 14 bp, Homo sapiens
atttaatgttgaac

SEQ ID NO: 5277801 - DNA, 16 bp, Homo sapiens
atttaatgtttgattt

SEQ ID NO: 5277802 - DNA, 12 bp, Homo sapiens
atttaatgtttt

SEQ ID NO: 5277803 - DNA, 21 bp, Homo sapiens
atttaatgttttaaatgtaca

SEQ ID NO: 5277804 - DNA, 21 bp, Homo sapiens
atttaatgttttctgctgttt

SEQ ID NO: 5277805 - DNA, 13 bp, Homo sapiens
atttaattacaaa

SEQ ID NO: 5277806 - DNA, 15 bp, Homo sapiens
atttaattacaaaca

SEQ ID NO: 5277807 - DNA, 18 bp, Homo sapiens
atttaattacaaacaata

SEQ ID NO: 5277808 - DNA, 22 bp, Homo sapiens
atttaattaccttattggatat

SEQ ID NO: 5277809 - DNA, 21 bp, Homo sapiens
atttaattaggaaaaaaacta

SEQ ID NO: 5277810 - DNA, 18 bp, Homo sapiens
atttaattagtgctaagt

SEQ ID NO: 5277811 - DNA, 20 bp, Homo sapiens
atttaattagtgctaagtgt

SEQ ID NO: 5277812 - DNA, 15 bp, Homo sapiens
atttaattataaaaa

SEQ ID NO: 5277813 - DNA, 13 bp, Homo sapiens
atttaattattaa

SEQ ID NO: 5277814 - DNA, 15 bp, Homo sapiens
atttaattattaact

SEQ ID NO: 5277815 - DNA, 20 bp, Homo sapiens
atttaattattaactacatt

SEQ ID NO: 5277816 - DNA, 12 bp, Homo sapiens
atttaattcaga

SEQ ID NO: 5277817 - DNA, 18 bp, Homo sapiens
atttaattcataattaga

SEQ ID NO: 5277818 - DNA, 20 bp, Homo sapiens
atttaattcataattagaac

SEQ ID NO: 5277819 - DNA, 15 bp, Homo sapiens
atttaattctcttga

SEQ ID NO: 5277820 - DNA, 16 bp, Homo sapiens
atttaattctcttgaa

SEQ ID NO: 5277821 - DNA, 14 bp, Homo sapiens
atttaattcttacc

SEQ ID NO: 5277822 - DNA, 23 bp, Homo sapiens
atttaattcttaccgaaatgaaa

SEQ ID NO: 5277823 - DNA, 21 bp, Homo sapiens
atttaattcttcacctttgta

SEQ ID NO: 5277824 - DNA, 14 bp, Homo sapiens
atttaattctttca

SEQ ID NO: 5277825 - DNA, 12 bp, Homo sapiens
atttaattgctt

SEQ ID NO: 5277826 - DNA, 19 bp, Homo sapiens
atttaattgggcactattt

SEQ ID NO: 5277827 - DNA, 14 bp, Homo sapiens
atttaattgtaaac

SEQ ID NO: 5277828 - DNA, 11 bp, Homo sapiens
atttaattgtg

SEQ ID NO: 5277829 - DNA, 16 bp, Homo sapiens
atttaattgtgtaact

SEQ ID NO: 5277830 - DNA, 14 bp, Homo sapiens
atttaatttatgtg

SEQ ID NO: 5277831 - DNA, 15 bp, Homo sapiens
atttaatttatgtga

SEQ ID NO: 5277832 - DNA, 13 bp, Homo sapiens
atttaatttcata

SEQ ID NO: 5277833 - DNA, 15 bp, Homo sapiens
atttaatttcatgta

SEQ ID NO: 5277834 - DNA, 20 bp, Homo sapiens
atttaatttcatgtatatct

SEQ ID NO: 5277835 - DNA, 16 bp, Homo sapiens
atgttttgttttcttg

SEQ ID NO: 5277836 - DNA, 11 bp, Homo sapiens
atgtttttaaa

SEQ ID NO: 5277837 - DNA, 23 bp, Homo sapiens
atgtttttaaaaagagtaatttc

SEQ ID NO: 5277838 - DNA, 17 bp, Homo sapiens
atgtttttaaatatatt

SEQ ID NO: 5277839 - DNA, 11 bp, Homo sapiens
atgtttttaat

SEQ ID NO: 5277840 - DNA, 15 bp, Homo sapiens
atgtttttaataaaa

SEQ ID NO: 5277841 - DNA, 14 bp, Homo sapiens
atgtttttaatgac

SEQ ID NO: 5277842 - DNA, 14 bp, Homo sapiens
atgtttttactgaa

SEQ ID NO: 5277843 - DNA, 18 bp, Homo sapiens
atgtttttactgaatgat

SEQ ID NO: 5277844 - DNA, 20 bp, Homo sapiens
atgtttttactgaatgatct

SEQ ID NO: 5277845 - DNA, 15 bp, Homo sapiens
atgtttttagttctg

SEQ ID NO: 5277846 - DNA, 14 bp, Homo sapiens
atgtttttatacaa

SEQ ID NO: 5277847 - DNA, 16 bp, Homo sapiens
atgtttttatgatatc

SEQ ID NO: 5277848 - DNA, 20 bp, Homo sapiens
atgtttttatgatatccctg

SEQ ID NO: 5277849 - DNA, 20 bp, Homo sapiens
atgtttttattaagattatt

SEQ ID NO: 5277850 - DNA, 14 bp, Homo sapiens
atgtttttatttca

SEQ ID NO: 5277851 - DNA, 17 bp, Homo sapiens
atgtttttatttcaatt

SEQ ID NO: 5277852 - DNA, 18 bp, Homo sapiens
atgtttttatttcaattg

SEQ ID NO: 5277853 - DNA, 19 bp, Homo sapiens
atgtttttcccctgctccc

SEQ ID NO: 5277854 - DNA, 13 bp, Homo sapiens
atgtttttccctc

SEQ ID NO: 5277855 - DNA, 14 bp, Homo sapiens
atgtttttccctcc

SEQ ID NO: 5277856 - DNA, 17 bp, Homo sapiens
atgtttttccctcccca

SEQ ID NO: 5277857 - DNA, 19 bp, Homo sapiens
atgtttttccctccccaga

SEQ ID NO: 5277858 - DNA, 12 bp, Homo sapiens
atgtttttcctt

SEQ ID NO: 5277859 - DNA, 22 bp, Homo sapiens
atgtttttctctataaagggtc

SEQ ID NO: 5277860 - DNA, 21 bp, Homo sapiens
atgtttttctgccagggagct

SEQ ID NO: 5277861 - DNA, 22 bp, Homo sapiens
atgtttttctgccagggagctt

SEQ ID NO: 5277862 - DNA, 18 bp, Homo sapiens
atgtttttctgtgttact

SEQ ID NO: 5277863 - DNA, 17 bp, Homo sapiens
atgtttttcttctccct

SEQ ID NO: 5277864 - DNA, 17 bp, Homo sapiens
atgtttttgaaacagaa

SEQ ID NO: 5277865 - DNA, 14 bp, Homo sapiens
atgtttttgccaaa

SEQ ID NO: 5277866 - DNA, 19 bp, Homo sapiens
atgtttttgttcaaagcca

SEQ ID NO: 5277867 - DNA, 23 bp, Homo sapiens
atgtttttgttttaaaacgtgta

SEQ ID NO: 5277868 - DNA, 16 bp, Homo sapiens
atgtttttgttttgct

SEQ ID NO: 5277869 - DNA, 23 bp, Homo sapiens
atgtttttgttttgctttttaaa

SEQ ID NO: 5277870 - DNA, 14 bp, Homo sapiens
atgttttttcatgg

SEQ ID NO: 5277871 - DNA, 22 bp, Homo sapiens
atgttttttccttttcacattt

SEQ ID NO: 5277872 - DNA, 14 bp, Homo sapiens
atgttttttctgca

SEQ ID NO: 5277873 - DNA, 15 bp, Homo sapiens
atgttttttctgcaa

SEQ ID NO: 5277874 - DNA, 12 bp, Homo sapiens
atgttttttgcc

SEQ ID NO: 5277875 - DNA, 18 bp, Homo sapiens
atgttttttgccacagct

SEQ ID NO: 5277876 - DNA, 19 bp, Homo sapiens
atgttttttgccacagctt

SEQ ID NO: 5277877 - DNA, 21 bp, Homo sapiens
atgttttttgccacagctttt

SEQ ID NO: 5277878 - DNA, 22 bp, Homo sapiens
atgttttttgccacagcttttg

SEQ ID NO: 5277879 - DNA, 13 bp, Homo sapiens
atgtttttttaat

SEQ ID NO: 5277880 - DNA, 18 bp, Homo sapiens
atgtttttttaattaaaa

SEQ ID NO: 5277881 - DNA, 21 bp, Homo sapiens
attaaaaaaaaaaaaaaactc

SEQ ID NO: 5277882 - DNA, 19 bp, Homo sapiens
attaaaaaaaaaaactaga

SEQ ID NO: 5277883 - DNA, 14 bp, Homo sapiens
attaaaaaaaaaga

SEQ ID NO: 5277884 - DNA, 20 bp, Homo sapiens
attaaaaaaaaagatctgtt

SEQ ID NO: 5277885 - DNA, 20 bp, Homo sapiens
attaaaaaaaaatactcttt

SEQ ID NO: 5277886 - DNA, 23 bp, Homo sapiens
attaaaaaaaacaaaaagaacaa

SEQ ID NO: 5277887 - DNA, 15 bp, Homo sapiens
attaaaaaaacacaa

SEQ ID NO: 5277888 - DNA, 17 bp, Homo sapiens
attaaaaaaacacaaaa

SEQ ID NO: 5277889 - DNA, 12 bp, Homo sapiens
attaaaaaacaa

SEQ ID NO: 5277890 - DNA, 18 bp, Homo sapiens
attaaaaaacaattaact

SEQ ID NO: 5277891 - DNA, 23 bp, Homo sapiens
attaaaaaagaaagaaatttgaa

SEQ ID NO: 5277892 - DNA, 13 bp, Homo sapiens
attaaaaaagaga

SEQ ID NO: 5277893 - DNA, 22 bp, Homo sapiens
attaaaaaagagacatccaaat

SEQ ID NO: 5277894 - DNA, 15 bp, Homo sapiens
attaaaaaagataaa

SEQ ID NO: 5277895 - DNA, 16 bp, Homo sapiens
attaaaaaagctgctg

SEQ ID NO: 5277896 - DNA, 17 bp, Homo sapiens
attaaaaaatcaaatca

SEQ ID NO: 5277897 - DNA, 20 bp, Homo sapiens
attaaaaaatcagttgtaca

SEQ ID NO: 5277898 - DNA, 17 bp, Homo sapiens
attaaaaaatttccagt

SEQ ID NO: 5277899 - DNA, 21 bp, Homo sapiens
attaaaaacacctaagtgact

SEQ ID NO: 5277900 - DNA, 22 bp, Homo sapiens
attaaaaacgaaaacctgacta

SEQ ID NO: 5277901 - DNA, 16 bp, Homo sapiens
attaaaaactagtagt

SEQ ID NO: 5277902 - DNA, 19 bp, Homo sapiens
attaaaaactagtagttct

SEQ ID NO: 5277903 - DNA, 16 bp, Homo sapiens
attaaaaactgcttat

SEQ ID NO: 5277904 - DNA, 11 bp, Homo sapiens
attaaaaactt

SEQ ID NO: 5277905 - DNA, 17 bp, Homo sapiens
attaaaaactttaaaga

SEQ ID NO: 5277906 - DNA, 21 bp, Homo sapiens
attaaaaagaagtttctatat

SEQ ID NO: 5277907 - DNA, 16 bp, Homo sapiens
attaaaaagattcttt

SEQ ID NO: 5277908 - DNA, 17 bp, Homo sapiens
attaaaaagattctttt

SEQ ID NO: 5277909 - DNA, 12 bp, Homo sapiens
attaaaaagcct

SEQ ID NO: 5277910 - DNA, 17 bp, Homo sapiens
attaaaaagcctgcatt

SEQ ID NO: 5277911 - DNA, 17 bp, Homo sapiens
attaaaaagtctgtatg

SEQ ID NO: 5277912 - DNA, 13 bp, Homo sapiens
attaaaaagtggg

SEQ ID NO: 5277913 - DNA, 21 bp, Homo sapiens
attaaaaagttgttctttgtt

SEQ ID NO: 5277914 - DNA, 11 bp, Homo sapiens
attaaaaataa

SEQ ID NO: 5277915 - DNA, 17 bp, Homo sapiens
attaaaaataagccaaa

SEQ ID NO: 5277916 - DNA, 15 bp, Homo sapiens
attaaaaatataaac

SEQ ID NO: 5277917 - DNA, 15 bp, Homo sapiens
attaaaaatctaaaa

SEQ ID NO: 5277918 - DNA, 20 bp, Homo sapiens
attaaaaatctcaaatttct

SEQ ID NO: 5277919 - DNA, 22 bp, Homo sapiens
attaaaaatctcaaatttctaa

SEQ ID NO: 5277920 - DNA, 21 bp, Homo sapiens
attaaaaatgagatttcttat

SEQ ID NO: 5277921 - DNA, 21 bp, Homo sapiens
attaaaaatggtaaaattgca

SEQ ID NO: 5277922 - DNA, 14 bp, Homo sapiens
attaaaaattactg

SEQ ID NO: 5277923 - DNA, 15 bp, Homo sapiens
attaaaaattgaaaa

SEQ ID NO: 5277924 - DNA, 20 bp, Homo sapiens
attaaaaattggctagttga

SEQ ID NO: 5277925 - DNA, 13 bp, Homo sapiens
attaaaacaaaat

SEQ ID NO: 5277926 - DNA, 16 bp, Homo sapiens
attaaaacaaaatcct

SEQ ID NO: 5277927 - DNA, 19 bp, Homo sapiens
attaaaacaaatatacatt

SEQ ID NO: 5277928 - DNA, 15 bp, Homo sapiens
attaaaacaataatg

SEQ ID NO: 5277929 - DNA, 20 bp, Homo sapiens
attaaaacaatattgtttct

SEQ ID NO: 5277930 - DNA, 19 bp, Homo sapiens
attaaaacacaacatcttt

SEQ ID NO: 5277931 - DNA, 22 bp, Homo sapiens
attaaaacagctgcattagaaa

SEQ ID NO: 5277932 - DNA, 13 bp, Homo sapiens
attaaaacagtgt

SEQ ID NO: 5277933 - DNA, 18 bp, Homo sapiens
attaaaacatatttcatt

SEQ ID NO: 5277934 - DNA, 13 bp, Homo sapiens
attaaaacattgg

SEQ ID NO: 5277935 - DNA, 20 bp, Homo sapiens
attaaaacattggattatcc

SEQ ID NO: 5277936 - DNA, 16 bp, Homo sapiens
attaaaactaaatttc

SEQ ID NO: 5277937 - DNA, 17 bp, Homo sapiens
attaaaactaaatttca

SEQ ID NO: 5277938 - DNA, 15 bp, Homo sapiens
attaaaactaggtaa

SEQ ID NO: 5277939 - DNA, 19 bp, Homo sapiens
attaaaactaggtaatgtt

SEQ ID NO: 5277940 - DNA, 19 bp, Homo sapiens
attaaaactcaacattact

SEQ ID NO: 5277941 - DNA, 21 bp, Homo sapiens
attaaaactgaagtctgaaat

SEQ ID NO: 5277942 - DNA, 22 bp, Homo sapiens
attaaaactgaagtctgaaatt

SEQ ID NO: 5277943 - DNA, 15 bp, Homo sapiens
attaaaactgaattg

SEQ ID NO: 5277944 - DNA, 17 bp, Homo sapiens
attaaaactgagtccat

SEQ ID NO: 5277945 - DNA, 20 bp, Homo sapiens
attaaaactgagtccatgaa

SEQ ID NO: 5277946 - DNA, 22 bp, Homo sapiens
attaaaacttaaccgcatcaga

SEQ ID NO: 5277947 - DNA, 18 bp, Homo sapiens
attaaaactttgtagaca

SEQ ID NO: 5277948 - DNA, 21 bp, Homo sapiens
attaaaagaaatatacagttt

SEQ ID NO: 5277949 - DNA, 16 bp, Homo sapiens
attaaaagaatatttt

SEQ ID NO: 5277950 - DNA, 17 bp, Homo sapiens
attaaaagaatgagtga

SEQ ID NO: 5277951 - DNA, 14 bp, Homo sapiens
attaaaagaatttt

SEQ ID NO: 5277952 - DNA, 14 bp, Homo sapiens
attaaaagacaaat

SEQ ID NO: 5277953 - DNA, 11 bp, Homo sapiens
attaaaagact

SEQ ID NO: 5277954 - DNA, 13 bp, Homo sapiens
attaaaagactca

SEQ ID NO: 5277955 - DNA, 15 bp, Homo sapiens
attaaaagcaaatca

SEQ ID NO: 5277956 - DNA, 23 bp, Homo sapiens
attaaaagcccactgtggagatg

SEQ ID NO: 5277957 - DNA, 17 bp, Homo sapiens
attaaaaggaaaaaaga

SEQ ID NO: 5277958 - DNA, 19 bp, Homo sapiens
attaaaaggaaaaaagaaa

SEQ ID NO: 5277959 - DNA, 16 bp, Homo sapiens
attaaaaggaaagtca

SEQ ID NO: 5277960 - DNA, 16 bp, Homo sapiens
attaaaaggatagtat

SEQ ID NO: 5277961 - DNA, 13 bp, Homo sapiens
attaaaagtcaca

SEQ ID NO: 5277962 - DNA, 14 bp, Homo sapiens
attaaaagtttggg

SEQ ID NO: 5277963 - DNA, 17 bp, Homo sapiens
attaaaataaaacaagc

SEQ ID NO: 5277964 - DNA, 15 bp, Homo sapiens
attaaaataaaccaa

SEQ ID NO: 5277965 - DNA, 12 bp, Homo sapiens
attaaaataact

SEQ ID NO: 5277966 - DNA, 15 bp, Homo sapiens
attaaaataactatc

SEQ ID NO: 5277967 - DNA, 21 bp, Homo sapiens
attaaaataactatcaggcag

SEQ ID NO: 5277968 - DNA, 22 bp, Homo sapiens
attaaaataactatcaggcaga

SEQ ID NO: 5277969 - DNA, 17 bp, Homo sapiens
attaaaatacattttaa

SEQ ID NO: 5277970 - DNA, 20 bp, Homo sapiens
attaaaatagcatactgtgt

SEQ ID NO: 5277971 - DNA, 21 bp, Homo sapiens
attaaaatagcatactgtgta

SEQ ID NO: 5277972 - DNA, 15 bp, Homo sapiens
attaaaatagttaca

SEQ ID NO: 5277973 - DNA, 15 bp, Homo sapiens
attaaaatatatata

SEQ ID NO: 5277974 - DNA, 16 bp, Homo sapiens
attaaaatatatataa

SEQ ID NO: 5277975 - DNA, 22 bp, Homo sapiens
attaaaatatatataaatatat

SEQ ID NO: 5277976 - DNA, 16 bp, Homo sapiens
attaaaatatgaaggt

SEQ ID NO: 5277977 - DNA, 14 bp, Homo sapiens
attaaaatatgcac

SEQ ID NO: 5277978 - DNA, 23 bp, Homo sapiens
attaaaatatgcactaagtctct

SEQ ID NO: 5277979 - DNA, 14 bp, Homo sapiens
attaaaatattatt

SEQ ID NO: 5277980 - DNA, 15 bp, Homo sapiens
attaaaatattattt

SEQ ID NO: 5277981 - DNA, 16 bp, Homo sapiens
attaaaatattatttg

SEQ ID NO: 5277982 - DNA, 12 bp, Homo sapiens
attaaaatattt

SEQ ID NO: 5277983 - DNA, 14 bp, Homo sapiens
attaaaatatttca

SEQ ID NO: 5277984 - DNA, 15 bp, Homo sapiens
attaaaatatttgcc

SEQ ID NO: 5277985 - DNA, 18 bp, Homo sapiens
attaaaatcacaaactca

SEQ ID NO: 5277986 - DNA, 17 bp, Homo sapiens
attaaaatccagcatcc

SEQ ID NO: 5277987 - DNA, 14 bp, Homo sapiens
attaaaatctgatg

SEQ ID NO: 5277988 - DNA, 11 bp, Homo sapiens
attaaaatctt

SEQ ID NO: 5277989 - DNA, 12 bp, Homo sapiens
attaaaatctta

SEQ ID NO: 5277990 - DNA, 13 bp, Homo sapiens
attaaaatcttaa

SEQ ID NO: 5277991 - DNA, 19 bp, Homo sapiens
attaaaatctttctttggg

SEQ ID NO: 5277992 - DNA, 13 bp, Homo sapiens
attaaaatgacaa

SEQ ID NO: 5277993 - DNA, 19 bp, Homo sapiens
attaaaatgacaaacatga

SEQ ID NO: 5277994 - DNA, 14 bp, Homo sapiens
attaaaatgcatat

SEQ ID NO: 5277995 - DNA, 18 bp, Homo sapiens
attaaaatgcatatttct

SEQ ID NO: 5277996 - DNA, 22 bp, Homo sapiens
attaaaatgcatatttctatgt

SEQ ID NO: 5277997 - DNA, 21 bp, Homo sapiens
attaaaatggtgacttaatcc

SEQ ID NO: 5277998 - DNA, 17 bp, Homo sapiens
attaaaatgtaaaactc

SEQ ID NO: 5277999 - DNA, 15 bp, Homo sapiens
attaaaatgtatgca

SEQ ID NO: 5278000 - DNA, 15 bp, Homo sapiens
attaaaattacaaaa

SEQ ID NO: 5278001 - DNA, 13 bp, Homo sapiens
attaaaattacag

SEQ ID NO: 5278002 - DNA, 15 bp, Homo sapiens
attaaaattacagat

SEQ ID NO: 5278003 - DNA, 16 bp, Homo sapiens
attaaaattagtgaga

SEQ ID NO: 5278004 - DNA, 14 bp, Homo sapiens
attaaaattctgaa

SEQ ID NO: 5278005 - DNA, 17 bp, Homo sapiens
attaaaattctgaattt

SEQ ID NO: 5278006 - DNA, 19 bp, Homo sapiens
attaaaattctgaattttg

SEQ ID NO: 5278007 - DNA, 22 bp, Homo sapiens
attaaaattctgatgtttctgt

SEQ ID NO: 5278008 - DNA, 13 bp, Homo sapiens
attaaacaaagtt

SEQ ID NO: 5278009 - DNA, 15 bp, Homo sapiens
attaaacaatttatt

SEQ ID NO: 5278010 - DNA, 16 bp, Homo sapiens
attaaacaatttattt

SEQ ID NO: 5278011 - DNA, 14 bp, Homo sapiens
attaaacacctgac

SEQ ID NO: 5278012 - DNA, 17 bp, Homo sapiens
attaaacacctgacaca

SEQ ID NO: 5278013 - DNA, 20 bp, Homo sapiens
attaaacacctgacacatct

SEQ ID NO: 5278014 - DNA, 21 bp, Homo sapiens
attaaacactaaatgcaagat

SEQ ID NO: 5278015 - DNA, 14 bp, Homo sapiens
attaaacactgtaa

SEQ ID NO: 5278016 - DNA, 12 bp, Homo sapiens
atttaatttcca

SEQ ID NO: 5278017 - DNA, 13 bp, Homo sapiens
atttaatttccag

SEQ ID NO: 5278018 - DNA, 18 bp, Homo sapiens
atttaatttgatatcaca

SEQ ID NO: 5278019 - DNA, 21 bp, Homo sapiens
atttaatttgccaaaataatg

SEQ ID NO: 5278020 - DNA, 11 bp, Homo sapiens
atttaatttgt

SEQ ID NO: 5278021 - DNA, 12 bp, Homo sapiens
atttaatttgta

SEQ ID NO: 5278022 - DNA, 20 bp, Homo sapiens
atttaatttgtaaaacttct

SEQ ID NO: 5278023 - DNA, 14 bp, Homo sapiens
atttaatttgttat

SEQ ID NO: 5278024 - DNA, 14 bp, Homo sapiens
atttaatttgttgt

SEQ ID NO: 5278025 - DNA, 14 bp, Homo sapiens
atttaattttgaca

SEQ ID NO: 5278026 - DNA, 19 bp, Homo sapiens
atttaattttgacactata

SEQ ID NO: 5278027 - DNA, 20 bp, Homo sapiens
atttaattttgacactgaaa

SEQ ID NO: 5278028 - DNA, 16 bp, Homo sapiens
atttaatttttaaaag

SEQ ID NO: 5278029 - DNA, 22 bp, Homo sapiens
atttaatttttaaaagactttg

SEQ ID NO: 5278030 - DNA, 19 bp, Homo sapiens
atttaatttttacatgacc

SEQ ID NO: 5278031 - DNA, 17 bp, Homo sapiens
atttaatttttattaaa

SEQ ID NO: 5278032 - DNA, 16 bp, Homo sapiens
atttaatttttgcaat

SEQ ID NO: 5278033 - DNA, 20 bp, Homo sapiens
atttacaaagtgtgtattaa

SEQ ID NO: 5278034 - DNA, 12 bp, Homo sapiens
atttacaaataa

SEQ ID NO: 5278035 - DNA, 13 bp, Homo sapiens
atttacaaatgaa

SEQ ID NO: 5278036 - DNA, 14 bp, Homo sapiens
atttacaaatgaag

SEQ ID NO: 5278037 - DNA, 15 bp, Homo sapiens
atttacaaatgaagt

SEQ ID NO: 5278038 - DNA, 22 bp, Homo sapiens
atttacaactgaaacctaggaa

SEQ ID NO: 5278039 - DNA, 18 bp, Homo sapiens
atttacaacttccagatt

SEQ ID NO: 5278040 - DNA, 19 bp, Homo sapiens
atttacaagacaacattgt

SEQ ID NO: 5278041 - DNA, 13 bp, Homo sapiens
atttacaagagaa

SEQ ID NO: 5278042 - DNA, 20 bp, Homo sapiens
atttacaagagctgttcatg

SEQ ID NO: 5278043 - DNA, 14 bp, Homo sapiens
atttacaagatatt

SEQ ID NO: 5278044 - DNA, 20 bp, Homo sapiens
atttacaagatattattaat

SEQ ID NO: 5278045 - DNA, 18 bp, Homo sapiens
atttacaataaatgaaga

SEQ ID NO: 5278046 - DNA, 15 bp, Homo sapiens
atttacaatgtatta

SEQ ID NO: 5278047 - DNA, 17 bp, Homo sapiens
atttacaatgtattaag

SEQ ID NO: 5278048 - DNA, 12 bp, Homo sapiens
atttacaatgtg

SEQ ID NO: 5278049 - DNA, 15 bp, Homo sapiens
atttacacagtgaga

SEQ ID NO: 5278050 - DNA, 20 bp, Homo sapiens
atttacacagtgagactgta

SEQ ID NO: 5278051 - DNA, 18 bp, Homo sapiens
atttacacatacaacttc

SEQ ID NO: 5278052 - DNA, 20 bp, Homo sapiens
atttacactattatttccta

SEQ ID NO: 5278053 - DNA, 12 bp, Homo sapiens
atttacactcaa

SEQ ID NO: 5278054 - DNA, 15 bp, Homo sapiens
atttacactcctcta

SEQ ID NO: 5278055 - DNA, 22 bp, Homo sapiens
atttacactcctctatcatgca

SEQ ID NO: 5278056 - DNA, 23 bp, Homo sapiens
atttacactcctctatcatgcaa

SEQ ID NO: 5278057 - DNA, 14 bp, Homo sapiens
atttacactgggag

SEQ ID NO: 5278058 - DNA, 15 bp, Homo sapiens
atttacactggtcta

SEQ ID NO: 5278059 - DNA, 20 bp, Homo sapiens
atttacacttttgagacttt

SEQ ID NO: 5278060 - DNA, 14 bp, Homo sapiens
atttacagaacaaa

SEQ ID NO: 5278061 - DNA, 18 bp, Homo sapiens
atttacagaagaaaagca

SEQ ID NO: 5278062 - DNA, 20 bp, Homo sapiens
atttacagaatattatataa

SEQ ID NO: 5278063 - DNA, 21 bp, Homo sapiens
atttacagcctcacttgaatg

SEQ ID NO: 5278064 - DNA, 19 bp, Homo sapiens
atttacagctctgtaacct

SEQ ID NO: 5278065 - DNA, 22 bp, Homo sapiens
atttacagtctagtacttatta

SEQ ID NO: 5278066 - DNA, 16 bp, Homo sapiens
atttacagtctctttc

SEQ ID NO: 5278067 - DNA, 20 bp, Homo sapiens
atttacagtgaaaatgtaag

SEQ ID NO: 5278068 - DNA, 15 bp, Homo sapiens
atttacagtgcctgt

SEQ ID NO: 5278069 - DNA, 16 bp, Homo sapiens
atttacagttactgcc

SEQ ID NO: 5278070 - DNA, 18 bp, Homo sapiens
atttacagttactgccta

SEQ ID NO: 5278071 - DNA, 13 bp, Homo sapiens
atttacagtttca

SEQ ID NO: 5278072 - DNA, 15 bp, Homo sapiens
atttacataaagact

SEQ ID NO: 5278073 - DNA, 16 bp, Homo sapiens
atttacatcactttgt

SEQ ID NO: 5278074 - DNA, 17 bp, Homo sapiens
atttacatcactttgtg

SEQ ID NO: 5278075 - DNA, 22 bp, Homo sapiens
atttacatcagaagtttgcatc

SEQ ID NO: 5278076 - DNA, 15 bp, Homo sapiens
atttacatccagctt

SEQ ID NO: 5278077 - DNA, 21 bp, Homo sapiens
atttacatgaattgcatttta

SEQ ID NO: 5278078 - DNA, 17 bp, Homo sapiens
atttacatgtatggtta

SEQ ID NO: 5278079 - DNA, 22 bp, Homo sapiens
atttacatgtattatttcatta

SEQ ID NO: 5278080 - DNA, 18 bp, Homo sapiens
atttacattctagttcag

SEQ ID NO: 5278081 - DNA, 15 bp, Homo sapiens
atttacatttaatag

SEQ ID NO: 5278082 - DNA, 14 bp, Homo sapiens
atttacatttatct

SEQ ID NO: 5278083 - DNA, 13 bp, Homo sapiens
atttacattttat

SEQ ID NO: 5278084 - DNA, 20 bp, Homo sapiens
atttaccaaagagatattga

SEQ ID NO: 5278085 - DNA, 13 bp, Homo sapiens
atttaccaaagta

SEQ ID NO: 5278086 - DNA, 14 bp, Homo sapiens
atttaccaaagtag

SEQ ID NO: 5278087 - DNA, 15 bp, Homo sapiens
atttaccaaattgct

SEQ ID NO: 5278088 - DNA, 18 bp, Homo sapiens
atttaccaacatgtatct

SEQ ID NO: 5278089 - DNA, 19 bp, Homo sapiens
atttaccaacatgtatctg

SEQ ID NO: 5278090 - DNA, 18 bp, Homo sapiens
atttaccacagcagctga

SEQ ID NO: 5278091 - DNA, 22 bp, Homo sapiens
atttaccacttgtgttttgcaa

SEQ ID NO: 5278092 - DNA, 16 bp, Homo sapiens
atttaccagaaatatt

SEQ ID NO: 5278093 - DNA, 14 bp, Homo sapiens
atttaccagaagtt

SEQ ID NO: 5278094 - DNA, 15 bp, Homo sapiens
atttaccagaagttt

SEQ ID NO: 5278095 - DNA, 17 bp, Homo sapiens
atttaccagaagtttaa

SEQ ID NO: 5278096 - DNA, 18 bp, Homo sapiens
atttaccagggatgtaga

SEQ ID NO: 5278097 - DNA, 21 bp, Homo sapiens
atttaccatcaaacaaatcat

SEQ ID NO: 5278098 - DNA, 18 bp, Homo sapiens
atttaccatcatctctga

SEQ ID NO: 5278099 - DNA, 18 bp, Homo sapiens
atttaccattattttaca

SEQ ID NO: 5278100 - DNA, 21 bp, Homo sapiens
atttaccattattttacagtc

SEQ ID NO: 5278101 - DNA, 19 bp, Homo sapiens
atttacccaactctgtaca

SEQ ID NO: 5278102 - DNA, 15 bp, Homo sapiens
atttaccctttatag

SEQ ID NO: 5278103 - DNA, 17 bp, Homo sapiens
atttaccctttatagaa

SEQ ID NO: 5278104 - DNA, 14 bp, Homo sapiens
atttaccctttggc

SEQ ID NO: 5278105 - DNA, 18 bp, Homo sapiens
atttaccgttgcttgaaa

SEQ ID NO: 5278106 - DNA, 21 bp, Homo sapiens
atttaccgttgcttgaaatta

SEQ ID NO: 5278107 - DNA, 18 bp, Homo sapiens
atttacctaagattacaa

SEQ ID NO: 5278108 - DNA, 23 bp, Homo sapiens
atttacctagtgcaaaaactgta

SEQ ID NO: 5278109 - DNA, 11 bp, Homo sapiens
atttacctcag

SEQ ID NO: 5278110 - DNA, 13 bp, Homo sapiens
atttacctgcagg

SEQ ID NO: 5278111 - DNA, 18 bp, Homo sapiens
atttacctgcgaacttgt

SEQ ID NO: 5278112 - DNA, 18 bp, Homo sapiens
atttacctgtatttaaga

SEQ ID NO: 5278113 - DNA, 14 bp, Homo sapiens
atttaccttgaaaa

SEQ ID NO: 5278114 - DNA, 14 bp, Homo sapiens
atttaccttgaaca

SEQ ID NO: 5278115 - DNA, 14 bp, Homo sapiens
atttacctttggaa

SEQ ID NO: 5278116 - DNA, 14 bp, Homo sapiens
atttaccttttaag

SEQ ID NO: 5278117 - DNA, 18 bp, Homo sapiens
atttacctttttgcttat

SEQ ID NO: 5278118 - DNA, 13 bp, Homo sapiens
atttacgactgaa

SEQ ID NO: 5278119 - DNA, 16 bp, Homo sapiens
atttacgcctgtaaat

SEQ ID NO: 5278120 - DNA, 14 bp, Homo sapiens
atttacgtatattt

SEQ ID NO: 5278121 - DNA, 16 bp, Homo sapiens
atttacgtatatttca

SEQ ID NO: 5278122 - DNA, 16 bp, Homo sapiens
atttacgtttttgtaa

SEQ ID NO: 5278123 - DNA, 13 bp, Homo sapiens
atttactaaaaga

SEQ ID NO: 5278124 - DNA, 16 bp, Homo sapiens
atttactaaaatggac

SEQ ID NO: 5278125 - DNA, 13 bp, Homo sapiens
atttactaaacat

SEQ ID NO: 5278126 - DNA, 15 bp, Homo sapiens
atttactaaacatat

SEQ ID NO: 5278127 - DNA, 18 bp, Homo sapiens
atttactaacagtaactg

SEQ ID NO: 5278128 - DNA, 12 bp, Homo sapiens
atttactatata

SEQ ID NO: 5278129 - DNA, 16 bp, Homo sapiens
atttactatgtaaatg

SEQ ID NO: 5278130 - DNA, 13 bp, Homo sapiens
atttactatttca

SEQ ID NO: 5278131 - DNA, 22 bp, Homo sapiens
atttactcaccatatttgaatt

SEQ ID NO: 5278132 - DNA, 17 bp, Homo sapiens
atttactctaaaaactg

SEQ ID NO: 5278133 - DNA, 15 bp, Homo sapiens
atttactctttgcaa

SEQ ID NO: 5278134 - DNA, 16 bp, Homo sapiens
atttactctttgcaaa

SEQ ID NO: 5278135 - DNA, 15 bp, Homo sapiens
atttactgagacttc

SEQ ID NO: 5278136 - DNA, 16 bp, Homo sapiens
atttactgagagaagg

SEQ ID NO: 5278137 - DNA, 13 bp, Homo sapiens
atttactgagctt

SEQ ID NO: 5278138 - DNA, 13 bp, Homo sapiens
atttactgctcta

SEQ ID NO: 5278139 - DNA, 22 bp, Homo sapiens
atttactgtcttaaatcagttt

SEQ ID NO: 5278140 - DNA, 19 bp, Homo sapiens
atttactgttagaattctt

SEQ ID NO: 5278141 - DNA, 12 bp, Homo sapiens
atttactgttta

SEQ ID NO: 5278142 - DNA, 17 bp, Homo sapiens
atttacttaagtgttca

SEQ ID NO: 5278143 - DNA, 18 bp, Homo sapiens
atttacttaagtgttcat

SEQ ID NO: 5278144 - DNA, 19 bp, Homo sapiens
atttacttaatgggtacaa

SEQ ID NO: 5278145 - DNA, 11 bp, Homo sapiens
atttacttagg

SEQ ID NO: 5278146 - DNA, 17 bp, Homo sapiens
atttacttcttatacat

SEQ ID NO: 5278147 - DNA, 15 bp, Homo sapiens
atttacttgttttgg

SEQ ID NO: 5278148 - DNA, 19 bp, Homo sapiens
atttactttaaaaagaaat

SEQ ID NO: 5278149 - DNA, 15 bp, Homo sapiens
atttactttaaacta

SEQ ID NO: 5278150 - DNA, 17 bp, Homo sapiens
atttactttattaactt

SEQ ID NO: 5278151 - DNA, 23 bp, Homo sapiens
atttactttattaacttacggat

SEQ ID NO: 5278152 - DNA, 18 bp, Homo sapiens
atttactttcttcaccaa

SEQ ID NO: 5278153 - DNA, 22 bp, Homo sapiens
atttactttgcattttgtttca

SEQ ID NO: 5278154 - DNA, 15 bp, Homo sapiens
atttacttttaataa

SEQ ID NO: 5278155 - DNA, 19 bp, Homo sapiens
atttacttttaataaagta

SEQ ID NO: 5278156 - DNA, 17 bp, Homo sapiens
atttactttttaaacag

SEQ ID NO: 5278157 - DNA, 21 bp, Homo sapiens
atttagaaaaagaacatgcag

SEQ ID NO: 5278158 - DNA, 12 bp, Homo sapiens
atttagaaaaca

SEQ ID NO: 5278159 - DNA, 23 bp, Homo sapiens
atttagaaaacattcatccagtt

SEQ ID NO: 5278160 - DNA, 21 bp, Homo sapiens
atttagaaaagtgaattgaag

SEQ ID NO: 5278161 - DNA, 22 bp, Homo sapiens
atttagaaaatagagcttttaa

SEQ ID NO: 5278162 - DNA, 22 bp, Homo sapiens
atttagaaactaattgacttta

SEQ ID NO: 5278163 - DNA, 18 bp, Homo sapiens
atttagaaactgaaaaat

SEQ ID NO: 5278164 - DNA, 15 bp, Homo sapiens
atttagaaatataat

SEQ ID NO: 5278165 - DNA, 17 bp, Homo sapiens
atttagaaatcaagcat

SEQ ID NO: 5278166 - DNA, 17 bp, Homo sapiens
atttagaacgagcctgg

SEQ ID NO: 5278167 - DNA, 14 bp, Homo sapiens
atttagaactgtat

SEQ ID NO: 5278168 - DNA, 15 bp, Homo sapiens
atttagaactttaag

SEQ ID NO: 5278169 - DNA, 13 bp, Homo sapiens
atttagaagaaaa

SEQ ID NO: 5278170 - DNA, 12 bp, Homo sapiens
atttagaagata

SEQ ID NO: 5278171 - DNA, 22 bp, Homo sapiens
atttagaagcaaagatttcagt

SEQ ID NO: 5278172 - DNA, 15 bp, Homo sapiens
atttagaagcagagg

SEQ ID NO: 5278173 - DNA, 12 bp, Homo sapiens
atttagaagcca

SEQ ID NO: 5278174 - DNA, 21 bp, Homo sapiens
atttagaagccaactatgatt

SEQ ID NO: 5278175 - DNA, 14 bp, Homo sapiens
atttagaagtgtca

SEQ ID NO: 5278176 - DNA, 18 bp, Homo sapiens
atttagaagtgtcatgtt

SEQ ID NO: 5278177 - DNA, 19 bp, Homo sapiens
atttagaagtgtcatgttt

SEQ ID NO: 5278178 - DNA, 14 bp, Homo sapiens
atttagaatatatt

SEQ ID NO: 5278179 - DNA, 22 bp, Homo sapiens
atttagaatttgaaaggaaaaa

SEQ ID NO: 5278180 - DNA, 14 bp, Homo sapiens
atttagacaagaga

SEQ ID NO: 5278181 - DNA, 19 bp, Homo sapiens
atttagacttggattcttt

SEQ ID NO: 5278182 - DNA, 20 bp, Homo sapiens
atttagagaactgtggccgt

SEQ ID NO: 5278183 - DNA, 16 bp, Homo sapiens
atttagagaggaaaag

SEQ ID NO: 5278184 - DNA, 17 bp, Homo sapiens
atttagagataggaaac

SEQ ID NO: 5278185 - DNA, 22 bp, Homo sapiens
atttagagatgaattaaattta

SEQ ID NO: 5278186 - DNA, 22 bp, Homo sapiens
atttagagcgtttggttaaagt

SEQ ID NO: 5278187 - DNA, 17 bp, Homo sapiens
atttagagctaaaaagg

SEQ ID NO: 5278188 - DNA, 22 bp, Homo sapiens
atttagagcttttcagaacatc

SEQ ID NO: 5278189 - DNA, 16 bp, Homo sapiens
atttagagtatttaca

SEQ ID NO: 5278190 - DNA, 19 bp, Homo sapiens
atttagagtcaatttgctg

SEQ ID NO: 5278191 - DNA, 15 bp, Homo sapiens
atttagataacaaga

SEQ ID NO: 5278192 - DNA, 17 bp, Homo sapiens
atttagataatttgaaa

SEQ ID NO: 5278193 - DNA, 13 bp, Homo sapiens
atttagatatgca

SEQ ID NO: 5278194 - DNA, 19 bp, Homo sapiens
atttagatattttccatat

SEQ ID NO: 5278195 - DNA, 16 bp, Homo sapiens
atttagatcttatatt

SEQ ID NO: 5278196 - DNA, 17 bp, Homo sapiens
atttagatgataaagag

SEQ ID NO: 5278197 - DNA, 15 bp, Homo sapiens
attaaacactgtaat

SEQ ID NO: 5278198 - DNA, 17 bp, Homo sapiens
attaaacagaaggtaat

SEQ ID NO: 5278199 - DNA, 18 bp, Homo sapiens
attaaacagcaaagccat

SEQ ID NO: 5278200 - DNA, 16 bp, Homo sapiens
attaaacataaaacaa

SEQ ID NO: 5278201 - DNA, 13 bp, Homo sapiens
attaaacattttc

SEQ ID NO: 5278202 - DNA, 18 bp, Homo sapiens
attaaacattttcatgca

SEQ ID NO: 5278203 - DNA, 13 bp, Homo sapiens
attaaacattttt

SEQ ID NO: 5278204 - DNA, 20 bp, Homo sapiens
attaaaccaatgaagaagac

SEQ ID NO: 5278205 - DNA, 14 bp, Homo sapiens
attaaaccatctcc

SEQ ID NO: 5278206 - DNA, 18 bp, Homo sapiens
attaaaccatctccctgg

SEQ ID NO: 5278207 - DNA, 22 bp, Homo sapiens
attaaacccacaagctgcctct

SEQ ID NO: 5278208 - DNA, 17 bp, Homo sapiens
attaaaccggaccatct

SEQ ID NO: 5278209 - DNA, 17 bp, Homo sapiens
attaaacctggatacta

SEQ ID NO: 5278210 - DNA, 12 bp, Homo sapiens
attaaacctgtc

SEQ ID NO: 5278211 - DNA, 10 bp, Homo sapiens
attaaacctt

SEQ ID NO: 5278212 - DNA, 19 bp, Homo sapiens
attaaacctttccatttta

SEQ ID NO: 5278213 - DNA, 17 bp, Homo sapiens
attaaacgagataatgt

SEQ ID NO: 5278214 - DNA, 13 bp, Homo sapiens
attaaacggatta

SEQ ID NO: 5278215 - DNA, 14 bp, Homo sapiens
attaaacggattat

SEQ ID NO: 5278216 - DNA, 20 bp, Homo sapiens
attaaacggattattttttc

SEQ ID NO: 5278217 - DNA, 19 bp, Homo sapiens
attaaacgtatgcatgtga

SEQ ID NO: 5278218 - DNA, 16 bp, Homo sapiens
attaaacgtcattcag

SEQ ID NO: 5278219 - DNA, 11 bp, Homo sapiens
attaaactaat

SEQ ID NO: 5278220 - DNA, 14 bp, Homo sapiens
attaaactctcctt

SEQ ID NO: 5278221 - DNA, 15 bp, Homo sapiens
attaaactctccttt

SEQ ID NO: 5278222 - DNA, 18 bp, Homo sapiens
attaaactgaagaaggat

SEQ ID NO: 5278223 - DNA, 15 bp, Homo sapiens
attaaactgattcca

SEQ ID NO: 5278224 - DNA, 19 bp, Homo sapiens
attaaactgggaaatgaga

SEQ ID NO: 5278225 - DNA, 15 bp, Homo sapiens
attaaactgtatgtc

SEQ ID NO: 5278226 - DNA, 22 bp, Homo sapiens
attaaactgtatgtcttataag

SEQ ID NO: 5278227 - DNA, 13 bp, Homo sapiens
attaaactgttaa

SEQ ID NO: 5278228 - DNA, 17 bp, Homo sapiens
attaaacttaatctaaa

SEQ ID NO: 5278229 - DNA, 19 bp, Homo sapiens
attaaacttaatctaaatg

SEQ ID NO: 5278230 - DNA, 12 bp, Homo sapiens
attaaacttcag

SEQ ID NO: 5278231 - DNA, 16 bp, Homo sapiens
attaaacttcagcaac

SEQ ID NO: 5278232 - DNA, 13 bp, Homo sapiens
attaaacttcata

SEQ ID NO: 5278233 - DNA, 18 bp, Homo sapiens
attaaacttcatatgtaa

SEQ ID NO: 5278234 - DNA, 19 bp, Homo sapiens
attaaacttctactgagca

SEQ ID NO: 5278235 - DNA, 24 bp, Homo sapiens
attaaacttcttttctcttctaca

SEQ ID NO: 5278236 - DNA, 14 bp, Homo sapiens
attaaacttgaagc

SEQ ID NO: 5278237 - DNA, 19 bp, Homo sapiens
attaaagaaaaaaatgtat

SEQ ID NO: 5278238 - DNA, 14 bp, Homo sapiens
attaaagaaaattg

SEQ ID NO: 5278239 - DNA, 21 bp, Homo sapiens
attaaagaaaattgccaaaat

SEQ ID NO: 5278240 - DNA, 21 bp, Homo sapiens
attaaagaagggttgagctgg

SEQ ID NO: 5278241 - DNA, 15 bp, Homo sapiens
attaaagaatatgaa

SEQ ID NO: 5278242 - DNA, 23 bp, Homo sapiens
attaaagaatgctgcaacttttt

SEQ ID NO: 5278243 - DNA, 20 bp, Homo sapiens
attaaagagccattctggca

SEQ ID NO: 5278244 - DNA, 15 bp, Homo sapiens
attaaagatgctatg

SEQ ID NO: 5278245 - DNA, 18 bp, Homo sapiens
attaaagatggtttatgc

SEQ ID NO: 5278246 - DNA, 15 bp, Homo sapiens
attaaagattctctt

SEQ ID NO: 5278247 - DNA, 20 bp, Homo sapiens
attaaagattggaatgtgtt

SEQ ID NO: 5278248 - DNA, 13 bp, Homo sapiens
attaaagatttct

SEQ ID NO: 5278249 - DNA, 19 bp, Homo sapiens
attaaagcaacattttatt

SEQ ID NO: 5278250 - DNA, 16 bp, Homo sapiens
attaaagcatttccta

SEQ ID NO: 5278251 - DNA, 16 bp, Homo sapiens
attaaagccatgttta

SEQ ID NO: 5278252 - DNA, 21 bp, Homo sapiens
attaaagccatgtttattaca

SEQ ID NO: 5278253 - DNA, 22 bp, Homo sapiens
attaaagccctgtgttaagtgt

SEQ ID NO: 5278254 - DNA, 18 bp, Homo sapiens
attaaagccttaagcaca

SEQ ID NO: 5278255 - DNA, 16 bp, Homo sapiens
attaaagcctttagta

SEQ ID NO: 5278256 - DNA, 20 bp, Homo sapiens
attaaaggaattaaactaaa

SEQ ID NO: 5278257 - DNA, 13 bp, Homo sapiens
attaaaggcagca

SEQ ID NO: 5278258 - DNA, 14 bp, Homo sapiens
attaaaggcttttg

SEQ ID NO: 5278259 - DNA, 16 bp, Homo sapiens
attaaaggtatacaaa

SEQ ID NO: 5278260 - DNA, 22 bp, Homo sapiens
attaaaggtgaaaattgtataa

SEQ ID NO: 5278261 - DNA, 14 bp, Homo sapiens
attaaagtatgcaa

SEQ ID NO: 5278262 - DNA, 23 bp, Homo sapiens
attaaagtatgcaaaataaagaa

SEQ ID NO: 5278263 - DNA, 22 bp, Homo sapiens
attaaagtctacactgcctttg

SEQ ID NO: 5278264 - DNA, 16 bp, Homo sapiens
attaaagtctgagaaa

SEQ ID NO: 5278265 - DNA, 18 bp, Homo sapiens
attaaagtctgagaaatt

SEQ ID NO: 5278266 - DNA, 19 bp, Homo sapiens
attaaagtctgagaaattt

SEQ ID NO: 5278267 - DNA, 17 bp, Homo sapiens
attaaagtgactttcta

SEQ ID NO: 5278268 - DNA, 17 bp, Homo sapiens
attaaagtgccttcagc

SEQ ID NO: 5278269 - DNA, 22 bp, Homo sapiens
attaaagtgctaaggttctaag

SEQ ID NO: 5278270 - DNA, 20 bp, Homo sapiens
attaaagtgctgtttagatt

SEQ ID NO: 5278271 - DNA, 17 bp, Homo sapiens
attaaagtgtccattga

SEQ ID NO: 5278272 - DNA, 22 bp, Homo sapiens
attaaagtgtccattgacatgt

SEQ ID NO: 5278273 - DNA, 12 bp, Homo sapiens
attaaagttcta

SEQ ID NO: 5278274 - DNA, 19 bp, Homo sapiens
attaaagttctagtgaccg

SEQ ID NO: 5278275 - DNA, 16 bp, Homo sapiens
attaaagttgtttccc

SEQ ID NO: 5278276 - DNA, 14 bp, Homo sapiens
attaaagtttcaaa

SEQ ID NO: 5278277 - DNA, 16 bp, Homo sapiens
attaaagtttcaaaaa

SEQ ID NO: 5278278 - DNA, 18 bp, Homo sapiens
attaaagtttcaaaaatc

SEQ ID NO: 5278279 - DNA, 21 bp, Homo sapiens
attaaagtttcaaaaatctga

SEQ ID NO: 5278280 - DNA, 23 bp, Homo sapiens
attaaagtttcaaaaatctgaag

SEQ ID NO: 5278281 - DNA, 23 bp, Homo sapiens
attaaagtttgcttgtttcttgg

SEQ ID NO: 5278282 - DNA, 21 bp, Homo sapiens
attaaataaaatcaattttta

SEQ ID NO: 5278283 - DNA, 13 bp, Homo sapiens
attaaataaaatt

SEQ ID NO: 5278284 - DNA, 14 bp, Homo sapiens
attaaataaactgt

SEQ ID NO: 5278285 - DNA, 22 bp, Homo sapiens
attaaataaactgttttcaagt

SEQ ID NO: 5278286 - DNA, 12 bp, Homo sapiens
attaaataaatt

SEQ ID NO: 5278287 - DNA, 16 bp, Homo sapiens
attaaataaattttaa

SEQ ID NO: 5278288 - DNA, 18 bp, Homo sapiens
attaaataacttgaagag

SEQ ID NO: 5278289 - DNA, 12 bp, Homo sapiens
attaaataattt

SEQ ID NO: 5278290 - DNA, 16 bp, Homo sapiens
attaaatacaaaactt

SEQ ID NO: 5278291 - DNA, 14 bp, Homo sapiens
attaaatacagaca

SEQ ID NO: 5278292 - DNA, 19 bp, Homo sapiens
attaaatacagacactaag

SEQ ID NO: 5278293 - DNA, 21 bp, Homo sapiens
attaaatagtgtgatgtttgg

SEQ ID NO: 5278294 - DNA, 17 bp, Homo sapiens
attaaatagttatataa

SEQ ID NO: 5278295 - DNA, 19 bp, Homo sapiens
attaaatataaaatacata

SEQ ID NO: 5278296 - DNA, 13 bp, Homo sapiens
attaaatataaat

SEQ ID NO: 5278297 - DNA, 22 bp, Homo sapiens
attaaatataaatatccccagg

SEQ ID NO: 5278298 - DNA, 16 bp, Homo sapiens
attaaatatatctttg

SEQ ID NO: 5278299 - DNA, 19 bp, Homo sapiens
attaaatatatctttgtaa

SEQ ID NO: 5278300 - DNA, 20 bp, Homo sapiens
attaaatatatctttgtaaa

SEQ ID NO: 5278301 - DNA, 15 bp, Homo sapiens
attaaatatatgtat

SEQ ID NO: 5278302 - DNA, 16 bp, Homo sapiens
attaaatatatgtatg

SEQ ID NO: 5278303 - DNA, 18 bp, Homo sapiens
attaaatatatgtatgta

SEQ ID NO: 5278304 - DNA, 15 bp, Homo sapiens
attaaatatttaatg

SEQ ID NO: 5278305 - DNA, 16 bp, Homo sapiens
attaaatatttaatga

SEQ ID NO: 5278306 - DNA, 15 bp, Homo sapiens
attaaatatttgaag

SEQ ID NO: 5278307 - DNA, 16 bp, Homo sapiens
attaaatatttgaaga

SEQ ID NO: 5278308 - DNA, 21 bp, Homo sapiens
attaaatcagaatctttaaag

SEQ ID NO: 5278309 - DNA, 17 bp, Homo sapiens
attaaatcagttctcaa

SEQ ID NO: 5278310 - DNA, 18 bp, Homo sapiens
attaaatcagttctcaat

SEQ ID NO: 5278311 - DNA, 22 bp, Homo sapiens
attaaatcagttctcaatttca

SEQ ID NO: 5278312 - DNA, 15 bp, Homo sapiens
attaaatcagttttg

SEQ ID NO: 5278313 - DNA, 16 bp, Homo sapiens
attaaatcagttttgt

SEQ ID NO: 5278314 - DNA, 15 bp, Homo sapiens
attaaatccaataaa

SEQ ID NO: 5278315 - DNA, 17 bp, Homo sapiens
attaaatcgtttaatgt

SEQ ID NO: 5278316 - DNA, 18 bp, Homo sapiens
attaaatcgtttaatgtt

SEQ ID NO: 5278317 - DNA, 20 bp, Homo sapiens
attaaatcgtttaatgttta

SEQ ID NO: 5278318 - DNA, 22 bp, Homo sapiens
attaaatcgtttaatgtttata

SEQ ID NO: 5278319 - DNA, 18 bp, Homo sapiens
attaaatcttaaacaatg

SEQ ID NO: 5278320 - DNA, 14 bp, Homo sapiens
attaaatgaaatac

SEQ ID NO: 5278321 - DNA, 17 bp, Homo sapiens
attaaatgaaatacttg

SEQ ID NO: 5278322 - DNA, 18 bp, Homo sapiens
attaaatgaatattttga

SEQ ID NO: 5278323 - DNA, 19 bp, Homo sapiens
attaaatgaatattttgat

SEQ ID NO: 5278324 - DNA, 17 bp, Homo sapiens
attaaatgactcttccc

SEQ ID NO: 5278325 - DNA, 22 bp, Homo sapiens
attaaatgacttagaaacaatg

SEQ ID NO: 5278326 - DNA, 16 bp, Homo sapiens
attaaatgcccagccc

SEQ ID NO: 5278327 - DNA, 17 bp, Homo sapiens
attaaatgcccagcccc

SEQ ID NO: 5278328 - DNA, 16 bp, Homo sapiens
attaaatgccttgtat

SEQ ID NO: 5278329 - DNA, 19 bp, Homo sapiens
attaaatgccttgtataaa

SEQ ID NO: 5278330 - DNA, 11 bp, Homo sapiens
attaaatggca

SEQ ID NO: 5278331 - DNA, 18 bp, Homo sapiens
attaaatggcacctgtat

SEQ ID NO: 5278332 - DNA, 22 bp, Homo sapiens
attaaatggtgatttcttgcta

SEQ ID NO: 5278333 - DNA, 18 bp, Homo sapiens
attaaatggtttttaaat

SEQ ID NO: 5278334 - DNA, 21 bp, Homo sapiens
attaaatgtatatgtcattta

SEQ ID NO: 5278335 - DNA, 15 bp, Homo sapiens
attaaatgtctgaca

SEQ ID NO: 5278336 - DNA, 21 bp, Homo sapiens
attaaatgtctgacacattaa

SEQ ID NO: 5278337 - DNA, 19 bp, Homo sapiens
attaaatgtggaaggaaaa

SEQ ID NO: 5278338 - DNA, 12 bp, Homo sapiens
attaaatgttgc

SEQ ID NO: 5278339 - DNA, 11 bp, Homo sapiens
attaaatgttt

SEQ ID NO: 5278340 - DNA, 16 bp, Homo sapiens
attaaatgtttcaaaa

SEQ ID NO: 5278341 - DNA, 15 bp, Homo sapiens
attaaattaattgaa

SEQ ID NO: 5278342 - DNA, 19 bp, Homo sapiens
attaaattaattgaatcta

SEQ ID NO: 5278343 - DNA, 22 bp, Homo sapiens
attaaattacacaattacactt

SEQ ID NO: 5278344 - DNA, 15 bp, Homo sapiens
attaaattacatttg

SEQ ID NO: 5278345 - DNA, 22 bp, Homo sapiens
attaaattactatagcaaagta

SEQ ID NO: 5278346 - DNA, 19 bp, Homo sapiens
attaaattagacttcctgt

SEQ ID NO: 5278347 - DNA, 24 bp, Homo sapiens
attaaattatatctgaggcactga

SEQ ID NO: 5278348 - DNA, 13 bp, Homo sapiens
attaaattatgaa

SEQ ID NO: 5278349 - DNA, 14 bp, Homo sapiens
attaaattatgaat

SEQ ID NO: 5278350 - DNA, 13 bp, Homo sapiens
attaaattcacaa

SEQ ID NO: 5278351 - DNA, 14 bp, Homo sapiens
attaaattcacaaa

SEQ ID NO: 5278352 - DNA, 15 bp, Homo sapiens
attaaattctcaaag

SEQ ID NO: 5278353 - DNA, 17 bp, Homo sapiens
attaaattctcaaagtt

SEQ ID NO: 5278354 - DNA, 24 bp, Homo sapiens
attaaattctctctaacataacaa

SEQ ID NO: 5278355 - DNA, 17 bp, Homo sapiens
attaaattggaattttc

SEQ ID NO: 5278356 - DNA, 20 bp, Homo sapiens
attaaattgggcttcaatca

SEQ ID NO: 5278357 - DNA, 12 bp, Homo sapiens
attaaatttaat

SEQ ID NO: 5278358 - DNA, 15 bp, Homo sapiens
attaaatttaatata

SEQ ID NO: 5278359 - DNA, 15 bp, Homo sapiens
attaaatttaattag

SEQ ID NO: 5278360 - DNA, 12 bp, Homo sapiens
attaaatttatt

SEQ ID NO: 5278361 - DNA, 19 bp, Homo sapiens
attaaatttattaaatgtt

SEQ ID NO: 5278362 - DNA, 20 bp, Homo sapiens
attaaatttatttgaaaatg

SEQ ID NO: 5278363 - DNA, 18 bp, Homo sapiens
attaaatttcaaatgcag

SEQ ID NO: 5278364 - DNA, 19 bp, Homo sapiens
attaaatttcacaatataa

SEQ ID NO: 5278365 - DNA, 17 bp, Homo sapiens
attaaatttctggattt

SEQ ID NO: 5278366 - DNA, 19 bp, Homo sapiens
attaaatttgatggttgaa

SEQ ID NO: 5278367 - DNA, 19 bp, Homo sapiens
attaaattttagtacattt

SEQ ID NO: 5278368 - DNA, 15 bp, Homo sapiens
attaaattttctatg

SEQ ID NO: 5278369 - DNA, 18 bp, Homo sapiens
attaaattttgagttcta

SEQ ID NO: 5278370 - DNA, 20 bp, Homo sapiens
attaaattttgagttctaca

SEQ ID NO: 5278371 - DNA, 20 bp, Homo sapiens
attaaattttttaaaaagca

SEQ ID NO: 5278372 - DNA, 17 bp, Homo sapiens
attaaatttttttgtat

SEQ ID NO: 5278373 - DNA, 19 bp, Homo sapiens
attaaatttttttgtatga

SEQ ID NO: 5278374 - DNA, 23 bp, Homo sapiens
attaaatttttttgtatgaaaac

SEQ ID NO: 5278375 - DNA, 17 bp, Homo sapiens
attaaattttttttaca

SEQ ID NO: 5278376 - DNA, 14 bp, Homo sapiens
atttagatttgtgt

SEQ ID NO: 5278377 - DNA, 15 bp, Homo sapiens
atttagcaaactgat

SEQ ID NO: 5278378 - DNA, 17 bp, Homo sapiens
atttagcaaactgatgc

SEQ ID NO: 5278379 - DNA, 15 bp, Homo sapiens
atttagcaagcaact

SEQ ID NO: 5278380 - DNA, 19 bp, Homo sapiens
atttagcaatgctgtgaat

SEQ ID NO: 5278381 - DNA, 20 bp, Homo sapiens
atttagcaatgctgtgaata

SEQ ID NO: 5278382 - DNA, 13 bp, Homo sapiens
atttagcacaaaa

SEQ ID NO: 5278383 - DNA, 23 bp, Homo sapiens
atttagcacaatttgagactgaa

SEQ ID NO: 5278384 - DNA, 13 bp, Homo sapiens
atttagcacagta

SEQ ID NO: 5278385 - DNA, 14 bp, Homo sapiens
atttagcacagtat

SEQ ID NO: 5278386 - DNA, 14 bp, Homo sapiens
atttagcacatttt

SEQ ID NO: 5278387 - DNA, 15 bp, Homo sapiens
atttagcataaattt

SEQ ID NO: 5278388 - DNA, 22 bp, Homo sapiens
atttagcatgacaagccccagg

SEQ ID NO: 5278389 - DNA, 17 bp, Homo sapiens
atttagcatgagttctg

SEQ ID NO: 5278390 - DNA, 21 bp, Homo sapiens
atttagcatggggattgcaga

SEQ ID NO: 5278391 - DNA, 13 bp, Homo sapiens
atttagcattgta

SEQ ID NO: 5278392 - DNA, 19 bp, Homo sapiens
atttagcattgtagtgctt

SEQ ID NO: 5278393 - DNA, 20 bp, Homo sapiens
atttagcattgtagtgcttt

SEQ ID NO: 5278394 - DNA, 16 bp, Homo sapiens
atttagccaataaaga

SEQ ID NO: 5278395 - DNA, 15 bp, Homo sapiens
atttagccagaatgt

SEQ ID NO: 5278396 - DNA, 16 bp, Homo sapiens
atttagccagaatgtt

SEQ ID NO: 5278397 - DNA, 21 bp, Homo sapiens
atttagccagaatgtttcctg

SEQ ID NO: 5278398 - DNA, 22 bp, Homo sapiens
atttagccaggacctgccaatg

SEQ ID NO: 5278399 - DNA, 15 bp, Homo sapiens
atttagcccctctct

SEQ ID NO: 5278400 - DNA, 13 bp, Homo sapiens
atttagccctcac

SEQ ID NO: 5278401 - DNA, 20 bp, Homo sapiens
atttagccctggtttgaaat

SEQ ID NO: 5278402 - DNA, 14 bp, Homo sapiens
atttagccctttaa

SEQ ID NO: 5278403 - DNA, 21 bp, Homo sapiens
atttagcgcacccagagaaaa

SEQ ID NO: 5278404 - DNA, 23 bp, Homo sapiens
atttagctagtttttaatagtgt

SEQ ID NO: 5278405 - DNA, 19 bp, Homo sapiens
atttagctgtatcaaacta

SEQ ID NO: 5278406 - DNA, 17 bp, Homo sapiens
atttagcttctttccct

SEQ ID NO: 5278407 - DNA, 13 bp, Homo sapiens
atttaggaaacac

SEQ ID NO: 5278408 - DNA, 14 bp, Homo sapiens
atttaggaaacacc

SEQ ID NO: 5278409 - DNA, 23 bp, Homo sapiens
atttaggaagttgacttatagta

SEQ ID NO: 5278410 - DNA, 19 bp, Homo sapiens
atttaggaatgctcaatgt

SEQ ID NO: 5278411 - DNA, 15 bp, Homo sapiens
atttaggactgggtt

SEQ ID NO: 5278412 - DNA, 14 bp, Homo sapiens
atttaggagaagcc

SEQ ID NO: 5278413 - DNA, 15 bp, Homo sapiens
atttaggagcagaaa

SEQ ID NO: 5278414 - DNA, 23 bp, Homo sapiens
atttaggatattacaatggccag

SEQ ID NO: 5278415 - DNA, 21 bp, Homo sapiens
atttaggatttgtgttttaca

SEQ ID NO: 5278416 - DNA, 22 bp, Homo sapiens
atttaggcagattgaaaaggac

SEQ ID NO: 5278417 - DNA, 18 bp, Homo sapiens
atttaggcatgagctctt

SEQ ID NO: 5278418 - DNA, 18 bp, Homo sapiens
atttagggaactgcttga

SEQ ID NO: 5278419 - DNA, 23 bp, Homo sapiens
atttagggaagcagggacacccc

SEQ ID NO: 5278420 - DNA, 20 bp, Homo sapiens
atttagggagtattctaata

SEQ ID NO: 5278421 - DNA, 17 bp, Homo sapiens
atttagggtactaaatt

SEQ ID NO: 5278422 - DNA, 20 bp, Homo sapiens
atttagggtactaaatttaa

SEQ ID NO: 5278423 - DNA, 17 bp, Homo sapiens
atttagggtacttttat

SEQ ID NO: 5278424 - DNA, 22 bp, Homo sapiens
atttagggtgattttaaagaac

SEQ ID NO: 5278425 - DNA, 19 bp, Homo sapiens
atttaggtaaataaagctc

SEQ ID NO: 5278426 - DNA, 21 bp, Homo sapiens
atttaggtttctgagttcctg

SEQ ID NO: 5278427 - DNA, 18 bp, Homo sapiens
atttaggtttttattagt

SEQ ID NO: 5278428 - DNA, 24 bp, Homo sapiens
atttagtaaaattatctgttctat

SEQ ID NO: 5278429 - DNA, 12 bp, Homo sapiens
atttagtaaata

SEQ ID NO: 5278430 - DNA, 15 bp, Homo sapiens
atttagtaaatgtta

SEQ ID NO: 5278431 - DNA, 19 bp, Homo sapiens
atttagtaacttctgtgtt

SEQ ID NO: 5278432 - DNA, 14 bp, Homo sapiens
atttagtaagaata

SEQ ID NO: 5278433 - DNA, 18 bp, Homo sapiens
atttagtaaggattttat

SEQ ID NO: 5278434 - DNA, 14 bp, Homo sapiens
atttagtaccctgc

SEQ ID NO: 5278435 - DNA, 20 bp, Homo sapiens
atttagtaccctgcaggcca

SEQ ID NO: 5278436 - DNA, 20 bp, Homo sapiens
atttagtaccttcaaataat

SEQ ID NO: 5278437 - DNA, 20 bp, Homo sapiens
atttagtataccagagaagg

SEQ ID NO: 5278438 - DNA, 21 bp, Homo sapiens
atttagtattgaatacttaca

SEQ ID NO: 5278439 - DNA, 14 bp, Homo sapiens
atttagtcaacata

SEQ ID NO: 5278440 - DNA, 15 bp, Homo sapiens
atttagtcctcacct

SEQ ID NO: 5278441 - DNA, 16 bp, Homo sapiens
atttagtcctcacctt

SEQ ID NO: 5278442 - DNA, 14 bp, Homo sapiens
atttagtcctgtac

SEQ ID NO: 5278443 - DNA, 23 bp, Homo sapiens
atttagtctagacacaatttcat

SEQ ID NO: 5278444 - DNA, 16 bp, Homo sapiens
atttagtgaatggcat

SEQ ID NO: 5278445 - DNA, 18 bp, Homo sapiens
atttagtgatcttagcat

SEQ ID NO: 5278446 - DNA, 23 bp, Homo sapiens
atttagtggtggtagaaatgatt

SEQ ID NO: 5278447 - DNA, 19 bp, Homo sapiens
atttagtgtatatgtgatt

SEQ ID NO: 5278448 - DNA, 20 bp, Homo sapiens
atttagtgtatatgtgattt

SEQ ID NO: 5278449 - DNA, 14 bp, Homo sapiens
atttagtgtgaata

SEQ ID NO: 5278450 - DNA, 13 bp, Homo sapiens
atttagtgttcat

SEQ ID NO: 5278451 - DNA, 21 bp, Homo sapiens
atttagtgtttttacctctgt

SEQ ID NO: 5278452 - DNA, 23 bp, Homo sapiens
atttagtgtttttttatttctac

SEQ ID NO: 5278453 - DNA, 21 bp, Homo sapiens
atttagttacgtataatgctt

SEQ ID NO: 5278454 - DNA, 16 bp, Homo sapiens
atttagttatagtttc

SEQ ID NO: 5278455 - DNA, 11 bp, Homo sapiens
atttagttatt

SEQ ID NO: 5278456 - DNA, 12 bp, Homo sapiens
atttagttcttt

SEQ ID NO: 5278457 - DNA, 16 bp, Homo sapiens
atttagttgtaaacca

SEQ ID NO: 5278458 - DNA, 15 bp, Homo sapiens
atttagttgttgtag

SEQ ID NO: 5278459 - DNA, 14 bp, Homo sapiens
atttagtttcagta

SEQ ID NO: 5278460 - DNA, 16 bp, Homo sapiens
atttagtttgttaaag

SEQ ID NO: 5278461 - DNA, 19 bp, Homo sapiens
atttagttttatggcatga

SEQ ID NO: 5278462 - DNA, 22 bp, Homo sapiens
atttagttttatggcatgattt

SEQ ID NO: 5278463 - DNA, 20 bp, Homo sapiens
atttagtttttgtaatttat

SEQ ID NO: 5278464 - DNA, 16 bp, Homo sapiens
atttagtttttgttct

SEQ ID NO: 5278465 - DNA, 19 bp, Homo sapiens
atttagtttttgttcttaa

SEQ ID NO: 5278466 - DNA, 22 bp, Homo sapiens
atttataaaaataaaaaacact

SEQ ID NO: 5278467 - DNA, 19 bp, Homo sapiens
atttataaaaatataaatt

SEQ ID NO: 5278468 - DNA, 22 bp, Homo sapiens
atttataaaaatataaattgta

SEQ ID NO: 5278469 - DNA, 14 bp, Homo sapiens
atttataaaacttc

SEQ ID NO: 5278470 - DNA, 21 bp, Homo sapiens
atttataaaacttctcaagat

SEQ ID NO: 5278471 - DNA, 15 bp, Homo sapiens
atttataaaattaga

SEQ ID NO: 5278472 - DNA, 23 bp, Homo sapiens
atttataaacagacaatatgtga

SEQ ID NO: 5278473 - DNA, 20 bp, Homo sapiens
atttataaactaattttgta

SEQ ID NO: 5278474 - DNA, 12 bp, Homo sapiens
atttataaagca

SEQ ID NO: 5278475 - DNA, 22 bp, Homo sapiens
atttataaatatatttaagata

SEQ ID NO: 5278476 - DNA, 16 bp, Homo sapiens
atttataaatgctatt

SEQ ID NO: 5278477 - DNA, 17 bp, Homo sapiens
atttataaatgctattt

SEQ ID NO: 5278478 - DNA, 9 bp, Homo sapiens
atttataac

SEQ ID NO: 5278479 - DNA, 18 bp, Homo sapiens
atttataacaattgattt

SEQ ID NO: 5278480 - DNA, 19 bp, Homo sapiens
atttataaccccagcctga

SEQ ID NO: 5278481 - DNA, 15 bp, Homo sapiens
atttataactcatca

SEQ ID NO: 5278482 - DNA, 17 bp, Homo sapiens
atttataactcatcata

SEQ ID NO: 5278483 - DNA, 20 bp, Homo sapiens
atttataactcatcataaaa

SEQ ID NO: 5278484 - DNA, 21 bp, Homo sapiens
atttataactcatcataaaat

SEQ ID NO: 5278485 - DNA, 21 bp, Homo sapiens
atttataagcattgccattga

SEQ ID NO: 5278486 - DNA, 18 bp, Homo sapiens
atttataaggacagagat

SEQ ID NO: 5278487 - DNA, 23 bp, Homo sapiens
atttataatataaatcaatctta

SEQ ID NO: 5278488 - DNA, 13 bp, Homo sapiens
atttataatcact

SEQ ID NO: 5278489 - DNA, 15 bp, Homo sapiens
atttataatcacttt

SEQ ID NO: 5278490 - DNA, 14 bp, Homo sapiens
atttataatgtatt

SEQ ID NO: 5278491 - DNA, 16 bp, Homo sapiens
atttataatgtatttg

SEQ ID NO: 5278492 - DNA, 14 bp, Homo sapiens
atttataatgttag

SEQ ID NO: 5278493 - DNA, 16 bp, Homo sapiens
atttataatgttagta

SEQ ID NO: 5278494 - DNA, 16 bp, Homo sapiens
atttataattaaagaa

SEQ ID NO: 5278495 - DNA, 14 bp, Homo sapiens
atttataattccta

SEQ ID NO: 5278496 - DNA, 11 bp, Homo sapiens
atttataattg

SEQ ID NO: 5278497 - DNA, 15 bp, Homo sapiens
atttataatttaaat

SEQ ID NO: 5278498 - DNA, 12 bp, Homo sapiens
atttataatttt

SEQ ID NO: 5278499 - DNA, 19 bp, Homo sapiens
atttataattttaagattc

SEQ ID NO: 5278500 - DNA, 15 bp, Homo sapiens
atttatacaaaataa

SEQ ID NO: 5278501 - DNA, 22 bp, Homo sapiens
atttatacaaaataatttaact

SEQ ID NO: 5278502 - DNA, 16 bp, Homo sapiens
atttatacaaagaaac

SEQ ID NO: 5278503 - DNA, 14 bp, Homo sapiens
atttatacaaatta

SEQ ID NO: 5278504 - DNA, 18 bp, Homo sapiens
atttatacaaattagaaa

SEQ ID NO: 5278505 - DNA, 19 bp, Homo sapiens
atttatacaggtcatatta

SEQ ID NO: 5278506 - DNA, 21 bp, Homo sapiens
atttataccattataccagca

SEQ ID NO: 5278507 - DNA, 17 bp, Homo sapiens
atttatacctaactgaa

SEQ ID NO: 5278508 - DNA, 23 bp, Homo sapiens
atttatactctagaacatgcaca

SEQ ID NO: 5278509 - DNA, 20 bp, Homo sapiens
atttatactcttttttcatg

SEQ ID NO: 5278510 - DNA, 15 bp, Homo sapiens
atttatactggcatg

SEQ ID NO: 5278511 - DNA, 20 bp, Homo sapiens
atttatactggtaacttatt

SEQ ID NO: 5278512 - DNA, 12 bp, Homo sapiens
atttatactgta

SEQ ID NO: 5278513 - DNA, 19 bp, Homo sapiens
atttatactgtagcaatat

SEQ ID NO: 5278514 - DNA, 20 bp, Homo sapiens
atttatactgtagcaatata

SEQ ID NO: 5278515 - DNA, 17 bp, Homo sapiens
atttatactgtatatat

SEQ ID NO: 5278516 - DNA, 20 bp, Homo sapiens
atttatactttaaagtattt

SEQ ID NO: 5278517 - DNA, 14 bp, Homo sapiens
atttatagaaatga

SEQ ID NO: 5278518 - DNA, 16 bp, Homo sapiens
atttatagaaatgaca

SEQ ID NO: 5278519 - DNA, 18 bp, Homo sapiens
atttatagaataatttct

SEQ ID NO: 5278520 - DNA, 18 bp, Homo sapiens
atttatagaatttaatat

SEQ ID NO: 5278521 - DNA, 14 bp, Homo sapiens
atttatagatcatt

SEQ ID NO: 5278522 - DNA, 23 bp, Homo sapiens
atttatagctgtaggttttctgt

SEQ ID NO: 5278523 - DNA, 18 bp, Homo sapiens
atttataggcagatcttt

SEQ ID NO: 5278524 - DNA, 22 bp, Homo sapiens
atttataggccagggcatgtgt

SEQ ID NO: 5278525 - DNA, 23 bp, Homo sapiens
atttataggccagggcatgtgta

SEQ ID NO: 5278526 - DNA, 14 bp, Homo sapiens
atttatagggcttt

SEQ ID NO: 5278527 - DNA, 17 bp, Homo sapiens
atttatagggcttttat

SEQ ID NO: 5278528 - DNA, 17 bp, Homo sapiens
atttatagtatgtgact

SEQ ID NO: 5278529 - DNA, 20 bp, Homo sapiens
atttatagtttatacagttt

SEQ ID NO: 5278530 - DNA, 17 bp, Homo sapiens
atttatataagtctgtt

SEQ ID NO: 5278531 - DNA, 14 bp, Homo sapiens
atttatataattat

SEQ ID NO: 5278532 - DNA, 20 bp, Homo sapiens
atttatataattatgttatt

SEQ ID NO: 5278533 - DNA, 22 bp, Homo sapiens
atttatataattatgttattga

SEQ ID NO: 5278534 - DNA, 21 bp, Homo sapiens
atttatatactttttcatgaa

SEQ ID NO: 5278535 - DNA, 15 bp, Homo sapiens
atttatatagattat

SEQ ID NO: 5278536 - DNA, 11 bp, Homo sapiens
atttatatata

SEQ ID NO: 5278537 - DNA, 19 bp, Homo sapiens
atttatatatatatgtata

SEQ ID NO: 5278538 - DNA, 16 bp, Homo sapiens
atttatatatgaaaac

SEQ ID NO: 5278539 - DNA, 18 bp, Homo sapiens
atttatatatggcatatt

SEQ ID NO: 5278540 - DNA, 19 bp, Homo sapiens
atttatatatggcatattt

SEQ ID NO: 5278541 - DNA, 23 bp, Homo sapiens
atttatatatggcatatttatat

SEQ ID NO: 5278542 - DNA, 14 bp, Homo sapiens
atttatatattgaa

SEQ ID NO: 5278543 - DNA, 15 bp, Homo sapiens
atttatatattggta

SEQ ID NO: 5278544 - DNA, 15 bp, Homo sapiens
atttatatattgtct

SEQ ID NO: 5278545 - DNA, 18 bp, Homo sapiens
atttatatatttataact

SEQ ID NO: 5278546 - DNA, 19 bp, Homo sapiens
atttatatatttataactc

SEQ ID NO: 5278547 - DNA, 12 bp, Homo sapiens
atttatatctat

SEQ ID NO: 5278548 - DNA, 18 bp, Homo sapiens
atttatatctatagtagt

SEQ ID NO: 5278549 - DNA, 13 bp, Homo sapiens
atttatatcttgt

SEQ ID NO: 5278550 - DNA, 23 bp, Homo sapiens
atttatatcttgttattaatgtt

SEQ ID NO: 5278551 - DNA, 16 bp, Homo sapiens
atttatatctttatgc

SEQ ID NO: 5278552 - DNA, 18 bp, Homo sapiens
atttatatctttatgcaa

SEQ ID NO: 5278553 - DNA, 14 bp, Homo sapiens
atttatatgaagca

SEQ ID NO: 5278554 - DNA, 19 bp, Homo sapiens
attaaattttttttacatt

SEQ ID NO: 5278555 - DNA, 20 bp, Homo sapiens
attaaattttttttacattt

SEQ ID NO: 5278556 - DNA, 17 bp, Homo sapiens
attaacaaagcaacctt

SEQ ID NO: 5278557 - DNA, 19 bp, Homo sapiens
attaacaaagttactggct

SEQ ID NO: 5278558 - DNA, 17 bp, Homo sapiens
attaacaaatatgctaa

SEQ ID NO: 5278559 - DNA, 22 bp, Homo sapiens
attaacaaatgctctgtcttca

SEQ ID NO: 5278560 - DNA, 16 bp, Homo sapiens
attaacaaattgcatt

SEQ ID NO: 5278561 - DNA, 18 bp, Homo sapiens
attaacaacaataacact

SEQ ID NO: 5278562 - DNA, 15 bp, Homo sapiens
attaacaactgtgaa

SEQ ID NO: 5278563 - DNA, 23 bp, Homo sapiens
attaacaactgtgaatatgagaa

SEQ ID NO: 5278564 - DNA, 15 bp, Homo sapiens
attaacaataaagca

SEQ ID NO: 5278565 - DNA, 16 bp, Homo sapiens
attaacaattaattgt

SEQ ID NO: 5278566 - DNA, 14 bp, Homo sapiens
attaacacactgaa

SEQ ID NO: 5278567 - DNA, 21 bp, Homo sapiens
attaacactactcaaagcaaa

SEQ ID NO: 5278568 - DNA, 15 bp, Homo sapiens
attaacactgagatc

SEQ ID NO: 5278569 - DNA, 11 bp, Homo sapiens
attaacactgc

SEQ ID NO: 5278570 - DNA, 22 bp, Homo sapiens
attaacaggtctttgaaatatg

SEQ ID NO: 5278571 - DNA, 20 bp, Homo sapiens
attaacagtattaaatgact

SEQ ID NO: 5278572 - DNA, 15 bp, Homo sapiens
attaacagtatttct

SEQ ID NO: 5278573 - DNA, 12 bp, Homo sapiens
attaacagtttt

SEQ ID NO: 5278574 - DNA, 22 bp, Homo sapiens
attaacagttttccatgaaaac

SEQ ID NO: 5278575 - DNA, 19 bp, Homo sapiens
attaacatacatcattcca

SEQ ID NO: 5278576 - DNA, 23 bp, Homo sapiens
attaacatacctaagaagtacat

SEQ ID NO: 5278577 - DNA, 24 bp, Homo sapiens
attaacatacctaagaagtacatt

SEQ ID NO: 5278578 - DNA, 14 bp, Homo sapiens
attaacatataata

SEQ ID NO: 5278579 - DNA, 17 bp, Homo sapiens
attaacatataatatat

SEQ ID NO: 5278580 - DNA, 18 bp, Homo sapiens
attaacatataatatatg

SEQ ID NO: 5278581 - DNA, 13 bp, Homo sapiens
attaacatatatt

SEQ ID NO: 5278582 - DNA, 13 bp, Homo sapiens
attaacatatcaa

SEQ ID NO: 5278583 - DNA, 15 bp, Homo sapiens
attaacatatcttta

SEQ ID NO: 5278584 - DNA, 19 bp, Homo sapiens
attaacatattatttcatt

SEQ ID NO: 5278585 - DNA, 22 bp, Homo sapiens
attaacatcatcaggcttggaa

SEQ ID NO: 5278586 - DNA, 17 bp, Homo sapiens
attaacatcgtgggtca

SEQ ID NO: 5278587 - DNA, 21 bp, Homo sapiens
attaacatgaatatttagtgt

SEQ ID NO: 5278588 - DNA, 11 bp, Homo sapiens
attaacatgat

SEQ ID NO: 5278589 - DNA, 23 bp, Homo sapiens
attaacatgatgtactaaagtag

SEQ ID NO: 5278590 - DNA, 18 bp, Homo sapiens
attaacatgcaataacaa

SEQ ID NO: 5278591 - DNA, 13 bp, Homo sapiens
attaacatgttaa

SEQ ID NO: 5278592 - DNA, 14 bp, Homo sapiens
attaacatgttaaa

SEQ ID NO: 5278593 - DNA, 15 bp, Homo sapiens
attaacatgttaaac

SEQ ID NO: 5278594 - DNA, 12 bp, Homo sapiens
attaacatgttt

SEQ ID NO: 5278595 - DNA, 19 bp, Homo sapiens
attaacattgggaaatctt

SEQ ID NO: 5278596 - DNA, 17 bp, Homo sapiens
attaaccaaaaaagtta

SEQ ID NO: 5278597 - DNA, 18 bp, Homo sapiens
attaaccaaagaaagtgg

SEQ ID NO: 5278598 - DNA, 19 bp, Homo sapiens
attaaccaaattaaccttt

SEQ ID NO: 5278599 - DNA, 22 bp, Homo sapiens
attaaccagctgatttttctta

SEQ ID NO: 5278600 - DNA, 23 bp, Homo sapiens
attaaccatttaataaagaaata

SEQ ID NO: 5278601 - DNA, 21 bp, Homo sapiens
attaacccccaaattcaaaag

SEQ ID NO: 5278602 - DNA, 21 bp, Homo sapiens
attaaccccttctttcatgtt

SEQ ID NO: 5278603 - DNA, 17 bp, Homo sapiens
attaaccgatgctttac

SEQ ID NO: 5278604 - DNA, 21 bp, Homo sapiens
attaaccgatgctttaccaaa

SEQ ID NO: 5278605 - DNA, 18 bp, Homo sapiens
attaacctaatgcagaat

SEQ ID NO: 5278606 - DNA, 23 bp, Homo sapiens
attaacctacttgtaaacttgaa

SEQ ID NO: 5278607 - DNA, 22 bp, Homo sapiens
attaacctgaaagaacatacat

SEQ ID NO: 5278608 - DNA, 14 bp, Homo sapiens
attaaccttttcaa

SEQ ID NO: 5278609 - DNA, 16 bp, Homo sapiens
attaaccttttcaaat

SEQ ID NO: 5278610 - DNA, 17 bp, Homo sapiens
attaaccttttttgtct

SEQ ID NO: 5278611 - DNA, 23 bp, Homo sapiens
attaaccttttttgtcttattga

SEQ ID NO: 5278612 - DNA, 15 bp, Homo sapiens
attaacgatgtccaa

SEQ ID NO: 5278613 - DNA, 14 bp, Homo sapiens
attaacgggcatgt

SEQ ID NO: 5278614 - DNA, 16 bp, Homo sapiens
attaacgggcatgtat

SEQ ID NO: 5278615 - DNA, 18 bp, Homo sapiens
attaacgggcatgtatta

SEQ ID NO: 5278616 - DNA, 22 bp, Homo sapiens
attaacggtgctaaccccgtct

SEQ ID NO: 5278617 - DNA, 16 bp, Homo sapiens
attaactaaagaagag

SEQ ID NO: 5278618 - DNA, 15 bp, Homo sapiens
attaactaaatgctc

SEQ ID NO: 5278619 - DNA, 18 bp, Homo sapiens
attaactaaggaaatatt

SEQ ID NO: 5278620 - DNA, 19 bp, Homo sapiens
attaactataacaatcact

SEQ ID NO: 5278621 - DNA, 15 bp, Homo sapiens
attaactatgtgatg

SEQ ID NO: 5278622 - DNA, 21 bp, Homo sapiens
attaactccctccaccagcct

SEQ ID NO: 5278623 - DNA, 16 bp, Homo sapiens
attaactctaactgtg

SEQ ID NO: 5278624 - DNA, 16 bp, Homo sapiens
attaactctctgctat

SEQ ID NO: 5278625 - DNA, 16 bp, Homo sapiens
attaactctggacctc

SEQ ID NO: 5278626 - DNA, 22 bp, Homo sapiens
attaactggtagttcattgtaa

SEQ ID NO: 5278627 - DNA, 13 bp, Homo sapiens
attaactgtatgt

SEQ ID NO: 5278628 - DNA, 20 bp, Homo sapiens
attaactgtattttctttca

SEQ ID NO: 5278629 - DNA, 16 bp, Homo sapiens
attaactgtgaaatgt

SEQ ID NO: 5278630 - DNA, 17 bp, Homo sapiens
attaactgtgaaatgta

SEQ ID NO: 5278631 - DNA, 13 bp, Homo sapiens
attaacttaactg

SEQ ID NO: 5278632 - DNA, 15 bp, Homo sapiens
attaacttaactgaa

SEQ ID NO: 5278633 - DNA, 16 bp, Homo sapiens
attaacttaataatca

SEQ ID NO: 5278634 - DNA, 19 bp, Homo sapiens
attaacttaccctgtatat

SEQ ID NO: 5278635 - DNA, 12 bp, Homo sapiens
attaacttattt

SEQ ID NO: 5278636 - DNA, 14 bp, Homo sapiens
attaacttatttag

SEQ ID NO: 5278637 - DNA, 15 bp, Homo sapiens
attaacttatttaga

SEQ ID NO: 5278638 - DNA, 18 bp, Homo sapiens
attaacttgaaaattttt

SEQ ID NO: 5278639 - DNA, 20 bp, Homo sapiens
attaacttggatgagttttg

SEQ ID NO: 5278640 - DNA, 20 bp, Homo sapiens
attaactttcaaaagcaaac

SEQ ID NO: 5278641 - DNA, 16 bp, Homo sapiens
attaacttttataaac

SEQ ID NO: 5278642 - DNA, 19 bp, Homo sapiens
attaacttttataaacttt

SEQ ID NO: 5278643 - DNA, 23 bp, Homo sapiens
attaacttttataaactttacct

SEQ ID NO: 5278644 - DNA, 13 bp, Homo sapiens
attaacttttgta

SEQ ID NO: 5278645 - DNA, 17 bp, Homo sapiens
attaacttttttagaat

SEQ ID NO: 5278646 - DNA, 19 bp, Homo sapiens
attaacttttttagaatga

SEQ ID NO: 5278647 - DNA, 14 bp, Homo sapiens
attaagaaaacatt

SEQ ID NO: 5278648 - DNA, 12 bp, Homo sapiens
attaagaaaata

SEQ ID NO: 5278649 - DNA, 14 bp, Homo sapiens
attaagaaaatatt

SEQ ID NO: 5278650 - DNA, 15 bp, Homo sapiens
attaagaaaatctat

SEQ ID NO: 5278651 - DNA, 13 bp, Homo sapiens
attaagaaacaat

SEQ ID NO: 5278652 - DNA, 14 bp, Homo sapiens
attaagaaacaatt

SEQ ID NO: 5278653 - DNA, 20 bp, Homo sapiens
attaagaaagattaaatata

SEQ ID NO: 5278654 - DNA, 12 bp, Homo sapiens
attaagaaagga

SEQ ID NO: 5278655 - DNA, 23 bp, Homo sapiens
attaagaaaggaagcattgtaaa

SEQ ID NO: 5278656 - DNA, 12 bp, Homo sapiens
attaagaacatt

SEQ ID NO: 5278657 - DNA, 17 bp, Homo sapiens
attaagaactgaatcca

SEQ ID NO: 5278658 - DNA, 20 bp, Homo sapiens
attaagaatatgtttccttg

SEQ ID NO: 5278659 - DNA, 21 bp, Homo sapiens
attaagaatatgtttccttgt

SEQ ID NO: 5278660 - DNA, 16 bp, Homo sapiens
attaagaatgatctga

SEQ ID NO: 5278661 - DNA, 21 bp, Homo sapiens
attaagacaaaaagccttgaa

SEQ ID NO: 5278662 - DNA, 13 bp, Homo sapiens
attaagacagcat

SEQ ID NO: 5278663 - DNA, 19 bp, Homo sapiens
attaagacagtgtacaaaa

SEQ ID NO: 5278664 - DNA, 14 bp, Homo sapiens
attaagaccaaaga

SEQ ID NO: 5278665 - DNA, 16 bp, Homo sapiens
attaagaccaaagact

SEQ ID NO: 5278666 - DNA, 17 bp, Homo sapiens
attaagagaacaaagag

SEQ ID NO: 5278667 - DNA, 22 bp, Homo sapiens
attaagagaacaaagagtgaaa

SEQ ID NO: 5278668 - DNA, 14 bp, Homo sapiens
attaagagatgaag

SEQ ID NO: 5278669 - DNA, 16 bp, Homo sapiens
attaagagctatttta

SEQ ID NO: 5278670 - DNA, 16 bp, Homo sapiens
attaagagttactcag

SEQ ID NO: 5278671 - DNA, 17 bp, Homo sapiens
attaagataaatagagt

SEQ ID NO: 5278672 - DNA, 15 bp, Homo sapiens
attaagatacaaatt

SEQ ID NO: 5278673 - DNA, 19 bp, Homo sapiens
attaagatacactcctgct

SEQ ID NO: 5278674 - DNA, 14 bp, Homo sapiens
attaagatctgtgt

SEQ ID NO: 5278675 - DNA, 14 bp, Homo sapiens
attaagatgagcaa

SEQ ID NO: 5278676 - DNA, 18 bp, Homo sapiens
attaagatgccttgaatt

SEQ ID NO: 5278677 - DNA, 14 bp, Homo sapiens
attaagatgtatat

SEQ ID NO: 5278678 - DNA, 11 bp, Homo sapiens
attaagatgtt

SEQ ID NO: 5278679 - DNA, 15 bp, Homo sapiens
attaagatgttgtct

SEQ ID NO: 5278680 - DNA, 18 bp, Homo sapiens
attaagattataattgtt

SEQ ID NO: 5278681 - DNA, 17 bp, Homo sapiens
attaagattattgtctg

SEQ ID NO: 5278682 - DNA, 22 bp, Homo sapiens
attaagattattgtctgattga

SEQ ID NO: 5278683 - DNA, 15 bp, Homo sapiens
attaagattttacaa

SEQ ID NO: 5278684 - DNA, 18 bp, Homo sapiens
attaagattttacaaaag

SEQ ID NO: 5278685 - DNA, 18 bp, Homo sapiens
attaagattttactttaa

SEQ ID NO: 5278686 - DNA, 22 bp, Homo sapiens
attaagattttactttaacagt

SEQ ID NO: 5278687 - DNA, 11 bp, Homo sapiens
attaagcacat

SEQ ID NO: 5278688 - DNA, 18 bp, Homo sapiens
attaagcacattattgta

SEQ ID NO: 5278689 - DNA, 17 bp, Homo sapiens
attaagcagactggaaa

SEQ ID NO: 5278690 - DNA, 15 bp, Homo sapiens
attaagcagttcatt

SEQ ID NO: 5278691 - DNA, 15 bp, Homo sapiens
attaagcatatattt

SEQ ID NO: 5278692 - DNA, 16 bp, Homo sapiens
attaagcatatgtgtt

SEQ ID NO: 5278693 - DNA, 18 bp, Homo sapiens
attaagcatcacaaatga

SEQ ID NO: 5278694 - DNA, 15 bp, Homo sapiens
attaagcattctttc

SEQ ID NO: 5278695 - DNA, 20 bp, Homo sapiens
attaagccacttaaaatgtt

SEQ ID NO: 5278696 - DNA, 13 bp, Homo sapiens
attaagcccaatc

SEQ ID NO: 5278697 - DNA, 19 bp, Homo sapiens
attaagcccacagtatatt

SEQ ID NO: 5278698 - DNA, 20 bp, Homo sapiens
attaagcccacagtatattt

SEQ ID NO: 5278699 - DNA, 16 bp, Homo sapiens
attaagccctcttcca

SEQ ID NO: 5278700 - DNA, 15 bp, Homo sapiens
attaagccttccaca

SEQ ID NO: 5278701 - DNA, 15 bp, Homo sapiens
attaagctaaaaggt

SEQ ID NO: 5278702 - DNA, 23 bp, Homo sapiens
attaagctaatggtcctgttatg

SEQ ID NO: 5278703 - DNA, 18 bp, Homo sapiens
attaagcttttcatttta

SEQ ID NO: 5278704 - DNA, 17 bp, Homo sapiens
attaagctttttggaat

SEQ ID NO: 5278705 - DNA, 11 bp, Homo sapiens
attaaggaagt

SEQ ID NO: 5278706 - DNA, 18 bp, Homo sapiens
attaaggaagtaactttt

SEQ ID NO: 5278707 - DNA, 19 bp, Homo sapiens
attaaggactacagaattg

SEQ ID NO: 5278708 - DNA, 23 bp, Homo sapiens
attaaggatgtagcttttcacct

SEQ ID NO: 5278709 - DNA, 20 bp, Homo sapiens
attaaggattttatgcttta

SEQ ID NO: 5278710 - DNA, 20 bp, Homo sapiens
attaaggcaactgaacaaaa

SEQ ID NO: 5278711 - DNA, 21 bp, Homo sapiens
attaaggcaactgaacaaaaa

SEQ ID NO: 5278712 - DNA, 16 bp, Homo sapiens
attaaggcagtatgat

SEQ ID NO: 5278713 - DNA, 16 bp, Homo sapiens
attaaggcgtgagcca

SEQ ID NO: 5278714 - DNA, 12 bp, Homo sapiens
attaagggacat

SEQ ID NO: 5278715 - DNA, 17 bp, Homo sapiens
attaagggacatgtatg

SEQ ID NO: 5278716 - DNA, 16 bp, Homo sapiens
attaagggacatttct

SEQ ID NO: 5278717 - DNA, 15 bp, Homo sapiens
attaagggagctgag

SEQ ID NO: 5278718 - DNA, 17 bp, Homo sapiens
attaagggcattttacc

SEQ ID NO: 5278719 - DNA, 17 bp, Homo sapiens
attaagggccagaaaaa

SEQ ID NO: 5278720 - DNA, 20 bp, Homo sapiens
attaagggccgatttaatta

SEQ ID NO: 5278721 - DNA, 14 bp, Homo sapiens
attaagggcctgct

SEQ ID NO: 5278722 - DNA, 15 bp, Homo sapiens
attaagggcctgctg

SEQ ID NO: 5278723 - DNA, 16 bp, Homo sapiens
attaagggctacttaa

SEQ ID NO: 5278724 - DNA, 18 bp, Homo sapiens
attaagggttaccccacc

SEQ ID NO: 5278725 - DNA, 18 bp, Homo sapiens
attaaggtacatcattat

SEQ ID NO: 5278726 - DNA, 22 bp, Homo sapiens
attaaggtatttcgaaactgcc

SEQ ID NO: 5278727 - DNA, 17 bp, Homo sapiens
attaaggtcaagcccag

SEQ ID NO: 5278728 - DNA, 15 bp, Homo sapiens
attaaggtctctctt

SEQ ID NO: 5278729 - DNA, 20 bp, Homo sapiens
attaaggtgtttgaaaatag

SEQ ID NO: 5278730 - DNA, 18 bp, Homo sapiens
attaagtaaactaatgag

SEQ ID NO: 5278731 - DNA, 15 bp, Homo sapiens
attaagtaaatgctg

SEQ ID NO: 5278732 - DNA, 18 bp, Homo sapiens
attaagtaatcaataaag

SEQ ID NO: 5278733 - DNA, 13 bp, Homo sapiens
attaagtaatctt

SEQ ID NO: 5278734 - DNA, 19 bp, Homo sapiens
atttatatgaagcaagctg

SEQ ID NO: 5278735 - DNA, 12 bp, Homo sapiens
atttatatgcat

SEQ ID NO: 5278736 - DNA, 22 bp, Homo sapiens
atttatatgcttcacatagcat

SEQ ID NO: 5278737 - DNA, 20 bp, Homo sapiens
atttatatggggaatatatt

SEQ ID NO: 5278738 - DNA, 19 bp, Homo sapiens
atttatatggtgttaaaat

SEQ ID NO: 5278739 - DNA, 11 bp, Homo sapiens
atttatatgta

SEQ ID NO: 5278740 - DNA, 14 bp, Homo sapiens
atttatatgtacat

SEQ ID NO: 5278741 - DNA, 13 bp, Homo sapiens
atttatatgtatg

SEQ ID NO: 5278742 - DNA, 14 bp, Homo sapiens
atttatatgtatgt

SEQ ID NO: 5278743 - DNA, 17 bp, Homo sapiens
atttatatgtatgtgtt

SEQ ID NO: 5278744 - DNA, 18 bp, Homo sapiens
atttatatgtatgtgttt

SEQ ID NO: 5278745 - DNA, 14 bp, Homo sapiens
atttatatgtgtaa

SEQ ID NO: 5278746 - DNA, 17 bp, Homo sapiens
atttatatgtgtaattt

SEQ ID NO: 5278747 - DNA, 12 bp, Homo sapiens
atttatatgtta

SEQ ID NO: 5278748 - DNA, 14 bp, Homo sapiens
atttatatgttaat

SEQ ID NO: 5278749 - DNA, 18 bp, Homo sapiens
atttatatgttaatttgt

SEQ ID NO: 5278750 - DNA, 20 bp, Homo sapiens
atttatatgttattaaacag

SEQ ID NO: 5278751 - DNA, 23 bp, Homo sapiens
atttatatgttattaaacaggtg

SEQ ID NO: 5278752 - DNA, 23 bp, Homo sapiens
atttatattcagagatgtaccat

SEQ ID NO: 5278753 - DNA, 21 bp, Homo sapiens
atttatattcataaagttaca

SEQ ID NO: 5278754 - DNA, 16 bp, Homo sapiens
atttatattcatcaaa

SEQ ID NO: 5278755 - DNA, 15 bp, Homo sapiens
atttatattccattt

SEQ ID NO: 5278756 - DNA, 15 bp, Homo sapiens
atttatattccgtat

SEQ ID NO: 5278757 - DNA, 20 bp, Homo sapiens
atttatattgtaaatattgt

SEQ ID NO: 5278758 - DNA, 18 bp, Homo sapiens
atttatattgtatattct

SEQ ID NO: 5278759 - DNA, 14 bp, Homo sapiens
atttatatttgtct

SEQ ID NO: 5278760 - DNA, 18 bp, Homo sapiens
atttatatttgtgtattt

SEQ ID NO: 5278761 - DNA, 18 bp, Homo sapiens
atttatatttttatttta

SEQ ID NO: 5278762 - DNA, 15 bp, Homo sapiens
atttatcaaaaaaca

SEQ ID NO: 5278763 - DNA, 16 bp, Homo sapiens
atttatcaaaatgtag

SEQ ID NO: 5278764 - DNA, 13 bp, Homo sapiens
atttatcaaagca

SEQ ID NO: 5278765 - DNA, 17 bp, Homo sapiens
atttatcaaatcagtca

SEQ ID NO: 5278766 - DNA, 14 bp, Homo sapiens
atttatcaagcatt

SEQ ID NO: 5278767 - DNA, 17 bp, Homo sapiens
atttatcacacaaagca

SEQ ID NO: 5278768 - DNA, 19 bp, Homo sapiens
atttatcacacaaagcaga

SEQ ID NO: 5278769 - DNA, 15 bp, Homo sapiens
atttatcagtgacag

SEQ ID NO: 5278770 - DNA, 17 bp, Homo sapiens
atttatcagtgacagag

SEQ ID NO: 5278771 - DNA, 18 bp, Homo sapiens
atttatcagtgacagagt

SEQ ID NO: 5278772 - DNA, 23 bp, Homo sapiens
atttatcagtgacagagttcact

SEQ ID NO: 5278773 - DNA, 22 bp, Homo sapiens
atttatcattttagtatagttt

SEQ ID NO: 5278774 - DNA, 18 bp, Homo sapiens
atttatccaaaatgtgta

SEQ ID NO: 5278775 - DNA, 19 bp, Homo sapiens
atttatccaaaatgtgtat

SEQ ID NO: 5278776 - DNA, 16 bp, Homo sapiens
atttatccaaagcatt

SEQ ID NO: 5278777 - DNA, 20 bp, Homo sapiens
atttatccagaaaactgtga

SEQ ID NO: 5278778 - DNA, 15 bp, Homo sapiens
atttatccaggaatt

SEQ ID NO: 5278779 - DNA, 15 bp, Homo sapiens
atttatccatttgta

SEQ ID NO: 5278780 - DNA, 16 bp, Homo sapiens
atttatccctcattca

SEQ ID NO: 5278781 - DNA, 16 bp, Homo sapiens
atttatccctttacaa

SEQ ID NO: 5278782 - DNA, 17 bp, Homo sapiens
atttatccctttacaat

SEQ ID NO: 5278783 - DNA, 23 bp, Homo sapiens
atttatccctttacaatgtgaat

SEQ ID NO: 5278784 - DNA, 12 bp, Homo sapiens
atttatcctctg

SEQ ID NO: 5278785 - DNA, 18 bp, Homo sapiens
atttatcctgaaatttca

SEQ ID NO: 5278786 - DNA, 17 bp, Homo sapiens
atttatcgcagaccttt

SEQ ID NO: 5278787 - DNA, 19 bp, Homo sapiens
atttatcgctgggaaatga

SEQ ID NO: 5278788 - DNA, 17 bp, Homo sapiens
atttatctaaatatgga

SEQ ID NO: 5278789 - DNA, 11 bp, Homo sapiens
atttatctata

SEQ ID NO: 5278790 - DNA, 16 bp, Homo sapiens
atttatctattaaaat

SEQ ID NO: 5278791 - DNA, 14 bp, Homo sapiens
atttatctccctta

SEQ ID NO: 5278792 - DNA, 22 bp, Homo sapiens
atttatctcccttagaagagag

SEQ ID NO: 5278793 - DNA, 23 bp, Homo sapiens
atttatctcctcttcatggcatc

SEQ ID NO: 5278794 - DNA, 14 bp, Homo sapiens
atttatctctattt

SEQ ID NO: 5278795 - DNA, 18 bp, Homo sapiens
atttatctgcaaggattt

SEQ ID NO: 5278796 - DNA, 15 bp, Homo sapiens
atttatcttcatgtc

SEQ ID NO: 5278797 - DNA, 24 bp, Homo sapiens
atttatcttctgtttttctcaaat

SEQ ID NO: 5278798 - DNA, 20 bp, Homo sapiens
atttatcttgaaggaaaaat

SEQ ID NO: 5278799 - DNA, 15 bp, Homo sapiens
atttatctttaccaa

SEQ ID NO: 5278800 - DNA, 17 bp, Homo sapiens
atttatctttaccaaaa

SEQ ID NO: 5278801 - DNA, 24 bp, Homo sapiens
atttatctttaccaaaaaccatgt

SEQ ID NO: 5278802 - DNA, 15 bp, Homo sapiens
atttatctttataca

SEQ ID NO: 5278803 - DNA, 19 bp, Homo sapiens
atttatctttatacagatt

SEQ ID NO: 5278804 - DNA, 20 bp, Homo sapiens
atttatctttatacagattt

SEQ ID NO: 5278805 - DNA, 16 bp, Homo sapiens
atttatctttcaaaga

SEQ ID NO: 5278806 - DNA, 18 bp, Homo sapiens
atttatcttttgggtctg

SEQ ID NO: 5278807 - DNA, 23 bp, Homo sapiens
atttatcttttgggtctgtcctc

SEQ ID NO: 5278808 - DNA, 16 bp, Homo sapiens
atttatcttttttcct

SEQ ID NO: 5278809 - DNA, 13 bp, Homo sapiens
atttatgaaaaga

SEQ ID NO: 5278810 - DNA, 20 bp, Homo sapiens
atttatgaacagaaatattg

SEQ ID NO: 5278811 - DNA, 19 bp, Homo sapiens
atttatgaagaaaatactt

SEQ ID NO: 5278812 - DNA, 14 bp, Homo sapiens
atttatgaagcaga

SEQ ID NO: 5278813 - DNA, 22 bp, Homo sapiens
atttatgaagtttaaaacagta

SEQ ID NO: 5278814 - DNA, 14 bp, Homo sapiens
atttatgaatataa

SEQ ID NO: 5278815 - DNA, 21 bp, Homo sapiens
atttatgaattgtctaaagtt

SEQ ID NO: 5278816 - DNA, 24 bp, Homo sapiens
atttatgacaagctgtatcactgc

SEQ ID NO: 5278817 - DNA, 18 bp, Homo sapiens
atttatgacctgaaataa

SEQ ID NO: 5278818 - DNA, 18 bp, Homo sapiens
atttatgagatcactgaa

SEQ ID NO: 5278819 - DNA, 12 bp, Homo sapiens
atttatgagatt

SEQ ID NO: 5278820 - DNA, 18 bp, Homo sapiens
atttatgagatttactgc

SEQ ID NO: 5278821 - DNA, 17 bp, Homo sapiens
atttatgagctcttcat

SEQ ID NO: 5278822 - DNA, 16 bp, Homo sapiens
atttatgataactatt

SEQ ID NO: 5278823 - DNA, 22 bp, Homo sapiens
atttatgatgcagcagatgttg

SEQ ID NO: 5278824 - DNA, 15 bp, Homo sapiens
atttatgatgttatt

SEQ ID NO: 5278825 - DNA, 19 bp, Homo sapiens
atttatgatgttattttgt

SEQ ID NO: 5278826 - DNA, 18 bp, Homo sapiens
atttatgattattcaaga

SEQ ID NO: 5278827 - DNA, 13 bp, Homo sapiens
atttatgatttaa

SEQ ID NO: 5278828 - DNA, 15 bp, Homo sapiens
atttatgatttaata

SEQ ID NO: 5278829 - DNA, 16 bp, Homo sapiens
atttatgatttaataa

SEQ ID NO: 5278830 - DNA, 17 bp, Homo sapiens
atttatgatttaataaa

SEQ ID NO: 5278831 - DNA, 19 bp, Homo sapiens
atttatgatttaataaaat

SEQ ID NO: 5278832 - DNA, 13 bp, Homo sapiens
atttatgcacatt

SEQ ID NO: 5278833 - DNA, 16 bp, Homo sapiens
atttatgcagagacag

SEQ ID NO: 5278834 - DNA, 22 bp, Homo sapiens
atttatgcatattattttatgt

SEQ ID NO: 5278835 - DNA, 13 bp, Homo sapiens
atttatgcatgag

SEQ ID NO: 5278836 - DNA, 19 bp, Homo sapiens
atttatgcatggaaacctg

SEQ ID NO: 5278837 - DNA, 15 bp, Homo sapiens
atttatgcatttcat

SEQ ID NO: 5278838 - DNA, 18 bp, Homo sapiens
atttatgcatttcattca

SEQ ID NO: 5278839 - DNA, 20 bp, Homo sapiens
atttatgcctctgtatttaa

SEQ ID NO: 5278840 - DNA, 14 bp, Homo sapiens
atttatgctaatat

SEQ ID NO: 5278841 - DNA, 23 bp, Homo sapiens
atttatgctataaattttttgaa

SEQ ID NO: 5278842 - DNA, 22 bp, Homo sapiens
atttatggattaaaaactgctt

SEQ ID NO: 5278843 - DNA, 13 bp, Homo sapiens
atttatggcttat

SEQ ID NO: 5278844 - DNA, 15 bp, Homo sapiens
atttatgggcccctg

SEQ ID NO: 5278845 - DNA, 19 bp, Homo sapiens
atttatgggcccctggcac

SEQ ID NO: 5278846 - DNA, 19 bp, Homo sapiens
atttatggtaatcatatta

SEQ ID NO: 5278847 - DNA, 15 bp, Homo sapiens
atttatggttgttaa

SEQ ID NO: 5278848 - DNA, 16 bp, Homo sapiens
atttatggtttctgcg

SEQ ID NO: 5278849 - DNA, 17 bp, Homo sapiens
atttatggtttctgcgt

SEQ ID NO: 5278850 - DNA, 13 bp, Homo sapiens
atttatgtaaaag

SEQ ID NO: 5278851 - DNA, 13 bp, Homo sapiens
atttatgtacaaa

SEQ ID NO: 5278852 - DNA, 14 bp, Homo sapiens
atttatgtacaaaa

SEQ ID NO: 5278853 - DNA, 16 bp, Homo sapiens
atttatgtagacattg

SEQ ID NO: 5278854 - DNA, 20 bp, Homo sapiens
atttatgtagatgtgcattt

SEQ ID NO: 5278855 - DNA, 12 bp, Homo sapiens
atttatgtattg

SEQ ID NO: 5278856 - DNA, 14 bp, Homo sapiens
atttatgtattgtg

SEQ ID NO: 5278857 - DNA, 16 bp, Homo sapiens
atttatgtattttgaa

SEQ ID NO: 5278858 - DNA, 15 bp, Homo sapiens
atttatgtccaggtg

SEQ ID NO: 5278859 - DNA, 13 bp, Homo sapiens
atttatgtgaaca

SEQ ID NO: 5278860 - DNA, 22 bp, Homo sapiens
atttatgtgaggtaattattgc

SEQ ID NO: 5278861 - DNA, 22 bp, Homo sapiens
atttatgtgcaaggtgatagga

SEQ ID NO: 5278862 - DNA, 12 bp, Homo sapiens
atttatgtgtga

SEQ ID NO: 5278863 - DNA, 19 bp, Homo sapiens
atttatgtgtgaggagctg

SEQ ID NO: 5278864 - DNA, 16 bp, Homo sapiens
atttatgttaaaagat

SEQ ID NO: 5278865 - DNA, 14 bp, Homo sapiens
atttatgttctcaa

SEQ ID NO: 5278866 - DNA, 15 bp, Homo sapiens
atttatgttctcaac

SEQ ID NO: 5278867 - DNA, 14 bp, Homo sapiens
atttatgtttaagt

SEQ ID NO: 5278868 - DNA, 15 bp, Homo sapiens
atttatgtttaagtg

SEQ ID NO: 5278869 - DNA, 15 bp, Homo sapiens
atttatgttttcaca

SEQ ID NO: 5278870 - DNA, 17 bp, Homo sapiens
atttattaaaaacatga

SEQ ID NO: 5278871 - DNA, 22 bp, Homo sapiens
atttattaaaaatgttctcaaa

SEQ ID NO: 5278872 - DNA, 16 bp, Homo sapiens
atttattaaacttcag

SEQ ID NO: 5278873 - DNA, 18 bp, Homo sapiens
atttattaaacttcagca

SEQ ID NO: 5278874 - DNA, 18 bp, Homo sapiens
atttattaaagaaaaaaa

SEQ ID NO: 5278875 - DNA, 20 bp, Homo sapiens
atttattaaagaaaaaaatg

SEQ ID NO: 5278876 - DNA, 13 bp, Homo sapiens
atttattaaataa

SEQ ID NO: 5278877 - DNA, 14 bp, Homo sapiens
atttattaaataaa

SEQ ID NO: 5278878 - DNA, 18 bp, Homo sapiens
atttattaaatgtattat

SEQ ID NO: 5278879 - DNA, 15 bp, Homo sapiens
atttattaaatttat

SEQ ID NO: 5278880 - DNA, 14 bp, Homo sapiens
atttattaaatttt

SEQ ID NO: 5278881 - DNA, 20 bp, Homo sapiens
atttattaacttaataatca

SEQ ID NO: 5278882 - DNA, 15 bp, Homo sapiens
atttattaagtctgg

SEQ ID NO: 5278883 - DNA, 14 bp, Homo sapiens
atttattaatattt

SEQ ID NO: 5278884 - DNA, 11 bp, Homo sapiens
atttattaatt

SEQ ID NO: 5278885 - DNA, 18 bp, Homo sapiens
atttattaattgctttga

SEQ ID NO: 5278886 - DNA, 14 bp, Homo sapiens
atttattaatttga

SEQ ID NO: 5278887 - DNA, 18 bp, Homo sapiens
atttattaatttgaaacc

SEQ ID NO: 5278888 - DNA, 12 bp, Homo sapiens
atttattacaac

SEQ ID NO: 5278889 - DNA, 15 bp, Homo sapiens
atttattacacaaag

SEQ ID NO: 5278890 - DNA, 12 bp, Homo sapiens
atttattacata

SEQ ID NO: 5278891 - DNA, 14 bp, Homo sapiens
atttattacctctg

SEQ ID NO: 5278892 - DNA, 20 bp, Homo sapiens
atttattactgtaagaaaat

SEQ ID NO: 5278893 - DNA, 14 bp, Homo sapiens
atttattactgtcc

SEQ ID NO: 5278894 - DNA, 19 bp, Homo sapiens
atttattagccctgcattt

SEQ ID NO: 5278895 - DNA, 14 bp, Homo sapiens
atttattagctgta

SEQ ID NO: 5278896 - DNA, 15 bp, Homo sapiens
atttattagctgtaa

SEQ ID NO: 5278897 - DNA, 23 bp, Homo sapiens
atttattagttaggtgtgccaaa

SEQ ID NO: 5278898 - DNA, 12 bp, Homo sapiens
atttattatata

SEQ ID NO: 5278899 - DNA, 13 bp, Homo sapiens
atttattatataa

SEQ ID NO: 5278900 - DNA, 20 bp, Homo sapiens
atttattatatatttacaga

SEQ ID NO: 5278901 - DNA, 19 bp, Homo sapiens
atttattatcgcatacaga

SEQ ID NO: 5278902 - DNA, 23 bp, Homo sapiens
atttattatgctttattggaaaa

SEQ ID NO: 5278903 - DNA, 18 bp, Homo sapiens
atttattattaaatcagt

SEQ ID NO: 5278904 - DNA, 14 bp, Homo sapiens
atttattatttacc

SEQ ID NO: 5278905 - DNA, 19 bp, Homo sapiens
atttattatttatttatta

SEQ ID NO: 5278906 - DNA, 21 bp, Homo sapiens
atttattattttttttatatt

SEQ ID NO: 5278907 - DNA, 12 bp, Homo sapiens
atttattcaaga

SEQ ID NO: 5278908 - DNA, 14 bp, Homo sapiens
atttattcaataaa

SEQ ID NO: 5278909 - DNA, 19 bp, Homo sapiens
atttattcaattcctctgg

SEQ ID NO: 5278910 - DNA, 14 bp, Homo sapiens
atttattcattagt

SEQ ID NO: 5278911 - DNA, 21 bp, Homo sapiens
atttattcattatttgtcaaa

SEQ ID NO: 5278912 - DNA, 14 bp, Homo sapiens
atttattcattcag

SEQ ID NO: 5278913 - DNA, 23 bp, Homo sapiens
atttattccatattcatgtaaac

SEQ ID NO: 5278914 - DNA, 21 bp, Homo sapiens
atttattccccagtgactcca

SEQ ID NO: 5278915 - DNA, 13 bp, Homo sapiens
attaagtaatgat

SEQ ID NO: 5278916 - DNA, 15 bp, Homo sapiens
attaagtatatttgt

SEQ ID NO: 5278917 - DNA, 17 bp, Homo sapiens
attaagtatatttgtaa

SEQ ID NO: 5278918 - DNA, 20 bp, Homo sapiens
attaagtatatttgtaaaag

SEQ ID NO: 5278919 - DNA, 21 bp, Homo sapiens
attaagtattccttggcccag

SEQ ID NO: 5278920 - DNA, 16 bp, Homo sapiens
attaagtcaagaatat

SEQ ID NO: 5278921 - DNA, 13 bp, Homo sapiens
attaagtgaaatt

SEQ ID NO: 5278922 - DNA, 15 bp, Homo sapiens
attaagtgaaatttt

SEQ ID NO: 5278923 - DNA, 19 bp, Homo sapiens
attaagtgaaattttaaat

SEQ ID NO: 5278924 - DNA, 19 bp, Homo sapiens
attaagtggttactttgtg

SEQ ID NO: 5278925 - DNA, 14 bp, Homo sapiens
attaagtgtgtgta

SEQ ID NO: 5278926 - DNA, 16 bp, Homo sapiens
attaagtgttgttcat

SEQ ID NO: 5278927 - DNA, 12 bp, Homo sapiens
attaagttacaa

SEQ ID NO: 5278928 - DNA, 21 bp, Homo sapiens
attaagttacaattacatctc

SEQ ID NO: 5278929 - DNA, 17 bp, Homo sapiens
attaagttataccagca

SEQ ID NO: 5278930 - DNA, 17 bp, Homo sapiens
attaagttattgatttt

SEQ ID NO: 5278931 - DNA, 13 bp, Homo sapiens
attaagttgaaaa

SEQ ID NO: 5278932 - DNA, 15 bp, Homo sapiens
attaagttgaaaaag

SEQ ID NO: 5278933 - DNA, 13 bp, Homo sapiens
attaagttgttaa

SEQ ID NO: 5278934 - DNA, 14 bp, Homo sapiens
attaagttgttaat

SEQ ID NO: 5278935 - DNA, 19 bp, Homo sapiens
attaataaaaaatggaaag

SEQ ID NO: 5278936 - DNA, 12 bp, Homo sapiens
attaataaaaag

SEQ ID NO: 5278937 - DNA, 17 bp, Homo sapiens
attaataaacgaagata

SEQ ID NO: 5278938 - DNA, 17 bp, Homo sapiens
attaataaagcattctt

SEQ ID NO: 5278939 - DNA, 13 bp, Homo sapiens
attaataaataga

SEQ ID NO: 5278940 - DNA, 13 bp, Homo sapiens
attaataacagaa

SEQ ID NO: 5278941 - DNA, 15 bp, Homo sapiens
attaataacctgcca

SEQ ID NO: 5278942 - DNA, 13 bp, Homo sapiens
attaataactgaa

SEQ ID NO: 5278943 - DNA, 20 bp, Homo sapiens
attaataactttctctgtga

SEQ ID NO: 5278944 - DNA, 17 bp, Homo sapiens
attaataagatttttca

SEQ ID NO: 5278945 - DNA, 19 bp, Homo sapiens
attaataagatttttcaaa

SEQ ID NO: 5278946 - DNA, 16 bp, Homo sapiens
attaataatatgtact

SEQ ID NO: 5278947 - DNA, 13 bp, Homo sapiens
attaataatctta

SEQ ID NO: 5278948 - DNA, 15 bp, Homo sapiens
attaataatgtttat

SEQ ID NO: 5278949 - DNA, 20 bp, Homo sapiens
attaatactaaaatatgtct

SEQ ID NO: 5278950 - DNA, 13 bp, Homo sapiens
attaatactgtgt

SEQ ID NO: 5278951 - DNA, 16 bp, Homo sapiens
attaatacttccttat

SEQ ID NO: 5278952 - DNA, 21 bp, Homo sapiens
attaatacttccttataaaaa

SEQ ID NO: 5278953 - DNA, 22 bp, Homo sapiens
attaatagccaaagatttcata

SEQ ID NO: 5278954 - DNA, 16 bp, Homo sapiens
attaatagctgccttc

SEQ ID NO: 5278955 - DNA, 16 bp, Homo sapiens
attaatagtaatttgt

SEQ ID NO: 5278956 - DNA, 20 bp, Homo sapiens
attaatagtaatttgtaaag

SEQ ID NO: 5278957 - DNA, 12 bp, Homo sapiens
attaatagttca

SEQ ID NO: 5278958 - DNA, 18 bp, Homo sapiens
attaatataagtttcttt

SEQ ID NO: 5278959 - DNA, 17 bp, Homo sapiens
attaatatatattatct

SEQ ID NO: 5278960 - DNA, 14 bp, Homo sapiens
attaatatattaaa

SEQ ID NO: 5278961 - DNA, 16 bp, Homo sapiens
attaatatcaactctg

SEQ ID NO: 5278962 - DNA, 19 bp, Homo sapiens
attaatatccctacatgta

SEQ ID NO: 5278963 - DNA, 19 bp, Homo sapiens
attaatatctttctgcaca

SEQ ID NO: 5278964 - DNA, 23 bp, Homo sapiens
attaatatgctacagtactatgt

SEQ ID NO: 5278965 - DNA, 18 bp, Homo sapiens
attaatatggcttcacca

SEQ ID NO: 5278966 - DNA, 21 bp, Homo sapiens
attaatatgtacttttccatt

SEQ ID NO: 5278967 - DNA, 22 bp, Homo sapiens
attaatatgtgggaattagtga

SEQ ID NO: 5278968 - DNA, 15 bp, Homo sapiens
attaatatgttcatt

SEQ ID NO: 5278969 - DNA, 20 bp, Homo sapiens
attaatattattatgaattt

SEQ ID NO: 5278970 - DNA, 16 bp, Homo sapiens
attaatattcattgta

SEQ ID NO: 5278971 - DNA, 17 bp, Homo sapiens
attaatattcattgtat

SEQ ID NO: 5278972 - DNA, 17 bp, Homo sapiens
attaatattcctcagtt

SEQ ID NO: 5278973 - DNA, 13 bp, Homo sapiens
attaatattcttt

SEQ ID NO: 5278974 - DNA, 15 bp, Homo sapiens
attaatattcttttg

SEQ ID NO: 5278975 - DNA, 18 bp, Homo sapiens
attaatattgtgcttaaa

SEQ ID NO: 5278976 - DNA, 12 bp, Homo sapiens
attaatatttgt

SEQ ID NO: 5278977 - DNA, 11 bp, Homo sapiens
attaatcaaaa

SEQ ID NO: 5278978 - DNA, 19 bp, Homo sapiens
attaatcaactttccttaa

SEQ ID NO: 5278979 - DNA, 17 bp, Homo sapiens
attaatcaagagaaact

SEQ ID NO: 5278980 - DNA, 20 bp, Homo sapiens
attaatcaagagaaacttca

SEQ ID NO: 5278981 - DNA, 23 bp, Homo sapiens
attaatcaatcatctgtgtgaaa

SEQ ID NO: 5278982 - DNA, 18 bp, Homo sapiens
attaatcacctctctgta

SEQ ID NO: 5278983 - DNA, 15 bp, Homo sapiens
attaatcaccttctt

SEQ ID NO: 5278984 - DNA, 19 bp, Homo sapiens
attaatcaccttctttgta

SEQ ID NO: 5278985 - DNA, 20 bp, Homo sapiens
attaatcaccttctttgtaa

SEQ ID NO: 5278986 - DNA, 21 bp, Homo sapiens
attaatcaccttctttgtaat

SEQ ID NO: 5278987 - DNA, 12 bp, Homo sapiens
attaatcactgt

SEQ ID NO: 5278988 - DNA, 15 bp, Homo sapiens
attaatcactgtgta

SEQ ID NO: 5278989 - DNA, 16 bp, Homo sapiens
attaatcactgtgtat

SEQ ID NO: 5278990 - DNA, 17 bp, Homo sapiens
attaatcactgtgtata

SEQ ID NO: 5278991 - DNA, 14 bp, Homo sapiens
attaatcatacaaa

SEQ ID NO: 5278992 - DNA, 18 bp, Homo sapiens
attaatcatacaaactct

SEQ ID NO: 5278993 - DNA, 21 bp, Homo sapiens
attaatcatacaaactctcac

SEQ ID NO: 5278994 - DNA, 22 bp, Homo sapiens
attaatcatacaaactctcacc

SEQ ID NO: 5278995 - DNA, 19 bp, Homo sapiens
attaatcatgaatgtgtaa

SEQ ID NO: 5278996 - DNA, 12 bp, Homo sapiens
attaatcattcc

SEQ ID NO: 5278997 - DNA, 17 bp, Homo sapiens
attaatccacatgtttc

SEQ ID NO: 5278998 - DNA, 21 bp, Homo sapiens
attaatccccatcattactgg

SEQ ID NO: 5278999 - DNA, 23 bp, Homo sapiens
attaatccccatcattactggta

SEQ ID NO: 5279000 - DNA, 21 bp, Homo sapiens
attaatcgtgtcttcaattaa

SEQ ID NO: 5279001 - DNA, 16 bp, Homo sapiens
attaatctactgtatc

SEQ ID NO: 5279002 - DNA, 16 bp, Homo sapiens
attaatctagaaaatg

SEQ ID NO: 5279003 - DNA, 13 bp, Homo sapiens
attaatctcaaag

SEQ ID NO: 5279004 - DNA, 19 bp, Homo sapiens
attaatctgtttgtgcaaa

SEQ ID NO: 5279005 - DNA, 14 bp, Homo sapiens
attaatcttaattt

SEQ ID NO: 5279006 - DNA, 19 bp, Homo sapiens
attaatcttagtgtatgat

SEQ ID NO: 5279007 - DNA, 13 bp, Homo sapiens
attaatcttgatc

SEQ ID NO: 5279008 - DNA, 20 bp, Homo sapiens
attaatcttgcttcattgtt

SEQ ID NO: 5279009 - DNA, 18 bp, Homo sapiens
attaatctttaataacaa

SEQ ID NO: 5279010 - DNA, 15 bp, Homo sapiens
attaatctttctata

SEQ ID NO: 5279011 - DNA, 17 bp, Homo sapiens
attaatcttttatattg

SEQ ID NO: 5279012 - DNA, 16 bp, Homo sapiens
attaatgaaaactttt

SEQ ID NO: 5279013 - DNA, 17 bp, Homo sapiens
attaatgaaaataagaa

SEQ ID NO: 5279014 - DNA, 19 bp, Homo sapiens
attaatgaaaataagaatt

SEQ ID NO: 5279015 - DNA, 22 bp, Homo sapiens
attaatgaactgtgacaggaag

SEQ ID NO: 5279016 - DNA, 17 bp, Homo sapiens
attaatgaagaaagtaa

SEQ ID NO: 5279017 - DNA, 14 bp, Homo sapiens
attaatgaagttga

SEQ ID NO: 5279018 - DNA, 20 bp, Homo sapiens
attaatgacacttgtcccca

SEQ ID NO: 5279019 - DNA, 16 bp, Homo sapiens
attaatgacagaatga

SEQ ID NO: 5279020 - DNA, 12 bp, Homo sapiens
attaatgactta

SEQ ID NO: 5279021 - DNA, 22 bp, Homo sapiens
attaatgagacacacttaacta

SEQ ID NO: 5279022 - DNA, 19 bp, Homo sapiens
attaatgatgatcttcaga

SEQ ID NO: 5279023 - DNA, 16 bp, Homo sapiens
attaatgattcaatta

SEQ ID NO: 5279024 - DNA, 13 bp, Homo sapiens
attaatgcacttt

SEQ ID NO: 5279025 - DNA, 14 bp, Homo sapiens
attaatgcatttat

SEQ ID NO: 5279026 - DNA, 20 bp, Homo sapiens
attaatgccattatccctga

SEQ ID NO: 5279027 - DNA, 13 bp, Homo sapiens
attaatgcccagc

SEQ ID NO: 5279028 - DNA, 18 bp, Homo sapiens
attaatgcctttaaagta

SEQ ID NO: 5279029 - DNA, 14 bp, Homo sapiens
attaatgctaaggg

SEQ ID NO: 5279030 - DNA, 17 bp, Homo sapiens
attaatggaaaactgtt

SEQ ID NO: 5279031 - DNA, 22 bp, Homo sapiens
attaatggacaaataagttttt

SEQ ID NO: 5279032 - DNA, 14 bp, Homo sapiens
attaatggcactga

SEQ ID NO: 5279033 - DNA, 17 bp, Homo sapiens
attaatggtctaaaaat

SEQ ID NO: 5279034 - DNA, 21 bp, Homo sapiens
attaatggtttattctttgca

SEQ ID NO: 5279035 - DNA, 14 bp, Homo sapiens
attaatgtaataaa

SEQ ID NO: 5279036 - DNA, 17 bp, Homo sapiens
attaatgtaataaagtg

SEQ ID NO: 5279037 - DNA, 12 bp, Homo sapiens
attaatgtactt

SEQ ID NO: 5279038 - DNA, 16 bp, Homo sapiens
attaatgtacttgttt

SEQ ID NO: 5279039 - DNA, 23 bp, Homo sapiens
attaatgtacttgtttctctgtt

SEQ ID NO: 5279040 - DNA, 16 bp, Homo sapiens
attaatgtacttttta

SEQ ID NO: 5279041 - DNA, 19 bp, Homo sapiens
attaatgtactttttattg

SEQ ID NO: 5279042 - DNA, 15 bp, Homo sapiens
attataatgccagaa

SEQ ID NO: 5279043 - DNA, 18 bp, Homo sapiens
attataatgccagaatat

SEQ ID NO: 5279044 - DNA, 13 bp, Homo sapiens
attataatgtatt

SEQ ID NO: 5279045 - DNA, 19 bp, Homo sapiens
attataatgtattcatatt

SEQ ID NO: 5279046 - DNA, 13 bp, Homo sapiens
attataattgtat

SEQ ID NO: 5279047 - DNA, 16 bp, Homo sapiens
attataattgtcatga

SEQ ID NO: 5279048 - DNA, 15 bp, Homo sapiens
attataattgttgca

SEQ ID NO: 5279049 - DNA, 16 bp, Homo sapiens
attataattgttgcat

SEQ ID NO: 5279050 - DNA, 18 bp, Homo sapiens
attataattgttgcatag

SEQ ID NO: 5279051 - DNA, 17 bp, Homo sapiens
attataatttaatgcat

SEQ ID NO: 5279052 - DNA, 23 bp, Homo sapiens
attataatttttttcaatattta

SEQ ID NO: 5279053 - DNA, 13 bp, Homo sapiens
attatacaaaaaa

SEQ ID NO: 5279054 - DNA, 16 bp, Homo sapiens
attatacaaaaaaaag

SEQ ID NO: 5279055 - DNA, 16 bp, Homo sapiens
attatacaaaagagca

SEQ ID NO: 5279056 - DNA, 20 bp, Homo sapiens
attatacatcaattggaaat

SEQ ID NO: 5279057 - DNA, 21 bp, Homo sapiens
attatacatgggtagcttctg

SEQ ID NO: 5279058 - DNA, 15 bp, Homo sapiens
attatacatgtgata

SEQ ID NO: 5279059 - DNA, 15 bp, Homo sapiens
attataccacttata

SEQ ID NO: 5279060 - DNA, 14 bp, Homo sapiens
attataccatgtgt

SEQ ID NO: 5279061 - DNA, 18 bp, Homo sapiens
attataccatgtgtgcta

SEQ ID NO: 5279062 - DNA, 20 bp, Homo sapiens
attataccgcagagtatttg

SEQ ID NO: 5279063 - DNA, 15 bp, Homo sapiens
attatacctgttgct

SEQ ID NO: 5279064 - DNA, 17 bp, Homo sapiens
attatacgtacatacac

SEQ ID NO: 5279065 - DNA, 17 bp, Homo sapiens
attatacgtatgcattt

SEQ ID NO: 5279066 - DNA, 17 bp, Homo sapiens
attatactaacttattt

SEQ ID NO: 5279067 - DNA, 18 bp, Homo sapiens
attatactctctgaaata

SEQ ID NO: 5279068 - DNA, 23 bp, Homo sapiens
attatactgtagatttcagtagt

SEQ ID NO: 5279069 - DNA, 20 bp, Homo sapiens
attatactgtagctgatgaa

SEQ ID NO: 5279070 - DNA, 12 bp, Homo sapiens
attatactgtat

SEQ ID NO: 5279071 - DNA, 18 bp, Homo sapiens
attatactgtattaagag

SEQ ID NO: 5279072 - DNA, 14 bp, Homo sapiens
attatactgttatc

SEQ ID NO: 5279073 - DNA, 20 bp, Homo sapiens
attatactgttatccatatt

SEQ ID NO: 5279074 - DNA, 21 bp, Homo sapiens
attatactgttatccatatta

SEQ ID NO: 5279075 - DNA, 16 bp, Homo sapiens
attatacttgagattt

SEQ ID NO: 5279076 - DNA, 14 bp, Homo sapiens
attatacttgtaat

SEQ ID NO: 5279077 - DNA, 21 bp, Homo sapiens
attatacttgtaattatggag

SEQ ID NO: 5279078 - DNA, 13 bp, Homo sapiens
attatactttata

SEQ ID NO: 5279079 - DNA, 14 bp, Homo sapiens
attatactttatat

SEQ ID NO: 5279080 - DNA, 17 bp, Homo sapiens
attatactttatatctg

SEQ ID NO: 5279081 - DNA, 23 bp, Homo sapiens
attatactttatatctgtaatga

SEQ ID NO: 5279082 - DNA, 15 bp, Homo sapiens
attatactttgttgt

SEQ ID NO: 5279083 - DNA, 21 bp, Homo sapiens
attatactttgttgtttttaa

SEQ ID NO: 5279084 - DNA, 12 bp, Homo sapiens
attatagaaaca

SEQ ID NO: 5279085 - DNA, 13 bp, Homo sapiens
attatagaaatta

SEQ ID NO: 5279086 - DNA, 13 bp, Homo sapiens
attatagaaattc

SEQ ID NO: 5279087 - DNA, 18 bp, Homo sapiens
attatagaatctacttta

SEQ ID NO: 5279088 - DNA, 20 bp, Homo sapiens
attatagaatctactttaat

SEQ ID NO: 5279089 - DNA, 20 bp, Homo sapiens
attatagacaacgatgaatt

SEQ ID NO: 5279090 - DNA, 23 bp, Homo sapiens
attatagagcagaaattctgttt

SEQ ID NO: 5279091 - DNA, 14 bp, Homo sapiens
attatagattctaa

SEQ ID NO: 5279092 - DNA, 16 bp, Homo sapiens
attatagattctaaag

SEQ ID NO: 5279093 - DNA, 16 bp, Homo sapiens
attatagcaactaatg

SEQ ID NO: 5279094 - DNA, 15 bp, Homo sapiens
attatagcaacttta

SEQ ID NO: 5279095 - DNA, 18 bp, Homo sapiens
attatagcaatgtgattt

SEQ ID NO: 5279096 - DNA, 19 bp, Homo sapiens
attatagcaatgtgatttt

SEQ ID NO: 5279097 - DNA, 13 bp, Homo sapiens
attatagcatgta

SEQ ID NO: 5279098 - DNA, 19 bp, Homo sapiens
attatagcctcagattcga

SEQ ID NO: 5279099 - DNA, 14 bp, Homo sapiens
attatagcgcctgt

SEQ ID NO: 5279100 - DNA, 15 bp, Homo sapiens
attatagcgcctgta

SEQ ID NO: 5279101 - DNA, 18 bp, Homo sapiens
attatagcgcctgtataa

SEQ ID NO: 5279102 - DNA, 22 bp, Homo sapiens
attatagcgcctgtataagtag

SEQ ID NO: 5279103 - DNA, 18 bp, Homo sapiens
atttctgataagacatga

SEQ ID NO: 5279104 - DNA, 15 bp, Homo sapiens
atttctgatatagaa

SEQ ID NO: 5279105 - DNA, 17 bp, Homo sapiens
atttctgatatagaatt

SEQ ID NO: 5279106 - DNA, 18 bp, Homo sapiens
atttctgatatagaattg

SEQ ID NO: 5279107 - DNA, 19 bp, Homo sapiens
atttctgatcagaggtgta

SEQ ID NO: 5279108 - DNA, 22 bp, Homo sapiens
atttctgatcagaggtgtacac

SEQ ID NO: 5279109 - DNA, 14 bp, Homo sapiens
atttctgatgtctc

SEQ ID NO: 5279110 - DNA, 17 bp, Homo sapiens
atttctgattataagac

SEQ ID NO: 5279111 - DNA, 13 bp, Homo sapiens
atttctgcaaaca

SEQ ID NO: 5279112 - DNA, 22 bp, Homo sapiens
atttctgcacaggtctctgttt

SEQ ID NO: 5279113 - DNA, 23 bp, Homo sapiens
atttctgcacaggtctctgttta

SEQ ID NO: 5279114 - DNA, 16 bp, Homo sapiens
atttctgcaggttctt

SEQ ID NO: 5279115 - DNA, 13 bp, Homo sapiens
atttctgcatatg

SEQ ID NO: 5279116 - DNA, 22 bp, Homo sapiens
atttctgcatatgttgaatact

SEQ ID NO: 5279117 - DNA, 21 bp, Homo sapiens
atttctgccaataaattctaa

SEQ ID NO: 5279118 - DNA, 23 bp, Homo sapiens
atttctgccacgtggtggcccag

SEQ ID NO: 5279119 - DNA, 16 bp, Homo sapiens
atttctgccatgatgt

SEQ ID NO: 5279120 - DNA, 15 bp, Homo sapiens
atttctgccatttca

SEQ ID NO: 5279121 - DNA, 16 bp, Homo sapiens
atttctgccatttcat

SEQ ID NO: 5279122 - DNA, 17 bp, Homo sapiens
atttctgccatttcatg

SEQ ID NO: 5279123 - DNA, 20 bp, Homo sapiens
atttctgcctataaatttac

SEQ ID NO: 5279124 - DNA, 11 bp, Homo sapiens
atttctgcctc

SEQ ID NO: 5279125 - DNA, 13 bp, Homo sapiens
atttctgcctccc

SEQ ID NO: 5279126 - DNA, 17 bp, Homo sapiens
atttctgccttccttgc

SEQ ID NO: 5279127 - DNA, 16 bp, Homo sapiens
atttctgcctttcccc

SEQ ID NO: 5279128 - DNA, 22 bp, Homo sapiens
atttctgcctttcccccctcac

SEQ ID NO: 5279129 - DNA, 14 bp, Homo sapiens
atttctgctctgga

SEQ ID NO: 5279130 - DNA, 17 bp, Homo sapiens
atttctgctttcaaagt

SEQ ID NO: 5279131 - DNA, 15 bp, Homo sapiens
atttctggaatgctt

SEQ ID NO: 5279132 - DNA, 21 bp, Homo sapiens
atttctggacatgacgtctgt

SEQ ID NO: 5279133 - DNA, 18 bp, Homo sapiens
atttctggcctcagcagg

SEQ ID NO: 5279134 - DNA, 23 bp, Homo sapiens
atttctggcctcctaaggctccc

SEQ ID NO: 5279135 - DNA, 17 bp, Homo sapiens
atttctggctttttgaa

SEQ ID NO: 5279136 - DNA, 18 bp, Homo sapiens
atttctggctttttgaat

SEQ ID NO: 5279137 - DNA, 17 bp, Homo sapiens
atttctgggggccgcag

SEQ ID NO: 5279138 - DNA, 18 bp, Homo sapiens
atttctggggggagaaaa

SEQ ID NO: 5279139 - DNA, 18 bp, Homo sapiens
atttctgggtcttttgct

SEQ ID NO: 5279140 - DNA, 20 bp, Homo sapiens
atttctgggtcttttgctac

SEQ ID NO: 5279141 - DNA, 16 bp, Homo sapiens
atttctggttctgatg

SEQ ID NO: 5279142 - DNA, 13 bp, Homo sapiens
atttctggttgat

SEQ ID NO: 5279143 - DNA, 19 bp, Homo sapiens
atttctgtaaaatttgttt

SEQ ID NO: 5279144 - DNA, 18 bp, Homo sapiens
atttctgtacatttgcaa

SEQ ID NO: 5279145 - DNA, 18 bp, Homo sapiens
atttctgtagaatgctgt

SEQ ID NO: 5279146 - DNA, 18 bp, Homo sapiens
atttctgtatactgtaaa

SEQ ID NO: 5279147 - DNA, 21 bp, Homo sapiens
atttctgtatactgtaaaagt

SEQ ID NO: 5279148 - DNA, 14 bp, Homo sapiens
atttctgtatatag

SEQ ID NO: 5279149 - DNA, 15 bp, Homo sapiens
atttctgtatatttg

SEQ ID NO: 5279150 - DNA, 18 bp, Homo sapiens
atttctgtatatttgtca

SEQ ID NO: 5279151 - DNA, 23 bp, Homo sapiens
atttctgtcacagtaaaaataaa

SEQ ID NO: 5279152 - DNA, 13 bp, Homo sapiens
atttctgtcagaa

SEQ ID NO: 5279153 - DNA, 21 bp, Homo sapiens
atttctgtcattcaaatgggt

SEQ ID NO: 5279154 - DNA, 15 bp, Homo sapiens
atttctgtctcataa

SEQ ID NO: 5279155 - DNA, 15 bp, Homo sapiens
atttctgtctctaac

SEQ ID NO: 5279156 - DNA, 16 bp, Homo sapiens
atttctgtctctaacc

SEQ ID NO: 5279157 - DNA, 16 bp, Homo sapiens
atttctgtctttaaga

SEQ ID NO: 5279158 - DNA, 13 bp, Homo sapiens
atttctgtgaaag

SEQ ID NO: 5279159 - DNA, 17 bp, Homo sapiens
atttctgtgaaagaagt

SEQ ID NO: 5279160 - DNA, 14 bp, Homo sapiens
atttctgtgaagtt

SEQ ID NO: 5279161 - DNA, 19 bp, Homo sapiens
atttctgtgaagttgaata

SEQ ID NO: 5279162 - DNA, 19 bp, Homo sapiens
atttctgtggaaaacaatt

SEQ ID NO: 5279163 - DNA, 23 bp, Homo sapiens
atttctgtggatacagtgcccac

SEQ ID NO: 5279164 - DNA, 19 bp, Homo sapiens
atttctgtgtacacatcta

SEQ ID NO: 5279165 - DNA, 12 bp, Homo sapiens
atttctgtgtag

SEQ ID NO: 5279166 - DNA, 13 bp, Homo sapiens
atttctgtgtcta

SEQ ID NO: 5279167 - DNA, 20 bp, Homo sapiens
atttctgttaaaatatatga

SEQ ID NO: 5279168 - DNA, 13 bp, Homo sapiens
atttctgttcagc

SEQ ID NO: 5279169 - DNA, 13 bp, Homo sapiens
atttctgttcctt

SEQ ID NO: 5279170 - DNA, 12 bp, Homo sapiens
atttctgttctc

SEQ ID NO: 5279171 - DNA, 15 bp, Homo sapiens
atttctgtttctcat

SEQ ID NO: 5279172 - DNA, 16 bp, Homo sapiens
atttctgtttgtttaa

SEQ ID NO: 5279173 - DNA, 19 bp, Homo sapiens
atttcttaaaacacatgat

SEQ ID NO: 5279174 - DNA, 20 bp, Homo sapiens
atttcttaaaacacatgata

SEQ ID NO: 5279175 - DNA, 15 bp, Homo sapiens
atttcttaaaatgtt

SEQ ID NO: 5279176 - DNA, 13 bp, Homo sapiens
atttcttaaaatt

SEQ ID NO: 5279177 - DNA, 16 bp, Homo sapiens
atttcttaaagctttt

SEQ ID NO: 5279178 - DNA, 15 bp, Homo sapiens
atttcttaaatcttt

SEQ ID NO: 5279179 - DNA, 17 bp, Homo sapiens
atttcttaacctttgct

SEQ ID NO: 5279180 - DNA, 17 bp, Homo sapiens
atttcttaatgtaacat

SEQ ID NO: 5279181 - DNA, 18 bp, Homo sapiens
atttcttaattattataa

SEQ ID NO: 5279182 - DNA, 19 bp, Homo sapiens
atttcttaattattataaa

SEQ ID NO: 5279183 - DNA, 20 bp, Homo sapiens
atttcttaccatgcatttct

SEQ ID NO: 5279184 - DNA, 14 bp, Homo sapiens
atttcttactagta

SEQ ID NO: 5279185 - DNA, 20 bp, Homo sapiens
atttcttactagtactattt

SEQ ID NO: 5279186 - DNA, 19 bp, Homo sapiens
atttcttagagattaaacc

SEQ ID NO: 5279187 - DNA, 23 bp, Homo sapiens
atttcttagtgcttcagagtttg

SEQ ID NO: 5279188 - DNA, 18 bp, Homo sapiens
atttcttagttcatatat

SEQ ID NO: 5279189 - DNA, 13 bp, Homo sapiens
atttcttatcaca

SEQ ID NO: 5279190 - DNA, 14 bp, Homo sapiens
atttcttattgaat

SEQ ID NO: 5279191 - DNA, 17 bp, Homo sapiens
atttcttcaaaatgtat

SEQ ID NO: 5279192 - DNA, 19 bp, Homo sapiens
atttcttcaaatctcagca

SEQ ID NO: 5279193 - DNA, 14 bp, Homo sapiens
atttcttcagaggg

SEQ ID NO: 5279194 - DNA, 16 bp, Homo sapiens
atttcttcagagggaa

SEQ ID NO: 5279195 - DNA, 15 bp, Homo sapiens
atttcttcagggctg

SEQ ID NO: 5279196 - DNA, 18 bp, Homo sapiens
atttcttcagtcagaaaa

SEQ ID NO: 5279197 - DNA, 20 bp, Homo sapiens
atttcttcagtcagaaaact

SEQ ID NO: 5279198 - DNA, 21 bp, Homo sapiens
atttcttcataggtagaaaca

SEQ ID NO: 5279199 - DNA, 21 bp, Homo sapiens
atttcttccagtgatgttgaa

SEQ ID NO: 5279200 - DNA, 20 bp, Homo sapiens
atttcttcctaccaagtcaa

SEQ ID NO: 5279201 - DNA, 16 bp, Homo sapiens
atttcttcctctgcat

SEQ ID NO: 5279202 - DNA, 11 bp, Homo sapiens
atttcttcctt

SEQ ID NO: 5279203 - DNA, 21 bp, Homo sapiens
atttcttcgctgctctagctg

SEQ ID NO: 5279204 - DNA, 17 bp, Homo sapiens
atttcttcgtgatgaca

SEQ ID NO: 5279205 - DNA, 13 bp, Homo sapiens
atttcttctcaaa

SEQ ID NO: 5279206 - DNA, 22 bp, Homo sapiens
atttcttctcctggagttgcat

SEQ ID NO: 5279207 - DNA, 13 bp, Homo sapiens
atttcttctctct

SEQ ID NO: 5279208 - DNA, 15 bp, Homo sapiens
atttcttctctctgt

SEQ ID NO: 5279209 - DNA, 15 bp, Homo sapiens
atttcttcttcacat

SEQ ID NO: 5279210 - DNA, 16 bp, Homo sapiens
atttcttcttcacatc

SEQ ID NO: 5279211 - DNA, 18 bp, Homo sapiens
atttcttcttttcctgca

SEQ ID NO: 5279212 - DNA, 18 bp, Homo sapiens
atttcttgaaaagccttg

SEQ ID NO: 5279213 - DNA, 20 bp, Homo sapiens
atttcttgaggtaaaagcat

SEQ ID NO: 5279214 - DNA, 14 bp, Homo sapiens
atttcttgcgagcc

SEQ ID NO: 5279215 - DNA, 16 bp, Homo sapiens
atttcttggtattatt

SEQ ID NO: 5279216 - DNA, 16 bp, Homo sapiens
atttcttgtgatgtat

SEQ ID NO: 5279217 - DNA, 18 bp, Homo sapiens
atttcttgtgatgtattc

SEQ ID NO: 5279218 - DNA, 14 bp, Homo sapiens
atttcttgtttgtt

SEQ ID NO: 5279219 - DNA, 15 bp, Homo sapiens
atttctttaaaaaag

SEQ ID NO: 5279220 - DNA, 20 bp, Homo sapiens
atttctttaaaaaagaaatt

SEQ ID NO: 5279221 - DNA, 20 bp, Homo sapiens
atttctttaaaagaatgact

SEQ ID NO: 5279222 - DNA, 18 bp, Homo sapiens
atttctttaaatgtgtat

SEQ ID NO: 5279223 - DNA, 16 bp, Homo sapiens
atttctttacagaatg

SEQ ID NO: 5279224 - DNA, 13 bp, Homo sapiens
atttctttagaac

SEQ ID NO: 5279225 - DNA, 15 bp, Homo sapiens
atttctttataaaat

SEQ ID NO: 5279226 - DNA, 15 bp, Homo sapiens
atttctttatttctg

SEQ ID NO: 5279227 - DNA, 13 bp, Homo sapiens
atttctttcatca

SEQ ID NO: 5279228 - DNA, 13 bp, Homo sapiens
atttctttccaga

SEQ ID NO: 5279229 - DNA, 17 bp, Homo sapiens
atttctttcctttaaaa

SEQ ID NO: 5279230 - DNA, 14 bp, Homo sapiens
atttctttctaact

SEQ ID NO: 5279231 - DNA, 15 bp, Homo sapiens
atttctttctaactg

SEQ ID NO: 5279232 - DNA, 11 bp, Homo sapiens
atttctttctt

SEQ ID NO: 5279233 - DNA, 14 bp, Homo sapiens
atttctttcttcca

SEQ ID NO: 5279234 - DNA, 15 bp, Homo sapiens
atttctttcttccat

SEQ ID NO: 5279235 - DNA, 23 bp, Homo sapiens
atttctttcttccattccttcat

SEQ ID NO: 5279236 - DNA, 22 bp, Homo sapiens
atttctttcttgctggctctga

SEQ ID NO: 5279237 - DNA, 12 bp, Homo sapiens
atttctttgaat

SEQ ID NO: 5279238 - DNA, 15 bp, Homo sapiens
atttctttgaatgta

SEQ ID NO: 5279239 - DNA, 14 bp, Homo sapiens
atttctttgattgt

SEQ ID NO: 5279240 - DNA, 15 bp, Homo sapiens
atttctttgattgtg

SEQ ID NO: 5279241 - DNA, 17 bp, Homo sapiens
atttctttgattgtgaa

SEQ ID NO: 5279242 - DNA, 15 bp, Homo sapiens
atttctttgcctgtt

SEQ ID NO: 5279243 - DNA, 17 bp, Homo sapiens
atttctttgctgtaaga

SEQ ID NO: 5279244 - DNA, 15 bp, Homo sapiens
atttctttgtagaat

SEQ ID NO: 5279245 - DNA, 21 bp, Homo sapiens
atttctttgtctttttcctac

SEQ ID NO: 5279246 - DNA, 17 bp, Homo sapiens
atttctttgtgataaca

SEQ ID NO: 5279247 - DNA, 20 bp, Homo sapiens
atttctttgttatacattta

SEQ ID NO: 5279248 - DNA, 21 bp, Homo sapiens
atttctttgtttaacaaaaga

SEQ ID NO: 5279249 - DNA, 16 bp, Homo sapiens
atttcttttaaaataa

SEQ ID NO: 5279250 - DNA, 11 bp, Homo sapiens
atttcttttac

SEQ ID NO: 5279251 - DNA, 18 bp, Homo sapiens
atttcttttactctgtgt

SEQ ID NO: 5279252 - DNA, 20 bp, Homo sapiens
atttcttttactctgtgtaa

SEQ ID NO: 5279253 - DNA, 12 bp, Homo sapiens
atttcttttata

SEQ ID NO: 5279254 - DNA, 13 bp, Homo sapiens
atttcttttatat

SEQ ID NO: 5279255 - DNA, 15 bp, Homo sapiens
atttcttttatatat

SEQ ID NO: 5279256 - DNA, 18 bp, Homo sapiens
atttcttttatatataaa

SEQ ID NO: 5279257 - DNA, 21 bp, Homo sapiens
atttcttttatatataaaata

SEQ ID NO: 5279258 - DNA, 23 bp, Homo sapiens
atttcttttatatataaaataaa

SEQ ID NO: 5279259 - DNA, 20 bp, Homo sapiens
atttcttttcaccattcgta

SEQ ID NO: 5279260 - DNA, 14 bp, Homo sapiens
atttcttttccaaa

SEQ ID NO: 5279261 - DNA, 22 bp, Homo sapiens
atttcttttccttcattcatag

SEQ ID NO: 5279262 - DNA, 16 bp, Homo sapiens
atttcttttcttcctg

SEQ ID NO: 5279263 - DNA, 18 bp, Homo sapiens
atttcttttcttcctggc

SEQ ID NO: 5279264 - DNA, 23 bp, Homo sapiens
atttcttttgccgttattaaaaa

SEQ ID NO: 5279265 - DNA, 21 bp, Homo sapiens
atttcttttgtaataaactat

SEQ ID NO: 5279266 - DNA, 19 bp, Homo sapiens
atttcttttgttgtacttt

SEQ ID NO: 5279267 - DNA, 14 bp, Homo sapiens
atttctttttaatt

SEQ ID NO: 5279268 - DNA, 18 bp, Homo sapiens
atttctttttaattattt

SEQ ID NO: 5279269 - DNA, 19 bp, Homo sapiens
atttctttttaattatttt

SEQ ID NO: 5279270 - DNA, 21 bp, Homo sapiens
atttctttttaggctctgaga

SEQ ID NO: 5279271 - DNA, 20 bp, Homo sapiens
atttctttttgggagagact

SEQ ID NO: 5279272 - DNA, 23 bp, Homo sapiens
atttctttttgggagagacttgt

SEQ ID NO: 5279273 - DNA, 17 bp, Homo sapiens
atttctttttggtaaat

SEQ ID NO: 5279274 - DNA, 21 bp, Homo sapiens
atttcttttttttaataagga

SEQ ID NO: 5279275 - DNA, 11 bp, Homo sapiens
atttgaaaaaa

SEQ ID NO: 5279276 - DNA, 16 bp, Homo sapiens
atttgaaaaaaacttc

SEQ ID NO: 5279277 - DNA, 15 bp, Homo sapiens
atttgaaaaaaagca

SEQ ID NO: 5279278 - DNA, 17 bp, Homo sapiens
atttgaaaataattgtt

SEQ ID NO: 5279279 - DNA, 18 bp, Homo sapiens
atttgaaaatgataaaag

SEQ ID NO: 5279280 - DNA, 12 bp, Homo sapiens
atttgaaaattg

SEQ ID NO: 5279281 - DNA, 17 bp, Homo sapiens
atttgaaacactggttt

SEQ ID NO: 5279282 - DNA, 18 bp, Homo sapiens
atttgaaacactttgcat

SEQ ID NO: 5279283 - DNA, 23 bp, Homo sapiens
attatagctcccaaaagaatgga

SEQ ID NO: 5279284 - DNA, 19 bp, Homo sapiens
attatagctcctattaaat

SEQ ID NO: 5279285 - DNA, 12 bp, Homo sapiens
attatagctcta

SEQ ID NO: 5279286 - DNA, 13 bp, Homo sapiens
attatagctctaa

SEQ ID NO: 5279287 - DNA, 23 bp, Homo sapiens
attatagctctaatgtttgcata

SEQ ID NO: 5279288 - DNA, 17 bp, Homo sapiens
attataggaagttcttt

SEQ ID NO: 5279289 - DNA, 19 bp, Homo sapiens
attataggaatatcaatat

SEQ ID NO: 5279290 - DNA, 21 bp, Homo sapiens
attataggaatatcaatataa

SEQ ID NO: 5279291 - DNA, 14 bp, Homo sapiens
attatagtaaatct

SEQ ID NO: 5279292 - DNA, 15 bp, Homo sapiens
attatagtaactata

SEQ ID NO: 5279293 - DNA, 22 bp, Homo sapiens
attatagtaatgtgacttggat

SEQ ID NO: 5279294 - DNA, 14 bp, Homo sapiens
attatagtctgtac

SEQ ID NO: 5279295 - DNA, 17 bp, Homo sapiens
attatagtgaaacatgt

SEQ ID NO: 5279296 - DNA, 23 bp, Homo sapiens
attatagtgatgtaatcttgaat

SEQ ID NO: 5279297 - DNA, 16 bp, Homo sapiens
attatagtgtagaaaa

SEQ ID NO: 5279298 - DNA, 19 bp, Homo sapiens
attatagttaagcaaattt

SEQ ID NO: 5279299 - DNA, 21 bp, Homo sapiens
attatagttaagcaaatttca

SEQ ID NO: 5279300 - DNA, 19 bp, Homo sapiens
attatagtttctgaggctt

SEQ ID NO: 5279301 - DNA, 15 bp, Homo sapiens
attatataactgtat

SEQ ID NO: 5279302 - DNA, 16 bp, Homo sapiens
attatataaggacaga

SEQ ID NO: 5279303 - DNA, 14 bp, Homo sapiens
attatataagtatt

SEQ ID NO: 5279304 - DNA, 20 bp, Homo sapiens
attatatacatactgcatct

SEQ ID NO: 5279305 - DNA, 20 bp, Homo sapiens
attatatacttgttgtttaa

SEQ ID NO: 5279306 - DNA, 13 bp, Homo sapiens
attatatagcaaa

SEQ ID NO: 5279307 - DNA, 18 bp, Homo sapiens
attatataggatattgct

SEQ ID NO: 5279308 - DNA, 13 bp, Homo sapiens
attatataggttg

SEQ ID NO: 5279309 - DNA, 23 bp, Homo sapiens
attatatagtaatgcactctcag

SEQ ID NO: 5279310 - DNA, 11 bp, Homo sapiens
attatatataa

SEQ ID NO: 5279311 - DNA, 12 bp, Homo sapiens
attatatatata

SEQ ID NO: 5279312 - DNA, 14 bp, Homo sapiens
attatatatataat

SEQ ID NO: 5279313 - DNA, 19 bp, Homo sapiens
attatatatttacagaaga

SEQ ID NO: 5279314 - DNA, 14 bp, Homo sapiens
attatatattttgt

SEQ ID NO: 5279315 - DNA, 23 bp, Homo sapiens
attatatcattggaacaactgat

SEQ ID NO: 5279316 - DNA, 13 bp, Homo sapiens
attatatctaatt

SEQ ID NO: 5279317 - DNA, 16 bp, Homo sapiens
attatatctaattatt

SEQ ID NO: 5279318 - DNA, 14 bp, Homo sapiens
attatatctaattt

SEQ ID NO: 5279319 - DNA, 19 bp, Homo sapiens
attatatctgaggaattct

SEQ ID NO: 5279320 - DNA, 20 bp, Homo sapiens
attatatctgaggaattctg

SEQ ID NO: 5279321 - DNA, 21 bp, Homo sapiens
attatatctgaggaattctgt

SEQ ID NO: 5279322 - DNA, 22 bp, Homo sapiens
attatatctgaggaattctgta

SEQ ID NO: 5279323 - DNA, 19 bp, Homo sapiens
attatatgctatttctata

SEQ ID NO: 5279324 - DNA, 23 bp, Homo sapiens
attatatggagacgctaagaaat

SEQ ID NO: 5279325 - DNA, 14 bp, Homo sapiens
attatatggcagga

SEQ ID NO: 5279326 - DNA, 20 bp, Homo sapiens
attatatggcttgagtttaa

SEQ ID NO: 5279327 - DNA, 22 bp, Homo sapiens
attatatgtaccctctgaaata

SEQ ID NO: 5279328 - DNA, 22 bp, Homo sapiens
attatatgtggactaaatatct

SEQ ID NO: 5279329 - DNA, 13 bp, Homo sapiens
attatattaaaat

SEQ ID NO: 5279330 - DNA, 13 bp, Homo sapiens
attatattaaaca

SEQ ID NO: 5279331 - DNA, 16 bp, Homo sapiens
attatattaaacatac

SEQ ID NO: 5279332 - DNA, 22 bp, Homo sapiens
attatattaatataaaaacatt

SEQ ID NO: 5279333 - DNA, 16 bp, Homo sapiens
attatattatgaataa

SEQ ID NO: 5279334 - DNA, 13 bp, Homo sapiens
attatattatgtt

SEQ ID NO: 5279335 - DNA, 23 bp, Homo sapiens
attatattcccaaatctcaaaag

SEQ ID NO: 5279336 - DNA, 15 bp, Homo sapiens
attatattctgttta

SEQ ID NO: 5279337 - DNA, 23 bp, Homo sapiens
attatattggtgcgtttttacag

SEQ ID NO: 5279338 - DNA, 15 bp, Homo sapiens
attatattgtattta

SEQ ID NO: 5279339 - DNA, 15 bp, Homo sapiens
attatatttacaaat

SEQ ID NO: 5279340 - DNA, 17 bp, Homo sapiens
attatatttacaaatgg

SEQ ID NO: 5279341 - DNA, 15 bp, Homo sapiens
attatatttaccttt

SEQ ID NO: 5279342 - DNA, 15 bp, Homo sapiens
attatatttattact

SEQ ID NO: 5279343 - DNA, 21 bp, Homo sapiens
attatatttcacccatctctc

SEQ ID NO: 5279344 - DNA, 16 bp, Homo sapiens
attatatttgaaatcg

SEQ ID NO: 5279345 - DNA, 14 bp, Homo sapiens
attatatttgacat

SEQ ID NO: 5279346 - DNA, 15 bp, Homo sapiens
attatatttgacatg

SEQ ID NO: 5279347 - DNA, 13 bp, Homo sapiens
attatatttgcat

SEQ ID NO: 5279348 - DNA, 14 bp, Homo sapiens
attatatttgcatt

SEQ ID NO: 5279349 - DNA, 17 bp, Homo sapiens
attatatttgcattatg

SEQ ID NO: 5279350 - DNA, 14 bp, Homo sapiens
attatattttataa

SEQ ID NO: 5279351 - DNA, 13 bp, Homo sapiens
attatattttgaa

SEQ ID NO: 5279352 - DNA, 22 bp, Homo sapiens
attatattttgaacaactcgaa

SEQ ID NO: 5279353 - DNA, 22 bp, Homo sapiens
attatattttgagtagaactct

SEQ ID NO: 5279354 - DNA, 20 bp, Homo sapiens
attatatttttgtaaatagt

SEQ ID NO: 5279355 - DNA, 19 bp, Homo sapiens
attatcaaaaaacagaaaa

SEQ ID NO: 5279356 - DNA, 22 bp, Homo sapiens
attatcaaagggataaagaaaa

SEQ ID NO: 5279357 - DNA, 17 bp, Homo sapiens
attatcaagctaataaa

SEQ ID NO: 5279358 - DNA, 20 bp, Homo sapiens
attatcaaggggactaaagt

SEQ ID NO: 5279359 - DNA, 21 bp, Homo sapiens
attatcaagtagactactgtt

SEQ ID NO: 5279360 - DNA, 16 bp, Homo sapiens
attatcaatattgagg

SEQ ID NO: 5279361 - DNA, 18 bp, Homo sapiens
attatcaatattgaggat

SEQ ID NO: 5279362 - DNA, 15 bp, Homo sapiens
attatcactttgggg

SEQ ID NO: 5279363 - DNA, 21 bp, Homo sapiens
attatcagtagaaagagtgtt

SEQ ID NO: 5279364 - DNA, 20 bp, Homo sapiens
attatcagttatattttgct

SEQ ID NO: 5279365 - DNA, 15 bp, Homo sapiens
attatcatatatgct

SEQ ID NO: 5279366 - DNA, 19 bp, Homo sapiens
attatcatatatgcttttt

SEQ ID NO: 5279367 - DNA, 14 bp, Homo sapiens
attatcatcctata

SEQ ID NO: 5279368 - DNA, 16 bp, Homo sapiens
attatcatcctataaa

SEQ ID NO: 5279369 - DNA, 18 bp, Homo sapiens
attatcatcctataaaga

SEQ ID NO: 5279370 - DNA, 20 bp, Homo sapiens
attatcatcctataaagaaa

SEQ ID NO: 5279371 - DNA, 15 bp, Homo sapiens
attatcatgcaaatg

SEQ ID NO: 5279372 - DNA, 20 bp, Homo sapiens
attatcatgcgttttatatc

SEQ ID NO: 5279373 - DNA, 21 bp, Homo sapiens
attatcatgtctatttttgat

SEQ ID NO: 5279374 - DNA, 22 bp, Homo sapiens
attatcatgtgtaatcaataaa

SEQ ID NO: 5279375 - DNA, 14 bp, Homo sapiens
attatccatattga

SEQ ID NO: 5279376 - DNA, 13 bp, Homo sapiens
attatccattacg

SEQ ID NO: 5279377 - DNA, 21 bp, Homo sapiens
attatccattacgtgcattta

SEQ ID NO: 5279378 - DNA, 21 bp, Homo sapiens
attatcctcctgttctgaaac

SEQ ID NO: 5279379 - DNA, 16 bp, Homo sapiens
attatcctctttgtaa

SEQ ID NO: 5279380 - DNA, 17 bp, Homo sapiens
attatcctgatcaagca

SEQ ID NO: 5279381 - DNA, 20 bp, Homo sapiens
attatccttcacaatttcaa

SEQ ID NO: 5279382 - DNA, 23 bp, Homo sapiens
attatccttcacaatttcaatgc

SEQ ID NO: 5279383 - DNA, 19 bp, Homo sapiens
attatcgggagcagtgtct

SEQ ID NO: 5279384 - DNA, 20 bp, Homo sapiens
attatcgttttcttaaagtg

SEQ ID NO: 5279385 - DNA, 19 bp, Homo sapiens
attatctaaaatctgctag

SEQ ID NO: 5279386 - DNA, 17 bp, Homo sapiens
attatctaaatgaatga

SEQ ID NO: 5279387 - DNA, 18 bp, Homo sapiens
attatctaatgagttgct

SEQ ID NO: 5279388 - DNA, 14 bp, Homo sapiens
attatctaatttat

SEQ ID NO: 5279389 - DNA, 16 bp, Homo sapiens
attatctactagtaat

SEQ ID NO: 5279390 - DNA, 16 bp, Homo sapiens
attatctagagaataa

SEQ ID NO: 5279391 - DNA, 18 bp, Homo sapiens
attatctagatactgtat

SEQ ID NO: 5279392 - DNA, 20 bp, Homo sapiens
attatctagtagttgtagaa

SEQ ID NO: 5279393 - DNA, 19 bp, Homo sapiens
attatctatacatatcttt

SEQ ID NO: 5279394 - DNA, 19 bp, Homo sapiens
attatctatagctaagtac

SEQ ID NO: 5279395 - DNA, 19 bp, Homo sapiens
attatctatggaaatgtga

SEQ ID NO: 5279396 - DNA, 17 bp, Homo sapiens
attatctcacttgtgcc

SEQ ID NO: 5279397 - DNA, 16 bp, Homo sapiens
attatctcactttgta

SEQ ID NO: 5279398 - DNA, 18 bp, Homo sapiens
attatctgcatttatctt

SEQ ID NO: 5279399 - DNA, 17 bp, Homo sapiens
attatctgggttttaga

SEQ ID NO: 5279400 - DNA, 15 bp, Homo sapiens
attatctgtaaaaat

SEQ ID NO: 5279401 - DNA, 14 bp, Homo sapiens
attatctgtactga

SEQ ID NO: 5279402 - DNA, 16 bp, Homo sapiens
attatctgtattaatg

SEQ ID NO: 5279403 - DNA, 16 bp, Homo sapiens
attatctgttctatgg

SEQ ID NO: 5279404 - DNA, 20 bp, Homo sapiens
attatctgttgccttatttc

SEQ ID NO: 5279405 - DNA, 11 bp, Homo sapiens
attatcttacg

SEQ ID NO: 5279406 - DNA, 17 bp, Homo sapiens
attatcttatactgaaa

SEQ ID NO: 5279407 - DNA, 14 bp, Homo sapiens
attatcttatcatt

SEQ ID NO: 5279408 - DNA, 16 bp, Homo sapiens
attatcttatctactg

SEQ ID NO: 5279409 - DNA, 14 bp, Homo sapiens
attatcttatgaaa

SEQ ID NO: 5279410 - DNA, 12 bp, Homo sapiens
attatcttcagc

SEQ ID NO: 5279411 - DNA, 19 bp, Homo sapiens
attatcttgaaaaagtatt

SEQ ID NO: 5279412 - DNA, 15 bp, Homo sapiens
attatcttgatacat

SEQ ID NO: 5279413 - DNA, 18 bp, Homo sapiens
attatcttgatacattca

SEQ ID NO: 5279414 - DNA, 23 bp, Homo sapiens
attatcttgatacattcaaattt

SEQ ID NO: 5279415 - DNA, 20 bp, Homo sapiens
attatcttggaaaaatgcgt

SEQ ID NO: 5279416 - DNA, 18 bp, Homo sapiens
attatcttggaaagaaac

SEQ ID NO: 5279417 - DNA, 22 bp, Homo sapiens
attatcttttcatacattttct

SEQ ID NO: 5279418 - DNA, 21 bp, Homo sapiens
attatgaaaaaatgttcaaat

SEQ ID NO: 5279419 - DNA, 19 bp, Homo sapiens
attatgaaaaacatcccaa

SEQ ID NO: 5279420 - DNA, 18 bp, Homo sapiens
attatgaaaaagattatt

SEQ ID NO: 5279421 - DNA, 13 bp, Homo sapiens
attatgaaaacta

SEQ ID NO: 5279422 - DNA, 13 bp, Homo sapiens
attatgaaaatta

SEQ ID NO: 5279423 - DNA, 20 bp, Homo sapiens
attatgaaaattaagattat

SEQ ID NO: 5279424 - DNA, 15 bp, Homo sapiens
attatgaaacttgtg

SEQ ID NO: 5279425 - DNA, 20 bp, Homo sapiens
attatgaaacttgtgtaaat

SEQ ID NO: 5279426 - DNA, 21 bp, Homo sapiens
attatgaaagcaacaaagaaa

SEQ ID NO: 5279427 - DNA, 13 bp, Homo sapiens
attatgaaatatg

SEQ ID NO: 5279428 - DNA, 15 bp, Homo sapiens
attatgaaatgccag

SEQ ID NO: 5279429 - DNA, 16 bp, Homo sapiens
attatgaaatttcact

SEQ ID NO: 5279430 - DNA, 19 bp, Homo sapiens
attatgaagaaggtgaata

SEQ ID NO: 5279431 - DNA, 15 bp, Homo sapiens
attatgaagatgttt

SEQ ID NO: 5279432 - DNA, 13 bp, Homo sapiens
attatgaaggaat

SEQ ID NO: 5279433 - DNA, 19 bp, Homo sapiens
attatgaaggaatttgatt

SEQ ID NO: 5279434 - DNA, 22 bp, Homo sapiens
attatgaatgagttttacaaat

SEQ ID NO: 5279435 - DNA, 15 bp, Homo sapiens
attatgacaaatgaa

SEQ ID NO: 5279436 - DNA, 17 bp, Homo sapiens
attatgacaaatgaaag

SEQ ID NO: 5279437 - DNA, 16 bp, Homo sapiens
attatgacagttatac

SEQ ID NO: 5279438 - DNA, 18 bp, Homo sapiens
attatgacatttcttaaa

SEQ ID NO: 5279439 - DNA, 20 bp, Homo sapiens
attatgacatttcttaaaac

SEQ ID NO: 5279440 - DNA, 21 bp, Homo sapiens
attatgacatttcttaaaact

SEQ ID NO: 5279441 - DNA, 15 bp, Homo sapiens
attatgacgtgcaca

SEQ ID NO: 5279442 - DNA, 22 bp, Homo sapiens
attatgacgtgcacaaaccttc

SEQ ID NO: 5279443 - DNA, 11 bp, Homo sapiens
attatgagcca

SEQ ID NO: 5279444 - DNA, 23 bp, Homo sapiens
attatgagctatcctttcaaaca

SEQ ID NO: 5279445 - DNA, 19 bp, Homo sapiens
attatgagttccctaaaca

SEQ ID NO: 5279446 - DNA, 16 bp, Homo sapiens
attatgagtttgctta

SEQ ID NO: 5279447 - DNA, 16 bp, Homo sapiens
attatgatctaataaa

SEQ ID NO: 5279448 - DNA, 19 bp, Homo sapiens
attatgatctaataaactt

SEQ ID NO: 5279449 - DNA, 20 bp, Homo sapiens
attatgatctaataaacttt

SEQ ID NO: 5279450 - DNA, 12 bp, Homo sapiens
attatgcaaaat

SEQ ID NO: 5279451 - DNA, 17 bp, Homo sapiens
attatgcaaattcccag

SEQ ID NO: 5279452 - DNA, 22 bp, Homo sapiens
attatgcaattagcctcatagt

SEQ ID NO: 5279453 - DNA, 13 bp, Homo sapiens
attatgcactggc

SEQ ID NO: 5279454 - DNA, 14 bp, Homo sapiens
attatgcactggcc

SEQ ID NO: 5279455 - DNA, 17 bp, Homo sapiens
attatgcagaatacttt

SEQ ID NO: 5279456 - DNA, 13 bp, Homo sapiens
attatgcataaag

SEQ ID NO: 5279457 - DNA, 23 bp, Homo sapiens
attatgcattcttataacataac

SEQ ID NO: 5279458 - DNA, 22 bp, Homo sapiens
attatgccacttccttttaact

SEQ ID NO: 5279459 - DNA, 17 bp, Homo sapiens
attatgcccatgaacaa

SEQ ID NO: 5279460 - DNA, 16 bp, Homo sapiens
attatgctttgaactt

SEQ ID NO: 5279461 - DNA, 13 bp, Homo sapiens
atttgaaacattg

SEQ ID NO: 5279462 - DNA, 19 bp, Homo sapiens
atttgaaacattgctttta

SEQ ID NO: 5279463 - DNA, 18 bp, Homo sapiens
atttgaaaccaggacatt

SEQ ID NO: 5279464 - DNA, 11 bp, Homo sapiens
atttgaaagaa

SEQ ID NO: 5279465 - DNA, 14 bp, Homo sapiens
atttgaaagaaagt

SEQ ID NO: 5279466 - DNA, 18 bp, Homo sapiens
atttgaaagaaagtgtta

SEQ ID NO: 5279467 - DNA, 21 bp, Homo sapiens
atttgaaagaagtcaaatgaa

SEQ ID NO: 5279468 - DNA, 16 bp, Homo sapiens
atttgaaagtgccttt

SEQ ID NO: 5279469 - DNA, 20 bp, Homo sapiens
atttgaaagtgcctttgcag

SEQ ID NO: 5279470 - DNA, 23 bp, Homo sapiens
atttgaaagtgggtttcaattta

SEQ ID NO: 5279471 - DNA, 22 bp, Homo sapiens
atttgaaagtttccttattttc

SEQ ID NO: 5279472 - DNA, 21 bp, Homo sapiens
atttgaaataaagttgaatat

SEQ ID NO: 5279473 - DNA, 14 bp, Homo sapiens
atttgaaataattt

SEQ ID NO: 5279474 - DNA, 21 bp, Homo sapiens
atttgaaatactaaaagcaaa

SEQ ID NO: 5279475 - DNA, 16 bp, Homo sapiens
atttgaaatagtatac

SEQ ID NO: 5279476 - DNA, 19 bp, Homo sapiens
atttgaaatcaccttttct

SEQ ID NO: 5279477 - DNA, 18 bp, Homo sapiens
atttgaaattttatttag

SEQ ID NO: 5279478 - DNA, 14 bp, Homo sapiens
atttgaacaaaaat

SEQ ID NO: 5279479 - DNA, 15 bp, Homo sapiens
atttgaacaaaaatt

SEQ ID NO: 5279480 - DNA, 16 bp, Homo sapiens
atttgaacaaaaattg

SEQ ID NO: 5279481 - DNA, 19 bp, Homo sapiens
atttgaacaatgaagttga

SEQ ID NO: 5279482 - DNA, 19 bp, Homo sapiens
atttgaacaggtcaaagat

SEQ ID NO: 5279483 - DNA, 21 bp, Homo sapiens
atttgaacccccgccatcctt

SEQ ID NO: 5279484 - DNA, 11 bp, Homo sapiens
atttgaacttt

SEQ ID NO: 5279485 - DNA, 19 bp, Homo sapiens
atttgaagaatgaacaaat

SEQ ID NO: 5279486 - DNA, 20 bp, Homo sapiens
atttgaagacaaaaatactc

SEQ ID NO: 5279487 - DNA, 20 bp, Homo sapiens
atttgaagaccaaagttgtt

SEQ ID NO: 5279488 - DNA, 19 bp, Homo sapiens
atttgaagatttaattact

SEQ ID NO: 5279489 - DNA, 16 bp, Homo sapiens
atttgaagctgtaccc

SEQ ID NO: 5279490 - DNA, 13 bp, Homo sapiens
atttgaaggccag

SEQ ID NO: 5279491 - DNA, 23 bp, Homo sapiens
atttgaaggtagaatgttttcaa

SEQ ID NO: 5279492 - DNA, 14 bp, Homo sapiens
atttgaaggtctgc

SEQ ID NO: 5279493 - DNA, 23 bp, Homo sapiens
atttgaaggtctgcaagaacctg

SEQ ID NO: 5279494 - DNA, 17 bp, Homo sapiens
atttgaaggtcttgatt

SEQ ID NO: 5279495 - DNA, 22 bp, Homo sapiens
atttgaagtgtacctgtgtaca

SEQ ID NO: 5279496 - DNA, 16 bp, Homo sapiens
atttgaataaattatg

SEQ ID NO: 5279497 - DNA, 15 bp, Homo sapiens
atttgaataagcaga

SEQ ID NO: 5279498 - DNA, 19 bp, Homo sapiens
atttgaataatcagatgct

SEQ ID NO: 5279499 - DNA, 13 bp, Homo sapiens
atttgaataatgt

SEQ ID NO: 5279500 - DNA, 20 bp, Homo sapiens
atttgaataatgtctagatt

SEQ ID NO: 5279501 - DNA, 17 bp, Homo sapiens
atttgaatatcattaaa

SEQ ID NO: 5279502 - DNA, 16 bp, Homo sapiens
atttgaatatccattc

SEQ ID NO: 5279503 - DNA, 14 bp, Homo sapiens
atttgaatcaatgt

SEQ ID NO: 5279504 - DNA, 14 bp, Homo sapiens
atttgaatcagcct

SEQ ID NO: 5279505 - DNA, 18 bp, Homo sapiens
atttgaatctgagtgaat

SEQ ID NO: 5279506 - DNA, 20 bp, Homo sapiens
atttgaatcttgtctcaatg

SEQ ID NO: 5279507 - DNA, 11 bp, Homo sapiens
atttgaatgaa

SEQ ID NO: 5279508 - DNA, 12 bp, Homo sapiens
atttgaatgcat

SEQ ID NO: 5279509 - DNA, 21 bp, Homo sapiens
atttgaatggtgcagaaaaaa

SEQ ID NO: 5279510 - DNA, 18 bp, Homo sapiens
atttgaatgtatgcttca

SEQ ID NO: 5279511 - DNA, 15 bp, Homo sapiens
atttgaattaaaact

SEQ ID NO: 5279512 - DNA, 17 bp, Homo sapiens
atttgaattaaaacttc

SEQ ID NO: 5279513 - DNA, 20 bp, Homo sapiens
atttgaattaaaacttctta

SEQ ID NO: 5279514 - DNA, 13 bp, Homo sapiens
atttgaattagaa

SEQ ID NO: 5279515 - DNA, 23 bp, Homo sapiens
atttgaattagtaactgtatgaa

SEQ ID NO: 5279516 - DNA, 19 bp, Homo sapiens
atttgaattcttgatctct

SEQ ID NO: 5279517 - DNA, 20 bp, Homo sapiens
atttgaattcttgatctcta

SEQ ID NO: 5279518 - DNA, 22 bp, Homo sapiens
atttgaatttagggtgatttta

SEQ ID NO: 5279519 - DNA, 20 bp, Homo sapiens
atttgaattttaaatctaaa

SEQ ID NO: 5279520 - DNA, 13 bp, Homo sapiens
atttgaattttgt

SEQ ID NO: 5279521 - DNA, 14 bp, Homo sapiens
atttgacaacacat

SEQ ID NO: 5279522 - DNA, 14 bp, Homo sapiens
atttgacacactca

SEQ ID NO: 5279523 - DNA, 20 bp, Homo sapiens
atttgacacactcaccattt

SEQ ID NO: 5279524 - DNA, 15 bp, Homo sapiens
atttgacacataaaa

SEQ ID NO: 5279525 - DNA, 19 bp, Homo sapiens
atttgacacataaaagtaa

SEQ ID NO: 5279526 - DNA, 16 bp, Homo sapiens
atttgacatagtctgg

SEQ ID NO: 5279527 - DNA, 21 bp, Homo sapiens
atttgacatagtctggctgta

SEQ ID NO: 5279528 - DNA, 19 bp, Homo sapiens
atttgacatgagtctccag

SEQ ID NO: 5279529 - DNA, 19 bp, Homo sapiens
atttgacattgtcagaatg

SEQ ID NO: 5279530 - DNA, 20 bp, Homo sapiens
atttgacattgtcagaatgt

SEQ ID NO: 5279531 - DNA, 22 bp, Homo sapiens
atttgacattgtcagaatgttg

SEQ ID NO: 5279532 - DNA, 23 bp, Homo sapiens
atttgacattgtcagaatgttgt

SEQ ID NO: 5279533 - DNA, 21 bp, Homo sapiens
atttgaccagaactttttcct

SEQ ID NO: 5279534 - DNA, 23 bp, Homo sapiens
atttgaccagaactttttcctct

SEQ ID NO: 5279535 - DNA, 19 bp, Homo sapiens
atttgaccattttagtttt

SEQ ID NO: 5279536 - DNA, 20 bp, Homo sapiens
atttgacccactcacacttg

SEQ ID NO: 5279537 - DNA, 13 bp, Homo sapiens
atttgacctaatc

SEQ ID NO: 5279538 - DNA, 21 bp, Homo sapiens
atttgacctaatcactaattt

SEQ ID NO: 5279539 - DNA, 13 bp, Homo sapiens
atttgacctacaa

SEQ ID NO: 5279540 - DNA, 16 bp, Homo sapiens
atttgactctttcaaa

SEQ ID NO: 5279541 - DNA, 22 bp, Homo sapiens
atttgactctttcaaagaaatc

SEQ ID NO: 5279542 - DNA, 18 bp, Homo sapiens
atttgactgtttttaccc

SEQ ID NO: 5279543 - DNA, 13 bp, Homo sapiens
atttgacttgaat

SEQ ID NO: 5279544 - DNA, 19 bp, Homo sapiens
atttgacttgcatgaagag

SEQ ID NO: 5279545 - DNA, 16 bp, Homo sapiens
atttgacttgtggttg

SEQ ID NO: 5279546 - DNA, 18 bp, Homo sapiens
atttgactttaatttatg

SEQ ID NO: 5279547 - DNA, 18 bp, Homo sapiens
atttgagaaaatataata

SEQ ID NO: 5279548 - DNA, 17 bp, Homo sapiens
atttgagaaatgcatat

SEQ ID NO: 5279549 - DNA, 16 bp, Homo sapiens
atttgagaatacataa

SEQ ID NO: 5279550 - DNA, 21 bp, Homo sapiens
atttgagaatataaaaaactt

SEQ ID NO: 5279551 - DNA, 14 bp, Homo sapiens
atttgagactattt

SEQ ID NO: 5279552 - DNA, 18 bp, Homo sapiens
atttgagactgaaattta

SEQ ID NO: 5279553 - DNA, 18 bp, Homo sapiens
atttgagagaaatatgaa

SEQ ID NO: 5279554 - DNA, 13 bp, Homo sapiens
atttgagagactg

SEQ ID NO: 5279555 - DNA, 16 bp, Homo sapiens
atttgagcactggtct

SEQ ID NO: 5279556 - DNA, 15 bp, Homo sapiens
atttgagcagggctc

SEQ ID NO: 5279557 - DNA, 17 bp, Homo sapiens
atttgagcagggctcag

SEQ ID NO: 5279558 - DNA, 21 bp, Homo sapiens
atttgagcatggccagactat

SEQ ID NO: 5279559 - DNA, 17 bp, Homo sapiens
atttgagccatttaaag

SEQ ID NO: 5279560 - DNA, 22 bp, Homo sapiens
atttgaggacaaccattccaga

SEQ ID NO: 5279561 - DNA, 14 bp, Homo sapiens
atttgaggagacga

SEQ ID NO: 5279562 - DNA, 23 bp, Homo sapiens
atttgaggagtgttaagattgca

SEQ ID NO: 5279563 - DNA, 14 bp, Homo sapiens
atttgaggctcaga

SEQ ID NO: 5279564 - DNA, 13 bp, Homo sapiens
atttgaggtcaag

SEQ ID NO: 5279565 - DNA, 15 bp, Homo sapiens
atttgaggtctgttc

SEQ ID NO: 5279566 - DNA, 21 bp, Homo sapiens
atttgaggtctgttctttcca

SEQ ID NO: 5279567 - DNA, 13 bp, Homo sapiens
atttgaggtgaaa

SEQ ID NO: 5279568 - DNA, 23 bp, Homo sapiens
atttgagtaatctgatcgttctt

SEQ ID NO: 5279569 - DNA, 14 bp, Homo sapiens
atttgagtgctctg

SEQ ID NO: 5279570 - DNA, 16 bp, Homo sapiens
atttgagttgtgattg

SEQ ID NO: 5279571 - DNA, 19 bp, Homo sapiens
atttgagttgtgattgaaa

SEQ ID NO: 5279572 - DNA, 13 bp, Homo sapiens
atttgagtttcct

SEQ ID NO: 5279573 - DNA, 23 bp, Homo sapiens
atttgagtttcctttaaatactc

SEQ ID NO: 5279574 - DNA, 14 bp, Homo sapiens
atttgagtttgctg

SEQ ID NO: 5279575 - DNA, 17 bp, Homo sapiens
atttgataaaaacccaa

SEQ ID NO: 5279576 - DNA, 20 bp, Homo sapiens
atttgataatcagtttccac

SEQ ID NO: 5279577 - DNA, 16 bp, Homo sapiens
atttgataatgacact

SEQ ID NO: 5279578 - DNA, 13 bp, Homo sapiens
atttgatacataa

SEQ ID NO: 5279579 - DNA, 14 bp, Homo sapiens
atttgatacataat

SEQ ID NO: 5279580 - DNA, 16 bp, Homo sapiens
atttgatacccctggg

SEQ ID NO: 5279581 - DNA, 14 bp, Homo sapiens
atttgatacttata

SEQ ID NO: 5279582 - DNA, 15 bp, Homo sapiens
atttgatacttatat

SEQ ID NO: 5279583 - DNA, 14 bp, Homo sapiens
atttgatagatgtt

SEQ ID NO: 5279584 - DNA, 20 bp, Homo sapiens
atttgatagtattgtgcata

SEQ ID NO: 5279585 - DNA, 21 bp, Homo sapiens
atttgatatacagacctccag

SEQ ID NO: 5279586 - DNA, 14 bp, Homo sapiens
atttgatatcacag

SEQ ID NO: 5279587 - DNA, 19 bp, Homo sapiens
atttgatatgtgaacagtt

SEQ ID NO: 5279588 - DNA, 22 bp, Homo sapiens
atttgatattgtgtaggaaatc

SEQ ID NO: 5279589 - DNA, 15 bp, Homo sapiens
atttgatatttggtt

SEQ ID NO: 5279590 - DNA, 22 bp, Homo sapiens
atttgatatttttccatttatt

SEQ ID NO: 5279591 - DNA, 17 bp, Homo sapiens
atttgatattttttaaa

SEQ ID NO: 5279592 - DNA, 19 bp, Homo sapiens
atttgatcttgtaaaaata

SEQ ID NO: 5279593 - DNA, 22 bp, Homo sapiens
atttgatctttgtttaaatgcc

SEQ ID NO: 5279594 - DNA, 23 bp, Homo sapiens
atttgatctttgtttaaatgcca

SEQ ID NO: 5279595 - DNA, 22 bp, Homo sapiens
atttgatgagttaactgtgaaa

SEQ ID NO: 5279596 - DNA, 22 bp, Homo sapiens
atttgatgcccaatatattctg

SEQ ID NO: 5279597 - DNA, 18 bp, Homo sapiens
atttgatgcccagataat

SEQ ID NO: 5279598 - DNA, 17 bp, Homo sapiens
atttgatgcgatctgct

SEQ ID NO: 5279599 - DNA, 22 bp, Homo sapiens
atttgatggactaattattatt

SEQ ID NO: 5279600 - DNA, 23 bp, Homo sapiens
atttgatgggccacaactgtctt

SEQ ID NO: 5279601 - DNA, 20 bp, Homo sapiens
atttgatggtatttctttct

SEQ ID NO: 5279602 - DNA, 17 bp, Homo sapiens
atttgatggtgaatatt

SEQ ID NO: 5279603 - DNA, 21 bp, Homo sapiens
atttgatggtggtattgtgac

SEQ ID NO: 5279604 - DNA, 19 bp, Homo sapiens
atttgatgtaagttactga

SEQ ID NO: 5279605 - DNA, 17 bp, Homo sapiens
atttgatgtaatacttc

SEQ ID NO: 5279606 - DNA, 13 bp, Homo sapiens
atttgatgtacat

SEQ ID NO: 5279607 - DNA, 19 bp, Homo sapiens
atttgatgtctagataaca

SEQ ID NO: 5279608 - DNA, 20 bp, Homo sapiens
atttgattaaattatgaatg

SEQ ID NO: 5279609 - DNA, 16 bp, Homo sapiens
atttgattaacaaata

SEQ ID NO: 5279610 - DNA, 17 bp, Homo sapiens
atttgattaacatttgt

SEQ ID NO: 5279611 - DNA, 14 bp, Homo sapiens
atttgattaggtat

SEQ ID NO: 5279612 - DNA, 19 bp, Homo sapiens
atttgattaggtatgtttg

SEQ ID NO: 5279613 - DNA, 19 bp, Homo sapiens
atttgattatttaagacta

SEQ ID NO: 5279614 - DNA, 20 bp, Homo sapiens
atttgattcaaaatatttaa

SEQ ID NO: 5279615 - DNA, 13 bp, Homo sapiens
atttgattgattt

SEQ ID NO: 5279616 - DNA, 16 bp, Homo sapiens
atttgattgatttgaa

SEQ ID NO: 5279617 - DNA, 13 bp, Homo sapiens
atttgattgcttt

SEQ ID NO: 5279618 - DNA, 15 bp, Homo sapiens
atttgattgctttgc

SEQ ID NO: 5279619 - DNA, 19 bp, Homo sapiens
atttgattgtaaaaacaaa

SEQ ID NO: 5279620 - DNA, 20 bp, Homo sapiens
atttgattgtaaaaacaaaa

SEQ ID NO: 5279621 - DNA, 13 bp, Homo sapiens
atttgatttctat

SEQ ID NO: 5279622 - DNA, 19 bp, Homo sapiens
atttgatttgatatacaga

SEQ ID NO: 5279623 - DNA, 22 bp, Homo sapiens
atttgcaaaccctttgtattat

SEQ ID NO: 5279624 - DNA, 13 bp, Homo sapiens
atttgcaaagtac

SEQ ID NO: 5279625 - DNA, 15 bp, Homo sapiens
atttgcaaagtactg

SEQ ID NO: 5279626 - DNA, 13 bp, Homo sapiens
atttgcaaatgca

SEQ ID NO: 5279627 - DNA, 14 bp, Homo sapiens
atttgcaacactgc

SEQ ID NO: 5279628 - DNA, 16 bp, Homo sapiens
atttgcaacagcaaat

SEQ ID NO: 5279629 - DNA, 18 bp, Homo sapiens
atttgcaacagcaaatta

SEQ ID NO: 5279630 - DNA, 12 bp, Homo sapiens
atttgcaacatt

SEQ ID NO: 5279631 - DNA, 18 bp, Homo sapiens
atttgcaagtcatggctg

SEQ ID NO: 5279632 - DNA, 13 bp, Homo sapiens
atttgcaataaaa

SEQ ID NO: 5279633 - DNA, 16 bp, Homo sapiens
atttgcaataacagct

SEQ ID NO: 5279634 - DNA, 21 bp, Homo sapiens
atttgcaatatggatttctta

SEQ ID NO: 5279635 - DNA, 18 bp, Homo sapiens
atttgcaatgggatgtat

SEQ ID NO: 5279636 - DNA, 21 bp, Homo sapiens
atttgcaattcatgtaacagt

SEQ ID NO: 5279637 - DNA, 20 bp, Homo sapiens
atttgcaatttgagccattt

SEQ ID NO: 5279638 - DNA, 18 bp, Homo sapiens
atttgcacaatatttctt

SEQ ID NO: 5279639 - DNA, 20 bp, Homo sapiens
attatgctttgaactttagt

SEQ ID NO: 5279640 - DNA, 15 bp, Homo sapiens
attatggaaaactgt

SEQ ID NO: 5279641 - DNA, 20 bp, Homo sapiens
attatggaagattttaaatt

SEQ ID NO: 5279642 - DNA, 23 bp, Homo sapiens
attatggatacgtgttttgaatt

SEQ ID NO: 5279643 - DNA, 13 bp, Homo sapiens
attatggcatttc

SEQ ID NO: 5279644 - DNA, 14 bp, Homo sapiens
attatggcatttct

SEQ ID NO: 5279645 - DNA, 17 bp, Homo sapiens
attatggcatttctatt

SEQ ID NO: 5279646 - DNA, 21 bp, Homo sapiens
attatggcctttttaagtatt

SEQ ID NO: 5279647 - DNA, 21 bp, Homo sapiens
attatggcttgtgaactgctg

SEQ ID NO: 5279648 - DNA, 18 bp, Homo sapiens
attatgggaacaagtgta

SEQ ID NO: 5279649 - DNA, 21 bp, Homo sapiens
attatgggaacaagtgtacag

SEQ ID NO: 5279650 - DNA, 22 bp, Homo sapiens
attatgggaacaagtgtacaga

SEQ ID NO: 5279651 - DNA, 18 bp, Homo sapiens
attatgggaatcaagatt

SEQ ID NO: 5279652 - DNA, 17 bp, Homo sapiens
attatgggtatgtgttg

SEQ ID NO: 5279653 - DNA, 18 bp, Homo sapiens
attatgggtatgtgttgc

SEQ ID NO: 5279654 - DNA, 16 bp, Homo sapiens
attatgggtcacagga

SEQ ID NO: 5279655 - DNA, 19 bp, Homo sapiens
attatggtcatatttcaca

SEQ ID NO: 5279656 - DNA, 15 bp, Homo sapiens
attatggtgaaatta

SEQ ID NO: 5279657 - DNA, 15 bp, Homo sapiens
attatggtgtaatgc

SEQ ID NO: 5279658 - DNA, 14 bp, Homo sapiens
attatgtaaaagaa

SEQ ID NO: 5279659 - DNA, 23 bp, Homo sapiens
attatgtaaatacaatttgtact

SEQ ID NO: 5279660 - DNA, 15 bp, Homo sapiens
attatgtaaatccca

SEQ ID NO: 5279661 - DNA, 15 bp, Homo sapiens
attatgtaacactag

SEQ ID NO: 5279662 - DNA, 18 bp, Homo sapiens
attatgtaacatccagaa

SEQ ID NO: 5279663 - DNA, 14 bp, Homo sapiens
attatgtaagcatt

SEQ ID NO: 5279664 - DNA, 17 bp, Homo sapiens
attatgtaatatattgt

SEQ ID NO: 5279665 - DNA, 15 bp, Homo sapiens
attatgtacaacatt

SEQ ID NO: 5279666 - DNA, 12 bp, Homo sapiens
attatgtagctc

SEQ ID NO: 5279667 - DNA, 14 bp, Homo sapiens
attatgtataaaat

SEQ ID NO: 5279668 - DNA, 20 bp, Homo sapiens
attatgtataaaatgtaaca

SEQ ID NO: 5279669 - DNA, 24 bp, Homo sapiens
attatgtataaaatgtaacactga

SEQ ID NO: 5279670 - DNA, 16 bp, Homo sapiens
attatgtataaacata

SEQ ID NO: 5279671 - DNA, 17 bp, Homo sapiens
attatgtatggatatat

SEQ ID NO: 5279672 - DNA, 17 bp, Homo sapiens
attatgtattggcattt

SEQ ID NO: 5279673 - DNA, 16 bp, Homo sapiens
attatgtatttataat

SEQ ID NO: 5279674 - DNA, 19 bp, Homo sapiens
attatgtatttataattta

SEQ ID NO: 5279675 - DNA, 23 bp, Homo sapiens
attatgtcaaatggatgtaatat

SEQ ID NO: 5279676 - DNA, 12 bp, Homo sapiens
attatgtcttct

SEQ ID NO: 5279677 - DNA, 11 bp, Homo sapiens
attatgtgaag

SEQ ID NO: 5279678 - DNA, 13 bp, Homo sapiens
attatgtgaagaa

SEQ ID NO: 5279679 - DNA, 14 bp, Homo sapiens
attatgtgaagaat

SEQ ID NO: 5279680 - DNA, 18 bp, Homo sapiens
attatgtgaagaatttag

SEQ ID NO: 5279681 - DNA, 20 bp, Homo sapiens
attatgtgacattttacatt

SEQ ID NO: 5279682 - DNA, 20 bp, Homo sapiens
attatgtgaccataatgtac

SEQ ID NO: 5279683 - DNA, 13 bp, Homo sapiens
attatgtgccaga

SEQ ID NO: 5279684 - DNA, 23 bp, Homo sapiens
attatgtgccagatttatgcata

SEQ ID NO: 5279685 - DNA, 21 bp, Homo sapiens
attatgtgccattttaataaa

SEQ ID NO: 5279686 - DNA, 14 bp, Homo sapiens
attatgtgccctgg

SEQ ID NO: 5279687 - DNA, 14 bp, Homo sapiens
attatgtggaatcc

SEQ ID NO: 5279688 - DNA, 17 bp, Homo sapiens
attatgtggttttagat

SEQ ID NO: 5279689 - DNA, 21 bp, Homo sapiens
attatgtgtgcatgtgtgtat

SEQ ID NO: 5279690 - DNA, 20 bp, Homo sapiens
attatgtgtgttttaaaatg

SEQ ID NO: 5279691 - DNA, 16 bp, Homo sapiens
attatgtgttgccaaa

SEQ ID NO: 5279692 - DNA, 21 bp, Homo sapiens
attatgttaaaactgggacag

SEQ ID NO: 5279693 - DNA, 13 bp, Homo sapiens
attatgttaaact

SEQ ID NO: 5279694 - DNA, 14 bp, Homo sapiens
attatgttaaacta

SEQ ID NO: 5279695 - DNA, 14 bp, Homo sapiens
attatgttaatatt

SEQ ID NO: 5279696 - DNA, 16 bp, Homo sapiens
attatgttaatatttc

SEQ ID NO: 5279697 - DNA, 19 bp, Homo sapiens
attatgttattgaaaaaaa

SEQ ID NO: 5279698 - DNA, 14 bp, Homo sapiens
attatgttattgga

SEQ ID NO: 5279699 - DNA, 12 bp, Homo sapiens
attatgttcatg

SEQ ID NO: 5279700 - DNA, 13 bp, Homo sapiens
attatgttcatgt

SEQ ID NO: 5279701 - DNA, 18 bp, Homo sapiens
attatgttcctgctgtat

SEQ ID NO: 5279702 - DNA, 19 bp, Homo sapiens
attatgttcctgctgtatt

SEQ ID NO: 5279703 - DNA, 22 bp, Homo sapiens
attatgttcctgctgtatttcc

SEQ ID NO: 5279704 - DNA, 19 bp, Homo sapiens
attatgttcttagcaataa

SEQ ID NO: 5279705 - DNA, 17 bp, Homo sapiens
attatgttggtactttc

SEQ ID NO: 5279706 - DNA, 16 bp, Homo sapiens
attatgttgttagaga

SEQ ID NO: 5279707 - DNA, 12 bp, Homo sapiens
attatgtttata

SEQ ID NO: 5279708 - DNA, 18 bp, Homo sapiens
attatgtttattacaatt

SEQ ID NO: 5279709 - DNA, 14 bp, Homo sapiens
attatgttttactg

SEQ ID NO: 5279710 - DNA, 22 bp, Homo sapiens
attatgttttatttaaatgctt

SEQ ID NO: 5279711 - DNA, 23 bp, Homo sapiens
attatgttttatttaaatgcttt

SEQ ID NO: 5279712 - DNA, 18 bp, Homo sapiens
attattaaaaattataga

SEQ ID NO: 5279713 - DNA, 19 bp, Homo sapiens
attattaaagaaaaatgca

SEQ ID NO: 5279714 - DNA, 11 bp, Homo sapiens
attattaaagg

SEQ ID NO: 5279715 - DNA, 18 bp, Homo sapiens
attattaaatcagttttg

SEQ ID NO: 5279716 - DNA, 14 bp, Homo sapiens
attattaacactaa

SEQ ID NO: 5279717 - DNA, 19 bp, Homo sapiens
attattaacactaataata

SEQ ID NO: 5279718 - DNA, 23 bp, Homo sapiens
attattaacatacctaagaagta

SEQ ID NO: 5279719 - DNA, 14 bp, Homo sapiens
attattaactacat

SEQ ID NO: 5279720 - DNA, 15 bp, Homo sapiens
attattaactacatt

SEQ ID NO: 5279721 - DNA, 20 bp, Homo sapiens
attattaactacatttatga

SEQ ID NO: 5279722 - DNA, 13 bp, Homo sapiens
attattaacttgt

SEQ ID NO: 5279723 - DNA, 21 bp, Homo sapiens
attattaaggtaactactgct

SEQ ID NO: 5279724 - DNA, 14 bp, Homo sapiens
attattaatcagaa

SEQ ID NO: 5279725 - DNA, 16 bp, Homo sapiens
attattaatcattcca

SEQ ID NO: 5279726 - DNA, 22 bp, Homo sapiens
attattaatgaaaataagaatt

SEQ ID NO: 5279727 - DNA, 14 bp, Homo sapiens
attattaatgcttt

SEQ ID NO: 5279728 - DNA, 16 bp, Homo sapiens
attattaatgctttgg

SEQ ID NO: 5279729 - DNA, 13 bp, Homo sapiens
attattaattgca

SEQ ID NO: 5279730 - DNA, 17 bp, Homo sapiens
attattacactgtaaga

SEQ ID NO: 5279731 - DNA, 20 bp, Homo sapiens
attattacactgtaagaaat

SEQ ID NO: 5279732 - DNA, 22 bp, Homo sapiens
attattactaattctatttctc

SEQ ID NO: 5279733 - DNA, 21 bp, Homo sapiens
attattactacaaaaccgttt

SEQ ID NO: 5279734 - DNA, 18 bp, Homo sapiens
attattactctacactga

SEQ ID NO: 5279735 - DNA, 14 bp, Homo sapiens
attattactggtat

SEQ ID NO: 5279736 - DNA, 20 bp, Homo sapiens
attattacttatttttgaca

SEQ ID NO: 5279737 - DNA, 16 bp, Homo sapiens
attattacttgtaaat

SEQ ID NO: 5279738 - DNA, 20 bp, Homo sapiens
attattacttgtaaatataa

SEQ ID NO: 5279739 - DNA, 22 bp, Homo sapiens
attattacttgtaaatataaag

SEQ ID NO: 5279740 - DNA, 14 bp, Homo sapiens
attattactttaaa

SEQ ID NO: 5279741 - DNA, 17 bp, Homo sapiens
attattactttaaatta

SEQ ID NO: 5279742 - DNA, 15 bp, Homo sapiens
attattagcatttgt

SEQ ID NO: 5279743 - DNA, 22 bp, Homo sapiens
attattagtttacatcattttt

SEQ ID NO: 5279744 - DNA, 22 bp, Homo sapiens
attattagttttgatttaatgt

SEQ ID NO: 5279745 - DNA, 19 bp, Homo sapiens
attattataaaagggggtc

SEQ ID NO: 5279746 - DNA, 13 bp, Homo sapiens
attattataaact

SEQ ID NO: 5279747 - DNA, 14 bp, Homo sapiens
attattataaacta

SEQ ID NO: 5279748 - DNA, 15 bp, Homo sapiens
attattatatacata

SEQ ID NO: 5279749 - DNA, 11 bp, Homo sapiens
attattatatt

SEQ ID NO: 5279750 - DNA, 14 bp, Homo sapiens
attattatattgaa

SEQ ID NO: 5279751 - DNA, 14 bp, Homo sapiens
attattatcattga

SEQ ID NO: 5279752 - DNA, 20 bp, Homo sapiens
attattatcttcttaacagt

SEQ ID NO: 5279753 - DNA, 14 bp, Homo sapiens
attattatgaagaa

SEQ ID NO: 5279754 - DNA, 22 bp, Homo sapiens
attattatgaagaattgccaat

SEQ ID NO: 5279755 - DNA, 15 bp, Homo sapiens
attattatgcaaaat

SEQ ID NO: 5279756 - DNA, 15 bp, Homo sapiens
attattatgtttatt

SEQ ID NO: 5279757 - DNA, 17 bp, Homo sapiens
attattattaaaaatat

SEQ ID NO: 5279758 - DNA, 14 bp, Homo sapiens
attattattactgt

SEQ ID NO: 5279759 - DNA, 16 bp, Homo sapiens
attattattatattgt

SEQ ID NO: 5279760 - DNA, 16 bp, Homo sapiens
attattatttaactct

SEQ ID NO: 5279761 - DNA, 17 bp, Homo sapiens
attattatttaactctt

SEQ ID NO: 5279762 - DNA, 15 bp, Homo sapiens
attattatttgtgtt

SEQ ID NO: 5279763 - DNA, 17 bp, Homo sapiens
attattattttaaaaat

SEQ ID NO: 5279764 - DNA, 19 bp, Homo sapiens
attattcaaaaaatcatgt

SEQ ID NO: 5279765 - DNA, 19 bp, Homo sapiens
attattcaaaccaatttct

SEQ ID NO: 5279766 - DNA, 13 bp, Homo sapiens
attattcaaagat

SEQ ID NO: 5279767 - DNA, 13 bp, Homo sapiens
attattcaaagtt

SEQ ID NO: 5279768 - DNA, 19 bp, Homo sapiens
attattcaaagttgcctaa

SEQ ID NO: 5279769 - DNA, 22 bp, Homo sapiens
attattcaaagttgcctaaatc

SEQ ID NO: 5279770 - DNA, 19 bp, Homo sapiens
attattcaagaaagtgaaa

SEQ ID NO: 5279771 - DNA, 18 bp, Homo sapiens
attattcaagaatgaaaa

SEQ ID NO: 5279772 - DNA, 20 bp, Homo sapiens
attattcaccatgtaaaaca

SEQ ID NO: 5279773 - DNA, 15 bp, Homo sapiens
attattcagtgtcac

SEQ ID NO: 5279774 - DNA, 18 bp, Homo sapiens
attattcatcaaactctt

SEQ ID NO: 5279775 - DNA, 12 bp, Homo sapiens
attattcattta

SEQ ID NO: 5279776 - DNA, 18 bp, Homo sapiens
attattcatttaaaatga

SEQ ID NO: 5279777 - DNA, 17 bp, Homo sapiens
attattccaaagttatt

SEQ ID NO: 5279778 - DNA, 21 bp, Homo sapiens
attattccctgtacaatattt

SEQ ID NO: 5279779 - DNA, 23 bp, Homo sapiens
attattctagtcaactgctgttt

SEQ ID NO: 5279780 - DNA, 13 bp, Homo sapiens
attattctcattt

SEQ ID NO: 5279781 - DNA, 16 bp, Homo sapiens
attattctcatttagt

SEQ ID NO: 5279782 - DNA, 18 bp, Homo sapiens
attattctcatttagtgc

SEQ ID NO: 5279783 - DNA, 22 bp, Homo sapiens
attattctccactttttcttat

SEQ ID NO: 5279784 - DNA, 12 bp, Homo sapiens
attattctctgc

SEQ ID NO: 5279785 - DNA, 21 bp, Homo sapiens
attattctcttttatctgttt

SEQ ID NO: 5279786 - DNA, 13 bp, Homo sapiens
attattctgcagc

SEQ ID NO: 5279787 - DNA, 15 bp, Homo sapiens
attattctgcctacg

SEQ ID NO: 5279788 - DNA, 13 bp, Homo sapiens
attattctgtttt

SEQ ID NO: 5279789 - DNA, 14 bp, Homo sapiens
attattctgttttg

SEQ ID NO: 5279790 - DNA, 17 bp, Homo sapiens
attattcttcttacatt

SEQ ID NO: 5279791 - DNA, 12 bp, Homo sapiens
attattcttgta

SEQ ID NO: 5279792 - DNA, 13 bp, Homo sapiens
attattctttctc

SEQ ID NO: 5279793 - DNA, 16 bp, Homo sapiens
attattctttctcctt

SEQ ID NO: 5279794 - DNA, 13 bp, Homo sapiens
attattgaaatag

SEQ ID NO: 5279795 - DNA, 15 bp, Homo sapiens
attattgaaatatta

SEQ ID NO: 5279796 - DNA, 17 bp, Homo sapiens
attattgaagatgtgat

SEQ ID NO: 5279797 - DNA, 21 bp, Homo sapiens
attattgaaggaagccaaatt

SEQ ID NO: 5279798 - DNA, 19 bp, Homo sapiens
attattgagtctgtccaga

SEQ ID NO: 5279799 - DNA, 16 bp, Homo sapiens
attattgagttcctcc

SEQ ID NO: 5279800 - DNA, 16 bp, Homo sapiens
attattgatacaacag

SEQ ID NO: 5279801 - DNA, 18 bp, Homo sapiens
attattgatcaaaatcaa

SEQ ID NO: 5279802 - DNA, 21 bp, Homo sapiens
attattgatcaaaatcaaaag

SEQ ID NO: 5279803 - DNA, 21 bp, Homo sapiens
attattgccaaataagacagt

SEQ ID NO: 5279804 - DNA, 20 bp, Homo sapiens
attattgctgtttggtttgt

SEQ ID NO: 5279805 - DNA, 11 bp, Homo sapiens
attattgctta

SEQ ID NO: 5279806 - DNA, 21 bp, Homo sapiens
attattggaaaggacctaaaa

SEQ ID NO: 5279807 - DNA, 15 bp, Homo sapiens
attattggctgcttt

SEQ ID NO: 5279808 - DNA, 20 bp, Homo sapiens
attattggtatatttgtaga

SEQ ID NO: 5279809 - DNA, 17 bp, Homo sapiens
attattggttggtgtga

SEQ ID NO: 5279810 - DNA, 23 bp, Homo sapiens
attattggttggtgtgaagaaag

SEQ ID NO: 5279811 - DNA, 14 bp, Homo sapiens
attattgtaaactt

SEQ ID NO: 5279812 - DNA, 22 bp, Homo sapiens
attattgtaagttgtacaaatg

SEQ ID NO: 5279813 - DNA, 13 bp, Homo sapiens
attattgtatatt

SEQ ID NO: 5279814 - DNA, 20 bp, Homo sapiens
attattgtctgattgaaaca

SEQ ID NO: 5279815 - DNA, 21 bp, Homo sapiens
attattgtctgattgaaacat

SEQ ID NO: 5279816 - DNA, 23 bp, Homo sapiens
attattgtctgattgaaacatga

SEQ ID NO: 5279817 - DNA, 19 bp, Homo sapiens
attattgtctgttttcctt

SEQ ID NO: 5279818 - DNA, 18 bp, Homo sapiens
attattgtgacttcactg

SEQ ID NO: 5279819 - DNA, 23 bp, Homo sapiens
atttgcacaatatttcttttgtt

SEQ ID NO: 5279820 - DNA, 17 bp, Homo sapiens
atttgcacacatttaaa

SEQ ID NO: 5279821 - DNA, 23 bp, Homo sapiens
atttgcacagaagcacatgcacc

SEQ ID NO: 5279822 - DNA, 14 bp, Homo sapiens
atttgcacattaaa

SEQ ID NO: 5279823 - DNA, 22 bp, Homo sapiens
atttgcaccagttttatccata

SEQ ID NO: 5279824 - DNA, 18 bp, Homo sapiens
atttgcaccatcatgttt

SEQ ID NO: 5279825 - DNA, 14 bp, Homo sapiens
atttgcacctctgt

SEQ ID NO: 5279826 - DNA, 17 bp, Homo sapiens
atttgcactaatgtgtt

SEQ ID NO: 5279827 - DNA, 14 bp, Homo sapiens
atttgcactgcttt

SEQ ID NO: 5279828 - DNA, 15 bp, Homo sapiens
atttgcacttatgta

SEQ ID NO: 5279829 - DNA, 19 bp, Homo sapiens
atttgcagagacaggacct

SEQ ID NO: 5279830 - DNA, 22 bp, Homo sapiens
atttgcagctgagagaaaataa

SEQ ID NO: 5279831 - DNA, 15 bp, Homo sapiens
atttgcagctgctgg

SEQ ID NO: 5279832 - DNA, 18 bp, Homo sapiens
atttgcaggatctgtctg

SEQ ID NO: 5279833 - DNA, 19 bp, Homo sapiens
atttgcaggatctgtctgt

SEQ ID NO: 5279834 - DNA, 23 bp, Homo sapiens
atttgcaggatctgtctgtgcac

SEQ ID NO: 5279835 - DNA, 17 bp, Homo sapiens
atttgcaggattccctt

SEQ ID NO: 5279836 - DNA, 21 bp, Homo sapiens
atttgcaggatttttagagca

SEQ ID NO: 5279837 - DNA, 13 bp, Homo sapiens
atttgcagtatga

SEQ ID NO: 5279838 - DNA, 21 bp, Homo sapiens
atttgcataacaattcctcta

SEQ ID NO: 5279839 - DNA, 14 bp, Homo sapiens
atttgcataatact

SEQ ID NO: 5279840 - DNA, 23 bp, Homo sapiens
atttgcataatactaatttattg

SEQ ID NO: 5279841 - DNA, 20 bp, Homo sapiens
atttgcatatcacccttccc

SEQ ID NO: 5279842 - DNA, 23 bp, Homo sapiens
atttgcatatcacccttccctgc

SEQ ID NO: 5279843 - DNA, 15 bp, Homo sapiens
atttgcatatgtatg

SEQ ID NO: 5279844 - DNA, 22 bp, Homo sapiens
atttgcatattctattgtatta

SEQ ID NO: 5279845 - DNA, 17 bp, Homo sapiens
atttgcatatttattgc

SEQ ID NO: 5279846 - DNA, 21 bp, Homo sapiens
atttgcatatttttctaaaga

SEQ ID NO: 5279847 - DNA, 14 bp, Homo sapiens
atttgcatgccttt

SEQ ID NO: 5279848 - DNA, 14 bp, Homo sapiens
atttgcatgtctaa

SEQ ID NO: 5279849 - DNA, 22 bp, Homo sapiens
atttgcatgtgtaaatctgaaa

SEQ ID NO: 5279850 - DNA, 14 bp, Homo sapiens
atttgcatgttatg

SEQ ID NO: 5279851 - DNA, 19 bp, Homo sapiens
atttgcattaaattcacaa

SEQ ID NO: 5279852 - DNA, 23 bp, Homo sapiens
atttgcattaaattcacaaactt

SEQ ID NO: 5279853 - DNA, 16 bp, Homo sapiens
atttgcattatgtatt

SEQ ID NO: 5279854 - DNA, 19 bp, Homo sapiens
atttgcattatgtatttat

SEQ ID NO: 5279855 - DNA, 18 bp, Homo sapiens
atttgcatttcagaatat

SEQ ID NO: 5279856 - DNA, 13 bp, Homo sapiens
atttgcatttgtt

SEQ ID NO: 5279857 - DNA, 21 bp, Homo sapiens
atttgcatttgtttatgtaat

SEQ ID NO: 5279858 - DNA, 22 bp, Homo sapiens
atttgcatttgtttatgtaatt

SEQ ID NO: 5279859 - DNA, 18 bp, Homo sapiens
atttgccaaaaactaaaa

SEQ ID NO: 5279860 - DNA, 17 bp, Homo sapiens
atttgccaaaataatgt

SEQ ID NO: 5279861 - DNA, 16 bp, Homo sapiens
atttgccaataataat

SEQ ID NO: 5279862 - DNA, 17 bp, Homo sapiens
atttgccagacagagat

SEQ ID NO: 5279863 - DNA, 22 bp, Homo sapiens
atttgccagacagagatcagaa

SEQ ID NO: 5279864 - DNA, 14 bp, Homo sapiens
atttgccagcacag

SEQ ID NO: 5279865 - DNA, 21 bp, Homo sapiens
atttgccatgacatttcatct

SEQ ID NO: 5279866 - DNA, 22 bp, Homo sapiens
atttgccatgacatttcatctg

SEQ ID NO: 5279867 - DNA, 11 bp, Homo sapiens
atttgccatta

SEQ ID NO: 5279868 - DNA, 15 bp, Homo sapiens
atttgcccatttaca

SEQ ID NO: 5279869 - DNA, 20 bp, Homo sapiens
atttgcccatttacactttt

SEQ ID NO: 5279870 - DNA, 11 bp, Homo sapiens
atttgccccaa

SEQ ID NO: 5279871 - DNA, 23 bp, Homo sapiens
atttgccccaacttaagtttaga

SEQ ID NO: 5279872 - DNA, 15 bp, Homo sapiens
atttgcccctggcaa

SEQ ID NO: 5279873 - DNA, 17 bp, Homo sapiens
atttgcccctggcaaat

SEQ ID NO: 5279874 - DNA, 20 bp, Homo sapiens
atttgcccctggcaaatgca

SEQ ID NO: 5279875 - DNA, 16 bp, Homo sapiens
atttgccctgggaaac

SEQ ID NO: 5279876 - DNA, 18 bp, Homo sapiens
atttgccctgggaaaccc

SEQ ID NO: 5279877 - DNA, 14 bp, Homo sapiens
atttgccctgtgga

SEQ ID NO: 5279878 - DNA, 23 bp, Homo sapiens
atttgcccttcaggacccttcta

SEQ ID NO: 5279879 - DNA, 17 bp, Homo sapiens
atttgcctaattcctgg

SEQ ID NO: 5279880 - DNA, 22 bp, Homo sapiens
atttgcctattcccacacctcc

SEQ ID NO: 5279881 - DNA, 20 bp, Homo sapiens
atttgcctcaccttggggcc

SEQ ID NO: 5279882 - DNA, 21 bp, Homo sapiens
atttgcctgcagagtttggat

SEQ ID NO: 5279883 - DNA, 13 bp, Homo sapiens
atttgcctgcctg

SEQ ID NO: 5279884 - DNA, 17 bp, Homo sapiens
atttgcctgcctgggcc

SEQ ID NO: 5279885 - DNA, 15 bp, Homo sapiens
atttgcctgcttctt

SEQ ID NO: 5279886 - DNA, 16 bp, Homo sapiens
atttgcctgcttcttt

SEQ ID NO: 5279887 - DNA, 20 bp, Homo sapiens
atttgcctgcttctttccag

SEQ ID NO: 5279888 - DNA, 16 bp, Homo sapiens
atttgcctgtaacaag

SEQ ID NO: 5279889 - DNA, 22 bp, Homo sapiens
atttgcctgtaacaagccagat

SEQ ID NO: 5279890 - DNA, 17 bp, Homo sapiens
atttgccttaggaagtg

SEQ ID NO: 5279891 - DNA, 19 bp, Homo sapiens
atttgccttctactcccct

SEQ ID NO: 5279892 - DNA, 17 bp, Homo sapiens
atttgccttctccctgg

SEQ ID NO: 5279893 - DNA, 13 bp, Homo sapiens
atttgccttgcag

SEQ ID NO: 5279894 - DNA, 15 bp, Homo sapiens
atttgccttgcagaa

SEQ ID NO: 5279895 - DNA, 13 bp, Homo sapiens
atttgccttttaa

SEQ ID NO: 5279896 - DNA, 23 bp, Homo sapiens
atttgcggcgtcagtctttttct

SEQ ID NO: 5279897 - DNA, 21 bp, Homo sapiens
atttgcgtaaatggttttcaa

SEQ ID NO: 5279898 - DNA, 18 bp, Homo sapiens
atttgctaaatatttctt

SEQ ID NO: 5279899 - DNA, 21 bp, Homo sapiens
atttgctaagaatgtctattt

SEQ ID NO: 5279900 - DNA, 14 bp, Homo sapiens
atttgctaagcata

SEQ ID NO: 5279901 - DNA, 15 bp, Homo sapiens
atttgctaaggcagc

SEQ ID NO: 5279902 - DNA, 14 bp, Homo sapiens
atttgctaatgtat

SEQ ID NO: 5279903 - DNA, 21 bp, Homo sapiens
atttgctaatgtataatgtgc

SEQ ID NO: 5279904 - DNA, 14 bp, Homo sapiens
atttgctaattttt

SEQ ID NO: 5279905 - DNA, 16 bp, Homo sapiens
atttgctactgttgta

SEQ ID NO: 5279906 - DNA, 17 bp, Homo sapiens
atttgctactgttgtaa

SEQ ID NO: 5279907 - DNA, 17 bp, Homo sapiens
atttgctagttctgctg

SEQ ID NO: 5279908 - DNA, 20 bp, Homo sapiens
atttgctatataattaatat

SEQ ID NO: 5279909 - DNA, 19 bp, Homo sapiens
atttgctcataagtaaatg

SEQ ID NO: 5279910 - DNA, 21 bp, Homo sapiens
atttgctcataagtaaatgtc

SEQ ID NO: 5279911 - DNA, 15 bp, Homo sapiens
atttgctcatatgaa

SEQ ID NO: 5279912 - DNA, 14 bp, Homo sapiens
atttgctcatggaa

SEQ ID NO: 5279913 - DNA, 17 bp, Homo sapiens
atttgctcatggaattg

SEQ ID NO: 5279914 - DNA, 13 bp, Homo sapiens
atttgctcctttc

SEQ ID NO: 5279915 - DNA, 21 bp, Homo sapiens
atttgctgaactcagcacatt

SEQ ID NO: 5279916 - DNA, 14 bp, Homo sapiens
atttgctgaatatg

SEQ ID NO: 5279917 - DNA, 22 bp, Homo sapiens
atttgctgacaaccattaaagt

SEQ ID NO: 5279918 - DNA, 23 bp, Homo sapiens
atttgctgacaaccattaaagtc

SEQ ID NO: 5279919 - DNA, 18 bp, Homo sapiens
atttgctgattgtctgaa

SEQ ID NO: 5279920 - DNA, 20 bp, Homo sapiens
atttgctgattgtctgaaat

SEQ ID NO: 5279921 - DNA, 13 bp, Homo sapiens
atttgctgatttc

SEQ ID NO: 5279922 - DNA, 15 bp, Homo sapiens
atttgctgcatgggt

SEQ ID NO: 5279923 - DNA, 14 bp, Homo sapiens
atttgctgccaaat

SEQ ID NO: 5279924 - DNA, 15 bp, Homo sapiens
atttgctgccaaatg

SEQ ID NO: 5279925 - DNA, 14 bp, Homo sapiens
atttgctgccccag

SEQ ID NO: 5279926 - DNA, 12 bp, Homo sapiens
atttgctgccct

SEQ ID NO: 5279927 - DNA, 22 bp, Homo sapiens
atttgctggaacacaaagacca

SEQ ID NO: 5279928 - DNA, 18 bp, Homo sapiens
atttgctgggcagttttt

SEQ ID NO: 5279929 - DNA, 22 bp, Homo sapiens
atttgctgtgtaagctcacatc

SEQ ID NO: 5279930 - DNA, 17 bp, Homo sapiens
atttgctgtttgtccag

SEQ ID NO: 5279931 - DNA, 13 bp, Homo sapiens
atttgcttattta

SEQ ID NO: 5279932 - DNA, 18 bp, Homo sapiens
atttgcttatttaataaa

SEQ ID NO: 5279933 - DNA, 14 bp, Homo sapiens
atttgcttatttat

SEQ ID NO: 5279934 - DNA, 22 bp, Homo sapiens
atttgcttatttttataattaa

SEQ ID NO: 5279935 - DNA, 23 bp, Homo sapiens
atttgctttaatgagaatagaaa

SEQ ID NO: 5279936 - DNA, 16 bp, Homo sapiens
atttgctttagagaca

SEQ ID NO: 5279937 - DNA, 13 bp, Homo sapiens
atttgctttcctc

SEQ ID NO: 5279938 - DNA, 13 bp, Homo sapiens
atttgctttggaa

SEQ ID NO: 5279939 - DNA, 14 bp, Homo sapiens
atttgctttggaag

SEQ ID NO: 5279940 - DNA, 23 bp, Homo sapiens
atttgcttttcatgtagaactca

SEQ ID NO: 5279941 - DNA, 18 bp, Homo sapiens
atttgctttttcaccaga

SEQ ID NO: 5279942 - DNA, 17 bp, Homo sapiens
atttgctttttgtgata

SEQ ID NO: 5279943 - DNA, 15 bp, Homo sapiens
atttggaaaaagaaa

SEQ ID NO: 5279944 - DNA, 13 bp, Homo sapiens
atttggaaaataa

SEQ ID NO: 5279945 - DNA, 17 bp, Homo sapiens
atttggaaactaataaa

SEQ ID NO: 5279946 - DNA, 21 bp, Homo sapiens
atttggaaactaataaaatat

SEQ ID NO: 5279947 - DNA, 22 bp, Homo sapiens
atttggaaataaagtcagatgg

SEQ ID NO: 5279948 - DNA, 21 bp, Homo sapiens
atttggaaatcctagtttcct

SEQ ID NO: 5279949 - DNA, 12 bp, Homo sapiens
atttggaaatct

SEQ ID NO: 5279950 - DNA, 17 bp, Homo sapiens
atttggaacaacaaatc

SEQ ID NO: 5279951 - DNA, 21 bp, Homo sapiens
atttggaaccaaagtctaaac

SEQ ID NO: 5279952 - DNA, 17 bp, Homo sapiens
atttggaaccttgtttt

SEQ ID NO: 5279953 - DNA, 14 bp, Homo sapiens
atttggaacttaca

SEQ ID NO: 5279954 - DNA, 16 bp, Homo sapiens
atttggaagagaggca

SEQ ID NO: 5279955 - DNA, 17 bp, Homo sapiens
atttggaagcaacgtgt

SEQ ID NO: 5279956 - DNA, 22 bp, Homo sapiens
atttggaagcaacgtgttaatt

SEQ ID NO: 5279957 - DNA, 13 bp, Homo sapiens
atttggaatactt

SEQ ID NO: 5279958 - DNA, 14 bp, Homo sapiens
atttggaatatttg

SEQ ID NO: 5279959 - DNA, 20 bp, Homo sapiens
atttggaatatttgaataat

SEQ ID NO: 5279960 - DNA, 15 bp, Homo sapiens
atttggaatcatatg

SEQ ID NO: 5279961 - DNA, 18 bp, Homo sapiens
atttggaatttatataca

SEQ ID NO: 5279962 - DNA, 14 bp, Homo sapiens
atttggacaaaatg

SEQ ID NO: 5279963 - DNA, 16 bp, Homo sapiens
atttggacaaaatgga

SEQ ID NO: 5279964 - DNA, 22 bp, Homo sapiens
atttggaccctggttgctttgt

SEQ ID NO: 5279965 - DNA, 21 bp, Homo sapiens
atttggagagccacatacttt

SEQ ID NO: 5279966 - DNA, 23 bp, Homo sapiens
atttggagggaagctcttggagc

SEQ ID NO: 5279967 - DNA, 21 bp, Homo sapiens
atttggagtgagccagaaaaa

SEQ ID NO: 5279968 - DNA, 15 bp, Homo sapiens
atttggagtggaggc

SEQ ID NO: 5279969 - DNA, 14 bp, Homo sapiens
atttggagtgtgta

SEQ ID NO: 5279970 - DNA, 19 bp, Homo sapiens
atttggataataaaaattg

SEQ ID NO: 5279971 - DNA, 15 bp, Homo sapiens
atttggatcctgtgt

SEQ ID NO: 5279972 - DNA, 14 bp, Homo sapiens
atttggatctattt

SEQ ID NO: 5279973 - DNA, 19 bp, Homo sapiens
atttggatctggatctgtt

SEQ ID NO: 5279974 - DNA, 18 bp, Homo sapiens
atttggattagaaattta

SEQ ID NO: 5279975 - DNA, 14 bp, Homo sapiens
atttggcaaaacaa

SEQ ID NO: 5279976 - DNA, 21 bp, Homo sapiens
atttggcagaactgctggggc

SEQ ID NO: 5279977 - DNA, 22 bp, Homo sapiens
atttggcagaactgctggggct

SEQ ID NO: 5279978 - DNA, 19 bp, Homo sapiens
atttggcagcccctgtttt

SEQ ID NO: 5279979 - DNA, 14 bp, Homo sapiens
atttggcatccctg

SEQ ID NO: 5279980 - DNA, 19 bp, Homo sapiens
atttggccacactggggct

SEQ ID NO: 5279981 - DNA, 18 bp, Homo sapiens
atttggccccaggggacg

SEQ ID NO: 5279982 - DNA, 15 bp, Homo sapiens
atttggccggctctg

SEQ ID NO: 5279983 - DNA, 15 bp, Homo sapiens
atttggcctcttgta

SEQ ID NO: 5279984 - DNA, 18 bp, Homo sapiens
atttggccttaagaactg

SEQ ID NO: 5279985 - DNA, 18 bp, Homo sapiens
atttggctccactgtaaa

SEQ ID NO: 5279986 - DNA, 14 bp, Homo sapiens
atttggctgcttct

SEQ ID NO: 5279987 - DNA, 20 bp, Homo sapiens
atttggctgggctacaattt

SEQ ID NO: 5279988 - DNA, 14 bp, Homo sapiens
atttggcttaaata

SEQ ID NO: 5279989 - DNA, 15 bp, Homo sapiens
atttggcttaaatat

SEQ ID NO: 5279990 - DNA, 16 bp, Homo sapiens
atttggcttaaatata

SEQ ID NO: 5279991 - DNA, 17 bp, Homo sapiens
atttggcttaaatatag

SEQ ID NO: 5279992 - DNA, 19 bp, Homo sapiens
atttggcttcatactcttt

SEQ ID NO: 5279993 - DNA, 11 bp, Homo sapiens
atttggcttcc

SEQ ID NO: 5279994 - DNA, 17 bp, Homo sapiens
atttggcttcctctgct

SEQ ID NO: 5279995 - DNA, 20 bp, Homo sapiens
atttggcttcctctgctgca

SEQ ID NO: 5279996 - DNA, 15 bp, Homo sapiens
atttggcttgctgtt

SEQ ID NO: 5279997 - DNA, 15 bp, Homo sapiens
atttggctttcacat

SEQ ID NO: 5279998 - DNA, 15 bp, Homo sapiens
atttggcttttctta

SEQ ID NO: 5279999 - DNA, 18 bp, Homo sapiens
atttgggaaaagaagctg

SEQ ID NO: 5280000 - DNA, 22 bp, Homo sapiens
atttgggaaaagaagctgtcag

SEQ ID NO: 5280001 - DNA, 23 bp, Homo sapiens
atttgggaaaagaagctgtcaga

SEQ ID NO: 5280002 - DNA, 23 bp, Homo sapiens
atttgggaaggtttgtgttttct

SEQ ID NO: 5280003 - DNA, 22 bp, Homo sapiens
atttgggagaagggcagagtta

SEQ ID NO: 5280004 - DNA, 19 bp, Homo sapiens
atttgggagacatgtgaca

SEQ ID NO: 5280005 - DNA, 13 bp, Homo sapiens
atttgggagctga

SEQ ID NO: 5280006 - DNA, 21 bp, Homo sapiens
atttgggagggaaaagggaag

SEQ ID NO: 5280007 - DNA, 14 bp, Homo sapiens
atttgggatggaga

SEQ ID NO: 5280008 - DNA, 12 bp, Homo sapiens
atttgggcagat

SEQ ID NO: 5280009 - DNA, 13 bp, Homo sapiens
atttgggctcagg

SEQ ID NO: 5280010 - DNA, 13 bp, Homo sapiens
atttgggctctgg

SEQ ID NO: 5280011 - DNA, 19 bp, Homo sapiens
atttgggctgaatgtatgt

SEQ ID NO: 5280012 - DNA, 21 bp, Homo sapiens
atttgggcttggaccagatct

SEQ ID NO: 5280013 - DNA, 23 bp, Homo sapiens
atttggggaaacctagagaagat

SEQ ID NO: 5280014 - DNA, 15 bp, Homo sapiens
atttggggaccacag

SEQ ID NO: 5280015 - DNA, 19 bp, Homo sapiens
atttggggaccacagaggc

SEQ ID NO: 5280016 - DNA, 23 bp, Homo sapiens
atttggggaccacagaggctgtg

SEQ ID NO: 5280017 - DNA, 21 bp, Homo sapiens
atttggggcctttcccattgg

SEQ ID NO: 5280018 - DNA, 19 bp, Homo sapiens
atttggggctaagaaatag

SEQ ID NO: 5280019 - DNA, 15 bp, Homo sapiens
atttggggcttccaa

SEQ ID NO: 5280020 - DNA, 23 bp, Homo sapiens
atttgggggaggctttgggagca

SEQ ID NO: 5280021 - DNA, 17 bp, Homo sapiens
atttgggtccaggagga

SEQ ID NO: 5280022 - DNA, 14 bp, Homo sapiens
atttgggttgcaaa

SEQ ID NO: 5280023 - DNA, 21 bp, Homo sapiens
atttggtaaaaatgctgctct

SEQ ID NO: 5280024 - DNA, 21 bp, Homo sapiens
atttggtaaattagtatttat

SEQ ID NO: 5280025 - DNA, 18 bp, Homo sapiens
atttggtaatgtttttaa

SEQ ID NO: 5280026 - DNA, 17 bp, Homo sapiens
atttggtaggaagcctg

SEQ ID NO: 5280027 - DNA, 17 bp, Homo sapiens
atttggtataattatgg

SEQ ID NO: 5280028 - DNA, 22 bp, Homo sapiens
atttggtatatactttgccact

SEQ ID NO: 5280029 - DNA, 15 bp, Homo sapiens
atttggtattaaact

SEQ ID NO: 5280030 - DNA, 14 bp, Homo sapiens
atttggtattacac

SEQ ID NO: 5280031 - DNA, 22 bp, Homo sapiens
atttggtcctgcctaaatttca

SEQ ID NO: 5280032 - DNA, 14 bp, Homo sapiens
atttggtctctatt

SEQ ID NO: 5280033 - DNA, 22 bp, Homo sapiens
atttggtctctcccagctctgg

SEQ ID NO: 5280034 - DNA, 22 bp, Homo sapiens
atttggtcttaattctgaccaa

SEQ ID NO: 5280035 - DNA, 17 bp, Homo sapiens
atttggtcttagcttta

SEQ ID NO: 5280036 - DNA, 19 bp, Homo sapiens
atttggtcttagctttaca

SEQ ID NO: 5280037 - DNA, 15 bp, Homo sapiens
atttggtgaatttga

SEQ ID NO: 5280038 - DNA, 19 bp, Homo sapiens
atttggtgaatttgaatct

SEQ ID NO: 5280039 - DNA, 21 bp, Homo sapiens
atttggtgcacttttctgtgt

SEQ ID NO: 5280040 - DNA, 19 bp, Homo sapiens
atttggtgctagtaaattt

SEQ ID NO: 5280041 - DNA, 17 bp, Homo sapiens
atttggtgctctgctaa

SEQ ID NO: 5280042 - DNA, 20 bp, Homo sapiens
atttggtggcctaatttaca

SEQ ID NO: 5280043 - DNA, 17 bp, Homo sapiens
atttggtggtttcagaa

SEQ ID NO: 5280044 - DNA, 20 bp, Homo sapiens
atttggtgtggctgtattca

SEQ ID NO: 5280045 - DNA, 22 bp, Homo sapiens
atttggtgtggctgtattcaga

SEQ ID NO: 5280046 - DNA, 14 bp, Homo sapiens
atttggtgtgttcg

SEQ ID NO: 5280047 - DNA, 19 bp, Homo sapiens
atttggtgttcctggaagc

SEQ ID NO: 5280048 - DNA, 22 bp, Homo sapiens
atttggtgtttgcttgaatgct

SEQ ID NO: 5280049 - DNA, 18 bp, Homo sapiens
atttggttatgttgataa

SEQ ID NO: 5280050 - DNA, 16 bp, Homo sapiens
atttggttcattaatt

SEQ ID NO: 5280051 - DNA, 14 bp, Homo sapiens
atttggttgcactt

SEQ ID NO: 5280052 - DNA, 20 bp, Homo sapiens
atttggtttggccatctctg

SEQ ID NO: 5280053 - DNA, 22 bp, Homo sapiens
atttggtttggccatctctgga

SEQ ID NO: 5280054 - DNA, 18 bp, Homo sapiens
atttggtttgttaattct

SEQ ID NO: 5280055 - DNA, 21 bp, Homo sapiens
atttggttttacacaggaaga

SEQ ID NO: 5280056 - DNA, 22 bp, Homo sapiens
atttggttttcacattggaaac

SEQ ID NO: 5280057 - DNA, 14 bp, Homo sapiens
atttggttttcctg

SEQ ID NO: 5280058 - DNA, 15 bp, Homo sapiens
atttggtttttactc

SEQ ID NO: 5280059 - DNA, 21 bp, Homo sapiens
atttggtttttgtcttgcatt

SEQ ID NO: 5280060 - DNA, 23 bp, Homo sapiens
atttgtaaaaacagcattgcttt

SEQ ID NO: 5280061 - DNA, 17 bp, Homo sapiens
atttgtaaaaagtagat

SEQ ID NO: 5280062 - DNA, 18 bp, Homo sapiens
atttgtaaaaagtagatt

SEQ ID NO: 5280063 - DNA, 23 bp, Homo sapiens
atttgtaaaaagtagattaaaat

SEQ ID NO: 5280064 - DNA, 13 bp, Homo sapiens
atttgtaaaaatg

SEQ ID NO: 5280065 - DNA, 19 bp, Homo sapiens
atttgtaaaacttctgctc

SEQ ID NO: 5280066 - DNA, 23 bp, Homo sapiens
atttgtaaaagaacagtaaacat

SEQ ID NO: 5280067 - DNA, 15 bp, Homo sapiens
atttgtaaaagctaa

SEQ ID NO: 5280068 - DNA, 16 bp, Homo sapiens
atttgtaaaatgacaa

SEQ ID NO: 5280069 - DNA, 19 bp, Homo sapiens
atttgtaaaatgacaatca

SEQ ID NO: 5280070 - DNA, 22 bp, Homo sapiens
atttgtaaaatgacaatcatgt

SEQ ID NO: 5280071 - DNA, 12 bp, Homo sapiens
atttgtaaacca

SEQ ID NO: 5280072 - DNA, 21 bp, Homo sapiens
atttgtaaacttctgaagact

SEQ ID NO: 5280073 - DNA, 21 bp, Homo sapiens
atttgtaaactttgcttctcc

SEQ ID NO: 5280074 - DNA, 19 bp, Homo sapiens
atttgtaaagctatttatg

SEQ ID NO: 5280075 - DNA, 13 bp, Homo sapiens
atttgtaaagttg

SEQ ID NO: 5280076 - DNA, 12 bp, Homo sapiens
atttgtaaatct

SEQ ID NO: 5280077 - DNA, 12 bp, Homo sapiens
atttgtaaatga

SEQ ID NO: 5280078 - DNA, 18 bp, Homo sapiens
atttgtaaatgattttaa

SEQ ID NO: 5280079 - DNA, 20 bp, Homo sapiens
atttgtaaattgaataagtg

SEQ ID NO: 5280080 - DNA, 14 bp, Homo sapiens
atttgtaaatttag

SEQ ID NO: 5280081 - DNA, 17 bp, Homo sapiens
atttgtaaatttagtgt

SEQ ID NO: 5280082 - DNA, 18 bp, Homo sapiens
atttgtaaatttatgtga

SEQ ID NO: 5280083 - DNA, 20 bp, Homo sapiens
atttgtaacattgtaaagta

SEQ ID NO: 5280084 - DNA, 19 bp, Homo sapiens
atttgtaacctcagctctg

SEQ ID NO: 5280085 - DNA, 14 bp, Homo sapiens
atttgtaactttgc

SEQ ID NO: 5280086 - DNA, 17 bp, Homo sapiens
atttgtaactttgcatg

SEQ ID NO: 5280087 - DNA, 13 bp, Homo sapiens
atttgtaagatat

SEQ ID NO: 5280088 - DNA, 18 bp, Homo sapiens
atttgtaagatatttgca

SEQ ID NO: 5280089 - DNA, 18 bp, Homo sapiens
atttgtaagcaacttgct

SEQ ID NO: 5280090 - DNA, 21 bp, Homo sapiens
atttgtaagcaacttgcttct

SEQ ID NO: 5280091 - DNA, 14 bp, Homo sapiens
atttgtaagtaaca

SEQ ID NO: 5280092 - DNA, 14 bp, Homo sapiens
atttgtaagtttat

SEQ ID NO: 5280093 - DNA, 17 bp, Homo sapiens
atttgtaagtttcaggt

SEQ ID NO: 5280094 - DNA, 15 bp, Homo sapiens
atttgtaataaaact

SEQ ID NO: 5280095 - DNA, 17 bp, Homo sapiens
atttgtaataaaactat

SEQ ID NO: 5280096 - DNA, 22 bp, Homo sapiens
atttgtaataaaactatttgta

SEQ ID NO: 5280097 - DNA, 18 bp, Homo sapiens
atttgtaatatatcctgt

SEQ ID NO: 5280098 - DNA, 16 bp, Homo sapiens
atttgtaatgtatctt

SEQ ID NO: 5280099 - DNA, 23 bp, Homo sapiens
atttgtaatgtatcttatttata

SEQ ID NO: 5280100 - DNA, 13 bp, Homo sapiens
atttgtaattaaa

SEQ ID NO: 5280101 - DNA, 14 bp, Homo sapiens
atttgtaattacag

SEQ ID NO: 5280102 - DNA, 23 bp, Homo sapiens
atttgtaattacaggagggaaca

SEQ ID NO: 5280103 - DNA, 15 bp, Homo sapiens
atttgtaattgctta

SEQ ID NO: 5280104 - DNA, 17 bp, Homo sapiens
atttgtaattttaaaag

SEQ ID NO: 5280105 - DNA, 20 bp, Homo sapiens
atttgtaatttttttctagt

SEQ ID NO: 5280106 - DNA, 14 bp, Homo sapiens
atttgtacaaataa

SEQ ID NO: 5280107 - DNA, 17 bp, Homo sapiens
atttgtacaaataaacc

SEQ ID NO: 5280108 - DNA, 18 bp, Homo sapiens
atttgtacaatggtttat

SEQ ID NO: 5280109 - DNA, 14 bp, Homo sapiens
atttgtacatatta

SEQ ID NO: 5280110 - DNA, 19 bp, Homo sapiens
atttgtacatattatcatc

SEQ ID NO: 5280111 - DNA, 11 bp, Homo sapiens
atttgtacatt

SEQ ID NO: 5280112 - DNA, 15 bp, Homo sapiens
atttgtacattcctg

SEQ ID NO: 5280113 - DNA, 22 bp, Homo sapiens
atttgtacattcctgatactgg

SEQ ID NO: 5280114 - DNA, 13 bp, Homo sapiens
atttgtaccattc

SEQ ID NO: 5280115 - DNA, 21 bp, Homo sapiens
atttgtacctctaagtacata

SEQ ID NO: 5280116 - DNA, 19 bp, Homo sapiens
atttgtaccttattgatct

SEQ ID NO: 5280117 - DNA, 20 bp, Homo sapiens
atttgtactattagcaagaa

SEQ ID NO: 5280118 - DNA, 18 bp, Homo sapiens
atttgtactatttaactg

SEQ ID NO: 5280119 - DNA, 22 bp, Homo sapiens
atttgtactgtttaatgttctg

SEQ ID NO: 5280120 - DNA, 13 bp, Homo sapiens
atttgtacttctt

SEQ ID NO: 5280121 - DNA, 14 bp, Homo sapiens
atttgtacttctta

SEQ ID NO: 5280122 - DNA, 15 bp, Homo sapiens
atttgtacttcttat

SEQ ID NO: 5280123 - DNA, 16 bp, Homo sapiens
atttgtacttcttatt

SEQ ID NO: 5280124 - DNA, 20 bp, Homo sapiens
atttgtactttctgttaaaa

SEQ ID NO: 5280125 - DNA, 24 bp, Homo sapiens
atttgtactttctgttaaaatgca

SEQ ID NO: 5280126 - DNA, 14 bp, Homo sapiens
atttgtagatatat

SEQ ID NO: 5280127 - DNA, 16 bp, Homo sapiens
atttgtagatttatcc

SEQ ID NO: 5280128 - DNA, 18 bp, Homo sapiens
atttgtagcactgagggt

SEQ ID NO: 5280129 - DNA, 22 bp, Homo sapiens
atttgtagcataactgtagctc

SEQ ID NO: 5280130 - DNA, 22 bp, Homo sapiens
atttgtaggaaggtctcattct

SEQ ID NO: 5280131 - DNA, 19 bp, Homo sapiens
atttgtaggggaactcatt

SEQ ID NO: 5280132 - DNA, 21 bp, Homo sapiens
atttgtaggtatactatgtaa

SEQ ID NO: 5280133 - DNA, 13 bp, Homo sapiens
atttgtagttgtt

SEQ ID NO: 5280134 - DNA, 18 bp, Homo sapiens
atttgtataaaataattt

SEQ ID NO: 5280135 - DNA, 19 bp, Homo sapiens
atttgtataaaataatttt

SEQ ID NO: 5280136 - DNA, 21 bp, Homo sapiens
atttgtataaaataattttta

SEQ ID NO: 5280137 - DNA, 22 bp, Homo sapiens
atttgtataaagcattactctt

SEQ ID NO: 5280138 - DNA, 22 bp, Homo sapiens
atttgtataaattaaataaact

SEQ ID NO: 5280139 - DNA, 16 bp, Homo sapiens
atttgtatatatacat

SEQ ID NO: 5280140 - DNA, 16 bp, Homo sapiens
atttgtatatggtatt

SEQ ID NO: 5280141 - DNA, 12 bp, Homo sapiens
atttgtatatta

SEQ ID NO: 5280142 - DNA, 19 bp, Homo sapiens
atttgtatattaaaatagc

SEQ ID NO: 5280143 - DNA, 14 bp, Homo sapiens
atttgtatcatgtt

SEQ ID NO: 5280144 - DNA, 20 bp, Homo sapiens
atttgtatctctgaagcatg

SEQ ID NO: 5280145 - DNA, 17 bp, Homo sapiens
atttgtatctgaaggag

SEQ ID NO: 5280146 - DNA, 21 bp, Homo sapiens
atttgtatctgaaggagattt

SEQ ID NO: 5280147 - DNA, 23 bp, Homo sapiens
atttgtatgaataatgaaaataa

SEQ ID NO: 5280148 - DNA, 14 bp, Homo sapiens
atttgtatgctaaa

SEQ ID NO: 5280149 - DNA, 18 bp, Homo sapiens
atttgtatgtcaaagctt

SEQ ID NO: 5280150 - DNA, 18 bp, Homo sapiens
atttgtatgtttttctgt

SEQ ID NO: 5280151 - DNA, 21 bp, Homo sapiens
atttgtattaaaattgtaagc

SEQ ID NO: 5280152 - DNA, 12 bp, Homo sapiens
atttgtattaat

SEQ ID NO: 5280153 - DNA, 14 bp, Homo sapiens
atttgtattaataa

SEQ ID NO: 5280154 - DNA, 16 bp, Homo sapiens
atttgtattaataaag

SEQ ID NO: 5280155 - DNA, 17 bp, Homo sapiens
atttgtattaataaagc

SEQ ID NO: 5280156 - DNA, 16 bp, Homo sapiens
atttgtattaatgtag

SEQ ID NO: 5280157 - DNA, 19 bp, Homo sapiens
atttgtattactttctctg

SEQ ID NO: 5280158 - DNA, 21 bp, Homo sapiens
atttgtattactttctctgta

SEQ ID NO: 5280159 - DNA, 17 bp, Homo sapiens
atttgtattcaaatttg

SEQ ID NO: 5280160 - DNA, 23 bp, Homo sapiens
atttgtattctctgcaattttac

SEQ ID NO: 5280161 - DNA, 11 bp, Homo sapiens
atttgtatttt

SEQ ID NO: 5280162 - DNA, 18 bp, Homo sapiens
atttgtattttgtgatga

SEQ ID NO: 5280163 - DNA, 18 bp, Homo sapiens
atttgtattttgtgtgac

SEQ ID NO: 5280164 - DNA, 20 bp, Homo sapiens
atttgtcaaggctgactact

SEQ ID NO: 5280165 - DNA, 14 bp, Homo sapiens
atttgtcaatgaca

SEQ ID NO: 5280166 - DNA, 18 bp, Homo sapiens
atttgtcagagaagaaaa

SEQ ID NO: 5280167 - DNA, 19 bp, Homo sapiens
atttgtcagtatttttgcc

SEQ ID NO: 5280168 - DNA, 17 bp, Homo sapiens
atttgtcagtttggttg

SEQ ID NO: 5280169 - DNA, 21 bp, Homo sapiens
atttgtcatgacagtgcttgc

SEQ ID NO: 5280170 - DNA, 19 bp, Homo sapiens
atttgtcatttaccctggt

SEQ ID NO: 5280171 - DNA, 14 bp, Homo sapiens
atttgtcattttca

SEQ ID NO: 5280172 - DNA, 21 bp, Homo sapiens
atttgtcattttcattagcaa

SEQ ID NO: 5280173 - DNA, 15 bp, Homo sapiens
atttgtccaaacagg

SEQ ID NO: 5280174 - DNA, 20 bp, Homo sapiens
attattgtgacttcactgta

SEQ ID NO: 5280175 - DNA, 13 bp, Homo sapiens
attattgttaata

SEQ ID NO: 5280176 - DNA, 22 bp, Homo sapiens
attattgttcccctaagtggat

SEQ ID NO: 5280177 - DNA, 19 bp, Homo sapiens
attattgtttatattttca

SEQ ID NO: 5280178 - DNA, 23 bp, Homo sapiens
attatttaaaaccattatttaat

SEQ ID NO: 5280179 - DNA, 15 bp, Homo sapiens
attatttaaagaaag

SEQ ID NO: 5280180 - DNA, 14 bp, Homo sapiens
attatttaaatgct

SEQ ID NO: 5280181 - DNA, 15 bp, Homo sapiens
attatttaaatgctt

SEQ ID NO: 5280182 - DNA, 18 bp, Homo sapiens
attatttaaatgctttta

SEQ ID NO: 5280183 - DNA, 14 bp, Homo sapiens
attatttaaatgta

SEQ ID NO: 5280184 - DNA, 15 bp, Homo sapiens
attatttaaatgtac

SEQ ID NO: 5280185 - DNA, 14 bp, Homo sapiens
attatttaactaat

SEQ ID NO: 5280186 - DNA, 19 bp, Homo sapiens
attatttaagactaaaagt

SEQ ID NO: 5280187 - DNA, 21 bp, Homo sapiens
attatttaataaaaaaacaat

SEQ ID NO: 5280188 - DNA, 13 bp, Homo sapiens
attatttaataac

SEQ ID NO: 5280189 - DNA, 15 bp, Homo sapiens
attatttaataagag

SEQ ID NO: 5280190 - DNA, 16 bp, Homo sapiens
attatttaataagagt

SEQ ID NO: 5280191 - DNA, 13 bp, Homo sapiens
attatttaatgtt

SEQ ID NO: 5280192 - DNA, 15 bp, Homo sapiens
attatttaattgtcc

SEQ ID NO: 5280193 - DNA, 15 bp, Homo sapiens
attatttaatttgta

SEQ ID NO: 5280194 - DNA, 14 bp, Homo sapiens
attatttacaagaa

SEQ ID NO: 5280195 - DNA, 16 bp, Homo sapiens
attatttacatcactt

SEQ ID NO: 5280196 - DNA, 19 bp, Homo sapiens
attatttagtaaaattatc

SEQ ID NO: 5280197 - DNA, 12 bp, Homo sapiens
attatttataat

SEQ ID NO: 5280198 - DNA, 16 bp, Homo sapiens
attatttatatatgta

SEQ ID NO: 5280199 - DNA, 13 bp, Homo sapiens
attatttatgtat

SEQ ID NO: 5280200 - DNA, 22 bp, Homo sapiens
attatttattaaaaatgttctc

SEQ ID NO: 5280201 - DNA, 14 bp, Homo sapiens
attatttattactt

SEQ ID NO: 5280202 - DNA, 23 bp, Homo sapiens
attatttattcagcttcatttgt

SEQ ID NO: 5280203 - DNA, 15 bp, Homo sapiens
attatttattgttaa

SEQ ID NO: 5280204 - DNA, 15 bp, Homo sapiens
attatttatttctgt

SEQ ID NO: 5280205 - DNA, 19 bp, Homo sapiens
attatttatttgattaggt

SEQ ID NO: 5280206 - DNA, 17 bp, Homo sapiens
attatttcaaaatgata

SEQ ID NO: 5280207 - DNA, 15 bp, Homo sapiens
attatttcaccagca

SEQ ID NO: 5280208 - DNA, 18 bp, Homo sapiens
attatttcagattcctca

SEQ ID NO: 5280209 - DNA, 14 bp, Homo sapiens
attatttcatacaa

SEQ ID NO: 5280210 - DNA, 18 bp, Homo sapiens
attatttcatacaaaact

SEQ ID NO: 5280211 - DNA, 20 bp, Homo sapiens
attatttcatatactataat

SEQ ID NO: 5280212 - DNA, 22 bp, Homo sapiens
attatttcattggtcttctttt

SEQ ID NO: 5280213 - DNA, 16 bp, Homo sapiens
attatttctaacacta

SEQ ID NO: 5280214 - DNA, 20 bp, Homo sapiens
attatttctaggaagaattt

SEQ ID NO: 5280215 - DNA, 21 bp, Homo sapiens
attatttctccatcccctccc

SEQ ID NO: 5280216 - DNA, 17 bp, Homo sapiens
attatttctgcttcctg

SEQ ID NO: 5280217 - DNA, 21 bp, Homo sapiens
attatttctggctttttgaat

SEQ ID NO: 5280218 - DNA, 14 bp, Homo sapiens
attatttctgtata

SEQ ID NO: 5280219 - DNA, 12 bp, Homo sapiens
attatttctgtt

SEQ ID NO: 5280220 - DNA, 14 bp, Homo sapiens
attatttcttctct

SEQ ID NO: 5280221 - DNA, 22 bp, Homo sapiens
attatttgagtttgacatttaa

SEQ ID NO: 5280222 - DNA, 18 bp, Homo sapiens
attatttgataacatttt

SEQ ID NO: 5280223 - DNA, 14 bp, Homo sapiens
attatttgatatct

SEQ ID NO: 5280224 - DNA, 16 bp, Homo sapiens
attatttgatgatact

SEQ ID NO: 5280225 - DNA, 18 bp, Homo sapiens
attatttgcacagaagag

SEQ ID NO: 5280226 - DNA, 13 bp, Homo sapiens
attatttgcagct

SEQ ID NO: 5280227 - DNA, 13 bp, Homo sapiens
attatttgcagtc

SEQ ID NO: 5280228 - DNA, 12 bp, Homo sapiens
attatttgcatg

SEQ ID NO: 5280229 - DNA, 20 bp, Homo sapiens
attatttgcatgttatgttt

SEQ ID NO: 5280230 - DNA, 21 bp, Homo sapiens
attatttgccttctgaaatgt

SEQ ID NO: 5280231 - DNA, 12 bp, Homo sapiens
attatttgctaa

SEQ ID NO: 5280232 - DNA, 13 bp, Homo sapiens
attatttgctaag

SEQ ID NO: 5280233 - DNA, 22 bp, Homo sapiens
attatttgcttttcatgtagaa

SEQ ID NO: 5280234 - DNA, 12 bp, Homo sapiens
attatttggaaa

SEQ ID NO: 5280235 - DNA, 14 bp, Homo sapiens
attatttggaaatt

SEQ ID NO: 5280236 - DNA, 20 bp, Homo sapiens
attatttgggagggaaaagg

SEQ ID NO: 5280237 - DNA, 21 bp, Homo sapiens
attatttgggagggaaaaggg

SEQ ID NO: 5280238 - DNA, 17 bp, Homo sapiens
attatttgtactttgtt

SEQ ID NO: 5280239 - DNA, 14 bp, Homo sapiens
attatttgtgcatt

SEQ ID NO: 5280240 - DNA, 20 bp, Homo sapiens
attatttgtgcattttattg

SEQ ID NO: 5280241 - DNA, 20 bp, Homo sapiens
attatttgtgtaatagaaaa

SEQ ID NO: 5280242 - DNA, 23 bp, Homo sapiens
attatttgtgtaatagaaaactg

SEQ ID NO: 5280243 - DNA, 17 bp, Homo sapiens
attatttgtttagatgt

SEQ ID NO: 5280244 - DNA, 14 bp, Homo sapiens
attatttgttttcc

SEQ ID NO: 5280245 - DNA, 14 bp, Homo sapiens
attattttaaaata

SEQ ID NO: 5280246 - DNA, 18 bp, Homo sapiens
attattttaaaatattta

SEQ ID NO: 5280247 - DNA, 16 bp, Homo sapiens
attattttaaattata

SEQ ID NO: 5280248 - DNA, 23 bp, Homo sapiens
attattttaaattataaggactg

SEQ ID NO: 5280249 - DNA, 16 bp, Homo sapiens
attattttaatattta

SEQ ID NO: 5280250 - DNA, 15 bp, Homo sapiens
attattttaattagg

SEQ ID NO: 5280251 - DNA, 15 bp, Homo sapiens
attattttacagtct

SEQ ID NO: 5280252 - DNA, 19 bp, Homo sapiens
attattttacagtctctgt

SEQ ID NO: 5280253 - DNA, 15 bp, Homo sapiens
attattttactgctt

SEQ ID NO: 5280254 - DNA, 15 bp, Homo sapiens
attattttagagcat

SEQ ID NO: 5280255 - DNA, 14 bp, Homo sapiens
attattttagctaa

SEQ ID NO: 5280256 - DNA, 18 bp, Homo sapiens
attattttagtgtgtaaa

SEQ ID NO: 5280257 - DNA, 14 bp, Homo sapiens
attattttattatg

SEQ ID NO: 5280258 - DNA, 15 bp, Homo sapiens
attattttattatga

SEQ ID NO: 5280259 - DNA, 11 bp, Homo sapiens
attattttcaa

SEQ ID NO: 5280260 - DNA, 13 bp, Homo sapiens
attattttcaagg

SEQ ID NO: 5280261 - DNA, 13 bp, Homo sapiens
attattttccttc

SEQ ID NO: 5280262 - DNA, 14 bp, Homo sapiens
attattttctatat

SEQ ID NO: 5280263 - DNA, 21 bp, Homo sapiens
attattttcttcatccaactt

SEQ ID NO: 5280264 - DNA, 16 bp, Homo sapiens
attattttgaatgtca

SEQ ID NO: 5280265 - DNA, 13 bp, Homo sapiens
attattttgatta

SEQ ID NO: 5280266 - DNA, 15 bp, Homo sapiens
attattttggaaagt

SEQ ID NO: 5280267 - DNA, 16 bp, Homo sapiens
attattttggggtctc

SEQ ID NO: 5280268 - DNA, 23 bp, Homo sapiens
attattttgtcataaaatgctat

SEQ ID NO: 5280269 - DNA, 12 bp, Homo sapiens
attattttgtga

SEQ ID NO: 5280270 - DNA, 21 bp, Homo sapiens
attattttgtggttctatttt

SEQ ID NO: 5280271 - DNA, 17 bp, Homo sapiens
attattttgttactgtc

SEQ ID NO: 5280272 - DNA, 16 bp, Homo sapiens
attattttgttgtgat

SEQ ID NO: 5280273 - DNA, 15 bp, Homo sapiens
attattttgtttaaa

SEQ ID NO: 5280274 - DNA, 14 bp, Homo sapiens
attatttttaaaag

SEQ ID NO: 5280275 - DNA, 12 bp, Homo sapiens
attatttttaat

SEQ ID NO: 5280276 - DNA, 12 bp, Homo sapiens
attatttttacc

SEQ ID NO: 5280277 - DNA, 14 bp, Homo sapiens
attatttttaccta

SEQ ID NO: 5280278 - DNA, 18 bp, Homo sapiens
attatttttacctaaaga

SEQ ID NO: 5280279 - DNA, 19 bp, Homo sapiens
attatttttacctaaagac

SEQ ID NO: 5280280 - DNA, 14 bp, Homo sapiens
attatttttataat

SEQ ID NO: 5280281 - DNA, 22 bp, Homo sapiens
attatttttatacaccattgtt

SEQ ID NO: 5280282 - DNA, 13 bp, Homo sapiens
attatttttcaag

SEQ ID NO: 5280283 - DNA, 19 bp, Homo sapiens
attatttttccactttgtt

SEQ ID NO: 5280284 - DNA, 22 bp, Homo sapiens
attatttttcttttaaagattt

SEQ ID NO: 5280285 - DNA, 20 bp, Homo sapiens
attatttttgagcaggagca

SEQ ID NO: 5280286 - DNA, 20 bp, Homo sapiens
attatttttgttagcaaaga

SEQ ID NO: 5280287 - DNA, 17 bp, Homo sapiens
attattttttaaagtct

SEQ ID NO: 5280288 - DNA, 13 bp, Homo sapiens
attattttttaat

SEQ ID NO: 5280289 - DNA, 16 bp, Homo sapiens
attattttttaataag

SEQ ID NO: 5280290 - DNA, 19 bp, Homo sapiens
attattttttaataagaac

SEQ ID NO: 5280291 - DNA, 15 bp, Homo sapiens
attattttttatttc

SEQ ID NO: 5280292 - DNA, 22 bp, Homo sapiens
attattttttgcatcatttaaa

SEQ ID NO: 5280293 - DNA, 22 bp, Homo sapiens
attattttttttatatttattg

SEQ ID NO: 5280294 - DNA, 23 bp, Homo sapiens
attatttttttttttgttcttga

SEQ ID NO: 5280295 - DNA, 21 bp, Homo sapiens
attattttttttttttgaaaa

SEQ ID NO: 5280296 - DNA, 13 bp, Homo sapiens
attcaaaaaaaaa

SEQ ID NO: 5280297 - DNA, 21 bp, Homo sapiens
attcaaaaagacagcagacaa

SEQ ID NO: 5280298 - DNA, 16 bp, Homo sapiens
attcaaaaagtgttta

SEQ ID NO: 5280299 - DNA, 23 bp, Homo sapiens
attcaaaagcacaaaccctgggg

SEQ ID NO: 5280300 - DNA, 22 bp, Homo sapiens
attcaaaagctctctttggaat

SEQ ID NO: 5280301 - DNA, 16 bp, Homo sapiens
attcaaaagtaagaat

SEQ ID NO: 5280302 - DNA, 14 bp, Homo sapiens
attcaaaagtattg

SEQ ID NO: 5280303 - DNA, 18 bp, Homo sapiens
attcaaaagtattgaaag

SEQ ID NO: 5280304 - DNA, 22 bp, Homo sapiens
attcaaaagtgattatctcttt

SEQ ID NO: 5280305 - DNA, 13 bp, Homo sapiens
attcaaaagttcc

SEQ ID NO: 5280306 - DNA, 14 bp, Homo sapiens
attcaaaagttcca

SEQ ID NO: 5280307 - DNA, 17 bp, Homo sapiens
attcaaaagttccaaga

SEQ ID NO: 5280308 - DNA, 21 bp, Homo sapiens
attcaaaagttccaagagtct

SEQ ID NO: 5280309 - DNA, 17 bp, Homo sapiens
attcaaaatacttttta

SEQ ID NO: 5280310 - DNA, 19 bp, Homo sapiens
attcaaaatagttctattt

SEQ ID NO: 5280311 - DNA, 22 bp, Homo sapiens
attcaaaatagttctatttcta

SEQ ID NO: 5280312 - DNA, 19 bp, Homo sapiens
attcaaaatataacaggtg

SEQ ID NO: 5280313 - DNA, 16 bp, Homo sapiens
attcaaaatatttaaa

SEQ ID NO: 5280314 - DNA, 12 bp, Homo sapiens
attcaaaatctt

SEQ ID NO: 5280315 - DNA, 15 bp, Homo sapiens
attcaaaatggcttg

SEQ ID NO: 5280316 - DNA, 17 bp, Homo sapiens
attcaaaccaaagctgc

SEQ ID NO: 5280317 - DNA, 19 bp, Homo sapiens
attcaaaccaaagctgcct

SEQ ID NO: 5280318 - DNA, 21 bp, Homo sapiens
attcaaaccaaagctgcctgt

SEQ ID NO: 5280319 - DNA, 13 bp, Homo sapiens
attcaaacccagg

SEQ ID NO: 5280320 - DNA, 15 bp, Homo sapiens
attcaaactacctat

SEQ ID NO: 5280321 - DNA, 18 bp, Homo sapiens
attcaaactacctatatt

SEQ ID NO: 5280322 - DNA, 16 bp, Homo sapiens
attcaaactgcacttt

SEQ ID NO: 5280323 - DNA, 17 bp, Homo sapiens
attcaaactgctccaag

SEQ ID NO: 5280324 - DNA, 17 bp, Homo sapiens
attcaaactggggcctc

SEQ ID NO: 5280325 - DNA, 19 bp, Homo sapiens
attcaaactggggcctcca

SEQ ID NO: 5280326 - DNA, 22 bp, Homo sapiens
attcaaactggggcctccagaa

SEQ ID NO: 5280327 - DNA, 16 bp, Homo sapiens
attcaaagaaatatct

SEQ ID NO: 5280328 - DNA, 15 bp, Homo sapiens
attcaaagcagctgt

SEQ ID NO: 5280329 - DNA, 20 bp, Homo sapiens
attcaaagcataaaactttg

SEQ ID NO: 5280330 - DNA, 20 bp, Homo sapiens
attcaaaggtggattacaag

SEQ ID NO: 5280331 - DNA, 13 bp, Homo sapiens
attcaaaggttct

SEQ ID NO: 5280332 - DNA, 14 bp, Homo sapiens
attcaaaggttcta

SEQ ID NO: 5280333 - DNA, 16 bp, Homo sapiens
attcaaaggttctagg

SEQ ID NO: 5280334 - DNA, 21 bp, Homo sapiens
attcaaaggttctaggtttca

SEQ ID NO: 5280335 - DNA, 18 bp, Homo sapiens
attcaaagtagttttatt

SEQ ID NO: 5280336 - DNA, 12 bp, Homo sapiens
attcaaagtgtt

SEQ ID NO: 5280337 - DNA, 14 bp, Homo sapiens
attcaaagtgttat

SEQ ID NO: 5280338 - DNA, 22 bp, Homo sapiens
attcaaagtgttgtgttcctgg

SEQ ID NO: 5280339 - DNA, 21 bp, Homo sapiens
attcaaagttgcctaaatcca

SEQ ID NO: 5280340 - DNA, 22 bp, Homo sapiens
attcaaagttgcctaaatccat

SEQ ID NO: 5280341 - DNA, 19 bp, Homo sapiens
attcaaatatcaaaaggaa

SEQ ID NO: 5280342 - DNA, 20 bp, Homo sapiens
attcaaatatcaaaaggaag

SEQ ID NO: 5280343 - DNA, 18 bp, Homo sapiens
attcaaatattctttcaa

SEQ ID NO: 5280344 - DNA, 14 bp, Homo sapiens
attcaaatcctctt

SEQ ID NO: 5280345 - DNA, 20 bp, Homo sapiens
attcaaatgaagattcagca

SEQ ID NO: 5280346 - DNA, 13 bp, Homo sapiens
attcaaatgaagg

SEQ ID NO: 5280347 - DNA, 12 bp, Homo sapiens
attcaaatgcat

SEQ ID NO: 5280348 - DNA, 20 bp, Homo sapiens
attcaaattatgtataaata

SEQ ID NO: 5280349 - DNA, 15 bp, Homo sapiens
attcaaattgctgct

SEQ ID NO: 5280350 - DNA, 16 bp, Homo sapiens
attcaaattgctgctt

SEQ ID NO: 5280351 - DNA, 21 bp, Homo sapiens
attcaaattgctgcttggatt

SEQ ID NO: 5280352 - DNA, 15 bp, Homo sapiens
attcaaatttgtaat

SEQ ID NO: 5280353 - DNA, 22 bp, Homo sapiens
attcaaatttgtaataaaacta

SEQ ID NO: 5280354 - DNA, 17 bp, Homo sapiens
attcaaatttgtacagg

SEQ ID NO: 5280355 - DNA, 23 bp, Homo sapiens
atttgtccaaacaggtgctggcc

SEQ ID NO: 5280356 - DNA, 21 bp, Homo sapiens
atttgtccaatggctgtaaac

SEQ ID NO: 5280357 - DNA, 15 bp, Homo sapiens
atttgtccaattctc

SEQ ID NO: 5280358 - DNA, 13 bp, Homo sapiens
atttgtccaccca

SEQ ID NO: 5280359 - DNA, 21 bp, Homo sapiens
atttgtccatgtgcaaacgct

SEQ ID NO: 5280360 - DNA, 22 bp, Homo sapiens
atttgtccattgtaaatctgaa

SEQ ID NO: 5280361 - DNA, 22 bp, Homo sapiens
atttgtcccaatagctctactg

SEQ ID NO: 5280362 - DNA, 12 bp, Homo sapiens
atttgtcccaga

SEQ ID NO: 5280363 - DNA, 15 bp, Homo sapiens
atttgtcccagcctg

SEQ ID NO: 5280364 - DNA, 19 bp, Homo sapiens
atttgtcccagcctggggc

SEQ ID NO: 5280365 - DNA, 20 bp, Homo sapiens
atttgtcctctttacatgaa

SEQ ID NO: 5280366 - DNA, 17 bp, Homo sapiens
atttgtcctgcagagct

SEQ ID NO: 5280367 - DNA, 19 bp, Homo sapiens
atttgtccttttatttctc

SEQ ID NO: 5280368 - DNA, 18 bp, Homo sapiens
atttgtccttttgtgaaa

SEQ ID NO: 5280369 - DNA, 19 bp, Homo sapiens
atttgtcggggaagatgaa

SEQ ID NO: 5280370 - DNA, 19 bp, Homo sapiens
atttgtcgggttctcccat

SEQ ID NO: 5280371 - DNA, 20 bp, Homo sapiens
atttgtcgggttctcccatg

SEQ ID NO: 5280372 - DNA, 17 bp, Homo sapiens
atttgtctattctccag

SEQ ID NO: 5280373 - DNA, 14 bp, Homo sapiens
atttgtctcctact

SEQ ID NO: 5280374 - DNA, 18 bp, Homo sapiens
atttgtctcctactctgt

SEQ ID NO: 5280375 - DNA, 16 bp, Homo sapiens
atttgtctgtgtgcta

SEQ ID NO: 5280376 - DNA, 22 bp, Homo sapiens
atttgtctgtgtgctactaaca

SEQ ID NO: 5280377 - DNA, 16 bp, Homo sapiens
atttgtcttaaaaatt

SEQ ID NO: 5280378 - DNA, 20 bp, Homo sapiens
atttgtcttaaaaatttata

SEQ ID NO: 5280379 - DNA, 21 bp, Homo sapiens
atttgtcttcccttctttgca

SEQ ID NO: 5280380 - DNA, 15 bp, Homo sapiens
atttgtcttccgatc

SEQ ID NO: 5280381 - DNA, 16 bp, Homo sapiens
atttgtctttggaaaa

SEQ ID NO: 5280382 - DNA, 14 bp, Homo sapiens
atttgtctttttgt

SEQ ID NO: 5280383 - DNA, 21 bp, Homo sapiens
atttgtctttttgttgtaaaa

SEQ ID NO: 5280384 - DNA, 23 bp, Homo sapiens
atttgtgaaatgatggtgaaagt

SEQ ID NO: 5280385 - DNA, 17 bp, Homo sapiens
atttgtgaactcagcca

SEQ ID NO: 5280386 - DNA, 17 bp, Homo sapiens
atttgtgaactggaaga

SEQ ID NO: 5280387 - DNA, 20 bp, Homo sapiens
atttgtgaactggaagaaag

SEQ ID NO: 5280388 - DNA, 17 bp, Homo sapiens
atttgtgaactgtcatg

SEQ ID NO: 5280389 - DNA, 23 bp, Homo sapiens
atttgtgaaggtggaaataaact

SEQ ID NO: 5280390 - DNA, 15 bp, Homo sapiens
atttgtgaatttgca

SEQ ID NO: 5280391 - DNA, 17 bp, Homo sapiens
atttgtgacaaaaaatt

SEQ ID NO: 5280392 - DNA, 18 bp, Homo sapiens
atttgtgactaattgtat

SEQ ID NO: 5280393 - DNA, 14 bp, Homo sapiens
atttgtgactcttt

SEQ ID NO: 5280394 - DNA, 15 bp, Homo sapiens
atttgtgacttttta

SEQ ID NO: 5280395 - DNA, 19 bp, Homo sapiens
atttgtgagccaaagagaa

SEQ ID NO: 5280396 - DNA, 22 bp, Homo sapiens
atttgtgagccaaagagaaaag

SEQ ID NO: 5280397 - DNA, 15 bp, Homo sapiens
atttgtgatacaatg

SEQ ID NO: 5280398 - DNA, 17 bp, Homo sapiens
atttgtgatacaatgct

SEQ ID NO: 5280399 - DNA, 18 bp, Homo sapiens
atttgtgatagcactttc

SEQ ID NO: 5280400 - DNA, 17 bp, Homo sapiens
atttgtgatatatgtat

SEQ ID NO: 5280401 - DNA, 17 bp, Homo sapiens
atttgtgcaaacatgga

SEQ ID NO: 5280402 - DNA, 16 bp, Homo sapiens
atttgtgcccattcct

SEQ ID NO: 5280403 - DNA, 19 bp, Homo sapiens
atttgtgcccccaaccatt

SEQ ID NO: 5280404 - DNA, 21 bp, Homo sapiens
atttgtgctatagtatttgat

SEQ ID NO: 5280405 - DNA, 14 bp, Homo sapiens
atttgtgctgggtt

SEQ ID NO: 5280406 - DNA, 15 bp, Homo sapiens
atttgtgctttgaaa

SEQ ID NO: 5280407 - DNA, 14 bp, Homo sapiens
atttgtgcttttta

SEQ ID NO: 5280408 - DNA, 12 bp, Homo sapiens
atttgtggaata

SEQ ID NO: 5280409 - DNA, 22 bp, Homo sapiens
atttgtgggtttttatttccta

SEQ ID NO: 5280410 - DNA, 18 bp, Homo sapiens
atttgtggtaatctacac

SEQ ID NO: 5280411 - DNA, 19 bp, Homo sapiens
atttgtggtcacatgcttt

SEQ ID NO: 5280412 - DNA, 20 bp, Homo sapiens
atttgtggtgatatagaatt

SEQ ID NO: 5280413 - DNA, 15 bp, Homo sapiens
atttgtggtgatttg

SEQ ID NO: 5280414 - DNA, 21 bp, Homo sapiens
atttgtggttagaatcttgtt

SEQ ID NO: 5280415 - DNA, 16 bp, Homo sapiens
atttgtgtaactgaaa

SEQ ID NO: 5280416 - DNA, 19 bp, Homo sapiens
atttgtgtaaggactttgg

SEQ ID NO: 5280417 - DNA, 16 bp, Homo sapiens
atttgtgtaataaagt

SEQ ID NO: 5280418 - DNA, 18 bp, Homo sapiens
atttgtgtaatatgaaat

SEQ ID NO: 5280419 - DNA, 21 bp, Homo sapiens
atttgtgtagattgtgtaaat

SEQ ID NO: 5280420 - DNA, 13 bp, Homo sapiens
atttgtgtatgtg

SEQ ID NO: 5280421 - DNA, 19 bp, Homo sapiens
atttgtgtattttcctgga

SEQ ID NO: 5280422 - DNA, 16 bp, Homo sapiens
atttgtgtcactgtac

SEQ ID NO: 5280423 - DNA, 14 bp, Homo sapiens
atttgtgtctcttt

SEQ ID NO: 5280424 - DNA, 17 bp, Homo sapiens
atttgtgtctctttatt

SEQ ID NO: 5280425 - DNA, 19 bp, Homo sapiens
atttgtgtctgcctgcctc

SEQ ID NO: 5280426 - DNA, 20 bp, Homo sapiens
atttgtgtggagtcatttct

SEQ ID NO: 5280427 - DNA, 21 bp, Homo sapiens
atttgtgtggagtcatttctg

SEQ ID NO: 5280428 - DNA, 23 bp, Homo sapiens
atttgtgtggagtcatttctgat

SEQ ID NO: 5280429 - DNA, 12 bp, Homo sapiens
atttgtgtgtgt

SEQ ID NO: 5280430 - DNA, 20 bp, Homo sapiens
atttgtgtgtgtgcaagtgt

SEQ ID NO: 5280431 - DNA, 21 bp, Homo sapiens
atttgtgtgtgtgtgtgtgtt

SEQ ID NO: 5280432 - DNA, 13 bp, Homo sapiens
atttgtgtgttac

SEQ ID NO: 5280433 - DNA, 15 bp, Homo sapiens
atttgtgttgaagga

SEQ ID NO: 5280434 - DNA, 22 bp, Homo sapiens
atttgtgttgggggaaatgttg

SEQ ID NO: 5280435 - DNA, 22 bp, Homo sapiens
atttgtgttttacagtatatct

SEQ ID NO: 5280436 - DNA, 19 bp, Homo sapiens
atttgtgtttttctttttc

SEQ ID NO: 5280437 - DNA, 14 bp, Homo sapiens
atttgttaaaatac

SEQ ID NO: 5280438 - DNA, 13 bp, Homo sapiens
atttgttaaattg

SEQ ID NO: 5280439 - DNA, 15 bp, Homo sapiens
atttgttaacagagc

SEQ ID NO: 5280440 - DNA, 16 bp, Homo sapiens
atttgttaacagagca

SEQ ID NO: 5280441 - DNA, 19 bp, Homo sapiens
atttgttaactgtactgaa

SEQ ID NO: 5280442 - DNA, 17 bp, Homo sapiens
atttgttaatatttctt

SEQ ID NO: 5280443 - DNA, 24 bp, Homo sapiens
atttgttaatatttcttcgtgatg

SEQ ID NO: 5280444 - DNA, 16 bp, Homo sapiens
atttgttaatgattct

SEQ ID NO: 5280445 - DNA, 16 bp, Homo sapiens
atttgttaattaaata

SEQ ID NO: 5280446 - DNA, 16 bp, Homo sapiens
atttgttacagtttct

SEQ ID NO: 5280447 - DNA, 19 bp, Homo sapiens
atttgttacagtttcttca

SEQ ID NO: 5280448 - DNA, 15 bp, Homo sapiens
atttgttactgtatt

SEQ ID NO: 5280449 - DNA, 21 bp, Homo sapiens
atttgttagccacggaaacat

SEQ ID NO: 5280450 - DNA, 22 bp, Homo sapiens
atttgttagccacggaaacata

SEQ ID NO: 5280451 - DNA, 20 bp, Homo sapiens
atttgttaggatagatctta

SEQ ID NO: 5280452 - DNA, 22 bp, Homo sapiens
atttgttagttcctgtatgaaa

SEQ ID NO: 5280453 - DNA, 15 bp, Homo sapiens
atttgttatatataa

SEQ ID NO: 5280454 - DNA, 16 bp, Homo sapiens
atttgttatatataat

SEQ ID NO: 5280455 - DNA, 18 bp, Homo sapiens
atttgttatatcagcaga

SEQ ID NO: 5280456 - DNA, 17 bp, Homo sapiens
atttgttatgataaaag

SEQ ID NO: 5280457 - DNA, 20 bp, Homo sapiens
atttgttatgataaaaggaa

SEQ ID NO: 5280458 - DNA, 17 bp, Homo sapiens
atttgttattttgcaac

SEQ ID NO: 5280459 - DNA, 14 bp, Homo sapiens
atttgttcagctcc

SEQ ID NO: 5280460 - DNA, 16 bp, Homo sapiens
atttgttcatgtttgg

SEQ ID NO: 5280461 - DNA, 17 bp, Homo sapiens
atttgttcccaagagca

SEQ ID NO: 5280462 - DNA, 11 bp, Homo sapiens
atttgttcctg

SEQ ID NO: 5280463 - DNA, 18 bp, Homo sapiens
atttgttcctgccccacc

SEQ ID NO: 5280464 - DNA, 13 bp, Homo sapiens
atttgttcctgct

SEQ ID NO: 5280465 - DNA, 21 bp, Homo sapiens
atttgttcctgcttccgagat

SEQ ID NO: 5280466 - DNA, 20 bp, Homo sapiens
atttgttcctggagttttga

SEQ ID NO: 5280467 - DNA, 23 bp, Homo sapiens
atttgttcctggagttttgattt

SEQ ID NO: 5280468 - DNA, 13 bp, Homo sapiens
atttgttctctgt

SEQ ID NO: 5280469 - DNA, 14 bp, Homo sapiens
atttgttctctgtc

SEQ ID NO: 5280470 - DNA, 21 bp, Homo sapiens
atttgttctgggttaacagta

SEQ ID NO: 5280471 - DNA, 13 bp, Homo sapiens
atttgttcttaca

SEQ ID NO: 5280472 - DNA, 13 bp, Homo sapiens
atttgttcttata

SEQ ID NO: 5280473 - DNA, 13 bp, Homo sapiens
atttgttcttgta

SEQ ID NO: 5280474 - DNA, 15 bp, Homo sapiens
atttgttctttgcca

SEQ ID NO: 5280475 - DNA, 16 bp, Homo sapiens
atttgttgaaattatg

SEQ ID NO: 5280476 - DNA, 18 bp, Homo sapiens
atttgttgaaattatgta

SEQ ID NO: 5280477 - DNA, 22 bp, Homo sapiens
atttgttgaataggggaaagaa

SEQ ID NO: 5280478 - DNA, 15 bp, Homo sapiens
atttgttgctgctgc

SEQ ID NO: 5280479 - DNA, 14 bp, Homo sapiens
atttgttggaatga

SEQ ID NO: 5280480 - DNA, 20 bp, Homo sapiens
atttgttggagatgcagcct

SEQ ID NO: 5280481 - DNA, 13 bp, Homo sapiens
atttgttggtaac

SEQ ID NO: 5280482 - DNA, 14 bp, Homo sapiens
atttgttgtacttt

SEQ ID NO: 5280483 - DNA, 16 bp, Homo sapiens
atttgttgtcatgtgt

SEQ ID NO: 5280484 - DNA, 18 bp, Homo sapiens
atttgttgtcatgtgtat

SEQ ID NO: 5280485 - DNA, 20 bp, Homo sapiens
atttgttgttctttcagaaa

SEQ ID NO: 5280486 - DNA, 15 bp, Homo sapiens
atttgttgttttctg

SEQ ID NO: 5280487 - DNA, 17 bp, Homo sapiens
atttgtttaaaaagtaa

SEQ ID NO: 5280488 - DNA, 13 bp, Homo sapiens
atttgtttaaaag

SEQ ID NO: 5280489 - DNA, 15 bp, Homo sapiens
atttgtttaaaagga

SEQ ID NO: 5280490 - DNA, 20 bp, Homo sapiens
atttgtttaaaattctcttt

SEQ ID NO: 5280491 - DNA, 20 bp, Homo sapiens
atttgtttaaagaataaagt

SEQ ID NO: 5280492 - DNA, 14 bp, Homo sapiens
atttgtttaaatta

SEQ ID NO: 5280493 - DNA, 18 bp, Homo sapiens
atttgtttaataccctgt

SEQ ID NO: 5280494 - DNA, 23 bp, Homo sapiens
atttgtttaataccctgtacata

SEQ ID NO: 5280495 - DNA, 19 bp, Homo sapiens
atttgtttaattaaattta

SEQ ID NO: 5280496 - DNA, 13 bp, Homo sapiens
atttgtttagaag

SEQ ID NO: 5280497 - DNA, 17 bp, Homo sapiens
atttgtttatatttaat

SEQ ID NO: 5280498 - DNA, 13 bp, Homo sapiens
atttgtttatgta

SEQ ID NO: 5280499 - DNA, 11 bp, Homo sapiens
atttgtttcat

SEQ ID NO: 5280500 - DNA, 12 bp, Homo sapiens
atttgtttcatc

SEQ ID NO: 5280501 - DNA, 16 bp, Homo sapiens
atttgtttcatctatt

SEQ ID NO: 5280502 - DNA, 16 bp, Homo sapiens
atttgtttcatttctg

SEQ ID NO: 5280503 - DNA, 20 bp, Homo sapiens
atttgtttcatttctgcaga

SEQ ID NO: 5280504 - DNA, 21 bp, Homo sapiens
atttgtttcatttctgcagat

SEQ ID NO: 5280505 - DNA, 20 bp, Homo sapiens
atttgtttcccccacagttt

SEQ ID NO: 5280506 - DNA, 18 bp, Homo sapiens
atttgtttctttctctga

SEQ ID NO: 5280507 - DNA, 20 bp, Homo sapiens
atttgtttgaactgataaag

SEQ ID NO: 5280508 - DNA, 14 bp, Homo sapiens
atttgtttgatttt

SEQ ID NO: 5280509 - DNA, 19 bp, Homo sapiens
atttgtttgattttcatat

SEQ ID NO: 5280510 - DNA, 12 bp, Homo sapiens
atttgtttgcat

SEQ ID NO: 5280511 - DNA, 14 bp, Homo sapiens
atttgtttgtagct

SEQ ID NO: 5280512 - DNA, 15 bp, Homo sapiens
atttgtttgtagctt

SEQ ID NO: 5280513 - DNA, 13 bp, Homo sapiens
atttgtttgtatt

SEQ ID NO: 5280514 - DNA, 14 bp, Homo sapiens
atttgtttgtattc

SEQ ID NO: 5280515 - DNA, 13 bp, Homo sapiens
atttgtttgtgtt

SEQ ID NO: 5280516 - DNA, 20 bp, Homo sapiens
atttgtttgtgtttatgaaa

SEQ ID NO: 5280517 - DNA, 15 bp, Homo sapiens
atttgttttagcatt

SEQ ID NO: 5280518 - DNA, 20 bp, Homo sapiens
atttgttttagcattaccta

SEQ ID NO: 5280519 - DNA, 23 bp, Homo sapiens
atttgttttagcattacctaatt

SEQ ID NO: 5280520 - DNA, 13 bp, Homo sapiens
atttgttttcaca

SEQ ID NO: 5280521 - DNA, 14 bp, Homo sapiens
atttgttttcatgg

SEQ ID NO: 5280522 - DNA, 20 bp, Homo sapiens
atttgttttcatttgtataa

SEQ ID NO: 5280523 - DNA, 20 bp, Homo sapiens
atttgttttcttcaacatgt

SEQ ID NO: 5280524 - DNA, 15 bp, Homo sapiens
atttgttttgaattt

SEQ ID NO: 5280525 - DNA, 17 bp, Homo sapiens
atttgttttgaattttg

SEQ ID NO: 5280526 - DNA, 17 bp, Homo sapiens
atttgttttgcattcct

SEQ ID NO: 5280527 - DNA, 12 bp, Homo sapiens
atttgttttgct

SEQ ID NO: 5280528 - DNA, 13 bp, Homo sapiens
atttgttttgctt

SEQ ID NO: 5280529 - DNA, 14 bp, Homo sapiens
atttgttttgcttt

SEQ ID NO: 5280530 - DNA, 18 bp, Homo sapiens
atttgttttgtttacaga

SEQ ID NO: 5280531 - DNA, 18 bp, Homo sapiens
atttgtttttaaactgta

SEQ ID NO: 5280532 - DNA, 22 bp, Homo sapiens
atttgtttttaaactgtacagt

SEQ ID NO: 5280533 - DNA, 15 bp, Homo sapiens
atttgtttttcattc

SEQ ID NO: 5280534 - DNA, 12 bp, Homo sapiens
attcaacaaaca

SEQ ID NO: 5280535 - DNA, 11 bp, Homo sapiens
attcaacaaat

SEQ ID NO: 5280536 - DNA, 17 bp, Homo sapiens
attcaacacactgcctt

SEQ ID NO: 5280537 - DNA, 16 bp, Homo sapiens
attcaacacattactt

SEQ ID NO: 5280538 - DNA, 18 bp, Homo sapiens
attcaacacatttttaag

SEQ ID NO: 5280539 - DNA, 18 bp, Homo sapiens
attcaacagcaagtgtga

SEQ ID NO: 5280540 - DNA, 19 bp, Homo sapiens
attcaacatcaaaacttaa

SEQ ID NO: 5280541 - DNA, 13 bp, Homo sapiens
attcaacatcaat

SEQ ID NO: 5280542 - DNA, 16 bp, Homo sapiens
attcaaccactgtaaa

SEQ ID NO: 5280543 - DNA, 19 bp, Homo sapiens
attcaaccactgtaaaatg

SEQ ID NO: 5280544 - DNA, 22 bp, Homo sapiens
attcaaccactgtaaaatgaaa

SEQ ID NO: 5280545 - DNA, 19 bp, Homo sapiens
attcaaccatggactttat

SEQ ID NO: 5280546 - DNA, 17 bp, Homo sapiens
attcaaccccagaaatt

SEQ ID NO: 5280547 - DNA, 15 bp, Homo sapiens
attcaaccctggaga

SEQ ID NO: 5280548 - DNA, 13 bp, Homo sapiens
attcaactaaaaa

SEQ ID NO: 5280549 - DNA, 13 bp, Homo sapiens
attcaactggaaa

SEQ ID NO: 5280550 - DNA, 14 bp, Homo sapiens
attcaactggaaat

SEQ ID NO: 5280551 - DNA, 19 bp, Homo sapiens
attcaactggaaattaaaa

SEQ ID NO: 5280552 - DNA, 16 bp, Homo sapiens
attcaactttccaaat

SEQ ID NO: 5280553 - DNA, 15 bp, Homo sapiens
attcaactttgtaaa

SEQ ID NO: 5280554 - DNA, 19 bp, Homo sapiens
attcaacttttctaagaaa

SEQ ID NO: 5280555 - DNA, 17 bp, Homo sapiens
attcaagaaagatatct

SEQ ID NO: 5280556 - DNA, 13 bp, Homo sapiens
attcaagaaagga

SEQ ID NO: 5280557 - DNA, 16 bp, Homo sapiens
attcaagaaagtgaaa

SEQ ID NO: 5280558 - DNA, 18 bp, Homo sapiens
attcaagaagatagttgt

SEQ ID NO: 5280559 - DNA, 14 bp, Homo sapiens
attcaagaagtatt

SEQ ID NO: 5280560 - DNA, 22 bp, Homo sapiens
attcaagaagtatttttttaat

SEQ ID NO: 5280561 - DNA, 21 bp, Homo sapiens
attcaagaatgaaaaatataa

SEQ ID NO: 5280562 - DNA, 16 bp, Homo sapiens
attcaagacaagagct

SEQ ID NO: 5280563 - DNA, 17 bp, Homo sapiens
attcaagacaagagctg

SEQ ID NO: 5280564 - DNA, 21 bp, Homo sapiens
attcaagacaagagctgttat

SEQ ID NO: 5280565 - DNA, 20 bp, Homo sapiens
attcaagagctagaaaaata

SEQ ID NO: 5280566 - DNA, 23 bp, Homo sapiens
attcaagaggcctttcttttaaa

SEQ ID NO: 5280567 - DNA, 20 bp, Homo sapiens
attcaagagtggggggagga

SEQ ID NO: 5280568 - DNA, 12 bp, Homo sapiens
attcaagattcc

SEQ ID NO: 5280569 - DNA, 17 bp, Homo sapiens
attcaagcaaacatcaa

SEQ ID NO: 5280570 - DNA, 15 bp, Homo sapiens
attcaagctatttaa

SEQ ID NO: 5280571 - DNA, 16 bp, Homo sapiens
attcaagctgagaaaa

SEQ ID NO: 5280572 - DNA, 17 bp, Homo sapiens
attcaaggaatttctta

SEQ ID NO: 5280573 - DNA, 18 bp, Homo sapiens
attcaaggaatttcttaa

SEQ ID NO: 5280574 - DNA, 19 bp, Homo sapiens
attcaaggaatttcttaac

SEQ ID NO: 5280575 - DNA, 18 bp, Homo sapiens
attcaaggccacaaaaac

SEQ ID NO: 5280576 - DNA, 19 bp, Homo sapiens
attcaaggctcagaaggaa

SEQ ID NO: 5280577 - DNA, 16 bp, Homo sapiens
attcaaggtaaaattc

SEQ ID NO: 5280578 - DNA, 15 bp, Homo sapiens
attcaaggtggccaa

SEQ ID NO: 5280579 - DNA, 14 bp, Homo sapiens
attcaagtaacact

SEQ ID NO: 5280580 - DNA, 18 bp, Homo sapiens
attcaagtaacactttaa

SEQ ID NO: 5280581 - DNA, 14 bp, Homo sapiens
attcaagtatttga

SEQ ID NO: 5280582 - DNA, 12 bp, Homo sapiens
attcaagtgcct

SEQ ID NO: 5280583 - DNA, 21 bp, Homo sapiens
attcaagtgtaaaatattttg

SEQ ID NO: 5280584 - DNA, 14 bp, Homo sapiens
attcaagttattgt

SEQ ID NO: 5280585 - DNA, 18 bp, Homo sapiens
attcaataaaaaaaagaa

SEQ ID NO: 5280586 - DNA, 12 bp, Homo sapiens
attcaataaagc

SEQ ID NO: 5280587 - DNA, 22 bp, Homo sapiens
attcaataaagcagttaattta

SEQ ID NO: 5280588 - DNA, 12 bp, Homo sapiens
attcaataaagt

SEQ ID NO: 5280589 - DNA, 12 bp, Homo sapiens
attcaataatga

SEQ ID NO: 5280590 - DNA, 19 bp, Homo sapiens
attcaataatgagagctca

SEQ ID NO: 5280591 - DNA, 15 bp, Homo sapiens
attcaatacaaacaa

SEQ ID NO: 5280592 - DNA, 17 bp, Homo sapiens
attcaataccgctcagt

SEQ ID NO: 5280593 - DNA, 20 bp, Homo sapiens
attcaataccgctcagtatt

SEQ ID NO: 5280594 - DNA, 21 bp, Homo sapiens
attcaataccgctcagtattt

SEQ ID NO: 5280595 - DNA, 22 bp, Homo sapiens
attcaataccgctcagtatttt

SEQ ID NO: 5280596 - DNA, 15 bp, Homo sapiens
attcaatatctgaca

SEQ ID NO: 5280597 - DNA, 13 bp, Homo sapiens
attcaatattgaa

SEQ ID NO: 5280598 - DNA, 21 bp, Homo sapiens
attcaatattgacatttgtag

SEQ ID NO: 5280599 - DNA, 20 bp, Homo sapiens
attcaatatttactgagact

SEQ ID NO: 5280600 - DNA, 19 bp, Homo sapiens
attcaatcaacctgcactt

SEQ ID NO: 5280601 - DNA, 15 bp, Homo sapiens
attcaatcatttatt

SEQ ID NO: 5280602 - DNA, 16 bp, Homo sapiens
attcaatcatttattc

SEQ ID NO: 5280603 - DNA, 14 bp, Homo sapiens
attcaatctgtaaa

SEQ ID NO: 5280604 - DNA, 15 bp, Homo sapiens
attcaatctgtaaac

SEQ ID NO: 5280605 - DNA, 13 bp, Homo sapiens
attcaatgaactt

SEQ ID NO: 5280606 - DNA, 22 bp, Homo sapiens
attcaatgaacttccatttgta

SEQ ID NO: 5280607 - DNA, 11 bp, Homo sapiens
attcaatgcaa

SEQ ID NO: 5280608 - DNA, 13 bp, Homo sapiens
attcaatgcaagt

SEQ ID NO: 5280609 - DNA, 13 bp, Homo sapiens
attcaatgcaatg

SEQ ID NO: 5280610 - DNA, 14 bp, Homo sapiens
attcaatgcaatga

SEQ ID NO: 5280611 - DNA, 22 bp, Homo sapiens
attcaatgcaatgcaattcaat

SEQ ID NO: 5280612 - DNA, 18 bp, Homo sapiens
attcaatgcatttaaaat

SEQ ID NO: 5280613 - DNA, 19 bp, Homo sapiens
attcaatgcatttaaaata

SEQ ID NO: 5280614 - DNA, 18 bp, Homo sapiens
attcaatgcccctgaatt

SEQ ID NO: 5280615 - DNA, 15 bp, Homo sapiens
attcaatgctttcta

SEQ ID NO: 5280616 - DNA, 23 bp, Homo sapiens
attcaatgggtaaataaatgctg

SEQ ID NO: 5280617 - DNA, 13 bp, Homo sapiens
attcaatgtattg

SEQ ID NO: 5280618 - DNA, 20 bp, Homo sapiens
attcaatgtgaacactggca

SEQ ID NO: 5280619 - DNA, 13 bp, Homo sapiens
attcaatgtgaca

SEQ ID NO: 5280620 - DNA, 22 bp, Homo sapiens
attcaatgtttatgcaaggaag

SEQ ID NO: 5280621 - DNA, 18 bp, Homo sapiens
attcaattaaagaaataa

SEQ ID NO: 5280622 - DNA, 23 bp, Homo sapiens
attcaattaagttattaacattt

SEQ ID NO: 5280623 - DNA, 17 bp, Homo sapiens
attcaattcctctggga

SEQ ID NO: 5280624 - DNA, 18 bp, Homo sapiens
attcaattcctctgggaa

SEQ ID NO: 5280625 - DNA, 14 bp, Homo sapiens
attcaattctgtat

SEQ ID NO: 5280626 - DNA, 13 bp, Homo sapiens
attcaattgtaaa

SEQ ID NO: 5280627 - DNA, 14 bp, Homo sapiens
attcaattgtaaat

SEQ ID NO: 5280628 - DNA, 22 bp, Homo sapiens
attcaattgtaaattgaatcag

SEQ ID NO: 5280629 - DNA, 14 bp, Homo sapiens
attcaatttctcac

SEQ ID NO: 5280630 - DNA, 21 bp, Homo sapiens
attcaatttgatgtggtgaaa

SEQ ID NO: 5280631 - DNA, 15 bp, Homo sapiens
attcaatttggcaaa

SEQ ID NO: 5280632 - DNA, 21 bp, Homo sapiens
attcaattttaaggcatattt

SEQ ID NO: 5280633 - DNA, 22 bp, Homo sapiens
attcaattttctttaaccagtc

SEQ ID NO: 5280634 - DNA, 23 bp, Homo sapiens
attcacaaacaaatggctgtaaa

SEQ ID NO: 5280635 - DNA, 17 bp, Homo sapiens
attcacaaacttttata

SEQ ID NO: 5280636 - DNA, 16 bp, Homo sapiens
attcacaaagtaattt

SEQ ID NO: 5280637 - DNA, 21 bp, Homo sapiens
attcacaaagtaatttggaaa

SEQ ID NO: 5280638 - DNA, 14 bp, Homo sapiens
attcacaaagtata

SEQ ID NO: 5280639 - DNA, 13 bp, Homo sapiens
attcacaacacaa

SEQ ID NO: 5280640 - DNA, 17 bp, Homo sapiens
attcacaactaggacct

SEQ ID NO: 5280641 - DNA, 20 bp, Homo sapiens
attcacaactaggacctcat

SEQ ID NO: 5280642 - DNA, 16 bp, Homo sapiens
attcacaagctaactt

SEQ ID NO: 5280643 - DNA, 14 bp, Homo sapiens
attcacaatagaaa

SEQ ID NO: 5280644 - DNA, 17 bp, Homo sapiens
attcacaatgcattttt

SEQ ID NO: 5280645 - DNA, 22 bp, Homo sapiens
attcacaatggattatacaaaa

SEQ ID NO: 5280646 - DNA, 14 bp, Homo sapiens
attcacacacagcc

SEQ ID NO: 5280647 - DNA, 16 bp, Homo sapiens
attcacacacagcctg

SEQ ID NO: 5280648 - DNA, 17 bp, Homo sapiens
attcacacacagcctgg

SEQ ID NO: 5280649 - DNA, 16 bp, Homo sapiens
attcacacacccctca

SEQ ID NO: 5280650 - DNA, 20 bp, Homo sapiens
attcacacatgcctatatta

SEQ ID NO: 5280651 - DNA, 16 bp, Homo sapiens
attcacacattaataa

SEQ ID NO: 5280652 - DNA, 20 bp, Homo sapiens
attcacacctcacgctctgg

SEQ ID NO: 5280653 - DNA, 15 bp, Homo sapiens
attcacacctgactc

SEQ ID NO: 5280654 - DNA, 12 bp, Homo sapiens
attcacacctta

SEQ ID NO: 5280655 - DNA, 23 bp, Homo sapiens
attcacactgtgcgttttagagt

SEQ ID NO: 5280656 - DNA, 19 bp, Homo sapiens
attcacacttgttcaacag

SEQ ID NO: 5280657 - DNA, 13 bp, Homo sapiens
attcacagcccag

SEQ ID NO: 5280658 - DNA, 18 bp, Homo sapiens
attcacagcccagaacca

SEQ ID NO: 5280659 - DNA, 12 bp, Homo sapiens
attcacagcctc

SEQ ID NO: 5280660 - DNA, 14 bp, Homo sapiens
attcacagcctccg

SEQ ID NO: 5280661 - DNA, 18 bp, Homo sapiens
attcacagcctttctgaa

SEQ ID NO: 5280662 - DNA, 20 bp, Homo sapiens
attcacaggtggacaaatgt

SEQ ID NO: 5280663 - DNA, 12 bp, Homo sapiens
attcacagtttt

SEQ ID NO: 5280664 - DNA, 16 bp, Homo sapiens
attcacatagtcctca

SEQ ID NO: 5280665 - DNA, 15 bp, Homo sapiens
attcacatatgtctt

SEQ ID NO: 5280666 - DNA, 17 bp, Homo sapiens
attcacatctaacctca

SEQ ID NO: 5280667 - DNA, 15 bp, Homo sapiens
attcacatgttttca

SEQ ID NO: 5280668 - DNA, 18 bp, Homo sapiens
attcacatgttttcaaat

SEQ ID NO: 5280669 - DNA, 14 bp, Homo sapiens
attcacattaatga

SEQ ID NO: 5280670 - DNA, 14 bp, Homo sapiens
attcacatttagaa

SEQ ID NO: 5280671 - DNA, 20 bp, Homo sapiens
attcacatttgatgtacatg

SEQ ID NO: 5280672 - DNA, 13 bp, Homo sapiens
attcaccaatgtt

SEQ ID NO: 5280673 - DNA, 18 bp, Homo sapiens
attcaccaatgttgtaca

SEQ ID NO: 5280674 - DNA, 20 bp, Homo sapiens
attcaccaatgttgtacaga

SEQ ID NO: 5280675 - DNA, 16 bp, Homo sapiens
attcaccagtgttcct

SEQ ID NO: 5280676 - DNA, 14 bp, Homo sapiens
attcaccatcatgt

SEQ ID NO: 5280677 - DNA, 21 bp, Homo sapiens
attcaccatgtaaaacaaaaa

SEQ ID NO: 5280678 - DNA, 16 bp, Homo sapiens
attcacccagaaaaaa

SEQ ID NO: 5280679 - DNA, 19 bp, Homo sapiens
attcacccagacagctccc

SEQ ID NO: 5280680 - DNA, 23 bp, Homo sapiens
attcacccccatccacagttgtc

SEQ ID NO: 5280681 - DNA, 19 bp, Homo sapiens
attcaccctccacttcccg

SEQ ID NO: 5280682 - DNA, 23 bp, Homo sapiens
attcacctaagagattctgattt

SEQ ID NO: 5280683 - DNA, 12 bp, Homo sapiens
attcacctcagc

SEQ ID NO: 5280684 - DNA, 22 bp, Homo sapiens
attcacctcagcctggagaggc

SEQ ID NO: 5280685 - DNA, 18 bp, Homo sapiens
attcacctcctaaaacaa

SEQ ID NO: 5280686 - DNA, 13 bp, Homo sapiens
attcacctcttcc

SEQ ID NO: 5280687 - DNA, 15 bp, Homo sapiens
attcacctcttcctc

SEQ ID NO: 5280688 - DNA, 12 bp, Homo sapiens
attcacctgtaa

SEQ ID NO: 5280689 - DNA, 23 bp, Homo sapiens
attcaccttccagtgtctcggag

SEQ ID NO: 5280690 - DNA, 18 bp, Homo sapiens
attcaccttttcttcaaa

SEQ ID NO: 5280691 - DNA, 20 bp, Homo sapiens
attcaccttttcttcaaaat

SEQ ID NO: 5280692 - DNA, 14 bp, Homo sapiens
attcacctttttaa

SEQ ID NO: 5280693 - DNA, 21 bp, Homo sapiens
attcacgccgtaattctttct

SEQ ID NO: 5280694 - DNA, 13 bp, Homo sapiens
attcacggcctgg

SEQ ID NO: 5280695 - DNA, 14 bp, Homo sapiens
attcacggcctggc

SEQ ID NO: 5280696 - DNA, 15 bp, Homo sapiens
attcacggcctggca

SEQ ID NO: 5280697 - DNA, 19 bp, Homo sapiens
attcacgtgctttgtgttc

SEQ ID NO: 5280698 - DNA, 23 bp, Homo sapiens
attcacgtgctttgtgttcagtt

SEQ ID NO: 5280699 - DNA, 19 bp, Homo sapiens
attcacgttctagtgaaac

SEQ ID NO: 5280700 - DNA, 20 bp, Homo sapiens
attcacgttctagtgaaact

SEQ ID NO: 5280701 - DNA, 22 bp, Homo sapiens
attcacgttctagtgaaactgc

SEQ ID NO: 5280702 - DNA, 20 bp, Homo sapiens
attcacgtttttctggacca

SEQ ID NO: 5280703 - DNA, 13 bp, Homo sapiens
attcactaaaata

SEQ ID NO: 5280704 - DNA, 16 bp, Homo sapiens
attcactaatcttgaa

SEQ ID NO: 5280705 - DNA, 21 bp, Homo sapiens
attcactaggctcgtgtttgc

SEQ ID NO: 5280706 - DNA, 19 bp, Homo sapiens
attcactattagagaaaca

SEQ ID NO: 5280707 - DNA, 18 bp, Homo sapiens
attcactcagcatcccca

SEQ ID NO: 5280708 - DNA, 21 bp, Homo sapiens
attcactctgagtgttttatg

SEQ ID NO: 5280709 - DNA, 20 bp, Homo sapiens
attcactgcccccagctctt

SEQ ID NO: 5280710 - DNA, 14 bp, Homo sapiens
attcactgggccaa

SEQ ID NO: 5280711 - DNA, 23 bp, Homo sapiens
attcactgtgcactttgctcaaa

SEQ ID NO: 5280712 - DNA, 18 bp, Homo sapiens
attcactgtgcttcgagc

SEQ ID NO: 5280713 - DNA, 14 bp, Homo sapiens
attcactgttgaat

SEQ ID NO: 5280714 - DNA, 15 bp, Homo sapiens
atttgtttttcttat

SEQ ID NO: 5280715 - DNA, 16 bp, Homo sapiens
atttgtttttcttatc

SEQ ID NO: 5280716 - DNA, 19 bp, Homo sapiens
atttgtttttcttatccaa

SEQ ID NO: 5280717 - DNA, 14 bp, Homo sapiens
attttaaaaaaggg

SEQ ID NO: 5280718 - DNA, 14 bp, Homo sapiens
attttaaaaaataa

SEQ ID NO: 5280719 - DNA, 13 bp, Homo sapiens
attttaaaaaatc

SEQ ID NO: 5280720 - DNA, 16 bp, Homo sapiens
attttaaaaaatcaat

SEQ ID NO: 5280721 - DNA, 17 bp, Homo sapiens
attttaaaaaatcaatc

SEQ ID NO: 5280722 - DNA, 19 bp, Homo sapiens
attttaaaaaatcaatcaa

SEQ ID NO: 5280723 - DNA, 16 bp, Homo sapiens
attttaaaaaatgaaa

SEQ ID NO: 5280724 - DNA, 22 bp, Homo sapiens
attttaaaaacatgagaaatgt

SEQ ID NO: 5280725 - DNA, 23 bp, Homo sapiens
attttaaaaacatgagaaatgtg

SEQ ID NO: 5280726 - DNA, 17 bp, Homo sapiens
attttaaaaactttatt

SEQ ID NO: 5280727 - DNA, 22 bp, Homo sapiens
attttaaaaaggaattttgtaa

SEQ ID NO: 5280728 - DNA, 19 bp, Homo sapiens
attttaaaaagtcaattca

SEQ ID NO: 5280729 - DNA, 14 bp, Homo sapiens
attttaaaaagtct

SEQ ID NO: 5280730 - DNA, 14 bp, Homo sapiens
attttaaaaatcta

SEQ ID NO: 5280731 - DNA, 22 bp, Homo sapiens
attttaaaaatctacgtcttta

SEQ ID NO: 5280732 - DNA, 13 bp, Homo sapiens
attttaaaaatga

SEQ ID NO: 5280733 - DNA, 16 bp, Homo sapiens
attttaaaaatggtgg

SEQ ID NO: 5280734 - DNA, 17 bp, Homo sapiens
attttaaaaattggaaa

SEQ ID NO: 5280735 - DNA, 18 bp, Homo sapiens
attttaaaacatgctgtt

SEQ ID NO: 5280736 - DNA, 17 bp, Homo sapiens
attttaaaacatggcaa

SEQ ID NO: 5280737 - DNA, 15 bp, Homo sapiens
attttaaaaccatgc

SEQ ID NO: 5280738 - DNA, 16 bp, Homo sapiens
attttaaaaccatgca

SEQ ID NO: 5280739 - DNA, 19 bp, Homo sapiens
attttaaaaccatgcagct

SEQ ID NO: 5280740 - DNA, 23 bp, Homo sapiens
attttaaaacttcatctgtctgt

SEQ ID NO: 5280741 - DNA, 18 bp, Homo sapiens
attttaaaagaatgatta

SEQ ID NO: 5280742 - DNA, 22 bp, Homo sapiens
attttaaaagaatgattatgaa

SEQ ID NO: 5280743 - DNA, 20 bp, Homo sapiens
attttaaaagatgcaatgta

SEQ ID NO: 5280744 - DNA, 20 bp, Homo sapiens
attttaaaagcaattatatt

SEQ ID NO: 5280745 - DNA, 22 bp, Homo sapiens
attttaaaagcaattatattgt

SEQ ID NO: 5280746 - DNA, 13 bp, Homo sapiens
attttaaaagcat

SEQ ID NO: 5280747 - DNA, 14 bp, Homo sapiens
attttaaaagcata

SEQ ID NO: 5280748 - DNA, 15 bp, Homo sapiens
attttaaaagcatat

SEQ ID NO: 5280749 - DNA, 18 bp, Homo sapiens
attttaaaagtctatttt

SEQ ID NO: 5280750 - DNA, 13 bp, Homo sapiens
attttaaaataga

SEQ ID NO: 5280751 - DNA, 20 bp, Homo sapiens
attttaaaatagcgttcttg

SEQ ID NO: 5280752 - DNA, 23 bp, Homo sapiens
attttaaaatagcgttcttgtaa

SEQ ID NO: 5280753 - DNA, 14 bp, Homo sapiens
attttaaaatatat

SEQ ID NO: 5280754 - DNA, 15 bp, Homo sapiens
attttaaaatatatg

SEQ ID NO: 5280755 - DNA, 13 bp, Homo sapiens
attttaaaatatt

SEQ ID NO: 5280756 - DNA, 13 bp, Homo sapiens
attttaaaatcaa

SEQ ID NO: 5280757 - DNA, 17 bp, Homo sapiens
attttaaaatcaacttt

SEQ ID NO: 5280758 - DNA, 20 bp, Homo sapiens
attttaaaatcaacttttga

SEQ ID NO: 5280759 - DNA, 22 bp, Homo sapiens
attttaaaatcaacttttgaaa

SEQ ID NO: 5280760 - DNA, 20 bp, Homo sapiens
attttaaaatctcctaaatg

SEQ ID NO: 5280761 - DNA, 23 bp, Homo sapiens
attttaaaatctgagggaaatgt

SEQ ID NO: 5280762 - DNA, 16 bp, Homo sapiens
attttaaaatctgatt

SEQ ID NO: 5280763 - DNA, 23 bp, Homo sapiens
attttaaaatctgatttaatgtt

SEQ ID NO: 5280764 - DNA, 14 bp, Homo sapiens
attttaaaatgaat

SEQ ID NO: 5280765 - DNA, 19 bp, Homo sapiens
attttaaaatgcaaatatt

SEQ ID NO: 5280766 - DNA, 15 bp, Homo sapiens
attttaaaatgtaca

SEQ ID NO: 5280767 - DNA, 15 bp, Homo sapiens
attttaaaatgtctt

SEQ ID NO: 5280768 - DNA, 15 bp, Homo sapiens
attttaaaattcatg

SEQ ID NO: 5280769 - DNA, 16 bp, Homo sapiens
attttaaaatttcata

SEQ ID NO: 5280770 - DNA, 15 bp, Homo sapiens
attttaaaatttgtt

SEQ ID NO: 5280771 - DNA, 17 bp, Homo sapiens
attttaaaatttgttct

SEQ ID NO: 5280772 - DNA, 17 bp, Homo sapiens
attttaaaattttatct

SEQ ID NO: 5280773 - DNA, 21 bp, Homo sapiens
attttaaacaaaatagaaagt

SEQ ID NO: 5280774 - DNA, 15 bp, Homo sapiens
attttaaacaaaatt

SEQ ID NO: 5280775 - DNA, 19 bp, Homo sapiens
attttaaacaaaatttatg

SEQ ID NO: 5280776 - DNA, 22 bp, Homo sapiens
attttaaacaaaggttgagatg

SEQ ID NO: 5280777 - DNA, 13 bp, Homo sapiens
attttaaacacat

SEQ ID NO: 5280778 - DNA, 13 bp, Homo sapiens
attttaaacattt

SEQ ID NO: 5280779 - DNA, 20 bp, Homo sapiens
attttaaaccataaaaagct

SEQ ID NO: 5280780 - DNA, 13 bp, Homo sapiens
attttaaacgctt

SEQ ID NO: 5280781 - DNA, 17 bp, Homo sapiens
attttaaactagatgac

SEQ ID NO: 5280782 - DNA, 18 bp, Homo sapiens
attttaaactagatgacc

SEQ ID NO: 5280783 - DNA, 17 bp, Homo sapiens
attttaaagaacagtga

SEQ ID NO: 5280784 - DNA, 13 bp, Homo sapiens
attttaaagaatt

SEQ ID NO: 5280785 - DNA, 14 bp, Homo sapiens
attttaaagacatg

SEQ ID NO: 5280786 - DNA, 18 bp, Homo sapiens
attttaaagacccaactt

SEQ ID NO: 5280787 - DNA, 14 bp, Homo sapiens
attttaaaggcaga

SEQ ID NO: 5280788 - DNA, 13 bp, Homo sapiens
attttaaagtaaa

SEQ ID NO: 5280789 - DNA, 14 bp, Homo sapiens
attttaaagtaatt

SEQ ID NO: 5280790 - DNA, 12 bp, Homo sapiens
attttaaagtta

SEQ ID NO: 5280791 - DNA, 11 bp, Homo sapiens
attttaaataa

SEQ ID NO: 5280792 - DNA, 14 bp, Homo sapiens
attttaaataaaag

SEQ ID NO: 5280793 - DNA, 19 bp, Homo sapiens
attttaaataacctctggc

SEQ ID NO: 5280794 - DNA, 15 bp, Homo sapiens
attttaaataagatg

SEQ ID NO: 5280795 - DNA, 17 bp, Homo sapiens
attttaaataatttcta

SEQ ID NO: 5280796 - DNA, 21 bp, Homo sapiens
attttaaatatccatttatct

SEQ ID NO: 5280797 - DNA, 16 bp, Homo sapiens
attttaaatatttgtt

SEQ ID NO: 5280798 - DNA, 18 bp, Homo sapiens
attttaaatatttgttct

SEQ ID NO: 5280799 - DNA, 19 bp, Homo sapiens
attttaaatctaaatctat

SEQ ID NO: 5280800 - DNA, 22 bp, Homo sapiens
attttaaatctgaaggttctgg

SEQ ID NO: 5280801 - DNA, 13 bp, Homo sapiens
attttaaatgaaa

SEQ ID NO: 5280802 - DNA, 13 bp, Homo sapiens
attttaaatgatc

SEQ ID NO: 5280803 - DNA, 14 bp, Homo sapiens
attttaaatgctgt

SEQ ID NO: 5280804 - DNA, 15 bp, Homo sapiens
attttaaatggacag

SEQ ID NO: 5280805 - DNA, 16 bp, Homo sapiens
attttaaatggacaga

SEQ ID NO: 5280806 - DNA, 12 bp, Homo sapiens
attttaaatgtc

SEQ ID NO: 5280807 - DNA, 20 bp, Homo sapiens
attttaaatgtctataaatg

SEQ ID NO: 5280808 - DNA, 11 bp, Homo sapiens
attttaaatta

SEQ ID NO: 5280809 - DNA, 18 bp, Homo sapiens
attttaaattaaagcaaa

SEQ ID NO: 5280810 - DNA, 18 bp, Homo sapiens
attttaaattacacagtt

SEQ ID NO: 5280811 - DNA, 14 bp, Homo sapiens
attttaaattataa

SEQ ID NO: 5280812 - DNA, 20 bp, Homo sapiens
attttaaattataaggactg

SEQ ID NO: 5280813 - DNA, 23 bp, Homo sapiens
attttaaattataaggactgcat

SEQ ID NO: 5280814 - DNA, 16 bp, Homo sapiens
attttaaattcacaat

SEQ ID NO: 5280815 - DNA, 19 bp, Homo sapiens
attttaaattccactgaaa

SEQ ID NO: 5280816 - DNA, 21 bp, Homo sapiens
attttaaattccactgaaaat

SEQ ID NO: 5280817 - DNA, 14 bp, Homo sapiens
attttaaattctca

SEQ ID NO: 5280818 - DNA, 22 bp, Homo sapiens
attttaaatttcttttattaat

SEQ ID NO: 5280819 - DNA, 16 bp, Homo sapiens
attttaaattttatgt

SEQ ID NO: 5280820 - DNA, 22 bp, Homo sapiens
attttaacaagaagatgaatgg

SEQ ID NO: 5280821 - DNA, 17 bp, Homo sapiens
attttaacacacataaa

SEQ ID NO: 5280822 - DNA, 22 bp, Homo sapiens
attttaacacacataaaggata

SEQ ID NO: 5280823 - DNA, 16 bp, Homo sapiens
attttaacagacatgt

SEQ ID NO: 5280824 - DNA, 22 bp, Homo sapiens
attttaacagttttacttctgg

SEQ ID NO: 5280825 - DNA, 13 bp, Homo sapiens
attttaacatgat

SEQ ID NO: 5280826 - DNA, 16 bp, Homo sapiens
attttaaccagttatt

SEQ ID NO: 5280827 - DNA, 23 bp, Homo sapiens
attttaaccagttatttttatta

SEQ ID NO: 5280828 - DNA, 17 bp, Homo sapiens
attttaacctagatgtt

SEQ ID NO: 5280829 - DNA, 20 bp, Homo sapiens
attttaacctagatgtttaa

SEQ ID NO: 5280830 - DNA, 16 bp, Homo sapiens
attttaactactttac

SEQ ID NO: 5280831 - DNA, 13 bp, Homo sapiens
attttaactctgt

SEQ ID NO: 5280832 - DNA, 15 bp, Homo sapiens
attttaactctgtct

SEQ ID NO: 5280833 - DNA, 16 bp, Homo sapiens
attttaactggcatgt

SEQ ID NO: 5280834 - DNA, 11 bp, Homo sapiens
attttaacttg

SEQ ID NO: 5280835 - DNA, 14 bp, Homo sapiens
attttaacttttgg

SEQ ID NO: 5280836 - DNA, 17 bp, Homo sapiens
attttaagaaagagaat

SEQ ID NO: 5280837 - DNA, 20 bp, Homo sapiens
attttaagaaagagaatgaa

SEQ ID NO: 5280838 - DNA, 21 bp, Homo sapiens
attttaagaaagagaatgaac

SEQ ID NO: 5280839 - DNA, 19 bp, Homo sapiens
attttaagaagaaagattt

SEQ ID NO: 5280840 - DNA, 18 bp, Homo sapiens
attttaagaagacatact

SEQ ID NO: 5280841 - DNA, 17 bp, Homo sapiens
attttaagaagacatga

SEQ ID NO: 5280842 - DNA, 19 bp, Homo sapiens
attttaagaagacatgaca

SEQ ID NO: 5280843 - DNA, 21 bp, Homo sapiens
attttaagacgtgtttgtgtt

SEQ ID NO: 5280844 - DNA, 16 bp, Homo sapiens
attttaagaggctttg

SEQ ID NO: 5280845 - DNA, 19 bp, Homo sapiens
attttaagatccagaaata

SEQ ID NO: 5280846 - DNA, 17 bp, Homo sapiens
attttaagattcctttt

SEQ ID NO: 5280847 - DNA, 22 bp, Homo sapiens
attttaagattccttttcttgt

SEQ ID NO: 5280848 - DNA, 14 bp, Homo sapiens
attttaagcactct

SEQ ID NO: 5280849 - DNA, 14 bp, Homo sapiens
attttaagcataat

SEQ ID NO: 5280850 - DNA, 15 bp, Homo sapiens
attttaagcattact

SEQ ID NO: 5280851 - DNA, 14 bp, Homo sapiens
attttaagcattgt

SEQ ID NO: 5280852 - DNA, 17 bp, Homo sapiens
attttaagcattgtgag

SEQ ID NO: 5280853 - DNA, 19 bp, Homo sapiens
attttaagcattgtgagta

SEQ ID NO: 5280854 - DNA, 22 bp, Homo sapiens
attttaagccatctcagattct

SEQ ID NO: 5280855 - DNA, 23 bp, Homo sapiens
attttaagccatctcagattctg

SEQ ID NO: 5280856 - DNA, 23 bp, Homo sapiens
attttaagccctatcactgacac

SEQ ID NO: 5280857 - DNA, 16 bp, Homo sapiens
attttaagcctttgtt

SEQ ID NO: 5280858 - DNA, 19 bp, Homo sapiens
attttaagcctttgttgaa

SEQ ID NO: 5280859 - DNA, 23 bp, Homo sapiens
attttaagcctttgttgaactgt

SEQ ID NO: 5280860 - DNA, 17 bp, Homo sapiens
attttaagctaggaaaa

SEQ ID NO: 5280861 - DNA, 22 bp, Homo sapiens
attttaaggttctcagacctcc

SEQ ID NO: 5280862 - DNA, 15 bp, Homo sapiens
attttaagtaggaaa

SEQ ID NO: 5280863 - DNA, 14 bp, Homo sapiens
attttaagtattgc

SEQ ID NO: 5280864 - DNA, 19 bp, Homo sapiens
attttaagtattgcatctg

SEQ ID NO: 5280865 - DNA, 22 bp, Homo sapiens
attttaagtattgcatctgtat

SEQ ID NO: 5280866 - DNA, 22 bp, Homo sapiens
attttaagtccctgtcacctct

SEQ ID NO: 5280867 - DNA, 18 bp, Homo sapiens
attttaagtgatgtcatt

SEQ ID NO: 5280868 - DNA, 18 bp, Homo sapiens
attttaagtgctttgtaa

SEQ ID NO: 5280869 - DNA, 20 bp, Homo sapiens
attttaagtgctttgtaatg

SEQ ID NO: 5280870 - DNA, 22 bp, Homo sapiens
attttaagtggggttgataaca

SEQ ID NO: 5280871 - DNA, 20 bp, Homo sapiens
attttaagtgtttaaaagca

SEQ ID NO: 5280872 - DNA, 20 bp, Homo sapiens
attttaataaagattctatt

SEQ ID NO: 5280873 - DNA, 13 bp, Homo sapiens
attttaataaagt

SEQ ID NO: 5280874 - DNA, 19 bp, Homo sapiens
attttaataacatatctaa

SEQ ID NO: 5280875 - DNA, 12 bp, Homo sapiens
attttaataatg

SEQ ID NO: 5280876 - DNA, 14 bp, Homo sapiens
attttaataatgtt

SEQ ID NO: 5280877 - DNA, 15 bp, Homo sapiens
attttaataatgttt

SEQ ID NO: 5280878 - DNA, 19 bp, Homo sapiens
attttaataatgtttcaaa

SEQ ID NO: 5280879 - DNA, 12 bp, Homo sapiens
attttaatacat

SEQ ID NO: 5280880 - DNA, 22 bp, Homo sapiens
attttaatacctttaaatatca

SEQ ID NO: 5280881 - DNA, 15 bp, Homo sapiens
attttaatagcctgt

SEQ ID NO: 5280882 - DNA, 20 bp, Homo sapiens
attttaatagggaatatatc

SEQ ID NO: 5280883 - DNA, 14 bp, Homo sapiens
attttaatatataa

SEQ ID NO: 5280884 - DNA, 24 bp, Homo sapiens
attttaatatataatttaatgtaa

SEQ ID NO: 5280885 - DNA, 20 bp, Homo sapiens
attttaatattaacttttaa

SEQ ID NO: 5280886 - DNA, 17 bp, Homo sapiens
attttaatattaattcc

SEQ ID NO: 5280887 - DNA, 15 bp, Homo sapiens
attttaatattgatg

SEQ ID NO: 5280888 - DNA, 20 bp, Homo sapiens
attttaatattgatgtcagt

SEQ ID NO: 5280889 - DNA, 16 bp, Homo sapiens
attttaatcattattt

SEQ ID NO: 5280890 - DNA, 13 bp, Homo sapiens
attttaatcccct

SEQ ID NO: 5280891 - DNA, 15 bp, Homo sapiens
attttaatcccctgc

SEQ ID NO: 5280892 - DNA, 15 bp, Homo sapiens
attttaatccttcta

SEQ ID NO: 5280893 - DNA, 20 bp, Homo sapiens
attcactgttgaatgcctgt

SEQ ID NO: 5280894 - DNA, 15 bp, Homo sapiens
attcacttcactgtg

SEQ ID NO: 5280895 - DNA, 23 bp, Homo sapiens
attcacttcactgtgctgttgtt

SEQ ID NO: 5280896 - DNA, 15 bp, Homo sapiens
attcacttctgaatt

SEQ ID NO: 5280897 - DNA, 14 bp, Homo sapiens
attcacttctgcat

SEQ ID NO: 5280898 - DNA, 17 bp, Homo sapiens
attcacttgtgtttgta

SEQ ID NO: 5280899 - DNA, 18 bp, Homo sapiens
attcacttgtgtttgtat

SEQ ID NO: 5280900 - DNA, 20 bp, Homo sapiens
attcacttgtgtttgtatat

SEQ ID NO: 5280901 - DNA, 22 bp, Homo sapiens
attcactttagagtgactaaaa

SEQ ID NO: 5280902 - DNA, 20 bp, Homo sapiens
attcactttattgtagaaaa

SEQ ID NO: 5280903 - DNA, 18 bp, Homo sapiens
attcactttcatttttga

SEQ ID NO: 5280904 - DNA, 20 bp, Homo sapiens
attcactttgacacttttca

SEQ ID NO: 5280905 - DNA, 14 bp, Homo sapiens
attcacttttattg

SEQ ID NO: 5280906 - DNA, 17 bp, Homo sapiens
attcacttttattgtat

SEQ ID NO: 5280907 - DNA, 13 bp, Homo sapiens
attcacttttgtt

SEQ ID NO: 5280908 - DNA, 19 bp, Homo sapiens
attcagaaaatgttctgtt

SEQ ID NO: 5280909 - DNA, 13 bp, Homo sapiens
attcagaaagctt

SEQ ID NO: 5280910 - DNA, 13 bp, Homo sapiens
attcagaaatgtt

SEQ ID NO: 5280911 - DNA, 18 bp, Homo sapiens
attcagaacataaatgca

SEQ ID NO: 5280912 - DNA, 18 bp, Homo sapiens
attcagaacatcctccaa

SEQ ID NO: 5280913 - DNA, 22 bp, Homo sapiens
attcagaactaaatttttcata

SEQ ID NO: 5280914 - DNA, 15 bp, Homo sapiens
attcagaactctcag

SEQ ID NO: 5280915 - DNA, 16 bp, Homo sapiens
attcagaactctcaga

SEQ ID NO: 5280916 - DNA, 20 bp, Homo sapiens
attcagaacttgtaactaaa

SEQ ID NO: 5280917 - DNA, 20 bp, Homo sapiens
attcagaactttagtattaa

SEQ ID NO: 5280918 - DNA, 16 bp, Homo sapiens
attcagaagaaaaaga

SEQ ID NO: 5280919 - DNA, 18 bp, Homo sapiens
attcagaagcttctgaaa

SEQ ID NO: 5280920 - DNA, 15 bp, Homo sapiens
attcagaaggggagg

SEQ ID NO: 5280921 - DNA, 18 bp, Homo sapiens
attcagaatatcatcttt

SEQ ID NO: 5280922 - DNA, 16 bp, Homo sapiens
attcagaatgagaatg

SEQ ID NO: 5280923 - DNA, 23 bp, Homo sapiens
attcagaatgtgcaaagcagtat

SEQ ID NO: 5280924 - DNA, 23 bp, Homo sapiens
attcagaattatacagacctaat

SEQ ID NO: 5280925 - DNA, 13 bp, Homo sapiens
attcagacaaaat

SEQ ID NO: 5280926 - DNA, 15 bp, Homo sapiens
attcagacaaaatgg

SEQ ID NO: 5280927 - DNA, 23 bp, Homo sapiens
attcagacaaaatggatacataa

SEQ ID NO: 5280928 - DNA, 20 bp, Homo sapiens
attcagacagatgaggcttt

SEQ ID NO: 5280929 - DNA, 12 bp, Homo sapiens
attcagacagct

SEQ ID NO: 5280930 - DNA, 14 bp, Homo sapiens
attcagacagctgc

SEQ ID NO: 5280931 - DNA, 15 bp, Homo sapiens
attcagacagctgcc

SEQ ID NO: 5280932 - DNA, 17 bp, Homo sapiens
attcagacagctgcctg

SEQ ID NO: 5280933 - DNA, 14 bp, Homo sapiens
attcagacaggcaa

SEQ ID NO: 5280934 - DNA, 14 bp, Homo sapiens
attcagagaatatc

SEQ ID NO: 5280935 - DNA, 16 bp, Homo sapiens
attcagagaatatcaa

SEQ ID NO: 5280936 - DNA, 20 bp, Homo sapiens
attcagagatgtaccatgtt

SEQ ID NO: 5280937 - DNA, 12 bp, Homo sapiens
attcagaggcag

SEQ ID NO: 5280938 - DNA, 13 bp, Homo sapiens
attcagaggcagt

SEQ ID NO: 5280939 - DNA, 19 bp, Homo sapiens
attcagagtatgtttttaa

SEQ ID NO: 5280940 - DNA, 21 bp, Homo sapiens
attcagataaggcagaactag

SEQ ID NO: 5280941 - DNA, 21 bp, Homo sapiens
attcagatataagatttgtac

SEQ ID NO: 5280942 - DNA, 18 bp, Homo sapiens
attcagatatgattcaaa

SEQ ID NO: 5280943 - DNA, 20 bp, Homo sapiens
attcagatatgattcaaatg

SEQ ID NO: 5280944 - DNA, 13 bp, Homo sapiens
attcagatcgaaa

SEQ ID NO: 5280945 - DNA, 22 bp, Homo sapiens
attcagatcgtattaattatct

SEQ ID NO: 5280946 - DNA, 16 bp, Homo sapiens
attcagatctgaagta

SEQ ID NO: 5280947 - DNA, 14 bp, Homo sapiens
attcagatgtatgt

SEQ ID NO: 5280948 - DNA, 14 bp, Homo sapiens
attcagatttctct

SEQ ID NO: 5280949 - DNA, 14 bp, Homo sapiens
attcagattttaaa

SEQ ID NO: 5280950 - DNA, 20 bp, Homo sapiens
attcagcaaggcgctaactt

SEQ ID NO: 5280951 - DNA, 18 bp, Homo sapiens
attcagcaccctgggtgc

SEQ ID NO: 5280952 - DNA, 18 bp, Homo sapiens
attcagcagcaaattttc

SEQ ID NO: 5280953 - DNA, 20 bp, Homo sapiens
attcagcagcaaattttcag

SEQ ID NO: 5280954 - DNA, 13 bp, Homo sapiens
attcagcagtttt

SEQ ID NO: 5280955 - DNA, 17 bp, Homo sapiens
attcagcagttttatcc

SEQ ID NO: 5280956 - DNA, 15 bp, Homo sapiens
attcagcatcactaa

SEQ ID NO: 5280957 - DNA, 19 bp, Homo sapiens
attcagcattagtgggaaa

SEQ ID NO: 5280958 - DNA, 11 bp, Homo sapiens
attcagcattt

SEQ ID NO: 5280959 - DNA, 19 bp, Homo sapiens
attcagcatttgatttcca

SEQ ID NO: 5280960 - DNA, 17 bp, Homo sapiens
attcagccaacatgtga

SEQ ID NO: 5280961 - DNA, 17 bp, Homo sapiens
attcagccagcttaaac

SEQ ID NO: 5280962 - DNA, 16 bp, Homo sapiens
attcagccttcaatca

SEQ ID NO: 5280963 - DNA, 21 bp, Homo sapiens
attcagccttctttttctgga

SEQ ID NO: 5280964 - DNA, 15 bp, Homo sapiens
attcagccttgctga

SEQ ID NO: 5280965 - DNA, 17 bp, Homo sapiens
attcagccttgctgacc

SEQ ID NO: 5280966 - DNA, 22 bp, Homo sapiens
attcagctagaactttgaagga

SEQ ID NO: 5280967 - DNA, 17 bp, Homo sapiens
attcagctagaatttct

SEQ ID NO: 5280968 - DNA, 14 bp, Homo sapiens
attcagctcatgga

SEQ ID NO: 5280969 - DNA, 19 bp, Homo sapiens
attcagctcattatgaaaa

SEQ ID NO: 5280970 - DNA, 11 bp, Homo sapiens
attcagctcct

SEQ ID NO: 5280971 - DNA, 12 bp, Homo sapiens
attcagctcctt

SEQ ID NO: 5280972 - DNA, 23 bp, Homo sapiens
attcagctctgatctgaggctaa

SEQ ID NO: 5280973 - DNA, 16 bp, Homo sapiens
attcagctctggagaa

SEQ ID NO: 5280974 - DNA, 17 bp, Homo sapiens
attcagctctggagaac

SEQ ID NO: 5280975 - DNA, 17 bp, Homo sapiens
attcagctgaggttcat

SEQ ID NO: 5280976 - DNA, 21 bp, Homo sapiens
attcagctgaggttcattaca

SEQ ID NO: 5280977 - DNA, 12 bp, Homo sapiens
attcagctgccc

SEQ ID NO: 5280978 - DNA, 14 bp, Homo sapiens
attcagctttgtcc

SEQ ID NO: 5280979 - DNA, 14 bp, Homo sapiens
attcaggaaaaatg

SEQ ID NO: 5280980 - DNA, 22 bp, Homo sapiens
attcaggaaaactgacagagga

SEQ ID NO: 5280981 - DNA, 19 bp, Homo sapiens
attcaggaaaagcctctgt

SEQ ID NO: 5280982 - DNA, 17 bp, Homo sapiens
attcaggaaaaggcctg

SEQ ID NO: 5280983 - DNA, 18 bp, Homo sapiens
attcaggaaaaggcctgg

SEQ ID NO: 5280984 - DNA, 19 bp, Homo sapiens
attcaggaaaaggcctggg

SEQ ID NO: 5280985 - DNA, 15 bp, Homo sapiens
attcaggaaatgttc

SEQ ID NO: 5280986 - DNA, 16 bp, Homo sapiens
attcaggaaatgttca

SEQ ID NO: 5280987 - DNA, 18 bp, Homo sapiens
attcaggaacctggacca

SEQ ID NO: 5280988 - DNA, 16 bp, Homo sapiens
attcaggaagataaaa

SEQ ID NO: 5280989 - DNA, 20 bp, Homo sapiens
attcaggaagctcagggcct

SEQ ID NO: 5280990 - DNA, 23 bp, Homo sapiens
attcaggaagctcagggcctggc

SEQ ID NO: 5280991 - DNA, 15 bp, Homo sapiens
attcaggaccccatc

SEQ ID NO: 5280992 - DNA, 20 bp, Homo sapiens
attcaggaccccatctgctg

SEQ ID NO: 5280993 - DNA, 10 bp, Homo sapiens
attcaggacg

SEQ ID NO: 5280994 - DNA, 17 bp, Homo sapiens
attcaggactggctcac

SEQ ID NO: 5280995 - DNA, 19 bp, Homo sapiens
attcaggactggctcaccc

SEQ ID NO: 5280996 - DNA, 18 bp, Homo sapiens
attcaggacttgaaagaa

SEQ ID NO: 5280997 - DNA, 21 bp, Homo sapiens
attcaggagagtagaacagat

SEQ ID NO: 5280998 - DNA, 13 bp, Homo sapiens
attcaggcactga

SEQ ID NO: 5280999 - DNA, 17 bp, Homo sapiens
attcaggcactgagaat

SEQ ID NO: 5281000 - DNA, 14 bp, Homo sapiens
attcaggccagccc

SEQ ID NO: 5281001 - DNA, 16 bp, Homo sapiens
attcaggccagcccag

SEQ ID NO: 5281002 - DNA, 15 bp, Homo sapiens
attcaggcctctgag

SEQ ID NO: 5281003 - DNA, 16 bp, Homo sapiens
attcaggcctctgagg

SEQ ID NO: 5281004 - DNA, 22 bp, Homo sapiens
attcaggctactgcttcaatct

SEQ ID NO: 5281005 - DNA, 19 bp, Homo sapiens
attcaggcttgcattaaaa

SEQ ID NO: 5281006 - DNA, 20 bp, Homo sapiens
attcaggcttgcattaaaag

SEQ ID NO: 5281007 - DNA, 20 bp, Homo sapiens
attcagggaaagtgggacag

SEQ ID NO: 5281008 - DNA, 20 bp, Homo sapiens
attcagggaaggaggagcct

SEQ ID NO: 5281009 - DNA, 23 bp, Homo sapiens
attcagggagaatgttgttgtct

SEQ ID NO: 5281010 - DNA, 19 bp, Homo sapiens
attcagggctttaaacatg

SEQ ID NO: 5281011 - DNA, 14 bp, Homo sapiens
attcaggggaaggg

SEQ ID NO: 5281012 - DNA, 20 bp, Homo sapiens
attcaggggctgacacttca

SEQ ID NO: 5281013 - DNA, 15 bp, Homo sapiens
attcaggggctgggg

SEQ ID NO: 5281014 - DNA, 20 bp, Homo sapiens
attcaggggctttgggccca

SEQ ID NO: 5281015 - DNA, 22 bp, Homo sapiens
attcaggggctttgggcccaag

SEQ ID NO: 5281016 - DNA, 20 bp, Homo sapiens
attcaggtatgttgccttta

SEQ ID NO: 5281017 - DNA, 19 bp, Homo sapiens
attcaggtcccagttgctg

SEQ ID NO: 5281018 - DNA, 18 bp, Homo sapiens
attcaggtgaaaatgttc

SEQ ID NO: 5281019 - DNA, 16 bp, Homo sapiens
attcaggtggccagaa

SEQ ID NO: 5281020 - DNA, 23 bp, Homo sapiens
attcaggtttttcctttttttgt

SEQ ID NO: 5281021 - DNA, 12 bp, Homo sapiens
attcagtaaaca

SEQ ID NO: 5281022 - DNA, 18 bp, Homo sapiens
attcagtaactgtcaggc

SEQ ID NO: 5281023 - DNA, 15 bp, Homo sapiens
attcagtactttatg

SEQ ID NO: 5281024 - DNA, 21 bp, Homo sapiens
attcagtagcattttaatagt

SEQ ID NO: 5281025 - DNA, 13 bp, Homo sapiens
attcagtagtttg

SEQ ID NO: 5281026 - DNA, 15 bp, Homo sapiens
attcagtagtttgag

SEQ ID NO: 5281027 - DNA, 13 bp, Homo sapiens
attcagtatgttt

SEQ ID NO: 5281028 - DNA, 19 bp, Homo sapiens
attcagtattaaagggggg

SEQ ID NO: 5281029 - DNA, 21 bp, Homo sapiens
attcagtctctgaatacacag

SEQ ID NO: 5281030 - DNA, 23 bp, Homo sapiens
attcagtctctgaatacacagta

SEQ ID NO: 5281031 - DNA, 15 bp, Homo sapiens
attcagtcttgcctt

SEQ ID NO: 5281032 - DNA, 14 bp, Homo sapiens
attcagtgaatttg

SEQ ID NO: 5281033 - DNA, 22 bp, Homo sapiens
attcagtgacaaaatgggagga

SEQ ID NO: 5281034 - DNA, 16 bp, Homo sapiens
attcagtgacatgtcc

SEQ ID NO: 5281035 - DNA, 14 bp, Homo sapiens
attcagtgacttct

SEQ ID NO: 5281036 - DNA, 16 bp, Homo sapiens
attcagtgagggtctt

SEQ ID NO: 5281037 - DNA, 20 bp, Homo sapiens
attcagtgcagcatatacaa

SEQ ID NO: 5281038 - DNA, 17 bp, Homo sapiens
attcagtgctgtggcct

SEQ ID NO: 5281039 - DNA, 21 bp, Homo sapiens
attcagtgctgtggcctgggc

SEQ ID NO: 5281040 - DNA, 14 bp, Homo sapiens
attcagtgcttctt

SEQ ID NO: 5281041 - DNA, 17 bp, Homo sapiens
attcagtgcttcttaaa

SEQ ID NO: 5281042 - DNA, 18 bp, Homo sapiens
attcagtggaggctggca

SEQ ID NO: 5281043 - DNA, 20 bp, Homo sapiens
attcagtgggttcagaacca

SEQ ID NO: 5281044 - DNA, 16 bp, Homo sapiens
attcagtggtcttatt

SEQ ID NO: 5281045 - DNA, 14 bp, Homo sapiens
attcagtgtcactg

SEQ ID NO: 5281046 - DNA, 18 bp, Homo sapiens
attcagttaagaaaaaaa

SEQ ID NO: 5281047 - DNA, 22 bp, Homo sapiens
attcagttagcagacagaagtg

SEQ ID NO: 5281048 - DNA, 16 bp, Homo sapiens
attcagttccaatact

SEQ ID NO: 5281049 - DNA, 18 bp, Homo sapiens
attcagttccaatacttc

SEQ ID NO: 5281050 - DNA, 22 bp, Homo sapiens
attcagttcccaccatctgatt

SEQ ID NO: 5281051 - DNA, 17 bp, Homo sapiens
attcagttcccagaatc

SEQ ID NO: 5281052 - DNA, 14 bp, Homo sapiens
attcagttctaggc

SEQ ID NO: 5281053 - DNA, 21 bp, Homo sapiens
attcagttgctttgcccaaga

SEQ ID NO: 5281054 - DNA, 20 bp, Homo sapiens
attcagttggtaagcttcca

SEQ ID NO: 5281055 - DNA, 23 bp, Homo sapiens
attcagtttaagagttttccttg

SEQ ID NO: 5281056 - DNA, 14 bp, Homo sapiens
attcagtttcactt

SEQ ID NO: 5281057 - DNA, 14 bp, Homo sapiens
attcagtttcataa

SEQ ID NO: 5281058 - DNA, 13 bp, Homo sapiens
attcagtttctaa

SEQ ID NO: 5281059 - DNA, 20 bp, Homo sapiens
attcagttttagtttcaaaa

SEQ ID NO: 5281060 - DNA, 21 bp, Homo sapiens
attcagttttagtttcaaaat

SEQ ID NO: 5281061 - DNA, 13 bp, Homo sapiens
attcagttttcat

SEQ ID NO: 5281062 - DNA, 13 bp, Homo sapiens
attcagttttttt

SEQ ID NO: 5281063 - DNA, 14 bp, Homo sapiens
attcataaaaataa

SEQ ID NO: 5281064 - DNA, 17 bp, Homo sapiens
attcataactaatgaat

SEQ ID NO: 5281065 - DNA, 21 bp, Homo sapiens
attcataagccaatttttctg

SEQ ID NO: 5281066 - DNA, 15 bp, Homo sapiens
attcataataaacta

SEQ ID NO: 5281067 - DNA, 17 bp, Homo sapiens
attcataataaattttc

SEQ ID NO: 5281068 - DNA, 15 bp, Homo sapiens
attcataatgaatta

SEQ ID NO: 5281069 - DNA, 18 bp, Homo sapiens
attcataatgaattataa

SEQ ID NO: 5281070 - DNA, 19 bp, Homo sapiens
attcataatgacttaagca

SEQ ID NO: 5281071 - DNA, 19 bp, Homo sapiens
attcataattaaaatttat

SEQ ID NO: 5281072 - DNA, 13 bp, Homo sapiens
attttaatgaaat

SEQ ID NO: 5281073 - DNA, 19 bp, Homo sapiens
attttaatgaaatcaaatg

SEQ ID NO: 5281074 - DNA, 23 bp, Homo sapiens
attttaatgaagaaagtggaaaa

SEQ ID NO: 5281075 - DNA, 14 bp, Homo sapiens
attttaatgataaa

SEQ ID NO: 5281076 - DNA, 18 bp, Homo sapiens
attttaatgataaaatag

SEQ ID NO: 5281077 - DNA, 21 bp, Homo sapiens
attttaatgataaaatagcca

SEQ ID NO: 5281078 - DNA, 21 bp, Homo sapiens
attttaatgatggtgttaaag

SEQ ID NO: 5281079 - DNA, 23 bp, Homo sapiens
attttaatgctgtttctaagaaa

SEQ ID NO: 5281080 - DNA, 23 bp, Homo sapiens
attttaatggattgttaatttca

SEQ ID NO: 5281081 - DNA, 20 bp, Homo sapiens
attttaatgggtttcccttg

SEQ ID NO: 5281082 - DNA, 22 bp, Homo sapiens
attttaatggtatgtacaagtt

SEQ ID NO: 5281083 - DNA, 21 bp, Homo sapiens
attttaatgtatatttgctgc

SEQ ID NO: 5281084 - DNA, 14 bp, Homo sapiens
attttaatgtgaag

SEQ ID NO: 5281085 - DNA, 21 bp, Homo sapiens
attttaatgtgaagacatttt

SEQ ID NO: 5281086 - DNA, 13 bp, Homo sapiens
attttaatgtgat

SEQ ID NO: 5281087 - DNA, 14 bp, Homo sapiens
attttaatgtgatg

SEQ ID NO: 5281088 - DNA, 22 bp, Homo sapiens
attttaatgtgatgatgtaatt

SEQ ID NO: 5281089 - DNA, 19 bp, Homo sapiens
attttaatgttaactttca

SEQ ID NO: 5281090 - DNA, 23 bp, Homo sapiens
attttaattaggttaactatgta

SEQ ID NO: 5281091 - DNA, 14 bp, Homo sapiens
attttaattcaaga

SEQ ID NO: 5281092 - DNA, 15 bp, Homo sapiens
attttaattcaggtg

SEQ ID NO: 5281093 - DNA, 12 bp, Homo sapiens
attttaattctc

SEQ ID NO: 5281094 - DNA, 14 bp, Homo sapiens
attttaattctctc

SEQ ID NO: 5281095 - DNA, 13 bp, Homo sapiens
attttaattgtca

SEQ ID NO: 5281096 - DNA, 16 bp, Homo sapiens
attttaatttatttgt

SEQ ID NO: 5281097 - DNA, 18 bp, Homo sapiens
attttaatttcaggaaaa

SEQ ID NO: 5281098 - DNA, 17 bp, Homo sapiens
attttaatttgtattga

SEQ ID NO: 5281099 - DNA, 18 bp, Homo sapiens
attttaatttgtattgaa

SEQ ID NO: 5281100 - DNA, 19 bp, Homo sapiens
attttaattttatattcag

SEQ ID NO: 5281101 - DNA, 18 bp, Homo sapiens
attttaatttttaaatgc

SEQ ID NO: 5281102 - DNA, 19 bp, Homo sapiens
attttaatttttaaatgca

SEQ ID NO: 5281103 - DNA, 15 bp, Homo sapiens
attttacaaaagatg

SEQ ID NO: 5281104 - DNA, 16 bp, Homo sapiens
attttacaaatattaa

SEQ ID NO: 5281105 - DNA, 14 bp, Homo sapiens
attttacacaaatg

SEQ ID NO: 5281106 - DNA, 18 bp, Homo sapiens
attttacacagaaacact

SEQ ID NO: 5281107 - DNA, 17 bp, Homo sapiens
attttacacattgacaa

SEQ ID NO: 5281108 - DNA, 21 bp, Homo sapiens
attttacacgcttttgtgatg

SEQ ID NO: 5281109 - DNA, 12 bp, Homo sapiens
attttacagaga

SEQ ID NO: 5281110 - DNA, 14 bp, Homo sapiens
attttacagagaat

SEQ ID NO: 5281111 - DNA, 17 bp, Homo sapiens
attttacagattttatg

SEQ ID NO: 5281112 - DNA, 23 bp, Homo sapiens
attttacagtctctgttgtaaat

SEQ ID NO: 5281113 - DNA, 22 bp, Homo sapiens
attttacagtgaccttttcttc

SEQ ID NO: 5281114 - DNA, 22 bp, Homo sapiens
attttacagttaaggaatataa

SEQ ID NO: 5281115 - DNA, 17 bp, Homo sapiens
attttacataaatttag

SEQ ID NO: 5281116 - DNA, 17 bp, Homo sapiens
attttacatctgaacaa

SEQ ID NO: 5281117 - DNA, 23 bp, Homo sapiens
attttacatgaagctgtataatt

SEQ ID NO: 5281118 - DNA, 18 bp, Homo sapiens
attttacatgtctcatat

SEQ ID NO: 5281119 - DNA, 12 bp, Homo sapiens
attttacattaa

SEQ ID NO: 5281120 - DNA, 15 bp, Homo sapiens
attttacattaaatt

SEQ ID NO: 5281121 - DNA, 18 bp, Homo sapiens
attttacatttagagtat

SEQ ID NO: 5281122 - DNA, 17 bp, Homo sapiens
attttacatttatctgt

SEQ ID NO: 5281123 - DNA, 17 bp, Homo sapiens
attttaccaaagcatca

SEQ ID NO: 5281124 - DNA, 13 bp, Homo sapiens
attttaccaagtt

SEQ ID NO: 5281125 - DNA, 18 bp, Homo sapiens
attttaccaagttatata

SEQ ID NO: 5281126 - DNA, 19 bp, Homo sapiens
attttaccaagttatataa

SEQ ID NO: 5281127 - DNA, 19 bp, Homo sapiens
attttaccactaattttgt

SEQ ID NO: 5281128 - DNA, 21 bp, Homo sapiens
attttaccatcacacatgttc

SEQ ID NO: 5281129 - DNA, 18 bp, Homo sapiens
attttaccattttgcgat

SEQ ID NO: 5281130 - DNA, 23 bp, Homo sapiens
attttacccaaatactcaattta

SEQ ID NO: 5281131 - DNA, 22 bp, Homo sapiens
attttaccctgggtcacttgct

SEQ ID NO: 5281132 - DNA, 17 bp, Homo sapiens
attttacctagctaatt

SEQ ID NO: 5281133 - DNA, 22 bp, Homo sapiens
attttacctagctaattattta

SEQ ID NO: 5281134 - DNA, 16 bp, Homo sapiens
attttacctctctctg

SEQ ID NO: 5281135 - DNA, 18 bp, Homo sapiens
attttacctcttattgca

SEQ ID NO: 5281136 - DNA, 23 bp, Homo sapiens
attttactaaaatcgtattctaa

SEQ ID NO: 5281137 - DNA, 15 bp, Homo sapiens
attttactgacagaa

SEQ ID NO: 5281138 - DNA, 16 bp, Homo sapiens
attttactgacagaaa

SEQ ID NO: 5281139 - DNA, 22 bp, Homo sapiens
attttactgattaacaaataaa

SEQ ID NO: 5281140 - DNA, 15 bp, Homo sapiens
attttactgtcttaa

SEQ ID NO: 5281141 - DNA, 15 bp, Homo sapiens
attttactgtgaaaa

SEQ ID NO: 5281142 - DNA, 15 bp, Homo sapiens
attttactgttgtac

SEQ ID NO: 5281143 - DNA, 23 bp, Homo sapiens
attttactgttgtacaatcatgt

SEQ ID NO: 5281144 - DNA, 15 bp, Homo sapiens
attttacttccatta

SEQ ID NO: 5281145 - DNA, 13 bp, Homo sapiens
attttacttgaat

SEQ ID NO: 5281146 - DNA, 21 bp, Homo sapiens
attttactttaaaaggagcca

SEQ ID NO: 5281147 - DNA, 16 bp, Homo sapiens
attttactttaacagt

SEQ ID NO: 5281148 - DNA, 16 bp, Homo sapiens
attttactttttcctg

SEQ ID NO: 5281149 - DNA, 17 bp, Homo sapiens
attttactttttggaaa

SEQ ID NO: 5281150 - DNA, 11 bp, Homo sapiens
attttagaaaa

SEQ ID NO: 5281151 - DNA, 19 bp, Homo sapiens
attttagaaagaaaattat

SEQ ID NO: 5281152 - DNA, 17 bp, Homo sapiens
attttagaaagctaaat

SEQ ID NO: 5281153 - DNA, 20 bp, Homo sapiens
attttagaaataataaaaag

SEQ ID NO: 5281154 - DNA, 16 bp, Homo sapiens
attttagaataaattc

SEQ ID NO: 5281155 - DNA, 15 bp, Homo sapiens
attttagaatgtcaa

SEQ ID NO: 5281156 - DNA, 16 bp, Homo sapiens
attttagaatgtcaat

SEQ ID NO: 5281157 - DNA, 12 bp, Homo sapiens
attttagacaaa

SEQ ID NO: 5281158 - DNA, 21 bp, Homo sapiens
attttagacaaccatagaact

SEQ ID NO: 5281159 - DNA, 21 bp, Homo sapiens
attttagacgatcacagaaac

SEQ ID NO: 5281160 - DNA, 20 bp, Homo sapiens
attttagacttaccttgaac

SEQ ID NO: 5281161 - DNA, 15 bp, Homo sapiens
attttagagcatctc

SEQ ID NO: 5281162 - DNA, 23 bp, Homo sapiens
attttagagttcttttggatcat

SEQ ID NO: 5281163 - DNA, 14 bp, Homo sapiens
attttagatatatt

SEQ ID NO: 5281164 - DNA, 19 bp, Homo sapiens
attttagatatattctcta

SEQ ID NO: 5281165 - DNA, 14 bp, Homo sapiens
attttagatttctt

SEQ ID NO: 5281166 - DNA, 18 bp, Homo sapiens
attttagcccagtgtttt

SEQ ID NO: 5281167 - DNA, 16 bp, Homo sapiens
attttagcctcttccc

SEQ ID NO: 5281168 - DNA, 18 bp, Homo sapiens
attttagcgtgctcactg

SEQ ID NO: 5281169 - DNA, 14 bp, Homo sapiens
attttagctcatgt

SEQ ID NO: 5281170 - DNA, 23 bp, Homo sapiens
attttagctctattgatactctt

SEQ ID NO: 5281171 - DNA, 16 bp, Homo sapiens
attttagctggtgtca

SEQ ID NO: 5281172 - DNA, 15 bp, Homo sapiens
attttagcttcagtt

SEQ ID NO: 5281173 - DNA, 20 bp, Homo sapiens
attttagcttcagttgttct

SEQ ID NO: 5281174 - DNA, 21 bp, Homo sapiens
attttagcttcagttgttctt

SEQ ID NO: 5281175 - DNA, 13 bp, Homo sapiens
attttaggaaact

SEQ ID NO: 5281176 - DNA, 17 bp, Homo sapiens
attttaggaacttcaga

SEQ ID NO: 5281177 - DNA, 15 bp, Homo sapiens
attttaggaataata

SEQ ID NO: 5281178 - DNA, 16 bp, Homo sapiens
attttaggaataataa

SEQ ID NO: 5281179 - DNA, 19 bp, Homo sapiens
attttaggaataataaatt

SEQ ID NO: 5281180 - DNA, 17 bp, Homo sapiens
attttaggatctcgcct

SEQ ID NO: 5281181 - DNA, 21 bp, Homo sapiens
attttaggatctcgcctggaa

SEQ ID NO: 5281182 - DNA, 22 bp, Homo sapiens
attttaggcactcttaaatgat

SEQ ID NO: 5281183 - DNA, 22 bp, Homo sapiens
attttaggcactgttcaatact

SEQ ID NO: 5281184 - DNA, 21 bp, Homo sapiens
attttaggcagggatttgagg

SEQ ID NO: 5281185 - DNA, 14 bp, Homo sapiens
attttaggcctcct

SEQ ID NO: 5281186 - DNA, 23 bp, Homo sapiens
attttaggcctcctctctgccac

SEQ ID NO: 5281187 - DNA, 19 bp, Homo sapiens
attttaggggtagcatttg

SEQ ID NO: 5281188 - DNA, 19 bp, Homo sapiens
attttagggttctaaatgc

SEQ ID NO: 5281189 - DNA, 21 bp, Homo sapiens
attttagggttctaaatgcaa

SEQ ID NO: 5281190 - DNA, 21 bp, Homo sapiens
attttaggtgttgattttctg

SEQ ID NO: 5281191 - DNA, 23 bp, Homo sapiens
attttaggtgttgattttctgtt

SEQ ID NO: 5281192 - DNA, 17 bp, Homo sapiens
attttagtaatttccta

SEQ ID NO: 5281193 - DNA, 22 bp, Homo sapiens
attttagtatatttatataatt

SEQ ID NO: 5281194 - DNA, 17 bp, Homo sapiens
attttagtcaaatattt

SEQ ID NO: 5281195 - DNA, 19 bp, Homo sapiens
attttagtcactaagactt

SEQ ID NO: 5281196 - DNA, 15 bp, Homo sapiens
attttagtcactttt

SEQ ID NO: 5281197 - DNA, 14 bp, Homo sapiens
attttagtccaaat

SEQ ID NO: 5281198 - DNA, 16 bp, Homo sapiens
attttagtccaaataa

SEQ ID NO: 5281199 - DNA, 23 bp, Homo sapiens
attttagtgacagctctgcctgt

SEQ ID NO: 5281200 - DNA, 14 bp, Homo sapiens
attttagtgactgt

SEQ ID NO: 5281201 - DNA, 18 bp, Homo sapiens
attttagtgactgtaatt

SEQ ID NO: 5281202 - DNA, 21 bp, Homo sapiens
attttagtggaccctgaaatg

SEQ ID NO: 5281203 - DNA, 22 bp, Homo sapiens
attttagtggataaaatttgta

SEQ ID NO: 5281204 - DNA, 15 bp, Homo sapiens
attttagtgtatctt

SEQ ID NO: 5281205 - DNA, 22 bp, Homo sapiens
attttagtgtatctttaaaaaa

SEQ ID NO: 5281206 - DNA, 13 bp, Homo sapiens
attttagtgtatt

SEQ ID NO: 5281207 - DNA, 14 bp, Homo sapiens
attttagtgtgtaa

SEQ ID NO: 5281208 - DNA, 15 bp, Homo sapiens
attttagtgtgtaaa

SEQ ID NO: 5281209 - DNA, 18 bp, Homo sapiens
attttagtgtgtaaaatt

SEQ ID NO: 5281210 - DNA, 22 bp, Homo sapiens
attttagtgtgtaaaattaatg

SEQ ID NO: 5281211 - DNA, 12 bp, Homo sapiens
attttagtttct

SEQ ID NO: 5281212 - DNA, 15 bp, Homo sapiens
attttagtttctgtt

SEQ ID NO: 5281213 - DNA, 23 bp, Homo sapiens
attttagtttttcattaaataaa

SEQ ID NO: 5281214 - DNA, 13 bp, Homo sapiens
attttataaaatt

SEQ ID NO: 5281215 - DNA, 21 bp, Homo sapiens
attttataaaattaaagaaaa

SEQ ID NO: 5281216 - DNA, 22 bp, Homo sapiens
attttataaaattaaagaaaat

SEQ ID NO: 5281217 - DNA, 13 bp, Homo sapiens
attttataaacaa

SEQ ID NO: 5281218 - DNA, 21 bp, Homo sapiens
attttataaagtgcttgtgta

SEQ ID NO: 5281219 - DNA, 18 bp, Homo sapiens
attttataaatttaagca

SEQ ID NO: 5281220 - DNA, 21 bp, Homo sapiens
attttataacatgttaaaatg

SEQ ID NO: 5281221 - DNA, 13 bp, Homo sapiens
attttataagaaa

SEQ ID NO: 5281222 - DNA, 20 bp, Homo sapiens
attttataagaaaaactttt

SEQ ID NO: 5281223 - DNA, 19 bp, Homo sapiens
attttataagcaaatttca

SEQ ID NO: 5281224 - DNA, 13 bp, Homo sapiens
attttataagcac

SEQ ID NO: 5281225 - DNA, 18 bp, Homo sapiens
attttataaggacttcct

SEQ ID NO: 5281226 - DNA, 14 bp, Homo sapiens
attttataatcaat

SEQ ID NO: 5281227 - DNA, 13 bp, Homo sapiens
attttatacaatt

SEQ ID NO: 5281228 - DNA, 21 bp, Homo sapiens
attttatacatagtcacaaaa

SEQ ID NO: 5281229 - DNA, 23 bp, Homo sapiens
attttatacatagtcacaaaaat

SEQ ID NO: 5281230 - DNA, 18 bp, Homo sapiens
attttatacccttgactt

SEQ ID NO: 5281231 - DNA, 17 bp, Homo sapiens
attttatactgtacatg

SEQ ID NO: 5281232 - DNA, 18 bp, Homo sapiens
attttatactgtacatgc

SEQ ID NO: 5281233 - DNA, 15 bp, Homo sapiens
attttatagaaaatg

SEQ ID NO: 5281234 - DNA, 17 bp, Homo sapiens
attttatagctactaat

SEQ ID NO: 5281235 - DNA, 19 bp, Homo sapiens
attttatagctcagtttat

SEQ ID NO: 5281236 - DNA, 17 bp, Homo sapiens
attttataggaaaaaat

SEQ ID NO: 5281237 - DNA, 22 bp, Homo sapiens
attttataggcatacctcctat

SEQ ID NO: 5281238 - DNA, 21 bp, Homo sapiens
attttataggggatacttgaa

SEQ ID NO: 5281239 - DNA, 17 bp, Homo sapiens
attttatataaagaaaa

SEQ ID NO: 5281240 - DNA, 16 bp, Homo sapiens
attttatataaagtat

SEQ ID NO: 5281241 - DNA, 17 bp, Homo sapiens
attttatataataaagt

SEQ ID NO: 5281242 - DNA, 22 bp, Homo sapiens
attttatataataaagtattcc

SEQ ID NO: 5281243 - DNA, 11 bp, Homo sapiens
attttatatca

SEQ ID NO: 5281244 - DNA, 17 bp, Homo sapiens
attttatatcatacagt

SEQ ID NO: 5281245 - DNA, 21 bp, Homo sapiens
attttatatcatacagttttc

SEQ ID NO: 5281246 - DNA, 21 bp, Homo sapiens
attttatatcattttaaaatg

SEQ ID NO: 5281247 - DNA, 16 bp, Homo sapiens
attttatatctggatt

SEQ ID NO: 5281248 - DNA, 12 bp, Homo sapiens
attttatatctt

SEQ ID NO: 5281249 - DNA, 13 bp, Homo sapiens
attcataattaga

SEQ ID NO: 5281250 - DNA, 15 bp, Homo sapiens
attcataattagaac

SEQ ID NO: 5281251 - DNA, 21 bp, Homo sapiens
attcataattattatttggcc

SEQ ID NO: 5281252 - DNA, 14 bp, Homo sapiens
attcatacagcact

SEQ ID NO: 5281253 - DNA, 14 bp, Homo sapiens
attcatacctgttg

SEQ ID NO: 5281254 - DNA, 13 bp, Homo sapiens
attcatactaaat

SEQ ID NO: 5281255 - DNA, 15 bp, Homo sapiens
attcatactaaataa

SEQ ID NO: 5281256 - DNA, 13 bp, Homo sapiens
attcatactcaaa

SEQ ID NO: 5281257 - DNA, 17 bp, Homo sapiens
attcatactctgttgcc

SEQ ID NO: 5281258 - DNA, 22 bp, Homo sapiens
attcatactctgttgcctcctc

SEQ ID NO: 5281259 - DNA, 13 bp, Homo sapiens
attcatacttaaa

SEQ ID NO: 5281260 - DNA, 21 bp, Homo sapiens
attcatacttaaaaatttatt

SEQ ID NO: 5281261 - DNA, 15 bp, Homo sapiens
attcatactttccaa

SEQ ID NO: 5281262 - DNA, 14 bp, Homo sapiens
attcatagaataac

SEQ ID NO: 5281263 - DNA, 17 bp, Homo sapiens
attcatagcatcctgat

SEQ ID NO: 5281264 - DNA, 22 bp, Homo sapiens
attcatagggaaaggttttgta

SEQ ID NO: 5281265 - DNA, 23 bp, Homo sapiens
attcatagtgatagagtgcagtg

SEQ ID NO: 5281266 - DNA, 14 bp, Homo sapiens
attcatataaaagt

SEQ ID NO: 5281267 - DNA, 14 bp, Homo sapiens
attcatatattgca

SEQ ID NO: 5281268 - DNA, 15 bp, Homo sapiens
attcatatattgcat

SEQ ID NO: 5281269 - DNA, 17 bp, Homo sapiens
attcatatattgcattt

SEQ ID NO: 5281270 - DNA, 16 bp, Homo sapiens
attcatatcctccgcc

SEQ ID NO: 5281271 - DNA, 12 bp, Homo sapiens
attcatatctta

SEQ ID NO: 5281272 - DNA, 20 bp, Homo sapiens
attcatatcttaaaaattaa

SEQ ID NO: 5281273 - DNA, 14 bp, Homo sapiens
attcatattaagac

SEQ ID NO: 5281274 - DNA, 15 bp, Homo sapiens
attcatattaagaca

SEQ ID NO: 5281275 - DNA, 17 bp, Homo sapiens
attcatattaagacagt

SEQ ID NO: 5281276 - DNA, 19 bp, Homo sapiens
attcatattaagacagtgt

SEQ ID NO: 5281277 - DNA, 23 bp, Homo sapiens
attcatattaagacagtgtacaa

SEQ ID NO: 5281278 - DNA, 13 bp, Homo sapiens
attcatattacaa

SEQ ID NO: 5281279 - DNA, 15 bp, Homo sapiens
attcatattacaata

SEQ ID NO: 5281280 - DNA, 17 bp, Homo sapiens
attcatattacaatatt

SEQ ID NO: 5281281 - DNA, 19 bp, Homo sapiens
attcatattacaatatttg

SEQ ID NO: 5281282 - DNA, 19 bp, Homo sapiens
attcatattaccagaaaat

SEQ ID NO: 5281283 - DNA, 17 bp, Homo sapiens
attcatattgcatcata

SEQ ID NO: 5281284 - DNA, 18 bp, Homo sapiens
attcatatttaatttgaa

SEQ ID NO: 5281285 - DNA, 14 bp, Homo sapiens
attcatatttactt

SEQ ID NO: 5281286 - DNA, 19 bp, Homo sapiens
attcatatttacttcttat

SEQ ID NO: 5281287 - DNA, 18 bp, Homo sapiens
attcatatttatgaatct

SEQ ID NO: 5281288 - DNA, 15 bp, Homo sapiens
attcatatttgtact

SEQ ID NO: 5281289 - DNA, 19 bp, Homo sapiens
attcatatttgtactttct

SEQ ID NO: 5281290 - DNA, 20 bp, Homo sapiens
attcatatttgtctttgaat

SEQ ID NO: 5281291 - DNA, 13 bp, Homo sapiens
attcatatttttc

SEQ ID NO: 5281292 - DNA, 16 bp, Homo sapiens
attcatatttttcctt

SEQ ID NO: 5281293 - DNA, 18 bp, Homo sapiens
attcatcaaataaacctt

SEQ ID NO: 5281294 - DNA, 16 bp, Homo sapiens
attcatcaagctgtac

SEQ ID NO: 5281295 - DNA, 14 bp, Homo sapiens
attcatcaagtaat

SEQ ID NO: 5281296 - DNA, 22 bp, Homo sapiens
attcatcagaatccttggctga

SEQ ID NO: 5281297 - DNA, 16 bp, Homo sapiens
attcatcagaatgtta

SEQ ID NO: 5281298 - DNA, 22 bp, Homo sapiens
attcatcatatgaatgttcttg

SEQ ID NO: 5281299 - DNA, 17 bp, Homo sapiens
attcatccaagttaaat

SEQ ID NO: 5281300 - DNA, 19 bp, Homo sapiens
attcatccaagttaaatgt

SEQ ID NO: 5281301 - DNA, 20 bp, Homo sapiens
attcatccaagttaaatgta

SEQ ID NO: 5281302 - DNA, 14 bp, Homo sapiens
attcatccagcagt

SEQ ID NO: 5281303 - DNA, 21 bp, Homo sapiens
attcatccagttgcaataaaa

SEQ ID NO: 5281304 - DNA, 17 bp, Homo sapiens
attcatcccaactgtct

SEQ ID NO: 5281305 - DNA, 17 bp, Homo sapiens
attcatcccttaattta

SEQ ID NO: 5281306 - DNA, 16 bp, Homo sapiens
attcatcctcttacca

SEQ ID NO: 5281307 - DNA, 18 bp, Homo sapiens
attcatcctttaagaaaa

SEQ ID NO: 5281308 - DNA, 19 bp, Homo sapiens
attcatctatttcgagtgt

SEQ ID NO: 5281309 - DNA, 17 bp, Homo sapiens
attcatctctcaaactt

SEQ ID NO: 5281310 - DNA, 17 bp, Homo sapiens
attcatctctctttaat

SEQ ID NO: 5281311 - DNA, 19 bp, Homo sapiens
attcatctctggttttctt

SEQ ID NO: 5281312 - DNA, 14 bp, Homo sapiens
attcatctggaggc

SEQ ID NO: 5281313 - DNA, 19 bp, Homo sapiens
attcatctgggaggcagaa

SEQ ID NO: 5281314 - DNA, 16 bp, Homo sapiens
attcatctgggctggc

SEQ ID NO: 5281315 - DNA, 18 bp, Homo sapiens
attcatctgggctggcag

SEQ ID NO: 5281316 - DNA, 19 bp, Homo sapiens
attcatctgggctggcaga

SEQ ID NO: 5281317 - DNA, 22 bp, Homo sapiens
attcatctgggctggcagaggg

SEQ ID NO: 5281318 - DNA, 17 bp, Homo sapiens
attcatctgtctatatt

SEQ ID NO: 5281319 - DNA, 14 bp, Homo sapiens
attcatctgtgaat

SEQ ID NO: 5281320 - DNA, 15 bp, Homo sapiens
attcatctgtgaatc

SEQ ID NO: 5281321 - DNA, 19 bp, Homo sapiens
attcatctgtgaatctgct

SEQ ID NO: 5281322 - DNA, 17 bp, Homo sapiens
attcatcttgtgtttta

SEQ ID NO: 5281323 - DNA, 14 bp, Homo sapiens
attcatctttcaga

SEQ ID NO: 5281324 - DNA, 15 bp, Homo sapiens
attcatctttcagaa

SEQ ID NO: 5281325 - DNA, 20 bp, Homo sapiens
attcatctttcagaaataaa

SEQ ID NO: 5281326 - DNA, 13 bp, Homo sapiens
attcatcttttaa

SEQ ID NO: 5281327 - DNA, 16 bp, Homo sapiens
attcatgaaaatgtat

SEQ ID NO: 5281328 - DNA, 20 bp, Homo sapiens
attcatgaatattttcaagt

SEQ ID NO: 5281329 - DNA, 17 bp, Homo sapiens
attcatgacattatgtg

SEQ ID NO: 5281330 - DNA, 20 bp, Homo sapiens
attcatgatgctagttctta

SEQ ID NO: 5281331 - DNA, 20 bp, Homo sapiens
attcatgcaagagtttcttg

SEQ ID NO: 5281332 - DNA, 14 bp, Homo sapiens
attcatgccatctg

SEQ ID NO: 5281333 - DNA, 18 bp, Homo sapiens
attcatgccccagtatta

SEQ ID NO: 5281334 - DNA, 14 bp, Homo sapiens
attcatgcctggct

SEQ ID NO: 5281335 - DNA, 23 bp, Homo sapiens
attcatgcctttcatagtttatt

SEQ ID NO: 5281336 - DNA, 16 bp, Homo sapiens
attcatgctactgcca

SEQ ID NO: 5281337 - DNA, 14 bp, Homo sapiens
attcatgctgcctg

SEQ ID NO: 5281338 - DNA, 15 bp, Homo sapiens
attcatgctgcctgc

SEQ ID NO: 5281339 - DNA, 16 bp, Homo sapiens
attcatgctgcctgcc

SEQ ID NO: 5281340 - DNA, 15 bp, Homo sapiens
attcatgctttctcc

SEQ ID NO: 5281341 - DNA, 16 bp, Homo sapiens
attcatgctttctcct

SEQ ID NO: 5281342 - DNA, 22 bp, Homo sapiens
attcatggaccactgtttcttg

SEQ ID NO: 5281343 - DNA, 16 bp, Homo sapiens
attcatggagtagcct

SEQ ID NO: 5281344 - DNA, 18 bp, Homo sapiens
attcatggagtagcctgg

SEQ ID NO: 5281345 - DNA, 21 bp, Homo sapiens
attcatggagtagcctggact

SEQ ID NO: 5281346 - DNA, 16 bp, Homo sapiens
attcatggatatttgt

SEQ ID NO: 5281347 - DNA, 17 bp, Homo sapiens
attcatggatatttgtc

SEQ ID NO: 5281348 - DNA, 20 bp, Homo sapiens
attcatggcatgcttaaatt

SEQ ID NO: 5281349 - DNA, 18 bp, Homo sapiens
attcatggttcaagtatt

SEQ ID NO: 5281350 - DNA, 23 bp, Homo sapiens
attcatggttcaagtattaagca

SEQ ID NO: 5281351 - DNA, 16 bp, Homo sapiens
attcatgtaacagttg

SEQ ID NO: 5281352 - DNA, 23 bp, Homo sapiens
attcatgtaactctccagccatt

SEQ ID NO: 5281353 - DNA, 18 bp, Homo sapiens
attcatgtgagaaagcta

SEQ ID NO: 5281354 - DNA, 12 bp, Homo sapiens
attcatgtgtac

SEQ ID NO: 5281355 - DNA, 13 bp, Homo sapiens
attcatgtgtaca

SEQ ID NO: 5281356 - DNA, 19 bp, Homo sapiens
attcatgtgtacagaaaca

SEQ ID NO: 5281357 - DNA, 20 bp, Homo sapiens
attcatgtgtacagaaacaa

SEQ ID NO: 5281358 - DNA, 17 bp, Homo sapiens
attcatgttcatgtgat

SEQ ID NO: 5281359 - DNA, 13 bp, Homo sapiens
attcatgtttctt

SEQ ID NO: 5281360 - DNA, 15 bp, Homo sapiens
attcatgtttcttaa

SEQ ID NO: 5281361 - DNA, 16 bp, Homo sapiens
attcattaaagaaaaa

SEQ ID NO: 5281362 - DNA, 20 bp, Homo sapiens
attcattaagtaatcttttt

SEQ ID NO: 5281363 - DNA, 16 bp, Homo sapiens
attcattaataaaata

SEQ ID NO: 5281364 - DNA, 14 bp, Homo sapiens
attcattaatagga

SEQ ID NO: 5281365 - DNA, 16 bp, Homo sapiens
attcattaataggaaa

SEQ ID NO: 5281366 - DNA, 14 bp, Homo sapiens
attcattaatctgt

SEQ ID NO: 5281367 - DNA, 16 bp, Homo sapiens
attcattaatctgttt

SEQ ID NO: 5281368 - DNA, 21 bp, Homo sapiens
attcattacatcctctgcttg

SEQ ID NO: 5281369 - DNA, 16 bp, Homo sapiens
attcattagtcatgtt

SEQ ID NO: 5281370 - DNA, 14 bp, Homo sapiens
attcattatgcaac

SEQ ID NO: 5281371 - DNA, 18 bp, Homo sapiens
attcattatgtcaattca

SEQ ID NO: 5281372 - DNA, 14 bp, Homo sapiens
attcattattcctc

SEQ ID NO: 5281373 - DNA, 19 bp, Homo sapiens
attcattatttttccactt

SEQ ID NO: 5281374 - DNA, 15 bp, Homo sapiens
attcattcagatata

SEQ ID NO: 5281375 - DNA, 18 bp, Homo sapiens
attcattcagatataaga

SEQ ID NO: 5281376 - DNA, 23 bp, Homo sapiens
attcattcagatataagatttgt

SEQ ID NO: 5281377 - DNA, 14 bp, Homo sapiens
attcattcagtgag

SEQ ID NO: 5281378 - DNA, 18 bp, Homo sapiens
attcattccattctggaa

SEQ ID NO: 5281379 - DNA, 19 bp, Homo sapiens
attcattccattctggaag

SEQ ID NO: 5281380 - DNA, 16 bp, Homo sapiens
attcattccccagctc

SEQ ID NO: 5281381 - DNA, 15 bp, Homo sapiens
attcattctgagccc

SEQ ID NO: 5281382 - DNA, 19 bp, Homo sapiens
attcattctgtgatcattt

SEQ ID NO: 5281383 - DNA, 17 bp, Homo sapiens
attcattcttaacaaga

SEQ ID NO: 5281384 - DNA, 21 bp, Homo sapiens
attcattcttaacaagatatt

SEQ ID NO: 5281385 - DNA, 14 bp, Homo sapiens
attcattcttagct

SEQ ID NO: 5281386 - DNA, 19 bp, Homo sapiens
attcattcttagctcttaa

SEQ ID NO: 5281387 - DNA, 16 bp, Homo sapiens
attcattctttttgaa

SEQ ID NO: 5281388 - DNA, 15 bp, Homo sapiens
attcattgaagtcag

SEQ ID NO: 5281389 - DNA, 20 bp, Homo sapiens
attcattgaagtcagatgtg

SEQ ID NO: 5281390 - DNA, 20 bp, Homo sapiens
attcattgagcagttagctc

SEQ ID NO: 5281391 - DNA, 14 bp, Homo sapiens
attcattggctcct

SEQ ID NO: 5281392 - DNA, 17 bp, Homo sapiens
attcattggttaacaat

SEQ ID NO: 5281393 - DNA, 13 bp, Homo sapiens
attcattgtctct

SEQ ID NO: 5281394 - DNA, 19 bp, Homo sapiens
attcattgtgaacagaagt

SEQ ID NO: 5281395 - DNA, 11 bp, Homo sapiens
attcattgtgt

SEQ ID NO: 5281396 - DNA, 14 bp, Homo sapiens
attcattgtgttac

SEQ ID NO: 5281397 - DNA, 12 bp, Homo sapiens
attcattgtttg

SEQ ID NO: 5281398 - DNA, 17 bp, Homo sapiens
attcattgtttgtttta

SEQ ID NO: 5281399 - DNA, 14 bp, Homo sapiens
attcatttaaaatg

SEQ ID NO: 5281400 - DNA, 15 bp, Homo sapiens
attcatttaagaaca

SEQ ID NO: 5281401 - DNA, 15 bp, Homo sapiens
attcatttacaactt

SEQ ID NO: 5281402 - DNA, 20 bp, Homo sapiens
attcatttacaacttccaga

SEQ ID NO: 5281403 - DNA, 22 bp, Homo sapiens
attcatttattaagtatatttg

SEQ ID NO: 5281404 - DNA, 11 bp, Homo sapiens
attcatttcaa

SEQ ID NO: 5281405 - DNA, 20 bp, Homo sapiens
attcatttcacattaatggt

SEQ ID NO: 5281406 - DNA, 22 bp, Homo sapiens
attcatttcacattaatggtct

SEQ ID NO: 5281407 - DNA, 19 bp, Homo sapiens
attcatttcactgtagctc

SEQ ID NO: 5281408 - DNA, 16 bp, Homo sapiens
attcatttcactttaa

SEQ ID NO: 5281409 - DNA, 13 bp, Homo sapiens
attcatttctaga

SEQ ID NO: 5281410 - DNA, 12 bp, Homo sapiens
attcatttgctg

SEQ ID NO: 5281411 - DNA, 11 bp, Homo sapiens
attcatttgta

SEQ ID NO: 5281412 - DNA, 20 bp, Homo sapiens
attcattttaaataggtttt

SEQ ID NO: 5281413 - DNA, 18 bp, Homo sapiens
attcattttaacatctga

SEQ ID NO: 5281414 - DNA, 15 bp, Homo sapiens
attcattttactcag

SEQ ID NO: 5281415 - DNA, 18 bp, Homo sapiens
attcattttcatcactgg

SEQ ID NO: 5281416 - DNA, 13 bp, Homo sapiens
attcattttcctg

SEQ ID NO: 5281417 - DNA, 15 bp, Homo sapiens
attcattttcctgtt

SEQ ID NO: 5281418 - DNA, 13 bp, Homo sapiens
attcattttctag

SEQ ID NO: 5281419 - DNA, 16 bp, Homo sapiens
attcattttctagata

SEQ ID NO: 5281420 - DNA, 21 bp, Homo sapiens
attcattttctagatacaata

SEQ ID NO: 5281421 - DNA, 22 bp, Homo sapiens
attcattttctagatacaataa

SEQ ID NO: 5281422 - DNA, 22 bp, Homo sapiens
attcattttctgacatgcattg

SEQ ID NO: 5281423 - DNA, 15 bp, Homo sapiens
attcatttttctgtt

SEQ ID NO: 5281424 - DNA, 17 bp, Homo sapiens
attcattttttaaattc

SEQ ID NO: 5281425 - DNA, 16 bp, Homo sapiens
attccaaaaagcacat

SEQ ID NO: 5281426 - DNA, 21 bp, Homo sapiens
attccaaaatacaatgttatc

SEQ ID NO: 5281427 - DNA, 14 bp, Homo sapiens
attccaaaatatta

SEQ ID NO: 5281428 - DNA, 15 bp, Homo sapiens
attccaaaatattat

SEQ ID NO: 5281429 - DNA, 17 bp, Homo sapiens
attccaaaattcatttc

SEQ ID NO: 5281430 - DNA, 19 bp, Homo sapiens
attttatatgaaatgtttc

SEQ ID NO: 5281431 - DNA, 22 bp, Homo sapiens
attttatatgaaatgtttcact

SEQ ID NO: 5281432 - DNA, 19 bp, Homo sapiens
attttatatgagagaatca

SEQ ID NO: 5281433 - DNA, 15 bp, Homo sapiens
attttatatgtaaat

SEQ ID NO: 5281434 - DNA, 16 bp, Homo sapiens
attttatatgtaaatg

SEQ ID NO: 5281435 - DNA, 20 bp, Homo sapiens
attttatatgtaaatgtgtt

SEQ ID NO: 5281436 - DNA, 20 bp, Homo sapiens
attttatattagaagtgtta

SEQ ID NO: 5281437 - DNA, 13 bp, Homo sapiens
attttatattgaa

SEQ ID NO: 5281438 - DNA, 20 bp, Homo sapiens
attttatatttaaaaaatta

SEQ ID NO: 5281439 - DNA, 18 bp, Homo sapiens
attttatattttctattt

SEQ ID NO: 5281440 - DNA, 18 bp, Homo sapiens
attttatatttttgtaca

SEQ ID NO: 5281441 - DNA, 17 bp, Homo sapiens
attttatcaaggaagtc

SEQ ID NO: 5281442 - DNA, 21 bp, Homo sapiens
attttatcaggggaatttcag

SEQ ID NO: 5281443 - DNA, 21 bp, Homo sapiens
attttatcatcctttcagttt

SEQ ID NO: 5281444 - DNA, 12 bp, Homo sapiens
attttatcatta

SEQ ID NO: 5281445 - DNA, 17 bp, Homo sapiens
attttatcattaaaaat

SEQ ID NO: 5281446 - DNA, 23 bp, Homo sapiens
attttatccctttctcttctgac

SEQ ID NO: 5281447 - DNA, 14 bp, Homo sapiens
attttatcctgtat

SEQ ID NO: 5281448 - DNA, 22 bp, Homo sapiens
attttatctacccagtcatgta

SEQ ID NO: 5281449 - DNA, 15 bp, Homo sapiens
attttatctcttatt

SEQ ID NO: 5281450 - DNA, 21 bp, Homo sapiens
attttatctgcctctcttgta

SEQ ID NO: 5281451 - DNA, 22 bp, Homo sapiens
attttatctgcctctcttgtaa

SEQ ID NO: 5281452 - DNA, 15 bp, Homo sapiens
attttatctggaaca

SEQ ID NO: 5281453 - DNA, 14 bp, Homo sapiens
attttatctgtata

SEQ ID NO: 5281454 - DNA, 15 bp, Homo sapiens
attttatctgtataa

SEQ ID NO: 5281455 - DNA, 14 bp, Homo sapiens
attttatctgtgaa

SEQ ID NO: 5281456 - DNA, 14 bp, Homo sapiens
attttatctgtgtt

SEQ ID NO: 5281457 - DNA, 13 bp, Homo sapiens
attttatctttga

SEQ ID NO: 5281458 - DNA, 14 bp, Homo sapiens
attttatgaacatt

SEQ ID NO: 5281459 - DNA, 19 bp, Homo sapiens
attttatgaacattgtact

SEQ ID NO: 5281460 - DNA, 20 bp, Homo sapiens
attttatgaacattgtactg

SEQ ID NO: 5281461 - DNA, 16 bp, Homo sapiens
attttatgacagtatc

SEQ ID NO: 5281462 - DNA, 17 bp, Homo sapiens
attttatgagaaatgta

SEQ ID NO: 5281463 - DNA, 18 bp, Homo sapiens
attttatgagaaatgtaa

SEQ ID NO: 5281464 - DNA, 20 bp, Homo sapiens
attttatgagaaatgtaatg

SEQ ID NO: 5281465 - DNA, 15 bp, Homo sapiens
attttatgatccagc

SEQ ID NO: 5281466 - DNA, 16 bp, Homo sapiens
attttatgatccagca

SEQ ID NO: 5281467 - DNA, 14 bp, Homo sapiens
attttatgcaaata

SEQ ID NO: 5281468 - DNA, 16 bp, Homo sapiens
attttatgcaaatatt

SEQ ID NO: 5281469 - DNA, 19 bp, Homo sapiens
attttatgccagttgttaa

SEQ ID NO: 5281470 - DNA, 20 bp, Homo sapiens
attttatgccttttatttct

SEQ ID NO: 5281471 - DNA, 14 bp, Homo sapiens
attttatgctaagt

SEQ ID NO: 5281472 - DNA, 18 bp, Homo sapiens
attttatgctttaaacat

SEQ ID NO: 5281473 - DNA, 22 bp, Homo sapiens
attttatggcacctatttcttt

SEQ ID NO: 5281474 - DNA, 19 bp, Homo sapiens
attttatggctcactatga

SEQ ID NO: 5281475 - DNA, 14 bp, Homo sapiens
attttatggtgcat

SEQ ID NO: 5281476 - DNA, 14 bp, Homo sapiens
attttatggttatg

SEQ ID NO: 5281477 - DNA, 23 bp, Homo sapiens
attttatggttatgtttttctgt

SEQ ID NO: 5281478 - DNA, 18 bp, Homo sapiens
attttatgtaaaattttg

SEQ ID NO: 5281479 - DNA, 22 bp, Homo sapiens
attttatgtatgtttacactgt

SEQ ID NO: 5281480 - DNA, 23 bp, Homo sapiens
attttatgtatgtttacactgtc

SEQ ID NO: 5281481 - DNA, 22 bp, Homo sapiens
attttatgtattctttctgcct

SEQ ID NO: 5281482 - DNA, 21 bp, Homo sapiens
attttatgtattttaaaataa

SEQ ID NO: 5281483 - DNA, 16 bp, Homo sapiens
attttatgtgcttgaa

SEQ ID NO: 5281484 - DNA, 17 bp, Homo sapiens
attttatgtgcttgaag

SEQ ID NO: 5281485 - DNA, 18 bp, Homo sapiens
attttatgtgcttgaaga

SEQ ID NO: 5281486 - DNA, 12 bp, Homo sapiens
attttatgtgtt

SEQ ID NO: 5281487 - DNA, 22 bp, Homo sapiens
attttatgttaagggaagaatt

SEQ ID NO: 5281488 - DNA, 17 bp, Homo sapiens
attttatgttatatata

SEQ ID NO: 5281489 - DNA, 23 bp, Homo sapiens
attttatgttatatataaatata

SEQ ID NO: 5281490 - DNA, 18 bp, Homo sapiens
attttatgttatttatag

SEQ ID NO: 5281491 - DNA, 13 bp, Homo sapiens
attttatgttgac

SEQ ID NO: 5281492 - DNA, 19 bp, Homo sapiens
attttatgttgacatttgt

SEQ ID NO: 5281493 - DNA, 14 bp, Homo sapiens
attttatgttgcat

SEQ ID NO: 5281494 - DNA, 13 bp, Homo sapiens
attttatgtttaa

SEQ ID NO: 5281495 - DNA, 20 bp, Homo sapiens
attttattaaacaattttgt

SEQ ID NO: 5281496 - DNA, 22 bp, Homo sapiens
attttattaataatatttatgt

SEQ ID NO: 5281497 - DNA, 15 bp, Homo sapiens
attttattacatatg

SEQ ID NO: 5281498 - DNA, 12 bp, Homo sapiens
attttattactg

SEQ ID NO: 5281499 - DNA, 14 bp, Homo sapiens
attttattactggc

SEQ ID NO: 5281500 - DNA, 21 bp, Homo sapiens
attttattactggcgtggatt

SEQ ID NO: 5281501 - DNA, 15 bp, Homo sapiens
attttattactgttt

SEQ ID NO: 5281502 - DNA, 23 bp, Homo sapiens
attttattatgaagaaggtgaat

SEQ ID NO: 5281503 - DNA, 12 bp, Homo sapiens
attttattatgc

SEQ ID NO: 5281504 - DNA, 14 bp, Homo sapiens
attttattatgtaa

SEQ ID NO: 5281505 - DNA, 19 bp, Homo sapiens
attttattatgtaaatccc

SEQ ID NO: 5281506 - DNA, 15 bp, Homo sapiens
attttattattcaga

SEQ ID NO: 5281507 - DNA, 18 bp, Homo sapiens
attttattatttctaaat

SEQ ID NO: 5281508 - DNA, 15 bp, Homo sapiens
attttattattttct

SEQ ID NO: 5281509 - DNA, 12 bp, Homo sapiens
attttattcaag

SEQ ID NO: 5281510 - DNA, 21 bp, Homo sapiens
attttattcacatatgtctta

SEQ ID NO: 5281511 - DNA, 18 bp, Homo sapiens
attttattcttgatcagt

SEQ ID NO: 5281512 - DNA, 17 bp, Homo sapiens
attttattgaaatgtat

SEQ ID NO: 5281513 - DNA, 17 bp, Homo sapiens
attttattgaatactgt

SEQ ID NO: 5281514 - DNA, 23 bp, Homo sapiens
attttattgaatataatggcctc

SEQ ID NO: 5281515 - DNA, 13 bp, Homo sapiens
attttattgactg

SEQ ID NO: 5281516 - DNA, 18 bp, Homo sapiens
attttattgatgcagtgt

SEQ ID NO: 5281517 - DNA, 13 bp, Homo sapiens
attttattgtata

SEQ ID NO: 5281518 - DNA, 20 bp, Homo sapiens
attttattgtataaaaagtt

SEQ ID NO: 5281519 - DNA, 23 bp, Homo sapiens
attttattgtataaaaagtttca

SEQ ID NO: 5281520 - DNA, 18 bp, Homo sapiens
attttattgtattttgat

SEQ ID NO: 5281521 - DNA, 20 bp, Homo sapiens
attttattgtattttgatga

SEQ ID NO: 5281522 - DNA, 14 bp, Homo sapiens
attttatttaaact

SEQ ID NO: 5281523 - DNA, 17 bp, Homo sapiens
attttatttaattttca

SEQ ID NO: 5281524 - DNA, 13 bp, Homo sapiens
attttatttatgg

SEQ ID NO: 5281525 - DNA, 17 bp, Homo sapiens
attttatttcaatgtaa

SEQ ID NO: 5281526 - DNA, 13 bp, Homo sapiens
attttatttctga

SEQ ID NO: 5281527 - DNA, 16 bp, Homo sapiens
attttatttgaaaaaa

SEQ ID NO: 5281528 - DNA, 14 bp, Homo sapiens
attttatttgacaa

SEQ ID NO: 5281529 - DNA, 15 bp, Homo sapiens
attttatttgtattc

SEQ ID NO: 5281530 - DNA, 19 bp, Homo sapiens
attttattttaaaatttca

SEQ ID NO: 5281531 - DNA, 18 bp, Homo sapiens
attttattttattatgca

SEQ ID NO: 5281532 - DNA, 16 bp, Homo sapiens
attttattttattgaa

SEQ ID NO: 5281533 - DNA, 19 bp, Homo sapiens
attttattttcaagcaaat

SEQ ID NO: 5281534 - DNA, 23 bp, Homo sapiens
attttattttgaaatggaaatta

SEQ ID NO: 5281535 - DNA, 16 bp, Homo sapiens
attttattttgctgag

SEQ ID NO: 5281536 - DNA, 19 bp, Homo sapiens
attttattttggcttcatt

SEQ ID NO: 5281537 - DNA, 21 bp, Homo sapiens
attttattttgtgctcattta

SEQ ID NO: 5281538 - DNA, 20 bp, Homo sapiens
attttatttttaaaatatta

SEQ ID NO: 5281539 - DNA, 21 bp, Homo sapiens
attttatttttattacttttt

SEQ ID NO: 5281540 - DNA, 16 bp, Homo sapiens
attttatttttgcaaa

SEQ ID NO: 5281541 - DNA, 17 bp, Homo sapiens
attttatttttgtatct

SEQ ID NO: 5281542 - DNA, 23 bp, Homo sapiens
attttattttttgggccattacc

SEQ ID NO: 5281543 - DNA, 16 bp, Homo sapiens
attttattttttttca

SEQ ID NO: 5281544 - DNA, 18 bp, Homo sapiens
attttattttttttcaaa

SEQ ID NO: 5281545 - DNA, 13 bp, Homo sapiens
attttcaaaaatc

SEQ ID NO: 5281546 - DNA, 15 bp, Homo sapiens
attttcaaaaattgt

SEQ ID NO: 5281547 - DNA, 15 bp, Homo sapiens
attttcaaaaccagg

SEQ ID NO: 5281548 - DNA, 17 bp, Homo sapiens
attttcaaaaccaggtc

SEQ ID NO: 5281549 - DNA, 20 bp, Homo sapiens
attttcaaaagaaaacccaa

SEQ ID NO: 5281550 - DNA, 13 bp, Homo sapiens
attttcaaaatct

SEQ ID NO: 5281551 - DNA, 23 bp, Homo sapiens
attttcaaacctcaaatatagta

SEQ ID NO: 5281552 - DNA, 18 bp, Homo sapiens
attttcaaactttgtact

SEQ ID NO: 5281553 - DNA, 15 bp, Homo sapiens
attttcaaagaaaat

SEQ ID NO: 5281554 - DNA, 15 bp, Homo sapiens
attttcaaagactta

SEQ ID NO: 5281555 - DNA, 16 bp, Homo sapiens
attttcaaagacttaa

SEQ ID NO: 5281556 - DNA, 17 bp, Homo sapiens
attttcaaagacttaag

SEQ ID NO: 5281557 - DNA, 15 bp, Homo sapiens
attttcaaagagatg

SEQ ID NO: 5281558 - DNA, 16 bp, Homo sapiens
attttcaaagagatgg

SEQ ID NO: 5281559 - DNA, 22 bp, Homo sapiens
attttcaaagattgttggcagt

SEQ ID NO: 5281560 - DNA, 22 bp, Homo sapiens
attttcaaagctttttccagag

SEQ ID NO: 5281561 - DNA, 14 bp, Homo sapiens
attttcaaaggaaa

SEQ ID NO: 5281562 - DNA, 15 bp, Homo sapiens
attttcaaaggaaaa

SEQ ID NO: 5281563 - DNA, 22 bp, Homo sapiens
attttcaaaggaaaacaccttt

SEQ ID NO: 5281564 - DNA, 17 bp, Homo sapiens
attttcaaagtacataa

SEQ ID NO: 5281565 - DNA, 22 bp, Homo sapiens
attttcaaatatgtaaacttta

SEQ ID NO: 5281566 - DNA, 18 bp, Homo sapiens
attttcaacattgatttt

SEQ ID NO: 5281567 - DNA, 22 bp, Homo sapiens
attttcaaccataaaagaagtt

SEQ ID NO: 5281568 - DNA, 20 bp, Homo sapiens
attttcaacgcagccctgct

SEQ ID NO: 5281569 - DNA, 14 bp, Homo sapiens
attttcaactgctt

SEQ ID NO: 5281570 - DNA, 16 bp, Homo sapiens
attttcaactgctttg

SEQ ID NO: 5281571 - DNA, 16 bp, Homo sapiens
attttcaagaaactga

SEQ ID NO: 5281572 - DNA, 22 bp, Homo sapiens
attttcaagaaactgaggaatt

SEQ ID NO: 5281573 - DNA, 22 bp, Homo sapiens
attttcaagagaagaaaaaatt

SEQ ID NO: 5281574 - DNA, 17 bp, Homo sapiens
attttcaagcaaagtat

SEQ ID NO: 5281575 - DNA, 17 bp, Homo sapiens
attttcaaggccttcag

SEQ ID NO: 5281576 - DNA, 22 bp, Homo sapiens
attttcaaggccttcagtttat

SEQ ID NO: 5281577 - DNA, 12 bp, Homo sapiens
attttcaagtaa

SEQ ID NO: 5281578 - DNA, 15 bp, Homo sapiens
attttcaagtagctg

SEQ ID NO: 5281579 - DNA, 21 bp, Homo sapiens
attttcaagttattcagaaat

SEQ ID NO: 5281580 - DNA, 13 bp, Homo sapiens
attttcaagtttt

SEQ ID NO: 5281581 - DNA, 16 bp, Homo sapiens
attttcaagtttttca

SEQ ID NO: 5281582 - DNA, 16 bp, Homo sapiens
attttcaatagccact

SEQ ID NO: 5281583 - DNA, 17 bp, Homo sapiens
attttcaatagccacta

SEQ ID NO: 5281584 - DNA, 20 bp, Homo sapiens
attttcaatagccactaacc

SEQ ID NO: 5281585 - DNA, 14 bp, Homo sapiens
attttcaatgtgat

SEQ ID NO: 5281586 - DNA, 14 bp, Homo sapiens
attttcaattatac

SEQ ID NO: 5281587 - DNA, 22 bp, Homo sapiens
attttcaattcaaaaatgtaca

SEQ ID NO: 5281588 - DNA, 17 bp, Homo sapiens
attttcacaattattaa

SEQ ID NO: 5281589 - DNA, 15 bp, Homo sapiens
attttcacacattca

SEQ ID NO: 5281590 - DNA, 21 bp, Homo sapiens
attttcacagctttgaggaac

SEQ ID NO: 5281591 - DNA, 20 bp, Homo sapiens
attttcacatgacgtaaaat

SEQ ID NO: 5281592 - DNA, 22 bp, Homo sapiens
attttcacattcccatctgtca

SEQ ID NO: 5281593 - DNA, 20 bp, Homo sapiens
attttcacattcttggctta

SEQ ID NO: 5281594 - DNA, 16 bp, Homo sapiens
attttcaccctctgta

SEQ ID NO: 5281595 - DNA, 16 bp, Homo sapiens
attttcactaaaagtg

SEQ ID NO: 5281596 - DNA, 14 bp, Homo sapiens
attttcactgtgtc

SEQ ID NO: 5281597 - DNA, 18 bp, Homo sapiens
attttcacttttaaacta

SEQ ID NO: 5281598 - DNA, 14 bp, Homo sapiens
attttcagaagctg

SEQ ID NO: 5281599 - DNA, 14 bp, Homo sapiens
attttcagaatctg

SEQ ID NO: 5281600 - DNA, 15 bp, Homo sapiens
attttcagaatctga

SEQ ID NO: 5281601 - DNA, 21 bp, Homo sapiens
attttcagaatctgaatgtaa

SEQ ID NO: 5281602 - DNA, 13 bp, Homo sapiens
attttcagattca

SEQ ID NO: 5281603 - DNA, 15 bp, Homo sapiens
attttcagatttgca

SEQ ID NO: 5281604 - DNA, 18 bp, Homo sapiens
attttcagatttgcacaa

SEQ ID NO: 5281605 - DNA, 20 bp, Homo sapiens
attttcagatttgcacaaaa

SEQ ID NO: 5281606 - DNA, 18 bp, Homo sapiens
attttcagcaaactcttt

SEQ ID NO: 5281607 - DNA, 19 bp, Homo sapiens
attttcagcaaactctttt

SEQ ID NO: 5281608 - DNA, 15 bp, Homo sapiens
attccaaaccaggac

SEQ ID NO: 5281609 - DNA, 17 bp, Homo sapiens
attccaaagaacagcct

SEQ ID NO: 5281610 - DNA, 12 bp, Homo sapiens
attccaaagatc

SEQ ID NO: 5281611 - DNA, 15 bp, Homo sapiens
attccaaagatctga

SEQ ID NO: 5281612 - DNA, 18 bp, Homo sapiens
attccaaagatctgaatg

SEQ ID NO: 5281613 - DNA, 20 bp, Homo sapiens
attccaaagcaaaaccagaa

SEQ ID NO: 5281614 - DNA, 15 bp, Homo sapiens
attccaaagctttat

SEQ ID NO: 5281615 - DNA, 17 bp, Homo sapiens
attccaaagttatttca

SEQ ID NO: 5281616 - DNA, 14 bp, Homo sapiens
attccaaagttctt

SEQ ID NO: 5281617 - DNA, 15 bp, Homo sapiens
attccaaatatgtat

SEQ ID NO: 5281618 - DNA, 19 bp, Homo sapiens
attccaaatttttttctta

SEQ ID NO: 5281619 - DNA, 20 bp, Homo sapiens
attccaaatttttttcttag

SEQ ID NO: 5281620 - DNA, 18 bp, Homo sapiens
attccaacaaagggtttt

SEQ ID NO: 5281621 - DNA, 20 bp, Homo sapiens
attccaacagctcaagtctt

SEQ ID NO: 5281622 - DNA, 14 bp, Homo sapiens
attccaacagtgag

SEQ ID NO: 5281623 - DNA, 15 bp, Homo sapiens
attccaacagtgagt

SEQ ID NO: 5281624 - DNA, 18 bp, Homo sapiens
attccaacagtttaatga

SEQ ID NO: 5281625 - DNA, 14 bp, Homo sapiens
attccaacccagcc

SEQ ID NO: 5281626 - DNA, 15 bp, Homo sapiens
attccaaccccaact

SEQ ID NO: 5281627 - DNA, 17 bp, Homo sapiens
attccaaccccaactcc

SEQ ID NO: 5281628 - DNA, 15 bp, Homo sapiens
attccaactcctgat

SEQ ID NO: 5281629 - DNA, 19 bp, Homo sapiens
attccaacttcctccttca

SEQ ID NO: 5281630 - DNA, 18 bp, Homo sapiens
attccaacttgaaggatt

SEQ ID NO: 5281631 - DNA, 14 bp, Homo sapiens
attccaagaaaata

SEQ ID NO: 5281632 - DNA, 16 bp, Homo sapiens
attccaagaaaatatc

SEQ ID NO: 5281633 - DNA, 13 bp, Homo sapiens
attccaagacagt

SEQ ID NO: 5281634 - DNA, 18 bp, Homo sapiens
attccaagactctagagt

SEQ ID NO: 5281635 - DNA, 13 bp, Homo sapiens
attccaaggaaaa

SEQ ID NO: 5281636 - DNA, 19 bp, Homo sapiens
attccaaggaaaattgaaa

SEQ ID NO: 5281637 - DNA, 22 bp, Homo sapiens
attccaaggaaaattgaaagta

SEQ ID NO: 5281638 - DNA, 21 bp, Homo sapiens
attccaaggctttaaagctga

SEQ ID NO: 5281639 - DNA, 22 bp, Homo sapiens
attccaagggtatgggaagcca

SEQ ID NO: 5281640 - DNA, 19 bp, Homo sapiens
attccaagtcaacactctt

SEQ ID NO: 5281641 - DNA, 23 bp, Homo sapiens
attccaagtcagaaactgtttct

SEQ ID NO: 5281642 - DNA, 14 bp, Homo sapiens
attccaagtctcca

SEQ ID NO: 5281643 - DNA, 17 bp, Homo sapiens
attccaagtgattgaaa

SEQ ID NO: 5281644 - DNA, 13 bp, Homo sapiens
attccaatacatt

SEQ ID NO: 5281645 - DNA, 16 bp, Homo sapiens
attccaatacattatt

SEQ ID NO: 5281646 - DNA, 21 bp, Homo sapiens
attccaataccctagaagaaa

SEQ ID NO: 5281647 - DNA, 17 bp, Homo sapiens
attccaatatgatgact

SEQ ID NO: 5281648 - DNA, 19 bp, Homo sapiens
attccaatatttataatta

SEQ ID NO: 5281649 - DNA, 16 bp, Homo sapiens
attccaattaaattta

SEQ ID NO: 5281650 - DNA, 22 bp, Homo sapiens
attccaattaaatttattttac

SEQ ID NO: 5281651 - DNA, 14 bp, Homo sapiens
attccaattctaaa

SEQ ID NO: 5281652 - DNA, 19 bp, Homo sapiens
attccaattctaaatccga

SEQ ID NO: 5281653 - DNA, 16 bp, Homo sapiens
attccaatttcaaaat

SEQ ID NO: 5281654 - DNA, 19 bp, Homo sapiens
attccaatttcaaaatgtc

SEQ ID NO: 5281655 - DNA, 19 bp, Homo sapiens
attccacaaacacattata

SEQ ID NO: 5281656 - DNA, 20 bp, Homo sapiens
attccacaaacacattataa

SEQ ID NO: 5281657 - DNA, 18 bp, Homo sapiens
attccacacaaaatgtca

SEQ ID NO: 5281658 - DNA, 15 bp, Homo sapiens
attccacacatttcc

SEQ ID NO: 5281659 - DNA, 19 bp, Homo sapiens
attccacactccttgtcaa

SEQ ID NO: 5281660 - DNA, 12 bp, Homo sapiens
attccacactgt

SEQ ID NO: 5281661 - DNA, 18 bp, Homo sapiens
attccacagatatctttt

SEQ ID NO: 5281662 - DNA, 13 bp, Homo sapiens
attccacagctgc

SEQ ID NO: 5281663 - DNA, 22 bp, Homo sapiens
attccacaggacgaatgcatat

SEQ ID NO: 5281664 - DNA, 15 bp, Homo sapiens
attccacagtctctg

SEQ ID NO: 5281665 - DNA, 16 bp, Homo sapiens
attccacagtctctgg

SEQ ID NO: 5281666 - DNA, 12 bp, Homo sapiens
attccacatcta

SEQ ID NO: 5281667 - DNA, 13 bp, Homo sapiens
attccaccagggc

SEQ ID NO: 5281668 - DNA, 14 bp, Homo sapiens
attccaccagggcc

SEQ ID NO: 5281669 - DNA, 16 bp, Homo sapiens
attccaccagggccag

SEQ ID NO: 5281670 - DNA, 20 bp, Homo sapiens
attccaccagggccagagca

SEQ ID NO: 5281671 - DNA, 16 bp, Homo sapiens
attccaccattcacat

SEQ ID NO: 5281672 - DNA, 21 bp, Homo sapiens
attccacccctccttccctgg

SEQ ID NO: 5281673 - DNA, 19 bp, Homo sapiens
attccacctggaaagccag

SEQ ID NO: 5281674 - DNA, 20 bp, Homo sapiens
attccacctggaaagccagg

SEQ ID NO: 5281675 - DNA, 16 bp, Homo sapiens
attccaccttaaatta

SEQ ID NO: 5281676 - DNA, 20 bp, Homo sapiens
attccaccttaaattaaaca

SEQ ID NO: 5281677 - DNA, 23 bp, Homo sapiens
attccaccttaaattaaacaatt

SEQ ID NO: 5281678 - DNA, 15 bp, Homo sapiens
attccacgtgcccct

SEQ ID NO: 5281679 - DNA, 17 bp, Homo sapiens
attccactacacctggc

SEQ ID NO: 5281680 - DNA, 22 bp, Homo sapiens
attccactcgtccaagggacag

SEQ ID NO: 5281681 - DNA, 13 bp, Homo sapiens
attccactgaaaa

SEQ ID NO: 5281682 - DNA, 14 bp, Homo sapiens
attccactgaaaat

SEQ ID NO: 5281683 - DNA, 15 bp, Homo sapiens
attccactgaaaatt

SEQ ID NO: 5281684 - DNA, 12 bp, Homo sapiens
attccactggac

SEQ ID NO: 5281685 - DNA, 20 bp, Homo sapiens
attccacttataggaattga

SEQ ID NO: 5281686 - DNA, 18 bp, Homo sapiens
attccacttcctgcccca

SEQ ID NO: 5281687 - DNA, 23 bp, Homo sapiens
attccacttgttcattctgtgac

SEQ ID NO: 5281688 - DNA, 16 bp, Homo sapiens
attccagaaaggatat

SEQ ID NO: 5281689 - DNA, 19 bp, Homo sapiens
attccagaacgccctgtgt

SEQ ID NO: 5281690 - DNA, 18 bp, Homo sapiens
attccagaatgaagaatt

SEQ ID NO: 5281691 - DNA, 19 bp, Homo sapiens
attccagaatgctgtacat

SEQ ID NO: 5281692 - DNA, 23 bp, Homo sapiens
attccagaatgctgtacatctat

SEQ ID NO: 5281693 - DNA, 17 bp, Homo sapiens
attccagaccaaaataa

SEQ ID NO: 5281694 - DNA, 18 bp, Homo sapiens
attccagacctgaagaat

SEQ ID NO: 5281695 - DNA, 15 bp, Homo sapiens
attccagacttcaaa

SEQ ID NO: 5281696 - DNA, 18 bp, Homo sapiens
attccagactttctatta

SEQ ID NO: 5281697 - DNA, 12 bp, Homo sapiens
attccagagctg

SEQ ID NO: 5281698 - DNA, 17 bp, Homo sapiens
attccagagctgccagt

SEQ ID NO: 5281699 - DNA, 12 bp, Homo sapiens
attccagaggaa

SEQ ID NO: 5281700 - DNA, 22 bp, Homo sapiens
attccagaggactctgcttaaa

SEQ ID NO: 5281701 - DNA, 16 bp, Homo sapiens
attccagagttaaaat

SEQ ID NO: 5281702 - DNA, 16 bp, Homo sapiens
attccagatcccaggc

SEQ ID NO: 5281703 - DNA, 20 bp, Homo sapiens
attccagatctgcagtcact

SEQ ID NO: 5281704 - DNA, 16 bp, Homo sapiens
attccagatctttcag

SEQ ID NO: 5281705 - DNA, 14 bp, Homo sapiens
attccagatttgtt

SEQ ID NO: 5281706 - DNA, 20 bp, Homo sapiens
attccagcaagtacagagat

SEQ ID NO: 5281707 - DNA, 14 bp, Homo sapiens
attccagcaataag

SEQ ID NO: 5281708 - DNA, 12 bp, Homo sapiens
attccagcagct

SEQ ID NO: 5281709 - DNA, 14 bp, Homo sapiens
attccagcagctgc

SEQ ID NO: 5281710 - DNA, 23 bp, Homo sapiens
attccagcagtgaaacttgtgct

SEQ ID NO: 5281711 - DNA, 15 bp, Homo sapiens
attccagccaggccc

SEQ ID NO: 5281712 - DNA, 23 bp, Homo sapiens
attccagccaggcccaggccagc

SEQ ID NO: 5281713 - DNA, 13 bp, Homo sapiens
attccagcccctc

SEQ ID NO: 5281714 - DNA, 17 bp, Homo sapiens
attccagcgtctgctgt

SEQ ID NO: 5281715 - DNA, 13 bp, Homo sapiens
attccagctcatt

SEQ ID NO: 5281716 - DNA, 16 bp, Homo sapiens
attccagctctgcccc

SEQ ID NO: 5281717 - DNA, 23 bp, Homo sapiens
attccaggaggagttagccaaac

SEQ ID NO: 5281718 - DNA, 12 bp, Homo sapiens
attccaggctcc

SEQ ID NO: 5281719 - DNA, 17 bp, Homo sapiens
attccagggaaccagag

SEQ ID NO: 5281720 - DNA, 14 bp, Homo sapiens
attccagggctggg

SEQ ID NO: 5281721 - DNA, 15 bp, Homo sapiens
attccagggctgggg

SEQ ID NO: 5281722 - DNA, 22 bp, Homo sapiens
attccaggggcctcaggtccta

SEQ ID NO: 5281723 - DNA, 22 bp, Homo sapiens
attccaggggctgcagccccct

SEQ ID NO: 5281724 - DNA, 17 bp, Homo sapiens
attccagtaactttttt

SEQ ID NO: 5281725 - DNA, 17 bp, Homo sapiens
attccagtacagtattc

SEQ ID NO: 5281726 - DNA, 20 bp, Homo sapiens
attccagtccaattttccta

SEQ ID NO: 5281727 - DNA, 16 bp, Homo sapiens
attccagtgtattttc

SEQ ID NO: 5281728 - DNA, 17 bp, Homo sapiens
attccagtgtccatgtt

SEQ ID NO: 5281729 - DNA, 23 bp, Homo sapiens
attccagttatttatttccaaaa

SEQ ID NO: 5281730 - DNA, 20 bp, Homo sapiens
attccagttgcgtgtctgtt

SEQ ID NO: 5281731 - DNA, 19 bp, Homo sapiens
attccagttgtatttgaag

SEQ ID NO: 5281732 - DNA, 23 bp, Homo sapiens
attccataaccccaggcatccca

SEQ ID NO: 5281733 - DNA, 15 bp, Homo sapiens
attccataatacata

SEQ ID NO: 5281734 - DNA, 21 bp, Homo sapiens
attccatagtatattaaaaat

SEQ ID NO: 5281735 - DNA, 23 bp, Homo sapiens
attccatagtatattaaaaatgg

SEQ ID NO: 5281736 - DNA, 16 bp, Homo sapiens
attccatagtggacca

SEQ ID NO: 5281737 - DNA, 22 bp, Homo sapiens
attccatagtggaccacttgga

SEQ ID NO: 5281738 - DNA, 17 bp, Homo sapiens
attccatatatatctga

SEQ ID NO: 5281739 - DNA, 23 bp, Homo sapiens
attccatatcttgcgaatccaag

SEQ ID NO: 5281740 - DNA, 17 bp, Homo sapiens
attccatatctttggat

SEQ ID NO: 5281741 - DNA, 17 bp, Homo sapiens
attccatattcatgtaa

SEQ ID NO: 5281742 - DNA, 20 bp, Homo sapiens
attccatcaaagagaaggaa

SEQ ID NO: 5281743 - DNA, 18 bp, Homo sapiens
attccatcaataaatgct

SEQ ID NO: 5281744 - DNA, 20 bp, Homo sapiens
attccatcacagccagccca

SEQ ID NO: 5281745 - DNA, 22 bp, Homo sapiens
attccatcacagccagcccagc

SEQ ID NO: 5281746 - DNA, 14 bp, Homo sapiens
attccatccatata

SEQ ID NO: 5281747 - DNA, 18 bp, Homo sapiens
attccatccatatacttt

SEQ ID NO: 5281748 - DNA, 20 bp, Homo sapiens
attccatctagtttttggaa

SEQ ID NO: 5281749 - DNA, 14 bp, Homo sapiens
attccatcttgtaa

SEQ ID NO: 5281750 - DNA, 19 bp, Homo sapiens
attccatgaatcgcttctc

SEQ ID NO: 5281751 - DNA, 23 bp, Homo sapiens
attccatgaccagaaacagggac

SEQ ID NO: 5281752 - DNA, 13 bp, Homo sapiens
attccatgactct

SEQ ID NO: 5281753 - DNA, 17 bp, Homo sapiens
attccatgactctgcct

SEQ ID NO: 5281754 - DNA, 22 bp, Homo sapiens
attccatgactctgcctaacca

SEQ ID NO: 5281755 - DNA, 14 bp, Homo sapiens
attccatgactgct

SEQ ID NO: 5281756 - DNA, 20 bp, Homo sapiens
attccatgactgcttgccct

SEQ ID NO: 5281757 - DNA, 16 bp, Homo sapiens
attccatgagctgctc

SEQ ID NO: 5281758 - DNA, 18 bp, Homo sapiens
attccatgagctgctcat

SEQ ID NO: 5281759 - DNA, 18 bp, Homo sapiens
attccatgaggaaaataa

SEQ ID NO: 5281760 - DNA, 16 bp, Homo sapiens
attccatgattttaca

SEQ ID NO: 5281761 - DNA, 17 bp, Homo sapiens
attccatgattttacag

SEQ ID NO: 5281762 - DNA, 22 bp, Homo sapiens
attccatgattttacagagaat

SEQ ID NO: 5281763 - DNA, 18 bp, Homo sapiens
attccatggatcttgctg

SEQ ID NO: 5281764 - DNA, 13 bp, Homo sapiens
attccatgtccct

SEQ ID NO: 5281765 - DNA, 20 bp, Homo sapiens
attccatgtgaaaataaaat

SEQ ID NO: 5281766 - DNA, 14 bp, Homo sapiens
attccatgtgccca

SEQ ID NO: 5281767 - DNA, 18 bp, Homo sapiens
attccatgttttaaaatt

SEQ ID NO: 5281768 - DNA, 13 bp, Homo sapiens
attccattatctt

SEQ ID NO: 5281769 - DNA, 17 bp, Homo sapiens
attccattcaatttcat

SEQ ID NO: 5281770 - DNA, 17 bp, Homo sapiens
attccattggtccaaga

SEQ ID NO: 5281771 - DNA, 15 bp, Homo sapiens
attccattgtgtgag

SEQ ID NO: 5281772 - DNA, 20 bp, Homo sapiens
attccatttactgcattctt

SEQ ID NO: 5281773 - DNA, 12 bp, Homo sapiens
attccatttatg

SEQ ID NO: 5281774 - DNA, 16 bp, Homo sapiens
attccatttccagttc

SEQ ID NO: 5281775 - DNA, 15 bp, Homo sapiens
attccatttgcttgt

SEQ ID NO: 5281776 - DNA, 14 bp, Homo sapiens
attccattttggaa

SEQ ID NO: 5281777 - DNA, 22 bp, Homo sapiens
attccatttttactaaagcagt

SEQ ID NO: 5281778 - DNA, 18 bp, Homo sapiens
attcccaaatcctagact

SEQ ID NO: 5281779 - DNA, 22 bp, Homo sapiens
attcccaacatttcttaaatta

SEQ ID NO: 5281780 - DNA, 22 bp, Homo sapiens
attcccaactgagtgttatttg

SEQ ID NO: 5281781 - DNA, 23 bp, Homo sapiens
attcccaagagtggtggcagctc

SEQ ID NO: 5281782 - DNA, 17 bp, Homo sapiens
attcccaagccatggca

SEQ ID NO: 5281783 - DNA, 20 bp, Homo sapiens
attcccaagctgaatgttct

SEQ ID NO: 5281784 - DNA, 19 bp, Homo sapiens
attcccaagtatgccttaa

SEQ ID NO: 5281785 - DNA, 19 bp, Homo sapiens
attcccactaagctttctc

SEQ ID NO: 5281786 - DNA, 16 bp, Homo sapiens
attttcagcatcaaac

SEQ ID NO: 5281787 - DNA, 23 bp, Homo sapiens
attttcagcatgaaaatgtgtgt

SEQ ID NO: 5281788 - DNA, 12 bp, Homo sapiens
attttcagcatt

SEQ ID NO: 5281789 - DNA, 23 bp, Homo sapiens
attttcagcccatatttcatcgt

SEQ ID NO: 5281790 - DNA, 19 bp, Homo sapiens
attttcagcgaacatgcct

SEQ ID NO: 5281791 - DNA, 16 bp, Homo sapiens
attttcagctgcaagg

SEQ ID NO: 5281792 - DNA, 17 bp, Homo sapiens
attttcagctgcaagga

SEQ ID NO: 5281793 - DNA, 21 bp, Homo sapiens
attttcaggatttttggtata

SEQ ID NO: 5281794 - DNA, 20 bp, Homo sapiens
attttcaggtagtctgagta

SEQ ID NO: 5281795 - DNA, 23 bp, Homo sapiens
attttcaggtttcttaaaaacag

SEQ ID NO: 5281796 - DNA, 18 bp, Homo sapiens
attttcagtaatgttatt

SEQ ID NO: 5281797 - DNA, 16 bp, Homo sapiens
attttcagtaccaaag

SEQ ID NO: 5281798 - DNA, 22 bp, Homo sapiens
attttcagtagggctacaaaac

SEQ ID NO: 5281799 - DNA, 17 bp, Homo sapiens
attttcagtcatctcat

SEQ ID NO: 5281800 - DNA, 19 bp, Homo sapiens
attttcagtcttgtagtgt

SEQ ID NO: 5281801 - DNA, 19 bp, Homo sapiens
attttcagtgctttgccct

SEQ ID NO: 5281802 - DNA, 15 bp, Homo sapiens
attttcataacttat

SEQ ID NO: 5281803 - DNA, 19 bp, Homo sapiens
attttcataacttattgct

SEQ ID NO: 5281804 - DNA, 23 bp, Homo sapiens
attttcataacttattgctgatt

SEQ ID NO: 5281805 - DNA, 17 bp, Homo sapiens
attttcataatcagtaa

SEQ ID NO: 5281806 - DNA, 15 bp, Homo sapiens
attttcataattcat

SEQ ID NO: 5281807 - DNA, 18 bp, Homo sapiens
attttcataattcattta

SEQ ID NO: 5281808 - DNA, 22 bp, Homo sapiens
attttcatacagcattacaaat

SEQ ID NO: 5281809 - DNA, 16 bp, Homo sapiens
attttcatacttttga

SEQ ID NO: 5281810 - DNA, 18 bp, Homo sapiens
attttcatatatttaact

SEQ ID NO: 5281811 - DNA, 15 bp, Homo sapiens
attttcatatccaag

SEQ ID NO: 5281812 - DNA, 20 bp, Homo sapiens
attttcatatttaaagccaa

SEQ ID NO: 5281813 - DNA, 14 bp, Homo sapiens
attttcatcaattt

SEQ ID NO: 5281814 - DNA, 14 bp, Homo sapiens
attttcatcactgg

SEQ ID NO: 5281815 - DNA, 21 bp, Homo sapiens
attttcatcccgtatcacagt

SEQ ID NO: 5281816 - DNA, 17 bp, Homo sapiens
attttcatccttgtctt

SEQ ID NO: 5281817 - DNA, 11 bp, Homo sapiens
attttcatcta

SEQ ID NO: 5281818 - DNA, 14 bp, Homo sapiens
attttcatgaaaat

SEQ ID NO: 5281819 - DNA, 20 bp, Homo sapiens
attttcatgaaaataccatt

SEQ ID NO: 5281820 - DNA, 17 bp, Homo sapiens
attttcatgaatgtgct

SEQ ID NO: 5281821 - DNA, 13 bp, Homo sapiens
attttcatgactt

SEQ ID NO: 5281822 - DNA, 18 bp, Homo sapiens
attttcatgcaaaagttc

SEQ ID NO: 5281823 - DNA, 24 bp, Homo sapiens
attttcatgcacagtagattcaag

SEQ ID NO: 5281824 - DNA, 15 bp, Homo sapiens
attttcatgcttcca

SEQ ID NO: 5281825 - DNA, 18 bp, Homo sapiens
attttcatgtatatgtgt

SEQ ID NO: 5281826 - DNA, 12 bp, Homo sapiens
attttcattaaa

SEQ ID NO: 5281827 - DNA, 15 bp, Homo sapiens
attttcattaaaagc

SEQ ID NO: 5281828 - DNA, 15 bp, Homo sapiens
attttcattacaatg

SEQ ID NO: 5281829 - DNA, 13 bp, Homo sapiens
attttcattagca

SEQ ID NO: 5281830 - DNA, 15 bp, Homo sapiens
attttcattagcaaa

SEQ ID NO: 5281831 - DNA, 15 bp, Homo sapiens
attttcattatttca

SEQ ID NO: 5281832 - DNA, 18 bp, Homo sapiens
attttcattggatgcagt

SEQ ID NO: 5281833 - DNA, 13 bp, Homo sapiens
attttcattgtga

SEQ ID NO: 5281834 - DNA, 14 bp, Homo sapiens
attttcatttcatg

SEQ ID NO: 5281835 - DNA, 12 bp, Homo sapiens
attttcatttgt

SEQ ID NO: 5281836 - DNA, 17 bp, Homo sapiens
attttcattttaattta

SEQ ID NO: 5281837 - DNA, 15 bp, Homo sapiens
attttcattttctgc

SEQ ID NO: 5281838 - DNA, 14 bp, Homo sapiens
attttccaaagagt

SEQ ID NO: 5281839 - DNA, 14 bp, Homo sapiens
attttccaaccttt

SEQ ID NO: 5281840 - DNA, 16 bp, Homo sapiens
attttccaagaacata

SEQ ID NO: 5281841 - DNA, 16 bp, Homo sapiens
attttccaagtaaaat

SEQ ID NO: 5281842 - DNA, 12 bp, Homo sapiens
attttccacatg

SEQ ID NO: 5281843 - DNA, 23 bp, Homo sapiens
attttccacgcagttctttccat

SEQ ID NO: 5281844 - DNA, 15 bp, Homo sapiens
attttccacttatct

SEQ ID NO: 5281845 - DNA, 15 bp, Homo sapiens
attttccagccttat

SEQ ID NO: 5281846 - DNA, 19 bp, Homo sapiens
attttccagccttatgtgt

SEQ ID NO: 5281847 - DNA, 20 bp, Homo sapiens
attttccagccttatgtgtt

SEQ ID NO: 5281848 - DNA, 21 bp, Homo sapiens
attttccagccttatgtgtta

SEQ ID NO: 5281849 - DNA, 19 bp, Homo sapiens
attttccaggactgtttca

SEQ ID NO: 5281850 - DNA, 17 bp, Homo sapiens
attttccagggcaatca

SEQ ID NO: 5281851 - DNA, 15 bp, Homo sapiens
attttccatatttgg

SEQ ID NO: 5281852 - DNA, 16 bp, Homo sapiens
attttccatatttgga

SEQ ID NO: 5281853 - DNA, 18 bp, Homo sapiens
attttccatctaaaaata

SEQ ID NO: 5281854 - DNA, 15 bp, Homo sapiens
attttccatgaaaat

SEQ ID NO: 5281855 - DNA, 22 bp, Homo sapiens
attttcccaatagcactttcat

SEQ ID NO: 5281856 - DNA, 23 bp, Homo sapiens
attttcccacaattcttttgaaa

SEQ ID NO: 5281857 - DNA, 14 bp, Homo sapiens
attttcccactgca

SEQ ID NO: 5281858 - DNA, 17 bp, Homo sapiens
attttcccactgcaccc

SEQ ID NO: 5281859 - DNA, 23 bp, Homo sapiens
attttcccatcatcctttgttct

SEQ ID NO: 5281860 - DNA, 21 bp, Homo sapiens
attttcccatttgctgtcttt

SEQ ID NO: 5281861 - DNA, 16 bp, Homo sapiens
attttccccaatacag

SEQ ID NO: 5281862 - DNA, 21 bp, Homo sapiens
attttccccccactctcccca

SEQ ID NO: 5281863 - DNA, 19 bp, Homo sapiens
attttcccccttggctctc

SEQ ID NO: 5281864 - DNA, 22 bp, Homo sapiens
attttcccccttttctgcattt

SEQ ID NO: 5281865 - DNA, 16 bp, Homo sapiens
attttccccttcctca

SEQ ID NO: 5281866 - DNA, 22 bp, Homo sapiens
attttccctcagaaaatgagta

SEQ ID NO: 5281867 - DNA, 17 bp, Homo sapiens
attttcccttcatgttt

SEQ ID NO: 5281868 - DNA, 20 bp, Homo sapiens
attttccctttttaaaaaat

SEQ ID NO: 5281869 - DNA, 22 bp, Homo sapiens
attttccctttttaaaaaatac

SEQ ID NO: 5281870 - DNA, 23 bp, Homo sapiens
attttccctttttaaaaaatacc

SEQ ID NO: 5281871 - DNA, 23 bp, Homo sapiens
attttccgggaactttgcagcat

SEQ ID NO: 5281872 - DNA, 16 bp, Homo sapiens
attttcctaaccacaa

SEQ ID NO: 5281873 - DNA, 15 bp, Homo sapiens
attttcctaatgtga

SEQ ID NO: 5281874 - DNA, 18 bp, Homo sapiens
attttcctaatgtgatca

SEQ ID NO: 5281875 - DNA, 13 bp, Homo sapiens
attttcctcaatc

SEQ ID NO: 5281876 - DNA, 15 bp, Homo sapiens
attttcctccaaagt

SEQ ID NO: 5281877 - DNA, 13 bp, Homo sapiens
attttcctcccca

SEQ ID NO: 5281878 - DNA, 21 bp, Homo sapiens
attttcctcctaaacaaaaac

SEQ ID NO: 5281879 - DNA, 14 bp, Homo sapiens
attttcctcctctg

SEQ ID NO: 5281880 - DNA, 16 bp, Homo sapiens
attttcctcctttcct

SEQ ID NO: 5281881 - DNA, 12 bp, Homo sapiens
attttcctctga

SEQ ID NO: 5281882 - DNA, 15 bp, Homo sapiens
attttcctctgcttt

SEQ ID NO: 5281883 - DNA, 21 bp, Homo sapiens
attttcctcttgtcctggccc

SEQ ID NO: 5281884 - DNA, 14 bp, Homo sapiens
attttcctcttgtg

SEQ ID NO: 5281885 - DNA, 19 bp, Homo sapiens
attttcctgaatattaatc

SEQ ID NO: 5281886 - DNA, 13 bp, Homo sapiens
attttcctgcttc

SEQ ID NO: 5281887 - DNA, 18 bp, Homo sapiens
attttcctggagtgaaga

SEQ ID NO: 5281888 - DNA, 23 bp, Homo sapiens
attttcctggagtgaagaaaact

SEQ ID NO: 5281889 - DNA, 13 bp, Homo sapiens
attttcctggatt

SEQ ID NO: 5281890 - DNA, 17 bp, Homo sapiens
attttcctggatttata

SEQ ID NO: 5281891 - DNA, 14 bp, Homo sapiens
attttcctgggagt

SEQ ID NO: 5281892 - DNA, 18 bp, Homo sapiens
attttcctggtgccaatt

SEQ ID NO: 5281893 - DNA, 16 bp, Homo sapiens
attttcctgtcctctt

SEQ ID NO: 5281894 - DNA, 21 bp, Homo sapiens
attttcctgtcctctttcagc

SEQ ID NO: 5281895 - DNA, 23 bp, Homo sapiens
attttcctgtcctctttcagctc

SEQ ID NO: 5281896 - DNA, 15 bp, Homo sapiens
attttcctgttcagt

SEQ ID NO: 5281897 - DNA, 17 bp, Homo sapiens
attttcctgttcagtga

SEQ ID NO: 5281898 - DNA, 16 bp, Homo sapiens
attttcctgtttactg

SEQ ID NO: 5281899 - DNA, 15 bp, Homo sapiens
attttccttccatgc

SEQ ID NO: 5281900 - DNA, 12 bp, Homo sapiens
attttccttgaa

SEQ ID NO: 5281901 - DNA, 13 bp, Homo sapiens
attttccttgaag

SEQ ID NO: 5281902 - DNA, 14 bp, Homo sapiens
attttccttgaagc

SEQ ID NO: 5281903 - DNA, 15 bp, Homo sapiens
attttccttgaagcc

SEQ ID NO: 5281904 - DNA, 13 bp, Homo sapiens
attttccttgctt

SEQ ID NO: 5281905 - DNA, 13 bp, Homo sapiens
attttcctttaat

SEQ ID NO: 5281906 - DNA, 14 bp, Homo sapiens
attttcctttagat

SEQ ID NO: 5281907 - DNA, 16 bp, Homo sapiens
attttcctttctgtat

SEQ ID NO: 5281908 - DNA, 17 bp, Homo sapiens
attttcctttggactgt

SEQ ID NO: 5281909 - DNA, 18 bp, Homo sapiens
attttccttttttataca

SEQ ID NO: 5281910 - DNA, 19 bp, Homo sapiens
attttcgatgaagttctga

SEQ ID NO: 5281911 - DNA, 15 bp, Homo sapiens
attttcgcccaccta

SEQ ID NO: 5281912 - DNA, 21 bp, Homo sapiens
attttcggaacacatttccct

SEQ ID NO: 5281913 - DNA, 17 bp, Homo sapiens
attttcgtatgaaaatg

SEQ ID NO: 5281914 - DNA, 17 bp, Homo sapiens
attttcgtgcatttgtg

SEQ ID NO: 5281915 - DNA, 16 bp, Homo sapiens
attttcgttcattact

SEQ ID NO: 5281916 - DNA, 14 bp, Homo sapiens
attttctaaaaaag

SEQ ID NO: 5281917 - DNA, 14 bp, Homo sapiens
attttctaaaagcc

SEQ ID NO: 5281918 - DNA, 14 bp, Homo sapiens
attttctaaactgt

SEQ ID NO: 5281919 - DNA, 13 bp, Homo sapiens
attttctaaattc

SEQ ID NO: 5281920 - DNA, 16 bp, Homo sapiens
attttctaagaaacat

SEQ ID NO: 5281921 - DNA, 15 bp, Homo sapiens
attttctaagacagt

SEQ ID NO: 5281922 - DNA, 18 bp, Homo sapiens
attttctaagcaatttct

SEQ ID NO: 5281923 - DNA, 19 bp, Homo sapiens
attttctaaggaatgcaca

SEQ ID NO: 5281924 - DNA, 18 bp, Homo sapiens
attttctaattaaagatg

SEQ ID NO: 5281925 - DNA, 17 bp, Homo sapiens
attttctaattctcttt

SEQ ID NO: 5281926 - DNA, 19 bp, Homo sapiens
attttctacaaataatttt

SEQ ID NO: 5281927 - DNA, 14 bp, Homo sapiens
attttctacaagta

SEQ ID NO: 5281928 - DNA, 14 bp, Homo sapiens
attttctacagtgg

SEQ ID NO: 5281929 - DNA, 23 bp, Homo sapiens
attttctacctgtgttcattctt

SEQ ID NO: 5281930 - DNA, 18 bp, Homo sapiens
attttctacgtcatgtat

SEQ ID NO: 5281931 - DNA, 17 bp, Homo sapiens
attttctacgtttcttt

SEQ ID NO: 5281932 - DNA, 22 bp, Homo sapiens
attttctactccacctcttcct

SEQ ID NO: 5281933 - DNA, 16 bp, Homo sapiens
attttctactgtaaga

SEQ ID NO: 5281934 - DNA, 20 bp, Homo sapiens
attttctagaatactaataa

SEQ ID NO: 5281935 - DNA, 19 bp, Homo sapiens
attttctataatttaaata

SEQ ID NO: 5281936 - DNA, 22 bp, Homo sapiens
attttctatagctcttctattt

SEQ ID NO: 5281937 - DNA, 20 bp, Homo sapiens
attttctatcagaagttgta

SEQ ID NO: 5281938 - DNA, 15 bp, Homo sapiens
attttctatgtacta

SEQ ID NO: 5281939 - DNA, 13 bp, Homo sapiens
attttctatttct

SEQ ID NO: 5281940 - DNA, 17 bp, Homo sapiens
attttctatttctctgt

SEQ ID NO: 5281941 - DNA, 21 bp, Homo sapiens
attttctatttctctgtgtat

SEQ ID NO: 5281942 - DNA, 23 bp, Homo sapiens
attttctattttaagactgattt

SEQ ID NO: 5281943 - DNA, 17 bp, Homo sapiens
attttctcaaaagcatt

SEQ ID NO: 5281944 - DNA, 21 bp, Homo sapiens
attttctcactgaactccacc

SEQ ID NO: 5281945 - DNA, 17 bp, Homo sapiens
attttctccaaatgttc

SEQ ID NO: 5281946 - DNA, 11 bp, Homo sapiens
attttctccac

SEQ ID NO: 5281947 - DNA, 19 bp, Homo sapiens
attttctccacaacactgt

SEQ ID NO: 5281948 - DNA, 18 bp, Homo sapiens
attttctccatgtctgta

SEQ ID NO: 5281949 - DNA, 17 bp, Homo sapiens
attttctcccaagctga

SEQ ID NO: 5281950 - DNA, 14 bp, Homo sapiens
attttctccctgga

SEQ ID NO: 5281951 - DNA, 21 bp, Homo sapiens
attttctctaaactgtttctt

SEQ ID NO: 5281952 - DNA, 16 bp, Homo sapiens
attttctctattcttt

SEQ ID NO: 5281953 - DNA, 17 bp, Homo sapiens
attttctctattctttc

SEQ ID NO: 5281954 - DNA, 16 bp, Homo sapiens
attttctctcaggtga

SEQ ID NO: 5281955 - DNA, 17 bp, Homo sapiens
attttctctgtactttt

SEQ ID NO: 5281956 - DNA, 22 bp, Homo sapiens
attttctctgtgtttgttccta

SEQ ID NO: 5281957 - DNA, 16 bp, Homo sapiens
attttctcttagaaaa

SEQ ID NO: 5281958 - DNA, 11 bp, Homo sapiens
attttctcttt

SEQ ID NO: 5281959 - DNA, 19 bp, Homo sapiens
attttctctttttgatctt

SEQ ID NO: 5281960 - DNA, 16 bp, Homo sapiens
attttctgaattcata

SEQ ID NO: 5281961 - DNA, 13 bp, Homo sapiens
attttctgaccaa

SEQ ID NO: 5281962 - DNA, 16 bp, Homo sapiens
attttctgcaagcctg

SEQ ID NO: 5281963 - DNA, 18 bp, Homo sapiens
attttctgcaatccaatg

SEQ ID NO: 5281964 - DNA, 15 bp, Homo sapiens
attttctgctacttt

SEQ ID NO: 5281965 - DNA, 21 bp, Homo sapiens
attttctggaaaatgcttctt

SEQ ID NO: 5281966 - DNA, 21 bp, Homo sapiens
attcccactaagctttctcct

SEQ ID NO: 5281967 - DNA, 17 bp, Homo sapiens
attcccactcaccagcc

SEQ ID NO: 5281968 - DNA, 11 bp, Homo sapiens
attcccactgc

SEQ ID NO: 5281969 - DNA, 15 bp, Homo sapiens
attcccactgccagg

SEQ ID NO: 5281970 - DNA, 17 bp, Homo sapiens
attcccactttcattca

SEQ ID NO: 5281971 - DNA, 17 bp, Homo sapiens
attcccagacagcagtg

SEQ ID NO: 5281972 - DNA, 16 bp, Homo sapiens
attcccagagacagga

SEQ ID NO: 5281973 - DNA, 14 bp, Homo sapiens
attcccagaggtgg

SEQ ID NO: 5281974 - DNA, 16 bp, Homo sapiens
attcccagaggtgggg

SEQ ID NO: 5281975 - DNA, 19 bp, Homo sapiens
attcccagatagtcccagc

SEQ ID NO: 5281976 - DNA, 14 bp, Homo sapiens
attcccagcctgac

SEQ ID NO: 5281977 - DNA, 22 bp, Homo sapiens
attcccagcctgactagaactc

SEQ ID NO: 5281978 - DNA, 11 bp, Homo sapiens
attcccaggag

SEQ ID NO: 5281979 - DNA, 18 bp, Homo sapiens
attcccaggagttctgct

SEQ ID NO: 5281980 - DNA, 16 bp, Homo sapiens
attcccaggcactctc

SEQ ID NO: 5281981 - DNA, 17 bp, Homo sapiens
attcccaggcagggagg

SEQ ID NO: 5281982 - DNA, 20 bp, Homo sapiens
attcccaggccagggctggg

SEQ ID NO: 5281983 - DNA, 23 bp, Homo sapiens
attcccaggccagggctgggtca

SEQ ID NO: 5281984 - DNA, 14 bp, Homo sapiens
attcccagggacct

SEQ ID NO: 5281985 - DNA, 21 bp, Homo sapiens
attcccagggccgcttctcct

SEQ ID NO: 5281986 - DNA, 15 bp, Homo sapiens
attcccatctgtcac

SEQ ID NO: 5281987 - DNA, 17 bp, Homo sapiens
attcccatgaatatcaa

SEQ ID NO: 5281988 - DNA, 16 bp, Homo sapiens
attcccatggagttgc

SEQ ID NO: 5281989 - DNA, 18 bp, Homo sapiens
attcccattgaaaatgta

SEQ ID NO: 5281990 - DNA, 20 bp, Homo sapiens
attccccagattgcaacagg

SEQ ID NO: 5281991 - DNA, 14 bp, Homo sapiens
attccccagcctct

SEQ ID NO: 5281992 - DNA, 20 bp, Homo sapiens
attccccagcctctcttcct

SEQ ID NO: 5281993 - DNA, 13 bp, Homo sapiens
attccccagctcc

SEQ ID NO: 5281994 - DNA, 14 bp, Homo sapiens
attccccagctcca

SEQ ID NO: 5281995 - DNA, 15 bp, Homo sapiens
attccccatcttcca

SEQ ID NO: 5281996 - DNA, 22 bp, Homo sapiens
attccccattctgtgtcccatg

SEQ ID NO: 5281997 - DNA, 17 bp, Homo sapiens
attccccatttcctgta

SEQ ID NO: 5281998 - DNA, 13 bp, Homo sapiens
attcccccacttg

SEQ ID NO: 5281999 - DNA, 13 bp, Homo sapiens
attcccccagtgc

SEQ ID NO: 5282000 - DNA, 14 bp, Homo sapiens
attcccccatcctt

SEQ ID NO: 5282001 - DNA, 21 bp, Homo sapiens
attccccccattttgcctctg

SEQ ID NO: 5282002 - DNA, 16 bp, Homo sapiens
attccccctgccctgt

SEQ ID NO: 5282003 - DNA, 13 bp, Homo sapiens
attcccccttcct

SEQ ID NO: 5282004 - DNA, 17 bp, Homo sapiens
attcccccttcctagtg

SEQ ID NO: 5282005 - DNA, 23 bp, Homo sapiens
attccccgtctctggttcctccc

SEQ ID NO: 5282006 - DNA, 15 bp, Homo sapiens
attcccctcccacct

SEQ ID NO: 5282007 - DNA, 21 bp, Homo sapiens
attcccctccccactcctctc

SEQ ID NO: 5282008 - DNA, 22 bp, Homo sapiens
attcccctccccactcctctcc

SEQ ID NO: 5282009 - DNA, 14 bp, Homo sapiens
attcccctgtgtca

SEQ ID NO: 5282010 - DNA, 16 bp, Homo sapiens
attcccggctggactt

SEQ ID NO: 5282011 - DNA, 15 bp, Homo sapiens
attcccgggcccttc

SEQ ID NO: 5282012 - DNA, 19 bp, Homo sapiens
attcccggtcagcagtatc

SEQ ID NO: 5282013 - DNA, 16 bp, Homo sapiens
attcccgttttgtcac

SEQ ID NO: 5282014 - DNA, 17 bp, Homo sapiens
attccctagatctttct

SEQ ID NO: 5282015 - DNA, 22 bp, Homo sapiens
attccctatcttttagttttag

SEQ ID NO: 5282016 - DNA, 11 bp, Homo sapiens
attccctcact

SEQ ID NO: 5282017 - DNA, 12 bp, Homo sapiens
attccctccagt

SEQ ID NO: 5282018 - DNA, 13 bp, Homo sapiens
attccctccattt

SEQ ID NO: 5282019 - DNA, 12 bp, Homo sapiens
attccctcccca

SEQ ID NO: 5282020 - DNA, 12 bp, Homo sapiens
attccctccccc

SEQ ID NO: 5282021 - DNA, 17 bp, Homo sapiens
attccctccccctcctt

SEQ ID NO: 5282022 - DNA, 22 bp, Homo sapiens
attccctccccctccttgtgcc

SEQ ID NO: 5282023 - DNA, 21 bp, Homo sapiens
attccctcctgctactctgtt

SEQ ID NO: 5282024 - DNA, 17 bp, Homo sapiens
attccctcgtctttccc

SEQ ID NO: 5282025 - DNA, 13 bp, Homo sapiens
attccctctcatc

SEQ ID NO: 5282026 - DNA, 14 bp, Homo sapiens
attccctctcatcc

SEQ ID NO: 5282027 - DNA, 14 bp, Homo sapiens
attccctctcccac

SEQ ID NO: 5282028 - DNA, 15 bp, Homo sapiens
attccctctcccacc

SEQ ID NO: 5282029 - DNA, 15 bp, Homo sapiens
attccctctcccagg

SEQ ID NO: 5282030 - DNA, 13 bp, Homo sapiens
attccctctcctg

SEQ ID NO: 5282031 - DNA, 18 bp, Homo sapiens
attccctctcctgcccag

SEQ ID NO: 5282032 - DNA, 20 bp, Homo sapiens
attccctctctcagcacagc

SEQ ID NO: 5282033 - DNA, 21 bp, Homo sapiens
attccctctctcagcacagcc

SEQ ID NO: 5282034 - DNA, 14 bp, Homo sapiens
attccctctctctg

SEQ ID NO: 5282035 - DNA, 19 bp, Homo sapiens
attccctctctctgactct

SEQ ID NO: 5282036 - DNA, 14 bp, Homo sapiens
attccctcttgcta

SEQ ID NO: 5282037 - DNA, 20 bp, Homo sapiens
attccctgagtcaccaggaa

SEQ ID NO: 5282038 - DNA, 14 bp, Homo sapiens
attccctgcacaca

SEQ ID NO: 5282039 - DNA, 17 bp, Homo sapiens
attccctgcacacacat

SEQ ID NO: 5282040 - DNA, 13 bp, Homo sapiens
attccctgcctgg

SEQ ID NO: 5282041 - DNA, 12 bp, Homo sapiens
attccctggaaa

SEQ ID NO: 5282042 - DNA, 19 bp, Homo sapiens
attccctggaccagatgct

SEQ ID NO: 5282043 - DNA, 12 bp, Homo sapiens
attccctggaga

SEQ ID NO: 5282044 - DNA, 22 bp, Homo sapiens
attccctggcctggctctcctg

SEQ ID NO: 5282045 - DNA, 21 bp, Homo sapiens
attccctggcctttcatattt

SEQ ID NO: 5282046 - DNA, 15 bp, Homo sapiens
attccctgtggaatg

SEQ ID NO: 5282047 - DNA, 22 bp, Homo sapiens
attcccttaactctaaccctgt

SEQ ID NO: 5282048 - DNA, 18 bp, Homo sapiens
attcccttcaatgcaaaa

SEQ ID NO: 5282049 - DNA, 21 bp, Homo sapiens
attcccttcagggattccctg

SEQ ID NO: 5282050 - DNA, 23 bp, Homo sapiens
attcccttcctgccagcccctgc

SEQ ID NO: 5282051 - DNA, 14 bp, Homo sapiens
attcccttcctgtt

SEQ ID NO: 5282052 - DNA, 18 bp, Homo sapiens
attcccttcctgttccct

SEQ ID NO: 5282053 - DNA, 19 bp, Homo sapiens
attcccttcctgttccctc

SEQ ID NO: 5282054 - DNA, 13 bp, Homo sapiens
attcccttccttc

SEQ ID NO: 5282055 - DNA, 23 bp, Homo sapiens
attcccttcgacagcattttcct

SEQ ID NO: 5282056 - DNA, 14 bp, Homo sapiens
attcccttctgatc

SEQ ID NO: 5282057 - DNA, 15 bp, Homo sapiens
attcccttctgggct

SEQ ID NO: 5282058 - DNA, 16 bp, Homo sapiens
attcccttctttttca

SEQ ID NO: 5282059 - DNA, 17 bp, Homo sapiens
attcccttgaattgtgt

SEQ ID NO: 5282060 - DNA, 18 bp, Homo sapiens
attccctttgacttcagc

SEQ ID NO: 5282061 - DNA, 16 bp, Homo sapiens
attccctttttaaatg

SEQ ID NO: 5282062 - DNA, 17 bp, Homo sapiens
attccctttttaaatga

SEQ ID NO: 5282063 - DNA, 23 bp, Homo sapiens
attccctttttaaatgagctttc

SEQ ID NO: 5282064 - DNA, 23 bp, Homo sapiens
attccctttttcaccctattttc

SEQ ID NO: 5282065 - DNA, 23 bp, Homo sapiens
attccgaaaaaaaaatgttcatt

SEQ ID NO: 5282066 - DNA, 15 bp, Homo sapiens
attccgaagagggaa

SEQ ID NO: 5282067 - DNA, 22 bp, Homo sapiens
attccgaagagggaatggatgg

SEQ ID NO: 5282068 - DNA, 17 bp, Homo sapiens
attccgatcgactgcca

SEQ ID NO: 5282069 - DNA, 17 bp, Homo sapiens
attccgcaccctgccta

SEQ ID NO: 5282070 - DNA, 18 bp, Homo sapiens
attccgcaccctgcctac

SEQ ID NO: 5282071 - DNA, 22 bp, Homo sapiens
attccgcatgatgtttccctct

SEQ ID NO: 5282072 - DNA, 22 bp, Homo sapiens
attccgcgcggagacctcctga

SEQ ID NO: 5282073 - DNA, 19 bp, Homo sapiens
attccggatcctaagcatc

SEQ ID NO: 5282074 - DNA, 14 bp, Homo sapiens
attccggccctggc

SEQ ID NO: 5282075 - DNA, 15 bp, Homo sapiens
attccggccctggct

SEQ ID NO: 5282076 - DNA, 16 bp, Homo sapiens
attccggccctggctg

SEQ ID NO: 5282077 - DNA, 15 bp, Homo sapiens
attccgtatttaaag

SEQ ID NO: 5282078 - DNA, 12 bp, Homo sapiens
attccgtcacca

SEQ ID NO: 5282079 - DNA, 22 bp, Homo sapiens
attccgttaggaataacactgc

SEQ ID NO: 5282080 - DNA, 19 bp, Homo sapiens
attcctaaaactctgccag

SEQ ID NO: 5282081 - DNA, 19 bp, Homo sapiens
attcctaaactatcttttt

SEQ ID NO: 5282082 - DNA, 17 bp, Homo sapiens
attcctaaagaaaaata

SEQ ID NO: 5282083 - DNA, 24 bp, Homo sapiens
attcctaaagctgcttagaatctg

SEQ ID NO: 5282084 - DNA, 14 bp, Homo sapiens
attcctaactagaa

SEQ ID NO: 5282085 - DNA, 21 bp, Homo sapiens
attcctaactatcactggttt

SEQ ID NO: 5282086 - DNA, 14 bp, Homo sapiens
attcctaagcagtg

SEQ ID NO: 5282087 - DNA, 23 bp, Homo sapiens
attcctaaggcccagctgccagg

SEQ ID NO: 5282088 - DNA, 15 bp, Homo sapiens
attcctaattcctgt

SEQ ID NO: 5282089 - DNA, 15 bp, Homo sapiens
attcctaattctatg

SEQ ID NO: 5282090 - DNA, 17 bp, Homo sapiens
attcctacaatatatat

SEQ ID NO: 5282091 - DNA, 22 bp, Homo sapiens
attcctacaatatatattctgg

SEQ ID NO: 5282092 - DNA, 13 bp, Homo sapiens
attcctacagcac

SEQ ID NO: 5282093 - DNA, 23 bp, Homo sapiens
attcctacagcactactgggtgt

SEQ ID NO: 5282094 - DNA, 15 bp, Homo sapiens
attcctactccctct

SEQ ID NO: 5282095 - DNA, 19 bp, Homo sapiens
attcctactccctcttcca

SEQ ID NO: 5282096 - DNA, 20 bp, Homo sapiens
attcctactgacaacattat

SEQ ID NO: 5282097 - DNA, 22 bp, Homo sapiens
attcctacttaaacaaaaactt

SEQ ID NO: 5282098 - DNA, 16 bp, Homo sapiens
attcctagagagcaga

SEQ ID NO: 5282099 - DNA, 15 bp, Homo sapiens
attcctagataaaaa

SEQ ID NO: 5282100 - DNA, 19 bp, Homo sapiens
attcctagataaaaagatg

SEQ ID NO: 5282101 - DNA, 23 bp, Homo sapiens
attcctaggaggaaaaagaaatg

SEQ ID NO: 5282102 - DNA, 14 bp, Homo sapiens
attcctaggcctca

SEQ ID NO: 5282103 - DNA, 19 bp, Homo sapiens
attcctaggtcacttgaag

SEQ ID NO: 5282104 - DNA, 14 bp, Homo sapiens
attcctagtctttc

SEQ ID NO: 5282105 - DNA, 18 bp, Homo sapiens
attcctagtctttccagt

SEQ ID NO: 5282106 - DNA, 19 bp, Homo sapiens
attcctagtggatgactgt

SEQ ID NO: 5282107 - DNA, 21 bp, Homo sapiens
attcctatacgcagcgtgctt

SEQ ID NO: 5282108 - DNA, 20 bp, Homo sapiens
attcctatatcctgtgactg

SEQ ID NO: 5282109 - DNA, 20 bp, Homo sapiens
attcctatgaagttggcaca

SEQ ID NO: 5282110 - DNA, 22 bp, Homo sapiens
attcctatgatggatggcagac

SEQ ID NO: 5282111 - DNA, 22 bp, Homo sapiens
attcctattgtgcaatgtaaat

SEQ ID NO: 5282112 - DNA, 18 bp, Homo sapiens
attcctcagattgctgaa

SEQ ID NO: 5282113 - DNA, 13 bp, Homo sapiens
attcctcagctgc

SEQ ID NO: 5282114 - DNA, 16 bp, Homo sapiens
attcctcaggaaggac

SEQ ID NO: 5282115 - DNA, 16 bp, Homo sapiens
attcctcatgaatgta

SEQ ID NO: 5282116 - DNA, 17 bp, Homo sapiens
attcctcatgaatgtaa

SEQ ID NO: 5282117 - DNA, 21 bp, Homo sapiens
attcctccaaatctcttgctt

SEQ ID NO: 5282118 - DNA, 15 bp, Homo sapiens
attcctccacctgcc

SEQ ID NO: 5282119 - DNA, 17 bp, Homo sapiens
attcctccagagacact

SEQ ID NO: 5282120 - DNA, 21 bp, Homo sapiens
attcctccagagacactgagc

SEQ ID NO: 5282121 - DNA, 15 bp, Homo sapiens
attcctccagccctg

SEQ ID NO: 5282122 - DNA, 16 bp, Homo sapiens
attcctccagcctccc

SEQ ID NO: 5282123 - DNA, 14 bp, Homo sapiens
attcctccagctgg

SEQ ID NO: 5282124 - DNA, 14 bp, Homo sapiens
attcctcccaggag

SEQ ID NO: 5282125 - DNA, 13 bp, Homo sapiens
attcctccccacc

SEQ ID NO: 5282126 - DNA, 17 bp, Homo sapiens
attcctcccccagagcc

SEQ ID NO: 5282127 - DNA, 13 bp, Homo sapiens
attcctcccctgg

SEQ ID NO: 5282128 - DNA, 12 bp, Homo sapiens
attcctcctggg

SEQ ID NO: 5282129 - DNA, 22 bp, Homo sapiens
attcctcctgggcccctcatct

SEQ ID NO: 5282130 - DNA, 13 bp, Homo sapiens
attcctcctgtct

SEQ ID NO: 5282131 - DNA, 10 bp, Homo sapiens
attcctcctt

SEQ ID NO: 5282132 - DNA, 22 bp, Homo sapiens
attcctccttccccccatctct

SEQ ID NO: 5282133 - DNA, 20 bp, Homo sapiens
attcctctaagatcttgcct

SEQ ID NO: 5282134 - DNA, 13 bp, Homo sapiens
attcctctaatgt

SEQ ID NO: 5282135 - DNA, 19 bp, Homo sapiens
attcctctcaaattcagct

SEQ ID NO: 5282136 - DNA, 23 bp, Homo sapiens
attcctctcaaattcagctctga

SEQ ID NO: 5282137 - DNA, 19 bp, Homo sapiens
attcctctcaccccactcc

SEQ ID NO: 5282138 - DNA, 21 bp, Homo sapiens
attcctctcaccccactcctg

SEQ ID NO: 5282139 - DNA, 22 bp, Homo sapiens
attcctctcaccccactcctgt

SEQ ID NO: 5282140 - DNA, 23 bp, Homo sapiens
attcctctcatttccagcttctc

SEQ ID NO: 5282141 - DNA, 16 bp, Homo sapiens
attcctctgctgaaca

SEQ ID NO: 5282142 - DNA, 13 bp, Homo sapiens
attcctctgtatt

SEQ ID NO: 5282143 - DNA, 14 bp, Homo sapiens
attcctctgtcccc

SEQ ID NO: 5282144 - DNA, 14 bp, Homo sapiens
attcctctgtccta

SEQ ID NO: 5282145 - DNA, 18 bp, Homo sapiens
attttctggaatacatga

SEQ ID NO: 5282146 - DNA, 18 bp, Homo sapiens
attttctggccagtgttt

SEQ ID NO: 5282147 - DNA, 19 bp, Homo sapiens
attttctgggataacagta

SEQ ID NO: 5282148 - DNA, 20 bp, Homo sapiens
attttctgggttctgggtgg

SEQ ID NO: 5282149 - DNA, 21 bp, Homo sapiens
attttctggtagatagaaata

SEQ ID NO: 5282150 - DNA, 14 bp, Homo sapiens
attttctggttcta

SEQ ID NO: 5282151 - DNA, 13 bp, Homo sapiens
attttctgtaaga

SEQ ID NO: 5282152 - DNA, 12 bp, Homo sapiens
attttctgtaat

SEQ ID NO: 5282153 - DNA, 13 bp, Homo sapiens
attttctgtaatt

SEQ ID NO: 5282154 - DNA, 16 bp, Homo sapiens
attttctgtaattctt

SEQ ID NO: 5282155 - DNA, 21 bp, Homo sapiens
attttctgtaattcttctcct

SEQ ID NO: 5282156 - DNA, 15 bp, Homo sapiens
attttctgtatttaa

SEQ ID NO: 5282157 - DNA, 16 bp, Homo sapiens
attttctgtatttaat

SEQ ID NO: 5282158 - DNA, 19 bp, Homo sapiens
attttctgtatttaattat

SEQ ID NO: 5282159 - DNA, 23 bp, Homo sapiens
attttctgtatttaattataaaa

SEQ ID NO: 5282160 - DNA, 17 bp, Homo sapiens
attttctgtcactgtag

SEQ ID NO: 5282161 - DNA, 18 bp, Homo sapiens
attttctgtcagatgaga

SEQ ID NO: 5282162 - DNA, 20 bp, Homo sapiens
attttctgtcagatgagaac

SEQ ID NO: 5282163 - DNA, 11 bp, Homo sapiens
attttctgtgg

SEQ ID NO: 5282164 - DNA, 12 bp, Homo sapiens
attttctgtgta

SEQ ID NO: 5282165 - DNA, 13 bp, Homo sapiens
attttctgtgtgt

SEQ ID NO: 5282166 - DNA, 20 bp, Homo sapiens
attttctgtgtgtacatgta

SEQ ID NO: 5282167 - DNA, 15 bp, Homo sapiens
attttctgtgtgttc

SEQ ID NO: 5282168 - DNA, 17 bp, Homo sapiens
attttctgtgtgttcct

SEQ ID NO: 5282169 - DNA, 17 bp, Homo sapiens
attttctgttatacaca

SEQ ID NO: 5282170 - DNA, 18 bp, Homo sapiens
attttctgttatacacag

SEQ ID NO: 5282171 - DNA, 11 bp, Homo sapiens
attttctgttg

SEQ ID NO: 5282172 - DNA, 21 bp, Homo sapiens
attttcttatccacaaagtac

SEQ ID NO: 5282173 - DNA, 19 bp, Homo sapiens
attttcttattgcgctgct

SEQ ID NO: 5282174 - DNA, 14 bp, Homo sapiens
attttcttcacagt

SEQ ID NO: 5282175 - DNA, 16 bp, Homo sapiens
attttcttcacagtgc

SEQ ID NO: 5282176 - DNA, 23 bp, Homo sapiens
attttcttcacagtgcagcttgc

SEQ ID NO: 5282177 - DNA, 18 bp, Homo sapiens
attttcttcatgcaatga

SEQ ID NO: 5282178 - DNA, 15 bp, Homo sapiens
attttcttcccattt

SEQ ID NO: 5282179 - DNA, 12 bp, Homo sapiens
attttcttctaa

SEQ ID NO: 5282180 - DNA, 13 bp, Homo sapiens
attttcttctaag

SEQ ID NO: 5282181 - DNA, 15 bp, Homo sapiens
attttcttctcattc

SEQ ID NO: 5282182 - DNA, 17 bp, Homo sapiens
attttcttctcattctt

SEQ ID NO: 5282183 - DNA, 16 bp, Homo sapiens
attttcttctctgtga

SEQ ID NO: 5282184 - DNA, 23 bp, Homo sapiens
attttcttctttaatttttctgt

SEQ ID NO: 5282185 - DNA, 21 bp, Homo sapiens
attttcttggaattttgtaaa

SEQ ID NO: 5282186 - DNA, 19 bp, Homo sapiens
attttcttgtcaatggaag

SEQ ID NO: 5282187 - DNA, 15 bp, Homo sapiens
attttcttgtttaac

SEQ ID NO: 5282188 - DNA, 22 bp, Homo sapiens
attttctttaaccagtctgaag

SEQ ID NO: 5282189 - DNA, 12 bp, Homo sapiens
attttctttcta

SEQ ID NO: 5282190 - DNA, 22 bp, Homo sapiens
attttctttctatgtagaactg

SEQ ID NO: 5282191 - DNA, 18 bp, Homo sapiens
attttctttgaaattcat

SEQ ID NO: 5282192 - DNA, 16 bp, Homo sapiens
attttctttgtttctt

SEQ ID NO: 5282193 - DNA, 16 bp, Homo sapiens
attttcttttatatct

SEQ ID NO: 5282194 - DNA, 17 bp, Homo sapiens
attttcttttatatctg

SEQ ID NO: 5282195 - DNA, 19 bp, Homo sapiens
attttcttttatatctgta

SEQ ID NO: 5282196 - DNA, 14 bp, Homo sapiens
attttcttttatta

SEQ ID NO: 5282197 - DNA, 13 bp, Homo sapiens
attttcttttctt

SEQ ID NO: 5282198 - DNA, 20 bp, Homo sapiens
attttcttttctttcaactt

SEQ ID NO: 5282199 - DNA, 17 bp, Homo sapiens
attttcttttgtaaatg

SEQ ID NO: 5282200 - DNA, 17 bp, Homo sapiens
attttcttttgtgcccc

SEQ ID NO: 5282201 - DNA, 20 bp, Homo sapiens
attttctttttcctttataa

SEQ ID NO: 5282202 - DNA, 13 bp, Homo sapiens
attttctttttcg

SEQ ID NO: 5282203 - DNA, 21 bp, Homo sapiens
attttctttttgtaattagta

SEQ ID NO: 5282204 - DNA, 23 bp, Homo sapiens
attttctttttttaactggtgaa

SEQ ID NO: 5282205 - DNA, 22 bp, Homo sapiens
attttctttttttattaaacag

SEQ ID NO: 5282206 - DNA, 13 bp, Homo sapiens
attttgaaaaact

SEQ ID NO: 5282207 - DNA, 13 bp, Homo sapiens
attttgaaaaaga

SEQ ID NO: 5282208 - DNA, 16 bp, Homo sapiens
attttgaaaaagagaa

SEQ ID NO: 5282209 - DNA, 13 bp, Homo sapiens
attttgaaaaatt

SEQ ID NO: 5282210 - DNA, 22 bp, Homo sapiens
attttgaaaaattcctattgtg

SEQ ID NO: 5282211 - DNA, 13 bp, Homo sapiens
attttgaaaacac

SEQ ID NO: 5282212 - DNA, 14 bp, Homo sapiens
attttgaaaacact

SEQ ID NO: 5282213 - DNA, 16 bp, Homo sapiens
attttgaaaacccctg

SEQ ID NO: 5282214 - DNA, 22 bp, Homo sapiens
attttgaaaacccctggctgaa

SEQ ID NO: 5282215 - DNA, 13 bp, Homo sapiens
attttgaaaagct

SEQ ID NO: 5282216 - DNA, 15 bp, Homo sapiens
attttgaaaagtatt

SEQ ID NO: 5282217 - DNA, 15 bp, Homo sapiens
attttgaaacaaagt

SEQ ID NO: 5282218 - DNA, 22 bp, Homo sapiens
attttgaaacaaagtactcttt

SEQ ID NO: 5282219 - DNA, 20 bp, Homo sapiens
attttgaaactttgctttgg

SEQ ID NO: 5282220 - DNA, 20 bp, Homo sapiens
attttgaaaggtcagaattt

SEQ ID NO: 5282221 - DNA, 12 bp, Homo sapiens
attttgaaataa

SEQ ID NO: 5282222 - DNA, 17 bp, Homo sapiens
attttgaaatgaacttt

SEQ ID NO: 5282223 - DNA, 20 bp, Homo sapiens
attttgaaatgaactttgtc

SEQ ID NO: 5282224 - DNA, 19 bp, Homo sapiens
attttgaaatgattcatct

SEQ ID NO: 5282225 - DNA, 15 bp, Homo sapiens
attttgaaatgtggt

SEQ ID NO: 5282226 - DNA, 13 bp, Homo sapiens
attttgaaattgt

SEQ ID NO: 5282227 - DNA, 17 bp, Homo sapiens
attttgaaccaaaacat

SEQ ID NO: 5282228 - DNA, 22 bp, Homo sapiens
attttgaacctgatgaaaataa

SEQ ID NO: 5282229 - DNA, 22 bp, Homo sapiens
attttgaacgcttaagtcatca

SEQ ID NO: 5282230 - DNA, 14 bp, Homo sapiens
attttgaagaatat

SEQ ID NO: 5282231 - DNA, 18 bp, Homo sapiens
attttgaagaatatttaa

SEQ ID NO: 5282232 - DNA, 22 bp, Homo sapiens
attttgaagaatatttaagaaa

SEQ ID NO: 5282233 - DNA, 14 bp, Homo sapiens
attttgaagctaat

SEQ ID NO: 5282234 - DNA, 15 bp, Homo sapiens
attttgaagctaatt

SEQ ID NO: 5282235 - DNA, 21 bp, Homo sapiens
attttgaagctaattatttta

SEQ ID NO: 5282236 - DNA, 18 bp, Homo sapiens
attttgaagtcagagaga

SEQ ID NO: 5282237 - DNA, 20 bp, Homo sapiens
attttgaagtgagaaaatga

SEQ ID NO: 5282238 - DNA, 12 bp, Homo sapiens
attttgaagttt

SEQ ID NO: 5282239 - DNA, 15 bp, Homo sapiens
attttgaagtttaca

SEQ ID NO: 5282240 - DNA, 16 bp, Homo sapiens
attttgaagtttacat

SEQ ID NO: 5282241 - DNA, 17 bp, Homo sapiens
attttgaagtttacatt

SEQ ID NO: 5282242 - DNA, 19 bp, Homo sapiens
attttgaagtttacatttt

SEQ ID NO: 5282243 - DNA, 11 bp, Homo sapiens
attttgaatac

SEQ ID NO: 5282244 - DNA, 22 bp, Homo sapiens
attttgaataccattaaaactg

SEQ ID NO: 5282245 - DNA, 14 bp, Homo sapiens
attttgaatcaata

SEQ ID NO: 5282246 - DNA, 17 bp, Homo sapiens
attttgaatcaataata

SEQ ID NO: 5282247 - DNA, 23 bp, Homo sapiens
attttgaatctgtgtgcatattt

SEQ ID NO: 5282248 - DNA, 21 bp, Homo sapiens
attttgaatgtacaccacatg

SEQ ID NO: 5282249 - DNA, 16 bp, Homo sapiens
attttgaatgtacctc

SEQ ID NO: 5282250 - DNA, 14 bp, Homo sapiens
attttgaatgttta

SEQ ID NO: 5282251 - DNA, 18 bp, Homo sapiens
attttgacaaaaatgttt

SEQ ID NO: 5282252 - DNA, 19 bp, Homo sapiens
attttgacaacatggcttc

SEQ ID NO: 5282253 - DNA, 18 bp, Homo sapiens
attttgacactatatctg

SEQ ID NO: 5282254 - DNA, 17 bp, Homo sapiens
attttgacagaagctat

SEQ ID NO: 5282255 - DNA, 17 bp, Homo sapiens
attttgacataaagttg

SEQ ID NO: 5282256 - DNA, 15 bp, Homo sapiens
attttgacataagta

SEQ ID NO: 5282257 - DNA, 20 bp, Homo sapiens
attttgaccataaattaatt

SEQ ID NO: 5282258 - DNA, 19 bp, Homo sapiens
attttgaccatatagattt

SEQ ID NO: 5282259 - DNA, 17 bp, Homo sapiens
attttgacctactctca

SEQ ID NO: 5282260 - DNA, 14 bp, Homo sapiens
attttgactggctt

SEQ ID NO: 5282261 - DNA, 19 bp, Homo sapiens
attttgacttaatgtgatt

SEQ ID NO: 5282262 - DNA, 20 bp, Homo sapiens
attttgacttagtaactttt

SEQ ID NO: 5282263 - DNA, 14 bp, Homo sapiens
attttgagaaaaat

SEQ ID NO: 5282264 - DNA, 19 bp, Homo sapiens
attttgagaactccagctg

SEQ ID NO: 5282265 - DNA, 17 bp, Homo sapiens
attttgaggtttagcaa

SEQ ID NO: 5282266 - DNA, 16 bp, Homo sapiens
attttgagtattccat

SEQ ID NO: 5282267 - DNA, 19 bp, Homo sapiens
attttgagtcctaggactt

SEQ ID NO: 5282268 - DNA, 21 bp, Homo sapiens
attttgagtctatcctagtct

SEQ ID NO: 5282269 - DNA, 14 bp, Homo sapiens
attttgagtgttta

SEQ ID NO: 5282270 - DNA, 14 bp, Homo sapiens
attttgataaatta

SEQ ID NO: 5282271 - DNA, 15 bp, Homo sapiens
attttgataaattac

SEQ ID NO: 5282272 - DNA, 17 bp, Homo sapiens
attttgataataaattg

SEQ ID NO: 5282273 - DNA, 21 bp, Homo sapiens
attttgataataatattgttt

SEQ ID NO: 5282274 - DNA, 19 bp, Homo sapiens
attttgatacaaatgttta

SEQ ID NO: 5282275 - DNA, 10 bp, Homo sapiens
attttgatat

SEQ ID NO: 5282276 - DNA, 18 bp, Homo sapiens
attttgatataattgtac

SEQ ID NO: 5282277 - DNA, 20 bp, Homo sapiens
attttgatataattgtactg

SEQ ID NO: 5282278 - DNA, 16 bp, Homo sapiens
attttgatatacattg

SEQ ID NO: 5282279 - DNA, 19 bp, Homo sapiens
attttgatatacattgtgt

SEQ ID NO: 5282280 - DNA, 12 bp, Homo sapiens
attttgatattg

SEQ ID NO: 5282281 - DNA, 19 bp, Homo sapiens
attttgatattttcacaga

SEQ ID NO: 5282282 - DNA, 18 bp, Homo sapiens
attttgatccaagctggt

SEQ ID NO: 5282283 - DNA, 17 bp, Homo sapiens
attttgatcttcaacaa

SEQ ID NO: 5282284 - DNA, 20 bp, Homo sapiens
attttgatcttcaacaaatt

SEQ ID NO: 5282285 - DNA, 21 bp, Homo sapiens
attttgatgagatattaaatt

SEQ ID NO: 5282286 - DNA, 22 bp, Homo sapiens
attttgatgagatattaaattc

SEQ ID NO: 5282287 - DNA, 14 bp, Homo sapiens
attttgatgcacaa

SEQ ID NO: 5282288 - DNA, 12 bp, Homo sapiens
attttgatgcag

SEQ ID NO: 5282289 - DNA, 20 bp, Homo sapiens
attttgatgcagcatttgat

SEQ ID NO: 5282290 - DNA, 12 bp, Homo sapiens
attttgatgtat

SEQ ID NO: 5282291 - DNA, 21 bp, Homo sapiens
attttgatgtgacaataatat

SEQ ID NO: 5282292 - DNA, 20 bp, Homo sapiens
attttgattaaccttttcaa

SEQ ID NO: 5282293 - DNA, 16 bp, Homo sapiens
attttgattattgtat

SEQ ID NO: 5282294 - DNA, 18 bp, Homo sapiens
attttgcaaaatttccag

SEQ ID NO: 5282295 - DNA, 13 bp, Homo sapiens
attttgcaaagat

SEQ ID NO: 5282296 - DNA, 16 bp, Homo sapiens
attttgcaaagattta

SEQ ID NO: 5282297 - DNA, 14 bp, Homo sapiens
attttgcaaatata

SEQ ID NO: 5282298 - DNA, 21 bp, Homo sapiens
attttgcaatcccttaatatc

SEQ ID NO: 5282299 - DNA, 12 bp, Homo sapiens
attttgcaatgt

SEQ ID NO: 5282300 - DNA, 19 bp, Homo sapiens
attttgcaatgtatttagc

SEQ ID NO: 5282301 - DNA, 11 bp, Homo sapiens
attttgcactg

SEQ ID NO: 5282302 - DNA, 15 bp, Homo sapiens
attttgcagaagcta

SEQ ID NO: 5282303 - DNA, 12 bp, Homo sapiens
attttgcagatt

SEQ ID NO: 5282304 - DNA, 18 bp, Homo sapiens
attttgcagcagaagcca

SEQ ID NO: 5282305 - DNA, 22 bp, Homo sapiens
attttgcatatatgttcttcat

SEQ ID NO: 5282306 - DNA, 18 bp, Homo sapiens
attttgcattagacagat

SEQ ID NO: 5282307 - DNA, 17 bp, Homo sapiens
attttgcattccagaat

SEQ ID NO: 5282308 - DNA, 12 bp, Homo sapiens
attttgcattta

SEQ ID NO: 5282309 - DNA, 16 bp, Homo sapiens
attttgcatttgaata

SEQ ID NO: 5282310 - DNA, 19 bp, Homo sapiens
attttgccaagggcataaa

SEQ ID NO: 5282311 - DNA, 20 bp, Homo sapiens
attttgccaagggcataaat

SEQ ID NO: 5282312 - DNA, 22 bp, Homo sapiens
attttgccacagggtactaaaa

SEQ ID NO: 5282313 - DNA, 17 bp, Homo sapiens
attttgccacctttcct

SEQ ID NO: 5282314 - DNA, 16 bp, Homo sapiens
attttgccagttggac

SEQ ID NO: 5282315 - DNA, 14 bp, Homo sapiens
attttgccctcctg

SEQ ID NO: 5282316 - DNA, 15 bp, Homo sapiens
attttgcccttgaca

SEQ ID NO: 5282317 - DNA, 23 bp, Homo sapiens
attttgcctctgtccgtgcccct

SEQ ID NO: 5282318 - DNA, 13 bp, Homo sapiens
attttgcctgtgt

SEQ ID NO: 5282319 - DNA, 20 bp, Homo sapiens
attttgctaaatgtgaatga

SEQ ID NO: 5282320 - DNA, 11 bp, Homo sapiens
attttgctaac

SEQ ID NO: 5282321 - DNA, 13 bp, Homo sapiens
attttgctaactg

SEQ ID NO: 5282322 - DNA, 14 bp, Homo sapiens
attttgctaactgg

SEQ ID NO: 5282323 - DNA, 15 bp, Homo sapiens
attttgctaactggg

SEQ ID NO: 5282324 - DNA, 17 bp, Homo sapiens
attttgctaactggtta

SEQ ID NO: 5282325 - DNA, 18 bp, Homo sapiens
attttgctaactggttaa

SEQ ID NO: 5282326 - DNA, 13 bp, Homo sapiens
attcctcttattg

SEQ ID NO: 5282327 - DNA, 18 bp, Homo sapiens
attcctcttgcctctctc

SEQ ID NO: 5282328 - DNA, 20 bp, Homo sapiens
attcctcttgcctctctcag

SEQ ID NO: 5282329 - DNA, 14 bp, Homo sapiens
attcctctttgccc

SEQ ID NO: 5282330 - DNA, 13 bp, Homo sapiens
attcctctttgct

SEQ ID NO: 5282331 - DNA, 17 bp, Homo sapiens
attcctctttgctttgc

SEQ ID NO: 5282332 - DNA, 12 bp, Homo sapiens
attcctcttttc

SEQ ID NO: 5282333 - DNA, 13 bp, Homo sapiens
attcctcttttta

SEQ ID NO: 5282334 - DNA, 13 bp, Homo sapiens
attcctgaacagg

SEQ ID NO: 5282335 - DNA, 24 bp, Homo sapiens
attcctgaactataacacctgcca

SEQ ID NO: 5282336 - DNA, 11 bp, Homo sapiens
attcctgaccc

SEQ ID NO: 5282337 - DNA, 22 bp, Homo sapiens
attcctgacccaggccgcagct

SEQ ID NO: 5282338 - DNA, 17 bp, Homo sapiens
attcctgaccctcactt

SEQ ID NO: 5282339 - DNA, 16 bp, Homo sapiens
attcctgaccctccct

SEQ ID NO: 5282340 - DNA, 21 bp, Homo sapiens
attcctgaccctccctacctg

SEQ ID NO: 5282341 - DNA, 22 bp, Homo sapiens
attcctgactaacccctctctt

SEQ ID NO: 5282342 - DNA, 17 bp, Homo sapiens
attcctgagattctggg

SEQ ID NO: 5282343 - DNA, 20 bp, Homo sapiens
attcctgagattctgggaaa

SEQ ID NO: 5282344 - DNA, 22 bp, Homo sapiens
attcctgatatgatttaaaaca

SEQ ID NO: 5282345 - DNA, 13 bp, Homo sapiens
attcctgcagcct

SEQ ID NO: 5282346 - DNA, 14 bp, Homo sapiens
attcctgcagcctg

SEQ ID NO: 5282347 - DNA, 16 bp, Homo sapiens
attcctgcatttgata

SEQ ID NO: 5282348 - DNA, 18 bp, Homo sapiens
attcctgcatttgtgaaa

SEQ ID NO: 5282349 - DNA, 13 bp, Homo sapiens
attcctgcatttt

SEQ ID NO: 5282350 - DNA, 20 bp, Homo sapiens
attcctgctatgacagctgg

SEQ ID NO: 5282351 - DNA, 16 bp, Homo sapiens
attcctggaaaactgg

SEQ ID NO: 5282352 - DNA, 14 bp, Homo sapiens
attcctggacatca

SEQ ID NO: 5282353 - DNA, 15 bp, Homo sapiens
attcctggacatcac

SEQ ID NO: 5282354 - DNA, 21 bp, Homo sapiens
attcctggagcccgaggcacc

SEQ ID NO: 5282355 - DNA, 16 bp, Homo sapiens
attcctggcatgacac

SEQ ID NO: 5282356 - DNA, 20 bp, Homo sapiens
attcctggcatgacactcta

SEQ ID NO: 5282357 - DNA, 16 bp, Homo sapiens
attcctggctctaccc

SEQ ID NO: 5282358 - DNA, 11 bp, Homo sapiens
attcctgggcc

SEQ ID NO: 5282359 - DNA, 15 bp, Homo sapiens
attcctgggcctgtc

SEQ ID NO: 5282360 - DNA, 16 bp, Homo sapiens
attcctgggcctgtcc

SEQ ID NO: 5282361 - DNA, 24 bp, Homo sapiens
attcctggtattatttacaatgca

SEQ ID NO: 5282362 - DNA, 15 bp, Homo sapiens
attcctgtaaatgtg

SEQ ID NO: 5282363 - DNA, 16 bp, Homo sapiens
attcctgtaaatgtga

SEQ ID NO: 5282364 - DNA, 16 bp, Homo sapiens
attcctgtaactttta

SEQ ID NO: 5282365 - DNA, 18 bp, Homo sapiens
attcctgtaacttttaat

SEQ ID NO: 5282366 - DNA, 16 bp, Homo sapiens
attcctgtagcatctt

SEQ ID NO: 5282367 - DNA, 17 bp, Homo sapiens
attcctgtagcatcttc

SEQ ID NO: 5282368 - DNA, 16 bp, Homo sapiens
attcctgtcaacaagg

SEQ ID NO: 5282369 - DNA, 16 bp, Homo sapiens
attcctgtccttcaca

SEQ ID NO: 5282370 - DNA, 20 bp, Homo sapiens
attcctgtgttcaatattta

SEQ ID NO: 5282371 - DNA, 16 bp, Homo sapiens
attcctgttctttctt

SEQ ID NO: 5282372 - DNA, 17 bp, Homo sapiens
attcctgttgctgtctt

SEQ ID NO: 5282373 - DNA, 23 bp, Homo sapiens
attccttaaaattttcattctga

SEQ ID NO: 5282374 - DNA, 14 bp, Homo sapiens
attccttaaatgaa

SEQ ID NO: 5282375 - DNA, 22 bp, Homo sapiens
attccttaaatgaactactgct

SEQ ID NO: 5282376 - DNA, 22 bp, Homo sapiens
attccttaccccagctgcggca

SEQ ID NO: 5282377 - DNA, 18 bp, Homo sapiens
attccttactagaaatat

SEQ ID NO: 5282378 - DNA, 22 bp, Homo sapiens
attccttactagaaatatattc

SEQ ID NO: 5282379 - DNA, 19 bp, Homo sapiens
attccttagactcttttcc

SEQ ID NO: 5282380 - DNA, 22 bp, Homo sapiens
attccttagaggaagaatataa

SEQ ID NO: 5282381 - DNA, 22 bp, Homo sapiens
attccttagcagctcaggcgca

SEQ ID NO: 5282382 - DNA, 20 bp, Homo sapiens
attccttaggcttaagagag

SEQ ID NO: 5282383 - DNA, 12 bp, Homo sapiens
attccttattta

SEQ ID NO: 5282384 - DNA, 15 bp, Homo sapiens
attccttatttaaga

SEQ ID NO: 5282385 - DNA, 15 bp, Homo sapiens
attccttcagggtga

SEQ ID NO: 5282386 - DNA, 22 bp, Homo sapiens
attccttccactaactcatagt

SEQ ID NO: 5282387 - DNA, 12 bp, Homo sapiens
attccttcccac

SEQ ID NO: 5282388 - DNA, 12 bp, Homo sapiens
attccttcccat

SEQ ID NO: 5282389 - DNA, 17 bp, Homo sapiens
attccttcctgttctga

SEQ ID NO: 5282390 - DNA, 18 bp, Homo sapiens
attccttcgaaaggcctt

SEQ ID NO: 5282391 - DNA, 22 bp, Homo sapiens
attccttcgaaaggccttcaga

SEQ ID NO: 5282392 - DNA, 21 bp, Homo sapiens
attccttctcccatctcttcc

SEQ ID NO: 5282393 - DNA, 22 bp, Homo sapiens
attccttctctgaacacaggca

SEQ ID NO: 5282394 - DNA, 16 bp, Homo sapiens
attccttctgtagtgt

SEQ ID NO: 5282395 - DNA, 16 bp, Homo sapiens
attccttctttgataa

SEQ ID NO: 5282396 - DNA, 20 bp, Homo sapiens
attccttctttgataatgtt

SEQ ID NO: 5282397 - DNA, 19 bp, Homo sapiens
attccttgagtttcatata

SEQ ID NO: 5282398 - DNA, 20 bp, Homo sapiens
attccttgataatgttgtgg

SEQ ID NO: 5282399 - DNA, 16 bp, Homo sapiens
attccttgccccacag

SEQ ID NO: 5282400 - DNA, 18 bp, Homo sapiens
attccttgccccacagtt

SEQ ID NO: 5282401 - DNA, 20 bp, Homo sapiens
attccttggcatgccttcca

SEQ ID NO: 5282402 - DNA, 15 bp, Homo sapiens
attccttggcccagc

SEQ ID NO: 5282403 - DNA, 16 bp, Homo sapiens
attccttggcccagca

SEQ ID NO: 5282404 - DNA, 18 bp, Homo sapiens
attccttggcccagcagc

SEQ ID NO: 5282405 - DNA, 16 bp, Homo sapiens
attccttgtcaccagc

SEQ ID NO: 5282406 - DNA, 17 bp, Homo sapiens
attccttgtcaccagca

SEQ ID NO: 5282407 - DNA, 14 bp, Homo sapiens
attccttgtcttga

SEQ ID NO: 5282408 - DNA, 12 bp, Homo sapiens
attccttgtgaa

SEQ ID NO: 5282409 - DNA, 19 bp, Homo sapiens
attccttgtgttttgtcct

SEQ ID NO: 5282410 - DNA, 23 bp, Homo sapiens
attccttgtgttttgtcctgcct

SEQ ID NO: 5282411 - DNA, 14 bp, Homo sapiens
attcctttaaaata

SEQ ID NO: 5282412 - DNA, 17 bp, Homo sapiens
attcctttaaaatattg

SEQ ID NO: 5282413 - DNA, 23 bp, Homo sapiens
attcctttaaagtgagtactgtt

SEQ ID NO: 5282414 - DNA, 15 bp, Homo sapiens
attcctttcagagtt

SEQ ID NO: 5282415 - DNA, 14 bp, Homo sapiens
attcctttcccttc

SEQ ID NO: 5282416 - DNA, 16 bp, Homo sapiens
attcctttcccttcct

SEQ ID NO: 5282417 - DNA, 18 bp, Homo sapiens
attcctttcccttcctct

SEQ ID NO: 5282418 - DNA, 14 bp, Homo sapiens
attcctttcccttt

SEQ ID NO: 5282419 - DNA, 18 bp, Homo sapiens
attcctttcctgatcact

SEQ ID NO: 5282420 - DNA, 16 bp, Homo sapiens
attcctttctatcatt

SEQ ID NO: 5282421 - DNA, 17 bp, Homo sapiens
attcctttctatcattt

SEQ ID NO: 5282422 - DNA, 15 bp, Homo sapiens
attcctttctcatcc

SEQ ID NO: 5282423 - DNA, 19 bp, Homo sapiens
attcctttcttgtgccctg

SEQ ID NO: 5282424 - DNA, 22 bp, Homo sapiens
attcctttcttgtgccctgggc

SEQ ID NO: 5282425 - DNA, 14 bp, Homo sapiens
attcctttctttaa

SEQ ID NO: 5282426 - DNA, 15 bp, Homo sapiens
attcctttctttaaa

SEQ ID NO: 5282427 - DNA, 16 bp, Homo sapiens
attcctttgaagagga

SEQ ID NO: 5282428 - DNA, 20 bp, Homo sapiens
attcctttgaagaggaaaat

SEQ ID NO: 5282429 - DNA, 14 bp, Homo sapiens
attcctttgggtat

SEQ ID NO: 5282430 - DNA, 20 bp, Homo sapiens
attccttttaaagaagcttt

SEQ ID NO: 5282431 - DNA, 21 bp, Homo sapiens
attccttttaaagaagcttta

SEQ ID NO: 5282432 - DNA, 23 bp, Homo sapiens
attccttttaaagaagctttatc

SEQ ID NO: 5282433 - DNA, 17 bp, Homo sapiens
attccttttgatgggga

SEQ ID NO: 5282434 - DNA, 20 bp, Homo sapiens
attccttttgatggggagaa

SEQ ID NO: 5282435 - DNA, 18 bp, Homo sapiens
attccttttgtgtacagt

SEQ ID NO: 5282436 - DNA, 15 bp, Homo sapiens
attcgaaatgagctc

SEQ ID NO: 5282437 - DNA, 19 bp, Homo sapiens
attcgaaggaacctgtgtt

SEQ ID NO: 5282438 - DNA, 21 bp, Homo sapiens
attcgaagggtcttaaagaat

SEQ ID NO: 5282439 - DNA, 16 bp, Homo sapiens
attcgaagtcagctaa

SEQ ID NO: 5282440 - DNA, 19 bp, Homo sapiens
attcgaatctctgcccctc

SEQ ID NO: 5282441 - DNA, 13 bp, Homo sapiens
attcgaatgaaat

SEQ ID NO: 5282442 - DNA, 16 bp, Homo sapiens
attcgaatgacactgt

SEQ ID NO: 5282443 - DNA, 21 bp, Homo sapiens
attcgacctgatttacagttt

SEQ ID NO: 5282444 - DNA, 17 bp, Homo sapiens
attcgagacagaacctt

SEQ ID NO: 5282445 - DNA, 14 bp, Homo sapiens
attcgagctatatt

SEQ ID NO: 5282446 - DNA, 21 bp, Homo sapiens
attcgaggtcctcctggcctg

SEQ ID NO: 5282447 - DNA, 22 bp, Homo sapiens
attcgaggtcctcctggcctga

SEQ ID NO: 5282448 - DNA, 19 bp, Homo sapiens
attcgatgcgtattctgtg

SEQ ID NO: 5282449 - DNA, 22 bp, Homo sapiens
attcgcagcagctccgcctggc

SEQ ID NO: 5282450 - DNA, 18 bp, Homo sapiens
attcgcagtgcccagtga

SEQ ID NO: 5282451 - DNA, 14 bp, Homo sapiens
attcgcatgtttaa

SEQ ID NO: 5282452 - DNA, 19 bp, Homo sapiens
attcgccacacagtatttt

SEQ ID NO: 5282453 - DNA, 12 bp, Homo sapiens
attcgccatctg

SEQ ID NO: 5282454 - DNA, 13 bp, Homo sapiens
attcgccatctga

SEQ ID NO: 5282455 - DNA, 20 bp, Homo sapiens
attcgcccaaagccagacag

SEQ ID NO: 5282456 - DNA, 21 bp, Homo sapiens
attcgcctgtgggaagagaag

SEQ ID NO: 5282457 - DNA, 22 bp, Homo sapiens
attcgcctgtgggaagagaagg

SEQ ID NO: 5282458 - DNA, 14 bp, Homo sapiens
attcgctagtgttt

SEQ ID NO: 5282459 - DNA, 17 bp, Homo sapiens
attcgctcccacattct

SEQ ID NO: 5282460 - DNA, 12 bp, Homo sapiens
attcgctgtccc

SEQ ID NO: 5282461 - DNA, 18 bp, Homo sapiens
attcgctgtcccctcagc

SEQ ID NO: 5282462 - DNA, 19 bp, Homo sapiens
attcggaccactaggcctg

SEQ ID NO: 5282463 - DNA, 21 bp, Homo sapiens
attcggaccctgcccataccc

SEQ ID NO: 5282464 - DNA, 14 bp, Homo sapiens
attcgggccacagg

SEQ ID NO: 5282465 - DNA, 15 bp, Homo sapiens
attcgggccacaggg

SEQ ID NO: 5282466 - DNA, 15 bp, Homo sapiens
attcgggccccacct

SEQ ID NO: 5282467 - DNA, 15 bp, Homo sapiens
attcggggctgacga

SEQ ID NO: 5282468 - DNA, 19 bp, Homo sapiens
attcggtgtgaacttttct

SEQ ID NO: 5282469 - DNA, 19 bp, Homo sapiens
attcggtgtgctgccaact

SEQ ID NO: 5282470 - DNA, 22 bp, Homo sapiens
attcggtgtgctgccaacttga

SEQ ID NO: 5282471 - DNA, 16 bp, Homo sapiens
attcgtaagttctgtg

SEQ ID NO: 5282472 - DNA, 22 bp, Homo sapiens
attcgtagatattggacaaaga

SEQ ID NO: 5282473 - DNA, 17 bp, Homo sapiens
attcgtcctttgacaaa

SEQ ID NO: 5282474 - DNA, 12 bp, Homo sapiens
attcgtcttttt

SEQ ID NO: 5282475 - DNA, 12 bp, Homo sapiens
attcgtgaaaac

SEQ ID NO: 5282476 - DNA, 17 bp, Homo sapiens
attcgtggcatgttttg

SEQ ID NO: 5282477 - DNA, 20 bp, Homo sapiens
attcgtgttatgaatctgtg

SEQ ID NO: 5282478 - DNA, 13 bp, Homo sapiens
attcgttctgtgg

SEQ ID NO: 5282479 - DNA, 14 bp, Homo sapiens
attcgttgctccag

SEQ ID NO: 5282480 - DNA, 20 bp, Homo sapiens
attcgttgtgttttttaaga

SEQ ID NO: 5282481 - DNA, 19 bp, Homo sapiens
attcgtttgctagaattga

SEQ ID NO: 5282482 - DNA, 23 bp, Homo sapiens
attctaaaaaagatactgtatat

SEQ ID NO: 5282483 - DNA, 14 bp, Homo sapiens
attctaaaaccatt

SEQ ID NO: 5282484 - DNA, 19 bp, Homo sapiens
attctaaaagtagacaatc

SEQ ID NO: 5282485 - DNA, 20 bp, Homo sapiens
attctaaaatgattgtagta

SEQ ID NO: 5282486 - DNA, 14 bp, Homo sapiens
attctaaaatgcct

SEQ ID NO: 5282487 - DNA, 23 bp, Homo sapiens
attctaaaatgtgatgttctaag

SEQ ID NO: 5282488 - DNA, 17 bp, Homo sapiens
attctaaacagactcat

SEQ ID NO: 5282489 - DNA, 20 bp, Homo sapiens
attctaaacagatgtccctg

SEQ ID NO: 5282490 - DNA, 21 bp, Homo sapiens
attctaaacttagaaatatgc

SEQ ID NO: 5282491 - DNA, 19 bp, Homo sapiens
attctaaagagcacttact

SEQ ID NO: 5282492 - DNA, 19 bp, Homo sapiens
attctaaagattctatagt

SEQ ID NO: 5282493 - DNA, 20 bp, Homo sapiens
attctaaagattctatagtt

SEQ ID NO: 5282494 - DNA, 14 bp, Homo sapiens
attctaaaggtcca

SEQ ID NO: 5282495 - DNA, 16 bp, Homo sapiens
attctaaagttttgca

SEQ ID NO: 5282496 - DNA, 19 bp, Homo sapiens
attctaaataaaatataat

SEQ ID NO: 5282497 - DNA, 16 bp, Homo sapiens
attctaaatgaactca

SEQ ID NO: 5282498 - DNA, 15 bp, Homo sapiens
attctaaatgttcat

SEQ ID NO: 5282499 - DNA, 17 bp, Homo sapiens
attctaaccagagcaag

SEQ ID NO: 5282500 - DNA, 19 bp, Homo sapiens
attctaaccagagcaagct

SEQ ID NO: 5282501 - DNA, 20 bp, Homo sapiens
attctaaccagagcaagctt

SEQ ID NO: 5282502 - DNA, 16 bp, Homo sapiens
attctaacgcaaaaat

SEQ ID NO: 5282503 - DNA, 19 bp, Homo sapiens
attctaacttttttgctat

SEQ ID NO: 5282504 - DNA, 18 bp, Homo sapiens
attctaagaaatatctgt

SEQ ID NO: 5282505 - DNA, 20 bp, Homo sapiens
attttgctatatataaagac

SEQ ID NO: 5282506 - DNA, 17 bp, Homo sapiens
attttgctattgtaaat

SEQ ID NO: 5282507 - DNA, 12 bp, Homo sapiens
attttgctccct

SEQ ID NO: 5282508 - DNA, 13 bp, Homo sapiens
attttgctccctc

SEQ ID NO: 5282509 - DNA, 15 bp, Homo sapiens
attttgctccctctg

SEQ ID NO: 5282510 - DNA, 17 bp, Homo sapiens
attttgctccctctgtt

SEQ ID NO: 5282511 - DNA, 16 bp, Homo sapiens
attttgctctgtgaac

SEQ ID NO: 5282512 - DNA, 19 bp, Homo sapiens
attttgctctgtgaactat

SEQ ID NO: 5282513 - DNA, 14 bp, Homo sapiens
attttgctgagttg

SEQ ID NO: 5282514 - DNA, 15 bp, Homo sapiens
attttgctgagttgt

SEQ ID NO: 5282515 - DNA, 16 bp, Homo sapiens
attttgctgagttgtt

SEQ ID NO: 5282516 - DNA, 19 bp, Homo sapiens
attttgctgagttgttcta

SEQ ID NO: 5282517 - DNA, 19 bp, Homo sapiens
attttgctggaattcctaa

SEQ ID NO: 5282518 - DNA, 12 bp, Homo sapiens
attttgctgtat

SEQ ID NO: 5282519 - DNA, 21 bp, Homo sapiens
attttgctgtcccttttcctt

SEQ ID NO: 5282520 - DNA, 14 bp, Homo sapiens
attttgcttaaaat

SEQ ID NO: 5282521 - DNA, 22 bp, Homo sapiens
attttgcttcccatctgaagag

SEQ ID NO: 5282522 - DNA, 12 bp, Homo sapiens
attttgctttaa

SEQ ID NO: 5282523 - DNA, 20 bp, Homo sapiens
attttgctttatcagaagca

SEQ ID NO: 5282524 - DNA, 14 bp, Homo sapiens
attttggaaaataa

SEQ ID NO: 5282525 - DNA, 17 bp, Homo sapiens
attttggaaaatgacat

SEQ ID NO: 5282526 - DNA, 18 bp, Homo sapiens
attttggaaactgctaaa

SEQ ID NO: 5282527 - DNA, 22 bp, Homo sapiens
attttggaaactgctaaattct

SEQ ID NO: 5282528 - DNA, 18 bp, Homo sapiens
attttggaaagatgttaa

SEQ ID NO: 5282529 - DNA, 22 bp, Homo sapiens
attttggaagaagttttttact

SEQ ID NO: 5282530 - DNA, 20 bp, Homo sapiens
attttggaagaattcatgat

SEQ ID NO: 5282531 - DNA, 22 bp, Homo sapiens
attttggaagaattcatgatgc

SEQ ID NO: 5282532 - DNA, 14 bp, Homo sapiens
attttggaagacat

SEQ ID NO: 5282533 - DNA, 17 bp, Homo sapiens
attttggaagacatata

SEQ ID NO: 5282534 - DNA, 20 bp, Homo sapiens
attttggaagacatatatta

SEQ ID NO: 5282535 - DNA, 17 bp, Homo sapiens
attttggaagattttca

SEQ ID NO: 5282536 - DNA, 21 bp, Homo sapiens
attttggaataagcattgttt

SEQ ID NO: 5282537 - DNA, 20 bp, Homo sapiens
attttggaattggtgtatat

SEQ ID NO: 5282538 - DNA, 16 bp, Homo sapiens
attttggacgtgtgag

SEQ ID NO: 5282539 - DNA, 20 bp, Homo sapiens
attttggagagtttcctgaa

SEQ ID NO: 5282540 - DNA, 21 bp, Homo sapiens
attttggagagtttcctgaaa

SEQ ID NO: 5282541 - DNA, 14 bp, Homo sapiens
attttggaggtgct

SEQ ID NO: 5282542 - DNA, 22 bp, Homo sapiens
attttggaggtgcttgatctat

SEQ ID NO: 5282543 - DNA, 12 bp, Homo sapiens
attttggatata

SEQ ID NO: 5282544 - DNA, 15 bp, Homo sapiens
attttggatgtcatt

SEQ ID NO: 5282545 - DNA, 20 bp, Homo sapiens
attttggcaagaagactgta

SEQ ID NO: 5282546 - DNA, 19 bp, Homo sapiens
attttggcgctattacaaa

SEQ ID NO: 5282547 - DNA, 16 bp, Homo sapiens
attttggctcactgca

SEQ ID NO: 5282548 - DNA, 15 bp, Homo sapiens
attttggctcagagt

SEQ ID NO: 5282549 - DNA, 18 bp, Homo sapiens
attttggctcagagtcca

SEQ ID NO: 5282550 - DNA, 16 bp, Homo sapiens
attttggcttcatttc

SEQ ID NO: 5282551 - DNA, 19 bp, Homo sapiens
attttggcttcatttcaat

SEQ ID NO: 5282552 - DNA, 17 bp, Homo sapiens
attttggctttctccct

SEQ ID NO: 5282553 - DNA, 16 bp, Homo sapiens
attttgggacttctac

SEQ ID NO: 5282554 - DNA, 14 bp, Homo sapiens
attttgggcatgtg

SEQ ID NO: 5282555 - DNA, 18 bp, Homo sapiens
attttgggcctgttcctt

SEQ ID NO: 5282556 - DNA, 20 bp, Homo sapiens
attttgggccttgctaaatt

SEQ ID NO: 5282557 - DNA, 21 bp, Homo sapiens
attttggggtacccactgctc

SEQ ID NO: 5282558 - DNA, 14 bp, Homo sapiens
attttggggtctct

SEQ ID NO: 5282559 - DNA, 16 bp, Homo sapiens
attttggggtctcttt

SEQ ID NO: 5282560 - DNA, 19 bp, Homo sapiens
attttgggtatattttcaa

SEQ ID NO: 5282561 - DNA, 19 bp, Homo sapiens
attttgggtgccattaaat

SEQ ID NO: 5282562 - DNA, 20 bp, Homo sapiens
attttgggtggccaaagtgt

SEQ ID NO: 5282563 - DNA, 19 bp, Homo sapiens
attttgggttcaggcctgg

SEQ ID NO: 5282564 - DNA, 15 bp, Homo sapiens
attttgggttgttta

SEQ ID NO: 5282565 - DNA, 16 bp, Homo sapiens
attttgggttgtttaa

SEQ ID NO: 5282566 - DNA, 22 bp, Homo sapiens
attttgggttgtttaaaaattt

SEQ ID NO: 5282567 - DNA, 20 bp, Homo sapiens
attttggtattacactgtat

SEQ ID NO: 5282568 - DNA, 21 bp, Homo sapiens
attttggtccaaattctttat

SEQ ID NO: 5282569 - DNA, 16 bp, Homo sapiens
attttggtgagaaatg

SEQ ID NO: 5282570 - DNA, 19 bp, Homo sapiens
attttggtgatgtaaaaca

SEQ ID NO: 5282571 - DNA, 16 bp, Homo sapiens
attttggtgctattta

SEQ ID NO: 5282572 - DNA, 18 bp, Homo sapiens
attttggtgtgcatctgt

SEQ ID NO: 5282573 - DNA, 23 bp, Homo sapiens
attttggttcccttgtaaagaca

SEQ ID NO: 5282574 - DNA, 17 bp, Homo sapiens
attttggttcttctcaa

SEQ ID NO: 5282575 - DNA, 22 bp, Homo sapiens
attttggttgtaattaaatttt

SEQ ID NO: 5282576 - DNA, 14 bp, Homo sapiens
attttggttgtatt

SEQ ID NO: 5282577 - DNA, 20 bp, Homo sapiens
attttggttgtattctttga

SEQ ID NO: 5282578 - DNA, 21 bp, Homo sapiens
attttggttgtattctttgat

SEQ ID NO: 5282579 - DNA, 15 bp, Homo sapiens
attttggtttagtgc

SEQ ID NO: 5282580 - DNA, 21 bp, Homo sapiens
attttggtttatttttgtaat

SEQ ID NO: 5282581 - DNA, 12 bp, Homo sapiens
attttggtttct

SEQ ID NO: 5282582 - DNA, 18 bp, Homo sapiens
attttggttttctactgt

SEQ ID NO: 5282583 - DNA, 20 bp, Homo sapiens
attttggtttttcctcattg

SEQ ID NO: 5282584 - DNA, 22 bp, Homo sapiens
attttggtttttctcatttgaa

SEQ ID NO: 5282585 - DNA, 17 bp, Homo sapiens
attttgtaaaaagaaat

SEQ ID NO: 5282586 - DNA, 14 bp, Homo sapiens
attttgtaaaacaa

SEQ ID NO: 5282587 - DNA, 19 bp, Homo sapiens
attttgtaaaacaatgcca

SEQ ID NO: 5282588 - DNA, 14 bp, Homo sapiens
attttgtaaaatgt

SEQ ID NO: 5282589 - DNA, 17 bp, Homo sapiens
attttgtaaactcaaaa

SEQ ID NO: 5282590 - DNA, 19 bp, Homo sapiens
attttgtaaactcaaaata

SEQ ID NO: 5282591 - DNA, 18 bp, Homo sapiens
attttgtaaatctgtact

SEQ ID NO: 5282592 - DNA, 19 bp, Homo sapiens
attttgtaaatctgtactt

SEQ ID NO: 5282593 - DNA, 20 bp, Homo sapiens
attttgtaaatctgtacttt

SEQ ID NO: 5282594 - DNA, 12 bp, Homo sapiens
attttgtaactg

SEQ ID NO: 5282595 - DNA, 19 bp, Homo sapiens
attttgtaacttccatgtg

SEQ ID NO: 5282596 - DNA, 20 bp, Homo sapiens
attttgtaagctataacata

SEQ ID NO: 5282597 - DNA, 12 bp, Homo sapiens
attttgtaataa

SEQ ID NO: 5282598 - DNA, 18 bp, Homo sapiens
attttgtaataaactctc

SEQ ID NO: 5282599 - DNA, 19 bp, Homo sapiens
attttgtaataaactctct

SEQ ID NO: 5282600 - DNA, 22 bp, Homo sapiens
attttgtaataataaagaatag

SEQ ID NO: 5282601 - DNA, 18 bp, Homo sapiens
attttgtaatatttgaat

SEQ ID NO: 5282602 - DNA, 15 bp, Homo sapiens
attttgtaattatga

SEQ ID NO: 5282603 - DNA, 17 bp, Homo sapiens
attttgtacaaagatat

SEQ ID NO: 5282604 - DNA, 15 bp, Homo sapiens
attttgtacagaatt

SEQ ID NO: 5282605 - DNA, 15 bp, Homo sapiens
attttgtacatactg

SEQ ID NO: 5282606 - DNA, 22 bp, Homo sapiens
attttgtacatgtatgaaattg

SEQ ID NO: 5282607 - DNA, 12 bp, Homo sapiens
attttgtacatt

SEQ ID NO: 5282608 - DNA, 16 bp, Homo sapiens
attttgtagatgtgat

SEQ ID NO: 5282609 - DNA, 20 bp, Homo sapiens
attttgtagttaatataaat

SEQ ID NO: 5282610 - DNA, 17 bp, Homo sapiens
attttgtataattgtat

SEQ ID NO: 5282611 - DNA, 14 bp, Homo sapiens
attttgtatatatc

SEQ ID NO: 5282612 - DNA, 19 bp, Homo sapiens
attttgtatatttaggaaa

SEQ ID NO: 5282613 - DNA, 18 bp, Homo sapiens
attttgtatatttgtatt

SEQ ID NO: 5282614 - DNA, 14 bp, Homo sapiens
attttgtatctgca

SEQ ID NO: 5282615 - DNA, 10 bp, Homo sapiens
attttgtatg

SEQ ID NO: 5282616 - DNA, 18 bp, Homo sapiens
attttgtatgaggtcctc

SEQ ID NO: 5282617 - DNA, 22 bp, Homo sapiens
attttgtatgaggtcctcaggt

SEQ ID NO: 5282618 - DNA, 12 bp, Homo sapiens
attttgtatgca

SEQ ID NO: 5282619 - DNA, 23 bp, Homo sapiens
attttgtatgcaagcagtttcaa

SEQ ID NO: 5282620 - DNA, 13 bp, Homo sapiens
attttgtatggag

SEQ ID NO: 5282621 - DNA, 20 bp, Homo sapiens
attttgtatggagttaaata

SEQ ID NO: 5282622 - DNA, 14 bp, Homo sapiens
attttgtatgtcaa

SEQ ID NO: 5282623 - DNA, 16 bp, Homo sapiens
attttgtatgtcaata

SEQ ID NO: 5282624 - DNA, 17 bp, Homo sapiens
attttgtatgtcaataa

SEQ ID NO: 5282625 - DNA, 15 bp, Homo sapiens
attttgtatgttaaa

SEQ ID NO: 5282626 - DNA, 10 bp, Homo sapiens
attttgtatt

SEQ ID NO: 5282627 - DNA, 17 bp, Homo sapiens
attttgtattaatttct

SEQ ID NO: 5282628 - DNA, 20 bp, Homo sapiens
attttgtattacatctaatg

SEQ ID NO: 5282629 - DNA, 14 bp, Homo sapiens
attttgtattgcca

SEQ ID NO: 5282630 - DNA, 15 bp, Homo sapiens
attttgtattgccat

SEQ ID NO: 5282631 - DNA, 20 bp, Homo sapiens
attttgtattttccaagtgt

SEQ ID NO: 5282632 - DNA, 22 bp, Homo sapiens
attttgtattttccaagtgtgc

SEQ ID NO: 5282633 - DNA, 16 bp, Homo sapiens
attttgtcacattatt

SEQ ID NO: 5282634 - DNA, 21 bp, Homo sapiens
attttgtcacattatttatta

SEQ ID NO: 5282635 - DNA, 20 bp, Homo sapiens
attttgtcaccagaacacaa

SEQ ID NO: 5282636 - DNA, 13 bp, Homo sapiens
attttgtcagttt

SEQ ID NO: 5282637 - DNA, 13 bp, Homo sapiens
attttgtccaagt

SEQ ID NO: 5282638 - DNA, 20 bp, Homo sapiens
attttgtccaagttcacagt

SEQ ID NO: 5282639 - DNA, 20 bp, Homo sapiens
attttgtccaccttttaagt

SEQ ID NO: 5282640 - DNA, 21 bp, Homo sapiens
attttgtcccttccatttcta

SEQ ID NO: 5282641 - DNA, 18 bp, Homo sapiens
attttgtcctttcatgta

SEQ ID NO: 5282642 - DNA, 15 bp, Homo sapiens
attttgtctcacttt

SEQ ID NO: 5282643 - DNA, 20 bp, Homo sapiens
attttgtctgccccaagttt

SEQ ID NO: 5282644 - DNA, 18 bp, Homo sapiens
attttgtcttaagtgttt

SEQ ID NO: 5282645 - DNA, 15 bp, Homo sapiens
attttgtcttattct

SEQ ID NO: 5282646 - DNA, 24 bp, Homo sapiens
attttgtgaaacagacttgtatat

SEQ ID NO: 5282647 - DNA, 17 bp, Homo sapiens
attttgtgaaatttcat

SEQ ID NO: 5282648 - DNA, 12 bp, Homo sapiens
attttgtgaagc

SEQ ID NO: 5282649 - DNA, 18 bp, Homo sapiens
attttgtgaagccctgtt

SEQ ID NO: 5282650 - DNA, 18 bp, Homo sapiens
attttgtgaagtgaagga

SEQ ID NO: 5282651 - DNA, 17 bp, Homo sapiens
attttgtgaatctattg

SEQ ID NO: 5282652 - DNA, 22 bp, Homo sapiens
attttgtgatgaataaaataat

SEQ ID NO: 5282653 - DNA, 13 bp, Homo sapiens
attttgtgcaaca

SEQ ID NO: 5282654 - DNA, 13 bp, Homo sapiens
attttgtgcaagc

SEQ ID NO: 5282655 - DNA, 22 bp, Homo sapiens
attttgtgcagttaatacttaa

SEQ ID NO: 5282656 - DNA, 12 bp, Homo sapiens
attttgtgcatt

SEQ ID NO: 5282657 - DNA, 16 bp, Homo sapiens
attttgtgcattcttt

SEQ ID NO: 5282658 - DNA, 22 bp, Homo sapiens
attttgtgcattctttggtaat

SEQ ID NO: 5282659 - DNA, 16 bp, Homo sapiens
attttgtgctcattta

SEQ ID NO: 5282660 - DNA, 16 bp, Homo sapiens
attttgtgctctttcc

SEQ ID NO: 5282661 - DNA, 20 bp, Homo sapiens
attttgtgggctggttgctg

SEQ ID NO: 5282662 - DNA, 20 bp, Homo sapiens
attttgtgggcttaattgaa

SEQ ID NO: 5282663 - DNA, 17 bp, Homo sapiens
attttgtggttaagaga

SEQ ID NO: 5282664 - DNA, 19 bp, Homo sapiens
attttgtggttaagagaat

SEQ ID NO: 5282665 - DNA, 15 bp, Homo sapiens
attttgtggttctat

SEQ ID NO: 5282666 - DNA, 22 bp, Homo sapiens
attttgtgtcttttaaactgga

SEQ ID NO: 5282667 - DNA, 15 bp, Homo sapiens
attttgtgtgaccaa

SEQ ID NO: 5282668 - DNA, 12 bp, Homo sapiens
attttgtgtgag

SEQ ID NO: 5282669 - DNA, 15 bp, Homo sapiens
attttgtgtgagact

SEQ ID NO: 5282670 - DNA, 19 bp, Homo sapiens
attttgtgtgatgcatgta

SEQ ID NO: 5282671 - DNA, 17 bp, Homo sapiens
attttgtgtttaggaac

SEQ ID NO: 5282672 - DNA, 18 bp, Homo sapiens
attttgtgtttattcttg

SEQ ID NO: 5282673 - DNA, 19 bp, Homo sapiens
attttgtgtttattcttga

SEQ ID NO: 5282674 - DNA, 15 bp, Homo sapiens
attttgttaaagctg

SEQ ID NO: 5282675 - DNA, 18 bp, Homo sapiens
attttgttaagaagttga

SEQ ID NO: 5282676 - DNA, 19 bp, Homo sapiens
attttgttaagaatttcaa

SEQ ID NO: 5282677 - DNA, 19 bp, Homo sapiens
attttgttaataataagat

SEQ ID NO: 5282678 - DNA, 22 bp, Homo sapiens
attttgttacataaggatgact

SEQ ID NO: 5282679 - DNA, 17 bp, Homo sapiens
attttgttactgtctgt

SEQ ID NO: 5282680 - DNA, 22 bp, Homo sapiens
attttgttactgtctgtagtgt

SEQ ID NO: 5282681 - DNA, 20 bp, Homo sapiens
attttgttatagttcatagt

SEQ ID NO: 5282682 - DNA, 14 bp, Homo sapiens
attttgttcataca

SEQ ID NO: 5282683 - DNA, 21 bp, Homo sapiens
attctaagaaatatctgtgaa

SEQ ID NO: 5282684 - DNA, 23 bp, Homo sapiens
attctaagacttactctaagatc

SEQ ID NO: 5282685 - DNA, 15 bp, Homo sapiens
attctaagattgtac

SEQ ID NO: 5282686 - DNA, 20 bp, Homo sapiens
attctaagccagttttcatt

SEQ ID NO: 5282687 - DNA, 23 bp, Homo sapiens
attctaagccagttttcattttg

SEQ ID NO: 5282688 - DNA, 19 bp, Homo sapiens
attctaagccctttgccat

SEQ ID NO: 5282689 - DNA, 13 bp, Homo sapiens
attctaagttatt

SEQ ID NO: 5282690 - DNA, 16 bp, Homo sapiens
attctaataagctagt

SEQ ID NO: 5282691 - DNA, 13 bp, Homo sapiens
attctaatctaac

SEQ ID NO: 5282692 - DNA, 23 bp, Homo sapiens
attctaatgatgatcaattatag

SEQ ID NO: 5282693 - DNA, 17 bp, Homo sapiens
attctaatgatggccca

SEQ ID NO: 5282694 - DNA, 13 bp, Homo sapiens
attctaatgcata

SEQ ID NO: 5282695 - DNA, 15 bp, Homo sapiens
attctaatgcatatt

SEQ ID NO: 5282696 - DNA, 16 bp, Homo sapiens
attctaatggtaactt

SEQ ID NO: 5282697 - DNA, 18 bp, Homo sapiens
attctaatggtaactttt

SEQ ID NO: 5282698 - DNA, 12 bp, Homo sapiens
attctaatgtct

SEQ ID NO: 5282699 - DNA, 18 bp, Homo sapiens
attctaatgtcttcattt

SEQ ID NO: 5282700 - DNA, 14 bp, Homo sapiens
attctaattaaaat

SEQ ID NO: 5282701 - DNA, 15 bp, Homo sapiens
attctaattcttcat

SEQ ID NO: 5282702 - DNA, 19 bp, Homo sapiens
attctaattcttcattata

SEQ ID NO: 5282703 - DNA, 13 bp, Homo sapiens
attctaattgtca

SEQ ID NO: 5282704 - DNA, 23 bp, Homo sapiens
attctaattttatatatagagaa

SEQ ID NO: 5282705 - DNA, 19 bp, Homo sapiens
attctacacatatatgtat

SEQ ID NO: 5282706 - DNA, 20 bp, Homo sapiens
attctacacatatatgtata

SEQ ID NO: 5282707 - DNA, 17 bp, Homo sapiens
attctacacctggacca

SEQ ID NO: 5282708 - DNA, 14 bp, Homo sapiens
attctacagaataa

SEQ ID NO: 5282709 - DNA, 21 bp, Homo sapiens
attctaccgtaattgctttgt

SEQ ID NO: 5282710 - DNA, 22 bp, Homo sapiens
attctaccgtaattgctttgtg

SEQ ID NO: 5282711 - DNA, 20 bp, Homo sapiens
attctacctggctacaatta

SEQ ID NO: 5282712 - DNA, 15 bp, Homo sapiens
attctacctttgtaa

SEQ ID NO: 5282713 - DNA, 18 bp, Homo sapiens
attctacctttgtaaaac

SEQ ID NO: 5282714 - DNA, 18 bp, Homo sapiens
attctactaaatatttta

SEQ ID NO: 5282715 - DNA, 22 bp, Homo sapiens
attctactagcaggcaatgctg

SEQ ID NO: 5282716 - DNA, 13 bp, Homo sapiens
attctactggaaa

SEQ ID NO: 5282717 - DNA, 16 bp, Homo sapiens
attctactggcctgta

SEQ ID NO: 5282718 - DNA, 19 bp, Homo sapiens
attctactggcctgtaatc

SEQ ID NO: 5282719 - DNA, 15 bp, Homo sapiens
attctacttcagctt

SEQ ID NO: 5282720 - DNA, 15 bp, Homo sapiens
attctacttgctctg

SEQ ID NO: 5282721 - DNA, 17 bp, Homo sapiens
attctacttgctctgga

SEQ ID NO: 5282722 - DNA, 23 bp, Homo sapiens
attctacttgctctggacctgcc

SEQ ID NO: 5282723 - DNA, 14 bp, Homo sapiens
attctacttgctta

SEQ ID NO: 5282724 - DNA, 13 bp, Homo sapiens
attctacttttaa

SEQ ID NO: 5282725 - DNA, 21 bp, Homo sapiens
attctagaccctatacatttt

SEQ ID NO: 5282726 - DNA, 22 bp, Homo sapiens
attctagagggatccaccgcca

SEQ ID NO: 5282727 - DNA, 22 bp, Homo sapiens
attctagatcagatgctccaag

SEQ ID NO: 5282728 - DNA, 21 bp, Homo sapiens
attctagatcctgcaccccag

SEQ ID NO: 5282729 - DNA, 13 bp, Homo sapiens
attctagcacctt

SEQ ID NO: 5282730 - DNA, 16 bp, Homo sapiens
attctagccaaactat

SEQ ID NO: 5282731 - DNA, 15 bp, Homo sapiens
attctagctaatgta

SEQ ID NO: 5282732 - DNA, 18 bp, Homo sapiens
attctagctgtatgattt

SEQ ID NO: 5282733 - DNA, 22 bp, Homo sapiens
attctagctgtatgatttgttt

SEQ ID NO: 5282734 - DNA, 14 bp, Homo sapiens
attctagctttttt

SEQ ID NO: 5282735 - DNA, 17 bp, Homo sapiens
attctagcttttttcct

SEQ ID NO: 5282736 - DNA, 19 bp, Homo sapiens
attctagcttttttcctcc

SEQ ID NO: 5282737 - DNA, 19 bp, Homo sapiens
attctaggaaacccaagga

SEQ ID NO: 5282738 - DNA, 16 bp, Homo sapiens
attctaggatgtggag

SEQ ID NO: 5282739 - DNA, 20 bp, Homo sapiens
attctaggcatcccagggga

SEQ ID NO: 5282740 - DNA, 17 bp, Homo sapiens
attctagggtttcttaa

SEQ ID NO: 5282741 - DNA, 19 bp, Homo sapiens
attctagggtttcttaaat

SEQ ID NO: 5282742 - DNA, 22 bp, Homo sapiens
attctagggtttcttaaatata

SEQ ID NO: 5282743 - DNA, 16 bp, Homo sapiens
attctaggtctgtaat

SEQ ID NO: 5282744 - DNA, 22 bp, Homo sapiens
attctagtactagaaactgaag

SEQ ID NO: 5282745 - DNA, 15 bp, Homo sapiens
attctagtcaactgc

SEQ ID NO: 5282746 - DNA, 22 bp, Homo sapiens
attctagtcaactgctgtttta

SEQ ID NO: 5282747 - DNA, 16 bp, Homo sapiens
attctagtctgtttca

SEQ ID NO: 5282748 - DNA, 18 bp, Homo sapiens
attctagtctgtttcatt

SEQ ID NO: 5282749 - DNA, 21 bp, Homo sapiens
attctagtgtctgacttttgt

SEQ ID NO: 5282750 - DNA, 23 bp, Homo sapiens
attctagtgtctgacttttgtta

SEQ ID NO: 5282751 - DNA, 17 bp, Homo sapiens
attctagttcagagcca

SEQ ID NO: 5282752 - DNA, 16 bp, Homo sapiens
attctagttttgtcaa

SEQ ID NO: 5282753 - DNA, 24 bp, Homo sapiens
attctataaaactctgcatgtaga

SEQ ID NO: 5282754 - DNA, 22 bp, Homo sapiens
attctataaacatatgcaaaca

SEQ ID NO: 5282755 - DNA, 14 bp, Homo sapiens
attctataaattca

SEQ ID NO: 5282756 - DNA, 15 bp, Homo sapiens
attctataaattcaa

SEQ ID NO: 5282757 - DNA, 14 bp, Homo sapiens
attctataagctat

SEQ ID NO: 5282758 - DNA, 15 bp, Homo sapiens
attctataaggccat

SEQ ID NO: 5282759 - DNA, 21 bp, Homo sapiens
attctatacacaccctgcccc

SEQ ID NO: 5282760 - DNA, 23 bp, Homo sapiens
attctatacacaccctgcccctg

SEQ ID NO: 5282761 - DNA, 17 bp, Homo sapiens
attctatactttcttgt

SEQ ID NO: 5282762 - DNA, 16 bp, Homo sapiens
attctatagttctaga

SEQ ID NO: 5282763 - DNA, 23 bp, Homo sapiens
attctatatgaatttaaatataa

SEQ ID NO: 5282764 - DNA, 15 bp, Homo sapiens
attctatatgatcct

SEQ ID NO: 5282765 - DNA, 21 bp, Homo sapiens
attctatcactggcaatattt

SEQ ID NO: 5282766 - DNA, 21 bp, Homo sapiens
attctatccacatccctaaca

SEQ ID NO: 5282767 - DNA, 14 bp, Homo sapiens
attctatccccaat

SEQ ID NO: 5282768 - DNA, 15 bp, Homo sapiens
attctatcgttatta

SEQ ID NO: 5282769 - DNA, 21 bp, Homo sapiens
attctatcgttattataaatg

SEQ ID NO: 5282770 - DNA, 13 bp, Homo sapiens
attctatctacat

SEQ ID NO: 5282771 - DNA, 15 bp, Homo sapiens
attctatctattcct

SEQ ID NO: 5282772 - DNA, 20 bp, Homo sapiens
attctatcttttgtttcctt

SEQ ID NO: 5282773 - DNA, 21 bp, Homo sapiens
attctatcttttgtttccttt

SEQ ID NO: 5282774 - DNA, 21 bp, Homo sapiens
attctatgcctgtatttccaa

SEQ ID NO: 5282775 - DNA, 17 bp, Homo sapiens
attctatggagctattt

SEQ ID NO: 5282776 - DNA, 13 bp, Homo sapiens
attctatgtaact

SEQ ID NO: 5282777 - DNA, 18 bp, Homo sapiens
attctatgtaacttgttg

SEQ ID NO: 5282778 - DNA, 13 bp, Homo sapiens
attctatgtgtca

SEQ ID NO: 5282779 - DNA, 14 bp, Homo sapiens
attctatgttaaat

SEQ ID NO: 5282780 - DNA, 21 bp, Homo sapiens
attctatgttaaatactgtgc

SEQ ID NO: 5282781 - DNA, 18 bp, Homo sapiens
attctatgttaatatttt

SEQ ID NO: 5282782 - DNA, 15 bp, Homo sapiens
attctattaaagtgc

SEQ ID NO: 5282783 - DNA, 13 bp, Homo sapiens
attctattatata

SEQ ID NO: 5282784 - DNA, 14 bp, Homo sapiens
attctattcaaaag

SEQ ID NO: 5282785 - DNA, 14 bp, Homo sapiens
attctattctaata

SEQ ID NO: 5282786 - DNA, 13 bp, Homo sapiens
attctattctcca

SEQ ID NO: 5282787 - DNA, 22 bp, Homo sapiens
attctattgcagttatagaaaa

SEQ ID NO: 5282788 - DNA, 23 bp, Homo sapiens
attctattgccttctttgaagaa

SEQ ID NO: 5282789 - DNA, 20 bp, Homo sapiens
attctatttatatgtacatg

SEQ ID NO: 5282790 - DNA, 21 bp, Homo sapiens
attctatttcaacttcaggaa

SEQ ID NO: 5282791 - DNA, 23 bp, Homo sapiens
attctatttcccctcttctgcta

SEQ ID NO: 5282792 - DNA, 13 bp, Homo sapiens
attctattttaca

SEQ ID NO: 5282793 - DNA, 20 bp, Homo sapiens
attctattttgctggagact

SEQ ID NO: 5282794 - DNA, 17 bp, Homo sapiens
attctatttttgtcctt

SEQ ID NO: 5282795 - DNA, 15 bp, Homo sapiens
attctcaaagatgca

SEQ ID NO: 5282796 - DNA, 19 bp, Homo sapiens
attctcaaagttaaaagta

SEQ ID NO: 5282797 - DNA, 21 bp, Homo sapiens
attctcaaagttaaaagtaaa

SEQ ID NO: 5282798 - DNA, 19 bp, Homo sapiens
attctcaaagtttcctaat

SEQ ID NO: 5282799 - DNA, 17 bp, Homo sapiens
attctcaaagttttatt

SEQ ID NO: 5282800 - DNA, 15 bp, Homo sapiens
attctcaagacctga

SEQ ID NO: 5282801 - DNA, 18 bp, Homo sapiens
attctcaagacctgagta

SEQ ID NO: 5282802 - DNA, 16 bp, Homo sapiens
attctcaagccctgca

SEQ ID NO: 5282803 - DNA, 21 bp, Homo sapiens
attctcaagccgcatcccaga

SEQ ID NO: 5282804 - DNA, 22 bp, Homo sapiens
attctcaatcatgggaatttta

SEQ ID NO: 5282805 - DNA, 12 bp, Homo sapiens
attctcacaata

SEQ ID NO: 5282806 - DNA, 16 bp, Homo sapiens
attctcacaattgtaa

SEQ ID NO: 5282807 - DNA, 10 bp, Homo sapiens
attctcacat

SEQ ID NO: 5282808 - DNA, 18 bp, Homo sapiens
attctcaccagctgtgtc

SEQ ID NO: 5282809 - DNA, 13 bp, Homo sapiens
attctcaccagga

SEQ ID NO: 5282810 - DNA, 17 bp, Homo sapiens
attctcaccctgtgaaa

SEQ ID NO: 5282811 - DNA, 23 bp, Homo sapiens
attctcacctaaaccctctgtga

SEQ ID NO: 5282812 - DNA, 14 bp, Homo sapiens
attctcacctgcct

SEQ ID NO: 5282813 - DNA, 19 bp, Homo sapiens
attctcactctgctttgca

SEQ ID NO: 5282814 - DNA, 13 bp, Homo sapiens
attctcactgcta

SEQ ID NO: 5282815 - DNA, 20 bp, Homo sapiens
attctcagaatctcaaataa

SEQ ID NO: 5282816 - DNA, 17 bp, Homo sapiens
attctcagagcatgtgt

SEQ ID NO: 5282817 - DNA, 17 bp, Homo sapiens
attctcagccacaacca

SEQ ID NO: 5282818 - DNA, 12 bp, Homo sapiens
attctcagggct

SEQ ID NO: 5282819 - DNA, 14 bp, Homo sapiens
attctcagggctgg

SEQ ID NO: 5282820 - DNA, 21 bp, Homo sapiens
attctcaggtaatcattttaa

SEQ ID NO: 5282821 - DNA, 14 bp, Homo sapiens
attctcagtgccaa

SEQ ID NO: 5282822 - DNA, 19 bp, Homo sapiens
attctcataattcctacag

SEQ ID NO: 5282823 - DNA, 22 bp, Homo sapiens
attctcataattcctacagcac

SEQ ID NO: 5282824 - DNA, 20 bp, Homo sapiens
attctcatatgtagccctca

SEQ ID NO: 5282825 - DNA, 21 bp, Homo sapiens
attctcatatgtagccctcat

SEQ ID NO: 5282826 - DNA, 22 bp, Homo sapiens
attctcatgcctcagcctcctg

SEQ ID NO: 5282827 - DNA, 22 bp, Homo sapiens
attctcatgcctcatcctccca

SEQ ID NO: 5282828 - DNA, 19 bp, Homo sapiens
attctcatgggaaggggag

SEQ ID NO: 5282829 - DNA, 18 bp, Homo sapiens
attctcattaaaagaata

SEQ ID NO: 5282830 - DNA, 19 bp, Homo sapiens
attctcattaaaagaatat

SEQ ID NO: 5282831 - DNA, 18 bp, Homo sapiens
attctcattatgaagatg

SEQ ID NO: 5282832 - DNA, 12 bp, Homo sapiens
attctcattatt

SEQ ID NO: 5282833 - DNA, 14 bp, Homo sapiens
attctcattatttc

SEQ ID NO: 5282834 - DNA, 16 bp, Homo sapiens
attctcattatttcat

SEQ ID NO: 5282835 - DNA, 21 bp, Homo sapiens
attctcattggaaatttagca

SEQ ID NO: 5282836 - DNA, 22 bp, Homo sapiens
attctcattggaaatttagcat

SEQ ID NO: 5282837 - DNA, 23 bp, Homo sapiens
attctcattggggttgcaacaat

SEQ ID NO: 5282838 - DNA, 17 bp, Homo sapiens
attctcatttgttctca

SEQ ID NO: 5282839 - DNA, 16 bp, Homo sapiens
attctccaaatgattt

SEQ ID NO: 5282840 - DNA, 18 bp, Homo sapiens
attctccaacccaaagta

SEQ ID NO: 5282841 - DNA, 13 bp, Homo sapiens
attctccacctgc

SEQ ID NO: 5282842 - DNA, 16 bp, Homo sapiens
attctccacctgccag

SEQ ID NO: 5282843 - DNA, 18 bp, Homo sapiens
attctccacctgccaggg

SEQ ID NO: 5282844 - DNA, 18 bp, Homo sapiens
attctccactcactgcat

SEQ ID NO: 5282845 - DNA, 13 bp, Homo sapiens
attctccactgtg

SEQ ID NO: 5282846 - DNA, 13 bp, Homo sapiens
attctccagacat

SEQ ID NO: 5282847 - DNA, 21 bp, Homo sapiens
attctccaggggtttacagtg

SEQ ID NO: 5282848 - DNA, 19 bp, Homo sapiens
attctccagttgattattt

SEQ ID NO: 5282849 - DNA, 14 bp, Homo sapiens
attctccatttgtt

SEQ ID NO: 5282850 - DNA, 18 bp, Homo sapiens
attctccatttgttatct

SEQ ID NO: 5282851 - DNA, 15 bp, Homo sapiens
attctcccagctcta

SEQ ID NO: 5282852 - DNA, 20 bp, Homo sapiens
attctcccagctctagcctc

SEQ ID NO: 5282853 - DNA, 23 bp, Homo sapiens
attctcccagctctagcctctgg

SEQ ID NO: 5282854 - DNA, 16 bp, Homo sapiens
attctccccacccacc

SEQ ID NO: 5282855 - DNA, 17 bp, Homo sapiens
attctccccacccaccc

SEQ ID NO: 5282856 - DNA, 19 bp, Homo sapiens
attctcccgcttcctggcc

SEQ ID NO: 5282857 - DNA, 22 bp, Homo sapiens
attctcccgcttcctggcctcc

SEQ ID NO: 5282858 - DNA, 20 bp, Homo sapiens
attctccctaaggaatctga

SEQ ID NO: 5282859 - DNA, 22 bp, Homo sapiens
attctccctaaggaatctgaaa

SEQ ID NO: 5282860 - DNA, 18 bp, Homo sapiens
attttgttcatacatatt

SEQ ID NO: 5282861 - DNA, 17 bp, Homo sapiens
attttgttcctgtttat

SEQ ID NO: 5282862 - DNA, 15 bp, Homo sapiens
attttgttctctggg

SEQ ID NO: 5282863 - DNA, 22 bp, Homo sapiens
attttgttctctgggagaaaat

SEQ ID NO: 5282864 - DNA, 14 bp, Homo sapiens
attttgttgaaatt

SEQ ID NO: 5282865 - DNA, 21 bp, Homo sapiens
attttgttggcatagctctgg

SEQ ID NO: 5282866 - DNA, 13 bp, Homo sapiens
attttgttgtgat

SEQ ID NO: 5282867 - DNA, 19 bp, Homo sapiens
attttgttgtgattttgta

SEQ ID NO: 5282868 - DNA, 24 bp, Homo sapiens
attttgttgtgattttgtacagaa

SEQ ID NO: 5282869 - DNA, 23 bp, Homo sapiens
attttgttgtgtgtatgctgctt

SEQ ID NO: 5282870 - DNA, 23 bp, Homo sapiens
attttgttgttcctctatacttt

SEQ ID NO: 5282871 - DNA, 17 bp, Homo sapiens
attttgtttatgctgct

SEQ ID NO: 5282872 - DNA, 11 bp, Homo sapiens
attttgtttca

SEQ ID NO: 5282873 - DNA, 16 bp, Homo sapiens
attttgtttcagtgca

SEQ ID NO: 5282874 - DNA, 11 bp, Homo sapiens
attttgtttct

SEQ ID NO: 5282875 - DNA, 16 bp, Homo sapiens
attttgtttcttttaa

SEQ ID NO: 5282876 - DNA, 21 bp, Homo sapiens
attttgtttggtattgtattt

SEQ ID NO: 5282877 - DNA, 17 bp, Homo sapiens
attttgtttgtaatcct

SEQ ID NO: 5282878 - DNA, 20 bp, Homo sapiens
attttgtttgtaatcctgta

SEQ ID NO: 5282879 - DNA, 22 bp, Homo sapiens
attttgttttaatctacttttt

SEQ ID NO: 5282880 - DNA, 14 bp, Homo sapiens
attttgttttgctt

SEQ ID NO: 5282881 - DNA, 20 bp, Homo sapiens
attttgtttttactgtatgt

SEQ ID NO: 5282882 - DNA, 21 bp, Homo sapiens
attttgtttttattaaatgga

SEQ ID NO: 5282883 - DNA, 18 bp, Homo sapiens
attttgtttttccttcca

SEQ ID NO: 5282884 - DNA, 15 bp, Homo sapiens
atttttaaaaaactg

SEQ ID NO: 5282885 - DNA, 18 bp, Homo sapiens
atttttaaaaaatatttt

SEQ ID NO: 5282886 - DNA, 20 bp, Homo sapiens
atttttaaaaaatattttct

SEQ ID NO: 5282887 - DNA, 23 bp, Homo sapiens
atttttaaaaaatattttctctg

SEQ ID NO: 5282888 - DNA, 22 bp, Homo sapiens
atttttaaaaaatgaaatcctt

SEQ ID NO: 5282889 - DNA, 13 bp, Homo sapiens
atttttaaaaaga

SEQ ID NO: 5282890 - DNA, 23 bp, Homo sapiens
atttttaaaaagaaatctggtct

SEQ ID NO: 5282891 - DNA, 13 bp, Homo sapiens
atttttaaaactc

SEQ ID NO: 5282892 - DNA, 16 bp, Homo sapiens
atttttaaaagaaaaa

SEQ ID NO: 5282893 - DNA, 17 bp, Homo sapiens
atttttaaaagaaaaaa

SEQ ID NO: 5282894 - DNA, 19 bp, Homo sapiens
atttttaaaagactttgat

SEQ ID NO: 5282895 - DNA, 20 bp, Homo sapiens
atttttaaaaggtaggtttt

SEQ ID NO: 5282896 - DNA, 12 bp, Homo sapiens
atttttaaaagt

SEQ ID NO: 5282897 - DNA, 18 bp, Homo sapiens
atttttaaaataaactgt

SEQ ID NO: 5282898 - DNA, 21 bp, Homo sapiens
atttttaaaataaactgtaaa

SEQ ID NO: 5282899 - DNA, 14 bp, Homo sapiens
atttttaaaataat

SEQ ID NO: 5282900 - DNA, 16 bp, Homo sapiens
atttttaaaatattta

SEQ ID NO: 5282901 - DNA, 24 bp, Homo sapiens
atttttaaaatcataacattgatt

SEQ ID NO: 5282902 - DNA, 15 bp, Homo sapiens
atttttaaaatgaat

SEQ ID NO: 5282903 - DNA, 22 bp, Homo sapiens
atttttaaaatgcaacatgtgt

SEQ ID NO: 5282904 - DNA, 14 bp, Homo sapiens
atttttaaacaaaa

SEQ ID NO: 5282905 - DNA, 18 bp, Homo sapiens
atttttaaacaaaatgta

SEQ ID NO: 5282906 - DNA, 14 bp, Homo sapiens
atttttaaactagt

SEQ ID NO: 5282907 - DNA, 15 bp, Homo sapiens
atttttaaactagta

SEQ ID NO: 5282908 - DNA, 16 bp, Homo sapiens
atttttaaactagtaa

SEQ ID NO: 5282909 - DNA, 13 bp, Homo sapiens
atttttaaagaaa

SEQ ID NO: 5282910 - DNA, 12 bp, Homo sapiens
atttttaaagat

SEQ ID NO: 5282911 - DNA, 15 bp, Homo sapiens
atttttaaagataga

SEQ ID NO: 5282912 - DNA, 16 bp, Homo sapiens
atttttaaagcaaata

SEQ ID NO: 5282913 - DNA, 21 bp, Homo sapiens
atttttaaaggacaaacagtg

SEQ ID NO: 5282914 - DNA, 15 bp, Homo sapiens
atttttaaaggcatt

SEQ ID NO: 5282915 - DNA, 22 bp, Homo sapiens
atttttaaaggttggaatcttt

SEQ ID NO: 5282916 - DNA, 17 bp, Homo sapiens
atttttaaagtatatat

SEQ ID NO: 5282917 - DNA, 13 bp, Homo sapiens
atttttaaagtct

SEQ ID NO: 5282918 - DNA, 12 bp, Homo sapiens
atttttaaagtt

SEQ ID NO: 5282919 - DNA, 13 bp, Homo sapiens
atttttaaagttt

SEQ ID NO: 5282920 - DNA, 14 bp, Homo sapiens
atttttaaagttta

SEQ ID NO: 5282921 - DNA, 15 bp, Homo sapiens
atttttaaagtttaa

SEQ ID NO: 5282922 - DNA, 16 bp, Homo sapiens
atttttaaataccaca

SEQ ID NO: 5282923 - DNA, 11 bp, Homo sapiens
atttttaaatg

SEQ ID NO: 5282924 - DNA, 13 bp, Homo sapiens
atttttaaatgtg

SEQ ID NO: 5282925 - DNA, 15 bp, Homo sapiens
atttttaaatgtgtt

SEQ ID NO: 5282926 - DNA, 14 bp, Homo sapiens
atttttaaatgttt

SEQ ID NO: 5282927 - DNA, 16 bp, Homo sapiens
atttttaaattctgct

SEQ ID NO: 5282928 - DNA, 17 bp, Homo sapiens
atttttaaattctgctc

SEQ ID NO: 5282929 - DNA, 21 bp, Homo sapiens
atttttaaccaaataagaata

SEQ ID NO: 5282930 - DNA, 18 bp, Homo sapiens
atttttaactactgtatt

SEQ ID NO: 5282931 - DNA, 23 bp, Homo sapiens
atttttaactctggattttgaat

SEQ ID NO: 5282932 - DNA, 13 bp, Homo sapiens
atttttaactgta

SEQ ID NO: 5282933 - DNA, 19 bp, Homo sapiens
atttttaacttatctccag

SEQ ID NO: 5282934 - DNA, 12 bp, Homo sapiens
atttttaagaaa

SEQ ID NO: 5282935 - DNA, 20 bp, Homo sapiens
atttttaagaaaggaagcaa

SEQ ID NO: 5282936 - DNA, 17 bp, Homo sapiens
atttttaagaacttcat

SEQ ID NO: 5282937 - DNA, 13 bp, Homo sapiens
atttttaagattt

SEQ ID NO: 5282938 - DNA, 14 bp, Homo sapiens
atttttaaggactt

SEQ ID NO: 5282939 - DNA, 18 bp, Homo sapiens
atttttaagtaatttcat

SEQ ID NO: 5282940 - DNA, 14 bp, Homo sapiens
atttttaagtgtca

SEQ ID NO: 5282941 - DNA, 23 bp, Homo sapiens
atttttaagtttttcactttggg

SEQ ID NO: 5282942 - DNA, 18 bp, Homo sapiens
atttttaatatgttgact

SEQ ID NO: 5282943 - DNA, 19 bp, Homo sapiens
atttttaatatgttgactt

SEQ ID NO: 5282944 - DNA, 14 bp, Homo sapiens
atttttaatcatga

SEQ ID NO: 5282945 - DNA, 17 bp, Homo sapiens
atttttaatcatgaaat

SEQ ID NO: 5282946 - DNA, 12 bp, Homo sapiens
atttttaatgat

SEQ ID NO: 5282947 - DNA, 16 bp, Homo sapiens
atttttaatggcagca

SEQ ID NO: 5282948 - DNA, 12 bp, Homo sapiens
atttttaatggg

SEQ ID NO: 5282949 - DNA, 19 bp, Homo sapiens
atttttaatgtatctattt

SEQ ID NO: 5282950 - DNA, 21 bp, Homo sapiens
atttttaatgtatctatttgt

SEQ ID NO: 5282951 - DNA, 20 bp, Homo sapiens
atttttaatgtttttaaata

SEQ ID NO: 5282952 - DNA, 12 bp, Homo sapiens
atttttaattaa

SEQ ID NO: 5282953 - DNA, 14 bp, Homo sapiens
atttttaattgctt

SEQ ID NO: 5282954 - DNA, 14 bp, Homo sapiens
atttttaatttaaa

SEQ ID NO: 5282955 - DNA, 18 bp, Homo sapiens
atttttaatttaaaaaag

SEQ ID NO: 5282956 - DNA, 15 bp, Homo sapiens
atttttaattttatg

SEQ ID NO: 5282957 - DNA, 20 bp, Homo sapiens
atttttaattttcacaaaat

SEQ ID NO: 5282958 - DNA, 14 bp, Homo sapiens
atttttacaaaact

SEQ ID NO: 5282959 - DNA, 19 bp, Homo sapiens
atttttacaagaagtttat

SEQ ID NO: 5282960 - DNA, 22 bp, Homo sapiens
atttttacaagaagtttattct

SEQ ID NO: 5282961 - DNA, 17 bp, Homo sapiens
atttttacaagatccat

SEQ ID NO: 5282962 - DNA, 13 bp, Homo sapiens
atttttacaataa

SEQ ID NO: 5282963 - DNA, 13 bp, Homo sapiens
atttttacactat

SEQ ID NO: 5282964 - DNA, 16 bp, Homo sapiens
atttttacactattgt

SEQ ID NO: 5282965 - DNA, 17 bp, Homo sapiens
atttttacactattgtg

SEQ ID NO: 5282966 - DNA, 14 bp, Homo sapiens
atttttacagaatt

SEQ ID NO: 5282967 - DNA, 16 bp, Homo sapiens
atttttacagaattgc

SEQ ID NO: 5282968 - DNA, 14 bp, Homo sapiens
atttttacagcaaa

SEQ ID NO: 5282969 - DNA, 16 bp, Homo sapiens
atttttacagctactt

SEQ ID NO: 5282970 - DNA, 16 bp, Homo sapiens
atttttacagttatag

SEQ ID NO: 5282971 - DNA, 17 bp, Homo sapiens
atttttaccaactctat

SEQ ID NO: 5282972 - DNA, 12 bp, Homo sapiens
atttttaccagt

SEQ ID NO: 5282973 - DNA, 15 bp, Homo sapiens
atttttacctaaaga

SEQ ID NO: 5282974 - DNA, 15 bp, Homo sapiens
atttttacctgcttt

SEQ ID NO: 5282975 - DNA, 20 bp, Homo sapiens
atttttacctttttccttcc

SEQ ID NO: 5282976 - DNA, 21 bp, Homo sapiens
atttttactaaagcagtgttt

SEQ ID NO: 5282977 - DNA, 15 bp, Homo sapiens
atttttactaatata

SEQ ID NO: 5282978 - DNA, 21 bp, Homo sapiens
atttttactagaacacagaaa

SEQ ID NO: 5282979 - DNA, 21 bp, Homo sapiens
atttttactcaggctttctat

SEQ ID NO: 5282980 - DNA, 15 bp, Homo sapiens
atttttactgccact

SEQ ID NO: 5282981 - DNA, 13 bp, Homo sapiens
atttttacttgaa

SEQ ID NO: 5282982 - DNA, 16 bp, Homo sapiens
atttttacttgaagta

SEQ ID NO: 5282983 - DNA, 15 bp, Homo sapiens
atttttacttgtatg

SEQ ID NO: 5282984 - DNA, 13 bp, Homo sapiens
atttttagaagga

SEQ ID NO: 5282985 - DNA, 21 bp, Homo sapiens
atttttagaattaaaaaagca

SEQ ID NO: 5282986 - DNA, 17 bp, Homo sapiens
atttttagactatttct

SEQ ID NO: 5282987 - DNA, 19 bp, Homo sapiens
atttttagactatttcttt

SEQ ID NO: 5282988 - DNA, 14 bp, Homo sapiens
atttttagagcatt

SEQ ID NO: 5282989 - DNA, 23 bp, Homo sapiens
atttttagaggcagggctgcatt

SEQ ID NO: 5282990 - DNA, 20 bp, Homo sapiens
atttttagatattcattaat

SEQ ID NO: 5282991 - DNA, 20 bp, Homo sapiens
atttttagatggttacactg

SEQ ID NO: 5282992 - DNA, 23 bp, Homo sapiens
atttttagatggttacactgtta

SEQ ID NO: 5282993 - DNA, 21 bp, Homo sapiens
atttttaggaagttttctgta

SEQ ID NO: 5282994 - DNA, 21 bp, Homo sapiens
atttttagtttaaaatcttgc

SEQ ID NO: 5282995 - DNA, 13 bp, Homo sapiens
atttttataaaac

SEQ ID NO: 5282996 - DNA, 14 bp, Homo sapiens
atttttataaaact

SEQ ID NO: 5282997 - DNA, 20 bp, Homo sapiens
atttttataaatatgtgaaa

SEQ ID NO: 5282998 - DNA, 16 bp, Homo sapiens
atttttataattttat

SEQ ID NO: 5282999 - DNA, 17 bp, Homo sapiens
atttttatacaaaccta

SEQ ID NO: 5283000 - DNA, 18 bp, Homo sapiens
atttttatacaagtaatt

SEQ ID NO: 5283001 - DNA, 19 bp, Homo sapiens
atttttatacaagtaattt

SEQ ID NO: 5283002 - DNA, 17 bp, Homo sapiens
atttttatacactgtaa

SEQ ID NO: 5283003 - DNA, 18 bp, Homo sapiens
atttttatacactgtaag

SEQ ID NO: 5283004 - DNA, 13 bp, Homo sapiens
atttttatacagt

SEQ ID NO: 5283005 - DNA, 16 bp, Homo sapiens
atttttatacagtagt

SEQ ID NO: 5283006 - DNA, 15 bp, Homo sapiens
atttttatacatatc

SEQ ID NO: 5283007 - DNA, 21 bp, Homo sapiens
atttttatactcagaactgtc

SEQ ID NO: 5283008 - DNA, 14 bp, Homo sapiens
atttttatacttta

SEQ ID NO: 5283009 - DNA, 20 bp, Homo sapiens
atttttatactttattgaaa

SEQ ID NO: 5283010 - DNA, 17 bp, Homo sapiens
atttttataggaataga

SEQ ID NO: 5283011 - DNA, 20 bp, Homo sapiens
atttttatataatatgaata

SEQ ID NO: 5283012 - DNA, 22 bp, Homo sapiens
atttttatatctatatgtactt

SEQ ID NO: 5283013 - DNA, 20 bp, Homo sapiens
atttttatattagttgcttt

SEQ ID NO: 5283014 - DNA, 15 bp, Homo sapiens
atttttatatttgaa

SEQ ID NO: 5283015 - DNA, 19 bp, Homo sapiens
atttttatatttgaaatat

SEQ ID NO: 5283016 - DNA, 13 bp, Homo sapiens
atttttatcacaa

SEQ ID NO: 5283017 - DNA, 17 bp, Homo sapiens
atttttatcatgaattc

SEQ ID NO: 5283018 - DNA, 12 bp, Homo sapiens
atttttatccat

SEQ ID NO: 5283019 - DNA, 20 bp, Homo sapiens
atttttatcccttcctgtct

SEQ ID NO: 5283020 - DNA, 16 bp, Homo sapiens
atttttatctaattca

SEQ ID NO: 5283021 - DNA, 15 bp, Homo sapiens
atttttatctccaag

SEQ ID NO: 5283022 - DNA, 14 bp, Homo sapiens
atttttatgtaaaa

SEQ ID NO: 5283023 - DNA, 14 bp, Homo sapiens
atttttatgtacat

SEQ ID NO: 5283024 - DNA, 13 bp, Homo sapiens
atttttatgtgca

SEQ ID NO: 5283025 - DNA, 15 bp, Homo sapiens
atttttatgtgtgat

SEQ ID NO: 5283026 - DNA, 16 bp, Homo sapiens
atttttatgttttctt

SEQ ID NO: 5283027 - DNA, 13 bp, Homo sapiens
atttttattaaat

SEQ ID NO: 5283028 - DNA, 16 bp, Homo sapiens
atttttattaaatgta

SEQ ID NO: 5283029 - DNA, 21 bp, Homo sapiens
atttttattaaatgtatttta

SEQ ID NO: 5283030 - DNA, 16 bp, Homo sapiens
atttttattaaattat

SEQ ID NO: 5283031 - DNA, 17 bp, Homo sapiens
atttttattaattttag

SEQ ID NO: 5283032 - DNA, 18 bp, Homo sapiens
atttttattacccttctt

SEQ ID NO: 5283033 - DNA, 15 bp, Homo sapiens
atttttattactttt

SEQ ID NO: 5283034 - DNA, 16 bp, Homo sapiens
atttttattacttttt

SEQ ID NO: 5283035 - DNA, 18 bp, Homo sapiens
atttttattatatttatg

SEQ ID NO: 5283036 - DNA, 19 bp, Homo sapiens
atttttattatgcataact

SEQ ID NO: 5283037 - DNA, 20 bp, Homo sapiens
atttttattatgcataactg

SEQ ID NO: 5283038 - DNA, 14 bp, Homo sapiens
atttttattattat

SEQ ID NO: 5283039 - DNA, 12 bp, Homo sapiens
atttttattcat

SEQ ID NO: 5283040 - DNA, 13 bp, Homo sapiens
atttttattcata

SEQ ID NO: 5283041 - DNA, 22 bp, Homo sapiens
attctccctatcttgtgaagtt

SEQ ID NO: 5283042 - DNA, 14 bp, Homo sapiens
attctccctgacct

SEQ ID NO: 5283043 - DNA, 14 bp, Homo sapiens
attctccctgggcc

SEQ ID NO: 5283044 - DNA, 16 bp, Homo sapiens
attctccctgggcctc

SEQ ID NO: 5283045 - DNA, 15 bp, Homo sapiens
attctcccttgctct

SEQ ID NO: 5283046 - DNA, 20 bp, Homo sapiens
attctcccttttgacacagt

SEQ ID NO: 5283047 - DNA, 17 bp, Homo sapiens
attctcctcctccctcc

SEQ ID NO: 5283048 - DNA, 22 bp, Homo sapiens
attctcctcctcctccctcctc

SEQ ID NO: 5283049 - DNA, 13 bp, Homo sapiens
attctcctcggac

SEQ ID NO: 5283050 - DNA, 11 bp, Homo sapiens
attctcctgcc

SEQ ID NO: 5283051 - DNA, 13 bp, Homo sapiens
attctcctgcctc

SEQ ID NO: 5283052 - DNA, 16 bp, Homo sapiens
attctcctgcctcagc

SEQ ID NO: 5283053 - DNA, 19 bp, Homo sapiens
attctcctgcctcagcctt

SEQ ID NO: 5283054 - DNA, 22 bp, Homo sapiens
attctcctgcctgtagcagtga

SEQ ID NO: 5283055 - DNA, 13 bp, Homo sapiens
attctcctgcctt

SEQ ID NO: 5283056 - DNA, 19 bp, Homo sapiens
attctcctggatgcttaga

SEQ ID NO: 5283057 - DNA, 16 bp, Homo sapiens
attctcctgtgcccct

SEQ ID NO: 5283058 - DNA, 14 bp, Homo sapiens
attctccttcagcc

SEQ ID NO: 5283059 - DNA, 12 bp, Homo sapiens
attctccttccc

SEQ ID NO: 5283060 - DNA, 17 bp, Homo sapiens
attctccttttatgtgt

SEQ ID NO: 5283061 - DNA, 19 bp, Homo sapiens
attctccttttatgtgtag

SEQ ID NO: 5283062 - DNA, 18 bp, Homo sapiens
attctcgattctttgaag

SEQ ID NO: 5283063 - DNA, 16 bp, Homo sapiens
attctcggggccctgt

SEQ ID NO: 5283064 - DNA, 22 bp, Homo sapiens
attctctaaactggcatctgct

SEQ ID NO: 5283065 - DNA, 17 bp, Homo sapiens
attctctaagcctggct

SEQ ID NO: 5283066 - DNA, 14 bp, Homo sapiens
attctctaataaaa

SEQ ID NO: 5283067 - DNA, 19 bp, Homo sapiens
attctctaattagaaattt

SEQ ID NO: 5283068 - DNA, 19 bp, Homo sapiens
attctctaccaacaataaa

SEQ ID NO: 5283069 - DNA, 16 bp, Homo sapiens
attctctagatttatt

SEQ ID NO: 5283070 - DNA, 20 bp, Homo sapiens
attctctagtttgattaaat

SEQ ID NO: 5283071 - DNA, 19 bp, Homo sapiens
attctctattgtaattttg

SEQ ID NO: 5283072 - DNA, 17 bp, Homo sapiens
attctctatttgaatta

SEQ ID NO: 5283073 - DNA, 20 bp, Homo sapiens
attctctatttgaattattt

SEQ ID NO: 5283074 - DNA, 20 bp, Homo sapiens
attctctcccatcctggggc

SEQ ID NO: 5283075 - DNA, 22 bp, Homo sapiens
attctctctaaaaataaaatga

SEQ ID NO: 5283076 - DNA, 10 bp, Homo sapiens
attctctctc

SEQ ID NO: 5283077 - DNA, 19 bp, Homo sapiens
attctctctcactcacatt

SEQ ID NO: 5283078 - DNA, 17 bp, Homo sapiens
attctctctcctgtcca

SEQ ID NO: 5283079 - DNA, 14 bp, Homo sapiens
attctctctctgtt

SEQ ID NO: 5283080 - DNA, 13 bp, Homo sapiens
attctctctgctc

SEQ ID NO: 5283081 - DNA, 20 bp, Homo sapiens
attctctctgctcagtgatc

SEQ ID NO: 5283082 - DNA, 12 bp, Homo sapiens
attctctcttta

SEQ ID NO: 5283083 - DNA, 13 bp, Homo sapiens
attctctgagctg

SEQ ID NO: 5283084 - DNA, 13 bp, Homo sapiens
attctctgagtgg

SEQ ID NO: 5283085 - DNA, 20 bp, Homo sapiens
attctctgagtggtggttcc

SEQ ID NO: 5283086 - DNA, 16 bp, Homo sapiens
attctctgcaatttta

SEQ ID NO: 5283087 - DNA, 18 bp, Homo sapiens
attctctgcaattttact

SEQ ID NO: 5283088 - DNA, 11 bp, Homo sapiens
attctctgccc

SEQ ID NO: 5283089 - DNA, 17 bp, Homo sapiens
attctctggctgtaagg

SEQ ID NO: 5283090 - DNA, 19 bp, Homo sapiens
attctctgtaagtgtagct

SEQ ID NO: 5283091 - DNA, 20 bp, Homo sapiens
attctctgtaagtgtagctc

SEQ ID NO: 5283092 - DNA, 16 bp, Homo sapiens
attctctgtccagggc

SEQ ID NO: 5283093 - DNA, 17 bp, Homo sapiens
attctctgtccagggct

SEQ ID NO: 5283094 - DNA, 12 bp, Homo sapiens
attctctgtctc

SEQ ID NO: 5283095 - DNA, 17 bp, Homo sapiens
attctctgtgtctaaga

SEQ ID NO: 5283096 - DNA, 21 bp, Homo sapiens
attctctgtgtctaagattct

SEQ ID NO: 5283097 - DNA, 21 bp, Homo sapiens
attctcttaaataaaaataat

SEQ ID NO: 5283098 - DNA, 22 bp, Homo sapiens
attctcttaaataaaaataata

SEQ ID NO: 5283099 - DNA, 19 bp, Homo sapiens
attctcttactttttgtaa

SEQ ID NO: 5283100 - DNA, 21 bp, Homo sapiens
attctcttactttttgtaaat

SEQ ID NO: 5283101 - DNA, 22 bp, Homo sapiens
attctcttactttttgtaaatg

SEQ ID NO: 5283102 - DNA, 12 bp, Homo sapiens
attctcttatcc

SEQ ID NO: 5283103 - DNA, 19 bp, Homo sapiens
attctcttcgctgtgatgc

SEQ ID NO: 5283104 - DNA, 23 bp, Homo sapiens
attctcttgaaggtgctgccacc

SEQ ID NO: 5283105 - DNA, 16 bp, Homo sapiens
attctcttgaataaag

SEQ ID NO: 5283106 - DNA, 15 bp, Homo sapiens
attctcttgtataag

SEQ ID NO: 5283107 - DNA, 14 bp, Homo sapiens
attctcttgtctgg

SEQ ID NO: 5283108 - DNA, 14 bp, Homo sapiens
attctctttcaaag

SEQ ID NO: 5283109 - DNA, 13 bp, Homo sapiens
attctctttgata

SEQ ID NO: 5283110 - DNA, 17 bp, Homo sapiens
attctctttgataacaa

SEQ ID NO: 5283111 - DNA, 20 bp, Homo sapiens
attctctttgataacaaaaa

SEQ ID NO: 5283112 - DNA, 16 bp, Homo sapiens
attctcttttatctgt

SEQ ID NO: 5283113 - DNA, 21 bp, Homo sapiens
attctcttttcaaacacacac

SEQ ID NO: 5283114 - DNA, 16 bp, Homo sapiens
attctctttttaacaa

SEQ ID NO: 5283115 - DNA, 15 bp, Homo sapiens
attctgaaaaagaca

SEQ ID NO: 5283116 - DNA, 17 bp, Homo sapiens
attctgaaaaagacata

SEQ ID NO: 5283117 - DNA, 18 bp, Homo sapiens
attctgaaaaagacataa

SEQ ID NO: 5283118 - DNA, 22 bp, Homo sapiens
attctgaaaaagacataaaaca

SEQ ID NO: 5283119 - DNA, 17 bp, Homo sapiens
attctgaaacaggccct

SEQ ID NO: 5283120 - DNA, 22 bp, Homo sapiens
attctgaaatacttttgagtat

SEQ ID NO: 5283121 - DNA, 16 bp, Homo sapiens
attctgaacaattctc

SEQ ID NO: 5283122 - DNA, 14 bp, Homo sapiens
attctgaacaattg

SEQ ID NO: 5283123 - DNA, 21 bp, Homo sapiens
attctgaaccctccaaaggaa

SEQ ID NO: 5283124 - DNA, 17 bp, Homo sapiens
attctgaagccattgtc

SEQ ID NO: 5283125 - DNA, 19 bp, Homo sapiens
attctgaaggggaaaacct

SEQ ID NO: 5283126 - DNA, 19 bp, Homo sapiens
attctgaagtatgaagtct

SEQ ID NO: 5283127 - DNA, 15 bp, Homo sapiens
attctgaagttatat

SEQ ID NO: 5283128 - DNA, 22 bp, Homo sapiens
attctgaagttatatttcctat

SEQ ID NO: 5283129 - DNA, 13 bp, Homo sapiens
attctgaagtttt

SEQ ID NO: 5283130 - DNA, 13 bp, Homo sapiens
attctgaatattt

SEQ ID NO: 5283131 - DNA, 10 bp, Homo sapiens
attctgaatg

SEQ ID NO: 5283132 - DNA, 14 bp, Homo sapiens
attctgaatttgca

SEQ ID NO: 5283133 - DNA, 16 bp, Homo sapiens
attctgaatttgcaaa

SEQ ID NO: 5283134 - DNA, 22 bp, Homo sapiens
attctgaattttggtaaatcac

SEQ ID NO: 5283135 - DNA, 16 bp, Homo sapiens
attctgacagagcaag

SEQ ID NO: 5283136 - DNA, 16 bp, Homo sapiens
attctgacatgtaaga

SEQ ID NO: 5283137 - DNA, 12 bp, Homo sapiens
attctgactgtc

SEQ ID NO: 5283138 - DNA, 15 bp, Homo sapiens
attctgactgtccag

SEQ ID NO: 5283139 - DNA, 19 bp, Homo sapiens
attctgagacatgtgtcaa

SEQ ID NO: 5283140 - DNA, 14 bp, Homo sapiens
attctgagagctgt

SEQ ID NO: 5283141 - DNA, 19 bp, Homo sapiens
attctgagatgactattca

SEQ ID NO: 5283142 - DNA, 16 bp, Homo sapiens
attctgagcaaaggcc

SEQ ID NO: 5283143 - DNA, 23 bp, Homo sapiens
attctgagcacgggcaaagaaaa

SEQ ID NO: 5283144 - DNA, 19 bp, Homo sapiens
attctgagcagtgcctctt

SEQ ID NO: 5283145 - DNA, 20 bp, Homo sapiens
attctgagcagtgcctcttg

SEQ ID NO: 5283146 - DNA, 17 bp, Homo sapiens
attctgagcctgatatt

SEQ ID NO: 5283147 - DNA, 16 bp, Homo sapiens
attctgagctggccct

SEQ ID NO: 5283148 - DNA, 18 bp, Homo sapiens
attctgaggccctgccca

SEQ ID NO: 5283149 - DNA, 13 bp, Homo sapiens
attctgagggaat

SEQ ID NO: 5283150 - DNA, 19 bp, Homo sapiens
attctgaggtaagtgtatg

SEQ ID NO: 5283151 - DNA, 17 bp, Homo sapiens
attctgagttttgtgtt

SEQ ID NO: 5283152 - DNA, 23 bp, Homo sapiens
attctgagttttgtgtttgttgt

SEQ ID NO: 5283153 - DNA, 18 bp, Homo sapiens
attctgataatgtattgc

SEQ ID NO: 5283154 - DNA, 15 bp, Homo sapiens
attctgataggaggg

SEQ ID NO: 5283155 - DNA, 16 bp, Homo sapiens
attctgatgtactcta

SEQ ID NO: 5283156 - DNA, 13 bp, Homo sapiens
attctgatgtttc

SEQ ID NO: 5283157 - DNA, 15 bp, Homo sapiens
attctgatgtttctg

SEQ ID NO: 5283158 - DNA, 17 bp, Homo sapiens
attctgatgtttctgtg

SEQ ID NO: 5283159 - DNA, 18 bp, Homo sapiens
attctgatgtttctgtga

SEQ ID NO: 5283160 - DNA, 14 bp, Homo sapiens
attctgattacaca

SEQ ID NO: 5283161 - DNA, 12 bp, Homo sapiens
attctgattcag

SEQ ID NO: 5283162 - DNA, 13 bp, Homo sapiens
attctgattccac

SEQ ID NO: 5283163 - DNA, 13 bp, Homo sapiens
attctgattccct

SEQ ID NO: 5283164 - DNA, 21 bp, Homo sapiens
attctgattcgaatgacactg

SEQ ID NO: 5283165 - DNA, 22 bp, Homo sapiens
attctgattcgaatgacactgt

SEQ ID NO: 5283166 - DNA, 19 bp, Homo sapiens
attctgattgctatcagca

SEQ ID NO: 5283167 - DNA, 20 bp, Homo sapiens
attctgattggacctggccc

SEQ ID NO: 5283168 - DNA, 21 bp, Homo sapiens
attctgattggacctggccca

SEQ ID NO: 5283169 - DNA, 15 bp, Homo sapiens
attctgattggtctg

SEQ ID NO: 5283170 - DNA, 20 bp, Homo sapiens
attctgatttcagtttttca

SEQ ID NO: 5283171 - DNA, 20 bp, Homo sapiens
attctgatttcttttcacca

SEQ ID NO: 5283172 - DNA, 20 bp, Homo sapiens
attctgatttgtattaaaat

SEQ ID NO: 5283173 - DNA, 20 bp, Homo sapiens
attctgatttttttgttgtt

SEQ ID NO: 5283174 - DNA, 15 bp, Homo sapiens
attctgcaagcaata

SEQ ID NO: 5283175 - DNA, 20 bp, Homo sapiens
attctgcaatggcagcattc

SEQ ID NO: 5283176 - DNA, 11 bp, Homo sapiens
attctgcacca

SEQ ID NO: 5283177 - DNA, 20 bp, Homo sapiens
attctgcaccacacctggca

SEQ ID NO: 5283178 - DNA, 17 bp, Homo sapiens
attctgcactcagaaaa

SEQ ID NO: 5283179 - DNA, 11 bp, Homo sapiens
attctgcagaa

SEQ ID NO: 5283180 - DNA, 11 bp, Homo sapiens
attctgcagcc

SEQ ID NO: 5283181 - DNA, 18 bp, Homo sapiens
attctgcagtaaatcttt

SEQ ID NO: 5283182 - DNA, 21 bp, Homo sapiens
attctgcagtaaatcttttac

SEQ ID NO: 5283183 - DNA, 17 bp, Homo sapiens
attctgcatgagctgat

SEQ ID NO: 5283184 - DNA, 13 bp, Homo sapiens
attctgcatgtac

SEQ ID NO: 5283185 - DNA, 13 bp, Homo sapiens
attctgcattaat

SEQ ID NO: 5283186 - DNA, 14 bp, Homo sapiens
attctgcatttagc

SEQ ID NO: 5283187 - DNA, 19 bp, Homo sapiens
attctgcatttagctgtat

SEQ ID NO: 5283188 - DNA, 21 bp, Homo sapiens
attctgcatttagctgtattc

SEQ ID NO: 5283189 - DNA, 15 bp, Homo sapiens
attctgccaaagtaa

SEQ ID NO: 5283190 - DNA, 16 bp, Homo sapiens
attctgccaaagtaaa

SEQ ID NO: 5283191 - DNA, 17 bp, Homo sapiens
attctgccaaagtaaaa

SEQ ID NO: 5283192 - DNA, 14 bp, Homo sapiens
attctgccatggga

SEQ ID NO: 5283193 - DNA, 19 bp, Homo sapiens
attctgccctccttaattt

SEQ ID NO: 5283194 - DNA, 20 bp, Homo sapiens
attctgccgccccctcctga

SEQ ID NO: 5283195 - DNA, 21 bp, Homo sapiens
attctgccgccccctcctgaa

SEQ ID NO: 5283196 - DNA, 16 bp, Homo sapiens
attctgcctaataaaa

SEQ ID NO: 5283197 - DNA, 21 bp, Homo sapiens
attctgcctagagtgtagcct

SEQ ID NO: 5283198 - DNA, 21 bp, Homo sapiens
attctgcctcagcctcctgag

SEQ ID NO: 5283199 - DNA, 17 bp, Homo sapiens
attctgcctctctagga

SEQ ID NO: 5283200 - DNA, 11 bp, Homo sapiens
attctgcctgc

SEQ ID NO: 5283201 - DNA, 18 bp, Homo sapiens
attctgcctgcccaggcc

SEQ ID NO: 5283202 - DNA, 21 bp, Homo sapiens
attctgcctgcccaggcccct

SEQ ID NO: 5283203 - DNA, 21 bp, Homo sapiens
attctgcctgcctcctccctc

SEQ ID NO: 5283204 - DNA, 17 bp, Homo sapiens
attctgcctgctccatc

SEQ ID NO: 5283205 - DNA, 21 bp, Homo sapiens
attctgcctttgcagaaacag

SEQ ID NO: 5283206 - DNA, 17 bp, Homo sapiens
attctgctaatttatga

SEQ ID NO: 5283207 - DNA, 20 bp, Homo sapiens
attctgctaatttatgaaga

SEQ ID NO: 5283208 - DNA, 19 bp, Homo sapiens
attctgctacctcactggg

SEQ ID NO: 5283209 - DNA, 22 bp, Homo sapiens
attctgctcacatatctgtcat

SEQ ID NO: 5283210 - DNA, 13 bp, Homo sapiens
attctgctccttc

SEQ ID NO: 5283211 - DNA, 18 bp, Homo sapiens
attctgctctaaataaag

SEQ ID NO: 5283212 - DNA, 13 bp, Homo sapiens
attctgctctgcc

SEQ ID NO: 5283213 - DNA, 17 bp, Homo sapiens
attctgctctgcccatg

SEQ ID NO: 5283214 - DNA, 18 bp, Homo sapiens
attctgctctgcccatgc

SEQ ID NO: 5283215 - DNA, 18 bp, Homo sapiens
attctgctggcctctgcg

SEQ ID NO: 5283216 - DNA, 12 bp, Homo sapiens
attctgctgtta

SEQ ID NO: 5283217 - DNA, 18 bp, Homo sapiens
attctgcttccacatgtg

SEQ ID NO: 5283218 - DNA, 13 bp, Homo sapiens
attctgcttgaga

SEQ ID NO: 5283219 - DNA, 16 bp, Homo sapiens
attctgcttgtgacat

SEQ ID NO: 5283220 - DNA, 12 bp, Homo sapiens
attctgctttag

SEQ ID NO: 5283221 - DNA, 16 bp, Homo sapiens
atttttatttatgaag

SEQ ID NO: 5283222 - DNA, 20 bp, Homo sapiens
atttttatttatttttcttg

SEQ ID NO: 5283223 - DNA, 14 bp, Homo sapiens
atttttatttcaaa

SEQ ID NO: 5283224 - DNA, 14 bp, Homo sapiens
atttttatttcaga

SEQ ID NO: 5283225 - DNA, 16 bp, Homo sapiens
atttttatttcagatt

SEQ ID NO: 5283226 - DNA, 17 bp, Homo sapiens
atttttatttcagattt

SEQ ID NO: 5283227 - DNA, 20 bp, Homo sapiens
atttttatttcagattttga

SEQ ID NO: 5283228 - DNA, 19 bp, Homo sapiens
atttttatttcattcacat

SEQ ID NO: 5283229 - DNA, 16 bp, Homo sapiens
atttttatttcttttt

SEQ ID NO: 5283230 - DNA, 21 bp, Homo sapiens
atttttatttctttttaatta

SEQ ID NO: 5283231 - DNA, 16 bp, Homo sapiens
atttttatttgtaaag

SEQ ID NO: 5283232 - DNA, 17 bp, Homo sapiens
atttttatttgtattag

SEQ ID NO: 5283233 - DNA, 21 bp, Homo sapiens
atttttatttttgctgagact

SEQ ID NO: 5283234 - DNA, 17 bp, Homo sapiens
atttttcaaaatcaaag

SEQ ID NO: 5283235 - DNA, 23 bp, Homo sapiens
atttttcaaagcaattgaaatgc

SEQ ID NO: 5283236 - DNA, 21 bp, Homo sapiens
atttttcaaatagatttttga

SEQ ID NO: 5283237 - DNA, 17 bp, Homo sapiens
atttttcaaccagcatt

SEQ ID NO: 5283238 - DNA, 22 bp, Homo sapiens
atttttcaaccagcattttact

SEQ ID NO: 5283239 - DNA, 23 bp, Homo sapiens
atttttcaaccagcattttacta

SEQ ID NO: 5283240 - DNA, 23 bp, Homo sapiens
atttttcaaccccaccctgtttg

SEQ ID NO: 5283241 - DNA, 15 bp, Homo sapiens
atttttcaaggaagg

SEQ ID NO: 5283242 - DNA, 14 bp, Homo sapiens
atttttcaaggcat

SEQ ID NO: 5283243 - DNA, 16 bp, Homo sapiens
atttttcaataaagca

SEQ ID NO: 5283244 - DNA, 12 bp, Homo sapiens
atttttcaatag

SEQ ID NO: 5283245 - DNA, 17 bp, Homo sapiens
atttttcaatatattga

SEQ ID NO: 5283246 - DNA, 20 bp, Homo sapiens
atttttcaatatattgaact

SEQ ID NO: 5283247 - DNA, 13 bp, Homo sapiens
atttttcagaaat

SEQ ID NO: 5283248 - DNA, 20 bp, Homo sapiens
atttttcagaccttttaact

SEQ ID NO: 5283249 - DNA, 11 bp, Homo sapiens
atttttcagag

SEQ ID NO: 5283250 - DNA, 18 bp, Homo sapiens
atttttcagatgcttctg

SEQ ID NO: 5283251 - DNA, 20 bp, Homo sapiens
atttttcagtagcaggacct

SEQ ID NO: 5283252 - DNA, 15 bp, Homo sapiens
atttttcataaacaa

SEQ ID NO: 5283253 - DNA, 11 bp, Homo sapiens
atttttcatac

SEQ ID NO: 5283254 - DNA, 21 bp, Homo sapiens
atttttcatacttttcttact

SEQ ID NO: 5283255 - DNA, 13 bp, Homo sapiens
atttttcatattg

SEQ ID NO: 5283256 - DNA, 19 bp, Homo sapiens
atttttcatgattttgaaa

SEQ ID NO: 5283257 - DNA, 15 bp, Homo sapiens
atttttcattcatga

SEQ ID NO: 5283258 - DNA, 16 bp, Homo sapiens
atttttcattcatgaa

SEQ ID NO: 5283259 - DNA, 22 bp, Homo sapiens
atttttcattgatatgaaaaat

SEQ ID NO: 5283260 - DNA, 15 bp, Homo sapiens
atttttcattttctc

SEQ ID NO: 5283261 - DNA, 19 bp, Homo sapiens
atttttccagagctgcaga

SEQ ID NO: 5283262 - DNA, 19 bp, Homo sapiens
atttttccagctccgtgtt

SEQ ID NO: 5283263 - DNA, 16 bp, Homo sapiens
atttttccatgacatt

SEQ ID NO: 5283264 - DNA, 14 bp, Homo sapiens
atttttccatttat

SEQ ID NO: 5283265 - DNA, 23 bp, Homo sapiens
atttttccccccaccccccagca

SEQ ID NO: 5283266 - DNA, 12 bp, Homo sapiens
atttttccctcc

SEQ ID NO: 5283267 - DNA, 19 bp, Homo sapiens
atttttccctgtttgccta

SEQ ID NO: 5283268 - DNA, 18 bp, Homo sapiens
atttttcctcaaagattc

SEQ ID NO: 5283269 - DNA, 20 bp, Homo sapiens
atttttcctccactgaacta

SEQ ID NO: 5283270 - DNA, 19 bp, Homo sapiens
atttttcctctgttcacaa

SEQ ID NO: 5283271 - DNA, 10 bp, Homo sapiens
atttttcctt

SEQ ID NO: 5283272 - DNA, 22 bp, Homo sapiens
atttttccttcctctgtaagat

SEQ ID NO: 5283273 - DNA, 11 bp, Homo sapiens
atttttccttt

SEQ ID NO: 5283274 - DNA, 12 bp, Homo sapiens
atttttccttta

SEQ ID NO: 5283275 - DNA, 17 bp, Homo sapiens
atttttcctttgagtgc

SEQ ID NO: 5283276 - DNA, 12 bp, Homo sapiens
atttttcctttt

SEQ ID NO: 5283277 - DNA, 18 bp, Homo sapiens
atttttctaagtgtaacc

SEQ ID NO: 5283278 - DNA, 23 bp, Homo sapiens
atttttctaagtgtaacctcagt

SEQ ID NO: 5283279 - DNA, 15 bp, Homo sapiens
atttttctaataggt

SEQ ID NO: 5283280 - DNA, 18 bp, Homo sapiens
atttttctactgctcttt

SEQ ID NO: 5283281 - DNA, 13 bp, Homo sapiens
atttttctataaa

SEQ ID NO: 5283282 - DNA, 24 bp, Homo sapiens
atttttctatgaaagctatgaatg

SEQ ID NO: 5283283 - DNA, 21 bp, Homo sapiens
atttttctcaaagttttgaaa

SEQ ID NO: 5283284 - DNA, 16 bp, Homo sapiens
atttttctcccaagaa

SEQ ID NO: 5283285 - DNA, 18 bp, Homo sapiens
atttttctcccaagaaac

SEQ ID NO: 5283286 - DNA, 19 bp, Homo sapiens
atttttctcccaagaaacc

SEQ ID NO: 5283287 - DNA, 24 bp, Homo sapiens
atttttctcccaagaaacctgact

SEQ ID NO: 5283288 - DNA, 19 bp, Homo sapiens
atttttctctcctgtcctc

SEQ ID NO: 5283289 - DNA, 13 bp, Homo sapiens
atttttctcttgt

SEQ ID NO: 5283290 - DNA, 14 bp, Homo sapiens
atttttctcttgta

SEQ ID NO: 5283291 - DNA, 14 bp, Homo sapiens
atttttctgagatt

SEQ ID NO: 5283292 - DNA, 14 bp, Homo sapiens
atttttctgcacct

SEQ ID NO: 5283293 - DNA, 19 bp, Homo sapiens
atttttctggaggttgata

SEQ ID NO: 5283294 - DNA, 22 bp, Homo sapiens
atttttctggaggttgataact

SEQ ID NO: 5283295 - DNA, 18 bp, Homo sapiens
atttttctgttggtctta

SEQ ID NO: 5283296 - DNA, 20 bp, Homo sapiens
atttttcttagtgtgatgat

SEQ ID NO: 5283297 - DNA, 11 bp, Homo sapiens
atttttcttcc

SEQ ID NO: 5283298 - DNA, 12 bp, Homo sapiens
atttttcttgcg

SEQ ID NO: 5283299 - DNA, 19 bp, Homo sapiens
atttttcttgctgttcagt

SEQ ID NO: 5283300 - DNA, 12 bp, Homo sapiens
atttttcttgga

SEQ ID NO: 5283301 - DNA, 13 bp, Homo sapiens
atttttctttaca

SEQ ID NO: 5283302 - DNA, 20 bp, Homo sapiens
atttttctttagtcatttaa

SEQ ID NO: 5283303 - DNA, 13 bp, Homo sapiens
atttttctttatt

SEQ ID NO: 5283304 - DNA, 14 bp, Homo sapiens
atttttctttccaa

SEQ ID NO: 5283305 - DNA, 20 bp, Homo sapiens
atttttcttttgaggcatgc

SEQ ID NO: 5283306 - DNA, 14 bp, Homo sapiens
atttttgaaaaaga

SEQ ID NO: 5283307 - DNA, 14 bp, Homo sapiens
atttttgaaaaata

SEQ ID NO: 5283308 - DNA, 16 bp, Homo sapiens
atttttgaaaaatatt

SEQ ID NO: 5283309 - DNA, 21 bp, Homo sapiens
atttttgaaaagctgctaact

SEQ ID NO: 5283310 - DNA, 14 bp, Homo sapiens
atttttgaaaaggc

SEQ ID NO: 5283311 - DNA, 13 bp, Homo sapiens
atttttgaagact

SEQ ID NO: 5283312 - DNA, 14 bp, Homo sapiens
atttttgaatctat

SEQ ID NO: 5283313 - DNA, 12 bp, Homo sapiens
atttttgacaga

SEQ ID NO: 5283314 - DNA, 13 bp, Homo sapiens
atttttgacagaa

SEQ ID NO: 5283315 - DNA, 22 bp, Homo sapiens
atttttgacagaatatgtttca

SEQ ID NO: 5283316 - DNA, 20 bp, Homo sapiens
atttttgactgtagccacag

SEQ ID NO: 5283317 - DNA, 23 bp, Homo sapiens
atttttgagccaagcttcaaccc

SEQ ID NO: 5283318 - DNA, 23 bp, Homo sapiens
atttttgagttacaatttggagc

SEQ ID NO: 5283319 - DNA, 19 bp, Homo sapiens
atttttgatctttgagtgt

SEQ ID NO: 5283320 - DNA, 23 bp, Homo sapiens
atttttgatgactacctcagaac

SEQ ID NO: 5283321 - DNA, 17 bp, Homo sapiens
atttttgatgtatatat

SEQ ID NO: 5283322 - DNA, 20 bp, Homo sapiens
atttttgatgtatatatcta

SEQ ID NO: 5283323 - DNA, 21 bp, Homo sapiens
atttttgattaacaatgtatt

SEQ ID NO: 5283324 - DNA, 22 bp, Homo sapiens
atttttgattgttatgtaaaac

SEQ ID NO: 5283325 - DNA, 11 bp, Homo sapiens
atttttgattt

SEQ ID NO: 5283326 - DNA, 13 bp, Homo sapiens
atttttgatttat

SEQ ID NO: 5283327 - DNA, 23 bp, Homo sapiens
atttttgatttatgcatggaaac

SEQ ID NO: 5283328 - DNA, 11 bp, Homo sapiens
atttttgcaaa

SEQ ID NO: 5283329 - DNA, 17 bp, Homo sapiens
atttttgcaattattct

SEQ ID NO: 5283330 - DNA, 16 bp, Homo sapiens
atttttgcacaacttt

SEQ ID NO: 5283331 - DNA, 17 bp, Homo sapiens
atttttgcacagtggag

SEQ ID NO: 5283332 - DNA, 17 bp, Homo sapiens
atttttgcactggaata

SEQ ID NO: 5283333 - DNA, 12 bp, Homo sapiens
atttttgcactt

SEQ ID NO: 5283334 - DNA, 18 bp, Homo sapiens
atttttgccatacatcag

SEQ ID NO: 5283335 - DNA, 12 bp, Homo sapiens
atttttgccctg

SEQ ID NO: 5283336 - DNA, 12 bp, Homo sapiens
atttttgcctat

SEQ ID NO: 5283337 - DNA, 12 bp, Homo sapiens
atttttgcctct

SEQ ID NO: 5283338 - DNA, 18 bp, Homo sapiens
atttttgcctcttccagt

SEQ ID NO: 5283339 - DNA, 15 bp, Homo sapiens
atttttgctatttct

SEQ ID NO: 5283340 - DNA, 21 bp, Homo sapiens
atttttgctgaattcctttac

SEQ ID NO: 5283341 - DNA, 13 bp, Homo sapiens
atttttgctgttt

SEQ ID NO: 5283342 - DNA, 14 bp, Homo sapiens
atttttgcttccta

SEQ ID NO: 5283343 - DNA, 14 bp, Homo sapiens
atttttgcttttga

SEQ ID NO: 5283344 - DNA, 21 bp, Homo sapiens
atttttgcttttgataagaaa

SEQ ID NO: 5283345 - DNA, 20 bp, Homo sapiens
atttttggcttactcatgga

SEQ ID NO: 5283346 - DNA, 17 bp, Homo sapiens
atttttggggaaaaaag

SEQ ID NO: 5283347 - DNA, 21 bp, Homo sapiens
atttttggggaaaaaagcaca

SEQ ID NO: 5283348 - DNA, 22 bp, Homo sapiens
atttttggggaaaaaagcacat

SEQ ID NO: 5283349 - DNA, 20 bp, Homo sapiens
atttttgggggctttccttt

SEQ ID NO: 5283350 - DNA, 17 bp, Homo sapiens
atttttgggtttggcca

SEQ ID NO: 5283351 - DNA, 21 bp, Homo sapiens
atttttgggtttggccaggga

SEQ ID NO: 5283352 - DNA, 19 bp, Homo sapiens
atttttggtgggaatccaa

SEQ ID NO: 5283353 - DNA, 17 bp, Homo sapiens
atttttggtttccaaag

SEQ ID NO: 5283354 - DNA, 14 bp, Homo sapiens
atttttgtaaaaag

SEQ ID NO: 5283355 - DNA, 18 bp, Homo sapiens
atttttgtaaaagacatt

SEQ ID NO: 5283356 - DNA, 21 bp, Homo sapiens
atttttgtaaaagacatttga

SEQ ID NO: 5283357 - DNA, 16 bp, Homo sapiens
atttttgtaaatagtt

SEQ ID NO: 5283358 - DNA, 12 bp, Homo sapiens
atttttgtaact

SEQ ID NO: 5283359 - DNA, 22 bp, Homo sapiens
atttttgtaagacaatccatgt

SEQ ID NO: 5283360 - DNA, 12 bp, Homo sapiens
atttttgtaata

SEQ ID NO: 5283361 - DNA, 19 bp, Homo sapiens
atttttgtaatataagaca

SEQ ID NO: 5283362 - DNA, 15 bp, Homo sapiens
atttttgtaatgctg

SEQ ID NO: 5283363 - DNA, 18 bp, Homo sapiens
atttttgtaatgtgaaaa

SEQ ID NO: 5283364 - DNA, 20 bp, Homo sapiens
atttttgtaatgtgaaaagt

SEQ ID NO: 5283365 - DNA, 12 bp, Homo sapiens
atttttgtaatt

SEQ ID NO: 5283366 - DNA, 18 bp, Homo sapiens
atttttgtaattcctcta

SEQ ID NO: 5283367 - DNA, 13 bp, Homo sapiens
atttttgtacatg

SEQ ID NO: 5283368 - DNA, 17 bp, Homo sapiens
atttttgtacattatgt

SEQ ID NO: 5283369 - DNA, 15 bp, Homo sapiens
atttttgtactgtgc

SEQ ID NO: 5283370 - DNA, 15 bp, Homo sapiens
atttttgtacttgat

SEQ ID NO: 5283371 - DNA, 17 bp, Homo sapiens
atttttgtacttttagt

SEQ ID NO: 5283372 - DNA, 19 bp, Homo sapiens
atttttgtagagccagggt

SEQ ID NO: 5283373 - DNA, 20 bp, Homo sapiens
atttttgtagcactgacaga

SEQ ID NO: 5283374 - DNA, 21 bp, Homo sapiens
atttttgtagcactgacagat

SEQ ID NO: 5283375 - DNA, 17 bp, Homo sapiens
atttttgtataaaaagg

SEQ ID NO: 5283376 - DNA, 13 bp, Homo sapiens
atttttgtatcta

SEQ ID NO: 5283377 - DNA, 20 bp, Homo sapiens
atttttgtatgttatgaaca

SEQ ID NO: 5283378 - DNA, 12 bp, Homo sapiens
atttttgtattt

SEQ ID NO: 5283379 - DNA, 21 bp, Homo sapiens
atttttgtcatgaactgtact

SEQ ID NO: 5283380 - DNA, 14 bp, Homo sapiens
atttttgtccctgc

SEQ ID NO: 5283381 - DNA, 15 bp, Homo sapiens
atttttgtccctgct

SEQ ID NO: 5283382 - DNA, 16 bp, Homo sapiens
atttttgtccctgctc

SEQ ID NO: 5283383 - DNA, 18 bp, Homo sapiens
atttttgtccctgctcct

SEQ ID NO: 5283384 - DNA, 16 bp, Homo sapiens
atttttgtctcagaag

SEQ ID NO: 5283385 - DNA, 16 bp, Homo sapiens
atttttgtctgcagct

SEQ ID NO: 5283386 - DNA, 13 bp, Homo sapiens
atttttgtgaaga

SEQ ID NO: 5283387 - DNA, 20 bp, Homo sapiens
atttttgtgaagtattcaca

SEQ ID NO: 5283388 - DNA, 22 bp, Homo sapiens
atttttgtgattttgtgattga

SEQ ID NO: 5283389 - DNA, 18 bp, Homo sapiens
atttttgtgccattatat

SEQ ID NO: 5283390 - DNA, 20 bp, Homo sapiens
atttttgttaagctcaggat

SEQ ID NO: 5283391 - DNA, 19 bp, Homo sapiens
atttttgttaatcatcttc

SEQ ID NO: 5283392 - DNA, 16 bp, Homo sapiens
atttttgttagcaaag

SEQ ID NO: 5283393 - DNA, 21 bp, Homo sapiens
atttttgttagtttacaatat

SEQ ID NO: 5283394 - DNA, 23 bp, Homo sapiens
atttttgttcttatggggtgaga

SEQ ID NO: 5283395 - DNA, 17 bp, Homo sapiens
atttttgttgcagtgta

SEQ ID NO: 5283396 - DNA, 12 bp, Homo sapiens
atttttgtttat

SEQ ID NO: 5283397 - DNA, 16 bp, Homo sapiens
atttttgtttctacct

SEQ ID NO: 5283398 - DNA, 17 bp, Homo sapiens
atttttgtttcttccaa

SEQ ID NO: 5283399 - DNA, 22 bp, Homo sapiens
atttttgtttcttccaaagcac

SEQ ID NO: 5283400 - DNA, 14 bp, Homo sapiens
atttttgtttggac

SEQ ID NO: 5283401 - DNA, 21 bp, Homo sapiens
attctggaaaaaaaatatata

SEQ ID NO: 5283402 - DNA, 13 bp, Homo sapiens
attctggaagctg

SEQ ID NO: 5283403 - DNA, 13 bp, Homo sapiens
attctggaaggaa

SEQ ID NO: 5283404 - DNA, 14 bp, Homo sapiens
attctggaaggaat

SEQ ID NO: 5283405 - DNA, 23 bp, Homo sapiens
attctggaatacatattccatgg

SEQ ID NO: 5283406 - DNA, 16 bp, Homo sapiens
attctggacagacaga

SEQ ID NO: 5283407 - DNA, 17 bp, Homo sapiens
attctggacagatttaa

SEQ ID NO: 5283408 - DNA, 15 bp, Homo sapiens
attctggacaggatg

SEQ ID NO: 5283409 - DNA, 20 bp, Homo sapiens
attctggacagtcagctctt

SEQ ID NO: 5283410 - DNA, 12 bp, Homo sapiens
attctggacctc

SEQ ID NO: 5283411 - DNA, 15 bp, Homo sapiens
attctggagatactg

SEQ ID NO: 5283412 - DNA, 20 bp, Homo sapiens
attctggaggggagagcttt

SEQ ID NO: 5283413 - DNA, 12 bp, Homo sapiens
attctggagtca

SEQ ID NO: 5283414 - DNA, 21 bp, Homo sapiens
attctggataaagccactgaa

SEQ ID NO: 5283415 - DNA, 17 bp, Homo sapiens
attctggatctgaccct

SEQ ID NO: 5283416 - DNA, 22 bp, Homo sapiens
attctggatggatttgaagcaa

SEQ ID NO: 5283417 - DNA, 16 bp, Homo sapiens
attctggcactttaat

SEQ ID NO: 5283418 - DNA, 14 bp, Homo sapiens
attctggcccagcc

SEQ ID NO: 5283419 - DNA, 15 bp, Homo sapiens
attctggcccagcca

SEQ ID NO: 5283420 - DNA, 12 bp, Homo sapiens
attctggctcca

SEQ ID NO: 5283421 - DNA, 14 bp, Homo sapiens
attctggctgaaaa

SEQ ID NO: 5283422 - DNA, 18 bp, Homo sapiens
attctggctgataaaaga

SEQ ID NO: 5283423 - DNA, 14 bp, Homo sapiens
attctggctttaag

SEQ ID NO: 5283424 - DNA, 16 bp, Homo sapiens
attctggctttaagcc

SEQ ID NO: 5283425 - DNA, 22 bp, Homo sapiens
attctgggaaatgttttaatgc

SEQ ID NO: 5283426 - DNA, 15 bp, Homo sapiens
attctgggaatgtat

SEQ ID NO: 5283427 - DNA, 19 bp, Homo sapiens
attctgggaatgtatagta

SEQ ID NO: 5283428 - DNA, 17 bp, Homo sapiens
attctgggcaaatagat

SEQ ID NO: 5283429 - DNA, 21 bp, Homo sapiens
attctgggcctaattttttaa

SEQ ID NO: 5283430 - DNA, 23 bp, Homo sapiens
attctgggggcccgacaggtggg

SEQ ID NO: 5283431 - DNA, 11 bp, Homo sapiens
attctgggtgc

SEQ ID NO: 5283432 - DNA, 16 bp, Homo sapiens
attctgggtgttttca

SEQ ID NO: 5283433 - DNA, 22 bp, Homo sapiens
attctgggtgttttcagaaaga

SEQ ID NO: 5283434 - DNA, 19 bp, Homo sapiens
attctgggttcatttgtga

SEQ ID NO: 5283435 - DNA, 17 bp, Homo sapiens
attctgggtttgcccag

SEQ ID NO: 5283436 - DNA, 19 bp, Homo sapiens
attctggtatacattgaat

SEQ ID NO: 5283437 - DNA, 19 bp, Homo sapiens
attctggtccttagtaaat

SEQ ID NO: 5283438 - DNA, 14 bp, Homo sapiens
attctggtgtttac

SEQ ID NO: 5283439 - DNA, 15 bp, Homo sapiens
attctggtgtttaca

SEQ ID NO: 5283440 - DNA, 19 bp, Homo sapiens
attctggttccagggtccc

SEQ ID NO: 5283441 - DNA, 23 bp, Homo sapiens
attctggttccagggtccctctg

SEQ ID NO: 5283442 - DNA, 17 bp, Homo sapiens
attctggttcttgaaaa

SEQ ID NO: 5283443 - DNA, 16 bp, Homo sapiens
attctggttgtaaatc

SEQ ID NO: 5283444 - DNA, 17 bp, Homo sapiens
attctgtaaaagaaaaa

SEQ ID NO: 5283445 - DNA, 14 bp, Homo sapiens
attctgtaaaatgt

SEQ ID NO: 5283446 - DNA, 20 bp, Homo sapiens
attctgtaaaatgtctgtta

SEQ ID NO: 5283447 - DNA, 12 bp, Homo sapiens
attctgtaattt

SEQ ID NO: 5283448 - DNA, 15 bp, Homo sapiens
attctgtaatttgaa

SEQ ID NO: 5283449 - DNA, 18 bp, Homo sapiens
attctgtacatagcctat

SEQ ID NO: 5283450 - DNA, 20 bp, Homo sapiens
attctgtacatagcctatat

SEQ ID NO: 5283451 - DNA, 13 bp, Homo sapiens
attctgtactgat

SEQ ID NO: 5283452 - DNA, 15 bp, Homo sapiens
attctgtagattctg

SEQ ID NO: 5283453 - DNA, 13 bp, Homo sapiens
attctgtatagat

SEQ ID NO: 5283454 - DNA, 12 bp, Homo sapiens
attctgtatccg

SEQ ID NO: 5283455 - DNA, 17 bp, Homo sapiens
attctgtatccgtgaat

SEQ ID NO: 5283456 - DNA, 20 bp, Homo sapiens
attctgtatctttcatcctt

SEQ ID NO: 5283457 - DNA, 20 bp, Homo sapiens
attctgtcattaaactcata

SEQ ID NO: 5283458 - DNA, 16 bp, Homo sapiens
attctgtccccaaaat

SEQ ID NO: 5283459 - DNA, 18 bp, Homo sapiens
attctgtccctaggtgtt

SEQ ID NO: 5283460 - DNA, 14 bp, Homo sapiens
attctgtccctcca

SEQ ID NO: 5283461 - DNA, 15 bp, Homo sapiens
attctgtctctgctt

SEQ ID NO: 5283462 - DNA, 24 bp, Homo sapiens
attctgtctctggattatattatg

SEQ ID NO: 5283463 - DNA, 20 bp, Homo sapiens
attctgtcttccaggcccag

SEQ ID NO: 5283464 - DNA, 11 bp, Homo sapiens
attctgtcttg

SEQ ID NO: 5283465 - DNA, 21 bp, Homo sapiens
attctgtctttcaaaaggtaa

SEQ ID NO: 5283466 - DNA, 18 bp, Homo sapiens
attctgtgaaactaatca

SEQ ID NO: 5283467 - DNA, 18 bp, Homo sapiens
attctgtgaccaaaatac

SEQ ID NO: 5283468 - DNA, 22 bp, Homo sapiens
attctgtgaccaaaataccttg

SEQ ID NO: 5283469 - DNA, 11 bp, Homo sapiens
attctgtgcag

SEQ ID NO: 5283470 - DNA, 16 bp, Homo sapiens
attctgtgcataaaag

SEQ ID NO: 5283471 - DNA, 17 bp, Homo sapiens
attctgtggaacaagcc

SEQ ID NO: 5283472 - DNA, 21 bp, Homo sapiens
attctgtggctgccatcagaa

SEQ ID NO: 5283473 - DNA, 19 bp, Homo sapiens
attctgtgggcagctggct

SEQ ID NO: 5283474 - DNA, 20 bp, Homo sapiens
attctgtgggcagctggctc

SEQ ID NO: 5283475 - DNA, 22 bp, Homo sapiens
attctgtgggcagctggctctg

SEQ ID NO: 5283476 - DNA, 16 bp, Homo sapiens
attctgtggttctata

SEQ ID NO: 5283477 - DNA, 21 bp, Homo sapiens
attctgtggttctataataag

SEQ ID NO: 5283478 - DNA, 16 bp, Homo sapiens
attctgtgtatctttt

SEQ ID NO: 5283479 - DNA, 21 bp, Homo sapiens
attctgtgtattaacatgcaa

SEQ ID NO: 5283480 - DNA, 14 bp, Homo sapiens
attctgtgtctctg

SEQ ID NO: 5283481 - DNA, 21 bp, Homo sapiens
attctgtgtgttttcataata

SEQ ID NO: 5283482 - DNA, 22 bp, Homo sapiens
attctgtgtgttttcataataa

SEQ ID NO: 5283483 - DNA, 14 bp, Homo sapiens
attctgtgttgaac

SEQ ID NO: 5283484 - DNA, 14 bp, Homo sapiens
attctgtgttgcat

SEQ ID NO: 5283485 - DNA, 18 bp, Homo sapiens
attctgtgttgcattatt

SEQ ID NO: 5283486 - DNA, 12 bp, Homo sapiens
attctgtgtttt

SEQ ID NO: 5283487 - DNA, 18 bp, Homo sapiens
attctgtgttttcagact

SEQ ID NO: 5283488 - DNA, 23 bp, Homo sapiens
attctgtgttttcagactgcctg

SEQ ID NO: 5283489 - DNA, 16 bp, Homo sapiens
attctgttaaaatcta

SEQ ID NO: 5283490 - DNA, 21 bp, Homo sapiens
attctgttaatgttaattaaa

SEQ ID NO: 5283491 - DNA, 17 bp, Homo sapiens
attctgttactttgcta

SEQ ID NO: 5283492 - DNA, 18 bp, Homo sapiens
attctgttagctgctcac

SEQ ID NO: 5283493 - DNA, 16 bp, Homo sapiens
attctgttatctcagg

SEQ ID NO: 5283494 - DNA, 18 bp, Homo sapiens
attctgttccctgggctg

SEQ ID NO: 5283495 - DNA, 14 bp, Homo sapiens
attctgttgcttta

SEQ ID NO: 5283496 - DNA, 15 bp, Homo sapiens
attctgttgtgttca

SEQ ID NO: 5283497 - DNA, 20 bp, Homo sapiens
attctgttgtgttcaccaga

SEQ ID NO: 5283498 - DNA, 21 bp, Homo sapiens
attctgttgttccattttatg

SEQ ID NO: 5283499 - DNA, 16 bp, Homo sapiens
attctgtttattatga

SEQ ID NO: 5283500 - DNA, 18 bp, Homo sapiens
attctgttttaggttaaa

SEQ ID NO: 5283501 - DNA, 12 bp, Homo sapiens
attctgttttgc

SEQ ID NO: 5283502 - DNA, 13 bp, Homo sapiens
attctgttttgca

SEQ ID NO: 5283503 - DNA, 14 bp, Homo sapiens
attctgttttgtta

SEQ ID NO: 5283504 - DNA, 17 bp, Homo sapiens
attctgttttgttaata

SEQ ID NO: 5283505 - DNA, 19 bp, Homo sapiens
attctgtttttaatgctat

SEQ ID NO: 5283506 - DNA, 16 bp, Homo sapiens
attcttaaaactataa

SEQ ID NO: 5283507 - DNA, 16 bp, Homo sapiens
attcttaaaggaaaag

SEQ ID NO: 5283508 - DNA, 19 bp, Homo sapiens
attcttaaagttgaattta

SEQ ID NO: 5283509 - DNA, 23 bp, Homo sapiens
attcttaacaagatatttatatg

SEQ ID NO: 5283510 - DNA, 17 bp, Homo sapiens
attcttaagcactttga

SEQ ID NO: 5283511 - DNA, 14 bp, Homo sapiens
attcttaagtcttt

SEQ ID NO: 5283512 - DNA, 21 bp, Homo sapiens
attcttaagtcttttgtctga

SEQ ID NO: 5283513 - DNA, 18 bp, Homo sapiens
attcttaatgttcacata

SEQ ID NO: 5283514 - DNA, 22 bp, Homo sapiens
attcttaattctctgcaacact

SEQ ID NO: 5283515 - DNA, 17 bp, Homo sapiens
attcttaatttggatct

SEQ ID NO: 5283516 - DNA, 17 bp, Homo sapiens
attcttacaaacatgtg

SEQ ID NO: 5283517 - DNA, 22 bp, Homo sapiens
attcttacaattgcactgctgt

SEQ ID NO: 5283518 - DNA, 14 bp, Homo sapiens
attcttacagccaa

SEQ ID NO: 5283519 - DNA, 17 bp, Homo sapiens
attcttacatgttttct

SEQ ID NO: 5283520 - DNA, 23 bp, Homo sapiens
attcttaccgaaatgaaaatggc

SEQ ID NO: 5283521 - DNA, 17 bp, Homo sapiens
attcttaccgagaaaag

SEQ ID NO: 5283522 - DNA, 19 bp, Homo sapiens
attcttacctcatttgcat

SEQ ID NO: 5283523 - DNA, 13 bp, Homo sapiens
attcttactaaaa

SEQ ID NO: 5283524 - DNA, 16 bp, Homo sapiens
attcttactgttctga

SEQ ID NO: 5283525 - DNA, 19 bp, Homo sapiens
attcttactgttctgaaat

SEQ ID NO: 5283526 - DNA, 15 bp, Homo sapiens
attcttactgttctt

SEQ ID NO: 5283527 - DNA, 15 bp, Homo sapiens
attcttagcaaaaaa

SEQ ID NO: 5283528 - DNA, 22 bp, Homo sapiens
attcttagcaaaaaatgaacag

SEQ ID NO: 5283529 - DNA, 20 bp, Homo sapiens
attcttagcctgtggcagta

SEQ ID NO: 5283530 - DNA, 16 bp, Homo sapiens
attcttagctcttggg

SEQ ID NO: 5283531 - DNA, 12 bp, Homo sapiens
attcttataaat

SEQ ID NO: 5283532 - DNA, 15 bp, Homo sapiens
attcttataaatatg

SEQ ID NO: 5283533 - DNA, 21 bp, Homo sapiens
attcttataacattgtatgtt

SEQ ID NO: 5283534 - DNA, 14 bp, Homo sapiens
attcttatgcttat

SEQ ID NO: 5283535 - DNA, 18 bp, Homo sapiens
attcttattcaaagaaat

SEQ ID NO: 5283536 - DNA, 22 bp, Homo sapiens
attcttattccatattagaaaa

SEQ ID NO: 5283537 - DNA, 19 bp, Homo sapiens
attcttattggaaatgtac

SEQ ID NO: 5283538 - DNA, 15 bp, Homo sapiens
attcttatttcccct

SEQ ID NO: 5283539 - DNA, 15 bp, Homo sapiens
attcttatttctgtg

SEQ ID NO: 5283540 - DNA, 17 bp, Homo sapiens
attcttatttctgtgtt

SEQ ID NO: 5283541 - DNA, 19 bp, Homo sapiens
attcttatttgatggtggt

SEQ ID NO: 5283542 - DNA, 17 bp, Homo sapiens
attcttattttataatt

SEQ ID NO: 5283543 - DNA, 18 bp, Homo sapiens
attcttcaacagggaaaa

SEQ ID NO: 5283544 - DNA, 12 bp, Homo sapiens
attcttcaactt

SEQ ID NO: 5283545 - DNA, 17 bp, Homo sapiens
attcttcacatgtaact

SEQ ID NO: 5283546 - DNA, 20 bp, Homo sapiens
attcttcacgcagagatttt

SEQ ID NO: 5283547 - DNA, 23 bp, Homo sapiens
attcttcagcaaaaatattttat

SEQ ID NO: 5283548 - DNA, 20 bp, Homo sapiens
attcttcagttggttgtgtc

SEQ ID NO: 5283549 - DNA, 23 bp, Homo sapiens
attcttcagttggttgtgtcttt

SEQ ID NO: 5283550 - DNA, 12 bp, Homo sapiens
attcttcatgaa

SEQ ID NO: 5283551 - DNA, 13 bp, Homo sapiens
attcttcatgaaa

SEQ ID NO: 5283552 - DNA, 20 bp, Homo sapiens
attcttcatgaaatgtgttt

SEQ ID NO: 5283553 - DNA, 17 bp, Homo sapiens
attcttccaacacattt

SEQ ID NO: 5283554 - DNA, 12 bp, Homo sapiens
attcttccactg

SEQ ID NO: 5283555 - DNA, 11 bp, Homo sapiens
attcttccaga

SEQ ID NO: 5283556 - DNA, 15 bp, Homo sapiens
attcttccagaatgc

SEQ ID NO: 5283557 - DNA, 19 bp, Homo sapiens
attcttccagtgcaacaaa

SEQ ID NO: 5283558 - DNA, 13 bp, Homo sapiens
attcttccatctg

SEQ ID NO: 5283559 - DNA, 23 bp, Homo sapiens
attcttccatctgattgtgatgt

SEQ ID NO: 5283560 - DNA, 20 bp, Homo sapiens
attcttcccaacttgccttt

SEQ ID NO: 5283561 - DNA, 19 bp, Homo sapiens
attcttcccgctccccacc

SEQ ID NO: 5283562 - DNA, 20 bp, Homo sapiens
attcttcccgctccccacct

SEQ ID NO: 5283563 - DNA, 24 bp, Homo sapiens
attcttcccgctccccacctaccc

SEQ ID NO: 5283564 - DNA, 14 bp, Homo sapiens
attcttccctgggg

SEQ ID NO: 5283565 - DNA, 19 bp, Homo sapiens
attcttccgggggaagggg

SEQ ID NO: 5283566 - DNA, 22 bp, Homo sapiens
attcttcctaatgtcagaacag

SEQ ID NO: 5283567 - DNA, 22 bp, Homo sapiens
attcttcctccctccctctttc

SEQ ID NO: 5283568 - DNA, 17 bp, Homo sapiens
attcttccttgccacaa

SEQ ID NO: 5283569 - DNA, 15 bp, Homo sapiens
attcttcggaggagg

SEQ ID NO: 5283570 - DNA, 20 bp, Homo sapiens
attcttctaaaagttttcta

SEQ ID NO: 5283571 - DNA, 23 bp, Homo sapiens
attcttctacttgtttaacattg

SEQ ID NO: 5283572 - DNA, 14 bp, Homo sapiens
attcttctaggcat

SEQ ID NO: 5283573 - DNA, 22 bp, Homo sapiens
attcttctaggggtagctggtg

SEQ ID NO: 5283574 - DNA, 19 bp, Homo sapiens
attcttctcataaatcttt

SEQ ID NO: 5283575 - DNA, 13 bp, Homo sapiens
attcttctccact

SEQ ID NO: 5283576 - DNA, 13 bp, Homo sapiens
attcttctgaact

SEQ ID NO: 5283577 - DNA, 14 bp, Homo sapiens
attcttctgcttca

SEQ ID NO: 5283578 - DNA, 19 bp, Homo sapiens
attcttctgcttcagcctc

SEQ ID NO: 5283579 - DNA, 20 bp, Homo sapiens
attcttctggtgctactcca

SEQ ID NO: 5283580 - DNA, 13 bp, Homo sapiens
atttttgtttgtt

SEQ ID NO: 5283581 - DNA, 15 bp, Homo sapiens
atttttgttttgaaa

SEQ ID NO: 5283582 - DNA, 16 bp, Homo sapiens
atttttgttttgaaag

SEQ ID NO: 5283583 - DNA, 21 bp, Homo sapiens
atttttgttttgtttttacaa

SEQ ID NO: 5283584 - DNA, 19 bp, Homo sapiens
atttttgtttttattaaaa

SEQ ID NO: 5283585 - DNA, 20 bp, Homo sapiens
attttttaaaaaaacaaatg

SEQ ID NO: 5283586 - DNA, 19 bp, Homo sapiens
attttttaaaaaagcttaa

SEQ ID NO: 5283587 - DNA, 14 bp, Homo sapiens
attttttaaaaatt

SEQ ID NO: 5283588 - DNA, 15 bp, Homo sapiens
attttttaaaaattg

SEQ ID NO: 5283589 - DNA, 21 bp, Homo sapiens
attttttaaaacactaaaagc

SEQ ID NO: 5283590 - DNA, 14 bp, Homo sapiens
attttttaaaagaa

SEQ ID NO: 5283591 - DNA, 17 bp, Homo sapiens
attttttaaaagccttc

SEQ ID NO: 5283592 - DNA, 16 bp, Homo sapiens
attttttaaaattcta

SEQ ID NO: 5283593 - DNA, 21 bp, Homo sapiens
attttttaaaattttggaata

SEQ ID NO: 5283594 - DNA, 19 bp, Homo sapiens
attttttaaacagatattc

SEQ ID NO: 5283595 - DNA, 17 bp, Homo sapiens
attttttaaagaatcca

SEQ ID NO: 5283596 - DNA, 12 bp, Homo sapiens
attttttaaagt

SEQ ID NO: 5283597 - DNA, 18 bp, Homo sapiens
attttttaaatcttgacc

SEQ ID NO: 5283598 - DNA, 14 bp, Homo sapiens
attttttaaatgaa

SEQ ID NO: 5283599 - DNA, 18 bp, Homo sapiens
attttttaaatgttcatg

SEQ ID NO: 5283600 - DNA, 16 bp, Homo sapiens
attttttaaatttaca

SEQ ID NO: 5283601 - DNA, 21 bp, Homo sapiens
attttttaaccccgtcaacaa

SEQ ID NO: 5283602 - DNA, 16 bp, Homo sapiens
attttttaactgctgc

SEQ ID NO: 5283603 - DNA, 21 bp, Homo sapiens
attttttaacttatgtatgtg

SEQ ID NO: 5283604 - DNA, 12 bp, Homo sapiens
attttttaagag

SEQ ID NO: 5283605 - DNA, 16 bp, Homo sapiens
attttttaaggaaaca

SEQ ID NO: 5283606 - DNA, 17 bp, Homo sapiens
attttttaaggaaacaa

SEQ ID NO: 5283607 - DNA, 14 bp, Homo sapiens
attttttaaggact

SEQ ID NO: 5283608 - DNA, 20 bp, Homo sapiens
attttttaaggcaaataaag

SEQ ID NO: 5283609 - DNA, 18 bp, Homo sapiens
attttttaagtatttata

SEQ ID NO: 5283610 - DNA, 20 bp, Homo sapiens
attttttaagtatttatata

SEQ ID NO: 5283611 - DNA, 16 bp, Homo sapiens
attttttaagtctatg

SEQ ID NO: 5283612 - DNA, 21 bp, Homo sapiens
attttttaagtgggctcctga

SEQ ID NO: 5283613 - DNA, 23 bp, Homo sapiens
attttttaagtgggctcctgaca

SEQ ID NO: 5283614 - DNA, 13 bp, Homo sapiens
attttttaataaa

SEQ ID NO: 5283615 - DNA, 15 bp, Homo sapiens
attttttaataaccc

SEQ ID NO: 5283616 - DNA, 15 bp, Homo sapiens
attttttaattatta

SEQ ID NO: 5283617 - DNA, 16 bp, Homo sapiens
attttttaattattgt

SEQ ID NO: 5283618 - DNA, 21 bp, Homo sapiens
attttttactacataattaaa

SEQ ID NO: 5283619 - DNA, 23 bp, Homo sapiens
attttttactacataattaaatt

SEQ ID NO: 5283620 - DNA, 15 bp, Homo sapiens
attttttagaccctc

SEQ ID NO: 5283621 - DNA, 17 bp, Homo sapiens
attttttagatcttcct

SEQ ID NO: 5283622 - DNA, 13 bp, Homo sapiens
attttttaggaaa

SEQ ID NO: 5283623 - DNA, 18 bp, Homo sapiens
attttttagtttgtgatt

SEQ ID NO: 5283624 - DNA, 17 bp, Homo sapiens
attttttataaaataca

SEQ ID NO: 5283625 - DNA, 13 bp, Homo sapiens
attttttatacag

SEQ ID NO: 5283626 - DNA, 13 bp, Homo sapiens
attttttatatat

SEQ ID NO: 5283627 - DNA, 18 bp, Homo sapiens
attttttatatttcaagt

SEQ ID NO: 5283628 - DNA, 21 bp, Homo sapiens
attttttatcatgcatgtcct

SEQ ID NO: 5283629 - DNA, 15 bp, Homo sapiens
attttttattcttgt

SEQ ID NO: 5283630 - DNA, 17 bp, Homo sapiens
attttttattcttgtga

SEQ ID NO: 5283631 - DNA, 15 bp, Homo sapiens
attttttatttaatt

SEQ ID NO: 5283632 - DNA, 16 bp, Homo sapiens
attttttatttacatt

SEQ ID NO: 5283633 - DNA, 14 bp, Homo sapiens
attttttatttcta

SEQ ID NO: 5283634 - DNA, 13 bp, Homo sapiens
attttttcaaatg

SEQ ID NO: 5283635 - DNA, 22 bp, Homo sapiens
attttttcagaaatatgtggtt

SEQ ID NO: 5283636 - DNA, 22 bp, Homo sapiens
attttttcagtattatatgtac

SEQ ID NO: 5283637 - DNA, 14 bp, Homo sapiens
attttttcagttgt

SEQ ID NO: 5283638 - DNA, 13 bp, Homo sapiens
attttttcatttc

SEQ ID NO: 5283639 - DNA, 14 bp, Homo sapiens
attttttcatttca

SEQ ID NO: 5283640 - DNA, 12 bp, Homo sapiens
attttttccaaa

SEQ ID NO: 5283641 - DNA, 15 bp, Homo sapiens
attttttccctcctg

SEQ ID NO: 5283642 - DNA, 16 bp, Homo sapiens
attttttcccttttta

SEQ ID NO: 5283643 - DNA, 19 bp, Homo sapiens
attttttcctgtaagacaa

SEQ ID NO: 5283644 - DNA, 19 bp, Homo sapiens
attttttctaataaagcca

SEQ ID NO: 5283645 - DNA, 14 bp, Homo sapiens
attttttctacaca

SEQ ID NO: 5283646 - DNA, 13 bp, Homo sapiens
attttttctatga

SEQ ID NO: 5283647 - DNA, 23 bp, Homo sapiens
attttttctctaggaaatattta

SEQ ID NO: 5283648 - DNA, 18 bp, Homo sapiens
attttttcttctgaagat

SEQ ID NO: 5283649 - DNA, 21 bp, Homo sapiens
attttttctttcttggcctca

SEQ ID NO: 5283650 - DNA, 13 bp, Homo sapiens
attttttgaaaca

SEQ ID NO: 5283651 - DNA, 14 bp, Homo sapiens
attttttgaaagtt

SEQ ID NO: 5283652 - DNA, 14 bp, Homo sapiens
attttttgaaatgc

SEQ ID NO: 5283653 - DNA, 22 bp, Homo sapiens
attttttgaaatgggcatttat

SEQ ID NO: 5283654 - DNA, 14 bp, Homo sapiens
attttttgaacttt

SEQ ID NO: 5283655 - DNA, 16 bp, Homo sapiens
attttttgaaggtttc

SEQ ID NO: 5283656 - DNA, 19 bp, Homo sapiens
attttttgatgtcagcctt

SEQ ID NO: 5283657 - DNA, 14 bp, Homo sapiens
attttttgcagtct

SEQ ID NO: 5283658 - DNA, 20 bp, Homo sapiens
attttttgctataatcatta

SEQ ID NO: 5283659 - DNA, 22 bp, Homo sapiens
attttttgggcagcaatttaaa

SEQ ID NO: 5283660 - DNA, 13 bp, Homo sapiens
attttttgggcca

SEQ ID NO: 5283661 - DNA, 21 bp, Homo sapiens
attttttggttaagctttgac

SEQ ID NO: 5283662 - DNA, 15 bp, Homo sapiens
attttttgtaactct

SEQ ID NO: 5283663 - DNA, 20 bp, Homo sapiens
attttttgtaactctttggc

SEQ ID NO: 5283664 - DNA, 14 bp, Homo sapiens
attttttgtataat

SEQ ID NO: 5283665 - DNA, 13 bp, Homo sapiens
attttttgtctgt

SEQ ID NO: 5283666 - DNA, 16 bp, Homo sapiens
attttttgtctgtgat

SEQ ID NO: 5283667 - DNA, 21 bp, Homo sapiens
attttttgtctgtgataacag

SEQ ID NO: 5283668 - DNA, 18 bp, Homo sapiens
attttttgttaaatgatt

SEQ ID NO: 5283669 - DNA, 23 bp, Homo sapiens
attttttgtttgtattgtaaaaa

SEQ ID NO: 5283670 - DNA, 15 bp, Homo sapiens
atttttttaaaatca

SEQ ID NO: 5283671 - DNA, 18 bp, Homo sapiens
atttttttaaaatcacta

SEQ ID NO: 5283672 - DNA, 15 bp, Homo sapiens
atttttttaaaattt

SEQ ID NO: 5283673 - DNA, 18 bp, Homo sapiens
atttttttaaatcaagga

SEQ ID NO: 5283674 - DNA, 16 bp, Homo sapiens
atttttttaaccaaag

SEQ ID NO: 5283675 - DNA, 23 bp, Homo sapiens
atttttttaacctaatatcactt

SEQ ID NO: 5283676 - DNA, 16 bp, Homo sapiens
atttttttaactgaaa

SEQ ID NO: 5283677 - DNA, 23 bp, Homo sapiens
atttttttaactgaaaatgtaaa

SEQ ID NO: 5283678 - DNA, 17 bp, Homo sapiens
atttttttaactgtgat

SEQ ID NO: 5283679 - DNA, 21 bp, Homo sapiens
atttttttaactgtgataatc

SEQ ID NO: 5283680 - DNA, 15 bp, Homo sapiens
atttttttaacttta

SEQ ID NO: 5283681 - DNA, 21 bp, Homo sapiens
atttttttaagctatcagcaa

SEQ ID NO: 5283682 - DNA, 15 bp, Homo sapiens
atttttttaagtctt

SEQ ID NO: 5283683 - DNA, 14 bp, Homo sapiens
atttttttaagtta

SEQ ID NO: 5283684 - DNA, 22 bp, Homo sapiens
atttttttaagttagagaatat

SEQ ID NO: 5283685 - DNA, 17 bp, Homo sapiens
atttttttaattttgta

SEQ ID NO: 5283686 - DNA, 20 bp, Homo sapiens
atttttttaccaattccaat

SEQ ID NO: 5283687 - DNA, 19 bp, Homo sapiens
atttttttaccttaaatct

SEQ ID NO: 5283688 - DNA, 15 bp, Homo sapiens
atttttttactgttt

SEQ ID NO: 5283689 - DNA, 22 bp, Homo sapiens
atttttttatctatgtggaaaa

SEQ ID NO: 5283690 - DNA, 21 bp, Homo sapiens
atttttttatcttgggactgg

SEQ ID NO: 5283691 - DNA, 16 bp, Homo sapiens
atttttttattactga

SEQ ID NO: 5283692 - DNA, 15 bp, Homo sapiens
atttttttattcttc

SEQ ID NO: 5283693 - DNA, 22 bp, Homo sapiens
atttttttattgtttaaagcaa

SEQ ID NO: 5283694 - DNA, 21 bp, Homo sapiens
atttttttcactggagttaca

SEQ ID NO: 5283695 - DNA, 13 bp, Homo sapiens
atttttttcagta

SEQ ID NO: 5283696 - DNA, 14 bp, Homo sapiens
atttttttcagtat

SEQ ID NO: 5283697 - DNA, 14 bp, Homo sapiens
atttttttccaagt

SEQ ID NO: 5283698 - DNA, 17 bp, Homo sapiens
atttttttccaagtgta

SEQ ID NO: 5283699 - DNA, 23 bp, Homo sapiens
atttttttccaagtgtataatgt

SEQ ID NO: 5283700 - DNA, 16 bp, Homo sapiens
atttttttccagaatt

SEQ ID NO: 5283701 - DNA, 18 bp, Homo sapiens
atttttttccagaattga

SEQ ID NO: 5283702 - DNA, 22 bp, Homo sapiens
atttttttcccaaggagtaacc

SEQ ID NO: 5283703 - DNA, 13 bp, Homo sapiens
atttttttcccat

SEQ ID NO: 5283704 - DNA, 15 bp, Homo sapiens
atttttttcccatga

SEQ ID NO: 5283705 - DNA, 13 bp, Homo sapiens
atttttttcctaa

SEQ ID NO: 5283706 - DNA, 18 bp, Homo sapiens
atttttttcctaagacat

SEQ ID NO: 5283707 - DNA, 16 bp, Homo sapiens
atttttttcctaagtt

SEQ ID NO: 5283708 - DNA, 19 bp, Homo sapiens
atttttttccttacataaa

SEQ ID NO: 5283709 - DNA, 20 bp, Homo sapiens
atttttttcctttgcattca

SEQ ID NO: 5283710 - DNA, 12 bp, Homo sapiens
atttttttctac

SEQ ID NO: 5283711 - DNA, 18 bp, Homo sapiens
atttttttctacataatt

SEQ ID NO: 5283712 - DNA, 21 bp, Homo sapiens
atttttttctacataattgtg

SEQ ID NO: 5283713 - DNA, 13 bp, Homo sapiens
atttttttctctc

SEQ ID NO: 5283714 - DNA, 17 bp, Homo sapiens
atttttttctctctgga

SEQ ID NO: 5283715 - DNA, 16 bp, Homo sapiens
atttttttctgattgt

SEQ ID NO: 5283716 - DNA, 19 bp, Homo sapiens
atttttttctgcacagctt

SEQ ID NO: 5283717 - DNA, 15 bp, Homo sapiens
atttttttctgtaaa

SEQ ID NO: 5283718 - DNA, 18 bp, Homo sapiens
atttttttctttctttgt

SEQ ID NO: 5283719 - DNA, 22 bp, Homo sapiens
atttttttctttttaaaataga

SEQ ID NO: 5283720 - DNA, 16 bp, Homo sapiens
atttttttgaaaaaag

SEQ ID NO: 5283721 - DNA, 22 bp, Homo sapiens
atttttttgaactcttctcatt

SEQ ID NO: 5283722 - DNA, 16 bp, Homo sapiens
atttttttgagacaga

SEQ ID NO: 5283723 - DNA, 18 bp, Homo sapiens
atttttttgatggctaag

SEQ ID NO: 5283724 - DNA, 17 bp, Homo sapiens
atttttttgcaagtgaa

SEQ ID NO: 5283725 - DNA, 20 bp, Homo sapiens
atttttttgcaagtgaaggt

SEQ ID NO: 5283726 - DNA, 23 bp, Homo sapiens
atttttttgtaaaggaaataatt

SEQ ID NO: 5283727 - DNA, 13 bp, Homo sapiens
atttttttgtaag

SEQ ID NO: 5283728 - DNA, 13 bp, Homo sapiens
atttttttgtaat

SEQ ID NO: 5283729 - DNA, 13 bp, Homo sapiens
atttttttgtatg

SEQ ID NO: 5283730 - DNA, 13 bp, Homo sapiens
atttttttgtctt

SEQ ID NO: 5283731 - DNA, 13 bp, Homo sapiens
atttttttgttgt

SEQ ID NO: 5283732 - DNA, 16 bp, Homo sapiens
atttttttgttgttta

SEQ ID NO: 5283733 - DNA, 18 bp, Homo sapiens
atttttttgttgtttgtt

SEQ ID NO: 5283734 - DNA, 22 bp, Homo sapiens
attttttttaaaatagaaattt

SEQ ID NO: 5283735 - DNA, 16 bp, Homo sapiens
attttttttaaagaaa

SEQ ID NO: 5283736 - DNA, 19 bp, Homo sapiens
attttttttaacaaatcta

SEQ ID NO: 5283737 - DNA, 14 bp, Homo sapiens
attttttttaactg

SEQ ID NO: 5283738 - DNA, 20 bp, Homo sapiens
attttttttaactgcattct

SEQ ID NO: 5283739 - DNA, 18 bp, Homo sapiens
attttttttaagtattta

SEQ ID NO: 5283740 - DNA, 19 bp, Homo sapiens
attttttttaagttcactt

SEQ ID NO: 5283741 - DNA, 20 bp, Homo sapiens
attttttttaatgcttaaga

SEQ ID NO: 5283742 - DNA, 18 bp, Homo sapiens
attttttttaattgtatt

SEQ ID NO: 5283743 - DNA, 14 bp, Homo sapiens
attttttttagtat

SEQ ID NO: 5283744 - DNA, 16 bp, Homo sapiens
attttttttatattta

SEQ ID NO: 5283745 - DNA, 12 bp, Homo sapiens
attttttttcaa

SEQ ID NO: 5283746 - DNA, 14 bp, Homo sapiens
attttttttcaaaa

SEQ ID NO: 5283747 - DNA, 21 bp, Homo sapiens
attttttttcaagtgctaaaa

SEQ ID NO: 5283748 - DNA, 14 bp, Homo sapiens
attttttttcatgt

SEQ ID NO: 5283749 - DNA, 23 bp, Homo sapiens
attttttttccgtaaatgtctgc

SEQ ID NO: 5283750 - DNA, 14 bp, Homo sapiens
attttttttccgtg

SEQ ID NO: 5283751 - DNA, 19 bp, Homo sapiens
attttttttccttgcctgt

SEQ ID NO: 5283752 - DNA, 17 bp, Homo sapiens
attttttttctgttata

SEQ ID NO: 5283753 - DNA, 16 bp, Homo sapiens
attttttttctttgaa

SEQ ID NO: 5283754 - DNA, 22 bp, Homo sapiens
attttttttggcctgtttgatg

SEQ ID NO: 5283755 - DNA, 17 bp, Homo sapiens
attttttttggtcaaat

SEQ ID NO: 5283756 - DNA, 23 bp, Homo sapiens
atttttttttaacgtggcttgta

SEQ ID NO: 5283757 - DNA, 20 bp, Homo sapiens
atttttttttaagctctgag

SEQ ID NO: 5283758 - DNA, 15 bp, Homo sapiens
atttttttttagaac

SEQ ID NO: 5283759 - DNA, 19 bp, Homo sapiens
atttttttttcaatcaact

SEQ ID NO: 5283760 - DNA, 22 bp, Homo sapiens
attcttctgtacgtctgacagg

SEQ ID NO: 5283761 - DNA, 15 bp, Homo sapiens
attcttctgtcctga

SEQ ID NO: 5283762 - DNA, 13 bp, Homo sapiens
attcttctgtgtt

SEQ ID NO: 5283763 - DNA, 14 bp, Homo sapiens
attcttctgtgttt

SEQ ID NO: 5283764 - DNA, 14 bp, Homo sapiens
attcttctgttctc

SEQ ID NO: 5283765 - DNA, 13 bp, Homo sapiens
attcttgaaagta

SEQ ID NO: 5283766 - DNA, 14 bp, Homo sapiens
attcttgaagtcag

SEQ ID NO: 5283767 - DNA, 18 bp, Homo sapiens
attcttgagaagtaactg

SEQ ID NO: 5283768 - DNA, 13 bp, Homo sapiens
attcttgatctct

SEQ ID NO: 5283769 - DNA, 16 bp, Homo sapiens
attcttgatctctaat

SEQ ID NO: 5283770 - DNA, 22 bp, Homo sapiens
attcttgatgaaaagctttgtt

SEQ ID NO: 5283771 - DNA, 16 bp, Homo sapiens
attcttgatgtaaaat

SEQ ID NO: 5283772 - DNA, 13 bp, Homo sapiens
attcttgattgct

SEQ ID NO: 5283773 - DNA, 16 bp, Homo sapiens
attcttgattgtttta

SEQ ID NO: 5283774 - DNA, 16 bp, Homo sapiens
attcttgattttcaag

SEQ ID NO: 5283775 - DNA, 21 bp, Homo sapiens
attcttgattttcaagctttc

SEQ ID NO: 5283776 - DNA, 16 bp, Homo sapiens
attcttgcaaagtatc

SEQ ID NO: 5283777 - DNA, 13 bp, Homo sapiens
attcttgcactgt

SEQ ID NO: 5283778 - DNA, 12 bp, Homo sapiens
attcttgcatat

SEQ ID NO: 5283779 - DNA, 13 bp, Homo sapiens
attcttgcatatt

SEQ ID NO: 5283780 - DNA, 14 bp, Homo sapiens
attcttgctctgct

SEQ ID NO: 5283781 - DNA, 19 bp, Homo sapiens
attcttgctgggcatactt

SEQ ID NO: 5283782 - DNA, 20 bp, Homo sapiens
attcttgctgggcatacttt

SEQ ID NO: 5283783 - DNA, 21 bp, Homo sapiens
attcttgctgggcatactttc

SEQ ID NO: 5283784 - DNA, 22 bp, Homo sapiens
attcttgctgggcatactttct

SEQ ID NO: 5283785 - DNA, 19 bp, Homo sapiens
attcttggaccatgccaga

SEQ ID NO: 5283786 - DNA, 21 bp, Homo sapiens
attcttggaccatgccagatt

SEQ ID NO: 5283787 - DNA, 21 bp, Homo sapiens
attcttggcccgcacagagct

SEQ ID NO: 5283788 - DNA, 15 bp, Homo sapiens
attcttgggaaacac

SEQ ID NO: 5283789 - DNA, 19 bp, Homo sapiens
attcttggttcttatttaa

SEQ ID NO: 5283790 - DNA, 13 bp, Homo sapiens
attcttgtaaatc

SEQ ID NO: 5283791 - DNA, 14 bp, Homo sapiens
attcttgtaaatct

SEQ ID NO: 5283792 - DNA, 15 bp, Homo sapiens
attcttgtccacatt

SEQ ID NO: 5283793 - DNA, 13 bp, Homo sapiens
attcttgtgaata

SEQ ID NO: 5283794 - DNA, 15 bp, Homo sapiens
attcttgtgcctcag

SEQ ID NO: 5283795 - DNA, 12 bp, Homo sapiens
attcttgtgctt

SEQ ID NO: 5283796 - DNA, 18 bp, Homo sapiens
attcttgtgggagacagc

SEQ ID NO: 5283797 - DNA, 19 bp, Homo sapiens
attcttgtgggagacagca

SEQ ID NO: 5283798 - DNA, 20 bp, Homo sapiens
attcttgtgggagacagcag

SEQ ID NO: 5283799 - DNA, 20 bp, Homo sapiens
attcttgtggttaaaaacct

SEQ ID NO: 5283800 - DNA, 14 bp, Homo sapiens
attcttgtgtctgt

SEQ ID NO: 5283801 - DNA, 19 bp, Homo sapiens
attcttgttggtagcatgt

SEQ ID NO: 5283802 - DNA, 23 bp, Homo sapiens
attcttgttttctttctttaaat

SEQ ID NO: 5283803 - DNA, 21 bp, Homo sapiens
attctttaaacaaatatgaaa

SEQ ID NO: 5283804 - DNA, 21 bp, Homo sapiens
attctttaaatatatattatt

SEQ ID NO: 5283805 - DNA, 20 bp, Homo sapiens
attctttaacatacatctaa

SEQ ID NO: 5283806 - DNA, 19 bp, Homo sapiens
attctttaatgattcctat

SEQ ID NO: 5283807 - DNA, 17 bp, Homo sapiens
attctttaattgttgct

SEQ ID NO: 5283808 - DNA, 12 bp, Homo sapiens
attctttacaaa

SEQ ID NO: 5283809 - DNA, 23 bp, Homo sapiens
attctttacaaactgaagataat

SEQ ID NO: 5283810 - DNA, 17 bp, Homo sapiens
attctttactgcactca

SEQ ID NO: 5283811 - DNA, 14 bp, Homo sapiens
attctttataattg

SEQ ID NO: 5283812 - DNA, 21 bp, Homo sapiens
attctttatacaacagtgcta

SEQ ID NO: 5283813 - DNA, 15 bp, Homo sapiens
attctttatagtgaa

SEQ ID NO: 5283814 - DNA, 20 bp, Homo sapiens
attctttatagtgaagtgtt

SEQ ID NO: 5283815 - DNA, 15 bp, Homo sapiens
attctttatcacatg

SEQ ID NO: 5283816 - DNA, 18 bp, Homo sapiens
attctttattctcagtaa

SEQ ID NO: 5283817 - DNA, 22 bp, Homo sapiens
attctttattctcagtaacttt

SEQ ID NO: 5283818 - DNA, 17 bp, Homo sapiens
attctttatttctgtca

SEQ ID NO: 5283819 - DNA, 16 bp, Homo sapiens
attctttcaatacaga

SEQ ID NO: 5283820 - DNA, 18 bp, Homo sapiens
attctttcaatacagata

SEQ ID NO: 5283821 - DNA, 19 bp, Homo sapiens
attctttcaatacagatat

SEQ ID NO: 5283822 - DNA, 21 bp, Homo sapiens
attctttcaatacagatatat

SEQ ID NO: 5283823 - DNA, 14 bp, Homo sapiens
attctttcaattct

SEQ ID NO: 5283824 - DNA, 22 bp, Homo sapiens
attctttcacaaggcatccata

SEQ ID NO: 5283825 - DNA, 18 bp, Homo sapiens
attctttcacttgatgtt

SEQ ID NO: 5283826 - DNA, 18 bp, Homo sapiens
attctttcagctatcagt

SEQ ID NO: 5283827 - DNA, 15 bp, Homo sapiens
attctttcagttctt

SEQ ID NO: 5283828 - DNA, 21 bp, Homo sapiens
attctttccattatgattctt

SEQ ID NO: 5283829 - DNA, 15 bp, Homo sapiens
attctttccatttgc

SEQ ID NO: 5283830 - DNA, 16 bp, Homo sapiens
attctttccatttgca

SEQ ID NO: 5283831 - DNA, 20 bp, Homo sapiens
attctttccatttgcatttg

SEQ ID NO: 5283832 - DNA, 22 bp, Homo sapiens
attctttccatttgcatttgtt

SEQ ID NO: 5283833 - DNA, 12 bp, Homo sapiens
attctttcccag

SEQ ID NO: 5283834 - DNA, 13 bp, Homo sapiens
attctttccccag

SEQ ID NO: 5283835 - DNA, 22 bp, Homo sapiens
attctttcctgaggctgggctc

SEQ ID NO: 5283836 - DNA, 17 bp, Homo sapiens
attctttcgaaagaaga

SEQ ID NO: 5283837 - DNA, 20 bp, Homo sapiens
attctttctattttcacaat

SEQ ID NO: 5283838 - DNA, 19 bp, Homo sapiens
attctttctcataaaactg

SEQ ID NO: 5283839 - DNA, 17 bp, Homo sapiens
attctttctctttgaaa

SEQ ID NO: 5283840 - DNA, 20 bp, Homo sapiens
attctttctgttgaaaagca

SEQ ID NO: 5283841 - DNA, 14 bp, Homo sapiens
attctttcttcctc

SEQ ID NO: 5283842 - DNA, 20 bp, Homo sapiens
attctttcttggtgcattcg

SEQ ID NO: 5283843 - DNA, 12 bp, Homo sapiens
attctttgaaca

SEQ ID NO: 5283844 - DNA, 17 bp, Homo sapiens
attctttgaacatgaac

SEQ ID NO: 5283845 - DNA, 19 bp, Homo sapiens
attctttgaacatgaacta

SEQ ID NO: 5283846 - DNA, 20 bp, Homo sapiens
attctttgacatttggtggt

SEQ ID NO: 5283847 - DNA, 18 bp, Homo sapiens
attctttgagatagccca

SEQ ID NO: 5283848 - DNA, 22 bp, Homo sapiens
attctttgatatgttgatgaaa

SEQ ID NO: 5283849 - DNA, 14 bp, Homo sapiens
attctttgatgtta

SEQ ID NO: 5283850 - DNA, 15 bp, Homo sapiens
attctttgcaaaaat

SEQ ID NO: 5283851 - DNA, 16 bp, Homo sapiens
attctttgcaatactg

SEQ ID NO: 5283852 - DNA, 14 bp, Homo sapiens
attctttgcattcc

SEQ ID NO: 5283853 - DNA, 14 bp, Homo sapiens
attctttgctagtt

SEQ ID NO: 5283854 - DNA, 21 bp, Homo sapiens
attctttggagttaaaatgca

SEQ ID NO: 5283855 - DNA, 22 bp, Homo sapiens
attctttggagttgtcacatca

SEQ ID NO: 5283856 - DNA, 17 bp, Homo sapiens
attctttggtaattttt

SEQ ID NO: 5283857 - DNA, 17 bp, Homo sapiens
attctttgttaatttgg

SEQ ID NO: 5283858 - DNA, 15 bp, Homo sapiens
attctttgttctgtt

SEQ ID NO: 5283859 - DNA, 21 bp, Homo sapiens
attctttgtttatgcactttt

SEQ ID NO: 5283860 - DNA, 14 bp, Homo sapiens
attctttgtttcct

SEQ ID NO: 5283861 - DNA, 13 bp, Homo sapiens
attcttttaaaag

SEQ ID NO: 5283862 - DNA, 22 bp, Homo sapiens
attcttttaaaagacaagactt

SEQ ID NO: 5283863 - DNA, 15 bp, Homo sapiens
attcttttaaatctc

SEQ ID NO: 5283864 - DNA, 14 bp, Homo sapiens
attcttttaaatta

SEQ ID NO: 5283865 - DNA, 14 bp, Homo sapiens
attcttttaacttc

SEQ ID NO: 5283866 - DNA, 22 bp, Homo sapiens
attcttttaattgtttcagaat

SEQ ID NO: 5283867 - DNA, 17 bp, Homo sapiens
attcttttataaatatt

SEQ ID NO: 5283868 - DNA, 18 bp, Homo sapiens
attcttttataataatga

SEQ ID NO: 5283869 - DNA, 15 bp, Homo sapiens
attcttttattaatg

SEQ ID NO: 5283870 - DNA, 22 bp, Homo sapiens
attcttttcagcttgtttctat

SEQ ID NO: 5283871 - DNA, 21 bp, Homo sapiens
attcttttccagaaagaaaat

SEQ ID NO: 5283872 - DNA, 20 bp, Homo sapiens
attcttttcccatcaccaga

SEQ ID NO: 5283873 - DNA, 22 bp, Homo sapiens
attcttttctataatgtgcctg

SEQ ID NO: 5283874 - DNA, 20 bp, Homo sapiens
attcttttctgcaaaataga

SEQ ID NO: 5283875 - DNA, 16 bp, Homo sapiens
attcttttgaaagatg

SEQ ID NO: 5283876 - DNA, 16 bp, Homo sapiens
attctttttaaagtat

SEQ ID NO: 5283877 - DNA, 16 bp, Homo sapiens
attctttttctttttt

SEQ ID NO: 5283878 - DNA, 13 bp, Homo sapiens
attctttttgctc

SEQ ID NO: 5283879 - DNA, 19 bp, Homo sapiens
attctttttgctctaaaat

SEQ ID NO: 5283880 - DNA, 20 bp, Homo sapiens
attctttttgctctaaaata

SEQ ID NO: 5283881 - DNA, 17 bp, Homo sapiens
attcttttttaaatttt

SEQ ID NO: 5283882 - DNA, 20 bp, Homo sapiens
attcttttttattaatcact

SEQ ID NO: 5283883 - DNA, 22 bp, Homo sapiens
attcttttttattaatcactgt

SEQ ID NO: 5283884 - DNA, 15 bp, Homo sapiens
attcttttttcaatg

SEQ ID NO: 5283885 - DNA, 18 bp, Homo sapiens
attctttttttctctaga

SEQ ID NO: 5283886 - DNA, 19 bp, Homo sapiens
attgaaaaaaaaaatgttg

SEQ ID NO: 5283887 - DNA, 15 bp, Homo sapiens
attgaaaaaaataat

SEQ ID NO: 5283888 - DNA, 16 bp, Homo sapiens
attgaaaaaaatatat

SEQ ID NO: 5283889 - DNA, 19 bp, Homo sapiens
attgaaaaaaattgaaata

SEQ ID NO: 5283890 - DNA, 16 bp, Homo sapiens
attgaaaaaaattggc

SEQ ID NO: 5283891 - DNA, 12 bp, Homo sapiens
attgaaaaaaca

SEQ ID NO: 5283892 - DNA, 14 bp, Homo sapiens
attgaaaaaagaga

SEQ ID NO: 5283893 - DNA, 16 bp, Homo sapiens
attgaaaaaagagaaa

SEQ ID NO: 5283894 - DNA, 16 bp, Homo sapiens
attgaaaaacaatttt

SEQ ID NO: 5283895 - DNA, 15 bp, Homo sapiens
attgaaaaaggaaaa

SEQ ID NO: 5283896 - DNA, 18 bp, Homo sapiens
attgaaaaataaaaacca

SEQ ID NO: 5283897 - DNA, 17 bp, Homo sapiens
attgaaaaatttctaac

SEQ ID NO: 5283898 - DNA, 14 bp, Homo sapiens
attgaaaacaaaga

SEQ ID NO: 5283899 - DNA, 14 bp, Homo sapiens
attgaaaacactaa

SEQ ID NO: 5283900 - DNA, 15 bp, Homo sapiens
attgaaaacactaac

SEQ ID NO: 5283901 - DNA, 19 bp, Homo sapiens
attgaaaacactaacaaaa

SEQ ID NO: 5283902 - DNA, 14 bp, Homo sapiens
attgaaaacactta

SEQ ID NO: 5283903 - DNA, 15 bp, Homo sapiens
attgaaaacttcaaa

SEQ ID NO: 5283904 - DNA, 19 bp, Homo sapiens
attgaaaacttcaaagctg

SEQ ID NO: 5283905 - DNA, 21 bp, Homo sapiens
attgaaaagaagaaagtctat

SEQ ID NO: 5283906 - DNA, 17 bp, Homo sapiens
attgaaaaggaagatca

SEQ ID NO: 5283907 - DNA, 13 bp, Homo sapiens
attgaaaaggaca

SEQ ID NO: 5283908 - DNA, 12 bp, Homo sapiens
attgaaaagtac

SEQ ID NO: 5283909 - DNA, 13 bp, Homo sapiens
attgaaaatatat

SEQ ID NO: 5283910 - DNA, 15 bp, Homo sapiens
attgaaaatcttgtg

SEQ ID NO: 5283911 - DNA, 20 bp, Homo sapiens
attgaaaatggtattaaaga

SEQ ID NO: 5283912 - DNA, 20 bp, Homo sapiens
attgaaaatgtaagtaaatg

SEQ ID NO: 5283913 - DNA, 22 bp, Homo sapiens
attgaaaattattaatcagaag

SEQ ID NO: 5283914 - DNA, 12 bp, Homo sapiens
attgaaacactt

SEQ ID NO: 5283915 - DNA, 19 bp, Homo sapiens
attgaaactagttatttta

SEQ ID NO: 5283916 - DNA, 15 bp, Homo sapiens
attgaaactgtattt

SEQ ID NO: 5283917 - DNA, 18 bp, Homo sapiens
attgaaactgtatttact

SEQ ID NO: 5283918 - DNA, 12 bp, Homo sapiens
attgaaagaaaa

SEQ ID NO: 5283919 - DNA, 13 bp, Homo sapiens
attgaaagaaaaa

SEQ ID NO: 5283920 - DNA, 14 bp, Homo sapiens
attgaaagaaaaaa

SEQ ID NO: 5283921 - DNA, 14 bp, Homo sapiens
attgaaagaactta

SEQ ID NO: 5283922 - DNA, 13 bp, Homo sapiens
attgaaagaatgt

SEQ ID NO: 5283923 - DNA, 14 bp, Homo sapiens
attgaaagcttcaa

SEQ ID NO: 5283924 - DNA, 19 bp, Homo sapiens
attgaaagcttttaaaatg

SEQ ID NO: 5283925 - DNA, 20 bp, Homo sapiens
attgaaaggacctcttctga

SEQ ID NO: 5283926 - DNA, 15 bp, Homo sapiens
attgaaagggacaag

SEQ ID NO: 5283927 - DNA, 18 bp, Homo sapiens
attgaaagggacaagtat

SEQ ID NO: 5283928 - DNA, 22 bp, Homo sapiens
attgaaagtattcagaaattaa

SEQ ID NO: 5283929 - DNA, 14 bp, Homo sapiens
attgaaagttgctt

SEQ ID NO: 5283930 - DNA, 19 bp, Homo sapiens
attgaaagttgcttttatt

SEQ ID NO: 5283931 - DNA, 22 bp, Homo sapiens
attgaaatagtttccaagaaat

SEQ ID NO: 5283932 - DNA, 23 bp, Homo sapiens
attgaaatagtttccaagaaatt

SEQ ID NO: 5283933 - DNA, 16 bp, Homo sapiens
attgaaatgactaaaa

SEQ ID NO: 5283934 - DNA, 17 bp, Homo sapiens
attgaaatgctgtattt

SEQ ID NO: 5283935 - DNA, 20 bp, Homo sapiens
attgaaatggggcgctggac

SEQ ID NO: 5283936 - DNA, 14 bp, Homo sapiens
attgaaatgtaagg

SEQ ID NO: 5283937 - DNA, 18 bp, Homo sapiens
attgaaatgtaatttcag

SEQ ID NO: 5283938 - DNA, 21 bp, Homo sapiens
attgaaatgtataattaactt

SEQ ID NO: 5283939 - DNA, 19 bp, Homo sapiens
attgaaattatagtttcaa

SEQ ID NO: 5283940 - DNA, 16 bp, Homo sapiens
atttttttttcataca

SEQ ID NO: 5283941 - DNA, 19 bp, Homo sapiens
atttttttttcatacactt

SEQ ID NO: 5283942 - DNA, 21 bp, Homo sapiens
atttttttttcatacacttat

SEQ ID NO: 5283943 - DNA, 12 bp, Homo sapiens
atttttttttcc

SEQ ID NO: 5283944 - DNA, 16 bp, Homo sapiens
atttttttttctttca

SEQ ID NO: 5283945 - DNA, 16 bp, Homo sapiens
atttttttttgtaaag

SEQ ID NO: 5283946 - DNA, 22 bp, Homo sapiens
attttttttttaacttgaaaag

SEQ ID NO: 5283947 - DNA, 20 bp, Homo sapiens
attttttttttccattagta

SEQ ID NO: 5283948 - DNA, 21 bp, Homo sapiens
attttttttttctttttgggg

SEQ ID NO: 5283949 - DNA, 23 bp, Homo sapiens
atttttttttttgttcttgatgg

SEQ ID NO: 5283950 - DNA, 22 bp, Homo sapiens
attttttttttttggtaattat

SEQ ID NO: 5283951 - DNA, 23 bp, Homo sapiens
atttttttttttttttttttaag

SEQ ID NO: 5283952 - DNA, 22 bp, Homo sapiens
caaaaaaaaaaaaaagcatcta

SEQ ID NO: 5283953 - DNA, 17 bp, Homo sapiens
caaaaaaaaaaaaaatc

SEQ ID NO: 5283954 - DNA, 17 bp, Homo sapiens
caaaaaaaaaaaaggaa

SEQ ID NO: 5283955 - DNA, 22 bp, Homo sapiens
caaaaaaaaaaaagtgtcttgt

SEQ ID NO: 5283956 - DNA, 15 bp, Homo sapiens
caaaaaaaaaaagat

SEQ ID NO: 5283957 - DNA, 15 bp, Homo sapiens
caaaaaaaaaaccct

SEQ ID NO: 5283958 - DNA, 14 bp, Homo sapiens
caaaaaaaaaagaa

SEQ ID NO: 5283959 - DNA, 17 bp, Homo sapiens
caaaaaaaaaatagaga

SEQ ID NO: 5283960 - DNA, 21 bp, Homo sapiens
caaaaaaaaaatagagagaga

SEQ ID NO: 5283961 - DNA, 19 bp, Homo sapiens
caaaaaaaaagttttattt

SEQ ID NO: 5283962 - DNA, 22 bp, Homo sapiens
caaaaaaaaagttttatttttc

SEQ ID NO: 5283963 - DNA, 21 bp, Homo sapiens
caaaaaaaaattttaaagacc

SEQ ID NO: 5283964 - DNA, 15 bp, Homo sapiens
caaaaaaaaattttt

SEQ ID NO: 5283965 - DNA, 13 bp, Homo sapiens
caaaaaaaacaac

SEQ ID NO: 5283966 - DNA, 14 bp, Homo sapiens
caaaaaaaacaaca

SEQ ID NO: 5283967 - DNA, 12 bp, Homo sapiens
caaaaaaaagaa

SEQ ID NO: 5283968 - DNA, 20 bp, Homo sapiens
caaaaaaaagcatgaatatt

SEQ ID NO: 5283969 - DNA, 15 bp, Homo sapiens
caaaaaaaatttaaa

SEQ ID NO: 5283970 - DNA, 17 bp, Homo sapiens
caaaaaaaatttaaaaa

SEQ ID NO: 5283971 - DNA, 21 bp, Homo sapiens
caaaaaaaatttagccgggcg

SEQ ID NO: 5283972 - DNA, 18 bp, Homo sapiens
caaaaaaacaagttatta

SEQ ID NO: 5283973 - DNA, 22 bp, Homo sapiens
caaaaaaaccacaaaggccaaa

SEQ ID NO: 5283974 - DNA, 10 bp, Homo sapiens
caaaaaaaga

SEQ ID NO: 5283975 - DNA, 13 bp, Homo sapiens
caaaaaaagcaac

SEQ ID NO: 5283976 - DNA, 18 bp, Homo sapiens
caaaaaaagcaacttttc

SEQ ID NO: 5283977 - DNA, 14 bp, Homo sapiens
caaaaaaaggaaaa

SEQ ID NO: 5283978 - DNA, 13 bp, Homo sapiens
caaaaaaagttgt

SEQ ID NO: 5283979 - DNA, 21 bp, Homo sapiens
caaaaaaatatcagacaagca

SEQ ID NO: 5283980 - DNA, 21 bp, Homo sapiens
caaaaaaatctgcagaaggaa

SEQ ID NO: 5283981 - DNA, 16 bp, Homo sapiens
caaaaaaatttaaaat

SEQ ID NO: 5283982 - DNA, 22 bp, Homo sapiens
caaaaaacaatatttattgtat

SEQ ID NO: 5283983 - DNA, 11 bp, Homo sapiens
caaaaaacaga

SEQ ID NO: 5283984 - DNA, 13 bp, Homo sapiens
caaaaaacatgag

SEQ ID NO: 5283985 - DNA, 11 bp, Homo sapiens
caaaaaactac

SEQ ID NO: 5283986 - DNA, 19 bp, Homo sapiens
caaaaaactctctcccagg

SEQ ID NO: 5283987 - DNA, 15 bp, Homo sapiens
caaaaaactgcagtg

SEQ ID NO: 5283988 - DNA, 10 bp, Homo sapiens
caaaaaactt

SEQ ID NO: 5283989 - DNA, 12 bp, Homo sapiens
caaaaaagaaaa

SEQ ID NO: 5283990 - DNA, 14 bp, Homo sapiens
caaaaaagaaaacc

SEQ ID NO: 5283991 - DNA, 15 bp, Homo sapiens
caaaaaagaaaagta

SEQ ID NO: 5283992 - DNA, 21 bp, Homo sapiens
caaaaaagcttttgttttgct

SEQ ID NO: 5283993 - DNA, 11 bp, Homo sapiens
caaaaaaggaa

SEQ ID NO: 5283994 - DNA, 16 bp, Homo sapiens
caaaaaaggtaactaa

SEQ ID NO: 5283995 - DNA, 18 bp, Homo sapiens
caaaaaaggtaactaact

SEQ ID NO: 5283996 - DNA, 18 bp, Homo sapiens
caaaaaagtatagaaaag

SEQ ID NO: 5283997 - DNA, 15 bp, Homo sapiens
caaaaaagtattttt

SEQ ID NO: 5283998 - DNA, 18 bp, Homo sapiens
caaaaaataaaataagtc

SEQ ID NO: 5283999 - DNA, 12 bp, Homo sapiens
caaaaaataaat

SEQ ID NO: 5284000 - DNA, 12 bp, Homo sapiens
caaaaaatgagc

SEQ ID NO: 5284001 - DNA, 22 bp, Homo sapiens
caaaaaatgggagacaatttca

SEQ ID NO: 5284002 - DNA, 16 bp, Homo sapiens
caaaaaatgttttaaa

SEQ ID NO: 5284003 - DNA, 14 bp, Homo sapiens
caaaaaattaaaac

SEQ ID NO: 5284004 - DNA, 16 bp, Homo sapiens
caaaaaattagccggg

SEQ ID NO: 5284005 - DNA, 12 bp, Homo sapiens
caaaaaattgtc

SEQ ID NO: 5284006 - DNA, 18 bp, Homo sapiens
caaaaacaaaaaaactat

SEQ ID NO: 5284007 - DNA, 15 bp, Homo sapiens
caaaaacaaaaacaa

SEQ ID NO: 5284008 - DNA, 15 bp, Homo sapiens
caaaaacaaaacaaa

SEQ ID NO: 5284009 - DNA, 20 bp, Homo sapiens
caaaaacaaaattagccggg

SEQ ID NO: 5284010 - DNA, 14 bp, Homo sapiens
caaaaacaaagaaa

SEQ ID NO: 5284011 - DNA, 14 bp, Homo sapiens
caaaaacaagacag

SEQ ID NO: 5284012 - DNA, 20 bp, Homo sapiens
caaaaacaagactgcctccc

SEQ ID NO: 5284013 - DNA, 19 bp, Homo sapiens
caaaaacaagtaaatatat

SEQ ID NO: 5284014 - DNA, 20 bp, Homo sapiens
caaaaacaagtaaatatata

SEQ ID NO: 5284015 - DNA, 14 bp, Homo sapiens
caaaaacaataaac

SEQ ID NO: 5284016 - DNA, 22 bp, Homo sapiens
caaaaacacagtgtttttgtaa

SEQ ID NO: 5284017 - DNA, 16 bp, Homo sapiens
caaaaacagaatttga

SEQ ID NO: 5284018 - DNA, 20 bp, Homo sapiens
caaaaacaggtatatacttt

SEQ ID NO: 5284019 - DNA, 17 bp, Homo sapiens
caaaaacaggtttttga

SEQ ID NO: 5284020 - DNA, 18 bp, Homo sapiens
caaaaacatacttcaaaa

SEQ ID NO: 5284021 - DNA, 19 bp, Homo sapiens
caaaaacatacttcaaaaa

SEQ ID NO: 5284022 - DNA, 23 bp, Homo sapiens
caaaaacatgtatgtgcatttca

SEQ ID NO: 5284023 - DNA, 22 bp, Homo sapiens
caaaaacatttgattaataaaa

SEQ ID NO: 5284024 - DNA, 10 bp, Homo sapiens
caaaaaccaa

SEQ ID NO: 5284025 - DNA, 22 bp, Homo sapiens
caaaaaccaaaagtgcattcaa

SEQ ID NO: 5284026 - DNA, 24 bp, Homo sapiens
caaaaaccaaacacccagaggtct

SEQ ID NO: 5284027 - DNA, 14 bp, Homo sapiens
caaaaaccagccag

SEQ ID NO: 5284028 - DNA, 19 bp, Homo sapiens
caaaaaccagtattgtaca

SEQ ID NO: 5284029 - DNA, 13 bp, Homo sapiens
caaaaaccatgtt

SEQ ID NO: 5284030 - DNA, 21 bp, Homo sapiens
caaaaacccagcaacagaaaa

SEQ ID NO: 5284031 - DNA, 19 bp, Homo sapiens
caaaaaccctaattttgta

SEQ ID NO: 5284032 - DNA, 17 bp, Homo sapiens
caaaaacctcacccgag

SEQ ID NO: 5284033 - DNA, 21 bp, Homo sapiens
caaaaactgactttatttatt

SEQ ID NO: 5284034 - DNA, 23 bp, Homo sapiens
caaaaactgtaaaagtgtacaga

SEQ ID NO: 5284035 - DNA, 17 bp, Homo sapiens
caaaaactgtactgtgt

SEQ ID NO: 5284036 - DNA, 22 bp, Homo sapiens
caaaaactgtattgatgacagt

SEQ ID NO: 5284037 - DNA, 16 bp, Homo sapiens
caaaaactgtgggaag

SEQ ID NO: 5284038 - DNA, 17 bp, Homo sapiens
caaaaacttcctttaca

SEQ ID NO: 5284039 - DNA, 21 bp, Homo sapiens
caaaaactttccatgacagta

SEQ ID NO: 5284040 - DNA, 20 bp, Homo sapiens
caaaaacttttcatttcaga

SEQ ID NO: 5284041 - DNA, 14 bp, Homo sapiens
caaaaacttttgca

SEQ ID NO: 5284042 - DNA, 16 bp, Homo sapiens
caaaaagaaaaatcaa

SEQ ID NO: 5284043 - DNA, 15 bp, Homo sapiens
caaaaagaaactttc

SEQ ID NO: 5284044 - DNA, 20 bp, Homo sapiens
caaaaagaaagctgtgaaat

SEQ ID NO: 5284045 - DNA, 12 bp, Homo sapiens
caaaaagaaata

SEQ ID NO: 5284046 - DNA, 14 bp, Homo sapiens
caaaaagaaatgac

SEQ ID NO: 5284047 - DNA, 16 bp, Homo sapiens
caaaaagaaatgacta

SEQ ID NO: 5284048 - DNA, 15 bp, Homo sapiens
caaaaagaaatgatg

SEQ ID NO: 5284049 - DNA, 19 bp, Homo sapiens
caaaaagaacaaaaaaatc

SEQ ID NO: 5284050 - DNA, 18 bp, Homo sapiens
caaaaagaacaaagctgg

SEQ ID NO: 5284051 - DNA, 17 bp, Homo sapiens
caaaaagaaccacttgt

SEQ ID NO: 5284052 - DNA, 18 bp, Homo sapiens
caaaaagaatctgcattt

SEQ ID NO: 5284053 - DNA, 19 bp, Homo sapiens
caaaaagaatctgcattta

SEQ ID NO: 5284054 - DNA, 12 bp, Homo sapiens
caaaaagacaag

SEQ ID NO: 5284055 - DNA, 15 bp, Homo sapiens
caaaaagacatggaa

SEQ ID NO: 5284056 - DNA, 13 bp, Homo sapiens
caaaaagaccaga

SEQ ID NO: 5284057 - DNA, 16 bp, Homo sapiens
caaaaagaccttctcc

SEQ ID NO: 5284058 - DNA, 17 bp, Homo sapiens
caaaaagaccttctccc

SEQ ID NO: 5284059 - DNA, 16 bp, Homo sapiens
caaaaagagtcagaca

SEQ ID NO: 5284060 - DNA, 19 bp, Homo sapiens
caaaaagataccttaaaat

SEQ ID NO: 5284061 - DNA, 22 bp, Homo sapiens
caaaaagataccttaaaatttg

SEQ ID NO: 5284062 - DNA, 13 bp, Homo sapiens
caaaaagatgcct

SEQ ID NO: 5284063 - DNA, 14 bp, Homo sapiens
caaaaagcaaggga

SEQ ID NO: 5284064 - DNA, 13 bp, Homo sapiens
caaaaagcaatta

SEQ ID NO: 5284065 - DNA, 16 bp, Homo sapiens
caaaaagcagaaggag

SEQ ID NO: 5284066 - DNA, 21 bp, Homo sapiens
caaaaagcagagtggactgca

SEQ ID NO: 5284067 - DNA, 13 bp, Homo sapiens
caaaaagccacag

SEQ ID NO: 5284068 - DNA, 16 bp, Homo sapiens
caaaaagccacagcag

SEQ ID NO: 5284069 - DNA, 18 bp, Homo sapiens
caaaaagctaataccagt

SEQ ID NO: 5284070 - DNA, 18 bp, Homo sapiens
caaaaagctaatgtgcag

SEQ ID NO: 5284071 - DNA, 21 bp, Homo sapiens
caaaaagctaatgtgcaggga

SEQ ID NO: 5284072 - DNA, 21 bp, Homo sapiens
caaaaagctgctatccaatga

SEQ ID NO: 5284073 - DNA, 15 bp, Homo sapiens
caaaaagcttctgtg

SEQ ID NO: 5284074 - DNA, 22 bp, Homo sapiens
caaaaaggctagtttattttgt

SEQ ID NO: 5284075 - DNA, 13 bp, Homo sapiens
caaaaagtaaagt

SEQ ID NO: 5284076 - DNA, 14 bp, Homo sapiens
caaaaagtattatc

SEQ ID NO: 5284077 - DNA, 15 bp, Homo sapiens
caaaaagtattatca

SEQ ID NO: 5284078 - DNA, 16 bp, Homo sapiens
caaaaagttgagtttc

SEQ ID NO: 5284079 - DNA, 17 bp, Homo sapiens
caaaaataaaaaatctg

SEQ ID NO: 5284080 - DNA, 21 bp, Homo sapiens
caaaaataaaaaatctgaaga

SEQ ID NO: 5284081 - DNA, 18 bp, Homo sapiens
caaaaataaaaggaaaac

SEQ ID NO: 5284082 - DNA, 13 bp, Homo sapiens
caaaaataaacta

SEQ ID NO: 5284083 - DNA, 19 bp, Homo sapiens
caaaaataaactagtttcc

SEQ ID NO: 5284084 - DNA, 22 bp, Homo sapiens
caaaaataaactagtttccagt

SEQ ID NO: 5284085 - DNA, 23 bp, Homo sapiens
caaaaataaactataaaacaaaa

SEQ ID NO: 5284086 - DNA, 12 bp, Homo sapiens
caaaaataaatt

SEQ ID NO: 5284087 - DNA, 16 bp, Homo sapiens
caaaaataacactgtt

SEQ ID NO: 5284088 - DNA, 16 bp, Homo sapiens
caaaaataatcatgaa

SEQ ID NO: 5284089 - DNA, 12 bp, Homo sapiens
caaaaataatgt

SEQ ID NO: 5284090 - DNA, 15 bp, Homo sapiens
caaaaataatttatt

SEQ ID NO: 5284091 - DNA, 18 bp, Homo sapiens
caaaaataatttattttg

SEQ ID NO: 5284092 - DNA, 21 bp, Homo sapiens
caaaaatacagaatttataga

SEQ ID NO: 5284093 - DNA, 17 bp, Homo sapiens
caaaaatacatcaagga

SEQ ID NO: 5284094 - DNA, 15 bp, Homo sapiens
caaaaatactctaat

SEQ ID NO: 5284095 - DNA, 18 bp, Homo sapiens
caaaaatactctaattct

SEQ ID NO: 5284096 - DNA, 19 bp, Homo sapiens
caaaaatagaatatataaa

SEQ ID NO: 5284097 - DNA, 14 bp, Homo sapiens
caaaaatagttaaa

SEQ ID NO: 5284098 - DNA, 15 bp, Homo sapiens
caaaaatatattaaa

SEQ ID NO: 5284099 - DNA, 17 bp, Homo sapiens
caaaaatatctcctcca

SEQ ID NO: 5284100 - DNA, 11 bp, Homo sapiens
caaaaatattt

SEQ ID NO: 5284101 - DNA, 12 bp, Homo sapiens
caaaaatatttt

SEQ ID NO: 5284102 - DNA, 14 bp, Homo sapiens
caaaaatattttat

SEQ ID NO: 5284103 - DNA, 21 bp, Homo sapiens
caaaaatcaaagaacagatgg

SEQ ID NO: 5284104 - DNA, 15 bp, Homo sapiens
caaaaatcagccaga

SEQ ID NO: 5284105 - DNA, 19 bp, Homo sapiens
caaaaatcccaccttccca

SEQ ID NO: 5284106 - DNA, 20 bp, Homo sapiens
caaaaatccttgttgaagtt

SEQ ID NO: 5284107 - DNA, 13 bp, Homo sapiens
caaaaatctacag

SEQ ID NO: 5284108 - DNA, 19 bp, Homo sapiens
caaaaatctcaatatttca

SEQ ID NO: 5284109 - DNA, 20 bp, Homo sapiens
caaaaatctcccagtgacaa

SEQ ID NO: 5284110 - DNA, 15 bp, Homo sapiens
caaaaatctgaagat

SEQ ID NO: 5284111 - DNA, 18 bp, Homo sapiens
caaaaatctgaagattgt

SEQ ID NO: 5284112 - DNA, 17 bp, Homo sapiens
caaaaatgaactgaagt

SEQ ID NO: 5284113 - DNA, 14 bp, Homo sapiens
caaaaatgaattca

SEQ ID NO: 5284114 - DNA, 20 bp, Homo sapiens
caaaaatgacaacagaaaaa

SEQ ID NO: 5284115 - DNA, 15 bp, Homo sapiens
caaaaatgacccaag

SEQ ID NO: 5284116 - DNA, 20 bp, Homo sapiens
caaaaatgagctaggcatgg

SEQ ID NO: 5284117 - DNA, 19 bp, Homo sapiens
caaaaatgcaacaaatgaa

SEQ ID NO: 5284118 - DNA, 20 bp, Homo sapiens
caaaaatgcaacaaatgaat

SEQ ID NO: 5284119 - DNA, 17 bp, Homo sapiens
caaaaatgccacttaac

SEQ ID NO: 5284120 - DNA, 18 bp, Homo sapiens
caaaaatgccacttaaca

SEQ ID NO: 5284121 - DNA, 13 bp, Homo sapiens
caaaaatgctaat

SEQ ID NO: 5284122 - DNA, 14 bp, Homo sapiens
caaaaatgctaata

SEQ ID NO: 5284123 - DNA, 11 bp, Homo sapiens
caaaaatggga

SEQ ID NO: 5284124 - DNA, 11 bp, Homo sapiens
caaaaatggtg

SEQ ID NO: 5284125 - DNA, 20 bp, Homo sapiens
caaaaatggtggtttgtcat

SEQ ID NO: 5284126 - DNA, 14 bp, Homo sapiens
caaaaatgtaaaaa

SEQ ID NO: 5284127 - DNA, 15 bp, Homo sapiens
caaaaatgtaaaaaa

SEQ ID NO: 5284128 - DNA, 19 bp, Homo sapiens
caaaaatgtaaaaaacaaa

SEQ ID NO: 5284129 - DNA, 19 bp, Homo sapiens
caaaaatgtacaaaataaa

SEQ ID NO: 5284130 - DNA, 22 bp, Homo sapiens
caaaaatgtatgccacatctca

SEQ ID NO: 5284131 - DNA, 19 bp, Homo sapiens
caaaaatgttaagcatcta

SEQ ID NO: 5284132 - DNA, 22 bp, Homo sapiens
caaaaatgttcccttgaccatt

SEQ ID NO: 5284133 - DNA, 23 bp, Homo sapiens
caaaaatgtttgtactttttaat

SEQ ID NO: 5284134 - DNA, 20 bp, Homo sapiens
caaaaattacactacaagtt

SEQ ID NO: 5284135 - DNA, 17 bp, Homo sapiens
caaaaattagccgggcg

SEQ ID NO: 5284136 - DNA, 20 bp, Homo sapiens
caaaaattatctatttgtat

SEQ ID NO: 5284137 - DNA, 23 bp, Homo sapiens
caaaaattatctatttgtatata

SEQ ID NO: 5284138 - DNA, 19 bp, Homo sapiens
caaaaattcaactcagact

SEQ ID NO: 5284139 - DNA, 20 bp, Homo sapiens
caaaaattcacaagctgcct

SEQ ID NO: 5284140 - DNA, 16 bp, Homo sapiens
caaaaattctcagttc

SEQ ID NO: 5284141 - DNA, 17 bp, Homo sapiens
caaaaattgacttagat

SEQ ID NO: 5284142 - DNA, 19 bp, Homo sapiens
caaaaattgagagctttat

SEQ ID NO: 5284143 - DNA, 17 bp, Homo sapiens
caaaaattgtctttatg

SEQ ID NO: 5284144 - DNA, 13 bp, Homo sapiens
caaaaatttctgc

SEQ ID NO: 5284145 - DNA, 20 bp, Homo sapiens
caaaaatttctgcttttgca

SEQ ID NO: 5284146 - DNA, 22 bp, Homo sapiens
caaaaatttctgtaaaacaggt

SEQ ID NO: 5284147 - DNA, 15 bp, Homo sapiens
caaaaatttgacatt

SEQ ID NO: 5284148 - DNA, 19 bp, Homo sapiens
caaaaatttgcttcactca

SEQ ID NO: 5284149 - DNA, 13 bp, Homo sapiens
caaaaatttttgg

SEQ ID NO: 5284150 - DNA, 18 bp, Homo sapiens
caaaaatttttggattga

SEQ ID NO: 5284151 - DNA, 18 bp, Homo sapiens
caaaacaaaaattaggta

SEQ ID NO: 5284152 - DNA, 23 bp, Homo sapiens
caaaacaaaaattaggtattttg

SEQ ID NO: 5284153 - DNA, 12 bp, Homo sapiens
caaaacaaaaca

SEQ ID NO: 5284154 - DNA, 14 bp, Homo sapiens
caaaacaaaacaaa

SEQ ID NO: 5284155 - DNA, 17 bp, Homo sapiens
caaaacaaaacaaaact

SEQ ID NO: 5284156 - DNA, 15 bp, Homo sapiens
caaaacaaaacaaca

SEQ ID NO: 5284157 - DNA, 16 bp, Homo sapiens
caaaacaaaacaacaa

SEQ ID NO: 5284158 - DNA, 16 bp, Homo sapiens
caaaacaaaacaacat

SEQ ID NO: 5284159 - DNA, 13 bp, Homo sapiens
caaaacaaacaca

SEQ ID NO: 5284160 - DNA, 16 bp, Homo sapiens
caaaacaaacacacac

SEQ ID NO: 5284161 - DNA, 17 bp, Homo sapiens
caaaacaaacacacaca

SEQ ID NO: 5284162 - DNA, 15 bp, Homo sapiens
caaaacaaaggccta

SEQ ID NO: 5284163 - DNA, 17 bp, Homo sapiens
caaaacaaattcaagaa

SEQ ID NO: 5284164 - DNA, 10 bp, Homo sapiens
caaaacaaca

SEQ ID NO: 5284165 - DNA, 11 bp, Homo sapiens
caaaacaacaa

SEQ ID NO: 5284166 - DNA, 15 bp, Homo sapiens
caaaacaacaaaaac

SEQ ID NO: 5284167 - DNA, 17 bp, Homo sapiens
caaaacaacaacaatac

SEQ ID NO: 5284168 - DNA, 13 bp, Homo sapiens
caaaacaacagca

SEQ ID NO: 5284169 - DNA, 21 bp, Homo sapiens
caaaacaacagcaacaacaac

SEQ ID NO: 5284170 - DNA, 18 bp, Homo sapiens
caaaacaatctatttaaa

SEQ ID NO: 5284171 - DNA, 16 bp, Homo sapiens
caaaacaatctctcaa

SEQ ID NO: 5284172 - DNA, 12 bp, Homo sapiens
caaaacactgtg

SEQ ID NO: 5284173 - DNA, 14 bp, Homo sapiens
caaaacactgtgga

SEQ ID NO: 5284174 - DNA, 18 bp, Homo sapiens
caaaacacttaggaagaa

SEQ ID NO: 5284175 - DNA, 19 bp, Homo sapiens
caaaacacttccagtctgg

SEQ ID NO: 5284176 - DNA, 16 bp, Homo sapiens
caaaacacttgtaatt

SEQ ID NO: 5284177 - DNA, 19 bp, Homo sapiens
caaaacagaagcagcttct

SEQ ID NO: 5284178 - DNA, 23 bp, Homo sapiens
caaaacagcgggagtgtgggggt

SEQ ID NO: 5284179 - DNA, 12 bp, Homo sapiens
caaaacatattt

SEQ ID NO: 5284180 - DNA, 14 bp, Homo sapiens
caaaacatcacatt

SEQ ID NO: 5284181 - DNA, 16 bp, Homo sapiens
caaaacatcacattcc

SEQ ID NO: 5284182 - DNA, 19 bp, Homo sapiens
caaaacatccacttaagtt

SEQ ID NO: 5284183 - DNA, 16 bp, Homo sapiens
caaaacatgcaccctg

SEQ ID NO: 5284184 - DNA, 22 bp, Homo sapiens
caaaacatgtctcctatcctgg

SEQ ID NO: 5284185 - DNA, 21 bp, Homo sapiens
caaaacattctcctttgcagt

SEQ ID NO: 5284186 - DNA, 19 bp, Homo sapiens
caaaacattttgaaggaaa

SEQ ID NO: 5284187 - DNA, 23 bp, Homo sapiens
caaaacattttgtatgctgcatg

SEQ ID NO: 5284188 - DNA, 17 bp, Homo sapiens
caaaaccaaaagttatt

SEQ ID NO: 5284189 - DNA, 15 bp, Homo sapiens
caaaaccaaacccag

SEQ ID NO: 5284190 - DNA, 17 bp, Homo sapiens
caaaaccaaactgggtc

SEQ ID NO: 5284191 - DNA, 16 bp, Homo sapiens
caaaaccaatgctgat

SEQ ID NO: 5284192 - DNA, 17 bp, Homo sapiens
caaaaccacatgggctg

SEQ ID NO: 5284193 - DNA, 13 bp, Homo sapiens
caaaaccaggcct

SEQ ID NO: 5284194 - DNA, 14 bp, Homo sapiens
caaaaccaggtaat

SEQ ID NO: 5284195 - DNA, 16 bp, Homo sapiens
caaaaccaggtccaat

SEQ ID NO: 5284196 - DNA, 17 bp, Homo sapiens
caaaaccatctctcttc

SEQ ID NO: 5284197 - DNA, 14 bp, Homo sapiens
caaaaccatgcctg

SEQ ID NO: 5284198 - DNA, 22 bp, Homo sapiens
caaaaccatgcctggtattttc

SEQ ID NO: 5284199 - DNA, 17 bp, Homo sapiens
caaaaccattgcttcac

SEQ ID NO: 5284200 - DNA, 15 bp, Homo sapiens
caaaacccacatttc

SEQ ID NO: 5284201 - DNA, 13 bp, Homo sapiens
caaaacccagacc

SEQ ID NO: 5284202 - DNA, 18 bp, Homo sapiens
caaaacccagctgcaccc

SEQ ID NO: 5284203 - DNA, 15 bp, Homo sapiens
caaaacccagggcaa

SEQ ID NO: 5284204 - DNA, 14 bp, Homo sapiens
caaaacccatatcc

SEQ ID NO: 5284205 - DNA, 19 bp, Homo sapiens
caaaaccccactacacagt

SEQ ID NO: 5284206 - DNA, 13 bp, Homo sapiens
caaaaccccagaa

SEQ ID NO: 5284207 - DNA, 18 bp, Homo sapiens
caaaaccgccagctctgt

SEQ ID NO: 5284208 - DNA, 18 bp, Homo sapiens
caaaaccggcaacctgta

SEQ ID NO: 5284209 - DNA, 14 bp, Homo sapiens
caaaacctaacttg

SEQ ID NO: 5284210 - DNA, 18 bp, Homo sapiens
caaaacctatttttcctt

SEQ ID NO: 5284211 - DNA, 20 bp, Homo sapiens
caaaacctatttttccttta

SEQ ID NO: 5284212 - DNA, 14 bp, Homo sapiens
caaaacctcaaacc

SEQ ID NO: 5284213 - DNA, 20 bp, Homo sapiens
caaaacctcatgacagccag

SEQ ID NO: 5284214 - DNA, 21 bp, Homo sapiens
caaaacctcatgacagccaga

SEQ ID NO: 5284215 - DNA, 18 bp, Homo sapiens
caaaacctgatgttaaaa

SEQ ID NO: 5284216 - DNA, 21 bp, Homo sapiens
caaaacctgatgttaaaattc

SEQ ID NO: 5284217 - DNA, 18 bp, Homo sapiens
caaaacctgcttccttca

SEQ ID NO: 5284218 - DNA, 16 bp, Homo sapiens
caaaacctgtattact

SEQ ID NO: 5284219 - DNA, 19 bp, Homo sapiens
caaaacctgtgccaggctg

SEQ ID NO: 5284220 - DNA, 18 bp, Homo sapiens
caaaaccttccttccctg

SEQ ID NO: 5284221 - DNA, 18 bp, Homo sapiens
caaaacctttccccagac

SEQ ID NO: 5284222 - DNA, 21 bp, Homo sapiens
caaaacctttccccagacaca

SEQ ID NO: 5284223 - DNA, 15 bp, Homo sapiens
caaaaccttttactg

SEQ ID NO: 5284224 - DNA, 21 bp, Homo sapiens
caaaaccttttactggttgca

SEQ ID NO: 5284225 - DNA, 15 bp, Homo sapiens
caaaacgagggctga

SEQ ID NO: 5284226 - DNA, 19 bp, Homo sapiens
caaaacgcatggagtgtgt

SEQ ID NO: 5284227 - DNA, 16 bp, Homo sapiens
caaaacgcgcagatgt

SEQ ID NO: 5284228 - DNA, 17 bp, Homo sapiens
caaaacgggtcagtatt

SEQ ID NO: 5284229 - DNA, 15 bp, Homo sapiens
caaaacggttttact

SEQ ID NO: 5284230 - DNA, 19 bp, Homo sapiens
caaaactacttttctaaaa

SEQ ID NO: 5284231 - DNA, 17 bp, Homo sapiens
caaaactagtaaaactt

SEQ ID NO: 5284232 - DNA, 19 bp, Homo sapiens
caaaactatacttgaacaa

SEQ ID NO: 5284233 - DNA, 21 bp, Homo sapiens
caaaactatacttgaacaaaa

SEQ ID NO: 5284234 - DNA, 13 bp, Homo sapiens
caaaactatccta

SEQ ID NO: 5284235 - DNA, 22 bp, Homo sapiens
caaaactatcctgattccaaat

SEQ ID NO: 5284236 - DNA, 20 bp, Homo sapiens
caaaactatgacaatttttg

SEQ ID NO: 5284237 - DNA, 21 bp, Homo sapiens
caaaactatgacaatttttgc

SEQ ID NO: 5284238 - DNA, 17 bp, Homo sapiens
caaaactatttttgtaa

SEQ ID NO: 5284239 - DNA, 13 bp, Homo sapiens
caaaactcaggca

SEQ ID NO: 5284240 - DNA, 18 bp, Homo sapiens
caaaactccactcagcac

SEQ ID NO: 5284241 - DNA, 20 bp, Homo sapiens
caaaactccgcccccagcct

SEQ ID NO: 5284242 - DNA, 21 bp, Homo sapiens
caaaactccgtctcaaaaaaa

SEQ ID NO: 5284243 - DNA, 16 bp, Homo sapiens
caaaactcctgtcttt

SEQ ID NO: 5284244 - DNA, 19 bp, Homo sapiens
caaaactctacttaatcca

SEQ ID NO: 5284245 - DNA, 22 bp, Homo sapiens
caaaactctcattattctctaa

SEQ ID NO: 5284246 - DNA, 15 bp, Homo sapiens
caaaactctcctctg

SEQ ID NO: 5284247 - DNA, 19 bp, Homo sapiens
caaaactctcctctgctgc

SEQ ID NO: 5284248 - DNA, 14 bp, Homo sapiens
caaaactgcactgt

SEQ ID NO: 5284249 - DNA, 12 bp, Homo sapiens
caaaactgccta

SEQ ID NO: 5284250 - DNA, 13 bp, Homo sapiens
caaaactgctttg

SEQ ID NO: 5284251 - DNA, 16 bp, Homo sapiens
caaaactggaactgtt

SEQ ID NO: 5284252 - DNA, 16 bp, Homo sapiens
caaaactgtaaataaa

SEQ ID NO: 5284253 - DNA, 20 bp, Homo sapiens
caaaactgtaaataaaatgt

SEQ ID NO: 5284254 - DNA, 21 bp, Homo sapiens
caaaactgtaaataaaatgtg

SEQ ID NO: 5284255 - DNA, 15 bp, Homo sapiens
caaaactgttctttt

SEQ ID NO: 5284256 - DNA, 15 bp, Homo sapiens
caaaacttaagatgg

SEQ ID NO: 5284257 - DNA, 13 bp, Homo sapiens
caaaacttctctt

SEQ ID NO: 5284258 - DNA, 21 bp, Homo sapiens
caaaacttctcttgaaaagtt

SEQ ID NO: 5284259 - DNA, 21 bp, Homo sapiens
caaaacttcttgtcagacata

SEQ ID NO: 5284260 - DNA, 20 bp, Homo sapiens
caaaacttgaaagaagtttt

SEQ ID NO: 5284261 - DNA, 23 bp, Homo sapiens
caaaactttaggccctgccccag

SEQ ID NO: 5284262 - DNA, 14 bp, Homo sapiens
caaaacttttaaac

SEQ ID NO: 5284263 - DNA, 15 bp, Homo sapiens
caaaacttttaaact

SEQ ID NO: 5284264 - DNA, 21 bp, Homo sapiens
caaaagaaaaaagcaagtaca

SEQ ID NO: 5284265 - DNA, 17 bp, Homo sapiens
caaaagaaaattgatat

SEQ ID NO: 5284266 - DNA, 14 bp, Homo sapiens
caaaagaaacacca

SEQ ID NO: 5284267 - DNA, 20 bp, Homo sapiens
caaaagaaaccatgacaaac

SEQ ID NO: 5284268 - DNA, 20 bp, Homo sapiens
caaaagaaaccatgcaaagc

SEQ ID NO: 5284269 - DNA, 22 bp, Homo sapiens
caaaagaaataatccctgtaat

SEQ ID NO: 5284270 - DNA, 15 bp, Homo sapiens
caaaagaaatacctt

SEQ ID NO: 5284271 - DNA, 15 bp, Homo sapiens
caaaagaaatttaga

SEQ ID NO: 5284272 - DNA, 22 bp, Homo sapiens
caaaagaaatttagagtcaatt

SEQ ID NO: 5284273 - DNA, 16 bp, Homo sapiens
caaaagaacttacccc

SEQ ID NO: 5284274 - DNA, 18 bp, Homo sapiens
caaaagaagcccccagct

SEQ ID NO: 5284275 - DNA, 22 bp, Homo sapiens
caaaagaagcccggctcctggt

SEQ ID NO: 5284276 - DNA, 12 bp, Homo sapiens
caaaagaagtaa

SEQ ID NO: 5284277 - DNA, 15 bp, Homo sapiens
caaaagaagtaaaag

SEQ ID NO: 5284278 - DNA, 17 bp, Homo sapiens
caaaagaagtaaaagca

SEQ ID NO: 5284279 - DNA, 19 bp, Homo sapiens
caaaagaagtaaaagcaaa

SEQ ID NO: 5284280 - DNA, 19 bp, Homo sapiens
caaaagaagtaacaagagt

SEQ ID NO: 5284281 - DNA, 15 bp, Homo sapiens
caaaagaagtgaaaa

SEQ ID NO: 5284282 - DNA, 16 bp, Homo sapiens
caaaagaagtttaaag

SEQ ID NO: 5284283 - DNA, 19 bp, Homo sapiens
caaaagaatctattagatt

SEQ ID NO: 5284284 - DNA, 13 bp, Homo sapiens
caaaagacaaaaa

SEQ ID NO: 5284285 - DNA, 14 bp, Homo sapiens
caaaagacaaaaat

SEQ ID NO: 5284286 - DNA, 21 bp, Homo sapiens
caaaagacaaaaatcaaagaa

SEQ ID NO: 5284287 - DNA, 13 bp, Homo sapiens
caaaagacaagca

SEQ ID NO: 5284288 - DNA, 11 bp, Homo sapiens
caaaagacagc

SEQ ID NO: 5284289 - DNA, 17 bp, Homo sapiens
caaaagactggtttgtt

SEQ ID NO: 5284290 - DNA, 20 bp, Homo sapiens
caaaagactggtttgtttgc

SEQ ID NO: 5284291 - DNA, 21 bp, Homo sapiens
caaaagactggtttgtttgct

SEQ ID NO: 5284292 - DNA, 23 bp, Homo sapiens
caaaagactggtttgtttgctta

SEQ ID NO: 5284293 - DNA, 15 bp, Homo sapiens
caaaagacttgagcc

SEQ ID NO: 5284294 - DNA, 14 bp, Homo sapiens
caaaagagaaaaaa

SEQ ID NO: 5284295 - DNA, 21 bp, Homo sapiens
caaaagagaaatacataaaaa

SEQ ID NO: 5284296 - DNA, 15 bp, Homo sapiens
caaaagagacaggga

SEQ ID NO: 5284297 - DNA, 12 bp, Homo sapiens
caaaagagagaa

SEQ ID NO: 5284298 - DNA, 22 bp, Homo sapiens
caaaagagcagcatttttaatt

SEQ ID NO: 5284299 - DNA, 14 bp, Homo sapiens
caaaagagccctgg

SEQ ID NO: 5284300 - DNA, 21 bp, Homo sapiens
attgaaattgtacatatttgt

SEQ ID NO: 5284301 - DNA, 19 bp, Homo sapiens
attgaaattgtgaactcat

SEQ ID NO: 5284302 - DNA, 21 bp, Homo sapiens
attgaaatttaaaaataaagc

SEQ ID NO: 5284303 - DNA, 14 bp, Homo sapiens
attgaaatttatac

SEQ ID NO: 5284304 - DNA, 16 bp, Homo sapiens
attgaaatttatacac

SEQ ID NO: 5284305 - DNA, 17 bp, Homo sapiens
attgaaatttatgacta

SEQ ID NO: 5284306 - DNA, 13 bp, Homo sapiens
attgaaatttgaa

SEQ ID NO: 5284307 - DNA, 23 bp, Homo sapiens
attgaaatttttaaatcatttca

SEQ ID NO: 5284308 - DNA, 23 bp, Homo sapiens
attgaacaaaaatgtttccactg

SEQ ID NO: 5284309 - DNA, 20 bp, Homo sapiens
attgaacaataaagtttgct

SEQ ID NO: 5284310 - DNA, 17 bp, Homo sapiens
attgaacacaaactgta

SEQ ID NO: 5284311 - DNA, 20 bp, Homo sapiens
attgaacacaaactgtaaat

SEQ ID NO: 5284312 - DNA, 12 bp, Homo sapiens
attgaacacagg

SEQ ID NO: 5284313 - DNA, 14 bp, Homo sapiens
attgaacacaggca

SEQ ID NO: 5284314 - DNA, 14 bp, Homo sapiens
attgaacagcaaag

SEQ ID NO: 5284315 - DNA, 14 bp, Homo sapiens
attgaacagctgtg

SEQ ID NO: 5284316 - DNA, 16 bp, Homo sapiens
attgaacagctgtgag

SEQ ID NO: 5284317 - DNA, 23 bp, Homo sapiens
attgaaccagctcatctccaagg

SEQ ID NO: 5284318 - DNA, 23 bp, Homo sapiens
attgaaccatttgggatggagaa

SEQ ID NO: 5284319 - DNA, 18 bp, Homo sapiens
attgaacctttgtgccct

SEQ ID NO: 5284320 - DNA, 20 bp, Homo sapiens
attgaacgactgtatattgc

SEQ ID NO: 5284321 - DNA, 21 bp, Homo sapiens
attgaacgactgtatattgct

SEQ ID NO: 5284322 - DNA, 22 bp, Homo sapiens
attgaacgactgtatattgcta

SEQ ID NO: 5284323 - DNA, 23 bp, Homo sapiens
attgaacgactgtatattgctaa

SEQ ID NO: 5284324 - DNA, 18 bp, Homo sapiens
attgaactggaataatat

SEQ ID NO: 5284325 - DNA, 15 bp, Homo sapiens
attgaactgtaaact

SEQ ID NO: 5284326 - DNA, 23 bp, Homo sapiens
attgaactgtattctagtggctg

SEQ ID NO: 5284327 - DNA, 19 bp, Homo sapiens
attgaacttactgtagcct

SEQ ID NO: 5284328 - DNA, 18 bp, Homo sapiens
attgaacttttgtactga

SEQ ID NO: 5284329 - DNA, 16 bp, Homo sapiens
attgaagaaaagcact

SEQ ID NO: 5284330 - DNA, 21 bp, Homo sapiens
attgaagaagaaccagcccag

SEQ ID NO: 5284331 - DNA, 15 bp, Homo sapiens
attgaagaagcctca

SEQ ID NO: 5284332 - DNA, 13 bp, Homo sapiens
attgaagacaatt

SEQ ID NO: 5284333 - DNA, 14 bp, Homo sapiens
attgaagacaattt

SEQ ID NO: 5284334 - DNA, 23 bp, Homo sapiens
attgaagagagatatatctgaaa

SEQ ID NO: 5284335 - DNA, 20 bp, Homo sapiens
attgaagagatttcaacata

SEQ ID NO: 5284336 - DNA, 23 bp, Homo sapiens
attgaagagatttcaacatatca

SEQ ID NO: 5284337 - DNA, 14 bp, Homo sapiens
attgaagaggtgaa

SEQ ID NO: 5284338 - DNA, 15 bp, Homo sapiens
attgaagatgctgcc

SEQ ID NO: 5284339 - DNA, 22 bp, Homo sapiens
attgaagatgtgatcaatagat

SEQ ID NO: 5284340 - DNA, 22 bp, Homo sapiens
attgaagcaactacaacttctc

SEQ ID NO: 5284341 - DNA, 14 bp, Homo sapiens
attgaagcagagtg

SEQ ID NO: 5284342 - DNA, 18 bp, Homo sapiens
attgaagcagagtggcag

SEQ ID NO: 5284343 - DNA, 22 bp, Homo sapiens
attgaagcattttataaatcgc

SEQ ID NO: 5284344 - DNA, 15 bp, Homo sapiens
attgaagccctccaa

SEQ ID NO: 5284345 - DNA, 20 bp, Homo sapiens
attgaagctttactttagaa

SEQ ID NO: 5284346 - DNA, 17 bp, Homo sapiens
attgaaggaagccaaat

SEQ ID NO: 5284347 - DNA, 21 bp, Homo sapiens
attgaaggaagccaaatttat

SEQ ID NO: 5284348 - DNA, 12 bp, Homo sapiens
attgaaggaatt

SEQ ID NO: 5284349 - DNA, 15 bp, Homo sapiens
attgaaggagaaaat

SEQ ID NO: 5284350 - DNA, 17 bp, Homo sapiens
attgaaggagaaaatgc

SEQ ID NO: 5284351 - DNA, 18 bp, Homo sapiens
attgaaggatcatctgaa

SEQ ID NO: 5284352 - DNA, 17 bp, Homo sapiens
attgaaggatgctgtct

SEQ ID NO: 5284353 - DNA, 20 bp, Homo sapiens
attgaaggcttaattgactg

SEQ ID NO: 5284354 - DNA, 21 bp, Homo sapiens
attgaaggcttaattgactga

SEQ ID NO: 5284355 - DNA, 13 bp, Homo sapiens
attgaaggggctt

SEQ ID NO: 5284356 - DNA, 18 bp, Homo sapiens
attgaaggggcttctaat

SEQ ID NO: 5284357 - DNA, 23 bp, Homo sapiens
attgaaggggcttctaatgaccc

SEQ ID NO: 5284358 - DNA, 20 bp, Homo sapiens
attgaaggtgataagggaaa

SEQ ID NO: 5284359 - DNA, 20 bp, Homo sapiens
attgaaggttgtatgtaaat

SEQ ID NO: 5284360 - DNA, 22 bp, Homo sapiens
attgaaggttgtatgtaaatct

SEQ ID NO: 5284361 - DNA, 16 bp, Homo sapiens
attgaaggttttagac

SEQ ID NO: 5284362 - DNA, 22 bp, Homo sapiens
attgaagtaaactttttgttct

SEQ ID NO: 5284363 - DNA, 16 bp, Homo sapiens
attgaagtaatgaatt

SEQ ID NO: 5284364 - DNA, 19 bp, Homo sapiens
attgaagtattttgctgga

SEQ ID NO: 5284365 - DNA, 16 bp, Homo sapiens
attgaagtcagatgtg

SEQ ID NO: 5284366 - DNA, 17 bp, Homo sapiens
attgaagtcatcataaa

SEQ ID NO: 5284367 - DNA, 14 bp, Homo sapiens
attgaagtcctcca

SEQ ID NO: 5284368 - DNA, 12 bp, Homo sapiens
attgaagtcttc

SEQ ID NO: 5284369 - DNA, 19 bp, Homo sapiens
attgaagtcttcttatcta

SEQ ID NO: 5284370 - DNA, 14 bp, Homo sapiens
attgaagtgtcttc

SEQ ID NO: 5284371 - DNA, 17 bp, Homo sapiens
attgaagtgtttaaaag

SEQ ID NO: 5284372 - DNA, 22 bp, Homo sapiens
attgaagttgtttatcaacttc

SEQ ID NO: 5284373 - DNA, 22 bp, Homo sapiens
attgaagtttattattttcaaa

SEQ ID NO: 5284374 - DNA, 20 bp, Homo sapiens
attgaagtttcaagttttaa

SEQ ID NO: 5284375 - DNA, 13 bp, Homo sapiens
attgaatactgtc

SEQ ID NO: 5284376 - DNA, 16 bp, Homo sapiens
attgaatactttgaat

SEQ ID NO: 5284377 - DNA, 23 bp, Homo sapiens
attgaatataatatatttgtgta

SEQ ID NO: 5284378 - DNA, 14 bp, Homo sapiens
attgaatattgtgt

SEQ ID NO: 5284379 - DNA, 14 bp, Homo sapiens
attgaatctctaaa

SEQ ID NO: 5284380 - DNA, 23 bp, Homo sapiens
attgaatggctatgtttttaatg

SEQ ID NO: 5284381 - DNA, 20 bp, Homo sapiens
attgaatggtgcattgtata

SEQ ID NO: 5284382 - DNA, 17 bp, Homo sapiens
attgaatgtaccttatt

SEQ ID NO: 5284383 - DNA, 19 bp, Homo sapiens
attgaatgtaccttattta

SEQ ID NO: 5284384 - DNA, 15 bp, Homo sapiens
attgaatgtgaaaca

SEQ ID NO: 5284385 - DNA, 14 bp, Homo sapiens
attgaatgttatat

SEQ ID NO: 5284386 - DNA, 18 bp, Homo sapiens
attgaattaataataaag

SEQ ID NO: 5284387 - DNA, 13 bp, Homo sapiens
attgaattagaaa

SEQ ID NO: 5284388 - DNA, 19 bp, Homo sapiens
attgaattattttgttact

SEQ ID NO: 5284389 - DNA, 23 bp, Homo sapiens
attgaattattttgttactgtct

SEQ ID NO: 5284390 - DNA, 16 bp, Homo sapiens
attgaattcattataa

SEQ ID NO: 5284391 - DNA, 18 bp, Homo sapiens
attgaattcatttcactg

SEQ ID NO: 5284392 - DNA, 15 bp, Homo sapiens
attgaatttaacaat

SEQ ID NO: 5284393 - DNA, 11 bp, Homo sapiens
attgaatttag

SEQ ID NO: 5284394 - DNA, 13 bp, Homo sapiens
attgaattttcaa

SEQ ID NO: 5284395 - DNA, 19 bp, Homo sapiens
attgaatttttaagcaaat

SEQ ID NO: 5284396 - DNA, 18 bp, Homo sapiens
attgacaaatctgtgtat

SEQ ID NO: 5284397 - DNA, 17 bp, Homo sapiens
attgacaacagttacat

SEQ ID NO: 5284398 - DNA, 19 bp, Homo sapiens
attgacaagctaggaaaga

SEQ ID NO: 5284399 - DNA, 19 bp, Homo sapiens
attgacaaggtagacatgg

SEQ ID NO: 5284400 - DNA, 21 bp, Homo sapiens
attgacaaggtagacatggat

SEQ ID NO: 5284401 - DNA, 19 bp, Homo sapiens
attgacaagtgtctttttg

SEQ ID NO: 5284402 - DNA, 14 bp, Homo sapiens
attgacaagtttaa

SEQ ID NO: 5284403 - DNA, 15 bp, Homo sapiens
attgacaataaaata

SEQ ID NO: 5284404 - DNA, 18 bp, Homo sapiens
attgacaataagaaacag

SEQ ID NO: 5284405 - DNA, 20 bp, Homo sapiens
attgacaataatttcaggtt

SEQ ID NO: 5284406 - DNA, 22 bp, Homo sapiens
attgacacacagcactctctaa

SEQ ID NO: 5284407 - DNA, 12 bp, Homo sapiens
attgacacagaa

SEQ ID NO: 5284408 - DNA, 17 bp, Homo sapiens
attgacacagaaaatgt

SEQ ID NO: 5284409 - DNA, 18 bp, Homo sapiens
attgacacagtaccattt

SEQ ID NO: 5284410 - DNA, 22 bp, Homo sapiens
attgacaccagaaagccctctt

SEQ ID NO: 5284411 - DNA, 17 bp, Homo sapiens
attgacactatatattt

SEQ ID NO: 5284412 - DNA, 22 bp, Homo sapiens
attgacactatatatttcttaa

SEQ ID NO: 5284413 - DNA, 15 bp, Homo sapiens
attgacactgaactt

SEQ ID NO: 5284414 - DNA, 18 bp, Homo sapiens
attgacactgaacttaat

SEQ ID NO: 5284415 - DNA, 22 bp, Homo sapiens
attgacactgtccctctttggc

SEQ ID NO: 5284416 - DNA, 15 bp, Homo sapiens
attgacacttaaaaa

SEQ ID NO: 5284417 - DNA, 13 bp, Homo sapiens
attgacagcaatt

SEQ ID NO: 5284418 - DNA, 14 bp, Homo sapiens
attgacagcaattc

SEQ ID NO: 5284419 - DNA, 15 bp, Homo sapiens
attgacagcaattca

SEQ ID NO: 5284420 - DNA, 15 bp, Homo sapiens
attgacagtaacttg

SEQ ID NO: 5284421 - DNA, 20 bp, Homo sapiens
attgacagtaacttggttat

SEQ ID NO: 5284422 - DNA, 22 bp, Homo sapiens
attgacatcagcatcacctaga

SEQ ID NO: 5284423 - DNA, 23 bp, Homo sapiens
attgacatgaccctctgtcccca

SEQ ID NO: 5284424 - DNA, 17 bp, Homo sapiens
attgacatgatatacaa

SEQ ID NO: 5284425 - DNA, 15 bp, Homo sapiens
attgacatgtacaga

SEQ ID NO: 5284426 - DNA, 23 bp, Homo sapiens
attgacatgtacagagaactaac

SEQ ID NO: 5284427 - DNA, 14 bp, Homo sapiens
attgacattctcta

SEQ ID NO: 5284428 - DNA, 15 bp, Homo sapiens
attgacattctctat

SEQ ID NO: 5284429 - DNA, 21 bp, Homo sapiens
attgacattgctttactgtca

SEQ ID NO: 5284430 - DNA, 16 bp, Homo sapiens
attgaccaagaactgc

SEQ ID NO: 5284431 - DNA, 20 bp, Homo sapiens
attgaccaagaactgcatgg

SEQ ID NO: 5284432 - DNA, 15 bp, Homo sapiens
attgaccatctgctt

SEQ ID NO: 5284433 - DNA, 21 bp, Homo sapiens
attgacccacaagaaatgaaa

SEQ ID NO: 5284434 - DNA, 17 bp, Homo sapiens
attgaccgcgactaatt

SEQ ID NO: 5284435 - DNA, 19 bp, Homo sapiens
attgacctaattgttaaat

SEQ ID NO: 5284436 - DNA, 14 bp, Homo sapiens
attgacctataaaa

SEQ ID NO: 5284437 - DNA, 22 bp, Homo sapiens
attgacctatttccagaaatac

SEQ ID NO: 5284438 - DNA, 15 bp, Homo sapiens
attgacctcagctgc

SEQ ID NO: 5284439 - DNA, 20 bp, Homo sapiens
attgacctcagctgcacatt

SEQ ID NO: 5284440 - DNA, 21 bp, Homo sapiens
attgacctcagctgcacattc

SEQ ID NO: 5284441 - DNA, 14 bp, Homo sapiens
attgacctctcagg

SEQ ID NO: 5284442 - DNA, 19 bp, Homo sapiens
attgacctctcagggcctg

SEQ ID NO: 5284443 - DNA, 20 bp, Homo sapiens
attgacctctcagggcctgg

SEQ ID NO: 5284444 - DNA, 14 bp, Homo sapiens
attgacctggaggg

SEQ ID NO: 5284445 - DNA, 17 bp, Homo sapiens
attgacctggaggggag

SEQ ID NO: 5284446 - DNA, 23 bp, Homo sapiens
attgaccttaatttcttgggaaa

SEQ ID NO: 5284447 - DNA, 20 bp, Homo sapiens
attgaccttctccctcactc

SEQ ID NO: 5284448 - DNA, 20 bp, Homo sapiens
attgacctttaggtattaca

SEQ ID NO: 5284449 - DNA, 22 bp, Homo sapiens
attgacgaactggctacagtac

SEQ ID NO: 5284450 - DNA, 22 bp, Homo sapiens
attgacggttttttattattgt

SEQ ID NO: 5284451 - DNA, 14 bp, Homo sapiens
attgactaaataaa

SEQ ID NO: 5284452 - DNA, 19 bp, Homo sapiens
attgactaaataaaaagta

SEQ ID NO: 5284453 - DNA, 23 bp, Homo sapiens
attgactaactcaaatacacatt

SEQ ID NO: 5284454 - DNA, 17 bp, Homo sapiens
attgactatttatacaa

SEQ ID NO: 5284455 - DNA, 17 bp, Homo sapiens
attgactcaaaccatat

SEQ ID NO: 5284456 - DNA, 23 bp, Homo sapiens
attgactcctttccaatagaaag

SEQ ID NO: 5284457 - DNA, 22 bp, Homo sapiens
attgactctgggtccttcctga

SEQ ID NO: 5284458 - DNA, 19 bp, Homo sapiens
attgactcttgagttgttt

SEQ ID NO: 5284459 - DNA, 22 bp, Homo sapiens
attgactcttgagttgtttttg

SEQ ID NO: 5284460 - DNA, 12 bp, Homo sapiens
attgactgaaat

SEQ ID NO: 5284461 - DNA, 14 bp, Homo sapiens
attgactgaaatta

SEQ ID NO: 5284462 - DNA, 14 bp, Homo sapiens
attgactgatgatt

SEQ ID NO: 5284463 - DNA, 15 bp, Homo sapiens
attgactgccctctt

SEQ ID NO: 5284464 - DNA, 22 bp, Homo sapiens
attgactgccctcttactgttt

SEQ ID NO: 5284465 - DNA, 20 bp, Homo sapiens
attgactgggcaacactgca

SEQ ID NO: 5284466 - DNA, 16 bp, Homo sapiens
attgactggtccccca

SEQ ID NO: 5284467 - DNA, 17 bp, Homo sapiens
attgactgtctttccta

SEQ ID NO: 5284468 - DNA, 14 bp, Homo sapiens
attgacttcatttt

SEQ ID NO: 5284469 - DNA, 22 bp, Homo sapiens
attgacttcattttatatttaa

SEQ ID NO: 5284470 - DNA, 15 bp, Homo sapiens
attgacttctcttga

SEQ ID NO: 5284471 - DNA, 22 bp, Homo sapiens
attgacttcttggtttggggag

SEQ ID NO: 5284472 - DNA, 23 bp, Homo sapiens
attgacttcttggtttggggaga

SEQ ID NO: 5284473 - DNA, 18 bp, Homo sapiens
attgacttgactttctag

SEQ ID NO: 5284474 - DNA, 17 bp, Homo sapiens
attgactttcttaaaaa

SEQ ID NO: 5284475 - DNA, 13 bp, Homo sapiens
attgactttgtct

SEQ ID NO: 5284476 - DNA, 19 bp, Homo sapiens
caaaagagccctggctctg

SEQ ID NO: 5284477 - DNA, 18 bp, Homo sapiens
caaaagagctactcagaa

SEQ ID NO: 5284478 - DNA, 23 bp, Homo sapiens
caaaagaggattagtagaaaata

SEQ ID NO: 5284479 - DNA, 14 bp, Homo sapiens
caaaagagtagaaa

SEQ ID NO: 5284480 - DNA, 16 bp, Homo sapiens
caaaagagtgtaaaat

SEQ ID NO: 5284481 - DNA, 19 bp, Homo sapiens
caaaagagtgtaaaatatt

SEQ ID NO: 5284482 - DNA, 14 bp, Homo sapiens
caaaagataaaact

SEQ ID NO: 5284483 - DNA, 19 bp, Homo sapiens
caaaagatccttcatttta

SEQ ID NO: 5284484 - DNA, 21 bp, Homo sapiens
caaaagatccttcattttaga

SEQ ID NO: 5284485 - DNA, 16 bp, Homo sapiens
caaaagatctggggag

SEQ ID NO: 5284486 - DNA, 16 bp, Homo sapiens
caaaagatgcttctca

SEQ ID NO: 5284487 - DNA, 15 bp, Homo sapiens
caaaagatgggtggt

SEQ ID NO: 5284488 - DNA, 21 bp, Homo sapiens
caaaagatgtatccttccaat

SEQ ID NO: 5284489 - DNA, 19 bp, Homo sapiens
caaaagatgtgcaaaatca

SEQ ID NO: 5284490 - DNA, 19 bp, Homo sapiens
caaaagattaatgtgtatt

SEQ ID NO: 5284491 - DNA, 15 bp, Homo sapiens
caaaagattatgtat

SEQ ID NO: 5284492 - DNA, 16 bp, Homo sapiens
caaaagattgctgaaa

SEQ ID NO: 5284493 - DNA, 18 bp, Homo sapiens
caaaagattgctgaaaaa

SEQ ID NO: 5284494 - DNA, 23 bp, Homo sapiens
caaaagattggagctgaagacct

SEQ ID NO: 5284495 - DNA, 15 bp, Homo sapiens
caaaagattgtttta

SEQ ID NO: 5284496 - DNA, 14 bp, Homo sapiens
caaaagatttattg

SEQ ID NO: 5284497 - DNA, 14 bp, Homo sapiens
caaaagcaaaacat

SEQ ID NO: 5284498 - DNA, 16 bp, Homo sapiens
caaaagcaaaattttt

SEQ ID NO: 5284499 - DNA, 18 bp, Homo sapiens
caaaagcaaaatttttaa

SEQ ID NO: 5284500 - DNA, 14 bp, Homo sapiens
caaaagcaaagatg

SEQ ID NO: 5284501 - DNA, 14 bp, Homo sapiens
caaaagcaagactg

SEQ ID NO: 5284502 - DNA, 20 bp, Homo sapiens
caaaagcaagggaccttcat

SEQ ID NO: 5284503 - DNA, 23 bp, Homo sapiens
caaaagcaatcatagagaaacct

SEQ ID NO: 5284504 - DNA, 16 bp, Homo sapiens
caaaagcacatgtatt

SEQ ID NO: 5284505 - DNA, 14 bp, Homo sapiens
caaaagcacccttg

SEQ ID NO: 5284506 - DNA, 18 bp, Homo sapiens
caaaagcagctaaatgta

SEQ ID NO: 5284507 - DNA, 14 bp, Homo sapiens
caaaagcaggaacc

SEQ ID NO: 5284508 - DNA, 19 bp, Homo sapiens
caaaagcaggaacccatct

SEQ ID NO: 5284509 - DNA, 22 bp, Homo sapiens
caaaagcaggaacccatctaaa

SEQ ID NO: 5284510 - DNA, 14 bp, Homo sapiens
caaaagccaaaaaa

SEQ ID NO: 5284511 - DNA, 12 bp, Homo sapiens
caaaagccatgt

SEQ ID NO: 5284512 - DNA, 22 bp, Homo sapiens
caaaagcccattcattccattc

SEQ ID NO: 5284513 - DNA, 11 bp, Homo sapiens
caaaagcctgg

SEQ ID NO: 5284514 - DNA, 14 bp, Homo sapiens
caaaagcctgggtg

SEQ ID NO: 5284515 - DNA, 20 bp, Homo sapiens
caaaagccttacggtcatga

SEQ ID NO: 5284516 - DNA, 17 bp, Homo sapiens
caaaagcgactcccagc

SEQ ID NO: 5284517 - DNA, 17 bp, Homo sapiens
caaaagcgcttttcctt

SEQ ID NO: 5284518 - DNA, 22 bp, Homo sapiens
caaaagcgcttttccttggcat

SEQ ID NO: 5284519 - DNA, 21 bp, Homo sapiens
caaaagctatttaaagcatct

SEQ ID NO: 5284520 - DNA, 20 bp, Homo sapiens
caaaagctgaacacatttct

SEQ ID NO: 5284521 - DNA, 15 bp, Homo sapiens
caaaagctgggcagg

SEQ ID NO: 5284522 - DNA, 18 bp, Homo sapiens
caaaagcttacaaatact

SEQ ID NO: 5284523 - DNA, 20 bp, Homo sapiens
caaaagcttccctccctgct

SEQ ID NO: 5284524 - DNA, 15 bp, Homo sapiens
caaaagcttgtgtat

SEQ ID NO: 5284525 - DNA, 20 bp, Homo sapiens
caaaagctttttaaaattta

SEQ ID NO: 5284526 - DNA, 14 bp, Homo sapiens
caaaaggaaaaagc

SEQ ID NO: 5284527 - DNA, 12 bp, Homo sapiens
caaaaggaaacc

SEQ ID NO: 5284528 - DNA, 19 bp, Homo sapiens
caaaaggaaacctctgact

SEQ ID NO: 5284529 - DNA, 22 bp, Homo sapiens
caaaaggaaacctctgacttgc

SEQ ID NO: 5284530 - DNA, 11 bp, Homo sapiens
caaaaggaaag

SEQ ID NO: 5284531 - DNA, 14 bp, Homo sapiens
caaaaggaacaaaa

SEQ ID NO: 5284532 - DNA, 21 bp, Homo sapiens
caaaaggaagactggagaaat

SEQ ID NO: 5284533 - DNA, 23 bp, Homo sapiens
caaaaggaagactggagaaatgc

SEQ ID NO: 5284534 - DNA, 23 bp, Homo sapiens
caaaaggaagagctatatcctta

SEQ ID NO: 5284535 - DNA, 20 bp, Homo sapiens
caaaaggagaactgtgctct

SEQ ID NO: 5284536 - DNA, 15 bp, Homo sapiens
caaaaggagaagagg

SEQ ID NO: 5284537 - DNA, 16 bp, Homo sapiens
caaaaggagagattat

SEQ ID NO: 5284538 - DNA, 17 bp, Homo sapiens
caaaaggagagattatt

SEQ ID NO: 5284539 - DNA, 15 bp, Homo sapiens
caaaaggaggtgaaa

SEQ ID NO: 5284540 - DNA, 21 bp, Homo sapiens
caaaaggataatgaatacttt

SEQ ID NO: 5284541 - DNA, 19 bp, Homo sapiens
caaaaggatctttgtggcc

SEQ ID NO: 5284542 - DNA, 17 bp, Homo sapiens
caaaaggcaaatcattt

SEQ ID NO: 5284543 - DNA, 16 bp, Homo sapiens
caaaaggcactgtgaa

SEQ ID NO: 5284544 - DNA, 13 bp, Homo sapiens
caaaaggcagctc

SEQ ID NO: 5284545 - DNA, 16 bp, Homo sapiens
caaaaggcagctcacc

SEQ ID NO: 5284546 - DNA, 21 bp, Homo sapiens
caaaaggcagtggggctgggg

SEQ ID NO: 5284547 - DNA, 17 bp, Homo sapiens
caaaaggcatttcccac

SEQ ID NO: 5284548 - DNA, 15 bp, Homo sapiens
caaaaggccccttcc

SEQ ID NO: 5284549 - DNA, 17 bp, Homo sapiens
caaaaggccgtgtgttt

SEQ ID NO: 5284550 - DNA, 22 bp, Homo sapiens
caaaaggcctcttgtaaagact

SEQ ID NO: 5284551 - DNA, 19 bp, Homo sapiens
caaaaggctccatatatat

SEQ ID NO: 5284552 - DNA, 21 bp, Homo sapiens
caaaaggctcgtttggatctg

SEQ ID NO: 5284553 - DNA, 15 bp, Homo sapiens
caaaaggctgagaag

SEQ ID NO: 5284554 - DNA, 16 bp, Homo sapiens
caaaaggctgagaagg

SEQ ID NO: 5284555 - DNA, 18 bp, Homo sapiens
caaaaggctgattactga

SEQ ID NO: 5284556 - DNA, 19 bp, Homo sapiens
caaaaggcttgcagaactt

SEQ ID NO: 5284557 - DNA, 21 bp, Homo sapiens
caaaagggaaaaaataaaaat

SEQ ID NO: 5284558 - DNA, 15 bp, Homo sapiens
caaaagggacatgaa

SEQ ID NO: 5284559 - DNA, 15 bp, Homo sapiens
caaaagggagaacat

SEQ ID NO: 5284560 - DNA, 12 bp, Homo sapiens
caaaagggcagc

SEQ ID NO: 5284561 - DNA, 15 bp, Homo sapiens
caaaagggcagccag

SEQ ID NO: 5284562 - DNA, 16 bp, Homo sapiens
caaaagggcagccagg

SEQ ID NO: 5284563 - DNA, 20 bp, Homo sapiens
caaaagggcagccaggggct

SEQ ID NO: 5284564 - DNA, 20 bp, Homo sapiens
caaaagggccaaagaaccaa

SEQ ID NO: 5284565 - DNA, 11 bp, Homo sapiens
caaaagggtca

SEQ ID NO: 5284566 - DNA, 14 bp, Homo sapiens
caaaagggtcagag

SEQ ID NO: 5284567 - DNA, 16 bp, Homo sapiens
caaaagggtcagagga

SEQ ID NO: 5284568 - DNA, 23 bp, Homo sapiens
caaaagggtgtatagtgttcaca

SEQ ID NO: 5284569 - DNA, 20 bp, Homo sapiens
caaaagggtttaaactgatt

SEQ ID NO: 5284570 - DNA, 24 bp, Homo sapiens
caaaaggtaatgcacatcctcatt

SEQ ID NO: 5284571 - DNA, 22 bp, Homo sapiens
caaaaggtactggtgagggcaa

SEQ ID NO: 5284572 - DNA, 23 bp, Homo sapiens
caaaaggtgattaaatatttaat

SEQ ID NO: 5284573 - DNA, 23 bp, Homo sapiens
caaaaggtgcctgtgaggcaggg

SEQ ID NO: 5284574 - DNA, 16 bp, Homo sapiens
caaaaggttaagccat

SEQ ID NO: 5284575 - DNA, 20 bp, Homo sapiens
caaaaggttaataaagtaat

SEQ ID NO: 5284576 - DNA, 19 bp, Homo sapiens
caaaaggttcactaaagca

SEQ ID NO: 5284577 - DNA, 11 bp, Homo sapiens
caaaaggttta

SEQ ID NO: 5284578 - DNA, 12 bp, Homo sapiens
caaaagtaaatg

SEQ ID NO: 5284579 - DNA, 13 bp, Homo sapiens
caaaagtaaatgg

SEQ ID NO: 5284580 - DNA, 15 bp, Homo sapiens
caaaagtacattgct

SEQ ID NO: 5284581 - DNA, 16 bp, Homo sapiens
caaaagtactagcaat

SEQ ID NO: 5284582 - DNA, 19 bp, Homo sapiens
caaaagtagaactttgtat

SEQ ID NO: 5284583 - DNA, 21 bp, Homo sapiens
caaaagtagaactttgtatag

SEQ ID NO: 5284584 - DNA, 16 bp, Homo sapiens
caaaagtatcgggggc

SEQ ID NO: 5284585 - DNA, 18 bp, Homo sapiens
caaaagtatcgggggctg

SEQ ID NO: 5284586 - DNA, 22 bp, Homo sapiens
caaaagtatcgggggctggggc

SEQ ID NO: 5284587 - DNA, 15 bp, Homo sapiens
caaaagtattttcct

SEQ ID NO: 5284588 - DNA, 16 bp, Homo sapiens
caaaagtattttcctg

SEQ ID NO: 5284589 - DNA, 19 bp, Homo sapiens
caaaagtcaaaaggtgcct

SEQ ID NO: 5284590 - DNA, 19 bp, Homo sapiens
caaaagtcagagttaaaat

SEQ ID NO: 5284591 - DNA, 15 bp, Homo sapiens
caaaagtcattgctg

SEQ ID NO: 5284592 - DNA, 15 bp, Homo sapiens
caaaagtccctccct

SEQ ID NO: 5284593 - DNA, 21 bp, Homo sapiens
caaaagtctcaatgttccatt

SEQ ID NO: 5284594 - DNA, 18 bp, Homo sapiens
caaaagtgacagatgtta

SEQ ID NO: 5284595 - DNA, 20 bp, Homo sapiens
caaaagtgatctgtcccctc

SEQ ID NO: 5284596 - DNA, 17 bp, Homo sapiens
caaaagtgcattcaacc

SEQ ID NO: 5284597 - DNA, 20 bp, Homo sapiens
caaaagtgcattcaacctta

SEQ ID NO: 5284598 - DNA, 21 bp, Homo sapiens
caaaagtgctccccaaaagga

SEQ ID NO: 5284599 - DNA, 13 bp, Homo sapiens
caaaagtgctttg

SEQ ID NO: 5284600 - DNA, 20 bp, Homo sapiens
caaaagtggcctctttgtct

SEQ ID NO: 5284601 - DNA, 16 bp, Homo sapiens
caaaagtgtacctgta

SEQ ID NO: 5284602 - DNA, 10 bp, Homo sapiens
caaaagtgtc

SEQ ID NO: 5284603 - DNA, 15 bp, Homo sapiens
caaaagtgtgtgtgg

SEQ ID NO: 5284604 - DNA, 17 bp, Homo sapiens
caaaagttagctgagcg

SEQ ID NO: 5284605 - DNA, 16 bp, Homo sapiens
caaaagttattaaaat

SEQ ID NO: 5284606 - DNA, 22 bp, Homo sapiens
caaaagttcatataatttaaag

SEQ ID NO: 5284607 - DNA, 23 bp, Homo sapiens
caaaagttccaagagtctaaaga

SEQ ID NO: 5284608 - DNA, 23 bp, Homo sapiens
caaaagttccatatagacaccaa

SEQ ID NO: 5284609 - DNA, 18 bp, Homo sapiens
caaaagttctgacttgac

SEQ ID NO: 5284610 - DNA, 21 bp, Homo sapiens
caaaagttgtttaataagtat

SEQ ID NO: 5284611 - DNA, 21 bp, Homo sapiens
caaaagtttcacaacagattt

SEQ ID NO: 5284612 - DNA, 23 bp, Homo sapiens
caaaagtttcacaacagatttct

SEQ ID NO: 5284613 - DNA, 18 bp, Homo sapiens
caaaagtttcatcctttt

SEQ ID NO: 5284614 - DNA, 12 bp, Homo sapiens
caaaataaaaac

SEQ ID NO: 5284615 - DNA, 15 bp, Homo sapiens
caaaataaaaactat

SEQ ID NO: 5284616 - DNA, 18 bp, Homo sapiens
caaaataaaacatagcaa

SEQ ID NO: 5284617 - DNA, 18 bp, Homo sapiens
caaaataaaacctcagct

SEQ ID NO: 5284618 - DNA, 16 bp, Homo sapiens
caaaataaaagaaata

SEQ ID NO: 5284619 - DNA, 11 bp, Homo sapiens
caaaataaaat

SEQ ID NO: 5284620 - DNA, 16 bp, Homo sapiens
caaaataaaatgaaaa

SEQ ID NO: 5284621 - DNA, 18 bp, Homo sapiens
caaaataaaatgagttac

SEQ ID NO: 5284622 - DNA, 23 bp, Homo sapiens
caaaataaaccgtgtatttatta

SEQ ID NO: 5284623 - DNA, 19 bp, Homo sapiens
caaaataaagaatagcaat

SEQ ID NO: 5284624 - DNA, 14 bp, Homo sapiens
caaaataaagctgt

SEQ ID NO: 5284625 - DNA, 20 bp, Homo sapiens
caaaataaagcttttgcata

SEQ ID NO: 5284626 - DNA, 20 bp, Homo sapiens
caaaataaaggataactctg

SEQ ID NO: 5284627 - DNA, 17 bp, Homo sapiens
caaaataaagtctgtca

SEQ ID NO: 5284628 - DNA, 18 bp, Homo sapiens
caaaataaagtctgtcat

SEQ ID NO: 5284629 - DNA, 19 bp, Homo sapiens
caaaataaagtctgtcatg

SEQ ID NO: 5284630 - DNA, 17 bp, Homo sapiens
caaaataaagtgtgtgt

SEQ ID NO: 5284631 - DNA, 11 bp, Homo sapiens
caaaataaatt

SEQ ID NO: 5284632 - DNA, 14 bp, Homo sapiens
caaaataaattgaa

SEQ ID NO: 5284633 - DNA, 17 bp, Homo sapiens
caaaataacaaaaaaga

SEQ ID NO: 5284634 - DNA, 20 bp, Homo sapiens
caaaataacaaaaaagagaa

SEQ ID NO: 5284635 - DNA, 18 bp, Homo sapiens
caaaataagccatgctgc

SEQ ID NO: 5284636 - DNA, 23 bp, Homo sapiens
caaaataaggatgactttagaat

SEQ ID NO: 5284637 - DNA, 21 bp, Homo sapiens
caaaataatctatattaaatg

SEQ ID NO: 5284638 - DNA, 16 bp, Homo sapiens
caaaataatgtcttgt

SEQ ID NO: 5284639 - DNA, 19 bp, Homo sapiens
caaaataattagctatatt

SEQ ID NO: 5284640 - DNA, 14 bp, Homo sapiens
caaaataattctaa

SEQ ID NO: 5284641 - DNA, 11 bp, Homo sapiens
caaaataattt

SEQ ID NO: 5284642 - DNA, 15 bp, Homo sapiens
caaaatacaatgtta

SEQ ID NO: 5284643 - DNA, 16 bp, Homo sapiens
caaaatacaatgttat

SEQ ID NO: 5284644 - DNA, 17 bp, Homo sapiens
caaaatacaatgttatc

SEQ ID NO: 5284645 - DNA, 15 bp, Homo sapiens
caaaatacacacccc

SEQ ID NO: 5284646 - DNA, 19 bp, Homo sapiens
caaaatacacgtttatctt

SEQ ID NO: 5284647 - DNA, 20 bp, Homo sapiens
caaaatacacgtttatctta

SEQ ID NO: 5284648 - DNA, 13 bp, Homo sapiens
caaaatacatgaa

SEQ ID NO: 5284649 - DNA, 11 bp, Homo sapiens
caaaatacatt

SEQ ID NO: 5284650 - DNA, 19 bp, Homo sapiens
caaaatacgcaatttcaga

SEQ ID NO: 5284651 - DNA, 19 bp, Homo sapiens
caaaatacgtgttcaaaaa

SEQ ID NO: 5284652 - DNA, 13 bp, Homo sapiens
caaaatactccaa

SEQ ID NO: 5284653 - DNA, 20 bp, Homo sapiens
caaaatacttgtctgtttta

SEQ ID NO: 5284654 - DNA, 13 bp, Homo sapiens
attgactttttat

SEQ ID NO: 5284655 - DNA, 20 bp, Homo sapiens
attgagaaaaatatatacta

SEQ ID NO: 5284656 - DNA, 16 bp, Homo sapiens
attgagaaaggagtag

SEQ ID NO: 5284657 - DNA, 16 bp, Homo sapiens
attgagaaccaaagca

SEQ ID NO: 5284658 - DNA, 18 bp, Homo sapiens
attgagaacctggcctgt

SEQ ID NO: 5284659 - DNA, 12 bp, Homo sapiens
attgagaactga

SEQ ID NO: 5284660 - DNA, 14 bp, Homo sapiens
attgagaactgcat

SEQ ID NO: 5284661 - DNA, 18 bp, Homo sapiens
attgagaagaaaaactca

SEQ ID NO: 5284662 - DNA, 13 bp, Homo sapiens
attgagaaggaga

SEQ ID NO: 5284663 - DNA, 15 bp, Homo sapiens
attgagaaggagaga

SEQ ID NO: 5284664 - DNA, 18 bp, Homo sapiens
attgagaataagaatttg

SEQ ID NO: 5284665 - DNA, 20 bp, Homo sapiens
attgagaataattatttcag

SEQ ID NO: 5284666 - DNA, 17 bp, Homo sapiens
attgagaatagaaattt

SEQ ID NO: 5284667 - DNA, 22 bp, Homo sapiens
attgagaatagaaatttgcccc

SEQ ID NO: 5284668 - DNA, 14 bp, Homo sapiens
attgagacaaaaat

SEQ ID NO: 5284669 - DNA, 16 bp, Homo sapiens
attgagacactgtcaa

SEQ ID NO: 5284670 - DNA, 19 bp, Homo sapiens
attgagacagtgcacatga

SEQ ID NO: 5284671 - DNA, 15 bp, Homo sapiens
attgagactgaaaga

SEQ ID NO: 5284672 - DNA, 11 bp, Homo sapiens
attgagagaat

SEQ ID NO: 5284673 - DNA, 21 bp, Homo sapiens
attgagagagatgtgtaattt

SEQ ID NO: 5284674 - DNA, 22 bp, Homo sapiens
attgagagatgttttgttgata

SEQ ID NO: 5284675 - DNA, 20 bp, Homo sapiens
attgagagtaacttaagtta

SEQ ID NO: 5284676 - DNA, 16 bp, Homo sapiens
attgagagttttgtct

SEQ ID NO: 5284677 - DNA, 21 bp, Homo sapiens
attgagataatatctgtgagg

SEQ ID NO: 5284678 - DNA, 18 bp, Homo sapiens
attgagatcttcctgctg

SEQ ID NO: 5284679 - DNA, 21 bp, Homo sapiens
attgagatctttttgtctcct

SEQ ID NO: 5284680 - DNA, 17 bp, Homo sapiens
attgagatgattaaaat

SEQ ID NO: 5284681 - DNA, 19 bp, Homo sapiens
attgagattatgatgaaaa

SEQ ID NO: 5284682 - DNA, 12 bp, Homo sapiens
attgagatttct

SEQ ID NO: 5284683 - DNA, 15 bp, Homo sapiens
attgagcaagtatcc

SEQ ID NO: 5284684 - DNA, 22 bp, Homo sapiens
attgagcaagtatccttcattg

SEQ ID NO: 5284685 - DNA, 18 bp, Homo sapiens
attgagcagaattcattc

SEQ ID NO: 5284686 - DNA, 22 bp, Homo sapiens
attgagcctaaaaataaagcac

SEQ ID NO: 5284687 - DNA, 16 bp, Homo sapiens
attgagccttgcatgt

SEQ ID NO: 5284688 - DNA, 17 bp, Homo sapiens
attgagctagcgatttc

SEQ ID NO: 5284689 - DNA, 15 bp, Homo sapiens
attgagctctctcat

SEQ ID NO: 5284690 - DNA, 15 bp, Homo sapiens
attgagctgatataa

SEQ ID NO: 5284691 - DNA, 19 bp, Homo sapiens
attgagctgatataaattc

SEQ ID NO: 5284692 - DNA, 17 bp, Homo sapiens
attgagctgcagaaacg

SEQ ID NO: 5284693 - DNA, 13 bp, Homo sapiens
attgagctgcctc

SEQ ID NO: 5284694 - DNA, 21 bp, Homo sapiens
attgagctgcctccagcctgg

SEQ ID NO: 5284695 - DNA, 22 bp, Homo sapiens
attgagctgctttttttgaaac

SEQ ID NO: 5284696 - DNA, 13 bp, Homo sapiens
attgagcttacaa

SEQ ID NO: 5284697 - DNA, 16 bp, Homo sapiens
attgagcttgcttctt

SEQ ID NO: 5284698 - DNA, 21 bp, Homo sapiens
attgaggaaaaatatgtgaag

SEQ ID NO: 5284699 - DNA, 12 bp, Homo sapiens
attgaggaagag

SEQ ID NO: 5284700 - DNA, 14 bp, Homo sapiens
attgaggaattaac

SEQ ID NO: 5284701 - DNA, 16 bp, Homo sapiens
attgaggagctgcact

SEQ ID NO: 5284702 - DNA, 19 bp, Homo sapiens
attgaggataaaaaggaag

SEQ ID NO: 5284703 - DNA, 20 bp, Homo sapiens
attgaggataaaaaggaagg

SEQ ID NO: 5284704 - DNA, 22 bp, Homo sapiens
attgaggataaaaaggaaggag

SEQ ID NO: 5284705 - DNA, 14 bp, Homo sapiens
attgaggataaatt

SEQ ID NO: 5284706 - DNA, 18 bp, Homo sapiens
attgaggataaattgcca

SEQ ID NO: 5284707 - DNA, 17 bp, Homo sapiens
attgaggccaagaatat

SEQ ID NO: 5284708 - DNA, 18 bp, Homo sapiens
attgaggccaagaatatt

SEQ ID NO: 5284709 - DNA, 17 bp, Homo sapiens
attgaggcctgtcctct

SEQ ID NO: 5284710 - DNA, 14 bp, Homo sapiens
attgaggctgcagc

SEQ ID NO: 5284711 - DNA, 21 bp, Homo sapiens
attgaggctgcagcaggtgct

SEQ ID NO: 5284712 - DNA, 21 bp, Homo sapiens
attgaggcttggttccttccc

SEQ ID NO: 5284713 - DNA, 16 bp, Homo sapiens
attgaggctttgtgtt

SEQ ID NO: 5284714 - DNA, 22 bp, Homo sapiens
attgaggctttgtgttgtaatt

SEQ ID NO: 5284715 - DNA, 18 bp, Homo sapiens
attgagggagaagagaca

SEQ ID NO: 5284716 - DNA, 20 bp, Homo sapiens
attgagggccagtgatgatg

SEQ ID NO: 5284717 - DNA, 21 bp, Homo sapiens
attgagggccagtgatgatgt

SEQ ID NO: 5284718 - DNA, 16 bp, Homo sapiens
attgaggttaggaacc

SEQ ID NO: 5284719 - DNA, 19 bp, Homo sapiens
attgaggttgtgggccttc

SEQ ID NO: 5284720 - DNA, 19 bp, Homo sapiens
attgaggttgttcaaagtt

SEQ ID NO: 5284721 - DNA, 20 bp, Homo sapiens
attgagtaatattacatttc

SEQ ID NO: 5284722 - DNA, 22 bp, Homo sapiens
attgagtaatattacatttcat

SEQ ID NO: 5284723 - DNA, 13 bp, Homo sapiens
attgagtcaccat

SEQ ID NO: 5284724 - DNA, 16 bp, Homo sapiens
attgagtccagctttc

SEQ ID NO: 5284725 - DNA, 19 bp, Homo sapiens
attgagtcttaactgtatt

SEQ ID NO: 5284726 - DNA, 20 bp, Homo sapiens
attgagtgagcacctcccca

SEQ ID NO: 5284727 - DNA, 19 bp, Homo sapiens
attgagttcttcctgtaat

SEQ ID NO: 5284728 - DNA, 22 bp, Homo sapiens
attgagttcttcctgtaatctt

SEQ ID NO: 5284729 - DNA, 13 bp, Homo sapiens
attgagttggaat

SEQ ID NO: 5284730 - DNA, 14 bp, Homo sapiens
attgagttgtaaag

SEQ ID NO: 5284731 - DNA, 22 bp, Homo sapiens
attgagttgtaaagaaaactta

SEQ ID NO: 5284732 - DNA, 16 bp, Homo sapiens
attgagtttgtaggta

SEQ ID NO: 5284733 - DNA, 15 bp, Homo sapiens
attgagttttcagtg

SEQ ID NO: 5284734 - DNA, 16 bp, Homo sapiens
attgagttttcagtgg

SEQ ID NO: 5284735 - DNA, 13 bp, Homo sapiens
attgataaatttt

SEQ ID NO: 5284736 - DNA, 15 bp, Homo sapiens
attgataaattttaa

SEQ ID NO: 5284737 - DNA, 17 bp, Homo sapiens
attgataacatggaaat

SEQ ID NO: 5284738 - DNA, 17 bp, Homo sapiens
attgataaccatagcat

SEQ ID NO: 5284739 - DNA, 17 bp, Homo sapiens
attgataagatctttta

SEQ ID NO: 5284740 - DNA, 15 bp, Homo sapiens
attgataagttcata

SEQ ID NO: 5284741 - DNA, 17 bp, Homo sapiens
attgataagttcataca

SEQ ID NO: 5284742 - DNA, 18 bp, Homo sapiens
attgataagttcatacat

SEQ ID NO: 5284743 - DNA, 21 bp, Homo sapiens
attgataagttcatacattgt

SEQ ID NO: 5284744 - DNA, 15 bp, Homo sapiens
attgataataaaatt

SEQ ID NO: 5284745 - DNA, 14 bp, Homo sapiens
attgataatcttca

SEQ ID NO: 5284746 - DNA, 20 bp, Homo sapiens
attgataatcttcaggtgaa

SEQ ID NO: 5284747 - DNA, 16 bp, Homo sapiens
attgataattcaacat

SEQ ID NO: 5284748 - DNA, 20 bp, Homo sapiens
attgataattcgagcaaaca

SEQ ID NO: 5284749 - DNA, 16 bp, Homo sapiens
attgataattgcattc

SEQ ID NO: 5284750 - DNA, 19 bp, Homo sapiens
attgatacaaagtacagaa

SEQ ID NO: 5284751 - DNA, 14 bp, Homo sapiens
attgatacattttt

SEQ ID NO: 5284752 - DNA, 12 bp, Homo sapiens
attgatacctgt

SEQ ID NO: 5284753 - DNA, 16 bp, Homo sapiens
attgatacttcaggtg

SEQ ID NO: 5284754 - DNA, 21 bp, Homo sapiens
attgatacttcaggtgctttt

SEQ ID NO: 5284755 - DNA, 14 bp, Homo sapiens
attgatagaactac

SEQ ID NO: 5284756 - DNA, 17 bp, Homo sapiens
attgatagaagaatatc

SEQ ID NO: 5284757 - DNA, 23 bp, Homo sapiens
attgatagcaggtgtaataagac

SEQ ID NO: 5284758 - DNA, 18 bp, Homo sapiens
attgatataaataaaaca

SEQ ID NO: 5284759 - DNA, 21 bp, Homo sapiens
attgatatacacggatgactt

SEQ ID NO: 5284760 - DNA, 21 bp, Homo sapiens
attgatatcgtgaaatcctca

SEQ ID NO: 5284761 - DNA, 15 bp, Homo sapiens
attgatatgaaaaat

SEQ ID NO: 5284762 - DNA, 15 bp, Homo sapiens
attgatattgtgaac

SEQ ID NO: 5284763 - DNA, 14 bp, Homo sapiens
attgatatttctgt

SEQ ID NO: 5284764 - DNA, 18 bp, Homo sapiens
attgatcaaaatcaaaag

SEQ ID NO: 5284765 - DNA, 21 bp, Homo sapiens
attgatcaaatatagaaagtt

SEQ ID NO: 5284766 - DNA, 17 bp, Homo sapiens
attgatcaaattcattt

SEQ ID NO: 5284767 - DNA, 16 bp, Homo sapiens
attgatcacacagtgt

SEQ ID NO: 5284768 - DNA, 20 bp, Homo sapiens
attgatcacagatgtgccca

SEQ ID NO: 5284769 - DNA, 18 bp, Homo sapiens
attgatcaccatgaaaga

SEQ ID NO: 5284770 - DNA, 15 bp, Homo sapiens
attgatcataaactg

SEQ ID NO: 5284771 - DNA, 20 bp, Homo sapiens
attgatcattttccccccac

SEQ ID NO: 5284772 - DNA, 14 bp, Homo sapiens
attgatccaggaga

SEQ ID NO: 5284773 - DNA, 12 bp, Homo sapiens
attgatctcttt

SEQ ID NO: 5284774 - DNA, 15 bp, Homo sapiens
attgatctcttttta

SEQ ID NO: 5284775 - DNA, 12 bp, Homo sapiens
attgatctgtat

SEQ ID NO: 5284776 - DNA, 20 bp, Homo sapiens
attgatctgtattaagctcc

SEQ ID NO: 5284777 - DNA, 17 bp, Homo sapiens
attgatctttttatcat

SEQ ID NO: 5284778 - DNA, 19 bp, Homo sapiens
attgatctttttatcatga

SEQ ID NO: 5284779 - DNA, 17 bp, Homo sapiens
attgatgaaaagattta

SEQ ID NO: 5284780 - DNA, 15 bp, Homo sapiens
attgatgattttgta

SEQ ID NO: 5284781 - DNA, 16 bp, Homo sapiens
attgatgattttgtaa

SEQ ID NO: 5284782 - DNA, 20 bp, Homo sapiens
attgatgcatgctattcaca

SEQ ID NO: 5284783 - DNA, 16 bp, Homo sapiens
attgatgccaagcttt

SEQ ID NO: 5284784 - DNA, 14 bp, Homo sapiens
attgatggggacat

SEQ ID NO: 5284785 - DNA, 22 bp, Homo sapiens
attgatgtacagtctgtcatga

SEQ ID NO: 5284786 - DNA, 12 bp, Homo sapiens
attgatgtatat

SEQ ID NO: 5284787 - DNA, 20 bp, Homo sapiens
attgatgtgaaattaaattc

SEQ ID NO: 5284788 - DNA, 21 bp, Homo sapiens
attgatgtgaaattaaattct

SEQ ID NO: 5284789 - DNA, 13 bp, Homo sapiens
attgatgtgcaaa

SEQ ID NO: 5284790 - DNA, 19 bp, Homo sapiens
attgatgtgtttatttata

SEQ ID NO: 5284791 - DNA, 15 bp, Homo sapiens
attgatgttaagaac

SEQ ID NO: 5284792 - DNA, 13 bp, Homo sapiens
attgatgttgatg

SEQ ID NO: 5284793 - DNA, 14 bp, Homo sapiens
attgatgttgatgc

SEQ ID NO: 5284794 - DNA, 19 bp, Homo sapiens
attgatgtttacatgtctg

SEQ ID NO: 5284795 - DNA, 13 bp, Homo sapiens
attgatgtttcca

SEQ ID NO: 5284796 - DNA, 20 bp, Homo sapiens
attgatgtttccagaaaata

SEQ ID NO: 5284797 - DNA, 19 bp, Homo sapiens
attgatgttttacgtgcaa

SEQ ID NO: 5284798 - DNA, 20 bp, Homo sapiens
attgatgttttacgtgcaaa

SEQ ID NO: 5284799 - DNA, 22 bp, Homo sapiens
attgatgttttacgtgcaaaca

SEQ ID NO: 5284800 - DNA, 23 bp, Homo sapiens
attgatgttttacgtgcaaacaa

SEQ ID NO: 5284801 - DNA, 16 bp, Homo sapiens
attgatgttttcatag

SEQ ID NO: 5284802 - DNA, 17 bp, Homo sapiens
attgatgttttcataga

SEQ ID NO: 5284803 - DNA, 14 bp, Homo sapiens
attgattaaaatct

SEQ ID NO: 5284804 - DNA, 18 bp, Homo sapiens
attgattaaaatctcttg

SEQ ID NO: 5284805 - DNA, 14 bp, Homo sapiens
attgattaaactgt

SEQ ID NO: 5284806 - DNA, 16 bp, Homo sapiens
attgattaaactgtat

SEQ ID NO: 5284807 - DNA, 21 bp, Homo sapiens
attgattacaaataaacagtt

SEQ ID NO: 5284808 - DNA, 12 bp, Homo sapiens
attgattagaaa

SEQ ID NO: 5284809 - DNA, 19 bp, Homo sapiens
attgattatataagcaaaa

SEQ ID NO: 5284810 - DNA, 18 bp, Homo sapiens
attgattgaaaaaagaga

SEQ ID NO: 5284811 - DNA, 21 bp, Homo sapiens
attgattgaaaaaagagaaag

SEQ ID NO: 5284812 - DNA, 19 bp, Homo sapiens
attgattgctgcattttac

SEQ ID NO: 5284813 - DNA, 15 bp, Homo sapiens
attgattgctgtgtc

SEQ ID NO: 5284814 - DNA, 17 bp, Homo sapiens
attgattggataaatgc

SEQ ID NO: 5284815 - DNA, 16 bp, Homo sapiens
attgattgtattgttg

SEQ ID NO: 5284816 - DNA, 16 bp, Homo sapiens
attgattgtcagccac

SEQ ID NO: 5284817 - DNA, 17 bp, Homo sapiens
attgattgtcatatttc

SEQ ID NO: 5284818 - DNA, 15 bp, Homo sapiens
attgatttaaaattg

SEQ ID NO: 5284819 - DNA, 14 bp, Homo sapiens
attgatttataaat

SEQ ID NO: 5284820 - DNA, 13 bp, Homo sapiens
attgatttcaagt

SEQ ID NO: 5284821 - DNA, 16 bp, Homo sapiens
attgatttcctgtgtc

SEQ ID NO: 5284822 - DNA, 17 bp, Homo sapiens
attgatttcctgtgtca

SEQ ID NO: 5284823 - DNA, 12 bp, Homo sapiens
attgatttcttc

SEQ ID NO: 5284824 - DNA, 12 bp, Homo sapiens
attgatttcttt

SEQ ID NO: 5284825 - DNA, 14 bp, Homo sapiens
attgatttgaccca

SEQ ID NO: 5284826 - DNA, 16 bp, Homo sapiens
attgatttgacccact

SEQ ID NO: 5284827 - DNA, 20 bp, Homo sapiens
attgatttgcattgaacaca

SEQ ID NO: 5284828 - DNA, 15 bp, Homo sapiens
attgatttgggtttt

SEQ ID NO: 5284829 - DNA, 18 bp, Homo sapiens
attgatttgggttttttt

SEQ ID NO: 5284830 - DNA, 15 bp, Homo sapiens
attgattttaaaaat

SEQ ID NO: 5284831 - DNA, 16 bp, Homo sapiens
attgattttaaaatgt

SEQ ID NO: 5284832 - DNA, 16 bp, Homo sapiens
attgattttaaatata

SEQ ID NO: 5284833 - DNA, 14 bp, Homo sapiens
attgattttcacag

SEQ ID NO: 5284834 - DNA, 21 bp, Homo sapiens
caaaatacttgtctgttttaa

SEQ ID NO: 5284835 - DNA, 12 bp, Homo sapiens
caaaatagaaag

SEQ ID NO: 5284836 - DNA, 13 bp, Homo sapiens
caaaatagaaagt

SEQ ID NO: 5284837 - DNA, 13 bp, Homo sapiens
caaaatagaagaa

SEQ ID NO: 5284838 - DNA, 18 bp, Homo sapiens
caaaatagaagaagagga

SEQ ID NO: 5284839 - DNA, 20 bp, Homo sapiens
caaaatagaagaagaggaag

SEQ ID NO: 5284840 - DNA, 13 bp, Homo sapiens
caaaatagaagct

SEQ ID NO: 5284841 - DNA, 16 bp, Homo sapiens
caaaatagcatttgtt

SEQ ID NO: 5284842 - DNA, 13 bp, Homo sapiens
caaaatagggact

SEQ ID NO: 5284843 - DNA, 18 bp, Homo sapiens
caaaatagtattgctgaa

SEQ ID NO: 5284844 - DNA, 15 bp, Homo sapiens
caaaatagtcatgtt

SEQ ID NO: 5284845 - DNA, 22 bp, Homo sapiens
caaaatagttctatttctatct

SEQ ID NO: 5284846 - DNA, 13 bp, Homo sapiens
caaaatataaatc

SEQ ID NO: 5284847 - DNA, 14 bp, Homo sapiens
caaaatatagttaa

SEQ ID NO: 5284848 - DNA, 23 bp, Homo sapiens
caaaatatatttatcttcttcac

SEQ ID NO: 5284849 - DNA, 20 bp, Homo sapiens
caaaatatattttgtttaca

SEQ ID NO: 5284850 - DNA, 17 bp, Homo sapiens
caaaatatggtttggtt

SEQ ID NO: 5284851 - DNA, 14 bp, Homo sapiens
caaaatatgttctt

SEQ ID NO: 5284852 - DNA, 18 bp, Homo sapiens
caaaatattatgttatga

SEQ ID NO: 5284853 - DNA, 18 bp, Homo sapiens
caaaatattgagcagaat

SEQ ID NO: 5284854 - DNA, 21 bp, Homo sapiens
caaaatattggtattaaagaa

SEQ ID NO: 5284855 - DNA, 18 bp, Homo sapiens
caaaatatttaagtgaag

SEQ ID NO: 5284856 - DNA, 15 bp, Homo sapiens
caaaatatttaatta

SEQ ID NO: 5284857 - DNA, 14 bp, Homo sapiens
caaaatatttattt

SEQ ID NO: 5284858 - DNA, 14 bp, Homo sapiens
caaaatatttctaa

SEQ ID NO: 5284859 - DNA, 16 bp, Homo sapiens
caaaatatttgtgaaa

SEQ ID NO: 5284860 - DNA, 16 bp, Homo sapiens
caaaatattttatctt

SEQ ID NO: 5284861 - DNA, 13 bp, Homo sapiens
caaaatattttta

SEQ ID NO: 5284862 - DNA, 17 bp, Homo sapiens
caaaatatttttataga

SEQ ID NO: 5284863 - DNA, 21 bp, Homo sapiens
caaaatattttttgcaagtta

SEQ ID NO: 5284864 - DNA, 11 bp, Homo sapiens
caaaatcaaag

SEQ ID NO: 5284865 - DNA, 14 bp, Homo sapiens
caaaatcaacatga

SEQ ID NO: 5284866 - DNA, 16 bp, Homo sapiens
caaaatcaacatgact

SEQ ID NO: 5284867 - DNA, 19 bp, Homo sapiens
caaaatcaagcaagcctct

SEQ ID NO: 5284868 - DNA, 17 bp, Homo sapiens
caaaatcacaagcaata

SEQ ID NO: 5284869 - DNA, 18 bp, Homo sapiens
caaaatcacaagcaataa

SEQ ID NO: 5284870 - DNA, 15 bp, Homo sapiens
caaaatcacagcacc

SEQ ID NO: 5284871 - DNA, 17 bp, Homo sapiens
caaaatcacattctgca

SEQ ID NO: 5284872 - DNA, 20 bp, Homo sapiens
caaaatcactttaagatctt

SEQ ID NO: 5284873 - DNA, 17 bp, Homo sapiens
caaaatcagaatggaat

SEQ ID NO: 5284874 - DNA, 12 bp, Homo sapiens
caaaatcagttt

SEQ ID NO: 5284875 - DNA, 16 bp, Homo sapiens
caaaatcagttttcct

SEQ ID NO: 5284876 - DNA, 11 bp, Homo sapiens
caaaatcataa

SEQ ID NO: 5284877 - DNA, 12 bp, Homo sapiens
caaaatcattcc

SEQ ID NO: 5284878 - DNA, 14 bp, Homo sapiens
caaaatccaaaact

SEQ ID NO: 5284879 - DNA, 21 bp, Homo sapiens
caaaatccaaaacttctcttg

SEQ ID NO: 5284880 - DNA, 13 bp, Homo sapiens
caaaatccaaact

SEQ ID NO: 5284881 - DNA, 15 bp, Homo sapiens
caaaatccaaactgc

SEQ ID NO: 5284882 - DNA, 17 bp, Homo sapiens
caaaatccaaactgctg

SEQ ID NO: 5284883 - DNA, 19 bp, Homo sapiens
caaaatccaaactgctgtc

SEQ ID NO: 5284884 - DNA, 22 bp, Homo sapiens
caaaatccatgtgaccattctg

SEQ ID NO: 5284885 - DNA, 14 bp, Homo sapiens
caaaatcccctcag

SEQ ID NO: 5284886 - DNA, 12 bp, Homo sapiens
caaaatcccctt

SEQ ID NO: 5284887 - DNA, 21 bp, Homo sapiens
caaaatcccttaatctatgtg

SEQ ID NO: 5284888 - DNA, 20 bp, Homo sapiens
caaaatcctgaactttctcc

SEQ ID NO: 5284889 - DNA, 18 bp, Homo sapiens
caaaatcctgactattat

SEQ ID NO: 5284890 - DNA, 18 bp, Homo sapiens
caaaatccttacttccag

SEQ ID NO: 5284891 - DNA, 17 bp, Homo sapiens
caaaatctaaaagctgt

SEQ ID NO: 5284892 - DNA, 16 bp, Homo sapiens
caaaatctcctggctt

SEQ ID NO: 5284893 - DNA, 16 bp, Homo sapiens
caaaatctctccactt

SEQ ID NO: 5284894 - DNA, 21 bp, Homo sapiens
caaaatctgaactctcaaaag

SEQ ID NO: 5284895 - DNA, 21 bp, Homo sapiens
caaaatctgtccaaaggaggc

SEQ ID NO: 5284896 - DNA, 23 bp, Homo sapiens
caaaatctgtgacctgtcagaat

SEQ ID NO: 5284897 - DNA, 20 bp, Homo sapiens
caaaatcttgttaatgtcat

SEQ ID NO: 5284898 - DNA, 13 bp, Homo sapiens
caaaatgaaaaaa

SEQ ID NO: 5284899 - DNA, 18 bp, Homo sapiens
caaaatgaaaaaaaaagg

SEQ ID NO: 5284900 - DNA, 20 bp, Homo sapiens
caaaatgaaaagagaaactt

SEQ ID NO: 5284901 - DNA, 20 bp, Homo sapiens
caaaatgaaagttttttcct

SEQ ID NO: 5284902 - DNA, 21 bp, Homo sapiens
caaaatgaagttttatagaaa

SEQ ID NO: 5284903 - DNA, 15 bp, Homo sapiens
caaaatgaatgcatt

SEQ ID NO: 5284904 - DNA, 15 bp, Homo sapiens
caaaatgaattgcct

SEQ ID NO: 5284905 - DNA, 15 bp, Homo sapiens
caaaatgacctggtg

SEQ ID NO: 5284906 - DNA, 16 bp, Homo sapiens
caaaatgactttgaac

SEQ ID NO: 5284907 - DNA, 22 bp, Homo sapiens
caaaatgagagggcagtgtttc

SEQ ID NO: 5284908 - DNA, 19 bp, Homo sapiens
caaaatgagatatgcaata

SEQ ID NO: 5284909 - DNA, 22 bp, Homo sapiens
caaaatgaggaatgtatatgtt

SEQ ID NO: 5284910 - DNA, 22 bp, Homo sapiens
caaaatgagtcaggcaattgat

SEQ ID NO: 5284911 - DNA, 18 bp, Homo sapiens
caaaatgatagttttcta

SEQ ID NO: 5284912 - DNA, 19 bp, Homo sapiens
caaaatgatattcaatctt

SEQ ID NO: 5284913 - DNA, 20 bp, Homo sapiens
caaaatgatggacccaatgc

SEQ ID NO: 5284914 - DNA, 15 bp, Homo sapiens
caaaatgattgtctt

SEQ ID NO: 5284915 - DNA, 18 bp, Homo sapiens
caaaatgcacttctattt

SEQ ID NO: 5284916 - DNA, 14 bp, Homo sapiens
caaaatgcaggaca

SEQ ID NO: 5284917 - DNA, 13 bp, Homo sapiens
caaaatgcatgtg

SEQ ID NO: 5284918 - DNA, 19 bp, Homo sapiens
caaaatgctgcttccactc

SEQ ID NO: 5284919 - DNA, 16 bp, Homo sapiens
caaaatggaaaattaa

SEQ ID NO: 5284920 - DNA, 21 bp, Homo sapiens
caaaatggaaaattaattcta

SEQ ID NO: 5284921 - DNA, 22 bp, Homo sapiens
caaaatggaaatgtaataataa

SEQ ID NO: 5284922 - DNA, 16 bp, Homo sapiens
caaaatggaagcaaag

SEQ ID NO: 5284923 - DNA, 18 bp, Homo sapiens
caaaatggaattcattct

SEQ ID NO: 5284924 - DNA, 18 bp, Homo sapiens
caaaatggataaaatctg

SEQ ID NO: 5284925 - DNA, 23 bp, Homo sapiens
caaaatggataaaatctgatatg

SEQ ID NO: 5284926 - DNA, 21 bp, Homo sapiens
caaaatggattttagtcaaat

SEQ ID NO: 5284927 - DNA, 14 bp, Homo sapiens
caaaatgggaggag

SEQ ID NO: 5284928 - DNA, 19 bp, Homo sapiens
caaaatggtacagcttctg

SEQ ID NO: 5284929 - DNA, 20 bp, Homo sapiens
caaaatggtcagtattatct

SEQ ID NO: 5284930 - DNA, 18 bp, Homo sapiens
caaaatggttatctttga

SEQ ID NO: 5284931 - DNA, 19 bp, Homo sapiens
caaaatggttatctttgag

SEQ ID NO: 5284932 - DNA, 21 bp, Homo sapiens
caaaatggtttattttaggaa

SEQ ID NO: 5284933 - DNA, 14 bp, Homo sapiens
caaaatgtagaaat

SEQ ID NO: 5284934 - DNA, 14 bp, Homo sapiens
caaaatgtagcttt

SEQ ID NO: 5284935 - DNA, 12 bp, Homo sapiens
caaaatgtatat

SEQ ID NO: 5284936 - DNA, 15 bp, Homo sapiens
caaaatgtatatatt

SEQ ID NO: 5284937 - DNA, 18 bp, Homo sapiens
caaaatgtatatatttag

SEQ ID NO: 5284938 - DNA, 15 bp, Homo sapiens
caaaatgtcacactt

SEQ ID NO: 5284939 - DNA, 20 bp, Homo sapiens
caaaatgtcacacttgtttc

SEQ ID NO: 5284940 - DNA, 23 bp, Homo sapiens
caaaatgtcacacttgtttcttg

SEQ ID NO: 5284941 - DNA, 18 bp, Homo sapiens
caaaatgtctcagttttc

SEQ ID NO: 5284942 - DNA, 13 bp, Homo sapiens
caaaatgtctgta

SEQ ID NO: 5284943 - DNA, 22 bp, Homo sapiens
caaaatgtctgtagctcctcaa

SEQ ID NO: 5284944 - DNA, 10 bp, Homo sapiens
caaaatgtga

SEQ ID NO: 5284945 - DNA, 15 bp, Homo sapiens
caaaatgtgaagctt

SEQ ID NO: 5284946 - DNA, 12 bp, Homo sapiens
caaaatgtgaat

SEQ ID NO: 5284947 - DNA, 12 bp, Homo sapiens
caaaatgtgagt

SEQ ID NO: 5284948 - DNA, 19 bp, Homo sapiens
caaaatgtgagtggttgaa

SEQ ID NO: 5284949 - DNA, 21 bp, Homo sapiens
caaaatgtgccgtctttggtt

SEQ ID NO: 5284950 - DNA, 19 bp, Homo sapiens
caaaatgtgtttcagccgt

SEQ ID NO: 5284951 - DNA, 18 bp, Homo sapiens
caaaatgttaataaaggt

SEQ ID NO: 5284952 - DNA, 20 bp, Homo sapiens
caaaatgttaataaaggttt

SEQ ID NO: 5284953 - DNA, 19 bp, Homo sapiens
caaaatgttatcttctcaa

SEQ ID NO: 5284954 - DNA, 21 bp, Homo sapiens
caaaatgttatcttctcaagt

SEQ ID NO: 5284955 - DNA, 16 bp, Homo sapiens
caaaatgttctattta

SEQ ID NO: 5284956 - DNA, 18 bp, Homo sapiens
caaaatgttctatttaac

SEQ ID NO: 5284957 - DNA, 19 bp, Homo sapiens
caaaatgttctatttaaca

SEQ ID NO: 5284958 - DNA, 16 bp, Homo sapiens
caaaatgttggctgcg

SEQ ID NO: 5284959 - DNA, 19 bp, Homo sapiens
caaaattaatatgattatt

SEQ ID NO: 5284960 - DNA, 20 bp, Homo sapiens
caaaattaccaaaaatcttg

SEQ ID NO: 5284961 - DNA, 23 bp, Homo sapiens
caaaattacctaccccagttcat

SEQ ID NO: 5284962 - DNA, 13 bp, Homo sapiens
caaaattacttct

SEQ ID NO: 5284963 - DNA, 21 bp, Homo sapiens
caaaattagatcctaagatgt

SEQ ID NO: 5284964 - DNA, 23 bp, Homo sapiens
caaaattagatcctaagatgtgt

SEQ ID NO: 5284965 - DNA, 13 bp, Homo sapiens
caaaattagccag

SEQ ID NO: 5284966 - DNA, 20 bp, Homo sapiens
caaaattagtacctcaaagt

SEQ ID NO: 5284967 - DNA, 21 bp, Homo sapiens
caaaattagtacctcaaagta

SEQ ID NO: 5284968 - DNA, 14 bp, Homo sapiens
caaaattataagaa

SEQ ID NO: 5284969 - DNA, 16 bp, Homo sapiens
caaaattataagaaga

SEQ ID NO: 5284970 - DNA, 18 bp, Homo sapiens
caaaattataagaagagg

SEQ ID NO: 5284971 - DNA, 21 bp, Homo sapiens
caaaattataggagacttgta

SEQ ID NO: 5284972 - DNA, 22 bp, Homo sapiens
caaaattataggagacttgtag

SEQ ID NO: 5284973 - DNA, 16 bp, Homo sapiens
caaaattatttcagaa

SEQ ID NO: 5284974 - DNA, 20 bp, Homo sapiens
caaaattcactaatcttgaa

SEQ ID NO: 5284975 - DNA, 13 bp, Homo sapiens
caaaattcatgtg

SEQ ID NO: 5284976 - DNA, 15 bp, Homo sapiens
caaaattcatttcta

SEQ ID NO: 5284977 - DNA, 19 bp, Homo sapiens
caaaattcatttctaatta

SEQ ID NO: 5284978 - DNA, 23 bp, Homo sapiens
caaaattcgacctgatttacagt

SEQ ID NO: 5284979 - DNA, 15 bp, Homo sapiens
caaaattctgttttg

SEQ ID NO: 5284980 - DNA, 12 bp, Homo sapiens
caaaattgagca

SEQ ID NO: 5284981 - DNA, 15 bp, Homo sapiens
caaaattgatgtgtt

SEQ ID NO: 5284982 - DNA, 22 bp, Homo sapiens
caaaattgcaaatcttgaaatt

SEQ ID NO: 5284983 - DNA, 15 bp, Homo sapiens
caaaattgcaatttc

SEQ ID NO: 5284984 - DNA, 18 bp, Homo sapiens
caaaattgcctttttctc

SEQ ID NO: 5284985 - DNA, 10 bp, Homo sapiens
caaaattgct

SEQ ID NO: 5284986 - DNA, 16 bp, Homo sapiens
caaaattgctccagat

SEQ ID NO: 5284987 - DNA, 14 bp, Homo sapiens
caaaattgcttcta

SEQ ID NO: 5284988 - DNA, 21 bp, Homo sapiens
caaaattgcttctaaaacaat

SEQ ID NO: 5284989 - DNA, 23 bp, Homo sapiens
caaaattgggaaaggagtagaaa

SEQ ID NO: 5284990 - DNA, 19 bp, Homo sapiens
caaaattgtaagccagagt

SEQ ID NO: 5284991 - DNA, 22 bp, Homo sapiens
caaaattgtaagccagagtcaa

SEQ ID NO: 5284992 - DNA, 23 bp, Homo sapiens
caaaattgtaagccagagtcaac

SEQ ID NO: 5284993 - DNA, 13 bp, Homo sapiens
caaaattgttgca

SEQ ID NO: 5284994 - DNA, 13 bp, Homo sapiens
caaaattgttttc

SEQ ID NO: 5284995 - DNA, 23 bp, Homo sapiens
caaaattgttttcacttgtattg

SEQ ID NO: 5284996 - DNA, 22 bp, Homo sapiens
caaaattgttttgagctttcca

SEQ ID NO: 5284997 - DNA, 23 bp, Homo sapiens
caaaattgttttgagctttccat

SEQ ID NO: 5284998 - DNA, 24 bp, Homo sapiens
caaaatttaacgttgatgtaatga

SEQ ID NO: 5284999 - DNA, 22 bp, Homo sapiens
caaaatttaattgtgtaactgt

SEQ ID NO: 5285000 - DNA, 12 bp, Homo sapiens
caaaatttagaa

SEQ ID NO: 5285001 - DNA, 21 bp, Homo sapiens
caaaatttagatttaatttac

SEQ ID NO: 5285002 - DNA, 17 bp, Homo sapiens
caaaatttagtttttgt

SEQ ID NO: 5285003 - DNA, 15 bp, Homo sapiens
caaaatttatatttt

SEQ ID NO: 5285004 - DNA, 23 bp, Homo sapiens
caaaatttattttataagaaaaa

SEQ ID NO: 5285005 - DNA, 14 bp, Homo sapiens
caaaatttcacagt

SEQ ID NO: 5285006 - DNA, 18 bp, Homo sapiens
caaaatttcacagttctg

SEQ ID NO: 5285007 - DNA, 20 bp, Homo sapiens
caaaatttcacagttctgta

SEQ ID NO: 5285008 - DNA, 21 bp, Homo sapiens
caaaatttctttttttaaatt

SEQ ID NO: 5285009 - DNA, 14 bp, Homo sapiens
caaaatttgaaatt

SEQ ID NO: 5285010 - DNA, 12 bp, Homo sapiens
caaaatttgaga

SEQ ID NO: 5285011 - DNA, 22 bp, Homo sapiens
caaaatttgctgccaaatgcgt

SEQ ID NO: 5285012 - DNA, 13 bp, Homo sapiens
attgattttgaac

SEQ ID NO: 5285013 - DNA, 15 bp, Homo sapiens
attgatttttaagaa

SEQ ID NO: 5285014 - DNA, 16 bp, Homo sapiens
attgatttttaagaaa

SEQ ID NO: 5285015 - DNA, 23 bp, Homo sapiens
attgatttttaagaaagtaattt

SEQ ID NO: 5285016 - DNA, 16 bp, Homo sapiens
attgatttttctcttc

SEQ ID NO: 5285017 - DNA, 20 bp, Homo sapiens
attgcaaaactagacaaaag

SEQ ID NO: 5285018 - DNA, 19 bp, Homo sapiens
attgcaaaaggttaagcca

SEQ ID NO: 5285019 - DNA, 13 bp, Homo sapiens
attgcaaaataga

SEQ ID NO: 5285020 - DNA, 20 bp, Homo sapiens
attgcaaaatagaagaagag

SEQ ID NO: 5285021 - DNA, 21 bp, Homo sapiens
attgcaaaatgcgtatttgca

SEQ ID NO: 5285022 - DNA, 23 bp, Homo sapiens
attgcaaagaaaattctcaagtg

SEQ ID NO: 5285023 - DNA, 13 bp, Homo sapiens
attgcaaagcaaa

SEQ ID NO: 5285024 - DNA, 22 bp, Homo sapiens
attgcaaagtcgacatactcat

SEQ ID NO: 5285025 - DNA, 21 bp, Homo sapiens
attgcaacaaaatacattctt

SEQ ID NO: 5285026 - DNA, 22 bp, Homo sapiens
attgcaacaaaatacattcttt

SEQ ID NO: 5285027 - DNA, 16 bp, Homo sapiens
attgcaacaatgcaaa

SEQ ID NO: 5285028 - DNA, 15 bp, Homo sapiens
attgcaacaggctgg

SEQ ID NO: 5285029 - DNA, 16 bp, Homo sapiens
attgcaacaggctggg

SEQ ID NO: 5285030 - DNA, 14 bp, Homo sapiens
attgcaaggaagga

SEQ ID NO: 5285031 - DNA, 15 bp, Homo sapiens
attgcaataaagtat

SEQ ID NO: 5285032 - DNA, 16 bp, Homo sapiens
attgcaataaagtata

SEQ ID NO: 5285033 - DNA, 19 bp, Homo sapiens
attgcaatctataatattt

SEQ ID NO: 5285034 - DNA, 16 bp, Homo sapiens
attgcaatttcttagg

SEQ ID NO: 5285035 - DNA, 20 bp, Homo sapiens
attgcaattttgcatagctt

SEQ ID NO: 5285036 - DNA, 18 bp, Homo sapiens
attgcacaaaatataaag

SEQ ID NO: 5285037 - DNA, 18 bp, Homo sapiens
attgcacaactctactgt

SEQ ID NO: 5285038 - DNA, 19 bp, Homo sapiens
attgcacaactctactgtt

SEQ ID NO: 5285039 - DNA, 10 bp, Homo sapiens
attgcacaat

SEQ ID NO: 5285040 - DNA, 20 bp, Homo sapiens
attgcacacacagtctgttc

SEQ ID NO: 5285041 - DNA, 16 bp, Homo sapiens
attgcacagaagtcct

SEQ ID NO: 5285042 - DNA, 16 bp, Homo sapiens
attgcacatgtcttaa

SEQ ID NO: 5285043 - DNA, 15 bp, Homo sapiens
attgcacattgtaaa

SEQ ID NO: 5285044 - DNA, 13 bp, Homo sapiens
attgcacattgtt

SEQ ID NO: 5285045 - DNA, 21 bp, Homo sapiens
attgcacattgttgttttttt

SEQ ID NO: 5285046 - DNA, 19 bp, Homo sapiens
attgcacatttttttctat

SEQ ID NO: 5285047 - DNA, 12 bp, Homo sapiens
attgcaccactg

SEQ ID NO: 5285048 - DNA, 20 bp, Homo sapiens
attgcaccatagtatgctct

SEQ ID NO: 5285049 - DNA, 21 bp, Homo sapiens
attgcacctatctcagccata

SEQ ID NO: 5285050 - DNA, 14 bp, Homo sapiens
attgcacctgcagg

SEQ ID NO: 5285051 - DNA, 15 bp, Homo sapiens
attgcacgtgcaata

SEQ ID NO: 5285052 - DNA, 16 bp, Homo sapiens
attgcacgtggcctct

SEQ ID NO: 5285053 - DNA, 23 bp, Homo sapiens
attgcacgtggcctcttgagcag

SEQ ID NO: 5285054 - DNA, 18 bp, Homo sapiens
attgcactaaaagtgatg

SEQ ID NO: 5285055 - DNA, 12 bp, Homo sapiens
attgcactaaat

SEQ ID NO: 5285056 - DNA, 13 bp, Homo sapiens
attgcactaaatg

SEQ ID NO: 5285057 - DNA, 16 bp, Homo sapiens
attgcactagagaaaa

SEQ ID NO: 5285058 - DNA, 20 bp, Homo sapiens
attgcactagagaaaataaa

SEQ ID NO: 5285059 - DNA, 16 bp, Homo sapiens
attgcactaggaattc

SEQ ID NO: 5285060 - DNA, 22 bp, Homo sapiens
attgcactaggaattctttgca

SEQ ID NO: 5285061 - DNA, 16 bp, Homo sapiens
attgcactccagcctg

SEQ ID NO: 5285062 - DNA, 18 bp, Homo sapiens
attgcactccagcctggg

SEQ ID NO: 5285063 - DNA, 20 bp, Homo sapiens
attgcactccagcctgggca

SEQ ID NO: 5285064 - DNA, 17 bp, Homo sapiens
attgcactgaagttttt

SEQ ID NO: 5285065 - DNA, 21 bp, Homo sapiens
attgcactgaagtttttgaaa

SEQ ID NO: 5285066 - DNA, 19 bp, Homo sapiens
attgcactgcagttattta

SEQ ID NO: 5285067 - DNA, 22 bp, Homo sapiens
attgcactgcagttatttacca

SEQ ID NO: 5285068 - DNA, 14 bp, Homo sapiens
attgcactgctgtt

SEQ ID NO: 5285069 - DNA, 20 bp, Homo sapiens
attgcactgctgttcctgct

SEQ ID NO: 5285070 - DNA, 20 bp, Homo sapiens
attgcactgcttatatgcca

SEQ ID NO: 5285071 - DNA, 22 bp, Homo sapiens
attgcactgttctgattatgta

SEQ ID NO: 5285072 - DNA, 16 bp, Homo sapiens
attgcactttataaac

SEQ ID NO: 5285073 - DNA, 11 bp, Homo sapiens
attgcactttc

SEQ ID NO: 5285074 - DNA, 18 bp, Homo sapiens
attgcactttcctttcaa

SEQ ID NO: 5285075 - DNA, 13 bp, Homo sapiens
attgcacttttaa

SEQ ID NO: 5285076 - DNA, 18 bp, Homo sapiens
attgcagaaaattctgtg

SEQ ID NO: 5285077 - DNA, 17 bp, Homo sapiens
attgcagaatgaagcca

SEQ ID NO: 5285078 - DNA, 20 bp, Homo sapiens
attgcagataactttgactt

SEQ ID NO: 5285079 - DNA, 22 bp, Homo sapiens
attgcagatttctgccttgaaa

SEQ ID NO: 5285080 - DNA, 22 bp, Homo sapiens
attgcagcagacccagcagcag

SEQ ID NO: 5285081 - DNA, 18 bp, Homo sapiens
attgcagcagataacttt

SEQ ID NO: 5285082 - DNA, 19 bp, Homo sapiens
attgcagcagataactttt

SEQ ID NO: 5285083 - DNA, 23 bp, Homo sapiens
attgcagcagataacttttttga

SEQ ID NO: 5285084 - DNA, 18 bp, Homo sapiens
attgcagcagttgctagc

SEQ ID NO: 5285085 - DNA, 15 bp, Homo sapiens
attgcagcctaagaa

SEQ ID NO: 5285086 - DNA, 14 bp, Homo sapiens
attgcagccttgcg

SEQ ID NO: 5285087 - DNA, 15 bp, Homo sapiens
attgcagctaagctc

SEQ ID NO: 5285088 - DNA, 21 bp, Homo sapiens
attgcagctaagctcaaatgt

SEQ ID NO: 5285089 - DNA, 22 bp, Homo sapiens
attgcagctaagctcaaatgta

SEQ ID NO: 5285090 - DNA, 23 bp, Homo sapiens
attgcagctaagctcaaatgtat

SEQ ID NO: 5285091 - DNA, 17 bp, Homo sapiens
attgcagctttatgttc

SEQ ID NO: 5285092 - DNA, 19 bp, Homo sapiens
attgcagcttttggttaat

SEQ ID NO: 5285093 - DNA, 19 bp, Homo sapiens
attgcaggtgcctggcttg

SEQ ID NO: 5285094 - DNA, 23 bp, Homo sapiens
attgcaggtgcctggcttgctgt

SEQ ID NO: 5285095 - DNA, 18 bp, Homo sapiens
attgcagtaacaaaagca

SEQ ID NO: 5285096 - DNA, 15 bp, Homo sapiens
attgcagtaatgata

SEQ ID NO: 5285097 - DNA, 18 bp, Homo sapiens
attgcagtcactttgaca

SEQ ID NO: 5285098 - DNA, 19 bp, Homo sapiens
attgcagttcaaatcctca

SEQ ID NO: 5285099 - DNA, 18 bp, Homo sapiens
attgcagtttacagtatt

SEQ ID NO: 5285100 - DNA, 19 bp, Homo sapiens
attgcagtttacagtattt

SEQ ID NO: 5285101 - DNA, 23 bp, Homo sapiens
attgcagtttatcattcaagtgt

SEQ ID NO: 5285102 - DNA, 23 bp, Homo sapiens
attgcagtttcatgtatgtatat

SEQ ID NO: 5285103 - DNA, 19 bp, Homo sapiens
attgcataagtggacccag

SEQ ID NO: 5285104 - DNA, 20 bp, Homo sapiens
attgcataagtggacccagc

SEQ ID NO: 5285105 - DNA, 21 bp, Homo sapiens
attgcataagtggacccagct

SEQ ID NO: 5285106 - DNA, 17 bp, Homo sapiens
attgcatactattaaac

SEQ ID NO: 5285107 - DNA, 20 bp, Homo sapiens
attgcatactattaaacatg

SEQ ID NO: 5285108 - DNA, 16 bp, Homo sapiens
attgcatatatacata

SEQ ID NO: 5285109 - DNA, 18 bp, Homo sapiens
attgcatcacctctgtaa

SEQ ID NO: 5285110 - DNA, 16 bp, Homo sapiens
attgcatcactgtatc

SEQ ID NO: 5285111 - DNA, 19 bp, Homo sapiens
attgcatccactagcttct

SEQ ID NO: 5285112 - DNA, 23 bp, Homo sapiens
attgcatcggactaaactatctg

SEQ ID NO: 5285113 - DNA, 21 bp, Homo sapiens
attgcatctgggtagctgtaa

SEQ ID NO: 5285114 - DNA, 22 bp, Homo sapiens
attgcatctgggtagctgtaag

SEQ ID NO: 5285115 - DNA, 19 bp, Homo sapiens
attgcatctgtataagtaa

SEQ ID NO: 5285116 - DNA, 20 bp, Homo sapiens
attgcatgaaaatagctatt

SEQ ID NO: 5285117 - DNA, 22 bp, Homo sapiens
attgcatgaaaatagctatttt

SEQ ID NO: 5285118 - DNA, 14 bp, Homo sapiens
attgcatgaaacta

SEQ ID NO: 5285119 - DNA, 15 bp, Homo sapiens
attgcatgctgcttt

SEQ ID NO: 5285120 - DNA, 17 bp, Homo sapiens
attgcatgggttttgta

SEQ ID NO: 5285121 - DNA, 13 bp, Homo sapiens
attgcatggtgtg

SEQ ID NO: 5285122 - DNA, 14 bp, Homo sapiens
attgcatggtgtga

SEQ ID NO: 5285123 - DNA, 13 bp, Homo sapiens
attgcatgtaaaa

SEQ ID NO: 5285124 - DNA, 15 bp, Homo sapiens
attgcatgtaaaatg

SEQ ID NO: 5285125 - DNA, 17 bp, Homo sapiens
attgcatgtaaaatgca

SEQ ID NO: 5285126 - DNA, 18 bp, Homo sapiens
attgcatgtaaaatgcag

SEQ ID NO: 5285127 - DNA, 17 bp, Homo sapiens
attgcatgtatttaaga

SEQ ID NO: 5285128 - DNA, 17 bp, Homo sapiens
attgcatgtgactctga

SEQ ID NO: 5285129 - DNA, 13 bp, Homo sapiens
attgcattcattg

SEQ ID NO: 5285130 - DNA, 17 bp, Homo sapiens
attgcattcattgactt

SEQ ID NO: 5285131 - DNA, 17 bp, Homo sapiens
attgcattctattgcct

SEQ ID NO: 5285132 - DNA, 22 bp, Homo sapiens
attgcattctattgccttcttt

SEQ ID NO: 5285133 - DNA, 14 bp, Homo sapiens
attgcattgacttt

SEQ ID NO: 5285134 - DNA, 19 bp, Homo sapiens
attgcatttattgcagttt

SEQ ID NO: 5285135 - DNA, 14 bp, Homo sapiens
attgcatttccaga

SEQ ID NO: 5285136 - DNA, 17 bp, Homo sapiens
attgcatttcctgacag

SEQ ID NO: 5285137 - DNA, 14 bp, Homo sapiens
attgcatttctgct

SEQ ID NO: 5285138 - DNA, 15 bp, Homo sapiens
attgcatttctgctc

SEQ ID NO: 5285139 - DNA, 15 bp, Homo sapiens
attgcatttgctgtt

SEQ ID NO: 5285140 - DNA, 17 bp, Homo sapiens
attgcatttttaccttt

SEQ ID NO: 5285141 - DNA, 19 bp, Homo sapiens
attgcattttttaaaacaa

SEQ ID NO: 5285142 - DNA, 15 bp, Homo sapiens
attgccaaaaaggat

SEQ ID NO: 5285143 - DNA, 20 bp, Homo sapiens
attgccaaaacccagctgca

SEQ ID NO: 5285144 - DNA, 12 bp, Homo sapiens
attgccaaaata

SEQ ID NO: 5285145 - DNA, 16 bp, Homo sapiens
attgccaaaatatatt

SEQ ID NO: 5285146 - DNA, 14 bp, Homo sapiens
attgccaaacatta

SEQ ID NO: 5285147 - DNA, 21 bp, Homo sapiens
attgccaaacattaatgttga

SEQ ID NO: 5285148 - DNA, 17 bp, Homo sapiens
attgccaaataagacag

SEQ ID NO: 5285149 - DNA, 20 bp, Homo sapiens
attgccaaggcatccccagt

SEQ ID NO: 5285150 - DNA, 14 bp, Homo sapiens
attgccaagggctt

SEQ ID NO: 5285151 - DNA, 14 bp, Homo sapiens
attgccaagtgcca

SEQ ID NO: 5285152 - DNA, 14 bp, Homo sapiens
attgccaagtgcct

SEQ ID NO: 5285153 - DNA, 17 bp, Homo sapiens
attgccaatcttgtttt

SEQ ID NO: 5285154 - DNA, 19 bp, Homo sapiens
attgccacaatgcctctcc

SEQ ID NO: 5285155 - DNA, 20 bp, Homo sapiens
attgccacaatgcctctccc

SEQ ID NO: 5285156 - DNA, 22 bp, Homo sapiens
attgccacaatgcctctcccac

SEQ ID NO: 5285157 - DNA, 21 bp, Homo sapiens
attgccacagctcaactcggg

SEQ ID NO: 5285158 - DNA, 20 bp, Homo sapiens
attgccacataattcattaa

SEQ ID NO: 5285159 - DNA, 15 bp, Homo sapiens
attgccaccaggaga

SEQ ID NO: 5285160 - DNA, 12 bp, Homo sapiens
attgccacctct

SEQ ID NO: 5285161 - DNA, 21 bp, Homo sapiens
attgccacctctggccaaata

SEQ ID NO: 5285162 - DNA, 15 bp, Homo sapiens
attgccacggaaaca

SEQ ID NO: 5285163 - DNA, 16 bp, Homo sapiens
attgccagcaaataaa

SEQ ID NO: 5285164 - DNA, 16 bp, Homo sapiens
attgccagcttttata

SEQ ID NO: 5285165 - DNA, 20 bp, Homo sapiens
attgccaggagatggcccca

SEQ ID NO: 5285166 - DNA, 21 bp, Homo sapiens
attgccaggtatttttctatt

SEQ ID NO: 5285167 - DNA, 21 bp, Homo sapiens
attgccagtatataagctgtt

SEQ ID NO: 5285168 - DNA, 21 bp, Homo sapiens
attgccagtgtctttctttgg

SEQ ID NO: 5285169 - DNA, 22 bp, Homo sapiens
attgccataatatgatgcaaac

SEQ ID NO: 5285170 - DNA, 22 bp, Homo sapiens
attgccatattgcacatgtctt

SEQ ID NO: 5285171 - DNA, 20 bp, Homo sapiens
attgccatgaatttctacca

SEQ ID NO: 5285172 - DNA, 17 bp, Homo sapiens
attgccatggtctttcc

SEQ ID NO: 5285173 - DNA, 19 bp, Homo sapiens
attgccattatagcgcctg

SEQ ID NO: 5285174 - DNA, 23 bp, Homo sapiens
attgccatttcttccacaagagc

SEQ ID NO: 5285175 - DNA, 22 bp, Homo sapiens
attgcccacacctgcctctgaa

SEQ ID NO: 5285176 - DNA, 12 bp, Homo sapiens
attgcccacttc

SEQ ID NO: 5285177 - DNA, 18 bp, Homo sapiens
attgcccacttctgtgta

SEQ ID NO: 5285178 - DNA, 14 bp, Homo sapiens
attgcccaggctgg

SEQ ID NO: 5285179 - DNA, 20 bp, Homo sapiens
attgcccaggctggtcttga

SEQ ID NO: 5285180 - DNA, 18 bp, Homo sapiens
attgcccaggctgttctt

SEQ ID NO: 5285181 - DNA, 18 bp, Homo sapiens
attgcccagtgagccctg

SEQ ID NO: 5285182 - DNA, 20 bp, Homo sapiens
attgcccagtgagccctgct

SEQ ID NO: 5285183 - DNA, 21 bp, Homo sapiens
attgcccatgggatatgtggt

SEQ ID NO: 5285184 - DNA, 15 bp, Homo sapiens
attgccccataacat

SEQ ID NO: 5285185 - DNA, 15 bp, Homo sapiens
attgcccccacctct

SEQ ID NO: 5285186 - DNA, 18 bp, Homo sapiens
attgcccccacctctggt

SEQ ID NO: 5285187 - DNA, 12 bp, Homo sapiens
attgcccctctg

SEQ ID NO: 5285188 - DNA, 14 bp, Homo sapiens
attgcccctggctt

SEQ ID NO: 5285189 - DNA, 11 bp, Homo sapiens
caaaatttgtt

SEQ ID NO: 5285190 - DNA, 13 bp, Homo sapiens
caaaatttgtttg

SEQ ID NO: 5285191 - DNA, 14 bp, Homo sapiens
caaaattttaaaaa

SEQ ID NO: 5285192 - DNA, 12 bp, Homo sapiens
caaaattttaac

SEQ ID NO: 5285193 - DNA, 13 bp, Homo sapiens
caaaattttaaca

SEQ ID NO: 5285194 - DNA, 17 bp, Homo sapiens
caaaattttaagtagga

SEQ ID NO: 5285195 - DNA, 20 bp, Homo sapiens
caaaattttagtccaaataa

SEQ ID NO: 5285196 - DNA, 20 bp, Homo sapiens
caaaattttctcattttctt

SEQ ID NO: 5285197 - DNA, 22 bp, Homo sapiens
caaaattttttctctaggaaat

SEQ ID NO: 5285198 - DNA, 15 bp, Homo sapiens
caaacaaaaaaaaga

SEQ ID NO: 5285199 - DNA, 20 bp, Homo sapiens
caaacaaaaatagaatatat

SEQ ID NO: 5285200 - DNA, 14 bp, Homo sapiens
caaacaaaactctt

SEQ ID NO: 5285201 - DNA, 14 bp, Homo sapiens
caaacaaaacttgc

SEQ ID NO: 5285202 - DNA, 16 bp, Homo sapiens
caaacaaaagcagccc

SEQ ID NO: 5285203 - DNA, 21 bp, Homo sapiens
caaacaaaagcagccctctgc

SEQ ID NO: 5285204 - DNA, 15 bp, Homo sapiens
caaacaaaagttctg

SEQ ID NO: 5285205 - DNA, 15 bp, Homo sapiens
caaacaaaatttcta

SEQ ID NO: 5285206 - DNA, 14 bp, Homo sapiens
caaacaaacaaaaa

SEQ ID NO: 5285207 - DNA, 14 bp, Homo sapiens
caaacaaacaaaac

SEQ ID NO: 5285208 - DNA, 19 bp, Homo sapiens
caaacaaaggatttgaaaa

SEQ ID NO: 5285209 - DNA, 21 bp, Homo sapiens
caaacaaaggatttgaaaaca

SEQ ID NO: 5285210 - DNA, 17 bp, Homo sapiens
caaacaaatatgcaaaa

SEQ ID NO: 5285211 - DNA, 17 bp, Homo sapiens
caaacaaatcattttga

SEQ ID NO: 5285212 - DNA, 18 bp, Homo sapiens
caaacaaatggaagagaa

SEQ ID NO: 5285213 - DNA, 20 bp, Homo sapiens
caaacaaccccccatcacaa

SEQ ID NO: 5285214 - DNA, 16 bp, Homo sapiens
caaacaacctgaatct

SEQ ID NO: 5285215 - DNA, 18 bp, Homo sapiens
caaacaacctgaatcttt

SEQ ID NO: 5285216 - DNA, 14 bp, Homo sapiens
caaacaacctgcca

SEQ ID NO: 5285217 - DNA, 18 bp, Homo sapiens
caaacaagcatataaaat

SEQ ID NO: 5285218 - DNA, 20 bp, Homo sapiens
caaacaagcatataaaatgg

SEQ ID NO: 5285219 - DNA, 17 bp, Homo sapiens
caaacaaggaagccaaa

SEQ ID NO: 5285220 - DNA, 16 bp, Homo sapiens
caaacaagggagaaga

SEQ ID NO: 5285221 - DNA, 23 bp, Homo sapiens
caaacaagtggatgtttttaatg

SEQ ID NO: 5285222 - DNA, 15 bp, Homo sapiens
caaacaataagaaca

SEQ ID NO: 5285223 - DNA, 20 bp, Homo sapiens
caaacaatctcttaaattgg

SEQ ID NO: 5285224 - DNA, 12 bp, Homo sapiens
caaacaattcaa

SEQ ID NO: 5285225 - DNA, 13 bp, Homo sapiens
caaacaattcgaa

SEQ ID NO: 5285226 - DNA, 14 bp, Homo sapiens
caaacaatttaaaa

SEQ ID NO: 5285227 - DNA, 16 bp, Homo sapiens
caaacaatttaaaaat

SEQ ID NO: 5285228 - DNA, 15 bp, Homo sapiens
caaacacaaaacatt

SEQ ID NO: 5285229 - DNA, 14 bp, Homo sapiens
caaacacaaatgca

SEQ ID NO: 5285230 - DNA, 20 bp, Homo sapiens
caaacacaaggtcatggcca

SEQ ID NO: 5285231 - DNA, 16 bp, Homo sapiens
caaacacacacaaaag

SEQ ID NO: 5285232 - DNA, 13 bp, Homo sapiens
caaacacacacac

SEQ ID NO: 5285233 - DNA, 14 bp, Homo sapiens
caaacacacacaca

SEQ ID NO: 5285234 - DNA, 15 bp, Homo sapiens
caaacacacacacta

SEQ ID NO: 5285235 - DNA, 18 bp, Homo sapiens
caaacacataatttctgt

SEQ ID NO: 5285236 - DNA, 13 bp, Homo sapiens
caaacacattaag

SEQ ID NO: 5285237 - DNA, 15 bp, Homo sapiens
caaacacattataaa

SEQ ID NO: 5285238 - DNA, 19 bp, Homo sapiens
caaacacatttaccctttg

SEQ ID NO: 5285239 - DNA, 18 bp, Homo sapiens
caaacaccaacataaaaa

SEQ ID NO: 5285240 - DNA, 15 bp, Homo sapiens
caaacacctcccagg

SEQ ID NO: 5285241 - DNA, 12 bp, Homo sapiens
caaacaccttca

SEQ ID NO: 5285242 - DNA, 23 bp, Homo sapiens
caaacaccttcagtgctggtggc

SEQ ID NO: 5285243 - DNA, 22 bp, Homo sapiens
caaacacggcttctcatgctat

SEQ ID NO: 5285244 - DNA, 15 bp, Homo sapiens
caaacactgaatcat

SEQ ID NO: 5285245 - DNA, 16 bp, Homo sapiens
caaacactgaggcagc

SEQ ID NO: 5285246 - DNA, 17 bp, Homo sapiens
caaacactgcagtttcc

SEQ ID NO: 5285247 - DNA, 11 bp, Homo sapiens
caaacactgcc

SEQ ID NO: 5285248 - DNA, 20 bp, Homo sapiens
caaacactgcttaaggaaaa

SEQ ID NO: 5285249 - DNA, 11 bp, Homo sapiens
caaacactggg

SEQ ID NO: 5285250 - DNA, 14 bp, Homo sapiens
caaacactgggctc

SEQ ID NO: 5285251 - DNA, 21 bp, Homo sapiens
caaacactgggctctgaggag

SEQ ID NO: 5285252 - DNA, 15 bp, Homo sapiens
caaacacttattgtt

SEQ ID NO: 5285253 - DNA, 16 bp, Homo sapiens
caaacacttctgcttt

SEQ ID NO: 5285254 - DNA, 21 bp, Homo sapiens
caaacacttctgctttcactt

SEQ ID NO: 5285255 - DNA, 12 bp, Homo sapiens
caaacagaaaaa

SEQ ID NO: 5285256 - DNA, 15 bp, Homo sapiens
caaacagaacagggt

SEQ ID NO: 5285257 - DNA, 17 bp, Homo sapiens
caaacagaacagggtca

SEQ ID NO: 5285258 - DNA, 14 bp, Homo sapiens
caaacagacaagca

SEQ ID NO: 5285259 - DNA, 11 bp, Homo sapiens
caaacagagcc

SEQ ID NO: 5285260 - DNA, 14 bp, Homo sapiens
caaacagcaaacca

SEQ ID NO: 5285261 - DNA, 17 bp, Homo sapiens
caaacagcaaaccaaga

SEQ ID NO: 5285262 - DNA, 19 bp, Homo sapiens
caaacagcaaaccaagaga

SEQ ID NO: 5285263 - DNA, 23 bp, Homo sapiens
caaacagcaagagtaagcagtgt

SEQ ID NO: 5285264 - DNA, 13 bp, Homo sapiens
caaacagcatgtg

SEQ ID NO: 5285265 - DNA, 20 bp, Homo sapiens
caaacagccaactagcccct

SEQ ID NO: 5285266 - DNA, 18 bp, Homo sapiens
caaacagccaagattttc

SEQ ID NO: 5285267 - DNA, 15 bp, Homo sapiens
caaacaggaacaatc

SEQ ID NO: 5285268 - DNA, 13 bp, Homo sapiens
caaacaggaacta

SEQ ID NO: 5285269 - DNA, 15 bp, Homo sapiens
caaacaggacagcac

SEQ ID NO: 5285270 - DNA, 15 bp, Homo sapiens
caaacaggctgtaat

SEQ ID NO: 5285271 - DNA, 22 bp, Homo sapiens
caaacagggacactacaaacat

SEQ ID NO: 5285272 - DNA, 14 bp, Homo sapiens
caaacagggcctct

SEQ ID NO: 5285273 - DNA, 17 bp, Homo sapiens
caaacagggtggcccag

SEQ ID NO: 5285274 - DNA, 13 bp, Homo sapiens
caaacaggtgcta

SEQ ID NO: 5285275 - DNA, 16 bp, Homo sapiens
caaacaggtgctggcc

SEQ ID NO: 5285276 - DNA, 19 bp, Homo sapiens
caaacaggtgctggcccag

SEQ ID NO: 5285277 - DNA, 18 bp, Homo sapiens
caaacaggttgttttcta

SEQ ID NO: 5285278 - DNA, 22 bp, Homo sapiens
caaacaggttgttttctacttt

SEQ ID NO: 5285279 - DNA, 19 bp, Homo sapiens
caaacagtaggttggcagt

SEQ ID NO: 5285280 - DNA, 14 bp, Homo sapiens
caaacagtatttct

SEQ ID NO: 5285281 - DNA, 17 bp, Homo sapiens
caaacagtctcaggaaa

SEQ ID NO: 5285282 - DNA, 17 bp, Homo sapiens
caaacagtctcccttcc

SEQ ID NO: 5285283 - DNA, 17 bp, Homo sapiens
caaacagtgccaaatgc

SEQ ID NO: 5285284 - DNA, 22 bp, Homo sapiens
caaacagtgccaaatgctgggg

SEQ ID NO: 5285285 - DNA, 21 bp, Homo sapiens
caaacagtgggagggaattcc

SEQ ID NO: 5285286 - DNA, 14 bp, Homo sapiens
caaacagtgtggct

SEQ ID NO: 5285287 - DNA, 23 bp, Homo sapiens
caaacagtgtggcttaaacattt

SEQ ID NO: 5285288 - DNA, 12 bp, Homo sapiens
caaacagttgta

SEQ ID NO: 5285289 - DNA, 20 bp, Homo sapiens
caaacataaggcacattgtg

SEQ ID NO: 5285290 - DNA, 19 bp, Homo sapiens
caaacatatgtatctttgg

SEQ ID NO: 5285291 - DNA, 16 bp, Homo sapiens
caaacatcaaataaat

SEQ ID NO: 5285292 - DNA, 22 bp, Homo sapiens
caaacatcaaataaatttctgg

SEQ ID NO: 5285293 - DNA, 18 bp, Homo sapiens
caaacatcactctgctgc

SEQ ID NO: 5285294 - DNA, 18 bp, Homo sapiens
caaacatcagacctgtct

SEQ ID NO: 5285295 - DNA, 16 bp, Homo sapiens
caaacatcagctgaat

SEQ ID NO: 5285296 - DNA, 19 bp, Homo sapiens
caaacatcagctgaattca

SEQ ID NO: 5285297 - DNA, 14 bp, Homo sapiens
caaacatcattgtt

SEQ ID NO: 5285298 - DNA, 18 bp, Homo sapiens
caaacatcctatcaacaa

SEQ ID NO: 5285299 - DNA, 19 bp, Homo sapiens
caaacatcctcttccatat

SEQ ID NO: 5285300 - DNA, 21 bp, Homo sapiens
caaacatctggaaaataaaag

SEQ ID NO: 5285301 - DNA, 13 bp, Homo sapiens
caaacatgaaaac

SEQ ID NO: 5285302 - DNA, 15 bp, Homo sapiens
caaacatgaaaacat

SEQ ID NO: 5285303 - DNA, 18 bp, Homo sapiens
caaacatgaaaacattga

SEQ ID NO: 5285304 - DNA, 12 bp, Homo sapiens
caaacatgaagt

SEQ ID NO: 5285305 - DNA, 21 bp, Homo sapiens
caaacatgaagtgtgtttcct

SEQ ID NO: 5285306 - DNA, 15 bp, Homo sapiens
caaacatgagatgtg

SEQ ID NO: 5285307 - DNA, 19 bp, Homo sapiens
caaacatgaggttctctct

SEQ ID NO: 5285308 - DNA, 13 bp, Homo sapiens
caaacatgcacac

SEQ ID NO: 5285309 - DNA, 11 bp, Homo sapiens
caaacatgcag

SEQ ID NO: 5285310 - DNA, 16 bp, Homo sapiens
caaacatgcagtactt

SEQ ID NO: 5285311 - DNA, 17 bp, Homo sapiens
caaacatgcagtacttt

SEQ ID NO: 5285312 - DNA, 22 bp, Homo sapiens
caaacatgccctcaggcttggg

SEQ ID NO: 5285313 - DNA, 18 bp, Homo sapiens
caaacatggaaaacagag

SEQ ID NO: 5285314 - DNA, 18 bp, Homo sapiens
caaacatggatacttcct

SEQ ID NO: 5285315 - DNA, 19 bp, Homo sapiens
caaacatggatacttcctg

SEQ ID NO: 5285316 - DNA, 20 bp, Homo sapiens
caaacatggggttggctggg

SEQ ID NO: 5285317 - DNA, 22 bp, Homo sapiens
caaacatgtatctctaatgaaa

SEQ ID NO: 5285318 - DNA, 19 bp, Homo sapiens
caaacatgtggcaacctgt

SEQ ID NO: 5285319 - DNA, 23 bp, Homo sapiens
caaacatgtttagagtggataga

SEQ ID NO: 5285320 - DNA, 18 bp, Homo sapiens
caaacattaatgttgatt

SEQ ID NO: 5285321 - DNA, 22 bp, Homo sapiens
caaacattaatgttgatttcta

SEQ ID NO: 5285322 - DNA, 15 bp, Homo sapiens
caaacattagtactt

SEQ ID NO: 5285323 - DNA, 16 bp, Homo sapiens
caaacattagtacttt

SEQ ID NO: 5285324 - DNA, 17 bp, Homo sapiens
caaacattagtacttta

SEQ ID NO: 5285325 - DNA, 21 bp, Homo sapiens
caaacattcgtgagctgggga

SEQ ID NO: 5285326 - DNA, 15 bp, Homo sapiens
caaacattcttattt

SEQ ID NO: 5285327 - DNA, 19 bp, Homo sapiens
caaacattcttattttaga

SEQ ID NO: 5285328 - DNA, 16 bp, Homo sapiens
caaacattgagactgc

SEQ ID NO: 5285329 - DNA, 14 bp, Homo sapiens
caaacattggaaga

SEQ ID NO: 5285330 - DNA, 21 bp, Homo sapiens
caaacattttctcttagaaaa

SEQ ID NO: 5285331 - DNA, 18 bp, Homo sapiens
caaacattttctggccag

SEQ ID NO: 5285332 - DNA, 12 bp, Homo sapiens
caaacattttga

SEQ ID NO: 5285333 - DNA, 15 bp, Homo sapiens
caaacattttgaaag

SEQ ID NO: 5285334 - DNA, 20 bp, Homo sapiens
caaacattttgaaagtctgt

SEQ ID NO: 5285335 - DNA, 17 bp, Homo sapiens
caaaccaaccatttcta

SEQ ID NO: 5285336 - DNA, 21 bp, Homo sapiens
caaaccaagggtacagatccc

SEQ ID NO: 5285337 - DNA, 22 bp, Homo sapiens
caaaccaagtcggaacagcaga

SEQ ID NO: 5285338 - DNA, 23 bp, Homo sapiens
caaaccaagtgccttgagctgcc

SEQ ID NO: 5285339 - DNA, 18 bp, Homo sapiens
caaaccaatttcttcctt

SEQ ID NO: 5285340 - DNA, 14 bp, Homo sapiens
caaaccacaactga

SEQ ID NO: 5285341 - DNA, 14 bp, Homo sapiens
caaaccacactgga

SEQ ID NO: 5285342 - DNA, 15 bp, Homo sapiens
caaaccacactggac

SEQ ID NO: 5285343 - DNA, 14 bp, Homo sapiens
caaaccacagcagg

SEQ ID NO: 5285344 - DNA, 15 bp, Homo sapiens
caaaccaccagaagc

SEQ ID NO: 5285345 - DNA, 19 bp, Homo sapiens
caaaccacgcctcttgacc

SEQ ID NO: 5285346 - DNA, 14 bp, Homo sapiens
caaaccactgtaca

SEQ ID NO: 5285347 - DNA, 16 bp, Homo sapiens
caaaccactgtacata

SEQ ID NO: 5285348 - DNA, 17 bp, Homo sapiens
caaaccactgtacatat

SEQ ID NO: 5285349 - DNA, 18 bp, Homo sapiens
caaaccactgtacatata

SEQ ID NO: 5285350 - DNA, 15 bp, Homo sapiens
caaaccagcctcagc

SEQ ID NO: 5285351 - DNA, 15 bp, Homo sapiens
caaaccagcctgggg

SEQ ID NO: 5285352 - DNA, 17 bp, Homo sapiens
caaaccagccttcggag

SEQ ID NO: 5285353 - DNA, 12 bp, Homo sapiens
caaaccaggagc

SEQ ID NO: 5285354 - DNA, 13 bp, Homo sapiens
caaaccaggctgc

SEQ ID NO: 5285355 - DNA, 15 bp, Homo sapiens
caaaccaggctgcag

SEQ ID NO: 5285356 - DNA, 22 bp, Homo sapiens
caaaccaggggacactttgtta

SEQ ID NO: 5285357 - DNA, 12 bp, Homo sapiens
caaaccagggtg

SEQ ID NO: 5285358 - DNA, 15 bp, Homo sapiens
caaaccagggtgcat

SEQ ID NO: 5285359 - DNA, 13 bp, Homo sapiens
caaaccaggtcac

SEQ ID NO: 5285360 - DNA, 21 bp, Homo sapiens
caaaccaggtcaccatcctca

SEQ ID NO: 5285361 - DNA, 17 bp, Homo sapiens
caaaccagtatcgctca

SEQ ID NO: 5285362 - DNA, 18 bp, Homo sapiens
caaaccagtttattctgt

SEQ ID NO: 5285363 - DNA, 22 bp, Homo sapiens
caaaccagtttattctgtggtt

SEQ ID NO: 5285364 - DNA, 21 bp, Homo sapiens
caaaccatcattgaaatcttt

SEQ ID NO: 5285365 - DNA, 20 bp, Homo sapiens
caaaccatcatttaatttct

SEQ ID NO: 5285366 - DNA, 18 bp, Homo sapiens
caaaccatctggtgcctt

SEQ ID NO: 5285367 - DNA, 23 bp, Homo sapiens
caaaccattgctcttagtcccaa

SEQ ID NO: 5285368 - DNA, 14 bp, Homo sapiens
caaaccatttcagc

SEQ ID NO: 5285369 - DNA, 21 bp, Homo sapiens
caaaccattttattttttggg

SEQ ID NO: 5285370 - DNA, 16 bp, Homo sapiens
attgcccctggctttg

SEQ ID NO: 5285371 - DNA, 21 bp, Homo sapiens
attgcccctggctttgcctct

SEQ ID NO: 5285372 - DNA, 21 bp, Homo sapiens
attgccctaattaaaaactgt

SEQ ID NO: 5285373 - DNA, 14 bp, Homo sapiens
attgccctgagggg

SEQ ID NO: 5285374 - DNA, 12 bp, Homo sapiens
attgccctgcca

SEQ ID NO: 5285375 - DNA, 14 bp, Homo sapiens
attgccctgccagg

SEQ ID NO: 5285376 - DNA, 18 bp, Homo sapiens
attgccgaagtccagctt

SEQ ID NO: 5285377 - DNA, 20 bp, Homo sapiens
attgccgtcctggactctgt

SEQ ID NO: 5285378 - DNA, 22 bp, Homo sapiens
attgcctaaaatttctgagaac

SEQ ID NO: 5285379 - DNA, 18 bp, Homo sapiens
attgcctacaataaaaag

SEQ ID NO: 5285380 - DNA, 21 bp, Homo sapiens
attgcctacaataaaaagaaa

SEQ ID NO: 5285381 - DNA, 13 bp, Homo sapiens
attgcctacattt

SEQ ID NO: 5285382 - DNA, 14 bp, Homo sapiens
attgcctatttcag

SEQ ID NO: 5285383 - DNA, 23 bp, Homo sapiens
attgcctccagtccagtttccca

SEQ ID NO: 5285384 - DNA, 13 bp, Homo sapiens
attgcctcccttc

SEQ ID NO: 5285385 - DNA, 17 bp, Homo sapiens
attgcctcccttcctcc

SEQ ID NO: 5285386 - DNA, 13 bp, Homo sapiens
attgcctctgtct

SEQ ID NO: 5285387 - DNA, 14 bp, Homo sapiens
attgcctgcagaga

SEQ ID NO: 5285388 - DNA, 15 bp, Homo sapiens
attgcctggactgac

SEQ ID NO: 5285389 - DNA, 20 bp, Homo sapiens
attgcctgtaacaatgtaat

SEQ ID NO: 5285390 - DNA, 19 bp, Homo sapiens
attgcctgtgactgaggcg

SEQ ID NO: 5285391 - DNA, 22 bp, Homo sapiens
attgcctgtgtatggaaaaacc

SEQ ID NO: 5285392 - DNA, 16 bp, Homo sapiens
attgcctgttaaatat

SEQ ID NO: 5285393 - DNA, 20 bp, Homo sapiens
attgccttcctaccctctct

SEQ ID NO: 5285394 - DNA, 18 bp, Homo sapiens
attgccttctcaccagct

SEQ ID NO: 5285395 - DNA, 17 bp, Homo sapiens
attgccttctttgaaga

SEQ ID NO: 5285396 - DNA, 21 bp, Homo sapiens
attgccttctttgaagaaggt

SEQ ID NO: 5285397 - DNA, 13 bp, Homo sapiens
attgccttgatgt

SEQ ID NO: 5285398 - DNA, 16 bp, Homo sapiens
attgccttgcatttgt

SEQ ID NO: 5285399 - DNA, 18 bp, Homo sapiens
attgcctttaatattttg

SEQ ID NO: 5285400 - DNA, 22 bp, Homo sapiens
attgcctttaatattttgtaat

SEQ ID NO: 5285401 - DNA, 18 bp, Homo sapiens
attgcctttgaatgttaa

SEQ ID NO: 5285402 - DNA, 16 bp, Homo sapiens
attgcctttgataatt

SEQ ID NO: 5285403 - DNA, 15 bp, Homo sapiens
attgcctttgcctct

SEQ ID NO: 5285404 - DNA, 22 bp, Homo sapiens
attgcctttggcaattcttctt

SEQ ID NO: 5285405 - DNA, 15 bp, Homo sapiens
attgcgaatgtgcag

SEQ ID NO: 5285406 - DNA, 16 bp, Homo sapiens
attgcgagagatgtgt

SEQ ID NO: 5285407 - DNA, 17 bp, Homo sapiens
attgcgccattgcactc

SEQ ID NO: 5285408 - DNA, 19 bp, Homo sapiens
attgcgccattgcactcca

SEQ ID NO: 5285409 - DNA, 16 bp, Homo sapiens
attgcgcctaatgtgt

SEQ ID NO: 5285410 - DNA, 18 bp, Homo sapiens
attgcgcctaatgtgttt

SEQ ID NO: 5285411 - DNA, 21 bp, Homo sapiens
attgcgcctttgtattataaa

SEQ ID NO: 5285412 - DNA, 23 bp, Homo sapiens
attgcgcctttgtattataaaag

SEQ ID NO: 5285413 - DNA, 20 bp, Homo sapiens
attgcgctcaggggctccat

SEQ ID NO: 5285414 - DNA, 18 bp, Homo sapiens
attgcggacagccacggc

SEQ ID NO: 5285415 - DNA, 14 bp, Homo sapiens
attgcggccccagg

SEQ ID NO: 5285416 - DNA, 17 bp, Homo sapiens
attgcggccccaggagg

SEQ ID NO: 5285417 - DNA, 18 bp, Homo sapiens
attgcggccccaggaggg

SEQ ID NO: 5285418 - DNA, 21 bp, Homo sapiens
attgcgtcttagcagtgattt

SEQ ID NO: 5285419 - DNA, 15 bp, Homo sapiens
attgctaaaagtgca

SEQ ID NO: 5285420 - DNA, 18 bp, Homo sapiens
attgctaaaagtgcattt

SEQ ID NO: 5285421 - DNA, 14 bp, Homo sapiens
attgctaaatgtaa

SEQ ID NO: 5285422 - DNA, 17 bp, Homo sapiens
attgctaaatgtaacag

SEQ ID NO: 5285423 - DNA, 17 bp, Homo sapiens
attgctaacgttttttc

SEQ ID NO: 5285424 - DNA, 20 bp, Homo sapiens
attgctaacgttttttcttc

SEQ ID NO: 5285425 - DNA, 15 bp, Homo sapiens
attgctaagatgctc

SEQ ID NO: 5285426 - DNA, 15 bp, Homo sapiens
attgctaatgttgct

SEQ ID NO: 5285427 - DNA, 16 bp, Homo sapiens
attgctaatgttgctg

SEQ ID NO: 5285428 - DNA, 21 bp, Homo sapiens
attgctaattctgagggaatt

SEQ ID NO: 5285429 - DNA, 15 bp, Homo sapiens
attgctaattgctgt

SEQ ID NO: 5285430 - DNA, 16 bp, Homo sapiens
attgctaattgctgtt

SEQ ID NO: 5285431 - DNA, 19 bp, Homo sapiens
attgctaattgctgttgaa

SEQ ID NO: 5285432 - DNA, 17 bp, Homo sapiens
attgctaccacagactt

SEQ ID NO: 5285433 - DNA, 15 bp, Homo sapiens
attgctactgtccta

SEQ ID NO: 5285434 - DNA, 16 bp, Homo sapiens
attgctagaggtggca

SEQ ID NO: 5285435 - DNA, 17 bp, Homo sapiens
attgctagataaaagct

SEQ ID NO: 5285436 - DNA, 13 bp, Homo sapiens
attgctagtattt

SEQ ID NO: 5285437 - DNA, 14 bp, Homo sapiens
attgctagtatttg

SEQ ID NO: 5285438 - DNA, 16 bp, Homo sapiens
attgctagtatttgaa

SEQ ID NO: 5285439 - DNA, 17 bp, Homo sapiens
attgctagtatttgaat

SEQ ID NO: 5285440 - DNA, 17 bp, Homo sapiens
attgctagtgatttcat

SEQ ID NO: 5285441 - DNA, 18 bp, Homo sapiens
attgctagtgatttcatt

SEQ ID NO: 5285442 - DNA, 23 bp, Homo sapiens
attgctagtgatttcattaccaa

SEQ ID NO: 5285443 - DNA, 21 bp, Homo sapiens
attgctatcgccctcctttcc

SEQ ID NO: 5285444 - DNA, 22 bp, Homo sapiens
attgctatcgccctcctttccc

SEQ ID NO: 5285445 - DNA, 17 bp, Homo sapiens
attgctatctattgata

SEQ ID NO: 5285446 - DNA, 15 bp, Homo sapiens
attgctatgttacta

SEQ ID NO: 5285447 - DNA, 15 bp, Homo sapiens
attgctattgtgtta

SEQ ID NO: 5285448 - DNA, 20 bp, Homo sapiens
attgctatttaaatagataa

SEQ ID NO: 5285449 - DNA, 15 bp, Homo sapiens
attgctatttatatt

SEQ ID NO: 5285450 - DNA, 18 bp, Homo sapiens
attgctatttatattcat

SEQ ID NO: 5285451 - DNA, 21 bp, Homo sapiens
attgctattttatttgtattc

SEQ ID NO: 5285452 - DNA, 13 bp, Homo sapiens
attgctcaaaaaa

SEQ ID NO: 5285453 - DNA, 23 bp, Homo sapiens
attgctcaagttcattgatgacc

SEQ ID NO: 5285454 - DNA, 13 bp, Homo sapiens
attgctcacagtt

SEQ ID NO: 5285455 - DNA, 16 bp, Homo sapiens
attgctcacccagtgc

SEQ ID NO: 5285456 - DNA, 23 bp, Homo sapiens
attgctcacccagtgccctctcc

SEQ ID NO: 5285457 - DNA, 21 bp, Homo sapiens
attgctcagcccgcttggcca

SEQ ID NO: 5285458 - DNA, 23 bp, Homo sapiens
attgctcagcccgcttggccacc

SEQ ID NO: 5285459 - DNA, 17 bp, Homo sapiens
attgctcataatctggt

SEQ ID NO: 5285460 - DNA, 14 bp, Homo sapiens
attgctccagagca

SEQ ID NO: 5285461 - DNA, 17 bp, Homo sapiens
attgctcccaggatctc

SEQ ID NO: 5285462 - DNA, 20 bp, Homo sapiens
attgctcccagtgccaaact

SEQ ID NO: 5285463 - DNA, 16 bp, Homo sapiens
attgctccctaagact

SEQ ID NO: 5285464 - DNA, 19 bp, Homo sapiens
attgctcctaactccaccg

SEQ ID NO: 5285465 - DNA, 12 bp, Homo sapiens
attgctcctccc

SEQ ID NO: 5285466 - DNA, 17 bp, Homo sapiens
attgctctaattctttt

SEQ ID NO: 5285467 - DNA, 22 bp, Homo sapiens
attgctctaattcttttcaaaa

SEQ ID NO: 5285468 - DNA, 21 bp, Homo sapiens
attgctctggaagcctgctga

SEQ ID NO: 5285469 - DNA, 23 bp, Homo sapiens
attgctctggaagcctgctgatt

SEQ ID NO: 5285470 - DNA, 13 bp, Homo sapiens
attgctcttctcc

SEQ ID NO: 5285471 - DNA, 12 bp, Homo sapiens
attgctgaaatt

SEQ ID NO: 5285472 - DNA, 16 bp, Homo sapiens
attgctgaaattttat

SEQ ID NO: 5285473 - DNA, 20 bp, Homo sapiens
attgctgaatcccatcaggc

SEQ ID NO: 5285474 - DNA, 21 bp, Homo sapiens
attgctgagagaaatatggaa

SEQ ID NO: 5285475 - DNA, 17 bp, Homo sapiens
attgctgagatgtttag

SEQ ID NO: 5285476 - DNA, 16 bp, Homo sapiens
attgctgagcctctgc

SEQ ID NO: 5285477 - DNA, 22 bp, Homo sapiens
attgctgagcctctgctcccca

SEQ ID NO: 5285478 - DNA, 21 bp, Homo sapiens
attgctgaggcaccgtccagg

SEQ ID NO: 5285479 - DNA, 22 bp, Homo sapiens
attgctgataccatatgaatga

SEQ ID NO: 5285480 - DNA, 19 bp, Homo sapiens
attgctgatggtgcaatga

SEQ ID NO: 5285481 - DNA, 23 bp, Homo sapiens
attgctgatggtgcaatgacctt

SEQ ID NO: 5285482 - DNA, 21 bp, Homo sapiens
attgctgcaaatgcattgtga

SEQ ID NO: 5285483 - DNA, 23 bp, Homo sapiens
attgctgcaaggacattcttgta

SEQ ID NO: 5285484 - DNA, 14 bp, Homo sapiens
attgctgcataaat

SEQ ID NO: 5285485 - DNA, 16 bp, Homo sapiens
attgctgcataaattt

SEQ ID NO: 5285486 - DNA, 17 bp, Homo sapiens
attgctgcataaatttg

SEQ ID NO: 5285487 - DNA, 18 bp, Homo sapiens
attgctgcatatttgtgc

SEQ ID NO: 5285488 - DNA, 12 bp, Homo sapiens
attgctgcattt

SEQ ID NO: 5285489 - DNA, 14 bp, Homo sapiens
attgctgcatttta

SEQ ID NO: 5285490 - DNA, 16 bp, Homo sapiens
attgctgccaaaacca

SEQ ID NO: 5285491 - DNA, 23 bp, Homo sapiens
attgctgccaaaaccacatgggc

SEQ ID NO: 5285492 - DNA, 21 bp, Homo sapiens
attgctgccactttttaacta

SEQ ID NO: 5285493 - DNA, 20 bp, Homo sapiens
attgctgccagagaagtctg

SEQ ID NO: 5285494 - DNA, 22 bp, Homo sapiens
attgctgctaagtcattggcaa

SEQ ID NO: 5285495 - DNA, 20 bp, Homo sapiens
attgctgctccttagctgcc

SEQ ID NO: 5285496 - DNA, 22 bp, Homo sapiens
attgctgctccttagctgccaa

SEQ ID NO: 5285497 - DNA, 18 bp, Homo sapiens
attgctgctctctgaggg

SEQ ID NO: 5285498 - DNA, 14 bp, Homo sapiens
attgctgcttggat

SEQ ID NO: 5285499 - DNA, 18 bp, Homo sapiens
attgctggaacccaggag

SEQ ID NO: 5285500 - DNA, 23 bp, Homo sapiens
attgctggactgatggttgcttt

SEQ ID NO: 5285501 - DNA, 22 bp, Homo sapiens
attgctggaggaaccagaggca

SEQ ID NO: 5285502 - DNA, 16 bp, Homo sapiens
attgctggtcttgtaa

SEQ ID NO: 5285503 - DNA, 17 bp, Homo sapiens
attgctggtcttgtaag

SEQ ID NO: 5285504 - DNA, 19 bp, Homo sapiens
attgctggtcttgtaagag

SEQ ID NO: 5285505 - DNA, 16 bp, Homo sapiens
attgctggtgcaaaga

SEQ ID NO: 5285506 - DNA, 14 bp, Homo sapiens
attgctggttctat

SEQ ID NO: 5285507 - DNA, 21 bp, Homo sapiens
attgctggttctatttaatgg

SEQ ID NO: 5285508 - DNA, 14 bp, Homo sapiens
attgctgtaaataa

SEQ ID NO: 5285509 - DNA, 20 bp, Homo sapiens
attgctgtaaataaaaatag

SEQ ID NO: 5285510 - DNA, 19 bp, Homo sapiens
attgctgtctatgattgta

SEQ ID NO: 5285511 - DNA, 16 bp, Homo sapiens
attgctgtctgaaaaa

SEQ ID NO: 5285512 - DNA, 12 bp, Homo sapiens
attgctgtctgg

SEQ ID NO: 5285513 - DNA, 21 bp, Homo sapiens
attgctgtctggtgaggtggc

SEQ ID NO: 5285514 - DNA, 18 bp, Homo sapiens
attgctgtcttgccccag

SEQ ID NO: 5285515 - DNA, 10 bp, Homo sapiens
attgctgtga

SEQ ID NO: 5285516 - DNA, 15 bp, Homo sapiens
attgctgtgtatctg

SEQ ID NO: 5285517 - DNA, 12 bp, Homo sapiens
attgctgtgtct

SEQ ID NO: 5285518 - DNA, 14 bp, Homo sapiens
attgctgtgtctcc

SEQ ID NO: 5285519 - DNA, 18 bp, Homo sapiens
attgctgtgtgtcccagg

SEQ ID NO: 5285520 - DNA, 19 bp, Homo sapiens
attgctgtgtgtcccaggc

SEQ ID NO: 5285521 - DNA, 22 bp, Homo sapiens
attgctgttgagatggtaacag

SEQ ID NO: 5285522 - DNA, 23 bp, Homo sapiens
attgctgttgagatggtaacaga

SEQ ID NO: 5285523 - DNA, 16 bp, Homo sapiens
attgcttaaacaaaac

SEQ ID NO: 5285524 - DNA, 17 bp, Homo sapiens
attgcttaatttctgcc

SEQ ID NO: 5285525 - DNA, 13 bp, Homo sapiens
attgcttacattt

SEQ ID NO: 5285526 - DNA, 14 bp, Homo sapiens
attgcttacatttt

SEQ ID NO: 5285527 - DNA, 16 bp, Homo sapiens
attgcttacattttta

SEQ ID NO: 5285528 - DNA, 21 bp, Homo sapiens
attgcttacatttttacaata

SEQ ID NO: 5285529 - DNA, 13 bp, Homo sapiens
attgcttactgat

SEQ ID NO: 5285530 - DNA, 16 bp, Homo sapiens
attgcttactgatatt

SEQ ID NO: 5285531 - DNA, 13 bp, Homo sapiens
attgcttagtaaa

SEQ ID NO: 5285532 - DNA, 22 bp, Homo sapiens
attgcttagtaagtatttccat

SEQ ID NO: 5285533 - DNA, 19 bp, Homo sapiens
attgcttagtgaaaatact

SEQ ID NO: 5285534 - DNA, 19 bp, Homo sapiens
attgcttattatgtaggta

SEQ ID NO: 5285535 - DNA, 15 bp, Homo sapiens
attgcttcaattaaa

SEQ ID NO: 5285536 - DNA, 20 bp, Homo sapiens
attgcttcaatttcaaactt

SEQ ID NO: 5285537 - DNA, 22 bp, Homo sapiens
attgcttcagctgctgaaggga

SEQ ID NO: 5285538 - DNA, 13 bp, Homo sapiens
attgcttctaaaa

SEQ ID NO: 5285539 - DNA, 17 bp, Homo sapiens
attgcttctctaaaaca

SEQ ID NO: 5285540 - DNA, 13 bp, Homo sapiens
attgcttctgact

SEQ ID NO: 5285541 - DNA, 22 bp, Homo sapiens
attgcttctgtagtactcctta

SEQ ID NO: 5285542 - DNA, 20 bp, Homo sapiens
attgcttctgtgcaataaaa

SEQ ID NO: 5285543 - DNA, 17 bp, Homo sapiens
attgcttcttctcctat

SEQ ID NO: 5285544 - DNA, 23 bp, Homo sapiens
attgcttcttgtgaaaccacagg

SEQ ID NO: 5285545 - DNA, 14 bp, Homo sapiens
attgcttcttgtgt

SEQ ID NO: 5285546 - DNA, 14 bp, Homo sapiens
attgcttgagcatg

SEQ ID NO: 5285547 - DNA, 18 bp, Homo sapiens
attgcttgagcccaggag

SEQ ID NO: 5285548 - DNA, 23 bp, Homo sapiens
caaaccattttattttttgggcc

SEQ ID NO: 5285549 - DNA, 21 bp, Homo sapiens
caaaccatttttaaagtagaa

SEQ ID NO: 5285550 - DNA, 22 bp, Homo sapiens
caaacccaaaaaagaacaagct

SEQ ID NO: 5285551 - DNA, 21 bp, Homo sapiens
caaacccacctgctagtgtga

SEQ ID NO: 5285552 - DNA, 23 bp, Homo sapiens
caaacccacgattttctccagct

SEQ ID NO: 5285553 - DNA, 22 bp, Homo sapiens
caaacccacttctggcctccag

SEQ ID NO: 5285554 - DNA, 19 bp, Homo sapiens
caaacccagacaaccaaaa

SEQ ID NO: 5285555 - DNA, 21 bp, Homo sapiens
caaacccagacaaccaaaaca

SEQ ID NO: 5285556 - DNA, 21 bp, Homo sapiens
caaacccagaggtggatgtta

SEQ ID NO: 5285557 - DNA, 11 bp, Homo sapiens
caaacccagcc

SEQ ID NO: 5285558 - DNA, 12 bp, Homo sapiens
caaacccagcca

SEQ ID NO: 5285559 - DNA, 19 bp, Homo sapiens
caaacccaggagtttgtgt

SEQ ID NO: 5285560 - DNA, 12 bp, Homo sapiens
caaacccaggct

SEQ ID NO: 5285561 - DNA, 16 bp, Homo sapiens
caaacccaggctgtct

SEQ ID NO: 5285562 - DNA, 22 bp, Homo sapiens
caaacccatgaagctggccctc

SEQ ID NO: 5285563 - DNA, 17 bp, Homo sapiens
caaaccccaccctagtt

SEQ ID NO: 5285564 - DNA, 18 bp, Homo sapiens
caaaccccagccccaact

SEQ ID NO: 5285565 - DNA, 14 bp, Homo sapiens
caaacccccattct

SEQ ID NO: 5285566 - DNA, 18 bp, Homo sapiens
caaaccccttcccacgac

SEQ ID NO: 5285567 - DNA, 16 bp, Homo sapiens
caaaccctatgccttt

SEQ ID NO: 5285568 - DNA, 20 bp, Homo sapiens
caaaccctccacttctcccc

SEQ ID NO: 5285569 - DNA, 13 bp, Homo sapiens
caaaccctcctgg

SEQ ID NO: 5285570 - DNA, 16 bp, Homo sapiens
caaaccctcctgggaa

SEQ ID NO: 5285571 - DNA, 14 bp, Homo sapiens
caaaccctgctgcc

SEQ ID NO: 5285572 - DNA, 15 bp, Homo sapiens
caaaccctgcttctg

SEQ ID NO: 5285573 - DNA, 23 bp, Homo sapiens
caaaccctgcttctgctgccctg

SEQ ID NO: 5285574 - DNA, 13 bp, Homo sapiens
caaaccctgggga

SEQ ID NO: 5285575 - DNA, 14 bp, Homo sapiens
caaaccctggggac

SEQ ID NO: 5285576 - DNA, 13 bp, Homo sapiens
caaaccctgtcaa

SEQ ID NO: 5285577 - DNA, 21 bp, Homo sapiens
caaaccctgtcaaacattagt

SEQ ID NO: 5285578 - DNA, 13 bp, Homo sapiens
caaaccctgtggg

SEQ ID NO: 5285579 - DNA, 17 bp, Homo sapiens
caaaccctgttcaggct

SEQ ID NO: 5285580 - DNA, 13 bp, Homo sapiens
caaaccctgttta

SEQ ID NO: 5285581 - DNA, 16 bp, Homo sapiens
caaacccttaactgac

SEQ ID NO: 5285582 - DNA, 17 bp, Homo sapiens
caaacccttaactgaca

SEQ ID NO: 5285583 - DNA, 17 bp, Homo sapiens
caaacccttagcagccc

SEQ ID NO: 5285584 - DNA, 21 bp, Homo sapiens
caaacccttcaactcctggct

SEQ ID NO: 5285585 - DNA, 14 bp, Homo sapiens
caaacccttcagtg

SEQ ID NO: 5285586 - DNA, 15 bp, Homo sapiens
caaacccttctcttc

SEQ ID NO: 5285587 - DNA, 16 bp, Homo sapiens
caaacccttgctttcc

SEQ ID NO: 5285588 - DNA, 21 bp, Homo sapiens
caaaccctttgtattataatt

SEQ ID NO: 5285589 - DNA, 21 bp, Homo sapiens
caaaccgccagcgaacttgac

SEQ ID NO: 5285590 - DNA, 23 bp, Homo sapiens
caaaccgccagcgaacttgacaa

SEQ ID NO: 5285591 - DNA, 22 bp, Homo sapiens
caaaccgtggtacccccccttt

SEQ ID NO: 5285592 - DNA, 21 bp, Homo sapiens
caaacctaacaggagaaagga

SEQ ID NO: 5285593 - DNA, 21 bp, Homo sapiens
caaacctaagtccttccacct

SEQ ID NO: 5285594 - DNA, 13 bp, Homo sapiens
caaacctaagttg

SEQ ID NO: 5285595 - DNA, 15 bp, Homo sapiens
caaacctaccaaaat

SEQ ID NO: 5285596 - DNA, 14 bp, Homo sapiens
caaacctactgccc

SEQ ID NO: 5285597 - DNA, 15 bp, Homo sapiens
caaacctactgccca

SEQ ID NO: 5285598 - DNA, 18 bp, Homo sapiens
caaacctagcttttaaaa

SEQ ID NO: 5285599 - DNA, 16 bp, Homo sapiens
caaacctcactgagag

SEQ ID NO: 5285600 - DNA, 18 bp, Homo sapiens
caaacctccaaaagccct

SEQ ID NO: 5285601 - DNA, 16 bp, Homo sapiens
caaacctccagcctcc

SEQ ID NO: 5285602 - DNA, 16 bp, Homo sapiens
caaacctctatatgtt

SEQ ID NO: 5285603 - DNA, 13 bp, Homo sapiens
caaacctctgttc

SEQ ID NO: 5285604 - DNA, 23 bp, Homo sapiens
caaacctctgttcagtgtaaata

SEQ ID NO: 5285605 - DNA, 19 bp, Homo sapiens
caaacctgacccctgctca

SEQ ID NO: 5285606 - DNA, 19 bp, Homo sapiens
caaacctgcaagggctccc

SEQ ID NO: 5285607 - DNA, 21 bp, Homo sapiens
caaacctgcaagggctcccca

SEQ ID NO: 5285608 - DNA, 16 bp, Homo sapiens
caaacctgccccatcc

SEQ ID NO: 5285609 - DNA, 20 bp, Homo sapiens
caaacctgctggtggggcag

SEQ ID NO: 5285610 - DNA, 12 bp, Homo sapiens
caaacctggaga

SEQ ID NO: 5285611 - DNA, 13 bp, Homo sapiens
caaacctggagat

SEQ ID NO: 5285612 - DNA, 13 bp, Homo sapiens
caaacctgggaag

SEQ ID NO: 5285613 - DNA, 17 bp, Homo sapiens
caaacctgggaaggcca

SEQ ID NO: 5285614 - DNA, 22 bp, Homo sapiens
caaacctgggaaggccagcctt

SEQ ID NO: 5285615 - DNA, 15 bp, Homo sapiens
caaacctgggacccc

SEQ ID NO: 5285616 - DNA, 13 bp, Homo sapiens
caaacctggttca

SEQ ID NO: 5285617 - DNA, 16 bp, Homo sapiens
caaacctgtagatgca

SEQ ID NO: 5285618 - DNA, 17 bp, Homo sapiens
caaacctgtgatctagt

SEQ ID NO: 5285619 - DNA, 19 bp, Homo sapiens
caaacctgtttaaatattt

SEQ ID NO: 5285620 - DNA, 22 bp, Homo sapiens
caaacctgtttaaatatttcaa

SEQ ID NO: 5285621 - DNA, 21 bp, Homo sapiens
caaaccttaaacacccagaag

SEQ ID NO: 5285622 - DNA, 17 bp, Homo sapiens
caaaccttactctgagc

SEQ ID NO: 5285623 - DNA, 21 bp, Homo sapiens
caaaccttactctgagctcat

SEQ ID NO: 5285624 - DNA, 15 bp, Homo sapiens
caaaccttatctcca

SEQ ID NO: 5285625 - DNA, 12 bp, Homo sapiens
caaaccttcctg

SEQ ID NO: 5285626 - DNA, 13 bp, Homo sapiens
caaaccttcctgg

SEQ ID NO: 5285627 - DNA, 19 bp, Homo sapiens
caaaccttcctgggaggac

SEQ ID NO: 5285628 - DNA, 17 bp, Homo sapiens
caaaccttcttttcaat

SEQ ID NO: 5285629 - DNA, 16 bp, Homo sapiens
caaaccttgatgtgcc

SEQ ID NO: 5285630 - DNA, 14 bp, Homo sapiens
caaaccttgggccc

SEQ ID NO: 5285631 - DNA, 20 bp, Homo sapiens
caaacctttattttagaatt

SEQ ID NO: 5285632 - DNA, 13 bp, Homo sapiens
caaacctttcccc

SEQ ID NO: 5285633 - DNA, 17 bp, Homo sapiens
caaacctttctggcctg

SEQ ID NO: 5285634 - DNA, 15 bp, Homo sapiens
caaacctttgagtag

SEQ ID NO: 5285635 - DNA, 22 bp, Homo sapiens
caaacgatgtgcaatacatttt

SEQ ID NO: 5285636 - DNA, 19 bp, Homo sapiens
caaacgcattaagaggttt

SEQ ID NO: 5285637 - DNA, 23 bp, Homo sapiens
caaacgccctttcctcctcaggc

SEQ ID NO: 5285638 - DNA, 14 bp, Homo sapiens
caaacgcctcccct

SEQ ID NO: 5285639 - DNA, 21 bp, Homo sapiens
caaacgctaaagagcccttgc

SEQ ID NO: 5285640 - DNA, 20 bp, Homo sapiens
caaacgctgagccacctgcc

SEQ ID NO: 5285641 - DNA, 13 bp, Homo sapiens
caaacgctgcctg

SEQ ID NO: 5285642 - DNA, 15 bp, Homo sapiens
caaacgctgcctgcc

SEQ ID NO: 5285643 - DNA, 16 bp, Homo sapiens
caaacgctgcctgccc

SEQ ID NO: 5285644 - DNA, 15 bp, Homo sapiens
caaacggagcccctg

SEQ ID NO: 5285645 - DNA, 22 bp, Homo sapiens
caaacggagcccctgaaagcct

SEQ ID NO: 5285646 - DNA, 21 bp, Homo sapiens
caaacggcaacgtagcctggg

SEQ ID NO: 5285647 - DNA, 16 bp, Homo sapiens
caaacgggagcttttg

SEQ ID NO: 5285648 - DNA, 23 bp, Homo sapiens
caaacggtgcaacagaagggtag

SEQ ID NO: 5285649 - DNA, 14 bp, Homo sapiens
caaacgtatgtaaa

SEQ ID NO: 5285650 - DNA, 16 bp, Homo sapiens
caaacgtgccccccag

SEQ ID NO: 5285651 - DNA, 15 bp, Homo sapiens
caaacgtgtttttta

SEQ ID NO: 5285652 - DNA, 22 bp, Homo sapiens
caaacgttggagtttgggctgg

SEQ ID NO: 5285653 - DNA, 21 bp, Homo sapiens
caaacgtttctcaaatctgct

SEQ ID NO: 5285654 - DNA, 16 bp, Homo sapiens
caaactaaattcaaag

SEQ ID NO: 5285655 - DNA, 20 bp, Homo sapiens
caaactaacaggcttagtga

SEQ ID NO: 5285656 - DNA, 21 bp, Homo sapiens
caaactaactaataaaatata

SEQ ID NO: 5285657 - DNA, 16 bp, Homo sapiens
caaactaaggagtgac

SEQ ID NO: 5285658 - DNA, 20 bp, Homo sapiens
caaactaaggtgctaaatct

SEQ ID NO: 5285659 - DNA, 22 bp, Homo sapiens
caaactacagacctgctttttg

SEQ ID NO: 5285660 - DNA, 18 bp, Homo sapiens
caaactacctatattcct

SEQ ID NO: 5285661 - DNA, 19 bp, Homo sapiens
caaactacctatattcctt

SEQ ID NO: 5285662 - DNA, 14 bp, Homo sapiens
caaactacctctgg

SEQ ID NO: 5285663 - DNA, 23 bp, Homo sapiens
caaactacgcgatagtctctgtt

SEQ ID NO: 5285664 - DNA, 16 bp, Homo sapiens
caaactactgaatgaa

SEQ ID NO: 5285665 - DNA, 22 bp, Homo sapiens
caaactactgaatgaagcagta

SEQ ID NO: 5285666 - DNA, 16 bp, Homo sapiens
caaactacttcatttt

SEQ ID NO: 5285667 - DNA, 21 bp, Homo sapiens
caaactaggaggaaaagacag

SEQ ID NO: 5285668 - DNA, 13 bp, Homo sapiens
caaactagggcca

SEQ ID NO: 5285669 - DNA, 20 bp, Homo sapiens
caaactatattttaataatt

SEQ ID NO: 5285670 - DNA, 17 bp, Homo sapiens
caaactatggtgtgctt

SEQ ID NO: 5285671 - DNA, 14 bp, Homo sapiens
caaactatttctta

SEQ ID NO: 5285672 - DNA, 18 bp, Homo sapiens
caaactatttcttatata

SEQ ID NO: 5285673 - DNA, 21 bp, Homo sapiens
caaactcaatgctttatttgt

SEQ ID NO: 5285674 - DNA, 19 bp, Homo sapiens
caaactcactgctcaagaa

SEQ ID NO: 5285675 - DNA, 15 bp, Homo sapiens
caaactcagatcctt

SEQ ID NO: 5285676 - DNA, 14 bp, Homo sapiens
caaactcagcctca

SEQ ID NO: 5285677 - DNA, 16 bp, Homo sapiens
caaactcagttccaaa

SEQ ID NO: 5285678 - DNA, 14 bp, Homo sapiens
caaactcagttcga

SEQ ID NO: 5285679 - DNA, 14 bp, Homo sapiens
caaactcatccatt

SEQ ID NO: 5285680 - DNA, 16 bp, Homo sapiens
caaactcatccattaa

SEQ ID NO: 5285681 - DNA, 13 bp, Homo sapiens
caaactcatcttg

SEQ ID NO: 5285682 - DNA, 13 bp, Homo sapiens
caaactccaggct

SEQ ID NO: 5285683 - DNA, 14 bp, Homo sapiens
caaactccccttcc

SEQ ID NO: 5285684 - DNA, 16 bp, Homo sapiens
caaactccccttccct

SEQ ID NO: 5285685 - DNA, 16 bp, Homo sapiens
caaactcgtctgatgt

SEQ ID NO: 5285686 - DNA, 17 bp, Homo sapiens
caaactctataaagaaa

SEQ ID NO: 5285687 - DNA, 19 bp, Homo sapiens
caaactctataaagaaact

SEQ ID NO: 5285688 - DNA, 23 bp, Homo sapiens
caaactctctagtgcaggaaaag

SEQ ID NO: 5285689 - DNA, 14 bp, Homo sapiens
caaactctctgaac

SEQ ID NO: 5285690 - DNA, 18 bp, Homo sapiens
caaactctgctgtctaac

SEQ ID NO: 5285691 - DNA, 14 bp, Homo sapiens
caaactctgtgtca

SEQ ID NO: 5285692 - DNA, 16 bp, Homo sapiens
caaactcttaattaga

SEQ ID NO: 5285693 - DNA, 19 bp, Homo sapiens
caaactctttggtcgtttt

SEQ ID NO: 5285694 - DNA, 12 bp, Homo sapiens
caaactgaaaaa

SEQ ID NO: 5285695 - DNA, 15 bp, Homo sapiens
caaactgaagccaga

SEQ ID NO: 5285696 - DNA, 17 bp, Homo sapiens
caaactgaggaatttca

SEQ ID NO: 5285697 - DNA, 21 bp, Homo sapiens
caaactgagtaaattggaaac

SEQ ID NO: 5285698 - DNA, 20 bp, Homo sapiens
caaactgatgcgaaaacttg

SEQ ID NO: 5285699 - DNA, 17 bp, Homo sapiens
caaactgatgctgagga

SEQ ID NO: 5285700 - DNA, 23 bp, Homo sapiens
caaactgatggaccgggtgggcc

SEQ ID NO: 5285701 - DNA, 23 bp, Homo sapiens
caaactgattaaatatttgaaga

SEQ ID NO: 5285702 - DNA, 11 bp, Homo sapiens
caaactgcaat

SEQ ID NO: 5285703 - DNA, 18 bp, Homo sapiens
caaactgcacacacagct

SEQ ID NO: 5285704 - DNA, 21 bp, Homo sapiens
caaactgcacacacagctcct

SEQ ID NO: 5285705 - DNA, 14 bp, Homo sapiens
caaactgcacatct

SEQ ID NO: 5285706 - DNA, 15 bp, Homo sapiens
caaactgcacatcta

SEQ ID NO: 5285707 - DNA, 14 bp, Homo sapiens
caaactgcacatga

SEQ ID NO: 5285708 - DNA, 15 bp, Homo sapiens
caaactgcactttta

SEQ ID NO: 5285709 - DNA, 15 bp, Homo sapiens
caaactgcagctgtg

SEQ ID NO: 5285710 - DNA, 18 bp, Homo sapiens
caaactgcagctgtgagt

SEQ ID NO: 5285711 - DNA, 19 bp, Homo sapiens
caaactgcatgcccagaga

SEQ ID NO: 5285712 - DNA, 23 bp, Homo sapiens
caaactgcctaagccctccgcca

SEQ ID NO: 5285713 - DNA, 16 bp, Homo sapiens
caaactgcctcaatcc

SEQ ID NO: 5285714 - DNA, 18 bp, Homo sapiens
caaactgcggtatacatt

SEQ ID NO: 5285715 - DNA, 13 bp, Homo sapiens
caaactgctgcat

SEQ ID NO: 5285716 - DNA, 22 bp, Homo sapiens
caaactgctggacgtctttctt

SEQ ID NO: 5285717 - DNA, 16 bp, Homo sapiens
caaactgctgtctctt

SEQ ID NO: 5285718 - DNA, 15 bp, Homo sapiens
caaactgctttattt

SEQ ID NO: 5285719 - DNA, 18 bp, Homo sapiens
caaactgctttattttcc

SEQ ID NO: 5285720 - DNA, 16 bp, Homo sapiens
caaactggagtctgga

SEQ ID NO: 5285721 - DNA, 17 bp, Homo sapiens
caaactggagtctggag

SEQ ID NO: 5285722 - DNA, 20 bp, Homo sapiens
caaactggagtctggagtgg

SEQ ID NO: 5285723 - DNA, 17 bp, Homo sapiens
caaactggcaaacttca

SEQ ID NO: 5285724 - DNA, 22 bp, Homo sapiens
caaactgggaacccctttccca

SEQ ID NO: 5285725 - DNA, 15 bp, Homo sapiens
caaactggggcctcc

SEQ ID NO: 5285726 - DNA, 19 bp, Homo sapiens
caaactggggcctccagaa

SEQ ID NO: 5285727 - DNA, 18 bp, Homo sapiens
attgcttgagctcaggag

SEQ ID NO: 5285728 - DNA, 14 bp, Homo sapiens
attgcttgggtctc

SEQ ID NO: 5285729 - DNA, 18 bp, Homo sapiens
attgcttgggtctctctc

SEQ ID NO: 5285730 - DNA, 21 bp, Homo sapiens
attgctttaatttgatgggaa

SEQ ID NO: 5285731 - DNA, 12 bp, Homo sapiens
attgctttcctg

SEQ ID NO: 5285732 - DNA, 23 bp, Homo sapiens
attgctttcctgcctccttgaaa

SEQ ID NO: 5285733 - DNA, 15 bp, Homo sapiens
attgctttctgaaat

SEQ ID NO: 5285734 - DNA, 14 bp, Homo sapiens
attgctttctttca

SEQ ID NO: 5285735 - DNA, 10 bp, Homo sapiens
attgctttga

SEQ ID NO: 5285736 - DNA, 23 bp, Homo sapiens
attgctttgaagcagttgtgtca

SEQ ID NO: 5285737 - DNA, 12 bp, Homo sapiens
attgctttgagc

SEQ ID NO: 5285738 - DNA, 21 bp, Homo sapiens
attgctttgctgcacagcagg

SEQ ID NO: 5285739 - DNA, 22 bp, Homo sapiens
attgctttgctgcacagcagga

SEQ ID NO: 5285740 - DNA, 20 bp, Homo sapiens
attgctttgtgacttcttct

SEQ ID NO: 5285741 - DNA, 22 bp, Homo sapiens
attgctttgtgacttcttcttc

SEQ ID NO: 5285742 - DNA, 22 bp, Homo sapiens
attgctttgtggttatcacttt

SEQ ID NO: 5285743 - DNA, 12 bp, Homo sapiens
attgcttttaaa

SEQ ID NO: 5285744 - DNA, 13 bp, Homo sapiens
attgcttttaaaa

SEQ ID NO: 5285745 - DNA, 16 bp, Homo sapiens
attgcttttaaaattt

SEQ ID NO: 5285746 - DNA, 17 bp, Homo sapiens
attgcttttaaaatttt

SEQ ID NO: 5285747 - DNA, 13 bp, Homo sapiens
attgcttttatta

SEQ ID NO: 5285748 - DNA, 19 bp, Homo sapiens
attgcttttggacaaggaa

SEQ ID NO: 5285749 - DNA, 21 bp, Homo sapiens
attgcttttgttgtgactttt

SEQ ID NO: 5285750 - DNA, 16 bp, Homo sapiens
attgcttttttaaata

SEQ ID NO: 5285751 - DNA, 17 bp, Homo sapiens
attgcttttttaaatat

SEQ ID NO: 5285752 - DNA, 23 bp, Homo sapiens
attgcttttttccaaaacaaaaa

SEQ ID NO: 5285753 - DNA, 19 bp, Homo sapiens
attggaaaataataaaaga

SEQ ID NO: 5285754 - DNA, 13 bp, Homo sapiens
attggaaacaagt

SEQ ID NO: 5285755 - DNA, 13 bp, Homo sapiens
attggaaagacag

SEQ ID NO: 5285756 - DNA, 14 bp, Homo sapiens
attggaaaggactt

SEQ ID NO: 5285757 - DNA, 15 bp, Homo sapiens
attggaaagtgattt

SEQ ID NO: 5285758 - DNA, 12 bp, Homo sapiens
attggaaatgga

SEQ ID NO: 5285759 - DNA, 23 bp, Homo sapiens
attggaaatggatgcaaagtaca

SEQ ID NO: 5285760 - DNA, 15 bp, Homo sapiens
attggaaatgtactt

SEQ ID NO: 5285761 - DNA, 13 bp, Homo sapiens
attggaaatttca

SEQ ID NO: 5285762 - DNA, 22 bp, Homo sapiens
attggaactctactcaacccat

SEQ ID NO: 5285763 - DNA, 16 bp, Homo sapiens
attggaactgcaatga

SEQ ID NO: 5285764 - DNA, 14 bp, Homo sapiens
attggaactggagg

SEQ ID NO: 5285765 - DNA, 18 bp, Homo sapiens
attggaagaaattcctgt

SEQ ID NO: 5285766 - DNA, 19 bp, Homo sapiens
attggaagaaattcctgta

SEQ ID NO: 5285767 - DNA, 20 bp, Homo sapiens
attggaagaagaaccaggca

SEQ ID NO: 5285768 - DNA, 16 bp, Homo sapiens
attggaagaccccacc

SEQ ID NO: 5285769 - DNA, 22 bp, Homo sapiens
attggaagagcagcacctcctc

SEQ ID NO: 5285770 - DNA, 14 bp, Homo sapiens
attggaagagcccg

SEQ ID NO: 5285771 - DNA, 20 bp, Homo sapiens
attggaagcaggttaaatgt

SEQ ID NO: 5285772 - DNA, 14 bp, Homo sapiens
attggaagctccca

SEQ ID NO: 5285773 - DNA, 15 bp, Homo sapiens
attggaagctcccac

SEQ ID NO: 5285774 - DNA, 21 bp, Homo sapiens
attggaaggagacacagatgt

SEQ ID NO: 5285775 - DNA, 22 bp, Homo sapiens
attggaaggagacacagatgtt

SEQ ID NO: 5285776 - DNA, 21 bp, Homo sapiens
attggaagtgttcaagaaata

SEQ ID NO: 5285777 - DNA, 14 bp, Homo sapiens
attggaatctgata

SEQ ID NO: 5285778 - DNA, 19 bp, Homo sapiens
attggaatggaactactgt

SEQ ID NO: 5285779 - DNA, 20 bp, Homo sapiens
attggaatgtgttgtaagtt

SEQ ID NO: 5285780 - DNA, 16 bp, Homo sapiens
attggaattaacctgg

SEQ ID NO: 5285781 - DNA, 20 bp, Homo sapiens
attggaattaacctggtgct

SEQ ID NO: 5285782 - DNA, 17 bp, Homo sapiens
attggaatttaaaaata

SEQ ID NO: 5285783 - DNA, 15 bp, Homo sapiens
attggacagacacag

SEQ ID NO: 5285784 - DNA, 17 bp, Homo sapiens
attggacagatttcagt

SEQ ID NO: 5285785 - DNA, 19 bp, Homo sapiens
attggacagtaaaatccac

SEQ ID NO: 5285786 - DNA, 15 bp, Homo sapiens
attggacagttttga

SEQ ID NO: 5285787 - DNA, 22 bp, Homo sapiens
attggacattaagcatcacaaa

SEQ ID NO: 5285788 - DNA, 17 bp, Homo sapiens
attggacattttcttca

SEQ ID NO: 5285789 - DNA, 15 bp, Homo sapiens
attggacccttccat

SEQ ID NO: 5285790 - DNA, 20 bp, Homo sapiens
attggacgcattttggtttt

SEQ ID NO: 5285791 - DNA, 18 bp, Homo sapiens
attggacggtttctagcc

SEQ ID NO: 5285792 - DNA, 23 bp, Homo sapiens
attggacttccatttggaatcat

SEQ ID NO: 5285793 - DNA, 19 bp, Homo sapiens
attggacttccttggtttg

SEQ ID NO: 5285794 - DNA, 16 bp, Homo sapiens
attggagaaaagcaca

SEQ ID NO: 5285795 - DNA, 21 bp, Homo sapiens
attggagaatactttgcttca

SEQ ID NO: 5285796 - DNA, 15 bp, Homo sapiens
attggagagaaaaaa

SEQ ID NO: 5285797 - DNA, 20 bp, Homo sapiens
attggagagaaaaaattaac

SEQ ID NO: 5285798 - DNA, 20 bp, Homo sapiens
attggagatgccatcctctt

SEQ ID NO: 5285799 - DNA, 15 bp, Homo sapiens
attggagcacctggg

SEQ ID NO: 5285800 - DNA, 16 bp, Homo sapiens
attggagctcgtggaa

SEQ ID NO: 5285801 - DNA, 20 bp, Homo sapiens
attggagctgactgttcttg

SEQ ID NO: 5285802 - DNA, 15 bp, Homo sapiens
attggaggaaagcaa

SEQ ID NO: 5285803 - DNA, 14 bp, Homo sapiens
attggaggctgcag

SEQ ID NO: 5285804 - DNA, 22 bp, Homo sapiens
attggagggtgggagagcccag

SEQ ID NO: 5285805 - DNA, 18 bp, Homo sapiens
attggagtgcagctaaca

SEQ ID NO: 5285806 - DNA, 21 bp, Homo sapiens
attggagttggagtagaatgt

SEQ ID NO: 5285807 - DNA, 22 bp, Homo sapiens
attggatacaaggatcagaatg

SEQ ID NO: 5285808 - DNA, 23 bp, Homo sapiens
attggataccccattaaatctga

SEQ ID NO: 5285809 - DNA, 16 bp, Homo sapiens
attggatcaagtatta

SEQ ID NO: 5285810 - DNA, 20 bp, Homo sapiens
attggatgattgttcataat

SEQ ID NO: 5285811 - DNA, 21 bp, Homo sapiens
attggatgattgttcataata

SEQ ID NO: 5285812 - DNA, 14 bp, Homo sapiens
attggattatttaa

SEQ ID NO: 5285813 - DNA, 22 bp, Homo sapiens
attggattatttaataacatta

SEQ ID NO: 5285814 - DNA, 21 bp, Homo sapiens
attggattgcgcctttgtatt

SEQ ID NO: 5285815 - DNA, 14 bp, Homo sapiens
attggatttcctaa

SEQ ID NO: 5285816 - DNA, 21 bp, Homo sapiens
attggatttgtccaaacaggt

SEQ ID NO: 5285817 - DNA, 13 bp, Homo sapiens
attggattttatg

SEQ ID NO: 5285818 - DNA, 18 bp, Homo sapiens
attggattttatgttgac

SEQ ID NO: 5285819 - DNA, 16 bp, Homo sapiens
attggatttttttaaa

SEQ ID NO: 5285820 - DNA, 21 bp, Homo sapiens
attggcaaagtgacaaagcaa

SEQ ID NO: 5285821 - DNA, 20 bp, Homo sapiens
attggcaatgggccgtcccc

SEQ ID NO: 5285822 - DNA, 18 bp, Homo sapiens
attggcacagtgcttaca

SEQ ID NO: 5285823 - DNA, 18 bp, Homo sapiens
attggcacccctttctag

SEQ ID NO: 5285824 - DNA, 19 bp, Homo sapiens
attggcaccgaagcccaga

SEQ ID NO: 5285825 - DNA, 20 bp, Homo sapiens
attggcacctaatccaggca

SEQ ID NO: 5285826 - DNA, 22 bp, Homo sapiens
attggcactgctaaaatagaat

SEQ ID NO: 5285827 - DNA, 21 bp, Homo sapiens
attggcagcacagctactcag

SEQ ID NO: 5285828 - DNA, 15 bp, Homo sapiens
attggcagcagattt

SEQ ID NO: 5285829 - DNA, 22 bp, Homo sapiens
attggcagcaggtgctgctacc

SEQ ID NO: 5285830 - DNA, 16 bp, Homo sapiens
attggcagccaaggaa

SEQ ID NO: 5285831 - DNA, 19 bp, Homo sapiens
attggcagccaaggaatgt

SEQ ID NO: 5285832 - DNA, 20 bp, Homo sapiens
attggcagccaaggaatgtg

SEQ ID NO: 5285833 - DNA, 23 bp, Homo sapiens
attggcagccaaggaatgtgtcc

SEQ ID NO: 5285834 - DNA, 20 bp, Homo sapiens
attggcagcttcaaaacaga

SEQ ID NO: 5285835 - DNA, 15 bp, Homo sapiens
attggcagtgacttt

SEQ ID NO: 5285836 - DNA, 17 bp, Homo sapiens
attggcagtgactttgt

SEQ ID NO: 5285837 - DNA, 17 bp, Homo sapiens
attggcagtggcagaga

SEQ ID NO: 5285838 - DNA, 17 bp, Homo sapiens
attggcagtgtgtcaca

SEQ ID NO: 5285839 - DNA, 23 bp, Homo sapiens
attggcatctctccccatatata

SEQ ID NO: 5285840 - DNA, 15 bp, Homo sapiens
attggcatggatttc

SEQ ID NO: 5285841 - DNA, 23 bp, Homo sapiens
attggcatggctttatttgtttt

SEQ ID NO: 5285842 - DNA, 12 bp, Homo sapiens
attggcatttta

SEQ ID NO: 5285843 - DNA, 18 bp, Homo sapiens
attggccacctgtagcca

SEQ ID NO: 5285844 - DNA, 23 bp, Homo sapiens
attggccacctgtagccatctgc

SEQ ID NO: 5285845 - DNA, 20 bp, Homo sapiens
attggccactgggtctcact

SEQ ID NO: 5285846 - DNA, 19 bp, Homo sapiens
attggccagaccacagcag

SEQ ID NO: 5285847 - DNA, 14 bp, Homo sapiens
attggccagcaaaa

SEQ ID NO: 5285848 - DNA, 19 bp, Homo sapiens
attggccagtgagaagctg

SEQ ID NO: 5285849 - DNA, 12 bp, Homo sapiens
attggccctgcc

SEQ ID NO: 5285850 - DNA, 15 bp, Homo sapiens
attggccgagctcct

SEQ ID NO: 5285851 - DNA, 18 bp, Homo sapiens
attggccgatgagctggt

SEQ ID NO: 5285852 - DNA, 19 bp, Homo sapiens
attggccgatgagctggtt

SEQ ID NO: 5285853 - DNA, 21 bp, Homo sapiens
attggcctgaacagatgtaaa

SEQ ID NO: 5285854 - DNA, 12 bp, Homo sapiens
attggcctggcc

SEQ ID NO: 5285855 - DNA, 13 bp, Homo sapiens
attggcctggcct

SEQ ID NO: 5285856 - DNA, 12 bp, Homo sapiens
attggcctgtag

SEQ ID NO: 5285857 - DNA, 23 bp, Homo sapiens
attggcctgtagagttgctgaga

SEQ ID NO: 5285858 - DNA, 20 bp, Homo sapiens
attggcctgtgtctggcccc

SEQ ID NO: 5285859 - DNA, 21 bp, Homo sapiens
attggccttcgattttaaata

SEQ ID NO: 5285860 - DNA, 22 bp, Homo sapiens
attggccttcgattttaaatat

SEQ ID NO: 5285861 - DNA, 22 bp, Homo sapiens
attggctacaatcttggagctg

SEQ ID NO: 5285862 - DNA, 22 bp, Homo sapiens
attggctagaggttcaaagata

SEQ ID NO: 5285863 - DNA, 16 bp, Homo sapiens
attggctatatggaat

SEQ ID NO: 5285864 - DNA, 19 bp, Homo sapiens
attggctatgatggtgaca

SEQ ID NO: 5285865 - DNA, 13 bp, Homo sapiens
attggctcacact

SEQ ID NO: 5285866 - DNA, 20 bp, Homo sapiens
attggctccatatcatttga

SEQ ID NO: 5285867 - DNA, 19 bp, Homo sapiens
attggctcccatctgaacc

SEQ ID NO: 5285868 - DNA, 14 bp, Homo sapiens
attggctcctttcc

SEQ ID NO: 5285869 - DNA, 17 bp, Homo sapiens
attggctcctttcccac

SEQ ID NO: 5285870 - DNA, 20 bp, Homo sapiens
attggctcctttcccacagt

SEQ ID NO: 5285871 - DNA, 21 bp, Homo sapiens
attggctcctttcccacagtc

SEQ ID NO: 5285872 - DNA, 23 bp, Homo sapiens
attggctgatctatgcctttcaa

SEQ ID NO: 5285873 - DNA, 15 bp, Homo sapiens
attggctgcaggaag

SEQ ID NO: 5285874 - DNA, 16 bp, Homo sapiens
attggctgcaggaaga

SEQ ID NO: 5285875 - DNA, 19 bp, Homo sapiens
attggctgcaggaagaaac

SEQ ID NO: 5285876 - DNA, 22 bp, Homo sapiens
attggctgcaggaagaaacttt

SEQ ID NO: 5285877 - DNA, 19 bp, Homo sapiens
attggctggttaatgggaa

SEQ ID NO: 5285878 - DNA, 17 bp, Homo sapiens
attggcttaaagtgaag

SEQ ID NO: 5285879 - DNA, 20 bp, Homo sapiens
attggcttaaagtgaaggaa

SEQ ID NO: 5285880 - DNA, 20 bp, Homo sapiens
attggcttgataaacataat

SEQ ID NO: 5285881 - DNA, 18 bp, Homo sapiens
attggcttgtagaattgt

SEQ ID NO: 5285882 - DNA, 14 bp, Homo sapiens
attggctttatcct

SEQ ID NO: 5285883 - DNA, 13 bp, Homo sapiens
attggctttgcag

SEQ ID NO: 5285884 - DNA, 15 bp, Homo sapiens
attggcttttctgat

SEQ ID NO: 5285885 - DNA, 20 bp, Homo sapiens
attggcttttctgatccagt

SEQ ID NO: 5285886 - DNA, 22 bp, Homo sapiens
attggctttttaaattttccat

SEQ ID NO: 5285887 - DNA, 14 bp, Homo sapiens
attgggaagctgta

SEQ ID NO: 5285888 - DNA, 15 bp, Homo sapiens
attgggaataaatat

SEQ ID NO: 5285889 - DNA, 20 bp, Homo sapiens
attgggaataaatatgcctc

SEQ ID NO: 5285890 - DNA, 20 bp, Homo sapiens
attgggacagcatgactgtg

SEQ ID NO: 5285891 - DNA, 19 bp, Homo sapiens
attgggacgcacagtgcag

SEQ ID NO: 5285892 - DNA, 14 bp, Homo sapiens
attgggactctgtt

SEQ ID NO: 5285893 - DNA, 15 bp, Homo sapiens
attgggagacaatta

SEQ ID NO: 5285894 - DNA, 18 bp, Homo sapiens
attgggagacaattagca

SEQ ID NO: 5285895 - DNA, 19 bp, Homo sapiens
attgggagggacagggctt

SEQ ID NO: 5285896 - DNA, 21 bp, Homo sapiens
attgggagggacagggcttgg

SEQ ID NO: 5285897 - DNA, 14 bp, Homo sapiens
attgggagggatga

SEQ ID NO: 5285898 - DNA, 15 bp, Homo sapiens
attgggagggatgag

SEQ ID NO: 5285899 - DNA, 14 bp, Homo sapiens
attgggatctgtct

SEQ ID NO: 5285900 - DNA, 17 bp, Homo sapiens
attgggatgtgagcccc

SEQ ID NO: 5285901 - DNA, 15 bp, Homo sapiens
attgggattttaaaa

SEQ ID NO: 5285902 - DNA, 16 bp, Homo sapiens
attgggattttctaca

SEQ ID NO: 5285903 - DNA, 17 bp, Homo sapiens
attgggcaagtgattga

SEQ ID NO: 5285904 - DNA, 21 bp, Homo sapiens
caaactggggcctccagaact

SEQ ID NO: 5285905 - DNA, 18 bp, Homo sapiens
caaactgggtcttcagct

SEQ ID NO: 5285906 - DNA, 21 bp, Homo sapiens
caaactgggtcttcagcttta

SEQ ID NO: 5285907 - DNA, 17 bp, Homo sapiens
caaactggttcacctga

SEQ ID NO: 5285908 - DNA, 21 bp, Homo sapiens
caaactgtaaaaaatgtgtgt

SEQ ID NO: 5285909 - DNA, 18 bp, Homo sapiens
caaactgtaaaaataaca

SEQ ID NO: 5285910 - DNA, 17 bp, Homo sapiens
caaactgtagatgaaga

SEQ ID NO: 5285911 - DNA, 13 bp, Homo sapiens
caaactgtccctc

SEQ ID NO: 5285912 - DNA, 20 bp, Homo sapiens
caaactgtccctcccttgct

SEQ ID NO: 5285913 - DNA, 23 bp, Homo sapiens
caaactgtcgtgcaaacccagtg

SEQ ID NO: 5285914 - DNA, 22 bp, Homo sapiens
caaactgtctctgcctcttccc

SEQ ID NO: 5285915 - DNA, 20 bp, Homo sapiens
caaactgtgaaaatagtgta

SEQ ID NO: 5285916 - DNA, 20 bp, Homo sapiens
caaactgtgccctgccttca

SEQ ID NO: 5285917 - DNA, 15 bp, Homo sapiens
caaactgtgcttctc

SEQ ID NO: 5285918 - DNA, 16 bp, Homo sapiens
caaactgttaaatgtg

SEQ ID NO: 5285919 - DNA, 20 bp, Homo sapiens
caaactgttcaagaaataat

SEQ ID NO: 5285920 - DNA, 12 bp, Homo sapiens
caaactgttctg

SEQ ID NO: 5285921 - DNA, 13 bp, Homo sapiens
caaactgttgatt

SEQ ID NO: 5285922 - DNA, 18 bp, Homo sapiens
caaacttactattttgac

SEQ ID NO: 5285923 - DNA, 14 bp, Homo sapiens
caaacttactgtca

SEQ ID NO: 5285924 - DNA, 21 bp, Homo sapiens
caaacttagtttttatctttg

SEQ ID NO: 5285925 - DNA, 22 bp, Homo sapiens
caaacttagtttttatctttga

SEQ ID NO: 5285926 - DNA, 13 bp, Homo sapiens
caaacttcagaaa

SEQ ID NO: 5285927 - DNA, 20 bp, Homo sapiens
caaacttcagaaacccggct

SEQ ID NO: 5285928 - DNA, 22 bp, Homo sapiens
caaacttcattttttaaaaaat

SEQ ID NO: 5285929 - DNA, 20 bp, Homo sapiens
caaacttctcgcaactgaag

SEQ ID NO: 5285930 - DNA, 22 bp, Homo sapiens
caaacttctgaactttggaagc

SEQ ID NO: 5285931 - DNA, 16 bp, Homo sapiens
caaacttcttgttcaa

SEQ ID NO: 5285932 - DNA, 18 bp, Homo sapiens
caaacttggatacttgga

SEQ ID NO: 5285933 - DNA, 19 bp, Homo sapiens
caaacttgtatctgaagac

SEQ ID NO: 5285934 - DNA, 15 bp, Homo sapiens
caaacttgtgctgag

SEQ ID NO: 5285935 - DNA, 16 bp, Homo sapiens
caaacttgtggcctca

SEQ ID NO: 5285936 - DNA, 13 bp, Homo sapiens
caaacttgttcat

SEQ ID NO: 5285937 - DNA, 14 bp, Homo sapiens
caaacttgttcatt

SEQ ID NO: 5285938 - DNA, 12 bp, Homo sapiens
caaactttaaaa

SEQ ID NO: 5285939 - DNA, 14 bp, Homo sapiens
caaactttaaaatg

SEQ ID NO: 5285940 - DNA, 16 bp, Homo sapiens
caaacttttaagattt

SEQ ID NO: 5285941 - DNA, 14 bp, Homo sapiens
caaacttttataaa

SEQ ID NO: 5285942 - DNA, 18 bp, Homo sapiens
caaacttttataaatgtt

SEQ ID NO: 5285943 - DNA, 21 bp, Homo sapiens
caaacttttataaatgtttta

SEQ ID NO: 5285944 - DNA, 19 bp, Homo sapiens
caaacttttcaaggcttat

SEQ ID NO: 5285945 - DNA, 16 bp, Homo sapiens
caaactttttccagca

SEQ ID NO: 5285946 - DNA, 17 bp, Homo sapiens
caaagaaaaaaatatat

SEQ ID NO: 5285947 - DNA, 19 bp, Homo sapiens
caaagaaaaattaattagg

SEQ ID NO: 5285948 - DNA, 14 bp, Homo sapiens
caaagaaaacatag

SEQ ID NO: 5285949 - DNA, 23 bp, Homo sapiens
caaagaaaagacttttgttgaaa

SEQ ID NO: 5285950 - DNA, 13 bp, Homo sapiens
caaagaaaagtat

SEQ ID NO: 5285951 - DNA, 12 bp, Homo sapiens
caaagaaaatga

SEQ ID NO: 5285952 - DNA, 18 bp, Homo sapiens
caaagaaaatgaaatgca

SEQ ID NO: 5285953 - DNA, 13 bp, Homo sapiens
caaagaaaattcc

SEQ ID NO: 5285954 - DNA, 18 bp, Homo sapiens
caaagaaacaaaatataa

SEQ ID NO: 5285955 - DNA, 17 bp, Homo sapiens
caaagaaacaaagatgt

SEQ ID NO: 5285956 - DNA, 17 bp, Homo sapiens
caaagaaacaaagcaaa

SEQ ID NO: 5285957 - DNA, 13 bp, Homo sapiens
caaagaaacaagc

SEQ ID NO: 5285958 - DNA, 18 bp, Homo sapiens
caaagaaacaagctgtgc

SEQ ID NO: 5285959 - DNA, 16 bp, Homo sapiens
caaagaaacattttac

SEQ ID NO: 5285960 - DNA, 12 bp, Homo sapiens
caaagaaagact

SEQ ID NO: 5285961 - DNA, 13 bp, Homo sapiens
caaagaaagtgta

SEQ ID NO: 5285962 - DNA, 17 bp, Homo sapiens
caaagaaataacccaga

SEQ ID NO: 5285963 - DNA, 14 bp, Homo sapiens
caaagaaatattaa

SEQ ID NO: 5285964 - DNA, 20 bp, Homo sapiens
caaagaaatccggagaagct

SEQ ID NO: 5285965 - DNA, 13 bp, Homo sapiens
caaagaaatgaac

SEQ ID NO: 5285966 - DNA, 16 bp, Homo sapiens
caaagaaatgaacatt

SEQ ID NO: 5285967 - DNA, 15 bp, Homo sapiens
caaagaaatgggcct

SEQ ID NO: 5285968 - DNA, 18 bp, Homo sapiens
caaagaaatgggcctgcc

SEQ ID NO: 5285969 - DNA, 14 bp, Homo sapiens
caaagaaatgtaag

SEQ ID NO: 5285970 - DNA, 18 bp, Homo sapiens
caaagaaatttccactca

SEQ ID NO: 5285971 - DNA, 19 bp, Homo sapiens
caaagaaatttccactcag

SEQ ID NO: 5285972 - DNA, 11 bp, Homo sapiens
caaagaacagt

SEQ ID NO: 5285973 - DNA, 22 bp, Homo sapiens
caaagaacatgtagaaaacaaa

SEQ ID NO: 5285974 - DNA, 14 bp, Homo sapiens
caaagaaccaaaga

SEQ ID NO: 5285975 - DNA, 15 bp, Homo sapiens
caaagaaccaggagg

SEQ ID NO: 5285976 - DNA, 16 bp, Homo sapiens
caaagaacccccctcc

SEQ ID NO: 5285977 - DNA, 17 bp, Homo sapiens
caaagaaccttgaagaa

SEQ ID NO: 5285978 - DNA, 19 bp, Homo sapiens
caaagaacggcatgtgaat

SEQ ID NO: 5285979 - DNA, 22 bp, Homo sapiens
caaagaactcatttgaatgctt

SEQ ID NO: 5285980 - DNA, 12 bp, Homo sapiens
caaagaactcct

SEQ ID NO: 5285981 - DNA, 20 bp, Homo sapiens
caaagaactgccccatctcc

SEQ ID NO: 5285982 - DNA, 11 bp, Homo sapiens
caaagaagaaa

SEQ ID NO: 5285983 - DNA, 14 bp, Homo sapiens
caaagaagaaagct

SEQ ID NO: 5285984 - DNA, 16 bp, Homo sapiens
caaagaagaaccatct

SEQ ID NO: 5285985 - DNA, 13 bp, Homo sapiens
caaagaagacatg

SEQ ID NO: 5285986 - DNA, 16 bp, Homo sapiens
caaagaagacatgttt

SEQ ID NO: 5285987 - DNA, 13 bp, Homo sapiens
caaagaagatagc

SEQ ID NO: 5285988 - DNA, 15 bp, Homo sapiens
caaagaagatagctc

SEQ ID NO: 5285989 - DNA, 21 bp, Homo sapiens
caaagaagattcttaccaaga

SEQ ID NO: 5285990 - DNA, 11 bp, Homo sapiens
caaagaagctt

SEQ ID NO: 5285991 - DNA, 20 bp, Homo sapiens
caaagaagcttccacaaaat

SEQ ID NO: 5285992 - DNA, 13 bp, Homo sapiens
caaagaaggaaaa

SEQ ID NO: 5285993 - DNA, 19 bp, Homo sapiens
caaagaaggaaaaggcagg

SEQ ID NO: 5285994 - DNA, 13 bp, Homo sapiens
caaagaaggaaat

SEQ ID NO: 5285995 - DNA, 18 bp, Homo sapiens
caaagaaggaaatatcat

SEQ ID NO: 5285996 - DNA, 17 bp, Homo sapiens
caaagaaggaattctag

SEQ ID NO: 5285997 - DNA, 20 bp, Homo sapiens
caaagaaggaggatggcttg

SEQ ID NO: 5285998 - DNA, 14 bp, Homo sapiens
caaagaaggcaggg

SEQ ID NO: 5285999 - DNA, 22 bp, Homo sapiens
caaagaaggcatttgcagggtc

SEQ ID NO: 5286000 - DNA, 14 bp, Homo sapiens
caaagaaggtgctg

SEQ ID NO: 5286001 - DNA, 20 bp, Homo sapiens
caaagaagtcggaatgtcat

SEQ ID NO: 5286002 - DNA, 13 bp, Homo sapiens
caaagaagtggtt

SEQ ID NO: 5286003 - DNA, 15 bp, Homo sapiens
caaagaataagaaaa

SEQ ID NO: 5286004 - DNA, 21 bp, Homo sapiens
caaagaatagtttggttcttc

SEQ ID NO: 5286005 - DNA, 21 bp, Homo sapiens
caaagaatcaacagccaaact

SEQ ID NO: 5286006 - DNA, 11 bp, Homo sapiens
caaagaatgca

SEQ ID NO: 5286007 - DNA, 22 bp, Homo sapiens
caaagaatgttagagcacagta

SEQ ID NO: 5286008 - DNA, 15 bp, Homo sapiens
caaagaatgtttata

SEQ ID NO: 5286009 - DNA, 15 bp, Homo sapiens
caaagaattacagta

SEQ ID NO: 5286010 - DNA, 22 bp, Homo sapiens
caaagaattcctgaagccagat

SEQ ID NO: 5286011 - DNA, 14 bp, Homo sapiens
caaagacaaaagaa

SEQ ID NO: 5286012 - DNA, 18 bp, Homo sapiens
caaagacaaaagaaactt

SEQ ID NO: 5286013 - DNA, 14 bp, Homo sapiens
caaagacaaatagt

SEQ ID NO: 5286014 - DNA, 16 bp, Homo sapiens
caaagacaaatagtag

SEQ ID NO: 5286015 - DNA, 21 bp, Homo sapiens
caaagacaaattctgtttctt

SEQ ID NO: 5286016 - DNA, 14 bp, Homo sapiens
caaagacagaagcc

SEQ ID NO: 5286017 - DNA, 21 bp, Homo sapiens
caaagacagggaatagtggga

SEQ ID NO: 5286018 - DNA, 14 bp, Homo sapiens
caaagacagtattt

SEQ ID NO: 5286019 - DNA, 16 bp, Homo sapiens
caaagacagtatttat

SEQ ID NO: 5286020 - DNA, 17 bp, Homo sapiens
caaagacatgctttcca

SEQ ID NO: 5286021 - DNA, 17 bp, Homo sapiens
caaagacatggaagatt

SEQ ID NO: 5286022 - DNA, 15 bp, Homo sapiens
caaagacattgacag

SEQ ID NO: 5286023 - DNA, 21 bp, Homo sapiens
caaagacattgacagcaattc

SEQ ID NO: 5286024 - DNA, 22 bp, Homo sapiens
caaagacatttcaaataactgc

SEQ ID NO: 5286025 - DNA, 15 bp, Homo sapiens
caaagacatttcatc

SEQ ID NO: 5286026 - DNA, 15 bp, Homo sapiens
caaagaccaatgtga

SEQ ID NO: 5286027 - DNA, 21 bp, Homo sapiens
caaagaccacacatttgtgta

SEQ ID NO: 5286028 - DNA, 15 bp, Homo sapiens
caaagaccacctcca

SEQ ID NO: 5286029 - DNA, 22 bp, Homo sapiens
caaagaccccatggtccatccc

SEQ ID NO: 5286030 - DNA, 19 bp, Homo sapiens
caaagacccgggagctggc

SEQ ID NO: 5286031 - DNA, 14 bp, Homo sapiens
caaagaccctggct

SEQ ID NO: 5286032 - DNA, 16 bp, Homo sapiens
caaagaccctggcttt

SEQ ID NO: 5286033 - DNA, 22 bp, Homo sapiens
caaagacctagattattgaatt

SEQ ID NO: 5286034 - DNA, 15 bp, Homo sapiens
caaagacctcccaag

SEQ ID NO: 5286035 - DNA, 13 bp, Homo sapiens
caaagacctgcct

SEQ ID NO: 5286036 - DNA, 20 bp, Homo sapiens
caaagacctgcctgtgtgct

SEQ ID NO: 5286037 - DNA, 20 bp, Homo sapiens
caaagacgcaaggtgtgctc

SEQ ID NO: 5286038 - DNA, 16 bp, Homo sapiens
caaagacgtaataaaa

SEQ ID NO: 5286039 - DNA, 20 bp, Homo sapiens
caaagacgtaataaaattaa

SEQ ID NO: 5286040 - DNA, 12 bp, Homo sapiens
caaagactattt

SEQ ID NO: 5286041 - DNA, 15 bp, Homo sapiens
caaagactcctctgg

SEQ ID NO: 5286042 - DNA, 20 bp, Homo sapiens
caaagactcctctgggcctg

SEQ ID NO: 5286043 - DNA, 13 bp, Homo sapiens
caaagactccttg

SEQ ID NO: 5286044 - DNA, 23 bp, Homo sapiens
caaagactccttgtggactggct

SEQ ID NO: 5286045 - DNA, 16 bp, Homo sapiens
caaagactctgagcca

SEQ ID NO: 5286046 - DNA, 21 bp, Homo sapiens
caaagactctgagccaaggga

SEQ ID NO: 5286047 - DNA, 13 bp, Homo sapiens
caaagactgccac

SEQ ID NO: 5286048 - DNA, 16 bp, Homo sapiens
caaagactgtactggc

SEQ ID NO: 5286049 - DNA, 23 bp, Homo sapiens
caaagacttaatcatatcaactt

SEQ ID NO: 5286050 - DNA, 22 bp, Homo sapiens
caaagacttcatttaacactga

SEQ ID NO: 5286051 - DNA, 15 bp, Homo sapiens
caaagagaaaaagaa

SEQ ID NO: 5286052 - DNA, 17 bp, Homo sapiens
caaagagaaaaagaaat

SEQ ID NO: 5286053 - DNA, 20 bp, Homo sapiens
caaagagaaaaagaaatgca

SEQ ID NO: 5286054 - DNA, 20 bp, Homo sapiens
caaagagaaaccgcttttgg

SEQ ID NO: 5286055 - DNA, 22 bp, Homo sapiens
caaagagaaacctattaagtca

SEQ ID NO: 5286056 - DNA, 21 bp, Homo sapiens
caaagagaaatcacaggggcg

SEQ ID NO: 5286057 - DNA, 16 bp, Homo sapiens
caaagagaagatgcct

SEQ ID NO: 5286058 - DNA, 20 bp, Homo sapiens
caaagagaagatgcctgtta

SEQ ID NO: 5286059 - DNA, 22 bp, Homo sapiens
caaagagaaggcctggtcagca

SEQ ID NO: 5286060 - DNA, 20 bp, Homo sapiens
caaagagaatcccacattag

SEQ ID NO: 5286061 - DNA, 15 bp, Homo sapiens
caaagagaatgtatt

SEQ ID NO: 5286062 - DNA, 15 bp, Homo sapiens
caaagagacatttca

SEQ ID NO: 5286063 - DNA, 18 bp, Homo sapiens
caaagagacatttcaaaa

SEQ ID NO: 5286064 - DNA, 14 bp, Homo sapiens
caaagagaccaggg

SEQ ID NO: 5286065 - DNA, 15 bp, Homo sapiens
caaagagaccagggg

SEQ ID NO: 5286066 - DNA, 14 bp, Homo sapiens
caaagagactggag

SEQ ID NO: 5286067 - DNA, 19 bp, Homo sapiens
caaagagagaaaataaaga

SEQ ID NO: 5286068 - DNA, 15 bp, Homo sapiens
caaagagaggtccag

SEQ ID NO: 5286069 - DNA, 20 bp, Homo sapiens
caaagagaggtccagagtcc

SEQ ID NO: 5286070 - DNA, 16 bp, Homo sapiens
caaagagagtggaaat

SEQ ID NO: 5286071 - DNA, 21 bp, Homo sapiens
caaagagagtttttaatagaa

SEQ ID NO: 5286072 - DNA, 22 bp, Homo sapiens
caaagagagtttttaatagaac

SEQ ID NO: 5286073 - DNA, 23 bp, Homo sapiens
caaagagatgggccttttcttga

SEQ ID NO: 5286074 - DNA, 17 bp, Homo sapiens
caaagagcacaaacatt

SEQ ID NO: 5286075 - DNA, 19 bp, Homo sapiens
caaagagcacaaacatttt

SEQ ID NO: 5286076 - DNA, 18 bp, Homo sapiens
caaagagcctggagaagc

SEQ ID NO: 5286077 - DNA, 23 bp, Homo sapiens
caaagaggactcgcttgtaaata

SEQ ID NO: 5286078 - DNA, 19 bp, Homo sapiens
caaagaggattagacagta

SEQ ID NO: 5286079 - DNA, 13 bp, Homo sapiens
caaagaggcaaga

SEQ ID NO: 5286080 - DNA, 20 bp, Homo sapiens
caaagaggcaagaggctgga

SEQ ID NO: 5286081 - DNA, 15 bp, Homo sapiens
caaagaggcattcag

SEQ ID NO: 5286082 - DNA, 20 bp, Homo sapiens
caaagaggccagtactttgc

SEQ ID NO: 5286083 - DNA, 12 bp, Homo sapiens
caaagaggctgc

SEQ ID NO: 5286084 - DNA, 18 bp, Homo sapiens
attgggcaagtgattgaa

SEQ ID NO: 5286085 - DNA, 16 bp, Homo sapiens
attgggcaataaaaga

SEQ ID NO: 5286086 - DNA, 17 bp, Homo sapiens
attgggcacagtccaga

SEQ ID NO: 5286087 - DNA, 22 bp, Homo sapiens
attgggcattagtgtcccccct

SEQ ID NO: 5286088 - DNA, 17 bp, Homo sapiens
attgggcccccaggtct

SEQ ID NO: 5286089 - DNA, 17 bp, Homo sapiens
attgggcttcaatcact

SEQ ID NO: 5286090 - DNA, 13 bp, Homo sapiens
attggggaagaaa

SEQ ID NO: 5286091 - DNA, 19 bp, Homo sapiens
attggggaattaaaagtca

SEQ ID NO: 5286092 - DNA, 16 bp, Homo sapiens
attggggaattaaata

SEQ ID NO: 5286093 - DNA, 18 bp, Homo sapiens
attggggaattaaatagt

SEQ ID NO: 5286094 - DNA, 14 bp, Homo sapiens
attggggaggaggg

SEQ ID NO: 5286095 - DNA, 16 bp, Homo sapiens
attggggattcttaaa

SEQ ID NO: 5286096 - DNA, 21 bp, Homo sapiens
attggggattcttaaagttga

SEQ ID NO: 5286097 - DNA, 13 bp, Homo sapiens
attggggccctct

SEQ ID NO: 5286098 - DNA, 20 bp, Homo sapiens
attggggctcccagccaggc

SEQ ID NO: 5286099 - DNA, 23 bp, Homo sapiens
attggggctcccagccaggccct

SEQ ID NO: 5286100 - DNA, 16 bp, Homo sapiens
attgggggatgtgaag

SEQ ID NO: 5286101 - DNA, 20 bp, Homo sapiens
attgggggatgtgaagaaat

SEQ ID NO: 5286102 - DNA, 20 bp, Homo sapiens
attggggggaaagagggagc

SEQ ID NO: 5286103 - DNA, 15 bp, Homo sapiens
attgggggggcttgg

SEQ ID NO: 5286104 - DNA, 21 bp, Homo sapiens
attgggggttggccatttatg

SEQ ID NO: 5286105 - DNA, 19 bp, Homo sapiens
attggggtcttttggctct

SEQ ID NO: 5286106 - DNA, 20 bp, Homo sapiens
attggggtgataaggggcct

SEQ ID NO: 5286107 - DNA, 12 bp, Homo sapiens
attggggttatt

SEQ ID NO: 5286108 - DNA, 13 bp, Homo sapiens
attggggttcctc

SEQ ID NO: 5286109 - DNA, 23 bp, Homo sapiens
attggggttcctctgtacagcaa

SEQ ID NO: 5286110 - DNA, 20 bp, Homo sapiens
attggggttgagagggaaaa

SEQ ID NO: 5286111 - DNA, 18 bp, Homo sapiens
attggggtttgatttgct

SEQ ID NO: 5286112 - DNA, 23 bp, Homo sapiens
attgggtaagggactccagaagc

SEQ ID NO: 5286113 - DNA, 17 bp, Homo sapiens
attgggtagctatactc

SEQ ID NO: 5286114 - DNA, 17 bp, Homo sapiens
attgggtagctccctga

SEQ ID NO: 5286115 - DNA, 22 bp, Homo sapiens
attgggtcccgcttagttcttg

SEQ ID NO: 5286116 - DNA, 19 bp, Homo sapiens
attgggtcctgggtctttc

SEQ ID NO: 5286117 - DNA, 20 bp, Homo sapiens
attgggtctattccagctca

SEQ ID NO: 5286118 - DNA, 17 bp, Homo sapiens
attgggtgccatgtgga

SEQ ID NO: 5286119 - DNA, 20 bp, Homo sapiens
attgggtgggattttttccc

SEQ ID NO: 5286120 - DNA, 18 bp, Homo sapiens
attgggtgggcaggaaaa

SEQ ID NO: 5286121 - DNA, 14 bp, Homo sapiens
attgggtggggctc

SEQ ID NO: 5286122 - DNA, 23 bp, Homo sapiens
attgggtggggggcttcatacac

SEQ ID NO: 5286123 - DNA, 13 bp, Homo sapiens
attgggttatgaa

SEQ ID NO: 5286124 - DNA, 19 bp, Homo sapiens
attgggttcatgatgcagt

SEQ ID NO: 5286125 - DNA, 23 bp, Homo sapiens
attgggttcatgatgcagtctcc

SEQ ID NO: 5286126 - DNA, 13 bp, Homo sapiens
attggtaaacatt

SEQ ID NO: 5286127 - DNA, 14 bp, Homo sapiens
attggtaaacattt

SEQ ID NO: 5286128 - DNA, 12 bp, Homo sapiens
attggtaaattc

SEQ ID NO: 5286129 - DNA, 16 bp, Homo sapiens
attggtaacatccttt

SEQ ID NO: 5286130 - DNA, 15 bp, Homo sapiens
attggtaattacctg

SEQ ID NO: 5286131 - DNA, 16 bp, Homo sapiens
attggtaattgaatgg

SEQ ID NO: 5286132 - DNA, 15 bp, Homo sapiens
attggtaccagagcc

SEQ ID NO: 5286133 - DNA, 17 bp, Homo sapiens
attggtaccttgcacac

SEQ ID NO: 5286134 - DNA, 19 bp, Homo sapiens
attggtaccttgcacacat

SEQ ID NO: 5286135 - DNA, 15 bp, Homo sapiens
attggtattaaagaa

SEQ ID NO: 5286136 - DNA, 12 bp, Homo sapiens
attggtcaattc

SEQ ID NO: 5286137 - DNA, 21 bp, Homo sapiens
attggtccaacccagcctgag

SEQ ID NO: 5286138 - DNA, 17 bp, Homo sapiens
attggtccagcttgctc

SEQ ID NO: 5286139 - DNA, 21 bp, Homo sapiens
attggtctgggtggatgtgag

SEQ ID NO: 5286140 - DNA, 18 bp, Homo sapiens
attggtcttaatgttgaa

SEQ ID NO: 5286141 - DNA, 16 bp, Homo sapiens
attggtctttctacat

SEQ ID NO: 5286142 - DNA, 12 bp, Homo sapiens
attggtgaataa

SEQ ID NO: 5286143 - DNA, 16 bp, Homo sapiens
attggtgacaatgtca

SEQ ID NO: 5286144 - DNA, 16 bp, Homo sapiens
attggtgataagtgga

SEQ ID NO: 5286145 - DNA, 19 bp, Homo sapiens
attggtgataagtggaaaa

SEQ ID NO: 5286146 - DNA, 13 bp, Homo sapiens
attggtgcttcag

SEQ ID NO: 5286147 - DNA, 21 bp, Homo sapiens
attggtggcatcacagacccc

SEQ ID NO: 5286148 - DNA, 16 bp, Homo sapiens
attggtggctgttcct

SEQ ID NO: 5286149 - DNA, 17 bp, Homo sapiens
attggtggttctcagca

SEQ ID NO: 5286150 - DNA, 12 bp, Homo sapiens
attggtgtatat

SEQ ID NO: 5286151 - DNA, 15 bp, Homo sapiens
attggtgtcattttc

SEQ ID NO: 5286152 - DNA, 15 bp, Homo sapiens
attggtgtgccttaa

SEQ ID NO: 5286153 - DNA, 20 bp, Homo sapiens
attggtgttcgtttccatca

SEQ ID NO: 5286154 - DNA, 16 bp, Homo sapiens
attggtgttgcagccg

SEQ ID NO: 5286155 - DNA, 17 bp, Homo sapiens
attggttaatctggact

SEQ ID NO: 5286156 - DNA, 17 bp, Homo sapiens
attggttaatgaaaaat

SEQ ID NO: 5286157 - DNA, 15 bp, Homo sapiens
attggttaattttta

SEQ ID NO: 5286158 - DNA, 15 bp, Homo sapiens
attggttactggtga

SEQ ID NO: 5286159 - DNA, 14 bp, Homo sapiens
attggttcacctgt

SEQ ID NO: 5286160 - DNA, 19 bp, Homo sapiens
attggttctgttttcgtac

SEQ ID NO: 5286161 - DNA, 23 bp, Homo sapiens
attggttcttcctttccctggag

SEQ ID NO: 5286162 - DNA, 15 bp, Homo sapiens
attggttcttgtatt

SEQ ID NO: 5286163 - DNA, 16 bp, Homo sapiens
attggttcttgtatta

SEQ ID NO: 5286164 - DNA, 18 bp, Homo sapiens
attggttggtgtgaagaa

SEQ ID NO: 5286165 - DNA, 14 bp, Homo sapiens
attggttgtatata

SEQ ID NO: 5286166 - DNA, 14 bp, Homo sapiens
attggttgtgcctt

SEQ ID NO: 5286167 - DNA, 23 bp, Homo sapiens
attggttgtgccttcccttctct

SEQ ID NO: 5286168 - DNA, 16 bp, Homo sapiens
attggtttaaactttt

SEQ ID NO: 5286169 - DNA, 18 bp, Homo sapiens
attggtttaaacttttat

SEQ ID NO: 5286170 - DNA, 21 bp, Homo sapiens
attggttttaattgaaggaaa

SEQ ID NO: 5286171 - DNA, 22 bp, Homo sapiens
attggttttaattgaaggaaag

SEQ ID NO: 5286172 - DNA, 21 bp, Homo sapiens
attggttttatcgcagatttt

SEQ ID NO: 5286173 - DNA, 14 bp, Homo sapiens
attggttttatgat

SEQ ID NO: 5286174 - DNA, 13 bp, Homo sapiens
attggttttccat

SEQ ID NO: 5286175 - DNA, 14 bp, Homo sapiens
attggttttgaaat

SEQ ID NO: 5286176 - DNA, 21 bp, Homo sapiens
attggttttgaaatgtttcct

SEQ ID NO: 5286177 - DNA, 22 bp, Homo sapiens
attggttttggggaaatgtgga

SEQ ID NO: 5286178 - DNA, 12 bp, Homo sapiens
attgtaaaaaaa

SEQ ID NO: 5286179 - DNA, 15 bp, Homo sapiens
attgtaaaaaattca

SEQ ID NO: 5286180 - DNA, 22 bp, Homo sapiens
attgtaaaaaattcacataata

SEQ ID NO: 5286181 - DNA, 14 bp, Homo sapiens
attgtaaaacaggt

SEQ ID NO: 5286182 - DNA, 21 bp, Homo sapiens
attgtaaaacctgtcaatgat

SEQ ID NO: 5286183 - DNA, 21 bp, Homo sapiens
attgtaaaagcattttgtaat

SEQ ID NO: 5286184 - DNA, 19 bp, Homo sapiens
attgtaaaatagcttgtat

SEQ ID NO: 5286185 - DNA, 13 bp, Homo sapiens
attgtaaaatggt

SEQ ID NO: 5286186 - DNA, 17 bp, Homo sapiens
attgtaaaattgtatag

SEQ ID NO: 5286187 - DNA, 16 bp, Homo sapiens
attgtaaacatgtgtt

SEQ ID NO: 5286188 - DNA, 13 bp, Homo sapiens
attgtaaactaaa

SEQ ID NO: 5286189 - DNA, 14 bp, Homo sapiens
attgtaaactgtac

SEQ ID NO: 5286190 - DNA, 15 bp, Homo sapiens
attgtaaactgtact

SEQ ID NO: 5286191 - DNA, 21 bp, Homo sapiens
attgtaaaggtgatgaattta

SEQ ID NO: 5286192 - DNA, 22 bp, Homo sapiens
attgtaaaggtgatgaatttac

SEQ ID NO: 5286193 - DNA, 22 bp, Homo sapiens
attgtaaataaattttgtgcaa

SEQ ID NO: 5286194 - DNA, 14 bp, Homo sapiens
attgtaaatactgg

SEQ ID NO: 5286195 - DNA, 15 bp, Homo sapiens
attgtaaatactgga

SEQ ID NO: 5286196 - DNA, 18 bp, Homo sapiens
attgtaaatattttgata

SEQ ID NO: 5286197 - DNA, 14 bp, Homo sapiens
attgtaaatctgaa

SEQ ID NO: 5286198 - DNA, 16 bp, Homo sapiens
attgtaaatctgaaga

SEQ ID NO: 5286199 - DNA, 17 bp, Homo sapiens
attgtaaatctgaagaa

SEQ ID NO: 5286200 - DNA, 20 bp, Homo sapiens
attgtaaatctgaagaaagt

SEQ ID NO: 5286201 - DNA, 19 bp, Homo sapiens
attgtaaatgaacataatg

SEQ ID NO: 5286202 - DNA, 15 bp, Homo sapiens
attgtaaatgtgctt

SEQ ID NO: 5286203 - DNA, 13 bp, Homo sapiens
attgtaaatgtgg

SEQ ID NO: 5286204 - DNA, 15 bp, Homo sapiens
attgtaaatgtttaa

SEQ ID NO: 5286205 - DNA, 20 bp, Homo sapiens
attgtaaatgtttaatatct

SEQ ID NO: 5286206 - DNA, 18 bp, Homo sapiens
attgtaaattatttcata

SEQ ID NO: 5286207 - DNA, 19 bp, Homo sapiens
attgtaaattttagagcat

SEQ ID NO: 5286208 - DNA, 14 bp, Homo sapiens
attgtaacagacat

SEQ ID NO: 5286209 - DNA, 16 bp, Homo sapiens
attgtaacagacattg

SEQ ID NO: 5286210 - DNA, 20 bp, Homo sapiens
attgtaaccatttctcacta

SEQ ID NO: 5286211 - DNA, 18 bp, Homo sapiens
attgtaacctgcattttt

SEQ ID NO: 5286212 - DNA, 18 bp, Homo sapiens
attgtaacgttaaatgaa

SEQ ID NO: 5286213 - DNA, 19 bp, Homo sapiens
attgtaactgttcttgaat

SEQ ID NO: 5286214 - DNA, 16 bp, Homo sapiens
attgtaacttatttca

SEQ ID NO: 5286215 - DNA, 21 bp, Homo sapiens
attgtaagaaatactgtacaa

SEQ ID NO: 5286216 - DNA, 13 bp, Homo sapiens
attgtaagccaga

SEQ ID NO: 5286217 - DNA, 18 bp, Homo sapiens
attgtaagcgtatggctt

SEQ ID NO: 5286218 - DNA, 21 bp, Homo sapiens
attgtaagtcccatgaataca

SEQ ID NO: 5286219 - DNA, 20 bp, Homo sapiens
attgtaagttgtacaaatgt

SEQ ID NO: 5286220 - DNA, 19 bp, Homo sapiens
attgtaagttgttggttta

SEQ ID NO: 5286221 - DNA, 18 bp, Homo sapiens
attgtaatacacatatct

SEQ ID NO: 5286222 - DNA, 23 bp, Homo sapiens
attgtaataggcgtaactaattt

SEQ ID NO: 5286223 - DNA, 13 bp, Homo sapiens
attgtaatatgac

SEQ ID NO: 5286224 - DNA, 15 bp, Homo sapiens
attgtaatatgacag

SEQ ID NO: 5286225 - DNA, 16 bp, Homo sapiens
attgtaatatgacaga

SEQ ID NO: 5286226 - DNA, 13 bp, Homo sapiens
attgtaatcactg

SEQ ID NO: 5286227 - DNA, 15 bp, Homo sapiens
attgtaatcataaat

SEQ ID NO: 5286228 - DNA, 18 bp, Homo sapiens
attgtaatcgtgtgccat

SEQ ID NO: 5286229 - DNA, 13 bp, Homo sapiens
attgtaatctatg

SEQ ID NO: 5286230 - DNA, 21 bp, Homo sapiens
attgtaatctgctttgttaat

SEQ ID NO: 5286231 - DNA, 21 bp, Homo sapiens
attgtaatctttcatagccat

SEQ ID NO: 5286232 - DNA, 17 bp, Homo sapiens
attgtaatgttactgat

SEQ ID NO: 5286233 - DNA, 15 bp, Homo sapiens
attgtaattatatct

SEQ ID NO: 5286234 - DNA, 21 bp, Homo sapiens
attgtaattatatctgaggaa

SEQ ID NO: 5286235 - DNA, 16 bp, Homo sapiens
attgtaattgtctcaa

SEQ ID NO: 5286236 - DNA, 17 bp, Homo sapiens
attgtaatttgggaaca

SEQ ID NO: 5286237 - DNA, 20 bp, Homo sapiens
attgtacaaaaaagttataa

SEQ ID NO: 5286238 - DNA, 15 bp, Homo sapiens
attgtacaaaattaa

SEQ ID NO: 5286239 - DNA, 20 bp, Homo sapiens
attgtacaaagtattaagca

SEQ ID NO: 5286240 - DNA, 20 bp, Homo sapiens
attgtacaaatgtaagcaaa

SEQ ID NO: 5286241 - DNA, 22 bp, Homo sapiens
attgtacaagagtccctttgaa

SEQ ID NO: 5286242 - DNA, 23 bp, Homo sapiens
attgtacaaggtatttacacata

SEQ ID NO: 5286243 - DNA, 12 bp, Homo sapiens
attgtacaataa

SEQ ID NO: 5286244 - DNA, 14 bp, Homo sapiens
attgtacaataaat

SEQ ID NO: 5286245 - DNA, 17 bp, Homo sapiens
attgtacaataaatttt

SEQ ID NO: 5286246 - DNA, 14 bp, Homo sapiens
attgtacagactgt

SEQ ID NO: 5286247 - DNA, 14 bp, Homo sapiens
attgtacagctgtt

SEQ ID NO: 5286248 - DNA, 17 bp, Homo sapiens
attgtacagctgtttaa

SEQ ID NO: 5286249 - DNA, 16 bp, Homo sapiens
attgtacagtttgttt

SEQ ID NO: 5286250 - DNA, 19 bp, Homo sapiens
attgtacagtttgtttaca

SEQ ID NO: 5286251 - DNA, 15 bp, Homo sapiens
attgtacagttttta

SEQ ID NO: 5286252 - DNA, 15 bp, Homo sapiens
attgtacatatggaa

SEQ ID NO: 5286253 - DNA, 20 bp, Homo sapiens
attgtacatatttgtggaat

SEQ ID NO: 5286254 - DNA, 17 bp, Homo sapiens
attgtacattttttact

SEQ ID NO: 5286255 - DNA, 18 bp, Homo sapiens
attgtaccatcattttat

SEQ ID NO: 5286256 - DNA, 19 bp, Homo sapiens
attgtaccatcattttatt

SEQ ID NO: 5286257 - DNA, 17 bp, Homo sapiens
attgtacctatttctga

SEQ ID NO: 5286258 - DNA, 17 bp, Homo sapiens
attgtacgctagagcat

SEQ ID NO: 5286259 - DNA, 15 bp, Homo sapiens
attgtacgtttaaag

SEQ ID NO: 5286260 - DNA, 15 bp, Homo sapiens
attgtactaaagcca

SEQ ID NO: 5286261 - DNA, 21 bp, Homo sapiens
attgtactaaagccaaacata

SEQ ID NO: 5286262 - DNA, 16 bp, Homo sapiens
attgtactaatctgag

SEQ ID NO: 5286263 - DNA, 16 bp, Homo sapiens
caaagaggctgcccct

SEQ ID NO: 5286264 - DNA, 18 bp, Homo sapiens
caaagagggagttggctg

SEQ ID NO: 5286265 - DNA, 23 bp, Homo sapiens
caaagagggagttggctggatct

SEQ ID NO: 5286266 - DNA, 18 bp, Homo sapiens
caaagagggcttcctcta

SEQ ID NO: 5286267 - DNA, 22 bp, Homo sapiens
caaagagggcttcctctagaag

SEQ ID NO: 5286268 - DNA, 20 bp, Homo sapiens
caaagaggggcgctgtcctg

SEQ ID NO: 5286269 - DNA, 18 bp, Homo sapiens
caaagagggggctctgcc

SEQ ID NO: 5286270 - DNA, 21 bp, Homo sapiens
caaagagggtgagggccttct

SEQ ID NO: 5286271 - DNA, 23 bp, Homo sapiens
caaagagggtgagggccttctta

SEQ ID NO: 5286272 - DNA, 21 bp, Homo sapiens
caaagaggtgctgctttgctt

SEQ ID NO: 5286273 - DNA, 14 bp, Homo sapiens
caaagaggttttaa

SEQ ID NO: 5286274 - DNA, 13 bp, Homo sapiens
caaagagtagaac

SEQ ID NO: 5286275 - DNA, 14 bp, Homo sapiens
caaagagtagaatt

SEQ ID NO: 5286276 - DNA, 17 bp, Homo sapiens
caaagagtagacatttc

SEQ ID NO: 5286277 - DNA, 12 bp, Homo sapiens
caaagagtattc

SEQ ID NO: 5286278 - DNA, 13 bp, Homo sapiens
caaagagtcatca

SEQ ID NO: 5286279 - DNA, 15 bp, Homo sapiens
caaagagtctctggc

SEQ ID NO: 5286280 - DNA, 17 bp, Homo sapiens
caaagagtctctggctc

SEQ ID NO: 5286281 - DNA, 15 bp, Homo sapiens
caaagagtgaaatat

SEQ ID NO: 5286282 - DNA, 22 bp, Homo sapiens
caaagagtgggctgcatctggg

SEQ ID NO: 5286283 - DNA, 17 bp, Homo sapiens
caaagagttcaagaaat

SEQ ID NO: 5286284 - DNA, 22 bp, Homo sapiens
caaagataaaaggtttcttttt

SEQ ID NO: 5286285 - DNA, 18 bp, Homo sapiens
caaagataaatgaaataa

SEQ ID NO: 5286286 - DNA, 19 bp, Homo sapiens
caaagataacgcaggagag

SEQ ID NO: 5286287 - DNA, 21 bp, Homo sapiens
caaagataaggactagatact

SEQ ID NO: 5286288 - DNA, 16 bp, Homo sapiens
caaagataatctctca

SEQ ID NO: 5286289 - DNA, 16 bp, Homo sapiens
caaagatacaagaaaa

SEQ ID NO: 5286290 - DNA, 18 bp, Homo sapiens
caaagatacaagaaaaag

SEQ ID NO: 5286291 - DNA, 22 bp, Homo sapiens
caaagatacttgatgcacttat

SEQ ID NO: 5286292 - DNA, 12 bp, Homo sapiens
caaagatatata

SEQ ID NO: 5286293 - DNA, 23 bp, Homo sapiens
caaagatatatacacaggatcct

SEQ ID NO: 5286294 - DNA, 13 bp, Homo sapiens
caaagatatatat

SEQ ID NO: 5286295 - DNA, 14 bp, Homo sapiens
caaagatatctttt

SEQ ID NO: 5286296 - DNA, 17 bp, Homo sapiens
caaagatatcttttctt

SEQ ID NO: 5286297 - DNA, 21 bp, Homo sapiens
caaagatatcttttctttaga

SEQ ID NO: 5286298 - DNA, 16 bp, Homo sapiens
caaagatattttgctt

SEQ ID NO: 5286299 - DNA, 18 bp, Homo sapiens
caaagatattttgctttg

SEQ ID NO: 5286300 - DNA, 14 bp, Homo sapiens
caaagatcaaaata

SEQ ID NO: 5286301 - DNA, 15 bp, Homo sapiens
caaagatcaaaataa

SEQ ID NO: 5286302 - DNA, 16 bp, Homo sapiens
caaagatcaaaataaa

SEQ ID NO: 5286303 - DNA, 14 bp, Homo sapiens
caaagatcaaatga

SEQ ID NO: 5286304 - DNA, 12 bp, Homo sapiens
caaagatcactt

SEQ ID NO: 5286305 - DNA, 19 bp, Homo sapiens
caaagatccagcggggctt

SEQ ID NO: 5286306 - DNA, 22 bp, Homo sapiens
caaagatctgaattaaataaat

SEQ ID NO: 5286307 - DNA, 23 bp, Homo sapiens
caaagatctgaattaaataaata

SEQ ID NO: 5286308 - DNA, 21 bp, Homo sapiens
caaagatctgtcctcagcctt

SEQ ID NO: 5286309 - DNA, 12 bp, Homo sapiens
caaagatgaaaa

SEQ ID NO: 5286310 - DNA, 15 bp, Homo sapiens
caaagatgacttccc

SEQ ID NO: 5286311 - DNA, 15 bp, Homo sapiens
caaagatgatggaaa

SEQ ID NO: 5286312 - DNA, 14 bp, Homo sapiens
caaagatgcagccg

SEQ ID NO: 5286313 - DNA, 23 bp, Homo sapiens
caaagatgcagccgccttccttg

SEQ ID NO: 5286314 - DNA, 14 bp, Homo sapiens
caaagatgcatcac

SEQ ID NO: 5286315 - DNA, 22 bp, Homo sapiens
caaagatgcattttgagtgttt

SEQ ID NO: 5286316 - DNA, 21 bp, Homo sapiens
caaagatgcgtttgcctcctg

SEQ ID NO: 5286317 - DNA, 23 bp, Homo sapiens
caaagatgcgtttgcctcctgga

SEQ ID NO: 5286318 - DNA, 16 bp, Homo sapiens
caaagatgctgtgagt

SEQ ID NO: 5286319 - DNA, 16 bp, Homo sapiens
caaagatggctcagag

SEQ ID NO: 5286320 - DNA, 19 bp, Homo sapiens
caaagatggctcagagggg

SEQ ID NO: 5286321 - DNA, 21 bp, Homo sapiens
caaagatgggtgaaggctggc

SEQ ID NO: 5286322 - DNA, 22 bp, Homo sapiens
caaagatgggtgaaggctggca

SEQ ID NO: 5286323 - DNA, 15 bp, Homo sapiens
caaagatggtggctg

SEQ ID NO: 5286324 - DNA, 18 bp, Homo sapiens
caaagatgtgttcaggca

SEQ ID NO: 5286325 - DNA, 19 bp, Homo sapiens
caaagatgtgttcaggcat

SEQ ID NO: 5286326 - DNA, 18 bp, Homo sapiens
caaagatgttaacagtat

SEQ ID NO: 5286327 - DNA, 15 bp, Homo sapiens
caaagatgtttgaaa

SEQ ID NO: 5286328 - DNA, 15 bp, Homo sapiens
caaagattatctgat

SEQ ID NO: 5286329 - DNA, 18 bp, Homo sapiens
caaagattatctgattcc

SEQ ID NO: 5286330 - DNA, 16 bp, Homo sapiens
caaagattgaacactg

SEQ ID NO: 5286331 - DNA, 14 bp, Homo sapiens
caaagattgatttg

SEQ ID NO: 5286332 - DNA, 16 bp, Homo sapiens
caaagatttaatctgc

SEQ ID NO: 5286333 - DNA, 13 bp, Homo sapiens
caaagatttcagt

SEQ ID NO: 5286334 - DNA, 14 bp, Homo sapiens
caaagatttcagta

SEQ ID NO: 5286335 - DNA, 19 bp, Homo sapiens
caaagatttcagtagaatt

SEQ ID NO: 5286336 - DNA, 16 bp, Homo sapiens
caaagatttcatatct

SEQ ID NO: 5286337 - DNA, 20 bp, Homo sapiens
caaagattttctaaggaatg

SEQ ID NO: 5286338 - DNA, 22 bp, Homo sapiens
caaagattttctaaggaatgca

SEQ ID NO: 5286339 - DNA, 19 bp, Homo sapiens
caaagcaaaacatcacatt

SEQ ID NO: 5286340 - DNA, 14 bp, Homo sapiens
caaagcaaaagaag

SEQ ID NO: 5286341 - DNA, 18 bp, Homo sapiens
caaagcaaaagaagtaaa

SEQ ID NO: 5286342 - DNA, 20 bp, Homo sapiens
caaagcaaataaatgccttc

SEQ ID NO: 5286343 - DNA, 17 bp, Homo sapiens
caaagcaaatgttggga

SEQ ID NO: 5286344 - DNA, 16 bp, Homo sapiens
caaagcaaccacctgt

SEQ ID NO: 5286345 - DNA, 16 bp, Homo sapiens
caaagcaacccgctgg

SEQ ID NO: 5286346 - DNA, 15 bp, Homo sapiens
caaagcaacctttcc

SEQ ID NO: 5286347 - DNA, 17 bp, Homo sapiens
caaagcaagcacctggg

SEQ ID NO: 5286348 - DNA, 23 bp, Homo sapiens
caaagcaagcattcagaagaaaa

SEQ ID NO: 5286349 - DNA, 15 bp, Homo sapiens
caaagcaaggaaact

SEQ ID NO: 5286350 - DNA, 22 bp, Homo sapiens
caaagcaatcaagcaccaggaa

SEQ ID NO: 5286351 - DNA, 20 bp, Homo sapiens
caaagcaatgtgagtcccag

SEQ ID NO: 5286352 - DNA, 18 bp, Homo sapiens
caaagcaattctttcaag

SEQ ID NO: 5286353 - DNA, 18 bp, Homo sapiens
caaagcaattgaaatgca

SEQ ID NO: 5286354 - DNA, 11 bp, Homo sapiens
caaagcacaga

SEQ ID NO: 5286355 - DNA, 19 bp, Homo sapiens
caaagcacagagagtctgg

SEQ ID NO: 5286356 - DNA, 15 bp, Homo sapiens
caaagcacagctggg

SEQ ID NO: 5286357 - DNA, 19 bp, Homo sapiens
caaagcacagtgttaaatg

SEQ ID NO: 5286358 - DNA, 23 bp, Homo sapiens
caaagcacatgcttagcttatct

SEQ ID NO: 5286359 - DNA, 17 bp, Homo sapiens
caaagcacattgaaaga

SEQ ID NO: 5286360 - DNA, 18 bp, Homo sapiens
caaagcacattgaaagag

SEQ ID NO: 5286361 - DNA, 19 bp, Homo sapiens
caaagcaccaaaataagaa

SEQ ID NO: 5286362 - DNA, 21 bp, Homo sapiens
caaagcaccagcttctccagg

SEQ ID NO: 5286363 - DNA, 20 bp, Homo sapiens
caaagcacgaaatgttattt

SEQ ID NO: 5286364 - DNA, 20 bp, Homo sapiens
caaagcactgacttctaagt

SEQ ID NO: 5286365 - DNA, 16 bp, Homo sapiens
caaagcactggccttg

SEQ ID NO: 5286366 - DNA, 17 bp, Homo sapiens
caaagcactggccttgc

SEQ ID NO: 5286367 - DNA, 19 bp, Homo sapiens
caaagcactggccttgcct

SEQ ID NO: 5286368 - DNA, 21 bp, Homo sapiens
caaagcactggccttgcctcc

SEQ ID NO: 5286369 - DNA, 19 bp, Homo sapiens
caaagcacttttaaaaaaa

SEQ ID NO: 5286370 - DNA, 22 bp, Homo sapiens
caaagcacttttaaaaaaattt

SEQ ID NO: 5286371 - DNA, 12 bp, Homo sapiens
caaagcagaact

SEQ ID NO: 5286372 - DNA, 18 bp, Homo sapiens
caaagcagaagtctggct

SEQ ID NO: 5286373 - DNA, 19 bp, Homo sapiens
caaagcagaagtggaatcc

SEQ ID NO: 5286374 - DNA, 12 bp, Homo sapiens
caaagcagacag

SEQ ID NO: 5286375 - DNA, 17 bp, Homo sapiens
caaagcagacagctcca

SEQ ID NO: 5286376 - DNA, 11 bp, Homo sapiens
caaagcagagt

SEQ ID NO: 5286377 - DNA, 15 bp, Homo sapiens
caaagcagataaaat

SEQ ID NO: 5286378 - DNA, 19 bp, Homo sapiens
caaagcagattcagaaatg

SEQ ID NO: 5286379 - DNA, 23 bp, Homo sapiens
caaagcagattttcctaaggcca

SEQ ID NO: 5286380 - DNA, 16 bp, Homo sapiens
caaagcagcagtgtcc

SEQ ID NO: 5286381 - DNA, 23 bp, Homo sapiens
caaagcagctgattcagcagtgc

SEQ ID NO: 5286382 - DNA, 10 bp, Homo sapiens
caaagcagga

SEQ ID NO: 5286383 - DNA, 16 bp, Homo sapiens
caaagcaggagtggaa

SEQ ID NO: 5286384 - DNA, 17 bp, Homo sapiens
caaagcagtatataata

SEQ ID NO: 5286385 - DNA, 21 bp, Homo sapiens
caaagcagtatataataactt

SEQ ID NO: 5286386 - DNA, 15 bp, Homo sapiens
caaagcagtgcatgc

SEQ ID NO: 5286387 - DNA, 21 bp, Homo sapiens
caaagcagtggagcccaggag

SEQ ID NO: 5286388 - DNA, 22 bp, Homo sapiens
caaagcagtggcttagctgcca

SEQ ID NO: 5286389 - DNA, 13 bp, Homo sapiens
caaagcatagatg

SEQ ID NO: 5286390 - DNA, 17 bp, Homo sapiens
caaagcatcattgtaaa

SEQ ID NO: 5286391 - DNA, 14 bp, Homo sapiens
caaagcatgctcag

SEQ ID NO: 5286392 - DNA, 19 bp, Homo sapiens
caaagcatgctcagtattg

SEQ ID NO: 5286393 - DNA, 22 bp, Homo sapiens
caaagcatgggaaaaagagact

SEQ ID NO: 5286394 - DNA, 23 bp, Homo sapiens
caaagcatgggaaaaagagactc

SEQ ID NO: 5286395 - DNA, 14 bp, Homo sapiens
caaagccaaacaaa

SEQ ID NO: 5286396 - DNA, 12 bp, Homo sapiens
caaagccaaggc

SEQ ID NO: 5286397 - DNA, 15 bp, Homo sapiens
caaagccaaggcagc

SEQ ID NO: 5286398 - DNA, 22 bp, Homo sapiens
caaagccaaggcagcgacccca

SEQ ID NO: 5286399 - DNA, 17 bp, Homo sapiens
caaagccacaaggctgg

SEQ ID NO: 5286400 - DNA, 21 bp, Homo sapiens
caaagccacaaggctggccag

SEQ ID NO: 5286401 - DNA, 23 bp, Homo sapiens
caaagccacctctgtcatttgtt

SEQ ID NO: 5286402 - DNA, 17 bp, Homo sapiens
caaagccacctgctgcg

SEQ ID NO: 5286403 - DNA, 18 bp, Homo sapiens
caaagccagaagctgagc

SEQ ID NO: 5286404 - DNA, 15 bp, Homo sapiens
caaagccagacagca

SEQ ID NO: 5286405 - DNA, 16 bp, Homo sapiens
caaagccagaggagaa

SEQ ID NO: 5286406 - DNA, 13 bp, Homo sapiens
caaagccagagtg

SEQ ID NO: 5286407 - DNA, 15 bp, Homo sapiens
caaagccagagtggc

SEQ ID NO: 5286408 - DNA, 20 bp, Homo sapiens
caaagccagcgtcctcctct

SEQ ID NO: 5286409 - DNA, 21 bp, Homo sapiens
caaagccagcgtcctcctctg

SEQ ID NO: 5286410 - DNA, 22 bp, Homo sapiens
caaagccagcgtcctcctctgt

SEQ ID NO: 5286411 - DNA, 20 bp, Homo sapiens
caaagccagctctgagcaga

SEQ ID NO: 5286412 - DNA, 14 bp, Homo sapiens
caaagccagggtct

SEQ ID NO: 5286413 - DNA, 22 bp, Homo sapiens
caaagccagggtctctccctca

SEQ ID NO: 5286414 - DNA, 12 bp, Homo sapiens
caaagccagtga

SEQ ID NO: 5286415 - DNA, 13 bp, Homo sapiens
caaagccatatgg

SEQ ID NO: 5286416 - DNA, 20 bp, Homo sapiens
caaagccatatggacactgt

SEQ ID NO: 5286417 - DNA, 14 bp, Homo sapiens
caaagccattcttt

SEQ ID NO: 5286418 - DNA, 18 bp, Homo sapiens
caaagccattcttttaaa

SEQ ID NO: 5286419 - DNA, 17 bp, Homo sapiens
caaagcccacttcacac

SEQ ID NO: 5286420 - DNA, 13 bp, Homo sapiens
caaagcccagccc

SEQ ID NO: 5286421 - DNA, 15 bp, Homo sapiens
caaagcccagcccgg

SEQ ID NO: 5286422 - DNA, 19 bp, Homo sapiens
caaagccccatgctggagc

SEQ ID NO: 5286423 - DNA, 14 bp, Homo sapiens
caaagccccatgtg

SEQ ID NO: 5286424 - DNA, 14 bp, Homo sapiens
caaagcccccagag

SEQ ID NO: 5286425 - DNA, 22 bp, Homo sapiens
caaagcccccagagcccaggct

SEQ ID NO: 5286426 - DNA, 15 bp, Homo sapiens
caaagccccccagct

SEQ ID NO: 5286427 - DNA, 16 bp, Homo sapiens
caaagccccccagctc

SEQ ID NO: 5286428 - DNA, 20 bp, Homo sapiens
caaagccccccagctcccac

SEQ ID NO: 5286429 - DNA, 21 bp, Homo sapiens
caaagccccccagctcccaca

SEQ ID NO: 5286430 - DNA, 11 bp, Homo sapiens
caaagcccccg

SEQ ID NO: 5286431 - DNA, 16 bp, Homo sapiens
caaagcccctcacact

SEQ ID NO: 5286432 - DNA, 15 bp, Homo sapiens
caaagccctaaaatt

SEQ ID NO: 5286433 - DNA, 11 bp, Homo sapiens
caaagccctcc

SEQ ID NO: 5286434 - DNA, 13 bp, Homo sapiens
caaagccctgcct

SEQ ID NO: 5286435 - DNA, 15 bp, Homo sapiens
caaagccctggtaaa

SEQ ID NO: 5286436 - DNA, 13 bp, Homo sapiens
caaagccctgtcc

SEQ ID NO: 5286437 - DNA, 17 bp, Homo sapiens
caaagccctgtccttca

SEQ ID NO: 5286438 - DNA, 15 bp, Homo sapiens
caaagcccttttata

SEQ ID NO: 5286439 - DNA, 23 bp, Homo sapiens
caaagccggcctgagaaacacta

SEQ ID NO: 5286440 - DNA, 13 bp, Homo sapiens
caaagcctccagc

SEQ ID NO: 5286441 - DNA, 16 bp, Homo sapiens
caaagcctccagcatc

SEQ ID NO: 5286442 - DNA, 18 bp, Homo sapiens
attgtactacctgtgtat

SEQ ID NO: 5286443 - DNA, 16 bp, Homo sapiens
attgtactccagcctg

SEQ ID NO: 5286444 - DNA, 17 bp, Homo sapiens
attgtactctgctttat

SEQ ID NO: 5286445 - DNA, 19 bp, Homo sapiens
attgtactgttgctttaat

SEQ ID NO: 5286446 - DNA, 21 bp, Homo sapiens
attgtactgttgctttaatat

SEQ ID NO: 5286447 - DNA, 14 bp, Homo sapiens
attgtactttgaaa

SEQ ID NO: 5286448 - DNA, 12 bp, Homo sapiens
attgtagaaagc

SEQ ID NO: 5286449 - DNA, 13 bp, Homo sapiens
attgtagaaagct

SEQ ID NO: 5286450 - DNA, 14 bp, Homo sapiens
attgtagaacttgt

SEQ ID NO: 5286451 - DNA, 15 bp, Homo sapiens
attgtagaattgtat

SEQ ID NO: 5286452 - DNA, 17 bp, Homo sapiens
attgtagacctgtttca

SEQ ID NO: 5286453 - DNA, 14 bp, Homo sapiens
attgtagagaaaaa

SEQ ID NO: 5286454 - DNA, 21 bp, Homo sapiens
attgtagagaaaaaaaaatat

SEQ ID NO: 5286455 - DNA, 15 bp, Homo sapiens
attgtagagcacatt

SEQ ID NO: 5286456 - DNA, 18 bp, Homo sapiens
attgtagagccagaggtc

SEQ ID NO: 5286457 - DNA, 20 bp, Homo sapiens
attgtagcatcctggaatat

SEQ ID NO: 5286458 - DNA, 15 bp, Homo sapiens
attgtagcatttctt

SEQ ID NO: 5286459 - DNA, 16 bp, Homo sapiens
attgtagcatttcttg

SEQ ID NO: 5286460 - DNA, 23 bp, Homo sapiens
attgtaggataattagcagtatc

SEQ ID NO: 5286461 - DNA, 16 bp, Homo sapiens
attgtagtaaactatt

SEQ ID NO: 5286462 - DNA, 20 bp, Homo sapiens
attgtagtgcaaaatggtca

SEQ ID NO: 5286463 - DNA, 14 bp, Homo sapiens
attgtagtgctttg

SEQ ID NO: 5286464 - DNA, 17 bp, Homo sapiens
attgtagttcatatatt

SEQ ID NO: 5286465 - DNA, 22 bp, Homo sapiens
attgtagttctgtgtacttttt

SEQ ID NO: 5286466 - DNA, 15 bp, Homo sapiens
attgtagttcttagt

SEQ ID NO: 5286467 - DNA, 22 bp, Homo sapiens
attgtagtttgaaagttgtaca

SEQ ID NO: 5286468 - DNA, 16 bp, Homo sapiens
attgtataaaacagtg

SEQ ID NO: 5286469 - DNA, 22 bp, Homo sapiens
attgtataaaacagtgtttcca

SEQ ID NO: 5286470 - DNA, 16 bp, Homo sapiens
attgtataacaggtta

SEQ ID NO: 5286471 - DNA, 17 bp, Homo sapiens
attgtataacaggttat

SEQ ID NO: 5286472 - DNA, 15 bp, Homo sapiens
attgtatagagatat

SEQ ID NO: 5286473 - DNA, 18 bp, Homo sapiens
attgtatagatataatga

SEQ ID NO: 5286474 - DNA, 23 bp, Homo sapiens
attgtataggccatctgtaaata

SEQ ID NO: 5286475 - DNA, 11 bp, Homo sapiens
attgtatatat

SEQ ID NO: 5286476 - DNA, 15 bp, Homo sapiens
attgtatatatgtgt

SEQ ID NO: 5286477 - DNA, 15 bp, Homo sapiens
attgtatattacaat

SEQ ID NO: 5286478 - DNA, 13 bp, Homo sapiens
attgtatattcac

SEQ ID NO: 5286479 - DNA, 13 bp, Homo sapiens
attgtatattctg

SEQ ID NO: 5286480 - DNA, 14 bp, Homo sapiens
attgtatattctgg

SEQ ID NO: 5286481 - DNA, 16 bp, Homo sapiens
attgtatattctggaa

SEQ ID NO: 5286482 - DNA, 18 bp, Homo sapiens
attgtatattctggaaaa

SEQ ID NO: 5286483 - DNA, 14 bp, Homo sapiens
attgtatcagaggc

SEQ ID NO: 5286484 - DNA, 14 bp, Homo sapiens
attgtatcatttga

SEQ ID NO: 5286485 - DNA, 14 bp, Homo sapiens
attgtatcctgagg

SEQ ID NO: 5286486 - DNA, 15 bp, Homo sapiens
attgtatcgatgtta

SEQ ID NO: 5286487 - DNA, 16 bp, Homo sapiens
attgtatcgtatagct

SEQ ID NO: 5286488 - DNA, 14 bp, Homo sapiens
attgtatctacatt

SEQ ID NO: 5286489 - DNA, 14 bp, Homo sapiens
attgtatctagtgc

SEQ ID NO: 5286490 - DNA, 19 bp, Homo sapiens
attgtatctagtgcagctg

SEQ ID NO: 5286491 - DNA, 18 bp, Homo sapiens
attgtatctcctttaata

SEQ ID NO: 5286492 - DNA, 13 bp, Homo sapiens
attgtatcttcat

SEQ ID NO: 5286493 - DNA, 12 bp, Homo sapiens
attgtatgaaaa

SEQ ID NO: 5286494 - DNA, 17 bp, Homo sapiens
attgtatgaagtttgaa

SEQ ID NO: 5286495 - DNA, 13 bp, Homo sapiens
attgtatgatgtg

SEQ ID NO: 5286496 - DNA, 14 bp, Homo sapiens
attgtatgcaggga

SEQ ID NO: 5286497 - DNA, 14 bp, Homo sapiens
attgtatgtaagta

SEQ ID NO: 5286498 - DNA, 14 bp, Homo sapiens
attgtatgtacctg

SEQ ID NO: 5286499 - DNA, 15 bp, Homo sapiens
attgtatgtggtcat

SEQ ID NO: 5286500 - DNA, 13 bp, Homo sapiens
attgtatgttaat

SEQ ID NO: 5286501 - DNA, 18 bp, Homo sapiens
attgtatgttgaggatct

SEQ ID NO: 5286502 - DNA, 15 bp, Homo sapiens
attgtattaggaaaa

SEQ ID NO: 5286503 - DNA, 18 bp, Homo sapiens
attgtattatcatatatg

SEQ ID NO: 5286504 - DNA, 13 bp, Homo sapiens
attgtattcagag

SEQ ID NO: 5286505 - DNA, 21 bp, Homo sapiens
attgtattcctcacattcaca

SEQ ID NO: 5286506 - DNA, 18 bp, Homo sapiens
attgtattgaaaacactt

SEQ ID NO: 5286507 - DNA, 16 bp, Homo sapiens
attgtatttaaaggta

SEQ ID NO: 5286508 - DNA, 21 bp, Homo sapiens
attgtatttaagacataaaca

SEQ ID NO: 5286509 - DNA, 18 bp, Homo sapiens
attgtatttagtgacaaa

SEQ ID NO: 5286510 - DNA, 11 bp, Homo sapiens
attgtatttat

SEQ ID NO: 5286511 - DNA, 15 bp, Homo sapiens
attgtatttatgtgt

SEQ ID NO: 5286512 - DNA, 16 bp, Homo sapiens
attgtatttattcaat

SEQ ID NO: 5286513 - DNA, 19 bp, Homo sapiens
attgtatttattcaataaa

SEQ ID NO: 5286514 - DNA, 23 bp, Homo sapiens
attgtatttattcaataaagtat

SEQ ID NO: 5286515 - DNA, 14 bp, Homo sapiens
attgtatttgtgta

SEQ ID NO: 5286516 - DNA, 13 bp, Homo sapiens
attgtattttact

SEQ ID NO: 5286517 - DNA, 22 bp, Homo sapiens
attgtattttactttgtgcaat

SEQ ID NO: 5286518 - DNA, 20 bp, Homo sapiens
attgtattttagatatattc

SEQ ID NO: 5286519 - DNA, 22 bp, Homo sapiens
attgtattttatatgagagaat

SEQ ID NO: 5286520 - DNA, 16 bp, Homo sapiens
attgtattttgatgag

SEQ ID NO: 5286521 - DNA, 19 bp, Homo sapiens
attgtcaaaaaccagaatt

SEQ ID NO: 5286522 - DNA, 18 bp, Homo sapiens
attgtcaaaattaatatg

SEQ ID NO: 5286523 - DNA, 14 bp, Homo sapiens
attgtcaaatgtca

SEQ ID NO: 5286524 - DNA, 18 bp, Homo sapiens
attgtcaacacaaactgg

SEQ ID NO: 5286525 - DNA, 18 bp, Homo sapiens
attgtcaccgcaggtgct

SEQ ID NO: 5286526 - DNA, 21 bp, Homo sapiens
attgtcacctctgttaaggtt

SEQ ID NO: 5286527 - DNA, 23 bp, Homo sapiens
attgtcacctctgttaaggttga

SEQ ID NO: 5286528 - DNA, 21 bp, Homo sapiens
attgtcacctgcttctctgcc

SEQ ID NO: 5286529 - DNA, 13 bp, Homo sapiens
attgtcacttttt

SEQ ID NO: 5286530 - DNA, 14 bp, Homo sapiens
attgtcagaattta

SEQ ID NO: 5286531 - DNA, 19 bp, Homo sapiens
attgtcagatcgttcattg

SEQ ID NO: 5286532 - DNA, 21 bp, Homo sapiens
attgtcagccacctccctctg

SEQ ID NO: 5286533 - DNA, 21 bp, Homo sapiens
attgtcagccatcgtcctggg

SEQ ID NO: 5286534 - DNA, 14 bp, Homo sapiens
attgtcagccttgc

SEQ ID NO: 5286535 - DNA, 13 bp, Homo sapiens
attgtcagctact

SEQ ID NO: 5286536 - DNA, 19 bp, Homo sapiens
attgtcagctactaatgat

SEQ ID NO: 5286537 - DNA, 16 bp, Homo sapiens
attgtcagtcctacaa

SEQ ID NO: 5286538 - DNA, 16 bp, Homo sapiens
attgtcagtgattttg

SEQ ID NO: 5286539 - DNA, 14 bp, Homo sapiens
attgtcagttttgt

SEQ ID NO: 5286540 - DNA, 13 bp, Homo sapiens
attgtcattaaag

SEQ ID NO: 5286541 - DNA, 15 bp, Homo sapiens
attgtcattaaaggt

SEQ ID NO: 5286542 - DNA, 16 bp, Homo sapiens
attgtcattactgcct

SEQ ID NO: 5286543 - DNA, 17 bp, Homo sapiens
attgtcattactgcctt

SEQ ID NO: 5286544 - DNA, 18 bp, Homo sapiens
attgtcattactgccttt

SEQ ID NO: 5286545 - DNA, 23 bp, Homo sapiens
attgtcattcctgtattcacccg

SEQ ID NO: 5286546 - DNA, 13 bp, Homo sapiens
attgtcatttata

SEQ ID NO: 5286547 - DNA, 14 bp, Homo sapiens
attgtccaaagttt

SEQ ID NO: 5286548 - DNA, 18 bp, Homo sapiens
attgtccaatcctatgtt

SEQ ID NO: 5286549 - DNA, 15 bp, Homo sapiens
attgtccacaaatgt

SEQ ID NO: 5286550 - DNA, 13 bp, Homo sapiens
attgtccagagct

SEQ ID NO: 5286551 - DNA, 19 bp, Homo sapiens
attgtccagagctgcttcc

SEQ ID NO: 5286552 - DNA, 13 bp, Homo sapiens
attgtccagctgg

SEQ ID NO: 5286553 - DNA, 20 bp, Homo sapiens
attgtccaggtgaggcccaa

SEQ ID NO: 5286554 - DNA, 22 bp, Homo sapiens
attgtccatatcagacctctga

SEQ ID NO: 5286555 - DNA, 23 bp, Homo sapiens
attgtccatatcagacctctgat

SEQ ID NO: 5286556 - DNA, 17 bp, Homo sapiens
attgtccatgtgcttcc

SEQ ID NO: 5286557 - DNA, 15 bp, Homo sapiens
attgtccattccaat

SEQ ID NO: 5286558 - DNA, 20 bp, Homo sapiens
attgtccccgacccttgccg

SEQ ID NO: 5286559 - DNA, 16 bp, Homo sapiens
attgtccctgtttcaa

SEQ ID NO: 5286560 - DNA, 14 bp, Homo sapiens
attgtcctaagtgt

SEQ ID NO: 5286561 - DNA, 23 bp, Homo sapiens
attgtcctattagtgttatatga

SEQ ID NO: 5286562 - DNA, 18 bp, Homo sapiens
attgtcctcatttctcca

SEQ ID NO: 5286563 - DNA, 21 bp, Homo sapiens
attgtcctcccctattttaag

SEQ ID NO: 5286564 - DNA, 23 bp, Homo sapiens
attgtcctcccctattttaagac

SEQ ID NO: 5286565 - DNA, 14 bp, Homo sapiens
attgtcctgtagct

SEQ ID NO: 5286566 - DNA, 12 bp, Homo sapiens
attgtcctgtgt

SEQ ID NO: 5286567 - DNA, 14 bp, Homo sapiens
attgtcctgtttct

SEQ ID NO: 5286568 - DNA, 14 bp, Homo sapiens
attgtccttcagag

SEQ ID NO: 5286569 - DNA, 23 bp, Homo sapiens
attgtccttgaagcttgtatctg

SEQ ID NO: 5286570 - DNA, 21 bp, Homo sapiens
attgtccttggaggaaactta

SEQ ID NO: 5286571 - DNA, 14 bp, Homo sapiens
attgtccttgtgta

SEQ ID NO: 5286572 - DNA, 14 bp, Homo sapiens
attgtccttttctc

SEQ ID NO: 5286573 - DNA, 17 bp, Homo sapiens
attgtcgctatgtgact

SEQ ID NO: 5286574 - DNA, 18 bp, Homo sapiens
attgtcgctatgtgactt

SEQ ID NO: 5286575 - DNA, 15 bp, Homo sapiens
attgtcgctattgat

SEQ ID NO: 5286576 - DNA, 18 bp, Homo sapiens
attgtctacatagtgaca

SEQ ID NO: 5286577 - DNA, 16 bp, Homo sapiens
attgtctactctgaag

SEQ ID NO: 5286578 - DNA, 19 bp, Homo sapiens
attgtctagggtgttctgt

SEQ ID NO: 5286579 - DNA, 14 bp, Homo sapiens
attgtctatttatc

SEQ ID NO: 5286580 - DNA, 18 bp, Homo sapiens
attgtctcaaagcatcaa

SEQ ID NO: 5286581 - DNA, 14 bp, Homo sapiens
attgtctcaacgcc

SEQ ID NO: 5286582 - DNA, 12 bp, Homo sapiens
attgtctcagag

SEQ ID NO: 5286583 - DNA, 14 bp, Homo sapiens
attgtctcagagca

SEQ ID NO: 5286584 - DNA, 15 bp, Homo sapiens
attgtctcagggccg

SEQ ID NO: 5286585 - DNA, 16 bp, Homo sapiens
attgtctcagtgctgg

SEQ ID NO: 5286586 - DNA, 14 bp, Homo sapiens
attgtctcattgcc

SEQ ID NO: 5286587 - DNA, 16 bp, Homo sapiens
attgtctcccttccag

SEQ ID NO: 5286588 - DNA, 22 bp, Homo sapiens
attgtctcctatatatttctat

SEQ ID NO: 5286589 - DNA, 18 bp, Homo sapiens
attgtctcgtttgtgatt

SEQ ID NO: 5286590 - DNA, 19 bp, Homo sapiens
attgtctcgtttgtgattc

SEQ ID NO: 5286591 - DNA, 13 bp, Homo sapiens
attgtctcttcat

SEQ ID NO: 5286592 - DNA, 16 bp, Homo sapiens
attgtctgaaattttc

SEQ ID NO: 5286593 - DNA, 18 bp, Homo sapiens
attgtctgacttctcagg

SEQ ID NO: 5286594 - DNA, 17 bp, Homo sapiens
attgtctgattgaaaca

SEQ ID NO: 5286595 - DNA, 23 bp, Homo sapiens
attgtctgattgaaacatgaaac

SEQ ID NO: 5286596 - DNA, 18 bp, Homo sapiens
attgtctgctgcctccaa

SEQ ID NO: 5286597 - DNA, 13 bp, Homo sapiens
attgtctgtaaaa

SEQ ID NO: 5286598 - DNA, 13 bp, Homo sapiens
attgtctgtaaat

SEQ ID NO: 5286599 - DNA, 14 bp, Homo sapiens
attgtctgtctgct

SEQ ID NO: 5286600 - DNA, 18 bp, Homo sapiens
attgtctgtctgctctta

SEQ ID NO: 5286601 - DNA, 18 bp, Homo sapiens
attgtctgttttccttct

SEQ ID NO: 5286602 - DNA, 16 bp, Homo sapiens
attgtcttaatattgt

SEQ ID NO: 5286603 - DNA, 23 bp, Homo sapiens
attgtcttaatggatgaaatcat

SEQ ID NO: 5286604 - DNA, 17 bp, Homo sapiens
attgtcttccaacccca

SEQ ID NO: 5286605 - DNA, 18 bp, Homo sapiens
attgtcttccaaccccag

SEQ ID NO: 5286606 - DNA, 19 bp, Homo sapiens
attgtcttccaaccccagc

SEQ ID NO: 5286607 - DNA, 17 bp, Homo sapiens
attgtcttgcaacttca

SEQ ID NO: 5286608 - DNA, 21 bp, Homo sapiens
attgtcttgttatgtacaaac

SEQ ID NO: 5286609 - DNA, 22 bp, Homo sapiens
attgtcttgttatgtacaaact

SEQ ID NO: 5286610 - DNA, 15 bp, Homo sapiens
attgtcttgttctgt

SEQ ID NO: 5286611 - DNA, 23 bp, Homo sapiens
attgtcttgttctgtcccttcca

SEQ ID NO: 5286612 - DNA, 20 bp, Homo sapiens
attgtctttaaaaactgttt

SEQ ID NO: 5286613 - DNA, 17 bp, Homo sapiens
attgtctttatatgaac

SEQ ID NO: 5286614 - DNA, 17 bp, Homo sapiens
attgtctttatttttat

SEQ ID NO: 5286615 - DNA, 16 bp, Homo sapiens
attgtctttcctccct

SEQ ID NO: 5286616 - DNA, 12 bp, Homo sapiens
attgtctttgct

SEQ ID NO: 5286617 - DNA, 13 bp, Homo sapiens
attgtctttgctg

SEQ ID NO: 5286618 - DNA, 18 bp, Homo sapiens
attgtctttggtgctttt

SEQ ID NO: 5286619 - DNA, 14 bp, Homo sapiens
attgtctttgttat

SEQ ID NO: 5286620 - DNA, 21 bp, Homo sapiens
attgtcttttagacaactaga

SEQ ID NO: 5286621 - DNA, 12 bp, Homo sapiens
attgtgaaaaaa

SEQ ID NO: 5286622 - DNA, 17 bp, Homo sapiens
attgtgaaagctccatg

SEQ ID NO: 5286623 - DNA, 14 bp, Homo sapiens
attgtgaaatagtc

SEQ ID NO: 5286624 - DNA, 17 bp, Homo sapiens
caaagcctccagcatct

SEQ ID NO: 5286625 - DNA, 14 bp, Homo sapiens
caaagcctcctttt

SEQ ID NO: 5286626 - DNA, 13 bp, Homo sapiens
caaagcctctgaa

SEQ ID NO: 5286627 - DNA, 14 bp, Homo sapiens
caaagcctcttatt

SEQ ID NO: 5286628 - DNA, 18 bp, Homo sapiens
caaagcctcttcaaaaag

SEQ ID NO: 5286629 - DNA, 13 bp, Homo sapiens
caaagcctggcct

SEQ ID NO: 5286630 - DNA, 19 bp, Homo sapiens
caaagcctgttcatggcag

SEQ ID NO: 5286631 - DNA, 16 bp, Homo sapiens
caaagccttaagcaaa

SEQ ID NO: 5286632 - DNA, 14 bp, Homo sapiens
caaagccttacaca

SEQ ID NO: 5286633 - DNA, 18 bp, Homo sapiens
caaagccttatcaagtgt

SEQ ID NO: 5286634 - DNA, 14 bp, Homo sapiens
caaagcctttaaat

SEQ ID NO: 5286635 - DNA, 14 bp, Homo sapiens
caaagcgacagatt

SEQ ID NO: 5286636 - DNA, 17 bp, Homo sapiens
caaagcgacagattcat

SEQ ID NO: 5286637 - DNA, 17 bp, Homo sapiens
caaagcgctaagtaaaa

SEQ ID NO: 5286638 - DNA, 19 bp, Homo sapiens
caaagcgctaagtaaaaat

SEQ ID NO: 5286639 - DNA, 21 bp, Homo sapiens
caaagcgggacgccgcaggtg

SEQ ID NO: 5286640 - DNA, 13 bp, Homo sapiens
caaagcgggggga

SEQ ID NO: 5286641 - DNA, 16 bp, Homo sapiens
caaagcggggggaggg

SEQ ID NO: 5286642 - DNA, 16 bp, Homo sapiens
caaagcggttgcttct

SEQ ID NO: 5286643 - DNA, 15 bp, Homo sapiens
caaagcgtttcttta

SEQ ID NO: 5286644 - DNA, 15 bp, Homo sapiens
caaagctaaaataaa

SEQ ID NO: 5286645 - DNA, 14 bp, Homo sapiens
caaagctaaaatat

SEQ ID NO: 5286646 - DNA, 17 bp, Homo sapiens
caaagctaaaatatata

SEQ ID NO: 5286647 - DNA, 15 bp, Homo sapiens
caaagctacaggact

SEQ ID NO: 5286648 - DNA, 16 bp, Homo sapiens
caaagctaggaaaggc

SEQ ID NO: 5286649 - DNA, 19 bp, Homo sapiens
caaagctaggaaaggcaga

SEQ ID NO: 5286650 - DNA, 20 bp, Homo sapiens
caaagctaggaaaggcagaa

SEQ ID NO: 5286651 - DNA, 18 bp, Homo sapiens
caaagctaggatggttct

SEQ ID NO: 5286652 - DNA, 18 bp, Homo sapiens
caaagctaggcctggcca

SEQ ID NO: 5286653 - DNA, 19 bp, Homo sapiens
caaagctctgtggccacat

SEQ ID NO: 5286654 - DNA, 13 bp, Homo sapiens
caaagctgaaaat

SEQ ID NO: 5286655 - DNA, 19 bp, Homo sapiens
caaagctgaaaatgtgtat

SEQ ID NO: 5286656 - DNA, 16 bp, Homo sapiens
caaagctgaatatttt

SEQ ID NO: 5286657 - DNA, 18 bp, Homo sapiens
caaagctgacgaggctgg

SEQ ID NO: 5286658 - DNA, 24 bp, Homo sapiens
caaagctgagcctgcagggaagcc

SEQ ID NO: 5286659 - DNA, 21 bp, Homo sapiens
caaagctgattttttttttaa

SEQ ID NO: 5286660 - DNA, 11 bp, Homo sapiens
caaagctgcct

SEQ ID NO: 5286661 - DNA, 12 bp, Homo sapiens
caaagctgcctg

SEQ ID NO: 5286662 - DNA, 15 bp, Homo sapiens
caaagctgcctgtgc

SEQ ID NO: 5286663 - DNA, 15 bp, Homo sapiens
caaagctgctgggcc

SEQ ID NO: 5286664 - DNA, 23 bp, Homo sapiens
caaagctgctgggccagtggcac

SEQ ID NO: 5286665 - DNA, 15 bp, Homo sapiens
caaagctgctttctt

SEQ ID NO: 5286666 - DNA, 18 bp, Homo sapiens
caaagctgttaaactgtt

SEQ ID NO: 5286667 - DNA, 15 bp, Homo sapiens
caaagcttaaaaaga

SEQ ID NO: 5286668 - DNA, 14 bp, Homo sapiens
caaagcttagcagg

SEQ ID NO: 5286669 - DNA, 13 bp, Homo sapiens
caaagcttcccct

SEQ ID NO: 5286670 - DNA, 20 bp, Homo sapiens
caaagcttctatcccaggag

SEQ ID NO: 5286671 - DNA, 19 bp, Homo sapiens
caaagcttggaagagcctg

SEQ ID NO: 5286672 - DNA, 18 bp, Homo sapiens
caaagcttgtcaaagatg

SEQ ID NO: 5286673 - DNA, 20 bp, Homo sapiens
caaagcttgtcaaagatgcc

SEQ ID NO: 5286674 - DNA, 15 bp, Homo sapiens
caaagcttgtggagg

SEQ ID NO: 5286675 - DNA, 21 bp, Homo sapiens
caaagctttactactgtggaa

SEQ ID NO: 5286676 - DNA, 13 bp, Homo sapiens
caaagctttcctg

SEQ ID NO: 5286677 - DNA, 18 bp, Homo sapiens
caaagctttcctgcccca

SEQ ID NO: 5286678 - DNA, 22 bp, Homo sapiens
caaagctttcctgccccaggcc

SEQ ID NO: 5286679 - DNA, 23 bp, Homo sapiens
caaagctttcctgccccaggcct

SEQ ID NO: 5286680 - DNA, 15 bp, Homo sapiens
caaagctttcctgga

SEQ ID NO: 5286681 - DNA, 18 bp, Homo sapiens
caaagctttcctgtttcc

SEQ ID NO: 5286682 - DNA, 18 bp, Homo sapiens
caaagctttcttttctaa

SEQ ID NO: 5286683 - DNA, 14 bp, Homo sapiens
caaagctttgctac

SEQ ID NO: 5286684 - DNA, 16 bp, Homo sapiens
caaagcttttagaaat

SEQ ID NO: 5286685 - DNA, 21 bp, Homo sapiens
caaagcttttgcctgcaagag

SEQ ID NO: 5286686 - DNA, 14 bp, Homo sapiens
caaagcttttgtaa

SEQ ID NO: 5286687 - DNA, 20 bp, Homo sapiens
caaagctttttgaaaaccaa

SEQ ID NO: 5286688 - DNA, 19 bp, Homo sapiens
caaaggaaaaagtatcatg

SEQ ID NO: 5286689 - DNA, 23 bp, Homo sapiens
caaaggaaagagcagtctatcat

SEQ ID NO: 5286690 - DNA, 11 bp, Homo sapiens
caaaggaaagg

SEQ ID NO: 5286691 - DNA, 19 bp, Homo sapiens
caaaggaactttctggtcc

SEQ ID NO: 5286692 - DNA, 21 bp, Homo sapiens
caaaggaactttctggtccct

SEQ ID NO: 5286693 - DNA, 24 bp, Homo sapiens
caaaggaactttctggtcccttca

SEQ ID NO: 5286694 - DNA, 23 bp, Homo sapiens
caaaggaacttttaaaagattat

SEQ ID NO: 5286695 - DNA, 23 bp, Homo sapiens
caaaggaagctttctctgcttca

SEQ ID NO: 5286696 - DNA, 11 bp, Homo sapiens
caaaggaagtg

SEQ ID NO: 5286697 - DNA, 20 bp, Homo sapiens
caaaggaataacctttctgg

SEQ ID NO: 5286698 - DNA, 22 bp, Homo sapiens
caaaggaatataagaaaagtaa

SEQ ID NO: 5286699 - DNA, 22 bp, Homo sapiens
caaaggaatcgtttcaaatgga

SEQ ID NO: 5286700 - DNA, 22 bp, Homo sapiens
caaaggaatctccagttttcag

SEQ ID NO: 5286701 - DNA, 12 bp, Homo sapiens
caaaggacacaa

SEQ ID NO: 5286702 - DNA, 16 bp, Homo sapiens
caaaggaccagcgtcc

SEQ ID NO: 5286703 - DNA, 17 bp, Homo sapiens
caaaggactgacctgcc

SEQ ID NO: 5286704 - DNA, 12 bp, Homo sapiens
caaaggagaaaa

SEQ ID NO: 5286705 - DNA, 14 bp, Homo sapiens
caaaggagaaaaaa

SEQ ID NO: 5286706 - DNA, 18 bp, Homo sapiens
caaaggagaaaaaaaacc

SEQ ID NO: 5286707 - DNA, 22 bp, Homo sapiens
caaaggagaaaaaaaaccttgt

SEQ ID NO: 5286708 - DNA, 14 bp, Homo sapiens
caaaggagacatat

SEQ ID NO: 5286709 - DNA, 15 bp, Homo sapiens
caaaggagacatatc

SEQ ID NO: 5286710 - DNA, 22 bp, Homo sapiens
caaaggagacccgccccagggc

SEQ ID NO: 5286711 - DNA, 16 bp, Homo sapiens
caaaggagagtcaaca

SEQ ID NO: 5286712 - DNA, 20 bp, Homo sapiens
caaaggagataaatctagta

SEQ ID NO: 5286713 - DNA, 13 bp, Homo sapiens
caaaggagccttg

SEQ ID NO: 5286714 - DNA, 22 bp, Homo sapiens
caaaggagctttctcaatgtct

SEQ ID NO: 5286715 - DNA, 18 bp, Homo sapiens
caaaggaggacaagaccc

SEQ ID NO: 5286716 - DNA, 13 bp, Homo sapiens
caaaggagggcct

SEQ ID NO: 5286717 - DNA, 19 bp, Homo sapiens
caaaggagggcctcagaga

SEQ ID NO: 5286718 - DNA, 21 bp, Homo sapiens
caaaggagggcctcagagaca

SEQ ID NO: 5286719 - DNA, 14 bp, Homo sapiens
caaaggataaattt

SEQ ID NO: 5286720 - DNA, 21 bp, Homo sapiens
caaaggatacttatttaaata

SEQ ID NO: 5286721 - DNA, 22 bp, Homo sapiens
caaaggatagtgcgatgtttca

SEQ ID NO: 5286722 - DNA, 20 bp, Homo sapiens
caaaggatctttgttcctct

SEQ ID NO: 5286723 - DNA, 19 bp, Homo sapiens
caaaggatgggggaaagaa

SEQ ID NO: 5286724 - DNA, 13 bp, Homo sapiens
caaaggatgtgat

SEQ ID NO: 5286725 - DNA, 22 bp, Homo sapiens
caaaggatgtgttttcagtctt

SEQ ID NO: 5286726 - DNA, 15 bp, Homo sapiens
caaaggatttgaaaa

SEQ ID NO: 5286727 - DNA, 19 bp, Homo sapiens
caaaggattttggaaaaga

SEQ ID NO: 5286728 - DNA, 20 bp, Homo sapiens
caaaggattttggaaaagaa

SEQ ID NO: 5286729 - DNA, 23 bp, Homo sapiens
caaaggattttggaaaagaaaca

SEQ ID NO: 5286730 - DNA, 13 bp, Homo sapiens
caaaggcaagact

SEQ ID NO: 5286731 - DNA, 20 bp, Homo sapiens
caaaggcacagtgaaggctg

SEQ ID NO: 5286732 - DNA, 13 bp, Homo sapiens
caaaggcagagga

SEQ ID NO: 5286733 - DNA, 14 bp, Homo sapiens
caaaggcagaggaa

SEQ ID NO: 5286734 - DNA, 12 bp, Homo sapiens
caaaggcagctg

SEQ ID NO: 5286735 - DNA, 15 bp, Homo sapiens
caaaggcagctgtgt

SEQ ID NO: 5286736 - DNA, 20 bp, Homo sapiens
caaaggcaggaggtgggtga

SEQ ID NO: 5286737 - DNA, 12 bp, Homo sapiens
caaaggcagggc

SEQ ID NO: 5286738 - DNA, 16 bp, Homo sapiens
caaaggcagtcccggg

SEQ ID NO: 5286739 - DNA, 17 bp, Homo sapiens
caaaggcagtcccggga

SEQ ID NO: 5286740 - DNA, 17 bp, Homo sapiens
caaaggcatccaggcca

SEQ ID NO: 5286741 - DNA, 15 bp, Homo sapiens
caaaggcatcccagc

SEQ ID NO: 5286742 - DNA, 17 bp, Homo sapiens
caaaggcatcccagcct

SEQ ID NO: 5286743 - DNA, 18 bp, Homo sapiens
caaaggcatcccagcctg

SEQ ID NO: 5286744 - DNA, 20 bp, Homo sapiens
caaaggcatcccagcctggg

SEQ ID NO: 5286745 - DNA, 22 bp, Homo sapiens
caaaggcatgcagtcatgagaa

SEQ ID NO: 5286746 - DNA, 15 bp, Homo sapiens
caaaggcatgctgga

SEQ ID NO: 5286747 - DNA, 13 bp, Homo sapiens
caaaggccaaact

SEQ ID NO: 5286748 - DNA, 15 bp, Homo sapiens
caaaggccaaactgc

SEQ ID NO: 5286749 - DNA, 19 bp, Homo sapiens
caaaggccacatacctctc

SEQ ID NO: 5286750 - DNA, 16 bp, Homo sapiens
caaaggccagcagcag

SEQ ID NO: 5286751 - DNA, 15 bp, Homo sapiens
caaaggccagggtca

SEQ ID NO: 5286752 - DNA, 16 bp, Homo sapiens
caaaggcccagggagg

SEQ ID NO: 5286753 - DNA, 19 bp, Homo sapiens
caaaggcccagggaggcag

SEQ ID NO: 5286754 - DNA, 14 bp, Homo sapiens
caaaggccctacca

SEQ ID NO: 5286755 - DNA, 19 bp, Homo sapiens
caaaggccctaccagaggg

SEQ ID NO: 5286756 - DNA, 15 bp, Homo sapiens
caaaggccctcagtg

SEQ ID NO: 5286757 - DNA, 23 bp, Homo sapiens
caaaggccctcagtgagataaat

SEQ ID NO: 5286758 - DNA, 13 bp, Homo sapiens
caaaggccctggg

SEQ ID NO: 5286759 - DNA, 23 bp, Homo sapiens
caaaggcctaattctatgcctgt

SEQ ID NO: 5286760 - DNA, 21 bp, Homo sapiens
caaaggcggggtggcggtgga

SEQ ID NO: 5286761 - DNA, 15 bp, Homo sapiens
caaaggctccctcgc

SEQ ID NO: 5286762 - DNA, 21 bp, Homo sapiens
caaaggctccctcgccctgtg

SEQ ID NO: 5286763 - DNA, 22 bp, Homo sapiens
caaaggctgacattcactgagt

SEQ ID NO: 5286764 - DNA, 15 bp, Homo sapiens
caaaggctttgccct

SEQ ID NO: 5286765 - DNA, 21 bp, Homo sapiens
caaaggctttgccctgctgcc

SEQ ID NO: 5286766 - DNA, 14 bp, Homo sapiens
caaagggaaaaaag

SEQ ID NO: 5286767 - DNA, 22 bp, Homo sapiens
caaagggaagcagagcctgggg

SEQ ID NO: 5286768 - DNA, 23 bp, Homo sapiens
caaagggaaggctgctgtgtagc

SEQ ID NO: 5286769 - DNA, 20 bp, Homo sapiens
caaagggaagtaacagacac

SEQ ID NO: 5286770 - DNA, 20 bp, Homo sapiens
caaagggacacacagtgaca

SEQ ID NO: 5286771 - DNA, 23 bp, Homo sapiens
caaagggacacacagtgacaaaa

SEQ ID NO: 5286772 - DNA, 17 bp, Homo sapiens
caaagggacttttgtaa

SEQ ID NO: 5286773 - DNA, 21 bp, Homo sapiens
caaagggacttttgtaaaatc

SEQ ID NO: 5286774 - DNA, 21 bp, Homo sapiens
caaagggagagaaaagctgga

SEQ ID NO: 5286775 - DNA, 14 bp, Homo sapiens
caaagggagagaga

SEQ ID NO: 5286776 - DNA, 23 bp, Homo sapiens
caaagggagggagcaagccctac

SEQ ID NO: 5286777 - DNA, 20 bp, Homo sapiens
caaagggagggtggcagaga

SEQ ID NO: 5286778 - DNA, 23 bp, Homo sapiens
caaagggagggtggcagagacag

SEQ ID NO: 5286779 - DNA, 20 bp, Homo sapiens
caaagggcacagcatctgta

SEQ ID NO: 5286780 - DNA, 13 bp, Homo sapiens
caaagggcagttt

SEQ ID NO: 5286781 - DNA, 22 bp, Homo sapiens
caaagggcataccttgtgcatt

SEQ ID NO: 5286782 - DNA, 22 bp, Homo sapiens
caaagggcatgggtcgggagag

SEQ ID NO: 5286783 - DNA, 23 bp, Homo sapiens
caaagggcatgggtcgggagagg

SEQ ID NO: 5286784 - DNA, 20 bp, Homo sapiens
caaagggccatcgttcatcc

SEQ ID NO: 5286785 - DNA, 13 bp, Homo sapiens
caaagggcctcct

SEQ ID NO: 5286786 - DNA, 14 bp, Homo sapiens
caaagggcgggcct

SEQ ID NO: 5286787 - DNA, 14 bp, Homo sapiens
caaagggctgaaag

SEQ ID NO: 5286788 - DNA, 12 bp, Homo sapiens
caaagggctgcc

SEQ ID NO: 5286789 - DNA, 13 bp, Homo sapiens
caaaggggacagc

SEQ ID NO: 5286790 - DNA, 18 bp, Homo sapiens
caaaggggacctggaagg

SEQ ID NO: 5286791 - DNA, 22 bp, Homo sapiens
caaaggggagaagggccagccc

SEQ ID NO: 5286792 - DNA, 19 bp, Homo sapiens
caaaggggagccagaaatg

SEQ ID NO: 5286793 - DNA, 14 bp, Homo sapiens
caaaggggctgctg

SEQ ID NO: 5286794 - DNA, 17 bp, Homo sapiens
caaaggggctgctgggg

SEQ ID NO: 5286795 - DNA, 22 bp, Homo sapiens
caaagggggaggagaagaaaat

SEQ ID NO: 5286796 - DNA, 18 bp, Homo sapiens
caaagggtatcaggtgct

SEQ ID NO: 5286797 - DNA, 19 bp, Homo sapiens
caaagggtatcaggtgctg

SEQ ID NO: 5286798 - DNA, 20 bp, Homo sapiens
caaagggtatcaggtgctgc

SEQ ID NO: 5286799 - DNA, 23 bp, Homo sapiens
caaagggtatcaggtgctgccat

SEQ ID NO: 5286800 - DNA, 16 bp, Homo sapiens
caaagggtccagaagg

SEQ ID NO: 5286801 - DNA, 19 bp, Homo sapiens
caaagggtcttttgcagct

SEQ ID NO: 5286802 - DNA, 15 bp, Homo sapiens
attgtgaaatttgtt

SEQ ID NO: 5286803 - DNA, 17 bp, Homo sapiens
attgtgaaatttgttaa

SEQ ID NO: 5286804 - DNA, 15 bp, Homo sapiens
attgtgaacagccaa

SEQ ID NO: 5286805 - DNA, 12 bp, Homo sapiens
attgtgaacatg

SEQ ID NO: 5286806 - DNA, 16 bp, Homo sapiens
attgtgaactgacagg

SEQ ID NO: 5286807 - DNA, 14 bp, Homo sapiens
attgtgaagtacat

SEQ ID NO: 5286808 - DNA, 23 bp, Homo sapiens
attgtgaagtgatgttcagattt

SEQ ID NO: 5286809 - DNA, 18 bp, Homo sapiens
attgtgaatatttggaat

SEQ ID NO: 5286810 - DNA, 22 bp, Homo sapiens
attgtgaatcgattcccaagct

SEQ ID NO: 5286811 - DNA, 16 bp, Homo sapiens
attgtgaattgcctgc

SEQ ID NO: 5286812 - DNA, 18 bp, Homo sapiens
attgtgaattgcctgcca

SEQ ID NO: 5286813 - DNA, 20 bp, Homo sapiens
attgtgaattgcctgccatg

SEQ ID NO: 5286814 - DNA, 18 bp, Homo sapiens
attgtgacagagccatgg

SEQ ID NO: 5286815 - DNA, 20 bp, Homo sapiens
attgtgaccaatacatttgt

SEQ ID NO: 5286816 - DNA, 22 bp, Homo sapiens
attgtgaccaatacatttgtat

SEQ ID NO: 5286817 - DNA, 22 bp, Homo sapiens
attgtgaccactgaattcactc

SEQ ID NO: 5286818 - DNA, 17 bp, Homo sapiens
attgtgacgattattta

SEQ ID NO: 5286819 - DNA, 15 bp, Homo sapiens
attgtgacttcactg

SEQ ID NO: 5286820 - DNA, 19 bp, Homo sapiens
attgtgagatcctgtgatt

SEQ ID NO: 5286821 - DNA, 16 bp, Homo sapiens
attgtgagggacatgc

SEQ ID NO: 5286822 - DNA, 23 bp, Homo sapiens
attgtgatcagaccataatgtta

SEQ ID NO: 5286823 - DNA, 14 bp, Homo sapiens
attgtgatgtatat

SEQ ID NO: 5286824 - DNA, 19 bp, Homo sapiens
attgtgatgtatattcctt

SEQ ID NO: 5286825 - DNA, 13 bp, Homo sapiens
attgtgatgtgtc

SEQ ID NO: 5286826 - DNA, 14 bp, Homo sapiens
attgtgatgtgtcc

SEQ ID NO: 5286827 - DNA, 13 bp, Homo sapiens
attgtgatgtttt

SEQ ID NO: 5286828 - DNA, 14 bp, Homo sapiens
attgtgatgttttg

SEQ ID NO: 5286829 - DNA, 19 bp, Homo sapiens
attgtgatgttttgttcaa

SEQ ID NO: 5286830 - DNA, 20 bp, Homo sapiens
attgtgattacgtgtatgtt

SEQ ID NO: 5286831 - DNA, 16 bp, Homo sapiens
attgtgattagacaga

SEQ ID NO: 5286832 - DNA, 15 bp, Homo sapiens
attgtgattggcctg

SEQ ID NO: 5286833 - DNA, 16 bp, Homo sapiens
attgtgattggcctgt

SEQ ID NO: 5286834 - DNA, 12 bp, Homo sapiens
attgtgatttga

SEQ ID NO: 5286835 - DNA, 15 bp, Homo sapiens
attgtgcaaaatatt

SEQ ID NO: 5286836 - DNA, 15 bp, Homo sapiens
attgtgcaatgtaaa

SEQ ID NO: 5286837 - DNA, 17 bp, Homo sapiens
attgtgcaatgtaaata

SEQ ID NO: 5286838 - DNA, 18 bp, Homo sapiens
attgtgcaatgtgtataa

SEQ ID NO: 5286839 - DNA, 18 bp, Homo sapiens
attgtgcacatttaataa

SEQ ID NO: 5286840 - DNA, 20 bp, Homo sapiens
attgtgcagtactttgtgca

SEQ ID NO: 5286841 - DNA, 23 bp, Homo sapiens
attgtgcataatgctttggaaaa

SEQ ID NO: 5286842 - DNA, 12 bp, Homo sapiens
attgtgcatgca

SEQ ID NO: 5286843 - DNA, 17 bp, Homo sapiens
attgtgcattaaaatta

SEQ ID NO: 5286844 - DNA, 15 bp, Homo sapiens
attgtgcattctaga

SEQ ID NO: 5286845 - DNA, 12 bp, Homo sapiens
attgtgccaaag

SEQ ID NO: 5286846 - DNA, 21 bp, Homo sapiens
attgtgccaaagatagcagaa

SEQ ID NO: 5286847 - DNA, 18 bp, Homo sapiens
attgtgccaagccttctg

SEQ ID NO: 5286848 - DNA, 16 bp, Homo sapiens
attgtgccaatatgta

SEQ ID NO: 5286849 - DNA, 17 bp, Homo sapiens
attgtgccaatatgtat

SEQ ID NO: 5286850 - DNA, 18 bp, Homo sapiens
attgtgccatgtcaaaca

SEQ ID NO: 5286851 - DNA, 16 bp, Homo sapiens
attgtgcccctaaaga

SEQ ID NO: 5286852 - DNA, 22 bp, Homo sapiens
attgtgcccctaaagagcatcc

SEQ ID NO: 5286853 - DNA, 13 bp, Homo sapiens
attgtgccctgta

SEQ ID NO: 5286854 - DNA, 16 bp, Homo sapiens
attgtgccctgtagct

SEQ ID NO: 5286855 - DNA, 15 bp, Homo sapiens
attgtgcctatgata

SEQ ID NO: 5286856 - DNA, 19 bp, Homo sapiens
attgtgccttactaaatat

SEQ ID NO: 5286857 - DNA, 15 bp, Homo sapiens
attgtgctccaaatg

SEQ ID NO: 5286858 - DNA, 16 bp, Homo sapiens
attgtgctccaaatgt

SEQ ID NO: 5286859 - DNA, 18 bp, Homo sapiens
attgtgctccaaatgtct

SEQ ID NO: 5286860 - DNA, 15 bp, Homo sapiens
attgtgcttcacagt

SEQ ID NO: 5286861 - DNA, 24 bp, Homo sapiens
attgtgcttcacagtagagccagc

SEQ ID NO: 5286862 - DNA, 14 bp, Homo sapiens
attgtgcttctccc

SEQ ID NO: 5286863 - DNA, 14 bp, Homo sapiens
attgtgctttctat

SEQ ID NO: 5286864 - DNA, 23 bp, Homo sapiens
attgtgctttggttaatacatct

SEQ ID NO: 5286865 - DNA, 20 bp, Homo sapiens
attgtggaaaaccaggaaaa

SEQ ID NO: 5286866 - DNA, 15 bp, Homo sapiens
attgtggaataaatc

SEQ ID NO: 5286867 - DNA, 16 bp, Homo sapiens
attgtggaataaatcc

SEQ ID NO: 5286868 - DNA, 15 bp, Homo sapiens
attgtggaatgttgg

SEQ ID NO: 5286869 - DNA, 14 bp, Homo sapiens
attgtggagaggag

SEQ ID NO: 5286870 - DNA, 16 bp, Homo sapiens
attgtggatgtgttca

SEQ ID NO: 5286871 - DNA, 21 bp, Homo sapiens
attgtggattataaaaaatgt

SEQ ID NO: 5286872 - DNA, 22 bp, Homo sapiens
attgtggattataaaaaatgta

SEQ ID NO: 5286873 - DNA, 23 bp, Homo sapiens
attgtggattataaaaaatgtaa

SEQ ID NO: 5286874 - DNA, 22 bp, Homo sapiens
attgtggcatcagataatgcca

SEQ ID NO: 5286875 - DNA, 17 bp, Homo sapiens
attgtggctatcctgat

SEQ ID NO: 5286876 - DNA, 18 bp, Homo sapiens
attgtggctatcctgatt

SEQ ID NO: 5286877 - DNA, 18 bp, Homo sapiens
attgtggctgtcagcagg

SEQ ID NO: 5286878 - DNA, 15 bp, Homo sapiens
attgtggctgttcac

SEQ ID NO: 5286879 - DNA, 13 bp, Homo sapiens
attgtgggaaggg

SEQ ID NO: 5286880 - DNA, 21 bp, Homo sapiens
attgtggggatgatgaaataa

SEQ ID NO: 5286881 - DNA, 13 bp, Homo sapiens
attgtggggtgca

SEQ ID NO: 5286882 - DNA, 20 bp, Homo sapiens
attgtgggtctatttctagt

SEQ ID NO: 5286883 - DNA, 18 bp, Homo sapiens
attgtggtacaatctcaa

SEQ ID NO: 5286884 - DNA, 23 bp, Homo sapiens
attgtggtagaaatttttaccaa

SEQ ID NO: 5286885 - DNA, 20 bp, Homo sapiens
attgtggtcacaacttgatg

SEQ ID NO: 5286886 - DNA, 14 bp, Homo sapiens
attgtggtggtgct

SEQ ID NO: 5286887 - DNA, 22 bp, Homo sapiens
attgtggtggtgctaaaggagg

SEQ ID NO: 5286888 - DNA, 23 bp, Homo sapiens
attgtggtggtgctaaaggaggc

SEQ ID NO: 5286889 - DNA, 18 bp, Homo sapiens
attgtggtgtgagcttca

SEQ ID NO: 5286890 - DNA, 20 bp, Homo sapiens
attgtggttatttttataca

SEQ ID NO: 5286891 - DNA, 22 bp, Homo sapiens
attgtggttatttttatacagt

SEQ ID NO: 5286892 - DNA, 23 bp, Homo sapiens
attgtggttccctaaagacaagt

SEQ ID NO: 5286893 - DNA, 22 bp, Homo sapiens
attgtgtaaaaaatggaaaaaa

SEQ ID NO: 5286894 - DNA, 21 bp, Homo sapiens
attgtgtaaacaaatcctgtt

SEQ ID NO: 5286895 - DNA, 14 bp, Homo sapiens
attgtgtaactgtt

SEQ ID NO: 5286896 - DNA, 14 bp, Homo sapiens
attgtgtacataga

SEQ ID NO: 5286897 - DNA, 20 bp, Homo sapiens
attgtgtacatagagcaatg

SEQ ID NO: 5286898 - DNA, 23 bp, Homo sapiens
attgtgtacatagagcaatgttg

SEQ ID NO: 5286899 - DNA, 20 bp, Homo sapiens
attgtgtaccttaagatatt

SEQ ID NO: 5286900 - DNA, 14 bp, Homo sapiens
attgtgtaggaaat

SEQ ID NO: 5286901 - DNA, 15 bp, Homo sapiens
attgtgtaggaaatc

SEQ ID NO: 5286902 - DNA, 20 bp, Homo sapiens
attgtgtatagatatttcct

SEQ ID NO: 5286903 - DNA, 19 bp, Homo sapiens
attgtgtatgagactgtgt

SEQ ID NO: 5286904 - DNA, 18 bp, Homo sapiens
attgtgtattttctttgg

SEQ ID NO: 5286905 - DNA, 22 bp, Homo sapiens
attgtgtcagaaacatgaaatg

SEQ ID NO: 5286906 - DNA, 12 bp, Homo sapiens
attgtgtctccc

SEQ ID NO: 5286907 - DNA, 21 bp, Homo sapiens
attgtgtctcttggtcctgct

SEQ ID NO: 5286908 - DNA, 23 bp, Homo sapiens
attgtgtctcttggtcctgctgc

SEQ ID NO: 5286909 - DNA, 14 bp, Homo sapiens
attgtgtctgcatt

SEQ ID NO: 5286910 - DNA, 16 bp, Homo sapiens
attgtgtcttaatctc

SEQ ID NO: 5286911 - DNA, 14 bp, Homo sapiens
attgtgtgaacttg

SEQ ID NO: 5286912 - DNA, 23 bp, Homo sapiens
attgtgtgaaggtaactaagaag

SEQ ID NO: 5286913 - DNA, 12 bp, Homo sapiens
attgtgtgaatt

SEQ ID NO: 5286914 - DNA, 18 bp, Homo sapiens
attgtgtgatatttcaga

SEQ ID NO: 5286915 - DNA, 20 bp, Homo sapiens
attgtgtgatatttcagaaa

SEQ ID NO: 5286916 - DNA, 12 bp, Homo sapiens
attgtgtgatgt

SEQ ID NO: 5286917 - DNA, 19 bp, Homo sapiens
attgtgtgcgctgcctggc

SEQ ID NO: 5286918 - DNA, 12 bp, Homo sapiens
attgtgtggaat

SEQ ID NO: 5286919 - DNA, 16 bp, Homo sapiens
attgtgtggcctggtg

SEQ ID NO: 5286920 - DNA, 20 bp, Homo sapiens
attgtgtggtcagtggctct

SEQ ID NO: 5286921 - DNA, 15 bp, Homo sapiens
attgtgtggtgcttt

SEQ ID NO: 5286922 - DNA, 14 bp, Homo sapiens
attgtgtgtctggt

SEQ ID NO: 5286923 - DNA, 15 bp, Homo sapiens
attgtgtgtctggta

SEQ ID NO: 5286924 - DNA, 19 bp, Homo sapiens
attgtgtgtgctctgcttc

SEQ ID NO: 5286925 - DNA, 20 bp, Homo sapiens
attgtgtgtgctctgcttca

SEQ ID NO: 5286926 - DNA, 12 bp, Homo sapiens
attgtgtgttag

SEQ ID NO: 5286927 - DNA, 18 bp, Homo sapiens
attgtgtgttgattgtat

SEQ ID NO: 5286928 - DNA, 20 bp, Homo sapiens
attgtgttacctgtagattc

SEQ ID NO: 5286929 - DNA, 12 bp, Homo sapiens
attgtgttcact

SEQ ID NO: 5286930 - DNA, 14 bp, Homo sapiens
attgtgttcttaaa

SEQ ID NO: 5286931 - DNA, 20 bp, Homo sapiens
attgtgttcttaaaatattg

SEQ ID NO: 5286932 - DNA, 18 bp, Homo sapiens
attgtgttgactttataa

SEQ ID NO: 5286933 - DNA, 19 bp, Homo sapiens
attgtgttgccttagcact

SEQ ID NO: 5286934 - DNA, 18 bp, Homo sapiens
attgtgtttacattttat

SEQ ID NO: 5286935 - DNA, 22 bp, Homo sapiens
attgtgtttacattttatggtg

SEQ ID NO: 5286936 - DNA, 12 bp, Homo sapiens
attgtgtttatt

SEQ ID NO: 5286937 - DNA, 22 bp, Homo sapiens
attgtgtttctaccggagagag

SEQ ID NO: 5286938 - DNA, 20 bp, Homo sapiens
attgtgtttgtgtgctgttg

SEQ ID NO: 5286939 - DNA, 19 bp, Homo sapiens
attgttaaaaaacaaccaa

SEQ ID NO: 5286940 - DNA, 20 bp, Homo sapiens
attgttaaacaaatgatttc

SEQ ID NO: 5286941 - DNA, 14 bp, Homo sapiens
attgttaaaggcta

SEQ ID NO: 5286942 - DNA, 13 bp, Homo sapiens
attgttaaataca

SEQ ID NO: 5286943 - DNA, 18 bp, Homo sapiens
attgttaaatacacatta

SEQ ID NO: 5286944 - DNA, 21 bp, Homo sapiens
attgttaaatacacattatca

SEQ ID NO: 5286945 - DNA, 13 bp, Homo sapiens
attgttaaatcct

SEQ ID NO: 5286946 - DNA, 14 bp, Homo sapiens
attgttaaatgata

SEQ ID NO: 5286947 - DNA, 16 bp, Homo sapiens
attgttaaatgataag

SEQ ID NO: 5286948 - DNA, 18 bp, Homo sapiens
attgttaaatgataaggt

SEQ ID NO: 5286949 - DNA, 17 bp, Homo sapiens
attgttaaattacattt

SEQ ID NO: 5286950 - DNA, 14 bp, Homo sapiens
attgttaaattcaa

SEQ ID NO: 5286951 - DNA, 19 bp, Homo sapiens
attgttaaatttaaaaata

SEQ ID NO: 5286952 - DNA, 22 bp, Homo sapiens
attgttaacataggcttataca

SEQ ID NO: 5286953 - DNA, 22 bp, Homo sapiens
attgttaagtctaaatatttcc

SEQ ID NO: 5286954 - DNA, 15 bp, Homo sapiens
attgttaatataatt

SEQ ID NO: 5286955 - DNA, 19 bp, Homo sapiens
attgttaatataatttaac

SEQ ID NO: 5286956 - DNA, 19 bp, Homo sapiens
attgttaatatcttcacat

SEQ ID NO: 5286957 - DNA, 20 bp, Homo sapiens
attgttaatattaatttata

SEQ ID NO: 5286958 - DNA, 15 bp, Homo sapiens
attgttaatgtgatg

SEQ ID NO: 5286959 - DNA, 15 bp, Homo sapiens
attgttaattgctga

SEQ ID NO: 5286960 - DNA, 18 bp, Homo sapiens
attgttaatttcagtcct

SEQ ID NO: 5286961 - DNA, 16 bp, Homo sapiens
attgttacaagtgttc

SEQ ID NO: 5286962 - DNA, 17 bp, Homo sapiens
attgttacaagtgttct

SEQ ID NO: 5286963 - DNA, 18 bp, Homo sapiens
attgttacaagtgttctt

SEQ ID NO: 5286964 - DNA, 16 bp, Homo sapiens
attgttacaatagaat

SEQ ID NO: 5286965 - DNA, 14 bp, Homo sapiens
attgttacaatttt

SEQ ID NO: 5286966 - DNA, 16 bp, Homo sapiens
attgttaccatgaaga

SEQ ID NO: 5286967 - DNA, 18 bp, Homo sapiens
attgttacccatttgaaa

SEQ ID NO: 5286968 - DNA, 21 bp, Homo sapiens
attgttacctgtcattttgca

SEQ ID NO: 5286969 - DNA, 15 bp, Homo sapiens
attgttactccatat

SEQ ID NO: 5286970 - DNA, 17 bp, Homo sapiens
attgttactcttacgaa

SEQ ID NO: 5286971 - DNA, 16 bp, Homo sapiens
attgttagatgtttgt

SEQ ID NO: 5286972 - DNA, 22 bp, Homo sapiens
attgttagcaaatgacagattt

SEQ ID NO: 5286973 - DNA, 16 bp, Homo sapiens
attgttagtaaacata

SEQ ID NO: 5286974 - DNA, 23 bp, Homo sapiens
attgttagttaagtttttattca

SEQ ID NO: 5286975 - DNA, 15 bp, Homo sapiens
attgttagtttctga

SEQ ID NO: 5286976 - DNA, 19 bp, Homo sapiens
attgttataaaataacatg

SEQ ID NO: 5286977 - DNA, 17 bp, Homo sapiens
attgttataaataaaat

SEQ ID NO: 5286978 - DNA, 23 bp, Homo sapiens
attgttatacctttttgaacatg

SEQ ID NO: 5286979 - DNA, 17 bp, Homo sapiens
attgttatgaaaatcct

SEQ ID NO: 5286980 - DNA, 18 bp, Homo sapiens
caaagggtgaaaattatt

SEQ ID NO: 5286981 - DNA, 19 bp, Homo sapiens
caaagggtgaagctattta

SEQ ID NO: 5286982 - DNA, 20 bp, Homo sapiens
caaagggtgaagctatttat

SEQ ID NO: 5286983 - DNA, 13 bp, Homo sapiens
caaagggtggaat

SEQ ID NO: 5286984 - DNA, 11 bp, Homo sapiens
caaagggtgtg

SEQ ID NO: 5286985 - DNA, 16 bp, Homo sapiens
caaagggttttctttt

SEQ ID NO: 5286986 - DNA, 19 bp, Homo sapiens
caaaggtaggttgaaggga

SEQ ID NO: 5286987 - DNA, 15 bp, Homo sapiens
caaaggtcttgaata

SEQ ID NO: 5286988 - DNA, 18 bp, Homo sapiens
caaaggtgcactccagac

SEQ ID NO: 5286989 - DNA, 22 bp, Homo sapiens
caaaggtgcactccagactctg

SEQ ID NO: 5286990 - DNA, 13 bp, Homo sapiens
caaaggtgcctca

SEQ ID NO: 5286991 - DNA, 17 bp, Homo sapiens
caaaggtggattacaag

SEQ ID NO: 5286992 - DNA, 17 bp, Homo sapiens
caaaggtggcaatgctt

SEQ ID NO: 5286993 - DNA, 14 bp, Homo sapiens
caaaggtggcagct

SEQ ID NO: 5286994 - DNA, 21 bp, Homo sapiens
caaaggtgggaggatcatttg

SEQ ID NO: 5286995 - DNA, 21 bp, Homo sapiens
caaaggtggtaaattcagaca

SEQ ID NO: 5286996 - DNA, 14 bp, Homo sapiens
caaaggttccattc

SEQ ID NO: 5286997 - DNA, 12 bp, Homo sapiens
caaaggttctag

SEQ ID NO: 5286998 - DNA, 16 bp, Homo sapiens
caaaggtttaaatgaa

SEQ ID NO: 5286999 - DNA, 23 bp, Homo sapiens
caaaggtttaaatgaacaagaga

SEQ ID NO: 5287000 - DNA, 20 bp, Homo sapiens
caaaggtttgaagacacagc

SEQ ID NO: 5287001 - DNA, 21 bp, Homo sapiens
caaagtaaaaaattaaagccc

SEQ ID NO: 5287002 - DNA, 23 bp, Homo sapiens
caaagtaaaaataaactgttatg

SEQ ID NO: 5287003 - DNA, 21 bp, Homo sapiens
caaagtaaaattagagcaaga

SEQ ID NO: 5287004 - DNA, 14 bp, Homo sapiens
caaagtaaactgtg

SEQ ID NO: 5287005 - DNA, 19 bp, Homo sapiens
caaagtaaagcagaggatg

SEQ ID NO: 5287006 - DNA, 17 bp, Homo sapiens
caaagtaaaggcctcct

SEQ ID NO: 5287007 - DNA, 23 bp, Homo sapiens
caaagtaaaggcctcctccccca

SEQ ID NO: 5287008 - DNA, 16 bp, Homo sapiens
caaagtaaatacaaga

SEQ ID NO: 5287009 - DNA, 20 bp, Homo sapiens
caaagtaaatacaagactgt

SEQ ID NO: 5287010 - DNA, 13 bp, Homo sapiens
caaagtacaaaat

SEQ ID NO: 5287011 - DNA, 14 bp, Homo sapiens
caaagtacaaaatt

SEQ ID NO: 5287012 - DNA, 16 bp, Homo sapiens
caaagtacaaaattgc

SEQ ID NO: 5287013 - DNA, 17 bp, Homo sapiens
caaagtacaaaattgcc

SEQ ID NO: 5287014 - DNA, 16 bp, Homo sapiens
caaagtacactgtttc

SEQ ID NO: 5287015 - DNA, 17 bp, Homo sapiens
caaagtacaggtacttt

SEQ ID NO: 5287016 - DNA, 15 bp, Homo sapiens
caaagtacattgtaa

SEQ ID NO: 5287017 - DNA, 22 bp, Homo sapiens
caaagtacattgtaaaataaag

SEQ ID NO: 5287018 - DNA, 21 bp, Homo sapiens
caaagtaccaactgagccaaa

SEQ ID NO: 5287019 - DNA, 18 bp, Homo sapiens
caaagtaccacactgaaa

SEQ ID NO: 5287020 - DNA, 19 bp, Homo sapiens
caaagtactgggattacag

SEQ ID NO: 5287021 - DNA, 13 bp, Homo sapiens
caaagtactgtaa

SEQ ID NO: 5287022 - DNA, 14 bp, Homo sapiens
caaagtactgtaag

SEQ ID NO: 5287023 - DNA, 16 bp, Homo sapiens
caaagtactgtcctca

SEQ ID NO: 5287024 - DNA, 23 bp, Homo sapiens
caaagtacttgtcatagactcct

SEQ ID NO: 5287025 - DNA, 14 bp, Homo sapiens
caaagtagaagtct

SEQ ID NO: 5287026 - DNA, 21 bp, Homo sapiens
caaagtagaagtcttagatgt

SEQ ID NO: 5287027 - DNA, 18 bp, Homo sapiens
caaagtagaatctctttt

SEQ ID NO: 5287028 - DNA, 13 bp, Homo sapiens
caaagtagagaag

SEQ ID NO: 5287029 - DNA, 16 bp, Homo sapiens
caaagtagagaagtat

SEQ ID NO: 5287030 - DNA, 20 bp, Homo sapiens
caaagtagatcatgcataga

SEQ ID NO: 5287031 - DNA, 16 bp, Homo sapiens
caaagtaggattttga

SEQ ID NO: 5287032 - DNA, 21 bp, Homo sapiens
caaagtagtacttcttctgta

SEQ ID NO: 5287033 - DNA, 22 bp, Homo sapiens
caaagtagtacttcttctgtaa

SEQ ID NO: 5287034 - DNA, 17 bp, Homo sapiens
caaagtagtcctggcag

SEQ ID NO: 5287035 - DNA, 19 bp, Homo sapiens
caaagtataaatttgtgta

SEQ ID NO: 5287036 - DNA, 20 bp, Homo sapiens
caaagtatctaacaaaacca

SEQ ID NO: 5287037 - DNA, 17 bp, Homo sapiens
caaagtattaagcatat

SEQ ID NO: 5287038 - DNA, 14 bp, Homo sapiens
caaagtattgtaaa

SEQ ID NO: 5287039 - DNA, 18 bp, Homo sapiens
caaagtattgtaaattat

SEQ ID NO: 5287040 - DNA, 22 bp, Homo sapiens
caaagtattgtgaaagtattct

SEQ ID NO: 5287041 - DNA, 22 bp, Homo sapiens
caaagtatttttttatcttggg

SEQ ID NO: 5287042 - DNA, 22 bp, Homo sapiens
caaagtatttttttcactgttt

SEQ ID NO: 5287043 - DNA, 21 bp, Homo sapiens
caaagtcaataaaagagctgt

SEQ ID NO: 5287044 - DNA, 17 bp, Homo sapiens
caaagtcacttctccat

SEQ ID NO: 5287045 - DNA, 21 bp, Homo sapiens
caaagtcatcccctctcagga

SEQ ID NO: 5287046 - DNA, 22 bp, Homo sapiens
caaagtcatcccctctcaggag

SEQ ID NO: 5287047 - DNA, 16 bp, Homo sapiens
caaagtcatgaagctc

SEQ ID NO: 5287048 - DNA, 17 bp, Homo sapiens
caaagtcatgatgtttt

SEQ ID NO: 5287049 - DNA, 18 bp, Homo sapiens
caaagtcatgatgttttt

SEQ ID NO: 5287050 - DNA, 19 bp, Homo sapiens
caaagtcatgatgttttta

SEQ ID NO: 5287051 - DNA, 22 bp, Homo sapiens
caaagtcatgatgtttttaaaa

SEQ ID NO: 5287052 - DNA, 20 bp, Homo sapiens
caaagtcatgcaaaggctgg

SEQ ID NO: 5287053 - DNA, 22 bp, Homo sapiens
caaagtcatgcaaaggctggga

SEQ ID NO: 5287054 - DNA, 13 bp, Homo sapiens
caaagtcattgaa

SEQ ID NO: 5287055 - DNA, 18 bp, Homo sapiens
caaagtccacacaaagat

SEQ ID NO: 5287056 - DNA, 16 bp, Homo sapiens
caaagtcccttcctgc

SEQ ID NO: 5287057 - DNA, 19 bp, Homo sapiens
caaagtcccttcctgcttc

SEQ ID NO: 5287058 - DNA, 22 bp, Homo sapiens
caaagtcccttcctgcttcctg

SEQ ID NO: 5287059 - DNA, 17 bp, Homo sapiens
caaagtcctctgctcca

SEQ ID NO: 5287060 - DNA, 23 bp, Homo sapiens
caaagtcctttttttccatcttt

SEQ ID NO: 5287061 - DNA, 14 bp, Homo sapiens
caaagtcgccagtc

SEQ ID NO: 5287062 - DNA, 12 bp, Homo sapiens
caaagtctaaac

SEQ ID NO: 5287063 - DNA, 13 bp, Homo sapiens
caaagtctaaagt

SEQ ID NO: 5287064 - DNA, 20 bp, Homo sapiens
caaagtctcatagctttgga

SEQ ID NO: 5287065 - DNA, 14 bp, Homo sapiens
caaagtctccagcc

SEQ ID NO: 5287066 - DNA, 14 bp, Homo sapiens
caaagtctctaatt

SEQ ID NO: 5287067 - DNA, 20 bp, Homo sapiens
caaagtctgatttgtgatga

SEQ ID NO: 5287068 - DNA, 23 bp, Homo sapiens
caaagtctgctctcatataagac

SEQ ID NO: 5287069 - DNA, 14 bp, Homo sapiens
caaagtctgtgtga

SEQ ID NO: 5287070 - DNA, 16 bp, Homo sapiens
caaagtctttggggtc

SEQ ID NO: 5287071 - DNA, 13 bp, Homo sapiens
caaagtgaaatta

SEQ ID NO: 5287072 - DNA, 11 bp, Homo sapiens
caaagtgaact

SEQ ID NO: 5287073 - DNA, 14 bp, Homo sapiens
caaagtgacaaagc

SEQ ID NO: 5287074 - DNA, 20 bp, Homo sapiens
caaagtgacctccagagctg

SEQ ID NO: 5287075 - DNA, 14 bp, Homo sapiens
caaagtgagaaatt

SEQ ID NO: 5287076 - DNA, 24 bp, Homo sapiens
caaagtgatgggagaattggtata

SEQ ID NO: 5287077 - DNA, 16 bp, Homo sapiens
caaagtgcaaagctgc

SEQ ID NO: 5287078 - DNA, 17 bp, Homo sapiens
caaagtgcaaagctgct

SEQ ID NO: 5287079 - DNA, 18 bp, Homo sapiens
caaagtgcaaagctgctt

SEQ ID NO: 5287080 - DNA, 19 bp, Homo sapiens
caaagtgcaaagctgcttg

SEQ ID NO: 5287081 - DNA, 19 bp, Homo sapiens
caaagtgcaaatactccaa

SEQ ID NO: 5287082 - DNA, 16 bp, Homo sapiens
caaagtgcaaggacct

SEQ ID NO: 5287083 - DNA, 14 bp, Homo sapiens
caaagtgcacacac

SEQ ID NO: 5287084 - DNA, 18 bp, Homo sapiens
caaagtgcagcccttcct

SEQ ID NO: 5287085 - DNA, 16 bp, Homo sapiens
caaagtgcatgtcaca

SEQ ID NO: 5287086 - DNA, 16 bp, Homo sapiens
caaagtgcccatggtg

SEQ ID NO: 5287087 - DNA, 22 bp, Homo sapiens
caaagtgctagccactggaaat

SEQ ID NO: 5287088 - DNA, 19 bp, Homo sapiens
caaagtgctaggattacag

SEQ ID NO: 5287089 - DNA, 20 bp, Homo sapiens
caaagtgctatgcggaggaa

SEQ ID NO: 5287090 - DNA, 21 bp, Homo sapiens
caaagtgctgagattacaggt

SEQ ID NO: 5287091 - DNA, 22 bp, Homo sapiens
caaagtgctgagattgcagatg

SEQ ID NO: 5287092 - DNA, 16 bp, Homo sapiens
caaagtgctgggatga

SEQ ID NO: 5287093 - DNA, 21 bp, Homo sapiens
caaagtgctgggatgacaggc

SEQ ID NO: 5287094 - DNA, 16 bp, Homo sapiens
caaagtgctgggatta

SEQ ID NO: 5287095 - DNA, 21 bp, Homo sapiens
caaagtgctgggattacaggt

SEQ ID NO: 5287096 - DNA, 21 bp, Homo sapiens
caaagtgctgtacccttccac

SEQ ID NO: 5287097 - DNA, 19 bp, Homo sapiens
caaagtgctttgacttctt

SEQ ID NO: 5287098 - DNA, 11 bp, Homo sapiens
caaagtggaac

SEQ ID NO: 5287099 - DNA, 14 bp, Homo sapiens
caaagtggaacgaa

SEQ ID NO: 5287100 - DNA, 15 bp, Homo sapiens
caaagtggaaggaaa

SEQ ID NO: 5287101 - DNA, 12 bp, Homo sapiens
caaagtggaggt

SEQ ID NO: 5287102 - DNA, 20 bp, Homo sapiens
caaagtggcaagtatttggc

SEQ ID NO: 5287103 - DNA, 17 bp, Homo sapiens
caaagtggggagggaca

SEQ ID NO: 5287104 - DNA, 18 bp, Homo sapiens
caaagtggggtacagtaa

SEQ ID NO: 5287105 - DNA, 19 bp, Homo sapiens
caaagtgggtactttctga

SEQ ID NO: 5287106 - DNA, 21 bp, Homo sapiens
caaagtgggtgtgtggcctcc

SEQ ID NO: 5287107 - DNA, 23 bp, Homo sapiens
caaagtggtacaggaaggcttgc

SEQ ID NO: 5287108 - DNA, 22 bp, Homo sapiens
caaagtggtaggtactttttgt

SEQ ID NO: 5287109 - DNA, 19 bp, Homo sapiens
caaagtggtgagaggcatc

SEQ ID NO: 5287110 - DNA, 16 bp, Homo sapiens
caaagtgtaagtttgt

SEQ ID NO: 5287111 - DNA, 15 bp, Homo sapiens
caaagtgtatattta

SEQ ID NO: 5287112 - DNA, 19 bp, Homo sapiens
caaagtgtggtctctggaa

SEQ ID NO: 5287113 - DNA, 14 bp, Homo sapiens
caaagtgtgtatta

SEQ ID NO: 5287114 - DNA, 18 bp, Homo sapiens
caaagtgtgtctgggatt

SEQ ID NO: 5287115 - DNA, 19 bp, Homo sapiens
caaagtgttgctgtggctc

SEQ ID NO: 5287116 - DNA, 18 bp, Homo sapiens
caaagtgttgtgttcctg

SEQ ID NO: 5287117 - DNA, 21 bp, Homo sapiens
caaagtgttttctcagaacag

SEQ ID NO: 5287118 - DNA, 15 bp, Homo sapiens
caaagtgttttctct

SEQ ID NO: 5287119 - DNA, 18 bp, Homo sapiens
caaagtgttttctctgaa

SEQ ID NO: 5287120 - DNA, 14 bp, Homo sapiens
caaagttaaatgta

SEQ ID NO: 5287121 - DNA, 16 bp, Homo sapiens
caaagttaacagattt

SEQ ID NO: 5287122 - DNA, 17 bp, Homo sapiens
caaagttaacctacctg

SEQ ID NO: 5287123 - DNA, 21 bp, Homo sapiens
caaagttaacctacctgtaac

SEQ ID NO: 5287124 - DNA, 17 bp, Homo sapiens
caaagttaattcaccta

SEQ ID NO: 5287125 - DNA, 22 bp, Homo sapiens
caaagttaattcacctatgtta

SEQ ID NO: 5287126 - DNA, 16 bp, Homo sapiens
caaagttactaggtaa

SEQ ID NO: 5287127 - DNA, 19 bp, Homo sapiens
caaagttactggctctttg

SEQ ID NO: 5287128 - DNA, 24 bp, Homo sapiens
caaagttagagaactaaactagtt

SEQ ID NO: 5287129 - DNA, 14 bp, Homo sapiens
caaagttagttcag

SEQ ID NO: 5287130 - DNA, 20 bp, Homo sapiens
caaagttatattcacagttt

SEQ ID NO: 5287131 - DNA, 21 bp, Homo sapiens
caaagttatcttaaatatgaa

SEQ ID NO: 5287132 - DNA, 18 bp, Homo sapiens
caaagttattccccatct

SEQ ID NO: 5287133 - DNA, 14 bp, Homo sapiens
caaagttcaacttg

SEQ ID NO: 5287134 - DNA, 13 bp, Homo sapiens
caaagttcagtgt

SEQ ID NO: 5287135 - DNA, 19 bp, Homo sapiens
caaagttcccactccttca

SEQ ID NO: 5287136 - DNA, 18 bp, Homo sapiens
caaagttcctgttcacct

SEQ ID NO: 5287137 - DNA, 20 bp, Homo sapiens
caaagttctattttattaat

SEQ ID NO: 5287138 - DNA, 17 bp, Homo sapiens
caaagttctcagagctc

SEQ ID NO: 5287139 - DNA, 21 bp, Homo sapiens
caaagttgagggaaagagctt

SEQ ID NO: 5287140 - DNA, 22 bp, Homo sapiens
caaagttgattaagaaaggaag

SEQ ID NO: 5287141 - DNA, 18 bp, Homo sapiens
caaagttgcctaaatcca

SEQ ID NO: 5287142 - DNA, 12 bp, Homo sapiens
caaagttgctca

SEQ ID NO: 5287143 - DNA, 15 bp, Homo sapiens
caaagttgctcaccg

SEQ ID NO: 5287144 - DNA, 15 bp, Homo sapiens
caaagttgtagttct

SEQ ID NO: 5287145 - DNA, 22 bp, Homo sapiens
caaagttgtagttcttgtgcat

SEQ ID NO: 5287146 - DNA, 15 bp, Homo sapiens
caaagttgtttaact

SEQ ID NO: 5287147 - DNA, 16 bp, Homo sapiens
caaagtttaacacaat

SEQ ID NO: 5287148 - DNA, 17 bp, Homo sapiens
caaagtttacattgtcc

SEQ ID NO: 5287149 - DNA, 23 bp, Homo sapiens
caaagtttacattgtcctgtagc

SEQ ID NO: 5287150 - DNA, 16 bp, Homo sapiens
caaagtttcaatttgt

SEQ ID NO: 5287151 - DNA, 17 bp, Homo sapiens
caaagtttcagagtata

SEQ ID NO: 5287152 - DNA, 12 bp, Homo sapiens
caaagtttctgt

SEQ ID NO: 5287153 - DNA, 14 bp, Homo sapiens
caaagtttggaagt

SEQ ID NO: 5287154 - DNA, 22 bp, Homo sapiens
caaagtttggaagtacataaag

SEQ ID NO: 5287155 - DNA, 13 bp, Homo sapiens
caaagttttgaaa

SEQ ID NO: 5287156 - DNA, 22 bp, Homo sapiens
caaagttttgttgtacttaaat

SEQ ID NO: 5287157 - DNA, 12 bp, Homo sapiens
attgttatgtaa

SEQ ID NO: 5287158 - DNA, 21 bp, Homo sapiens
attgttatgtaaaactcgctt

SEQ ID NO: 5287159 - DNA, 14 bp, Homo sapiens
attgttattaaatg

SEQ ID NO: 5287160 - DNA, 14 bp, Homo sapiens
attgttcaaacaat

SEQ ID NO: 5287161 - DNA, 24 bp, Homo sapiens
attgttcaaacaatatcatatcat

SEQ ID NO: 5287162 - DNA, 18 bp, Homo sapiens
attgttcaactcccttct

SEQ ID NO: 5287163 - DNA, 15 bp, Homo sapiens
attgttcaattccca

SEQ ID NO: 5287164 - DNA, 12 bp, Homo sapiens
attgttcagaag

SEQ ID NO: 5287165 - DNA, 21 bp, Homo sapiens
attgttcagaagacctccctg

SEQ ID NO: 5287166 - DNA, 23 bp, Homo sapiens
attgttcatgttaccaaagcaat

SEQ ID NO: 5287167 - DNA, 13 bp, Homo sapiens
attgttcatttgt

SEQ ID NO: 5287168 - DNA, 12 bp, Homo sapiens
attgttcatttt

SEQ ID NO: 5287169 - DNA, 20 bp, Homo sapiens
attgttcattttgagctgaa

SEQ ID NO: 5287170 - DNA, 17 bp, Homo sapiens
attgttccaagacattg

SEQ ID NO: 5287171 - DNA, 18 bp, Homo sapiens
attgttccaagacattgt

SEQ ID NO: 5287172 - DNA, 19 bp, Homo sapiens
attgttcccagtgacactt

SEQ ID NO: 5287173 - DNA, 16 bp, Homo sapiens
attgttcccttcctct

SEQ ID NO: 5287174 - DNA, 23 bp, Homo sapiens
attgttcccttcctcttcctgcc

SEQ ID NO: 5287175 - DNA, 13 bp, Homo sapiens
attgttcctaagt

SEQ ID NO: 5287176 - DNA, 13 bp, Homo sapiens
attgttcctcccc

SEQ ID NO: 5287177 - DNA, 17 bp, Homo sapiens
attgttcctccccagcc

SEQ ID NO: 5287178 - DNA, 20 bp, Homo sapiens
attgttcgatgcctgcatgc

SEQ ID NO: 5287179 - DNA, 22 bp, Homo sapiens
attgttctaatgcaacagaaaa

SEQ ID NO: 5287180 - DNA, 12 bp, Homo sapiens
attgttctagta

SEQ ID NO: 5287181 - DNA, 21 bp, Homo sapiens
attgttctcacttattattaa

SEQ ID NO: 5287182 - DNA, 17 bp, Homo sapiens
attgttctcagaatccc

SEQ ID NO: 5287183 - DNA, 21 bp, Homo sapiens
attgttctctaatatgtaaaa

SEQ ID NO: 5287184 - DNA, 23 bp, Homo sapiens
attgttctgtttgtgttatttca

SEQ ID NO: 5287185 - DNA, 15 bp, Homo sapiens
attgttctttttcct

SEQ ID NO: 5287186 - DNA, 19 bp, Homo sapiens
attgttgaaaaagtttgtt

SEQ ID NO: 5287187 - DNA, 16 bp, Homo sapiens
attgttgaaactaaag

SEQ ID NO: 5287188 - DNA, 14 bp, Homo sapiens
attgttgaaagctt

SEQ ID NO: 5287189 - DNA, 19 bp, Homo sapiens
attgttgaaagctttgaaa

SEQ ID NO: 5287190 - DNA, 15 bp, Homo sapiens
attgttgaaattttg

SEQ ID NO: 5287191 - DNA, 18 bp, Homo sapiens
attgttgaacatacttca

SEQ ID NO: 5287192 - DNA, 15 bp, Homo sapiens
attgttgaataaatg

SEQ ID NO: 5287193 - DNA, 16 bp, Homo sapiens
attgttgaataaatgt

SEQ ID NO: 5287194 - DNA, 21 bp, Homo sapiens
attgttgaataaatgtatctg

SEQ ID NO: 5287195 - DNA, 17 bp, Homo sapiens
attgttgaatctatttc

SEQ ID NO: 5287196 - DNA, 15 bp, Homo sapiens
attgttgaatgtatt

SEQ ID NO: 5287197 - DNA, 19 bp, Homo sapiens
attgttgaatgtattcttt

SEQ ID NO: 5287198 - DNA, 19 bp, Homo sapiens
attgttgacaactgtgact

SEQ ID NO: 5287199 - DNA, 20 bp, Homo sapiens
attgttgacaactgtgactg

SEQ ID NO: 5287200 - DNA, 21 bp, Homo sapiens
attgttgacagttctgaagaa

SEQ ID NO: 5287201 - DNA, 15 bp, Homo sapiens
attgttgactaaaat

SEQ ID NO: 5287202 - DNA, 20 bp, Homo sapiens
attgttgaggtggtctgaat

SEQ ID NO: 5287203 - DNA, 21 bp, Homo sapiens
attgttgaggtggtctgaatg

SEQ ID NO: 5287204 - DNA, 21 bp, Homo sapiens
attgttgatgggcacttgaga

SEQ ID NO: 5287205 - DNA, 23 bp, Homo sapiens
attgttgcatccctcaattgaat

SEQ ID NO: 5287206 - DNA, 12 bp, Homo sapiens
attgttgcatta

SEQ ID NO: 5287207 - DNA, 14 bp, Homo sapiens
attgttgcattgct

SEQ ID NO: 5287208 - DNA, 16 bp, Homo sapiens
attgttgcattgcttt

SEQ ID NO: 5287209 - DNA, 13 bp, Homo sapiens
attgttggagtat

SEQ ID NO: 5287210 - DNA, 14 bp, Homo sapiens
attgttggctattt

SEQ ID NO: 5287211 - DNA, 18 bp, Homo sapiens
attgttgtatatcactaa

SEQ ID NO: 5287212 - DNA, 19 bp, Homo sapiens
attgttgtatatcactaaa

SEQ ID NO: 5287213 - DNA, 13 bp, Homo sapiens
attgttgtccttt

SEQ ID NO: 5287214 - DNA, 17 bp, Homo sapiens
attgttgtccttttcat

SEQ ID NO: 5287215 - DNA, 16 bp, Homo sapiens
attgttgtctgcaact

SEQ ID NO: 5287216 - DNA, 13 bp, Homo sapiens
attgttgtgtctg

SEQ ID NO: 5287217 - DNA, 15 bp, Homo sapiens
attgttgtgtctgtg

SEQ ID NO: 5287218 - DNA, 20 bp, Homo sapiens
attgttgtttctttctagtg

SEQ ID NO: 5287219 - DNA, 22 bp, Homo sapiens
attgttgtttgccatactttgt

SEQ ID NO: 5287220 - DNA, 18 bp, Homo sapiens
attgttgtttgtatgtat

SEQ ID NO: 5287221 - DNA, 15 bp, Homo sapiens
attgttgttttccat

SEQ ID NO: 5287222 - DNA, 17 bp, Homo sapiens
attgttgtttttttaat

SEQ ID NO: 5287223 - DNA, 15 bp, Homo sapiens
attgtttaaaaacag

SEQ ID NO: 5287224 - DNA, 22 bp, Homo sapiens
attgtttaaaaacaggaaaaaa

SEQ ID NO: 5287225 - DNA, 14 bp, Homo sapiens
attgtttaaaatgt

SEQ ID NO: 5287226 - DNA, 16 bp, Homo sapiens
attgtttaaaatgtaa

SEQ ID NO: 5287227 - DNA, 14 bp, Homo sapiens
attgtttaaaattc

SEQ ID NO: 5287228 - DNA, 15 bp, Homo sapiens
attgtttaaaattca

SEQ ID NO: 5287229 - DNA, 16 bp, Homo sapiens
attgtttaaagcaact

SEQ ID NO: 5287230 - DNA, 20 bp, Homo sapiens
attgtttaaagcaactgtct

SEQ ID NO: 5287231 - DNA, 22 bp, Homo sapiens
attgtttaaagcaactgtctat

SEQ ID NO: 5287232 - DNA, 13 bp, Homo sapiens
attgtttaagaat

SEQ ID NO: 5287233 - DNA, 16 bp, Homo sapiens
attgtttaagaatcat

SEQ ID NO: 5287234 - DNA, 17 bp, Homo sapiens
attgtttaagaatcatg

SEQ ID NO: 5287235 - DNA, 19 bp, Homo sapiens
attgtttaagaatcatgga

SEQ ID NO: 5287236 - DNA, 16 bp, Homo sapiens
attgtttacaggatat

SEQ ID NO: 5287237 - DNA, 21 bp, Homo sapiens
attgtttaccatagaaagatg

SEQ ID NO: 5287238 - DNA, 16 bp, Homo sapiens
attgtttataatggca

SEQ ID NO: 5287239 - DNA, 20 bp, Homo sapiens
attgtttatacacaactttg

SEQ ID NO: 5287240 - DNA, 21 bp, Homo sapiens
attgtttatacacaactttgc

SEQ ID NO: 5287241 - DNA, 23 bp, Homo sapiens
attgtttatatggataatctgag

SEQ ID NO: 5287242 - DNA, 20 bp, Homo sapiens
attgtttatctagatgtaaa

SEQ ID NO: 5287243 - DNA, 22 bp, Homo sapiens
attgtttatctagatgtaaatt

SEQ ID NO: 5287244 - DNA, 22 bp, Homo sapiens
attgtttatgtgttatgaacat

SEQ ID NO: 5287245 - DNA, 14 bp, Homo sapiens
attgtttattttag

SEQ ID NO: 5287246 - DNA, 21 bp, Homo sapiens
attgtttcaaaatagtcattt

SEQ ID NO: 5287247 - DNA, 13 bp, Homo sapiens
attgtttcaattg

SEQ ID NO: 5287248 - DNA, 22 bp, Homo sapiens
attgtttcattgcgaatctttt

SEQ ID NO: 5287249 - DNA, 20 bp, Homo sapiens
attgtttccaaagtgcatgt

SEQ ID NO: 5287250 - DNA, 16 bp, Homo sapiens
attgtttccaacttgt

SEQ ID NO: 5287251 - DNA, 22 bp, Homo sapiens
attgtttcctaaatcagcattt

SEQ ID NO: 5287252 - DNA, 15 bp, Homo sapiens
attgtttctagatta

SEQ ID NO: 5287253 - DNA, 16 bp, Homo sapiens
attgtttctatacaaa

SEQ ID NO: 5287254 - DNA, 17 bp, Homo sapiens
attgtttctcaaatctt

SEQ ID NO: 5287255 - DNA, 12 bp, Homo sapiens
attgtttctgca

SEQ ID NO: 5287256 - DNA, 21 bp, Homo sapiens
attgtttctttatcacctggc

SEQ ID NO: 5287257 - DNA, 17 bp, Homo sapiens
attgtttgaaacaaaga

SEQ ID NO: 5287258 - DNA, 14 bp, Homo sapiens
attgtttgaaagac

SEQ ID NO: 5287259 - DNA, 16 bp, Homo sapiens
attgtttgaaagactt

SEQ ID NO: 5287260 - DNA, 16 bp, Homo sapiens
attgtttgaaatgtcg

SEQ ID NO: 5287261 - DNA, 15 bp, Homo sapiens
attgtttgatgtttt

SEQ ID NO: 5287262 - DNA, 16 bp, Homo sapiens
attgtttgcacagagg

SEQ ID NO: 5287263 - DNA, 12 bp, Homo sapiens
attgtttgctgc

SEQ ID NO: 5287264 - DNA, 13 bp, Homo sapiens
attgtttgctgtt

SEQ ID NO: 5287265 - DNA, 15 bp, Homo sapiens
attgtttgctgttgg

SEQ ID NO: 5287266 - DNA, 20 bp, Homo sapiens
attgtttgctgttgggtttt

SEQ ID NO: 5287267 - DNA, 23 bp, Homo sapiens
attgtttgctgttgggtttttgc

SEQ ID NO: 5287268 - DNA, 14 bp, Homo sapiens
attgtttgcttatt

SEQ ID NO: 5287269 - DNA, 23 bp, Homo sapiens
attgtttgcttattgttccaaga

SEQ ID NO: 5287270 - DNA, 20 bp, Homo sapiens
attgtttggatttcctttat

SEQ ID NO: 5287271 - DNA, 23 bp, Homo sapiens
attgtttggggaagttcaagtga

SEQ ID NO: 5287272 - DNA, 17 bp, Homo sapiens
attgtttggtaaatgtt

SEQ ID NO: 5287273 - DNA, 18 bp, Homo sapiens
attgtttggtaaatgttt

SEQ ID NO: 5287274 - DNA, 22 bp, Homo sapiens
attgtttgtacagtaatatgtt

SEQ ID NO: 5287275 - DNA, 20 bp, Homo sapiens
attgtttgtctgtcttcata

SEQ ID NO: 5287276 - DNA, 23 bp, Homo sapiens
attgtttgtttgtaagtttgaat

SEQ ID NO: 5287277 - DNA, 23 bp, Homo sapiens
attgttttaaaaagaaacaagat

SEQ ID NO: 5287278 - DNA, 17 bp, Homo sapiens
attgttttaatctgaaa

SEQ ID NO: 5287279 - DNA, 21 bp, Homo sapiens
attgttttacctgttctgaaa

SEQ ID NO: 5287280 - DNA, 13 bp, Homo sapiens
attgttttactcc

SEQ ID NO: 5287281 - DNA, 13 bp, Homo sapiens
attgttttataaa

SEQ ID NO: 5287282 - DNA, 16 bp, Homo sapiens
attgttttataaatgg

SEQ ID NO: 5287283 - DNA, 18 bp, Homo sapiens
attgttttatcatgacat

SEQ ID NO: 5287284 - DNA, 19 bp, Homo sapiens
attgttttattttggaatt

SEQ ID NO: 5287285 - DNA, 21 bp, Homo sapiens
attgttttattttggaattgg

SEQ ID NO: 5287286 - DNA, 15 bp, Homo sapiens
attgttttcacttgt

SEQ ID NO: 5287287 - DNA, 16 bp, Homo sapiens
attgttttcacttgta

SEQ ID NO: 5287288 - DNA, 13 bp, Homo sapiens
attgttttcaggt

SEQ ID NO: 5287289 - DNA, 17 bp, Homo sapiens
attgttttcagtgtaca

SEQ ID NO: 5287290 - DNA, 15 bp, Homo sapiens
attgttttccagaag

SEQ ID NO: 5287291 - DNA, 18 bp, Homo sapiens
attgttttccagtgtcac

SEQ ID NO: 5287292 - DNA, 19 bp, Homo sapiens
attgttttcccaagtgtaa

SEQ ID NO: 5287293 - DNA, 22 bp, Homo sapiens
attgttttctatttatgccttg

SEQ ID NO: 5287294 - DNA, 15 bp, Homo sapiens
attgttttgaatatt

SEQ ID NO: 5287295 - DNA, 20 bp, Homo sapiens
attgttttgagctttccatg

SEQ ID NO: 5287296 - DNA, 15 bp, Homo sapiens
attgttttgcacttt

SEQ ID NO: 5287297 - DNA, 12 bp, Homo sapiens
attgttttgcat

SEQ ID NO: 5287298 - DNA, 13 bp, Homo sapiens
attgttttgcatc

SEQ ID NO: 5287299 - DNA, 22 bp, Homo sapiens
attgttttggtctcaaaatggt

SEQ ID NO: 5287300 - DNA, 14 bp, Homo sapiens
attgttttgttaac

SEQ ID NO: 5287301 - DNA, 22 bp, Homo sapiens
attgtttttaagaaaaacatgt

SEQ ID NO: 5287302 - DNA, 14 bp, Homo sapiens
attgtttttatata

SEQ ID NO: 5287303 - DNA, 16 bp, Homo sapiens
attgtttttatatatt

SEQ ID NO: 5287304 - DNA, 13 bp, Homo sapiens
attgtttttcaaa

SEQ ID NO: 5287305 - DNA, 11 bp, Homo sapiens
attgtttttct

SEQ ID NO: 5287306 - DNA, 20 bp, Homo sapiens
attgtttttctgatatgttt

SEQ ID NO: 5287307 - DNA, 19 bp, Homo sapiens
attgtttttctttctacaa

SEQ ID NO: 5287308 - DNA, 20 bp, Homo sapiens
attgtttttgaatttaaata

SEQ ID NO: 5287309 - DNA, 17 bp, Homo sapiens
attgtttttgtatttat

SEQ ID NO: 5287310 - DNA, 13 bp, Homo sapiens
attgttttttaaa

SEQ ID NO: 5287311 - DNA, 17 bp, Homo sapiens
attgttttttaaagcaa

SEQ ID NO: 5287312 - DNA, 16 bp, Homo sapiens
attgttttttatcttt

SEQ ID NO: 5287313 - DNA, 21 bp, Homo sapiens
attgttttttcctaaggaaac

SEQ ID NO: 5287314 - DNA, 22 bp, Homo sapiens
attgtttttttatttggcataa

SEQ ID NO: 5287315 - DNA, 18 bp, Homo sapiens
atttaaaaaaaaacataa

SEQ ID NO: 5287316 - DNA, 19 bp, Homo sapiens
atttaaaaaaaagaaactt

SEQ ID NO: 5287317 - DNA, 14 bp, Homo sapiens
atttaaaaaaatca

SEQ ID NO: 5287318 - DNA, 16 bp, Homo sapiens
atttaaaaaaatcaca

SEQ ID NO: 5287319 - DNA, 19 bp, Homo sapiens
atttaaaaaacattttaca

SEQ ID NO: 5287320 - DNA, 20 bp, Homo sapiens
atttaaaaaacattttacag

SEQ ID NO: 5287321 - DNA, 20 bp, Homo sapiens
atttaaaaaactcctgtctt

SEQ ID NO: 5287322 - DNA, 13 bp, Homo sapiens
atttaaaaaactg

SEQ ID NO: 5287323 - DNA, 15 bp, Homo sapiens
atttaaaaaagaaaa

SEQ ID NO: 5287324 - DNA, 18 bp, Homo sapiens
atttaaaaaagaaaaaag

SEQ ID NO: 5287325 - DNA, 23 bp, Homo sapiens
atttaaaaaagaaaaaagtccag

SEQ ID NO: 5287326 - DNA, 11 bp, Homo sapiens
atttaaaaaat

SEQ ID NO: 5287327 - DNA, 18 bp, Homo sapiens
atttaaaaaataaatata

SEQ ID NO: 5287328 - DNA, 22 bp, Homo sapiens
atttaaaaaataaatataattg

SEQ ID NO: 5287329 - DNA, 19 bp, Homo sapiens
atttaaaaaattatggaat

SEQ ID NO: 5287330 - DNA, 13 bp, Homo sapiens
atttaaaaacaac

SEQ ID NO: 5287331 - DNA, 17 bp, Homo sapiens
atttaaaaacttaaata

SEQ ID NO: 5287332 - DNA, 13 bp, Homo sapiens
atttaaaaacttg

SEQ ID NO: 5287333 - DNA, 18 bp, Homo sapiens
atttaaaaagcccaacct

SEQ ID NO: 5287334 - DNA, 13 bp, Homo sapiens
atttaaaaagctc

SEQ ID NO: 5287335 - DNA, 21 bp, Homo sapiens
atttaaaaagctcactgctga

SEQ ID NO: 5287336 - DNA, 16 bp, Homo sapiens
caaataaaaatattgt

SEQ ID NO: 5287337 - DNA, 18 bp, Homo sapiens
caaataaaaatattgtgt

SEQ ID NO: 5287338 - DNA, 14 bp, Homo sapiens
caaataaaacagtg

SEQ ID NO: 5287339 - DNA, 12 bp, Homo sapiens
caaataaaacat

SEQ ID NO: 5287340 - DNA, 13 bp, Homo sapiens
caaataaaacatg

SEQ ID NO: 5287341 - DNA, 14 bp, Homo sapiens
caaataaaacccaa

SEQ ID NO: 5287342 - DNA, 19 bp, Homo sapiens
caaataaaacccaatactt

SEQ ID NO: 5287343 - DNA, 12 bp, Homo sapiens
caaataaaatat

SEQ ID NO: 5287344 - DNA, 23 bp, Homo sapiens
caaataaaatgtttacattttct

SEQ ID NO: 5287345 - DNA, 15 bp, Homo sapiens
caaataaaattattt

SEQ ID NO: 5287346 - DNA, 13 bp, Homo sapiens
caaataaacagct

SEQ ID NO: 5287347 - DNA, 14 bp, Homo sapiens
caaataaacagcta

SEQ ID NO: 5287348 - DNA, 19 bp, Homo sapiens
caaataaacagctatttaa

SEQ ID NO: 5287349 - DNA, 21 bp, Homo sapiens
caaataaacagctatttaagg

SEQ ID NO: 5287350 - DNA, 13 bp, Homo sapiens
caaataaacagtt

SEQ ID NO: 5287351 - DNA, 17 bp, Homo sapiens
caaataaacagttgtta

SEQ ID NO: 5287352 - DNA, 17 bp, Homo sapiens
caaataaacagtttgac

SEQ ID NO: 5287353 - DNA, 12 bp, Homo sapiens
caaataaacatt

SEQ ID NO: 5287354 - DNA, 14 bp, Homo sapiens
caaataaacctgag

SEQ ID NO: 5287355 - DNA, 13 bp, Homo sapiens
caaataaactagt

SEQ ID NO: 5287356 - DNA, 17 bp, Homo sapiens
caaataaactctaaaca

SEQ ID NO: 5287357 - DNA, 20 bp, Homo sapiens
caaataaacttacagatctg

SEQ ID NO: 5287358 - DNA, 12 bp, Homo sapiens
caaataaagaaa

SEQ ID NO: 5287359 - DNA, 20 bp, Homo sapiens
caaataaagaaatttggtac

SEQ ID NO: 5287360 - DNA, 18 bp, Homo sapiens
caaataaagcagtcatga

SEQ ID NO: 5287361 - DNA, 15 bp, Homo sapiens
caaataaagcctgct

SEQ ID NO: 5287362 - DNA, 14 bp, Homo sapiens
caaataaagccttt

SEQ ID NO: 5287363 - DNA, 17 bp, Homo sapiens
caaataaagccttttaa

SEQ ID NO: 5287364 - DNA, 22 bp, Homo sapiens
caaataaagccttttaaatcat

SEQ ID NO: 5287365 - DNA, 23 bp, Homo sapiens
caaataaagccttttaaatcatc

SEQ ID NO: 5287366 - DNA, 13 bp, Homo sapiens
caaataaagtaaa

SEQ ID NO: 5287367 - DNA, 19 bp, Homo sapiens
caaataaagtagtaaaaga

SEQ ID NO: 5287368 - DNA, 21 bp, Homo sapiens
caaataaatcatcctcatgtc

SEQ ID NO: 5287369 - DNA, 22 bp, Homo sapiens
caaataaatcatcctcatgtcc

SEQ ID NO: 5287370 - DNA, 23 bp, Homo sapiens
caaataaatgccttccacctcac

SEQ ID NO: 5287371 - DNA, 15 bp, Homo sapiens
caaataaatgtgtaa

SEQ ID NO: 5287372 - DNA, 17 bp, Homo sapiens
caaataaatgtgtaaat

SEQ ID NO: 5287373 - DNA, 13 bp, Homo sapiens
caaataaatgttt

SEQ ID NO: 5287374 - DNA, 23 bp, Homo sapiens
caaataaattacactttattctt

SEQ ID NO: 5287375 - DNA, 13 bp, Homo sapiens
caaataacaactt

SEQ ID NO: 5287376 - DNA, 19 bp, Homo sapiens
caaataactgcagaaaaaa

SEQ ID NO: 5287377 - DNA, 14 bp, Homo sapiens
caaataagaaataa

SEQ ID NO: 5287378 - DNA, 13 bp, Homo sapiens
caaataagacttc

SEQ ID NO: 5287379 - DNA, 17 bp, Homo sapiens
caaataaggacagcagc

SEQ ID NO: 5287380 - DNA, 16 bp, Homo sapiens
caaataagtatttata

SEQ ID NO: 5287381 - DNA, 19 bp, Homo sapiens
caaataagtcatctgatga

SEQ ID NO: 5287382 - DNA, 17 bp, Homo sapiens
caaataagtgtattttg

SEQ ID NO: 5287383 - DNA, 19 bp, Homo sapiens
caaataagtgtattttgaa

SEQ ID NO: 5287384 - DNA, 13 bp, Homo sapiens
caaataagttttt

SEQ ID NO: 5287385 - DNA, 14 bp, Homo sapiens
caaataataagcaa

SEQ ID NO: 5287386 - DNA, 18 bp, Homo sapiens
caaataataataataaca

SEQ ID NO: 5287387 - DNA, 18 bp, Homo sapiens
caaataatattactctat

SEQ ID NO: 5287388 - DNA, 13 bp, Homo sapiens
caaataatcacat

SEQ ID NO: 5287389 - DNA, 13 bp, Homo sapiens
caaataatgcttt

SEQ ID NO: 5287390 - DNA, 14 bp, Homo sapiens
caaataattaaaag

SEQ ID NO: 5287391 - DNA, 13 bp, Homo sapiens
caaataattaaat

SEQ ID NO: 5287392 - DNA, 23 bp, Homo sapiens
caaataatttaagttggctagag

SEQ ID NO: 5287393 - DNA, 12 bp, Homo sapiens
caaataatttca

SEQ ID NO: 5287394 - DNA, 20 bp, Homo sapiens
caaatacaaaaatggtaact

SEQ ID NO: 5287395 - DNA, 16 bp, Homo sapiens
caaatacaaaatgatt

SEQ ID NO: 5287396 - DNA, 22 bp, Homo sapiens
caaatacaaaatgattgtcttt

SEQ ID NO: 5287397 - DNA, 20 bp, Homo sapiens
caaatacaaagtaaatacaa

SEQ ID NO: 5287398 - DNA, 14 bp, Homo sapiens
caaatacaattcaa

SEQ ID NO: 5287399 - DNA, 11 bp, Homo sapiens
caaatacacat

SEQ ID NO: 5287400 - DNA, 13 bp, Homo sapiens
caaatacacattt

SEQ ID NO: 5287401 - DNA, 14 bp, Homo sapiens
caaatacacatttc

SEQ ID NO: 5287402 - DNA, 17 bp, Homo sapiens
caaatacacatttgcta

SEQ ID NO: 5287403 - DNA, 13 bp, Homo sapiens
caaatacatgcac

SEQ ID NO: 5287404 - DNA, 20 bp, Homo sapiens
caaatacatgcacagtcata

SEQ ID NO: 5287405 - DNA, 13 bp, Homo sapiens
caaatacatgtgt

SEQ ID NO: 5287406 - DNA, 18 bp, Homo sapiens
caaatacattaacaagct

SEQ ID NO: 5287407 - DNA, 15 bp, Homo sapiens
caaatacattccagt

SEQ ID NO: 5287408 - DNA, 19 bp, Homo sapiens
caaatacatttaaaacatt

SEQ ID NO: 5287409 - DNA, 22 bp, Homo sapiens
caaataccagagcacagattca

SEQ ID NO: 5287410 - DNA, 15 bp, Homo sapiens
caaatacctcaattt

SEQ ID NO: 5287411 - DNA, 16 bp, Homo sapiens
caaatacctcaatttt

SEQ ID NO: 5287412 - DNA, 22 bp, Homo sapiens
caaatacgtgggcattcaaatg

SEQ ID NO: 5287413 - DNA, 17 bp, Homo sapiens
caaatactaatgaaaac

SEQ ID NO: 5287414 - DNA, 14 bp, Homo sapiens
caaatactcatgtg

SEQ ID NO: 5287415 - DNA, 15 bp, Homo sapiens
caaatactccaagct

SEQ ID NO: 5287416 - DNA, 18 bp, Homo sapiens
caaatactccaagcttca

SEQ ID NO: 5287417 - DNA, 22 bp, Homo sapiens
caaatactccaagcttcaagtg

SEQ ID NO: 5287418 - DNA, 19 bp, Homo sapiens
caaatactgattttcaaaa

SEQ ID NO: 5287419 - DNA, 18 bp, Homo sapiens
caaatactgtatattcag

SEQ ID NO: 5287420 - DNA, 19 bp, Homo sapiens
caaatacttagcaaaaagt

SEQ ID NO: 5287421 - DNA, 12 bp, Homo sapiens
caaatactttaa

SEQ ID NO: 5287422 - DNA, 16 bp, Homo sapiens
caaatagaaaaagtga

SEQ ID NO: 5287423 - DNA, 12 bp, Homo sapiens
caaatagaaaac

SEQ ID NO: 5287424 - DNA, 14 bp, Homo sapiens
caaatagaaaacag

SEQ ID NO: 5287425 - DNA, 19 bp, Homo sapiens
caaatagattaatgacgta

SEQ ID NO: 5287426 - DNA, 18 bp, Homo sapiens
caaatagattcagagaaa

SEQ ID NO: 5287427 - DNA, 15 bp, Homo sapiens
caaatagcaaggcca

SEQ ID NO: 5287428 - DNA, 21 bp, Homo sapiens
caaatagcaaggccagggcac

SEQ ID NO: 5287429 - DNA, 15 bp, Homo sapiens
caaatagcataagtt

SEQ ID NO: 5287430 - DNA, 21 bp, Homo sapiens
caaatagcatacaccaaacat

SEQ ID NO: 5287431 - DNA, 22 bp, Homo sapiens
caaatagcatacaccaaacatt

SEQ ID NO: 5287432 - DNA, 19 bp, Homo sapiens
caaatagccacaattatat

SEQ ID NO: 5287433 - DNA, 20 bp, Homo sapiens
caaatagccaccttgatttt

SEQ ID NO: 5287434 - DNA, 21 bp, Homo sapiens
caaatagccaccttgattttc

SEQ ID NO: 5287435 - DNA, 22 bp, Homo sapiens
caaatagccaccttgattttct

SEQ ID NO: 5287436 - DNA, 16 bp, Homo sapiens
caaatagccccagact

SEQ ID NO: 5287437 - DNA, 17 bp, Homo sapiens
caaatagccccagactg

SEQ ID NO: 5287438 - DNA, 21 bp, Homo sapiens
caaatagcttttcacttctta

SEQ ID NO: 5287439 - DNA, 22 bp, Homo sapiens
caaataggagtgagtgtatgtg

SEQ ID NO: 5287440 - DNA, 21 bp, Homo sapiens
caaataggcatcatcaataaa

SEQ ID NO: 5287441 - DNA, 21 bp, Homo sapiens
caaataggtagagtcattcat

SEQ ID NO: 5287442 - DNA, 23 bp, Homo sapiens
caaatagtagacatttgtgtgga

SEQ ID NO: 5287443 - DNA, 21 bp, Homo sapiens
caaatagtagagtatcagttg

SEQ ID NO: 5287444 - DNA, 22 bp, Homo sapiens
caaatagtaggctaaaaacatt

SEQ ID NO: 5287445 - DNA, 21 bp, Homo sapiens
caaatagtgtgaaatatatta

SEQ ID NO: 5287446 - DNA, 19 bp, Homo sapiens
caaatagttgtaaatatag

SEQ ID NO: 5287447 - DNA, 12 bp, Homo sapiens
caaatataaact

SEQ ID NO: 5287448 - DNA, 13 bp, Homo sapiens
caaatataaactt

SEQ ID NO: 5287449 - DNA, 17 bp, Homo sapiens
caaatataacatgaaag

SEQ ID NO: 5287450 - DNA, 21 bp, Homo sapiens
caaatataacatgaaagtcaa

SEQ ID NO: 5287451 - DNA, 18 bp, Homo sapiens
caaatataaccatttaaa

SEQ ID NO: 5287452 - DNA, 23 bp, Homo sapiens
caaatatacattttctaaataaa

SEQ ID NO: 5287453 - DNA, 13 bp, Homo sapiens
caaatatagagat

SEQ ID NO: 5287454 - DNA, 22 bp, Homo sapiens
caaatatagagatatttttgta

SEQ ID NO: 5287455 - DNA, 21 bp, Homo sapiens
caaatataggtcctgtgttaa

SEQ ID NO: 5287456 - DNA, 18 bp, Homo sapiens
caaatatagtatattaac

SEQ ID NO: 5287457 - DNA, 12 bp, Homo sapiens
caaatatatgta

SEQ ID NO: 5287458 - DNA, 14 bp, Homo sapiens
caaatatatgtata

SEQ ID NO: 5287459 - DNA, 18 bp, Homo sapiens
caaatatattctctttgg

SEQ ID NO: 5287460 - DNA, 22 bp, Homo sapiens
caaatatatttaactatttaga

SEQ ID NO: 5287461 - DNA, 15 bp, Homo sapiens
caaatatatttaatt

SEQ ID NO: 5287462 - DNA, 23 bp, Homo sapiens
caaatatcagtgggctctcttac

SEQ ID NO: 5287463 - DNA, 14 bp, Homo sapiens
caaatatctaaata

SEQ ID NO: 5287464 - DNA, 16 bp, Homo sapiens
caaatatctaaataat

SEQ ID NO: 5287465 - DNA, 13 bp, Homo sapiens
caaatatctcaga

SEQ ID NO: 5287466 - DNA, 17 bp, Homo sapiens
caaatatctctatttaa

SEQ ID NO: 5287467 - DNA, 15 bp, Homo sapiens
caaatatcttgtgtt

SEQ ID NO: 5287468 - DNA, 21 bp, Homo sapiens
caaatatgaaaaatgtaaata

SEQ ID NO: 5287469 - DNA, 22 bp, Homo sapiens
caaatatgagtacaaatgcctt

SEQ ID NO: 5287470 - DNA, 21 bp, Homo sapiens
caaatatgattctcctctccc

SEQ ID NO: 5287471 - DNA, 19 bp, Homo sapiens
caaatatgcaaagcactga

SEQ ID NO: 5287472 - DNA, 22 bp, Homo sapiens
caaatatgcactttccctagaa

SEQ ID NO: 5287473 - DNA, 17 bp, Homo sapiens
caaatatgctaaatgtt

SEQ ID NO: 5287474 - DNA, 14 bp, Homo sapiens
caaatatgtaaact

SEQ ID NO: 5287475 - DNA, 16 bp, Homo sapiens
caaatatgtaaacttt

SEQ ID NO: 5287476 - DNA, 13 bp, Homo sapiens
caaatatgtagaa

SEQ ID NO: 5287477 - DNA, 17 bp, Homo sapiens
caaatatgtattttcct

SEQ ID NO: 5287478 - DNA, 23 bp, Homo sapiens
caaatatgtggtccatctctgaa

SEQ ID NO: 5287479 - DNA, 17 bp, Homo sapiens
caaatatgttaaagttt

SEQ ID NO: 5287480 - DNA, 12 bp, Homo sapiens
caaatattaaag

SEQ ID NO: 5287481 - DNA, 18 bp, Homo sapiens
caaatattaagaaaatat

SEQ ID NO: 5287482 - DNA, 21 bp, Homo sapiens
caaatattaagaaaatattct

SEQ ID NO: 5287483 - DNA, 23 bp, Homo sapiens
caaatattaccaaaaaagtattt

SEQ ID NO: 5287484 - DNA, 20 bp, Homo sapiens
caaatattagatgtgattta

SEQ ID NO: 5287485 - DNA, 20 bp, Homo sapiens
caaatattagccaaagaggc

SEQ ID NO: 5287486 - DNA, 20 bp, Homo sapiens
caaatattattcaagtgcct

SEQ ID NO: 5287487 - DNA, 18 bp, Homo sapiens
caaatattcactggcccc

SEQ ID NO: 5287488 - DNA, 13 bp, Homo sapiens
caaatattccaga

SEQ ID NO: 5287489 - DNA, 17 bp, Homo sapiens
caaatattccagagact

SEQ ID NO: 5287490 - DNA, 18 bp, Homo sapiens
caaatattgaagttgttt

SEQ ID NO: 5287491 - DNA, 14 bp, Homo sapiens
caaatattgatctg

SEQ ID NO: 5287492 - DNA, 18 bp, Homo sapiens
caaatattgatctgtatt

SEQ ID NO: 5287493 - DNA, 13 bp, Homo sapiens
caaatattgccaa

SEQ ID NO: 5287494 - DNA, 18 bp, Homo sapiens
caaatattgctattgttt

SEQ ID NO: 5287495 - DNA, 21 bp, Homo sapiens
caaatattgctattgtttata

SEQ ID NO: 5287496 - DNA, 16 bp, Homo sapiens
caaatattggtgttgt

SEQ ID NO: 5287497 - DNA, 18 bp, Homo sapiens
caaatatttatgacctca

SEQ ID NO: 5287498 - DNA, 18 bp, Homo sapiens
caaatatttattggatga

SEQ ID NO: 5287499 - DNA, 13 bp, Homo sapiens
caaatatttcact

SEQ ID NO: 5287500 - DNA, 15 bp, Homo sapiens
caaatatttcactta

SEQ ID NO: 5287501 - DNA, 22 bp, Homo sapiens
caaatatttcacttaaactttg

SEQ ID NO: 5287502 - DNA, 13 bp, Homo sapiens
caaatatttggag

SEQ ID NO: 5287503 - DNA, 17 bp, Homo sapiens
caaatattttagaagct

SEQ ID NO: 5287504 - DNA, 20 bp, Homo sapiens
caaatattttcaagcttttt

SEQ ID NO: 5287505 - DNA, 13 bp, Homo sapiens
caaatattttcat

SEQ ID NO: 5287506 - DNA, 16 bp, Homo sapiens
caaatattttgtcact

SEQ ID NO: 5287507 - DNA, 15 bp, Homo sapiens
caaatatttttttgt

SEQ ID NO: 5287508 - DNA, 17 bp, Homo sapiens
caaatatttttttgtag

SEQ ID NO: 5287509 - DNA, 22 bp, Homo sapiens
caaatcaaagcaagggctccag

SEQ ID NO: 5287510 - DNA, 13 bp, Homo sapiens
caaatcaaagcag

SEQ ID NO: 5287511 - DNA, 14 bp, Homo sapiens
caaatcaaagcaga

SEQ ID NO: 5287512 - DNA, 17 bp, Homo sapiens
caaatcaaatgaatgat

SEQ ID NO: 5287513 - DNA, 15 bp, Homo sapiens
caaatcaacagaagc

SEQ ID NO: 5287514 - DNA, 16 bp, Homo sapiens
caaatcaagtttccaa

SEQ ID NO: 5287515 - DNA, 17 bp, Homo sapiens
caaatcaatctgtaaaa

SEQ ID NO: 5287516 - DNA, 23 bp, Homo sapiens
atttaaaaagtgagaaagaaagt

SEQ ID NO: 5287517 - DNA, 15 bp, Homo sapiens
atttaaaaataaagc

SEQ ID NO: 5287518 - DNA, 14 bp, Homo sapiens
atttaaaaatagaa

SEQ ID NO: 5287519 - DNA, 15 bp, Homo sapiens
atttaaaaatagaaa

SEQ ID NO: 5287520 - DNA, 17 bp, Homo sapiens
atttaaaaatagaaaca

SEQ ID NO: 5287521 - DNA, 15 bp, Homo sapiens
atttaaaaataggta

SEQ ID NO: 5287522 - DNA, 14 bp, Homo sapiens
atttaaaaatatcg

SEQ ID NO: 5287523 - DNA, 19 bp, Homo sapiens
atttaaaaatatctgaata

SEQ ID NO: 5287524 - DNA, 13 bp, Homo sapiens
atttaaaaatatt

SEQ ID NO: 5287525 - DNA, 22 bp, Homo sapiens
atttaaaaatatttcagatatc

SEQ ID NO: 5287526 - DNA, 18 bp, Homo sapiens
atttaaaaatctccatta

SEQ ID NO: 5287527 - DNA, 16 bp, Homo sapiens
atttaaaaatctttca

SEQ ID NO: 5287528 - DNA, 15 bp, Homo sapiens
atttaaaaatgccaa

SEQ ID NO: 5287529 - DNA, 13 bp, Homo sapiens
atttaaaaatgtc

SEQ ID NO: 5287530 - DNA, 14 bp, Homo sapiens
atttaaaaatgtct

SEQ ID NO: 5287531 - DNA, 18 bp, Homo sapiens
atttaaaaatgtcttgct

SEQ ID NO: 5287532 - DNA, 15 bp, Homo sapiens
atttaaaaattgttt

SEQ ID NO: 5287533 - DNA, 11 bp, Homo sapiens
atttaaaacaa

SEQ ID NO: 5287534 - DNA, 16 bp, Homo sapiens
atttaaaacaagctga

SEQ ID NO: 5287535 - DNA, 17 bp, Homo sapiens
atttaaaacaagctgat

SEQ ID NO: 5287536 - DNA, 21 bp, Homo sapiens
atttaaaacaatccttactaa

SEQ ID NO: 5287537 - DNA, 13 bp, Homo sapiens
atttaaaacacag

SEQ ID NO: 5287538 - DNA, 23 bp, Homo sapiens
atttaaaacacagtattgtagaa

SEQ ID NO: 5287539 - DNA, 15 bp, Homo sapiens
atttaaaacagacac

SEQ ID NO: 5287540 - DNA, 18 bp, Homo sapiens
atttaaaacagacactgg

SEQ ID NO: 5287541 - DNA, 21 bp, Homo sapiens
atttaaaacattaaaatataa

SEQ ID NO: 5287542 - DNA, 13 bp, Homo sapiens
atttaaaacattt

SEQ ID NO: 5287543 - DNA, 23 bp, Homo sapiens
atttaaaacatttcatgtatttc

SEQ ID NO: 5287544 - DNA, 22 bp, Homo sapiens
atttaaaaccattatttaataa

SEQ ID NO: 5287545 - DNA, 16 bp, Homo sapiens
atttaaaaccttgatt

SEQ ID NO: 5287546 - DNA, 13 bp, Homo sapiens
atttaaaactctg

SEQ ID NO: 5287547 - DNA, 17 bp, Homo sapiens
atttaaaactgtaattt

SEQ ID NO: 5287548 - DNA, 17 bp, Homo sapiens
atttaaaactgttattt

SEQ ID NO: 5287549 - DNA, 15 bp, Homo sapiens
atttaaaagacaaac

SEQ ID NO: 5287550 - DNA, 16 bp, Homo sapiens
atttaaaagacaaaca

SEQ ID NO: 5287551 - DNA, 15 bp, Homo sapiens
atttaaaagacactg

SEQ ID NO: 5287552 - DNA, 14 bp, Homo sapiens
atttaaaagacaga

SEQ ID NO: 5287553 - DNA, 14 bp, Homo sapiens
atttaaaagagcag

SEQ ID NO: 5287554 - DNA, 14 bp, Homo sapiens
atttaaaagagtaa

SEQ ID NO: 5287555 - DNA, 17 bp, Homo sapiens
atttaaaagatacagtt

SEQ ID NO: 5287556 - DNA, 15 bp, Homo sapiens
atttaaaagcctgct

SEQ ID NO: 5287557 - DNA, 17 bp, Homo sapiens
atttaaaagcctgctca

SEQ ID NO: 5287558 - DNA, 23 bp, Homo sapiens
atttaaaaggatggcaagttgca

SEQ ID NO: 5287559 - DNA, 15 bp, Homo sapiens
atttaaaagggaagt

SEQ ID NO: 5287560 - DNA, 21 bp, Homo sapiens
atttaaaagggaagtctagag

SEQ ID NO: 5287561 - DNA, 20 bp, Homo sapiens
atttaaaagtgtattttatt

SEQ ID NO: 5287562 - DNA, 21 bp, Homo sapiens
atttaaaataccactgtaatt

SEQ ID NO: 5287563 - DNA, 23 bp, Homo sapiens
atttaaaatagcaaaagaagaag

SEQ ID NO: 5287564 - DNA, 22 bp, Homo sapiens
atttaaaatagttttctaaatg

SEQ ID NO: 5287565 - DNA, 16 bp, Homo sapiens
atttaaaatgattaga

SEQ ID NO: 5287566 - DNA, 20 bp, Homo sapiens
atttaaaatgcctatgtttt

SEQ ID NO: 5287567 - DNA, 23 bp, Homo sapiens
atttaaaatgctcaatttcagca

SEQ ID NO: 5287568 - DNA, 20 bp, Homo sapiens
atttaaaatggaaaattttc

SEQ ID NO: 5287569 - DNA, 21 bp, Homo sapiens
atttaaaatgtgtttcttaca

SEQ ID NO: 5287570 - DNA, 10 bp, Homo sapiens
atttaaaatt

SEQ ID NO: 5287571 - DNA, 14 bp, Homo sapiens
atttaaaattaagt

SEQ ID NO: 5287572 - DNA, 15 bp, Homo sapiens
atttaaaattaagta

SEQ ID NO: 5287573 - DNA, 15 bp, Homo sapiens
atttaaaattaatct

SEQ ID NO: 5287574 - DNA, 12 bp, Homo sapiens
atttaaaattat

SEQ ID NO: 5287575 - DNA, 14 bp, Homo sapiens
atttaaaattcata

SEQ ID NO: 5287576 - DNA, 15 bp, Homo sapiens
atttaaaattccatt

SEQ ID NO: 5287577 - DNA, 20 bp, Homo sapiens
atttaaaattccattatctt

SEQ ID NO: 5287578 - DNA, 17 bp, Homo sapiens
atttaaaattgctatgt

SEQ ID NO: 5287579 - DNA, 15 bp, Homo sapiens
atttaaaattggcac

SEQ ID NO: 5287580 - DNA, 16 bp, Homo sapiens
atttaaaattggcacc

SEQ ID NO: 5287581 - DNA, 21 bp, Homo sapiens
atttaaaatttcgttgtccaa

SEQ ID NO: 5287582 - DNA, 16 bp, Homo sapiens
atttaaacaaatgtgt

SEQ ID NO: 5287583 - DNA, 18 bp, Homo sapiens
atttaaacaatgccaagt

SEQ ID NO: 5287584 - DNA, 18 bp, Homo sapiens
atttaaacacattaaagg

SEQ ID NO: 5287585 - DNA, 12 bp, Homo sapiens
atttaaacagat

SEQ ID NO: 5287586 - DNA, 16 bp, Homo sapiens
atttaaacagcagtgt

SEQ ID NO: 5287587 - DNA, 15 bp, Homo sapiens
atttaaacaggccca

SEQ ID NO: 5287588 - DNA, 17 bp, Homo sapiens
atttaaacatgcagaag

SEQ ID NO: 5287589 - DNA, 17 bp, Homo sapiens
atttaaacattaaaaat

SEQ ID NO: 5287590 - DNA, 15 bp, Homo sapiens
atttaaaccagcaga

SEQ ID NO: 5287591 - DNA, 17 bp, Homo sapiens
atttaaaccagcagaaa

SEQ ID NO: 5287592 - DNA, 23 bp, Homo sapiens
atttaaaccagcagaaaagtgct

SEQ ID NO: 5287593 - DNA, 15 bp, Homo sapiens
atttaaacccatttt

SEQ ID NO: 5287594 - DNA, 24 bp, Homo sapiens
atttaaaccgctaaaagaaacttt

SEQ ID NO: 5287595 - DNA, 16 bp, Homo sapiens
atttaaacctttttct

SEQ ID NO: 5287596 - DNA, 22 bp, Homo sapiens
atttaaacctttttcttgatct

SEQ ID NO: 5287597 - DNA, 18 bp, Homo sapiens
atttaaactaaattactg

SEQ ID NO: 5287598 - DNA, 11 bp, Homo sapiens
atttaaactat

SEQ ID NO: 5287599 - DNA, 16 bp, Homo sapiens
atttaaactatcttgt

SEQ ID NO: 5287600 - DNA, 17 bp, Homo sapiens
atttaaactatgataaa

SEQ ID NO: 5287601 - DNA, 21 bp, Homo sapiens
atttaaactctgaatttatct

SEQ ID NO: 5287602 - DNA, 23 bp, Homo sapiens
atttaaactctgaatttatcttt

SEQ ID NO: 5287603 - DNA, 17 bp, Homo sapiens
atttaaactctgccaga

SEQ ID NO: 5287604 - DNA, 20 bp, Homo sapiens
atttaaactgttctgtgtgg

SEQ ID NO: 5287605 - DNA, 20 bp, Homo sapiens
atttaaagaaaaccacagtt

SEQ ID NO: 5287606 - DNA, 19 bp, Homo sapiens
atttaaagaaactgatttt

SEQ ID NO: 5287607 - DNA, 18 bp, Homo sapiens
atttaaagaaatatgtat

SEQ ID NO: 5287608 - DNA, 17 bp, Homo sapiens
atttaaagaatgagaaa

SEQ ID NO: 5287609 - DNA, 21 bp, Homo sapiens
atttaaagacagggaagagca

SEQ ID NO: 5287610 - DNA, 16 bp, Homo sapiens
atttaaagatttaaag

SEQ ID NO: 5287611 - DNA, 12 bp, Homo sapiens
atttaaagcagg

SEQ ID NO: 5287612 - DNA, 16 bp, Homo sapiens
atttaaagcaggttct

SEQ ID NO: 5287613 - DNA, 12 bp, Homo sapiens
atttaaagcatt

SEQ ID NO: 5287614 - DNA, 18 bp, Homo sapiens
atttaaagcattgctgtt

SEQ ID NO: 5287615 - DNA, 16 bp, Homo sapiens
atttaaagcattgctt

SEQ ID NO: 5287616 - DNA, 17 bp, Homo sapiens
atttaaagccaaatgta

SEQ ID NO: 5287617 - DNA, 15 bp, Homo sapiens
atttaaagcctcctc

SEQ ID NO: 5287618 - DNA, 12 bp, Homo sapiens
atttaaagctgt

SEQ ID NO: 5287619 - DNA, 15 bp, Homo sapiens
atttaaaggaaagtt

SEQ ID NO: 5287620 - DNA, 18 bp, Homo sapiens
atttaaaggccctatctg

SEQ ID NO: 5287621 - DNA, 19 bp, Homo sapiens
atttaaaggctaccttatt

SEQ ID NO: 5287622 - DNA, 21 bp, Homo sapiens
atttaaaggctaccttattgt

SEQ ID NO: 5287623 - DNA, 14 bp, Homo sapiens
atttaaaggggaga

SEQ ID NO: 5287624 - DNA, 20 bp, Homo sapiens
atttaaagggtgtacttata

SEQ ID NO: 5287625 - DNA, 16 bp, Homo sapiens
atttaaagtattttaa

SEQ ID NO: 5287626 - DNA, 22 bp, Homo sapiens
atttaaagtattttaattttaa

SEQ ID NO: 5287627 - DNA, 20 bp, Homo sapiens
atttaaagttccctatttgt

SEQ ID NO: 5287628 - DNA, 11 bp, Homo sapiens
atttaaataaa

SEQ ID NO: 5287629 - DNA, 15 bp, Homo sapiens
atttaaataaaatca

SEQ ID NO: 5287630 - DNA, 13 bp, Homo sapiens
atttaaataaagt

SEQ ID NO: 5287631 - DNA, 19 bp, Homo sapiens
atttaaatagaacttgatt

SEQ ID NO: 5287632 - DNA, 15 bp, Homo sapiens
atttaaatagatgac

SEQ ID NO: 5287633 - DNA, 20 bp, Homo sapiens
atttaaatagcattatctta

SEQ ID NO: 5287634 - DNA, 15 bp, Homo sapiens
atttaaatataattc

SEQ ID NO: 5287635 - DNA, 13 bp, Homo sapiens
atttaaatatctg

SEQ ID NO: 5287636 - DNA, 23 bp, Homo sapiens
atttaaatatctgaacatttact

SEQ ID NO: 5287637 - DNA, 15 bp, Homo sapiens
atttaaatatctgtt

SEQ ID NO: 5287638 - DNA, 20 bp, Homo sapiens
atttaaatcctgaagagcat

SEQ ID NO: 5287639 - DNA, 16 bp, Homo sapiens
atttaaatccttggct

SEQ ID NO: 5287640 - DNA, 18 bp, Homo sapiens
atttaaatccttgtgtaa

SEQ ID NO: 5287641 - DNA, 23 bp, Homo sapiens
atttaaatctgattaatccattt

SEQ ID NO: 5287642 - DNA, 12 bp, Homo sapiens
atttaaatgaaa

SEQ ID NO: 5287643 - DNA, 13 bp, Homo sapiens
atttaaatgaaag

SEQ ID NO: 5287644 - DNA, 17 bp, Homo sapiens
atttaaatgaaagaaaa

SEQ ID NO: 5287645 - DNA, 15 bp, Homo sapiens
atttaaatgacagca

SEQ ID NO: 5287646 - DNA, 20 bp, Homo sapiens
atttaaatgcatgtcttaaa

SEQ ID NO: 5287647 - DNA, 13 bp, Homo sapiens
atttaaatgcttt

SEQ ID NO: 5287648 - DNA, 17 bp, Homo sapiens
atttaaatgctttgttt

SEQ ID NO: 5287649 - DNA, 20 bp, Homo sapiens
atttaaatgctttttatcgc

SEQ ID NO: 5287650 - DNA, 16 bp, Homo sapiens
atttaaatggcttttg

SEQ ID NO: 5287651 - DNA, 20 bp, Homo sapiens
atttaaatggttctgtgcta

SEQ ID NO: 5287652 - DNA, 18 bp, Homo sapiens
atttaaatgtaacttatt

SEQ ID NO: 5287653 - DNA, 15 bp, Homo sapiens
atttaaatgtgaatt

SEQ ID NO: 5287654 - DNA, 16 bp, Homo sapiens
atttaaatgtgtacaa

SEQ ID NO: 5287655 - DNA, 22 bp, Homo sapiens
atttaaattccacagattatca

SEQ ID NO: 5287656 - DNA, 20 bp, Homo sapiens
atttaaattctttttcaaaa

SEQ ID NO: 5287657 - DNA, 15 bp, Homo sapiens
atttaaatttaaaga

SEQ ID NO: 5287658 - DNA, 16 bp, Homo sapiens
atttaaatttaagtaa

SEQ ID NO: 5287659 - DNA, 14 bp, Homo sapiens
atttaaatttgatt

SEQ ID NO: 5287660 - DNA, 19 bp, Homo sapiens
atttaaatttgatttccat

SEQ ID NO: 5287661 - DNA, 21 bp, Homo sapiens
atttaaatttgatttccatct

SEQ ID NO: 5287662 - DNA, 17 bp, Homo sapiens
atttaaattttcagaaa

SEQ ID NO: 5287663 - DNA, 21 bp, Homo sapiens
atttaaattttcagaaagcat

SEQ ID NO: 5287664 - DNA, 17 bp, Homo sapiens
atttaacaaaaaatgta

SEQ ID NO: 5287665 - DNA, 16 bp, Homo sapiens
atttaacaaaaagtgc

SEQ ID NO: 5287666 - DNA, 17 bp, Homo sapiens
atttaacaaactaaaaa

SEQ ID NO: 5287667 - DNA, 19 bp, Homo sapiens
atttaacaaactaaaaata

SEQ ID NO: 5287668 - DNA, 13 bp, Homo sapiens
atttaacaagatc

SEQ ID NO: 5287669 - DNA, 20 bp, Homo sapiens
atttaacaatgcgaatggta

SEQ ID NO: 5287670 - DNA, 16 bp, Homo sapiens
atttaacaatttattc

SEQ ID NO: 5287671 - DNA, 21 bp, Homo sapiens
atttaacactaaaattccact

SEQ ID NO: 5287672 - DNA, 14 bp, Homo sapiens
atttaacagaaatg

SEQ ID NO: 5287673 - DNA, 15 bp, Homo sapiens
atttaacagaaatgt

SEQ ID NO: 5287674 - DNA, 22 bp, Homo sapiens
atttaacagaaattgtatattg

SEQ ID NO: 5287675 - DNA, 15 bp, Homo sapiens
atttaacagctgaat

SEQ ID NO: 5287676 - DNA, 17 bp, Homo sapiens
atttaacagggagggga

SEQ ID NO: 5287677 - DNA, 22 bp, Homo sapiens
atttaacagggtctctagtgct

SEQ ID NO: 5287678 - DNA, 15 bp, Homo sapiens
atttaacagtcattt

SEQ ID NO: 5287679 - DNA, 18 bp, Homo sapiens
atttaacagtcatttaaa

SEQ ID NO: 5287680 - DNA, 15 bp, Homo sapiens
atttaacataatggt

SEQ ID NO: 5287681 - DNA, 20 bp, Homo sapiens
atttaacattcttggtcaca

SEQ ID NO: 5287682 - DNA, 19 bp, Homo sapiens
atttaacattttacagtaa

SEQ ID NO: 5287683 - DNA, 16 bp, Homo sapiens
atttaaccataaatca

SEQ ID NO: 5287684 - DNA, 24 bp, Homo sapiens
atttaaccataaatcaattcatgt

SEQ ID NO: 5287685 - DNA, 22 bp, Homo sapiens
atttaaccattccataatcatg

SEQ ID NO: 5287686 - DNA, 19 bp, Homo sapiens
atttaacccccctgtacac

SEQ ID NO: 5287687 - DNA, 19 bp, Homo sapiens
atttaacccctccactgct

SEQ ID NO: 5287688 - DNA, 16 bp, Homo sapiens
atttaacctatttcca

SEQ ID NO: 5287689 - DNA, 16 bp, Homo sapiens
atttaacctctaaatt

SEQ ID NO: 5287690 - DNA, 14 bp, Homo sapiens
atttaactaattta

SEQ ID NO: 5287691 - DNA, 16 bp, Homo sapiens
atttaactaatttaaa

SEQ ID NO: 5287692 - DNA, 17 bp, Homo sapiens
atttaactaatttaaac

SEQ ID NO: 5287693 - DNA, 22 bp, Homo sapiens
atttaactactaagaataaata

SEQ ID NO: 5287694 - DNA, 15 bp, Homo sapiens
atttaactagcactt

SEQ ID NO: 5287695 - DNA, 15 bp, Homo sapiens
atttaactatttaga

SEQ ID NO: 5287696 - DNA, 16 bp, Homo sapiens
caaatcaattctagtc

SEQ ID NO: 5287697 - DNA, 15 bp, Homo sapiens
caaatcacaaacata

SEQ ID NO: 5287698 - DNA, 19 bp, Homo sapiens
caaatcacaaacatatgta

SEQ ID NO: 5287699 - DNA, 14 bp, Homo sapiens
caaatcacatattt

SEQ ID NO: 5287700 - DNA, 18 bp, Homo sapiens
caaatcacatattttaaa

SEQ ID NO: 5287701 - DNA, 13 bp, Homo sapiens
caaatcacatctc

SEQ ID NO: 5287702 - DNA, 14 bp, Homo sapiens
caaatcacatctca

SEQ ID NO: 5287703 - DNA, 17 bp, Homo sapiens
caaatcacatctcacct

SEQ ID NO: 5287704 - DNA, 15 bp, Homo sapiens
caaatcacccaatcc

SEQ ID NO: 5287705 - DNA, 23 bp, Homo sapiens
caaatcacccaatcccagttctt

SEQ ID NO: 5287706 - DNA, 23 bp, Homo sapiens
caaatcactctgcaatggaaact

SEQ ID NO: 5287707 - DNA, 14 bp, Homo sapiens
caaatcactgaact

SEQ ID NO: 5287708 - DNA, 15 bp, Homo sapiens
caaatcactgcattc

SEQ ID NO: 5287709 - DNA, 18 bp, Homo sapiens
caaatcactgtatttatc

SEQ ID NO: 5287710 - DNA, 18 bp, Homo sapiens
caaatcactgtggggaaa

SEQ ID NO: 5287711 - DNA, 21 bp, Homo sapiens
caaatcactgtggggaaacaa

SEQ ID NO: 5287712 - DNA, 14 bp, Homo sapiens
caaatcagaacttt

SEQ ID NO: 5287713 - DNA, 15 bp, Homo sapiens
caaatcagacacaat

SEQ ID NO: 5287714 - DNA, 12 bp, Homo sapiens
caaatcaggggc

SEQ ID NO: 5287715 - DNA, 17 bp, Homo sapiens
caaatcaggggccagag

SEQ ID NO: 5287716 - DNA, 23 bp, Homo sapiens
caaatcaggttttcttttaagaa

SEQ ID NO: 5287717 - DNA, 15 bp, Homo sapiens
caaatcagtatattt

SEQ ID NO: 5287718 - DNA, 17 bp, Homo sapiens
caaatcagtatattttc

SEQ ID NO: 5287719 - DNA, 22 bp, Homo sapiens
caaatcagtatattttctgtat

SEQ ID NO: 5287720 - DNA, 23 bp, Homo sapiens
caaatcagtatattttctgtatt

SEQ ID NO: 5287721 - DNA, 24 bp, Homo sapiens
caaatcagtatattttctgtattt

SEQ ID NO: 5287722 - DNA, 21 bp, Homo sapiens
caaatcagtcctttgattcca

SEQ ID NO: 5287723 - DNA, 17 bp, Homo sapiens
caaatcagtcttccttg

SEQ ID NO: 5287724 - DNA, 22 bp, Homo sapiens
caaatcagtcttccttgtggaa

SEQ ID NO: 5287725 - DNA, 18 bp, Homo sapiens
caaatcagtttgactact

SEQ ID NO: 5287726 - DNA, 12 bp, Homo sapiens
caaatcatgaag

SEQ ID NO: 5287727 - DNA, 16 bp, Homo sapiens
caaatcattatgtttc

SEQ ID NO: 5287728 - DNA, 12 bp, Homo sapiens
caaatcattcaa

SEQ ID NO: 5287729 - DNA, 16 bp, Homo sapiens
caaatcattgtatcaa

SEQ ID NO: 5287730 - DNA, 13 bp, Homo sapiens
caaatcatttgtt

SEQ ID NO: 5287731 - DNA, 23 bp, Homo sapiens
caaatccaacgcttttcccacct

SEQ ID NO: 5287732 - DNA, 13 bp, Homo sapiens
caaatccactgac

SEQ ID NO: 5287733 - DNA, 18 bp, Homo sapiens
caaatccaggaccctgcc

SEQ ID NO: 5287734 - DNA, 22 bp, Homo sapiens
caaatccaggaccctgccaggc

SEQ ID NO: 5287735 - DNA, 19 bp, Homo sapiens
caaatccaggactttgtta

SEQ ID NO: 5287736 - DNA, 12 bp, Homo sapiens
caaatccagtgg

SEQ ID NO: 5287737 - DNA, 13 bp, Homo sapiens
caaatccagtggt

SEQ ID NO: 5287738 - DNA, 14 bp, Homo sapiens
caaatccagtggtg

SEQ ID NO: 5287739 - DNA, 16 bp, Homo sapiens
caaatccagtggtggg

SEQ ID NO: 5287740 - DNA, 18 bp, Homo sapiens
caaatccagtggtgggta

SEQ ID NO: 5287741 - DNA, 22 bp, Homo sapiens
caaatccataccccctgcccca

SEQ ID NO: 5287742 - DNA, 15 bp, Homo sapiens
caaatccatagcaca

SEQ ID NO: 5287743 - DNA, 13 bp, Homo sapiens
caaatccatgtgt

SEQ ID NO: 5287744 - DNA, 15 bp, Homo sapiens
caaatccatgtgtcc

SEQ ID NO: 5287745 - DNA, 16 bp, Homo sapiens
caaatccgaacctcct

SEQ ID NO: 5287746 - DNA, 16 bp, Homo sapiens
caaatccgctctcttc

SEQ ID NO: 5287747 - DNA, 20 bp, Homo sapiens
caaatcctagactgctcctg

SEQ ID NO: 5287748 - DNA, 17 bp, Homo sapiens
caaatcctatgtgattt

SEQ ID NO: 5287749 - DNA, 18 bp, Homo sapiens
caaatcctatgtgatttt

SEQ ID NO: 5287750 - DNA, 18 bp, Homo sapiens
caaatcctctgttttctc

SEQ ID NO: 5287751 - DNA, 20 bp, Homo sapiens
caaatcctctgttttctctc

SEQ ID NO: 5287752 - DNA, 18 bp, Homo sapiens
caaatcctgcatttagat

SEQ ID NO: 5287753 - DNA, 20 bp, Homo sapiens
caaatcctggaaggacacag

SEQ ID NO: 5287754 - DNA, 21 bp, Homo sapiens
caaatcctggaaggacacagt

SEQ ID NO: 5287755 - DNA, 15 bp, Homo sapiens
caaatccttattgtt

SEQ ID NO: 5287756 - DNA, 15 bp, Homo sapiens
caaatccttgaagat

SEQ ID NO: 5287757 - DNA, 21 bp, Homo sapiens
caaatccttggagtcccaggg

SEQ ID NO: 5287758 - DNA, 23 bp, Homo sapiens
caaatcctttctgccccccaggg

SEQ ID NO: 5287759 - DNA, 22 bp, Homo sapiens
caaatcgatttagtaagtatgt

SEQ ID NO: 5287760 - DNA, 19 bp, Homo sapiens
caaatcgtacattgtgccc

SEQ ID NO: 5287761 - DNA, 16 bp, Homo sapiens
caaatctaaaatgcaa

SEQ ID NO: 5287762 - DNA, 23 bp, Homo sapiens
caaatctaatctcttattctaat

SEQ ID NO: 5287763 - DNA, 14 bp, Homo sapiens
caaatctacagatc

SEQ ID NO: 5287764 - DNA, 21 bp, Homo sapiens
caaatctacagatcctttttc

SEQ ID NO: 5287765 - DNA, 22 bp, Homo sapiens
caaatctacagatcctttttcc

SEQ ID NO: 5287766 - DNA, 23 bp, Homo sapiens
caaatctaggaaaatattttgat

SEQ ID NO: 5287767 - DNA, 14 bp, Homo sapiens
caaatctataaaga

SEQ ID NO: 5287768 - DNA, 13 bp, Homo sapiens
caaatctatatta

SEQ ID NO: 5287769 - DNA, 14 bp, Homo sapiens
caaatctattcaga

SEQ ID NO: 5287770 - DNA, 22 bp, Homo sapiens
caaatctattcagacaagcaac

SEQ ID NO: 5287771 - DNA, 21 bp, Homo sapiens
caaatctcaatgaagccagct

SEQ ID NO: 5287772 - DNA, 14 bp, Homo sapiens
caaatctcactgta

SEQ ID NO: 5287773 - DNA, 16 bp, Homo sapiens
caaatctcagaacctt

SEQ ID NO: 5287774 - DNA, 18 bp, Homo sapiens
caaatctcagcaaagcta

SEQ ID NO: 5287775 - DNA, 21 bp, Homo sapiens
caaatctcagttgtttgcttc

SEQ ID NO: 5287776 - DNA, 23 bp, Homo sapiens
caaatctcagttgtttgcttctt

SEQ ID NO: 5287777 - DNA, 15 bp, Homo sapiens
caaatctcctgctga

SEQ ID NO: 5287778 - DNA, 15 bp, Homo sapiens
caaatctctcatatt

SEQ ID NO: 5287779 - DNA, 14 bp, Homo sapiens
caaatctgaagatt

SEQ ID NO: 5287780 - DNA, 15 bp, Homo sapiens
caaatctgacatatt

SEQ ID NO: 5287781 - DNA, 13 bp, Homo sapiens
caaatctgagcct

SEQ ID NO: 5287782 - DNA, 14 bp, Homo sapiens
caaatctgagcctt

SEQ ID NO: 5287783 - DNA, 18 bp, Homo sapiens
caaatctgcaaagcatgt

SEQ ID NO: 5287784 - DNA, 14 bp, Homo sapiens
caaatctgctttca

SEQ ID NO: 5287785 - DNA, 21 bp, Homo sapiens
caaatctgctttttaaagaat

SEQ ID NO: 5287786 - DNA, 20 bp, Homo sapiens
caaatctgggtatctttcca

SEQ ID NO: 5287787 - DNA, 11 bp, Homo sapiens
caaatctggtc

SEQ ID NO: 5287788 - DNA, 16 bp, Homo sapiens
caaatctggtccatat

SEQ ID NO: 5287789 - DNA, 21 bp, Homo sapiens
caaatctggtccatatttaca

SEQ ID NO: 5287790 - DNA, 18 bp, Homo sapiens
caaatctgtcctctgtag

SEQ ID NO: 5287791 - DNA, 14 bp, Homo sapiens
caaatctgtctgct

SEQ ID NO: 5287792 - DNA, 15 bp, Homo sapiens
caaatctgtgtatat

SEQ ID NO: 5287793 - DNA, 18 bp, Homo sapiens
caaatctgtgtatattat

SEQ ID NO: 5287794 - DNA, 16 bp, Homo sapiens
caaatctgttacctct

SEQ ID NO: 5287795 - DNA, 13 bp, Homo sapiens
caaatcttaagaa

SEQ ID NO: 5287796 - DNA, 15 bp, Homo sapiens
caaatcttacaaaat

SEQ ID NO: 5287797 - DNA, 20 bp, Homo sapiens
caaatcttcaaggtgtaaaa

SEQ ID NO: 5287798 - DNA, 20 bp, Homo sapiens
caaatcttcagtattttctc

SEQ ID NO: 5287799 - DNA, 16 bp, Homo sapiens
caaatcttcctctgga

SEQ ID NO: 5287800 - DNA, 21 bp, Homo sapiens
caaatcttccttactgtctct

SEQ ID NO: 5287801 - DNA, 14 bp, Homo sapiens
caaatcttctaatt

SEQ ID NO: 5287802 - DNA, 16 bp, Homo sapiens
caaatcttgaatttct

SEQ ID NO: 5287803 - DNA, 14 bp, Homo sapiens
caaatcttgggtgg

SEQ ID NO: 5287804 - DNA, 22 bp, Homo sapiens
caaatcttgggtgggtgaaggc

SEQ ID NO: 5287805 - DNA, 23 bp, Homo sapiens
caaatcttgttattgaagtgttc

SEQ ID NO: 5287806 - DNA, 19 bp, Homo sapiens
caaatctttaagaatagtt

SEQ ID NO: 5287807 - DNA, 14 bp, Homo sapiens
caaatgaaaagtaa

SEQ ID NO: 5287808 - DNA, 16 bp, Homo sapiens
caaatgaaagagaaaa

SEQ ID NO: 5287809 - DNA, 18 bp, Homo sapiens
caaatgaaatatatttaa

SEQ ID NO: 5287810 - DNA, 20 bp, Homo sapiens
caaatgaaatatatttaaaa

SEQ ID NO: 5287811 - DNA, 16 bp, Homo sapiens
caaatgaaatgccaaa

SEQ ID NO: 5287812 - DNA, 14 bp, Homo sapiens
caaatgaactttaa

SEQ ID NO: 5287813 - DNA, 15 bp, Homo sapiens
caaatgaactttaaa

SEQ ID NO: 5287814 - DNA, 14 bp, Homo sapiens
caaatgaactttta

SEQ ID NO: 5287815 - DNA, 16 bp, Homo sapiens
caaatgaacttttaca

SEQ ID NO: 5287816 - DNA, 17 bp, Homo sapiens
caaatgaacttttacag

SEQ ID NO: 5287817 - DNA, 12 bp, Homo sapiens
caaatgaagaaa

SEQ ID NO: 5287818 - DNA, 14 bp, Homo sapiens
caaatgaaggaatg

SEQ ID NO: 5287819 - DNA, 19 bp, Homo sapiens
caaatgaaggaatgcaata

SEQ ID NO: 5287820 - DNA, 13 bp, Homo sapiens
caaatgaagtatt

SEQ ID NO: 5287821 - DNA, 18 bp, Homo sapiens
caaatgaagtatttcatg

SEQ ID NO: 5287822 - DNA, 20 bp, Homo sapiens
caaatgaagtatttcatgta

SEQ ID NO: 5287823 - DNA, 16 bp, Homo sapiens
caaatgaatcattgtt

SEQ ID NO: 5287824 - DNA, 17 bp, Homo sapiens
caaatgaatgattaaat

SEQ ID NO: 5287825 - DNA, 21 bp, Homo sapiens
caaatgaatgattaaattatg

SEQ ID NO: 5287826 - DNA, 22 bp, Homo sapiens
caaatgaatgcctttcaaacat

SEQ ID NO: 5287827 - DNA, 10 bp, Homo sapiens
caaatgaatt

SEQ ID NO: 5287828 - DNA, 15 bp, Homo sapiens
caaatgaatttatca

SEQ ID NO: 5287829 - DNA, 21 bp, Homo sapiens
caaatgaatttatcattttag

SEQ ID NO: 5287830 - DNA, 16 bp, Homo sapiens
caaatgaatttgctaa

SEQ ID NO: 5287831 - DNA, 18 bp, Homo sapiens
caaatgacagattctgac

SEQ ID NO: 5287832 - DNA, 10 bp, Homo sapiens
caaatgacat

SEQ ID NO: 5287833 - DNA, 19 bp, Homo sapiens
caaatgacatgcactgacc

SEQ ID NO: 5287834 - DNA, 21 bp, Homo sapiens
caaatgacatgcactgaccct

SEQ ID NO: 5287835 - DNA, 18 bp, Homo sapiens
caaatgacccaaagacca

SEQ ID NO: 5287836 - DNA, 14 bp, Homo sapiens
caaatgaccgagcc

SEQ ID NO: 5287837 - DNA, 20 bp, Homo sapiens
caaatgaccgagccctggag

SEQ ID NO: 5287838 - DNA, 22 bp, Homo sapiens
caaatgaccgagccctggagag

SEQ ID NO: 5287839 - DNA, 20 bp, Homo sapiens
caaatgaccgcacgttctct

SEQ ID NO: 5287840 - DNA, 16 bp, Homo sapiens
caaatgactactacac

SEQ ID NO: 5287841 - DNA, 23 bp, Homo sapiens
caaatgactgtatctaggcattt

SEQ ID NO: 5287842 - DNA, 16 bp, Homo sapiens
caaatgacttcatttc

SEQ ID NO: 5287843 - DNA, 22 bp, Homo sapiens
caaatgacttcatttctgatgt

SEQ ID NO: 5287844 - DNA, 13 bp, Homo sapiens
caaatgactttat

SEQ ID NO: 5287845 - DNA, 17 bp, Homo sapiens
caaatgactttattatt

SEQ ID NO: 5287846 - DNA, 20 bp, Homo sapiens
caaatgagatctaagccttt

SEQ ID NO: 5287847 - DNA, 16 bp, Homo sapiens
caaatgagatttcttt

SEQ ID NO: 5287848 - DNA, 19 bp, Homo sapiens
caaatgagccttaagaaat

SEQ ID NO: 5287849 - DNA, 16 bp, Homo sapiens
caaatgagctctgaaa

SEQ ID NO: 5287850 - DNA, 18 bp, Homo sapiens
caaatgaggaaaccaaga

SEQ ID NO: 5287851 - DNA, 18 bp, Homo sapiens
caaatgagtaacatttgc

SEQ ID NO: 5287852 - DNA, 15 bp, Homo sapiens
caaatgatacagtca

SEQ ID NO: 5287853 - DNA, 21 bp, Homo sapiens
caaatgatagaactgtactgt

SEQ ID NO: 5287854 - DNA, 15 bp, Homo sapiens
caaatgatcctagta

SEQ ID NO: 5287855 - DNA, 22 bp, Homo sapiens
caaatgatcctagtaattgcct

SEQ ID NO: 5287856 - DNA, 15 bp, Homo sapiens
caaatgatcctccca

SEQ ID NO: 5287857 - DNA, 16 bp, Homo sapiens
caaatgatcctcccac

SEQ ID NO: 5287858 - DNA, 18 bp, Homo sapiens
caaatgatccttcctact

SEQ ID NO: 5287859 - DNA, 22 bp, Homo sapiens
caaatgatccttcctactttgc

SEQ ID NO: 5287860 - DNA, 9 bp, Homo sapiens
caaatgatg

SEQ ID NO: 5287861 - DNA, 20 bp, Homo sapiens
caaatgatgattatgagttc

SEQ ID NO: 5287862 - DNA, 24 bp, Homo sapiens
caaatgattatgattagttatgtc

SEQ ID NO: 5287863 - DNA, 12 bp, Homo sapiens
caaatgattgct

SEQ ID NO: 5287864 - DNA, 17 bp, Homo sapiens
caaatgattgcttttaa

SEQ ID NO: 5287865 - DNA, 18 bp, Homo sapiens
caaatgattgcttttaaa

SEQ ID NO: 5287866 - DNA, 20 bp, Homo sapiens
caaatgattgcttttaaaat

SEQ ID NO: 5287867 - DNA, 23 bp, Homo sapiens
caaatgattgcttttaaaatttt

SEQ ID NO: 5287868 - DNA, 12 bp, Homo sapiens
caaatgatttca

SEQ ID NO: 5287869 - DNA, 21 bp, Homo sapiens
caaatgattttcatcaattta

SEQ ID NO: 5287870 - DNA, 16 bp, Homo sapiens
caaatgcaaaattagt

SEQ ID NO: 5287871 - DNA, 18 bp, Homo sapiens
caaatgcaaaattagtac

SEQ ID NO: 5287872 - DNA, 15 bp, Homo sapiens
caaatgcagacacac

SEQ ID NO: 5287873 - DNA, 19 bp, Homo sapiens
caaatgcagacacacaaca

SEQ ID NO: 5287874 - DNA, 20 bp, Homo sapiens
caaatgcagcaatcccactt

SEQ ID NO: 5287875 - DNA, 17 bp, Homo sapiens
atttaactatttagaga

SEQ ID NO: 5287876 - DNA, 15 bp, Homo sapiens
atttaactccctgta

SEQ ID NO: 5287877 - DNA, 13 bp, Homo sapiens
atttaactctctt

SEQ ID NO: 5287878 - DNA, 21 bp, Homo sapiens
atttaactctttgaaactgta

SEQ ID NO: 5287879 - DNA, 13 bp, Homo sapiens
atttaactgaaga

SEQ ID NO: 5287880 - DNA, 12 bp, Homo sapiens
atttaactgcat

SEQ ID NO: 5287881 - DNA, 14 bp, Homo sapiens
atttaactgcatat

SEQ ID NO: 5287882 - DNA, 17 bp, Homo sapiens
atttaactgcatataga

SEQ ID NO: 5287883 - DNA, 19 bp, Homo sapiens
atttaactgcctaaaatgt

SEQ ID NO: 5287884 - DNA, 13 bp, Homo sapiens
atttaactgcctt

SEQ ID NO: 5287885 - DNA, 19 bp, Homo sapiens
atttaacttacatttgtac

SEQ ID NO: 5287886 - DNA, 22 bp, Homo sapiens
atttaacttgagggtaataaac

SEQ ID NO: 5287887 - DNA, 20 bp, Homo sapiens
atttaacttgtttccaatgt

SEQ ID NO: 5287888 - DNA, 15 bp, Homo sapiens
atttaactttccagt

SEQ ID NO: 5287889 - DNA, 22 bp, Homo sapiens
atttaactttccagtcttagct

SEQ ID NO: 5287890 - DNA, 18 bp, Homo sapiens
atttaacttttaaagaat

SEQ ID NO: 5287891 - DNA, 19 bp, Homo sapiens
atttaacttttaaagaatt

SEQ ID NO: 5287892 - DNA, 16 bp, Homo sapiens
atttaacttttctacc

SEQ ID NO: 5287893 - DNA, 18 bp, Homo sapiens
atttaagaaaaacaaaat

SEQ ID NO: 5287894 - DNA, 14 bp, Homo sapiens
atttaagaaaacac

SEQ ID NO: 5287895 - DNA, 13 bp, Homo sapiens
atttaagaagaat

SEQ ID NO: 5287896 - DNA, 17 bp, Homo sapiens
atttaagaataaagtct

SEQ ID NO: 5287897 - DNA, 21 bp, Homo sapiens
atttaagaatgaaactataaa

SEQ ID NO: 5287898 - DNA, 22 bp, Homo sapiens
atttaagaattgccagtctttt

SEQ ID NO: 5287899 - DNA, 13 bp, Homo sapiens
atttaagacacat

SEQ ID NO: 5287900 - DNA, 16 bp, Homo sapiens
atttaagacataaaca

SEQ ID NO: 5287901 - DNA, 18 bp, Homo sapiens
atttaagacataaacaaa

SEQ ID NO: 5287902 - DNA, 20 bp, Homo sapiens
atttaagacataaacaaaga

SEQ ID NO: 5287903 - DNA, 16 bp, Homo sapiens
atttaagagactcttt

SEQ ID NO: 5287904 - DNA, 19 bp, Homo sapiens
atttaagagattttatgtt

SEQ ID NO: 5287905 - DNA, 22 bp, Homo sapiens
atttaagagattttatgtttaa

SEQ ID NO: 5287906 - DNA, 15 bp, Homo sapiens
atttaagatgtacat

SEQ ID NO: 5287907 - DNA, 17 bp, Homo sapiens
atttaagatgtacattt

SEQ ID NO: 5287908 - DNA, 20 bp, Homo sapiens
atttaagatgtacatttaat

SEQ ID NO: 5287909 - DNA, 15 bp, Homo sapiens
atttaagcaaacgtc

SEQ ID NO: 5287910 - DNA, 16 bp, Homo sapiens
atttaagcaacatctt

SEQ ID NO: 5287911 - DNA, 15 bp, Homo sapiens
atttaagcaataaaa

SEQ ID NO: 5287912 - DNA, 18 bp, Homo sapiens
atttaagcaataaaactg

SEQ ID NO: 5287913 - DNA, 12 bp, Homo sapiens
atttaagcacaa

SEQ ID NO: 5287914 - DNA, 13 bp, Homo sapiens
atttaagcacaaa

SEQ ID NO: 5287915 - DNA, 12 bp, Homo sapiens
atttaagcatga

SEQ ID NO: 5287916 - DNA, 13 bp, Homo sapiens
atttaagcatttt

SEQ ID NO: 5287917 - DNA, 22 bp, Homo sapiens
atttaagccaataaataatatt

SEQ ID NO: 5287918 - DNA, 16 bp, Homo sapiens
atttaagccttacaaa

SEQ ID NO: 5287919 - DNA, 16 bp, Homo sapiens
atttaagccttgacac

SEQ ID NO: 5287920 - DNA, 20 bp, Homo sapiens
atttaagccttttgtgtaat

SEQ ID NO: 5287921 - DNA, 18 bp, Homo sapiens
atttaagcttatgtcaga

SEQ ID NO: 5287922 - DNA, 19 bp, Homo sapiens
atttaaggaatcaaatctt

SEQ ID NO: 5287923 - DNA, 22 bp, Homo sapiens
atttaaggaatcaaatcttaca

SEQ ID NO: 5287924 - DNA, 19 bp, Homo sapiens
atttaaggagaaccatgct

SEQ ID NO: 5287925 - DNA, 16 bp, Homo sapiens
atttaaggagattggg

SEQ ID NO: 5287926 - DNA, 19 bp, Homo sapiens
atttaaggatagtgtgaag

SEQ ID NO: 5287927 - DNA, 12 bp, Homo sapiens
atttaaggatgg

SEQ ID NO: 5287928 - DNA, 15 bp, Homo sapiens
atttaaggatggatg

SEQ ID NO: 5287929 - DNA, 22 bp, Homo sapiens
atttaaggatggatggcaccct

SEQ ID NO: 5287930 - DNA, 18 bp, Homo sapiens
atttaagggaaaaatata

SEQ ID NO: 5287931 - DNA, 16 bp, Homo sapiens
atttaagggaaagaaa

SEQ ID NO: 5287932 - DNA, 17 bp, Homo sapiens
atttaagggaaagaaaa

SEQ ID NO: 5287933 - DNA, 19 bp, Homo sapiens
atttaagggaaagaaaatg

SEQ ID NO: 5287934 - DNA, 22 bp, Homo sapiens
atttaaggtctgtttgctgttg

SEQ ID NO: 5287935 - DNA, 23 bp, Homo sapiens
atttaagtagtgggcatttcata

SEQ ID NO: 5287936 - DNA, 21 bp, Homo sapiens
atttaagtatatagtatattt

SEQ ID NO: 5287937 - DNA, 13 bp, Homo sapiens
atttaagtatctt

SEQ ID NO: 5287938 - DNA, 16 bp, Homo sapiens
atttaagtatcttgtg

SEQ ID NO: 5287939 - DNA, 12 bp, Homo sapiens
atttaagtatgg

SEQ ID NO: 5287940 - DNA, 21 bp, Homo sapiens
atttaagtatggaatattcat

SEQ ID NO: 5287941 - DNA, 23 bp, Homo sapiens
atttaagtatggaatattcattt

SEQ ID NO: 5287942 - DNA, 22 bp, Homo sapiens
atttaagtcgggaaattctgct

SEQ ID NO: 5287943 - DNA, 23 bp, Homo sapiens
atttaagtgacacagacattttg

SEQ ID NO: 5287944 - DNA, 14 bp, Homo sapiens
atttaagtgcgtgt

SEQ ID NO: 5287945 - DNA, 19 bp, Homo sapiens
atttaagtggactgtattt

SEQ ID NO: 5287946 - DNA, 16 bp, Homo sapiens
atttaagttcctgctg

SEQ ID NO: 5287947 - DNA, 20 bp, Homo sapiens
atttaagttcctgctgcctg

SEQ ID NO: 5287948 - DNA, 20 bp, Homo sapiens
atttaagtttcaaacttact

SEQ ID NO: 5287949 - DNA, 12 bp, Homo sapiens
atttaagttttg

SEQ ID NO: 5287950 - DNA, 20 bp, Homo sapiens
atttaagttttgacaagctg

SEQ ID NO: 5287951 - DNA, 15 bp, Homo sapiens
atttaataaagaaat

SEQ ID NO: 5287952 - DNA, 16 bp, Homo sapiens
atttaataaagaaata

SEQ ID NO: 5287953 - DNA, 13 bp, Homo sapiens
atttaataaagat

SEQ ID NO: 5287954 - DNA, 15 bp, Homo sapiens
atttaataaagatga

SEQ ID NO: 5287955 - DNA, 16 bp, Homo sapiens
atttaataaagatgag

SEQ ID NO: 5287956 - DNA, 14 bp, Homo sapiens
atttaataaatgta

SEQ ID NO: 5287957 - DNA, 15 bp, Homo sapiens
atttaataaatgtat

SEQ ID NO: 5287958 - DNA, 14 bp, Homo sapiens
atttaataacatta

SEQ ID NO: 5287959 - DNA, 18 bp, Homo sapiens
atttaataacattacctt

SEQ ID NO: 5287960 - DNA, 15 bp, Homo sapiens
atttaataactttgc

SEQ ID NO: 5287961 - DNA, 18 bp, Homo sapiens
atttaataactttgctgg

SEQ ID NO: 5287962 - DNA, 14 bp, Homo sapiens
atttaataatatca

SEQ ID NO: 5287963 - DNA, 22 bp, Homo sapiens
atttaatacagctgaagtcaaa

SEQ ID NO: 5287964 - DNA, 19 bp, Homo sapiens
atttaatactaattttcca

SEQ ID NO: 5287965 - DNA, 13 bp, Homo sapiens
atttaatactttt

SEQ ID NO: 5287966 - DNA, 18 bp, Homo sapiens
atttaatagcaaagaatt

SEQ ID NO: 5287967 - DNA, 18 bp, Homo sapiens
atttaatagctgtgatca

SEQ ID NO: 5287968 - DNA, 16 bp, Homo sapiens
atttaatatagctatt

SEQ ID NO: 5287969 - DNA, 14 bp, Homo sapiens
atttaatatattga

SEQ ID NO: 5287970 - DNA, 17 bp, Homo sapiens
atttaatatcaaaagaa

SEQ ID NO: 5287971 - DNA, 20 bp, Homo sapiens
atttaatatctggcactgtt

SEQ ID NO: 5287972 - DNA, 16 bp, Homo sapiens
atttaatatgcaaagt

SEQ ID NO: 5287973 - DNA, 14 bp, Homo sapiens
atttaatatgcatc

SEQ ID NO: 5287974 - DNA, 13 bp, Homo sapiens
atttaatattaca

SEQ ID NO: 5287975 - DNA, 15 bp, Homo sapiens
atttaatatttactc

SEQ ID NO: 5287976 - DNA, 13 bp, Homo sapiens
atttaatatttat

SEQ ID NO: 5287977 - DNA, 19 bp, Homo sapiens
atttaatatttctgtggaa

SEQ ID NO: 5287978 - DNA, 19 bp, Homo sapiens
atttaatatttttcaaaat

SEQ ID NO: 5287979 - DNA, 15 bp, Homo sapiens
atttaatcacagtca

SEQ ID NO: 5287980 - DNA, 15 bp, Homo sapiens
atttaatccattttt

SEQ ID NO: 5287981 - DNA, 15 bp, Homo sapiens
atttaatctccattt

SEQ ID NO: 5287982 - DNA, 15 bp, Homo sapiens
atttaatgaaagact

SEQ ID NO: 5287983 - DNA, 12 bp, Homo sapiens
atttaatgaaca

SEQ ID NO: 5287984 - DNA, 18 bp, Homo sapiens
atttaatgacttttgaat

SEQ ID NO: 5287985 - DNA, 19 bp, Homo sapiens
atttaatgacttttgaatt

SEQ ID NO: 5287986 - DNA, 20 bp, Homo sapiens
atttaatgatgcttcagtgg

SEQ ID NO: 5287987 - DNA, 19 bp, Homo sapiens
atttaatgcattaaacctg

SEQ ID NO: 5287988 - DNA, 16 bp, Homo sapiens
atttaatgcttaaaaa

SEQ ID NO: 5287989 - DNA, 14 bp, Homo sapiens
atttaatggactgt

SEQ ID NO: 5287990 - DNA, 18 bp, Homo sapiens
atttaatggatatttctc

SEQ ID NO: 5287991 - DNA, 21 bp, Homo sapiens
atttaatggcagctagtgcct

SEQ ID NO: 5287992 - DNA, 16 bp, Homo sapiens
atttaatgtaaataaa

SEQ ID NO: 5287993 - DNA, 21 bp, Homo sapiens
atttaatgtattaatctgttt

SEQ ID NO: 5287994 - DNA, 12 bp, Homo sapiens
atttaatgttga

SEQ ID NO: 5287995 - DNA, 15 bp, Homo sapiens
atttaatgttgaaca

SEQ ID NO: 5287996 - DNA, 19 bp, Homo sapiens
atttaatgtttgtaagcaa

SEQ ID NO: 5287997 - DNA, 19 bp, Homo sapiens
atttaatgttttaaatgta

SEQ ID NO: 5287998 - DNA, 23 bp, Homo sapiens
atttaatgttttaaatgtacaga

SEQ ID NO: 5287999 - DNA, 17 bp, Homo sapiens
atttaattaaagcacac

SEQ ID NO: 5288000 - DNA, 17 bp, Homo sapiens
atttaattacaaacaat

SEQ ID NO: 5288001 - DNA, 14 bp, Homo sapiens
atttaattacctta

SEQ ID NO: 5288002 - DNA, 13 bp, Homo sapiens
atttaattataaa

SEQ ID NO: 5288003 - DNA, 16 bp, Homo sapiens
atttaattatgaaaac

SEQ ID NO: 5288004 - DNA, 13 bp, Homo sapiens
atttaattcataa

SEQ ID NO: 5288005 - DNA, 13 bp, Homo sapiens
atttaattctctt

SEQ ID NO: 5288006 - DNA, 14 bp, Homo sapiens
atttaattcttatt

SEQ ID NO: 5288007 - DNA, 19 bp, Homo sapiens
atttaattcttatttctgt

SEQ ID NO: 5288008 - DNA, 15 bp, Homo sapiens
atttaattctttcta

SEQ ID NO: 5288009 - DNA, 15 bp, Homo sapiens
atttaattgtaaact

SEQ ID NO: 5288010 - DNA, 16 bp, Homo sapiens
atttaattgtaaactg

SEQ ID NO: 5288011 - DNA, 14 bp, Homo sapiens
atttaattgtaatt

SEQ ID NO: 5288012 - DNA, 15 bp, Homo sapiens
atttaattgtgtaac

SEQ ID NO: 5288013 - DNA, 17 bp, Homo sapiens
atttaattgtgtaactg

SEQ ID NO: 5288014 - DNA, 22 bp, Homo sapiens
atttaattgtgtaactgttctt

SEQ ID NO: 5288015 - DNA, 22 bp, Homo sapiens
atttaattgtgtcatattaaac

SEQ ID NO: 5288016 - DNA, 22 bp, Homo sapiens
atttaatttacgtcttgagaaa

SEQ ID NO: 5288017 - DNA, 20 bp, Homo sapiens
atttaatttagatattttcc

SEQ ID NO: 5288018 - DNA, 18 bp, Homo sapiens
atttaatttaggacacat

SEQ ID NO: 5288019 - DNA, 15 bp, Homo sapiens
atttaatttagtgat

SEQ ID NO: 5288020 - DNA, 18 bp, Homo sapiens
atttaatttcataaattg

SEQ ID NO: 5288021 - DNA, 18 bp, Homo sapiens
atttaatttctattgtgt

SEQ ID NO: 5288022 - DNA, 19 bp, Homo sapiens
atttaatttcttcatgtga

SEQ ID NO: 5288023 - DNA, 20 bp, Homo sapiens
atttaatttcttcatgtgat

SEQ ID NO: 5288024 - DNA, 13 bp, Homo sapiens
atttaatttgaag

SEQ ID NO: 5288025 - DNA, 15 bp, Homo sapiens
atttaatttgaagat

SEQ ID NO: 5288026 - DNA, 15 bp, Homo sapiens
atttaatttgaaggt

SEQ ID NO: 5288027 - DNA, 22 bp, Homo sapiens
atttaatttgtatgctaaatga

SEQ ID NO: 5288028 - DNA, 13 bp, Homo sapiens
atttaattttgac

SEQ ID NO: 5288029 - DNA, 18 bp, Homo sapiens
atttaattttgacactat

SEQ ID NO: 5288030 - DNA, 20 bp, Homo sapiens
atttaatttttaaatgttta

SEQ ID NO: 5288031 - DNA, 14 bp, Homo sapiens
atttaatttttcct

SEQ ID NO: 5288032 - DNA, 15 bp, Homo sapiens
atttaatttttcctt

SEQ ID NO: 5288033 - DNA, 19 bp, Homo sapiens
atttaatttttttgagaca

SEQ ID NO: 5288034 - DNA, 23 bp, Homo sapiens
atttaatttttttgagacagagt

SEQ ID NO: 5288035 - DNA, 19 bp, Homo sapiens
atttacaaaagatttattg

SEQ ID NO: 5288036 - DNA, 14 bp, Homo sapiens
atttacaaactgaa

SEQ ID NO: 5288037 - DNA, 13 bp, Homo sapiens
atttacaaagtgt

SEQ ID NO: 5288038 - DNA, 14 bp, Homo sapiens
atttacaaagtgtg

SEQ ID NO: 5288039 - DNA, 16 bp, Homo sapiens
atttacaaatgaagta

SEQ ID NO: 5288040 - DNA, 19 bp, Homo sapiens
atttacaaatgaagtattt

SEQ ID NO: 5288041 - DNA, 15 bp, Homo sapiens
atttacaaatgtttt

SEQ ID NO: 5288042 - DNA, 13 bp, Homo sapiens
atttacaataaat

SEQ ID NO: 5288043 - DNA, 21 bp, Homo sapiens
atttacaataaatattctgca

SEQ ID NO: 5288044 - DNA, 16 bp, Homo sapiens
atttacaatgtattaa

SEQ ID NO: 5288045 - DNA, 15 bp, Homo sapiens
atttacaatgtgtat

SEQ ID NO: 5288046 - DNA, 17 bp, Homo sapiens
atttacaatttcaaaag

SEQ ID NO: 5288047 - DNA, 22 bp, Homo sapiens
atttacacaaaaagaaagctgt

SEQ ID NO: 5288048 - DNA, 23 bp, Homo sapiens
atttacacaaaaagaaagctgtg

SEQ ID NO: 5288049 - DNA, 21 bp, Homo sapiens
atttacacagtgagactgtac

SEQ ID NO: 5288050 - DNA, 14 bp, Homo sapiens
atttacaccacact

SEQ ID NO: 5288051 - DNA, 17 bp, Homo sapiens
atttacaccacactttc

SEQ ID NO: 5288052 - DNA, 20 bp, Homo sapiens
atttacaccacactttcaaa

SEQ ID NO: 5288053 - DNA, 19 bp, Homo sapiens
atttacactattatttcct

SEQ ID NO: 5288054 - DNA, 12 bp, Homo sapiens
atttacactggt

SEQ ID NO: 5288055 - DNA, 20 bp, Homo sapiens
caaatgcagggattgctgcc

SEQ ID NO: 5288056 - DNA, 18 bp, Homo sapiens
caaatgcagtatatttct

SEQ ID NO: 5288057 - DNA, 20 bp, Homo sapiens
caaatgcagtccagtgagaa

SEQ ID NO: 5288058 - DNA, 22 bp, Homo sapiens
caaatgcagtccagtgagaaat

SEQ ID NO: 5288059 - DNA, 11 bp, Homo sapiens
caaatgcagtg

SEQ ID NO: 5288060 - DNA, 12 bp, Homo sapiens
caaatgcataaa

SEQ ID NO: 5288061 - DNA, 18 bp, Homo sapiens
caaatgcatcaatcctgt

SEQ ID NO: 5288062 - DNA, 21 bp, Homo sapiens
caaatgcatctttgatgtgtt

SEQ ID NO: 5288063 - DNA, 10 bp, Homo sapiens
caaatgcatg

SEQ ID NO: 5288064 - DNA, 16 bp, Homo sapiens
caaatgcatgaacaag

SEQ ID NO: 5288065 - DNA, 21 bp, Homo sapiens
caaatgcatgatattgtatgt

SEQ ID NO: 5288066 - DNA, 16 bp, Homo sapiens
caaatgcattcatgtt

SEQ ID NO: 5288067 - DNA, 15 bp, Homo sapiens
caaatgccaaagcag

SEQ ID NO: 5288068 - DNA, 19 bp, Homo sapiens
caaatgccaactgttggaa

SEQ ID NO: 5288069 - DNA, 19 bp, Homo sapiens
caaatgccactctgggcag

SEQ ID NO: 5288070 - DNA, 19 bp, Homo sapiens
caaatgcccaagggaaaga

SEQ ID NO: 5288071 - DNA, 15 bp, Homo sapiens
caaatgcctgactca

SEQ ID NO: 5288072 - DNA, 17 bp, Homo sapiens
caaatgccttaaaatgg

SEQ ID NO: 5288073 - DNA, 14 bp, Homo sapiens
caaatgccttttca

SEQ ID NO: 5288074 - DNA, 14 bp, Homo sapiens
caaatgctaaatgc

SEQ ID NO: 5288075 - DNA, 17 bp, Homo sapiens
caaatgctaaatgcaaa

SEQ ID NO: 5288076 - DNA, 16 bp, Homo sapiens
caaatgctactcagta

SEQ ID NO: 5288077 - DNA, 13 bp, Homo sapiens
caaatgctattaa

SEQ ID NO: 5288078 - DNA, 21 bp, Homo sapiens
caaatgctgcgcccttcccca

SEQ ID NO: 5288079 - DNA, 23 bp, Homo sapiens
caaatgctgtaactttctgaaat

SEQ ID NO: 5288080 - DNA, 17 bp, Homo sapiens
caaatgctgtagaatgc

SEQ ID NO: 5288081 - DNA, 15 bp, Homo sapiens
caaatgctgtgcaaa

SEQ ID NO: 5288082 - DNA, 20 bp, Homo sapiens
caaatgctgtgcaaacagtg

SEQ ID NO: 5288083 - DNA, 22 bp, Homo sapiens
caaatgctgtggttcactgcac

SEQ ID NO: 5288084 - DNA, 17 bp, Homo sapiens
caaatgcttggcttctc

SEQ ID NO: 5288085 - DNA, 15 bp, Homo sapiens
caaatgctttgtgac

SEQ ID NO: 5288086 - DNA, 14 bp, Homo sapiens
caaatggaaacaga

SEQ ID NO: 5288087 - DNA, 13 bp, Homo sapiens
caaatggaaagga

SEQ ID NO: 5288088 - DNA, 22 bp, Homo sapiens
caaatggaactccccagggcct

SEQ ID NO: 5288089 - DNA, 13 bp, Homo sapiens
caaatggaagaga

SEQ ID NO: 5288090 - DNA, 16 bp, Homo sapiens
caaatggaagagaaga

SEQ ID NO: 5288091 - DNA, 19 bp, Homo sapiens
caaatggagaaacaggccc

SEQ ID NO: 5288092 - DNA, 20 bp, Homo sapiens
caaatggagaaacaggccca

SEQ ID NO: 5288093 - DNA, 18 bp, Homo sapiens
caaatggaggcttttcac

SEQ ID NO: 5288094 - DNA, 19 bp, Homo sapiens
caaatggagttggagttca

SEQ ID NO: 5288095 - DNA, 20 bp, Homo sapiens
caaatggatggggataagaa

SEQ ID NO: 5288096 - DNA, 15 bp, Homo sapiens
caaatggatgtaata

SEQ ID NO: 5288097 - DNA, 16 bp, Homo sapiens
caaatggatgtaatat

SEQ ID NO: 5288098 - DNA, 18 bp, Homo sapiens
caaatggatgtaatatag

SEQ ID NO: 5288099 - DNA, 21 bp, Homo sapiens
caaatggcagcagttccatga

SEQ ID NO: 5288100 - DNA, 16 bp, Homo sapiens
caaatggccattttaa

SEQ ID NO: 5288101 - DNA, 19 bp, Homo sapiens
caaatggcgtctggaagtc

SEQ ID NO: 5288102 - DNA, 18 bp, Homo sapiens
caaatggctctgtgaaat

SEQ ID NO: 5288103 - DNA, 12 bp, Homo sapiens
caaatggctgct

SEQ ID NO: 5288104 - DNA, 19 bp, Homo sapiens
caaatggcttacttacaaa

SEQ ID NO: 5288105 - DNA, 16 bp, Homo sapiens
caaatgggaaaaaaac

SEQ ID NO: 5288106 - DNA, 11 bp, Homo sapiens
caaatgggact

SEQ ID NO: 5288107 - DNA, 13 bp, Homo sapiens
caaatgggactga

SEQ ID NO: 5288108 - DNA, 19 bp, Homo sapiens
caaatgggactgatgtcat

SEQ ID NO: 5288109 - DNA, 21 bp, Homo sapiens
caaatgggactgatgtcatct

SEQ ID NO: 5288110 - DNA, 23 bp, Homo sapiens
caaatgggagactctttgaaatg

SEQ ID NO: 5288111 - DNA, 24 bp, Homo sapiens
caaatgggagactctttgaaatga

SEQ ID NO: 5288112 - DNA, 19 bp, Homo sapiens
caaatgggcattttacaag

SEQ ID NO: 5288113 - DNA, 21 bp, Homo sapiens
caaatgggcgcccccccctcc

SEQ ID NO: 5288114 - DNA, 15 bp, Homo sapiens
caaatggggccagat

SEQ ID NO: 5288115 - DNA, 22 bp, Homo sapiens
caaatggggtccaggtcaccag

SEQ ID NO: 5288116 - DNA, 18 bp, Homo sapiens
caaatgggtgatatcctg

SEQ ID NO: 5288117 - DNA, 22 bp, Homo sapiens
caaatgggtgatatcctgaaaa

SEQ ID NO: 5288118 - DNA, 18 bp, Homo sapiens
caaatgggttttccacgc

SEQ ID NO: 5288119 - DNA, 20 bp, Homo sapiens
caaatggtaggcatttccta

SEQ ID NO: 5288120 - DNA, 20 bp, Homo sapiens
caaatggtattttttgtgaa

SEQ ID NO: 5288121 - DNA, 22 bp, Homo sapiens
caaatggtattttttgtgaatg

SEQ ID NO: 5288122 - DNA, 15 bp, Homo sapiens
caaatggtggaggat

SEQ ID NO: 5288123 - DNA, 23 bp, Homo sapiens
caaatggtggttgtttcttccaa

SEQ ID NO: 5288124 - DNA, 23 bp, Homo sapiens
caaatggttaccttgttatttaa

SEQ ID NO: 5288125 - DNA, 22 bp, Homo sapiens
caaatggttccagatacttcag

SEQ ID NO: 5288126 - DNA, 19 bp, Homo sapiens
caaatggttcttacttttc

SEQ ID NO: 5288127 - DNA, 16 bp, Homo sapiens
caaatggtttttgcaa

SEQ ID NO: 5288128 - DNA, 15 bp, Homo sapiens
caaatgtaaaatatt

SEQ ID NO: 5288129 - DNA, 15 bp, Homo sapiens
caaatgtaaaggcag

SEQ ID NO: 5288130 - DNA, 18 bp, Homo sapiens
caaatgtaaagtctagaa

SEQ ID NO: 5288131 - DNA, 12 bp, Homo sapiens
caaatgtaaatc

SEQ ID NO: 5288132 - DNA, 15 bp, Homo sapiens
caaatgtaatagttt

SEQ ID NO: 5288133 - DNA, 21 bp, Homo sapiens
caaatgtaattgaataaagtt

SEQ ID NO: 5288134 - DNA, 17 bp, Homo sapiens
caaatgtacccagccta

SEQ ID NO: 5288135 - DNA, 22 bp, Homo sapiens
caaatgtagtatggcctgtgtc

SEQ ID NO: 5288136 - DNA, 23 bp, Homo sapiens
caaatgtagtatggcctgtgtca

SEQ ID NO: 5288137 - DNA, 18 bp, Homo sapiens
caaatgtagttttgtata

SEQ ID NO: 5288138 - DNA, 15 bp, Homo sapiens
caaatgtattttgaa

SEQ ID NO: 5288139 - DNA, 16 bp, Homo sapiens
caaatgtcagatacaa

SEQ ID NO: 5288140 - DNA, 16 bp, Homo sapiens
caaatgtcatgctgcc

SEQ ID NO: 5288141 - DNA, 17 bp, Homo sapiens
caaatgtcattgtctac

SEQ ID NO: 5288142 - DNA, 18 bp, Homo sapiens
caaatgtcattgtctact

SEQ ID NO: 5288143 - DNA, 14 bp, Homo sapiens
caaatgtcctcaga

SEQ ID NO: 5288144 - DNA, 18 bp, Homo sapiens
caaatgtcctccagaagc

SEQ ID NO: 5288145 - DNA, 19 bp, Homo sapiens
caaatgtcctccagaagcc

SEQ ID NO: 5288146 - DNA, 17 bp, Homo sapiens
caaatgtctactgaagc

SEQ ID NO: 5288147 - DNA, 16 bp, Homo sapiens
caaatgtctagtttct

SEQ ID NO: 5288148 - DNA, 16 bp, Homo sapiens
caaatgtctattttct

SEQ ID NO: 5288149 - DNA, 19 bp, Homo sapiens
caaatgtctgggaagccct

SEQ ID NO: 5288150 - DNA, 22 bp, Homo sapiens
caaatgtgaaacggaagctcat

SEQ ID NO: 5288151 - DNA, 18 bp, Homo sapiens
caaatgtgaagatgcatt

SEQ ID NO: 5288152 - DNA, 18 bp, Homo sapiens
caaatgtgaccatgtgaa

SEQ ID NO: 5288153 - DNA, 16 bp, Homo sapiens
caaatgtgatttttgt

SEQ ID NO: 5288154 - DNA, 18 bp, Homo sapiens
caaatgtgatttttgtaa

SEQ ID NO: 5288155 - DNA, 20 bp, Homo sapiens
caaatgtgcaatttgtaaat

SEQ ID NO: 5288156 - DNA, 21 bp, Homo sapiens
caaatgtggcaattattttgg

SEQ ID NO: 5288157 - DNA, 22 bp, Homo sapiens
caaatgtggcaattattttgga

SEQ ID NO: 5288158 - DNA, 19 bp, Homo sapiens
caaatgtggcatttgtgat

SEQ ID NO: 5288159 - DNA, 19 bp, Homo sapiens
caaatgtggcctccatgtg

SEQ ID NO: 5288160 - DNA, 21 bp, Homo sapiens
caaatgtggctgtatccactt

SEQ ID NO: 5288161 - DNA, 17 bp, Homo sapiens
caaatgtgtaactttat

SEQ ID NO: 5288162 - DNA, 12 bp, Homo sapiens
caaatgtgtaat

SEQ ID NO: 5288163 - DNA, 12 bp, Homo sapiens
caaatgtgtact

SEQ ID NO: 5288164 - DNA, 20 bp, Homo sapiens
caaatgtgtactttattgat

SEQ ID NO: 5288165 - DNA, 16 bp, Homo sapiens
caaatgtgtataattt

SEQ ID NO: 5288166 - DNA, 20 bp, Homo sapiens
caaatgtgtatcggatgctt

SEQ ID NO: 5288167 - DNA, 15 bp, Homo sapiens
caaatgtgtattttt

SEQ ID NO: 5288168 - DNA, 20 bp, Homo sapiens
caaatgtgtcttgtattatc

SEQ ID NO: 5288169 - DNA, 13 bp, Homo sapiens
caaatgtgtgact

SEQ ID NO: 5288170 - DNA, 16 bp, Homo sapiens
caaatgtgtgcccagc

SEQ ID NO: 5288171 - DNA, 18 bp, Homo sapiens
caaatgtgtgcccagctt

SEQ ID NO: 5288172 - DNA, 21 bp, Homo sapiens
caaatgtgtgggtttttaaaa

SEQ ID NO: 5288173 - DNA, 12 bp, Homo sapiens
caaatgtgtttt

SEQ ID NO: 5288174 - DNA, 18 bp, Homo sapiens
caaatgttaaaatgtgtt

SEQ ID NO: 5288175 - DNA, 16 bp, Homo sapiens
caaatgttaactgcca

SEQ ID NO: 5288176 - DNA, 18 bp, Homo sapiens
caaatgttacatagtgta

SEQ ID NO: 5288177 - DNA, 20 bp, Homo sapiens
caaatgttagacttgtgtgc

SEQ ID NO: 5288178 - DNA, 20 bp, Homo sapiens
caaatgttcatcaatgaatg

SEQ ID NO: 5288179 - DNA, 15 bp, Homo sapiens
caaatgttcatcctc

SEQ ID NO: 5288180 - DNA, 12 bp, Homo sapiens
caaatgttctaa

SEQ ID NO: 5288181 - DNA, 14 bp, Homo sapiens
caaatgttctaagt

SEQ ID NO: 5288182 - DNA, 15 bp, Homo sapiens
caaatgttctaagtt

SEQ ID NO: 5288183 - DNA, 10 bp, Homo sapiens
caaatgttga

SEQ ID NO: 5288184 - DNA, 20 bp, Homo sapiens
caaatgtttaatcatataaa

SEQ ID NO: 5288185 - DNA, 18 bp, Homo sapiens
caaatgtttacagggagc

SEQ ID NO: 5288186 - DNA, 13 bp, Homo sapiens
caaatgtttactg

SEQ ID NO: 5288187 - DNA, 15 bp, Homo sapiens
caaatgtttactgta

SEQ ID NO: 5288188 - DNA, 16 bp, Homo sapiens
caaatgtttactgtat

SEQ ID NO: 5288189 - DNA, 18 bp, Homo sapiens
caaatgtttactgtatca

SEQ ID NO: 5288190 - DNA, 23 bp, Homo sapiens
caaatgtttattaagcatcagaa

SEQ ID NO: 5288191 - DNA, 17 bp, Homo sapiens
caaatgtttatttaaaa

SEQ ID NO: 5288192 - DNA, 18 bp, Homo sapiens
caaatgtttccttaaaca

SEQ ID NO: 5288193 - DNA, 19 bp, Homo sapiens
caaatgtttccttaaacat

SEQ ID NO: 5288194 - DNA, 19 bp, Homo sapiens
caaatgtttctaaggtaac

SEQ ID NO: 5288195 - DNA, 14 bp, Homo sapiens
caaatgtttctgca

SEQ ID NO: 5288196 - DNA, 20 bp, Homo sapiens
caaatgttttcatttacagg

SEQ ID NO: 5288197 - DNA, 16 bp, Homo sapiens
caaatgttttgcaaac

SEQ ID NO: 5288198 - DNA, 13 bp, Homo sapiens
caaattaaaaaaa

SEQ ID NO: 5288199 - DNA, 19 bp, Homo sapiens
caaattaaaaaagataaac

SEQ ID NO: 5288200 - DNA, 21 bp, Homo sapiens
caaattaaaaaagataaacac

SEQ ID NO: 5288201 - DNA, 15 bp, Homo sapiens
caaattaaaaaagct

SEQ ID NO: 5288202 - DNA, 19 bp, Homo sapiens
caaattaaaaagattcttt

SEQ ID NO: 5288203 - DNA, 22 bp, Homo sapiens
caaattaaaaagattctttttc

SEQ ID NO: 5288204 - DNA, 15 bp, Homo sapiens
caaattaaaaatttt

SEQ ID NO: 5288205 - DNA, 21 bp, Homo sapiens
caaattaaaacaaatatacat

SEQ ID NO: 5288206 - DNA, 23 bp, Homo sapiens
caaattaaaacaaatatacattt

SEQ ID NO: 5288207 - DNA, 18 bp, Homo sapiens
caaattaaagggcagata

SEQ ID NO: 5288208 - DNA, 18 bp, Homo sapiens
caaattaaagtgctgttt

SEQ ID NO: 5288209 - DNA, 16 bp, Homo sapiens
caaattaacctttcag

SEQ ID NO: 5288210 - DNA, 19 bp, Homo sapiens
caaattaacctttcaggaa

SEQ ID NO: 5288211 - DNA, 22 bp, Homo sapiens
caaattaactaaggaaatattt

SEQ ID NO: 5288212 - DNA, 15 bp, Homo sapiens
caaattaatctttct

SEQ ID NO: 5288213 - DNA, 18 bp, Homo sapiens
caaattaatcttttaaaa

SEQ ID NO: 5288214 - DNA, 19 bp, Homo sapiens
caaattaatcttttaaaaa

SEQ ID NO: 5288215 - DNA, 13 bp, Homo sapiens
caaattaatgtgt

SEQ ID NO: 5288216 - DNA, 15 bp, Homo sapiens
caaattaatgtgtaa

SEQ ID NO: 5288217 - DNA, 20 bp, Homo sapiens
caaattaatgtgtaaaattg

SEQ ID NO: 5288218 - DNA, 18 bp, Homo sapiens
caaattaattggcagcag

SEQ ID NO: 5288219 - DNA, 19 bp, Homo sapiens
caaattaattgtgtgaact

SEQ ID NO: 5288220 - DNA, 14 bp, Homo sapiens
caaattactaatga

SEQ ID NO: 5288221 - DNA, 18 bp, Homo sapiens
caaattactttgtgaata

SEQ ID NO: 5288222 - DNA, 12 bp, Homo sapiens
caaattagaaaa

SEQ ID NO: 5288223 - DNA, 18 bp, Homo sapiens
caaattagaaaatgttat

SEQ ID NO: 5288224 - DNA, 21 bp, Homo sapiens
caaattagaaacaccattcat

SEQ ID NO: 5288225 - DNA, 15 bp, Homo sapiens
caaattagaagacat

SEQ ID NO: 5288226 - DNA, 19 bp, Homo sapiens
caaattagaagacatttat

SEQ ID NO: 5288227 - DNA, 16 bp, Homo sapiens
caaattagcatgcaag

SEQ ID NO: 5288228 - DNA, 17 bp, Homo sapiens
caaattagcatgcaagc

SEQ ID NO: 5288229 - DNA, 18 bp, Homo sapiens
caaattagcatgcaagct

SEQ ID NO: 5288230 - DNA, 19 bp, Homo sapiens
caaattagcatgcaagctt

SEQ ID NO: 5288231 - DNA, 20 bp, Homo sapiens
caaattagggctacattgta

SEQ ID NO: 5288232 - DNA, 18 bp, Homo sapiens
caaattaggttttgtaca

SEQ ID NO: 5288233 - DNA, 19 bp, Homo sapiens
caaattaggttttgtacaa

SEQ ID NO: 5288234 - DNA, 14 bp, Homo sapiens
caaattagtaattt

SEQ ID NO: 5288235 - DNA, 14 bp, Homo sapiens
caaattagttatat

SEQ ID NO: 5288236 - DNA, 18 bp, Homo sapiens
caaattataagggccctg

SEQ ID NO: 5288237 - DNA, 22 bp, Homo sapiens
caaattataagggccctgccct

SEQ ID NO: 5288238 - DNA, 14 bp, Homo sapiens
caaattataatgta

SEQ ID NO: 5288239 - DNA, 20 bp, Homo sapiens
caaattataatgtattcata

SEQ ID NO: 5288240 - DNA, 16 bp, Homo sapiens
caaattatatgctaat

SEQ ID NO: 5288241 - DNA, 13 bp, Homo sapiens
caaattatatttg

SEQ ID NO: 5288242 - DNA, 14 bp, Homo sapiens
caaattatcttaaa

SEQ ID NO: 5288243 - DNA, 22 bp, Homo sapiens
caaattatcttgatacattcaa

SEQ ID NO: 5288244 - DNA, 19 bp, Homo sapiens
caaattatgctaagaattt

SEQ ID NO: 5288245 - DNA, 20 bp, Homo sapiens
caaattatgctaagaatttt

SEQ ID NO: 5288246 - DNA, 17 bp, Homo sapiens
caaattattaatgaaaa

SEQ ID NO: 5288247 - DNA, 15 bp, Homo sapiens
caaattattctagtc

SEQ ID NO: 5288248 - DNA, 22 bp, Homo sapiens
caaattattttaatattttgta

SEQ ID NO: 5288249 - DNA, 22 bp, Homo sapiens
caaattatttttaaaagaaaaa

SEQ ID NO: 5288250 - DNA, 21 bp, Homo sapiens
caaattcaagagctagaaaaa

SEQ ID NO: 5288251 - DNA, 19 bp, Homo sapiens
caaattcaaggccttccaa

SEQ ID NO: 5288252 - DNA, 17 bp, Homo sapiens
caaattcacgttctagt

SEQ ID NO: 5288253 - DNA, 12 bp, Homo sapiens
caaattcagaac

SEQ ID NO: 5288254 - DNA, 14 bp, Homo sapiens
caaattcagcctac

SEQ ID NO: 5288255 - DNA, 13 bp, Homo sapiens
caaattcagctct

SEQ ID NO: 5288256 - DNA, 14 bp, Homo sapiens
caaattcagctctg

SEQ ID NO: 5288257 - DNA, 15 bp, Homo sapiens
caaattcagctctga

SEQ ID NO: 5288258 - DNA, 16 bp, Homo sapiens
caaattcagtttcata

SEQ ID NO: 5288259 - DNA, 19 bp, Homo sapiens
caaattcatgtacagcatg

SEQ ID NO: 5288260 - DNA, 23 bp, Homo sapiens
caaattccaaacttctaaatgtt

SEQ ID NO: 5288261 - DNA, 15 bp, Homo sapiens
caaattccaatacat

SEQ ID NO: 5288262 - DNA, 16 bp, Homo sapiens
caaattccaatacatt

SEQ ID NO: 5288263 - DNA, 21 bp, Homo sapiens
caaattccacccctccttccc

SEQ ID NO: 5288264 - DNA, 23 bp, Homo sapiens
caaattccacccctccttccctg

SEQ ID NO: 5288265 - DNA, 17 bp, Homo sapiens
caaattccatcacatca

SEQ ID NO: 5288266 - DNA, 15 bp, Homo sapiens
caaattccatgtccc

SEQ ID NO: 5288267 - DNA, 18 bp, Homo sapiens
caaattccctcctccctt

SEQ ID NO: 5288268 - DNA, 14 bp, Homo sapiens
caaattccctctgg

SEQ ID NO: 5288269 - DNA, 23 bp, Homo sapiens
caaattccgattagacctttatc

SEQ ID NO: 5288270 - DNA, 20 bp, Homo sapiens
caaattcctgttagccaggt

SEQ ID NO: 5288271 - DNA, 13 bp, Homo sapiens
caaattccttccc

SEQ ID NO: 5288272 - DNA, 19 bp, Homo sapiens
caaattctcttctttttct

SEQ ID NO: 5288273 - DNA, 12 bp, Homo sapiens
caaattctgatt

SEQ ID NO: 5288274 - DNA, 14 bp, Homo sapiens
caaattctgtttct

SEQ ID NO: 5288275 - DNA, 18 bp, Homo sapiens
caaattctttagtactca

SEQ ID NO: 5288276 - DNA, 19 bp, Homo sapiens
caaattctttagtactcaa

SEQ ID NO: 5288277 - DNA, 22 bp, Homo sapiens
caaattctttattcttccttga

SEQ ID NO: 5288278 - DNA, 22 bp, Homo sapiens
caaattctttttttattattat

SEQ ID NO: 5288279 - DNA, 13 bp, Homo sapiens
caaattgaaaaca

SEQ ID NO: 5288280 - DNA, 13 bp, Homo sapiens
caaattgaaagct

SEQ ID NO: 5288281 - DNA, 21 bp, Homo sapiens
caaattgactcttatttatag

SEQ ID NO: 5288282 - DNA, 19 bp, Homo sapiens
caaattgagagaatggaaa

SEQ ID NO: 5288283 - DNA, 20 bp, Homo sapiens
caaattgagtttaacaataa

SEQ ID NO: 5288284 - DNA, 23 bp, Homo sapiens
caaattgagtttaacaataataa

SEQ ID NO: 5288285 - DNA, 22 bp, Homo sapiens
caaattgatcaagatattaaaa

SEQ ID NO: 5288286 - DNA, 12 bp, Homo sapiens
caaattgattgt

SEQ ID NO: 5288287 - DNA, 22 bp, Homo sapiens
caaattgattgtcatatttcat

SEQ ID NO: 5288288 - DNA, 21 bp, Homo sapiens
caaattgcactgaagtttttg

SEQ ID NO: 5288289 - DNA, 16 bp, Homo sapiens
caaattgcagaagaaa

SEQ ID NO: 5288290 - DNA, 13 bp, Homo sapiens
caaattgcatttg

SEQ ID NO: 5288291 - DNA, 14 bp, Homo sapiens
caaattgcatttgt

SEQ ID NO: 5288292 - DNA, 15 bp, Homo sapiens
caaattgctgcatat

SEQ ID NO: 5288293 - DNA, 19 bp, Homo sapiens
caaattgctgcatatttgt

SEQ ID NO: 5288294 - DNA, 17 bp, Homo sapiens
caaattgcttgaaagaa

SEQ ID NO: 5288295 - DNA, 17 bp, Homo sapiens
caaattggacagaagat

SEQ ID NO: 5288296 - DNA, 13 bp, Homo sapiens
caaattggacagc

SEQ ID NO: 5288297 - DNA, 20 bp, Homo sapiens
caaattgggatctgtcttgg

SEQ ID NO: 5288298 - DNA, 23 bp, Homo sapiens
caaattgggatctgtcttggcat

SEQ ID NO: 5288299 - DNA, 17 bp, Homo sapiens
caaattgtaagcatgca

SEQ ID NO: 5288300 - DNA, 16 bp, Homo sapiens
caaattgtaattaata

SEQ ID NO: 5288301 - DNA, 20 bp, Homo sapiens
caaattgtaattaataatag

SEQ ID NO: 5288302 - DNA, 21 bp, Homo sapiens
caaattgtaattaataataga

SEQ ID NO: 5288303 - DNA, 15 bp, Homo sapiens
caaattgtatcttat

SEQ ID NO: 5288304 - DNA, 22 bp, Homo sapiens
caaattgtatcttattataaaa

SEQ ID NO: 5288305 - DNA, 19 bp, Homo sapiens
caaattgtcacctgcttct

SEQ ID NO: 5288306 - DNA, 20 bp, Homo sapiens
caaattgtcacctgcttctc

SEQ ID NO: 5288307 - DNA, 19 bp, Homo sapiens
caaattgtctggtactatt

SEQ ID NO: 5288308 - DNA, 18 bp, Homo sapiens
caaattgtgcaaaatatt

SEQ ID NO: 5288309 - DNA, 18 bp, Homo sapiens
caaattgtgcagtacttt

SEQ ID NO: 5288310 - DNA, 11 bp, Homo sapiens
caaattgttca

SEQ ID NO: 5288311 - DNA, 12 bp, Homo sapiens
caaattgttcat

SEQ ID NO: 5288312 - DNA, 22 bp, Homo sapiens
caaattgttcatgttaccaaag

SEQ ID NO: 5288313 - DNA, 12 bp, Homo sapiens
caaattgtttac

SEQ ID NO: 5288314 - DNA, 18 bp, Homo sapiens
caaattgtttgtacagta

SEQ ID NO: 5288315 - DNA, 15 bp, Homo sapiens
caaatttaaaacaaa

SEQ ID NO: 5288316 - DNA, 14 bp, Homo sapiens
caaatttaaaatgt

SEQ ID NO: 5288317 - DNA, 12 bp, Homo sapiens
caaatttaaagg

SEQ ID NO: 5288318 - DNA, 13 bp, Homo sapiens
caaatttaaagga

SEQ ID NO: 5288319 - DNA, 19 bp, Homo sapiens
caaatttaaaggaaacact

SEQ ID NO: 5288320 - DNA, 20 bp, Homo sapiens
caaatttaaccataaatcaa

SEQ ID NO: 5288321 - DNA, 19 bp, Homo sapiens
caaatttaacttttaaaga

SEQ ID NO: 5288322 - DNA, 15 bp, Homo sapiens
caaatttaatgtaga

SEQ ID NO: 5288323 - DNA, 14 bp, Homo sapiens
caaatttacagaga

SEQ ID NO: 5288324 - DNA, 15 bp, Homo sapiens
caaatttacagagac

SEQ ID NO: 5288325 - DNA, 17 bp, Homo sapiens
caaatttacagagacag

SEQ ID NO: 5288326 - DNA, 23 bp, Homo sapiens
caaatttacagagacagaaagca

SEQ ID NO: 5288327 - DNA, 14 bp, Homo sapiens
caaatttacatcag

SEQ ID NO: 5288328 - DNA, 15 bp, Homo sapiens
caaatttacatttat

SEQ ID NO: 5288329 - DNA, 20 bp, Homo sapiens
caaatttacatttatctatt

SEQ ID NO: 5288330 - DNA, 15 bp, Homo sapiens
caaatttactttaaa

SEQ ID NO: 5288331 - DNA, 21 bp, Homo sapiens
caaatttagaaactaattgac

SEQ ID NO: 5288332 - DNA, 15 bp, Homo sapiens
caaatttataatttt

SEQ ID NO: 5288333 - DNA, 17 bp, Homo sapiens
caaatttatcaaagcat

SEQ ID NO: 5288334 - DNA, 23 bp, Homo sapiens
caaatttatgcatttcattcaaa

SEQ ID NO: 5288335 - DNA, 16 bp, Homo sapiens
caaatttcaaaagaca

SEQ ID NO: 5288336 - DNA, 15 bp, Homo sapiens
caaatttcacttata

SEQ ID NO: 5288337 - DNA, 17 bp, Homo sapiens
caaatttcatctttcca

SEQ ID NO: 5288338 - DNA, 17 bp, Homo sapiens
caaatttcatgaccagt

SEQ ID NO: 5288339 - DNA, 14 bp, Homo sapiens
caaatttcattgca

SEQ ID NO: 5288340 - DNA, 20 bp, Homo sapiens
caaatttcattgcactttcc

SEQ ID NO: 5288341 - DNA, 14 bp, Homo sapiens
caaatttcatttca

SEQ ID NO: 5288342 - DNA, 13 bp, Homo sapiens
caaatttccctgg

SEQ ID NO: 5288343 - DNA, 11 bp, Homo sapiens
caaatttctaa

SEQ ID NO: 5288344 - DNA, 12 bp, Homo sapiens
caaatttctaaa

SEQ ID NO: 5288345 - DNA, 21 bp, Homo sapiens
caaatttctataaatttaaga

SEQ ID NO: 5288346 - DNA, 23 bp, Homo sapiens
caaatttctataaatttaagaaa

SEQ ID NO: 5288347 - DNA, 13 bp, Homo sapiens
caaatttctctct

SEQ ID NO: 5288348 - DNA, 14 bp, Homo sapiens
caaatttctctctt

SEQ ID NO: 5288349 - DNA, 17 bp, Homo sapiens
caaatttcttttgctga

SEQ ID NO: 5288350 - DNA, 19 bp, Homo sapiens
caaatttgaaaataattgt

SEQ ID NO: 5288351 - DNA, 23 bp, Homo sapiens
caaatttgaatggattaaatggc

SEQ ID NO: 5288352 - DNA, 17 bp, Homo sapiens
caaatttggccttaaga

SEQ ID NO: 5288353 - DNA, 20 bp, Homo sapiens
caaatttggccttaagaact

SEQ ID NO: 5288354 - DNA, 23 bp, Homo sapiens
caaatttggccttaagaactgtg

SEQ ID NO: 5288355 - DNA, 21 bp, Homo sapiens
caaatttggctcacttgcctt

SEQ ID NO: 5288356 - DNA, 20 bp, Homo sapiens
caaatttgtacctctaagta

SEQ ID NO: 5288357 - DNA, 19 bp, Homo sapiens
caaatttgtagggtttcta

SEQ ID NO: 5288358 - DNA, 20 bp, Homo sapiens
caaatttgtgaactgtcatg

SEQ ID NO: 5288359 - DNA, 21 bp, Homo sapiens
caaatttgtgtcataccagaa

SEQ ID NO: 5288360 - DNA, 16 bp, Homo sapiens
caaattttaaaagcca

SEQ ID NO: 5288361 - DNA, 15 bp, Homo sapiens
caaattttatctgcc

SEQ ID NO: 5288362 - DNA, 17 bp, Homo sapiens
caaattttcaaataata

SEQ ID NO: 5288363 - DNA, 21 bp, Homo sapiens
caaattttcaagtttacactt

SEQ ID NO: 5288364 - DNA, 18 bp, Homo sapiens
caaattttcactgctgct

SEQ ID NO: 5288365 - DNA, 19 bp, Homo sapiens
caaattttcactgctgctc

SEQ ID NO: 5288366 - DNA, 16 bp, Homo sapiens
caaattttcagaaggt

SEQ ID NO: 5288367 - DNA, 14 bp, Homo sapiens
caaattttctggtg

SEQ ID NO: 5288368 - DNA, 19 bp, Homo sapiens
caaattttgaggtctttta

SEQ ID NO: 5288369 - DNA, 19 bp, Homo sapiens
caaattttgagttgccaca

SEQ ID NO: 5288370 - DNA, 19 bp, Homo sapiens
caaattttgcacttttttg

SEQ ID NO: 5288371 - DNA, 13 bp, Homo sapiens
caaattttggcca

SEQ ID NO: 5288372 - DNA, 15 bp, Homo sapiens
caaattttggccaaa

SEQ ID NO: 5288373 - DNA, 19 bp, Homo sapiens
caaatttttactcaggctt

SEQ ID NO: 5288374 - DNA, 17 bp, Homo sapiens
caaatttttacttgaag

SEQ ID NO: 5288375 - DNA, 19 bp, Homo sapiens
caaatttttattttttagt

SEQ ID NO: 5288376 - DNA, 17 bp, Homo sapiens
caaattttttaaaagag

SEQ ID NO: 5288377 - DNA, 17 bp, Homo sapiens
caaattttttgaaaata

SEQ ID NO: 5288378 - DNA, 16 bp, Homo sapiens
caaatttttttcttag

SEQ ID NO: 5288379 - DNA, 23 bp, Homo sapiens
caacaaaaaaaatttaactccat

SEQ ID NO: 5288380 - DNA, 19 bp, Homo sapiens
caacaaaaaaagtttgtta

SEQ ID NO: 5288381 - DNA, 14 bp, Homo sapiens
caacaaaaagacat

SEQ ID NO: 5288382 - DNA, 16 bp, Homo sapiens
caacaaaaagcttccc

SEQ ID NO: 5288383 - DNA, 23 bp, Homo sapiens
caacaaaaatttgaaccaaaaca

SEQ ID NO: 5288384 - DNA, 22 bp, Homo sapiens
caacaaaagaagcccggctcct

SEQ ID NO: 5288385 - DNA, 12 bp, Homo sapiens
caacaaaagaat

SEQ ID NO: 5288386 - DNA, 13 bp, Homo sapiens
caacaaaaggaag

SEQ ID NO: 5288387 - DNA, 20 bp, Homo sapiens
caacaaaaggacttcaggaa

SEQ ID NO: 5288388 - DNA, 13 bp, Homo sapiens
caacaaaatacat

SEQ ID NO: 5288389 - DNA, 16 bp, Homo sapiens
caacaaaatatttaat

SEQ ID NO: 5288390 - DNA, 12 bp, Homo sapiens
caacaaacactg

SEQ ID NO: 5288391 - DNA, 13 bp, Homo sapiens
caacaaaccaaaa

SEQ ID NO: 5288392 - DNA, 13 bp, Homo sapiens
caacaaaccaaga

SEQ ID NO: 5288393 - DNA, 23 bp, Homo sapiens
caacaaacctgtttctgcagcca

SEQ ID NO: 5288394 - DNA, 22 bp, Homo sapiens
caacaaactgcacatgatttca

SEQ ID NO: 5288395 - DNA, 15 bp, Homo sapiens
caacaaagaaacaaa

SEQ ID NO: 5288396 - DNA, 20 bp, Homo sapiens
caacaaagaagaaccatctt

SEQ ID NO: 5288397 - DNA, 17 bp, Homo sapiens
caacaaagaggacacca

SEQ ID NO: 5288398 - DNA, 19 bp, Homo sapiens
caacaaagattgagaagcc

SEQ ID NO: 5288399 - DNA, 19 bp, Homo sapiens
caacaaagcatgctcagta

SEQ ID NO: 5288400 - DNA, 12 bp, Homo sapiens
caacaaaggaag

SEQ ID NO: 5288401 - DNA, 22 bp, Homo sapiens
caacaaaggattaattgctgca

SEQ ID NO: 5288402 - DNA, 20 bp, Homo sapiens
caacaaagggttttaatgta

SEQ ID NO: 5288403 - DNA, 22 bp, Homo sapiens
caacaaagtatttttttctttt

SEQ ID NO: 5288404 - DNA, 18 bp, Homo sapiens
caacaaagtgcttccttt

SEQ ID NO: 5288405 - DNA, 16 bp, Homo sapiens
caacaaataatttaag

SEQ ID NO: 5288406 - DNA, 17 bp, Homo sapiens
caacaaataatttaagt

SEQ ID NO: 5288407 - DNA, 22 bp, Homo sapiens
caacaaatctaggaaaatattt

SEQ ID NO: 5288408 - DNA, 9 bp, Homo sapiens
caacaaatt

SEQ ID NO: 5288409 - DNA, 22 bp, Homo sapiens
caacaaattaaataaattaccc

SEQ ID NO: 5288410 - DNA, 14 bp, Homo sapiens
caacaaatttcatt

SEQ ID NO: 5288411 - DNA, 15 bp, Homo sapiens
caacaacaaaaaata

SEQ ID NO: 5288412 - DNA, 14 bp, Homo sapiens
atttacactggtct

SEQ ID NO: 5288413 - DNA, 19 bp, Homo sapiens
atttacactggtctaatgt

SEQ ID NO: 5288414 - DNA, 11 bp, Homo sapiens
atttacagaaa

SEQ ID NO: 5288415 - DNA, 13 bp, Homo sapiens
atttacagaagaa

SEQ ID NO: 5288416 - DNA, 22 bp, Homo sapiens
atttacagaagaaaagcatgca

SEQ ID NO: 5288417 - DNA, 12 bp, Homo sapiens
atttacagaata

SEQ ID NO: 5288418 - DNA, 17 bp, Homo sapiens
atttacaggacttctct

SEQ ID NO: 5288419 - DNA, 16 bp, Homo sapiens
atttacagggatttct

SEQ ID NO: 5288420 - DNA, 19 bp, Homo sapiens
atttacagtattgagcttt

SEQ ID NO: 5288421 - DNA, 18 bp, Homo sapiens
atttacagtccttcaaaa

SEQ ID NO: 5288422 - DNA, 18 bp, Homo sapiens
atttacagtctctttctt

SEQ ID NO: 5288423 - DNA, 23 bp, Homo sapiens
atttacagtgatagaacaaaaga

SEQ ID NO: 5288424 - DNA, 15 bp, Homo sapiens
atttacagtttcaaa

SEQ ID NO: 5288425 - DNA, 20 bp, Homo sapiens
atttacatagtgcaaaactg

SEQ ID NO: 5288426 - DNA, 13 bp, Homo sapiens
atttacatataat

SEQ ID NO: 5288427 - DNA, 16 bp, Homo sapiens
atttacatatgaaatt

SEQ ID NO: 5288428 - DNA, 21 bp, Homo sapiens
atttacatatgaaatttaata

SEQ ID NO: 5288429 - DNA, 13 bp, Homo sapiens
atttacatcactt

SEQ ID NO: 5288430 - DNA, 21 bp, Homo sapiens
atttacatcactttgtgaatt

SEQ ID NO: 5288431 - DNA, 21 bp, Homo sapiens
atttacatcagaagtttgcat

SEQ ID NO: 5288432 - DNA, 20 bp, Homo sapiens
atttacatgaattgcatttt

SEQ ID NO: 5288433 - DNA, 16 bp, Homo sapiens
atttacatgtattatt

SEQ ID NO: 5288434 - DNA, 17 bp, Homo sapiens
atttacatgttcttcca

SEQ ID NO: 5288435 - DNA, 21 bp, Homo sapiens
atttacattctagttcagagc

SEQ ID NO: 5288436 - DNA, 18 bp, Homo sapiens
atttacatttaatacaga

SEQ ID NO: 5288437 - DNA, 14 bp, Homo sapiens
atttaccaacatgt

SEQ ID NO: 5288438 - DNA, 16 bp, Homo sapiens
atttaccaacatgtat

SEQ ID NO: 5288439 - DNA, 22 bp, Homo sapiens
atttaccaacatgtatctgtct

SEQ ID NO: 5288440 - DNA, 23 bp, Homo sapiens
atttaccaacatgtatctgtcta

SEQ ID NO: 5288441 - DNA, 22 bp, Homo sapiens
atttaccaaggatgaattcttt

SEQ ID NO: 5288442 - DNA, 15 bp, Homo sapiens
atttaccacagcagc

SEQ ID NO: 5288443 - DNA, 15 bp, Homo sapiens
atttaccacttgtgt

SEQ ID NO: 5288444 - DNA, 13 bp, Homo sapiens
atttaccagaaat

SEQ ID NO: 5288445 - DNA, 15 bp, Homo sapiens
atttaccagaaatat

SEQ ID NO: 5288446 - DNA, 17 bp, Homo sapiens
atttaccagaaatattt

SEQ ID NO: 5288447 - DNA, 13 bp, Homo sapiens
atttaccagaagt

SEQ ID NO: 5288448 - DNA, 21 bp, Homo sapiens
atttaccagaagtttaaatct

SEQ ID NO: 5288449 - DNA, 16 bp, Homo sapiens
atttaccagcttaaga

SEQ ID NO: 5288450 - DNA, 19 bp, Homo sapiens
atttaccagggatgtagat

SEQ ID NO: 5288451 - DNA, 23 bp, Homo sapiens
atttaccatcaaacaaatcattt

SEQ ID NO: 5288452 - DNA, 15 bp, Homo sapiens
atttaccatctgaaa

SEQ ID NO: 5288453 - DNA, 15 bp, Homo sapiens
atttaccatgtgcta

SEQ ID NO: 5288454 - DNA, 20 bp, Homo sapiens
atttaccattattttacagt

SEQ ID NO: 5288455 - DNA, 19 bp, Homo sapiens
atttacccagaatgtcaga

SEQ ID NO: 5288456 - DNA, 20 bp, Homo sapiens
atttaccctttggccccact

SEQ ID NO: 5288457 - DNA, 14 bp, Homo sapiens
atttacctaagatt

SEQ ID NO: 5288458 - DNA, 15 bp, Homo sapiens
atttacctaagatta

SEQ ID NO: 5288459 - DNA, 12 bp, Homo sapiens
atttacctcagc

SEQ ID NO: 5288460 - DNA, 17 bp, Homo sapiens
atttacctctaaatttc

SEQ ID NO: 5288461 - DNA, 21 bp, Homo sapiens
atttacctctcattagaaagg

SEQ ID NO: 5288462 - DNA, 17 bp, Homo sapiens
atttacctgcgaacttg

SEQ ID NO: 5288463 - DNA, 19 bp, Homo sapiens
atttacctgtatttaagat

SEQ ID NO: 5288464 - DNA, 13 bp, Homo sapiens
atttacctttgga

SEQ ID NO: 5288465 - DNA, 17 bp, Homo sapiens
atttacctttggaattg

SEQ ID NO: 5288466 - DNA, 13 bp, Homo sapiens
atttaccttttaa

SEQ ID NO: 5288467 - DNA, 15 bp, Homo sapiens
atttaccttttaaga

SEQ ID NO: 5288468 - DNA, 19 bp, Homo sapiens
atttaccttttaagacatt

SEQ ID NO: 5288469 - DNA, 21 bp, Homo sapiens
atttacgaaaccaaaaagttg

SEQ ID NO: 5288470 - DNA, 19 bp, Homo sapiens
atttacgcctgtaaatgta

SEQ ID NO: 5288471 - DNA, 23 bp, Homo sapiens
atttacgcctgtaaatgtattca

SEQ ID NO: 5288472 - DNA, 19 bp, Homo sapiens
atttacgctttgattcata

SEQ ID NO: 5288473 - DNA, 22 bp, Homo sapiens
atttacgtatatttcattgaat

SEQ ID NO: 5288474 - DNA, 15 bp, Homo sapiens
atttactaaaagaat

SEQ ID NO: 5288475 - DNA, 15 bp, Homo sapiens
atttactaaaatgga

SEQ ID NO: 5288476 - DNA, 16 bp, Homo sapiens
atttactaaacatatg

SEQ ID NO: 5288477 - DNA, 19 bp, Homo sapiens
atttactaaacatatgatt

SEQ ID NO: 5288478 - DNA, 22 bp, Homo sapiens
atttactaaacatatgatttca

SEQ ID NO: 5288479 - DNA, 13 bp, Homo sapiens
atttactaacagt

SEQ ID NO: 5288480 - DNA, 14 bp, Homo sapiens
atttactaacagta

SEQ ID NO: 5288481 - DNA, 19 bp, Homo sapiens
atttactaacagtaactgc

SEQ ID NO: 5288482 - DNA, 22 bp, Homo sapiens
atttactaacagtaactgccat

SEQ ID NO: 5288483 - DNA, 22 bp, Homo sapiens
atttactatgcacaacagagta

SEQ ID NO: 5288484 - DNA, 18 bp, Homo sapiens
atttactatgtaaatgct

SEQ ID NO: 5288485 - DNA, 13 bp, Homo sapiens
atttactcacagc

SEQ ID NO: 5288486 - DNA, 13 bp, Homo sapiens
atttactcattat

SEQ ID NO: 5288487 - DNA, 16 bp, Homo sapiens
atttactcctcctgct

SEQ ID NO: 5288488 - DNA, 16 bp, Homo sapiens
atttactctgttgaat

SEQ ID NO: 5288489 - DNA, 17 bp, Homo sapiens
atttactctgttgaata

SEQ ID NO: 5288490 - DNA, 19 bp, Homo sapiens
atttactcttagagatgat

SEQ ID NO: 5288491 - DNA, 13 bp, Homo sapiens
atttactgagaga

SEQ ID NO: 5288492 - DNA, 20 bp, Homo sapiens
atttactgagcttctctgtg

SEQ ID NO: 5288493 - DNA, 19 bp, Homo sapiens
atttactgatcatctgctg

SEQ ID NO: 5288494 - DNA, 20 bp, Homo sapiens
atttactgatcatctgctgt

SEQ ID NO: 5288495 - DNA, 22 bp, Homo sapiens
atttactgatcatctgctgtga

SEQ ID NO: 5288496 - DNA, 17 bp, Homo sapiens
atttactgatgagagaa

SEQ ID NO: 5288497 - DNA, 16 bp, Homo sapiens
atttactgattccagc

SEQ ID NO: 5288498 - DNA, 19 bp, Homo sapiens
atttactgctctagaaagt

SEQ ID NO: 5288499 - DNA, 17 bp, Homo sapiens
atttactgctctttatt

SEQ ID NO: 5288500 - DNA, 23 bp, Homo sapiens
atttactggaaacctagccagct

SEQ ID NO: 5288501 - DNA, 17 bp, Homo sapiens
atttactgtactaatta

SEQ ID NO: 5288502 - DNA, 14 bp, Homo sapiens
atttactgtcccag

SEQ ID NO: 5288503 - DNA, 18 bp, Homo sapiens
atttactgtcttaaatca

SEQ ID NO: 5288504 - DNA, 15 bp, Homo sapiens
atttactgtgctaat

SEQ ID NO: 5288505 - DNA, 15 bp, Homo sapiens
atttactgtgtcttt

SEQ ID NO: 5288506 - DNA, 12 bp, Homo sapiens
atttactgtttt

SEQ ID NO: 5288507 - DNA, 15 bp, Homo sapiens
atttacttgaaagat

SEQ ID NO: 5288508 - DNA, 14 bp, Homo sapiens
atttacttgatcat

SEQ ID NO: 5288509 - DNA, 14 bp, Homo sapiens
atttacttgtagaa

SEQ ID NO: 5288510 - DNA, 18 bp, Homo sapiens
atttacttgtagaaatct

SEQ ID NO: 5288511 - DNA, 16 bp, Homo sapiens
atttacttgttttgga

SEQ ID NO: 5288512 - DNA, 16 bp, Homo sapiens
atttactttgtagact

SEQ ID NO: 5288513 - DNA, 17 bp, Homo sapiens
atttactttttaaaaat

SEQ ID NO: 5288514 - DNA, 18 bp, Homo sapiens
atttactttttaaaaata

SEQ ID NO: 5288515 - DNA, 18 bp, Homo sapiens
atttactttttaaacagt

SEQ ID NO: 5288516 - DNA, 19 bp, Homo sapiens
atttactttttaaacagtg

SEQ ID NO: 5288517 - DNA, 18 bp, Homo sapiens
atttactttttatttgca

SEQ ID NO: 5288518 - DNA, 19 bp, Homo sapiens
atttagaaaaaaacatgaa

SEQ ID NO: 5288519 - DNA, 13 bp, Homo sapiens
atttagaaaaaag

SEQ ID NO: 5288520 - DNA, 15 bp, Homo sapiens
atttagaaaaagtca

SEQ ID NO: 5288521 - DNA, 13 bp, Homo sapiens
atttagaaaacat

SEQ ID NO: 5288522 - DNA, 19 bp, Homo sapiens
atttagaaaacattcatcc

SEQ ID NO: 5288523 - DNA, 20 bp, Homo sapiens
atttagaaaacattcatcca

SEQ ID NO: 5288524 - DNA, 13 bp, Homo sapiens
atttagaaaactt

SEQ ID NO: 5288525 - DNA, 14 bp, Homo sapiens
atttagaaaacttt

SEQ ID NO: 5288526 - DNA, 18 bp, Homo sapiens
atttagaaaactttaaag

SEQ ID NO: 5288527 - DNA, 18 bp, Homo sapiens
atttagaaactaattgac

SEQ ID NO: 5288528 - DNA, 13 bp, Homo sapiens
atttagaaactga

SEQ ID NO: 5288529 - DNA, 16 bp, Homo sapiens
atttagaaactgattt

SEQ ID NO: 5288530 - DNA, 16 bp, Homo sapiens
atttagaaatcaagca

SEQ ID NO: 5288531 - DNA, 17 bp, Homo sapiens
atttagaacctaacttt

SEQ ID NO: 5288532 - DNA, 19 bp, Homo sapiens
atttagaacctgcatttaa

SEQ ID NO: 5288533 - DNA, 15 bp, Homo sapiens
atttagaagaaaagt

SEQ ID NO: 5288534 - DNA, 15 bp, Homo sapiens
atttagaagaaagat

SEQ ID NO: 5288535 - DNA, 22 bp, Homo sapiens
atttagaagataggtgagcaac

SEQ ID NO: 5288536 - DNA, 23 bp, Homo sapiens
atttagaagcaaagatttcagta

SEQ ID NO: 5288537 - DNA, 13 bp, Homo sapiens
atttagaagccaa

SEQ ID NO: 5288538 - DNA, 19 bp, Homo sapiens
atttagaagcctgacaact

SEQ ID NO: 5288539 - DNA, 19 bp, Homo sapiens
atttagaagctgaagatcc

SEQ ID NO: 5288540 - DNA, 13 bp, Homo sapiens
atttagaatatat

SEQ ID NO: 5288541 - DNA, 20 bp, Homo sapiens
atttagaatatattaaatcg

SEQ ID NO: 5288542 - DNA, 14 bp, Homo sapiens
atttagaatctaga

SEQ ID NO: 5288543 - DNA, 15 bp, Homo sapiens
atttagaatctagaa

SEQ ID NO: 5288544 - DNA, 16 bp, Homo sapiens
atttagaatctagaaa

SEQ ID NO: 5288545 - DNA, 15 bp, Homo sapiens
atttagaatgaatat

SEQ ID NO: 5288546 - DNA, 11 bp, Homo sapiens
atttagaatgg

SEQ ID NO: 5288547 - DNA, 17 bp, Homo sapiens
atttagaatggtgattt

SEQ ID NO: 5288548 - DNA, 19 bp, Homo sapiens
atttagaatggttgagtta

SEQ ID NO: 5288549 - DNA, 18 bp, Homo sapiens
atttagaatttgaaagga

SEQ ID NO: 5288550 - DNA, 23 bp, Homo sapiens
atttagacaacctgaaatttatt

SEQ ID NO: 5288551 - DNA, 21 bp, Homo sapiens
atttagacaatggctatatta

SEQ ID NO: 5288552 - DNA, 13 bp, Homo sapiens
atttagaccctgt

SEQ ID NO: 5288553 - DNA, 19 bp, Homo sapiens
atttagagataggaaactg

SEQ ID NO: 5288554 - DNA, 16 bp, Homo sapiens
atttagagatgctgta

SEQ ID NO: 5288555 - DNA, 22 bp, Homo sapiens
atttagagatgctgtaacttaa

SEQ ID NO: 5288556 - DNA, 21 bp, Homo sapiens
atttagagcaatgcattctgg

SEQ ID NO: 5288557 - DNA, 18 bp, Homo sapiens
atttagagcgtttggtta

SEQ ID NO: 5288558 - DNA, 19 bp, Homo sapiens
atttagagcgtttggttaa

SEQ ID NO: 5288559 - DNA, 23 bp, Homo sapiens
atttagagcgtttggttaaagta

SEQ ID NO: 5288560 - DNA, 22 bp, Homo sapiens
atttagaggataaataataaag

SEQ ID NO: 5288561 - DNA, 18 bp, Homo sapiens
atttagagtatttacact

SEQ ID NO: 5288562 - DNA, 15 bp, Homo sapiens
atttagagtcaattt

SEQ ID NO: 5288563 - DNA, 21 bp, Homo sapiens
atttagagtcaatttgctgaa

SEQ ID NO: 5288564 - DNA, 23 bp, Homo sapiens
atttagataatttgaaaaagttc

SEQ ID NO: 5288565 - DNA, 18 bp, Homo sapiens
atttagatattttccata

SEQ ID NO: 5288566 - DNA, 20 bp, Homo sapiens
atttagatcttatattggtt

SEQ ID NO: 5288567 - DNA, 21 bp, Homo sapiens
atttagatcttatattggttt

SEQ ID NO: 5288568 - DNA, 15 bp, Homo sapiens
atttagatgcacttt

SEQ ID NO: 5288569 - DNA, 16 bp, Homo sapiens
atttagatgcatatta

SEQ ID NO: 5288570 - DNA, 17 bp, Homo sapiens
atttagattgaaaactt

SEQ ID NO: 5288571 - DNA, 14 bp, Homo sapiens
atttagattgtaaa

SEQ ID NO: 5288572 - DNA, 15 bp, Homo sapiens
atttagattgtaaac

SEQ ID NO: 5288573 - DNA, 18 bp, Homo sapiens
atttagattgttaaaata

SEQ ID NO: 5288574 - DNA, 17 bp, Homo sapiens
atttagatttatcactt

SEQ ID NO: 5288575 - DNA, 18 bp, Homo sapiens
atttagatttgttttgca

SEQ ID NO: 5288576 - DNA, 20 bp, Homo sapiens
atttagcaaactgatgctga

SEQ ID NO: 5288577 - DNA, 16 bp, Homo sapiens
atttagcaatgctgtg

SEQ ID NO: 5288578 - DNA, 16 bp, Homo sapiens
atttagcacagtattt

SEQ ID NO: 5288579 - DNA, 23 bp, Homo sapiens
atttagcacatactacacattca

SEQ ID NO: 5288580 - DNA, 14 bp, Homo sapiens
atttagcagtattg

SEQ ID NO: 5288581 - DNA, 18 bp, Homo sapiens
atttagcataaatttaat

SEQ ID NO: 5288582 - DNA, 14 bp, Homo sapiens
atttagcatgagtt

SEQ ID NO: 5288583 - DNA, 17 bp, Homo sapiens
atttagccaatgcttac

SEQ ID NO: 5288584 - DNA, 21 bp, Homo sapiens
atttagccagcgtttattgta

SEQ ID NO: 5288585 - DNA, 16 bp, Homo sapiens
atttagccattaccca

SEQ ID NO: 5288586 - DNA, 16 bp, Homo sapiens
atttagccctcacatt

SEQ ID NO: 5288587 - DNA, 22 bp, Homo sapiens
atttagccctggtttgaaattt

SEQ ID NO: 5288588 - DNA, 23 bp, Homo sapiens
atttagccctggtttgaaatttt

SEQ ID NO: 5288589 - DNA, 14 bp, Homo sapiens
atttagcctgtcct

SEQ ID NO: 5288590 - DNA, 15 bp, Homo sapiens
atttagcctgtcctg

SEQ ID NO: 5288591 - DNA, 22 bp, Homo sapiens
caacaacaaaaaatacattata

SEQ ID NO: 5288592 - DNA, 14 bp, Homo sapiens
caacaacaaaaaca

SEQ ID NO: 5288593 - DNA, 17 bp, Homo sapiens
caacaacaacaataata

SEQ ID NO: 5288594 - DNA, 15 bp, Homo sapiens
caacaacaaggaccc

SEQ ID NO: 5288595 - DNA, 13 bp, Homo sapiens
caacaacaataac

SEQ ID NO: 5288596 - DNA, 15 bp, Homo sapiens
caacaacaataataa

SEQ ID NO: 5288597 - DNA, 12 bp, Homo sapiens
caacaacaatac

SEQ ID NO: 5288598 - DNA, 15 bp, Homo sapiens
caacaacaatacaac

SEQ ID NO: 5288599 - DNA, 13 bp, Homo sapiens
caacaacagaaca

SEQ ID NO: 5288600 - DNA, 19 bp, Homo sapiens
caacaacagaacaacaaca

SEQ ID NO: 5288601 - DNA, 14 bp, Homo sapiens
caacaacatccatg

SEQ ID NO: 5288602 - DNA, 19 bp, Homo sapiens
caacaacatgaaactgcct

SEQ ID NO: 5288603 - DNA, 23 bp, Homo sapiens
caacaaccacacttaaatccagt

SEQ ID NO: 5288604 - DNA, 13 bp, Homo sapiens
caacaaccacagt

SEQ ID NO: 5288605 - DNA, 20 bp, Homo sapiens
caacaacctttccagctact

SEQ ID NO: 5288606 - DNA, 22 bp, Homo sapiens
caacaacgcttgtgaatgtatt

SEQ ID NO: 5288607 - DNA, 21 bp, Homo sapiens
caacaacgttcttagtttact

SEQ ID NO: 5288608 - DNA, 17 bp, Homo sapiens
caacaactattttttaa

SEQ ID NO: 5288609 - DNA, 18 bp, Homo sapiens
caacaactccaggaaaac

SEQ ID NO: 5288610 - DNA, 23 bp, Homo sapiens
caacaactgtccctccttgagca

SEQ ID NO: 5288611 - DNA, 12 bp, Homo sapiens
caacaagaagaa

SEQ ID NO: 5288612 - DNA, 18 bp, Homo sapiens
caacaagaagaatttgaa

SEQ ID NO: 5288613 - DNA, 16 bp, Homo sapiens
caacaagaaggtttct

SEQ ID NO: 5288614 - DNA, 16 bp, Homo sapiens
caacaagaatgcattg

SEQ ID NO: 5288615 - DNA, 18 bp, Homo sapiens
caacaagaatgcattgat

SEQ ID NO: 5288616 - DNA, 20 bp, Homo sapiens
caacaagaccgccccagggc

SEQ ID NO: 5288617 - DNA, 17 bp, Homo sapiens
caacaagagcaaaatga

SEQ ID NO: 5288618 - DNA, 14 bp, Homo sapiens
caacaagagtttat

SEQ ID NO: 5288619 - DNA, 15 bp, Homo sapiens
caacaagatttccac

SEQ ID NO: 5288620 - DNA, 21 bp, Homo sapiens
caacaagcccgttagccccag

SEQ ID NO: 5288621 - DNA, 13 bp, Homo sapiens
caacaagcctcaa

SEQ ID NO: 5288622 - DNA, 13 bp, Homo sapiens
caacaagctattt

SEQ ID NO: 5288623 - DNA, 16 bp, Homo sapiens
caacaagctcatccct

SEQ ID NO: 5288624 - DNA, 17 bp, Homo sapiens
caacaagctcatccctg

SEQ ID NO: 5288625 - DNA, 17 bp, Homo sapiens
caacaaggacaacttta

SEQ ID NO: 5288626 - DNA, 17 bp, Homo sapiens
caacaaggatcaggctg

SEQ ID NO: 5288627 - DNA, 20 bp, Homo sapiens
caacaaggccctttaacttg

SEQ ID NO: 5288628 - DNA, 19 bp, Homo sapiens
caacaagggcagtggaggt

SEQ ID NO: 5288629 - DNA, 17 bp, Homo sapiens
caacaaggtatacctca

SEQ ID NO: 5288630 - DNA, 19 bp, Homo sapiens
caacaaggttggcacccca

SEQ ID NO: 5288631 - DNA, 13 bp, Homo sapiens
caacaagtaactt

SEQ ID NO: 5288632 - DNA, 16 bp, Homo sapiens
caacaagtgctcctga

SEQ ID NO: 5288633 - DNA, 14 bp, Homo sapiens
caacaagttgcctc

SEQ ID NO: 5288634 - DNA, 23 bp, Homo sapiens
caacaataaacaggaattttatt

SEQ ID NO: 5288635 - DNA, 22 bp, Homo sapiens
caacaataaaccaaacccagcc

SEQ ID NO: 5288636 - DNA, 23 bp, Homo sapiens
caacaataaaccaaacccagcca

SEQ ID NO: 5288637 - DNA, 16 bp, Homo sapiens
caacaataacaacaat

SEQ ID NO: 5288638 - DNA, 12 bp, Homo sapiens
caacaataataa

SEQ ID NO: 5288639 - DNA, 13 bp, Homo sapiens
caacaataataaa

SEQ ID NO: 5288640 - DNA, 22 bp, Homo sapiens
caacaataataaagatgtgaaa

SEQ ID NO: 5288641 - DNA, 16 bp, Homo sapiens
caacaataataaatgt

SEQ ID NO: 5288642 - DNA, 18 bp, Homo sapiens
caacaataataattaaag

SEQ ID NO: 5288643 - DNA, 21 bp, Homo sapiens
caacaatacaacaagaacaac

SEQ ID NO: 5288644 - DNA, 22 bp, Homo sapiens
caacaatacatgctgctaattc

SEQ ID NO: 5288645 - DNA, 18 bp, Homo sapiens
caacaatactacctcact

SEQ ID NO: 5288646 - DNA, 18 bp, Homo sapiens
caacaatactttgtgtct

SEQ ID NO: 5288647 - DNA, 20 bp, Homo sapiens
caacaatactttgtgtcttt

SEQ ID NO: 5288648 - DNA, 19 bp, Homo sapiens
caacaatagtgacaccagt

SEQ ID NO: 5288649 - DNA, 17 bp, Homo sapiens
caacaatcccaaggccc

SEQ ID NO: 5288650 - DNA, 22 bp, Homo sapiens
caacaatctggagatactaaat

SEQ ID NO: 5288651 - DNA, 17 bp, Homo sapiens
caacaatgagtggacaa

SEQ ID NO: 5288652 - DNA, 18 bp, Homo sapiens
caacaatgattaatcagc

SEQ ID NO: 5288653 - DNA, 15 bp, Homo sapiens
caacaatgattttct

SEQ ID NO: 5288654 - DNA, 11 bp, Homo sapiens
caacaatgcaa

SEQ ID NO: 5288655 - DNA, 19 bp, Homo sapiens
caacaatggggtgggccca

SEQ ID NO: 5288656 - DNA, 21 bp, Homo sapiens
caacaatggtttacatgaaca

SEQ ID NO: 5288657 - DNA, 22 bp, Homo sapiens
caacaatggtttacatgaacac

SEQ ID NO: 5288658 - DNA, 18 bp, Homo sapiens
caacaatgtgaggggtcc

SEQ ID NO: 5288659 - DNA, 13 bp, Homo sapiens
caacaattagagg

SEQ ID NO: 5288660 - DNA, 15 bp, Homo sapiens
caacaattaggtctg

SEQ ID NO: 5288661 - DNA, 14 bp, Homo sapiens
caacaattcagcat

SEQ ID NO: 5288662 - DNA, 23 bp, Homo sapiens
caacaattctcccgggactctgc

SEQ ID NO: 5288663 - DNA, 14 bp, Homo sapiens
caacaattggtaaa

SEQ ID NO: 5288664 - DNA, 19 bp, Homo sapiens
caacaattggtaaaactca

SEQ ID NO: 5288665 - DNA, 20 bp, Homo sapiens
caacaatttagaaggaaaac

SEQ ID NO: 5288666 - DNA, 22 bp, Homo sapiens
caacaatttaggaatgctcaat

SEQ ID NO: 5288667 - DNA, 17 bp, Homo sapiens
caacaatttatgaattg

SEQ ID NO: 5288668 - DNA, 16 bp, Homo sapiens
caacacaaagacacag

SEQ ID NO: 5288669 - DNA, 14 bp, Homo sapiens
caacacaaagacat

SEQ ID NO: 5288670 - DNA, 18 bp, Homo sapiens
caacacaaagacatggaa

SEQ ID NO: 5288671 - DNA, 13 bp, Homo sapiens
caacacaaagatt

SEQ ID NO: 5288672 - DNA, 17 bp, Homo sapiens
caacacaagctggaagc

SEQ ID NO: 5288673 - DNA, 20 bp, Homo sapiens
caacacaatcaaaagattaa

SEQ ID NO: 5288674 - DNA, 21 bp, Homo sapiens
caacacaatctttccttgtct

SEQ ID NO: 5288675 - DNA, 21 bp, Homo sapiens
caacacacacacacacaaaac

SEQ ID NO: 5288676 - DNA, 18 bp, Homo sapiens
caacacacacatgcttcc

SEQ ID NO: 5288677 - DNA, 21 bp, Homo sapiens
caacacacagatttgagctca

SEQ ID NO: 5288678 - DNA, 22 bp, Homo sapiens
caacacacagatttgagctcag

SEQ ID NO: 5288679 - DNA, 12 bp, Homo sapiens
caacacacagga

SEQ ID NO: 5288680 - DNA, 24 bp, Homo sapiens
caacacagagctggcgactgcagc

SEQ ID NO: 5288681 - DNA, 16 bp, Homo sapiens
caacacagaggaattt

SEQ ID NO: 5288682 - DNA, 14 bp, Homo sapiens
caacacagaggcag

SEQ ID NO: 5288683 - DNA, 13 bp, Homo sapiens
caacacagatccg

SEQ ID NO: 5288684 - DNA, 22 bp, Homo sapiens
caacacagcctgggccccagct

SEQ ID NO: 5288685 - DNA, 24 bp, Homo sapiens
caacacagcttgtctcttgcctgc

SEQ ID NO: 5288686 - DNA, 22 bp, Homo sapiens
caacacaggcaagtccacccca

SEQ ID NO: 5288687 - DNA, 12 bp, Homo sapiens
caacacatgtgg

SEQ ID NO: 5288688 - DNA, 16 bp, Homo sapiens
caacacattacttgca

SEQ ID NO: 5288689 - DNA, 23 bp, Homo sapiens
caacacattacttgcacaagctt

SEQ ID NO: 5288690 - DNA, 20 bp, Homo sapiens
caacacattgaaactgtatt

SEQ ID NO: 5288691 - DNA, 12 bp, Homo sapiens
caacacattttt

SEQ ID NO: 5288692 - DNA, 15 bp, Homo sapiens
caacaccaaaaaata

SEQ ID NO: 5288693 - DNA, 13 bp, Homo sapiens
caacaccacaaac

SEQ ID NO: 5288694 - DNA, 12 bp, Homo sapiens
caacaccacaga

SEQ ID NO: 5288695 - DNA, 21 bp, Homo sapiens
caacaccaccgagctctgtgg

SEQ ID NO: 5288696 - DNA, 13 bp, Homo sapiens
caacaccagcccc

SEQ ID NO: 5288697 - DNA, 22 bp, Homo sapiens
caacaccagcccctgccccagc

SEQ ID NO: 5288698 - DNA, 19 bp, Homo sapiens
caacacccaagatgaatta

SEQ ID NO: 5288699 - DNA, 16 bp, Homo sapiens
caacacccaagtccac

SEQ ID NO: 5288700 - DNA, 15 bp, Homo sapiens
caacaccccacagga

SEQ ID NO: 5288701 - DNA, 15 bp, Homo sapiens
caacaccccgcctgc

SEQ ID NO: 5288702 - DNA, 19 bp, Homo sapiens
caacaccccgcctgcctcc

SEQ ID NO: 5288703 - DNA, 13 bp, Homo sapiens
caacaccctcttc

SEQ ID NO: 5288704 - DNA, 16 bp, Homo sapiens
caacaccctgcttctc

SEQ ID NO: 5288705 - DNA, 17 bp, Homo sapiens
caacacctcctcctgct

SEQ ID NO: 5288706 - DNA, 22 bp, Homo sapiens
caacacctcctcctgctgctca

SEQ ID NO: 5288707 - DNA, 24 bp, Homo sapiens
caacacctcctcctgctgctcact

SEQ ID NO: 5288708 - DNA, 19 bp, Homo sapiens
caacacctccttgctttgc

SEQ ID NO: 5288709 - DNA, 20 bp, Homo sapiens
caacacctctgcacaagctg

SEQ ID NO: 5288710 - DNA, 18 bp, Homo sapiens
caacacctcttggggagt

SEQ ID NO: 5288711 - DNA, 13 bp, Homo sapiens
caacacctgccgt

SEQ ID NO: 5288712 - DNA, 14 bp, Homo sapiens
caacacctgctgcg

SEQ ID NO: 5288713 - DNA, 16 bp, Homo sapiens
caacacctgctgcgct

SEQ ID NO: 5288714 - DNA, 20 bp, Homo sapiens
caacacctgtggataaaaca

SEQ ID NO: 5288715 - DNA, 23 bp, Homo sapiens
caacaccttcagaggctgaggtg

SEQ ID NO: 5288716 - DNA, 15 bp, Homo sapiens
caacaccttcctcct

SEQ ID NO: 5288717 - DNA, 20 bp, Homo sapiens
caacaccttcctcctgcaga

SEQ ID NO: 5288718 - DNA, 14 bp, Homo sapiens
caacaccttcttgg

SEQ ID NO: 5288719 - DNA, 23 bp, Homo sapiens
caacacgagcaggctactgtcag

SEQ ID NO: 5288720 - DNA, 15 bp, Homo sapiens
caacacgcaggagca

SEQ ID NO: 5288721 - DNA, 17 bp, Homo sapiens
caacacgtcattgtgta

SEQ ID NO: 5288722 - DNA, 14 bp, Homo sapiens
caacactaacatga

SEQ ID NO: 5288723 - DNA, 18 bp, Homo sapiens
caacactaattgtccaca

SEQ ID NO: 5288724 - DNA, 18 bp, Homo sapiens
caacactacttccctgcc

SEQ ID NO: 5288725 - DNA, 16 bp, Homo sapiens
caacactatataaata

SEQ ID NO: 5288726 - DNA, 17 bp, Homo sapiens
caacactatatatttta

SEQ ID NO: 5288727 - DNA, 15 bp, Homo sapiens
caacactattgtaat

SEQ ID NO: 5288728 - DNA, 17 bp, Homo sapiens
caacactcactgcctgc

SEQ ID NO: 5288729 - DNA, 19 bp, Homo sapiens
caacactcactgcctgcag

SEQ ID NO: 5288730 - DNA, 14 bp, Homo sapiens
caacactcagtcct

SEQ ID NO: 5288731 - DNA, 18 bp, Homo sapiens
caacactcattgacctga

SEQ ID NO: 5288732 - DNA, 15 bp, Homo sapiens
caacactccaggccc

SEQ ID NO: 5288733 - DNA, 21 bp, Homo sapiens
caacactccaggccctgcccc

SEQ ID NO: 5288734 - DNA, 23 bp, Homo sapiens
caacactccggtcagcccctggc

SEQ ID NO: 5288735 - DNA, 14 bp, Homo sapiens
caacactctacttg

SEQ ID NO: 5288736 - DNA, 22 bp, Homo sapiens
caacactgaagtgcttgcagat

SEQ ID NO: 5288737 - DNA, 15 bp, Homo sapiens
caacactgattcctg

SEQ ID NO: 5288738 - DNA, 23 bp, Homo sapiens
caacactgatttccccttttgca

SEQ ID NO: 5288739 - DNA, 22 bp, Homo sapiens
caacactgccagaagtgtgttt

SEQ ID NO: 5288740 - DNA, 13 bp, Homo sapiens
caacactgccagc

SEQ ID NO: 5288741 - DNA, 21 bp, Homo sapiens
caacactgtccttccctgcca

SEQ ID NO: 5288742 - DNA, 17 bp, Homo sapiens
caacactgtgccctggt

SEQ ID NO: 5288743 - DNA, 23 bp, Homo sapiens
caacactgtgccctggtggagaa

SEQ ID NO: 5288744 - DNA, 19 bp, Homo sapiens
caacactgtgggtgtgtga

SEQ ID NO: 5288745 - DNA, 19 bp, Homo sapiens
caacacttaatagcaacag

SEQ ID NO: 5288746 - DNA, 16 bp, Homo sapiens
caacacttaatcattt

SEQ ID NO: 5288747 - DNA, 21 bp, Homo sapiens
caacacttgcaggggtccctg

SEQ ID NO: 5288748 - DNA, 19 bp, Homo sapiens
caacacttgtgttgctttc

SEQ ID NO: 5288749 - DNA, 15 bp, Homo sapiens
caacactttgagcat

SEQ ID NO: 5288750 - DNA, 21 bp, Homo sapiens
caacactttgagcatttttaa

SEQ ID NO: 5288751 - DNA, 16 bp, Homo sapiens
caacacttttgggagg

SEQ ID NO: 5288752 - DNA, 15 bp, Homo sapiens
caacagaaaaacaat

SEQ ID NO: 5288753 - DNA, 17 bp, Homo sapiens
caacagaaaccaagaga

SEQ ID NO: 5288754 - DNA, 22 bp, Homo sapiens
caacagaaacctatcctcactg

SEQ ID NO: 5288755 - DNA, 14 bp, Homo sapiens
caacagaaaccttt

SEQ ID NO: 5288756 - DNA, 18 bp, Homo sapiens
caacagaaaccttttatt

SEQ ID NO: 5288757 - DNA, 17 bp, Homo sapiens
caacagaaagagggaca

SEQ ID NO: 5288758 - DNA, 14 bp, Homo sapiens
caacagaacaacaa

SEQ ID NO: 5288759 - DNA, 21 bp, Homo sapiens
caacagaacaacaacaaagca

SEQ ID NO: 5288760 - DNA, 15 bp, Homo sapiens
caacagaacccacag

SEQ ID NO: 5288761 - DNA, 16 bp, Homo sapiens
caacagaacccacagt

SEQ ID NO: 5288762 - DNA, 16 bp, Homo sapiens
caacagaactaaatgt

SEQ ID NO: 5288763 - DNA, 15 bp, Homo sapiens
caacagaagaactgt

SEQ ID NO: 5288764 - DNA, 12 bp, Homo sapiens
caacagaagcag

SEQ ID NO: 5288765 - DNA, 23 bp, Homo sapiens
caacagaagcatttgtattttgt

SEQ ID NO: 5288766 - DNA, 21 bp, Homo sapiens
caacagaagtatcaagccatg

SEQ ID NO: 5288767 - DNA, 20 bp, Homo sapiens
caacagaagtcatgaagccc

SEQ ID NO: 5288768 - DNA, 22 bp, Homo sapiens
caacagaagtcatgaagcccaa

SEQ ID NO: 5288769 - DNA, 22 bp, Homo sapiens
atttagcctgtcctgtcatcat

SEQ ID NO: 5288770 - DNA, 22 bp, Homo sapiens
atttagcgcacccagagaaaat

SEQ ID NO: 5288771 - DNA, 18 bp, Homo sapiens
atttagcgtagctaagtg

SEQ ID NO: 5288772 - DNA, 21 bp, Homo sapiens
atttagctaaacggattccaa

SEQ ID NO: 5288773 - DNA, 22 bp, Homo sapiens
atttagctaaacggattccaaa

SEQ ID NO: 5288774 - DNA, 23 bp, Homo sapiens
atttagctaaacggattccaaag

SEQ ID NO: 5288775 - DNA, 19 bp, Homo sapiens
atttagctacagcttgttt

SEQ ID NO: 5288776 - DNA, 21 bp, Homo sapiens
atttagctacagcttgtttaa

SEQ ID NO: 5288777 - DNA, 14 bp, Homo sapiens
atttagctatttat

SEQ ID NO: 5288778 - DNA, 14 bp, Homo sapiens
atttagctgtaaac

SEQ ID NO: 5288779 - DNA, 17 bp, Homo sapiens
atttagctgtattcata

SEQ ID NO: 5288780 - DNA, 21 bp, Homo sapiens
atttagctgtattcatatatt

SEQ ID NO: 5288781 - DNA, 23 bp, Homo sapiens
atttagctgtggctccctcctcc

SEQ ID NO: 5288782 - DNA, 13 bp, Homo sapiens
atttagcttcttt

SEQ ID NO: 5288783 - DNA, 17 bp, Homo sapiens
atttagctttacatatt

SEQ ID NO: 5288784 - DNA, 19 bp, Homo sapiens
atttagctttacatattcc

SEQ ID NO: 5288785 - DNA, 17 bp, Homo sapiens
atttaggaaacaccatt

SEQ ID NO: 5288786 - DNA, 22 bp, Homo sapiens
atttaggaatgctcaatgtgct

SEQ ID NO: 5288787 - DNA, 17 bp, Homo sapiens
atttaggagaagttggt

SEQ ID NO: 5288788 - DNA, 16 bp, Homo sapiens
atttaggatccatgca

SEQ ID NO: 5288789 - DNA, 13 bp, Homo sapiens
atttaggcaagag

SEQ ID NO: 5288790 - DNA, 17 bp, Homo sapiens
atttaggcaagagaaaa

SEQ ID NO: 5288791 - DNA, 21 bp, Homo sapiens
atttagggaaaggtagtgtat

SEQ ID NO: 5288792 - DNA, 16 bp, Homo sapiens
atttagggaactgctt

SEQ ID NO: 5288793 - DNA, 14 bp, Homo sapiens
atttagggaagcag

SEQ ID NO: 5288794 - DNA, 17 bp, Homo sapiens
atttagggaagcaggga

SEQ ID NO: 5288795 - DNA, 22 bp, Homo sapiens
atttagggagaaatgttgttca

SEQ ID NO: 5288796 - DNA, 16 bp, Homo sapiens
atttagggagtattct

SEQ ID NO: 5288797 - DNA, 18 bp, Homo sapiens
atttagggccttttctgt

SEQ ID NO: 5288798 - DNA, 18 bp, Homo sapiens
atttagggtgttaaactt

SEQ ID NO: 5288799 - DNA, 19 bp, Homo sapiens
atttagggttctatattta

SEQ ID NO: 5288800 - DNA, 21 bp, Homo sapiens
atttagggttctatatttact

SEQ ID NO: 5288801 - DNA, 15 bp, Homo sapiens
atttaggtaaataaa

SEQ ID NO: 5288802 - DNA, 22 bp, Homo sapiens
atttaggtaaataaagctcaag

SEQ ID NO: 5288803 - DNA, 16 bp, Homo sapiens
atttaggtatgctatt

SEQ ID NO: 5288804 - DNA, 23 bp, Homo sapiens
atttaggtcagtagactgtgatt

SEQ ID NO: 5288805 - DNA, 17 bp, Homo sapiens
atttaggttttctctgt

SEQ ID NO: 5288806 - DNA, 13 bp, Homo sapiens
atttagtaaaatt

SEQ ID NO: 5288807 - DNA, 18 bp, Homo sapiens
atttagtaaaattatctg

SEQ ID NO: 5288808 - DNA, 19 bp, Homo sapiens
atttagtaaaattatctgt

SEQ ID NO: 5288809 - DNA, 18 bp, Homo sapiens
atttagtaaagtttgttg

SEQ ID NO: 5288810 - DNA, 20 bp, Homo sapiens
atttagtaaatgctgaaata

SEQ ID NO: 5288811 - DNA, 15 bp, Homo sapiens
atttagtaagaatac

SEQ ID NO: 5288812 - DNA, 15 bp, Homo sapiens
atttagtaagtatgt

SEQ ID NO: 5288813 - DNA, 14 bp, Homo sapiens
atttagtacactat

SEQ ID NO: 5288814 - DNA, 18 bp, Homo sapiens
atttagtacatccagaaa

SEQ ID NO: 5288815 - DNA, 19 bp, Homo sapiens
atttagtaccttcaaataa

SEQ ID NO: 5288816 - DNA, 16 bp, Homo sapiens
atttagtatctgtaat

SEQ ID NO: 5288817 - DNA, 20 bp, Homo sapiens
atttagtatctttttattca

SEQ ID NO: 5288818 - DNA, 14 bp, Homo sapiens
atttagtcatgtga

SEQ ID NO: 5288819 - DNA, 16 bp, Homo sapiens
atttagtcatgtgacc

SEQ ID NO: 5288820 - DNA, 20 bp, Homo sapiens
atttagtccaatgaagataa

SEQ ID NO: 5288821 - DNA, 16 bp, Homo sapiens
atttagtctaacacag

SEQ ID NO: 5288822 - DNA, 13 bp, Homo sapiens
atttagtctcttt

SEQ ID NO: 5288823 - DNA, 17 bp, Homo sapiens
atttagtctgttatatt

SEQ ID NO: 5288824 - DNA, 18 bp, Homo sapiens
atttagtgacaaaaataa

SEQ ID NO: 5288825 - DNA, 20 bp, Homo sapiens
atttagtgatactggctcag

SEQ ID NO: 5288826 - DNA, 20 bp, Homo sapiens
atttagtgatattgtgggta

SEQ ID NO: 5288827 - DNA, 21 bp, Homo sapiens
atttagtgatcaaattgtgca

SEQ ID NO: 5288828 - DNA, 19 bp, Homo sapiens
atttagtgatcttagcata

SEQ ID NO: 5288829 - DNA, 21 bp, Homo sapiens
atttagtggtggtagaaatga

SEQ ID NO: 5288830 - DNA, 17 bp, Homo sapiens
atttagtgtatatgtga

SEQ ID NO: 5288831 - DNA, 15 bp, Homo sapiens
atttagtgtatccat

SEQ ID NO: 5288832 - DNA, 10 bp, Homo sapiens
atttagtgtg

SEQ ID NO: 5288833 - DNA, 16 bp, Homo sapiens
atttagtgttcataaa

SEQ ID NO: 5288834 - DNA, 22 bp, Homo sapiens
atttagtgtttttttatttcta

SEQ ID NO: 5288835 - DNA, 17 bp, Homo sapiens
atttagttaacacacat

SEQ ID NO: 5288836 - DNA, 15 bp, Homo sapiens
atttagttaataaaa

SEQ ID NO: 5288837 - DNA, 13 bp, Homo sapiens
atttagttattga

SEQ ID NO: 5288838 - DNA, 16 bp, Homo sapiens
atttagttgagttatt

SEQ ID NO: 5288839 - DNA, 21 bp, Homo sapiens
atttagttgggtctgaaagga

SEQ ID NO: 5288840 - DNA, 22 bp, Homo sapiens
atttagttgggtctgaaaggaa

SEQ ID NO: 5288841 - DNA, 19 bp, Homo sapiens
atttagttgttgtagagaa

SEQ ID NO: 5288842 - DNA, 12 bp, Homo sapiens
atttagtttcag

SEQ ID NO: 5288843 - DNA, 22 bp, Homo sapiens
atttagtttgattattcagtgt

SEQ ID NO: 5288844 - DNA, 15 bp, Homo sapiens
atttagtttgttaaa

SEQ ID NO: 5288845 - DNA, 23 bp, Homo sapiens
atttagtttgttaaagcctgttc

SEQ ID NO: 5288846 - DNA, 21 bp, Homo sapiens
atttagttttatggcatgatt

SEQ ID NO: 5288847 - DNA, 17 bp, Homo sapiens
atttagttttgtaactt

SEQ ID NO: 5288848 - DNA, 17 bp, Homo sapiens
atttagtttttaacaat

SEQ ID NO: 5288849 - DNA, 23 bp, Homo sapiens
atttataaaaataaaaaacactg

SEQ ID NO: 5288850 - DNA, 18 bp, Homo sapiens
atttataaaaatataaat

SEQ ID NO: 5288851 - DNA, 19 bp, Homo sapiens
atttataaaattagaaagc

SEQ ID NO: 5288852 - DNA, 15 bp, Homo sapiens
atttataaacagaca

SEQ ID NO: 5288853 - DNA, 17 bp, Homo sapiens
atttataaactaatttt

SEQ ID NO: 5288854 - DNA, 17 bp, Homo sapiens
atttataaagctaaaat

SEQ ID NO: 5288855 - DNA, 21 bp, Homo sapiens
atttataaagctaaaataacc

SEQ ID NO: 5288856 - DNA, 12 bp, Homo sapiens
atttataaaggg

SEQ ID NO: 5288857 - DNA, 21 bp, Homo sapiens
atttataaataacaaaatttt

SEQ ID NO: 5288858 - DNA, 23 bp, Homo sapiens
atttataaatatattcaggagtt

SEQ ID NO: 5288859 - DNA, 16 bp, Homo sapiens
atttataaatatgtga

SEQ ID NO: 5288860 - DNA, 17 bp, Homo sapiens
atttataaatgaagatg

SEQ ID NO: 5288861 - DNA, 20 bp, Homo sapiens
atttataaatgaagatgcat

SEQ ID NO: 5288862 - DNA, 22 bp, Homo sapiens
atttataaatgagcaaatggaa

SEQ ID NO: 5288863 - DNA, 14 bp, Homo sapiens
atttataaatgtgt

SEQ ID NO: 5288864 - DNA, 15 bp, Homo sapiens
atttataaatgtgtg

SEQ ID NO: 5288865 - DNA, 13 bp, Homo sapiens
atttataaatttg

SEQ ID NO: 5288866 - DNA, 21 bp, Homo sapiens
atttataacagttataaagaa

SEQ ID NO: 5288867 - DNA, 18 bp, Homo sapiens
atttataaccccagcctg

SEQ ID NO: 5288868 - DNA, 16 bp, Homo sapiens
atttataactaatatg

SEQ ID NO: 5288869 - DNA, 14 bp, Homo sapiens
atttataactcatc

SEQ ID NO: 5288870 - DNA, 18 bp, Homo sapiens
atttataactcatcataa

SEQ ID NO: 5288871 - DNA, 14 bp, Homo sapiens
atttataagcagat

SEQ ID NO: 5288872 - DNA, 13 bp, Homo sapiens
atttataagcatt

SEQ ID NO: 5288873 - DNA, 14 bp, Homo sapiens
atttataagcattg

SEQ ID NO: 5288874 - DNA, 18 bp, Homo sapiens
atttataagcattgccat

SEQ ID NO: 5288875 - DNA, 19 bp, Homo sapiens
atttataagcattgccatt

SEQ ID NO: 5288876 - DNA, 16 bp, Homo sapiens
atttataaggaaattt

SEQ ID NO: 5288877 - DNA, 16 bp, Homo sapiens
atttataaggttttaa

SEQ ID NO: 5288878 - DNA, 15 bp, Homo sapiens
atttataatacagaa

SEQ ID NO: 5288879 - DNA, 20 bp, Homo sapiens
atttataatataaatatatg

SEQ ID NO: 5288880 - DNA, 22 bp, Homo sapiens
atttataatgaatactttctta

SEQ ID NO: 5288881 - DNA, 15 bp, Homo sapiens
atttataatgtattt

SEQ ID NO: 5288882 - DNA, 17 bp, Homo sapiens
atttataatgtatttga

SEQ ID NO: 5288883 - DNA, 14 bp, Homo sapiens
atttataatgtttg

SEQ ID NO: 5288884 - DNA, 14 bp, Homo sapiens
atttataattaaag

SEQ ID NO: 5288885 - DNA, 15 bp, Homo sapiens
atttataattaaaga

SEQ ID NO: 5288886 - DNA, 17 bp, Homo sapiens
atttataattaaagaaa

SEQ ID NO: 5288887 - DNA, 20 bp, Homo sapiens
atttataattcagtatgttt

SEQ ID NO: 5288888 - DNA, 14 bp, Homo sapiens
atttatacaaaata

SEQ ID NO: 5288889 - DNA, 14 bp, Homo sapiens
atttatacaaagaa

SEQ ID NO: 5288890 - DNA, 19 bp, Homo sapiens
atttatacaaagaaacttt

SEQ ID NO: 5288891 - DNA, 17 bp, Homo sapiens
atttatacaagggttaa

SEQ ID NO: 5288892 - DNA, 15 bp, Homo sapiens
atttatacaccagca

SEQ ID NO: 5288893 - DNA, 13 bp, Homo sapiens
atttatacataca

SEQ ID NO: 5288894 - DNA, 19 bp, Homo sapiens
atttataccattataccag

SEQ ID NO: 5288895 - DNA, 13 bp, Homo sapiens
atttatacctcaa

SEQ ID NO: 5288896 - DNA, 18 bp, Homo sapiens
atttatacctcaaactat

SEQ ID NO: 5288897 - DNA, 16 bp, Homo sapiens
atttatacctttgaaa

SEQ ID NO: 5288898 - DNA, 10 bp, Homo sapiens
atttatactc

SEQ ID NO: 5288899 - DNA, 11 bp, Homo sapiens
atttatactct

SEQ ID NO: 5288900 - DNA, 22 bp, Homo sapiens
atttatactggtaacttattta

SEQ ID NO: 5288901 - DNA, 17 bp, Homo sapiens
atttatactgtagcaat

SEQ ID NO: 5288902 - DNA, 13 bp, Homo sapiens
atttatactgtga

SEQ ID NO: 5288903 - DNA, 14 bp, Homo sapiens
atttatactttgca

SEQ ID NO: 5288904 - DNA, 22 bp, Homo sapiens
atttatactttgcaatccaaat

SEQ ID NO: 5288905 - DNA, 15 bp, Homo sapiens
atttatagaagaaat

SEQ ID NO: 5288906 - DNA, 16 bp, Homo sapiens
atttatagaatttaat

SEQ ID NO: 5288907 - DNA, 15 bp, Homo sapiens
atttatagatcattt

SEQ ID NO: 5288908 - DNA, 17 bp, Homo sapiens
atttataggcagatctt

SEQ ID NO: 5288909 - DNA, 13 bp, Homo sapiens
atttatagtaatg

SEQ ID NO: 5288910 - DNA, 16 bp, Homo sapiens
atttatagtatgtgac

SEQ ID NO: 5288911 - DNA, 19 bp, Homo sapiens
atttatagtatgtgacttt

SEQ ID NO: 5288912 - DNA, 15 bp, Homo sapiens
atttatagtttaata

SEQ ID NO: 5288913 - DNA, 14 bp, Homo sapiens
atttatagtttgta

SEQ ID NO: 5288914 - DNA, 14 bp, Homo sapiens
atttatataaagta

SEQ ID NO: 5288915 - DNA, 15 bp, Homo sapiens
atttatataaatgta

SEQ ID NO: 5288916 - DNA, 15 bp, Homo sapiens
atttatataactgtt

SEQ ID NO: 5288917 - DNA, 16 bp, Homo sapiens
atttatataattatgt

SEQ ID NO: 5288918 - DNA, 12 bp, Homo sapiens
atttatatactt

SEQ ID NO: 5288919 - DNA, 13 bp, Homo sapiens
atttatatacttt

SEQ ID NO: 5288920 - DNA, 14 bp, Homo sapiens
atttatatactttt

SEQ ID NO: 5288921 - DNA, 21 bp, Homo sapiens
atttatatagcaagtgctatt

SEQ ID NO: 5288922 - DNA, 19 bp, Homo sapiens
atttatatataaaaagaaa

SEQ ID NO: 5288923 - DNA, 15 bp, Homo sapiens
atttatatatatatg

SEQ ID NO: 5288924 - DNA, 17 bp, Homo sapiens
atttatatatatatgta

SEQ ID NO: 5288925 - DNA, 18 bp, Homo sapiens
atttatatatatatgtat

SEQ ID NO: 5288926 - DNA, 16 bp, Homo sapiens
atttatatatatgtgt

SEQ ID NO: 5288927 - DNA, 18 bp, Homo sapiens
atttatatatcagttata

SEQ ID NO: 5288928 - DNA, 14 bp, Homo sapiens
atttatatatcata

SEQ ID NO: 5288929 - DNA, 13 bp, Homo sapiens
atttatatatgaa

SEQ ID NO: 5288930 - DNA, 15 bp, Homo sapiens
atttatatatgaaaa

SEQ ID NO: 5288931 - DNA, 16 bp, Homo sapiens
atttatatatggcata

SEQ ID NO: 5288932 - DNA, 19 bp, Homo sapiens
atttatatattgtctgtaa

SEQ ID NO: 5288933 - DNA, 21 bp, Homo sapiens
atttatatattgtctgtaaaa

SEQ ID NO: 5288934 - DNA, 14 bp, Homo sapiens
atttatatatttat

SEQ ID NO: 5288935 - DNA, 16 bp, Homo sapiens
atttatatatttataa

SEQ ID NO: 5288936 - DNA, 21 bp, Homo sapiens
atttatatcacacaatatagt

SEQ ID NO: 5288937 - DNA, 15 bp, Homo sapiens
atttatatgaagcaa

SEQ ID NO: 5288938 - DNA, 17 bp, Homo sapiens
atttatatgcttcacat

SEQ ID NO: 5288939 - DNA, 15 bp, Homo sapiens
atttatatgtacatg

SEQ ID NO: 5288940 - DNA, 15 bp, Homo sapiens
atttatatgtactgt

SEQ ID NO: 5288941 - DNA, 17 bp, Homo sapiens
atttatatgtactgttt

SEQ ID NO: 5288942 - DNA, 22 bp, Homo sapiens
atttatatgtatccagtacatt

SEQ ID NO: 5288943 - DNA, 16 bp, Homo sapiens
atttatatgtatgtgt

SEQ ID NO: 5288944 - DNA, 21 bp, Homo sapiens
atttatatgtatgtgtttaga

SEQ ID NO: 5288945 - DNA, 22 bp, Homo sapiens
atttatatgtcagagctgttat

SEQ ID NO: 5288946 - DNA, 14 bp, Homo sapiens
atttatatgttatt

SEQ ID NO: 5288947 - DNA, 13 bp, Homo sapiens
atttatattaaat

SEQ ID NO: 5288948 - DNA, 15 bp, Homo sapiens
atttatattcagaga

SEQ ID NO: 5288949 - DNA, 18 bp, Homo sapiens
caacagaataaagcagcc

SEQ ID NO: 5288950 - DNA, 19 bp, Homo sapiens
caacagaataaagcagcct

SEQ ID NO: 5288951 - DNA, 14 bp, Homo sapiens
caacagaatgaaaa

SEQ ID NO: 5288952 - DNA, 17 bp, Homo sapiens
caacagaatgaaaaatg

SEQ ID NO: 5288953 - DNA, 19 bp, Homo sapiens
caacagacaccctccactc

SEQ ID NO: 5288954 - DNA, 18 bp, Homo sapiens
caacagacctaagaaata

SEQ ID NO: 5288955 - DNA, 15 bp, Homo sapiens
caacagactgcctta

SEQ ID NO: 5288956 - DNA, 20 bp, Homo sapiens
caacagactgccttatatta

SEQ ID NO: 5288957 - DNA, 23 bp, Homo sapiens
caacagactgccttatattattt

SEQ ID NO: 5288958 - DNA, 17 bp, Homo sapiens
caacagactgttgagtt

SEQ ID NO: 5288959 - DNA, 17 bp, Homo sapiens
caacagagaaggcagga

SEQ ID NO: 5288960 - DNA, 20 bp, Homo sapiens
caacagagactgaatagata

SEQ ID NO: 5288961 - DNA, 17 bp, Homo sapiens
caacagagagggagaaa

SEQ ID NO: 5288962 - DNA, 22 bp, Homo sapiens
caacagagaggttcctgtttga

SEQ ID NO: 5288963 - DNA, 13 bp, Homo sapiens
caacagagcaaga

SEQ ID NO: 5288964 - DNA, 16 bp, Homo sapiens
caacagagcaagactc

SEQ ID NO: 5288965 - DNA, 11 bp, Homo sapiens
caacagaggcc

SEQ ID NO: 5288966 - DNA, 21 bp, Homo sapiens
caacagagtggactcttccct

SEQ ID NO: 5288967 - DNA, 17 bp, Homo sapiens
caacagatactggaagt

SEQ ID NO: 5288968 - DNA, 14 bp, Homo sapiens
caacagatcagtaa

SEQ ID NO: 5288969 - DNA, 19 bp, Homo sapiens
caacagatgaccgtgtaca

SEQ ID NO: 5288970 - DNA, 20 bp, Homo sapiens
caacagatgaccgtgtacaa

SEQ ID NO: 5288971 - DNA, 21 bp, Homo sapiens
caacagatgaccgtgtacaat

SEQ ID NO: 5288972 - DNA, 22 bp, Homo sapiens
caacagatgatagtccaatttt

SEQ ID NO: 5288973 - DNA, 13 bp, Homo sapiens
caacagattcaga

SEQ ID NO: 5288974 - DNA, 21 bp, Homo sapiens
caacagattggattttatgtt

SEQ ID NO: 5288975 - DNA, 16 bp, Homo sapiens
caacagatttaaagaa

SEQ ID NO: 5288976 - DNA, 14 bp, Homo sapiens
caacagatttctaa

SEQ ID NO: 5288977 - DNA, 14 bp, Homo sapiens
caacagatttgtga

SEQ ID NO: 5288978 - DNA, 16 bp, Homo sapiens
caacagatttgtgaac

SEQ ID NO: 5288979 - DNA, 17 bp, Homo sapiens
caacagcaaatcacgac

SEQ ID NO: 5288980 - DNA, 22 bp, Homo sapiens
caacagcaaattaatgtgtaaa

SEQ ID NO: 5288981 - DNA, 12 bp, Homo sapiens
caacagcacaca

SEQ ID NO: 5288982 - DNA, 15 bp, Homo sapiens
caacagcacacaggc

SEQ ID NO: 5288983 - DNA, 16 bp, Homo sapiens
caacagcacacaggca

SEQ ID NO: 5288984 - DNA, 11 bp, Homo sapiens
caacagcactt

SEQ ID NO: 5288985 - DNA, 21 bp, Homo sapiens
caacagcaggaggcacagcag

SEQ ID NO: 5288986 - DNA, 20 bp, Homo sapiens
caacagcagtctccttcagc

SEQ ID NO: 5288987 - DNA, 21 bp, Homo sapiens
caacagcagtctccttcagca

SEQ ID NO: 5288988 - DNA, 15 bp, Homo sapiens
caacagcagtgagtt

SEQ ID NO: 5288989 - DNA, 17 bp, Homo sapiens
caacagcatgtctactg

SEQ ID NO: 5288990 - DNA, 17 bp, Homo sapiens
caacagccaaactgctg

SEQ ID NO: 5288991 - DNA, 19 bp, Homo sapiens
caacagccaatatttaaaa

SEQ ID NO: 5288992 - DNA, 17 bp, Homo sapiens
caacagccactcagaaa

SEQ ID NO: 5288993 - DNA, 17 bp, Homo sapiens
caacagccatttaggca

SEQ ID NO: 5288994 - DNA, 15 bp, Homo sapiens
caacagcccagcaag

SEQ ID NO: 5288995 - DNA, 14 bp, Homo sapiens
caacagcccaggca

SEQ ID NO: 5288996 - DNA, 18 bp, Homo sapiens
caacagccctgcctgaga

SEQ ID NO: 5288997 - DNA, 13 bp, Homo sapiens
caacagcctgaga

SEQ ID NO: 5288998 - DNA, 13 bp, Homo sapiens
caacagcctgggg

SEQ ID NO: 5288999 - DNA, 14 bp, Homo sapiens
caacagcctggggt

SEQ ID NO: 5289000 - DNA, 11 bp, Homo sapiens
caacagcctgt

SEQ ID NO: 5289001 - DNA, 23 bp, Homo sapiens
caacagcgacatagcccatccct

SEQ ID NO: 5289002 - DNA, 23 bp, Homo sapiens
caacagcgttcctagagaagaca

SEQ ID NO: 5289003 - DNA, 16 bp, Homo sapiens
caacagctacaacagc

SEQ ID NO: 5289004 - DNA, 16 bp, Homo sapiens
caacagctcagagatg

SEQ ID NO: 5289005 - DNA, 11 bp, Homo sapiens
caacagctctc

SEQ ID NO: 5289006 - DNA, 12 bp, Homo sapiens
caacagctctcg

SEQ ID NO: 5289007 - DNA, 14 bp, Homo sapiens
caacagctgatgcc

SEQ ID NO: 5289008 - DNA, 15 bp, Homo sapiens
caacagcttcagaaa

SEQ ID NO: 5289009 - DNA, 12 bp, Homo sapiens
caacagcttctt

SEQ ID NO: 5289010 - DNA, 13 bp, Homo sapiens
caacagcttcttg

SEQ ID NO: 5289011 - DNA, 16 bp, Homo sapiens
caacagcttcttgctt

SEQ ID NO: 5289012 - DNA, 22 bp, Homo sapiens
caacagcttcttgcttgtaaaa

SEQ ID NO: 5289013 - DNA, 18 bp, Homo sapiens
caacagcttttcccagga

SEQ ID NO: 5289014 - DNA, 20 bp, Homo sapiens
caacagcttttcccaggaga

SEQ ID NO: 5289015 - DNA, 14 bp, Homo sapiens
caacaggacagagt

SEQ ID NO: 5289016 - DNA, 17 bp, Homo sapiens
caacaggacagagttca

SEQ ID NO: 5289017 - DNA, 19 bp, Homo sapiens
caacaggacagagttcaca

SEQ ID NO: 5289018 - DNA, 20 bp, Homo sapiens
caacaggaccaggagccagg

SEQ ID NO: 5289019 - DNA, 22 bp, Homo sapiens
caacaggagaatggggttcctg

SEQ ID NO: 5289020 - DNA, 12 bp, Homo sapiens
caacaggagaga

SEQ ID NO: 5289021 - DNA, 13 bp, Homo sapiens
caacaggagagag

SEQ ID NO: 5289022 - DNA, 21 bp, Homo sapiens
caacaggagctgggatcctaa

SEQ ID NO: 5289023 - DNA, 16 bp, Homo sapiens
caacaggaggacaatt

SEQ ID NO: 5289024 - DNA, 20 bp, Homo sapiens
caacaggagtcagtctcttt

SEQ ID NO: 5289025 - DNA, 15 bp, Homo sapiens
caacaggattttcaa

SEQ ID NO: 5289026 - DNA, 17 bp, Homo sapiens
caacaggcaggggccca

SEQ ID NO: 5289027 - DNA, 17 bp, Homo sapiens
caacaggcccagggagg

SEQ ID NO: 5289028 - DNA, 19 bp, Homo sapiens
caacaggcctcagggctcc

SEQ ID NO: 5289029 - DNA, 22 bp, Homo sapiens
caacaggcgttctcagcctccg

SEQ ID NO: 5289030 - DNA, 14 bp, Homo sapiens
caacaggctgggct

SEQ ID NO: 5289031 - DNA, 24 bp, Homo sapiens
caacaggctgggcttcagtggcag

SEQ ID NO: 5289032 - DNA, 15 bp, Homo sapiens
caacaggctgtgtgt

SEQ ID NO: 5289033 - DNA, 15 bp, Homo sapiens
caacagggaaaacag

SEQ ID NO: 5289034 - DNA, 21 bp, Homo sapiens
caacagggagcacctgtctgg

SEQ ID NO: 5289035 - DNA, 15 bp, Homo sapiens
caacaggggaggaaa

SEQ ID NO: 5289036 - DNA, 16 bp, Homo sapiens
caacaggggaggaaaa

SEQ ID NO: 5289037 - DNA, 22 bp, Homo sapiens
caacaggggaggaaaaaagaac

SEQ ID NO: 5289038 - DNA, 19 bp, Homo sapiens
caacagggtagatttctct

SEQ ID NO: 5289039 - DNA, 17 bp, Homo sapiens
caacaggtaaaacaggg

SEQ ID NO: 5289040 - DNA, 20 bp, Homo sapiens
caacaggtcacttgatcatg

SEQ ID NO: 5289041 - DNA, 22 bp, Homo sapiens
caacaggtggcaggaccaggac

SEQ ID NO: 5289042 - DNA, 23 bp, Homo sapiens
caacaggtggcaggaccaggact

SEQ ID NO: 5289043 - DNA, 17 bp, Homo sapiens
caacaggtttatctgaa

SEQ ID NO: 5289044 - DNA, 15 bp, Homo sapiens
caacagtaacacatc

SEQ ID NO: 5289045 - DNA, 15 bp, Homo sapiens
caacagtaatcagag

SEQ ID NO: 5289046 - DNA, 23 bp, Homo sapiens
caacagtacctgaaggattatta

SEQ ID NO: 5289047 - DNA, 15 bp, Homo sapiens
caacagtagcaggga

SEQ ID NO: 5289048 - DNA, 14 bp, Homo sapiens
caacagtcacctca

SEQ ID NO: 5289049 - DNA, 16 bp, Homo sapiens
caacagtcagccagct

SEQ ID NO: 5289050 - DNA, 16 bp, Homo sapiens
caacagtcatgtttta

SEQ ID NO: 5289051 - DNA, 14 bp, Homo sapiens
caacagtgctaaaa

SEQ ID NO: 5289052 - DNA, 17 bp, Homo sapiens
caacagtgctaaaaatg

SEQ ID NO: 5289053 - DNA, 12 bp, Homo sapiens
caacagtgtgaa

SEQ ID NO: 5289054 - DNA, 14 bp, Homo sapiens
caacagtgtgaagt

SEQ ID NO: 5289055 - DNA, 22 bp, Homo sapiens
caacagtgttaggcctggcaca

SEQ ID NO: 5289056 - DNA, 13 bp, Homo sapiens
caacagttaaact

SEQ ID NO: 5289057 - DNA, 12 bp, Homo sapiens
caacagttcaaa

SEQ ID NO: 5289058 - DNA, 14 bp, Homo sapiens
caacagttccttca

SEQ ID NO: 5289059 - DNA, 21 bp, Homo sapiens
caacagttggccgattagaag

SEQ ID NO: 5289060 - DNA, 19 bp, Homo sapiens
caacagttgggctgtcaac

SEQ ID NO: 5289061 - DNA, 11 bp, Homo sapiens
caacagttgta

SEQ ID NO: 5289062 - DNA, 12 bp, Homo sapiens
caacagtttaat

SEQ ID NO: 5289063 - DNA, 15 bp, Homo sapiens
caacagtttaatgaa

SEQ ID NO: 5289064 - DNA, 17 bp, Homo sapiens
caacagtttgatgctga

SEQ ID NO: 5289065 - DNA, 20 bp, Homo sapiens
caacagttttcctatgcttt

SEQ ID NO: 5289066 - DNA, 13 bp, Homo sapiens
caacataaaatta

SEQ ID NO: 5289067 - DNA, 14 bp, Homo sapiens
caacataaaattaa

SEQ ID NO: 5289068 - DNA, 16 bp, Homo sapiens
caacataacccacttg

SEQ ID NO: 5289069 - DNA, 21 bp, Homo sapiens
caacataaggagaatgtatct

SEQ ID NO: 5289070 - DNA, 16 bp, Homo sapiens
caacataatctagttt

SEQ ID NO: 5289071 - DNA, 13 bp, Homo sapiens
caacataatgaaa

SEQ ID NO: 5289072 - DNA, 14 bp, Homo sapiens
caacataatgatac

SEQ ID NO: 5289073 - DNA, 19 bp, Homo sapiens
caacataatttttattttt

SEQ ID NO: 5289074 - DNA, 14 bp, Homo sapiens
caacatacaattta

SEQ ID NO: 5289075 - DNA, 18 bp, Homo sapiens
caacatacccttctttaa

SEQ ID NO: 5289076 - DNA, 21 bp, Homo sapiens
caacatacccttctttaaatc

SEQ ID NO: 5289077 - DNA, 17 bp, Homo sapiens
caacatactcccatctg

SEQ ID NO: 5289078 - DNA, 15 bp, Homo sapiens
caacatactgtaatc

SEQ ID NO: 5289079 - DNA, 23 bp, Homo sapiens
caacatagtaagaccccatctct

SEQ ID NO: 5289080 - DNA, 21 bp, Homo sapiens
caacatagtattcatgactat

SEQ ID NO: 5289081 - DNA, 15 bp, Homo sapiens
caacatagtgagacc

SEQ ID NO: 5289082 - DNA, 23 bp, Homo sapiens
caacatagtgagacccctgtctc

SEQ ID NO: 5289083 - DNA, 21 bp, Homo sapiens
caacatagtgagaccttgtct

SEQ ID NO: 5289084 - DNA, 22 bp, Homo sapiens
caacatatactatttagtctca

SEQ ID NO: 5289085 - DNA, 14 bp, Homo sapiens
caacatatagttga

SEQ ID NO: 5289086 - DNA, 20 bp, Homo sapiens
caacatatatttattgagta

SEQ ID NO: 5289087 - DNA, 22 bp, Homo sapiens
caacatcaatgttcattgtaat

SEQ ID NO: 5289088 - DNA, 14 bp, Homo sapiens
caacatcacagccc

SEQ ID NO: 5289089 - DNA, 16 bp, Homo sapiens
caacatcacagcccag

SEQ ID NO: 5289090 - DNA, 19 bp, Homo sapiens
caacatcatatacctcttg

SEQ ID NO: 5289091 - DNA, 20 bp, Homo sapiens
caacatcatatacctcttga

SEQ ID NO: 5289092 - DNA, 15 bp, Homo sapiens
caacatcattccaaa

SEQ ID NO: 5289093 - DNA, 14 bp, Homo sapiens
caacatccactctc

SEQ ID NO: 5289094 - DNA, 16 bp, Homo sapiens
caacatcccacagtgg

SEQ ID NO: 5289095 - DNA, 17 bp, Homo sapiens
caacatcccacagtggc

SEQ ID NO: 5289096 - DNA, 19 bp, Homo sapiens
caacatcccattgccctgg

SEQ ID NO: 5289097 - DNA, 20 bp, Homo sapiens
caacatcccattgccctggt

SEQ ID NO: 5289098 - DNA, 15 bp, Homo sapiens
caacatcctgccagc

SEQ ID NO: 5289099 - DNA, 17 bp, Homo sapiens
caacatcctgccagccc

SEQ ID NO: 5289100 - DNA, 14 bp, Homo sapiens
caacatctgagtgc

SEQ ID NO: 5289101 - DNA, 13 bp, Homo sapiens
caacatcttctct

SEQ ID NO: 5289102 - DNA, 14 bp, Homo sapiens
caacatcttctctc

SEQ ID NO: 5289103 - DNA, 15 bp, Homo sapiens
caacatcttctctct

SEQ ID NO: 5289104 - DNA, 22 bp, Homo sapiens
caacatcttggtcagatttgaa

SEQ ID NO: 5289105 - DNA, 15 bp, Homo sapiens
caacatctttttcct

SEQ ID NO: 5289106 - DNA, 19 bp, Homo sapiens
caacatctttttcctccct

SEQ ID NO: 5289107 - DNA, 23 bp, Homo sapiens
caacatgaatttttatgatttct

SEQ ID NO: 5289108 - DNA, 21 bp, Homo sapiens
caacatgacatccagagatga

SEQ ID NO: 5289109 - DNA, 16 bp, Homo sapiens
caacatgaggacagaa

SEQ ID NO: 5289110 - DNA, 13 bp, Homo sapiens
caacatgcacatt

SEQ ID NO: 5289111 - DNA, 19 bp, Homo sapiens
caacatgcacattcatcct

SEQ ID NO: 5289112 - DNA, 22 bp, Homo sapiens
caacatgcacattcatcctcac

SEQ ID NO: 5289113 - DNA, 15 bp, Homo sapiens
caacatgcactgatg

SEQ ID NO: 5289114 - DNA, 23 bp, Homo sapiens
caacatgcctgccccaaacaaat

SEQ ID NO: 5289115 - DNA, 21 bp, Homo sapiens
caacatggcaaaaccccatct

SEQ ID NO: 5289116 - DNA, 20 bp, Homo sapiens
caacatggcaattgcactca

SEQ ID NO: 5289117 - DNA, 13 bp, Homo sapiens
caacatggcttct

SEQ ID NO: 5289118 - DNA, 17 bp, Homo sapiens
caacatggcttctcctt

SEQ ID NO: 5289119 - DNA, 19 bp, Homo sapiens
caacatggcttctcctttg

SEQ ID NO: 5289120 - DNA, 18 bp, Homo sapiens
caacatgggagggatcag

SEQ ID NO: 5289121 - DNA, 19 bp, Homo sapiens
caacatgggagggatcagc

SEQ ID NO: 5289122 - DNA, 20 bp, Homo sapiens
caacatgggagggatcagcc

SEQ ID NO: 5289123 - DNA, 23 bp, Homo sapiens
caacatgggagggatcagccccg

SEQ ID NO: 5289124 - DNA, 22 bp, Homo sapiens
caacatggtaattcacttcagt

SEQ ID NO: 5289125 - DNA, 21 bp, Homo sapiens
caacatggtgaaaccccatct

SEQ ID NO: 5289126 - DNA, 18 bp, Homo sapiens
caacatggtgaaaccccg

SEQ ID NO: 5289127 - DNA, 12 bp, Homo sapiens
caacatggtgct

SEQ ID NO: 5289128 - DNA, 17 bp, Homo sapiens
caacatgtagggcaaga

SEQ ID NO: 5289129 - DNA, 19 bp, Homo sapiens
atttatattcagagatgta

SEQ ID NO: 5289130 - DNA, 15 bp, Homo sapiens
atttatattcataaa

SEQ ID NO: 5289131 - DNA, 19 bp, Homo sapiens
atttatattcataaagtta

SEQ ID NO: 5289132 - DNA, 20 bp, Homo sapiens
atttatattcataaagttac

SEQ ID NO: 5289133 - DNA, 14 bp, Homo sapiens
atttatattccatt

SEQ ID NO: 5289134 - DNA, 21 bp, Homo sapiens
atttatattccatttacataa

SEQ ID NO: 5289135 - DNA, 12 bp, Homo sapiens
atttatattccg

SEQ ID NO: 5289136 - DNA, 20 bp, Homo sapiens
atttatattgataagatctt

SEQ ID NO: 5289137 - DNA, 21 bp, Homo sapiens
atttatattgtaaatattgtg

SEQ ID NO: 5289138 - DNA, 19 bp, Homo sapiens
atttatattgtcactcatt

SEQ ID NO: 5289139 - DNA, 17 bp, Homo sapiens
atttatatttgaaattt

SEQ ID NO: 5289140 - DNA, 14 bp, Homo sapiens
atttatatttggaa

SEQ ID NO: 5289141 - DNA, 16 bp, Homo sapiens
atttatatttggaaag

SEQ ID NO: 5289142 - DNA, 15 bp, Homo sapiens
atttatattttaaag

SEQ ID NO: 5289143 - DNA, 17 bp, Homo sapiens
atttatattttgtgtat

SEQ ID NO: 5289144 - DNA, 19 bp, Homo sapiens
atttatatttttaaaatat

SEQ ID NO: 5289145 - DNA, 15 bp, Homo sapiens
atttatcaaaatgta

SEQ ID NO: 5289146 - DNA, 18 bp, Homo sapiens
atttatcaaacttgtgct

SEQ ID NO: 5289147 - DNA, 14 bp, Homo sapiens
atttatcaaagcat

SEQ ID NO: 5289148 - DNA, 14 bp, Homo sapiens
atttatcaaatcag

SEQ ID NO: 5289149 - DNA, 14 bp, Homo sapiens
atttatcaactgtc

SEQ ID NO: 5289150 - DNA, 17 bp, Homo sapiens
atttatcaccagcatat

SEQ ID NO: 5289151 - DNA, 15 bp, Homo sapiens
atttatcagattgct

SEQ ID NO: 5289152 - DNA, 23 bp, Homo sapiens
atttatcatctcgaccacttttc

SEQ ID NO: 5289153 - DNA, 18 bp, Homo sapiens
atttatcatggtcctgaa

SEQ ID NO: 5289154 - DNA, 21 bp, Homo sapiens
atttatcatggtcctgaatgt

SEQ ID NO: 5289155 - DNA, 21 bp, Homo sapiens
atttatccaaagcattgcaga

SEQ ID NO: 5289156 - DNA, 12 bp, Homo sapiens
atttatccacta

SEQ ID NO: 5289157 - DNA, 16 bp, Homo sapiens
atttatccagaaaact

SEQ ID NO: 5289158 - DNA, 14 bp, Homo sapiens
atttatccagaatg

SEQ ID NO: 5289159 - DNA, 17 bp, Homo sapiens
atttatccaggaattga

SEQ ID NO: 5289160 - DNA, 19 bp, Homo sapiens
atttatccaggaattgata

SEQ ID NO: 5289161 - DNA, 16 bp, Homo sapiens
atttatccatttgtaa

SEQ ID NO: 5289162 - DNA, 17 bp, Homo sapiens
atttatcccaaatcctg

SEQ ID NO: 5289163 - DNA, 17 bp, Homo sapiens
atttatccctcattcat

SEQ ID NO: 5289164 - DNA, 22 bp, Homo sapiens
atttatccctttacaatgtgaa

SEQ ID NO: 5289165 - DNA, 20 bp, Homo sapiens
atttatcctcacataaaaaa

SEQ ID NO: 5289166 - DNA, 16 bp, Homo sapiens
atttatcctctgttga

SEQ ID NO: 5289167 - DNA, 19 bp, Homo sapiens
atttatcctgaaatttcag

SEQ ID NO: 5289168 - DNA, 21 bp, Homo sapiens
atttatcctgaaatttcagat

SEQ ID NO: 5289169 - DNA, 18 bp, Homo sapiens
atttatcgaaagtaaaaa

SEQ ID NO: 5289170 - DNA, 17 bp, Homo sapiens
atttatctaaaagaatt

SEQ ID NO: 5289171 - DNA, 15 bp, Homo sapiens
atttatctaaatatg

SEQ ID NO: 5289172 - DNA, 15 bp, Homo sapiens
atttatctaaattaa

SEQ ID NO: 5289173 - DNA, 10 bp, Homo sapiens
atttatctat

SEQ ID NO: 5289174 - DNA, 21 bp, Homo sapiens
atttatctattaaaattgcca

SEQ ID NO: 5289175 - DNA, 18 bp, Homo sapiens
atttatctattgtaagat

SEQ ID NO: 5289176 - DNA, 20 bp, Homo sapiens
atttatctattgtaagataa

SEQ ID NO: 5289177 - DNA, 23 bp, Homo sapiens
atttatctcccttagaagagagc

SEQ ID NO: 5289178 - DNA, 19 bp, Homo sapiens
atttatctctatttaatat

SEQ ID NO: 5289179 - DNA, 22 bp, Homo sapiens
atttatctctatttaatattta

SEQ ID NO: 5289180 - DNA, 19 bp, Homo sapiens
atttatctgcaaggatttt

SEQ ID NO: 5289181 - DNA, 14 bp, Homo sapiens
atttatctgtctga

SEQ ID NO: 5289182 - DNA, 20 bp, Homo sapiens
atttatctgtgtttttgaaa

SEQ ID NO: 5289183 - DNA, 19 bp, Homo sapiens
atttatctgttgtcccctt

SEQ ID NO: 5289184 - DNA, 14 bp, Homo sapiens
atttatcttaagtt

SEQ ID NO: 5289185 - DNA, 23 bp, Homo sapiens
atttatcttatctagcaagaaga

SEQ ID NO: 5289186 - DNA, 20 bp, Homo sapiens
atttatcttctgtttttctc

SEQ ID NO: 5289187 - DNA, 19 bp, Homo sapiens
atttatcttgaaggaaaaa

SEQ ID NO: 5289188 - DNA, 23 bp, Homo sapiens
atttatcttgaaggaaaaattca

SEQ ID NO: 5289189 - DNA, 18 bp, Homo sapiens
atttatcttgttcaatga

SEQ ID NO: 5289190 - DNA, 23 bp, Homo sapiens
atttatctttaccaaaaaccatg

SEQ ID NO: 5289191 - DNA, 12 bp, Homo sapiens
atttatctttat

SEQ ID NO: 5289192 - DNA, 17 bp, Homo sapiens
atttatctttatacaga

SEQ ID NO: 5289193 - DNA, 13 bp, Homo sapiens
atttatctttgat

SEQ ID NO: 5289194 - DNA, 18 bp, Homo sapiens
atttatctttgtagccta

SEQ ID NO: 5289195 - DNA, 15 bp, Homo sapiens
atttatctttgtatt

SEQ ID NO: 5289196 - DNA, 21 bp, Homo sapiens
atttatctttgtattcttcat

SEQ ID NO: 5289197 - DNA, 22 bp, Homo sapiens
atttatgaaaaaatatgaacct

SEQ ID NO: 5289198 - DNA, 16 bp, Homo sapiens
atttatgaagaaaata

SEQ ID NO: 5289199 - DNA, 17 bp, Homo sapiens
atttatgaagcagattt

SEQ ID NO: 5289200 - DNA, 13 bp, Homo sapiens
atttatgaagttt

SEQ ID NO: 5289201 - DNA, 23 bp, Homo sapiens
atttatgaataaagaatgccatt

SEQ ID NO: 5289202 - DNA, 23 bp, Homo sapiens
atttatgaattgaattatcttgg

SEQ ID NO: 5289203 - DNA, 13 bp, Homo sapiens
atttatgaattgt

SEQ ID NO: 5289204 - DNA, 15 bp, Homo sapiens
atttatgaccagagc

SEQ ID NO: 5289205 - DNA, 18 bp, Homo sapiens
atttatgaccagagcaaa

SEQ ID NO: 5289206 - DNA, 22 bp, Homo sapiens
atttatgactagcaaacaaaaa

SEQ ID NO: 5289207 - DNA, 17 bp, Homo sapiens
atttatgagatcactga

SEQ ID NO: 5289208 - DNA, 17 bp, Homo sapiens
atttatgagatttactg

SEQ ID NO: 5289209 - DNA, 20 bp, Homo sapiens
atttatgagtaactattatt

SEQ ID NO: 5289210 - DNA, 18 bp, Homo sapiens
atttatgagtttttgata

SEQ ID NO: 5289211 - DNA, 19 bp, Homo sapiens
atttatgagtttttgatag

SEQ ID NO: 5289212 - DNA, 20 bp, Homo sapiens
atttatgatataataaatat

SEQ ID NO: 5289213 - DNA, 18 bp, Homo sapiens
atttatgatgcagcagat

SEQ ID NO: 5289214 - DNA, 20 bp, Homo sapiens
atttatgatgttattttgta

SEQ ID NO: 5289215 - DNA, 13 bp, Homo sapiens
atttatgatttca

SEQ ID NO: 5289216 - DNA, 15 bp, Homo sapiens
atttatgatttctcc

SEQ ID NO: 5289217 - DNA, 17 bp, Homo sapiens
atttatgcacattcacg

SEQ ID NO: 5289218 - DNA, 14 bp, Homo sapiens
atttatgcactgtg

SEQ ID NO: 5289219 - DNA, 15 bp, Homo sapiens
atttatgcactgtgg

SEQ ID NO: 5289220 - DNA, 19 bp, Homo sapiens
atttatgcacttataaggt

SEQ ID NO: 5289221 - DNA, 18 bp, Homo sapiens
atttatgcagaaggtatt

SEQ ID NO: 5289222 - DNA, 16 bp, Homo sapiens
atttatgcatgagaac

SEQ ID NO: 5289223 - DNA, 12 bp, Homo sapiens
atttatgcattt

SEQ ID NO: 5289224 - DNA, 13 bp, Homo sapiens
atttatgcattta

SEQ ID NO: 5289225 - DNA, 16 bp, Homo sapiens
atttatgcatttatgc

SEQ ID NO: 5289226 - DNA, 23 bp, Homo sapiens
atttatgcatttcattcaaatca

SEQ ID NO: 5289227 - DNA, 21 bp, Homo sapiens
atttatgccttgatgatttaa

SEQ ID NO: 5289228 - DNA, 22 bp, Homo sapiens
atttatgccttgatgatttaat

SEQ ID NO: 5289229 - DNA, 19 bp, Homo sapiens
atttatgcgtaatttaatg

SEQ ID NO: 5289230 - DNA, 19 bp, Homo sapiens
atttatgcttaaaatatgt

SEQ ID NO: 5289231 - DNA, 13 bp, Homo sapiens
atttatgctttaa

SEQ ID NO: 5289232 - DNA, 20 bp, Homo sapiens
atttatgctttaacttcaga

SEQ ID NO: 5289233 - DNA, 23 bp, Homo sapiens
atttatggaagaaagagttgtcc

SEQ ID NO: 5289234 - DNA, 13 bp, Homo sapiens
atttatggaccac

SEQ ID NO: 5289235 - DNA, 12 bp, Homo sapiens
atttatggctta

SEQ ID NO: 5289236 - DNA, 18 bp, Homo sapiens
atttatggcttataaatg

SEQ ID NO: 5289237 - DNA, 21 bp, Homo sapiens
atttatggcttataaatgtgt

SEQ ID NO: 5289238 - DNA, 18 bp, Homo sapiens
atttatgggcccctggca

SEQ ID NO: 5289239 - DNA, 15 bp, Homo sapiens
atttatggtacctat

SEQ ID NO: 5289240 - DNA, 22 bp, Homo sapiens
atttatggtttctgcgtgcttt

SEQ ID NO: 5289241 - DNA, 15 bp, Homo sapiens
atttatggttttttt

SEQ ID NO: 5289242 - DNA, 18 bp, Homo sapiens
atttatgtaaaatcaata

SEQ ID NO: 5289243 - DNA, 20 bp, Homo sapiens
atttatgtaaaatcaataaa

SEQ ID NO: 5289244 - DNA, 22 bp, Homo sapiens
atttatgtaacaaagtttgctg

SEQ ID NO: 5289245 - DNA, 16 bp, Homo sapiens
atttatgtaacttgaa

SEQ ID NO: 5289246 - DNA, 18 bp, Homo sapiens
atttatgtaatttgtaca

SEQ ID NO: 5289247 - DNA, 20 bp, Homo sapiens
atttatgtaatttgtacagg

SEQ ID NO: 5289248 - DNA, 18 bp, Homo sapiens
atttatgtacaaaatgaa

SEQ ID NO: 5289249 - DNA, 15 bp, Homo sapiens
atttatgtactctct

SEQ ID NO: 5289250 - DNA, 17 bp, Homo sapiens
atttatgtagacattgt

SEQ ID NO: 5289251 - DNA, 22 bp, Homo sapiens
atttatgtagacattgtaaata

SEQ ID NO: 5289252 - DNA, 18 bp, Homo sapiens
atttatgtagatgtgcat

SEQ ID NO: 5289253 - DNA, 18 bp, Homo sapiens
atttatgtattgtgcaat

SEQ ID NO: 5289254 - DNA, 16 bp, Homo sapiens
atttatgtctcatgta

SEQ ID NO: 5289255 - DNA, 15 bp, Homo sapiens
atttatgtgaacaac

SEQ ID NO: 5289256 - DNA, 17 bp, Homo sapiens
atttatgtgaacaactg

SEQ ID NO: 5289257 - DNA, 23 bp, Homo sapiens
atttatgtgctgttagaatatgt

SEQ ID NO: 5289258 - DNA, 12 bp, Homo sapiens
atttatgtgtat

SEQ ID NO: 5289259 - DNA, 16 bp, Homo sapiens
atttatgtgtatatgg

SEQ ID NO: 5289260 - DNA, 15 bp, Homo sapiens
atttatgtgtgaagc

SEQ ID NO: 5289261 - DNA, 12 bp, Homo sapiens
atttatgtgttt

SEQ ID NO: 5289262 - DNA, 18 bp, Homo sapiens
atttatgtgttttaataa

SEQ ID NO: 5289263 - DNA, 20 bp, Homo sapiens
atttatgtttaagtgcttgg

SEQ ID NO: 5289264 - DNA, 22 bp, Homo sapiens
atttatgtttgcacttgtgatt

SEQ ID NO: 5289265 - DNA, 15 bp, Homo sapiens
atttattaaaaatgt

SEQ ID NO: 5289266 - DNA, 16 bp, Homo sapiens
atttattaaaaatgtt

SEQ ID NO: 5289267 - DNA, 20 bp, Homo sapiens
atttattaaaaatgttctca

SEQ ID NO: 5289268 - DNA, 22 bp, Homo sapiens
atttattaaacagatttttaca

SEQ ID NO: 5289269 - DNA, 13 bp, Homo sapiens
atttattaaactt

SEQ ID NO: 5289270 - DNA, 19 bp, Homo sapiens
atttattaaacttcagcaa

SEQ ID NO: 5289271 - DNA, 14 bp, Homo sapiens
atttattaaagaaa

SEQ ID NO: 5289272 - DNA, 15 bp, Homo sapiens
atttattaaagaaaa

SEQ ID NO: 5289273 - DNA, 17 bp, Homo sapiens
atttattaaagaaaaaa

SEQ ID NO: 5289274 - DNA, 16 bp, Homo sapiens
atttattaaataaaat

SEQ ID NO: 5289275 - DNA, 22 bp, Homo sapiens
atttattaaatgcccagcccct

SEQ ID NO: 5289276 - DNA, 14 bp, Homo sapiens
atttattaaatgtt

SEQ ID NO: 5289277 - DNA, 22 bp, Homo sapiens
atttattaaatttattaaatgt

SEQ ID NO: 5289278 - DNA, 24 bp, Homo sapiens
atttattaaatttttttgtatgaa

SEQ ID NO: 5289279 - DNA, 15 bp, Homo sapiens
atttattaagatgga

SEQ ID NO: 5289280 - DNA, 21 bp, Homo sapiens
atttattaagatggattctca

SEQ ID NO: 5289281 - DNA, 23 bp, Homo sapiens
atttattaagatggattctcaga

SEQ ID NO: 5289282 - DNA, 22 bp, Homo sapiens
atttattaagtatatttgtaaa

SEQ ID NO: 5289283 - DNA, 16 bp, Homo sapiens
atttattaagtctggg

SEQ ID NO: 5289284 - DNA, 20 bp, Homo sapiens
atttattaatatatattatc

SEQ ID NO: 5289285 - DNA, 23 bp, Homo sapiens
atttattaatatttaacattatt

SEQ ID NO: 5289286 - DNA, 16 bp, Homo sapiens
atttattaattgcttt

SEQ ID NO: 5289287 - DNA, 19 bp, Homo sapiens
atttattaatttgaaacca

SEQ ID NO: 5289288 - DNA, 15 bp, Homo sapiens
atttattagccaact

SEQ ID NO: 5289289 - DNA, 17 bp, Homo sapiens
atttattagtattctaa

SEQ ID NO: 5289290 - DNA, 16 bp, Homo sapiens
atttattagttaatat

SEQ ID NO: 5289291 - DNA, 21 bp, Homo sapiens
atttattagtttaaaatgcag

SEQ ID NO: 5289292 - DNA, 18 bp, Homo sapiens
atttattatatatttaca

SEQ ID NO: 5289293 - DNA, 21 bp, Homo sapiens
atttattatcgcatacagata

SEQ ID NO: 5289294 - DNA, 13 bp, Homo sapiens
atttattatggca

SEQ ID NO: 5289295 - DNA, 13 bp, Homo sapiens
atttattattaat

SEQ ID NO: 5289296 - DNA, 14 bp, Homo sapiens
atttattattaatt

SEQ ID NO: 5289297 - DNA, 12 bp, Homo sapiens
atttattattga

SEQ ID NO: 5289298 - DNA, 15 bp, Homo sapiens
atttattattgaaat

SEQ ID NO: 5289299 - DNA, 17 bp, Homo sapiens
atttattattgaaattg

SEQ ID NO: 5289300 - DNA, 11 bp, Homo sapiens
atttattattt

SEQ ID NO: 5289301 - DNA, 14 bp, Homo sapiens
atttattatttgaa

SEQ ID NO: 5289302 - DNA, 15 bp, Homo sapiens
atttattattttcat

SEQ ID NO: 5289303 - DNA, 14 bp, Homo sapiens
atttattcaagaaa

SEQ ID NO: 5289304 - DNA, 12 bp, Homo sapiens
atttattcaagt

SEQ ID NO: 5289305 - DNA, 13 bp, Homo sapiens
atttattcaataa

SEQ ID NO: 5289306 - DNA, 16 bp, Homo sapiens
atttattcaataaagt

SEQ ID NO: 5289307 - DNA, 19 bp, Homo sapiens
caacatgtagggcaagagg

SEQ ID NO: 5289308 - DNA, 13 bp, Homo sapiens
caacatgtataat

SEQ ID NO: 5289309 - DNA, 19 bp, Homo sapiens
caacatgtataatattttt

SEQ ID NO: 5289310 - DNA, 23 bp, Homo sapiens
caacatgtataatatttttaatt

SEQ ID NO: 5289311 - DNA, 19 bp, Homo sapiens
caacatgtatgtggataca

SEQ ID NO: 5289312 - DNA, 15 bp, Homo sapiens
caacatgtgctcgct

SEQ ID NO: 5289313 - DNA, 17 bp, Homo sapiens
caacatgtggctcctcc

SEQ ID NO: 5289314 - DNA, 15 bp, Homo sapiens
caacatgtgtttctg

SEQ ID NO: 5289315 - DNA, 15 bp, Homo sapiens
caacatgttatttgt

SEQ ID NO: 5289316 - DNA, 22 bp, Homo sapiens
caacatgttatttgtaatagat

SEQ ID NO: 5289317 - DNA, 19 bp, Homo sapiens
caacatgttgggaaacttg

SEQ ID NO: 5289318 - DNA, 22 bp, Homo sapiens
caacatgttttatgtacacaaa

SEQ ID NO: 5289319 - DNA, 17 bp, Homo sapiens
caacattaaaactcata

SEQ ID NO: 5289320 - DNA, 14 bp, Homo sapiens
caacattagaatat

SEQ ID NO: 5289321 - DNA, 15 bp, Homo sapiens
caacattagaatatt

SEQ ID NO: 5289322 - DNA, 18 bp, Homo sapiens
caacattatcctgtgtga

SEQ ID NO: 5289323 - DNA, 18 bp, Homo sapiens
caacattatgatctaata

SEQ ID NO: 5289324 - DNA, 11 bp, Homo sapiens
caacattccac

SEQ ID NO: 5289325 - DNA, 23 bp, Homo sapiens
caacattcctttcttgtgccctg

SEQ ID NO: 5289326 - DNA, 12 bp, Homo sapiens
caacattctgca

SEQ ID NO: 5289327 - DNA, 22 bp, Homo sapiens
caacattgccttgcatttgtac

SEQ ID NO: 5289328 - DNA, 14 bp, Homo sapiens
caacattggacaga

SEQ ID NO: 5289329 - DNA, 16 bp, Homo sapiens
caacattggacagaaa

SEQ ID NO: 5289330 - DNA, 16 bp, Homo sapiens
caacattgtagcctca

SEQ ID NO: 5289331 - DNA, 18 bp, Homo sapiens
caacatttacaactcatt

SEQ ID NO: 5289332 - DNA, 14 bp, Homo sapiens
caacatttatgacc

SEQ ID NO: 5289333 - DNA, 12 bp, Homo sapiens
caacatttatgt

SEQ ID NO: 5289334 - DNA, 15 bp, Homo sapiens
caacatttattattt

SEQ ID NO: 5289335 - DNA, 17 bp, Homo sapiens
caacatttattttgaga

SEQ ID NO: 5289336 - DNA, 22 bp, Homo sapiens
caacatttccaaaagtggctag

SEQ ID NO: 5289337 - DNA, 23 bp, Homo sapiens
caacatttcctcaggcaattcct

SEQ ID NO: 5289338 - DNA, 14 bp, Homo sapiens
caacatttctcaat

SEQ ID NO: 5289339 - DNA, 16 bp, Homo sapiens
caacatttctcatgtt

SEQ ID NO: 5289340 - DNA, 22 bp, Homo sapiens
caacatttctcatgttgaaact

SEQ ID NO: 5289341 - DNA, 21 bp, Homo sapiens
caacatttctgtatactgtaa

SEQ ID NO: 5289342 - DNA, 17 bp, Homo sapiens
caacatttcttaaatta

SEQ ID NO: 5289343 - DNA, 16 bp, Homo sapiens
caacatttgtgtcact

SEQ ID NO: 5289344 - DNA, 19 bp, Homo sapiens
caacattttaaaaataaat

SEQ ID NO: 5289345 - DNA, 18 bp, Homo sapiens
caacattttaatacagat

SEQ ID NO: 5289346 - DNA, 12 bp, Homo sapiens
caacattttatt

SEQ ID NO: 5289347 - DNA, 21 bp, Homo sapiens
caacattttatttaagaataa

SEQ ID NO: 5289348 - DNA, 13 bp, Homo sapiens
caacattttcttg

SEQ ID NO: 5289349 - DNA, 16 bp, Homo sapiens
caacatttttttttct

SEQ ID NO: 5289350 - DNA, 21 bp, Homo sapiens
caacatttttttttctccata

SEQ ID NO: 5289351 - DNA, 13 bp, Homo sapiens
caaccaaagaaaa

SEQ ID NO: 5289352 - DNA, 15 bp, Homo sapiens
caaccaaagaaaatt

SEQ ID NO: 5289353 - DNA, 16 bp, Homo sapiens
caaccaaagatgctta

SEQ ID NO: 5289354 - DNA, 15 bp, Homo sapiens
caaccaaccagcagg

SEQ ID NO: 5289355 - DNA, 12 bp, Homo sapiens
caaccaactgca

SEQ ID NO: 5289356 - DNA, 15 bp, Homo sapiens
caaccaactgcccca

SEQ ID NO: 5289357 - DNA, 17 bp, Homo sapiens
caaccaactgccccagg

SEQ ID NO: 5289358 - DNA, 17 bp, Homo sapiens
caaccaactttcccccc

SEQ ID NO: 5289359 - DNA, 16 bp, Homo sapiens
caaccaaggaaggagc

SEQ ID NO: 5289360 - DNA, 17 bp, Homo sapiens
caaccaaggaaggagcc

SEQ ID NO: 5289361 - DNA, 22 bp, Homo sapiens
caaccaagtatgaatctatttg

SEQ ID NO: 5289362 - DNA, 14 bp, Homo sapiens
caaccaagtgtgct

SEQ ID NO: 5289363 - DNA, 21 bp, Homo sapiens
caaccaataaaagccagatgc

SEQ ID NO: 5289364 - DNA, 15 bp, Homo sapiens
caaccaataaaagtg

SEQ ID NO: 5289365 - DNA, 16 bp, Homo sapiens
caaccaatgtagaaag

SEQ ID NO: 5289366 - DNA, 14 bp, Homo sapiens
caaccacaaaccac

SEQ ID NO: 5289367 - DNA, 19 bp, Homo sapiens
caaccacacacacctgtct

SEQ ID NO: 5289368 - DNA, 14 bp, Homo sapiens
caaccacacacctc

SEQ ID NO: 5289369 - DNA, 20 bp, Homo sapiens
caaccacacacctcaccaga

SEQ ID NO: 5289370 - DNA, 20 bp, Homo sapiens
caaccacacttgtcggctcc

SEQ ID NO: 5289371 - DNA, 12 bp, Homo sapiens
caaccacagaga

SEQ ID NO: 5289372 - DNA, 16 bp, Homo sapiens
caaccacagtgccacc

SEQ ID NO: 5289373 - DNA, 17 bp, Homo sapiens
caaccaccgctccccag

SEQ ID NO: 5289374 - DNA, 19 bp, Homo sapiens
caaccaccgctccccagcc

SEQ ID NO: 5289375 - DNA, 18 bp, Homo sapiens
caaccacctctggccctg

SEQ ID NO: 5289376 - DNA, 16 bp, Homo sapiens
caaccacctttcagat

SEQ ID NO: 5289377 - DNA, 23 bp, Homo sapiens
caaccacggtcacacctcactgt

SEQ ID NO: 5289378 - DNA, 22 bp, Homo sapiens
caaccacgtggagaaaatcaaa

SEQ ID NO: 5289379 - DNA, 14 bp, Homo sapiens
caaccactaatttg

SEQ ID NO: 5289380 - DNA, 19 bp, Homo sapiens
caaccactaatttgtcact

SEQ ID NO: 5289381 - DNA, 19 bp, Homo sapiens
caaccactcggggccccca

SEQ ID NO: 5289382 - DNA, 19 bp, Homo sapiens
caaccactctgtggccagc

SEQ ID NO: 5289383 - DNA, 21 bp, Homo sapiens
caaccactctgtggccagcct

SEQ ID NO: 5289384 - DNA, 23 bp, Homo sapiens
caaccactggtctgtagggattt

SEQ ID NO: 5289385 - DNA, 14 bp, Homo sapiens
caaccactgtaaaa

SEQ ID NO: 5289386 - DNA, 15 bp, Homo sapiens
caaccactgtgccac

SEQ ID NO: 5289387 - DNA, 12 bp, Homo sapiens
caaccactgtgg

SEQ ID NO: 5289388 - DNA, 18 bp, Homo sapiens
caaccagaactttctgtc

SEQ ID NO: 5289389 - DNA, 11 bp, Homo sapiens
caaccagacag

SEQ ID NO: 5289390 - DNA, 12 bp, Homo sapiens
caaccagacctg

SEQ ID NO: 5289391 - DNA, 13 bp, Homo sapiens
caaccagagcact

SEQ ID NO: 5289392 - DNA, 12 bp, Homo sapiens
caaccagagccc

SEQ ID NO: 5289393 - DNA, 20 bp, Homo sapiens
caaccagaggaagaaaatga

SEQ ID NO: 5289394 - DNA, 17 bp, Homo sapiens
caaccagatcaggagag

SEQ ID NO: 5289395 - DNA, 19 bp, Homo sapiens
caaccagattgtcagctcc

SEQ ID NO: 5289396 - DNA, 15 bp, Homo sapiens
caaccagccacacag

SEQ ID NO: 5289397 - DNA, 11 bp, Homo sapiens
caaccagcctt

SEQ ID NO: 5289398 - DNA, 15 bp, Homo sapiens
caaccagctaagaaa

SEQ ID NO: 5289399 - DNA, 12 bp, Homo sapiens
caaccaggaaga

SEQ ID NO: 5289400 - DNA, 13 bp, Homo sapiens
caaccaggaccca

SEQ ID NO: 5289401 - DNA, 18 bp, Homo sapiens
caaccaggacccagggtc

SEQ ID NO: 5289402 - DNA, 22 bp, Homo sapiens
caaccaggagctgatggcagct

SEQ ID NO: 5289403 - DNA, 19 bp, Homo sapiens
caaccaggaggggtctgcc

SEQ ID NO: 5289404 - DNA, 22 bp, Homo sapiens
caaccaggaggggtctgcctcc

SEQ ID NO: 5289405 - DNA, 16 bp, Homo sapiens
caaccaggcacctctt

SEQ ID NO: 5289406 - DNA, 13 bp, Homo sapiens
caaccaggcagct

SEQ ID NO: 5289407 - DNA, 20 bp, Homo sapiens
caaccaggcagctgagacca

SEQ ID NO: 5289408 - DNA, 22 bp, Homo sapiens
caaccaggcagtagatgtgctt

SEQ ID NO: 5289409 - DNA, 20 bp, Homo sapiens
caaccaggccttcatcctcc

SEQ ID NO: 5289410 - DNA, 21 bp, Homo sapiens
caaccaggccttcatcctcct

SEQ ID NO: 5289411 - DNA, 19 bp, Homo sapiens
caaccagggagctgcaggg

SEQ ID NO: 5289412 - DNA, 20 bp, Homo sapiens
caaccagtaggatatttcta

SEQ ID NO: 5289413 - DNA, 16 bp, Homo sapiens
caaccagtgccaagga

SEQ ID NO: 5289414 - DNA, 13 bp, Homo sapiens
caaccatcatgtg

SEQ ID NO: 5289415 - DNA, 21 bp, Homo sapiens
caaccatcatgtgtagagccc

SEQ ID NO: 5289416 - DNA, 20 bp, Homo sapiens
caaccatgaatgaacccctg

SEQ ID NO: 5289417 - DNA, 23 bp, Homo sapiens
caaccatgagtggcatggccacc

SEQ ID NO: 5289418 - DNA, 21 bp, Homo sapiens
caaccatgcaaattgtgaaat

SEQ ID NO: 5289419 - DNA, 17 bp, Homo sapiens
caaccatggactttata

SEQ ID NO: 5289420 - DNA, 16 bp, Homo sapiens
caaccatgggcaccag

SEQ ID NO: 5289421 - DNA, 13 bp, Homo sapiens
caaccatgttctt

SEQ ID NO: 5289422 - DNA, 14 bp, Homo sapiens
caaccattaaagtc

SEQ ID NO: 5289423 - DNA, 16 bp, Homo sapiens
caaccattgtattttg

SEQ ID NO: 5289424 - DNA, 13 bp, Homo sapiens
caaccatttatct

SEQ ID NO: 5289425 - DNA, 16 bp, Homo sapiens
caaccatttatcttga

SEQ ID NO: 5289426 - DNA, 17 bp, Homo sapiens
caaccatttatcttgaa

SEQ ID NO: 5289427 - DNA, 22 bp, Homo sapiens
caaccatttatcttgaaggaaa

SEQ ID NO: 5289428 - DNA, 16 bp, Homo sapiens
caaccatttcctcaga

SEQ ID NO: 5289429 - DNA, 15 bp, Homo sapiens
caacccaaaccatga

SEQ ID NO: 5289430 - DNA, 18 bp, Homo sapiens
caacccaaacctggagat

SEQ ID NO: 5289431 - DNA, 19 bp, Homo sapiens
caacccaaatgttcatcaa

SEQ ID NO: 5289432 - DNA, 18 bp, Homo sapiens
caacccaacctcatcctc

SEQ ID NO: 5289433 - DNA, 20 bp, Homo sapiens
caacccaactgacttctgct

SEQ ID NO: 5289434 - DNA, 22 bp, Homo sapiens
caacccaactgacttctgctag

SEQ ID NO: 5289435 - DNA, 19 bp, Homo sapiens
caacccaaggactgaggga

SEQ ID NO: 5289436 - DNA, 16 bp, Homo sapiens
caacccaatccctctc

SEQ ID NO: 5289437 - DNA, 17 bp, Homo sapiens
caacccaatctggctgg

SEQ ID NO: 5289438 - DNA, 13 bp, Homo sapiens
caacccacagcct

SEQ ID NO: 5289439 - DNA, 14 bp, Homo sapiens
caacccacagctca

SEQ ID NO: 5289440 - DNA, 17 bp, Homo sapiens
caacccacagctcagct

SEQ ID NO: 5289441 - DNA, 18 bp, Homo sapiens
caacccacagctcagctg

SEQ ID NO: 5289442 - DNA, 19 bp, Homo sapiens
caacccacatggggttcct

SEQ ID NO: 5289443 - DNA, 14 bp, Homo sapiens
caacccacctctgg

SEQ ID NO: 5289444 - DNA, 19 bp, Homo sapiens
caacccacctctggccctg

SEQ ID NO: 5289445 - DNA, 22 bp, Homo sapiens
caacccacctctggccctgtgt

SEQ ID NO: 5289446 - DNA, 23 bp, Homo sapiens
caacccacctctggccctgtgta

SEQ ID NO: 5289447 - DNA, 12 bp, Homo sapiens
caacccagccca

SEQ ID NO: 5289448 - DNA, 14 bp, Homo sapiens
caacccagccgctg

SEQ ID NO: 5289449 - DNA, 16 bp, Homo sapiens
caacccagccgctgcc

SEQ ID NO: 5289450 - DNA, 18 bp, Homo sapiens
caacccagccgctgcccg

SEQ ID NO: 5289451 - DNA, 17 bp, Homo sapiens
caacccaggattcaaca

SEQ ID NO: 5289452 - DNA, 20 bp, Homo sapiens
caacccagtcacactgtggc

SEQ ID NO: 5289453 - DNA, 23 bp, Homo sapiens
caacccatgagcgtccaggtgat

SEQ ID NO: 5289454 - DNA, 22 bp, Homo sapiens
caacccatgatgagctcctctt

SEQ ID NO: 5289455 - DNA, 13 bp, Homo sapiens
caacccatgcatg

SEQ ID NO: 5289456 - DNA, 17 bp, Homo sapiens
caacccatgcatggcct

SEQ ID NO: 5289457 - DNA, 18 bp, Homo sapiens
caacccatgcatggcctc

SEQ ID NO: 5289458 - DNA, 19 bp, Homo sapiens
caacccatgcatggcctcc

SEQ ID NO: 5289459 - DNA, 23 bp, Homo sapiens
caacccatgcatggcctcccagc

SEQ ID NO: 5289460 - DNA, 24 bp, Homo sapiens
caacccatgcatggcctcccagcc

SEQ ID NO: 5289461 - DNA, 18 bp, Homo sapiens
caacccatgcccctgaca

SEQ ID NO: 5289462 - DNA, 15 bp, Homo sapiens
caacccatgccctgg

SEQ ID NO: 5289463 - DNA, 22 bp, Homo sapiens
caacccattgttgtcaaggaag

SEQ ID NO: 5289464 - DNA, 18 bp, Homo sapiens
caaccccaaacccaagtg

SEQ ID NO: 5289465 - DNA, 16 bp, Homo sapiens
caaccccaccctgttt

SEQ ID NO: 5289466 - DNA, 15 bp, Homo sapiens
caaccccagatgccc

SEQ ID NO: 5289467 - DNA, 15 bp, Homo sapiens
caaccccagctggcc

SEQ ID NO: 5289468 - DNA, 23 bp, Homo sapiens
caaccccagctggcctctagaac

SEQ ID NO: 5289469 - DNA, 21 bp, Homo sapiens
caaccccagggcccccacagg

SEQ ID NO: 5289470 - DNA, 23 bp, Homo sapiens
caaccccagggcccccacaggcc

SEQ ID NO: 5289471 - DNA, 13 bp, Homo sapiens
caaccccagttct

SEQ ID NO: 5289472 - DNA, 12 bp, Homo sapiens
caacccccaccc

SEQ ID NO: 5289473 - DNA, 17 bp, Homo sapiens
caacccccaccccacac

SEQ ID NO: 5289474 - DNA, 13 bp, Homo sapiens
caacccccaccga

SEQ ID NO: 5289475 - DNA, 21 bp, Homo sapiens
caacccccaccgaagagccct

SEQ ID NO: 5289476 - DNA, 13 bp, Homo sapiens
caacccccacctc

SEQ ID NO: 5289477 - DNA, 21 bp, Homo sapiens
caacccccagaggtggccctt

SEQ ID NO: 5289478 - DNA, 14 bp, Homo sapiens
caacccccagcccc

SEQ ID NO: 5289479 - DNA, 14 bp, Homo sapiens
caaccccccagcac

SEQ ID NO: 5289480 - DNA, 14 bp, Homo sapiens
caacccccctcctg

SEQ ID NO: 5289481 - DNA, 17 bp, Homo sapiens
caacccccctcctgctc

SEQ ID NO: 5289482 - DNA, 23 bp, Homo sapiens
caacccccgccacctcagggcac

SEQ ID NO: 5289483 - DNA, 20 bp, Homo sapiens
caaccccctcgcctcctact

SEQ ID NO: 5289484 - DNA, 15 bp, Homo sapiens
caaccccctcggagc

SEQ ID NO: 5289485 - DNA, 19 bp, Homo sapiens
caaccccctcggagcctgt

SEQ ID NO: 5289486 - DNA, 17 bp, Homo sapiens
atttattcaataaagta

SEQ ID NO: 5289487 - DNA, 18 bp, Homo sapiens
atttattcaataaagtat

SEQ ID NO: 5289488 - DNA, 18 bp, Homo sapiens
atttattcaattcctctg

SEQ ID NO: 5289489 - DNA, 21 bp, Homo sapiens
atttattcacatatatcaaag

SEQ ID NO: 5289490 - DNA, 18 bp, Homo sapiens
atttattcactgtaagtt

SEQ ID NO: 5289491 - DNA, 20 bp, Homo sapiens
atttattcactgtaagttta

SEQ ID NO: 5289492 - DNA, 18 bp, Homo sapiens
atttattcagcttcattt

SEQ ID NO: 5289493 - DNA, 16 bp, Homo sapiens
atttattcataatgaa

SEQ ID NO: 5289494 - DNA, 18 bp, Homo sapiens
atttattcataatgaatt

SEQ ID NO: 5289495 - DNA, 20 bp, Homo sapiens
atttattcataatgaattat

SEQ ID NO: 5289496 - DNA, 17 bp, Homo sapiens
atttattcatattttct

SEQ ID NO: 5289497 - DNA, 15 bp, Homo sapiens
atttattcatctgca

SEQ ID NO: 5289498 - DNA, 15 bp, Homo sapiens
atttattcatgtgta

SEQ ID NO: 5289499 - DNA, 16 bp, Homo sapiens
atttattcatgtgtac

SEQ ID NO: 5289500 - DNA, 22 bp, Homo sapiens
atttattcattatttgtcaaat

SEQ ID NO: 5289501 - DNA, 13 bp, Homo sapiens
atttattccccag

SEQ ID NO: 5289502 - DNA, 20 bp, Homo sapiens
atttattccccagtgactcc

SEQ ID NO: 5289503 - DNA, 19 bp, Homo sapiens
atttattcccttttaaaga

SEQ ID NO: 5289504 - DNA, 14 bp, Homo sapiens
atttattctgcttc

SEQ ID NO: 5289505 - DNA, 20 bp, Homo sapiens
atttattctgggaatgtata

SEQ ID NO: 5289506 - DNA, 21 bp, Homo sapiens
atttattctgggaatgtatag

SEQ ID NO: 5289507 - DNA, 15 bp, Homo sapiens
atttattgaaatgat

SEQ ID NO: 5289508 - DNA, 19 bp, Homo sapiens
atttattgaaatgatttca

SEQ ID NO: 5289509 - DNA, 21 bp, Homo sapiens
atttattgaaatgatttcaca

SEQ ID NO: 5289510 - DNA, 22 bp, Homo sapiens
atttattgaaatgatttcacag

SEQ ID NO: 5289511 - DNA, 16 bp, Homo sapiens
atttattgaaattttt

SEQ ID NO: 5289512 - DNA, 14 bp, Homo sapiens
atttattgaatatt

SEQ ID NO: 5289513 - DNA, 20 bp, Homo sapiens
atttattgaatatttatact

SEQ ID NO: 5289514 - DNA, 20 bp, Homo sapiens
atttattgaattattttgtt

SEQ ID NO: 5289515 - DNA, 16 bp, Homo sapiens
atttattgactcttga

SEQ ID NO: 5289516 - DNA, 19 bp, Homo sapiens
atttattgactcttgagtt

SEQ ID NO: 5289517 - DNA, 20 bp, Homo sapiens
atttattgactcttgagttg

SEQ ID NO: 5289518 - DNA, 22 bp, Homo sapiens
atttattgactcttgagttgtt

SEQ ID NO: 5289519 - DNA, 18 bp, Homo sapiens
atttattgactttgacaa

SEQ ID NO: 5289520 - DNA, 14 bp, Homo sapiens
atttattgaggaaa

SEQ ID NO: 5289521 - DNA, 22 bp, Homo sapiens
atttattgagtacctactgtgt

SEQ ID NO: 5289522 - DNA, 13 bp, Homo sapiens
atttattgatgtt

SEQ ID NO: 5289523 - DNA, 14 bp, Homo sapiens
atttattgatgttt

SEQ ID NO: 5289524 - DNA, 16 bp, Homo sapiens
atttattgatgttttc

SEQ ID NO: 5289525 - DNA, 19 bp, Homo sapiens
atttattgattaaaaatgt

SEQ ID NO: 5289526 - DNA, 20 bp, Homo sapiens
atttattgattaaaaatgtg

SEQ ID NO: 5289527 - DNA, 23 bp, Homo sapiens
atttattgattccttttttcaaa

SEQ ID NO: 5289528 - DNA, 16 bp, Homo sapiens
atttattgatttcaag

SEQ ID NO: 5289529 - DNA, 16 bp, Homo sapiens
atttattgcacattgt

SEQ ID NO: 5289530 - DNA, 14 bp, Homo sapiens
atttattgccatat

SEQ ID NO: 5289531 - DNA, 20 bp, Homo sapiens
atttattgcttagtgaaaat

SEQ ID NO: 5289532 - DNA, 13 bp, Homo sapiens
atttattgcttta

SEQ ID NO: 5289533 - DNA, 21 bp, Homo sapiens
atttattggatgatacagtgt

SEQ ID NO: 5289534 - DNA, 17 bp, Homo sapiens
atttattggcagccaag

SEQ ID NO: 5289535 - DNA, 19 bp, Homo sapiens
atttattggcagccaagga

SEQ ID NO: 5289536 - DNA, 18 bp, Homo sapiens
atttattggcttttctga

SEQ ID NO: 5289537 - DNA, 20 bp, Homo sapiens
atttattggcttttctgatc

SEQ ID NO: 5289538 - DNA, 20 bp, Homo sapiens
atttattgggatgtgagccc

SEQ ID NO: 5289539 - DNA, 13 bp, Homo sapiens
atttattggggat

SEQ ID NO: 5289540 - DNA, 22 bp, Homo sapiens
atttattggtcagggtgtggga

SEQ ID NO: 5289541 - DNA, 13 bp, Homo sapiens
atttattgtatta

SEQ ID NO: 5289542 - DNA, 19 bp, Homo sapiens
atttattgtcattactgcc

SEQ ID NO: 5289543 - DNA, 14 bp, Homo sapiens
atttattgtctgtc

SEQ ID NO: 5289544 - DNA, 16 bp, Homo sapiens
atttattgtctgtcta

SEQ ID NO: 5289545 - DNA, 19 bp, Homo sapiens
atttattgtctgtctacat

SEQ ID NO: 5289546 - DNA, 18 bp, Homo sapiens
atttattgtgtgttctca

SEQ ID NO: 5289547 - DNA, 14 bp, Homo sapiens
atttattgttagaa

SEQ ID NO: 5289548 - DNA, 23 bp, Homo sapiens
atttattgttagaaaatgactta

SEQ ID NO: 5289549 - DNA, 17 bp, Homo sapiens
atttattgtttatgtaa

SEQ ID NO: 5289550 - DNA, 19 bp, Homo sapiens
atttattgtttatgtaaat

SEQ ID NO: 5289551 - DNA, 21 bp, Homo sapiens
atttattgtttatgtaaatgt

SEQ ID NO: 5289552 - DNA, 22 bp, Homo sapiens
atttattgtttatttatcagtg

SEQ ID NO: 5289553 - DNA, 20 bp, Homo sapiens
atttattgtttgaaatgtcg

SEQ ID NO: 5289554 - DNA, 14 bp, Homo sapiens
atttatttaaaact

SEQ ID NO: 5289555 - DNA, 16 bp, Homo sapiens
atttatttaaaactct

SEQ ID NO: 5289556 - DNA, 14 bp, Homo sapiens
atttatttaaaaga

SEQ ID NO: 5289557 - DNA, 14 bp, Homo sapiens
atttatttaaacaa

SEQ ID NO: 5289558 - DNA, 15 bp, Homo sapiens
atttatttaaagcat

SEQ ID NO: 5289559 - DNA, 11 bp, Homo sapiens
atttatttaat

SEQ ID NO: 5289560 - DNA, 13 bp, Homo sapiens
atttatttaataa

SEQ ID NO: 5289561 - DNA, 15 bp, Homo sapiens
atttatttaatattt

SEQ ID NO: 5289562 - DNA, 13 bp, Homo sapiens
atttatttaatta

SEQ ID NO: 5289563 - DNA, 13 bp, Homo sapiens
atttatttacaga

SEQ ID NO: 5289564 - DNA, 17 bp, Homo sapiens
atttatttatgtgcaag

SEQ ID NO: 5289565 - DNA, 14 bp, Homo sapiens
atttatttattaag

SEQ ID NO: 5289566 - DNA, 16 bp, Homo sapiens
atttatttattaagat

SEQ ID NO: 5289567 - DNA, 14 bp, Homo sapiens
atttatttattacc

SEQ ID NO: 5289568 - DNA, 15 bp, Homo sapiens
atttatttattactg

SEQ ID NO: 5289569 - DNA, 12 bp, Homo sapiens
atttatttattt

SEQ ID NO: 5289570 - DNA, 16 bp, Homo sapiens
atttatttatttattc

SEQ ID NO: 5289571 - DNA, 14 bp, Homo sapiens
atttatttccaaaa

SEQ ID NO: 5289572 - DNA, 19 bp, Homo sapiens
atttatttccaatgtttca

SEQ ID NO: 5289573 - DNA, 21 bp, Homo sapiens
atttatttccactaaaaatat

SEQ ID NO: 5289574 - DNA, 14 bp, Homo sapiens
atttatttccagac

SEQ ID NO: 5289575 - DNA, 15 bp, Homo sapiens
atttatttccagtgg

SEQ ID NO: 5289576 - DNA, 12 bp, Homo sapiens
atttatttccat

SEQ ID NO: 5289577 - DNA, 22 bp, Homo sapiens
atttatttccatattaaaatca

SEQ ID NO: 5289578 - DNA, 18 bp, Homo sapiens
atttatttcctagttctg

SEQ ID NO: 5289579 - DNA, 12 bp, Homo sapiens
atttatttcctc

SEQ ID NO: 5289580 - DNA, 15 bp, Homo sapiens
atttatttcctccct

SEQ ID NO: 5289581 - DNA, 17 bp, Homo sapiens
atttatttcctgctact

SEQ ID NO: 5289582 - DNA, 11 bp, Homo sapiens
atttatttcta

SEQ ID NO: 5289583 - DNA, 13 bp, Homo sapiens
atttatttctctg

SEQ ID NO: 5289584 - DNA, 14 bp, Homo sapiens
atttatttctctgg

SEQ ID NO: 5289585 - DNA, 20 bp, Homo sapiens
atttatttcttttttgccaa

SEQ ID NO: 5289586 - DNA, 13 bp, Homo sapiens
atttatttgaatg

SEQ ID NO: 5289587 - DNA, 14 bp, Homo sapiens
atttatttgactaa

SEQ ID NO: 5289588 - DNA, 19 bp, Homo sapiens
atttatttgaggtcagtgt

SEQ ID NO: 5289589 - DNA, 16 bp, Homo sapiens
atttatttgattaggt

SEQ ID NO: 5289590 - DNA, 13 bp, Homo sapiens
atttatttgcaaa

SEQ ID NO: 5289591 - DNA, 23 bp, Homo sapiens
atttatttgcaaatatactttac

SEQ ID NO: 5289592 - DNA, 13 bp, Homo sapiens
atttatttgcttc

SEQ ID NO: 5289593 - DNA, 15 bp, Homo sapiens
atttatttgcttctt

SEQ ID NO: 5289594 - DNA, 16 bp, Homo sapiens
atttatttgcttcttc

SEQ ID NO: 5289595 - DNA, 13 bp, Homo sapiens
atttatttggagt

SEQ ID NO: 5289596 - DNA, 19 bp, Homo sapiens
atttatttggagtggaggc

SEQ ID NO: 5289597 - DNA, 23 bp, Homo sapiens
atttatttggagtggaggcattg

SEQ ID NO: 5289598 - DNA, 21 bp, Homo sapiens
atttatttggatttagagcag

SEQ ID NO: 5289599 - DNA, 20 bp, Homo sapiens
atttatttgtcgtgttggaa

SEQ ID NO: 5289600 - DNA, 22 bp, Homo sapiens
atttattttaaaaaatgaaaat

SEQ ID NO: 5289601 - DNA, 23 bp, Homo sapiens
atttattttaacaaaagaagatt

SEQ ID NO: 5289602 - DNA, 16 bp, Homo sapiens
atttattttaatgtat

SEQ ID NO: 5289603 - DNA, 15 bp, Homo sapiens
atttattttagcaaa

SEQ ID NO: 5289604 - DNA, 16 bp, Homo sapiens
atttattttagcaaat

SEQ ID NO: 5289605 - DNA, 14 bp, Homo sapiens
atttattttataac

SEQ ID NO: 5289606 - DNA, 20 bp, Homo sapiens
atttattttataacatgtta

SEQ ID NO: 5289607 - DNA, 20 bp, Homo sapiens
atttattttataagaaaaac

SEQ ID NO: 5289608 - DNA, 16 bp, Homo sapiens
atttattttatgagaa

SEQ ID NO: 5289609 - DNA, 20 bp, Homo sapiens
atttattttatgagaaatgt

SEQ ID NO: 5289610 - DNA, 21 bp, Homo sapiens
atttattttattctatgtatg

SEQ ID NO: 5289611 - DNA, 13 bp, Homo sapiens
atttattttcctc

SEQ ID NO: 5289612 - DNA, 21 bp, Homo sapiens
atttattttcttttttgataa

SEQ ID NO: 5289613 - DNA, 17 bp, Homo sapiens
atttattttgctccctc

SEQ ID NO: 5289614 - DNA, 14 bp, Homo sapiens
atttattttgtaat

SEQ ID NO: 5289615 - DNA, 16 bp, Homo sapiens
atttattttgtaatta

SEQ ID NO: 5289616 - DNA, 19 bp, Homo sapiens
atttattttgtaattatga

SEQ ID NO: 5289617 - DNA, 16 bp, Homo sapiens
atttattttgtatgaa

SEQ ID NO: 5289618 - DNA, 15 bp, Homo sapiens
atttattttgtttaa

SEQ ID NO: 5289619 - DNA, 18 bp, Homo sapiens
atttatttttacaagaag

SEQ ID NO: 5289620 - DNA, 18 bp, Homo sapiens
atttatttttcagttcca

SEQ ID NO: 5289621 - DNA, 19 bp, Homo sapiens
atttatttttcagttccaa

SEQ ID NO: 5289622 - DNA, 20 bp, Homo sapiens
atttatttttcagttccaag

SEQ ID NO: 5289623 - DNA, 23 bp, Homo sapiens
atttatttttcagttccaagaaa

SEQ ID NO: 5289624 - DNA, 17 bp, Homo sapiens
atttatttttgcatggc

SEQ ID NO: 5289625 - DNA, 22 bp, Homo sapiens
atttatttttgggtttggccag

SEQ ID NO: 5289626 - DNA, 23 bp, Homo sapiens
atttatttttgggtttggccagg

SEQ ID NO: 5289627 - DNA, 15 bp, Homo sapiens
atttattttttaaga

SEQ ID NO: 5289628 - DNA, 21 bp, Homo sapiens
atttattttttaagaaaaaaa

SEQ ID NO: 5289629 - DNA, 19 bp, Homo sapiens
atttattttttacattatt

SEQ ID NO: 5289630 - DNA, 22 bp, Homo sapiens
atttattttttcttttctttac

SEQ ID NO: 5289631 - DNA, 16 bp, Homo sapiens
atttattttttgtaac

SEQ ID NO: 5289632 - DNA, 18 bp, Homo sapiens
atttattttttgtaactc

SEQ ID NO: 5289633 - DNA, 22 bp, Homo sapiens
atttattttttgtaactctttg

SEQ ID NO: 5289634 - DNA, 19 bp, Homo sapiens
atttatttttttattcttc

SEQ ID NO: 5289635 - DNA, 22 bp, Homo sapiens
atttattttttttaattgtatt

SEQ ID NO: 5289636 - DNA, 23 bp, Homo sapiens
atttattttttttaattgtattt

SEQ ID NO: 5289637 - DNA, 22 bp, Homo sapiens
atttcaaaaaaaaaaaaaaaga

SEQ ID NO: 5289638 - DNA, 17 bp, Homo sapiens
atttcaaaaatataact

SEQ ID NO: 5289639 - DNA, 19 bp, Homo sapiens
atttcaaaaatataactta

SEQ ID NO: 5289640 - DNA, 12 bp, Homo sapiens
atttcaaaaatt

SEQ ID NO: 5289641 - DNA, 17 bp, Homo sapiens
atttcaaaaatttggaa

SEQ ID NO: 5289642 - DNA, 22 bp, Homo sapiens
atttcaaaaatttggaattctg

SEQ ID NO: 5289643 - DNA, 14 bp, Homo sapiens
atttcaaaactcat

SEQ ID NO: 5289644 - DNA, 19 bp, Homo sapiens
atttcaaaagaacattctt

SEQ ID NO: 5289645 - DNA, 12 bp, Homo sapiens
atttcaaaataa

SEQ ID NO: 5289646 - DNA, 17 bp, Homo sapiens
atttcaaaataaactgg

SEQ ID NO: 5289647 - DNA, 21 bp, Homo sapiens
atttcaaaatacatttgtaag

SEQ ID NO: 5289648 - DNA, 13 bp, Homo sapiens
atttcaaaatata

SEQ ID NO: 5289649 - DNA, 14 bp, Homo sapiens
atttcaaaatgata

SEQ ID NO: 5289650 - DNA, 21 bp, Homo sapiens
atttcaaaatgatagacatat

SEQ ID NO: 5289651 - DNA, 16 bp, Homo sapiens
atttcaaaatgcatgt

SEQ ID NO: 5289652 - DNA, 20 bp, Homo sapiens
atttcaaaatgcatgtgatt

SEQ ID NO: 5289653 - DNA, 15 bp, Homo sapiens
atttcaaaatgcttt

SEQ ID NO: 5289654 - DNA, 23 bp, Homo sapiens
atttcaaaatggtaactttacaa

SEQ ID NO: 5289655 - DNA, 13 bp, Homo sapiens
atttcaaaatgtc

SEQ ID NO: 5289656 - DNA, 14 bp, Homo sapiens
atttcaaaatgtct

SEQ ID NO: 5289657 - DNA, 15 bp, Homo sapiens
atttcaaaatgtctc

SEQ ID NO: 5289658 - DNA, 13 bp, Homo sapiens
atttcaaaattaa

SEQ ID NO: 5289659 - DNA, 13 bp, Homo sapiens
atttcaaaattta

SEQ ID NO: 5289660 - DNA, 14 bp, Homo sapiens
atttcaaacatttg

SEQ ID NO: 5289661 - DNA, 18 bp, Homo sapiens
atttcaaacattttgtat

SEQ ID NO: 5289662 - DNA, 19 bp, Homo sapiens
atttcaaaccattgctctt

SEQ ID NO: 5289663 - DNA, 18 bp, Homo sapiens
atttcaaacttaaacaaa

SEQ ID NO: 5289664 - DNA, 23 bp, Homo sapiens
atttcaaacttaaacaaaaaact

SEQ ID NO: 5289665 - DNA, 12 bp, Homo sapiens
caaccccctgca

SEQ ID NO: 5289666 - DNA, 14 bp, Homo sapiens
caaccccctgcaag

SEQ ID NO: 5289667 - DNA, 17 bp, Homo sapiens
caaccccggggcatgga

SEQ ID NO: 5289668 - DNA, 21 bp, Homo sapiens
caacccctcccctccatccct

SEQ ID NO: 5289669 - DNA, 22 bp, Homo sapiens
caacccctcccctccatccctg

SEQ ID NO: 5289670 - DNA, 15 bp, Homo sapiens
caacccctccttccc

SEQ ID NO: 5289671 - DNA, 17 bp, Homo sapiens
caacccctcgcccagtc

SEQ ID NO: 5289672 - DNA, 14 bp, Homo sapiens
caacccctctccag

SEQ ID NO: 5289673 - DNA, 18 bp, Homo sapiens
caacccctctccaggcct

SEQ ID NO: 5289674 - DNA, 20 bp, Homo sapiens
caacccctctccaggcctgt

SEQ ID NO: 5289675 - DNA, 22 bp, Homo sapiens
caacccctctttcgtctactgc

SEQ ID NO: 5289676 - DNA, 18 bp, Homo sapiens
caacccctgacctacccc

SEQ ID NO: 5289677 - DNA, 21 bp, Homo sapiens
caacccctgacctaccccagc

SEQ ID NO: 5289678 - DNA, 12 bp, Homo sapiens
caacccctgagg

SEQ ID NO: 5289679 - DNA, 12 bp, Homo sapiens
caacccctgtac

SEQ ID NO: 5289680 - DNA, 14 bp, Homo sapiens
caaccccttcgctc

SEQ ID NO: 5289681 - DNA, 14 bp, Homo sapiens
caacccgctgcttc

SEQ ID NO: 5289682 - DNA, 22 bp, Homo sapiens
caacccgtctggcccaccaggg

SEQ ID NO: 5289683 - DNA, 16 bp, Homo sapiens
caacccgtgccaagtc

SEQ ID NO: 5289684 - DNA, 19 bp, Homo sapiens
caacccgtgcccctgggat

SEQ ID NO: 5289685 - DNA, 21 bp, Homo sapiens
caacccgtgcccctgggatcc

SEQ ID NO: 5289686 - DNA, 23 bp, Homo sapiens
caacccgttgggtcccttgctgc

SEQ ID NO: 5289687 - DNA, 16 bp, Homo sapiens
caaccctatctcctga

SEQ ID NO: 5289688 - DNA, 19 bp, Homo sapiens
caaccctatctcctgacag

SEQ ID NO: 5289689 - DNA, 13 bp, Homo sapiens
caaccctcagagc

SEQ ID NO: 5289690 - DNA, 18 bp, Homo sapiens
caaccctcagagccaccc

SEQ ID NO: 5289691 - DNA, 13 bp, Homo sapiens
caaccctcagcct

SEQ ID NO: 5289692 - DNA, 22 bp, Homo sapiens
caaccctcagggcaaagccagg

SEQ ID NO: 5289693 - DNA, 22 bp, Homo sapiens
caaccctccctcagcccctctt

SEQ ID NO: 5289694 - DNA, 15 bp, Homo sapiens
caaccctcctatcac

SEQ ID NO: 5289695 - DNA, 22 bp, Homo sapiens
caaccctcctatcacctcccct

SEQ ID NO: 5289696 - DNA, 12 bp, Homo sapiens
caaccctctcct

SEQ ID NO: 5289697 - DNA, 15 bp, Homo sapiens
caaccctctcctgtc

SEQ ID NO: 5289698 - DNA, 16 bp, Homo sapiens
caaccctctgaagaag

SEQ ID NO: 5289699 - DNA, 12 bp, Homo sapiens
caaccctgcaat

SEQ ID NO: 5289700 - DNA, 23 bp, Homo sapiens
caaccctgcccacttcagcccag

SEQ ID NO: 5289701 - DNA, 13 bp, Homo sapiens
caaccctgcccag

SEQ ID NO: 5289702 - DNA, 15 bp, Homo sapiens
caaccctgcccagcc

SEQ ID NO: 5289703 - DNA, 16 bp, Homo sapiens
caaccctgccctgcac

SEQ ID NO: 5289704 - DNA, 20 bp, Homo sapiens
caaccctgccgtcaccacca

SEQ ID NO: 5289705 - DNA, 15 bp, Homo sapiens
caaccctgcctgtca

SEQ ID NO: 5289706 - DNA, 18 bp, Homo sapiens
caaccctgggctggggag

SEQ ID NO: 5289707 - DNA, 22 bp, Homo sapiens
caaccctggggaaggagccagt

SEQ ID NO: 5289708 - DNA, 23 bp, Homo sapiens
caaccctggggaaggagccagtt

SEQ ID NO: 5289709 - DNA, 11 bp, Homo sapiens
caaccctgtgg

SEQ ID NO: 5289710 - DNA, 16 bp, Homo sapiens
caaccctgtttcctga

SEQ ID NO: 5289711 - DNA, 20 bp, Homo sapiens
caacccttaccccttagcct

SEQ ID NO: 5289712 - DNA, 21 bp, Homo sapiens
caacccttagagattgcccca

SEQ ID NO: 5289713 - DNA, 23 bp, Homo sapiens
caacccttagagattgccccaga

SEQ ID NO: 5289714 - DNA, 11 bp, Homo sapiens
caacccttccc

SEQ ID NO: 5289715 - DNA, 19 bp, Homo sapiens
caacccttcctgaaacttc

SEQ ID NO: 5289716 - DNA, 22 bp, Homo sapiens
caacccttctaaacggtgacct

SEQ ID NO: 5289717 - DNA, 21 bp, Homo sapiens
caacccttctcctcttgtaaa

SEQ ID NO: 5289718 - DNA, 14 bp, Homo sapiens
caacccttctctgt

SEQ ID NO: 5289719 - DNA, 22 bp, Homo sapiens
caaccgagagaatgctgacctg

SEQ ID NO: 5289720 - DNA, 14 bp, Homo sapiens
caaccgatgctcca

SEQ ID NO: 5289721 - DNA, 18 bp, Homo sapiens
caaccgatgctccagcca

SEQ ID NO: 5289722 - DNA, 21 bp, Homo sapiens
caaccgatgctccagccaacc

SEQ ID NO: 5289723 - DNA, 16 bp, Homo sapiens
caaccgcttgccatat

SEQ ID NO: 5289724 - DNA, 13 bp, Homo sapiens
caaccggatgcca

SEQ ID NO: 5289725 - DNA, 22 bp, Homo sapiens
caaccggctttgtggcactggg

SEQ ID NO: 5289726 - DNA, 20 bp, Homo sapiens
caaccgtccccggcccctgc

SEQ ID NO: 5289727 - DNA, 15 bp, Homo sapiens
caaccgtcctgctgt

SEQ ID NO: 5289728 - DNA, 18 bp, Homo sapiens
caaccgtcctgctgtccc

SEQ ID NO: 5289729 - DNA, 19 bp, Homo sapiens
caaccgtggcccttcctgg

SEQ ID NO: 5289730 - DNA, 22 bp, Homo sapiens
caaccgtggcccttcctggaca

SEQ ID NO: 5289731 - DNA, 15 bp, Homo sapiens
caacctaaaactctt

SEQ ID NO: 5289732 - DNA, 19 bp, Homo sapiens
caacctaacctgtgtctgc

SEQ ID NO: 5289733 - DNA, 13 bp, Homo sapiens
caacctactgtct

SEQ ID NO: 5289734 - DNA, 17 bp, Homo sapiens
caacctactgtctaagc

SEQ ID NO: 5289735 - DNA, 12 bp, Homo sapiens
caacctagaatg

SEQ ID NO: 5289736 - DNA, 13 bp, Homo sapiens
caacctagaatgt

SEQ ID NO: 5289737 - DNA, 19 bp, Homo sapiens
caacctaggagcagtgggc

SEQ ID NO: 5289738 - DNA, 17 bp, Homo sapiens
caacctatttgactgct

SEQ ID NO: 5289739 - DNA, 16 bp, Homo sapiens
caacctattttgaagt

SEQ ID NO: 5289740 - DNA, 18 bp, Homo sapiens
caacctcaactgcctact

SEQ ID NO: 5289741 - DNA, 14 bp, Homo sapiens
caacctcaatgccc

SEQ ID NO: 5289742 - DNA, 17 bp, Homo sapiens
caacctcaatgccctgc

SEQ ID NO: 5289743 - DNA, 20 bp, Homo sapiens
caacctcaatgccctgccat

SEQ ID NO: 5289744 - DNA, 15 bp, Homo sapiens
caacctcaccaaact

SEQ ID NO: 5289745 - DNA, 16 bp, Homo sapiens
caacctcaccctcctg

SEQ ID NO: 5289746 - DNA, 11 bp, Homo sapiens
caacctcactt

SEQ ID NO: 5289747 - DNA, 13 bp, Homo sapiens
caacctcagaggc

SEQ ID NO: 5289748 - DNA, 19 bp, Homo sapiens
caacctcagaggcagcttc

SEQ ID NO: 5289749 - DNA, 20 bp, Homo sapiens
caacctcagaggcagcttca

SEQ ID NO: 5289750 - DNA, 15 bp, Homo sapiens
caacctcaggctcct

SEQ ID NO: 5289751 - DNA, 20 bp, Homo sapiens
caacctcagggctcccaggg

SEQ ID NO: 5289752 - DNA, 18 bp, Homo sapiens
caacctcagtaatttaga

SEQ ID NO: 5289753 - DNA, 18 bp, Homo sapiens
caacctcatcctccttct

SEQ ID NO: 5289754 - DNA, 15 bp, Homo sapiens
caacctcatcctctc

SEQ ID NO: 5289755 - DNA, 12 bp, Homo sapiens
caacctccacct

SEQ ID NO: 5289756 - DNA, 14 bp, Homo sapiens
caacctccacctcc

SEQ ID NO: 5289757 - DNA, 19 bp, Homo sapiens
caacctccacctcccaggt

SEQ ID NO: 5289758 - DNA, 19 bp, Homo sapiens
caacctccacctcccgggt

SEQ ID NO: 5289759 - DNA, 19 bp, Homo sapiens
caacctccaccttccaggc

SEQ ID NO: 5289760 - DNA, 18 bp, Homo sapiens
caacctccagactcagca

SEQ ID NO: 5289761 - DNA, 20 bp, Homo sapiens
caacctccccgcagagctcc

SEQ ID NO: 5289762 - DNA, 18 bp, Homo sapiens
caacctccctcttgtttt

SEQ ID NO: 5289763 - DNA, 20 bp, Homo sapiens
caacctccctcttgttttgt

SEQ ID NO: 5289764 - DNA, 19 bp, Homo sapiens
caacctccctggctcaagc

SEQ ID NO: 5289765 - DNA, 19 bp, Homo sapiens
caacctccgcctcccgggt

SEQ ID NO: 5289766 - DNA, 13 bp, Homo sapiens
caacctcctgctc

SEQ ID NO: 5289767 - DNA, 21 bp, Homo sapiens
caacctcctgctctgggacgt

SEQ ID NO: 5289768 - DNA, 15 bp, Homo sapiens
caacctcctgggcta

SEQ ID NO: 5289769 - DNA, 16 bp, Homo sapiens
caacctcctgtggaac

SEQ ID NO: 5289770 - DNA, 23 bp, Homo sapiens
caacctcctgtggaacccagcag

SEQ ID NO: 5289771 - DNA, 13 bp, Homo sapiens
caacctcgccctc

SEQ ID NO: 5289772 - DNA, 16 bp, Homo sapiens
caacctcgccctctct

SEQ ID NO: 5289773 - DNA, 23 bp, Homo sapiens
caacctcgccctctctcaccagc

SEQ ID NO: 5289774 - DNA, 20 bp, Homo sapiens
caacctcgctccaactccaa

SEQ ID NO: 5289775 - DNA, 16 bp, Homo sapiens
caacctcgctgagggc

SEQ ID NO: 5289776 - DNA, 17 bp, Homo sapiens
caacctcggctcctgga

SEQ ID NO: 5289777 - DNA, 19 bp, Homo sapiens
caacctctcctttctgtgc

SEQ ID NO: 5289778 - DNA, 16 bp, Homo sapiens
caacctctctccttct

SEQ ID NO: 5289779 - DNA, 16 bp, Homo sapiens
caacctctctgatctt

SEQ ID NO: 5289780 - DNA, 21 bp, Homo sapiens
caacctctgccccccaagttc

SEQ ID NO: 5289781 - DNA, 15 bp, Homo sapiens
caacctctgcctccc

SEQ ID NO: 5289782 - DNA, 20 bp, Homo sapiens
caacctctgcctcccaggtt

SEQ ID NO: 5289783 - DNA, 19 bp, Homo sapiens
caacctctgcctcccgggt

SEQ ID NO: 5289784 - DNA, 17 bp, Homo sapiens
caacctctgcctcctgg

SEQ ID NO: 5289785 - DNA, 19 bp, Homo sapiens
caacctctgcctcctgggt

SEQ ID NO: 5289786 - DNA, 14 bp, Homo sapiens
caacctctgtatta

SEQ ID NO: 5289787 - DNA, 19 bp, Homo sapiens
caacctctgtctcccgggt

SEQ ID NO: 5289788 - DNA, 21 bp, Homo sapiens
caacctctgttccccacccag

SEQ ID NO: 5289789 - DNA, 14 bp, Homo sapiens
caacctcttcctcc

SEQ ID NO: 5289790 - DNA, 18 bp, Homo sapiens
caacctcttctggctcaa

SEQ ID NO: 5289791 - DNA, 13 bp, Homo sapiens
caacctgaaagac

SEQ ID NO: 5289792 - DNA, 23 bp, Homo sapiens
caacctgaaggtcccctggcagt

SEQ ID NO: 5289793 - DNA, 13 bp, Homo sapiens
caacctgaatctt

SEQ ID NO: 5289794 - DNA, 20 bp, Homo sapiens
caacctgagccttttcttat

SEQ ID NO: 5289795 - DNA, 15 bp, Homo sapiens
caacctgatacattt

SEQ ID NO: 5289796 - DNA, 21 bp, Homo sapiens
caacctgatgccccttcccca

SEQ ID NO: 5289797 - DNA, 16 bp, Homo sapiens
caacctgattgtaaac

SEQ ID NO: 5289798 - DNA, 16 bp, Homo sapiens
caacctgattgtgtct

SEQ ID NO: 5289799 - DNA, 21 bp, Homo sapiens
caacctgattgtgtctcttgg

SEQ ID NO: 5289800 - DNA, 10 bp, Homo sapiens
caacctgcaa

SEQ ID NO: 5289801 - DNA, 12 bp, Homo sapiens
caacctgcactc

SEQ ID NO: 5289802 - DNA, 17 bp, Homo sapiens
caacctgcaggctcccg

SEQ ID NO: 5289803 - DNA, 12 bp, Homo sapiens
caacctgcccct

SEQ ID NO: 5289804 - DNA, 14 bp, Homo sapiens
caacctgcccctcc

SEQ ID NO: 5289805 - DNA, 21 bp, Homo sapiens
caacctgcctgacatttggag

SEQ ID NO: 5289806 - DNA, 18 bp, Homo sapiens
caacctgcctgtgcatga

SEQ ID NO: 5289807 - DNA, 18 bp, Homo sapiens
caacctgcggaaggaggt

SEQ ID NO: 5289808 - DNA, 15 bp, Homo sapiens
caacctgctctcctc

SEQ ID NO: 5289809 - DNA, 18 bp, Homo sapiens
caacctgctctcctcttg

SEQ ID NO: 5289810 - DNA, 23 bp, Homo sapiens
caacctgctctcctcttgccact

SEQ ID NO: 5289811 - DNA, 18 bp, Homo sapiens
caacctgctctgtcccca

SEQ ID NO: 5289812 - DNA, 12 bp, Homo sapiens
caacctggactt

SEQ ID NO: 5289813 - DNA, 13 bp, Homo sapiens
caacctggacttc

SEQ ID NO: 5289814 - DNA, 11 bp, Homo sapiens
caacctggaga

SEQ ID NO: 5289815 - DNA, 17 bp, Homo sapiens
caacctggaggctggac

SEQ ID NO: 5289816 - DNA, 17 bp, Homo sapiens
caacctggccagaggca

SEQ ID NO: 5289817 - DNA, 17 bp, Homo sapiens
caacctggctccctccc

SEQ ID NO: 5289818 - DNA, 18 bp, Homo sapiens
caacctggctccctccca

SEQ ID NO: 5289819 - DNA, 15 bp, Homo sapiens
caacctggctctggc

SEQ ID NO: 5289820 - DNA, 13 bp, Homo sapiens
caacctgggtcca

SEQ ID NO: 5289821 - DNA, 14 bp, Homo sapiens
caacctgggtccaa

SEQ ID NO: 5289822 - DNA, 17 bp, Homo sapiens
caacctgggtccaaata

SEQ ID NO: 5289823 - DNA, 18 bp, Homo sapiens
caacctggtggcaccaga

SEQ ID NO: 5289824 - DNA, 21 bp, Homo sapiens
caacctgtaaattattttaaa

SEQ ID NO: 5289825 - DNA, 17 bp, Homo sapiens
caacctgtaactcacat

SEQ ID NO: 5289826 - DNA, 17 bp, Homo sapiens
caacctgtaataaatat

SEQ ID NO: 5289827 - DNA, 14 bp, Homo sapiens
caacctgtccttac

SEQ ID NO: 5289828 - DNA, 21 bp, Homo sapiens
caacctgtccttactcagagc

SEQ ID NO: 5289829 - DNA, 23 bp, Homo sapiens
caacctgtccttactcagagctg

SEQ ID NO: 5289830 - DNA, 16 bp, Homo sapiens
caacctgtggctcagg

SEQ ID NO: 5289831 - DNA, 23 bp, Homo sapiens
caacctgttacctactttgactt

SEQ ID NO: 5289832 - DNA, 20 bp, Homo sapiens
caacctgttctgctttcctc

SEQ ID NO: 5289833 - DNA, 21 bp, Homo sapiens
caacctgttcttagagtgtag

SEQ ID NO: 5289834 - DNA, 20 bp, Homo sapiens
caaccttaaagcaataagtt

SEQ ID NO: 5289835 - DNA, 22 bp, Homo sapiens
caaccttaaagcaataagttca

SEQ ID NO: 5289836 - DNA, 14 bp, Homo sapiens
caaccttaccaaaa

SEQ ID NO: 5289837 - DNA, 14 bp, Homo sapiens
caaccttacttaca

SEQ ID NO: 5289838 - DNA, 15 bp, Homo sapiens
caaccttcaaagaaa

SEQ ID NO: 5289839 - DNA, 16 bp, Homo sapiens
caaccttcaaagaaac

SEQ ID NO: 5289840 - DNA, 17 bp, Homo sapiens
caaccttcaaagaaact

SEQ ID NO: 5289841 - DNA, 14 bp, Homo sapiens
caaccttcaagctg

SEQ ID NO: 5289842 - DNA, 14 bp, Homo sapiens
caaccttcacctcc

SEQ ID NO: 5289843 - DNA, 22 bp, Homo sapiens
caaccttcagctttatttttct

SEQ ID NO: 5289844 - DNA, 17 bp, Homo sapiens
atttcaaacttttgaaa

SEQ ID NO: 5289845 - DNA, 19 bp, Homo sapiens
atttcaaacttttgaaaga

SEQ ID NO: 5289846 - DNA, 21 bp, Homo sapiens
atttcaaacttttgaaagatg

SEQ ID NO: 5289847 - DNA, 16 bp, Homo sapiens
atttcaaagaaaacag

SEQ ID NO: 5289848 - DNA, 20 bp, Homo sapiens
atttcaaagaaaacagacca

SEQ ID NO: 5289849 - DNA, 15 bp, Homo sapiens
atttcaaagccctgc

SEQ ID NO: 5289850 - DNA, 20 bp, Homo sapiens
atttcaaagccctgcctctg

SEQ ID NO: 5289851 - DNA, 21 bp, Homo sapiens
atttcaaagccctgcctctgt

SEQ ID NO: 5289852 - DNA, 22 bp, Homo sapiens
atttcaaagccctgcctctgtg

SEQ ID NO: 5289853 - DNA, 19 bp, Homo sapiens
atttcaaagttttgttgta

SEQ ID NO: 5289854 - DNA, 15 bp, Homo sapiens
atttcaaatctgtaa

SEQ ID NO: 5289855 - DNA, 11 bp, Homo sapiens
atttcaaatga

SEQ ID NO: 5289856 - DNA, 15 bp, Homo sapiens
atttcaaatgaacac

SEQ ID NO: 5289857 - DNA, 18 bp, Homo sapiens
atttcaaatgattatgat

SEQ ID NO: 5289858 - DNA, 12 bp, Homo sapiens
atttcaaatgca

SEQ ID NO: 5289859 - DNA, 14 bp, Homo sapiens
atttcaaatgttag

SEQ ID NO: 5289860 - DNA, 17 bp, Homo sapiens
atttcaaattggagctt

SEQ ID NO: 5289861 - DNA, 15 bp, Homo sapiens
atttcaacaagaata

SEQ ID NO: 5289862 - DNA, 23 bp, Homo sapiens
atttcaacaagtagctaaagtct

SEQ ID NO: 5289863 - DNA, 21 bp, Homo sapiens
atttcaacataattatgggaa

SEQ ID NO: 5289864 - DNA, 19 bp, Homo sapiens
atttcaacatatcattttt

SEQ ID NO: 5289865 - DNA, 18 bp, Homo sapiens
atttcaacatgagtgtat

SEQ ID NO: 5289866 - DNA, 19 bp, Homo sapiens
atttcaaccacacctaaat

SEQ ID NO: 5289867 - DNA, 13 bp, Homo sapiens
atttcaactccag

SEQ ID NO: 5289868 - DNA, 17 bp, Homo sapiens
atttcaactgctgtaaa

SEQ ID NO: 5289869 - DNA, 19 bp, Homo sapiens
atttcaactgctgtaaaat

SEQ ID NO: 5289870 - DNA, 19 bp, Homo sapiens
atttcaagaaaaaataaat

SEQ ID NO: 5289871 - DNA, 22 bp, Homo sapiens
atttcaagaaaaaataaatgga

SEQ ID NO: 5289872 - DNA, 23 bp, Homo sapiens
atttcaagaagtcccctctcctc

SEQ ID NO: 5289873 - DNA, 16 bp, Homo sapiens
atttcaagaatgtttc

SEQ ID NO: 5289874 - DNA, 17 bp, Homo sapiens
atttcaagaatgtttca

SEQ ID NO: 5289875 - DNA, 20 bp, Homo sapiens
atttcaagaatgtttcagtt

SEQ ID NO: 5289876 - DNA, 17 bp, Homo sapiens
atttcaagacagattgt

SEQ ID NO: 5289877 - DNA, 21 bp, Homo sapiens
atttcaagacattaaatctat

SEQ ID NO: 5289878 - DNA, 15 bp, Homo sapiens
atttcaagaccttct

SEQ ID NO: 5289879 - DNA, 15 bp, Homo sapiens
atttcaagagattta

SEQ ID NO: 5289880 - DNA, 19 bp, Homo sapiens
atttcaagagatttaatta

SEQ ID NO: 5289881 - DNA, 14 bp, Homo sapiens
atttcaagatccaa

SEQ ID NO: 5289882 - DNA, 15 bp, Homo sapiens
atttcaagctcatgt

SEQ ID NO: 5289883 - DNA, 17 bp, Homo sapiens
atttcaagctcatgtca

SEQ ID NO: 5289884 - DNA, 12 bp, Homo sapiens
atttcaagctct

SEQ ID NO: 5289885 - DNA, 19 bp, Homo sapiens
atttcaaggaatggaatct

SEQ ID NO: 5289886 - DNA, 17 bp, Homo sapiens
atttcaaggtccgagct

SEQ ID NO: 5289887 - DNA, 13 bp, Homo sapiens
atttcaaggttct

SEQ ID NO: 5289888 - DNA, 14 bp, Homo sapiens
atttcaaggttcta

SEQ ID NO: 5289889 - DNA, 12 bp, Homo sapiens
atttcaagtgcc

SEQ ID NO: 5289890 - DNA, 13 bp, Homo sapiens
atttcaagtgcct

SEQ ID NO: 5289891 - DNA, 16 bp, Homo sapiens
atttcaagtgcctaga

SEQ ID NO: 5289892 - DNA, 23 bp, Homo sapiens
atttcaagtgcctagactgttac

SEQ ID NO: 5289893 - DNA, 14 bp, Homo sapiens
atttcaagtttact

SEQ ID NO: 5289894 - DNA, 15 bp, Homo sapiens
atttcaatacactca

SEQ ID NO: 5289895 - DNA, 21 bp, Homo sapiens
atttcaatagtacccaaccaa

SEQ ID NO: 5289896 - DNA, 15 bp, Homo sapiens
atttcaatcaaccaa

SEQ ID NO: 5289897 - DNA, 17 bp, Homo sapiens
atttcaatcaaccaaag

SEQ ID NO: 5289898 - DNA, 18 bp, Homo sapiens
atttcaatcaaccaaagt

SEQ ID NO: 5289899 - DNA, 14 bp, Homo sapiens
atttcaatcactga

SEQ ID NO: 5289900 - DNA, 14 bp, Homo sapiens
atttcaatcattga

SEQ ID NO: 5289901 - DNA, 14 bp, Homo sapiens
atttcaatccattt

SEQ ID NO: 5289902 - DNA, 13 bp, Homo sapiens
atttcaatctttt

SEQ ID NO: 5289903 - DNA, 16 bp, Homo sapiens
atttcaatgtaattaa

SEQ ID NO: 5289904 - DNA, 22 bp, Homo sapiens
atttcaatgtaattaaactgtt

SEQ ID NO: 5289905 - DNA, 15 bp, Homo sapiens
atttcaatgtccagt

SEQ ID NO: 5289906 - DNA, 15 bp, Homo sapiens
atttcaattgctttg

SEQ ID NO: 5289907 - DNA, 21 bp, Homo sapiens
atttcaatttccaagagctga

SEQ ID NO: 5289908 - DNA, 17 bp, Homo sapiens
atttcaatttgttcagt

SEQ ID NO: 5289909 - DNA, 14 bp, Homo sapiens
atttcacaaatatt

SEQ ID NO: 5289910 - DNA, 10 bp, Homo sapiens
atttcacaag

SEQ ID NO: 5289911 - DNA, 20 bp, Homo sapiens
atttcacacaactgtggata

SEQ ID NO: 5289912 - DNA, 17 bp, Homo sapiens
atttcacagatgctgtg

SEQ ID NO: 5289913 - DNA, 14 bp, Homo sapiens
atttcacaggctaa

SEQ ID NO: 5289914 - DNA, 18 bp, Homo sapiens
atttcacaggctgtaaat

SEQ ID NO: 5289915 - DNA, 15 bp, Homo sapiens
atttcacagtattta

SEQ ID NO: 5289916 - DNA, 17 bp, Homo sapiens
atttcacagtgcccaag

SEQ ID NO: 5289917 - DNA, 15 bp, Homo sapiens
atttcacatgccttg

SEQ ID NO: 5289918 - DNA, 16 bp, Homo sapiens
atttcacatgccttgc

SEQ ID NO: 5289919 - DNA, 13 bp, Homo sapiens
atttcacattaat

SEQ ID NO: 5289920 - DNA, 16 bp, Homo sapiens
atttcacatttctact

SEQ ID NO: 5289921 - DNA, 20 bp, Homo sapiens
atttcacatttttgtaatgc

SEQ ID NO: 5289922 - DNA, 23 bp, Homo sapiens
atttcaccactcaaaggccagac

SEQ ID NO: 5289923 - DNA, 23 bp, Homo sapiens
atttcacccagacagcctgtttc

SEQ ID NO: 5289924 - DNA, 14 bp, Homo sapiens
atttcacctcctta

SEQ ID NO: 5289925 - DNA, 22 bp, Homo sapiens
atttcacctccttagtccccct

SEQ ID NO: 5289926 - DNA, 14 bp, Homo sapiens
atttcacctgtaaa

SEQ ID NO: 5289927 - DNA, 15 bp, Homo sapiens
atttcacctgtaaac

SEQ ID NO: 5289928 - DNA, 15 bp, Homo sapiens
atttcacctgtgaca

SEQ ID NO: 5289929 - DNA, 16 bp, Homo sapiens
atttcacgaactgttc

SEQ ID NO: 5289930 - DNA, 16 bp, Homo sapiens
atttcacggagacagc

SEQ ID NO: 5289931 - DNA, 20 bp, Homo sapiens
atttcactaaaagtctccaa

SEQ ID NO: 5289932 - DNA, 16 bp, Homo sapiens
atttcactaatcatga

SEQ ID NO: 5289933 - DNA, 20 bp, Homo sapiens
atttcactaggactcagaaa

SEQ ID NO: 5289934 - DNA, 21 bp, Homo sapiens
atttcactgacactgcgaact

SEQ ID NO: 5289935 - DNA, 19 bp, Homo sapiens
atttcactggagcacaata

SEQ ID NO: 5289936 - DNA, 14 bp, Homo sapiens
atttcactgtcttt

SEQ ID NO: 5289937 - DNA, 22 bp, Homo sapiens
atttcactgtctttaattctgt

SEQ ID NO: 5289938 - DNA, 12 bp, Homo sapiens
atttcactgtga

SEQ ID NO: 5289939 - DNA, 17 bp, Homo sapiens
atttcacttgaaattaa

SEQ ID NO: 5289940 - DNA, 20 bp, Homo sapiens
atttcactttagaaggttgt

SEQ ID NO: 5289941 - DNA, 18 bp, Homo sapiens
atttcactttagatgctg

SEQ ID NO: 5289942 - DNA, 16 bp, Homo sapiens
atttcacttttgttct

SEQ ID NO: 5289943 - DNA, 18 bp, Homo sapiens
atttcacttttgttctgc

SEQ ID NO: 5289944 - DNA, 22 bp, Homo sapiens
atttcagaaactaagaatcatc

SEQ ID NO: 5289945 - DNA, 21 bp, Homo sapiens
atttcagaaagcctttcattt

SEQ ID NO: 5289946 - DNA, 12 bp, Homo sapiens
atttcagaagtt

SEQ ID NO: 5289947 - DNA, 19 bp, Homo sapiens
atttcagaagttagtttgt

SEQ ID NO: 5289948 - DNA, 20 bp, Homo sapiens
atttcagacctagcagggaa

SEQ ID NO: 5289949 - DNA, 18 bp, Homo sapiens
atttcagactcccattcc

SEQ ID NO: 5289950 - DNA, 23 bp, Homo sapiens
atttcagactcccattcctgaag

SEQ ID NO: 5289951 - DNA, 16 bp, Homo sapiens
atttcagactgcagag

SEQ ID NO: 5289952 - DNA, 19 bp, Homo sapiens
atttcagagagcttcaact

SEQ ID NO: 5289953 - DNA, 15 bp, Homo sapiens
atttcagaggctgca

SEQ ID NO: 5289954 - DNA, 23 bp, Homo sapiens
atttcagagtgactacacacagt

SEQ ID NO: 5289955 - DNA, 23 bp, Homo sapiens
atttcagatgattcaaatatcaa

SEQ ID NO: 5289956 - DNA, 11 bp, Homo sapiens
atttcagattt

SEQ ID NO: 5289957 - DNA, 13 bp, Homo sapiens
atttcagatttta

SEQ ID NO: 5289958 - DNA, 15 bp, Homo sapiens
atttcagattttgat

SEQ ID NO: 5289959 - DNA, 18 bp, Homo sapiens
atttcagattttgataac

SEQ ID NO: 5289960 - DNA, 17 bp, Homo sapiens
atttcagcacatgcact

SEQ ID NO: 5289961 - DNA, 16 bp, Homo sapiens
atttcagcatgtgctt

SEQ ID NO: 5289962 - DNA, 14 bp, Homo sapiens
atttcagccaatct

SEQ ID NO: 5289963 - DNA, 16 bp, Homo sapiens
atttcagccaatctgg

SEQ ID NO: 5289964 - DNA, 15 bp, Homo sapiens
atttcagcctacatt

SEQ ID NO: 5289965 - DNA, 14 bp, Homo sapiens
atttcagcctcctg

SEQ ID NO: 5289966 - DNA, 22 bp, Homo sapiens
atttcagctggagatactgatt

SEQ ID NO: 5289967 - DNA, 18 bp, Homo sapiens
atttcagctgtgagcttt

SEQ ID NO: 5289968 - DNA, 16 bp, Homo sapiens
atttcagcttgaacct

SEQ ID NO: 5289969 - DNA, 22 bp, Homo sapiens
atttcagcttgaacctgcttcc

SEQ ID NO: 5289970 - DNA, 12 bp, Homo sapiens
atttcaggaaaa

SEQ ID NO: 5289971 - DNA, 16 bp, Homo sapiens
atttcaggaatttaaa

SEQ ID NO: 5289972 - DNA, 20 bp, Homo sapiens
atttcaggaatttaatttat

SEQ ID NO: 5289973 - DNA, 12 bp, Homo sapiens
atttcaggactc

SEQ ID NO: 5289974 - DNA, 18 bp, Homo sapiens
atttcaggactctctcca

SEQ ID NO: 5289975 - DNA, 22 bp, Homo sapiens
atttcaggatactctgtcagat

SEQ ID NO: 5289976 - DNA, 14 bp, Homo sapiens
atttcaggattctc

SEQ ID NO: 5289977 - DNA, 19 bp, Homo sapiens
atttcaggcattttgttct

SEQ ID NO: 5289978 - DNA, 18 bp, Homo sapiens
atttcagggaaaacagaa

SEQ ID NO: 5289979 - DNA, 20 bp, Homo sapiens
atttcagggaaattaatcaa

SEQ ID NO: 5289980 - DNA, 19 bp, Homo sapiens
atttcagggagaaactcca

SEQ ID NO: 5289981 - DNA, 23 bp, Homo sapiens
atttcagggagaaactccaaagt

SEQ ID NO: 5289982 - DNA, 22 bp, Homo sapiens
atttcaggggtcgtcaccacct

SEQ ID NO: 5289983 - DNA, 15 bp, Homo sapiens
atttcagggtgcagc

SEQ ID NO: 5289984 - DNA, 20 bp, Homo sapiens
atttcaggttttgtaaagat

SEQ ID NO: 5289985 - DNA, 18 bp, Homo sapiens
atttcagtaagtctcata

SEQ ID NO: 5289986 - DNA, 14 bp, Homo sapiens
atttcagtacttca

SEQ ID NO: 5289987 - DNA, 18 bp, Homo sapiens
atttcagtacttcagcaa

SEQ ID NO: 5289988 - DNA, 22 bp, Homo sapiens
atttcagtagaattttagtcct

SEQ ID NO: 5289989 - DNA, 16 bp, Homo sapiens
atttcagtagtttcta

SEQ ID NO: 5289990 - DNA, 20 bp, Homo sapiens
atttcagtatcatctccatc

SEQ ID NO: 5289991 - DNA, 17 bp, Homo sapiens
atttcagtcaattctga

SEQ ID NO: 5289992 - DNA, 20 bp, Homo sapiens
atttcagtcttggtggttct

SEQ ID NO: 5289993 - DNA, 11 bp, Homo sapiens
atttcagtgac

SEQ ID NO: 5289994 - DNA, 14 bp, Homo sapiens
atttcagtgccaat

SEQ ID NO: 5289995 - DNA, 18 bp, Homo sapiens
atttcagtgggaaatatg

SEQ ID NO: 5289996 - DNA, 23 bp, Homo sapiens
atttcagtgggaaatatgccact

SEQ ID NO: 5289997 - DNA, 16 bp, Homo sapiens
atttcagtgtagttaa

SEQ ID NO: 5289998 - DNA, 21 bp, Homo sapiens
atttcagtgtagttaatttat

SEQ ID NO: 5289999 - DNA, 19 bp, Homo sapiens
atttcagtgttacctgtgt

SEQ ID NO: 5290000 - DNA, 13 bp, Homo sapiens
atttcagttactt

SEQ ID NO: 5290001 - DNA, 22 bp, Homo sapiens
atttcagttattgtccctggct

SEQ ID NO: 5290002 - DNA, 14 bp, Homo sapiens
atttcagttcatca

SEQ ID NO: 5290003 - DNA, 22 bp, Homo sapiens
atttcagttccgtcagaaagtg

SEQ ID NO: 5290004 - DNA, 17 bp, Homo sapiens
atttcagttctaggaaa

SEQ ID NO: 5290005 - DNA, 18 bp, Homo sapiens
atttcagttctaggaaaa

SEQ ID NO: 5290006 - DNA, 13 bp, Homo sapiens
atttcagtttcta

SEQ ID NO: 5290007 - DNA, 15 bp, Homo sapiens
atttcagtttgttta

SEQ ID NO: 5290008 - DNA, 14 bp, Homo sapiens
atttcagtttttca

SEQ ID NO: 5290009 - DNA, 16 bp, Homo sapiens
atttcagtttttcatt

SEQ ID NO: 5290010 - DNA, 15 bp, Homo sapiens
atttcataaattaac

SEQ ID NO: 5290011 - DNA, 18 bp, Homo sapiens
atttcataaattggctcc

SEQ ID NO: 5290012 - DNA, 19 bp, Homo sapiens
atttcataaattggctcct

SEQ ID NO: 5290013 - DNA, 15 bp, Homo sapiens
atttcataagcacat

SEQ ID NO: 5290014 - DNA, 21 bp, Homo sapiens
atttcataaggcctgccctcc

SEQ ID NO: 5290015 - DNA, 15 bp, Homo sapiens
atttcataattgcct

SEQ ID NO: 5290016 - DNA, 21 bp, Homo sapiens
atttcataattgcctacattt

SEQ ID NO: 5290017 - DNA, 18 bp, Homo sapiens
atttcatacaaaactgtt

SEQ ID NO: 5290018 - DNA, 21 bp, Homo sapiens
atttcatacaaaactgttcac

SEQ ID NO: 5290019 - DNA, 13 bp, Homo sapiens
atttcatacaaat

SEQ ID NO: 5290020 - DNA, 19 bp, Homo sapiens
atttcatactgaaattatt

SEQ ID NO: 5290021 - DNA, 22 bp, Homo sapiens
atttcatagctatttagagata

SEQ ID NO: 5290022 - DNA, 15 bp, Homo sapiens
atttcatagttcaga

SEQ ID NO: 5290023 - DNA, 13 bp, Homo sapiens
caaccttcattta

SEQ ID NO: 5290024 - DNA, 16 bp, Homo sapiens
caaccttccaagtgta

SEQ ID NO: 5290025 - DNA, 19 bp, Homo sapiens
caaccttcggagtagctgg

SEQ ID NO: 5290026 - DNA, 18 bp, Homo sapiens
caaccttcggctccgggc

SEQ ID NO: 5290027 - DNA, 19 bp, Homo sapiens
caaccttctgtggctcaca

SEQ ID NO: 5290028 - DNA, 18 bp, Homo sapiens
caaccttgctcttgggga

SEQ ID NO: 5290029 - DNA, 13 bp, Homo sapiens
caaccttggcctt

SEQ ID NO: 5290030 - DNA, 17 bp, Homo sapiens
caaccttggccttctcc

SEQ ID NO: 5290031 - DNA, 22 bp, Homo sapiens
caaccttggcttggccctggca

SEQ ID NO: 5290032 - DNA, 17 bp, Homo sapiens
caaccttgtactttaca

SEQ ID NO: 5290033 - DNA, 16 bp, Homo sapiens
caaccttgtcagtttt

SEQ ID NO: 5290034 - DNA, 19 bp, Homo sapiens
caacctttccctcaccccc

SEQ ID NO: 5290035 - DNA, 19 bp, Homo sapiens
caacctttgtaagaaaacc

SEQ ID NO: 5290036 - DNA, 21 bp, Homo sapiens
caacctttgtaagaaaaccaa

SEQ ID NO: 5290037 - DNA, 11 bp, Homo sapiens
caacctttgtg

SEQ ID NO: 5290038 - DNA, 18 bp, Homo sapiens
caacctttgtgtaataaa

SEQ ID NO: 5290039 - DNA, 16 bp, Homo sapiens
caacctttttccctct

SEQ ID NO: 5290040 - DNA, 18 bp, Homo sapiens
caacgaaaagcacatcca

SEQ ID NO: 5290041 - DNA, 20 bp, Homo sapiens
caacgaagaaaaaaaataac

SEQ ID NO: 5290042 - DNA, 17 bp, Homo sapiens
caacgactactttgcta

SEQ ID NO: 5290043 - DNA, 17 bp, Homo sapiens
caacgagacacattgcc

SEQ ID NO: 5290044 - DNA, 19 bp, Homo sapiens
caacgagacacattgcctt

SEQ ID NO: 5290045 - DNA, 21 bp, Homo sapiens
caacgagacacattgccttct

SEQ ID NO: 5290046 - DNA, 13 bp, Homo sapiens
caacgagcctcct

SEQ ID NO: 5290047 - DNA, 20 bp, Homo sapiens
caacgagcctcctcaggggg

SEQ ID NO: 5290048 - DNA, 16 bp, Homo sapiens
caacgattcacagcct

SEQ ID NO: 5290049 - DNA, 20 bp, Homo sapiens
caacgattgtatttgtgact

SEQ ID NO: 5290050 - DNA, 18 bp, Homo sapiens
caacgcaaacctctcctt

SEQ ID NO: 5290051 - DNA, 12 bp, Homo sapiens
caacgcagccct

SEQ ID NO: 5290052 - DNA, 18 bp, Homo sapiens
caacgcagccctgctttg

SEQ ID NO: 5290053 - DNA, 21 bp, Homo sapiens
caacgcaggaggagaaaagaa

SEQ ID NO: 5290054 - DNA, 24 bp, Homo sapiens
caacgccaggaatcatgaagagac

SEQ ID NO: 5290055 - DNA, 17 bp, Homo sapiens
caacgcccctccaaacc

SEQ ID NO: 5290056 - DNA, 12 bp, Homo sapiens
caacgcccctgt

SEQ ID NO: 5290057 - DNA, 14 bp, Homo sapiens
caacgcccctgtgg

SEQ ID NO: 5290058 - DNA, 15 bp, Homo sapiens
caacgcccctgtggc

SEQ ID NO: 5290059 - DNA, 22 bp, Homo sapiens
caacgcccctgtggccaactgc

SEQ ID NO: 5290060 - DNA, 18 bp, Homo sapiens
caacgccgagtgcactgc

SEQ ID NO: 5290061 - DNA, 21 bp, Homo sapiens
caacgccgccttggccttgca

SEQ ID NO: 5290062 - DNA, 16 bp, Homo sapiens
caacgcctgccttctg

SEQ ID NO: 5290063 - DNA, 22 bp, Homo sapiens
caacgctgaagcggtcagactg

SEQ ID NO: 5290064 - DNA, 23 bp, Homo sapiens
caacgctgaagcggtcagactgg

SEQ ID NO: 5290065 - DNA, 20 bp, Homo sapiens
caacgctgattcctaaggcc

SEQ ID NO: 5290066 - DNA, 13 bp, Homo sapiens
caacggagtcaaa

SEQ ID NO: 5290067 - DNA, 14 bp, Homo sapiens
caacggcagtgaag

SEQ ID NO: 5290068 - DNA, 21 bp, Homo sapiens
caacggcccatagccttgggg

SEQ ID NO: 5290069 - DNA, 13 bp, Homo sapiens
caacgggagcgag

SEQ ID NO: 5290070 - DNA, 23 bp, Homo sapiens
caacgggattgaagggtcctgcc

SEQ ID NO: 5290071 - DNA, 15 bp, Homo sapiens
caacggggggctcct

SEQ ID NO: 5290072 - DNA, 16 bp, Homo sapiens
caacggggtggggagg

SEQ ID NO: 5290073 - DNA, 20 bp, Homo sapiens
caacggggtggggagggtga

SEQ ID NO: 5290074 - DNA, 21 bp, Homo sapiens
caacggtctggcagggcagca

SEQ ID NO: 5290075 - DNA, 19 bp, Homo sapiens
caacgtaaattattacata

SEQ ID NO: 5290076 - DNA, 14 bp, Homo sapiens
caacgtagcctggg

SEQ ID NO: 5290077 - DNA, 15 bp, Homo sapiens
caacgtagcctgggc

SEQ ID NO: 5290078 - DNA, 15 bp, Homo sapiens
caacgtagcttctac

SEQ ID NO: 5290079 - DNA, 16 bp, Homo sapiens
caacgtcccctcaagc

SEQ ID NO: 5290080 - DNA, 13 bp, Homo sapiens
caacgtcccctcc

SEQ ID NO: 5290081 - DNA, 13 bp, Homo sapiens
caacgtctgtgcc

SEQ ID NO: 5290082 - DNA, 12 bp, Homo sapiens
caacgtcttgct

SEQ ID NO: 5290083 - DNA, 12 bp, Homo sapiens
caacgtcttttt

SEQ ID NO: 5290084 - DNA, 17 bp, Homo sapiens
caacgtgagagaaagag

SEQ ID NO: 5290085 - DNA, 18 bp, Homo sapiens
caacgtgagagaaagaga

SEQ ID NO: 5290086 - DNA, 20 bp, Homo sapiens
caacgtgagagaaagagaga

SEQ ID NO: 5290087 - DNA, 21 bp, Homo sapiens
caacgtgagagaaagagagaa

SEQ ID NO: 5290088 - DNA, 22 bp, Homo sapiens
caacgtgagagaaagagagaag

SEQ ID NO: 5290089 - DNA, 14 bp, Homo sapiens
caacgtgcaaagcc

SEQ ID NO: 5290090 - DNA, 16 bp, Homo sapiens
caacgtgcaaagccaa

SEQ ID NO: 5290091 - DNA, 18 bp, Homo sapiens
caacgtgcaaagccaagg

SEQ ID NO: 5290092 - DNA, 20 bp, Homo sapiens
caacgtgcaaagccaaggca

SEQ ID NO: 5290093 - DNA, 13 bp, Homo sapiens
caacgtgcattgt

SEQ ID NO: 5290094 - DNA, 16 bp, Homo sapiens
caacgtgcattgtgct

SEQ ID NO: 5290095 - DNA, 23 bp, Homo sapiens
caacgtgcgtgtctctgccatgt

SEQ ID NO: 5290096 - DNA, 18 bp, Homo sapiens
caacgtgctctttgtttt

SEQ ID NO: 5290097 - DNA, 16 bp, Homo sapiens
caacgtggacctgcct

SEQ ID NO: 5290098 - DNA, 17 bp, Homo sapiens
caacgtggcccagagaa

SEQ ID NO: 5290099 - DNA, 19 bp, Homo sapiens
caacgtgggcttaaagcag

SEQ ID NO: 5290100 - DNA, 12 bp, Homo sapiens
caacgtggggca

SEQ ID NO: 5290101 - DNA, 16 bp, Homo sapiens
caacgttactcagggc

SEQ ID NO: 5290102 - DNA, 17 bp, Homo sapiens
caacgttactcagggct

SEQ ID NO: 5290103 - DNA, 17 bp, Homo sapiens
caacgttcgatttctac

SEQ ID NO: 5290104 - DNA, 21 bp, Homo sapiens
caacgttcgatttctacctca

SEQ ID NO: 5290105 - DNA, 22 bp, Homo sapiens
caacgttcgatttctacctcag

SEQ ID NO: 5290106 - DNA, 13 bp, Homo sapiens
caacgttgctatt

SEQ ID NO: 5290107 - DNA, 18 bp, Homo sapiens
caacgttggtatgataat

SEQ ID NO: 5290108 - DNA, 23 bp, Homo sapiens
caacgtttacaccgactagccag

SEQ ID NO: 5290109 - DNA, 13 bp, Homo sapiens
caactaaaaataa

SEQ ID NO: 5290110 - DNA, 22 bp, Homo sapiens
caactaaaacccccaataaacc

SEQ ID NO: 5290111 - DNA, 22 bp, Homo sapiens
caactaaaagtggcatagagaa

SEQ ID NO: 5290112 - DNA, 15 bp, Homo sapiens
caactaaaattagga

SEQ ID NO: 5290113 - DNA, 19 bp, Homo sapiens
caactaaaatttgaagtag

SEQ ID NO: 5290114 - DNA, 18 bp, Homo sapiens
caactaaataaaaaattc

SEQ ID NO: 5290115 - DNA, 22 bp, Homo sapiens
caactaaataaaaaattcaaac

SEQ ID NO: 5290116 - DNA, 14 bp, Homo sapiens
caactaaataacac

SEQ ID NO: 5290117 - DNA, 17 bp, Homo sapiens
caactaacaatgccttg

SEQ ID NO: 5290118 - DNA, 18 bp, Homo sapiens
caactaacagtcaagaaa

SEQ ID NO: 5290119 - DNA, 15 bp, Homo sapiens
caactaactaaccac

SEQ ID NO: 5290120 - DNA, 18 bp, Homo sapiens
caactaactaaccacatt

SEQ ID NO: 5290121 - DNA, 23 bp, Homo sapiens
caactaactgtttacatatctgt

SEQ ID NO: 5290122 - DNA, 13 bp, Homo sapiens
caactaagccctc

SEQ ID NO: 5290123 - DNA, 20 bp, Homo sapiens
caactaaggacaaattagca

SEQ ID NO: 5290124 - DNA, 15 bp, Homo sapiens
caactaagttgtatt

SEQ ID NO: 5290125 - DNA, 16 bp, Homo sapiens
caactaagttgtattt

SEQ ID NO: 5290126 - DNA, 22 bp, Homo sapiens
caactaattttaaagtaaaagg

SEQ ID NO: 5290127 - DNA, 17 bp, Homo sapiens
caactaattttatttct

SEQ ID NO: 5290128 - DNA, 15 bp, Homo sapiens
caactaattttctcc

SEQ ID NO: 5290129 - DNA, 14 bp, Homo sapiens
caactaatttttga

SEQ ID NO: 5290130 - DNA, 18 bp, Homo sapiens
caactaatttttgtattt

SEQ ID NO: 5290131 - DNA, 21 bp, Homo sapiens
caactacccaaaacaagcctg

SEQ ID NO: 5290132 - DNA, 19 bp, Homo sapiens
caactacccccagctgtgc

SEQ ID NO: 5290133 - DNA, 11 bp, Homo sapiens
caactacctga

SEQ ID NO: 5290134 - DNA, 11 bp, Homo sapiens
caactactaaa

SEQ ID NO: 5290135 - DNA, 21 bp, Homo sapiens
caactactaatagaataaagg

SEQ ID NO: 5290136 - DNA, 18 bp, Homo sapiens
caactactagtgtgactc

SEQ ID NO: 5290137 - DNA, 20 bp, Homo sapiens
caactactatctcagagata

SEQ ID NO: 5290138 - DNA, 20 bp, Homo sapiens
caactactcagaaggccgag

SEQ ID NO: 5290139 - DNA, 16 bp, Homo sapiens
caactagaagcctagt

SEQ ID NO: 5290140 - DNA, 15 bp, Homo sapiens
caactagacattctg

SEQ ID NO: 5290141 - DNA, 15 bp, Homo sapiens
caactagccaaggct

SEQ ID NO: 5290142 - DNA, 16 bp, Homo sapiens
caactaggacctcata

SEQ ID NO: 5290143 - DNA, 14 bp, Homo sapiens
caactaggggagga

SEQ ID NO: 5290144 - DNA, 17 bp, Homo sapiens
caactagtaaaatgctg

SEQ ID NO: 5290145 - DNA, 15 bp, Homo sapiens
caactagtggagaga

SEQ ID NO: 5290146 - DNA, 16 bp, Homo sapiens
caactagtggagagaa

SEQ ID NO: 5290147 - DNA, 14 bp, Homo sapiens
caactatattgcga

SEQ ID NO: 5290148 - DNA, 19 bp, Homo sapiens
caactatattgtttgctaa

SEQ ID NO: 5290149 - DNA, 19 bp, Homo sapiens
caactatcctgacttctaa

SEQ ID NO: 5290150 - DNA, 18 bp, Homo sapiens
caactatgatttggaaaa

SEQ ID NO: 5290151 - DNA, 14 bp, Homo sapiens
caactatggctgtt

SEQ ID NO: 5290152 - DNA, 12 bp, Homo sapiens
caactatgtagg

SEQ ID NO: 5290153 - DNA, 17 bp, Homo sapiens
caactattaaagtgcca

SEQ ID NO: 5290154 - DNA, 18 bp, Homo sapiens
caactattatgattattt

SEQ ID NO: 5290155 - DNA, 13 bp, Homo sapiens
caactattcttca

SEQ ID NO: 5290156 - DNA, 13 bp, Homo sapiens
caactatttataa

SEQ ID NO: 5290157 - DNA, 21 bp, Homo sapiens
caactattttattatcctaga

SEQ ID NO: 5290158 - DNA, 17 bp, Homo sapiens
caactattttcagatgt

SEQ ID NO: 5290159 - DNA, 13 bp, Homo sapiens
caactatttttgt

SEQ ID NO: 5290160 - DNA, 18 bp, Homo sapiens
caactcaaaaaacattgt

SEQ ID NO: 5290161 - DNA, 19 bp, Homo sapiens
caactcaagtgtcacctcc

SEQ ID NO: 5290162 - DNA, 20 bp, Homo sapiens
caactcaagtgtcacctcct

SEQ ID NO: 5290163 - DNA, 23 bp, Homo sapiens
caactcaagtgtcacctccttcc

SEQ ID NO: 5290164 - DNA, 15 bp, Homo sapiens
caactcacacctcct

SEQ ID NO: 5290165 - DNA, 22 bp, Homo sapiens
caactcacacctccttttcttc

SEQ ID NO: 5290166 - DNA, 15 bp, Homo sapiens
caactcacagcttct

SEQ ID NO: 5290167 - DNA, 13 bp, Homo sapiens
caactcaccccag

SEQ ID NO: 5290168 - DNA, 18 bp, Homo sapiens
caactcaccccagcccca

SEQ ID NO: 5290169 - DNA, 14 bp, Homo sapiens
caactcactgtgct

SEQ ID NO: 5290170 - DNA, 19 bp, Homo sapiens
caactcagaatgggggctt

SEQ ID NO: 5290171 - DNA, 13 bp, Homo sapiens
caactcagcctgt

SEQ ID NO: 5290172 - DNA, 14 bp, Homo sapiens
caactcagcctgtt

SEQ ID NO: 5290173 - DNA, 22 bp, Homo sapiens
caactcagcctgttccttcctg

SEQ ID NO: 5290174 - DNA, 13 bp, Homo sapiens
caactcagtctgt

SEQ ID NO: 5290175 - DNA, 17 bp, Homo sapiens
caactcatattttcatg

SEQ ID NO: 5290176 - DNA, 14 bp, Homo sapiens
caactcattccaga

SEQ ID NO: 5290177 - DNA, 15 bp, Homo sapiens
caactcattccagat

SEQ ID NO: 5290178 - DNA, 14 bp, Homo sapiens
caactcattgcatc

SEQ ID NO: 5290179 - DNA, 17 bp, Homo sapiens
caactccaacatccact

SEQ ID NO: 5290180 - DNA, 11 bp, Homo sapiens
caactccaagg

SEQ ID NO: 5290181 - DNA, 14 bp, Homo sapiens
caactccaaggcaa

SEQ ID NO: 5290182 - DNA, 15 bp, Homo sapiens
caactccaaggcaaa

SEQ ID NO: 5290183 - DNA, 20 bp, Homo sapiens
caactccaaggcaaatgtcc

SEQ ID NO: 5290184 - DNA, 17 bp, Homo sapiens
caactccaccctctgcg

SEQ ID NO: 5290185 - DNA, 12 bp, Homo sapiens
caactccagaaa

SEQ ID NO: 5290186 - DNA, 20 bp, Homo sapiens
caactccagcaacttcttct

SEQ ID NO: 5290187 - DNA, 20 bp, Homo sapiens
caactccagccacccagcca

SEQ ID NO: 5290188 - DNA, 23 bp, Homo sapiens
caactccagccacccagccagga

SEQ ID NO: 5290189 - DNA, 18 bp, Homo sapiens
caactccagcgtcctcag

SEQ ID NO: 5290190 - DNA, 14 bp, Homo sapiens
caactccagctccc

SEQ ID NO: 5290191 - DNA, 21 bp, Homo sapiens
caactccagctgagtcctggg

SEQ ID NO: 5290192 - DNA, 22 bp, Homo sapiens
caactccagctgagtcctgggg

SEQ ID NO: 5290193 - DNA, 19 bp, Homo sapiens
caactccaggaaagagcag

SEQ ID NO: 5290194 - DNA, 18 bp, Homo sapiens
caactccaggacttgctt

SEQ ID NO: 5290195 - DNA, 18 bp, Homo sapiens
caactccatactccactc

SEQ ID NO: 5290196 - DNA, 15 bp, Homo sapiens
caactccatgaccag

SEQ ID NO: 5290197 - DNA, 17 bp, Homo sapiens
caactccatgaccaggc

SEQ ID NO: 5290198 - DNA, 21 bp, Homo sapiens
caactccatggggttcgagac

SEQ ID NO: 5290199 - DNA, 22 bp, Homo sapiens
caactccatggggttcgagact

SEQ ID NO: 5290200 - DNA, 14 bp, Homo sapiens
caactcccagccac

SEQ ID NO: 5290201 - DNA, 15 bp, Homo sapiens
caactcccagccacc

SEQ ID NO: 5290202 - DNA, 21 bp, Homo sapiens
caactcccagccaccaccact

SEQ ID NO: 5290203 - DNA, 17 bp, Homo sapiens
atttcatatactataat

SEQ ID NO: 5290204 - DNA, 19 bp, Homo sapiens
atttcatatactataattg

SEQ ID NO: 5290205 - DNA, 17 bp, Homo sapiens
atttcatatatctatat

SEQ ID NO: 5290206 - DNA, 19 bp, Homo sapiens
atttcatatctaactttgt

SEQ ID NO: 5290207 - DNA, 20 bp, Homo sapiens
atttcatatctaactttgta

SEQ ID NO: 5290208 - DNA, 18 bp, Homo sapiens
atttcatatctacagata

SEQ ID NO: 5290209 - DNA, 19 bp, Homo sapiens
atttcatattattttagtg

SEQ ID NO: 5290210 - DNA, 12 bp, Homo sapiens
atttcatattga

SEQ ID NO: 5290211 - DNA, 14 bp, Homo sapiens
atttcatcaagatt

SEQ ID NO: 5290212 - DNA, 15 bp, Homo sapiens
atttcatcaagatta

SEQ ID NO: 5290213 - DNA, 19 bp, Homo sapiens
atttcatcacaagaacaca

SEQ ID NO: 5290214 - DNA, 17 bp, Homo sapiens
atttcatcattgtttct

SEQ ID NO: 5290215 - DNA, 18 bp, Homo sapiens
atttcatccctatttata

SEQ ID NO: 5290216 - DNA, 14 bp, Homo sapiens
atttcatctatttc

SEQ ID NO: 5290217 - DNA, 15 bp, Homo sapiens
atttcatctatttct

SEQ ID NO: 5290218 - DNA, 16 bp, Homo sapiens
atttcatctatttctg

SEQ ID NO: 5290219 - DNA, 18 bp, Homo sapiens
atttcatctatttctgag

SEQ ID NO: 5290220 - DNA, 20 bp, Homo sapiens
atttcatctatttctgagaa

SEQ ID NO: 5290221 - DNA, 22 bp, Homo sapiens
atttcatctcatttaagggaaa

SEQ ID NO: 5290222 - DNA, 11 bp, Homo sapiens
atttcatctgc

SEQ ID NO: 5290223 - DNA, 22 bp, Homo sapiens
atttcatcttgcaaatgttgta

SEQ ID NO: 5290224 - DNA, 14 bp, Homo sapiens
atttcatgaaaaag

SEQ ID NO: 5290225 - DNA, 19 bp, Homo sapiens
atttcatgaaaaagctgct

SEQ ID NO: 5290226 - DNA, 17 bp, Homo sapiens
atttcatgaaaactttt

SEQ ID NO: 5290227 - DNA, 14 bp, Homo sapiens
atttcatgaaaatt

SEQ ID NO: 5290228 - DNA, 15 bp, Homo sapiens
atttcatgactggtg

SEQ ID NO: 5290229 - DNA, 15 bp, Homo sapiens
atttcatgattagaa

SEQ ID NO: 5290230 - DNA, 16 bp, Homo sapiens
atttcatgattagaca

SEQ ID NO: 5290231 - DNA, 20 bp, Homo sapiens
atttcatgattcaacctgat

SEQ ID NO: 5290232 - DNA, 17 bp, Homo sapiens
atttcatgattggctta

SEQ ID NO: 5290233 - DNA, 14 bp, Homo sapiens
atttcatgcacaca

SEQ ID NO: 5290234 - DNA, 12 bp, Homo sapiens
atttcatgcatt

SEQ ID NO: 5290235 - DNA, 17 bp, Homo sapiens
atttcatgctctgcaaa

SEQ ID NO: 5290236 - DNA, 17 bp, Homo sapiens
atttcatggattattta

SEQ ID NO: 5290237 - DNA, 23 bp, Homo sapiens
atttcatggggtttggttgtgct

SEQ ID NO: 5290238 - DNA, 14 bp, Homo sapiens
atttcatgtaacca

SEQ ID NO: 5290239 - DNA, 20 bp, Homo sapiens
atttcatgtactgcattatt

SEQ ID NO: 5290240 - DNA, 19 bp, Homo sapiens
atttcatgtagtaagattt

SEQ ID NO: 5290241 - DNA, 20 bp, Homo sapiens
atttcatgtagtaagatttg

SEQ ID NO: 5290242 - DNA, 16 bp, Homo sapiens
atttcatgtatttctt

SEQ ID NO: 5290243 - DNA, 20 bp, Homo sapiens
atttcatgtatttctttaga

SEQ ID NO: 5290244 - DNA, 18 bp, Homo sapiens
atttcatgtcctgtgtca

SEQ ID NO: 5290245 - DNA, 13 bp, Homo sapiens
atttcatgtgatc

SEQ ID NO: 5290246 - DNA, 16 bp, Homo sapiens
atttcattatttttca

SEQ ID NO: 5290247 - DNA, 20 bp, Homo sapiens
atttcattcaaatcagtgat

SEQ ID NO: 5290248 - DNA, 11 bp, Homo sapiens
atttcattcca

SEQ ID NO: 5290249 - DNA, 13 bp, Homo sapiens
atttcattccatt

SEQ ID NO: 5290250 - DNA, 21 bp, Homo sapiens
atttcattcgggccccacctg

SEQ ID NO: 5290251 - DNA, 14 bp, Homo sapiens
atttcattcttctc

SEQ ID NO: 5290252 - DNA, 15 bp, Homo sapiens
atttcattgactgaa

SEQ ID NO: 5290253 - DNA, 18 bp, Homo sapiens
atttcattgactgaactg

SEQ ID NO: 5290254 - DNA, 19 bp, Homo sapiens
atttcattgactgaactgc

SEQ ID NO: 5290255 - DNA, 12 bp, Homo sapiens
atttcattgcac

SEQ ID NO: 5290256 - DNA, 15 bp, Homo sapiens
atttcattgcacttt

SEQ ID NO: 5290257 - DNA, 14 bp, Homo sapiens
atttcattgcctgt

SEQ ID NO: 5290258 - DNA, 17 bp, Homo sapiens
atttcattgcctgtgta

SEQ ID NO: 5290259 - DNA, 20 bp, Homo sapiens
atttcattgtacaagtatta

SEQ ID NO: 5290260 - DNA, 15 bp, Homo sapiens
atttcattgtatgat

SEQ ID NO: 5290261 - DNA, 20 bp, Homo sapiens
atttcattgtatgatgtgtt

SEQ ID NO: 5290262 - DNA, 16 bp, Homo sapiens
atttcatttaaatatc

SEQ ID NO: 5290263 - DNA, 16 bp, Homo sapiens
atttcatttatactgt

SEQ ID NO: 5290264 - DNA, 17 bp, Homo sapiens
atttcatttatactgta

SEQ ID NO: 5290265 - DNA, 20 bp, Homo sapiens
atttcatttatactgtagca

SEQ ID NO: 5290266 - DNA, 21 bp, Homo sapiens
atttcatttccaactcaggtt

SEQ ID NO: 5290267 - DNA, 23 bp, Homo sapiens
atttcatttccaactcaggttaa

SEQ ID NO: 5290268 - DNA, 19 bp, Homo sapiens
atttcatttttacccttac

SEQ ID NO: 5290269 - DNA, 22 bp, Homo sapiens
atttcattttttgcatcagtat

SEQ ID NO: 5290270 - DNA, 17 bp, Homo sapiens
atttccaaaataatcta

SEQ ID NO: 5290271 - DNA, 21 bp, Homo sapiens
atttccaaacctggttcatat

SEQ ID NO: 5290272 - DNA, 19 bp, Homo sapiens
atttccaacaccacagaca

SEQ ID NO: 5290273 - DNA, 16 bp, Homo sapiens
atttccaactcaggtt

SEQ ID NO: 5290274 - DNA, 19 bp, Homo sapiens
atttccaactcgaatctgt

SEQ ID NO: 5290275 - DNA, 15 bp, Homo sapiens
atttccaagaggctg

SEQ ID NO: 5290276 - DNA, 12 bp, Homo sapiens
atttccaagctg

SEQ ID NO: 5290277 - DNA, 21 bp, Homo sapiens
atttccaagctgttagttgct

SEQ ID NO: 5290278 - DNA, 23 bp, Homo sapiens
atttccacaatagggttcaaatt

SEQ ID NO: 5290279 - DNA, 17 bp, Homo sapiens
atttccacaattcttct

SEQ ID NO: 5290280 - DNA, 15 bp, Homo sapiens
atttccacataaagg

SEQ ID NO: 5290281 - DNA, 21 bp, Homo sapiens
atttccacataaaggtattta

SEQ ID NO: 5290282 - DNA, 18 bp, Homo sapiens
atttccaccaggccgtgc

SEQ ID NO: 5290283 - DNA, 21 bp, Homo sapiens
atttccactaaaaatattgtt

SEQ ID NO: 5290284 - DNA, 14 bp, Homo sapiens
atttccactgaaca

SEQ ID NO: 5290285 - DNA, 16 bp, Homo sapiens
atttccactgtaatta

SEQ ID NO: 5290286 - DNA, 19 bp, Homo sapiens
atttccagaaggatttctt

SEQ ID NO: 5290287 - DNA, 20 bp, Homo sapiens
atttccagaaggatttcttg

SEQ ID NO: 5290288 - DNA, 22 bp, Homo sapiens
atttccagaaggatttcttgta

SEQ ID NO: 5290289 - DNA, 14 bp, Homo sapiens
atttccagacaaat

SEQ ID NO: 5290290 - DNA, 11 bp, Homo sapiens
atttccagacc

SEQ ID NO: 5290291 - DNA, 13 bp, Homo sapiens
atttccagcaaaa

SEQ ID NO: 5290292 - DNA, 17 bp, Homo sapiens
atttccagcaaaatata

SEQ ID NO: 5290293 - DNA, 17 bp, Homo sapiens
atttccagccagggctg

SEQ ID NO: 5290294 - DNA, 18 bp, Homo sapiens
atttccagccagggctgc

SEQ ID NO: 5290295 - DNA, 22 bp, Homo sapiens
atttccagctttctccccgcta

SEQ ID NO: 5290296 - DNA, 22 bp, Homo sapiens
atttccaggaaaaaataaaaag

SEQ ID NO: 5290297 - DNA, 11 bp, Homo sapiens
atttccaggcc

SEQ ID NO: 5290298 - DNA, 13 bp, Homo sapiens
atttccaggcccc

SEQ ID NO: 5290299 - DNA, 15 bp, Homo sapiens
atttccaggcccctg

SEQ ID NO: 5290300 - DNA, 15 bp, Homo sapiens
atttccagtgagtgt

SEQ ID NO: 5290301 - DNA, 11 bp, Homo sapiens
atttccagtgg

SEQ ID NO: 5290302 - DNA, 12 bp, Homo sapiens
atttccatatcc

SEQ ID NO: 5290303 - DNA, 14 bp, Homo sapiens
atttccatattaaa

SEQ ID NO: 5290304 - DNA, 17 bp, Homo sapiens
atttccatgggccccac

SEQ ID NO: 5290305 - DNA, 14 bp, Homo sapiens
atttccatgtatgc

SEQ ID NO: 5290306 - DNA, 15 bp, Homo sapiens
atttccatgtatgca

SEQ ID NO: 5290307 - DNA, 17 bp, Homo sapiens
atttccattatttatat

SEQ ID NO: 5290308 - DNA, 22 bp, Homo sapiens
atttccattcatggatatttgt

SEQ ID NO: 5290309 - DNA, 22 bp, Homo sapiens
atttccattcttttaaatgggt

SEQ ID NO: 5290310 - DNA, 13 bp, Homo sapiens
atttccattgctt

SEQ ID NO: 5290311 - DNA, 19 bp, Homo sapiens
atttccattgtgtggcctg

SEQ ID NO: 5290312 - DNA, 18 bp, Homo sapiens
atttccatttacttaaga

SEQ ID NO: 5290313 - DNA, 19 bp, Homo sapiens
atttccatttacttaagac

SEQ ID NO: 5290314 - DNA, 22 bp, Homo sapiens
atttccatttacttaagactta

SEQ ID NO: 5290315 - DNA, 14 bp, Homo sapiens
atttccatttctct

SEQ ID NO: 5290316 - DNA, 12 bp, Homo sapiens
atttccatttgt

SEQ ID NO: 5290317 - DNA, 19 bp, Homo sapiens
atttcccaagtcagacaga

SEQ ID NO: 5290318 - DNA, 23 bp, Homo sapiens
atttcccacaccgtgtaaaccaa

SEQ ID NO: 5290319 - DNA, 12 bp, Homo sapiens
atttcccacccc

SEQ ID NO: 5290320 - DNA, 21 bp, Homo sapiens
atttcccactgcactccagcc

SEQ ID NO: 5290321 - DNA, 20 bp, Homo sapiens
atttcccacttccacccccg

SEQ ID NO: 5290322 - DNA, 12 bp, Homo sapiens
atttcccaggac

SEQ ID NO: 5290323 - DNA, 16 bp, Homo sapiens
atttcccaggaccctg

SEQ ID NO: 5290324 - DNA, 21 bp, Homo sapiens
atttcccatcccctgtgggaa

SEQ ID NO: 5290325 - DNA, 18 bp, Homo sapiens
atttccccaacagtgtga

SEQ ID NO: 5290326 - DNA, 17 bp, Homo sapiens
atttccccaccccagct

SEQ ID NO: 5290327 - DNA, 15 bp, Homo sapiens
atttccccagggcac

SEQ ID NO: 5290328 - DNA, 21 bp, Homo sapiens
atttccccaggggaaaatgaa

SEQ ID NO: 5290329 - DNA, 23 bp, Homo sapiens
atttcccccctccgcctccagga

SEQ ID NO: 5290330 - DNA, 14 bp, Homo sapiens
atttccccctcctc

SEQ ID NO: 5290331 - DNA, 14 bp, Homo sapiens
atttccccctttct

SEQ ID NO: 5290332 - DNA, 15 bp, Homo sapiens
atttcccctcccgct

SEQ ID NO: 5290333 - DNA, 22 bp, Homo sapiens
atttcccctcccgtcttcctcc

SEQ ID NO: 5290334 - DNA, 23 bp, Homo sapiens
atttcccctcccgtcttcctcct

SEQ ID NO: 5290335 - DNA, 15 bp, Homo sapiens
atttcccctccttcc

SEQ ID NO: 5290336 - DNA, 14 bp, Homo sapiens
atttccccttggac

SEQ ID NO: 5290337 - DNA, 21 bp, Homo sapiens
atttccccttttgcattctcc

SEQ ID NO: 5290338 - DNA, 22 bp, Homo sapiens
atttccccttttgcattctccc

SEQ ID NO: 5290339 - DNA, 14 bp, Homo sapiens
atttcccgcacatg

SEQ ID NO: 5290340 - DNA, 18 bp, Homo sapiens
atttcccgtggccccagc

SEQ ID NO: 5290341 - DNA, 20 bp, Homo sapiens
atttcccgtggccccagcct

SEQ ID NO: 5290342 - DNA, 21 bp, Homo sapiens
atttcccgtggccccagcctg

SEQ ID NO: 5290343 - DNA, 22 bp, Homo sapiens
atttccctaaggagcctgggat

SEQ ID NO: 5290344 - DNA, 20 bp, Homo sapiens
atttccctacattaaacatg

SEQ ID NO: 5290345 - DNA, 16 bp, Homo sapiens
atttccctatggctga

SEQ ID NO: 5290346 - DNA, 18 bp, Homo sapiens
atttccctggaatttaat

SEQ ID NO: 5290347 - DNA, 16 bp, Homo sapiens
atttccctgtgtggat

SEQ ID NO: 5290348 - DNA, 17 bp, Homo sapiens
atttcccttcatttaaa

SEQ ID NO: 5290349 - DNA, 24 bp, Homo sapiens
atttcccttcatttaaactaaatt

SEQ ID NO: 5290350 - DNA, 14 bp, Homo sapiens
atttcccttccaaa

SEQ ID NO: 5290351 - DNA, 15 bp, Homo sapiens
atttcccttcttctg

SEQ ID NO: 5290352 - DNA, 20 bp, Homo sapiens
atttccctttagctgtgtta

SEQ ID NO: 5290353 - DNA, 21 bp, Homo sapiens
atttccgaagaccttctgaag

SEQ ID NO: 5290354 - DNA, 14 bp, Homo sapiens
atttccgtaattct

SEQ ID NO: 5290355 - DNA, 18 bp, Homo sapiens
atttccgtaattcttatt

SEQ ID NO: 5290356 - DNA, 15 bp, Homo sapiens
atttccgtccccccc

SEQ ID NO: 5290357 - DNA, 18 bp, Homo sapiens
atttccgtccccccccag

SEQ ID NO: 5290358 - DNA, 23 bp, Homo sapiens
atttccgtccccccccaggccct

SEQ ID NO: 5290359 - DNA, 21 bp, Homo sapiens
atttccgtgaactctggtgct

SEQ ID NO: 5290360 - DNA, 23 bp, Homo sapiens
atttccgtgagagtcatctcaaa

SEQ ID NO: 5290361 - DNA, 20 bp, Homo sapiens
atttcctaaacataattgtg

SEQ ID NO: 5290362 - DNA, 21 bp, Homo sapiens
atttcctaatactgtcatcct

SEQ ID NO: 5290363 - DNA, 15 bp, Homo sapiens
atttcctacagaaat

SEQ ID NO: 5290364 - DNA, 23 bp, Homo sapiens
atttcctagtggagttttataaa

SEQ ID NO: 5290365 - DNA, 15 bp, Homo sapiens
atttcctagttctgt

SEQ ID NO: 5290366 - DNA, 18 bp, Homo sapiens
atttcctagttctgtaga

SEQ ID NO: 5290367 - DNA, 20 bp, Homo sapiens
atttcctagttctgtagaaa

SEQ ID NO: 5290368 - DNA, 23 bp, Homo sapiens
atttcctatagctacatgttctt

SEQ ID NO: 5290369 - DNA, 14 bp, Homo sapiens
atttcctatgatgt

SEQ ID NO: 5290370 - DNA, 20 bp, Homo sapiens
atttcctatgtaactgcatt

SEQ ID NO: 5290371 - DNA, 18 bp, Homo sapiens
atttcctatgtattctgg

SEQ ID NO: 5290372 - DNA, 16 bp, Homo sapiens
atttcctattttaaaa

SEQ ID NO: 5290373 - DNA, 20 bp, Homo sapiens
atttcctattttaaaaccat

SEQ ID NO: 5290374 - DNA, 23 bp, Homo sapiens
atttcctcagatccccagctttc

SEQ ID NO: 5290375 - DNA, 21 bp, Homo sapiens
atttcctcagcttatctcttt

SEQ ID NO: 5290376 - DNA, 18 bp, Homo sapiens
atttcctcatctgggtct

SEQ ID NO: 5290377 - DNA, 21 bp, Homo sapiens
atttcctcatgtgatcacaat

SEQ ID NO: 5290378 - DNA, 20 bp, Homo sapiens
atttcctccattcctgctct

SEQ ID NO: 5290379 - DNA, 13 bp, Homo sapiens
atttcctcccaat

SEQ ID NO: 5290380 - DNA, 19 bp, Homo sapiens
atttcctccctctgcccct

SEQ ID NO: 5290381 - DNA, 22 bp, Homo sapiens
caactcccccaccgcccactct

SEQ ID NO: 5290382 - DNA, 20 bp, Homo sapiens
caactccctgaacctcagtt

SEQ ID NO: 5290383 - DNA, 21 bp, Homo sapiens
caactccctgaacctcagttt

SEQ ID NO: 5290384 - DNA, 12 bp, Homo sapiens
caactccctgcc

SEQ ID NO: 5290385 - DNA, 21 bp, Homo sapiens
caactccctgccccccagccc

SEQ ID NO: 5290386 - DNA, 13 bp, Homo sapiens
caactcccttgca

SEQ ID NO: 5290387 - DNA, 15 bp, Homo sapiens
caactccgcccagcc

SEQ ID NO: 5290388 - DNA, 17 bp, Homo sapiens
caactccgcccagcctc

SEQ ID NO: 5290389 - DNA, 18 bp, Homo sapiens
caactccgcccagcctct

SEQ ID NO: 5290390 - DNA, 19 bp, Homo sapiens
caactcctagggccactga

SEQ ID NO: 5290391 - DNA, 13 bp, Homo sapiens
caactcctcccat

SEQ ID NO: 5290392 - DNA, 21 bp, Homo sapiens
caactcctcgacatcactgtt

SEQ ID NO: 5290393 - DNA, 12 bp, Homo sapiens
caactcctgatg

SEQ ID NO: 5290394 - DNA, 21 bp, Homo sapiens
caactcctgatgccctcttct

SEQ ID NO: 5290395 - DNA, 22 bp, Homo sapiens
caactcctggagatttcagtta

SEQ ID NO: 5290396 - DNA, 13 bp, Homo sapiens
caactccttactt

SEQ ID NO: 5290397 - DNA, 17 bp, Homo sapiens
caactccttcctctttg

SEQ ID NO: 5290398 - DNA, 14 bp, Homo sapiens
caactcgctttagg

SEQ ID NO: 5290399 - DNA, 17 bp, Homo sapiens
caactcggagagggctg

SEQ ID NO: 5290400 - DNA, 20 bp, Homo sapiens
caactcgggagcattctgcc

SEQ ID NO: 5290401 - DNA, 19 bp, Homo sapiens
caactcgggggcgcctgga

SEQ ID NO: 5290402 - DNA, 19 bp, Homo sapiens
caactcgtatagcatgcat

SEQ ID NO: 5290403 - DNA, 18 bp, Homo sapiens
caactcgtgacagcctct

SEQ ID NO: 5290404 - DNA, 18 bp, Homo sapiens
caactctacacagctcag

SEQ ID NO: 5290405 - DNA, 18 bp, Homo sapiens
caactctccccagtgcct

SEQ ID NO: 5290406 - DNA, 21 bp, Homo sapiens
caactctccccagtgcctgcc

SEQ ID NO: 5290407 - DNA, 24 bp, Homo sapiens
caactctcccctgacctgtgagcc

SEQ ID NO: 5290408 - DNA, 14 bp, Homo sapiens
caactctcctccag

SEQ ID NO: 5290409 - DNA, 20 bp, Homo sapiens
caactctcctccagagtcag

SEQ ID NO: 5290410 - DNA, 12 bp, Homo sapiens
caactctctcct

SEQ ID NO: 5290411 - DNA, 15 bp, Homo sapiens
caactctctctgccc

SEQ ID NO: 5290412 - DNA, 16 bp, Homo sapiens
caactctctctgcccc

SEQ ID NO: 5290413 - DNA, 19 bp, Homo sapiens
caactctctctgcccccaa

SEQ ID NO: 5290414 - DNA, 14 bp, Homo sapiens
caactctctgagag

SEQ ID NO: 5290415 - DNA, 13 bp, Homo sapiens
caactctcttatt

SEQ ID NO: 5290416 - DNA, 18 bp, Homo sapiens
caactctgaaagagcaaa

SEQ ID NO: 5290417 - DNA, 22 bp, Homo sapiens
caactctgaaagagcaaaccta

SEQ ID NO: 5290418 - DNA, 12 bp, Homo sapiens
caactctgaagc

SEQ ID NO: 5290419 - DNA, 15 bp, Homo sapiens
caactctgagcccat

SEQ ID NO: 5290420 - DNA, 15 bp, Homo sapiens
caactctgcactcca

SEQ ID NO: 5290421 - DNA, 17 bp, Homo sapiens
caactctgcactccatg

SEQ ID NO: 5290422 - DNA, 13 bp, Homo sapiens
caactctgccttt

SEQ ID NO: 5290423 - DNA, 15 bp, Homo sapiens
caactctgctgaggg

SEQ ID NO: 5290424 - DNA, 11 bp, Homo sapiens
caactctggcc

SEQ ID NO: 5290425 - DNA, 13 bp, Homo sapiens
caactctggctcc

SEQ ID NO: 5290426 - DNA, 19 bp, Homo sapiens
caactcttagaggtaggtg

SEQ ID NO: 5290427 - DNA, 14 bp, Homo sapiens
caactcttatttct

SEQ ID NO: 5290428 - DNA, 22 bp, Homo sapiens
caactcttatttctttccttta

SEQ ID NO: 5290429 - DNA, 18 bp, Homo sapiens
caactcttccctgaactt

SEQ ID NO: 5290430 - DNA, 19 bp, Homo sapiens
caactcttcctcccctctc

SEQ ID NO: 5290431 - DNA, 14 bp, Homo sapiens
caactcttgtattg

SEQ ID NO: 5290432 - DNA, 22 bp, Homo sapiens
caactcttgtattgctccattt

SEQ ID NO: 5290433 - DNA, 14 bp, Homo sapiens
caactctttgttat

SEQ ID NO: 5290434 - DNA, 22 bp, Homo sapiens
caactgaaaagactcagtgttc

SEQ ID NO: 5290435 - DNA, 16 bp, Homo sapiens
caactgaaagaaaaag

SEQ ID NO: 5290436 - DNA, 14 bp, Homo sapiens
caactgaaagtgtt

SEQ ID NO: 5290437 - DNA, 16 bp, Homo sapiens
caactgaaatgtggat

SEQ ID NO: 5290438 - DNA, 15 bp, Homo sapiens
caactgaacaaaaaa

SEQ ID NO: 5290439 - DNA, 16 bp, Homo sapiens
caactgaacaaaaaaa

SEQ ID NO: 5290440 - DNA, 20 bp, Homo sapiens
caactgaacaaaagctcagg

SEQ ID NO: 5290441 - DNA, 14 bp, Homo sapiens
caactgaaggaagg

SEQ ID NO: 5290442 - DNA, 22 bp, Homo sapiens
caactgaaggctaaaaagcaac

SEQ ID NO: 5290443 - DNA, 22 bp, Homo sapiens
caactgaataaattcagtattt

SEQ ID NO: 5290444 - DNA, 16 bp, Homo sapiens
caactgaatacttgaa

SEQ ID NO: 5290445 - DNA, 21 bp, Homo sapiens
caactgaattgctatcatttg

SEQ ID NO: 5290446 - DNA, 11 bp, Homo sapiens
caactgacaca

SEQ ID NO: 5290447 - DNA, 13 bp, Homo sapiens
caactgacacagg

SEQ ID NO: 5290448 - DNA, 17 bp, Homo sapiens
caactgacattgctcca

SEQ ID NO: 5290449 - DNA, 13 bp, Homo sapiens
caactgacctgcc

SEQ ID NO: 5290450 - DNA, 16 bp, Homo sapiens
caactgacttctgcta

SEQ ID NO: 5290451 - DNA, 19 bp, Homo sapiens
caactgagagtcatataca

SEQ ID NO: 5290452 - DNA, 16 bp, Homo sapiens
caactgagatgtcaga

SEQ ID NO: 5290453 - DNA, 13 bp, Homo sapiens
caactgagatgtt

SEQ ID NO: 5290454 - DNA, 22 bp, Homo sapiens
caactgagccaaaaacaataaa

SEQ ID NO: 5290455 - DNA, 23 bp, Homo sapiens
caactgagccaaaaacaataaac

SEQ ID NO: 5290456 - DNA, 16 bp, Homo sapiens
caactgaggcagacag

SEQ ID NO: 5290457 - DNA, 17 bp, Homo sapiens
caactgagggccaggga

SEQ ID NO: 5290458 - DNA, 21 bp, Homo sapiens
caactgagggccagggaccca

SEQ ID NO: 5290459 - DNA, 15 bp, Homo sapiens
caactgaggtaacct

SEQ ID NO: 5290460 - DNA, 15 bp, Homo sapiens
caactgatcatattt

SEQ ID NO: 5290461 - DNA, 22 bp, Homo sapiens
caactgatcatttgcagctgct

SEQ ID NO: 5290462 - DNA, 15 bp, Homo sapiens
caactgattttgtat

SEQ ID NO: 5290463 - DNA, 20 bp, Homo sapiens
caactgattttgtatgtaaa

SEQ ID NO: 5290464 - DNA, 19 bp, Homo sapiens
caactgcaaaaaaagcctc

SEQ ID NO: 5290465 - DNA, 22 bp, Homo sapiens
caactgcaagtcacaaaggaat

SEQ ID NO: 5290466 - DNA, 15 bp, Homo sapiens
caactgcacatgaaa

SEQ ID NO: 5290467 - DNA, 17 bp, Homo sapiens
caactgcatcaagatgt

SEQ ID NO: 5290468 - DNA, 23 bp, Homo sapiens
caactgcatcaagatgtgacatg

SEQ ID NO: 5290469 - DNA, 20 bp, Homo sapiens
caactgcatccaggcctgag

SEQ ID NO: 5290470 - DNA, 16 bp, Homo sapiens
caactgccaggctgcc

SEQ ID NO: 5290471 - DNA, 20 bp, Homo sapiens
caactgccaggctgcctcct

SEQ ID NO: 5290472 - DNA, 14 bp, Homo sapiens
caactgcccagcaa

SEQ ID NO: 5290473 - DNA, 13 bp, Homo sapiens
caactgccccagg

SEQ ID NO: 5290474 - DNA, 16 bp, Homo sapiens
caactgccccaggggg

SEQ ID NO: 5290475 - DNA, 22 bp, Homo sapiens
caactgccctaagcccccaggg

SEQ ID NO: 5290476 - DNA, 13 bp, Homo sapiens
caactgcccttcc

SEQ ID NO: 5290477 - DNA, 15 bp, Homo sapiens
caactgcctactcca

SEQ ID NO: 5290478 - DNA, 18 bp, Homo sapiens
caactgcctactccaaaa

SEQ ID NO: 5290479 - DNA, 14 bp, Homo sapiens
caactgcggtgatg

SEQ ID NO: 5290480 - DNA, 20 bp, Homo sapiens
caactgctaatgcaaattaa

SEQ ID NO: 5290481 - DNA, 18 bp, Homo sapiens
caactgctcagctctggt

SEQ ID NO: 5290482 - DNA, 14 bp, Homo sapiens
caactgctccagcc

SEQ ID NO: 5290483 - DNA, 17 bp, Homo sapiens
caactgctcccacctcc

SEQ ID NO: 5290484 - DNA, 13 bp, Homo sapiens
caactgctctgcc

SEQ ID NO: 5290485 - DNA, 20 bp, Homo sapiens
caactgctctgcccactgtg

SEQ ID NO: 5290486 - DNA, 12 bp, Homo sapiens
caactgctctta

SEQ ID NO: 5290487 - DNA, 18 bp, Homo sapiens
caactgctcttttatact

SEQ ID NO: 5290488 - DNA, 21 bp, Homo sapiens
caactgctgatgctcatggtc

SEQ ID NO: 5290489 - DNA, 21 bp, Homo sapiens
caactgctgccccaaaggaag

SEQ ID NO: 5290490 - DNA, 14 bp, Homo sapiens
caactgctgtttta

SEQ ID NO: 5290491 - DNA, 17 bp, Homo sapiens
caactgctgttttatgt

SEQ ID NO: 5290492 - DNA, 21 bp, Homo sapiens
caactgcttgtaaaggtgctc

SEQ ID NO: 5290493 - DNA, 12 bp, Homo sapiens
caactggaaata

SEQ ID NO: 5290494 - DNA, 17 bp, Homo sapiens
caactggaaataaagta

SEQ ID NO: 5290495 - DNA, 18 bp, Homo sapiens
caactggaaggctttatt

SEQ ID NO: 5290496 - DNA, 13 bp, Homo sapiens
caactggacaaga

SEQ ID NO: 5290497 - DNA, 20 bp, Homo sapiens
caactggacatcacagcaga

SEQ ID NO: 5290498 - DNA, 19 bp, Homo sapiens
caactggacattgtctgcg

SEQ ID NO: 5290499 - DNA, 18 bp, Homo sapiens
caactggagcaagaagga

SEQ ID NO: 5290500 - DNA, 22 bp, Homo sapiens
caactggagcaagaaggaagga

SEQ ID NO: 5290501 - DNA, 22 bp, Homo sapiens
caactggagtgggtagaagcct

SEQ ID NO: 5290502 - DNA, 23 bp, Homo sapiens
caactggatgttgacgtatatat

SEQ ID NO: 5290503 - DNA, 14 bp, Homo sapiens
caactggccagcca

SEQ ID NO: 5290504 - DNA, 18 bp, Homo sapiens
caactggccctatttaga

SEQ ID NO: 5290505 - DNA, 19 bp, Homo sapiens
caactggccctatttagat

SEQ ID NO: 5290506 - DNA, 16 bp, Homo sapiens
caactggcgaagcctg

SEQ ID NO: 5290507 - DNA, 19 bp, Homo sapiens
caactggcgaagcctgagc

SEQ ID NO: 5290508 - DNA, 16 bp, Homo sapiens
caactggctggccagt

SEQ ID NO: 5290509 - DNA, 15 bp, Homo sapiens
caactggcttctgtg

SEQ ID NO: 5290510 - DNA, 16 bp, Homo sapiens
caactggcttctgtgc

SEQ ID NO: 5290511 - DNA, 16 bp, Homo sapiens
caactgggccaggagg

SEQ ID NO: 5290512 - DNA, 17 bp, Homo sapiens
caactgggccaggaggt

SEQ ID NO: 5290513 - DNA, 13 bp, Homo sapiens
caactgggcccaa

SEQ ID NO: 5290514 - DNA, 13 bp, Homo sapiens
caactgggcctct

SEQ ID NO: 5290515 - DNA, 19 bp, Homo sapiens
caactggggaaaaggatga

SEQ ID NO: 5290516 - DNA, 13 bp, Homo sapiens
caactgggtcatg

SEQ ID NO: 5290517 - DNA, 14 bp, Homo sapiens
caactggtcactgt

SEQ ID NO: 5290518 - DNA, 18 bp, Homo sapiens
caactggttagtgtgaaa

SEQ ID NO: 5290519 - DNA, 17 bp, Homo sapiens
caactggttcaggctca

SEQ ID NO: 5290520 - DNA, 21 bp, Homo sapiens
caactggttgtatatttttat

SEQ ID NO: 5290521 - DNA, 24 bp, Homo sapiens
caactggttgtatatttttatatt

SEQ ID NO: 5290522 - DNA, 12 bp, Homo sapiens
caactgtatata

SEQ ID NO: 5290523 - DNA, 13 bp, Homo sapiens
caactgtatatat

SEQ ID NO: 5290524 - DNA, 18 bp, Homo sapiens
caactgtctatttctgct

SEQ ID NO: 5290525 - DNA, 23 bp, Homo sapiens
caactgtctcgatgcaatgaaca

SEQ ID NO: 5290526 - DNA, 16 bp, Homo sapiens
caactgtcttcctcaa

SEQ ID NO: 5290527 - DNA, 20 bp, Homo sapiens
caactgtgaatatgagaaat

SEQ ID NO: 5290528 - DNA, 20 bp, Homo sapiens
caactgtggataaattttgg

SEQ ID NO: 5290529 - DNA, 22 bp, Homo sapiens
caactgtggataaattttggaa

SEQ ID NO: 5290530 - DNA, 20 bp, Homo sapiens
caactgtggtagctccagcg

SEQ ID NO: 5290531 - DNA, 22 bp, Homo sapiens
caactgtggtagctccagcgat

SEQ ID NO: 5290532 - DNA, 23 bp, Homo sapiens
caactgtggtcccagctacaggg

SEQ ID NO: 5290533 - DNA, 19 bp, Homo sapiens
caactgtgttgtattaaca

SEQ ID NO: 5290534 - DNA, 21 bp, Homo sapiens
caactgtgttgtattaacaaa

SEQ ID NO: 5290535 - DNA, 14 bp, Homo sapiens
caactgttgatggt

SEQ ID NO: 5290536 - DNA, 19 bp, Homo sapiens
caactgttgattgcaggaa

SEQ ID NO: 5290537 - DNA, 19 bp, Homo sapiens
caactgttggataataact

SEQ ID NO: 5290538 - DNA, 19 bp, Homo sapiens
caactgttggattcagaaa

SEQ ID NO: 5290539 - DNA, 15 bp, Homo sapiens
caactgtttccctgc

SEQ ID NO: 5290540 - DNA, 16 bp, Homo sapiens
caactgtttccctgct

SEQ ID NO: 5290541 - DNA, 19 bp, Homo sapiens
caactgtttccctgctgaa

SEQ ID NO: 5290542 - DNA, 17 bp, Homo sapiens
caactgttttaaaactt

SEQ ID NO: 5290543 - DNA, 19 bp, Homo sapiens
caactgttttgatactgaa

SEQ ID NO: 5290544 - DNA, 15 bp, Homo sapiens
caactgtttttgaag

SEQ ID NO: 5290545 - DNA, 17 bp, Homo sapiens
caactgtttttgaagaa

SEQ ID NO: 5290546 - DNA, 15 bp, Homo sapiens
caacttaaaaagtct

SEQ ID NO: 5290547 - DNA, 14 bp, Homo sapiens
caacttaaacctgt

SEQ ID NO: 5290548 - DNA, 14 bp, Homo sapiens
caacttaaatcact

SEQ ID NO: 5290549 - DNA, 20 bp, Homo sapiens
caacttaaatcactgaggca

SEQ ID NO: 5290550 - DNA, 16 bp, Homo sapiens
caacttaacatgggct

SEQ ID NO: 5290551 - DNA, 15 bp, Homo sapiens
caacttaagtatatt

SEQ ID NO: 5290552 - DNA, 23 bp, Homo sapiens
caacttaagtttagaaattacaa

SEQ ID NO: 5290553 - DNA, 14 bp, Homo sapiens
caacttaatggaaa

SEQ ID NO: 5290554 - DNA, 12 bp, Homo sapiens
caacttaatgtg

SEQ ID NO: 5290555 - DNA, 17 bp, Homo sapiens
caacttacatatgtctt

SEQ ID NO: 5290556 - DNA, 16 bp, Homo sapiens
caacttactaaatcta

SEQ ID NO: 5290557 - DNA, 17 bp, Homo sapiens
caacttagagattgcat

SEQ ID NO: 5290558 - DNA, 18 bp, Homo sapiens
caacttagatctccagga

SEQ ID NO: 5290559 - DNA, 19 bp, Homo sapiens
caacttagatctctcctgc

SEQ ID NO: 5290560 - DNA, 19 bp, Homo sapiens
atttcctcgcagcctctca

SEQ ID NO: 5290561 - DNA, 11 bp, Homo sapiens
atttcctctat

SEQ ID NO: 5290562 - DNA, 18 bp, Homo sapiens
atttcctctattgatgta

SEQ ID NO: 5290563 - DNA, 20 bp, Homo sapiens
atttcctctctatctttttt

SEQ ID NO: 5290564 - DNA, 18 bp, Homo sapiens
atttcctctgagctgtta

SEQ ID NO: 5290565 - DNA, 16 bp, Homo sapiens
atttcctcttccttct

SEQ ID NO: 5290566 - DNA, 19 bp, Homo sapiens
atttcctcttccttctcta

SEQ ID NO: 5290567 - DNA, 21 bp, Homo sapiens
atttcctgaacctggaaatga

SEQ ID NO: 5290568 - DNA, 15 bp, Homo sapiens
atttcctgacttgag

SEQ ID NO: 5290569 - DNA, 22 bp, Homo sapiens
atttcctgaggtggatttactg

SEQ ID NO: 5290570 - DNA, 10 bp, Homo sapiens
atttcctgat

SEQ ID NO: 5290571 - DNA, 13 bp, Homo sapiens
atttcctgccctt

SEQ ID NO: 5290572 - DNA, 22 bp, Homo sapiens
atttcctgctacttaaatttga

SEQ ID NO: 5290573 - DNA, 13 bp, Homo sapiens
atttcctgctgaa

SEQ ID NO: 5290574 - DNA, 15 bp, Homo sapiens
atttcctgcttccct

SEQ ID NO: 5290575 - DNA, 12 bp, Homo sapiens
atttcctgtaat

SEQ ID NO: 5290576 - DNA, 14 bp, Homo sapiens
atttcctgtaatat

SEQ ID NO: 5290577 - DNA, 18 bp, Homo sapiens
atttcctgtaatatattt

SEQ ID NO: 5290578 - DNA, 21 bp, Homo sapiens
atttcctgtaatatatttata

SEQ ID NO: 5290579 - DNA, 19 bp, Homo sapiens
atttcctgtacaatcatga

SEQ ID NO: 5290580 - DNA, 21 bp, Homo sapiens
atttcctgtacaatcatgaac

SEQ ID NO: 5290581 - DNA, 18 bp, Homo sapiens
atttcctgtattgcttta

SEQ ID NO: 5290582 - DNA, 13 bp, Homo sapiens
atttcctgtgagg

SEQ ID NO: 5290583 - DNA, 15 bp, Homo sapiens
atttcctgtgaggat

SEQ ID NO: 5290584 - DNA, 12 bp, Homo sapiens
atttcctgtgtt

SEQ ID NO: 5290585 - DNA, 16 bp, Homo sapiens
atttcctgttggattt

SEQ ID NO: 5290586 - DNA, 18 bp, Homo sapiens
atttccttaaactgtgtg

SEQ ID NO: 5290587 - DNA, 16 bp, Homo sapiens
atttccttatcacaga

SEQ ID NO: 5290588 - DNA, 20 bp, Homo sapiens
atttccttatcacagaaata

SEQ ID NO: 5290589 - DNA, 17 bp, Homo sapiens
atttccttatgtgtgta

SEQ ID NO: 5290590 - DNA, 19 bp, Homo sapiens
atttccttcaatgtgcata

SEQ ID NO: 5290591 - DNA, 16 bp, Homo sapiens
atttccttcaggcagc

SEQ ID NO: 5290592 - DNA, 16 bp, Homo sapiens
atttccttcaggtttt

SEQ ID NO: 5290593 - DNA, 15 bp, Homo sapiens
atttccttccactgt

SEQ ID NO: 5290594 - DNA, 15 bp, Homo sapiens
atttccttccagccc

SEQ ID NO: 5290595 - DNA, 15 bp, Homo sapiens
atttccttccagcct

SEQ ID NO: 5290596 - DNA, 16 bp, Homo sapiens
atttccttccagcctt

SEQ ID NO: 5290597 - DNA, 17 bp, Homo sapiens
atttccttccagccttt

SEQ ID NO: 5290598 - DNA, 13 bp, Homo sapiens
atttccttctgtt

SEQ ID NO: 5290599 - DNA, 18 bp, Homo sapiens
atttccttctgttaagaa

SEQ ID NO: 5290600 - DNA, 23 bp, Homo sapiens
atttccttctgttaagaaaggat

SEQ ID NO: 5290601 - DNA, 12 bp, Homo sapiens
atttccttggag

SEQ ID NO: 5290602 - DNA, 16 bp, Homo sapiens
atttccttggaggcca

SEQ ID NO: 5290603 - DNA, 10 bp, Homo sapiens
atttccttta

SEQ ID NO: 5290604 - DNA, 16 bp, Homo sapiens
atttcctttatgtgaa

SEQ ID NO: 5290605 - DNA, 20 bp, Homo sapiens
atttcctttattattctgta

SEQ ID NO: 5290606 - DNA, 20 bp, Homo sapiens
atttcctttcataccttgaa

SEQ ID NO: 5290607 - DNA, 21 bp, Homo sapiens
atttcctttggcaatatcata

SEQ ID NO: 5290608 - DNA, 19 bp, Homo sapiens
atttccttttctctgccct

SEQ ID NO: 5290609 - DNA, 21 bp, Homo sapiens
atttccttttcttccctgacc

SEQ ID NO: 5290610 - DNA, 17 bp, Homo sapiens
atttcctttttctattt

SEQ ID NO: 5290611 - DNA, 19 bp, Homo sapiens
atttcctttttctatttta

SEQ ID NO: 5290612 - DNA, 17 bp, Homo sapiens
atttccttttttaaaaa

SEQ ID NO: 5290613 - DNA, 17 bp, Homo sapiens
atttcgaaactgccaag

SEQ ID NO: 5290614 - DNA, 15 bp, Homo sapiens
atttcgaccctgggg

SEQ ID NO: 5290615 - DNA, 18 bp, Homo sapiens
atttcgccttaaactctg

SEQ ID NO: 5290616 - DNA, 15 bp, Homo sapiens
atttcgcttcttaga

SEQ ID NO: 5290617 - DNA, 19 bp, Homo sapiens
atttcgggagccttgtcag

SEQ ID NO: 5290618 - DNA, 21 bp, Homo sapiens
atttcgggtgaatctgtctat

SEQ ID NO: 5290619 - DNA, 16 bp, Homo sapiens
atttcgtgactttttt

SEQ ID NO: 5290620 - DNA, 22 bp, Homo sapiens
atttcgtgggtctgttttcctt

SEQ ID NO: 5290621 - DNA, 20 bp, Homo sapiens
atttcgttgtccaatttgta

SEQ ID NO: 5290622 - DNA, 21 bp, Homo sapiens
atttctaaaaaacagaggcca

SEQ ID NO: 5290623 - DNA, 13 bp, Homo sapiens
atttctaaaacat

SEQ ID NO: 5290624 - DNA, 16 bp, Homo sapiens
atttctaaaactccaa

SEQ ID NO: 5290625 - DNA, 12 bp, Homo sapiens
atttctaaaaga

SEQ ID NO: 5290626 - DNA, 21 bp, Homo sapiens
atttctaaaatgttaaaacat

SEQ ID NO: 5290627 - DNA, 22 bp, Homo sapiens
atttctaaaccacaaaagttgt

SEQ ID NO: 5290628 - DNA, 16 bp, Homo sapiens
atttctaaagttgtag

SEQ ID NO: 5290629 - DNA, 15 bp, Homo sapiens
atttctaaataaaag

SEQ ID NO: 5290630 - DNA, 21 bp, Homo sapiens
atttctaaatctccaaaataa

SEQ ID NO: 5290631 - DNA, 14 bp, Homo sapiens
atttctaaattaag

SEQ ID NO: 5290632 - DNA, 13 bp, Homo sapiens
atttctaaatttg

SEQ ID NO: 5290633 - DNA, 13 bp, Homo sapiens
atttctaactatt

SEQ ID NO: 5290634 - DNA, 19 bp, Homo sapiens
atttctaactctattaatg

SEQ ID NO: 5290635 - DNA, 16 bp, Homo sapiens
atttctaactctgatg

SEQ ID NO: 5290636 - DNA, 20 bp, Homo sapiens
atttctaactctgatgtaaa

SEQ ID NO: 5290637 - DNA, 14 bp, Homo sapiens
atttctaagaagtt

SEQ ID NO: 5290638 - DNA, 17 bp, Homo sapiens
atttctaagaagttact

SEQ ID NO: 5290639 - DNA, 23 bp, Homo sapiens
atttctaagaagttactttttgt

SEQ ID NO: 5290640 - DNA, 23 bp, Homo sapiens
atttctaagactactaaggcctt

SEQ ID NO: 5290641 - DNA, 14 bp, Homo sapiens
atttctaagcagat

SEQ ID NO: 5290642 - DNA, 14 bp, Homo sapiens
atttctaagccttt

SEQ ID NO: 5290643 - DNA, 16 bp, Homo sapiens
atttctaagcttattt

SEQ ID NO: 5290644 - DNA, 20 bp, Homo sapiens
atttctaagcttatttctaa

SEQ ID NO: 5290645 - DNA, 21 bp, Homo sapiens
atttctaagcttatttctaac

SEQ ID NO: 5290646 - DNA, 22 bp, Homo sapiens
atttctaagtatttaaatgttc

SEQ ID NO: 5290647 - DNA, 18 bp, Homo sapiens
atttctaagtgtttcaca

SEQ ID NO: 5290648 - DNA, 19 bp, Homo sapiens
atttctaagttaaatcatt

SEQ ID NO: 5290649 - DNA, 21 bp, Homo sapiens
atttctaatccttttccttat

SEQ ID NO: 5290650 - DNA, 15 bp, Homo sapiens
atttctaatgtttac

SEQ ID NO: 5290651 - DNA, 14 bp, Homo sapiens
atttctaattatgt

SEQ ID NO: 5290652 - DNA, 15 bp, Homo sapiens
atttctaattatgta

SEQ ID NO: 5290653 - DNA, 13 bp, Homo sapiens
atttctaattgca

SEQ ID NO: 5290654 - DNA, 16 bp, Homo sapiens
atttctaattgtaagt

SEQ ID NO: 5290655 - DNA, 14 bp, Homo sapiens
atttctaatttgaa

SEQ ID NO: 5290656 - DNA, 18 bp, Homo sapiens
atttctaatttgaatgaa

SEQ ID NO: 5290657 - DNA, 21 bp, Homo sapiens
atttctacaactgatcatttg

SEQ ID NO: 5290658 - DNA, 19 bp, Homo sapiens
atttctacacagtgggaac

SEQ ID NO: 5290659 - DNA, 13 bp, Homo sapiens
atttctacagaga

SEQ ID NO: 5290660 - DNA, 17 bp, Homo sapiens
atttctacagagaaaat

SEQ ID NO: 5290661 - DNA, 14 bp, Homo sapiens
atttctacattaca

SEQ ID NO: 5290662 - DNA, 17 bp, Homo sapiens
atttctaccatttcaga

SEQ ID NO: 5290663 - DNA, 18 bp, Homo sapiens
atttctaccatttcagag

SEQ ID NO: 5290664 - DNA, 17 bp, Homo sapiens
atttctacctttctgag

SEQ ID NO: 5290665 - DNA, 17 bp, Homo sapiens
atttctactatatacat

SEQ ID NO: 5290666 - DNA, 13 bp, Homo sapiens
atttctactatga

SEQ ID NO: 5290667 - DNA, 23 bp, Homo sapiens
atttctactatgatcagaagaac

SEQ ID NO: 5290668 - DNA, 15 bp, Homo sapiens
atttctactgtcaaa

SEQ ID NO: 5290669 - DNA, 15 bp, Homo sapiens
atttctactgtgact

SEQ ID NO: 5290670 - DNA, 16 bp, Homo sapiens
atttctactgtgactg

SEQ ID NO: 5290671 - DNA, 15 bp, Homo sapiens
atttctactttgact

SEQ ID NO: 5290672 - DNA, 20 bp, Homo sapiens
atttctagaaaagcttccta

SEQ ID NO: 5290673 - DNA, 16 bp, Homo sapiens
atttctagaacaatta

SEQ ID NO: 5290674 - DNA, 22 bp, Homo sapiens
atttctagaacaattacatgta

SEQ ID NO: 5290675 - DNA, 23 bp, Homo sapiens
atttctagaacaattacatgtaa

SEQ ID NO: 5290676 - DNA, 21 bp, Homo sapiens
atttctagaacatccctgcca

SEQ ID NO: 5290677 - DNA, 14 bp, Homo sapiens
atttctagactcaa

SEQ ID NO: 5290678 - DNA, 21 bp, Homo sapiens
atttctagactcaaaacctgg

SEQ ID NO: 5290679 - DNA, 21 bp, Homo sapiens
atttctagacttccacaaaat

SEQ ID NO: 5290680 - DNA, 14 bp, Homo sapiens
atttctagagacaa

SEQ ID NO: 5290681 - DNA, 23 bp, Homo sapiens
atttctagcaaacagatgtttgt

SEQ ID NO: 5290682 - DNA, 16 bp, Homo sapiens
atttctagcagagtga

SEQ ID NO: 5290683 - DNA, 14 bp, Homo sapiens
atttctagcaggca

SEQ ID NO: 5290684 - DNA, 17 bp, Homo sapiens
atttctagcaggcagga

SEQ ID NO: 5290685 - DNA, 23 bp, Homo sapiens
atttctagcctgcactttgatgt

SEQ ID NO: 5290686 - DNA, 15 bp, Homo sapiens
atttctaggaagaat

SEQ ID NO: 5290687 - DNA, 22 bp, Homo sapiens
atttctaggaagaattttaaaa

SEQ ID NO: 5290688 - DNA, 22 bp, Homo sapiens
atttctagggctgggaaacact

SEQ ID NO: 5290689 - DNA, 19 bp, Homo sapiens
atttctagtacctgtgact

SEQ ID NO: 5290690 - DNA, 21 bp, Homo sapiens
atttctagtacctgtgactct

SEQ ID NO: 5290691 - DNA, 14 bp, Homo sapiens
atttctagtagaaa

SEQ ID NO: 5290692 - DNA, 16 bp, Homo sapiens
atttctagtagaaaga

SEQ ID NO: 5290693 - DNA, 17 bp, Homo sapiens
atttctagtaggcagca

SEQ ID NO: 5290694 - DNA, 15 bp, Homo sapiens
atttctagtatctat

SEQ ID NO: 5290695 - DNA, 23 bp, Homo sapiens
atttctagtcccttctctctttc

SEQ ID NO: 5290696 - DNA, 20 bp, Homo sapiens
atttctagtgtatactctgt

SEQ ID NO: 5290697 - DNA, 21 bp, Homo sapiens
atttctagtgtatactctgta

SEQ ID NO: 5290698 - DNA, 21 bp, Homo sapiens
atttctataaatagatgctgt

SEQ ID NO: 5290699 - DNA, 16 bp, Homo sapiens
atttctatactttaca

SEQ ID NO: 5290700 - DNA, 20 bp, Homo sapiens
atttctatattcctccagct

SEQ ID NO: 5290701 - DNA, 17 bp, Homo sapiens
atttctatattttcatt

SEQ ID NO: 5290702 - DNA, 20 bp, Homo sapiens
atttctatcagtacttttat

SEQ ID NO: 5290703 - DNA, 14 bp, Homo sapiens
atttctatctgcaa

SEQ ID NO: 5290704 - DNA, 16 bp, Homo sapiens
atttctatctgcaaat

SEQ ID NO: 5290705 - DNA, 15 bp, Homo sapiens
atttctatgaaatat

SEQ ID NO: 5290706 - DNA, 14 bp, Homo sapiens
atttctatgagaaa

SEQ ID NO: 5290707 - DNA, 16 bp, Homo sapiens
atttctatggcatatt

SEQ ID NO: 5290708 - DNA, 16 bp, Homo sapiens
atttctatggctttca

SEQ ID NO: 5290709 - DNA, 17 bp, Homo sapiens
atttctatggctttcaa

SEQ ID NO: 5290710 - DNA, 19 bp, Homo sapiens
atttctatggctttcaaag

SEQ ID NO: 5290711 - DNA, 14 bp, Homo sapiens
atttctatgtaaat

SEQ ID NO: 5290712 - DNA, 16 bp, Homo sapiens
atttctatgtaaatta

SEQ ID NO: 5290713 - DNA, 18 bp, Homo sapiens
atttctatgtaaattatt

SEQ ID NO: 5290714 - DNA, 21 bp, Homo sapiens
atttctatgtaaattattgta

SEQ ID NO: 5290715 - DNA, 14 bp, Homo sapiens
atttctatgtatgt

SEQ ID NO: 5290716 - DNA, 11 bp, Homo sapiens
atttctatgtc

SEQ ID NO: 5290717 - DNA, 23 bp, Homo sapiens
atttctatgtcatttttaatgta

SEQ ID NO: 5290718 - DNA, 16 bp, Homo sapiens
atttctatgttgtaat

SEQ ID NO: 5290719 - DNA, 13 bp, Homo sapiens
atttctattaata

SEQ ID NO: 5290720 - DNA, 14 bp, Homo sapiens
atttctattattaa

SEQ ID NO: 5290721 - DNA, 11 bp, Homo sapiens
atttctattcc

SEQ ID NO: 5290722 - DNA, 14 bp, Homo sapiens
atttctattcctta

SEQ ID NO: 5290723 - DNA, 16 bp, Homo sapiens
atttctatttatttac

SEQ ID NO: 5290724 - DNA, 15 bp, Homo sapiens
atttctatttctcct

SEQ ID NO: 5290725 - DNA, 15 bp, Homo sapiens
atttctattttttgt

SEQ ID NO: 5290726 - DNA, 23 bp, Homo sapiens
atttctcaaagtttttacagtgt

SEQ ID NO: 5290727 - DNA, 18 bp, Homo sapiens
atttctcaatcagtgcag

SEQ ID NO: 5290728 - DNA, 16 bp, Homo sapiens
atttctcactagtgtc

SEQ ID NO: 5290729 - DNA, 16 bp, Homo sapiens
atttctcagactttgg

SEQ ID NO: 5290730 - DNA, 21 bp, Homo sapiens
atttctcagcctggttcagaa

SEQ ID NO: 5290731 - DNA, 13 bp, Homo sapiens
atttctcagctgt

SEQ ID NO: 5290732 - DNA, 15 bp, Homo sapiens
atttctcaggaagag

SEQ ID NO: 5290733 - DNA, 16 bp, Homo sapiens
atttctcaggctaggc

SEQ ID NO: 5290734 - DNA, 20 bp, Homo sapiens
atttctcaggctaggccagc

SEQ ID NO: 5290735 - DNA, 22 bp, Homo sapiens
atttctcaggctaggccagcag

SEQ ID NO: 5290736 - DNA, 22 bp, Homo sapiens
atttctcagggaagtaagatgt

SEQ ID NO: 5290737 - DNA, 20 bp, Homo sapiens
atttctcataatgtgaaata

SEQ ID NO: 5290738 - DNA, 21 bp, Homo sapiens
atttctcataggctatgccat

SEQ ID NO: 5290739 - DNA, 16 bp, Homo sapiens
caacttagctcaggtg

SEQ ID NO: 5290740 - DNA, 16 bp, Homo sapiens
caacttagtgtctcta

SEQ ID NO: 5290741 - DNA, 19 bp, Homo sapiens
caacttagtgtctctattt

SEQ ID NO: 5290742 - DNA, 18 bp, Homo sapiens
caacttattctttgagta

SEQ ID NO: 5290743 - DNA, 19 bp, Homo sapiens
caacttattctttgagtaa

SEQ ID NO: 5290744 - DNA, 14 bp, Homo sapiens
caacttatttaaaa

SEQ ID NO: 5290745 - DNA, 15 bp, Homo sapiens
caacttatttaaaaa

SEQ ID NO: 5290746 - DNA, 16 bp, Homo sapiens
caacttatttaaaaat

SEQ ID NO: 5290747 - DNA, 17 bp, Homo sapiens
caacttatttaaaaata

SEQ ID NO: 5290748 - DNA, 14 bp, Homo sapiens
caacttatttcata

SEQ ID NO: 5290749 - DNA, 15 bp, Homo sapiens
caacttatttcataa

SEQ ID NO: 5290750 - DNA, 18 bp, Homo sapiens
caacttatttcataattg

SEQ ID NO: 5290751 - DNA, 16 bp, Homo sapiens
caacttatttttcacc

SEQ ID NO: 5290752 - DNA, 18 bp, Homo sapiens
caacttcagcagtaccta

SEQ ID NO: 5290753 - DNA, 20 bp, Homo sapiens
caacttcagttttatttttg

SEQ ID NO: 5290754 - DNA, 15 bp, Homo sapiens
caacttcatcccagc

SEQ ID NO: 5290755 - DNA, 17 bp, Homo sapiens
caacttcatcccagctg

SEQ ID NO: 5290756 - DNA, 21 bp, Homo sapiens
caacttcatcccagctgctga

SEQ ID NO: 5290757 - DNA, 17 bp, Homo sapiens
caacttcatctggaagt

SEQ ID NO: 5290758 - DNA, 19 bp, Homo sapiens
caacttcatgtcaacttct

SEQ ID NO: 5290759 - DNA, 19 bp, Homo sapiens
caacttccaaagggttagg

SEQ ID NO: 5290760 - DNA, 22 bp, Homo sapiens
caacttccagaggacagctctg

SEQ ID NO: 5290761 - DNA, 17 bp, Homo sapiens
caacttcccacacggca

SEQ ID NO: 5290762 - DNA, 19 bp, Homo sapiens
caacttcccacacggcagc

SEQ ID NO: 5290763 - DNA, 20 bp, Homo sapiens
caacttcccacacggcagcc

SEQ ID NO: 5290764 - DNA, 13 bp, Homo sapiens
caacttcccaggc

SEQ ID NO: 5290765 - DNA, 14 bp, Homo sapiens
caacttcccaggcc

SEQ ID NO: 5290766 - DNA, 11 bp, Homo sapiens
caacttcccct

SEQ ID NO: 5290767 - DNA, 17 bp, Homo sapiens
caacttccctgttcttt

SEQ ID NO: 5290768 - DNA, 16 bp, Homo sapiens
caacttccgcctcctg

SEQ ID NO: 5290769 - DNA, 17 bp, Homo sapiens
caacttccgcctcctgt

SEQ ID NO: 5290770 - DNA, 15 bp, Homo sapiens
caacttcctctgcca

SEQ ID NO: 5290771 - DNA, 11 bp, Homo sapiens
caacttcctgt

SEQ ID NO: 5290772 - DNA, 19 bp, Homo sapiens
caacttctcccaccccttg

SEQ ID NO: 5290773 - DNA, 19 bp, Homo sapiens
caacttctgaatattggac

SEQ ID NO: 5290774 - DNA, 22 bp, Homo sapiens
caacttctgcctcccatgctta

SEQ ID NO: 5290775 - DNA, 14 bp, Homo sapiens
caacttcttcagag

SEQ ID NO: 5290776 - DNA, 18 bp, Homo sapiens
caacttcttcagagctga

SEQ ID NO: 5290777 - DNA, 15 bp, Homo sapiens
caacttcttctatat

SEQ ID NO: 5290778 - DNA, 18 bp, Homo sapiens
caacttgaagaaacgctt

SEQ ID NO: 5290779 - DNA, 19 bp, Homo sapiens
caacttgaagcaagctttc

SEQ ID NO: 5290780 - DNA, 9 bp, Homo sapiens
caacttgag

SEQ ID NO: 5290781 - DNA, 13 bp, Homo sapiens
caacttgagggcc

SEQ ID NO: 5290782 - DNA, 16 bp, Homo sapiens
caacttgagggcccag

SEQ ID NO: 5290783 - DNA, 20 bp, Homo sapiens
caacttgagggcccagagca

SEQ ID NO: 5290784 - DNA, 22 bp, Homo sapiens
caacttgagggcccagagcagg

SEQ ID NO: 5290785 - DNA, 15 bp, Homo sapiens
caacttgcaaaatca

SEQ ID NO: 5290786 - DNA, 18 bp, Homo sapiens
caacttgccaaaatgttg

SEQ ID NO: 5290787 - DNA, 21 bp, Homo sapiens
caacttgccaaaatgttggct

SEQ ID NO: 5290788 - DNA, 22 bp, Homo sapiens
caacttgcttctaaatgcccag

SEQ ID NO: 5290789 - DNA, 23 bp, Homo sapiens
caacttgcttctaaatgcccagt

SEQ ID NO: 5290790 - DNA, 16 bp, Homo sapiens
caacttggctgcagga

SEQ ID NO: 5290791 - DNA, 15 bp, Homo sapiens
caacttggtccagat

SEQ ID NO: 5290792 - DNA, 19 bp, Homo sapiens
caacttggttctgcttcaa

SEQ ID NO: 5290793 - DNA, 13 bp, Homo sapiens
caacttgtctctg

SEQ ID NO: 5290794 - DNA, 15 bp, Homo sapiens
caacttgtctctgta

SEQ ID NO: 5290795 - DNA, 22 bp, Homo sapiens
caacttgtgaactccatcattc

SEQ ID NO: 5290796 - DNA, 18 bp, Homo sapiens
caactttaagcagctctt

SEQ ID NO: 5290797 - DNA, 22 bp, Homo sapiens
caactttaagcagctcttgcta

SEQ ID NO: 5290798 - DNA, 12 bp, Homo sapiens
caactttactgt

SEQ ID NO: 5290799 - DNA, 18 bp, Homo sapiens
caactttagaaagaaatt

SEQ ID NO: 5290800 - DNA, 19 bp, Homo sapiens
caactttagcagaatcaaa

SEQ ID NO: 5290801 - DNA, 18 bp, Homo sapiens
caactttagctagtatct

SEQ ID NO: 5290802 - DNA, 23 bp, Homo sapiens
caactttatgtagcaaagggctt

SEQ ID NO: 5290803 - DNA, 19 bp, Homo sapiens
caactttattgattgaatt

SEQ ID NO: 5290804 - DNA, 19 bp, Homo sapiens
caactttcacttcttccta

SEQ ID NO: 5290805 - DNA, 15 bp, Homo sapiens
caactttcatttgaa

SEQ ID NO: 5290806 - DNA, 12 bp, Homo sapiens
caactttccccc

SEQ ID NO: 5290807 - DNA, 19 bp, Homo sapiens
caactttcccttgccctgg

SEQ ID NO: 5290808 - DNA, 21 bp, Homo sapiens
caactttctcactgctgtcag

SEQ ID NO: 5290809 - DNA, 11 bp, Homo sapiens
caactttctgt

SEQ ID NO: 5290810 - DNA, 13 bp, Homo sapiens
caactttgcaaat

SEQ ID NO: 5290811 - DNA, 17 bp, Homo sapiens
caactttgcaaattatt

SEQ ID NO: 5290812 - DNA, 13 bp, Homo sapiens
caactttgctttt

SEQ ID NO: 5290813 - DNA, 17 bp, Homo sapiens
caactttggaatttgaa

SEQ ID NO: 5290814 - DNA, 22 bp, Homo sapiens
caactttgtaaaaatcttttga

SEQ ID NO: 5290815 - DNA, 11 bp, Homo sapiens
caactttgtat

SEQ ID NO: 5290816 - DNA, 17 bp, Homo sapiens
caacttttaattactgt

SEQ ID NO: 5290817 - DNA, 13 bp, Homo sapiens
caacttttagatt

SEQ ID NO: 5290818 - DNA, 13 bp, Homo sapiens
caacttttgaaat

SEQ ID NO: 5290819 - DNA, 18 bp, Homo sapiens
caacttttgaaatttaaa

SEQ ID NO: 5290820 - DNA, 16 bp, Homo sapiens
caacttttgttttctg

SEQ ID NO: 5290821 - DNA, 17 bp, Homo sapiens
caacttttgttttctga

SEQ ID NO: 5290822 - DNA, 14 bp, Homo sapiens
caactttttaaagt

SEQ ID NO: 5290823 - DNA, 22 bp, Homo sapiens
caactttttaaagtaaattatt

SEQ ID NO: 5290824 - DNA, 15 bp, Homo sapiens
caactttttcatagt

SEQ ID NO: 5290825 - DNA, 19 bp, Homo sapiens
caactttttccctcactaa

SEQ ID NO: 5290826 - DNA, 15 bp, Homo sapiens
caacttttttccctt

SEQ ID NO: 5290827 - DNA, 23 bp, Homo sapiens
caactttttttccttgtggttag

SEQ ID NO: 5290828 - DNA, 15 bp, Homo sapiens
caacttttttttctt

SEQ ID NO: 5290829 - DNA, 23 bp, Homo sapiens
caactttttttttttttgagatg

SEQ ID NO: 5290830 - DNA, 19 bp, Homo sapiens
caagaaaaaaaaatgccat

SEQ ID NO: 5290831 - DNA, 16 bp, Homo sapiens
caagaaaaagtagaaa

SEQ ID NO: 5290832 - DNA, 14 bp, Homo sapiens
caagaaaaataaag

SEQ ID NO: 5290833 - DNA, 19 bp, Homo sapiens
caagaaaaataaagaaaag

SEQ ID NO: 5290834 - DNA, 22 bp, Homo sapiens
caagaaaaataaagaaaagatg

SEQ ID NO: 5290835 - DNA, 23 bp, Homo sapiens
caagaaaaataaagaaaagatgc

SEQ ID NO: 5290836 - DNA, 18 bp, Homo sapiens
caagaaaacaacttcaat

SEQ ID NO: 5290837 - DNA, 22 bp, Homo sapiens
caagaaaacagcaagggagaga

SEQ ID NO: 5290838 - DNA, 17 bp, Homo sapiens
caagaaaacaggcactg

SEQ ID NO: 5290839 - DNA, 15 bp, Homo sapiens
caagaaaactggaaa

SEQ ID NO: 5290840 - DNA, 18 bp, Homo sapiens
caagaaaactggaaatct

SEQ ID NO: 5290841 - DNA, 23 bp, Homo sapiens
caagaaaagaacctaatagcacc

SEQ ID NO: 5290842 - DNA, 21 bp, Homo sapiens
caagaaaagaggaaaaaaagc

SEQ ID NO: 5290843 - DNA, 20 bp, Homo sapiens
caagaaaagcgcagagaaat

SEQ ID NO: 5290844 - DNA, 10 bp, Homo sapiens
caagaaaagg

SEQ ID NO: 5290845 - DNA, 12 bp, Homo sapiens
caagaaaatctt

SEQ ID NO: 5290846 - DNA, 20 bp, Homo sapiens
caagaaacaatgtctgggga

SEQ ID NO: 5290847 - DNA, 14 bp, Homo sapiens
caagaaacagaagt

SEQ ID NO: 5290848 - DNA, 15 bp, Homo sapiens
caagaaacagaagta

SEQ ID NO: 5290849 - DNA, 17 bp, Homo sapiens
caagaaacagaagtaga

SEQ ID NO: 5290850 - DNA, 16 bp, Homo sapiens
caagaaacagccagca

SEQ ID NO: 5290851 - DNA, 21 bp, Homo sapiens
caagaaacatcattctacata

SEQ ID NO: 5290852 - DNA, 20 bp, Homo sapiens
caagaaaccaagtgggctgg

SEQ ID NO: 5290853 - DNA, 21 bp, Homo sapiens
caagaaaccaagtgggctggt

SEQ ID NO: 5290854 - DNA, 23 bp, Homo sapiens
caagaaacctccatcctgccagg

SEQ ID NO: 5290855 - DNA, 24 bp, Homo sapiens
caagaaacctccatcctgccagga

SEQ ID NO: 5290856 - DNA, 20 bp, Homo sapiens
caagaaacgtggatctcccc

SEQ ID NO: 5290857 - DNA, 23 bp, Homo sapiens
caagaaacgtgtcacacttgtga

SEQ ID NO: 5290858 - DNA, 13 bp, Homo sapiens
caagaaactgaat

SEQ ID NO: 5290859 - DNA, 18 bp, Homo sapiens
caagaaactgaggaattt

SEQ ID NO: 5290860 - DNA, 15 bp, Homo sapiens
caagaaactttggaa

SEQ ID NO: 5290861 - DNA, 15 bp, Homo sapiens
caagaaagaattcct

SEQ ID NO: 5290862 - DNA, 21 bp, Homo sapiens
caagaaagagggtcccagggc

SEQ ID NO: 5290863 - DNA, 23 bp, Homo sapiens
caagaaagagggtcccagggctg

SEQ ID NO: 5290864 - DNA, 16 bp, Homo sapiens
caagaaagccagtctt

SEQ ID NO: 5290865 - DNA, 19 bp, Homo sapiens
caagaaagccagtcttaac

SEQ ID NO: 5290866 - DNA, 13 bp, Homo sapiens
caagaaaggagag

SEQ ID NO: 5290867 - DNA, 18 bp, Homo sapiens
caagaaaggcagacacac

SEQ ID NO: 5290868 - DNA, 20 bp, Homo sapiens
caagaaaggggacccaagaa

SEQ ID NO: 5290869 - DNA, 21 bp, Homo sapiens
caagaaaggggacccaagaaa

SEQ ID NO: 5290870 - DNA, 16 bp, Homo sapiens
caagaaaggttaagga

SEQ ID NO: 5290871 - DNA, 13 bp, Homo sapiens
caagaaagtttcc

SEQ ID NO: 5290872 - DNA, 19 bp, Homo sapiens
caagaaataaaaggaagcc

SEQ ID NO: 5290873 - DNA, 15 bp, Homo sapiens
caagaaataaatcag

SEQ ID NO: 5290874 - DNA, 19 bp, Homo sapiens
caagaaatgaaagcaggga

SEQ ID NO: 5290875 - DNA, 13 bp, Homo sapiens
caagaaatgaaga

SEQ ID NO: 5290876 - DNA, 21 bp, Homo sapiens
caagaaatgattcaaattgct

SEQ ID NO: 5290877 - DNA, 18 bp, Homo sapiens
caagaaatggcgtctgct

SEQ ID NO: 5290878 - DNA, 20 bp, Homo sapiens
caagaaatgtctctgctcct

SEQ ID NO: 5290879 - DNA, 16 bp, Homo sapiens
caagaaattcattaaa

SEQ ID NO: 5290880 - DNA, 22 bp, Homo sapiens
caagaaattcattaaagaaaaa

SEQ ID NO: 5290881 - DNA, 17 bp, Homo sapiens
caagaaattgcctcctt

SEQ ID NO: 5290882 - DNA, 16 bp, Homo sapiens
caagaaatttgatttc

SEQ ID NO: 5290883 - DNA, 13 bp, Homo sapiens
caagaacaaacag

SEQ ID NO: 5290884 - DNA, 22 bp, Homo sapiens
caagaacaacaacaacaataac

SEQ ID NO: 5290885 - DNA, 16 bp, Homo sapiens
caagaacactggacct

SEQ ID NO: 5290886 - DNA, 13 bp, Homo sapiens
caagaacagcagg

SEQ ID NO: 5290887 - DNA, 21 bp, Homo sapiens
caagaacataaaccctccaag

SEQ ID NO: 5290888 - DNA, 12 bp, Homo sapiens
caagaaccagtt

SEQ ID NO: 5290889 - DNA, 16 bp, Homo sapiens
caagaaccatttgcaa

SEQ ID NO: 5290890 - DNA, 16 bp, Homo sapiens
caagaacccaagtgcc

SEQ ID NO: 5290891 - DNA, 19 bp, Homo sapiens
caagaacccaagtgcctca

SEQ ID NO: 5290892 - DNA, 19 bp, Homo sapiens
caagaactattgtgttttt

SEQ ID NO: 5290893 - DNA, 16 bp, Homo sapiens
caagaactcatcactg

SEQ ID NO: 5290894 - DNA, 17 bp, Homo sapiens
caagaactcattatttt

SEQ ID NO: 5290895 - DNA, 21 bp, Homo sapiens
caagaactcccttctcccctc

SEQ ID NO: 5290896 - DNA, 13 bp, Homo sapiens
caagaactcctcc

SEQ ID NO: 5290897 - DNA, 15 bp, Homo sapiens
caagaactgaaaaca

SEQ ID NO: 5290898 - DNA, 17 bp, Homo sapiens
caagaactgaaaacata

SEQ ID NO: 5290899 - DNA, 22 bp, Homo sapiens
caagaactgcagatagcccagg

SEQ ID NO: 5290900 - DNA, 23 bp, Homo sapiens
caagaactgcagatagcccagga

SEQ ID NO: 5290901 - DNA, 23 bp, Homo sapiens
caagaactgcatggacctaacat

SEQ ID NO: 5290902 - DNA, 22 bp, Homo sapiens
caagaacttctcgtagatgctg

SEQ ID NO: 5290903 - DNA, 17 bp, Homo sapiens
caagaagaaatatgaaa

SEQ ID NO: 5290904 - DNA, 22 bp, Homo sapiens
caagaagaaatgctttccaaaa

SEQ ID NO: 5290905 - DNA, 19 bp, Homo sapiens
caagaagaagggcacccta

SEQ ID NO: 5290906 - DNA, 17 bp, Homo sapiens
caagaagaatataaata

SEQ ID NO: 5290907 - DNA, 18 bp, Homo sapiens
caagaagaatataaataa

SEQ ID NO: 5290908 - DNA, 14 bp, Homo sapiens
caagaagaatgaac

SEQ ID NO: 5290909 - DNA, 19 bp, Homo sapiens
caagaagaattgactgatt

SEQ ID NO: 5290910 - DNA, 16 bp, Homo sapiens
caagaagactgtattt

SEQ ID NO: 5290911 - DNA, 20 bp, Homo sapiens
caagaagatagttgtaaaga

SEQ ID NO: 5290912 - DNA, 18 bp, Homo sapiens
caagaagatcacgctccc

SEQ ID NO: 5290913 - DNA, 23 bp, Homo sapiens
caagaagatcacgctccccgcct

SEQ ID NO: 5290914 - DNA, 14 bp, Homo sapiens
caagaagattctaa

SEQ ID NO: 5290915 - DNA, 21 bp, Homo sapiens
caagaagcaatgttataaagt

SEQ ID NO: 5290916 - DNA, 13 bp, Homo sapiens
caagaagcaggct

SEQ ID NO: 5290917 - DNA, 22 bp, Homo sapiens
atttctcatcaattctctatca

SEQ ID NO: 5290918 - DNA, 11 bp, Homo sapiens
atttctcatgt

SEQ ID NO: 5290919 - DNA, 13 bp, Homo sapiens
atttctcatgtgc

SEQ ID NO: 5290920 - DNA, 15 bp, Homo sapiens
atttctcatgtgctt

SEQ ID NO: 5290921 - DNA, 19 bp, Homo sapiens
atttctcatgtgctttgta

SEQ ID NO: 5290922 - DNA, 22 bp, Homo sapiens
atttctcatgttccttttgaaa

SEQ ID NO: 5290923 - DNA, 15 bp, Homo sapiens
atttctcattgactt

SEQ ID NO: 5290924 - DNA, 22 bp, Homo sapiens
atttctcattgcctcttctact

SEQ ID NO: 5290925 - DNA, 12 bp, Homo sapiens
atttctccagaa

SEQ ID NO: 5290926 - DNA, 16 bp, Homo sapiens
atttctccagaaattt

SEQ ID NO: 5290927 - DNA, 14 bp, Homo sapiens
atttctccagaccc

SEQ ID NO: 5290928 - DNA, 15 bp, Homo sapiens
atttctccagaccca

SEQ ID NO: 5290929 - DNA, 20 bp, Homo sapiens
atttctccagttgggactca

SEQ ID NO: 5290930 - DNA, 18 bp, Homo sapiens
atttctccatcccctccc

SEQ ID NO: 5290931 - DNA, 23 bp, Homo sapiens
atttctccatcccctccctgcct

SEQ ID NO: 5290932 - DNA, 18 bp, Homo sapiens
atttctccatcctgcaga

SEQ ID NO: 5290933 - DNA, 21 bp, Homo sapiens
atttctccccatggtagttta

SEQ ID NO: 5290934 - DNA, 15 bp, Homo sapiens
atttctcccttcaat

SEQ ID NO: 5290935 - DNA, 17 bp, Homo sapiens
atttctcctactttaca

SEQ ID NO: 5290936 - DNA, 21 bp, Homo sapiens
atttctcctttgataaaataa

SEQ ID NO: 5290937 - DNA, 20 bp, Homo sapiens
atttctcctttgcaatagca

SEQ ID NO: 5290938 - DNA, 20 bp, Homo sapiens
atttctctaactcctgccat

SEQ ID NO: 5290939 - DNA, 18 bp, Homo sapiens
atttctctacttgtcata

SEQ ID NO: 5290940 - DNA, 21 bp, Homo sapiens
atttctctagaggctggcaag

SEQ ID NO: 5290941 - DNA, 17 bp, Homo sapiens
atttctctagtagttaa

SEQ ID NO: 5290942 - DNA, 19 bp, Homo sapiens
atttctctcaatttgggtc

SEQ ID NO: 5290943 - DNA, 13 bp, Homo sapiens
atttctctctcca

SEQ ID NO: 5290944 - DNA, 22 bp, Homo sapiens
atttctctctccagtcttccac

SEQ ID NO: 5290945 - DNA, 15 bp, Homo sapiens
atttctctctcctgg

SEQ ID NO: 5290946 - DNA, 16 bp, Homo sapiens
atttctctctcctggt

SEQ ID NO: 5290947 - DNA, 23 bp, Homo sapiens
atttctctctcctggtgtgggta

SEQ ID NO: 5290948 - DNA, 22 bp, Homo sapiens
atttctctcttatatgccagaa

SEQ ID NO: 5290949 - DNA, 19 bp, Homo sapiens
atttctctgatttgcaaaa

SEQ ID NO: 5290950 - DNA, 18 bp, Homo sapiens
atttctcttactgcaaat

SEQ ID NO: 5290951 - DNA, 21 bp, Homo sapiens
atttctcttcagtgtgttgac

SEQ ID NO: 5290952 - DNA, 14 bp, Homo sapiens
atttctctttctct

SEQ ID NO: 5290953 - DNA, 19 bp, Homo sapiens
atttctcttttattctgtt

SEQ ID NO: 5290954 - DNA, 21 bp, Homo sapiens
atttctgaaaacctaccagcc

SEQ ID NO: 5290955 - DNA, 13 bp, Homo sapiens
atttctgaagagt

SEQ ID NO: 5290956 - DNA, 20 bp, Homo sapiens
atttctgaaggtagcattct

SEQ ID NO: 5290957 - DNA, 18 bp, Homo sapiens
atttctgaagtggactct

SEQ ID NO: 5290958 - DNA, 23 bp, Homo sapiens
atttctgaatctcgttgaggcca

SEQ ID NO: 5290959 - DNA, 16 bp, Homo sapiens
atttctgactcttatt

SEQ ID NO: 5290960 - DNA, 16 bp, Homo sapiens
atttctgagcaaagca

SEQ ID NO: 5290961 - DNA, 12 bp, Homo sapiens
atttctgataaa

SEQ ID NO: 5290962 - DNA, 15 bp, Homo sapiens
atttctgatcagagg

SEQ ID NO: 5290963 - DNA, 15 bp, Homo sapiens
atttctgatgatgtc

SEQ ID NO: 5290964 - DNA, 19 bp, Homo sapiens
atttctgatgtctccagat

SEQ ID NO: 5290965 - DNA, 16 bp, Homo sapiens
atttctgattctgatt

SEQ ID NO: 5290966 - DNA, 21 bp, Homo sapiens
atttctgcacaggtctctgtt

SEQ ID NO: 5290967 - DNA, 13 bp, Homo sapiens
atttctgccagcg

SEQ ID NO: 5290968 - DNA, 22 bp, Homo sapiens
atttctgccctcagcttcaaat

SEQ ID NO: 5290969 - DNA, 18 bp, Homo sapiens
atttctgccctgagccct

SEQ ID NO: 5290970 - DNA, 15 bp, Homo sapiens
atttctgccttcctt

SEQ ID NO: 5290971 - DNA, 15 bp, Homo sapiens
atttctgccttgaaa

SEQ ID NO: 5290972 - DNA, 17 bp, Homo sapiens
atttctgctaagttctc

SEQ ID NO: 5290973 - DNA, 18 bp, Homo sapiens
atttctgctaagttctcc

SEQ ID NO: 5290974 - DNA, 22 bp, Homo sapiens
atttctgctcagattcccccca

SEQ ID NO: 5290975 - DNA, 13 bp, Homo sapiens
atttctgctctgg

SEQ ID NO: 5290976 - DNA, 18 bp, Homo sapiens
atttctgctctggaataa

SEQ ID NO: 5290977 - DNA, 20 bp, Homo sapiens
atttctgctcttccaaagct

SEQ ID NO: 5290978 - DNA, 14 bp, Homo sapiens
atttctgctgaatt

SEQ ID NO: 5290979 - DNA, 21 bp, Homo sapiens
atttctgctgtggtctataaa

SEQ ID NO: 5290980 - DNA, 13 bp, Homo sapiens
atttctgcttcct

SEQ ID NO: 5290981 - DNA, 17 bp, Homo sapiens
atttctgctttctttga

SEQ ID NO: 5290982 - DNA, 19 bp, Homo sapiens
atttctggaatgcttctgc

SEQ ID NO: 5290983 - DNA, 17 bp, Homo sapiens
atttctggccatttaac

SEQ ID NO: 5290984 - DNA, 12 bp, Homo sapiens
atttctggcctc

SEQ ID NO: 5290985 - DNA, 15 bp, Homo sapiens
atttctggcctcagc

SEQ ID NO: 5290986 - DNA, 17 bp, Homo sapiens
atttctggctgggtcac

SEQ ID NO: 5290987 - DNA, 18 bp, Homo sapiens
atttctgggggccgcaga

SEQ ID NO: 5290988 - DNA, 21 bp, Homo sapiens
atttctggggggagaaaaaaa

SEQ ID NO: 5290989 - DNA, 12 bp, Homo sapiens
atttctggttga

SEQ ID NO: 5290990 - DNA, 17 bp, Homo sapiens
atttctgtaaataccat

SEQ ID NO: 5290991 - DNA, 23 bp, Homo sapiens
atttctgtaaataccattgacac

SEQ ID NO: 5290992 - DNA, 10 bp, Homo sapiens
atttctgtag

SEQ ID NO: 5290993 - DNA, 13 bp, Homo sapiens
atttctgtagaat

SEQ ID NO: 5290994 - DNA, 20 bp, Homo sapiens
atttctgtagaatgctgtag

SEQ ID NO: 5290995 - DNA, 21 bp, Homo sapiens
atttctgtaggagcaacttct

SEQ ID NO: 5290996 - DNA, 16 bp, Homo sapiens
atttctgtatactgta

SEQ ID NO: 5290997 - DNA, 22 bp, Homo sapiens
atttctgtatactgtaaaagtt

SEQ ID NO: 5290998 - DNA, 23 bp, Homo sapiens
atttctgtatactgtaaaagtta

SEQ ID NO: 5290999 - DNA, 13 bp, Homo sapiens
atttctgtatata

SEQ ID NO: 5291000 - DNA, 15 bp, Homo sapiens
atttctgtatataga

SEQ ID NO: 5291001 - DNA, 18 bp, Homo sapiens
atttctgtatatagatgt

SEQ ID NO: 5291002 - DNA, 22 bp, Homo sapiens
atttctgtatatagatgtctgt

SEQ ID NO: 5291003 - DNA, 23 bp, Homo sapiens
atttctgtatatagatgtctgtg

SEQ ID NO: 5291004 - DNA, 14 bp, Homo sapiens
atttctgtatattt

SEQ ID NO: 5291005 - DNA, 16 bp, Homo sapiens
atttctgtatatttgt

SEQ ID NO: 5291006 - DNA, 20 bp, Homo sapiens
atttctgtatatttgtcatg

SEQ ID NO: 5291007 - DNA, 16 bp, Homo sapiens
atttctgtatctgaca

SEQ ID NO: 5291008 - DNA, 18 bp, Homo sapiens
atttctgtatctgacata

SEQ ID NO: 5291009 - DNA, 17 bp, Homo sapiens
atttctgtatttggcta

SEQ ID NO: 5291010 - DNA, 20 bp, Homo sapiens
atttctgtattttttgtttg

SEQ ID NO: 5291011 - DNA, 15 bp, Homo sapiens
atttctgtgaaagaa

SEQ ID NO: 5291012 - DNA, 21 bp, Homo sapiens
atttctgtgccattttctgta

SEQ ID NO: 5291013 - DNA, 23 bp, Homo sapiens
atttctgtgccattttctgtaaa

SEQ ID NO: 5291014 - DNA, 20 bp, Homo sapiens
atttctgtggaaaacaattt

SEQ ID NO: 5291015 - DNA, 21 bp, Homo sapiens
atttctgtggagggttgccat

SEQ ID NO: 5291016 - DNA, 13 bp, Homo sapiens
atttctgtgggag

SEQ ID NO: 5291017 - DNA, 15 bp, Homo sapiens
atttctgtgtagtat

SEQ ID NO: 5291018 - DNA, 19 bp, Homo sapiens
atttctgtgtagtatttat

SEQ ID NO: 5291019 - DNA, 18 bp, Homo sapiens
atttctgtgtcctgtttt

SEQ ID NO: 5291020 - DNA, 23 bp, Homo sapiens
atttctgtgttgccaagctccaa

SEQ ID NO: 5291021 - DNA, 20 bp, Homo sapiens
atttctgttatttttaagct

SEQ ID NO: 5291022 - DNA, 23 bp, Homo sapiens
atttctgttatttttaagctttt

SEQ ID NO: 5291023 - DNA, 20 bp, Homo sapiens
atttctgttcctttttgtaa

SEQ ID NO: 5291024 - DNA, 16 bp, Homo sapiens
atttctgtttagataa

SEQ ID NO: 5291025 - DNA, 20 bp, Homo sapiens
atttctgtttagataataca

SEQ ID NO: 5291026 - DNA, 21 bp, Homo sapiens
atttctgtttagataatacac

SEQ ID NO: 5291027 - DNA, 23 bp, Homo sapiens
atttctgtttcctatttaataca

SEQ ID NO: 5291028 - DNA, 17 bp, Homo sapiens
atttctgtttgtttaag

SEQ ID NO: 5291029 - DNA, 20 bp, Homo sapiens
atttcttaaaactttattaa

SEQ ID NO: 5291030 - DNA, 16 bp, Homo sapiens
atttcttaaaatgttt

SEQ ID NO: 5291031 - DNA, 13 bp, Homo sapiens
atttcttaaacaa

SEQ ID NO: 5291032 - DNA, 14 bp, Homo sapiens
atttcttaaacact

SEQ ID NO: 5291033 - DNA, 14 bp, Homo sapiens
atttcttaaatctt

SEQ ID NO: 5291034 - DNA, 17 bp, Homo sapiens
atttcttaaatctttct

SEQ ID NO: 5291035 - DNA, 15 bp, Homo sapiens
atttcttaaattatt

SEQ ID NO: 5291036 - DNA, 15 bp, Homo sapiens
atttcttaaattttt

SEQ ID NO: 5291037 - DNA, 14 bp, Homo sapiens
atttcttaacttct

SEQ ID NO: 5291038 - DNA, 14 bp, Homo sapiens
atttcttaagaatt

SEQ ID NO: 5291039 - DNA, 15 bp, Homo sapiens
atttcttaagaattc

SEQ ID NO: 5291040 - DNA, 16 bp, Homo sapiens
atttcttaagaattca

SEQ ID NO: 5291041 - DNA, 20 bp, Homo sapiens
atttcttaagtataaacctt

SEQ ID NO: 5291042 - DNA, 20 bp, Homo sapiens
atttcttaataaaataattc

SEQ ID NO: 5291043 - DNA, 23 bp, Homo sapiens
atttcttaattattataaaaata

SEQ ID NO: 5291044 - DNA, 14 bp, Homo sapiens
atttcttaatttgg

SEQ ID NO: 5291045 - DNA, 22 bp, Homo sapiens
atttcttagtgcttcagagttt

SEQ ID NO: 5291046 - DNA, 22 bp, Homo sapiens
atttcttatacgcttttctttg

SEQ ID NO: 5291047 - DNA, 11 bp, Homo sapiens
atttcttatag

SEQ ID NO: 5291048 - DNA, 15 bp, Homo sapiens
atttcttatcaccac

SEQ ID NO: 5291049 - DNA, 19 bp, Homo sapiens
atttcttatcaccacagta

SEQ ID NO: 5291050 - DNA, 14 bp, Homo sapiens
atttcttatgattt

SEQ ID NO: 5291051 - DNA, 15 bp, Homo sapiens
atttcttatgatttt

SEQ ID NO: 5291052 - DNA, 19 bp, Homo sapiens
atttcttattgaatttgtt

SEQ ID NO: 5291053 - DNA, 11 bp, Homo sapiens
atttcttattt

SEQ ID NO: 5291054 - DNA, 15 bp, Homo sapiens
atttcttatttaatt

SEQ ID NO: 5291055 - DNA, 16 bp, Homo sapiens
atttcttatttgaaag

SEQ ID NO: 5291056 - DNA, 19 bp, Homo sapiens
atttcttatttgaaagtgt

SEQ ID NO: 5291057 - DNA, 22 bp, Homo sapiens
atttcttcaaaatgtatatatt

SEQ ID NO: 5291058 - DNA, 21 bp, Homo sapiens
atttcttcaaatccttccaaa

SEQ ID NO: 5291059 - DNA, 20 bp, Homo sapiens
atttcttcaaatctcagcaa

SEQ ID NO: 5291060 - DNA, 22 bp, Homo sapiens
atttcttcaaatctcagcaaag

SEQ ID NO: 5291061 - DNA, 13 bp, Homo sapiens
atttcttcactgt

SEQ ID NO: 5291062 - DNA, 14 bp, Homo sapiens
atttcttcagaatt

SEQ ID NO: 5291063 - DNA, 15 bp, Homo sapiens
atttcttcagagttt

SEQ ID NO: 5291064 - DNA, 21 bp, Homo sapiens
atttcttcagtcagaaaactt

SEQ ID NO: 5291065 - DNA, 20 bp, Homo sapiens
atttcttcatgtgatgtcat

SEQ ID NO: 5291066 - DNA, 22 bp, Homo sapiens
atttcttcatgtgatgtcatga

SEQ ID NO: 5291067 - DNA, 16 bp, Homo sapiens
atttcttccacaagag

SEQ ID NO: 5291068 - DNA, 20 bp, Homo sapiens
atttcttccacaagagccca

SEQ ID NO: 5291069 - DNA, 12 bp, Homo sapiens
atttcttccctg

SEQ ID NO: 5291070 - DNA, 15 bp, Homo sapiens
atttcttccctgctt

SEQ ID NO: 5291071 - DNA, 22 bp, Homo sapiens
atttcttccctgctttgcatct

SEQ ID NO: 5291072 - DNA, 19 bp, Homo sapiens
atttcttcctaccaagtca

SEQ ID NO: 5291073 - DNA, 23 bp, Homo sapiens
atttcttcctaccaagtcaaact

SEQ ID NO: 5291074 - DNA, 14 bp, Homo sapiens
atttcttcctatta

SEQ ID NO: 5291075 - DNA, 17 bp, Homo sapiens
atttcttccttgttgtt

SEQ ID NO: 5291076 - DNA, 18 bp, Homo sapiens
atttcttcgtgatgacat

SEQ ID NO: 5291077 - DNA, 17 bp, Homo sapiens
atttcttcgttcttttt

SEQ ID NO: 5291078 - DNA, 17 bp, Homo sapiens
atttcttctagaagata

SEQ ID NO: 5291079 - DNA, 14 bp, Homo sapiens
atttcttctctctg

SEQ ID NO: 5291080 - DNA, 16 bp, Homo sapiens
atttcttctctctgtt

SEQ ID NO: 5291081 - DNA, 20 bp, Homo sapiens
atttcttctcttatcctctc

SEQ ID NO: 5291082 - DNA, 15 bp, Homo sapiens
atttcttcttagaaa

SEQ ID NO: 5291083 - DNA, 17 bp, Homo sapiens
atttcttcttagaaaaa

SEQ ID NO: 5291084 - DNA, 18 bp, Homo sapiens
atttcttcttcacatcca

SEQ ID NO: 5291085 - DNA, 16 bp, Homo sapiens
atttcttcttctaaga

SEQ ID NO: 5291086 - DNA, 19 bp, Homo sapiens
atttcttcttctaagaaga

SEQ ID NO: 5291087 - DNA, 13 bp, Homo sapiens
atttcttctttat

SEQ ID NO: 5291088 - DNA, 13 bp, Homo sapiens
atttcttcttttc

SEQ ID NO: 5291089 - DNA, 20 bp, Homo sapiens
atttcttcttttcctgcagg

SEQ ID NO: 5291090 - DNA, 15 bp, Homo sapiens
atttcttgagtaatt

SEQ ID NO: 5291091 - DNA, 19 bp, Homo sapiens
atttcttgagtaatttaaa

SEQ ID NO: 5291092 - DNA, 22 bp, Homo sapiens
atttcttgcaatttgaaggtac

SEQ ID NO: 5291093 - DNA, 21 bp, Homo sapiens
atttcttgctctatctctcaa

SEQ ID NO: 5291094 - DNA, 13 bp, Homo sapiens
atttcttgctttc

SEQ ID NO: 5291095 - DNA, 14 bp, Homo sapiens
caagaagcaggcta

SEQ ID NO: 5291096 - DNA, 18 bp, Homo sapiens
caagaagcagtggcctta

SEQ ID NO: 5291097 - DNA, 17 bp, Homo sapiens
caagaagcattttgtaa

SEQ ID NO: 5291098 - DNA, 11 bp, Homo sapiens
caagaagccca

SEQ ID NO: 5291099 - DNA, 13 bp, Homo sapiens
caagaagcccagg

SEQ ID NO: 5291100 - DNA, 15 bp, Homo sapiens
caagaagcccaggaa

SEQ ID NO: 5291101 - DNA, 17 bp, Homo sapiens
caagaagccctccttgc

SEQ ID NO: 5291102 - DNA, 21 bp, Homo sapiens
caagaagccctccttgccacc

SEQ ID NO: 5291103 - DNA, 20 bp, Homo sapiens
caagaagctcccagatgctg

SEQ ID NO: 5291104 - DNA, 12 bp, Homo sapiens
caagaagctgct

SEQ ID NO: 5291105 - DNA, 21 bp, Homo sapiens
caagaaggaaagatttgtgaa

SEQ ID NO: 5291106 - DNA, 20 bp, Homo sapiens
caagaaggaaatagccaccg

SEQ ID NO: 5291107 - DNA, 20 bp, Homo sapiens
caagaaggaaggaggcagac

SEQ ID NO: 5291108 - DNA, 16 bp, Homo sapiens
caagaaggagaggaaa

SEQ ID NO: 5291109 - DNA, 15 bp, Homo sapiens
caagaaggccagccc

SEQ ID NO: 5291110 - DNA, 13 bp, Homo sapiens
caagaaggcgagt

SEQ ID NO: 5291111 - DNA, 18 bp, Homo sapiens
caagaagggactgagaga

SEQ ID NO: 5291112 - DNA, 13 bp, Homo sapiens
caagaagggctgc

SEQ ID NO: 5291113 - DNA, 16 bp, Homo sapiens
caagaagggctgcatg

SEQ ID NO: 5291114 - DNA, 17 bp, Homo sapiens
caagaagggctgcatga

SEQ ID NO: 5291115 - DNA, 20 bp, Homo sapiens
caagaagggctgcatgatgt

SEQ ID NO: 5291116 - DNA, 23 bp, Homo sapiens
caagaagggttttccaccctgga

SEQ ID NO: 5291117 - DNA, 16 bp, Homo sapiens
caagaaggtgagtgct

SEQ ID NO: 5291118 - DNA, 22 bp, Homo sapiens
caagaagtacatgaagagcagc

SEQ ID NO: 5291119 - DNA, 19 bp, Homo sapiens
caagaagtcaaagtaaaac

SEQ ID NO: 5291120 - DNA, 19 bp, Homo sapiens
caagaagtcagagaaaaca

SEQ ID NO: 5291121 - DNA, 22 bp, Homo sapiens
caagaagtcagagaaaacactt

SEQ ID NO: 5291122 - DNA, 21 bp, Homo sapiens
caagaagtcatacctttttct

SEQ ID NO: 5291123 - DNA, 20 bp, Homo sapiens
caagaagtcccctctcctcc

SEQ ID NO: 5291124 - DNA, 13 bp, Homo sapiens
caagaagtcttga

SEQ ID NO: 5291125 - DNA, 14 bp, Homo sapiens
caagaagtgaagaa

SEQ ID NO: 5291126 - DNA, 17 bp, Homo sapiens
caagaagtgaggcctgg

SEQ ID NO: 5291127 - DNA, 18 bp, Homo sapiens
caagaagtgaggcctggg

SEQ ID NO: 5291128 - DNA, 20 bp, Homo sapiens
caagaagtgagggaaggatg

SEQ ID NO: 5291129 - DNA, 14 bp, Homo sapiens
caagaagtgattag

SEQ ID NO: 5291130 - DNA, 20 bp, Homo sapiens
caagaagtgggagtgggaga

SEQ ID NO: 5291131 - DNA, 20 bp, Homo sapiens
caagaagttaaactattttg

SEQ ID NO: 5291132 - DNA, 15 bp, Homo sapiens
caagaagtttaagga

SEQ ID NO: 5291133 - DNA, 17 bp, Homo sapiens
caagaagtttattctca

SEQ ID NO: 5291134 - DNA, 16 bp, Homo sapiens
caagaagtttcttcag

SEQ ID NO: 5291135 - DNA, 17 bp, Homo sapiens
caagaataaaggcagct

SEQ ID NO: 5291136 - DNA, 20 bp, Homo sapiens
caagaataatcacgctttcc

SEQ ID NO: 5291137 - DNA, 13 bp, Homo sapiens
caagaatacttga

SEQ ID NO: 5291138 - DNA, 21 bp, Homo sapiens
caagaatattgcaaaatacat

SEQ ID NO: 5291139 - DNA, 23 bp, Homo sapiens
caagaatcattgacctaattgtt

SEQ ID NO: 5291140 - DNA, 18 bp, Homo sapiens
caagaatccacatttcta

SEQ ID NO: 5291141 - DNA, 18 bp, Homo sapiens
caagaatgcattccctga

SEQ ID NO: 5291142 - DNA, 15 bp, Homo sapiens
caagaatgctgaaac

SEQ ID NO: 5291143 - DNA, 15 bp, Homo sapiens
caagaatggtggctt

SEQ ID NO: 5291144 - DNA, 20 bp, Homo sapiens
caagaatggtggcttctttt

SEQ ID NO: 5291145 - DNA, 20 bp, Homo sapiens
caagaatgtacgtccagcct

SEQ ID NO: 5291146 - DNA, 13 bp, Homo sapiens
caagaattaaaac

SEQ ID NO: 5291147 - DNA, 15 bp, Homo sapiens
caagaattaaaactg

SEQ ID NO: 5291148 - DNA, 17 bp, Homo sapiens
caagaattaaaactgag

SEQ ID NO: 5291149 - DNA, 17 bp, Homo sapiens
caagaattaatatttat

SEQ ID NO: 5291150 - DNA, 19 bp, Homo sapiens
caagaattataacagcaag

SEQ ID NO: 5291151 - DNA, 20 bp, Homo sapiens
caagaattgtccatgtgctt

SEQ ID NO: 5291152 - DNA, 21 bp, Homo sapiens
caagaatttaaagaaatattt

SEQ ID NO: 5291153 - DNA, 20 bp, Homo sapiens
caagaatttctaggactgaa

SEQ ID NO: 5291154 - DNA, 23 bp, Homo sapiens
caagaatttctaggactgaatta

SEQ ID NO: 5291155 - DNA, 17 bp, Homo sapiens
caagacaaagcaaagcc

SEQ ID NO: 5291156 - DNA, 19 bp, Homo sapiens
caagacaagagctgttatg

SEQ ID NO: 5291157 - DNA, 23 bp, Homo sapiens
caagacaagagctgttatgctgt

SEQ ID NO: 5291158 - DNA, 15 bp, Homo sapiens
caagacaagctcctc

SEQ ID NO: 5291159 - DNA, 17 bp, Homo sapiens
caagacaagctcctccc

SEQ ID NO: 5291160 - DNA, 15 bp, Homo sapiens
caagacacagcaggg

SEQ ID NO: 5291161 - DNA, 15 bp, Homo sapiens
caagacacaggctca

SEQ ID NO: 5291162 - DNA, 19 bp, Homo sapiens
caagacacaggctcagcat

SEQ ID NO: 5291163 - DNA, 16 bp, Homo sapiens
caagacacccagtgga

SEQ ID NO: 5291164 - DNA, 20 bp, Homo sapiens
caagacaccttcccagctgc

SEQ ID NO: 5291165 - DNA, 13 bp, Homo sapiens
caagacacctttt

SEQ ID NO: 5291166 - DNA, 16 bp, Homo sapiens
caagacacgtggcctc

SEQ ID NO: 5291167 - DNA, 21 bp, Homo sapiens
caagacacgtggcctcgtgag

SEQ ID NO: 5291168 - DNA, 13 bp, Homo sapiens
caagacactgtgg

SEQ ID NO: 5291169 - DNA, 15 bp, Homo sapiens
caagacagaaaagtg

SEQ ID NO: 5291170 - DNA, 19 bp, Homo sapiens
caagacagaaaagtgcctg

SEQ ID NO: 5291171 - DNA, 18 bp, Homo sapiens
caagacagaagctgaagt

SEQ ID NO: 5291172 - DNA, 13 bp, Homo sapiens
caagacagactcg

SEQ ID NO: 5291173 - DNA, 12 bp, Homo sapiens
caagacagagac

SEQ ID NO: 5291174 - DNA, 16 bp, Homo sapiens
caagacagaggggagc

SEQ ID NO: 5291175 - DNA, 12 bp, Homo sapiens
caagacagatga

SEQ ID NO: 5291176 - DNA, 17 bp, Homo sapiens
caagacagatgagcagg

SEQ ID NO: 5291177 - DNA, 18 bp, Homo sapiens
caagacagatgagcagga

SEQ ID NO: 5291178 - DNA, 22 bp, Homo sapiens
caagacagatgagcaggagctt

SEQ ID NO: 5291179 - DNA, 16 bp, Homo sapiens
caagacagatgcccca

SEQ ID NO: 5291180 - DNA, 15 bp, Homo sapiens
caagacagattgtga

SEQ ID NO: 5291181 - DNA, 18 bp, Homo sapiens
caagacagattttcggaa

SEQ ID NO: 5291182 - DNA, 22 bp, Homo sapiens
caagacagcagagccatctgcg

SEQ ID NO: 5291183 - DNA, 12 bp, Homo sapiens
caagacagcagc

SEQ ID NO: 5291184 - DNA, 13 bp, Homo sapiens
caagacagcagca

SEQ ID NO: 5291185 - DNA, 14 bp, Homo sapiens
caagacagcagcag

SEQ ID NO: 5291186 - DNA, 15 bp, Homo sapiens
caagacagcagcagc

SEQ ID NO: 5291187 - DNA, 17 bp, Homo sapiens
caagacagcagcagcct

SEQ ID NO: 5291188 - DNA, 18 bp, Homo sapiens
caagacagcagcagcctg

SEQ ID NO: 5291189 - DNA, 19 bp, Homo sapiens
caagacagcagcagcctgc

SEQ ID NO: 5291190 - DNA, 18 bp, Homo sapiens
caagacagccatacttcc

SEQ ID NO: 5291191 - DNA, 12 bp, Homo sapiens
caagacagcctt

SEQ ID NO: 5291192 - DNA, 13 bp, Homo sapiens
caagacagccttc

SEQ ID NO: 5291193 - DNA, 15 bp, Homo sapiens
caagacagccttcac

SEQ ID NO: 5291194 - DNA, 20 bp, Homo sapiens
caagacagctcttcttgaaa

SEQ ID NO: 5291195 - DNA, 13 bp, Homo sapiens
caagacaggcaga

SEQ ID NO: 5291196 - DNA, 18 bp, Homo sapiens
caagacagtggcactaaa

SEQ ID NO: 5291197 - DNA, 15 bp, Homo sapiens
caagacagtggcagc

SEQ ID NO: 5291198 - DNA, 21 bp, Homo sapiens
caagacagttgtatcacaaag

SEQ ID NO: 5291199 - DNA, 13 bp, Homo sapiens
caagacattgtca

SEQ ID NO: 5291200 - DNA, 15 bp, Homo sapiens
caagacatttgctga

SEQ ID NO: 5291201 - DNA, 15 bp, Homo sapiens
caagaccaaagagcc

SEQ ID NO: 5291202 - DNA, 20 bp, Homo sapiens
caagaccaagcttagtcctg

SEQ ID NO: 5291203 - DNA, 21 bp, Homo sapiens
caagaccaagcttagtcctgg

SEQ ID NO: 5291204 - DNA, 22 bp, Homo sapiens
caagaccaagcttagtcctggg

SEQ ID NO: 5291205 - DNA, 19 bp, Homo sapiens
caagaccaagtcctcaaag

SEQ ID NO: 5291206 - DNA, 17 bp, Homo sapiens
caagaccaccagggtcc

SEQ ID NO: 5291207 - DNA, 18 bp, Homo sapiens
caagaccaccagggtccc

SEQ ID NO: 5291208 - DNA, 12 bp, Homo sapiens
caagaccagact

SEQ ID NO: 5291209 - DNA, 17 bp, Homo sapiens
caagaccagcctgtcca

SEQ ID NO: 5291210 - DNA, 13 bp, Homo sapiens
caagaccatgggg

SEQ ID NO: 5291211 - DNA, 19 bp, Homo sapiens
caagacccaaaaggcagaa

SEQ ID NO: 5291212 - DNA, 15 bp, Homo sapiens
caagacccccaggaa

SEQ ID NO: 5291213 - DNA, 22 bp, Homo sapiens
caagacccccatttgtcccaga

SEQ ID NO: 5291214 - DNA, 16 bp, Homo sapiens
caagaccctctcaggc

SEQ ID NO: 5291215 - DNA, 18 bp, Homo sapiens
caagacccttgtggtccc

SEQ ID NO: 5291216 - DNA, 23 bp, Homo sapiens
caagacccttgtggtcccacccc

SEQ ID NO: 5291217 - DNA, 21 bp, Homo sapiens
caagacccttttgggtttctg

SEQ ID NO: 5291218 - DNA, 15 bp, Homo sapiens
caagacctcagggca

SEQ ID NO: 5291219 - DNA, 23 bp, Homo sapiens
caagacctcagggcacaaagatg

SEQ ID NO: 5291220 - DNA, 24 bp, Homo sapiens
caagacctcagggcacaaagatgg

SEQ ID NO: 5291221 - DNA, 17 bp, Homo sapiens
caagacctcagtgcctt

SEQ ID NO: 5291222 - DNA, 16 bp, Homo sapiens
caagacctcatctgcc

SEQ ID NO: 5291223 - DNA, 18 bp, Homo sapiens
caagacctcatctgcctg

SEQ ID NO: 5291224 - DNA, 22 bp, Homo sapiens
caagacctcatctgtggagctg

SEQ ID NO: 5291225 - DNA, 14 bp, Homo sapiens
caagacgaggggca

SEQ ID NO: 5291226 - DNA, 16 bp, Homo sapiens
caagacgctgtgctgc

SEQ ID NO: 5291227 - DNA, 16 bp, Homo sapiens
caagacggggagtgag

SEQ ID NO: 5291228 - DNA, 14 bp, Homo sapiens
caagacgtaaagaa

SEQ ID NO: 5291229 - DNA, 13 bp, Homo sapiens
caagactaacctt

SEQ ID NO: 5291230 - DNA, 15 bp, Homo sapiens
caagactcagatgat

SEQ ID NO: 5291231 - DNA, 14 bp, Homo sapiens
caagactcagggga

SEQ ID NO: 5291232 - DNA, 18 bp, Homo sapiens
caagactcattgctggag

SEQ ID NO: 5291233 - DNA, 14 bp, Homo sapiens
caagactcccatga

SEQ ID NO: 5291234 - DNA, 18 bp, Homo sapiens
caagactcccatgaggga

SEQ ID NO: 5291235 - DNA, 11 bp, Homo sapiens
caagactcctc

SEQ ID NO: 5291236 - DNA, 14 bp, Homo sapiens
caagactctagagt

SEQ ID NO: 5291237 - DNA, 22 bp, Homo sapiens
caagactctgccttaatttttg

SEQ ID NO: 5291238 - DNA, 19 bp, Homo sapiens
caagactctgctctcctcg

SEQ ID NO: 5291239 - DNA, 23 bp, Homo sapiens
caagactctgtctaaaaaacaaa

SEQ ID NO: 5291240 - DNA, 22 bp, Homo sapiens
caagactctttatgatctggcc

SEQ ID NO: 5291241 - DNA, 22 bp, Homo sapiens
caagactgagccagcttagcaa

SEQ ID NO: 5291242 - DNA, 19 bp, Homo sapiens
caagactgcacatcaaaat

SEQ ID NO: 5291243 - DNA, 13 bp, Homo sapiens
caagactgccagg

SEQ ID NO: 5291244 - DNA, 14 bp, Homo sapiens
caagactgcctccc

SEQ ID NO: 5291245 - DNA, 17 bp, Homo sapiens
caagactgctccctttt

SEQ ID NO: 5291246 - DNA, 21 bp, Homo sapiens
caagactgctgtggccaggag

SEQ ID NO: 5291247 - DNA, 22 bp, Homo sapiens
caagactgctgtggccaggagg

SEQ ID NO: 5291248 - DNA, 19 bp, Homo sapiens
caagactggcccagtgcca

SEQ ID NO: 5291249 - DNA, 21 bp, Homo sapiens
caagactgtaaattccaaaga

SEQ ID NO: 5291250 - DNA, 23 bp, Homo sapiens
caagactgtcttacctggcagca

SEQ ID NO: 5291251 - DNA, 13 bp, Homo sapiens
caagactgtggta

SEQ ID NO: 5291252 - DNA, 14 bp, Homo sapiens
caagactgttgctc

SEQ ID NO: 5291253 - DNA, 15 bp, Homo sapiens
caagacttaaatagt

SEQ ID NO: 5291254 - DNA, 19 bp, Homo sapiens
caagacttcactgcagcct

SEQ ID NO: 5291255 - DNA, 13 bp, Homo sapiens
caagacttcagat

SEQ ID NO: 5291256 - DNA, 16 bp, Homo sapiens
caagacttcagtatgt

SEQ ID NO: 5291257 - DNA, 15 bp, Homo sapiens
caagacttggcaaca

SEQ ID NO: 5291258 - DNA, 18 bp, Homo sapiens
caagactttgatccttgg

SEQ ID NO: 5291259 - DNA, 15 bp, Homo sapiens
caagacttttctttg

SEQ ID NO: 5291260 - DNA, 17 bp, Homo sapiens
caagacttttctttgaa

SEQ ID NO: 5291261 - DNA, 20 bp, Homo sapiens
caagagaaaagaaaaatcaa

SEQ ID NO: 5291262 - DNA, 13 bp, Homo sapiens
caagagaaaataa

SEQ ID NO: 5291263 - DNA, 21 bp, Homo sapiens
caagagaaaggcctgcacaca

SEQ ID NO: 5291264 - DNA, 17 bp, Homo sapiens
caagagaaatgaggaag

SEQ ID NO: 5291265 - DNA, 18 bp, Homo sapiens
caagagaaatgaggaaga

SEQ ID NO: 5291266 - DNA, 23 bp, Homo sapiens
caagagaactcgcgctcagtaaa

SEQ ID NO: 5291267 - DNA, 17 bp, Homo sapiens
caagagaagaaaaaatt

SEQ ID NO: 5291268 - DNA, 19 bp, Homo sapiens
caagagaagaaaaaattaa

SEQ ID NO: 5291269 - DNA, 17 bp, Homo sapiens
caagagaagaaagtgaa

SEQ ID NO: 5291270 - DNA, 19 bp, Homo sapiens
caagagaaggagatgtaat

SEQ ID NO: 5291271 - DNA, 20 bp, Homo sapiens
caagagaaggagatgtaatg

SEQ ID NO: 5291272 - DNA, 21 bp, Homo sapiens
caagagaatttcaaggcaggg

SEQ ID NO: 5291273 - DNA, 16 bp, Homo sapiens
caagagacagagcccc

SEQ ID NO: 5291274 - DNA, 14 bp, Homo sapiens
atttcttggcaaat

SEQ ID NO: 5291275 - DNA, 12 bp, Homo sapiens
atttcttggcat

SEQ ID NO: 5291276 - DNA, 14 bp, Homo sapiens
atttcttggcatgc

SEQ ID NO: 5291277 - DNA, 22 bp, Homo sapiens
atttcttggcatgcatctttaa

SEQ ID NO: 5291278 - DNA, 16 bp, Homo sapiens
atttcttggcattgga

SEQ ID NO: 5291279 - DNA, 16 bp, Homo sapiens
atttcttgggccctcc

SEQ ID NO: 5291280 - DNA, 17 bp, Homo sapiens
atttcttgggccctcct

SEQ ID NO: 5291281 - DNA, 18 bp, Homo sapiens
atttcttgggccctcctg

SEQ ID NO: 5291282 - DNA, 20 bp, Homo sapiens
atttcttgggccctcctgaa

SEQ ID NO: 5291283 - DNA, 19 bp, Homo sapiens
atttcttggtatgatcatt

SEQ ID NO: 5291284 - DNA, 21 bp, Homo sapiens
atttcttgtagctaaaaataa

SEQ ID NO: 5291285 - DNA, 17 bp, Homo sapiens
atttcttgtgatgtatt

SEQ ID NO: 5291286 - DNA, 21 bp, Homo sapiens
atttcttgtgatgtattcttt

SEQ ID NO: 5291287 - DNA, 19 bp, Homo sapiens
atttcttgtgttctgtaga

SEQ ID NO: 5291288 - DNA, 22 bp, Homo sapiens
atttctttaaaaaagaaattat

SEQ ID NO: 5291289 - DNA, 21 bp, Homo sapiens
atttctttaaaagaatgacta

SEQ ID NO: 5291290 - DNA, 18 bp, Homo sapiens
atttctttaaatcattta

SEQ ID NO: 5291291 - DNA, 22 bp, Homo sapiens
atttctttaaatgtgtatttct

SEQ ID NO: 5291292 - DNA, 11 bp, Homo sapiens
atttctttaat

SEQ ID NO: 5291293 - DNA, 22 bp, Homo sapiens
atttctttaatctgttgtttga

SEQ ID NO: 5291294 - DNA, 21 bp, Homo sapiens
atttctttagaacaacataaa

SEQ ID NO: 5291295 - DNA, 19 bp, Homo sapiens
atttctttatataaggtca

SEQ ID NO: 5291296 - DNA, 16 bp, Homo sapiens
atttctttatatttat

SEQ ID NO: 5291297 - DNA, 21 bp, Homo sapiens
atttctttatatttatccact

SEQ ID NO: 5291298 - DNA, 16 bp, Homo sapiens
atttctttatgtggaa

SEQ ID NO: 5291299 - DNA, 17 bp, Homo sapiens
atttctttccttcccaa

SEQ ID NO: 5291300 - DNA, 18 bp, Homo sapiens
atttctttccttcccaat

SEQ ID NO: 5291301 - DNA, 14 bp, Homo sapiens
atttctttctgttt

SEQ ID NO: 5291302 - DNA, 13 bp, Homo sapiens
atttctttcttcc

SEQ ID NO: 5291303 - DNA, 17 bp, Homo sapiens
atttctttctttcctta

SEQ ID NO: 5291304 - DNA, 21 bp, Homo sapiens
atttctttctttgcaccaaag

SEQ ID NO: 5291305 - DNA, 23 bp, Homo sapiens
atttctttctttgcaccaaagac

SEQ ID NO: 5291306 - DNA, 16 bp, Homo sapiens
atttctttgaaaaaaa

SEQ ID NO: 5291307 - DNA, 16 bp, Homo sapiens
atttctttgaatgtat

SEQ ID NO: 5291308 - DNA, 21 bp, Homo sapiens
atttctttgatctggacagaa

SEQ ID NO: 5291309 - DNA, 16 bp, Homo sapiens
atttctttgcattcca

SEQ ID NO: 5291310 - DNA, 19 bp, Homo sapiens
atttctttgcctgttcagt

SEQ ID NO: 5291311 - DNA, 21 bp, Homo sapiens
atttctttgcctgttcagtta

SEQ ID NO: 5291312 - DNA, 14 bp, Homo sapiens
atttctttgctgta

SEQ ID NO: 5291313 - DNA, 13 bp, Homo sapiens
atttctttggaaa

SEQ ID NO: 5291314 - DNA, 15 bp, Homo sapiens
atttctttgtctttt

SEQ ID NO: 5291315 - DNA, 17 bp, Homo sapiens
atttctttgtctttttc

SEQ ID NO: 5291316 - DNA, 19 bp, Homo sapiens
atttctttgtctttttcct

SEQ ID NO: 5291317 - DNA, 22 bp, Homo sapiens
atttctttgtctttttcctact

SEQ ID NO: 5291318 - DNA, 21 bp, Homo sapiens
atttctttgtgataacaaaga

SEQ ID NO: 5291319 - DNA, 21 bp, Homo sapiens
atttctttgttatcaaacttc

SEQ ID NO: 5291320 - DNA, 19 bp, Homo sapiens
atttctttgttcccactgt

SEQ ID NO: 5291321 - DNA, 17 bp, Homo sapiens
atttcttttaaagaagt

SEQ ID NO: 5291322 - DNA, 18 bp, Homo sapiens
atttcttttaaagaagta

SEQ ID NO: 5291323 - DNA, 21 bp, Homo sapiens
atttcttttaaagaagtaaat

SEQ ID NO: 5291324 - DNA, 22 bp, Homo sapiens
atttcttttaaagaagtaaatt

SEQ ID NO: 5291325 - DNA, 16 bp, Homo sapiens
atttcttttactctgt

SEQ ID NO: 5291326 - DNA, 17 bp, Homo sapiens
atttcttttactctgtg

SEQ ID NO: 5291327 - DNA, 11 bp, Homo sapiens
atttcttttag

SEQ ID NO: 5291328 - DNA, 19 bp, Homo sapiens
atttcttttattaatactt

SEQ ID NO: 5291329 - DNA, 19 bp, Homo sapiens
atttcttttctttttacat

SEQ ID NO: 5291330 - DNA, 20 bp, Homo sapiens
atttcttttctttttacata

SEQ ID NO: 5291331 - DNA, 13 bp, Homo sapiens
atttcttttgtgc

SEQ ID NO: 5291332 - DNA, 15 bp, Homo sapiens
atttctttttatagg

SEQ ID NO: 5291333 - DNA, 14 bp, Homo sapiens
atttctttttgatt

SEQ ID NO: 5291334 - DNA, 18 bp, Homo sapiens
atttcttttttaaatgaa

SEQ ID NO: 5291335 - DNA, 17 bp, Homo sapiens
atttcttttttatgtga

SEQ ID NO: 5291336 - DNA, 18 bp, Homo sapiens
atttctttttttaaattg

SEQ ID NO: 5291337 - DNA, 22 bp, Homo sapiens
atttcttttttttaataaggaa

SEQ ID NO: 5291338 - DNA, 12 bp, Homo sapiens
atttgaaaaaac

SEQ ID NO: 5291339 - DNA, 16 bp, Homo sapiens
atttgaaaaaactttc

SEQ ID NO: 5291340 - DNA, 18 bp, Homo sapiens
atttgaaaaaactttctc

SEQ ID NO: 5291341 - DNA, 20 bp, Homo sapiens
atttgaaaaaactttctctt

SEQ ID NO: 5291342 - DNA, 21 bp, Homo sapiens
atttgaaaaaactttctcttt

SEQ ID NO: 5291343 - DNA, 15 bp, Homo sapiens
atttgaaaaaagaag

SEQ ID NO: 5291344 - DNA, 20 bp, Homo sapiens
atttgaaaaaagttactgca

SEQ ID NO: 5291345 - DNA, 12 bp, Homo sapiens
atttgaaaaaat

SEQ ID NO: 5291346 - DNA, 14 bp, Homo sapiens
atttgaaaaaatta

SEQ ID NO: 5291347 - DNA, 15 bp, Homo sapiens
atttgaaaaatataa

SEQ ID NO: 5291348 - DNA, 17 bp, Homo sapiens
atttgaaaacagaaatt

SEQ ID NO: 5291349 - DNA, 19 bp, Homo sapiens
atttgaaaacagaaattgg

SEQ ID NO: 5291350 - DNA, 20 bp, Homo sapiens
atttgaaaacagaaattggt

SEQ ID NO: 5291351 - DNA, 18 bp, Homo sapiens
atttgaaaatggttttga

SEQ ID NO: 5291352 - DNA, 12 bp, Homo sapiens
atttgaaaatta

SEQ ID NO: 5291353 - DNA, 15 bp, Homo sapiens
atttgaaaattgtat

SEQ ID NO: 5291354 - DNA, 14 bp, Homo sapiens
atttgaaaattttg

SEQ ID NO: 5291355 - DNA, 14 bp, Homo sapiens
atttgaaacacaag

SEQ ID NO: 5291356 - DNA, 14 bp, Homo sapiens
atttgaaacactgg

SEQ ID NO: 5291357 - DNA, 20 bp, Homo sapiens
atttgaaacattgcttttaa

SEQ ID NO: 5291358 - DNA, 17 bp, Homo sapiens
atttgaaacctttttct

SEQ ID NO: 5291359 - DNA, 17 bp, Homo sapiens
atttgaaactgctaatt

SEQ ID NO: 5291360 - DNA, 20 bp, Homo sapiens
atttgaaactgctaattaca

SEQ ID NO: 5291361 - DNA, 14 bp, Homo sapiens
atttgaaaggaaaa

SEQ ID NO: 5291362 - DNA, 17 bp, Homo sapiens
atttgaaaggaaaaaca

SEQ ID NO: 5291363 - DNA, 14 bp, Homo sapiens
atttgaaagtgcct

SEQ ID NO: 5291364 - DNA, 22 bp, Homo sapiens
atttgaaagtgcctttgcagct

SEQ ID NO: 5291365 - DNA, 18 bp, Homo sapiens
atttgaaagtttccttat

SEQ ID NO: 5291366 - DNA, 22 bp, Homo sapiens
atttgaaataaagtaattttta

SEQ ID NO: 5291367 - DNA, 15 bp, Homo sapiens
atttgaaataagaat

SEQ ID NO: 5291368 - DNA, 17 bp, Homo sapiens
atttgaaatactaaaag

SEQ ID NO: 5291369 - DNA, 17 bp, Homo sapiens
atttgaaatagtataca

SEQ ID NO: 5291370 - DNA, 21 bp, Homo sapiens
atttgaaatagtatacattgt

SEQ ID NO: 5291371 - DNA, 22 bp, Homo sapiens
atttgaaatccaaactactttc

SEQ ID NO: 5291372 - DNA, 13 bp, Homo sapiens
atttgaaatgttt

SEQ ID NO: 5291373 - DNA, 21 bp, Homo sapiens
atttgaaattttatttagttc

SEQ ID NO: 5291374 - DNA, 17 bp, Homo sapiens
atttgaacaatgaagtt

SEQ ID NO: 5291375 - DNA, 18 bp, Homo sapiens
atttgaacaatgaagttg

SEQ ID NO: 5291376 - DNA, 20 bp, Homo sapiens
atttgaacaatgaagttgaa

SEQ ID NO: 5291377 - DNA, 22 bp, Homo sapiens
atttgaacagttggctgtatga

SEQ ID NO: 5291378 - DNA, 15 bp, Homo sapiens
atttgaaccaaaaca

SEQ ID NO: 5291379 - DNA, 20 bp, Homo sapiens
atttgaaccaggccttctga

SEQ ID NO: 5291380 - DNA, 16 bp, Homo sapiens
atttgaagaaaaaaat

SEQ ID NO: 5291381 - DNA, 17 bp, Homo sapiens
atttgaagaccaaagtt

SEQ ID NO: 5291382 - DNA, 19 bp, Homo sapiens
atttgaagatagaaggttt

SEQ ID NO: 5291383 - DNA, 16 bp, Homo sapiens
atttgaagcaaagcac

SEQ ID NO: 5291384 - DNA, 13 bp, Homo sapiens
atttgaagcagct

SEQ ID NO: 5291385 - DNA, 18 bp, Homo sapiens
atttgaagcagctctgcc

SEQ ID NO: 5291386 - DNA, 20 bp, Homo sapiens
atttgaagcagctctgcctt

SEQ ID NO: 5291387 - DNA, 23 bp, Homo sapiens
atttgaagcatgctctgtaagtt

SEQ ID NO: 5291388 - DNA, 18 bp, Homo sapiens
atttgaaggtagaatgtt

SEQ ID NO: 5291389 - DNA, 22 bp, Homo sapiens
atttgaagtaacttatttgact

SEQ ID NO: 5291390 - DNA, 13 bp, Homo sapiens
atttgaagtgtaa

SEQ ID NO: 5291391 - DNA, 17 bp, Homo sapiens
atttgaagtgtacctgt

SEQ ID NO: 5291392 - DNA, 19 bp, Homo sapiens
atttgaataaactctcccc

SEQ ID NO: 5291393 - DNA, 16 bp, Homo sapiens
atttgaataagcagaa

SEQ ID NO: 5291394 - DNA, 19 bp, Homo sapiens
atttgaataataaatcgat

SEQ ID NO: 5291395 - DNA, 14 bp, Homo sapiens
atttgaataatgtc

SEQ ID NO: 5291396 - DNA, 21 bp, Homo sapiens
atttgaataatgtctagattt

SEQ ID NO: 5291397 - DNA, 15 bp, Homo sapiens
atttgaatcttgtct

SEQ ID NO: 5291398 - DNA, 13 bp, Homo sapiens
atttgaatgaaaa

SEQ ID NO: 5291399 - DNA, 14 bp, Homo sapiens
atttgaatgaaaaa

SEQ ID NO: 5291400 - DNA, 15 bp, Homo sapiens
atttgaatgaaaaat

SEQ ID NO: 5291401 - DNA, 15 bp, Homo sapiens
atttgaatgaaaaca

SEQ ID NO: 5291402 - DNA, 20 bp, Homo sapiens
atttgaatgatttttcttta

SEQ ID NO: 5291403 - DNA, 16 bp, Homo sapiens
atttgaatgcattttg

SEQ ID NO: 5291404 - DNA, 18 bp, Homo sapiens
atttgaatgggtccattt

SEQ ID NO: 5291405 - DNA, 11 bp, Homo sapiens
atttgaatgta

SEQ ID NO: 5291406 - DNA, 23 bp, Homo sapiens
atttgaatgtatgcttcatacag

SEQ ID NO: 5291407 - DNA, 22 bp, Homo sapiens
atttgaatgtgtgaattcaata

SEQ ID NO: 5291408 - DNA, 13 bp, Homo sapiens
atttgaatgttaa

SEQ ID NO: 5291409 - DNA, 17 bp, Homo sapiens
atttgaattatttctgt

SEQ ID NO: 5291410 - DNA, 15 bp, Homo sapiens
atttgaattttgtgt

SEQ ID NO: 5291411 - DNA, 19 bp, Homo sapiens
atttgacacaaagcttcta

SEQ ID NO: 5291412 - DNA, 22 bp, Homo sapiens
atttgacacaaagcttctaaag

SEQ ID NO: 5291413 - DNA, 13 bp, Homo sapiens
atttgacacactc

SEQ ID NO: 5291414 - DNA, 14 bp, Homo sapiens
atttgacagacatc

SEQ ID NO: 5291415 - DNA, 18 bp, Homo sapiens
atttgacagacatccttg

SEQ ID NO: 5291416 - DNA, 17 bp, Homo sapiens
atttgacatagtctggc

SEQ ID NO: 5291417 - DNA, 23 bp, Homo sapiens
atttgaccagaaaatatgatata

SEQ ID NO: 5291418 - DNA, 22 bp, Homo sapiens
atttgaccagaactttttcctc

SEQ ID NO: 5291419 - DNA, 18 bp, Homo sapiens
atttgacctaatcactaa

SEQ ID NO: 5291420 - DNA, 22 bp, Homo sapiens
atttgacctaatcactaatttt

SEQ ID NO: 5291421 - DNA, 11 bp, Homo sapiens
atttgacctcc

SEQ ID NO: 5291422 - DNA, 19 bp, Homo sapiens
atttgacgttgttgtcatt

SEQ ID NO: 5291423 - DNA, 22 bp, Homo sapiens
atttgacgttgttgtcattgtc

SEQ ID NO: 5291424 - DNA, 12 bp, Homo sapiens
atttgactaatt

SEQ ID NO: 5291425 - DNA, 17 bp, Homo sapiens
atttgactaattttaca

SEQ ID NO: 5291426 - DNA, 12 bp, Homo sapiens
atttgactcttt

SEQ ID NO: 5291427 - DNA, 18 bp, Homo sapiens
atttgactctttcaaaga

SEQ ID NO: 5291428 - DNA, 19 bp, Homo sapiens
atttgactctttcaaagaa

SEQ ID NO: 5291429 - DNA, 16 bp, Homo sapiens
atttgacttgaatatg

SEQ ID NO: 5291430 - DNA, 21 bp, Homo sapiens
atttgacttgcatgaagagaa

SEQ ID NO: 5291431 - DNA, 15 bp, Homo sapiens
atttgacttttctgt

SEQ ID NO: 5291432 - DNA, 19 bp, Homo sapiens
atttgagaaaataaagcta

SEQ ID NO: 5291433 - DNA, 20 bp, Homo sapiens
atttgagaaaatataataaa

SEQ ID NO: 5291434 - DNA, 23 bp, Homo sapiens
atttgagaaaatataataaaaga

SEQ ID NO: 5291435 - DNA, 19 bp, Homo sapiens
atttgagaagataatcatt

SEQ ID NO: 5291436 - DNA, 20 bp, Homo sapiens
atttgagaagctgctcaact

SEQ ID NO: 5291437 - DNA, 22 bp, Homo sapiens
atttgagaataagttcatacaa

SEQ ID NO: 5291438 - DNA, 23 bp, Homo sapiens
atttgagaatagacccttactag

SEQ ID NO: 5291439 - DNA, 13 bp, Homo sapiens
atttgagacattc

SEQ ID NO: 5291440 - DNA, 15 bp, Homo sapiens
atttgagacattcca

SEQ ID NO: 5291441 - DNA, 16 bp, Homo sapiens
atttgagactgaaatt

SEQ ID NO: 5291442 - DNA, 21 bp, Homo sapiens
atttgagactgaaatttagta

SEQ ID NO: 5291443 - DNA, 12 bp, Homo sapiens
atttgagagaat

SEQ ID NO: 5291444 - DNA, 13 bp, Homo sapiens
atttgagataaag

SEQ ID NO: 5291445 - DNA, 21 bp, Homo sapiens
atttgagatgtatttcaactt

SEQ ID NO: 5291446 - DNA, 12 bp, Homo sapiens
atttgagatttt

SEQ ID NO: 5291447 - DNA, 16 bp, Homo sapiens
atttgagcaagtaaca

SEQ ID NO: 5291448 - DNA, 14 bp, Homo sapiens
atttgagcaattca

SEQ ID NO: 5291449 - DNA, 13 bp, Homo sapiens
atttgagcagctg

SEQ ID NO: 5291450 - DNA, 16 bp, Homo sapiens
atttgagcagggctca

SEQ ID NO: 5291451 - DNA, 14 bp, Homo sapiens
atttgagcatgcac

SEQ ID NO: 5291452 - DNA, 18 bp, Homo sapiens
caagagacatggaagaga

SEQ ID NO: 5291453 - DNA, 15 bp, Homo sapiens
caagagaccacttcc

SEQ ID NO: 5291454 - DNA, 18 bp, Homo sapiens
caagagaccacttcctta

SEQ ID NO: 5291455 - DNA, 20 bp, Homo sapiens
caagagaccacttccttaac

SEQ ID NO: 5291456 - DNA, 23 bp, Homo sapiens
caagagaccacttccttaacagc

SEQ ID NO: 5291457 - DNA, 16 bp, Homo sapiens
caagagactactctgc

SEQ ID NO: 5291458 - DNA, 13 bp, Homo sapiens
caagagactgagt

SEQ ID NO: 5291459 - DNA, 20 bp, Homo sapiens
caagagactgcttgacaaag

SEQ ID NO: 5291460 - DNA, 14 bp, Homo sapiens
caagagagaaagaa

SEQ ID NO: 5291461 - DNA, 13 bp, Homo sapiens
caagagagacagc

SEQ ID NO: 5291462 - DNA, 21 bp, Homo sapiens
caagagagacagcacaggcag

SEQ ID NO: 5291463 - DNA, 13 bp, Homo sapiens
caagagagatgtt

SEQ ID NO: 5291464 - DNA, 15 bp, Homo sapiens
caagagagcagcaag

SEQ ID NO: 5291465 - DNA, 20 bp, Homo sapiens
caagagagcagcgcccaggc

SEQ ID NO: 5291466 - DNA, 22 bp, Homo sapiens
caagagagcagcgcccaggcct

SEQ ID NO: 5291467 - DNA, 23 bp, Homo sapiens
caagagaggaaggacccctcacc

SEQ ID NO: 5291468 - DNA, 12 bp, Homo sapiens
caagagaggaga

SEQ ID NO: 5291469 - DNA, 20 bp, Homo sapiens
caagagagggccatgcaatt

SEQ ID NO: 5291470 - DNA, 16 bp, Homo sapiens
caagagatctgtgtgg

SEQ ID NO: 5291471 - DNA, 20 bp, Homo sapiens
caagagatctgtgtggctcc

SEQ ID NO: 5291472 - DNA, 21 bp, Homo sapiens
caagagatctgtgtggctcct

SEQ ID NO: 5291473 - DNA, 23 bp, Homo sapiens
caagagatgaagagtgagagggc

SEQ ID NO: 5291474 - DNA, 16 bp, Homo sapiens
caagagatgggacaag

SEQ ID NO: 5291475 - DNA, 17 bp, Homo sapiens
caagagattatgtaact

SEQ ID NO: 5291476 - DNA, 13 bp, Homo sapiens
caagagcacactt

SEQ ID NO: 5291477 - DNA, 18 bp, Homo sapiens
caagagcagcctgtggca

SEQ ID NO: 5291478 - DNA, 20 bp, Homo sapiens
caagagcagcctgtggcatc

SEQ ID NO: 5291479 - DNA, 13 bp, Homo sapiens
caagagcaggagg

SEQ ID NO: 5291480 - DNA, 17 bp, Homo sapiens
caagagcaggaggtgcc

SEQ ID NO: 5291481 - DNA, 20 bp, Homo sapiens
caagagcatcatgcctctga

SEQ ID NO: 5291482 - DNA, 22 bp, Homo sapiens
caagagcatcgtgacccttcag

SEQ ID NO: 5291483 - DNA, 11 bp, Homo sapiens
caagagccagg

SEQ ID NO: 5291484 - DNA, 12 bp, Homo sapiens
caagagccaggg

SEQ ID NO: 5291485 - DNA, 23 bp, Homo sapiens
caagagccaggggtgtcccagtc

SEQ ID NO: 5291486 - DNA, 14 bp, Homo sapiens
caagagccatctga

SEQ ID NO: 5291487 - DNA, 13 bp, Homo sapiens
caagagcccagca

SEQ ID NO: 5291488 - DNA, 13 bp, Homo sapiens
caagagcccaggc

SEQ ID NO: 5291489 - DNA, 17 bp, Homo sapiens
caagagcccccttgaca

SEQ ID NO: 5291490 - DNA, 17 bp, Homo sapiens
caagagccctgtggccg

SEQ ID NO: 5291491 - DNA, 16 bp, Homo sapiens
caagagcctgagactg

SEQ ID NO: 5291492 - DNA, 23 bp, Homo sapiens
caagagcctgagagtgaggtgga

SEQ ID NO: 5291493 - DNA, 23 bp, Homo sapiens
caagagcctgatctcttcctgtt

SEQ ID NO: 5291494 - DNA, 12 bp, Homo sapiens
caagagccttaa

SEQ ID NO: 5291495 - DNA, 14 bp, Homo sapiens
caagagccttaaaa

SEQ ID NO: 5291496 - DNA, 17 bp, Homo sapiens
caagagccttaaaacat

SEQ ID NO: 5291497 - DNA, 18 bp, Homo sapiens
caagagcgttactgtaga

SEQ ID NO: 5291498 - DNA, 19 bp, Homo sapiens
caagagcgttactgtagac

SEQ ID NO: 5291499 - DNA, 13 bp, Homo sapiens
caagagctccttg

SEQ ID NO: 5291500 - DNA, 12 bp, Homo sapiens
caagagctgagg

SEQ ID NO: 5291501 - DNA, 14 bp, Homo sapiens
caagagctgctgtc

SEQ ID NO: 5291502 - DNA, 15 bp, Homo sapiens
caagagctgctgtcc

SEQ ID NO: 5291503 - DNA, 24 bp, Homo sapiens
caagagctgttatgctgtttccta

SEQ ID NO: 5291504 - DNA, 19 bp, Homo sapiens
caagagcttccagagctct

SEQ ID NO: 5291505 - DNA, 16 bp, Homo sapiens
caagaggaaaaacagg

SEQ ID NO: 5291506 - DNA, 21 bp, Homo sapiens
caagaggaaaaacagggaaaa

SEQ ID NO: 5291507 - DNA, 20 bp, Homo sapiens
caagaggaaaaatactaaga

SEQ ID NO: 5291508 - DNA, 16 bp, Homo sapiens
caagaggaaaagctaa

SEQ ID NO: 5291509 - DNA, 22 bp, Homo sapiens
caagaggaaaagctgtaagaaa

SEQ ID NO: 5291510 - DNA, 12 bp, Homo sapiens
caagaggaatga

SEQ ID NO: 5291511 - DNA, 15 bp, Homo sapiens
caagaggacacaatg

SEQ ID NO: 5291512 - DNA, 14 bp, Homo sapiens
caagaggagatcca

SEQ ID NO: 5291513 - DNA, 21 bp, Homo sapiens
caagaggagcccccaccctgt

SEQ ID NO: 5291514 - DNA, 22 bp, Homo sapiens
caagaggagttctaacacattt

SEQ ID NO: 5291515 - DNA, 14 bp, Homo sapiens
caagaggcaaagga

SEQ ID NO: 5291516 - DNA, 19 bp, Homo sapiens
caagaggcaagctgaaatt

SEQ ID NO: 5291517 - DNA, 15 bp, Homo sapiens
caagaggcccaggga

SEQ ID NO: 5291518 - DNA, 20 bp, Homo sapiens
caagaggcctcatgcctgct

SEQ ID NO: 5291519 - DNA, 20 bp, Homo sapiens
caagaggcgtgtgcaggccg

SEQ ID NO: 5291520 - DNA, 18 bp, Homo sapiens
caagaggctagccccagg

SEQ ID NO: 5291521 - DNA, 19 bp, Homo sapiens
caagaggctagccccaggg

SEQ ID NO: 5291522 - DNA, 21 bp, Homo sapiens
caagaggctagccccagggtg

SEQ ID NO: 5291523 - DNA, 23 bp, Homo sapiens
caagaggctagccccagggtgag

SEQ ID NO: 5291524 - DNA, 16 bp, Homo sapiens
caagaggctccctcct

SEQ ID NO: 5291525 - DNA, 17 bp, Homo sapiens
caagaggctgagacagg

SEQ ID NO: 5291526 - DNA, 14 bp, Homo sapiens
caagaggctgcagc

SEQ ID NO: 5291527 - DNA, 17 bp, Homo sapiens
caagagggaacaaaact

SEQ ID NO: 5291528 - DNA, 22 bp, Homo sapiens
caagagggaatagtatagacaa

SEQ ID NO: 5291529 - DNA, 22 bp, Homo sapiens
caagagggactccaagccctgg

SEQ ID NO: 5291530 - DNA, 12 bp, Homo sapiens
caagagggaggg

SEQ ID NO: 5291531 - DNA, 15 bp, Homo sapiens
caagagggcaaagct

SEQ ID NO: 5291532 - DNA, 16 bp, Homo sapiens
caagagggcaaagctg

SEQ ID NO: 5291533 - DNA, 15 bp, Homo sapiens
caagagggcaagcct

SEQ ID NO: 5291534 - DNA, 13 bp, Homo sapiens
caagagggctgct

SEQ ID NO: 5291535 - DNA, 21 bp, Homo sapiens
caagaggggcgggctcagagc

SEQ ID NO: 5291536 - DNA, 14 bp, Homo sapiens
caagagggggtgga

SEQ ID NO: 5291537 - DNA, 21 bp, Homo sapiens
caagagggggtggaggggtgt

SEQ ID NO: 5291538 - DNA, 17 bp, Homo sapiens
caagagggtctgaggaa

SEQ ID NO: 5291539 - DNA, 20 bp, Homo sapiens
caagaggtaccaaaaaagaa

SEQ ID NO: 5291540 - DNA, 12 bp, Homo sapiens
caagaggtctga

SEQ ID NO: 5291541 - DNA, 14 bp, Homo sapiens
caagaggtttcagc

SEQ ID NO: 5291542 - DNA, 14 bp, Homo sapiens
caagagtaaatatt

SEQ ID NO: 5291543 - DNA, 15 bp, Homo sapiens
caagagtatgtggca

SEQ ID NO: 5291544 - DNA, 19 bp, Homo sapiens
caagagtccaagccatctg

SEQ ID NO: 5291545 - DNA, 22 bp, Homo sapiens
caagagtccctttgaagataat

SEQ ID NO: 5291546 - DNA, 14 bp, Homo sapiens
caagagtccggatt

SEQ ID NO: 5291547 - DNA, 22 bp, Homo sapiens
caagagtcgctgtgccacaggc

SEQ ID NO: 5291548 - DNA, 15 bp, Homo sapiens
caagagtctaaagat

SEQ ID NO: 5291549 - DNA, 14 bp, Homo sapiens
caagagtctctcca

SEQ ID NO: 5291550 - DNA, 20 bp, Homo sapiens
caagagtctctccagcctca

SEQ ID NO: 5291551 - DNA, 18 bp, Homo sapiens
caagagtctgtctcaaaa

SEQ ID NO: 5291552 - DNA, 20 bp, Homo sapiens
caagagtgaattccctcact

SEQ ID NO: 5291553 - DNA, 19 bp, Homo sapiens
caagagtgatgggaaagac

SEQ ID NO: 5291554 - DNA, 15 bp, Homo sapiens
caagagtgattcttg

SEQ ID NO: 5291555 - DNA, 19 bp, Homo sapiens
caagagtgattcttgctgc

SEQ ID NO: 5291556 - DNA, 22 bp, Homo sapiens
caagagtggactgaatgtgcct

SEQ ID NO: 5291557 - DNA, 21 bp, Homo sapiens
caagagtggagagaagctctt

SEQ ID NO: 5291558 - DNA, 14 bp, Homo sapiens
caagagtggcccca

SEQ ID NO: 5291559 - DNA, 19 bp, Homo sapiens
caagagtggccccacctgg

SEQ ID NO: 5291560 - DNA, 15 bp, Homo sapiens
caagagtgggctttg

SEQ ID NO: 5291561 - DNA, 14 bp, Homo sapiens
caagagtgggggga

SEQ ID NO: 5291562 - DNA, 18 bp, Homo sapiens
caagagtggtggcagctc

SEQ ID NO: 5291563 - DNA, 20 bp, Homo sapiens
caagagtgtctatggagcag

SEQ ID NO: 5291564 - DNA, 13 bp, Homo sapiens
caagagtttcttg

SEQ ID NO: 5291565 - DNA, 16 bp, Homo sapiens
caagagtttgttctgt

SEQ ID NO: 5291566 - DNA, 22 bp, Homo sapiens
caagataaaggaagtcaccaaa

SEQ ID NO: 5291567 - DNA, 16 bp, Homo sapiens
caagataaaggacagt

SEQ ID NO: 5291568 - DNA, 17 bp, Homo sapiens
caagataaattgagcta

SEQ ID NO: 5291569 - DNA, 15 bp, Homo sapiens
caagataagcctgag

SEQ ID NO: 5291570 - DNA, 15 bp, Homo sapiens
caagatacacttgta

SEQ ID NO: 5291571 - DNA, 21 bp, Homo sapiens
caagatacatatgaggacaag

SEQ ID NO: 5291572 - DNA, 18 bp, Homo sapiens
caagatacatttcatctg

SEQ ID NO: 5291573 - DNA, 16 bp, Homo sapiens
caagatacctaaaaga

SEQ ID NO: 5291574 - DNA, 14 bp, Homo sapiens
caagatactggact

SEQ ID NO: 5291575 - DNA, 18 bp, Homo sapiens
caagatagcatcccatct

SEQ ID NO: 5291576 - DNA, 18 bp, Homo sapiens
caagataggagttctctg

SEQ ID NO: 5291577 - DNA, 13 bp, Homo sapiens
caagatagtcttc

SEQ ID NO: 5291578 - DNA, 15 bp, Homo sapiens
caagatattgtacat

SEQ ID NO: 5291579 - DNA, 21 bp, Homo sapiens
caagatattgtacataaaaga

SEQ ID NO: 5291580 - DNA, 21 bp, Homo sapiens
caagatcaaaaaggcttataa

SEQ ID NO: 5291581 - DNA, 14 bp, Homo sapiens
caagatcacaaata

SEQ ID NO: 5291582 - DNA, 18 bp, Homo sapiens
caagatcacaaatagtgt

SEQ ID NO: 5291583 - DNA, 20 bp, Homo sapiens
caagatcattatcttcatgt

SEQ ID NO: 5291584 - DNA, 15 bp, Homo sapiens
caagatccatttgcc

SEQ ID NO: 5291585 - DNA, 15 bp, Homo sapiens
caagatcccatttga

SEQ ID NO: 5291586 - DNA, 21 bp, Homo sapiens
caagatcgcaccactgcactc

SEQ ID NO: 5291587 - DNA, 15 bp, Homo sapiens
caagatctacaggac

SEQ ID NO: 5291588 - DNA, 13 bp, Homo sapiens
caagatctgccag

SEQ ID NO: 5291589 - DNA, 17 bp, Homo sapiens
caagatctgccagacct

SEQ ID NO: 5291590 - DNA, 21 bp, Homo sapiens
caagatctgccagacctgcat

SEQ ID NO: 5291591 - DNA, 15 bp, Homo sapiens
caagatctgtgcagc

SEQ ID NO: 5291592 - DNA, 18 bp, Homo sapiens
caagatcttgtctccact

SEQ ID NO: 5291593 - DNA, 21 bp, Homo sapiens
caagatcttgtctccactaaa

SEQ ID NO: 5291594 - DNA, 14 bp, Homo sapiens
caagatctttacat

SEQ ID NO: 5291595 - DNA, 15 bp, Homo sapiens
caagatctttcagga

SEQ ID NO: 5291596 - DNA, 16 bp, Homo sapiens
caagatgaaataattt

SEQ ID NO: 5291597 - DNA, 18 bp, Homo sapiens
caagatgaaattccattt

SEQ ID NO: 5291598 - DNA, 18 bp, Homo sapiens
caagatgaaggagaggca

SEQ ID NO: 5291599 - DNA, 23 bp, Homo sapiens
caagatgaatgcagattacactg

SEQ ID NO: 5291600 - DNA, 23 bp, Homo sapiens
caagatgagattggcatggcttt

SEQ ID NO: 5291601 - DNA, 16 bp, Homo sapiens
caagatgagcctgggc

SEQ ID NO: 5291602 - DNA, 22 bp, Homo sapiens
caagatgatttttaagtacaaa

SEQ ID NO: 5291603 - DNA, 20 bp, Homo sapiens
caagatgccccagggatggg

SEQ ID NO: 5291604 - DNA, 13 bp, Homo sapiens
caagatgcctgat

SEQ ID NO: 5291605 - DNA, 15 bp, Homo sapiens
caagatgcctgatca

SEQ ID NO: 5291606 - DNA, 16 bp, Homo sapiens
caagatggaaaggatt

SEQ ID NO: 5291607 - DNA, 17 bp, Homo sapiens
caagatggaagtcacct

SEQ ID NO: 5291608 - DNA, 14 bp, Homo sapiens
caagatggagagga

SEQ ID NO: 5291609 - DNA, 19 bp, Homo sapiens
caagatggagaggaagaaa

SEQ ID NO: 5291610 - DNA, 13 bp, Homo sapiens
caagatggcacag

SEQ ID NO: 5291611 - DNA, 20 bp, Homo sapiens
caagatggcacagggcatga

SEQ ID NO: 5291612 - DNA, 15 bp, Homo sapiens
caagatggcccatcc

SEQ ID NO: 5291613 - DNA, 15 bp, Homo sapiens
caagatggctgctgc

SEQ ID NO: 5291614 - DNA, 16 bp, Homo sapiens
caagatggctgctgcc

SEQ ID NO: 5291615 - DNA, 18 bp, Homo sapiens
caagatgggcatcttttg

SEQ ID NO: 5291616 - DNA, 19 bp, Homo sapiens
caagatgggggcagggctg

SEQ ID NO: 5291617 - DNA, 20 bp, Homo sapiens
caagatgggggcagggctgt

SEQ ID NO: 5291618 - DNA, 19 bp, Homo sapiens
caagatgggtgattatgaa

SEQ ID NO: 5291619 - DNA, 21 bp, Homo sapiens
caagatggtgttatcttttga

SEQ ID NO: 5291620 - DNA, 13 bp, Homo sapiens
caagatggttcta

SEQ ID NO: 5291621 - DNA, 16 bp, Homo sapiens
caagatggttctagca

SEQ ID NO: 5291622 - DNA, 15 bp, Homo sapiens
caagatgtagcacct

SEQ ID NO: 5291623 - DNA, 15 bp, Homo sapiens
caagatgtcagactg

SEQ ID NO: 5291624 - DNA, 18 bp, Homo sapiens
caagatgttatattaaag

SEQ ID NO: 5291625 - DNA, 17 bp, Homo sapiens
caagatgttctcctgat

SEQ ID NO: 5291626 - DNA, 15 bp, Homo sapiens
caagatgtttatctg

SEQ ID NO: 5291627 - DNA, 20 bp, Homo sapiens
caagatgtttcttatattat

SEQ ID NO: 5291628 - DNA, 14 bp, Homo sapiens
caagatgtttcttg

SEQ ID NO: 5291629 - DNA, 23 bp, Homo sapiens
caagatgttttgtataaaatctg

SEQ ID NO: 5291630 - DNA, 21 bp, Homo sapiens
caagattaagttataccagca

SEQ ID NO: 5291631 - DNA, 15 bp, Homo sapiens
atttgagcatgcaca

SEQ ID NO: 5291632 - DNA, 18 bp, Homo sapiens
atttgagccatttaaaga

SEQ ID NO: 5291633 - DNA, 14 bp, Homo sapiens
atttgagcccagga

SEQ ID NO: 5291634 - DNA, 19 bp, Homo sapiens
atttgaggactgaagctgg

SEQ ID NO: 5291635 - DNA, 22 bp, Homo sapiens
atttgaggagcagcttcagttg

SEQ ID NO: 5291636 - DNA, 16 bp, Homo sapiens
atttgaggagtgttaa

SEQ ID NO: 5291637 - DNA, 20 bp, Homo sapiens
atttgaggatttagaagtgt

SEQ ID NO: 5291638 - DNA, 22 bp, Homo sapiens
atttgaggatttagaagtgtca

SEQ ID NO: 5291639 - DNA, 23 bp, Homo sapiens
atttgaggatttagaagtgtcat

SEQ ID NO: 5291640 - DNA, 15 bp, Homo sapiens
atttgaggggccagg

SEQ ID NO: 5291641 - DNA, 14 bp, Homo sapiens
atttgaggtcagtg

SEQ ID NO: 5291642 - DNA, 16 bp, Homo sapiens
atttgaggtcagtgtt

SEQ ID NO: 5291643 - DNA, 17 bp, Homo sapiens
atttgaggtctgttctt

SEQ ID NO: 5291644 - DNA, 14 bp, Homo sapiens
atttgagtgtatat

SEQ ID NO: 5291645 - DNA, 20 bp, Homo sapiens
atttgagttaacctttaaga

SEQ ID NO: 5291646 - DNA, 17 bp, Homo sapiens
atttgagttgtgattga

SEQ ID NO: 5291647 - DNA, 23 bp, Homo sapiens
atttgagtttagggttctggtgt

SEQ ID NO: 5291648 - DNA, 18 bp, Homo sapiens
atttgagtttctttcaga

SEQ ID NO: 5291649 - DNA, 19 bp, Homo sapiens
atttgagtttctttcagat

SEQ ID NO: 5291650 - DNA, 22 bp, Homo sapiens
atttgagttttgttgaaaagat

SEQ ID NO: 5291651 - DNA, 16 bp, Homo sapiens
atttgataatcagttt

SEQ ID NO: 5291652 - DNA, 16 bp, Homo sapiens
atttgataatgataaa

SEQ ID NO: 5291653 - DNA, 20 bp, Homo sapiens
atttgataattttgaaatga

SEQ ID NO: 5291654 - DNA, 14 bp, Homo sapiens
atttgatacaaaat

SEQ ID NO: 5291655 - DNA, 20 bp, Homo sapiens
atttgatatacagacctcca

SEQ ID NO: 5291656 - DNA, 13 bp, Homo sapiens
atttgatatgcac

SEQ ID NO: 5291657 - DNA, 18 bp, Homo sapiens
atttgatatgtgaacagt

SEQ ID NO: 5291658 - DNA, 15 bp, Homo sapiens
atttgatattatcta

SEQ ID NO: 5291659 - DNA, 14 bp, Homo sapiens
atttgatatttggt

SEQ ID NO: 5291660 - DNA, 17 bp, Homo sapiens
atttgatatttttccat

SEQ ID NO: 5291661 - DNA, 18 bp, Homo sapiens
atttgatatttttccatt

SEQ ID NO: 5291662 - DNA, 17 bp, Homo sapiens
atttgatcgttccagtt

SEQ ID NO: 5291663 - DNA, 20 bp, Homo sapiens
atttgatctggtgcgtgtgg

SEQ ID NO: 5291664 - DNA, 17 bp, Homo sapiens
atttgatctttgtttaa

SEQ ID NO: 5291665 - DNA, 18 bp, Homo sapiens
atttgatctttgtttaaa

SEQ ID NO: 5291666 - DNA, 15 bp, Homo sapiens
atttgatgaaagctg

SEQ ID NO: 5291667 - DNA, 16 bp, Homo sapiens
atttgatgaaagctga

SEQ ID NO: 5291668 - DNA, 21 bp, Homo sapiens
atttgatgaaagctgattact

SEQ ID NO: 5291669 - DNA, 17 bp, Homo sapiens
atttgatgactgaaaat

SEQ ID NO: 5291670 - DNA, 18 bp, Homo sapiens
atttgatgactgaaaatg

SEQ ID NO: 5291671 - DNA, 17 bp, Homo sapiens
atttgatgagttaactg

SEQ ID NO: 5291672 - DNA, 16 bp, Homo sapiens
atttgatgatagcaga

SEQ ID NO: 5291673 - DNA, 17 bp, Homo sapiens
atttgatgatagcagac

SEQ ID NO: 5291674 - DNA, 17 bp, Homo sapiens
atttgatgatgttaaat

SEQ ID NO: 5291675 - DNA, 19 bp, Homo sapiens
atttgatgatgttaaatgt

SEQ ID NO: 5291676 - DNA, 19 bp, Homo sapiens
atttgatgcccagataata

SEQ ID NO: 5291677 - DNA, 16 bp, Homo sapiens
atttgatgctgtttga

SEQ ID NO: 5291678 - DNA, 22 bp, Homo sapiens
atttgatggcttgggaaactga

SEQ ID NO: 5291679 - DNA, 17 bp, Homo sapiens
atttgatggtatttctt

SEQ ID NO: 5291680 - DNA, 19 bp, Homo sapiens
atttgatggtatttctttc

SEQ ID NO: 5291681 - DNA, 16 bp, Homo sapiens
atttgatggtgaatat

SEQ ID NO: 5291682 - DNA, 13 bp, Homo sapiens
atttgatgtaagt

SEQ ID NO: 5291683 - DNA, 14 bp, Homo sapiens
atttgatgtaagtt

SEQ ID NO: 5291684 - DNA, 15 bp, Homo sapiens
atttgatgtacatgt

SEQ ID NO: 5291685 - DNA, 17 bp, Homo sapiens
atttgatgtacatgtgt

SEQ ID NO: 5291686 - DNA, 18 bp, Homo sapiens
atttgatgtacatgtgta

SEQ ID NO: 5291687 - DNA, 18 bp, Homo sapiens
atttgattaaattatgaa

SEQ ID NO: 5291688 - DNA, 14 bp, Homo sapiens
atttgattaacaaa

SEQ ID NO: 5291689 - DNA, 17 bp, Homo sapiens
atttgattaacaaatat

SEQ ID NO: 5291690 - DNA, 16 bp, Homo sapiens
atttgattaacatttg

SEQ ID NO: 5291691 - DNA, 13 bp, Homo sapiens
atttgattaataa

SEQ ID NO: 5291692 - DNA, 14 bp, Homo sapiens
atttgattaataaa

SEQ ID NO: 5291693 - DNA, 14 bp, Homo sapiens
atttgattatgtat

SEQ ID NO: 5291694 - DNA, 21 bp, Homo sapiens
atttgattatgtatggatata

SEQ ID NO: 5291695 - DNA, 16 bp, Homo sapiens
atttgattatttaaga

SEQ ID NO: 5291696 - DNA, 15 bp, Homo sapiens
atttgattcaaaata

SEQ ID NO: 5291697 - DNA, 16 bp, Homo sapiens
atttgattcaaaatat

SEQ ID NO: 5291698 - DNA, 13 bp, Homo sapiens
atttgattcgtat

SEQ ID NO: 5291699 - DNA, 23 bp, Homo sapiens
atttgattcttaactaaaattgt

SEQ ID NO: 5291700 - DNA, 14 bp, Homo sapiens
atttgatttaaaca

SEQ ID NO: 5291701 - DNA, 14 bp, Homo sapiens
atttgatttattaa

SEQ ID NO: 5291702 - DNA, 17 bp, Homo sapiens
atttgatttattaactt

SEQ ID NO: 5291703 - DNA, 13 bp, Homo sapiens
atttgatttccat

SEQ ID NO: 5291704 - DNA, 16 bp, Homo sapiens
atttgatttcgatgta

SEQ ID NO: 5291705 - DNA, 13 bp, Homo sapiens
atttgatttctaa

SEQ ID NO: 5291706 - DNA, 18 bp, Homo sapiens
atttgatttgaaaagtat

SEQ ID NO: 5291707 - DNA, 16 bp, Homo sapiens
atttgatttgtacaga

SEQ ID NO: 5291708 - DNA, 21 bp, Homo sapiens
atttgatttgttcatgaatat

SEQ ID NO: 5291709 - DNA, 18 bp, Homo sapiens
atttgcaaaatggaaatg

SEQ ID NO: 5291710 - DNA, 21 bp, Homo sapiens
atttgcaaaccctttgtatta

SEQ ID NO: 5291711 - DNA, 21 bp, Homo sapiens
atttgcaaataaaggctctgg

SEQ ID NO: 5291712 - DNA, 13 bp, Homo sapiens
atttgcaacactg

SEQ ID NO: 5291713 - DNA, 18 bp, Homo sapiens
atttgcaacactgccaaa

SEQ ID NO: 5291714 - DNA, 20 bp, Homo sapiens
atttgcaacaggggaggaaa

SEQ ID NO: 5291715 - DNA, 14 bp, Homo sapiens
atttgcaacattta

SEQ ID NO: 5291716 - DNA, 15 bp, Homo sapiens
atttgcaacatttac

SEQ ID NO: 5291717 - DNA, 18 bp, Homo sapiens
atttgcaactttagaaag

SEQ ID NO: 5291718 - DNA, 17 bp, Homo sapiens
atttgcaaggctgattt

SEQ ID NO: 5291719 - DNA, 21 bp, Homo sapiens
atttgcaaggctgatttatgg

SEQ ID NO: 5291720 - DNA, 15 bp, Homo sapiens
atttgcaagggaaaa

SEQ ID NO: 5291721 - DNA, 21 bp, Homo sapiens
atttgcaatgggatgtatgaa

SEQ ID NO: 5291722 - DNA, 15 bp, Homo sapiens
atttgcaatttgagc

SEQ ID NO: 5291723 - DNA, 22 bp, Homo sapiens
atttgcaatttgagccatttaa

SEQ ID NO: 5291724 - DNA, 14 bp, Homo sapiens
atttgcacaatatt

SEQ ID NO: 5291725 - DNA, 15 bp, Homo sapiens
atttgcacacaaaaa

SEQ ID NO: 5291726 - DNA, 16 bp, Homo sapiens
atttgcacacaaaaat

SEQ ID NO: 5291727 - DNA, 15 bp, Homo sapiens
atttgcacacaaaac

SEQ ID NO: 5291728 - DNA, 21 bp, Homo sapiens
atttgcacacaaaacatctta

SEQ ID NO: 5291729 - DNA, 14 bp, Homo sapiens
atttgcacagaaga

SEQ ID NO: 5291730 - DNA, 17 bp, Homo sapiens
atttgcacattaaatga

SEQ ID NO: 5291731 - DNA, 19 bp, Homo sapiens
atttgcacattaaatgact

SEQ ID NO: 5291732 - DNA, 21 bp, Homo sapiens
atttgcacattaaatgactct

SEQ ID NO: 5291733 - DNA, 14 bp, Homo sapiens
atttgcaccagttt

SEQ ID NO: 5291734 - DNA, 16 bp, Homo sapiens
atttgcaccagtttta

SEQ ID NO: 5291735 - DNA, 16 bp, Homo sapiens
atttgcacggtttgtg

SEQ ID NO: 5291736 - DNA, 13 bp, Homo sapiens
atttgcactgctt

SEQ ID NO: 5291737 - DNA, 21 bp, Homo sapiens
atttgcactggagttctatgc

SEQ ID NO: 5291738 - DNA, 17 bp, Homo sapiens
atttgcacttatgtact

SEQ ID NO: 5291739 - DNA, 21 bp, Homo sapiens
atttgcagaccaggaaggaag

SEQ ID NO: 5291740 - DNA, 15 bp, Homo sapiens
atttgcagagacagg

SEQ ID NO: 5291741 - DNA, 16 bp, Homo sapiens
atttgcagatgttcaa

SEQ ID NO: 5291742 - DNA, 19 bp, Homo sapiens
atttgcagatgttcaaata

SEQ ID NO: 5291743 - DNA, 21 bp, Homo sapiens
atttgcagctgagagaaaata

SEQ ID NO: 5291744 - DNA, 14 bp, Homo sapiens
atttgcagctgctg

SEQ ID NO: 5291745 - DNA, 17 bp, Homo sapiens
atttgcagctgctggtt

SEQ ID NO: 5291746 - DNA, 16 bp, Homo sapiens
atttgcagcttccaat

SEQ ID NO: 5291747 - DNA, 10 bp, Homo sapiens
atttgcagtc

SEQ ID NO: 5291748 - DNA, 21 bp, Homo sapiens
atttgcataatatgcatatat

SEQ ID NO: 5291749 - DNA, 17 bp, Homo sapiens
atttgcatacattcttc

SEQ ID NO: 5291750 - DNA, 17 bp, Homo sapiens
atttgcatatgtatgac

SEQ ID NO: 5291751 - DNA, 18 bp, Homo sapiens
atttgcatattctattgt

SEQ ID NO: 5291752 - DNA, 19 bp, Homo sapiens
atttgcatattctattgta

SEQ ID NO: 5291753 - DNA, 14 bp, Homo sapiens
atttgcatatttat

SEQ ID NO: 5291754 - DNA, 20 bp, Homo sapiens
atttgcatatttatttcaga

SEQ ID NO: 5291755 - DNA, 21 bp, Homo sapiens
atttgcatatttatttcagat

SEQ ID NO: 5291756 - DNA, 20 bp, Homo sapiens
atttgcatattttgagaaac

SEQ ID NO: 5291757 - DNA, 22 bp, Homo sapiens
atttgcatatttttctaaagaa

SEQ ID NO: 5291758 - DNA, 14 bp, Homo sapiens
atttgcatccagca

SEQ ID NO: 5291759 - DNA, 15 bp, Homo sapiens
atttgcatctgaaat

SEQ ID NO: 5291760 - DNA, 12 bp, Homo sapiens
atttgcatgaaa

SEQ ID NO: 5291761 - DNA, 13 bp, Homo sapiens
atttgcatggatt

SEQ ID NO: 5291762 - DNA, 22 bp, Homo sapiens
atttgcatggctccagaaatgt

SEQ ID NO: 5291763 - DNA, 20 bp, Homo sapiens
atttgcattactctggtgga

SEQ ID NO: 5291764 - DNA, 16 bp, Homo sapiens
atttgcattgaacaca

SEQ ID NO: 5291765 - DNA, 19 bp, Homo sapiens
atttgcattgaggaaatat

SEQ ID NO: 5291766 - DNA, 15 bp, Homo sapiens
atttgcattgggcat

SEQ ID NO: 5291767 - DNA, 16 bp, Homo sapiens
atttgcattgggcatt

SEQ ID NO: 5291768 - DNA, 19 bp, Homo sapiens
atttgcattttttaaattt

SEQ ID NO: 5291769 - DNA, 16 bp, Homo sapiens
atttgccaataaagct

SEQ ID NO: 5291770 - DNA, 14 bp, Homo sapiens
atttgccaatcttt

SEQ ID NO: 5291771 - DNA, 21 bp, Homo sapiens
atttgccacttagtattttaa

SEQ ID NO: 5291772 - DNA, 18 bp, Homo sapiens
atttgccagacagagatc

SEQ ID NO: 5291773 - DNA, 13 bp, Homo sapiens
atttgccagagga

SEQ ID NO: 5291774 - DNA, 11 bp, Homo sapiens
atttgccagca

SEQ ID NO: 5291775 - DNA, 24 bp, Homo sapiens
atttgccatgggcttcactgtata

SEQ ID NO: 5291776 - DNA, 21 bp, Homo sapiens
atttgccattggtttctgaaa

SEQ ID NO: 5291777 - DNA, 15 bp, Homo sapiens
atttgcccaaatctt

SEQ ID NO: 5291778 - DNA, 14 bp, Homo sapiens
atttgcccctggca

SEQ ID NO: 5291779 - DNA, 18 bp, Homo sapiens
atttgcccctggcaaatg

SEQ ID NO: 5291780 - DNA, 21 bp, Homo sapiens
atttgccctaagaactttgag

SEQ ID NO: 5291781 - DNA, 15 bp, Homo sapiens
atttgccgatttcct

SEQ ID NO: 5291782 - DNA, 16 bp, Homo sapiens
atttgcctaaatactt

SEQ ID NO: 5291783 - DNA, 21 bp, Homo sapiens
atttgcctaatatgatgactg

SEQ ID NO: 5291784 - DNA, 18 bp, Homo sapiens
atttgcctaattcctggc

SEQ ID NO: 5291785 - DNA, 21 bp, Homo sapiens
atttgcctcaccttggggcct

SEQ ID NO: 5291786 - DNA, 14 bp, Homo sapiens
atttgcctctgtcc

SEQ ID NO: 5291787 - DNA, 14 bp, Homo sapiens
atttgcctgcctgg

SEQ ID NO: 5291788 - DNA, 21 bp, Homo sapiens
atttgcctgcctgggcctccc

SEQ ID NO: 5291789 - DNA, 14 bp, Homo sapiens
atttgcctgcttct

SEQ ID NO: 5291790 - DNA, 11 bp, Homo sapiens
atttgcctgta

SEQ ID NO: 5291791 - DNA, 15 bp, Homo sapiens
atttgcctgtaacaa

SEQ ID NO: 5291792 - DNA, 12 bp, Homo sapiens
atttgcctgtct

SEQ ID NO: 5291793 - DNA, 16 bp, Homo sapiens
atttgccttcagtctt

SEQ ID NO: 5291794 - DNA, 18 bp, Homo sapiens
atttgccttttaaattct

SEQ ID NO: 5291795 - DNA, 15 bp, Homo sapiens
atttgcgaatggttc

SEQ ID NO: 5291796 - DNA, 22 bp, Homo sapiens
atttgcgtaaatggttttcaac

SEQ ID NO: 5291797 - DNA, 17 bp, Homo sapiens
atttgctaaatatttct

SEQ ID NO: 5291798 - DNA, 23 bp, Homo sapiens
atttgctaaatgctgttcttaca

SEQ ID NO: 5291799 - DNA, 16 bp, Homo sapiens
atttgctaaggcagct

SEQ ID NO: 5291800 - DNA, 20 bp, Homo sapiens
atttgctaagtgtatgatgt

SEQ ID NO: 5291801 - DNA, 22 bp, Homo sapiens
atttgctaataccaactatttc

SEQ ID NO: 5291802 - DNA, 23 bp, Homo sapiens
atttgctaatcaaagccagggtc

SEQ ID NO: 5291803 - DNA, 14 bp, Homo sapiens
atttgctaatgaat

SEQ ID NO: 5291804 - DNA, 16 bp, Homo sapiens
atttgctaatttttat

SEQ ID NO: 5291805 - DNA, 16 bp, Homo sapiens
atttgctactgtacat

SEQ ID NO: 5291806 - DNA, 21 bp, Homo sapiens
atttgctagcagtaaaagatg

SEQ ID NO: 5291807 - DNA, 19 bp, Homo sapiens
atttgctagttctgctgcc

SEQ ID NO: 5291808 - DNA, 15 bp, Homo sapiens
atttgctatataatt

SEQ ID NO: 5291809 - DNA, 15 bp, Homo sapiens
atttgctatctctat

SEQ ID NO: 5291810 - DNA, 21 bp, Homo sapiens
atttgctatctgaactaattc

SEQ ID NO: 5291811 - DNA, 20 bp, Homo sapiens
caagattagaagctgaaaac

SEQ ID NO: 5291812 - DNA, 16 bp, Homo sapiens
caagattaggaagtca

SEQ ID NO: 5291813 - DNA, 21 bp, Homo sapiens
caagattatattataataatg

SEQ ID NO: 5291814 - DNA, 15 bp, Homo sapiens
caagattcaaagaga

SEQ ID NO: 5291815 - DNA, 18 bp, Homo sapiens
caagattcacacctgact

SEQ ID NO: 5291816 - DNA, 19 bp, Homo sapiens
caagattcacacctgactc

SEQ ID NO: 5291817 - DNA, 14 bp, Homo sapiens
caagattcccagag

SEQ ID NO: 5291818 - DNA, 15 bp, Homo sapiens
caagattcccaggag

SEQ ID NO: 5291819 - DNA, 16 bp, Homo sapiens
caagattcccaggagt

SEQ ID NO: 5291820 - DNA, 18 bp, Homo sapiens
caagattccggatcctaa

SEQ ID NO: 5291821 - DNA, 13 bp, Homo sapiens
caagattctagat

SEQ ID NO: 5291822 - DNA, 14 bp, Homo sapiens
caagattctagatg

SEQ ID NO: 5291823 - DNA, 18 bp, Homo sapiens
caagattctagatgatta

SEQ ID NO: 5291824 - DNA, 17 bp, Homo sapiens
caagattctgaaacatt

SEQ ID NO: 5291825 - DNA, 17 bp, Homo sapiens
caagattctgtgggcag

SEQ ID NO: 5291826 - DNA, 17 bp, Homo sapiens
caagattgagctctctg

SEQ ID NO: 5291827 - DNA, 20 bp, Homo sapiens
caagattgagctctctgccc

SEQ ID NO: 5291828 - DNA, 19 bp, Homo sapiens
caagattgatcatttttat

SEQ ID NO: 5291829 - DNA, 14 bp, Homo sapiens
caagattggaaaga

SEQ ID NO: 5291830 - DNA, 20 bp, Homo sapiens
caagattggaaagacaggaa

SEQ ID NO: 5291831 - DNA, 22 bp, Homo sapiens
caagattggaaagacaggaaga

SEQ ID NO: 5291832 - DNA, 20 bp, Homo sapiens
caagattgtgtcccattccc

SEQ ID NO: 5291833 - DNA, 14 bp, Homo sapiens
caagattgttgata

SEQ ID NO: 5291834 - DNA, 16 bp, Homo sapiens
caagatttaaatgcca

SEQ ID NO: 5291835 - DNA, 23 bp, Homo sapiens
caagatttaacactaaaaaggtt

SEQ ID NO: 5291836 - DNA, 15 bp, Homo sapiens
caagatttagaaaaa

SEQ ID NO: 5291837 - DNA, 18 bp, Homo sapiens
caagatttccctaaaaat

SEQ ID NO: 5291838 - DNA, 17 bp, Homo sapiens
caagatttgaccaaatc

SEQ ID NO: 5291839 - DNA, 17 bp, Homo sapiens
caagatttgtaattaca

SEQ ID NO: 5291840 - DNA, 21 bp, Homo sapiens
caagattttagggcttttatt

SEQ ID NO: 5291841 - DNA, 18 bp, Homo sapiens
caagattttccacaagat

SEQ ID NO: 5291842 - DNA, 16 bp, Homo sapiens
caagattttccttttt

SEQ ID NO: 5291843 - DNA, 22 bp, Homo sapiens
caagattttccttttttataca

SEQ ID NO: 5291844 - DNA, 22 bp, Homo sapiens
caagattttgaatgcttcctga

SEQ ID NO: 5291845 - DNA, 12 bp, Homo sapiens
caagattttgtt

SEQ ID NO: 5291846 - DNA, 15 bp, Homo sapiens
caagatttttttcct

SEQ ID NO: 5291847 - DNA, 16 bp, Homo sapiens
caagatttttttcctg

SEQ ID NO: 5291848 - DNA, 23 bp, Homo sapiens
caagattttttttttaagtgaca

SEQ ID NO: 5291849 - DNA, 16 bp, Homo sapiens
caagcaaaatttctgt

SEQ ID NO: 5291850 - DNA, 19 bp, Homo sapiens
caagcaaaccaatggtgat

SEQ ID NO: 5291851 - DNA, 16 bp, Homo sapiens
caagcaaaccttctca

SEQ ID NO: 5291852 - DNA, 15 bp, Homo sapiens
caagcaaactgaaat

SEQ ID NO: 5291853 - DNA, 17 bp, Homo sapiens
caagcaaactgaaatta

SEQ ID NO: 5291854 - DNA, 18 bp, Homo sapiens
caagcaaagacagtttct

SEQ ID NO: 5291855 - DNA, 11 bp, Homo sapiens
caagcaaagca

SEQ ID NO: 5291856 - DNA, 21 bp, Homo sapiens
caagcaaagtatcaaagaaaa

SEQ ID NO: 5291857 - DNA, 22 bp, Homo sapiens
caagcaaagtattgtgaaagta

SEQ ID NO: 5291858 - DNA, 14 bp, Homo sapiens
caagcaaatataaa

SEQ ID NO: 5291859 - DNA, 19 bp, Homo sapiens
caagcaaatgtgaatcatt

SEQ ID NO: 5291860 - DNA, 15 bp, Homo sapiens
caagcaaatgttaca

SEQ ID NO: 5291861 - DNA, 17 bp, Homo sapiens
caagcaacaagctattt

SEQ ID NO: 5291862 - DNA, 16 bp, Homo sapiens
caagcaacagcacttt

SEQ ID NO: 5291863 - DNA, 22 bp, Homo sapiens
caagcaacatttgtatggattt

SEQ ID NO: 5291864 - DNA, 16 bp, Homo sapiens
caagcaacccaaactg

SEQ ID NO: 5291865 - DNA, 19 bp, Homo sapiens
caagcaacctgggtccaaa

SEQ ID NO: 5291866 - DNA, 13 bp, Homo sapiens
caagcaagaaaca

SEQ ID NO: 5291867 - DNA, 18 bp, Homo sapiens
caagcaagaaacactggg

SEQ ID NO: 5291868 - DNA, 22 bp, Homo sapiens
caagcaagaggtggtagaacca

SEQ ID NO: 5291869 - DNA, 12 bp, Homo sapiens
caagcaagctcc

SEQ ID NO: 5291870 - DNA, 22 bp, Homo sapiens
caagcaagctctcttgccgagg

SEQ ID NO: 5291871 - DNA, 19 bp, Homo sapiens
caagcaaggatatcagagc

SEQ ID NO: 5291872 - DNA, 21 bp, Homo sapiens
caagcaataattaggatctat

SEQ ID NO: 5291873 - DNA, 19 bp, Homo sapiens
caagcaataattgtttcca

SEQ ID NO: 5291874 - DNA, 14 bp, Homo sapiens
caagcaatcctccc

SEQ ID NO: 5291875 - DNA, 22 bp, Homo sapiens
caagcaatcctcctacctcagc

SEQ ID NO: 5291876 - DNA, 21 bp, Homo sapiens
caagcaatcctcctgcctcag

SEQ ID NO: 5291877 - DNA, 14 bp, Homo sapiens
caagcaatgatgac

SEQ ID NO: 5291878 - DNA, 18 bp, Homo sapiens
caagcaatggacctttgg

SEQ ID NO: 5291879 - DNA, 21 bp, Homo sapiens
caagcaattctgccccacacc

SEQ ID NO: 5291880 - DNA, 14 bp, Homo sapiens
caagcacaaactgt

SEQ ID NO: 5291881 - DNA, 18 bp, Homo sapiens
caagcacaaactgtcgtc

SEQ ID NO: 5291882 - DNA, 22 bp, Homo sapiens
caagcacactggaatataaaac

SEQ ID NO: 5291883 - DNA, 13 bp, Homo sapiens
caagcacactgta

SEQ ID NO: 5291884 - DNA, 20 bp, Homo sapiens
caagcacactgtatgttcag

SEQ ID NO: 5291885 - DNA, 17 bp, Homo sapiens
caagcacagcagcctgg

SEQ ID NO: 5291886 - DNA, 18 bp, Homo sapiens
caagcacatgtaataaat

SEQ ID NO: 5291887 - DNA, 14 bp, Homo sapiens
caagcaccaacctc

SEQ ID NO: 5291888 - DNA, 21 bp, Homo sapiens
caagcaccaacctccagactc

SEQ ID NO: 5291889 - DNA, 23 bp, Homo sapiens
caagcaccaacctccagactcag

SEQ ID NO: 5291890 - DNA, 15 bp, Homo sapiens
caagcaccactctgg

SEQ ID NO: 5291891 - DNA, 16 bp, Homo sapiens
caagcaccactctggg

SEQ ID NO: 5291892 - DNA, 20 bp, Homo sapiens
caagcaccactctgggcaca

SEQ ID NO: 5291893 - DNA, 17 bp, Homo sapiens
caagcaccatcccctcc

SEQ ID NO: 5291894 - DNA, 15 bp, Homo sapiens
caagcaccctgttcc

SEQ ID NO: 5291895 - DNA, 19 bp, Homo sapiens
caagcaccctgttccctct

SEQ ID NO: 5291896 - DNA, 18 bp, Homo sapiens
caagcacctagcctcgct

SEQ ID NO: 5291897 - DNA, 15 bp, Homo sapiens
caagcacctcctgcc

SEQ ID NO: 5291898 - DNA, 16 bp, Homo sapiens
caagcacctcctgcct

SEQ ID NO: 5291899 - DNA, 17 bp, Homo sapiens
caagcacctcctgcctc

SEQ ID NO: 5291900 - DNA, 15 bp, Homo sapiens
caagcacctgggtgt

SEQ ID NO: 5291901 - DNA, 20 bp, Homo sapiens
caagcactatgcccttttat

SEQ ID NO: 5291902 - DNA, 19 bp, Homo sapiens
caagcactcgagaccatcc

SEQ ID NO: 5291903 - DNA, 21 bp, Homo sapiens
caagcactcgagaccatcctg

SEQ ID NO: 5291904 - DNA, 11 bp, Homo sapiens
caagcactgat

SEQ ID NO: 5291905 - DNA, 15 bp, Homo sapiens
caagcactgatatct

SEQ ID NO: 5291906 - DNA, 23 bp, Homo sapiens
caagcactgctaggcgagtgcca

SEQ ID NO: 5291907 - DNA, 12 bp, Homo sapiens
caagcactgctc

SEQ ID NO: 5291908 - DNA, 16 bp, Homo sapiens
caagcactgctcacgt

SEQ ID NO: 5291909 - DNA, 12 bp, Homo sapiens
caagcactgtgc

SEQ ID NO: 5291910 - DNA, 13 bp, Homo sapiens
caagcactgtgct

SEQ ID NO: 5291911 - DNA, 17 bp, Homo sapiens
caagcactgtgctcagg

SEQ ID NO: 5291912 - DNA, 21 bp, Homo sapiens
caagcactttaatggcctgga

SEQ ID NO: 5291913 - DNA, 18 bp, Homo sapiens
caagcagaaaaacaggca

SEQ ID NO: 5291914 - DNA, 23 bp, Homo sapiens
caagcagaaaaacaggcacaggc

SEQ ID NO: 5291915 - DNA, 16 bp, Homo sapiens
caagcagaagaccaga

SEQ ID NO: 5291916 - DNA, 16 bp, Homo sapiens
caagcagacacacaca

SEQ ID NO: 5291917 - DNA, 17 bp, Homo sapiens
caagcagacacacacat

SEQ ID NO: 5291918 - DNA, 17 bp, Homo sapiens
caagcagactccagccc

SEQ ID NO: 5291919 - DNA, 19 bp, Homo sapiens
caagcagactccagcccct

SEQ ID NO: 5291920 - DNA, 13 bp, Homo sapiens
caagcagagacct

SEQ ID NO: 5291921 - DNA, 18 bp, Homo sapiens
caagcagagacctttgtt

SEQ ID NO: 5291922 - DNA, 19 bp, Homo sapiens
caagcagagcgggtaaagt

SEQ ID NO: 5291923 - DNA, 19 bp, Homo sapiens
caagcagaggaccagggcc

SEQ ID NO: 5291924 - DNA, 21 bp, Homo sapiens
caagcagaggaccagggcctt

SEQ ID NO: 5291925 - DNA, 18 bp, Homo sapiens
caagcagaggtggccaga

SEQ ID NO: 5291926 - DNA, 18 bp, Homo sapiens
caagcagagtgcacagct

SEQ ID NO: 5291927 - DNA, 20 bp, Homo sapiens
caagcagagtgcacagctgt

SEQ ID NO: 5291928 - DNA, 19 bp, Homo sapiens
caagcagatactgctgtgt

SEQ ID NO: 5291929 - DNA, 23 bp, Homo sapiens
caagcagatactgctgtgtaatg

SEQ ID NO: 5291930 - DNA, 16 bp, Homo sapiens
caagcagatctgcttt

SEQ ID NO: 5291931 - DNA, 14 bp, Homo sapiens
caagcagattccct

SEQ ID NO: 5291932 - DNA, 17 bp, Homo sapiens
caagcagcaaaatcctt

SEQ ID NO: 5291933 - DNA, 15 bp, Homo sapiens
caagcagcattcagc

SEQ ID NO: 5291934 - DNA, 22 bp, Homo sapiens
caagcagccaagctccttggga

SEQ ID NO: 5291935 - DNA, 13 bp, Homo sapiens
caagcagccagcc

SEQ ID NO: 5291936 - DNA, 14 bp, Homo sapiens
caagcagcctcctg

SEQ ID NO: 5291937 - DNA, 22 bp, Homo sapiens
caagcagctttttattccctgc

SEQ ID NO: 5291938 - DNA, 21 bp, Homo sapiens
caagcaggaagctcagactgg

SEQ ID NO: 5291939 - DNA, 18 bp, Homo sapiens
caagcaggacagtgcttg

SEQ ID NO: 5291940 - DNA, 17 bp, Homo sapiens
caagcagggaaagctcc

SEQ ID NO: 5291941 - DNA, 12 bp, Homo sapiens
caagcagggagg

SEQ ID NO: 5291942 - DNA, 13 bp, Homo sapiens
caagcagggagga

SEQ ID NO: 5291943 - DNA, 22 bp, Homo sapiens
caagcagtagcaggacgatgat

SEQ ID NO: 5291944 - DNA, 15 bp, Homo sapiens
caagcagtcgtgcct

SEQ ID NO: 5291945 - DNA, 16 bp, Homo sapiens
caagcagtcgtgcctg

SEQ ID NO: 5291946 - DNA, 19 bp, Homo sapiens
caagcagtcgtgcctgtgt

SEQ ID NO: 5291947 - DNA, 21 bp, Homo sapiens
caagcagtctaccctgtcctt

SEQ ID NO: 5291948 - DNA, 17 bp, Homo sapiens
caagcagtgtctgtcag

SEQ ID NO: 5291949 - DNA, 22 bp, Homo sapiens
caagcagtgtctgtcagctgtg

SEQ ID NO: 5291950 - DNA, 22 bp, Homo sapiens
caagcagttgggactacaggcg

SEQ ID NO: 5291951 - DNA, 13 bp, Homo sapiens
caagcagtttcaa

SEQ ID NO: 5291952 - DNA, 14 bp, Homo sapiens
caagcagtttcaat

SEQ ID NO: 5291953 - DNA, 20 bp, Homo sapiens
caagcagtttcaataaagtt

SEQ ID NO: 5291954 - DNA, 21 bp, Homo sapiens
caagcagtttcaataaagttt

SEQ ID NO: 5291955 - DNA, 22 bp, Homo sapiens
caagcataacatggagctcttg

SEQ ID NO: 5291956 - DNA, 17 bp, Homo sapiens
caagcatataaaatttt

SEQ ID NO: 5291957 - DNA, 22 bp, Homo sapiens
caagcatattttgtggcatttg

SEQ ID NO: 5291958 - DNA, 18 bp, Homo sapiens
caagcatcagcaagacaa

SEQ ID NO: 5291959 - DNA, 21 bp, Homo sapiens
caagcatcagtagctgagtgc

SEQ ID NO: 5291960 - DNA, 13 bp, Homo sapiens
caagcatcattgt

SEQ ID NO: 5291961 - DNA, 23 bp, Homo sapiens
caagcatcattgtccccatgcaa

SEQ ID NO: 5291962 - DNA, 17 bp, Homo sapiens
caagcatcctcagaagc

SEQ ID NO: 5291963 - DNA, 10 bp, Homo sapiens
caagcatctc

SEQ ID NO: 5291964 - DNA, 14 bp, Homo sapiens
caagcatctcctga

SEQ ID NO: 5291965 - DNA, 17 bp, Homo sapiens
caagcatctcctgagga

SEQ ID NO: 5291966 - DNA, 21 bp, Homo sapiens
caagcatgaagataaacacag

SEQ ID NO: 5291967 - DNA, 19 bp, Homo sapiens
caagcatgacaacttttaa

SEQ ID NO: 5291968 - DNA, 21 bp, Homo sapiens
caagcatgcaataatgtgcaa

SEQ ID NO: 5291969 - DNA, 22 bp, Homo sapiens
caagcatgcaataatgtgcaaa

SEQ ID NO: 5291970 - DNA, 19 bp, Homo sapiens
caagcatgcataaatcaat

SEQ ID NO: 5291971 - DNA, 15 bp, Homo sapiens
caagcatgccccacc

SEQ ID NO: 5291972 - DNA, 20 bp, Homo sapiens
caagcatgcttgtgaaaatg

SEQ ID NO: 5291973 - DNA, 22 bp, Homo sapiens
caagcatgtctctctgccaaga

SEQ ID NO: 5291974 - DNA, 14 bp, Homo sapiens
caagcattacttta

SEQ ID NO: 5291975 - DNA, 18 bp, Homo sapiens
caagcattactttaacct

SEQ ID NO: 5291976 - DNA, 22 bp, Homo sapiens
caagcattcagaagaaaaagaa

SEQ ID NO: 5291977 - DNA, 23 bp, Homo sapiens
caagcattccttagcagctcagg

SEQ ID NO: 5291978 - DNA, 17 bp, Homo sapiens
caagcattctctccatt

SEQ ID NO: 5291979 - DNA, 23 bp, Homo sapiens
caagcattgcttcagaatgaatt

SEQ ID NO: 5291980 - DNA, 13 bp, Homo sapiens
caagcatttcaaa

SEQ ID NO: 5291981 - DNA, 18 bp, Homo sapiens
caagccaaaatgggagca

SEQ ID NO: 5291982 - DNA, 20 bp, Homo sapiens
caagccaacttgtaaataca

SEQ ID NO: 5291983 - DNA, 15 bp, Homo sapiens
caagccaagcagcca

SEQ ID NO: 5291984 - DNA, 16 bp, Homo sapiens
caagccaagcagccaa

SEQ ID NO: 5291985 - DNA, 21 bp, Homo sapiens
caagccaagggaacctgtgtc

SEQ ID NO: 5291986 - DNA, 23 bp, Homo sapiens
caagccaagggaacctgtgtccg

SEQ ID NO: 5291987 - DNA, 12 bp, Homo sapiens
caagccacagaa

SEQ ID NO: 5291988 - DNA, 16 bp, Homo sapiens
atttgctatgagctgg

SEQ ID NO: 5291989 - DNA, 14 bp, Homo sapiens
atttgctatttaca

SEQ ID NO: 5291990 - DNA, 21 bp, Homo sapiens
atttgctatttacaaatgaag

SEQ ID NO: 5291991 - DNA, 15 bp, Homo sapiens
atttgctcataagta

SEQ ID NO: 5291992 - DNA, 20 bp, Homo sapiens
atttgctcataagtaaatgt

SEQ ID NO: 5291993 - DNA, 20 bp, Homo sapiens
atttgctctgtggtaagaga

SEQ ID NO: 5291994 - DNA, 16 bp, Homo sapiens
atttgctgaactcagc

SEQ ID NO: 5291995 - DNA, 21 bp, Homo sapiens
atttgctgacaaccattaaag

SEQ ID NO: 5291996 - DNA, 19 bp, Homo sapiens
atttgctgagtttcccttc

SEQ ID NO: 5291997 - DNA, 16 bp, Homo sapiens
atttgctgatttctag

SEQ ID NO: 5291998 - DNA, 10 bp, Homo sapiens
atttgctgca

SEQ ID NO: 5291999 - DNA, 16 bp, Homo sapiens
atttgctgcaaagaga

SEQ ID NO: 5292000 - DNA, 15 bp, Homo sapiens
atttgctgcatttca

SEQ ID NO: 5292001 - DNA, 19 bp, Homo sapiens
atttgctgccaaatgcgta

SEQ ID NO: 5292002 - DNA, 22 bp, Homo sapiens
atttgctgccagacactgagct

SEQ ID NO: 5292003 - DNA, 11 bp, Homo sapiens
atttgctgccc

SEQ ID NO: 5292004 - DNA, 15 bp, Homo sapiens
atttgctgccctggg

SEQ ID NO: 5292005 - DNA, 22 bp, Homo sapiens
atttgctggagtgctggctcca

SEQ ID NO: 5292006 - DNA, 13 bp, Homo sapiens
atttgctggggaa

SEQ ID NO: 5292007 - DNA, 19 bp, Homo sapiens
atttgctgtattgccccca

SEQ ID NO: 5292008 - DNA, 11 bp, Homo sapiens
atttgctgttg

SEQ ID NO: 5292009 - DNA, 15 bp, Homo sapiens
atttgcttatttata

SEQ ID NO: 5292010 - DNA, 18 bp, Homo sapiens
atttgcttatttatattc

SEQ ID NO: 5292011 - DNA, 16 bp, Homo sapiens
atttgcttatttttat

SEQ ID NO: 5292012 - DNA, 19 bp, Homo sapiens
atttgcttatttttataat

SEQ ID NO: 5292013 - DNA, 13 bp, Homo sapiens
atttgcttcagga

SEQ ID NO: 5292014 - DNA, 14 bp, Homo sapiens
atttgcttcattgt

SEQ ID NO: 5292015 - DNA, 19 bp, Homo sapiens
atttgcttgcaatctaatc

SEQ ID NO: 5292016 - DNA, 22 bp, Homo sapiens
atttgcttgcaatctaatctga

SEQ ID NO: 5292017 - DNA, 18 bp, Homo sapiens
atttgctttaatgagtgc

SEQ ID NO: 5292018 - DNA, 13 bp, Homo sapiens
atttgctttacat

SEQ ID NO: 5292019 - DNA, 19 bp, Homo sapiens
atttgctttagagacaggg

SEQ ID NO: 5292020 - DNA, 19 bp, Homo sapiens
atttgctttgggattttct

SEQ ID NO: 5292021 - DNA, 10 bp, Homo sapiens
atttggaaaa

SEQ ID NO: 5292022 - DNA, 14 bp, Homo sapiens
atttggaaaattca

SEQ ID NO: 5292023 - DNA, 19 bp, Homo sapiens
atttggaaactaataaaat

SEQ ID NO: 5292024 - DNA, 23 bp, Homo sapiens
atttggaaactaataaaatattt

SEQ ID NO: 5292025 - DNA, 13 bp, Homo sapiens
atttggaaagaga

SEQ ID NO: 5292026 - DNA, 18 bp, Homo sapiens
atttggaaaggaccaaat

SEQ ID NO: 5292027 - DNA, 14 bp, Homo sapiens
atttggaaatccta

SEQ ID NO: 5292028 - DNA, 20 bp, Homo sapiens
atttggaaatctttaaaaaa

SEQ ID NO: 5292029 - DNA, 13 bp, Homo sapiens
atttggaaatttt

SEQ ID NO: 5292030 - DNA, 15 bp, Homo sapiens
atttggaaccaaagt

SEQ ID NO: 5292031 - DNA, 17 bp, Homo sapiens
atttggaacttacaaag

SEQ ID NO: 5292032 - DNA, 20 bp, Homo sapiens
atttggaacttacaaagggt

SEQ ID NO: 5292033 - DNA, 15 bp, Homo sapiens
atttggaatactttt

SEQ ID NO: 5292034 - DNA, 11 bp, Homo sapiens
atttggaatag

SEQ ID NO: 5292035 - DNA, 19 bp, Homo sapiens
atttggaatcatatgggat

SEQ ID NO: 5292036 - DNA, 18 bp, Homo sapiens
atttggaatgcacacagc

SEQ ID NO: 5292037 - DNA, 20 bp, Homo sapiens
atttggaatgtacatactga

SEQ ID NO: 5292038 - DNA, 15 bp, Homo sapiens
atttggaattctgtt

SEQ ID NO: 5292039 - DNA, 16 bp, Homo sapiens
atttggaattgacatt

SEQ ID NO: 5292040 - DNA, 14 bp, Homo sapiens
atttggaccatttt

SEQ ID NO: 5292041 - DNA, 17 bp, Homo sapiens
atttggaccattttcct

SEQ ID NO: 5292042 - DNA, 20 bp, Homo sapiens
atttggagacacaactattt

SEQ ID NO: 5292043 - DNA, 17 bp, Homo sapiens
atttggagactctgtgg

SEQ ID NO: 5292044 - DNA, 14 bp, Homo sapiens
atttggagagaaat

SEQ ID NO: 5292045 - DNA, 17 bp, Homo sapiens
atttggagagaaatatt

SEQ ID NO: 5292046 - DNA, 18 bp, Homo sapiens
atttggagagaaatattt

SEQ ID NO: 5292047 - DNA, 20 bp, Homo sapiens
atttggagcacaaaattcaa

SEQ ID NO: 5292048 - DNA, 16 bp, Homo sapiens
atttggagcataactg

SEQ ID NO: 5292049 - DNA, 21 bp, Homo sapiens
atttggagcattaactaaatg

SEQ ID NO: 5292050 - DNA, 23 bp, Homo sapiens
atttggagcattaactaaatgct

SEQ ID NO: 5292051 - DNA, 20 bp, Homo sapiens
atttggagcctgccaagagg

SEQ ID NO: 5292052 - DNA, 23 bp, Homo sapiens
atttggagtaaatatatatgtca

SEQ ID NO: 5292053 - DNA, 13 bp, Homo sapiens
atttggagtggag

SEQ ID NO: 5292054 - DNA, 21 bp, Homo sapiens
atttggagtgttccccttcca

SEQ ID NO: 5292055 - DNA, 20 bp, Homo sapiens
atttggagttaggtcctcac

SEQ ID NO: 5292056 - DNA, 16 bp, Homo sapiens
atttggatatctgtta

SEQ ID NO: 5292057 - DNA, 14 bp, Homo sapiens
atttggatatttgg

SEQ ID NO: 5292058 - DNA, 20 bp, Homo sapiens
atttggatctggatctgtta

SEQ ID NO: 5292059 - DNA, 14 bp, Homo sapiens
atttggatgcagag

SEQ ID NO: 5292060 - DNA, 18 bp, Homo sapiens
atttggcaaaacaaaatg

SEQ ID NO: 5292061 - DNA, 18 bp, Homo sapiens
atttggcaccaggcaaac

SEQ ID NO: 5292062 - DNA, 19 bp, Homo sapiens
atttggcagcacgcaggcg

SEQ ID NO: 5292063 - DNA, 16 bp, Homo sapiens
atttggcagtttggta

SEQ ID NO: 5292064 - DNA, 16 bp, Homo sapiens
atttggcatccctggg

SEQ ID NO: 5292065 - DNA, 20 bp, Homo sapiens
atttggcatccctgggcctt

SEQ ID NO: 5292066 - DNA, 18 bp, Homo sapiens
atttggcattgatcttaa

SEQ ID NO: 5292067 - DNA, 19 bp, Homo sapiens
atttggcatttatttgtga

SEQ ID NO: 5292068 - DNA, 16 bp, Homo sapiens
atttggccaggcctag

SEQ ID NO: 5292069 - DNA, 21 bp, Homo sapiens
atttggcccaaactcatcttg

SEQ ID NO: 5292070 - DNA, 12 bp, Homo sapiens
atttggcccaga

SEQ ID NO: 5292071 - DNA, 13 bp, Homo sapiens
atttggcccagag

SEQ ID NO: 5292072 - DNA, 15 bp, Homo sapiens
atttggcccagagag

SEQ ID NO: 5292073 - DNA, 19 bp, Homo sapiens
atttggccccaggggacgt

SEQ ID NO: 5292074 - DNA, 22 bp, Homo sapiens
atttggccggctctggtggcca

SEQ ID NO: 5292075 - DNA, 17 bp, Homo sapiens
atttggccttaagaact

SEQ ID NO: 5292076 - DNA, 15 bp, Homo sapiens
atttggcgtgacccg

SEQ ID NO: 5292077 - DNA, 19 bp, Homo sapiens
atttggctcacttgcctta

SEQ ID NO: 5292078 - DNA, 14 bp, Homo sapiens
atttggctcgctgt

SEQ ID NO: 5292079 - DNA, 15 bp, Homo sapiens
atttggctgggtgtt

SEQ ID NO: 5292080 - DNA, 16 bp, Homo sapiens
atttggcttatattct

SEQ ID NO: 5292081 - DNA, 14 bp, Homo sapiens
atttggcttcctct

SEQ ID NO: 5292082 - DNA, 17 bp, Homo sapiens
atttggcttctgttgtc

SEQ ID NO: 5292083 - DNA, 19 bp, Homo sapiens
atttggcttgacaaaggca

SEQ ID NO: 5292084 - DNA, 13 bp, Homo sapiens
atttggcttgctg

SEQ ID NO: 5292085 - DNA, 19 bp, Homo sapiens
atttggcttgctgtttact

SEQ ID NO: 5292086 - DNA, 17 bp, Homo sapiens
atttgggaaaagaagct

SEQ ID NO: 5292087 - DNA, 16 bp, Homo sapiens
atttgggaacataaaa

SEQ ID NO: 5292088 - DNA, 16 bp, Homo sapiens
atttgggaccctgctt

SEQ ID NO: 5292089 - DNA, 21 bp, Homo sapiens
atttgggacctgcttcattca

SEQ ID NO: 5292090 - DNA, 18 bp, Homo sapiens
atttgggagaagggcaga

SEQ ID NO: 5292091 - DNA, 17 bp, Homo sapiens
atttgggagacatgtga

SEQ ID NO: 5292092 - DNA, 14 bp, Homo sapiens
atttgggcagagag

SEQ ID NO: 5292093 - DNA, 16 bp, Homo sapiens
atttgggccaaggtgt

SEQ ID NO: 5292094 - DNA, 19 bp, Homo sapiens
atttgggcctgctccagac

SEQ ID NO: 5292095 - DNA, 22 bp, Homo sapiens
atttgggcctgctccagacctg

SEQ ID NO: 5292096 - DNA, 23 bp, Homo sapiens
atttgggcctgctccagacctga

SEQ ID NO: 5292097 - DNA, 17 bp, Homo sapiens
atttgggctcagggttg

SEQ ID NO: 5292098 - DNA, 20 bp, Homo sapiens
atttgggctgaatgtatgta

SEQ ID NO: 5292099 - DNA, 22 bp, Homo sapiens
atttgggcttatttagaaaaaa

SEQ ID NO: 5292100 - DNA, 14 bp, Homo sapiens
atttggggacagat

SEQ ID NO: 5292101 - DNA, 21 bp, Homo sapiens
atttggggaccacagaggctg

SEQ ID NO: 5292102 - DNA, 23 bp, Homo sapiens
atttggggagagataatgaggca

SEQ ID NO: 5292103 - DNA, 17 bp, Homo sapiens
atttggggcatttgtaa

SEQ ID NO: 5292104 - DNA, 22 bp, Homo sapiens
atttggggctacttatattctg

SEQ ID NO: 5292105 - DNA, 17 bp, Homo sapiens
atttgggggggaataag

SEQ ID NO: 5292106 - DNA, 23 bp, Homo sapiens
atttggggtataggtctcatctc

SEQ ID NO: 5292107 - DNA, 15 bp, Homo sapiens
atttggggtgatttc

SEQ ID NO: 5292108 - DNA, 22 bp, Homo sapiens
atttggggttgcatcagaaatg

SEQ ID NO: 5292109 - DNA, 23 bp, Homo sapiens
atttggggttgcatcagaaatgt

SEQ ID NO: 5292110 - DNA, 22 bp, Homo sapiens
atttggggtttgtgtttgattg

SEQ ID NO: 5292111 - DNA, 16 bp, Homo sapiens
atttgggtaaatcatg

SEQ ID NO: 5292112 - DNA, 17 bp, Homo sapiens
atttgggtattttgtca

SEQ ID NO: 5292113 - DNA, 21 bp, Homo sapiens
atttgggtattttgtcagttt

SEQ ID NO: 5292114 - DNA, 14 bp, Homo sapiens
atttgggtccagga

SEQ ID NO: 5292115 - DNA, 15 bp, Homo sapiens
atttgggtccaggag

SEQ ID NO: 5292116 - DNA, 17 bp, Homo sapiens
atttgggtggtttttat

SEQ ID NO: 5292117 - DNA, 23 bp, Homo sapiens
atttgggtggtttttatttttat

SEQ ID NO: 5292118 - DNA, 17 bp, Homo sapiens
atttgggttactatttc

SEQ ID NO: 5292119 - DNA, 13 bp, Homo sapiens
atttggtacacat

SEQ ID NO: 5292120 - DNA, 21 bp, Homo sapiens
atttggtagatgacaaatatt

SEQ ID NO: 5292121 - DNA, 21 bp, Homo sapiens
atttggtatatactttgccac

SEQ ID NO: 5292122 - DNA, 21 bp, Homo sapiens
atttggtcaagaaatgagtct

SEQ ID NO: 5292123 - DNA, 18 bp, Homo sapiens
atttggtcagaatgcagt

SEQ ID NO: 5292124 - DNA, 17 bp, Homo sapiens
atttggtccaaaaaaag

SEQ ID NO: 5292125 - DNA, 19 bp, Homo sapiens
atttggtccaaaaaaagga

SEQ ID NO: 5292126 - DNA, 22 bp, Homo sapiens
atttggtccaaaaaaaggaaaa

SEQ ID NO: 5292127 - DNA, 20 bp, Homo sapiens
atttggtctctcccagctct

SEQ ID NO: 5292128 - DNA, 21 bp, Homo sapiens
atttggtctctcccagctctg

SEQ ID NO: 5292129 - DNA, 23 bp, Homo sapiens
atttggtgccgatgttgaacttt

SEQ ID NO: 5292130 - DNA, 22 bp, Homo sapiens
atttggtggcctaatttacaag

SEQ ID NO: 5292131 - DNA, 18 bp, Homo sapiens
atttggtggtttcagaaa

SEQ ID NO: 5292132 - DNA, 21 bp, Homo sapiens
atttggtggtttcagaaatgt

SEQ ID NO: 5292133 - DNA, 18 bp, Homo sapiens
atttggtgtggctgtatt

SEQ ID NO: 5292134 - DNA, 21 bp, Homo sapiens
atttggtgtggctgtattcag

SEQ ID NO: 5292135 - DNA, 17 bp, Homo sapiens
atttggtgttcctggaa

SEQ ID NO: 5292136 - DNA, 20 bp, Homo sapiens
atttggtgttcctggaagca

SEQ ID NO: 5292137 - DNA, 15 bp, Homo sapiens
atttggttatggtta

SEQ ID NO: 5292138 - DNA, 18 bp, Homo sapiens
atttggttgcactttaga

SEQ ID NO: 5292139 - DNA, 12 bp, Homo sapiens
atttggtttcta

SEQ ID NO: 5292140 - DNA, 12 bp, Homo sapiens
atttggttttca

SEQ ID NO: 5292141 - DNA, 14 bp, Homo sapiens
atttggttttcaca

SEQ ID NO: 5292142 - DNA, 16 bp, Homo sapiens
atttggtttttctctt

SEQ ID NO: 5292143 - DNA, 17 bp, Homo sapiens
atttggtttttctcttt

SEQ ID NO: 5292144 - DNA, 11 bp, Homo sapiens
atttgtaaaaa

SEQ ID NO: 5292145 - DNA, 13 bp, Homo sapiens
atttgtaaaaaag

SEQ ID NO: 5292146 - DNA, 22 bp, Homo sapiens
atttgtaaaaacagcattgctt

SEQ ID NO: 5292147 - DNA, 14 bp, Homo sapiens
atttgtaaaaatga

SEQ ID NO: 5292148 - DNA, 16 bp, Homo sapiens
atttgtaaaaatgagt

SEQ ID NO: 5292149 - DNA, 16 bp, Homo sapiens
atttgtaaaacttctg

SEQ ID NO: 5292150 - DNA, 21 bp, Homo sapiens
atttgtaaaacttctgctcgt

SEQ ID NO: 5292151 - DNA, 16 bp, Homo sapiens
atttgtaaacttctga

SEQ ID NO: 5292152 - DNA, 17 bp, Homo sapiens
atttgtaaagctattta

SEQ ID NO: 5292153 - DNA, 11 bp, Homo sapiens
atttgtaaagg

SEQ ID NO: 5292154 - DNA, 21 bp, Homo sapiens
atttgtaaaggactatttata

SEQ ID NO: 5292155 - DNA, 17 bp, Homo sapiens
atttgtaaatctgccac

SEQ ID NO: 5292156 - DNA, 23 bp, Homo sapiens
atttgtaaatctttgtgaacatt

SEQ ID NO: 5292157 - DNA, 13 bp, Homo sapiens
atttgtaaatgat

SEQ ID NO: 5292158 - DNA, 16 bp, Homo sapiens
atttgtaaatgatttt

SEQ ID NO: 5292159 - DNA, 17 bp, Homo sapiens
atttgtaaatgatttta

SEQ ID NO: 5292160 - DNA, 13 bp, Homo sapiens
atttgtaaatgct

SEQ ID NO: 5292161 - DNA, 13 bp, Homo sapiens
atttgtaaattta

SEQ ID NO: 5292162 - DNA, 23 bp, Homo sapiens
atttgtaacccactgagaggaca

SEQ ID NO: 5292163 - DNA, 17 bp, Homo sapiens
atttgtaacctcagctc

SEQ ID NO: 5292164 - DNA, 20 bp, Homo sapiens
atttgtaacctcagctctgg

SEQ ID NO: 5292165 - DNA, 21 bp, Homo sapiens
atttgtaacctcagctctggg

SEQ ID NO: 5292166 - DNA, 21 bp, Homo sapiens
caagccaccaacatactccca

SEQ ID NO: 5292167 - DNA, 22 bp, Homo sapiens
caagccaccaacatactcccat

SEQ ID NO: 5292168 - DNA, 15 bp, Homo sapiens
caagccaccgcagct

SEQ ID NO: 5292169 - DNA, 17 bp, Homo sapiens
caagccaccgcagctgc

SEQ ID NO: 5292170 - DNA, 21 bp, Homo sapiens
caagccaccgcagctgctgcc

SEQ ID NO: 5292171 - DNA, 23 bp, Homo sapiens
caagccaccgcagctgctgccac

SEQ ID NO: 5292172 - DNA, 14 bp, Homo sapiens
caagccacgcctgc

SEQ ID NO: 5292173 - DNA, 16 bp, Homo sapiens
caagccacgttgcaga

SEQ ID NO: 5292174 - DNA, 15 bp, Homo sapiens
caagccactatgtcc

SEQ ID NO: 5292175 - DNA, 13 bp, Homo sapiens
caagccagaactt

SEQ ID NO: 5292176 - DNA, 13 bp, Homo sapiens
caagccagaccta

SEQ ID NO: 5292177 - DNA, 15 bp, Homo sapiens
caagccagacctagc

SEQ ID NO: 5292178 - DNA, 21 bp, Homo sapiens
caagccagacctagcaggctg

SEQ ID NO: 5292179 - DNA, 16 bp, Homo sapiens
caagccagaggctggg

SEQ ID NO: 5292180 - DNA, 11 bp, Homo sapiens
caagccagagt

SEQ ID NO: 5292181 - DNA, 14 bp, Homo sapiens
caagccagagtttt

SEQ ID NO: 5292182 - DNA, 21 bp, Homo sapiens
caagccagattttcctgaaaa

SEQ ID NO: 5292183 - DNA, 22 bp, Homo sapiens
caagccagcaacacagagcact

SEQ ID NO: 5292184 - DNA, 12 bp, Homo sapiens
caagccagcaag

SEQ ID NO: 5292185 - DNA, 14 bp, Homo sapiens
caagccagccccct

SEQ ID NO: 5292186 - DNA, 19 bp, Homo sapiens
caagccagccccctccagc

SEQ ID NO: 5292187 - DNA, 13 bp, Homo sapiens
caagccagctgcc

SEQ ID NO: 5292188 - DNA, 21 bp, Homo sapiens
caagccagcttcctgtgcaga

SEQ ID NO: 5292189 - DNA, 15 bp, Homo sapiens
caagccaggagaaga

SEQ ID NO: 5292190 - DNA, 19 bp, Homo sapiens
caagccaggagaccctgtc

SEQ ID NO: 5292191 - DNA, 20 bp, Homo sapiens
caagccaggctcactcacag

SEQ ID NO: 5292192 - DNA, 22 bp, Homo sapiens
caagccagggatggggccacag

SEQ ID NO: 5292193 - DNA, 13 bp, Homo sapiens
caagccagggccc

SEQ ID NO: 5292194 - DNA, 17 bp, Homo sapiens
caagccagggcccagag

SEQ ID NO: 5292195 - DNA, 22 bp, Homo sapiens
caagccagggcccagagccctt

SEQ ID NO: 5292196 - DNA, 16 bp, Homo sapiens
caagccagggttccag

SEQ ID NO: 5292197 - DNA, 20 bp, Homo sapiens
caagccagttctccttccct

SEQ ID NO: 5292198 - DNA, 10 bp, Homo sapiens
caagccataa

SEQ ID NO: 5292199 - DNA, 22 bp, Homo sapiens
caagccataaaccaataaaaca

SEQ ID NO: 5292200 - DNA, 12 bp, Homo sapiens
caagccataacg

SEQ ID NO: 5292201 - DNA, 21 bp, Homo sapiens
caagccataacgtgcccccag

SEQ ID NO: 5292202 - DNA, 23 bp, Homo sapiens
caagccataacgtgcccccagag

SEQ ID NO: 5292203 - DNA, 22 bp, Homo sapiens
caagccatcttcccgcctcagc

SEQ ID NO: 5292204 - DNA, 20 bp, Homo sapiens
caagccatcttgagtggtca

SEQ ID NO: 5292205 - DNA, 23 bp, Homo sapiens
caagccatggagtgagacccagg

SEQ ID NO: 5292206 - DNA, 21 bp, Homo sapiens
caagccatgggtagcctgggt

SEQ ID NO: 5292207 - DNA, 19 bp, Homo sapiens
caagccatggtgacacaca

SEQ ID NO: 5292208 - DNA, 17 bp, Homo sapiens
caagccatgtataaatg

SEQ ID NO: 5292209 - DNA, 18 bp, Homo sapiens
caagccattctgcctcag

SEQ ID NO: 5292210 - DNA, 20 bp, Homo sapiens
caagccatttactttgcaag

SEQ ID NO: 5292211 - DNA, 20 bp, Homo sapiens
caagccattttttgaggaga

SEQ ID NO: 5292212 - DNA, 17 bp, Homo sapiens
caagcccaccaggtgtc

SEQ ID NO: 5292213 - DNA, 23 bp, Homo sapiens
caagcccacgtcaggcctggcct

SEQ ID NO: 5292214 - DNA, 19 bp, Homo sapiens
caagcccactggccagctc

SEQ ID NO: 5292215 - DNA, 12 bp, Homo sapiens
caagcccaggag

SEQ ID NO: 5292216 - DNA, 14 bp, Homo sapiens
caagcccaggaggg

SEQ ID NO: 5292217 - DNA, 15 bp, Homo sapiens
caagcccaggctgga

SEQ ID NO: 5292218 - DNA, 22 bp, Homo sapiens
caagcccaggcttcctgggtcc

SEQ ID NO: 5292219 - DNA, 23 bp, Homo sapiens
caagcccaggcttcctgggtcct

SEQ ID NO: 5292220 - DNA, 21 bp, Homo sapiens
caagcccaggtgccagcctga

SEQ ID NO: 5292221 - DNA, 20 bp, Homo sapiens
caagcccagttcagcttggg

SEQ ID NO: 5292222 - DNA, 21 bp, Homo sapiens
caagccccagcagccctcaac

SEQ ID NO: 5292223 - DNA, 15 bp, Homo sapiens
caagccccagggcct

SEQ ID NO: 5292224 - DNA, 19 bp, Homo sapiens
caagccccagggcctgggg

SEQ ID NO: 5292225 - DNA, 12 bp, Homo sapiens
caagccccatct

SEQ ID NO: 5292226 - DNA, 14 bp, Homo sapiens
caagccccatctca

SEQ ID NO: 5292227 - DNA, 15 bp, Homo sapiens
caagccccattcacg

SEQ ID NO: 5292228 - DNA, 22 bp, Homo sapiens
caagccccattcacggcctggc

SEQ ID NO: 5292229 - DNA, 14 bp, Homo sapiens
caagcccccccttc

SEQ ID NO: 5292230 - DNA, 15 bp, Homo sapiens
caagccccccgagtg

SEQ ID NO: 5292231 - DNA, 15 bp, Homo sapiens
caagccccctgccct

SEQ ID NO: 5292232 - DNA, 13 bp, Homo sapiens
caagccccctggc

SEQ ID NO: 5292233 - DNA, 20 bp, Homo sapiens
caagccccctggcagctgcc

SEQ ID NO: 5292234 - DNA, 21 bp, Homo sapiens
caagccccctggcagctgccc

SEQ ID NO: 5292235 - DNA, 16 bp, Homo sapiens
caagccccctttgatt

SEQ ID NO: 5292236 - DNA, 16 bp, Homo sapiens
caagcccctcagccct

SEQ ID NO: 5292237 - DNA, 18 bp, Homo sapiens
caagcccctcagcccttg

SEQ ID NO: 5292238 - DNA, 16 bp, Homo sapiens
caagccccttctctca

SEQ ID NO: 5292239 - DNA, 21 bp, Homo sapiens
caagcccgacttgctgttttg

SEQ ID NO: 5292240 - DNA, 19 bp, Homo sapiens
caagcccgcctccagcacc

SEQ ID NO: 5292241 - DNA, 19 bp, Homo sapiens
caagcccgtgacagatgcc

SEQ ID NO: 5292242 - DNA, 18 bp, Homo sapiens
caagccctaagcctgtcc

SEQ ID NO: 5292243 - DNA, 21 bp, Homo sapiens
caagccctcctccccagagct

SEQ ID NO: 5292244 - DNA, 22 bp, Homo sapiens
caagccctcctccccagagctg

SEQ ID NO: 5292245 - DNA, 17 bp, Homo sapiens
caagccctcctttggag

SEQ ID NO: 5292246 - DNA, 14 bp, Homo sapiens
caagccctgagggg

SEQ ID NO: 5292247 - DNA, 11 bp, Homo sapiens
caagccctgcc

SEQ ID NO: 5292248 - DNA, 16 bp, Homo sapiens
caagccctgcccacag

SEQ ID NO: 5292249 - DNA, 17 bp, Homo sapiens
caagccctgcccacaga

SEQ ID NO: 5292250 - DNA, 19 bp, Homo sapiens
caagccctgcccacagaaa

SEQ ID NO: 5292251 - DNA, 15 bp, Homo sapiens
caagccctggcaaca

SEQ ID NO: 5292252 - DNA, 11 bp, Homo sapiens
caagccctggg

SEQ ID NO: 5292253 - DNA, 12 bp, Homo sapiens
caagccctgggg

SEQ ID NO: 5292254 - DNA, 18 bp, Homo sapiens
caagccctggggcagggt

SEQ ID NO: 5292255 - DNA, 17 bp, Homo sapiens
caagcccttgcccagag

SEQ ID NO: 5292256 - DNA, 13 bp, Homo sapiens
caagccctttgct

SEQ ID NO: 5292257 - DNA, 15 bp, Homo sapiens
caagccctttgctgt

SEQ ID NO: 5292258 - DNA, 16 bp, Homo sapiens
caagccgaccttccct

SEQ ID NO: 5292259 - DNA, 14 bp, Homo sapiens
caagccgcaagctc

SEQ ID NO: 5292260 - DNA, 18 bp, Homo sapiens
caagccgcaagctctcag

SEQ ID NO: 5292261 - DNA, 15 bp, Homo sapiens
caagccggcccaacc

SEQ ID NO: 5292262 - DNA, 14 bp, Homo sapiens
caagccggtgccca

SEQ ID NO: 5292263 - DNA, 16 bp, Homo sapiens
caagccggtgcccacc

SEQ ID NO: 5292264 - DNA, 14 bp, Homo sapiens
caagcctaacattg

SEQ ID NO: 5292265 - DNA, 13 bp, Homo sapiens
caagcctcaaagt

SEQ ID NO: 5292266 - DNA, 18 bp, Homo sapiens
caagcctcactattactt

SEQ ID NO: 5292267 - DNA, 20 bp, Homo sapiens
caagcctcagcaaacccaaa

SEQ ID NO: 5292268 - DNA, 12 bp, Homo sapiens
caagcctcagcc

SEQ ID NO: 5292269 - DNA, 15 bp, Homo sapiens
caagcctcagccact

SEQ ID NO: 5292270 - DNA, 13 bp, Homo sapiens
caagcctccacag

SEQ ID NO: 5292271 - DNA, 14 bp, Homo sapiens
caagcctcctgtac

SEQ ID NO: 5292272 - DNA, 13 bp, Homo sapiens
caagcctctgccc

SEQ ID NO: 5292273 - DNA, 17 bp, Homo sapiens
caagcctctgccccaag

SEQ ID NO: 5292274 - DNA, 20 bp, Homo sapiens
caagcctctgccccaagggg

SEQ ID NO: 5292275 - DNA, 12 bp, Homo sapiens
caagcctctgga

SEQ ID NO: 5292276 - DNA, 15 bp, Homo sapiens
caagcctcttctgaa

SEQ ID NO: 5292277 - DNA, 14 bp, Homo sapiens
caagcctgagaact

SEQ ID NO: 5292278 - DNA, 22 bp, Homo sapiens
caagcctgagggaaaggccagc

SEQ ID NO: 5292279 - DNA, 22 bp, Homo sapiens
caagcctgagggaggaggcagg

SEQ ID NO: 5292280 - DNA, 13 bp, Homo sapiens
caagcctgcaact

SEQ ID NO: 5292281 - DNA, 12 bp, Homo sapiens
caagcctgcagc

SEQ ID NO: 5292282 - DNA, 21 bp, Homo sapiens
caagcctgcagcgagctgaga

SEQ ID NO: 5292283 - DNA, 13 bp, Homo sapiens
caagcctgccccg

SEQ ID NO: 5292284 - DNA, 23 bp, Homo sapiens
caagcctgccccggccactctgt

SEQ ID NO: 5292285 - DNA, 13 bp, Homo sapiens
caagcctgcctcg

SEQ ID NO: 5292286 - DNA, 13 bp, Homo sapiens
caagcctgctggc

SEQ ID NO: 5292287 - DNA, 14 bp, Homo sapiens
caagcctgctggct

SEQ ID NO: 5292288 - DNA, 16 bp, Homo sapiens
caagcctgctggctgc

SEQ ID NO: 5292289 - DNA, 15 bp, Homo sapiens
caagcctggagcccc

SEQ ID NO: 5292290 - DNA, 12 bp, Homo sapiens
caagcctggagg

SEQ ID NO: 5292291 - DNA, 18 bp, Homo sapiens
caagcctggagtaggcct

SEQ ID NO: 5292292 - DNA, 22 bp, Homo sapiens
caagcctggagtaggcctgggg

SEQ ID NO: 5292293 - DNA, 12 bp, Homo sapiens
caagcctggcac

SEQ ID NO: 5292294 - DNA, 21 bp, Homo sapiens
caagcctggcacccaccgtct

SEQ ID NO: 5292295 - DNA, 14 bp, Homo sapiens
caagcctggcccag

SEQ ID NO: 5292296 - DNA, 17 bp, Homo sapiens
caagcctgggccactgg

SEQ ID NO: 5292297 - DNA, 20 bp, Homo sapiens
caagcctgggccactggcat

SEQ ID NO: 5292298 - DNA, 15 bp, Homo sapiens
caagcctggtcagcc

SEQ ID NO: 5292299 - DNA, 17 bp, Homo sapiens
caagcctggtcagccca

SEQ ID NO: 5292300 - DNA, 16 bp, Homo sapiens
caagcctggtctcctc

SEQ ID NO: 5292301 - DNA, 16 bp, Homo sapiens
caagcctgtgcaaaaa

SEQ ID NO: 5292302 - DNA, 12 bp, Homo sapiens
caagcctgtggg

SEQ ID NO: 5292303 - DNA, 14 bp, Homo sapiens
caagcctgtgggag

SEQ ID NO: 5292304 - DNA, 20 bp, Homo sapiens
caagccttactcacctctct

SEQ ID NO: 5292305 - DNA, 17 bp, Homo sapiens
caagccttggctctacc

SEQ ID NO: 5292306 - DNA, 22 bp, Homo sapiens
caagcgactctcctgcctcagc

SEQ ID NO: 5292307 - DNA, 17 bp, Homo sapiens
caagcgaggtcaacaga

SEQ ID NO: 5292308 - DNA, 18 bp, Homo sapiens
caagcgattctcctgcct

SEQ ID NO: 5292309 - DNA, 23 bp, Homo sapiens
caagcgattctcctgcctcagcc

SEQ ID NO: 5292310 - DNA, 16 bp, Homo sapiens
caagcgattctcctgt

SEQ ID NO: 5292311 - DNA, 18 bp, Homo sapiens
caagcgattctcctgtct

SEQ ID NO: 5292312 - DNA, 15 bp, Homo sapiens
caagcgattctcttg

SEQ ID NO: 5292313 - DNA, 15 bp, Homo sapiens
caagcgattcttctg

SEQ ID NO: 5292314 - DNA, 18 bp, Homo sapiens
caagcgattcttctgctt

SEQ ID NO: 5292315 - DNA, 20 bp, Homo sapiens
caagcgattcttctgcttca

SEQ ID NO: 5292316 - DNA, 22 bp, Homo sapiens
caagcgattcttgtgcctcagc

SEQ ID NO: 5292317 - DNA, 21 bp, Homo sapiens
caagcgcagggaggatgccac

SEQ ID NO: 5292318 - DNA, 16 bp, Homo sapiens
caagcgcatccaatct

SEQ ID NO: 5292319 - DNA, 23 bp, Homo sapiens
caagcgcatccaatctcaaggaa

SEQ ID NO: 5292320 - DNA, 17 bp, Homo sapiens
caagcgccctggccccc

SEQ ID NO: 5292321 - DNA, 17 bp, Homo sapiens
caagcgctcccagcctg

SEQ ID NO: 5292322 - DNA, 20 bp, Homo sapiens
caagcgctcccagcctgccc

SEQ ID NO: 5292323 - DNA, 14 bp, Homo sapiens
caagcgcttctgct

SEQ ID NO: 5292324 - DNA, 17 bp, Homo sapiens
caagcgcttctgctgaa

SEQ ID NO: 5292325 - DNA, 16 bp, Homo sapiens
caagcgcttctttctg

SEQ ID NO: 5292326 - DNA, 16 bp, Homo sapiens
caagcggatgctccat

SEQ ID NO: 5292327 - DNA, 12 bp, Homo sapiens
caagcggccctg

SEQ ID NO: 5292328 - DNA, 13 bp, Homo sapiens
caagcggtgtctc

SEQ ID NO: 5292329 - DNA, 22 bp, Homo sapiens
caagcgtctgggcaagaggaaa

SEQ ID NO: 5292330 - DNA, 16 bp, Homo sapiens
caagcgtgagccactg

SEQ ID NO: 5292331 - DNA, 18 bp, Homo sapiens
caagcgtgagccactgca

SEQ ID NO: 5292332 - DNA, 18 bp, Homo sapiens
caagcgtgcagcttgttc

SEQ ID NO: 5292333 - DNA, 15 bp, Homo sapiens
caagcgtgctgcctc

SEQ ID NO: 5292334 - DNA, 16 bp, Homo sapiens
caagcgtgttctcagc

SEQ ID NO: 5292335 - DNA, 17 bp, Homo sapiens
caagcgtgttctcagca

SEQ ID NO: 5292336 - DNA, 15 bp, Homo sapiens
caagcgttattttgg

SEQ ID NO: 5292337 - DNA, 17 bp, Homo sapiens
caagcgttcctggcctt

SEQ ID NO: 5292338 - DNA, 17 bp, Homo sapiens
caagctaagctgcaggc

SEQ ID NO: 5292339 - DNA, 18 bp, Homo sapiens
caagctaagctgcaggca

SEQ ID NO: 5292340 - DNA, 19 bp, Homo sapiens
caagctaagctgcaggcac

SEQ ID NO: 5292341 - DNA, 19 bp, Homo sapiens
caagctaagtaaaaatatg

SEQ ID NO: 5292342 - DNA, 16 bp, Homo sapiens
caagctaataaaatat

SEQ ID NO: 5292343 - DNA, 17 bp, Homo sapiens
caagctaataaaatatc

SEQ ID NO: 5292344 - DNA, 21 bp, Homo sapiens
caagctaataaaatatcattc

SEQ ID NO: 5292345 - DNA, 17 bp, Homo sapiens
caagctaatgtggtagt

SEQ ID NO: 5292346 - DNA, 18 bp, Homo sapiens
atttgtaagtaacacagt

SEQ ID NO: 5292347 - DNA, 15 bp, Homo sapiens
atttgtaagtgtaaa

SEQ ID NO: 5292348 - DNA, 14 bp, Homo sapiens
atttgtaagtttca

SEQ ID NO: 5292349 - DNA, 21 bp, Homo sapiens
atttgtaagtttcaggtgaca

SEQ ID NO: 5292350 - DNA, 18 bp, Homo sapiens
atttgtaataaagtatat

SEQ ID NO: 5292351 - DNA, 17 bp, Homo sapiens
atttgtaatagatgttt

SEQ ID NO: 5292352 - DNA, 17 bp, Homo sapiens
atttgtaatatatcctg

SEQ ID NO: 5292353 - DNA, 20 bp, Homo sapiens
atttgtaatatttttgtcat

SEQ ID NO: 5292354 - DNA, 15 bp, Homo sapiens
atttgtaatgtatct

SEQ ID NO: 5292355 - DNA, 22 bp, Homo sapiens
atttgtaatgtatcttatttat

SEQ ID NO: 5292356 - DNA, 19 bp, Homo sapiens
atttgtaatgtcttgagct

SEQ ID NO: 5292357 - DNA, 21 bp, Homo sapiens
atttgtaattaaaagcaaatc

SEQ ID NO: 5292358 - DNA, 16 bp, Homo sapiens
atttgtaattaaatta

SEQ ID NO: 5292359 - DNA, 20 bp, Homo sapiens
atttgtaattgcttacattt

SEQ ID NO: 5292360 - DNA, 13 bp, Homo sapiens
atttgtacaaata

SEQ ID NO: 5292361 - DNA, 15 bp, Homo sapiens
atttgtacaaataaa

SEQ ID NO: 5292362 - DNA, 14 bp, Homo sapiens
atttgtacaatggt

SEQ ID NO: 5292363 - DNA, 17 bp, Homo sapiens
atttgtacaatggttta

SEQ ID NO: 5292364 - DNA, 19 bp, Homo sapiens
atttgtacagaattttgga

SEQ ID NO: 5292365 - DNA, 21 bp, Homo sapiens
atttgtacagattctttatta

SEQ ID NO: 5292366 - DNA, 18 bp, Homo sapiens
atttgtacaggactgtaa

SEQ ID NO: 5292367 - DNA, 23 bp, Homo sapiens
atttgtacaggactgtaaagatt

SEQ ID NO: 5292368 - DNA, 18 bp, Homo sapiens
atttgtacaggggccatg

SEQ ID NO: 5292369 - DNA, 21 bp, Homo sapiens
atttgtacatagttatttatt

SEQ ID NO: 5292370 - DNA, 16 bp, Homo sapiens
atttgtacattcctga

SEQ ID NO: 5292371 - DNA, 13 bp, Homo sapiens
atttgtaccttat

SEQ ID NO: 5292372 - DNA, 21 bp, Homo sapiens
atttgtactgtttaatgttct

SEQ ID NO: 5292373 - DNA, 19 bp, Homo sapiens
atttgtacttcttattgca

SEQ ID NO: 5292374 - DNA, 14 bp, Homo sapiens
atttgtactttgtt

SEQ ID NO: 5292375 - DNA, 20 bp, Homo sapiens
atttgtagaagggttatatt

SEQ ID NO: 5292376 - DNA, 12 bp, Homo sapiens
atttgtagatat

SEQ ID NO: 5292377 - DNA, 15 bp, Homo sapiens
atttgtagcactgag

SEQ ID NO: 5292378 - DNA, 11 bp, Homo sapiens
atttgtagcat

SEQ ID NO: 5292379 - DNA, 18 bp, Homo sapiens
atttgtagcataactgta

SEQ ID NO: 5292380 - DNA, 20 bp, Homo sapiens
atttgtagccaaagaaattt

SEQ ID NO: 5292381 - DNA, 23 bp, Homo sapiens
atttgtaggaaggtctcattctt

SEQ ID NO: 5292382 - DNA, 14 bp, Homo sapiens
atttgtaggagaaa

SEQ ID NO: 5292383 - DNA, 22 bp, Homo sapiens
atttgtaggggaactcatttgg

SEQ ID NO: 5292384 - DNA, 16 bp, Homo sapiens
atttgtaggtatacta

SEQ ID NO: 5292385 - DNA, 22 bp, Homo sapiens
atttgtaggtatactatgtaag

SEQ ID NO: 5292386 - DNA, 22 bp, Homo sapiens
atttgtagtggaaacatttata

SEQ ID NO: 5292387 - DNA, 18 bp, Homo sapiens
atttgtagtgttggagaa

SEQ ID NO: 5292388 - DNA, 19 bp, Homo sapiens
atttgtagtgttggagaag

SEQ ID NO: 5292389 - DNA, 14 bp, Homo sapiens
atttgtataaaata

SEQ ID NO: 5292390 - DNA, 22 bp, Homo sapiens
atttgtataaagaaactggtcc

SEQ ID NO: 5292391 - DNA, 23 bp, Homo sapiens
atttgtataaattaaataaactg

SEQ ID NO: 5292392 - DNA, 22 bp, Homo sapiens
atttgtataagtccatgaatgt

SEQ ID NO: 5292393 - DNA, 21 bp, Homo sapiens
atttgtatagttgcttgcctg

SEQ ID NO: 5292394 - DNA, 18 bp, Homo sapiens
atttgtatatatacataa

SEQ ID NO: 5292395 - DNA, 14 bp, Homo sapiens
atttgtatatattt

SEQ ID NO: 5292396 - DNA, 16 bp, Homo sapiens
atttgtatatcatgaa

SEQ ID NO: 5292397 - DNA, 15 bp, Homo sapiens
atttgtatcacaaat

SEQ ID NO: 5292398 - DNA, 23 bp, Homo sapiens
atttgtatccacacaaattcagt

SEQ ID NO: 5292399 - DNA, 22 bp, Homo sapiens
atttgtatcggagggaaacaga

SEQ ID NO: 5292400 - DNA, 14 bp, Homo sapiens
atttgtatctgaag

SEQ ID NO: 5292401 - DNA, 21 bp, Homo sapiens
atttgtatgtattttcagtta

SEQ ID NO: 5292402 - DNA, 18 bp, Homo sapiens
atttgtatgttgtgaaga

SEQ ID NO: 5292403 - DNA, 19 bp, Homo sapiens
atttgtatgtttttctgta

SEQ ID NO: 5292404 - DNA, 18 bp, Homo sapiens
atttgtattaataaagca

SEQ ID NO: 5292405 - DNA, 19 bp, Homo sapiens
atttgtattaataaagcat

SEQ ID NO: 5292406 - DNA, 20 bp, Homo sapiens
atttgtattaataaagcatt

SEQ ID NO: 5292407 - DNA, 23 bp, Homo sapiens
atttgtattaccattacttgtat

SEQ ID NO: 5292408 - DNA, 23 bp, Homo sapiens
atttgtattactttctctgtagt

SEQ ID NO: 5292409 - DNA, 23 bp, Homo sapiens
atttgtattcaaatttgtgtcat

SEQ ID NO: 5292410 - DNA, 14 bp, Homo sapiens
atttgtattccatt

SEQ ID NO: 5292411 - DNA, 14 bp, Homo sapiens
atttgtattgtaca

SEQ ID NO: 5292412 - DNA, 16 bp, Homo sapiens
atttgtatttatatta

SEQ ID NO: 5292413 - DNA, 20 bp, Homo sapiens
atttgtatttatattagagt

SEQ ID NO: 5292414 - DNA, 16 bp, Homo sapiens
atttgtatttattctt

SEQ ID NO: 5292415 - DNA, 20 bp, Homo sapiens
atttgtatttctcttgtcct

SEQ ID NO: 5292416 - DNA, 21 bp, Homo sapiens
atttgtatttctcttgtcctt

SEQ ID NO: 5292417 - DNA, 14 bp, Homo sapiens
atttgtattttaaa

SEQ ID NO: 5292418 - DNA, 16 bp, Homo sapiens
atttgtattttgtgat

SEQ ID NO: 5292419 - DNA, 20 bp, Homo sapiens
atttgtattttgtgatgaat

SEQ ID NO: 5292420 - DNA, 17 bp, Homo sapiens
atttgtattttgtgtga

SEQ ID NO: 5292421 - DNA, 17 bp, Homo sapiens
atttgtatttttttgca

SEQ ID NO: 5292422 - DNA, 20 bp, Homo sapiens
atttgtcaaaaagtaatgat

SEQ ID NO: 5292423 - DNA, 15 bp, Homo sapiens
atttgtcaacaaagt

SEQ ID NO: 5292424 - DNA, 19 bp, Homo sapiens
atttgtcaacagatttaaa

SEQ ID NO: 5292425 - DNA, 22 bp, Homo sapiens
atttgtcaacagatttaaagaa

SEQ ID NO: 5292426 - DNA, 21 bp, Homo sapiens
atttgtcaagaggataaattt

SEQ ID NO: 5292427 - DNA, 16 bp, Homo sapiens
atttgtcacagaaatc

SEQ ID NO: 5292428 - DNA, 15 bp, Homo sapiens
atttgtcactgaata

SEQ ID NO: 5292429 - DNA, 21 bp, Homo sapiens
atttgtcactggaacctccct

SEQ ID NO: 5292430 - DNA, 15 bp, Homo sapiens
atttgtcatgacagt

SEQ ID NO: 5292431 - DNA, 16 bp, Homo sapiens
atttgtcattcctctc

SEQ ID NO: 5292432 - DNA, 15 bp, Homo sapiens
atttgtcattttcat

SEQ ID NO: 5292433 - DNA, 22 bp, Homo sapiens
atttgtccaatggctgtaaact

SEQ ID NO: 5292434 - DNA, 16 bp, Homo sapiens
atttgtccaattgagt

SEQ ID NO: 5292435 - DNA, 21 bp, Homo sapiens
atttgtccatttaaaaatgat

SEQ ID NO: 5292436 - DNA, 18 bp, Homo sapiens
atttgtcccaagtgccaa

SEQ ID NO: 5292437 - DNA, 23 bp, Homo sapiens
atttgtccttttatttctccatc

SEQ ID NO: 5292438 - DNA, 21 bp, Homo sapiens
atttgtcgggttctcccatga

SEQ ID NO: 5292439 - DNA, 21 bp, Homo sapiens
atttgtctcattttgtatgta

SEQ ID NO: 5292440 - DNA, 21 bp, Homo sapiens
atttgtctgaaacatttcata

SEQ ID NO: 5292441 - DNA, 15 bp, Homo sapiens
atttgtctgtgtgct

SEQ ID NO: 5292442 - DNA, 18 bp, Homo sapiens
atttgtctgtgtgctact

SEQ ID NO: 5292443 - DNA, 20 bp, Homo sapiens
atttgtctgtgtgctactaa

SEQ ID NO: 5292444 - DNA, 22 bp, Homo sapiens
atttgtcttaaaaaatgtgaaa

SEQ ID NO: 5292445 - DNA, 19 bp, Homo sapiens
atttgtcttaaaaatttat

SEQ ID NO: 5292446 - DNA, 23 bp, Homo sapiens
atttgtcttcagattattaaaat

SEQ ID NO: 5292447 - DNA, 16 bp, Homo sapiens
atttgtcttcccttct

SEQ ID NO: 5292448 - DNA, 14 bp, Homo sapiens
atttgtcttccgat

SEQ ID NO: 5292449 - DNA, 23 bp, Homo sapiens
atttgtcttccgatcaacattta

SEQ ID NO: 5292450 - DNA, 15 bp, Homo sapiens
atttgtctttcaagt

SEQ ID NO: 5292451 - DNA, 15 bp, Homo sapiens
atttgtctttcagga

SEQ ID NO: 5292452 - DNA, 20 bp, Homo sapiens
atttgtctttggaaaattca

SEQ ID NO: 5292453 - DNA, 22 bp, Homo sapiens
atttgtctttttgttgtaaaac

SEQ ID NO: 5292454 - DNA, 15 bp, Homo sapiens
atttgtgaactggaa

SEQ ID NO: 5292455 - DNA, 13 bp, Homo sapiens
atttgtgaactgt

SEQ ID NO: 5292456 - DNA, 12 bp, Homo sapiens
atttgtgaagaa

SEQ ID NO: 5292457 - DNA, 21 bp, Homo sapiens
atttgtgaaggtggaaataaa

SEQ ID NO: 5292458 - DNA, 13 bp, Homo sapiens
atttgtgaatata

SEQ ID NO: 5292459 - DNA, 17 bp, Homo sapiens
atttgtgaatttgcaac

SEQ ID NO: 5292460 - DNA, 22 bp, Homo sapiens
atttgtgactaattgtataaca

SEQ ID NO: 5292461 - DNA, 21 bp, Homo sapiens
atttgtgagccaaagagaaaa

SEQ ID NO: 5292462 - DNA, 15 bp, Homo sapiens
atttgtgatggccaa

SEQ ID NO: 5292463 - DNA, 17 bp, Homo sapiens
atttgtgatgtactgta

SEQ ID NO: 5292464 - DNA, 14 bp, Homo sapiens
atttgtgcaaacat

SEQ ID NO: 5292465 - DNA, 15 bp, Homo sapiens
atttgtgcaaacatg

SEQ ID NO: 5292466 - DNA, 22 bp, Homo sapiens
atttgtgcaaacatggagaaat

SEQ ID NO: 5292467 - DNA, 21 bp, Homo sapiens
atttgtgcacatgtacatatg

SEQ ID NO: 5292468 - DNA, 18 bp, Homo sapiens
atttgtgcattttattga

SEQ ID NO: 5292469 - DNA, 16 bp, Homo sapiens
atttgtgcattttcta

SEQ ID NO: 5292470 - DNA, 14 bp, Homo sapiens
atttgtgccagagg

SEQ ID NO: 5292471 - DNA, 21 bp, Homo sapiens
atttgtgccgacactgttctc

SEQ ID NO: 5292472 - DNA, 20 bp, Homo sapiens
atttgtgccgtaattatgta

SEQ ID NO: 5292473 - DNA, 16 bp, Homo sapiens
atttgtgctatttaat

SEQ ID NO: 5292474 - DNA, 22 bp, Homo sapiens
atttgtgctgggttattcagaa

SEQ ID NO: 5292475 - DNA, 18 bp, Homo sapiens
atttgtgctttgaaaaaa

SEQ ID NO: 5292476 - DNA, 21 bp, Homo sapiens
atttgtgctttttaagaatat

SEQ ID NO: 5292477 - DNA, 14 bp, Homo sapiens
atttgtggcagtgc

SEQ ID NO: 5292478 - DNA, 13 bp, Homo sapiens
atttgtggtcaca

SEQ ID NO: 5292479 - DNA, 16 bp, Homo sapiens
atttgtggttgcatgt

SEQ ID NO: 5292480 - DNA, 17 bp, Homo sapiens
atttgtgtaataaagtg

SEQ ID NO: 5292481 - DNA, 18 bp, Homo sapiens
atttgtgtaataaagtgt

SEQ ID NO: 5292482 - DNA, 19 bp, Homo sapiens
atttgtgtatgtgtatttg

SEQ ID NO: 5292483 - DNA, 14 bp, Homo sapiens
atttgtgtatttaa

SEQ ID NO: 5292484 - DNA, 22 bp, Homo sapiens
atttgtgtatttaacagggagg

SEQ ID NO: 5292485 - DNA, 21 bp, Homo sapiens
atttgtgtcagcatgtctcag

SEQ ID NO: 5292486 - DNA, 14 bp, Homo sapiens
atttgtgtggaaat

SEQ ID NO: 5292487 - DNA, 16 bp, Homo sapiens
atttgtgtggaaatca

SEQ ID NO: 5292488 - DNA, 18 bp, Homo sapiens
atttgtgtggatatttat

SEQ ID NO: 5292489 - DNA, 17 bp, Homo sapiens
atttgtgtgtatgtgta

SEQ ID NO: 5292490 - DNA, 17 bp, Homo sapiens
atttgtgtgttacaatg

SEQ ID NO: 5292491 - DNA, 22 bp, Homo sapiens
atttgtgtgttataccttgatt

SEQ ID NO: 5292492 - DNA, 15 bp, Homo sapiens
atttgtgttgaagag

SEQ ID NO: 5292493 - DNA, 19 bp, Homo sapiens
atttgtgttgaaggaactt

SEQ ID NO: 5292494 - DNA, 13 bp, Homo sapiens
atttgtgttttaa

SEQ ID NO: 5292495 - DNA, 21 bp, Homo sapiens
atttgtgttttaatttaaaca

SEQ ID NO: 5292496 - DNA, 14 bp, Homo sapiens
atttgttaaaatta

SEQ ID NO: 5292497 - DNA, 17 bp, Homo sapiens
atttgttaaagaaacat

SEQ ID NO: 5292498 - DNA, 15 bp, Homo sapiens
atttgttaaatattt

SEQ ID NO: 5292499 - DNA, 17 bp, Homo sapiens
atttgttaaatatttac

SEQ ID NO: 5292500 - DNA, 14 bp, Homo sapiens
atttgttaatatat

SEQ ID NO: 5292501 - DNA, 15 bp, Homo sapiens
atttgttaatatata

SEQ ID NO: 5292502 - DNA, 17 bp, Homo sapiens
atttgttaatatatata

SEQ ID NO: 5292503 - DNA, 18 bp, Homo sapiens
atttgttaatgattcttg

SEQ ID NO: 5292504 - DNA, 23 bp, Homo sapiens
atttgttaatttagaaaacttta

SEQ ID NO: 5292505 - DNA, 14 bp, Homo sapiens
atttgttaatttct

SEQ ID NO: 5292506 - DNA, 15 bp, Homo sapiens
atttgttaatttctt

SEQ ID NO: 5292507 - DNA, 23 bp, Homo sapiens
atttgttaatttcttgcaatttg

SEQ ID NO: 5292508 - DNA, 14 bp, Homo sapiens
atttgttacagcca

SEQ ID NO: 5292509 - DNA, 19 bp, Homo sapiens
atttgttatatataataaa

SEQ ID NO: 5292510 - DNA, 22 bp, Homo sapiens
atttgttatatcagcagacact

SEQ ID NO: 5292511 - DNA, 22 bp, Homo sapiens
atttgttatcctcttgtatact

SEQ ID NO: 5292512 - DNA, 21 bp, Homo sapiens
atttgttatggcagatgacaa

SEQ ID NO: 5292513 - DNA, 16 bp, Homo sapiens
atttgttattcttaag

SEQ ID NO: 5292514 - DNA, 17 bp, Homo sapiens
atttgttatttgtacag

SEQ ID NO: 5292515 - DNA, 19 bp, Homo sapiens
atttgttatttgtacagtt

SEQ ID NO: 5292516 - DNA, 12 bp, Homo sapiens
atttgttcaagt

SEQ ID NO: 5292517 - DNA, 23 bp, Homo sapiens
atttgttcactgaaggtgattca

SEQ ID NO: 5292518 - DNA, 15 bp, Homo sapiens
atttgttcagctccc

SEQ ID NO: 5292519 - DNA, 13 bp, Homo sapiens
atttgttcatatt

SEQ ID NO: 5292520 - DNA, 12 bp, Homo sapiens
atttgttcatgt

SEQ ID NO: 5292521 - DNA, 13 bp, Homo sapiens
atttgttcatgtt

SEQ ID NO: 5292522 - DNA, 21 bp, Homo sapiens
caagctaatttctaatggcct

SEQ ID NO: 5292523 - DNA, 14 bp, Homo sapiens
caagctaattttct

SEQ ID NO: 5292524 - DNA, 18 bp, Homo sapiens
caagctactttatgtaaa

SEQ ID NO: 5292525 - DNA, 17 bp, Homo sapiens
caagctagaacctggag

SEQ ID NO: 5292526 - DNA, 18 bp, Homo sapiens
caagctagactgtgtctg

SEQ ID NO: 5292527 - DNA, 20 bp, Homo sapiens
caagctagactgtgtctgaa

SEQ ID NO: 5292528 - DNA, 15 bp, Homo sapiens
caagctagccagagg

SEQ ID NO: 5292529 - DNA, 22 bp, Homo sapiens
caagctagccagagggtgggag

SEQ ID NO: 5292530 - DNA, 17 bp, Homo sapiens
caagctataaaagccca

SEQ ID NO: 5292531 - DNA, 16 bp, Homo sapiens
caagctatcctggctc

SEQ ID NO: 5292532 - DNA, 16 bp, Homo sapiens
caagctatctaaagtt

SEQ ID NO: 5292533 - DNA, 21 bp, Homo sapiens
caagctatctaaagtttgtta

SEQ ID NO: 5292534 - DNA, 22 bp, Homo sapiens
caagctattctcatgcctcagc

SEQ ID NO: 5292535 - DNA, 13 bp, Homo sapiens
caagctatttaat

SEQ ID NO: 5292536 - DNA, 15 bp, Homo sapiens
caagctatttaatat

SEQ ID NO: 5292537 - DNA, 14 bp, Homo sapiens
caagctcacacctg

SEQ ID NO: 5292538 - DNA, 19 bp, Homo sapiens
caagctcacagttcctcgc

SEQ ID NO: 5292539 - DNA, 21 bp, Homo sapiens
caagctcacagttcctcgccc

SEQ ID NO: 5292540 - DNA, 13 bp, Homo sapiens
caagctcaccctg

SEQ ID NO: 5292541 - DNA, 16 bp, Homo sapiens
caagctcaccctgctc

SEQ ID NO: 5292542 - DNA, 18 bp, Homo sapiens
caagctcaccctgctcct

SEQ ID NO: 5292543 - DNA, 14 bp, Homo sapiens
caagctcacttgct

SEQ ID NO: 5292544 - DNA, 15 bp, Homo sapiens
caagctcagaataga

SEQ ID NO: 5292545 - DNA, 14 bp, Homo sapiens
caagctcagagcag

SEQ ID NO: 5292546 - DNA, 22 bp, Homo sapiens
caagctcaggaggcgaataaat

SEQ ID NO: 5292547 - DNA, 14 bp, Homo sapiens
caagctcatagcac

SEQ ID NO: 5292548 - DNA, 17 bp, Homo sapiens
caagctcatccctggac

SEQ ID NO: 5292549 - DNA, 15 bp, Homo sapiens
caagctcatgtcatt

SEQ ID NO: 5292550 - DNA, 18 bp, Homo sapiens
caagctccaagctcccag

SEQ ID NO: 5292551 - DNA, 17 bp, Homo sapiens
caagctccagtagctcc

SEQ ID NO: 5292552 - DNA, 17 bp, Homo sapiens
caagctccatctccact

SEQ ID NO: 5292553 - DNA, 16 bp, Homo sapiens
caagctccctgcccca

SEQ ID NO: 5292554 - DNA, 19 bp, Homo sapiens
caagctccctgccccaaat

SEQ ID NO: 5292555 - DNA, 14 bp, Homo sapiens
caagctccctggag

SEQ ID NO: 5292556 - DNA, 15 bp, Homo sapiens
caagctccctggtga

SEQ ID NO: 5292557 - DNA, 18 bp, Homo sapiens
caagctcctagtatgccc

SEQ ID NO: 5292558 - DNA, 10 bp, Homo sapiens
caagctcctc

SEQ ID NO: 5292559 - DNA, 13 bp, Homo sapiens
caagctcctccct

SEQ ID NO: 5292560 - DNA, 15 bp, Homo sapiens
caagctcctcccttg

SEQ ID NO: 5292561 - DNA, 17 bp, Homo sapiens
caagctcctcccttgag

SEQ ID NO: 5292562 - DNA, 14 bp, Homo sapiens
caagctcctcctcg

SEQ ID NO: 5292563 - DNA, 16 bp, Homo sapiens
caagctcctcctcgga

SEQ ID NO: 5292564 - DNA, 19 bp, Homo sapiens
caagctcctcctcggaacc

SEQ ID NO: 5292565 - DNA, 19 bp, Homo sapiens
caagctccttaaccttcca

SEQ ID NO: 5292566 - DNA, 17 bp, Homo sapiens
caagctccttgggaggc

SEQ ID NO: 5292567 - DNA, 14 bp, Homo sapiens
caagctctcttgcc

SEQ ID NO: 5292568 - DNA, 14 bp, Homo sapiens
caagctctgaggga

SEQ ID NO: 5292569 - DNA, 13 bp, Homo sapiens
caagctctgccct

SEQ ID NO: 5292570 - DNA, 18 bp, Homo sapiens
caagctctgccctggctg

SEQ ID NO: 5292571 - DNA, 20 bp, Homo sapiens
caagctctgccctggctgtg

SEQ ID NO: 5292572 - DNA, 14 bp, Homo sapiens
caagctctgctcct

SEQ ID NO: 5292573 - DNA, 19 bp, Homo sapiens
caagctcttcattgcactg

SEQ ID NO: 5292574 - DNA, 16 bp, Homo sapiens
caagctcttcccttgc

SEQ ID NO: 5292575 - DNA, 24 bp, Homo sapiens
caagctcttcccttgctcatgagc

SEQ ID NO: 5292576 - DNA, 15 bp, Homo sapiens
caagctcttctcctc

SEQ ID NO: 5292577 - DNA, 13 bp, Homo sapiens
caagctcttgttt

SEQ ID NO: 5292578 - DNA, 19 bp, Homo sapiens
caagctcttgtttctgttt

SEQ ID NO: 5292579 - DNA, 21 bp, Homo sapiens
caagctgaaattttagaaata

SEQ ID NO: 5292580 - DNA, 13 bp, Homo sapiens
caagctgaagcta

SEQ ID NO: 5292581 - DNA, 18 bp, Homo sapiens
caagctgaagtgaaggag

SEQ ID NO: 5292582 - DNA, 19 bp, Homo sapiens
caagctgaagtgaaggaga

SEQ ID NO: 5292583 - DNA, 22 bp, Homo sapiens
caagctgaagtgaaggagaaag

SEQ ID NO: 5292584 - DNA, 14 bp, Homo sapiens
caagctgagaaaag

SEQ ID NO: 5292585 - DNA, 23 bp, Homo sapiens
caagctgagcaggacagccagca

SEQ ID NO: 5292586 - DNA, 16 bp, Homo sapiens
caagctgagctggctt

SEQ ID NO: 5292587 - DNA, 18 bp, Homo sapiens
caagctgagctggcttcg

SEQ ID NO: 5292588 - DNA, 12 bp, Homo sapiens
caagctgaggag

SEQ ID NO: 5292589 - DNA, 15 bp, Homo sapiens
caagctgaggtgccc

SEQ ID NO: 5292590 - DNA, 21 bp, Homo sapiens
caagctgaggtgcccaggaga

SEQ ID NO: 5292591 - DNA, 15 bp, Homo sapiens
caagctgagtttcct

SEQ ID NO: 5292592 - DNA, 16 bp, Homo sapiens
caagctgagtttccta

SEQ ID NO: 5292593 - DNA, 14 bp, Homo sapiens
caagctgatagtgt

SEQ ID NO: 5292594 - DNA, 15 bp, Homo sapiens
caagctgatagtgtt

SEQ ID NO: 5292595 - DNA, 16 bp, Homo sapiens
caagctgatagtgttt

SEQ ID NO: 5292596 - DNA, 23 bp, Homo sapiens
caagctgatgaagttaagcacaa

SEQ ID NO: 5292597 - DNA, 17 bp, Homo sapiens
caagctgcaaaaggcct

SEQ ID NO: 5292598 - DNA, 10 bp, Homo sapiens
caagctgcac

SEQ ID NO: 5292599 - DNA, 13 bp, Homo sapiens
caagctgcactgt

SEQ ID NO: 5292600 - DNA, 15 bp, Homo sapiens
caagctgcactgtga

SEQ ID NO: 5292601 - DNA, 16 bp, Homo sapiens
caagctgcactgtgaa

SEQ ID NO: 5292602 - DNA, 17 bp, Homo sapiens
caagctgcactgtgaac

SEQ ID NO: 5292603 - DNA, 14 bp, Homo sapiens
caagctgcagggaa

SEQ ID NO: 5292604 - DNA, 14 bp, Homo sapiens
caagctgcccagcc

SEQ ID NO: 5292605 - DNA, 17 bp, Homo sapiens
caagctgcccagccctg

SEQ ID NO: 5292606 - DNA, 18 bp, Homo sapiens
caagctgcccagccctgg

SEQ ID NO: 5292607 - DNA, 19 bp, Homo sapiens
caagctgcccagccctggc

SEQ ID NO: 5292608 - DNA, 21 bp, Homo sapiens
caagctgcccagccctggccc

SEQ ID NO: 5292609 - DNA, 13 bp, Homo sapiens
caagctgcctccc

SEQ ID NO: 5292610 - DNA, 20 bp, Homo sapiens
caagctgcctccctgtccac

SEQ ID NO: 5292611 - DNA, 12 bp, Homo sapiens
caagctgcctct

SEQ ID NO: 5292612 - DNA, 20 bp, Homo sapiens
caagctgcctctgacagcag

SEQ ID NO: 5292613 - DNA, 14 bp, Homo sapiens
caagctgcctctgg

SEQ ID NO: 5292614 - DNA, 18 bp, Homo sapiens
caagctgcctctgggcca

SEQ ID NO: 5292615 - DNA, 12 bp, Homo sapiens
caagctgcgggc

SEQ ID NO: 5292616 - DNA, 21 bp, Homo sapiens
caagctgcgggctccctggca

SEQ ID NO: 5292617 - DNA, 24 bp, Homo sapiens
caagctgcgggctccctggcagga

SEQ ID NO: 5292618 - DNA, 15 bp, Homo sapiens
caagctgctctgagc

SEQ ID NO: 5292619 - DNA, 15 bp, Homo sapiens
caagctgctgccgcc

SEQ ID NO: 5292620 - DNA, 22 bp, Homo sapiens
caagctgctgccgcctcacctt

SEQ ID NO: 5292621 - DNA, 20 bp, Homo sapiens
caagctggaaaggccagcag

SEQ ID NO: 5292622 - DNA, 21 bp, Homo sapiens
caagctggaaaggccagcagc

SEQ ID NO: 5292623 - DNA, 15 bp, Homo sapiens
caagctggaagaagt

SEQ ID NO: 5292624 - DNA, 18 bp, Homo sapiens
caagctggaagcacatgt

SEQ ID NO: 5292625 - DNA, 12 bp, Homo sapiens
caagctggcaca

SEQ ID NO: 5292626 - DNA, 17 bp, Homo sapiens
caagctggccaaagtca

SEQ ID NO: 5292627 - DNA, 19 bp, Homo sapiens
caagctggccaaagtcact

SEQ ID NO: 5292628 - DNA, 11 bp, Homo sapiens
caagctggcct

SEQ ID NO: 5292629 - DNA, 12 bp, Homo sapiens
caagctggctgg

SEQ ID NO: 5292630 - DNA, 23 bp, Homo sapiens
caagctggctggggtggcctgtg

SEQ ID NO: 5292631 - DNA, 17 bp, Homo sapiens
caagctggcttacactg

SEQ ID NO: 5292632 - DNA, 15 bp, Homo sapiens
caagctggcttctgt

SEQ ID NO: 5292633 - DNA, 16 bp, Homo sapiens
caagctggcttctgtg

SEQ ID NO: 5292634 - DNA, 16 bp, Homo sapiens
caagctgggccccagc

SEQ ID NO: 5292635 - DNA, 17 bp, Homo sapiens
caagctgggccccagcc

SEQ ID NO: 5292636 - DNA, 20 bp, Homo sapiens
caagctgggccccagcccac

SEQ ID NO: 5292637 - DNA, 22 bp, Homo sapiens
caagctgggccccagcccaccc

SEQ ID NO: 5292638 - DNA, 13 bp, Homo sapiens
caagctgggctcc

SEQ ID NO: 5292639 - DNA, 15 bp, Homo sapiens
caagctgggctccct

SEQ ID NO: 5292640 - DNA, 23 bp, Homo sapiens
caagctggtcccactcagtccat

SEQ ID NO: 5292641 - DNA, 20 bp, Homo sapiens
caagctggtcttaaactcct

SEQ ID NO: 5292642 - DNA, 20 bp, Homo sapiens
caagctgtacaaagggaagc

SEQ ID NO: 5292643 - DNA, 20 bp, Homo sapiens
caagctgtacccttgagacc

SEQ ID NO: 5292644 - DNA, 23 bp, Homo sapiens
caagctgtataaacagaactcca

SEQ ID NO: 5292645 - DNA, 12 bp, Homo sapiens
caagctgtcaca

SEQ ID NO: 5292646 - DNA, 13 bp, Homo sapiens
caagctgtccctg

SEQ ID NO: 5292647 - DNA, 16 bp, Homo sapiens
caagctgtccctgcag

SEQ ID NO: 5292648 - DNA, 18 bp, Homo sapiens
caagctgtccctgcaggg

SEQ ID NO: 5292649 - DNA, 22 bp, Homo sapiens
caagctgtccctgcagggccat

SEQ ID NO: 5292650 - DNA, 18 bp, Homo sapiens
caagctgtgagacagtgg

SEQ ID NO: 5292651 - DNA, 22 bp, Homo sapiens
caagctgtgctgggaagcccgg

SEQ ID NO: 5292652 - DNA, 23 bp, Homo sapiens
caagctgtgctgggaagcccgga

SEQ ID NO: 5292653 - DNA, 17 bp, Homo sapiens
caagctgtgttacttga

SEQ ID NO: 5292654 - DNA, 19 bp, Homo sapiens
caagctgtgttacttgaag

SEQ ID NO: 5292655 - DNA, 20 bp, Homo sapiens
caagctgtgttacttgaagt

SEQ ID NO: 5292656 - DNA, 16 bp, Homo sapiens
caagctgtgttcatcc

SEQ ID NO: 5292657 - DNA, 23 bp, Homo sapiens
caagctgtgttcatccagctact

SEQ ID NO: 5292658 - DNA, 17 bp, Homo sapiens
caagctgttaaagatat

SEQ ID NO: 5292659 - DNA, 23 bp, Homo sapiens
caagctgttaaagatatttttat

SEQ ID NO: 5292660 - DNA, 18 bp, Homo sapiens
caagctgttagttgctgt

SEQ ID NO: 5292661 - DNA, 21 bp, Homo sapiens
caagctgttatttcttccctg

SEQ ID NO: 5292662 - DNA, 23 bp, Homo sapiens
caagctgttatttcttccctgct

SEQ ID NO: 5292663 - DNA, 13 bp, Homo sapiens
caagctgttccac

SEQ ID NO: 5292664 - DNA, 15 bp, Homo sapiens
caagcttagaagcca

SEQ ID NO: 5292665 - DNA, 16 bp, Homo sapiens
caagcttagtcctggg

SEQ ID NO: 5292666 - DNA, 23 bp, Homo sapiens
caagcttagtcctgggagaggac

SEQ ID NO: 5292667 - DNA, 23 bp, Homo sapiens
caagcttatttagcacattttga

SEQ ID NO: 5292668 - DNA, 14 bp, Homo sapiens
caagcttattttgg

SEQ ID NO: 5292669 - DNA, 15 bp, Homo sapiens
caagcttcaaagcca

SEQ ID NO: 5292670 - DNA, 17 bp, Homo sapiens
caagcttcaaccctcag

SEQ ID NO: 5292671 - DNA, 19 bp, Homo sapiens
caagcttcaagtgatatat

SEQ ID NO: 5292672 - DNA, 19 bp, Homo sapiens
caagcttcagacctccctc

SEQ ID NO: 5292673 - DNA, 22 bp, Homo sapiens
caagcttcagagcctagccacc

SEQ ID NO: 5292674 - DNA, 21 bp, Homo sapiens
caagcttccatagctgctgcc

SEQ ID NO: 5292675 - DNA, 13 bp, Homo sapiens
caagcttcccaac

SEQ ID NO: 5292676 - DNA, 15 bp, Homo sapiens
caagcttcctgtgcc

SEQ ID NO: 5292677 - DNA, 17 bp, Homo sapiens
caagcttcctgtgccct

SEQ ID NO: 5292678 - DNA, 20 bp, Homo sapiens
caagcttcctgtgccctcac

SEQ ID NO: 5292679 - DNA, 15 bp, Homo sapiens
caagcttctgtcctg

SEQ ID NO: 5292680 - DNA, 18 bp, Homo sapiens
caagcttctgtcctgccc

SEQ ID NO: 5292681 - DNA, 21 bp, Homo sapiens
caagcttctgtcctgccccca

SEQ ID NO: 5292682 - DNA, 14 bp, Homo sapiens
caagcttgaggcca

SEQ ID NO: 5292683 - DNA, 22 bp, Homo sapiens
caagcttgaggccaagatggct

SEQ ID NO: 5292684 - DNA, 14 bp, Homo sapiens
caagcttgtatata

SEQ ID NO: 5292685 - DNA, 17 bp, Homo sapiens
caagcttgtatatacat

SEQ ID NO: 5292686 - DNA, 18 bp, Homo sapiens
caagcttgtatatacata

SEQ ID NO: 5292687 - DNA, 24 bp, Homo sapiens
caagcttgtatatacatattataa

SEQ ID NO: 5292688 - DNA, 17 bp, Homo sapiens
caagcttgtccaacccg

SEQ ID NO: 5292689 - DNA, 20 bp, Homo sapiens
caagcttgtgagagctggtt

SEQ ID NO: 5292690 - DNA, 15 bp, Homo sapiens
caagcttgtgtactt

SEQ ID NO: 5292691 - DNA, 20 bp, Homo sapiens
caagcttgttatcagctttc

SEQ ID NO: 5292692 - DNA, 21 bp, Homo sapiens
caagcttgtttccctgctggc

SEQ ID NO: 5292693 - DNA, 23 bp, Homo sapiens
caagctttaaatggcaatttttt

SEQ ID NO: 5292694 - DNA, 16 bp, Homo sapiens
caagctttaaattatg

SEQ ID NO: 5292695 - DNA, 14 bp, Homo sapiens
caagctttaacaga

SEQ ID NO: 5292696 - DNA, 17 bp, Homo sapiens
caagctttaacagacta

SEQ ID NO: 5292697 - DNA, 17 bp, Homo sapiens
caagctttcctgctgtc

SEQ ID NO: 5292698 - DNA, 22 bp, Homo sapiens
caagctttcctgctgtcttctc

SEQ ID NO: 5292699 - DNA, 12 bp, Homo sapiens
caagctttcttc

SEQ ID NO: 5292700 - DNA, 12 bp, Homo sapiens
caagctttgctc

SEQ ID NO: 5292701 - DNA, 15 bp, Homo sapiens
atttgttcatgtttg

SEQ ID NO: 5292702 - DNA, 11 bp, Homo sapiens
atttgttcatt

SEQ ID NO: 5292703 - DNA, 14 bp, Homo sapiens
atttgttcccaaga

SEQ ID NO: 5292704 - DNA, 15 bp, Homo sapiens
atttgttcctttctg

SEQ ID NO: 5292705 - DNA, 15 bp, Homo sapiens
atttgttctgggagt

SEQ ID NO: 5292706 - DNA, 16 bp, Homo sapiens
atttgttctgggagta

SEQ ID NO: 5292707 - DNA, 20 bp, Homo sapiens
atttgttcttaaaaaaataa

SEQ ID NO: 5292708 - DNA, 19 bp, Homo sapiens
atttgttcttataaacctt

SEQ ID NO: 5292709 - DNA, 16 bp, Homo sapiens
atttgttcttcaagaa

SEQ ID NO: 5292710 - DNA, 16 bp, Homo sapiens
atttgttcttgtattt

SEQ ID NO: 5292711 - DNA, 13 bp, Homo sapiens
atttgttctttgt

SEQ ID NO: 5292712 - DNA, 18 bp, Homo sapiens
atttgttgaaatcttttt

SEQ ID NO: 5292713 - DNA, 20 bp, Homo sapiens
atttgttgaaattatgtatg

SEQ ID NO: 5292714 - DNA, 13 bp, Homo sapiens
atttgttgagagt

SEQ ID NO: 5292715 - DNA, 18 bp, Homo sapiens
atttgttgattctctcca

SEQ ID NO: 5292716 - DNA, 20 bp, Homo sapiens
atttgttgcaccaattaagt

SEQ ID NO: 5292717 - DNA, 22 bp, Homo sapiens
atttgttgcaccaattaagtgt

SEQ ID NO: 5292718 - DNA, 14 bp, Homo sapiens
atttgttgctgctg

SEQ ID NO: 5292719 - DNA, 20 bp, Homo sapiens
atttgttggtaactaatgtt

SEQ ID NO: 5292720 - DNA, 21 bp, Homo sapiens
atttgttggtaactaatgtta

SEQ ID NO: 5292721 - DNA, 22 bp, Homo sapiens
atttgttggtaactaatgttat

SEQ ID NO: 5292722 - DNA, 22 bp, Homo sapiens
atttgttgtactttttattcaa

SEQ ID NO: 5292723 - DNA, 14 bp, Homo sapiens
atttgttgtcatgt

SEQ ID NO: 5292724 - DNA, 16 bp, Homo sapiens
atttgtttaaaaagta

SEQ ID NO: 5292725 - DNA, 16 bp, Homo sapiens
atttgtttaaaaggat

SEQ ID NO: 5292726 - DNA, 17 bp, Homo sapiens
atttgtttaaagaataa

SEQ ID NO: 5292727 - DNA, 22 bp, Homo sapiens
atttgtttaaagaataaagtcc

SEQ ID NO: 5292728 - DNA, 17 bp, Homo sapiens
atttgtttaatttatac

SEQ ID NO: 5292729 - DNA, 21 bp, Homo sapiens
atttgtttacttgtaaattga

SEQ ID NO: 5292730 - DNA, 18 bp, Homo sapiens
atttgtttatccttaaga

SEQ ID NO: 5292731 - DNA, 22 bp, Homo sapiens
atttgtttatggtaaaaaattt

SEQ ID NO: 5292732 - DNA, 19 bp, Homo sapiens
atttgtttatgtaatttca

SEQ ID NO: 5292733 - DNA, 19 bp, Homo sapiens
atttgtttatttgcaattt

SEQ ID NO: 5292734 - DNA, 21 bp, Homo sapiens
atttgtttatttgcaatttga

SEQ ID NO: 5292735 - DNA, 23 bp, Homo sapiens
atttgtttatttttatatagctt

SEQ ID NO: 5292736 - DNA, 16 bp, Homo sapiens
atttgtttattttttg

SEQ ID NO: 5292737 - DNA, 18 bp, Homo sapiens
atttgtttcatctatttt

SEQ ID NO: 5292738 - DNA, 13 bp, Homo sapiens
atttgtttcatta

SEQ ID NO: 5292739 - DNA, 16 bp, Homo sapiens
atttgtttcattaaag

SEQ ID NO: 5292740 - DNA, 22 bp, Homo sapiens
atttgtttcccccacagtttta

SEQ ID NO: 5292741 - DNA, 13 bp, Homo sapiens
atttgtttgaact

SEQ ID NO: 5292742 - DNA, 16 bp, Homo sapiens
atttgtttgaactgat

SEQ ID NO: 5292743 - DNA, 14 bp, Homo sapiens
atttgtttgagaca

SEQ ID NO: 5292744 - DNA, 15 bp, Homo sapiens
atttgtttgattttc

SEQ ID NO: 5292745 - DNA, 17 bp, Homo sapiens
atttgtttgattttcat

SEQ ID NO: 5292746 - DNA, 18 bp, Homo sapiens
atttgtttgctgtacaga

SEQ ID NO: 5292747 - DNA, 21 bp, Homo sapiens
atttgtttggttatagtgcaa

SEQ ID NO: 5292748 - DNA, 20 bp, Homo sapiens
atttgtttgtagctttcctg

SEQ ID NO: 5292749 - DNA, 21 bp, Homo sapiens
atttgtttgtagctttcctgg

SEQ ID NO: 5292750 - DNA, 16 bp, Homo sapiens
atttgtttgtattcat

SEQ ID NO: 5292751 - DNA, 19 bp, Homo sapiens
atttgtttgtattcatgtt

SEQ ID NO: 5292752 - DNA, 14 bp, Homo sapiens
atttgtttgtgctt

SEQ ID NO: 5292753 - DNA, 16 bp, Homo sapiens
atttgtttgtgcttct

SEQ ID NO: 5292754 - DNA, 17 bp, Homo sapiens
atttgtttgtgcttcta

SEQ ID NO: 5292755 - DNA, 21 bp, Homo sapiens
atttgtttgtgttcaatatca

SEQ ID NO: 5292756 - DNA, 23 bp, Homo sapiens
atttgtttgttttcttgtctgtg

SEQ ID NO: 5292757 - DNA, 21 bp, Homo sapiens
atttgttttagcattacctaa

SEQ ID NO: 5292758 - DNA, 21 bp, Homo sapiens
atttgttttgccaatttgcac

SEQ ID NO: 5292759 - DNA, 18 bp, Homo sapiens
atttgttttgcttttgtt

SEQ ID NO: 5292760 - DNA, 15 bp, Homo sapiens
atttgttttggatat

SEQ ID NO: 5292761 - DNA, 20 bp, Homo sapiens
atttgttttgttttaaaata

SEQ ID NO: 5292762 - DNA, 20 bp, Homo sapiens
atttgtttttaaactgtaca

SEQ ID NO: 5292763 - DNA, 16 bp, Homo sapiens
atttgtttttcattca

SEQ ID NO: 5292764 - DNA, 15 bp, Homo sapiens
atttgtttttctcac

SEQ ID NO: 5292765 - DNA, 21 bp, Homo sapiens
atttgtttttctcttttcaca

SEQ ID NO: 5292766 - DNA, 22 bp, Homo sapiens
atttgtttttgtatttttaatg

SEQ ID NO: 5292767 - DNA, 22 bp, Homo sapiens
attttaaaaaaattcatcatat

SEQ ID NO: 5292768 - DNA, 12 bp, Homo sapiens
attttaaaaaag

SEQ ID NO: 5292769 - DNA, 24 bp, Homo sapiens
attttaaaaaagatggatttgaca

SEQ ID NO: 5292770 - DNA, 13 bp, Homo sapiens
attttaaaaaagg

SEQ ID NO: 5292771 - DNA, 14 bp, Homo sapiens
attttaaaaaatca

SEQ ID NO: 5292772 - DNA, 16 bp, Homo sapiens
attttaaaaaatcaaa

SEQ ID NO: 5292773 - DNA, 18 bp, Homo sapiens
attttaaaaaatcaaaag

SEQ ID NO: 5292774 - DNA, 18 bp, Homo sapiens
attttaaaaaatcaatca

SEQ ID NO: 5292775 - DNA, 14 bp, Homo sapiens
attttaaaaaatga

SEQ ID NO: 5292776 - DNA, 23 bp, Homo sapiens
attttaaaaaatgaaaataagtg

SEQ ID NO: 5292777 - DNA, 16 bp, Homo sapiens
attttaaaaaatggtc

SEQ ID NO: 5292778 - DNA, 17 bp, Homo sapiens
attttaaaaacatgaga

SEQ ID NO: 5292779 - DNA, 20 bp, Homo sapiens
attttaaaaacatgagaaat

SEQ ID NO: 5292780 - DNA, 23 bp, Homo sapiens
attttaaaaagtccataccttat

SEQ ID NO: 5292781 - DNA, 18 bp, Homo sapiens
attttaaaaagtcttcac

SEQ ID NO: 5292782 - DNA, 22 bp, Homo sapiens
attttaaaaatacagatagata

SEQ ID NO: 5292783 - DNA, 22 bp, Homo sapiens
attttaaaaatacatatcgctg

SEQ ID NO: 5292784 - DNA, 14 bp, Homo sapiens
attttaaaaattgg

SEQ ID NO: 5292785 - DNA, 22 bp, Homo sapiens
attttaaaaattggaaactgac

SEQ ID NO: 5292786 - DNA, 13 bp, Homo sapiens
attttaaaacaat

SEQ ID NO: 5292787 - DNA, 20 bp, Homo sapiens
attttaaaaccatgcagctt

SEQ ID NO: 5292788 - DNA, 20 bp, Homo sapiens
attttaaaagataaatatta

SEQ ID NO: 5292789 - DNA, 13 bp, Homo sapiens
attttaaaataaa

SEQ ID NO: 5292790 - DNA, 14 bp, Homo sapiens
attttaaaataaac

SEQ ID NO: 5292791 - DNA, 16 bp, Homo sapiens
attttaaaataaactt

SEQ ID NO: 5292792 - DNA, 17 bp, Homo sapiens
attttaaaataaacttt

SEQ ID NO: 5292793 - DNA, 22 bp, Homo sapiens
attttaaaatagcgttcttgta

SEQ ID NO: 5292794 - DNA, 13 bp, Homo sapiens
attttaaaatctg

SEQ ID NO: 5292795 - DNA, 22 bp, Homo sapiens
attttaaaatctgagggaaatg

SEQ ID NO: 5292796 - DNA, 13 bp, Homo sapiens
attttaaaatgaa

SEQ ID NO: 5292797 - DNA, 22 bp, Homo sapiens
attttaaaatgaaatgcatttt

SEQ ID NO: 5292798 - DNA, 16 bp, Homo sapiens
attttaaaatgaataa

SEQ ID NO: 5292799 - DNA, 18 bp, Homo sapiens
attttaaaatgaataatt

SEQ ID NO: 5292800 - DNA, 20 bp, Homo sapiens
attttaaaatgaataattta

SEQ ID NO: 5292801 - DNA, 14 bp, Homo sapiens
attttaaaatgaga

SEQ ID NO: 5292802 - DNA, 13 bp, Homo sapiens
attttaaaatgta

SEQ ID NO: 5292803 - DNA, 14 bp, Homo sapiens
attttaaaatgtac

SEQ ID NO: 5292804 - DNA, 22 bp, Homo sapiens
attttaaaatgtacatgtatta

SEQ ID NO: 5292805 - DNA, 20 bp, Homo sapiens
attttaaaatgtagaagaaa

SEQ ID NO: 5292806 - DNA, 13 bp, Homo sapiens
attttaaaatgtc

SEQ ID NO: 5292807 - DNA, 14 bp, Homo sapiens
attttaaaatgtct

SEQ ID NO: 5292808 - DNA, 14 bp, Homo sapiens
attttaaaatgttt

SEQ ID NO: 5292809 - DNA, 15 bp, Homo sapiens
attttaaaatgttta

SEQ ID NO: 5292810 - DNA, 15 bp, Homo sapiens
attttaaaattggta

SEQ ID NO: 5292811 - DNA, 18 bp, Homo sapiens
attttaaaattttatctc

SEQ ID NO: 5292812 - DNA, 16 bp, Homo sapiens
attttaaaattttgct

SEQ ID NO: 5292813 - DNA, 13 bp, Homo sapiens
attttaaacaaag

SEQ ID NO: 5292814 - DNA, 14 bp, Homo sapiens
attttaaacacatt

SEQ ID NO: 5292815 - DNA, 22 bp, Homo sapiens
attttaaaccataaaaagctga

SEQ ID NO: 5292816 - DNA, 23 bp, Homo sapiens
attttaaactagatgacctcatt

SEQ ID NO: 5292817 - DNA, 17 bp, Homo sapiens
attttaaagaattgtgt

SEQ ID NO: 5292818 - DNA, 15 bp, Homo sapiens
attttaaagacccaa

SEQ ID NO: 5292819 - DNA, 21 bp, Homo sapiens
attttaaagacccaacttgcc

SEQ ID NO: 5292820 - DNA, 15 bp, Homo sapiens
attttaaagacccct

SEQ ID NO: 5292821 - DNA, 18 bp, Homo sapiens
attttaaagcctgaaaat

SEQ ID NO: 5292822 - DNA, 20 bp, Homo sapiens
attttaaagggacagtttgt

SEQ ID NO: 5292823 - DNA, 22 bp, Homo sapiens
attttaaagtatgcattattaa

SEQ ID NO: 5292824 - DNA, 17 bp, Homo sapiens
attttaaagtcagtgtt

SEQ ID NO: 5292825 - DNA, 17 bp, Homo sapiens
attttaaagtgcaaaag

SEQ ID NO: 5292826 - DNA, 14 bp, Homo sapiens
attttaaagttagt

SEQ ID NO: 5292827 - DNA, 15 bp, Homo sapiens
attttaaataaaaga

SEQ ID NO: 5292828 - DNA, 20 bp, Homo sapiens
attttaaataaaagtgatca

SEQ ID NO: 5292829 - DNA, 15 bp, Homo sapiens
attttaaataacctc

SEQ ID NO: 5292830 - DNA, 18 bp, Homo sapiens
attttaaataacctctgg

SEQ ID NO: 5292831 - DNA, 19 bp, Homo sapiens
attttaaatataaatagct

SEQ ID NO: 5292832 - DNA, 22 bp, Homo sapiens
attttaaatatccacagtactc

SEQ ID NO: 5292833 - DNA, 19 bp, Homo sapiens
attttaaatattgtatttg

SEQ ID NO: 5292834 - DNA, 15 bp, Homo sapiens
attttaaatgaaagt

SEQ ID NO: 5292835 - DNA, 18 bp, Homo sapiens
attttaaatgaagtgatt

SEQ ID NO: 5292836 - DNA, 22 bp, Homo sapiens
attttaaatgctgtatgtcatt

SEQ ID NO: 5292837 - DNA, 11 bp, Homo sapiens
attttaaatgt

SEQ ID NO: 5292838 - DNA, 12 bp, Homo sapiens
attttaaatgtg

SEQ ID NO: 5292839 - DNA, 13 bp, Homo sapiens
attttaaatgtgg

SEQ ID NO: 5292840 - DNA, 16 bp, Homo sapiens
attttaaatgtggttt

SEQ ID NO: 5292841 - DNA, 23 bp, Homo sapiens
attttaaatgtgtgagtgcatgt

SEQ ID NO: 5292842 - DNA, 15 bp, Homo sapiens
attttaaatgttcac

SEQ ID NO: 5292843 - DNA, 10 bp, Homo sapiens
attttaaatt

SEQ ID NO: 5292844 - DNA, 17 bp, Homo sapiens
attttaaattataagga

SEQ ID NO: 5292845 - DNA, 18 bp, Homo sapiens
attttaaattataaggac

SEQ ID NO: 5292846 - DNA, 15 bp, Homo sapiens
attttaaatttcttt

SEQ ID NO: 5292847 - DNA, 17 bp, Homo sapiens
attttaaatttctttta

SEQ ID NO: 5292848 - DNA, 17 bp, Homo sapiens
attttaaattttatgtc

SEQ ID NO: 5292849 - DNA, 18 bp, Homo sapiens
attttaacaaaagcaaga

SEQ ID NO: 5292850 - DNA, 13 bp, Homo sapiens
attttaacaagaa

SEQ ID NO: 5292851 - DNA, 15 bp, Homo sapiens
attttaacaataact

SEQ ID NO: 5292852 - DNA, 20 bp, Homo sapiens
attttaacacacataaagga

SEQ ID NO: 5292853 - DNA, 22 bp, Homo sapiens
attttaacagtacctgtgcctg

SEQ ID NO: 5292854 - DNA, 12 bp, Homo sapiens
attttaacatag

SEQ ID NO: 5292855 - DNA, 18 bp, Homo sapiens
attttaacataggcaaga

SEQ ID NO: 5292856 - DNA, 16 bp, Homo sapiens
attttaaccaaaacat

SEQ ID NO: 5292857 - DNA, 22 bp, Homo sapiens
attttaacctagatgtttaaca

SEQ ID NO: 5292858 - DNA, 17 bp, Homo sapiens
attttaacctgcataaa

SEQ ID NO: 5292859 - DNA, 23 bp, Homo sapiens
attttaacctgtatactcttgaa

SEQ ID NO: 5292860 - DNA, 16 bp, Homo sapiens
attttaactaaatttt

SEQ ID NO: 5292861 - DNA, 21 bp, Homo sapiens
attttaactaaattttaaagc

SEQ ID NO: 5292862 - DNA, 13 bp, Homo sapiens
attttaactattt

SEQ ID NO: 5292863 - DNA, 17 bp, Homo sapiens
attttaactatttttgt

SEQ ID NO: 5292864 - DNA, 16 bp, Homo sapiens
attttaactctgtctt

SEQ ID NO: 5292865 - DNA, 20 bp, Homo sapiens
attttaactgccaatcctta

SEQ ID NO: 5292866 - DNA, 15 bp, Homo sapiens
attttaactgtgtga

SEQ ID NO: 5292867 - DNA, 10 bp, Homo sapiens
attttaactt

SEQ ID NO: 5292868 - DNA, 17 bp, Homo sapiens
attttaactttatcaca

SEQ ID NO: 5292869 - DNA, 14 bp, Homo sapiens
attttaagaaagag

SEQ ID NO: 5292870 - DNA, 19 bp, Homo sapiens
attttaagaaagagaatga

SEQ ID NO: 5292871 - DNA, 16 bp, Homo sapiens
attttaagaagaaaga

SEQ ID NO: 5292872 - DNA, 15 bp, Homo sapiens
attttaagaagacat

SEQ ID NO: 5292873 - DNA, 23 bp, Homo sapiens
attttaagacgtgaatgtctcag

SEQ ID NO: 5292874 - DNA, 19 bp, Homo sapiens
attttaagacgtgtttgtg

SEQ ID NO: 5292875 - DNA, 20 bp, Homo sapiens
attttaagacgtgtttgtgt

SEQ ID NO: 5292876 - DNA, 16 bp, Homo sapiens
attttaagactgattt

SEQ ID NO: 5292877 - DNA, 14 bp, Homo sapiens
attttaagagaaaa

SEQ ID NO: 5292878 - DNA, 14 bp, Homo sapiens
attttaagattcct

SEQ ID NO: 5292879 - DNA, 21 bp, Homo sapiens
attttaagcactcttaaagca

SEQ ID NO: 5292880 - DNA, 17 bp, Homo sapiens
caagcttttaacttttt

SEQ ID NO: 5292881 - DNA, 22 bp, Homo sapiens
caagcttttagtatccacagga

SEQ ID NO: 5292882 - DNA, 15 bp, Homo sapiens
caagcttttctgtag

SEQ ID NO: 5292883 - DNA, 14 bp, Homo sapiens
caagcttttgctca

SEQ ID NO: 5292884 - DNA, 22 bp, Homo sapiens
caagcttttttgccacaaagaa

SEQ ID NO: 5292885 - DNA, 20 bp, Homo sapiens
caaggaaaaaataacaatga

SEQ ID NO: 5292886 - DNA, 20 bp, Homo sapiens
caaggaaaaatgccactccc

SEQ ID NO: 5292887 - DNA, 16 bp, Homo sapiens
caaggaaaaggaggag

SEQ ID NO: 5292888 - DNA, 18 bp, Homo sapiens
caaggaaaaggaggaggt

SEQ ID NO: 5292889 - DNA, 15 bp, Homo sapiens
caaggaaaataagtg

SEQ ID NO: 5292890 - DNA, 21 bp, Homo sapiens
caaggaaaataagtgaaattt

SEQ ID NO: 5292891 - DNA, 17 bp, Homo sapiens
caaggaaaataatagga

SEQ ID NO: 5292892 - DNA, 22 bp, Homo sapiens
caaggaaaattgaaagtattca

SEQ ID NO: 5292893 - DNA, 14 bp, Homo sapiens
caaggaaacattaa

SEQ ID NO: 5292894 - DNA, 14 bp, Homo sapiens
caaggaaagaacta

SEQ ID NO: 5292895 - DNA, 18 bp, Homo sapiens
caaggaaaggctcattta

SEQ ID NO: 5292896 - DNA, 23 bp, Homo sapiens
caaggaaaggctcatttaaaaca

SEQ ID NO: 5292897 - DNA, 23 bp, Homo sapiens
caaggaaagggggtcccagtggg

SEQ ID NO: 5292898 - DNA, 17 bp, Homo sapiens
caaggaaagtgaacctt

SEQ ID NO: 5292899 - DNA, 23 bp, Homo sapiens
caaggaaataaagcgtcctctca

SEQ ID NO: 5292900 - DNA, 20 bp, Homo sapiens
caaggaaatacccttctttt

SEQ ID NO: 5292901 - DNA, 15 bp, Homo sapiens
caaggaaatgtcctg

SEQ ID NO: 5292902 - DNA, 17 bp, Homo sapiens
caaggaaatgtcctgca

SEQ ID NO: 5292903 - DNA, 19 bp, Homo sapiens
caaggaaatgtcctgcatg

SEQ ID NO: 5292904 - DNA, 21 bp, Homo sapiens
caaggaaatgtcctgcatggg

SEQ ID NO: 5292905 - DNA, 13 bp, Homo sapiens
caaggaacagcca

SEQ ID NO: 5292906 - DNA, 22 bp, Homo sapiens
caaggaaccctcaggccaccct

SEQ ID NO: 5292907 - DNA, 18 bp, Homo sapiens
caaggaacctaattgaaa

SEQ ID NO: 5292908 - DNA, 15 bp, Homo sapiens
caaggaactcttgaa

SEQ ID NO: 5292909 - DNA, 12 bp, Homo sapiens
caaggaagaaaa

SEQ ID NO: 5292910 - DNA, 18 bp, Homo sapiens
caaggaagaaattaactt

SEQ ID NO: 5292911 - DNA, 17 bp, Homo sapiens
caaggaagaagaaatct

SEQ ID NO: 5292912 - DNA, 11 bp, Homo sapiens
caaggaagagc

SEQ ID NO: 5292913 - DNA, 18 bp, Homo sapiens
caaggaagagccagccgt

SEQ ID NO: 5292914 - DNA, 20 bp, Homo sapiens
caaggaagcagaagacggga

SEQ ID NO: 5292915 - DNA, 18 bp, Homo sapiens
caaggaagcagagcactg

SEQ ID NO: 5292916 - DNA, 10 bp, Homo sapiens
caaggaagct

SEQ ID NO: 5292917 - DNA, 16 bp, Homo sapiens
caaggaagctccttcc

SEQ ID NO: 5292918 - DNA, 19 bp, Homo sapiens
caaggaagctttggaagca

SEQ ID NO: 5292919 - DNA, 20 bp, Homo sapiens
caaggaagctttggaagcag

SEQ ID NO: 5292920 - DNA, 16 bp, Homo sapiens
caaggaaggaaaagaa

SEQ ID NO: 5292921 - DNA, 16 bp, Homo sapiens
caaggaaggaaacaat

SEQ ID NO: 5292922 - DNA, 17 bp, Homo sapiens
caaggaaggaaagatgt

SEQ ID NO: 5292923 - DNA, 13 bp, Homo sapiens
caaggaaggacac

SEQ ID NO: 5292924 - DNA, 15 bp, Homo sapiens
caaggaaggacattt

SEQ ID NO: 5292925 - DNA, 13 bp, Homo sapiens
caaggaaggactt

SEQ ID NO: 5292926 - DNA, 14 bp, Homo sapiens
caaggaaggagccc

SEQ ID NO: 5292927 - DNA, 17 bp, Homo sapiens
caaggaaggagcccctg

SEQ ID NO: 5292928 - DNA, 17 bp, Homo sapiens
caaggaagggatgtatt

SEQ ID NO: 5292929 - DNA, 24 bp, Homo sapiens
caaggaagggtgggaagcttgctg

SEQ ID NO: 5292930 - DNA, 12 bp, Homo sapiens
caaggaagtcaa

SEQ ID NO: 5292931 - DNA, 16 bp, Homo sapiens
caaggaagtctgtgtc

SEQ ID NO: 5292932 - DNA, 21 bp, Homo sapiens
caaggaagtctgtgtctacca

SEQ ID NO: 5292933 - DNA, 17 bp, Homo sapiens
caaggaagtcttcaaat

SEQ ID NO: 5292934 - DNA, 20 bp, Homo sapiens
caaggaataaatgagaggga

SEQ ID NO: 5292935 - DNA, 16 bp, Homo sapiens
caaggaatcagcagga

SEQ ID NO: 5292936 - DNA, 14 bp, Homo sapiens
caaggaatccatcc

SEQ ID NO: 5292937 - DNA, 19 bp, Homo sapiens
caaggaatgcctgtgccaa

SEQ ID NO: 5292938 - DNA, 14 bp, Homo sapiens
caaggaatgtgtcc

SEQ ID NO: 5292939 - DNA, 20 bp, Homo sapiens
caaggaatttccctgtgtgg

SEQ ID NO: 5292940 - DNA, 15 bp, Homo sapiens
caaggaatttcttaa

SEQ ID NO: 5292941 - DNA, 16 bp, Homo sapiens
caaggaatttcttaac

SEQ ID NO: 5292942 - DNA, 18 bp, Homo sapiens
caaggacaaagtctccag

SEQ ID NO: 5292943 - DNA, 16 bp, Homo sapiens
caaggacaacctgccc

SEQ ID NO: 5292944 - DNA, 22 bp, Homo sapiens
caaggacacgcgcccccctccc

SEQ ID NO: 5292945 - DNA, 12 bp, Homo sapiens
caaggacactga

SEQ ID NO: 5292946 - DNA, 15 bp, Homo sapiens
caaggacagacagca

SEQ ID NO: 5292947 - DNA, 18 bp, Homo sapiens
caaggacagcccctcctc

SEQ ID NO: 5292948 - DNA, 15 bp, Homo sapiens
caaggacaggagcct

SEQ ID NO: 5292949 - DNA, 16 bp, Homo sapiens
caaggacaggagcctg

SEQ ID NO: 5292950 - DNA, 14 bp, Homo sapiens
caaggacagggctg

SEQ ID NO: 5292951 - DNA, 16 bp, Homo sapiens
caaggacagggctgag

SEQ ID NO: 5292952 - DNA, 18 bp, Homo sapiens
caaggacagggctgagcg

SEQ ID NO: 5292953 - DNA, 15 bp, Homo sapiens
caaggacagggctgg

SEQ ID NO: 5292954 - DNA, 22 bp, Homo sapiens
caaggacagttcagagatcagg

SEQ ID NO: 5292955 - DNA, 22 bp, Homo sapiens
caaggacatggtgagtctattt

SEQ ID NO: 5292956 - DNA, 17 bp, Homo sapiens
caaggacattcactgct

SEQ ID NO: 5292957 - DNA, 16 bp, Homo sapiens
caaggacattgcccca

SEQ ID NO: 5292958 - DNA, 18 bp, Homo sapiens
caaggacattgccccaag

SEQ ID NO: 5292959 - DNA, 19 bp, Homo sapiens
caaggacattgccccaaga

SEQ ID NO: 5292960 - DNA, 15 bp, Homo sapiens
caaggacatttggga

SEQ ID NO: 5292961 - DNA, 23 bp, Homo sapiens
caaggaccaacaagggcagtgga

SEQ ID NO: 5292962 - DNA, 14 bp, Homo sapiens
caaggaccaggact

SEQ ID NO: 5292963 - DNA, 20 bp, Homo sapiens
caaggaccaggactccctcc

SEQ ID NO: 5292964 - DNA, 12 bp, Homo sapiens
caaggacccagc

SEQ ID NO: 5292965 - DNA, 15 bp, Homo sapiens
caaggacccaggcgc

SEQ ID NO: 5292966 - DNA, 15 bp, Homo sapiens
caaggacccctcacc

SEQ ID NO: 5292967 - DNA, 18 bp, Homo sapiens
caaggaccgtttttacta

SEQ ID NO: 5292968 - DNA, 12 bp, Homo sapiens
caaggacctctt

SEQ ID NO: 5292969 - DNA, 23 bp, Homo sapiens
caaggacctctttactctctccg

SEQ ID NO: 5292970 - DNA, 20 bp, Homo sapiens
caaggaccttacaggccctc

SEQ ID NO: 5292971 - DNA, 20 bp, Homo sapiens
caaggacgaatttgcacagt

SEQ ID NO: 5292972 - DNA, 14 bp, Homo sapiens
caaggacgctggct

SEQ ID NO: 5292973 - DNA, 17 bp, Homo sapiens
caaggacgctggctact

SEQ ID NO: 5292974 - DNA, 18 bp, Homo sapiens
caaggacgctggctactg

SEQ ID NO: 5292975 - DNA, 21 bp, Homo sapiens
caaggacgcttcacaggacag

SEQ ID NO: 5292976 - DNA, 22 bp, Homo sapiens
caaggactaatccaatacctct

SEQ ID NO: 5292977 - DNA, 16 bp, Homo sapiens
caaggactagggtcct

SEQ ID NO: 5292978 - DNA, 20 bp, Homo sapiens
caaggactagggtcctgggg

SEQ ID NO: 5292979 - DNA, 19 bp, Homo sapiens
caaggactcccggagcctg

SEQ ID NO: 5292980 - DNA, 22 bp, Homo sapiens
caaggactcccggagcctgtgc

SEQ ID NO: 5292981 - DNA, 23 bp, Homo sapiens
caaggactcccggagcctgtgca

SEQ ID NO: 5292982 - DNA, 17 bp, Homo sapiens
caaggactctggcctct

SEQ ID NO: 5292983 - DNA, 14 bp, Homo sapiens
caaggactgaggga

SEQ ID NO: 5292984 - DNA, 22 bp, Homo sapiens
caaggactgcagggactgccag

SEQ ID NO: 5292985 - DNA, 18 bp, Homo sapiens
caaggactgtttcagtgt

SEQ ID NO: 5292986 - DNA, 19 bp, Homo sapiens
caaggacttcctgtccagc

SEQ ID NO: 5292987 - DNA, 16 bp, Homo sapiens
caaggacttgaaagca

SEQ ID NO: 5292988 - DNA, 16 bp, Homo sapiens
caaggactttgcagcc

SEQ ID NO: 5292989 - DNA, 16 bp, Homo sapiens
caaggactttgtacat

SEQ ID NO: 5292990 - DNA, 16 bp, Homo sapiens
caaggagaaacagaga

SEQ ID NO: 5292991 - DNA, 14 bp, Homo sapiens
caaggagaacaaat

SEQ ID NO: 5292992 - DNA, 18 bp, Homo sapiens
caaggagaacaaatattc

SEQ ID NO: 5292993 - DNA, 14 bp, Homo sapiens
caaggagaggaggc

SEQ ID NO: 5292994 - DNA, 18 bp, Homo sapiens
caaggagaggaggcaact

SEQ ID NO: 5292995 - DNA, 16 bp, Homo sapiens
caaggagatataaaat

SEQ ID NO: 5292996 - DNA, 23 bp, Homo sapiens
caaggagatgaagcaaacacatt

SEQ ID NO: 5292997 - DNA, 13 bp, Homo sapiens
caaggagatttct

SEQ ID NO: 5292998 - DNA, 15 bp, Homo sapiens
caaggagatttctta

SEQ ID NO: 5292999 - DNA, 18 bp, Homo sapiens
caaggagcaaacactgaa

SEQ ID NO: 5293000 - DNA, 23 bp, Homo sapiens
caaggagcctccgttcccacctc

SEQ ID NO: 5293001 - DNA, 19 bp, Homo sapiens
caaggagctcaccctgccc

SEQ ID NO: 5293002 - DNA, 21 bp, Homo sapiens
caaggagctcaccctgcccgc

SEQ ID NO: 5293003 - DNA, 14 bp, Homo sapiens
caaggagctgagaa

SEQ ID NO: 5293004 - DNA, 18 bp, Homo sapiens
caaggagctgagaataga

SEQ ID NO: 5293005 - DNA, 22 bp, Homo sapiens
caaggagctgagaatagaagga

SEQ ID NO: 5293006 - DNA, 19 bp, Homo sapiens
caaggagcttacccaagct

SEQ ID NO: 5293007 - DNA, 19 bp, Homo sapiens
caaggaggaaatgtggaaa

SEQ ID NO: 5293008 - DNA, 14 bp, Homo sapiens
caaggaggcagcct

SEQ ID NO: 5293009 - DNA, 16 bp, Homo sapiens
caaggaggcccactgt

SEQ ID NO: 5293010 - DNA, 14 bp, Homo sapiens
caaggaggctggct

SEQ ID NO: 5293011 - DNA, 15 bp, Homo sapiens
caaggagggcacagg

SEQ ID NO: 5293012 - DNA, 18 bp, Homo sapiens
caaggagggggcctcatt

SEQ ID NO: 5293013 - DNA, 19 bp, Homo sapiens
caaggagggggcctcattg

SEQ ID NO: 5293014 - DNA, 20 bp, Homo sapiens
caaggagggtgagtgcaagg

SEQ ID NO: 5293015 - DNA, 15 bp, Homo sapiens
caaggaggtagagag

SEQ ID NO: 5293016 - DNA, 23 bp, Homo sapiens
caaggaggtcagaagaaaattgg

SEQ ID NO: 5293017 - DNA, 15 bp, Homo sapiens
caaggaggtggctgt

SEQ ID NO: 5293018 - DNA, 18 bp, Homo sapiens
caaggagtatgcagggag

SEQ ID NO: 5293019 - DNA, 18 bp, Homo sapiens
caaggagtcactgagacc

SEQ ID NO: 5293020 - DNA, 18 bp, Homo sapiens
caaggagtgcccgccttg

SEQ ID NO: 5293021 - DNA, 16 bp, Homo sapiens
caaggagtgtaaaatg

SEQ ID NO: 5293022 - DNA, 17 bp, Homo sapiens
caaggagtgtaaaatgt

SEQ ID NO: 5293023 - DNA, 22 bp, Homo sapiens
caaggagtgtaaaatgtatatt

SEQ ID NO: 5293024 - DNA, 21 bp, Homo sapiens
caaggagttcgtggctgcaaa

SEQ ID NO: 5293025 - DNA, 15 bp, Homo sapiens
caaggagttctcttc

SEQ ID NO: 5293026 - DNA, 17 bp, Homo sapiens
caaggagttctcttccg

SEQ ID NO: 5293027 - DNA, 18 bp, Homo sapiens
caaggagtttattacaat

SEQ ID NO: 5293028 - DNA, 22 bp, Homo sapiens
caaggagtttattacaatgtat

SEQ ID NO: 5293029 - DNA, 17 bp, Homo sapiens
caaggatagaagtatac

SEQ ID NO: 5293030 - DNA, 15 bp, Homo sapiens
caaggatagatgctg

SEQ ID NO: 5293031 - DNA, 21 bp, Homo sapiens
caaggatagatgctggcccag

SEQ ID NO: 5293032 - DNA, 22 bp, Homo sapiens
caaggatagatgctggcccagg

SEQ ID NO: 5293033 - DNA, 16 bp, Homo sapiens
caaggatatactgcag

SEQ ID NO: 5293034 - DNA, 15 bp, Homo sapiens
caaggatcagattct

SEQ ID NO: 5293035 - DNA, 19 bp, Homo sapiens
caaggatcaggctgctgga

SEQ ID NO: 5293036 - DNA, 13 bp, Homo sapiens
caaggatcctctc

SEQ ID NO: 5293037 - DNA, 16 bp, Homo sapiens
caaggatcctctccac

SEQ ID NO: 5293038 - DNA, 13 bp, Homo sapiens
caaggatcctgag

SEQ ID NO: 5293039 - DNA, 22 bp, Homo sapiens
caaggatcctgagccagatttc

SEQ ID NO: 5293040 - DNA, 21 bp, Homo sapiens
caaggatgaattctttcaatt

SEQ ID NO: 5293041 - DNA, 19 bp, Homo sapiens
caaggatgccccgtccccc

SEQ ID NO: 5293042 - DNA, 12 bp, Homo sapiens
caaggatgctca

SEQ ID NO: 5293043 - DNA, 21 bp, Homo sapiens
caaggatgggccatctggggt

SEQ ID NO: 5293044 - DNA, 14 bp, Homo sapiens
caaggatgttttta

SEQ ID NO: 5293045 - DNA, 16 bp, Homo sapiens
caaggatgtttttaat

SEQ ID NO: 5293046 - DNA, 18 bp, Homo sapiens
caaggattacagaaactg

SEQ ID NO: 5293047 - DNA, 20 bp, Homo sapiens
caaggattacagaaactgat

SEQ ID NO: 5293048 - DNA, 21 bp, Homo sapiens
caaggattacagaaactgatg

SEQ ID NO: 5293049 - DNA, 15 bp, Homo sapiens
caaggattgctactg

SEQ ID NO: 5293050 - DNA, 19 bp, Homo sapiens
caaggattgctactgtcct

SEQ ID NO: 5293051 - DNA, 19 bp, Homo sapiens
caaggcaaagtaaaattag

SEQ ID NO: 5293052 - DNA, 13 bp, Homo sapiens
caaggcaaatgtc

SEQ ID NO: 5293053 - DNA, 14 bp, Homo sapiens
caaggcaaatgtcc

SEQ ID NO: 5293054 - DNA, 15 bp, Homo sapiens
caaggcaaatgtcca

SEQ ID NO: 5293055 - DNA, 17 bp, Homo sapiens
caaggcaaatgtccaag

SEQ ID NO: 5293056 - DNA, 18 bp, Homo sapiens
caaggcaactagtggaga

SEQ ID NO: 5293057 - DNA, 14 bp, Homo sapiens
caaggcaagaagtg

SEQ ID NO: 5293058 - DNA, 15 bp, Homo sapiens
caaggcaagaagtgg

SEQ ID NO: 5293059 - DNA, 14 bp, Homo sapiens
attttaagcattac

SEQ ID NO: 5293060 - DNA, 15 bp, Homo sapiens
attttaagcattctt

SEQ ID NO: 5293061 - DNA, 15 bp, Homo sapiens
attttaagcattgtg

SEQ ID NO: 5293062 - DNA, 14 bp, Homo sapiens
attttaagcatttt

SEQ ID NO: 5293063 - DNA, 22 bp, Homo sapiens
attttaagccctatcactgaca

SEQ ID NO: 5293064 - DNA, 19 bp, Homo sapiens
attttaagccttcatttgc

SEQ ID NO: 5293065 - DNA, 16 bp, Homo sapiens
attttaagctaggaaa

SEQ ID NO: 5293066 - DNA, 23 bp, Homo sapiens
attttaagctaggaaaagaaatc

SEQ ID NO: 5293067 - DNA, 13 bp, Homo sapiens
attttaagggtaa

SEQ ID NO: 5293068 - DNA, 19 bp, Homo sapiens
attttaaggttgcacacag

SEQ ID NO: 5293069 - DNA, 18 bp, Homo sapiens
attttaagtaacgtgctc

SEQ ID NO: 5293070 - DNA, 23 bp, Homo sapiens
attttaagtattgcatctgtata

SEQ ID NO: 5293071 - DNA, 15 bp, Homo sapiens
attttaagtccctgt

SEQ ID NO: 5293072 - DNA, 20 bp, Homo sapiens
attttaagtccctgtcacct

SEQ ID NO: 5293073 - DNA, 11 bp, Homo sapiens
attttaagtgc

SEQ ID NO: 5293074 - DNA, 12 bp, Homo sapiens
attttaagtgct

SEQ ID NO: 5293075 - DNA, 15 bp, Homo sapiens
attttaagtgcttca

SEQ ID NO: 5293076 - DNA, 14 bp, Homo sapiens
attttaagtgcttt

SEQ ID NO: 5293077 - DNA, 21 bp, Homo sapiens
attttaagtttgcagatttat

SEQ ID NO: 5293078 - DNA, 17 bp, Homo sapiens
attttaagtttgtagta

SEQ ID NO: 5293079 - DNA, 18 bp, Homo sapiens
attttaataaaaataatt

SEQ ID NO: 5293080 - DNA, 20 bp, Homo sapiens
attttaataaaatgaaaggg

SEQ ID NO: 5293081 - DNA, 16 bp, Homo sapiens
attttaataaacactc

SEQ ID NO: 5293082 - DNA, 17 bp, Homo sapiens
attttaataaactttga

SEQ ID NO: 5293083 - DNA, 13 bp, Homo sapiens
attttaataaaga

SEQ ID NO: 5293084 - DNA, 14 bp, Homo sapiens
attttaataaagat

SEQ ID NO: 5293085 - DNA, 14 bp, Homo sapiens
attttaataaagta

SEQ ID NO: 5293086 - DNA, 18 bp, Homo sapiens
attttaataatgtttcaa

SEQ ID NO: 5293087 - DNA, 10 bp, Homo sapiens
attttaatac

SEQ ID NO: 5293088 - DNA, 13 bp, Homo sapiens
attttaatacaag

SEQ ID NO: 5293089 - DNA, 19 bp, Homo sapiens
attttaatacctttaaata

SEQ ID NO: 5293090 - DNA, 23 bp, Homo sapiens
attttaatacctttaaatatcat

SEQ ID NO: 5293091 - DNA, 13 bp, Homo sapiens
attttaatagaaa

SEQ ID NO: 5293092 - DNA, 15 bp, Homo sapiens
attttaatagaaata

SEQ ID NO: 5293093 - DNA, 14 bp, Homo sapiens
attttaatagaatt

SEQ ID NO: 5293094 - DNA, 16 bp, Homo sapiens
attttaatagaatttt

SEQ ID NO: 5293095 - DNA, 22 bp, Homo sapiens
attttaatagtttctaaaccat

SEQ ID NO: 5293096 - DNA, 15 bp, Homo sapiens
attttaatatataat

SEQ ID NO: 5293097 - DNA, 16 bp, Homo sapiens
attttaatatataatt

SEQ ID NO: 5293098 - DNA, 16 bp, Homo sapiens
attttaatattttgta

SEQ ID NO: 5293099 - DNA, 14 bp, Homo sapiens
attttaatcaagtt

SEQ ID NO: 5293100 - DNA, 14 bp, Homo sapiens
attttaatcctgta

SEQ ID NO: 5293101 - DNA, 15 bp, Homo sapiens
attttaatcctgtac

SEQ ID NO: 5293102 - DNA, 20 bp, Homo sapiens
attttaatgaaatcaaatgt

SEQ ID NO: 5293103 - DNA, 22 bp, Homo sapiens
attttaatgaaatcaaatgtat

SEQ ID NO: 5293104 - DNA, 17 bp, Homo sapiens
attttaatgatggtgtt

SEQ ID NO: 5293105 - DNA, 19 bp, Homo sapiens
attttaatgcattgttata

SEQ ID NO: 5293106 - DNA, 20 bp, Homo sapiens
attttaatggattgttaatt

SEQ ID NO: 5293107 - DNA, 12 bp, Homo sapiens
attttaatggct

SEQ ID NO: 5293108 - DNA, 15 bp, Homo sapiens
attttaatgggtttc

SEQ ID NO: 5293109 - DNA, 12 bp, Homo sapiens
attttaatgtaa

SEQ ID NO: 5293110 - DNA, 20 bp, Homo sapiens
attttaatgtaaaattcata

SEQ ID NO: 5293111 - DNA, 22 bp, Homo sapiens
attttaatgtaaagatttgctt

SEQ ID NO: 5293112 - DNA, 17 bp, Homo sapiens
attttaatgtacttgaa

SEQ ID NO: 5293113 - DNA, 19 bp, Homo sapiens
attttaatgtacttgaaaa

SEQ ID NO: 5293114 - DNA, 17 bp, Homo sapiens
attttaatgtatatttg

SEQ ID NO: 5293115 - DNA, 22 bp, Homo sapiens
attttaatgtatatttgctgca

SEQ ID NO: 5293116 - DNA, 14 bp, Homo sapiens
attttaatgtattg

SEQ ID NO: 5293117 - DNA, 15 bp, Homo sapiens
attttaatgtgaaga

SEQ ID NO: 5293118 - DNA, 16 bp, Homo sapiens
attttaatgtgatgat

SEQ ID NO: 5293119 - DNA, 24 bp, Homo sapiens
attttaatgtgatgatgtaattga

SEQ ID NO: 5293120 - DNA, 17 bp, Homo sapiens
attttaatgttaacttt

SEQ ID NO: 5293121 - DNA, 20 bp, Homo sapiens
attttaatgttaactttcaa

SEQ ID NO: 5293122 - DNA, 21 bp, Homo sapiens
attttaatgttaactttcaaa

SEQ ID NO: 5293123 - DNA, 17 bp, Homo sapiens
attttaattcaggtgat

SEQ ID NO: 5293124 - DNA, 14 bp, Homo sapiens
attttaattgtcat

SEQ ID NO: 5293125 - DNA, 15 bp, Homo sapiens
attttaatttagtaa

SEQ ID NO: 5293126 - DNA, 19 bp, Homo sapiens
attttaatttagtaaatgt

SEQ ID NO: 5293127 - DNA, 21 bp, Homo sapiens
attttaatttagtaaatgtta

SEQ ID NO: 5293128 - DNA, 14 bp, Homo sapiens
attttaatttatat

SEQ ID NO: 5293129 - DNA, 19 bp, Homo sapiens
attttaatttatatttgaa

SEQ ID NO: 5293130 - DNA, 18 bp, Homo sapiens
attttaatttcaagctta

SEQ ID NO: 5293131 - DNA, 19 bp, Homo sapiens
attttaatttcaagcttat

SEQ ID NO: 5293132 - DNA, 16 bp, Homo sapiens
attttaatttgggcat

SEQ ID NO: 5293133 - DNA, 12 bp, Homo sapiens
attttacaaaaa

SEQ ID NO: 5293134 - DNA, 15 bp, Homo sapiens
attttacaaaatgct

SEQ ID NO: 5293135 - DNA, 16 bp, Homo sapiens
attttacaaaatgctg

SEQ ID NO: 5293136 - DNA, 12 bp, Homo sapiens
attttacaaata

SEQ ID NO: 5293137 - DNA, 14 bp, Homo sapiens
attttacaaatatt

SEQ ID NO: 5293138 - DNA, 21 bp, Homo sapiens
attttacaaattaatatttgt

SEQ ID NO: 5293139 - DNA, 20 bp, Homo sapiens
attttacaataggtgcttat

SEQ ID NO: 5293140 - DNA, 21 bp, Homo sapiens
attttacaattgaaatgacta

SEQ ID NO: 5293141 - DNA, 21 bp, Homo sapiens
attttacacaaatgtgatttt

SEQ ID NO: 5293142 - DNA, 14 bp, Homo sapiens
attttacacagaaa

SEQ ID NO: 5293143 - DNA, 22 bp, Homo sapiens
attttacacagaaacactgcct

SEQ ID NO: 5293144 - DNA, 15 bp, Homo sapiens
attttacagagaatc

SEQ ID NO: 5293145 - DNA, 13 bp, Homo sapiens
attttacagagcg

SEQ ID NO: 5293146 - DNA, 15 bp, Homo sapiens
attttacagatttct

SEQ ID NO: 5293147 - DNA, 18 bp, Homo sapiens
attttacagctcattaaa

SEQ ID NO: 5293148 - DNA, 22 bp, Homo sapiens
attttacagctcattaaacttt

SEQ ID NO: 5293149 - DNA, 21 bp, Homo sapiens
attttacagtatcttcaaaaa

SEQ ID NO: 5293150 - DNA, 16 bp, Homo sapiens
attttacagtctctgt

SEQ ID NO: 5293151 - DNA, 11 bp, Homo sapiens
attttacagtg

SEQ ID NO: 5293152 - DNA, 12 bp, Homo sapiens
attttacagtga

SEQ ID NO: 5293153 - DNA, 13 bp, Homo sapiens
attttacataaat

SEQ ID NO: 5293154 - DNA, 16 bp, Homo sapiens
attttacataaattta

SEQ ID NO: 5293155 - DNA, 21 bp, Homo sapiens
attttacatatggaaatatag

SEQ ID NO: 5293156 - DNA, 22 bp, Homo sapiens
attttacatgtctcatattttc

SEQ ID NO: 5293157 - DNA, 14 bp, Homo sapiens
attttaccaaagca

SEQ ID NO: 5293158 - DNA, 20 bp, Homo sapiens
attttaccaagagtaacttt

SEQ ID NO: 5293159 - DNA, 12 bp, Homo sapiens
attttacctatt

SEQ ID NO: 5293160 - DNA, 15 bp, Homo sapiens
attttacctattctg

SEQ ID NO: 5293161 - DNA, 18 bp, Homo sapiens
attttacctctctctggg

SEQ ID NO: 5293162 - DNA, 14 bp, Homo sapiens
attttaccttgttt

SEQ ID NO: 5293163 - DNA, 22 bp, Homo sapiens
attttacgttttagaaaatttt

SEQ ID NO: 5293164 - DNA, 22 bp, Homo sapiens
attttactactgtggaaaaata

SEQ ID NO: 5293165 - DNA, 17 bp, Homo sapiens
attttactagaaatggg

SEQ ID NO: 5293166 - DNA, 22 bp, Homo sapiens
attttactatgcctgttgatct

SEQ ID NO: 5293167 - DNA, 18 bp, Homo sapiens
attttactgacagaaatg

SEQ ID NO: 5293168 - DNA, 21 bp, Homo sapiens
attttactgacagaaatgcaa

SEQ ID NO: 5293169 - DNA, 18 bp, Homo sapiens
attttactgtctgtaaga

SEQ ID NO: 5293170 - DNA, 23 bp, Homo sapiens
attttactgtctgtaagagaatt

SEQ ID NO: 5293171 - DNA, 16 bp, Homo sapiens
attttactgtcttaat

SEQ ID NO: 5293172 - DNA, 18 bp, Homo sapiens
attttacttagctggaga

SEQ ID NO: 5293173 - DNA, 20 bp, Homo sapiens
attttacttccatgatactt

SEQ ID NO: 5293174 - DNA, 17 bp, Homo sapiens
attttacttccattata

SEQ ID NO: 5293175 - DNA, 13 bp, Homo sapiens
attttactttgta

SEQ ID NO: 5293176 - DNA, 16 bp, Homo sapiens
attttacttttacagt

SEQ ID NO: 5293177 - DNA, 16 bp, Homo sapiens
attttacttttataat

SEQ ID NO: 5293178 - DNA, 18 bp, Homo sapiens
attttacttttctgccaa

SEQ ID NO: 5293179 - DNA, 20 bp, Homo sapiens
attttacttttctgccaaaa

SEQ ID NO: 5293180 - DNA, 14 bp, Homo sapiens
attttactttttgg

SEQ ID NO: 5293181 - DNA, 19 bp, Homo sapiens
attttagaaaatcagattt

SEQ ID NO: 5293182 - DNA, 17 bp, Homo sapiens
attttagaaagaaaatt

SEQ ID NO: 5293183 - DNA, 18 bp, Homo sapiens
attttagaaagaaaatta

SEQ ID NO: 5293184 - DNA, 23 bp, Homo sapiens
attttagaaagaaaattatattc

SEQ ID NO: 5293185 - DNA, 15 bp, Homo sapiens
attttagaaagctaa

SEQ ID NO: 5293186 - DNA, 14 bp, Homo sapiens
attttagaaataat

SEQ ID NO: 5293187 - DNA, 17 bp, Homo sapiens
attttagaaatattcac

SEQ ID NO: 5293188 - DNA, 19 bp, Homo sapiens
attttagaatgtcaataaa

SEQ ID NO: 5293189 - DNA, 16 bp, Homo sapiens
attttagacaaccata

SEQ ID NO: 5293190 - DNA, 21 bp, Homo sapiens
attttagacactgggagaaga

SEQ ID NO: 5293191 - DNA, 23 bp, Homo sapiens
attttagacactgggagaagaga

SEQ ID NO: 5293192 - DNA, 24 bp, Homo sapiens
attttagacactgggagaagagaa

SEQ ID NO: 5293193 - DNA, 14 bp, Homo sapiens
attttagacattca

SEQ ID NO: 5293194 - DNA, 18 bp, Homo sapiens
attttagactcaaagaat

SEQ ID NO: 5293195 - DNA, 19 bp, Homo sapiens
attttagacttaccttgaa

SEQ ID NO: 5293196 - DNA, 18 bp, Homo sapiens
attttagagaaactttga

SEQ ID NO: 5293197 - DNA, 23 bp, Homo sapiens
attttagagcataccagtactca

SEQ ID NO: 5293198 - DNA, 15 bp, Homo sapiens
attttagatgtagat

SEQ ID NO: 5293199 - DNA, 23 bp, Homo sapiens
attttagatgttattatgctaat

SEQ ID NO: 5293200 - DNA, 15 bp, Homo sapiens
attttagatgtttaa

SEQ ID NO: 5293201 - DNA, 19 bp, Homo sapiens
attttagatttctttgatt

SEQ ID NO: 5293202 - DNA, 14 bp, Homo sapiens
attttagcagttct

SEQ ID NO: 5293203 - DNA, 21 bp, Homo sapiens
attttagcagttctgcaaata

SEQ ID NO: 5293204 - DNA, 19 bp, Homo sapiens
attttagcatgatgaaact

SEQ ID NO: 5293205 - DNA, 18 bp, Homo sapiens
attttagccttctctgtt

SEQ ID NO: 5293206 - DNA, 21 bp, Homo sapiens
attttagccttctctgttcat

SEQ ID NO: 5293207 - DNA, 13 bp, Homo sapiens
attttagctaaat

SEQ ID NO: 5293208 - DNA, 16 bp, Homo sapiens
attttagctaatttag

SEQ ID NO: 5293209 - DNA, 13 bp, Homo sapiens
attttagctcttc

SEQ ID NO: 5293210 - DNA, 15 bp, Homo sapiens
attttagctgcagaa

SEQ ID NO: 5293211 - DNA, 16 bp, Homo sapiens
attttagctgcagaac

SEQ ID NO: 5293212 - DNA, 18 bp, Homo sapiens
attttagctggtgtcagc

SEQ ID NO: 5293213 - DNA, 18 bp, Homo sapiens
attttagcttcagttgtt

SEQ ID NO: 5293214 - DNA, 15 bp, Homo sapiens
attttaggaaaggat

SEQ ID NO: 5293215 - DNA, 20 bp, Homo sapiens
attttaggaaatttaagact

SEQ ID NO: 5293216 - DNA, 15 bp, Homo sapiens
attttaggaacttca

SEQ ID NO: 5293217 - DNA, 18 bp, Homo sapiens
attttaggaataataaat

SEQ ID NO: 5293218 - DNA, 19 bp, Homo sapiens
attttaggagacagtctca

SEQ ID NO: 5293219 - DNA, 17 bp, Homo sapiens
attttaggcacccatcc

SEQ ID NO: 5293220 - DNA, 17 bp, Homo sapiens
attttaggcctcctctc

SEQ ID NO: 5293221 - DNA, 15 bp, Homo sapiens
attttaggctattat

SEQ ID NO: 5293222 - DNA, 21 bp, Homo sapiens
attttaggctattataatata

SEQ ID NO: 5293223 - DNA, 22 bp, Homo sapiens
attttagggtgggtaagaaagc

SEQ ID NO: 5293224 - DNA, 20 bp, Homo sapiens
attttagggttctaaatgca

SEQ ID NO: 5293225 - DNA, 16 bp, Homo sapiens
attttaggtgttgatt

SEQ ID NO: 5293226 - DNA, 18 bp, Homo sapiens
attttagtaatttcctag

SEQ ID NO: 5293227 - DNA, 19 bp, Homo sapiens
attttagtaatttcctaga

SEQ ID NO: 5293228 - DNA, 15 bp, Homo sapiens
attttagtacatttt

SEQ ID NO: 5293229 - DNA, 23 bp, Homo sapiens
attttagtatatttatataatta

SEQ ID NO: 5293230 - DNA, 16 bp, Homo sapiens
attttagtatgtgcag

SEQ ID NO: 5293231 - DNA, 14 bp, Homo sapiens
attttagtcacttt

SEQ ID NO: 5293232 - DNA, 15 bp, Homo sapiens
attttagtcttgctg

SEQ ID NO: 5293233 - DNA, 20 bp, Homo sapiens
attttagtggaccctgaaat

SEQ ID NO: 5293234 - DNA, 22 bp, Homo sapiens
attttagtggaccctgaaatgt

SEQ ID NO: 5293235 - DNA, 14 bp, Homo sapiens
attttagtgtatct

SEQ ID NO: 5293236 - DNA, 20 bp, Homo sapiens
attttagtgtgtaaaattaa

SEQ ID NO: 5293237 - DNA, 14 bp, Homo sapiens
attttagttaacta

SEQ ID NO: 5293238 - DNA, 14 bp, Homo sapiens
caaggcaagcattt

SEQ ID NO: 5293239 - DNA, 14 bp, Homo sapiens
caaggcaaggcagg

SEQ ID NO: 5293240 - DNA, 16 bp, Homo sapiens
caaggcaaggcaggtg

SEQ ID NO: 5293241 - DNA, 18 bp, Homo sapiens
caaggcaaggcaggtgcc

SEQ ID NO: 5293242 - DNA, 14 bp, Homo sapiens
caaggcaatggaaa

SEQ ID NO: 5293243 - DNA, 17 bp, Homo sapiens
caaggcacattgaaata

SEQ ID NO: 5293244 - DNA, 13 bp, Homo sapiens
caaggcacctgca

SEQ ID NO: 5293245 - DNA, 17 bp, Homo sapiens
caaggcaccttcttaaa

SEQ ID NO: 5293246 - DNA, 22 bp, Homo sapiens
caaggcactaatgttttggtct

SEQ ID NO: 5293247 - DNA, 19 bp, Homo sapiens
caaggcactctagattcca

SEQ ID NO: 5293248 - DNA, 12 bp, Homo sapiens
caaggcactgcc

SEQ ID NO: 5293249 - DNA, 18 bp, Homo sapiens
caaggcactgcctgatgg

SEQ ID NO: 5293250 - DNA, 15 bp, Homo sapiens
caaggcactgtacta

SEQ ID NO: 5293251 - DNA, 16 bp, Homo sapiens
caaggcactgtactag

SEQ ID NO: 5293252 - DNA, 15 bp, Homo sapiens
caaggcactgtcact

SEQ ID NO: 5293253 - DNA, 20 bp, Homo sapiens
caaggcagaagcttggagga

SEQ ID NO: 5293254 - DNA, 13 bp, Homo sapiens
caaggcagaggcc

SEQ ID NO: 5293255 - DNA, 15 bp, Homo sapiens
caaggcagaggcctg

SEQ ID NO: 5293256 - DNA, 15 bp, Homo sapiens
caaggcagcaaggcc

SEQ ID NO: 5293257 - DNA, 17 bp, Homo sapiens
caaggcagcaaggcccg

SEQ ID NO: 5293258 - DNA, 14 bp, Homo sapiens
caaggcagcctcca

SEQ ID NO: 5293259 - DNA, 17 bp, Homo sapiens
caaggcagcctccagag

SEQ ID NO: 5293260 - DNA, 20 bp, Homo sapiens
caaggcagcctccagagcca

SEQ ID NO: 5293261 - DNA, 15 bp, Homo sapiens
caaggcagctcccag

SEQ ID NO: 5293262 - DNA, 20 bp, Homo sapiens
caaggcagctcttctggagt

SEQ ID NO: 5293263 - DNA, 21 bp, Homo sapiens
caaggcagctcttctggagtt

SEQ ID NO: 5293264 - DNA, 13 bp, Homo sapiens
caaggcaggcctg

SEQ ID NO: 5293265 - DNA, 17 bp, Homo sapiens
caaggcaggcctttcct

SEQ ID NO: 5293266 - DNA, 18 bp, Homo sapiens
caaggcaggtagatcact

SEQ ID NO: 5293267 - DNA, 16 bp, Homo sapiens
caaggcaggtgcctcc

SEQ ID NO: 5293268 - DNA, 17 bp, Homo sapiens
caaggcagtgcatgcat

SEQ ID NO: 5293269 - DNA, 13 bp, Homo sapiens
caaggcagtgttc

SEQ ID NO: 5293270 - DNA, 14 bp, Homo sapiens
caaggcagttctgt

SEQ ID NO: 5293271 - DNA, 18 bp, Homo sapiens
caaggcagttctgtgtcc

SEQ ID NO: 5293272 - DNA, 21 bp, Homo sapiens
caaggcagttctgtgtcctcg

SEQ ID NO: 5293273 - DNA, 20 bp, Homo sapiens
caaggcatccccagtgccag

SEQ ID NO: 5293274 - DNA, 14 bp, Homo sapiens
caaggcattatttg

SEQ ID NO: 5293275 - DNA, 19 bp, Homo sapiens
caaggcattctcccagctc

SEQ ID NO: 5293276 - DNA, 20 bp, Homo sapiens
caaggcattctcccagctct

SEQ ID NO: 5293277 - DNA, 18 bp, Homo sapiens
caaggccaaaggaagcac

SEQ ID NO: 5293278 - DNA, 18 bp, Homo sapiens
caaggccaataataaaga

SEQ ID NO: 5293279 - DNA, 12 bp, Homo sapiens
caaggccacctc

SEQ ID NO: 5293280 - DNA, 13 bp, Homo sapiens
caaggccacctct

SEQ ID NO: 5293281 - DNA, 14 bp, Homo sapiens
caaggccacctctt

SEQ ID NO: 5293282 - DNA, 19 bp, Homo sapiens
caaggccacctcttcctgg

SEQ ID NO: 5293283 - DNA, 14 bp, Homo sapiens
caaggccagaaaaa

SEQ ID NO: 5293284 - DNA, 18 bp, Homo sapiens
caaggccagaaaaagaag

SEQ ID NO: 5293285 - DNA, 19 bp, Homo sapiens
caaggccagaaaaagaaga

SEQ ID NO: 5293286 - DNA, 20 bp, Homo sapiens
caaggccagaaaaagaagaa

SEQ ID NO: 5293287 - DNA, 23 bp, Homo sapiens
caaggccagaaaaagaagaagga

SEQ ID NO: 5293288 - DNA, 16 bp, Homo sapiens
caaggccagaaggagg

SEQ ID NO: 5293289 - DNA, 14 bp, Homo sapiens
caaggccagagtgg

SEQ ID NO: 5293290 - DNA, 21 bp, Homo sapiens
caaggccagcaaggtggagtg

SEQ ID NO: 5293291 - DNA, 20 bp, Homo sapiens
caaggccagcccacacagcc

SEQ ID NO: 5293292 - DNA, 15 bp, Homo sapiens
caaggccagggacag

SEQ ID NO: 5293293 - DNA, 20 bp, Homo sapiens
caaggccagggcacagctgg

SEQ ID NO: 5293294 - DNA, 17 bp, Homo sapiens
caaggccagtccccatt

SEQ ID NO: 5293295 - DNA, 15 bp, Homo sapiens
caaggccatccttcc

SEQ ID NO: 5293296 - DNA, 17 bp, Homo sapiens
caaggccatccttccct

SEQ ID NO: 5293297 - DNA, 23 bp, Homo sapiens
caaggccatccttccctgtctgc

SEQ ID NO: 5293298 - DNA, 15 bp, Homo sapiens
caaggccatctgctt

SEQ ID NO: 5293299 - DNA, 16 bp, Homo sapiens
caaggcccagacctgg

SEQ ID NO: 5293300 - DNA, 15 bp, Homo sapiens
caaggcccagccctg

SEQ ID NO: 5293301 - DNA, 17 bp, Homo sapiens
caaggcccagccctggg

SEQ ID NO: 5293302 - DNA, 22 bp, Homo sapiens
caaggcccagccctgggcaagg

SEQ ID NO: 5293303 - DNA, 16 bp, Homo sapiens
caaggccccagggaca

SEQ ID NO: 5293304 - DNA, 22 bp, Homo sapiens
caaggccccagggacagaggcc

SEQ ID NO: 5293305 - DNA, 18 bp, Homo sapiens
caaggcccccacctctgt

SEQ ID NO: 5293306 - DNA, 22 bp, Homo sapiens
caaggcccccacctctgtgacc

SEQ ID NO: 5293307 - DNA, 22 bp, Homo sapiens
caaggcccccgggccgacggag

SEQ ID NO: 5293308 - DNA, 17 bp, Homo sapiens
caaggccccctgcctgc

SEQ ID NO: 5293309 - DNA, 13 bp, Homo sapiens
caaggcccgagca

SEQ ID NO: 5293310 - DNA, 19 bp, Homo sapiens
caaggccctcggagctggc

SEQ ID NO: 5293311 - DNA, 12 bp, Homo sapiens
caaggccctgca

SEQ ID NO: 5293312 - DNA, 15 bp, Homo sapiens
caaggccctgccctg

SEQ ID NO: 5293313 - DNA, 17 bp, Homo sapiens
caaggccctgccctgcc

SEQ ID NO: 5293314 - DNA, 12 bp, Homo sapiens
caaggccctgct

SEQ ID NO: 5293315 - DNA, 13 bp, Homo sapiens
caaggccctgctg

SEQ ID NO: 5293316 - DNA, 14 bp, Homo sapiens
caaggccctgctgc

SEQ ID NO: 5293317 - DNA, 16 bp, Homo sapiens
caaggccctgtcccag

SEQ ID NO: 5293318 - DNA, 19 bp, Homo sapiens
caaggccctgtcccagcag

SEQ ID NO: 5293319 - DNA, 17 bp, Homo sapiens
caaggccctgtctctgg

SEQ ID NO: 5293320 - DNA, 14 bp, Homo sapiens
caaggccctttcct

SEQ ID NO: 5293321 - DNA, 19 bp, Homo sapiens
caaggccgaagctctggct

SEQ ID NO: 5293322 - DNA, 15 bp, Homo sapiens
caaggccgagggcca

SEQ ID NO: 5293323 - DNA, 19 bp, Homo sapiens
caaggccgagggccaggca

SEQ ID NO: 5293324 - DNA, 17 bp, Homo sapiens
caaggccgcccacctgc

SEQ ID NO: 5293325 - DNA, 23 bp, Homo sapiens
caaggccgcccacctgcatcagc

SEQ ID NO: 5293326 - DNA, 13 bp, Homo sapiens
caaggccgcggcc

SEQ ID NO: 5293327 - DNA, 16 bp, Homo sapiens
caaggccgcggcccag

SEQ ID NO: 5293328 - DNA, 19 bp, Homo sapiens
caaggccgctgttcaccca

SEQ ID NO: 5293329 - DNA, 23 bp, Homo sapiens
caaggccggagacccacagccct

SEQ ID NO: 5293330 - DNA, 20 bp, Homo sapiens
caaggcctaccccagttcct

SEQ ID NO: 5293331 - DNA, 21 bp, Homo sapiens
caaggcctaccccagttccta

SEQ ID NO: 5293332 - DNA, 18 bp, Homo sapiens
caaggcctaggacctatg

SEQ ID NO: 5293333 - DNA, 18 bp, Homo sapiens
caaggcctatgccacctg

SEQ ID NO: 5293334 - DNA, 13 bp, Homo sapiens
caaggcctcagga

SEQ ID NO: 5293335 - DNA, 15 bp, Homo sapiens
caaggcctcaggaga

SEQ ID NO: 5293336 - DNA, 11 bp, Homo sapiens
caaggcctccc

SEQ ID NO: 5293337 - DNA, 16 bp, Homo sapiens
caaggcctcccacagt

SEQ ID NO: 5293338 - DNA, 23 bp, Homo sapiens
caaggcctccccaatccaggcca

SEQ ID NO: 5293339 - DNA, 22 bp, Homo sapiens
caaggcctccctcaggctctgt

SEQ ID NO: 5293340 - DNA, 19 bp, Homo sapiens
caaggcctctcagacccag

SEQ ID NO: 5293341 - DNA, 14 bp, Homo sapiens
caaggcctgcttga

SEQ ID NO: 5293342 - DNA, 15 bp, Homo sapiens
caaggcctggtctgg

SEQ ID NO: 5293343 - DNA, 14 bp, Homo sapiens
caaggcctgtccct

SEQ ID NO: 5293344 - DNA, 16 bp, Homo sapiens
caaggcctgtgctgca

SEQ ID NO: 5293345 - DNA, 22 bp, Homo sapiens
caaggccttattggaaagcagt

SEQ ID NO: 5293346 - DNA, 12 bp, Homo sapiens
caaggccttcca

SEQ ID NO: 5293347 - DNA, 23 bp, Homo sapiens
caaggccttggtggagcagccag

SEQ ID NO: 5293348 - DNA, 18 bp, Homo sapiens
caaggcctttctgtgtgt

SEQ ID NO: 5293349 - DNA, 15 bp, Homo sapiens
caaggcgctaacttg

SEQ ID NO: 5293350 - DNA, 13 bp, Homo sapiens
caaggcggcccct

SEQ ID NO: 5293351 - DNA, 22 bp, Homo sapiens
caaggcgggcggatcacctgag

SEQ ID NO: 5293352 - DNA, 16 bp, Homo sapiens
caaggcgtgaggatgg

SEQ ID NO: 5293353 - DNA, 20 bp, Homo sapiens
caaggctaacatcccactta

SEQ ID NO: 5293354 - DNA, 17 bp, Homo sapiens
caaggctactacagaga

SEQ ID NO: 5293355 - DNA, 22 bp, Homo sapiens
caaggctcagaaggaatggtgc

SEQ ID NO: 5293356 - DNA, 17 bp, Homo sapiens
caaggctcatctttctg

SEQ ID NO: 5293357 - DNA, 19 bp, Homo sapiens
caaggctcctgatcattct

SEQ ID NO: 5293358 - DNA, 13 bp, Homo sapiens
caaggctctctct

SEQ ID NO: 5293359 - DNA, 18 bp, Homo sapiens
caaggctcttcttcctca

SEQ ID NO: 5293360 - DNA, 14 bp, Homo sapiens
caaggctgaaaagt

SEQ ID NO: 5293361 - DNA, 19 bp, Homo sapiens
caaggctgaccaagagaga

SEQ ID NO: 5293362 - DNA, 15 bp, Homo sapiens
caaggctgaggtggc

SEQ ID NO: 5293363 - DNA, 13 bp, Homo sapiens
caaggctgattta

SEQ ID NO: 5293364 - DNA, 13 bp, Homo sapiens
caaggctgccaga

SEQ ID NO: 5293365 - DNA, 15 bp, Homo sapiens
caaggctgccagaca

SEQ ID NO: 5293366 - DNA, 16 bp, Homo sapiens
caaggctgccagacat

SEQ ID NO: 5293367 - DNA, 12 bp, Homo sapiens
caaggctgccct

SEQ ID NO: 5293368 - DNA, 14 bp, Homo sapiens
caaggctgcctgcc

SEQ ID NO: 5293369 - DNA, 17 bp, Homo sapiens
caaggctgcctgcccca

SEQ ID NO: 5293370 - DNA, 13 bp, Homo sapiens
caaggctgcctgg

SEQ ID NO: 5293371 - DNA, 16 bp, Homo sapiens
caaggctgcctggaga

SEQ ID NO: 5293372 - DNA, 17 bp, Homo sapiens
caaggctgcctggagaa

SEQ ID NO: 5293373 - DNA, 21 bp, Homo sapiens
caaggctgcctggagaaagga

SEQ ID NO: 5293374 - DNA, 11 bp, Homo sapiens
caaggctgcta

SEQ ID NO: 5293375 - DNA, 13 bp, Homo sapiens
caaggctgctgcc

SEQ ID NO: 5293376 - DNA, 14 bp, Homo sapiens
caaggctgctgccg

SEQ ID NO: 5293377 - DNA, 13 bp, Homo sapiens
caaggctggcagg

SEQ ID NO: 5293378 - DNA, 14 bp, Homo sapiens
caaggctggccagc

SEQ ID NO: 5293379 - DNA, 15 bp, Homo sapiens
caaggctggggcatg

SEQ ID NO: 5293380 - DNA, 18 bp, Homo sapiens
caaggctggggcatggca

SEQ ID NO: 5293381 - DNA, 18 bp, Homo sapiens
caaggctgggggaagaag

SEQ ID NO: 5293382 - DNA, 22 bp, Homo sapiens
caaggctggggtcttgggttcc

SEQ ID NO: 5293383 - DNA, 13 bp, Homo sapiens
caaggctgtcaat

SEQ ID NO: 5293384 - DNA, 20 bp, Homo sapiens
caaggctgtcttctcccaga

SEQ ID NO: 5293385 - DNA, 13 bp, Homo sapiens
caaggctgtgcca

SEQ ID NO: 5293386 - DNA, 16 bp, Homo sapiens
caaggctgtgccaggc

SEQ ID NO: 5293387 - DNA, 20 bp, Homo sapiens
caaggctgtgctcttcctct

SEQ ID NO: 5293388 - DNA, 15 bp, Homo sapiens
caaggcttagaccct

SEQ ID NO: 5293389 - DNA, 18 bp, Homo sapiens
caaggcttatattcaacc

SEQ ID NO: 5293390 - DNA, 20 bp, Homo sapiens
caaggcttatttatatatat

SEQ ID NO: 5293391 - DNA, 15 bp, Homo sapiens
caaggcttcagtctc

SEQ ID NO: 5293392 - DNA, 15 bp, Homo sapiens
caaggcttgctgcag

SEQ ID NO: 5293393 - DNA, 15 bp, Homo sapiens
caaggcttggagagg

SEQ ID NO: 5293394 - DNA, 16 bp, Homo sapiens
caaggctttaaagctg

SEQ ID NO: 5293395 - DNA, 18 bp, Homo sapiens
caagggaaaggcaagctt

SEQ ID NO: 5293396 - DNA, 16 bp, Homo sapiens
caagggaaaggggtgc

SEQ ID NO: 5293397 - DNA, 16 bp, Homo sapiens
caagggaacctgtgtc

SEQ ID NO: 5293398 - DNA, 14 bp, Homo sapiens
caagggaagagcct

SEQ ID NO: 5293399 - DNA, 16 bp, Homo sapiens
caagggaagagccttt

SEQ ID NO: 5293400 - DNA, 17 bp, Homo sapiens
caagggaagagccttta

SEQ ID NO: 5293401 - DNA, 13 bp, Homo sapiens
caagggaaggaag

SEQ ID NO: 5293402 - DNA, 14 bp, Homo sapiens
caagggaaggacag

SEQ ID NO: 5293403 - DNA, 15 bp, Homo sapiens
caagggaaggggcct

SEQ ID NO: 5293404 - DNA, 21 bp, Homo sapiens
caagggaaggggcctccctcc

SEQ ID NO: 5293405 - DNA, 18 bp, Homo sapiens
caagggaatgtaactgct

SEQ ID NO: 5293406 - DNA, 15 bp, Homo sapiens
caagggacagcaagt

SEQ ID NO: 5293407 - DNA, 22 bp, Homo sapiens
caagggacagcaagtgagcaga

SEQ ID NO: 5293408 - DNA, 13 bp, Homo sapiens
caagggacagccc

SEQ ID NO: 5293409 - DNA, 23 bp, Homo sapiens
caagggacagcccacggtctgga

SEQ ID NO: 5293410 - DNA, 13 bp, Homo sapiens
caagggacaggaa

SEQ ID NO: 5293411 - DNA, 19 bp, Homo sapiens
caagggacaggaaggtctg

SEQ ID NO: 5293412 - DNA, 21 bp, Homo sapiens
caagggacaggtgggcctggc

SEQ ID NO: 5293413 - DNA, 13 bp, Homo sapiens
caagggacctgct

SEQ ID NO: 5293414 - DNA, 15 bp, Homo sapiens
caagggaccttcatg

SEQ ID NO: 5293415 - DNA, 19 bp, Homo sapiens
caagggactagtgagtcag

SEQ ID NO: 5293416 - DNA, 10 bp, Homo sapiens
caagggagaa

SEQ ID NO: 5293417 - DNA, 19 bp, Homo sapiens
caagggagaaaagagaaac

SEQ ID NO: 5293418 - DNA, 20 bp, Homo sapiens
caagggagaaaagagaaacc

SEQ ID NO: 5293419 - DNA, 15 bp, Homo sapiens
caagggagaagaaat

SEQ ID NO: 5293420 - DNA, 12 bp, Homo sapiens
attttagttact

SEQ ID NO: 5293421 - DNA, 19 bp, Homo sapiens
attttagttcacacttagt

SEQ ID NO: 5293422 - DNA, 20 bp, Homo sapiens
attttagttccttctataca

SEQ ID NO: 5293423 - DNA, 18 bp, Homo sapiens
attttagtttctgttctg

SEQ ID NO: 5293424 - DNA, 19 bp, Homo sapiens
attttagtttctgttctgt

SEQ ID NO: 5293425 - DNA, 21 bp, Homo sapiens
attttagtttctgttctgtgg

SEQ ID NO: 5293426 - DNA, 21 bp, Homo sapiens
attttagttttattttctaaa

SEQ ID NO: 5293427 - DNA, 22 bp, Homo sapiens
attttagttttattttctaaag

SEQ ID NO: 5293428 - DNA, 15 bp, Homo sapiens
attttagttttgcaa

SEQ ID NO: 5293429 - DNA, 20 bp, Homo sapiens
attttagtttttcattaaat

SEQ ID NO: 5293430 - DNA, 13 bp, Homo sapiens
attttataaaaca

SEQ ID NO: 5293431 - DNA, 17 bp, Homo sapiens
attttataaaattaaag

SEQ ID NO: 5293432 - DNA, 19 bp, Homo sapiens
attttataaaattaaagaa

SEQ ID NO: 5293433 - DNA, 15 bp, Homo sapiens
attttataaagtgct

SEQ ID NO: 5293434 - DNA, 16 bp, Homo sapiens
attttataaatcgctt

SEQ ID NO: 5293435 - DNA, 15 bp, Homo sapiens
attttataaatgtat

SEQ ID NO: 5293436 - DNA, 22 bp, Homo sapiens
attttataacatgttaaaatgt

SEQ ID NO: 5293437 - DNA, 20 bp, Homo sapiens
attttataaggctgactctt

SEQ ID NO: 5293438 - DNA, 22 bp, Homo sapiens
attttataatgatgaacttata

SEQ ID NO: 5293439 - DNA, 14 bp, Homo sapiens
attttataattctg

SEQ ID NO: 5293440 - DNA, 14 bp, Homo sapiens
attttatacaattt

SEQ ID NO: 5293441 - DNA, 22 bp, Homo sapiens
attttatacatagtcacaaaaa

SEQ ID NO: 5293442 - DNA, 13 bp, Homo sapiens
attttatactgca

SEQ ID NO: 5293443 - DNA, 18 bp, Homo sapiens
attttatactgcacttta

SEQ ID NO: 5293444 - DNA, 16 bp, Homo sapiens
attttatactgtacat

SEQ ID NO: 5293445 - DNA, 21 bp, Homo sapiens
attttatactgtacatgctat

SEQ ID NO: 5293446 - DNA, 19 bp, Homo sapiens
attttatagacaccctggc

SEQ ID NO: 5293447 - DNA, 22 bp, Homo sapiens
attttatagctcagtttatcca

SEQ ID NO: 5293448 - DNA, 19 bp, Homo sapiens
attttataggaaaaaataa

SEQ ID NO: 5293449 - DNA, 20 bp, Homo sapiens
attttataggggatacttga

SEQ ID NO: 5293450 - DNA, 23 bp, Homo sapiens
attttatagtagtgggaaagata

SEQ ID NO: 5293451 - DNA, 14 bp, Homo sapiens
attttatataaaga

SEQ ID NO: 5293452 - DNA, 22 bp, Homo sapiens
attttatataaagaaaatcaat

SEQ ID NO: 5293453 - DNA, 21 bp, Homo sapiens
attttatataaagtattcttt

SEQ ID NO: 5293454 - DNA, 18 bp, Homo sapiens
attttatatcatacagtt

SEQ ID NO: 5293455 - DNA, 19 bp, Homo sapiens
attttatatcatacagttt

SEQ ID NO: 5293456 - DNA, 14 bp, Homo sapiens
attttatatcttgt

SEQ ID NO: 5293457 - DNA, 20 bp, Homo sapiens
attttatatgaaatgtttca

SEQ ID NO: 5293458 - DNA, 13 bp, Homo sapiens
attttatatgaga

SEQ ID NO: 5293459 - DNA, 20 bp, Homo sapiens
attttatatgattttctcca

SEQ ID NO: 5293460 - DNA, 15 bp, Homo sapiens
attttatatgcttac

SEQ ID NO: 5293461 - DNA, 18 bp, Homo sapiens
attttatatgcttactga

SEQ ID NO: 5293462 - DNA, 21 bp, Homo sapiens
attttatatgtaaatgtgtta

SEQ ID NO: 5293463 - DNA, 15 bp, Homo sapiens
attttatatgttcat

SEQ ID NO: 5293464 - DNA, 18 bp, Homo sapiens
attttatattacactaca

SEQ ID NO: 5293465 - DNA, 22 bp, Homo sapiens
attttatattactgacatttct

SEQ ID NO: 5293466 - DNA, 17 bp, Homo sapiens
attttatattcagtgaa

SEQ ID NO: 5293467 - DNA, 14 bp, Homo sapiens
attttatattgaaa

SEQ ID NO: 5293468 - DNA, 20 bp, Homo sapiens
attttatatttaaaaattgt

SEQ ID NO: 5293469 - DNA, 19 bp, Homo sapiens
attttatatttttgtacat

SEQ ID NO: 5293470 - DNA, 15 bp, Homo sapiens
attttatcattaatt

SEQ ID NO: 5293471 - DNA, 20 bp, Homo sapiens
attttatccctcacctgtag

SEQ ID NO: 5293472 - DNA, 21 bp, Homo sapiens
attttatccctttctcttctg

SEQ ID NO: 5293473 - DNA, 13 bp, Homo sapiens
attttatctcttc

SEQ ID NO: 5293474 - DNA, 18 bp, Homo sapiens
attttatctgtataagct

SEQ ID NO: 5293475 - DNA, 13 bp, Homo sapiens
attttatctgtga

SEQ ID NO: 5293476 - DNA, 15 bp, Homo sapiens
attttatctgtgaat

SEQ ID NO: 5293477 - DNA, 15 bp, Homo sapiens
attttatctttgatt

SEQ ID NO: 5293478 - DNA, 13 bp, Homo sapiens
attttatgaacat

SEQ ID NO: 5293479 - DNA, 18 bp, Homo sapiens
attttatgaacattgtac

SEQ ID NO: 5293480 - DNA, 20 bp, Homo sapiens
attttatgacatgaaaagtt

SEQ ID NO: 5293481 - DNA, 23 bp, Homo sapiens
attttatgacatgaaaagttatt

SEQ ID NO: 5293482 - DNA, 21 bp, Homo sapiens
attttatgagaaatgtaatgc

SEQ ID NO: 5293483 - DNA, 18 bp, Homo sapiens
attttatgatcagtgttg

SEQ ID NO: 5293484 - DNA, 16 bp, Homo sapiens
attttatgcacagcct

SEQ ID NO: 5293485 - DNA, 21 bp, Homo sapiens
attttatgccttttatttctt

SEQ ID NO: 5293486 - DNA, 20 bp, Homo sapiens
attttatggcacctatttct

SEQ ID NO: 5293487 - DNA, 17 bp, Homo sapiens
attttatggcactattt

SEQ ID NO: 5293488 - DNA, 18 bp, Homo sapiens
attttatggttatgtttt

SEQ ID NO: 5293489 - DNA, 22 bp, Homo sapiens
attttatggttatgtttttctg

SEQ ID NO: 5293490 - DNA, 14 bp, Homo sapiens
attttatgtatgtt

SEQ ID NO: 5293491 - DNA, 12 bp, Homo sapiens
attttatgtctt

SEQ ID NO: 5293492 - DNA, 19 bp, Homo sapiens
attttatgtgcttgaagat

SEQ ID NO: 5293493 - DNA, 13 bp, Homo sapiens
attttatgtgtaa

SEQ ID NO: 5293494 - DNA, 14 bp, Homo sapiens
attttatgttatat

SEQ ID NO: 5293495 - DNA, 16 bp, Homo sapiens
attttatgttatttat

SEQ ID NO: 5293496 - DNA, 17 bp, Homo sapiens
attttatgttgacattt

SEQ ID NO: 5293497 - DNA, 18 bp, Homo sapiens
attttatgttgacatttg

SEQ ID NO: 5293498 - DNA, 22 bp, Homo sapiens
attttatgtttaaaatggcatt

SEQ ID NO: 5293499 - DNA, 14 bp, Homo sapiens
attttattaaaaca

SEQ ID NO: 5293500 - DNA, 20 bp, Homo sapiens
attttattaaacattttcat

SEQ ID NO: 5293501 - DNA, 15 bp, Homo sapiens
attttattaaagcaa

SEQ ID NO: 5293502 - DNA, 16 bp, Homo sapiens
attttattaaagcaac

SEQ ID NO: 5293503 - DNA, 21 bp, Homo sapiens
attttattaaagcaacatttt

SEQ ID NO: 5293504 - DNA, 14 bp, Homo sapiens
attttattaaatct

SEQ ID NO: 5293505 - DNA, 16 bp, Homo sapiens
attttattaataatat

SEQ ID NO: 5293506 - DNA, 16 bp, Homo sapiens
attttattactgttta

SEQ ID NO: 5293507 - DNA, 18 bp, Homo sapiens
attttattagacattctc

SEQ ID NO: 5293508 - DNA, 13 bp, Homo sapiens
attttattatgaa

SEQ ID NO: 5293509 - DNA, 14 bp, Homo sapiens
attttattatgaaa

SEQ ID NO: 5293510 - DNA, 21 bp, Homo sapiens
attttattatgaaacttgtgt

SEQ ID NO: 5293511 - DNA, 16 bp, Homo sapiens
attttattatgaagaa

SEQ ID NO: 5293512 - DNA, 13 bp, Homo sapiens
attttattatgta

SEQ ID NO: 5293513 - DNA, 13 bp, Homo sapiens
attttattattca

SEQ ID NO: 5293514 - DNA, 15 bp, Homo sapiens
attttattatttcta

SEQ ID NO: 5293515 - DNA, 18 bp, Homo sapiens
attttattcaagaatgcc

SEQ ID NO: 5293516 - DNA, 22 bp, Homo sapiens
attttattctagggtttcttaa

SEQ ID NO: 5293517 - DNA, 14 bp, Homo sapiens
attttattctatgt

SEQ ID NO: 5293518 - DNA, 12 bp, Homo sapiens
attttattcttg

SEQ ID NO: 5293519 - DNA, 13 bp, Homo sapiens
attttattcttga

SEQ ID NO: 5293520 - DNA, 16 bp, Homo sapiens
attttattcttgatca

SEQ ID NO: 5293521 - DNA, 14 bp, Homo sapiens
attttattgaaatg

SEQ ID NO: 5293522 - DNA, 16 bp, Homo sapiens
attttattgaaatgta

SEQ ID NO: 5293523 - DNA, 19 bp, Homo sapiens
attttattgaaatgtataa

SEQ ID NO: 5293524 - DNA, 13 bp, Homo sapiens
attttattgaata

SEQ ID NO: 5293525 - DNA, 14 bp, Homo sapiens
attttattgcttga

SEQ ID NO: 5293526 - DNA, 20 bp, Homo sapiens
attttattgtaacagacatt

SEQ ID NO: 5293527 - DNA, 21 bp, Homo sapiens
attttattgtaacagacattg

SEQ ID NO: 5293528 - DNA, 15 bp, Homo sapiens
attttattgtgtaat

SEQ ID NO: 5293529 - DNA, 22 bp, Homo sapiens
attttatttacccctcccctat

SEQ ID NO: 5293530 - DNA, 19 bp, Homo sapiens
attttatttagacaagaga

SEQ ID NO: 5293531 - DNA, 22 bp, Homo sapiens
attttatttagacaagagatgg

SEQ ID NO: 5293532 - DNA, 16 bp, Homo sapiens
attttatttatctttg

SEQ ID NO: 5293533 - DNA, 20 bp, Homo sapiens
attttatttattagctgtaa

SEQ ID NO: 5293534 - DNA, 19 bp, Homo sapiens
attttatttcaatgtaatt

SEQ ID NO: 5293535 - DNA, 21 bp, Homo sapiens
attttatttcaatgtaattaa

SEQ ID NO: 5293536 - DNA, 23 bp, Homo sapiens
attttatttcctggacatcctct

SEQ ID NO: 5293537 - DNA, 15 bp, Homo sapiens
attttatttctattt

SEQ ID NO: 5293538 - DNA, 16 bp, Homo sapiens
attttatttctgatgt

SEQ ID NO: 5293539 - DNA, 13 bp, Homo sapiens
attttatttgctt

SEQ ID NO: 5293540 - DNA, 15 bp, Homo sapiens
attttatttgcttat

SEQ ID NO: 5293541 - DNA, 12 bp, Homo sapiens
attttatttgta

SEQ ID NO: 5293542 - DNA, 14 bp, Homo sapiens
attttattttatag

SEQ ID NO: 5293543 - DNA, 17 bp, Homo sapiens
attttattttattgaat

SEQ ID NO: 5293544 - DNA, 16 bp, Homo sapiens
attttattttcaagca

SEQ ID NO: 5293545 - DNA, 14 bp, Homo sapiens
attttattttcatg

SEQ ID NO: 5293546 - DNA, 22 bp, Homo sapiens
attttattttgaaatggaaatt

SEQ ID NO: 5293547 - DNA, 14 bp, Homo sapiens
attttattttgaca

SEQ ID NO: 5293548 - DNA, 16 bp, Homo sapiens
attttattttgacaga

SEQ ID NO: 5293549 - DNA, 14 bp, Homo sapiens
attttattttgctg

SEQ ID NO: 5293550 - DNA, 15 bp, Homo sapiens
attttattttgctga

SEQ ID NO: 5293551 - DNA, 19 bp, Homo sapiens
attttattttgctgagttg

SEQ ID NO: 5293552 - DNA, 15 bp, Homo sapiens
attttattttgtaat

SEQ ID NO: 5293553 - DNA, 19 bp, Homo sapiens
attttatttttaaaatatt

SEQ ID NO: 5293554 - DNA, 20 bp, Homo sapiens
attttatttttattactttt

SEQ ID NO: 5293555 - DNA, 17 bp, Homo sapiens
attttatttttttctac

SEQ ID NO: 5293556 - DNA, 22 bp, Homo sapiens
attttattttttttcaaaatga

SEQ ID NO: 5293557 - DNA, 16 bp, Homo sapiens
attttcaaaaaaatgt

SEQ ID NO: 5293558 - DNA, 22 bp, Homo sapiens
attttcaaaagaaaacccaaag

SEQ ID NO: 5293559 - DNA, 24 bp, Homo sapiens
attttcaaaagataatattttaca

SEQ ID NO: 5293560 - DNA, 15 bp, Homo sapiens
attttcaaacaaaat

SEQ ID NO: 5293561 - DNA, 14 bp, Homo sapiens
attttcaaactaga

SEQ ID NO: 5293562 - DNA, 11 bp, Homo sapiens
attttcaaaga

SEQ ID NO: 5293563 - DNA, 13 bp, Homo sapiens
attttcaaagaga

SEQ ID NO: 5293564 - DNA, 14 bp, Homo sapiens
attttcaaaggctt

SEQ ID NO: 5293565 - DNA, 15 bp, Homo sapiens
attttcaaatcctta

SEQ ID NO: 5293566 - DNA, 16 bp, Homo sapiens
attttcaaatctggtc

SEQ ID NO: 5293567 - DNA, 14 bp, Homo sapiens
attttcaaatgtaa

SEQ ID NO: 5293568 - DNA, 16 bp, Homo sapiens
attttcaaatgtaaac

SEQ ID NO: 5293569 - DNA, 22 bp, Homo sapiens
attttcaaatgtaaactctctt

SEQ ID NO: 5293570 - DNA, 15 bp, Homo sapiens
attttcaacaattag

SEQ ID NO: 5293571 - DNA, 14 bp, Homo sapiens
attttcaacattga

SEQ ID NO: 5293572 - DNA, 21 bp, Homo sapiens
attttcaacatttcaaaatga

SEQ ID NO: 5293573 - DNA, 18 bp, Homo sapiens
attttcaacgcagccctg

SEQ ID NO: 5293574 - DNA, 20 bp, Homo sapiens
attttcaactgtcttcctca

SEQ ID NO: 5293575 - DNA, 14 bp, Homo sapiens
attttcaagaaact

SEQ ID NO: 5293576 - DNA, 23 bp, Homo sapiens
attttcaagaaactgaggaattt

SEQ ID NO: 5293577 - DNA, 15 bp, Homo sapiens
attttcaagagaaga

SEQ ID NO: 5293578 - DNA, 15 bp, Homo sapiens
attttcaagattcta

SEQ ID NO: 5293579 - DNA, 20 bp, Homo sapiens
attttcaagattctaaagct

SEQ ID NO: 5293580 - DNA, 14 bp, Homo sapiens
attttcaaggcctt

SEQ ID NO: 5293581 - DNA, 20 bp, Homo sapiens
attttcaaggccttcagttt

SEQ ID NO: 5293582 - DNA, 16 bp, Homo sapiens
attttcaagtaattgt

SEQ ID NO: 5293583 - DNA, 16 bp, Homo sapiens
attttcaagtggaaac

SEQ ID NO: 5293584 - DNA, 20 bp, Homo sapiens
attttcaagtggaaaccttg

SEQ ID NO: 5293585 - DNA, 18 bp, Homo sapiens
attttcaagttattcaga

SEQ ID NO: 5293586 - DNA, 20 bp, Homo sapiens
attttcaagttattcagaaa

SEQ ID NO: 5293587 - DNA, 22 bp, Homo sapiens
attttcaagttattcagaaata

SEQ ID NO: 5293588 - DNA, 16 bp, Homo sapiens
attttcaagtttacac

SEQ ID NO: 5293589 - DNA, 17 bp, Homo sapiens
attttcaagtttttcat

SEQ ID NO: 5293590 - DNA, 18 bp, Homo sapiens
attttcaagtttttcata

SEQ ID NO: 5293591 - DNA, 23 bp, Homo sapiens
attttcaagtttttcatactgta

SEQ ID NO: 5293592 - DNA, 17 bp, Homo sapiens
attttcaatgaaacaaa

SEQ ID NO: 5293593 - DNA, 14 bp, Homo sapiens
attttcaattcaaa

SEQ ID NO: 5293594 - DNA, 20 bp, Homo sapiens
attttcaattcaaaaatgta

SEQ ID NO: 5293595 - DNA, 18 bp, Homo sapiens
attttcacaaaatgtctc

SEQ ID NO: 5293596 - DNA, 14 bp, Homo sapiens
attttcacaacata

SEQ ID NO: 5293597 - DNA, 15 bp, Homo sapiens
attttcacaacatat

SEQ ID NO: 5293598 - DNA, 15 bp, Homo sapiens
attttcacaatgtca

SEQ ID NO: 5293599 - DNA, 13 bp, Homo sapiens
caagggagaagac

SEQ ID NO: 5293600 - DNA, 21 bp, Homo sapiens
caagggagaagacaacagaaa

SEQ ID NO: 5293601 - DNA, 15 bp, Homo sapiens
caagggagagacctc

SEQ ID NO: 5293602 - DNA, 17 bp, Homo sapiens
caagggagagacctcat

SEQ ID NO: 5293603 - DNA, 14 bp, Homo sapiens
caagggaggcagtg

SEQ ID NO: 5293604 - DNA, 15 bp, Homo sapiens
caagggaggcagtgg

SEQ ID NO: 5293605 - DNA, 14 bp, Homo sapiens
caagggaggcccag

SEQ ID NO: 5293606 - DNA, 14 bp, Homo sapiens
caagggagggaagg

SEQ ID NO: 5293607 - DNA, 15 bp, Homo sapiens
caagggagggaaggg

SEQ ID NO: 5293608 - DNA, 19 bp, Homo sapiens
caagggagggaagggccac

SEQ ID NO: 5293609 - DNA, 23 bp, Homo sapiens
caagggagggaagggccaccctg

SEQ ID NO: 5293610 - DNA, 20 bp, Homo sapiens
caagggagggtgcagccctc

SEQ ID NO: 5293611 - DNA, 15 bp, Homo sapiens
caagggatataaaat

SEQ ID NO: 5293612 - DNA, 22 bp, Homo sapiens
caagggatataaaatgaaagat

SEQ ID NO: 5293613 - DNA, 22 bp, Homo sapiens
caagggatgaattgtaaaagca

SEQ ID NO: 5293614 - DNA, 15 bp, Homo sapiens
caagggatggcacca

SEQ ID NO: 5293615 - DNA, 14 bp, Homo sapiens
caagggatttgagg

SEQ ID NO: 5293616 - DNA, 17 bp, Homo sapiens
caagggcaaaattccca

SEQ ID NO: 5293617 - DNA, 19 bp, Homo sapiens
caagggcaaaattcccagg

SEQ ID NO: 5293618 - DNA, 22 bp, Homo sapiens
caagggcaaaccatttcaaatg

SEQ ID NO: 5293619 - DNA, 15 bp, Homo sapiens
caagggcacaaactg

SEQ ID NO: 5293620 - DNA, 21 bp, Homo sapiens
caagggcacaaactgcagctg

SEQ ID NO: 5293621 - DNA, 17 bp, Homo sapiens
caagggcacattgccca

SEQ ID NO: 5293622 - DNA, 18 bp, Homo sapiens
caagggcacattgcccat

SEQ ID NO: 5293623 - DNA, 21 bp, Homo sapiens
caagggcactgtgatacagtt

SEQ ID NO: 5293624 - DNA, 14 bp, Homo sapiens
caagggcagaaagt

SEQ ID NO: 5293625 - DNA, 20 bp, Homo sapiens
caagggcagaacactaacct

SEQ ID NO: 5293626 - DNA, 12 bp, Homo sapiens
caagggcagagg

SEQ ID NO: 5293627 - DNA, 13 bp, Homo sapiens
caagggcaggttg

SEQ ID NO: 5293628 - DNA, 22 bp, Homo sapiens
caagggccaaacccacttctgg

SEQ ID NO: 5293629 - DNA, 15 bp, Homo sapiens
caagggccagacaga

SEQ ID NO: 5293630 - DNA, 12 bp, Homo sapiens
caagggcccaga

SEQ ID NO: 5293631 - DNA, 20 bp, Homo sapiens
caagggcccagaccctgggc

SEQ ID NO: 5293632 - DNA, 19 bp, Homo sapiens
caagggccccaggggcagc

SEQ ID NO: 5293633 - DNA, 19 bp, Homo sapiens
caagggccctcactcagga

SEQ ID NO: 5293634 - DNA, 14 bp, Homo sapiens
caagggccctggca

SEQ ID NO: 5293635 - DNA, 16 bp, Homo sapiens
caagggcggcctttcc

SEQ ID NO: 5293636 - DNA, 18 bp, Homo sapiens
caagggcggcctttccca

SEQ ID NO: 5293637 - DNA, 20 bp, Homo sapiens
caagggctccagcatccagc

SEQ ID NO: 5293638 - DNA, 23 bp, Homo sapiens
caagggctccagcatccagcctg

SEQ ID NO: 5293639 - DNA, 12 bp, Homo sapiens
caagggctccta

SEQ ID NO: 5293640 - DNA, 22 bp, Homo sapiens
caagggctcctatctttcctcc

SEQ ID NO: 5293641 - DNA, 15 bp, Homo sapiens
caagggctgacttct

SEQ ID NO: 5293642 - DNA, 21 bp, Homo sapiens
caagggctgacttctccagga

SEQ ID NO: 5293643 - DNA, 14 bp, Homo sapiens
caagggctgcaatg

SEQ ID NO: 5293644 - DNA, 17 bp, Homo sapiens
caagggctgcaatgccc

SEQ ID NO: 5293645 - DNA, 14 bp, Homo sapiens
caagggctggcact

SEQ ID NO: 5293646 - DNA, 17 bp, Homo sapiens
caagggctgtcattgca

SEQ ID NO: 5293647 - DNA, 18 bp, Homo sapiens
caagggcttctgcaccct

SEQ ID NO: 5293648 - DNA, 16 bp, Homo sapiens
caaggggaaaatctca

SEQ ID NO: 5293649 - DNA, 21 bp, Homo sapiens
caaggggaaaatgtgaagctg

SEQ ID NO: 5293650 - DNA, 15 bp, Homo sapiens
caaggggaacgcaga

SEQ ID NO: 5293651 - DNA, 16 bp, Homo sapiens
caaggggaccccgaga

SEQ ID NO: 5293652 - DNA, 19 bp, Homo sapiens
caaggggagtcaccttccc

SEQ ID NO: 5293653 - DNA, 20 bp, Homo sapiens
caaggggagtcaccttccct

SEQ ID NO: 5293654 - DNA, 16 bp, Homo sapiens
caaggggattttgctg

SEQ ID NO: 5293655 - DNA, 15 bp, Homo sapiens
caaggggcagccagc

SEQ ID NO: 5293656 - DNA, 15 bp, Homo sapiens
caaggggcagggagg

SEQ ID NO: 5293657 - DNA, 18 bp, Homo sapiens
caaggggccagctgcccc

SEQ ID NO: 5293658 - DNA, 13 bp, Homo sapiens
caaggggccagga

SEQ ID NO: 5293659 - DNA, 15 bp, Homo sapiens
caaggggccaggaag

SEQ ID NO: 5293660 - DNA, 17 bp, Homo sapiens
caaggggcccaaattct

SEQ ID NO: 5293661 - DNA, 15 bp, Homo sapiens
caaggggcctgagca

SEQ ID NO: 5293662 - DNA, 20 bp, Homo sapiens
caaggggctcagcaaggtgt

SEQ ID NO: 5293663 - DNA, 14 bp, Homo sapiens
caaggggctgcgct

SEQ ID NO: 5293664 - DNA, 23 bp, Homo sapiens
caaggggctgcgctagcagccct

SEQ ID NO: 5293665 - DNA, 16 bp, Homo sapiens
caaggggctggctgga

SEQ ID NO: 5293666 - DNA, 18 bp, Homo sapiens
caaggggctggctggagt

SEQ ID NO: 5293667 - DNA, 22 bp, Homo sapiens
caaggggcttcaggtccaggct

SEQ ID NO: 5293668 - DNA, 15 bp, Homo sapiens
caagggggaaggctg

SEQ ID NO: 5293669 - DNA, 19 bp, Homo sapiens
caagggggacctcgggctg

SEQ ID NO: 5293670 - DNA, 15 bp, Homo sapiens
caagggggactgtct

SEQ ID NO: 5293671 - DNA, 21 bp, Homo sapiens
caagggggatgacatgtgact

SEQ ID NO: 5293672 - DNA, 18 bp, Homo sapiens
caagggggcggggactgc

SEQ ID NO: 5293673 - DNA, 14 bp, Homo sapiens
caagggggctgctg

SEQ ID NO: 5293674 - DNA, 22 bp, Homo sapiens
caagggggctgctgctcctctc

SEQ ID NO: 5293675 - DNA, 15 bp, Homo sapiens
caagggggtgactgg

SEQ ID NO: 5293676 - DNA, 16 bp, Homo sapiens
caagggggtgactgga

SEQ ID NO: 5293677 - DNA, 17 bp, Homo sapiens
caagggggtgactggaa

SEQ ID NO: 5293678 - DNA, 17 bp, Homo sapiens
caaggggtctccttgga

SEQ ID NO: 5293679 - DNA, 19 bp, Homo sapiens
caaggggtggaagggcagg

SEQ ID NO: 5293680 - DNA, 22 bp, Homo sapiens
caaggggtggccgtcctgaggg

SEQ ID NO: 5293681 - DNA, 19 bp, Homo sapiens
caagggtatctgctgcctc

SEQ ID NO: 5293682 - DNA, 15 bp, Homo sapiens
caagggtcaggcctt

SEQ ID NO: 5293683 - DNA, 23 bp, Homo sapiens
caagggtgatgggaaagcattgt

SEQ ID NO: 5293684 - DNA, 14 bp, Homo sapiens
caagggtgcaagcc

SEQ ID NO: 5293685 - DNA, 12 bp, Homo sapiens
caagggtggcag

SEQ ID NO: 5293686 - DNA, 21 bp, Homo sapiens
caagggtggcatcccagtggc

SEQ ID NO: 5293687 - DNA, 17 bp, Homo sapiens
caagggttaaggcctga

SEQ ID NO: 5293688 - DNA, 18 bp, Homo sapiens
caagggttaaggcctgaa

SEQ ID NO: 5293689 - DNA, 15 bp, Homo sapiens
caagggttctttcct

SEQ ID NO: 5293690 - DNA, 22 bp, Homo sapiens
caagggtttcgactggtccagc

SEQ ID NO: 5293691 - DNA, 14 bp, Homo sapiens
caagggttttccag

SEQ ID NO: 5293692 - DNA, 13 bp, Homo sapiens
caaggtaaaattc

SEQ ID NO: 5293693 - DNA, 15 bp, Homo sapiens
caaggtaaaattcta

SEQ ID NO: 5293694 - DNA, 17 bp, Homo sapiens
caaggtaaaattctaaa

SEQ ID NO: 5293695 - DNA, 23 bp, Homo sapiens
caaggtaagaggattgcttgagc

SEQ ID NO: 5293696 - DNA, 23 bp, Homo sapiens
caaggtaatttttttttgtaaag

SEQ ID NO: 5293697 - DNA, 18 bp, Homo sapiens
caaggtacaactgtattt

SEQ ID NO: 5293698 - DNA, 18 bp, Homo sapiens
caaggtaccgatttctgc

SEQ ID NO: 5293699 - DNA, 19 bp, Homo sapiens
caaggtaccgatttctgct

SEQ ID NO: 5293700 - DNA, 18 bp, Homo sapiens
caaggtagaatgaccttg

SEQ ID NO: 5293701 - DNA, 15 bp, Homo sapiens
caaggtagccatccc

SEQ ID NO: 5293702 - DNA, 14 bp, Homo sapiens
caaggtaggctgca

SEQ ID NO: 5293703 - DNA, 20 bp, Homo sapiens
caaggtaggctgcaaaatta

SEQ ID NO: 5293704 - DNA, 17 bp, Homo sapiens
caaggtatttctccagt

SEQ ID NO: 5293705 - DNA, 16 bp, Homo sapiens
caaggtcactcttggt

SEQ ID NO: 5293706 - DNA, 14 bp, Homo sapiens
caaggtcagggagg

SEQ ID NO: 5293707 - DNA, 22 bp, Homo sapiens
caaggtccactccctgctccac

SEQ ID NO: 5293708 - DNA, 13 bp, Homo sapiens
caaggtccagtgg

SEQ ID NO: 5293709 - DNA, 23 bp, Homo sapiens
caaggtccccccaccgctcagtg

SEQ ID NO: 5293710 - DNA, 16 bp, Homo sapiens
caaggtcccctccaca

SEQ ID NO: 5293711 - DNA, 15 bp, Homo sapiens
caaggtccgagctct

SEQ ID NO: 5293712 - DNA, 16 bp, Homo sapiens
caaggtccggatgtca

SEQ ID NO: 5293713 - DNA, 20 bp, Homo sapiens
caaggtcctctgtcagtcac

SEQ ID NO: 5293714 - DNA, 21 bp, Homo sapiens
caaggtcctctgtcagtcaca

SEQ ID NO: 5293715 - DNA, 22 bp, Homo sapiens
caaggtcctctgtcagtcacag

SEQ ID NO: 5293716 - DNA, 15 bp, Homo sapiens
caaggtcctcttgaa

SEQ ID NO: 5293717 - DNA, 14 bp, Homo sapiens
caaggtcctgctca

SEQ ID NO: 5293718 - DNA, 16 bp, Homo sapiens
caaggtcggtaagttg

SEQ ID NO: 5293719 - DNA, 16 bp, Homo sapiens
caaggtctcacactcc

SEQ ID NO: 5293720 - DNA, 20 bp, Homo sapiens
caaggtctcacactcctcct

SEQ ID NO: 5293721 - DNA, 24 bp, Homo sapiens
caaggtctcacactcctcctgcca

SEQ ID NO: 5293722 - DNA, 22 bp, Homo sapiens
caaggtctccttactctgagcc

SEQ ID NO: 5293723 - DNA, 23 bp, Homo sapiens
caaggtctccttactctgagccc

SEQ ID NO: 5293724 - DNA, 15 bp, Homo sapiens
caaggtctgagccac

SEQ ID NO: 5293725 - DNA, 18 bp, Homo sapiens
caaggtctggcctcaggt

SEQ ID NO: 5293726 - DNA, 20 bp, Homo sapiens
caaggtctgtggctcctccc

SEQ ID NO: 5293727 - DNA, 22 bp, Homo sapiens
caaggtctgtggctcctcccga

SEQ ID NO: 5293728 - DNA, 14 bp, Homo sapiens
caaggtctttggtt

SEQ ID NO: 5293729 - DNA, 12 bp, Homo sapiens
caaggtgaaacg

SEQ ID NO: 5293730 - DNA, 23 bp, Homo sapiens
caaggtgaagatgggaacgcaga

SEQ ID NO: 5293731 - DNA, 15 bp, Homo sapiens
caaggtgaaggatct

SEQ ID NO: 5293732 - DNA, 19 bp, Homo sapiens
caaggtgaaggatctgtcc

SEQ ID NO: 5293733 - DNA, 22 bp, Homo sapiens
caaggtgaaggatctgtccgac

SEQ ID NO: 5293734 - DNA, 19 bp, Homo sapiens
caaggtgaatagcacaggt

SEQ ID NO: 5293735 - DNA, 13 bp, Homo sapiens
caaggtgacagaa

SEQ ID NO: 5293736 - DNA, 21 bp, Homo sapiens
caaggtgacagaaggaccagc

SEQ ID NO: 5293737 - DNA, 19 bp, Homo sapiens
caaggtgagggatgccata

SEQ ID NO: 5293738 - DNA, 14 bp, Homo sapiens
caaggtgaggtgaa

SEQ ID NO: 5293739 - DNA, 23 bp, Homo sapiens
caaggtgatatataatttcctca

SEQ ID NO: 5293740 - DNA, 15 bp, Homo sapiens
caaggtgatttcaga

SEQ ID NO: 5293741 - DNA, 18 bp, Homo sapiens
caaggtgatttcagactg

SEQ ID NO: 5293742 - DNA, 21 bp, Homo sapiens
caaggtgatttcagactgcag

SEQ ID NO: 5293743 - DNA, 20 bp, Homo sapiens
caaggtgcacctgccccagg

SEQ ID NO: 5293744 - DNA, 19 bp, Homo sapiens
caaggtgcaggcaggctgg

SEQ ID NO: 5293745 - DNA, 20 bp, Homo sapiens
caaggtgcatatagaaaaca

SEQ ID NO: 5293746 - DNA, 18 bp, Homo sapiens
caaggtgctcttctcatt

SEQ ID NO: 5293747 - DNA, 19 bp, Homo sapiens
caaggtgctcttctcattt

SEQ ID NO: 5293748 - DNA, 21 bp, Homo sapiens
caaggtgctcttgaacctgtg

SEQ ID NO: 5293749 - DNA, 19 bp, Homo sapiens
caaggtgctggtgggtctg

SEQ ID NO: 5293750 - DNA, 23 bp, Homo sapiens
caaggtgctggtgggtctgagct

SEQ ID NO: 5293751 - DNA, 15 bp, Homo sapiens
caaggtgcttttctt

SEQ ID NO: 5293752 - DNA, 22 bp, Homo sapiens
caaggtggaaatggcccattta

SEQ ID NO: 5293753 - DNA, 16 bp, Homo sapiens
caaggtggagggaagg

SEQ ID NO: 5293754 - DNA, 15 bp, Homo sapiens
caaggtggagtggat

SEQ ID NO: 5293755 - DNA, 18 bp, Homo sapiens
caaggtggagtggatgcc

SEQ ID NO: 5293756 - DNA, 14 bp, Homo sapiens
caaggtggcagatg

SEQ ID NO: 5293757 - DNA, 17 bp, Homo sapiens
caaggtggcagcaagca

SEQ ID NO: 5293758 - DNA, 12 bp, Homo sapiens
caaggtgggagg

SEQ ID NO: 5293759 - DNA, 23 bp, Homo sapiens
caaggtgggaggattgcttgagc

SEQ ID NO: 5293760 - DNA, 17 bp, Homo sapiens
caaggtgggggagcctg

SEQ ID NO: 5293761 - DNA, 18 bp, Homo sapiens
caaggtgggggagcctgg

SEQ ID NO: 5293762 - DNA, 22 bp, Homo sapiens
caaggtggggggatcacaaggt

SEQ ID NO: 5293763 - DNA, 12 bp, Homo sapiens
caaggtgggggt

SEQ ID NO: 5293764 - DNA, 21 bp, Homo sapiens
caaggtgggtggatcacctgt

SEQ ID NO: 5293765 - DNA, 20 bp, Homo sapiens
caaggtggtgcttctgccat

SEQ ID NO: 5293766 - DNA, 17 bp, Homo sapiens
caaggtggtgtgatctt

SEQ ID NO: 5293767 - DNA, 18 bp, Homo sapiens
caaggtggtgtgatctta

SEQ ID NO: 5293768 - DNA, 18 bp, Homo sapiens
caaggtgtccctgccttc

SEQ ID NO: 5293769 - DNA, 13 bp, Homo sapiens
caaggtgtcctac

SEQ ID NO: 5293770 - DNA, 15 bp, Homo sapiens
caaggtgtgctctga

SEQ ID NO: 5293771 - DNA, 23 bp, Homo sapiens
caaggtgtgctctgagccacaga

SEQ ID NO: 5293772 - DNA, 12 bp, Homo sapiens
caaggtgtggaa

SEQ ID NO: 5293773 - DNA, 19 bp, Homo sapiens
caaggtgtggaggctcctg

SEQ ID NO: 5293774 - DNA, 17 bp, Homo sapiens
caaggtgtttaagtaat

SEQ ID NO: 5293775 - DNA, 17 bp, Homo sapiens
caaggtgtttctctgta

SEQ ID NO: 5293776 - DNA, 23 bp, Homo sapiens
caaggttactcagcagcagagag

SEQ ID NO: 5293777 - DNA, 17 bp, Homo sapiens
attttcacactggtaaa

SEQ ID NO: 5293778 - DNA, 14 bp, Homo sapiens
attttcacagcttt

SEQ ID NO: 5293779 - DNA, 18 bp, Homo sapiens
attttcacagctttgagg

SEQ ID NO: 5293780 - DNA, 15 bp, Homo sapiens
attttcaccccaccc

SEQ ID NO: 5293781 - DNA, 16 bp, Homo sapiens
attttcaccccaccct

SEQ ID NO: 5293782 - DNA, 23 bp, Homo sapiens
attttcacctgttaaggtggaaa

SEQ ID NO: 5293783 - DNA, 21 bp, Homo sapiens
attttcacctgtttttaagct

SEQ ID NO: 5293784 - DNA, 15 bp, Homo sapiens
attttcactagggct

SEQ ID NO: 5293785 - DNA, 16 bp, Homo sapiens
attttcactagggctg

SEQ ID NO: 5293786 - DNA, 16 bp, Homo sapiens
attttcactggaagat

SEQ ID NO: 5293787 - DNA, 14 bp, Homo sapiens
attttcactttgtg

SEQ ID NO: 5293788 - DNA, 17 bp, Homo sapiens
attttcagaaaatatta

SEQ ID NO: 5293789 - DNA, 21 bp, Homo sapiens
attttcagaagctgatgagga

SEQ ID NO: 5293790 - DNA, 17 bp, Homo sapiens
attttcagaagttaaca

SEQ ID NO: 5293791 - DNA, 11 bp, Homo sapiens
attttcagaat

SEQ ID NO: 5293792 - DNA, 12 bp, Homo sapiens
attttcagaatc

SEQ ID NO: 5293793 - DNA, 17 bp, Homo sapiens
attttcagaatctgaat

SEQ ID NO: 5293794 - DNA, 20 bp, Homo sapiens
attttcagaatctgaatgta

SEQ ID NO: 5293795 - DNA, 22 bp, Homo sapiens
attttcagaatctgaatgtaat

SEQ ID NO: 5293796 - DNA, 19 bp, Homo sapiens
attttcagaattaatgcat

SEQ ID NO: 5293797 - DNA, 16 bp, Homo sapiens
attttcagacacattt

SEQ ID NO: 5293798 - DNA, 13 bp, Homo sapiens
attttcagacatt

SEQ ID NO: 5293799 - DNA, 19 bp, Homo sapiens
attttcagacatttttgga

SEQ ID NO: 5293800 - DNA, 12 bp, Homo sapiens
attttcagaccc

SEQ ID NO: 5293801 - DNA, 12 bp, Homo sapiens
attttcagagac

SEQ ID NO: 5293802 - DNA, 13 bp, Homo sapiens
attttcagagccg

SEQ ID NO: 5293803 - DNA, 12 bp, Homo sapiens
attttcagagtg

SEQ ID NO: 5293804 - DNA, 15 bp, Homo sapiens
attttcagagtgaca

SEQ ID NO: 5293805 - DNA, 10 bp, Homo sapiens
attttcagat

SEQ ID NO: 5293806 - DNA, 14 bp, Homo sapiens
attttcagatcctt

SEQ ID NO: 5293807 - DNA, 12 bp, Homo sapiens
attttcagattt

SEQ ID NO: 5293808 - DNA, 14 bp, Homo sapiens
attttcagatttgc

SEQ ID NO: 5293809 - DNA, 16 bp, Homo sapiens
attttcagatttgcac

SEQ ID NO: 5293810 - DNA, 16 bp, Homo sapiens
attttcagcaaagaat

SEQ ID NO: 5293811 - DNA, 18 bp, Homo sapiens
attttcagcatgaaaatg

SEQ ID NO: 5293812 - DNA, 22 bp, Homo sapiens
attttcagggttttaaacacta

SEQ ID NO: 5293813 - DNA, 23 bp, Homo sapiens
attttcagggttttaaacactaa

SEQ ID NO: 5293814 - DNA, 11 bp, Homo sapiens
attttcagtac

SEQ ID NO: 5293815 - DNA, 17 bp, Homo sapiens
attttcagtaccaaaga

SEQ ID NO: 5293816 - DNA, 21 bp, Homo sapiens
attttcagtaccaaagaaaca

SEQ ID NO: 5293817 - DNA, 17 bp, Homo sapiens
attttcagtatactgtg

SEQ ID NO: 5293818 - DNA, 16 bp, Homo sapiens
attttcagtcttgtag

SEQ ID NO: 5293819 - DNA, 13 bp, Homo sapiens
attttcagtgact

SEQ ID NO: 5293820 - DNA, 16 bp, Homo sapiens
attttcagtgcatcat

SEQ ID NO: 5293821 - DNA, 22 bp, Homo sapiens
attttcagttacaagattgtaa

SEQ ID NO: 5293822 - DNA, 22 bp, Homo sapiens
attttcagttccctcctgccca

SEQ ID NO: 5293823 - DNA, 13 bp, Homo sapiens
attttcagttcta

SEQ ID NO: 5293824 - DNA, 21 bp, Homo sapiens
attttcataacttattgctga

SEQ ID NO: 5293825 - DNA, 22 bp, Homo sapiens
attttcataagtatttcaaatt

SEQ ID NO: 5293826 - DNA, 21 bp, Homo sapiens
attttcataatcagtaaatag

SEQ ID NO: 5293827 - DNA, 21 bp, Homo sapiens
attttcataattcatttaaga

SEQ ID NO: 5293828 - DNA, 16 bp, Homo sapiens
attttcatagatgtgt

SEQ ID NO: 5293829 - DNA, 18 bp, Homo sapiens
attttcatagatgtgtta

SEQ ID NO: 5293830 - DNA, 20 bp, Homo sapiens
attttcatatatttaacttt

SEQ ID NO: 5293831 - DNA, 19 bp, Homo sapiens
attttcatatcccgtgaaa

SEQ ID NO: 5293832 - DNA, 14 bp, Homo sapiens
attttcatatgctt

SEQ ID NO: 5293833 - DNA, 16 bp, Homo sapiens
attttcatattgtaat

SEQ ID NO: 5293834 - DNA, 18 bp, Homo sapiens
attttcatattgtaatct

SEQ ID NO: 5293835 - DNA, 14 bp, Homo sapiens
attttcatcaagta

SEQ ID NO: 5293836 - DNA, 12 bp, Homo sapiens
attttcatcccg

SEQ ID NO: 5293837 - DNA, 17 bp, Homo sapiens
attttcatgaaaatacc

SEQ ID NO: 5293838 - DNA, 20 bp, Homo sapiens
attttcatgacttttccatg

SEQ ID NO: 5293839 - DNA, 20 bp, Homo sapiens
attttcatgcacagtagatt

SEQ ID NO: 5293840 - DNA, 11 bp, Homo sapiens
attttcatgtg

SEQ ID NO: 5293841 - DNA, 13 bp, Homo sapiens
attttcatgtgtg

SEQ ID NO: 5293842 - DNA, 22 bp, Homo sapiens
attttcattaaaaggaaaaaag

SEQ ID NO: 5293843 - DNA, 15 bp, Homo sapiens
attttcattaaactt

SEQ ID NO: 5293844 - DNA, 16 bp, Homo sapiens
attttcattaaacttg

SEQ ID NO: 5293845 - DNA, 18 bp, Homo sapiens
attttcattaaacttgaa

SEQ ID NO: 5293846 - DNA, 14 bp, Homo sapiens
attttcattagcaa

SEQ ID NO: 5293847 - DNA, 17 bp, Homo sapiens
attttcattagcaaaaa

SEQ ID NO: 5293848 - DNA, 18 bp, Homo sapiens
attttcattctgccaaag

SEQ ID NO: 5293849 - DNA, 20 bp, Homo sapiens
attttcattctgccaaagta

SEQ ID NO: 5293850 - DNA, 16 bp, Homo sapiens
attttcattggatgca

SEQ ID NO: 5293851 - DNA, 14 bp, Homo sapiens
attttcattgtaaa

SEQ ID NO: 5293852 - DNA, 12 bp, Homo sapiens
attttcattgtg

SEQ ID NO: 5293853 - DNA, 14 bp, Homo sapiens
attttcatttctaa

SEQ ID NO: 5293854 - DNA, 18 bp, Homo sapiens
attttcatttctaacata

SEQ ID NO: 5293855 - DNA, 13 bp, Homo sapiens
attttcatttgta

SEQ ID NO: 5293856 - DNA, 15 bp, Homo sapiens
attttcatttgtaca

SEQ ID NO: 5293857 - DNA, 22 bp, Homo sapiens
attttcatttgtacaaggtaat

SEQ ID NO: 5293858 - DNA, 19 bp, Homo sapiens
attttcattttaatttata

SEQ ID NO: 5293859 - DNA, 23 bp, Homo sapiens
attttcattttctgcaagcctgc

SEQ ID NO: 5293860 - DNA, 22 bp, Homo sapiens
attttccaaaagtggcctcttt

SEQ ID NO: 5293861 - DNA, 14 bp, Homo sapiens
attttccaaatgta

SEQ ID NO: 5293862 - DNA, 20 bp, Homo sapiens
attttccaagtaaaatatta

SEQ ID NO: 5293863 - DNA, 21 bp, Homo sapiens
attttccacaagattcccaga

SEQ ID NO: 5293864 - DNA, 23 bp, Homo sapiens
attttccacaagattcccagaga

SEQ ID NO: 5293865 - DNA, 15 bp, Homo sapiens
attttccacggaaac

SEQ ID NO: 5293866 - DNA, 18 bp, Homo sapiens
attttccacggaaacaga

SEQ ID NO: 5293867 - DNA, 16 bp, Homo sapiens
attttccacttatctt

SEQ ID NO: 5293868 - DNA, 17 bp, Homo sapiens
attttccagccttatgt

SEQ ID NO: 5293869 - DNA, 22 bp, Homo sapiens
attttccagggcaatcaatgtt

SEQ ID NO: 5293870 - DNA, 17 bp, Homo sapiens
attttccagtataaaac

SEQ ID NO: 5293871 - DNA, 17 bp, Homo sapiens
attttccataagctatt

SEQ ID NO: 5293872 - DNA, 14 bp, Homo sapiens
attttccatatatt

SEQ ID NO: 5293873 - DNA, 17 bp, Homo sapiens
attttccatatttggat

SEQ ID NO: 5293874 - DNA, 18 bp, Homo sapiens
attttccatatttggatg

SEQ ID NO: 5293875 - DNA, 22 bp, Homo sapiens
attttccatatttggatggtga

SEQ ID NO: 5293876 - DNA, 16 bp, Homo sapiens
attttccattaatttc

SEQ ID NO: 5293877 - DNA, 19 bp, Homo sapiens
attttccattaatttcaac

SEQ ID NO: 5293878 - DNA, 13 bp, Homo sapiens
attttcccaatga

SEQ ID NO: 5293879 - DNA, 20 bp, Homo sapiens
attttcccactcattctgaa

SEQ ID NO: 5293880 - DNA, 22 bp, Homo sapiens
attttcccactcattctgaatt

SEQ ID NO: 5293881 - DNA, 15 bp, Homo sapiens
attttcccagtgaat

SEQ ID NO: 5293882 - DNA, 19 bp, Homo sapiens
attttcccagtgaataaat

SEQ ID NO: 5293883 - DNA, 20 bp, Homo sapiens
attttccccccactctcccc

SEQ ID NO: 5293884 - DNA, 22 bp, Homo sapiens
attttccccccactctccccac

SEQ ID NO: 5293885 - DNA, 19 bp, Homo sapiens
attttccccctaattctta

SEQ ID NO: 5293886 - DNA, 17 bp, Homo sapiens
attttcccctatcattt

SEQ ID NO: 5293887 - DNA, 14 bp, Homo sapiens
attttccccttcct

SEQ ID NO: 5293888 - DNA, 19 bp, Homo sapiens
attttccctattagagaag

SEQ ID NO: 5293889 - DNA, 14 bp, Homo sapiens
attttccctctctt

SEQ ID NO: 5293890 - DNA, 13 bp, Homo sapiens
attttccctgcta

SEQ ID NO: 5293891 - DNA, 18 bp, Homo sapiens
attttccctttttaaaaa

SEQ ID NO: 5293892 - DNA, 21 bp, Homo sapiens
attttccctttttaaaaaata

SEQ ID NO: 5293893 - DNA, 21 bp, Homo sapiens
attttcctaaggccactgttt

SEQ ID NO: 5293894 - DNA, 16 bp, Homo sapiens
attttcctacaggcag

SEQ ID NO: 5293895 - DNA, 21 bp, Homo sapiens
attttcctacatcggaatcca

SEQ ID NO: 5293896 - DNA, 20 bp, Homo sapiens
attttcctatattacggttt

SEQ ID NO: 5293897 - DNA, 14 bp, Homo sapiens
attttcctcatttt

SEQ ID NO: 5293898 - DNA, 17 bp, Homo sapiens
attttcctcattttgaa

SEQ ID NO: 5293899 - DNA, 12 bp, Homo sapiens
attttcctcccc

SEQ ID NO: 5293900 - DNA, 14 bp, Homo sapiens
attttcctccccag

SEQ ID NO: 5293901 - DNA, 11 bp, Homo sapiens
attttcctcct

SEQ ID NO: 5293902 - DNA, 13 bp, Homo sapiens
attttcctccttt

SEQ ID NO: 5293903 - DNA, 17 bp, Homo sapiens
attttcctcctttctct

SEQ ID NO: 5293904 - DNA, 13 bp, Homo sapiens
attttcctctggc

SEQ ID NO: 5293905 - DNA, 23 bp, Homo sapiens
attttcctcttgtcctggccctt

SEQ ID NO: 5293906 - DNA, 15 bp, Homo sapiens
attttcctcttgtga

SEQ ID NO: 5293907 - DNA, 19 bp, Homo sapiens
attttcctgaagctgctta

SEQ ID NO: 5293908 - DNA, 19 bp, Homo sapiens
attttcctgacatttgttt

SEQ ID NO: 5293909 - DNA, 22 bp, Homo sapiens
attttcctggatttatagtatg

SEQ ID NO: 5293910 - DNA, 12 bp, Homo sapiens
attttcctgtgg

SEQ ID NO: 5293911 - DNA, 17 bp, Homo sapiens
attttcctgtgtccaca

SEQ ID NO: 5293912 - DNA, 19 bp, Homo sapiens
attttcctgttgtcaagaa

SEQ ID NO: 5293913 - DNA, 18 bp, Homo sapiens
attttccttccatgctcc

SEQ ID NO: 5293914 - DNA, 22 bp, Homo sapiens
attttccttccatgctcccaac

SEQ ID NO: 5293915 - DNA, 23 bp, Homo sapiens
attttccttcctgttctgtgtct

SEQ ID NO: 5293916 - DNA, 12 bp, Homo sapiens
attttccttctg

SEQ ID NO: 5293917 - DNA, 22 bp, Homo sapiens
attttccttctgaagtctgagc

SEQ ID NO: 5293918 - DNA, 16 bp, Homo sapiens
attttccttgaagccg

SEQ ID NO: 5293919 - DNA, 15 bp, Homo sapiens
attttcctttatgtg

SEQ ID NO: 5293920 - DNA, 18 bp, Homo sapiens
attttcctttatgtgatg

SEQ ID NO: 5293921 - DNA, 19 bp, Homo sapiens
attttcctttctgtattaa

SEQ ID NO: 5293922 - DNA, 17 bp, Homo sapiens
attttcctttgtagcta

SEQ ID NO: 5293923 - DNA, 18 bp, Homo sapiens
attttcctttttcatgta

SEQ ID NO: 5293924 - DNA, 13 bp, Homo sapiens
attttcctttttt

SEQ ID NO: 5293925 - DNA, 20 bp, Homo sapiens
attttccttttttatacaca

SEQ ID NO: 5293926 - DNA, 18 bp, Homo sapiens
attttcgatgaagttctg

SEQ ID NO: 5293927 - DNA, 15 bp, Homo sapiens
attttcggaacacat

SEQ ID NO: 5293928 - DNA, 15 bp, Homo sapiens
attttcgtatgaaaa

SEQ ID NO: 5293929 - DNA, 16 bp, Homo sapiens
attttcgtgcatttgt

SEQ ID NO: 5293930 - DNA, 18 bp, Homo sapiens
attttcgtgcatttgtga

SEQ ID NO: 5293931 - DNA, 15 bp, Homo sapiens
attttctaaaagctt

SEQ ID NO: 5293932 - DNA, 21 bp, Homo sapiens
attttctaaaagctttcatgt

SEQ ID NO: 5293933 - DNA, 15 bp, Homo sapiens
attttctaaagtact

SEQ ID NO: 5293934 - DNA, 20 bp, Homo sapiens
attttctaaagtactgagca

SEQ ID NO: 5293935 - DNA, 14 bp, Homo sapiens
attttctaaattct

SEQ ID NO: 5293936 - DNA, 22 bp, Homo sapiens
attttctaagacagtttttata

SEQ ID NO: 5293937 - DNA, 20 bp, Homo sapiens
attttctaataatcctgctt

SEQ ID NO: 5293938 - DNA, 14 bp, Homo sapiens
attttctactttaa

SEQ ID NO: 5293939 - DNA, 18 bp, Homo sapiens
attttctagaaatgttta

SEQ ID NO: 5293940 - DNA, 18 bp, Homo sapiens
attttctagaatactaat

SEQ ID NO: 5293941 - DNA, 21 bp, Homo sapiens
attttctagaatactaataaa

SEQ ID NO: 5293942 - DNA, 23 bp, Homo sapiens
attttctagaatactaataaaat

SEQ ID NO: 5293943 - DNA, 19 bp, Homo sapiens
attttctagactgtgaaga

SEQ ID NO: 5293944 - DNA, 20 bp, Homo sapiens
attttctagacttcagaaca

SEQ ID NO: 5293945 - DNA, 14 bp, Homo sapiens
attttctagataca

SEQ ID NO: 5293946 - DNA, 16 bp, Homo sapiens
attttctagatacaat

SEQ ID NO: 5293947 - DNA, 16 bp, Homo sapiens
attttctagtttcctg

SEQ ID NO: 5293948 - DNA, 17 bp, Homo sapiens
attttctataacagata

SEQ ID NO: 5293949 - DNA, 17 bp, Homo sapiens
attttctataagaaaaa

SEQ ID NO: 5293950 - DNA, 18 bp, Homo sapiens
attttctataagaaaaag

SEQ ID NO: 5293951 - DNA, 17 bp, Homo sapiens
attttctataatttaaa

SEQ ID NO: 5293952 - DNA, 14 bp, Homo sapiens
attttctatgtact

SEQ ID NO: 5293953 - DNA, 19 bp, Homo sapiens
attttctatgtactagtac

SEQ ID NO: 5293954 - DNA, 22 bp, Homo sapiens
attttctatgtactagtactgt

SEQ ID NO: 5293955 - DNA, 22 bp, Homo sapiens
attttctattgtggaattttat

SEQ ID NO: 5293956 - DNA, 16 bp, Homo sapiens
attttctattttaaga

SEQ ID NO: 5293957 - DNA, 17 bp, Homo sapiens
caaggttataatttttt

SEQ ID NO: 5293958 - DNA, 17 bp, Homo sapiens
caaggttatatgaatat

SEQ ID NO: 5293959 - DNA, 14 bp, Homo sapiens
caaggttccagagg

SEQ ID NO: 5293960 - DNA, 18 bp, Homo sapiens
caaggttccagaggccct

SEQ ID NO: 5293961 - DNA, 16 bp, Homo sapiens
caaggttcccttgtgg

SEQ ID NO: 5293962 - DNA, 15 bp, Homo sapiens
caaggttgcacagca

SEQ ID NO: 5293963 - DNA, 19 bp, Homo sapiens
caaggttgcacagcaagaa

SEQ ID NO: 5293964 - DNA, 12 bp, Homo sapiens
caaggttgctgt

SEQ ID NO: 5293965 - DNA, 13 bp, Homo sapiens
caaggttggagcc

SEQ ID NO: 5293966 - DNA, 22 bp, Homo sapiens
caaggtttaaacttctctgaag

SEQ ID NO: 5293967 - DNA, 17 bp, Homo sapiens
caaggtttacactgcgg

SEQ ID NO: 5293968 - DNA, 20 bp, Homo sapiens
caaggtttaggctggtggcc

SEQ ID NO: 5293969 - DNA, 23 bp, Homo sapiens
caaggtttaggctggtggcccag

SEQ ID NO: 5293970 - DNA, 24 bp, Homo sapiens
caaggtttaggctggtggcccagg

SEQ ID NO: 5293971 - DNA, 22 bp, Homo sapiens
caaggtttcccagtgagcctct

SEQ ID NO: 5293972 - DNA, 17 bp, Homo sapiens
caaggtttcgtggcagc

SEQ ID NO: 5293973 - DNA, 15 bp, Homo sapiens
caagtaaaaaggcta

SEQ ID NO: 5293974 - DNA, 16 bp, Homo sapiens
caagtaaaacaaatga

SEQ ID NO: 5293975 - DNA, 17 bp, Homo sapiens
caagtaaaacaaatgaa

SEQ ID NO: 5293976 - DNA, 12 bp, Homo sapiens
caagtaaaagaa

SEQ ID NO: 5293977 - DNA, 14 bp, Homo sapiens
caagtaaagtgctt

SEQ ID NO: 5293978 - DNA, 21 bp, Homo sapiens
caagtaaatagtttgaattca

SEQ ID NO: 5293979 - DNA, 15 bp, Homo sapiens
caagtaaatctatct

SEQ ID NO: 5293980 - DNA, 16 bp, Homo sapiens
caagtaaatctatctc

SEQ ID NO: 5293981 - DNA, 18 bp, Homo sapiens
caagtaaatctatctcta

SEQ ID NO: 5293982 - DNA, 14 bp, Homo sapiens
caagtaaattctgt

SEQ ID NO: 5293983 - DNA, 14 bp, Homo sapiens
caagtaacacattt

SEQ ID NO: 5293984 - DNA, 15 bp, Homo sapiens
caagtaacactttaa

SEQ ID NO: 5293985 - DNA, 22 bp, Homo sapiens
caagtaacagttgaagaaaaaa

SEQ ID NO: 5293986 - DNA, 13 bp, Homo sapiens
caagtaagaagac

SEQ ID NO: 5293987 - DNA, 16 bp, Homo sapiens
caagtaagaagacatg

SEQ ID NO: 5293988 - DNA, 22 bp, Homo sapiens
caagtaagaagacatgaaccaa

SEQ ID NO: 5293989 - DNA, 23 bp, Homo sapiens
caagtaagactttctgaaaacac

SEQ ID NO: 5293990 - DNA, 20 bp, Homo sapiens
caagtaagagactcagcctg

SEQ ID NO: 5293991 - DNA, 17 bp, Homo sapiens
caagtaagaggctggag

SEQ ID NO: 5293992 - DNA, 21 bp, Homo sapiens
caagtaagagtactgggagaa

SEQ ID NO: 5293993 - DNA, 12 bp, Homo sapiens
caagtaatatta

SEQ ID NO: 5293994 - DNA, 13 bp, Homo sapiens
caagtaatattat

SEQ ID NO: 5293995 - DNA, 14 bp, Homo sapiens
caagtaatattatt

SEQ ID NO: 5293996 - DNA, 12 bp, Homo sapiens
caagtaatcact

SEQ ID NO: 5293997 - DNA, 17 bp, Homo sapiens
caagtaatcatggccag

SEQ ID NO: 5293998 - DNA, 20 bp, Homo sapiens
caagtaatcctgcacagatc

SEQ ID NO: 5293999 - DNA, 17 bp, Homo sapiens
caagtaatgaattttat

SEQ ID NO: 5294000 - DNA, 19 bp, Homo sapiens
caagtaatggaggtcccag

SEQ ID NO: 5294001 - DNA, 20 bp, Homo sapiens
caagtaatggaggtcccagc

SEQ ID NO: 5294002 - DNA, 22 bp, Homo sapiens
caagtaatggaggtcccagccc

SEQ ID NO: 5294003 - DNA, 23 bp, Homo sapiens
caagtaatttcagtgtaaagtgt

SEQ ID NO: 5294004 - DNA, 21 bp, Homo sapiens
caagtacaaaaggagaagagg

SEQ ID NO: 5294005 - DNA, 15 bp, Homo sapiens
caagtacactgagag

SEQ ID NO: 5294006 - DNA, 23 bp, Homo sapiens
caagtacagccttcactggagac

SEQ ID NO: 5294007 - DNA, 20 bp, Homo sapiens
caagtacatggctagctttt

SEQ ID NO: 5294008 - DNA, 16 bp, Homo sapiens
caagtaccaaagtttt

SEQ ID NO: 5294009 - DNA, 12 bp, Homo sapiens
caagtacccatt

SEQ ID NO: 5294010 - DNA, 20 bp, Homo sapiens
caagtactacattttctttt

SEQ ID NO: 5294011 - DNA, 14 bp, Homo sapiens
caagtactatctgt

SEQ ID NO: 5294012 - DNA, 15 bp, Homo sapiens
caagtagaaaagcag

SEQ ID NO: 5294013 - DNA, 19 bp, Homo sapiens
caagtagaacaaaaactat

SEQ ID NO: 5294014 - DNA, 13 bp, Homo sapiens
caagtagaatctc

SEQ ID NO: 5294015 - DNA, 20 bp, Homo sapiens
caagtagaatggcagctgga

SEQ ID NO: 5294016 - DNA, 13 bp, Homo sapiens
caagtagatcatg

SEQ ID NO: 5294017 - DNA, 19 bp, Homo sapiens
caagtagatcctgagaagt

SEQ ID NO: 5294018 - DNA, 15 bp, Homo sapiens
caagtagattggctg

SEQ ID NO: 5294019 - DNA, 14 bp, Homo sapiens
caagtagcacactg

SEQ ID NO: 5294020 - DNA, 14 bp, Homo sapiens
caagtagcaggact

SEQ ID NO: 5294021 - DNA, 15 bp, Homo sapiens
caagtagcctctggg

SEQ ID NO: 5294022 - DNA, 14 bp, Homo sapiens
caagtagctgctac

SEQ ID NO: 5294023 - DNA, 15 bp, Homo sapiens
caagtagctttccac

SEQ ID NO: 5294024 - DNA, 12 bp, Homo sapiens
caagtaggaatc

SEQ ID NO: 5294025 - DNA, 14 bp, Homo sapiens
caagtaggagacac

SEQ ID NO: 5294026 - DNA, 21 bp, Homo sapiens
caagtaggagacacagatggc

SEQ ID NO: 5294027 - DNA, 20 bp, Homo sapiens
caagtaggtgggattacagg

SEQ ID NO: 5294028 - DNA, 22 bp, Homo sapiens
caagtagtagtacttaatagta

SEQ ID NO: 5294029 - DNA, 17 bp, Homo sapiens
caagtagtagtgtcttc

SEQ ID NO: 5294030 - DNA, 19 bp, Homo sapiens
caagtagtccaccttcatt

SEQ ID NO: 5294031 - DNA, 17 bp, Homo sapiens
caagtagttctgtattt

SEQ ID NO: 5294032 - DNA, 19 bp, Homo sapiens
caagtagttctgtatttga

SEQ ID NO: 5294033 - DNA, 20 bp, Homo sapiens
caagtagttctgtatttgaa

SEQ ID NO: 5294034 - DNA, 13 bp, Homo sapiens
caagtataaagtc

SEQ ID NO: 5294035 - DNA, 17 bp, Homo sapiens
caagtataaagtcagga

SEQ ID NO: 5294036 - DNA, 21 bp, Homo sapiens
caagtataatattaataatac

SEQ ID NO: 5294037 - DNA, 15 bp, Homo sapiens
caagtatagaaaatc

SEQ ID NO: 5294038 - DNA, 18 bp, Homo sapiens
caagtatagcctatggca

SEQ ID NO: 5294039 - DNA, 15 bp, Homo sapiens
caagtatataattta

SEQ ID NO: 5294040 - DNA, 22 bp, Homo sapiens
caagtatatacttttaaattat

SEQ ID NO: 5294041 - DNA, 18 bp, Homo sapiens
caagtatatgtcatttac

SEQ ID NO: 5294042 - DNA, 22 bp, Homo sapiens
caagtatatgtgaaaaaaatga

SEQ ID NO: 5294043 - DNA, 18 bp, Homo sapiens
caagtatcatctaaatat

SEQ ID NO: 5294044 - DNA, 17 bp, Homo sapiens
caagtatccttcattgt

SEQ ID NO: 5294045 - DNA, 16 bp, Homo sapiens
caagtatcttctattt

SEQ ID NO: 5294046 - DNA, 17 bp, Homo sapiens
caagtatcttctatttt

SEQ ID NO: 5294047 - DNA, 16 bp, Homo sapiens
caagtatgaataaaga

SEQ ID NO: 5294048 - DNA, 13 bp, Homo sapiens
caagtatgcctta

SEQ ID NO: 5294049 - DNA, 22 bp, Homo sapiens
caagtatggtaggggagggcag

SEQ ID NO: 5294050 - DNA, 22 bp, Homo sapiens
caagtatgtgggcagattttca

SEQ ID NO: 5294051 - DNA, 17 bp, Homo sapiens
caagtatgttttagcat

SEQ ID NO: 5294052 - DNA, 14 bp, Homo sapiens
caagtattaaactg

SEQ ID NO: 5294053 - DNA, 15 bp, Homo sapiens
caagtattaaactgt

SEQ ID NO: 5294054 - DNA, 19 bp, Homo sapiens
caagtattaaactgtaaat

SEQ ID NO: 5294055 - DNA, 16 bp, Homo sapiens
caagtattaagcagtt

SEQ ID NO: 5294056 - DNA, 20 bp, Homo sapiens
caagtattaagcagttcatt

SEQ ID NO: 5294057 - DNA, 23 bp, Homo sapiens
caagtattactaaattgaccttt

SEQ ID NO: 5294058 - DNA, 20 bp, Homo sapiens
caagtattagaataccacag

SEQ ID NO: 5294059 - DNA, 13 bp, Homo sapiens
caagtattatacc

SEQ ID NO: 5294060 - DNA, 17 bp, Homo sapiens
caagtattatacctttt

SEQ ID NO: 5294061 - DNA, 17 bp, Homo sapiens
caagtattcagttccaa

SEQ ID NO: 5294062 - DNA, 15 bp, Homo sapiens
caagtatttaagcct

SEQ ID NO: 5294063 - DNA, 16 bp, Homo sapiens
caagtatttattccca

SEQ ID NO: 5294064 - DNA, 18 bp, Homo sapiens
caagtattttatctgtgt

SEQ ID NO: 5294065 - DNA, 21 bp, Homo sapiens
caagtatttttatttaaatta

SEQ ID NO: 5294066 - DNA, 17 bp, Homo sapiens
caagtcaaacagtgtgg

SEQ ID NO: 5294067 - DNA, 13 bp, Homo sapiens
caagtcaagtgaa

SEQ ID NO: 5294068 - DNA, 16 bp, Homo sapiens
caagtcaatcatttct

SEQ ID NO: 5294069 - DNA, 14 bp, Homo sapiens
caagtcacaaagga

SEQ ID NO: 5294070 - DNA, 15 bp, Homo sapiens
caagtcacacagcta

SEQ ID NO: 5294071 - DNA, 15 bp, Homo sapiens
caagtcacagaaaat

SEQ ID NO: 5294072 - DNA, 15 bp, Homo sapiens
caagtcacagctgca

SEQ ID NO: 5294073 - DNA, 18 bp, Homo sapiens
caagtcacagctgcagct

SEQ ID NO: 5294074 - DNA, 20 bp, Homo sapiens
caagtcacagctgcagctgg

SEQ ID NO: 5294075 - DNA, 20 bp, Homo sapiens
caagtcacggtctaaacaca

SEQ ID NO: 5294076 - DNA, 15 bp, Homo sapiens
caagtcactaaattt

SEQ ID NO: 5294077 - DNA, 14 bp, Homo sapiens
caagtcactcccaa

SEQ ID NO: 5294078 - DNA, 20 bp, Homo sapiens
caagtcactcttttttagtt

SEQ ID NO: 5294079 - DNA, 17 bp, Homo sapiens
caagtcacttaactata

SEQ ID NO: 5294080 - DNA, 21 bp, Homo sapiens
caagtcagaggatggccagtg

SEQ ID NO: 5294081 - DNA, 18 bp, Homo sapiens
caagtcagattgctggga

SEQ ID NO: 5294082 - DNA, 20 bp, Homo sapiens
caagtcagattgctgggagg

SEQ ID NO: 5294083 - DNA, 15 bp, Homo sapiens
caagtcagctccagc

SEQ ID NO: 5294084 - DNA, 16 bp, Homo sapiens
caagtcagctccagct

SEQ ID NO: 5294085 - DNA, 15 bp, Homo sapiens
caagtcaggccaggt

SEQ ID NO: 5294086 - DNA, 17 bp, Homo sapiens
caagtcaggccaggtgg

SEQ ID NO: 5294087 - DNA, 22 bp, Homo sapiens
caagtcagtaggactccttatt

SEQ ID NO: 5294088 - DNA, 16 bp, Homo sapiens
caagtcagtttctaca

SEQ ID NO: 5294089 - DNA, 13 bp, Homo sapiens
caagtcatggctg

SEQ ID NO: 5294090 - DNA, 14 bp, Homo sapiens
caagtcatggctgt

SEQ ID NO: 5294091 - DNA, 15 bp, Homo sapiens
caagtcatgggagaa

SEQ ID NO: 5294092 - DNA, 17 bp, Homo sapiens
caagtcatggtcacagt

SEQ ID NO: 5294093 - DNA, 16 bp, Homo sapiens
caagtcatgtgcattt

SEQ ID NO: 5294094 - DNA, 18 bp, Homo sapiens
caagtcattcctaatctt

SEQ ID NO: 5294095 - DNA, 13 bp, Homo sapiens
caagtcattgttt

SEQ ID NO: 5294096 - DNA, 14 bp, Homo sapiens
caagtcatttcaaa

SEQ ID NO: 5294097 - DNA, 17 bp, Homo sapiens
caagtcattttaacttt

SEQ ID NO: 5294098 - DNA, 19 bp, Homo sapiens
caagtcatttttgtatttt

SEQ ID NO: 5294099 - DNA, 15 bp, Homo sapiens
caagtcatttttgtt

SEQ ID NO: 5294100 - DNA, 15 bp, Homo sapiens
caagtccaaatgttt

SEQ ID NO: 5294101 - DNA, 18 bp, Homo sapiens
caagtccaacctgcctgt

SEQ ID NO: 5294102 - DNA, 15 bp, Homo sapiens
caagtccaataagac

SEQ ID NO: 5294103 - DNA, 14 bp, Homo sapiens
caagtccagctggg

SEQ ID NO: 5294104 - DNA, 13 bp, Homo sapiens
caagtccaggtcc

SEQ ID NO: 5294105 - DNA, 16 bp, Homo sapiens
caagtccaggtcctgg

SEQ ID NO: 5294106 - DNA, 17 bp, Homo sapiens
caagtccatagctgagc

SEQ ID NO: 5294107 - DNA, 20 bp, Homo sapiens
caagtccatagctgagctgg

SEQ ID NO: 5294108 - DNA, 21 bp, Homo sapiens
caagtccatagctgagctgga

SEQ ID NO: 5294109 - DNA, 18 bp, Homo sapiens
caagtcccagacaaggag

SEQ ID NO: 5294110 - DNA, 17 bp, Homo sapiens
caagtcccatcatagaa

SEQ ID NO: 5294111 - DNA, 23 bp, Homo sapiens
caagtccccagcccctcaaccct

SEQ ID NO: 5294112 - DNA, 17 bp, Homo sapiens
caagtcccccaagacct

SEQ ID NO: 5294113 - DNA, 18 bp, Homo sapiens
caagtcccccagcagaac

SEQ ID NO: 5294114 - DNA, 15 bp, Homo sapiens
caagtcccgaggcag

SEQ ID NO: 5294115 - DNA, 20 bp, Homo sapiens
caagtccctgactctctgtg

SEQ ID NO: 5294116 - DNA, 14 bp, Homo sapiens
caagtccctggaaa

SEQ ID NO: 5294117 - DNA, 22 bp, Homo sapiens
caagtccctgttttctgagccc

SEQ ID NO: 5294118 - DNA, 20 bp, Homo sapiens
caagtcccttgacctttcca

SEQ ID NO: 5294119 - DNA, 22 bp, Homo sapiens
caagtcccttgacctttccagc

SEQ ID NO: 5294120 - DNA, 18 bp, Homo sapiens
caagtcctcctagaactc

SEQ ID NO: 5294121 - DNA, 14 bp, Homo sapiens
caagtcctcgcccc

SEQ ID NO: 5294122 - DNA, 14 bp, Homo sapiens
caagtcctcttttc

SEQ ID NO: 5294123 - DNA, 14 bp, Homo sapiens
caagtcctgaagag

SEQ ID NO: 5294124 - DNA, 18 bp, Homo sapiens
caagtcctgcctcttaaa

SEQ ID NO: 5294125 - DNA, 19 bp, Homo sapiens
caagtcctggatgttgtgt

SEQ ID NO: 5294126 - DNA, 18 bp, Homo sapiens
caagtccttaggctactg

SEQ ID NO: 5294127 - DNA, 20 bp, Homo sapiens
caagtccttgacctctataa

SEQ ID NO: 5294128 - DNA, 15 bp, Homo sapiens
caagtccttttgtaa

SEQ ID NO: 5294129 - DNA, 17 bp, Homo sapiens
caagtccttttgtaaag

SEQ ID NO: 5294130 - DNA, 17 bp, Homo sapiens
caagtcgatgaactatt

SEQ ID NO: 5294131 - DNA, 18 bp, Homo sapiens
caagtcggaacagcagat

SEQ ID NO: 5294132 - DNA, 23 bp, Homo sapiens
caagtctaaaaagacctggcctt

SEQ ID NO: 5294133 - DNA, 16 bp, Homo sapiens
caagtctaatgaagag

SEQ ID NO: 5294134 - DNA, 20 bp, Homo sapiens
caagtctaatgaagagaaaa

SEQ ID NO: 5294135 - DNA, 19 bp, Homo sapiens
caagtctacagagtgatag

SEQ ID NO: 5294136 - DNA, 14 bp, Homo sapiens
caagtctaccaatt

SEQ ID NO: 5294137 - DNA, 22 bp, Homo sapiens
attttctatttttcttctaaaa

SEQ ID NO: 5294138 - DNA, 19 bp, Homo sapiens
attttctcaaaagcattta

SEQ ID NO: 5294139 - DNA, 20 bp, Homo sapiens
attttctcaaaagcatttat

SEQ ID NO: 5294140 - DNA, 22 bp, Homo sapiens
attttctcaaaagcatttatca

SEQ ID NO: 5294141 - DNA, 18 bp, Homo sapiens
attttctcactgaactcc

SEQ ID NO: 5294142 - DNA, 21 bp, Homo sapiens
attttctcataggaagtttgg

SEQ ID NO: 5294143 - DNA, 22 bp, Homo sapiens
attttctccaaataaaaattag

SEQ ID NO: 5294144 - DNA, 17 bp, Homo sapiens
attttctccagtccctg

SEQ ID NO: 5294145 - DNA, 23 bp, Homo sapiens
attttctccctggatttttacca

SEQ ID NO: 5294146 - DNA, 19 bp, Homo sapiens
attttctcctaggagaagc

SEQ ID NO: 5294147 - DNA, 14 bp, Homo sapiens
attttctcctgtgg

SEQ ID NO: 5294148 - DNA, 18 bp, Homo sapiens
attttctctaaactgttt

SEQ ID NO: 5294149 - DNA, 18 bp, Homo sapiens
attttctctgatactttt

SEQ ID NO: 5294150 - DNA, 14 bp, Homo sapiens
attttctcttagaa

SEQ ID NO: 5294151 - DNA, 17 bp, Homo sapiens
attttctctttaggaga

SEQ ID NO: 5294152 - DNA, 20 bp, Homo sapiens
attttctgaaactaatgaaa

SEQ ID NO: 5294153 - DNA, 12 bp, Homo sapiens
attttctgaaag

SEQ ID NO: 5294154 - DNA, 18 bp, Homo sapiens
attttctgaattcataaa

SEQ ID NO: 5294155 - DNA, 14 bp, Homo sapiens
attttctgaccaaa

SEQ ID NO: 5294156 - DNA, 15 bp, Homo sapiens
attttctgaccaaaa

SEQ ID NO: 5294157 - DNA, 18 bp, Homo sapiens
attttctgagtagcatat

SEQ ID NO: 5294158 - DNA, 14 bp, Homo sapiens
attttctgatgtat

SEQ ID NO: 5294159 - DNA, 12 bp, Homo sapiens
attttctgcaag

SEQ ID NO: 5294160 - DNA, 13 bp, Homo sapiens
attttctgcaatc

SEQ ID NO: 5294161 - DNA, 17 bp, Homo sapiens
attttctgcagctgttt

SEQ ID NO: 5294162 - DNA, 20 bp, Homo sapiens
attttctgcccaactttcat

SEQ ID NO: 5294163 - DNA, 20 bp, Homo sapiens
attttctggaaaatgcttct

SEQ ID NO: 5294164 - DNA, 19 bp, Homo sapiens
attttctggaatacatgaa

SEQ ID NO: 5294165 - DNA, 13 bp, Homo sapiens
attttctggattc

SEQ ID NO: 5294166 - DNA, 22 bp, Homo sapiens
attttctggattccccatctca

SEQ ID NO: 5294167 - DNA, 16 bp, Homo sapiens
attttctggtaaaaag

SEQ ID NO: 5294168 - DNA, 18 bp, Homo sapiens
attttctggtagatagaa

SEQ ID NO: 5294169 - DNA, 17 bp, Homo sapiens
attttctggttctaaca

SEQ ID NO: 5294170 - DNA, 19 bp, Homo sapiens
attttctggttctaacatt

SEQ ID NO: 5294171 - DNA, 17 bp, Homo sapiens
attttctgtaaatgaag

SEQ ID NO: 5294172 - DNA, 20 bp, Homo sapiens
attttctgtaagagaaaata

SEQ ID NO: 5294173 - DNA, 15 bp, Homo sapiens
attttctgtaattct

SEQ ID NO: 5294174 - DNA, 17 bp, Homo sapiens
attttctgtaattcttc

SEQ ID NO: 5294175 - DNA, 14 bp, Homo sapiens
attttctgtattta

SEQ ID NO: 5294176 - DNA, 22 bp, Homo sapiens
attttctgtatttaattataaa

SEQ ID NO: 5294177 - DNA, 13 bp, Homo sapiens
attttctgtcaga

SEQ ID NO: 5294178 - DNA, 16 bp, Homo sapiens
attttctgtgcctgaa

SEQ ID NO: 5294179 - DNA, 21 bp, Homo sapiens
attttctgtgcctgaatattt

SEQ ID NO: 5294180 - DNA, 21 bp, Homo sapiens
attttctgtgtaaaatgagta

SEQ ID NO: 5294181 - DNA, 23 bp, Homo sapiens
attttctgtgtgtacatgtacat

SEQ ID NO: 5294182 - DNA, 18 bp, Homo sapiens
attttctgtgtgttcctg

SEQ ID NO: 5294183 - DNA, 19 bp, Homo sapiens
attttctgtgtgttcctgg

SEQ ID NO: 5294184 - DNA, 23 bp, Homo sapiens
attttctgtgttttgctgtacca

SEQ ID NO: 5294185 - DNA, 21 bp, Homo sapiens
attttctgttcagattaaaaa

SEQ ID NO: 5294186 - DNA, 15 bp, Homo sapiens
attttctgttccagg

SEQ ID NO: 5294187 - DNA, 15 bp, Homo sapiens
attttcttaaaccaa

SEQ ID NO: 5294188 - DNA, 14 bp, Homo sapiens
attttcttaattat

SEQ ID NO: 5294189 - DNA, 21 bp, Homo sapiens
attttcttacccaatttccca

SEQ ID NO: 5294190 - DNA, 15 bp, Homo sapiens
attttcttactttta

SEQ ID NO: 5294191 - DNA, 14 bp, Homo sapiens
attttcttatgtaa

SEQ ID NO: 5294192 - DNA, 20 bp, Homo sapiens
attttcttatgtaagtttgc

SEQ ID NO: 5294193 - DNA, 24 bp, Homo sapiens
attttcttatgtaagtttgcatat

SEQ ID NO: 5294194 - DNA, 10 bp, Homo sapiens
attttcttca

SEQ ID NO: 5294195 - DNA, 22 bp, Homo sapiens
attttcttcacagtgcagcttg

SEQ ID NO: 5294196 - DNA, 18 bp, Homo sapiens
attttcttcacctctgct

SEQ ID NO: 5294197 - DNA, 13 bp, Homo sapiens
attttcttcagaa

SEQ ID NO: 5294198 - DNA, 16 bp, Homo sapiens
attttcttcccatttg

SEQ ID NO: 5294199 - DNA, 17 bp, Homo sapiens
attttcttcccatttgt

SEQ ID NO: 5294200 - DNA, 18 bp, Homo sapiens
attttcttcccatttgta

SEQ ID NO: 5294201 - DNA, 22 bp, Homo sapiens
attttcttcccatttgtaatgt

SEQ ID NO: 5294202 - DNA, 12 bp, Homo sapiens
attttcttcctt

SEQ ID NO: 5294203 - DNA, 14 bp, Homo sapiens
attttcttctaagt

SEQ ID NO: 5294204 - DNA, 16 bp, Homo sapiens
attttcttctaagtga

SEQ ID NO: 5294205 - DNA, 20 bp, Homo sapiens
attttcttctaagtgaaatt

SEQ ID NO: 5294206 - DNA, 19 bp, Homo sapiens
attttcttctctgtgaagt

SEQ ID NO: 5294207 - DNA, 18 bp, Homo sapiens
attttcttctctgtgaga

SEQ ID NO: 5294208 - DNA, 13 bp, Homo sapiens
attttcttcttta

SEQ ID NO: 5294209 - DNA, 16 bp, Homo sapiens
attttcttgaggaaaa

SEQ ID NO: 5294210 - DNA, 23 bp, Homo sapiens
attttcttgatgtagcagaatat

SEQ ID NO: 5294211 - DNA, 17 bp, Homo sapiens
attttcttgcctgaggc

SEQ ID NO: 5294212 - DNA, 18 bp, Homo sapiens
attttcttgcctgaggct

SEQ ID NO: 5294213 - DNA, 14 bp, Homo sapiens
attttcttgtcaat

SEQ ID NO: 5294214 - DNA, 13 bp, Homo sapiens
attttctttaaaa

SEQ ID NO: 5294215 - DNA, 15 bp, Homo sapiens
attttctttatttgt

SEQ ID NO: 5294216 - DNA, 16 bp, Homo sapiens
attttctttatttgta

SEQ ID NO: 5294217 - DNA, 16 bp, Homo sapiens
attttctttcatacat

SEQ ID NO: 5294218 - DNA, 18 bp, Homo sapiens
attttctttcatacatta

SEQ ID NO: 5294219 - DNA, 19 bp, Homo sapiens
attttctttcatacattat

SEQ ID NO: 5294220 - DNA, 20 bp, Homo sapiens
attttctttcatacattata

SEQ ID NO: 5294221 - DNA, 14 bp, Homo sapiens
attttctttccttt

SEQ ID NO: 5294222 - DNA, 13 bp, Homo sapiens
attttctttctat

SEQ ID NO: 5294223 - DNA, 16 bp, Homo sapiens
attttctttctatgta

SEQ ID NO: 5294224 - DNA, 16 bp, Homo sapiens
attttctttctgtaac

SEQ ID NO: 5294225 - DNA, 21 bp, Homo sapiens
attttctttctttttctggaa

SEQ ID NO: 5294226 - DNA, 16 bp, Homo sapiens
attttctttgaaattc

SEQ ID NO: 5294227 - DNA, 23 bp, Homo sapiens
attttctttgtgtagctttgctc

SEQ ID NO: 5294228 - DNA, 14 bp, Homo sapiens
attttctttgtttc

SEQ ID NO: 5294229 - DNA, 20 bp, Homo sapiens
attttcttttaagcatttgt

SEQ ID NO: 5294230 - DNA, 18 bp, Homo sapiens
attttcttttatatctgt

SEQ ID NO: 5294231 - DNA, 18 bp, Homo sapiens
attttcttttgaattgtt

SEQ ID NO: 5294232 - DNA, 16 bp, Homo sapiens
attttcttttgtaaat

SEQ ID NO: 5294233 - DNA, 22 bp, Homo sapiens
attttctttttaactttaccaa

SEQ ID NO: 5294234 - DNA, 22 bp, Homo sapiens
attttctttttattttttaatt

SEQ ID NO: 5294235 - DNA, 22 bp, Homo sapiens
attttctttttctgaagcctct

SEQ ID NO: 5294236 - DNA, 21 bp, Homo sapiens
attttctttttgtttcactgg

SEQ ID NO: 5294237 - DNA, 20 bp, Homo sapiens
attttctttttttaactggt

SEQ ID NO: 5294238 - DNA, 21 bp, Homo sapiens
attttgaaaaagtaggctgcc

SEQ ID NO: 5294239 - DNA, 16 bp, Homo sapiens
attttgaaaacactta

SEQ ID NO: 5294240 - DNA, 18 bp, Homo sapiens
attttgaaaacacttatt

SEQ ID NO: 5294241 - DNA, 22 bp, Homo sapiens
attttgaaaactacattttaac

SEQ ID NO: 5294242 - DNA, 19 bp, Homo sapiens
attttgaaaagcttcttaa

SEQ ID NO: 5294243 - DNA, 16 bp, Homo sapiens
attttgaaaagtaata

SEQ ID NO: 5294244 - DNA, 17 bp, Homo sapiens
attttgaaaagtaatat

SEQ ID NO: 5294245 - DNA, 21 bp, Homo sapiens
attttgaaaagtaatatttat

SEQ ID NO: 5294246 - DNA, 19 bp, Homo sapiens
attttgaaataaaaatgga

SEQ ID NO: 5294247 - DNA, 12 bp, Homo sapiens
attttgaaatat

SEQ ID NO: 5294248 - DNA, 20 bp, Homo sapiens
attttgaaatattgatgcag

SEQ ID NO: 5294249 - DNA, 13 bp, Homo sapiens
attttgaaatgat

SEQ ID NO: 5294250 - DNA, 15 bp, Homo sapiens
attttgaaattgttt

SEQ ID NO: 5294251 - DNA, 18 bp, Homo sapiens
attttgaaccaaaacata

SEQ ID NO: 5294252 - DNA, 20 bp, Homo sapiens
attttgaacctgatgaaaat

SEQ ID NO: 5294253 - DNA, 14 bp, Homo sapiens
attttgaagaaaac

SEQ ID NO: 5294254 - DNA, 18 bp, Homo sapiens
attttgaagaaaacacaa

SEQ ID NO: 5294255 - DNA, 13 bp, Homo sapiens
attttgaagaata

SEQ ID NO: 5294256 - DNA, 12 bp, Homo sapiens
attttgaagcta

SEQ ID NO: 5294257 - DNA, 22 bp, Homo sapiens
attttgaagtgctgtttattaa

SEQ ID NO: 5294258 - DNA, 18 bp, Homo sapiens
attttgaagtttacattt

SEQ ID NO: 5294259 - DNA, 12 bp, Homo sapiens
attttgaatacc

SEQ ID NO: 5294260 - DNA, 13 bp, Homo sapiens
attttgaatcaat

SEQ ID NO: 5294261 - DNA, 14 bp, Homo sapiens
attttgaatctgtg

SEQ ID NO: 5294262 - DNA, 22 bp, Homo sapiens
attttgaatctgtgtgcatatt

SEQ ID NO: 5294263 - DNA, 12 bp, Homo sapiens
attttgaatgtg

SEQ ID NO: 5294264 - DNA, 14 bp, Homo sapiens
attttgaatgtgat

SEQ ID NO: 5294265 - DNA, 16 bp, Homo sapiens
attttgacaaagtgcc

SEQ ID NO: 5294266 - DNA, 18 bp, Homo sapiens
attttgacaactgaaaga

SEQ ID NO: 5294267 - DNA, 24 bp, Homo sapiens
attttgacataaagttgataaaga

SEQ ID NO: 5294268 - DNA, 18 bp, Homo sapiens
attttgacataagtaact

SEQ ID NO: 5294269 - DNA, 14 bp, Homo sapiens
attttgaccttgta

SEQ ID NO: 5294270 - DNA, 15 bp, Homo sapiens
attttgaccttgtat

SEQ ID NO: 5294271 - DNA, 18 bp, Homo sapiens
attttgaccttgtattga

SEQ ID NO: 5294272 - DNA, 19 bp, Homo sapiens
attttgacttgaaaaatat

SEQ ID NO: 5294273 - DNA, 14 bp, Homo sapiens
attttgagaaactg

SEQ ID NO: 5294274 - DNA, 15 bp, Homo sapiens
attttgagaacaaag

SEQ ID NO: 5294275 - DNA, 21 bp, Homo sapiens
attttgagccttattaaaata

SEQ ID NO: 5294276 - DNA, 14 bp, Homo sapiens
attttgagctattt

SEQ ID NO: 5294277 - DNA, 20 bp, Homo sapiens
attttgagggtgtaaccagt

SEQ ID NO: 5294278 - DNA, 17 bp, Homo sapiens
attttgaggtaaagata

SEQ ID NO: 5294279 - DNA, 22 bp, Homo sapiens
attttgaggtagaggaaaatca

SEQ ID NO: 5294280 - DNA, 22 bp, Homo sapiens
attttgaggttttgtaaaactg

SEQ ID NO: 5294281 - DNA, 15 bp, Homo sapiens
attttgagtattcca

SEQ ID NO: 5294282 - DNA, 19 bp, Homo sapiens
attttgagtattccatgag

SEQ ID NO: 5294283 - DNA, 21 bp, Homo sapiens
attttgagtattccatgagct

SEQ ID NO: 5294284 - DNA, 18 bp, Homo sapiens
attttgagtatttttaaa

SEQ ID NO: 5294285 - DNA, 20 bp, Homo sapiens
attttgagtcctaggactta

SEQ ID NO: 5294286 - DNA, 21 bp, Homo sapiens
attttgagtcctaggacttaa

SEQ ID NO: 5294287 - DNA, 22 bp, Homo sapiens
attttgagtcctaggacttaaa

SEQ ID NO: 5294288 - DNA, 13 bp, Homo sapiens
attttgagtgaat

SEQ ID NO: 5294289 - DNA, 14 bp, Homo sapiens
attttgagtgactc

SEQ ID NO: 5294290 - DNA, 14 bp, Homo sapiens
attttgagttgcca

SEQ ID NO: 5294291 - DNA, 21 bp, Homo sapiens
attttgagtttcagctggaaa

SEQ ID NO: 5294292 - DNA, 15 bp, Homo sapiens
attttgataataaat

SEQ ID NO: 5294293 - DNA, 16 bp, Homo sapiens
attttgataataatat

SEQ ID NO: 5294294 - DNA, 17 bp, Homo sapiens
attttgatacaaatgtt

SEQ ID NO: 5294295 - DNA, 20 bp, Homo sapiens
attttgatatacattgtgtg

SEQ ID NO: 5294296 - DNA, 17 bp, Homo sapiens
attttgatattttcaca

SEQ ID NO: 5294297 - DNA, 23 bp, Homo sapiens
attttgatattttcacagatgga

SEQ ID NO: 5294298 - DNA, 19 bp, Homo sapiens
attttgatccaagctggtc

SEQ ID NO: 5294299 - DNA, 16 bp, Homo sapiens
attttgatcttcaaca

SEQ ID NO: 5294300 - DNA, 19 bp, Homo sapiens
attttgatcttcaacaaat

SEQ ID NO: 5294301 - DNA, 14 bp, Homo sapiens
attttgatgaacaa

SEQ ID NO: 5294302 - DNA, 23 bp, Homo sapiens
attttgatgagatattaaattct

SEQ ID NO: 5294303 - DNA, 16 bp, Homo sapiens
attttgatgcagataa

SEQ ID NO: 5294304 - DNA, 21 bp, Homo sapiens
attttgatgcagcatttgata

SEQ ID NO: 5294305 - DNA, 23 bp, Homo sapiens
attttgatgcagcatttgataat

SEQ ID NO: 5294306 - DNA, 18 bp, Homo sapiens
attttgatgtaaagatgt

SEQ ID NO: 5294307 - DNA, 16 bp, Homo sapiens
attttgatgtattatt

SEQ ID NO: 5294308 - DNA, 18 bp, Homo sapiens
attttgattattgtattt

SEQ ID NO: 5294309 - DNA, 17 bp, Homo sapiens
attttgattgtttgatg

SEQ ID NO: 5294310 - DNA, 19 bp, Homo sapiens
attttgcaaaatttccagt

SEQ ID NO: 5294311 - DNA, 21 bp, Homo sapiens
attttgcaaacactgtgatta

SEQ ID NO: 5294312 - DNA, 21 bp, Homo sapiens
attttgcaaacccaactaagc

SEQ ID NO: 5294313 - DNA, 19 bp, Homo sapiens
attttgcaaatataaacat

SEQ ID NO: 5294314 - DNA, 17 bp, Homo sapiens
caagtctacctgccttg

SEQ ID NO: 5294315 - DNA, 14 bp, Homo sapiens
caagtctagagtct

SEQ ID NO: 5294316 - DNA, 17 bp, Homo sapiens
caagtctagtcttctgg

SEQ ID NO: 5294317 - DNA, 23 bp, Homo sapiens
caagtctcagtggcttcatctgt

SEQ ID NO: 5294318 - DNA, 14 bp, Homo sapiens
caagtctctctgtg

SEQ ID NO: 5294319 - DNA, 22 bp, Homo sapiens
caagtctctctgtgaatacaat

SEQ ID NO: 5294320 - DNA, 17 bp, Homo sapiens
caagtctgcacagagca

SEQ ID NO: 5294321 - DNA, 19 bp, Homo sapiens
caagtctgcatttcatatt

SEQ ID NO: 5294322 - DNA, 14 bp, Homo sapiens
caagtctggcacca

SEQ ID NO: 5294323 - DNA, 15 bp, Homo sapiens
caagtctgtacctca

SEQ ID NO: 5294324 - DNA, 21 bp, Homo sapiens
caagtctgtacctcaaatgaa

SEQ ID NO: 5294325 - DNA, 14 bp, Homo sapiens
caagtctgtgcctg

SEQ ID NO: 5294326 - DNA, 19 bp, Homo sapiens
caagtctgtgcctggagct

SEQ ID NO: 5294327 - DNA, 23 bp, Homo sapiens
caagtctgtgcctggagctcctg

SEQ ID NO: 5294328 - DNA, 13 bp, Homo sapiens
caagtctgtgttc

SEQ ID NO: 5294329 - DNA, 14 bp, Homo sapiens
caagtctgtttact

SEQ ID NO: 5294330 - DNA, 14 bp, Homo sapiens
caagtcttccctga

SEQ ID NO: 5294331 - DNA, 15 bp, Homo sapiens
caagtcttccctgat

SEQ ID NO: 5294332 - DNA, 13 bp, Homo sapiens
caagtcttgctgt

SEQ ID NO: 5294333 - DNA, 22 bp, Homo sapiens
caagtcttgggtctgaatttat

SEQ ID NO: 5294334 - DNA, 18 bp, Homo sapiens
caagtctttccagaggag

SEQ ID NO: 5294335 - DNA, 19 bp, Homo sapiens
caagtctttctcctctttg

SEQ ID NO: 5294336 - DNA, 21 bp, Homo sapiens
caagtctttctctttccctgg

SEQ ID NO: 5294337 - DNA, 23 bp, Homo sapiens
caagtctttctctttccctggtc

SEQ ID NO: 5294338 - DNA, 19 bp, Homo sapiens
caagtgaaaaaggaggaag

SEQ ID NO: 5294339 - DNA, 12 bp, Homo sapiens
caagtgaaaaat

SEQ ID NO: 5294340 - DNA, 21 bp, Homo sapiens
caagtgaaaactgatttccca

SEQ ID NO: 5294341 - DNA, 20 bp, Homo sapiens
caagtgaaataacaaaatgg

SEQ ID NO: 5294342 - DNA, 14 bp, Homo sapiens
caagtgaagaaaag

SEQ ID NO: 5294343 - DNA, 19 bp, Homo sapiens
caagtgaagaacactactg

SEQ ID NO: 5294344 - DNA, 12 bp, Homo sapiens
caagtgaaggtt

SEQ ID NO: 5294345 - DNA, 21 bp, Homo sapiens
caagtgaaggttcccaaggac

SEQ ID NO: 5294346 - DNA, 19 bp, Homo sapiens
caagtgaatctttctcctg

SEQ ID NO: 5294347 - DNA, 20 bp, Homo sapiens
caagtgaatctttctcctgg

SEQ ID NO: 5294348 - DNA, 21 bp, Homo sapiens
caagtgaatctttctcctggt

SEQ ID NO: 5294349 - DNA, 23 bp, Homo sapiens
caagtgaatctttctcctggtga

SEQ ID NO: 5294350 - DNA, 21 bp, Homo sapiens
caagtgaccagggaagtgtgt

SEQ ID NO: 5294351 - DNA, 17 bp, Homo sapiens
caagtgaccccagggcc

SEQ ID NO: 5294352 - DNA, 17 bp, Homo sapiens
caagtgaccgacaaaat

SEQ ID NO: 5294353 - DNA, 21 bp, Homo sapiens
caagtgaccgacaaaattcca

SEQ ID NO: 5294354 - DNA, 22 bp, Homo sapiens
caagtgactctcctgcctcagc

SEQ ID NO: 5294355 - DNA, 23 bp, Homo sapiens
caagtgactctcctgcctcagcc

SEQ ID NO: 5294356 - DNA, 14 bp, Homo sapiens
caagtgagagagca

SEQ ID NO: 5294357 - DNA, 19 bp, Homo sapiens
caagtgaggtgacactcca

SEQ ID NO: 5294358 - DNA, 19 bp, Homo sapiens
caagtgaggtgtgtcacaa

SEQ ID NO: 5294359 - DNA, 19 bp, Homo sapiens
caagtgagttgaatagttg

SEQ ID NO: 5294360 - DNA, 18 bp, Homo sapiens
caagtgatatatgtattt

SEQ ID NO: 5294361 - DNA, 17 bp, Homo sapiens
caagtgatcctcacgcc

SEQ ID NO: 5294362 - DNA, 21 bp, Homo sapiens
caagtgatcctcctgcctcag

SEQ ID NO: 5294363 - DNA, 19 bp, Homo sapiens
caagtgatctgcccacctc

SEQ ID NO: 5294364 - DNA, 18 bp, Homo sapiens
caagtgatctttcaatat

SEQ ID NO: 5294365 - DNA, 15 bp, Homo sapiens
caagtgatggtcatt

SEQ ID NO: 5294366 - DNA, 18 bp, Homo sapiens
caagtgatggtcattcat

SEQ ID NO: 5294367 - DNA, 17 bp, Homo sapiens
caagtgatgtgtttaca

SEQ ID NO: 5294368 - DNA, 18 bp, Homo sapiens
caagtgattctcatgcct

SEQ ID NO: 5294369 - DNA, 14 bp, Homo sapiens
caagtgattctcct

SEQ ID NO: 5294370 - DNA, 18 bp, Homo sapiens
caagtgattctcctgcct

SEQ ID NO: 5294371 - DNA, 20 bp, Homo sapiens
caagtgattctcctgcctca

SEQ ID NO: 5294372 - DNA, 21 bp, Homo sapiens
caagtgattctcctgcctcag

SEQ ID NO: 5294373 - DNA, 15 bp, Homo sapiens
caagtgattgaaaat

SEQ ID NO: 5294374 - DNA, 18 bp, Homo sapiens
caagtgattgggacagag

SEQ ID NO: 5294375 - DNA, 14 bp, Homo sapiens
caagtgcaatagat

SEQ ID NO: 5294376 - DNA, 23 bp, Homo sapiens
caagtgcaatagattactgatgt

SEQ ID NO: 5294377 - DNA, 13 bp, Homo sapiens
caagtgcaatgcc

SEQ ID NO: 5294378 - DNA, 20 bp, Homo sapiens
caagtgcacggggcacagcg

SEQ ID NO: 5294379 - DNA, 20 bp, Homo sapiens
caagtgcactttctaatgtt

SEQ ID NO: 5294380 - DNA, 13 bp, Homo sapiens
caagtgcaggctg

SEQ ID NO: 5294381 - DNA, 22 bp, Homo sapiens
caagtgcagggcctgtaatccc

SEQ ID NO: 5294382 - DNA, 15 bp, Homo sapiens
caagtgccaaacaga

SEQ ID NO: 5294383 - DNA, 16 bp, Homo sapiens
caagtgccaaatgctc

SEQ ID NO: 5294384 - DNA, 17 bp, Homo sapiens
caagtgccagaggtggg

SEQ ID NO: 5294385 - DNA, 16 bp, Homo sapiens
caagtgccagggctgg

SEQ ID NO: 5294386 - DNA, 20 bp, Homo sapiens
caagtgccagtcttgtgtct

SEQ ID NO: 5294387 - DNA, 14 bp, Homo sapiens
caagtgcccagtgg

SEQ ID NO: 5294388 - DNA, 17 bp, Homo sapiens
caagtgccccctcacct

SEQ ID NO: 5294389 - DNA, 18 bp, Homo sapiens
caagtgccccctcacctc

SEQ ID NO: 5294390 - DNA, 22 bp, Homo sapiens
caagtgcccgccctgcccctgc

SEQ ID NO: 5294391 - DNA, 23 bp, Homo sapiens
caagtgcccgccctgcccctgcc

SEQ ID NO: 5294392 - DNA, 18 bp, Homo sapiens
caagtgccgcaaattgta

SEQ ID NO: 5294393 - DNA, 20 bp, Homo sapiens
caagtgcctagactgttact

SEQ ID NO: 5294394 - DNA, 12 bp, Homo sapiens
caagtgcctcac

SEQ ID NO: 5294395 - DNA, 16 bp, Homo sapiens
caagtgcctgcttttg

SEQ ID NO: 5294396 - DNA, 22 bp, Homo sapiens
caagtgcctgcttttgatgatg

SEQ ID NO: 5294397 - DNA, 14 bp, Homo sapiens
caagtgcctgggat

SEQ ID NO: 5294398 - DNA, 15 bp, Homo sapiens
caagtgctcagggaa

SEQ ID NO: 5294399 - DNA, 16 bp, Homo sapiens
caagtgctctttccac

SEQ ID NO: 5294400 - DNA, 14 bp, Homo sapiens
caagtgctgaacag

SEQ ID NO: 5294401 - DNA, 17 bp, Homo sapiens
caagtgctgaacagtgg

SEQ ID NO: 5294402 - DNA, 20 bp, Homo sapiens
caagtgctgaacagtggagg

SEQ ID NO: 5294403 - DNA, 14 bp, Homo sapiens
caagtgctggagtc

SEQ ID NO: 5294404 - DNA, 21 bp, Homo sapiens
caagtgctggagtctcctgag

SEQ ID NO: 5294405 - DNA, 21 bp, Homo sapiens
caagtgctggcaccaccaggc

SEQ ID NO: 5294406 - DNA, 13 bp, Homo sapiens
caagtgctggccc

SEQ ID NO: 5294407 - DNA, 15 bp, Homo sapiens
caagtgcttcctaca

SEQ ID NO: 5294408 - DNA, 16 bp, Homo sapiens
caagtggaagccactg

SEQ ID NO: 5294409 - DNA, 18 bp, Homo sapiens
caagtggacctcgtccca

SEQ ID NO: 5294410 - DNA, 12 bp, Homo sapiens
caagtggacctt

SEQ ID NO: 5294411 - DNA, 21 bp, Homo sapiens
caagtggaccttaggccttcc

SEQ ID NO: 5294412 - DNA, 23 bp, Homo sapiens
caagtggactcagggcagcgcca

SEQ ID NO: 5294413 - DNA, 16 bp, Homo sapiens
caagtggacttggagc

SEQ ID NO: 5294414 - DNA, 18 bp, Homo sapiens
caagtggacttggagctg

SEQ ID NO: 5294415 - DNA, 17 bp, Homo sapiens
caagtggagctgtctgt

SEQ ID NO: 5294416 - DNA, 18 bp, Homo sapiens
caagtggagctgtctgtc

SEQ ID NO: 5294417 - DNA, 11 bp, Homo sapiens
caagtggaggg

SEQ ID NO: 5294418 - DNA, 17 bp, Homo sapiens
caagtggatggcccagc

SEQ ID NO: 5294419 - DNA, 23 bp, Homo sapiens
caagtggatgggaatttgtcagc

SEQ ID NO: 5294420 - DNA, 16 bp, Homo sapiens
caagtggcccccaccc

SEQ ID NO: 5294421 - DNA, 18 bp, Homo sapiens
caagtggctccccacctg

SEQ ID NO: 5294422 - DNA, 17 bp, Homo sapiens
caagtggctcttgggac

SEQ ID NO: 5294423 - DNA, 18 bp, Homo sapiens
caagtggctcttgggaca

SEQ ID NO: 5294424 - DNA, 19 bp, Homo sapiens
caagtggctcttgggacaa

SEQ ID NO: 5294425 - DNA, 18 bp, Homo sapiens
caagtgggagatgaaaac

SEQ ID NO: 5294426 - DNA, 19 bp, Homo sapiens
caagtgggagatgaaaacc

SEQ ID NO: 5294427 - DNA, 20 bp, Homo sapiens
caagtgggatctgtcacacc

SEQ ID NO: 5294428 - DNA, 10 bp, Homo sapiens
caagtgggct

SEQ ID NO: 5294429 - DNA, 13 bp, Homo sapiens
caagtgggctggt

SEQ ID NO: 5294430 - DNA, 17 bp, Homo sapiens
caagtggggctcgccat

SEQ ID NO: 5294431 - DNA, 14 bp, Homo sapiens
caagtgggggcaga

SEQ ID NO: 5294432 - DNA, 20 bp, Homo sapiens
caagtgggggcagagggcag

SEQ ID NO: 5294433 - DNA, 12 bp, Homo sapiens
caagtggggtgc

SEQ ID NO: 5294434 - DNA, 15 bp, Homo sapiens
caagtggggtgctgg

SEQ ID NO: 5294435 - DNA, 17 bp, Homo sapiens
caagtgggtacccccag

SEQ ID NO: 5294436 - DNA, 20 bp, Homo sapiens
caagtgggtcaattccttag

SEQ ID NO: 5294437 - DNA, 22 bp, Homo sapiens
caagtggtaatttttgtacatt

SEQ ID NO: 5294438 - DNA, 15 bp, Homo sapiens
caagtggtgaccaaa

SEQ ID NO: 5294439 - DNA, 16 bp, Homo sapiens
caagtggtgagcaagc

SEQ ID NO: 5294440 - DNA, 17 bp, Homo sapiens
caagtggtgagcaagca

SEQ ID NO: 5294441 - DNA, 13 bp, Homo sapiens
caagtggtgccta

SEQ ID NO: 5294442 - DNA, 20 bp, Homo sapiens
caagtggtggtaaccctggt

SEQ ID NO: 5294443 - DNA, 18 bp, Homo sapiens
caagtggtgtttattgca

SEQ ID NO: 5294444 - DNA, 21 bp, Homo sapiens
caagtggttaagaatgtatat

SEQ ID NO: 5294445 - DNA, 22 bp, Homo sapiens
caagtggtttccacatgctctg

SEQ ID NO: 5294446 - DNA, 21 bp, Homo sapiens
caagtgtaaaatattttgaat

SEQ ID NO: 5294447 - DNA, 19 bp, Homo sapiens
caagtgtaatgaatacctt

SEQ ID NO: 5294448 - DNA, 12 bp, Homo sapiens
caagtgtaatta

SEQ ID NO: 5294449 - DNA, 12 bp, Homo sapiens
caagtgtacaga

SEQ ID NO: 5294450 - DNA, 16 bp, Homo sapiens
caagtgtacagaagaa

SEQ ID NO: 5294451 - DNA, 23 bp, Homo sapiens
caagtgtacatttgatttgatat

SEQ ID NO: 5294452 - DNA, 20 bp, Homo sapiens
caagtgtagatgtagcattg

SEQ ID NO: 5294453 - DNA, 12 bp, Homo sapiens
caagtgtataat

SEQ ID NO: 5294454 - DNA, 14 bp, Homo sapiens
caagtgtatatcag

SEQ ID NO: 5294455 - DNA, 15 bp, Homo sapiens
caagtgtatttaaaa

SEQ ID NO: 5294456 - DNA, 14 bp, Homo sapiens
caagtgtattttaa

SEQ ID NO: 5294457 - DNA, 18 bp, Homo sapiens
caagtgtattttaaaata

SEQ ID NO: 5294458 - DNA, 20 bp, Homo sapiens
caagtgtattttaaaataga

SEQ ID NO: 5294459 - DNA, 13 bp, Homo sapiens
caagtgtcacctc

SEQ ID NO: 5294460 - DNA, 15 bp, Homo sapiens
caagtgtcacctcct

SEQ ID NO: 5294461 - DNA, 14 bp, Homo sapiens
caagtgtcttccat

SEQ ID NO: 5294462 - DNA, 15 bp, Homo sapiens
caagtgtcttccatc

SEQ ID NO: 5294463 - DNA, 12 bp, Homo sapiens
caagtgtctttt

SEQ ID NO: 5294464 - DNA, 19 bp, Homo sapiens
caagtgtgaacaaaagatg

SEQ ID NO: 5294465 - DNA, 14 bp, Homo sapiens
caagtgtgaatact

SEQ ID NO: 5294466 - DNA, 15 bp, Homo sapiens
caagtgtgcatattg

SEQ ID NO: 5294467 - DNA, 17 bp, Homo sapiens
caagtgtgcatattgta

SEQ ID NO: 5294468 - DNA, 14 bp, Homo sapiens
caagtgtgcatggc

SEQ ID NO: 5294469 - DNA, 23 bp, Homo sapiens
caagtgtgcctgctatccagccg

SEQ ID NO: 5294470 - DNA, 13 bp, Homo sapiens
caagtgtggagga

SEQ ID NO: 5294471 - DNA, 19 bp, Homo sapiens
caagtgtgggaacattatt

SEQ ID NO: 5294472 - DNA, 22 bp, Homo sapiens
caagtgtggtagagtgtgcctg

SEQ ID NO: 5294473 - DNA, 22 bp, Homo sapiens
caagtgtggtagggacttaaaa

SEQ ID NO: 5294474 - DNA, 23 bp, Homo sapiens
caagtgtgtatgtgcgtgtgtgc

SEQ ID NO: 5294475 - DNA, 12 bp, Homo sapiens
caagtgtgtgag

SEQ ID NO: 5294476 - DNA, 22 bp, Homo sapiens
caagtgtgtgcacatgtgtgcg

SEQ ID NO: 5294477 - DNA, 16 bp, Homo sapiens
caagtgttaaggcaac

SEQ ID NO: 5294478 - DNA, 22 bp, Homo sapiens
caagtgttaaggcaacattcct

SEQ ID NO: 5294479 - DNA, 16 bp, Homo sapiens
caagtgttcacaacct

SEQ ID NO: 5294480 - DNA, 14 bp, Homo sapiens
caagtgttctaaaa

SEQ ID NO: 5294481 - DNA, 20 bp, Homo sapiens
caagtgttggtcagtagttt

SEQ ID NO: 5294482 - DNA, 19 bp, Homo sapiens
caagtgtttgaagtctgct

SEQ ID NO: 5294483 - DNA, 19 bp, Homo sapiens
caagtgttttggagaaaaa

SEQ ID NO: 5294484 - DNA, 20 bp, Homo sapiens
caagtgttttggagaaaaaa

SEQ ID NO: 5294485 - DNA, 14 bp, Homo sapiens
caagtgttttgtat

SEQ ID NO: 5294486 - DNA, 14 bp, Homo sapiens
caagttaaataaat

SEQ ID NO: 5294487 - DNA, 14 bp, Homo sapiens
caagttaaatgtag

SEQ ID NO: 5294488 - DNA, 18 bp, Homo sapiens
caagttaacaaggaatgc

SEQ ID NO: 5294489 - DNA, 19 bp, Homo sapiens
caagttaaccagttgcact

SEQ ID NO: 5294490 - DNA, 22 bp, Homo sapiens
caagttaatgtactttcattcc

SEQ ID NO: 5294491 - DNA, 22 bp, Homo sapiens
caagttagaaaattcagctcct

SEQ ID NO: 5294492 - DNA, 13 bp, Homo sapiens
attttgcaatgta

SEQ ID NO: 5294493 - DNA, 14 bp, Homo sapiens
attttgcaatgtat

SEQ ID NO: 5294494 - DNA, 11 bp, Homo sapiens
attttgcacaa

SEQ ID NO: 5294495 - DNA, 20 bp, Homo sapiens
attttgcacagacatctcct

SEQ ID NO: 5294496 - DNA, 22 bp, Homo sapiens
attttgcacctgcagccaagca

SEQ ID NO: 5294497 - DNA, 20 bp, Homo sapiens
attttgcacgaattttaaaa

SEQ ID NO: 5294498 - DNA, 14 bp, Homo sapiens
attttgcagaagga

SEQ ID NO: 5294499 - DNA, 17 bp, Homo sapiens
attttgcagaaggaaat

SEQ ID NO: 5294500 - DNA, 19 bp, Homo sapiens
attttgcagattattttag

SEQ ID NO: 5294501 - DNA, 18 bp, Homo sapiens
attttgcagctatggaca

SEQ ID NO: 5294502 - DNA, 19 bp, Homo sapiens
attttgcataataaatgct

SEQ ID NO: 5294503 - DNA, 23 bp, Homo sapiens
attttgcattgtgtgagcttcta

SEQ ID NO: 5294504 - DNA, 12 bp, Homo sapiens
attttgcatttc

SEQ ID NO: 5294505 - DNA, 15 bp, Homo sapiens
attttgccagactta

SEQ ID NO: 5294506 - DNA, 13 bp, Homo sapiens
attttgccctcct

SEQ ID NO: 5294507 - DNA, 15 bp, Homo sapiens
attttgccctcctgc

SEQ ID NO: 5294508 - DNA, 18 bp, Homo sapiens
attttgccctcctgccca

SEQ ID NO: 5294509 - DNA, 17 bp, Homo sapiens
attttgccgctgagata

SEQ ID NO: 5294510 - DNA, 21 bp, Homo sapiens
attttgcctcttttctctgtg

SEQ ID NO: 5294511 - DNA, 15 bp, Homo sapiens
attttgcgatgtgtt

SEQ ID NO: 5294512 - DNA, 21 bp, Homo sapiens
attttgctaactgggttaaat

SEQ ID NO: 5294513 - DNA, 22 bp, Homo sapiens
attttgctaactgggttaaata

SEQ ID NO: 5294514 - DNA, 15 bp, Homo sapiens
attttgctaactggt

SEQ ID NO: 5294515 - DNA, 16 bp, Homo sapiens
attttgctaactggtt

SEQ ID NO: 5294516 - DNA, 17 bp, Homo sapiens
attttgctaccaaagaa

SEQ ID NO: 5294517 - DNA, 21 bp, Homo sapiens
attttgctagacagttaaact

SEQ ID NO: 5294518 - DNA, 21 bp, Homo sapiens
attttgctattgtaaatatgt

SEQ ID NO: 5294519 - DNA, 16 bp, Homo sapiens
attttgctccctctgt

SEQ ID NO: 5294520 - DNA, 14 bp, Homo sapiens
attttgctggaata

SEQ ID NO: 5294521 - DNA, 20 bp, Homo sapiens
attttgctgtagaagatggc

SEQ ID NO: 5294522 - DNA, 23 bp, Homo sapiens
attttgcttcttggtcaagaaag

SEQ ID NO: 5294523 - DNA, 17 bp, Homo sapiens
attttgctttaattgct

SEQ ID NO: 5294524 - DNA, 12 bp, Homo sapiens
attttgctttat

SEQ ID NO: 5294525 - DNA, 22 bp, Homo sapiens
attttgctttatcagaagcaag

SEQ ID NO: 5294526 - DNA, 14 bp, Homo sapiens
attttgctttggtt

SEQ ID NO: 5294527 - DNA, 20 bp, Homo sapiens
attttgctttgtgatttttg

SEQ ID NO: 5294528 - DNA, 13 bp, Homo sapiens
attttggaaaaat

SEQ ID NO: 5294529 - DNA, 20 bp, Homo sapiens
attttggaaaaatgtcactg

SEQ ID NO: 5294530 - DNA, 15 bp, Homo sapiens
attttggaaaagaaa

SEQ ID NO: 5294531 - DNA, 19 bp, Homo sapiens
attttggaaaataaattat

SEQ ID NO: 5294532 - DNA, 12 bp, Homo sapiens
attttggaaact

SEQ ID NO: 5294533 - DNA, 20 bp, Homo sapiens
attttggaaactcaaggaaa

SEQ ID NO: 5294534 - DNA, 16 bp, Homo sapiens
attttggaaactgcta

SEQ ID NO: 5294535 - DNA, 23 bp, Homo sapiens
attttggaaagctcctagcagag

SEQ ID NO: 5294536 - DNA, 17 bp, Homo sapiens
attttggaactatgaag

SEQ ID NO: 5294537 - DNA, 20 bp, Homo sapiens
attttggaactatgaagact

SEQ ID NO: 5294538 - DNA, 14 bp, Homo sapiens
attttggaactgtg

SEQ ID NO: 5294539 - DNA, 16 bp, Homo sapiens
attttggaagaattca

SEQ ID NO: 5294540 - DNA, 21 bp, Homo sapiens
attttggaagaattcatgatg

SEQ ID NO: 5294541 - DNA, 20 bp, Homo sapiens
attttggaagattttcagtc

SEQ ID NO: 5294542 - DNA, 20 bp, Homo sapiens
attttggaatatttgcttta

SEQ ID NO: 5294543 - DNA, 12 bp, Homo sapiens
attttggaattt

SEQ ID NO: 5294544 - DNA, 18 bp, Homo sapiens
attttggacctaaacatt

SEQ ID NO: 5294545 - DNA, 19 bp, Homo sapiens
attttggactgagatttct

SEQ ID NO: 5294546 - DNA, 21 bp, Homo sapiens
attttggagaaattatttaat

SEQ ID NO: 5294547 - DNA, 22 bp, Homo sapiens
attttggagagtttcctgaaac

SEQ ID NO: 5294548 - DNA, 20 bp, Homo sapiens
attttggagattataataaa

SEQ ID NO: 5294549 - DNA, 19 bp, Homo sapiens
attttggataaatcatttc

SEQ ID NO: 5294550 - DNA, 22 bp, Homo sapiens
attttggataaatcatttcagt

SEQ ID NO: 5294551 - DNA, 19 bp, Homo sapiens
attttggatatattattgt

SEQ ID NO: 5294552 - DNA, 13 bp, Homo sapiens
attttggatgagc

SEQ ID NO: 5294553 - DNA, 15 bp, Homo sapiens
attttggatttcttt

SEQ ID NO: 5294554 - DNA, 16 bp, Homo sapiens
attttggatttcttta

SEQ ID NO: 5294555 - DNA, 20 bp, Homo sapiens
attttggatttttacacaac

SEQ ID NO: 5294556 - DNA, 23 bp, Homo sapiens
attttggcaagaagactgtattt

SEQ ID NO: 5294557 - DNA, 12 bp, Homo sapiens
attttggccact

SEQ ID NO: 5294558 - DNA, 21 bp, Homo sapiens
attttggcttcatttcaatca

SEQ ID NO: 5294559 - DNA, 15 bp, Homo sapiens
attttggctttctcc

SEQ ID NO: 5294560 - DNA, 16 bp, Homo sapiens
attttggctttctccc

SEQ ID NO: 5294561 - DNA, 21 bp, Homo sapiens
attttgggccttgctaaattg

SEQ ID NO: 5294562 - DNA, 20 bp, Homo sapiens
attttgggctggataaatat

SEQ ID NO: 5294563 - DNA, 22 bp, Homo sapiens
attttggggggcagagaataaa

SEQ ID NO: 5294564 - DNA, 22 bp, Homo sapiens
attttggggtacccactgctct

SEQ ID NO: 5294565 - DNA, 20 bp, Homo sapiens
attttggggttgtgttgtca

SEQ ID NO: 5294566 - DNA, 18 bp, Homo sapiens
attttgggttcaggcctg

SEQ ID NO: 5294567 - DNA, 13 bp, Homo sapiens
attttggtaatga

SEQ ID NO: 5294568 - DNA, 21 bp, Homo sapiens
attttggtgaatgtgggtagt

SEQ ID NO: 5294569 - DNA, 15 bp, Homo sapiens
attttggtgagaaat

SEQ ID NO: 5294570 - DNA, 17 bp, Homo sapiens
attttggtgtctttctc

SEQ ID NO: 5294571 - DNA, 13 bp, Homo sapiens
attttggtgtgca

SEQ ID NO: 5294572 - DNA, 22 bp, Homo sapiens
attttggttgaagacaccagac

SEQ ID NO: 5294573 - DNA, 20 bp, Homo sapiens
attttggttgctgatgttta

SEQ ID NO: 5294574 - DNA, 18 bp, Homo sapiens
attttggttgtaattaaa

SEQ ID NO: 5294575 - DNA, 16 bp, Homo sapiens
attttggttgtattct

SEQ ID NO: 5294576 - DNA, 19 bp, Homo sapiens
attttggttgtattctttg

SEQ ID NO: 5294577 - DNA, 22 bp, Homo sapiens
attttggtttattccctccagg

SEQ ID NO: 5294578 - DNA, 14 bp, Homo sapiens
attttggttttcta

SEQ ID NO: 5294579 - DNA, 16 bp, Homo sapiens
attttggttttctact

SEQ ID NO: 5294580 - DNA, 17 bp, Homo sapiens
attttggttttctactg

SEQ ID NO: 5294581 - DNA, 17 bp, Homo sapiens
attttggttttgttccc

SEQ ID NO: 5294582 - DNA, 21 bp, Homo sapiens
attttggttttgttcccctcc

SEQ ID NO: 5294583 - DNA, 22 bp, Homo sapiens
attttggttttgttcccctcct

SEQ ID NO: 5294584 - DNA, 22 bp, Homo sapiens
attttggtttttcaacactgaa

SEQ ID NO: 5294585 - DNA, 17 bp, Homo sapiens
attttggtttttcctca

SEQ ID NO: 5294586 - DNA, 13 bp, Homo sapiens
attttgtaaaaca

SEQ ID NO: 5294587 - DNA, 15 bp, Homo sapiens
attttgtaaaacaat

SEQ ID NO: 5294588 - DNA, 17 bp, Homo sapiens
attttgtaaaacaatgc

SEQ ID NO: 5294589 - DNA, 13 bp, Homo sapiens
attttgtaaaata

SEQ ID NO: 5294590 - DNA, 18 bp, Homo sapiens
attttgtaaaatgtatta

SEQ ID NO: 5294591 - DNA, 19 bp, Homo sapiens
attttgtaaactgatgttt

SEQ ID NO: 5294592 - DNA, 13 bp, Homo sapiens
attttgtaaaggt

SEQ ID NO: 5294593 - DNA, 16 bp, Homo sapiens
attttgtaaatctgta

SEQ ID NO: 5294594 - DNA, 21 bp, Homo sapiens
attttgtaaatctgtactttt

SEQ ID NO: 5294595 - DNA, 14 bp, Homo sapiens
attttgtaactgta

SEQ ID NO: 5294596 - DNA, 20 bp, Homo sapiens
attttgtaagtataagaaat

SEQ ID NO: 5294597 - DNA, 21 bp, Homo sapiens
attttgtaagtataagaaatt

SEQ ID NO: 5294598 - DNA, 13 bp, Homo sapiens
attttgtaataaa

SEQ ID NO: 5294599 - DNA, 16 bp, Homo sapiens
attttgtaataaactc

SEQ ID NO: 5294600 - DNA, 14 bp, Homo sapiens
attttgtaataata

SEQ ID NO: 5294601 - DNA, 19 bp, Homo sapiens
attttgtaataataaagaa

SEQ ID NO: 5294602 - DNA, 17 bp, Homo sapiens
attttgtaatattctgt

SEQ ID NO: 5294603 - DNA, 17 bp, Homo sapiens
attttgtaatatttgaa

SEQ ID NO: 5294604 - DNA, 14 bp, Homo sapiens
attttgtaattaac

SEQ ID NO: 5294605 - DNA, 16 bp, Homo sapiens
attttgtaattattgt

SEQ ID NO: 5294606 - DNA, 17 bp, Homo sapiens
attttgtaattcttatg

SEQ ID NO: 5294607 - DNA, 21 bp, Homo sapiens
attttgtaattcttatgacta

SEQ ID NO: 5294608 - DNA, 12 bp, Homo sapiens
attttgtaattt

SEQ ID NO: 5294609 - DNA, 18 bp, Homo sapiens
attttgtaattttcttga

SEQ ID NO: 5294610 - DNA, 20 bp, Homo sapiens
attttgtaattttcttgatg

SEQ ID NO: 5294611 - DNA, 10 bp, Homo sapiens
attttgtaca

SEQ ID NO: 5294612 - DNA, 17 bp, Homo sapiens
attttgtacagaatttt

SEQ ID NO: 5294613 - DNA, 23 bp, Homo sapiens
attttgtacagaatttttaatga

SEQ ID NO: 5294614 - DNA, 20 bp, Homo sapiens
attttgtacatgtatgaaat

SEQ ID NO: 5294615 - DNA, 14 bp, Homo sapiens
attttgtacatttt

SEQ ID NO: 5294616 - DNA, 20 bp, Homo sapiens
attttgtacatttttcagca

SEQ ID NO: 5294617 - DNA, 16 bp, Homo sapiens
attttgtagcctctct

SEQ ID NO: 5294618 - DNA, 17 bp, Homo sapiens
attttgtagcctctctt

SEQ ID NO: 5294619 - DNA, 12 bp, Homo sapiens
attttgtagcta

SEQ ID NO: 5294620 - DNA, 14 bp, Homo sapiens
attttgtagctagt

SEQ ID NO: 5294621 - DNA, 23 bp, Homo sapiens
attttgtagtagttgatgaccaa

SEQ ID NO: 5294622 - DNA, 17 bp, Homo sapiens
attttgtagttaatata

SEQ ID NO: 5294623 - DNA, 19 bp, Homo sapiens
attttgtagttaatataaa

SEQ ID NO: 5294624 - DNA, 18 bp, Homo sapiens
attttgtataacttttga

SEQ ID NO: 5294625 - DNA, 14 bp, Homo sapiens
attttgtataatca

SEQ ID NO: 5294626 - DNA, 20 bp, Homo sapiens
attttgtataattgtatcgt

SEQ ID NO: 5294627 - DNA, 17 bp, Homo sapiens
attttgtatattaactt

SEQ ID NO: 5294628 - DNA, 19 bp, Homo sapiens
attttgtatattatgttta

SEQ ID NO: 5294629 - DNA, 14 bp, Homo sapiens
attttgtatattgt

SEQ ID NO: 5294630 - DNA, 16 bp, Homo sapiens
attttgtatatttgta

SEQ ID NO: 5294631 - DNA, 21 bp, Homo sapiens
attttgtatcacctcttcaca

SEQ ID NO: 5294632 - DNA, 19 bp, Homo sapiens
attttgtatccccctgtag

SEQ ID NO: 5294633 - DNA, 23 bp, Homo sapiens
attttgtatctgcaggcagacac

SEQ ID NO: 5294634 - DNA, 16 bp, Homo sapiens
attttgtatcttgatg

SEQ ID NO: 5294635 - DNA, 14 bp, Homo sapiens
attttgtatgaaat

SEQ ID NO: 5294636 - DNA, 21 bp, Homo sapiens
attttgtatgaaatatatgtg

SEQ ID NO: 5294637 - DNA, 20 bp, Homo sapiens
attttgtatgcaagcagttt

SEQ ID NO: 5294638 - DNA, 18 bp, Homo sapiens
attttgtatgctgaattt

SEQ ID NO: 5294639 - DNA, 14 bp, Homo sapiens
attttgtatggagt

SEQ ID NO: 5294640 - DNA, 21 bp, Homo sapiens
attttgtatggagttaaataa

SEQ ID NO: 5294641 - DNA, 15 bp, Homo sapiens
attttgtatgtcaat

SEQ ID NO: 5294642 - DNA, 23 bp, Homo sapiens
attttgtatgtcaataactttat

SEQ ID NO: 5294643 - DNA, 19 bp, Homo sapiens
attttgtattacatctaat

SEQ ID NO: 5294644 - DNA, 17 bp, Homo sapiens
attttgtattattgctg

SEQ ID NO: 5294645 - DNA, 14 bp, Homo sapiens
attttgtattgtgg

SEQ ID NO: 5294646 - DNA, 17 bp, Homo sapiens
attttgtattgttaata

SEQ ID NO: 5294647 - DNA, 16 bp, Homo sapiens
attttgtattttcaac

SEQ ID NO: 5294648 - DNA, 18 bp, Homo sapiens
attttgtattttcaactt

SEQ ID NO: 5294649 - DNA, 15 bp, Homo sapiens
attttgtattttcca

SEQ ID NO: 5294650 - DNA, 20 bp, Homo sapiens
attttgtatttttgaataaa

SEQ ID NO: 5294651 - DNA, 13 bp, Homo sapiens
attttgtcactgc

SEQ ID NO: 5294652 - DNA, 22 bp, Homo sapiens
attttgtcactgctgtaaagca

SEQ ID NO: 5294653 - DNA, 15 bp, Homo sapiens
attttgtcactgtct

SEQ ID NO: 5294654 - DNA, 18 bp, Homo sapiens
attttgtcataaaatgct

SEQ ID NO: 5294655 - DNA, 21 bp, Homo sapiens
attttgtccaagttcacagta

SEQ ID NO: 5294656 - DNA, 18 bp, Homo sapiens
attttgtccatgtccccc

SEQ ID NO: 5294657 - DNA, 21 bp, Homo sapiens
attttgtcccatctctacccc

SEQ ID NO: 5294658 - DNA, 18 bp, Homo sapiens
attttgtcccattttccc

SEQ ID NO: 5294659 - DNA, 17 bp, Homo sapiens
attttgtcctaatatat

SEQ ID NO: 5294660 - DNA, 14 bp, Homo sapiens
attttgtcgaattt

SEQ ID NO: 5294661 - DNA, 13 bp, Homo sapiens
attttgtctaaaa

SEQ ID NO: 5294662 - DNA, 16 bp, Homo sapiens
attttgtctaaaatgc

SEQ ID NO: 5294663 - DNA, 20 bp, Homo sapiens
attttgtctaggagatgctt

SEQ ID NO: 5294664 - DNA, 14 bp, Homo sapiens
attttgtctcactt

SEQ ID NO: 5294665 - DNA, 21 bp, Homo sapiens
attttgtctcctacctgctgc

SEQ ID NO: 5294666 - DNA, 12 bp, Homo sapiens
attttgtctggc

SEQ ID NO: 5294667 - DNA, 15 bp, Homo sapiens
attttgtctggctgt

SEQ ID NO: 5294668 - DNA, 15 bp, Homo sapiens
attttgtcttaagtg

SEQ ID NO: 5294669 - DNA, 19 bp, Homo sapiens
attttgtcttaagtgtttc

SEQ ID NO: 5294670 - DNA, 23 bp, Homo sapiens
caagttagaaaattcagctcctt

SEQ ID NO: 5294671 - DNA, 16 bp, Homo sapiens
caagttagttcaatct

SEQ ID NO: 5294672 - DNA, 19 bp, Homo sapiens
caagttatataaagagaaa

SEQ ID NO: 5294673 - DNA, 21 bp, Homo sapiens
caagttatataaagagaaaat

SEQ ID NO: 5294674 - DNA, 20 bp, Homo sapiens
caagttatattagtgaagat

SEQ ID NO: 5294675 - DNA, 21 bp, Homo sapiens
caagttatattagtgaagatg

SEQ ID NO: 5294676 - DNA, 14 bp, Homo sapiens
caagttatattgaa

SEQ ID NO: 5294677 - DNA, 17 bp, Homo sapiens
caagttatctgtttcct

SEQ ID NO: 5294678 - DNA, 21 bp, Homo sapiens
caagttatctgtttcctgttc

SEQ ID NO: 5294679 - DNA, 16 bp, Homo sapiens
caagttatctttccct

SEQ ID NO: 5294680 - DNA, 20 bp, Homo sapiens
caagttattcaaatttgtac

SEQ ID NO: 5294681 - DNA, 14 bp, Homo sapiens
caagttattcagaa

SEQ ID NO: 5294682 - DNA, 17 bp, Homo sapiens
caagttattcagaaata

SEQ ID NO: 5294683 - DNA, 17 bp, Homo sapiens
caagttattttatttgc

SEQ ID NO: 5294684 - DNA, 18 bp, Homo sapiens
caagttattttatttgct

SEQ ID NO: 5294685 - DNA, 19 bp, Homo sapiens
caagttattttatttgctt

SEQ ID NO: 5294686 - DNA, 20 bp, Homo sapiens
caagttatttttaatttggt

SEQ ID NO: 5294687 - DNA, 22 bp, Homo sapiens
caagttcaaagaaccctagcac

SEQ ID NO: 5294688 - DNA, 21 bp, Homo sapiens
caagttcaagggctctttctc

SEQ ID NO: 5294689 - DNA, 17 bp, Homo sapiens
caagttcaatctgtttt

SEQ ID NO: 5294690 - DNA, 14 bp, Homo sapiens
caagttcagggaag

SEQ ID NO: 5294691 - DNA, 15 bp, Homo sapiens
caagttcagggaagc

SEQ ID NO: 5294692 - DNA, 19 bp, Homo sapiens
caagttcatctcatttgta

SEQ ID NO: 5294693 - DNA, 18 bp, Homo sapiens
caagttcattacctccct

SEQ ID NO: 5294694 - DNA, 16 bp, Homo sapiens
caagttcattcatact

SEQ ID NO: 5294695 - DNA, 13 bp, Homo sapiens
caagttcatttta

SEQ ID NO: 5294696 - DNA, 13 bp, Homo sapiens
caagttccagctg

SEQ ID NO: 5294697 - DNA, 17 bp, Homo sapiens
caagttccagctggtct

SEQ ID NO: 5294698 - DNA, 14 bp, Homo sapiens
caagttccagtgca

SEQ ID NO: 5294699 - DNA, 15 bp, Homo sapiens
caagttccagtgcag

SEQ ID NO: 5294700 - DNA, 15 bp, Homo sapiens
caagttcccaactga

SEQ ID NO: 5294701 - DNA, 19 bp, Homo sapiens
caagttccctcctgcagcc

SEQ ID NO: 5294702 - DNA, 23 bp, Homo sapiens
caagttccgtctcctctccagcc

SEQ ID NO: 5294703 - DNA, 15 bp, Homo sapiens
caagttctaagattc

SEQ ID NO: 5294704 - DNA, 17 bp, Homo sapiens
caagttctaagattcta

SEQ ID NO: 5294705 - DNA, 16 bp, Homo sapiens
caagttctagagaaga

SEQ ID NO: 5294706 - DNA, 14 bp, Homo sapiens
caagttcttcacct

SEQ ID NO: 5294707 - DNA, 15 bp, Homo sapiens
caagttcttcacctc

SEQ ID NO: 5294708 - DNA, 15 bp, Homo sapiens
caagttcttggacca

SEQ ID NO: 5294709 - DNA, 16 bp, Homo sapiens
caagttctttcccagc

SEQ ID NO: 5294710 - DNA, 23 bp, Homo sapiens
caagttgaaaaatagcatatgcc

SEQ ID NO: 5294711 - DNA, 13 bp, Homo sapiens
caagttgaagaag

SEQ ID NO: 5294712 - DNA, 19 bp, Homo sapiens
caagttgaagactttgttt

SEQ ID NO: 5294713 - DNA, 17 bp, Homo sapiens
caagttgagatttttaa

SEQ ID NO: 5294714 - DNA, 20 bp, Homo sapiens
caagttgagatttttaagaa

SEQ ID NO: 5294715 - DNA, 12 bp, Homo sapiens
caagttgcagtg

SEQ ID NO: 5294716 - DNA, 18 bp, Homo sapiens
caagttgcagtgagcagg

SEQ ID NO: 5294717 - DNA, 13 bp, Homo sapiens
caagttgctctga

SEQ ID NO: 5294718 - DNA, 23 bp, Homo sapiens
caagttgctctgacctcctctgg

SEQ ID NO: 5294719 - DNA, 13 bp, Homo sapiens
caagttgctctgt

SEQ ID NO: 5294720 - DNA, 16 bp, Homo sapiens
caagttgctgtcactg

SEQ ID NO: 5294721 - DNA, 20 bp, Homo sapiens
caagttgggttcacttgcca

SEQ ID NO: 5294722 - DNA, 20 bp, Homo sapiens
caagttggtcttactttgtt

SEQ ID NO: 5294723 - DNA, 21 bp, Homo sapiens
caagttggtcttactttgtta

SEQ ID NO: 5294724 - DNA, 14 bp, Homo sapiens
caagttgtaaaaat

SEQ ID NO: 5294725 - DNA, 18 bp, Homo sapiens
caagttgtgcttttctgt

SEQ ID NO: 5294726 - DNA, 21 bp, Homo sapiens
caagttgtggtgctgacaaag

SEQ ID NO: 5294727 - DNA, 13 bp, Homo sapiens
caagttgttaaaa

SEQ ID NO: 5294728 - DNA, 22 bp, Homo sapiens
caagttgttccttaagtcagaa

SEQ ID NO: 5294729 - DNA, 12 bp, Homo sapiens
caagttgtttat

SEQ ID NO: 5294730 - DNA, 16 bp, Homo sapiens
caagttgtttcattga

SEQ ID NO: 5294731 - DNA, 17 bp, Homo sapiens
caagttgtttgagaaat

SEQ ID NO: 5294732 - DNA, 15 bp, Homo sapiens
caagtttaaagtcat

SEQ ID NO: 5294733 - DNA, 16 bp, Homo sapiens
caagtttaaagtcatg

SEQ ID NO: 5294734 - DNA, 13 bp, Homo sapiens
caagtttacactt

SEQ ID NO: 5294735 - DNA, 16 bp, Homo sapiens
caagtttacacttcat

SEQ ID NO: 5294736 - DNA, 13 bp, Homo sapiens
caagtttacatga

SEQ ID NO: 5294737 - DNA, 20 bp, Homo sapiens
caagtttactcaaccctctc

SEQ ID NO: 5294738 - DNA, 17 bp, Homo sapiens
caagtttacttgtcttt

SEQ ID NO: 5294739 - DNA, 16 bp, Homo sapiens
caagtttataaaacat

SEQ ID NO: 5294740 - DNA, 18 bp, Homo sapiens
caagtttataagcccaaa

SEQ ID NO: 5294741 - DNA, 23 bp, Homo sapiens
caagtttataagcccaaatggct

SEQ ID NO: 5294742 - DNA, 14 bp, Homo sapiens
caagtttatatata

SEQ ID NO: 5294743 - DNA, 20 bp, Homo sapiens
caagtttatcagtaaataac

SEQ ID NO: 5294744 - DNA, 14 bp, Homo sapiens
caagtttatttctc

SEQ ID NO: 5294745 - DNA, 19 bp, Homo sapiens
caagtttcagtaatagctg

SEQ ID NO: 5294746 - DNA, 13 bp, Homo sapiens
caagtttcatcca

SEQ ID NO: 5294747 - DNA, 16 bp, Homo sapiens
caagtttcatccagaa

SEQ ID NO: 5294748 - DNA, 22 bp, Homo sapiens
caagtttccaagcaaatgttac

SEQ ID NO: 5294749 - DNA, 17 bp, Homo sapiens
caagtttctgtttcaaa

SEQ ID NO: 5294750 - DNA, 12 bp, Homo sapiens
caagtttgaaca

SEQ ID NO: 5294751 - DNA, 20 bp, Homo sapiens
caagtttgctaaaagaagag

SEQ ID NO: 5294752 - DNA, 22 bp, Homo sapiens
caagtttgctgcaacccaagtg

SEQ ID NO: 5294753 - DNA, 17 bp, Homo sapiens
caagtttgtatcaggtg

SEQ ID NO: 5294754 - DNA, 13 bp, Homo sapiens
caagttttaaagt

SEQ ID NO: 5294755 - DNA, 15 bp, Homo sapiens
caagttttaaagttc

SEQ ID NO: 5294756 - DNA, 15 bp, Homo sapiens
caagttttagttaaa

SEQ ID NO: 5294757 - DNA, 20 bp, Homo sapiens
caagttttcataagcacact

SEQ ID NO: 5294758 - DNA, 14 bp, Homo sapiens
caagttttgtgaaa

SEQ ID NO: 5294759 - DNA, 13 bp, Homo sapiens
caagttttgtgta

SEQ ID NO: 5294760 - DNA, 19 bp, Homo sapiens
caagtttttacaaaatact

SEQ ID NO: 5294761 - DNA, 22 bp, Homo sapiens
caagtttttatagttattaaat

SEQ ID NO: 5294762 - DNA, 15 bp, Homo sapiens
caagtttttcagaaa

SEQ ID NO: 5294763 - DNA, 18 bp, Homo sapiens
caagtttttcagaaagtt

SEQ ID NO: 5294764 - DNA, 12 bp, Homo sapiens
caagtttttcat

SEQ ID NO: 5294765 - DNA, 13 bp, Homo sapiens
caagtttttcata

SEQ ID NO: 5294766 - DNA, 20 bp, Homo sapiens
caagtttttcatactgtaca

SEQ ID NO: 5294767 - DNA, 15 bp, Homo sapiens
caagtttttctctca

SEQ ID NO: 5294768 - DNA, 16 bp, Homo sapiens
caataaaaaaaagaaa

SEQ ID NO: 5294769 - DNA, 19 bp, Homo sapiens
caataaaaaaaagaaatga

SEQ ID NO: 5294770 - DNA, 21 bp, Homo sapiens
caataaaaaaaagaaatgaaa

SEQ ID NO: 5294771 - DNA, 19 bp, Homo sapiens
caataaaaacaactttcac

SEQ ID NO: 5294772 - DNA, 18 bp, Homo sapiens
caataaaaacattttgaa

SEQ ID NO: 5294773 - DNA, 20 bp, Homo sapiens
caataaaaacattttgaagt

SEQ ID NO: 5294774 - DNA, 15 bp, Homo sapiens
caataaaaataaatc

SEQ ID NO: 5294775 - DNA, 19 bp, Homo sapiens
caataaaaatcaggagcct

SEQ ID NO: 5294776 - DNA, 21 bp, Homo sapiens
caataaaaatcaggagcctgc

SEQ ID NO: 5294777 - DNA, 22 bp, Homo sapiens
caataaaaatcaggagcctgct

SEQ ID NO: 5294778 - DNA, 16 bp, Homo sapiens
caataaaaatggctca

SEQ ID NO: 5294779 - DNA, 17 bp, Homo sapiens
caataaaaatgtttaac

SEQ ID NO: 5294780 - DNA, 15 bp, Homo sapiens
caataaaacattaat

SEQ ID NO: 5294781 - DNA, 12 bp, Homo sapiens
caataaaaccaa

SEQ ID NO: 5294782 - DNA, 14 bp, Homo sapiens
caataaaaccaagc

SEQ ID NO: 5294783 - DNA, 22 bp, Homo sapiens
caataaaaccaagcctctggaa

SEQ ID NO: 5294784 - DNA, 20 bp, Homo sapiens
caataaaactcccttcctta

SEQ ID NO: 5294785 - DNA, 13 bp, Homo sapiens
caataaaactgct

SEQ ID NO: 5294786 - DNA, 14 bp, Homo sapiens
caataaaactgcta

SEQ ID NO: 5294787 - DNA, 15 bp, Homo sapiens
caataaaagagctgt

SEQ ID NO: 5294788 - DNA, 17 bp, Homo sapiens
caataaaagagctgtct

SEQ ID NO: 5294789 - DNA, 14 bp, Homo sapiens
caataaaagagctt

SEQ ID NO: 5294790 - DNA, 17 bp, Homo sapiens
caataaaagagctttat

SEQ ID NO: 5294791 - DNA, 21 bp, Homo sapiens
caataaaagccagatgctaga

SEQ ID NO: 5294792 - DNA, 18 bp, Homo sapiens
caataaaagtgactctca

SEQ ID NO: 5294793 - DNA, 18 bp, Homo sapiens
caataaaagttgatcata

SEQ ID NO: 5294794 - DNA, 13 bp, Homo sapiens
caataaaataaca

SEQ ID NO: 5294795 - DNA, 13 bp, Homo sapiens
caataaaatagca

SEQ ID NO: 5294796 - DNA, 21 bp, Homo sapiens
caataaaatagtattgaaagt

SEQ ID NO: 5294797 - DNA, 15 bp, Homo sapiens
caataaaatgcactg

SEQ ID NO: 5294798 - DNA, 21 bp, Homo sapiens
caataaaatgtgatttttctg

SEQ ID NO: 5294799 - DNA, 20 bp, Homo sapiens
caataaaattatagctctaa

SEQ ID NO: 5294800 - DNA, 23 bp, Homo sapiens
caataaaattatagctctaatgt

SEQ ID NO: 5294801 - DNA, 17 bp, Homo sapiens
caataaaattatttgca

SEQ ID NO: 5294802 - DNA, 22 bp, Homo sapiens
caataaaattatttgcaggtct

SEQ ID NO: 5294803 - DNA, 15 bp, Homo sapiens
caataaaattctgta

SEQ ID NO: 5294804 - DNA, 16 bp, Homo sapiens
caataaaattctgtaa

SEQ ID NO: 5294805 - DNA, 20 bp, Homo sapiens
caataaaatttaaaaaataa

SEQ ID NO: 5294806 - DNA, 19 bp, Homo sapiens
caataaacaggaattttat

SEQ ID NO: 5294807 - DNA, 22 bp, Homo sapiens
caataaacaggaattttatttt

SEQ ID NO: 5294808 - DNA, 10 bp, Homo sapiens
caataaacca

SEQ ID NO: 5294809 - DNA, 19 bp, Homo sapiens
caataaaccaaacccagcc

SEQ ID NO: 5294810 - DNA, 16 bp, Homo sapiens
caataaaccaatgaac

SEQ ID NO: 5294811 - DNA, 20 bp, Homo sapiens
caataaaccacaagcatctc

SEQ ID NO: 5294812 - DNA, 23 bp, Homo sapiens
caataaaccaggtttagacagta

SEQ ID NO: 5294813 - DNA, 13 bp, Homo sapiens
caataaaccagtg

SEQ ID NO: 5294814 - DNA, 19 bp, Homo sapiens
caataaaccctcagagcct

SEQ ID NO: 5294815 - DNA, 18 bp, Homo sapiens
caataaacgaaacacaga

SEQ ID NO: 5294816 - DNA, 18 bp, Homo sapiens
caataaacgatttaattc

SEQ ID NO: 5294817 - DNA, 21 bp, Homo sapiens
caataaacgctgacttgcaga

SEQ ID NO: 5294818 - DNA, 16 bp, Homo sapiens
caataaactcagtcaa

SEQ ID NO: 5294819 - DNA, 13 bp, Homo sapiens
caataaactgaat

SEQ ID NO: 5294820 - DNA, 18 bp, Homo sapiens
caataaacttagaggaaa

SEQ ID NO: 5294821 - DNA, 20 bp, Homo sapiens
caataaacttgtaggacttt

SEQ ID NO: 5294822 - DNA, 17 bp, Homo sapiens
caataaacttgtgcctc

SEQ ID NO: 5294823 - DNA, 11 bp, Homo sapiens
caataaagaaa

SEQ ID NO: 5294824 - DNA, 17 bp, Homo sapiens
caataaagaaaaaaata

SEQ ID NO: 5294825 - DNA, 19 bp, Homo sapiens
caataaagaaaaaaatagt

SEQ ID NO: 5294826 - DNA, 20 bp, Homo sapiens
caataaagaaagaaatatta

SEQ ID NO: 5294827 - DNA, 13 bp, Homo sapiens
caataaagaagag

SEQ ID NO: 5294828 - DNA, 11 bp, Homo sapiens
caataaagaat

SEQ ID NO: 5294829 - DNA, 12 bp, Homo sapiens
caataaagaatt

SEQ ID NO: 5294830 - DNA, 12 bp, Homo sapiens
caataaagagct

SEQ ID NO: 5294831 - DNA, 16 bp, Homo sapiens
caataaagagtaaata

SEQ ID NO: 5294832 - DNA, 16 bp, Homo sapiens
caataaagatacatga

SEQ ID NO: 5294833 - DNA, 18 bp, Homo sapiens
caataaagatacatgatt

SEQ ID NO: 5294834 - DNA, 19 bp, Homo sapiens
caataaagatatttccaag

SEQ ID NO: 5294835 - DNA, 14 bp, Homo sapiens
caataaagattttt

SEQ ID NO: 5294836 - DNA, 21 bp, Homo sapiens
caataaagcacgcagttatgt

SEQ ID NO: 5294837 - DNA, 14 bp, Homo sapiens
caataaagcactat

SEQ ID NO: 5294838 - DNA, 14 bp, Homo sapiens
caataaagcagagc

SEQ ID NO: 5294839 - DNA, 17 bp, Homo sapiens
caataaagcagagccaa

SEQ ID NO: 5294840 - DNA, 23 bp, Homo sapiens
caataaagcagcctcattctgag

SEQ ID NO: 5294841 - DNA, 13 bp, Homo sapiens
caataaagcagtc

SEQ ID NO: 5294842 - DNA, 23 bp, Homo sapiens
caataaagcagttaatttatata

SEQ ID NO: 5294843 - DNA, 13 bp, Homo sapiens
caataaagcattt

SEQ ID NO: 5294844 - DNA, 23 bp, Homo sapiens
caataaagctgctgagaatctag

SEQ ID NO: 5294845 - DNA, 14 bp, Homo sapiens
caataaagctggac

SEQ ID NO: 5294846 - DNA, 18 bp, Homo sapiens
caataaagcttttggaag

SEQ ID NO: 5294847 - DNA, 22 bp, Homo sapiens
caataaaggagaagagatcatt

SEQ ID NO: 5294848 - DNA, 13 bp, Homo sapiens
caataaaggagga

SEQ ID NO: 5294849 - DNA, 18 bp, Homo sapiens
caataaaggaggaatcag

SEQ ID NO: 5294850 - DNA, 21 bp, Homo sapiens
caataaaggaggaatcagacc

SEQ ID NO: 5294851 - DNA, 12 bp, Homo sapiens
caataaaggcag

SEQ ID NO: 5294852 - DNA, 15 bp, Homo sapiens
caataaaggcagctg

SEQ ID NO: 5294853 - DNA, 21 bp, Homo sapiens
caataaaggcagctgcctctg

SEQ ID NO: 5294854 - DNA, 24 bp, Homo sapiens
caataaaggcagctgcctctgctc

SEQ ID NO: 5294855 - DNA, 19 bp, Homo sapiens
caataaagggagaatggtg

SEQ ID NO: 5294856 - DNA, 21 bp, Homo sapiens
caataaagggagaatggtgct

SEQ ID NO: 5294857 - DNA, 13 bp, Homo sapiens
caataaaggtcat

SEQ ID NO: 5294858 - DNA, 17 bp, Homo sapiens
caataaagtactgcaaa

SEQ ID NO: 5294859 - DNA, 11 bp, Homo sapiens
caataaagtat

SEQ ID NO: 5294860 - DNA, 13 bp, Homo sapiens
caataaagtattt

SEQ ID NO: 5294861 - DNA, 22 bp, Homo sapiens
caataaagtatttaattagtgc

SEQ ID NO: 5294862 - DNA, 17 bp, Homo sapiens
caataaagtcctcttcc

SEQ ID NO: 5294863 - DNA, 14 bp, Homo sapiens
caataaagtgatct

SEQ ID NO: 5294864 - DNA, 19 bp, Homo sapiens
caataaagtgatctgtgtt

SEQ ID NO: 5294865 - DNA, 22 bp, Homo sapiens
caataaagtgatctgtgttcaa

SEQ ID NO: 5294866 - DNA, 17 bp, Homo sapiens
caataaagtgccttctg

SEQ ID NO: 5294867 - DNA, 18 bp, Homo sapiens
caataaagtgccttctgg

SEQ ID NO: 5294868 - DNA, 22 bp, Homo sapiens
caataaagtgccttctgggctt

SEQ ID NO: 5294869 - DNA, 12 bp, Homo sapiens
caataaagtgta

SEQ ID NO: 5294870 - DNA, 18 bp, Homo sapiens
caataaagttgttgcatt

SEQ ID NO: 5294871 - DNA, 15 bp, Homo sapiens
caataaagtttacaa

SEQ ID NO: 5294872 - DNA, 13 bp, Homo sapiens
caataaagtttga

SEQ ID NO: 5294873 - DNA, 23 bp, Homo sapiens
caataaagtttgatcttcctctg

SEQ ID NO: 5294874 - DNA, 17 bp, Homo sapiens
caataaagtttgctttc

SEQ ID NO: 5294875 - DNA, 14 bp, Homo sapiens
caataaataaatgt

SEQ ID NO: 5294876 - DNA, 15 bp, Homo sapiens
caataaataaatgtt

SEQ ID NO: 5294877 - DNA, 17 bp, Homo sapiens
caataaataaatgtttt

SEQ ID NO: 5294878 - DNA, 12 bp, Homo sapiens
caataaataaca

SEQ ID NO: 5294879 - DNA, 15 bp, Homo sapiens
caataaataacactt

SEQ ID NO: 5294880 - DNA, 13 bp, Homo sapiens
caataaataatat

SEQ ID NO: 5294881 - DNA, 16 bp, Homo sapiens
caataaataatattat

SEQ ID NO: 5294882 - DNA, 23 bp, Homo sapiens
caataaataatattatattgtat

SEQ ID NO: 5294883 - DNA, 16 bp, Homo sapiens
caataaatagaccatt

SEQ ID NO: 5294884 - DNA, 14 bp, Homo sapiens
caataaatatactt

SEQ ID NO: 5294885 - DNA, 17 bp, Homo sapiens
caataaatatacttctg

SEQ ID NO: 5294886 - DNA, 13 bp, Homo sapiens
caataaatattat

SEQ ID NO: 5294887 - DNA, 14 bp, Homo sapiens
caataaatatttgt

SEQ ID NO: 5294888 - DNA, 20 bp, Homo sapiens
caataaatctgacccagtgc

SEQ ID NO: 5294889 - DNA, 15 bp, Homo sapiens
caataaatctttcaa

SEQ ID NO: 5294890 - DNA, 17 bp, Homo sapiens
caataaatgacacccag

SEQ ID NO: 5294891 - DNA, 13 bp, Homo sapiens
caataaatgctga

SEQ ID NO: 5294892 - DNA, 16 bp, Homo sapiens
caataaatgctgaatg

SEQ ID NO: 5294893 - DNA, 21 bp, Homo sapiens
caataaatggccagtgctgct

SEQ ID NO: 5294894 - DNA, 18 bp, Homo sapiens
caataaatgtattcaaat

SEQ ID NO: 5294895 - DNA, 19 bp, Homo sapiens
caataaatgtgtgttgact

SEQ ID NO: 5294896 - DNA, 15 bp, Homo sapiens
caataaatgttgaaa

SEQ ID NO: 5294897 - DNA, 22 bp, Homo sapiens
caataaatgtttgttatttaca

SEQ ID NO: 5294898 - DNA, 17 bp, Homo sapiens
caataaattattagaga

SEQ ID NO: 5294899 - DNA, 13 bp, Homo sapiens
caataaattgcta

SEQ ID NO: 5294900 - DNA, 20 bp, Homo sapiens
caataaatttgtaactttgc

SEQ ID NO: 5294901 - DNA, 15 bp, Homo sapiens
caataaattttgaaa

SEQ ID NO: 5294902 - DNA, 17 bp, Homo sapiens
caataaattttgaaaag

SEQ ID NO: 5294903 - DNA, 22 bp, Homo sapiens
caataaattttgaaaagtaata

SEQ ID NO: 5294904 - DNA, 13 bp, Homo sapiens
caataacaacaat

SEQ ID NO: 5294905 - DNA, 15 bp, Homo sapiens
caataacaacaatgg

SEQ ID NO: 5294906 - DNA, 13 bp, Homo sapiens
caataacaagcat

SEQ ID NO: 5294907 - DNA, 15 bp, Homo sapiens
caataacacacagct

SEQ ID NO: 5294908 - DNA, 15 bp, Homo sapiens
caataacactatatt

SEQ ID NO: 5294909 - DNA, 17 bp, Homo sapiens
caataacactatattta

SEQ ID NO: 5294910 - DNA, 20 bp, Homo sapiens
caataacactatatttattt

SEQ ID NO: 5294911 - DNA, 22 bp, Homo sapiens
caataacactgtattttaatgt

SEQ ID NO: 5294912 - DNA, 15 bp, Homo sapiens
caataacagctgcaa

SEQ ID NO: 5294913 - DNA, 13 bp, Homo sapiens
caataacagtttt

SEQ ID NO: 5294914 - DNA, 17 bp, Homo sapiens
caataacagttttaaga

SEQ ID NO: 5294915 - DNA, 16 bp, Homo sapiens
caataacccagttact

SEQ ID NO: 5294916 - DNA, 18 bp, Homo sapiens
caataacccagttacttt

SEQ ID NO: 5294917 - DNA, 21 bp, Homo sapiens
caataaccgcttggtttgcaa

SEQ ID NO: 5294918 - DNA, 23 bp, Homo sapiens
caataacgtttaagccaaaacaa

SEQ ID NO: 5294919 - DNA, 14 bp, Homo sapiens
caataactactgtg

SEQ ID NO: 5294920 - DNA, 18 bp, Homo sapiens
caataactactgtgttcc

SEQ ID NO: 5294921 - DNA, 19 bp, Homo sapiens
caataactactgtgttcct

SEQ ID NO: 5294922 - DNA, 14 bp, Homo sapiens
caataactagtgat

SEQ ID NO: 5294923 - DNA, 15 bp, Homo sapiens
caataactccaagca

SEQ ID NO: 5294924 - DNA, 18 bp, Homo sapiens
caataactctgattttga

SEQ ID NO: 5294925 - DNA, 19 bp, Homo sapiens
caataactctgattttgat

SEQ ID NO: 5294926 - DNA, 21 bp, Homo sapiens
caataactctgattttgatat

SEQ ID NO: 5294927 - DNA, 12 bp, Homo sapiens
caataactctgg

SEQ ID NO: 5294928 - DNA, 14 bp, Homo sapiens
caataactgaaaat

SEQ ID NO: 5294929 - DNA, 18 bp, Homo sapiens
caataactggaacactct

SEQ ID NO: 5294930 - DNA, 21 bp, Homo sapiens
caataacttcagagaagtcag

SEQ ID NO: 5294931 - DNA, 20 bp, Homo sapiens
caataacttctatattttaa

SEQ ID NO: 5294932 - DNA, 16 bp, Homo sapiens
caataacttctatgtt

SEQ ID NO: 5294933 - DNA, 19 bp, Homo sapiens
caataactttatatgaagt

SEQ ID NO: 5294934 - DNA, 14 bp, Homo sapiens
caataacttttcac

SEQ ID NO: 5294935 - DNA, 21 bp, Homo sapiens
caataagaaaatgtaaaggtt

SEQ ID NO: 5294936 - DNA, 13 bp, Homo sapiens
caataagaaacag

SEQ ID NO: 5294937 - DNA, 23 bp, Homo sapiens
caataagaaacagtttaacagaa

SEQ ID NO: 5294938 - DNA, 15 bp, Homo sapiens
caataagaaatgaac

SEQ ID NO: 5294939 - DNA, 21 bp, Homo sapiens
caataagaacaagttttggca

SEQ ID NO: 5294940 - DNA, 21 bp, Homo sapiens
caataagagtctccttctctt

SEQ ID NO: 5294941 - DNA, 12 bp, Homo sapiens
caataagcaaaa

SEQ ID NO: 5294942 - DNA, 19 bp, Homo sapiens
caataagctcctaaattat

SEQ ID NO: 5294943 - DNA, 19 bp, Homo sapiens
caataagctggactagtgt

SEQ ID NO: 5294944 - DNA, 15 bp, Homo sapiens
caataaggatttatt

SEQ ID NO: 5294945 - DNA, 16 bp, Homo sapiens
caataaggatttattc

SEQ ID NO: 5294946 - DNA, 19 bp, Homo sapiens
caataaggatttattctca

SEQ ID NO: 5294947 - DNA, 16 bp, Homo sapiens
caataagtaaatccac

SEQ ID NO: 5294948 - DNA, 19 bp, Homo sapiens
caataagtgttgtaccata

SEQ ID NO: 5294949 - DNA, 19 bp, Homo sapiens
caataagttacttgaaata

SEQ ID NO: 5294950 - DNA, 13 bp, Homo sapiens
caataagttcatt

SEQ ID NO: 5294951 - DNA, 18 bp, Homo sapiens
caataagttcattaaaca

SEQ ID NO: 5294952 - DNA, 20 bp, Homo sapiens
caataagttcattaaacaga

SEQ ID NO: 5294953 - DNA, 22 bp, Homo sapiens
caataagttcattaaacagaag

SEQ ID NO: 5294954 - DNA, 16 bp, Homo sapiens
caataataaaaaacaa

SEQ ID NO: 5294955 - DNA, 20 bp, Homo sapiens
caataataaaaaacaagaaa

SEQ ID NO: 5294956 - DNA, 14 bp, Homo sapiens
caataataaagaca

SEQ ID NO: 5294957 - DNA, 13 bp, Homo sapiens
caataataaagta

SEQ ID NO: 5294958 - DNA, 19 bp, Homo sapiens
caataataaatatttttgc

SEQ ID NO: 5294959 - DNA, 13 bp, Homo sapiens
caataataaatgt

SEQ ID NO: 5294960 - DNA, 15 bp, Homo sapiens
caataataaatgtta

SEQ ID NO: 5294961 - DNA, 15 bp, Homo sapiens
caataataagtccat

SEQ ID NO: 5294962 - DNA, 22 bp, Homo sapiens
caataataagtccatctgtcac

SEQ ID NO: 5294963 - DNA, 21 bp, Homo sapiens
caataataagtgatgtgctga

SEQ ID NO: 5294964 - DNA, 15 bp, Homo sapiens
caataataataaatt

SEQ ID NO: 5294965 - DNA, 18 bp, Homo sapiens
caataataataaattaaa

SEQ ID NO: 5294966 - DNA, 18 bp, Homo sapiens
caataataatacctccct

SEQ ID NO: 5294967 - DNA, 14 bp, Homo sapiens
caataatatatttt

SEQ ID NO: 5294968 - DNA, 22 bp, Homo sapiens
caataatattgttgtataattt

SEQ ID NO: 5294969 - DNA, 20 bp, Homo sapiens
caataatatttcaagtgcct

SEQ ID NO: 5294970 - DNA, 18 bp, Homo sapiens
caataatcagaaaagtaa

SEQ ID NO: 5294971 - DNA, 19 bp, Homo sapiens
caataatgatcaaagtttt

SEQ ID NO: 5294972 - DNA, 20 bp, Homo sapiens
caataatgcagtatggtaca

SEQ ID NO: 5294973 - DNA, 17 bp, Homo sapiens
caataatggtcccatcc

SEQ ID NO: 5294974 - DNA, 18 bp, Homo sapiens
caataatgtaatttagtc

SEQ ID NO: 5294975 - DNA, 17 bp, Homo sapiens
caataattaatgtgtgt

SEQ ID NO: 5294976 - DNA, 21 bp, Homo sapiens
caataattatttgtctcagat

SEQ ID NO: 5294977 - DNA, 19 bp, Homo sapiens
caataattcatattcttca

SEQ ID NO: 5294978 - DNA, 13 bp, Homo sapiens
caataattcatca

SEQ ID NO: 5294979 - DNA, 15 bp, Homo sapiens
caataattcatcaag

SEQ ID NO: 5294980 - DNA, 17 bp, Homo sapiens
caataattgtggagagg

SEQ ID NO: 5294981 - DNA, 19 bp, Homo sapiens
caataattgtggagaggag

SEQ ID NO: 5294982 - DNA, 15 bp, Homo sapiens
caataatttgtacaa

SEQ ID NO: 5294983 - DNA, 20 bp, Homo sapiens
caataatttgtggtgatttg

SEQ ID NO: 5294984 - DNA, 13 bp, Homo sapiens
caataattttcta

SEQ ID NO: 5294985 - DNA, 12 bp, Homo sapiens
caatacaaaatg

SEQ ID NO: 5294986 - DNA, 14 bp, Homo sapiens
caatacaaaatgta

SEQ ID NO: 5294987 - DNA, 18 bp, Homo sapiens
caatacaaaggttccatt

SEQ ID NO: 5294988 - DNA, 15 bp, Homo sapiens
caatacaaatggatt

SEQ ID NO: 5294989 - DNA, 23 bp, Homo sapiens
caatacaaattgaggacttaatt

SEQ ID NO: 5294990 - DNA, 14 bp, Homo sapiens
caatacaacaagaa

SEQ ID NO: 5294991 - DNA, 18 bp, Homo sapiens
caatacaacaagaacaac

SEQ ID NO: 5294992 - DNA, 14 bp, Homo sapiens
caatacaactttac

SEQ ID NO: 5294993 - DNA, 20 bp, Homo sapiens
caatacaactttaccataaa

SEQ ID NO: 5294994 - DNA, 21 bp, Homo sapiens
caatacaagtttcatccagaa

SEQ ID NO: 5294995 - DNA, 16 bp, Homo sapiens
caatacaatgtacaat

SEQ ID NO: 5294996 - DNA, 17 bp, Homo sapiens
caatacaatgtacaatt

SEQ ID NO: 5294997 - DNA, 18 bp, Homo sapiens
caatacaatgtacaatta

SEQ ID NO: 5294998 - DNA, 19 bp, Homo sapiens
caatacaatgtacaattat

SEQ ID NO: 5294999 - DNA, 23 bp, Homo sapiens
caatacactcaagtgccattcat

SEQ ID NO: 5295000 - DNA, 18 bp, Homo sapiens
caatacagataacattag

SEQ ID NO: 5295001 - DNA, 13 bp, Homo sapiens
caatacagatata

SEQ ID NO: 5295002 - DNA, 16 bp, Homo sapiens
caatacagatatattt

SEQ ID NO: 5295003 - DNA, 17 bp, Homo sapiens
caatacagtacaggcag

SEQ ID NO: 5295004 - DNA, 19 bp, Homo sapiens
caatacagtacaggcagca

SEQ ID NO: 5295005 - DNA, 13 bp, Homo sapiens
caatacagtattt

SEQ ID NO: 5295006 - DNA, 20 bp, Homo sapiens
caatacatatatctacacat

SEQ ID NO: 5295007 - DNA, 22 bp, Homo sapiens
caatacatatatctacacatac

SEQ ID NO: 5295008 - DNA, 15 bp, Homo sapiens
caatacatgagaaag

SEQ ID NO: 5295009 - DNA, 16 bp, Homo sapiens
caatacattaaaataa

SEQ ID NO: 5295010 - DNA, 13 bp, Homo sapiens
caatacattgttc

SEQ ID NO: 5295011 - DNA, 20 bp, Homo sapiens
caatacatttacagcaatct

SEQ ID NO: 5295012 - DNA, 12 bp, Homo sapiens
caatacatttgt

SEQ ID NO: 5295013 - DNA, 20 bp, Homo sapiens
caataccagcaggaggttct

SEQ ID NO: 5295014 - DNA, 23 bp, Homo sapiens
caatacccaaatcctctccagct

SEQ ID NO: 5295015 - DNA, 22 bp, Homo sapiens
caatacccctagtatctggctg

SEQ ID NO: 5295016 - DNA, 17 bp, Homo sapiens
caataccctactgtggg

SEQ ID NO: 5295017 - DNA, 16 bp, Homo sapiens
caataccctgtcttta

SEQ ID NO: 5295018 - DNA, 23 bp, Homo sapiens
caatacccttggcactgatgggc

SEQ ID NO: 5295019 - DNA, 22 bp, Homo sapiens
caatacccttttaagtttaaaa

SEQ ID NO: 5295020 - DNA, 19 bp, Homo sapiens
caataccgctcagtatttt

SEQ ID NO: 5295021 - DNA, 21 bp, Homo sapiens
caatacctacaataaactggt

SEQ ID NO: 5295022 - DNA, 17 bp, Homo sapiens
caatacctgaatgctct

SEQ ID NO: 5295023 - DNA, 15 bp, Homo sapiens
caatacctggcctca

SEQ ID NO: 5295024 - DNA, 22 bp, Homo sapiens
caataccttcaaggctcttctt

SEQ ID NO: 5295025 - DNA, 19 bp, Homo sapiens
caatacggaacactgtcaa

SEQ ID NO: 5295026 - DNA, 22 bp, Homo sapiens
caatacgggagtgacccagcta

SEQ ID NO: 5295027 - DNA, 21 bp, Homo sapiens
caatacgtttgataatagttt

SEQ ID NO: 5295028 - DNA, 20 bp, Homo sapiens
caatacgtttgtgcagaatc

SEQ ID NO: 5295029 - DNA, 20 bp, Homo sapiens
attttgtcttaagtgtttct

SEQ ID NO: 5295030 - DNA, 23 bp, Homo sapiens
attttgtcttaagtgtttctcaa

SEQ ID NO: 5295031 - DNA, 17 bp, Homo sapiens
attttgtcttattctta

SEQ ID NO: 5295032 - DNA, 19 bp, Homo sapiens
attttgtcttattcttaag

SEQ ID NO: 5295033 - DNA, 22 bp, Homo sapiens
attttgtctttttgtttgggat

SEQ ID NO: 5295034 - DNA, 19 bp, Homo sapiens
attttgtgaaagaaggagc

SEQ ID NO: 5295035 - DNA, 14 bp, Homo sapiens
attttgtgaaattt

SEQ ID NO: 5295036 - DNA, 18 bp, Homo sapiens
attttgtgaaatttcatg

SEQ ID NO: 5295037 - DNA, 22 bp, Homo sapiens
attttgtgaaatttcatgaaaa

SEQ ID NO: 5295038 - DNA, 21 bp, Homo sapiens
attttgtgaagactgggaagt

SEQ ID NO: 5295039 - DNA, 12 bp, Homo sapiens
attttgtgaatg

SEQ ID NO: 5295040 - DNA, 15 bp, Homo sapiens
attttgtgaatggat

SEQ ID NO: 5295041 - DNA, 18 bp, Homo sapiens
attttgtgagtttgtttc

SEQ ID NO: 5295042 - DNA, 16 bp, Homo sapiens
attttgtgatgatgct

SEQ ID NO: 5295043 - DNA, 17 bp, Homo sapiens
attttgtgatgcaaata

SEQ ID NO: 5295044 - DNA, 21 bp, Homo sapiens
attttgtgcaaaaaggactgg

SEQ ID NO: 5295045 - DNA, 12 bp, Homo sapiens
attttgtgcagt

SEQ ID NO: 5295046 - DNA, 15 bp, Homo sapiens
attttgtgcattctt

SEQ ID NO: 5295047 - DNA, 19 bp, Homo sapiens
attttgtgcccccatgtaa

SEQ ID NO: 5295048 - DNA, 13 bp, Homo sapiens
attttgtgctctt

SEQ ID NO: 5295049 - DNA, 19 bp, Homo sapiens
attttgtgctctttcctgc

SEQ ID NO: 5295050 - DNA, 21 bp, Homo sapiens
attttgtggaggcagtgtcat

SEQ ID NO: 5295051 - DNA, 16 bp, Homo sapiens
attttgtggcttcaat

SEQ ID NO: 5295052 - DNA, 19 bp, Homo sapiens
attttgtgggctggttgct

SEQ ID NO: 5295053 - DNA, 23 bp, Homo sapiens
attttgtgggctggttgctgtag

SEQ ID NO: 5295054 - DNA, 21 bp, Homo sapiens
attttgtggttctattttact

SEQ ID NO: 5295055 - DNA, 23 bp, Homo sapiens
attttgtggttttcgagattatc

SEQ ID NO: 5295056 - DNA, 18 bp, Homo sapiens
attttgtgtaagaaatac

SEQ ID NO: 5295057 - DNA, 22 bp, Homo sapiens
attttgtgtataatgtgcttta

SEQ ID NO: 5295058 - DNA, 23 bp, Homo sapiens
attttgtgtataatgtgctttat

SEQ ID NO: 5295059 - DNA, 13 bp, Homo sapiens
attttgtgtgacc

SEQ ID NO: 5295060 - DNA, 22 bp, Homo sapiens
attttgtgtgaccaactgtgtt

SEQ ID NO: 5295061 - DNA, 23 bp, Homo sapiens
attttgtgtgaccaactgtgttg

SEQ ID NO: 5295062 - DNA, 16 bp, Homo sapiens
attttgtgtgagactt

SEQ ID NO: 5295063 - DNA, 22 bp, Homo sapiens
attttgtgtgagacttaaaaca

SEQ ID NO: 5295064 - DNA, 13 bp, Homo sapiens
attttgtgttgct

SEQ ID NO: 5295065 - DNA, 17 bp, Homo sapiens
attttgtgttgctaaaa

SEQ ID NO: 5295066 - DNA, 18 bp, Homo sapiens
attttgtgttgctaaaaa

SEQ ID NO: 5295067 - DNA, 18 bp, Homo sapiens
attttgtgttgtacaatt

SEQ ID NO: 5295068 - DNA, 15 bp, Homo sapiens
attttgttaaaatct

SEQ ID NO: 5295069 - DNA, 20 bp, Homo sapiens
attttgttaaaatctacttt

SEQ ID NO: 5295070 - DNA, 14 bp, Homo sapiens
attttgttaacttt

SEQ ID NO: 5295071 - DNA, 17 bp, Homo sapiens
attttgttaacttttgt

SEQ ID NO: 5295072 - DNA, 22 bp, Homo sapiens
attttgttaccttttacagaat

SEQ ID NO: 5295073 - DNA, 12 bp, Homo sapiens
attttgttactg

SEQ ID NO: 5295074 - DNA, 15 bp, Homo sapiens
attttgttactgatt

SEQ ID NO: 5295075 - DNA, 15 bp, Homo sapiens
attttgttactgtct

SEQ ID NO: 5295076 - DNA, 18 bp, Homo sapiens
attttgttactgtctgta

SEQ ID NO: 5295077 - DNA, 15 bp, Homo sapiens
attttgttagatttt

SEQ ID NO: 5295078 - DNA, 18 bp, Homo sapiens
attttgttatagttcata

SEQ ID NO: 5295079 - DNA, 12 bp, Homo sapiens
attttgttatgt

SEQ ID NO: 5295080 - DNA, 16 bp, Homo sapiens
attttgttcatacata

SEQ ID NO: 5295081 - DNA, 14 bp, Homo sapiens
attttgttcttaca

SEQ ID NO: 5295082 - DNA, 17 bp, Homo sapiens
attttgttcttacacat

SEQ ID NO: 5295083 - DNA, 17 bp, Homo sapiens
attttgttctttaagga

SEQ ID NO: 5295084 - DNA, 13 bp, Homo sapiens
attttgttgcctt

SEQ ID NO: 5295085 - DNA, 19 bp, Homo sapiens
attttgttgctgttttgat

SEQ ID NO: 5295086 - DNA, 23 bp, Homo sapiens
attttgttgctgttttgatttgt

SEQ ID NO: 5295087 - DNA, 15 bp, Homo sapiens
attttgttggcatag

SEQ ID NO: 5295088 - DNA, 17 bp, Homo sapiens
attttgttgtaaaaaga

SEQ ID NO: 5295089 - DNA, 15 bp, Homo sapiens
attttgttgtgattt

SEQ ID NO: 5295090 - DNA, 22 bp, Homo sapiens
attttgttgtgattttgtacag

SEQ ID NO: 5295091 - DNA, 14 bp, Homo sapiens
attttgttgttcct

SEQ ID NO: 5295092 - DNA, 11 bp, Homo sapiens
attttgtttac

SEQ ID NO: 5295093 - DNA, 17 bp, Homo sapiens
attttgtttcactcttt

SEQ ID NO: 5295094 - DNA, 21 bp, Homo sapiens
attttgtttcagaattttgta

SEQ ID NO: 5295095 - DNA, 14 bp, Homo sapiens
attttgtttccaaa

SEQ ID NO: 5295096 - DNA, 17 bp, Homo sapiens
attttgtttctgtatat

SEQ ID NO: 5295097 - DNA, 17 bp, Homo sapiens
attttgtttggtattgt

SEQ ID NO: 5295098 - DNA, 18 bp, Homo sapiens
attttgtttggtattgta

SEQ ID NO: 5295099 - DNA, 19 bp, Homo sapiens
attttgtttggtattgtat

SEQ ID NO: 5295100 - DNA, 13 bp, Homo sapiens
attttgttttaat

SEQ ID NO: 5295101 - DNA, 15 bp, Homo sapiens
attttgttttaatct

SEQ ID NO: 5295102 - DNA, 18 bp, Homo sapiens
attttgttttaatctact

SEQ ID NO: 5295103 - DNA, 21 bp, Homo sapiens
attttgttttaatctactttt

SEQ ID NO: 5295104 - DNA, 18 bp, Homo sapiens
attttgttttgctttttc

SEQ ID NO: 5295105 - DNA, 23 bp, Homo sapiens
attttgttttgctttttctgact

SEQ ID NO: 5295106 - DNA, 18 bp, Homo sapiens
attttgtttttactgtat

SEQ ID NO: 5295107 - DNA, 21 bp, Homo sapiens
attttgtttttgtcttaaaaa

SEQ ID NO: 5295108 - DNA, 16 bp, Homo sapiens
atttttaaaaaacaat

SEQ ID NO: 5295109 - DNA, 16 bp, Homo sapiens
atttttaaaaaatgaa

SEQ ID NO: 5295110 - DNA, 17 bp, Homo sapiens
atttttaaaaagaaatc

SEQ ID NO: 5295111 - DNA, 23 bp, Homo sapiens
atttttaaaaagatttatctgga

SEQ ID NO: 5295112 - DNA, 17 bp, Homo sapiens
atttttaaaacaaacca

SEQ ID NO: 5295113 - DNA, 16 bp, Homo sapiens
atttttaaaacccatt

SEQ ID NO: 5295114 - DNA, 17 bp, Homo sapiens
atttttaaaacccattt

SEQ ID NO: 5295115 - DNA, 18 bp, Homo sapiens
atttttaaaactcagatt

SEQ ID NO: 5295116 - DNA, 13 bp, Homo sapiens
atttttaaaactg

SEQ ID NO: 5295117 - DNA, 20 bp, Homo sapiens
atttttaaaactgcattttt

SEQ ID NO: 5295118 - DNA, 23 bp, Homo sapiens
atttttaaaagaaaaaaaccaaa

SEQ ID NO: 5295119 - DNA, 15 bp, Homo sapiens
atttttaaaagactt

SEQ ID NO: 5295120 - DNA, 16 bp, Homo sapiens
atttttaaaagacttt

SEQ ID NO: 5295121 - DNA, 13 bp, Homo sapiens
atttttaaaagat

SEQ ID NO: 5295122 - DNA, 16 bp, Homo sapiens
atttttaaaagtatac

SEQ ID NO: 5295123 - DNA, 21 bp, Homo sapiens
atttttaaaagtatacatgtc

SEQ ID NO: 5295124 - DNA, 14 bp, Homo sapiens
atttttaaaagttg

SEQ ID NO: 5295125 - DNA, 18 bp, Homo sapiens
atttttaaaataaaaata

SEQ ID NO: 5295126 - DNA, 22 bp, Homo sapiens
atttttaaaatatttaactttt

SEQ ID NO: 5295127 - DNA, 15 bp, Homo sapiens
atttttaaaatgtca

SEQ ID NO: 5295128 - DNA, 19 bp, Homo sapiens
atttttaaaattttaatat

SEQ ID NO: 5295129 - DNA, 13 bp, Homo sapiens
atttttaaacaag

SEQ ID NO: 5295130 - DNA, 14 bp, Homo sapiens
atttttaaacaagt

SEQ ID NO: 5295131 - DNA, 13 bp, Homo sapiens
atttttaaacttg

SEQ ID NO: 5295132 - DNA, 12 bp, Homo sapiens
atttttaaagaa

SEQ ID NO: 5295133 - DNA, 13 bp, Homo sapiens
atttttaaagaat

SEQ ID NO: 5295134 - DNA, 14 bp, Homo sapiens
atttttaaagcaaa

SEQ ID NO: 5295135 - DNA, 13 bp, Homo sapiens
atttttaaagcct

SEQ ID NO: 5295136 - DNA, 16 bp, Homo sapiens
atttttaaagtacttt

SEQ ID NO: 5295137 - DNA, 22 bp, Homo sapiens
atttttaaagtttaaataccag

SEQ ID NO: 5295138 - DNA, 14 bp, Homo sapiens
atttttaaagtttt

SEQ ID NO: 5295139 - DNA, 16 bp, Homo sapiens
atttttaaagttttgt

SEQ ID NO: 5295140 - DNA, 19 bp, Homo sapiens
atttttaaatgcagttaca

SEQ ID NO: 5295141 - DNA, 19 bp, Homo sapiens
atttttaaatgtaaaacat

SEQ ID NO: 5295142 - DNA, 19 bp, Homo sapiens
atttttaaattcttactct

SEQ ID NO: 5295143 - DNA, 18 bp, Homo sapiens
atttttaacacttaaatt

SEQ ID NO: 5295144 - DNA, 20 bp, Homo sapiens
atttttaacacttaaatttc

SEQ ID NO: 5295145 - DNA, 20 bp, Homo sapiens
atttttaacctcaaaatggt

SEQ ID NO: 5295146 - DNA, 22 bp, Homo sapiens
atttttaactctggattttgaa

SEQ ID NO: 5295147 - DNA, 22 bp, Homo sapiens
atttttaactttttatttctaa

SEQ ID NO: 5295148 - DNA, 23 bp, Homo sapiens
atttttaactttttatttctaaa

SEQ ID NO: 5295149 - DNA, 20 bp, Homo sapiens
atttttaagaaaaattcaca

SEQ ID NO: 5295150 - DNA, 18 bp, Homo sapiens
atttttaagaaagtaatt

SEQ ID NO: 5295151 - DNA, 12 bp, Homo sapiens
atttttaagagc

SEQ ID NO: 5295152 - DNA, 19 bp, Homo sapiens
atttttaagataataatat

SEQ ID NO: 5295153 - DNA, 15 bp, Homo sapiens
atttttaagatgcat

SEQ ID NO: 5295154 - DNA, 19 bp, Homo sapiens
atttttaagatgcatgtct

SEQ ID NO: 5295155 - DNA, 14 bp, Homo sapiens
atttttaagcaaat

SEQ ID NO: 5295156 - DNA, 15 bp, Homo sapiens
atttttaagctccat

SEQ ID NO: 5295157 - DNA, 22 bp, Homo sapiens
atttttaagctccatgtgcata

SEQ ID NO: 5295158 - DNA, 12 bp, Homo sapiens
atttttaagctg

SEQ ID NO: 5295159 - DNA, 18 bp, Homo sapiens
atttttaaggtctaatca

SEQ ID NO: 5295160 - DNA, 19 bp, Homo sapiens
atttttaagtaatttcatg

SEQ ID NO: 5295161 - DNA, 17 bp, Homo sapiens
atttttaagtacaaaaa

SEQ ID NO: 5295162 - DNA, 23 bp, Homo sapiens
atttttaagtcaacactatatat

SEQ ID NO: 5295163 - DNA, 18 bp, Homo sapiens
atttttaagtgctgcatt

SEQ ID NO: 5295164 - DNA, 19 bp, Homo sapiens
atttttaagtgctgcattt

SEQ ID NO: 5295165 - DNA, 18 bp, Homo sapiens
atttttaatatatactat

SEQ ID NO: 5295166 - DNA, 11 bp, Homo sapiens
atttttaatgc

SEQ ID NO: 5295167 - DNA, 19 bp, Homo sapiens
atttttaatggaaagtttg

SEQ ID NO: 5295168 - DNA, 20 bp, Homo sapiens
atttttaatggaaagtttgt

SEQ ID NO: 5295169 - DNA, 15 bp, Homo sapiens
atttttaatgggggt

SEQ ID NO: 5295170 - DNA, 16 bp, Homo sapiens
atttttaatgtatcta

SEQ ID NO: 5295171 - DNA, 20 bp, Homo sapiens
atttttaatgtatctatttg

SEQ ID NO: 5295172 - DNA, 16 bp, Homo sapiens
atttttacaaaactgc

SEQ ID NO: 5295173 - DNA, 18 bp, Homo sapiens
atttttacaaaactgcca

SEQ ID NO: 5295174 - DNA, 14 bp, Homo sapiens
atttttacaataaa

SEQ ID NO: 5295175 - DNA, 14 bp, Homo sapiens
atttttacaataat

SEQ ID NO: 5295176 - DNA, 19 bp, Homo sapiens
atttttacaatgtaattat

SEQ ID NO: 5295177 - DNA, 22 bp, Homo sapiens
atttttacagaattgcttgttt

SEQ ID NO: 5295178 - DNA, 18 bp, Homo sapiens
atttttacagctacttta

SEQ ID NO: 5295179 - DNA, 17 bp, Homo sapiens
atttttacatctaaact

SEQ ID NO: 5295180 - DNA, 19 bp, Homo sapiens
atttttacatggagaaaac

SEQ ID NO: 5295181 - DNA, 17 bp, Homo sapiens
atttttacattctgaat

SEQ ID NO: 5295182 - DNA, 21 bp, Homo sapiens
atttttacatttaaacctttt

SEQ ID NO: 5295183 - DNA, 19 bp, Homo sapiens
atttttaccaactctatac

SEQ ID NO: 5295184 - DNA, 14 bp, Homo sapiens
atttttacctaatc

SEQ ID NO: 5295185 - DNA, 17 bp, Homo sapiens
atttttacctgtttaaa

SEQ ID NO: 5295186 - DNA, 21 bp, Homo sapiens
atttttacgtttgaagacatt

SEQ ID NO: 5295187 - DNA, 15 bp, Homo sapiens
atttttactaaagca

SEQ ID NO: 5295188 - DNA, 16 bp, Homo sapiens
atttttactaaagcag

SEQ ID NO: 5295189 - DNA, 21 bp, Homo sapiens
atttttactatcacacatgaa

SEQ ID NO: 5295190 - DNA, 15 bp, Homo sapiens
atttttactcaggct

SEQ ID NO: 5295191 - DNA, 23 bp, Homo sapiens
atttttactcaggctttctattg

SEQ ID NO: 5295192 - DNA, 14 bp, Homo sapiens
atttttactgcttt

SEQ ID NO: 5295193 - DNA, 18 bp, Homo sapiens
atttttactgctttctga

SEQ ID NO: 5295194 - DNA, 19 bp, Homo sapiens
atttttactgctttctgaa

SEQ ID NO: 5295195 - DNA, 20 bp, Homo sapiens
atttttactgctttctgaat

SEQ ID NO: 5295196 - DNA, 15 bp, Homo sapiens
atttttactggggat

SEQ ID NO: 5295197 - DNA, 19 bp, Homo sapiens
atttttagaataagaattt

SEQ ID NO: 5295198 - DNA, 21 bp, Homo sapiens
atttttagaataagaatttgc

SEQ ID NO: 5295199 - DNA, 22 bp, Homo sapiens
atttttagaataagaatttgca

SEQ ID NO: 5295200 - DNA, 24 bp, Homo sapiens
atttttagaataagaatttgcata

SEQ ID NO: 5295201 - DNA, 14 bp, Homo sapiens
atttttagacagag

SEQ ID NO: 5295202 - DNA, 13 bp, Homo sapiens
atttttagagatt

SEQ ID NO: 5295203 - DNA, 16 bp, Homo sapiens
atttttagagattaat

SEQ ID NO: 5295204 - DNA, 20 bp, Homo sapiens
atttttagagattaatttgt

SEQ ID NO: 5295205 - DNA, 15 bp, Homo sapiens
atttttagagcatta

SEQ ID NO: 5295206 - DNA, 16 bp, Homo sapiens
atttttagagcattaa

SEQ ID NO: 5295207 - DNA, 22 bp, Homo sapiens
caatacgtttgtgcagaatctc

SEQ ID NO: 5295208 - DNA, 14 bp, Homo sapiens
caatactaagtgac

SEQ ID NO: 5295209 - DNA, 16 bp, Homo sapiens
caatactaagtgacag

SEQ ID NO: 5295210 - DNA, 13 bp, Homo sapiens
caatactacctct

SEQ ID NO: 5295211 - DNA, 23 bp, Homo sapiens
caatactacctctgaatgttaca

SEQ ID NO: 5295212 - DNA, 14 bp, Homo sapiens
caatactactgtaa

SEQ ID NO: 5295213 - DNA, 22 bp, Homo sapiens
caatactattatattatgtagt

SEQ ID NO: 5295214 - DNA, 17 bp, Homo sapiens
caatactcataatgtga

SEQ ID NO: 5295215 - DNA, 18 bp, Homo sapiens
caatactccctttaaaga

SEQ ID NO: 5295216 - DNA, 15 bp, Homo sapiens
caatactctcctaaa

SEQ ID NO: 5295217 - DNA, 19 bp, Homo sapiens
caatactcttaaattttat

SEQ ID NO: 5295218 - DNA, 18 bp, Homo sapiens
caatactcttgaaatgta

SEQ ID NO: 5295219 - DNA, 15 bp, Homo sapiens
caatactgagtgcct

SEQ ID NO: 5295220 - DNA, 18 bp, Homo sapiens
caatactgccgctgcccc

SEQ ID NO: 5295221 - DNA, 23 bp, Homo sapiens
caatactgccgctgcccccaccc

SEQ ID NO: 5295222 - DNA, 16 bp, Homo sapiens
caatactgccttaatg

SEQ ID NO: 5295223 - DNA, 23 bp, Homo sapiens
caatactgccttaatgagaacat

SEQ ID NO: 5295224 - DNA, 11 bp, Homo sapiens
caatactgctt

SEQ ID NO: 5295225 - DNA, 20 bp, Homo sapiens
caatactgtatcagatgtga

SEQ ID NO: 5295226 - DNA, 18 bp, Homo sapiens
caatactgtatgccttct

SEQ ID NO: 5295227 - DNA, 21 bp, Homo sapiens
caatactgtatgccttctgta

SEQ ID NO: 5295228 - DNA, 19 bp, Homo sapiens
caatacttggagggcccag

SEQ ID NO: 5295229 - DNA, 18 bp, Homo sapiens
caatactttgtgtctttt

SEQ ID NO: 5295230 - DNA, 21 bp, Homo sapiens
caatacttttgtgtattctgt

SEQ ID NO: 5295231 - DNA, 11 bp, Homo sapiens
caatagaaagc

SEQ ID NO: 5295232 - DNA, 15 bp, Homo sapiens
caatagaaagcaaac

SEQ ID NO: 5295233 - DNA, 15 bp, Homo sapiens
caatagaacatgcaa

SEQ ID NO: 5295234 - DNA, 23 bp, Homo sapiens
caatagaaggatgtacatttcca

SEQ ID NO: 5295235 - DNA, 15 bp, Homo sapiens
caatagagactgtag

SEQ ID NO: 5295236 - DNA, 21 bp, Homo sapiens
caatagatttaggagcagaaa

SEQ ID NO: 5295237 - DNA, 20 bp, Homo sapiens
caatagcacccctactcaca

SEQ ID NO: 5295238 - DNA, 20 bp, Homo sapiens
caatagcactttcattgcca

SEQ ID NO: 5295239 - DNA, 21 bp, Homo sapiens
caatagcactttcattgccag

SEQ ID NO: 5295240 - DNA, 23 bp, Homo sapiens
caatagcatttctagaacaatta

SEQ ID NO: 5295241 - DNA, 18 bp, Homo sapiens
caatagccactaaccttg

SEQ ID NO: 5295242 - DNA, 14 bp, Homo sapiens
caatagccccatct

SEQ ID NO: 5295243 - DNA, 23 bp, Homo sapiens
caatagccgatatcagaatttgt

SEQ ID NO: 5295244 - DNA, 17 bp, Homo sapiens
caatagcctgaatttga

SEQ ID NO: 5295245 - DNA, 16 bp, Homo sapiens
caatagcgtgtgtaga

SEQ ID NO: 5295246 - DNA, 16 bp, Homo sapiens
caatagctattgcatg

SEQ ID NO: 5295247 - DNA, 19 bp, Homo sapiens
caatagctattgcatgtaa

SEQ ID NO: 5295248 - DNA, 22 bp, Homo sapiens
caatagctattgcatgtaaaat

SEQ ID NO: 5295249 - DNA, 17 bp, Homo sapiens
caatagctccaagctgt

SEQ ID NO: 5295250 - DNA, 20 bp, Homo sapiens
caatagctccaagctgttaa

SEQ ID NO: 5295251 - DNA, 22 bp, Homo sapiens
caatagctccaagctgttaaag

SEQ ID NO: 5295252 - DNA, 23 bp, Homo sapiens
caatagctctactgccctcccct

SEQ ID NO: 5295253 - DNA, 12 bp, Homo sapiens
caataggaaaaa

SEQ ID NO: 5295254 - DNA, 16 bp, Homo sapiens
caataggaaaaactga

SEQ ID NO: 5295255 - DNA, 20 bp, Homo sapiens
caataggaaaaactgatttt

SEQ ID NO: 5295256 - DNA, 23 bp, Homo sapiens
caatagggtagaatgattaatca

SEQ ID NO: 5295257 - DNA, 18 bp, Homo sapiens
caataggtagctggggag

SEQ ID NO: 5295258 - DNA, 15 bp, Homo sapiens
caataggtgcaaaaa

SEQ ID NO: 5295259 - DNA, 15 bp, Homo sapiens
caatagtaactcttt

SEQ ID NO: 5295260 - DNA, 18 bp, Homo sapiens
caatagtaattctcaggc

SEQ ID NO: 5295261 - DNA, 17 bp, Homo sapiens
caatagtatacatttta

SEQ ID NO: 5295262 - DNA, 20 bp, Homo sapiens
caatagtatacattttataa

SEQ ID NO: 5295263 - DNA, 13 bp, Homo sapiens
caatagtatttct

SEQ ID NO: 5295264 - DNA, 17 bp, Homo sapiens
caatagtcatatgtgaa

SEQ ID NO: 5295265 - DNA, 13 bp, Homo sapiens
caatagtgcaaca

SEQ ID NO: 5295266 - DNA, 18 bp, Homo sapiens
caatagtggcataccaaa

SEQ ID NO: 5295267 - DNA, 20 bp, Homo sapiens
caatagtgtcctatgcaata

SEQ ID NO: 5295268 - DNA, 14 bp, Homo sapiens
caatagtgtgttct

SEQ ID NO: 5295269 - DNA, 15 bp, Homo sapiens
caatagtgtgttctg

SEQ ID NO: 5295270 - DNA, 17 bp, Homo sapiens
caatagtgtgttctgat

SEQ ID NO: 5295271 - DNA, 23 bp, Homo sapiens
caatagtgtgttctgattagaaa

SEQ ID NO: 5295272 - DNA, 22 bp, Homo sapiens
caatagtgttgaggaggggagc

SEQ ID NO: 5295273 - DNA, 16 bp, Homo sapiens
caatagttaagtcaat

SEQ ID NO: 5295274 - DNA, 16 bp, Homo sapiens
caatagttcttaaaat

SEQ ID NO: 5295275 - DNA, 19 bp, Homo sapiens
caatagttcttaaaattag

SEQ ID NO: 5295276 - DNA, 23 bp, Homo sapiens
caatagttgctgtccccttccag

SEQ ID NO: 5295277 - DNA, 21 bp, Homo sapiens
caatagttttttacttctctt

SEQ ID NO: 5295278 - DNA, 23 bp, Homo sapiens
caatataaaaggcaaatgtgtac

SEQ ID NO: 5295279 - DNA, 12 bp, Homo sapiens
caatataaagtt

SEQ ID NO: 5295280 - DNA, 18 bp, Homo sapiens
caatataacattctattg

SEQ ID NO: 5295281 - DNA, 20 bp, Homo sapiens
caatataaccaatgtttaaa

SEQ ID NO: 5295282 - DNA, 19 bp, Homo sapiens
caatataactgagttatat

SEQ ID NO: 5295283 - DNA, 15 bp, Homo sapiens
caatataagaaggaa

SEQ ID NO: 5295284 - DNA, 16 bp, Homo sapiens
caatataagcttttct

SEQ ID NO: 5295285 - DNA, 15 bp, Homo sapiens
caatataatgttttt

SEQ ID NO: 5295286 - DNA, 21 bp, Homo sapiens
caatataatgtttttaatatt

SEQ ID NO: 5295287 - DNA, 22 bp, Homo sapiens
caatataccatgacatgaagaa

SEQ ID NO: 5295288 - DNA, 22 bp, Homo sapiens
caatatagaaaaataaaaatct

SEQ ID NO: 5295289 - DNA, 13 bp, Homo sapiens
caatatagcaaga

SEQ ID NO: 5295290 - DNA, 22 bp, Homo sapiens
caatatagttttctaactcctg

SEQ ID NO: 5295291 - DNA, 18 bp, Homo sapiens
caatatataaaaatatat

SEQ ID NO: 5295292 - DNA, 21 bp, Homo sapiens
caatatataagactattccaa

SEQ ID NO: 5295293 - DNA, 19 bp, Homo sapiens
caatatataataaatggga

SEQ ID NO: 5295294 - DNA, 23 bp, Homo sapiens
caatatatatttctttaaacctt

SEQ ID NO: 5295295 - DNA, 18 bp, Homo sapiens
caatatatgatatataaa

SEQ ID NO: 5295296 - DNA, 20 bp, Homo sapiens
caatatatgtattttttgaa

SEQ ID NO: 5295297 - DNA, 16 bp, Homo sapiens
caatatattaccagca

SEQ ID NO: 5295298 - DNA, 14 bp, Homo sapiens
caatatattgaact

SEQ ID NO: 5295299 - DNA, 15 bp, Homo sapiens
caatatattgaactt

SEQ ID NO: 5295300 - DNA, 15 bp, Homo sapiens
caatatatttgtagg

SEQ ID NO: 5295301 - DNA, 23 bp, Homo sapiens
caatatatttgtaggtatactat

SEQ ID NO: 5295302 - DNA, 18 bp, Homo sapiens
caatatattttgaaatat

SEQ ID NO: 5295303 - DNA, 17 bp, Homo sapiens
caatatatttttactgc

SEQ ID NO: 5295304 - DNA, 18 bp, Homo sapiens
caatatcagctttgataa

SEQ ID NO: 5295305 - DNA, 21 bp, Homo sapiens
caatatcatgtcttgtgcata

SEQ ID NO: 5295306 - DNA, 14 bp, Homo sapiens
caatatcatgtgat

SEQ ID NO: 5295307 - DNA, 16 bp, Homo sapiens
caatatcatgtgtaga

SEQ ID NO: 5295308 - DNA, 23 bp, Homo sapiens
caatatcatgtgtagatattatg

SEQ ID NO: 5295309 - DNA, 20 bp, Homo sapiens
caatatcattactaacttct

SEQ ID NO: 5295310 - DNA, 18 bp, Homo sapiens
caatatcccaacattctg

SEQ ID NO: 5295311 - DNA, 19 bp, Homo sapiens
caatatcccaacattctgc

SEQ ID NO: 5295312 - DNA, 18 bp, Homo sapiens
caatatccctcttgtaag

SEQ ID NO: 5295313 - DNA, 16 bp, Homo sapiens
caatatcctaataaaa

SEQ ID NO: 5295314 - DNA, 12 bp, Homo sapiens
caatatcctttg

SEQ ID NO: 5295315 - DNA, 18 bp, Homo sapiens
caatatcgtacctgtccc

SEQ ID NO: 5295316 - DNA, 13 bp, Homo sapiens
caatatctgaagc

SEQ ID NO: 5295317 - DNA, 14 bp, Homo sapiens
caatatctgcagcg

SEQ ID NO: 5295318 - DNA, 22 bp, Homo sapiens
caatatcttgcttgaacttaca

SEQ ID NO: 5295319 - DNA, 21 bp, Homo sapiens
caatatcttttttttaataaa

SEQ ID NO: 5295320 - DNA, 16 bp, Homo sapiens
caatatgaatctataa

SEQ ID NO: 5295321 - DNA, 19 bp, Homo sapiens
caatatgaatctataagta

SEQ ID NO: 5295322 - DNA, 20 bp, Homo sapiens
caatatgaggggactgcatg

SEQ ID NO: 5295323 - DNA, 21 bp, Homo sapiens
caatatgaggggactgcatgc

SEQ ID NO: 5295324 - DNA, 22 bp, Homo sapiens
caatatgagtaatgtttaagat

SEQ ID NO: 5295325 - DNA, 11 bp, Homo sapiens
caatatgcaag

SEQ ID NO: 5295326 - DNA, 16 bp, Homo sapiens
caatatggatttctta

SEQ ID NO: 5295327 - DNA, 14 bp, Homo sapiens
caatatgggaggaa

SEQ ID NO: 5295328 - DNA, 17 bp, Homo sapiens
caatatggtggccctgg

SEQ ID NO: 5295329 - DNA, 19 bp, Homo sapiens
caatatggtggccctgggg

SEQ ID NO: 5295330 - DNA, 20 bp, Homo sapiens
caatatggtggccctgggga

SEQ ID NO: 5295331 - DNA, 21 bp, Homo sapiens
caatatggtggccctggggaa

SEQ ID NO: 5295332 - DNA, 23 bp, Homo sapiens
caatatggtgtcttgatatattt

SEQ ID NO: 5295333 - DNA, 21 bp, Homo sapiens
caatatgtaaatagtgcagaa

SEQ ID NO: 5295334 - DNA, 13 bp, Homo sapiens
caatatgtagcct

SEQ ID NO: 5295335 - DNA, 15 bp, Homo sapiens
caatatgtattgtaa

SEQ ID NO: 5295336 - DNA, 22 bp, Homo sapiens
caatatgtattgtaaacatgtg

SEQ ID NO: 5295337 - DNA, 23 bp, Homo sapiens
caatatgtattgtaaacatgtgt

SEQ ID NO: 5295338 - DNA, 16 bp, Homo sapiens
caatatgtgagtgcct

SEQ ID NO: 5295339 - DNA, 17 bp, Homo sapiens
caatatgtgagtgcctt

SEQ ID NO: 5295340 - DNA, 20 bp, Homo sapiens
caatatgtgagtgccttttg

SEQ ID NO: 5295341 - DNA, 19 bp, Homo sapiens
caatatgtgccaatcaata

SEQ ID NO: 5295342 - DNA, 18 bp, Homo sapiens
caatatgttagcaagaga

SEQ ID NO: 5295343 - DNA, 15 bp, Homo sapiens
caatattaaatacag

SEQ ID NO: 5295344 - DNA, 20 bp, Homo sapiens
caatattaaatacagacact

SEQ ID NO: 5295345 - DNA, 14 bp, Homo sapiens
caatattaagtgtt

SEQ ID NO: 5295346 - DNA, 15 bp, Homo sapiens
caatattaattataa

SEQ ID NO: 5295347 - DNA, 17 bp, Homo sapiens
caatattaattataata

SEQ ID NO: 5295348 - DNA, 19 bp, Homo sapiens
caatattaattataataaa

SEQ ID NO: 5295349 - DNA, 18 bp, Homo sapiens
caatattaccatcttaat

SEQ ID NO: 5295350 - DNA, 20 bp, Homo sapiens
caatattaccatcttaatct

SEQ ID NO: 5295351 - DNA, 20 bp, Homo sapiens
caatattaccttaagatttt

SEQ ID NO: 5295352 - DNA, 21 bp, Homo sapiens
caatattactttgtcttttca

SEQ ID NO: 5295353 - DNA, 18 bp, Homo sapiens
caatattatactaagaaa

SEQ ID NO: 5295354 - DNA, 19 bp, Homo sapiens
caatattatactaagaaaa

SEQ ID NO: 5295355 - DNA, 21 bp, Homo sapiens
caatattatactaagaaaaga

SEQ ID NO: 5295356 - DNA, 23 bp, Homo sapiens
caatattatactaagaaaagata

SEQ ID NO: 5295357 - DNA, 21 bp, Homo sapiens
caatattatgaattcacagat

SEQ ID NO: 5295358 - DNA, 14 bp, Homo sapiens
caatattcaataaa

SEQ ID NO: 5295359 - DNA, 22 bp, Homo sapiens
caatattcagtggtgaaatctt

SEQ ID NO: 5295360 - DNA, 20 bp, Homo sapiens
caatattcctggtattattt

SEQ ID NO: 5295361 - DNA, 17 bp, Homo sapiens
caatattcgctgtgtca

SEQ ID NO: 5295362 - DNA, 15 bp, Homo sapiens
caatattctctctta

SEQ ID NO: 5295363 - DNA, 19 bp, Homo sapiens
caatattctctcttattgt

SEQ ID NO: 5295364 - DNA, 16 bp, Homo sapiens
caatattctctgtaca

SEQ ID NO: 5295365 - DNA, 18 bp, Homo sapiens
caatattctctgtacata

SEQ ID NO: 5295366 - DNA, 12 bp, Homo sapiens
caatattgaatt

SEQ ID NO: 5295367 - DNA, 18 bp, Homo sapiens
caatattgaatttttcct

SEQ ID NO: 5295368 - DNA, 16 bp, Homo sapiens
caatattgacatttgt

SEQ ID NO: 5295369 - DNA, 18 bp, Homo sapiens
caatattgagatgtaatt

SEQ ID NO: 5295370 - DNA, 15 bp, Homo sapiens
caatattgagcagtt

SEQ ID NO: 5295371 - DNA, 17 bp, Homo sapiens
caatattgattgggaaa

SEQ ID NO: 5295372 - DNA, 16 bp, Homo sapiens
caatattgattttaaa

SEQ ID NO: 5295373 - DNA, 22 bp, Homo sapiens
caatattgctagaggtggcatg

SEQ ID NO: 5295374 - DNA, 15 bp, Homo sapiens
caatattgtacagtt

SEQ ID NO: 5295375 - DNA, 19 bp, Homo sapiens
caatattgtatatttttat

SEQ ID NO: 5295376 - DNA, 14 bp, Homo sapiens
caatattgtttcta

SEQ ID NO: 5295377 - DNA, 16 bp, Homo sapiens
caatatttaaggagat

SEQ ID NO: 5295378 - DNA, 17 bp, Homo sapiens
caatatttagaaaattt

SEQ ID NO: 5295379 - DNA, 19 bp, Homo sapiens
caatatttagaaaattttg

SEQ ID NO: 5295380 - DNA, 15 bp, Homo sapiens
caatatttataatta

SEQ ID NO: 5295381 - DNA, 18 bp, Homo sapiens
caatatttataattaaag

SEQ ID NO: 5295382 - DNA, 20 bp, Homo sapiens
caatatttataattaaagaa

SEQ ID NO: 5295383 - DNA, 17 bp, Homo sapiens
atttttagagcattaaa

SEQ ID NO: 5295384 - DNA, 18 bp, Homo sapiens
atttttagagcattaaaa

SEQ ID NO: 5295385 - DNA, 23 bp, Homo sapiens
atttttagagcattaaaataact

SEQ ID NO: 5295386 - DNA, 21 bp, Homo sapiens
atttttagatagttagaacct

SEQ ID NO: 5295387 - DNA, 18 bp, Homo sapiens
atttttagccataatttt

SEQ ID NO: 5295388 - DNA, 23 bp, Homo sapiens
atttttagccataattttgcata

SEQ ID NO: 5295389 - DNA, 20 bp, Homo sapiens
atttttagccccaaatctct

SEQ ID NO: 5295390 - DNA, 23 bp, Homo sapiens
atttttagctctgttctttataa

SEQ ID NO: 5295391 - DNA, 17 bp, Homo sapiens
atttttaggacatgaaa

SEQ ID NO: 5295392 - DNA, 17 bp, Homo sapiens
atttttaggtgtctttt

SEQ ID NO: 5295393 - DNA, 22 bp, Homo sapiens
atttttagtaacctttaaaaat

SEQ ID NO: 5295394 - DNA, 13 bp, Homo sapiens
atttttagtagag

SEQ ID NO: 5295395 - DNA, 17 bp, Homo sapiens
atttttagtagagacgg

SEQ ID NO: 5295396 - DNA, 22 bp, Homo sapiens
atttttagtagagactggtttc

SEQ ID NO: 5295397 - DNA, 15 bp, Homo sapiens
atttttagtttgcta

SEQ ID NO: 5295398 - DNA, 15 bp, Homo sapiens
atttttataaatatg

SEQ ID NO: 5295399 - DNA, 13 bp, Homo sapiens
atttttataaatt

SEQ ID NO: 5295400 - DNA, 14 bp, Homo sapiens
atttttataagaaa

SEQ ID NO: 5295401 - DNA, 12 bp, Homo sapiens
atttttataatt

SEQ ID NO: 5295402 - DNA, 16 bp, Homo sapiens
atttttataattaaag

SEQ ID NO: 5295403 - DNA, 19 bp, Homo sapiens
atttttataattaaagatg

SEQ ID NO: 5295404 - DNA, 20 bp, Homo sapiens
atttttataattttatctgt

SEQ ID NO: 5295405 - DNA, 21 bp, Homo sapiens
atttttataattttatctgta

SEQ ID NO: 5295406 - DNA, 15 bp, Homo sapiens
atttttatacactgt

SEQ ID NO: 5295407 - DNA, 13 bp, Homo sapiens
atttttatacata

SEQ ID NO: 5295408 - DNA, 14 bp, Homo sapiens
atttttatacatat

SEQ ID NO: 5295409 - DNA, 17 bp, Homo sapiens
atttttatacatatcag

SEQ ID NO: 5295410 - DNA, 19 bp, Homo sapiens
atttttatacatatcagaa

SEQ ID NO: 5295411 - DNA, 15 bp, Homo sapiens
atttttatacggaaa

SEQ ID NO: 5295412 - DNA, 17 bp, Homo sapiens
atttttatacggaaaaa

SEQ ID NO: 5295413 - DNA, 15 bp, Homo sapiens
atttttatactgaca

SEQ ID NO: 5295414 - DNA, 13 bp, Homo sapiens
atttttatagcaa

SEQ ID NO: 5295415 - DNA, 17 bp, Homo sapiens
atttttatataatatct

SEQ ID NO: 5295416 - DNA, 21 bp, Homo sapiens
atttttatataatatctaaag

SEQ ID NO: 5295417 - DNA, 18 bp, Homo sapiens
atttttatatattatgtc

SEQ ID NO: 5295418 - DNA, 20 bp, Homo sapiens
atttttatatcagcctgagt

SEQ ID NO: 5295419 - DNA, 22 bp, Homo sapiens
atttttatatcatgcaaaatat

SEQ ID NO: 5295420 - DNA, 19 bp, Homo sapiens
atttttatattagttgctt

SEQ ID NO: 5295421 - DNA, 14 bp, Homo sapiens
atttttatatttaa

SEQ ID NO: 5295422 - DNA, 15 bp, Homo sapiens
atttttatatttact

SEQ ID NO: 5295423 - DNA, 15 bp, Homo sapiens
atttttatatttagt

SEQ ID NO: 5295424 - DNA, 14 bp, Homo sapiens
atttttatatttcc

SEQ ID NO: 5295425 - DNA, 17 bp, Homo sapiens
atttttatatttccttt

SEQ ID NO: 5295426 - DNA, 20 bp, Homo sapiens
atttttatcagttacacatg

SEQ ID NO: 5295427 - DNA, 16 bp, Homo sapiens
atttttatcatgaatt

SEQ ID NO: 5295428 - DNA, 12 bp, Homo sapiens
atttttatccaa

SEQ ID NO: 5295429 - DNA, 18 bp, Homo sapiens
atttttatccatttcttt

SEQ ID NO: 5295430 - DNA, 13 bp, Homo sapiens
atttttatcccag

SEQ ID NO: 5295431 - DNA, 16 bp, Homo sapiens
atttttatcccaggaa

SEQ ID NO: 5295432 - DNA, 15 bp, Homo sapiens
atttttatctatata

SEQ ID NO: 5295433 - DNA, 12 bp, Homo sapiens
atttttatctcc

SEQ ID NO: 5295434 - DNA, 12 bp, Homo sapiens
atttttatcttt

SEQ ID NO: 5295435 - DNA, 14 bp, Homo sapiens
atttttatgcagac

SEQ ID NO: 5295436 - DNA, 16 bp, Homo sapiens
atttttatgcagacag

SEQ ID NO: 5295437 - DNA, 17 bp, Homo sapiens
atttttatgccacctga

SEQ ID NO: 5295438 - DNA, 12 bp, Homo sapiens
atttttatggaa

SEQ ID NO: 5295439 - DNA, 23 bp, Homo sapiens
atttttatgtaattatatatact

SEQ ID NO: 5295440 - DNA, 15 bp, Homo sapiens
atttttatgtgcagc

SEQ ID NO: 5295441 - DNA, 16 bp, Homo sapiens
atttttatgtgcagcg

SEQ ID NO: 5295442 - DNA, 17 bp, Homo sapiens
atttttatgtggtctta

SEQ ID NO: 5295443 - DNA, 15 bp, Homo sapiens
atttttattaactgc

SEQ ID NO: 5295444 - DNA, 22 bp, Homo sapiens
atttttattaattttagttttt

SEQ ID NO: 5295445 - DNA, 15 bp, Homo sapiens
atttttattatgcat

SEQ ID NO: 5295446 - DNA, 22 bp, Homo sapiens
atttttattatgcataactgac

SEQ ID NO: 5295447 - DNA, 14 bp, Homo sapiens
atttttattattga

SEQ ID NO: 5295448 - DNA, 14 bp, Homo sapiens
atttttattcataa

SEQ ID NO: 5295449 - DNA, 15 bp, Homo sapiens
atttttattcataag

SEQ ID NO: 5295450 - DNA, 14 bp, Homo sapiens
atttttatttatat

SEQ ID NO: 5295451 - DNA, 14 bp, Homo sapiens
atttttatttcatt

SEQ ID NO: 5295452 - DNA, 15 bp, Homo sapiens
atttttatttcattc

SEQ ID NO: 5295453 - DNA, 12 bp, Homo sapiens
atttttatttct

SEQ ID NO: 5295454 - DNA, 17 bp, Homo sapiens
atttttatttctgactc

SEQ ID NO: 5295455 - DNA, 17 bp, Homo sapiens
atttttatttcttccta

SEQ ID NO: 5295456 - DNA, 14 bp, Homo sapiens
atttttatttcttt

SEQ ID NO: 5295457 - DNA, 13 bp, Homo sapiens
atttttatttgca

SEQ ID NO: 5295458 - DNA, 20 bp, Homo sapiens
atttttattttcttatgtaa

SEQ ID NO: 5295459 - DNA, 16 bp, Homo sapiens
atttttatttttctaa

SEQ ID NO: 5295460 - DNA, 11 bp, Homo sapiens
atttttcaaaa

SEQ ID NO: 5295461 - DNA, 17 bp, Homo sapiens
atttttcaaaaccctaa

SEQ ID NO: 5295462 - DNA, 12 bp, Homo sapiens
atttttcaaaat

SEQ ID NO: 5295463 - DNA, 16 bp, Homo sapiens
atttttcaaaatcaaa

SEQ ID NO: 5295464 - DNA, 18 bp, Homo sapiens
atttttcaaaatcaaagt

SEQ ID NO: 5295465 - DNA, 22 bp, Homo sapiens
atttttcaaaatcaaagttatg

SEQ ID NO: 5295466 - DNA, 12 bp, Homo sapiens
atttttcaaata

SEQ ID NO: 5295467 - DNA, 13 bp, Homo sapiens
atttttcaaatag

SEQ ID NO: 5295468 - DNA, 15 bp, Homo sapiens
atttttcaaatagat

SEQ ID NO: 5295469 - DNA, 23 bp, Homo sapiens
atttttcaaatagatttttgatt

SEQ ID NO: 5295470 - DNA, 20 bp, Homo sapiens
atttttcaacaaatatcttg

SEQ ID NO: 5295471 - DNA, 15 bp, Homo sapiens
atttttcaaccagca

SEQ ID NO: 5295472 - DNA, 16 bp, Homo sapiens
atttttcaaccagcat

SEQ ID NO: 5295473 - DNA, 14 bp, Homo sapiens
atttttcaactttg

SEQ ID NO: 5295474 - DNA, 18 bp, Homo sapiens
atttttcaactttgaata

SEQ ID NO: 5295475 - DNA, 22 bp, Homo sapiens
atttttcaactttgaataaaga

SEQ ID NO: 5295476 - DNA, 16 bp, Homo sapiens
atttttcaagagaaat

SEQ ID NO: 5295477 - DNA, 22 bp, Homo sapiens
atttttcaagtaataaaacaat

SEQ ID NO: 5295478 - DNA, 22 bp, Homo sapiens
atttttcaatagcacatatgga

SEQ ID NO: 5295479 - DNA, 18 bp, Homo sapiens
atttttcaatatattgaa

SEQ ID NO: 5295480 - DNA, 12 bp, Homo sapiens
atttttcaatca

SEQ ID NO: 5295481 - DNA, 16 bp, Homo sapiens
atttttcaattatgtt

SEQ ID NO: 5295482 - DNA, 22 bp, Homo sapiens
atttttcactctaagtcatgta

SEQ ID NO: 5295483 - DNA, 15 bp, Homo sapiens
atttttcagaaatca

SEQ ID NO: 5295484 - DNA, 20 bp, Homo sapiens
atttttcagagttttctaac

SEQ ID NO: 5295485 - DNA, 14 bp, Homo sapiens
atttttcagatata

SEQ ID NO: 5295486 - DNA, 15 bp, Homo sapiens
atttttcagatataa

SEQ ID NO: 5295487 - DNA, 15 bp, Homo sapiens
atttttcagatgctt

SEQ ID NO: 5295488 - DNA, 17 bp, Homo sapiens
atttttcagcacttaac

SEQ ID NO: 5295489 - DNA, 22 bp, Homo sapiens
atttttcagcacttaactactt

SEQ ID NO: 5295490 - DNA, 15 bp, Homo sapiens
atttttcagttccaa

SEQ ID NO: 5295491 - DNA, 16 bp, Homo sapiens
atttttcagttccaag

SEQ ID NO: 5295492 - DNA, 16 bp, Homo sapiens
atttttcatacttttc

SEQ ID NO: 5295493 - DNA, 12 bp, Homo sapiens
atttttcataga

SEQ ID NO: 5295494 - DNA, 15 bp, Homo sapiens
atttttcatcctaaa

SEQ ID NO: 5295495 - DNA, 16 bp, Homo sapiens
atttttcatctcttca

SEQ ID NO: 5295496 - DNA, 12 bp, Homo sapiens
atttttcatgta

SEQ ID NO: 5295497 - DNA, 17 bp, Homo sapiens
atttttcattcatgaat

SEQ ID NO: 5295498 - DNA, 17 bp, Homo sapiens
atttttccaatcacagt

SEQ ID NO: 5295499 - DNA, 21 bp, Homo sapiens
atttttccagctccgtgtttc

SEQ ID NO: 5295500 - DNA, 14 bp, Homo sapiens
atttttccaggact

SEQ ID NO: 5295501 - DNA, 16 bp, Homo sapiens
atttttccaggactct

SEQ ID NO: 5295502 - DNA, 15 bp, Homo sapiens
atttttccatgtgtg

SEQ ID NO: 5295503 - DNA, 16 bp, Homo sapiens
atttttcccagtattt

SEQ ID NO: 5295504 - DNA, 21 bp, Homo sapiens
atttttccccccaccccccag

SEQ ID NO: 5295505 - DNA, 17 bp, Homo sapiens
atttttccgtttgcttt

SEQ ID NO: 5295506 - DNA, 10 bp, Homo sapiens
atttttccta

SEQ ID NO: 5295507 - DNA, 16 bp, Homo sapiens
atttttcctgcatgtt

SEQ ID NO: 5295508 - DNA, 14 bp, Homo sapiens
atttttcctgtcct

SEQ ID NO: 5295509 - DNA, 15 bp, Homo sapiens
atttttccttccttc

SEQ ID NO: 5295510 - DNA, 20 bp, Homo sapiens
atttttctaaagaaattaca

SEQ ID NO: 5295511 - DNA, 22 bp, Homo sapiens
atttttctatatatttgtttca

SEQ ID NO: 5295512 - DNA, 13 bp, Homo sapiens
atttttctatctg

SEQ ID NO: 5295513 - DNA, 17 bp, Homo sapiens
atttttctcaaagtttt

SEQ ID NO: 5295514 - DNA, 23 bp, Homo sapiens
atttttctctccctctttttctc

SEQ ID NO: 5295515 - DNA, 15 bp, Homo sapiens
atttttctctcctgt

SEQ ID NO: 5295516 - DNA, 13 bp, Homo sapiens
atttttctctctc

SEQ ID NO: 5295517 - DNA, 13 bp, Homo sapiens
atttttctcttca

SEQ ID NO: 5295518 - DNA, 15 bp, Homo sapiens
atttttctcttcatt

SEQ ID NO: 5295519 - DNA, 20 bp, Homo sapiens
atttttctctttaaaaacat

SEQ ID NO: 5295520 - DNA, 22 bp, Homo sapiens
atttttctcttttttaaaaaca

SEQ ID NO: 5295521 - DNA, 22 bp, Homo sapiens
atttttctgacgagtgtccata

SEQ ID NO: 5295522 - DNA, 16 bp, Homo sapiens
atttttctgactttta

SEQ ID NO: 5295523 - DNA, 22 bp, Homo sapiens
atttttctgacttttacagatt

SEQ ID NO: 5295524 - DNA, 12 bp, Homo sapiens
atttttctgatg

SEQ ID NO: 5295525 - DNA, 15 bp, Homo sapiens
atttttctgcactga

SEQ ID NO: 5295526 - DNA, 13 bp, Homo sapiens
atttttctgcaga

SEQ ID NO: 5295527 - DNA, 22 bp, Homo sapiens
atttttctgggcttttcctttt

SEQ ID NO: 5295528 - DNA, 10 bp, Homo sapiens
atttttctgt

SEQ ID NO: 5295529 - DNA, 13 bp, Homo sapiens
atttttctgtact

SEQ ID NO: 5295530 - DNA, 19 bp, Homo sapiens
atttttctgtgtggagtat

SEQ ID NO: 5295531 - DNA, 20 bp, Homo sapiens
atttttcttaaaaagtaact

SEQ ID NO: 5295532 - DNA, 19 bp, Homo sapiens
atttttcttagtgttgtgg

SEQ ID NO: 5295533 - DNA, 19 bp, Homo sapiens
atttttcttatttatgtaa

SEQ ID NO: 5295534 - DNA, 20 bp, Homo sapiens
atttttcttatttcatttct

SEQ ID NO: 5295535 - DNA, 21 bp, Homo sapiens
atttttcttcaggtaacacta

SEQ ID NO: 5295536 - DNA, 15 bp, Homo sapiens
atttttcttctaaaa

SEQ ID NO: 5295537 - DNA, 14 bp, Homo sapiens
atttttcttcttga

SEQ ID NO: 5295538 - DNA, 19 bp, Homo sapiens
atttttcttgttgcatctt

SEQ ID NO: 5295539 - DNA, 16 bp, Homo sapiens
atttttcttgtttcct

SEQ ID NO: 5295540 - DNA, 16 bp, Homo sapiens
atttttctttaactgc

SEQ ID NO: 5295541 - DNA, 15 bp, Homo sapiens
atttttctttacaaa

SEQ ID NO: 5295542 - DNA, 22 bp, Homo sapiens
atttttcttttattcttctttc

SEQ ID NO: 5295543 - DNA, 17 bp, Homo sapiens
atttttcttttcctggg

SEQ ID NO: 5295544 - DNA, 18 bp, Homo sapiens
atttttcttttgaggcat

SEQ ID NO: 5295545 - DNA, 15 bp, Homo sapiens
atttttgaaaaatat

SEQ ID NO: 5295546 - DNA, 23 bp, Homo sapiens
atttttgaaaaatattgctaaaa

SEQ ID NO: 5295547 - DNA, 18 bp, Homo sapiens
atttttgaaaatcctgaa

SEQ ID NO: 5295548 - DNA, 21 bp, Homo sapiens
atttttgaaaatcctgaataa

SEQ ID NO: 5295549 - DNA, 16 bp, Homo sapiens
atttttgaaacccatt

SEQ ID NO: 5295550 - DNA, 21 bp, Homo sapiens
atttttgaaacccattaggca

SEQ ID NO: 5295551 - DNA, 13 bp, Homo sapiens
atttttgaaagaa

SEQ ID NO: 5295552 - DNA, 11 bp, Homo sapiens
atttttgaatg

SEQ ID NO: 5295553 - DNA, 12 bp, Homo sapiens
atttttgaattc

SEQ ID NO: 5295554 - DNA, 14 bp, Homo sapiens
atttttgaattctt

SEQ ID NO: 5295555 - DNA, 15 bp, Homo sapiens
atttttgacagaata

SEQ ID NO: 5295556 - DNA, 21 bp, Homo sapiens
atttttgagatattaaagatt

SEQ ID NO: 5295557 - DNA, 18 bp, Homo sapiens
atttttgaggaagttttg

SEQ ID NO: 5295558 - DNA, 16 bp, Homo sapiens
atttttgagtaaaact

SEQ ID NO: 5295559 - DNA, 18 bp, Homo sapiens
atttttgagttacaattt

SEQ ID NO: 5295560 - DNA, 13 bp, Homo sapiens
atttttgataaat

SEQ ID NO: 5295561 - DNA, 19 bp, Homo sapiens
atttttgataaattatgtt

SEQ ID NO: 5295562 - DNA, 19 bp, Homo sapiens
atttttgatactaagcatt

SEQ ID NO: 5295563 - DNA, 15 bp, Homo sapiens
atttttgatcaaatg

SEQ ID NO: 5295564 - DNA, 18 bp, Homo sapiens
atttttgatcaaatgtac

SEQ ID NO: 5295565 - DNA, 21 bp, Homo sapiens
caatatttataattaaagaaa

SEQ ID NO: 5295566 - DNA, 22 bp, Homo sapiens
caatatttataattaaagaaaa

SEQ ID NO: 5295567 - DNA, 19 bp, Homo sapiens
caatatttatggatgcaac

SEQ ID NO: 5295568 - DNA, 21 bp, Homo sapiens
caatatttattacacaaagaa

SEQ ID NO: 5295569 - DNA, 13 bp, Homo sapiens
caatatttattat

SEQ ID NO: 5295570 - DNA, 13 bp, Homo sapiens
caatatttattgt

SEQ ID NO: 5295571 - DNA, 22 bp, Homo sapiens
caatatttattgtattttagta

SEQ ID NO: 5295572 - DNA, 20 bp, Homo sapiens
caatatttcagataatcaca

SEQ ID NO: 5295573 - DNA, 23 bp, Homo sapiens
caatatttctgctttctttgatt

SEQ ID NO: 5295574 - DNA, 14 bp, Homo sapiens
caatatttcttttg

SEQ ID NO: 5295575 - DNA, 16 bp, Homo sapiens
caatatttcttttgtt

SEQ ID NO: 5295576 - DNA, 13 bp, Homo sapiens
caatatttgtaga

SEQ ID NO: 5295577 - DNA, 19 bp, Homo sapiens
caatatttgtgtgctaaac

SEQ ID NO: 5295578 - DNA, 13 bp, Homo sapiens
caatatttgttct

SEQ ID NO: 5295579 - DNA, 14 bp, Homo sapiens
caatattttaataa

SEQ ID NO: 5295580 - DNA, 17 bp, Homo sapiens
caatattttaataaagt

SEQ ID NO: 5295581 - DNA, 22 bp, Homo sapiens
caatattttatggttatgtttt

SEQ ID NO: 5295582 - DNA, 19 bp, Homo sapiens
caatattttccatgaaaat

SEQ ID NO: 5295583 - DNA, 21 bp, Homo sapiens
caatattttggagtatgttaa

SEQ ID NO: 5295584 - DNA, 14 bp, Homo sapiens
caatatttttagat

SEQ ID NO: 5295585 - DNA, 22 bp, Homo sapiens
caatatttttatatcatgcaaa

SEQ ID NO: 5295586 - DNA, 22 bp, Homo sapiens
caatattttttattcagtaaac

SEQ ID NO: 5295587 - DNA, 13 bp, Homo sapiens
caatcaaacaggg

SEQ ID NO: 5295588 - DNA, 14 bp, Homo sapiens
caatcaaactttca

SEQ ID NO: 5295589 - DNA, 15 bp, Homo sapiens
caatcaaagaaaaga

SEQ ID NO: 5295590 - DNA, 15 bp, Homo sapiens
caatcaaagaattac

SEQ ID NO: 5295591 - DNA, 16 bp, Homo sapiens
caatcaaagaattaca

SEQ ID NO: 5295592 - DNA, 17 bp, Homo sapiens
caatcaaagcagcacat

SEQ ID NO: 5295593 - DNA, 11 bp, Homo sapiens
caatcaaagct

SEQ ID NO: 5295594 - DNA, 17 bp, Homo sapiens
caatcaaagctaccttt

SEQ ID NO: 5295595 - DNA, 18 bp, Homo sapiens
caatcaaagctacctttt

SEQ ID NO: 5295596 - DNA, 20 bp, Homo sapiens
caatcaaagctacctttttt

SEQ ID NO: 5295597 - DNA, 17 bp, Homo sapiens
caatcaaataagtattt

SEQ ID NO: 5295598 - DNA, 22 bp, Homo sapiens
caatcaaataagtatttataat

SEQ ID NO: 5295599 - DNA, 13 bp, Homo sapiens
caatcaaataata

SEQ ID NO: 5295600 - DNA, 16 bp, Homo sapiens
caatcaacagaattgt

SEQ ID NO: 5295601 - DNA, 14 bp, Homo sapiens
caatcaacatctct

SEQ ID NO: 5295602 - DNA, 14 bp, Homo sapiens
caatcaaccaaagt

SEQ ID NO: 5295603 - DNA, 17 bp, Homo sapiens
caatcaacctgcacttc

SEQ ID NO: 5295604 - DNA, 15 bp, Homo sapiens
caatcaactttactg

SEQ ID NO: 5295605 - DNA, 17 bp, Homo sapiens
caatcaactttactgta

SEQ ID NO: 5295606 - DNA, 12 bp, Homo sapiens
caatcaagataa

SEQ ID NO: 5295607 - DNA, 16 bp, Homo sapiens
caatcaagataaagga

SEQ ID NO: 5295608 - DNA, 20 bp, Homo sapiens
caatcaagcaaaatttctgt

SEQ ID NO: 5295609 - DNA, 20 bp, Homo sapiens
caatcaaggttataattttt

SEQ ID NO: 5295610 - DNA, 15 bp, Homo sapiens
caatcaagtctgttt

SEQ ID NO: 5295611 - DNA, 11 bp, Homo sapiens
caatcaagttt

SEQ ID NO: 5295612 - DNA, 21 bp, Homo sapiens
caatcaataaaaaacaaatat

SEQ ID NO: 5295613 - DNA, 16 bp, Homo sapiens
caatcaatcttgcatg

SEQ ID NO: 5295614 - DNA, 17 bp, Homo sapiens
caatcaatggtgcaaaa

SEQ ID NO: 5295615 - DNA, 16 bp, Homo sapiens
caatcacaaaagctgt

SEQ ID NO: 5295616 - DNA, 16 bp, Homo sapiens
caatcacaaaggctga

SEQ ID NO: 5295617 - DNA, 13 bp, Homo sapiens
caatcacaggaaa

SEQ ID NO: 5295618 - DNA, 22 bp, Homo sapiens
caatcacagggaatggccacaa

SEQ ID NO: 5295619 - DNA, 15 bp, Homo sapiens
caatcacagtctcag

SEQ ID NO: 5295620 - DNA, 12 bp, Homo sapiens
caatcacattca

SEQ ID NO: 5295621 - DNA, 17 bp, Homo sapiens
caatcacccccaggacc

SEQ ID NO: 5295622 - DNA, 21 bp, Homo sapiens
caatcacccccaggacctctt

SEQ ID NO: 5295623 - DNA, 19 bp, Homo sapiens
caatcaccttgcatttcaa

SEQ ID NO: 5295624 - DNA, 22 bp, Homo sapiens
caatcacgagatcttccttccg

SEQ ID NO: 5295625 - DNA, 23 bp, Homo sapiens
caatcacgagatcttccttccgc

SEQ ID NO: 5295626 - DNA, 15 bp, Homo sapiens
caatcactaaacttt

SEQ ID NO: 5295627 - DNA, 14 bp, Homo sapiens
caatcactaaatat

SEQ ID NO: 5295628 - DNA, 19 bp, Homo sapiens
caatcactaaatatctagt

SEQ ID NO: 5295629 - DNA, 20 bp, Homo sapiens
caatcactaaatatctagtg

SEQ ID NO: 5295630 - DNA, 13 bp, Homo sapiens
caatcactattct

SEQ ID NO: 5295631 - DNA, 23 bp, Homo sapiens
caatcactattcttaagcacttt

SEQ ID NO: 5295632 - DNA, 15 bp, Homo sapiens
caatcactgctcccc

SEQ ID NO: 5295633 - DNA, 14 bp, Homo sapiens
caatcactgggccc

SEQ ID NO: 5295634 - DNA, 16 bp, Homo sapiens
caatcactgggcccag

SEQ ID NO: 5295635 - DNA, 17 bp, Homo sapiens
caatcactgggcccaga

SEQ ID NO: 5295636 - DNA, 19 bp, Homo sapiens
caatcactgggcccagagg

SEQ ID NO: 5295637 - DNA, 21 bp, Homo sapiens
caatcactgggcccagaggag

SEQ ID NO: 5295638 - DNA, 22 bp, Homo sapiens
caatcactgggcccagaggaga

SEQ ID NO: 5295639 - DNA, 21 bp, Homo sapiens
caatcactgtaacctgattca

SEQ ID NO: 5295640 - DNA, 18 bp, Homo sapiens
caatcacttgaaagtgaa

SEQ ID NO: 5295641 - DNA, 15 bp, Homo sapiens
caatcagaatgaaca

SEQ ID NO: 5295642 - DNA, 14 bp, Homo sapiens
caatcagagaataa

SEQ ID NO: 5295643 - DNA, 13 bp, Homo sapiens
caatcagagagcc

SEQ ID NO: 5295644 - DNA, 14 bp, Homo sapiens
caatcagagagcct

SEQ ID NO: 5295645 - DNA, 15 bp, Homo sapiens
caatcagagagccta

SEQ ID NO: 5295646 - DNA, 21 bp, Homo sapiens
caatcagagtgtacaaattgt

SEQ ID NO: 5295647 - DNA, 15 bp, Homo sapiens
caatcagcactctgt

SEQ ID NO: 5295648 - DNA, 21 bp, Homo sapiens
caatcagcactctgtaaaatg

SEQ ID NO: 5295649 - DNA, 12 bp, Homo sapiens
caatcagcactg

SEQ ID NO: 5295650 - DNA, 14 bp, Homo sapiens
caatcagcactgaa

SEQ ID NO: 5295651 - DNA, 15 bp, Homo sapiens
caatcagcactgaaa

SEQ ID NO: 5295652 - DNA, 18 bp, Homo sapiens
caatcagcccagtgcaaa

SEQ ID NO: 5295653 - DNA, 19 bp, Homo sapiens
caatcagcccagtgcaaac

SEQ ID NO: 5295654 - DNA, 12 bp, Homo sapiens
caatcagccttt

SEQ ID NO: 5295655 - DNA, 18 bp, Homo sapiens
caatcagctccttcctgg

SEQ ID NO: 5295656 - DNA, 13 bp, Homo sapiens
caatcagctgctt

SEQ ID NO: 5295657 - DNA, 17 bp, Homo sapiens
caatcagctgctttgtt

SEQ ID NO: 5295658 - DNA, 19 bp, Homo sapiens
caatcagcttttgttctag

SEQ ID NO: 5295659 - DNA, 21 bp, Homo sapiens
caatcagcttttgttctagac

SEQ ID NO: 5295660 - DNA, 22 bp, Homo sapiens
caatcagcttttgttctagact

SEQ ID NO: 5295661 - DNA, 14 bp, Homo sapiens
caatcagtcccctc

SEQ ID NO: 5295662 - DNA, 21 bp, Homo sapiens
caatcagtcccctcccatctg

SEQ ID NO: 5295663 - DNA, 15 bp, Homo sapiens
caatcagttgacttt

SEQ ID NO: 5295664 - DNA, 17 bp, Homo sapiens
caatcagtttatcctga

SEQ ID NO: 5295665 - DNA, 17 bp, Homo sapiens
caatcatatgtgatctg

SEQ ID NO: 5295666 - DNA, 18 bp, Homo sapiens
caatcatatttaaaggga

SEQ ID NO: 5295667 - DNA, 16 bp, Homo sapiens
caatcatcttctccca

SEQ ID NO: 5295668 - DNA, 19 bp, Homo sapiens
caatcatgaacagctctga

SEQ ID NO: 5295669 - DNA, 23 bp, Homo sapiens
caatcatgaacagctctgagatc

SEQ ID NO: 5295670 - DNA, 15 bp, Homo sapiens
caatcatgagtcaga

SEQ ID NO: 5295671 - DNA, 17 bp, Homo sapiens
caatcatggtcaagttc

SEQ ID NO: 5295672 - DNA, 14 bp, Homo sapiens
caatcatgtgccag

SEQ ID NO: 5295673 - DNA, 13 bp, Homo sapiens
caatcatgttctg

SEQ ID NO: 5295674 - DNA, 15 bp, Homo sapiens
caatcattgctgaaa

SEQ ID NO: 5295675 - DNA, 18 bp, Homo sapiens
caatcattgctgaaaatg

SEQ ID NO: 5295676 - DNA, 19 bp, Homo sapiens
caatcattgttttgaatat

SEQ ID NO: 5295677 - DNA, 15 bp, Homo sapiens
caatcatttcccctc

SEQ ID NO: 5295678 - DNA, 12 bp, Homo sapiens
caatcatttcct

SEQ ID NO: 5295679 - DNA, 17 bp, Homo sapiens
caatcatttctcactgt

SEQ ID NO: 5295680 - DNA, 17 bp, Homo sapiens
caatcattttaattatt

SEQ ID NO: 5295681 - DNA, 13 bp, Homo sapiens
caatcattttgga

SEQ ID NO: 5295682 - DNA, 22 bp, Homo sapiens
caatcattttgggaaattcttg

SEQ ID NO: 5295683 - DNA, 21 bp, Homo sapiens
caatccaaattccctctggag

SEQ ID NO: 5295684 - DNA, 20 bp, Homo sapiens
caatccaacccatgcatggc

SEQ ID NO: 5295685 - DNA, 13 bp, Homo sapiens
caatccaacccgg

SEQ ID NO: 5295686 - DNA, 22 bp, Homo sapiens
caatccaatctgtaatttcact

SEQ ID NO: 5295687 - DNA, 17 bp, Homo sapiens
caatccacagtattgtt

SEQ ID NO: 5295688 - DNA, 14 bp, Homo sapiens
caatccactctcag

SEQ ID NO: 5295689 - DNA, 20 bp, Homo sapiens
caatccagagaagcgctgtt

SEQ ID NO: 5295690 - DNA, 15 bp, Homo sapiens
caatccaggctgttc

SEQ ID NO: 5295691 - DNA, 16 bp, Homo sapiens
caatccaggctgttct

SEQ ID NO: 5295692 - DNA, 17 bp, Homo sapiens
caatccaggctgttctc

SEQ ID NO: 5295693 - DNA, 20 bp, Homo sapiens
caatccaggctgttctcagc

SEQ ID NO: 5295694 - DNA, 20 bp, Homo sapiens
caatccaggtacgcacagac

SEQ ID NO: 5295695 - DNA, 22 bp, Homo sapiens
caatccaggtacgcacagacag

SEQ ID NO: 5295696 - DNA, 23 bp, Homo sapiens
caatccaggtacgcacagacagg

SEQ ID NO: 5295697 - DNA, 20 bp, Homo sapiens
caatccaggtgggagagaca

SEQ ID NO: 5295698 - DNA, 17 bp, Homo sapiens
caatccataactttagt

SEQ ID NO: 5295699 - DNA, 19 bp, Homo sapiens
caatccatgtatctgtatg

SEQ ID NO: 5295700 - DNA, 23 bp, Homo sapiens
caatccatgttagtttttacttt

SEQ ID NO: 5295701 - DNA, 16 bp, Homo sapiens
caatccatttggcaga

SEQ ID NO: 5295702 - DNA, 20 bp, Homo sapiens
caatccatttggcagaactg

SEQ ID NO: 5295703 - DNA, 17 bp, Homo sapiens
caatcccaatctttcta

SEQ ID NO: 5295704 - DNA, 16 bp, Homo sapiens
caatcccaccaaatca

SEQ ID NO: 5295705 - DNA, 23 bp, Homo sapiens
caatcccaccaaatcatcctgaa

SEQ ID NO: 5295706 - DNA, 15 bp, Homo sapiens
caatcccacctagcc

SEQ ID NO: 5295707 - DNA, 22 bp, Homo sapiens
caatcccacttagcagggacag

SEQ ID NO: 5295708 - DNA, 13 bp, Homo sapiens
caatcccagttct

SEQ ID NO: 5295709 - DNA, 19 bp, Homo sapiens
caatcccagttcttcctgc

SEQ ID NO: 5295710 - DNA, 16 bp, Homo sapiens
caatcccatctattct

SEQ ID NO: 5295711 - DNA, 19 bp, Homo sapiens
caatccccataatgcttct

SEQ ID NO: 5295712 - DNA, 20 bp, Homo sapiens
caatccccataatgcttctt

SEQ ID NO: 5295713 - DNA, 14 bp, Homo sapiens
caatcccctccttg

SEQ ID NO: 5295714 - DNA, 20 bp, Homo sapiens
caatcccctccttgggcact

SEQ ID NO: 5295715 - DNA, 15 bp, Homo sapiens
caatcccgtgaaaga

SEQ ID NO: 5295716 - DNA, 19 bp, Homo sapiens
caatccctctccactcttc

SEQ ID NO: 5295717 - DNA, 15 bp, Homo sapiens
caatccctgccactg

SEQ ID NO: 5295718 - DNA, 16 bp, Homo sapiens
caatccctgccactgg

SEQ ID NO: 5295719 - DNA, 17 bp, Homo sapiens
caatccctgccactggg

SEQ ID NO: 5295720 - DNA, 20 bp, Homo sapiens
caatccctggggctgtgcat

SEQ ID NO: 5295721 - DNA, 19 bp, Homo sapiens
caatcctaatttctcctcc

SEQ ID NO: 5295722 - DNA, 21 bp, Homo sapiens
caatcctagaaccaagcttca

SEQ ID NO: 5295723 - DNA, 23 bp, Homo sapiens
caatcctagaaccaagcttcaga

SEQ ID NO: 5295724 - DNA, 20 bp, Homo sapiens
caatcctatgcatggtttca

SEQ ID NO: 5295725 - DNA, 23 bp, Homo sapiens
caatcctatgcatggtttcagca

SEQ ID NO: 5295726 - DNA, 18 bp, Homo sapiens
caatcctatgtcatttct

SEQ ID NO: 5295727 - DNA, 20 bp, Homo sapiens
caatcctatgtttttgttca

SEQ ID NO: 5295728 - DNA, 22 bp, Homo sapiens
caatcctcccacttcagcctcc

SEQ ID NO: 5295729 - DNA, 12 bp, Homo sapiens
caatcctcccca

SEQ ID NO: 5295730 - DNA, 14 bp, Homo sapiens
caatcctccccgct

SEQ ID NO: 5295731 - DNA, 15 bp, Homo sapiens
caatcctccccgctc

SEQ ID NO: 5295732 - DNA, 21 bp, Homo sapiens
caatcctccccgctctgccgc

SEQ ID NO: 5295733 - DNA, 18 bp, Homo sapiens
caatcctccctggagaag

SEQ ID NO: 5295734 - DNA, 24 bp, Homo sapiens
caatcctcctacctcagcctcctg

SEQ ID NO: 5295735 - DNA, 13 bp, Homo sapiens
caatcctcctgcc

SEQ ID NO: 5295736 - DNA, 14 bp, Homo sapiens
caatcctcctgcct

SEQ ID NO: 5295737 - DNA, 16 bp, Homo sapiens
caatcctcctgcctca

SEQ ID NO: 5295738 - DNA, 20 bp, Homo sapiens
caatcctcctgcctcagcct

SEQ ID NO: 5295739 - DNA, 15 bp, Homo sapiens
caatcctctctcccc

SEQ ID NO: 5295740 - DNA, 20 bp, Homo sapiens
caatcctctctcccctctgc

SEQ ID NO: 5295741 - DNA, 18 bp, Homo sapiens
caatcctgaagaaaccac

SEQ ID NO: 5295742 - DNA, 13 bp, Homo sapiens
caatcctgcattg

SEQ ID NO: 5295743 - DNA, 14 bp, Homo sapiens
caatcctgccccca

SEQ ID NO: 5295744 - DNA, 15 bp, Homo sapiens
atttttgcaaaataa

SEQ ID NO: 5295745 - DNA, 19 bp, Homo sapiens
atttttgcaaaataagttt

SEQ ID NO: 5295746 - DNA, 11 bp, Homo sapiens
atttttgcaat

SEQ ID NO: 5295747 - DNA, 18 bp, Homo sapiens
atttttgcactggaatat

SEQ ID NO: 5295748 - DNA, 13 bp, Homo sapiens
atttttgccctgc

SEQ ID NO: 5295749 - DNA, 16 bp, Homo sapiens
atttttgcctatcttt

SEQ ID NO: 5295750 - DNA, 22 bp, Homo sapiens
atttttgcctatctttaaacat

SEQ ID NO: 5295751 - DNA, 14 bp, Homo sapiens
atttttgccttcat

SEQ ID NO: 5295752 - DNA, 15 bp, Homo sapiens
atttttgccttcatt

SEQ ID NO: 5295753 - DNA, 22 bp, Homo sapiens
atttttgctaggagccccagct

SEQ ID NO: 5295754 - DNA, 23 bp, Homo sapiens
atttttgctcttctgtatgtgac

SEQ ID NO: 5295755 - DNA, 14 bp, Homo sapiens
atttttgctgaatt

SEQ ID NO: 5295756 - DNA, 15 bp, Homo sapiens
atttttgctgagact

SEQ ID NO: 5295757 - DNA, 15 bp, Homo sapiens
atttttgcttttgat

SEQ ID NO: 5295758 - DNA, 12 bp, Homo sapiens
atttttggactg

SEQ ID NO: 5295759 - DNA, 14 bp, Homo sapiens
atttttggagaaat

SEQ ID NO: 5295760 - DNA, 16 bp, Homo sapiens
atttttggagaaatgt

SEQ ID NO: 5295761 - DNA, 20 bp, Homo sapiens
atttttggagaaatgtcata

SEQ ID NO: 5295762 - DNA, 21 bp, Homo sapiens
atttttggagaaatgtcataa

SEQ ID NO: 5295763 - DNA, 18 bp, Homo sapiens
atttttggaggtttatta

SEQ ID NO: 5295764 - DNA, 15 bp, Homo sapiens
atttttggattgaca

SEQ ID NO: 5295765 - DNA, 21 bp, Homo sapiens
atttttggattgacagtaact

SEQ ID NO: 5295766 - DNA, 22 bp, Homo sapiens
atttttggattgacagtaactt

SEQ ID NO: 5295767 - DNA, 19 bp, Homo sapiens
atttttggcagtctgaatt

SEQ ID NO: 5295768 - DNA, 14 bp, Homo sapiens
atttttggggaaaa

SEQ ID NO: 5295769 - DNA, 20 bp, Homo sapiens
atttttggggcatcctggat

SEQ ID NO: 5295770 - DNA, 24 bp, Homo sapiens
atttttggggcatcctggatgatt

SEQ ID NO: 5295771 - DNA, 21 bp, Homo sapiens
atttttggggggagagacaca

SEQ ID NO: 5295772 - DNA, 15 bp, Homo sapiens
atttttgggtgattt

SEQ ID NO: 5295773 - DNA, 18 bp, Homo sapiens
atttttgggtttggccag

SEQ ID NO: 5295774 - DNA, 20 bp, Homo sapiens
atttttgggtttggccaggg

SEQ ID NO: 5295775 - DNA, 22 bp, Homo sapiens
atttttgggtttggccagggag

SEQ ID NO: 5295776 - DNA, 18 bp, Homo sapiens
atttttggtatttatgta

SEQ ID NO: 5295777 - DNA, 20 bp, Homo sapiens
atttttggtatttatgtaaa

SEQ ID NO: 5295778 - DNA, 18 bp, Homo sapiens
atttttggtcattgtaat

SEQ ID NO: 5295779 - DNA, 15 bp, Homo sapiens
atttttggtgcaagt

SEQ ID NO: 5295780 - DNA, 22 bp, Homo sapiens
atttttggtggtggtgggtttg

SEQ ID NO: 5295781 - DNA, 16 bp, Homo sapiens
atttttggtgtatttg

SEQ ID NO: 5295782 - DNA, 17 bp, Homo sapiens
atttttggttgaataaa

SEQ ID NO: 5295783 - DNA, 13 bp, Homo sapiens
atttttgtaaagt

SEQ ID NO: 5295784 - DNA, 14 bp, Homo sapiens
atttttgtaaagtt

SEQ ID NO: 5295785 - DNA, 12 bp, Homo sapiens
atttttgtaaat

SEQ ID NO: 5295786 - DNA, 18 bp, Homo sapiens
atttttgtaaatagttta

SEQ ID NO: 5295787 - DNA, 15 bp, Homo sapiens
atttttgtaataaaa

SEQ ID NO: 5295788 - DNA, 17 bp, Homo sapiens
atttttgtaataacatt

SEQ ID NO: 5295789 - DNA, 19 bp, Homo sapiens
atttttgtaataacattta

SEQ ID NO: 5295790 - DNA, 11 bp, Homo sapiens
atttttgtaca

SEQ ID NO: 5295791 - DNA, 20 bp, Homo sapiens
atttttgtacagtttgctgt

SEQ ID NO: 5295792 - DNA, 14 bp, Homo sapiens
atttttgtacatat

SEQ ID NO: 5295793 - DNA, 22 bp, Homo sapiens
atttttgtacatcccaaaggat

SEQ ID NO: 5295794 - DNA, 15 bp, Homo sapiens
atttttgtacattat

SEQ ID NO: 5295795 - DNA, 18 bp, Homo sapiens
atttttgtacattatgtt

SEQ ID NO: 5295796 - DNA, 13 bp, Homo sapiens
atttttgtaccat

SEQ ID NO: 5295797 - DNA, 16 bp, Homo sapiens
atttttgtaccatatt

SEQ ID NO: 5295798 - DNA, 22 bp, Homo sapiens
atttttgtacgttatatattgt

SEQ ID NO: 5295799 - DNA, 18 bp, Homo sapiens
atttttgtacttgatttg

SEQ ID NO: 5295800 - DNA, 21 bp, Homo sapiens
atttttgtacttgatttgatg

SEQ ID NO: 5295801 - DNA, 15 bp, Homo sapiens
atttttgtactttta

SEQ ID NO: 5295802 - DNA, 18 bp, Homo sapiens
atttttgtagttagacaa

SEQ ID NO: 5295803 - DNA, 12 bp, Homo sapiens
atttttgtataa

SEQ ID NO: 5295804 - DNA, 13 bp, Homo sapiens
atttttgtataaa

SEQ ID NO: 5295805 - DNA, 16 bp, Homo sapiens
atttttgtataaaaag

SEQ ID NO: 5295806 - DNA, 19 bp, Homo sapiens
atttttgtataaaatccat

SEQ ID NO: 5295807 - DNA, 23 bp, Homo sapiens
atttttgtatagtgtaaactgaa

SEQ ID NO: 5295808 - DNA, 17 bp, Homo sapiens
atttttgtatgttatga

SEQ ID NO: 5295809 - DNA, 14 bp, Homo sapiens
atttttgtatttct

SEQ ID NO: 5295810 - DNA, 13 bp, Homo sapiens
atttttgtccctg

SEQ ID NO: 5295811 - DNA, 23 bp, Homo sapiens
atttttgtcttatatatatttct

SEQ ID NO: 5295812 - DNA, 21 bp, Homo sapiens
atttttgtgaagtattcacaa

SEQ ID NO: 5295813 - DNA, 16 bp, Homo sapiens
atttttgtgaattata

SEQ ID NO: 5295814 - DNA, 20 bp, Homo sapiens
atttttgtgagcctctttgt

SEQ ID NO: 5295815 - DNA, 24 bp, Homo sapiens
atttttgtgccattatatttgcat

SEQ ID NO: 5295816 - DNA, 23 bp, Homo sapiens
atttttgtggcatgttgtaacat

SEQ ID NO: 5295817 - DNA, 16 bp, Homo sapiens
atttttgtgtatccag

SEQ ID NO: 5295818 - DNA, 12 bp, Homo sapiens
atttttgttaag

SEQ ID NO: 5295819 - DNA, 16 bp, Homo sapiens
atttttgttaagctca

SEQ ID NO: 5295820 - DNA, 18 bp, Homo sapiens
atttttgttaagctcagg

SEQ ID NO: 5295821 - DNA, 19 bp, Homo sapiens
atttttgttaagctcagga

SEQ ID NO: 5295822 - DNA, 21 bp, Homo sapiens
atttttgttaattttcctcat

SEQ ID NO: 5295823 - DNA, 20 bp, Homo sapiens
atttttgttactctcttcca

SEQ ID NO: 5295824 - DNA, 21 bp, Homo sapiens
atttttgttagcaaagattaa

SEQ ID NO: 5295825 - DNA, 19 bp, Homo sapiens
atttttgttagtttacaat

SEQ ID NO: 5295826 - DNA, 22 bp, Homo sapiens
atttttgttagtttacaatatt

SEQ ID NO: 5295827 - DNA, 23 bp, Homo sapiens
atttttgttggggggtgggagag

SEQ ID NO: 5295828 - DNA, 16 bp, Homo sapiens
atttttgttgttgttg

SEQ ID NO: 5295829 - DNA, 22 bp, Homo sapiens
atttttgtttggactgttttca

SEQ ID NO: 5295830 - DNA, 20 bp, Homo sapiens
atttttgttttccactgtgc

SEQ ID NO: 5295831 - DNA, 19 bp, Homo sapiens
attttttaaaaaaaatgtg

SEQ ID NO: 5295832 - DNA, 18 bp, Homo sapiens
attttttaaaaaagctta

SEQ ID NO: 5295833 - DNA, 20 bp, Homo sapiens
attttttaaaaaagcttaaa

SEQ ID NO: 5295834 - DNA, 14 bp, Homo sapiens
attttttaaaaaat

SEQ ID NO: 5295835 - DNA, 13 bp, Homo sapiens
attttttaaaaag

SEQ ID NO: 5295836 - DNA, 15 bp, Homo sapiens
attttttaaaaagca

SEQ ID NO: 5295837 - DNA, 16 bp, Homo sapiens
attttttaaaaagcaa

SEQ ID NO: 5295838 - DNA, 18 bp, Homo sapiens
attttttaaaaagcaaaa

SEQ ID NO: 5295839 - DNA, 16 bp, Homo sapiens
attttttaaaaagtgt

SEQ ID NO: 5295840 - DNA, 22 bp, Homo sapiens
attttttaaaaagtgttttgaa

SEQ ID NO: 5295841 - DNA, 15 bp, Homo sapiens
attttttaaaacaag

SEQ ID NO: 5295842 - DNA, 15 bp, Homo sapiens
attttttaaaagaga

SEQ ID NO: 5295843 - DNA, 21 bp, Homo sapiens
attttttaaaagagacaaact

SEQ ID NO: 5295844 - DNA, 20 bp, Homo sapiens
attttttaaaagcatggcta

SEQ ID NO: 5295845 - DNA, 18 bp, Homo sapiens
attttttaaacgaagaga

SEQ ID NO: 5295846 - DNA, 14 bp, Homo sapiens
attttttaaagaat

SEQ ID NO: 5295847 - DNA, 16 bp, Homo sapiens
attttttaaataaaat

SEQ ID NO: 5295848 - DNA, 15 bp, Homo sapiens
attttttaaatcttg

SEQ ID NO: 5295849 - DNA, 23 bp, Homo sapiens
attttttaaatgaaaatgtaact

SEQ ID NO: 5295850 - DNA, 13 bp, Homo sapiens
attttttaaatgc

SEQ ID NO: 5295851 - DNA, 14 bp, Homo sapiens
attttttaaatgca

SEQ ID NO: 5295852 - DNA, 19 bp, Homo sapiens
attttttaaatgtaaaatt

SEQ ID NO: 5295853 - DNA, 19 bp, Homo sapiens
attttttaaatgttcatgt

SEQ ID NO: 5295854 - DNA, 21 bp, Homo sapiens
attttttaaatgttcatgtca

SEQ ID NO: 5295855 - DNA, 20 bp, Homo sapiens
attttttaaatttacagaat

SEQ ID NO: 5295856 - DNA, 22 bp, Homo sapiens
attttttaaccccgtcaacaaa

SEQ ID NO: 5295857 - DNA, 14 bp, Homo sapiens
attttttaactttt

SEQ ID NO: 5295858 - DNA, 16 bp, Homo sapiens
attttttaagaaaaaa

SEQ ID NO: 5295859 - DNA, 21 bp, Homo sapiens
attttttaagagacagtttcg

SEQ ID NO: 5295860 - DNA, 18 bp, Homo sapiens
attttttaaggagctggg

SEQ ID NO: 5295861 - DNA, 22 bp, Homo sapiens
attttttaagggatgttgcaaa

SEQ ID NO: 5295862 - DNA, 16 bp, Homo sapiens
attttttaagtattta

SEQ ID NO: 5295863 - DNA, 22 bp, Homo sapiens
attttttaagtatttatatatt

SEQ ID NO: 5295864 - DNA, 21 bp, Homo sapiens
attttttaagtgaaaatatag

SEQ ID NO: 5295865 - DNA, 14 bp, Homo sapiens
attttttaagttca

SEQ ID NO: 5295866 - DNA, 15 bp, Homo sapiens
attttttaagttcaa

SEQ ID NO: 5295867 - DNA, 16 bp, Homo sapiens
attttttaagttcaat

SEQ ID NO: 5295868 - DNA, 12 bp, Homo sapiens
attttttaatta

SEQ ID NO: 5295869 - DNA, 14 bp, Homo sapiens
attttttaattatt

SEQ ID NO: 5295870 - DNA, 20 bp, Homo sapiens
attttttaattattatttat

SEQ ID NO: 5295871 - DNA, 15 bp, Homo sapiens
attttttaattattg

SEQ ID NO: 5295872 - DNA, 13 bp, Homo sapiens
attttttaattgt

SEQ ID NO: 5295873 - DNA, 14 bp, Homo sapiens
attttttaattgtt

SEQ ID NO: 5295874 - DNA, 19 bp, Homo sapiens
attttttaatttaaagctt

SEQ ID NO: 5295875 - DNA, 22 bp, Homo sapiens
attttttaatttgatgaaagct

SEQ ID NO: 5295876 - DNA, 11 bp, Homo sapiens
attttttacaa

SEQ ID NO: 5295877 - DNA, 17 bp, Homo sapiens
attttttacaaattatg

SEQ ID NO: 5295878 - DNA, 20 bp, Homo sapiens
attttttacaaattatgttt

SEQ ID NO: 5295879 - DNA, 20 bp, Homo sapiens
attttttacaagagtctgta

SEQ ID NO: 5295880 - DNA, 17 bp, Homo sapiens
attttttacattttcct

SEQ ID NO: 5295881 - DNA, 16 bp, Homo sapiens
attttttactgccctt

SEQ ID NO: 5295882 - DNA, 14 bp, Homo sapiens
attttttacttgaa

SEQ ID NO: 5295883 - DNA, 15 bp, Homo sapiens
attttttacttgaat

SEQ ID NO: 5295884 - DNA, 21 bp, Homo sapiens
attttttacttgaatcagatg

SEQ ID NO: 5295885 - DNA, 23 bp, Homo sapiens
attttttacttgaatcagatggt

SEQ ID NO: 5295886 - DNA, 14 bp, Homo sapiens
attttttaggaaat

SEQ ID NO: 5295887 - DNA, 18 bp, Homo sapiens
attttttaggacatctta

SEQ ID NO: 5295888 - DNA, 17 bp, Homo sapiens
attttttaggtgcttta

SEQ ID NO: 5295889 - DNA, 17 bp, Homo sapiens
attttttataaatatca

SEQ ID NO: 5295890 - DNA, 19 bp, Homo sapiens
attttttataattttctaa

SEQ ID NO: 5295891 - DNA, 15 bp, Homo sapiens
attttttatactgta

SEQ ID NO: 5295892 - DNA, 14 bp, Homo sapiens
attttttattaata

SEQ ID NO: 5295893 - DNA, 17 bp, Homo sapiens
attttttatttacattt

SEQ ID NO: 5295894 - DNA, 16 bp, Homo sapiens
attttttcaaaaacag

SEQ ID NO: 5295895 - DNA, 13 bp, Homo sapiens
attttttcagaaa

SEQ ID NO: 5295896 - DNA, 12 bp, Homo sapiens
attttttcagac

SEQ ID NO: 5295897 - DNA, 14 bp, Homo sapiens
attttttcagaccg

SEQ ID NO: 5295898 - DNA, 20 bp, Homo sapiens
attttttcagactgtgcaat

SEQ ID NO: 5295899 - DNA, 20 bp, Homo sapiens
attttttcagacttgtcaag

SEQ ID NO: 5295900 - DNA, 15 bp, Homo sapiens
attttttcagtatta

SEQ ID NO: 5295901 - DNA, 13 bp, Homo sapiens
attttttccaaaa

SEQ ID NO: 5295902 - DNA, 13 bp, Homo sapiens
attttttcccttc

SEQ ID NO: 5295903 - DNA, 17 bp, Homo sapiens
attttttcccttctctt

SEQ ID NO: 5295904 - DNA, 22 bp, Homo sapiens
attttttcccttctcttctaac

SEQ ID NO: 5295905 - DNA, 13 bp, Homo sapiens
attttttcccttt

SEQ ID NO: 5295906 - DNA, 20 bp, Homo sapiens
attttttcctgctagtgtag

SEQ ID NO: 5295907 - DNA, 14 bp, Homo sapiens
attttttcctgttt

SEQ ID NO: 5295908 - DNA, 11 bp, Homo sapiens
attttttcctt

SEQ ID NO: 5295909 - DNA, 21 bp, Homo sapiens
attttttcgtgcactctgcta

SEQ ID NO: 5295910 - DNA, 14 bp, Homo sapiens
attttttctctttg

SEQ ID NO: 5295911 - DNA, 13 bp, Homo sapiens
attttttctgaat

SEQ ID NO: 5295912 - DNA, 12 bp, Homo sapiens
attttttcttcc

SEQ ID NO: 5295913 - DNA, 12 bp, Homo sapiens
attttttcttct

SEQ ID NO: 5295914 - DNA, 17 bp, Homo sapiens
attttttcttgcattga

SEQ ID NO: 5295915 - DNA, 17 bp, Homo sapiens
attttttctttaaataa

SEQ ID NO: 5295916 - DNA, 16 bp, Homo sapiens
attttttgaaaagcag

SEQ ID NO: 5295917 - DNA, 19 bp, Homo sapiens
attttttgaaaagcagaca

SEQ ID NO: 5295918 - DNA, 13 bp, Homo sapiens
attttttgaaagt

SEQ ID NO: 5295919 - DNA, 19 bp, Homo sapiens
attttttgaaatgctgaaa

SEQ ID NO: 5295920 - DNA, 12 bp, Homo sapiens
attttttgaata

SEQ ID NO: 5295921 - DNA, 16 bp, Homo sapiens
attttttgaatctatg

SEQ ID NO: 5295922 - DNA, 17 bp, Homo sapiens
attttttgacacttcca

SEQ ID NO: 5295923 - DNA, 12 bp, Homo sapiens
attttttgactt

SEQ ID NO: 5295924 - DNA, 17 bp, Homo sapiens
caatcctgcccccagcc

SEQ ID NO: 5295925 - DNA, 12 bp, Homo sapiens
caatcctggctc

SEQ ID NO: 5295926 - DNA, 13 bp, Homo sapiens
caatcctgtccct

SEQ ID NO: 5295927 - DNA, 16 bp, Homo sapiens
caatcctgtccctcac

SEQ ID NO: 5295928 - DNA, 17 bp, Homo sapiens
caatcctgtctttctga

SEQ ID NO: 5295929 - DNA, 15 bp, Homo sapiens
caatcctgtttataa

SEQ ID NO: 5295930 - DNA, 17 bp, Homo sapiens
caatcctgtttttccta

SEQ ID NO: 5295931 - DNA, 13 bp, Homo sapiens
caatccttacaaa

SEQ ID NO: 5295932 - DNA, 16 bp, Homo sapiens
caatccttacaaatga

SEQ ID NO: 5295933 - DNA, 14 bp, Homo sapiens
caatccttgttcag

SEQ ID NO: 5295934 - DNA, 12 bp, Homo sapiens
caatcctttcca

SEQ ID NO: 5295935 - DNA, 15 bp, Homo sapiens
caatcctttgagtta

SEQ ID NO: 5295936 - DNA, 19 bp, Homo sapiens
caatccttttgataaattt

SEQ ID NO: 5295937 - DNA, 18 bp, Homo sapiens
caatcgacatcctagccc

SEQ ID NO: 5295938 - DNA, 19 bp, Homo sapiens
caatcgactgggtttatgt

SEQ ID NO: 5295939 - DNA, 14 bp, Homo sapiens
caatcgcaaagcaa

SEQ ID NO: 5295940 - DNA, 13 bp, Homo sapiens
caatcgcaaatca

SEQ ID NO: 5295941 - DNA, 14 bp, Homo sapiens
caatcggactgcca

SEQ ID NO: 5295942 - DNA, 14 bp, Homo sapiens
caatcgggagtagc

SEQ ID NO: 5295943 - DNA, 18 bp, Homo sapiens
caatcgtgatagttatta

SEQ ID NO: 5295944 - DNA, 16 bp, Homo sapiens
caatcgttctgctggc

SEQ ID NO: 5295945 - DNA, 23 bp, Homo sapiens
caatctaaaaaatatcttaggtt

SEQ ID NO: 5295946 - DNA, 15 bp, Homo sapiens
caatctaaaatggca

SEQ ID NO: 5295947 - DNA, 16 bp, Homo sapiens
caatctaaattaaaaa

SEQ ID NO: 5295948 - DNA, 13 bp, Homo sapiens
caatctaaggcct

SEQ ID NO: 5295949 - DNA, 15 bp, Homo sapiens
caatctaaggccttc

SEQ ID NO: 5295950 - DNA, 14 bp, Homo sapiens
caatctaatctgaa

SEQ ID NO: 5295951 - DNA, 14 bp, Homo sapiens
caatctacactgcc

SEQ ID NO: 5295952 - DNA, 15 bp, Homo sapiens
caatctacactgcct

SEQ ID NO: 5295953 - DNA, 17 bp, Homo sapiens
caatctactcaaagcat

SEQ ID NO: 5295954 - DNA, 11 bp, Homo sapiens
caatctactgg

SEQ ID NO: 5295955 - DNA, 15 bp, Homo sapiens
caatctagctctcca

SEQ ID NO: 5295956 - DNA, 23 bp, Homo sapiens
caatctaggcgaggcgaagctga

SEQ ID NO: 5295957 - DNA, 24 bp, Homo sapiens
caatctatagttatacatcttcat

SEQ ID NO: 5295958 - DNA, 13 bp, Homo sapiens
caatctattattt

SEQ ID NO: 5295959 - DNA, 14 bp, Homo sapiens
caatctatttaaaa

SEQ ID NO: 5295960 - DNA, 19 bp, Homo sapiens
caatctatttaaaaaactg

SEQ ID NO: 5295961 - DNA, 13 bp, Homo sapiens
caatctatttatt

SEQ ID NO: 5295962 - DNA, 20 bp, Homo sapiens
caatctcaaattctcaacct

SEQ ID NO: 5295963 - DNA, 18 bp, Homo sapiens
caatctcacacagctggg

SEQ ID NO: 5295964 - DNA, 20 bp, Homo sapiens
caatctcacaccttagctat

SEQ ID NO: 5295965 - DNA, 12 bp, Homo sapiens
caatctccaggg

SEQ ID NO: 5295966 - DNA, 19 bp, Homo sapiens
caatctccagggctgcccc

SEQ ID NO: 5295967 - DNA, 17 bp, Homo sapiens
caatctccatgtgtact

SEQ ID NO: 5295968 - DNA, 17 bp, Homo sapiens
caatctcccgctgctgc

SEQ ID NO: 5295969 - DNA, 22 bp, Homo sapiens
caatctcggcccgctgcagcct

SEQ ID NO: 5295970 - DNA, 20 bp, Homo sapiens
caatctcggctcactgcatc

SEQ ID NO: 5295971 - DNA, 19 bp, Homo sapiens
caatctcgtaggtgtcctg

SEQ ID NO: 5295972 - DNA, 20 bp, Homo sapiens
caatctcgtcaggctgccag

SEQ ID NO: 5295973 - DNA, 16 bp, Homo sapiens
caatctcgtttagtgc

SEQ ID NO: 5295974 - DNA, 20 bp, Homo sapiens
caatctctacccctttcttc

SEQ ID NO: 5295975 - DNA, 23 bp, Homo sapiens
caatctctacccctttcttctcg

SEQ ID NO: 5295976 - DNA, 20 bp, Homo sapiens
caatctctgcctcccgggtt

SEQ ID NO: 5295977 - DNA, 10 bp, Homo sapiens
caatctctgg

SEQ ID NO: 5295978 - DNA, 14 bp, Homo sapiens
caatctctggtgcc

SEQ ID NO: 5295979 - DNA, 14 bp, Homo sapiens
caatctctgtgact

SEQ ID NO: 5295980 - DNA, 20 bp, Homo sapiens
caatctctgtgactcgctta

SEQ ID NO: 5295981 - DNA, 22 bp, Homo sapiens
caatctcttcattattctctgc

SEQ ID NO: 5295982 - DNA, 18 bp, Homo sapiens
caatctcttggtggggag

SEQ ID NO: 5295983 - DNA, 14 bp, Homo sapiens
caatctctttttgt

SEQ ID NO: 5295984 - DNA, 13 bp, Homo sapiens
caatctgaaattc

SEQ ID NO: 5295985 - DNA, 17 bp, Homo sapiens
caatctgacattctcag

SEQ ID NO: 5295986 - DNA, 13 bp, Homo sapiens
caatctgaccctt

SEQ ID NO: 5295987 - DNA, 20 bp, Homo sapiens
caatctgattcagcatcact

SEQ ID NO: 5295988 - DNA, 22 bp, Homo sapiens
caatctgattcagcatcactaa

SEQ ID NO: 5295989 - DNA, 11 bp, Homo sapiens
caatctgcagc

SEQ ID NO: 5295990 - DNA, 12 bp, Homo sapiens
caatctgcccac

SEQ ID NO: 5295991 - DNA, 17 bp, Homo sapiens
caatctgcccaccgacc

SEQ ID NO: 5295992 - DNA, 11 bp, Homo sapiens
caatctgccct

SEQ ID NO: 5295993 - DNA, 16 bp, Homo sapiens
caatctggaagaaaaa

SEQ ID NO: 5295994 - DNA, 19 bp, Homo sapiens
caatctggacacttcttta

SEQ ID NO: 5295995 - DNA, 12 bp, Homo sapiens
caatctggccct

SEQ ID NO: 5295996 - DNA, 17 bp, Homo sapiens
caatctggcccttacac

SEQ ID NO: 5295997 - DNA, 20 bp, Homo sapiens
caatctggcccttacacact

SEQ ID NO: 5295998 - DNA, 22 bp, Homo sapiens
caatctggcccttacacactca

SEQ ID NO: 5295999 - DNA, 11 bp, Homo sapiens
caatctggctc

SEQ ID NO: 5296000 - DNA, 12 bp, Homo sapiens
caatctggctca

SEQ ID NO: 5296001 - DNA, 14 bp, Homo sapiens
caatctggctcact

SEQ ID NO: 5296002 - DNA, 17 bp, Homo sapiens
caatctggctcactgca

SEQ ID NO: 5296003 - DNA, 22 bp, Homo sapiens
caatctggctcactgcagcctc

SEQ ID NO: 5296004 - DNA, 21 bp, Homo sapiens
caatctgggaagatttgaaaa

SEQ ID NO: 5296005 - DNA, 22 bp, Homo sapiens
caatctgggtggtaactgccag

SEQ ID NO: 5296006 - DNA, 18 bp, Homo sapiens
caatctgtaaaactaaga

SEQ ID NO: 5296007 - DNA, 17 bp, Homo sapiens
caatctgtaaactgtgt

SEQ ID NO: 5296008 - DNA, 18 bp, Homo sapiens
caatctgtaaactgtgta

SEQ ID NO: 5296009 - DNA, 14 bp, Homo sapiens
caatctgtaaattt

SEQ ID NO: 5296010 - DNA, 15 bp, Homo sapiens
caatctgtacaaaat

SEQ ID NO: 5296011 - DNA, 18 bp, Homo sapiens
caatctgtacaaaatggt

SEQ ID NO: 5296012 - DNA, 14 bp, Homo sapiens
caatctgtcagttc

SEQ ID NO: 5296013 - DNA, 23 bp, Homo sapiens
caatctgtgaagcctttatctat

SEQ ID NO: 5296014 - DNA, 21 bp, Homo sapiens
caatcttaaagacaaattttg

SEQ ID NO: 5296015 - DNA, 14 bp, Homo sapiens
caatcttaagagga

SEQ ID NO: 5296016 - DNA, 15 bp, Homo sapiens
caatcttaagaggat

SEQ ID NO: 5296017 - DNA, 18 bp, Homo sapiens
caatcttaagcagagata

SEQ ID NO: 5296018 - DNA, 19 bp, Homo sapiens
caatcttaaggggcagctt

SEQ ID NO: 5296019 - DNA, 18 bp, Homo sapiens
caatcttaccagatgcta

SEQ ID NO: 5296020 - DNA, 20 bp, Homo sapiens
caatcttaccagatgctact

SEQ ID NO: 5296021 - DNA, 22 bp, Homo sapiens
caatcttactttgtaaattctg

SEQ ID NO: 5296022 - DNA, 15 bp, Homo sapiens
caatcttatgttgat

SEQ ID NO: 5296023 - DNA, 16 bp, Homo sapiens
caatcttatgttgatc

SEQ ID NO: 5296024 - DNA, 15 bp, Homo sapiens
caatcttcaatcctt

SEQ ID NO: 5296025 - DNA, 16 bp, Homo sapiens
caatcttcaatgaata

SEQ ID NO: 5296026 - DNA, 21 bp, Homo sapiens
caatcttcctgtttaaaaaac

SEQ ID NO: 5296027 - DNA, 16 bp, Homo sapiens
caatcttcgacagctg

SEQ ID NO: 5296028 - DNA, 14 bp, Homo sapiens
caatcttctttttc

SEQ ID NO: 5296029 - DNA, 15 bp, Homo sapiens
caatcttctttttca

SEQ ID NO: 5296030 - DNA, 15 bp, Homo sapiens
caatcttgcccactg

SEQ ID NO: 5296031 - DNA, 20 bp, Homo sapiens
caatcttgcccactggccgc

SEQ ID NO: 5296032 - DNA, 14 bp, Homo sapiens
caatcttgccttct

SEQ ID NO: 5296033 - DNA, 17 bp, Homo sapiens
caatcttgctgtgaaac

SEQ ID NO: 5296034 - DNA, 22 bp, Homo sapiens
caatcttgctgtgaaacagtgt

SEQ ID NO: 5296035 - DNA, 13 bp, Homo sapiens
caatcttgctttg

SEQ ID NO: 5296036 - DNA, 11 bp, Homo sapiens
caatcttggga

SEQ ID NO: 5296037 - DNA, 19 bp, Homo sapiens
caatcttggggctgatgaa

SEQ ID NO: 5296038 - DNA, 21 bp, Homo sapiens
caatcttggggctgatgaaga

SEQ ID NO: 5296039 - DNA, 16 bp, Homo sapiens
caatcttgtccacagt

SEQ ID NO: 5296040 - DNA, 19 bp, Homo sapiens
caatcttgtttatagcaaa

SEQ ID NO: 5296041 - DNA, 20 bp, Homo sapiens
caatcttgtttatagcaaaa

SEQ ID NO: 5296042 - DNA, 19 bp, Homo sapiens
caatcttgttttaagcaaa

SEQ ID NO: 5296043 - DNA, 16 bp, Homo sapiens
caatctttcatgtctt

SEQ ID NO: 5296044 - DNA, 12 bp, Homo sapiens
caatctttctat

SEQ ID NO: 5296045 - DNA, 14 bp, Homo sapiens
caatctttgaaaga

SEQ ID NO: 5296046 - DNA, 15 bp, Homo sapiens
caatctttgaaataa

SEQ ID NO: 5296047 - DNA, 19 bp, Homo sapiens
caatctttgaaataaaaaa

SEQ ID NO: 5296048 - DNA, 14 bp, Homo sapiens
caatctttgctgta

SEQ ID NO: 5296049 - DNA, 12 bp, Homo sapiens
caatgaaaacaa

SEQ ID NO: 5296050 - DNA, 22 bp, Homo sapiens
caatgaaaacaaataaaagttg

SEQ ID NO: 5296051 - DNA, 20 bp, Homo sapiens
caatgaaaacatgtactaca

SEQ ID NO: 5296052 - DNA, 19 bp, Homo sapiens
caatgaaaactctttgctg

SEQ ID NO: 5296053 - DNA, 20 bp, Homo sapiens
caatgaaaactctttgctgc

SEQ ID NO: 5296054 - DNA, 22 bp, Homo sapiens
caatgaaaagaaaatgtgccat

SEQ ID NO: 5296055 - DNA, 20 bp, Homo sapiens
caatgaaaagtcgttttcca

SEQ ID NO: 5296056 - DNA, 22 bp, Homo sapiens
caatgaaacagatgataaatat

SEQ ID NO: 5296057 - DNA, 16 bp, Homo sapiens
caatgaaaccttcctc

SEQ ID NO: 5296058 - DNA, 17 bp, Homo sapiens
caatgaaatactccagc

SEQ ID NO: 5296059 - DNA, 22 bp, Homo sapiens
caatgaaatactccagcacctg

SEQ ID NO: 5296060 - DNA, 20 bp, Homo sapiens
caatgaaatatttgcttatt

SEQ ID NO: 5296061 - DNA, 23 bp, Homo sapiens
caatgaaatatttgcttatttat

SEQ ID NO: 5296062 - DNA, 19 bp, Homo sapiens
caatgaaatgctctccttt

SEQ ID NO: 5296063 - DNA, 13 bp, Homo sapiens
caatgaacatctc

SEQ ID NO: 5296064 - DNA, 16 bp, Homo sapiens
caatgaactctttccc

SEQ ID NO: 5296065 - DNA, 14 bp, Homo sapiens
caatgaagaagaca

SEQ ID NO: 5296066 - DNA, 16 bp, Homo sapiens
caatgaagataaatgc

SEQ ID NO: 5296067 - DNA, 20 bp, Homo sapiens
caatgaagataaatgcttta

SEQ ID NO: 5296068 - DNA, 21 bp, Homo sapiens
caatgaagccagctcacagtg

SEQ ID NO: 5296069 - DNA, 20 bp, Homo sapiens
caatgaaggaaaacctcact

SEQ ID NO: 5296070 - DNA, 20 bp, Homo sapiens
caatgaaggaaataaaaaag

SEQ ID NO: 5296071 - DNA, 22 bp, Homo sapiens
caatgaaggatttcttattttc

SEQ ID NO: 5296072 - DNA, 19 bp, Homo sapiens
caatgaagggaaattgttt

SEQ ID NO: 5296073 - DNA, 22 bp, Homo sapiens
caatgaagtgttttacaatgat

SEQ ID NO: 5296074 - DNA, 20 bp, Homo sapiens
caatgaataaaaactcaagg

SEQ ID NO: 5296075 - DNA, 22 bp, Homo sapiens
caatgaatccccgaccccccta

SEQ ID NO: 5296076 - DNA, 14 bp, Homo sapiens
caatgaatgtatat

SEQ ID NO: 5296077 - DNA, 15 bp, Homo sapiens
caatgaattaagaaa

SEQ ID NO: 5296078 - DNA, 17 bp, Homo sapiens
caatgaattaagaaaga

SEQ ID NO: 5296079 - DNA, 14 bp, Homo sapiens
caatgaattcttca

SEQ ID NO: 5296080 - DNA, 15 bp, Homo sapiens
caatgacaaagcaga

SEQ ID NO: 5296081 - DNA, 20 bp, Homo sapiens
caatgacacccatgccagag

SEQ ID NO: 5296082 - DNA, 20 bp, Homo sapiens
caatgacactggaagggtcc

SEQ ID NO: 5296083 - DNA, 17 bp, Homo sapiens
caatgacatctcagggg

SEQ ID NO: 5296084 - DNA, 13 bp, Homo sapiens
caatgacatgaat

SEQ ID NO: 5296085 - DNA, 14 bp, Homo sapiens
caatgacatgaatt

SEQ ID NO: 5296086 - DNA, 14 bp, Homo sapiens
caatgacctttcaa

SEQ ID NO: 5296087 - DNA, 16 bp, Homo sapiens
caatgacctttcaata

SEQ ID NO: 5296088 - DNA, 14 bp, Homo sapiens
caatgactaattct

SEQ ID NO: 5296089 - DNA, 14 bp, Homo sapiens
caatgactgagcag

SEQ ID NO: 5296090 - DNA, 17 bp, Homo sapiens
caatgacttactgtaca

SEQ ID NO: 5296091 - DNA, 15 bp, Homo sapiens
caatgacttccatat

SEQ ID NO: 5296092 - DNA, 11 bp, Homo sapiens
caatgactttt

SEQ ID NO: 5296093 - DNA, 12 bp, Homo sapiens
caatgactttta

SEQ ID NO: 5296094 - DNA, 13 bp, Homo sapiens
caatgagaaaaat

SEQ ID NO: 5296095 - DNA, 20 bp, Homo sapiens
caatgagaaaaataaatgga

SEQ ID NO: 5296096 - DNA, 19 bp, Homo sapiens
caatgagacttgccttcct

SEQ ID NO: 5296097 - DNA, 15 bp, Homo sapiens
caatgagagccataa

SEQ ID NO: 5296098 - DNA, 14 bp, Homo sapiens
caatgagatgcatg

SEQ ID NO: 5296099 - DNA, 12 bp, Homo sapiens
caatgagcatgt

SEQ ID NO: 5296100 - DNA, 12 bp, Homo sapiens
caatgagctgta

SEQ ID NO: 5296101 - DNA, 16 bp, Homo sapiens
caatgagctgtatctg

SEQ ID NO: 5296102 - DNA, 12 bp, Homo sapiens
caatgagctttc

SEQ ID NO: 5296103 - DNA, 13 bp, Homo sapiens
caatgagctttct

SEQ ID NO: 5296104 - DNA, 17 bp, Homo sapiens
caatgaggtctgaaatg

SEQ ID NO: 5296105 - DNA, 18 bp, Homo sapiens
caatgaggtctgaaatgg

SEQ ID NO: 5296106 - DNA, 17 bp, Homo sapiens
attttttgatcctgtaa

SEQ ID NO: 5296107 - DNA, 14 bp, Homo sapiens
attttttgattaat

SEQ ID NO: 5296108 - DNA, 22 bp, Homo sapiens
attttttgcagtcttttgctgt

SEQ ID NO: 5296109 - DNA, 18 bp, Homo sapiens
attttttgcatcagtatt

SEQ ID NO: 5296110 - DNA, 19 bp, Homo sapiens
attttttgggccattaccc

SEQ ID NO: 5296111 - DNA, 20 bp, Homo sapiens
attttttggtggtgaaattg

SEQ ID NO: 5296112 - DNA, 14 bp, Homo sapiens
attttttgtaactc

SEQ ID NO: 5296113 - DNA, 23 bp, Homo sapiens
attttttgtaatgtgtgaaaaag

SEQ ID NO: 5296114 - DNA, 14 bp, Homo sapiens
attttttgtctgtg

SEQ ID NO: 5296115 - DNA, 18 bp, Homo sapiens
attttttgtgatgaaaag

SEQ ID NO: 5296116 - DNA, 12 bp, Homo sapiens
attttttgtgtg

SEQ ID NO: 5296117 - DNA, 14 bp, Homo sapiens
attttttgttctgt

SEQ ID NO: 5296118 - DNA, 13 bp, Homo sapiens
attttttgttctt

SEQ ID NO: 5296119 - DNA, 19 bp, Homo sapiens
attttttgttcttgttgtt

SEQ ID NO: 5296120 - DNA, 12 bp, Homo sapiens
attttttgttga

SEQ ID NO: 5296121 - DNA, 20 bp, Homo sapiens
attttttgttgaataggaaa

SEQ ID NO: 5296122 - DNA, 16 bp, Homo sapiens
attttttgttgacatt

SEQ ID NO: 5296123 - DNA, 21 bp, Homo sapiens
attttttgttgacattagtct

SEQ ID NO: 5296124 - DNA, 19 bp, Homo sapiens
attttttgtttgtattgta

SEQ ID NO: 5296125 - DNA, 18 bp, Homo sapiens
atttttttaaaatgttaa

SEQ ID NO: 5296126 - DNA, 21 bp, Homo sapiens
atttttttaaacaaaatttca

SEQ ID NO: 5296127 - DNA, 13 bp, Homo sapiens
atttttttaaaga

SEQ ID NO: 5296128 - DNA, 18 bp, Homo sapiens
atttttttaaagaaaact

SEQ ID NO: 5296129 - DNA, 17 bp, Homo sapiens
atttttttaaagtagtt

SEQ ID NO: 5296130 - DNA, 18 bp, Homo sapiens
atttttttaaagtagttc

SEQ ID NO: 5296131 - DNA, 20 bp, Homo sapiens
atttttttaaagtagttcct

SEQ ID NO: 5296132 - DNA, 14 bp, Homo sapiens
atttttttaaatca

SEQ ID NO: 5296133 - DNA, 19 bp, Homo sapiens
atttttttaaccaaaggtg

SEQ ID NO: 5296134 - DNA, 19 bp, Homo sapiens
atttttttaactacataaa

SEQ ID NO: 5296135 - DNA, 19 bp, Homo sapiens
atttttttaactgaaaatg

SEQ ID NO: 5296136 - DNA, 21 bp, Homo sapiens
atttttttaactgaaaatgta

SEQ ID NO: 5296137 - DNA, 18 bp, Homo sapiens
atttttttaagaaaaaag

SEQ ID NO: 5296138 - DNA, 18 bp, Homo sapiens
atttttttaagctgtaaa

SEQ ID NO: 5296139 - DNA, 16 bp, Homo sapiens
atttttttaatttctg

SEQ ID NO: 5296140 - DNA, 16 bp, Homo sapiens
atttttttaattttgt

SEQ ID NO: 5296141 - DNA, 17 bp, Homo sapiens
atttttttaccaattcc

SEQ ID NO: 5296142 - DNA, 19 bp, Homo sapiens
atttttttaccaattccaa

SEQ ID NO: 5296143 - DNA, 18 bp, Homo sapiens
atttttttattgtttaaa

SEQ ID NO: 5296144 - DNA, 15 bp, Homo sapiens
atttttttcaatatt

SEQ ID NO: 5296145 - DNA, 22 bp, Homo sapiens
atttttttcactggagttacat

SEQ ID NO: 5296146 - DNA, 15 bp, Homo sapiens
atttttttcagtatt

SEQ ID NO: 5296147 - DNA, 13 bp, Homo sapiens
atttttttccaag

SEQ ID NO: 5296148 - DNA, 19 bp, Homo sapiens
atttttttccaagtgtata

SEQ ID NO: 5296149 - DNA, 21 bp, Homo sapiens
atttttttccaagtgtataat

SEQ ID NO: 5296150 - DNA, 13 bp, Homo sapiens
atttttttcccaa

SEQ ID NO: 5296151 - DNA, 19 bp, Homo sapiens
atttttttcctaagacatt

SEQ ID NO: 5296152 - DNA, 12 bp, Homo sapiens
atttttttcctg

SEQ ID NO: 5296153 - DNA, 21 bp, Homo sapiens
atttttttccttacataaaca

SEQ ID NO: 5296154 - DNA, 17 bp, Homo sapiens
atttttttcctttgcat

SEQ ID NO: 5296155 - DNA, 21 bp, Homo sapiens
atttttttcctttgcattcat

SEQ ID NO: 5296156 - DNA, 15 bp, Homo sapiens
atttttttctaccta

SEQ ID NO: 5296157 - DNA, 13 bp, Homo sapiens
atttttttctagc

SEQ ID NO: 5296158 - DNA, 22 bp, Homo sapiens
atttttttctagctataacaac

SEQ ID NO: 5296159 - DNA, 13 bp, Homo sapiens
atttttttctatt

SEQ ID NO: 5296160 - DNA, 13 bp, Homo sapiens
atttttttctccc

SEQ ID NO: 5296161 - DNA, 15 bp, Homo sapiens
atttttttctgaatt

SEQ ID NO: 5296162 - DNA, 14 bp, Homo sapiens
atttttttctgatt

SEQ ID NO: 5296163 - DNA, 20 bp, Homo sapiens
atttttttctgatttgtcct

SEQ ID NO: 5296164 - DNA, 16 bp, Homo sapiens
atttttttctgcacag

SEQ ID NO: 5296165 - DNA, 22 bp, Homo sapiens
atttttttctgcacagcttttc

SEQ ID NO: 5296166 - DNA, 18 bp, Homo sapiens
atttttttctgtaaaagt

SEQ ID NO: 5296167 - DNA, 15 bp, Homo sapiens
atttttttcttgtag

SEQ ID NO: 5296168 - DNA, 17 bp, Homo sapiens
atttttttgatggctaa

SEQ ID NO: 5296169 - DNA, 23 bp, Homo sapiens
atttttttgcatgcatgcaaatg

SEQ ID NO: 5296170 - DNA, 16 bp, Homo sapiens
atttttttgtaaagga

SEQ ID NO: 5296171 - DNA, 21 bp, Homo sapiens
atttttttgtaaaggaaataa

SEQ ID NO: 5296172 - DNA, 15 bp, Homo sapiens
atttttttgtaaggg

SEQ ID NO: 5296173 - DNA, 15 bp, Homo sapiens
atttttttgtaataa

SEQ ID NO: 5296174 - DNA, 19 bp, Homo sapiens
atttttttgtaataagcaa

SEQ ID NO: 5296175 - DNA, 18 bp, Homo sapiens
atttttttgtaattgctt

SEQ ID NO: 5296176 - DNA, 14 bp, Homo sapiens
atttttttgtattt

SEQ ID NO: 5296177 - DNA, 20 bp, Homo sapiens
atttttttgttcttgttgta

SEQ ID NO: 5296178 - DNA, 15 bp, Homo sapiens
atttttttgttgctg

SEQ ID NO: 5296179 - DNA, 15 bp, Homo sapiens
attttttttaaacaa

SEQ ID NO: 5296180 - DNA, 17 bp, Homo sapiens
attttttttaaatcaaa

SEQ ID NO: 5296181 - DNA, 18 bp, Homo sapiens
attttttttaaatcaaaa

SEQ ID NO: 5296182 - DNA, 19 bp, Homo sapiens
attttttttaaatcaaaaa

SEQ ID NO: 5296183 - DNA, 21 bp, Homo sapiens
attttttttaagttcactttt

SEQ ID NO: 5296184 - DNA, 18 bp, Homo sapiens
attttttttaatgcttaa

SEQ ID NO: 5296185 - DNA, 15 bp, Homo sapiens
attttttttaatgta

SEQ ID NO: 5296186 - DNA, 14 bp, Homo sapiens
attttttttacatt

SEQ ID NO: 5296187 - DNA, 14 bp, Homo sapiens
attttttttatatt

SEQ ID NO: 5296188 - DNA, 17 bp, Homo sapiens
attttttttatatttat

SEQ ID NO: 5296189 - DNA, 20 bp, Homo sapiens
attttttttatcatgtcgta

SEQ ID NO: 5296190 - DNA, 16 bp, Homo sapiens
attttttttattagta

SEQ ID NO: 5296191 - DNA, 20 bp, Homo sapiens
attttttttcaaaaatgctg

SEQ ID NO: 5296192 - DNA, 17 bp, Homo sapiens
attttttttcaaaatga

SEQ ID NO: 5296193 - DNA, 22 bp, Homo sapiens
attttttttcaaacaagtatga

SEQ ID NO: 5296194 - DNA, 22 bp, Homo sapiens
attttttttcatgctttatcaa

SEQ ID NO: 5296195 - DNA, 20 bp, Homo sapiens
attttttttcatgttttaac

SEQ ID NO: 5296196 - DNA, 19 bp, Homo sapiens
attttttttccgtaaatgt

SEQ ID NO: 5296197 - DNA, 21 bp, Homo sapiens
attttttttccgtgtgtttat

SEQ ID NO: 5296198 - DNA, 14 bp, Homo sapiens
attttttttctgta

SEQ ID NO: 5296199 - DNA, 15 bp, Homo sapiens
attttttttctgtta

SEQ ID NO: 5296200 - DNA, 18 bp, Homo sapiens
attttttttctgttatat

SEQ ID NO: 5296201 - DNA, 19 bp, Homo sapiens
attttttttctgttatata

SEQ ID NO: 5296202 - DNA, 21 bp, Homo sapiens
attttttttctttgaataaat

SEQ ID NO: 5296203 - DNA, 18 bp, Homo sapiens
attttttttggcctgttt

SEQ ID NO: 5296204 - DNA, 18 bp, Homo sapiens
attttttttggtcaaatt

SEQ ID NO: 5296205 - DNA, 14 bp, Homo sapiens
attttttttggttg

SEQ ID NO: 5296206 - DNA, 15 bp, Homo sapiens
attttttttgtaact

SEQ ID NO: 5296207 - DNA, 16 bp, Homo sapiens
attttttttgtaactt

SEQ ID NO: 5296208 - DNA, 23 bp, Homo sapiens
attttttttgtacatttggaaca

SEQ ID NO: 5296209 - DNA, 15 bp, Homo sapiens
attttttttgtagct

SEQ ID NO: 5296210 - DNA, 17 bp, Homo sapiens
attttttttgtggttat

SEQ ID NO: 5296211 - DNA, 22 bp, Homo sapiens
attttttttgttgtttcagtga

SEQ ID NO: 5296212 - DNA, 15 bp, Homo sapiens
attttttttgtttca

SEQ ID NO: 5296213 - DNA, 21 bp, Homo sapiens
attttttttgttttttgtaac

SEQ ID NO: 5296214 - DNA, 24 bp, Homo sapiens
attttttttgttttttgtaactac

SEQ ID NO: 5296215 - DNA, 21 bp, Homo sapiens
atttttttttagaacagaaaa

SEQ ID NO: 5296216 - DNA, 20 bp, Homo sapiens
atttttttttattttgcttt

SEQ ID NO: 5296217 - DNA, 15 bp, Homo sapiens
atttttttttcaatc

SEQ ID NO: 5296218 - DNA, 20 bp, Homo sapiens
atttttttttcatacactta

SEQ ID NO: 5296219 - DNA, 23 bp, Homo sapiens
atttttttttcatagagatttgt

SEQ ID NO: 5296220 - DNA, 17 bp, Homo sapiens
atttttttttccttcag

SEQ ID NO: 5296221 - DNA, 20 bp, Homo sapiens
atttttttttccttcagtgc

SEQ ID NO: 5296222 - DNA, 19 bp, Homo sapiens
atttttttttctaagagaa

SEQ ID NO: 5296223 - DNA, 15 bp, Homo sapiens
atttttttttctctt

SEQ ID NO: 5296224 - DNA, 18 bp, Homo sapiens
atttttttttctctttta

SEQ ID NO: 5296225 - DNA, 17 bp, Homo sapiens
attttttttttaaaact

SEQ ID NO: 5296226 - DNA, 18 bp, Homo sapiens
attttttttttaaaacta

SEQ ID NO: 5296227 - DNA, 22 bp, Homo sapiens
attttttttttaaataaaagca

SEQ ID NO: 5296228 - DNA, 21 bp, Homo sapiens
attttttttttaacttgaaaa

SEQ ID NO: 5296229 - DNA, 23 bp, Homo sapiens
attttttttttaatctcctgagt

SEQ ID NO: 5296230 - DNA, 15 bp, Homo sapiens
attttttttttcagg

SEQ ID NO: 5296231 - DNA, 23 bp, Homo sapiens
attttttttttcaggttaaatta

SEQ ID NO: 5296232 - DNA, 21 bp, Homo sapiens
attttttttttcctcttcaga

SEQ ID NO: 5296233 - DNA, 18 bp, Homo sapiens
atttttttttttaatcta

SEQ ID NO: 5296234 - DNA, 23 bp, Homo sapiens
atttttttttttgtttctgagaa

SEQ ID NO: 5296235 - DNA, 23 bp, Homo sapiens
atttttttttttttcacaatgtg

SEQ ID NO: 5296236 - DNA, 19 bp, Homo sapiens
caaaaaaaaaaaaaaatta

SEQ ID NO: 5296237 - DNA, 18 bp, Homo sapiens
caaaaaaaaaatagagag

SEQ ID NO: 5296238 - DNA, 14 bp, Homo sapiens
caaaaaaaaaatga

SEQ ID NO: 5296239 - DNA, 13 bp, Homo sapiens
caaaaaaaaactt

SEQ ID NO: 5296240 - DNA, 20 bp, Homo sapiens
caaaaaaaaacttaaagcaa

SEQ ID NO: 5296241 - DNA, 21 bp, Homo sapiens
caaaaaaaaacttaaagcaaa

SEQ ID NO: 5296242 - DNA, 20 bp, Homo sapiens
caaaaaaaaagttttatttt

SEQ ID NO: 5296243 - DNA, 19 bp, Homo sapiens
caaaaaaaatttagccggg

SEQ ID NO: 5296244 - DNA, 16 bp, Homo sapiens
caaaaaaacactagtt

SEQ ID NO: 5296245 - DNA, 17 bp, Homo sapiens
caaaaaaaccacaaagg

SEQ ID NO: 5296246 - DNA, 23 bp, Homo sapiens
caaaaaaacctcttaatattctg

SEQ ID NO: 5296247 - DNA, 21 bp, Homo sapiens
caaaaaaacctttattcttta

SEQ ID NO: 5296248 - DNA, 21 bp, Homo sapiens
caaaaaaagcaacttttccaa

SEQ ID NO: 5296249 - DNA, 12 bp, Homo sapiens
caaaaaaaggaa

SEQ ID NO: 5296250 - DNA, 13 bp, Homo sapiens
caaaaaaaggaaa

SEQ ID NO: 5296251 - DNA, 16 bp, Homo sapiens
caaaaaaaggaaaaat

SEQ ID NO: 5296252 - DNA, 17 bp, Homo sapiens
caaaaaaaggaaaaata

SEQ ID NO: 5296253 - DNA, 19 bp, Homo sapiens
caaaaaaagggcaataaat

SEQ ID NO: 5296254 - DNA, 10 bp, Homo sapiens
caaaaaaagt

SEQ ID NO: 5296255 - DNA, 12 bp, Homo sapiens
caaaaaaagttg

SEQ ID NO: 5296256 - DNA, 15 bp, Homo sapiens
caaaaaaagttgtat

SEQ ID NO: 5296257 - DNA, 18 bp, Homo sapiens
caaaaaaagttgtatgat

SEQ ID NO: 5296258 - DNA, 15 bp, Homo sapiens
caaaaaaatactgcc

SEQ ID NO: 5296259 - DNA, 23 bp, Homo sapiens
caaaaaaatactgccagatgctg

SEQ ID NO: 5296260 - DNA, 16 bp, Homo sapiens
caaaaaaatccagaaa

SEQ ID NO: 5296261 - DNA, 18 bp, Homo sapiens
caaaaaaatttaaaatta

SEQ ID NO: 5296262 - DNA, 23 bp, Homo sapiens
caaaaaacaatatttattgtatt

SEQ ID NO: 5296263 - DNA, 12 bp, Homo sapiens
caaaaaacagat

SEQ ID NO: 5296264 - DNA, 15 bp, Homo sapiens
caaaaaactacttct

SEQ ID NO: 5296265 - DNA, 21 bp, Homo sapiens
caaaaaactcgaggactgtat

SEQ ID NO: 5296266 - DNA, 20 bp, Homo sapiens
caaaaaactctctcccagga

SEQ ID NO: 5296267 - DNA, 13 bp, Homo sapiens
caaaaaactgcag

SEQ ID NO: 5296268 - DNA, 22 bp, Homo sapiens
caaaaaacttttaatgccttcc

SEQ ID NO: 5296269 - DNA, 20 bp, Homo sapiens
caaaaaagaaaagtagaaag

SEQ ID NO: 5296270 - DNA, 12 bp, Homo sapiens
caaaaaagaaag

SEQ ID NO: 5296271 - DNA, 12 bp, Homo sapiens
caaaaaagaaca

SEQ ID NO: 5296272 - DNA, 16 bp, Homo sapiens
caaaaaagattactag

SEQ ID NO: 5296273 - DNA, 12 bp, Homo sapiens
caaaaaagcgaa

SEQ ID NO: 5296274 - DNA, 15 bp, Homo sapiens
caaaaaagggacagc

SEQ ID NO: 5296275 - DNA, 18 bp, Homo sapiens
caaaaaagtccaatttta

SEQ ID NO: 5296276 - DNA, 15 bp, Homo sapiens
caaaaaagttataag

SEQ ID NO: 5296277 - DNA, 11 bp, Homo sapiens
caaaaaataaa

SEQ ID NO: 5296278 - DNA, 14 bp, Homo sapiens
caaaaaataaagaa

SEQ ID NO: 5296279 - DNA, 13 bp, Homo sapiens
caaaaaataaatt

SEQ ID NO: 5296280 - DNA, 23 bp, Homo sapiens
caaaaaatatctagtaatatatt

SEQ ID NO: 5296281 - DNA, 13 bp, Homo sapiens
caaaaaatcatgt

SEQ ID NO: 5296282 - DNA, 18 bp, Homo sapiens
caaaaaatcatgtttatt

SEQ ID NO: 5296283 - DNA, 16 bp, Homo sapiens
caaaaaatgcttgctt

SEQ ID NO: 5296284 - DNA, 15 bp, Homo sapiens
caatgaggtggctca

SEQ ID NO: 5296285 - DNA, 19 bp, Homo sapiens
caatgagtaaaatcacaga

SEQ ID NO: 5296286 - DNA, 16 bp, Homo sapiens
caatgagtctgtaatt

SEQ ID NO: 5296287 - DNA, 21 bp, Homo sapiens
caatgagtctgtaattttacg

SEQ ID NO: 5296288 - DNA, 15 bp, Homo sapiens
caatgagtgtgccag

SEQ ID NO: 5296289 - DNA, 13 bp, Homo sapiens
caatgataaataa

SEQ ID NO: 5296290 - DNA, 14 bp, Homo sapiens
caatgataaataaa

SEQ ID NO: 5296291 - DNA, 22 bp, Homo sapiens
caatgatacccaacagtttatt

SEQ ID NO: 5296292 - DNA, 13 bp, Homo sapiens
caatgatatagga

SEQ ID NO: 5296293 - DNA, 19 bp, Homo sapiens
caatgatcacatctaaagc

SEQ ID NO: 5296294 - DNA, 14 bp, Homo sapiens
caatgatcagactt

SEQ ID NO: 5296295 - DNA, 22 bp, Homo sapiens
caatgatctaggtttaactcag

SEQ ID NO: 5296296 - DNA, 23 bp, Homo sapiens
caatgatctaggtttaactcaga

SEQ ID NO: 5296297 - DNA, 22 bp, Homo sapiens
caatgatgattaaacacctgac

SEQ ID NO: 5296298 - DNA, 18 bp, Homo sapiens
caatgatgctatttgcaa

SEQ ID NO: 5296299 - DNA, 16 bp, Homo sapiens
caatgatggcaatttt

SEQ ID NO: 5296300 - DNA, 21 bp, Homo sapiens
caatgatggcaattttgtaac

SEQ ID NO: 5296301 - DNA, 17 bp, Homo sapiens
caatgatggtttaatag

SEQ ID NO: 5296302 - DNA, 13 bp, Homo sapiens
caatgatgtgacc

SEQ ID NO: 5296303 - DNA, 23 bp, Homo sapiens
caatgatgtgaccctcaatccca

SEQ ID NO: 5296304 - DNA, 21 bp, Homo sapiens
caatgatgtgagtacccagga

SEQ ID NO: 5296305 - DNA, 13 bp, Homo sapiens
caatgattatttt

SEQ ID NO: 5296306 - DNA, 15 bp, Homo sapiens
caatgattattttca

SEQ ID NO: 5296307 - DNA, 15 bp, Homo sapiens
caatgattcataaca

SEQ ID NO: 5296308 - DNA, 15 bp, Homo sapiens
caatgattgttaatt

SEQ ID NO: 5296309 - DNA, 22 bp, Homo sapiens
caatgattgttaatttacagct

SEQ ID NO: 5296310 - DNA, 14 bp, Homo sapiens
caatgatttggcca

SEQ ID NO: 5296311 - DNA, 20 bp, Homo sapiens
caatgatttggccaggccta

SEQ ID NO: 5296312 - DNA, 13 bp, Homo sapiens
caatgatttgtaa

SEQ ID NO: 5296313 - DNA, 14 bp, Homo sapiens
caatgatttgtaaa

SEQ ID NO: 5296314 - DNA, 19 bp, Homo sapiens
caatgcaaaagccaagaaa

SEQ ID NO: 5296315 - DNA, 22 bp, Homo sapiens
caatgcaaaagccaagaaagta

SEQ ID NO: 5296316 - DNA, 18 bp, Homo sapiens
caatgcaaaccatcattg

SEQ ID NO: 5296317 - DNA, 20 bp, Homo sapiens
caatgcaaaccatcattgaa

SEQ ID NO: 5296318 - DNA, 21 bp, Homo sapiens
caatgcaaaccatcattgaaa

SEQ ID NO: 5296319 - DNA, 12 bp, Homo sapiens
caatgcaacatt

SEQ ID NO: 5296320 - DNA, 16 bp, Homo sapiens
caatgcaacctctgcc

SEQ ID NO: 5296321 - DNA, 18 bp, Homo sapiens
caatgcaagacgccctct

SEQ ID NO: 5296322 - DNA, 14 bp, Homo sapiens
caatgcaatgcatc

SEQ ID NO: 5296323 - DNA, 16 bp, Homo sapiens
caatgcacacacacag

SEQ ID NO: 5296324 - DNA, 18 bp, Homo sapiens
caatgcacacacacagag

SEQ ID NO: 5296325 - DNA, 13 bp, Homo sapiens
caatgcacatcca

SEQ ID NO: 5296326 - DNA, 16 bp, Homo sapiens
caatgcacatggtgca

SEQ ID NO: 5296327 - DNA, 18 bp, Homo sapiens
caatgcacctaaagaaaa

SEQ ID NO: 5296328 - DNA, 14 bp, Homo sapiens
caatgcactgacat

SEQ ID NO: 5296329 - DNA, 17 bp, Homo sapiens
caatgcacttttatgaa

SEQ ID NO: 5296330 - DNA, 21 bp, Homo sapiens
caatgcacttttatgaagttt

SEQ ID NO: 5296331 - DNA, 17 bp, Homo sapiens
caatgcagatgccagag

SEQ ID NO: 5296332 - DNA, 13 bp, Homo sapiens
caatgcagtcagt

SEQ ID NO: 5296333 - DNA, 15 bp, Homo sapiens
caatgcagtgcagca

SEQ ID NO: 5296334 - DNA, 18 bp, Homo sapiens
caatgcataatgtcttta

SEQ ID NO: 5296335 - DNA, 17 bp, Homo sapiens
caatgcatacaataaaa

SEQ ID NO: 5296336 - DNA, 19 bp, Homo sapiens
caatgcatacaataaaaga

SEQ ID NO: 5296337 - DNA, 22 bp, Homo sapiens
caatgcatagagccctggccag

SEQ ID NO: 5296338 - DNA, 22 bp, Homo sapiens
caatgcatatatgaaaacaata

SEQ ID NO: 5296339 - DNA, 14 bp, Homo sapiens
caatgcatgatgac

SEQ ID NO: 5296340 - DNA, 15 bp, Homo sapiens
caatgcatgatgact

SEQ ID NO: 5296341 - DNA, 20 bp, Homo sapiens
caatgcatgcagccactgtg

SEQ ID NO: 5296342 - DNA, 22 bp, Homo sapiens
caatgcatgtgctgtctccatg

SEQ ID NO: 5296343 - DNA, 22 bp, Homo sapiens
caatgcattaccttctgttcct

SEQ ID NO: 5296344 - DNA, 21 bp, Homo sapiens
caatgcattggcctctgtacc

SEQ ID NO: 5296345 - DNA, 13 bp, Homo sapiens
caatgcatttaaa

SEQ ID NO: 5296346 - DNA, 16 bp, Homo sapiens
caatgcattttcaaga

SEQ ID NO: 5296347 - DNA, 15 bp, Homo sapiens
caatgccacagccaa

SEQ ID NO: 5296348 - DNA, 16 bp, Homo sapiens
caatgccacagccaag

SEQ ID NO: 5296349 - DNA, 15 bp, Homo sapiens
caatgccacagccct

SEQ ID NO: 5296350 - DNA, 20 bp, Homo sapiens
caatgccacatacttgcagc

SEQ ID NO: 5296351 - DNA, 17 bp, Homo sapiens
caatgccacctagactc

SEQ ID NO: 5296352 - DNA, 17 bp, Homo sapiens
caatgccagaccgcaga

SEQ ID NO: 5296353 - DNA, 18 bp, Homo sapiens
caatgccagggcccagga

SEQ ID NO: 5296354 - DNA, 16 bp, Homo sapiens
caatgccatcagcccc

SEQ ID NO: 5296355 - DNA, 18 bp, Homo sapiens
caatgccatcagcccctg

SEQ ID NO: 5296356 - DNA, 18 bp, Homo sapiens
caatgccatcctcaaaca

SEQ ID NO: 5296357 - DNA, 15 bp, Homo sapiens
caatgccatgaacaa

SEQ ID NO: 5296358 - DNA, 17 bp, Homo sapiens
caatgccattgtgcaga

SEQ ID NO: 5296359 - DNA, 19 bp, Homo sapiens
caatgcccagtaaaatttc

SEQ ID NO: 5296360 - DNA, 17 bp, Homo sapiens
caatgccccctcccctc

SEQ ID NO: 5296361 - DNA, 21 bp, Homo sapiens
caatgccccctcccctccttt

SEQ ID NO: 5296362 - DNA, 21 bp, Homo sapiens
caatgcccgtaagatggctta

SEQ ID NO: 5296363 - DNA, 20 bp, Homo sapiens
caatgcccgtaatgcttaga

SEQ ID NO: 5296364 - DNA, 16 bp, Homo sapiens
caatgccctacctgcc

SEQ ID NO: 5296365 - DNA, 11 bp, Homo sapiens
caatgccctgc

SEQ ID NO: 5296366 - DNA, 13 bp, Homo sapiens
caatgccctgcca

SEQ ID NO: 5296367 - DNA, 15 bp, Homo sapiens
caatgccctgccatt

SEQ ID NO: 5296368 - DNA, 13 bp, Homo sapiens
caatgccctgcct

SEQ ID NO: 5296369 - DNA, 18 bp, Homo sapiens
caatgccctgcggctctg

SEQ ID NO: 5296370 - DNA, 20 bp, Homo sapiens
caatgccctgcggctctgga

SEQ ID NO: 5296371 - DNA, 22 bp, Homo sapiens
caatgccctgcggctctggaaa

SEQ ID NO: 5296372 - DNA, 15 bp, Homo sapiens
caatgccctgctggc

SEQ ID NO: 5296373 - DNA, 20 bp, Homo sapiens
caatgccgccgtgtttcctc

SEQ ID NO: 5296374 - DNA, 16 bp, Homo sapiens
caatgccgcctgtcaa

SEQ ID NO: 5296375 - DNA, 23 bp, Homo sapiens
caatgccgcctgtcaataaatgt

SEQ ID NO: 5296376 - DNA, 18 bp, Homo sapiens
caatgcctagactgtgta

SEQ ID NO: 5296377 - DNA, 14 bp, Homo sapiens
caatgcctctccca

SEQ ID NO: 5296378 - DNA, 15 bp, Homo sapiens
caatgcctctcccac

SEQ ID NO: 5296379 - DNA, 21 bp, Homo sapiens
caatgccttgacaacagactg

SEQ ID NO: 5296380 - DNA, 23 bp, Homo sapiens
caatgccttgacaacagactgaa

SEQ ID NO: 5296381 - DNA, 12 bp, Homo sapiens
caatgccttggg

SEQ ID NO: 5296382 - DNA, 17 bp, Homo sapiens
caatgcctttttagatg

SEQ ID NO: 5296383 - DNA, 20 bp, Homo sapiens
caatgcctttttagatgtat

SEQ ID NO: 5296384 - DNA, 22 bp, Homo sapiens
caatgcggcccactttcctgag

SEQ ID NO: 5296385 - DNA, 23 bp, Homo sapiens
caatgcggcccactttcctgagc

SEQ ID NO: 5296386 - DNA, 17 bp, Homo sapiens
caatgcgtcttgtgaaa

SEQ ID NO: 5296387 - DNA, 23 bp, Homo sapiens
caatgcgtcttgtgaaattgtgt

SEQ ID NO: 5296388 - DNA, 12 bp, Homo sapiens
caatgcgtggca

SEQ ID NO: 5296389 - DNA, 14 bp, Homo sapiens
caatgcgtgttgta

SEQ ID NO: 5296390 - DNA, 20 bp, Homo sapiens
caatgctacaaaatgtgtgc

SEQ ID NO: 5296391 - DNA, 17 bp, Homo sapiens
caatgctatcactgtct

SEQ ID NO: 5296392 - DNA, 17 bp, Homo sapiens
caatgctatggactgca

SEQ ID NO: 5296393 - DNA, 20 bp, Homo sapiens
caatgctattgaaattactg

SEQ ID NO: 5296394 - DNA, 20 bp, Homo sapiens
caatgctgatgaatcactgt

SEQ ID NO: 5296395 - DNA, 20 bp, Homo sapiens
caatgctgatgtcctcacca

SEQ ID NO: 5296396 - DNA, 19 bp, Homo sapiens
caatgctgcaggatggact

SEQ ID NO: 5296397 - DNA, 16 bp, Homo sapiens
caatgctgccatgccc

SEQ ID NO: 5296398 - DNA, 19 bp, Homo sapiens
caatgctgctccaccctcc

SEQ ID NO: 5296399 - DNA, 11 bp, Homo sapiens
caatgctgctt

SEQ ID NO: 5296400 - DNA, 13 bp, Homo sapiens
caatgctgctttt

SEQ ID NO: 5296401 - DNA, 13 bp, Homo sapiens
caatgctggctgt

SEQ ID NO: 5296402 - DNA, 20 bp, Homo sapiens
caatgctggctgttggctgg

SEQ ID NO: 5296403 - DNA, 13 bp, Homo sapiens
caatgctgggccc

SEQ ID NO: 5296404 - DNA, 13 bp, Homo sapiens
caatgctgggtgg

SEQ ID NO: 5296405 - DNA, 15 bp, Homo sapiens
caatgctgtacctgg

SEQ ID NO: 5296406 - DNA, 14 bp, Homo sapiens
caatgctgtacgta

SEQ ID NO: 5296407 - DNA, 13 bp, Homo sapiens
caatgctgtgaat

SEQ ID NO: 5296408 - DNA, 13 bp, Homo sapiens
caatgcttaaact

SEQ ID NO: 5296409 - DNA, 20 bp, Homo sapiens
caatgcttaaactaaataat

SEQ ID NO: 5296410 - DNA, 21 bp, Homo sapiens
caatgcttaaactaaataatg

SEQ ID NO: 5296411 - DNA, 18 bp, Homo sapiens
caatgcttctagagtttt

SEQ ID NO: 5296412 - DNA, 19 bp, Homo sapiens
caatgcttcttttagtcag

SEQ ID NO: 5296413 - DNA, 21 bp, Homo sapiens
caatgcttcttttagtcagaa

SEQ ID NO: 5296414 - DNA, 22 bp, Homo sapiens
caatgcttgcatggagaatggg

SEQ ID NO: 5296415 - DNA, 20 bp, Homo sapiens
caatgcttgtagaagtagga

SEQ ID NO: 5296416 - DNA, 13 bp, Homo sapiens
caatgctttgata

SEQ ID NO: 5296417 - DNA, 19 bp, Homo sapiens
caatgctttgataaaatat

SEQ ID NO: 5296418 - DNA, 22 bp, Homo sapiens
caatgctttgataaaatatttt

SEQ ID NO: 5296419 - DNA, 20 bp, Homo sapiens
caatgcttttatatggccca

SEQ ID NO: 5296420 - DNA, 22 bp, Homo sapiens
caatggaaaacctgggggatgg

SEQ ID NO: 5296421 - DNA, 23 bp, Homo sapiens
caatggaaaacctgggggatggt

SEQ ID NO: 5296422 - DNA, 17 bp, Homo sapiens
caatggaaacagggcag

SEQ ID NO: 5296423 - DNA, 19 bp, Homo sapiens
caatggaaacagggcagtg

SEQ ID NO: 5296424 - DNA, 17 bp, Homo sapiens
caatggaaacctcacgc

SEQ ID NO: 5296425 - DNA, 15 bp, Homo sapiens
caatggaaactgaat

SEQ ID NO: 5296426 - DNA, 15 bp, Homo sapiens
caatggaaactttag

SEQ ID NO: 5296427 - DNA, 14 bp, Homo sapiens
caatggaacctcct

SEQ ID NO: 5296428 - DNA, 16 bp, Homo sapiens
caatggaacctccttt

SEQ ID NO: 5296429 - DNA, 17 bp, Homo sapiens
caatggaacctcctttc

SEQ ID NO: 5296430 - DNA, 21 bp, Homo sapiens
caatggaagaagaaaggactg

SEQ ID NO: 5296431 - DNA, 17 bp, Homo sapiens
caatggaagatttgccc

SEQ ID NO: 5296432 - DNA, 14 bp, Homo sapiens
caatggacaagcag

SEQ ID NO: 5296433 - DNA, 19 bp, Homo sapiens
caatggacctctcagcaga

SEQ ID NO: 5296434 - DNA, 15 bp, Homo sapiens
caatggagaaatgaa

SEQ ID NO: 5296435 - DNA, 18 bp, Homo sapiens
caatggagaaatgaagca

SEQ ID NO: 5296436 - DNA, 22 bp, Homo sapiens
caatggagtagacccctggctg

SEQ ID NO: 5296437 - DNA, 23 bp, Homo sapiens
caatggagtagacccctggctgg

SEQ ID NO: 5296438 - DNA, 17 bp, Homo sapiens
caatggagtctgcagtg

SEQ ID NO: 5296439 - DNA, 14 bp, Homo sapiens
caatggataaatca

SEQ ID NO: 5296440 - DNA, 16 bp, Homo sapiens
caatggataaatcagt

SEQ ID NO: 5296441 - DNA, 18 bp, Homo sapiens
caatggatcagccaaggc

SEQ ID NO: 5296442 - DNA, 17 bp, Homo sapiens
caatggattcatggagt

SEQ ID NO: 5296443 - DNA, 13 bp, Homo sapiens
caatggatttgat

SEQ ID NO: 5296444 - DNA, 17 bp, Homo sapiens
caatggatttgatgctg

SEQ ID NO: 5296445 - DNA, 20 bp, Homo sapiens
caatggcacgatctcagctc

SEQ ID NO: 5296446 - DNA, 21 bp, Homo sapiens
caatggcagcattcccaccaa

SEQ ID NO: 5296447 - DNA, 13 bp, Homo sapiens
caatggcagcctt

SEQ ID NO: 5296448 - DNA, 14 bp, Homo sapiens
caatggcagccttg

SEQ ID NO: 5296449 - DNA, 18 bp, Homo sapiens
caatggcagctagactgg

SEQ ID NO: 5296450 - DNA, 19 bp, Homo sapiens
caatggcagctagactgga

SEQ ID NO: 5296451 - DNA, 22 bp, Homo sapiens
caatggcagctagactggagtg

SEQ ID NO: 5296452 - DNA, 12 bp, Homo sapiens
caatggccagag

SEQ ID NO: 5296453 - DNA, 22 bp, Homo sapiens
caatggccagagcctctggccc

SEQ ID NO: 5296454 - DNA, 12 bp, Homo sapiens
caatggccaggg

SEQ ID NO: 5296455 - DNA, 16 bp, Homo sapiens
caatggccaggggcca

SEQ ID NO: 5296456 - DNA, 15 bp, Homo sapiens
caatggcctaaactt

SEQ ID NO: 5296457 - DNA, 11 bp, Homo sapiens
caatggccttt

SEQ ID NO: 5296458 - DNA, 18 bp, Homo sapiens
caatggcgcagtgcctct

SEQ ID NO: 5296459 - DNA, 17 bp, Homo sapiens
caatggcgcctgctccc

SEQ ID NO: 5296460 - DNA, 14 bp, Homo sapiens
caatggcgctgtgc

SEQ ID NO: 5296461 - DNA, 18 bp, Homo sapiens
caatggctaattcccaga

SEQ ID NO: 5296462 - DNA, 19 bp, Homo sapiens
caatggctacctaaaaaga

SEQ ID NO: 5296463 - DNA, 15 bp, Homo sapiens
caaaaaatgttttaa

SEQ ID NO: 5296464 - DNA, 18 bp, Homo sapiens
caaaaaattaaagcattt

SEQ ID NO: 5296465 - DNA, 16 bp, Homo sapiens
caaaaaattagccaag

SEQ ID NO: 5296466 - DNA, 11 bp, Homo sapiens
caaaaaattat

SEQ ID NO: 5296467 - DNA, 13 bp, Homo sapiens
caaaaaattatat

SEQ ID NO: 5296468 - DNA, 15 bp, Homo sapiens
caaaaaatttaagag

SEQ ID NO: 5296469 - DNA, 13 bp, Homo sapiens
caaaaacaaaaaa

SEQ ID NO: 5296470 - DNA, 17 bp, Homo sapiens
caaaaacaaaaaagcaa

SEQ ID NO: 5296471 - DNA, 19 bp, Homo sapiens
caaaaacaaaaccagctgc

SEQ ID NO: 5296472 - DNA, 20 bp, Homo sapiens
caaaaacaaaaccagctgct

SEQ ID NO: 5296473 - DNA, 15 bp, Homo sapiens
caaaaacaaagctga

SEQ ID NO: 5296474 - DNA, 17 bp, Homo sapiens
caaaaacaaagtgcaaa

SEQ ID NO: 5296475 - DNA, 16 bp, Homo sapiens
caaaaacaagactgcc

SEQ ID NO: 5296476 - DNA, 12 bp, Homo sapiens
caaaaacacaaa

SEQ ID NO: 5296477 - DNA, 14 bp, Homo sapiens
caaaaacacagcaa

SEQ ID NO: 5296478 - DNA, 17 bp, Homo sapiens
caaaaacacagcaaggg

SEQ ID NO: 5296479 - DNA, 20 bp, Homo sapiens
caaaaacacagtgtttttgt

SEQ ID NO: 5296480 - DNA, 18 bp, Homo sapiens
caaaaacagaatttgaga

SEQ ID NO: 5296481 - DNA, 17 bp, Homo sapiens
caaaaacagcagtttgt

SEQ ID NO: 5296482 - DNA, 13 bp, Homo sapiens
caaaaacagcctc

SEQ ID NO: 5296483 - DNA, 16 bp, Homo sapiens
caaaaacagcctcaca

SEQ ID NO: 5296484 - DNA, 21 bp, Homo sapiens
caaaaacagctggacttattt

SEQ ID NO: 5296485 - DNA, 22 bp, Homo sapiens
caaaaacaggtatatactttga

SEQ ID NO: 5296486 - DNA, 18 bp, Homo sapiens
caaaaacaggtttttgat

SEQ ID NO: 5296487 - DNA, 21 bp, Homo sapiens
caaaaacaggtttttgatttt

SEQ ID NO: 5296488 - DNA, 21 bp, Homo sapiens
caaaaacatgcttttccaaac

SEQ ID NO: 5296489 - DNA, 20 bp, Homo sapiens
caaaaacatggcctttgctt

SEQ ID NO: 5296490 - DNA, 20 bp, Homo sapiens
caaaaacatgtttctgcctt

SEQ ID NO: 5296491 - DNA, 12 bp, Homo sapiens
caaaaacatttg

SEQ ID NO: 5296492 - DNA, 14 bp, Homo sapiens
caaaaacattttat

SEQ ID NO: 5296493 - DNA, 21 bp, Homo sapiens
caaaaaccaaaagtgcattca

SEQ ID NO: 5296494 - DNA, 15 bp, Homo sapiens
caaaaaccagcaggt

SEQ ID NO: 5296495 - DNA, 16 bp, Homo sapiens
caaaaaccagccaggc

SEQ ID NO: 5296496 - DNA, 20 bp, Homo sapiens
caaaaaccagtattgtacaa

SEQ ID NO: 5296497 - DNA, 15 bp, Homo sapiens
caaaaaccccagtgt

SEQ ID NO: 5296498 - DNA, 17 bp, Homo sapiens
caaaaaccccagtgttt

SEQ ID NO: 5296499 - DNA, 23 bp, Homo sapiens
caaaaaccctaattttgtacata

SEQ ID NO: 5296500 - DNA, 23 bp, Homo sapiens
caaaaacgaaactccatctcaaa

SEQ ID NO: 5296501 - DNA, 16 bp, Homo sapiens
caaaaactacacatat

SEQ ID NO: 5296502 - DNA, 14 bp, Homo sapiens
caaaaactatttgg

SEQ ID NO: 5296503 - DNA, 13 bp, Homo sapiens
caaaaactgtaaa

SEQ ID NO: 5296504 - DNA, 15 bp, Homo sapiens
caaaaactgtactgt

SEQ ID NO: 5296505 - DNA, 13 bp, Homo sapiens
caaaaacttcctt

SEQ ID NO: 5296506 - DNA, 18 bp, Homo sapiens
caaaaactttccatgaca

SEQ ID NO: 5296507 - DNA, 16 bp, Homo sapiens
caaaaacttttcattt

SEQ ID NO: 5296508 - DNA, 21 bp, Homo sapiens
caaaaacttttcatttcagat

SEQ ID NO: 5296509 - DNA, 17 bp, Homo sapiens
caaaaacttttttggaa

SEQ ID NO: 5296510 - DNA, 20 bp, Homo sapiens
caaaaagaaaaaaagaaaag

SEQ ID NO: 5296511 - DNA, 17 bp, Homo sapiens
caaaaagaaaaatcaaa

SEQ ID NO: 5296512 - DNA, 16 bp, Homo sapiens
caaaaagaaaagtgtt

SEQ ID NO: 5296513 - DNA, 20 bp, Homo sapiens
caaaaagaaatattaatatg

SEQ ID NO: 5296514 - DNA, 13 bp, Homo sapiens
caaaaagaacaaa

SEQ ID NO: 5296515 - DNA, 21 bp, Homo sapiens
caaaaagaacaaaaaaatctg

SEQ ID NO: 5296516 - DNA, 12 bp, Homo sapiens
caaaaagaagag

SEQ ID NO: 5296517 - DNA, 22 bp, Homo sapiens
caaaaagaagatggatgtaatt

SEQ ID NO: 5296518 - DNA, 23 bp, Homo sapiens
caaaaagaatctgcatttagcac

SEQ ID NO: 5296519 - DNA, 15 bp, Homo sapiens
caaaaagacaagtgc

SEQ ID NO: 5296520 - DNA, 18 bp, Homo sapiens
caaaaagacagtgtgtgt

SEQ ID NO: 5296521 - DNA, 14 bp, Homo sapiens
caaaaagaccagac

SEQ ID NO: 5296522 - DNA, 22 bp, Homo sapiens
caaaaagagtcttaattttcta

SEQ ID NO: 5296523 - DNA, 18 bp, Homo sapiens
caaaaagataccttaaaa

SEQ ID NO: 5296524 - DNA, 22 bp, Homo sapiens
caaaaagatgccttttaccatg

SEQ ID NO: 5296525 - DNA, 22 bp, Homo sapiens
caaaaagatgctttaattgtgt

SEQ ID NO: 5296526 - DNA, 16 bp, Homo sapiens
caaaaagatgtatatt

SEQ ID NO: 5296527 - DNA, 9 bp, Homo sapiens
caaaaagcc

SEQ ID NO: 5296528 - DNA, 13 bp, Homo sapiens
caaaaagccaaaa

SEQ ID NO: 5296529 - DNA, 11 bp, Homo sapiens
caaaaagccac

SEQ ID NO: 5296530 - DNA, 13 bp, Homo sapiens
caaaaagccttga

SEQ ID NO: 5296531 - DNA, 21 bp, Homo sapiens
caaaaagccttgaagaaaatg

SEQ ID NO: 5296532 - DNA, 19 bp, Homo sapiens
caaaaagctaacatcttta

SEQ ID NO: 5296533 - DNA, 14 bp, Homo sapiens
caaaaagctctgaa

SEQ ID NO: 5296534 - DNA, 13 bp, Homo sapiens
caaaaagcttccc

SEQ ID NO: 5296535 - DNA, 14 bp, Homo sapiens
caaaaagcttcccc

SEQ ID NO: 5296536 - DNA, 22 bp, Homo sapiens
caaaaaggaccaactggcttct

SEQ ID NO: 5296537 - DNA, 15 bp, Homo sapiens
caaaaaggactggaa

SEQ ID NO: 5296538 - DNA, 21 bp, Homo sapiens
caaaaaggagccttttgctct

SEQ ID NO: 5296539 - DNA, 20 bp, Homo sapiens
caaaaaggagcgggcagggc

SEQ ID NO: 5296540 - DNA, 15 bp, Homo sapiens
caaaaaggagctctt

SEQ ID NO: 5296541 - DNA, 17 bp, Homo sapiens
caaaaaggcaaatattg

SEQ ID NO: 5296542 - DNA, 16 bp, Homo sapiens
caaaaaggtataaata

SEQ ID NO: 5296543 - DNA, 22 bp, Homo sapiens
caaaaagtaaaaattaaaaaat

SEQ ID NO: 5296544 - DNA, 15 bp, Homo sapiens
caaaaagtaaagtaa

SEQ ID NO: 5296545 - DNA, 22 bp, Homo sapiens
caaaaagtaacacagtggactt

SEQ ID NO: 5296546 - DNA, 20 bp, Homo sapiens
caaaaagtaatgtatatctg

SEQ ID NO: 5296547 - DNA, 14 bp, Homo sapiens
caaaaagtatatta

SEQ ID NO: 5296548 - DNA, 14 bp, Homo sapiens
caaaaagtcattgt

SEQ ID NO: 5296549 - DNA, 17 bp, Homo sapiens
caaaaagtcatttttct

SEQ ID NO: 5296550 - DNA, 15 bp, Homo sapiens
caaaaagtgaaataa

SEQ ID NO: 5296551 - DNA, 11 bp, Homo sapiens
caaaaagtgtt

SEQ ID NO: 5296552 - DNA, 12 bp, Homo sapiens
caaaaagtgttt

SEQ ID NO: 5296553 - DNA, 17 bp, Homo sapiens
caaaaagtgtttatttt

SEQ ID NO: 5296554 - DNA, 22 bp, Homo sapiens
caaaaataaaaaatctgaagag

SEQ ID NO: 5296555 - DNA, 14 bp, Homo sapiens
caaaaataaaatat

SEQ ID NO: 5296556 - DNA, 14 bp, Homo sapiens
caaaaataaactag

SEQ ID NO: 5296557 - DNA, 16 bp, Homo sapiens
caaaaataaactagtt

SEQ ID NO: 5296558 - DNA, 20 bp, Homo sapiens
caaaaataacactgttggca

SEQ ID NO: 5296559 - DNA, 12 bp, Homo sapiens
caaaaataatag

SEQ ID NO: 5296560 - DNA, 16 bp, Homo sapiens
caaaaataatttattt

SEQ ID NO: 5296561 - DNA, 19 bp, Homo sapiens
caaaaataatttattttgc

SEQ ID NO: 5296562 - DNA, 13 bp, Homo sapiens
caaaaatagaaat

SEQ ID NO: 5296563 - DNA, 15 bp, Homo sapiens
caaaaatagaatata

SEQ ID NO: 5296564 - DNA, 23 bp, Homo sapiens
caaaaatagagaaaattcaggtc

SEQ ID NO: 5296565 - DNA, 16 bp, Homo sapiens
caaaaatagctcttgc

SEQ ID NO: 5296566 - DNA, 17 bp, Homo sapiens
caaaaatagctcttgct

SEQ ID NO: 5296567 - DNA, 14 bp, Homo sapiens
caaaaatagctggg

SEQ ID NO: 5296568 - DNA, 16 bp, Homo sapiens
caaaaatagttaaaat

SEQ ID NO: 5296569 - DNA, 12 bp, Homo sapiens
caaaaatataaa

SEQ ID NO: 5296570 - DNA, 22 bp, Homo sapiens
caaaaatattttatgatccagc

SEQ ID NO: 5296571 - DNA, 23 bp, Homo sapiens
caaaaatattttatgatccagca

SEQ ID NO: 5296572 - DNA, 14 bp, Homo sapiens
caaaaatattttgc

SEQ ID NO: 5296573 - DNA, 21 bp, Homo sapiens
caaaaatatttttatgtgaag

SEQ ID NO: 5296574 - DNA, 20 bp, Homo sapiens
caaaaatcactcacaagcaa

SEQ ID NO: 5296575 - DNA, 14 bp, Homo sapiens
caaaaatcagccag

SEQ ID NO: 5296576 - DNA, 16 bp, Homo sapiens
caaaaatcagccagac

SEQ ID NO: 5296577 - DNA, 17 bp, Homo sapiens
caaaaatcagccagaca

SEQ ID NO: 5296578 - DNA, 20 bp, Homo sapiens
caaaaatcatcaaagtgttt

SEQ ID NO: 5296579 - DNA, 20 bp, Homo sapiens
caaaaatcccaccttcccac

SEQ ID NO: 5296580 - DNA, 12 bp, Homo sapiens
caaaaatgagtt

SEQ ID NO: 5296581 - DNA, 17 bp, Homo sapiens
caaaaatgatcctcagt

SEQ ID NO: 5296582 - DNA, 18 bp, Homo sapiens
caaaaatgcaacaaatga

SEQ ID NO: 5296583 - DNA, 10 bp, Homo sapiens
caaaaatggg

SEQ ID NO: 5296584 - DNA, 18 bp, Homo sapiens
caaaaatgggtaattttc

SEQ ID NO: 5296585 - DNA, 19 bp, Homo sapiens
caaaaatggtggtttgtca

SEQ ID NO: 5296586 - DNA, 21 bp, Homo sapiens
caaaaatgtaaaaaacaaaaa

SEQ ID NO: 5296587 - DNA, 14 bp, Homo sapiens
caaaaatgtacaaa

SEQ ID NO: 5296588 - DNA, 21 bp, Homo sapiens
caaaaatgtacaaaataaagt

SEQ ID NO: 5296589 - DNA, 17 bp, Homo sapiens
caaaaatgtttccactg

SEQ ID NO: 5296590 - DNA, 16 bp, Homo sapiens
caaaaattaaatatat

SEQ ID NO: 5296591 - DNA, 15 bp, Homo sapiens
caaaaattacaaaga

SEQ ID NO: 5296592 - DNA, 17 bp, Homo sapiens
caaaaattacactacaa

SEQ ID NO: 5296593 - DNA, 21 bp, Homo sapiens
caaaaattacactacaagttt

SEQ ID NO: 5296594 - DNA, 20 bp, Homo sapiens
caaaaattagccggacgtgg

SEQ ID NO: 5296595 - DNA, 15 bp, Homo sapiens
caaaaattagctggg

SEQ ID NO: 5296596 - DNA, 11 bp, Homo sapiens
caaaaattagg

SEQ ID NO: 5296597 - DNA, 11 bp, Homo sapiens
caaaaattatc

SEQ ID NO: 5296598 - DNA, 17 bp, Homo sapiens
caaaaattatctatagc

SEQ ID NO: 5296599 - DNA, 19 bp, Homo sapiens
caaaaattatctatagcta

SEQ ID NO: 5296600 - DNA, 19 bp, Homo sapiens
caaaaattatctatttgta

SEQ ID NO: 5296601 - DNA, 20 bp, Homo sapiens
caaaaattgacttagatatt

SEQ ID NO: 5296602 - DNA, 11 bp, Homo sapiens
caaaaattgcc

SEQ ID NO: 5296603 - DNA, 23 bp, Homo sapiens
caaaaatttattatatatttaca

SEQ ID NO: 5296604 - DNA, 13 bp, Homo sapiens
caaaaatttgaac

SEQ ID NO: 5296605 - DNA, 20 bp, Homo sapiens
caaaaatttggaattctgtt

SEQ ID NO: 5296606 - DNA, 13 bp, Homo sapiens
caaaaattttgaa

SEQ ID NO: 5296607 - DNA, 16 bp, Homo sapiens
caaaaattttgaatgt

SEQ ID NO: 5296608 - DNA, 17 bp, Homo sapiens
caaaaattttgaatgta

SEQ ID NO: 5296609 - DNA, 20 bp, Homo sapiens
caaaaattttgaatgtacac

SEQ ID NO: 5296610 - DNA, 10 bp, Homo sapiens
caaaacaaaa

SEQ ID NO: 5296611 - DNA, 15 bp, Homo sapiens
caaaacaaaaaacaa

SEQ ID NO: 5296612 - DNA, 16 bp, Homo sapiens
caaaacaaaaagatgt

SEQ ID NO: 5296613 - DNA, 22 bp, Homo sapiens
caaaacaaaaattaggtatttt

SEQ ID NO: 5296614 - DNA, 13 bp, Homo sapiens
caaaacaaaacaa

SEQ ID NO: 5296615 - DNA, 15 bp, Homo sapiens
caaaacaaaacaaaa

SEQ ID NO: 5296616 - DNA, 16 bp, Homo sapiens
caaaacaaaacaaaac

SEQ ID NO: 5296617 - DNA, 14 bp, Homo sapiens
caaaacaaaactat

SEQ ID NO: 5296618 - DNA, 13 bp, Homo sapiens
caaaacaaaatag

SEQ ID NO: 5296619 - DNA, 12 bp, Homo sapiens
caaaacaaacaa

SEQ ID NO: 5296620 - DNA, 22 bp, Homo sapiens
caaaacaaagcaattctttcaa

SEQ ID NO: 5296621 - DNA, 21 bp, Homo sapiens
caaaacaaagcagctttaaaa

SEQ ID NO: 5296622 - DNA, 20 bp, Homo sapiens
caaaacaacaaaaaccaaaa

SEQ ID NO: 5296623 - DNA, 15 bp, Homo sapiens
caaaacaacaacaat

SEQ ID NO: 5296624 - DNA, 16 bp, Homo sapiens
caaaacaacaacaata

SEQ ID NO: 5296625 - DNA, 15 bp, Homo sapiens
caaaacaacagcaac

SEQ ID NO: 5296626 - DNA, 14 bp, Homo sapiens
caaaacaagaaaga

SEQ ID NO: 5296627 - DNA, 15 bp, Homo sapiens
caaaacaagaaagaa

SEQ ID NO: 5296628 - DNA, 16 bp, Homo sapiens
caaaacaagaaagaaa

SEQ ID NO: 5296629 - DNA, 15 bp, Homo sapiens
caaaacaagccaaag

SEQ ID NO: 5296630 - DNA, 20 bp, Homo sapiens
caaaacaagtttttctgtca

SEQ ID NO: 5296631 - DNA, 20 bp, Homo sapiens
caaaacaatctatttaaaaa

SEQ ID NO: 5296632 - DNA, 14 bp, Homo sapiens
caaaacaatgttta

SEQ ID NO: 5296633 - DNA, 18 bp, Homo sapiens
caaaacaatgtttaaacc

SEQ ID NO: 5296634 - DNA, 23 bp, Homo sapiens
caaaacacacgcgcgcacacaca

SEQ ID NO: 5296635 - DNA, 19 bp, Homo sapiens
caaaacacactactacctc

SEQ ID NO: 5296636 - DNA, 19 bp, Homo sapiens
caaaacactcggcatttca

SEQ ID NO: 5296637 - DNA, 13 bp, Homo sapiens
caaaacactgtgg

SEQ ID NO: 5296638 - DNA, 18 bp, Homo sapiens
caaaacacttgtaatttt

SEQ ID NO: 5296639 - DNA, 11 bp, Homo sapiens
caaaacagaac

SEQ ID NO: 5296640 - DNA, 12 bp, Homo sapiens
caaaacagaacg

SEQ ID NO: 5296641 - DNA, 14 bp, Homo sapiens
caaaacatatcaat

SEQ ID NO: 5296642 - DNA, 18 bp, Homo sapiens
caaaacatatcaattcaa

SEQ ID NO: 5296643 - DNA, 18 bp, Homo sapiens
caaaacatattttacatc

SEQ ID NO: 5296644 - DNA, 20 bp, Homo sapiens
caaaacatattttacatctg

SEQ ID NO: 5296645 - DNA, 16 bp, Homo sapiens
caatggctatattaat

SEQ ID NO: 5296646 - DNA, 14 bp, Homo sapiens
caatggctgctgaa

SEQ ID NO: 5296647 - DNA, 15 bp, Homo sapiens
caatggctgggaggg

SEQ ID NO: 5296648 - DNA, 11 bp, Homo sapiens
caatgggaaaa

SEQ ID NO: 5296649 - DNA, 14 bp, Homo sapiens
caatgggaaaagag

SEQ ID NO: 5296650 - DNA, 21 bp, Homo sapiens
caatgggaaatactactcctg

SEQ ID NO: 5296651 - DNA, 13 bp, Homo sapiens
caatgggaagcag

SEQ ID NO: 5296652 - DNA, 23 bp, Homo sapiens
caatgggaccgtgccccacctcc

SEQ ID NO: 5296653 - DNA, 17 bp, Homo sapiens
caatgggacctgtggct

SEQ ID NO: 5296654 - DNA, 14 bp, Homo sapiens
caatgggactggag

SEQ ID NO: 5296655 - DNA, 20 bp, Homo sapiens
caatgggagaatcagcagaa

SEQ ID NO: 5296656 - DNA, 15 bp, Homo sapiens
caatgggagctcatg

SEQ ID NO: 5296657 - DNA, 23 bp, Homo sapiens
caatgggagctgaggccacactc

SEQ ID NO: 5296658 - DNA, 18 bp, Homo sapiens
caatgggagggggctcca

SEQ ID NO: 5296659 - DNA, 22 bp, Homo sapiens
caatgggagggggctccatgga

SEQ ID NO: 5296660 - DNA, 18 bp, Homo sapiens
caatgggagtgaacattt

SEQ ID NO: 5296661 - DNA, 21 bp, Homo sapiens
caatgggagtgaacatttcta

SEQ ID NO: 5296662 - DNA, 15 bp, Homo sapiens
caatgggattttcta

SEQ ID NO: 5296663 - DNA, 23 bp, Homo sapiens
caatgggattttctagtttcctg

SEQ ID NO: 5296664 - DNA, 18 bp, Homo sapiens
caatgggcactgggatga

SEQ ID NO: 5296665 - DNA, 21 bp, Homo sapiens
caatgggccgtcccctctccc

SEQ ID NO: 5296666 - DNA, 22 bp, Homo sapiens
caatgggccgtcccctctcccc

SEQ ID NO: 5296667 - DNA, 15 bp, Homo sapiens
caatgggctagaggg

SEQ ID NO: 5296668 - DNA, 12 bp, Homo sapiens
caatggggagag

SEQ ID NO: 5296669 - DNA, 17 bp, Homo sapiens
caatggggccagcactg

SEQ ID NO: 5296670 - DNA, 15 bp, Homo sapiens
caatggggccagtca

SEQ ID NO: 5296671 - DNA, 23 bp, Homo sapiens
caatggggctggttttgcttccc

SEQ ID NO: 5296672 - DNA, 17 bp, Homo sapiens
caatgggggagggaggg

SEQ ID NO: 5296673 - DNA, 12 bp, Homo sapiens
caatgggtaagg

SEQ ID NO: 5296674 - DNA, 17 bp, Homo sapiens
caatgggtcttagctct

SEQ ID NO: 5296675 - DNA, 20 bp, Homo sapiens
caatgggtcttagctctttc

SEQ ID NO: 5296676 - DNA, 22 bp, Homo sapiens
caatggtagaagtgagagcttt

SEQ ID NO: 5296677 - DNA, 23 bp, Homo sapiens
caatggtagattcgctgtcccct

SEQ ID NO: 5296678 - DNA, 17 bp, Homo sapiens
caatggtagtttctgtg

SEQ ID NO: 5296679 - DNA, 21 bp, Homo sapiens
caatggtgagggctgagaggg

SEQ ID NO: 5296680 - DNA, 22 bp, Homo sapiens
caatggtgatcctctattttgt

SEQ ID NO: 5296681 - DNA, 21 bp, Homo sapiens
caatggtgtcagtatccaggc

SEQ ID NO: 5296682 - DNA, 20 bp, Homo sapiens
caatggtgtggtgaatgtgt

SEQ ID NO: 5296683 - DNA, 20 bp, Homo sapiens
caatggtgttatttgaaact

SEQ ID NO: 5296684 - DNA, 22 bp, Homo sapiens
caatggtgttgccctgagtgga

SEQ ID NO: 5296685 - DNA, 23 bp, Homo sapiens
caatggtgtttttcttgtaaatg

SEQ ID NO: 5296686 - DNA, 15 bp, Homo sapiens
caatggtttgtgtca

SEQ ID NO: 5296687 - DNA, 17 bp, Homo sapiens
caatggtttttaaattt

SEQ ID NO: 5296688 - DNA, 18 bp, Homo sapiens
caatggtttttaaatttt

SEQ ID NO: 5296689 - DNA, 21 bp, Homo sapiens
caatggtttttaaattttgta

SEQ ID NO: 5296690 - DNA, 23 bp, Homo sapiens
caatggtttttaaattttgtaat

SEQ ID NO: 5296691 - DNA, 21 bp, Homo sapiens
caatgtaaaaatacactaatg

SEQ ID NO: 5296692 - DNA, 13 bp, Homo sapiens
caatgtaacactg

SEQ ID NO: 5296693 - DNA, 15 bp, Homo sapiens
caatgtaacattaat

SEQ ID NO: 5296694 - DNA, 17 bp, Homo sapiens
caatgtaagcatacttt

SEQ ID NO: 5296695 - DNA, 20 bp, Homo sapiens
caatgtaataaaaagcctct

SEQ ID NO: 5296696 - DNA, 21 bp, Homo sapiens
caatgtaattacattaaaatg

SEQ ID NO: 5296697 - DNA, 14 bp, Homo sapiens
caatgtaattattt

SEQ ID NO: 5296698 - DNA, 22 bp, Homo sapiens
caatgtaattatttatgtatgg

SEQ ID NO: 5296699 - DNA, 15 bp, Homo sapiens
caatgtacaaggtat

SEQ ID NO: 5296700 - DNA, 21 bp, Homo sapiens
caatgtacaaggtatgtacag

SEQ ID NO: 5296701 - DNA, 16 bp, Homo sapiens
caatgtacaattatgt

SEQ ID NO: 5296702 - DNA, 18 bp, Homo sapiens
caatgtacaattatgtct

SEQ ID NO: 5296703 - DNA, 19 bp, Homo sapiens
caatgtacccaccgggcca

SEQ ID NO: 5296704 - DNA, 21 bp, Homo sapiens
caatgtactaggatactgctg

SEQ ID NO: 5296705 - DNA, 22 bp, Homo sapiens
caatgtactcttccgatgtttg

SEQ ID NO: 5296706 - DNA, 17 bp, Homo sapiens
caatgtacttgtttgaa

SEQ ID NO: 5296707 - DNA, 17 bp, Homo sapiens
caatgtagaaagctttg

SEQ ID NO: 5296708 - DNA, 21 bp, Homo sapiens
caatgtagataagtgttctgt

SEQ ID NO: 5296709 - DNA, 17 bp, Homo sapiens
caatgtataaagattgt

SEQ ID NO: 5296710 - DNA, 16 bp, Homo sapiens
caatgtatacaatgca

SEQ ID NO: 5296711 - DNA, 18 bp, Homo sapiens
caatgtatacaatgcact

SEQ ID NO: 5296712 - DNA, 19 bp, Homo sapiens
caatgtatacaatgcactt

SEQ ID NO: 5296713 - DNA, 21 bp, Homo sapiens
caatgtatatgaagctcttga

SEQ ID NO: 5296714 - DNA, 19 bp, Homo sapiens
caatgtatctttattaaaa

SEQ ID NO: 5296715 - DNA, 20 bp, Homo sapiens
caatgtatctttattaaaac

SEQ ID NO: 5296716 - DNA, 22 bp, Homo sapiens
caatgtatctttattaaaacaa

SEQ ID NO: 5296717 - DNA, 13 bp, Homo sapiens
caatgtatgtaca

SEQ ID NO: 5296718 - DNA, 22 bp, Homo sapiens
caatgtatgtacaatacaatgt

SEQ ID NO: 5296719 - DNA, 18 bp, Homo sapiens
caatgtatgtgtggctgt

SEQ ID NO: 5296720 - DNA, 14 bp, Homo sapiens
caatgtatttagct

SEQ ID NO: 5296721 - DNA, 15 bp, Homo sapiens
caatgtatttagcta

SEQ ID NO: 5296722 - DNA, 15 bp, Homo sapiens
caatgtatttattta

SEQ ID NO: 5296723 - DNA, 18 bp, Homo sapiens
caatgtattttatcttat

SEQ ID NO: 5296724 - DNA, 19 bp, Homo sapiens
caatgtcacaacctctctg

SEQ ID NO: 5296725 - DNA, 15 bp, Homo sapiens
caatgtcagaaactc

SEQ ID NO: 5296726 - DNA, 16 bp, Homo sapiens
caatgtcagcctttgt

SEQ ID NO: 5296727 - DNA, 21 bp, Homo sapiens
caatgtcagcctttgttaacc

SEQ ID NO: 5296728 - DNA, 14 bp, Homo sapiens
caatgtcaggaaca

SEQ ID NO: 5296729 - DNA, 16 bp, Homo sapiens
caatgtcaggaacaga

SEQ ID NO: 5296730 - DNA, 21 bp, Homo sapiens
caatgtcagtatttcagtgta

SEQ ID NO: 5296731 - DNA, 15 bp, Homo sapiens
caatgtcataaatgt

SEQ ID NO: 5296732 - DNA, 14 bp, Homo sapiens
caatgtccaaaccc

SEQ ID NO: 5296733 - DNA, 19 bp, Homo sapiens
caatgtccaaacccactca

SEQ ID NO: 5296734 - DNA, 17 bp, Homo sapiens
caatgtccagcagtctg

SEQ ID NO: 5296735 - DNA, 16 bp, Homo sapiens
caatgtccagtgagtg

SEQ ID NO: 5296736 - DNA, 13 bp, Homo sapiens
caatgtctcccac

SEQ ID NO: 5296737 - DNA, 14 bp, Homo sapiens
caatgtctcccaca

SEQ ID NO: 5296738 - DNA, 15 bp, Homo sapiens
caatgtctcccacac

SEQ ID NO: 5296739 - DNA, 20 bp, Homo sapiens
caatgtctgagtgaacctgt

SEQ ID NO: 5296740 - DNA, 13 bp, Homo sapiens
caatgtctgcagc

SEQ ID NO: 5296741 - DNA, 22 bp, Homo sapiens
caatgtctgcagccctgagaaa

SEQ ID NO: 5296742 - DNA, 13 bp, Homo sapiens
caatgtctggaga

SEQ ID NO: 5296743 - DNA, 21 bp, Homo sapiens
caatgtctggagaccaccagg

SEQ ID NO: 5296744 - DNA, 13 bp, Homo sapiens
caatgtctgggga

SEQ ID NO: 5296745 - DNA, 16 bp, Homo sapiens
caatgtctggggacag

SEQ ID NO: 5296746 - DNA, 13 bp, Homo sapiens
caatgtctgtgct

SEQ ID NO: 5296747 - DNA, 20 bp, Homo sapiens
caatgtctgtgctagggaaa

SEQ ID NO: 5296748 - DNA, 21 bp, Homo sapiens
caatgtcttaaataaaactat

SEQ ID NO: 5296749 - DNA, 23 bp, Homo sapiens
caatgtcttaaataaaactattt

SEQ ID NO: 5296750 - DNA, 20 bp, Homo sapiens
caatgtcttaggtcaggagt

SEQ ID NO: 5296751 - DNA, 23 bp, Homo sapiens
caatgtcttgatgcatgcactgt

SEQ ID NO: 5296752 - DNA, 22 bp, Homo sapiens
caatgtgaaaagaaaaatgagc

SEQ ID NO: 5296753 - DNA, 19 bp, Homo sapiens
caatgtgaaacacatgcca

SEQ ID NO: 5296754 - DNA, 12 bp, Homo sapiens
caatgtgaaact

SEQ ID NO: 5296755 - DNA, 16 bp, Homo sapiens
caatgtgaaataaaga

SEQ ID NO: 5296756 - DNA, 14 bp, Homo sapiens
caatgtgaacttta

SEQ ID NO: 5296757 - DNA, 15 bp, Homo sapiens
caatgtgaactttat

SEQ ID NO: 5296758 - DNA, 17 bp, Homo sapiens
caatgtgaataatggca

SEQ ID NO: 5296759 - DNA, 14 bp, Homo sapiens
caatgtgaatcaga

SEQ ID NO: 5296760 - DNA, 21 bp, Homo sapiens
caatgtgaattttaaaatgca

SEQ ID NO: 5296761 - DNA, 18 bp, Homo sapiens
caatgtgactaccgtgcc

SEQ ID NO: 5296762 - DNA, 19 bp, Homo sapiens
caatgtgactaccgtgcca

SEQ ID NO: 5296763 - DNA, 18 bp, Homo sapiens
caatgtgaggggtcccta

SEQ ID NO: 5296764 - DNA, 19 bp, Homo sapiens
caatgtgagtcccagagcc

SEQ ID NO: 5296765 - DNA, 21 bp, Homo sapiens
caatgtgagtcccagagcccg

SEQ ID NO: 5296766 - DNA, 15 bp, Homo sapiens
caatgtgataaaacc

SEQ ID NO: 5296767 - DNA, 17 bp, Homo sapiens
caatgtgataaaacccc

SEQ ID NO: 5296768 - DNA, 20 bp, Homo sapiens
caatgtgatataaacagctt

SEQ ID NO: 5296769 - DNA, 22 bp, Homo sapiens
caatgtgatataaacagcttct

SEQ ID NO: 5296770 - DNA, 15 bp, Homo sapiens
caatgtgatctatgt

SEQ ID NO: 5296771 - DNA, 15 bp, Homo sapiens
caatgtgattctaat

SEQ ID NO: 5296772 - DNA, 15 bp, Homo sapiens
caatgtgattcttct

SEQ ID NO: 5296773 - DNA, 13 bp, Homo sapiens
caatgtgatttat

SEQ ID NO: 5296774 - DNA, 18 bp, Homo sapiens
caatgtgcaagttgtact

SEQ ID NO: 5296775 - DNA, 18 bp, Homo sapiens
caatgtgcataatgataa

SEQ ID NO: 5296776 - DNA, 13 bp, Homo sapiens
caatgtgccccca

SEQ ID NO: 5296777 - DNA, 23 bp, Homo sapiens
caatgtgctactgattgtttcat

SEQ ID NO: 5296778 - DNA, 13 bp, Homo sapiens
caatgtgctctcg

SEQ ID NO: 5296779 - DNA, 16 bp, Homo sapiens
caatgtgcttccgaga

SEQ ID NO: 5296780 - DNA, 17 bp, Homo sapiens
caatgtggaattacata

SEQ ID NO: 5296781 - DNA, 21 bp, Homo sapiens
caatgtggacgtgcactgaca

SEQ ID NO: 5296782 - DNA, 24 bp, Homo sapiens
caatgtggacgtgcactgacagcc

SEQ ID NO: 5296783 - DNA, 16 bp, Homo sapiens
caatgtggagcagcag

SEQ ID NO: 5296784 - DNA, 21 bp, Homo sapiens
caatgtggagtctccctctga

SEQ ID NO: 5296785 - DNA, 17 bp, Homo sapiens
caatgtggatttgggga

SEQ ID NO: 5296786 - DNA, 23 bp, Homo sapiens
caatgtggcaaggaaaaacaggt

SEQ ID NO: 5296787 - DNA, 17 bp, Homo sapiens
caatgtgggatctcaga

SEQ ID NO: 5296788 - DNA, 21 bp, Homo sapiens
caatgtgggcgtttgtaaatt

SEQ ID NO: 5296789 - DNA, 22 bp, Homo sapiens
caatgtggtgacacctccccct

SEQ ID NO: 5296790 - DNA, 21 bp, Homo sapiens
caatgtgtataaacaagaaaa

SEQ ID NO: 5296791 - DNA, 15 bp, Homo sapiens
caatgtgtataaatt

SEQ ID NO: 5296792 - DNA, 19 bp, Homo sapiens
caatgtgtctatttctgaa

SEQ ID NO: 5296793 - DNA, 20 bp, Homo sapiens
caatgtgtctatttctgaaa

SEQ ID NO: 5296794 - DNA, 20 bp, Homo sapiens
caatgtgtctttctttttgg

SEQ ID NO: 5296795 - DNA, 19 bp, Homo sapiens
caatgtgtggctgaagact

SEQ ID NO: 5296796 - DNA, 14 bp, Homo sapiens
caatgtgtgtatat

SEQ ID NO: 5296797 - DNA, 16 bp, Homo sapiens
caatgtgtgtatatgg

SEQ ID NO: 5296798 - DNA, 15 bp, Homo sapiens
caatgtgttttctgt

SEQ ID NO: 5296799 - DNA, 21 bp, Homo sapiens
caatgttaaacttataaccca

SEQ ID NO: 5296800 - DNA, 16 bp, Homo sapiens
caatgttaaatctaca

SEQ ID NO: 5296801 - DNA, 11 bp, Homo sapiens
caatgttaagg

SEQ ID NO: 5296802 - DNA, 18 bp, Homo sapiens
caatgttaaggaaactct

SEQ ID NO: 5296803 - DNA, 16 bp, Homo sapiens
caatgttagagacttt

SEQ ID NO: 5296804 - DNA, 17 bp, Homo sapiens
caatgttagagactttt

SEQ ID NO: 5296805 - DNA, 23 bp, Homo sapiens
caatgttcattgtaatgttactg

SEQ ID NO: 5296806 - DNA, 18 bp, Homo sapiens
caatgttccgttcatctg

SEQ ID NO: 5296807 - DNA, 19 bp, Homo sapiens
caatgttccgttcatctga

SEQ ID NO: 5296808 - DNA, 20 bp, Homo sapiens
caatgttccttttttgtata

SEQ ID NO: 5296809 - DNA, 21 bp, Homo sapiens
caatgttctgttgtaaagagt

SEQ ID NO: 5296810 - DNA, 14 bp, Homo sapiens
caatgttctttata

SEQ ID NO: 5296811 - DNA, 15 bp, Homo sapiens
caatgttgagaagtt

SEQ ID NO: 5296812 - DNA, 23 bp, Homo sapiens
caatgttgcatttatgatgcagt

SEQ ID NO: 5296813 - DNA, 13 bp, Homo sapiens
caatgttggagca

SEQ ID NO: 5296814 - DNA, 15 bp, Homo sapiens
caatgttggagcagc

SEQ ID NO: 5296815 - DNA, 19 bp, Homo sapiens
caatgttggagcagcaggc

SEQ ID NO: 5296816 - DNA, 21 bp, Homo sapiens
caatgttggctagtctgtgcc

SEQ ID NO: 5296817 - DNA, 13 bp, Homo sapiens
caatgttggtttt

SEQ ID NO: 5296818 - DNA, 17 bp, Homo sapiens
caatgttgtccaacaat

SEQ ID NO: 5296819 - DNA, 17 bp, Homo sapiens
caatgttgttttaagac

SEQ ID NO: 5296820 - DNA, 20 bp, Homo sapiens
caatgtttaaaaaagtttaa

SEQ ID NO: 5296821 - DNA, 14 bp, Homo sapiens
caaaacatccactt

SEQ ID NO: 5296822 - DNA, 21 bp, Homo sapiens
caaaacatccacttaagttct

SEQ ID NO: 5296823 - DNA, 22 bp, Homo sapiens
caaaacatccacttaagttctt

SEQ ID NO: 5296824 - DNA, 23 bp, Homo sapiens
caaaacatccacttaagttcttt

SEQ ID NO: 5296825 - DNA, 12 bp, Homo sapiens
caaaacattcca

SEQ ID NO: 5296826 - DNA, 23 bp, Homo sapiens
caaaacatttaaataaaactttc

SEQ ID NO: 5296827 - DNA, 18 bp, Homo sapiens
caaaacatttatgacaag

SEQ ID NO: 5296828 - DNA, 12 bp, Homo sapiens
caaaacatttct

SEQ ID NO: 5296829 - DNA, 21 bp, Homo sapiens
caaaacatttctggacagtac

SEQ ID NO: 5296830 - DNA, 16 bp, Homo sapiens
caaaacattttgaagg

SEQ ID NO: 5296831 - DNA, 20 bp, Homo sapiens
caaaacattttgaaggaaaa

SEQ ID NO: 5296832 - DNA, 18 bp, Homo sapiens
caaaaccaaaagttatta

SEQ ID NO: 5296833 - DNA, 23 bp, Homo sapiens
caaaaccaaaagttattaaaatt

SEQ ID NO: 5296834 - DNA, 13 bp, Homo sapiens
caaaaccaaattg

SEQ ID NO: 5296835 - DNA, 18 bp, Homo sapiens
caaaaccaagattttgaa

SEQ ID NO: 5296836 - DNA, 16 bp, Homo sapiens
caaaaccaagccttgg

SEQ ID NO: 5296837 - DNA, 17 bp, Homo sapiens
caaaaccaattcatgaa

SEQ ID NO: 5296838 - DNA, 13 bp, Homo sapiens
caaaaccacagcc

SEQ ID NO: 5296839 - DNA, 21 bp, Homo sapiens
caaaaccacagccctgtcagt

SEQ ID NO: 5296840 - DNA, 13 bp, Homo sapiens
caaaaccacatgg

SEQ ID NO: 5296841 - DNA, 16 bp, Homo sapiens
caaaaccacatgggct

SEQ ID NO: 5296842 - DNA, 13 bp, Homo sapiens
caaaaccagctgc

SEQ ID NO: 5296843 - DNA, 16 bp, Homo sapiens
caaaaccaggcctctg

SEQ ID NO: 5296844 - DNA, 18 bp, Homo sapiens
caaaaccaggcctctgct

SEQ ID NO: 5296845 - DNA, 22 bp, Homo sapiens
caaaaccaggtccaatgagctt

SEQ ID NO: 5296846 - DNA, 13 bp, Homo sapiens
caaaaccatctct

SEQ ID NO: 5296847 - DNA, 14 bp, Homo sapiens
caaaaccatctctc

SEQ ID NO: 5296848 - DNA, 22 bp, Homo sapiens
caaaaccatgcattcctaagaa

SEQ ID NO: 5296849 - DNA, 23 bp, Homo sapiens
caaaaccattgatgtttaagtgt

SEQ ID NO: 5296850 - DNA, 15 bp, Homo sapiens
caaaaccattgcttc

SEQ ID NO: 5296851 - DNA, 21 bp, Homo sapiens
caaaacccagctgcacccctt

SEQ ID NO: 5296852 - DNA, 12 bp, Homo sapiens
caaaacccagga

SEQ ID NO: 5296853 - DNA, 14 bp, Homo sapiens
caaaacccaggaca

SEQ ID NO: 5296854 - DNA, 12 bp, Homo sapiens
caaaaccccaga

SEQ ID NO: 5296855 - DNA, 19 bp, Homo sapiens
caaaaccccccagatatca

SEQ ID NO: 5296856 - DNA, 16 bp, Homo sapiens
caaaaccctgaagcca

SEQ ID NO: 5296857 - DNA, 17 bp, Homo sapiens
caaaaccgccagctctg

SEQ ID NO: 5296858 - DNA, 20 bp, Homo sapiens
caaaaccgccagctctgttc

SEQ ID NO: 5296859 - DNA, 19 bp, Homo sapiens
caaaaccggcaacctgtaa

SEQ ID NO: 5296860 - DNA, 22 bp, Homo sapiens
caaaaccggcaacctgtaactg

SEQ ID NO: 5296861 - DNA, 14 bp, Homo sapiens
caaaacctattttt

SEQ ID NO: 5296862 - DNA, 19 bp, Homo sapiens
caaaacctatttttccttt

SEQ ID NO: 5296863 - DNA, 22 bp, Homo sapiens
caaaacctcatgacagccagag

SEQ ID NO: 5296864 - DNA, 20 bp, Homo sapiens
caaaacctgtattactgaat

SEQ ID NO: 5296865 - DNA, 15 bp, Homo sapiens
caaaacctgtcctat

SEQ ID NO: 5296866 - DNA, 11 bp, Homo sapiens
caaaaccttcc

SEQ ID NO: 5296867 - DNA, 15 bp, Homo sapiens
caaaaccttccttcc

SEQ ID NO: 5296868 - DNA, 17 bp, Homo sapiens
caaaaccttccttccct

SEQ ID NO: 5296869 - DNA, 22 bp, Homo sapiens
caaaacctttccccagacacat

SEQ ID NO: 5296870 - DNA, 18 bp, Homo sapiens
caaaacgcacaagccaga

SEQ ID NO: 5296871 - DNA, 17 bp, Homo sapiens
caaaacgcgcagatgtg

SEQ ID NO: 5296872 - DNA, 18 bp, Homo sapiens
caaaacgcgcagatgtgc

SEQ ID NO: 5296873 - DNA, 20 bp, Homo sapiens
caaaacgggttactaagatg

SEQ ID NO: 5296874 - DNA, 19 bp, Homo sapiens
caaaactaccacattctgt

SEQ ID NO: 5296875 - DNA, 19 bp, Homo sapiens
caaaactactgacagggag

SEQ ID NO: 5296876 - DNA, 16 bp, Homo sapiens
caaaactagaattgtt

SEQ ID NO: 5296877 - DNA, 17 bp, Homo sapiens
caaaactatacttgaac

SEQ ID NO: 5296878 - DNA, 18 bp, Homo sapiens
caaaactatacttgaaca

SEQ ID NO: 5296879 - DNA, 19 bp, Homo sapiens
caaaactatcctatgcctt

SEQ ID NO: 5296880 - DNA, 20 bp, Homo sapiens
caaaactatcctatgccttc

SEQ ID NO: 5296881 - DNA, 20 bp, Homo sapiens
caaaactatcggttcaagtt

SEQ ID NO: 5296882 - DNA, 15 bp, Homo sapiens
caaaactatggaaat

SEQ ID NO: 5296883 - DNA, 20 bp, Homo sapiens
caaaactcaaatgcttggct

SEQ ID NO: 5296884 - DNA, 18 bp, Homo sapiens
caaaactcactaagttta

SEQ ID NO: 5296885 - DNA, 14 bp, Homo sapiens
caaaactccactca

SEQ ID NO: 5296886 - DNA, 17 bp, Homo sapiens
caaaactcccaatggat

SEQ ID NO: 5296887 - DNA, 18 bp, Homo sapiens
caaaactccgcccccagc

SEQ ID NO: 5296888 - DNA, 21 bp, Homo sapiens
caaaactcctgcccctgttct

SEQ ID NO: 5296889 - DNA, 21 bp, Homo sapiens
caaaactctcctctgctgctg

SEQ ID NO: 5296890 - DNA, 16 bp, Homo sapiens
caaaactctgtagctt

SEQ ID NO: 5296891 - DNA, 17 bp, Homo sapiens
caaaactgcactgtcaa

SEQ ID NO: 5296892 - DNA, 11 bp, Homo sapiens
caaaactgcca

SEQ ID NO: 5296893 - DNA, 19 bp, Homo sapiens
caaaactgcctgaaagcaa

SEQ ID NO: 5296894 - DNA, 18 bp, Homo sapiens
caaaactggaagcacagc

SEQ ID NO: 5296895 - DNA, 13 bp, Homo sapiens
caaaactgtaact

SEQ ID NO: 5296896 - DNA, 14 bp, Homo sapiens
caaaactgtgcaga

SEQ ID NO: 5296897 - DNA, 14 bp, Homo sapiens
caaaacttaagatg

SEQ ID NO: 5296898 - DNA, 23 bp, Homo sapiens
caaaacttcagacatagaattaa

SEQ ID NO: 5296899 - DNA, 21 bp, Homo sapiens
caaaacttcgtttaatgaatg

SEQ ID NO: 5296900 - DNA, 14 bp, Homo sapiens
caaaacttgcatct

SEQ ID NO: 5296901 - DNA, 20 bp, Homo sapiens
caaaacttggtatttttcag

SEQ ID NO: 5296902 - DNA, 17 bp, Homo sapiens
caaaactttaaacctgt

SEQ ID NO: 5296903 - DNA, 23 bp, Homo sapiens
caaaactttatcagggaaactaa

SEQ ID NO: 5296904 - DNA, 22 bp, Homo sapiens
caaaactttttgaccagtttct

SEQ ID NO: 5296905 - DNA, 23 bp, Homo sapiens
caaaactttttgaccagtttctt

SEQ ID NO: 5296906 - DNA, 21 bp, Homo sapiens
caaaagaaaaaaaaaagcacc

SEQ ID NO: 5296907 - DNA, 11 bp, Homo sapiens
caaaagaaaat

SEQ ID NO: 5296908 - DNA, 23 bp, Homo sapiens
caaaagaaaatgtgtaacagagt

SEQ ID NO: 5296909 - DNA, 16 bp, Homo sapiens
caaaagaaaattgata

SEQ ID NO: 5296910 - DNA, 19 bp, Homo sapiens
caaaagaaacaccagtgtt

SEQ ID NO: 5296911 - DNA, 18 bp, Homo sapiens
caaaagaaaccatgacaa

SEQ ID NO: 5296912 - DNA, 12 bp, Homo sapiens
caaaagaaactt

SEQ ID NO: 5296913 - DNA, 16 bp, Homo sapiens
caaaagaaagagaaat

SEQ ID NO: 5296914 - DNA, 14 bp, Homo sapiens
caaaagaaagcaaa

SEQ ID NO: 5296915 - DNA, 15 bp, Homo sapiens
caaaagaaagcaaat

SEQ ID NO: 5296916 - DNA, 22 bp, Homo sapiens
caaaagaaagcaaattattttt

SEQ ID NO: 5296917 - DNA, 19 bp, Homo sapiens
caaaagaacaagaatttct

SEQ ID NO: 5296918 - DNA, 17 bp, Homo sapiens
caaaagaagcccccagc

SEQ ID NO: 5296919 - DNA, 19 bp, Homo sapiens
caaaagaagcccccagcta

SEQ ID NO: 5296920 - DNA, 20 bp, Homo sapiens
caaaagaagcctagaaaaga

SEQ ID NO: 5296921 - DNA, 16 bp, Homo sapiens
caaaagaaggtcaaac

SEQ ID NO: 5296922 - DNA, 21 bp, Homo sapiens
caaaagaagtaaaagctaatt

SEQ ID NO: 5296923 - DNA, 22 bp, Homo sapiens
caaaagaagtaacaagagtgat

SEQ ID NO: 5296924 - DNA, 12 bp, Homo sapiens
caaaagaagttc

SEQ ID NO: 5296925 - DNA, 19 bp, Homo sapiens
caaaagaagttgtagtgtt

SEQ ID NO: 5296926 - DNA, 14 bp, Homo sapiens
caaaagaataagac

SEQ ID NO: 5296927 - DNA, 15 bp, Homo sapiens
caaaagaatcagaaa

SEQ ID NO: 5296928 - DNA, 19 bp, Homo sapiens
caaaagaatcagaaacagg

SEQ ID NO: 5296929 - DNA, 20 bp, Homo sapiens
caaaagaatttttgtttgga

SEQ ID NO: 5296930 - DNA, 22 bp, Homo sapiens
caaaagacaagcattgggtcag

SEQ ID NO: 5296931 - DNA, 14 bp, Homo sapiens
caaaagacactgca

SEQ ID NO: 5296932 - DNA, 19 bp, Homo sapiens
caaaagacagacccagtga

SEQ ID NO: 5296933 - DNA, 20 bp, Homo sapiens
caaaagacagcactacagat

SEQ ID NO: 5296934 - DNA, 11 bp, Homo sapiens
caaaagacatc

SEQ ID NO: 5296935 - DNA, 16 bp, Homo sapiens
caaaagacatcctcaa

SEQ ID NO: 5296936 - DNA, 14 bp, Homo sapiens
caaaagacattaga

SEQ ID NO: 5296937 - DNA, 16 bp, Homo sapiens
caaaagacattagaga

SEQ ID NO: 5296938 - DNA, 18 bp, Homo sapiens
caaaagacattagagaaa

SEQ ID NO: 5296939 - DNA, 17 bp, Homo sapiens
caaaagaccaaatctca

SEQ ID NO: 5296940 - DNA, 22 bp, Homo sapiens
caaaagactggtttgtttgctt

SEQ ID NO: 5296941 - DNA, 12 bp, Homo sapiens
caaaagagaaaa

SEQ ID NO: 5296942 - DNA, 16 bp, Homo sapiens
caaaagagaaaaagaa

SEQ ID NO: 5296943 - DNA, 17 bp, Homo sapiens
caaaagagaaaaagaag

SEQ ID NO: 5296944 - DNA, 13 bp, Homo sapiens
caaaagagcagca

SEQ ID NO: 5296945 - DNA, 15 bp, Homo sapiens
caaaagagcagcatt

SEQ ID NO: 5296946 - DNA, 21 bp, Homo sapiens
caaaagagcatggatgcattt

SEQ ID NO: 5296947 - DNA, 22 bp, Homo sapiens
caaaagagcatggatgcatttc

SEQ ID NO: 5296948 - DNA, 18 bp, Homo sapiens
caaaagagccctggctct

SEQ ID NO: 5296949 - DNA, 21 bp, Homo sapiens
caaaagaggttactttagtta

SEQ ID NO: 5296950 - DNA, 15 bp, Homo sapiens
caaaagagtgtaaaa

SEQ ID NO: 5296951 - DNA, 20 bp, Homo sapiens
caaaagagtgtaaaatattt

SEQ ID NO: 5296952 - DNA, 20 bp, Homo sapiens
caaaagataatattttacat

SEQ ID NO: 5296953 - DNA, 19 bp, Homo sapiens
caaaagatacccaaatttt

SEQ ID NO: 5296954 - DNA, 16 bp, Homo sapiens
caaaagatatgaagaa

SEQ ID NO: 5296955 - DNA, 20 bp, Homo sapiens
caaaagatccttcattttag

SEQ ID NO: 5296956 - DNA, 12 bp, Homo sapiens
caaaagatgaaa

SEQ ID NO: 5296957 - DNA, 19 bp, Homo sapiens
caaaagatgctcttctgtg

SEQ ID NO: 5296958 - DNA, 20 bp, Homo sapiens
caaaagatgctcttctgtgg

SEQ ID NO: 5296959 - DNA, 18 bp, Homo sapiens
caaaagatgggtggttga

SEQ ID NO: 5296960 - DNA, 21 bp, Homo sapiens
caaaagatgtgcaaaatcact

SEQ ID NO: 5296961 - DNA, 20 bp, Homo sapiens
caaaagattgctgaaatttt

SEQ ID NO: 5296962 - DNA, 22 bp, Homo sapiens
caaaagattgctgaaattttat

SEQ ID NO: 5296963 - DNA, 13 bp, Homo sapiens
caaaagatttgtt

SEQ ID NO: 5296964 - DNA, 21 bp, Homo sapiens
caaaagatttgtttttgtaga

SEQ ID NO: 5296965 - DNA, 11 bp, Homo sapiens
caaaagcaaac

SEQ ID NO: 5296966 - DNA, 15 bp, Homo sapiens
caaaagcaaagtgaa

SEQ ID NO: 5296967 - DNA, 15 bp, Homo sapiens
caaaagcaaatgaga

SEQ ID NO: 5296968 - DNA, 20 bp, Homo sapiens
caaaagcacaaaccctgggg

SEQ ID NO: 5296969 - DNA, 15 bp, Homo sapiens
caaaagcacttactt

SEQ ID NO: 5296970 - DNA, 18 bp, Homo sapiens
caaaagcagcacaaggaa

SEQ ID NO: 5296971 - DNA, 20 bp, Homo sapiens
caaaagcagtaaatttgcta

SEQ ID NO: 5296972 - DNA, 21 bp, Homo sapiens
caaaagcagtgggctcctggc

SEQ ID NO: 5296973 - DNA, 19 bp, Homo sapiens
caaaagcatctatgtgaga

SEQ ID NO: 5296974 - DNA, 13 bp, Homo sapiens
caaaagcatgtga

SEQ ID NO: 5296975 - DNA, 19 bp, Homo sapiens
caaaagcatttatcattct

SEQ ID NO: 5296976 - DNA, 21 bp, Homo sapiens
caaaagcatttatcattcttg

SEQ ID NO: 5296977 - DNA, 12 bp, Homo sapiens
caaaagccaaaa

SEQ ID NO: 5296978 - DNA, 16 bp, Homo sapiens
caaaagccaagaaagt

SEQ ID NO: 5296979 - DNA, 17 bp, Homo sapiens
caaaagccaagaaagta

SEQ ID NO: 5296980 - DNA, 13 bp, Homo sapiens
caaaagcctctca

SEQ ID NO: 5296981 - DNA, 13 bp, Homo sapiens
caaaagccttgtg

SEQ ID NO: 5296982 - DNA, 19 bp, Homo sapiens
caaaagccttgtgtatatt

SEQ ID NO: 5296983 - DNA, 18 bp, Homo sapiens
caaaagcgactcccagct

SEQ ID NO: 5296984 - DNA, 21 bp, Homo sapiens
caaaagcgccctcactattct

SEQ ID NO: 5296985 - DNA, 23 bp, Homo sapiens
caaaagcgtgagcttaaaataca

SEQ ID NO: 5296986 - DNA, 18 bp, Homo sapiens
caaaagctagaggagatt

SEQ ID NO: 5296987 - DNA, 22 bp, Homo sapiens
caaaagctcagggccctgtgcc

SEQ ID NO: 5296988 - DNA, 20 bp, Homo sapiens
caaaagctctctttggaatg

SEQ ID NO: 5296989 - DNA, 14 bp, Homo sapiens
caaaagctgctcag

SEQ ID NO: 5296990 - DNA, 15 bp, Homo sapiens
caaaagctgcttgac

SEQ ID NO: 5296991 - DNA, 18 bp, Homo sapiens
caaaagctgggaaccagc

SEQ ID NO: 5296992 - DNA, 14 bp, Homo sapiens
caaaagctgtgtct

SEQ ID NO: 5296993 - DNA, 23 bp, Homo sapiens
caaaagctgtgtctctgtatata

SEQ ID NO: 5296994 - DNA, 16 bp, Homo sapiens
caaaagcttcaaatta

SEQ ID NO: 5296995 - DNA, 13 bp, Homo sapiens
caaaagcttttta

SEQ ID NO: 5296996 - DNA, 19 bp, Homo sapiens
caaaagctttttaaaattt

SEQ ID NO: 5296997 - DNA, 15 bp, Homo sapiens
caaaaggaaaaagct

SEQ ID NO: 5296998 - DNA, 13 bp, Homo sapiens
caaaaggaagact

SEQ ID NO: 5296999 - DNA, 23 bp, Homo sapiens
caatgtttaaaaaagtttaaaat

SEQ ID NO: 5297000 - DNA, 11 bp, Homo sapiens
caatgtttaca

SEQ ID NO: 5297001 - DNA, 20 bp, Homo sapiens
caatgtttatgcaaggaagg

SEQ ID NO: 5297002 - DNA, 12 bp, Homo sapiens
caatgtttcaag

SEQ ID NO: 5297003 - DNA, 22 bp, Homo sapiens
caatgtttcaagaggagccccc

SEQ ID NO: 5297004 - DNA, 13 bp, Homo sapiens
caatgtttctttt

SEQ ID NO: 5297005 - DNA, 14 bp, Homo sapiens
caatgtttgcttta

SEQ ID NO: 5297006 - DNA, 22 bp, Homo sapiens
caatgtttgcttttcactggca

SEQ ID NO: 5297007 - DNA, 15 bp, Homo sapiens
caatgtttttgtgta

SEQ ID NO: 5297008 - DNA, 20 bp, Homo sapiens
caatgtttttgtgtagagtg

SEQ ID NO: 5297009 - DNA, 23 bp, Homo sapiens
caattaaaaaaaaagatctgttt

SEQ ID NO: 5297010 - DNA, 14 bp, Homo sapiens
caattaaaaataaa

SEQ ID NO: 5297011 - DNA, 17 bp, Homo sapiens
caattaaaatatatata

SEQ ID NO: 5297012 - DNA, 19 bp, Homo sapiens
caattaaacggattatttt

SEQ ID NO: 5297013 - DNA, 23 bp, Homo sapiens
caattaaacggattattttttca

SEQ ID NO: 5297014 - DNA, 12 bp, Homo sapiens
caattaaagtct

SEQ ID NO: 5297015 - DNA, 13 bp, Homo sapiens
caattaaatgtag

SEQ ID NO: 5297016 - DNA, 19 bp, Homo sapiens
caattaacatatgtcacga

SEQ ID NO: 5297017 - DNA, 14 bp, Homo sapiens
caattaactctcca

SEQ ID NO: 5297018 - DNA, 16 bp, Homo sapiens
caattaactctccagt

SEQ ID NO: 5297019 - DNA, 22 bp, Homo sapiens
caattaactctccagttatcag

SEQ ID NO: 5297020 - DNA, 13 bp, Homo sapiens
caattaactctgg

SEQ ID NO: 5297021 - DNA, 11 bp, Homo sapiens
caattaactgc

SEQ ID NO: 5297022 - DNA, 14 bp, Homo sapiens
caattaagcagctt

SEQ ID NO: 5297023 - DNA, 21 bp, Homo sapiens
caattaaggattttatgcttt

SEQ ID NO: 5297024 - DNA, 15 bp, Homo sapiens
caattaagttacaat

SEQ ID NO: 5297025 - DNA, 15 bp, Homo sapiens
caattaatagtttgt

SEQ ID NO: 5297026 - DNA, 19 bp, Homo sapiens
caattaatagtttgtctat

SEQ ID NO: 5297027 - DNA, 16 bp, Homo sapiens
caattaatgattcaat

SEQ ID NO: 5297028 - DNA, 12 bp, Homo sapiens
caattaattaaa

SEQ ID NO: 5297029 - DNA, 21 bp, Homo sapiens
caattaattgtccctgtttca

SEQ ID NO: 5297030 - DNA, 14 bp, Homo sapiens
caattaattgtctt

SEQ ID NO: 5297031 - DNA, 19 bp, Homo sapiens
caattacaacggagtcaaa

SEQ ID NO: 5297032 - DNA, 16 bp, Homo sapiens
caattacaggaagtac

SEQ ID NO: 5297033 - DNA, 17 bp, Homo sapiens
caattacaggaagtact

SEQ ID NO: 5297034 - DNA, 13 bp, Homo sapiens
caattacatctct

SEQ ID NO: 5297035 - DNA, 15 bp, Homo sapiens
caattacatctctaa

SEQ ID NO: 5297036 - DNA, 16 bp, Homo sapiens
caattacatctctaat

SEQ ID NO: 5297037 - DNA, 14 bp, Homo sapiens
caattacatgtaaa

SEQ ID NO: 5297038 - DNA, 20 bp, Homo sapiens
caattacatgtaaacaaata

SEQ ID NO: 5297039 - DNA, 17 bp, Homo sapiens
caattaccagaaagata

SEQ ID NO: 5297040 - DNA, 17 bp, Homo sapiens
caattacggtgtacagt

SEQ ID NO: 5297041 - DNA, 19 bp, Homo sapiens
caattactaaattgtatac

SEQ ID NO: 5297042 - DNA, 15 bp, Homo sapiens
caattactcaggttt

SEQ ID NO: 5297043 - DNA, 13 bp, Homo sapiens
caattactgtaca

SEQ ID NO: 5297044 - DNA, 15 bp, Homo sapiens
caattactgtacaca

SEQ ID NO: 5297045 - DNA, 15 bp, Homo sapiens
caattactttggtag

SEQ ID NO: 5297046 - DNA, 19 bp, Homo sapiens
caattagaaatattaaaga

SEQ ID NO: 5297047 - DNA, 22 bp, Homo sapiens
caattagagcttgatgcctccc

SEQ ID NO: 5297048 - DNA, 18 bp, Homo sapiens
caattagaggaatttaaa

SEQ ID NO: 5297049 - DNA, 22 bp, Homo sapiens
caattagatagaaaaggtccaa

SEQ ID NO: 5297050 - DNA, 21 bp, Homo sapiens
caattagcaattgactgtcac

SEQ ID NO: 5297051 - DNA, 15 bp, Homo sapiens
caattagcagaagtg

SEQ ID NO: 5297052 - DNA, 23 bp, Homo sapiens
caattaggaagtgtaacagctga

SEQ ID NO: 5297053 - DNA, 16 bp, Homo sapiens
caattaggattttgat

SEQ ID NO: 5297054 - DNA, 14 bp, Homo sapiens
caattaggtctgca

SEQ ID NO: 5297055 - DNA, 20 bp, Homo sapiens
caattaggtctgcattttct

SEQ ID NO: 5297056 - DNA, 15 bp, Homo sapiens
caattagtctgaaac

SEQ ID NO: 5297057 - DNA, 21 bp, Homo sapiens
caattagtggtcataaaatag

SEQ ID NO: 5297058 - DNA, 22 bp, Homo sapiens
caattagtgtgacagtttccaa

SEQ ID NO: 5297059 - DNA, 21 bp, Homo sapiens
caattagtttcctttttaata

SEQ ID NO: 5297060 - DNA, 22 bp, Homo sapiens
caattataaactcattttgctt

SEQ ID NO: 5297061 - DNA, 15 bp, Homo sapiens
caattataacttatt

SEQ ID NO: 5297062 - DNA, 21 bp, Homo sapiens
caattataagaggatatgaac

SEQ ID NO: 5297063 - DNA, 14 bp, Homo sapiens
caattatagtttct

SEQ ID NO: 5297064 - DNA, 22 bp, Homo sapiens
caattatagtttctgaggcttt

SEQ ID NO: 5297065 - DNA, 17 bp, Homo sapiens
caattatataaatcatt

SEQ ID NO: 5297066 - DNA, 21 bp, Homo sapiens
caattatatctattatgtata

SEQ ID NO: 5297067 - DNA, 13 bp, Homo sapiens
caattatattgtc

SEQ ID NO: 5297068 - DNA, 15 bp, Homo sapiens
caattatcaaaaaac

SEQ ID NO: 5297069 - DNA, 22 bp, Homo sapiens
caattatcaaaaaacagaaaaa

SEQ ID NO: 5297070 - DNA, 17 bp, Homo sapiens
caattatcttatttaat

SEQ ID NO: 5297071 - DNA, 18 bp, Homo sapiens
caattatcttatttaatt

SEQ ID NO: 5297072 - DNA, 17 bp, Homo sapiens
caattatgaaaaaatgt

SEQ ID NO: 5297073 - DNA, 20 bp, Homo sapiens
caattatgatagcttatgta

SEQ ID NO: 5297074 - DNA, 13 bp, Homo sapiens
caattatggaaat

SEQ ID NO: 5297075 - DNA, 14 bp, Homo sapiens
caattatgtctctt

SEQ ID NO: 5297076 - DNA, 13 bp, Homo sapiens
caattatgtgaca

SEQ ID NO: 5297077 - DNA, 13 bp, Homo sapiens
caattatgttaaa

SEQ ID NO: 5297078 - DNA, 13 bp, Homo sapiens
caattatgtttct

SEQ ID NO: 5297079 - DNA, 20 bp, Homo sapiens
caattattacatttatacat

SEQ ID NO: 5297080 - DNA, 13 bp, Homo sapiens
caattattctaat

SEQ ID NO: 5297081 - DNA, 15 bp, Homo sapiens
caattattgatatat

SEQ ID NO: 5297082 - DNA, 14 bp, Homo sapiens
caattattggcaaa

SEQ ID NO: 5297083 - DNA, 16 bp, Homo sapiens
caattattggcaaagt

SEQ ID NO: 5297084 - DNA, 13 bp, Homo sapiens
caattattgtata

SEQ ID NO: 5297085 - DNA, 22 bp, Homo sapiens
caattattgttacacattaagt

SEQ ID NO: 5297086 - DNA, 17 bp, Homo sapiens
caattatttaaagaaag

SEQ ID NO: 5297087 - DNA, 13 bp, Homo sapiens
caattatttcccc

SEQ ID NO: 5297088 - DNA, 15 bp, Homo sapiens
caattatttccccca

SEQ ID NO: 5297089 - DNA, 18 bp, Homo sapiens
caattatttgcatatttt

SEQ ID NO: 5297090 - DNA, 23 bp, Homo sapiens
caattattttggatctatcacct

SEQ ID NO: 5297091 - DNA, 14 bp, Homo sapiens
caattcaaaaatgt

SEQ ID NO: 5297092 - DNA, 12 bp, Homo sapiens
caattcaaaaca

SEQ ID NO: 5297093 - DNA, 13 bp, Homo sapiens
caattcaaaagtt

SEQ ID NO: 5297094 - DNA, 13 bp, Homo sapiens
caattcaaagctg

SEQ ID NO: 5297095 - DNA, 13 bp, Homo sapiens
caattcaaatgct

SEQ ID NO: 5297096 - DNA, 14 bp, Homo sapiens
caattcaacacatt

SEQ ID NO: 5297097 - DNA, 23 bp, Homo sapiens
caattcaacacattacttgcaca

SEQ ID NO: 5297098 - DNA, 14 bp, Homo sapiens
caattcaacccttt

SEQ ID NO: 5297099 - DNA, 17 bp, Homo sapiens
caattcaagctgagaaa

SEQ ID NO: 5297100 - DNA, 15 bp, Homo sapiens
caattcaatcaaagc

SEQ ID NO: 5297101 - DNA, 19 bp, Homo sapiens
caattcaatgcaatgaaaa

SEQ ID NO: 5297102 - DNA, 22 bp, Homo sapiens
caattcaatgcaatgaaaacaa

SEQ ID NO: 5297103 - DNA, 14 bp, Homo sapiens
caattcacccactc

SEQ ID NO: 5297104 - DNA, 19 bp, Homo sapiens
caattcacgccccccttaa

SEQ ID NO: 5297105 - DNA, 13 bp, Homo sapiens
caattcacgctgt

SEQ ID NO: 5297106 - DNA, 14 bp, Homo sapiens
caattcacttcatt

SEQ ID NO: 5297107 - DNA, 14 bp, Homo sapiens
caattcagacaggc

SEQ ID NO: 5297108 - DNA, 23 bp, Homo sapiens
caattcagacaggcaaataaaag

SEQ ID NO: 5297109 - DNA, 19 bp, Homo sapiens
caattcagattgtcttgca

SEQ ID NO: 5297110 - DNA, 19 bp, Homo sapiens
caattcaggactggctcac

SEQ ID NO: 5297111 - DNA, 15 bp, Homo sapiens
caattcagtaacaaa

SEQ ID NO: 5297112 - DNA, 14 bp, Homo sapiens
caattcagtctgct

SEQ ID NO: 5297113 - DNA, 14 bp, Homo sapiens
caattcagttttag

SEQ ID NO: 5297114 - DNA, 13 bp, Homo sapiens
caattcatgaact

SEQ ID NO: 5297115 - DNA, 15 bp, Homo sapiens
caattcatgaagtga

SEQ ID NO: 5297116 - DNA, 16 bp, Homo sapiens
caattcatgaagtgaa

SEQ ID NO: 5297117 - DNA, 19 bp, Homo sapiens
caattcatgcctttcatag

SEQ ID NO: 5297118 - DNA, 20 bp, Homo sapiens
caattcatgcctttcatagt

SEQ ID NO: 5297119 - DNA, 17 bp, Homo sapiens
caattcatggttcaagt

SEQ ID NO: 5297120 - DNA, 18 bp, Homo sapiens
caattcatggttcaagta

SEQ ID NO: 5297121 - DNA, 17 bp, Homo sapiens
caattcatgtaacagtt

SEQ ID NO: 5297122 - DNA, 13 bp, Homo sapiens
caattcattgtgt

SEQ ID NO: 5297123 - DNA, 16 bp, Homo sapiens
caattcatttcacttt

SEQ ID NO: 5297124 - DNA, 17 bp, Homo sapiens
caattcatttcacttta

SEQ ID NO: 5297125 - DNA, 20 bp, Homo sapiens
caattccaaaattccatccc

SEQ ID NO: 5297126 - DNA, 17 bp, Homo sapiens
caattccaatatttctg

SEQ ID NO: 5297127 - DNA, 18 bp, Homo sapiens
caattccaatttcaaaat

SEQ ID NO: 5297128 - DNA, 16 bp, Homo sapiens
caattccaccagggcc

SEQ ID NO: 5297129 - DNA, 22 bp, Homo sapiens
caattccaccagggccagagca

SEQ ID NO: 5297130 - DNA, 23 bp, Homo sapiens
caattccaccagggccagagcag

SEQ ID NO: 5297131 - DNA, 13 bp, Homo sapiens
caattccacctgc

SEQ ID NO: 5297132 - DNA, 22 bp, Homo sapiens
caattccactctgatagaatta

SEQ ID NO: 5297133 - DNA, 13 bp, Homo sapiens
caattccagagct

SEQ ID NO: 5297134 - DNA, 19 bp, Homo sapiens
caattccaggctgagccat

SEQ ID NO: 5297135 - DNA, 23 bp, Homo sapiens
caattccaggtgtgcacagaaaa

SEQ ID NO: 5297136 - DNA, 15 bp, Homo sapiens
caattccatttccag

SEQ ID NO: 5297137 - DNA, 17 bp, Homo sapiens
caattccattttgtgtc

SEQ ID NO: 5297138 - DNA, 17 bp, Homo sapiens
caattcccaccactaaa

SEQ ID NO: 5297139 - DNA, 14 bp, Homo sapiens
caattcccccttaa

SEQ ID NO: 5297140 - DNA, 11 bp, Homo sapiens
caattcccctc

SEQ ID NO: 5297141 - DNA, 21 bp, Homo sapiens
caattcccttctttttcatcc

SEQ ID NO: 5297142 - DNA, 21 bp, Homo sapiens
caattccgtagccagctgctc

SEQ ID NO: 5297143 - DNA, 15 bp, Homo sapiens
caattcctagataaa

SEQ ID NO: 5297144 - DNA, 16 bp, Homo sapiens
caattcctagataaaa

SEQ ID NO: 5297145 - DNA, 15 bp, Homo sapiens
caattcctcatcctc

SEQ ID NO: 5297146 - DNA, 18 bp, Homo sapiens
caattcctcatcctcaga

SEQ ID NO: 5297147 - DNA, 22 bp, Homo sapiens
caattcctcatcctcagatgct

SEQ ID NO: 5297148 - DNA, 16 bp, Homo sapiens
caattcctccagagac

SEQ ID NO: 5297149 - DNA, 18 bp, Homo sapiens
caattcctccagagacac

SEQ ID NO: 5297150 - DNA, 23 bp, Homo sapiens
caattcctccagagacactgagc

SEQ ID NO: 5297151 - DNA, 16 bp, Homo sapiens
caattcctggccctgt

SEQ ID NO: 5297152 - DNA, 19 bp, Homo sapiens
caattcggggcctgctgga

SEQ ID NO: 5297153 - DNA, 15 bp, Homo sapiens
caattctaagtgaga

SEQ ID NO: 5297154 - DNA, 19 bp, Homo sapiens
caattctaagtgagatgtt

SEQ ID NO: 5297155 - DNA, 15 bp, Homo sapiens
caattctaatggtaa

SEQ ID NO: 5297156 - DNA, 23 bp, Homo sapiens
caattctaatggtaacttttgta

SEQ ID NO: 5297157 - DNA, 20 bp, Homo sapiens
caattctacccagagccttc

SEQ ID NO: 5297158 - DNA, 19 bp, Homo sapiens
caattctaggatgaacaat

SEQ ID NO: 5297159 - DNA, 22 bp, Homo sapiens
caattctaggatgaacaatgta

SEQ ID NO: 5297160 - DNA, 23 bp, Homo sapiens
caattctaggatgaacaatgtat

SEQ ID NO: 5297161 - DNA, 16 bp, Homo sapiens
caattctagtcatata

SEQ ID NO: 5297162 - DNA, 17 bp, Homo sapiens
caattctcctgcctcag

SEQ ID NO: 5297163 - DNA, 17 bp, Homo sapiens
caattctctttagttct

SEQ ID NO: 5297164 - DNA, 22 bp, Homo sapiens
caattctgaaggggaaaacctc

SEQ ID NO: 5297165 - DNA, 12 bp, Homo sapiens
caattctgtata

SEQ ID NO: 5297166 - DNA, 13 bp, Homo sapiens
caattctgtccca

SEQ ID NO: 5297167 - DNA, 21 bp, Homo sapiens
caattctgtccctgtccctgc

SEQ ID NO: 5297168 - DNA, 14 bp, Homo sapiens
caattctgttttag

SEQ ID NO: 5297169 - DNA, 17 bp, Homo sapiens
caattcttacaaacatg

SEQ ID NO: 5297170 - DNA, 19 bp, Homo sapiens
caattcttacaaacatgtg

SEQ ID NO: 5297171 - DNA, 17 bp, Homo sapiens
caattcttccctatctt

SEQ ID NO: 5297172 - DNA, 20 bp, Homo sapiens
caattcttccctatctttgc

SEQ ID NO: 5297173 - DNA, 22 bp, Homo sapiens
caattcttccctatctttgcca

SEQ ID NO: 5297174 - DNA, 21 bp, Homo sapiens
caattcttctcgacttcagga

SEQ ID NO: 5297175 - DNA, 17 bp, Homo sapiens
caattcttgtaactttc

SEQ ID NO: 5297176 - DNA, 13 bp, Homo sapiens
caattctttatac

SEQ ID NO: 5297177 - DNA, 21 bp, Homo sapiens
caattgaacttaaataaatgt

SEQ ID NO: 5297178 - DNA, 20 bp, Homo sapiens
caattgaaggatcatctgaa

SEQ ID NO: 5297179 - DNA, 14 bp, Homo sapiens
caattgacaacagt

SEQ ID NO: 5297180 - DNA, 21 bp, Homo sapiens
caattgacaacagttacataa

SEQ ID NO: 5297181 - DNA, 14 bp, Homo sapiens
caattgactctcac

SEQ ID NO: 5297182 - DNA, 15 bp, Homo sapiens
caattgacttcctcc

SEQ ID NO: 5297183 - DNA, 14 bp, Homo sapiens
caattgagaaaaat

SEQ ID NO: 5297184 - DNA, 23 bp, Homo sapiens
caattgagaaaaatatatactaa

SEQ ID NO: 5297185 - DNA, 22 bp, Homo sapiens
caattgagggcattagtacttt

SEQ ID NO: 5297186 - DNA, 16 bp, Homo sapiens
caattgatacttcagg

SEQ ID NO: 5297187 - DNA, 22 bp, Homo sapiens
caattgatccttaaccaataat

SEQ ID NO: 5297188 - DNA, 21 bp, Homo sapiens
caattgatgtatatgtttata

SEQ ID NO: 5297189 - DNA, 18 bp, Homo sapiens
caattgatgtgattattt

SEQ ID NO: 5297190 - DNA, 13 bp, Homo sapiens
caattgatgtttt

SEQ ID NO: 5297191 - DNA, 14 bp, Homo sapiens
caattgcacaaata

SEQ ID NO: 5297192 - DNA, 17 bp, Homo sapiens
caattgcaccaaaagaa

SEQ ID NO: 5297193 - DNA, 15 bp, Homo sapiens
caattgcactgctgt

SEQ ID NO: 5297194 - DNA, 15 bp, Homo sapiens
caattgcagatgcca

SEQ ID NO: 5297195 - DNA, 21 bp, Homo sapiens
caattgcagcagacccagcag

SEQ ID NO: 5297196 - DNA, 13 bp, Homo sapiens
caattgccacatt

SEQ ID NO: 5297197 - DNA, 15 bp, Homo sapiens
caattgccctgccag

SEQ ID NO: 5297198 - DNA, 18 bp, Homo sapiens
caattgccctgccaggct

SEQ ID NO: 5297199 - DNA, 23 bp, Homo sapiens
caattgcgaccttaatttaactt

SEQ ID NO: 5297200 - DNA, 20 bp, Homo sapiens
caattgctcatgttggccaa

SEQ ID NO: 5297201 - DNA, 20 bp, Homo sapiens
caattgctcttctccacgtc

SEQ ID NO: 5297202 - DNA, 21 bp, Homo sapiens
caattgcttctgtgcaataaa

SEQ ID NO: 5297203 - DNA, 18 bp, Homo sapiens
caattggaagtctaagaa

SEQ ID NO: 5297204 - DNA, 14 bp, Homo sapiens
caattggagggtct

SEQ ID NO: 5297205 - DNA, 15 bp, Homo sapiens
caattggcaccgaag

SEQ ID NO: 5297206 - DNA, 19 bp, Homo sapiens
caattggcaccgaagccca

SEQ ID NO: 5297207 - DNA, 20 bp, Homo sapiens
caattggcaccgaagcccag

SEQ ID NO: 5297208 - DNA, 16 bp, Homo sapiens
caattggcagtgactt

SEQ ID NO: 5297209 - DNA, 22 bp, Homo sapiens
caattgggatggcgctaggcat

SEQ ID NO: 5297210 - DNA, 16 bp, Homo sapiens
caattggggaagaaaa

SEQ ID NO: 5297211 - DNA, 17 bp, Homo sapiens
caattggggaagaaaaa

SEQ ID NO: 5297212 - DNA, 18 bp, Homo sapiens
caattggggaagaaaaaa

SEQ ID NO: 5297213 - DNA, 23 bp, Homo sapiens
caattgggttttgatctcagcat

SEQ ID NO: 5297214 - DNA, 21 bp, Homo sapiens
caattggtaaaactcactgtg

SEQ ID NO: 5297215 - DNA, 20 bp, Homo sapiens
caattggtgcttcagccctg

SEQ ID NO: 5297216 - DNA, 22 bp, Homo sapiens
caattgtaaacagaaattgcaa

SEQ ID NO: 5297217 - DNA, 15 bp, Homo sapiens
caattgtaaactagt

SEQ ID NO: 5297218 - DNA, 14 bp, Homo sapiens
caattgtacaaaaa

SEQ ID NO: 5297219 - DNA, 15 bp, Homo sapiens
caattgtacaaaaaa

SEQ ID NO: 5297220 - DNA, 17 bp, Homo sapiens
caattgtatatatatgt

SEQ ID NO: 5297221 - DNA, 12 bp, Homo sapiens
caattgtatttt

SEQ ID NO: 5297222 - DNA, 14 bp, Homo sapiens
caattgtcatttat

SEQ ID NO: 5297223 - DNA, 15 bp, Homo sapiens
caattgtcatttata

SEQ ID NO: 5297224 - DNA, 13 bp, Homo sapiens
caattgtcttttt

SEQ ID NO: 5297225 - DNA, 20 bp, Homo sapiens
caattgtcttttttttcctt

SEQ ID NO: 5297226 - DNA, 17 bp, Homo sapiens
caattgtgaacatgata

SEQ ID NO: 5297227 - DNA, 21 bp, Homo sapiens
caattgtgagaattactgttt

SEQ ID NO: 5297228 - DNA, 21 bp, Homo sapiens
caattgtgagccaccacgtcc

SEQ ID NO: 5297229 - DNA, 15 bp, Homo sapiens
caattgtgctgccat

SEQ ID NO: 5297230 - DNA, 15 bp, Homo sapiens
caattgtgtagcctt

SEQ ID NO: 5297231 - DNA, 16 bp, Homo sapiens
caattgtgtagccttt

SEQ ID NO: 5297232 - DNA, 20 bp, Homo sapiens
caattgtgtagcctttttgt

SEQ ID NO: 5297233 - DNA, 21 bp, Homo sapiens
caattgttacaagtgttctta

SEQ ID NO: 5297234 - DNA, 14 bp, Homo sapiens
caattgttcttaaa

SEQ ID NO: 5297235 - DNA, 14 bp, Homo sapiens
caattgttgacagt

SEQ ID NO: 5297236 - DNA, 21 bp, Homo sapiens
caattgttgacagttctgaag

SEQ ID NO: 5297237 - DNA, 24 bp, Homo sapiens
caattgttgacagttctgaagaat

SEQ ID NO: 5297238 - DNA, 22 bp, Homo sapiens
caattgtttggggttgaaaatt

SEQ ID NO: 5297239 - DNA, 22 bp, Homo sapiens
caattgtttgggtgattcctaa

SEQ ID NO: 5297240 - DNA, 21 bp, Homo sapiens
caattgttttaatctgaaatt

SEQ ID NO: 5297241 - DNA, 23 bp, Homo sapiens
caattgttttacctgttctgaaa

SEQ ID NO: 5297242 - DNA, 12 bp, Homo sapiens
caatttaaaaaa

SEQ ID NO: 5297243 - DNA, 13 bp, Homo sapiens
caatttaaaatta

SEQ ID NO: 5297244 - DNA, 20 bp, Homo sapiens
caatttaaacccattttagt

SEQ ID NO: 5297245 - DNA, 12 bp, Homo sapiens
caatttaaagca

SEQ ID NO: 5297246 - DNA, 22 bp, Homo sapiens
caatttaaaggaaagttctatt

SEQ ID NO: 5297247 - DNA, 11 bp, Homo sapiens
caatttaaatg

SEQ ID NO: 5297248 - DNA, 14 bp, Homo sapiens
caatttaaatgtta

SEQ ID NO: 5297249 - DNA, 19 bp, Homo sapiens
caatttaaatgtttactat

SEQ ID NO: 5297250 - DNA, 17 bp, Homo sapiens
caatttaaattgttata

SEQ ID NO: 5297251 - DNA, 12 bp, Homo sapiens
caatttaaggaa

SEQ ID NO: 5297252 - DNA, 22 bp, Homo sapiens
caatttaaggaacacagagcag

SEQ ID NO: 5297253 - DNA, 20 bp, Homo sapiens
caatttaatggatatttctc

SEQ ID NO: 5297254 - DNA, 16 bp, Homo sapiens
caatttaattcttatt

SEQ ID NO: 5297255 - DNA, 13 bp, Homo sapiens
caatttacaaagt

SEQ ID NO: 5297256 - DNA, 20 bp, Homo sapiens
caatttacaaagtgtgtatt

SEQ ID NO: 5297257 - DNA, 16 bp, Homo sapiens
caatttagaaaacatt

SEQ ID NO: 5297258 - DNA, 23 bp, Homo sapiens
caatttaggaatgctcaatgtgc

SEQ ID NO: 5297259 - DNA, 20 bp, Homo sapiens
caatttagttgttgtagaga

SEQ ID NO: 5297260 - DNA, 14 bp, Homo sapiens
caatttatacctca

SEQ ID NO: 5297261 - DNA, 21 bp, Homo sapiens
caatttatatctttatgcaaa

SEQ ID NO: 5297262 - DNA, 22 bp, Homo sapiens
caatttatatctttatgcaaaa

SEQ ID NO: 5297263 - DNA, 14 bp, Homo sapiens
caatttatgaattg

SEQ ID NO: 5297264 - DNA, 13 bp, Homo sapiens
caatttatgcaga

SEQ ID NO: 5297265 - DNA, 15 bp, Homo sapiens
caatttatgggagaa

SEQ ID NO: 5297266 - DNA, 14 bp, Homo sapiens
caatttattaaaat

SEQ ID NO: 5297267 - DNA, 22 bp, Homo sapiens
caatttattaaaatgattgtaa

SEQ ID NO: 5297268 - DNA, 13 bp, Homo sapiens
caatttattatgg

SEQ ID NO: 5297269 - DNA, 13 bp, Homo sapiens
caatttattctga

SEQ ID NO: 5297270 - DNA, 13 bp, Homo sapiens
caatttatttggg

SEQ ID NO: 5297271 - DNA, 13 bp, Homo sapiens
caatttattttat

SEQ ID NO: 5297272 - DNA, 21 bp, Homo sapiens
caatttcaaaaaaataaaata

SEQ ID NO: 5297273 - DNA, 14 bp, Homo sapiens
caatttcaaaagaa

SEQ ID NO: 5297274 - DNA, 22 bp, Homo sapiens
caatttcaaaagaacattctta

SEQ ID NO: 5297275 - DNA, 16 bp, Homo sapiens
caatttcaaaatgcat

SEQ ID NO: 5297276 - DNA, 23 bp, Homo sapiens
caatttcaaaatgcatgtgattg

SEQ ID NO: 5297277 - DNA, 17 bp, Homo sapiens
caatttcaaacttttga

SEQ ID NO: 5297278 - DNA, 16 bp, Homo sapiens
caatttcaaggttcta

SEQ ID NO: 5297279 - DNA, 15 bp, Homo sapiens
caatttcaatggtgt

SEQ ID NO: 5297280 - DNA, 19 bp, Homo sapiens
caatttcaattttgtctgt

SEQ ID NO: 5297281 - DNA, 20 bp, Homo sapiens
caatttcacagagtacaaaa

SEQ ID NO: 5297282 - DNA, 14 bp, Homo sapiens
caatttcagactcc

SEQ ID NO: 5297283 - DNA, 11 bp, Homo sapiens
caatttcagca

SEQ ID NO: 5297284 - DNA, 23 bp, Homo sapiens
caatttcaggaatttaatttata

SEQ ID NO: 5297285 - DNA, 17 bp, Homo sapiens
caatttccaagagctga

SEQ ID NO: 5297286 - DNA, 15 bp, Homo sapiens
caatttcccacccat

SEQ ID NO: 5297287 - DNA, 15 bp, Homo sapiens
caatttcccagaagg

SEQ ID NO: 5297288 - DNA, 15 bp, Homo sapiens
caatttccccctgtt

SEQ ID NO: 5297289 - DNA, 22 bp, Homo sapiens
caatttcccctctgtgtcctct

SEQ ID NO: 5297290 - DNA, 15 bp, Homo sapiens
caatttcctctccac

SEQ ID NO: 5297291 - DNA, 16 bp, Homo sapiens
caatttcctctccact

SEQ ID NO: 5297292 - DNA, 14 bp, Homo sapiens
caatttcctggccc

SEQ ID NO: 5297293 - DNA, 15 bp, Homo sapiens
caatttcctttatat

SEQ ID NO: 5297294 - DNA, 21 bp, Homo sapiens
caatttcctttatatttagtg

SEQ ID NO: 5297295 - DNA, 21 bp, Homo sapiens
caatttcggattttttccaaa

SEQ ID NO: 5297296 - DNA, 15 bp, Homo sapiens
caatttctaaatttg

SEQ ID NO: 5297297 - DNA, 16 bp, Homo sapiens
caatttctaatgttta

SEQ ID NO: 5297298 - DNA, 18 bp, Homo sapiens
caatttctaatgtttact

SEQ ID NO: 5297299 - DNA, 17 bp, Homo sapiens
caatttctaatttttaa

SEQ ID NO: 5297300 - DNA, 20 bp, Homo sapiens
caatttctacaaaatcctga

SEQ ID NO: 5297301 - DNA, 16 bp, Homo sapiens
caatttctattaaagg

SEQ ID NO: 5297302 - DNA, 23 bp, Homo sapiens
caatttctattatttttcaagta

SEQ ID NO: 5297303 - DNA, 22 bp, Homo sapiens
caatttctcacaatagacagaa

SEQ ID NO: 5297304 - DNA, 13 bp, Homo sapiens
caatttctcccca

SEQ ID NO: 5297305 - DNA, 23 bp, Homo sapiens
caatttctgtacatttgcaatta

SEQ ID NO: 5297306 - DNA, 22 bp, Homo sapiens
caatttctgtccttcagatgga

SEQ ID NO: 5297307 - DNA, 13 bp, Homo sapiens
caatttcttcctt

SEQ ID NO: 5297308 - DNA, 17 bp, Homo sapiens
caatttctttaaaaaag

SEQ ID NO: 5297309 - DNA, 22 bp, Homo sapiens
caatttctttctttccttaata

SEQ ID NO: 5297310 - DNA, 17 bp, Homo sapiens
caatttcttttatgtta

SEQ ID NO: 5297311 - DNA, 21 bp, Homo sapiens
caatttgaaatcaccttttct

SEQ ID NO: 5297312 - DNA, 16 bp, Homo sapiens
caatttgagcaattca

SEQ ID NO: 5297313 - DNA, 21 bp, Homo sapiens
caatttgagcaattcatttca

SEQ ID NO: 5297314 - DNA, 20 bp, Homo sapiens
caatttgagccatttaaaga

SEQ ID NO: 5297315 - DNA, 14 bp, Homo sapiens
caatttgatacata

SEQ ID NO: 5297316 - DNA, 19 bp, Homo sapiens
caatttgatacataataaa

SEQ ID NO: 5297317 - DNA, 19 bp, Homo sapiens
caatttgcacaatatttct

SEQ ID NO: 5297318 - DNA, 20 bp, Homo sapiens
caatttgcacaatatttctt

SEQ ID NO: 5297319 - DNA, 15 bp, Homo sapiens
caatttgcacattaa

SEQ ID NO: 5297320 - DNA, 22 bp, Homo sapiens
caatttgcacattaaatgactc

SEQ ID NO: 5297321 - DNA, 13 bp, Homo sapiens
caatttgcaccag

SEQ ID NO: 5297322 - DNA, 21 bp, Homo sapiens
caatttgcactaaatcagaga

SEQ ID NO: 5297323 - DNA, 23 bp, Homo sapiens
caatttgcataatactaatttat

SEQ ID NO: 5297324 - DNA, 13 bp, Homo sapiens
caatttgccttag

SEQ ID NO: 5297325 - DNA, 15 bp, Homo sapiens
caatttgctatttac

SEQ ID NO: 5297326 - DNA, 16 bp, Homo sapiens
caatttgctgaaaaca

SEQ ID NO: 5297327 - DNA, 19 bp, Homo sapiens
caatttgggagatatattt

SEQ ID NO: 5297328 - DNA, 18 bp, Homo sapiens
caatttgggcttcctgtt

SEQ ID NO: 5297329 - DNA, 17 bp, Homo sapiens
caatttgggtcccagct

SEQ ID NO: 5297330 - DNA, 23 bp, Homo sapiens
caatttgggtcccagctaaagag

SEQ ID NO: 5297331 - DNA, 24 bp, Homo sapiens
caatttggtttagaatgctgcgct

SEQ ID NO: 5297332 - DNA, 14 bp, Homo sapiens
caatttgtaaatat

SEQ ID NO: 5297333 - DNA, 16 bp, Homo sapiens
caatttgtaaatattg

SEQ ID NO: 5297334 - DNA, 21 bp, Homo sapiens
caatttgtaagtaacacagta

SEQ ID NO: 5297335 - DNA, 23 bp, Homo sapiens
caatttgtaattgcttacatttt

SEQ ID NO: 5297336 - DNA, 16 bp, Homo sapiens
caatttgtaattttag

SEQ ID NO: 5297337 - DNA, 21 bp, Homo sapiens
caatttgtacttttttcttaa

SEQ ID NO: 5297338 - DNA, 15 bp, Homo sapiens
caatttgtattactt

SEQ ID NO: 5297339 - DNA, 16 bp, Homo sapiens
caatttgtcattttga

SEQ ID NO: 5297340 - DNA, 17 bp, Homo sapiens
caatttgttaacagagc

SEQ ID NO: 5297341 - DNA, 19 bp, Homo sapiens
caatttgttaacagagcaa

SEQ ID NO: 5297342 - DNA, 18 bp, Homo sapiens
caatttgttaattcctat

SEQ ID NO: 5297343 - DNA, 19 bp, Homo sapiens
caatttgttaattcctatg

SEQ ID NO: 5297344 - DNA, 21 bp, Homo sapiens
caatttgttaattcctatgaa

SEQ ID NO: 5297345 - DNA, 23 bp, Homo sapiens
caatttgttggagatgcagcctt

SEQ ID NO: 5297346 - DNA, 15 bp, Homo sapiens
caatttgtttaaaga

SEQ ID NO: 5297347 - DNA, 18 bp, Homo sapiens
caatttgtttgtgcttct

SEQ ID NO: 5297348 - DNA, 19 bp, Homo sapiens
caatttgtttgtgcttcta

SEQ ID NO: 5297349 - DNA, 20 bp, Homo sapiens
caatttgtttttgcattttt

SEQ ID NO: 5297350 - DNA, 22 bp, Homo sapiens
caatttgtttttgcatttttgt

SEQ ID NO: 5297351 - DNA, 19 bp, Homo sapiens
caattttaaaaaataacat

SEQ ID NO: 5297352 - DNA, 22 bp, Homo sapiens
caattttaaaaaataacatatt

SEQ ID NO: 5297353 - DNA, 22 bp, Homo sapiens
caattttaaaatgaaatgcatt

SEQ ID NO: 5297354 - DNA, 12 bp, Homo sapiens
caattttaaaga

SEQ ID NO: 5297355 - DNA, 15 bp, Homo sapiens
caattttaaagacat

SEQ ID NO: 5297356 - DNA, 20 bp, Homo sapiens
caaaaggaagactggagaaa

SEQ ID NO: 5297357 - DNA, 20 bp, Homo sapiens
caaaaggaagggtggctttg

SEQ ID NO: 5297358 - DNA, 13 bp, Homo sapiens
caaaaggaagtct

SEQ ID NO: 5297359 - DNA, 14 bp, Homo sapiens
caaaaggaatgaac

SEQ ID NO: 5297360 - DNA, 15 bp, Homo sapiens
caaaaggaatgaact

SEQ ID NO: 5297361 - DNA, 22 bp, Homo sapiens
caaaaggatctttgtggccaag

SEQ ID NO: 5297362 - DNA, 14 bp, Homo sapiens
caaaaggatgattt

SEQ ID NO: 5297363 - DNA, 15 bp, Homo sapiens
caaaaggcagaagca

SEQ ID NO: 5297364 - DNA, 16 bp, Homo sapiens
caaaaggcagcccttt

SEQ ID NO: 5297365 - DNA, 19 bp, Homo sapiens
caaaaggcagccctttggg

SEQ ID NO: 5297366 - DNA, 19 bp, Homo sapiens
caaaaggcagctcacccct

SEQ ID NO: 5297367 - DNA, 22 bp, Homo sapiens
caaaaggcagctcacccctggg

SEQ ID NO: 5297368 - DNA, 18 bp, Homo sapiens
caaaaggcggtgagagag

SEQ ID NO: 5297369 - DNA, 15 bp, Homo sapiens
caaaaggcttgcaga

SEQ ID NO: 5297370 - DNA, 15 bp, Homo sapiens
caaaagggaaaaaat

SEQ ID NO: 5297371 - DNA, 14 bp, Homo sapiens
caaaagggaaaaga

SEQ ID NO: 5297372 - DNA, 16 bp, Homo sapiens
caaaagggaagagttt

SEQ ID NO: 5297373 - DNA, 18 bp, Homo sapiens
caaaagggcagccagggg

SEQ ID NO: 5297374 - DNA, 19 bp, Homo sapiens
caaaagggcagccaggggc

SEQ ID NO: 5297375 - DNA, 21 bp, Homo sapiens
caaaagggcagccaggggctg

SEQ ID NO: 5297376 - DNA, 17 bp, Homo sapiens
caaaagggcagctgtga

SEQ ID NO: 5297377 - DNA, 19 bp, Homo sapiens
caaaagggccaaagaacca

SEQ ID NO: 5297378 - DNA, 14 bp, Homo sapiens
caaaagggccaggt

SEQ ID NO: 5297379 - DNA, 16 bp, Homo sapiens
caaaagggccaggtgc

SEQ ID NO: 5297380 - DNA, 13 bp, Homo sapiens
caaaagggtcaga

SEQ ID NO: 5297381 - DNA, 23 bp, Homo sapiens
caaaagggtcagaggacctgtat

SEQ ID NO: 5297382 - DNA, 22 bp, Homo sapiens
caaaagggtcttgactctaaat

SEQ ID NO: 5297383 - DNA, 19 bp, Homo sapiens
caaaagggtgtatagtgtt

SEQ ID NO: 5297384 - DNA, 18 bp, Homo sapiens
caaaagggttcatagaaa

SEQ ID NO: 5297385 - DNA, 20 bp, Homo sapiens
caaaaggtaatgcacatcct

SEQ ID NO: 5297386 - DNA, 23 bp, Homo sapiens
caaaaggtactggtgagggcaag

SEQ ID NO: 5297387 - DNA, 20 bp, Homo sapiens
caaaaggttcactaaagcag

SEQ ID NO: 5297388 - DNA, 15 bp, Homo sapiens
caaaaggtttattcc

SEQ ID NO: 5297389 - DNA, 19 bp, Homo sapiens
caaaagtaaatgggagggc

SEQ ID NO: 5297390 - DNA, 14 bp, Homo sapiens
caaaagtaatgcct

SEQ ID NO: 5297391 - DNA, 17 bp, Homo sapiens
caaaagtacattgctta

SEQ ID NO: 5297392 - DNA, 15 bp, Homo sapiens
caaaagtaccataga

SEQ ID NO: 5297393 - DNA, 20 bp, Homo sapiens
caaaagtactagcaataagt

SEQ ID NO: 5297394 - DNA, 15 bp, Homo sapiens
caaaagtatattcaa

SEQ ID NO: 5297395 - DNA, 17 bp, Homo sapiens
caaaagtatcgggggct

SEQ ID NO: 5297396 - DNA, 13 bp, Homo sapiens
caaaagtattttc

SEQ ID NO: 5297397 - DNA, 17 bp, Homo sapiens
caaaagtcacccaggga

SEQ ID NO: 5297398 - DNA, 16 bp, Homo sapiens
caaaagtccctccctg

SEQ ID NO: 5297399 - DNA, 22 bp, Homo sapiens
caaaagtccttagaatgaggga

SEQ ID NO: 5297400 - DNA, 14 bp, Homo sapiens
caaaagtctatttt

SEQ ID NO: 5297401 - DNA, 16 bp, Homo sapiens
caaaagtctgtctttc

SEQ ID NO: 5297402 - DNA, 22 bp, Homo sapiens
caaaagtgacagatgttatttt

SEQ ID NO: 5297403 - DNA, 16 bp, Homo sapiens
caaaagtgagatggga

SEQ ID NO: 5297404 - DNA, 14 bp, Homo sapiens
caaaagtgatctgt

SEQ ID NO: 5297405 - DNA, 23 bp, Homo sapiens
caaaagtgcattcaaccttacca

SEQ ID NO: 5297406 - DNA, 14 bp, Homo sapiens
caaaagtggcctct

SEQ ID NO: 5297407 - DNA, 18 bp, Homo sapiens
caaaagtggcctctttgt

SEQ ID NO: 5297408 - DNA, 22 bp, Homo sapiens
caaaagtggggctaaatgaagt

SEQ ID NO: 5297409 - DNA, 22 bp, Homo sapiens
caaaagttattaaaattgttgt

SEQ ID NO: 5297410 - DNA, 18 bp, Homo sapiens
caaaagttcatataattt

SEQ ID NO: 5297411 - DNA, 17 bp, Homo sapiens
caaaagttcgaaagaaa

SEQ ID NO: 5297412 - DNA, 15 bp, Homo sapiens
caaaagttctgactt

SEQ ID NO: 5297413 - DNA, 17 bp, Homo sapiens
caaaagttctgacttga

SEQ ID NO: 5297414 - DNA, 19 bp, Homo sapiens
caaaagttgatttcttctt

SEQ ID NO: 5297415 - DNA, 21 bp, Homo sapiens
caaaagttggactaaatgcct

SEQ ID NO: 5297416 - DNA, 15 bp, Homo sapiens
caaaagtttatcttt

SEQ ID NO: 5297417 - DNA, 11 bp, Homo sapiens
caaaataaaaa

SEQ ID NO: 5297418 - DNA, 18 bp, Homo sapiens
caaaataaaaaccttcca

SEQ ID NO: 5297419 - DNA, 19 bp, Homo sapiens
caaaataaaaaccttccaa

SEQ ID NO: 5297420 - DNA, 21 bp, Homo sapiens
caaaataaaaagtgacacagc

SEQ ID NO: 5297421 - DNA, 22 bp, Homo sapiens
caaaataaaaagtgacacagca

SEQ ID NO: 5297422 - DNA, 12 bp, Homo sapiens
caaaataaaaca

SEQ ID NO: 5297423 - DNA, 15 bp, Homo sapiens
caaaataaaacaaag

SEQ ID NO: 5297424 - DNA, 17 bp, Homo sapiens
caaaataaaacaaaggg

SEQ ID NO: 5297425 - DNA, 16 bp, Homo sapiens
caaaataaaaccagaa

SEQ ID NO: 5297426 - DNA, 21 bp, Homo sapiens
caaaataaaacctcagctagc

SEQ ID NO: 5297427 - DNA, 12 bp, Homo sapiens
caaaataaaact

SEQ ID NO: 5297428 - DNA, 17 bp, Homo sapiens
caaaataaaatgagtta

SEQ ID NO: 5297429 - DNA, 15 bp, Homo sapiens
caaaataaaattatg

SEQ ID NO: 5297430 - DNA, 19 bp, Homo sapiens
caaaataaacctgttcttc

SEQ ID NO: 5297431 - DNA, 14 bp, Homo sapiens
caaaataaagaata

SEQ ID NO: 5297432 - DNA, 20 bp, Homo sapiens
caaaataaagaatagcaatt

SEQ ID NO: 5297433 - DNA, 20 bp, Homo sapiens
caaaataaagtctgtcatgc

SEQ ID NO: 5297434 - DNA, 12 bp, Homo sapiens
caaaataaagtg

SEQ ID NO: 5297435 - DNA, 16 bp, Homo sapiens
caaaataaagtgtgtg

SEQ ID NO: 5297436 - DNA, 19 bp, Homo sapiens
caaaataaagttacattgc

SEQ ID NO: 5297437 - DNA, 14 bp, Homo sapiens
caaaataaatcagt

SEQ ID NO: 5297438 - DNA, 13 bp, Homo sapiens
caaaataaattgg

SEQ ID NO: 5297439 - DNA, 16 bp, Homo sapiens
caaaataagaaaagat

SEQ ID NO: 5297440 - DNA, 14 bp, Homo sapiens
caaaataagttttt

SEQ ID NO: 5297441 - DNA, 22 bp, Homo sapiens
caaaataagtttttctttaata

SEQ ID NO: 5297442 - DNA, 14 bp, Homo sapiens
caaaataatacaac

SEQ ID NO: 5297443 - DNA, 15 bp, Homo sapiens
caaaataatgtcttg

SEQ ID NO: 5297444 - DNA, 18 bp, Homo sapiens
caaaataatgtcttgtta

SEQ ID NO: 5297445 - DNA, 21 bp, Homo sapiens
caaaataatgtcttgttaata

SEQ ID NO: 5297446 - DNA, 18 bp, Homo sapiens
caaaataatttaactaat

SEQ ID NO: 5297447 - DNA, 19 bp, Homo sapiens
caaaataatttaactaatt

SEQ ID NO: 5297448 - DNA, 18 bp, Homo sapiens
caaaataattttaagaaa

SEQ ID NO: 5297449 - DNA, 22 bp, Homo sapiens
caaaataattttaagaaatcaa

SEQ ID NO: 5297450 - DNA, 12 bp, Homo sapiens
caaaatacaatc

SEQ ID NO: 5297451 - DNA, 16 bp, Homo sapiens
caaaatacacgtttat

SEQ ID NO: 5297452 - DNA, 18 bp, Homo sapiens
caaaataccactagtgga

SEQ ID NO: 5297453 - DNA, 22 bp, Homo sapiens
caaaataccagagccttcaagt

SEQ ID NO: 5297454 - DNA, 19 bp, Homo sapiens
caaaatactccaaagatga

SEQ ID NO: 5297455 - DNA, 19 bp, Homo sapiens
caaaatactgggattacag

SEQ ID NO: 5297456 - DNA, 13 bp, Homo sapiens
caaaatacttttt

SEQ ID NO: 5297457 - DNA, 21 bp, Homo sapiens
caaaatagaaagttgcaaggc

SEQ ID NO: 5297458 - DNA, 22 bp, Homo sapiens
caaaatagaaagttgcaaggca

SEQ ID NO: 5297459 - DNA, 14 bp, Homo sapiens
caaaatagaagaag

SEQ ID NO: 5297460 - DNA, 16 bp, Homo sapiens
caaaatagaagaagag

SEQ ID NO: 5297461 - DNA, 16 bp, Homo sapiens
caaaatagacaagttt

SEQ ID NO: 5297462 - DNA, 13 bp, Homo sapiens
caaaatagagaat

SEQ ID NO: 5297463 - DNA, 20 bp, Homo sapiens
caaaataggatttcttaaat

SEQ ID NO: 5297464 - DNA, 22 bp, Homo sapiens
caaaataggatttcttaaattt

SEQ ID NO: 5297465 - DNA, 21 bp, Homo sapiens
caaaatagggtatattttcct

SEQ ID NO: 5297466 - DNA, 22 bp, Homo sapiens
caaaatagtcatgtttctgcag

SEQ ID NO: 5297467 - DNA, 16 bp, Homo sapiens
caaaatagtgccacta

SEQ ID NO: 5297468 - DNA, 14 bp, Homo sapiens
caaaatagttctat

SEQ ID NO: 5297469 - DNA, 19 bp, Homo sapiens
caaaatagttctatttcta

SEQ ID NO: 5297470 - DNA, 13 bp, Homo sapiens
caaaatataaagc

SEQ ID NO: 5297471 - DNA, 15 bp, Homo sapiens
caaaatatatacaca

SEQ ID NO: 5297472 - DNA, 22 bp, Homo sapiens
caaaatatattttgtttacaaa

SEQ ID NO: 5297473 - DNA, 21 bp, Homo sapiens
caaaatatgccccttcttggg

SEQ ID NO: 5297474 - DNA, 14 bp, Homo sapiens
caaaatattaacat

SEQ ID NO: 5297475 - DNA, 23 bp, Homo sapiens
caaaatattatgcaaactactgt

SEQ ID NO: 5297476 - DNA, 21 bp, Homo sapiens
caaaatattatgttatgaaaa

SEQ ID NO: 5297477 - DNA, 14 bp, Homo sapiens
caaaatattcttct

SEQ ID NO: 5297478 - DNA, 20 bp, Homo sapiens
caaaatatttaaaaatgtct

SEQ ID NO: 5297479 - DNA, 21 bp, Homo sapiens
caaaatatttaaaaatgtctt

SEQ ID NO: 5297480 - DNA, 16 bp, Homo sapiens
caaaatatttaagtga

SEQ ID NO: 5297481 - DNA, 19 bp, Homo sapiens
caaaatatttaagtgaagg

SEQ ID NO: 5297482 - DNA, 23 bp, Homo sapiens
caaaatatttaagtgaaggagaa

SEQ ID NO: 5297483 - DNA, 13 bp, Homo sapiens
caaaatatttcta

SEQ ID NO: 5297484 - DNA, 22 bp, Homo sapiens
caaaatatttctaagcttattt

SEQ ID NO: 5297485 - DNA, 13 bp, Homo sapiens
caaaatatttgtg

SEQ ID NO: 5297486 - DNA, 14 bp, Homo sapiens
caaaatatttgtga

SEQ ID NO: 5297487 - DNA, 17 bp, Homo sapiens
caaaatatttgtgaaag

SEQ ID NO: 5297488 - DNA, 13 bp, Homo sapiens
caaaatattttat

SEQ ID NO: 5297489 - DNA, 16 bp, Homo sapiens
caaaatattttttcct

SEQ ID NO: 5297490 - DNA, 20 bp, Homo sapiens
caaaatattttttgcaagtt

SEQ ID NO: 5297491 - DNA, 15 bp, Homo sapiens
caaaatcaacatgac

SEQ ID NO: 5297492 - DNA, 13 bp, Homo sapiens
caaaatcaagagt

SEQ ID NO: 5297493 - DNA, 19 bp, Homo sapiens
caaaatcaggaaaggctgt

SEQ ID NO: 5297494 - DNA, 15 bp, Homo sapiens
caaaatcaggtaact

SEQ ID NO: 5297495 - DNA, 19 bp, Homo sapiens
caaaatcattttatatgtc

SEQ ID NO: 5297496 - DNA, 22 bp, Homo sapiens
caaaatcattttatatgtcaaa

SEQ ID NO: 5297497 - DNA, 16 bp, Homo sapiens
caaaatccaaaaagaa

SEQ ID NO: 5297498 - DNA, 20 bp, Homo sapiens
caaaatccaaactgctgtct

SEQ ID NO: 5297499 - DNA, 13 bp, Homo sapiens
caaaatcccctca

SEQ ID NO: 5297500 - DNA, 15 bp, Homo sapiens
caaaatcccctcagc

SEQ ID NO: 5297501 - DNA, 15 bp, Homo sapiens
caaaatcctacagat

SEQ ID NO: 5297502 - DNA, 16 bp, Homo sapiens
caaaatcctcaggaaa

SEQ ID NO: 5297503 - DNA, 17 bp, Homo sapiens
caaaatcctcaggaaat

SEQ ID NO: 5297504 - DNA, 21 bp, Homo sapiens
caaaatcctggaagattttgg

SEQ ID NO: 5297505 - DNA, 20 bp, Homo sapiens
caaaatccttacttccagca

SEQ ID NO: 5297506 - DNA, 16 bp, Homo sapiens
caaaatccttgcttat

SEQ ID NO: 5297507 - DNA, 21 bp, Homo sapiens
caaaatcgatgcagtgcttcc

SEQ ID NO: 5297508 - DNA, 23 bp, Homo sapiens
caaaatcgccataggccaaggtg

SEQ ID NO: 5297509 - DNA, 20 bp, Homo sapiens
caaaatctaaaacaaaatct

SEQ ID NO: 5297510 - DNA, 17 bp, Homo sapiens
caaaatctcctggcttt

SEQ ID NO: 5297511 - DNA, 22 bp, Homo sapiens
caaaatctctccactttcagct

SEQ ID NO: 5297512 - DNA, 23 bp, Homo sapiens
caaaatctctccactttcagctg

SEQ ID NO: 5297513 - DNA, 22 bp, Homo sapiens
caaaatctgccctcagatgaaa

SEQ ID NO: 5297514 - DNA, 23 bp, Homo sapiens
caaaatctgccctcagatgaaaa

SEQ ID NO: 5297515 - DNA, 13 bp, Homo sapiens
caaaatctgtcca

SEQ ID NO: 5297516 - DNA, 21 bp, Homo sapiens
caaaatcttaaccttcaaata

SEQ ID NO: 5297517 - DNA, 24 bp, Homo sapiens
caaaatcttgttaatgtcattgct

SEQ ID NO: 5297518 - DNA, 19 bp, Homo sapiens
caaaatgaaaaaaaaaggg

SEQ ID NO: 5297519 - DNA, 11 bp, Homo sapiens
caaaatgaaac

SEQ ID NO: 5297520 - DNA, 16 bp, Homo sapiens
caaaatgaagacacca

SEQ ID NO: 5297521 - DNA, 12 bp, Homo sapiens
caaaatgaagat

SEQ ID NO: 5297522 - DNA, 12 bp, Homo sapiens
caaaatgaattg

SEQ ID NO: 5297523 - DNA, 16 bp, Homo sapiens
caaaatgaattgcctt

SEQ ID NO: 5297524 - DNA, 19 bp, Homo sapiens
caaaatgaatttttattga

SEQ ID NO: 5297525 - DNA, 15 bp, Homo sapiens
caaaatgacaatgat

SEQ ID NO: 5297526 - DNA, 23 bp, Homo sapiens
caaaatgacatctttttaaagct

SEQ ID NO: 5297527 - DNA, 12 bp, Homo sapiens
caaaatgacttt

SEQ ID NO: 5297528 - DNA, 17 bp, Homo sapiens
caaaatgagatatgcaa

SEQ ID NO: 5297529 - DNA, 22 bp, Homo sapiens
caaaatgagatatgcaataaat

SEQ ID NO: 5297530 - DNA, 20 bp, Homo sapiens
caaaatgagatctcattaaa

SEQ ID NO: 5297531 - DNA, 17 bp, Homo sapiens
caaaatgaggaatgtat

SEQ ID NO: 5297532 - DNA, 18 bp, Homo sapiens
caaaatgaggaatgtata

SEQ ID NO: 5297533 - DNA, 17 bp, Homo sapiens
caaaatgagtcaggcaa

SEQ ID NO: 5297534 - DNA, 16 bp, Homo sapiens
caattttaaagttctt

SEQ ID NO: 5297535 - DNA, 19 bp, Homo sapiens
caattttaaagttcttatt

SEQ ID NO: 5297536 - DNA, 16 bp, Homo sapiens
caattttaaataagat

SEQ ID NO: 5297537 - DNA, 17 bp, Homo sapiens
caattttaatcccctgc

SEQ ID NO: 5297538 - DNA, 19 bp, Homo sapiens
caattttaatcccctgcac

SEQ ID NO: 5297539 - DNA, 20 bp, Homo sapiens
caattttacctattctgaaa

SEQ ID NO: 5297540 - DNA, 19 bp, Homo sapiens
caattttagtcttgctgtt

SEQ ID NO: 5297541 - DNA, 12 bp, Homo sapiens
caattttatgta

SEQ ID NO: 5297542 - DNA, 20 bp, Homo sapiens
caattttatgtattctttct

SEQ ID NO: 5297543 - DNA, 19 bp, Homo sapiens
caattttattttttttctg

SEQ ID NO: 5297544 - DNA, 14 bp, Homo sapiens
caattttcatccca

SEQ ID NO: 5297545 - DNA, 15 bp, Homo sapiens
caattttcctaagtt

SEQ ID NO: 5297546 - DNA, 23 bp, Homo sapiens
caattttcctgtggaataaagat

SEQ ID NO: 5297547 - DNA, 14 bp, Homo sapiens
caattttccttgaa

SEQ ID NO: 5297548 - DNA, 15 bp, Homo sapiens
caattttccttgaag

SEQ ID NO: 5297549 - DNA, 18 bp, Homo sapiens
caattttccttgaagccg

SEQ ID NO: 5297550 - DNA, 12 bp, Homo sapiens
caattttcttgt

SEQ ID NO: 5297551 - DNA, 15 bp, Homo sapiens
caattttctttgttt

SEQ ID NO: 5297552 - DNA, 13 bp, Homo sapiens
caattttcttttt

SEQ ID NO: 5297553 - DNA, 12 bp, Homo sapiens
caattttgaaaa

SEQ ID NO: 5297554 - DNA, 14 bp, Homo sapiens
caattttggatgag

SEQ ID NO: 5297555 - DNA, 22 bp, Homo sapiens
caattttggtttttctcatttg

SEQ ID NO: 5297556 - DNA, 23 bp, Homo sapiens
caattttggtttttctcatttga

SEQ ID NO: 5297557 - DNA, 11 bp, Homo sapiens
caattttgtaa

SEQ ID NO: 5297558 - DNA, 12 bp, Homo sapiens
caattttgtaac

SEQ ID NO: 5297559 - DNA, 20 bp, Homo sapiens
caattttgtctattaaagat

SEQ ID NO: 5297560 - DNA, 14 bp, Homo sapiens
caattttgtctcta

SEQ ID NO: 5297561 - DNA, 16 bp, Homo sapiens
caattttgtttctgta

SEQ ID NO: 5297562 - DNA, 14 bp, Homo sapiens
caatttttaaacta

SEQ ID NO: 5297563 - DNA, 17 bp, Homo sapiens
caatttttaaactagta

SEQ ID NO: 5297564 - DNA, 14 bp, Homo sapiens
caatttttaactta

SEQ ID NO: 5297565 - DNA, 19 bp, Homo sapiens
caatttttaacttatctcc

SEQ ID NO: 5297566 - DNA, 14 bp, Homo sapiens
caatttttaataaa

SEQ ID NO: 5297567 - DNA, 17 bp, Homo sapiens
caatttttaccacttct

SEQ ID NO: 5297568 - DNA, 22 bp, Homo sapiens
caatttttaccacttctgttta

SEQ ID NO: 5297569 - DNA, 22 bp, Homo sapiens
caatttttatacatatcagaaa

SEQ ID NO: 5297570 - DNA, 23 bp, Homo sapiens
caatttttatacatatcagaaaa

SEQ ID NO: 5297571 - DNA, 14 bp, Homo sapiens
caatttttcccagt

SEQ ID NO: 5297572 - DNA, 15 bp, Homo sapiens
caatttttcccagta

SEQ ID NO: 5297573 - DNA, 14 bp, Homo sapiens
caatttttctgcac

SEQ ID NO: 5297574 - DNA, 22 bp, Homo sapiens
caatttttcttatttcatttct

SEQ ID NO: 5297575 - DNA, 16 bp, Homo sapiens
caatttttgccttcat

SEQ ID NO: 5297576 - DNA, 19 bp, Homo sapiens
caatttttgtctcagaagt

SEQ ID NO: 5297577 - DNA, 14 bp, Homo sapiens
caatttttgttttc

SEQ ID NO: 5297578 - DNA, 15 bp, Homo sapiens
caattttttaaacca

SEQ ID NO: 5297579 - DNA, 14 bp, Homo sapiens
caattttttcaaat

SEQ ID NO: 5297580 - DNA, 17 bp, Homo sapiens
caattttttgttcttca

SEQ ID NO: 5297581 - DNA, 17 bp, Homo sapiens
caatttttttaattttg

SEQ ID NO: 5297582 - DNA, 21 bp, Homo sapiens
caatttttttaattttgtatt

SEQ ID NO: 5297583 - DNA, 22 bp, Homo sapiens
caatttttttaattttgtattt

SEQ ID NO: 5297584 - DNA, 17 bp, Homo sapiens
caattttttttattagt

SEQ ID NO: 5297585 - DNA, 20 bp, Homo sapiens
caattttttttattagtatt

SEQ ID NO: 5297586 - DNA, 23 bp, Homo sapiens
caattttttttattagtattgtt

SEQ ID NO: 5297587 - DNA, 20 bp, Homo sapiens
cacaaaaaaatgttcattgt

SEQ ID NO: 5297588 - DNA, 23 bp, Homo sapiens
cacaaaaaatgaggaatagcaaa

SEQ ID NO: 5297589 - DNA, 13 bp, Homo sapiens
cacaaaaaattta

SEQ ID NO: 5297590 - DNA, 14 bp, Homo sapiens
cacaaaaacaaaaa

SEQ ID NO: 5297591 - DNA, 23 bp, Homo sapiens
cacaaaaagagaagctgtgtctt

SEQ ID NO: 5297592 - DNA, 14 bp, Homo sapiens
cacaaaaaggagcg

SEQ ID NO: 5297593 - DNA, 21 bp, Homo sapiens
cacaaaaaggagcgggcaggg

SEQ ID NO: 5297594 - DNA, 17 bp, Homo sapiens
cacaaaaatagagaaaa
